United States Patent 10,706,955 (BIOINFORMATIC PROCESSES FOR DETERMINATION OF PEPTIDE BINDING) - sequence listing, part 38

SEQ ID NO: 1471434 - protein, 21 aa, Mycobacterium tuberculosis
DAWEDFLFWLAADRKTARRIT

SEQ ID NO: 1471435 - protein, 17 aa, Mycobacterium tuberculosis
DAWLGRIACGDRDLASL

SEQ ID NO: 1471436 - protein, 19 aa, Mycobacterium tuberculosis
DAYYEHGVQVWDCAAGALI

SEQ ID NO: 1471437 - protein, 17 aa, Mycobacterium tuberculosis
DDARPVLERASARETAA

SEQ ID NO: 1471438 - protein, 24 aa, Mycobacterium tuberculosis
DDGFVRVIYRWSRTGDLAAALAAA

SEQ ID NO: 1471439 - protein, 17 aa, Mycobacterium tuberculosis
DDIADWVEGARCAGMRA

SEQ ID NO: 1471440 - protein, 19 aa, Mycobacterium tuberculosis
DDTLPMLTGIRVEILGETV

SEQ ID NO: 1471441 - protein, 19 aa, Mycobacterium tuberculosis
DEGFARPGARRSREDFEIC

SEQ ID NO: 1471442 - protein, 21 aa, Mycobacterium tuberculosis
DEIRWDIRPSPHLGTLEVRIC

SEQ ID NO: 1471443 - protein, 17 aa, Mycobacterium tuberculosis
DELAAGPASRVAILLPA

SEQ ID NO: 1471444 - protein, 26 aa, Mycobacterium tuberculosis
DEPLVRRLWVLKVWGDVVDDRRGTRP

SEQ ID NO: 1471445 - protein, 27 aa, Mycobacterium tuberculosis
DEQRRWAAEGVQRGWQATMVLTEPDAG

SEQ ID NO: 1471446 - protein, 22 aa, Mycobacterium tuberculosis
DEVSAAIAALFSAHGQAYQAAS

SEQ ID NO: 1471447 - protein, 23 aa, Mycobacterium tuberculosis
DEVSAAIASLFAAHGQAYQAVSA

SEQ ID NO: 1471448 - protein, 22 aa, Mycobacterium tuberculosis
DEVSTAIAALFGSHGQHYQAIS

SEQ ID NO: 1471449 - protein, 21 aa, Mycobacterium tuberculosis
DEVYGIMLMHGWAVQHVECER

SEQ ID NO: 1471450 - protein, 19 aa, Mycobacterium tuberculosis
DFGGEVERGLSMVDGVLLL

SEQ ID NO: 1471451 - protein, 20 aa, Mycobacterium tuberculosis
DFLGPINWMRPLRAIAARHE

SEQ ID NO: 1471452 - protein, 17 aa, Mycobacterium tuberculosis
DGDYRFGQQIVVSHDGG

SEQ ID NO: 1471453 - protein, 24 aa, Mycobacterium tuberculosis
DGEPFVLHPGEFVLGSTLELFTLP

SEQ ID NO: 1471454 - protein, 19 aa, Mycobacterium tuberculosis
DGGFQLGRLAAILRDKRIP

SEQ ID NO: 1471455 - protein, 20 aa, Mycobacterium tuberculosis
DGGLPAWRSAGGSIETGQVS

SEQ ID NO: 1471456 - protein, 26 aa, Mycobacterium tuberculosis
DGGPSQGGGNPGFGGDGGTGGPGGVG

SEQ ID NO: 1471457 - protein, 18 aa, Mycobacterium tuberculosis
DGHYRIGLRPSGNGPTAI

SEQ ID NO: 1471458 - protein, 20 aa, Mycobacterium tuberculosis
DGIDPLRDVVMLGATNRPDL

SEQ ID NO: 1471459 - protein, 24 aa, Mycobacterium tuberculosis
DGLACVVLRVARFFVEGDDMPDLY

SEQ ID NO: 1471460 - protein, 22 aa, Mycobacterium tuberculosis
DGMAGWYFTKWQRVLNDGLDAV

SEQ ID NO: 1471461 - protein, 18 aa, Mycobacterium tuberculosis
DGMTYVGLVPFRMSSTKL

SEQ ID NO: 1471462 - protein, 18 aa, Mycobacterium tuberculosis
DGPPGVKGDGGNGGNGGN

SEQ ID NO: 1471463 - protein, 17 aa, Mycobacterium tuberculosis
DGSDFVFMDSQDYEQHP

SEQ ID NO: 1471464 - protein, 30 aa, Mycobacterium tuberculosis
DGVVWWQVVLQLPLLPGWPSSPSSPSAPPP

SEQ ID NO: 1471465 - protein, 20 aa, Mycobacterium tuberculosis
DIARGSLRLWSLAGGMPLHR

SEQ ID NO: 1471466 - protein, 24 aa, Mycobacterium tuberculosis
DIDHSAPWPLGPTHPSNLKCACRK

SEQ ID NO: 1471467 - protein, 21 aa, Mycobacterium tuberculosis
DIGGGFGNKVPIYPGYVCAIV

SEQ ID NO: 1471468 - protein, 18 aa, Mycobacterium tuberculosis
DIGRGRNGVLYAGEVNWD

SEQ ID NO: 1471469 - protein, 24 aa, Mycobacterium tuberculosis
DLIDPALLRPGRLERLVFVEPPDA

SEQ ID NO: 1471470 - protein, 18 aa, Mycobacterium tuberculosis
DLLVVRRGEKVVVEVSVV

SEQ ID NO: 1471471 - protein, 20 aa, Mycobacterium tuberculosis
DLMTAAATNLAEIGSAISTA

SEQ ID NO: 1471472 - protein, 18 aa, Mycobacterium tuberculosis
DLYWAARGAGPGFFGVVT

SEQ ID NO: 1471473 - protein, 17 aa, Mycobacterium tuberculosis
DMRSGRMSDDDWTRLAR

SEQ ID NO: 1471474 - protein, 24 aa, Mycobacterium tuberculosis
DMTKGYCPGGRWGFGDLAVCDGEK

SEQ ID NO: 1471475 - protein, 24 aa, Mycobacterium tuberculosis
DMTRRLAREEAMLVGGSCGMAVVA

SEQ ID NO: 1471476 - protein, 17 aa, Mycobacterium tuberculosis
DNLERVWAPKATGALRM

SEQ ID NO: 1471477 - protein, 27 aa, Mycobacterium tuberculosis
DPKTAVLNWKGDQVIVFVELSGSGARY

SEQ ID NO: 1471478 - protein, 18 aa, Mycobacterium tuberculosis
DPQRAGLVRSHFGARRKA

SEQ ID NO: 1471479 - protein, 24 aa, Mycobacterium tuberculosis
DPRMKANVGIRRRLAPLLDNDRNQ

SEQ ID NO: 1471480 - protein, 17 aa, Mycobacterium tuberculosis
DPSRLHPLATMERTFIA

SEQ ID NO: 1471481 - protein, 17 aa, Mycobacterium tuberculosis
DPSRRTSCLSGLGYPAS

SEQ ID NO: 1471482 - protein, 25 aa, Mycobacterium tuberculosis
DPVMCFSGPMIFGAGVLGGAQADLL

SEQ ID NO: 1471483 - protein, 21 aa, Mycobacterium tuberculosis
DPWLPSLGNPLTFLSPANIAF

SEQ ID NO: 1471484 - protein, 17 aa, Mycobacterium tuberculosis
DQHVWCFLGDGEMDEPE

SEQ ID NO: 1471485 - protein, 17 aa, Mycobacterium tuberculosis
DRFWLAVGRTRSNAYLL

SEQ ID NO: 1471486 - protein, 26 aa, Mycobacterium tuberculosis
DRGFYAGAVGWCDGRGDGHWVVSIRC

SEQ ID NO: 1471487 - protein, 26 aa, Mycobacterium tuberculosis
DRICIPVPFYHCFGMVMGNLAATSHG

SEQ ID NO: 1471488 - protein, 22 aa, Mycobacterium tuberculosis
DRIRYHGGEFIDLIVGGSTYDL

SEQ ID NO: 1471489 - protein, 28 aa, Mycobacterium tuberculosis
DRLARRAWQRFQAIEARGGFVEAHDFLA

SEQ ID NO: 1471490 - protein, 19 aa, Mycobacterium tuberculosis
DRNGALRMVRGVKNRFGAA

SEQ ID NO: 1471491 - protein, 23 aa, Mycobacterium tuberculosis
DRPAFKTCVAHGIVLGFDGQKMS

SEQ ID NO: 1471492 - protein, 34 aa, Mycobacterium tuberculosis
DRSAERCGSPAWDLPTVFGPIAITYNIKGVSTLN

SEQ ID NO: 1471493 - protein, 21 aa, Mycobacterium tuberculosis
DRVAAAAAFHPGGLVANSPDS

SEQ ID NO: 1471494 - protein, 17 aa, Mycobacterium tuberculosis
DSAGDLGDWGGPDALAD

SEQ ID NO: 1471495 - protein, 17 aa, Mycobacterium tuberculosis
DSFEWLIGSPRWRESAA

SEQ ID NO: 1471496 - protein, 19 aa, Mycobacterium tuberculosis
DSITLFPGGLAFPENPVVS

SEQ ID NO: 1471497 - protein, 28 aa, Mycobacterium tuberculosis
DSLLPLPNIPLLEYAARFITPVHPGYTA

SEQ ID NO: 1471498 - protein, 21 aa, Mycobacterium tuberculosis
DSLRIFPATHYVAGPERMAHA

SEQ ID NO: 1471499 - protein, 17 aa, Mycobacterium tuberculosis
DSVAWLAQRGILVAPGD

SEQ ID NO: 1471500 - protein, 25 aa, Mycobacterium tuberculosis
DSVPDEVWPAVVFTLVTLLDDPVAA

SEQ ID NO: 1471501 - protein, 26 aa, Mycobacterium tuberculosis
DTAYFGNAFPPNYLVNSHTSAEQVGE

SEQ ID NO: 1471502 - protein, 17 aa, Mycobacterium tuberculosis
DTLADAKALAGAHPDGI

SEQ ID NO: 1471503 - protein, 20 aa, Mycobacterium tuberculosis
DTPLPRVSIFLSILDAHVQR

SEQ ID NO: 1471504 - protein, 25 aa, Mycobacterium tuberculosis
DTSASVTCGIGFADLSSFTALTQAL

SEQ ID NO: 1471505 - protein, 17 aa, Mycobacterium tuberculosis
DTVVFPALRDVMSAVEF

SEQ ID NO: 1471506 - protein, 23 aa, Mycobacterium tuberculosis
DTWLRERPREMARTVFIELLAWQ

SEQ ID NO: 1471507 - protein, 20 aa, Mycobacterium tuberculosis
DTYGFPIELTLEMAAETGLQ

SEQ ID NO: 1471508 - protein, 18 aa, Mycobacterium tuberculosis
DVALLRLSFGRFGDEPAL

SEQ ID NO: 1471509 - protein, 24 aa, Mycobacterium tuberculosis
DVRANRLPKVSWLVPNILQSEHPA

SEQ ID NO: 1471510 - protein, 22 aa, Mycobacterium tuberculosis
DVSAAIAALFATHGQAYQELSA

SEQ ID NO: 1471511 - protein, 24 aa, Mycobacterium tuberculosis
DVVHYGNGVSIVYADVPTTVDFGG

SEQ ID NO: 1471512 - protein, 18 aa, Mycobacterium tuberculosis
DVVNKVWFLDAVRGQVDV

SEQ ID NO: 1471513 - protein, 22 aa, Mycobacterium tuberculosis
EAANAGPNMLAAVNAPAQALLG

SEQ ID NO: 1471514 - protein, 20 aa, Mycobacterium tuberculosis
EAGLHLVGVFTFPGHSYAPG

SEQ ID NO: 1471515 - protein, 17 aa, Mycobacterium tuberculosis
EAGSPVWHQLTTRDYRS

SEQ ID NO: 1471516 - protein, 26 aa, Mycobacterium tuberculosis
EANIAPWLRAAHRYGAKVKWAEVDIE

SEQ ID NO: 1471517 - protein, 20 aa, Mycobacterium tuberculosis
EAPPVPVAYSVNWDAIAQCE

SEQ ID NO: 1471518 - protein, 18 aa, Mycobacterium tuberculosis
EATFFNFEFPRNGFQLRR

SEQ ID NO: 1471519 - protein, 22 aa, Mycobacterium tuberculosis
EATSAAPLQDLLGVVNAPAQAL

SEQ ID NO: 1471520 - protein, 19 aa, Mycobacterium tuberculosis
EAVMNRFSPQQAQLTLIDP

SEQ ID NO: 1471521 - protein, 17 aa, Mycobacterium tuberculosis
EAVNLALRTLLGEADTA

SEQ ID NO: 1471522 - protein, 19 aa, Mycobacterium tuberculosis
ECRSMFDAAVKSYQSGDLA

SEQ ID NO: 1471523 - protein, 18 aa, Mycobacterium tuberculosis
EDHLDWHATMAEYTAAKA

SEQ ID NO: 1471524 - protein, 18 aa, Mycobacterium tuberculosis
EDPDTVLLGTDFGGDSLT

SEQ ID NO: 1471525 - protein, 22 aa, Mycobacterium tuberculosis
EDRYLEVWNLVFMQNERGEGTT

SEQ ID NO: 1471526 - protein, 21 aa, Mycobacterium tuberculosis
EDVPGFCKSATLAEIKATDYA

SEQ ID NO: 1471527 - protein, 22 aa, Mycobacterium tuberculosis
EEADRLAARLARIDDIEGDRDR

SEQ ID NO: 1471528 - protein, 18 aa, Mycobacterium tuberculosis
EEGLEGAGLSELGAAEAA

SEQ ID NO: 1471529 - protein, 21 aa, Mycobacterium tuberculosis
EELLRGADMVFVTAGEGGGTG

SEQ ID NO: 1471530 - protein, 23 aa, Mycobacterium tuberculosis
EESRGRLSAVVQRELADEAYHGG

SEQ ID NO: 1471531 - protein, 17 aa, Mycobacterium tuberculosis
EFFATIRAAGYTRVSLG

SEQ ID NO: 1471532 - protein, 26 aa, Mycobacterium tuberculosis
EFISWEPFTRMAFRFNECSTRAVGAF

SEQ ID NO: 1471533 - protein, 38 aa, Mycobacterium tuberculosis; identical to SEQ ID NO: 233359

SEQ ID NO: 1471534 - protein, 18 aa, Mycobacterium tuberculosis
EFSRACESLYHFAWDEFC

SEQ ID NO: 1471535 - protein, 19 aa, Mycobacterium tuberculosis
EFVAPVVAYLCTEECADNA

SEQ ID NO: 1471536 - protein, 25 aa, Mycobacterium tuberculosis
EGPLPQTRFVLRKALAAHLPVILVV

SEQ ID NO: 1471537 - protein, 18 aa, Mycobacterium tuberculosis
EGRLRRFDCSQMTDGGAG

SEQ ID NO: 1471538 - protein, 17 aa, Mycobacterium tuberculosis
EGVLASAARLVLGQLGL

SEQ ID NO: 1471539 - protein, 20 aa, Mycobacterium tuberculosis
EHDPRLAAAERSELDALITC

SEQ ID NO: 1471540 - protein, 22 aa, Mycobacterium tuberculosis
EHKERRLAEIAASGVTRIGGVI

SEQ ID NO: 1471541 - protein, 23 aa, Mycobacterium tuberculosis
EHPFPVWTERGGPATIVPMFLLY

SEQ ID NO: 1471542 - protein, 22 aa, Mycobacterium tuberculosis
EIEPRSGRHLGNFPQAFTHLAL

SEQ ID NO: 1471543 - protein, 17 aa, Mycobacterium tuberculosis
EIRAHALAIGDDLVGRG

SEQ ID NO: 1471544 - protein, 24 aa, Mycobacterium tuberculosis
ELAELRLALMHGRLSADDKDAAMA

SEQ ID NO: 1471545 - protein, 17 aa, Mycobacterium tuberculosis
ELIARIRAVLRRGGDDD

SEQ ID NO: 1471546 - protein, 18 aa, Mycobacterium tuberculosis
ELLQRPGQRLAYNGRLLE

SEQ ID NO: 1471547 - protein, 22 aa, Mycobacterium tuberculosis
ELPGEPPRLFVVTRSAASVLPS

SEQ ID NO: 1471548 - protein, 21 aa, Mycobacterium tuberculosis
ELTPYRGAWCGNDVWRGALPP

SEQ ID NO: 1471549 - protein, 17 aa, Mycobacterium tuberculosis
ENIREVHRADLIGQHIG

SEQ ID NO: 1471550 - protein, 17 aa, Mycobacterium tuberculosis
EPGHGLALAALGLDPIV

SEQ ID NO: 1471551 - protein, 24 aa, Mycobacterium tuberculosis
EPHYGPPPLLLRMVEAGQLGKKSG

SEQ ID NO: 1471552 - protein, 19 aa, Mycobacterium tuberculosis
EPPTRPAPQHSRRARRGHR

SEQ ID NO: 1471553 - protein, 19 aa, Mycobacterium tuberculosis
EPRFIKLTGELASEQTLSF

SEQ ID NO: 1471554 - protein, 20 aa, Mycobacterium tuberculosis
EQALRFGADLRMEDVESVSL

SEQ ID NO: 1471555 - protein, 19 aa, Mycobacterium tuberculosis
EQANINWGKAGRMRWKGKR

SEQ ID NO: 1471556 - protein, 19 aa, Mycobacterium tuberculosis
EQQRLRRILDTVARQEPGL

SEQ ID NO: 1471557 - protein, 24 aa, Mycobacterium tuberculosis
EQQWLPRIAAHLGVASPVPVGLGS

SEQ ID NO: 1471558 - protein, 17 aa, Mycobacterium tuberculosis
EQWLKTTGLNTLRPDFE

SEQ ID NO: 1471559 - protein, 23 aa, Mycobacterium tuberculosis
ERALAQRPAWLAAAEALTTEGAD

SEQ ID NO: 1471560 - protein, 17 aa, Mycobacterium tuberculosis
ERARQAGAVGLVVTTDW

SEQ ID NO: 1471561 - protein, 18 aa, Mycobacterium tuberculosis
ERFRRGRDRIPLTGRIAV

SEQ ID NO: 1471562 - protein, 19 aa, Mycobacterium tuberculosis
ERPEPKRAGVLVVSSDRGL

SEQ ID NO: 1471563 - protein, 17 aa, Mycobacterium tuberculosis
ERVGKRGLGFGAEVRSK

SEQ ID NO: 1471564 - protein, 17 aa, Mycobacterium tuberculosis
ESEINGLITSWRGPSST

SEQ ID NO: 1471565 - protein, 20 aa, Mycobacterium tuberculosis
ESELRAAVNAARAAGDTWAA

SEQ ID NO: 1471566 - protein, 18 aa, Mycobacterium tuberculosis
ESLASRWLADRIAADSTV

SEQ ID NO: 1471567 - protein, 19 aa, Mycobacterium tuberculosis
ESLTEVWRTDGYCHCMFTA

SEQ ID NO: 1471568 - protein, 19 aa, Mycobacterium tuberculosis
ESPDAYDLELMWDANDDNQ

SEQ ID NO: 1471569 - protein, 19 aa, Mycobacterium tuberculosis
ETAELLYGTALLAEGGALE

SEQ ID NO: 1471570 - protein, 17 aa, Mycobacterium tuberculosis
ETLAFFAGIGIPIAEIW

SEQ ID NO: 1471571 - protein, 24 aa, Mycobacterium tuberculosis
ETLIQCGWFQIRISASDVVAASTR

SEQ ID NO: 1471572 - protein, 18 aa, Mycobacterium tuberculosis
ETTPGGGVTIVIPGHENV

SEQ ID NO: 1471573 - protein, 32 aa, Mycobacterium tuberculosis; identical to SEQ ID NO: 198861

SEQ ID NO: 1471574 - protein, 21 aa, Mycobacterium tuberculosis
EVEPRMLLVHFLRDQLRLTGT

SEQ ID NO: 1471575 - protein, 17 aa, Mycobacterium tuberculosis
EVGGRVTSPPQPPVAAL

SEQ ID NO: 1471576 - protein, 17 aa, Mycobacterium tuberculosis
EVRAVPAAAQASVLVLP

SEQ ID NO: 1471577 - protein, 19 aa, Mycobacterium tuberculosis
EVRHVPPGDMPGGTAAADA

SEQ ID NO: 1471578 - protein, 23 aa, Mycobacterium tuberculosis
EVRRARKSIAQFKLREGMPVGVR

SEQ ID NO: 1471579 - protein, 27 aa, Mycobacterium tuberculosis
EVSAAVSRLFGAYGQQFQALNARAATF

SEQ ID NO: 1471580 - protein, 27 aa, Mycobacterium tuberculosis
EVVQRPAGRARSRWFSDYLRTVTQRDV

SEQ ID NO: 1471581 - protein, 17 aa, Mycobacterium tuberculosis
EVVSYPATIGVLSGSLG

SEQ ID NO: 1471582 - protein, 21 aa, Mycobacterium tuberculosis
EVYELRGSELIRIEAPTDASV

SEQ ID NO: 1471583 - protein, 17 aa, Mycobacterium tuberculosis
FAAVALASIRELGLNPQ

SEQ ID NO: 1471584 - protein, 18 aa, Mycobacterium tuberculosis
FADRALVMYAGRVVESAG

SEQ ID NO: 1471585 - protein, 27 aa, Mycobacterium tuberculosis
FAGFGGSAGGGGWVGAVNFGPISVQGF

SEQ ID NO: 1471586 - protein, 24 aa, Mycobacterium tuberculosis
FAKLREPLEVPGLLDVQTDSFEWL

SEQ ID NO: 1471587 - protein, 20 aa, Mycobacterium tuberculosis
FAPRELVELAVAAEAHGMDS

SEQ ID NO: 1471588 - protein, 17 aa, Mycobacterium tuberculosis
FASEVAMEIALNAVRIH

SEQ ID NO: 1471589 - protein, 20 aa, Mycobacterium tuberculosis
FDASAAVAQLAPWQQVLRNL

SEQ ID NO: 1471590 - protein, 17 aa, Mycobacterium tuberculosis
FDAWRFENRCELLAFRH

SEQ ID NO: 1471591 - protein, 20 aa, Mycobacterium tuberculosis
FDGDGMIHVVGFRDGKAFYR

SEQ ID NO: 1471592 - protein, 18 aa, Mycobacterium tuberculosis
FDLDDTWIGGSSAFMTDA

SEQ ID NO: 1471593 - protein, 18 aa, Mycobacterium tuberculosis
FDTELGPVVANFLLADEI

SEQ ID NO: 1471594 - protein, 17 aa, Mycobacterium tuberculosis
FDTRRGMVVGSPVDLVD

SEQ ID NO: 1471595 - protein, 19 aa, Mycobacterium tuberculosis
FEALSALSAGVKEVRAVIE

SEQ ID NO: 1471596 - protein, 26 aa, Mycobacterium tuberculosis
FEDLVIRLLEAMGYGRAGAVERTSAS

SEQ ID NO: 1471597 - protein, 25 aa, Mycobacterium tuberculosis
FEVEGGIIRVAEGWAHGPQVDKGVK

SEQ ID NO: 1471598 - protein, 22 aa, Mycobacterium tuberculosis
FEWLIGSPRWRESAAERGDVNP

SEQ ID NO: 1471599 - protein, 18 aa, Mycobacterium tuberculosis
FFRISPREATAMDPQQRV

SEQ ID NO: 1471600 - protein, 26 aa, Mycobacterium tuberculosis
FGAGGIGGAGGPGFNGGAGGAGGRSG

SEQ ID NO: 1471601 - protein, 19 aa, Mycobacterium tuberculosis
FGGSGARLMTTVLHHMPDK

SEQ ID NO: 1471602 - protein, 23 aa, Mycobacterium tuberculosis
FGLEIPGNIYTRIGNPTTDVVEQ

SEQ ID NO: 1471603 - protein, 27 aa, Mycobacterium tuberculosis
FGNKGTGLFSGFMSGFGNTGFLQSGFG

SEQ ID NO: 1471604 - protein, 24 aa, Mycobacterium tuberculosis
FGRRVAVVACEFDFLGGSIGVAAA

SEQ ID NO: 1471605 - protein, 17 aa, Mycobacterium tuberculosis
FGSVRVVEPAEWTRSNR

SEQ ID NO: 1471606 - protein, 19 aa, Mycobacterium tuberculosis
FHGFRQGRNPFWDRLSRAM

SEQ ID NO: 1471607 - protein, 28 aa, Mycobacterium tuberculosis
FINLELIDSPTLPTCERIAVLSQSGVNL

SEQ ID NO: 1471608 - protein, 20 aa, Mycobacterium tuberculosis
FITGRIKELLVVDGANHYPE

SEQ ID NO: 1471609 - protein, 20 aa, Mycobacterium tuberculosis
FKTHGCQPWQNTGSEGAAPA

SEQ ID NO: 1471610 - protein, 23 aa, Mycobacterium tuberculosis
FLARLCKTAIWIDHGVIRLAGGI

SEQ ID NO: 1471611 - protein, 18 aa, Mycobacterium tuberculosis
FLCACGPAYLPERDQRMG

SEQ ID NO: 1471612 - protein, 18 aa, Mycobacterium tuberculosis
FLDRGLRDTGRCRVPLIL

SEQ ID NO: 1471613 - protein, 26 aa, Mycobacterium tuberculosis
FLTACQRRYGSVFTLHVAGFGHMVYL

SEQ ID NO: 1471614 - protein, 20 aa, Mycobacterium tuberculosis
FNGAGARVPGMIRLVRHSIA

SEQ ID NO: 1471615 - protein, 17 aa, Mycobacterium tuberculosis
FNRPLRPLAPVAHLDFD

SEQ ID NO: 1471616 - protein, 17 aa, Mycobacterium tuberculosis
FPARAFDALDALVASAA

SEQ ID NO: 1471617 - protein, 19 aa, Mycobacterium tuberculosis
FPDRPALELDGWAYARPLA

SEQ ID NO: 1471618 - protein, 21 aa, Mycobacterium tuberculosis
FPGGLTIPAMNPLSINLSGGT

SEQ ID NO: 1471619 - protein, 20 aa, Mycobacterium tuberculosis
FPILKRIMRGGNPLAYLDSG

SEQ ID NO: 1471620 - protein, 19 aa, Mycobacterium tuberculosis
FRPEFFAAMRELCDEFDAL

SEQ ID NO: 1471621 - protein, 20 aa, Mycobacterium tuberculosis
FRPVALESLSHFPVTVAAHR

SEQ ID NO: 1471622 - protein, 17 aa, Mycobacterium tuberculosis
FRQSACPLFNPNSAIAL

SEQ ID NO: 1471623 - protein, 17 aa, Mycobacterium tuberculosis
FSPGKGLGVIPREGYFQ

SEQ ID NO: 1471624 - protein, 25 aa, Mycobacterium tuberculosis
FSTLLGVPMESMIGLLAVAALDDLD

SEQ ID NO: 1471625 - protein, 19 aa, Mycobacterium tuberculosis
FSTLLSNAGTIFWNGPMGV

SEQ ID NO: 1471626 - protein, 23 aa, Mycobacterium tuberculosis
FTGAFGPVVVPPIPVPAINAHLT

SEQ ID NO: 1471627 - protein, 19 aa, Mycobacterium tuberculosis
FTLYHLPVALQLPPGATGV

SEQ ID NO: 1471628 - protein, 17 aa, Mycobacterium tuberculosis
FTRRSHAWLEQQTGCRK

SEQ ID NO: 1471629 - protein, 23 aa, Mycobacterium tuberculosis
FTSEVRGVFTYRVNKAGLITNMR

SEQ ID NO: 1471630 - protein, 23 aa, Mycobacterium tuberculosis
FVAEAIAVLGARVAGSSLAGFAT

SEQ ID NO: 1471631 - protein, 18 aa, Mycobacterium tuberculosis
FYFLTGRGALLQLGLLQL

SEQ ID NO: 1471632 - protein, 22 aa, Mycobacterium tuberculosis
FYLQYFGCRPYFAERVGGFTMR

SEQ ID NO: 1471633 - protein, 19 aa, Mycobacterium tuberculosis
GACDSTLLIAERVQSYADV

SEQ ID NO: 1471634 - protein, 25 aa, Mycobacterium tuberculosis
GADEISAAIAALFGAHGRAYQAASA

SEQ ID NO: 1471635 - protein, 25 aa, Mycobacterium tuberculosis
GADEVSAAIAALFSGHAQAYQALSA

SEQ ID NO: 1471636 - protein, 26 aa, Mycobacterium tuberculosis
GADEVSVAISALFGSHAQGYQTLSAQ

SEQ ID NO: 1471637 - protein, 24 aa, Mycobacterium tuberculosis
GAGCGGSARFGLGGDRKRGGAGCG

SEQ ID NO: 1471638 - protein, 21 aa, Mycobacterium tuberculosis
GAGGDGFGFVGAGGNGGNAGT

SEQ ID NO: 1471639 - protein, 21 aa, Mycobacterium tuberculosis
GAGGPAGLIGVGGAGGAGGDS

SEQ ID NO: 1471640 - protein, 23 aa, Mycobacterium tuberculosis
GAGGRAGGGVGGIGGAGGAGGNG

SEQ ID NO: 1471641 - protein, 17 aa, Mycobacterium tuberculosis
GAGGSARGLIFALGGAG

SEQ ID NO: 1471642 - protein, 20 aa, Mycobacterium tuberculosis
GAGGSGRTDLGGAGGAGGKA

SEQ ID NO: 1471643 - protein, 26 aa, Mycobacterium tuberculosis
GAGISRPTFYFYFPSKEAVLLTLLDR

SEQ ID NO: 1471644 - protein, 17 aa, Mycobacterium tuberculosis
GAIAFSSVLSYPVVAEQ

SEQ ID NO: 1471645 - protein, 30 aa, Mycobacterium tuberculosis; identical to SEQ ID NO: 199503

SEQ ID NO: 1471646 - protein, 17 aa, Mycobacterium tuberculosis
GALAGAMRPPAPPAAPP

SEQ ID NO: 1471647 - protein, 18 aa, Mycobacterium tuberculosis
GALKPARLLVSGSAALPV

SEQ ID NO: 1471648 - protein, 18 aa, Mycobacterium tuberculosis
GANGISAFMVHKDDEGFT

SEQ ID NO: 1471649 - protein, 19 aa, Mycobacterium tuberculosis
GARGYAHIGVIQALRERGY

SEQ ID NO: 1471650 - protein, 18 aa, Mycobacterium tuberculosis
GCDHEIRSGTAHVVVWPT

SEQ ID NO: 1471651 - protein, 21 aa, Mycobacterium tuberculosis
GCGDGAFRLGTMPIEVESSVA

SEQ ID NO: 1471652 - protein, 24 aa, Mycobacterium tuberculosis
GCGIKASMGMGAIRVQPLAPREKC

SEQ ID NO: 1471653 - protein, 17 aa, Mycobacterium tuberculosis
GCRVHPLGEMRYLPVAS

SEQ ID NO: 1471654 - protein, 17 aa, Mycobacterium tuberculosis
GCYVGASALEYGPALTE

SEQ ID NO: 1471655 - protein, 19 aa, Mycobacterium tuberculosis
GDDDRLHGMLTDRDIVIKG

SEQ ID NO: 1471656 - protein, 23 aa, Mycobacterium tuberculosis
GDEVSAAIAALFSSHGQQYQAMS

SEQ ID NO: 1471657 - protein, 19 aa, Mycobacterium tuberculosis
GDGQIGIGGLNSGSGNIGF

SEQ ID NO: 1471658 - protein, 21 aa, Mycobacterium tuberculosis
GDGWVHFDAPAGMLIPDSVAT

SEQ ID NO: 1471659 - protein, 24 aa, Mycobacterium tuberculosis
GDHRMLPRATFCQPNVASFGLTEQ

SEQ ID NO: 1471660 - protein, 19 aa, Mycobacterium tuberculosis
GDLRSLFAFLADRGSSLDA

SEQ ID NO: 1471661 - protein, 22 aa, Mycobacterium tuberculosis
GDSRRANLWAADRYNRAIARGH

SEQ ID NO: 1471662 - protein, 23 aa, Mycobacterium tuberculosis
GDSSSWKGWGHVRWFIEEVPAGA

SEQ ID NO: 1471663 - protein, 17 aa, Mycobacterium tuberculosis
GEFIDLIVGGSTYDLAA

SEQ ID NO: 1471664 - protein, 18 aa, Mycobacterium tuberculosis
GEHPMFKAMAAGLSSLAG

SEQ ID NO: 1471665 - protein, 22 aa, Mycobacterium tuberculosis
GEIEWAKASLIGPEEYVTAVAA

SEQ ID NO: 1471666 - protein, 17 aa, Mycobacterium tuberculosis
GELARIGVAADIGAAPA

SEQ ID NO: 1471667 - protein, 27 aa, Mycobacterium tuberculosis
GELFIMGRIKDLLIVDGRNHYPDDIEA

SEQ ID NO: 1471668 - protein, 18 aa, Mycobacterium tuberculosis
GELREIFSAVQIIADTER

SEQ ID NO: 1471669 - protein, 43 aa, Mycobacterium tuberculosis
GEPGKPVRLPIPWRDVGGYRPTGRSIAACRRGEPRGLHEFAAA

SEQ ID NO: 1471670 - protein, 20 aa, Mycobacterium tuberculosis
GEPHAISAMHGRGVADLLDG

SEQ ID NO: 1471671 - protein, 17 aa, Mycobacterium tuberculosis
GERLDAKALVAFTQSGD

SEQ ID NO: 1471672 - protein, 19 aa, Mycobacterium tuberculosis
GFDRLRLIQRITDRLPAKA

SEQ ID NO: 1471673 - protein, 24 aa, Mycobacterium tuberculosis
GFDSADLSLPWGQDALIAAVASAN

SEQ ID NO: 1471674 - protein, 20 aa, Mycobacterium tuberculosis
GFERSKYASGEFFDKYTDQI

SEQ ID NO: 1471675 - protein, 18 aa, Mycobacterium tuberculosis
GGAAGFAGGVGGAGGEGL

SEQ ID NO: 1471676 - protein, 17 aa, Mycobacterium tuberculosis
GGADLAAIAGFCAQAAV

SEQ ID NO: 1471677 - protein, 34 aa, Mycobacterium tuberculosis; identical to SEQ ID NO: 199788

SEQ ID NO: 1471678 - protein, 22 aa, Mycobacterium tuberculosis
GGAGGNALMFGIGGNGGAGGAA

SEQ ID NO: 1471679 - protein, 21 aa, Mycobacterium tuberculosis
GGAGSIGFNASAPGAAGSPGG

SEQ ID NO: 1471680 - protein, 22 aa, Mycobacterium tuberculosis
GGEITARFLISACGILTVPKLP

SEQ ID NO: 1471681 - protein, 17 aa, Mycobacterium tuberculosis
GGFGILGAVAHSPKRLE

SEQ ID NO: 1471682 - protein, 24 aa, Mycobacterium tuberculosis
GGLFASGGSGGFGGFASTGTGGAG

SEQ ID NO: 1471683 - protein, 24 aa, Mycobacterium tuberculosis
GGLGGGGGSLFGNGGAGGVGATGG

SEQ ID NO: 1471684 - protein, 18 aa, Mycobacterium tuberculosis
GGLSGVLRVPPRPYVMPH

SEQ ID NO: 1471685 - protein, 23 aa, Mycobacterium tuberculosis
GGNGGAGGMLLGDGGAGGQGGPA

SEQ ID NO: 1471686 - protein, 28 aa, Mycobacterium tuberculosis
GGNGSKGLPGLGRLGNPGLDGGTGGNGG

SEQ ID NO: 1471687 - protein, 17 aa, Mycobacterium tuberculosis
GGPRKVSPLAVQMIMPN

SEQ ID NO: 1471688 - protein, 18 aa, Mycobacterium tuberculosis
GGSGTPIPSARYVELANA

SEQ ID NO: 1471689 - protein, 17 aa, Mycobacterium tuberculosis
GGTAGFLTGFRRAGRRH

SEQ ID NO: 1471690 - protein, 22 aa, Mycobacterium tuberculosis
GGTGGDALGLIGAGIGGVGGVG

SEQ ID NO: 1471691 - protein, 27 aa, Mycobacterium tuberculosis
GGTGGKGGDGFGVFGKGGAGGTGGRGG

SEQ ID NO: 1471692 - protein, 17 aa, Mycobacterium tuberculosis
GGVTIVIPGHENVTLPH

SEQ ID NO: 1471693 - protein, 17 aa, Mycobacterium tuberculosis
GGVTLGLLSAWRGPNGQ

SEQ ID NO: 1471694 - protein, 23 aa, Mycobacterium tuberculosis
GIAFLRAPCRVVYVIDEPDVRGF

SEQ ID NO: 1471695 - protein, 20 aa, Mycobacterium tuberculosis
GIDNARRAELIERFGLDPTK

SEQ ID NO: 1471696 - protein, 17 aa, Mycobacterium tuberculosis
GIELPRRIFAHGFLHNR

SEQ ID NO: 1471697 - protein, 19 aa, Mycobacterium tuberculosis
GIGRRLLRELLDFARGGVV

SEQ ID NO: 1471698 - protein, 18 aa, Mycobacterium tuberculosis
GIGSALAAANRAAEAPTT

SEQ ID NO: 1471699 - protein, 23 aa, Mycobacterium tuberculosis
GKARWYRNRWVRTPAVCAALGEP

SEQ ID NO: 1471700 - protein, 23 aa, Mycobacterium tuberculosis
GKHLRVGVTSIYWYFRKKDDLLN

SEQ ID NO: 1471701 - protein, 22 aa, Mycobacterium tuberculosis
GKLSLPPNWAGASPSLAPTVGS

SEQ ID NO: 1471702 - protein, 17 aa, Mycobacterium tuberculosis
GKSRLALQIGAQIAHEF

SEQ ID NO: 1471703 - protein, 24 aa, Mycobacterium tuberculosis
GKSTLLLEVAHRWAQSGRRALYVS

SEQ ID NO: 1471704 - protein, 18 aa, Mycobacterium tuberculosis
GKTLAAAKAEALKCAKGF

SEQ ID NO: 1471705 - protein, 22 aa, Mycobacterium tuberculosis
GLADRRLYLAANRCLAIAARRV

SEQ ID NO: 1471706 - protein, 20 aa, Mycobacterium tuberculosis
GLAVRPGYVLSDGFRVPGLP

SEQ ID NO: 1471707 - protein, 18 aa, Mycobacterium tuberculosis
GLDHCFGPVMLHRVEATV

SEQ ID NO: 1471708 - protein, 26 aa, Mycobacterium tuberculosis
GLDTRAYRLPWPPGTVVYEIDQPAVI

SEQ ID NO: 1471709 - protein, 20 aa, Mycobacterium tuberculosis
GLETLSLRIERHVANAQRVA

SEQ ID NO: 1471710 - protein, 17 aa, Mycobacterium tuberculosis
GLFAGITARYLALVATT

SEQ ID NO: 1471711 - protein, 30 aa, Mycobacterium tuberculosis
GLGGGSFGLPGLNGSCGDGGDGGNGAPGGV

SEQ ID NO: 1471712 - protein, 20 aa, Mycobacterium tuberculosis
GLGSVPSRILCAGKLRQSIQ

SEQ ID NO: 1471713 - protein, 28 aa, Mycobacterium tuberculosis
GLLNRLSAFKVPHRFAVVDRLPRTPNGK

SEQ ID NO: 1471714 - protein, 22 aa, Mycobacterium tuberculosis
GLLPPTFSLVGFARRDWSTQDF

SEQ ID NO: 1471715 - protein, 18 aa, Mycobacterium tuberculosis
GLMGRRIAGVLASAGLDV

SEQ ID NO: 1471716 - protein, 29 aa, Mycobacterium tuberculosis
GLPGNPGAVPGRAGGAGGLGGSGSDTSEG

SEQ ID NO: 1471717 - protein, 24 aa, Mycobacterium tuberculosis
GLPYLGLEHRAAWVEAEADGTITS

SEQ ID NO: 1471718 - protein, 17 aa, Mycobacterium tuberculosis
GLVGFSYSIEITGSTLV

SEQ ID NO: 1471719 - protein, 23 aa, Mycobacterium tuberculosis
GMRARSALTTALLRSRTNGPCRA

SEQ ID NO: 1471720 - protein, 19 aa, Mycobacterium tuberculosis
GNADFRYNTVITEETCAGR

SEQ ID NO: 1471721 - protein, 33 aa, Mycobacterium tuberculosis; identical to SEQ ID NO: 209467

SEQ ID NO: 1471722 - protein, 25 aa, Mycobacterium tuberculosis
GNGGRGADATGFGQTGASGGRGGDG

SEQ ID NO: 1471723 - protein, 25 aa, Mycobacterium tuberculosis
GNGGSGGSLFGFGGAGGTGGSSGIG

SEQ ID NO: 1471724 - protein, 17 aa, Mycobacterium tuberculosis
GNGGWLWGNGGNGGSGA

SEQ ID NO: 1471725 - protein, 18 aa, Mycobacterium tuberculosis
GNGLNLVGVPGTAGGGAD

SEQ ID NO: 1471726 - protein, 19 aa, Mycobacterium tuberculosis
GNIFLITGIGYYPSLGVKD

SEQ ID NO: 1471727 - protein, 29 aa, Mycobacterium tuberculosis
GNLMLYSRLRLATAASWSIRYVVERRAIG

SEQ ID NO: 1471728 - protein, 17 aa, Mycobacterium tuberculosis
GNLVLMVQPPRGFGENP

SEQ ID NO: 1471729 - protein, 19 aa, Mycobacterium tuberculosis
GNTGFFDAGNYNFGSLNAG

SEQ ID NO: 1471730 - protein, 35 aa, Mycobacterium tuberculosis; identical to SEQ ID NO: 200154

SEQ ID NO: 1471731 - protein, 21 aa, Mycobacterium tuberculosis
GPHALKGRFSGVAMAAVDDDE

SEQ ID NO: 1471732 - protein, 25 aa, Mycobacterium tuberculosis
GPIHIGLPLSLTIPGFTIPGGTLIP

SEQ ID NO: 1471733 - protein, 24 aa, Mycobacterium tuberculosis
GPMDRFHRRLLWPIRTSAGEVVGF

SEQ ID NO: 1471734 - protein, 27 aa, Mycobacterium tuberculosis
GPSGVAVSPVTGLVFVTNFDSNTVSVI

SEQ ID NO: 1471735 - protein, 19 aa, Mycobacterium tuberculosis
GPVVGVWRRAPLQALARLH

SEQ ID NO: 1471736 - protein, 21 aa, Mycobacterium tuberculosis
GQAALSQNFIGAGGTAGAGGT

SEQ ID NO: 1471737 - protein, 17 aa, Mycobacterium tuberculosis
GQAGGNGGWLWGNGGNG

SEQ ID NO: 1471738 - protein, 18 aa, Mycobacterium tuberculosis
GQFGKWLQGARDWSISRN

SEQ ID NO: 1471739 - protein, 18 aa, Mycobacterium tuberculosis
GQGGLLRGIPLARAGRRT

SEQ ID NO: 1471740 - protein, 24 aa, Mycobacterium tuberculosis
GQPRVNPLYFLRDGGRVIVAASKG

SEQ ID NO: 1471741 - protein, 20 aa, Mycobacterium tuberculosis
GQPVKGRLTVPPSVPVKSAD

SEQ ID NO: 1471742 - protein, 23 aa, Mycobacterium tuberculosis
GQRRFWFMWDDLVRGAIGAIVLV

SEQ ID NO: 1471743 - protein, 19 aa, Mycobacterium tuberculosis
GRAIVRRPRVFCMDEPLSN

SEQ ID NO: 1471744 - protein, 20 aa, Mycobacterium tuberculosis
GRDDLALRIAVQPGGCAGLR

SEQ ID NO: 1471745 - protein, 24 aa, Mycobacterium tuberculosis
GRFPYRNDGALGWVGTSPVGRFPA

SEQ ID NO: 1471746 - protein, 21 aa, Mycobacterium tuberculosis
GRKRPGSGPLMIGSIKPNIGH

SEQ ID NO: 1471747 - protein, 17 aa, Mycobacterium tuberculosis
GRMKDLIIQDGVNHYHD

SEQ ID NO: 1471748 - protein, 23 aa, Mycobacterium tuberculosis
GRPVVDPRARIVILVDDGIATGA

SEQ ID NO: 1471749 - protein, 24 aa, Mycobacterium tuberculosis
GRTERFWVGLSVYRPGGTAEPAPT

SEQ ID NO: 1471750 - protein, 19 aa, Mycobacterium tuberculosis
GSAGLFYGSGGAGGNGGYS

SEQ ID NO: 1471751 - protein, 20 aa, Mycobacterium tuberculosis
GSAIAQHWMYEGKHVLIIFD

SEQ ID NO: 1471752 - protein, 18 aa, Mycobacterium tuberculosis
GSALLWGDGGAGGAGGVG

SEQ ID NO: 1471753 - protein, 25 aa, Mycobacterium tuberculosis
GSGGVGGVFGNGGFGGAGGLGAAGG

SEQ ID NO: 1471754 - protein, 17 aa, Mycobacterium tuberculosis
GSKDTWVLAPRASAAAR

SEQ ID NO: 1471755 - protein, 19 aa, Mycobacterium tuberculosis
GSPIPVGLDPTGVAVNPVT

SEQ ID NO: 1471756 - protein, 26 aa, Mycobacterium tuberculosis
GSSGTVFALDLSWGGAGGNGGAATTG

SEQ ID NO: 1471757 - protein, 59 aa, Mycobacterium tuberculosis
GTALTRASSTWADSPRAWPIRAPSRLQVWRTRATTARECSIRVIISRVSSTGAPPKKSR

SEQ ID NO: 1471758 - protein, 59 aa, Mycobacterium tuberculosis
GTALTRASSTWADSPRAWPIRAPSRLQVWRTRATTARECSIRVIISRVSSTGAPPQKKV

SEQ ID NO: 1471759 - protein, 24 aa, Mycobacterium tuberculosis
GTASSPFGIAIAIGGAGAQGGAGT

SEQ ID NO: 1471760 - protein, 20 aa, Mycobacterium tuberculosis
GTCPLWNVYETFANPGKILV

SEQ ID NO: 1471761 - protein, 26 aa, Mycobacterium tuberculosis
GTGADGGAGGWLFGNGGNGGHGATGA

SEQ ID NO: 1471762 - protein, 26 aa, Mycobacterium tuberculosis
GTGEAGGPGGWLLGNGGNGGSGAPGQ

SEQ ID NO: 1471763 - protein, 30 aa, Mycobacterium tuberculosis; identical to SEQ ID NO: 200474

SEQ ID NO: 1471764 - protein, 17 aa, Mycobacterium tuberculosis
GTGMPAAPMVPPTGSPG

SEQ ID NO: 1471765 - protein, 26 aa, Mycobacterium tuberculosis
GTGQPGGPGGLLWGNGGNGGSGVAGV

SEQ ID NO: 1471766 - protein, 25 aa, Mycobacterium tuberculosis
GTLDGRFRVPFVMRAEEKLLSYNRN

SEQ ID NO: 1471767 - protein, 19 aa, Mycobacterium tuberculosis
GTPLRSRVGHSYIKALMAE

SEQ ID NO: 1471768 - protein, 18 aa, Mycobacterium tuberculosis
GTQLSGILNRGAGISGVY

SEQ ID NO: 1471769 - protein, 27 aa, Mycobacterium tuberculosis
GVGGAGGAGWLVGNGGAGGFGGVGTTV

SEQ ID NO: 1471770 - protein, 20 aa, Mycobacterium tuberculosis
GVGGHGGTAILFGDGGAGGA

SEQ ID NO: 1471771 - protein, 26 aa, Mycobacterium tuberculosis
GVGYWRRAGLTASRFVACPFGGSGAR

SEQ ID NO: 1471772 - protein, 17 aa, Mycobacterium tuberculosis
GVISAPLTPPVKASAYR

SEQ ID NO: 1471773 - protein, 19 aa, Mycobacterium tuberculosis
GVPDLRRLFPTGFDEQRRA

SEQ ID NO: 1471774 - protein, 19 aa, Mycobacterium tuberculosis
GVPPTRLRLIYLADGQLLD

SEQ ID NO: 1471775 - protein, 20 aa, Mycobacterium tuberculosis
GWCGEAGFRSFEVIPLAGGS

SEQ ID NO: 1471776 - protein, 19 aa, Mycobacterium tuberculosis
GWVKLVGDWIDRQIGDLAP

SEQ ID NO: 1471777 - protein, 18 aa, Mycobacterium tuberculosis
GYAHVTGRVGVCMATSGP

SEQ ID NO: 1471778 - protein, 21 aa, Mycobacterium tuberculosis
GYEIRSAAVAGNIPCITTVQG

SEQ ID NO: 1471779 - protein, 17 aa, Mycobacterium tuberculosis
HAAAKVNGRHLVLPLQQ

SEQ ID NO: 1471780 - protein, 19 aa, Mycobacterium tuberculosis
HAEPGAWLLISTCDATDLV

SEQ ID NO: 1471781 - protein, 25 aa, Mycobacterium tuberculosis
HAGPGGYCGYLLYNLTTSGFRPATF

SEQ ID NO: 1471782 - protein, 20 aa, Mycobacterium tuberculosis
HAWGGPPIGAMVFRDPSVMN

SEQ ID NO: 1471783 - protein, 18 aa, Mycobacterium tuberculosis
HDAYCLRIAITETMSDLP

SEQ ID NO: 1471784 - protein, 23 aa, Mycobacterium tuberculosis
HDETRKSFSIAGTRVVDAIKLSV

SEQ ID NO: 1471785 - protein, 24 aa, Mycobacterium tuberculosis
HDEVSTAIAALFGSHGQHYQAISA

SEQ ID NO: 1471786 - protein, 25 aa, Mycobacterium tuberculosis
HEDDWLAPGGFNFDAWRFENRCELL

SEQ ID NO: 1471787 - protein, 20 aa, Mycobacterium tuberculosis
HEDLKRFFDGFPRNAHPMPV

SEQ ID NO: 1471788 - protein, 20 aa, Mycobacterium tuberculosis
HERSAFRLSPPVLSGAMGPF

SEQ ID NO: 1471789 - protein, 19 aa, Mycobacterium tuberculosis
HFFRSVLRWLQVGYPEGVP

SEQ ID NO: 1471790 - protein, 24 aa, Mycobacterium tuberculosis
HFTGAFGPVVVPPIPVPAINAHLT

SEQ ID NO: 1471791 - protein, 25 aa, Mycobacterium tuberculosis
HGARLRPGATVSLPCAPFLHLFVAY

SEQ ID NO: 1471792 - protein, 20 aa, Mycobacterium tuberculosis
HGKLAYHAVTYGWLLSGLAR

SEQ ID NO: 1471793 - protein, 25 aa, Mycobacterium tuberculosis
HGLRLRLSPDLTNLIERYLANDVTT

SEQ ID NO: 1471794 - protein, 17 aa, Mycobacterium tuberculosis
HGMLTDRDIVIKGLAAG

SEQ ID NO: 1471795 - protein, 22 aa, Mycobacterium tuberculosis
HHTRLRKIISRGFTPRAVGRLH

SEQ ID NO: 1471796 - protein, 18 aa, Mycobacterium tuberculosis
HILDGFAGTGTFITRLLQ

SEQ ID NO: 1471797 - protein, 18 aa, Mycobacterium tuberculosis
HIVAPVVVGWPVGQLYAN

SEQ ID NO: 1471798 - protein, 23 aa, Mycobacterium tuberculosis
HKLVPRKEFRGVAQARLTEVGLW

SEQ ID NO: 1471799 - protein, 19 aa, Mycobacterium tuberculosis
HKTRIRGASFVDRDGNELF

SEQ ID NO: 1471800 - protein, 20 aa, Mycobacterium tuberculosis
HMGRRYGRRLTVMADRPNVG

SEQ ID NO: 1471801 - protein, 18 aa, Mycobacterium tuberculosis
HNLAALGMEADLCRADVL

SEQ ID NO: 1471802 - protein, 20 aa, Mycobacterium tuberculosis
HPDEACGVLAGPEGSDRPER

SEQ ID NO: 1471803 - protein, 27 aa, Mycobacterium tuberculosis
HPIEPGRPCWLVGLLFPSADGCAGHSD

SEQ ID NO: 1471804 - protein, 20 aa, Mycobacterium tuberculosis
HPIQGIGAGFVPPVLDQDLV

SEQ ID NO: 1471805 - protein, 30 aa, Mycobacterium tuberculosis
HPRAAFFGRSGLRRNIRWDPLDSVYFAGYA

SEQ ID NO: 1471806 - protein, 20 aa, Mycobacterium tuberculosis
HRALMAAGVGCTRLAIHAVT

SEQ ID NO: 1471807 - protein, 20 aa, Mycobacterium tuberculosis
HRIHAAIHFDDLQWERRYNR

SEQ ID NO: 1471808 - protein, 18 aa, Mycobacterium tuberculosis
HRLDSGTWGVMGIGMGYA

SEQ ID NO: 1471809 - protein, 18 aa, Mycobacterium tuberculosis
HRRIMSLVAIGAAVENVK

SEQ ID NO: 1471810 - protein, 24 aa, Mycobacterium tuberculosis
HSDPEFAAAAGFPRPILHGLCTYG

SEQ ID NO: 1471811 - protein, 24 aa, Mycobacterium tuberculosis
HVATVRRFIERFAPYNLSPTAIRP

SEQ ID NO: 1471812 - protein, 18 aa, Mycobacterium tuberculosis
HVDLYFEAAVAGAIPVIR

SEQ ID NO: 1471813 - protein, 22 aa, Mycobacterium tuberculosis
HVKEVRLSTRLTESPACLITDA

SEQ ID NO: 1471814 - protein, 18 aa, Mycobacterium tuberculosis
HWGDAMMTDGRWDPGKDF

SEQ ID NO: 1471815 - protein, 17 aa, Mycobacterium tuberculosis
IAADLAVRLHDWRQRTA

SEQ ID NO: 1471816 - protein, 22 aa, Mycobacterium tuberculosis
IAENRAELMILIATNLLGQNTP

SEQ ID NO: 1471817 - protein, 25 aa, Mycobacterium tuberculosis
IAEVSARAGVEVTVFEPAEALITAG

SEQ ID NO: 1471818 - protein, 19 aa, Mycobacterium tuberculosis
IAGITYRQLDYWARTSLVV

SEQ ID NO: 1471819 - protein, 22 aa, Mycobacterium tuberculosis
IAIDRLPAAIITRLTQTNDPLG

SEQ ID NO: 1471820 - protein, 21 aa, Mycobacterium tuberculosis
IATWQRIAAALKRDPYGRTAR

SEQ ID NO: 1471821 - protein, 17 aa, Mycobacterium tuberculosis
IAVDICEQIASVPYPLS

SEQ ID NO: 1471822 - protein, 23 aa, Mycobacterium tuberculosis
IDALRPMMRLVVTNGTAKEIAGC

SEQ ID NO: 1471823 - protein, 18 aa, Mycobacterium tuberculosis
IDDFAEWLQRFEASLGAL

SEQ ID NO: 1471824 - protein, 25 aa, Mycobacterium tuberculosis
IDEIKPARLYARFPAGFAGMPALLD

SEQ ID NO: 1471825 - protein, 17 aa, Mycobacterium tuberculosis
IDFLAYVYEETRHKVVP

SEQ ID NO: 1471826 - protein, 25 aa, Mycobacterium tuberculosis
IDGSRAATHAALWAVDEAVNRDIPL

SEQ ID NO: 1471827 - protein, 17 aa, Mycobacterium tuberculosis
IDIGLPVSLTIPGFTIP

SEQ ID NO: 1471828 - protein, 23 aa, Mycobacterium tuberculosis
IDRAREAGRIAAREALPQIMELV

SEQ ID NO: 1471829 - protein, 26 aa, Mycobacterium tuberculosis
IDRCWAPKVHGAWNIHRATAAQPLEW

SEQ ID NO: 1471830 - protein, 24 aa, Mycobacterium tuberculosis
IDYPEPDRAAAIVRRTVPGATAPL

SEQ ID NO: 1471831 - protein, 19 aa, Mycobacterium tuberculosis
IEGPAGWGEFGAFVEYQSA

SEQ ID NO: 1471832 - protein, 17 aa, Mycobacterium tuberculosis
IEPALVIMLDEYPGRSM

SEQ ID NO: 1471833 - protein, 25 aa, Mycobacterium tuberculosis
IETLIQCGWFQIRISASDVVAASTR

SEQ ID NO: 1471834 - protein, 17 aa, Mycobacterium tuberculosis
IGAHRVLVLAGRIHAYE

SEQ ID NO: 1471835 - protein, 19 aa, Mycobacterium tuberculosis
IGFYSSFMVADKVQLLTRK

SEQ ID NO: 1471836 - protein, 24 aa, Mycobacterium tuberculosis
IGGAGGGGGWLHGDGGAGGHGGQG

SEQ ID NO: 1471837 - protein, 18 aa, Mycobacterium tuberculosis
IGGLNSGSGNIGFGNSGT

SEQ ID NO: 1471838 - protein, 17 aa, Mycobacterium tuberculosis
IGRRLAKALGVGLLDTD

SEQ ID NO: 1471839 - protein, 18 aa, Mycobacterium tuberculosis
IISCGAVLDHLRIAMTAA

SEQ ID NO: 1471840 - protein, 17 aa, Mycobacterium tuberculosis
IKELLVVDGANHYPEDI

SEQ ID NO: 1471841 - protein, 22 aa, Mycobacterium tuberculosis
ILCDPWVNPAYFASWFPFPDNS

SEQ ID NO: 1471842 - protein, 17 aa, Mycobacterium tuberculosis
ILFLEWTANSAVSRVDD

SEQ ID NO: 1471843 - protein, 27 aa, Mycobacterium tuberculosis
INAPAAALSGRPFIGNGTNGAPGTGEA

SEQ ID NO: 1471844 - protein, 17 aa, Mycobacterium tuberculosis
INIDAGVVTLQGFSIVA

SEQ ID NO: 1471845 - protein, 26 aa, Mycobacterium tuberculosis
INMFEFARPVLEACGQRWPKMRISGP

SEQ ID NO: 1471846 - protein, 17 aa, Mycobacterium tuberculosis
IPPNLPLPAKIVMQVLD

SEQ ID NO: 1471847 - protein, 21 aa, Mycobacterium tuberculosis
IPVTVEVPVGGILAPLQPFQA

SEQ ID NO: 1471848 - protein, 17 aa, Mycobacterium tuberculosis
IPYQRFRGAEIAGLTAG

SEQ ID NO: 1471849 - protein, 19 aa, Mycobacterium tuberculosis
IQHADLLVVRRGEKVVVEV

SEQ ID NO: 1471850 - protein, 17 aa, Mycobacterium tuberculosis
IQREHLLQAIKDVGFDL

SEQ ID NO: 1471851 - protein, 19 aa, Mycobacterium tuberculosis
IRLGGTWKKPGTSDIEIVC

SEQ ID NO: 1471852 - protein, 17 aa, Mycobacterium tuberculosis
ISDGELFIMGRIKDLLI

SEQ ID NO: 1471853 - protein, 20 aa, Mycobacterium tuberculosis
ISGGLMRLGSAVAPLLQVGG

SEQ ID NO: 1471854 - protein, 21 aa, Mycobacterium tuberculosis
ISGLTGDDWLGPSALSMAAAA

SEQ ID NO: 1471855 - protein, 33 aa, Mycobacterium tuberculosis
ISGSYSNGFLWSGNYQGLIGLHAALAIPEIALT

SEQ ID NO: 1471856 - protein, 19 aa, Mycobacterium tuberculosis
ISHVVFKPGTIEQIRSVIR

SEQ ID NO: 1471857 - protein, 23 aa, Mycobacterium tuberculosis
ITRASARLAPAFTDTWVATTDND

SEQ ID NO: 1471858 - protein, 30 aa, Mycobacterium tuberculosis
IVDAVARQEPRISWAAGLRDDGTTTLLVTD

SEQ ID NO: 1471859 - protein, 22 aa, Mycobacterium tuberculosis
IVDEPFLAPARIDLTALRAHAV

SEQ ID NO: 1471860 - protein, 33 aa, Mycobacterium tuberculosis; identical to SEQ ID NO: 201489

SEQ ID NO: 1471861 - protein, 23 aa, Mycobacterium tuberculosis
IVSPRTGSLLDHAQRVAEGRLLD

SEQ ID NO: 1471862 - protein, 19 aa, Mycobacterium tuberculosis
IWPIAAARFVDNVVAVDSA

SEQ ID NO: 1471863 - protein, 18 aa, Mycobacterium tuberculosis
KAAIAVSRRVRTRWINFA

SEQ ID NO: 1471864 - protein, 20 aa, Mycobacterium tuberculosis
KALRSGGVVVVFPGGDYDAY

SEQ ID NO: 1471865 - protein, 21 aa, Mycobacterium tuberculosis
KANPAVRVRIGGRWRSGTAYL

SEQ ID NO: 1471866 - protein, 27 aa, Mycobacterium tuberculosis
KAVAGIRLALSLGFRVRVAATVASPAP

SEQ ID NO: 1471867 - protein, 20 aa, Mycobacterium tuberculosis
KAYGAGPCSGHLTDIEHIVL

SEQ ID NO: 1471868 - protein, 19 aa, Mycobacterium tuberculosis
KDGYGRNFLLPRGLAIVAS

SEQ ID NO: 1471869 - protein, 17 aa, Mycobacterium tuberculosis
KDLRIAVDGGFLSVTEE

SEQ ID NO: 1471870 - protein, 17 aa, Mycobacterium tuberculosis
KEGGYGCTLHRDYDGEF

SEQ ID NO: 1471871 - protein, 20 aa, Mycobacterium tuberculosis
KELERVRMASARAAATNAAA

SEQ ID NO: 1471872 - protein, 23 aa, Mycobacterium tuberculosis
KEVKGFAGFPIGGRFLRAGNPAL

SEQ ID NO: 1471873 - protein, 24 aa, Mycobacterium tuberculosis
KGGAGTLLGLTVFGDNGGAGVLGD

SEQ ID NO: 1471874 - protein, 17 aa, Mycobacterium tuberculosis
KGGENIIGDGGGGNGGA

SEQ ID NO: 1471875 - protein, 17 aa, Mycobacterium tuberculosis
KHARRCVFWEVDPAILG

SEQ ID NO: 1471876 - protein, 20 aa, Mycobacterium tuberculosis
KKFYTSLFGWGYDDNPVPGG

SEQ ID NO: 1471877 - protein, 24 aa, Mycobacterium tuberculosis
KPGLRRLAPLAFVRFRIDGKDWPA

SEQ ID NO: 1471878 - protein, 23 aa, Mycobacterium tuberculosis
KRLASPAQRIMLFANDRGCTKPG

SEQ ID NO: 1471879 - protein, 18 aa, Mycobacterium tuberculosis
KRLHRVLGPLAHVNLIPL

SEQ ID NO: 1471880 - protein, 33 aa, Mycobacterium tuberculosis; identical to SEQ ID NO: 201763

SEQ ID NO: 1471881 - protein, 17 aa, Mycobacterium tuberculosis
KSPRLVKPEMLASARFR

SEQ ID NO: 1471882 - protein, 19 aa, Mycobacterium tuberculosis
KSTTLRILLGLVKADGGSV

SEQ ID NO: 1471883 - protein, 24 aa, Mycobacterium tuberculosis
KTVDDYRLAHKIGLDAVLVDSPLA

SEQ ID NO: 1471884 - protein, 17 aa, Mycobacterium tuberculosis
KVEAPGGEAARQITSVL

SEQ ID NO: 1471885 - protein, 22 aa, Mycobacterium tuberculosis
KVGLGSVRFLMSVGALIIGWLL

SEQ ID NO: 1471886 - protein, 25 aa, Mycobacterium tuberculosis
KVIRALFRPPARRGGCVHPPGRRSR

SEQ ID NO: 1471887 - protein, 17 aa, Mycobacterium tuberculosis
KVLEDLGWYVADNLPPQ

SEQ ID NO: 1471888 - protein, 30 aa, Mycobacterium tuberculosis
KVSHPIVFGHAVRIFYKDAFAKHQELFDDL

SEQ ID NO: 1471889 - protein, 20 aa, Mycobacterium tuberculosis
KWTKRKGRIYSDDRIGVALD

SEQ ID NO: 1471890 - protein, 17 aa, Mycobacterium tuberculosis
LAAAKIVFAHKGFHATT

SEQ ID NO: 1471891 - protein, 19 aa, Mycobacterium tuberculosis
LAARCSFEQVAFLLWRGEL

SEQ ID NO: 1471892 - protein, 24 aa, Mycobacterium tuberculosis
LADHARLDFLAGLRVVPAELGGAA

SEQ ID NO: 1471893 - protein, 24 aa, Mycobacterium tuberculosis
LADHVVNGVVLFPGAGFVELVIRA

SEQ ID NO: 1471894 - protein, 23 aa, Mycobacterium tuberculosis
LADVVGCSMRLPFLYAPLPYGGT

SEQ ID NO: 1471895 - protein, 17 aa, Mycobacterium tuberculosis
LADWDFNIRCFSNPALV

SEQ ID NO: 1471896 - protein, 28 aa, Mycobacterium tuberculosis
LAFFAGIGIPIAEIWGMSELSCVATASH

SEQ ID NO: 1471897 - protein, 21 aa, Mycobacterium tuberculosis
LAKTIKGYALGKHFEGRNATH

SEQ ID NO: 1471898 - protein, 26 aa, Mycobacterium tuberculosis
LALTRFHIFSHSWGGMLAQQYVLDKA

SEQ ID NO: 1471899 - protein, 17 aa, Mycobacterium tuberculosis
LAPENPYPAALGDCYSA

SEQ ID NO: 1471900 - protein, 17 aa, Mycobacterium tuberculosis
LAPRFGVGIVATTGAHF

SEQ ID NO: 1471901 - protein, 27 aa, Mycobacterium tuberculosis
LAQLWPPHVPAMLVAGCDPRPNAEPLP

SEQ ID NO: 1471902 - protein, 18 aa, Mycobacterium tuberculosis
LAQRCFELLTPALTRYYP

SEQ ID NO: 1471903 - protein, 17 aa, Mycobacterium tuberculosis
LARAAGLAIGDRGGVLT

SEQ ID NO: 1471904 - protein, 26 aa, Mycobacterium tuberculosis
LATAETWPNPWPMYRALRDHDPVHHV

SEQ ID NO: 1471905 - protein, 27 aa, Mycobacterium tuberculosis
LATARAYRAAAEFVPRIGALIDTVHRH

SEQ ID NO: 1471906 - protein, 22 aa, Mycobacterium tuberculosis
LATQVACRVLRDGGTAADAVVA

SEQ ID NO: 1471907 - protein, 20 aa, Mycobacterium tuberculosis
LATTKFRLERAINEAESAGG

SEQ ID NO: 1471908 - protein, 25 aa, Mycobacterium tuberculosis
LAYDPREGWPPALQGNWRSDSANHA

SEQ ID NO: 1471909 - protein, 17 aa, Mycobacterium tuberculosis
LDAGLVLTSIGYRGKPI

SEQ ID NO: 1471910 - protein, 18 aa, Mycobacterium tuberculosis
LDGGFGPVVLPPIPVPAV

SEQ ID NO: 1471911 - protein, 24 aa, Mycobacterium tuberculosis
LDKSRPLWEMYLVEGLEKNRIALY

SEQ ID NO: 1471912 - protein, 17 aa, Mycobacterium tuberculosis
LDLERAMELCAPDECVE

SEQ ID NO: 1471913 - protein, 19 aa, Mycobacterium tuberculosis
LDLYSCAVYAGQLIIEHHG

SEQ ID NO: 1471914 - protein, 17 aa, Mycobacterium tuberculosis
LDQEGRDDLALRIAVQP

SEQ ID NO: 1471915 - protein, 24 aa, Mycobacterium tuberculosis
LDRLLAQKLPDGWDADLPHWEPGS

SEQ ID NO: 1471916 - protein, 18 aa, Mycobacterium tuberculosis
LDVDARFYFVHSYAAQRW

SEQ ID NO: 1471917 - protein, 19 aa, Mycobacterium tuberculosis
LDVLERMGLLAAAQEHKTR

SEQ ID NO: 1471918 - protein, 24 aa, Mycobacterium tuberculosis
LEDGTTWRVEIERAHMEEDTGKLT

SEQ ID NO: 1471919 - protein, 19 aa, Mycobacterium tuberculosis
LEGLPGLRLIGLDRDPTAL

SEQ ID NO: 1471920 - protein, 18 aa, Mycobacterium tuberculosis
LEILAQLLVLATGTRITY

SEQ ID NO: 1471921 - protein, 23 aa, Mycobacterium tuberculosis
LEPRRFASGSALGMLSATGRCHA

SEQ ID NO: 1471922 - protein, 17 aa, Mycobacterium tuberculosis
LEPVSVWAPECSEDLLY

SEQ ID NO: 1471923 - protein, 19 aa, Mycobacterium tuberculosis
LETLAAHWRVPQQRPHDAF

SEQ ID NO: 1471924 - protein, 26 aa, Mycobacterium tuberculosis
LFDRIAGHRRFRFYLNVEIGKHLGHA

SEQ ID NO: 1471925 - protein, 17 aa, Mycobacterium tuberculosis
LFQSLWRLDFVAVALPA

SEQ ID NO: 1471926 - protein, 23 aa, Mycobacterium tuberculosis
LGCELRHAHRLVYSEGLDLSGDP

SEQ ID NO: 1471927 - protein, 17 aa, Mycobacterium tuberculosis
LGDRVVVMYGGIAQQIG

SEQ ID NO: 1471928 - protein, 18 aa, Mycobacterium tuberculosis
LGFVEAQGGGTILLARGD

SEQ ID NO: 1471929 - protein, 17 aa, Mycobacterium tuberculosis
LGHPFGGSGARLMTTVL

SEQ ID NO: 1471930 - protein, 17 aa, Mycobacterium tuberculosis
LGIPVTPGYFNLTGGPS

SEQ ID NO: 1471931 - protein, 18 aa, Mycobacterium tuberculosis
LGLDSVRFVLLMKQLGVN

SEQ ID NO: 1471932 - protein, 17 aa, Mycobacterium tuberculosis
LHHCGDAAAFLGPVGAS

SEQ ID NO: 1471933 - protein, 17 aa, Mycobacterium tuberculosis
LIARLAARPLDKSRPLW

SEQ ID NO: 1471934 - protein, 23 aa, Mycobacterium tuberculosis
LIDPALLRPGRLERLVFVEPPDA

SEQ ID NO: 1471935 - protein, 17 aa, Mycobacterium tuberculosis
LIERDAWLRCMHTAVAS

SEQ ID NO: 1471936 - protein, 18 aa, Mycobacterium tuberculosis
LIERIQGGWLEFDAAIAT

SEQ ID NO: 1471937 - protein, 24 aa, Mycobacterium tuberculosis
LIYPREALWRPPVLTMSAVEGRGL

SEQ ID NO: 1471938 - protein, 18 aa, Mycobacterium tuberculosis
LKAEKVLQAIGFAPNVEG

SEQ ID NO: 1471939 - protein, 19 aa, Mycobacterium tuberculosis
LKLIRARFGVPVPNLTAWR

SEQ ID NO: 1471940 - protein, 20 aa, Mycobacterium tuberculosis
LKLRVEVFVVEQACPYPELD

SEQ ID NO: 1471941 - protein, 20 aa, Mycobacterium tuberculosis
LLAHCYRMTGSLHDAEDLVQ

SEQ ID NO: 1471942 - protein, 17 aa, Mycobacterium tuberculosis
LLAKGYEVHGLIRRAST

SEQ ID NO: 1471943 - protein, 18 aa, Mycobacterium tuberculosis
LLALGALLHDIGKGRGTD

SEQ ID NO: 1471944 - protein, 22 aa, Mycobacterium tuberculosis
LLAVRRIAERPGLTVGLEPLLD

SEQ ID NO: 1471945 - protein, 17 aa, Mycobacterium tuberculosis
LLDPGLRESVRHGVTTV

SEQ ID NO: 1471946 - protein, 28 aa, Mycobacterium tuberculosis
LLEALPERERTVLVLRFFDSMTQTQIAE

SEQ ID NO: 1471947 - protein, 23 aa, Mycobacterium tuberculosis
LLECGLLRGWLIPPADIKAARDV

SEQ ID NO: 1471948 - protein, 19 aa, Mycobacterium tuberculosis
LLERSGLVALRNVIDQQFA

SEQ ID NO: 1471949 - protein, 17 aa, Mycobacterium tuberculosis
LLGKKCYSLRIASAMAH

SEQ ID NO: 1471950 - protein, 17 aa, Mycobacterium tuberculosis
LLLDLQEQFGLSYLFVS

SEQ ID NO: 1471951 - protein, 26 aa, Mycobacterium tuberculosis
LLLILRRPRAGLSYEALLETVEQRLP

SEQ ID NO: 1471952 - protein, 17 aa, Mycobacterium tuberculosis
LLNAALEAGETVLLEGS

SEQ ID NO: 1471953 - protein, 19 aa, Mycobacterium tuberculosis
LLPDELYTAVGASIGDAWA

SEQ ID NO: 1471954 - protein, 18 aa, Mycobacterium tuberculosis
LLPREKRAALSAVYALGR

SEQ ID NO: 1471955 - protein, 23 aa, Mycobacterium tuberculosis
LLQPGVLSLAWGSVVRQLAAGLG

SEQ ID NO: 1471956 - protein, 20 aa, Mycobacterium tuberculosis
LLRLLHPVIPFLTEALWLAL

SEQ ID NO: 1471957 - protein, 19 aa, Mycobacterium tuberculosis
LLTSLPFAPGYGVEIGLLI

SEQ ID NO: 1471958 - protein, 17 aa, Mycobacterium tuberculosis
LNAAVRRIDRHGAGVTV

SEQ ID NO: 1471959 - protein, 18 aa, Mycobacterium tuberculosis
LNAGLGFGGGCLPKDIRA

SEQ ID NO: 1471960 - protein, 19 aa, Mycobacterium tuberculosis
LNTAVWSGGSFIYVPPGVH

SEQ ID NO: 1471961 - protein, 17 aa, Mycobacterium tuberculosis
LNWAEAGSGEHARLHRF

SEQ ID NO: 1471962 - protein, 17 aa, Mycobacterium tuberculosis
LPADVCWSDGAHAAAGV

SEQ ID NO: 1471963 - protein, 26 aa, Mycobacterium tuberculosis
LPAFALPLRLPAGLAAGPAAVVTALT

SEQ ID NO: 1471964 - protein, 17 aa, Mycobacterium tuberculosis
LPAKLAIPMRVIASVGA

SEQ ID NO: 1471965 - protein, 18 aa, Mycobacterium tuberculosis
LPALFSQLVAGPIRRIID

SEQ ID NO: 1471966 - protein, 19 aa, Mycobacterium tuberculosis
LPDECWHLVIVAHHIVIDG

SEQ ID NO: 1471967 - protein, 17 aa, Mycobacterium tuberculosis
LPEHAIVQFVKAICSPM

SEQ ID NO: 1471968 - protein, 23 aa, Mycobacterium tuberculosis
LPGSARTTYPCHVEVGPQDSESG

SEQ ID NO: 1471969 - protein, 18 aa, Mycobacterium tuberculosis
LPKSIIIAGAGAIGMEFG

SEQ ID NO: 1471970 - protein, 25 aa, Mycobacterium tuberculosis
LPLYHDMGLILGICAPLVARRRAVL

SEQ ID NO: 1471971 - protein, 17 aa, Mycobacterium tuberculosis
LPPAKRLPDGLASYVSV

SEQ ID NO: 1471972 - protein, 21 aa, Mycobacterium tuberculosis
LPPEGASAIVFRDTAHAAELA

SEQ ID NO: 1471973 - protein, 25 aa, Mycobacterium tuberculosis
LPPLSGGMVGFFAYDMVRRLERLPE

SEQ ID NO: 1471974 - protein, 20 aa, Mycobacterium tuberculosis
LPRRGISALVRRPKRRPLDE

SEQ ID NO: 1471975 - protein, 17 aa, Mycobacterium tuberculosis
LPVLDTRAADTILGYDE

SEQ ID NO: 1471976 - protein, 17 aa, Mycobacterium tuberculosis
LPVSLSVQVRGELAAEE

SEQ ID NO: 1471977 - protein, 25 aa, Mycobacterium tuberculosis
LQADRAVVVAARLDRAALAGAGAAL

SEQ ID NO: 1471978 - protein, 17 aa, Mycobacterium tuberculosis
LQDLLGVVNAPAQALLG

SEQ ID NO: 1471979 - protein, 18 aa, Mycobacterium tuberculosis
LQLGYWGAQPPQNHAELV

SEQ ID NO: 1471980 - protein, 18 aa, Mycobacterium tuberculosis
LQLLIIISAGRTIANDIS

SEQ ID NO: 1471981 - protein, 21 aa, Mycobacterium tuberculosis
LQPLFDVINAPTLALLNRPLI

SEQ ID NO: 1471982 - protein, 19 aa, Mycobacterium tuberculosis
LQSRPEDRRAFIEEAAGVL

SEQ ID NO: 1471983 - protein, 17 aa, Mycobacterium tuberculosis
LQTHGAIGFTCEHDLSL

SEQ ID NO: 1471984 - protein, 17 aa, Mycobacterium tuberculosis
LRAAGRVAGLIGTIGIR

SEQ ID NO: 1471985 - protein, 17 aa, Mycobacterium tuberculosis
LRAGLRERLGVTVAVVI

SEQ ID NO: 1471986 - protein, 17 aa, Mycobacterium tuberculosis
LRAKHGLIPEDEALRAI

SEQ ID NO: 1471987 - protein, 30 aa, Mycobacterium tuberculosis; identical to SEQ ID NO: 202839

SEQ ID NO: 1471988 - protein, 17 aa, Mycobacterium tuberculosis
LRDHAGWPLYPIRPDRS

SEQ ID NO: 1471989 - protein, 31 aa, Mycobacterium tuberculosis; identical to SEQ ID NO: 202857

SEQ ID NO: 1471990 - protein, 17 aa, Mycobacterium tuberculosis
LRESFGGSKPAPAKGTA

SEQ ID NO: 1471991 - protein, 21 aa, Mycobacterium tuberculosis
LRHGLRFLTACQRRYGSVFTL

SEQ ID NO: 1471992 - protein, 20 aa, Mycobacterium tuberculosis
LRIHCDGATDFARIPGSGID

SEQ ID NO: 1471993 - protein, 18 aa, Mycobacterium tuberculosis
LRISLSVSARLAGIPYIA

SEQ ID NO: 1471994 - protein, 26 aa, Mycobacterium tuberculosis
LRKADELGCRSLALVAFGTGVGGFPL

SEQ ID NO: 1471995 - protein, 17 aa, Mycobacterium tuberculosis
LRLIQRITDRLPAKAPL

SEQ ID NO: 1471996 - protein, 17 aa, Mycobacterium tuberculosis
LRPIAHIRANAVDVSDD

SEQ ID NO: 1471997 - protein, 18 aa, Mycobacterium tuberculosis
LRQISFRLAADDDQFMTL

SEQ ID NO: 1471998 - protein, 19 aa, Mycobacterium tuberculosis
LRRLFPTGFDEQRRAAEIA

SEQ ID NO: 1471999 - protein, 19 aa, Mycobacterium tuberculosis
LRRRCLYHWIDYPEPDRAA

SEQ ID NO: 1472000 - protein, 24 aa, Mycobacterium tuberculosis
LRRVIRSAKLLGIDAAIVGDLMAT

SEQ ID NO: 1472001 - protein, 25 aa, Mycobacterium tuberculosis
LRRWWPRRYRRSSVYWTLMALDQRF

SEQ ID NO: 1472002 - protein, 18 aa, Mycobacterium tuberculosis
LRSLGATLKASNAAAAVP

SEQ ID NO: 1472003 - protein, 17 aa, Mycobacterium tuberculosis
LRSYRGDMINGFAPDAA

SEQ ID NO: 1472004 - protein, 22 aa, Mycobacterium tuberculosis
LRVQVGHGLVVDFVRSCGMTAI

SEQ ID NO: 1472005 - protein, 20 aa, Mycobacterium tuberculosis
LRWTAGQAPDASGYWPAPAV

SEQ ID NO: 1472006 - protein, 20 aa, Mycobacterium tuberculosis
LSAQCPVAIVRPHRVPIGRD

SEQ ID NO: 1472007 - protein, 20 aa, Mycobacterium tuberculosis
LSFSLPRNGIVGVIGPNGVG

SEQ ID NO: 1472008 - protein, 21 aa, Mycobacterium tuberculosis
LSGLDLRPATSRAQCLRMVAD

SEQ ID NO: 1472009 - protein, 26 aa, Mycobacterium tuberculosis
LSPSLRRPQPLFSLVNFFDAQVGPLS

SEQ ID NO: 1472010 - protein, 19 aa, Mycobacterium tuberculosis
LSRELPKSIIIAGAGAIGM

SEQ ID NO: 1472011 - protein, 18 aa, Mycobacterium tuberculosis
LSVSLKFQGFEVYTATNG

SEQ ID NO: 1472012 - protein, 23 aa, Mycobacterium tuberculosis
LSWRRVRTGDLGLAVWGGREEYR

SEQ ID NO: 1472013 - protein, 18 aa, Mycobacterium tuberculosis
LTEAIPVQIIWGTKDVVL

SEQ ID NO: 1472014 - protein, 17 aa, Mycobacterium tuberculosis
LTGVPAYLGAQIAGVRA

SEQ ID NO: 1472015 - protein, 17 aa, Mycobacterium tuberculosis
LTHDDFRNAWFVDASGR

SEQ ID NO: 1472016 - protein, 18 aa, Mycobacterium tuberculosis
LTIPAGITIGGFSLPAIH

SEQ ID NO: 1472017 - protein, 17 aa, Mycobacterium tuberculosis
LTKAGELGFSCYVHPEI

SEQ ID NO: 1472018 - protein, 17 aa, Mycobacterium tuberculosis
LTVGEAVRWSPTVRVPG

SEQ ID NO: 1472019 - protein, 23 aa, Mycobacterium tuberculosis
LTVPEKPRGIVVFAHGSGSSRHS

SEQ ID NO: 1472020 - protein, 24 aa, Mycobacterium tuberculosis
LTWLLSRWACVFGTPACQGTVAGR

SEQ ID NO: 1472021 - protein, 23 aa, Mycobacterium tuberculosis
LVAIWRRGSELFAEVVAPGEAGV

SEQ ID NO: 1472022 - protein, 17 aa, Mycobacterium tuberculosis
LVDCRRLQDSFAAVDFF

SEQ ID NO: 1472023 - protein, 19 aa, Mycobacterium tuberculosis
LVGVFTFPGHSYAPGKPGE

SEQ ID NO: 1472024 - protein, 21 aa, Mycobacterium tuberculosis
LVKLTCRGRDLPTAVSRARRA

SEQ ID NO: 1472025 - protein, 20 aa, Mycobacterium tuberculosis
LVMSRDCWDAVGGMDLSTFG

SEQ ID NO: 1472026 - protein, 20 aa, Mycobacterium tuberculosis
LVNLPNWLSLTFRINGGAWF

SEQ ID NO: 1472027 - protein, 18 aa, Mycobacterium tuberculosis
LWFEEFQIGTTYLHRPGR

SEQ ID NO: 1472028 - protein, 24 aa, Mycobacterium tuberculosis
LWPPHVPAMLVAGCDPRPNAEPLP

SEQ ID NO: 1472029 - protein, 17 aa, Mycobacterium tuberculosis
LYGLLAVNSIWFNHESP

SEQ ID NO: 1472030 - protein, 17 aa, Mycobacterium tuberculosis
MAGNFSFGDYFKRGAIE

SEQ ID NO: 1472031 - protein, 24 aa, Mycobacterium tuberculosis
MAPGARPGPVPKPGIRTPRVGNNP

SEQ ID NO: 1472032 - protein, 19 aa, Mycobacterium tuberculosis
MAVPVGWAATVVGEGGFSV

SEQ ID NO: 1472033 - protein, 17 aa, Mycobacterium tuberculosis
MFGGTPAVEEWEIAAMH

SEQ ID NO: 1472034 - protein, 20 aa, Mycobacterium tuberculosis
MGRIAAQLADLVVVTDDNPR

SEQ ID NO: 1472035 - protein, 17 aa, Mycobacterium tuberculosis
MGTWKFFRASVDGRPVF

SEQ ID NO: 1472036 - protein, 24 aa, Mycobacterium tuberculosis
MIGKPGAGVCPVRGHSNVQGDRTM

SEQ ID NO: 1472037 - protein, 26 aa, Mycobacterium tuberculosis
MMTDGRWDPGKDFAMVTARETGPTQK

SEQ ID NO: 1472038 - protein, 19 aa, Mycobacterium tuberculosis
MNNGVPWSVPRMNPTHLNF

SEQ ID NO: 1472039 - protein, 20 aa, Mycobacterium tuberculosis
MPEDLIKFGLIPEFIGRLPV

SEQ ID NO: 1472040 - protein, 18 aa, Mycobacterium tuberculosis
MPRKPGGDLARLPSRVWR

SEQ ID NO: 1472041 - protein, 18 aa, Mycobacterium tuberculosis
MRALDWFEVQSIRGHLVD

SEQ ID NO: 1472042 - protein, 24 aa, Mycobacterium tuberculosis
MRDRGRLPGLSKRLGVLTRTNSES

SEQ ID NO: 1472043 - protein, 17 aa, Mycobacterium tuberculosis
MREQAARIGRATLTRYA

SEQ ID NO: 1472044 - protein, 17 aa, Mycobacterium tuberculosis
MRGAGGSDLDTTRLMPA

SEQ ID NO: 1472045 - protein, 17 aa, Mycobacterium tuberculosis
MRLGSAVAPLLQVGGTP

SEQ ID NO: 1472046 - protein, 23 aa, Mycobacterium tuberculosis
MRLRPQSAMSFRELLTATRDIAS

SEQ ID NO: 1472047 - protein, 21 aa, Mycobacterium tuberculosis
MRWKGKRPSVRGVVMNPVDHP

SEQ ID NO: 1472048 - protein, 28 aa, Mycobacterium tuberculosis
MSAELGKARLVGAMSVPPTWEGSVPARM

SEQ ID NO: 1472049 - protein, 30 aa, Mycobacterium tuberculosis
MTGDYSNGLLWRGGYEGLVGVRVGPTISQF

SEQ ID NO: 1472050 - protein, 17 aa, Mycobacterium tuberculosis
NDARFLVYPAMKALTLD

SEQ ID NO: 1472051 - protein, 23 aa, Mycobacterium tuberculosis
NDGNEVWVLPGGLTRVALVEGSR

SEQ ID NO: 1472052 - protein, 19 aa, Mycobacterium tuberculosis
NDHWSGFRPDRIKALAGAA

SEQ ID NO: 1472053 - protein, 21 aa, Mycobacterium tuberculosis
NELCFVSGVLPTAPVSAVADP

SEQ ID NO: 1472054 - protein, 26 aa, Mycobacterium tuberculosis
NELPFNVAGIFTGYIGPIPLSTFVLG

SEQ ID NO: 1472055 - protein, 24 aa, Mycobacterium tuberculosis
NERYKLVWKNRLGFARLAIQHGYP

SEQ ID NO: 1472056 - protein, 25 aa, Mycobacterium tuberculosis
NGAAALPTVEVVAAAADEVSTQIAA

SEQ ID NO: 1472057 - protein, 25 aa, Mycobacterium tuberculosis
NGGAGGAGGWLFGNGGAGGVGGAGG

SEQ ID NO: 1472058 - protein, 23 aa, Mycobacterium tuberculosis
NGGAGGTGGWLFGNGGAGGNSGG

SEQ ID NO: 1472059 - protein, 26 aa, Mycobacterium tuberculosis
NGIWYTARLRPGPLRPAERRTAVVEY

SEQ ID NO: 1472060 - protein, 21 aa, Mycobacterium tuberculosis
NGVARVIAYRWLRVGRLPVPA

SEQ ID NO: 1472061 - protein, 20 aa, Mycobacterium tuberculosis
NHLKRSYGWNRTELTGITGA

SEQ ID NO: 1472062 - protein, 19 aa, Mycobacterium tuberculosis
NHTGGWRVDPLRGLSRPDF

SEQ ID NO: 1472063 - protein, 20 aa, Mycobacterium tuberculosis
NIGNPAPFGFEAPDVIMRDI

SEQ ID NO: 1472064 - protein, 18 aa, Mycobacterium tuberculosis
NILCLDVRRGIEQTRAHE

SEQ ID NO: 1472065 - protein, 17 aa, Mycobacterium tuberculosis
NLEDAGVSWKVYQNKGL

SEQ ID NO: 1472066 - protein, 18 aa, Mycobacterium tuberculosis
NNKIAFDRIDERLVVVGL

SEQ ID NO: 1472067 - protein, 19 aa, Mycobacterium tuberculosis
NPATWSGAGVVASHMTATE

SEQ ID NO: 1472068 - protein, 25 aa, Mycobacterium tuberculosis
NPVNWPRVLTVWRANLIGSSGKGGE

SEQ ID NO: 1472069 - protein, 20 aa, Mycobacterium tuberculosis
NPVTGEVYVTNFAGDTVSVI

SEQ ID NO: 1472070 - protein, 21 aa, Mycobacterium tuberculosis
NQFPYQSKTGWVYDSGDYETT

SEQ ID NO: 1472071 - protein, 18 aa, Mycobacterium tuberculosis
NRIVKSLARAVSAGKVTE

SEQ ID NO: 1472072 - protein, 23 aa, Mycobacterium tuberculosis
NRPGYLRFDFNWQGPLTDDQRTQ

SEQ ID NO: 1472073 - protein, 17 aa, Mycobacterium tuberculosis
NRTGVFWIQDRLTIGQL

SEQ ID NO: 1472074 - protein, 25 aa, Mycobacterium tuberculosis
NSGRMYCGPGSGPMLAAAAAWDGVA

SEQ ID NO: 1472075 - protein, 24 aa, Mycobacterium tuberculosis
NTATRRLCEWAGCKFLGEHATTNR

SEQ ID NO: 1472076 - protein, 23 aa, Mycobacterium tuberculosis
NTLSRFCNRFAPYNFREDMIRPS

SEQ ID NO: 1472077 - protein, 23 aa, Mycobacterium tuberculosis
NTTFPVGPFFGLGVVNISGIEIK

SEQ ID NO: 1472078 - protein, 18 aa, Mycobacterium tuberculosis
NWLSLTFRINGGAWFNVD

SEQ ID NO: 1472079 - protein, 17 aa, Mycobacterium tuberculosis
PACFEPTLDYVVVKAPR

SEQ ID NO: 1472080 - protein, 26 aa, Mycobacterium tuberculosis
PAGGAGGAAGLWGHGGAGGAGGSASG

SEQ ID NO: 1472081 - protein, 17 aa, Mycobacterium tuberculosis
PAKVIAMCNQKGGVGKT

SEQ ID NO: 1472082 - protein, 25 aa, Mycobacterium tuberculosis
PALELMRRVSLRPTKLTNAWVPFVV

SEQ ID NO: 1472083 - protein, 23 aa, Mycobacterium tuberculosis
PAPRKPIPLLMWPDRIKGRIRRR

SEQ ID NO: 1472084 - protein, 18 aa, Mycobacterium tuberculosis
PAQRVCAVDGAIHVMTTV

SEQ ID NO: 1472085 - protein, 20 aa, Mycobacterium tuberculosis
PASGAAHLLAQWTGAHNDGP

SEQ ID NO: 1472086 - protein, 17 aa, Mycobacterium tuberculosis
PAVSFLLISSGSAEVSH

SEQ ID NO: 1472087 - protein, 21 aa, Mycobacterium tuberculosis
PDEIEAAIGLAERDQDIKVIV

SEQ ID NO: 1472088 - protein, 17 aa, Mycobacterium tuberculosis
PDGKYLYIADYSGTITR

SEQ ID NO: 1472089 - protein, 28 aa, Mycobacterium tuberculosis
PDGSWGAEFPFCYEDRLLSTLAAMISLT

SEQ ID NO: 1472090 - protein, 19 aa, Mycobacterium tuberculosis
PDHPAFHWYAERIGEQRAV

SEQ ID NO: 1472091 - protein, 38 aa, Mycobacterium tuberculosis; identical to SEQ ID NO: 203867

SEQ ID NO: 1472092 - protein, 17 aa, Mycobacterium tuberculosis
PDIKLLQPVPAGDPSKG

SEQ ID NO: 1472093 - protein, 17 aa, Mycobacterium tuberculosis
PDLITWWCERDGVHPDK

SEQ ID NO: 1472094 - protein, 17 aa, Mycobacterium tuberculosis
PDQFLGAHVRRVTGRKN

SEQ ID NO: 1472095 - protein, 18 aa, Mycobacterium tuberculosis
PEAGEPVGTPGRRQHHQP

SEQ ID NO: 1472096 - protein, 20 aa, Mycobacterium tuberculosis
PEALADMVAIGQRIARAARA

SEQ ID NO: 1472097 - protein, 17 aa, Mycobacterium tuberculosis
PEALGGLGGAASSQLLP

SEQ ID NO: 1472098 - protein, 18 aa, Mycobacterium tuberculosis
PEEAIGLPETFVRDVYGK

SEQ ID NO: 1472099 - protein, 25 aa, Mycobacterium tuberculosis
PEHFAEELVRIIGVLRGMQLKKVPS

SEQ ID NO: 1472100 - protein, 17 aa, Mycobacterium tuberculosis
PEHPDHVMYVWVDALTN

SEQ ID NO: 1472101 - protein, 19 aa, Mycobacterium tuberculosis
PEPHPVLPTTPWQHTQHWI

SEQ ID NO: 1472102 - protein, 20 aa, Mycobacterium tuberculosis
PGAAGGDAGLLFGSGGAGGA

SEQ ID NO: 1472103 - protein, 21 aa, Mycobacterium tuberculosis
PGAYVAGWIKRGPTGFIGTNK

SEQ ID NO: 1472104 - protein, 22 aa, Mycobacterium tuberculosis
PGCGHWPGAVIRLEAPVIPHMG

SEQ ID NO: 1472105 - protein, 17 aa, Mycobacterium tuberculosis
PGGGVTIVIPGHENVTL

SEQ ID NO: 1472106 - protein, 17 aa, Mycobacterium tuberculosis
PGGTGVGGIGGLLLGLD

SEQ ID NO: 1472107 - protein, 23 aa, Mycobacterium tuberculosis
PGIPFGAAVGSGFARLNFATTRA

SEQ ID NO: 1472108 - protein, 18 aa, Mycobacterium tuberculosis
PGMGHAIELRVYRFGGSL

SEQ ID NO: 1472109 - protein, 18 aa, Mycobacterium tuberculosis
PGMRAKLFDAARLAASAI

SEQ ID NO: 1472110 - protein, 18 aa, Mycobacterium tuberculosis
PGQPGGRGGAAGLIGNGG

SEQ ID NO: 1472111 - protein, 22 aa, Mycobacterium tuberculosis
PGRREGWDYPDMARESGTKALR

SEQ ID NO: 1472112 - protein, 30 aa, Mycobacterium tuberculosis; identical to SEQ ID NO: 211473

SEQ ID NO: 1472113 - protein, 22 aa, Mycobacterium tuberculosis
PGSLAAKWLVTRVPVAGLAEKC

SEQ ID NO: 1472114 - protein, 18 aa, Mycobacterium tuberculosis
PGVSLGVRPDPVRPVRSA

SEQ ID NO: 1472115 - protein, 17 aa, Mycobacterium tuberculosis
PHDWIVWHFTHADNLPG

SEQ ID NO: 1472116 - protein, 17 aa, Mycobacterium tuberculosis
PHVQLWPHRHGTDAMFA

SEQ ID NO: 1472117 - protein, 22 aa, Mycobacterium tuberculosis
PISEADLLWDLASRLEGRMAAI

SEQ ID NO: 1472118 - protein, 19 aa, Mycobacterium tuberculosis
PITAVSLAWLPAGDYERAL

SEQ ID NO: 1472119 - protein, 18 aa, Mycobacterium tuberculosis
PKRRPVPLRLRDWREVYE

SEQ ID NO: 1472120 - protein, 19 aa, Mycobacterium tuberculosis
PKTPEWAAALSGLAAGDLR

SEQ ID NO: 1472121 - protein, 19 aa, Mycobacterium tuberculosis
PLDRVCMIDGLRIIVLDTS

SEQ ID NO: 1472122 - protein, 17 aa, Mycobacterium tuberculosis
PLEWSSFLPPQCTDPDV

SEQ ID NO: 1472123 - protein, 17 aa, Mycobacterium tuberculosis
PLLAQGIRHGFRAPTEL

SEQ ID NO: 1472124 - protein, 22 aa, Mycobacterium tuberculosis
PLPTEKNVYCVIRSPHKYKDSR

SEQ ID NO: 1472125 - protein, 23 aa, Mycobacterium tuberculosis
PLRLLFKDEVRAVGRELGLPEEI

SEQ ID NO: 1472126 - protein, 25 aa, Mycobacterium tuberculosis
PLYYLEMPPALFAPIVENLANVRLL

SEQ ID NO: 1472127 - protein, 19 aa, Mycobacterium tuberculosis
PMGMMPMPMGMGGAGAGMP

SEQ ID NO: 1472128 - protein, 20 aa, Mycobacterium tuberculosis
PMVAATMWDRYRQAVAGRIA

SEQ ID NO: 1472129 - protein, 23 aa, Mycobacterium tuberculosis
PNIKTDAMFPARAFDALDALVAS

SEQ ID NO: 1472130 - protein, 20 aa, Mycobacterium tuberculosis
PNRDPITGVHFVFVSNSSPW

SEQ ID NO: 1472131 - protein, 20 aa, Mycobacterium tuberculosis
PNSGTEPGFGGDGGLGGAGA

SEQ ID NO: 1472132 - protein, 18 aa, Mycobacterium tuberculosis
PPDKIWTLIADVRNTGRF

SEQ ID NO: 1472133 - protein, 25 aa, Mycobacterium tuberculosis
PPEFADRVADAWIKAQAYRLQTFGT

SEQ ID NO: 1472134 - protein, 17 aa, Mycobacterium tuberculosis
PPFPANLTTLFFGPTGI

SEQ ID NO: 1472135 - protein, 25 aa, Mycobacterium tuberculosis
PPGAKFPSGSFYLSISDLQINGPII

SEQ ID NO: 1472136 - protein, 25 aa, Mycobacterium tuberculosis
PPPHLDHGQPWTCEIHYTCACCCLP

SEQ ID NO: 1472137 - protein, 24 aa, Mycobacterium tuberculosis
PQLGKGGGRLPITLWIVDTNASTP

SEQ ID NO: 1472138 - protein, 22 aa, Mycobacterium tuberculosis
PQVHTLLDFHFRPHLTAASGKH

SEQ ID NO: 1472139 - protein, 18 aa, Mycobacterium tuberculosis
PRGLSAVPLEPGQQTVGF

SEQ ID NO: 1472140 - protein, 21 aa, Mycobacterium tuberculosis
PRKWARNLIREMSADRLYERL

SEQ ID NO: 1472141 - protein, 27 aa, Mycobacterium tuberculosis
PRLLMVGDAFSPRYGDRVVRLLESKIF

SEQ ID NO: 1472142 - protein, 28 aa, Mycobacterium tuberculosis
PRRGHRVLTRCQMSFVVTIPEALAAVAT

SEQ ID NO: 1472143 - protein, 20 aa, Mycobacterium tuberculosis
PRVAWWALCTDFDVPRSMGR

SEQ ID NO: 1472144 - protein, 19 aa, Mycobacterium tuberculosis
PRVNCPTHGPTVVAVAWAR

SEQ ID NO: 1472145 - protein, 18 aa, Mycobacterium tuberculosis
PSAPARLVVLASGTGSLL

SEQ ID NO: 1472146 - protein, 23 aa, Mycobacterium tuberculosis
PSGEGLHVGHPLGYIATDVYARY

SEQ ID NO: 1472147 - protein, 17 aa, Mycobacterium tuberculosis
PSGFVKLVADAKHGELL

SEQ ID NO: 1472148 - protein, 17 aa, Mycobacterium tuberculosis
PSGTSWAQLGLASLAGG

SEQ ID NO: 1472149 - protein, 27 aa, Mycobacterium tuberculosis
PSLRLYERLWRPASFHLASRITTRTER

SEQ ID NO: 1472150 - protein, 25 aa, Mycobacterium tuberculosis
PSPHLGTLEVRICDGVSNLRELGAL

SEQ ID NO: 1472151 - protein, 17 aa, Mycobacterium tuberculosis
PSQIPVVRKAYRPSHEK

SEQ ID NO: 1472152 - protein, 18 aa, Mycobacterium tuberculosis
PTDICEPVAVVGIGCRFP

SEQ ID NO: 1472153 - protein, 21 aa, Mycobacterium tuberculosis
PTLAAAAAWDGLAAELGQAAN

SEQ ID NO: 1472154 - protein, 18 aa, Mycobacterium tuberculosis
PTLKGEFAHTLNLTDVHI

SEQ ID NO: 1472155 - protein, 21 aa, Mycobacterium tuberculosis
PTLPLPTPVGMEIMPPQPPLP

SEQ ID NO: 1472156 - protein, 19 aa, Mycobacterium tuberculosis
PTQPRSITLTFIRNAQSQA

SEQ ID NO: 1472157 - protein, 18 aa, Mycobacterium tuberculosis
PTSGLLAAAGDEVSAAIA

SEQ ID NO: 1472158 - protein, 17 aa, Mycobacterium tuberculosis
PTTAFRLGEKVDDPLAM

SEQ ID NO: 1472159 - protein, 17 aa, Mycobacterium tuberculosis
PVARRLFAVRAVVGLSL

SEQ ID NO: 1472160 - protein, 18 aa, Mycobacterium tuberculosis
PVAVLAPRSPADCFETAL

SEQ ID NO: 1472161 - protein, 18 aa, Mycobacterium tuberculosis
PVGEVRSRFYARAPELHR

SEQ ID NO: 1472162 - protein, 17 aa, Mycobacterium tuberculosis
PVIDMWAPFVPSAEVID

SEQ ID NO: 1472163 - protein, 19 aa, Mycobacterium tuberculosis
PVLPDPVGLLRCAGGADLA

SEQ ID NO: 1472164 - protein, 17 aa, Mycobacterium tuberculosis
PVMRALIVVAGLRMSRT

SEQ ID NO: 1472165 - protein, 17 aa, Mycobacterium tuberculosis
PVPREVLVPCLPSNAEE

SEQ ID NO: 1472166 - protein, 51 aa, Mycobacterium tuberculosis; identical to SEQ ID NO: 1382986

SEQ ID NO: 1472167 - protein, 20 aa, Mycobacterium tuberculosis
PVTIPGFAINPFGLDVPLSG

SEQ ID NO: 1472168 - protein, 17 aa, Mycobacterium tuberculosis
PWPEDYELMGVPFAKRG

SEQ ID NO: 1472169 - protein, 20 aa, Mycobacterium tuberculosis
QAAAIHEMFVNTLQMSSGSY

SEQ ID NO: 1472170 - protein, 21 aa, Mycobacterium tuberculosis
QAAAIHEMFVNTLVASSGSYA

SEQ ID NO: 1472171 - protein, 22 aa, Mycobacterium tuberculosis
QALLGRPLIGNGADGAPGTGQA

SEQ ID NO: 1472172 - protein, 34 aa, Mycobacterium tuberculosis; identical to SEQ ID NO: 204600

SEQ ID NO: 1472173 - protein, 19 aa, Mycobacterium tuberculosis
QARGKGGLVRVSWAEASEM

SEQ ID NO: 1472174 - protein, 23 aa, Mycobacterium tuberculosis
QATTRAGPYVPLTMGYYTRQDIP

SEQ ID NO: 1472175 - protein, 19 aa, Mycobacterium tuberculosis
QAWWSRPLEKVYAAVFIDA

SEQ ID NO: 1472176 - protein, 17 aa, Mycobacterium tuberculosis
QCLNAGLGFGGGCLPKD

SEQ ID NO: 1472177 - protein, 30 aa, Mycobacterium tuberculosis; identical to SEQ ID NO: 204617

SEQ ID NO: 1472178 - protein, 23 aa, Mycobacterium tuberculosis
QEAYRISISELDWMTPQTRQRAL

SEQ ID NO: 1472179 - protein, 17 aa, Mycobacterium tuberculosis
QEGRDDLALRIAVQPGG

SEQ ID NO: 1472180 - protein, 20 aa, Mycobacterium tuberculosis
QEIMTELEIAPTRRLRGLGD

SEQ ID NO: 1472181 - protein, 17 aa, Mycobacterium tuberculosis
QEPDDVASWGRVDLGAA

SEQ ID NO: 1472182 - protein, 17 aa, Mycobacterium tuberculosis
QEYQRLSAQAAGFHAQF

SEQ ID NO: 1472183 - protein, 26 aa, Mycobacterium tuberculosis
QFSMCINCMLCYSACPVYALDPDFLG

SEQ ID NO: 1472184 - protein, 17 aa, Mycobacterium tuberculosis
QFVRALNAGAGSYASAE

SEQ ID NO: 1472185 - protein, 20 aa, Mycobacterium tuberculosis
QFWRSGGRTRTRFGHVEDIP

SEQ ID NO: 1472186 - protein, 20 aa, Mycobacterium tuberculosis
QFWSQIHGFVMLELAGFYGD

SEQ ID NO: 1472187 - protein, 31 aa, Mycobacterium tuberculosis; identical to SEQ ID NO: 204666

SEQ ID NO: 1472188 - protein, 17 aa, Mycobacterium tuberculosis
QGLRVTAVRSRLMAPLS

SEQ ID NO: 1472189 - protein, 19 aa, Mycobacterium tuberculosis
QGLTAMWRRESELFADVAV

SEQ ID NO: 1472190 - protein, 18 aa, Mycobacterium tuberculosis
QGRFYAMRTLRKYVEADL

SEQ ID NO: 1472191 - protein, 17 aa, Mycobacterium tuberculosis
QGTYLAWLDCRELGFDD

SEQ ID NO: 1472192 - protein, 17 aa, Mycobacterium tuberculosis
QGVRLGRGRGFYDRSLR

SEQ ID NO: 1472193 - protein, 19 aa, Mycobacterium tuberculosis
QHPELWPNTVEEILRLDSP

SEQ ID NO: 1472194 - protein, 18 aa, Mycobacterium tuberculosis
QIDIPGMSLFDVHEIVEI

SEQ ID NO: 1472195 - protein, 24 aa, Mycobacterium tuberculosis
QLAERRGEAWFDPDGLILAFGDSP

SEQ ID NO: 1472196 - protein, 17 aa, Mycobacterium tuberculosis
QLAPAVAWVKKRAGRTP

SEQ ID NO: 1472197 - protein, 23 aa, Mycobacterium tuberculosis
QLIWREYRPGWTRYGDGSVAQVK

SEQ ID NO: 1472198 - protein, 23 aa, Mycobacterium tuberculosis
QLPDDRLEELLALAHEVRMRWCG

SEQ ID NO: 1472199 - protein, 23 aa, Mycobacterium tuberculosis
QLRHEFGDAVAIIGRPAYTPAGL

SEQ ID NO: 1472200 - protein, 18 aa, Mycobacterium tuberculosis
QPLFDVINAPTLALLNRP

SEQ ID NO: 1472201 - protein, 18 aa, Mycobacterium tuberculosis
QQLGIDFAGVVTAVGPDV

SEQ ID NO: 1472202 - protein, 19 aa, Mycobacterium tuberculosis
QQLTLPFGAPHTMLNVAVG

SEQ ID NO: 1472203 - protein, 21 aa, Mycobacterium tuberculosis
QQQRLCIARAIAVQPDVLLMD

SEQ ID NO: 1472204 - protein, 20 aa, Mycobacterium tuberculosis
QQVAPWWRRRPHRSLTSLGQ

SEQ ID NO: 1472205 - protein, 22 aa, Mycobacterium tuberculosis
QRAWLNLVQPLTIVEGFALLSV

SEQ ID NO: 1472206 - protein, 19 aa, Mycobacterium tuberculosis
QRIAAFGAYVVAYDPYVSP

SEQ ID NO: 1472207 - protein, 18 aa, Mycobacterium tuberculosis
QRNGFDCPGCAWPEEPGG

SEQ ID NO: 1472208 - protein, 17 aa, Mycobacterium tuberculosis
QRPELVLDRVRAFLAAG

SEQ ID NO: 1472209 - protein, 20 aa, Mycobacterium tuberculosis
QRPGQRLAYNGRLLELPDIK

SEQ ID NO: 1472210 - protein, 23 aa, Mycobacterium tuberculosis
QRRFEWLLSVLRLADRLIPHRAW

SEQ ID NO: 1472211 - protein, 17 aa, Mycobacterium tuberculosis
QRSAAVIARNIEALGLS

SEQ ID NO: 1472212 - protein, 23 aa, Mycobacterium tuberculosis
QRWLADHVIAGVVLLAGAAFVEL

SEQ ID NO: 1472213 - protein, 17 aa, Mycobacterium tuberculosis
QRYRDRYIFAGLQPGQR

SEQ ID NO: 1472214 - protein, 25 aa, Mycobacterium tuberculosis
QSARAGDPFQHWIGRRFDAVATDKP

SEQ ID NO: 1472215 - protein, 20 aa, Mycobacterium tuberculosis
QSLTGRPLIGDGANGIDGTG

SEQ ID NO: 1472216 - protein, 17 aa, Mycobacterium tuberculosis
QTDQRWAELVYDGLWYS

SEQ ID NO: 1472217 - protein, 24 aa, Mycobacterium tuberculosis
QTLLGRPLIGNGADGGPGQNGGPG

SEQ ID NO: 1472218 - protein, 20 aa, Mycobacterium tuberculosis
QYLRVRFVYQSGREDAVKTF

SEQ ID NO: 1472219 - protein, 18 aa, Mycobacterium tuberculosis
RACTPVWSGVGLHRPAEF

SEQ ID NO: 1472220 - protein, 18 aa, Mycobacterium tuberculosis
RAGARILLAPDGPDLRVQ

SEQ ID NO: 1472221 - protein, 28 aa, Mycobacterium tuberculosis
RAGGVLRRSIKFPTFMAGIDAVRRVAER

SEQ ID NO: 1472222 - protein, 17 aa, Mycobacterium tuberculosis
RAGYMYGTVLARGLRGH

SEQ ID NO: 1472223 - protein, 17 aa, Mycobacterium tuberculosis
RAHGIAFETSWLDPFTE

SEQ ID NO: 1472224 - protein, 23 aa, Mycobacterium tuberculosis
RALKEASYRLGARTLYHQFGAPL

SEQ ID NO: 1472225 - protein, 19 aa, Mycobacterium tuberculosis
RALPDRQRHASLLPLLHNY

SEQ ID NO: 1472226 - protein, 20 aa, Mycobacterium tuberculosis
RALTTMPIPVIAAVRGLAVG

SEQ ID NO: 1472227 - protein, 17 aa, Mycobacterium tuberculosis
RAPRGVLAIAYRCPNGE

SEQ ID NO: 1472228 - protein, 23 aa, Mycobacterium tuberculosis
RARFGVPVPNLTAWRDATVGDMT

SEQ ID NO: 1472229 - protein, 18 aa, Mycobacterium tuberculosis
RASGLEVRDEFVVGSLAG

SEQ ID NO: 1472230 - protein, 17 aa, Mycobacterium tuberculosis
RASIEAVFASWNSPRAV

SEQ ID NO: 1472231 - protein, 18 aa, Mycobacterium tuberculosis
RASKATVYRRWPSKAELV

SEQ ID NO: 1472232 - protein, 17 aa, Mycobacterium tuberculosis
RATIEAVLAKLAAPGAC

SEQ ID NO: 1472233 - protein, 17 aa, Mycobacterium tuberculosis
RCAPAALRYLSQARHTG

SEQ ID NO: 1472234 - protein, 21 aa, Mycobacterium tuberculosis
RDALRCFASLFGDEALDPLDY

SEQ ID NO: 1472235 - protein, 21 aa, Mycobacterium tuberculosis
RDLRLRVLSWGAAPAPDALLR

SEQ ID NO: 1472236 - protein, 17 aa, Mycobacterium tuberculosis
RDMAGRFEVHAQTVEDE

SEQ ID NO: 1472237 - protein, 17 aa, Mycobacterium tuberculosis
RDMVHPLIARPLPAETG

SEQ ID NO: 1472238 - protein, 23 aa, Mycobacterium tuberculosis
RDPGIPVVIGRNVSGPVSGPNED

SEQ ID NO: 1472239 - protein, 22 aa, Mycobacterium tuberculosis
RDRTCVVPGCGATRGLHAHHIR

SEQ ID NO: 1472240 - protein, 21 aa, Mycobacterium tuberculosis
RDVDWWLTFSSAAALLGTPGQ

SEQ ID NO: 1472241 - protein, 21 aa, Mycobacterium tuberculosis
RDVPYDVLASFRYLAQGHHRA

SEQ ID NO: 1472242 - protein, 18 aa, Mycobacterium tuberculosis
REAKKICMGCEVRHECLE

SEQ ID NO: 1472243 - protein, 20 aa, Mycobacterium tuberculosis
REFGVTTGRRRRCGWFDAVI

SEQ ID NO: 1472244 - protein, 18 aa, Mycobacterium tuberculosis
REGIACAVLRRPDHRDTY

SEQ ID NO: 1472245 - protein, 22 aa, Mycobacterium tuberculosis
REIPANRPGRAVSMEKHHLMIG

SEQ ID NO: 1472246 - protein, 21 aa, Mycobacterium tuberculosis
RELKKLVPITTFLRRSPYLAA

SEQ ID NO: 1472247 - protein, 26 aa, Mycobacterium tuberculosis
REPVRSLVWIRGCLHQIPPAELVETL

SEQ ID NO: 1472248 - protein, 17 aa, Mycobacterium tuberculosis
REREANLIPGGKSLSGG

SEQ ID NO: 1472249 - protein, 21 aa, Mycobacterium tuberculosis
RERGWPQFADRLLELAREAEP

SEQ ID NO: 1472250 - protein, 24 aa, Mycobacterium tuberculosis
RERLDFSCALFDPDGNLVANAPHI

SEQ ID NO: 1472251 - protein, 19 aa, Mycobacterium tuberculosis
RERYSMLAACFEPDVACEI

SEQ ID NO: 1472252 - protein, 18 aa, Mycobacterium tuberculosis
RESIKATLTFRDPKELRF

SEQ ID NO: 1472253 - protein, 26 aa, Mycobacterium tuberculosis
REVPADLRQDWPAALRDAGFDPTART

SEQ ID NO: 1472254 - protein, 20 aa, Mycobacterium tuberculosis
RFAECPTFPAPPPREILDAA

SEQ ID NO: 1472255 - protein, 24 aa, Mycobacterium tuberculosis
RFLMSVGALIIGWLLQRQAAVAVA

SEQ ID NO: 1472256 - protein, 18 aa, Mycobacterium tuberculosis
RFVFANADAFSWSQTFES

SEQ ID NO: 1472257 - protein, 17 aa, Mycobacterium tuberculosis
RGARKRPTSGWGALTPT

SEQ ID NO: 1472258 - protein, 20 aa, Mycobacterium tuberculosis
RGDVALLRLSFGRFGDEPAL

SEQ ID NO: 1472259 - protein, 29 aa, Mycobacterium tuberculosis
RGEIARRVFATCRRLGLGTVAVYTDPDAA

SEQ ID NO: 1472260 - protein, 18 aa, Mycobacterium tuberculosis
RGGKLSLRVIALVNGTVI

SEQ ID NO: 1472261 - protein, 24 aa, Mycobacterium tuberculosis
RGLLPPTFSLVGFARRDWSTQDFG

SEQ ID NO: 1472262 - protein, 17 aa, Mycobacterium tuberculosis
RGLPLLDLKDLRAVITH

SEQ ID NO: 1472263 - protein, 19 aa, Mycobacterium tuberculosis
RGPHRVLRGDLAFAGLPGV

SEQ ID NO: 1472264 - protein, 18 aa, Mycobacterium tuberculosis
RGQGFLALVDYAHKPEAL

SEQ ID NO: 1472265 - protein, 21 aa, Mycobacterium tuberculosis
RGREICGMPSSGGVAVAATLG

SEQ ID NO: 1472266 - protein, 20 aa, Mycobacterium tuberculosis
RGVEAAERLATRRRQLLSAG

SEQ ID NO: 1472267 - protein, 17 aa, Mycobacterium tuberculosis
RHFSALRPIGGGRFTVI

SEQ ID NO: 1472268 - protein, 17 aa, Mycobacterium tuberculosis
RHGARRMVIAPWLLAPG

SEQ ID NO: 1472269 - protein, 22 aa, Mycobacterium tuberculosis
RHGRPLLRHRVELGAGSLADDV

SEQ ID NO: 1472270 - protein, 19 aa, Mycobacterium tuberculosis
RHRAVLRAADRLELAEGLR

SEQ ID NO: 1472271 - protein, 25 aa, Mycobacterium tuberculosis
RIEAHALGMVFGRKRPGSGPLMIGS

SEQ ID NO: 1472272 - protein, 21 aa, Mycobacterium tuberculosis
RILRVRGRGVPKRSGGSGDLL

SEQ ID NO: 1472273 - protein, 17 aa, Mycobacterium tuberculosis
RIMRGGNPLAYLDSGAT

SEQ ID NO: 1472274 - protein, 17 aa, Mycobacterium tuberculosis
RIRVDGVAYDREEQTEG

SEQ ID NO: 1472275 - protein, 17 aa, Mycobacterium tuberculosis
RKASLPFTARRTLFNNT

SEQ ID NO: 1472276 - protein, 18 aa, Mycobacterium tuberculosis
RKGFEFEELEAAGLSRQG

SEQ ID NO: 1472277 - protein, 24 aa, Mycobacterium tuberculosis
RKLDRKATLAFAFSHRSYLDGMLL

SEQ ID NO: 1472278 - protein, 17 aa, Mycobacterium tuberculosis
RKNHKVFRRRRFFEGEP

SEQ ID NO: 1472279 - protein, 18 aa, Mycobacterium tuberculosis
RLAAHLRFLGQVDDAGKA

SEQ ID NO: 1472280 - protein, 18 aa, Mycobacterium tuberculosis
RLAEIRKALGHARQADVA

SEQ ID NO: 1472281 - protein, 21 aa, Mycobacterium tuberculosis
RLALDLRWEAAAGLTVHAPSL

SEQ ID NO: 1472282 - protein, 23 aa, Mycobacterium tuberculosis
RLARHRPEIPIGVNIGKTKKTPA

SEQ ID NO: 1472283 - protein, 17 aa, Mycobacterium tuberculosis
RLASVLRRCTVLDAHLR

SEQ ID NO: 1472284 - protein, 22 aa, Mycobacterium tuberculosis
RLDRPGWFYPPTVITDISKDMA

SEQ ID NO: 1472285 - protein, 24 aa, Mycobacterium tuberculosis
RLDSKRSAVDLALRRLVGEPLGRD

SEQ ID NO: 1472286 - protein, 18 aa, Mycobacterium tuberculosis
RLEAEGHRILKLNIGNPA

SEQ ID NO: 1472287 - protein, 17 aa, Mycobacterium tuberculosis
RLLAEPTAWLFGPEAHG

SEQ ID NO: 1472288 - protein, 25 aa, Mycobacterium tuberculosis
RLLFKRNICHQAIFYRRGLFGTIGP

SEQ ID NO: 1472289 - protein, 21 aa, Mycobacterium tuberculosis
RLLRSGGVIVVHRAALGGRAG

SEQ ID NO: 1472290 - protein, 27 aa, Mycobacterium tuberculosis
RLPEIPQLRWRVTGAPLGLDRPWFVED

SEQ ID NO: 1472291 - protein, 23 aa, Mycobacterium tuberculosis
RLPQKVGIGLARRMSLTGDYLSA

SEQ ID NO: 1472292 - protein, 22 aa, Mycobacterium tuberculosis
RLPRIDCRGGVQARRTAPDTVH

SEQ ID NO: 1472293 - protein, 20 aa, Mycobacterium tuberculosis
RLRQAGTFADAALRRVLEVI

SEQ ID NO: 1472294 - protein, 24 aa, Mycobacterium tuberculosis
RLTKPPLLVPVLRAGLGMVDEAHA

SEQ ID NO: 1472295 - protein, 17 aa, Mycobacterium tuberculosis
RLTKVLGLPGPHRRTQR

SEQ ID NO: 1472296 - protein, 18 aa, Mycobacterium tuberculosis
RLVAHPTESFGLRITDPS

SEQ ID NO: 1472297 - protein, 18 aa, Mycobacterium tuberculosis
RMRPGLDVRVAFCELNSP

SEQ ID NO: 1472298 - protein, 18 aa, Mycobacterium tuberculosis
RMWAASGVDYPTLLATMI

SEQ ID NO: 1472299 - protein, 17 aa, Mycobacterium tuberculosis
RNGALRMVRGVKNRFGA

SEQ ID NO: 1472300 - protein, 17 aa, Mycobacterium tuberculosis
RNLPTPSGNTFEWDPNS

SEQ ID NO: 1472301 - protein, 17 aa, Mycobacterium tuberculosis
RNPEVFVNARVDTYWLR

SEQ ID NO: 1472302 - protein, 22 aa, Mycobacterium tuberculosis
RNRISGTLGVRFARSGETAVTL

SEQ ID NO: 1472303 - protein, 22 aa, Mycobacterium tuberculosis
RPDETVPCLTQRQVLDQAPDAV

SEQ ID NO: 1472304 - protein, 21 aa, Mycobacterium tuberculosis
RPDIMIVVGGVIPPGDFDELY

SEQ ID NO: 1472305 - protein, 18 aa, Mycobacterium tuberculosis
RPFHIDWDLAAAEKGGYE

SEQ ID NO: 1472306 - protein, 18 aa, Mycobacterium tuberculosis
RPLMSDAMLRVFFEAYEI

SEQ ID NO: 1472307 - protein, 17 aa, Mycobacterium tuberculosis
RPLRPLAPVAHLDFDEP

SEQ ID NO: 1472308 - protein, 17 aa, Mycobacterium tuberculosis
RPMLPLWPPSRVPSPPV

SEQ ID NO: 1472309 - protein, 29 aa, Mycobacterium tuberculosis
RPNPSRLCDWCPHQQRCPAFGGTPPPYPG

SEQ ID NO: 1472310 - protein, 19 aa, Mycobacterium tuberculosis
RPSAVWTTWLPVAETPHTR

SEQ ID NO: 1472311 - protein, 20 aa, Mycobacterium tuberculosis
RPTGAFMFLGPTGVGKTELA

SEQ ID NO: 1472312 - protein, 19 aa, Mycobacterium tuberculosis
RQAMLPGHAVVLHPGPMVR

SEQ ID NO: 1472313 - protein, 19 aa, Mycobacterium tuberculosis
RQRHWVEPNHTVWAQAPGA

SEQ ID NO: 1472314 - protein, 20 aa, Mycobacterium tuberculosis
RRAGGCWRTAQNAVGPLWSI

SEQ ID NO: 1472315 - protein, 21 aa, Mycobacterium tuberculosis
RRASGRRKAWLRQAINHLEKL

SEQ ID NO: 1472316 - protein, 27 aa, Mycobacterium tuberculosis
RRDAIRHAVAWARPGDVVLIAGKGHET

SEQ ID NO: 1472317 - protein, 20 aa, Mycobacterium tuberculosis
RRESRFPISEIIAQTPPIPD

SEQ ID NO: 1472318 - protein, 24 aa, Mycobacterium tuberculosis
RRFLPRCAAGAISAFLLTEPDVGS

SEQ ID NO: 1472319 - protein, 21 aa, Mycobacterium tuberculosis
RRFNFPDGETHTWAYWRAPLQ

SEQ ID NO: 1472320 - protein, 17 aa, Mycobacterium tuberculosis
RRGELVMVFPGGAREVN

SEQ ID NO: 1472321 - protein, 19 aa, Mycobacterium tuberculosis
RRLGLKRLLRSDILPISFG

SEQ ID NO: 1472322 - protein, 17 aa, Mycobacterium tuberculosis
RRLKTQWRKLAAATPSR

SEQ ID NO: 1472323 - protein, 18 aa, Mycobacterium tuberculosis
RRLVGLFCQQGHFDRSKA

SEQ ID NO: 1472324 - protein, 17 aa, Mycobacterium tuberculosis
RRPLLVLQVGDRVTHDK

SEQ ID NO: 1472325 - protein, 19 aa, Mycobacterium tuberculosis
RRRRELLRRNNLDGTLQEI

SEQ ID NO: 1472326 - protein, 20 aa, Mycobacterium tuberculosis
RRVFAPKVTGSWRLHVATAA

SEQ ID NO: 1472327 - protein, 22 aa, Mycobacterium tuberculosis
RRVRARLARRMTAQRSTTNPVL

SEQ ID NO: 1472328 - protein, 18 aa, Mycobacterium tuberculosis
RRYYRVSGADAYTMRRDS

SEQ ID NO: 1472329 - protein, 18 aa, Mycobacterium tuberculosis
RSALRWLRTVNRSPGLVS

SEQ ID NO: 1472330 - protein, 17 aa, Mycobacterium tuberculosis
RSGAGLFGSIAQLVKVL

SEQ ID NO: 1472331 - protein, 19 aa, Mycobacterium tuberculosis
RSSEMIICGGVNIAPDEVD

SEQ ID NO: 1472332 - protein, 20 aa, Mycobacterium tuberculosis
RTAQWVLPWPNPRYSKLARV

SEQ ID NO: 1472333 - protein, 28 aa, Mycobacterium tuberculosis
RTHLQFRRFAACPICHLHLRSFANRHQE

SEQ ID NO: 1472334 - protein, 17 aa, Mycobacterium tuberculosis
RTPWRLNQNYLRDIRLI

SEQ ID NO: 1472335 - protein, 21 aa, Mycobacterium tuberculosis
RTRHECTGLSSPIDALDGVST

SEQ ID NO: 1472336 - protein, 20 aa, Mycobacterium tuberculosis
RTYQPRIVFVDAYNKPIDMG

SEQ ID NO: 1472337 - protein, 18 aa, Mycobacterium tuberculosis
RVIVACFASNVDRVQQII

SEQ ID NO: 1472338 - protein, 19 aa, Mycobacterium tuberculosis
RVLAFFVSACSAPGHIRYK

SEQ ID NO: 1472339 - protein, 25 aa, Mycobacterium tuberculosis
RVLPLLGGLAVMFGDLPPLPTTARF

SEQ ID NO: 1472340 - protein, 28 aa, Mycobacterium tuberculosis
RVLSRDGVFPLAAFRKIVDINLVGTFNV

SEQ ID NO: 1472341 - protein, 25 aa, Mycobacterium tuberculosis
RVLVWDGEGAIGRWRGGRSELTTEC

SEQ ID NO: 1472342 - protein, 19 aa, Mycobacterium tuberculosis
RVRESDVYTPTLFLTARDS

SEQ ID NO: 1472343 - protein, 19 aa, Mycobacterium tuberculosis
RVSRAMFNELWAGFDPDEV

SEQ ID NO: 1472344 - protein, 25 aa, Mycobacterium tuberculosis
RVVAKIYCGLGLLKRENIREVHRAD

SEQ ID NO: 1472345 - protein, 22 aa, Mycobacterium tuberculosis
RVVERFGDLVFDTVITRTVRFP

SEQ ID NO: 1472346 - protein, 21 aa, Mycobacterium tuberculosis
RVVVMPWDRHIAAGTEISLDL

SEQ ID NO: 1472347 - protein, 18 aa, Mycobacterium tuberculosis
RVWAPKATGALRMHEATA

SEQ ID NO: 1472348 - protein, 19 aa, Mycobacterium tuberculosis
RWARERAQRAVSGMASVAI

SEQ ID NO: 1472349 - protein, 19 aa, Mycobacterium tuberculosis
RWMQLLATSGRCFSAAPNF

SEQ ID NO: 1472350 - protein, 25 aa, Mycobacterium tuberculosis
RWPSKAELVLAAFIEGIRQVAVPPN

SEQ ID NO: 1472351 - protein, 23 aa, Mycobacterium tuberculosis
RWSAVLVGPWWPAPSAALRAAAQ

SEQ ID NO: 1472352 - protein, 20 aa, Mycobacterium tuberculosis
RWVVDPDFNLDFHVRRVRVS

SEQ ID NO: 1472353 - protein, 20 aa, Mycobacterium tuberculosis
RYDVTFSLGDGLRPGSIADA

SEQ ID NO: 1472354 - protein, 19 aa, Mycobacterium tuberculosis
RYGRRRHVRSLGSQVIDVR

SEQ ID NO: 1472355 - protein, 20 aa, Mycobacterium tuberculosis
RYIILKGRNSEHLFVAAESL

SEQ ID NO: 1472356 - protein, 20 aa, Mycobacterium tuberculosis
RYRCYTDRLTRLSCGYSATS

SEQ ID NO: 1472357 - protein, 17 aa, Mycobacterium tuberculosis
SAAPLEGVLDVINAPAL

SEQ ID NO: 1472358 - protein, 18 aa, Mycobacterium tuberculosis
SAAYRYPGSMCVGFPKVL

SEQ ID NO: 1472359 - protein, 26 aa, Mycobacterium tuberculosis
SAEGRVAALRRCVPMVGQIKDPTLRD

SEQ ID NO: 1472360 - protein, 24 aa, Mycobacterium tuberculosis
SAERFVLGVGFGWNVEELADHGVP

SEQ ID NO: 1472361 - protein, 19 aa, Mycobacterium tuberculosis
SAEYLRLLRRHNVAAALSG

SEQ ID NO: 1472362 - protein, 22 aa, Mycobacterium tuberculosis
SAGRGGDAGFFYGNGGAGGSGA

SEQ ID NO: 1472363 - protein, 20 aa, Mycobacterium tuberculosis
SAHSPYYRLVALRLATVGLR

SEQ ID NO: 1472364 - protein, 24 aa, Mycobacterium tuberculosis
SAQAALFHEQFVRALTAGAGSYAA

SEQ ID NO: 1472365 - protein, 17 aa, Mycobacterium tuberculosis
SARMGRFGDVDRLAERA

SEQ ID NO: 1472366 - protein, 20 aa, Mycobacterium tuberculosis
SARPYAFEITRMLTTLAAEA

SEQ ID NO: 1472367 - protein, 20 aa, Mycobacterium tuberculosis
SAVRARIAPVGPSAVSIELA

SEQ ID NO: 1472368 - protein, 24 aa, Mycobacterium tuberculosis
SDAAQWLATHGWQVHSVSNREEMA

SEQ ID NO: 1472369 - protein, 20 aa, Mycobacterium tuberculosis
SDDEFGFFVVMLAVAGNETT

SEQ ID NO: 1472370 - protein, 21 aa, Mycobacterium tuberculosis
SDGEIAEAAWFTRDEVRAALA

SEQ ID NO: 1472371 - protein, 21 aa, Mycobacterium tuberculosis
SDGFAGLGGSGGRGGDAGLIG

SEQ ID NO: 1472372 - protein, 22 aa, Mycobacterium tuberculosis
SDKVVRFILGLVQRYGPGLFGA

SEQ ID NO: 1472373 - protein, 21 aa, Mycobacterium tuberculosis
SDLLVIFGITGDLARKMTFRA

SEQ ID NO: 1472374 - protein, 18 aa, Mycobacterium tuberculosis
SEIRPELRRLDLGKLLEL

SEQ ID NO: 1472375 - protein, 34 aa, Mycobacterium tuberculosis; identical to SEQ ID NO: 206357

SEQ ID NO: 1472376 - protein, 27 aa, Mycobacterium tuberculosis
SFVALCRAAGVPARIAFQTIDAPDKEF

SEQ ID NO: 1472377 - protein, 17 aa, Mycobacterium tuberculosis
SGALLNICVSYRITGDI

SEQ ID NO: 1472378 - protein, 25 aa, Mycobacterium tuberculosis
SGDPYRLAAQLGMPPWRVQKAQKQA

SEQ ID NO: 1472379 - protein, 27 aa, Mycobacterium tuberculosis
SGGAGGAGGFGFLGGDGGAGGNAGLLL

SEQ ID NO: 1472380 - protein, 19 aa, Mycobacterium tuberculosis
SGGRPAALYRFTDSQLRVT

SEQ ID NO: 1472381 - protein, 29 aa, Mycobacterium tuberculosis
SGLDARAYRLAWPVGSIVYEVDMPEVIEF

SEQ ID NO: 1472382 - protein, 20 aa, Mycobacterium tuberculosis
SGLTGDDWLGPSALSMAAAA

SEQ ID NO: 1472383 - protein, 24 aa, Mycobacterium tuberculosis
SGMPRLYREAPLMGIWEGSGNVSA

SEQ ID NO: 1472384 - protein, 17 aa, Mycobacterium tuberculosis
SGPAADDMAVAWAASAA

SEQ ID NO: 1472385 - protein, 18 aa, Mycobacterium tuberculosis
SGPARWFLDHARVALSSG

SEQ ID NO: 1472386 - protein, 22 aa, Mycobacterium tuberculosis
SGPPGAAALAFPSLSSSVPILG

SEQ ID NO: 1472387 - protein, 27 aa, Mycobacterium tuberculosis
SGQPGQFGSPGADGRGGAGGAGGGGGA

SEQ ID NO: 1472388 - protein, 17 aa, Mycobacterium tuberculosis
SGTAVFEIFFRKLPPGR

SEQ ID NO: 1472389 - protein, 26 aa, Mycobacterium tuberculosis
SGTPRASGPAGMTGMPMVPPGALGAG

SEQ ID NO: 1472390 - protein, 17 aa, Mycobacterium tuberculosis
SIMPGKVNPVLPEAVTQ

SEQ ID NO: 1472391 - protein, 25 aa, Mycobacterium tuberculosis
SIPEIDIHTLVAFACRELLLSEDVR

SEQ ID NO: 1472392 - protein, 23 aa, Mycobacterium tuberculosis
SIPLIKIPAAPGFGNSTTSPSSG

SEQ ID NO: 1472393 - protein, 22 aa, Mycobacterium tuberculosis
SIRTILRALAIHRRPSANSKLG

SEQ ID NO: 1472394 - protein, 24 aa, Mycobacterium tuberculosis
SISPITVRIDPVFDLGPITVQDIT

SEQ ID NO: 1472395 - protein, 20 aa, Mycobacterium tuberculosis
SKAARKVWDTADKFTRDTLG

SEQ ID NO: 1472396 - protein, 19 aa, Mycobacterium tuberculosis
SKELWRRMSAAGDIYLDNY

SEQ ID NO: 1472397 - protein, 20 aa, Mycobacterium tuberculosis
SKSPRCTWPAHIVDVKRAIA

SEQ ID NO: 1472398 - protein, 19 aa, Mycobacterium tuberculosis
SKTGREFGVTTGRRRRCGW

SEQ ID NO: 1472399 - protein, 19 aa, Mycobacterium tuberculosis
SLATDSWLSAASFQETTRV

SEQ ID NO: 1472400 - protein, 39 aa, Mycobacterium tuberculosis; identical to SEQ ID NO: 234270

SEQ ID NO: 1472401 - protein, 21 aa, Mycobacterium tuberculosis
SMGALHSWCLAAERPELVSAL

SEQ ID NO: 1472402 - protein, 22 aa, Mycobacterium tuberculosis
SMILHEILPIDVSINLEDAVFI

SEQ ID NO: 1472403 - protein, 18 aa, Mycobacterium tuberculosis
SMKMEIPVLAEAAGTVSK

SEQ ID NO: 1472404 - protein, 18 aa, Mycobacterium tuberculosis
SPAACRRIAIAAHDGLAR

SEQ ID NO: 1472405 - protein, 19 aa, Mycobacterium tuberculosis
SPCGLAELCDRTDLPRATA

SEQ ID NO: 1472406 - protein, 18 aa, Mycobacterium tuberculosis
SPGLELYSPAQLGLDHGH

SEQ ID NO: 1472407 - protein, 28 aa, Mycobacterium tuberculosis
SPVAGTVRFNWDPLRWFEEDEPIHGHPR

SEQ ID NO: 1472408 - protein, 19 aa, Mycobacterium tuberculosis
SREIEVLEFVPAADVDPMM

SEQ ID NO: 1472409 - protein, 19 aa, Mycobacterium tuberculosis
SRGAPWRRVESRAVDGVSF

SEQ ID NO: 1472410 - protein, 18 aa, Mycobacterium tuberculosis
SRVRLCPTPGHLHFFAVD

SEQ ID NO: 1472411 - protein, 18 aa, Mycobacterium tuberculosis
SSGIQGNMGPPGTQGADG

SEQ ID NO: 1472412 - protein, 24 aa, Mycobacterium tuberculosis
SSLYPDSLHIMGWDVGSHGLRLRL

SEQ ID NO: 1472413 - protein, 18 aa, Mycobacterium tuberculosis
SSVISGLTGDDWLGPSAL

SEQ ID NO: 1472414 - protein, 22 aa, Mycobacterium tuberculosis
SSWCAGRRALAEAACRAFDALA

SEQ ID NO: 1472415 - protein, 30 aa, Mycobacterium tuberculosis; identical to SEQ ID NO: 234295

SEQ ID NO: 1472416 - protein, 17 aa, Mycobacterium tuberculosis
STGAVALFSARAASDDG

SEQ ID NO: 1472417 - protein, 17 aa, Mycobacterium tuberculosis
STGFARDLADYIQEQGW

SEQ ID NO: 1472418 - protein, 17 aa, Mycobacterium tuberculosis
STIGRRLAKALGVGLLD

SEQ ID NO: 1472419 - protein, 24 aa, Mycobacterium tuberculosis
STVGRRILQRGLWFEEFQIGTTYL

SEQ ID NO: 1472420 - protein, 34 aa, Mycobacterium tuberculosis
SVADWLTDHGWRARSQRAPDEMRRVGRWVEGVPM

SEQ ID NO: 1472421 - protein, 18 aa, Mycobacterium tuberculosis
SVGSPWLADTWRDRFEQM

SEQ ID NO: 1472422 - protein, 21 aa, Mycobacterium tuberculosis
SVHVRGSVVLDRLSRKSQSAG

SEQ ID NO: 1472423 - protein, 23 aa, Mycobacterium tuberculosis
SVSDALDILRWAPQAASGPVAKV

SEQ ID NO: 1472424 - protein, 26 aa, Mycobacterium tuberculosis
SVSSSLVRRAGCPVAVIHSDDAVIPD

SEQ ID NO: 1472425 - protein, 18 aa, Mycobacterium tuberculosis
SWDLRKFLWAPRLGCYGI

SEQ ID NO: 1472426 - protein, 23 aa, Mycobacterium tuberculosis
SYLPSELVAAFLWAQFEEAERIT

SEQ ID NO: 1472427 - protein, 17 aa, Mycobacterium tuberculosis
SYLVSLLPSRIVADLGA

SEQ ID NO: 1472428 - protein, 17 aa, Mycobacterium tuberculosis
TAIVARVPVRAFINPAN

SEQ ID NO: 1472429 - protein, 24 aa, Mycobacterium tuberculosis
TAPGHMLGGLPLGHSVNAGSGINN

SEQ ID NO: 1472430 - protein, 19 aa, Mycobacterium tuberculosis
TAPQCTHYPLAEAADAIRA

SEQ ID NO: 1472431 - protein, 19 aa, Mycobacterium tuberculosis
TARMVRSRLDAELVGNVSI

SEQ ID NO: 1472432 - protein, 25 aa, Mycobacterium tuberculosis
TASDFWGGAGSAACQGFITQLGRNF

SEQ ID NO: 1472433 - protein, 17 aa, Mycobacterium tuberculosis
TASHHRRALGIQRLLAA

SEQ ID NO: 1472434 - protein, 33 aa, Mycobacterium tuberculosis; identical to SEQ ID NO: 210177

SEQ ID NO: 1472435 - protein, 29 aa, Mycobacterium tuberculosis
TATFHEDPVAGVWAVGGVGGDGGSGGSSL

SEQ ID NO: 1472436 - protein, 26 aa, Mycobacterium tuberculosis
TATPLRPGIWRAYADHRMAMAGAIIG

SEQ ID NO: 1472437 - protein, 19 aa, Mycobacterium tuberculosis
TAWLAEGMLIYLPPDPRTR

SEQ ID NO: 1472438 - protein, 24 aa, Mycobacterium tuberculosis
TCDRSRLTADGLWLHCLYAISGIN

SEQ ID NO: 1472439 - protein, 38 aa, Mycobacterium tuberculosis; identical to SEQ ID NO: 211836

SEQ ID NO: 1472440 - protein, 17 aa, Mycobacterium tuberculosis
TDAVEFGAAKGFAVTEL

SEQ ID NO: 1472441 - protein, 20 aa, Mycobacterium tuberculosis
TDEIKRRILAMAQPDADGNR

SEQ ID NO: 1472442 - protein, 22 aa, Mycobacterium tuberculosis
TEALVGRKLIGDGAHGAPGTGQ

SEQ ID NO: 1472443 - protein, 20 aa, Mycobacterium tuberculosis
TEFNSQFSAAVRKIYDSGHN

SEQ ID NO: 1472444 - protein, 17 aa, Mycobacterium tuberculosis
TEHFLRSVFRDAPHEEP

SEQ ID NO: 1472445 - protein, 25 aa, Mycobacterium tuberculosis
TEIDNLRAAFAWSRENDHITEALQL

SEQ ID NO: 1472446 - protein, 19 aa, Mycobacterium tuberculosis
TFIEVCYLLIYGELPDTDQ

SEQ ID NO: 1472447 - protein, 25 aa, Mycobacterium tuberculosis
TFLRAIGAIPRFSARSSARTWLLAI

SEQ ID NO: 1472448 - protein, 29 aa, Mycobacterium tuberculosis
TFPEFPLPLGDPSVRCGGDLLSMMLMDEQ

SEQ ID NO: 1472449 - protein, 17 aa, Mycobacterium tuberculosis
TFTPKHMGVMFGAPGGD

SEQ ID NO: 1472450 - protein, 19 aa, Mycobacterium tuberculosis
TGCAEMFRIGYIDVNQFTC

SEQ ID NO: 1472451 - protein, 17 aa, Mycobacterium tuberculosis
TGFNWPAPDHLRLVTLP

SEQ ID NO: 1472452 - protein, 20 aa, Mycobacterium tuberculosis
TGHGFLDWPAGAREATTARL

SEQ ID NO: 1472453 - protein, 24 aa, Mycobacterium tuberculosis
TGIGAPANVSGMFNIGSNLAGFFH

SEQ ID NO: 1472454 - protein, 25 aa, Mycobacterium tuberculosis
TGIIGWPALVMLFAGPRVGEPGKPV

SEQ ID NO: 1472455 - protein, 19 aa, Mycobacterium tuberculosis
TGSWLRRDRRTFTATQLVL

SEQ ID NO: 1472456 - protein, 22 aa, Mycobacterium tuberculosis
TGVLHWNRRVQAWLAEETGQPP

SEQ ID NO: 1472457 - protein, 18 aa, Mycobacterium tuberculosis
THLGLPADFLLDADGTVA

SEQ ID NO: 1472458 - protein, 19 aa, Mycobacterium tuberculosis
TIHGARAYAAFCEFADTTP

SEQ ID NO: 1472459 - protein, 17 aa, Mycobacterium tuberculosis
TIIPDFIGHTFAVHDGR

SEQ ID NO: 1472460 - protein, 21 aa, Mycobacterium tuberculosis
TILLECTMAGMATCTLTHLIE

SEQ ID NO: 1472461 - protein, 21 aa, Mycobacterium tuberculosis
TIPQFRTLVILSNHGPINLAT

SEQ ID NO: 1472462 - protein, 26 aa, Mycobacterium tuberculosis
TKGFKFSTYATWWIRQAITRGMADQS

SEQ ID NO: 1472463 - protein, 17 aa, Mycobacterium tuberculosis
TKHSRQILETAYVIDFL

SEQ ID NO: 1472464 - protein, 23 aa, Mycobacterium tuberculosis
TKIRLLTRIAFGFRSPEALIALA

SEQ ID NO: 1472465 - protein, 19 aa, Mycobacterium tuberculosis
TKKHWRAPSKLAYIDAGLI

SEQ ID NO: 1472466 - protein, 26 aa, Mycobacterium tuberculosis
TKSGAWCVAADFSVGMLAAGAARKVP

SEQ ID NO: 1472467 - protein, 25 aa, Mycobacterium tuberculosis
TLAPHLVKPLPFLFPLTKRWWERPY

SEQ ID NO: 1472468 - protein, 19 aa, Mycobacterium tuberculosis
TLASQAAHVVMRFQQGLAE

SEQ ID NO: 1472469 - protein, 18 aa, Mycobacterium tuberculosis
TLDVCVRDGLMSSRAAEA

SEQ ID NO: 1472470 - protein, 23 aa, Mycobacterium tuberculosis
TLGLVEVLCIRRRIRTGDQPLAL

SEQ ID NO: 1472471 - protein, 25 aa, Mycobacterium tuberculosis
TLGSYRWLRPSGRRTAKEIAAEFST

SEQ ID NO: 1472472 - protein, 24 aa, Mycobacterium tuberculosis
TLIPRARAKISIRVAPGGDATAHL

SEQ ID NO: 1472473 - protein, 19 aa, Mycobacterium tuberculosis
TLLGRPLIGNGADGGPGQN

SEQ ID NO: 1472474 - protein, 20 aa, Mycobacterium tuberculosis
TLRRWRYGRRRHVRSLGSQV

SEQ ID NO: 1472475 - protein, 27 aa, Mycobacterium tuberculosis
TMADPGSVSYLFSRKGVVTLEKNGLTE

SEQ ID NO: 1472476 - protein, 19 aa, Mycobacterium tuberculosis
TMAGMATCTLTHLIESSDS

SEQ ID NO: 1472477 - protein, 19 aa, Mycobacterium tuberculosis
TMCAGLFAGVGRKFSDEEL

SEQ ID NO: 1472478 - protein, 20 aa, Mycobacterium tuberculosis
TNFRWGGAFDLDRLLFKRNI

SEQ ID NO: 1472479 - protein, 17 aa, Mycobacterium tuberculosis
TPCRGQEAAQVGAAACL

SEQ ID NO: 1472480 - protein, 23 aa, Mycobacterium tuberculosis
TPEFAIPPIGVGGFTLPQITTQE

SEQ ID NO: 1472481 - protein, 21 aa, Mycobacterium tuberculosis
TPETLLGCPGEIDIGHRTIPN

SEQ ID NO: 1472482 - protein, 18 aa, Mycobacterium tuberculosis
TPIPKVYLCSAATPPGAG

SEQ ID NO: 1472483 - protein, 19 aa, Mycobacterium tuberculosis
TPLRTVVRANLKSIYQHAI

SEQ ID NO: 1472484 - protein, 23 aa, Mycobacterium tuberculosis
TPVRKACTVLAVLAATLLLGACG

SEQ ID NO: 1472485 - protein, 17 aa, Mycobacterium tuberculosis
TRIGTVLGILKAYTTRV

SEQ ID NO: 1472486 - protein, 18 aa, Mycobacterium tuberculosis
TRNYRELYGLLAVNSIWF

SEQ ID NO: 1472487 - protein, 21 aa, Mycobacterium tuberculosis
TRPGATLLLSCFSNAMPPDEE

SEQ ID NO: 1472488 - protein, 18 aa, Mycobacterium tuberculosis
TSGSRGFHVYARIAPCWS

SEQ ID NO: 1472489 - protein, 19 aa, Mycobacterium tuberculosis
TSSKVMCWVALDRGAKLAE

SEQ ID NO: 1472490 - protein, 21 aa, Mycobacterium tuberculosis
TSTLRLAPALGASRTVAVVST

SEQ ID NO: 1472491 - protein, 19 aa, Mycobacterium tuberculosis
TTCEIRLALLEADVSLPVV

SEQ ID NO: 1472492 - protein, 19 aa, Mycobacterium tuberculosis
TTEEFSIRVFPGDHFYLND

SEQ ID NO: 1472493 - protein, 17 aa, Mycobacterium tuberculosis
TVEHTIEILKGLRDRYE

SEQ ID NO: 1472494 - protein, 19 aa, Mycobacterium tuberculosis
TWAAIGVALGITRQAAFQR

SEQ ID NO: 1472495 - protein, 17 aa, Mycobacterium tuberculosis
TYGFTGIDTSQCTGDTV

SEQ ID NO: 1472496 - protein, 20 aa, Mycobacterium tuberculosis
TYLYRDGSDFVFMDSQDYEQ

SEQ ID NO: 1472497 - protein, 22 aa, Mycobacterium tuberculosis
TYMGINCWKSVSDMWNYQEILS

SEQ ID NO: 1472498 - protein, 22 aa, Mycobacterium tuberculosis
TYMRAIWTGSIAFGLVNVPVKV

SEQ ID NO: 1472499 - protein, 24 aa, Mycobacterium tuberculosis
TYREVRAGHQVRWTILLDGAVRIS

SEQ ID NO: 1472500 - protein, 24 aa, Mycobacterium tuberculosis
VAAGARFSGGVFACAALAERELTN

SEQ ID NO: 1472501 - protein, 23 aa, Mycobacterium tuberculosis
VAALQRRGHLAAVDLDRIFDAAR

SEQ ID NO: 1472502 - protein, 20 aa, Mycobacterium tuberculosis
VAARRAGVPITELTETLPSG

SEQ ID NO: 1472503 - protein, 17 aa, Mycobacterium tuberculosis
VADRLWYPLWDANIRLD

SEQ ID NO: 1472504 - protein, 24 aa, Mycobacterium tuberculosis
VAEALRAGGFKHRAKVEICWVASD

SEQ ID NO: 1472505 - protein, 22 aa, Mycobacterium tuberculosis
VAELFPKVVEAYRELVDDGPGL

SEQ ID NO: 1472506 - protein, 24 aa, Mycobacterium tuberculosis
VAELGLPVVVRPSFTMGGLGSGIA

SEQ ID NO: 1472507 - protein, 17 aa, Mycobacterium tuberculosis
VAELHQLGLGKWLADHI

SEQ ID NO: 1472508 - protein, 17 aa, Mycobacterium tuberculosis
VAGCAAMDGTVLVNLIN

SEQ ID NO: 1472509 - protein, 26 aa, Mycobacterium tuberculosis
VANARVRWDLPAAVVERRIRAVTPNP

SEQ ID NO: 1472510 - protein, 17 aa, Mycobacterium tuberculosis
VAPMLGHDVSIAAVNGP

SEQ ID NO: 1472511 - protein, 17 aa, Mycobacterium tuberculosis
VAQRYSLGMTEQLITEA

SEQ ID NO: 1472512 - protein, 19 aa, Mycobacterium tuberculosis
VARRLAREEGLLVGISSGA

SEQ ID NO: 1472513 - protein, 20 aa, Mycobacterium tuberculosis
VASCGSDFGAVVDVIDTRTH

SEQ ID NO: 1472514 - protein, 18 aa, Mycobacterium tuberculosis
VATSFSARLFNLLITNAP

SEQ ID NO: 1472515 - protein, 28 aa, Mycobacterium tuberculosis
VCVHDPLIMRRALEYATGLGVLIAQHAE

SEQ ID NO: 1472516 - protein, 29 aa, Mycobacterium tuberculosis
VDAVARQEPRISWAAGLRDDGTTTLLVTD

SEQ ID NO: 1472517 - protein, 17 aa, Mycobacterium tuberculosis
VDGLPVFGAFWDREAEL

SEQ ID NO: 1472518 - protein, 21 aa, Mycobacterium tuberculosis
VDGLWLAGSHGFELVAPDGSH

SEQ ID NO: 1472519 - protein, 18 aa, Mycobacterium tuberculosis
VDGPLRFELIDIATATSC

SEQ ID NO: 1472520 - protein, 19 aa, Mycobacterium tuberculosis
VDGRLICLVRAESDEDARR

SEQ ID NO: 1472521 - protein, 17 aa, Mycobacterium tuberculosis
VDPAAALKAELRSKPGD

SEQ ID NO: 1472522 - protein, 24 aa, Mycobacterium tuberculosis
VDPVCPGQTGATLPAGTTGPEPVG

SEQ ID NO: 1472523 - protein, 18 aa, Mycobacterium tuberculosis
VDVPLKFHHPMWREHCQV

SEQ ID NO: 1472524 - protein, 33 aa, Mycobacterium tuberculosis; identical to SEQ ID NO: 207653

SEQ ID NO: 1472525 - protein, 18 aa, Mycobacterium tuberculosis
VEPGHAFYMIGVNDHVAN

SEQ ID NO: 1472526 - protein, 22 aa, Mycobacterium tuberculosis
VEVCRTCSWNHLVKSYVLGAAR

SEQ ID NO: 1472527 - protein, 17 aa, Mycobacterium tuberculosis
VFGDNGGAGVLGDSTDP

SEQ ID NO: 1472528 - protein, 17 aa, Mycobacterium tuberculosis
VFVARAGGGIVEDVDGN

SEQ ID NO: 1472529 - protein, 23 aa, Mycobacterium tuberculosis
VGAAGGLAGQIGNGGSGGSGGAG

SEQ ID NO: 1472530 - protein, 17 aa, Mycobacterium tuberculosis
VGAFLAEDHALRLLNLR

SEQ ID NO: 1472531 - protein, 25 aa, Mycobacterium tuberculosis
VGALRDGGCNDVILVLGAVEVSAPA

SEQ ID NO: 1472532 - protein, 24 aa, Mycobacterium tuberculosis
VGGAGGQGGLLFGDGGNGGAGGAG

SEQ ID NO: 1472533 - protein, 18 aa, Mycobacterium tuberculosis
VGGHPAKRTFQALRIAVN

SEQ ID NO: 1472534 - protein, 20 aa, Mycobacterium tuberculosis
VGGIGGLLLGLDGANAPAST

SEQ ID NO: 1472535 - protein, 26 aa, Mycobacterium tuberculosis
VGGMSPNGCWATFVTCDARLATRLPE

SEQ ID NO: 1472536 - protein, 17 aa, Mycobacterium tuberculosis
VGIAPSITTASLRAVVS

SEQ ID NO: 1472537 - protein, 17 aa, Mycobacterium tuberculosis
VGIVEVDGFPVFDVPPD

SEQ ID NO: 1472538 - protein, 17 aa, Mycobacterium tuberculosis
VGLALRGFVPVPEIQFD

SEQ ID NO: 1472539 - protein, 18 aa, Mycobacterium tuberculosis
VGNVRFAGAPVVAHSAVQ

SEQ ID NO: 1472540 - protein, 17 aa, Mycobacterium tuberculosis
VGRHLLEVNPCFDRLAR

SEQ ID NO: 1472541 - protein, 23 aa, Mycobacterium tuberculosis
VGRIARVLGPRGLMPNPKTGTVT

SEQ ID NO: 1472542 - protein, 18 aa, Mycobacterium tuberculosis
VGSAENFSVVEALADSLG

SEQ ID NO: 1472543 - protein, 21 aa, Mycobacterium tuberculosis
VGSGGAGGSRGVLFGTPGANG

SEQ ID NO: 1472544 - protein, 21 aa, Mycobacterium tuberculosis
VGSLRSGECDLALAGGVTVNA

SEQ ID NO: 1472545 - protein, 20 aa, Mycobacterium tuberculosis
VGVSFGGLVTRSFSPRWRGL

SEQ ID NO: 1472546 - protein, 18 aa, Mycobacterium tuberculosis
VIADRTRRPPAFPEDIWV

SEQ ID NO: 1472547 - protein, 18 aa, Mycobacterium tuberculosis
VIPKRIRERLGLRGNDQV

SEQ ID NO: 1472548 - protein, 25 aa, Mycobacterium tuberculosis
VIRALFRPPARRGGCVHPPGRRSRP

SEQ ID NO: 1472549 - protein, 22 aa, Mycobacterium tuberculosis
VKDAPIRDWVKLAVTRARISGM

SEQ ID NO: 1472550 - protein, 17 aa, Mycobacterium tuberculosis
VKDIFFLVCDGLKGLPD

SEQ ID NO: 1472551 - protein, 23 aa, Mycobacterium tuberculosis
VKDRIGVAMLQAGRAGRFDQAGH

SEQ ID NO: 1472552 - protein, 17 aa, Mycobacterium tuberculosis
VKHPSAWRGWLTTMRSR

SEQ ID NO: 1472553 - protein, 17 aa, Mycobacterium tuberculosis
VKVVGFVASAPGFHGQP

SEQ ID NO: 1472554 - protein, 22 aa, Mycobacterium tuberculosis
VKWFNAEKGFGFIAPEDGSADV

SEQ ID NO: 1472555 - protein, 25 aa, Mycobacterium tuberculosis
VLAISINGPRAWDLDLAIDFTFTEP

SEQ ID NO: 1472556 - protein, 21 aa, Mycobacterium tuberculosis
VLAVLQRLVSRWDRPLRDVDI

SEQ ID NO: 1472557 - protein, 25 aa, Mycobacterium tuberculosis
VLISRGGWCTVTVRYDRASVRNDEL

SEQ ID NO: 1472558 - protein, 17 aa, Mycobacterium tuberculosis
VLPDPFITIDHYGPPLG

SEQ ID NO: 1472559 - protein, 17 aa, Mycobacterium tuberculosis
VLRLVGRRRLWGRGLGA

SEQ ID NO: 1472560 - protein, 19 aa, Mycobacterium tuberculosis
VLSGSACSALVFATLAAGD

SEQ ID NO: 1472561 - protein, 20 aa, Mycobacterium tuberculosis
VLTPLAVDPAHPFPFVSGLS

SEQ ID NO: 1472562 - protein, 31 aa, Mycobacterium tuberculosis
VMLESFLFYSGFYLPMYWSSRGKLTNTADLI

SEQ ID NO: 1472563 - protein, 22 aa, Mycobacterium tuberculosis
VNHLPLTLPLRYLGISDAEVDQ

SEQ ID NO: 1472564 - protein, 18 aa, Mycobacterium tuberculosis
VNSARIFAGAGLGPMLAA

SEQ ID NO: 1472565 - protein, 21 aa, Mycobacterium tuberculosis
VNSPGWRRAMAARKRIDDLID

SEQ ID NO: 1472566 - protein, 17 aa, Mycobacterium tuberculosis
VNVMLARDTIRRRLAGE

SEQ ID NO: 1472567 - protein, 17 aa, Mycobacterium tuberculosis
VPGEAWARHGVEHPMGA

SEQ ID NO: 1472568 - protein, 22 aa, Mycobacterium tuberculosis
VPGIYQVRGFDISNISFVEGDT

SEQ ID NO: 1472569 - protein, 17 aa, Mycobacterium tuberculosis
VPRSLWFVDEVKRSPAG

SEQ ID NO: 1472570 - protein, 17 aa, Mycobacterium tuberculosis
VPSLLGLFLSLPGVSQW

SEQ ID NO: 1472571 - protein, 17 aa, Mycobacterium tuberculosis
VQAAWAVLVAYFNRLRC

SEQ ID NO: 1472572 - protein, 24 aa, Mycobacterium tuberculosis
VQKAQKQARRWSRDTVATAMRLVA

SEQ ID NO: 1472573 - protein, 26 aa, Mycobacterium tuberculosis
VQVIGNRPKIGWRRLEAQAVLSRLLN

SEQ ID NO: 1472574 - protein, 18 aa, Mycobacterium tuberculosis
VRGRTMYPPEVGLHAEAS

SEQ ID NO: 1472575 - protein, 18 aa, Mycobacterium tuberculosis
VRQVCARALSLPSLPCEV

SEQ ID NO: 1472576 - protein, 29 aa, Mycobacterium tuberculosis
VRRLARLHTPLPLLAFTAWPEVRSQLAMT

SEQ ID NO: 1472577 - protein, 22 aa, Mycobacterium tuberculosis
VRVPAKALWRAQTQRAVENFPI

SEQ ID NO: 1472578 - protein, 28 aa, Mycobacterium tuberculosis
VRYAATRLRELCKMDGAVVLSTDGSRIV

SEQ ID NO: 1472579 - protein, 20 aa, Mycobacterium tuberculosis
VSAAVAALFGAHGQTYQVLS

SEQ ID NO: 1472580 - protein, 20 aa, Mycobacterium tuberculosis
VSALRVPGRHPAVAAWADSV

SEQ ID NO: 1472581 - protein, 18 aa, Mycobacterium tuberculosis
VSARWKFLAENTKGKPAV

SEQ ID NO: 1472582 - protein, 22 aa, Mycobacterium tuberculosis
VSGLDRKNCWTIAEHRGDTTPM

SEQ ID NO: 1472583 - protein, 22 aa, Mycobacterium tuberculosis
VSLGKRKGKIVVEFGSVDDLAR

SEQ ID NO: 1472584 - protein, 26 aa, Mycobacterium tuberculosis
VSLPCAPFLHLFVAYGRLTLEGGGEL

SEQ ID NO: 1472585 - protein, 21 aa, Mycobacterium tuberculosis
VSRLPAPLRRGQIRPLGLDRY

SEQ ID NO: 1472586 - protein, 18 aa, Mycobacterium tuberculosis
VTGGLTFAGGPWSNYVTH

SEQ ID NO: 1472587 - protein, 24 aa, Mycobacterium tuberculosis
VTGSPIPVGLDPTGVAVNPVTGVV

SEQ ID NO: 1472588 - protein, 20 aa, Mycobacterium tuberculosis
VTIPQLTIPAGITIGGFSLP

SEQ ID NO: 1472589 - protein, 17 aa, Mycobacterium tuberculosis
VTLTRAWCLRELGDDDA

SEQ ID NO: 1472590 - protein, 26 aa, Mycobacterium tuberculosis
VTTMFRPKLDALALLHRRSLKSPVRH

SEQ ID NO: 1472591 - protein, 24 aa, Mycobacterium tuberculosis
VVGLPMRCVFALTAMGFLPQSAET

SEQ ID NO: 1472592 - protein, 24 aa, Mycobacterium tuberculosis
VVQRLELVRRIGLVIDYDVVELGT

SEQ ID NO: 1472593 - protein, 17 aa, Mycobacterium tuberculosis
VVRGEACADSFYAALES

SEQ ID NO: 1472594 - protein, 19 aa, Mycobacterium tuberculosis
VVVLPDFGERYLSTPLFAD

SEQ ID NO: 1472595 - protein, 23 aa, Mycobacterium tuberculosis
VWNTILAIGFEWGVALQHLEIGK

SEQ ID NO: 1472596 - protein, 17 aa, Mycobacterium tuberculosis
VYADSTVIYPGHGDDTE

SEQ ID NO: 1472597 - protein, 18 aa, Mycobacterium tuberculosis
VYFCWATRNYRELYGLLA

SEQ ID NO: 1472598 - protein, 19 aa, Mycobacterium tuberculosis
WAAWQRSGLQRRWLAASEH

SEQ ID NO: 1472599 - protein, 24 aa, Mycobacterium tuberculosis
WASANWRLRRGRIVLLEGDSPAGL

SEQ ID NO: 1472600 - protein, 22 aa, Mycobacterium tuberculosis
WAVRWKPALNALAITFADRMPA

SEQ ID NO: 1472601 - protein, 19 aa, Mycobacterium tuberculosis
WCRDRETFGRPLISRQSVQ

SEQ ID NO: 1472602 - protein, 23 aa, Mycobacterium tuberculosis
WEEVRDRLAASFPKIGPLMDDAR

SEQ ID NO: 1472603 - protein, 19 aa, Mycobacterium tuberculosis
WEKMPEQFLAALDREFGIT

SEQ ID NO: 1472604 - protein, 17 aa, Mycobacterium tuberculosis
WGESMSRQAGGRAGGSG

SEQ ID NO: 1472605 - protein, 23 aa, Mycobacterium tuberculosis
WGGATYDVALRFLKEDPWERLAT

SEQ ID NO: 1472606 - protein, 21 aa, Mycobacterium tuberculosis
WGQDAEAMYGYAATAATATEA

SEQ ID NO: 1472607 - protein, 24 aa, Mycobacterium tuberculosis
WHGQRLRALAALPELIAAKPDGPR

SEQ ID NO: 1472608 - protein, 18 aa, Mycobacterium tuberculosis
WIHPDHRKKGYGTAALRK

SEQ ID NO: 1472609 - protein, 19 aa, Mycobacterium tuberculosis
WIPPHVRLPANVTLLEPTA

SEQ ID NO: 1472610 - protein, 23 aa, Mycobacterium tuberculosis
WLDDRKWAYVRLEGRAFGDVPLN

SEQ ID NO: 1472611 - protein, 18 aa, Mycobacterium tuberculosis
WLGDHRIHNVAALPGAAY

SEQ ID NO: 1472612 - protein, 21 aa, Mycobacterium tuberculosis
WLIERLQRPTLVMAPNKTLAA

SEQ ID NO: 1472613 - protein, 17 aa, Mycobacterium tuberculosis
WNGLVWINLDADAEPIA

SEQ ID NO: 1472614 - protein, 19 aa, Mycobacterium tuberculosis
WNPEFLREGFAVHDTLNPD

SEQ ID NO: 1472615 - protein, 30 aa, Mycobacterium tuberculosis; identical to SEQ ID NO: 212045

SEQ ID NO: 1472616 - protein, 17 aa, Mycobacterium tuberculosis
WPVALVIATGHILANNH

SEQ ID NO: 1472617 - protein, 23 aa, Mycobacterium tuberculosis
WQAARCVANWDGARVDKGLRRWR

SEQ ID NO: 1472618 - protein, 25 aa, Mycobacterium tuberculosis
WQENWARLGTFNVPNPVGSLAPPDG

SEQ ID NO: 1472619 - protein, 18 aa, Mycobacterium tuberculosis
WQRLRTDVGAVFDTEVYL

SEQ ID NO: 1472620 - protein, 19 aa, Mycobacterium tuberculosis
WRHLPDWPPATTERAWYLQ

SEQ ID NO: 1472621 - protein, 20 aa, Mycobacterium tuberculosis
WRRESELFADVAVPDDVDVT

SEQ ID NO: 1472622 - protein, 17 aa, Mycobacterium tuberculosis
WSGAGVVASHMTATEIT

SEQ ID NO: 1472623 - protein, 17 aa, Mycobacterium tuberculosis
WSPTALRILGAAAELIA

SEQ ID NO: 1472624 - protein, 17 aa, Mycobacterium tuberculosis
WVDNMVNELAARPPDDP

SEQ ID NO: 1472625 - protein, 30 aa, Mycobacterium tuberculosis
WVGAVNFGPISVQGFGLFGHGGDGGNGGDV

SEQ ID NO: 1472626 - protein, 23 aa, Mycobacterium tuberculosis
WVVGRLQLWHGYRLGLIEITPSS

SEQ ID NO: 1472627 - protein, 24 aa, Mycobacterium tuberculosis
WVVGRLQLWHGYRLGLIEITPSSA

SEQ ID NO: 1472628 - protein, 27 aa, Mycobacterium tuberculosis
YACASAWLDALVGWRRASGLPAAVINW

SEQ ID NO: 1472629 - protein, 28 aa, Mycobacterium tuberculosis
YAKALRRYRFRAGIAKVDFVLSDEIPWS

SEQ ID NO: 1472630 - protein, 17 aa, Mycobacterium tuberculosis
YATARARSGEELKVLLT

SEQ ID NO: 1472631 - protein, 18 aa, Mycobacterium tuberculosis
YGAALPWPASSADGTARP

SEQ ID NO: 1472632 - protein, 22 aa, Mycobacterium tuberculosis
YGAECATWRNFFLTGAAELRDG

SEQ ID NO: 1472633 - protein, 17 aa, Mycobacterium tuberculosis
YIAALLWFGEFSGCGIK

SEQ ID NO: 1472634 - protein, 20 aa, Mycobacterium tuberculosis
YKIRGVAAVTFYGRGRLVSA

SEQ ID NO: 1472635 - protein, 26 aa, Mycobacterium tuberculosis
YKPPAARCPLCPGPTGLSSEVPAPDY

SEQ ID NO: 1472636 - protein, 22 aa, Mycobacterium tuberculosis
YKTSRGSIRMRGVVEVEEDSRG

SEQ ID NO: 1472637 - protein, 20 aa, Mycobacterium tuberculosis
YMKYLRGCEHYFTDEMLDCS

SEQ ID NO: 1472638 - protein, 17 aa, Mycobacterium tuberculosis
YNLRYRVLADWDFNIRC

SEQ ID NO: 1472639 - protein, 27 aa, Mycobacterium tuberculosis
YNPLRFLRAAMKWCRKAQELGTLDEDA

SEQ ID NO: 1472640 - protein, 21 aa, Mycobacterium tuberculosis
YPGPDRAAAIVRRTVPGATAP

SEQ ID NO: 1472641 - protein, 23 aa, Mycobacterium tuberculosis
YPKVVLVTGACRFLGGYLTARLA

SEQ ID NO: 1472642 - protein, 19 aa, Mycobacterium tuberculosis
YPPGARCLVHESMAEGLAA

SEQ ID NO: 1472643 - protein, 22 aa, Mycobacterium tuberculosis
YPSAPWVPGGPILPWMPELPPG

SEQ ID NO: 1472644 - protein, 25 aa, Mycobacterium tuberculosis
YRAERYLGIIERVRAAIPHAAITTD

SEQ ID NO: 1472645 - protein, 23 aa, Mycobacterium tuberculosis
YRFRRLELARFLAALHATVLDNP

SEQ ID NO: 1472646 - protein, 25 aa, Mycobacterium tuberculosis
YRLVALRLATVGLRAQSLGRHTDQS

SEQ ID NO: 1472647 - protein, 18 aa, Mycobacterium tuberculosis
YRMTGSLHDAEDLVQETL

SEQ ID NO: 1472648 - protein, 17 aa, Mycobacterium tuberculosis
YRRCRRALRQIGVLERP

SEQ ID NO: 1472649 - protein, 17 aa, Mycobacterium tuberculosis
YSCWPVPGGDIALMAAR

SEQ ID NO: 1472650 - protein, 33 aa, Mycobacterium tuberculosis
YTDAAQPIWWVVRAIEFSKDFETFVQKLFVNPV

SEQ ID NO: 1472651 - protein, 22 aa, Mycobacterium tuberculosis
YTEARLTPLAMEMLREIDEETV

SEQ ID NO: 1472652 - protein, 23 aa, Mycobacterium tuberculosis
YWDRVLFDAGLSVITWPAKYGGR

SEQ ID NO: 1472653 - protein, 17 aa, Mycobacterium tuberculosis
AAADPAAVWATHFPSTD

SEQ ID NO: 1472654 - protein, 24 aa, Mycobacterium tuberculosis
AAAGRAGGNALLFGNGGNGGSGAS

SEQ ID NO: 1472655 - protein, 17 aa, Mycobacterium tuberculosis
AADRPTILMLHGGGQNR

SEQ ID NO: 1472656 - protein, 18 aa, Mycobacterium tuberculosis
AADRPTILMLHGGGQNRF

SEQ ID NO: 1472657 - protein, 18 aa, Mycobacterium tuberculosis
AADTGARIILACGFDSIP

SEQ ID NO: 1472658 - protein, 19 aa, Mycobacterium tuberculosis
AAECRWIRENLGVDVPVHF

SEQ ID NO: 1472659 - protein, 18 aa, Mycobacterium tuberculosis
AAEHTQSYVRACHLVGYQ

SEQ ID NO: 1472660 - protein, 18 aa, Mycobacterium tuberculosis
AAFAGRPALLSEMTDDDV

SEQ ID NO: 1472661 - protein, 27 aa, Mycobacterium tuberculosis
AAGKPLLGICGGFQMLGRVIRDPYGIE

SEQ ID NO: 1472662 - protein, 21 aa, Mycobacterium tuberculosis
AAGNLARLGSMISAANSAAAA

SEQ ID NO: 1472663 - protein, 19 aa, Mycobacterium tuberculosis
AAGPTMGILAAGADEVSVA

SEQ ID NO: 1472664 - protein, 18 aa, Mycobacterium tuberculosis
AAGVWAFGALVDPLEPQA

SEQ ID NO: 1472665 - protein, 22 aa, Mycobacterium tuberculosis
AAIEIKSAATLRGRDTRSISRL

SEQ ID NO: 1472666 - protein, 28 aa, Mycobacterium tuberculosis
AALAALELIDWPVALVIATGHILANNHH

SEQ ID NO: 1472667 - protein, 17 aa, Mycobacterium tuberculosis
AALRRVELARPRSVVGK

SEQ ID NO: 1472668 - protein, 18 aa, Mycobacterium tuberculosis
AANSWLDTFTHWRRAQDL

SEQ ID NO: 1472669 - protein, 23 aa, Mycobacterium tuberculosis
AARRCPEATFLPSNPAAYNAASE

SEQ ID NO: 1472670 - protein, 24 aa, Mycobacterium tuberculosis
AARRVGGTDVAVWLGTLSTLSRTA

SEQ ID NO: 1472671 - protein, 19 aa, Mycobacterium tuberculosis
AARWDLARIISALGDEVAF

SEQ ID NO: 1472672 - protein, 17 aa, Mycobacterium tuberculosis
AASSLRKAKKLRVRLPL

SEQ ID NO: 1472673 - protein, 25 aa, Mycobacterium tuberculosis
AAVEAEYELMWAADVAAMAGYHSGA

SEQ ID NO: 1472674 - protein, 17 aa, Mycobacterium tuberculosis
AAVGSYVSAEATNAAPL

SEQ ID NO: 1472675 - protein, 26 aa, Mycobacterium tuberculosis
AAVSWAERRRMFELPRSSWGDYDRSL

SEQ ID NO: 1472676 - protein, 17 aa, Mycobacterium tuberculosis
ACGAIELGIKWLSLYAF

SEQ ID NO: 1472677 - protein, 27 aa, Mycobacterium tuberculosis
ACPAALVDRWAPGRVMLNAYGPTETTI

SEQ ID NO: 1472678 - protein, 24 aa, Mycobacterium tuberculosis
ADDVSAAIAALFGAHAQAYQTISA

SEQ ID NO: 1472679 - protein, 23 aa, Mycobacterium tuberculosis
ADEVSAAIASLFSGNAQAYQALS

SEQ ID NO: 1472680 - protein, 23 aa, Mycobacterium tuberculosis
ADEVSAAMAALFGAHAQEYQRLS

SEQ ID NO: 1472681 - protein, 23 aa, Mycobacterium tuberculosis
ADEVSAGIAALFGAQAQSYQAVS

SEQ ID NO: 1472682 - protein, 18 aa, Mycobacterium tuberculosis
ADGCLVDGPLGRVGLEME

SEQ ID NO: 1472683 - protein, 23 aa, Mycobacterium tuberculosis
ADHHPRELLVVGIATFDQKRPAV

SEQ ID NO: 1472684 - protein, 27 aa, Mycobacterium tuberculosis
ADLARPWLAEAVGLARAVGDKWRLAEV

SEQ ID NO: 1472685 - protein, 18 aa, Mycobacterium tuberculosis
ADPRAWLTTVVSRLGLDK

SEQ ID NO: 1472686 - protein, 20 aa, Mycobacterium tuberculosis
ADPVADCPEAGEPVGTPGRR

SEQ ID NO: 1472687 - protein, 17 aa, Mycobacterium tuberculosis
ADPVSLQTAAGFSAQGV

SEQ ID NO: 1472688 - protein, 17 aa, Mycobacterium tuberculosis
ADRWADPTPAPGWTIAH

SEQ ID NO: 1472689 - protein, 21 aa, Mycobacterium tuberculosis
ADRYRRLHVIIGDANLAETST

SEQ ID NO: 1472690 - protein, 19 aa, Mycobacterium tuberculosis
ADTHPSGGCSRHLAECPAG

SEQ ID NO: 1472691 - protein, 19 aa, Mycobacterium tuberculosis
ADVHIAIELACPLVYGAAV

SEQ ID NO: 1472692 - protein, 19 aa, Mycobacterium tuberculosis
ADVLLAHLVLRPFLDAYHI

SEQ ID NO: 1472693 - protein, 22 aa, Mycobacterium tuberculosis
ADVPGLIPGASRGRGLGLDFLR

SEQ ID NO: 1472694 - protein, 28 aa, Mycobacterium tuberculosis
ADWLSVKRLAGWLAAAGYCGRAPRPAHR

SEQ ID NO: 1472695 - protein, 24 aa, Mycobacterium tuberculosis
AEAAAAAPLEGLLNIVNTPTQLLL

SEQ ID NO: 1472696 - protein, 26 aa, Mycobacterium tuberculosis
AEAANASPLQSAMGAVSASAQTLLSR

SEQ ID NO: 1472697 - protein, 24 aa, Mycobacterium tuberculosis
AEAKARRGPLCLGIDPHPELLRGW

SEQ ID NO: 1472698 - protein, 28 aa, Mycobacterium tuberculosis
AECGIAKGSLRGGLVLGLEDSSSRMSRL

SEQ ID NO: 1472699 - protein, 22 aa, Mycobacterium tuberculosis
AEDGAGWLAFFRDLVARGLSGV

SEQ ID NO: 1472700 - protein, 20 aa, Mycobacterium tuberculosis
AEERRTCVFFESPRRLAACL

SEQ ID NO: 1472701 - protein, 20 aa, Mycobacterium tuberculosis
AEKLVRARLRREVLIDDGTD

SEQ ID NO: 1472702 - protein, 20 aa, Mycobacterium tuberculosis
AELLPADWPGAGLRAAYHDF

SEQ ID NO: 1472703 - protein, 20 aa, Mycobacterium tuberculosis
AELLSAVGALAEATRDGVVA

SEQ ID NO: 1472704 - protein, 19 aa, Mycobacterium tuberculosis
AEMMRACRPITVPLTQAQG

SEQ ID NO: 1472705 - protein, 19 aa, Mycobacterium tuberculosis
AESCTAGLLAARLTDRPGS

SEQ ID NO: 1472706 - protein, 18 aa, Mycobacterium tuberculosis
AESQWFAAAGCNLVNMTG

SEQ ID NO: 1472707 - protein, 18 aa, Mycobacterium tuberculosis
AEYWPAFGANGKATLTVR

SEQ ID NO: 1472708 - protein, 34 aa, Mycobacterium tuberculosis; identical to SEQ ID NO: 233116

SEQ ID NO: 1472709 - protein, 18 aa, Mycobacterium tuberculosis
AFSIVWDGQKLHGLNASG

SEQ ID NO: 1472710 - protein, 33 aa, Mycobacterium tuberculosis
AFWTGDYQGLLDFSFPVGPLIPQTHLVHLRETV

SEQ ID NO: 1472711 - protein, 19 aa, Mycobacterium tuberculosis
AGAAAPYVGWLSAAAGQAE

SEQ ID NO: 1472712 - protein, 17 aa, Mycobacterium tuberculosis
AGCLVSFATQTSVQPPS

SEQ ID NO: 1472713 - protein, 31 aa, Mycobacterium tuberculosis
AGDPNNLLWRAFRPGTHVPIIDYTVPAPVES

SEQ ID NO: 1472714 - protein, 18 aa, Mycobacterium tuberculosis
AGDTWAAIGVALGITRQA

SEQ ID NO: 1472715 - protein, 29 aa, Mycobacterium tuberculosis
AGGAGGRGGKGIDGGFGGDGGNGGSNNGT

SEQ ID NO: 1472716 - protein, 28 aa, Mycobacterium tuberculosis
AGGAGGSGFFGGKGGFGGDGGQGGPNGG

SEQ ID NO: 1472717 - protein, 20 aa, Mycobacterium tuberculosis
AGGAGGWLSGHSGAHGAMGS

SEQ ID NO: 1472718 - protein, 17 aa, Mycobacterium tuberculosis
AGGAGWSPDSDLKGFDG

SEQ ID NO: 1472719 - protein, 17 aa, Mycobacterium tuberculosis
AGGEQWCDAEVLRILRR

SEQ ID NO: 1472720 - protein, 17 aa, Mycobacterium tuberculosis
AGGFGIPVGSGGAGGSR

SEQ ID NO: 1472721 - protein, 20 aa, Mycobacterium tuberculosis
AGGLFGVSGSSGLGGAAGSG

SEQ ID NO: 1472722 - protein, 20 aa, Mycobacterium tuberculosis
AGGRGGDAGLFLGAAGTGGQ

SEQ ID NO: 1472723 - protein, 20 aa, Mycobacterium tuberculosis
AGGVGGLFGAGGAGGSGGGG

SEQ ID NO: 1472724 - protein, 21 aa, Mycobacterium tuberculosis
AGKIAAVVAWDLDRLHRRPIE

SEQ ID NO: 1472725 - protein, 27 aa, Mycobacterium tuberculosis
AGLLFGAGGAGGFGFGGAGGAGGLGGK

SEQ ID NO: 1472726 - protein, 17 aa, Mycobacterium tuberculosis
AGLPRRGTPDAIVVVRD

SEQ ID NO: 1472727 - protein, 17 aa, Mycobacterium tuberculosis
AGLPRTMTFKVIKRQLS

SEQ ID NO: 1472728 - protein, 28 aa, Mycobacterium tuberculosis
AGNGGLGGDGFTYLADFDGEPGGDGGDG

SEQ ID NO: 1472729 - protein, 28 aa, Mycobacterium tuberculosis
AGQGSARWRRWLLLLALVGAGDQRRPAG

SEQ ID NO: 1472730 - protein, 27 aa, Mycobacterium tuberculosis
AGQPGRWGRTAVCARLSSADQKVDLDR

SEQ ID NO: 1472731 - protein, 18 aa, Mycobacterium tuberculosis
AGQRFVIDVTVWIDLAEA

SEQ ID NO: 1472732 - protein, 17 aa, Mycobacterium tuberculosis
AGRHLARPKRYIAGFAV

SEQ ID NO: 1472733 - protein, 24 aa, Mycobacterium tuberculosis
AGRRCSGHFPVTDRSAAMMAAGVG

SEQ ID NO: 1472734 - protein, 19 aa, Mycobacterium tuberculosis
AGRYLDWLTKHSRQILETA

SEQ ID NO: 1472735 - protein, 19 aa, Mycobacterium tuberculosis
AGSIGLFLEPFRLSDPFIT

SEQ ID NO: 1472736 - protein, 18 aa, Mycobacterium tuberculosis
AGSWPMAGTPAWRQLDDA

SEQ ID NO: 1472737 - protein, 18 aa, Mycobacterium tuberculosis
AGVDGMWLTVQVSSDGVP

SEQ ID NO: 1472738 - protein, 24 aa, Mycobacterium tuberculosis
AGVVRLRFGLTDGQPRTLDEIGQV

SEQ ID NO: 1472739 - protein, 18 aa, Mycobacterium tuberculosis
AGYLRLMRSGVYVNPVAP

SEQ ID NO: 1472740 - protein, 22 aa, Mycobacterium tuberculosis
AHAIPGLRQALGLAEDGTDERA

SEQ ID NO: 1472741 - protein, 21 aa, Mycobacterium tuberculosis
AHDWGGPVAFIMMLRHPEKVT

SEQ ID NO: 1472742 - protein, 21 aa, Mycobacterium tuberculosis
AHGGLQRWRAAETVHGRVRTG

SEQ ID NO: 1472743 - protein, 17 aa, Mycobacterium tuberculosis
AHGKGHFNIEDWDAILA

SEQ ID NO: 1472744 - protein, 24 aa, Mycobacterium tuberculosis
AHPQGRISLAIAHRPGERNGVADL

SEQ ID NO: 1472745 - protein, 18 aa, Mycobacterium tuberculosis
AIHRKYGDVFSLRVPPYA

SEQ ID NO: 1472746 - protein, 28 aa, Mycobacterium tuberculosis
AIPKLRQGSYFPDWLLQRRKRAERALTS

SEQ ID NO: 1472747 - protein, 17 aa, Mycobacterium tuberculosis
AIREWARRNGHNVSTRG

SEQ ID NO: 1472748 - protein, 20 aa, Mycobacterium tuberculosis
AIVGALGRLGHLGISDVRQG

SEQ ID NO: 1472749 - protein, 22 aa, Mycobacterium tuberculosis
AKTARRPRVIGVVSNGDTAAAP

SEQ ID NO: 1472750 - protein, 18 aa, Mycobacterium tuberculosis
ALAADWRVSGDNVKFGAT

SEQ ID NO: 1472751 - protein, 17 aa, Mycobacterium tuberculosis
ALDAARMLAEHRLPGLL

SEQ ID NO: 1472752 - protein, 32 aa, Mycobacterium tuberculosis
ALGGKGGSGGLIGRAGSDGGVGAGGAGGAGGA

SEQ ID NO: 1472753 - protein, 19 aa, Mycobacterium tuberculosis
ALHGAWGVRVHDVRASVDA

SEQ ID NO: 1472754 - protein, 18 aa, Mycobacterium tuberculosis
ALLGRPLIGNGANGAPGT

SEQ ID NO: 1472755 - protein, 34 aa, Mycobacterium tuberculosis
ALMSGNFSNGILWRGNFEGLFGLNVGITIPEFPI

SEQ ID NO: 1472756 - protein, 25 aa, Mycobacterium tuberculosis
ALNARAATFHAEFVSLLNGGAAAYT

SEQ ID NO: 1472757 - protein, 20 aa, Mycobacterium tuberculosis
ALRVADLFDSQGIWLVSSMT

SEQ ID NO: 1472758 - protein, 17 aa, Mycobacterium tuberculosis
ALTRDWFTSTFAAPTAA

SEQ ID NO: 1472759 - protein, 17 aa, Mycobacterium tuberculosis
ALYMSGSVPGVIAQALF

SEQ ID NO: 1472760 - protein, 22 aa, Mycobacterium tuberculosis
AMFDLWFPAALGARAVITTEDE

SEQ ID NO: 1472761 - protein, 19 aa, Mycobacterium tuberculosis
AMGVRVATSFSARLFNLLI

SEQ ID NO: 1472762 - protein, 21 aa, Mycobacterium tuberculosis
AMPAALRAAQMLAAEWDVAAD

SEQ ID NO: 1472763 - protein, 27 aa, Mycobacterium tuberculosis
ANGIDAPALWPGLPIRPVKGEVLRLRW

SEQ ID NO: 1472764 - protein, 19 aa, Mycobacterium tuberculosis
ANITVCVGGGIGTPRRAAE

SEQ ID NO: 1472765 - protein, 18 aa, Mycobacterium tuberculosis
ANLGRAASVGSLSVPPAW

SEQ ID NO: 1472766 - protein, 21 aa, Mycobacterium tuberculosis
APFQPEELMPEYSIGTMTFAG

SEQ ID NO: 1472767 - protein, 27 aa, Mycobacterium tuberculosis
APGGIGVNTGTGWAYGGNGGNGGDGGA

SEQ ID NO: 1472768 - protein, 22 aa, Mycobacterium tuberculosis
APLAPIRLRIGMHTGEVSSPDE

SEQ ID NO: 1472769 - protein, 17 aa, Mycobacterium tuberculosis
APLGYRPARSTAVMSTM

SEQ ID NO: 1472770 - protein, 26 aa, Mycobacterium tuberculosis
APLHTDLKEFGRWAADRIAEAIEFEG

SEQ ID NO: 1472771 - protein, 21 aa, Mycobacterium tuberculosis
APLPSWTHRTLMLSREDSHRS

SEQ ID NO: 1472772 - protein, 19 aa, Mycobacterium tuberculosis
APSAGTPVGPWLRTGDSGF

SEQ ID NO: 1472773 - protein, 22 aa, Mycobacterium tuberculosis
APTKRQLLSAAFIDHLRHLGRI

SEQ ID NO: 1472774 - protein, 17 aa, Mycobacterium tuberculosis
APYTGSAIAQHWMYEGK

SEQ ID NO: 1472775 - protein, 24 aa, Mycobacterium tuberculosis
AQAFPHVYCELDFTTPLELAVATI

SEQ ID NO: 1472776 - protein, 22 aa, Mycobacterium tuberculosis
AQGYSRVRVDGVVHPLTDPPKL

SEQ ID NO: 1472777 - protein, 18 aa, Mycobacterium tuberculosis
AQLPSGWMVTAAKFEVEW

SEQ ID NO: 1472778 - protein, 25 aa, Mycobacterium tuberculosis
AQMGRDGWLALGWPKEYGGQGRSAM

SEQ ID NO: 1472779 - protein, 17 aa, Mycobacterium tuberculosis
AQWGNNVAILAGDYLLA

SEQ ID NO: 1472780 - protein, 19 aa, Mycobacterium tuberculosis
ARHIRAVVRFGDSVRSAHC

SEQ ID NO: 1472781 - protein, 17 aa, Mycobacterium tuberculosis
ARIQLRLADPGESQMGH

SEQ ID NO: 1472782 - protein, 30 aa, Mycobacterium tuberculosis
ARIVGGRCLMPASSAARCAARIVGGRCLMP

SEQ ID NO: 1472783 - protein, 19 aa, Mycobacterium tuberculosis
ARPIRKGRLGKPVEFGYKA

SEQ ID NO: 1472784 - protein, 17 aa, Mycobacterium tuberculosis
ARRRGISVLGDRPPMVS

SEQ ID NO: 1472785 - protein, 17 aa, Mycobacterium tuberculosis
ARTGGFVDGVADFDPAF

SEQ ID NO: 1472786 - protein, 20 aa, Mycobacterium tuberculosis
ARTTVLLDEIVTLVGTDQRL

SEQ ID NO: 1472787 - protein, 17 aa, Mycobacterium tuberculosis
ARVLALAADKSMPLLER

SEQ ID NO: 1472788 - protein, 21 aa, Mycobacterium tuberculosis
ARYSNRFSVPTARSDAPLSVT

SEQ ID NO: 1472789 - protein, 18 aa, Mycobacterium tuberculosis
ASCGSDFGAVVDVIDTRT

SEQ ID NO: 1472790 - protein, 19 aa, Mycobacterium tuberculosis
ASGAGRAGVVPRYGVRLTV

SEQ ID NO: 1472791 - protein, 25 aa, Mycobacterium tuberculosis
ASIQRTGRCVVMHEGPRSLGYGAGL

SEQ ID NO: 1472792 - protein, 33 aa, Mycobacterium tuberculosis; identical to SEQ ID NO: 197095

SEQ ID NO: 1472793 - protein, 26 aa, Mycobacterium tuberculosis
ASLTGWQWLGPSSVRMGAAVTPYVEW

SEQ ID NO: 1472794 - protein, 23 aa, Mycobacterium tuberculosis
ASMPAMIRAGGKMYGADGKLKDT

SEQ ID NO: 1472795 - protein, 17 aa, Mycobacterium tuberculosis
ASRRLRVGQPIQPSPAP

SEQ ID NO: 1472796 - protein, 17 aa, Mycobacterium tuberculosis
ATAKAFAREGAVVALAA

SEQ ID NO: 1472797 - protein, 25 aa, Mycobacterium tuberculosis
ATASKGKWDTLRAMGFDDDHISDSR

SEQ ID NO: 1472798 - protein, 18 aa, Mycobacterium tuberculosis
ATDVARPAETVRGWLRRF

SEQ ID NO: 1472799 - protein, 28 aa, Mycobacterium tuberculosis
ATFHEDPVAGVWAVGGVGGDGGSGGSSL

SEQ ID NO: 1472800 - protein, 18 aa, Mycobacterium tuberculosis
ATGALLLIGDPAAGDPLL

SEQ ID NO: 1472801 - protein, 17 aa, Mycobacterium tuberculosis
ATLASDLMEVWRAPIID

SEQ ID NO: 1472802 - protein, 19 aa, Mycobacterium tuberculosis
ATLPGGFTISARKAYGRNS

SEQ ID NO: 1472803 - protein, 21 aa, Mycobacterium tuberculosis
ATNLAEIGSAISTANGAAALP

SEQ ID NO: 1472804 - protein, 20 aa, Mycobacterium tuberculosis
ATRVQVLWSLADREMSVNEL

SEQ ID NO: 1472805 - protein, 22 aa, Mycobacterium tuberculosis
ATVGGLMLPVGVRRLRNYHSTR

SEQ ID NO: 1472806 - protein, 17 aa, Mycobacterium tuberculosis
AVAARTRSGVILRSPAA

SEQ ID NO: 1472807 - protein, 34 aa, Mycobacterium tuberculosis; identical to SEQ ID NO: 233252

SEQ ID NO: 1472808 - protein, 25 aa, Mycobacterium tuberculosis
AVIYFLRKVIWFLPDFTVEGYHDRL

SEQ ID NO: 1472809 - protein, 23 aa, Mycobacterium tuberculosis
AVLALASVEAFFGAGAQRQLDGD

SEQ ID NO: 1472810 - protein, 26 aa, Mycobacterium tuberculosis
AVLSRAQLLELVWGYDFAADTNVVDV

SEQ ID NO: 1472811 - protein, 18 aa, Mycobacterium tuberculosis
AVRNELNLSVLQRELTRL

SEQ ID NO: 1472812 - protein, 18 aa, Mycobacterium tuberculosis
AVSSFGLSGTNAHVVVEQ

SEQ ID NO: 1472813 - protein, 26 aa, Mycobacterium tuberculosis
AVVSELFLRAAQAYGVKRGQRMLGLS

SEQ ID NO: 1472814 - protein, 18 aa, Mycobacterium tuberculosis
AVWSDGTPITWRDIASQI

SEQ ID NO: 1472815 - protein, 19 aa, Mycobacterium tuberculosis
AWDYRARARAARALHGEPV

SEQ ID NO: 1472816 - protein, 22 aa, Mycobacterium tuberculosis
CAALPVLDTRAADTILGYDERG

SEQ ID NO: 1472817 - protein, 33 aa, Mycobacterium tuberculosis
CAARIVGGRCLMPASSAARCAARIVGGRCLMPA

SEQ ID NO: 1472818 - protein, 20 aa, Mycobacterium tuberculosis
CADGRYVAVGAIEPQFYAAM

SEQ ID NO: 1472819 - protein, 33 aa, Mycobacterium tuberculosis
CCADGDPQLARARWRRVRSLPHLQDRWVAMFGD

SEQ ID NO: 1472820 - protein, 20 aa, Mycobacterium tuberculosis
CEAVARLGRHQFPLVCTDTV

SEQ ID NO: 1472821 - protein, 33 aa, Mycobacterium tuberculosis; identical to SEQ ID NO: 197423

SEQ ID NO: 1472822 - protein, 25 aa, Mycobacterium tuberculosis
CGSPTTARCGWLLSLGGAATDRLLS

SEQ ID NO: 1472823 - protein, 19 aa, Mycobacterium tuberculosis
CKLPEAIAAVSHERIALLV

SEQ ID NO: 1472824 - protein, 17 aa, Mycobacterium tuberculosis
CKSNVLYKGALQGDPAS

SEQ ID NO: 1472825 - protein, 24 aa, Mycobacterium tuberculosis
CLTLKGFTYSQMRLPGGDTVDVYN

SEQ ID NO: 1472826 - protein, 24 aa, Mycobacterium tuberculosis
CPASAYSRMCLTTFFTSLTQRFPQ

SEQ ID NO: 1472827 - protein, 29 aa, Mycobacterium tuberculosis
CPDRRIAVETCWRKAIQMDYETDTDTELV

SEQ ID NO: 1472828 - protein, 26 aa, Mycobacterium tuberculosis
CQVAAMALRIGVAVAHRDRDYEAIRT

SEQ ID NO: 1472829 - protein, 22 aa, Mycobacterium tuberculosis
CRAKHRLPGLQFVQGDAQNLPF

SEQ ID NO: 1472830 - protein, 28 aa, Mycobacterium tuberculosis
CRYCMPEAEYAWLPRADLLSVDEISLIV

SEQ ID NO: 1472831 - protein, 20 aa, Mycobacterium tuberculosis
CSWRRWWPDLRLQVTEDRAD

SEQ ID NO: 1472832 - protein, 21 aa, Mycobacterium tuberculosis
CTAAARAVSWPAVTSPAGPVT

SEQ ID NO: 1472833 - protein, 18 aa, Mycobacterium tuberculosis
CTGQDSFADPVRVDPITD

SEQ ID NO: 1472834 - protein, 17 aa, Mycobacterium tuberculosis
CTYHVAHPGGRAYDEPP

SEQ ID NO: 1472835 - protein, 17 aa, Mycobacterium tuberculosis
CVRDGLMSSRAAEAAET

SEQ ID NO: 1472836 - protein, 22 aa, Mycobacterium tuberculosis
DAASVFARRVPLAAAVWTQRGW

SEQ ID NO: 1472837 - protein, 21 aa, Mycobacterium tuberculosis
DAGVLGALAGVLAKRQHQTRV

SEQ ID NO: 1472838 - protein, 24 aa, Mycobacterium tuberculosis
DAHTWLRDHGVSLDAPARPRPVTA

SEQ ID NO: 1472839 - protein, 18 aa, Mycobacterium tuberculosis
DAPAGRAGSQGVGGDGGA

SEQ ID NO: 1472840 - protein, 42 aa, Mycobacterium tuberculosis
DASDLSNILLLGPVGDLFPILSIPGAMSQNFTNVVMTVTDTT

SEQ ID NO: 1472841 - protein, 24 aa, Mycobacterium tuberculosis
DASRRIRDAFVVGDGYAELMTADY

SEQ ID NO: 1472842 - protein, 22 aa, Mycobacterium tuberculosis
DATRVQVLWSLADREMSVNELA

SEQ ID NO: 1472843 - protein, 18 aa, Mycobacterium tuberculosis
DCKSNVLYKGALQGDPAS

SEQ ID NO: 1472844 - protein, 17 aa, Mycobacterium tuberculosis
DDSRRLLQMVGRDLGLD

SEQ ID NO: 1472845 - protein, 41 aa, Mycobacterium tuberculosis; identical to SEQ ID NO: 197680

SEQ ID NO: 1472846 - protein, 33 aa, Mycobacterium tuberculosis
DEIARCATYPVLAVQAWAAFHDMTLRAVIGTAE

SEQ ID NO: 1472847 - protein, 21 aa, Mycobacterium tuberculosis
DEIWQCDGCSITHQRDDNAAI

SEQ ID NO: 1472848 - protein, 21 aa, Mycobacterium tuberculosis
DFDPIYCWPKPVTKPYPPLYV

SEQ ID NO: 1472849 - protein, 30 aa, Mycobacterium tuberculosis; identical to SEQ ID NO: 214614

SEQ ID NO: 1472850 - protein, 24 aa, Mycobacterium tuberculosis
DGKPVVRRRILLPEHKDFGRIAPD

SEQ ID NO: 1472851 - protein, 26 aa, Mycobacterium tuberculosis
DGLRVICRRSRLMSRIAGSGAMASVE

SEQ ID NO: 1472852 - protein, 19 aa, Mycobacterium tuberculosis
DGPDRVRISGVIGEPPPPT

SEQ ID NO: 1472853 - protein, 20 aa, Mycobacterium tuberculosis
DGQWRLRQQRHFGCGGQPEF

SEQ ID NO: 1472854 - protein, 20 aa, Mycobacterium tuberculosis
DGRMLPLLVVNGLTVIRTAR

SEQ ID NO: 1472855 - protein, 21 aa, Mycobacterium tuberculosis
DGYFSRPGLARVAAGKVSPSA

SEQ ID NO: 1472856 - protein, 17 aa, Mycobacterium tuberculosis
DITCPILAFVGEVDDIG

SEQ ID NO: 1472857 - protein, 17 aa, Mycobacterium tuberculosis
DKPWFSYVCPGAGHAPH

SEQ ID NO: 1472858 - protein, 19 aa, Mycobacterium tuberculosis
DKRRFWLSAEGSGADVSGL

SEQ ID NO: 1472859 - protein, 21 aa, Mycobacterium tuberculosis
DKVTALQLVWADRRGRWPWAA

SEQ ID NO: 1472860 - protein, 19 aa, Mycobacterium tuberculosis
DLAAAIPMMVFSGVMNAGQ

SEQ ID NO: 1472861 - protein, 24 aa, Mycobacterium tuberculosis
DLAAAVSWTLGRGVISHESALALH

SEQ ID NO: 1472862 - protein, 20 aa, Mycobacterium tuberculosis
DLADAWARRLHIGRSELLRD

SEQ ID NO: 1472863 - protein, 17 aa, Mycobacterium tuberculosis
DLDALWTALKTLYPVGI

SEQ ID NO: 1472864 - protein, 24 aa, Mycobacterium tuberculosis
DLETDWPIRAALLSTPEQTVLSLV

SEQ ID NO: 1472865 - protein, 26 aa, Mycobacterium tuberculosis
DLLAFTAFPKQIWRQIGSNNPQERLN

SEQ ID NO: 1472866 - protein, 23 aa, Mycobacterium tuberculosis
DLLDSWAGTLIVVSHDRYLLERV

SEQ ID NO: 1472867 - protein, 20 aa, Mycobacterium tuberculosis
DLLLVPSIVEPSNFLENISR

SEQ ID NO: 1472868 - protein, 22 aa, Mycobacterium tuberculosis
DLRADWPAALQAAGLDSTAPTA

SEQ ID NO: 1472869 - protein, 24 aa, Mycobacterium tuberculosis
DLVEAIGVDAARYSLIRSSVDTAI

SEQ ID NO: 1472870 - protein, 17 aa, Mycobacterium tuberculosis
DMFRLDLDGIVARLRPA

SEQ ID NO: 1472871 - protein, 22 aa, Mycobacterium tuberculosis
DNKRFKVVWQVLNALRSHDERF

SEQ ID NO: 1472872 - protein, 24 aa, Mycobacterium tuberculosis
DPERTADLATRFGVESSIARLQKA

SEQ ID NO: 1472873 - protein, 17 aa, Mycobacterium tuberculosis
DPLEPGGRLPIDREPRA

SEQ ID NO: 1472874 - protein, 20 aa, Mycobacterium tuberculosis
DPMQWRVLERAFSRHSALIL

SEQ ID NO: 1472875 - protein, 18 aa, Mycobacterium tuberculosis
DPQQRLMLEVSWEALEHA

SEQ ID NO: 1472876 - protein, 23 aa, Mycobacterium tuberculosis
DPRSNLARYGIAPTYPGDFAADV

SEQ ID NO: 1472877 - protein, 25 aa, Mycobacterium tuberculosis
DQARTIRIPVHMVEVINKLGRIQRE

SEQ ID NO: 1472878 - protein, 20 aa, Mycobacterium tuberculosis
DQRTFGGWLLADLVTVDGSV

SEQ ID NO: 1472879 - protein, 24 aa, Mycobacterium tuberculosis
DRDVIDAFLAWYVPGLDISDHTML

SEQ ID NO: 1472880 - protein, 19 aa, Mycobacterium tuberculosis
DRERIALSNVRIKSSVQNY

SEQ ID NO: 1472881 - protein, 23 aa, Mycobacterium tuberculosis
DRGFYAGAVGWCDGRGDGHWVVS

SEQ ID NO: 1472882 - protein, 22 aa, Mycobacterium tuberculosis
DRGMPVLGICNGFQVLCEAGLL

SEQ ID NO: 1472883 - protein, 20 aa, Mycobacterium tuberculosis
DRGSMDWMPLGDYETFRHWS

SEQ ID NO: 1472884 - protein, 28 aa, Mycobacterium tuberculosis
DRRATRLVAEWPPRLNIPDPDPLRLIYF

SEQ ID NO: 1472885 - protein, 25 aa, Mycobacterium tuberculosis
DRRFTRTRLRTEVLPLLEDVLGGGV

SEQ ID NO: 1472886 - protein, 17 aa, Mycobacterium tuberculosis
DRSTLQTSLLLTVMIDE

SEQ ID NO: 1472887 - protein, 19 aa, Mycobacterium tuberculosis
DRVIDRAPLWCAVDLRDGN

SEQ ID NO: 1472888 - protein, 17 aa, Mycobacterium tuberculosis
DRVNLAITALRDEVEAE

SEQ ID NO: 1472889 - protein, 17 aa, Mycobacterium tuberculosis
DRWFLPLAVPLGLGPKN

SEQ ID NO: 1472890 - protein, 24 aa, Mycobacterium tuberculosis
DRYRMYPLVRRLLFLIPPEHAHKL

SEQ ID NO: 1472891 - protein, 17 aa, Mycobacterium tuberculosis
DSFLRAAELLGVTPDAA

SEQ ID NO: 1472892 - protein, 20 aa, Mycobacterium tuberculosis
DSLRIFPATHYVAGPERMAH

SEQ ID NO: 1472893 - protein, 20 aa, Mycobacterium tuberculosis
DSRLRELVIMRIGWLTDCDY

SEQ ID NO: 1472894 - protein, 18 aa, Mycobacterium tuberculosis
DSRLRVLARREFAGMISV

SEQ ID NO: 1472895 - protein, 22 aa, Mycobacterium tuberculosis
DSSSWKGWGHVRWFIEEVPAGA

SEQ ID NO: 1472896 - protein, 23 aa, Mycobacterium tuberculosis
DSSYHAELFWWTGAFETSEGIPH

SEQ ID NO: 1472897 - protein, 24 aa, Mycobacterium tuberculosis
DTPCDLLIAVGVSFGGLVTRSFSP

SEQ ID NO: 1472898 - protein, 25 aa, Mycobacterium tuberculosis
DVIGLRIAGGAIVWATPDHKVLTEY

SEQ ID NO: 1472899 - protein, 23 aa, Mycobacterium tuberculosis
DVMPEDLIKFGLIPEFIGRLPVV

SEQ ID NO: 1472900 - protein, 25 aa, Mycobacterium tuberculosis
DVVEAIVAQGVWCGMTIPRVYPEMP

SEQ ID NO: 1472901 - protein, 33 aa, Mycobacterium tuberculosis; identical to SEQ ID NO: 209256

SEQ ID NO: 1472902 - protein, 18 aa, Mycobacterium tuberculosis
DWVRINGFGTPWWADDLA

SEQ ID NO: 1472903 - protein, 17 aa, Mycobacterium tuberculosis
EAAHGRRLLRIAASSAF

SEQ ID NO: 1472904 - protein, 24 aa, Mycobacterium tuberculosis
EAAHGRRLLRIAASSAFAEHAAPG

SEQ ID NO: 1472905 - protein, 18 aa, Mycobacterium tuberculosis
EAALRVARDIAAKDTRVI

SEQ ID NO: 1472906 - protein, 18 aa, Mycobacterium tuberculosis
EAARRTLNRPGFGLTESL

SEQ ID NO: 1472907 - protein, 21 aa, Mycobacterium tuberculosis
EADRLASRLARIDDIEGDRDR

SEQ ID NO: 1472908 - protein, 24 aa, Mycobacterium tuberculosis
EAELRRGRRYSVARRLAGLFASYA

SEQ ID NO: 1472909 - protein, 19 aa, Mycobacterium tuberculosis
EAIVDRIDYIVSLGETVMS

SEQ ID NO: 1472910 - protein, 18 aa, Mycobacterium tuberculosis
EALEHAGIDPLSLRGSAT

SEQ ID NO: 1472911 - protein, 17 aa, Mycobacterium tuberculosis
EALGRWDKPFLAIFGYR

SEQ ID NO: 1472912 - protein, 17 aa, Mycobacterium tuberculosis
EALMSVASEVAGIGSAL

SEQ ID NO: 1472913 - protein, 34 aa, Mycobacterium tuberculosis; identical to SEQ ID NO: 209263

SEQ ID NO: 1472914 - protein, 17 aa, Mycobacterium tuberculosis
ECVLRRFPILGFQHPLS

SEQ ID NO: 1472915 - protein, 25 aa, Mycobacterium tuberculosis
EDGWVRAQLLHYMRSAPRRNVADPD

SEQ ID NO: 1472916 - protein, 22 aa, Mycobacterium tuberculosis
EDLSWLWDVRFEHFEKTRVVAA

SEQ ID NO: 1472917 - protein, 21 aa, Mycobacterium tuberculosis
EDRYLEVWNLVFMQNERGEGT

SEQ ID NO: 1472918 - protein, 18 aa, Mycobacterium tuberculosis
EELLGVVASEGWQGQAAE

SEQ ID NO: 1472919 - protein, 18 aa, Mycobacterium tuberculosis
EESYVLLVRVASARALED

SEQ ID NO: 1472920 - protein, 21 aa, Mycobacterium tuberculosis
EFDGRIITVPFSFKEIDDDGL

SEQ ID NO: 1472921 - protein, 19 aa, Mycobacterium tuberculosis
EGFAPRKGAARRAWLAELA

SEQ ID NO: 1472922 - protein, 23 aa, Mycobacterium tuberculosis
EGIGRPRVEPSFLPGVVDRMVAV

SEQ ID NO: 1472923 - protein, 19 aa, Mycobacterium tuberculosis
EGLGPFPTDRGWALRELFD

SEQ ID NO: 1472924 - protein, 19 aa, Mycobacterium tuberculosis
EGLRFAIREGGRTVGAGRV

SEQ ID NO: 1472925 - protein, 18 aa, Mycobacterium tuberculosis
EGPKGGPGMREMLAITGA

SEQ ID NO: 1472926 - protein, 20 aa, Mycobacterium tuberculosis
EGTYSLPLIGSWHGTDGGYL

SEQ ID NO: 1472927 - protein, 18 aa, Mycobacterium tuberculosis
EGVLDVINAPALALLGRP

SEQ ID NO: 1472928 - protein, 20 aa, Mycobacterium tuberculosis
EGVSALLIRVGESGVAPDRL

SEQ ID NO: 1472929 - protein, 20 aa, Mycobacterium tuberculosis
EGVTLRFGSKVPGTAMEVRD

SEQ ID NO: 1472930 - protein, 17 aa, Mycobacterium tuberculosis
EGWAERVRLAHALGPTM

SEQ ID NO: 1472931 - protein, 26 aa, Mycobacterium tuberculosis
EGWAGCFTEDGAFEFDGWVIRGRPAL

SEQ ID NO: 1472932 - protein, 18 aa, Mycobacterium tuberculosis
EHAIVQFVKAICSPMALA

SEQ ID NO: 1472933 - protein, 17 aa, Mycobacterium tuberculosis
EHILLRTVRCVSGTVEL

SEQ ID NO: 1472934 - protein, 17 aa, Mycobacterium tuberculosis
EHIRVFPLSNWTEFDIW

SEQ ID NO: 1472935 - protein, 25 aa, Mycobacterium tuberculosis
EIAESPIDWDIAWPAGDLQVNLTPA

SEQ ID NO: 1472936 - protein, 20 aa, Mycobacterium tuberculosis
EIAGIGAGVTWAADNRTVYY

SEQ ID NO: 1472937 - protein, 21 aa, Mycobacterium tuberculosis
EIKSQDLLTANGFQPFEDEEV

SEQ ID NO: 1472938 - protein, 20 aa, Mycobacterium tuberculosis
EINSGRMFFGAGSGPMLAAA

SEQ ID NO: 1472939 - protein, 33 aa, Mycobacterium tuberculosis; identical to SEQ ID NO: 209281

SEQ ID NO: 1472940 - protein, 24 aa, Mycobacterium tuberculosis
ELAAPSLDIGIPWRQYLRVQQGIR

SEQ ID NO: 1472941 - protein, 25 aa, Mycobacterium tuberculosis
ELGANHALHGVLMATNFFGINTIPI

SEQ ID NO: 1472942 - protein, 22 aa, Mycobacterium tuberculosis
ELLVRGGVVFSGYWRNEQATTE

SEQ ID NO: 1472943 - protein, 24 aa, Mycobacterium tuberculosis
ELPSRLAANPSIAGWLRELEAVCT

SEQ ID NO: 1472944 - protein, 22 aa, Mycobacterium tuberculosis
ELREKIGAVAMGRVLTLSIAPD

SEQ ID NO: 1472945 - protein, 19 aa, Mycobacterium tuberculosis
ELRQITGRVPVEIPRMRGA

SEQ ID NO: 1472946 - protein, 17 aa, Mycobacterium tuberculosis
ELSEICGHIASLPATAV

SEQ ID NO: 1472947 - protein, 19 aa, Mycobacterium tuberculosis
ELWMLMSPTMIARGVKGTN

SEQ ID NO: 1472948 - protein, 19 aa, Mycobacterium tuberculosis
ELYDPEILTARYSVGAVDA

SEQ ID NO: 1472949 - protein, 21 aa, Mycobacterium tuberculosis
EMLGAAATDLASIGSAISTAN

SEQ ID NO: 1472950 - protein, 25 aa, Mycobacterium tuberculosis
EMLTTAATDLAKIGSTITAANTAAA

SEQ ID NO: 1472951 - protein, 25 aa, Mycobacterium tuberculosis
ENNRGRAGYRLLYSVRQYALEKLSE

SEQ ID NO: 1472952 - protein, 18 aa, Mycobacterium tuberculosis
EPAFFGVRPHVVLKGGAI

SEQ ID NO: 1472953 - protein, 23 aa, Mycobacterium tuberculosis
EPEPHWGPFGGAAPVSAGVGHAA

SEQ ID NO: 1472954 - protein, 24 aa, Mycobacterium tuberculosis
EPSGWAYWVAESLLGPGTQLADLK

SEQ ID NO: 1472955 - protein, 22 aa, Mycobacterium tuberculosis
ERARCIAGGLAAAGVGLGDVVG

SEQ ID NO: 1472956 - protein, 23 aa, Mycobacterium tuberculosis
ERFRTRYAIPIERHGHTEPAERL

SEQ ID NO: 1472957 - protein, 24 aa, Mycobacterium tuberculosis
ERGPGQMLGGLPVGQMGARAGGGL

SEQ ID NO: 1472958 - protein, 21 aa, Mycobacterium tuberculosis
ERLDDRFQFGVLLTAAPEATP

SEQ ID NO: 1472959 - protein, 46 aa, Mycobacterium tuberculosis
ERLTCSPWLNAEWRLVSDHIRAIVALGGFAWQVALRLAGASGTPKP

SEQ ID NO: 1472960 - protein, 18 aa, Mycobacterium tuberculosis
ERYRICSTVHTKIAVVKS

SEQ ID NO: 1472961 - protein, 18 aa, Mycobacterium tuberculosis
ESDQRSAAVIARNIEALG

SEQ ID NO: 1472962 - protein, 17 aa, Mycobacterium tuberculosis
ESEFRTSLRSCPAEKRR

SEQ ID NO: 1472963 - protein, 25 aa, Mycobacterium tuberculosis
ESGKMTGRSRLEVVDPSAAAQLADT

SEQ ID NO: 1472964 - protein, 19 aa, Mycobacterium tuberculosis
ESPIVFLRLRKAARRHRVP

SEQ ID NO: 1472965 - protein, 18 aa, Mycobacterium tuberculosis
ETLPERWSADAGPEQMAI

SEQ ID NO: 1472966 - protein, 25 aa, Mycobacterium tuberculosis
ETLVRAASDLANIGSTLGAANAAAL

SEQ ID NO: 1472967 - protein, 19 aa, Mycobacterium tuberculosis
EVHPCCADGDPQLARARWR

SEQ ID NO: 1472968 - protein, 19 aa, Mycobacterium tuberculosis
EVIAAAATDLASLESSIAA

SEQ ID NO: 1472969 - protein, 19 aa, Mycobacterium tuberculosis
EVKAKILSLLDEVAQGEEI

SEQ ID NO: 1472970 - protein, 20 aa, Mycobacterium tuberculosis
EVNSALMFAGAGSGPTLAAA

SEQ ID NO: 1472971 - protein, 17 aa, Mycobacterium tuberculosis
EVPADRIVNTWPADTLL

SEQ ID NO: 1472972 - protein, 22 aa, Mycobacterium tuberculosis
EVSALTAAQFAAHAQMYQTVSA

SEQ ID NO: 1472973 - protein, 18 aa, Mycobacterium tuberculosis
FAKLGVRDEIVRALGEEG

SEQ ID NO: 1472974 - protein, 23 aa, Mycobacterium tuberculosis
FASLDRWPGTVGEYLNTMFDPSL

SEQ ID NO: 1472975 - protein, 18 aa, Mycobacterium tuberculosis
FDRLPRRLVERVTPKPGT

SEQ ID NO: 1472976 - protein, 24 aa, Mycobacterium tuberculosis
FDSVWLCDHFLKISPGEYAKVAGI

SEQ ID NO: 1472977 - protein, 21 aa, Mycobacterium tuberculosis
FEAACSVIPGGVNSPVRAFTA

SEQ ID NO: 1472978 - protein, 21 aa, Mycobacterium tuberculosis
FEQHLRAVLDYPLGDSDAVVP

SEQ ID NO: 1472979 - protein, 18 aa, Mycobacterium tuberculosis
FEQRPGEALALGQVLDTL

SEQ ID NO: 1472980 - protein, 25 aa, Mycobacterium tuberculosis
FERIARGVPVAAPWDARRARELDDV

SEQ ID NO: 1472981 - protein, 19 aa, Mycobacterium tuberculosis
FESHCGWPSFFDPKSSDAV

SEQ ID NO: 1472982 - protein, 17 aa, Mycobacterium tuberculosis
FEVEQMLPLDGHTPLTT

SEQ ID NO: 1472983 - protein, 19 aa, Mycobacterium tuberculosis
FFYIKGRSSEMIICGGVNI

SEQ ID NO: 1472984 - protein, 20 aa, Mycobacterium tuberculosis
FGGGASGFWNLASATSGLSG

SEQ ID NO: 1472985 - protein, 25 aa, Mycobacterium tuberculosis
FGISGEVTFDYGIAYDRSRKVAEGR

SEQ ID NO: 1472986 - protein, 26 aa, Mycobacterium tuberculosis
FGLIPEFIGRLPVVASVTNLDKESLV

SEQ ID NO: 1472987 - protein, 18 aa, Mycobacterium tuberculosis
FGNHGARLSGILNNGSGP

SEQ ID NO: 1472988 - protein, 20 aa, Mycobacterium tuberculosis
FGQRFPDRLFDVGIAEQHAM

SEQ ID NO: 1472989 - protein, 17 aa, Mycobacterium tuberculosis
FGRPGGAPRRGRKSKRQ

SEQ ID NO: 1472990 - protein, 19 aa, Mycobacterium tuberculosis
FIGECKVWSGPRTMDDALK

SEQ ID NO: 1472991 - protein, 21 aa, Mycobacterium tuberculosis
FIVTEIFPGGRLPSIPMVQEC

SEQ ID NO: 1472992 - protein, 23 aa, Mycobacterium tuberculosis
FKHLHRAGLRRVFIGVETGSYEQ

SEQ ID NO: 1472993 - protein, 18 aa, Mycobacterium tuberculosis
FKTALRLARHRELVDGAD

SEQ ID NO: 1472994 - protein, 29 aa, Mycobacterium tuberculosis
FLHIPFPPVELFMQMPWRTEIIQGLLGAD

SEQ ID NO: 1472995 - protein, 17 aa, Mycobacterium tuberculosis
FLISACGILTVPKLPDI

SEQ ID NO: 1472996 - protein, 17 aa, Mycobacterium tuberculosis
FLKRVRKVVDDEFPGRV

SEQ ID NO: 1472997 - protein, 24 aa, Mycobacterium tuberculosis
FNVNLKLQFLHDAFPNEFPDPTIS

SEQ ID NO: 1472998 - protein, 17 aa, Mycobacterium tuberculosis
FPEDIWVPERDPGTTRL

SEQ ID NO: 1472999 - protein, 17 aa, Mycobacterium tuberculosis
FPGGLTFPRASAGVTGL

SEQ ID NO: 1473000 - protein, 29 aa, Mycobacterium tuberculosis
FPKVAAMHYPVWRQSWTGILDPYLLDMIG

SEQ ID NO: 1473001 - protein, 21 aa, Mycobacterium tuberculosis
FPVTVNWSTPAVTIFPNGISI

SEQ ID NO: 1473002 - protein, 23 aa, Mycobacterium tuberculosis
FPYAWPRMPILATNVVCTSQPLA

SEQ ID NO: 1473003 - protein, 18 aa, Mycobacterium tuberculosis
FQHGHSAWREDGNYSPQL

SEQ ID NO: 1473004 - protein, 17 aa, Mycobacterium tuberculosis
FQHQKFWLAPAPSVSDP

SEQ ID NO: 1473005 - protein, 17 aa, Mycobacterium tuberculosis
FRLSPPVLSGAMGPFMH

SEQ ID NO: 1473006 - protein, 18 aa, Mycobacterium tuberculosis
FRPATLHQAYLALRAWGL

SEQ ID NO: 1473007 - protein, 17 aa, Mycobacterium tuberculosis
FRSPEALIALAMLALGG

SEQ ID NO: 1473008 - protein, 17 aa, Mycobacterium tuberculosis
FSAKFASAVSKNPFVGE

SEQ ID NO: 1473009 - protein, 21 aa, Mycobacterium tuberculosis
FSDKQLDMMAAFADQAALAWR

SEQ ID NO: 1473010 - protein, 22 aa, Mycobacterium tuberculosis
FSMHGELYKAIARQAHVIHESF

SEQ ID NO: 1473011 - protein, 26 aa, Mycobacterium tuberculosis
FSRWNVGKDLSFVPLRPERVVEVRYD

SEQ ID NO: 1473012 - protein, 22 aa, Mycobacterium tuberculosis
FTAFPKAHWQKIWSTNPLERIN

SEQ ID NO: 1473013 - protein, 18 aa, Mycobacterium tuberculosis
FTKARLSDGVLGVRAEYL

SEQ ID NO: 1473014 - protein, 18 aa, Mycobacterium tuberculosis
FTVADAYQGRGIGSFLIG

SEQ ID NO: 1473015 - protein, 18 aa, Mycobacterium tuberculosis
FVAALRAIWLAWQDGTKL

SEQ ID NO: 1473016 - protein, 18 aa, Mycobacterium tuberculosis
FVDAMCRKVLRLTPEDTG

SEQ ID NO: 1473017 - protein, 20 aa, Mycobacterium tuberculosis
FVIAANRSRLVSLALSNLFG

SEQ ID NO: 1473018 - protein, 23 aa, Mycobacterium tuberculosis
FVIGASNRFAHAAALAIAEAPAR

SEQ ID NO: 1473019 - protein, 32 aa, Mycobacterium tuberculosis
FWTGDYQGLLDFSFPVGPLIPQTHLVHLRETV

SEQ ID NO: 1473020 - protein, 24 aa, Mycobacterium tuberculosis
FWYQIPMSLPVIGPRVISDPKGRY

SEQ ID NO: 1473021 - protein, 18 aa, Mycobacterium tuberculosis
FYDSCRVLPQGDEQPTDL

SEQ ID NO: 1473022 - protein, 22 aa, Mycobacterium tuberculosis
FYEADYWKARLAETPVDVATLE

SEQ ID NO: 1473023 - protein, 20 aa, Mycobacterium tuberculosis
GAAGLLGVGGHGGAGGHGAE

SEQ ID NO: 1473024 - protein, 24 aa, Mycobacterium tuberculosis
GAALLPTHCWFEGRGWGFQVYPAL

SEQ ID NO: 1473025 - protein, 26 aa, Mycobacterium tuberculosis
GAAQRAGIELLAFGGRFVEIGKRDIY

SEQ ID NO: 1473026 - protein, 19 aa, Mycobacterium tuberculosis
GACRRVRRVARVRVLRADT

SEQ ID NO: 1473027 - protein, 33 aa, Mycobacterium tuberculosis; identical to SEQ ID NO: 235141

SEQ ID NO: 1473028 - protein, 21 aa, Mycobacterium tuberculosis
GAEALLRWEHPTLGTLLPGRF

SEQ ID NO: 1473029 - protein, 17 aa, Mycobacterium tuberculosis
GAGGFGLTTGGPGAAGG

SEQ ID NO: 1473030 - protein, 20 aa, Mycobacterium tuberculosis
GAGGQGGLLFGDGGNGGAGG

SEQ ID NO: 1473031 - protein, 35 aa, Mycobacterium tuberculosis; identical to SEQ ID NO: 199487

SEQ ID NO: 1473032 - protein, 21 aa, Mycobacterium tuberculosis
GAGGSAMLFGAGGAGGAGGAA

SEQ ID NO: 1473033 - protein, 26 aa, Mycobacterium tuberculosis
GAGGTGGPGGFGIFGGGAGGDGGSGG

SEQ ID NO: 1473034 - protein, 26 aa, Mycobacterium tuberculosis
GAIELGIKWLSLYAFSTENWKRSPEE

SEQ ID NO: 1473035 - protein, 17 aa, Mycobacterium tuberculosis
GALLPRLHKLVRADCTT

SEQ ID NO: 1473036 - protein, 20 aa, Mycobacterium tuberculosis
GARTRYFDAFFRDATSAGIR

SEQ ID NO: 1473037 - protein, 23 aa, Mycobacterium tuberculosis
GATVGFAGSGGFGGAGGIAQLFG

SEQ ID NO: 1473038 - protein, 17 aa, Mycobacterium tuberculosis
GAVALVAGWAARNLPAD

SEQ ID NO: 1473039 - protein, 31 aa, Mycobacterium tuberculosis; identical to SEQ ID NO: 199577

SEQ ID NO: 1473040 - protein, 33 aa, Mycobacterium tuberculosis
GCDGVVIGRGCLGRPWLFAELSAAFTGSPAPTP

SEQ ID NO: 1473041 - protein, 22 aa, Mycobacterium tuberculosis
GCGKCGNHLAGSYRTDGQVVYV

SEQ ID NO: 1473042 - protein, 17 aa, Mycobacterium tuberculosis
GCGKTTLLSCLGGILRP

SEQ ID NO: 1473043 - protein, 21 aa, Mycobacterium tuberculosis
GDAASFVGEIGKILADSVEQL

SEQ ID NO: 1473044 - protein, 30 aa, Mycobacterium tuberculosis; identical to SEQ ID NO: 199618

SEQ ID NO: 1473045 - protein, 17 aa, Mycobacterium tuberculosis
GDGGQFGAGGNGGAGGS

SEQ ID NO: 1473046 - protein, 25 aa, Mycobacterium tuberculosis
GDGGRGAHGTLFSSLAGTGGTGGNG

SEQ ID NO: 1473047 - protein, 24 aa, Mycobacterium tuberculosis
GDILTRLTAPVIRGLGIGIVPAAT

SEQ ID NO: 1473048 - protein, 18 aa, Mycobacterium tuberculosis
GDISVCLHDPCLPVDLTV

SEQ ID NO: 1473049 - protein, 20 aa, Mycobacterium tuberculosis
GDKLSVAKGMMLRRDPDREA

SEQ ID NO: 1473050 - protein, 22 aa, Mycobacterium tuberculosis
GDKVTALQLVWADRRGRWPWAA

SEQ ID NO: 1473051 - protein, 29 aa, Mycobacterium tuberculosis
GDLATIWRGGCIIRAKFLNHIKEAFDASP

SEQ ID NO: 1473052 - protein, 21 aa, Mycobacterium tuberculosis
GDLPGWLALHGYQNSRKRAVA

SEQ ID NO: 1473053 - protein, 24 aa, Mycobacterium tuberculosis
GDLWAAPSGWRGGGHMAPVRTAMR

SEQ ID NO: 1473054 - protein, 32 aa, Mycobacterium tuberculosis
GDMGNGAFWRGDQQGLFSAGYRVHVPEIPAHV

SEQ ID NO: 1473055 - protein, 17 aa, Mycobacterium tuberculosis
GDTMVFFGGIEPVALHE

SEQ ID NO: 1473056 - protein, 20 aa, Mycobacterium tuberculosis
GEESYVLLVRVASARALEDL

SEQ ID NO: 1473057 - protein, 20 aa, Mycobacterium tuberculosis
GEMWAQDAAAMFGYAAATAT

SEQ ID NO: 1473058 - protein, 26 aa, Mycobacterium tuberculosis
GENRLKIARLLALIDMLSDRFIGEPA

SEQ ID NO: 1473059 - protein, 22 aa, Mycobacterium tuberculosis
GEPAPHVKPAALAEQPGVPGQH

SEQ ID NO: 1473060 - protein, 21 aa, Mycobacterium tuberculosis
GEVGVGFVVGSAHHFDTAIGE

SEQ ID NO: 1473061 - protein, 27 aa, Mycobacterium tuberculosis
GEVRYFIDRLAGWYVITSSDRMSREGY

SEQ ID NO: 1473062 - protein, 17 aa, Mycobacterium tuberculosis
GFGSLRPLLEVAAAHGR

SEQ ID NO: 1473063 - protein, 19 aa, Mycobacterium tuberculosis
GFVDARGFDSLPIEERRRD

SEQ ID NO: 1473064 - protein, 20 aa, Mycobacterium tuberculosis
GGAAGLFGHGGNGGAGGSNA

SEQ ID NO: 1473065 - protein, 24 aa, Mycobacterium tuberculosis
GGADALRYPARYLFVFLDHHGMLS

SEQ ID NO: 1473066 - protein, 32 aa, Mycobacterium tuberculosis
GGADRLGCGCGRADCAAGKRPAAPPVVIHLIA

SEQ ID NO: 1473067 - protein, 26 aa, Mycobacterium tuberculosis
GGAGDRGGAGGTGFISSDGGAGGDGG

SEQ ID NO: 1473068 - protein, 31 aa, Mycobacterium tuberculosis; identical to SEQ ID NO: 199783

SEQ ID NO: 1473069 - protein, 26 aa, Mycobacterium tuberculosis
GGAGGDGGNAGFFGNGGNGGMGGAGA

SEQ ID NO: 1473070 - protein, 26 aa, Mycobacterium tuberculosis
GGAGGDRAGALVGRDGGPGGNGGAGG

SEQ ID NO: 1473071 - protein, 27 aa, Mycobacterium tuberculosis
GGAGGNGGRGGMLIGNGGAGGAGGTGG

SEQ ID NO: 1473072 - protein, 25 aa, Mycobacterium tuberculosis
GGAGGRSGLFEVLAAGGAGGTGGLS

SEQ ID NO: 1473073 - protein, 23 aa, Mycobacterium tuberculosis
GGAGGSGGWLLGNGGVGGAGGQS

SEQ ID NO: 1473074 - protein, 25 aa, Mycobacterium tuberculosis
GGAIARLPAIFTHRDVGNTDCPGNA

SEQ ID NO: 1473075 - protein, 25 aa, Mycobacterium tuberculosis
GGDGGKGGSGLGVGGAGGTGGAGGN

SEQ ID NO: 1473076 - protein, 27 aa, Mycobacterium tuberculosis
GGDGVFEGIAVLGLGFGGAAGAGGAAT

SEQ ID NO: 1473077 - protein, 21 aa, Mycobacterium tuberculosis
GGFERRGRWNVPKKLTTFTLW

SEQ ID NO: 1473078 - protein, 23 aa, Mycobacterium tuberculosis
GGGGNRQSIVIDFVRHGQTPGNA

SEQ ID NO: 1473079 - protein, 23 aa, Mycobacterium tuberculosis
GGGVRRCLGFGFALTEGAVILQE

SEQ ID NO: 1473080 - protein, 27 aa, Mycobacterium tuberculosis
GGKGADPGGLFPIPGAGGKGGTGGTGG

SEQ ID NO: 1473081 - protein, 26 aa, Mycobacterium tuberculosis
GGLGGAGRDGGAPGGDGGDGGTGGSG

SEQ ID NO: 1473082 - protein, 26 aa, Mycobacterium tuberculosis
GGLGGQLLGRDGFNAPASTPLHTLQQ

SEQ ID NO: 1473083 - protein, 17 aa, Mycobacterium tuberculosis
GGLLPAWSPGGHIDVQL

SEQ ID NO: 1473084 - protein, 17 aa, Mycobacterium tuberculosis
GGLPLSGLLRGVGDEPE

SEQ ID NO: 1473085 - protein, 21 aa, Mycobacterium tuberculosis
GGLPLSGLLRGVGDEPELTDF

SEQ ID NO: 1473086 - protein, 23 aa, Mycobacterium tuberculosis
GGMSPNGCWATFVTCDARLATRL

SEQ ID NO: 1473087 - protein, 17 aa, Mycobacterium tuberculosis
GGNAGAGGTGFTQGADG

SEQ ID NO: 1473088 - protein, 25 aa, Mycobacterium tuberculosis
GGNGGSAGLWGNGGAGGAGGSGGAA

SEQ ID NO: 1473089 - protein, 24 aa, Mycobacterium tuberculosis
GGPGGQGGQAFGANNIGGTGGAGG

SEQ ID NO: 1473090 - protein, 18 aa, Mycobacterium tuberculosis
GGSCGRKVLGEGWGDVLV

SEQ ID NO: 1473091 - protein, 18 aa, Mycobacterium tuberculosis
GGSGGAWAGNGGTGGAGG

SEQ ID NO: 1473092 - protein, 24 aa, Mycobacterium tuberculosis
GGSGGFGAPPPRSIGGGDGGDGGR

SEQ ID NO: 1473093 - protein, 17 aa, Mycobacterium tuberculosis
GGSVRWDPTNGQGRVYY

SEQ ID NO: 1473094 - protein, 20 aa, Mycobacterium tuberculosis
GGTAGLFGVGGAGGAGGNGI

SEQ ID NO: 1473095 - protein, 23 aa, Mycobacterium tuberculosis
GGVGGHGGTAILFGDGGAGGAGA

SEQ ID NO: 1473096 - protein, 29 aa, Mycobacterium tuberculosis
GGVGGNGGRGGWLLGNGGAGGVGGVGGAG

SEQ ID NO: 1473097 - protein, 19 aa, Mycobacterium tuberculosis
GIDGVGLGLLLQHKRIRRT

SEQ ID NO: 1473098 - protein, 18 aa, Mycobacterium tuberculosis
GIFAAPGLMRNCHHGGSA

SEQ ID NO: 1473099 - protein, 21 aa, Mycobacterium tuberculosis
GILGEVWEFITNALNGLKELW

SEQ ID NO: 1473100 - protein, 19 aa, Mycobacterium tuberculosis
GISDVRQGKRFELEVDDTV

SEQ ID NO: 1473101 - protein, 28 aa, Mycobacterium tuberculosis
GITIPEFPIHWTSTGGIGPIIIPDTTIL

SEQ ID NO: 1473102 - protein, 27 aa, Mycobacterium tuberculosis
GKGGEGGVGSILGGPGGNGGTGGNASA

SEQ ID NO: 1473103 - protein, 26 aa, Mycobacterium tuberculosis
GKKCYSLRIASAMAHDEGWLAEHMLI

SEQ ID NO: 1473104 - protein, 18 aa, Mycobacterium tuberculosis
GKPPTWWDSLPTDRPIVY

SEQ ID NO: 1473105 - protein, 20 aa, Mycobacterium tuberculosis
GKTYTRWGAFLDDATGFDAG

SEQ ID NO: 1473106 - protein, 24 aa, Mycobacterium tuberculosis
GLGGAGRDGGAPGGDGGDGGTGGS

SEQ ID NO: 1473107 - protein, 24 aa, Mycobacterium tuberculosis
GLGGQGNHTGGHGGAGGSAGLLAL

SEQ ID NO: 1473108 - protein, 17 aa, Mycobacterium tuberculosis
GLMQLLAATNWFGQNAP

SEQ ID NO: 1473109 - protein, 20 aa, Mycobacterium tuberculosis
GLPRTAFKPSYGIAEATLLV

SEQ ID NO: 1473110 - protein, 25 aa, Mycobacterium tuberculosis
GLPYLGLEHRAAWVEAEADGTITSM

SEQ ID NO: 1473111 - protein, 22 aa, Mycobacterium tuberculosis
GLRAGRNGGFALVIAVDAHGDA

SEQ ID NO: 1473112 - protein, 19 aa, Mycobacterium tuberculosis
GLRDLHAPGYVRAYAYDQD

SEQ ID NO: 1473113 - protein, 19 aa, Mycobacterium tuberculosis
GLRGAGFAGRIVSFEPLPG

SEQ ID NO: 1473114 - protein, 19 aa, Mycobacterium tuberculosis
GLTAIRLAAMAPDLVGELV

SEQ ID NO: 1473115 - protein, 18 aa, Mycobacterium tuberculosis
GLTIPVLLIRGKLSDVVS

SEQ ID NO: 1473116 - protein, 18 aa, Mycobacterium tuberculosis
GLVRGRTGILLVDTGTTL

SEQ ID NO: 1473117 - protein, 33 aa, Mycobacterium tuberculosis
GLVRRSRVHWVRARVVQLERGWVLRDETGGRWQ

SEQ ID NO: 1473118 - protein, 17 aa, Mycobacterium tuberculosis
GLYAVVVDREMSALLDG

SEQ ID NO: 1473119 - protein, 17 aa, Mycobacterium tuberculosis
GLYPGRKFGGGALSVYI

SEQ ID NO: 1473120 - protein, 25 aa, Mycobacterium tuberculosis
GMGPGPLLAAARAWHALAAQYTEIA

SEQ ID NO: 1473121 - protein, 19 aa, Mycobacterium tuberculosis
GNAGILFGAGGIGGTGGTG

SEQ ID NO: 1473122 - protein, 22 aa, Mycobacterium tuberculosis
GNFGGGASGFWNLASATSGLSG

SEQ ID NO: 1473123 - protein, 31 aa, Mycobacterium tuberculosis; identical to SEQ ID NO: 200122

SEQ ID NO: 1473124 - protein, 23 aa, Mycobacterium tuberculosis
GNGGAGGLFMNGGDGGAGGQGGD

SEQ ID NO: 1473125 - protein, 23 aa, Mycobacterium tuberculosis
GNGGTGGQLWGSGGAGGEGGAAL

SEQ ID NO: 1473126 - protein, 17 aa, Mycobacterium tuberculosis
GNGGYSLNGTGGDGGTG

SEQ ID NO: 1473127 - protein, 26 aa, Mycobacterium tuberculosis
GNMIKPMLARGELRLVGATTLDEYRK

SEQ ID NO: 1473128 - protein, 24 aa, Mycobacterium tuberculosis
GPAKMLRLNAGLGNVGNYNVGLGN

SEQ ID NO: 1473129 - protein, 25 aa, Mycobacterium tuberculosis
GPEPVGITAVAARAGHPAQDTRHGR

SEQ ID NO: 1473130 - protein, 19 aa, Mycobacterium tuberculosis
GPEVGRYVPDPAPTKRQLL

SEQ ID NO: 1473131 - protein, 18 aa, Mycobacterium tuberculosis
GPGIPRHHRAAGGLQSVA

SEQ ID NO: 1473132 - protein, 21 aa, Mycobacterium tuberculosis
GPGIPRHHRAAGGLQSVAKAS

SEQ ID NO: 1473133 - protein, 24 aa, Mycobacterium tuberculosis
GPGQPGGPGGLLYGNGGHGGAGAA

SEQ ID NO: 1473134 - protein, 17 aa, Mycobacterium tuberculosis
GPGSIVVEGRDIGTVVF

SEQ ID NO: 1473135 - protein, 30 aa, Mycobacterium tuberculosis; identical to SEQ ID NO: 200181

SEQ ID NO: 1473136 - protein, 18 aa, Mycobacterium tuberculosis
GPNNGFPGTSSIVTAMPG

SEQ ID NO: 1473137 - protein, 17 aa, Mycobacterium tuberculosis
GPRMPMVPGTWEQGSNE

SEQ ID NO: 1473138 - protein, 21 aa, Mycobacterium tuberculosis
GPSLARWARANGWSAPPGAGA

SEQ ID NO: 1473139 - protein, 22 aa, Mycobacterium tuberculosis
GPTGCGKTYLAQTLAKMLNVPF

SEQ ID NO: 1473140 - protein, 20 aa, Mycobacterium tuberculosis
GPTLMVSDLFDFSLYVDARI

SEQ ID NO: 1473141 - protein, 20 aa, Mycobacterium tuberculosis
GPTTELLAAGADEVSAAIAS

SEQ ID NO: 1473142 - protein, 24 aa, Mycobacterium tuberculosis
GQAGGAGGILWGNGGAGGSGAPGQ

SEQ ID NO: 1473143 - protein, 21 aa, Mycobacterium tuberculosis
GQAGGPGGLLYGNGGNGAAGG

SEQ ID NO: 1473144 - protein, 18 aa, Mycobacterium tuberculosis
GQLVSFIGPIVIDTTIPG

SEQ ID NO: 1473145 - protein, 21 aa, Mycobacterium tuberculosis
GRAAVPVLVHPAPRGVLGGLA

SEQ ID NO: 1473146 - protein, 18 aa, Mycobacterium tuberculosis
GRARVLAITVRRNGTRLD

SEQ ID NO: 1473147 - protein, 24 aa, Mycobacterium tuberculosis
GRAYLDFGEPLPLRKRLQEMRADK

SEQ ID NO: 1473148 - protein, 17 aa, Mycobacterium tuberculosis
GRFASIYDRVHAWASVP

SEQ ID NO: 1473149 - protein, 23 aa, Mycobacterium tuberculosis
GRGCQLLRLGGRWLSVVCCRNGS

SEQ ID NO: 1473150 - protein, 21 aa, Mycobacterium tuberculosis
GRGPVATVLVQRGTLRVGDSV

SEQ ID NO: 1473151 - protein, 20 aa, Mycobacterium tuberculosis
GRIHKLLRIFANPKLPTIGD

SEQ ID NO: 1473152 - protein, 21 aa, Mycobacterium tuberculosis
GRLDLGLGAGWFRRESQAYGI

SEQ ID NO: 1473153 - protein, 20 aa, Mycobacterium tuberculosis
GRPYYNAIVWQDTRTDRIAS

SEQ ID NO: 1473154 - protein, 19 aa, Mycobacterium tuberculosis
GRSEFAYGSFVRTVSLPVG

SEQ ID NO: 1473155 - protein, 18 aa, Mycobacterium tuberculosis
GRVVSLFDRVEALRVTAL

SEQ ID NO: 1473156 - protein, 18 aa, Mycobacterium tuberculosis
GRYFRLLTGWVGGGFRVP

SEQ ID NO: 1473157 - protein, 26 aa, Mycobacterium tuberculosis
GSGGAGGLIGWAGAAGGTGAGGTGGQ

SEQ ID NO: 1473158 - protein, 19 aa, Mycobacterium tuberculosis
GSSGIQGNMGPPGTQGADG

SEQ ID NO: 1473159 - protein, 25 aa, Mycobacterium tuberculosis
GSTPGAKGAHGFTPTSGGDGGDGGN

SEQ ID NO: 1473160 - protein, 25 aa, Mycobacterium tuberculosis
GTGANGGDAGWLIGNGGAGGSGAKG

SEQ ID NO: 1473161 - protein, 24 aa, Mycobacterium tuberculosis
GTGANGGDGGWLIGNGGAGGSGAA

SEQ ID NO: 1473162 - protein, 20 aa, Mycobacterium tuberculosis
GTGGFAGFGGTAGNGGSGGT

SEQ ID NO: 1473163 - protein, 25 aa, Mycobacterium tuberculosis
GTGGNGGNGALLIGGGGLGGAGGMG

SEQ ID NO: 1473164 - protein, 22 aa, Mycobacterium tuberculosis
GTGGNGGYAQLIGDGGDGGPGD

SEQ ID NO: 1473165 - protein, 23 aa, Mycobacterium tuberculosis
GTIEMADWWAYLNGVRKTYPLSY

SEQ ID NO: 1473166 - protein, 21 aa, Mycobacterium tuberculosis
GTMPNRLYWISATVNPDGDQG

SEQ ID NO: 1473167 - protein, 27 aa, Mycobacterium tuberculosis
GTQAAAFHERFIQALSTAAGAYGSAEA

SEQ ID NO: 1473168 - protein, 17 aa, Mycobacterium tuberculosis
GTVGEYLNTMFDPSLTF

SEQ ID NO: 1473169 - protein, 19 aa, Mycobacterium tuberculosis
GVGCVDRIVTELAVIDVCA

SEQ ID NO: 1473170 - protein, 25 aa, Mycobacterium tuberculosis
GVHLGYKCSIRKPWWSTPSLWMPDL

SEQ ID NO: 1473171 - protein, 17 aa, Mycobacterium tuberculosis
GVHRVQRVPVTESQGRV

SEQ ID NO: 1473172 - protein, 24 aa, Mycobacterium tuberculosis
GVIANGSFAPSFVGFGGNGGNGVN

SEQ ID NO: 1473173 - protein, 17 aa, Mycobacterium tuberculosis
GVKDVILESAITTIMDF

SEQ ID NO: 1473174 - protein, 17 aa, Mycobacterium tuberculosis
GVLAIAYRCPNGEPGVV

SEQ ID NO: 1473175 - protein, 17 aa, Mycobacterium tuberculosis
GVLHEFTTVPGVKEDVT

SEQ ID NO: 1473176 - protein, 17 aa, Mycobacterium tuberculosis
GVLNFGSGVSGLYNTGG

SEQ ID NO: 1473177 - protein, 18 aa, Mycobacterium tuberculosis
GVSKPVLYQHFSSKLELY

SEQ ID NO: 1473178 - protein, 21 aa, Mycobacterium tuberculosis
GWFWPAAAAHPSLPRGALLQI

SEQ ID NO: 1473179 - protein, 18 aa, Mycobacterium tuberculosis
GYGSLGLMTSVLMTADGK

SEQ ID NO: 1473180 - protein, 19 aa, Mycobacterium tuberculosis
GYHGDTFLAMSICDPHGGM

SEQ ID NO: 1473181 - protein, 18 aa, Mycobacterium tuberculosis
GYIGTALRLLERKIAQLP

SEQ ID NO: 1473182 - protein, 20 aa, Mycobacterium tuberculosis
HAARRCATRLLDLHVVDGRL

SEQ ID NO: 1473183 - protein, 17 aa, Mycobacterium tuberculosis
HALRASNRIAIERGTHF

SEQ ID NO: 1473184 - protein, 28 aa, Mycobacterium tuberculosis
HDYFWRWDTDWFWCSRSFGAQNPRLRRW

SEQ ID NO: 1473185 - protein, 26 aa, Mycobacterium tuberculosis
HEMRDRWAGFFNEFDVLLLPVTPTPA

SEQ ID NO: 1473186 - protein, 17 aa, Mycobacterium tuberculosis
HGIGRRTGLPGSPTRGP

SEQ ID NO: 1473187 - protein, 21 aa, Mycobacterium tuberculosis
HGQLPNMRAIVGFAAETGDAN

SEQ ID NO: 1473188 - protein, 17 aa, Mycobacterium tuberculosis
HGRQARYSGLGSMEPKP

SEQ ID NO: 1473189 - protein, 21 aa, Mycobacterium tuberculosis
HGRRLLRIAASSAFAEHAAPG

SEQ ID NO: 1473190 - protein, 21 aa, Mycobacterium tuberculosis
HGRSPRLWLVTGGGLSVADDE

SEQ ID NO: 1473191 - protein, 22 aa, Mycobacterium tuberculosis
HIDTAILPNGWRDRLVSWTVES

SEQ ID NO: 1473192 - protein, 19 aa, Mycobacterium tuberculosis
HKERRLAEIAASGVTRIGG

SEQ ID NO: 1473193 - protein, 21 aa, Mycobacterium tuberculosis
HKPQLAFLPRQAFLDTNIIGT

SEQ ID NO: 1473194 - protein, 19 aa, Mycobacterium tuberculosis
HLEACPGCLRHYGLEERIK

SEQ ID NO: 1473195 - protein, 24 aa, Mycobacterium tuberculosis
HLGARLFSIIAWRTYLVRDPHALS

SEQ ID NO: 1473196 - protein, 18 aa, Mycobacterium tuberculosis
HLGLTGQANYGFAVPDIP

SEQ ID NO: 1473197 - protein, 18 aa, Mycobacterium tuberculosis
HLQDRWVAMFGDDHCSHN

SEQ ID NO: 1473198 - protein, 21 aa, Mycobacterium tuberculosis
HLRVVFPGVVGLFADLDSPIS

SEQ ID NO: 1473199 - protein, 28 aa, Mycobacterium tuberculosis
HNKTLRADACFVIGFGILRHIRCAGIDE

SEQ ID NO: 1473200 - protein, 17 aa, Mycobacterium tuberculosis
HPPDVVILDLGLPDMSG

SEQ ID NO: 1473201 - protein, 24 aa, Mycobacterium tuberculosis
HRLLETWHPLGVVGVITAFNFPVA

SEQ ID NO: 1473202 - protein, 18 aa, Mycobacterium tuberculosis
HSRAALLSAARTDAAAGA

SEQ ID NO: 1473203 - protein, 25 aa, Mycobacterium tuberculosis
HSRVLRVGVAEFRRSLDRVMPRDAD

SEQ ID NO: 1473204 - protein, 18 aa, Mycobacterium tuberculosis
HTNLGLAIDLQGKDGKRS

SEQ ID NO: 1473205 - protein, 24 aa, Mycobacterium tuberculosis
HTPPPHWRPDVLLVAVGAMSRPRM

SEQ ID NO: 1473206 - protein, 22 aa, Mycobacterium tuberculosis
HTQSYVRACHLVGYQHPDLTAY

SEQ ID NO: 1473207 - protein, 17 aa, Mycobacterium tuberculosis
HTYAFDDTVAWLAVACS

SEQ ID NO: 1473208 - protein, 17 aa, Mycobacterium tuberculosis
HVAYWWSAEPQRLSMAA

SEQ ID NO: 1473209 - protein, 17 aa, Mycobacterium tuberculosis
HVQDIGWDEKWQCDGCS

SEQ ID NO: 1473210 - protein, 20 aa, Mycobacterium tuberculosis
HWPQGRLSKAYAAYSTPFWR

SEQ ID NO: 1473211 - protein, 23 aa, Mycobacterium tuberculosis
HYDFRLERDGVLVSWAVPKNLPD

SEQ ID NO: 1473212 - protein, 17 aa, Mycobacterium tuberculosis
IAAIAARAADLDVLGAD

SEQ ID NO: 1473213 - protein, 23 aa, Mycobacterium tuberculosis
IACAVLRRPDHRDTYDAMFDLWF

SEQ ID NO: 1473214 - protein, 21 aa, Mycobacterium tuberculosis
IAIELACPLVYGAAVSLEPRD

SEQ ID NO: 1473215 - protein, 19 aa, Mycobacterium tuberculosis
IAPSRFHVVPVLAYSPDPG

SEQ ID NO: 1473216 - protein, 17 aa, Mycobacterium tuberculosis
IAPVGPSAVSIELADGL

SEQ ID NO: 1473217 - protein, 19 aa, Mycobacterium tuberculosis
IAYTKKLWQAIRAQDVCGN

SEQ ID NO: 1473218 - protein, 23 aa, Mycobacterium tuberculosis
IDHSAPWPLGPTHPSNLKCACRK

SEQ ID NO: 1473219 - protein, 18 aa, Mycobacterium tuberculosis
IDRMTWSQLYSRVTAVSA

SEQ ID NO: 1473220 - protein, 28 aa, Mycobacterium tuberculosis
IDVSGRLGPINIPIEIAGTPGFGNSTTT

SEQ ID NO: 1473221 - protein, 17 aa, Mycobacterium tuberculosis
IEEAMRLAAEMGEQDPG

SEQ ID NO: 1473222 - protein, 24 aa, Mycobacterium tuberculosis
IELALRLGATVERVAEASGVDPWF

SEQ ID NO: 1473223 - protein, 19 aa, Mycobacterium tuberculosis
IGAILPLLASVADPSNFGA

SEQ ID NO: 1473224 - protein, 21 aa, Mycobacterium tuberculosis
IGEAHIKVIRALFRPPARRGG

SEQ ID NO: 1473225 - protein, 17 aa, Mycobacterium tuberculosis
IGKRLNAYYVANVQEDF

SEQ ID NO: 1473226 - protein, 21 aa, Mycobacterium tuberculosis
IGNTEWPKWETVMAADPVDPA

SEQ ID NO: 1473227 - protein, 22 aa, Mycobacterium tuberculosis
IGQMSVPPAWKAPAVTTVRAFD

SEQ ID NO: 1473228 - protein, 19 aa, Mycobacterium tuberculosis
IHAALRINGFTVMLNDDVP

SEQ ID NO: 1473229 - protein, 22 aa, Mycobacterium tuberculosis
IHIPSIPLGFAAIGHIGPISIP

SEQ ID NO: 1473230 - protein, 19 aa, Mycobacterium tuberculosis
IHLRGHTPGSIALALGGPV

SEQ ID NO: 1473231 - protein, 19 aa, Mycobacterium tuberculosis
IKVTPEILLQVLTTPPASG

SEQ ID NO: 1473232 - protein, 23 aa, Mycobacterium tuberculosis
INGQPCRPPHCVASVSPARPSAG

SEQ ID NO: 1473233 - protein, 27 aa, Mycobacterium tuberculosis
INLELIDSPTLPTCERIAVLSQSGVNL

SEQ ID NO: 1473234 - protein, 20 aa, Mycobacterium tuberculosis
INRHIKRGGKVWINIFPDRP

SEQ ID NO: 1473235 - protein, 17 aa, Mycobacterium tuberculosis
INSYARYCELRAAGRID

SEQ ID NO: 1473236 - protein, 22 aa, Mycobacterium tuberculosis
IPGFTIPGGTLIPTLPLGLALS

SEQ ID NO: 1473237 - protein, 18 aa, Mycobacterium tuberculosis
IPHTLAALDWGGITCQSG

SEQ ID NO: 1473238 - protein, 18 aa, Mycobacterium tuberculosis
IPPLVAVAQQLGVCGAEL

SEQ ID NO: 1473239 - protein, 17 aa, Mycobacterium tuberculosis
IPRHHRAAGGLQSVAKA

SEQ ID NO: 1473240 - protein, 17 aa, Mycobacterium tuberculosis
IPVTFSYSTPALTLFPV

SEQ ID NO: 1473241 - protein, 18 aa, Mycobacterium tuberculosis
IRADFPILKRIMRGGNPL

SEQ ID NO: 1473242 - protein, 17 aa, Mycobacterium tuberculosis
IRIGGRVVSLFDRVEAL

SEQ ID NO: 1473243 - protein, 25 aa, Mycobacterium tuberculosis
IRTCAATGCELHLVEPLGFDLSEPK

SEQ ID NO: 1473244 - protein, 23 aa, Mycobacterium tuberculosis
ISAVRGPNFLGWIHPAATATAPA

SEQ ID NO: 1473245 - protein, 20 aa, Mycobacterium tuberculosis
ITKRAGVSVGALFRHFETMG

SEQ ID NO: 1473246 - protein, 19 aa, Mycobacterium tuberculosis
IVGAKGKAALLRELSDVVP

SEQ ID NO: 1473247 - protein, 18 aa, Mycobacterium tuberculosis
IVSVVNWADCLVALQQRE

SEQ ID NO: 1473248 - protein, 18 aa, Mycobacterium tuberculosis
IWTRLFGVRLVKLLYRLE

SEQ ID NO: 1473249 - protein, 18 aa, Mycobacterium tuberculosis
IYRRSFAVIRAEADLARF

SEQ ID NO: 1473250 - protein, 27 aa, Mycobacterium tuberculosis
KAARRGLVPGLPRLLRVVGHYYKPGFH

SEQ ID NO: 1473251 - protein, 17 aa, Mycobacterium tuberculosis
KAFNWTVTALKADIKAW

SEQ ID NO: 1473252 - protein, 18 aa, Mycobacterium tuberculosis
KALEGGAIYQRWQALGGM

SEQ ID NO: 1473253 - protein, 17 aa, Mycobacterium tuberculosis
KEHTCYYAHVLGSDLPL

SEQ ID NO: 1473254 - protein, 20 aa, Mycobacterium tuberculosis
KELNVMGAMQLFAACQKAPS

SEQ ID NO: 1473255 - protein, 28 aa, Mycobacterium tuberculosis
KFARCSWRAGPCGMPILDDAAAWFIGRT

SEQ ID NO: 1473256 - protein, 18 aa, Mycobacterium tuberculosis
KGAARRAWLAELAEERRT

SEQ ID NO: 1473257 - protein, 32 aa, Mycobacterium tuberculosis; identical to SEQ ID NO: 201620

SEQ ID NO: 1473258 - protein, 24 aa, Mycobacterium tuberculosis
KGGPGMREMLAITGAIKGAGLGKD

SEQ ID NO: 1473259 - protein, 18 aa, Mycobacterium tuberculosis
KHHLLKTFWTGWRDVQLP

SEQ ID NO: 1473260 - protein, 19 aa, Mycobacterium tuberculosis
KIKLHQLGLSLKDSPPSFD

SEQ ID NO: 1473261 - protein, 40 aa, Mycobacterium tuberculosis; identical to SEQ ID NO: 99181

SEQ ID NO: 1473262 - protein, 17 aa, Mycobacterium tuberculosis
KLGKSVAIVERGRMLGG

SEQ ID NO: 1473263 - protein, 20 aa, Mycobacterium tuberculosis
KLKDAGFYWATRSGVTVSMA

SEQ ID NO: 1473264 - protein, 18 aa, Mycobacterium tuberculosis
KLLQEVRSTIRAARALLE

SEQ ID NO: 1473265 - protein, 22 aa, Mycobacterium tuberculosis
KLRDRPRLGVSVLAEGHDAACM

SEQ ID NO: 1473266 - protein, 17 aa, Mycobacterium tuberculosis
KMVFWSMVTPRAADMAV

SEQ ID NO: 1473267 - protein, 20 aa, Mycobacterium tuberculosis
KPPVGAALWKLMERARQVGL

SEQ ID NO: 1473268 - protein, 17 aa, Mycobacterium tuberculosis
KRIVGAKGKAALLRELS

SEQ ID NO: 1473269 - protein, 17 aa, Mycobacterium tuberculosis
KRPARGWGSLTPTERDV

SEQ ID NO: 1473270 - protein, 20 aa, Mycobacterium tuberculosis
KSFASVGGFIAGDRPVVDYI

SEQ ID NO: 1473271 - protein, 23 aa, Mycobacterium tuberculosis
KSMILHEILPIDVSINLEDAVFI

SEQ ID NO: 1473272 - protein, 17 aa, Mycobacterium tuberculosis
KSVYLCCRAALRHMVLA

SEQ ID NO: 1473273 - protein, 19 aa, Mycobacterium tuberculosis
KTFDELDCLLDRLDGTVPF

SEQ ID NO: 1473274 - protein, 20 aa, Mycobacterium tuberculosis
KTLTCVLPAYLNALAGNGVH

SEQ ID NO: 1473275 - protein, 24 aa, Mycobacterium tuberculosis
KTRAEAMAALDIWRDRYPGAAALL

SEQ ID NO: 1473276 - protein, 24 aa, Mycobacterium tuberculosis
KTVVCAALASAARQAGIDVAVCKP

SEQ ID NO: 1473277 - protein, 18 aa, Mycobacterium tuberculosis
KVALEHRTSYTFDRLVRV

SEQ ID NO: 1473278 - protein, 19 aa, Mycobacterium tuberculosis
KVDGGWLLNGQKIWSSRVP

SEQ ID NO: 1473279 - protein, 17 aa, Mycobacterium tuberculosis
KVPTPLLDFIAPKVAGL

SEQ ID NO: 1473280 - protein, 20 aa, Mycobacterium tuberculosis
KWQCDGCSITHQRDDNAAIN

SEQ ID NO: 1473281 - protein, 17 aa, Mycobacterium tuberculosis
KYGMTLCALGIAEEMRA

SEQ ID NO: 1473282 - protein, 17 aa, Mycobacterium tuberculosis
KYLLARIGDAFLALPNG

SEQ ID NO: 1473283 - protein, 23 aa, Mycobacterium tuberculosis
KYLNRLSDLLFILSRVANPDGDV

SEQ ID NO: 1473284 - protein, 19 aa, Mycobacterium tuberculosis
LAAAAAWDGLADELAVAAS

SEQ ID NO: 1473285 - protein, 22 aa, Mycobacterium tuberculosis
LAATGRPLIGNGANGAPGTGAN

SEQ ID NO: 1473286 - protein, 24 aa, Mycobacterium tuberculosis
LAAYPGHIARMFGLVYGGESRDHA

SEQ ID NO: 1473287 - protein, 19 aa, Mycobacterium tuberculosis
LACGCGKPDCPSGAGNDER

SEQ ID NO: 1473288 - protein, 22 aa, Mycobacterium tuberculosis
LADHLRRRWARNTGGLLVVTHD

SEQ ID NO: 1473289 - protein, 18 aa, Mycobacterium tuberculosis
LAGLAARGGSAPTPAAAA

SEQ ID NO: 1473290 - protein, 23 aa, Mycobacterium tuberculosis
LAGLARAIADIAARARSGNLKPD

SEQ ID NO: 1473291 - protein, 24 aa, Mycobacterium tuberculosis
LAGLARAIADIAARARSGNLKPDE

SEQ ID NO: 1473292 - protein, 18 aa, Mycobacterium tuberculosis
LAGQSWQGAAAAMAAAAA

SEQ ID NO: 1473293 - protein, 17 aa, Mycobacterium tuberculosis
LAGQWGDRVRPLVGDLT

SEQ ID NO: 1473294 - protein, 18 aa, Mycobacterium tuberculosis
LAPGPARCCVVLKRCSAH

SEQ ID NO: 1473295 - protein, 17 aa, Mycobacterium tuberculosis
LAPGTGLRDGLERILRG

SEQ ID NO: 1473296 - protein, 24 aa, Mycobacterium tuberculosis
LAPVRFFNPIAMRFAQKATREDID

SEQ ID NO: 1473297 - protein, 26 aa, Mycobacterium tuberculosis
LARGDLALRMGLPVLAVVAFAQSFGD

SEQ ID NO: 1473298 - protein, 17 aa, Mycobacterium tuberculosis
LARPRTDFHTEILRMQK

SEQ ID NO: 1473299 - protein, 34 aa, Mycobacterium tuberculosis
LASCLQPLWRARGRLQEGLAWFAAALADHDAHPA

SEQ ID NO: 1473300 - protein, 17 aa, Mycobacterium tuberculosis
LASRLIDVTGWLATQPD

SEQ ID NO: 1473301 - protein, 18 aa, Mycobacterium tuberculosis
LATDSWLSAASFQETTRV

SEQ ID NO: 1473302 - protein, 18 aa, Mycobacterium tuberculosis
LATFRDAQGLTFPLLSDP

SEQ ID NO: 1473303 - protein, 17 aa, Mycobacterium tuberculosis
LAVDGCVPLDVDTWDDY

SEQ ID NO: 1473304 - protein, 19 aa, Mycobacterium tuberculosis
LCGYGPIPAAVARTMVASA

SEQ ID NO: 1473305 - protein, 17 aa, Mycobacterium tuberculosis
LCLLAGAIQARRVLEIG

SEQ ID NO: 1473306 - protein, 17 aa, Mycobacterium tuberculosis
LDELAIWAAGGVLGEIT

SEQ ID NO: 1473307 - protein, 19 aa, Mycobacterium tuberculosis
LDHVREVVCEDSLGLAEEF

SEQ ID NO: 1473308 - protein, 19 aa, Mycobacterium tuberculosis
LDIDLVFSPFFNALPIRRL

SEQ ID NO: 1473309 - protein, 17 aa, Mycobacterium tuberculosis
LDLQEQFGLSYLFVSHD

SEQ ID NO: 1473310 - protein, 19 aa, Mycobacterium tuberculosis
LDNTGNLTLNFGVANQGGL

SEQ ID NO: 1473311 - protein, 25 aa, Mycobacterium tuberculosis
LDPFTEFRFPRIGTAVFDGIEIELR

SEQ ID NO: 1473312 - protein, 21 aa, Mycobacterium tuberculosis
LDPGDLYDVLAINAASASTQL

SEQ ID NO: 1473313 - protein, 17 aa, Mycobacterium tuberculosis
LDSLVLIASGGAFGPNG

SEQ ID NO: 1473314 - protein, 21 aa, Mycobacterium tuberculosis
LDSWRNYQWHQLARAFLMYVT

SEQ ID NO: 1473315 - protein, 17 aa, Mycobacterium tuberculosis
LDVDGRLICLVRAESDE

SEQ ID NO: 1473316 - protein, 17 aa, Mycobacterium tuberculosis
LDYFPEDFLLVIDESHV

SEQ ID NO: 1473317 - protein, 35 aa, Mycobacterium tuberculosis; identical to SEQ ID NO: 202173

SEQ ID NO: 1473318 - protein, 17 aa, Mycobacterium tuberculosis
LEDWLWRNATRVLRLDT

SEQ ID NO: 1473319 - protein, 22 aa, Mycobacterium tuberculosis
LEEEMRLHPAFLGRQRAAERSA

SEQ ID NO: 1473320 - protein, 17 aa, Mycobacterium tuberculosis
LEEVRGAAAAAIADGAR

SEQ ID NO: 1473321 - protein, 22 aa, Mycobacterium tuberculosis
LELLPFRRNLAFYGLDLGLMSV

SEQ ID NO: 1473322 - protein, 17 aa, Mycobacterium tuberculosis
LEVLRLGGLETGSVPSP

SEQ ID NO: 1473323 - protein, 24 aa, Mycobacterium tuberculosis
LFLIPPEHAHKLVFAVLRGVAAVA

SEQ ID NO: 1473324 - protein, 19 aa, Mycobacterium tuberculosis
LGAFVKRVSNPVAGHTTWT

SEQ ID NO: 1473325 - protein, 21 aa, Mycobacterium tuberculosis
LGGDGGGRGIFGQFGAGGAGG

SEQ ID NO: 1473326 - protein, 34 aa, Mycobacterium tuberculosis; identical to SEQ ID NO: 202308

SEQ ID NO: 1473327 - protein, 31 aa, Mycobacterium tuberculosis
LGGKGGSGGLIGRAGSDGGVGAGGAGGAGGA

SEQ ID NO: 1473328 - protein, 20 aa, Mycobacterium tuberculosis
LGIDVGGGLGPFTVFPDGYS

SEQ ID NO: 1473329 - protein, 18 aa, Mycobacterium tuberculosis
LGIVPLLLLDMWEHAFYL

SEQ ID NO: 1473330 - protein, 19 aa, Mycobacterium tuberculosis
LGLPPAPAPPVRRLAERGA

SEQ ID NO: 1473331 - protein, 19 aa, Mycobacterium tuberculosis
LGPAGRFASIYDRVHAWAS

SEQ ID NO: 1473332 - protein, 17 aa, Mycobacterium tuberculosis
LGPHEFLSFIEGRAAMF

SEQ ID NO: 1473333 - protein, 30 aa, Mycobacterium tuberculosis
LGSGVSGFANRGILPFSVASVVSGFANIGT

SEQ ID NO: 1473334 - protein, 19 aa, Mycobacterium tuberculosis
LGTASFALGNARRALVESL

SEQ ID NO: 1473335 - protein, 17 aa, Mycobacterium tuberculosis
LGVCVGMQILFACGVEF

SEQ ID NO: 1473336 - protein, 34 aa, Mycobacterium tuberculosis; identical to SEQ ID NO: 202391

SEQ ID NO: 1473337 - protein, 20 aa, Mycobacterium tuberculosis
LHIPRTTWYDGVRFEEVSVG

SEQ ID NO: 1473338 - protein, 17 aa, Mycobacterium tuberculosis
LHKGHRAGELLLKPPRS

SEQ ID NO: 1473339 - protein, 19 aa, Mycobacterium tuberculosis
LILRFFPTPACARLTEQNL

SEQ ID NO: 1473340 - protein, 17 aa, Mycobacterium tuberculosis
LKDAFVYPETMPAWFTE

SEQ ID NO: 1473341 - protein, 19 aa, Mycobacterium tuberculosis
LKLIRARFGVPVPNMTAWR

SEQ ID NO: 1473342 - protein, 17 aa, Mycobacterium tuberculosis
LKTARGLLEVKRFDTAQ

SEQ ID NO: 1473343 - protein, 18 aa, Mycobacterium tuberculosis
LLAAAARDAFGLDVHPAV

SEQ ID NO: 1473344 - protein, 29 aa, Mycobacterium tuberculosis
LLAGERPYREFPLDWMLGRLGLAGFRILE

SEQ ID NO: 1473345 - protein, 21 aa, Mycobacterium tuberculosis
LLARIGDAFLALPNGFTAHPR

SEQ ID NO: 1473346 - protein, 17 aa, Mycobacterium tuberculosis
LLDLLWRNRRGELELSV

SEQ ID NO: 1473347 - protein, 17 aa, Mycobacterium tuberculosis
LLDRVCALGSPDRVAAR

SEQ ID NO: 1473348 - protein, 18 aa, Mycobacterium tuberculosis
LLEPLRSVPIVGNPLANL

SEQ ID NO: 1473349 - protein, 23 aa, Mycobacterium tuberculosis
LLGGFERRGRWNVPKKLTTFTLW

SEQ ID NO: 1473350 - protein, 25 aa, Mycobacterium tuberculosis
LLGNGNFGFGNAFGDGNLGSGNVGS

SEQ ID NO: 1473351 - protein, 18 aa, Mycobacterium tuberculosis
LLLWIRGVRFMYSVDPYL

SEQ ID NO: 1473352 - protein, 18 aa, Mycobacterium tuberculosis
LLPYSDLDVLLLHDGKPA

SEQ ID NO: 1473353 - protein, 19 aa, Mycobacterium tuberculosis
LLQRCYSGLELRDDRLVLS

SEQ ID NO: 1473354 - protein, 17 aa, Mycobacterium tuberculosis
LLSGLGITGSIDISGIQ

SEQ ID NO: 1473355 - protein, 17 aa, Mycobacterium tuberculosis
LLTRIAFGFRSPQALIA

SEQ ID NO: 1473356 - protein, 18 aa, Mycobacterium tuberculosis
LMAALGMLEARHIAGDQQ

SEQ ID NO: 1473357 - protein, 18 aa, Mycobacterium tuberculosis
LMRNCHHGGSAPSAVGGS

SEQ ID NO: 1473358 - protein, 19 aa, Mycobacterium tuberculosis
LNHPEAIAVIADHILEGAR

SEQ ID NO: 1473359 - protein, 18 aa, Mycobacterium tuberculosis
LPALKSFVLPGGSPLSAL

SEQ ID NO: 1473360 - protein, 20 aa, Mycobacterium tuberculosis
LPASQVVRFIVPRYVQDDPL

SEQ ID NO: 1473361 - protein, 24 aa, Mycobacterium tuberculosis
LPDDQVCLVVEVFRMLADATRVQV

SEQ ID NO: 1473362 - protein, 29 aa, Mycobacterium tuberculosis
LPDGISRLRFRLRWRGFRLIVDANHTDVT

SEQ ID NO: 1473363 - protein, 20 aa, Mycobacterium tuberculosis
LPEGTRYVLSITWSDVETPG

SEQ ID NO: 1473364 - protein, 23 aa, Mycobacterium tuberculosis
LPEVPQIDAGSWLLLSASEADPL

SEQ ID NO: 1473365 - protein, 17 aa, Mycobacterium tuberculosis
LPFTLGAGAHLQADIAL

SEQ ID NO: 1473366 - protein, 40 aa, Mycobacterium tuberculosis; identical to SEQ ID NO: 202714

SEQ ID NO: 1473367 - protein, 18 aa, Mycobacterium tuberculosis
LPPTPWHHQRFWVTDRSA

SEQ ID NO: 1473368 - protein, 17 aa, Mycobacterium tuberculosis
LPSNCFDKPPVVNPGLE

SEQ ID NO: 1473369 - protein, 26 aa, Mycobacterium tuberculosis
LPTAAPRWVVDPDFNLDFHVRRVRVS

SEQ ID NO: 1473370 - protein, 20 aa, Mycobacterium tuberculosis
LPTDPNALVFPGRKGGFLPL

SEQ ID NO: 1473371 - protein, 19 aa, Mycobacterium tuberculosis
LPVRVCTICTDPWNLDHET

SEQ ID NO: 1473372 - protein, 25 aa, Mycobacterium tuberculosis
LQPLFDVINAPTLALLNRPLIGNGA

SEQ ID NO: 1473373 - protein, 20 aa, Mycobacterium tuberculosis
LQSFLPPPFDAIPNPIEDLD

SEQ ID NO: 1473374 - protein, 26 aa, Mycobacterium tuberculosis
LQTPGRINALWSLRPVLPMPGRGCQL

SEQ ID NO: 1473375 - protein, 20 aa, Mycobacterium tuberculosis
LRAAAQHWATWAMQKQELAR

SEQ ID NO: 1473376 - protein, 18 aa, Mycobacterium tuberculosis
LRAGEVGVGFVVGSAHHF

SEQ ID NO: 1473377 - protein, 22 aa, Mycobacterium tuberculosis
LRAHVPDAGGMIIASDRTTARA

SEQ ID NO: 1473378 - protein, 21 aa, Mycobacterium tuberculosis
LRALKPWEGPRHFVLIDDVQD

SEQ ID NO: 1473379 - protein, 20 aa, Mycobacterium tuberculosis
LRASNRIAIERGTHFKGFER

SEQ ID NO: 1473380 - protein, 17 aa, Mycobacterium tuberculosis
LRAVVCAPACAVDDADR

SEQ ID NO: 1473381 - protein, 18 aa, Mycobacterium tuberculosis
LRDIEWRIGPGERIGIVG

SEQ ID NO: 1473382 - protein, 20 aa, Mycobacterium tuberculosis
LRELIQVLGHAGVRSLVSQP

SEQ ID NO: 1473383 - protein, 19 aa, Mycobacterium tuberculosis
LRFQPRWKELFPTARQLQV

SEQ ID NO: 1473384 - protein, 18 aa, Mycobacterium tuberculosis
LRIGVPALADPGTGELVG

SEQ ID NO: 1473385 - protein, 21 aa, Mycobacterium tuberculosis
LRIVLGHELFHYAARADTALD

SEQ ID NO: 1473386 - protein, 17 aa, Mycobacterium tuberculosis
LRLTGRRVMLVPTMGAL

SEQ ID NO: 1473387 - protein, 18 aa, Mycobacterium tuberculosis
LRNLAAIKDVAARPTRTI

SEQ ID NO: 1473388 - protein, 20 aa, Mycobacterium tuberculosis
LRPIESIRVGDFVTDHDGRP

SEQ ID NO: 1473389 - protein, 20 aa, Mycobacterium tuberculosis
LRPPATVVFARRGKQIARGS

SEQ ID NO: 1473390 - protein, 26 aa, Mycobacterium tuberculosis
LRQLGCAGAACLGEFGGRDNSVIAGV

SEQ ID NO: 1473391 - protein, 23 aa, Mycobacterium tuberculosis
LRQTAARLADWVDAQGPELAPAD

SEQ ID NO: 1473392 - protein, 19 aa, Mycobacterium tuberculosis
LRRGGIQFADTRGYAYDRR

SEQ ID NO: 1473393 - protein, 19 aa, Mycobacterium tuberculosis
LRRSGRISGAKAWLGTALA

SEQ ID NO: 1473394 - protein, 21 aa, Mycobacterium tuberculosis
LRSDPSIEFVDRFAEQLAGVR

SEQ ID NO: 1473395 - protein, 18 aa, Mycobacterium tuberculosis
LRTATIRMLLAAIQTEEV

SEQ ID NO: 1473396 - protein, 21 aa, Mycobacterium tuberculosis
LRTAVRRAKVLAGLDEDTEVR

SEQ ID NO: 1473397 - protein, 17 aa, Mycobacterium tuberculosis
LRTVRCVSGTVELMMSC

SEQ ID NO: 1473398 - protein, 19 aa, Mycobacterium tuberculosis
LRVPDSHLIYVARPDDPAD

SEQ ID NO: 1473399 - protein, 21 aa, Mycobacterium tuberculosis
LSAALAEWRGPVLDDLREFSF

SEQ ID NO: 1473400 - protein, 18 aa, Mycobacterium tuberculosis
LSALLHVARTVVRRAERS

SEQ ID NO: 1473401 - protein, 17 aa, Mycobacterium tuberculosis
LSFGRFGDEPALTASDD

SEQ ID NO: 1473402 - protein, 17 aa, Mycobacterium tuberculosis
LSIAFAIGERHELGPVP

SEQ ID NO: 1473403 - protein, 20 aa, Mycobacterium tuberculosis
LSPDGRCKAFAAAADGTGFS

SEQ ID NO: 1473404 - protein, 24 aa, Mycobacterium tuberculosis
LSRNTTLWASWAFVGPNHRAYFGG

SEQ ID NO: 1473405 - protein, 20 aa, Mycobacterium tuberculosis
LSSSVPILGPYEDLIANTVA

SEQ ID NO: 1473406 - protein, 19 aa, Mycobacterium tuberculosis
LSVRAARDYHNGILDGDAV

SEQ ID NO: 1473407 - protein, 23 aa, Mycobacterium tuberculosis
LTAEQRGTVALMHGEREFPSFQA

SEQ ID NO: 1473408 - protein, 18 aa, Mycobacterium tuberculosis
LTDIPVRVYWPPVVRDNL

SEQ ID NO: 1473409 - protein, 17 aa, Mycobacterium tuberculosis
LTGRRVMLVPTMGALHE

SEQ ID NO: 1473410 - protein, 17 aa, Mycobacterium tuberculosis
LTPGYLTMGGFIPAQDE

SEQ ID NO: 1473411 - protein, 25 aa, Mycobacterium tuberculosis
LTVEGLRLAAGISEHERANRVFDER

SEQ ID NO: 1473412 - protein, 20 aa, Mycobacterium tuberculosis
LVAFGRYPTFEGYRQQLGID

SEQ ID NO: 1473413 - protein, 29 aa, Mycobacterium tuberculosis
LVDLILFDWPTHMLQLATWLAENPQLLVA

SEQ ID NO: 1473414 - protein, 17 aa, Mycobacterium tuberculosis
LVDSLGFTLSGLQPGFT

SEQ ID NO: 1473415 - protein, 34 aa, Mycobacterium tuberculosis
LVGLGAVGRAVRWRLSGLGLRVIAHDPYRDDAGH

SEQ ID NO: 1473416 - protein, 20 aa, Mycobacterium tuberculosis
LVHHPCVGDLGWIADAPKAP

SEQ ID NO: 1473417 - protein, 19 aa, Mycobacterium tuberculosis
LVIPFWKIGWQNLGLPTGF

SEQ ID NO: 1473418 - protein, 17 aa, Mycobacterium tuberculosis
LVKLTCRGRDLPTAVSR

SEQ ID NO: 1473419 - protein, 20 aa, Mycobacterium tuberculosis
LVKVPAGWSHTAAATTSVVF

SEQ ID NO: 1473420 - protein, 21 aa, Mycobacterium tuberculosis
LVLRHLAAKRIRVMEQFTVQA

SEQ ID NO: 1473421 - protein, 18 aa, Mycobacterium tuberculosis
LVRGRFVLVGVTPAVLAS

SEQ ID NO: 1473422 - protein, 19 aa, Mycobacterium tuberculosis
LVRHHLLLPITATRRDLND

SEQ ID NO: 1473423 - protein, 17 aa, Mycobacterium tuberculosis
LVSRAHRDKVAGYVPDD

SEQ ID NO: 1473424 - protein, 17 aa, Mycobacterium tuberculosis
LWIPVRRSWRLNERHYG

SEQ ID NO: 1473425 - protein, 19 aa, Mycobacterium tuberculosis
LWSPAGKPPTWWDSLPTDR

SEQ ID NO: 1473426 - protein, 18 aa, Mycobacterium tuberculosis
LYDLLAQAVAPKFYERDE

SEQ ID NO: 1473427 - protein, 19 aa, Mycobacterium tuberculosis
LYISYLRKKIDNGREPMIH

SEQ ID NO: 1473428 - protein, 25 aa, Mycobacterium tuberculosis
LYPRKGVSELTRFTPEAVVEKYGLP

SEQ ID NO: 1473429 - protein, 23 aa, Mycobacterium tuberculosis
MAGLRICARIAQARPLRDLLGSI

SEQ ID NO: 1473430 - protein, 25 aa, Mycobacterium tuberculosis
MAPGARPGPVPKPGIRTPRVGNNPF

SEQ ID NO: 1473431 - protein, 18 aa, Mycobacterium tuberculosis
MAVAAIRRLNARKECQKT

SEQ ID NO: 1473432 - protein, 17 aa, Mycobacterium tuberculosis
MEEVLLPVMYDIPSRDD

SEQ ID NO: 1473433 - protein, 17 aa, Mycobacterium tuberculosis
MGVQVIAGRGELIDSTP

SEQ ID NO: 1473434 - protein, 17 aa, Mycobacterium tuberculosis
MHIDAEYNADGSLRKPG

SEQ ID NO: 1473435 - protein, 32 aa, Mycobacterium tuberculosis; identical to SEQ ID NO: 203330

SEQ ID NO: 1473436 - protein, 24 aa, Mycobacterium tuberculosis
MLAMSAPYVEWLERTAAQTKQTAT

SEQ ID NO: 1473437 - protein, 18 aa, Mycobacterium tuberculosis
MLVPVHWGTFRLAPHPWG

SEQ ID NO: 1473438 - protein, 18 aa, Mycobacterium tuberculosis
MMINLFWLGLKGAPVDRL

SEQ ID NO: 1473439 - protein, 17 aa, Mycobacterium tuberculosis
MMSSMLGGMGIPGIGRK

SEQ ID NO: 1473440 - protein, 28 aa, Mycobacterium tuberculosis
MNNGVFYRGVGQGSLQFSITTPDLTLPP

SEQ ID NO: 1473441 - protein, 17 aa, Mycobacterium tuberculosis
MNSMAFDAMVPLKEALA

SEQ ID NO: 1473442 - protein, 21 aa, Mycobacterium tuberculosis
MPELMSELLWSRIGAQCDATI

SEQ ID NO: 1473443 - protein, 18 aa, Mycobacterium tuberculosis
MPENLVAVVQDGWRNIRR

SEQ ID NO: 1473444 - protein, 18 aa, Mycobacterium tuberculosis
MPTMTGLVPAGGEEVSAQ

SEQ ID NO: 1473445 - protein, 17 aa, Mycobacterium tuberculosis
MQLLAATNWFGQNAPAL

SEQ ID NO: 1473446 - protein, 19 aa, Mycobacterium tuberculosis
MRALIVVAGLRMSRTPPDI

SEQ ID NO: 1473447 - protein, 17 aa, Mycobacterium tuberculosis
MRALTGRSWRAGLRQRA

SEQ ID NO: 1473448 - protein, 25 aa, Mycobacterium tuberculosis
MRANLERWAPLLPEGATLVSLAKGI

SEQ ID NO: 1473449 - protein, 17 aa, Mycobacterium tuberculosis
MRAPLSASGDAVPAELL

SEQ ID NO: 1473450 - protein, 29 aa, Mycobacterium tuberculosis
MSAQAAAFHARFVQALAGAMGAYAAAEAA

SEQ ID NO: 1473451 - protein, 24 aa, Mycobacterium tuberculosis
MSEFPTDRGWDLAGLFDPDPDAAG

SEQ ID NO: 1473452 - protein, 17 aa, Mycobacterium tuberculosis
MSRPCMDAARCLSEEQI

SEQ ID NO: 1473453 - protein, 24 aa, Mycobacterium tuberculosis
MTDAALRYLKWLSKHSKRLWQTAN

SEQ ID NO: 1473454 - protein, 18 aa, Mycobacterium tuberculosis
MVKRLKKVADYVGTLSDD

SEQ ID NO: 1473455 - protein, 20 aa, Mycobacterium tuberculosis
NAGAGGTGFTQGADGNAGNG

SEQ ID NO: 1473456 - protein, 28 aa, Mycobacterium tuberculosis
NANYYARVCVDLLKPRKAQPLLPGIGKT

SEQ ID NO: 1473457 - protein, 23 aa, Mycobacterium tuberculosis
NDVADYLAGSGWQVTTSTGKELF

SEQ ID NO: 1473458 - protein, 22 aa, Mycobacterium tuberculosis
NEGLRSRFTRNIDFPSYTSHEL

SEQ ID NO: 1473459 - protein, 18 aa, Mycobacterium tuberculosis
NEGVKGAWVLARYDDGRP

SEQ ID NO: 1473460 - protein, 29 aa, Mycobacterium tuberculosis
NELDPAGARLCVRPMSEFQSNEAYRELHA

SEQ ID NO: 1473461 - protein, 22 aa, Mycobacterium tuberculosis
NERYKLVWKNRLGFARLAIQHG

SEQ ID NO: 1473462 - protein, 19 aa, Mycobacterium tuberculosis
NFGDCLSYALAIDRREPLL

SEQ ID NO: 1473463 - protein, 32 aa, Mycobacterium tuberculosis; identical to SEQ ID NO: 233926

SEQ ID NO: 1473464 - protein, 23 aa, Mycobacterium tuberculosis
NGGAGGLLIGNGGAGGVGGTAGA

SEQ ID NO: 1473465 - protein, 23 aa, Mycobacterium tuberculosis
NGGMGGNAVGLFGQGGAGGAGGS

SEQ ID NO: 1473466 - protein, 20 aa, Mycobacterium tuberculosis
NGGNGALLIGAGGVGGAGGI

SEQ ID NO: 1473467 - protein, 18 aa, Mycobacterium tuberculosis
NGGPAILSGNGGNGGAGG

SEQ ID NO: 1473468 - protein, 27 aa, Mycobacterium tuberculosis
NGGVGGRGGDGVFAGAGGQGGLGGQGG

SEQ ID NO: 1473469 - protein, 20 aa, Mycobacterium tuberculosis
NGIEVSRYFAELDWERNFLR

SEQ ID NO: 1473470 - protein, 18 aa, Mycobacterium tuberculosis
NGQPCRPPHCVASVSPAR

SEQ ID NO: 1473471 - protein, 25 aa, Mycobacterium tuberculosis
NGSLCKELSADIARRPMAKPVDFGS

SEQ ID NO: 1473472 - protein, 20 aa, Mycobacterium tuberculosis
NHLSCLRGCGLVVATYEGRQ

SEQ ID NO: 1473473 - protein, 20 aa, Mycobacterium tuberculosis
NILRRNGIEVSRYFAELDWE

SEQ ID NO: 1473474 - protein, 24 aa, Mycobacterium tuberculosis
NISIIDIPALPGFGNSTELPSSGF

SEQ ID NO: 1473475 - protein, 20 aa, Mycobacterium tuberculosis
NLLEEIGILLLPIAPELTPF

SEQ ID NO: 1473476 - protein, 25 aa, Mycobacterium tuberculosis
NLPICGQVKIPRPEHLAYYGGLAAL

SEQ ID NO: 1473477 - protein, 27 aa, Mycobacterium tuberculosis
NPRLTALMCTADILALSAMDYLRAHGI

SEQ ID NO: 1473478 - protein, 24 aa, Mycobacterium tuberculosis
NQIKLAVLVATNFFGINTIPIAIN

SEQ ID NO: 1473479 - protein, 20 aa, Mycobacterium tuberculosis
NRDGIPIAVRNELNLSVLQR

SEQ ID NO: 1473480 - protein, 20 aa, Mycobacterium tuberculosis
NRHQLVSLVLSNLFGQNAPA

SEQ ID NO: 1473481 - protein, 22 aa, Mycobacterium tuberculosis
NRLPPVHMFGGINLSFGLMGPL

SEQ ID NO: 1473482 - protein, 37 aa, Mycobacterium tuberculosis; identical to SEQ ID NO: 203675

SEQ ID NO: 1473483 - protein, 25 aa, Mycobacterium tuberculosis
NSPNGYRTDVDWATQISYSGVFVHS

SEQ ID NO: 1473484 - protein, 25 aa, Mycobacterium tuberculosis
NTGFGNAGFFNMGIGNAGNEDMGVG

SEQ ID NO: 1473485 - protein, 26 aa, Mycobacterium tuberculosis
NTPTQLLLGRPLIGNGANGAPGTGQA

SEQ ID NO: 1473486 - protein, 18 aa, Mycobacterium tuberculosis
PAACGGPFARLTLNSPHN

SEQ ID NO: 1473487 - protein, 19 aa, Mycobacterium tuberculosis
PAAGPAWFDIAGVRMAPAE

SEQ ID NO: 1473488 - protein, 20 aa, Mycobacterium tuberculosis
PAALLRWGVSQFDAEVRPVR

SEQ ID NO: 1473489 - protein, 20 aa, Mycobacterium tuberculosis
PAKLAGWWAEQFDGTTRELL

SEQ ID NO: 1473490 - protein, 21 aa, Mycobacterium tuberculosis
PAQAIAQVCELTWQLRGQATG

SEQ ID NO: 1473491 - protein, 19 aa, Mycobacterium tuberculosis
PATLDRVLAIGGPDASYVP

SEQ ID NO: 1473492 - protein, 27 aa, Mycobacterium tuberculosis
PATLKRFVDRFSRFNLREFAIRPAYGL

SEQ ID NO: 1473493 - protein, 17 aa, Mycobacterium tuberculosis
PAVAPWPGPTGERADWW

SEQ ID NO: 1473494 - protein, 20 aa, Mycobacterium tuberculosis
PDARGIYYGRLTEMTTTDFQ

SEQ ID NO: 1473495 - protein, 25 aa, Mycobacterium tuberculosis
PDELAEALAGFIAEFGLSLVGGCCG

SEQ ID NO: 1473496 - protein, 26 aa, Mycobacterium tuberculosis
PDEYVKGLAELGCFGLKIPSEYGGLN

SEQ ID NO: 1473497 - protein, 21 aa, Mycobacterium tuberculosis
PDGKVSPYHAVIVNTGESFMI

SEQ ID NO: 1473498 - protein, 23 aa, Mycobacterium tuberculosis
PDGMELPNKVYLASADHAIPVDE

SEQ ID NO: 1473499 - protein, 18 aa, Mycobacterium tuberculosis
PDHPKFHGPKGIGYAELP

SEQ ID NO: 1473500 - protein, 19 aa, Mycobacterium tuberculosis
PEDAWQFAGRVRELTGGTG

SEQ ID NO: 1473501 - protein, 26 aa, Mycobacterium tuberculosis
PEGKSIASFARRLQVAGVRVAAHTSH

SEQ ID NO: 1473502 - protein, 21 aa, Mycobacterium tuberculosis
PEINSALMFAGAGPGPMLAAA

SEQ ID NO: 1473503 - protein, 33 aa, Mycobacterium tuberculosis
PELISRWAAYWPPAGAEALFRWLSERDGRTRYS

SEQ ID NO: 1473504 - protein, 17 aa, Mycobacterium tuberculosis
PELPVAAAAAVPTASAT

SEQ ID NO: 1473505 - protein, 20 aa, Mycobacterium tuberculosis
PEVNSALMYAGPGSGPMLAA

SEQ ID NO: 1473506 - protein, 21 aa, Mycobacterium tuberculosis
PFGGAYRLIDFVLSNLVNARY

SEQ ID NO: 1473507 - protein, 25 aa, Mycobacterium tuberculosis
PGAEASWVVGITWWSAVVGGFQMSF

SEQ ID NO: 1473508 - protein, 22 aa, Mycobacterium tuberculosis
PGGPGQPGTEFGQTGGTGGTGG

SEQ ID NO: 1473509 - protein, 19 aa, Mycobacterium tuberculosis
PGGSTAIRIPATASVGPFD

SEQ ID NO: 1473510 - protein, 18 aa, Mycobacterium tuberculosis
PGGTAFPHCSGVLVAGDE

SEQ ID NO: 1473511 - protein, 17 aa, Mycobacterium tuberculosis
PGLATPVTPAANGGNGL

SEQ ID NO: 1473512 - protein, 18 aa, Mycobacterium tuberculosis
PGMHALRASTIVAALQYM

SEQ ID NO: 1473513 - protein, 17 aa, Mycobacterium tuberculosis
PGMSLFDIHELVNIGPF

SEQ ID NO: 1473514 - protein, 25 aa, Mycobacterium tuberculosis
PGPWKESLRLLAHEVMPRLNARLAT

SEQ ID NO: 1473515 - protein, 18 aa, Mycobacterium tuberculosis
PGQVLGLTFTRKAAGQLL

SEQ ID NO: 1473516 - protein, 17 aa, Mycobacterium tuberculosis
PGQVRTRMSAHLKEAPL

SEQ ID NO: 1473517 - protein, 36 aa, Mycobacterium tuberculosis
PGSGGIRGPLGLGFRVPCIVISPYSRGPLMVSDTFD

SEQ ID NO: 1473518 - protein, 18 aa, Mycobacterium tuberculosis
PHYIKTLRIWGDTLQSNK

SEQ ID NO: 1473519 - protein, 17 aa, Mycobacterium tuberculosis
PKIKQWLSQVLGNFPVY

SEQ ID NO: 1473520 - protein, 22 aa, Mycobacterium tuberculosis
PLATLEHNVLNALNAPTQALLG

SEQ ID NO: 1473521 - protein, 35 aa, Mycobacterium tuberculosis; identical to SEQ ID NO: 204163

SEQ ID NO: 1473522 - protein, 19 aa, Mycobacterium tuberculosis
PLRADLRGKAPYGAPQLAV

SEQ ID NO: 1473523 - protein, 20 aa, Mycobacterium tuberculosis
PLSLGRLDRGWVVASETAAL

SEQ ID NO: 1473524 - protein, 25 aa, Mycobacterium tuberculosis
PLTPGRMTTKWGGFVPDVAGFDAEF

SEQ ID NO: 1473525 - protein, 18 aa, Mycobacterium tuberculosis
PMAVGPLRVSAGVIRLRP

SEQ ID NO: 1473526 - protein, 21 aa, Mycobacterium tuberculosis
PMGCSICWHGPAGTPTMSVTI

SEQ ID NO: 1473527 - protein, 23 aa, Mycobacterium tuberculosis
PMSFLRRPARWMQLLATSGRCFS

SEQ ID NO: 1473528 - protein, 20 aa, Mycobacterium tuberculosis
PMYVGLLLILRRPRAGLSYE

SEQ ID NO: 1473529 - protein, 20 aa, Mycobacterium tuberculosis
PNAADWPLILADASQPLTLE

SEQ ID NO: 1473530 - protein, 21 aa, Mycobacterium tuberculosis
PNRLYWLSANIDPAGTDGGPQ

SEQ ID NO: 1473531 - protein, 17 aa, Mycobacterium tuberculosis
PPERGSRVRLCPTPGHL

SEQ ID NO: 1473532 - protein, 17 aa, Mycobacterium tuberculosis
PPGIPVDIGPGATVAHL

SEQ ID NO: 1473533 - protein, 19 aa, Mycobacterium tuberculosis
PPGSWTKYGHWLREPVGPI

SEQ ID NO: 1473534 - protein, 21 aa, Mycobacterium tuberculosis
PPYQGTVRMAFLLQGDHDAYF

SEQ ID NO: 1473535 - protein, 23 aa, Mycobacterium tuberculosis
PQARRADLRAGVLGEHQDQRRDR

SEQ ID NO: 1473536 - protein, 19 aa, Mycobacterium tuberculosis
PREWSDWVTRTAMPPLRIP

SEQ ID NO: 1473537 - protein, 20 aa, Mycobacterium tuberculosis
PRGDLDMKLRSVRAAARHEF

SEQ ID NO: 1473538 - protein, 20 aa, Mycobacterium tuberculosis
PRLRKPTVLVIDQIPDREGE

SEQ ID NO: 1473539 - protein, 19 aa, Mycobacterium tuberculosis
PRQVLGHRSPAELFTALLT

SEQ ID NO: 1473540 - protein, 17 aa, Mycobacterium tuberculosis
PRRGHRVLTRCQMSFVV

SEQ ID NO: 1473541 - protein, 18 aa, Mycobacterium tuberculosis
PSDRPWRLAMSTAGTFEN

SEQ ID NO: 1473542 - protein, 17 aa, Mycobacterium tuberculosis
PSLHPTVLVGMRNRLRA

SEQ ID NO: 1473543 - protein, 17 aa, Mycobacterium tuberculosis
PSRVWRAVREARDVLDD

SEQ ID NO: 1473544 - protein, 19 aa, Mycobacterium tuberculosis
PSSGPNLGRFGSFGRGVTP

SEQ ID NO: 1473545 - protein, 19 aa, Mycobacterium tuberculosis
PSVPLRIDVDGGIPGFTLF

SEQ ID NO: 1473546 - protein, 22 aa, Mycobacterium tuberculosis
PSWLRRWVRDGYAWVQPRLSPV

SEQ ID NO: 1473547 - protein, 21 aa, Mycobacterium tuberculosis
PTFSARLTAVAGRRVATGRDF

SEQ ID NO: 1473548 - protein, 18 aa, Mycobacterium tuberculosis
PTGTFTFAELLAHELSVE

SEQ ID NO: 1473549 - protein, 26 aa, Mycobacterium tuberculosis
PTMALLGRPLIGHGADGAPGTGQAGG

SEQ ID NO: 1473550 - protein, 21 aa, Mycobacterium tuberculosis
PTQIPSVAVPVTGAGGTGGNG

SEQ ID NO: 1473551 - protein, 21 aa, Mycobacterium tuberculosis
PVGEVRSRFYARAPELHRSPV

SEQ ID NO: 1473552 - protein, 25 aa, Mycobacterium tuberculosis
PVHAATLLPFIGRLLAARYAELNTA

SEQ ID NO: 1473553 - protein, 21 aa, Mycobacterium tuberculosis
PYLIRLPVGAGLVFATSDVWP

SEQ ID NO: 1473554 - protein, 29 aa, Mycobacterium tuberculosis
PYTLTGPIVIGSFFLPAFNIPGIDVPAIN

SEQ ID NO: 1473555 - protein, 21 aa, Mycobacterium tuberculosis
QALLGRPLIGDGAAGAPGTGQ

SEQ ID NO: 1473556 - protein, 21 aa, Mycobacterium tuberculosis
QALTGRPLIGNGANGTPGTGA

SEQ ID NO: 1473557 - protein, 17 aa, Mycobacterium tuberculosis
QAVGGAFVRLLDSSDEF

SEQ ID NO: 1473558 - protein, 19 aa, Mycobacterium tuberculosis
QAVIPGKCQLTVVPGATHL

SEQ ID NO: 1473559 - protein, 24 aa, Mycobacterium tuberculosis
QDAFGEKVLPLYLPSGDGLIGLLS

SEQ ID NO: 1473560 - protein, 24 aa, Mycobacterium tuberculosis
QDTRHGRPTLSAGTAIAQQHPAGT

SEQ ID NO: 1473561 - protein, 24 aa, Mycobacterium tuberculosis
QDYLATVITWHRHIAGLIEQAKSD

SEQ ID NO: 1473562 - protein, 20 aa, Mycobacterium tuberculosis
QEAWLRWDSQDTVIADPRAW

SEQ ID NO: 1473563 - protein, 24 aa, Mycobacterium tuberculosis
QEELMRAGTALTDIARMYGDTDDN

SEQ ID NO: 1473564 - protein, 17 aa, Mycobacterium tuberculosis
QEWIEGVPMAEIIRHGT

SEQ ID NO: 1473565 - protein, 19 aa, Mycobacterium tuberculosis
QIDIPGMSLFDVHEIVEIG

SEQ ID NO: 1473566 - protein, 18 aa, Mycobacterium tuberculosis
QLGRGYEYLDLDPETGHD

SEQ ID NO: 1473567 - protein, 25 aa, Mycobacterium tuberculosis
QLRSRSWWSGFDVVLLVDDWHMIVG

SEQ ID NO: 1473568 - protein, 18 aa, Mycobacterium tuberculosis
QNFGNLLSGWANLGNTVS

SEQ ID NO: 1473569 - protein, 17 aa, Mycobacterium tuberculosis
QNGFILPSFPPFSTPDV

SEQ ID NO: 1473570 - protein, 25 aa, Mycobacterium tuberculosis
QPDPGKWAGFELHRDVTVTEEFTLG

SEQ ID NO: 1473571 - protein, 24 aa, Mycobacterium tuberculosis
QPFQATAVIPVIGPVTVTLEGTPA

SEQ ID NO: 1473572 - protein, 21 aa, Mycobacterium tuberculosis
QPRKLRVMAEHVELPRGGRLG

SEQ ID NO: 1473573 - protein, 22 aa, Mycobacterium tuberculosis
QQEELWLLRGGDPGQPGLLPPA

SEQ ID NO: 1473574 - protein, 21 aa, Mycobacterium tuberculosis
QRAPQLGFGRYLVSATTPFTR

SEQ ID NO: 1473575 - protein, 20 aa, Mycobacterium tuberculosis
QRASSMPVNRYRPFAEEVEP

SEQ ID NO: 1473576 - protein, 17 aa, Mycobacterium tuberculosis
QRFLRALICRRWAGIAA

SEQ ID NO: 1473577 - protein, 18 aa, Mycobacterium tuberculosis
QRGLRPIQIWVPDVNAPE

SEQ ID NO: 1473578 - protein, 26 aa, Mycobacterium tuberculosis
QRGRGDALRLARRIAAALNASDNNAG

SEQ ID NO: 1473579 - protein, 20 aa, Mycobacterium tuberculosis
QRLSGPLQRLRAMAGGDVPV

SEQ ID NO: 1473580 - protein, 17 aa, Mycobacterium tuberculosis
QRTAPWVESLGLDHVRE

SEQ ID NO: 1473581 - protein, 26 aa, Mycobacterium tuberculosis
QSAVSEIPWSYDIGSNIEIPIEGDIN

SEQ ID NO: 1473582 - protein, 22 aa, Mycobacterium tuberculosis
QSPRHCGCEIVVLTTRQHGHPV

SEQ ID NO: 1473583 - protein, 23 aa, Mycobacterium tuberculosis
QSTSWAQRWLAATGNRDYLGAFV

SEQ ID NO: 1473584 - protein, 23 aa, Mycobacterium tuberculosis
QTGMGRTGAFFAHQHDGITPDVV

SEQ ID NO: 1473585 - protein, 23 aa, Mycobacterium tuberculosis
QTLLGRPLIGNGTNGAPGTGQAG

SEQ ID NO: 1473586 - protein, 24 aa, Mycobacterium tuberculosis
QTRRWNPKMKRFIFTDRNGIYIID

SEQ ID NO: 1473587 - protein, 25 aa, Mycobacterium tuberculosis
QVAAYQERFVLALSQASSTYAVAEA

SEQ ID NO: 1473588 - protein, 17 aa, Mycobacterium tuberculosis
QYQAWKHTQLIIDVVPG

SEQ ID NO: 1473589 - protein, 21 aa, Mycobacterium tuberculosis
RAAVDSGYYPGQFQVGQTGKT

SEQ ID NO: 1473590 - protein, 22 aa, Mycobacterium tuberculosis
RADLAAARRVCRRLTTSAPALA

SEQ ID NO: 1473591 - protein, 18 aa, Mycobacterium tuberculosis
RAKVLAGLDEDTEVRIVS

SEQ ID NO: 1473592 - protein, 23 aa, Mycobacterium tuberculosis
RALAEAACRAFDALAARYDVVVA

SEQ ID NO: 1473593 - protein, 30 aa, Mycobacterium tuberculosis
RALGEIRAIWRINELLNWQVASAGEDINMA

SEQ ID NO: 1473594 - protein, 17 aa, Mycobacterium tuberculosis
RALGYRLDGVHIAAVVW

SEQ ID NO: 1473595 - protein, 23 aa, Mycobacterium tuberculosis
RAPLAPIRLRIGMHTGEVSSPDE

SEQ ID NO: 1473596 - protein, 20 aa, Mycobacterium tuberculosis
RARHAKFATVIARDRAEAIA

SEQ ID NO: 1473597 - protein, 25 aa, Mycobacterium tuberculosis
RAVQAWRGFSRWLMRAYDVLVDEDQ

SEQ ID NO: 1473598 - protein, 21 aa, Mycobacterium tuberculosis
RAVVARARQKGCTLLVTDGDW

SEQ ID NO: 1473599 - protein, 18 aa, Mycobacterium tuberculosis
RDGVIPRRLVTSCEHFHR

SEQ ID NO: 1473600 - protein, 19 aa, Mycobacterium tuberculosis
RDLPRQPVHPELRVVDLAI

SEQ ID NO: 1473601 - protein, 20 aa, Mycobacterium tuberculosis
RDTLLWAKLIDKYQGTMTAA

SEQ ID NO: 1473602 - protein, 18 aa, Mycobacterium tuberculosis
REILDSRGNPTVEVEVAL

SEQ ID NO: 1473603 - protein, 19 aa, Mycobacterium tuberculosis
RELIQVLGHAGVRSLVSQP

SEQ ID NO: 1473604 - protein, 20 aa, Mycobacterium tuberculosis
RELRQLWEDRGCPRMPPRPR

SEQ ID NO: 1473605 - protein, 22 aa, Mycobacterium tuberculosis
RELTARTGGVVGRRVCAVVGSG

SEQ ID NO: 1473606 - protein, 17 aa, Mycobacterium tuberculosis
RERRKLISVLRHRGRIL

SEQ ID NO: 1473607 - protein, 20 aa, Mycobacterium tuberculosis
REVLTAWGAYGEKQMYGKTV

SEQ ID NO: 1473608 - protein, 17 aa, Mycobacterium tuberculosis
RFGDAFIPMDETLAHAA

SEQ ID NO: 1473609 - protein, 18 aa, Mycobacterium tuberculosis
RFHVVPVLAYSPDPGPVA

SEQ ID NO: 1473610 - protein, 18 aa, Mycobacterium tuberculosis
RFKVVWQALNALRSHDER

SEQ ID NO: 1473611 - protein, 21 aa, Mycobacterium tuberculosis
RFNLREFAIRPAYGLAEATVY

SEQ ID NO: 1473612 - protein, 20 aa, Mycobacterium tuberculosis
RFSGWQSTRQRVWGQMDSAR

SEQ ID NO: 1473613 - protein, 19 aa, Mycobacterium tuberculosis
RFVIDVTVWIDLAEAANSD

SEQ ID NO: 1473614 - protein, 25 aa, Mycobacterium tuberculosis
RGAEYSVDFVPKVRIEVVVDDSIVD

SEQ ID NO: 1473615 - protein, 19 aa, Mycobacterium tuberculosis
RGLLAPGCFIPVAESINLA

SEQ ID NO: 1473616 - protein, 19 aa, Mycobacterium tuberculosis
RGPAKRPARKAARKVPAKK

SEQ ID NO: 1473617 - protein, 19 aa, Mycobacterium tuberculosis
RGPTVPILLDTGSSSLVIP

SEQ ID NO: 1473618 - protein, 21 aa, Mycobacterium tuberculosis
RGRDRLLVLGLARGGVPVGWE

SEQ ID NO: 1473619 - protein, 18 aa, Mycobacterium tuberculosis
RGSRCARCARGWHDQGRH

SEQ ID NO: 1473620 - protein, 23 aa, Mycobacterium tuberculosis
RGTGARGLRAIMEEVLLPVMYDI

SEQ ID NO: 1473621 - protein, 17 aa, Mycobacterium tuberculosis
RHALALGPSKALLDGQI

SEQ ID NO: 1473622 - protein, 19 aa, Mycobacterium tuberculosis
RHELLSGLVPQISIILGKC

SEQ ID NO: 1473623 - protein, 26 aa, Mycobacterium tuberculosis
RHGLSSLGWNLCRIFTDGDHTLYADV

SEQ ID NO: 1473624 - protein, 18 aa, Mycobacterium tuberculosis
RHPGWPMAVGPLRVSAGV

SEQ ID NO: 1473625 - protein, 20 aa, Mycobacterium tuberculosis
RINQSFPVTVNWSTPAVTIF

SEQ ID NO: 1473626 - protein, 20 aa, Mycobacterium tuberculosis
RIRDVTELWCQGYSEPGAGS

SEQ ID NO: 1473627 - protein, 24 aa, Mycobacterium tuberculosis
RISIPSCRPGWCGPITASTECWDV

SEQ ID NO: 1473628 - protein, 18 aa, Mycobacterium tuberculosis
RIVPYPGTPLYQAYSDAG

SEQ ID NO: 1473629 - protein, 24 aa, Mycobacterium tuberculosis
RIVSYPGSSLWDMVRPRPSSRPAA

SEQ ID NO: 1473630 - protein, 20 aa, Mycobacterium tuberculosis
RKPPPAWARPQQLQIETDDA

SEQ ID NO: 1473631 - protein, 20 aa, Mycobacterium tuberculosis
RKSVRPRPHRPAGARAAFKP

SEQ ID NO: 1473632 - protein, 19 aa, Mycobacterium tuberculosis
RLAALYGLQLAHESQCCQM

SEQ ID NO: 1473633 - protein, 21 aa, Mycobacterium tuberculosis
RLAGEMLELAGIHGRDPAQTL

SEQ ID NO: 1473634 - protein, 26 aa, Mycobacterium tuberculosis
RLDERGVLRLRALMESFWSDELDRLV

SEQ ID NO: 1473635 - protein, 17 aa, Mycobacterium tuberculosis
RLHRVLGPLAHVNLIPL

SEQ ID NO: 1473636 - protein, 22 aa, Mycobacterium tuberculosis
RLLDCCQETDGAVAIVLTSAAR

SEQ ID NO: 1473637 - protein, 17 aa, Mycobacterium tuberculosis
RLLGEAITQAQLVLADH

SEQ ID NO: 1473638 - protein, 31 aa, Mycobacterium tuberculosis
RLLRATKYTVCFKFMSRIVPYPGTPLYQAYS

SEQ ID NO: 1473639 - protein, 17 aa, Mycobacterium tuberculosis
RLMRFDKHGPLDLILYH

SEQ ID NO: 1473640 - protein, 18 aa, Mycobacterium tuberculosis
RLPLSASVWDIAQRYNKG

SEQ ID NO: 1473641 - protein, 18 aa, Mycobacterium tuberculosis
RLPPTLPARSSMAAATVM

SEQ ID NO: 1473642 - protein, 25 aa, Mycobacterium tuberculosis
RLSTEHWMVPASLSMAAAVQPYLVW

SEQ ID NO: 1473643 - protein, 21 aa, Mycobacterium tuberculosis
RLVAACIDAGVSVTCLPGPSA

SEQ ID NO: 1473644 - protein, 17 aa, Mycobacterium tuberculosis
RLVTSCEHFHRQAVGIV

SEQ ID NO: 1473645 - protein, 18 aa, Mycobacterium tuberculosis
RLWEHPKDKLSHYSDRTV

SEQ ID NO: 1473646 - protein, 17 aa, Mycobacterium tuberculosis
RLYERLLGWLADIQQPR

SEQ ID NO: 1473647 - protein, 18 aa, Mycobacterium tuberculosis
RMLMDAAIFKDTLIMSYE

SEQ ID NO: 1473648 - protein, 19 aa, Mycobacterium tuberculosis
RMWAASGVDYPTLLATMIE

SEQ ID NO: 1473649 - protein, 33 aa, Mycobacterium tuberculosis; identical to SEQ ID NO: 205635

SEQ ID NO: 1473650 - protein, 20 aa, Mycobacterium tuberculosis
RNQGAFGFSEPCTDCRGSGS

SEQ ID NO: 1473651 - protein, 24 aa, Mycobacterium tuberculosis
RNTQPGWVVAPGMQGVQVGPITQG

SEQ ID NO: 1473652 - protein, 20 aa, Mycobacterium tuberculosis
RPACGVCVLAKDCPSFGLGP

SEQ ID NO: 1473653 - protein, 18 aa, Mycobacterium tuberculosis
RPEHLAYYGGLAALAALE

SEQ ID NO: 1473654 - protein, 26 aa, Mycobacterium tuberculosis
RPELGLRPRLAIGIHQPGVGALRPPV

SEQ ID NO: 1473655 - protein, 20 aa, Mycobacterium tuberculosis
RPGDVISLGATSWRITEITH

SEQ ID NO: 1473656 - protein, 20 aa, Mycobacterium tuberculosis
RPGQYEAPLGITLRELLDYA

SEQ ID NO: 1473657 - protein, 23 aa, Mycobacterium tuberculosis
RPGVPRPGASPGSMPPRPGGAVG

SEQ ID NO: 1473658 - protein, 17 aa, Mycobacterium tuberculosis
RPWQLGTEMLRVTKPGG

SEQ ID NO: 1473659 - protein, 18 aa, Mycobacterium tuberculosis
RQAAVAAGIGWDVPALTI

SEQ ID NO: 1473660 - protein, 17 aa, Mycobacterium tuberculosis
RQGCGKTTALVAIGEAV

SEQ ID NO: 1473661 - protein, 19 aa, Mycobacterium tuberculosis
RQGEPAVSFLLISSGSAEV

SEQ ID NO: 1473662 - protein, 18 aa, Mycobacterium tuberculosis
RQGIRVNALCPGPVNTPL

SEQ ID NO: 1473663 - protein, 18 aa, Mycobacterium tuberculosis
RQGVRLGRGRGFYDRSLR

SEQ ID NO: 1473664 - protein, 21 aa, Mycobacterium tuberculosis
RQVPDNGGMYFVPAFSGLFAP

SEQ ID NO: 1473665 - protein, 19 aa, Mycobacterium tuberculosis
RRAAFGLATEIGRELTART

SEQ ID NO: 1473666 - protein, 21 aa, Mycobacterium tuberculosis
RRDGWWQGLGPYDVVLDALGG

SEQ ID NO: 1473667 - protein, 21 aa, Mycobacterium tuberculosis
RRDRGWLAWCARFDRGHRGDR

SEQ ID NO: 1473668 - protein, 22 aa, Mycobacterium tuberculosis
RRGRDRIPLTGRIAVIVDDGIA

SEQ ID NO: 1473669 - protein, 17 aa, Mycobacterium tuberculosis
RRKVLEEAFRVLRPGGE

SEQ ID NO: 1473670 - protein, 20 aa, Mycobacterium tuberculosis
RRLAEKLWNLRVLADEKSAS

SEQ ID NO: 1473671 - protein, 26 aa, Mycobacterium tuberculosis
RRLAKELDFRPRKSLGQNFVHDANTV

SEQ ID NO: 1473672 - protein, 21 aa, Mycobacterium tuberculosis
RRLRHACALIADNVTQPLTLQ

SEQ ID NO: 1473673 - protein, 20 aa, Mycobacterium tuberculosis
RRLRVGPRQPGVQWHQARLR

SEQ ID NO: 1473674 - protein, 20 aa, Mycobacterium tuberculosis
RRPSWEEITEVLEWLSPLPG

SEQ ID NO: 1473675 - protein, 17 aa, Mycobacterium tuberculosis
RRRFRHVLVDEYQDTNH

SEQ ID NO: 1473676 - protein, 21 aa, Mycobacterium tuberculosis
RRRLIKYISQIDVERYRSLIE

SEQ ID NO: 1473677 - protein, 17 aa, Mycobacterium tuberculosis
RRRRSVVAPGLRHHHVQ

SEQ ID NO: 1473678 - protein, 18 aa, Mycobacterium tuberculosis
RRSASVTAVAWRTSAGAA

SEQ ID NO: 1473679 - protein, 19 aa, Mycobacterium tuberculosis
RRSLFGRRIAKYGWPNLSD

SEQ ID NO: 1473680 - protein, 24 aa, Mycobacterium tuberculosis
RRSLRPVGIVEVDGFPVFDVPPDA

SEQ ID NO: 1473681 - protein, 18 aa, Mycobacterium tuberculosis
RRTGLPGSPTRGPANSIT

SEQ ID NO: 1473682 - protein, 17 aa, Mycobacterium tuberculosis
RRVIVYFYPAASTPGCT

SEQ ID NO: 1473683 - protein, 25 aa, Mycobacterium tuberculosis
RRWWPRRYRRSSVYWRLMALDQRFG

SEQ ID NO: 1473684 - protein, 19 aa, Mycobacterium tuberculosis
RSLERLECLVRRLPAVGHT

SEQ ID NO: 1473685 - protein, 18 aa, Mycobacterium tuberculosis
RSLLGGRLTGVVVVTGPP

SEQ ID NO: 1473686 - protein, 17 aa, Mycobacterium tuberculosis
RSPHGVSAGGSRLVGVA

SEQ ID NO: 1473687 - protein, 17 aa, Mycobacterium tuberculosis
RSRRGGRGWVVPAGGAV

SEQ ID NO: 1473688 - protein, 20 aa, Mycobacterium tuberculosis
RSTCRSLEFHRAVEVIAVGR

SEQ ID NO: 1473689 - protein, 22 aa, Mycobacterium tuberculosis
RTLPAHELATALNLMNERTLFA

SEQ ID NO: 1473690 - protein, 22 aa, Mycobacterium tuberculosis
RTRRPPAFPEDIWVPERDPGTT

SEQ ID NO: 1473691 - protein, 28 aa, Mycobacterium tuberculosis
RTSGEQRLSGFLLWQSAYSEMWFTEAHW

SEQ ID NO: 1473692 - protein, 19 aa, Mycobacterium tuberculosis
RTSNDLLLVPSIVEPSNFL

SEQ ID NO: 1473693 - protein, 18 aa, Mycobacterium tuberculosis
RTTPSIVAFARNGEVLVG

SEQ ID NO: 1473694 - protein, 26 aa, Mycobacterium tuberculosis
RVAQTRAAPHLARITCPALVLNAEAD

SEQ ID NO: 1473695 - protein, 20 aa, Mycobacterium tuberculosis
RVCGAIGVIECDRPVDLAVA

SEQ ID NO: 1473696 - protein, 17 aa, Mycobacterium tuberculosis
RVNDPRNEWLFNDAWGV

SEQ ID NO: 1473697 - protein, 33 aa, Mycobacterium tuberculosis; identical to SEQ ID NO: 234201

SEQ ID NO: 1473698 - protein, 21 aa, Mycobacterium tuberculosis
RVQVGHGLVVDFVRSCGMTAI

SEQ ID NO: 1473699 - protein, 19 aa, Mycobacterium tuberculosis
RVRATLVLDGDTLRVEANS

SEQ ID NO: 1473700 - protein, 20 aa, Mycobacterium tuberculosis
RVYPEMPENLVAVVQDGWRN

SEQ ID NO: 1473701 - protein, 21 aa, Mycobacterium tuberculosis
RWMGSGPLTGLAEIQLPDLQP

SEQ ID NO: 1473702 - protein, 18 aa, Mycobacterium tuberculosis
RWSPTALRILGAAAELIA

SEQ ID NO: 1473703 - protein, 20 aa, Mycobacterium tuberculosis
RYDPGALRRSRISARTRDLC

SEQ ID NO: 1473704 - protein, 23 aa, Mycobacterium tuberculosis
RYMLDRRRALGGFVPERRTKSKA

SEQ ID NO: 1473705 - protein, 17 aa, Mycobacterium tuberculosis
RYPNMLRLRYEKKRNLP

SEQ ID NO: 1473706 - protein, 20 aa, Mycobacterium tuberculosis
SACRPHSGTDLLAGIGGTPE

SEQ ID NO: 1473707 - protein, 25 aa, Mycobacterium tuberculosis
SADEVSVAVAALFGTHAQEYQTVSA

SEQ ID NO: 1473708 - protein, 31 aa, Mycobacterium tuberculosis; identical to SEQ ID NO: 206199

SEQ ID NO: 1473709 - protein, 24 aa, Mycobacterium tuberculosis
SAGGDGGRGGFGGDGLDASSGGNG

SEQ ID NO: 1473710 - protein, 19 aa, Mycobacterium tuberculosis
SAGKWPDKFLAGAAGVAHG

SEQ ID NO: 1473711 - protein, 26 aa, Mycobacterium tuberculosis
SAGVQLFRPAFLLAVPTALGGVGSLA

SEQ ID NO: 1473712 - protein, 23 aa, Mycobacterium tuberculosis
SAPGSRLAFEFVPDTAIFADERW

SEQ ID NO: 1473713 - protein, 19 aa, Mycobacterium tuberculosis
SAPRAHFEIPDDLGPGRQP

SEQ ID NO: 1473714 - protein, 23 aa, Mycobacterium tuberculosis
SAQAATFHAQFVQTLSAGAGAYA

SEQ ID NO: 1473715 - protein, 23 aa, Mycobacterium tuberculosis
SAQMSAFHAQFVQTFTAGAGAYA

SEQ ID NO: 1473716 - protein, 17 aa, Mycobacterium tuberculosis
SAWIAEGLLIYLPATAQ

SEQ ID NO: 1473717 - protein, 20 aa, Mycobacterium tuberculosis
SCQAIWRLDDGYLAASDPRR

SEQ ID NO: 1473718 - protein, 20 aa, Mycobacterium tuberculosis
SDLLICQKMDMNVHGKPDGL

SEQ ID NO: 1473719 - protein, 24 aa, Mycobacterium tuberculosis
SDNNAGDYGFFWITAVTTDGSIVV

SEQ ID NO: 1473720 - protein, 17 aa, Mycobacterium tuberculosis
SDPWRKLSANRDNRVFV

SEQ ID NO: 1473721 - protein, 17 aa, Mycobacterium tuberculosis
SDVVLFPGTGFVELAIR

SEQ ID NO: 1473722 - protein, 25 aa, Mycobacterium tuberculosis
SEARRTLEEISQWRVGILEQLARIH

SEQ ID NO: 1473723 - protein, 21 aa, Mycobacterium tuberculosis
SEFPPLSWRRDLSVDALLARN

SEQ ID NO: 1473724 - protein, 25 aa, Mycobacterium tuberculosis
SEFPWCGQAAEVLRSHFGSSLPVRV

SEQ ID NO: 1473725 - protein, 19 aa, Mycobacterium tuberculosis
SEGAISCYQYSKVTIELSD

SEQ ID NO: 1473726 - protein, 19 aa, Mycobacterium tuberculosis
SESLRLAREREANLIPGGK

SEQ ID NO: 1473727 - protein, 27 aa, Mycobacterium tuberculosis
SFAHVVRAVHRCLLAGRFATALGADDD

SEQ ID NO: 1473728 - protein, 17 aa, Mycobacterium tuberculosis
SGDACRVPWAAPDVPSA

SEQ ID NO: 1473729 - protein, 26 aa, Mycobacterium tuberculosis
SGGAGGAGGWLWGNGGAGGNGGVGVA

SEQ ID NO: 1473730 - protein, 20 aa, Mycobacterium tuberculosis
SGHLDWYADGMFPPMHIDAE

SEQ ID NO: 1473731 - protein, 38 aa, Mycobacterium tuberculosis
SGLADAAWRGPAAVAMARAVAPYLGWLISATAQAEQAA

SEQ ID NO: 1473732 - protein, 23 aa, Mycobacterium tuberculosis
SGMPRLYREAPLMGIWEGSGNVS

SEQ ID NO: 1473733 - protein, 20 aa, Mycobacterium tuberculosis
SGNFSTGLFNPGHGNTGFLN

SEQ ID NO: 1473734 - protein, 17 aa, Mycobacterium tuberculosis
SGNRGSYNIGPANLGNY

SEQ ID NO: 1473735 - protein, 36 aa, Mycobacterium tuberculosis
SGNYSNGAFWRGDYQGLLGFSYRPAVLPQTPFLDLT

SEQ ID NO: 1473736 - protein, 25 aa, Mycobacterium tuberculosis
SGRFEFRAGPIFTNLLLADEINRTP

SEQ ID NO: 1473737 - protein, 20 aa, Mycobacterium tuberculosis
SGTGRTRCAGRSGVISSAAM

SEQ ID NO: 1473738 - protein, 24 aa, Mycobacterium tuberculosis
SGVAVSPVTGLVFVTNFDSNTVSV

SEQ ID NO: 1473739 - protein, 25 aa, Mycobacterium tuberculosis
SHGPAVLGAPAWKPPHPLSDSITAA

SEQ ID NO: 1473740 - protein, 21 aa, Mycobacterium tuberculosis
SHGSPFRSGPIRTLADLEDIA

SEQ ID NO: 1473741 - protein, 17 aa, Mycobacterium tuberculosis
SIPYRVPYPQVMPTQET

SEQ ID NO: 1473742 - protein, 23 aa, Mycobacterium tuberculosis
SIRTILRALAIHRRPSANSKLGA

SEQ ID NO: 1473743 - protein, 24 aa, Mycobacterium tuberculosis
SKGWNLPGLMCAQVILSNRRDAHD

SEQ ID NO: 1473744 - protein, 24 aa, Mycobacterium tuberculosis
SKTVIGLNMLRLWDDRRTLEPWIA

SEQ ID NO: 1473745 - protein, 18 aa, Mycobacterium tuberculosis
SLARLLAPVLPKLDTVHT

SEQ ID NO: 1473746 - protein, 18 aa, Mycobacterium tuberculosis
SLARPVADTVWPTPFLAH

SEQ ID NO: 1473747 - protein, 18 aa, Mycobacterium tuberculosis
SLIPVAAVVGTVRTGVGV

SEQ ID NO: 1473748 - protein, 23 aa, Mycobacterium tuberculosis
SLLVRSLVAWFWDQPLRAPLIRH

SEQ ID NO: 1473749 - protein, 31 aa, Mycobacterium tuberculosis; identical to SEQ ID NO: 206518

SEQ ID NO: 1473750 - protein, 24 aa, Mycobacterium tuberculosis
SLPIFGFGGAPGFGNDTTAPSSGF

SEQ ID NO: 1473751 - protein, 19 aa, Mycobacterium tuberculosis
SLRDPYHAYTIDWLPEGWF

SEQ ID NO: 1473752 - protein, 21 aa, Mycobacterium tuberculosis
SLTAPAPFVYGLGAVGPALTT

SEQ ID NO: 1473753 - protein, 17 aa, Mycobacterium tuberculosis
SLVDDLVRRCRMVMAGE

SEQ ID NO: 1473754 - protein, 20 aa, Mycobacterium tuberculosis
SLVIRIAPPVGRQLDWMVCR

SEQ ID NO: 1473755 - protein, 24 aa, Mycobacterium tuberculosis
SMQVCQKAQCPFSTADSENLQIPQ

SEQ ID NO: 1473756 - protein, 27 aa, Mycobacterium tuberculosis
SNGMLWRGDHEGLFGLSYGITIPQFPI

SEQ ID NO: 1473757 - protein, 24 aa, Mycobacterium tuberculosis
SPEAFIRKPARWMQLLAKHQAPFS

SEQ ID NO: 1473758 - protein, 20 aa, Mycobacterium tuberculosis
SPFAASLLFGYVGAFMYEGD

SEQ ID NO: 1473759 - protein, 40 aa, Mycobacterium tuberculosis
SPGAEASWVVGITWWSAVVGGFQMSFVIAVPETIAAAATD

SEQ ID NO: 1473760 - protein, 18 aa, Mycobacterium tuberculosis
SPGLMIAMGPGFCSELVL

SEQ ID NO: 1473761 - protein, 17 aa, Mycobacterium tuberculosis
SPHVVAVGFTFDPKTHI

SEQ ID NO: 1473762 - protein, 23 aa, Mycobacterium tuberculosis
SQLRSRFGFLAIHGGGLEQATDL

SEQ ID NO: 1473763 - protein, 21 aa, Mycobacterium tuberculosis
SRDALTFARRRGVLVANAVGE

SEQ ID NO: 1473764 - protein, 19 aa, Mycobacterium tuberculosis
SRDPERHPGLAIGAVAVVN

SEQ ID NO: 1473765 - protein, 17 aa, Mycobacterium tuberculosis
SRFEHLVGYPFAPHYVD

SEQ ID NO: 1473766 - protein, 24 aa, Mycobacterium tuberculosis
SRHARIPVSVMPNAGLPVLGAKGA

SEQ ID NO: 1473767 - protein, 23 aa, Mycobacterium tuberculosis
SRLPRWRAMAAHALCKRDDLARQ

SEQ ID NO: 1473768 - protein, 18 aa, Mycobacterium tuberculosis
SRPLAAPVVRKLAKELAV

SEQ ID NO: 1473769 - protein, 19 aa, Mycobacterium tuberculosis
SRRRGIGTAMARAALAKTA

SEQ ID NO: 1473770 - protein, 22 aa, Mycobacterium tuberculosis
SRVRVWCGGTLVADHDRIWAKH

SEQ ID NO: 1473771 - protein, 18 aa, Mycobacterium tuberculosis
SSGSEFESAVGYSRAVRI

SEQ ID NO: 1473772 - protein, 17 aa, Mycobacterium tuberculosis
SSSALGWIIDHATTDET

SEQ ID NO: 1473773 - protein, 19 aa, Mycobacterium tuberculosis
SSSASEFCGIFAAPGLMRN

SEQ ID NO: 1473774 - protein, 21 aa, Mycobacterium tuberculosis
STFIEVCYLLIYGELPDTDQL

SEQ ID NO: 1473775 - protein, 19 aa, Mycobacterium tuberculosis
SVFELQARAILGLAVDTLM

SEQ ID NO: 1473776 - protein, 19 aa, Mycobacterium tuberculosis
SVFRADFLSELDAPAQAGT

SEQ ID NO: 1473777 - protein, 17 aa, Mycobacterium tuberculosis
SVGGMSVPPSWAAATPA

SEQ ID NO: 1473778 - protein, 18 aa, Mycobacterium tuberculosis
SVNGTVVVSVWQPGEPAA

SEQ ID NO: 1473779 - protein, 18 aa, Mycobacterium tuberculosis
SVPLRIDVDGGIPGFTLF

SEQ ID NO: 1473780 - protein, 22 aa, Mycobacterium tuberculosis
SVRMGAAVTPYVEWLTTTAAQA

SEQ ID NO: 1473781 - protein, 20 aa, Mycobacterium tuberculosis
SVSMTAQWWLDAREPKKEVV

SEQ ID NO: 1473782 - protein, 21 aa, Mycobacterium tuberculosis
SWQAREWLPFVGIERADTDRP

SEQ ID NO: 1473783 - protein, 20 aa, Mycobacterium tuberculosis
SYNGMLYFGINADRDAMSDV

SEQ ID NO: 1473784 - protein, 20 aa, Mycobacterium tuberculosis
TAAARAVSWPAVTSPAGPVT

SEQ ID NO: 1473785 - protein, 22 aa, Mycobacterium tuberculosis
TACSSGLTAVHMACRSLHEGES

SEQ ID NO: 1473786 - protein, 19 aa, Mycobacterium tuberculosis
TALWEEWPPSGARASIHSY

SEQ ID NO: 1473787 - protein, 22 aa, Mycobacterium tuberculosis
TAPRPATLYRLSVVDVLLGSQV

SEQ ID NO: 1473788 - protein, 17 aa, Mycobacterium tuberculosis
TAPSGRKPLRFTSFGDQ

SEQ ID NO: 1473789 - protein, 22 aa, Mycobacterium tuberculosis
TAPSGRKPLRFTSFGDQSTPAL

SEQ ID NO: 1473790 - protein, 17 aa, Mycobacterium tuberculosis
TDALIRFGVEAYEGADL

SEQ ID NO: 1473791 - protein, 20 aa, Mycobacterium tuberculosis
TDGNPGMGGSPGSAGQPGQP

SEQ ID NO: 1473792 - protein, 17 aa, Mycobacterium tuberculosis
TDIDAVLEFRVSEEVLL

SEQ ID NO: 1473793 - protein, 23 aa, Mycobacterium tuberculosis
TDVPTGVVVPYFWSDQYDVKIQC

SEQ ID NO: 1473794 - protein, 19 aa, Mycobacterium tuberculosis
TEKGRWYLVGHDRDRDATR

SEQ ID NO: 1473795 - protein, 25 aa, Mycobacterium tuberculosis
TELSRAVFSKGIFPAVDPLASSSTI

SEQ ID NO: 1473796 - protein, 42 aa, Mycobacterium tuberculosis; identical to SEQ ID NO: 210187

SEQ ID NO: 1473797 - protein, 25 aa, Mycobacterium tuberculosis
TFGYKFRPWRHVKVLADGASIRQYI

SEQ ID NO: 1473798 - protein, 17 aa, Mycobacterium tuberculosis
TGAMYRIVTLAVLRAGA

SEQ ID NO: 1473799 - protein, 25 aa, Mycobacterium tuberculosis
TGDLARYWHDGTLEFVGRADHRVKI

SEQ ID NO: 1473800 - protein, 26 aa, Mycobacterium tuberculosis
TGGAGGRGGLLIGDGGAGGAGGVGGT

SEQ ID NO: 1473801 - protein, 28 aa, Mycobacterium tuberculosis
TGGGGGNGGTGWNGGKGDTGSGGGAGDG

SEQ ID NO: 1473802 - protein, 22 aa, Mycobacterium tuberculosis
TGGLGGLGLFLAEKMANAGAGR

SEQ ID NO: 1473803 - protein, 28 aa, Mycobacterium tuberculosis
TGGLGGLGLVVARWLVDRGAGRVVLGGR

SEQ ID NO: 1473804 - protein, 24 aa, Mycobacterium tuberculosis
TGGTAHLGPLAIIGQSGQPGQFGS

SEQ ID NO: 1473805 - protein, 17 aa, Mycobacterium tuberculosis
TGLARQGYQAEYHGTAI

SEQ ID NO: 1473806 - protein, 24 aa, Mycobacterium tuberculosis
TGLRPDFPRPALLSGAGDAVEFRL

SEQ ID NO: 1473807 - protein, 23 aa, Mycobacterium tuberculosis
TGQAGGNGGWLWGNGGNGGSGAP

SEQ ID NO: 1473808 - protein, 23 aa, Mycobacterium tuberculosis
TGQAGGPGGILYGNGGNGGSGAP

SEQ ID NO: 1473809 - protein, 24 aa, Mycobacterium tuberculosis
TGREAAHLRAFRAYAAHSQEIALH

SEQ ID NO: 1473810 - protein, 17 aa, Mycobacterium tuberculosis
TGRTHLQFRRFAACPIC

SEQ ID NO: 1473811 - protein, 20 aa, Mycobacterium tuberculosis
TGSPIPVGLDPTGVAVNPVT

SEQ ID NO: 1473812 - protein, 27 aa, Mycobacterium tuberculosis
TGVGSCRDSAWLLVSILRQFGLAARFV

SEQ ID NO: 1473813 - protein, 19 aa, Mycobacterium tuberculosis
TGWRLHGRTARWIEIAAEW

SEQ ID NO: 1473814 - protein, 25 aa, Mycobacterium tuberculosis
TIRTGRANPGMFSRITIDYYGAATP

SEQ ID NO: 1473815 - protein, 30 aa, Mycobacterium tuberculosis
TITIPEIPYRYDLSVPIDIPITGTVVATTP

SEQ ID NO: 1473816 - protein, 18 aa, Mycobacterium tuberculosis
TLAELRVGVLAAATTDIR

SEQ ID NO: 1473817 - protein, 18 aa, Mycobacterium tuberculosis
TLLGRPLVGDGADGASGP

SEQ ID NO: 1473818 - protein, 29 aa, Mycobacterium tuberculosis
TLSTQAAAFHSRFVQALTTAAASYASVEA

SEQ ID NO: 1473819 - protein, 23 aa, Mycobacterium tuberculosis
TMKHLRAGYWRQVRAQLTVTPVM

SEQ ID NO: 1473820 - protein, 24 aa, Mycobacterium tuberculosis
TMLPTGEVVRRCYTDVLAAARPAT

SEQ ID NO: 1473821 - protein, 22 aa, Mycobacterium tuberculosis
TMLREYLEAMRALWTQEEACYD

SEQ ID NO: 1473822 - protein, 17 aa, Mycobacterium tuberculosis
TNREAWAAYAAFLDDDR

SEQ ID NO: 1473823 - protein, 18 aa, Mycobacterium tuberculosis
TNVLLLRGMIGKPGAGVC

SEQ ID NO: 1473824 - protein, 24 aa, Mycobacterium tuberculosis
TPDSLHWDCFSFGVIQRADSFTFY

SEQ ID NO: 1473825 - protein, 22 aa, Mycobacterium tuberculosis
TPKLRARQLISQWERYRRGIYC

SEQ ID NO: 1473826 - protein, 18 aa, Mycobacterium tuberculosis
TQQLKKLAGLSERLTSAA

SEQ ID NO: 1473827 - protein, 26 aa, Mycobacterium tuberculosis
TQRAFLRYGKGRHRAALNFGDCMTYA

SEQ ID NO: 1473828 - protein, 26 aa, Mycobacterium tuberculosis
TRFVYRRLGADAGVPVIFLHHLGAVL

SEQ ID NO: 1473829 - protein, 19 aa, Mycobacterium tuberculosis
TRGAPTVRIRGFSLWGDVG

SEQ ID NO: 1473830 - protein, 17 aa, Mycobacterium tuberculosis
TRKSRRLRTDLVGGDQA

SEQ ID NO: 1473831 - protein, 21 aa, Mycobacterium tuberculosis
TRLWEHWGKPEIVWYPGGHTG

SEQ ID NO: 1473832 - protein, 21 aa, Mycobacterium tuberculosis
TRRPPAFPEDIWVPERRHHAV

SEQ ID NO: 1473833 - protein, 19 aa, Mycobacterium tuberculosis
TRVQVLWSLADREMSVNEL

SEQ ID NO: 1473834 - protein, 25 aa, Mycobacterium tuberculosis
TSDIKNLLPMLAVFKPTVVVSVPRV

SEQ ID NO: 1473835 - protein, 22 aa, Mycobacterium tuberculosis
TSGRLTDTWSRPRCMRRHWPPG

SEQ ID NO: 1473836 - protein, 25 aa, Mycobacterium tuberculosis
TSLRRSYTLLRPGGRLVGYGISNMQ

SEQ ID NO: 1473837 - protein, 18 aa, Mycobacterium tuberculosis
TSTRCWTNAWMCWTRRRN

SEQ ID NO: 1473838 - protein, 20 aa, Mycobacterium tuberculosis
TTIRNLVHGIGFQRDVLGAE

SEQ ID NO: 1473839 - protein, 20 aa, Mycobacterium tuberculosis
TTLLSALGITGQFRFGPITV

SEQ ID NO: 1473840 - protein, 23 aa, Mycobacterium tuberculosis
TTTGARYRATFAHNVDAYKSTAV

SEQ ID NO: 1473841 - protein, 24 aa, Mycobacterium tuberculosis
TVAVLLRITEVFGVDATFFASQDD

SEQ ID NO: 1473842 - protein, 17 aa, Mycobacterium tuberculosis
TVGLGPFTVPPISIPSL

SEQ ID NO: 1473843 - protein, 21 aa, Mycobacterium tuberculosis
TVKTFKRAGGQVWLMPHNPAF

SEQ ID NO: 1473844 - protein, 22 aa, Mycobacterium tuberculosis
TVSAADRPAHWRATDVAPTDAG

SEQ ID NO: 1473845 - protein, 23 aa, Mycobacterium tuberculosis
TVSAADRPAHWRATDVAPTDAGG

SEQ ID NO: 1473846 - protein, 17 aa, Mycobacterium tuberculosis
TVSGLYVCEMVTARALI

SEQ ID NO: 1473847 - protein, 25 aa, Mycobacterium tuberculosis
TWSRPRCMRRHWPPGWHVPTCLRLA

SEQ ID NO: 1473848 - protein, 18 aa, Mycobacterium tuberculosis
TYAFQHQKFWLAPAPSVS

SEQ ID NO: 1473849 - protein, 22 aa, Mycobacterium tuberculosis
TYARIGERWRIGSDGLVLEVSA

SEQ ID NO: 1473850 - protein, 17 aa, Mycobacterium tuberculosis
VALRARLYPLLGPRHDP

SEQ ID NO: 1473851 - protein, 18 aa, Mycobacterium tuberculosis
VALRARLYPLLGPRHDPT

SEQ ID NO: 1473852 - protein, 17 aa, Mycobacterium tuberculosis
VAMGRAIVRRPRVFCMD

SEQ ID NO: 1473853 - protein, 21 aa, Mycobacterium tuberculosis
VARLRVILRRAGKGNKEPRNV

SEQ ID NO: 1473854 - protein, 26 aa, Mycobacterium tuberculosis
VASAFGGGNAFGGRGGDGGDGGDGGT

SEQ ID NO: 1473855 - protein, 28 aa, Mycobacterium tuberculosis
VAVDLRDEWQIALCNNGFDANRPSAWIA

SEQ ID NO: 1473856 - protein, 21 aa, Mycobacterium tuberculosis
VCDLGRQIGYLLASQEPALAE

SEQ ID NO: 1473857 - protein, 18 aa, Mycobacterium tuberculosis
VDALNRLNRNSCSSPRAG

SEQ ID NO: 1473858 - protein, 25 aa, Mycobacterium tuberculosis
VDDPDFDLGRHVWRIALPRPGNEDQ

SEQ ID NO: 1473859 - protein, 20 aa, Mycobacterium tuberculosis
VDEFERWVVEHGFRGLNLRP

SEQ ID NO: 1473860 - protein, 18 aa, Mycobacterium tuberculosis
VDGARWLSLEGRVAVNSD

SEQ ID NO: 1473861 - protein, 18 aa, Mycobacterium tuberculosis
VDRQLARLADRVAAKHTE

SEQ ID NO: 1473862 - protein, 24 aa, Mycobacterium tuberculosis
VDTHFGRLVRRWRWTTAEDPVKVE

SEQ ID NO: 1473863 - protein, 18 aa, Mycobacterium tuberculosis
VDVPLKFHHPMWREHCKV

SEQ ID NO: 1473864 - protein, 17 aa, Mycobacterium tuberculosis
VDYRLIPKHSIGMALDD

SEQ ID NO: 1473865 - protein, 30 aa, Mycobacterium tuberculosis
VEASHCYPHFRRFLAEVVRVLRPGRYFPYA

SEQ ID NO: 1473866 - protein, 18 aa, Mycobacterium tuberculosis
VEGFRPATLHQAYLALRA

SEQ ID NO: 1473867 - protein, 21 aa, Mycobacterium tuberculosis
VEGGWKINGQKVWTSGAQYCA

SEQ ID NO: 1473868 - protein, 22 aa, Mycobacterium tuberculosis
VENLRYTVRFAAAVQAALKDGY

SEQ ID NO: 1473869 - protein, 19 aa, Mycobacterium tuberculosis
VEPRMLLVHFLRDQLRLTG

SEQ ID NO: 1473870 - protein, 20 aa, Mycobacterium tuberculosis
VEQRPELVLDRVRAFLAAGT

SEQ ID NO: 1473871 - protein, 21 aa, Mycobacterium tuberculosis
VFARMWRGYARGVLEKLSALL

SEQ ID NO: 1473872 - protein, 24 aa, Mycobacterium tuberculosis
VFFESPRRLAACLNDAVEQLGGAR

SEQ ID NO: 1473873 - protein, 18 aa, Mycobacterium tuberculosis
VFGSPTWRTVTGGSANYV

SEQ ID NO: 1473874 - protein, 17 aa, Mycobacterium tuberculosis
VFRAWKLHDELGLNIVM

SEQ ID NO: 1473875 - protein, 24 aa, Mycobacterium tuberculosis
VFVPRPETEAILAWATAQSLPARP

SEQ ID NO: 1473876 - protein, 25 aa, Mycobacterium tuberculosis
VGAMSRPRMDAARCLSEEQIGVTVV

SEQ ID NO: 1473877 - protein, 19 aa, Mycobacterium tuberculosis
VGAVVGRYAAGGYEVDFTA

SEQ ID NO: 1473878 - protein, 18 aa, Mycobacterium tuberculosis
VGDPSGFVKLVADAKHGE

SEQ ID NO: 1473879 - protein, 25 aa, Mycobacterium tuberculosis
VGFDIPNDFVVGYGLDYDERYRDLS

SEQ ID NO: 1473880 - protein, 24 aa, Mycobacterium tuberculosis
VGGDGGRGGLLAGNGGTGGAGGNG

SEQ ID NO: 1473881 - protein, 17 aa, Mycobacterium tuberculosis
VGLFGVDVGDVLAGVDR

SEQ ID NO: 1473882 - protein, 19 aa, Mycobacterium tuberculosis
VGPAEKIYDPGIILDKDRG

SEQ ID NO: 1473883 - protein, 17 aa, Mycobacterium tuberculosis
VGVLAGFPVEIAPTAQA

SEQ ID NO: 1473884 - protein, 17 aa, Mycobacterium tuberculosis
VGVLDMLAVFYNDTPDE

SEQ ID NO: 1473885 - protein, 17 aa, Mycobacterium tuberculosis
VGWCDGRGDGHWVVSIR

SEQ ID NO: 1473886 - protein, 20 aa, Mycobacterium tuberculosis
VGYPREWRRRKPYSWLRQVL

SEQ ID NO: 1473887 - protein, 21 aa, Mycobacterium tuberculosis
VHAAGARWILDLGPGDILTRL

SEQ ID NO: 1473888 - protein, 24 aa, Mycobacterium tuberculosis
VHADAGIDFFEVFCDTPLQDCERR

SEQ ID NO: 1473889 - protein, 29 aa, Mycobacterium tuberculosis
VHADAGIDFFEVFCDTPLQDCERRDPKGL

SEQ ID NO: 1473890 - protein, 26 aa, Mycobacterium tuberculosis
VIATGPRWRCPAGRCRRRPSDRAYRL

SEQ ID NO: 1473891 - protein, 19 aa, Mycobacterium tuberculosis
VIDCARPQSNHAFGAEPGV

SEQ ID NO: 1473892 - protein, 19 aa, Mycobacterium tuberculosis
VIISDFLGPINWMRPLRAI

SEQ ID NO: 1473893 - protein, 17 aa, Mycobacterium tuberculosis
VIVTGDFNARYSDDQSA

SEQ ID NO: 1473894 - protein, 17 aa, Mycobacterium tuberculosis
VKLPNRWPLTDAAGVPV

SEQ ID NO: 1473895 - protein, 20 aa, Mycobacterium tuberculosis
VKTFDELDCLLDRLDGTVPF

SEQ ID NO: 1473896 - protein, 22 aa, Mycobacterium tuberculosis
VKWTGSRVDLVFGSNSELRALV

SEQ ID NO: 1473897 - protein, 20 aa, Mycobacterium tuberculosis
VLAKDCPSFGLGPTEPLLAA

SEQ ID NO: 1473898 - protein, 23 aa, Mycobacterium tuberculosis
VLDVTHITRWAGCIGNRSTVIAV

SEQ ID NO: 1473899 - protein, 36 aa, Mycobacterium tuberculosis
VLERGLLLRLRFELDHHINLRPARLYPGVASPLSGN

SEQ ID NO: 1473900 - protein, 19 aa, Mycobacterium tuberculosis
VLFCGVVGPGPAHIRTVRL

SEQ ID NO: 1473901 - protein, 17 aa, Mycobacterium tuberculosis
VLHEVRIMLDQYWPSVP

SEQ ID NO: 1473902 - protein, 19 aa, Mycobacterium tuberculosis
VLMATNFFGINTIPIALNE

SEQ ID NO: 1473903 - protein, 20 aa, Mycobacterium tuberculosis
VLRLEGLEVIPSVLPPAPAG

SEQ ID NO: 1473904 - protein, 18 aa, Mycobacterium tuberculosis
VLRSMGIPCRYVSGYLHP

SEQ ID NO: 1473905 - protein, 18 aa, Mycobacterium tuberculosis
VLVHPAPRGVLGGLAATV

SEQ ID NO: 1473906 - protein, 29 aa, Mycobacterium tuberculosis
VMTIPGMRLPFTSIVPFVVYYGPVELPQS

SEQ ID NO: 1473907 - protein, 29 aa, Mycobacterium tuberculosis
VNAPTQALFGRPLIGNGADGSPGTGQAGG

SEQ ID NO: 1473908 - protein, 23 aa, Mycobacterium tuberculosis
VNDARFLIYPAMKALTLDIASMV

SEQ ID NO: 1473909 - protein, 25 aa, Mycobacterium tuberculosis
VNPPGDERHMLWFELMKPMTSTATG

SEQ ID NO: 1473910 - protein, 17 aa, Mycobacterium tuberculosis
VNTGAFIGGNFSNGAFW

SEQ ID NO: 1473911 - protein, 18 aa, Mycobacterium tuberculosis
VNTGAFIGGNFSNGAFWQ

SEQ ID NO: 1473912 - protein, 20 aa, Mycobacterium tuberculosis
VPDIPIPAIHIGINGVVTVG

SEQ ID NO: 1473913 - protein, 23 aa, Mycobacterium tuberculosis
VPIWGDVELAWRLDAAGCYGPPR

SEQ ID NO: 1473914 - protein, 23 aa, Mycobacterium tuberculosis
VPPCAPFARRASSSGYARADRRI

SEQ ID NO: 1473915 - protein, 17 aa, Mycobacterium tuberculosis
VPSARRYLPGSLIMETT

SEQ ID NO: 1473916 - protein, 26 aa, Mycobacterium tuberculosis
VPSLPFRLIHIADTYTPIAPEDLPGR

SEQ ID NO: 1473917 - protein, 20 aa, Mycobacterium tuberculosis
VQDLGIEVFLVMPFTTDFMK

SEQ ID NO: 1473918 - protein, 19 aa, Mycobacterium tuberculosis
VQEIGWAEHWQCDSCSASH

SEQ ID NO: 1473919 - protein, 18 aa, Mycobacterium tuberculosis
VQGSGWAALGWDTLGNKL

SEQ ID NO: 1473920 - protein, 17 aa, Mycobacterium tuberculosis
VQLASLLVGEWDVIALD

SEQ ID NO: 1473921 - protein, 17 aa, Mycobacterium tuberculosis
VQVIAGRGELIDSTPGL

SEQ ID NO: 1473922 - protein, 20 aa, Mycobacterium tuberculosis
VRARLRQSWLERGATDAELG

SEQ ID NO: 1473923 - protein, 21 aa, Mycobacterium tuberculosis
VRARWERRLAEVGVDRLHAEL

SEQ ID NO: 1473924 - protein, 25 aa, Mycobacterium tuberculosis
VRATMKVSWRLYAYVSKDADRAQRR

SEQ ID NO: 1473925 - protein, 22 aa, Mycobacterium tuberculosis
VRRPAIAAVRAEYERVLRQRTA

SEQ ID NO: 1473926 - protein, 20 aa, Mycobacterium tuberculosis
VRSRRPGETASIFVPSVPNL

SEQ ID NO: 1473927 - protein, 21 aa, Mycobacterium tuberculosis
VRSRRPGETASIFVPSVPNLL

SEQ ID NO: 1473928 - protein, 19 aa, Mycobacterium tuberculosis
VRSTIRAARALLERIEAGE

SEQ ID NO: 1473929 - protein, 17 aa, Mycobacterium tuberculosis
VRTDELLDLWAAAYPGG

SEQ ID NO: 1473930 - protein, 17 aa, Mycobacterium tuberculosis
VRVAEGMVLGQWSAVVG

SEQ ID NO: 1473931 - protein, 28 aa, Mycobacterium tuberculosis
VSALKALEGDAKWVASVEELMNAVDESI

SEQ ID NO: 1473932 - protein, 17 aa, Mycobacterium tuberculosis
VSFKVRRGEVIGLLGPN

SEQ ID NO: 1473933 - protein, 20 aa, Mycobacterium tuberculosis
VSTQIAALFGAHARSYQTLS

SEQ ID NO: 1473934 - protein, 25 aa, Mycobacterium tuberculosis
VTADPRLNTGLTPFLLGPVYISNNP

SEQ ID NO: 1473935 - protein, 27 aa, Mycobacterium tuberculosis
VTADPRLNTGLTPFLLGPVYISNNPSG

SEQ ID NO: 1473936 - protein, 22 aa, Mycobacterium tuberculosis
VTARLWPTLIEPLRTREQARRD

SEQ ID NO: 1473937 - protein, 25 aa, Mycobacterium tuberculosis
VTVWQGRTGAMAVPVGWAATVVGEG

SEQ ID NO: 1473938 - protein, 19 aa, Mycobacterium tuberculosis
VVNLHRRYRITTAQLAAAT

SEQ ID NO: 1473939 - protein, 25 aa, Mycobacterium tuberculosis
VVRVLRPGRYFPYADLRPNNEIAAW

SEQ ID NO: 1473940 - protein, 19 aa, Mycobacterium tuberculosis
VVSKPAALVHGMFVALPAA

SEQ ID NO: 1473941 - protein, 22 aa, Mycobacterium tuberculosis
VVSLSSLAARRGRIHFDDLQFE

SEQ ID NO: 1473942 - protein, 20 aa, Mycobacterium tuberculosis
VVSPGDLWDLLRDGREAAGS

SEQ ID NO: 1473943 - protein, 17 aa, Mycobacterium tuberculosis
VWTLRLYLTGKRLWHDP

SEQ ID NO: 1473944 - protein, 25 aa, Mycobacterium tuberculosis
VYPALGRTPLVVWPAGPGTRRQPGI

SEQ ID NO: 1473945 - protein, 17 aa, Mycobacterium tuberculosis
WAALPFDERAAVFLRAA

SEQ ID NO: 1473946 - protein, 17 aa, Mycobacterium tuberculosis
WADLIVFAGNCALESMG

SEQ ID NO: 1473947 - protein, 20 aa, Mycobacterium tuberculosis
WADLRRRVAALAGALSGRGV

SEQ ID NO: 1473948 - protein, 18 aa, Mycobacterium tuberculosis
WASSGHVGFKGSRKSTPF

SEQ ID NO: 1473949 - protein, 17 aa, Mycobacterium tuberculosis
WCGMTIPRVYPEMPENL

SEQ ID NO: 1473950 - protein, 22 aa, Mycobacterium tuberculosis
WDELAAELWLAAASFESVCSGL

SEQ ID NO: 1473951 - protein, 18 aa, Mycobacterium tuberculosis
WDQLKWNALANIAGTPAT

SEQ ID NO: 1473952 - protein, 17 aa, Mycobacterium tuberculosis
WEAAAGLTVHAPSLHPT

SEQ ID NO: 1473953 - protein, 21 aa, Mycobacterium tuberculosis
WEQVADWDFVCEQLAAAEPWW

SEQ ID NO: 1473954 - protein, 17 aa, Mycobacterium tuberculosis
WGRRHVVMGANQVDRYG

SEQ ID NO: 1473955 - protein, 25 aa, Mycobacterium tuberculosis
WGTPRPRWRSAQALTSRSCNGSLDT

SEQ ID NO: 1473956 - protein, 24 aa, Mycobacterium tuberculosis
WIEGRRYLGLEVLTRARAALTSTE

SEQ ID NO: 1473957 - protein, 20 aa, Mycobacterium tuberculosis
WLDTFTHWRRAQDLPATSIA

SEQ ID NO: 1473958 - protein, 20 aa, Mycobacterium tuberculosis
WLPCFHDMGMVGFLTIPMFF

SEQ ID NO: 1473959 - protein, 21 aa, Mycobacterium tuberculosis
WLRERPREMARTVFIELLAWQ

SEQ ID NO: 1473960 - protein, 17 aa, Mycobacterium tuberculosis
WLVDRGAGRVVLGGRSD

SEQ ID NO: 1473961 - protein, 17 aa, Mycobacterium tuberculosis
WNGTLCDDRTILLDAVG

SEQ ID NO: 1473962 - protein, 25 aa, Mycobacterium tuberculosis
WPASYDASLRVSWRQLQPTDPRTLP

SEQ ID NO: 1473963 - protein, 18 aa, Mycobacterium tuberculosis
WPDPRASLCDIARALRPG

SEQ ID NO: 1473964 - protein, 19 aa, Mycobacterium tuberculosis
WPLTDAAGVPVVFLTAYYA

SEQ ID NO: 1473965 - protein, 21 aa, Mycobacterium tuberculosis
WPSYVRVSAGLPRTMTFKVIK

SEQ ID NO: 1473966 - protein, 18 aa, Mycobacterium tuberculosis
WRTIGRVLDGPARVLVDG

SEQ ID NO: 1473967 - protein, 19 aa, Mycobacterium tuberculosis
WRWDMLAAKLADFLRGDDA

SEQ ID NO: 1473968 - protein, 25 aa, Mycobacterium tuberculosis
WSLAVALRLAAYQLLRVDGGEPVLL

SEQ ID NO: 1473969 - protein, 25 aa, Mycobacterium tuberculosis
WSPDSDLKGFDGFDGGSGGAGGDGG

SEQ ID NO: 1473970 - protein, 18 aa, Mycobacterium tuberculosis
WVVEHGFRGLNLRPFMIG

SEQ ID NO: 1473971 - protein, 18 aa, Mycobacterium tuberculosis
YARHTGGTFVFRIEDTDA

SEQ ID NO: 1473972 - protein, 18 aa, Mycobacterium tuberculosis
YDQIWKDHVLALNGAYQM

SEQ ID NO: 1473973 - protein, 18 aa, Mycobacterium tuberculosis
YDQLSVRAARDYHNGILD

SEQ ID NO: 1473974 - protein, 19 aa, Mycobacterium tuberculosis
YERVGKRGLGFGAEVRSKA

SEQ ID NO: 1473975 - protein, 18 aa, Mycobacterium tuberculosis
YGAAGFAVLERTIAELRA

SEQ ID NO: 1473976 - protein, 23 aa, Mycobacterium tuberculosis
YGEMWAQDAAAMFGYAAATATAT

SEQ ID NO: 1473977 - protein, 17 aa, Mycobacterium tuberculosis
YGGVEFYSAIAAGSPER

SEQ ID NO: 1473978 - protein, 25 aa, Mycobacterium tuberculosis
YGVHLMCSAGGWIHGQRQSLLQNVT

SEQ ID NO: 1473979 - protein, 20 aa, Mycobacterium tuberculosis
YHWIDYPGPDRAAAIVRRTV

SEQ ID NO: 1473980 - protein, 19 aa, Mycobacterium tuberculosis
YLVAEILRIISGGRLIWDP

SEQ ID NO: 1473981 - protein, 20 aa, Mycobacterium tuberculosis
YLVAEILRIISGGRLIWDPA

SEQ ID NO: 1473982 - protein, 36 aa, Mycobacterium tuberculosis
YNIAGLPFPLSSAILPRFFYTKEIGKRLNAYYVANV

SEQ ID NO: 1473983 - protein, 20 aa, Mycobacterium tuberculosis
YQAISTQVAAFHDRFAQTLS

SEQ ID NO: 1473984 - protein, 17 aa, Mycobacterium tuberculosis
YQPGRRCASWVKDKHWN

SEQ ID NO: 1473985 - protein, 18 aa, Mycobacterium tuberculosis
YRESLGFEVLPLSGGERP

SEQ ID NO: 1473986 - protein, 19 aa, Mycobacterium tuberculosis
YRLRAVSAVGLRFPLNGTA

SEQ ID NO: 1473987 - protein, 28 aa, Mycobacterium tuberculosis
YTAPEISARILMKLKRDAEAYLGEDITD

SEQ ID NO: 1473988 - protein, 31 aa, Mycobacterium tuberculosis; identical to SEQ ID NO: 210415

SEQ ID NO: 1473989 - protein, 22 aa, Mycobacterium tuberculosis
YTGELAGGFAFVPGLETVGTIA

SEQ ID NO: 1473990 - protein, 17 aa, Mycobacterium tuberculosis
YVGLLLILRRPRAGLSY

SEQ ID NO: 1473991 - protein, 19 aa, Mycobacterium tuberculosis
YWLQEFHIDGLRVDAVASM

SEQ ID NO: 1473992 - protein, 17 aa, Mycobacterium tuberculosis
AAAARLTPFSPLAPIAN

SEQ ID NO: 1473993 - protein, 26 aa, Mycobacterium tuberculosis
AAACLARAGLRVRLLERLAQTGGAAV

SEQ ID NO: 1473994 - protein, 27 aa, Mycobacterium tuberculosis
AAAGGWPTWVWAISGWPTPAPATSGSG

SEQ ID NO: 1473995 - protein, 19 aa, Mycobacterium tuberculosis
AAANAFLDGLVAYRRSRGL

SEQ ID NO: 1473996 - protein, 23 aa, Mycobacterium tuberculosis
AAARTGHPWWTLSQLSDESAIEL

SEQ ID NO: 1473997 - protein, 23 aa, Mycobacterium tuberculosis
AAATRGGWRAGGVRDGRIGTLVP

SEQ ID NO: 1473998 - protein, 29 aa, Mycobacterium tuberculosis
AAAVLRFAATEVIPRLAGTATEIEQVLRA

SEQ ID NO: 1473999 - protein, 23 aa, Mycobacterium tuberculosis
AAAYETAYRLTVPPPVIAENRTE

SEQ ID NO: 1474000 - protein, 18 aa, Mycobacterium tuberculosis
AACTKLGTEHLVGTTLNV

SEQ ID NO: 1474001 - protein, 17 aa, Mycobacterium tuberculosis
AADAARIGSAINTANTA

SEQ ID NO: 1474002 - protein, 18 aa, Mycobacterium tuberculosis
AADVAAMVSYHSGASAVA

SEQ ID NO: 1474003 - protein, 21 aa, Mycobacterium tuberculosis
AAFCYAAAVVTELGGPMSHAA

SEQ ID NO: 1474004 - protein, 18 aa, Mycobacterium tuberculosis
AAFQLARSDADIAALAEV

SEQ ID NO: 1474005 - protein, 26 aa, Mycobacterium tuberculosis
AAGDEVSAAIAALFSSHGQQYQAMSA

SEQ ID NO: 1474006 - protein, 29 aa, Mycobacterium tuberculosis
AAGGLNWASLPLKLFAGGNAKFWHPADID

SEQ ID NO: 1474007 - protein, 22 aa, Mycobacterium tuberculosis
AAGNLARLGSMISAANSAAAAQ

SEQ ID NO: 1474008 - protein, 24 aa, Mycobacterium tuberculosis
AAGRAAPRLTVCVPVAVNPGAAAH

SEQ ID NO: 1474009 - protein, 17 aa, Mycobacterium tuberculosis
AAHGLGRPPADVTAEHL

SEQ ID NO: 1474010 - protein, 20 aa, Mycobacterium tuberculosis
AAHRRVWRDREPALASPRRP

SEQ ID NO: 1474011 - protein, 20 aa, Mycobacterium tuberculosis
AALARSRATLVLHLAAAQID

SEQ ID NO: 1474012 - protein, 24 aa, Mycobacterium tuberculosis
AALDYSALYPAGWLVDAPLPAWTH

SEQ ID NO: 1474013 - protein, 19 aa, Mycobacterium tuberculosis
AALEHRGFESLFLAEHTHI

SEQ ID NO: 1474014 - protein, 17 aa, Mycobacterium tuberculosis
AALERRTGELAHELGQA

SEQ ID NO: 1474015 - protein, 23 aa, Mycobacterium tuberculosis
AALKNPEFDATLVTRAFSGRYAR

SEQ ID NO: 1474016 - protein, 24 aa, Mycobacterium tuberculosis
AALRIVLGHELFHYAARADTALDA

SEQ ID NO: 1474017 - protein, 18 aa, Mycobacterium tuberculosis
AALSGRPFIGNGTNGAPG

SEQ ID NO: 1474018 - protein, 26 aa, Mycobacterium tuberculosis
AAMARTCVDAGWLLSLSGTVSFRTAR

SEQ ID NO: 1474019 - protein, 25 aa, Mycobacterium tuberculosis
AANSWLDAFAHWRRAQGLPATSIAW

SEQ ID NO: 1474020 - protein, 17 aa, Mycobacterium tuberculosis
AAPIGRAVIEAALQGEP

SEQ ID NO: 1474021 - protein, 17 aa, Mycobacterium tuberculosis
AAPYVAWMSVTAVRAEQ

SEQ ID NO: 1474022 - protein, 19 aa, Mycobacterium tuberculosis
AARFPGPFIYTVHPSKIVR

SEQ ID NO: 1474023 - protein, 27 aa, Mycobacterium tuberculosis
AASAEAAAFHGRFVQALTTGGGAYAAA

SEQ ID NO: 1474024 - protein, 17 aa, Mycobacterium tuberculosis
AAVEQHLLEVLGASVDV

SEQ ID NO: 1474025 - protein, 25 aa, Mycobacterium tuberculosis
AAWFPSAEHLASWVRLCPGNHESAG

SEQ ID NO: 1474026 - protein, 23 aa, Mycobacterium tuberculosis
AAYQQRFVLALSQAGSTYAVAEA

SEQ ID NO: 1474027 - protein, 17 aa, Mycobacterium tuberculosis
ADAAVRLGPAPARESYL

SEQ ID NO: 1474028 - protein, 22 aa, Mycobacterium tuberculosis
ADARGVRACRGPGAGTRAPAWA

SEQ ID NO: 1474029 - protein, 17 aa, Mycobacterium tuberculosis
ADDRFWLAVGRTRSNAY

SEQ ID NO: 1474030 - protein, 24 aa, Mycobacterium tuberculosis
ADEVSAGIAALFSAHAQEYQALSA

SEQ ID NO: 1474031 - protein, 17 aa, Mycobacterium tuberculosis
ADIAAALAVQCRGGEAF

SEQ ID NO: 1474032 - protein, 17 aa, Mycobacterium tuberculosis
ADISGVYNTGALGLITS

SEQ ID NO: 1474033 - protein, 18 aa, Mycobacterium tuberculosis
ADLARLGREGVLALSTAE

SEQ ID NO: 1474034 - protein, 25 aa, Mycobacterium tuberculosis
ADLTNRSTIRWTLHQMVASGVVSVY

SEQ ID NO: 1474035 - protein, 17 aa, Mycobacterium tuberculosis
ADPSEWHGLAPVSTSDP

SEQ ID NO: 1474036 - protein, 26 aa, Mycobacterium tuberculosis
ADQRADWACDFWDCAAAEVAAALTIS

SEQ ID NO: 1474037 - protein, 17 aa, Mycobacterium tuberculosis
ADRLYERLLGWLADIQQ

SEQ ID NO: 1474038 - protein, 17 aa, Mycobacterium tuberculosis
ADVLLAHLVLRPFLDAY

SEQ ID NO: 1474039 - protein, 20 aa, Mycobacterium tuberculosis
ADVLPLPGGLTVHLPQPPNY

SEQ ID NO: 1474040 - protein, 22 aa, Mycobacterium tuberculosis
ADVTWLDCLGIPTVQAVRPASL

SEQ ID NO: 1474041 - protein, 23 aa, Mycobacterium tuberculosis
AEADLFYSDFVERVAEGRKMTTD

SEQ ID NO: 1474042 - protein, 18 aa, Mycobacterium tuberculosis
AEGVAGAAGEDLSPHGTS

SEQ ID NO: 1474043 - protein, 18 aa, Mycobacterium tuberculosis
AEGVRLFRFDRIVDAAEL

SEQ ID NO: 1474044 - protein, 17 aa, Mycobacterium tuberculosis
AEILVYGHVPFELVSYV

SEQ ID NO: 1474045 - protein, 23 aa, Mycobacterium tuberculosis
AELALRLAEHGLRDERLADILTR

SEQ ID NO: 1474046 - protein, 23 aa, Mycobacterium tuberculosis
AELSVWPPVGARAMDVADGYQVL

SEQ ID NO: 1474047 - protein, 22 aa, Mycobacterium tuberculosis
AEMEMKVLLWAVQRLIGGLSTI

SEQ ID NO: 1474048 - protein, 20 aa, Mycobacterium tuberculosis
AEMWAQDAMAMYGYAGSSAT

SEQ ID NO: 1474049 - protein, 17 aa, Mycobacterium tuberculosis
AENALLRGFPMASAGQS

SEQ ID NO: 1474050 - protein, 21 aa, Mycobacterium tuberculosis
AEPGWTMFMISHFHYDPVWWN

SEQ ID NO: 1474051 - protein, 22 aa, Mycobacterium tuberculosis
AEPITAVSLAWLPAGDYERALD

SEQ ID NO: 1474052 - protein, 18 aa, Mycobacterium tuberculosis
AESFSEVHPLPGRDLMPV

SEQ ID NO: 1474053 - protein, 19 aa, Mycobacterium tuberculosis
AEVAALGRFASAYTESLEN

SEQ ID NO: 1474054 - protein, 26 aa, Mycobacterium tuberculosis
AFAEFLEVRGSLLPDDERLLAEQWLL

SEQ ID NO: 1474055 - protein, 18 aa, Mycobacterium tuberculosis
AFGASRFTGIDFSDEAVA

SEQ ID NO: 1474056 - protein, 20 aa, Mycobacterium tuberculosis
AFKPSYGIAEATLLVATIDH

SEQ ID NO: 1474057 - protein, 19 aa, Mycobacterium tuberculosis
AFRVLRPGGELIFTDPMQA

SEQ ID NO: 1474058 - protein, 17 aa, Mycobacterium tuberculosis
AFTIPGFSIPEQPLPLA

SEQ ID NO: 1474059 - protein, 30 aa, Mycobacterium tuberculosis
AGADEISAAIAALFGAHGRAYQAASAEAAA

SEQ ID NO: 1474060 - protein, 57 aa, Mycobacterium tuberculosis; identical to SEQ ID NO: 233120

SEQ ID NO: 1474061 - protein, 19 aa, Mycobacterium tuberculosis
AGAGLMRAGSLPGEAGSAA

SEQ ID NO: 1474062 - protein, 23 aa, Mycobacterium tuberculosis
AGAGLMRAGSLPGEAGSAARTPL

SEQ ID NO: 1474063 - protein, 30 aa, Mycobacterium tuberculosis
AGDFWGGAGSVACQGFITQLGRNFQVIYEQ

SEQ ID NO: 1474064 - protein, 17 aa, Mycobacterium tuberculosis
AGDRARLAVTIGSRAHA

SEQ ID NO: 1474065 - protein, 19 aa, Mycobacterium tuberculosis
AGFPLGWVHDVVWAPRPIG

SEQ ID NO: 1474066 - protein, 24 aa, Mycobacterium tuberculosis
AGGAGGAGGFGFGGAGGAGGLGGK

SEQ ID NO: 1474067 - protein, 24 aa, Mycobacterium tuberculosis
AGGAGGNGGWLYGNGGPGGAAGLG

SEQ ID NO: 1474068 - protein, 20 aa, Mycobacterium tuberculosis
AGGIAQLFGTGGMGGSGGGI

SEQ ID NO: 1474069 - protein, 19 aa, Mycobacterium tuberculosis
AGGKAGLIGNGGNGGAGGA

SEQ ID NO: 1474070 - protein, 19 aa, Mycobacterium tuberculosis
AGGKAGLYGNGGDGGAGGD

SEQ ID NO: 1474071 - protein, 21 aa, Mycobacterium tuberculosis
AGGNGAHGFNAVLVSDGGNGG

SEQ ID NO: 1474072 - protein, 17 aa, Mycobacterium tuberculosis
AGGNGGWLWGNGGNGGS

SEQ ID NO: 1474073 - protein, 20 aa, Mycobacterium tuberculosis
AGGVGGRPAGNSFASGAAGT

SEQ ID NO: 1474074 - protein, 23 aa, Mycobacterium tuberculosis
AGKAGPAGSILHDGGNGGHGGHG

SEQ ID NO: 1474075 - protein, 18 aa, Mycobacterium tuberculosis
AGKVAALLPGRDPYHPSQ

SEQ ID NO: 1474076 - protein, 17 aa, Mycobacterium tuberculosis
AGLDGYSAADCVALLRE

SEQ ID NO: 1474077 - protein, 17 aa, Mycobacterium tuberculosis
AGLLFGSGGAGGAGGSG

SEQ ID NO: 1474078 - protein, 28 aa, Mycobacterium tuberculosis
AGLRAAGRVAGLIGTIGIRVGGADLPSA

SEQ ID NO: 1474079 - protein, 17 aa, Mycobacterium tuberculosis
AGLTSRHPLAGGSGASA

SEQ ID NO: 1474080 - protein, 24 aa, Mycobacterium tuberculosis
AGPDRIAAMLSEVVGLLAAGVLAR

SEQ ID NO: 1474081 - protein, 27 aa, Mycobacterium tuberculosis
AGPPEHLQWIGQWGIFDALRAGREVVR

SEQ ID NO: 1474082 - protein, 23 aa, Mycobacterium tuberculosis
AGQLGRPIGFRGLAGGCPVSPLG

SEQ ID NO: 1474083 - protein, 24 aa, Mycobacterium tuberculosis
AGRGARFLLGLVVSTGVGGGLVLD

SEQ ID NO: 1474084 - protein, 17 aa, Mycobacterium tuberculosis
AGSNNWGLANLGVGNIG

SEQ ID NO: 1474085 - protein, 17 aa, Mycobacterium tuberculosis
AGTEPRKIFDLLEHAPV

SEQ ID NO: 1474086 - protein, 17 aa, Mycobacterium tuberculosis
AGVDIARVEAAGVGVAG

SEQ ID NO: 1474087 - protein, 17 aa, Mycobacterium tuberculosis
AGVKITWTPIEPTLPSI

SEQ ID NO: 1474088 - protein, 19 aa, Mycobacterium tuberculosis
AGVTYWREAAQLKRNEAND

SEQ ID NO: 1474089 - protein, 17 aa, Mycobacterium tuberculosis
AIGHAYALWLRDTGRVT

SEQ ID NO: 1474090 - protein, 19 aa, Mycobacterium tuberculosis
AIRADFPILKRIMRGGNPL

SEQ ID NO: 1474091 - protein, 23 aa, Mycobacterium tuberculosis
AISAERAAAMVIRGLVEKPARID

SEQ ID NO: 1474092 - protein, 21 aa, Mycobacterium tuberculosis
AKMFNCTGWKIGWACGPAELI

SEQ ID NO: 1474093 - protein, 19 aa, Mycobacterium tuberculosis
AKMLRLAVDEVFQMQSEAR

SEQ ID NO: 1474094 - protein, 25 aa, Mycobacterium tuberculosis
AKTAASRNKHGWVTVGYLDDDGYLF

SEQ ID NO: 1474095 - protein, 19 aa, Mycobacterium tuberculosis
AKVGVFRPITRLSAERDYI

SEQ ID NO: 1474096 - protein, 21 aa, Mycobacterium tuberculosis
ALAPRRTTLPGGLRVVTEFLP

SEQ ID NO: 1474097 - protein, 18 aa, Mycobacterium tuberculosis
ALASRAGDHVDFLAHDRI

SEQ ID NO: 1474098 - protein, 28 aa, Mycobacterium tuberculosis
ALDPPLRLRACLRRRRLAARRHPGAQRA

SEQ ID NO: 1474099 - protein, 17 aa, Mycobacterium tuberculosis
ALERAGIDPTGLRGSAT

SEQ ID NO: 1474100 - protein, 17 aa, Mycobacterium tuberculosis
ALLRRLVEAGTRVVQYG

SEQ ID NO: 1474101 - protein, 22 aa, Mycobacterium tuberculosis
ALMGAFPMRLILATMLVAGRLL

SEQ ID NO: 1474102 - protein, 18 aa, Mycobacterium tuberculosis
ALPDRQRHASLLPLLHNY

SEQ ID NO: 1474103 - protein, 22 aa, Mycobacterium tuberculosis
ALPSRPVQVIGFTSVPGAGDNF

SEQ ID NO: 1474104 - protein, 19 aa, Mycobacterium tuberculosis
ALQAGRIAVPLSVPQGGVT

SEQ ID NO: 1474105 - protein, 23 aa, Mycobacterium tuberculosis
ALRAAAQHWATWAMQKQELARNL

SEQ ID NO: 1474106 - protein, 20 aa, Mycobacterium tuberculosis
ALRPPVFAGTIWVQQGSQPL

SEQ ID NO: 1474107 - protein, 17 aa, Mycobacterium tuberculosis
ALTAPAPHHTRPTRFVW

SEQ ID NO: 1474108 - protein, 26 aa, Mycobacterium tuberculosis
AMGPEGRAAIGLGDGVVRISVGLEDT

SEQ ID NO: 1474109 - protein, 40 aa, Mycobacterium tuberculosis
AMPNRLVRSLQRWRPFGLPPHRWRLAPWYWRGLQVTLEPG

SEQ ID NO: 1474110 - protein, 17 aa, Mycobacterium tuberculosis
ANAQWGNNVAILAGDYL

SEQ ID NO: 1474111 - protein, 26 aa, Mycobacterium tuberculosis
ANGGAGGNGGWLYGNGGLGGNGGAAT

SEQ ID NO: 1474112 - protein, 17 aa, Mycobacterium tuberculosis
ANLGRAASVGSLSVPQA

SEQ ID NO: 1474113 - protein, 32 aa, Mycobacterium tuberculosis
ANLNFFPMGAWAKRTGAIFIRRQTKDIPVYRF

SEQ ID NO: 1474114 - protein, 25 aa, Mycobacterium tuberculosis
ANRRRFPVEIIRRSRAAVGCDFIIC

SEQ ID NO: 1474115 - protein, 27 aa, Mycobacterium tuberculosis
APDAGPPQRWFVVWLGTANNPVDKGAA

SEQ ID NO: 1474116 - protein, 18 aa, Mycobacterium tuberculosis
APDGIRMLVEAARRIDEA

SEQ ID NO: 1474117 - protein, 18 aa, Mycobacterium tuberculosis
APDRRKVLEEAFRVLRPG

SEQ ID NO: 1474118 - protein, 18 aa, Mycobacterium tuberculosis
APEVSGWLDGLRAAKRAL

SEQ ID NO: 1474119 - protein, 25 aa, Mycobacterium tuberculosis
APGQPGGAGGLLFGNGGNGAAGAVG

SEQ ID NO: 1474120 - protein, 21 aa, Mycobacterium tuberculosis
APGSDALALGQPGGNGGQGDA

SEQ ID NO: 1474121 - protein, 19 aa, Mycobacterium tuberculosis
APGSFSWHVLTALADDVQT

SEQ ID NO: 1474122 - protein, 24 aa, Mycobacterium tuberculosis
APIPGRLFAGPGLSQPSDVLPADD

SEQ ID NO: 1474123 - protein, 22 aa, Mycobacterium tuberculosis
APKAGDTTRSWYVIDATDVVLG

SEQ ID NO: 1474124 - protein, 18 aa, Mycobacterium tuberculosis
APLGYRPARSTAVMSTMS

SEQ ID NO: 1474125 - protein, 24 aa, Mycobacterium tuberculosis
APPGNSLRDIAFRTLDVCVRDGLM

SEQ ID NO: 1474126 - protein, 24 aa, Mycobacterium tuberculosis
APRFHPSYRHAAAVRREIGVPTVF

SEQ ID NO: 1474127 - protein, 18 aa, Mycobacterium tuberculosis
APRTTVGVVEYVRRRKNG

SEQ ID NO: 1474128 - protein, 23 aa, Mycobacterium tuberculosis
APSEILPFTVLLSSLGVTHLTPE

SEQ ID NO: 1474129 - protein, 19 aa, Mycobacterium tuberculosis
APTHFLGALFALRSGTATL

SEQ ID NO: 1474130 - protein, 23 aa, Mycobacterium tuberculosis
APVRFFNPIAMRFAQKATREDID

SEQ ID NO: 1474131 - protein, 29 aa, Mycobacterium tuberculosis
AQCLRGMAARNRLDIVAALQNFRTAFEVG

SEQ ID NO: 1474132 - protein, 27 aa, Mycobacterium tuberculosis
AQCVKAEMLAASSWRVAVNAGADSTGR

SEQ ID NO: 1474133 - protein, 31 aa, Mycobacterium tuberculosis; identical to SEQ ID NO: 210564

SEQ ID NO: 1474134 - protein, 17 aa, Mycobacterium tuberculosis
AQIAHEFTYGRWDCDLA

SEQ ID NO: 1474135 - protein, 17 aa, Mycobacterium tuberculosis
AQLWPPHVPAMLVAGCD

SEQ ID NO: 1474136 - protein, 24 aa, Mycobacterium tuberculosis
AQPLEWFCLFSSAAALVGSPGQGA

SEQ ID NO: 1474137 - protein, 32 aa, Mycobacterium tuberculosis
AQQYDAVWRWIDWPERRGRTGTGIDLVARERD

SEQ ID NO: 1474138 - protein, 21 aa, Mycobacterium tuberculosis
AQQYRLGRLILLAQAGALLDR

SEQ ID NO: 1474139 - protein, 19 aa, Mycobacterium tuberculosis
AQRPELWNLYNGRHHKGEH

SEQ ID NO: 1474140 - protein, 20 aa, Mycobacterium tuberculosis
AQRRLPLLIASGADVHVIAP

SEQ ID NO: 1474141 - protein, 18 aa, Mycobacterium tuberculosis
AQRRTVEGLNRVEAAHDN

SEQ ID NO: 1474142 - protein, 18 aa, Mycobacterium tuberculosis
AQYGEMWAQDIVAMEGYA

SEQ ID NO: 1474143 - protein, 23 aa, Mycobacterium tuberculosis
ARAFQTLLRYGRAYSGYAPIMGT

SEQ ID NO: 1474144 - protein, 19 aa, Mycobacterium tuberculosis
ARATFEAVLAKLAAPGATN

SEQ ID NO: 1474145 - protein, 18 aa, Mycobacterium tuberculosis
ARFRSHPDLEVLTHGLTL

SEQ ID NO: 1474146 - protein, 18 aa, Mycobacterium tuberculosis
ARGRGGGRIPEPRRRRNV

SEQ ID NO: 1474147 - protein, 24 aa, Mycobacterium tuberculosis
ARIAGRPAAVLLHLGPGLGNGLAN

SEQ ID NO: 1474148 - protein, 17 aa, Mycobacterium tuberculosis
ARIFAGAGLGPMLAAAS

SEQ ID NO: 1474149 - protein, 21 aa, Mycobacterium tuberculosis
ARPDTAPALALAARSSASFPL

SEQ ID NO: 1474150 - protein, 21 aa, Mycobacterium tuberculosis
ARPSVTAGGVGGRPAGNSFAS

SEQ ID NO: 1474151 - protein, 19 aa, Mycobacterium tuberculosis
ARPVPAGDTMVFFGGIEPV

SEQ ID NO: 1474152 - protein, 21 aa, Mycobacterium tuberculosis
ARRILGWRVASTMATSMVLDA

SEQ ID NO: 1474153 - protein, 23 aa, Mycobacterium tuberculosis
ARRVGGTDVAVWLGTLSTLSRTA

SEQ ID NO: 1474154 - protein, 23 aa, Mycobacterium tuberculosis
ARRVRARAAAAIEHGIELMLAER

SEQ ID NO: 1474155 - protein, 20 aa, Mycobacterium tuberculosis
ARSIGCSWCVDFGAMLQRLD

SEQ ID NO: 1474156 - protein, 27 aa, Mycobacterium tuberculosis
ARSSTEHSRHCYFFRTRRYRPLHRPSD

SEQ ID NO: 1474157 - protein, 27 aa, Mycobacterium tuberculosis
ARVPGMIRLVRHSIALVAAGLAAALSG

SEQ ID NO: 1474158 - protein, 18 aa, Mycobacterium tuberculosis
ARVSALSRRRRGPETTAV

SEQ ID NO: 1474159 - protein, 18 aa, Mycobacterium tuberculosis
ARYLFVFLDHHGMLSVFG

SEQ ID NO: 1474160 - protein, 27 aa, Mycobacterium tuberculosis
ASGGKGGTGGWLWGSGGAGGAGGSGGG

SEQ ID NO: 1474161 - protein, 23 aa, Mycobacterium tuberculosis
ASGGRHSVRFAYDSAIVSLIKST

SEQ ID NO: 1474162 - protein, 25 aa, Mycobacterium tuberculosis
ASGVRLAIVASSWHGKICDALLDGA

SEQ ID NO: 1474163 - protein, 23 aa, Mycobacterium tuberculosis
ASIDPEWSRPPGSITDDHVFDAP

SEQ ID NO: 1474164 - protein, 20 aa, Mycobacterium tuberculosis
ASPPRPPLPPNPAKPSLETP

SEQ ID NO: 1474165 - protein, 17 aa, Mycobacterium tuberculosis
ASQWRRLGGTFPTNSQL

SEQ ID NO: 1474166 - protein, 27 aa, Mycobacterium tuberculosis
ASRGADSWLIRRCSVVQGCLDDPGATV

SEQ ID NO: 1474167 - protein, 17 aa, Mycobacterium tuberculosis
ASRGMGGDGGTGGAGGN

SEQ ID NO: 1474168 - protein, 18 aa, Mycobacterium tuberculosis
ASVSSMQALLDAVNAPTQ

SEQ ID NO: 1474169 - protein, 20 aa, Mycobacterium tuberculosis
ATAVLRPHLSLVPEAPAPFE

SEQ ID NO: 1474170 - protein, 20 aa, Mycobacterium tuberculosis
ATDVSKGIVVAAALAGDGNV

SEQ ID NO: 1474171 - protein, 20 aa, Mycobacterium tuberculosis
ATENYLRWVSDVDRSAPRPN

SEQ ID NO: 1474172 - protein, 18 aa, Mycobacterium tuberculosis
ATFHAQFVQTLSAGAGAY

SEQ ID NO: 1474173 - protein, 17 aa, Mycobacterium tuberculosis
ATKWAELGLSRLLVDAG

SEQ ID NO: 1474174 - protein, 17 aa, Mycobacterium tuberculosis
ATLRCRRLGAVLHAAAD

SEQ ID NO: 1474175 - protein, 26 aa, Mycobacterium tuberculosis
ATLSLVKFACAWTYIALDPAVVQSVP

SEQ ID NO: 1474176 - protein, 18 aa, Mycobacterium tuberculosis
ATNAAPLATLEHNVLNAL

SEQ ID NO: 1474177 - protein, 17 aa, Mycobacterium tuberculosis
ATQRPVHLITCLAEPDP

SEQ ID NO: 1474178 - protein, 17 aa, Mycobacterium tuberculosis
ATVHPMLVAANRNAFVQ

SEQ ID NO: 1474179 - protein, 23 aa, Mycobacterium tuberculosis
AVAEFPGFAFFEIQLRLPVNGRW

SEQ ID NO: 1474180 - protein, 19 aa, Mycobacterium tuberculosis
AVAGRRCGGLVRAVNDLTE

SEQ ID NO: 1474181 - protein, 18 aa, Mycobacterium tuberculosis
AVCDGRRLVTLDGPEIGA

SEQ ID NO: 1474182 - protein, 18 aa, Mycobacterium tuberculosis
AVCELMRIAWRTVGAIVA

SEQ ID NO: 1474183 - protein, 29 aa, Mycobacterium tuberculosis
AVERLCRRLADQAVRQWGFMQGLKQKLGP

SEQ ID NO: 1474184 - protein, 25 aa, Mycobacterium tuberculosis
AVGGKGGTGGLLFGNGGAGGQGGLG

SEQ ID NO: 1474185 - protein, 24 aa, Mycobacterium tuberculosis
AVGGVGGNGGWLYGNGGAGGLGGT

SEQ ID NO: 1474186 - protein, 17 aa, Mycobacterium tuberculosis
AVGSPITTAIAFAESTT

SEQ ID NO: 1474187 - protein, 17 aa, Mycobacterium tuberculosis
AVMAAVFAENGAIDVFS

SEQ ID NO: 1474188 - protein, 18 aa, Mycobacterium tuberculosis
AVPFRLSIDDGIEAVRQR

SEQ ID NO: 1474189 - protein, 22 aa, Mycobacterium tuberculosis
AVTIPGFAINPFGLDVPLSGGT

SEQ ID NO: 1474190 - protein, 18 aa, Mycobacterium tuberculosis
AVTVPELGTFLAECPPMA

SEQ ID NO: 1474191 - protein, 17 aa, Mycobacterium tuberculosis
AVWTACVDDPAAFTEPV

SEQ ID NO: 1474192 - protein, 25 aa, Mycobacterium tuberculosis
AWHKICVERAILPGMQELVRRIGDD

SEQ ID NO: 1474193 - protein, 17 aa, Mycobacterium tuberculosis
AWHTSWHNPNRAFEDDV

SEQ ID NO: 1474194 - protein, 23 aa, Mycobacterium tuberculosis
AWKAPAVTTVRAFDATPMTTLPG

SEQ ID NO: 1474195 - protein, 25 aa, Mycobacterium tuberculosis
AWTSTWRRWCILANAATSSTTCAPR

SEQ ID NO: 1474196 - protein, 18 aa, Mycobacterium tuberculosis
AYATRAGITCAVLIPQGK

SEQ ID NO: 1474197 - protein, 25 aa, Mycobacterium tuberculosis
AYSEPRLQPPNGYKDTTVPGIWVPD

SEQ ID NO: 1474198 - protein, 32 aa, Mycobacterium tuberculosis
CAARIVGGRCLMPASSAARCAARIVGGPRLYG

SEQ ID NO: 1474199 - protein, 23 aa, Mycobacterium tuberculosis
CAEAFAEFVDWSLVDVLRGAPGA

SEQ ID NO: 1474200 - protein, 17 aa, Mycobacterium tuberculosis
CAERLPGAVLAIGNAPT

SEQ ID NO: 1474201 - protein, 17 aa, Mycobacterium tuberculosis
CCRVRPIDIAEIGRALT

SEQ ID NO: 1474202 - protein, 19 aa, Mycobacterium tuberculosis
CDAPGWFLYLTDIPRAGVE

SEQ ID NO: 1474203 - protein, 17 aa, Mycobacterium tuberculosis
CDLQRPAAVNQLQVVGE

SEQ ID NO: 1474204 - protein, 18 aa, Mycobacterium tuberculosis
CEHFFRKGISNVGQFTLT

SEQ ID NO: 1474205 - protein, 25 aa, Mycobacterium tuberculosis
CEIHYTCACCCLPPNLRRPLRRTAR

SEQ ID NO: 1474206 - protein, 21 aa, Mycobacterium tuberculosis
CKSCEQRDNLSIKFVAHEGEV

SEQ ID NO: 1474207 - protein, 20 aa, Mycobacterium tuberculosis
CLATPALFFAVGQGYRNFTQ

SEQ ID NO: 1474208 - protein, 20 aa, Mycobacterium tuberculosis
CMDNGMPILVFNLLTDGNIA

SEQ ID NO: 1474209 - protein, 17 aa, Mycobacterium tuberculosis
CQAGHRVLFATAAEWVA

SEQ ID NO: 1474210 - protein, 20 aa, Mycobacterium tuberculosis
CQLLRLGGRWLSVVCCRNGS

SEQ ID NO: 1474211 - protein, 18 aa, Mycobacterium tuberculosis
CQYDPLMSPLVWDLAHIG

SEQ ID NO: 1474212 - protein, 17 aa, Mycobacterium tuberculosis
CRARVSLATFGGNAHQG

SEQ ID NO: 1474213 - protein, 26 aa, Mycobacterium tuberculosis
CREGHCGACACTLRAGKVNIGVNDVL

SEQ ID NO: 1474214 - protein, 20 aa, Mycobacterium tuberculosis
CSCPARPERSSLVSAEEQDT

SEQ ID NO: 1474215 - protein, 23 aa, Mycobacterium tuberculosis
CSSGLTAIHLACRSLHDGESDIA

SEQ ID NO: 1474216 - protein, 21 aa, Mycobacterium tuberculosis
CSVSNRPAIYVATYFGDPGAA

SEQ ID NO: 1474217 - protein, 19 aa, Mycobacterium tuberculosis
CTSIGSAARPRAVNHPSIE

SEQ ID NO: 1474218 - protein, 23 aa, Mycobacterium tuberculosis
CVSCPIRRQCLAAALQRAEPWAF

SEQ ID NO: 1474219 - protein, 18 aa, Mycobacterium tuberculosis
DAARGRMGAVRFGIYQAG

SEQ ID NO: 1474220 - protein, 18 aa, Mycobacterium tuberculosis
DAATRAGFEAGFEADPVL

SEQ ID NO: 1474221 - protein, 26 aa, Mycobacterium tuberculosis
DAAVSWAERRRMFELPRSSWSDYDRS

SEQ ID NO: 1474222 - protein, 24 aa, Mycobacterium tuberculosis
DAEGCAYLLVSVALRRLWFHGTKA

SEQ ID NO: 1474223 - protein, 18 aa, Mycobacterium tuberculosis
DAGDCAVLARALVACGCG

SEQ ID NO: 1474224 - protein, 18 aa, Mycobacterium tuberculosis
DAHILVLCGPIWLGDNSS

SEQ ID NO: 1474225 - protein, 18 aa, Mycobacterium tuberculosis
DALRCFASLFGDEALDPL

SEQ ID NO: 1474226 - protein, 18 aa, Mycobacterium tuberculosis
DALVAHLPADRWADPTPA

SEQ ID NO: 1474227 - protein, 22 aa, Mycobacterium tuberculosis
DARTYLADHGWRTASASTTDLL

SEQ ID NO: 1474228 - protein, 22 aa, Mycobacterium tuberculosis
DASLRLLPRGGRFIEMGKTEFG

SEQ ID NO: 1474229 - protein, 18 aa, Mycobacterium tuberculosis
DAVARMAEFGRHVEELVA

SEQ ID NO: 1474230 - protein, 20 aa, Mycobacterium tuberculosis
DCRRIRGVPVFDGYTRMVAR

SEQ ID NO: 1474231 - protein, 22 aa, Mycobacterium tuberculosis
DEIAGIGAGVTWAADNHCLLHH

SEQ ID NO: 1474232 - protein, 22 aa, Mycobacterium tuberculosis
DEIARRAGVGAGTVYRHFPTKE

SEQ ID NO: 1474233 - protein, 17 aa, Mycobacterium tuberculosis
DELARYAQRVMDWLHPD

SEQ ID NO: 1474234 - protein, 21 aa, Mycobacterium tuberculosis
DELCDRVAFVVDGRIVALDSP

SEQ ID NO: 1474235 - protein, 22 aa, Mycobacterium tuberculosis
DELRPRMRVVNEFQRRYPDIKV

SEQ ID NO: 1474236 - protein, 22 aa, Mycobacterium tuberculosis
DEVSAAVAALFGSYAQSYQAFG

SEQ ID NO: 1474237 - protein, 29 aa, Mycobacterium tuberculosis
DEVSAAVSRLFGAYGQQFQALNARAATFH

SEQ ID NO: 1474238 - protein, 25 aa, Mycobacterium tuberculosis
DEYVKGLAELGCFGLKIPSEYGGLN

SEQ ID NO: 1474239 - protein, 23 aa, Mycobacterium tuberculosis
DGENCRRCGAVIRRERFMNRSSF

SEQ ID NO: 1474240 - protein, 24 aa, Mycobacterium tuberculosis
DGGTGGRGGWLAGAGGAGGAGGVG

SEQ ID NO: 1474241 - protein, 19 aa, Mycobacterium tuberculosis
DGGYGGWGGAGGNGGAGGS

SEQ ID NO: 1474242 - protein, 34 aa, Mycobacterium tuberculosis
DGLVRRSRVHWVRARVVQLERGWVLRDETGGRWQ

SEQ ID NO: 1474243 - protein, 17 aa, Mycobacterium tuberculosis
DGVIPPNRSLDCVDDEL

SEQ ID NO: 1474244 - protein, 19 aa, Mycobacterium tuberculosis
DHVLQHWTVDISIDEHEGL

SEQ ID NO: 1474245 - protein, 26 aa, Mycobacterium tuberculosis
DIAPRKTRCCVHVAKPNRIRLADQLA

SEQ ID NO: 1474246 - protein, 25 aa, Mycobacterium tuberculosis
DIPGFADSLLRVWQAKKRTSTRISN

SEQ ID NO: 1474247 - protein, 25 aa, Mycobacterium tuberculosis
DIPSWMARMGFQMMDPLKTAKARVD

SEQ ID NO: 1474248 - protein, 26 aa, Mycobacterium tuberculosis
DIYGDTRLGLFPFRRNLSLYAVDLAL

SEQ ID NO: 1474249 - protein, 20 aa, Mycobacterium tuberculosis
DKRTEMRAPLSASGDAVPAE

SEQ ID NO: 1474250 - protein, 23 aa, Mycobacterium tuberculosis
DLASRACVVINHIMPGEPNVAVK

SEQ ID NO: 1474251 - protein, 18 aa, Mycobacterium tuberculosis
DLASSVGLTATMVAAARA

SEQ ID NO: 1474252 - protein, 17 aa, Mycobacterium tuberculosis
DLAYFRVLIHSTRNRAL

SEQ ID NO: 1474253 - protein, 23 aa, Mycobacterium tuberculosis
DLDKPKLVFFFDEAHLLFTDASK

SEQ ID NO: 1474254 - protein, 26 aa, Mycobacterium tuberculosis
DLTDLLWRMGIRTIGQFAALSRTDVA

SEQ ID NO: 1474255 - protein, 17 aa, Mycobacterium tuberculosis
DLYSCFPSAVQVAAIEL

SEQ ID NO: 1474256 - protein, 29 aa, Mycobacterium tuberculosis
DMNNGVFYRGVGQGSLQFSITTPDLTLPP

SEQ ID NO: 1474257 - protein, 37 aa, Mycobacterium tuberculosis; identical to SEQ ID NO: 197967

SEQ ID NO: 1474258 - protein, 23 aa, Mycobacterium tuberculosis
DPDRPLPEYGLDSLGALELRTRI

SEQ ID NO: 1474259 - protein, 26 aa, Mycobacterium tuberculosis
DPGAKSARPATVWIAQDGSHHLVRAS

SEQ ID NO: 1474260 - protein, 22 aa, Mycobacterium tuberculosis
DPGLGARLFQVGSRGGDGGVGG

SEQ ID NO: 1474261 - protein, 24 aa, Mycobacterium tuberculosis
DPHAWLGDAFHAWVQQFYGAELLF

SEQ ID NO: 1474262 - protein, 22 aa, Mycobacterium tuberculosis
DPLELAAKLHAVYPALGRTPLV

SEQ ID NO: 1474263 - protein, 19 aa, Mycobacterium tuberculosis
DPMQWRVLERAFSRHSALI

SEQ ID NO: 1474264 - protein, 24 aa, Mycobacterium tuberculosis
DPQQRLLLEVAWEALEHAGIPPGT

SEQ ID NO: 1474265 - protein, 17 aa, Mycobacterium tuberculosis
DPSRDALTFARRRGVLV

SEQ ID NO: 1474266 - protein, 26 aa, Mycobacterium tuberculosis
DQFVHTLTAAARWYTATEIANAAAMR

SEQ ID NO: 1474267 - protein, 24 aa, Mycobacterium tuberculosis
DQRLLVKVPAGWSHTAAATTSVVF

SEQ ID NO: 1474268 - protein, 23 aa, Mycobacterium tuberculosis
DRAEPTTRWWVLTVNVGGDSGPS

SEQ ID NO: 1474269 - protein, 24 aa, Mycobacterium tuberculosis
DRDWSPKVFGSWNLHRATLGQPLD

SEQ ID NO: 1474270 - protein, 24 aa, Mycobacterium tuberculosis
DRPSWLSSSAWPWQPYLLSHHQGG

SEQ ID NO: 1474271 - protein, 21 aa, Mycobacterium tuberculosis
DRQLARFALRGDRTMFLFVFR

SEQ ID NO: 1474272 - protein, 27 aa, Mycobacterium tuberculosis
DRRRQRGRCGLDNGVADRRRRRSVGGD

SEQ ID NO: 1474273 - protein, 21 aa, Mycobacterium tuberculosis
DRTCVVPGCGATRGLHAHHIR

SEQ ID NO: 1474274 - protein, 18 aa, Mycobacterium tuberculosis
DSAEAVGGAGGKGGDGGV

SEQ ID NO: 1474275 - protein, 19 aa, Mycobacterium tuberculosis
DSHLLLLWGAANRDPAQFE

SEQ ID NO: 1474276 - protein, 17 aa, Mycobacterium tuberculosis
DSLFFAAEQLRLMYNSA

SEQ ID NO: 1474277 - protein, 18 aa, Mycobacterium tuberculosis
DSPELLWKALLRGDDLIT

SEQ ID NO: 1474278 - protein, 52 aa, Mycobacterium tuberculosis
DSPGAEASWVVGITWWSAVVGGFQMSFVIAVPETIAAAATDLADLGSTIAGA

SEQ ID NO: 1474279 - protein, 17 aa, Mycobacterium tuberculosis
DSPLARALAKLGVAADD

SEQ ID NO: 1474280 - protein, 26 aa, Mycobacterium tuberculosis
DSRAYRLRWPAGTIVFEVDQPQVIDF

SEQ ID NO: 1474281 - protein, 19 aa, Mycobacterium tuberculosis
DTFLAMSICDPHGGMHSLW

SEQ ID NO: 1474282 - protein, 18 aa, Mycobacterium tuberculosis
DVAEGPVYVRKQIVHNTV

SEQ ID NO: 1474283 - protein, 21 aa, Mycobacterium tuberculosis
DVAGPQFLLSLIVSSAVCGTS

SEQ ID NO: 1474284 - protein, 17 aa, Mycobacterium tuberculosis
DVDTPWRKLPAKARKAI

SEQ ID NO: 1474285 - protein, 28 aa, Mycobacterium tuberculosis
DVLLKVRLRQGLPLARLGAAERERAEAV

SEQ ID NO: 1474286 - protein, 18 aa, Mycobacterium tuberculosis
DVMMPGMDGFGVLRRLRA

SEQ ID NO: 1474287 - protein, 17 aa, Mycobacterium tuberculosis
DVRRWWRSDSLWQAHDA

SEQ ID NO: 1474288 - protein, 26 aa, Mycobacterium tuberculosis
DVSKRALAGLPYRAAEIGLLVLATST

SEQ ID NO: 1474289 - protein, 19 aa, Mycobacterium tuberculosis
DWAKYALKAPVMMVRSPDT

SEQ ID NO: 1474290 - protein, 24 aa, Mycobacterium tuberculosis
DYFKRGAIELAWALLTNSLAAGGY

SEQ ID NO: 1474291 - protein, 22 aa, Mycobacterium tuberculosis
EAIKELFSMSATRYYQVLNALV

SEQ ID NO: 1474292 - protein, 20 aa, Mycobacterium tuberculosis
EALAAVATDLAGIGSTIGTA

SEQ ID NO: 1474293 - protein, 19 aa, Mycobacterium tuberculosis
EALEHAGIDPLSLRGSATG

SEQ ID NO: 1474294 - protein, 19 aa, Mycobacterium tuberculosis
EALFTLGDRPEARWRQARE

SEQ ID NO: 1474295 - protein, 19 aa, Mycobacterium tuberculosis
EALTGRPLIGNGDSGTPGT

SEQ ID NO: 1474296 - protein, 21 aa, Mycobacterium tuberculosis
EASWLPASLLTPAMLGAHYRL

SEQ ID NO: 1474297 - protein, 20 aa, Mycobacterium tuberculosis
EAVDNRLGRRVAVKVLKSEF

SEQ ID NO: 1474298 - protein, 20 aa, Mycobacterium tuberculosis
ECLRAGVPATALYVALGTEA

SEQ ID NO: 1474299 - protein, 29 aa, Mycobacterium tuberculosis
ECQEVLKQAAAFHGEFTRALAAAGAAYAQ

SEQ ID NO: 1474300 - protein, 20 aa, Mycobacterium tuberculosis
EFLSAAATDLANLGSTISAA

SEQ ID NO: 1474301 - protein, 20 aa, Mycobacterium tuberculosis
EFPADRGWDVAGLFDPDPDA

SEQ ID NO: 1474302 - protein, 17 aa, Mycobacterium tuberculosis
EFTFGWDELLSKVIEEK

SEQ ID NO: 1474303 - protein, 22 aa, Mycobacterium tuberculosis
EFTYPLKWGWLDVDEVVDVLRA

SEQ ID NO: 1474304 - protein, 17 aa, Mycobacterium tuberculosis
EGFHVNPAFVLFGQTAM

SEQ ID NO: 1474305 - protein, 17 aa, Mycobacterium tuberculosis
EGFTDAYRDLAFPGGIR

SEQ ID NO: 1474306 - protein, 23 aa, Mycobacterium tuberculosis
EGGAIYQRWQALGGMNSALGAPT

SEQ ID NO: 1474307 - protein, 19 aa, Mycobacterium tuberculosis
EGLAAVLRGAADQARAAVV

SEQ ID NO: 1474308 - protein, 17 aa, Mycobacterium tuberculosis
EGLARLAGQVETMRARV

SEQ ID NO: 1474309 - protein, 17 aa, Mycobacterium tuberculosis
EIACGRADSVISELEEL

SEQ ID NO: 1474310 - protein, 23 aa, Mycobacterium tuberculosis
EIAESPIDWDIAWPADDLQVNLT

SEQ ID NO: 1474311 - protein, 23 aa, Mycobacterium tuberculosis
EIDNWRWAGVPIFVRAGKELPAK

SEQ ID NO: 1474312 - protein, 17 aa, Mycobacterium tuberculosis
EIFGDLKQRVAALDAAG

SEQ ID NO: 1474313 - protein, 32 aa, Mycobacterium tuberculosis
EIGDAFLSRSCRWALAAANLWQGNLEAAVGLS

SEQ ID NO: 1474314 - protein, 24 aa, Mycobacterium tuberculosis
EINSGRMFFGAGSGPMLAAAAAWD

SEQ ID NO: 1474315 - protein, 25 aa, Mycobacterium tuberculosis
EKHDLAFGTSRWSSKLVHGGLRYLA

SEQ ID NO: 1474316 - protein, 19 aa, Mycobacterium tuberculosis
EKLVRARLRREVLIDDGTD

SEQ ID NO: 1474317 - protein, 20 aa, Mycobacterium tuberculosis
EKPSLPAHIGMTLRSRGFTD

SEQ ID NO: 1474318 - protein, 27 aa, Mycobacterium tuberculosis
ELGYKGLLAPLTFICVFGYKAQAAFFK

SEQ ID NO: 1474319 - protein, 26 aa, Mycobacterium tuberculosis
ELKCAIADGCGDVPALKSCTAAGTSC

SEQ ID NO: 1474320 - protein, 24 aa, Mycobacterium tuberculosis
ELLAHCYRMTGSLHDAEDLVQETL

SEQ ID NO: 1474321 - protein, 17 aa, Mycobacterium tuberculosis
ELLRSRVFFDWFDAMGV

SEQ ID NO: 1474322 - protein, 20 aa, Mycobacterium tuberculosis
ELMRAGTALTDIARMYGDTD

SEQ ID NO: 1474323 - protein, 21 aa, Mycobacterium tuberculosis
ELNGGSLIGLEWAEIVRGQIA

SEQ ID NO: 1474324 - protein, 17 aa, Mycobacterium tuberculosis
ELPECLNALSADPSPAA

SEQ ID NO: 1474325 - protein, 21 aa, Mycobacterium tuberculosis
ELRIGLATAEDIRQWSYGEVK

SEQ ID NO: 1474326 - protein, 17 aa, Mycobacterium tuberculosis
ELRNRLTAVTAVTLPAT

SEQ ID NO: 1474327 - protein, 17 aa, Mycobacterium tuberculosis
ELTGLALQRIYLDRVAK

SEQ ID NO: 1474328 - protein, 26 aa, Mycobacterium tuberculosis
ELTNRLRLGTAPFALGNARRALVESL

SEQ ID NO: 1474329 - protein, 20 aa, Mycobacterium tuberculosis
EMIAAAAGELASIRSAINAA

SEQ ID NO: 1474330 - protein, 26 aa, Mycobacterium tuberculosis
ENNRGRAGYRLLYSVRQYALEKLSES

SEQ ID NO: 1474331 - protein, 29 aa, Mycobacterium tuberculosis
ENVPISPIWLCPLRLRDHAGWPLYPIRPD

SEQ ID NO: 1474332 - protein, 17 aa, Mycobacterium tuberculosis
EPAPALLWIHAGGYVMG

SEQ ID NO: 1474333 - protein, 23 aa, Mycobacterium tuberculosis
EPGGPGQPGTEFGQTGGTGGTGG

SEQ ID NO: 1474334 - protein, 24 aa, Mycobacterium tuberculosis
EPGKRPRSSMAPTLVFDHSSAGRG

SEQ ID NO: 1474335 - protein, 28 aa, Mycobacterium tuberculosis
EPGVPGRTDCKWGAYLDNVGDFDPEFFG

SEQ ID NO: 1474336 - protein, 22 aa, Mycobacterium tuberculosis
EPHITGPRIKQPHIPATGIETT

SEQ ID NO: 1474337 - protein, 20 aa, Mycobacterium tuberculosis
EPPMRRAVAFAKDIKTSKQV

SEQ ID NO: 1474338 - protein, 21 aa, Mycobacterium tuberculosis
EPRRFGVGAAEFHHRAATRAR

SEQ ID NO: 1474339 - protein, 19 aa, Mycobacterium tuberculosis
EQAPHDWRVDRKLLAWERP

SEQ ID NO: 1474340 - protein, 18 aa, Mycobacterium tuberculosis
ERMCARIAAVMGYTDQST

SEQ ID NO: 1474341 - protein, 19 aa, Mycobacterium tuberculosis
ERMCARIAAVMGYTDQSTV

SEQ ID NO: 1474342 - protein, 20 aa, Mycobacterium tuberculosis
ERYRTKMIWWDRRTLANHAE

SEQ ID NO: 1474343 - protein, 25 aa, Mycobacterium tuberculosis
ESAELCAQYLAPVLDAIKFNYFPFG

SEQ ID NO: 1474344 - protein, 21 aa, Mycobacterium tuberculosis
ESIASMAAFAWLNSHGEGGSV

SEQ ID NO: 1474345 - protein, 20 aa, Mycobacterium tuberculosis
ESLAELMGGPDIAPPSSGLQ

SEQ ID NO: 1474346 - protein, 20 aa, Mycobacterium tuberculosis
ESMKMEIPVLAEAAGTVSKV

SEQ ID NO: 1474347 - protein, 26 aa, Mycobacterium tuberculosis
ESPDGMTPPVRWRSGRRVHFDLDPLL

SEQ ID NO: 1474348 - protein, 22 aa, Mycobacterium tuberculosis
ETAGLWGKRADMIVRGCLPYNA

SEQ ID NO: 1474349 - protein, 23 aa, Mycobacterium tuberculosis
ETAWKVAKQYFKLTGKPGKQKVI

SEQ ID NO: 1474350 - protein, 19 aa, Mycobacterium tuberculosis
ETPVAVVAFASWPQQRTLR

SEQ ID NO: 1474351 - protein, 19 aa, Mycobacterium tuberculosis
ETVAAAASDVARIGSSIGV

SEQ ID NO: 1474352 - protein, 24 aa, Mycobacterium tuberculosis
ETVNRCPVYMPFDDVDIALNLGDA

SEQ ID NO: 1474353 - protein, 24 aa, Mycobacterium tuberculosis
ETWERLWPELGLLALPQSPRGTPV

SEQ ID NO: 1474354 - protein, 19 aa, Mycobacterium tuberculosis
EVMAAAATDLANIGSSISA

SEQ ID NO: 1474355 - protein, 34 aa, Mycobacterium tuberculosis; identical to SEQ ID NO: 96427

SEQ ID NO: 1474356 - protein, 19 aa, Mycobacterium tuberculosis
EVRDIRFEQMLLLDDETPI

SEQ ID NO: 1474357 - protein, 23 aa, Mycobacterium tuberculosis
EYAEMWAQDAAVMYSYEGASAAA

SEQ ID NO: 1474358 - protein, 19 aa, Mycobacterium tuberculosis
EYLQLAARVSAPAPAERPA

SEQ ID NO: 1474359 - protein, 29 aa, Mycobacterium tuberculosis
EYLSGRWAQAYGFPLMPIDGILVGTAAMA

SEQ ID NO: 1474360 - protein, 20 aa, Mycobacterium tuberculosis
FAASHLRDGAVLLDVSRIDH

SEQ ID NO: 1474361 - protein, 19 aa, Mycobacterium tuberculosis
FAAVRAELAKRGWVPSPQT

SEQ ID NO: 1474362 - protein, 22 aa, Mycobacterium tuberculosis
FADVRRELAIRAAVEAATVTDS

SEQ ID NO: 1474363 - protein, 17 aa, Mycobacterium tuberculosis
FAELSVRAISLRAGVAR

SEQ ID NO: 1474364 - protein, 25 aa, Mycobacterium tuberculosis
FAERGFRRARTWLGATAEAIEACEC

SEQ ID NO: 1474365 - protein, 21 aa, Mycobacterium tuberculosis
FAIELGRLGGLGVLNGEGLIG

SEQ ID NO: 1474366 - protein, 18 aa, Mycobacterium tuberculosis
FASTAWTSTWRRWCILAN

SEQ ID NO: 1474367 - protein, 23 aa, Mycobacterium tuberculosis
FATELRNLLARCAERGLDPLELQ

SEQ ID NO: 1474368 - protein, 20 aa, Mycobacterium tuberculosis
FAVGPDRLARFVLVVLTQAE

SEQ ID NO: 1474369 - protein, 24 aa, Mycobacterium tuberculosis
FDAWRFENRCELLAFRHDLDPNDA

SEQ ID NO: 1474370 - protein, 20 aa, Mycobacterium tuberculosis
FDDMARLGAQVTIFRLGSDP

SEQ ID NO: 1474371 - protein, 17 aa, Mycobacterium tuberculosis
FDKDRDGFVFGEAGALM

SEQ ID NO: 1474372 - protein, 17 aa, Mycobacterium tuberculosis
FDLDDTWIGGSSAFMTD

SEQ ID NO: 1474373 - protein, 17 aa, Mycobacterium tuberculosis
FDLPQLVVHPYTLTGPI

SEQ ID NO: 1474374 - protein, 18 aa, Mycobacterium tuberculosis
FDREWPLRVGDIDRAGRL

SEQ ID NO: 1474375 - protein, 17 aa, Mycobacterium tuberculosis
FEGGLWSGGAANAANGA

SEQ ID NO: 1474376 - protein, 23 aa, Mycobacterium tuberculosis
FEHLPRGSFGRILSVLNAAADHH

SEQ ID NO: 1474377 - protein, 21 aa, Mycobacterium tuberculosis
FFKDPVKGFFRALDYTLPWDV

SEQ ID NO: 1474378 - protein, 17 aa, Mycobacterium tuberculosis
FGEACLLGGMRRIATVR

SEQ ID NO: 1474379 - protein, 17 aa, Mycobacterium tuberculosis
FGIPGGAVLPVYDPLFD

SEQ ID NO: 1474380 - protein, 21 aa, Mycobacterium tuberculosis
FGVEPPVALILQGASLHDLTA

SEQ ID NO: 1474381 - protein, 20 aa, Mycobacterium tuberculosis
FHDRFTASRLFGAPPGYVGY

SEQ ID NO: 1474382 - protein, 17 aa, Mycobacterium tuberculosis
FIGAPAMNLIDAAVAHG

SEQ ID NO: 1474383 - protein, 23 aa, Mycobacterium tuberculosis
FISGNFNNGVLWVGDYQGLFGVS

SEQ ID NO: 1474384 - protein, 23 aa, Mycobacterium tuberculosis
FLCGAIQAASRLGGEQAAKLCVQ

SEQ ID NO: 1474385 - protein, 18 aa, Mycobacterium tuberculosis
FLGKPAAVLCSTGYQSNL

SEQ ID NO: 1474386 - protein, 25 aa, Mycobacterium tuberculosis
FLNGEARLPLALPTSATGGIPVTVE

SEQ ID NO: 1474387 - protein, 21 aa, Mycobacterium tuberculosis
FLRRFRPYNLMPAAVKPSYGM

SEQ ID NO: 1474388 - protein, 23 aa, Mycobacterium tuberculosis
FNPGTLNTGFFSAMTQAGPNSGF

SEQ ID NO: 1474389 - protein, 20 aa, Mycobacterium tuberculosis
FNWPALPVAMADTIVPDFPL

SEQ ID NO: 1474390 - protein, 40 aa, Mycobacterium tuberculosis
FPESHALSFASLVFYSAWFKLHHPAAFCAALLRAQPMGFY

SEQ ID NO: 1474391 - protein, 23 aa, Mycobacterium tuberculosis
FPESYNRRALMRFVTSVKSGSDY

SEQ ID NO: 1474392 - protein, 30 aa, Mycobacterium tuberculosis
FPGEISGGMRKRAGLARVLVLDPQIILCDE

SEQ ID NO: 1474393 - protein, 29 aa, Mycobacterium tuberculosis
FQALNARAATFHAEFVSLLNGGAAAYTGA

SEQ ID NO: 1474394 - protein, 25 aa, Mycobacterium tuberculosis
FQHVRAAMLSHGWIDGPPPGQYFHG

SEQ ID NO: 1474395 - protein, 23 aa, Mycobacterium tuberculosis
FQRGPCWSWSRMVGSARSILLAP

SEQ ID NO: 1474396 - protein, 22 aa, Mycobacterium tuberculosis
FQTRLAQFVAIAARYHIKPLFV

SEQ ID NO: 1474397 - protein, 20 aa, Mycobacterium tuberculosis
FRELSIPYLPVRWSTDNPDS

SEQ ID NO: 1474398 - protein, 19 aa, Mycobacterium tuberculosis
FRPATLHQAYLALRAWGLP

SEQ ID NO: 1474399 - protein, 20 aa, Mycobacterium tuberculosis
FRSAAPVWRHDPAPTVLNAH

SEQ ID NO: 1474400 - protein, 17 aa, Mycobacterium tuberculosis
FRVEFLTPTAFKQSGEY

SEQ ID NO: 1474401 - protein, 30 aa, Mycobacterium tuberculosis
FSAASAFQSVVWGLTVGSWIGSSAGLMAAA

SEQ ID NO: 1474402 - protein, 20 aa, Mycobacterium tuberculosis
FSDKQLDMMAAFADQAALAW

SEQ ID NO: 1474403 - protein, 27 aa, Mycobacterium tuberculosis
FSFNVKGGRCEACTGDGTIKIEMNFLP

SEQ ID NO: 1474404 - protein, 18 aa, Mycobacterium tuberculosis
FSKLPASTIDELKTNSSL

SEQ ID NO: 1474405 - protein, 25 aa, Mycobacterium tuberculosis
FSMDGCCKFAAISAHVYCPHQITKT

SEQ ID NO: 1474406 - protein, 23 aa, Mycobacterium tuberculosis
FSRISDVLLPFLVTRQLICGAGK

SEQ ID NO: 1474407 - protein, 20 aa, Mycobacterium tuberculosis
FTATPRTGMWRLNHDGRVSF

SEQ ID NO: 1474408 - protein, 22 aa, Mycobacterium tuberculosis
FTEFRFPRIGTAVFDGIEIELR

SEQ ID NO: 1474409 - protein, 20 aa, Mycobacterium tuberculosis
FTRAALPAIRPVNHLVVDGR

SEQ ID NO: 1474410 - protein, 19 aa, Mycobacterium tuberculosis
FTSHGLRLGVEASLRSLAR

SEQ ID NO: 1474411 - protein, 17 aa, Mycobacterium tuberculosis
FTSPHPAEFTDDVIEAM

SEQ ID NO: 1474412 - protein, 23 aa, Mycobacterium tuberculosis
FTTGVPVQWSAVFAGSGGRRVQL

SEQ ID NO: 1474413 - protein, 17 aa, Mycobacterium tuberculosis
FVAAFDVDAKKVGFDLS

SEQ ID NO: 1474414 - protein, 19 aa, Mycobacterium tuberculosis
FVARGEYKSAANLFTEDGF

SEQ ID NO: 1474415 - protein, 18 aa, Mycobacterium tuberculosis
FVKIFCRRSTGVVIGGVV

SEQ ID NO: 1474416 - protein, 24 aa, Mycobacterium tuberculosis
FVPAFSGLFAPYWRSDARGAIVGL

SEQ ID NO: 1474417 - protein, 17 aa, Mycobacterium tuberculosis
FVQALAGAMGAYAAAEA

SEQ ID NO: 1474418 - protein, 21 aa, Mycobacterium tuberculosis
FVRGEGAGVVVLKRLTDAQRD

SEQ ID NO: 1474419 - protein, 17 aa, Mycobacterium tuberculosis
FVVPYPPGFPVLVPGQL

SEQ ID NO: 1474420 - protein, 17 aa, Mycobacterium tuberculosis
FYFLTGRGALLQLGLLQ

SEQ ID NO: 1474421 - protein, 20 aa, Mycobacterium tuberculosis
GAAGGAGWSPDSDLKGFDGF

SEQ ID NO: 1474422 - protein, 18 aa, Mycobacterium tuberculosis
GAAGSLIGLGGGGGAGGV

SEQ ID NO: 1474423 - protein, 22 aa, Mycobacterium tuberculosis
GAAPRARVPAVRESIYSSIDDL

SEQ ID NO: 1474424 - protein, 22 aa, Mycobacterium tuberculosis
GACPECSGLGIRKEVDPELVVP

SEQ ID NO: 1474425 - protein, 39 aa, Mycobacterium tuberculosis
GADEVSAGIAALFSAHAQEYQALSAQAAAFHDQFVHTLT

SEQ ID NO: 1474426 - protein, 17 aa, Mycobacterium tuberculosis
GAEYWLAPSGFTRAPQN

SEQ ID NO: 1474427 - protein, 23 aa, Mycobacterium tuberculosis
GAGGAAGLFGIGGAGGAGGAGAP

SEQ ID NO: 1474428 - protein, 21 aa, Mycobacterium tuberculosis
GAGGAAGLWGAGGGGGNGGNG

SEQ ID NO: 1474429 - protein, 18 aa, Mycobacterium tuberculosis
GAGGFSFSTAGGAGGAGG

SEQ ID NO: 1474430 - protein, 27 aa, Mycobacterium tuberculosis
GAGGHGGAGGWLYGNGGAGGFGGAGAV

SEQ ID NO: 1474431 - protein, 22 aa, Mycobacterium tuberculosis
GAGGIAQLFGTGGMGGSGGGIG

SEQ ID NO: 1474432 - protein, 17 aa, Mycobacterium tuberculosis
GAGGLFGAGGMGGAGGF

SEQ ID NO: 1474433 - protein, 19 aa, Mycobacterium tuberculosis
GAGGLLIGNGGAGGVGGTA

SEQ ID NO: 1474434 - protein, 25 aa, Mycobacterium tuberculosis
GAGGSAGLLGYVGRAGDGGAGGGGG

SEQ ID NO: 1474435 - protein, 20 aa, Mycobacterium tuberculosis
GAGGVAGLFGDGGNGGNAGV

SEQ ID NO: 1474436 - protein, 19 aa, Mycobacterium tuberculosis
GAGHLGFAGTARREAVADA

SEQ ID NO: 1474437 - protein, 21 aa, Mycobacterium tuberculosis
GAGLTSRHPLAGGSGASAGAG

SEQ ID NO: 1474438 - protein, 21 aa, Mycobacterium tuberculosis
GAGQITGLRSGFGGAGGAGGA

SEQ ID NO: 1474439 - protein, 18 aa, Mycobacterium tuberculosis
GAIFAYWVANPSAYGVVE

SEQ ID NO: 1474440 - protein, 19 aa, Mycobacterium tuberculosis
GALNSGIGNMGFGNSGNNN

SEQ ID NO: 1474441 - protein, 23 aa, Mycobacterium tuberculosis
GAPGGAGGLLFGNGGAGGPGASG

SEQ ID NO: 1474442 - protein, 18 aa, Mycobacterium tuberculosis
GASAVHYGLACRELEAAD

SEQ ID NO: 1474443 - protein, 20 aa, Mycobacterium tuberculosis
GATGTLTFFGSGGDGGPGGA

SEQ ID NO: 1474444 - protein, 21 aa, Mycobacterium tuberculosis
GATKRFGLTVTLAERERQLAI

SEQ ID NO: 1474445 - protein, 17 aa, Mycobacterium tuberculosis
GAVRRYLERCGSPPTDA

SEQ ID NO: 1474446 - protein, 23 aa, Mycobacterium tuberculosis
GAVSAWVELHARFGRLPFETLFE

SEQ ID NO: 1474447 - protein, 23 aa, Mycobacterium tuberculosis
GCDFIICYRLSMADYVAEGQSWD

SEQ ID NO: 1474448 - protein, 21 aa, Mycobacterium tuberculosis
GCGKCGNHLAGSYRTDGQVVY

SEQ ID NO: 1474449 - protein, 20 aa, Mycobacterium tuberculosis
GDAASFVGEIGKILADSVEQ

SEQ ID NO: 1474450 - protein, 17 aa, Mycobacterium tuberculosis
GDAGLFLGAAGTGGQAA

SEQ ID NO: 1474451 - protein, 20 aa, Mycobacterium tuberculosis
GDALGLVGVGGNGGNAGTGF

SEQ ID NO: 1474452 - protein, 25 aa, Mycobacterium tuberculosis
GDGFAACRVVNLTFNQAWRGQSAQV

SEQ ID NO: 1474453 - protein, 31 aa, Mycobacterium tuberculosis
GDGGDGGDGGWGRPGGQGGFGSTSGAHGKAG

SEQ ID NO: 1474454 - protein, 20 aa, Mycobacterium tuberculosis
GDGGGLFSIGVGGDGGNAGN

SEQ ID NO: 1474455 - protein, 29 aa, Mycobacterium tuberculosis
GDGGNGANGNFAFGDGNGGHGGNGGNPGA

SEQ ID NO: 1474456 - protein, 26 aa, Mycobacterium tuberculosis
GDGGQGGAGRGLWGTGGAGGHGGQGG

SEQ ID NO: 1474457 - protein, 18 aa, Mycobacterium tuberculosis
GDGVGRLARCVVEQAGRG

SEQ ID NO: 1474458 - protein, 24 aa, Mycobacterium tuberculosis
GDHRIHNVAAFPGAAYCEMALAAA

SEQ ID NO: 1474459 - protein, 17 aa, Mycobacterium tuberculosis
GDLGDWGGPDALADLDP

SEQ ID NO: 1474460 - protein, 24 aa, Mycobacterium tuberculosis
GDNISVKLFDDWSNLGSISELSTS

SEQ ID NO: 1474461 - protein, 19 aa, Mycobacterium tuberculosis
GDPRAGAPHRGYRGCRLPP

SEQ ID NO: 1474462 - protein, 20 aa, Mycobacterium tuberculosis
GEATGLPSMVVLQPATSAVA

SEQ ID NO: 1474463 - protein, 20 aa, Mycobacterium tuberculosis
GEFRAIGYTSIYEDVEHVAL

SEQ ID NO: 1474464 - protein, 27 aa, Mycobacterium tuberculosis
GEGWAGCFTEDGAFEFDGWVIRGRPAL

SEQ ID NO: 1474465 - protein, 25 aa, Mycobacterium tuberculosis
GELMRSGERPMVWSLDERLRMVARP

SEQ ID NO: 1474466 - protein, 17 aa, Mycobacterium tuberculosis
GEMGRLWYENGKLLDKK

SEQ ID NO: 1474467 - protein, 29 aa, Mycobacterium tuberculosis
GERYLTALMPMVWRACEREDFVVEVQAMR

SEQ ID NO: 1474468 - protein, 21 aa, Mycobacterium tuberculosis
GEVRQGVLALSAWSESDTPEL

SEQ ID NO: 1474469 - protein, 25 aa, Mycobacterium tuberculosis
GFLKSKLRTGGLLLNHCITRHDNRS

SEQ ID NO: 1474470 - protein, 26 aa, Mycobacterium tuberculosis
GFLNGEARLPLALPTSATGGIPVTVE

SEQ ID NO: 1474471 - protein, 21 aa, Mycobacterium tuberculosis
GFPAGSARRALAMVKTFDELD

SEQ ID NO: 1474472 - protein, 19 aa, Mycobacterium tuberculosis
GFPGTAAGFARRIARNTQL

SEQ ID NO: 1474473 - protein, 25 aa, Mycobacterium tuberculosis
GFRSMLWPRVYADLRTAGVRGEDAA

SEQ ID NO: 1474474 - protein, 23 aa, Mycobacterium tuberculosis
GGAAGLLGVGGHGGAGGHGAEGV

SEQ ID NO: 1474475 - protein, 17 aa, Mycobacterium tuberculosis
GGAAVQAKAVAGAFEAA

SEQ ID NO: 1474476 - protein, 22 aa, Mycobacterium tuberculosis
GGAGARGANGIDSIGGTGGAGG

SEQ ID NO: 1474477 - protein, 23 aa, Mycobacterium tuberculosis
GGAGGAGGWLFGNGGAGGVGGAG

SEQ ID NO: 1474478 - protein, 24 aa, Mycobacterium tuberculosis
GGAGGAGGWLWGNGGAGGNGGVGV

SEQ ID NO: 1474479 - protein, 30 aa, Mycobacterium tuberculosis
GGAGGHGGAGGWLYGNGGAGGFGGAGAVGG

SEQ ID NO: 1474480 - protein, 23 aa, Mycobacterium tuberculosis
GGAGGNAGMLFGSGGGGGTGGFG

SEQ ID NO: 1474481 - protein, 24 aa, Mycobacterium tuberculosis
GGAGGNAGWFGHGGAGGVGGVGAA

SEQ ID NO: 1474482 - protein, 24 aa, Mycobacterium tuberculosis
GGAGGNGGSWLAAGDGGAGGHGGD

SEQ ID NO: 1474483 - protein, 24 aa, Mycobacterium tuberculosis
GGAGGSGGWLLGNGGVGGAGGQSL

SEQ ID NO: 1474484 - protein, 22 aa, Mycobacterium tuberculosis
GGAGGTSGWLFGNGGAGGNSGG

SEQ ID NO: 1474485 - protein, 20 aa, Mycobacterium tuberculosis
GGAPRRGRKSKRQKRQEYDS

SEQ ID NO: 1474486 - protein, 17 aa, Mycobacterium tuberculosis
GGCSRHLAECPAGRRIG

SEQ ID NO: 1474487 - protein, 22 aa, Mycobacterium tuberculosis
GGDARFLSLLSIRQLATEPSLS

SEQ ID NO: 1474488 - protein, 21 aa, Mycobacterium tuberculosis
GGGARWLIPRLDLPAKKRDAI

SEQ ID NO: 1474489 - protein, 24 aa, Mycobacterium tuberculosis
GGGASGAGGWLLGTGGAGGAGGNG

SEQ ID NO: 1474490 - protein, 22 aa, Mycobacterium tuberculosis
GGGGAAGFAGGVGGAGGEGLTD

SEQ ID NO: 1474491 - protein, 21 aa, Mycobacterium tuberculosis
GGGGHGFGYSRLDDRRRQRGR

SEQ ID NO: 1474492 - protein, 19 aa, Mycobacterium tuberculosis
GGGTRRCVGAAFANMEMDV

SEQ ID NO: 1474493 - protein, 21 aa, Mycobacterium tuberculosis
GGIDNARRAELIERFGLDPTK

SEQ ID NO: 1474494 - protein, 29 aa, Mycobacterium tuberculosis
GGIGALAGKSGFGGFGGLLLGADGYNAPE

SEQ ID NO: 1474495 - protein, 17 aa, Mycobacterium tuberculosis
GGINTGWFNTGHANTGL

SEQ ID NO: 1474496 - protein, 22 aa, Mycobacterium tuberculosis
GGKGGSGLGVGGAGGTGGAGGN

SEQ ID NO: 1474497 - protein, 22 aa, Mycobacterium tuberculosis
GGKGGTGLMPGINGTGGAGGSR

SEQ ID NO: 1474498 - protein, 25 aa, Mycobacterium tuberculosis
GGLGGLGLVVARWLVDRGAGRVVLG

SEQ ID NO: 1474499 - protein, 17 aa, Mycobacterium tuberculosis
GGLSGVLRVPPRPYVMP

SEQ ID NO: 1474500 - protein, 26 aa, Mycobacterium tuberculosis
GGNAVIPGDGVGKAPHGDAGGSGGDG

SEQ ID NO: 1474501 - protein, 19 aa, Mycobacterium tuberculosis
GGNGAHAPVAGGHGGNGGA

SEQ ID NO: 1474502 - protein, 19 aa, Mycobacterium tuberculosis
GGNGAHFSSGGKAGGNGGA

SEQ ID NO: 1474503 - protein, 23 aa, Mycobacterium tuberculosis
GGNGGAGGLLFGDGGNGGAGGAG

SEQ ID NO: 1474504 - protein, 19 aa, Mycobacterium tuberculosis
GGNGGLPFIGSTNAGNGGS

SEQ ID NO: 1474505 - protein, 27 aa, Mycobacterium tuberculosis
GGPGGLAGNLFGQNGIQGVGGSGGKGG

SEQ ID NO: 1474506 - protein, 20 aa, Mycobacterium tuberculosis
GGPGGVGVPDGIGGANGAQG

SEQ ID NO: 1474507 - protein, 20 aa, Mycobacterium tuberculosis
GGPLKIGPITGLFNTPIGLT

SEQ ID NO: 1474508 - protein, 19 aa, Mycobacterium tuberculosis
GGQGGDFALGGNGGAGGAG

SEQ ID NO: 1474509 - protein, 23 aa, Mycobacterium tuberculosis
GGTGGAGGLLFGAGEDGTTPGGN

SEQ ID NO: 1474510 - protein, 19 aa, Mycobacterium tuberculosis
GGTGGTLFGQPGQPGPPGQ

SEQ ID NO: 1474511 - protein, 20 aa, Mycobacterium tuberculosis
GGTPFRPLFTVLAAQLGSDP

SEQ ID NO: 1474512 - protein, 24 aa, Mycobacterium tuberculosis
GGVATRFPGISFPSLGVTATGATP

SEQ ID NO: 1474513 - protein, 23 aa, Mycobacterium tuberculosis
GHAGGCPHPLVVVAGAATRWVWV

SEQ ID NO: 1474514 - protein, 23 aa, Mycobacterium tuberculosis
GHIPRNLHFTRWNPAIDASATRL

SEQ ID NO: 1474515 - protein, 23 aa, Mycobacterium tuberculosis
GHSWRKRPATGWESLTPTEIDVV

SEQ ID NO: 1474516 - protein, 21 aa, Mycobacterium tuberculosis
GHTEWLPPPHLDHGQPRTNTF

SEQ ID NO: 1474517 - protein, 18 aa, Mycobacterium tuberculosis
GIDPLRDVVMLGATNRPD

SEQ ID NO: 1474518 - protein, 18 aa, Mycobacterium tuberculosis
GIGVPACVGAAGRAVTSV

SEQ ID NO: 1474519 - protein, 18 aa, Mycobacterium tuberculosis
GITCAVLIPQGKIAMGKL

SEQ ID NO: 1474520 - protein, 18 aa, Mycobacterium tuberculosis
GITMRPYLVGSLKGPDLA

SEQ ID NO: 1474521 - protein, 17 aa, Mycobacterium tuberculosis
GKAGWRVVSVNQNGVDV

SEQ ID NO: 1474522 - protein, 20 aa, Mycobacterium tuberculosis
GKGGDGMAGVAGSSPTTAGE

SEQ ID NO: 1474523 - protein, 19 aa, Mycobacterium tuberculosis
GKGGSGLVGGDGGNGGAGG

SEQ ID NO: 1474524 - protein, 19 aa, Mycobacterium tuberculosis
GKLGWLDRVVSPEPVLTTE

SEQ ID NO: 1474525 - protein, 22 aa, Mycobacterium tuberculosis
GKLRPPVFGILRYITDAVDEID

SEQ ID NO: 1474526 - protein, 17 aa, Mycobacterium tuberculosis
GKPHGWIHDERRRRCGG

SEQ ID NO: 1474527 - protein, 24 aa, Mycobacterium tuberculosis
GKTFTALKIAERIAADNGGSARIL

SEQ ID NO: 1474528 - protein, 21 aa, Mycobacterium tuberculosis
GKVKADLGVDVFRRMVGDDFT

SEQ ID NO: 1474529 - protein, 26 aa, Mycobacterium tuberculosis
GLDSRAYRLPWPDGTTVFELDRPQVL

SEQ ID NO: 1474530 - protein, 27 aa, Mycobacterium tuberculosis
GLGGGSFGLPGLNGSGGDGGDGGNGAP

SEQ ID NO: 1474531 - protein, 20 aa, Mycobacterium tuberculosis
GLGGRAGLIGHGGAGGNGGD

SEQ ID NO: 1474532 - protein, 20 aa, Mycobacterium tuberculosis
GLIAGCLVTSGVMRRNAKAR

SEQ ID NO: 1474533 - protein, 19 aa, Mycobacterium tuberculosis
GLLQRQGQSAQRCRSKGYG

SEQ ID NO: 1474534 - protein, 17 aa, Mycobacterium tuberculosis
GLMMPRRRRTRAAELAH

SEQ ID NO: 1474535 - protein, 19 aa, Mycobacterium tuberculosis
GLTRLAERQGLPAPQIRVG

SEQ ID NO: 1474536 - protein, 23 aa, Mycobacterium tuberculosis
GMADGRAAMLLHVSHAVTDGVGG

SEQ ID NO: 1474537 - protein, 22 aa, Mycobacterium tuberculosis
GMLTGPVTILAWSFVRDDQPLA

SEQ ID NO: 1474538 - protein, 17 aa, Mycobacterium tuberculosis
GMREGRLSLDQVGVIAG

SEQ ID NO: 1474539 - protein, 18 aa, Mycobacterium tuberculosis
GMSKSGLFRHFGAKEQLQ

SEQ ID NO: 1474540 - protein, 19 aa, Mycobacterium tuberculosis
GNEAPKFFNSKGEPLSDHS

SEQ ID NO: 1474541 - protein, 17 aa, Mycobacterium tuberculosis
GNGALGAAGGNGGTGGA

SEQ ID NO: 1474542 - protein, 18 aa, Mycobacterium tuberculosis
GNGGLPFIGSTNAGNGGS

SEQ ID NO: 1474543 - protein, 28 aa, Mycobacterium tuberculosis
GNGGSGGRGDMAFKDGDGGAGGDGGDPG

SEQ ID NO: 1474544 - protein, 17 aa, Mycobacterium tuberculosis
GNHGARLSGILNNGSGP

SEQ ID NO: 1474545 - protein, 28 aa, Mycobacterium tuberculosis
GNPNRPDGGILTRFGFSIPQLGFTLSGA

SEQ ID NO: 1474546 - protein, 17 aa, Mycobacterium tuberculosis
GNQTMTWRDYAAQVRRV

SEQ ID NO: 1474547 - protein, 19 aa, Mycobacterium tuberculosis
GPEVGEALVSMLKDHGVGF

SEQ ID NO: 1474548 - protein, 33 aa, Mycobacterium tuberculosis
GPGTGKCQQVWCPLCALAALVTGEQHPLLTVIA

SEQ ID NO: 1474549 - protein, 21 aa, Mycobacterium tuberculosis
GPGTIPGPFGATFNLSTSSLA

SEQ ID NO: 1474550 - protein, 25 aa, Mycobacterium tuberculosis
GPMSHAAVVAREFGFPCVVDAQGAT

SEQ ID NO: 1474551 - protein, 18 aa, Mycobacterium tuberculosis
GPTLMVSDLFDFSLYVDA

SEQ ID NO: 1474552 - protein, 22 aa, Mycobacterium tuberculosis
GPVMRAALGGAVRFFAGQLVKA

SEQ ID NO: 1474553 - protein, 20 aa, Mycobacterium tuberculosis
GQGAGAFAGGGGGRGGDGGN

SEQ ID NO: 1474554 - protein, 24 aa, Mycobacterium tuberculosis
GQGGHGGNAILFGQGGAGGPGGTG

SEQ ID NO: 1474555 - protein, 24 aa, Mycobacterium tuberculosis
GQGSQWLGMGIELLDTAPAFAQQI

SEQ ID NO: 1474556 - protein, 22 aa, Mycobacterium tuberculosis
GQLPGHKVYPWVAEVRHSTPGV

SEQ ID NO: 1474557 - protein, 24 aa, Mycobacterium tuberculosis
GQLSARLVSIIAWRTYLVRDPEAL

SEQ ID NO: 1474558 - protein, 21 aa, Mycobacterium tuberculosis
GQLTRWTRFSAQPVATMDPTR

SEQ ID NO: 1474559 - protein, 17 aa, Mycobacterium tuberculosis
GQPQHEWTIYRLSGPRL

SEQ ID NO: 1474560 - protein, 24 aa, Mycobacterium tuberculosis
GQRDGLVEVLCRPQGDGIDFDGAD

SEQ ID NO: 1474561 - protein, 19 aa, Mycobacterium tuberculosis
GQRRRLQLMLTLLSEPNVL

SEQ ID NO: 1474562 - protein, 45 aa, Mycobacterium tuberculosis
GQSAQRCRSKGYGDLYLNRDCGIGKFIWERVVEELKLEVNVERIE

SEQ ID NO: 1474563 - protein, 19 aa, Mycobacterium tuberculosis
GQTPAGCSLMEWQNDNNGR

SEQ ID NO: 1474564 - protein, 18 aa, Mycobacterium tuberculosis
GQTQFAAPVWMPRAKRTS

SEQ ID NO: 1474565 - protein, 19 aa, Mycobacterium tuberculosis
GRCRACTTTLAGTHADVRR

SEQ ID NO: 1474566 - protein, 21 aa, Mycobacterium tuberculosis
GREAAHLRAFRAYAAHSQEIA

SEQ ID NO: 1474567 - protein, 18 aa, Mycobacterium tuberculosis
GRESIEIPAIRRSVDPRR

SEQ ID NO: 1474568 - protein, 22 aa, Mycobacterium tuberculosis
GREWSALCIGRSKTRNHIARRL

SEQ ID NO: 1474569 - protein, 17 aa, Mycobacterium tuberculosis
GRGIFDLLQRKGLAARV

SEQ ID NO: 1474570 - protein, 19 aa, Mycobacterium tuberculosis
GRIAVPLSVPQGGVTDERS

SEQ ID NO: 1474571 - protein, 18 aa, Mycobacterium tuberculosis
GRLDGVVRAIELSRQTLR

SEQ ID NO: 1474572 - protein, 17 aa, Mycobacterium tuberculosis
GRPFIAAGLAIAAVGHR

SEQ ID NO: 1474573 - protein, 24 aa, Mycobacterium tuberculosis
GRPGRGCPGRRDRDLGGLRRGFRR

SEQ ID NO: 1474574 - protein, 20 aa, Mycobacterium tuberculosis
GRPHLRLENRVLPAGPTVVD

SEQ ID NO: 1474575 - protein, 19 aa, Mycobacterium tuberculosis
GRRLLSWARAAGFDDVTPT

SEQ ID NO: 1474576 - protein, 19 aa, Mycobacterium tuberculosis
GRRLRRRRLDAGDQAGFPL

SEQ ID NO: 1474577 - protein, 18 aa, Mycobacterium tuberculosis
GRRVHFDLDPLLPFPRWH

SEQ ID NO: 1474578 - protein, 18 aa, Mycobacterium tuberculosis
GRTARWIEIAAEWGTRDY

SEQ ID NO: 1474579 - protein, 22 aa, Mycobacterium tuberculosis
GRVPDRLAVVRVETGESLHDVA

SEQ ID NO: 1474580 - protein, 26 aa, Mycobacterium tuberculosis
GSGGAGGGAFVHIATATSTGGSGGFG

SEQ ID NO: 1474581 - protein, 18 aa, Mycobacterium tuberculosis
GSGGFGLDTGGAGGRGGD

SEQ ID NO: 1474582 - protein, 22 aa, Mycobacterium tuberculosis
GSGKTLAAFLWALDSLAGSEPM

SEQ ID NO: 1474583 - protein, 19 aa, Mycobacterium tuberculosis
GSGPAYFFLLVEALVDAGV

SEQ ID NO: 1474584 - protein, 19 aa, Mycobacterium tuberculosis
GSGPMLAAAAAWDGLADEL

SEQ ID NO: 1474585 - protein, 22 aa, Mycobacterium tuberculosis
GSMPPRPGGAVGGARPPRPGAP

SEQ ID NO: 1474586 - protein, 17 aa, Mycobacterium tuberculosis
GSRCARCARGWHDQGRH

SEQ ID NO: 1474587 - protein, 25 aa, Mycobacterium tuberculosis
GSSSEWMADAALRYLDWLSKHSRQI

SEQ ID NO: 1474588 - protein, 17 aa, Mycobacterium tuberculosis
GSTLIRLFGHDNVTVLP

SEQ ID NO: 1474589 - protein, 18 aa, Mycobacterium tuberculosis
GSVTSGLAGQSWQGAAAA

SEQ ID NO: 1474590 - protein, 17 aa, Mycobacterium tuberculosis
GTAFLRVLNRDRNYTAP

SEQ ID NO: 1474591 - protein, 18 aa, Mycobacterium tuberculosis
GTCRETPDGLVITATPLR

SEQ ID NO: 1474592 - protein, 26 aa, Mycobacterium tuberculosis
GTGGNAGVALSVGSTGGLGGNGGSGG

SEQ ID NO: 1474593 - protein, 21 aa, Mycobacterium tuberculosis
GTGGTGGWLAGGGGVGGMGGA

SEQ ID NO: 1474594 - protein, 24 aa, Mycobacterium tuberculosis
GTGQAGGDGGLLFGNGGNGGSGAP

SEQ ID NO: 1474595 - protein, 25 aa, Mycobacterium tuberculosis
GTGQPGGPGGLLWGNGGNGGSGVAG

SEQ ID NO: 1474596 - protein, 26 aa, Mycobacterium tuberculosis
GTIVRYRVGELIPVYRSQRALLQRLL

SEQ ID NO: 1474597 - protein, 19 aa, Mycobacterium tuberculosis
GTLFNFGFANDGTLNLGNA

SEQ ID NO: 1474598 - protein, 24 aa, Mycobacterium tuberculosis
GTPRASGPAGMTGMPMVPPGALGA

SEQ ID NO: 1474599 - protein, 25 aa, Mycobacterium tuberculosis
GTPRASGPAGMTGMPMVPPGALGAG

SEQ ID NO: 1474600 - protein, 18 aa, Mycobacterium tuberculosis
GTPWLTAFAQRSRFAEAF

SEQ ID NO: 1474601 - protein, 23 aa, Mycobacterium tuberculosis
GTTCWRRPVAPVAIASAAEPGAA

SEQ ID NO: 1474602 - protein, 18 aa, Mycobacterium tuberculosis
GTTFPTDICEPVAVVGIG

SEQ ID NO: 1474603 - protein, 27 aa, Mycobacterium tuberculosis
GTVSLRLPVRAPFAFEGVFGHLAATAV

SEQ ID NO: 1474604 - protein, 18 aa, Mycobacterium tuberculosis
GVARVIAYRWLRVGRLPV

SEQ ID NO: 1474605 - protein, 24 aa, Mycobacterium tuberculosis
GVDGFDINETTGRDGGDGGDGGYG

SEQ ID NO: 1474606 - protein, 22 aa, Mycobacterium tuberculosis
GVGGHGGTAILFGDGGAGGAGA

SEQ ID NO: 1474607 - protein, 19 aa, Mycobacterium tuberculosis
GVGGLGFDAGGAGGAGGKA

SEQ ID NO: 1474608 - protein, 27 aa, Mycobacterium tuberculosis
GVGGNGATGPWLFGDGGAGGGGGAGGI

SEQ ID NO: 1474609 - protein, 21 aa, Mycobacterium tuberculosis
GVGGTWHWNTYPGIAVDIPSF

SEQ ID NO: 1474610 - protein, 18 aa, Mycobacterium tuberculosis
GVGPTRAAGPTGPAVTSI

SEQ ID NO: 1474611 - protein, 37 aa, Mycobacterium tuberculosis
GVLERGLLLRLRFELDHHINLRPARLYPGVASPLSGN

SEQ ID NO: 1474612 - protein, 17 aa, Mycobacterium tuberculosis
GVNMLFTMRAAVVEADL

SEQ ID NO: 1474613 - protein, 21 aa, Mycobacterium tuberculosis
GVTLMEFHLMYAAVVGGHAPL

SEQ ID NO: 1474614 - protein, 17 aa, Mycobacterium tuberculosis
GVWARALAEKVILKAWP

SEQ ID NO: 1474615 - protein, 21 aa, Mycobacterium tuberculosis
GWRHLPDWPPATTERAWYLQP

SEQ ID NO: 1474616 - protein, 29 aa, Mycobacterium tuberculosis
GYNAPESTSPWHNLQQDILSFINEPTEAL

SEQ ID NO: 1474617 - protein, 18 aa, Mycobacterium tuberculosis
HADRSWGQRIREYTKPLV

SEQ ID NO: 1474618 - protein, 19 aa, Mycobacterium tuberculosis
HADRSWGQRIREYTKPLVL

SEQ ID NO: 1474619 - protein, 17 aa, Mycobacterium tuberculosis
HAFAGSLLRDYGLLLPL

SEQ ID NO: 1474620 - protein, 17 aa, Mycobacterium tuberculosis
HARARPRGSSAAHPSPH

SEQ ID NO: 1474621 - protein, 18 aa, Mycobacterium tuberculosis
HARARPRGSSAAHPSPHR

SEQ ID NO: 1474622 - protein, 17 aa, Mycobacterium tuberculosis
HAVLDSVNWLVEHEGAH

SEQ ID NO: 1474623 - protein, 26 aa, Mycobacterium tuberculosis
HDPRRFATDLLERFRDLIVLQSVPDA

SEQ ID NO: 1474624 - protein, 21 aa, Mycobacterium tuberculosis
HGGDGFRTAGAGGRGGDGGKG

SEQ ID NO: 1474625 - protein, 17 aa, Mycobacterium tuberculosis
HGLHVTDFLLVPPGALP

SEQ ID NO: 1474626 - protein, 17 aa, Mycobacterium tuberculosis
HGLSTTDVGAWVTHPGD

SEQ ID NO: 1474627 - protein, 21 aa, Mycobacterium tuberculosis
HGLTGPAIRIRCKSLLNALHE

SEQ ID NO: 1474628 - protein, 20 aa, Mycobacterium tuberculosis
HGRGGFPGMHLGSVSRAVVN

SEQ ID NO: 1474629 - protein, 22 aa, Mycobacterium tuberculosis
HGRSPRLWLVTGGGLSVADDEP

SEQ ID NO: 1474630 - protein, 19 aa, Mycobacterium tuberculosis
HGVGGVGGDGGLGGAGGNG

SEQ ID NO: 1474631 - protein, 28 aa, Mycobacterium tuberculosis
HHIVIDGWSLPLFVSELLALYRAGGHVA

SEQ ID NO: 1474632 - protein, 37 aa, Mycobacterium tuberculosis
HILEVQRLIRFMPKVVICLVNGWAAGGGHSLHVVCDL

SEQ ID NO: 1474633 - protein, 24 aa, Mycobacterium tuberculosis
HIVDVKRALAWVKENIAAYGGDPN

SEQ ID NO: 1474634 - protein, 26 aa, Mycobacterium tuberculosis
HKYTGLKLGGVYGFYPRFTGPQRSTV

SEQ ID NO: 1474635 - protein, 18 aa, Mycobacterium tuberculosis
HLAATFYLLAESFDEDPF

SEQ ID NO: 1474636 - protein, 20 aa, Mycobacterium tuberculosis
HLACGCGKPDCPSGAGNDER

SEQ ID NO: 1474637 - protein, 25 aa, Mycobacterium tuberculosis
HLSSKEWPGMLAFYRNLAIALVGDH

SEQ ID NO: 1474638 - protein, 20 aa, Mycobacterium tuberculosis
HLYPDSLRTMGYDVGSAGFE

SEQ ID NO: 1474639 - protein, 26 aa, Mycobacterium tuberculosis
HPLLEPVGACRQCLVEVEGQRKPLAS

SEQ ID NO: 1474640 - protein, 22 aa, Mycobacterium tuberculosis
HRAACIRTELVTGRSAADIYRV

SEQ ID NO: 1474641 - protein, 24 aa, Mycobacterium tuberculosis
HRDLRLLAADMVFDLPVIGEAARK

SEQ ID NO: 1474642 - protein, 18 aa, Mycobacterium tuberculosis
HREPLGFQDGVLGGPVGL

SEQ ID NO: 1474643 - protein, 32 aa, Mycobacterium tuberculosis
HRFFREYPYRDAYLLREARLFRAELTIPLILL

SEQ ID NO: 1474644 - protein, 17 aa, Mycobacterium tuberculosis
HRSAVLTASLTSPRGKR

SEQ ID NO: 1474645 - protein, 22 aa, Mycobacterium tuberculosis
HRSPLGRLPLRIGRSKSNDMVL

SEQ ID NO: 1474646 - protein, 20 aa, Mycobacterium tuberculosis
HRVGCPPIACLDEHQQDSRG

SEQ ID NO: 1474647 - protein, 33 aa, Mycobacterium tuberculosis
HSASLSFSSLSGWARPGLRERFIGLTDTVWRVR

SEQ ID NO: 1474648 - protein, 23 aa, Mycobacterium tuberculosis
HSNGLLWRGDNQGLIDLAIGVDI

SEQ ID NO: 1474649 - protein, 25 aa, Mycobacterium tuberculosis
HTAEFVFRPGPVFTNLLLADEINRT

SEQ ID NO: 1474650 - protein, 22 aa, Mycobacterium tuberculosis
HTFNYLDLVRYLAVGNLNPSPL

SEQ ID NO: 1474651 - protein, 25 aa, Mycobacterium tuberculosis
HTGPAMSAFNAWVLLKGLETLAIRV

SEQ ID NO: 1474652 - protein, 19 aa, Mycobacterium tuberculosis
HVEGFRPATLHQAYLALRA

SEQ ID NO: 1474653 - protein, 22 aa, Mycobacterium tuberculosis
HVFRRAFSWLPAQFASQSDAPV

SEQ ID NO: 1474654 - protein, 19 aa, Mycobacterium tuberculosis
HVYTKLGFTSRLQLAQAAA

SEQ ID NO: 1474655 - protein, 19 aa, Mycobacterium tuberculosis
HYNPWDQRLCLVPNGDLFR

SEQ ID NO: 1474656 - protein, 20 aa, Mycobacterium tuberculosis
HYRPSAKLAEFVRMRDLTCR

SEQ ID NO: 1474657 - protein, 17 aa, Mycobacterium tuberculosis
HYSDVWVVIPAFNEAAV

SEQ ID NO: 1474658 - protein, 19 aa, Mycobacterium tuberculosis
IAAGTPPIYFGFGSTPVQT

SEQ ID NO: 1474659 - protein, 17 aa, Mycobacterium tuberculosis
IAASADGSVYVLASSIP

SEQ ID NO: 1474660 - protein, 19 aa, Mycobacterium tuberculosis
IAASTARPSVTAGGVGGRP

SEQ ID NO: 1474661 - protein, 18 aa, Mycobacterium tuberculosis
IADAARWASTDRIVEPSA

SEQ ID NO: 1474662 - protein, 20 aa, Mycobacterium tuberculosis
IAFETSWLDPFTEFRFPRIG

SEQ ID NO: 1474663 - protein, 30 aa, Mycobacterium tuberculosis; identical to SEQ ID NO: 200948

SEQ ID NO: 1474664 - protein, 17 aa, Mycobacterium tuberculosis
IAGPRGVGVLAVRPELM

SEQ ID NO: 1474665 - protein, 25 aa, Mycobacterium tuberculosis
IALGHPFGGSGARLMTTVLHHMPDK

SEQ ID NO: 1474666 - protein, 17 aa, Mycobacterium tuberculosis
IAMTRWQALVNWSGTDP

SEQ ID NO: 1474667 - protein, 20 aa, Mycobacterium tuberculosis
IANAAAMRVVLGAVNAPTQT

SEQ ID NO: 1474668 - protein, 24 aa, Mycobacterium tuberculosis
IANSDFYAVCGWDAVNEAIGRPED

SEQ ID NO: 1474669 - protein, 24 aa, Mycobacterium tuberculosis
IARFKRLDRYDVRFLTGTDEHGLK

SEQ ID NO: 1474670 - protein, 17 aa, Mycobacterium tuberculosis
IDAPALFLTARDSLQDK

SEQ ID NO: 1474671 - protein, 22 aa, Mycobacterium tuberculosis
IDEFGFPVAPWMFGAAGREHMK

SEQ ID NO: 1474672 - protein, 21 aa, Mycobacterium tuberculosis
IDKVFVVACGTAYHSGLLAKY

SEQ ID NO: 1474673 - protein, 19 aa, Mycobacterium tuberculosis
IDLRQDWPKALQKAGFDPS

SEQ ID NO: 1474674 - protein, 19 aa, Mycobacterium tuberculosis
IDPEWSRPPGSITDDHVFD

SEQ ID NO: 1474675 - protein, 18 aa, Mycobacterium tuberculosis
IDRIPVVLDVNALLGPIN

SEQ ID NO: 1474676 - protein, 18 aa, Mycobacterium tuberculosis
IDRQHKYTGLKLGGVYGF

SEQ ID NO: 1474677 - protein, 31 aa, Mycobacterium tuberculosis
IDTTNLTGVMTFGLPLAMTLNAVGSPITTAI

SEQ ID NO: 1474678 - protein, 21 aa, Mycobacterium tuberculosis
IDYLRSRLTGIAGEGNKEIDD

SEQ ID NO: 1474679 - protein, 25 aa, Mycobacterium tuberculosis
IEACECPSGCPSCVQSPKCGNGNDP

SEQ ID NO: 1474680 - protein, 17 aa, Mycobacterium tuberculosis
IEMIPIPTLQDGPDVDL

SEQ ID NO: 1474681 - protein, 22 aa, Mycobacterium tuberculosis
IFPGGLTIPAMNPLSINLSGGT

SEQ ID NO: 1474682 - protein, 22 aa, Mycobacterium tuberculosis
IGDLFGGLFGRGGSARPSRPRR

SEQ ID NO: 1474683 - protein, 20 aa, Mycobacterium tuberculosis
IGGAGERGADGAGPNANGAN

SEQ ID NO: 1474684 - protein, 17 aa, Mycobacterium tuberculosis
IGGQPQHEWTIYRLSGP

SEQ ID NO: 1474685 - protein, 17 aa, Mycobacterium tuberculosis
IGLTGTGQIEFGSFNSG

SEQ ID NO: 1474686 - protein, 24 aa, Mycobacterium tuberculosis
IGNGGDGGPGMFGGPGGAGGSGGT

SEQ ID NO: 1474687 - protein, 26 aa, Mycobacterium tuberculosis
IHLRGHTPGSIALALGGPVTGGVTQL

SEQ ID NO: 1474688 - protein, 20 aa, Mycobacterium tuberculosis
IINSGFGWHEARVPTIVTSV

SEQ ID NO: 1474689 - protein, 20 aa, Mycobacterium tuberculosis
IKQLGRGYEYLDLDPETGHD

SEQ ID NO: 1474690 - protein, 18 aa, Mycobacterium tuberculosis
ILDRGEKLMGFGHRVYRA

SEQ ID NO: 1474691 - protein, 26 aa, Mycobacterium tuberculosis
ILQRYKDLQDIIAILGIDELSEEDKQ

SEQ ID NO: 1474692 - protein, 19 aa, Mycobacterium tuberculosis
ILSSILFRTAELRPGEGRT

SEQ ID NO: 1474693 - protein, 23 aa, Mycobacterium tuberculosis
ILTEHPDRFRAMIVESGNPAHSL

SEQ ID NO: 1474694 - protein, 28 aa, Mycobacterium tuberculosis
INAPAQTLLGRPLIGNGADGSTPGQAGG

SEQ ID NO: 1474695 - protein, 27 aa, Mycobacterium tuberculosis
INAPFLAALGRPLIGNGADGAPGTGAA

SEQ ID NO: 1474696 - protein, 21 aa, Mycobacterium tuberculosis
IPCRTFAAFLDLRYWIKTFTR

SEQ ID NO: 1474697 - protein, 17 aa, Mycobacterium tuberculosis
IPDVLPLDVAAPLLCAG

SEQ ID NO: 1474698 - protein, 24 aa, Mycobacterium tuberculosis
IPEIDIHTLVAFACRELLLSEDVR

SEQ ID NO: 1474699 - protein, 17 aa, Mycobacterium tuberculosis
IPGFAINPFGLDVPLSG

SEQ ID NO: 1474700 - protein, 20 aa, Mycobacterium tuberculosis
IPGWAWSDVLEHFRAIETDL

SEQ ID NO: 1474701 - protein, 17 aa, Mycobacterium tuberculosis
IPPHVRLPANVTLLEPT

SEQ ID NO: 1474702 - protein, 18 aa, Mycobacterium tuberculosis
IPVATALAAARAAQSADA

SEQ ID NO: 1474703 - protein, 17 aa, Mycobacterium tuberculosis
IPVGFAAVGGIGPIAIP

SEQ ID NO: 1474704 - protein, 19 aa, Mycobacterium tuberculosis
IPVRRSWRLNERHYGALQG

SEQ ID NO: 1474705 - protein, 18 aa, Mycobacterium tuberculosis
IQGLLTEAARTWADRLIG

SEQ ID NO: 1474706 - protein, 19 aa, Mycobacterium tuberculosis
IQGLLTEAARTWADRLIGA

SEQ ID NO: 1474707 - protein, 19 aa, Mycobacterium tuberculosis
IQLRLPVNGRWVLVVTGGT

SEQ ID NO: 1474708 - protein, 20 aa, Mycobacterium tuberculosis
IRALHEVGVELSVFGTQGRK

SEQ ID NO: 1474709 - protein, 20 aa, Mycobacterium tuberculosis
ISAAIAALFGAHGRAYQAAS

SEQ ID NO: 1474710 - protein, 17 aa, Mycobacterium tuberculosis
ISEQGITAAEEFLSDPE

SEQ ID NO: 1474711 - protein, 31 aa, Mycobacterium tuberculosis; identical to SEQ ID NO: 201429

SEQ ID NO: 1474712 - protein, 17 aa, Mycobacterium tuberculosis
ISTDIGAPGILDLRRVR

SEQ ID NO: 1474713 - protein, 25 aa, Mycobacterium tuberculosis
ITAPERWAFEYSRFQEAQKREIVEH

SEQ ID NO: 1474714 - protein, 24 aa, Mycobacterium tuberculosis
ITDLPDGRWSEFLEEPRLAARVAG

SEQ ID NO: 1474715 - protein, 18 aa, Mycobacterium tuberculosis
ITEVLEWLSPLPGGSVVS

SEQ ID NO: 1474716 - protein, 23 aa, Mycobacterium tuberculosis
ITIDRIPLNLGASVTVGPILING

SEQ ID NO: 1474717 - protein, 21 aa, Mycobacterium tuberculosis
ITVDGPLRFELIDIATATSCG

SEQ ID NO: 1474718 - protein, 37 aa, Mycobacterium tuberculosis; identical to SEQ ID NO: 233736

SEQ ID NO: 1474719 - protein, 17 aa, Mycobacterium tuberculosis
IVSVVNWADCLVALQQR

SEQ ID NO: 1474720 - protein, 17 aa, Mycobacterium tuberculosis
IVTELAVIDVCADGLHL

SEQ ID NO: 1474721 - protein, 25 aa, Mycobacterium tuberculosis
IYDTGHLEACLRLWAEDLLAEPLQF

SEQ ID NO: 1474722 - protein, 23 aa, Mycobacterium tuberculosis
IYRFNGQTSVFWPGRGPCYRCLH

SEQ ID NO: 1474723 - protein, 24 aa, Mycobacterium tuberculosis
KAGEGDAFISAGVEAVSRFAKGNS

SEQ ID NO: 1474724 - protein, 24 aa, Mycobacterium tuberculosis
KAGQLWDAAGIEWAATSALSASLL

SEQ ID NO: 1474725 - protein, 18 aa, Mycobacterium tuberculosis
KATRDEIFGDLKQRVAAL

SEQ ID NO: 1474726 - protein, 18 aa, Mycobacterium tuberculosis
KCACRKHHLLKTFWTGWR

SEQ ID NO: 1474727 - protein, 21 aa, Mycobacterium tuberculosis
KCPAAPFEAAFLIAAQLGDRY

SEQ ID NO: 1474728 - protein, 24 aa, Mycobacterium tuberculosis
KDIDFAFGVGQLFANVPYAQLILE

SEQ ID NO: 1474729 - protein, 25 aa, Mycobacterium tuberculosis
KDRMIGIDATHAWASVWTPQQPGRF

SEQ ID NO: 1474730 - protein, 18 aa, Mycobacterium tuberculosis
KFSTAWDYRARARAARAL

SEQ ID NO: 1474731 - protein, 23 aa, Mycobacterium tuberculosis
KGADPGGLFPIPGAGGKGGTGGT

SEQ ID NO: 1474732 - protein, 24 aa, Mycobacterium tuberculosis
KGAQPQAAKLTEWLKLALDEPHLL

SEQ ID NO: 1474733 - protein, 22 aa, Mycobacterium tuberculosis
KGDVMAAARIAGIAAAKRTGDL

SEQ ID NO: 1474734 - protein, 17 aa, Mycobacterium tuberculosis
KGLPGARARRRALSDAA

SEQ ID NO: 1474735 - protein, 21 aa, Mycobacterium tuberculosis
KGLPVRAGWIHLPCLPSVAAL

SEQ ID NO: 1474736 - protein, 18 aa, Mycobacterium tuberculosis
KGQLLSLHLGRLKDRVGL

SEQ ID NO: 1474737 - protein, 20 aa, Mycobacterium tuberculosis
KGQRGGNLWLSEVFGAELII

SEQ ID NO: 1474738 - protein, 17 aa, Mycobacterium tuberculosis
KHHLLKTFWTGWRDVQL

SEQ ID NO: 1474739 - protein, 22 aa, Mycobacterium tuberculosis
KKLGPVRPYGFLLICPVRSLDK

SEQ ID NO: 1474740 - protein, 18 aa, Mycobacterium tuberculosis
KLDTMAANLARLTDLTTE

SEQ ID NO: 1474741 - protein, 18 aa, Mycobacterium tuberculosis
KLLSSILTYHVIAGQASP

SEQ ID NO: 1474742 - protein, 19 aa, Mycobacterium tuberculosis
KLQHKMVYRHSGYPGGLHK

SEQ ID NO: 1474743 - protein, 20 aa, Mycobacterium tuberculosis
KLRPPVFGILRYITDAVDEI

SEQ ID NO: 1474744 - protein, 18 aa, Mycobacterium tuberculosis
KMLARRLSGWQDRYPDVV

SEQ ID NO: 1474745 - protein, 17 aa, Mycobacterium tuberculosis
KPPKNALEDLLQQKSPP

SEQ ID NO: 1474746 - protein, 20 aa, Mycobacterium tuberculosis
KPPRPPWAKPPVNSSANPPF

SEQ ID NO: 1474747 - protein, 20 aa, Mycobacterium tuberculosis
KSATTAWLIERLQRPTLVMA

SEQ ID NO: 1474748 - protein, 17 aa, Mycobacterium tuberculosis
KSYRFRRLELARFLAAL

SEQ ID NO: 1474749 - protein, 17 aa, Mycobacterium tuberculosis
KTFCIPHGGGGPGVGPV

SEQ ID NO: 1474750 - protein, 25 aa, Mycobacterium tuberculosis
KVIAQLRFPGYFLVVHDITRFCRDN

SEQ ID NO: 1474751 - protein, 17 aa, Mycobacterium tuberculosis
KVLTEYNNKAALEPVNP

SEQ ID NO: 1474752 - protein, 20 aa, Mycobacterium tuberculosis
KYFLDMGWEDIMLAVEYDGE

SEQ ID NO: 1474753 - protein, 18 aa, Mycobacterium tuberculosis
KYLSRTNIASTQMALIVQ

SEQ ID NO: 1474754 - protein, 17 aa, Mycobacterium tuberculosis
LAAAIPMMVFSGVMNAG

SEQ ID NO: 1474755 - protein, 22 aa, Mycobacterium tuberculosis
LAARCPIDGFGVGTQLVVAQDA

SEQ ID NO: 1474756 - protein, 18 aa, Mycobacterium tuberculosis
LADTWRDRFEQMLQRAEA

SEQ ID NO: 1474757 - protein, 19 aa, Mycobacterium tuberculosis
LAEELRYSVIREVLPTRRA

SEQ ID NO: 1474758 - protein, 18 aa, Mycobacterium tuberculosis
LAERDCRQFDGVDGLLQR

SEQ ID NO: 1474759 - protein, 25 aa, Mycobacterium tuberculosis
LAERLMEFFGGIPILDGIGSTEVGQ

SEQ ID NO: 1474760 - protein, 22 aa, Mycobacterium tuberculosis
LAFQCVDDLIGIWGDPGVTGKP

SEQ ID NO: 1474761 - protein, 17 aa, Mycobacterium tuberculosis
LAGATLPVAGFEQLGAD

SEQ ID NO: 1474762 - protein, 17 aa, Mycobacterium tuberculosis
LAIARPDLQVVLLDPLL

SEQ ID NO: 1474763 - protein, 17 aa, Mycobacterium tuberculosis
LALALLGFRAFQLGDPA

SEQ ID NO: 1474764 - protein, 18 aa, Mycobacterium tuberculosis
LAPLHGWGLDPYLTPGFT

SEQ ID NO: 1474765 - protein, 18 aa, Mycobacterium tuberculosis
LAQRAVQVLRRLYDRVGD

SEQ ID NO: 1474766 - protein, 25 aa, Mycobacterium tuberculosis
LAQRQGIEILGPVGVAARTAATVGD

SEQ ID NO: 1474767 - protein, 23 aa, Mycobacterium tuberculosis
LAQTRISGVLIDLRPYRPPDAAR

SEQ ID NO: 1474768 - protein, 25 aa, Mycobacterium tuberculosis
LARAFLMYVTQRWPDVLSTAAEDLP

SEQ ID NO: 1474769 - protein, 17 aa, Mycobacterium tuberculosis
LARPVADTVWPTPFLAH

SEQ ID NO: 1474770 - protein, 17 aa, Mycobacterium tuberculosis
LATGLAVDFSSLKRRTR

SEQ ID NO: 1474771 - protein, 17 aa, Mycobacterium tuberculosis
LDGIPLAIELAASRVRA

SEQ ID NO: 1474772 - protein, 26 aa, Mycobacterium tuberculosis
LDKLTKWSMPLIRPNGRMLAIKGERA

SEQ ID NO: 1474773 - protein, 17 aa, Mycobacterium tuberculosis
LDKVVGGAVPRQFIPNV

SEQ ID NO: 1474774 - protein, 17 aa, Mycobacterium tuberculosis
LDKVVGGAVPRQFIPSV

SEQ ID NO: 1474775 - protein, 18 aa, Mycobacterium tuberculosis
LDLWPDFAGSDLVTGPDG

SEQ ID NO: 1474776 - protein, 18 aa, Mycobacterium tuberculosis
LDPFTEFRFPRIGTAVFD

SEQ ID NO: 1474777 - protein, 23 aa, Mycobacterium tuberculosis
LDTPIEIDFGPSPAINLNIGKPD

SEQ ID NO: 1474778 - protein, 21 aa, Mycobacterium tuberculosis
LDVINAPALALLGRPLIGNGA

SEQ ID NO: 1474779 - protein, 28 aa, Mycobacterium tuberculosis
LDVVRRARFAAAFTFQYSKRPGTPAAQL

SEQ ID NO: 1474780 - protein, 18 aa, Mycobacterium tuberculosis
LEAAAGVAGFIKAVLAVQ

SEQ ID NO: 1474781 - protein, 25 aa, Mycobacterium tuberculosis
LEGVLDVINAPALALLGRPLIGNGA

SEQ ID NO: 1474782 - protein, 17 aa, Mycobacterium tuberculosis
LEIPVATALAAARAAQS

SEQ ID NO: 1474783 - protein, 18 aa, Mycobacterium tuberculosis
LEMTKWFDTNYHYLVPEI

SEQ ID NO: 1474784 - protein, 18 aa, Mycobacterium tuberculosis
LEPVSVWAPECSEDLLYL

SEQ ID NO: 1474785 - protein, 19 aa, Mycobacterium tuberculosis
LEPVSVWAPECSEDLLYLS

SEQ ID NO: 1474786 - protein, 20 aa, Mycobacterium tuberculosis
LEPVSVWAPECSEDLLYLSD

SEQ ID NO: 1474787 - protein, 20 aa, Mycobacterium tuberculosis
LERAYRMGLVSAEARTKLYK

SEQ ID NO: 1474788 - protein, 18 aa, Mycobacterium tuberculosis
LFAAQGLPPFEDDHITRF

SEQ ID NO: 1474789 - protein, 20 aa, Mycobacterium tuberculosis
LFGAGGMGGAGGFGDHGTLG

SEQ ID NO: 1474790 - protein, 21 aa, Mycobacterium tuberculosis
LGALRMLAGDVIEMATGEGKT

SEQ ID NO: 1474791 - protein, 17 aa, Mycobacterium tuberculosis
LGIGPNNGFPGTSSIVT

SEQ ID NO: 1474792 - protein, 18 aa, Mycobacterium tuberculosis
LGNARRALVESLCYAGQR

SEQ ID NO: 1474793 - protein, 27 aa, Mycobacterium tuberculosis
LGNFLSRSGAVGVLGIGPNNGFPGTSS

SEQ ID NO: 1474794 - protein, 24 aa, Mycobacterium tuberculosis
LGPSGKRPGAIAERVKKTWELGEG

SEQ ID NO: 1474795 - protein, 17 aa, Mycobacterium tuberculosis
LGPVRPYGFLLICPVRS

SEQ ID NO: 1474796 - protein, 17 aa, Mycobacterium tuberculosis
LGQWPFTSGPGFGHTRN

SEQ ID NO: 1474797 - protein, 26 aa, Mycobacterium tuberculosis
LHAGGAGRVRARFASAGADAISVDVC

SEQ ID NO: 1474798 - protein, 18 aa, Mycobacterium tuberculosis
LIATGGMGQVWEAVDNRL

SEQ ID NO: 1474799 - protein, 17 aa, Mycobacterium tuberculosis
LIDEARTPLIISGPADG

SEQ ID NO: 1474800 - protein, 26 aa, Mycobacterium tuberculosis
LIDLVRRYAPKLALIVTSHQHFDHWQ

SEQ ID NO: 1474801 - protein, 24 aa, Mycobacterium tuberculosis
LIETARLWLSLGHHDRHGVWHLDG

SEQ ID NO: 1474802 - protein, 18 aa, Mycobacterium tuberculosis
LIRARWARELAKGRQVGH

SEQ ID NO: 1474803 - protein, 18 aa, Mycobacterium tuberculosis
LITAPQYAAYDIWESLFT

SEQ ID NO: 1474804 - protein, 17 aa, Mycobacterium tuberculosis
LKATAAAVLAERGLDAS

SEQ ID NO: 1474805 - protein, 25 aa, Mycobacterium tuberculosis
LKDPKRPSGSFIFAGPSGVGKTELS

SEQ ID NO: 1474806 - protein, 18 aa, Mycobacterium tuberculosis
LKELIPRQQFEVPVQAAI

SEQ ID NO: 1474807 - protein, 17 aa, Mycobacterium tuberculosis
LKESVQAHGIYNQNLQA

SEQ ID NO: 1474808 - protein, 20 aa, Mycobacterium tuberculosis
LKHAFDVCYYLCLDTTRGRS

SEQ ID NO: 1474809 - protein, 17 aa, Mycobacterium tuberculosis
LKLAGLLEELGHRVEHV

SEQ ID NO: 1474810 - protein, 24 aa, Mycobacterium tuberculosis
LKTSLEFRERFGIEVEELDEYAEH

SEQ ID NO: 1474811 - protein, 17 aa, Mycobacterium tuberculosis
LLAAELWERGRIVRSLG

SEQ ID NO: 1474812 - protein, 26 aa, Mycobacterium tuberculosis
LLALAHEVRMRWCGPEVEVEGIISLK

SEQ ID NO: 1474813 - protein, 17 aa, Mycobacterium tuberculosis
LLAPGILSDRVRGYARE

SEQ ID NO: 1474814 - protein, 21 aa, Mycobacterium tuberculosis
LLCAGITLYSPLRHWNTGANT

SEQ ID NO: 1474815 - protein, 25 aa, Mycobacterium tuberculosis
LLDQEGRDDLALRIAVQPGGCAGLR

SEQ ID NO: 1474816 - protein, 27 aa, Mycobacterium tuberculosis
LLDRERCILCARCTRFSDQIAGDPFID

SEQ ID NO: 1474817 - protein, 18 aa, Mycobacterium tuberculosis
LLHRADAAVLPSHYEPFG

SEQ ID NO: 1474818 - protein, 19 aa, Mycobacterium tuberculosis
LLLEVSWEALERAGIDPIT

SEQ ID NO: 1474819 - protein, 25 aa, Mycobacterium tuberculosis
LLPSRIVADLGAPVRLARRPFSSYT

SEQ ID NO: 1474820 - protein, 17 aa, Mycobacterium tuberculosis
LLREFDAKLGRGPAVAV

SEQ ID NO: 1474821 - protein, 17 aa, Mycobacterium tuberculosis
LLTGGARSTVQRQQTLR

SEQ ID NO: 1474822 - protein, 19 aa, Mycobacterium tuberculosis
LMAALGMLEARHIAGDQQL

SEQ ID NO: 1474823 - protein, 22 aa, Mycobacterium tuberculosis
LMAARGVGVGQILAITFTNKAA

SEQ ID NO: 1474824 - protein, 17 aa, Mycobacterium tuberculosis
LMIACNLGAEPTCVPVS

SEQ ID NO: 1474825 - protein, 19 aa, Mycobacterium tuberculosis
LNAIAAGGYYGHSATAFSD

SEQ ID NO: 1474826 - protein, 20 aa, Mycobacterium tuberculosis
LNALVGLARPGKFGGDVSHL

SEQ ID NO: 1474827 - protein, 17 aa, Mycobacterium tuberculosis
LNFGSGMSGLFNTSVLG

SEQ ID NO: 1474828 - protein, 17 aa, Mycobacterium tuberculosis
LNRLRALTHDDFRNAWF

SEQ ID NO: 1474829 - protein, 22 aa, Mycobacterium tuberculosis
LPDDMSEEFCRWEERIRLDQDG

SEQ ID NO: 1474830 - protein, 22 aa, Mycobacterium tuberculosis
LPDVLECLAGLASDAGTHHAAA

SEQ ID NO: 1474831 - protein, 29 aa, Mycobacterium tuberculosis
LPFYHDMGLVIGICAPILGGYPAVLTSPV

SEQ ID NO: 1474832 - protein, 22 aa, Mycobacterium tuberculosis
LPGRLRAVGFTDIHVDVAGARL

SEQ ID NO: 1474833 - protein, 17 aa, Mycobacterium tuberculosis
LPLRIGRSKSNDMVLPD

SEQ ID NO: 1474834 - protein, 23 aa, Mycobacterium tuberculosis
LPPQLRAVTNWVGPVGTGARLAN

SEQ ID NO: 1474835 - protein, 19 aa, Mycobacterium tuberculosis
LPTDRPIVYATLGTSGGRN

SEQ ID NO: 1474836 - protein, 17 aa, Mycobacterium tuberculosis
LPVPARRVGRVILVDEP

SEQ ID NO: 1474837 - protein, 25 aa, Mycobacterium tuberculosis
LQAAVSGLVTALFGAPGQPGDTGQP

SEQ ID NO: 1474838 - protein, 28 aa, Mycobacterium tuberculosis
LRAAEDALWRWMTAAALVRPRGAGGVVT

SEQ ID NO: 1474839 - protein, 21 aa, Mycobacterium tuberculosis
LRAELTVACDGRWSIARHEAG

SEQ ID NO: 1474840 - protein, 18 aa, Mycobacterium tuberculosis
LRATNPLRALARCVQAGK

SEQ ID NO: 1474841 - protein, 19 aa, Mycobacterium tuberculosis
LRDEVPVLLVRGQVSDIVR

SEQ ID NO: 1474842 - protein, 18 aa, Mycobacterium tuberculosis
LRGSRVVLRVPRRGDKRA

SEQ ID NO: 1474843 - protein, 18 aa, Mycobacterium tuberculosis
LRHVADLVMTGWPVLMAL

SEQ ID NO: 1474844 - protein, 17 aa, Mycobacterium tuberculosis
LRIGEKMSAPITNLQAA

SEQ ID NO: 1474845 - protein, 17 aa, Mycobacterium tuberculosis
LRILLGLVKADGGSVRL

SEQ ID NO: 1474846 - protein, 17 aa, Mycobacterium tuberculosis
LRLETLAAHWGVPQQRP

SEQ ID NO: 1474847 - protein, 21 aa, Mycobacterium tuberculosis
LRLETLAAHWGVPQQRPHDAF

SEQ ID NO: 1474848 - protein, 17 aa, Mycobacterium tuberculosis
LRPPATVVFARRGKQIA

SEQ ID NO: 1474849 - protein, 17 aa, Mycobacterium tuberculosis
LRRFQHYLGEPLGGFTG

SEQ ID NO: 1474850 - protein, 22 aa, Mycobacterium tuberculosis
LRRPRAGLSYEALLETVEQRLP

SEQ ID NO: 1474851 - protein, 22 aa, Mycobacterium tuberculosis
LRSLERLECLARRLPAAQHTLI

SEQ ID NO: 1474852 - protein, 17 aa, Mycobacterium tuberculosis
LRSPLLRLATWNVNSIR

SEQ ID NO: 1474853 - protein, 21 aa, Mycobacterium tuberculosis
LRSRVFFDWFDAMGVDDIPAV

SEQ ID NO: 1474854 - protein, 17 aa, Mycobacterium tuberculosis
LRTADRGSWALADATVD

SEQ ID NO: 1474855 - protein, 28 aa, Mycobacterium tuberculosis
LRVQPGCDAWCLAALAAVLVQENLCNEA

SEQ ID NO: 1474856 - protein, 17 aa, Mycobacterium tuberculosis
LRVVVCAPACAVDDADR

SEQ ID NO: 1474857 - protein, 18 aa, Mycobacterium tuberculosis
LRYLDWLSKHSRQILRTA

SEQ ID NO: 1474858 - protein, 20 aa, Mycobacterium tuberculosis
LRYLMFSVFLVSPGALGDQR

SEQ ID NO: 1474859 - protein, 19 aa, Mycobacterium tuberculosis
LSAFVVFSSMAGIVGTPAQ

SEQ ID NO: 1474860 - protein, 18 aa, Mycobacterium tuberculosis
LSKLVRHHLLLPITATRR

SEQ ID NO: 1474861 - protein, 27 aa, Mycobacterium tuberculosis
LSLRDLLKFEFLFSGRAQFEKDLANEV

SEQ ID NO: 1474862 - protein, 28 aa, Mycobacterium tuberculosis
LSTFTNGALIFGEFDLPQLVVHPYTLTG

SEQ ID NO: 1474863 - protein, 32 aa, Mycobacterium tuberculosis
LSTFTNGALIFGEFDLPQLVVHPYTLTGPIVI

SEQ ID NO: 1474864 - protein, 20 aa, Mycobacterium tuberculosis
LSTTDVGAWVTHPGDPRSST

SEQ ID NO: 1474865 - protein, 19 aa, Mycobacterium tuberculosis
LSVSLKFQGFEVYTATNGA

SEQ ID NO: 1474866 - protein, 18 aa, Mycobacterium tuberculosis
LTAAARWYTATEIANAAA

SEQ ID NO: 1474867 - protein, 17 aa, Mycobacterium tuberculosis
LTARMVFEHPVLCELAA

SEQ ID NO: 1474868 - protein, 17 aa, Mycobacterium tuberculosis
LTDLQPYASFFYNTEGL

SEQ ID NO: 1474869 - protein, 18 aa, Mycobacterium tuberculosis
LTELAGRLGEMCSLAGIA

SEQ ID NO: 1474870 - protein, 24 aa, Mycobacterium tuberculosis
LTGLSSPRIVGWIMRTDSSDLPWH

SEQ ID NO: 1474871 - protein, 17 aa, Mycobacterium tuberculosis
LTGQANYGFAVPDIPIP

SEQ ID NO: 1474872 - protein, 18 aa, Mycobacterium tuberculosis
LTIVEGFALLSVPSSFVQ

SEQ ID NO: 1474873 - protein, 17 aa, Mycobacterium tuberculosis
LTLRLAGEMLELAGIHG

SEQ ID NO: 1474874 - protein, 19 aa, Mycobacterium tuberculosis
LTQELRFATTMTGGVSLAI

SEQ ID NO: 1474875 - protein, 18 aa, Mycobacterium tuberculosis
LVAAAKMWDSVASDLFSA

SEQ ID NO: 1474876 - protein, 18 aa, Mycobacterium tuberculosis
LVAFPEIRSISYFTQVVE

SEQ ID NO: 1474877 - protein, 18 aa, Mycobacterium tuberculosis
LVASALARQGPLLVVTAT

SEQ ID NO: 1474878 - protein, 25 aa, Mycobacterium tuberculosis
LVGMSVDCARYWLDADKPISKSDAV

SEQ ID NO: 1474879 - protein, 17 aa, Mycobacterium tuberculosis
LVGVRVGPTISQFPVTV

SEQ ID NO: 1474880 - protein, 22 aa, Mycobacterium tuberculosis
LVHHPCVGDLGWIADAPKAPLG

SEQ ID NO: 1474881 - protein, 17 aa, Mycobacterium tuberculosis
LVKSGSRTPGLANIALL

SEQ ID NO: 1474882 - protein, 19 aa, Mycobacterium tuberculosis
LVLDECHHLLATWGALVSA

SEQ ID NO: 1474883 - protein, 23 aa, Mycobacterium tuberculosis
LVLGDWKQFLIGDRVGSMVELVP

SEQ ID NO: 1474884 - protein, 19 aa, Mycobacterium tuberculosis
LVLGDWKQFLIVDRVGSMV

SEQ ID NO: 1474885 - protein, 22 aa, Mycobacterium tuberculosis
LVSKEIIYFLAQLDVKEIHGYN

SEQ ID NO: 1474886 - protein, 18 aa, Mycobacterium tuberculosis
LVVIAGLQDGLWPNTVPR

SEQ ID NO: 1474887 - protein, 24 aa, Mycobacterium tuberculosis
LWAATFLRRRGAAADAVLLNPDRT

SEQ ID NO: 1474888 - protein, 19 aa, Mycobacterium tuberculosis
LYDEVLRVVQHWVNHGVKF

SEQ ID NO: 1474889 - protein, 21 aa, Mycobacterium tuberculosis
LYKEDCRGFGWLPNIQNRAFL

SEQ ID NO: 1474890 - protein, 18 aa, Mycobacterium tuberculosis
MAGAPGFEADDVLGTLAT

SEQ ID NO: 1474891 - protein, 25 aa, Mycobacterium tuberculosis
MAGGGARGLAHFGVYQELTEAGVVI

SEQ ID NO: 1474892 - protein, 22 aa, Mycobacterium tuberculosis
MALLGRPLIGHGADGAPGTGQA

SEQ ID NO: 1474893 - protein, 17 aa, Mycobacterium tuberculosis
MAPALRKTLGVPLFQEQ

SEQ ID NO: 1474894 - protein, 22 aa, Mycobacterium tuberculosis
MAPDLRGRISMASMAAAEMGHY

SEQ ID NO: 1474895 - protein, 21 aa, Mycobacterium tuberculosis
MASAAAPYVAWMSATAVHAEL

SEQ ID NO: 1474896 - protein, 18 aa, Mycobacterium tuberculosis
MASYRGRALGSIGDLGAL

SEQ ID NO: 1474897 - protein, 17 aa, Mycobacterium tuberculosis
MDEGLRFAIREGGRTVG

SEQ ID NO: 1474898 - protein, 19 aa, Mycobacterium tuberculosis
MDQPYPVAMAKLGQAIATE

SEQ ID NO: 1474899 - protein, 25 aa, Mycobacterium tuberculosis
MDSRLWRLLLAPGRGIGRLITGVMA

SEQ ID NO: 1474900 - protein, 25 aa, Mycobacterium tuberculosis
MFPARAFDALAAWVRAAAAKNMVDG

SEQ ID NO: 1474901 - protein, 21 aa, Mycobacterium tuberculosis
MGAREFQTFLVAKQREIVAVV

SEQ ID NO: 1474902 - protein, 20 aa, Mycobacterium tuberculosis
MGGAGGFGDHGTLGTGGAGG

SEQ ID NO: 1474903 - protein, 21 aa, Mycobacterium tuberculosis
MGRIAAQLADLVVVTDDNPRD

SEQ ID NO: 1474904 - protein, 23 aa, Mycobacterium tuberculosis
MHPFCARRELIASIPGIGVGASA

SEQ ID NO: 1474905 - protein, 19 aa, Mycobacterium tuberculosis
MMAAFADQAALAWRLATAQ

SEQ ID NO: 1474906 - protein, 17 aa, Mycobacterium tuberculosis
MMGLCQILRDGVIPPNR

SEQ ID NO: 1474907 - protein, 32 aa, Mycobacterium tuberculosis
MPNLVMGSNVQVVWEKFCRYFDVEPRYLPMER

SEQ ID NO: 1474908 - protein, 19 aa, Mycobacterium tuberculosis
MQMRLPFARSLINDPELLF

SEQ ID NO: 1474909 - protein, 18 aa, Mycobacterium tuberculosis
MRDMAGRFEVHAQTVEDE

SEQ ID NO: 1474910 - protein, 20 aa, Mycobacterium tuberculosis
MRLAAIGAHVQRFAGPGDCV

SEQ ID NO: 1474911 - protein, 27 aa, Mycobacterium tuberculosis
MSSPAWRNGWCRAKRGAIRSSTAENSA

SEQ ID NO: 1474912 - protein, 17 aa, Mycobacterium tuberculosis
MTLDVDRDCFARIAPGL

SEQ ID NO: 1474913 - protein, 28 aa, Mycobacterium tuberculosis
NAKDCIQVLGGIGCTWEHDAHLYLRRAH

SEQ ID NO: 1474914 - protein, 26 aa, Mycobacterium tuberculosis
NAPAQALLGRPLIGNGANGAPGTGQA

SEQ ID NO: 1474915 - protein, 27 aa, Mycobacterium tuberculosis
NAPAQALLGRPLIGNGANGAPGTGQAG

SEQ ID NO: 1474916 - protein, 23 aa, Mycobacterium tuberculosis
NAQAAAFHHSFVQTLNAAGGAYS

SEQ ID NO: 1474917 - protein, 18 aa, Mycobacterium tuberculosis
NATLRYLMFSVFLVSPGA

SEQ ID NO: 1474918 - protein, 23 aa, Mycobacterium tuberculosis
NAVPTAAAYRWRGAARALRRLAN

SEQ ID NO: 1474919 - protein, 26 aa, Mycobacterium tuberculosis
NDWPSPPTHFVITLGVRGARYVGADG

SEQ ID NO: 1474920 - protein, 22 aa, Mycobacterium tuberculosis
NGGAAGSLIGLGGGGGAGGVGG

SEQ ID NO: 1474921 - protein, 19 aa, Mycobacterium tuberculosis
NGGAAVLIGNGGGGGAGGN

SEQ ID NO: 1474922 - protein, 24 aa, Mycobacterium tuberculosis
NGGAGGAGGWLFGNGGAGGNGGIG

SEQ ID NO: 1474923 - protein, 25 aa, Mycobacterium tuberculosis
NGGAGGAGGWLFGNGGAGGNGGIGG

SEQ ID NO: 1474924 - protein, 23 aa, Mycobacterium tuberculosis
NGGKGGTGLMPGINGTGGAGGSR

SEQ ID NO: 1474925 - protein, 23 aa, Mycobacterium tuberculosis
NGGLGGDGFTYLADFDGEPGGDG

SEQ ID NO: 1474926 - protein, 19 aa, Mycobacterium tuberculosis
NGGTGGNGLLFGAGGTGGA

SEQ ID NO: 1474927 - protein, 21 aa, Mycobacterium tuberculosis
NGRQRWCVRLVQGGGFAGPLF

SEQ ID NO: 1474928 - protein, 17 aa, Mycobacterium tuberculosis
NGSSGTAGFDGNPGQPG

SEQ ID NO: 1474929 - protein, 29 aa, Mycobacterium tuberculosis
NIGGLSVPHSWNLPPAVRQVAAMFPGATP

SEQ ID NO: 1474930 - protein, 18 aa, Mycobacterium tuberculosis
NKAFGRWGEVFGGDDVVA

SEQ ID NO: 1474931 - protein, 19 aa, Mycobacterium tuberculosis
NLAQYPSILVELGNMKNPA

SEQ ID NO: 1474932 - protein, 18 aa, Mycobacterium tuberculosis
NLLVNRGPTVPILLDTGS

SEQ ID NO: 1474933 - protein, 31 aa, Mycobacterium tuberculosis
NLRCRYCMPEAEYAWLPRADLLSVDEISLIV

SEQ ID NO: 1474934 - protein, 21 aa, Mycobacterium tuberculosis
NLSPEQWFAFTPPRVPVLESL

SEQ ID NO: 1474935 - protein, 24 aa, Mycobacterium tuberculosis
NMANALRPNAIVSLHADGGPASGR

SEQ ID NO: 1474936 - protein, 27 aa, Mycobacterium tuberculosis
NNREVRWRPEHFWKPGTAVDVAVNTYG

SEQ ID NO: 1474937 - protein, 17 aa, Mycobacterium tuberculosis
NPVDSWGTGLVVDHNHV

SEQ ID NO: 1474938 - protein, 24 aa, Mycobacterium tuberculosis
NPVNWPRVLTVWRANLIGSSGKGG

SEQ ID NO: 1474939 - protein, 27 aa, Mycobacterium tuberculosis
NSEPLPRAHGGPVRVVVPGFIGARSVK

SEQ ID NO: 1474940 - protein, 34 aa, Mycobacterium tuberculosis; identical to SEQ ID NO: 203676

SEQ ID NO: 1474941 - protein, 18 aa, Mycobacterium tuberculosis
NVDGYGLAERDCRQFDGV

SEQ ID NO: 1474942 - protein, 34 aa, Mycobacterium tuberculosis
NVEDWKCWARWRLIRARAPWLTRALVAEDFEFYG

SEQ ID NO: 1474943 - protein, 23 aa, Mycobacterium tuberculosis
NVLTFAGGLWLRTVDEVGECYPD

SEQ ID NO: 1474944 - protein, 17 aa, Mycobacterium tuberculosis
NWLSLTFRIDGGAWFNV

SEQ ID NO: 1474945 - protein, 18 aa, Mycobacterium tuberculosis
NWWEWRDLIGPLAADGNR

SEQ ID NO: 1474946 - protein, 17 aa, Mycobacterium tuberculosis
NYLRPPATVVFARRGKQ

SEQ ID NO: 1474947 - protein, 24 aa, Mycobacterium tuberculosis
PAAHVVKLLNRFFAIVVNEVDRHH

SEQ ID NO: 1474948 - protein, 17 aa, Mycobacterium tuberculosis
PAATRPAAQQTPAVPAA

SEQ ID NO: 1474949 - protein, 20 aa, Mycobacterium tuberculosis
PAEPILRPGARGMFDDCGVS

SEQ ID NO: 1474950 - protein, 30 aa, Mycobacterium tuberculosis
PAERLRALRRACAAGALATLVSGVGDCAPA

SEQ ID NO: 1474951 - protein, 19 aa, Mycobacterium tuberculosis
PAGPIPGFIVKRASEHVLD

SEQ ID NO: 1474952 - protein, 17 aa, Mycobacterium tuberculosis
PAGTVLVVVHSGGGRAK

SEQ ID NO: 1474953 - protein, 19 aa, Mycobacterium tuberculosis
PAITSCFWAPPGTGKTHLA

SEQ ID NO: 1474954 - protein, 18 aa, Mycobacterium tuberculosis
PAPMANSLPGQWTAHVTL

SEQ ID NO: 1474955 - protein, 18 aa, Mycobacterium tuberculosis
PAVRQVAAMFPGATPMYM

SEQ ID NO: 1474956 - protein, 22 aa, Mycobacterium tuberculosis
PAWLEPGQWWALVRVGCAGQLV

SEQ ID NO: 1474957 - protein, 19 aa, Mycobacterium tuberculosis
PDAIQCADPFHVVAWATEA

SEQ ID NO: 1474958 - protein, 22 aa, Mycobacterium tuberculosis
PDDPRYDPVLLRDGDARNVVDA

SEQ ID NO: 1474959 - protein, 18 aa, Mycobacterium tuberculosis
PDKPGVAGCAAMDGTVLV

SEQ ID NO: 1474960 - protein, 19 aa, Mycobacterium tuberculosis
PDPETARIDPFRAAKTLNI

SEQ ID NO: 1474961 - protein, 21 aa, Mycobacterium tuberculosis
PDPRAADIVETWAHVLDQLER

SEQ ID NO: 1474962 - protein, 20 aa, Mycobacterium tuberculosis
PDRRPGHPGIHPREKKVSAV

SEQ ID NO: 1474963 - protein, 17 aa, Mycobacterium tuberculosis
PDSLHWDCFSFGVIQRA

SEQ ID NO: 1474964 - protein, 26 aa, Mycobacterium tuberculosis
PDTCIECPQGSVGEIWVQGGNVASGY

SEQ ID NO: 1474965 - protein, 19 aa, Mycobacterium tuberculosis
PDTKLIVMIGEIGGDAEER

SEQ ID NO: 1474966 - protein, 20 aa, Mycobacterium tuberculosis
PDTWLPMPPEWAALTAEKQR

SEQ ID NO: 1474967 - protein, 17 aa, Mycobacterium tuberculosis
PEAPVFPLPPKPPRPPW

SEQ ID NO: 1474968 - protein, 20 aa, Mycobacterium tuberculosis
PEATFFNFEFPRNGFQLRRP

SEQ ID NO: 1474969 - protein, 24 aa, Mycobacterium tuberculosis
PEHFAEELVRIIGVLRGMQLKKVP

SEQ ID NO: 1474970 - protein, 22 aa, Mycobacterium tuberculosis
PEMMATAAFDLARIGSQVSAAS

SEQ ID NO: 1474971 - protein, 24 aa, Mycobacterium tuberculosis
PEQNAWWWDVLKFGRSSAYAEFFD

SEQ ID NO: 1474972 - protein, 19 aa, Mycobacterium tuberculosis
PETFNVIFVDMKFESAAQD

SEQ ID NO: 1474973 - protein, 21 aa, Mycobacterium tuberculosis
PETIPAMSSPAWRNGWCRAKR

SEQ ID NO: 1474974 - protein, 20 aa, Mycobacterium tuberculosis
PEVAAEFGAGLVCAHTGGAL

SEQ ID NO: 1474975 - protein, 17 aa, Mycobacterium tuberculosis
PEVLLAWQMNSEPLPRA

SEQ ID NO: 1474976 - protein, 26 aa, Mycobacterium tuberculosis
PFTQQLKKLAGLSERLTSAAAAAAGP

SEQ ID NO: 1474977 - protein, 20 aa, Mycobacterium tuberculosis
PGAPRPGGRPGAPGAGRSDA

SEQ ID NO: 1474978 - protein, 20 aa, Mycobacterium tuberculosis
PGGIDEYLQLAARVSAPAPA

SEQ ID NO: 1474979 - protein, 23 aa, Mycobacterium tuberculosis
PGHSFPAIALCQRFRAAADTPTL

SEQ ID NO: 1474980 - protein, 23 aa, Mycobacterium tuberculosis
PGKRPRSSMAPTLVFDHSSAGRG

SEQ ID NO: 1474981 - protein, 28 aa, Mycobacterium tuberculosis
PGLGGAGGAGGWLIGQSGSTGGGGAGGA

SEQ ID NO: 1474982 - protein, 21 aa, Mycobacterium tuberculosis
PGPRAQFLTALAGVMRPGDSL

SEQ ID NO: 1474983 - protein, 30 aa, Mycobacterium tuberculosis
PGRWSCSRPHCAWLAIASWSTVPMRRTSPN

SEQ ID NO: 1474984 - protein, 18 aa, Mycobacterium tuberculosis
PGSWTKYGHWLREPVGPI

SEQ ID NO: 1474985 - protein, 23 aa, Mycobacterium tuberculosis
PGVEFKDLTPLFADRRGLAAVTE

SEQ ID NO: 1474986 - protein, 31 aa, Mycobacterium tuberculosis
PHAGHVYLCEFARRWVDELTIVVGSTAAEPI

SEQ ID NO: 1474987 - protein, 19 aa, Mycobacterium tuberculosis
PHALKGRFSGVAMAAADDD

SEQ ID NO: 1474988 - protein, 21 aa, Mycobacterium tuberculosis
PHGESGKVIGIRVFSREDEDE

SEQ ID NO: 1474989 - protein, 25 aa, Mycobacterium tuberculosis
PHPTSRRELLAALTKRGRDVVRQVT

SEQ ID NO: 1474990 - protein, 19 aa, Mycobacterium tuberculosis
PHRSAARWVPPEPPPSKLS

SEQ ID NO: 1474991 - protein, 29 aa, Mycobacterium tuberculosis
PHSPMAGTGWLPGWRLTFGGEDIGWEGAL

SEQ ID NO: 1474992 - protein, 23 aa, Mycobacterium tuberculosis
PHYRPSAKLAEFVRMRDLTCRFP

SEQ ID NO: 1474993 - protein, 19 aa, Mycobacterium tuberculosis
PIAIVGMACRYPGGVNSPD

SEQ ID NO: 1474994 - protein, 20 aa, Mycobacterium tuberculosis
PIELTLEMAAETGLQVDEIG

SEQ ID NO: 1474995 - protein, 22 aa, Mycobacterium tuberculosis
PIEVNAGPVLKVHPNLRYATDG

SEQ ID NO: 1474996 - protein, 22 aa, Mycobacterium tuberculosis
PIRRYDVDAAILFSDIVVPLRA

SEQ ID NO: 1474997 - protein, 23 aa, Mycobacterium tuberculosis
PIRRYDVDAAILFSDIVVPLRAA

SEQ ID NO: 1474998 - protein, 18 aa, Mycobacterium tuberculosis
PITLGFQVPGSVNAITLF

SEQ ID NO: 1474999 - protein, 21 aa, Mycobacterium tuberculosis
PKKQVRCVYVAIGQKGTTIAA

SEQ ID NO: 1475000 - protein, 17 aa, Mycobacterium tuberculosis
PKPGQKWVNVDPTKNKS

SEQ ID NO: 1475001 - protein, 18 aa, Mycobacterium tuberculosis
PKVAAALKDPPYRLKTTT

SEQ ID NO: 1475002 - protein, 19 aa, Mycobacterium tuberculosis
PLACVSARRFRCRSAARAS

SEQ ID NO: 1475003 - protein, 23 aa, Mycobacterium tuberculosis
PLATLEHNVLNALNAPTQALLGR

SEQ ID NO: 1475004 - protein, 19 aa, Mycobacterium tuberculosis
PLPGEVADKFHATFDALLH

SEQ ID NO: 1475005 - protein, 27 aa, Mycobacterium tuberculosis
PLQPFQATAVIPVIGPVTVTLEGTPAG

SEQ ID NO: 1475006 - protein, 20 aa, Mycobacterium tuberculosis
PLQQFSWRIMPENLEDAGVS

SEQ ID NO: 1475007 - protein, 18 aa, Mycobacterium tuberculosis
PLRRGLVWRRRASELRTE

SEQ ID NO: 1475008 - protein, 22 aa, Mycobacterium tuberculosis
PLSLGRLDRGWVVASETAALDI

SEQ ID NO: 1475009 - protein, 29 aa, Mycobacterium tuberculosis
PLVRSTITAIDWLYWRMTKGVEDAQRREL

SEQ ID NO: 1475010 - protein, 17 aa, Mycobacterium tuberculosis
PMDLSVWPPEGAESVDI

SEQ ID NO: 1475011 - protein, 17 aa, Mycobacterium tuberculosis
PNPIGVGLMEYHQIDRA

SEQ ID NO: 1475012 - protein, 23 aa, Mycobacterium tuberculosis
PNPKATIALLRRVEDVLDVEVPL

SEQ ID NO: 1475013 - protein, 18 aa, Mycobacterium tuberculosis
PNWGRVLAAVGMAPITLD

SEQ ID NO: 1475014 - protein, 19 aa, Mycobacterium tuberculosis
PPAALLRLVNPILRSLLHT

SEQ ID NO: 1475015 - protein, 19 aa, Mycobacterium tuberculosis
PPGAAALAFPSLSSSVPIL

SEQ ID NO: 1475016 - protein, 20 aa, Mycobacterium tuberculosis
PPGAAALAFPSLSSSVPILG

SEQ ID NO: 1475017 - protein, 17 aa, Mycobacterium tuberculosis
PPIACLDEHQQDSRGTF

SEQ ID NO: 1475018 - protein, 19 aa, Mycobacterium tuberculosis
PPNLRRPLRRTARRGPPTR

SEQ ID NO: 1475019 - protein, 18 aa, Mycobacterium tuberculosis
PPTLEALRAHVARTLDVT

SEQ ID NO: 1475020 - protein, 17 aa, Mycobacterium tuberculosis
PPVPVLLVIVDEYLELF

SEQ ID NO: 1475021 - protein, 24 aa, Mycobacterium tuberculosis
PPVRELMGYRWLRRDEWLHRRFGD

SEQ ID NO: 1475022 - protein, 24 aa, Mycobacterium tuberculosis
PQGKRLGKTTGWVHRASLKAKGVH

SEQ ID NO: 1475023 - protein, 17 aa, Mycobacterium tuberculosis
PQIIPFQLVDNASGHML

SEQ ID NO: 1475024 - protein, 17 aa, Mycobacterium tuberculosis
PQQRLLLEVSWEALERA

SEQ ID NO: 1475025 - protein, 24 aa, Mycobacterium tuberculosis
PQVLWRRGEVYTARVHGSRAVGGL

SEQ ID NO: 1475026 - protein, 20 aa, Mycobacterium tuberculosis
PRARGRITLVSSDPQIPVRI

SEQ ID NO: 1475027 - protein, 21 aa, Mycobacterium tuberculosis
PRQRGIPFIFVRTDKAGNISK

SEQ ID NO: 1475028 - protein, 18 aa, Mycobacterium tuberculosis
PRQVLGHRSPAELFTALL

SEQ ID NO: 1475029 - protein, 18 aa, Mycobacterium tuberculosis
PRRNRVGRQHGWPADVPS

SEQ ID NO: 1475030 - protein, 20 aa, Mycobacterium tuberculosis
PRTLAGLTIVVTGSLTGFSR

SEQ ID NO: 1475031 - protein, 23 aa, Mycobacterium tuberculosis
PRTLSTSADNVWAIGDATVLTLP

SEQ ID NO: 1475032 - protein, 17 aa, Mycobacterium tuberculosis
PRVLQIRALVLGGALDW

SEQ ID NO: 1475033 - protein, 23 aa, Mycobacterium tuberculosis
PRVVLAAAPPGYRLSIPDNTCDL

SEQ ID NO: 1475034 - protein, 24 aa, Mycobacterium tuberculosis
PRVVLAAAPPGYRLSIPDNTYDLG

SEQ ID NO: 1475035 - protein, 18 aa, Mycobacterium tuberculosis
PRWAELVAGDGAFVPYRE

SEQ ID NO: 1475036 - protein, 17 aa, Mycobacterium tuberculosis
PRYVTAIDADTATVHVG

SEQ ID NO: 1475037 - protein, 23 aa, Mycobacterium tuberculosis
PSEILPFTVLLSSLGVTHLTPEI

SEQ ID NO: 1475038 - protein, 23 aa, Mycobacterium tuberculosis
PSLVIRIAPPVGRQLDWMVCRTV

SEQ ID NO: 1475039 - protein, 20 aa, Mycobacterium tuberculosis
PSVPLRIDVDGGIPGFTLFP

SEQ ID NO: 1475040 - protein, 26 aa, Mycobacterium tuberculosis
PSVRELAVFWTARSIGCSWCVDFGAM

SEQ ID NO: 1475041 - protein, 26 aa, Mycobacterium tuberculosis
PTANPCGVCESCVSLAPNAPGSIDVV

SEQ ID NO: 1475042 - protein, 19 aa, Mycobacterium tuberculosis
PTDDAFRRRVFELVDIAFA

SEQ ID NO: 1475043 - protein, 17 aa, Mycobacterium tuberculosis
PTLSGFWHWAVANLPAN

SEQ ID NO: 1475044 - protein, 25 aa, Mycobacterium tuberculosis
PTMFADVRRELAIRAAVEAATVTDS

SEQ ID NO: 1475045 - protein, 18 aa, Mycobacterium tuberculosis
PVADRLWYPLWDANIRLD

SEQ ID NO: 1475046 - protein, 18 aa, Mycobacterium tuberculosis
PVGSGIREKCCRTERQRD

SEQ ID NO: 1475047 - protein, 18 aa, Mycobacterium tuberculosis
PVHDPARYDQIWKDHVLA

SEQ ID NO: 1475048 - protein, 20 aa, Mycobacterium tuberculosis
PVLRRRRGAWVGWPGVNDDG

SEQ ID NO: 1475049 - protein, 17 aa, Mycobacterium tuberculosis
PVNGRWVLVVTGGTGAI

SEQ ID NO: 1475050 - protein, 17 aa, Mycobacterium tuberculosis
PVSHLMATFAGRNLTER

SEQ ID NO: 1475051 - protein, 18 aa, Mycobacterium tuberculosis
PVTGEVYVTNFAGDTVSV

SEQ ID NO: 1475052 - protein, 25 aa, Mycobacterium tuberculosis
PVVDGRGRLTGLITVKDFVKTEQHP

SEQ ID NO: 1475053 - protein, 19 aa, Mycobacterium tuberculosis
PWHPDLWLDSEDALDLQGR

SEQ ID NO: 1475054 - protein, 17 aa, Mycobacterium tuberculosis
PYLGWLSAAAAQAQQAA

SEQ ID NO: 1475055 - protein, 18 aa, Mycobacterium tuberculosis
PYMPTDLPAWYDVAMTHY

SEQ ID NO: 1475056 - protein, 21 aa, Mycobacterium tuberculosis
QAALKDGYRVFGELAPHPLLT

SEQ ID NO: 1475057 - protein, 22 aa, Mycobacterium tuberculosis
QAARCVANWDGARVDKGLRRWR

SEQ ID NO: 1475058 - protein, 18 aa, Mycobacterium tuberculosis
QAEPWRPQAVLNHAGELA

SEQ ID NO: 1475059 - protein, 24 aa, Mycobacterium tuberculosis
QAGCGMACPFCATGQGGLTRNLST

SEQ ID NO: 1475060 - protein, 20 aa, Mycobacterium tuberculosis
QALDRWISWAQRCRIPVFVE

SEQ ID NO: 1475061 - protein, 19 aa, Mycobacterium tuberculosis
QALELTWRSLGEIGNLSSA

SEQ ID NO: 1475062 - protein, 20 aa, Mycobacterium tuberculosis
QALFGRPLIGNGADGSPGTG

SEQ ID NO: 1475063 - protein, 24 aa, Mycobacterium tuberculosis
QANGFDVGRRLGIGSRETYILALK

SEQ ID NO: 1475064 - protein, 21 aa, Mycobacterium tuberculosis
QEAWLRWDSPDTVIADPRAWL

SEQ ID NO: 1475065 - protein, 22 aa, Mycobacterium tuberculosis
QEGRGANVFFMLGGQRLDLSSL

SEQ ID NO: 1475066 - protein, 17 aa, Mycobacterium tuberculosis
QGHPVIWESAARDFEPL

SEQ ID NO: 1475067 - protein, 23 aa, Mycobacterium tuberculosis
QIREFLERLATFTAELNNQRGDL

SEQ ID NO: 1475068 - protein, 17 aa, Mycobacterium tuberculosis
QLADALGATVLLKGNVT

SEQ ID NO: 1475069 - protein, 32 aa, Mycobacterium tuberculosis; identical to SEQ ID NO: 1376967

SEQ ID NO: 1475070 - protein, 18 aa, Mycobacterium tuberculosis
QLARASVMALSYVAQSAR

SEQ ID NO: 1475071 - protein, 28 aa, Mycobacterium tuberculosis
QLFTGDCLFPGGVGKTWQPADFTQLLDD

SEQ ID NO: 1475072 - protein, 17 aa, Mycobacterium tuberculosis
QNGWPFVARLLYGRRSL

SEQ ID NO: 1475073 - protein, 23 aa, Mycobacterium tuberculosis
QPFQATAVIPVIGPVTVTLEGTP

SEQ ID NO: 1475074 - protein, 20 aa, Mycobacterium tuberculosis
QPFVPYQNFDALRTLALPFG

SEQ ID NO: 1475075 - protein, 19 aa, Mycobacterium tuberculosis
QQFSRVRVFAFIDSTDEVT

SEQ ID NO: 1475076 - protein, 28 aa, Mycobacterium tuberculosis
QQYDAVWWWIDWPERRGRTDTGIDLVAR

SEQ ID NO: 1475077 - protein, 18 aa, Mycobacterium tuberculosis
QREAFAWHIDLAKRTGKP

SEQ ID NO: 1475078 - protein, 17 aa, Mycobacterium tuberculosis
QRGLRPIQIWVPDVNAP

SEQ ID NO: 1475079 - protein, 21 aa, Mycobacterium tuberculosis
QRLMLEVSWEALEHAGIDPLS

SEQ ID NO: 1475080 - protein, 31 aa, Mycobacterium tuberculosis
QRLPRGRCTPIAAWLAGLGLFTKRSHEKCVP

SEQ ID NO: 1475081 - protein, 22 aa, Mycobacterium tuberculosis
QRLSAQAAGFHAQFVQALNAGV

SEQ ID NO: 1475082 - protein, 20 aa, Mycobacterium tuberculosis
QRPARWMHLMASDFHAFSAA

SEQ ID NO: 1475083 - protein, 18 aa, Mycobacterium tuberculosis
QRPVSLGFLSDSEPINCD

SEQ ID NO: 1475084 - protein, 31 aa, Mycobacterium tuberculosis; identical to SEQ ID NO: 1383061

SEQ ID NO: 1475085 - protein, 24 aa, Mycobacterium tuberculosis
QSLLVRSLVAWFWDQPLRAPLIRH

SEQ ID NO: 1475086 - protein, 17 aa, Mycobacterium tuberculosis
QSRPEDRRAFIEEAAGV

SEQ ID NO: 1475087 - protein, 22 aa, Mycobacterium tuberculosis
QTLLGRPLIGNGADGGPGQNGG

SEQ ID NO: 1475088 - protein, 23 aa, Mycobacterium tuberculosis
QTLLGRPLIGNGADGVAGTGSNA

SEQ ID NO: 1475089 - protein, 24 aa, Mycobacterium tuberculosis
QTVAALLRLQARRTSNAEGREALI

SEQ ID NO: 1475090 - protein, 20 aa, Mycobacterium tuberculosis
QVAAMFPGATPMYMTGSSDG

SEQ ID NO: 1475091 - protein, 30 aa, Mycobacterium tuberculosis
QVNRPLRGCYRIAVLSLKGGIGKTTITATL

SEQ ID NO: 1475092 - protein, 19 aa, Mycobacterium tuberculosis
QVPRRAAVSSYGFSGTNVH

SEQ ID NO: 1475093 - protein, 23 aa, Mycobacterium tuberculosis
QYLGEKICAAVVFAGAPITLAEL

SEQ ID NO: 1475094 - protein, 23 aa, Mycobacterium tuberculosis
QYNYPPLGANLFVGAQARPNEVT

SEQ ID NO: 1475095 - protein, 19 aa, Mycobacterium tuberculosis
QYREIICGATNFAVGDLVV

SEQ ID NO: 1475096 - protein, 18 aa, Mycobacterium tuberculosis
RAATAAGVEEARRRQLGR

SEQ ID NO: 1475097 - protein, 27 aa, Mycobacterium tuberculosis
RAAVGSDFIICYRLSMADYVAEGQSWD

SEQ ID NO: 1475098 - protein, 18 aa, Mycobacterium tuberculosis
RADLVICGGGHGMVAKTL

SEQ ID NO: 1475099 - protein, 22 aa, Mycobacterium tuberculosis
RAELTIPLILLGGITNRTTMDL

SEQ ID NO: 1475100 - protein, 26 aa, Mycobacterium tuberculosis
RAFIEISAHPALLFAIGQNCEGAANL

SEQ ID NO: 1475101 - protein, 20 aa, Mycobacterium tuberculosis
RAFRDKIKWRTGSEGRINHL

SEQ ID NO: 1475102 - protein, 20 aa, Mycobacterium tuberculosis
RAGGQVWLMPHNPAFDPIPG

SEQ ID NO: 1475103 - protein, 20 aa, Mycobacterium tuberculosis
RAHLLLRFDRGNWIAIDNDS

SEQ ID NO: 1475104 - protein, 23 aa, Mycobacterium tuberculosis
RAIYKDGWWACARLDKAPWDLSP

SEQ ID NO: 1475105 - protein, 19 aa, Mycobacterium tuberculosis
RAKANGINLWRVDADHVSV

SEQ ID NO: 1475106 - protein, 19 aa, Mycobacterium tuberculosis
RARDSAPSLVFLDELDALA

SEQ ID NO: 1475107 - protein, 20 aa, Mycobacterium tuberculosis
RARRDLNWRPRFDLNAVAAR

SEQ ID NO: 1475108 - protein, 21 aa, Mycobacterium tuberculosis
RASVMALSYVAQSARGIYQPA

SEQ ID NO: 1475109 - protein, 17 aa, Mycobacterium tuberculosis
RATDTVAGISGRVQLTH

SEQ ID NO: 1475110 - protein, 18 aa, Mycobacterium tuberculosis
RAVMIGRAYLWGLAANGQ

SEQ ID NO: 1475111 - protein, 25 aa, Mycobacterium tuberculosis
RCGPYCPRARITLLQRTTIAKSNRK

SEQ ID NO: 1475112 - protein, 17 aa, Mycobacterium tuberculosis
RCLQLHGGYGYMREYPV

SEQ ID NO: 1475113 - protein, 17 aa, Mycobacterium tuberculosis
RCQRGYFIESLGGAQFA

SEQ ID NO: 1475114 - protein, 18 aa, Mycobacterium tuberculosis
RDADVIDLLGAVVAVAAH

SEQ ID NO: 1475115 - protein, 18 aa, Mycobacterium tuberculosis
RDDPRGGEADFILAKHRN

SEQ ID NO: 1475116 - protein, 23 aa, Mycobacterium tuberculosis
RDGFVFGEAGALMLIETEEHAKA

SEQ ID NO: 1475117 - protein, 18 aa, Mycobacterium tuberculosis
RDGLLRLLVDVQYTRNDM

SEQ ID NO: 1475118 - protein, 20 aa, Mycobacterium tuberculosis
RDGRGCVIVEDMAIASKSAL

SEQ ID NO: 1475119 - protein, 20 aa, Mycobacterium tuberculosis
RDHIRHGAAIAAALRERLDP

SEQ ID NO: 1475120 - protein, 20 aa, Mycobacterium tuberculosis
RDPDTMIPDVRYTPNPNDAP

SEQ ID NO: 1475121 - protein, 17 aa, Mycobacterium tuberculosis
RDPYHAYTIDWLPEGWF

SEQ ID NO: 1475122 - protein, 24 aa, Mycobacterium tuberculosis
RDSEWMGRVHRFLGLQVGVILATM

SEQ ID NO: 1475123 - protein, 18 aa, Mycobacterium tuberculosis
RDYAALALREEYRQKTTV

SEQ ID NO: 1475124 - protein, 17 aa, Mycobacterium tuberculosis
REELGDLLLQVLFHARI

SEQ ID NO: 1475125 - protein, 30 aa, Mycobacterium tuberculosis
REHAEARLGYPLDRSHTAAVIWGDQAQGDH

SEQ ID NO: 1475126 - protein, 20 aa, Mycobacterium tuberculosis
REIDGLLPTLIRGQGTEFDS

SEQ ID NO: 1475127 - protein, 23 aa, Mycobacterium tuberculosis
REPIAVAGEQIWRVPPLGHGEAI

SEQ ID NO: 1475128 - protein, 17 aa, Mycobacterium tuberculosis
REQFAYLSYGRVVDTTR

SEQ ID NO: 1475129 - protein, 24 aa, Mycobacterium tuberculosis
REREVLNRIACRQSIPAIAAELYV

SEQ ID NO: 1475130 - protein, 17 aa, Mycobacterium tuberculosis
RERMRFVHAHHQLLSEA

SEQ ID NO: 1475131 - protein, 17 aa, Mycobacterium tuberculosis
REYPPVRGVIHAAGVLD

SEQ ID NO: 1475132 - protein, 27 aa, Mycobacterium tuberculosis
RFADTHARVGLLPTWGLSVRLPQKVGI

SEQ ID NO: 1475133 - protein, 19 aa, Mycobacterium tuberculosis
RGAAVLAARIMSRLATQPN

SEQ ID NO: 1475134 - protein, 20 aa, Mycobacterium tuberculosis
RGAGHLGFAGTARREAVADA

SEQ ID NO: 1475135 - protein, 18 aa, Mycobacterium tuberculosis
RGALAVDAHMRRHKTTKA

SEQ ID NO: 1475136 - protein, 20 aa, Mycobacterium tuberculosis
RGDEALQWFLRSAAADIDGV

SEQ ID NO: 1475137 - protein, 20 aa, Mycobacterium tuberculosis
RGERDAVAGRRCGGLVRAVN

SEQ ID NO: 1475138 - protein, 20 aa, Mycobacterium tuberculosis
RGSQWAGMGRQLLADEPAFA

SEQ ID NO: 1475139 - protein, 18 aa, Mycobacterium tuberculosis
RGVARIGLANYFAGAFLL

SEQ ID NO: 1475140 - protein, 22 aa, Mycobacterium tuberculosis
RGVGVCGGRVRGRVRIVRPETI

SEQ ID NO: 1475141 - protein, 18 aa, Mycobacterium tuberculosis
RGVLAIAYRCPNGEPGVV

SEQ ID NO: 1475142 - protein, 19 aa, Mycobacterium tuberculosis
RGYPRAVNNLALQALVAAF

SEQ ID NO: 1475143 - protein, 19 aa, Mycobacterium tuberculosis
RHAKGWNHFLDRLVVAGQH

SEQ ID NO: 1475144 - protein, 17 aa, Mycobacterium tuberculosis
RHLWLVPITQAVQLQMV

SEQ ID NO: 1475145 - protein, 27 aa, Mycobacterium tuberculosis
RHTLKKLSGLRARNGLLTASGDNASGS

SEQ ID NO: 1475146 - protein, 18 aa, Mycobacterium tuberculosis
RIAAFGAYVVAYDPYVSP

SEQ ID NO: 1475147 - protein, 26 aa, Mycobacterium tuberculosis
RIAEAIRRFGPIFAQYYGQSEAPMVI

SEQ ID NO: 1475148 - protein, 17 aa, Mycobacterium tuberculosis
RIFAASANHSVWFHRQV

SEQ ID NO: 1475149 - protein, 24 aa, Mycobacterium tuberculosis
RIGWLTDCDYEWTQHWRVASGLGV

SEQ ID NO: 1475150 - protein, 19 aa, Mycobacterium tuberculosis
RIGWWYSIRTLSGRVRELR

SEQ ID NO: 1475151 - protein, 17 aa, Mycobacterium tuberculosis
RISGNRFTGMLVALPAD

SEQ ID NO: 1475152 - protein, 28 aa, Mycobacterium tuberculosis
RIYAELTRLCRYPLLVVDEVGYIPFEPE

SEQ ID NO: 1475153 - protein, 18 aa, Mycobacterium tuberculosis
RLAGAPMRRAIPYHIGRH

SEQ ID NO: 1475154 - protein, 20 aa, Mycobacterium tuberculosis
RLASLDKFSTAWDYRARARA

SEQ ID NO: 1475155 - protein, 21 aa, Mycobacterium tuberculosis
RLGEMCSLAGIAMKRATQALL

SEQ ID NO: 1475156 - protein, 25 aa, Mycobacterium tuberculosis
RLGPCPQHRYSFINVRRVASGSNTA

SEQ ID NO: 1475157 - protein, 19 aa, Mycobacterium tuberculosis
RLGQRRLRILGAGQQRGEH

SEQ ID NO: 1475158 - protein, 18 aa, Mycobacterium tuberculosis
RLLGEAITQAQLVLADHD

SEQ ID NO: 1475159 - protein, 19 aa, Mycobacterium tuberculosis
RLLRQLGVEAARVRMLRSF

SEQ ID NO: 1475160 - protein, 17 aa, Mycobacterium tuberculosis
RLPPLACVSARRFRCRS

SEQ ID NO: 1475161 - protein, 19 aa, Mycobacterium tuberculosis
RLRADRALVAFPEIRSISY

SEQ ID NO: 1475162 - protein, 23 aa, Mycobacterium tuberculosis
RLRDGRWHWHWDPAMMTAPGHDP

SEQ ID NO: 1475163 - protein, 24 aa, Mycobacterium tuberculosis
RLRPDQRVAFVLHDGFAVPFAEVA

SEQ ID NO: 1475164 - protein, 25 aa, Mycobacterium tuberculosis
RLTDPKAGPLIAVKLHILTRKTLGG

SEQ ID NO: 1475165 - protein, 17 aa, Mycobacterium tuberculosis
RLWAEDLLAEPLQFSIV

SEQ ID NO: 1475166 - protein, 22 aa, Mycobacterium tuberculosis
RMATGMACRTRFFDQFFLDATH

SEQ ID NO: 1475167 - protein, 17 aa, Mycobacterium tuberculosis
RNEFPPLRMSVGNRSSL

SEQ ID NO: 1475168 - protein, 18 aa, Mycobacterium tuberculosis
RNGALRMVRGVKNRFGAA

SEQ ID NO: 1475169 - protein, 18 aa, Mycobacterium tuberculosis
RNPGSPAERLRALRRACA

SEQ ID NO: 1475170 - protein, 26 aa, Mycobacterium tuberculosis
RPDELARYAQRVMDWLHPDGDLTDTE

SEQ ID NO: 1475171 - protein, 17 aa, Mycobacterium tuberculosis
RPGAELRRLTPRNTDQL

SEQ ID NO: 1475172 - protein, 19 aa, Mycobacterium tuberculosis
RPGGELIFTDPMQADDVPD

SEQ ID NO: 1475173 - protein, 30 aa, Mycobacterium tuberculosis
RPLKAVAARMACPYLNPGRYVQGRPLVQGM

SEQ ID NO: 1475174 - protein, 22 aa, Mycobacterium tuberculosis
RPSLPFPLPTCRQTQNPERGRK

SEQ ID NO: 1475175 - protein, 25 aa, Mycobacterium tuberculosis
RPVMVKAQVKIGGRGKAGGVKYAAT

SEQ ID NO: 1475176 - protein, 21 aa, Mycobacterium tuberculosis
RQGEPAVSFLLISSGSAEVSH

SEQ ID NO: 1475177 - protein, 25 aa, Mycobacterium tuberculosis
RQISRRTVCQAASILASILLETVAG

SEQ ID NO: 1475178 - protein, 17 aa, Mycobacterium tuberculosis
RQTWLDLHESWLIDKAD

SEQ ID NO: 1475179 - protein, 20 aa, Mycobacterium tuberculosis
RQVPDNGGMYFVPAFSGLFA

SEQ ID NO: 1475180 - protein, 19 aa, Mycobacterium tuberculosis
RRASMPAGALLLSAVIAIQ

SEQ ID NO: 1475181 - protein, 17 aa, Mycobacterium tuberculosis
RRDLNWRPRFDLNAVAA

SEQ ID NO: 1475182 - protein, 23 aa, Mycobacterium tuberculosis
RREDKPFWWAHFDRLNYPVDEWS

SEQ ID NO: 1475183 - protein, 22 aa, Mycobacterium tuberculosis
RRHSRNPDCERRREYPDSHTDH

SEQ ID NO: 1475184 - protein, 18 aa, Mycobacterium tuberculosis
RRISESFAASRSTRRSPI

SEQ ID NO: 1475185 - protein, 17 aa, Mycobacterium tuberculosis
RRLLFLIPPEHAHKLVF

SEQ ID NO: 1475186 - protein, 22 aa, Mycobacterium tuberculosis
RRNGRYFPAPGVKPHAAVDVRG

SEQ ID NO: 1475187 - protein, 21 aa, Mycobacterium tuberculosis
RRPRGTIRAVPGRKYPSNGPL

SEQ ID NO: 1475188 - protein, 17 aa, Mycobacterium tuberculosis
RRRCSCPARPERSSLVS

SEQ ID NO: 1475189 - protein, 20 aa, Mycobacterium tuberculosis
RRRETLRIGEKMSAPITNLQ

SEQ ID NO: 1475190 - protein, 17 aa, Mycobacterium tuberculosis
RRSASVTAVAWRTSAGA

SEQ ID NO: 1475191 - protein, 19 aa, Mycobacterium tuberculosis
RRVFAPKVTGSWRLHVATA

SEQ ID NO: 1475192 - protein, 23 aa, Mycobacterium tuberculosis
RSGVPVHTALGFTVAVAVCTPGE

SEQ ID NO: 1475193 - protein, 18 aa, Mycobacterium tuberculosis
RSHTCGHGGWTHYRDQYR

SEQ ID NO: 1475194 - protein, 20 aa, Mycobacterium tuberculosis
RSLEHLVDVVLHFEGDRNGA

SEQ ID NO: 1475195 - protein, 18 aa, Mycobacterium tuberculosis
RSPHGVSAGGSRLVGVAF

SEQ ID NO: 1475196 - protein, 17 aa, Mycobacterium tuberculosis
RSRRIPASRVVEIAPTV

SEQ ID NO: 1475197 - protein, 20 aa, Mycobacterium tuberculosis
RTADGYASNWLCDHAQVGMR

SEQ ID NO: 1475198 - protein, 23 aa, Mycobacterium tuberculosis
RTGEAPEQFAWSLVVTASDLSRR

SEQ ID NO: 1475199 - protein, 23 aa, Mycobacterium tuberculosis
RTGGADAGWHLKLPAGPDKRTEM

SEQ ID NO: 1475200 - protein, 19 aa, Mycobacterium tuberculosis
RTLDVCVRDGLMSSRAAEA

SEQ ID NO: 1475201 - protein, 17 aa, Mycobacterium tuberculosis
RTRGVLNGDEWVINGHK

SEQ ID NO: 1475202 - protein, 28 aa, Mycobacterium tuberculosis
RTVFIELLAWQFASPVRWIETQDLLFIE

SEQ ID NO: 1475203 - protein, 18 aa, Mycobacterium tuberculosis
RVAATASVLADWLDGPGA

SEQ ID NO: 1475204 - protein, 18 aa, Mycobacterium tuberculosis
RVGACRQLADALGATVLL

SEQ ID NO: 1475205 - protein, 19 aa, Mycobacterium tuberculosis
RVGGGLSVGQRGGRVHRPA

SEQ ID NO: 1475206 - protein, 23 aa, Mycobacterium tuberculosis
RVHWRPREYYPAGTTVDVDAKLY

SEQ ID NO: 1475207 - protein, 17 aa, Mycobacterium tuberculosis
RVIPSDANFVLFGEFAD

SEQ ID NO: 1475208 - protein, 17 aa, Mycobacterium tuberculosis
RVLRVSWCTVLRSSGGE

SEQ ID NO: 1475209 - protein, 17 aa, Mycobacterium tuberculosis
RVVFVLHEIFGLPYQQI

SEQ ID NO: 1475210 - protein, 24 aa, Mycobacterium tuberculosis
RWIPRVRRRWWHCIWRCSHCASAN

SEQ ID NO: 1475211 - protein, 18 aa, Mycobacterium tuberculosis
RWRSSGGVIAARIPAAAY

SEQ ID NO: 1475212 - protein, 20 aa, Mycobacterium tuberculosis
RWVLTKGKLPTSLWIEIVTT

SEQ ID NO: 1475213 - protein, 31 aa, Mycobacterium tuberculosis
RWYTATEIANAAAMRVVLGAVNAPTQTLLGR

SEQ ID NO: 1475214 - protein, 21 aa, Mycobacterium tuberculosis
RYADAWIPIVVVRPSDYSRAL

SEQ ID NO: 1475215 - protein, 17 aa, Mycobacterium tuberculosis
RYHIGRRQLHSHLRVRS

SEQ ID NO: 1475216 - protein, 18 aa, Mycobacterium tuberculosis
RYMKLLAPRWQMMSDPQL

SEQ ID NO: 1475217 - protein, 26 aa, Mycobacterium tuberculosis
RYNPDYLPGALLPPSIHATADAEEAL

SEQ ID NO: 1475218 - protein, 17 aa, Mycobacterium tuberculosis
RYPEVIVQAVSADDIVS

SEQ ID NO: 1475219 - protein, 19 aa, Mycobacterium tuberculosis
RYTYSSAWFDAISAPPKLG

SEQ ID NO: 1475220 - protein, 23 aa, Mycobacterium tuberculosis
RYWREVFRLPTINHRKLARQLDR

SEQ ID NO: 1475221 - protein, 19 aa, Mycobacterium tuberculosis
SAAASSYVAAEAVNVEQSL

SEQ ID NO: 1475222 - protein, 19 aa, Mycobacterium tuberculosis
SAAENYGSVIARLTGMHWW

SEQ ID NO: 1475223 - protein, 19 aa, Mycobacterium tuberculosis
SAGIAALFSAHAQEYQALS

SEQ ID NO: 1475224 - protein, 23 aa, Mycobacterium tuberculosis
SAHLPYYRLVALRETSPRIHELI

SEQ ID NO: 1475225 - protein, 19 aa, Mycobacterium tuberculosis
SAISPAPSPGRWSCSRPHC

SEQ ID NO: 1475226 - protein, 19 aa, Mycobacterium tuberculosis
SALLFPALCTPTGDPPAPE

SEQ ID NO: 1475227 - protein, 29 aa, Mycobacterium tuberculosis
SALQPLWSQGRMREGLAWLESILEREGDN

SEQ ID NO: 1475228 - protein, 17 aa, Mycobacterium tuberculosis
SALTTALLRSRTNGPCR

SEQ ID NO: 1475229 - protein, 23 aa, Mycobacterium tuberculosis
SAPGCDVPGYYCEVHHVTPYAQC

SEQ ID NO: 1475230 - protein, 28 aa, Mycobacterium tuberculosis
SAQVATFHDRFVQTLSAAASSYVAAEAV

SEQ ID NO: 1475231 - protein, 26 aa, Mycobacterium tuberculosis
SARAAAFHERFVQALATGGGAYAAAE

SEQ ID NO: 1475232 - protein, 26 aa, Mycobacterium tuberculosis
SARGRLGLLELRGFEMPPHLHMAMVQ

SEQ ID NO: 1475233 - protein, 26 aa, Mycobacterium tuberculosis
SARNRSCRRWFGMTPRQYRAYGGVSG

SEQ ID NO: 1475234 - protein, 18 aa, Mycobacterium tuberculosis
SATQAAALVAEFEAVRAA

SEQ ID NO: 1475235 - protein, 17 aa, Mycobacterium tuberculosis
SAVWRLQRQPEPTEAWN

SEQ ID NO: 1475236 - protein, 18 aa, Mycobacterium tuberculosis
SAYSEMWFTEAHWPAFRH

SEQ ID NO: 1475237 - protein, 19 aa, Mycobacterium tuberculosis
SCAEGGVLGAICATIASIQ

SEQ ID NO: 1475238 - protein, 21 aa, Mycobacterium tuberculosis
SCQAIWRLDDGYLAASDPRRD

SEQ ID NO: 1475239 - protein, 22 aa, Mycobacterium tuberculosis
SDGFWDEVFRELSIPYLPVRWS

SEQ ID NO: 1475240 - protein, 18 aa, Mycobacterium tuberculosis
SDLSVTLVRSITWDQGIE

SEQ ID NO: 1475241 - protein, 20 aa, Mycobacterium tuberculosis
SDSYPFCHNGFRPIMMPKIV

SEQ ID NO: 1475242 - protein, 24 aa, Mycobacterium tuberculosis
SEERKVNALKFIAFVTNPTNTAYF

SEQ ID NO: 1475243 - protein, 21 aa, Mycobacterium tuberculosis
SEFESAVGYSRAVRIGPLVVV

SEQ ID NO: 1475244 - protein, 17 aa, Mycobacterium tuberculosis
SEFLTHPAFTQYRTETS

SEQ ID NO: 1475245 - protein, 20 aa, Mycobacterium tuberculosis
SEFPPLSWRRDLSVDALLAR

SEQ ID NO: 1475246 - protein, 18 aa, Mycobacterium tuberculosis
SEHCSYKSSKVHLRYFGE

SEQ ID NO: 1475247 - protein, 19 aa, Mycobacterium tuberculosis
SETDWDALRAAYPRDAERV

SEQ ID NO: 1475248 - protein, 18 aa, Mycobacterium tuberculosis
SETFPGLAGLGDLIVTCT

SEQ ID NO: 1475249 - protein, 32 aa, Mycobacterium tuberculosis
SFNNELGHPWTVLRATRRTDYLILEMAARHHG

SEQ ID NO: 1475250 - protein, 23 aa, Mycobacterium tuberculosis
SGAHGKAGFGAPGGDGGDGGNGG

SEQ ID NO: 1475251 - protein, 22 aa, Mycobacterium tuberculosis
SGASRAAVRLQIDQPGRLDALN

SEQ ID NO: 1475252 - protein, 22 aa, Mycobacterium tuberculosis
SGDHPGIDWAKYALKAPVMMVR

SEQ ID NO: 1475253 - protein, 24 aa, Mycobacterium tuberculosis
SGDPRGGMKQVLGASRLRRDRVQA

SEQ ID NO: 1475254 - protein, 17 aa, Mycobacterium tuberculosis
SGEGRWTAIAAIDEGVP

SEQ ID NO: 1475255 - protein, 19 aa, Mycobacterium tuberculosis
SGGFVPAGTTISVYTSDGQ

SEQ ID NO: 1475256 - protein, 25 aa, Mycobacterium tuberculosis
SGGTDLRWSGSFTEKVRGTGPVMRA

SEQ ID NO: 1475257 - protein, 21 aa, Mycobacterium tuberculosis
SGILNRGADISGVYNTGALGL

SEQ ID NO: 1475258 - protein, 23 aa, Mycobacterium tuberculosis
SGKMTSRSRLEVVDPSAAAQLAD

SEQ ID NO: 1475259 - protein, 25 aa, Mycobacterium tuberculosis
SGKQRSRLALWSRRLLGEAITQAQL

SEQ ID NO: 1475260 - protein, 18 aa, Mycobacterium tuberculosis
SGLAPALIAVAGFDPLRD

SEQ ID NO: 1475261 - protein, 17 aa, Mycobacterium tuberculosis
SGNVGWANMGLGNIGFG

SEQ ID NO: 1475262 - protein, 20 aa, Mycobacterium tuberculosis
SGQEPFVFHGQFTPDRVGLW

SEQ ID NO: 1475263 - protein, 22 aa, Mycobacterium tuberculosis
SGRMYCGPGSGPMLAAAAAWDG

SEQ ID NO: 1475264 - protein, 20 aa, Mycobacterium tuberculosis
SGSAKWNLLAPYAAKSDGGR

SEQ ID NO: 1475265 - protein, 18 aa, Mycobacterium tuberculosis
SGSGRPWDRDQLLRALGL

SEQ ID NO: 1475266 - protein, 30 aa, Mycobacterium tuberculosis; identical to SEQ ID NO: 206433

SEQ ID NO: 1475267 - protein, 20 aa, Mycobacterium tuberculosis
SHALGWLPIEEIDAAASDDG

SEQ ID NO: 1475268 - protein, 23 aa, Mycobacterium tuberculosis
SHLYPDSLRTMGYDVGSAGFELV

SEQ ID NO: 1475269 - protein, 21 aa, Mycobacterium tuberculosis
SIAALRRGRGALVTQQRGAGR

SEQ ID NO: 1475270 - protein, 17 aa, Mycobacterium tuberculosis
SIGNRFVSRQCRLFACL

SEQ ID NO: 1475271 - protein, 18 aa, Mycobacterium tuberculosis
SKDLPFAQKRFCGAEGTE

SEQ ID NO: 1475272 - protein, 19 aa, Mycobacterium tuberculosis
SKNAIPWGDFSTHLAQLQG

SEQ ID NO: 1475273 - protein, 17 aa, Mycobacterium tuberculosis
SKTCWSAEGAAMTVLNR

SEQ ID NO: 1475274 - protein, 27 aa, Mycobacterium tuberculosis
SLDEPIAVVGMGCRFPGGISCPEALWD

SEQ ID NO: 1475275 - protein, 22 aa, Mycobacterium tuberculosis
SLEQELACFLGKPAAVLCSTGY

SEQ ID NO: 1475276 - protein, 22 aa, Mycobacterium tuberculosis
SLHRLRGLGRRTVLPGHGPDLL

SEQ ID NO: 1475277 - protein, 21 aa, Mycobacterium tuberculosis
SLHWDCFSFGVIQRADSFTFY

SEQ ID NO: 1475278 - protein, 17 aa, Mycobacterium tuberculosis
SLRDPYHAYTIDWLPEG

SEQ ID NO: 1475279 - protein, 17 aa, Mycobacterium tuberculosis
SLRNWIATLTLELEPTV

SEQ ID NO: 1475280 - protein, 18 aa, Mycobacterium tuberculosis
SLTGRPLIGDGANGIDGT

SEQ ID NO: 1475281 - protein, 24 aa, Mycobacterium tuberculosis
SLTVATIVRRHWPTPSLARVDAEY

SEQ ID NO: 1475282 - protein, 25 aa, Mycobacterium tuberculosis
SLVRMAQPWSLRYPLVDGQGNFGSP

SEQ ID NO: 1475283 - protein, 18 aa, Mycobacterium tuberculosis
SMDSAWRGGLPPESGFTY

SEQ ID NO: 1475284 - protein, 27 aa, Mycobacterium tuberculosis
SPAQVRVGFRLGEPAARELGVRDAHLV

SEQ ID NO: 1475285 - protein, 28 aa, Mycobacterium tuberculosis
SPGATAFPWRRQSALVQWYVETSGSPPE

SEQ ID NO: 1475286 - protein, 18 aa, Mycobacterium tuberculosis
SPISLAFLTFLPRFDCQD

SEQ ID NO: 1475287 - protein, 23 aa, Mycobacterium tuberculosis
SPVTIPGFAINPFGLDVPLSGGT

SEQ ID NO: 1475288 - protein, 26 aa, Mycobacterium tuberculosis
SQAGCGMACPFCATGQGGLTRNLSTA

SEQ ID NO: 1475289 - protein, 25 aa, Mycobacterium tuberculosis
SQPSPGGPFDWRLPDLVGASLDSLL

SEQ ID NO: 1475290 - protein, 21 aa, Mycobacterium tuberculosis
SQTAEAIWPPARTLRYDRQSP

SEQ ID NO: 1475291 - protein, 18 aa, Mycobacterium tuberculosis
SRATLVLHLAAAQIDAIV

SEQ ID NO: 1475292 - protein, 19 aa, Mycobacterium tuberculosis
SRPAALMVPDGVLRARKLP

SEQ ID NO: 1475293 - protein, 23 aa, Mycobacterium tuberculosis
SRTIRLPVHLVEQVNKLARIKRE

SEQ ID NO: 1475294 - protein, 18 aa, Mycobacterium tuberculosis
SSLVAVHLACRSLSTWDC

SEQ ID NO: 1475295 - protein, 19 aa, Mycobacterium tuberculosis
SSSLVAIHLACQSLRTQDC

SEQ ID NO: 1475296 - protein, 19 aa, Mycobacterium tuberculosis
SSSLVAVHLACRSLSTWDC

SEQ ID NO: 1475297 - protein, 21 aa, Mycobacterium tuberculosis
SSWCAGRRALAEAACRAFDAL

SEQ ID NO: 1475298 - protein, 17 aa, Mycobacterium tuberculosis
SSYGFLRSRLDGSTEQS

SEQ ID NO: 1475299 - protein, 23 aa, Mycobacterium tuberculosis
STIATYLRGDWYRDWGSVEQYHR

SEQ ID NO: 1475300 - protein, 18 aa, Mycobacterium tuberculosis
STIDELRIFVSQWDTRAR

SEQ ID NO: 1475301 - protein, 23 aa, Mycobacterium tuberculosis
STPGCTKQACDFRDNLGDFTTAG

SEQ ID NO: 1475302 - protein, 25 aa, Mycobacterium tuberculosis
STSGAHGKAGFGAPGGDGGDGGNGG

SEQ ID NO: 1475303 - protein, 34 aa, Mycobacterium tuberculosis
SVLKAYPSHELTAVGDWMLLAAIEALIDEQDYLA

SEQ ID NO: 1475304 - protein, 20 aa, Mycobacterium tuberculosis
SVLMRYSRRNTVCISSQAGC

SEQ ID NO: 1475305 - protein, 17 aa, Mycobacterium tuberculosis
SVPRTLAGLTIVVTGSL

SEQ ID NO: 1475306 - protein, 24 aa, Mycobacterium tuberculosis
SVQRESGIEFGRYLTEAVCEHLGM

SEQ ID NO: 1475307 - protein, 19 aa, Mycobacterium tuberculosis
SWRIMPENLEDAGVSWKVY

SEQ ID NO: 1475308 - protein, 17 aa, Mycobacterium tuberculosis
SYFLDLRGPSVAVDTAC

SEQ ID NO: 1475309 - protein, 25 aa, Mycobacterium tuberculosis
SYQEVRRGVTFAVVHFDWERLTDSV

SEQ ID NO: 1475310 - protein, 21 aa, Mycobacterium tuberculosis
TAAADAARIGSAINTANTAAA

SEQ ID NO: 1475311 - protein, 26 aa, Mycobacterium tuberculosis
TAADPAGWPRLDWSMDAALLLAALAS

SEQ ID NO: 1475312 - protein, 23 aa, Mycobacterium tuberculosis
TAAKAMCGLCANGVTGLQLVADL

SEQ ID NO: 1475313 - protein, 18 aa, Mycobacterium tuberculosis
TACSNLRNPAGVGADDGA

SEQ ID NO: 1475314 - protein, 25 aa, Mycobacterium tuberculosis
TADCELDWWLGFSSAASLLGSPGQA

SEQ ID NO: 1475315 - protein, 18 aa, Mycobacterium tuberculosis
TAEELGRAFPGTAVITSA

SEQ ID NO: 1475316 - protein, 21 aa, Mycobacterium tuberculosis
TAELKFPGGHTGGIRCSMRSS

SEQ ID NO: 1475317 - protein, 17 aa, Mycobacterium tuberculosis
TALVLPAAGAPAVVLPR

SEQ ID NO: 1475318 - protein, 17 aa, Mycobacterium tuberculosis
TAQWRWDMLAAKLADFL

SEQ ID NO: 1475319 - protein, 18 aa, Mycobacterium tuberculosis
TASHTVWLVTPTHKHTYI

SEQ ID NO: 1475320 - protein, 23 aa, Mycobacterium tuberculosis
TATRRLCEWAGCKFLGEHATTNR

SEQ ID NO: 1475321 - protein, 20 aa, Mycobacterium tuberculosis
TAVWQLLCADGDAIDAIGRS

SEQ ID NO: 1475322 - protein, 20 aa, Mycobacterium tuberculosis
TCGHGGWTHYRDQYRRHCGR

SEQ ID NO: 1475323 - protein, 23 aa, Mycobacterium tuberculosis
TCIECPDGTVGEIWVHGDNVANG

SEQ ID NO: 1475324 - protein, 21 aa, Mycobacterium tuberculosis
TDADGGPALVEFAGRACYQSW

SEQ ID NO: 1475325 - protein, 20 aa, Mycobacterium tuberculosis
TDMVLRLAAGMERRTTHGGT

SEQ ID NO: 1475326 - protein, 17 aa, Mycobacterium tuberculosis
TDPETGVAFALVHNRLL

SEQ ID NO: 1475327 - protein, 17 aa, Mycobacterium tuberculosis
TDRGWDVEGLYDPDPDA

SEQ ID NO: 1475328 - protein, 17 aa, Mycobacterium tuberculosis
TDTRIATAVARTVTARL

SEQ ID NO: 1475329 - protein, 17 aa, Mycobacterium tuberculosis
TEIGRELTARTGGVVGR

SEQ ID NO: 1475330 - protein, 18 aa, Mycobacterium tuberculosis
TELTGITGARTWCGHGVF

SEQ ID NO: 1475331 - protein, 19 aa, Mycobacterium tuberculosis
TENYLRWVSDVDRSAPRPN

SEQ ID NO: 1475332 - protein, 20 aa, Mycobacterium tuberculosis
TESWMGPASMAMVTAAQPYL

SEQ ID NO: 1475333 - protein, 17 aa, Mycobacterium tuberculosis
TETLELAPAHPPALPDP

SEQ ID NO: 1475334 - protein, 18 aa, Mycobacterium tuberculosis
TEVIALQERLGLDVLVHG

SEQ ID NO: 1475335 - protein, 22 aa, Mycobacterium tuberculosis
TFFVRGLRDWDQCAGGIVGQPE

SEQ ID NO: 1475336 - protein, 17 aa, Mycobacterium tuberculosis
TFGGLKPVHALADCGRV

SEQ ID NO: 1475337 - protein, 20 aa, Mycobacterium tuberculosis
TFLCACGPAYLPERDQRMGE

SEQ ID NO: 1475338 - protein, 17 aa, Mycobacterium tuberculosis
TGAGVFTGIAGSLSRGF

SEQ ID NO: 1475339 - protein, 32 aa, Mycobacterium tuberculosis
TGCGGEYEWTRAKAAYFMIVFSGPIPDDKWLQ

SEQ ID NO: 1475340 - protein, 19 aa, Mycobacterium tuberculosis
TGFDFPFAAMGAIHTENRI

SEQ ID NO: 1475341 - protein, 27 aa, Mycobacterium tuberculosis
TGGGGGNGGTGWNGGKGDTGSGGGAGD

SEQ ID NO: 1475342 - protein, 26 aa, Mycobacterium tuberculosis
TGGSGGFGAPPPRSIGGGDGGDGGRG

SEQ ID NO: 1475343 - protein, 22 aa, Mycobacterium tuberculosis
TGKELFAAQGLPPFEDDHITRF

SEQ ID NO: 1475344 - protein, 24 aa, Mycobacterium tuberculosis
TGPEGLPSVFVYDGYPGGAGFAER

SEQ ID NO: 1475345 - protein, 25 aa, Mycobacterium tuberculosis
TGQAGGAGGILWGNGGAGGSGAPGQ

SEQ ID NO: 1475346 - protein, 23 aa, Mycobacterium tuberculosis
TGQAGGDGGLLFGNGGNGGSGAP

SEQ ID NO: 1475347 - protein, 22 aa, Mycobacterium tuberculosis
TGQAGGPGGLLYGNGGNGGSGG

SEQ ID NO: 1475348 - protein, 18 aa, Mycobacterium tuberculosis
TGQGGWPMTCFLTPNGRP

SEQ ID NO: 1475349 - protein, 21 aa, Mycobacterium tuberculosis
TGSPIPVGLDPTGVAVNPVTG

SEQ ID NO: 1475350 - protein, 18 aa, Mycobacterium tuberculosis
THAALPGMVKRGAGAVLN

SEQ ID NO: 1475351 - protein, 18 aa, Mycobacterium tuberculosis
THLVHLRETVNLGPIHID

SEQ ID NO: 1475352 - protein, 25 aa, Mycobacterium tuberculosis
TIGEIPFDLVAHSTLGPVHILIDLP

SEQ ID NO: 1475353 - protein, 28 aa, Mycobacterium tuberculosis
TIPAIPIGLELNGGVGPITVLPIQILPT

SEQ ID NO: 1475354 - protein, 29 aa, Mycobacterium tuberculosis
TITIPEIPYRYDLSVPIDIPITGTVVATT

SEQ ID NO: 1475355 - protein, 17 aa, Mycobacterium tuberculosis
TKAVGWSPTDWVDNTLA

SEQ ID NO: 1475356 - protein, 29 aa, Mycobacterium tuberculosis
TKIVGLRARAKAAFAEREGVNLTFLPFFA

SEQ ID NO: 1475357 - protein, 17 aa, Mycobacterium tuberculosis
TKLPWSDWLSRQRWYAG

SEQ ID NO: 1475358 - protein, 24 aa, Mycobacterium tuberculosis
TLDALVSLVLDWHRPVKIFVETKH

SEQ ID NO: 1475359 - protein, 19 aa, Mycobacterium tuberculosis
TLGEVWEFITNALNGLKEL

SEQ ID NO: 1475360 - protein, 30 aa, Mycobacterium tuberculosis
TLGLDFMRSCSIRHRMASVIFSLEMSKSEI

SEQ ID NO: 1475361 - protein, 18 aa, Mycobacterium tuberculosis
TLLALSAFCVVIDKGTSF

SEQ ID NO: 1475362 - protein, 18 aa, Mycobacterium tuberculosis
TLLALSVFCVVIDKGTSF

SEQ ID NO: 1475363 - protein, 19 aa, Mycobacterium tuberculosis
TLLGRPLIGNGTNGAPGTG

SEQ ID NO: 1475364 - protein, 23 aa, Mycobacterium tuberculosis
TLMALMCSAATMYTPERVTFFCI

SEQ ID NO: 1475365 - protein, 17 aa, Mycobacterium tuberculosis
TLPGGFTISARKAYGRN

SEQ ID NO: 1475366 - protein, 18 aa, Mycobacterium tuberculosis
TLTGRPLIGNGANGTPGT

SEQ ID NO: 1475367 - protein, 26 aa, Mycobacterium tuberculosis
TLTSRPGGGGWGWGVEPPGAAVAEVI

SEQ ID NO: 1475368 - protein, 17 aa, Mycobacterium tuberculosis
TLVRAASDLANIGSTLG

SEQ ID NO: 1475369 - protein, 23 aa, Mycobacterium tuberculosis
TMALLGRPLIGHGADGAPGTGQA

SEQ ID NO: 1475370 - protein, 26 aa, Mycobacterium tuberculosis
TMELALRVALGVIRLLLGADYAPLAV

SEQ ID NO: 1475371 - protein, 24 aa, Mycobacterium tuberculosis
TMPVPEPMVKMMLNNVLEHLAENL

SEQ ID NO: 1475372 - protein, 25 aa, Mycobacterium tuberculosis
TMVRRLPPGAIWQVIAIGKANMELT

SEQ ID NO: 1475373 - protein, 21 aa, Mycobacterium tuberculosis
TNALGGPGIELFRRLVKEYER

SEQ ID NO: 1475374 - protein, 18 aa, Mycobacterium tuberculosis
TNFGPLQPLFDVINAPTL

SEQ ID NO: 1475375 - protein, 26 aa, Mycobacterium tuberculosis
TPAPLPCTPRGIVHLLRRYDISIAGA

SEQ ID NO: 1475376 - protein, 20 aa, Mycobacterium tuberculosis
TPETLLGCPGEIDIGHRTIP

SEQ ID NO: 1475377 - protein, 17 aa, Mycobacterium tuberculosis
TPFCVTVDFDSLQDNAV

SEQ ID NO: 1475378 - protein, 19 aa, Mycobacterium tuberculosis
TPLMAQLLEGHPRRWHRPP

SEQ ID NO: 1475379 - protein, 20 aa, Mycobacterium tuberculosis
TPLVPMPGRFIYAGIADRLV

SEQ ID NO: 1475380 - protein, 30 aa, Mycobacterium tuberculosis
TPPSPPRLPTWNRRAPSPGSPPLPPPPPTP

SEQ ID NO: 1475381 - protein, 17 aa, Mycobacterium tuberculosis
TPSPPVTHCTTVASHTA

SEQ ID NO: 1475382 - protein, 24 aa, Mycobacterium tuberculosis
TPSSKLGGLWKTVSPHLSPISNMV

SEQ ID NO: 1475383 - protein, 24 aa, Mycobacterium tuberculosis
TQAAAFHERFIQALSTAAGAYGSA

SEQ ID NO: 1475384 - protein, 22 aa, Mycobacterium tuberculosis
TQALFGRPLIGNGADGSPGTGQ

SEQ ID NO: 1475385 - protein, 24 aa, Mycobacterium tuberculosis
TQALLGRPLIGDGAAGAPGTGQAG

SEQ ID NO: 1475386 - protein, 18 aa, Mycobacterium tuberculosis
TQGIDMVARIGIPDRPAA

SEQ ID NO: 1475387 - protein, 18 aa, Mycobacterium tuberculosis
TQLLAYAAEQGRLQLTDY

SEQ ID NO: 1475388 - protein, 25 aa, Mycobacterium tuberculosis
TQTLLGRPLIGDGAHGTAPGQPGGA

SEQ ID NO: 1475389 - protein, 23 aa, Mycobacterium tuberculosis
TRDFPENTVLAITNAVAAGVDGM

SEQ ID NO: 1475390 - protein, 19 aa, Mycobacterium tuberculosis
TRLAEGLVQAAALMEGHEA

SEQ ID NO: 1475391 - protein, 20 aa, Mycobacterium tuberculosis
TRMRVELGYQPKWTTVEAFD

SEQ ID NO: 1475392 - protein, 26 aa, Mycobacterium tuberculosis
TRRGRPTVWSVWGVGVAILLGDALHA

SEQ ID NO: 1475393 - protein, 19 aa, Mycobacterium tuberculosis
TRRTGLCQFEDAFTQLSGA

SEQ ID NO: 1475394 - protein, 28 aa, Mycobacterium tuberculosis
TRVEFWAFDLLYLDGRALLGTRYQDRRK

SEQ ID NO: 1475395 - protein, 18 aa, Mycobacterium tuberculosis
TRVSAAFIDRICSATRAE

SEQ ID NO: 1475396 - protein, 22 aa, Mycobacterium tuberculosis
TSLLCTACFDGKYPIELPRETA

SEQ ID NO: 1475397 - protein, 18 aa, Mycobacterium tuberculosis
TSRLRLTARASLNAGELE

SEQ ID NO: 1475398 - protein, 17 aa, Mycobacterium tuberculosis
TSSAITITEVRAVSMDR

SEQ ID NO: 1475399 - protein, 19 aa, Mycobacterium tuberculosis
TTDGLRIDTGMYLTGMEQA

SEQ ID NO: 1475400 - protein, 25 aa, Mycobacterium tuberculosis
TTGGPYAHGWVTWFPPDAPPGTERF

SEQ ID NO: 1475401 - protein, 18 aa, Mycobacterium tuberculosis
TTIRNLVHGIGFQRDVLG

SEQ ID NO: 1475402 - protein, 25 aa, Mycobacterium tuberculosis
TTMFRPKLDALALLHRLSLKSPVRH

SEQ ID NO: 1475403 - protein, 27 aa, Mycobacterium tuberculosis
TTNPPVEGAFYWLNNREVRWRPEHFWK

SEQ ID NO: 1475404 - protein, 31 aa, Mycobacterium tuberculosis; identical to SEQ ID NO: 207356

SEQ ID NO: 1475405 - protein, 24 aa, Mycobacterium tuberculosis
TTVLKAINWFGQFSTRIADKEADY

SEQ ID NO: 1475406 - protein, 17 aa, Mycobacterium tuberculosis
TVADWPEGLAAVLRGAA

SEQ ID NO: 1475407 - protein, 20 aa, Mycobacterium tuberculosis
TVAEWSHLLAGHGLVVEHVV

SEQ ID NO: 1475408 - protein, 17 aa, Mycobacterium tuberculosis
TVLPIQILPTIPLNIHQ

SEQ ID NO: 1475409 - protein, 21 aa, Mycobacterium tuberculosis
TVQAQKLWAQAGFRPVDPAVA

SEQ ID NO: 1475410 - protein, 18 aa, Mycobacterium tuberculosis
TVSGWVRRTEAAADVGAD

SEQ ID NO: 1475411 - protein, 19 aa, Mycobacterium tuberculosis
TWLALQPFLAPAGITRVAD

SEQ ID NO: 1475412 - protein, 22 aa, Mycobacterium tuberculosis
TYAFQRRRFWLSGDGVAADAAG

SEQ ID NO: 1475413 - protein, 22 aa, Mycobacterium tuberculosis
TYSEDWLRPDYVAPVADTPPDP

SEQ ID NO: 1475414 - protein, 21 aa, Mycobacterium tuberculosis
VAAECRWIRENLGVDVPVHFT

SEQ ID NO: 1475415 - protein, 23 aa, Mycobacterium tuberculosis
VAAGARFSGGVFACAALAERELT

SEQ ID NO: 1475416 - protein, 23 aa, Mycobacterium tuberculosis
VAAMPTTEVVAAGADEVSAGIAA

SEQ ID NO: 1475417 - protein, 22 aa, Mycobacterium tuberculosis
VAETLIEVALRFVKIRETAWRV

SEQ ID NO: 1475418 - protein, 30 aa, Mycobacterium tuberculosis
VAFLRAGDAIACALELQLSTLAPMRPRVGV

SEQ ID NO: 1475419 - protein, 24 aa, Mycobacterium tuberculosis
VAHPLYCRRMQQKLVEFAEAGFPG

SEQ ID NO: 1475420 - protein, 18 aa, Mycobacterium tuberculosis
VAISRALAHNPMLVLADE

SEQ ID NO: 1475421 - protein, 17 aa, Mycobacterium tuberculosis
VALEHRTSYTFDRLVRV

SEQ ID NO: 1475422 - protein, 17 aa, Mycobacterium tuberculosis
VALKDLEIRGAGNVLGI

SEQ ID NO: 1475423 - protein, 23 aa, Mycobacterium tuberculosis
VALSVPVSGTWVDIRFTLPANTV

SEQ ID NO: 1475424 - protein, 20 aa, Mycobacterium tuberculosis
VANALYWLQEFHIDGLRVDA

SEQ ID NO: 1475425 - protein, 18 aa, Mycobacterium tuberculosis
VAPWMFGAAGREHMKKYG

SEQ ID NO: 1475426 - protein, 22 aa, Mycobacterium tuberculosis
VARDRAQAIAGLRALAAGQHAP

SEQ ID NO: 1475427 - protein, 27 aa, Mycobacterium tuberculosis
VARIRSGPPMGFFRIGWVRTLANLNEF

SEQ ID NO: 1475428 - protein, 24 aa, Mycobacterium tuberculosis
VARQEPRLNWAVGVHADGTTVLVT

SEQ ID NO: 1475429 - protein, 20 aa, Mycobacterium tuberculosis
VARVGTVVMSWRLRTRHRLP

SEQ ID NO: 1475430 - protein, 23 aa, Mycobacterium tuberculosis
VCTLDRPRHAQLIHDVRATGARI

SEQ ID NO: 1475431 - protein, 24 aa, Mycobacterium tuberculosis
VDDARLPGAARPAAGQHRQQAIDG

SEQ ID NO: 1475432 - protein, 28 aa, Mycobacterium tuberculosis
VDGRSHAWVQAWNGGWWHYDPTNDNEIT

SEQ ID NO: 1475433 - protein, 17 aa, Mycobacterium tuberculosis
VDGRVVGAIRPDGQGLV

SEQ ID NO: 1475434 - protein, 17 aa, Mycobacterium tuberculosis
VDYRLIPKHSLGMALDD

SEQ ID NO: 1475435 - protein, 20 aa, Mycobacterium tuberculosis
VEANAAFEEARRRFEASWNR

SEQ ID NO: 1475436 - protein, 20 aa, Mycobacterium tuberculosis
VEAPTGWPNILPDDFTILDG

SEQ ID NO: 1475437 - protein, 17 aa, Mycobacterium tuberculosis
VEGLRGWLREERIDAVV

SEQ ID NO: 1475438 - protein, 18 aa, Mycobacterium tuberculosis
VELGWICVSINYSKSPRC

SEQ ID NO: 1475439 - protein, 24 aa, Mycobacterium tuberculosis
VELLRSRVFFDWFDAMGVDDIPAV

SEQ ID NO: 1475440 - protein, 20 aa, Mycobacterium tuberculosis
VELRNRLKTATGLTLSPTLI

SEQ ID NO: 1475441 - protein, 17 aa, Mycobacterium tuberculosis
VELYISYLRKKIDNGRE

SEQ ID NO: 1475442 - protein, 17 aa, Mycobacterium tuberculosis
VEQRVGGGLSVGQRGGR

SEQ ID NO: 1475443 - protein, 17 aa, Mycobacterium tuberculosis
VERALIAGHDFVLLGER

SEQ ID NO: 1475444 - protein, 31 aa, Mycobacterium tuberculosis
VEVALFRLLGSWGVRPDFVMGHSIGELSAAH

SEQ ID NO: 1475445 - protein, 24 aa, Mycobacterium tuberculosis
VFGDTVALLPSWETLPHERLSPGV

SEQ ID NO: 1475446 - protein, 23 aa, Mycobacterium tuberculosis
VFGRLQRHVAMIVVAQFAATLTD

SEQ ID NO: 1475447 - protein, 29 aa, Mycobacterium tuberculosis
VGDVGAGYQFPAWRLVGGHQPVNPPAQRG

SEQ ID NO: 1475448 - protein, 18 aa, Mycobacterium tuberculosis
VGGNGGKGGVGAAGGLAG

SEQ ID NO: 1475449 - protein, 25 aa, Mycobacterium tuberculosis
VGGPGGGHGLLGLGGSHGAGGAGGS

SEQ ID NO: 1475450 - protein, 17 aa, Mycobacterium tuberculosis
VGGWGFSWLDGRATEER

SEQ ID NO: 1475451 - protein, 18 aa, Mycobacterium tuberculosis
VGLPAIYVPLPIGNGEQR

SEQ ID NO: 1475452 - protein, 19 aa, Mycobacterium tuberculosis
VGPPPFRPPTFNPVDGAMV

SEQ ID NO: 1475453 - protein, 18 aa, Mycobacterium tuberculosis
VGRQHGWPADVPSAEQRR

SEQ ID NO: 1475454 - protein, 17 aa, Mycobacterium tuberculosis
VGVRSRFGAAVLGSRTI

SEQ ID NO: 1475455 - protein, 17 aa, Mycobacterium tuberculosis
VHLSLMVLRSMGIPCRY

SEQ ID NO: 1475456 - protein, 22 aa, Mycobacterium tuberculosis
VIDELRELADVLGVARDAEVLG

SEQ ID NO: 1475457 - protein, 18 aa, Mycobacterium tuberculosis
VINAPTLALLNRPLIGNG

SEQ ID NO: 1475458 - protein, 30 aa, Mycobacterium tuberculosis
VKEKNDWTYPKWAKQVIRVLIAIENAIWPD

SEQ ID NO: 1475459 - protein, 24 aa, Mycobacterium tuberculosis
VKFDGGTLPPMFVDLINAPTRRQV

SEQ ID NO: 1475460 - protein, 21 aa, Mycobacterium tuberculosis
VKSNIAFRIALRAESGDDSRE

SEQ ID NO: 1475461 - protein, 19 aa, Mycobacterium tuberculosis
VKTFWGWRDQQLPDGTLIL

SEQ ID NO: 1475462 - protein, 21 aa, Mycobacterium tuberculosis
VLARPPWDPGTAIIAVSDIEA

SEQ ID NO: 1475463 - protein, 26 aa, Mycobacterium tuberculosis
VLFGEMLIELDIHFRIEDDLYYPALS

SEQ ID NO: 1475464 - protein, 26 aa, Mycobacterium tuberculosis
VLGAGIPLFGICFGNQILGRALGLPT

SEQ ID NO: 1475465 - protein, 17 aa, Mycobacterium tuberculosis
VLLAWQMNSEPLPRAHG

SEQ ID NO: 1475466 - protein, 17 aa, Mycobacterium tuberculosis
VLLLRDIRRVFSDRDRM

SEQ ID NO: 1475467 - protein, 18 aa, Mycobacterium tuberculosis
VLVPGQLVSKEIIYFLAQ

SEQ ID NO: 1475468 - protein, 26 aa, Mycobacterium tuberculosis
VLYPRKGVSELTRFTPEAVVEKYGLT

SEQ ID NO: 1475469 - protein, 32 aa, Mycobacterium tuberculosis
VMLESFLFYSGFYLPMYWSSRGKLTNTADLIR

SEQ ID NO: 1475470 - protein, 21 aa, Mycobacterium tuberculosis
VMPEDLIKFGLIPEFIGRLPV

SEQ ID NO: 1475471 - protein, 18 aa, Mycobacterium tuberculosis
VMTGFRVSRSGWYGIDPV

SEQ ID NO: 1475472 - protein, 26 aa, Mycobacterium tuberculosis
VNGPTQLLLGRPLIGDGANGGPGQNG

SEQ ID NO: 1475473 - protein, 18 aa, Mycobacterium tuberculosis
VNSLRMYLGAGSGPMLAA

SEQ ID NO: 1475474 - protein, 21 aa, Mycobacterium tuberculosis
VPADEAPGWELVPGTDIANEH

SEQ ID NO: 1475475 - protein, 17 aa, Mycobacterium tuberculosis
VPDPAAERVLVGVRPES

SEQ ID NO: 1475476 - protein, 31 aa, Mycobacterium tuberculosis
VPLAAAVWTQRGWRFPDRLDRVYVNSRARRD

SEQ ID NO: 1475477 - protein, 24 aa, Mycobacterium tuberculosis
VPLPSKWRIAFGEPICTADYASTD

SEQ ID NO: 1475478 - protein, 21 aa, Mycobacterium tuberculosis
VPLTFPSLVKSGSRTPGLANI

SEQ ID NO: 1475479 - protein, 23 aa, Mycobacterium tuberculosis
VPRSRMGRIAWSWFRHPVKSHEF

SEQ ID NO: 1475480 - protein, 24 aa, Mycobacterium tuberculosis
VPTQLRFDRWFLPLAVPLGLGPKN

SEQ ID NO: 1475481 - protein, 25 aa, Mycobacterium tuberculosis
VQHTGCQAAGIAQAGERPHHRTRGL

SEQ ID NO: 1475482 - protein, 18 aa, Mycobacterium tuberculosis
VREPIPGMGHAIELRVYR

SEQ ID NO: 1475483 - protein, 20 aa, Mycobacterium tuberculosis
VRGEGAAVVVLKRLDDAVRD

SEQ ID NO: 1475484 - protein, 18 aa, Mycobacterium tuberculosis
VRGGEGFFNRQEIKQALL

SEQ ID NO: 1475485 - protein, 19 aa, Mycobacterium tuberculosis
VRHLEVIALTPARLLMVVI

SEQ ID NO: 1475486 - protein, 26 aa, Mycobacterium tuberculosis
VRIVSYPGSSLWDMVRPRPSSRPAAA

SEQ ID NO: 1475487 - protein, 24 aa, Mycobacterium tuberculosis
VRNMPRPLVAVAAILAPLMQDAEL

SEQ ID NO: 1475488 - protein, 19 aa, Mycobacterium tuberculosis
VRNQVPFFVDYVRRYTDLP

SEQ ID NO: 1475489 - protein, 18 aa, Mycobacterium tuberculosis
VRPPEELARFLSGQSPTT

SEQ ID NO: 1475490 - protein, 25 aa, Mycobacterium tuberculosis
VRSYNCLKREGVHTVGELVARTESD

SEQ ID NO: 1475491 - protein, 18 aa, Mycobacterium tuberculosis
VRVADVWVGTVRDISLRN

SEQ ID NO: 1475492 - protein, 20 aa, Mycobacterium tuberculosis
VSAAIAALFGAHAQAYQTIS

SEQ ID NO: 1475493 - protein, 20 aa, Mycobacterium tuberculosis
VSAAIASLFAAHGQAYQAVS

SEQ ID NO: 1475494 - protein, 19 aa, Mycobacterium tuberculosis
VSAAMAALFSGHAQAYQAL

SEQ ID NO: 1475495 - protein, 20 aa, Mycobacterium tuberculosis
VSAGIAALFSAHAQEYQALS

SEQ ID NO: 1475496 - protein, 24 aa, Mycobacterium tuberculosis
VSGMGLDWASVFSGYRPKRVELPT

SEQ ID NO: 1475497 - protein, 25 aa, Mycobacterium tuberculosis
VSLDGAEFLVRWLTTGWPRQVAEAL

SEQ ID NO: 1475498 - protein, 17 aa, Mycobacterium tuberculosis
VSNLRKLLGGAGIDPRV

SEQ ID NO: 1475499 - protein, 17 aa, Mycobacterium tuberculosis
VSTLVVFGKTAPRVAAT

SEQ ID NO: 1475500 - protein, 20 aa, Mycobacterium tuberculosis
VTPGATPWVTWGEFVETRML

SEQ ID NO: 1475501 - protein, 17 aa, Mycobacterium tuberculosis
VTRCARLAALAITASPD

SEQ ID NO: 1475502 - protein, 22 aa, Mycobacterium tuberculosis
VTSFRVGRHRAEVVAVADGITY

SEQ ID NO: 1475503 - protein, 18 aa, Mycobacterium tuberculosis
VVADRWFPSLSVEPTVRP

SEQ ID NO: 1475504 - protein, 24 aa, Mycobacterium tuberculosis
VVDDAARLTAVWIADWADNTVHLS

SEQ ID NO: 1475505 - protein, 21 aa, Mycobacterium tuberculosis
VVDSLDFQDGIAFVHAEDPGY

SEQ ID NO: 1475506 - protein, 17 aa, Mycobacterium tuberculosis
VVFVRYALPGERVRARV

SEQ ID NO: 1475507 - protein, 18 aa, Mycobacterium tuberculosis
VVHRWRNVGVLDMGWEKY

SEQ ID NO: 1475508 - protein, 21 aa, Mycobacterium tuberculosis
VVNLHRRYRITTARLAAATEE

SEQ ID NO: 1475509 - protein, 22 aa, Mycobacterium tuberculosis
VVRTLTVDAGAYASAEAANAGP

SEQ ID NO: 1475510 - protein, 18 aa, Mycobacterium tuberculosis
VVSEFPTDRGWDVEGLYD

SEQ ID NO: 1475511 - protein, 25 aa, Mycobacterium tuberculosis
VWLEAGKQGFLGMAVPEEYGGGGNA

SEQ ID NO: 1475512 - protein, 18 aa, Mycobacterium tuberculosis
VYDYLRLLYARAGTPHCP

SEQ ID NO: 1475513 - protein, 20 aa, Mycobacterium tuberculosis
VYGTLPWHPDLWLDSEDALD

SEQ ID NO: 1475514 - protein, 19 aa, Mycobacterium tuberculosis
WAADVAAMVSYHSGASAVA

SEQ ID NO: 1475515 - protein, 18 aa, Mycobacterium tuberculosis
WACVDLELHPGRTVFVGP

SEQ ID NO: 1475516 - protein, 17 aa, Mycobacterium tuberculosis
WAHFDRLNYPVDEWSDS

SEQ ID NO: 1475517 - protein, 18 aa, Mycobacterium tuberculosis
WAKYALKAPVMMVRSPDT

SEQ ID NO: 1475518 - protein, 17 aa, Mycobacterium tuberculosis
WCIGGAVDLISAVDIRY

SEQ ID NO: 1475519 - protein, 20 aa, Mycobacterium tuberculosis
WDLPGRCNIRAMNYAINAHL

SEQ ID NO: 1475520 - protein, 23 aa, Mycobacterium tuberculosis
WESELDPDLLWLADHVIDDLVVL

SEQ ID NO: 1475521 - protein, 24 aa, Mycobacterium tuberculosis
WETTCLISPAGSVEWLCVPRPDSP

SEQ ID NO: 1475522 - protein, 25 aa, Mycobacterium tuberculosis
WETTCLISPAGSVEWLCVPRPDSPS

SEQ ID NO: 1475523 - protein, 18 aa, Mycobacterium tuberculosis
WHAESSWAARVSLAHALI

SEQ ID NO: 1475524 - protein, 19 aa, Mycobacterium tuberculosis
WIATLTLELEPTVRLPANA

SEQ ID NO: 1475525 - protein, 25 aa, Mycobacterium tuberculosis
WIHDERRRRCGGPPIAAATRAQIKA

SEQ ID NO: 1475526 - protein, 20 aa, Mycobacterium tuberculosis
WIHLPCLPSVAALDHNLGVP

SEQ ID NO: 1475527 - protein, 19 aa, Mycobacterium tuberculosis
WLADTWRDRFEQMLQRAEA

SEQ ID NO: 1475528 - protein, 17 aa, Mycobacterium tuberculosis
WLMPVSYAGTVSEHNAT

SEQ ID NO: 1475529 - protein, 22 aa, Mycobacterium tuberculosis
WLRNSTRGALAMDPRRMAMMFE

SEQ ID NO: 1475530 - protein, 17 aa, Mycobacterium tuberculosis
WLTTGWPRQVAEALHAT

SEQ ID NO: 1475531 - protein, 17 aa, Mycobacterium tuberculosis
WNLLAPYAAKSDGGRNN

SEQ ID NO: 1475532 - protein, 24 aa, Mycobacterium tuberculosis
WPATPARLPFTLGAGAHLQADIAL

SEQ ID NO: 1475533 - protein, 18 aa, Mycobacterium tuberculosis
WPPEAQLYVALDDDGERH

SEQ ID NO: 1475534 - protein, 17 aa, Mycobacterium tuberculosis
WQALGGMNSALGAPTSP

SEQ ID NO: 1475535 - protein, 18 aa, Mycobacterium tuberculosis
WRAVRRDLGSMSVAETNP

SEQ ID NO: 1475536 - protein, 25 aa, Mycobacterium tuberculosis
WRDREPALASPRRPQAPVVPIISSA

SEQ ID NO: 1475537 - protein, 24 aa, Mycobacterium tuberculosis
WRNRRGELELSVVMVIANHPDLAA

SEQ ID NO: 1475538 - protein, 17 aa, Mycobacterium tuberculosis
WRTFLTCDANLAVTLPP

SEQ ID NO: 1475539 - protein, 31 aa, Mycobacterium tuberculosis
WRTPCTCARASWRRAIWRWYRARYVSPKPWT

SEQ ID NO: 1475540 - protein, 17 aa, Mycobacterium tuberculosis
WRTVGAIVARVWADTEK

SEQ ID NO: 1475541 - protein, 18 aa, Mycobacterium tuberculosis
WRWYRARYVSPKPWTCRS

SEQ ID NO: 1475542 - protein, 20 aa, Mycobacterium tuberculosis
WSANPFPFLRQIIANHQVYW

SEQ ID NO: 1475543 - protein, 26 aa, Mycobacterium tuberculosis
WSPDSDLKGFDGFDGGSGGAGGDGGA

SEQ ID NO: 1475544 - protein, 17 aa, Mycobacterium tuberculosis
WVRINGFGTPWWADDLA

SEQ ID NO: 1475545 - protein, 19 aa, Mycobacterium tuberculosis
WWQVHRRAMIVAEELWIYA

SEQ ID NO: 1475546 - protein, 18 aa, Mycobacterium tuberculosis
YACSFRITEAVYFVERLV

SEQ ID NO: 1475547 - protein, 31 aa, Mycobacterium tuberculosis
YADGDIWDWAVDWDTWVSMSALPPPAAKPAA

SEQ ID NO: 1475548 - protein, 26 aa, Mycobacterium tuberculosis
YADGKRSGLWPGLRETFKSGSSQPPL

SEQ ID NO: 1475549 - protein, 26 aa, Mycobacterium tuberculosis
YDDIPANVMPIDWYLHVRHAVGGEIA

SEQ ID NO: 1475550 - protein, 19 aa, Mycobacterium tuberculosis
YDDRLLYLDRYWREDEQVC

SEQ ID NO: 1475551 - protein, 20 aa, Mycobacterium tuberculosis
YDPIWPRHGIRIIPGPSSLW

SEQ ID NO: 1475552 - protein, 27 aa, Mycobacterium tuberculosis
YDRALELGCGTGFFLLNLIQAGVARRG

SEQ ID NO: 1475553 - protein, 19 aa, Mycobacterium tuberculosis
YDRQSPWLATGFDRRMSQT

SEQ ID NO: 1475554 - protein, 17 aa, Mycobacterium tuberculosis
YESRPGDVISLGATSWR

SEQ ID NO: 1475555 - protein, 17 aa, Mycobacterium tuberculosis
YFRDFWGADSGMLAALH

SEQ ID NO: 1475556 - protein, 17 aa, Mycobacterium tuberculosis
YGAAGFAVLERTIAELR

SEQ ID NO: 1475557 - protein, 17 aa, Mycobacterium tuberculosis
YGAAVFAVSETFCLTDH

SEQ ID NO: 1475558 - protein, 24 aa, Mycobacterium tuberculosis
YITKSGHDYTWFVLNAKIIEKEFA

SEQ ID NO: 1475559 - protein, 25 aa, Mycobacterium tuberculosis
YLHVPFCLTRCGYCDFNTYTPAQLG

SEQ ID NO: 1475560 - protein, 24 aa, Mycobacterium tuberculosis
YLMAARGVGVGQILAITFTNKAAA

SEQ ID NO: 1475561 - protein, 20 aa, Mycobacterium tuberculosis
YLMQVLARFARYLRESRSID

SEQ ID NO: 1475562 - protein, 17 aa, Mycobacterium tuberculosis
YLNPFPANLGEVLRRYP

SEQ ID NO: 1475563 - protein, 17 aa, Mycobacterium tuberculosis
YMIAVPDMLSSAAGDLA

SEQ ID NO: 1475564 - protein, 40 aa, Mycobacterium tuberculosis; identical to SEQ ID NO: 160739

SEQ ID NO: 1475565 - protein, 18 aa, Mycobacterium tuberculosis
YPGQLAAHLGLTRSNVSN

SEQ ID NO: 1475566 - protein, 27 aa, Mycobacterium tuberculosis
YPLMSHLAARGWVCVSLNYRVSPRHTW

SEQ ID NO: 1475567 - protein, 19 aa, Mycobacterium tuberculosis
YPPGFPVLVPGQLVSKEII

SEQ ID NO: 1475568 - protein, 17 aa, Mycobacterium tuberculosis
YPPVRGVIHAAGVLDDA

SEQ ID NO: 1475569 - protein, 17 aa, Mycobacterium tuberculosis
YRAAEIGLLVLATSTGF

SEQ ID NO: 1475570 - protein, 17 aa, Mycobacterium tuberculosis
YRDFGFGSLRAVAPKNC

SEQ ID NO: 1475571 - protein, 30 aa, Mycobacterium tuberculosis
YRGYYGLSVAALMKWHLPRLEVLVDAGADM

SEQ ID NO: 1475572 - protein, 18 aa, Mycobacterium tuberculosis
YRITTARLAAATEERFSD

SEQ ID NO: 1475573 - protein, 20 aa, Mycobacterium tuberculosis
YRLTVEGVLPMPQSTHYPLA

SEQ ID NO: 1475574 - protein, 24 aa, Mycobacterium tuberculosis
YRRSRGLAGLSVAWGLWEQASAMT

SEQ ID NO: 1475575 - protein, 18 aa, Mycobacterium tuberculosis
YRRVDIARVPDCAVVGAA

SEQ ID NO: 1475576 - protein, 19 aa, Mycobacterium tuberculosis
YRYIDYWGTAVTAFDLHAP

SEQ ID NO: 1475577 - protein, 19 aa, Mycobacterium tuberculosis
YTITIERPAAFLNVDIPVN

SEQ ID NO: 1475578 - protein, 21 aa, Mycobacterium tuberculosis
YTLRLPLDVLVVASANPEDYT

SEQ ID NO: 1475579 - protein, 18 aa, Mycobacterium tuberculosis
YVPCEVCQGARYNRETLE

SEQ ID NO: 1475580 - protein, 17 aa, Mycobacterium tuberculosis
YVRAMRQKRSWRNTEPA

SEQ ID NO: 1475581 - protein, 24 aa, Mycobacterium tuberculosis
YVRSRLGSDFPRVRRLGTSGSHLY

SEQ ID NO: 1475582 - protein, 25 aa, Mycobacterium tuberculosis
YVVGALKLGLTAPFNIDEVPNVIRG

SEQ ID NO: 1475583 - protein, 17 aa, Mycobacterium tuberculosis
YWLAPSGFTRAPQNSVD

SEQ ID NO: 1475584 - protein, 26 aa, Mycobacterium tuberculosis
AAAASCGLGHRKGRIAPGYDADLLAV

SEQ ID NO: 1475585 - protein, 20 aa, Mycobacterium tuberculosis
AAAAVPYVAWMRATAASAEQ

SEQ ID NO: 1475586 - protein, 18 aa, Mycobacterium tuberculosis
AAADAARIGSAINTANTA

SEQ ID NO: 1475587 - protein, 21 aa, Mycobacterium tuberculosis
AAAEALAPFGSPLASLAAAAE

SEQ ID NO: 1475588 - protein, 25 aa, Mycobacterium tuberculosis
AAAELGERCAFGLQLIAPRLPPFDV

SEQ ID NO: 1475589 - protein, 27 aa, Mycobacterium tuberculosis
AAAHGGPHYLCLAIHAMVTDDSSRQIL

SEQ ID NO: 1475590 - protein, 19 aa, Mycobacterium tuberculosis
AAALWLVAPCTELYHDSRA

SEQ ID NO: 1475591 - protein, 20 aa, Mycobacterium tuberculosis
AAAPYAGWLAAAAARAAGAS

SEQ ID NO: 1475592 - protein, 21 aa, Mycobacterium tuberculosis
AAAPYAGWLAAAAARAAGASA

SEQ ID NO: 1475593 - protein, 17 aa, Mycobacterium tuberculosis
AAARAAIARGLDEDLRY

SEQ ID NO: 1475594 - protein, 18 aa, Mycobacterium tuberculosis
AAAWRRIRSQVRDWTDLE

SEQ ID NO: 1475595 - protein, 24 aa, Mycobacterium tuberculosis
AACWDARRWLGRPGLDDRASADLL

SEQ ID NO: 1475596 - protein, 24 aa, Mycobacterium tuberculosis
AADEVSAHIAALFSGHGEGYQAIA

SEQ ID NO: 1475597 - protein, 19 aa, Mycobacterium tuberculosis
AAEATRVGMPYVNQRWLGG

SEQ ID NO: 1475598 - protein, 19 aa, Mycobacterium tuberculosis
AAEGARPGWVGSSAGALSG

SEQ ID NO: 1475599 - protein, 17 aa, Mycobacterium tuberculosis
AAEMLKPCTLELGGKSA

SEQ ID NO: 1475600 - protein, 21 aa, Mycobacterium tuberculosis
AAERRRYVEVFAAGQGGGSKG

SEQ ID NO: 1475601 - protein, 18 aa, Mycobacterium tuberculosis
AAFHQQFVQTLAGGAGAY

SEQ ID NO: 1475602 - protein, 33 aa, Mycobacterium tuberculosis
AAGADEVSARIAALFGMYGLEYQAISAQVAAYH

SEQ ID NO: 1475603 - protein, 28 aa, Mycobacterium tuberculosis
AAGAGYADMTAIFLGSSGTPGEDGGNGG

SEQ ID NO: 1475604 - protein, 27 aa, Mycobacterium tuberculosis
AAGGAGGHGGWLWGNGGVGGSGGAGVG

SEQ ID NO: 1475605 - protein, 24 aa, Mycobacterium tuberculosis
AAGGAGGNAYLFGSGGAGGQGGMG

SEQ ID NO: 1475606 - protein, 19 aa, Mycobacterium tuberculosis
AAGGAGWSPDSDLKGFDGF

SEQ ID NO: 1475607 - protein, 23 aa, Mycobacterium tuberculosis
AAGGLGGNGGWLYGNGGAGGIGG

SEQ ID NO: 1475608 - protein, 21 aa, Mycobacterium tuberculosis
AAGVRRLVLASSMVVYGQGRY

SEQ ID NO: 1475609 - protein, 17 aa, Mycobacterium tuberculosis
AAIAIGNPDTAKHTAVI

SEQ ID NO: 1475610 - protein, 20 aa, Mycobacterium tuberculosis
AAILSARFGPSVLYGVPNFF

SEQ ID NO: 1475611 - protein, 26 aa, Mycobacterium tuberculosis
AALATLSAVAGRPAGAAGASGAAGAA

SEQ ID NO: 1475612 - protein, 19 aa, Mycobacterium tuberculosis
AALDYSALYPAGRLVDAPL

SEQ ID NO: 1475613 - protein, 30 aa, Mycobacterium tuberculosis
AALPSWQQALRGLPGLGQVASAISGGAASM

SEQ ID NO: 1475614 - protein, 17 aa, Mycobacterium tuberculosis
AALRVARDIAAKDTRVI

SEQ ID NO: 1475615 - protein, 17 aa, Mycobacterium tuberculosis
AALYKKAFAPLNELAGS

SEQ ID NO: 1475616 - protein, 24 aa, Mycobacterium tuberculosis
AANRARLTSLVTHNVFGQNTASIA

SEQ ID NO: 1475617 - protein, 26 aa, Mycobacterium tuberculosis
AANSWLDAFAHWRRAQGLPATSIAWG

SEQ ID NO: 1475618 - protein, 27 aa, Mycobacterium tuberculosis
AAPRKIPPGTGWRKFVYSVSFHKINPG

SEQ ID NO: 1475619 - protein, 18 aa, Mycobacterium tuberculosis
AAQFGWQGASAMALNAKM

SEQ ID NO: 1475620 - protein, 23 aa, Mycobacterium tuberculosis
AARAGKMTNWAIARPPGQTQALR

SEQ ID NO: 1475621 - protein, 17 aa, Mycobacterium tuberculosis
AARGRMGAVRFGIYQAG

SEQ ID NO: 1475622 - protein, 17 aa, Mycobacterium tuberculosis
AARLTGWRIDIRGDAPP

SEQ ID NO: 1475623 - protein, 17 aa, Mycobacterium tuberculosis
AASAYFAGGLSLRDATR

SEQ ID NO: 1475624 - protein, 24 aa, Mycobacterium tuberculosis
AASDVARIGSSIGVANSAAAGSTT

SEQ ID NO: 1475625 - protein, 21 aa, Mycobacterium tuberculosis
AASGFSRFPVVEGDLDATVGI

SEQ ID NO: 1475626 - protein, 20 aa, Mycobacterium tuberculosis
AASNTHRWFGAYGVTKSAVD

SEQ ID NO: 1475627 - protein, 20 aa, Mycobacterium tuberculosis
AASPAGWLFVSRWTAGGNSL

SEQ ID NO: 1475628 - protein, 26 aa, Mycobacterium tuberculosis
AASPRTAVDFAVPFSPRMSAPPISGR

SEQ ID NO: 1475629 - protein, 22 aa, Mycobacterium tuberculosis
AASVCPTGSAAPMARKESTGDR

SEQ ID NO: 1475630 - protein, 25 aa, Mycobacterium tuberculosis
AATAWGELAEELLASIASLGSVTSE

SEQ ID NO: 1475631 - protein, 19 aa, Mycobacterium tuberculosis
AATGRPLIGNGANGAPGTG

SEQ ID NO: 1475632 - protein, 20 aa, Mycobacterium tuberculosis
AATQDPRAWAALPRAGAVIF

SEQ ID NO: 1475633 - protein, 26 aa, Mycobacterium tuberculosis
AATSPLLAPINEFFLANTGRPLIGNG

SEQ ID NO: 1475634 - protein, 27 aa, Mycobacterium tuberculosis
AATSPLLAPINEFFLANTGRPLIGNGT

SEQ ID NO: 1475635 - protein, 17 aa, Mycobacterium tuberculosis
AAVAALFGAHGQTYQVL

SEQ ID NO: 1475636 - protein, 17 aa, Mycobacterium tuberculosis
AAVAALFGSYAQSYQAF

SEQ ID NO: 1475637 - protein, 17 aa, Mycobacterium tuberculosis
AAVATDLAGIGSTIGTA

SEQ ID NO: 1475638 - protein, 18 aa, Mycobacterium tuberculosis
AAVPSRVSASSWYVDAGT

SEQ ID NO: 1475639 - protein, 18 aa, Mycobacterium tuberculosis
AAYEKAYHAEPFIYLMPE

SEQ ID NO: 1475640 - protein, 20 aa, Mycobacterium tuberculosis
AAYGVRPGAVIGHSMGESAA

SEQ ID NO: 1475641 - protein, 21 aa, Mycobacterium tuberculosis
AAYQQRFVLALSQAGSTYAVA

SEQ ID NO: 1475642 - protein, 24 aa, Mycobacterium tuberculosis
ACAEAFAEFVDWSLVDVLRGAPGA

SEQ ID NO: 1475643 - protein, 26 aa, Mycobacterium tuberculosis
ACFRCPQCTERLRASDDLLLVGGMRV

SEQ ID NO: 1475644 - protein, 20 aa, Mycobacterium tuberculosis
ACQGFITQLGRNFQVIYEQA

SEQ ID NO: 1475645 - protein, 17 aa, Mycobacterium tuberculosis
ADALMLLYLLSSDELIG

SEQ ID NO: 1475646 - protein, 17 aa, Mycobacterium tuberculosis
ADAPPFFVLHGRHDSLI

SEQ ID NO: 1475647 - protein, 17 aa, Mycobacterium tuberculosis
ADCALFVIAANEGVDEP

SEQ ID NO: 1475648 - protein, 24 aa, Mycobacterium tuberculosis
ADCAQLRAAASVLMEALRMERSQV

SEQ ID NO: 1475649 - protein, 24 aa, Mycobacterium tuberculosis
ADDRYAFSFSGLKTAVARYVESHA

SEQ ID NO: 1475650 - protein, 17 aa, Mycobacterium tuberculosis
ADEGRNDIRIEAALAKL

SEQ ID NO: 1475651 - protein, 23 aa, Mycobacterium tuberculosis
ADEISAAIAALFGAHGRAYQAAS

SEQ ID NO: 1475652 - protein, 23 aa, Mycobacterium tuberculosis
ADEVSAAIAALFSGHAQAYQALS

SEQ ID NO: 1475653 - protein, 24 aa, Mycobacterium tuberculosis
ADEVSAAIASLFAAHGQAYQAVSA

SEQ ID NO: 1475654 - protein, 24 aa, Mycobacterium tuberculosis
ADEVSAALAALFGAHAREYQAAAA

SEQ ID NO: 1475655 - protein, 22 aa, Mycobacterium tuberculosis
ADEVSAAMAALFSGHAQAYQAL

SEQ ID NO: 1475656 - protein, 23 aa, Mycobacterium tuberculosis
ADEVSAAMAALFSGHAQAYQALS

SEQ ID NO: 1475657 - protein, 24 aa, Mycobacterium tuberculosis
ADEVSAAVAALFSGHAQTYQALST

SEQ ID NO: 1475658 - protein, 31 aa, Mycobacterium tuberculosis
ADEVSAAVSRLFGAYGQQFQALNARAATFHA

SEQ ID NO: 1475659 - protein, 29 aa, Mycobacterium tuberculosis
ADEVSQAIARLFSDYATHYQSLNAQAAAF

SEQ ID NO: 1475660 - protein, 24 aa, Mycobacterium tuberculosis
ADEVSTQIAALFGAHARSYQTLST

SEQ ID NO: 1475661 - protein, 19 aa, Mycobacterium tuberculosis
ADGHKWAMLTAYDYSTARI

SEQ ID NO: 1475662 - protein, 17 aa, Mycobacterium tuberculosis
ADGYIDVKGLRLTLTQA

SEQ ID NO: 1475663 - protein, 17 aa, Mycobacterium tuberculosis
ADHVVNGVVLFPGAGFV

SEQ ID NO: 1475664 - protein, 21 aa, Mycobacterium tuberculosis
ADIAMAFERYRIVTGDGSLEE

SEQ ID NO: 1475665 - protein, 17 aa, Mycobacterium tuberculosis
ADLMARLQVESTGGGRR

SEQ ID NO: 1475666 - protein, 30 aa, Mycobacterium tuberculosis
ADLPKLGERLNLPAGWSYHTRVLTSELRVD

SEQ ID NO: 1475667 - protein, 20 aa, Mycobacterium tuberculosis
ADLPRLIRLLATRSASELNL

SEQ ID NO: 1475668 - protein, 18 aa, Mycobacterium tuberculosis
ADLRAIRAHQDCMEARTD

SEQ ID NO: 1475669 - protein, 18 aa, Mycobacterium tuberculosis
ADLYGRRSRDRFFTALWG

SEQ ID NO: 1475670 - protein, 17 aa, Mycobacterium tuberculosis
ADMGGSFIGPTQDAVLA

SEQ ID NO: 1475671 - protein, 20 aa, Mycobacterium tuberculosis
ADNTANMTAQAGGDGGNGGD

SEQ ID NO: 1475672 - protein, 29 aa, Mycobacterium tuberculosis
ADPATISAFVVRISCHLRIQNQAADNDVK

SEQ ID NO: 1475673 - protein, 23 aa, Mycobacterium tuberculosis
ADPELKSTGFARDLADYIQEQGW

SEQ ID NO: 1475674 - protein, 25 aa, Mycobacterium tuberculosis
ADQRTRVFFCNSGAEANEAAFKLSR

SEQ ID NO: 1475675 - protein, 25 aa, Mycobacterium tuberculosis
ADRGRTGVFSLDARQWFQSFPAVAG

SEQ ID NO: 1475676 - protein, 24 aa, Mycobacterium tuberculosis
ADRIVLCAGAIQSAHLLMLSGVGE

SEQ ID NO: 1475677 - protein, 20 aa, Mycobacterium tuberculosis
ADRYRRLHVIIGDANLAETS

SEQ ID NO: 1475678 - protein, 19 aa, Mycobacterium tuberculosis
ADVVARFLPYFTDVIVGDL

SEQ ID NO: 1475679 - protein, 22 aa, Mycobacterium tuberculosis
AEAEGLQVLGWRSVPTDDSSLG

SEQ ID NO: 1475680 - protein, 18 aa, Mycobacterium tuberculosis
AEALAPFGSPLASLAAAA

SEQ ID NO: 1475681 - protein, 20 aa, Mycobacterium tuberculosis
AEAQVEQQLLAAINAPTQAL

SEQ ID NO: 1475682 - protein, 17 aa, Mycobacterium tuberculosis
AEAVARFLSWVYATNPP

SEQ ID NO: 1475683 - protein, 18 aa, Mycobacterium tuberculosis
AEGRDAGWCPCTCPGGDP

SEQ ID NO: 1475684 - protein, 24 aa, Mycobacterium tuberculosis
AELAAAGLHRIRWWTDEAGDFGLS

SEQ ID NO: 1475685 - protein, 24 aa, Mycobacterium tuberculosis
AELAAQGWGGRWLVVGADVDPGRL

SEQ ID NO: 1475686 - protein, 19 aa, Mycobacterium tuberculosis
AELAEAFHAAGRCTVEANA

SEQ ID NO: 1475687 - protein, 20 aa, Mycobacterium tuberculosis
AELAEAFHAAGRYTAEANAA

SEQ ID NO: 1475688 - protein, 20 aa, Mycobacterium tuberculosis
AELFWALRGGGGGNFGVTTS

SEQ ID NO: 1475689 - protein, 30 aa, Mycobacterium tuberculosis
AELGANHALHGVLMATNFFGINTIPIALNE

SEQ ID NO: 1475690 - protein, 22 aa, Mycobacterium tuberculosis
AELGLRVCDWVDGDDPYGLVSA

SEQ ID NO: 1475691 - protein, 19 aa, Mycobacterium tuberculosis
AELGRMYVHHGVVVVEQKI

SEQ ID NO: 1475692 - protein, 19 aa, Mycobacterium tuberculosis
AELGVALRAAIAGPVAGLA

SEQ ID NO: 1475693 - protein, 18 aa, Mycobacterium tuberculosis
AELHRRASAWFAENGYLH

SEQ ID NO: 1475694 - protein, 27 aa, Mycobacterium tuberculosis
AELLADCARLLLQIPAVLGLAFDGGWW

SEQ ID NO: 1475695 - protein, 19 aa, Mycobacterium tuberculosis
AELLGWRASVHTDELARIM

SEQ ID NO: 1475696 - protein, 18 aa, Mycobacterium tuberculosis
AELRHRLESKIVMTRLAD

SEQ ID NO: 1475697 - protein, 19 aa, Mycobacterium tuberculosis
AELRRGRRYSVARRLAGLF

SEQ ID NO: 1475698 - protein, 20 aa, Mycobacterium tuberculosis
AELTIPLILLGGITNRTTMD

SEQ ID NO: 1475699 - protein, 25 aa, Mycobacterium tuberculosis
AEPEDFVGALIYLLSDASSFYTGQV

SEQ ID NO: 1475700 - protein, 20 aa, Mycobacterium tuberculosis
AEPKRYVVVPGVGHNDPELL

SEQ ID NO: 1475701 - protein, 18 aa, Mycobacterium tuberculosis
AEQALALFGTCPVVEQAL

SEQ ID NO: 1475702 - protein, 27 aa, Mycobacterium tuberculosis
AERLRAGGMGIPAFYTPAGVGTQVADG

SEQ ID NO: 1475703 - protein, 18 aa, Mycobacterium tuberculosis
AETLRARGLWYIDGAGNA

SEQ ID NO: 1475704 - protein, 28 aa, Mycobacterium tuberculosis
AEYWHRRIREELKFSGDRAMAAEDPEAK

SEQ ID NO: 1475705 - protein, 26 aa, Mycobacterium tuberculosis
AFARLNRRLCGGWYGGLFQDQMRVGA

SEQ ID NO: 1475706 - protein, 32 aa, Mycobacterium tuberculosis
AFCSAHPLAKVQVCSRLAATELYRRLREFELN

SEQ ID NO: 1475707 - protein, 25 aa, Mycobacterium tuberculosis
AFHPDRFGFAGSMSGFLYPSNTTTN

SEQ ID NO: 1475708 - protein, 18 aa, Mycobacterium tuberculosis
AFLGERIGVRRGVVVDAD

SEQ ID NO: 1475709 - protein, 28 aa, Mycobacterium tuberculosis
AFLRAGDAIACALELQLSTLAPMRPRVG

SEQ ID NO: 1475710 - protein, 18 aa, Mycobacterium tuberculosis
AFPKPVLVSPELKKPKLL

SEQ ID NO: 1475711 - protein, 19 aa, Mycobacterium tuberculosis
AFPKQIWRQIWSNNPQERL

SEQ ID NO: 1475712 - protein, 25 aa, Mycobacterium tuberculosis
AFPSLSSSVPILGPYEDLIANTVAN

SEQ ID NO: 1475713 - protein, 20 aa, Mycobacterium tuberculosis
AFQSVVWGLTTGSWIGSSAG

SEQ ID NO: 1475714 - protein, 18 aa, Mycobacterium tuberculosis
AFRPGALPELQNWARTVE

SEQ ID NO: 1475715 - protein, 24 aa, Mycobacterium tuberculosis
AFTAFPKAHWQKIWSTNPLERINK

SEQ ID NO: 1475716 - protein, 24 aa, Mycobacterium tuberculosis
AGAARRCPDRPGLIDELGTLTWRQ

SEQ ID NO: 1475717 - protein, 26 aa, Mycobacterium tuberculosis
AGAGYADMTAIFLGSSGTPGEDGGNG

SEQ ID NO: 1475718 - protein, 17 aa, Mycobacterium tuberculosis
AGALLAWVSKVDAWFNG

SEQ ID NO: 1475719 - protein, 22 aa, Mycobacterium tuberculosis
AGAPEVSGWLDGLRAAKRALVV

SEQ ID NO: 1475720 - protein, 18 aa, Mycobacterium tuberculosis
AGCCDLAFAAPEAARTLK

SEQ ID NO: 1475721 - protein, 25 aa, Mycobacterium tuberculosis
AGDEVSAAIAALFSSHGQQYQAMSA

SEQ ID NO: 1475722 - protein, 23 aa, Mycobacterium tuberculosis
AGDGNVHMAIACKDPEKKKKLMT

SEQ ID NO: 1475723 - protein, 27 aa, Mycobacterium tuberculosis
AGEPGRWSADRAHRWYQAHGWLVGANY

SEQ ID NO: 1475724 - protein, 35 aa, Mycobacterium tuberculosis; identical to SEQ ID NO: 209058

SEQ ID NO: 1475725 - protein, 25 aa, Mycobacterium tuberculosis
AGGAGGHGGWLWGNGGVGGSGGAGV

SEQ ID NO: 1475726 - protein, 23 aa, Mycobacterium tuberculosis
AGGAGGSAMLFGAGGAGGAGGAA

SEQ ID NO: 1475727 - protein, 24 aa, Mycobacterium tuberculosis
AGGDGIGGVGGGKGGNGADGEVGG

SEQ ID NO: 1475728 - protein, 17 aa, Mycobacterium tuberculosis
AGGKAGLIGNGGNGGAG

SEQ ID NO: 1475729 - protein, 19 aa, Mycobacterium tuberculosis
AGGKARPDIGPLFYEPTVL

SEQ ID NO: 1475730 - protein, 19 aa, Mycobacterium tuberculosis
AGGNAGWFGHGGAGGVGGV

SEQ ID NO: 1475731 - protein, 24 aa, Mycobacterium tuberculosis
AGGNGGAGGMLLGDGGAGGQGGPA

SEQ ID NO: 1475732 - protein, 30 aa, Mycobacterium tuberculosis
AGGNGSKGLPGLGRLGNPGLDGGTGGNGGA

SEQ ID NO: 1475733 - protein, 19 aa, Mycobacterium tuberculosis
AGGSAMLFGAGGAGGAGGA

SEQ ID NO: 1475734 - protein, 26 aa, Mycobacterium tuberculosis
AGGSGGRGGLLVGDGGAGGIGGTGGE

SEQ ID NO: 1475735 - protein, 23 aa, Mycobacterium tuberculosis
AGGTGGNAAWLLGGGGTGGAGGI

SEQ ID NO: 1475736 - protein, 21 aa, Mycobacterium tuberculosis
AGGTLFNFGFANDGTLNLGNA

SEQ ID NO: 1475737 - protein, 19 aa, Mycobacterium tuberculosis
AGGVAGLFGDGGNGGNAGV

SEQ ID NO: 1475738 - protein, 17 aa, Mycobacterium tuberculosis
AGHLGFAGTARREAVAD

SEQ ID NO: 1475739 - protein, 22 aa, Mycobacterium tuberculosis
AGHPFAATGGRILAQTAKQLAE

SEQ ID NO: 1475740 - protein, 21 aa, Mycobacterium tuberculosis
AGIPPGTLRRSATGVFAGACL

SEQ ID NO: 1475741 - protein, 19 aa, Mycobacterium tuberculosis
AGLAVGFWAAPSDLRANWR

SEQ ID NO: 1475742 - protein, 22 aa, Mycobacterium tuberculosis
AGLDGYSAADCVALLREAALTA

SEQ ID NO: 1475743 - protein, 27 aa, Mycobacterium tuberculosis
AGLDPRYPLKGVFHAAGVLDDAVITGL

SEQ ID NO: 1475744 - protein, 18 aa, Mycobacterium tuberculosis
AGLIDRIARDEVRHEEFF

SEQ ID NO: 1475745 - protein, 28 aa, Mycobacterium tuberculosis
AGLKTSRDAWCYNFSRGALEANIGRTID

SEQ ID NO: 1475746 - protein, 31 aa, Mycobacterium tuberculosis
AGLPGNPGAVPGRAGGAGGLGGSGSDTSEGP

SEQ ID NO: 1475747 - protein, 20 aa, Mycobacterium tuberculosis
AGLRLKKLGTDRSWRPDVVH

SEQ ID NO: 1475748 - protein, 18 aa, Mycobacterium tuberculosis
AGLSRASSIGALSVPPSW

SEQ ID NO: 1475749 - protein, 18 aa, Mycobacterium tuberculosis
AGLVCGGVHTANATVYMI

SEQ ID NO: 1475750 - protein, 28 aa, Mycobacterium tuberculosis
AGNYSNGVLWRGDYQGLIGADIALEIPA

SEQ ID NO: 1475751 - protein, 27 aa, Mycobacterium tuberculosis
AGPAMLPGFNSGFANIGSFNAGIANSG

SEQ ID NO: 1475752 - protein, 19 aa, Mycobacterium tuberculosis
AGPEPMAAAATAWDGLAME

SEQ ID NO: 1475753 - protein, 21 aa, Mycobacterium tuberculosis
AGPIWPLDTCLFVRDFKGNDP

SEQ ID NO: 1475754 - protein, 17 aa, Mycobacterium tuberculosis
AGQACLAHALAHRGDTE

SEQ ID NO: 1475755 - protein, 20 aa, Mycobacterium tuberculosis
AGQFCLANTIAVAPAATNLL

SEQ ID NO: 1475756 - protein, 26 aa, Mycobacterium tuberculosis
AGQPGRWGRTAVCARLSSADQKVDLD

SEQ ID NO: 1475757 - protein, 23 aa, Mycobacterium tuberculosis
AGRVAGLIGTIGIRVGGADLPSA

SEQ ID NO: 1475758 - protein, 20 aa, Mycobacterium tuberculosis
AGRYGDGWIAQARDINDAKL

SEQ ID NO: 1475759 - protein, 24 aa, Mycobacterium tuberculosis
AGSAARTPLMAQLLEGASAPMAST

SEQ ID NO: 1475760 - protein, 24 aa, Mycobacterium tuberculosis
AGSAARTPLMAQLLEGASSPMAST

SEQ ID NO: 1475761 - protein, 25 aa, Mycobacterium tuberculosis
AGSAPMLAASVAWDGLAAELAVAAS

SEQ ID NO: 1475762 - protein, 22 aa, Mycobacterium tuberculosis
AGSIDRLAVWNMVATVDAFLSS

SEQ ID NO: 1475763 - protein, 21 aa, Mycobacterium tuberculosis
AGSIGPMSVPPSWATPSSTPV

SEQ ID NO: 1475764 - protein, 23 aa, Mycobacterium tuberculosis
AGSIRIPAAWTHLVGIKPQRGRI

SEQ ID NO: 1475765 - protein, 20 aa, Mycobacterium tuberculosis
AGSLLRDYGLLLPLEPDTRL

SEQ ID NO: 1475766 - protein, 31 aa, Mycobacterium tuberculosis
AGTSISGFFNFGSLMSGFANFDDEVSGYLNG

SEQ ID NO: 1475767 - protein, 18 aa, Mycobacterium tuberculosis
AGVDGARIGDAGVGVAGV

SEQ ID NO: 1475768 - protein, 18 aa, Mycobacterium tuberculosis
AGVPVVFLTAYYALRVLA

SEQ ID NO: 1475769 - protein, 22 aa, Mycobacterium tuberculosis
AHRPLELCRVDLLALASDAAHD

SEQ ID NO: 1475770 - protein, 17 aa, Mycobacterium tuberculosis
AHWTRLYPEVRVDRAIA

SEQ ID NO: 1475771 - protein, 23 aa, Mycobacterium tuberculosis
AIFDRGKALALYHTKRLASPAQR

SEQ ID NO: 1475772 - protein, 19 aa, Mycobacterium tuberculosis
AIHRAWRPTASSDLSVLVR

SEQ ID NO: 1475773 - protein, 23 aa, Mycobacterium tuberculosis
AIIDSLLRSCPRLTILTTSTEAI

SEQ ID NO: 1475774 - protein, 20 aa, Mycobacterium tuberculosis
AIPARWTLDNGATFRGVDPG

SEQ ID NO: 1475775 - protein, 26 aa, Mycobacterium tuberculosis
AIPPDGPWGIWASRRIIAGLMGTFGP

SEQ ID NO: 1475776 - protein, 18 aa, Mycobacterium tuberculosis
AIRAWAYQIADLAGDYRV

SEQ ID NO: 1475777 - protein, 19 aa, Mycobacterium tuberculosis
AISHASRRRAQRRLPDTPV

SEQ ID NO: 1475778 - protein, 18 aa, Mycobacterium tuberculosis
AISKGQRGGNLWLSEVFG

SEQ ID NO: 1475779 - protein, 17 aa, Mycobacterium tuberculosis
AITWPEIAASADGSVYV

SEQ ID NO: 1475780 - protein, 29 aa, Mycobacterium tuberculosis
AIVIGCGPIGLAVICMLKSRGVHTVIASD

SEQ ID NO: 1475781 - protein, 18 aa, Mycobacterium tuberculosis
AIYEAWASQSYERGPLGL

SEQ ID NO: 1475782 - protein, 23 aa, Mycobacterium tuberculosis
AKAAELRYGRIPEVEKKLDAALP

SEQ ID NO: 1475783 - protein, 17 aa, Mycobacterium tuberculosis
AKEALNFIDVQRVNASY

SEQ ID NO: 1475784 - protein, 18 aa, Mycobacterium tuberculosis
AKEAPDRVWELETYGALF

SEQ ID NO: 1475785 - protein, 20 aa, Mycobacterium tuberculosis
AKEVISIAGRNIFPTEVELV

SEQ ID NO: 1475786 - protein, 23 aa, Mycobacterium tuberculosis
AKGLEFPVVFVTGWEDGMFPHMR

SEQ ID NO: 1475787 - protein, 18 aa, Mycobacterium tuberculosis
AKLFDEWFPANKLVKLGL

SEQ ID NO: 1475788 - protein, 24 aa, Mycobacterium tuberculosis
AKRAFSEPVALNWAADGTDVDFGA

SEQ ID NO: 1475789 - protein, 17 aa, Mycobacterium tuberculosis
ALAARYGGRLVTFDAAL

SEQ ID NO: 1475790 - protein, 19 aa, Mycobacterium tuberculosis
ALAGKSGFGGFGGLLLGAD

SEQ ID NO: 1475791 - protein, 18 aa, Mycobacterium tuberculosis
ALAKLWAQSCEWEPVTPK

SEQ ID NO: 1475792 - protein, 18 aa, Mycobacterium tuberculosis
ALASLPSGGFVPAGTTIS

SEQ ID NO: 1475793 - protein, 17 aa, Mycobacterium tuberculosis
ALAYGIVVAGQLAGLPV

SEQ ID NO: 1475794 - protein, 21 aa, Mycobacterium tuberculosis
ALCVGMCGQLIYVNRAAEVVA

SEQ ID NO: 1475795 - protein, 21 aa, Mycobacterium tuberculosis
ALDMAYKLVAYDGSGRTKFSS

SEQ ID NO: 1475796 - protein, 37 aa, Mycobacterium tuberculosis
ALEASNGIQCFLRDLPATWPPFIRPGVVTTHLQSQWS

SEQ ID NO: 1475797 - protein, 19 aa, Mycobacterium tuberculosis
ALEPLEVTSRWIAGENPET

SEQ ID NO: 1475798 - protein, 20 aa, Mycobacterium tuberculosis
ALERTFPLALSALIQEAIAA

SEQ ID NO: 1475799 - protein, 20 aa, Mycobacterium tuberculosis
ALEVLQSWLGADRAATLVVL

SEQ ID NO: 1475800 - protein, 18 aa, Mycobacterium tuberculosis
ALGAACWDARRWLGRPGL

SEQ ID NO: 1475801 - protein, 24 aa, Mycobacterium tuberculosis
ALGEGCCFRVSLPRVSDVDQLSLT

SEQ ID NO: 1475802 - protein, 23 aa, Mycobacterium tuberculosis
ALGRGDEALQWFLRSAAADIDGV

SEQ ID NO: 1475803 - protein, 17 aa, Mycobacterium tuberculosis
ALGRPNLTLLARMRAVR

SEQ ID NO: 1475804 - protein, 17 aa, Mycobacterium tuberculosis
ALIDRRGYVLIVSSLAA

SEQ ID NO: 1475805 - protein, 18 aa, Mycobacterium tuberculosis
ALINRYATMCGMTGTALA

SEQ ID NO: 1475806 - protein, 18 aa, Mycobacterium tuberculosis
ALLGRPLIGNGANGADGT

SEQ ID NO: 1475807 - protein, 22 aa, Mycobacterium tuberculosis
ALLPHWRERRFGHVVNVSSAGV

SEQ ID NO: 1475808 - protein, 23 aa, Mycobacterium tuberculosis
ALLYVVVLHRFLRWRQRDYAPAR

SEQ ID NO: 1475809 - protein, 31 aa, Mycobacterium tuberculosis
ALMERLYKTSWRFAPFLWQEIEEGILPALYA

SEQ ID NO: 1475810 - protein, 17 aa, Mycobacterium tuberculosis
ALNTGLGNIGSWNLGGG

SEQ ID NO: 1475811 - protein, 18 aa, Mycobacterium tuberculosis
ALNTGLGNIGSWNLGGGN

SEQ ID NO: 1475812 - protein, 18 aa, Mycobacterium tuberculosis
ALPLTSLTSAAERGPGQM

SEQ ID NO: 1475813 - protein, 24 aa, Mycobacterium tuberculosis
ALPPCPPEPAGTVPPPTVRSPPVP

SEQ ID NO: 1475814 - protein, 23 aa, Mycobacterium tuberculosis
ALPSRPVQVIGFTSVPGAGDNFL

SEQ ID NO: 1475815 - protein, 19 aa, Mycobacterium tuberculosis
ALPVCRRPGAKTVTALGGG

SEQ ID NO: 1475816 - protein, 24 aa, Mycobacterium tuberculosis
ALPVPEWIEGDIFRIYFSGRDGQN

SEQ ID NO: 1475817 - protein, 22 aa, Mycobacterium tuberculosis
ALRIVLGHELFHYAARADTALD

SEQ ID NO: 1475818 - protein, 18 aa, Mycobacterium tuberculosis
ALRPPRCRFQSAGRQDRA

SEQ ID NO: 1475819 - protein, 24 aa, Mycobacterium tuberculosis
ALRQTAARLADWVDAQGPELAPAD

SEQ ID NO: 1475820 - protein, 17 aa, Mycobacterium tuberculosis
ALSESKIAATAHILDTE

SEQ ID NO: 1475821 - protein, 19 aa, Mycobacterium tuberculosis
ALSTRLEVEIKRDGYEWSQ

SEQ ID NO: 1475822 - protein, 34 aa, Mycobacterium tuberculosis; identical to SEQ ID NO: 210543

SEQ ID NO: 1475823 - protein, 19 aa, Mycobacterium tuberculosis
ALTDATRDFAIGLAGIPPS

SEQ ID NO: 1475824 - protein, 20 aa, Mycobacterium tuberculosis
ALTGGMCWEALNNIAASRRP

SEQ ID NO: 1475825 - protein, 17 aa, Mycobacterium tuberculosis
ALTRPRHPDYWTEIDSA

SEQ ID NO: 1475826 - protein, 28 aa, Mycobacterium tuberculosis
ALVAANRSGLISLVISNLFGQNAPAIAA

SEQ ID NO: 1475827 - protein, 17 aa, Mycobacterium tuberculosis
ALVGALSVPHSWTTAAP

SEQ ID NO: 1475828 - protein, 18 aa, Mycobacterium tuberculosis
ALYELGMTGIPIVNVNNN

SEQ ID NO: 1475829 - protein, 23 aa, Mycobacterium tuberculosis
AMDPKRRITLEVLDGPGTPEVLG

SEQ ID NO: 1475830 - protein, 19 aa, Mycobacterium tuberculosis
AMHTEMWLHPATVDNVATL

SEQ ID NO: 1475831 - protein, 21 aa, Mycobacterium tuberculosis
AMLRRLMMDDSFFRGELIYVF

SEQ ID NO: 1475832 - protein, 26 aa, Mycobacterium tuberculosis
AMNFFPARLTAIGLTLPFGEVTLAPE

SEQ ID NO: 1475833 - protein, 17 aa, Mycobacterium tuberculosis
AMTIWRVPSKVTSGPVS

SEQ ID NO: 1475834 - protein, 18 aa, Mycobacterium tuberculosis
AMVGCPIVGINDSGGARI

SEQ ID NO: 1475835 - protein, 29 aa, Mycobacterium tuberculosis
ANDGKLKYCYNLGGIKHFYAESADPLPAG

SEQ ID NO: 1475836 - protein, 22 aa, Mycobacterium tuberculosis
ANEPKHPAARPKHVALQQLTGA

SEQ ID NO: 1475837 - protein, 17 aa, Mycobacterium tuberculosis
ANLFELENFVAREVDVA

SEQ ID NO: 1475838 - protein, 19 aa, Mycobacterium tuberculosis
ANLLGQMALGSMTGGALGA

SEQ ID NO: 1475839 - protein, 17 aa, Mycobacterium tuberculosis
ANPAALVQALFNLGEMV

SEQ ID NO: 1475840 - protein, 18 aa, Mycobacterium tuberculosis
ANYHLAWAIAAISTRRSR

SEQ ID NO: 1475841 - protein, 18 aa, Mycobacterium tuberculosis
APAAEWFGERGWTAVATL

SEQ ID NO: 1475842 - protein, 23 aa, Mycobacterium tuberculosis
APAQALFGRPLIGNGANGTAASP

SEQ ID NO: 1475843 - protein, 29 aa, Mycobacterium tuberculosis
APARPARTADPWLAPIFARSTLRHSHHLG

SEQ ID NO: 1475844 - protein, 20 aa, Mycobacterium tuberculosis
APDHVRCLLVLDDFRDLMTA

SEQ ID NO: 1475845 - protein, 17 aa, Mycobacterium tuberculosis
APDRRKVLEEAFRVLRP

SEQ ID NO: 1475846 - protein, 32 aa, Mycobacterium tuberculosis
APEIPYYSATLWDPRERPSFTGEYWVENLRYT

SEQ ID NO: 1475847 - protein, 17 aa, Mycobacterium tuberculosis
APGCGQPGGSIQVRIFD

SEQ ID NO: 1475848 - protein, 28 aa, Mycobacterium tuberculosis
APGGNGGNAGWLYGRGGVGGAGGIGGGT

SEQ ID NO: 1475849 - protein, 19 aa, Mycobacterium tuberculosis
APGGVAYACSFRITEAVYF

SEQ ID NO: 1475850 - protein, 17 aa, Mycobacterium tuberculosis
APGPARCCVVLKRCSAH

SEQ ID NO: 1475851 - protein, 24 aa, Mycobacterium tuberculosis
APGQPGGAGGLLFGNGGNGAAGAV

SEQ ID NO: 1475852 - protein, 24 aa, Mycobacterium tuberculosis
APGRAIPFGAFRHLISLPASGADI

SEQ ID NO: 1475853 - protein, 20 aa, Mycobacterium tuberculosis
APHHRWPRHILDVKTAIAWA

SEQ ID NO: 1475854 - protein, 23 aa, Mycobacterium tuberculosis
APHIDRIQPWVGLHVGHKSTRLR

SEQ ID NO: 1475855 - protein, 17 aa, Mycobacterium tuberculosis
APLADVHKLAFVSAKGG

SEQ ID NO: 1475856 - protein, 19 aa, Mycobacterium tuberculosis
APLNWCNPSGRALGAPPTT

SEQ ID NO: 1475857 - protein, 27 aa, Mycobacterium tuberculosis
APLVPLPISGRPVFARKNSLIGSSSGD

SEQ ID NO: 1475858 - protein, 19 aa, Mycobacterium tuberculosis
APMRPRVGVHTGDVRLRGD

SEQ ID NO: 1475859 - protein, 22 aa, Mycobacterium tuberculosis
APPRLVGQVIDALRGYASITVV

SEQ ID NO: 1475860 - protein, 17 aa, Mycobacterium tuberculosis
APQHWIALTPPRIPRVR

SEQ ID NO: 1475861 - protein, 21 aa, Mycobacterium tuberculosis
APRKPIPLLMWPDRIKGRIRR

SEQ ID NO: 1475862 - protein, 19 aa, Mycobacterium tuberculosis
APRPAPFRLRVVKRHTLGY

SEQ ID NO: 1475863 - protein, 23 aa, Mycobacterium tuberculosis
APSDAGFHVGERVSAFGVLGGYA

SEQ ID NO: 1475864 - protein, 24 aa, Mycobacterium tuberculosis
APSEILPFTVLLSSLGVTHLTPEI

SEQ ID NO: 1475865 - protein, 23 aa, Mycobacterium tuberculosis
APVARRLRESFGGSKPAPAKGTA

SEQ ID NO: 1475866 - protein, 17 aa, Mycobacterium tuberculosis
APVDRHVIPQGLASRNS

SEQ ID NO: 1475867 - protein, 17 aa, Mycobacterium tuberculosis
APVVRKLAKELAVDLAA

SEQ ID NO: 1475868 - protein, 19 aa, Mycobacterium tuberculosis
APYLGWLSAAAAQAQQAAT

SEQ ID NO: 1475869 - protein, 17 aa, Mycobacterium tuberculosis
AQARKAVGTGVRKKTPE

SEQ ID NO: 1475870 - protein, 24 aa, Mycobacterium tuberculosis
AQIRPGQYVRLHWARPRSRLPGQG

SEQ ID NO: 1475871 - protein, 21 aa, Mycobacterium tuberculosis
AQKYPAILAMTSLNDTRVYYV

SEQ ID NO: 1475872 - protein, 17 aa, Mycobacterium tuberculosis
AQLPSLLAEKVRAPSVM

SEQ ID NO: 1475873 - protein, 22 aa, Mycobacterium tuberculosis
AQTRISGVLIDLRPYRPPDAAR

SEQ ID NO: 1475874 - protein, 18 aa, Mycobacterium tuberculosis
AQVLLAVLAAMYASYHGA

SEQ ID NO: 1475875 - protein, 18 aa, Mycobacterium tuberculosis
AQVSLAQMEYMLPRLRGW

SEQ ID NO: 1475876 - protein, 17 aa, Mycobacterium tuberculosis
ARAARVLGFRAAVDPGE

SEQ ID NO: 1475877 - protein, 31 aa, Mycobacterium tuberculosis
ARAQHPWPPRVATLPHWPLIYAGALEGLDHL

SEQ ID NO: 1475878 - protein, 23 aa, Mycobacterium tuberculosis
ARASAMAAWLFGRPAAVPEIARS

SEQ ID NO: 1475879 - protein, 17 aa, Mycobacterium tuberculosis
ARATGGFLGGGRVTAVK

SEQ ID NO: 1475880 - protein, 19 aa, Mycobacterium tuberculosis
ARCAQFSTLLGVPMESMIG

SEQ ID NO: 1475881 - protein, 17 aa, Mycobacterium tuberculosis
ARCGIELAPDTNQQVAG

SEQ ID NO: 1475882 - protein, 24 aa, Mycobacterium tuberculosis
ARCRGKTRLGECARPVGRVSSLAR

SEQ ID NO: 1475883 - protein, 19 aa, Mycobacterium tuberculosis
AREDLSVWVVTGDGDALSI

SEQ ID NO: 1475884 - protein, 22 aa, Mycobacterium tuberculosis
ARGNLTPRERIELLVDPDSPFL

SEQ ID NO: 1475885 - protein, 24 aa, Mycobacterium tuberculosis
ARGPYRLGPEITRMATTVRLGVVT

SEQ ID NO: 1475886 - protein, 19 aa, Mycobacterium tuberculosis
ARGQYWIHPALPEVVENAL

SEQ ID NO: 1475887 - protein, 20 aa, Mycobacterium tuberculosis
ARHAKGWNHFLDRLVVAGQH

SEQ ID NO: 1475888 - protein, 21 aa, Mycobacterium tuberculosis
ARHAKGWNHFLDRLVVAGQHG

SEQ ID NO: 1475889 - protein, 18 aa, Mycobacterium tuberculosis
ARHRLRPSISDVPELNTA

SEQ ID NO: 1475890 - protein, 21 aa, Mycobacterium tuberculosis
ARIAFLIRFGTGVLPEPKTVL

SEQ ID NO: 1475891 - protein, 20 aa, Mycobacterium tuberculosis
ARKLPDWPTGPLPKVRVAAA

SEQ ID NO: 1475892 - protein, 22 aa, Mycobacterium tuberculosis
ARLRADRALVAFPEIRSISYFT

SEQ ID NO: 1475893 - protein, 19 aa, Mycobacterium tuberculosis
ARLVVKLPNRWPLTDAAGV

SEQ ID NO: 1475894 - protein, 17 aa, Mycobacterium tuberculosis
ARMVTAWRRQRGQQTPA

SEQ ID NO: 1475895 - protein, 20 aa, Mycobacterium tuberculosis
ARPHPRTGIIEGGPNTNVLT

SEQ ID NO: 1475896 - protein, 19 aa, Mycobacterium tuberculosis
ARPRYIRIAADLPSTATHK

SEQ ID NO: 1475897 - protein, 17 aa, Mycobacterium tuberculosis
ARPVIIGPITFLLLSKA

SEQ ID NO: 1475898 - protein, 18 aa, Mycobacterium tuberculosis
ARQGRRGRRFRDRRRRGE

SEQ ID NO: 1475899 - protein, 19 aa, Mycobacterium tuberculosis
ARRDLNWRPRFDLNAVAAR

SEQ ID NO: 1475900 - protein, 19 aa, Mycobacterium tuberculosis
ARSADLCRRELLSRRDQLT

SEQ ID NO: 1475901 - protein, 22 aa, Mycobacterium tuberculosis
ARSLVSEVLEFLATAGTNYNKT

SEQ ID NO: 1475902 - protein, 24 aa, Mycobacterium tuberculosis
ARSVAGCSFPIERLRQVAEHADAT

SEQ ID NO: 1475903 - protein, 19 aa, Mycobacterium tuberculosis
ARTAAAIAKQVGIEKVLAE

SEQ ID NO: 1475904 - protein, 19 aa, Mycobacterium tuberculosis
ARTAAICAVSPALWLSAGS

SEQ ID NO: 1475905 - protein, 20 aa, Mycobacterium tuberculosis
ARTRTGASIVAIVRDEDVLA

SEQ ID NO: 1475906 - protein, 18 aa, Mycobacterium tuberculosis
ARTTFTYVAVAVAGSDDQ

SEQ ID NO: 1475907 - protein, 30 aa, Mycobacterium tuberculosis
ARVETARIGLPRVETAGVVATRIDHTRIEP

SEQ ID NO: 1475908 - protein, 20 aa, Mycobacterium tuberculosis
ARVGSYLRYGAYPYAIAVRE

SEQ ID NO: 1475909 - protein, 27 aa, Mycobacterium tuberculosis
ARVVAKIYCGLGLLKRENIREVHRADL

SEQ ID NO: 1475910 - protein, 20 aa, Mycobacterium tuberculosis
ARVVNPRWMAAMRRHGYKGA

SEQ ID NO: 1475911 - protein, 18 aa, Mycobacterium tuberculosis
ARYQHARVCQAGVTDGPR

SEQ ID NO: 1475912 - protein, 17 aa, Mycobacterium tuberculosis
ASARLLVASALARQGPL

SEQ ID NO: 1475913 - protein, 32 aa, Mycobacterium tuberculosis
ASCRPVGQSRRERGPAMEYLIAAQDVLVAAAA

SEQ ID NO: 1475914 - protein, 25 aa, Mycobacterium tuberculosis
ASEEERARWSLGRHVKLRGHDQPVR

SEQ ID NO: 1475915 - protein, 22 aa, Mycobacterium tuberculosis
ASGFYAKWLPKLVFGEGQLPTT

SEQ ID NO: 1475916 - protein, 26 aa, Mycobacterium tuberculosis
ASGSFMLCAAFNVLLRGLCGRDTAPA

SEQ ID NO: 1475917 - protein, 17 aa, Mycobacterium tuberculosis
ASLKGLVRVLAFEHPDM

SEQ ID NO: 1475918 - protein, 28 aa, Mycobacterium tuberculosis
ASRAKWDTLRAMGFDDIHISDSRSLEFE

SEQ ID NO: 1475919 - protein, 29 aa, Mycobacterium tuberculosis
ASRASATLIWRRPRWARRLQPAPIADLLT

SEQ ID NO: 1475920 - protein, 21 aa, Mycobacterium tuberculosis
ASRLIRLPMWVGLQEVDQSRV

SEQ ID NO: 1475921 - protein, 19 aa, Mycobacterium tuberculosis
ASSVGGLSVPAGWSTAAPA

SEQ ID NO: 1475922 - protein, 18 aa, Mycobacterium tuberculosis
ASTIDELKTNSSLLTSIL

SEQ ID NO: 1475923 - protein, 24 aa, Mycobacterium tuberculosis
ASVGGWDFSWLDGRATEERPSWGY

SEQ ID NO: 1475924 - protein, 17 aa, Mycobacterium tuberculosis
ASVGSLSVPPAWAAANQ

SEQ ID NO: 1475925 - protein, 23 aa, Mycobacterium tuberculosis
ASVRCARLYRAAVHAGAKGLTVR

SEQ ID NO: 1475926 - protein, 19 aa, Mycobacterium tuberculosis
ASVSDGFQAFVYGPIHATG

SEQ ID NO: 1475927 - protein, 25 aa, Mycobacterium tuberculosis
ASYARQRPGLLAAWLDGDLGELPGD

SEQ ID NO: 1475928 - protein, 18 aa, Mycobacterium tuberculosis
ATAAFDLARIGSQVSAAS

SEQ ID NO: 1475929 - protein, 29 aa, Mycobacterium tuberculosis
ATAPRLLLEVVCARLLLPSASDAESALLQ

SEQ ID NO: 1475930 - protein, 25 aa, Mycobacterium tuberculosis
ATDLAEWLVRQGVPFRSAHEAAGAA

SEQ ID NO: 1475931 - protein, 20 aa, Mycobacterium tuberculosis
ATESLGRFSEVANRALAATR

SEQ ID NO: 1475932 - protein, 18 aa, Mycobacterium tuberculosis
ATFDGTILIGDIPIPIID

SEQ ID NO: 1475933 - protein, 17 aa, Mycobacterium tuberculosis
ATFEAVLAKLAAPGATN

SEQ ID NO: 1475934 - protein, 19 aa, Mycobacterium tuberculosis
ATFEMRYLQSLPAHLRPGL

SEQ ID NO: 1475935 - protein, 22 aa, Mycobacterium tuberculosis
ATGHVLLPGFVDLHTHLREPGR

SEQ ID NO: 1475936 - protein, 17 aa, Mycobacterium tuberculosis
ATGRPLIGNGANGAPGT

SEQ ID NO: 1475937 - protein, 21 aa, Mycobacterium tuberculosis
ATKGIPFGSVVTFVVRAGNPK

SEQ ID NO: 1475938 - protein, 20 aa, Mycobacterium tuberculosis
ATKKILCRSVMGERPRMATG

SEQ ID NO: 1475939 - protein, 25 aa, Mycobacterium tuberculosis
ATLPAAAWQRCRTHYAANLMAATPK

SEQ ID NO: 1475940 - protein, 22 aa, Mycobacterium tuberculosis
ATLPALIDRRGYVLIVSSLAAF

SEQ ID NO: 1475941 - protein, 18 aa, Mycobacterium tuberculosis
ATLSVPFSAFPKPQNYPG

SEQ ID NO: 1475942 - protein, 22 aa, Mycobacterium tuberculosis
ATPETLLGCPGEIDIGHRTIPN

SEQ ID NO: 1475943 - protein, 20 aa, Mycobacterium tuberculosis
ATPGDGWASLASSIGGQVLL

SEQ ID NO: 1475944 - protein, 27 aa, Mycobacterium tuberculosis
ATVIARDRAEAIAGLRALAAGQPRVGV

SEQ ID NO: 1475945 - protein, 17 aa, Mycobacterium tuberculosis
AVARMAEFGRHVEELVA

SEQ ID NO: 1475946 - protein, 23 aa, Mycobacterium tuberculosis
AVAVLRRLAPRARITGGVDRVEL

SEQ ID NO: 1475947 - protein, 23 aa, Mycobacterium tuberculosis
AVEAPEFHSAVLAELTLIGHRGP

SEQ ID NO: 1475948 - protein, 19 aa, Mycobacterium tuberculosis
AVEKFDYTKGYKFSTYATW

SEQ ID NO: 1475949 - protein, 32 aa, Mycobacterium tuberculosis
AVEVALFRLLGSWGVRPDFVMGHSIGELSAAH

SEQ ID NO: 1475950 - protein, 17 aa, Mycobacterium tuberculosis
AVFDQLGAIGIDLTDVF

SEQ ID NO: 1475951 - protein, 24 aa, Mycobacterium tuberculosis
AVGSELKAADSLAEYVLELARKLI

SEQ ID NO: 1475952 - protein, 25 aa, Mycobacterium tuberculosis
AVGSELKAADSLAEYVLELARKLIR

SEQ ID NO: 1475953 - protein, 25 aa, Mycobacterium tuberculosis
AVLLARAPRSAGHWLAVAEAVVRGP

SEQ ID NO: 1475954 - protein, 19 aa, Mycobacterium tuberculosis
AVLYTRAGPEIGVASTKTF

SEQ ID NO: 1475955 - protein, 17 aa, Mycobacterium tuberculosis
AVRDGRPTVLQSLTEDP

SEQ ID NO: 1475956 - protein, 20 aa, Mycobacterium tuberculosis
AVREFACQRWQWHDLEVSRT

SEQ ID NO: 1475957 - protein, 17 aa, Mycobacterium tuberculosis
AVRKWTKRKGRIYSDDR

SEQ ID NO: 1475958 - protein, 26 aa, Mycobacterium tuberculosis
AVRPRSCAALPRILRDNGYVTGAFGK

SEQ ID NO: 1475959 - protein, 17 aa, Mycobacterium tuberculosis
AVRWHRYSLDNGDMHRT

SEQ ID NO: 1475960 - protein, 24 aa, Mycobacterium tuberculosis
AVSDDIPQRLGFGVDVEVLDQLLD

SEQ ID NO: 1475961 - protein, 26 aa, Mycobacterium tuberculosis
AVSLRLWRCGRVGPMRVAVVAGPDPG

SEQ ID NO: 1475962 - protein, 17 aa, Mycobacterium tuberculosis
AVSRAHRGVLFLDECAE

SEQ ID NO: 1475963 - protein, 19 aa, Mycobacterium tuberculosis
AVTDVLGAVVKVFVSGVDA

SEQ ID NO: 1475964 - protein, 20 aa, Mycobacterium tuberculosis
AVVARARQKGCTLLVTDGDW

SEQ ID NO: 1475965 - protein, 19 aa, Mycobacterium tuberculosis
AVVCLHSYLYPGHEREIGT

SEQ ID NO: 1475966 - protein, 35 aa, Mycobacterium tuberculosis
AVVMAPMYLGLRVWSRATIGLAYASALIIADRHDE

SEQ ID NO: 1475967 - protein, 25 aa, Mycobacterium tuberculosis
AVVSELKAADSLAEYVLELARKLIK

SEQ ID NO: 1475968 - protein, 18 aa, Mycobacterium tuberculosis
AVWQLLCADGDAIDAIGR

SEQ ID NO: 1475969 - protein, 18 aa, Mycobacterium tuberculosis
AVYPRAAFEQLARRASKA

SEQ ID NO: 1475970 - protein, 25 aa, Mycobacterium tuberculosis
AVYRRCADVRYLGSWPTGPAAGAQP

SEQ ID NO: 1475971 - protein, 21 aa, Mycobacterium tuberculosis
AWEARVRKRFAFLTDLDADEQ

SEQ ID NO: 1475972 - protein, 25 aa, Mycobacterium tuberculosis
AWLYSQRRFEVPSDKIANTMKLAIV

SEQ ID NO: 1475973 - protein, 22 aa, Mycobacterium tuberculosis
AYAEGLRALYLYAAAHQDDAVA

SEQ ID NO: 1475974 - protein, 17 aa, Mycobacterium tuberculosis
AYGGTFLQFSDYMRPAV

SEQ ID NO: 1475975 - protein, 18 aa, Mycobacterium tuberculosis
AYLPRLPVDVVKLGGKFI

SEQ ID NO: 1475976 - protein, 26 aa, Mycobacterium tuberculosis
AYSEERLRPPPGYKDTTVPGIFSRDT

SEQ ID NO: 1475977 - protein, 19 aa, Mycobacterium tuberculosis
AYTPWYLVRYWRLLRFKLA

SEQ ID NO: 1475978 - protein, 22 aa, Mycobacterium tuberculosis
CAAEIGRFLGCQGHRGGAAHAV

SEQ ID NO: 1475979 - protein, 18 aa, Mycobacterium tuberculosis
CAPANHWSVRTVGDLGLI

SEQ ID NO: 1475980 - protein, 24 aa, Mycobacterium tuberculosis
CARARFLRPKRGCWDGHRATTHWA

SEQ ID NO: 1475981 - protein, 19 aa, Mycobacterium tuberculosis
CARCARGWHDQGRHVWGWR

SEQ ID NO: 1475982 - protein, 18 aa, Mycobacterium tuberculosis
CDGPRFCWVNGMRVSFEN

SEQ ID NO: 1475983 - protein, 20 aa, Mycobacterium tuberculosis
CDQHAGGPGRVFVYSGQGSQ

SEQ ID NO: 1475984 - protein, 18 aa, Mycobacterium tuberculosis
CDRSRLTADGIWLHCLYA

SEQ ID NO: 1475985 - protein, 17 aa, Mycobacterium tuberculosis
CEIKDVQIRDGLHILGQ

SEQ ID NO: 1475986 - protein, 24 aa, Mycobacterium tuberculosis
CEPVAVVGIGCRFPGNVTGPESFW

SEQ ID NO: 1475987 - protein, 22 aa, Mycobacterium tuberculosis
CFASGRVAYAMGLQGPAITVDT

SEQ ID NO: 1475988 - protein, 17 aa, Mycobacterium tuberculosis
CFVREAIDDQAFGHARE

SEQ ID NO: 1475989 - protein, 25 aa, Mycobacterium tuberculosis
CGDACPYFPGVSYRNWKLPDPAGQP

SEQ ID NO: 1475990 - protein, 26 aa, Mycobacterium tuberculosis
CGIAKGSLRGGLVLGLEDSSSRMSRL

SEQ ID NO: 1475991 - protein, 20 aa, Mycobacterium tuberculosis
CGKCGNHLAGSYRTDGQVVY

SEQ ID NO: 1475992 - protein, 19 aa, Mycobacterium tuberculosis
CGLIDRIGFRDQAYARMAE

SEQ ID NO: 1475993 - protein, 24 aa, Mycobacterium tuberculosis
CGPYCPRARITLLQRTTIAKSNRK

SEQ ID NO: 1475994 - protein, 26 aa, Mycobacterium tuberculosis
CHLGREALPLAERVDWLYAKASQHAL

SEQ ID NO: 1475995 - protein, 18 aa, Mycobacterium tuberculosis
CHNGFRPIMMPKIVSVQH

SEQ ID NO: 1475996 - protein, 22 aa, Mycobacterium tuberculosis
CIECPDGTVGEIWVHGDNVANG

SEQ ID NO: 1475997 - protein, 17 aa, Mycobacterium tuberculosis
CLIRAGHFGLVVGSRAA

SEQ ID NO: 1475998 - protein, 18 aa, Mycobacterium tuberculosis
CPAEKRRDMLFDHVGALA

SEQ ID NO: 1475999 - protein, 24 aa, Mycobacterium tuberculosis
CPEALWDFLCERRSSISQVPPQRW

SEQ ID NO: 1476000 - protein, 24 aa, Mycobacterium tuberculosis
CQRRDGRRSPGMVAKHRRHVLGPH

SEQ ID NO: 1476001 - protein, 25 aa, Mycobacterium tuberculosis
CQTPPAGRCRPTLSARANRGRRLAE

SEQ ID NO: 1476002 - protein, 22 aa, Mycobacterium tuberculosis
CRLDRLAGELSVWSRAAVQIAF

SEQ ID NO: 1476003 - protein, 18 aa, Mycobacterium tuberculosis
CRQIMLYHLDRGWADHLA

SEQ ID NO: 1476004 - protein, 21 aa, Mycobacterium tuberculosis
CRQQITATILLSWSQPTAQPL

SEQ ID NO: 1476005 - protein, 18 aa, Mycobacterium tuberculosis
CRQSIPAIAAELYVAPST

SEQ ID NO: 1476006 - protein, 18 aa, Mycobacterium tuberculosis
CSPMGPKALTSLRAAETE

SEQ ID NO: 1476007 - protein, 19 aa, Mycobacterium tuberculosis
CSPTRYGGVKGAHRIDLDA

SEQ ID NO: 1476008 - protein, 20 aa, Mycobacterium tuberculosis
CSSGLTAVHMACRSLHEGES

SEQ ID NO: 1476009 - protein, 17 aa, Mycobacterium tuberculosis
CTGCPGATGRHCPGTVG

SEQ ID NO: 1476010 - protein, 24 aa, Mycobacterium tuberculosis
CTRFRSDALQIIAFGRYARTVTAA

SEQ ID NO: 1476011 - protein, 17 aa, Mycobacterium tuberculosis
CTVGRTLKSGTVNLEVV

SEQ ID NO: 1476012 - protein, 22 aa, Mycobacterium tuberculosis
CVGRLRYLGLVLYDVDQVLQAA

SEQ ID NO: 1476013 - protein, 18 aa, Mycobacterium tuberculosis
CVKHVSVTIPITTEHLGP

SEQ ID NO: 1476014 - protein, 17 aa, Mycobacterium tuberculosis
CWDGHRATTHWAFAEHF

SEQ ID NO: 1476015 - protein, 18 aa, Mycobacterium tuberculosis
DAAAIPEAHWRLGDACEL

SEQ ID NO: 1476016 - protein, 17 aa, Mycobacterium tuberculosis
DAAYRRVRKAAKAAKTA

SEQ ID NO: 1476017 - protein, 17 aa, Mycobacterium tuberculosis
DADEWRQELPLIEEWLQ

SEQ ID NO: 1476018 - protein, 18 aa, Mycobacterium tuberculosis
DAEGGSVFGRLVNTSSEA

SEQ ID NO: 1476019 - protein, 28 aa, Mycobacterium tuberculosis
DAELRYKMCVDAVAFARHIGYSCAGTVE

SEQ ID NO: 1476020 - protein, 19 aa, Mycobacterium tuberculosis
DAEPGRITVILALHDLING

SEQ ID NO: 1476021 - protein, 18 aa, Mycobacterium tuberculosis
DAERRKALEAGYDLNQVL

SEQ ID NO: 1476022 - protein, 23 aa, Mycobacterium tuberculosis
DAGKRIANRLLEFALNALNQPFL

SEQ ID NO: 1476023 - protein, 23 aa, Mycobacterium tuberculosis
DAGLHWFRAALDARPADESIIDS

SEQ ID NO: 1476024 - protein, 25 aa, Mycobacterium tuberculosis
DAGLLAGAVTMVWQREKLLQVNEIG

SEQ ID NO: 1476025 - protein, 17 aa, Mycobacterium tuberculosis
DAIQCADPFHVVAWATE

SEQ ID NO: 1476026 - protein, 21 aa, Mycobacterium tuberculosis
DAKIGYPPTRVWGVPAAGLWA

SEQ ID NO: 1476027 - protein, 17 aa, Mycobacterium tuberculosis
DALEHFIDLVARVEAAA

SEQ ID NO: 1476028 - protein, 18 aa, Mycobacterium tuberculosis
DAPLIGWGGNGGPGGFAA

SEQ ID NO: 1476029 - protein, 24 aa, Mycobacterium tuberculosis
DAPVLPTLCRAAAALLGSTAADVR

SEQ ID NO: 1476030 - protein, 21 aa, Mycobacterium tuberculosis
DATRAICSRSHLMGEGEAMLF

SEQ ID NO: 1476031 - protein, 22 aa, Mycobacterium tuberculosis
DAVPRMRGMLTLFEGVATGAAD

SEQ ID NO: 1476032 - protein, 19 aa, Mycobacterium tuberculosis
DDGFKKKKIVDVLRESLYN

SEQ ID NO: 1476033 - protein, 23 aa, Mycobacterium tuberculosis
DDGFVRVIYRWSRTGDLAAALAA

SEQ ID NO: 1476034 - protein, 32 aa, Mycobacterium tuberculosis
DDKLPRYIAGVLARLQEVWLGRQIAEVKSKLQ

SEQ ID NO: 1476035 - protein, 19 aa, Mycobacterium tuberculosis
DDMARLGAQVTIFRLGSDP

SEQ ID NO: 1476036 - protein, 22 aa, Mycobacterium tuberculosis
DDSRDAPTMAWKLFDLATTQRA

SEQ ID NO: 1476037 - protein, 19 aa, Mycobacterium tuberculosis
DDTHLRAIAQLNFANARRN

SEQ ID NO: 1476038 - protein, 24 aa, Mycobacterium tuberculosis
DDVAQLLLRVGIFSWITHAPKLGG

SEQ ID NO: 1476039 - protein, 18 aa, Mycobacterium tuberculosis
DDVIAWRGERRFVERLSR

SEQ ID NO: 1476040 - protein, 26 aa, Mycobacterium tuberculosis
DDVIAWRGERRFVERLSRATIDVSKG

SEQ ID NO: 1476041 - protein, 21 aa, Mycobacterium tuberculosis
DEAQRCRCRGIDLRLVSHQPI

SEQ ID NO: 1476042 - protein, 20 aa, Mycobacterium tuberculosis
DEARQPISVIPTGSIALDVA

SEQ ID NO: 1476043 - protein, 18 aa, Mycobacterium tuberculosis
DECCKLVGIALQVFGGQQ

SEQ ID NO: 1476044 - protein, 28 aa, Mycobacterium tuberculosis
DEEKKLFCRMAEVFAGFLSYTDAQIGRI

SEQ ID NO: 1476045 - protein, 19 aa, Mycobacterium tuberculosis
DEFSGVVVLTGSNTGTPHQ

SEQ ID NO: 1476046 - protein, 25 aa, Mycobacterium tuberculosis
DEFTCSSCFLVQHRSRLASEKNGVM

SEQ ID NO: 1476047 - protein, 22 aa, Mycobacterium tuberculosis
DEIAGIGAGVTWAADNRTVYYT

SEQ ID NO: 1476048 - protein, 20 aa, Mycobacterium tuberculosis
DEIRWDIRPSPHLGTLEVRI

SEQ ID NO: 1476049 - protein, 18 aa, Mycobacterium tuberculosis
DEKVEYVDVRFCDLPGIM

SEQ ID NO: 1476050 - protein, 18 aa, Mycobacterium tuberculosis
DELALPFAWQGVSLHATG

SEQ ID NO: 1476051 - protein, 19 aa, Mycobacterium tuberculosis
DELPVSLSVQVRGELAAEE

SEQ ID NO: 1476052 - protein, 18 aa, Mycobacterium tuberculosis
DEMRAIVQIAARRPTTGH

SEQ ID NO: 1476053 - protein, 28 aa, Mycobacterium tuberculosis
DEQFSCWRIKLPHVEAAKFDAALQSHLD

SEQ ID NO: 1476054 - protein, 22 aa, Mycobacterium tuberculosis
DERYRTKMIWWDRRTLANHAEP

SEQ ID NO: 1476055 - protein, 22 aa, Mycobacterium tuberculosis
DEVSAAVAALFSGHAQTYQALS

SEQ ID NO: 1476056 - protein, 22 aa, Mycobacterium tuberculosis
DEVSAAVASLFSGHAQAYQTLG

SEQ ID NO: 1476057 - protein, 24 aa, Mycobacterium tuberculosis
DEVSQAIARLFSDYATHYQSLNAQ

SEQ ID NO: 1476058 - protein, 20 aa, Mycobacterium tuberculosis
DEVYGIMLMHGWAVQHVECE

SEQ ID NO: 1476059 - protein, 29 aa, Mycobacterium tuberculosis
DEWAARAGPRWSYADVLGYFRRIENVTAA

SEQ ID NO: 1476060 - protein, 23 aa, Mycobacterium tuberculosis
DEWRQELPLIEEWLQFVGEKLPT

SEQ ID NO: 1476061 - protein, 19 aa, Mycobacterium tuberculosis
DFGQIRIGPDFSLVELPAK

SEQ ID NO: 1476062 - protein, 23 aa, Mycobacterium tuberculosis
DFGVEPPVALILQGASLHDLTAD

SEQ ID NO: 1476063 - protein, 24 aa, Mycobacterium tuberculosis
DFIEIRRAAGLSVELTVVESAMAQ

SEQ ID NO: 1476064 - protein, 22 aa, Mycobacterium tuberculosis
DFWTFPRSCNPTGGLMSTARDQ

SEQ ID NO: 1476065 - protein, 24 aa, Mycobacterium tuberculosis
DGENCRRCGAVIRRERFMNRSSFY

SEQ ID NO: 1476066 - protein, 19 aa, Mycobacterium tuberculosis
DGFCSASLMVDHPACRRAV

SEQ ID NO: 1476067 - protein, 17 aa, Mycobacterium tuberculosis
DGFTEMRGKLDGAAAGQ

SEQ ID NO: 1476068 - protein, 26 aa, Mycobacterium tuberculosis
DGGGAGGNGAWLFGNGGAGGGGGKGG

SEQ ID NO: 1476069 - protein, 26 aa, Mycobacterium tuberculosis
DGGNGAIGGHGPLTDDPGGNGGTGGN

SEQ ID NO: 1476070 - protein, 24 aa, Mycobacterium tuberculosis
DGGQGGAGRGLWGTGGAGGHGGQG

SEQ ID NO: 1476071 - protein, 26 aa, Mycobacterium tuberculosis
DGGTGGRGGLLMGAGAGGHGGTGGAG

SEQ ID NO: 1476072 - protein, 23 aa, Mycobacterium tuberculosis
DGGTGGRGGWLAGAGGAGGAGGV

SEQ ID NO: 1476073 - protein, 26 aa, Mycobacterium tuberculosis
DGGVAQGDIASAFGGDGGNGSDGVAA

SEQ ID NO: 1476074 - protein, 20 aa, Mycobacterium tuberculosis
DGGYGGWGGAGGNGGAGGSA

SEQ ID NO: 1476075 - protein, 23 aa, Mycobacterium tuberculosis
DGLPDDSMRWLATVIQMDGRRID

SEQ ID NO: 1476076 - protein, 25 aa, Mycobacterium tuberculosis
DGPYETIGGLVLRELGHIPVAGETV

SEQ ID NO: 1476077 - protein, 25 aa, Mycobacterium tuberculosis
DGRDAGRRRPPVLSEAEFLARREAV

SEQ ID NO: 1476078 - protein, 17 aa, Mycobacterium tuberculosis
DGRLRRASLGGVVGDSA

SEQ ID NO: 1476079 - protein, 18 aa, Mycobacterium tuberculosis
DGSLRHPPVPAVWQDKSV

SEQ ID NO: 1476080 - protein, 17 aa, Mycobacterium tuberculosis
DGTSALRYRELVAEVGG

SEQ ID NO: 1476081 - protein, 23 aa, Mycobacterium tuberculosis
DGVHVSFVMAYPEMLAAAADTLQ

SEQ ID NO: 1476082 - protein, 17 aa, Mycobacterium tuberculosis
DGVKAADVFAAFGENIE

SEQ ID NO: 1476083 - protein, 28 aa, Mycobacterium tuberculosis
DGVLGRLWLARGGTYALANIRGGGEYGP

SEQ ID NO: 1476084 - protein, 18 aa, Mycobacterium tuberculosis
DGVRFCAVCGNVSDNERC

SEQ ID NO: 1476085 - protein, 24 aa, Mycobacterium tuberculosis
DHGPVVAVAGRFVHTSIRTTVGAL

SEQ ID NO: 1476086 - protein, 30 aa, Mycobacterium tuberculosis
DHPRLNALPKLPQCVPNAVLGTVTKTAIPY

SEQ ID NO: 1476087 - protein, 26 aa, Mycobacterium tuberculosis
DHPRPRLFSLLHEFVHVVLHTEGLCD

SEQ ID NO: 1476088 - protein, 22 aa, Mycobacterium tuberculosis
DHSRIPMWVEETLRYDTSSQIL

SEQ ID NO: 1476089 - protein, 19 aa, Mycobacterium tuberculosis
DIADGEFLVLVGPSGCGKS

SEQ ID NO: 1476090 - protein, 23 aa, Mycobacterium tuberculosis
DIDALKGIALYLNFDMLASPNPG

SEQ ID NO: 1476091 - protein, 18 aa, Mycobacterium tuberculosis
DIEPCAAVGLELQRRGHD

SEQ ID NO: 1476092 - protein, 24 aa, Mycobacterium tuberculosis
DIFPGGLTIPAMNPLSINLSGGTG

SEQ ID NO: 1476093 - protein, 19 aa, Mycobacterium tuberculosis
DINDAKLLAAFAAGAQAAG

SEQ ID NO: 1476094 - protein, 21 aa, Mycobacterium tuberculosis
DKLQHKMVYRHSGYPGGLHKR

SEQ ID NO: 1476095 - protein, 19 aa, Mycobacterium tuberculosis
DKRLDRIGSRQALELRGQA

SEQ ID NO: 1476096 - protein, 18 aa, Mycobacterium tuberculosis
DLAIPFDVVVAGVRRQPY

SEQ ID NO: 1476097 - protein, 18 aa, Mycobacterium tuberculosis
DLALAGGCAVLLEPHASV

SEQ ID NO: 1476098 - protein, 18 aa, Mycobacterium tuberculosis
DLCDAESKVAAARSPIKA

SEQ ID NO: 1476099 - protein, 26 aa, Mycobacterium tuberculosis
DLDFMGSCAYAVWAQESVRCRRRGVN

SEQ ID NO: 1476100 - protein, 25 aa, Mycobacterium tuberculosis
DLEPFRCFYLSAPFVVPKKKEVART

SEQ ID NO: 1476101 - protein, 19 aa, Mycobacterium tuberculosis
DLQSWLVLITGYDAVSLQP

SEQ ID NO: 1476102 - protein, 34 aa, Mycobacterium tuberculosis
DLSNILLLGPVGDLFPILSIPGAMSQNFTNVVMT

SEQ ID NO: 1476103 - protein, 19 aa, Mycobacterium tuberculosis
DLTAPPVWFIKTIGDAVML

SEQ ID NO: 1476104 - protein, 21 aa, Mycobacterium tuberculosis
DLVRRCRMVMAGESLPQAEPT

SEQ ID NO: 1476105 - protein, 17 aa, Mycobacterium tuberculosis
DLVSCRQWVVSVTAIGD

SEQ ID NO: 1476106 - protein, 22 aa, Mycobacterium tuberculosis
DMLGRAGGLLVDVAIDTVPRGY

SEQ ID NO: 1476107 - protein, 29 aa, Mycobacterium tuberculosis
DMNNGVFYRGVGQGSLQFAITSPDLTLPS

SEQ ID NO: 1476108 - protein, 30 aa, Mycobacterium tuberculosis
DMNNGVFYRGVGQGSLQFAITSPDLTLPSL

SEQ ID NO: 1476109 - protein, 22 aa, Mycobacterium tuberculosis
DNAMLGLLCDAAFDELTRPDVV

SEQ ID NO: 1476110 - protein, 19 aa, Mycobacterium tuberculosis
DPATGVTVGPIFSSGSIID

SEQ ID NO: 1476111 - protein, 20 aa, Mycobacterium tuberculosis
DPHTIPIGLFDTAGNLAKLS

SEQ ID NO: 1476112 - protein, 18 aa, Mycobacterium tuberculosis
DPMQWRVLERAFSRHSAL

SEQ ID NO: 1476113 - protein, 20 aa, Mycobacterium tuberculosis
DPQLRVRGVDGLRVADASVM

SEQ ID NO: 1476114 - protein, 25 aa, Mycobacterium tuberculosis
DPQQRLLLETSWEAIEHAGLDPASL

SEQ ID NO: 1476115 - protein, 25 aa, Mycobacterium tuberculosis
DPQQRLLLEVAWEALEHAGIPPGTL

SEQ ID NO: 1476116 - protein, 25 aa, Mycobacterium tuberculosis
DPQQRMALELTWEALEHARIPASSL

SEQ ID NO: 1476117 - protein, 31 aa, Mycobacterium tuberculosis
DPQQRMALELTWEALEHARIPASSLRGQAVG

SEQ ID NO: 1476118 - protein, 20 aa, Mycobacterium tuberculosis
DPRKWAAICDAARHWALRVE

SEQ ID NO: 1476119 - protein, 22 aa, Mycobacterium tuberculosis
DPRRGPCRGVRRRRLPPDAAAS

SEQ ID NO: 1476120 - protein, 22 aa, Mycobacterium tuberculosis
DPSRAMPAYNWMTVAKSALESV

SEQ ID NO: 1476121 - protein, 18 aa, Mycobacterium tuberculosis
DQACTDWPVAAAEDDEAR

SEQ ID NO: 1476122 - protein, 21 aa, Mycobacterium tuberculosis
DQGENFAFLGGRDWDPSQSTL

SEQ ID NO: 1476123 - protein, 27 aa, Mycobacterium tuberculosis
DQSARRCRWPRSWATSPVMDLSRNSKM

SEQ ID NO: 1476124 - protein, 17 aa, Mycobacterium tuberculosis
DQVSVAIAAAFGAHGQA

SEQ ID NO: 1476125 - protein, 25 aa, Mycobacterium tuberculosis
DRAASYRAAGYWSGRTLDTVLSDAA

SEQ ID NO: 1476126 - protein, 25 aa, Mycobacterium tuberculosis
DRALELGCGTGFFLLNLIQAGVARR

SEQ ID NO: 1476127 - protein, 17 aa, Mycobacterium tuberculosis
DRCGVVLVGPHGVGKTL

SEQ ID NO: 1476128 - protein, 24 aa, Mycobacterium tuberculosis
DREREVAELLLLGMPYRDIGARLF

SEQ ID NO: 1476129 - protein, 17 aa, Mycobacterium tuberculosis
DRFTASRLFGAPPGYVG

SEQ ID NO: 1476130 - protein, 25 aa, Mycobacterium tuberculosis
DRGFYAGAVGWCDGRGDGHWVVSIR

SEQ ID NO: 1476131 - protein, 18 aa, Mycobacterium tuberculosis
DRHALALGPSKALLDGQI

SEQ ID NO: 1476132 - protein, 21 aa, Mycobacterium tuberculosis
DRHVIPQGLASRNSPGVCLSG

SEQ ID NO: 1476133 - protein, 20 aa, Mycobacterium tuberculosis
DRIVGAVGALRCHAGDRACR

SEQ ID NO: 1476134 - protein, 22 aa, Mycobacterium tuberculosis
DRLAAELAVAASSFGSVTSGLA

SEQ ID NO: 1476135 - protein, 17 aa, Mycobacterium tuberculosis
DRLARRAWQRFQAIEAR

SEQ ID NO: 1476136 - protein, 22 aa, Mycobacterium tuberculosis
DRLDAEILALVKRRAEVSKAIG

SEQ ID NO: 1476137 - protein, 17 aa, Mycobacterium tuberculosis
DRMTWSQLYSRVTAVSA

SEQ ID NO: 1476138 - protein, 21 aa, Mycobacterium tuberculosis
DRPLYRFPVFGFFALSIGAAA

SEQ ID NO: 1476139 - protein, 24 aa, Mycobacterium tuberculosis
DRQRKWLLGNRESRNGEGLGACRY

SEQ ID NO: 1476140 - protein, 19 aa, Mycobacterium tuberculosis
DRRLAVVFGAGGDRDPGKR

SEQ ID NO: 1476141 - protein, 18 aa, Mycobacterium tuberculosis
DRRRGRLVGALIVDDDSE

SEQ ID NO: 1476142 - protein, 23 aa, Mycobacterium tuberculosis
DRRSRAAGWGIISNAAHPGLTKT

SEQ ID NO: 1476143 - protein, 21 aa, Mycobacterium tuberculosis
DRRVLEFGGRLYTAKDSRTTA

SEQ ID NO: 1476144 - protein, 27 aa, Mycobacterium tuberculosis
DSAGSSRKAFGGDGGVGGDGASALGTG

SEQ ID NO: 1476145 - protein, 27 aa, Mycobacterium tuberculosis
DSLLPLPNIPLLEYAARFITPVHPGYT

SEQ ID NO: 1476146 - protein, 21 aa, Mycobacterium tuberculosis
DSLLRRLKQYSGRLATEAVSA

SEQ ID NO: 1476147 - protein, 19 aa, Mycobacterium tuberculosis
DSPDRLWEALLRGDDLVTE

SEQ ID NO: 1476148 - protein, 18 aa, Mycobacterium tuberculosis
DSPLARALAKLGVAADDV

SEQ ID NO: 1476149 - protein, 17 aa, Mycobacterium tuberculosis
DSVAVCRGVRAVARARL

SEQ ID NO: 1476150 - protein, 23 aa, Mycobacterium tuberculosis
DSVHWSRIRLADRAHLEPWEPSA

SEQ ID NO: 1476151 - protein, 24 aa, Mycobacterium tuberculosis
DTACSSGLMAVHLACRSLHDGEAD

SEQ ID NO: 1476152 - protein, 17 aa, Mycobacterium tuberculosis
DTARLAVFDADSGANLT

SEQ ID NO: 1476153 - protein, 23 aa, Mycobacterium tuberculosis
DTCETRSAWSFNRYAHLHTERHE

SEQ ID NO: 1476154 - protein, 23 aa, Mycobacterium tuberculosis
DTLARQGISYVLVRNDLDPETSR

SEQ ID NO: 1476155 - protein, 27 aa, Mycobacterium tuberculosis
DTLPPHPAHFLWLNWGPCPPRQDMAYS

SEQ ID NO: 1476156 - protein, 33 aa, Mycobacterium tuberculosis
DTMRGGKFLNNWRMAELHAKEAPDRVWELETYG

SEQ ID NO: 1476157 - protein, 17 aa, Mycobacterium tuberculosis
DTQFGMTQLHYPLRTRQ

SEQ ID NO: 1476158 - protein, 29 aa, Mycobacterium tuberculosis
DTRAYFRGECLRRFGADIAAASWDSVIFD

SEQ ID NO: 1476159 - protein, 23 aa, Mycobacterium tuberculosis
DTRTDVSLVLRMHHGGDFVIEPL

SEQ ID NO: 1476160 - protein, 25 aa, Mycobacterium tuberculosis
DTSCGGCRWGLVSGWEGEWVMEFPV

SEQ ID NO: 1476161 - protein, 17 aa, Mycobacterium tuberculosis
DTVRRAAPFATLPRSLF

SEQ ID NO: 1476162 - protein, 18 aa, Mycobacterium tuberculosis
DVADGARLVDSIEGEPGL

SEQ ID NO: 1476163 - protein, 18 aa, Mycobacterium tuberculosis
DVADGARLVDSVEGEPGL

SEQ ID NO: 1476164 - protein, 24 aa, Mycobacterium tuberculosis
DVALSVPVSGTWVDIRFTLPANTV

SEQ ID NO: 1476165 - protein, 23 aa, Mycobacterium tuberculosis
DVAPRVAQIFGVQAVPTVVALAA

SEQ ID NO: 1476166 - protein, 25 aa, Mycobacterium tuberculosis
DVFHIDRGYPLFVENLVSLGAEIER

SEQ ID NO: 1476167 - protein, 18 aa, Mycobacterium tuberculosis
DVGWSLAGRSVFEHRAVV

SEQ ID NO: 1476168 - protein, 20 aa, Mycobacterium tuberculosis
DVKGLRLTLTQAAWRVAEDS

SEQ ID NO: 1476169 - protein, 25 aa, Mycobacterium tuberculosis
DVNIPIHIPITASFTDIVYSGLDLP

SEQ ID NO: 1476170 - protein, 23 aa, Mycobacterium tuberculosis
DVNTGFWNGGPFNTGFGNGGNTN

SEQ ID NO: 1476171 - protein, 19 aa, Mycobacterium tuberculosis
DVPCARLRATNPLRALARC

SEQ ID NO: 1476172 - protein, 24 aa, Mycobacterium tuberculosis
DVTYARIGERWRIGSDGLVLEVSA

SEQ ID NO: 1476173 - protein, 22 aa, Mycobacterium tuberculosis
DWAAKGTLLLGVRAVIAESFER

SEQ ID NO: 1476174 - protein, 19 aa, Mycobacterium tuberculosis
DWADEVYVFGYPRVPMTAE

SEQ ID NO: 1476175 - protein, 19 aa, Mycobacterium tuberculosis
DWPHIGVALMQPRARGRIT

SEQ ID NO: 1476176 - protein, 17 aa, Mycobacterium tuberculosis
DYARMWIQAATTMASYQ

SEQ ID NO: 1476177 - protein, 25 aa, Mycobacterium tuberculosis
DYGRANDIAVVWSPTGVPYVVAVMS

SEQ ID NO: 1476178 - protein, 21 aa, Mycobacterium tuberculosis
DYLATVITWHRHIAGLIEQAK

SEQ ID NO: 1476179 - protein, 19 aa, Mycobacterium tuberculosis
DYLRMWIQAATVMSHYQAV

SEQ ID NO: 1476180 - protein, 19 aa, Mycobacterium tuberculosis
DYMIGSSFGSIIGSLVARE

SEQ ID NO: 1476181 - protein, 28 aa, Mycobacterium tuberculosis
DYVYPGHAIWWLARGLEFFQDGEQFGEL

SEQ ID NO: 1476182 - protein, 24 aa, Mycobacterium tuberculosis
EAAKGVAMPLRLTSPAPCTNCHGS

SEQ ID NO: 1476183 - protein, 17 aa, Mycobacterium tuberculosis
EAAWRNLSLALPLSAAV

SEQ ID NO: 1476184 - protein, 17 aa, Mycobacterium tuberculosis
EADLVLLAMGFVGPERA

SEQ ID NO: 1476185 - protein, 19 aa, Mycobacterium tuberculosis
EADRLASRLARIDDIEGDR

SEQ ID NO: 1476186 - protein, 21 aa, Mycobacterium tuberculosis
EAEEKFGFLLEAFMFGAPPHG

SEQ ID NO: 1476187 - protein, 25 aa, Mycobacterium tuberculosis
EAELRRGRRYSVARRLAGLFASYAR

SEQ ID NO: 1476188 - protein, 21 aa, Mycobacterium tuberculosis
EAGVAQCWHQLVGDTGEIVSI

SEQ ID NO: 1476189 - protein, 17 aa, Mycobacterium tuberculosis
EAIKGLRAVAAGKQAPN

SEQ ID NO: 1476190 - protein, 22 aa, Mycobacterium tuberculosis
EAIRASGLSAGIVDAGLSRGLA

SEQ ID NO: 1476191 - protein, 21 aa, Mycobacterium tuberculosis
EALDASLLLVVLTRFLPPDDP

SEQ ID NO: 1476192 - protein, 19 aa, Mycobacterium tuberculosis
EALEHGRIAVAIAGVPFKC

SEQ ID NO: 1476193 - protein, 18 aa, Mycobacterium tuberculosis
EALERAGIDPITLRGSQT

SEQ ID NO: 1476194 - protein, 19 aa, Mycobacterium tuberculosis
EALVSMLKDHGVGFHPRKA

SEQ ID NO: 1476195 - protein, 25 aa, Mycobacterium tuberculosis
EANLRLVVSLAKRYTGRGMAFLDLI

SEQ ID NO: 1476196 - protein, 23 aa, Mycobacterium tuberculosis
EAQNRYGRKVSWGVEVGGERILF

SEQ ID NO: 1476197 - protein, 18 aa, Mycobacterium tuberculosis
EAQVEQQLLAAINAPTQA

SEQ ID NO: 1476198 - protein, 21 aa, Mycobacterium tuberculosis
EAQYGEMWAQDIVAMEGYAGA

SEQ ID NO: 1476199 - protein, 21 aa, Mycobacterium tuberculosis
EASYFGPSFMINWLHNRYGNY

SEQ ID NO: 1476200 - protein, 22 aa, Mycobacterium tuberculosis
EATRPLVICDLGMPRDVDPAVA

SEQ ID NO: 1476201 - protein, 26 aa, Mycobacterium tuberculosis
EAVARGDASAGWCVSIAITSALLVAY

SEQ ID NO: 1476202 - protein, 18 aa, Mycobacterium tuberculosis
EAVDEFKKIIGVIQTSGH

SEQ ID NO: 1476203 - protein, 22 aa, Mycobacterium tuberculosis
EAVLALRARKGMVLDPTDHDTW

SEQ ID NO: 1476204 - protein, 24 aa, Mycobacterium tuberculosis
EAVLPSAFFFEIAQWADGDGEPVA

SEQ ID NO: 1476205 - protein, 18 aa, Mycobacterium tuberculosis
EAVTVFLAPPSWQDLQAR

SEQ ID NO: 1476206 - protein, 21 aa, Mycobacterium tuberculosis
ECLRSIFTGARVEYSGRHVNS

SEQ ID NO: 1476207 - protein, 18 aa, Mycobacterium tuberculosis
ECVLRRFPILGFQHPLSG

SEQ ID NO: 1476208 - protein, 17 aa, Mycobacterium tuberculosis
EDFRLLAAEHRVVPVTR

SEQ ID NO: 1476209 - protein, 19 aa, Mycobacterium tuberculosis
EEAVFRIDHYLGKETVQNI

SEQ ID NO: 1476210 - protein, 24 aa, Mycobacterium tuberculosis
EFAWLRSRLPTLWTNSYFVATVGG

SEQ ID NO: 1476211 - protein, 24 aa, Mycobacterium tuberculosis
EFDRRQWRALRMSTPLALTEEELV

SEQ ID NO: 1476212 - protein, 18 aa, Mycobacterium tuberculosis
EFTEAWTTFATVEKSWAY

SEQ ID NO: 1476213 - protein, 36 aa, Mycobacterium tuberculosis; identical to SEQ ID NO: 209271

SEQ ID NO: 1476214 - protein, 17 aa, Mycobacterium tuberculosis
EGAGLMNYSVLPPEINS

SEQ ID NO: 1476215 - protein, 19 aa, Mycobacterium tuberculosis
EGFFNTGMFNNGIYNSGVA

SEQ ID NO: 1476216 - protein, 20 aa, Mycobacterium tuberculosis
EGIGSALAAANRAAEAPTTG

SEQ ID NO: 1476217 - protein, 22 aa, Mycobacterium tuberculosis
EGTEFRPGVNVGVDISAEKLRA

SEQ ID NO: 1476218 - protein, 24 aa, Mycobacterium tuberculosis
EGTEVIVSPVTVYGARSVTLSGST

SEQ ID NO: 1476219 - protein, 20 aa, Mycobacterium tuberculosis
EGTVTRWLKQEGDTVELDEP

SEQ ID NO: 1476220 - protein, 20 aa, Mycobacterium tuberculosis
EGVMMPELLMADAMGATGKP

SEQ ID NO: 1476221 - protein, 19 aa, Mycobacterium tuberculosis
EHAEGIIITTGCPSGEVQT

SEQ ID NO: 1476222 - protein, 18 aa, Mycobacterium tuberculosis
EHKIRVISPYIGGGFGNK

SEQ ID NO: 1476223 - protein, 18 aa, Mycobacterium tuberculosis
EHRRAWEQLITPRSMHVV

SEQ ID NO: 1476224 - protein, 22 aa, Mycobacterium tuberculosis
EHRVWRADTEIRLSHKEFTLLE

SEQ ID NO: 1476225 - protein, 22 aa, Mycobacterium tuberculosis
EIANAAAMRVVLGAVNAPTQTL

SEQ ID NO: 1476226 - protein, 17 aa, Mycobacterium tuberculosis
EIARWTAAMLASGARLD

SEQ ID NO: 1476227 - protein, 19 aa, Mycobacterium tuberculosis
EIHAARCGIELAPDTNQQV

SEQ ID NO: 1476228 - protein, 19 aa, Mycobacterium tuberculosis
EIKRRLPSMYHQFKELAEV

SEQ ID NO: 1476229 - protein, 19 aa, Mycobacterium tuberculosis
EINSALIFAGAGPEPMAAA

SEQ ID NO: 1476230 - protein, 19 aa, Mycobacterium tuberculosis
EINSLLIYTGAGPGPLLAA

SEQ ID NO: 1476231 - protein, 21 aa, Mycobacterium tuberculosis
EINSLRMFTGAGSAPMLAASV

SEQ ID NO: 1476232 - protein, 18 aa, Mycobacterium tuberculosis
EIRALFRSSKVGLIAGCL

SEQ ID NO: 1476233 - protein, 17 aa, Mycobacterium tuberculosis
EIRRVVQVLSRRTKNNP

SEQ ID NO: 1476234 - protein, 20 aa, Mycobacterium tuberculosis
EISEQLLRVLARRLRRTNNN

SEQ ID NO: 1476235 - protein, 26 aa, Mycobacterium tuberculosis
EISMKHPPCSVVAAATAILAVVLAIG

SEQ ID NO: 1476236 - protein, 17 aa, Mycobacterium tuberculosis
EIVVAAATDLAGIGSAI

SEQ ID NO: 1476237 - protein, 19 aa, Mycobacterium tuberculosis
EIVVAAATDLAGIGSAISA

SEQ ID NO: 1476238 - protein, 17 aa, Mycobacterium tuberculosis
EKACAWDPATGSRRRYP

SEQ ID NO: 1476239 - protein, 18 aa, Mycobacterium tuberculosis
EKGRWYLVGHDRDRDATR

SEQ ID NO: 1476240 - protein, 17 aa, Mycobacterium tuberculosis
EKLRKAAGLLNLDDLAE

SEQ ID NO: 1476241 - protein, 18 aa, Mycobacterium tuberculosis
EKVLIEYNNKAALEPVNP

SEQ ID NO: 1476242 - protein, 26 aa, Mycobacterium tuberculosis
ELADLLPGCAGLRVVESVYGHDGFLV

SEQ ID NO: 1476243 - protein, 18 aa, Mycobacterium tuberculosis
ELAHLGIRVNAIAPGLIR

SEQ ID NO: 1476244 - protein, 19 aa, Mycobacterium tuberculosis
ELDARAAVEQHLLEVLGAS

SEQ ID NO: 1476245 - protein, 25 aa, Mycobacterium tuberculosis
ELDELRRLIPPWVTLGSRLAALPKP

SEQ ID NO: 1476246 - protein, 17 aa, Mycobacterium tuberculosis
ELFTAEAIWEMPPYTGW

SEQ ID NO: 1476247 - protein, 19 aa, Mycobacterium tuberculosis
ELLPYSDLDVLLLHDGKPA

SEQ ID NO: 1476248 - protein, 21 aa, Mycobacterium tuberculosis
ELNLHLACYRAFDDIGSVIHS

SEQ ID NO: 1476249 - protein, 24 aa, Mycobacterium tuberculosis
ELNSLRMFTGAGSAPMLAAAVAWD

SEQ ID NO: 1476250 - protein, 19 aa, Mycobacterium tuberculosis
ELPRGLDTVLGRGGVGLSL

SEQ ID NO: 1476251 - protein, 18 aa, Mycobacterium tuberculosis
ELRASWTATTPDLGAHVQ

SEQ ID NO: 1476252 - protein, 18 aa, Mycobacterium tuberculosis
ELRERAVRMVAEIRGQHD

SEQ ID NO: 1476253 - protein, 20 aa, Mycobacterium tuberculosis
ELSASPGFRRANLPPLNVPL

SEQ ID NO: 1476254 - protein, 26 aa, Mycobacterium tuberculosis
ELWPLRPDVRTLLCSSVMGVWGGHGV

SEQ ID NO: 1476255 - protein, 19 aa, Mycobacterium tuberculosis
EMLGAAATDLASIGSAIST

SEQ ID NO: 1476256 - protein, 31 aa, Mycobacterium tuberculosis
EMMATAAFDLARIGSQVSAASAVAAMPTTEV

SEQ ID NO: 1476257 - protein, 22 aa, Mycobacterium tuberculosis
EMMMPFLEHFVMRSRYVDNPGL

SEQ ID NO: 1476258 - protein, 17 aa, Mycobacterium tuberculosis
EMMPRLMAQQIDEAGGA

SEQ ID NO: 1476259 - protein, 19 aa, Mycobacterium tuberculosis
EMPKIAALIRHIEDLHARH

SEQ ID NO: 1476260 - protein, 21 aa, Mycobacterium tuberculosis
ENLGARPARFASDAAMAKLDR

SEQ ID NO: 1476261 - protein, 27 aa, Mycobacterium tuberculosis
ENVPISPIWLCPLRLRDHAGWPLYPIR

SEQ ID NO: 1476262 - protein, 31 aa, Mycobacterium tuberculosis
EPANGPPPPGRWVRRKPAAAARLDAARAALT

SEQ ID NO: 1476263 - protein, 18 aa, Mycobacterium tuberculosis
EPDVVGGKGGDGGKGGSG

SEQ ID NO: 1476264 - protein, 24 aa, Mycobacterium tuberculosis
EPGGPGQPGTEFGQTGGTGGTGGT

SEQ ID NO: 1476265 - protein, 20 aa, Mycobacterium tuberculosis
EPKHPAARPKHVALQQLTGA

SEQ ID NO: 1476266 - protein, 21 aa, Mycobacterium tuberculosis
EPLPEEPWRSAVEATGSADVM

SEQ ID NO: 1476267 - protein, 18 aa, Mycobacterium tuberculosis
EPNHTVWAQAPGANNGSP

SEQ ID NO: 1476268 - protein, 22 aa, Mycobacterium tuberculosis
EPNQALGWLPMQDIDAAAEAAA

SEQ ID NO: 1476269 - protein, 22 aa, Mycobacterium tuberculosis
EPSAPLPAFWVNIARKKILHAA

SEQ ID NO: 1476270 - protein, 20 aa, Mycobacterium tuberculosis
EPTAALPIIRSDGDDSEAAT

SEQ ID NO: 1476271 - protein, 23 aa, Mycobacterium tuberculosis
EPTGDGLVEWEGIGTVEAWTTPV

SEQ ID NO: 1476272 - protein, 18 aa, Mycobacterium tuberculosis
EPVSTGWREWSLRCAALA

SEQ ID NO: 1476273 - protein, 17 aa, Mycobacterium tuberculosis
EPYTVRTVEPWGVVTEK

SEQ ID NO: 1476274 - protein, 18 aa, Mycobacterium tuberculosis
EQAELWGGTADEPFDPNY

SEQ ID NO: 1476275 - protein, 17 aa, Mycobacterium tuberculosis
EQARFAMRMVRRPVHDP

SEQ ID NO: 1476276 - protein, 27 aa, Mycobacterium tuberculosis
EQFGLELIWGIEDCRNMSARLERDLLA

SEQ ID NO: 1476277 - protein, 24 aa, Mycobacterium tuberculosis
EQGCRTAILAPMRRWCDGDVDGRK

SEQ ID NO: 1476278 - protein, 20 aa, Mycobacterium tuberculosis
EQLLLLPLTSLRGLRHTLKK

SEQ ID NO: 1476279 - protein, 19 aa, Mycobacterium tuberculosis
EQRPAGPPADREEAADTPG

SEQ ID NO: 1476280 - protein, 33 aa, Mycobacterium tuberculosis
EQRYEGGSTLFGRWELCALMQTVAELAEAMRDG

SEQ ID NO: 1476281 - protein, 25 aa, Mycobacterium tuberculosis
EQSRRRCRCNALRAGSMLASMSKIH

SEQ ID NO: 1476282 - protein, 19 aa, Mycobacterium tuberculosis
EQTFLLRLLGGELRQGAKG

SEQ ID NO: 1476283 - protein, 22 aa, Mycobacterium tuberculosis
ERARLRIFFEFLRGADETGTSA

SEQ ID NO: 1476284 - protein, 23 aa, Mycobacterium tuberculosis
ERDRPRISLGPLPVAEHLRDCTA

SEQ ID NO: 1476285 - protein, 18 aa, Mycobacterium tuberculosis
EREPRGDLDMKLRSVRAA

SEQ ID NO: 1476286 - protein, 25 aa, Mycobacterium tuberculosis
ERFLARPGLVYLLWPVALGYLRVVT

SEQ ID NO: 1476287 - protein, 24 aa, Mycobacterium tuberculosis
ERGLAIPAANAFTAVAGHGVRAQV

SEQ ID NO: 1476288 - protein, 28 aa, Mycobacterium tuberculosis
ERGLPMSFTFARFLKFIVTEIFPGGRLP

SEQ ID NO: 1476289 - protein, 22 aa, Mycobacterium tuberculosis
ERIGFAAQHTWDGSARRVLAHA

SEQ ID NO: 1476290 - protein, 20 aa, Mycobacterium tuberculosis
ERLRLSGTRIELEELLQLPV

SEQ ID NO: 1476291 - protein, 18 aa, Mycobacterium tuberculosis
ERRAVPLPLEQKIFDAEW

SEQ ID NO: 1476292 - protein, 18 aa, Mycobacterium tuberculosis
ERVGLGIGQQRAEPVGKQ

SEQ ID NO: 1476293 - protein, 17 aa, Mycobacterium tuberculosis
ERYDDFFKFAYNAMPAD

SEQ ID NO: 1476294 - protein, 18 aa, Mycobacterium tuberculosis
ERYPVLTYVGPHDDKQIA

SEQ ID NO: 1476295 - protein, 21 aa, Mycobacterium tuberculosis
ERYRTKMIWWDRRTLANHAEP

SEQ ID NO: 1476296 - protein, 17 aa, Mycobacterium tuberculosis
ERYWQLAADTLRAHAVL

SEQ ID NO: 1476297 - protein, 26 aa, Mycobacterium tuberculosis
ESAAAFQGAHARFVAAAAKVNTLLDI

SEQ ID NO: 1476298 - protein, 25 aa, Mycobacterium tuberculosis
ESAELCAQYLAPVLDALKFNYLPFG

SEQ ID NO: 1476299 - protein, 22 aa, Mycobacterium tuberculosis
ESFAAACLPYLSWLTQASADCA

SEQ ID NO: 1476300 - protein, 19 aa, Mycobacterium tuberculosis
ESFLGRWQCEQNYRGVDTS

SEQ ID NO: 1476301 - protein, 17 aa, Mycobacterium tuberculosis
ESLLTSHHCCLGAAEGA

SEQ ID NO: 1476302 - protein, 17 aa, Mycobacterium tuberculosis
ESRNLFRDIYLKVTADG

SEQ ID NO: 1476303 - protein, 21 aa, Mycobacterium tuberculosis
ESVCSGLADRWWQGPSSRMMA

SEQ ID NO: 1476304 - protein, 23 aa, Mycobacterium tuberculosis
ESVPRTLAGLTIVVTGSLTGFSR

SEQ ID NO: 1476305 - protein, 24 aa, Mycobacterium tuberculosis
ETAKRLGANPGRCVVIDSCQTGLR

SEQ ID NO: 1476306 - protein, 24 aa, Mycobacterium tuberculosis
ETLVRAASDLANIGSTLGAANAAA

SEQ ID NO: 1476307 - protein, 20 aa, Mycobacterium tuberculosis
ETPSQFFPFTGLNSLTYDVS

SEQ ID NO: 1476308 - protein, 17 aa, Mycobacterium tuberculosis
ETRRQVLDHITFDFEPG

SEQ ID NO: 1476309 - protein, 30 aa, Mycobacterium tuberculosis
ETVAAAALDVARIGSSIGAANAAAAGSTTS

SEQ ID NO: 1476310 - protein, 18 aa, Mycobacterium tuberculosis
EVAGRLAAQVGAYHLMRT

SEQ ID NO: 1476311 - protein, 18 aa, Mycobacterium tuberculosis
EVEINIACSLGMLTAEQV

SEQ ID NO: 1476312 - protein, 19 aa, Mycobacterium tuberculosis
EVFCAPEVVEYLRSATDRL

SEQ ID NO: 1476313 - protein, 22 aa, Mycobacterium tuberculosis
EVNAGVYAFDIAALRSALSRLS

SEQ ID NO: 1476314 - protein, 19 aa, Mycobacterium tuberculosis
EVNSLRMYLGAGSGPMLAA

SEQ ID NO: 1476315 - protein, 20 aa, Mycobacterium tuberculosis
EVPAAGGPMGMMPMPMGMGG

SEQ ID NO: 1476316 - protein, 18 aa, Mycobacterium tuberculosis
EVRDIRFEQMLLLDDETP

SEQ ID NO: 1476317 - protein, 24 aa, Mycobacterium tuberculosis
EVRLRLLDTLDLFGIALGMAAFRP

SEQ ID NO: 1476318 - protein, 18 aa, Mycobacterium tuberculosis
EVSHARGVGGPGGAGGAG

SEQ ID NO: 1476319 - protein, 19 aa, Mycobacterium tuberculosis
EVVSAAAGDLANVGSTISA

SEQ ID NO: 1476320 - protein, 24 aa, Mycobacterium tuberculosis
EVVSAAAGDLANVGSTISAANKAA

SEQ ID NO: 1476321 - protein, 25 aa, Mycobacterium tuberculosis
EWIEGRRYLGLEVLTRARAALTSTE

SEQ ID NO: 1476322 - protein, 22 aa, Mycobacterium tuberculosis
EWPDRLRRLLSKQVGLILRRTI

SEQ ID NO: 1476323 - protein, 27 aa, Mycobacterium tuberculosis
EWRRGTLPPGRLGVRRAKEIRNRARDL

SEQ ID NO: 1476324 - protein, 20 aa, Mycobacterium tuberculosis
EYCVVKSGFGLEVAKTADVA

SEQ ID NO: 1476325 - protein, 22 aa, Mycobacterium tuberculosis
EYEIKDVWYVVGLRGTGSNTLV

SEQ ID NO: 1476326 - protein, 18 aa, Mycobacterium tuberculosis
EYSPESYTGTELEYAKQV

SEQ ID NO: 1476327 - protein, 32 aa, Mycobacterium tuberculosis
EYVKTPAQVLLRWNLQLGNAVVVRSARPERIA

SEQ ID NO: 1476328 - protein, 17 aa, Mycobacterium tuberculosis
FAASHLRDGAVLLDVSR

SEQ ID NO: 1476329 - protein, 19 aa, Mycobacterium tuberculosis
FADAMAIRTHYFDNFFLDA

SEQ ID NO: 1476330 - protein, 17 aa, Mycobacterium tuberculosis
FADLAEVMAGVFAARRS

SEQ ID NO: 1476331 - protein, 21 aa, Mycobacterium tuberculosis
FADPGNPLAILVPLTAAAMDL

SEQ ID NO: 1476332 - protein, 19 aa, Mycobacterium tuberculosis
FAESRIRPSTIAAEDVLHD

SEQ ID NO: 1476333 - protein, 24 aa, Mycobacterium tuberculosis
FAFTSWKTLGWVDANVWRHVVPKG

SEQ ID NO: 1476334 - protein, 17 aa, Mycobacterium tuberculosis
FAGGVGGAGGEGLTDGA

SEQ ID NO: 1476335 - protein, 17 aa, Mycobacterium tuberculosis
FAGKINRLAIMVRGNLA

SEQ ID NO: 1476336 - protein, 18 aa, Mycobacterium tuberculosis
FALRGDRTMFLFVFRAEH

SEQ ID NO: 1476337 - protein, 23 aa, Mycobacterium tuberculosis
FAQPIPRECRFIYAETAVFGSEI

SEQ ID NO: 1476338 - protein, 18 aa, Mycobacterium tuberculosis
FAVATWNGLVWINLDADA

SEQ ID NO: 1476339 - protein, 18 aa, Mycobacterium tuberculosis
FCDHPLLEPVGACRQCLV

SEQ ID NO: 1476340 - protein, 19 aa, Mycobacterium tuberculosis
FDAKAWRLVDGFDDLTDIT

SEQ ID NO: 1476341 - protein, 18 aa, Mycobacterium tuberculosis
FDAKLGRGPAVAVDDELM

SEQ ID NO: 1476342 - protein, 17 aa, Mycobacterium tuberculosis
FDCEAWIPTQGAYRELT

SEQ ID NO: 1476343 - protein, 18 aa, Mycobacterium tuberculosis
FDDHPWNWAAHVAGQRTP

SEQ ID NO: 1476344 - protein, 19 aa, Mycobacterium tuberculosis
FDGPDDWSANSVFGLPALG

SEQ ID NO: 1476345 - protein, 18 aa, Mycobacterium tuberculosis
FDGTMAGLGGTGGSGGTG

SEQ ID NO: 1476346 - protein, 28 aa, Mycobacterium tuberculosis
FDLDPLLPFPRWHEHAAMVEEPVRRIPG

SEQ ID NO: 1476347 - protein, 26 aa, Mycobacterium tuberculosis
FDQLGAIGIDLTDVFAVLEEEGVRKF

SEQ ID NO: 1476348 - protein, 23 aa, Mycobacterium tuberculosis
FDRIDERLVVVGLDKTVTYKNGD

SEQ ID NO: 1476349 - protein, 25 aa, Mycobacterium tuberculosis
FDTACSSGLMAVHLACRSLHDGEAD

SEQ ID NO: 1476350 - protein, 17 aa, Mycobacterium tuberculosis
FDVHEIVEIGPFTIPQV

SEQ ID NO: 1476351 - protein, 17 aa, Mycobacterium tuberculosis
FEAARAATVHPMLVAAN

SEQ ID NO: 1476352 - protein, 17 aa, Mycobacterium tuberculosis
FEDGGWVWFDITTDTAV

SEQ ID NO: 1476353 - protein, 17 aa, Mycobacterium tuberculosis
FEGTSFGGALMTTTGVE

SEQ ID NO: 1476354 - protein, 25 aa, Mycobacterium tuberculosis
FELDHHINLRPARLYPGVASPLSGN

SEQ ID NO: 1476355 - protein, 17 aa, Mycobacterium tuberculosis
FEMPEGKYIPRLGGMAF

SEQ ID NO: 1476356 - protein, 17 aa, Mycobacterium tuberculosis
FEMPPHLHMAMVQSLLV

SEQ ID NO: 1476357 - protein, 19 aa, Mycobacterium tuberculosis
FEQRPGEALALGQVLDTLV

SEQ ID NO: 1476358 - protein, 21 aa, Mycobacterium tuberculosis
FERGAVESVVRPKTPRGDGNT

SEQ ID NO: 1476359 - protein, 18 aa, Mycobacterium tuberculosis
FFARHGFTEIEGTPVTAE

SEQ ID NO: 1476360 - protein, 18 aa, Mycobacterium tuberculosis
FFEFLTDLLDGWVAYFAE

SEQ ID NO: 1476361 - protein, 18 aa, Mycobacterium tuberculosis
FFRALDYTLPWDVDTVED

SEQ ID NO: 1476362 - protein, 23 aa, Mycobacterium tuberculosis
FGAADPRFACVVRAFASVFPGRR

SEQ ID NO: 1476363 - protein, 24 aa, Mycobacterium tuberculosis
FGHAGGCPHPLVVVAGAATRWVWV

SEQ ID NO: 1476364 - protein, 17 aa, Mycobacterium tuberculosis
FGHDNVTVFAARVRGDV

SEQ ID NO: 1476365 - protein, 17 aa, Mycobacterium tuberculosis
FGLGCVAGAAGVARLHD

SEQ ID NO: 1476366 - protein, 39 aa, Mycobacterium tuberculosis
FGNGGDGGCRRVWRRYRRQRWCRRQRRADRQRRQRRQRR

SEQ ID NO: 1476367 - protein, 24 aa, Mycobacterium tuberculosis
FGPNPLDPLCRVNSAMAGRQQGRR

SEQ ID NO: 1476368 - protein, 25 aa, Mycobacterium tuberculosis
FGQPAADALHAWLVDGRRALVTAES

SEQ ID NO: 1476369 - protein, 19 aa, Mycobacterium tuberculosis
FGQRFPDRLFDVGIAEQHA

SEQ ID NO: 1476370 - protein, 18 aa, Mycobacterium tuberculosis
FGSFGRGQSGVVLEFQRL

SEQ ID NO: 1476371 - protein, 19 aa, Mycobacterium tuberculosis
FGSHAREYQAISTQVAAFH

SEQ ID NO: 1476372 - protein, 18 aa, Mycobacterium tuberculosis
FGSHGQHYQAISAQVAAY

SEQ ID NO: 1476373 - protein, 18 aa, Mycobacterium tuberculosis
FGSSLPVRVCTICTDPWN

SEQ ID NO: 1476374 - protein, 18 aa, Mycobacterium tuberculosis
FGSTHCRPTTHQQVVVPP

SEQ ID NO: 1476375 - protein, 26 aa, Mycobacterium tuberculosis
FGTAGCNLACKFCQNWDISKSREIDV

SEQ ID NO: 1476376 - protein, 19 aa, Mycobacterium tuberculosis
FGTRYGGSAVYFANIMRQI

SEQ ID NO: 1476377 - protein, 18 aa, Mycobacterium tuberculosis
FGVTCTFHGHRRLSPDEV

SEQ ID NO: 1476378 - protein, 19 aa, Mycobacterium tuberculosis
FGVTTSMTFARFPTADCDV

SEQ ID NO: 1476379 - protein, 17 aa, Mycobacterium tuberculosis
FGYPYAIAPPGIGFGSG

SEQ ID NO: 1476380 - protein, 17 aa, Mycobacterium tuberculosis
FHAAIVLGRKSSHDIDP

SEQ ID NO: 1476381 - protein, 17 aa, Mycobacterium tuberculosis
FHERFIQALSTAAGAYG

SEQ ID NO: 1476382 - protein, 24 aa, Mycobacterium tuberculosis
FHSGDLNTGFGSPVDQPVMNSGFG

SEQ ID NO: 1476383 - protein, 18 aa, Mycobacterium tuberculosis
FIDRLRCAERAIAVARRG

SEQ ID NO: 1476384 - protein, 26 aa, Mycobacterium tuberculosis
FIGRMSGVSPSVWGGLAAARFQDVVD

SEQ ID NO: 1476385 - protein, 26 aa, Mycobacterium tuberculosis
FIGVDGYRWMIRCVVNGPQETVDALT

SEQ ID NO: 1476386 - protein, 20 aa, Mycobacterium tuberculosis
FIVTEIFPGGRLPSIPMVQE

SEQ ID NO: 1476387 - protein, 19 aa, Mycobacterium tuberculosis
FLDSARGVHQFLGRRRFVY

SEQ ID NO: 1476388 - protein, 19 aa, Mycobacterium tuberculosis
FLEEPRLAARVAGARTRGG

SEQ ID NO: 1476389 - protein, 20 aa, Mycobacterium tuberculosis
FLEEPRLAARVAGARTRGGY

SEQ ID NO: 1476390 - protein, 18 aa, Mycobacterium tuberculosis
FLGAPFWVGRGFGLNLSV

SEQ ID NO: 1476391 - protein, 26 aa, Mycobacterium tuberculosis
FLNSPLSDFFIKWMSRINTWMYRRND

SEQ ID NO: 1476392 - protein, 18 aa, Mycobacterium tuberculosis
FLPAVARMRALDPVTSEL

SEQ ID NO: 1476393 - protein, 17 aa, Mycobacterium tuberculosis
FLPDKAIDLVDEAASRL

SEQ ID NO: 1476394 - protein, 25 aa, Mycobacterium tuberculosis
FLSAELPDWLAANRGLAPGGHAAVG

SEQ ID NO: 1476395 - protein, 18 aa, Mycobacterium tuberculosis
FLSGGFLAPPGRAPVLVY

SEQ ID NO: 1476396 - protein, 21 aa, Mycobacterium tuberculosis
FLTEKKCAITAYPDRGFTNAG

SEQ ID NO: 1476397 - protein, 17 aa, Mycobacterium tuberculosis
FNCTGWKIGWACGPAEL

SEQ ID NO: 1476398 - protein, 18 aa, Mycobacterium tuberculosis
FNGAPGFGGPGGSGGASL

SEQ ID NO: 1476399 - protein, 28 aa, Mycobacterium tuberculosis
FNIWGRPDLRRWLPLDVYRPLKSTLVTL

SEQ ID NO: 1476400 - protein, 24 aa, Mycobacterium tuberculosis
FNPGTLNTGFFSAMTQAGPNSGFF

SEQ ID NO: 1476401 - protein, 17 aa, Mycobacterium tuberculosis
FNSRFPGTLVVPDVLIP

SEQ ID NO: 1476402 - protein, 21 aa, Mycobacterium tuberculosis
FPFLRQIIANHQVYWQQIAAA

SEQ ID NO: 1476403 - protein, 25 aa, Mycobacterium tuberculosis
FPGKRAPTVQLCRDPRGYVPVGTNP

SEQ ID NO: 1476404 - protein, 20 aa, Mycobacterium tuberculosis
FPLACPGLLGAMTVGATAVF

SEQ ID NO: 1476405 - protein, 17 aa, Mycobacterium tuberculosis
FPLPRELVGEGTLFLLK

SEQ ID NO: 1476406 - protein, 19 aa, Mycobacterium tuberculosis
FPPAGTLSGIAKRELRGVP

SEQ ID NO: 1476407 - protein, 18 aa, Mycobacterium tuberculosis
FPQIGGFANTPPAFINTG

SEQ ID NO: 1476408 - protein, 23 aa, Mycobacterium tuberculosis
FPSLSSSVPILGPYEDLIANTVA

SEQ ID NO: 1476409 - protein, 18 aa, Mycobacterium tuberculosis
FPTPACARLTEQNLQGFR

SEQ ID NO: 1476410 - protein, 17 aa, Mycobacterium tuberculosis
FPVAPFPAVIKNRERAS

SEQ ID NO: 1476411 - protein, 21 aa, Mycobacterium tuberculosis
FPVLPPEINSVLMYSGAGSSP

SEQ ID NO: 1476412 - protein, 18 aa, Mycobacterium tuberculosis
FQAIEARGGFVEAHDFLA

SEQ ID NO: 1476413 - protein, 21 aa, Mycobacterium tuberculosis
FQATAVIPVIGPVTVTLEGTP

SEQ ID NO: 1476414 - protein, 17 aa, Mycobacterium tuberculosis
FQDGIAFVHAEDPGYAT

SEQ ID NO: 1476415 - protein, 21 aa, Mycobacterium tuberculosis
FQHYLGEPLGGFTGWRPQLPV

SEQ ID NO: 1476416 - protein, 19 aa, Mycobacterium tuberculosis
FQVLCEAGLLPGALTRNVG

SEQ ID NO: 1476417 - protein, 18 aa, Mycobacterium tuberculosis
FRDKIKWRTGSEGRINHL

SEQ ID NO: 1476418 - protein, 19 aa, Mycobacterium tuberculosis
FRFDLASTLARELHDVDRL

SEQ ID NO: 1476419 - protein, 19 aa, Mycobacterium tuberculosis
FRRPRVVVEGAGDLGDQGL

SEQ ID NO: 1476420 - protein, 18 aa, Mycobacterium tuberculosis
FRRTIKWRTGCEGRISHL

SEQ ID NO: 1476421 - protein, 19 aa, Mycobacterium tuberculosis
FRTARELREAVPLMPVEQL

SEQ ID NO: 1476422 - protein, 19 aa, Mycobacterium tuberculosis
FRTRRYRPLHRPSDTDNRS

SEQ ID NO: 1476423 - protein, 20 aa, Mycobacterium tuberculosis
FSAASAFQSVVWGLTTGSWI

SEQ ID NO: 1476424 - protein, 19 aa, Mycobacterium tuberculosis
FSAHAQEYQALSAQAAAFH

SEQ ID NO: 1476425 - protein, 23 aa, Mycobacterium tuberculosis
FSDFPDRPDNLLAVANAAIGAAI

SEQ ID NO: 1476426 - protein, 17 aa, Mycobacterium tuberculosis
FSDYATHYQSLNAQAAA

SEQ ID NO: 1476427 - protein, 17 aa, Mycobacterium tuberculosis
FSGRAQVGKGMWTMTEL

SEQ ID NO: 1476428 - protein, 18 aa, Mycobacterium tuberculosis
FSGWQSTRQRVWGQMDSA

SEQ ID NO: 1476429 - protein, 17 aa, Mycobacterium tuberculosis
FSVARRLALLLTFPRFL

SEQ ID NO: 1476430 - protein, 17 aa, Mycobacterium tuberculosis
FTAAEALEYGFVDHIIT

SEQ ID NO: 1476431 - protein, 17 aa, Mycobacterium tuberculosis
FTIPAQTPVTVGMEVAN

SEQ ID NO: 1476432 - protein, 18 aa, Mycobacterium tuberculosis
FTIPGGTLIPTLPLGLAL

SEQ ID NO: 1476433 - protein, 24 aa, Mycobacterium tuberculosis
FTPKIRFWHVESAPRVRSLAKSLA

SEQ ID NO: 1476434 - protein, 17 aa, Mycobacterium tuberculosis
FTPSELLAAGRRIAELE

SEQ ID NO: 1476435 - protein, 17 aa, Mycobacterium tuberculosis
FVDAMCRKALRLTPEDT

SEQ ID NO: 1476436 - protein, 25 aa, Mycobacterium tuberculosis
FVSAIDVLLGLGWLAPSHVDQWRQG

SEQ ID NO: 1476437 - protein, 26 aa, Mycobacterium tuberculosis
FVSGAAGNLARLGSMISAANSAAAAQ

SEQ ID NO: 1476438 - protein, 25 aa, Mycobacterium tuberculosis
FWRDAANPPGLWRRTTLDSYRTDSP

SEQ ID NO: 1476439 - protein, 18 aa, Mycobacterium tuberculosis
FYAYAEILLALGRGDEAL

SEQ ID NO: 1476440 - protein, 18 aa, Mycobacterium tuberculosis
FYDHVKRGDIVEVVNTVG

SEQ ID NO: 1476441 - protein, 19 aa, Mycobacterium tuberculosis
GAAAPRVVTPDVLVHTPQV

SEQ ID NO: 1476442 - protein, 23 aa, Mycobacterium tuberculosis
GAAGGAGGWLFGNGGNGGHGATN

SEQ ID NO: 1476443 - protein, 17 aa, Mycobacterium tuberculosis
GAALPWPASSADGTARP

SEQ ID NO: 1476444 - protein, 22 aa, Mycobacterium tuberculosis
GAALRFAPPLVITAQEIDCAVR

SEQ ID NO: 1476445 - protein, 25 aa, Mycobacterium tuberculosis
GAAQRAGIELLAFGGRFVEIGKRDI

SEQ ID NO: 1476446 - protein, 18 aa, Mycobacterium tuberculosis
GAATLLFCDPMLQRFPAT

SEQ ID NO: 1476447 - protein, 17 aa, Mycobacterium tuberculosis
GAAVAIGGDGGAGGRAG

SEQ ID NO: 1476448 - protein, 26 aa, Mycobacterium tuberculosis
GAAVTGGPRGARGAAGDIAAVAAGPA

SEQ ID NO: 1476449 - protein, 17 aa, Mycobacterium tuberculosis
GACIGPMGQRVRNVMSE

SEQ ID NO: 1476450 - protein, 17 aa, Mycobacterium tuberculosis
GACLSEYGAMASADLSQ

SEQ ID NO: 1476451 - protein, 21 aa, Mycobacterium tuberculosis
GADAAYVCRGRVCDLPVTSAA

SEQ ID NO: 1476452 - protein, 18 aa, Mycobacterium tuberculosis
GADESLRCETPEYDRGVR

SEQ ID NO: 1476453 - protein, 25 aa, Mycobacterium tuberculosis
GADEVSAAVAALFSGHAQTYQALRT

SEQ ID NO: 1476454 - protein, 25 aa, Mycobacterium tuberculosis
GADEVSAAVAALFSGHAQTYQALST

SEQ ID NO: 1476455 - protein, 25 aa, Mycobacterium tuberculosis
GADEVSTAVAALFGAHGQAYQALSA

SEQ ID NO: 1476456 - protein, 26 aa, Mycobacterium tuberculosis
GADEVSTAVAALFGAHGQAYQALSAQ

SEQ ID NO: 1476457 - protein, 28 aa, Mycobacterium tuberculosis
GADEVSTAVAALFGAHGQAYQALSAQAQ

SEQ ID NO: 1476458 - protein, 25 aa, Mycobacterium tuberculosis
GADFKRPAPHWWFDDATLYGPDGLA

SEQ ID NO: 1476459 - protein, 18 aa, Mycobacterium tuberculosis
GADGEVGGAGGAGGSGPN

SEQ ID NO: 1476460 - protein, 17 aa, Mycobacterium tuberculosis
GADGRVIVACFASNVDR

SEQ ID NO: 1476461 - protein, 21 aa, Mycobacterium tuberculosis
GADSLKGLCPFHNEKSPSFHV

SEQ ID NO: 1476462 - protein, 17 aa, Mycobacterium tuberculosis
GADWIKVMATGGFVTTA

SEQ ID NO: 1476463 - protein, 25 aa, Mycobacterium tuberculosis
GAELRRPLDHCRGVAGALQPVGERR

SEQ ID NO: 1476464 - protein, 19 aa, Mycobacterium tuberculosis
GAFADPAGGTGIFAPGMTG

SEQ ID NO: 1476465 - protein, 19 aa, Mycobacterium tuberculosis
GAGCCDLAFAAPEAARTRK

SEQ ID NO: 1476466 - protein, 24 aa, Mycobacterium tuberculosis
GAGDRGGAGGTGFISSDGGAGGDG

SEQ ID NO: 1476467 - protein, 24 aa, Mycobacterium tuberculosis
GAGGDGGGALGVLGGMGGDGGDGG

SEQ ID NO: 1476468 - protein, 25 aa, Mycobacterium tuberculosis
GAGGDGGNAGFFGNGGNGGMGGAGA

SEQ ID NO: 1476469 - protein, 25 aa, Mycobacterium tuberculosis
GAGGDRAGALVGRDGGPGGNGGAGG

SEQ ID NO: 1476470 - protein, 18 aa, Mycobacterium tuberculosis
GAGGHLFGNGGSGGHGGA

SEQ ID NO: 1476471 - protein, 18 aa, Mycobacterium tuberculosis
GAGGILWGNGGAGGSGAP

SEQ ID NO: 1476472 - protein, 22 aa, Mycobacterium tuberculosis
GAGGLFGVSGSSGLGGAAGSGG

SEQ ID NO: 1476473 - protein, 21 aa, Mycobacterium tuberculosis
GAGGLISLLGGQGAGGAGGTG

SEQ ID NO: 1476474 - protein, 17 aa, Mycobacterium tuberculosis
GAGGLLFGNGGNGAAGA

SEQ ID NO: 1476475 - protein, 29 aa, Mycobacterium tuberculosis
GAGGTGGNAAWLLGGGGTGGAGGIGGGNG

SEQ ID NO: 1476476 - protein, 18 aa, Mycobacterium tuberculosis
GAGGTVFGGGKGGAGGAG

SEQ ID NO: 1476477 - protein, 19 aa, Mycobacterium tuberculosis
GAGPPRPALAAALAGSCSA

SEQ ID NO: 1476478 - protein, 20 aa, Mycobacterium tuberculosis
GAGQLLSHSGVAGASGKGGA

SEQ ID NO: 1476479 - protein, 19 aa, Mycobacterium tuberculosis
GAGSAGAWFEDRVTTKIRA

SEQ ID NO: 1476480 - protein, 19 aa, Mycobacterium tuberculosis
GAIEACARKLFVHPNTVRY

SEQ ID NO: 1476481 - protein, 17 aa, Mycobacterium tuberculosis
GAIPDRGLFAVYLATER

SEQ ID NO: 1476482 - protein, 19 aa, Mycobacterium tuberculosis
GAIYEAWASQSYERGPLGL

SEQ ID NO: 1476483 - protein, 17 aa, Mycobacterium tuberculosis
GALDPITIFPGGYTIDP

SEQ ID NO: 1476484 - protein, 30 aa, Mycobacterium tuberculosis
GALESRTITFLKIDPAPGIGNSTTNPSSGF

SEQ ID NO: 1476485 - protein, 19 aa, Mycobacterium tuberculosis
GALGLMKAVLALQHGVVPQ

SEQ ID NO: 1476486 - protein, 25 aa, Mycobacterium tuberculosis
GALHPQHLMRVGRAFHQLLAHLDVV

SEQ ID NO: 1476487 - protein, 27 aa, Mycobacterium tuberculosis
GALLLRGSPCAIGWVAGWLSAEFPALV

SEQ ID NO: 1476488 - protein, 27 aa, Mycobacterium tuberculosis
GALLLRGSPCAIGWVAGWLSAEFPARV

SEQ ID NO: 1476489 - protein, 26 aa, Mycobacterium tuberculosis
GALVTLDWLGAHGFGRLLQHTVVVLN

SEQ ID NO: 1476490 - protein, 18 aa, Mycobacterium tuberculosis
GAPGGFGGGAGAGGLGGS

SEQ ID NO: 1476491 - protein, 31 aa, Mycobacterium tuberculosis; identical to SEQ ID NO: 199528

SEQ ID NO: 1476492 - protein, 18 aa, Mycobacterium tuberculosis
GAPGQWWQQQVVLGLQRS

SEQ ID NO: 1476493 - protein, 23 aa, Mycobacterium tuberculosis
GAPGSDALALGQPGGNGGQGDAG

SEQ ID NO: 1476494 - protein, 23 aa, Mycobacterium tuberculosis
GAPLAPLPISGRPVAARTGALIE

SEQ ID NO: 1476495 - protein, 29 aa, Mycobacterium tuberculosis
GAPLAPLPISGRPVFARKNSLIGSSSGDT

SEQ ID NO: 1476496 - protein, 19 aa, Mycobacterium tuberculosis
GAPRRGRKSKRQKRQEYDS

SEQ ID NO: 1476497 - protein, 17 aa, Mycobacterium tuberculosis
GARSVAGLVAWKMGCSS

SEQ ID NO: 1476498 - protein, 19 aa, Mycobacterium tuberculosis
GASEGWCPYCGSPYSFLPQ

SEQ ID NO: 1476499 - protein, 23 aa, Mycobacterium tuberculosis
GATRPALQLSRALLGNQGLGGTA

SEQ ID NO: 1476500 - protein, 24 aa, Mycobacterium tuberculosis
GATVGFAGSGGFGGAGGIAQLFGT

SEQ ID NO: 1476501 - protein, 27 aa, Mycobacterium tuberculosis
GAVGGKRGTGGLLFGNGGAGGQGGLGL

SEQ ID NO: 1476502 - protein, 27 aa, Mycobacterium tuberculosis
GAVGGVGGNGGWLYGNGGAGGLGGTGV

SEQ ID NO: 1476503 - protein, 28 aa, Mycobacterium tuberculosis
GAVGGVGGNGGWLYGNGGAGGLGGTGVA

SEQ ID NO: 1476504 - protein, 22 aa, Mycobacterium tuberculosis
GAVSAWVELHARFGRLPFETLF

SEQ ID NO: 1476505 - protein, 22 aa, Mycobacterium tuberculosis
GAWLVCRAAGRVLLEQGQGGSV

SEQ ID NO: 1476506 - protein, 17 aa, Mycobacterium tuberculosis
GCGQPGGSIQVRIFDHQ

SEQ ID NO: 1476507 - protein, 27 aa, Mycobacterium tuberculosis
GCVNQTRILAPRSRYDEIVAAVTNFVT

SEQ ID NO: 1476508 - protein, 17 aa, Mycobacterium tuberculosis
GDAGLLFGAAGTGGHGA

SEQ ID NO: 1476509 - protein, 25 aa, Mycobacterium tuberculosis
GDAHTWLRDHGVSLDAPARPRPVTA

SEQ ID NO: 1476510 - protein, 25 aa, Mycobacterium tuberculosis
GDALAADVRRADCQIVVTDADHRAL

SEQ ID NO: 1476511 - protein, 23 aa, Mycobacterium tuberculosis
GDAWLNRHLSAYANWAKTNNSLL

SEQ ID NO: 1476512 - protein, 24 aa, Mycobacterium tuberculosis
GDFAYDVSHLELPLPADGSTMPST

SEQ ID NO: 1476513 - protein, 21 aa, Mycobacterium tuberculosis
GDGFARYWLHNGWVTMGGEKM

SEQ ID NO: 1476514 - protein, 32 aa, Mycobacterium tuberculosis; identical to SEQ ID NO: 209391

SEQ ID NO: 1476515 - protein, 31 aa, Mycobacterium tuberculosis; identical to SEQ ID NO: 209392

SEQ ID NO: 1476516 - protein, 20 aa, Mycobacterium tuberculosis
GDLFGGLFGRGGSARPSRPR

SEQ ID NO: 1476517 - protein, 19 aa, Mycobacterium tuberculosis
GDLLLLRQGQLLAHTTPHR

SEQ ID NO: 1476518 - protein, 28 aa, Mycobacterium tuberculosis
GDRGFYAGAVGWCDGRGDGHWVVSIRCA

SEQ ID NO: 1476519 - protein, 20 aa, Mycobacterium tuberculosis
GDTAAMRPFLLVASFVNPHD

SEQ ID NO: 1476520 - protein, 25 aa, Mycobacterium tuberculosis
GDTDLAWSRITYWRALLTSAVDQPR

SEQ ID NO: 1476521 - protein, 18 aa, Mycobacterium tuberculosis
GDTGITYQAWQAQWNQAM

SEQ ID NO: 1476522 - protein, 17 aa, Mycobacterium tuberculosis
GDVWRFVDTAGLRRKVG

SEQ ID NO: 1476523 - protein, 17 aa, Mycobacterium tuberculosis
GEARQGRRGRRFRDRRR

SEQ ID NO: 1476524 - protein, 18 aa, Mycobacterium tuberculosis
GEFIPRPVKSSFREGLTV

SEQ ID NO: 1476525 - protein, 20 aa, Mycobacterium tuberculosis
GEGAAAYGVLVTRPDGTRVE

SEQ ID NO: 1476526 - protein, 23 aa, Mycobacterium tuberculosis
GEGFRACKRCRPDASPGSPEWNV

SEQ ID NO: 1476527 - protein, 18 aa, Mycobacterium tuberculosis
GEICRRLDGVPLAIELAA

SEQ ID NO: 1476528 - protein, 20 aa, Mycobacterium tuberculosis
GEIDPSLRLRPSRGTHLVFD

SEQ ID NO: 1476529 - protein, 18 aa, Mycobacterium tuberculosis
GELARMCGVAAVPDSAMV

SEQ ID NO: 1476530 - protein, 17 aa, Mycobacterium tuberculosis
GELEPSRIVRHMREVEA

SEQ ID NO: 1476531 - protein, 31 aa, Mycobacterium tuberculosis
GELLKPFARRYFQAIPGVWARRSSEVAQSVV

SEQ ID NO: 1476532 - protein, 19 aa, Mycobacterium tuberculosis
GELRRPVVHADDLVAVSAK

SEQ ID NO: 1476533 - protein, 23 aa, Mycobacterium tuberculosis
GEPAPHVKPAALAEQPGVPGQHA

SEQ ID NO: 1476534 - protein, 20 aa, Mycobacterium tuberculosis
GERIRVVRRVHLRYEGTDTA

SEQ ID NO: 1476535 - protein, 24 aa, Mycobacterium tuberculosis
GESDWNALNLFTGWVDVGLTDKGQ

SEQ ID NO: 1476536 - protein, 19 aa, Mycobacterium tuberculosis
GEVVRRCYTDVLAAARPAT

SEQ ID NO: 1476537 - protein, 43 aa, Mycobacterium tuberculosis
GFAGFGGSAGGGGWVGAVNFGPISVQGFGLFGHGGDGGNGGDV

SEQ ID NO: 1476538 - protein, 21 aa, Mycobacterium tuberculosis
GFERSKYASGEFFDKYTDRIW

SEQ ID NO: 1476539 - protein, 25 aa, Mycobacterium tuberculosis
GFGGNGFAGVGGRGGMGGSGGTGGT

SEQ ID NO: 1476540 - protein, 24 aa, Mycobacterium tuberculosis
GFGSEAPGRPGGAGGTGGAGGNGG

SEQ ID NO: 1476541 - protein, 19 aa, Mycobacterium tuberculosis
GFGTLLLLGHDWAPPPATF

SEQ ID NO: 1476542 - protein, 26 aa, Mycobacterium tuberculosis
GFLDAAVGIRCRPEPGAGRLQRAHHL

SEQ ID NO: 1476543 - protein, 18 aa, Mycobacterium tuberculosis
GFNPPGIECERYDLRSNI

SEQ ID NO: 1476544 - protein, 18 aa, Mycobacterium tuberculosis
GFSCYVHPEIEFFLLKPG

SEQ ID NO: 1476545 - protein, 17 aa, Mycobacterium tuberculosis
GFSFFDGNGGDGGTGGT

SEQ ID NO: 1476546 - protein, 18 aa, Mycobacterium tuberculosis
GFVGLRVVPWLWGAPPTD

SEQ ID NO: 1476547 - protein, 17 aa, Mycobacterium tuberculosis
GFVPAGTTISVYTSDGQ

SEQ ID NO: 1476548 - protein, 25 aa, Mycobacterium tuberculosis
GGAAGARGALTSGGLAGGVGAGGTG

SEQ ID NO: 1476549 - protein, 26 aa, Mycobacterium tuberculosis
GGAAGARGALTSGGLAGGVGAGGTGG

SEQ ID NO: 1476550 - protein, 17 aa, Mycobacterium tuberculosis
GGAAGLFGNGGAGGAGG

SEQ ID NO: 1476551 - protein, 19 aa, Mycobacterium tuberculosis
GGAAGLWGAGGGGGNGGNG

SEQ ID NO: 1476552 - protein, 18 aa, Mycobacterium tuberculosis
GGAAINILANAGAGGAGG

SEQ ID NO: 1476553 - protein, 17 aa, Mycobacterium tuberculosis
GGADPVADCPEAGEPVG

SEQ ID NO: 1476554 - protein, 17 aa, Mycobacterium tuberculosis
GGAEMHALISGLADYFA

SEQ ID NO: 1476555 - protein, 20 aa, Mycobacterium tuberculosis
GGAGGFSFSTAGGAGGAGGA

SEQ ID NO: 1476556 - protein, 19 aa, Mycobacterium tuberculosis
GGAGGILWGNGGNGGSGAP

SEQ ID NO: 1476557 - protein, 26 aa, Mycobacterium tuberculosis
GGAGGKADIANSLGDNATVTGGNGGT

SEQ ID NO: 1476558 - protein, 22 aa, Mycobacterium tuberculosis
GGAGGNGAWLFGNGGAGGGGGK

SEQ ID NO: 1476559 - protein, 25 aa, Mycobacterium tuberculosis
GGAGGQAALLFGRGGTGGAGGYGGD

SEQ ID NO: 1476560 - protein, 22 aa, Mycobacterium tuberculosis
GGAGGRGGDAGLLFGAAGTGGH

SEQ ID NO: 1476561 - protein, 22 aa, Mycobacterium tuberculosis
GGAGGSGGWLLGNGGVGGAGGQ

SEQ ID NO: 1476562 - protein, 22 aa, Mycobacterium tuberculosis
GGAGGTGGWLFGNGGAGGNSGG

SEQ ID NO: 1476563 - protein, 19 aa, Mycobacterium tuberculosis
GGAHFCLGANLARREIRVA

SEQ ID NO: 1476564 - protein, 22 aa, Mycobacterium tuberculosis
GGALRLPSSVVSWLPLYHDMGL

SEQ ID NO: 1476565 - protein, 25 aa, Mycobacterium tuberculosis
GGAPKGWGWVAPYIGMIWPNGDSTK

SEQ ID NO: 1476566 - protein, 18 aa, Mycobacterium tuberculosis
GGAVLPVYDPLFDSKKLR

SEQ ID NO: 1476567 - protein, 18 aa, Mycobacterium tuberculosis
GGDAWVRAMMLVDAGVDV

SEQ ID NO: 1476568 - protein, 19 aa, Mycobacterium tuberculosis
GGDGGGRGIFGQFGAGGAG

SEQ ID NO: 1476569 - protein, 24 aa, Mycobacterium tuberculosis
GGDGGKGGSGLGVGGAGGTGGAGG

SEQ ID NO: 1476570 - protein, 27 aa, Mycobacterium tuberculosis
GGDGGRGAHGTLFSSLAGTGGTGGNGG

SEQ ID NO: 1476571 - protein, 26 aa, Mycobacterium tuberculosis
GGDGVFEGIAVLGLGFGGAAGAGGAA

SEQ ID NO: 1476572 - protein, 20 aa, Mycobacterium tuberculosis
GGEGGEVGGAGGTGGAAGNG

SEQ ID NO: 1476573 - protein, 22 aa, Mycobacterium tuberculosis
GGEGTLTAASWLSEENVPVVGV

SEQ ID NO: 1476574 - protein, 25 aa, Mycobacterium tuberculosis
GGEITARFLISACGILTVPKLPDID

SEQ ID NO: 1476575 - protein, 26 aa, Mycobacterium tuberculosis
GGFETGRRFPCDVVDDLVEGVTDGQF

SEQ ID NO: 1476576 - protein, 18 aa, Mycobacterium tuberculosis
GGFGGVEGLRGWLREERI

SEQ ID NO: 1476577 - protein, 27 aa, Mycobacterium tuberculosis
GGGAALGSPGWAFGVLAAAGGGGATGV

SEQ ID NO: 1476578 - protein, 22 aa, Mycobacterium tuberculosis
GGGAALPFKRRLFGQIVAAAVR

SEQ ID NO: 1476579 - protein, 21 aa, Mycobacterium tuberculosis
GGGARGFAHLGVLDELERVGV

SEQ ID NO: 1476580 - protein, 18 aa, Mycobacterium tuberculosis
GGGDGFAVLGLDYLDGDV

SEQ ID NO: 1476581 - protein, 20 aa, Mycobacterium tuberculosis
GGGGDGFDGTMAGLGGTGGS

SEQ ID NO: 1476582 - protein, 19 aa, Mycobacterium tuberculosis
GGGGFSILLGLGGLGGLGS

SEQ ID NO: 1476583 - protein, 20 aa, Mycobacterium tuberculosis
GGGGNFGVTTSMTFARFPTA

SEQ ID NO: 1476584 - protein, 30 aa, Mycobacterium tuberculosis; identical to SEQ ID NO: 199828

SEQ ID NO: 1476585 - protein, 31 aa, Mycobacterium tuberculosis; identical to SEQ ID NO: 199831

SEQ ID NO: 1476586 - protein, 21 aa, Mycobacterium tuberculosis
GGGSFGLPGLNGSGGDGGDGG

SEQ ID NO: 1476587 - protein, 29 aa, Mycobacterium tuberculosis
GGGTGGAGGHAWLFGHGGTGGIGGGPGGN

SEQ ID NO: 1476588 - protein, 20 aa, Mycobacterium tuberculosis
GGGVKRCLGANFSMRELITV

SEQ ID NO: 1476589 - protein, 19 aa, Mycobacterium tuberculosis
GGHGAEGVAGAAGEDLSPH

SEQ ID NO: 1476590 - protein, 23 aa, Mycobacterium tuberculosis
GGHGGAGGLIWGNGGAGGNGGNG

SEQ ID NO: 1476591 - protein, 22 aa, Mycobacterium tuberculosis
GGIGGAAINILANAGAGGAGGA

SEQ ID NO: 1476592 - protein, 31 aa, Mycobacterium tuberculosis; identical to SEQ ID NO: 199836

SEQ ID NO: 1476593 - protein, 21 aa, Mycobacterium tuberculosis
GGISRKADKWVPLLENRTPVV

SEQ ID NO: 1476594 - protein, 18 aa, Mycobacterium tuberculosis
GGKAGLYGNGGDGGAGGD

SEQ ID NO: 1476595 - protein, 18 aa, Mycobacterium tuberculosis
GGLGCGAHRVIDRCSQQR

SEQ ID NO: 1476596 - protein, 20 aa, Mycobacterium tuberculosis
GGLGGLGLFLAEKMANAGAG

SEQ ID NO: 1476597 - protein, 25 aa, Mycobacterium tuberculosis
GGLGGQLLGRDGFNAPASTPLHTLQ

SEQ ID NO: 1476598 - protein, 21 aa, Mycobacterium tuberculosis
GGLGGRAGLIGHGGAGGNGGD

SEQ ID NO: 1476599 - protein, 23 aa, Mycobacterium tuberculosis
GGLGSAFGPGGTGGMGGAGGTST

SEQ ID NO: 1476600 - protein, 17 aa, Mycobacterium tuberculosis
GGLHRFLLSAASAFVAG

SEQ ID NO: 1476601 - protein, 19 aa, Mycobacterium tuberculosis
GGLISLLGGQGAGGAGGTG

SEQ ID NO: 1476602 - protein, 18 aa, Mycobacterium tuberculosis
GGLLPAWSPGGHIDVQLP

SEQ ID NO: 1476603 - protein, 27 aa, Mycobacterium tuberculosis
GGLSVPHSWNLPPAVRQVAAMFPGATP

SEQ ID NO: 1476604 - protein, 23 aa, Mycobacterium tuberculosis
GGMGGNGGLVFGNGGPGGLGGPG

SEQ ID NO: 1476605 - protein, 22 aa, Mycobacterium tuberculosis
GGNAGAGGTGFTQGADGNAGNG

SEQ ID NO: 1476606 - protein, 25 aa, Mycobacterium tuberculosis
GGNAVIPGDGVGKAPHGDAGGSGGD

SEQ ID NO: 1476607 - protein, 22 aa, Mycobacterium tuberculosis
GGNEPSRTWFAAMKPIANNFGE

SEQ ID NO: 1476608 - protein, 26 aa, Mycobacterium tuberculosis
GGNGGHGGNGGWLLGNGGNGGLGGDG

SEQ ID NO: 1476609 - protein, 27 aa, Mycobacterium tuberculosis
GGNGGKGGTGLMPGINGTGGAGGSRGQ

SEQ ID NO: 1476610 - protein, 28 aa, Mycobacterium tuberculosis
GGNGGKGGTGLMPGINGTGGAGGSRGQI

SEQ ID NO: 1476611 - protein, 23 aa, Mycobacterium tuberculosis
GGNGGLSLGLGVAGGAGGAGGSG

SEQ ID NO: 1476612 - protein, 17 aa, Mycobacterium tuberculosis
GGNGHDSNAPGGAGGSG

SEQ ID NO: 1476613 - protein, 18 aa, Mycobacterium tuberculosis
GGNGLALNGGNGIGGNGG

SEQ ID NO: 1476614 - protein, 21 aa, Mycobacterium tuberculosis
GGPGGVGVPDGIGGANGAQGK

SEQ ID NO: 1476615 - protein, 25 aa, Mycobacterium tuberculosis
GGQGGHGGNAILFGQGGAGGPGGTG

SEQ ID NO: 1476616 - protein, 30 aa, Mycobacterium tuberculosis; identical to SEQ ID NO: 199868

SEQ ID NO: 1476617 - protein, 21 aa, Mycobacterium tuberculosis
GGSGGLGGLLFGQTGTAGVSP

SEQ ID NO: 1476618 - protein, 18 aa, Mycobacterium tuberculosis
GGSSIGVSRVSSWDQLPA

SEQ ID NO: 1476619 - protein, 18 aa, Mycobacterium tuberculosis
GGSVRWDPTNGQGRVYYG

SEQ ID NO: 1476620 - protein, 23 aa, Mycobacterium tuberculosis
GGTAGFTGSGGIGGNGGAGGTGG

SEQ ID NO: 1476621 - protein, 28 aa, Mycobacterium tuberculosis
GGTGGLGDPRVGGSGGDGGTGGSGGAAG

SEQ ID NO: 1476622 - protein, 19 aa, Mycobacterium tuberculosis
GGTPGDWGTGGTGGTGGTG

SEQ ID NO: 1476623 - protein, 25 aa, Mycobacterium tuberculosis
GGVAQGDIASAFGGDGGNGSDGVAA

SEQ ID NO: 1476624 - protein, 28 aa, Mycobacterium tuberculosis
GGVGGNGGRGGWLLGNGGAGGVGGVGGA

SEQ ID NO: 1476625 - protein, 17 aa, Mycobacterium tuberculosis
GGVGGNGVDGFDINETT

SEQ ID NO: 1476626 - protein, 18 aa, Mycobacterium tuberculosis
GGVGLSLGQRQRLGLARA

SEQ ID NO: 1476627 - protein, 18 aa, Mycobacterium tuberculosis
GGVHKCIGMVFGQLEIKT

SEQ ID NO: 1476628 - protein, 17 aa, Mycobacterium tuberculosis
GGVYLDIPGDVLGQAVE

SEQ ID NO: 1476629 - protein, 24 aa, Mycobacterium tuberculosis
GGYHVLRAAWPHFREQSYGRVVVA

SEQ ID NO: 1476630 - protein, 18 aa, Mycobacterium tuberculosis
GHGFLDWPAGAREATTAR

SEQ ID NO: 1476631 - protein, 25 aa, Mycobacterium tuberculosis
GHGGNGGNPGWLLGTAGGGGNGGAG

SEQ ID NO: 1476632 - protein, 17 aa, Mycobacterium tuberculosis
GHLEAAAGVAGFIKAVL

SEQ ID NO: 1476633 - protein, 21 aa, Mycobacterium tuberculosis
GHPESLVNWDALAALTGTIVL

SEQ ID NO: 1476634 - protein, 26 aa, Mycobacterium tuberculosis
GHRLLETWHPLGVVGVITAFNFPVAV

SEQ ID NO: 1476635 - protein, 18 aa, Mycobacterium tuberculosis
GHRNGGVVLLMWAGILAY

SEQ ID NO: 1476636 - protein, 23 aa, Mycobacterium tuberculosis
GHTYAFDDTVAWLAVACSKTAVC

SEQ ID NO: 1476637 - protein, 19 aa, Mycobacterium tuberculosis
GIADARRVLVALRAVGGHR

SEQ ID NO: 1476638 - protein, 25 aa, Mycobacterium tuberculosis
GIAERLRPSGVIQREIAMRTVAVFA

SEQ ID NO: 1476639 - protein, 18 aa, Mycobacterium tuberculosis
GIARELSDLPGAVPRMYV

SEQ ID NO: 1476640 - protein, 17 aa, Mycobacterium tuberculosis
GICNGFQVLCEAGLLPG

SEQ ID NO: 1476641 - protein, 20 aa, Mycobacterium tuberculosis
GIGNTGNWNIGIGITGNGQI

SEQ ID NO: 1476642 - protein, 19 aa, Mycobacterium tuberculosis
GIGVSRLVAVVAEQHHDEL

SEQ ID NO: 1476643 - protein, 25 aa, Mycobacterium tuberculosis
GIQAIKGVEIGDGFQTARRRGSRAH

SEQ ID NO: 1476644 - protein, 25 aa, Mycobacterium tuberculosis
GIRVDGNDVLACYAVMAEAAARARA

SEQ ID NO: 1476645 - protein, 19 aa, Mycobacterium tuberculosis
GITGLDFDNGTVFLNKPVI

SEQ ID NO: 1476646 - protein, 19 aa, Mycobacterium tuberculosis
GIVPALVNYAPTQLAQAIA

SEQ ID NO: 1476647 - protein, 23 aa, Mycobacterium tuberculosis
GKDRPELASALGAAGQVFTTGVP

SEQ ID NO: 1476648 - protein, 18 aa, Mycobacterium tuberculosis
GKELAEAYASMDVFVHSG

SEQ ID NO: 1476649 - protein, 24 aa, Mycobacterium tuberculosis
GKFEWLDNDVVQWVPDRFWPAHST

SEQ ID NO: 1476650 - protein, 22 aa, Mycobacterium tuberculosis
GKNNPGLVVLLTFGTGIGSAVI

SEQ ID NO: 1476651 - protein, 19 aa, Mycobacterium tuberculosis
GKPDYRWAKEQTEARPADD

SEQ ID NO: 1476652 - protein, 17 aa, Mycobacterium tuberculosis
GKRAQCFGGAKNHMIVM

SEQ ID NO: 1476653 - protein, 22 aa, Mycobacterium tuberculosis
GKRRVVLKMGRRGPAPAPAQLK

SEQ ID NO: 1476654 - protein, 21 aa, Mycobacterium tuberculosis
GKTGMDVCLWLLRNDVCPDKL

SEQ ID NO: 1476655 - protein, 17 aa, Mycobacterium tuberculosis
GKTTLLSCLGGILRPKS

SEQ ID NO: 1476656 - protein, 19 aa, Mycobacterium tuberculosis
GLAAWPRVPRHIEWKHGVC

SEQ ID NO: 1476657 - protein, 23 aa, Mycobacterium tuberculosis
GLARELACAYDLDFVDPASNSRV

SEQ ID NO: 1476658 - protein, 19 aa, Mycobacterium tuberculosis
GLDALGFAGTIPKSAPGSA

SEQ ID NO: 1476659 - protein, 20 aa, Mycobacterium tuberculosis
GLEIALACHHRIAADVKGSQ

SEQ ID NO: 1476660 - protein, 19 aa, Mycobacterium tuberculosis
GLFNPGHGNTGFLNAGSFN

SEQ ID NO: 1476661 - protein, 25 aa, Mycobacterium tuberculosis
GLGCELRHAHRLVYSEGLDLSGDPN

SEQ ID NO: 1476662 - protein, 25 aa, Mycobacterium tuberculosis
GLGGHGGAGGLLIGNGGAGGAGGLG

SEQ ID NO: 1476663 - protein, 19 aa, Mycobacterium tuberculosis
GLGGRAGLIGHGGAGGNGG

SEQ ID NO: 1476664 - protein, 22 aa, Mycobacterium tuberculosis
GLGSAFGPGGTGGMGGAGGTST

SEQ ID NO: 1476665 - protein, 17 aa, Mycobacterium tuberculosis
GLHQALRLGKPLQFHVG

SEQ ID NO: 1476666 - protein, 19 aa, Mycobacterium tuberculosis
GLIAGCLVTSGVMRRNAKA

SEQ ID NO: 1476667 - protein, 18 aa, Mycobacterium tuberculosis
GLLDRLSKQPGIHAVHVS

SEQ ID NO: 1476668 - protein, 19 aa, Mycobacterium tuberculosis
GLLLARAGVQVTLLEKHGD

SEQ ID NO: 1476669 - protein, 20 aa, Mycobacterium tuberculosis
GLLVPPSDRPWRLAMSTAGT

SEQ ID NO: 1476670 - protein, 17 aa, Mycobacterium tuberculosis
GLMGRRIAGVLASAGLD

SEQ ID NO: 1476671 - protein, 26 aa, Mycobacterium tuberculosis
GLMMSLNMLIEFGDAFDYSAADFRGW

SEQ ID NO: 1476672 - protein, 20 aa, Mycobacterium tuberculosis
GLPGGRCAVYVKVHHALADG

SEQ ID NO: 1476673 - protein, 21 aa, Mycobacterium tuberculosis
GLPGGRCAVYVKVHHALADGV

SEQ ID NO: 1476674 - protein, 26 aa, Mycobacterium tuberculosis
GLPRTAFKPSYGIAEATLLVATIDHA

SEQ ID NO: 1476675 - protein, 25 aa, Mycobacterium tuberculosis
GLQALWRRGAEVFADVTLPEGVPIR

SEQ ID NO: 1476676 - protein, 20 aa, Mycobacterium tuberculosis
GLRDLHAPGYVRAYAYDQDE

SEQ ID NO: 1476677 - protein, 17 aa, Mycobacterium tuberculosis
GLRQWRSLDWGTVEVFL

SEQ ID NO: 1476678 - protein, 24 aa, Mycobacterium tuberculosis
GLRVRRRAKVWYDRLNAEDPTRKP

SEQ ID NO: 1476679 - protein, 23 aa, Mycobacterium tuberculosis
GLSLPLLRSLVQRCGLSVAALWA

SEQ ID NO: 1476680 - protein, 18 aa, Mycobacterium tuberculosis
GLTGDDWLGPSALSMAAA

SEQ ID NO: 1476681 - protein, 19 aa, Mycobacterium tuberculosis
GLTGPAIRIRCKSLLNALH

SEQ ID NO: 1476682 - protein, 17 aa, Mycobacterium tuberculosis
GLTVPSLTIPAAMTPAN

SEQ ID NO: 1476683 - protein, 19 aa, Mycobacterium tuberculosis
GMAATDCALRAMLRPGDHV

SEQ ID NO: 1476684 - protein, 22 aa, Mycobacterium tuberculosis
GMAAVSLARYWGAEVFVTASRA

SEQ ID NO: 1476685 - protein, 24 aa, Mycobacterium tuberculosis
GMALAFRAGAPLKDMEFVQYHPTG

SEQ ID NO: 1476686 - protein, 22 aa, Mycobacterium tuberculosis
GMPPCTGTGMGIDRLLMSLTGL

SEQ ID NO: 1476687 - protein, 23 aa, Mycobacterium tuberculosis
GMPPCTGTGMGIDRLLMSLTGLS

SEQ ID NO: 1476688 - protein, 18 aa, Mycobacterium tuberculosis
GMRARSALTTALLRSRTN

SEQ ID NO: 1476689 - protein, 17 aa, Mycobacterium tuberculosis
GMTGASSAENWVDLMRD

SEQ ID NO: 1476690 - protein, 18 aa, Mycobacterium tuberculosis
GNAEIVISGGSVAGTGGN

SEQ ID NO: 1476691 - protein, 25 aa, Mycobacterium tuberculosis
GNAGWLGFGGAGGIGGIGGNANGGA

SEQ ID NO: 1476692 - protein, 24 aa, Mycobacterium tuberculosis
GNANLGGGNWGFANLGSGNIGNTN

SEQ ID NO: 1476693 - protein, 23 aa, Mycobacterium tuberculosis
GNFGGGASGFWNLASATSGLSGF

SEQ ID NO: 1476694 - protein, 19 aa, Mycobacterium tuberculosis
GNGGLVFGNGGPGGLGGPG

SEQ ID NO: 1476695 - protein, 24 aa, Mycobacterium tuberculosis
GNGGSGGSLFGFGGAGGTGGSSGI

SEQ ID NO: 1476696 - protein, 20 aa, Mycobacterium tuberculosis
GNGGSRGIGGAGGIGGAGST

SEQ ID NO: 1476697 - protein, 18 aa, Mycobacterium tuberculosis
GNGLLTLPTSVNVVTSSS

SEQ ID NO: 1476698 - protein, 17 aa, Mycobacterium tuberculosis
GNIGSWNLGGGNVGLLN

SEQ ID NO: 1476699 - protein, 18 aa, Mycobacterium tuberculosis
GNIGSWNLGGGNVGLLNL

SEQ ID NO: 1476700 - protein, 18 aa, Mycobacterium tuberculosis
GNINPIWAYAHVPFGYTG

SEQ ID NO: 1476701 - protein, 18 aa, Mycobacterium tuberculosis
GNLARLGSMISAANSAAA

SEQ ID NO: 1476702 - protein, 30 aa, Mycobacterium tuberculosis
GNPDYGLRLSWNFLARSTAGLWEWAERLGD

SEQ ID NO: 1476703 - protein, 32 aa, Mycobacterium tuberculosis
GNRLRLALDSDLCAAVTGMPGPLAHPGLVCDV

SEQ ID NO: 1476704 - protein, 22 aa, Mycobacterium tuberculosis
GNSFGAFVPKGITLRVYGDAND

SEQ ID NO: 1476705 - protein, 22 aa, Mycobacterium tuberculosis
GNSGNFSTGLFNPGHGNTGFLN

SEQ ID NO: 1476706 - protein, 18 aa, Mycobacterium tuberculosis
GNTSGLWNLASAASGVSG

SEQ ID NO: 1476707 - protein, 26 aa, Mycobacterium tuberculosis
GNYSNGVLWRGDYQGLIGADIALEIP

SEQ ID NO: 1476708 - protein, 27 aa, Mycobacterium tuberculosis
GNYSNGVLWRGDYQGLIGADIALEIPA

SEQ ID NO: 1476709 - protein, 23 aa, Mycobacterium tuberculosis
GPAALPWGDLGVDVVVESTGLFT

SEQ ID NO: 1476710 - protein, 20 aa, Mycobacterium tuberculosis
GPIARSVMDAALLLDATTTV

SEQ ID NO: 1476711 - protein, 23 aa, Mycobacterium tuberculosis
GPLLLPRIVASVFANEPRCRRIM

SEQ ID NO: 1476712 - protein, 20 aa, Mycobacterium tuberculosis
GPMDRFHRRLLWPIRTSAGE

SEQ ID NO: 1476713 - protein, 22 aa, Mycobacterium tuberculosis
GPNGRPRYVTAIDADTATVHVG

SEQ ID NO: 1476714 - protein, 20 aa, Mycobacterium tuberculosis
GPRGGCACHRCNQRQPDHVD

SEQ ID NO: 1476715 - protein, 36 aa, Mycobacterium tuberculosis
GPRLPRYLQSVLYLRFREWFLPAIHRKYGDVFSLRV

SEQ ID NO: 1476716 - protein, 37 aa, Mycobacterium tuberculosis
GPRLPRYLQSVLYLRFREWFLPAIHRKYGDVFSLRVP

SEQ ID NO: 1476717 - protein, 18 aa, Mycobacterium tuberculosis
GPSIGWRTSTRLPRDHYV

SEQ ID NO: 1476718 - protein, 27 aa, Mycobacterium tuberculosis
GPVAHPLYCRRMQQKLVEFAEAGFPGL

SEQ ID NO: 1476719 - protein, 31 aa, Mycobacterium tuberculosis
GPWGREVIGIAAGVVRFIGVDGYRWMIRCVV

SEQ ID NO: 1476720 - protein, 18 aa, Mycobacterium tuberculosis
GQANYGFAVPDIPIPAIH

SEQ ID NO: 1476721 - protein, 19 aa, Mycobacterium tuberculosis
GQANYGFAVPDIPIPAIHI

SEQ ID NO: 1476722 - protein, 28 aa, Mycobacterium tuberculosis
GQGGGGGFSILLGLGGLGGLGSPGSIAT

SEQ ID NO: 1476723 - protein, 23 aa, Mycobacterium tuberculosis
GQGGHGGNAILFGQGGAGGPGGT

SEQ ID NO: 1476724 - protein, 17 aa, Mycobacterium tuberculosis
GQILFRRLAPFVGGFDL

SEQ ID NO: 1476725 - protein, 17 aa, Mycobacterium tuberculosis
GQKCGFGSAVSLRPRRY

SEQ ID NO: 1476726 - protein, 18 aa, Mycobacterium tuberculosis
GQKCGFGSAVSLRPRRYR

SEQ ID NO: 1476727 - protein, 22 aa, Mycobacterium tuberculosis
GQLLPRRAAQKFADFANARTAA

SEQ ID NO: 1476728 - protein, 22 aa, Mycobacterium tuberculosis
GQLPKLRLGKVLQISGPADLLQ

SEQ ID NO: 1476729 - protein, 19 aa, Mycobacterium tuberculosis
GQNARLAARLTGWRIDIRG

SEQ ID NO: 1476730 - protein, 17 aa, Mycobacterium tuberculosis
GQNWLVEMEMFRAENRY

SEQ ID NO: 1476731 - protein, 19 aa, Mycobacterium tuberculosis
GQPVKGRLTVPPSVPVKSA

SEQ ID NO: 1476732 - protein, 24 aa, Mycobacterium tuberculosis
GQRPADRPLWLGSIKSNIGHTSAA

SEQ ID NO: 1476733 - protein, 18 aa, Mycobacterium tuberculosis
GQTLRPAPVGAYPAGASA

SEQ ID NO: 1476734 - protein, 23 aa, Mycobacterium tuberculosis
GQVTSGLTAGVWQGAAAAAMAAA

SEQ ID NO: 1476735 - protein, 17 aa, Mycobacterium tuberculosis
GRADGVCAGIAFRNPQS

SEQ ID NO: 1476736 - protein, 30 aa, Mycobacterium tuberculosis
GRAYSPRFLWMWPNARISVIGGEQAASVLA

SEQ ID NO: 1476737 - protein, 31 aa, Mycobacterium tuberculosis
GRAYSPRFLWMWPNARISVIGGEQAASVLAT

SEQ ID NO: 1476738 - protein, 20 aa, Mycobacterium tuberculosis
GRDDVCYVSMPLFHSNAVLV

SEQ ID NO: 1476739 - protein, 18 aa, Mycobacterium tuberculosis
GRGGYAGMLVGSVGETVA

SEQ ID NO: 1476740 - protein, 33 aa, Mycobacterium tuberculosis
GRGQLCWPDCGIPSIPPGHGWSPAAAAHVFVRS

SEQ ID NO: 1476741 - protein, 19 aa, Mycobacterium tuberculosis
GRGSYPWLPTDNANWHMIG

SEQ ID NO: 1476742 - protein, 17 aa, Mycobacterium tuberculosis
GRKLLAWERPLRKSDRE

SEQ ID NO: 1476743 - protein, 17 aa, Mycobacterium tuberculosis
GRLAVVVDFAMEADAQY

SEQ ID NO: 1476744 - protein, 18 aa, Mycobacterium tuberculosis
GRLIKLPVFGSVAEAMEK

SEQ ID NO: 1476745 - protein, 18 aa, Mycobacterium tuberculosis
GRLLELTLHPGVMTGYAH

SEQ ID NO: 1476746 - protein, 20 aa, Mycobacterium tuberculosis
GRLPDPLPCEAYCHSLTDPS

SEQ ID NO: 1476747 - protein, 26 aa, Mycobacterium tuberculosis
GRLSPDGLRWSTTEQLGYNRRYTLNA

SEQ ID NO: 1476748 - protein, 29 aa, Mycobacterium tuberculosis
GRLVDVIGCSLRLPGIYPPQVYNGRLHVD

SEQ ID NO: 1476749 - protein, 18 aa, Mycobacterium tuberculosis
GRNQQCWCGSGHKYKKCC

SEQ ID NO: 1476750 - protein, 29 aa, Mycobacterium tuberculosis
GRPAGTPGLPSRPGAAIAAIAVQDPPSPA

SEQ ID NO: 1476751 - protein, 25 aa, Mycobacterium tuberculosis
GRPRGWPEWAEPDVVDAFADRGISS

SEQ ID NO: 1476752 - protein, 18 aa, Mycobacterium tuberculosis
GRQGCGKTTALVAIGEAV

SEQ ID NO: 1476753 - protein, 27 aa, Mycobacterium tuberculosis
GRQLVEVPVGFKWFVDGLIGATLGFGG

SEQ ID NO: 1476754 - protein, 22 aa, Mycobacterium tuberculosis
GRRLSGTVTPVFGGRTVSVTYS

SEQ ID NO: 1476755 - protein, 18 aa, Mycobacterium tuberculosis
GRRRGRVGATWPPSTITE

SEQ ID NO: 1476756 - protein, 21 aa, Mycobacterium tuberculosis
GRSLAHAVLMMIPEAWERHES

SEQ ID NO: 1476757 - protein, 18 aa, Mycobacterium tuberculosis
GRTAYLVMELVNGEPLNS

SEQ ID NO: 1476758 - protein, 17 aa, Mycobacterium tuberculosis
GRVIFARNSGKLCFATL

SEQ ID NO: 1476759 - protein, 17 aa, Mycobacterium tuberculosis
GRVRGQRGWIIEKPGEP

SEQ ID NO: 1476760 - protein, 17 aa, Mycobacterium tuberculosis
GRYLDWLTKHSRQILET

SEQ ID NO: 1476761 - protein, 25 aa, Mycobacterium tuberculosis
GSALLFPALCTPTGDPPRPDPARAD

SEQ ID NO: 1476762 - protein, 18 aa, Mycobacterium tuberculosis
GSAPAHFARQAGSSLRTA

SEQ ID NO: 1476763 - protein, 24 aa, Mycobacterium tuberculosis
GSAPMCYPRADFLVGDRDILLGVL

SEQ ID NO: 1476764 - protein, 26 aa, Mycobacterium tuberculosis
GSAQRWKAIRGEAGWMTTYAYPAEAI

SEQ ID NO: 1476765 - protein, 22 aa, Mycobacterium tuberculosis
GSASILPITWAYIRMMGAEGLR

SEQ ID NO: 1476766 - protein, 23 aa, Mycobacterium tuberculosis
GSGNGPLAAFVHALADVGFDVAV

SEQ ID NO: 1476767 - protein, 17 aa, Mycobacterium tuberculosis
GSGNLLGNGNFGFGNAF

SEQ ID NO: 1476768 - protein, 17 aa, Mycobacterium tuberculosis
GSGPAYFFLLVEALVDA

SEQ ID NO: 1476769 - protein, 24 aa, Mycobacterium tuberculosis
GSGPMLAAAAAWDGLAAELGLAAE

SEQ ID NO: 1476770 - protein, 24 aa, Mycobacterium tuberculosis
GSGPMLAAAAAWDGLADELAVAAS

SEQ ID NO: 1476771 - protein, 17 aa, Mycobacterium tuberculosis
GSHHLVRASIDLGSGSI

SEQ ID NO: 1476772 - protein, 17 aa, Mycobacterium tuberculosis
GSIGLFLEPFRLSDPFI

SEQ ID NO: 1476773 - protein, 17 aa, Mycobacterium tuberculosis
GSILRYTTFTPKHMGVM

SEQ ID NO: 1476774 - protein, 23 aa, Mycobacterium tuberculosis
GSLDDFRGTLCVPGDPDYPRVRA

SEQ ID NO: 1476775 - protein, 18 aa, Mycobacterium tuberculosis
GSLLRDYGLLLPLEPDTR

SEQ ID NO: 1476776 - protein, 19 aa, Mycobacterium tuberculosis
GSMPPRPGGAVGGARPPRP

SEQ ID NO: 1476777 - protein, 18 aa, Mycobacterium tuberculosis
GSNIIGRGQDAQFRLPDT

SEQ ID NO: 1476778 - protein, 17 aa, Mycobacterium tuberculosis
GSSLPVRVCTICTDPWN

SEQ ID NO: 1476779 - protein, 17 aa, Mycobacterium tuberculosis
GSSSDLLADAVERYLQW

SEQ ID NO: 1476780 - protein, 17 aa, Mycobacterium tuberculosis
GSSYGPIGEACRRARRR

SEQ ID NO: 1476781 - protein, 27 aa, Mycobacterium tuberculosis
GSTSGAHGKAGFGAPGGDGGDGGNGGH

SEQ ID NO: 1476782 - protein, 17 aa, Mycobacterium tuberculosis
GSVPGVIAQALFTPQGL

SEQ ID NO: 1476783 - protein, 22 aa, Mycobacterium tuberculosis
GSVPQRLWAKPAITVIGIDTTS

SEQ ID NO: 1476784 - protein, 30 aa, Mycobacterium tuberculosis
GSYSNGILWRGDYQGLIGYSDTLSIPAIPL

SEQ ID NO: 1476785 - protein, 25 aa, Mycobacterium tuberculosis
GTAAAYWLGRHGYSVTMVERHPGLR

SEQ ID NO: 1476786 - protein, 18 aa, Mycobacterium tuberculosis
GTAGYAGGLTYNYNTYST

SEQ ID NO: 1476787 - protein, 18 aa, Mycobacterium tuberculosis
GTAPMLAAAAAWDGLAEE

SEQ ID NO: 1476788 - protein, 26 aa, Mycobacterium tuberculosis
GTATVTRLALAIAAIASAANRPLRRV

SEQ ID NO: 1476789 - protein, 18 aa, Mycobacterium tuberculosis
GTCRARGLLDAVIGAAAE

SEQ ID NO: 1476790 - protein, 21 aa, Mycobacterium tuberculosis
GTEARLITAMIVREDSMTLYG

SEQ ID NO: 1476791 - protein, 23 aa, Mycobacterium tuberculosis
GTETRMVGKLALGSESSRQTQNP

SEQ ID NO: 1476792 - protein, 25 aa, Mycobacterium tuberculosis
GTGADGGAGGWLFGNGGNGGSGATG

SEQ ID NO: 1476793 - protein, 26 aa, Mycobacterium tuberculosis
GTGDDGGAGGWLLGNGGNGGAGAAGT

SEQ ID NO: 1476794 - protein, 23 aa, Mycobacterium tuberculosis
GTGGEGGEVGGAGGTGGAAGNGG

SEQ ID NO: 1476795 - protein, 19 aa, Mycobacterium tuberculosis
GTGGLLFGAGGNGGPGGSG

SEQ ID NO: 1476796 - protein, 31 aa, Mycobacterium tuberculosis
GTGGNGGDAEPGVPPGAGGAGGAGTTGGKGG

SEQ ID NO: 1476797 - protein, 27 aa, Mycobacterium tuberculosis
GTLGLSLLWVLRGWRRPDDVRVRPTAA

SEQ ID NO: 1476798 - protein, 22 aa, Mycobacterium tuberculosis
GTLPRLATHAWTADPDSAPKTT

SEQ ID NO: 1476799 - protein, 17 aa, Mycobacterium tuberculosis
GTPDTWVLWNLTGGPRG

SEQ ID NO: 1476800 - protein, 20 aa, Mycobacterium tuberculosis
GTPLLNWLRQRGVDEVDVVA

SEQ ID NO: 1476801 - protein, 19 aa, Mycobacterium tuberculosis
GTRGAPTVRIRGFSLGGDV

SEQ ID NO: 1476802 - protein, 18 aa, Mycobacterium tuberculosis
GTRLGLRPVTAARYGDCG

SEQ ID NO: 1476803 - protein, 18 aa, Mycobacterium tuberculosis
GTSEPFDLLAVVPPHVPS

SEQ ID NO: 1476804 - protein, 25 aa, Mycobacterium tuberculosis
GTSVRMPLTLNIPAGIPLEPGIYEW

SEQ ID NO: 1476805 - protein, 17 aa, Mycobacterium tuberculosis
GTTFPTDICEPVAVVGI

SEQ ID NO: 1476806 - protein, 17 aa, Mycobacterium tuberculosis
GTWAVAVDRGGQLRWYG

SEQ ID NO: 1476807 - protein, 18 aa, Mycobacterium tuberculosis
GVEPPVALILQGASLHDL

SEQ ID NO: 1476808 - protein, 17 aa, Mycobacterium tuberculosis
GVGFVVWRGPEHLPEDL

SEQ ID NO: 1476809 - protein, 18 aa, Mycobacterium tuberculosis
GVGFVVWRGPEHLPEDLV

SEQ ID NO: 1476810 - protein, 25 aa, Mycobacterium tuberculosis
GVGGAGGLLFGYGGAGGAGGYSNIG

SEQ ID NO: 1476811 - protein, 26 aa, Mycobacterium tuberculosis
GVGGDGGRGGLLAGNGGTGGAGGNGG

SEQ ID NO: 1476812 - protein, 21 aa, Mycobacterium tuberculosis
GVGGHGGTAILFGDGGAGGAG

SEQ ID NO: 1476813 - protein, 20 aa, Mycobacterium tuberculosis
GVLWVGDYQGLFGVSAGSSI

SEQ ID NO: 1476814 - protein, 20 aa, Mycobacterium tuberculosis
GVPGLRHVAGRLVMVDLDAD

SEQ ID NO: 1476815 - protein, 18 aa, Mycobacterium tuberculosis
GVVDRVLAVFSIPGRFEA

SEQ ID NO: 1476816 - protein, 21 aa, Mycobacterium tuberculosis
GVVPMGITFVIAGSVRLTVTT

SEQ ID NO: 1476817 - protein, 19 aa, Mycobacterium tuberculosis
GWAEIALRLATQRHDFYLL

SEQ ID NO: 1476818 - protein, 18 aa, Mycobacterium tuberculosis
GWAGIKVGVDYEGDHHRT

SEQ ID NO: 1476819 - protein, 20 aa, Mycobacterium tuberculosis
GWPDGSYGWAKVEAFLSSRF

SEQ ID NO: 1476820 - protein, 25 aa, Mycobacterium tuberculosis
GWQLLDMRLSRAFQCTNFDQSIDFM

SEQ ID NO: 1476821 - protein, 27 aa, Mycobacterium tuberculosis
GWSPDSDLKGFDGFDGGSGGAGGDGGA

SEQ ID NO: 1476822 - protein, 23 aa, Mycobacterium tuberculosis
GYAHVTGRVGVCMATSGPGATNL

SEQ ID NO: 1476823 - protein, 32 aa, Mycobacterium tuberculosis; identical to SEQ ID NO: 200611

SEQ ID NO: 1476824 - protein, 23 aa, Mycobacterium tuberculosis
GYGRPNARLAATIGTIADACAPA

SEQ ID NO: 1476825 - protein, 24 aa, Mycobacterium tuberculosis
GYKFSTYATWWIRQAITRAMADQA

SEQ ID NO: 1476826 - protein, 24 aa, Mycobacterium tuberculosis
GYPLELLVRAAAAGWRVVELDVSY

SEQ ID NO: 1476827 - protein, 18 aa, Mycobacterium tuberculosis
GYSRAGVHGLHLRRGPAI

SEQ ID NO: 1476828 - protein, 18 aa, Mycobacterium tuberculosis
GYVLSDGFRVPGLPMPSL

SEQ ID NO: 1476829 - protein, 24 aa, Mycobacterium tuberculosis
HAAEGFPSLSCIVLNGGFQLHPAI

SEQ ID NO: 1476830 - protein, 22 aa, Mycobacterium tuberculosis
HAESIRKFRILPVDFTEDTGEL

SEQ ID NO: 1476831 - protein, 23 aa, Mycobacterium tuberculosis
HAGGAAAAYRWLAKSLVANDVDT

SEQ ID NO: 1476832 - protein, 17 aa, Mycobacterium tuberculosis
HAGIPVTVVPGVTSAIA

SEQ ID NO: 1476833 - protein, 18 aa, Mycobacterium tuberculosis
HAGIPVTVVPGVTSAIAV

SEQ ID NO: 1476834 - protein, 18 aa, Mycobacterium tuberculosis
HALALLLAASRQIPAADA

SEQ ID NO: 1476835 - protein, 17 aa, Mycobacterium tuberculosis
HAMAVAIPRERTMPAVL

SEQ ID NO: 1476836 - protein, 18 aa, Mycobacterium tuberculosis
HARVRYTTIQNWSNNVYN

SEQ ID NO: 1476837 - protein, 24 aa, Mycobacterium tuberculosis
HDIACLPTPHGLVPDYQRHTRTGR

SEQ ID NO: 1476838 - protein, 17 aa, Mycobacterium tuberculosis
HDWGGPVAFIMMLRHPE

SEQ ID NO: 1476839 - protein, 21 aa, Mycobacterium tuberculosis
HELARGDAYWDTVVEITSIGD

SEQ ID NO: 1476840 - protein, 20 aa, Mycobacterium tuberculosis
HELLMKRRRLGAERLIGLSV

SEQ ID NO: 1476841 - protein, 17 aa, Mycobacterium tuberculosis
HFADGWNTFNLTLQGDV

SEQ ID NO: 1476842 - protein, 17 aa, Mycobacterium tuberculosis
HFAGCLDINASEKAARF

SEQ ID NO: 1476843 - protein, 23 aa, Mycobacterium tuberculosis
HFARRGRRVHRLAVSHAFHSLLM

SEQ ID NO: 1476844 - protein, 27 aa, Mycobacterium tuberculosis
HFDYALVCGGGDWRRAGIPARSAQFSH

SEQ ID NO: 1476845 - protein, 18 aa, Mycobacterium tuberculosis
HGARKGLADTALRTADSG

SEQ ID NO: 1476846 - protein, 19 aa, Mycobacterium tuberculosis
HGAVQGHDALRGWASSLTT

SEQ ID NO: 1476847 - protein, 24 aa, Mycobacterium tuberculosis
HGAVQGHDALRGWASSLTTTAELG

SEQ ID NO: 1476848 - protein, 23 aa, Mycobacterium tuberculosis
HGGAHGGHVLFVRDGRLHYVYNF

SEQ ID NO: 1476849 - protein, 18 aa, Mycobacterium tuberculosis
HGGDGGNAVGLIGNGGAG

SEQ ID NO: 1476850 - protein, 18 aa, Mycobacterium tuberculosis
HGKELTWSQVLMAANTPM

SEQ ID NO: 1476851 - protein, 19 aa, Mycobacterium tuberculosis
HGKLAYHAVTYGWLLSGLA

SEQ ID NO: 1476852 - protein, 22 aa, Mycobacterium tuberculosis
HGMPGVPGVPVAAGRASGVLPR

SEQ ID NO: 1476853 - protein, 25 aa, Mycobacterium tuberculosis
HGNHEPGWVVAPGMQGMQVQPFTAN

SEQ ID NO: 1476854 - protein, 18 aa, Mycobacterium tuberculosis
HGYSVTMVERHPGLRPGG

SEQ ID NO: 1476855 - protein, 27 aa, Mycobacterium tuberculosis
HHRAATRARLWPRSMTTLSTHDTKRGE

SEQ ID NO: 1476856 - protein, 25 aa, Mycobacterium tuberculosis
HHRRPRPAAPGAFARLNRRLCGGWY

SEQ ID NO: 1476857 - protein, 20 aa, Mycobacterium tuberculosis
HKAIGYGMPGIRVDGNDVLA

SEQ ID NO: 1476858 - protein, 19 aa, Mycobacterium tuberculosis
HKDARACRNALAEAGIPAI

SEQ ID NO: 1476859 - protein, 19 aa, Mycobacterium tuberculosis
HKGQLLSLHLGRLKDRVGL

SEQ ID NO: 1476860 - protein, 25 aa, Mycobacterium tuberculosis
HKPGLRRLAPLAFVRFRIDGKDWPA

SEQ ID NO: 1476861 - protein, 29 aa, Mycobacterium tuberculosis
HLDGTLSFRWSCRMGICGSSGMTINGDPK

SEQ ID NO: 1476862 - protein, 25 aa, Mycobacterium tuberculosis
HLGREALPLAERVDWLYAKASQHAL

SEQ ID NO: 1476863 - protein, 18 aa, Mycobacterium tuberculosis
HLKRHSGTLNHHMHANDL

SEQ ID NO: 1476864 - protein, 23 aa, Mycobacterium tuberculosis
HLPAADLRPAYSNADAARQVADG

SEQ ID NO: 1476865 - protein, 20 aa, Mycobacterium tuberculosis
HLRGWTLDRLPAVDRAILRV

SEQ ID NO: 1476866 - protein, 22 aa, Mycobacterium tuberculosis
HLVKTFWGWRDQQLPDGTLILT

SEQ ID NO: 1476867 - protein, 21 aa, Mycobacterium tuberculosis
HNVAFSKPPIGKRGYNEDEVD

SEQ ID NO: 1476868 - protein, 17 aa, Mycobacterium tuberculosis
HPDVWELAGHVSPNPGG

SEQ ID NO: 1476869 - protein, 19 aa, Mycobacterium tuberculosis
HPMMLPLLERMVVKQPRTA

SEQ ID NO: 1476870 - protein, 26 aa, Mycobacterium tuberculosis
HPNIKTDAMFPARAFDALDALVASAA

SEQ ID NO: 1476871 - protein, 25 aa, Mycobacterium tuberculosis
HPVSPRARASFYGYGFNVGVTSSGR

SEQ ID NO: 1476872 - protein, 25 aa, Mycobacterium tuberculosis
HRAALHSRYRWLARWRKEVVMADPG

SEQ ID NO: 1476873 - protein, 24 aa, Mycobacterium tuberculosis
HRAFKMLAEDGIDLQTCGLVAVGH

SEQ ID NO: 1476874 - protein, 22 aa, Mycobacterium tuberculosis
HRDRFCRLGSKYVQAAFAAQGR

SEQ ID NO: 1476875 - protein, 17 aa, Mycobacterium tuberculosis
HRFLDLRRSPGMLTDPA

SEQ ID NO: 1476876 - protein, 19 aa, Mycobacterium tuberculosis
HRIRIAIAGADASHFAILP

SEQ ID NO: 1476877 - protein, 17 aa, Mycobacterium tuberculosis
HRKAFRRTIKWRTGCEG

SEQ ID NO: 1476878 - protein, 17 aa, Mycobacterium tuberculosis
HRMAMAGAIIGLRVAGV

SEQ ID NO: 1476879 - protein, 17 aa, Mycobacterium tuberculosis
HRNLPFLIAINEFDSAP

SEQ ID NO: 1476880 - protein, 17 aa, Mycobacterium tuberculosis
HRRAFRDKIKWRTGSEG

SEQ ID NO: 1476881 - protein, 23 aa, Mycobacterium tuberculosis
HRRGLLQFRWQRVSRELTEADGP

SEQ ID NO: 1476882 - protein, 22 aa, Mycobacterium tuberculosis
HRRIPGPLPLHPSADRRGIHSA

SEQ ID NO: 1476883 - protein, 22 aa, Mycobacterium tuberculosis
HRRKRGRGRTQFVGQSIPSGRR

SEQ ID NO: 1476884 - protein, 20 aa, Mycobacterium tuberculosis
HRRRAQGLTVVFCTYQSLPT

SEQ ID NO: 1476885 - protein, 21 aa, Mycobacterium tuberculosis
HRRRAQGLTVVFCTYQSLPTV

SEQ ID NO: 1476886 - protein, 25 aa, Mycobacterium tuberculosis
HRRRRRAQPRGTCQPRRHRRKRGRG

SEQ ID NO: 1476887 - protein, 24 aa, Mycobacterium tuberculosis
HRSPLGRLPLRIGRSKSNDMVLPD

SEQ ID NO: 1476888 - protein, 19 aa, Mycobacterium tuberculosis
HRVLTRCQMSFVVTIPEAL

SEQ ID NO: 1476889 - protein, 21 aa, Mycobacterium tuberculosis
HSFPAIALCQRFRAAADTPTL

SEQ ID NO: 1476890 - protein, 23 aa, Mycobacterium tuberculosis
HSLSKIHSVASFFVSRVDTEIDK

SEQ ID NO: 1476891 - protein, 25 aa, Mycobacterium tuberculosis
HTCDSRSAVVVELLPPITAPRRNAL

SEQ ID NO: 1476892 - protein, 29 aa, Mycobacterium tuberculosis
HTGGFNRNTWGVAMIGNFDDVAPTPIQIR

SEQ ID NO: 1476893 - protein, 26 aa, Mycobacterium tuberculosis
HTLKKLSGLRARNGLLTASGDNASGS

SEQ ID NO: 1476894 - protein, 21 aa, Mycobacterium tuberculosis
HTLTAAARWYTATEIANAAAM

SEQ ID NO: 1476895 - protein, 23 aa, Mycobacterium tuberculosis
HTPPHAWYIAFAPAQAPKVAVAV

SEQ ID NO: 1476896 - protein, 17 aa, Mycobacterium tuberculosis
HVVNGVVLFPGAGFVEL

SEQ ID NO: 1476897 - protein, 19 aa, Mycobacterium tuberculosis
IAAAEAMYEQMWAADVAAM

SEQ ID NO: 1476898 - protein, 25 aa, Mycobacterium tuberculosis
IAAAEARYAEMWAQDAAAMYGYAGS

SEQ ID NO: 1476899 - protein, 17 aa, Mycobacterium tuberculosis
IAAALAVQCRGGEAFLM

SEQ ID NO: 1476900 - protein, 20 aa, Mycobacterium tuberculosis
IAAAWRRIRSQVRDWTDLEP

SEQ ID NO: 1476901 - protein, 24 aa, Mycobacterium tuberculosis
IAAHWRYKEAKGRNGVLHPHAAAE

SEQ ID NO: 1476902 - protein, 23 aa, Mycobacterium tuberculosis
IAALSRLGAVAVVMRPDTDLSAS

SEQ ID NO: 1476903 - protein, 24 aa, Mycobacterium tuberculosis
IACLDLLADMARQFGSQCIVLSVD

SEQ ID NO: 1476904 - protein, 18 aa, Mycobacterium tuberculosis
IADARPVLVALRAVGGHR

SEQ ID NO: 1476905 - protein, 17 aa, Mycobacterium tuberculosis
IADTGWQLLDSKFAVVA

SEQ ID NO: 1476906 - protein, 25 aa, Mycobacterium tuberculosis
IAELVTEHAWRIGVVAQSHATVENL

SEQ ID NO: 1476907 - protein, 18 aa, Mycobacterium tuberculosis
IALLCHVLLVETDDGLVL

SEQ ID NO: 1476908 - protein, 19 aa, Mycobacterium tuberculosis
IALSLPLGAGRLTREWLPD

SEQ ID NO: 1476909 - protein, 20 aa, Mycobacterium tuberculosis
IAMAGAPGFEADDVLGTLAT

SEQ ID NO: 1476910 - protein, 18 aa, Mycobacterium tuberculosis
IAMRTVAVFAHRLYGAIT

SEQ ID NO: 1476911 - protein, 19 aa, Mycobacterium tuberculosis
IANAAAMRVVLGAVNAPTQ

SEQ ID NO: 1476912 - protein, 22 aa, Mycobacterium tuberculosis
IANRVSYFYDFHGPSVTIDTAC

SEQ ID NO: 1476913 - protein, 17 aa, Mycobacterium tuberculosis
IAQALFTPQGLYPVVVI

SEQ ID NO: 1476914 - protein, 17 aa, Mycobacterium tuberculosis
IARVPDCAVVGAAAGGV

SEQ ID NO: 1476915 - protein, 19 aa, Mycobacterium tuberculosis
IASAVAFLVSDAASWITGE

SEQ ID NO: 1476916 - protein, 28 aa, Mycobacterium tuberculosis
IATPEMMATAAFDLARIGSQVSAASAVA

SEQ ID NO: 1476917 - protein, 22 aa, Mycobacterium tuberculosis
IAVSQLFGRYGQEFQTVSNQLA

SEQ ID NO: 1476918 - protein, 17 aa, Mycobacterium tuberculosis
IAYALAGTMDFDFQTQP

SEQ ID NO: 1476919 - protein, 20 aa, Mycobacterium tuberculosis
ICDARGGSMSPAITGHYRSG

SEQ ID NO: 1476920 - protein, 22 aa, Mycobacterium tuberculosis
IDARLADRLAVNRGLAPVADVR

SEQ ID NO: 1476921 - protein, 17 aa, Mycobacterium tuberculosis
IDIPGMSLFDVHEIVEI

SEQ ID NO: 1476922 - protein, 18 aa, Mycobacterium tuberculosis
IDNIRYFAELCGVDRQAA

SEQ ID NO: 1476923 - protein, 24 aa, Mycobacterium tuberculosis
IDPQHRLLLETSWEAMEHGGLTPN

SEQ ID NO: 1476924 - protein, 25 aa, Mycobacterium tuberculosis
IDPQHRLLLETSWEAMEHGGLTPNQ

SEQ ID NO: 1476925 - protein, 23 aa, Mycobacterium tuberculosis
IDPYLRPLYDALYDMMDPELIPK

SEQ ID NO: 1476926 - protein, 17 aa, Mycobacterium tuberculosis
IDSDAAWQAPANDAGEP

SEQ ID NO: 1476927 - protein, 20 aa, Mycobacterium tuberculosis
IDSPELLWKALLRGDDLITE

SEQ ID NO: 1476928 - protein, 32 aa, Mycobacterium tuberculosis
IDTTNLTGVMTFGLPLAMTLNAVGSPITTAIA

SEQ ID NO: 1476929 - protein, 21 aa, Mycobacterium tuberculosis
IEEMLRWTAPVKNMCRVLTAD

SEQ ID NO: 1476930 - protein, 22 aa, Mycobacterium tuberculosis
IEVTGPWYGGWAARGPADGVAS

SEQ ID NO: 1476931 - protein, 23 aa, Mycobacterium tuberculosis
IFGIPGGAVLPVYDPLFDSKKLR

SEQ ID NO: 1476932 - protein, 18 aa, Mycobacterium tuberculosis
IFGPPGTVADISYFDVNS

SEQ ID NO: 1476933 - protein, 23 aa, Mycobacterium tuberculosis
IFPGGLTIPAMNPLSINLSGGTG

SEQ ID NO: 1476934 - protein, 27 aa, Mycobacterium tuberculosis
IGAAGLGGCGGGAFTAGVTTGGAGGTG

SEQ ID NO: 1476935 - protein, 18 aa, Mycobacterium tuberculosis
IGDSVLMADWCYICDFDH

SEQ ID NO: 1476936 - protein, 19 aa, Mycobacterium tuberculosis
IGFEPLQWVRALAAEDPVP

SEQ ID NO: 1476937 - protein, 22 aa, Mycobacterium tuberculosis
IGGAGGGGGWLHGDGGAGGHGG

SEQ ID NO: 1476938 - protein, 23 aa, Mycobacterium tuberculosis
IGGAGGGGGWLHGDGGAGGHGGQ

SEQ ID NO: 1476939 - protein, 25 aa, Mycobacterium tuberculosis
IGGGPGGNGGWLLGNGGHGGAGGIG

SEQ ID NO: 1476940 - protein, 33 aa, Mycobacterium tuberculosis; identical to SEQ ID NO: 201150

SEQ ID NO: 1476941 - protein, 20 aa, Mycobacterium tuberculosis
IGGICAALGAAYGGALGVTS

SEQ ID NO: 1476942 - protein, 17 aa, Mycobacterium tuberculosis
IGGLGYVLAPGPAAYTL

SEQ ID NO: 1476943 - protein, 18 aa, Mycobacterium tuberculosis
IGGLNSGTGNIGFGNSGN

SEQ ID NO: 1476944 - protein, 20 aa, Mycobacterium tuberculosis
IGGLPRGRVIEIYGPESSGK

SEQ ID NO: 1476945 - protein, 17 aa, Mycobacterium tuberculosis
IGISHVVFKPGTIEQIR

SEQ ID NO: 1476946 - protein, 20 aa, Mycobacterium tuberculosis
IGRGCAQYAAQNPTGPGSVA

SEQ ID NO: 1476947 - protein, 17 aa, Mycobacterium tuberculosis
IGSSIMTLIQTVTTDDL

SEQ ID NO: 1476948 - protein, 32 aa, Mycobacterium tuberculosis
IGVLYGRRELLAQMPPFLTGGSMIETVTMEGA

SEQ ID NO: 1476949 - protein, 17 aa, Mycobacterium tuberculosis
IGVPACVGAAGRAVTSV

SEQ ID NO: 1476950 - protein, 20 aa, Mycobacterium tuberculosis
IGWACGPAELIAGVRAAKQY

SEQ ID NO: 1476951 - protein, 17 aa, Mycobacterium tuberculosis
IHAPLIPSGARFTPYLS

SEQ ID NO: 1476952 - protein, 23 aa, Mycobacterium tuberculosis
IHELARGDAYWDTVVEITSIGDQ

SEQ ID NO: 1476953 - protein, 18 aa, Mycobacterium tuberculosis
IHGARAYAAFCEFADTTP

SEQ ID NO: 1476954 - protein, 23 aa, Mycobacterium tuberculosis
IHSLAWARLAPVVALEPAPGTHS

SEQ ID NO: 1476955 - protein, 17 aa, Mycobacterium tuberculosis
IKQALLALQRVSERDTD

SEQ ID NO: 1476956 - protein, 21 aa, Mycobacterium tuberculosis
IKQDGQWRIAYRRLRNDRLVS

SEQ ID NO: 1476957 - protein, 24 aa, Mycobacterium tuberculosis
IKVVREIVSGLGLKEAKDLVDGAP

SEQ ID NO: 1476958 - protein, 20 aa, Mycobacterium tuberculosis
ILAGEAHFAIGYTEPEAGTD

SEQ ID NO: 1476959 - protein, 22 aa, Mycobacterium tuberculosis
ILAHAAVVYGYFPAVSEGNDIV

SEQ ID NO: 1476960 - protein, 19 aa, Mycobacterium tuberculosis
ILETAYVIDFLAYVYEETR

SEQ ID NO: 1476961 - protein, 21 aa, Mycobacterium tuberculosis
ILHRRRREFKARAAEKPAPSD

SEQ ID NO: 1476962 - protein, 24 aa, Mycobacterium tuberculosis
ILLTRRRARDLGHTTALFRAQTLQ

SEQ ID NO: 1476963 - protein, 25 aa, Mycobacterium tuberculosis
ILPTRPRATLVLRKDADHSINRLRL

SEQ ID NO: 1476964 - protein, 17 aa, Mycobacterium tuberculosis
ILTRYLNLVSFGNNSFG

SEQ ID NO: 1476965 - protein, 18 aa, Mycobacterium tuberculosis
IMELAMPGVGYGVLESRV

SEQ ID NO: 1476966 - protein, 18 aa, Mycobacterium tuberculosis
INAAFALGGGRLLTQTVE

SEQ ID NO: 1476967 - protein, 17 aa, Mycobacterium tuberculosis
INGFTVMLNDDVPQMCG

SEQ ID NO: 1476968 - protein, 18 aa, Mycobacterium tuberculosis
INGTGGAGGSRGQISGNP

SEQ ID NO: 1476969 - protein, 18 aa, Mycobacterium tuberculosis
INHAYLFSGPRGCGKTSS

SEQ ID NO: 1476970 - protein, 19 aa, Mycobacterium tuberculosis
INIACSLGMLTAEQVDQLA

SEQ ID NO: 1476971 - protein, 24 aa, Mycobacterium tuberculosis
INIGSWGGFPLRDRVAAAVPGVPV

SEQ ID NO: 1476972 - protein, 23 aa, Mycobacterium tuberculosis
INIPINITSAPGFGNSTTTPSSG

SEQ ID NO: 1476973 - protein, 19 aa, Mycobacterium tuberculosis
IPAGCWHQHKFHGHTQFHG

SEQ ID NO: 1476974 - protein, 17 aa, Mycobacterium tuberculosis
IPARPVIIGPITFLLLS

SEQ ID NO: 1476975 - protein, 24 aa, Mycobacterium tuberculosis
IPDDLLNALIDFLAAVRNGLVPII

SEQ ID NO: 1476976 - protein, 28 aa, Mycobacterium tuberculosis
IPDERFRYGFAIAPELVRTVLRDNEPDW

SEQ ID NO: 1476977 - protein, 18 aa, Mycobacterium tuberculosis
IPEAYRHTPPPIPTSETR

SEQ ID NO: 1476978 - protein, 17 aa, Mycobacterium tuberculosis
IPFAAALHGPCDTNAFA

SEQ ID NO: 1476979 - protein, 22 aa, Mycobacterium tuberculosis
IPGWAWSDVLEHFRAIETDLDF

SEQ ID NO: 1476980 - protein, 20 aa, Mycobacterium tuberculosis
IPHTLAALDWGGITCQSGAG

SEQ ID NO: 1476981 - protein, 19 aa, Mycobacterium tuberculosis
IPIIDVPAVPGFGNTTTAP

SEQ ID NO: 1476982 - protein, 21 aa, Mycobacterium tuberculosis
IPIRTGGPMNDPWPRPTQGPA

SEQ ID NO: 1476983 - protein, 19 aa, Mycobacterium tuberculosis
IPIVPIVIRNAEIVASRNS

SEQ ID NO: 1476984 - protein, 22 aa, Mycobacterium tuberculosis
IPLLLEMPMVYTGRALTQATCL

SEQ ID NO: 1476985 - protein, 18 aa, Mycobacterium tuberculosis
IPQFRTLVILSNHGPINL

SEQ ID NO: 1476986 - protein, 31 aa, Mycobacterium tuberculosis
IPSLACGRCRAIARCRSCTGPLSLQGAGSPG

SEQ ID NO: 1476987 - protein, 20 aa, Mycobacterium tuberculosis
IPSPTLPLLLPLKQIGVPDW

SEQ ID NO: 1476988 - protein, 17 aa, Mycobacterium tuberculosis
IPTTLIGPIHINTGFSI

SEQ ID NO: 1476989 - protein, 17 aa, Mycobacterium tuberculosis
IPVDLHTTLSIGPFPFR

SEQ ID NO: 1476990 - protein, 25 aa, Mycobacterium tuberculosis
IQAQDFFFRKIVRDKGVALAHVSGQ

SEQ ID NO: 1476991 - protein, 31 aa, Mycobacterium tuberculosis; identical to SEQ ID NO: 233719

SEQ ID NO: 1476992 - protein, 18 aa, Mycobacterium tuberculosis
IQLLPLWRRVHSHILRIS

SEQ ID NO: 1476993 - protein, 23 aa, Mycobacterium tuberculosis
IQRELPDWLSADVAILGEPTAGC

SEQ ID NO: 1476994 - protein, 17 aa, Mycobacterium tuberculosis
IQSFGYLVGDLNSAAQA

SEQ ID NO: 1476995 - protein, 26 aa, Mycobacterium tuberculosis
IRDFARASFSYGLNAKWPVYLSTKNT

SEQ ID NO: 1476996 - protein, 18 aa, Mycobacterium tuberculosis
IRLRFGLDDGQPRTLDQI

SEQ ID NO: 1476997 - protein, 22 aa, Mycobacterium tuberculosis
IRTDFALVHAWQGDRHGNLMYR

SEQ ID NO: 1476998 - protein, 21 aa, Mycobacterium tuberculosis
IRTICRRAGLSVRYFYESFTD

SEQ ID NO: 1476999 - protein, 22 aa, Mycobacterium tuberculosis
ISADAPPFFVLHGRNDSLVPVQ

SEQ ID NO: 1477000 - protein, 24 aa, Mycobacterium tuberculosis
ISAVRGRNFLGWIHPAATATAPAR

SEQ ID NO: 1477001 - protein, 21 aa, Mycobacterium tuberculosis
ISGGAASMFAAPAAATAAVTP

SEQ ID NO: 1477002 - protein, 19 aa, Mycobacterium tuberculosis
ISMYPRMWAASGVDYPTLL

SEQ ID NO: 1477003 - protein, 21 aa, Mycobacterium tuberculosis
ISNFPPKRHKTRVLAAAEDEV

SEQ ID NO: 1477004 - protein, 25 aa, Mycobacterium tuberculosis
ISPTPRPASVITIARPGTSLSESDR

SEQ ID NO: 1477005 - protein, 21 aa, Mycobacterium tuberculosis
ISQVPPQRWQPFEGGPPEVAA

SEQ ID NO: 1477006 - protein, 18 aa, Mycobacterium tuberculosis
ISVVAAPWLADHAVGPVV

SEQ ID NO: 1477007 - protein, 18 aa, Mycobacterium tuberculosis
ITARGAWEAVKRHFREIG

SEQ ID NO: 1477008 - protein, 23 aa, Mycobacterium tuberculosis
ITGDHQMGFGGFNSGSGNIGFGN

SEQ ID NO: 1477009 - protein, 39 aa, Mycobacterium tuberculosis
ITGNFSNGILWRGNYEGLAGFSFGYPIPLFPAVGADVTG

SEQ ID NO: 1477010 - protein, 25 aa, Mycobacterium tuberculosis
ITIPQLPLGLALSGATPAFAFPLEI

SEQ ID NO: 1477011 - protein, 30 aa, Mycobacterium tuberculosis
ITLSARSAGFAGIRACRRTTAGTSLAARTA

SEQ ID NO: 1477012 - protein, 25 aa, Mycobacterium tuberculosis
ITPRIEHPPVPGARVKEPHITGPRI

SEQ ID NO: 1477013 - protein, 22 aa, Mycobacterium tuberculosis
ITRWAPELCKVAVLDDAAGPLD

SEQ ID NO: 1477014 - protein, 17 aa, Mycobacterium tuberculosis
ITTTGGIGPIVIPDTTI

SEQ ID NO: 1477015 - protein, 20 aa, Mycobacterium tuberculosis
ITVDGPLRFELIDIATATSC

SEQ ID NO: 1477016 - protein, 18 aa, Mycobacterium tuberculosis
IVDGTSWITGADQPGRHV

SEQ ID NO: 1477017 - protein, 18 aa, Mycobacterium tuberculosis
IVEISCCPSAGPRGPYDN

SEQ ID NO: 1477018 - protein, 36 aa, Mycobacterium tuberculosis
IVGLERIGLRFVLEIRVPAGVDGRIMWSNWIDEQLL

SEQ ID NO: 1477019 - protein, 21 aa, Mycobacterium tuberculosis
IVKAGAILVNVNFRYVEGELR

SEQ ID NO: 1477020 - protein, 19 aa, Mycobacterium tuberculosis
IVPPPLIAANRARLTSLVT

SEQ ID NO: 1477021 - protein, 21 aa, Mycobacterium tuberculosis
IVTGLSRLPGSFSGRYAARIV

SEQ ID NO: 1477022 - protein, 19 aa, Mycobacterium tuberculosis
IYSSCAVPPLVAYLDTGKL

SEQ ID NO: 1477023 - protein, 19 aa, Mycobacterium tuberculosis
IYTYHSKTLGWCDIAYNAL

SEQ ID NO: 1477024 - protein, 23 aa, Mycobacterium tuberculosis
KAGEGDAFISAGVETVSRFAKGN

SEQ ID NO: 1477025 - protein, 18 aa, Mycobacterium tuberculosis
KATFDVRVTAPAHWKVIS

SEQ ID NO: 1477026 - protein, 18 aa, Mycobacterium tuberculosis
KATLTFRDPKELRFFTRT

SEQ ID NO: 1477027 - protein, 24 aa, Mycobacterium tuberculosis
KCRLYCGACDAGARSTTSLAAGNG

SEQ ID NO: 1477028 - protein, 20 aa, Mycobacterium tuberculosis
KDGYGRNFLLPRGLAIVASR

SEQ ID NO: 1477029 - protein, 23 aa, Mycobacterium tuberculosis
KDMWGRVVPELAALNLLKESDLG

SEQ ID NO: 1477030 - protein, 17 aa, Mycobacterium tuberculosis
KDRDIAMVFQSYALYPH

SEQ ID NO: 1477031 - protein, 17 aa, Mycobacterium tuberculosis
KEFMVRNTYIYPPKPSM

SEQ ID NO: 1477032 - protein, 19 aa, Mycobacterium tuberculosis
KEGNRFAGVFWSELSSGGV

SEQ ID NO: 1477033 - protein, 18 aa, Mycobacterium tuberculosis
KENDGWRLITTQLNNERV

SEQ ID NO: 1477034 - protein, 17 aa, Mycobacterium tuberculosis
KEVREMQALLAKYGAGH

SEQ ID NO: 1477035 - protein, 32 aa, Mycobacterium tuberculosis
KFARCSWRAGPCGMPILDDAAAWFIGRTASRS

SEQ ID NO: 1477036 - protein, 18 aa, Mycobacterium tuberculosis
KGAVSALLSAARSGDGPG

SEQ ID NO: 1477037 - protein, 26 aa, Mycobacterium tuberculosis
KGGDGGKGGSGLGVGGAGGTGGAGGN

SEQ ID NO: 1477038 - protein, 22 aa, Mycobacterium tuberculosis
KGTGAYAGPRYGFKPTVMPKQV

SEQ ID NO: 1477039 - protein, 21 aa, Mycobacterium tuberculosis
KHRRHVLGPHLLVGGLGGRDR

SEQ ID NO: 1477040 - protein, 18 aa, Mycobacterium tuberculosis
KIGALAITEPGGGSDVGH

SEQ ID NO: 1477041 - protein, 18 aa, Mycobacterium tuberculosis
KILITWRRGTAQGPAGQN

SEQ ID NO: 1477042 - protein, 20 aa, Mycobacterium tuberculosis
KKIKEKLGIGAVVTDDPSND

SEQ ID NO: 1477043 - protein, 17 aa, Mycobacterium tuberculosis
KKPKLLSPELKKLNRPG

SEQ ID NO: 1477044 - protein, 19 aa, Mycobacterium tuberculosis
KKSSVMFGIDLAKRDIAKG

SEQ ID NO: 1477045 - protein, 22 aa, Mycobacterium tuberculosis
KLADLVLWEPAFFGVRPHVVLK

SEQ ID NO: 1477046 - protein, 17 aa, Mycobacterium tuberculosis
KLANLLFTYELQRRLGE

SEQ ID NO: 1477047 - protein, 27 aa, Mycobacterium tuberculosis
KLEETFMFYLPRICEHCLNPSCVASCP

SEQ ID NO: 1477048 - protein, 20 aa, Mycobacterium tuberculosis
KLIRPEERSVAGFNEPVDVP

SEQ ID NO: 1477049 - protein, 17 aa, Mycobacterium tuberculosis
KLLSSILTYHVIAGQAS

SEQ ID NO: 1477050 - protein, 31 aa, Mycobacterium tuberculosis
KLPAAQRRDMMWICRDGDRAKNHLLEANLRL

SEQ ID NO: 1477051 - protein, 23 aa, Mycobacterium tuberculosis
KLQPARYRQLLQHILQHVADGKL

SEQ ID NO: 1477052 - protein, 20 aa, Mycobacterium tuberculosis
KLRGGMRNNIGLELKVAESE

SEQ ID NO: 1477053 - protein, 17 aa, Mycobacterium tuberculosis
KLSVGLGRLAAEDPTLR

SEQ ID NO: 1477054 - protein, 22 aa, Mycobacterium tuberculosis
KLWAQSCEWEPVTPKSLRLLQV

SEQ ID NO: 1477055 - protein, 24 aa, Mycobacterium tuberculosis
KMCLKANTPGAVTWLDTPKRFLST

SEQ ID NO: 1477056 - protein, 19 aa, Mycobacterium tuberculosis
KMRALRQLWARVAEVVGDP

SEQ ID NO: 1477057 - protein, 19 aa, Mycobacterium tuberculosis
KNLMLFAGRAHPELAEQVA

SEQ ID NO: 1477058 - protein, 25 aa, Mycobacterium tuberculosis
KNVDAFLAVCRKWEVLATVIGEVTD

SEQ ID NO: 1477059 - protein, 17 aa, Mycobacterium tuberculosis
KPARGGSSIGVSRVSSW

SEQ ID NO: 1477060 - protein, 20 aa, Mycobacterium tuberculosis
KPDAPVRYRFHFPRQQRGRF

SEQ ID NO: 1477061 - protein, 26 aa, Mycobacterium tuberculosis
KPEQNAWWWYVLKFGRSSAYAEFFDI

SEQ ID NO: 1477062 - protein, 17 aa, Mycobacterium tuberculosis
KPGLRRLAPLAFVRFRI

SEQ ID NO: 1477063 - protein, 31 aa, Mycobacterium tuberculosis
KQASAAKFIWFFATRTRFGLWFRNVAMRTMN

SEQ ID NO: 1477064 - protein, 28 aa, Mycobacterium tuberculosis
KQLGPHMAGGGWAWADFVAEADPSNPDM

SEQ ID NO: 1477065 - protein, 17 aa, Mycobacterium tuberculosis
KQSESNAMWALSIPVPF

SEQ ID NO: 1477066 - protein, 19 aa, Mycobacterium tuberculosis
KRLDFGLLGPLQMTIDGTP

SEQ ID NO: 1477067 - protein, 27 aa, Mycobacterium tuberculosis
KRLPRLTRMQRFWIALYFPLTMRSLCN

SEQ ID NO: 1477068 - protein, 18 aa, Mycobacterium tuberculosis
KRNGWLSGLHATELLGAV

SEQ ID NO: 1477069 - protein, 24 aa, Mycobacterium tuberculosis
KRPEFGKLTPLYPNQRLRLETSTE

SEQ ID NO: 1477070 - protein, 17 aa, Mycobacterium tuberculosis
KRRIVDLGGDPLESAAA

SEQ ID NO: 1477071 - protein, 23 aa, Mycobacterium tuberculosis
KRYTGRGMAFLDLIQEGNLGLIR

SEQ ID NO: 1477072 - protein, 20 aa, Mycobacterium tuberculosis
KSASSLGLDGTEVFDITGID

SEQ ID NO: 1477073 - protein, 21 aa, Mycobacterium tuberculosis
KSICPVCKVVVDAQVNIRHDK

SEQ ID NO: 1477074 - protein, 25 aa, Mycobacterium tuberculosis
KSSSEPIAVIGMGCRFPGGVNNPEQ

SEQ ID NO: 1477075 - protein, 18 aa, Mycobacterium tuberculosis
KSVYRRLVQLWQARRAVT

SEQ ID NO: 1477076 - protein, 24 aa, Mycobacterium tuberculosis
KTAASRNKHGWVTVGDVGYLDDDG

SEQ ID NO: 1477077 - protein, 20 aa, Mycobacterium tuberculosis
KTGMDVCLWLLRNDVCPDKP

SEQ ID NO: 1477078 - protein, 31 aa, Mycobacterium tuberculosis
KTIAEVVNGFGWRGPLGVTYPGVVTHGVVRT

SEQ ID NO: 1477079 - protein, 24 aa, Mycobacterium tuberculosis
KTRLIKRLQAILTDCTAPPASSGP

SEQ ID NO: 1477080 - protein, 20 aa, Mycobacterium tuberculosis
KTVHHYLMRFLGGELSDEDL

SEQ ID NO: 1477081 - protein, 23 aa, Mycobacterium tuberculosis
KVARSLLDYRYRRLPAARRAAHR

SEQ ID NO: 1477082 - protein, 18 aa, Mycobacterium tuberculosis
KVGPFALQDFSLFQVLRY

SEQ ID NO: 1477083 - protein, 21 aa, Mycobacterium tuberculosis
KVPSWISDIANIFNIGAGNWV

SEQ ID NO: 1477084 - protein, 20 aa, Mycobacterium tuberculosis
KVVGCGALHVLWSDLGEIRT

SEQ ID NO: 1477085 - protein, 25 aa, Mycobacterium tuberculosis
KWRAHPADVLPLWVAEMDVKLPPTV

SEQ ID NO: 1477086 - protein, 20 aa, Mycobacterium tuberculosis
KYPDGSFWHQWMQTWFTGPQ

SEQ ID NO: 1477087 - protein, 19 aa, Mycobacterium tuberculosis
LAAAAAWDGLAEELGTAAQ

SEQ ID NO: 1477088 - protein, 18 aa, Mycobacterium tuberculosis
LAAAFANVLARWSASSRF

SEQ ID NO: 1477089 - protein, 18 aa, Mycobacterium tuberculosis
LAAATAWDGLAVELHATA

SEQ ID NO: 1477090 - protein, 17 aa, Mycobacterium tuberculosis
LAAELAVAASSFGSVTS

SEQ ID NO: 1477091 - protein, 23 aa, Mycobacterium tuberculosis
LAAELCLPLVLVIDAAGPALSAA

SEQ ID NO: 1477092 - protein, 23 aa, Mycobacterium tuberculosis
LAAELPLPVGLLKIDVEGLERAV

SEQ ID NO: 1477093 - protein, 19 aa, Mycobacterium tuberculosis
LAALMCYEAHIAGLGDNVA

SEQ ID NO: 1477094 - protein, 17 aa, Mycobacterium tuberculosis
LAAVATDLAGIGSTIGT

SEQ ID NO: 1477095 - protein, 24 aa, Mycobacterium tuberculosis
LADARRLAPGGAIVVGGAAGSSAL

SEQ ID NO: 1477096 - protein, 18 aa, Mycobacterium tuberculosis
LADCGYAGATVRHLLDMR

SEQ ID NO: 1477097 - protein, 18 aa, Mycobacterium tuberculosis
LADHAVGPVVLFPGTGFV

SEQ ID NO: 1477098 - protein, 20 aa, Mycobacterium tuberculosis
LADLVLWEPAFFGVRPHVVL

SEQ ID NO: 1477099 - protein, 18 aa, Mycobacterium tuberculosis
LADRFGCRTIVFTGVAGG

SEQ ID NO: 1477100 - protein, 20 aa, Mycobacterium tuberculosis
LADRRLYLAANRCLAIAARR

SEQ ID NO: 1477101 - protein, 20 aa, Mycobacterium tuberculosis
LAEPGPRSAKEFYRGAPHGV

SEQ ID NO: 1477102 - protein, 29 aa, Mycobacterium tuberculosis
LAEYWHRRIREELKFSGDRAMAAEDPEAK

SEQ ID NO: 1477103 - protein, 20 aa, Mycobacterium tuberculosis
LAFYRPDYGLDLGPDNKPTG

SEQ ID NO: 1477104 - protein, 20 aa, Mycobacterium tuberculosis
LAGEMLELAGIHGRDPAQTL

SEQ ID NO: 1477105 - protein, 17 aa, Mycobacterium tuberculosis
LAGQSWQGAAAAMAAAA

SEQ ID NO: 1477106 - protein, 20 aa, Mycobacterium tuberculosis
LAGRTGLAGLAEQGSPGPAD

SEQ ID NO: 1477107 - protein, 17 aa, Mycobacterium tuberculosis
LAICEASVRVDDPAGIQ

SEQ ID NO: 1477108 - protein, 20 aa, Mycobacterium tuberculosis
LALAADWRVSGDNVKFGATE

SEQ ID NO: 1477109 - protein, 19 aa, Mycobacterium tuberculosis
LALPLLRPQQVIMLGRPTL

SEQ ID NO: 1477110 - protein, 17 aa, Mycobacterium tuberculosis
LAMVFRHRAALHSRYRW

SEQ ID NO: 1477111 - protein, 22 aa, Mycobacterium tuberculosis
LANTGRPLIGNGTNGAPGTGAN

SEQ ID NO: 1477112 - protein, 23 aa, Mycobacterium tuberculosis
LANTGRPLIGNGTNGAPGTGANG

SEQ ID NO: 1477113 - protein, 18 aa, Mycobacterium tuberculosis
LAPPRAGALKDFRVAVWA

SEQ ID NO: 1477114 - protein, 22 aa, Mycobacterium tuberculosis
LAQLRPQPILQLPDTNSGWRLV

SEQ ID NO: 1477115 - protein, 19 aa, Mycobacterium tuberculosis
LAQRPAWLAAAEALTTEGA

SEQ ID NO: 1477116 - protein, 31 aa, Mycobacterium tuberculosis; identical to SEQ ID NO: 233787

SEQ ID NO: 1477117 - protein, 17 aa, Mycobacterium tuberculosis
LAQYPSILVELGNMKNP

SEQ ID NO: 1477118 - protein, 26 aa, Mycobacterium tuberculosis
LARAGSRAAPLLRLPDVRALLDAQLA

SEQ ID NO: 1477119 - protein, 18 aa, Mycobacterium tuberculosis
LARAYGIEVSDFEDEPVH

SEQ ID NO: 1477120 - protein, 21 aa, Mycobacterium tuberculosis
LARELACAYDLDFVDPASNSR

SEQ ID NO: 1477121 - protein, 24 aa, Mycobacterium tuberculosis
LARELADAILIRKVDWVDEITRVH

SEQ ID NO: 1477122 - protein, 17 aa, Mycobacterium tuberculosis
LARTRTLLVASVVETVT

SEQ ID NO: 1477123 - protein, 17 aa, Mycobacterium tuberculosis
LARVFDYTLAIGKTPIV

SEQ ID NO: 1477124 - protein, 25 aa, Mycobacterium tuberculosis
LARVVSMPCLEWFEAQPYEYRDAVL

SEQ ID NO: 1477125 - protein, 21 aa, Mycobacterium tuberculosis
LARYAQRVMDWLHPDGDLTDT

SEQ ID NO: 1477126 - protein, 21 aa, Mycobacterium tuberculosis
LASIGNTWLADPAPFLQQYLA

SEQ ID NO: 1477127 - protein, 19 aa, Mycobacterium tuberculosis
LASWLQRLQSIPGAASLDA

SEQ ID NO: 1477128 - protein, 20 aa, Mycobacterium tuberculosis
LATAAARMVTAWRRQRGQQT

SEQ ID NO: 1477129 - protein, 19 aa, Mycobacterium tuberculosis
LATAPVITEWCELPTGSSP

SEQ ID NO: 1477130 - protein, 17 aa, Mycobacterium tuberculosis
LATTRWLVAILENHQRP

SEQ ID NO: 1477131 - protein, 19 aa, Mycobacterium tuberculosis
LAVGLAIRACQAGHRVLFA

SEQ ID NO: 1477132 - protein, 24 aa, Mycobacterium tuberculosis
LAYMDLRPGTAMREIAVDAVFVGS

SEQ ID NO: 1477133 - protein, 18 aa, Mycobacterium tuberculosis
LCARRSPICSGRWKGASM

SEQ ID NO: 1477134 - protein, 18 aa, Mycobacterium tuberculosis
LCDHFLTISPGEYAKVAG

SEQ ID NO: 1477135 - protein, 20 aa, Mycobacterium tuberculosis
LCELKDIIDRSAAAGDPCGV

SEQ ID NO: 1477136 - protein, 20 aa, Mycobacterium tuberculosis
LCGAATRIGPAVWATSQHLC

SEQ ID NO: 1477137 - protein, 17 aa, Mycobacterium tuberculosis
LCHRRLLADESRTLPTT

SEQ ID NO: 1477138 - protein, 17 aa, Mycobacterium tuberculosis
LCLPTGNPWAARLQKGW

SEQ ID NO: 1477139 - protein, 28 aa, Mycobacterium tuberculosis
LCPRRSRCTGCGVTHVLLPVSALLRRAD

SEQ ID NO: 1477140 - protein, 18 aa, Mycobacterium tuberculosis
LDAGVKVGCFRPPTVPAG

SEQ ID NO: 1477141 - protein, 20 aa, Mycobacterium tuberculosis
LDCVIGAPVLFGRANVVFTR

SEQ ID NO: 1477142 - protein, 20 aa, Mycobacterium tuberculosis
LDDARLASYDGVNRVNPPLR

SEQ ID NO: 1477143 - protein, 22 aa, Mycobacterium tuberculosis
LDERALFLGQWGLRGQRGGEGP

SEQ ID NO: 1477144 - protein, 24 aa, Mycobacterium tuberculosis
LDERGVLRLRALMESFWSDELDRL

SEQ ID NO: 1477145 - protein, 18 aa, Mycobacterium tuberculosis
LDGCAALIVALLGACPAL

SEQ ID NO: 1477146 - protein, 18 aa, Mycobacterium tuberculosis
LDGIPLAIELAASRVRAL

SEQ ID NO: 1477147 - protein, 28 aa, Mycobacterium tuberculosis
LDGLAAYRRSRGLAALSVAWGLWEQASA

SEQ ID NO: 1477148 - protein, 22 aa, Mycobacterium tuberculosis
LDGRLPFDLRRAVLSNGSVILE

SEQ ID NO: 1477149 - protein, 17 aa, Mycobacterium tuberculosis
LDHRAPGPVLALLCDPR

SEQ ID NO: 1477150 - protein, 18 aa, Mycobacterium tuberculosis
LDKMGWRSSDTAELCYTD

SEQ ID NO: 1477151 - protein, 22 aa, Mycobacterium tuberculosis
LDKPKLVFFFDEAHLLFTDASK

SEQ ID NO: 1477152 - protein, 20 aa, Mycobacterium tuberculosis
LDLANQVYLHLAGALHPQHL

SEQ ID NO: 1477153 - protein, 24 aa, Mycobacterium tuberculosis
LDLGSLVAGSRYRGDFEERLKKVL

SEQ ID NO: 1477154 - protein, 20 aa, Mycobacterium tuberculosis
LDMVVGGAVLKHSRDFNLMR

SEQ ID NO: 1477155 - protein, 17 aa, Mycobacterium tuberculosis
LDNIAIEIGTFAGTDRP

SEQ ID NO: 1477156 - protein, 29 aa, Mycobacterium tuberculosis
LDPGAAVQAPWPLLRTFAAGPALSRDAAL

SEQ ID NO: 1477157 - protein, 17 aa, Mycobacterium tuberculosis
LDPYLTPGFTELSSQAG

SEQ ID NO: 1477158 - protein, 27 aa, Mycobacterium tuberculosis
LDQQRQWILHMAKLSAAMAKQAQYVAQ

SEQ ID NO: 1477159 - protein, 17 aa, Mycobacterium tuberculosis
LDRVRVVVIDGAALRGD

SEQ ID NO: 1477160 - protein, 21 aa, Mycobacterium tuberculosis
LDSHVAYWWSAEPQRLSMAAS

SEQ ID NO: 1477161 - protein, 23 aa, Mycobacterium tuberculosis
LDSPELIRLAPRPAARTDPMLLA

SEQ ID NO: 1477162 - protein, 22 aa, Mycobacterium tuberculosis
LDVTHITRWAGCIGNRSTVIAV

SEQ ID NO: 1477163 - protein, 21 aa, Mycobacterium tuberculosis
LDWPAKLRLLDGFRQRENLSW

SEQ ID NO: 1477164 - protein, 17 aa, Mycobacterium tuberculosis
LDYTLPWDVDTVEDSIP

SEQ ID NO: 1477165 - protein, 17 aa, Mycobacterium tuberculosis
LEAAAGVAGLMKAVLAV

SEQ ID NO: 1477166 - protein, 19 aa, Mycobacterium tuberculosis
LECVLRRFPILGFQHPLSG

SEQ ID NO: 1477167 - protein, 20 aa, Mycobacterium tuberculosis
LECVLRRFPILGFQHPLSGL

SEQ ID NO: 1477168 - protein, 18 aa, Mycobacterium tuberculosis
LEEGRRWTVEEFRSTHPV

SEQ ID NO: 1477169 - protein, 22 aa, Mycobacterium tuberculosis
LEHWGCPWSRKPDGRVAVRPFG

SEQ ID NO: 1477170 - protein, 19 aa, Mycobacterium tuberculosis
LEKGPRLGVLGVVVEIDGR

SEQ ID NO: 1477171 - protein, 23 aa, Mycobacterium tuberculosis
LEKTRGAIDFNRPGIPIIASLPS

SEQ ID NO: 1477172 - protein, 24 aa, Mycobacterium tuberculosis
LEPEFVAQGGFSLRDVIAGGKELV

SEQ ID NO: 1477173 - protein, 23 aa, Mycobacterium tuberculosis
LESARELDVWLPVHPVTRRRWPN

SEQ ID NO: 1477174 - protein, 18 aa, Mycobacterium tuberculosis
LETAYVIDFLAYVYEETR

SEQ ID NO: 1477175 - protein, 23 aa, Mycobacterium tuberculosis
LETPSQFFPFTGLNSLTYDVSVA

SEQ ID NO: 1477176 - protein, 24 aa, Mycobacterium tuberculosis
LFANHKKWIGLIIHIGQEGRGANV

SEQ ID NO: 1477177 - protein, 20 aa, Mycobacterium tuberculosis
LFGHSGWQPGDAWMAETTLG

SEQ ID NO: 1477178 - protein, 24 aa, Mycobacterium tuberculosis
LFGHSYGSLLSGIALKDGASSLVD

SEQ ID NO: 1477179 - protein, 31 aa, Mycobacterium tuberculosis
LFLEPFRLSDPFITIDAFQVVAGVLFLENII

SEQ ID NO: 1477180 - protein, 21 aa, Mycobacterium tuberculosis
LFQRRHLLLSGWIKMQEGQLP

SEQ ID NO: 1477181 - protein, 18 aa, Mycobacterium tuberculosis
LFRYPGVRSDSSIFTLPF

SEQ ID NO: 1477182 - protein, 19 aa, Mycobacterium tuberculosis
LFSGHAQTYQALRTQAAAF

SEQ ID NO: 1477183 - protein, 18 aa, Mycobacterium tuberculosis
LFSHVPWLASQLLGAVEA

SEQ ID NO: 1477184 - protein, 23 aa, Mycobacterium tuberculosis
LFSMPIHQVMVMPGSVMTIPGMR

SEQ ID NO: 1477185 - protein, 17 aa, Mycobacterium tuberculosis
LFYPEFSLWCGTTKTAD

SEQ ID NO: 1477186 - protein, 20 aa, Mycobacterium tuberculosis
LGAELGAPVIQGSTRTSERE

SEQ ID NO: 1477187 - protein, 25 aa, Mycobacterium tuberculosis
LGDDLFEHIPHLGALALHHALGALD

SEQ ID NO: 1477188 - protein, 17 aa, Mycobacterium tuberculosis
LGDHRIHNVAALPGAAY

SEQ ID NO: 1477189 - protein, 18 aa, Mycobacterium tuberculosis
LGGHIWADGGIRHPRDVA

SEQ ID NO: 1477190 - protein, 18 aa, Mycobacterium tuberculosis
LGLAEEIGGMPAPPPLAW

SEQ ID NO: 1477191 - protein, 21 aa, Mycobacterium tuberculosis
LGLDGTEVFDITGIDVLNDGK

SEQ ID NO: 1477192 - protein, 24 aa, Mycobacterium tuberculosis
LGLIKVVLALKHGVVPRNLHFTRL

SEQ ID NO: 1477193 - protein, 18 aa, Mycobacterium tuberculosis
LGLILEIAAAAGLIASGM

SEQ ID NO: 1477194 - protein, 23 aa, Mycobacterium tuberculosis
LGLPRLAAGPPTFSITISVDVSH

SEQ ID NO: 1477195 - protein, 17 aa, Mycobacterium tuberculosis
LGQRQRLGLARALGSPA

SEQ ID NO: 1477196 - protein, 17 aa, Mycobacterium tuberculosis
LGRANLYSVCFDLATTD

SEQ ID NO: 1477197 - protein, 17 aa, Mycobacterium tuberculosis
LGRRELLPYSDLDVLLL

SEQ ID NO: 1477198 - protein, 23 aa, Mycobacterium tuberculosis
LGRRELLPYSDLDVLLLHDGKPA

SEQ ID NO: 1477199 - protein, 24 aa, Mycobacterium tuberculosis
LGSPFTSHGLRLGVEASLRSLARV

SEQ ID NO: 1477200 - protein, 26 aa, Mycobacterium tuberculosis
LGTDRSWRPDVVHAHDWLVAHPAIAL

SEQ ID NO: 1477201 - protein, 18 aa, Mycobacterium tuberculosis
LGTMPIEVESSVARVAGA

SEQ ID NO: 1477202 - protein, 17 aa, Mycobacterium tuberculosis
LGVRYLRTGTVPNSHTP

SEQ ID NO: 1477203 - protein, 17 aa, Mycobacterium tuberculosis
LGWLGAQVAVSSLVLDP

SEQ ID NO: 1477204 - protein, 20 aa, Mycobacterium tuberculosis
LGYQRCRVADGMVYGEGSSG

SEQ ID NO: 1477205 - protein, 24 aa, Mycobacterium tuberculosis
LHAAKGLEWDAVFLVGLADGTLPI

SEQ ID NO: 1477206 - protein, 20 aa, Mycobacterium tuberculosis
LHAEVHRLCGPHLAPAPMAN

SEQ ID NO: 1477207 - protein, 19 aa, Mycobacterium tuberculosis
LHDRFRLLTGGSRSAPPAD

SEQ ID NO: 1477208 - protein, 19 aa, Mycobacterium tuberculosis
LHEAELQLAEFIGLDEVKR

SEQ ID NO: 1477209 - protein, 18 aa, Mycobacterium tuberculosis
LHGAWGVRVHDVRASVDA

SEQ ID NO: 1477210 - protein, 18 aa, Mycobacterium tuberculosis
LHGGYGYMREYPVARAYL

SEQ ID NO: 1477211 - protein, 23 aa, Mycobacterium tuberculosis
LHGIGSTLIRLFGHDNVTVFAAR

SEQ ID NO: 1477212 - protein, 22 aa, Mycobacterium tuberculosis
LHHPPMRTFLGVPVRIRDEVFG

SEQ ID NO: 1477213 - protein, 19 aa, Mycobacterium tuberculosis
LHIPRTTWYDGVRFEEVSV

SEQ ID NO: 1477214 - protein, 26 aa, Mycobacterium tuberculosis
LHIRAGDCGRDYRVLSAALLEVTFCG

SEQ ID NO: 1477215 - protein, 25 aa, Mycobacterium tuberculosis
LHNGTVYRWNRPVYDVVDGRPHLRL

SEQ ID NO: 1477216 - protein, 17 aa, Mycobacterium tuberculosis
LHQLPQPIAWPGSSDRN

SEQ ID NO: 1477217 - protein, 22 aa, Mycobacterium tuberculosis
LHSRYHTPVSLIGWSLGGIFAR

SEQ ID NO: 1477218 - protein, 18 aa, Mycobacterium tuberculosis
LIAFGRERMRFVHAHHQL

SEQ ID NO: 1477219 - protein, 17 aa, Mycobacterium tuberculosis
LIERIEAEYARYFTPTG

SEQ ID NO: 1477220 - protein, 22 aa, Mycobacterium tuberculosis
LIHAALRINGFTVMLNDDVPQM

SEQ ID NO: 1477221 - protein, 31 aa, Mycobacterium tuberculosis; identical to SEQ ID NO: 202446

SEQ ID NO: 1477222 - protein, 19 aa, Mycobacterium tuberculosis
LINIHHSFLPAFTGAAPYQ

SEQ ID NO: 1477223 - protein, 18 aa, Mycobacterium tuberculosis
LKAEFFKTLAHPARIRIL

SEQ ID NO: 1477224 - protein, 18 aa, Mycobacterium tuberculosis
LKGLVRVLAFEHPDMRTT

SEQ ID NO: 1477225 - protein, 24 aa, Mycobacterium tuberculosis
LKLDRKIAERRVFPAVDVNPSGTR

SEQ ID NO: 1477226 - protein, 21 aa, Mycobacterium tuberculosis
LKPVLCRQMEVYAGFLEYTDH

SEQ ID NO: 1477227 - protein, 23 aa, Mycobacterium tuberculosis
LKRTGRLSLRHALDMLEQTGRAL

SEQ ID NO: 1477228 - protein, 17 aa, Mycobacterium tuberculosis
LKSATGLALSPTLIFDY

SEQ ID NO: 1477229 - protein, 17 aa, Mycobacterium tuberculosis
LLAALAARRDAELERGV

SEQ ID NO: 1477230 - protein, 18 aa, Mycobacterium tuberculosis
LLAARLLAALAARRDAEL

SEQ ID NO: 1477231 - protein, 18 aa, Mycobacterium tuberculosis
LLAPGILSDRVRGYAREA

SEQ ID NO: 1477232 - protein, 17 aa, Mycobacterium tuberculosis
LLAPRWQMMSDPQLTGY

SEQ ID NO: 1477233 - protein, 18 aa, Mycobacterium tuberculosis
LLASSGFAARLAGRSADE

SEQ ID NO: 1477234 - protein, 20 aa, Mycobacterium tuberculosis
LLEFPGGILGVALNLDEHSV

SEQ ID NO: 1477235 - protein, 17 aa, Mycobacterium tuberculosis
LLERCWDAAYEARSNIV

SEQ ID NO: 1477236 - protein, 28 aa, Mycobacterium tuberculosis
LLGPVGDLFPILSIPGAMSQNFTNVVMT

SEQ ID NO: 1477237 - protein, 17 aa, Mycobacterium tuberculosis
LLGRPLVGDGADGASGP

SEQ ID NO: 1477238 - protein, 20 aa, Mycobacterium tuberculosis
LLGRPLVGNGANGAPGTGAN

SEQ ID NO: 1477239 - protein, 24 aa, Mycobacterium tuberculosis
LLILRRPRAGLSYEALLETVEQRL

SEQ ID NO: 1477240 - protein, 25 aa, Mycobacterium tuberculosis
LLNGPRYWLMNAIEKAPQGPPVTKT

SEQ ID NO: 1477241 - protein, 25 aa, Mycobacterium tuberculosis
LLPGRRMPIPQLPGATAGARSTDIE

SEQ ID NO: 1477242 - protein, 23 aa, Mycobacterium tuberculosis
LLSKHIRLIAAFDHRHIFLDPNP

SEQ ID NO: 1477243 - protein, 24 aa, Mycobacterium tuberculosis
LLSMRTGQGYAEFAVSSFGTDAVI

SEQ ID NO: 1477244 - protein, 19 aa, Mycobacterium tuberculosis
LLVPPSDRPWRLAMSTAGT

SEQ ID NO: 1477245 - protein, 25 aa, Mycobacterium tuberculosis
LMGAEADALCGAGYRERSDERSNQR

SEQ ID NO: 1477246 - protein, 21 aa, Mycobacterium tuberculosis
LMRGYLRLGARACGEPAHDPD

SEQ ID NO: 1477247 - protein, 24 aa, Mycobacterium tuberculosis
LMVEAVAPYVAWMRATAIQAEQAA

SEQ ID NO: 1477248 - protein, 25 aa, Mycobacterium tuberculosis
LNGPFQALFGRPLIGDGANGAPGQP

SEQ ID NO: 1477249 - protein, 18 aa, Mycobacterium tuberculosis
LNPGPATRLVFDLDPGEG

SEQ ID NO: 1477250 - protein, 17 aa, Mycobacterium tuberculosis
LNSQYRWPAMAGAAVAV

SEQ ID NO: 1477251 - protein, 18 aa, Mycobacterium tuberculosis
LPADLLIHNRWHRDPHGS

SEQ ID NO: 1477252 - protein, 17 aa, Mycobacterium tuberculosis
LPAGRLVNFGTVHRVPA

SEQ ID NO: 1477253 - protein, 26 aa, Mycobacterium tuberculosis
LPAMRRAFPSWMAWSPFAPAMRQAVV

SEQ ID NO: 1477254 - protein, 17 aa, Mycobacterium tuberculosis
LPAWAESSTSHYVQTKD

SEQ ID NO: 1477255 - protein, 21 aa, Mycobacterium tuberculosis
LPDATLRLVVDPRKDEVVVEA

SEQ ID NO: 1477256 - protein, 22 aa, Mycobacterium tuberculosis
LPDGALMRRAAFGLATEIGREL

SEQ ID NO: 1477257 - protein, 18 aa, Mycobacterium tuberculosis
LPDGGAWLYAATVRAIKE

SEQ ID NO: 1477258 - protein, 19 aa, Mycobacterium tuberculosis
LPEGTRYVLSITWSDVETP

SEQ ID NO: 1477259 - protein, 24 aa, Mycobacterium tuberculosis
LPEIPQLRWRVTGAPLGLDRPWFV

SEQ ID NO: 1477260 - protein, 18 aa, Mycobacterium tuberculosis
LPELVQWLHVAALGAPLG

SEQ ID NO: 1477261 - protein, 29 aa, Mycobacterium tuberculosis
LPEQYREGMARAWGPVRVAIAAEQAHGAK

SEQ ID NO: 1477262 - protein, 20 aa, Mycobacterium tuberculosis
LPFFAKAVIDALKIHPNINA

SEQ ID NO: 1477263 - protein, 24 aa, Mycobacterium tuberculosis
LPGDLAWQPPLWRALVTTVGADPP

SEQ ID NO: 1477264 - protein, 24 aa, Mycobacterium tuberculosis
LPGRRMPIPQLPGATAGARSTDIE

SEQ ID NO: 1477265 - protein, 17 aa, Mycobacterium tuberculosis
LPHEVHRLRALIVELER

SEQ ID NO: 1477266 - protein, 17 aa, Mycobacterium tuberculosis
LPKDAWLNDLGTYRLDD

SEQ ID NO: 1477267 - protein, 25 aa, Mycobacterium tuberculosis
LPKHFRCVSVDLLARRPVVHRQGPL

SEQ ID NO: 1477268 - protein, 23 aa, Mycobacterium tuberculosis
LPLDCVIGAPVLFGRANVVFTRL

SEQ ID NO: 1477269 - protein, 19 aa, Mycobacterium tuberculosis
LPLGAGRLTREWLPDDPPG

SEQ ID NO: 1477270 - protein, 17 aa, Mycobacterium tuberculosis
LPLRRLLLDHYPSIERI

SEQ ID NO: 1477271 - protein, 19 aa, Mycobacterium tuberculosis
LPLSVTIGPFVSPEITIPQ

SEQ ID NO: 1477272 - protein, 22 aa, Mycobacterium tuberculosis
LPPATYFSGGKLQWILENVDGV

SEQ ID NO: 1477273 - protein, 17 aa, Mycobacterium tuberculosis
LPPEGASAIVFRDTAHA

SEQ ID NO: 1477274 - protein, 18 aa, Mycobacterium tuberculosis
LPPRARDVAMVFQNYALY

SEQ ID NO: 1477275 - protein, 18 aa, Mycobacterium tuberculosis
LPQVAALFLAGHLGARLF

SEQ ID NO: 1477276 - protein, 17 aa, Mycobacterium tuberculosis
LPRELVGEGTLFLLKVI

SEQ ID NO: 1477277 - protein, 26 aa, Mycobacterium tuberculosis
LPTGNPWAARLQKGWRESSTTVSTSG

SEQ ID NO: 1477278 - protein, 22 aa, Mycobacterium tuberculosis
LPVMRALIVVAGLRMSRTPPDI

SEQ ID NO: 1477279 - protein, 20 aa, Mycobacterium tuberculosis
LPVSAIAWGAWGEVGRATFL

SEQ ID NO: 1477280 - protein, 25 aa, Mycobacterium tuberculosis
LQALNDCPLRWLAERHGGTNTRELP

SEQ ID NO: 1477281 - protein, 29 aa, Mycobacterium tuberculosis
LQALTIPSFIPEDFTFLDAIFAGYATVGV

SEQ ID NO: 1477282 - protein, 25 aa, Mycobacterium tuberculosis
LQDYLATVITWHRHIAGLIEQAKSD

SEQ ID NO: 1477283 - protein, 17 aa, Mycobacterium tuberculosis
LQGPRGVAVIFDKNSTR

SEQ ID NO: 1477284 - protein, 19 aa, Mycobacterium tuberculosis
LQLAARAYTASGLSHNLAP

SEQ ID NO: 1477285 - protein, 20 aa, Mycobacterium tuberculosis
LQLSTLAPMRPRVGVHTGDV

SEQ ID NO: 1477286 - protein, 17 aa, Mycobacterium tuberculosis
LQMAIGLPGLSLPRTLI

SEQ ID NO: 1477287 - protein, 25 aa, Mycobacterium tuberculosis
LQPFQATAVIPVIGPVTVTLEGTPA

SEQ ID NO: 1477288 - protein, 21 aa, Mycobacterium tuberculosis
LQVNVRQALTLADQATAAGDA

SEQ ID NO: 1477289 - protein, 19 aa, Mycobacterium tuberculosis
LRAAAQHWATWAMQKQELA

SEQ ID NO: 1477290 - protein, 22 aa, Mycobacterium tuberculosis
LRAAEDALWRWMTAAALVRPRG

SEQ ID NO: 1477291 - protein, 23 aa, Mycobacterium tuberculosis
LRAAEDALWRWMTAAALVRPRGA

SEQ ID NO: 1477292 - protein, 19 aa, Mycobacterium tuberculosis
LRAEAAFEYADRLGYDGVE

SEQ ID NO: 1477293 - protein, 19 aa, Mycobacterium tuberculosis
LRAKVEALEHGRIAVAIAG

SEQ ID NO: 1477294 - protein, 22 aa, Mycobacterium tuberculosis
LRALKPWEGPRHFVLIDDVQDL

SEQ ID NO: 1477295 - protein, 23 aa, Mycobacterium tuberculosis
LRDDGACYAELLTAAGVSVELSN

SEQ ID NO: 1477296 - protein, 18 aa, Mycobacterium tuberculosis
LRECTVLGKLATHAEQGR

SEQ ID NO: 1477297 - protein, 17 aa, Mycobacterium tuberculosis
LRFESRKILGIPDLLVS

SEQ ID NO: 1477298 - protein, 21 aa, Mycobacterium tuberculosis
LRFTGGGYAWLVRLPVGGIES

SEQ ID NO: 1477299 - protein, 17 aa, Mycobacterium tuberculosis
LRGITKLTGITVDDVAK

SEQ ID NO: 1477300 - protein, 20 aa, Mycobacterium tuberculosis
LRGLLTELHRAGAALDYSAL

SEQ ID NO: 1477301 - protein, 20 aa, Mycobacterium tuberculosis
LRLGKPLQFHVGFGDRDADL

SEQ ID NO: 1477302 - protein, 19 aa, Mycobacterium tuberculosis
LRLLPSGGRFIELGKTDIR

SEQ ID NO: 1477303 - protein, 17 aa, Mycobacterium tuberculosis
LRLPGQRYLVVDYKTNH

SEQ ID NO: 1477304 - protein, 17 aa, Mycobacterium tuberculosis
LRLRDHAGWPLYPIRPD

SEQ ID NO: 1477305 - protein, 20 aa, Mycobacterium tuberculosis
LRLVAAGVNPIALGVGIGKA

SEQ ID NO: 1477306 - protein, 20 aa, Mycobacterium tuberculosis
LRMRTTLGVRHWQLEGRIGG

SEQ ID NO: 1477307 - protein, 21 aa, Mycobacterium tuberculosis
LRNMWRFWYQIPMSLPVIGPR

SEQ ID NO: 1477308 - protein, 21 aa, Mycobacterium tuberculosis
LRPRYPAIEIYRVSAPANPGA

SEQ ID NO: 1477309 - protein, 20 aa, Mycobacterium tuberculosis
LRQDGMLALARLQRKMRLVE

SEQ ID NO: 1477310 - protein, 25 aa, Mycobacterium tuberculosis
LRQTCSRLTVEIAEVSAMDVPHEQP

SEQ ID NO: 1477311 - protein, 17 aa, Mycobacterium tuberculosis
LRRAKAMAVVMLALPGV

SEQ ID NO: 1477312 - protein, 18 aa, Mycobacterium tuberculosis
LRRGPAIPRHTCDSRSAV

SEQ ID NO: 1477313 - protein, 19 aa, Mycobacterium tuberculosis
LRRIEPLLATLRAIAVDVD

SEQ ID NO: 1477314 - protein, 19 aa, Mycobacterium tuberculosis
LRRPAPVKFMLSAPTEHEG

SEQ ID NO: 1477315 - protein, 22 aa, Mycobacterium tuberculosis
LRRRDMGVGELLGMVQAGLNHT

SEQ ID NO: 1477316 - protein, 18 aa, Mycobacterium tuberculosis
LRVDEVLFATGRAPRTDD

SEQ ID NO: 1477317 - protein, 17 aa, Mycobacterium tuberculosis
LRVFERFYRADSSRARA

SEQ ID NO: 1477318 - protein, 19 aa, Mycobacterium tuberculosis
LRVGHDGGRIRVHQADLQA

SEQ ID NO: 1477319 - protein, 25 aa, Mycobacterium tuberculosis
LRVWSRATIGLAYASALIIADRHDE

SEQ ID NO: 1477320 - protein, 20 aa, Mycobacterium tuberculosis
LRWCHEAGIELATVYLLSTE

SEQ ID NO: 1477321 - protein, 24 aa, Mycobacterium tuberculosis
LSALGPKLPELWGGSADLAGSNNT

SEQ ID NO: 1477322 - protein, 24 aa, Mycobacterium tuberculosis
LSAVPRALQGLALPTASQSASATP

SEQ ID NO: 1477323 - protein, 23 aa, Mycobacterium tuberculosis
LSESIPIRIPVDIPASVIDGISM

SEQ ID NO: 1477324 - protein, 31 aa, Mycobacterium tuberculosis; identical to SEQ ID NO: 211311

SEQ ID NO: 1477325 - protein, 21 aa, Mycobacterium tuberculosis
LSGPNWSYWPSRVLGSADPTT

SEQ ID NO: 1477326 - protein, 26 aa, Mycobacterium tuberculosis
LSHGRVSVGVGFGWNTDELVDHGVPP

SEQ ID NO: 1477327 - protein, 20 aa, Mycobacterium tuberculosis
LSNILLLGPVGDLFPILSIP

SEQ ID NO: 1477328 - protein, 26 aa, Mycobacterium tuberculosis
LSSSLWRSSFSWWWKVLVRGWPWTAE

SEQ ID NO: 1477329 - protein, 30 aa, Mycobacterium tuberculosis
LSTFTNGALIFGEFDLPQLVVHPYTLTGPI

SEQ ID NO: 1477330 - protein, 28 aa, Mycobacterium tuberculosis
LSTQAAAFHSRFVQALTTAAASYASVEA

SEQ ID NO: 1477331 - protein, 17 aa, Mycobacterium tuberculosis
LSVLQVWQALTEAVSRR

SEQ ID NO: 1477332 - protein, 21 aa, Mycobacterium tuberculosis
LSVPVSGTWVDIRFTLPANTV

SEQ ID NO: 1477333 - protein, 18 aa, Mycobacterium tuberculosis
LTADGLWLHCLYAISGIN

SEQ ID NO: 1477334 - protein, 17 aa, Mycobacterium tuberculosis
LTEAMGLVEIRPELRAV

SEQ ID NO: 1477335 - protein, 19 aa, Mycobacterium tuberculosis
LTEKKCAITAYPDRGFTNA

SEQ ID NO: 1477336 - protein, 20 aa, Mycobacterium tuberculosis
LTEKKCAITAYPDRGFTNAG

SEQ ID NO: 1477337 - protein, 17 aa, Mycobacterium tuberculosis
LTEYGVRVLGGLSALNS

SEQ ID NO: 1477338 - protein, 19 aa, Mycobacterium tuberculosis
LTGAPWVGAASLSMVAAAT

SEQ ID NO: 1477339 - protein, 18 aa, Mycobacterium tuberculosis
LTGCMALGITGPILRSTG

SEQ ID NO: 1477340 - protein, 17 aa, Mycobacterium tuberculosis
LTGDNLVGIGALNSGIG

SEQ ID NO: 1477341 - protein, 23 aa, Mycobacterium tuberculosis
LTGVMTFGLPLAMTLNAVGSPIT

SEQ ID NO: 1477342 - protein, 17 aa, Mycobacterium tuberculosis
LTKLRFTGGGYAWLVRL

SEQ ID NO: 1477343 - protein, 18 aa, Mycobacterium tuberculosis
LTLVPALRDALAQVGRPD

SEQ ID NO: 1477344 - protein, 18 aa, Mycobacterium tuberculosis
LTPLAVDPAHPFPFVSGL

SEQ ID NO: 1477345 - protein, 17 aa, Mycobacterium tuberculosis
LTRADLVICGGGHGMVA

SEQ ID NO: 1477346 - protein, 24 aa, Mycobacterium tuberculosis
LTSVVATCYLLGVSTRRMERLVET

SEQ ID NO: 1477347 - protein, 21 aa, Mycobacterium tuberculosis
LTVAEWSHLLAGHGLVVEHVV

SEQ ID NO: 1477348 - protein, 19 aa, Mycobacterium tuberculosis
LTVTCSRDLVLSAPVKLAE

SEQ ID NO: 1477349 - protein, 18 aa, Mycobacterium tuberculosis
LVAEILRIISGGRLIWDP

SEQ ID NO: 1477350 - protein, 17 aa, Mycobacterium tuberculosis
LVLALRWVHDNIAEFGG

SEQ ID NO: 1477351 - protein, 17 aa, Mycobacterium tuberculosis
LVLASSMVVYGQGRYDC

SEQ ID NO: 1477352 - protein, 19 aa, Mycobacterium tuberculosis
LVLDAGCDWQRARGQLLAL

SEQ ID NO: 1477353 - protein, 18 aa, Mycobacterium tuberculosis
LVLDPGLGFAKTAQHNWA

SEQ ID NO: 1477354 - protein, 18 aa, Mycobacterium tuberculosis
LVLRTPVRELAGYRSDDP

SEQ ID NO: 1477355 - protein, 25 aa, Mycobacterium tuberculosis
LVPPGDGPWRLGLGSAGTFENLRLE

SEQ ID NO: 1477356 - protein, 17 aa, Mycobacterium tuberculosis
LVQGMRVGLAAEVKRTH

SEQ ID NO: 1477357 - protein, 17 aa, Mycobacterium tuberculosis
LVRAGFLAGDALRVLAG

SEQ ID NO: 1477358 - protein, 21 aa, Mycobacterium tuberculosis
LVSGRASFELTQKALMAGIPV

SEQ ID NO: 1477359 - protein, 17 aa, Mycobacterium tuberculosis
LVSPELKKPKLLSPELK

SEQ ID NO: 1477360 - protein, 25 aa, Mycobacterium tuberculosis
LVTPAFASGLMRDGMGTMTLNLGLA

SEQ ID NO: 1477361 - protein, 17 aa, Mycobacterium tuberculosis
LVVKLPNRWPLTDAAGV

SEQ ID NO: 1477362 - protein, 20 aa, Mycobacterium tuberculosis
LVYGHVPFELVSYVCCYNTE

SEQ ID NO: 1477363 - protein, 22 aa, Mycobacterium tuberculosis
LWAATFLRRRGAAADAVLLNPD

SEQ ID NO: 1477364 - protein, 23 aa, Mycobacterium tuberculosis
LWAATFLRRRGAAADAVLLNPDR

SEQ ID NO: 1477365 - protein, 22 aa, Mycobacterium tuberculosis
LWADSFRLALVAAHDDGDSLRV

SEQ ID NO: 1477366 - protein, 27 aa, Mycobacterium tuberculosis
LWRARGRLQEGLAWFAAALADHDAHPA

SEQ ID NO: 1477367 - protein, 18 aa, Mycobacterium tuberculosis
LYHREWWDRYVDVNQRFA

SEQ ID NO: 1477368 - protein, 25 aa, Mycobacterium tuberculosis
LYIQLYLGGFGLELSDIESLRTWGS

SEQ ID NO: 1477369 - protein, 18 aa, Mycobacterium tuberculosis
LYREAPLMGIWEGSGNVS

SEQ ID NO: 1477370 - protein, 17 aa, Mycobacterium tuberculosis
LYVVVLHRFLRWRQRDY

SEQ ID NO: 1477371 - protein, 17 aa, Mycobacterium tuberculosis
MAAAAAPYVTWMSGTSA

SEQ ID NO: 1477372 - protein, 24 aa, Mycobacterium tuberculosis
MAAAVAPYLGWLAAAAAQAQRSAT

SEQ ID NO: 1477373 - protein, 19 aa, Mycobacterium tuberculosis
MAAWADCCWATGVPGESAV

SEQ ID NO: 1477374 - protein, 29 aa, Mycobacterium tuberculosis
MAFSIELGIYFPGRWGARIEDIVIVTEDG

SEQ ID NO: 1477375 - protein, 20 aa, Mycobacterium tuberculosis
MALLGRPLIGHGADGAPGTG

SEQ ID NO: 1477376 - protein, 21 aa, Mycobacterium tuberculosis
MANSLPGQWTAHVTLARRVGG

SEQ ID NO: 1477377 - protein, 17 aa, Mycobacterium tuberculosis
MASESWLGPSSAGMAAA

SEQ ID NO: 1477378 - protein, 17 aa, Mycobacterium tuberculosis
MASVIFSLEMSKSEIVM

SEQ ID NO: 1477379 - protein, 19 aa, Mycobacterium tuberculosis
MAVAIPRERTMPAVLSNLD

SEQ ID NO: 1477380 - protein, 25 aa, Mycobacterium tuberculosis
MDPQHRMLLEVAWEALEHAGIPPDS

SEQ ID NO: 1477381 - protein, 18 aa, Mycobacterium tuberculosis
MDQPYPVAMAKLGQAIAT

SEQ ID NO: 1477382 - protein, 17 aa, Mycobacterium tuberculosis
MEKFDYTKGFKFSTYAT

SEQ ID NO: 1477383 - protein, 17 aa, Mycobacterium tuberculosis
MFDRMVVAKNAELIEHY

SEQ ID NO: 1477384 - protein, 24 aa, Mycobacterium tuberculosis
MGAEADALCGAGYGERSDERSNQR

SEQ ID NO: 1477385 - protein, 24 aa, Mycobacterium tuberculosis
MGAEADALCGAGYREGSDERSNQR

SEQ ID NO: 1477386 - protein, 20 aa, Mycobacterium tuberculosis
MGATVTGWVARLPAAPQTTR

SEQ ID NO: 1477387 - protein, 21 aa, Mycobacterium tuberculosis
MGATVTGWVARLPAAPQTTRA

SEQ ID NO: 1477388 - protein, 18 aa, Mycobacterium tuberculosis
MGDSHVGLQARLMSQALR

SEQ ID NO: 1477389 - protein, 25 aa, Mycobacterium tuberculosis
MGMGGSIPFIAEFAAAFPQATILVT

SEQ ID NO: 1477390 - protein, 18 aa, Mycobacterium tuberculosis
MGRLAVVVDFAMEADAQY

SEQ ID NO: 1477391 - protein, 22 aa, Mycobacterium tuberculosis
MGRQAFAAVLGRGLANTGQLVL

SEQ ID NO: 1477392 - protein, 22 aa, Mycobacterium tuberculosis
MGSMVFPGYGAELLRWLDRAPQ

SEQ ID NO: 1477393 - protein, 19 aa, Mycobacterium tuberculosis
MGTPWLTAFAQRSRFAEAF

SEQ ID NO: 1477394 - protein, 28 aa, Mycobacterium tuberculosis
MIVDEPFMLPAHIDFAALKVKFDGGTLP

SEQ ID NO: 1477395 - protein, 19 aa, Mycobacterium tuberculosis
MLDLGFLPDIERILRQIPA

SEQ ID NO: 1477396 - protein, 18 aa, Mycobacterium tuberculosis
MLDVLRAALPQTVALLGT

SEQ ID NO: 1477397 - protein, 31 aa, Mycobacterium tuberculosis
MLESFLFYSGFYLPMYWSSRGKLTNTADLIR

SEQ ID NO: 1477398 - protein, 19 aa, Mycobacterium tuberculosis
MLRHRGPQLLPAVFSHSQQ

SEQ ID NO: 1477399 - protein, 21 aa, Mycobacterium tuberculosis
MLRWCHEAGIELATVYLLSTE

SEQ ID NO: 1477400 - protein, 19 aa, Mycobacterium tuberculosis
MMDDSFFRGELIYVFDGDE

SEQ ID NO: 1477401 - protein, 20 aa, Mycobacterium tuberculosis
MNAFGIALLCHVLLVETDDG

SEQ ID NO: 1477402 - protein, 24 aa, Mycobacterium tuberculosis
MNPIARLVWRLCKIDGKPSRYRSE

SEQ ID NO: 1477403 - protein, 27 aa, Mycobacterium tuberculosis
MPEGKYIPRLGGMAFRDPDWADEVYVF

SEQ ID NO: 1477404 - protein, 17 aa, Mycobacterium tuberculosis
MPRKPGGDLARLPSRVW

SEQ ID NO: 1477405 - protein, 17 aa, Mycobacterium tuberculosis
MPVDGDPVFRIGSTTKT

SEQ ID NO: 1477406 - protein, 19 aa, Mycobacterium tuberculosis
MQGRIAGSRLEFFESSSHM

SEQ ID NO: 1477407 - protein, 17 aa, Mycobacterium tuberculosis
MQRLAPLGPVYQAGTLS

SEQ ID NO: 1477408 - protein, 22 aa, Mycobacterium tuberculosis
MRADGGFSYALAPPRAGALKDF

SEQ ID NO: 1477409 - protein, 18 aa, Mycobacterium tuberculosis
MRALIVVAGLRMSRTPPD

SEQ ID NO: 1477410 - protein, 20 aa, Mycobacterium tuberculosis
MRHGMYWSGDLAYRDSEGWI

SEQ ID NO: 1477411 - protein, 17 aa, Mycobacterium tuberculosis
MRLILATMLVAGRLLAT

SEQ ID NO: 1477412 - protein, 19 aa, Mycobacterium tuberculosis
MRRALEYATGLGVLIAQHA

SEQ ID NO: 1477413 - protein, 18 aa, Mycobacterium tuberculosis
MRRHPAFLGRQRAAERSA

SEQ ID NO: 1477414 - protein, 17 aa, Mycobacterium tuberculosis
MSAALQALATILTGRGI

SEQ ID NO: 1477415 - protein, 18 aa, Mycobacterium tuberculosis
MSRLSGYLTPQARATFEA

SEQ ID NO: 1477416 - protein, 17 aa, Mycobacterium tuberculosis
MSVPPGWSAPPATPQAQ

SEQ ID NO: 1477417 - protein, 17 aa, Mycobacterium tuberculosis
MSVPPSWATPSSTPVSA

SEQ ID NO: 1477418 - protein, 21 aa, Mycobacterium tuberculosis
MTRAASPYVGWLNTAAGQAAQ

SEQ ID NO: 1477419 - protein, 17 aa, Mycobacterium tuberculosis
MTRWQALVNWSGTDPVA

SEQ ID NO: 1477420 - protein, 28 aa, Mycobacterium tuberculosis
MVAACLKWEGGYVWACKNYDGDVQSDTV

SEQ ID NO: 1477421 - protein, 18 aa, Mycobacterium tuberculosis
MVANRSRILGFYRLAMVF

SEQ ID NO: 1477422 - protein, 23 aa, Mycobacterium tuberculosis
MVLPELRALANRAGVKGTSGMRK

SEQ ID NO: 1477423 - protein, 24 aa, Mycobacterium tuberculosis
MVNGIAFCGMLRPPGNSVKAGRPP

SEQ ID NO: 1477424 - protein, 17 aa, Mycobacterium tuberculosis
MVSGGWNQAPSALLGGG

SEQ ID NO: 1477425 - protein, 17 aa, Mycobacterium tuberculosis
MVTDRRVLLTLPISHVY

SEQ ID NO: 1477426 - protein, 18 aa, Mycobacterium tuberculosis
MWESMKIVEQCLDKLRPG

SEQ ID NO: 1477427 - protein, 17 aa, Mycobacterium tuberculosis
MWIQAATVMSHYQAVAH

SEQ ID NO: 1477428 - protein, 25 aa, Mycobacterium tuberculosis
MYEQMWAADVAAMVGYHGGASAAAA

SEQ ID NO: 1477429 - protein, 18 aa, Mycobacterium tuberculosis
MYTKRGGDYVSVGPAEKI

SEQ ID NO: 1477430 - protein, 28 aa, Mycobacterium tuberculosis
NAAFEEARRRFEASWNRENGEHPINDSA

SEQ ID NO: 1477431 - protein, 22 aa, Mycobacterium tuberculosis
NADIAMAFERYRIVTGDGSLEE

SEQ ID NO: 1477432 - protein, 21 aa, Mycobacterium tuberculosis
NAETGTVWWPECSKEAYADGI

SEQ ID NO: 1477433 - protein, 29 aa, Mycobacterium tuberculosis
NAGLTAGAGAWAMWGWVTPAAAAGGWPTW

SEQ ID NO: 1477434 - protein, 24 aa, Mycobacterium tuberculosis
NAGWLGFGGAGGIGGIGGNANGGA

SEQ ID NO: 1477435 - protein, 25 aa, Mycobacterium tuberculosis
NALNEGRGDFFAVVRSLALFVNALH

SEQ ID NO: 1477436 - protein, 18 aa, Mycobacterium tuberculosis
NALYMSGSVPGVIAQALF

SEQ ID NO: 1477437 - protein, 23 aa, Mycobacterium tuberculosis
NANLGGGNWGFANLGSGNIGNTN

SEQ ID NO: 1477438 - protein, 27 aa, Mycobacterium tuberculosis
NAPAQTLLGRPLIGNGADGSTPGQAGG

SEQ ID NO: 1477439 - protein, 21 aa, Mycobacterium tuberculosis
NCDKGRWAFTYATQPDVITTP

SEQ ID NO: 1477440 - protein, 22 aa, Mycobacterium tuberculosis
NCDVTCGGLFYATDEVQQSAFT

SEQ ID NO: 1477441 - protein, 20 aa, Mycobacterium tuberculosis
NDGMLRVRATLVLDGDTLRV

SEQ ID NO: 1477442 - protein, 24 aa, Mycobacterium tuberculosis
NDQVAALFRMWLRDAVRRVATGVL

SEQ ID NO: 1477443 - protein, 18 aa, Mycobacterium tuberculosis
NDVCPDKPTWIMPRDSWL

SEQ ID NO: 1477444 - protein, 19 aa, Mycobacterium tuberculosis
NEALYDWNYQRQLLSIRLA

SEQ ID NO: 1477445 - protein, 29 aa, Mycobacterium tuberculosis
NGAAGGAGGRLFGNGGAGGNGGTAGQGGD

SEQ ID NO: 1477446 - protein, 26 aa, Mycobacterium tuberculosis
NGALKFPSLHASPPMLAGKHIWEVSN

SEQ ID NO: 1477447 - protein, 21 aa, Mycobacterium tuberculosis
NGGAGGLLFGNGGNGGNAGAG

SEQ ID NO: 1477448 - protein, 20 aa, Mycobacterium tuberculosis
NGGAGGLLFGTAGAGGNGGL

SEQ ID NO: 1477449 - protein, 29 aa, Mycobacterium tuberculosis
NGGAGGQAALLFGRGGTGGAGGYGGDGGG

SEQ ID NO: 1477450 - protein, 19 aa, Mycobacterium tuberculosis
NGGDAGWLIGNGGAGGSGA

SEQ ID NO: 1477451 - protein, 20 aa, Mycobacterium tuberculosis
NGGDGGFGGGAGAGGGGLTA

SEQ ID NO: 1477452 - protein, 19 aa, Mycobacterium tuberculosis
NGGDGGWLIGNGGAGGSGA

SEQ ID NO: 1477453 - protein, 25 aa, Mycobacterium tuberculosis
NGGGRLAPRPVFRPPVDPASRQAFG

SEQ ID NO: 1477454 - protein, 18 aa, Mycobacterium tuberculosis
NGGLAGIGGNAGFVGNGG

SEQ ID NO: 1477455 - protein, 21 aa, Mycobacterium tuberculosis
NGGSGGNGFDSFASGGTGGAG

SEQ ID NO: 1477456 - protein, 22 aa, Mycobacterium tuberculosis
NGGVVLLMWAGILAYLDRYGYD

SEQ ID NO: 1477457 - protein, 18 aa, Mycobacterium tuberculosis
NGLKELWDKLTGWVTGLF

SEQ ID NO: 1477458 - protein, 31 aa, Mycobacterium tuberculosis
NGMWGAPQLGRWKWHDPWVHASLLAQNNTRV

SEQ ID NO: 1477459 - protein, 19 aa, Mycobacterium tuberculosis
NGQFFPRWTYEKTEPRDGE

SEQ ID NO: 1477460 - protein, 25 aa, Mycobacterium tuberculosis
NGVDGFDINETTGRDGGDGGDGGYG

SEQ ID NO: 1477461 - protein, 17 aa, Mycobacterium tuberculosis
NGYRLTGKLHIRGKSRE

SEQ ID NO: 1477462 - protein, 25 aa, Mycobacterium tuberculosis
NHSNGLLWRGDNQGLIDLAIGVDIP

SEQ ID NO: 1477463 - protein, 19 aa, Mycobacterium tuberculosis
NICVSYRITGDIDLARLRD

SEQ ID NO: 1477464 - protein, 19 aa, Mycobacterium tuberculosis
NIEYLASVVMTRDGVAYPD

SEQ ID NO: 1477465 - protein, 17 aa, Mycobacterium tuberculosis
NIGGLSVPHSWNLPPAV

SEQ ID NO: 1477466 - protein, 20 aa, Mycobacterium tuberculosis
NKLAAPVGVRSDCLGVDAPL

SEQ ID NO: 1477467 - protein, 23 aa, Mycobacterium tuberculosis
NKYRLIFEKLRLEPGDRLLDVGC

SEQ ID NO: 1477468 - protein, 20 aa, Mycobacterium tuberculosis
NLLGWPSINVPAGFTSDGLP

SEQ ID NO: 1477469 - protein, 20 aa, Mycobacterium tuberculosis
NLSIRDGWWDEWYDGENGWE

SEQ ID NO: 1477470 - protein, 18 aa, Mycobacterium tuberculosis
NLVPRLFTLDRDFIQEIR

SEQ ID NO: 1477471 - protein, 17 aa, Mycobacterium tuberculosis
NNIGFGLTGDNLVGIGA

SEQ ID NO: 1477472 - protein, 25 aa, Mycobacterium tuberculosis
NPHFYQNFIHEFGMSRSRRHVTAAS

SEQ ID NO: 1477473 - protein, 17 aa, Mycobacterium tuberculosis
NPMRQLRITVGLIADLK

SEQ ID NO: 1477474 - protein, 25 aa, Mycobacterium tuberculosis
NPPGDERHMLWFALMKPMTSTATGR

SEQ ID NO: 1477475 - protein, 19 aa, Mycobacterium tuberculosis
NQFPYQSKTGWVYDSGDYE

SEQ ID NO: 1477476 - protein, 19 aa, Mycobacterium tuberculosis
NQIRWLFEKLLGESPRRSP

SEQ ID NO: 1477477 - protein, 17 aa, Mycobacterium tuberculosis
NQQGFNIASGWNSGTGN

SEQ ID NO: 1477478 - protein, 22 aa, Mycobacterium tuberculosis
NRAVELACTVGRTLKSGTVNLE

SEQ ID NO: 1477479 - protein, 17 aa, Mycobacterium tuberculosis
NRLAHRLAGCGAGPGEC

SEQ ID NO: 1477480 - protein, 20 aa, Mycobacterium tuberculosis
NRNAFVQLVLSNLFGQNAPA

SEQ ID NO: 1477481 - protein, 19 aa, Mycobacterium tuberculosis
NRQEIKQALLALQRVSERD

SEQ ID NO: 1477482 - protein, 17 aa, Mycobacterium tuberculosis
NRSLDCVDDELAGSAHF

SEQ ID NO: 1477483 - protein, 23 aa, Mycobacterium tuberculosis
NRTGCGRCSSRQTQNPERGRKRI

SEQ ID NO: 1477484 - protein, 20 aa, Mycobacterium tuberculosis
NSGHGNTGFFNAGSFNTGML

SEQ ID NO: 1477485 - protein, 17 aa, Mycobacterium tuberculosis
NSGSYNFGFGNTGNNNI

SEQ ID NO: 1477486 - protein, 18 aa, Mycobacterium tuberculosis
NSKECYSSGLADLAQDLA

SEQ ID NO: 1477487 - protein, 17 aa, Mycobacterium tuberculosis
NSQPWRWVAESGSEHTT

SEQ ID NO: 1477488 - protein, 33 aa, Mycobacterium tuberculosis
NSRLTDPEVLEWRYPVLLREFAVRQGSGGAGRW

SEQ ID NO: 1477489 - protein, 19 aa, Mycobacterium tuberculosis
NSRVLKWIVDRIEHKAGGA

SEQ ID NO: 1477490 - protein, 26 aa, Mycobacterium tuberculosis
NTGHAAELFGWLGPHPDTMVSSAATI

SEQ ID NO: 1477491 - protein, 26 aa, Mycobacterium tuberculosis
NTNTGAFFIGHSGLLNSGGGQHVGIS

SEQ ID NO: 1477492 - protein, 25 aa, Mycobacterium tuberculosis
NTPVVWRGPMLHRALQQFLADVYWG

SEQ ID NO: 1477493 - protein, 19 aa, Mycobacterium tuberculosis
NTVPRGGVLGTQRLLDELD

SEQ ID NO: 1477494 - protein, 17 aa, Mycobacterium tuberculosis
NVANGFLNGEARLPLAL

SEQ ID NO: 1477495 - protein, 30 aa, Mycobacterium tuberculosis
NVGSGGSGFWNIAGNLGNSGFLNVGPLTSG

SEQ ID NO: 1477496 - protein, 24 aa, Mycobacterium tuberculosis
NYAPRPLLDLPWDIQESPAGMAVA

SEQ ID NO: 1477497 - protein, 19 aa, Mycobacterium tuberculosis
NYGSLNWGSGNTGTGNAGS

SEQ ID NO: 1477498 - protein, 22 aa, Mycobacterium tuberculosis
NYRNNWKRLGFTDDEVSRPGSD

SEQ ID NO: 1477499 - protein, 28 aa, Mycobacterium tuberculosis
NYSLARWRKADAALGRPVVSNQVRFSLA

SEQ ID NO: 1477500 - protein, 19 aa, Mycobacterium tuberculosis
PAAAAAVACAHVLRRRPGQ

SEQ ID NO: 1477501 - protein, 18 aa, Mycobacterium tuberculosis
PAAGPAWFDIAGVRMAPA

SEQ ID NO: 1477502 - protein, 18 aa, Mycobacterium tuberculosis
PAALRLLATDAIVVLVSA

SEQ ID NO: 1477503 - protein, 41 aa, Mycobacterium tuberculosis
PAAVAANREAFLALIRSNWLGLNAPWIAAVESLYEEYWAAD

SEQ ID NO: 1477504 - protein, 17 aa, Mycobacterium tuberculosis
PADEAKYADWARSHMAA

SEQ ID NO: 1477505 - protein, 17 aa, Mycobacterium tuberculosis
PAFFGVRPHVVLKGGAI

SEQ ID NO: 1477506 - protein, 18 aa, Mycobacterium tuberculosis
PAGGTGIFAPGMTGASSA

SEQ ID NO: 1477507 - protein, 19 aa, Mycobacterium tuberculosis
PAGRPFIAAGLAIAAVGHR

SEQ ID NO: 1477508 - protein, 25 aa, Mycobacterium tuberculosis
PAGSGAMGSTGFAGGAGGDGGNGGG

SEQ ID NO: 1477509 - protein, 22 aa, Mycobacterium tuberculosis
PAHLWWIRSQLRSMLVEDVRAR

SEQ ID NO: 1477510 - protein, 20 aa, Mycobacterium tuberculosis
PAIKGMWTVPVFGNPSGVTY

SEQ ID NO: 1477511 - protein, 17 aa, Mycobacterium tuberculosis
PAKRLAQALGINDLGNT

SEQ ID NO: 1477512 - protein, 24 aa, Mycobacterium tuberculosis
PAPPRLRSPLVLLDGASMWFRSFF

SEQ ID NO: 1477513 - protein, 19 aa, Mycobacterium tuberculosis
PAPPRPPTPPLPINSGPAP

SEQ ID NO: 1477514 - protein, 18 aa, Mycobacterium tuberculosis
PAPPRPPVPPAPPRPPGE

SEQ ID NO: 1477515 - protein, 24 aa, Mycobacterium tuberculosis
PAPPRPPVPPAPPRPPGEPTPVPP

SEQ ID NO: 1477516 - protein, 25 aa, Mycobacterium tuberculosis
PAPPVRRLAERGAPEIQAYDPVFSP

SEQ ID NO: 1477517 - protein, 17 aa, Mycobacterium tuberculosis
PAPVSWADFCAGSDGDA

SEQ ID NO: 1477518 - protein, 26 aa, Mycobacterium tuberculosis
PARKLREIRMALTLDKTFTKSEILTR

SEQ ID NO: 1477519 - protein, 20 aa, Mycobacterium tuberculosis
PARLHPGSFYALPQSPQLFK

SEQ ID NO: 1477520 - protein, 20 aa, Mycobacterium tuberculosis
PARVANLVERLRAAEKELER

SEQ ID NO: 1477521 - protein, 24 aa, Mycobacterium tuberculosis
PASGPAPFPAVPVDLPAPADIANG

SEQ ID NO: 1477522 - protein, 22 aa, Mycobacterium tuberculosis
PASLPTALFVDVRELITAPQYA

SEQ ID NO: 1477523 - protein, 21 aa, Mycobacterium tuberculosis
PATGARLRWAPAQGPSATPAQ

SEQ ID NO: 1477524 - protein, 23 aa, Mycobacterium tuberculosis
PATKADLYAAVDAMRADMRELLE

SEQ ID NO: 1477525 - protein, 23 aa, Mycobacterium tuberculosis
PAVARLPCVWVVDVDSVQHEPSA

SEQ ID NO: 1477526 - protein, 18 aa, Mycobacterium tuberculosis
PAVGFGGRHERSNAELLA

SEQ ID NO: 1477527 - protein, 25 aa, Mycobacterium tuberculosis
PAVLGIKVARRLLANVAHVAVFDTA

SEQ ID NO: 1477528 - protein, 17 aa, Mycobacterium tuberculosis
PAVSWARPVETLTTNMV

SEQ ID NO: 1477529 - protein, 30 aa, Mycobacterium tuberculosis
PAYDLAKGCALTVIRAAFQLARSDADIAAL

SEQ ID NO: 1477530 - protein, 21 aa, Mycobacterium tuberculosis
PDAHLYCAIAIFGDKVTALQL

SEQ ID NO: 1477531 - protein, 26 aa, Mycobacterium tuberculosis
PDALVGPCWPAVFAAIGSAVTDTGEP

SEQ ID NO: 1477532 - protein, 20 aa, Mycobacterium tuberculosis
PDAPPRAVMKVAVLAESELG

SEQ ID NO: 1477533 - protein, 23 aa, Mycobacterium tuberculosis
PDAPQLAPAVAWVKKRAGRTPRT

SEQ ID NO: 1477534 - protein, 17 aa, Mycobacterium tuberculosis
PDDFEVPPMPAPVEPQG

SEQ ID NO: 1477535 - protein, 22 aa, Mycobacterium tuberculosis
PDEFARRLPFMAAKRAFSEPVA

SEQ ID NO: 1477536 - protein, 17 aa, Mycobacterium tuberculosis
PDEIYCAALEGIKKVQY

SEQ ID NO: 1477537 - protein, 23 aa, Mycobacterium tuberculosis
PDETNFEYGLECILDHAGRLIEQ

SEQ ID NO: 1477538 - protein, 19 aa, Mycobacterium tuberculosis
PDGALMRRAAFGLATEIGR

SEQ ID NO: 1477539 - protein, 20 aa, Mycobacterium tuberculosis
PDGALMRRAAFGLATEIGRE

SEQ ID NO: 1477540 - protein, 19 aa, Mycobacterium tuberculosis
PDGDYRFGQQIVVSHDGGD

SEQ ID NO: 1477541 - protein, 17 aa, Mycobacterium tuberculosis
PDGGGAHDTVVFDKTGT

SEQ ID NO: 1477542 - protein, 18 aa, Mycobacterium tuberculosis
PDIFVEFSRWRGLSPDGR

SEQ ID NO: 1477543 - protein, 20 aa, Mycobacterium tuberculosis
PDIPIPAIHIDFDGAADAGF

SEQ ID NO: 1477544 - protein, 17 aa, Mycobacterium tuberculosis
PDLGGRLRAGRSRNDQV

SEQ ID NO: 1477545 - protein, 20 aa, Mycobacterium tuberculosis
PDLLALGALLHDIGKGRGTD

SEQ ID NO: 1477546 - protein, 17 aa, Mycobacterium tuberculosis
PDPPGPHLLVLARGPEG

SEQ ID NO: 1477547 - protein, 20 aa, Mycobacterium tuberculosis
PDPRAADIVETWAHVLDQLE

SEQ ID NO: 1477548 - protein, 18 aa, Mycobacterium tuberculosis
PDQFLGAHVRRVTGRKNL

SEQ ID NO: 1477549 - protein, 35 aa, Mycobacterium tuberculosis; identical to SEQ ID NO: 233978

SEQ ID NO: 1477550 - protein, 27 aa, Mycobacterium tuberculosis
PDRVDTVLRAKVDGAWNLHELTEDMDL

SEQ ID NO: 1477551 - protein, 24 aa, Mycobacterium tuberculosis
PDSLCGVRVFFPDPWPKARHHKRR

SEQ ID NO: 1477552 - protein, 17 aa, Mycobacterium tuberculosis
PDTAIFADERWRNYHNR

SEQ ID NO: 1477553 - protein, 17 aa, Mycobacterium tuberculosis
PDTPGGAGEPGGAGGAG

SEQ ID NO: 1477554 - protein, 20 aa, Mycobacterium tuberculosis
PDTWVLWNLTGGPRGGCACH

SEQ ID NO: 1477555 - protein, 23 aa, Mycobacterium tuberculosis
PDYLVTFASLWASVNVEDWKCWA

SEQ ID NO: 1477556 - protein, 23 aa, Mycobacterium tuberculosis
PDYLVTFASLWVSVNVEDWKCWA

SEQ ID NO: 1477557 - protein, 22 aa, Mycobacterium tuberculosis
PEAIAYGLIPRAHRGIVAVNEL

SEQ ID NO: 1477558 - protein, 17 aa, Mycobacterium tuberculosis
PECLAMLQRCEKIRRRL

SEQ ID NO: 1477559 - protein, 17 aa, Mycobacterium tuberculosis
PECQSPLFLHVDASDPN

SEQ ID NO: 1477560 - protein, 18 aa, Mycobacterium tuberculosis
PEDAWQFAGRVRELTGGT

SEQ ID NO: 1477561 - protein, 25 aa, Mycobacterium tuberculosis
PEDCHFCSQSGLFASPVRSAWLDIP

SEQ ID NO: 1477562 - protein, 22 aa, Mycobacterium tuberculosis
PEFAIPPIGVGGFTLPQITTQE

SEQ ID NO: 1477563 - protein, 25 aa, Mycobacterium tuberculosis
PEFDFPRLRTLLCTEAIAAADLMSA

SEQ ID NO: 1477564 - protein, 18 aa, Mycobacterium tuberculosis
PEFLNRIDDIIVFHQLTR

SEQ ID NO: 1477565 - protein, 20 aa, Mycobacterium tuberculosis
PEHRRIMSLVAIGAAVENVK

SEQ ID NO: 1477566 - protein, 29 aa, Mycobacterium tuberculosis
PEIDDEALVECRPRRGQPRQLLTNIADAR

SEQ ID NO: 1477567 - protein, 23 aa, Mycobacterium tuberculosis
PELAGRWELPGGKVAAGETERAA

SEQ ID NO: 1477568 - protein, 19 aa, Mycobacterium tuberculosis
PELEVPAMGVLPTVDPKVA

SEQ ID NO: 1477569 - protein, 17 aa, Mycobacterium tuberculosis
PELYRITYDGSIADEPH

SEQ ID NO: 1477570 - protein, 24 aa, Mycobacterium tuberculosis
PEMMATAAFDLARIGSQVSAASAV

SEQ ID NO: 1477571 - protein, 19 aa, Mycobacterium tuberculosis
PEMRQWLRNWVGKAVGKAP

SEQ ID NO: 1477572 - protein, 20 aa, Mycobacterium tuberculosis
PEPPALPAFSAINPPPKEDQ

SEQ ID NO: 1477573 - protein, 21 aa, Mycobacterium tuberculosis
PETPARPVLVVDFGAQYAQLI

SEQ ID NO: 1477574 - protein, 20 aa, Mycobacterium tuberculosis
PEVESVLAGVGRLFAEGVAV

SEQ ID NO: 1477575 - protein, 30 aa, Mycobacterium tuberculosis; identical to SEQ ID NO: 209852

SEQ ID NO: 1477576 - protein, 24 aa, Mycobacterium tuberculosis
PFFNNYRPQFYFRTTDVTGVVTLP

SEQ ID NO: 1477577 - protein, 17 aa, Mycobacterium tuberculosis
PFMAAKRAFSEPVALNW

SEQ ID NO: 1477578 - protein, 32 aa, Mycobacterium tuberculosis
PFPTTARLTGRWLRGRLPTLNDWLRGIPVLDR

SEQ ID NO: 1477579 - protein, 20 aa, Mycobacterium tuberculosis
PFTPRAKKVLELSLREALQL

SEQ ID NO: 1477580 - protein, 17 aa, Mycobacterium tuberculosis
PGAAFGGNGNTGGNGGN

SEQ ID NO: 1477581 - protein, 24 aa, Mycobacterium tuberculosis
PGAGSLWAAAAWDQVSAELQSAAE

SEQ ID NO: 1477582 - protein, 17 aa, Mycobacterium tuberculosis
PGAPGQAGGAGGSAGLL

SEQ ID NO: 1477583 - protein, 17 aa, Mycobacterium tuberculosis
PGDAYWLLRHAIACPDP

SEQ ID NO: 1477584 - protein, 29 aa, Mycobacterium tuberculosis
PGDDTAIWRRIRVVPFEVVIPADEQDREL

SEQ ID NO: 1477585 - protein, 19 aa, Mycobacterium tuberculosis
PGDRAEVLASLNKLGYTPG

SEQ ID NO: 1477586 - protein, 18 aa, Mycobacterium tuberculosis
PGELNRFVFAMPEQLGRI

SEQ ID NO: 1477587 - protein, 19 aa, Mycobacterium tuberculosis
PGGAAFGLGNGGNGGNGGT

SEQ ID NO: 1477588 - protein, 24 aa, Mycobacterium tuberculosis
PGGAGGLISLLGGQGAGGAGGTGG

SEQ ID NO: 1477589 - protein, 20 aa, Mycobacterium tuberculosis
PGGAGGLLFGNGGNGAAGAV

SEQ ID NO: 1477590 - protein, 18 aa, Mycobacterium tuberculosis
PGGFAVGQCGGERFARLI

SEQ ID NO: 1477591 - protein, 21 aa, Mycobacterium tuberculosis
PGGQGGQAFGANNIGGTGGAG

SEQ ID NO: 1477592 - protein, 19 aa, Mycobacterium tuberculosis
PGIDGALLFALSASSQDAL

SEQ ID NO: 1477593 - protein, 32 aa, Mycobacterium tuberculosis
PGKGNAMGPAFWSEMPEVFHALDADREVRAIV

SEQ ID NO: 1477594 - protein, 29 aa, Mycobacterium tuberculosis
PGLGGAGGAGGWLIGQSGSTGGGGAGGAG

SEQ ID NO: 1477595 - protein, 18 aa, Mycobacterium tuberculosis
PGLLSWRDIARVMSENPA

SEQ ID NO: 1477596 - protein, 20 aa, Mycobacterium tuberculosis
PGMFVRASGMALPFADDSVD

SEQ ID NO: 1477597 - protein, 19 aa, Mycobacterium tuberculosis
PGPHDVYVSMNMVRKNGMR

SEQ ID NO: 1477598 - protein, 22 aa, Mycobacterium tuberculosis
PGQAGGPGGLLYGNGGNGAAGG

SEQ ID NO: 1477599 - protein, 18 aa, Mycobacterium tuberculosis
PGQVGFRGGQALPQAQLV

SEQ ID NO: 1477600 - protein, 26 aa, Mycobacterium tuberculosis
PGSALLFPSLCHFSGGIPAPEADPPY

SEQ ID NO: 1477601 - protein, 19 aa, Mycobacterium tuberculosis
PGTLNTGFFSAMTQAGPNS

SEQ ID NO: 1477602 - protein, 24 aa, Mycobacterium tuberculosis
PHECCRLRKVVPLGKTLRGYSAWV

SEQ ID NO: 1477603 - protein, 19 aa, Mycobacterium tuberculosis
PHGSRPGIDLVVAAEAGMT

SEQ ID NO: 1477604 - protein, 24 aa, Mycobacterium tuberculosis
PHIPFTDLRMKVVDTQTEWPATGH

SEQ ID NO: 1477605 - protein, 17 aa, Mycobacterium tuberculosis
PHVVLKGGAIAWAAMGD

SEQ ID NO: 1477606 - protein, 18 aa, Mycobacterium tuberculosis
PIDIGLPVSLTIPGFTIP

SEQ ID NO: 1477607 - protein, 20 aa, Mycobacterium tuberculosis
PIERAFRDARAGSVMAPTAD

SEQ ID NO: 1477608 - protein, 20 aa, Mycobacterium tuberculosis
PIGPACGRRSKGPNHFDSVG

SEQ ID NO: 1477609 - protein, 24 aa, Mycobacterium tuberculosis
PIKLRESPGLMILGRQGCGKTTAL

SEQ ID NO: 1477610 - protein, 18 aa, Mycobacterium tuberculosis
PIPTTLIGPIHINTGFSI

SEQ ID NO: 1477611 - protein, 23 aa, Mycobacterium tuberculosis
PITDSWYLTSIRAGLEPWSDGVG

SEQ ID NO: 1477612 - protein, 19 aa, Mycobacterium tuberculosis
PITIFPGGFTIDPLPLSLA

SEQ ID NO: 1477613 - protein, 17 aa, Mycobacterium tuberculosis
PITLRGGQLVAFDSSSG

SEQ ID NO: 1477614 - protein, 18 aa, Mycobacterium tuberculosis
PIVDRPLYRFPVFGFFAL

SEQ ID NO: 1477615 - protein, 18 aa, Mycobacterium tuberculosis
PKAKRRKGVGFATQPSDA

SEQ ID NO: 1477616 - protein, 24 aa, Mycobacterium tuberculosis
PKEFRCVSVDLLARRPVVHRRGRL

SEQ ID NO: 1477617 - protein, 23 aa, Mycobacterium tuberculosis
PKHFRCVSVDLLARRPVVHRQGP

SEQ ID NO: 1477618 - protein, 21 aa, Mycobacterium tuberculosis
PKPQNYPGLPTVSFVIPNADN

SEQ ID NO: 1477619 - protein, 17 aa, Mycobacterium tuberculosis
PKSYLPTYREFYERRQM

SEQ ID NO: 1477620 - protein, 22 aa, Mycobacterium tuberculosis
PKTPRGDGNLCEVTSPTPSKRL

SEQ ID NO: 1477621 - protein, 19 aa, Mycobacterium tuberculosis
PLAPHGLPGHLVGFVEALR

SEQ ID NO: 1477622 - protein, 17 aa, Mycobacterium tuberculosis
PLDSVYFAGYAMWNYLT

SEQ ID NO: 1477623 - protein, 24 aa, Mycobacterium tuberculosis
PLEGAKLLLPLAVSDDIPQRLGFG

SEQ ID NO: 1477624 - protein, 17 aa, Mycobacterium tuberculosis
PLGPVLMTADARAAGLP

SEQ ID NO: 1477625 - protein, 22 aa, Mycobacterium tuberculosis
PLLEPLRSVPIVGNPLANLVQP

SEQ ID NO: 1477626 - protein, 30 aa, Mycobacterium tuberculosis
PLPLRWGEYRAGGLARARWGLLEPPEPWLP

SEQ ID NO: 1477627 - protein, 24 aa, Mycobacterium tuberculosis
PLQQFSWRIMPENLEDAGVSWKVY

SEQ ID NO: 1477628 - protein, 24 aa, Mycobacterium tuberculosis
PLTKLRFTGGGYARLVRLPVGGIE

SEQ ID NO: 1477629 - protein, 18 aa, Mycobacterium tuberculosis
PLYCASLRTAEPRLLERL

SEQ ID NO: 1477630 - protein, 25 aa, Mycobacterium tuberculosis
PMEFICSSIQAGSRLGYQESAELCA

SEQ ID NO: 1477631 - protein, 20 aa, Mycobacterium tuberculosis
PNADDRWRALAVSKAGARAE

SEQ ID NO: 1477632 - protein, 19 aa, Mycobacterium tuberculosis
PNCNGRIPADTALLPEVLA

SEQ ID NO: 1477633 - protein, 22 aa, Mycobacterium tuberculosis
PNLDYPGLHALSTVPQCVPNAA

SEQ ID NO: 1477634 - protein, 26 aa, Mycobacterium tuberculosis
PPCGRTHCIGLECTLESSPIRRNRWH

SEQ ID NO: 1477635 - protein, 19 aa, Mycobacterium tuberculosis
PPEAIDWLLPAAARRVLDL

SEQ ID NO: 1477636 - protein, 19 aa, Mycobacterium tuberculosis
PPGRRRRARHASPADQAYN

SEQ ID NO: 1477637 - protein, 17 aa, Mycobacterium tuberculosis
PPGYDITALLQAHPHAV

SEQ ID NO: 1477638 - protein, 17 aa, Mycobacterium tuberculosis
PPLPPQQERPVWQPVTS

SEQ ID NO: 1477639 - protein, 25 aa, Mycobacterium tuberculosis
PPLTRSGGHCWFLGGVADSVEELVD

SEQ ID NO: 1477640 - protein, 21 aa, Mycobacterium tuberculosis
PPMKWDAWGDPAAAKPLSDGV

SEQ ID NO: 1477641 - protein, 18 aa, Mycobacterium tuberculosis
PPNPGSVPELGWPACPLP

SEQ ID NO: 1477642 - protein, 19 aa, Mycobacterium tuberculosis
PPPAPSRPSASPAEPPTRP

SEQ ID NO: 1477643 - protein, 19 aa, Mycobacterium tuberculosis
PPPPFTSWMPPGYPPEPPQ

SEQ ID NO: 1477644 - protein, 18 aa, Mycobacterium tuberculosis
PPPPVAAPAPPGAPEPAN

SEQ ID NO: 1477645 - protein, 17 aa, Mycobacterium tuberculosis
PPPRAEDLPAIDASPVR

SEQ ID NO: 1477646 - protein, 19 aa, Mycobacterium tuberculosis
PPRPSLPGPPFVLSALPVP

SEQ ID NO: 1477647 - protein, 24 aa, Mycobacterium tuberculosis
PPRWLPGPRELRAWTLAAGSPEAD

SEQ ID NO: 1477648 - protein, 24 aa, Mycobacterium tuberculosis
PPTMRSCRFLRAMLPALGDSQLPA

SEQ ID NO: 1477649 - protein, 19 aa, Mycobacterium tuberculosis
PPVAEPPPPVAAPAPPGAP

SEQ ID NO: 1477650 - protein, 17 aa, Mycobacterium tuberculosis
PPVALILQGASLHDLTA

SEQ ID NO: 1477651 - protein, 17 aa, Mycobacterium tuberculosis
PPVVKDKFLAATSSDTV

SEQ ID NO: 1477652 - protein, 18 aa, Mycobacterium tuberculosis
PPWPGRPGGHSVGYDSQG

SEQ ID NO: 1477653 - protein, 17 aa, Mycobacterium tuberculosis
PQARVAVYNGRGLPVPP

SEQ ID NO: 1477654 - protein, 24 aa, Mycobacterium tuberculosis
PQATAGAPAHDWLTLTGGAIGYGI

SEQ ID NO: 1477655 - protein, 19 aa, Mycobacterium tuberculosis
PQGTYLAWLDCRELGFDDA

SEQ ID NO: 1477656 - protein, 19 aa, Mycobacterium tuberculosis
PQLAPAVAWVKKRAGRTPR

SEQ ID NO: 1477657 - protein, 18 aa, Mycobacterium tuberculosis
PQLDRIGGDQGKYLAIME

SEQ ID NO: 1477658 - protein, 18 aa, Mycobacterium tuberculosis
PQMLRYFASIGISLDSRL

SEQ ID NO: 1477659 - protein, 17 aa, Mycobacterium tuberculosis
PQPAIPNMPLDLGASQS

SEQ ID NO: 1477660 - protein, 26 aa, Mycobacterium tuberculosis
PQPDPGKWAGFELHRDVTVTEEFTLG

SEQ ID NO: 1477661 - protein, 33 aa, Mycobacterium tuberculosis
PQSAPGRWTLIRWGPAGSLVLRITLCRVSELPA

SEQ ID NO: 1477662 - protein, 22 aa, Mycobacterium tuberculosis
PRASGPAGMTGMPMVPPGALGA

SEQ ID NO: 1477663 - protein, 18 aa, Mycobacterium tuberculosis
PRAWRQCGPQSGPRRSQA

SEQ ID NO: 1477664 - protein, 18 aa, Mycobacterium tuberculosis
PREQPVCDGAYWVDNLRN

SEQ ID NO: 1477665 - protein, 23 aa, Mycobacterium tuberculosis
PRERGRVGAALVTEIYSVGPLTA

SEQ ID NO: 1477666 - protein, 18 aa, Mycobacterium tuberculosis
PRGAAFSWYTYSPTRVRH

SEQ ID NO: 1477667 - protein, 21 aa, Mycobacterium tuberculosis
PRGRVTLHWGPRYDAHLLIPE

SEQ ID NO: 1477668 - protein, 30 aa, Mycobacterium tuberculosis; identical to SEQ ID NO: 209897

SEQ ID NO: 1477669 - protein, 21 aa, Mycobacterium tuberculosis
PRPARPELVVLCDVSGSVAGF

SEQ ID NO: 1477670 - protein, 21 aa, Mycobacterium tuberculosis
PRREAPARRGGVAGRRPGRRR

SEQ ID NO: 1477671 - protein, 25 aa, Mycobacterium tuberculosis
PRRHLSYKTGWYGSQLVVADRWFPS

SEQ ID NO: 1477672 - protein, 17 aa, Mycobacterium tuberculosis
PRRQLTVVGAREHNLRG

SEQ ID NO: 1477673 - protein, 18 aa, Mycobacterium tuberculosis
PRRVRRRVLHGGAARRRR

SEQ ID NO: 1477674 - protein, 23 aa, Mycobacterium tuberculosis
PRSHRGCGWNRGLHQDGAGCAAW

SEQ ID NO: 1477675 - protein, 18 aa, Mycobacterium tuberculosis
PRSRRIPASRVVEIAPTV

SEQ ID NO: 1477676 - protein, 18 aa, Mycobacterium tuberculosis
PRSVPYAELQARLVDYEN

SEQ ID NO: 1477677 - protein, 19 aa, Mycobacterium tuberculosis
PRTALWLLLAKCGGDTEVS

SEQ ID NO: 1477678 - protein, 21 aa, Mycobacterium tuberculosis
PRVRRLGTSGSHLYWLETCRV

SEQ ID NO: 1477679 - protein, 25 aa, Mycobacterium tuberculosis
PSASGRMTTKWGGFVSDVDAFDADF

SEQ ID NO: 1477680 - protein, 20 aa, Mycobacterium tuberculosis
PSCKELIESIVLDAITHLQT

SEQ ID NO: 1477681 - protein, 24 aa, Mycobacterium tuberculosis
PSGRRVTVDGGRGCARRGDVGHGG

SEQ ID NO: 1477682 - protein, 19 aa, Mycobacterium tuberculosis
PSINVPAGFTSDGLPIGVQ

SEQ ID NO: 1477683 - protein, 24 aa, Mycobacterium tuberculosis
PSIVAVTGGLLWPTRQNDARMEDV

SEQ ID NO: 1477684 - protein, 18 aa, Mycobacterium tuberculosis
PSPPRPPGAPAPPMPPLP

SEQ ID NO: 1477685 - protein, 21 aa, Mycobacterium tuberculosis
PSSGPNLGRFGSFGRGVTPQQ

SEQ ID NO: 1477686 - protein, 19 aa, Mycobacterium tuberculosis
PSSLREAFGHFPTGVVAIA

SEQ ID NO: 1477687 - protein, 21 aa, Mycobacterium tuberculosis
PSTGPSMGILPAGGVGGPGGS

SEQ ID NO: 1477688 - protein, 21 aa, Mycobacterium tuberculosis
PSTRWWTEIARVLRAGGSYFA

SEQ ID NO: 1477689 - protein, 18 aa, Mycobacterium tuberculosis
PTAASLVRITFEEPPPDQ

SEQ ID NO: 1477690 - protein, 17 aa, Mycobacterium tuberculosis
PTASSDLSVLVRTMCSR

SEQ ID NO: 1477691 - protein, 25 aa, Mycobacterium tuberculosis
PTDRPRCAYLPFGGGRRICIGQSFA

SEQ ID NO: 1477692 - protein, 20 aa, Mycobacterium tuberculosis
PTFEGYRQQLGIDFAGVVTA

SEQ ID NO: 1477693 - protein, 21 aa, Mycobacterium tuberculosis
PTFEGYRQQLGIDFAGVVTAV

SEQ ID NO: 1477694 - protein, 22 aa, Mycobacterium tuberculosis
PTFSARLTAVAGRRVATGRDFD

SEQ ID NO: 1477695 - protein, 24 aa, Mycobacterium tuberculosis
PTGEQKLDLVLAILRARQLFGGAH

SEQ ID NO: 1477696 - protein, 24 aa, Mycobacterium tuberculosis
PTGPLPKVRVAAALPPPADYLTRI

SEQ ID NO: 1477697 - protein, 27 aa, Mycobacterium tuberculosis
PTKGIFTSSFGYRWGVLHAGIDLANAI

SEQ ID NO: 1477698 - protein, 17 aa, Mycobacterium tuberculosis
PTKMFVYAAEVAKTIRG

SEQ ID NO: 1477699 - protein, 19 aa, Mycobacterium tuberculosis
PTLRCVRCGSDVVRAVVVG

SEQ ID NO: 1477700 - protein, 17 aa, Mycobacterium tuberculosis
PTRGCSAPTDRFRAAVR

SEQ ID NO: 1477701 - protein, 17 aa, Mycobacterium tuberculosis
PTTELLAAGADEVSAAI

SEQ ID NO: 1477702 - protein, 18 aa, Mycobacterium tuberculosis
PTTEVVAAGADEVSAGIA

SEQ ID NO: 1477703 - protein, 29 aa, Mycobacterium tuberculosis
PTTLLVEGRVALTIPADWSTQPVVSGPGS

SEQ ID NO: 1477704 - protein, 17 aa, Mycobacterium tuberculosis
PTVEIAPGITIPIGPPT

SEQ ID NO: 1477705 - protein, 18 aa, Mycobacterium tuberculosis
PVAEPPPPAAPPVAEPPP

SEQ ID NO: 1477706 - protein, 18 aa, Mycobacterium tuberculosis
PVARGVSVYAALKRAADT

SEQ ID NO: 1477707 - protein, 28 aa, Mycobacterium tuberculosis
PVDVDGFVFPTCRWVHPIGPGNRSLPFP

SEQ ID NO: 1477708 - protein, 21 aa, Mycobacterium tuberculosis
PVEAFQFYFELLLFDYPTHIV

SEQ ID NO: 1477709 - protein, 24 aa, Mycobacterium tuberculosis
PVEAFQFYFELLLFDYPTHIVQIV

SEQ ID NO: 1477710 - protein, 24 aa, Mycobacterium tuberculosis
PVGQPGGDGGILWGNGGNGGDSTS

SEQ ID NO: 1477711 - protein, 25 aa, Mycobacterium tuberculosis
PVLRRPEIRAGQLARHVRHQPKLGL

SEQ ID NO: 1477712 - protein, 17 aa, Mycobacterium tuberculosis
PVLTRIDLRGAELTAAE

SEQ ID NO: 1477713 - protein, 25 aa, Mycobacterium tuberculosis
PVNHLPLTLPLRYLGMSDAEVDQID

SEQ ID NO: 1477714 - protein, 26 aa, Mycobacterium tuberculosis
PVPLPELRLPPLPPLPPVPASPPSPP

SEQ ID NO: 1477715 - protein, 17 aa, Mycobacterium tuberculosis
PVSLTIPGFTIPGGTLI

SEQ ID NO: 1477716 - protein, 19 aa, Mycobacterium tuberculosis
PVTVEVPVGGILAPLQPFQ

SEQ ID NO: 1477717 - protein, 19 aa, Mycobacterium tuberculosis
PVTVHAIGGVGPLHVAPVP

SEQ ID NO: 1477718 - protein, 23 aa, Mycobacterium tuberculosis
PVVSFRLAGDRGYTEFDVSHELR

SEQ ID NO: 1477719 - protein, 18 aa, Mycobacterium tuberculosis
PWLAPIFARSTLRHSHHL

SEQ ID NO: 1477720 - protein, 19 aa, Mycobacterium tuberculosis
PWPTYPLMYRVSAAHEEGG

SEQ ID NO: 1477721 - protein, 25 aa, Mycobacterium tuberculosis
PWSDWLSRQRWYAGRNRELATVKPG

SEQ ID NO: 1477722 - protein, 18 aa, Mycobacterium tuberculosis
PYCGSPYSFLPQLNPGDI

SEQ ID NO: 1477723 - protein, 29 aa, Mycobacterium tuberculosis
PYTFPGVLPPSGVPYLLGIQSVLVTQNGQ

SEQ ID NO: 1477724 - protein, 40 aa, Mycobacterium tuberculosis; identical to SEQ ID NO: 211556

SEQ ID NO: 1477725 - protein, 21 aa, Mycobacterium tuberculosis
QAAAFHDRFVQLLNAGGGSYA

SEQ ID NO: 1477726 - protein, 21 aa, Mycobacterium tuberculosis
QAAAFHSRFVQALTTAAASYA

SEQ ID NO: 1477727 - protein, 19 aa, Mycobacterium tuberculosis
QAFHAQFVQALTSGGGAYA

SEQ ID NO: 1477728 - protein, 18 aa, Mycobacterium tuberculosis
QAFVQWRAQSRSELTKVG

SEQ ID NO: 1477729 - protein, 18 aa, Mycobacterium tuberculosis
QALADGIIDCVATDHAPH

SEQ ID NO: 1477730 - protein, 27 aa, Mycobacterium tuberculosis
QALDFFFRKIVRDHGKALQFVLAQVTH

SEQ ID NO: 1477731 - protein, 21 aa, Mycobacterium tuberculosis
QALFGRPLIGNGADGSPGTGQ

SEQ ID NO: 1477732 - protein, 22 aa, Mycobacterium tuberculosis
QALLGRPLIGDGADGTAPGQNG

SEQ ID NO: 1477733 - protein, 20 aa, Mycobacterium tuberculosis
QALLGRPLIGNGANGADGTG

SEQ ID NO: 1477734 - protein, 21 aa, Mycobacterium tuberculosis
QAPDGLSCFLLPRVLPDGTRN

SEQ ID NO: 1477735 - protein, 18 aa, Mycobacterium tuberculosis
QCDRRVIAVIGDGALTGG

SEQ ID NO: 1477736 - protein, 20 aa, Mycobacterium tuberculosis
QCLNAGLGFGGGCLPKDIRA

SEQ ID NO: 1477737 - protein, 25 aa, Mycobacterium tuberculosis
QDGILTIVGFAWRGDHVQILDSLPE

SEQ ID NO: 1477738 - protein, 31 aa, Mycobacterium tuberculosis; identical to SEQ ID NO: 204625

SEQ ID NO: 1477739 - protein, 19 aa, Mycobacterium tuberculosis
QDVRRWWRSDSLWQAHDAR

SEQ ID NO: 1477740 - protein, 23 aa, Mycobacterium tuberculosis
QDYGDVAYGWAMEDTSGIVKLIT

SEQ ID NO: 1477741 - protein, 17 aa, Mycobacterium tuberculosis
QEDFAYHQFLIKKSKMP

SEQ ID NO: 1477742 - protein, 21 aa, Mycobacterium tuberculosis
QEERGRTAVFVGQDGQVVGVL

SEQ ID NO: 1477743 - protein, 28 aa, Mycobacterium tuberculosis
QFGAVAALNLVKCVHWPSSSPPQPPKDL

SEQ ID NO: 1477744 - protein, 18 aa, Mycobacterium tuberculosis
QGHPVIWESAARDFEPLL

SEQ ID NO: 1477745 - protein, 17 aa, Mycobacterium tuberculosis
QGLAQGYALRLADRLVD

SEQ ID NO: 1477746 - protein, 27 aa, Mycobacterium tuberculosis
QGLRVITTRSRLMARLSGQGAMALLEL

SEQ ID NO: 1477747 - protein, 23 aa, Mycobacterium tuberculosis
QGRSEVRILFAFDPARQAIMLAA

SEQ ID NO: 1477748 - protein, 17 aa, Mycobacterium tuberculosis
QGSLLVRHGHPAVAEAF

SEQ ID NO: 1477749 - protein, 24 aa, Mycobacterium tuberculosis
QHAPTLDGARDWARQQIDALPPEL

SEQ ID NO: 1477750 - protein, 18 aa, Mycobacterium tuberculosis
QHLAGAYVSSGMVNQAAD

SEQ ID NO: 1477751 - protein, 23 aa, Mycobacterium tuberculosis
QHPARLSPGVVELARLADDDRPG

SEQ ID NO: 1477752 - protein, 17 aa, Mycobacterium tuberculosis
QIDRGQGFLALVDYAHK

SEQ ID NO: 1477753 - protein, 21 aa, Mycobacterium tuberculosis
QKGLPGARARRRGLSDSALGT

SEQ ID NO: 1477754 - protein, 21 aa, Mycobacterium tuberculosis
QKPPVGAALWKLMERARQVGL

SEQ ID NO: 1477755 - protein, 22 aa, Mycobacterium tuberculosis
QLADHLLRSLAIIGAAAGAQLA

SEQ ID NO: 1477756 - protein, 25 aa, Mycobacterium tuberculosis
QLAERRGEAWFDPDGLILAFGDSPR

SEQ ID NO: 1477757 - protein, 28 aa, Mycobacterium tuberculosis
QLGGGFARYSVDGAWVVPHFEKMLYDNA

SEQ ID NO: 1477758 - protein, 19 aa, Mycobacterium tuberculosis
QLNGLAFHQHWLEGLDTQP

SEQ ID NO: 1477759 - protein, 18 aa, Mycobacterium tuberculosis
QLNRTAAVWHLCTAITGR

SEQ ID NO: 1477760 - protein, 19 aa, Mycobacterium tuberculosis
QLNRTAAVWHLCTAITGRL

SEQ ID NO: 1477761 - protein, 24 aa, Mycobacterium tuberculosis
QLSGYSRVLLKLGGEMFGGGQVGL

SEQ ID NO: 1477762 - protein, 20 aa, Mycobacterium tuberculosis
QMTWRSMIRDGLTMRHGKEL

SEQ ID NO: 1477763 - protein, 19 aa, Mycobacterium tuberculosis
QMYRLLAVAKYEERYVIPT

SEQ ID NO: 1477764 - protein, 24 aa, Mycobacterium tuberculosis
QPDRLRRWMAVAARIELRTGGAYR

SEQ ID NO: 1477765 - protein, 22 aa, Mycobacterium tuberculosis
QPEIPYYSATSFDPREEPYCDA

SEQ ID NO: 1477766 - protein, 18 aa, Mycobacterium tuberculosis
QPFINWLTNLPFLQAMFS

SEQ ID NO: 1477767 - protein, 23 aa, Mycobacterium tuberculosis
QPLWEPKIPLGRLGRPEELAGLY

SEQ ID NO: 1477768 - protein, 21 aa, Mycobacterium tuberculosis
QQCPAYSPGDMRLISLIANGQ

SEQ ID NO: 1477769 - protein, 20 aa, Mycobacterium tuberculosis
QQERPVWQPVTSHGQWLPAE

SEQ ID NO: 1477770 - protein, 17 aa, Mycobacterium tuberculosis
QQFLAFNAAYYIQQIIS

SEQ ID NO: 1477771 - protein, 18 aa, Mycobacterium tuberculosis
QQRLAFFADIHMIAVLTE

SEQ ID NO: 1477772 - protein, 27 aa, Mycobacterium tuberculosis
QQTMLPFSWQGVCLHASGAARVRVRLA

SEQ ID NO: 1477773 - protein, 26 aa, Mycobacterium tuberculosis
QQVSCAGLVIGSWPDPPGLVAASNRS

SEQ ID NO: 1477774 - protein, 19 aa, Mycobacterium tuberculosis
QQWRFPRSLMVGFHALGDP

SEQ ID NO: 1477775 - protein, 24 aa, Mycobacterium tuberculosis
QRAAGEMRSRLRALDAAARTGSGV

SEQ ID NO: 1477776 - protein, 21 aa, Mycobacterium tuberculosis
QRARGKGGLVRVSWAEATEMI

SEQ ID NO: 1477777 - protein, 20 aa, Mycobacterium tuberculosis
QRFLAEQGYGYIIRDADDLL

SEQ ID NO: 1477778 - protein, 20 aa, Mycobacterium tuberculosis
QRFQVTASRFGRSVDVAAAR

SEQ ID NO: 1477779 - protein, 19 aa, Mycobacterium tuberculosis
QRGGAAGAFGRPGGAPRRG

SEQ ID NO: 1477780 - protein, 20 aa, Mycobacterium tuberculosis
QRGGAAGAFGRPGGAPRRGR

SEQ ID NO: 1477781 - protein, 17 aa, Mycobacterium tuberculosis
QRGGAGGAAGLIGNGGN

SEQ ID NO: 1477782 - protein, 24 aa, Mycobacterium tuberculosis
QRIDCGQGHCAWFVGYRDKNLDTV

SEQ ID NO: 1477783 - protein, 17 aa, Mycobacterium tuberculosis
QRIFDRLQVRYVIVSAV

SEQ ID NO: 1477784 - protein, 19 aa, Mycobacterium tuberculosis
QRIPSSWLDSGVIVQADTL

SEQ ID NO: 1477785 - protein, 17 aa, Mycobacterium tuberculosis
QRIREYTKPLVLILDDF

SEQ ID NO: 1477786 - protein, 17 aa, Mycobacterium tuberculosis
QRPARWLQLMAREGQAF

SEQ ID NO: 1477787 - protein, 18 aa, Mycobacterium tuberculosis
QRPARWMHLMASDFHAFS

SEQ ID NO: 1477788 - protein, 20 aa, Mycobacterium tuberculosis
QRPPAALVLRSPFTSLAEVG

SEQ ID NO: 1477789 - protein, 25 aa, Mycobacterium tuberculosis
QRQQTLRASIDWSHALLTETGQILF

SEQ ID NO: 1477790 - protein, 21 aa, Mycobacterium tuberculosis
QRRWRCFSQIGVPGDDWPAYT

SEQ ID NO: 1477791 - protein, 17 aa, Mycobacterium tuberculosis
QRTAPWVESLGLDHLRE

SEQ ID NO: 1477792 - protein, 18 aa, Mycobacterium tuberculosis
QRTSMKWRAHPADVLPLW

SEQ ID NO: 1477793 - protein, 22 aa, Mycobacterium tuberculosis
QSLTGRPLIGDGANGIDGTGQA

SEQ ID NO: 1477794 - protein, 18 aa, Mycobacterium tuberculosis
QSYVRACHLVGYQHPDLT

SEQ ID NO: 1477795 - protein, 25 aa, Mycobacterium tuberculosis
QTAHVMKARRGALEGDPSGSQAADN

SEQ ID NO: 1477796 - protein, 18 aa, Mycobacterium tuberculosis
QTDGFLRGHGGDGGNAVG

SEQ ID NO: 1477797 - protein, 17 aa, Mycobacterium tuberculosis
QTFLLRLLGGELRQGAK

SEQ ID NO: 1477798 - protein, 22 aa, Mycobacterium tuberculosis
QTLLGRPLIGDGANATTPGGAG

SEQ ID NO: 1477799 - protein, 21 aa, Mycobacterium tuberculosis
QTLLGRPLIGNGADGGPGQNG

SEQ ID NO: 1477800 - protein, 21 aa, Mycobacterium tuberculosis
QTLLGRPLIGNGADGSTPGQA

SEQ ID NO: 1477801 - protein, 25 aa, Mycobacterium tuberculosis
QTLRTIYQNLGWAFGYNTAAIPLAA

SEQ ID NO: 1477802 - protein, 20 aa, Mycobacterium tuberculosis
QTLTGRPLIGNGANGTPGTG

SEQ ID NO: 1477803 - protein, 19 aa, Mycobacterium tuberculosis
QTNMPGVFPQIGGFANTPP

SEQ ID NO: 1477804 - protein, 17 aa, Mycobacterium tuberculosis
QTYQALRTQAAAFHQQI

SEQ ID NO: 1477805 - protein, 27 aa, Mycobacterium tuberculosis
QVAAFHDRFAQTLSAAVGSYVSAEATN

SEQ ID NO: 1477806 - protein, 28 aa, Mycobacterium tuberculosis
QVAAFHDRFAQTLSAAVGSYVSAEATNA

SEQ ID NO: 1477807 - protein, 24 aa, Mycobacterium tuberculosis
QVEPKRSRLVVCAPEPSHAREFPD

SEQ ID NO: 1477808 - protein, 27 aa, Mycobacterium tuberculosis
QVGSRGGDGGVGGWLYGDGGGGGDGGN

SEQ ID NO: 1477809 - protein, 17 aa, Mycobacterium tuberculosis
QVHRRAMIVAEELWIYA

SEQ ID NO: 1477810 - protein, 20 aa, Mycobacterium tuberculosis
QVHTLLDFHFRPHLTAASGK

SEQ ID NO: 1477811 - protein, 24 aa, Mycobacterium tuberculosis
QVIGNRPKIGWRRLEAQAVLSRLL

SEQ ID NO: 1477812 - protein, 30 aa, Mycobacterium tuberculosis; identical to SEQ ID NO: 234095

SEQ ID NO: 1477813 - protein, 19 aa, Mycobacterium tuberculosis
QVYRRARGCPGLGMRVQDR

SEQ ID NO: 1477814 - protein, 26 aa, Mycobacterium tuberculosis
QWGCFRFGIVQGCDHFTFFASVDHVH

SEQ ID NO: 1477815 - protein, 19 aa, Mycobacterium tuberculosis
RAAAFHERFVQALATGGGA

SEQ ID NO: 1477816 - protein, 17 aa, Mycobacterium tuberculosis
RAAARSGARVALVAGDR

SEQ ID NO: 1477817 - protein, 17 aa, Mycobacterium tuberculosis
RAAARYLLTDVQLADAR

SEQ ID NO: 1477818 - protein, 19 aa, Mycobacterium tuberculosis
RAAATRLALRHPMLRVQFL

SEQ ID NO: 1477819 - protein, 18 aa, Mycobacterium tuberculosis
RAACANRGGFVVHATACS

SEQ ID NO: 1477820 - protein, 25 aa, Mycobacterium tuberculosis
RAAELMGIQIPRFCDHPLLEPVGAC

SEQ ID NO: 1477821 - protein, 19 aa, Mycobacterium tuberculosis
RAAGIARRTLFRYYASKNA

SEQ ID NO: 1477822 - protein, 19 aa, Mycobacterium tuberculosis
RAAMMAGLRICARIAQARP

SEQ ID NO: 1477823 - protein, 20 aa, Mycobacterium tuberculosis
RAARAGSAPAHFARQAGSSL

SEQ ID NO: 1477824 - protein, 17 aa, Mycobacterium tuberculosis
RAARGADWIKVMATGGF

SEQ ID NO: 1477825 - protein, 18 aa, Mycobacterium tuberculosis
RAASLGIQIRYETGATEL

SEQ ID NO: 1477826 - protein, 17 aa, Mycobacterium tuberculosis
RACQAGHRVLFATAAEW

SEQ ID NO: 1477827 - protein, 24 aa, Mycobacterium tuberculosis
RADIEFPAPALIYGYGAYEICEDP

SEQ ID NO: 1477828 - protein, 25 aa, Mycobacterium tuberculosis
RADLLGKRLHRVLGPLAHVNLIPLN

SEQ ID NO: 1477829 - protein, 25 aa, Mycobacterium tuberculosis
RAEGDLLDLGNCYGRDGPGQRDGLV

SEQ ID NO: 1477830 - protein, 20 aa, Mycobacterium tuberculosis
RAELGVALRAAIAGPVAGLA

SEQ ID NO: 1477831 - protein, 19 aa, Mycobacterium tuberculosis
RAGADAIYPGYGFLSENPD

SEQ ID NO: 1477832 - protein, 31 aa, Mycobacterium tuberculosis
RAGLLLPLGWDPRLPVMGQKYISQGAISKGQ

SEQ ID NO: 1477833 - protein, 20 aa, Mycobacterium tuberculosis
RAGQGCRRCGTLIAYDTTDE

SEQ ID NO: 1477834 - protein, 20 aa, Mycobacterium tuberculosis
RAGVEIARNRSRQHLHGLGG

SEQ ID NO: 1477835 - protein, 20 aa, Mycobacterium tuberculosis
RAGVKPSLALFAADYLLNQA

SEQ ID NO: 1477836 - protein, 18 aa, Mycobacterium tuberculosis
RAIAQLNFANARRNPNAQ

SEQ ID NO: 1477837 - protein, 25 aa, Mycobacterium tuberculosis
RAIHELARGDAYWDTVVEITSIGDQ

SEQ ID NO: 1477838 - protein, 25 aa, Mycobacterium tuberculosis
RAKAALRYADALIWTPAHLAVDVAV

SEQ ID NO: 1477839 - protein, 39 aa, Mycobacterium tuberculosis
RALLEHVWALMGMPCGKYLVVMLELWLPLEAAAGDLDKP

SEQ ID NO: 1477840 - protein, 41 aa, Mycobacterium tuberculosis; identical to SEQ ID NO: 211611

SEQ ID NO: 1477841 - protein, 19 aa, Mycobacterium tuberculosis
RALLSAYCETWSVYVAAVQ

SEQ ID NO: 1477842 - protein, 20 aa, Mycobacterium tuberculosis
RALPPLPALVEPINGSPPLP

SEQ ID NO: 1477843 - protein, 20 aa, Mycobacterium tuberculosis
RANLYSVCFDLATTDRKLTP

SEQ ID NO: 1477844 - protein, 19 aa, Mycobacterium tuberculosis
RAPQLGFGRYLVSATTPFT

SEQ ID NO: 1477845 - protein, 17 aa, Mycobacterium tuberculosis
RARAGWDRATGRIPADA

SEQ ID NO: 1477846 - protein, 17 aa, Mycobacterium tuberculosis
RARDVAMVFQNYALYPN

SEQ ID NO: 1477847 - protein, 17 aa, Mycobacterium tuberculosis
RARERWEALTALAELVD

SEQ ID NO: 1477848 - protein, 31 aa, Mycobacterium tuberculosis; identical to SEQ ID NO: 234108

SEQ ID NO: 1477849 - protein, 19 aa, Mycobacterium tuberculosis
RARLRQSWLERGATDAELG

SEQ ID NO: 1477850 - protein, 17 aa, Mycobacterium tuberculosis
RARRRGLTLGKQDVDGM

SEQ ID NO: 1477851 - protein, 18 aa, Mycobacterium tuberculosis
RARSAEIERDRRLPDELV

SEQ ID NO: 1477852 - protein, 24 aa, Mycobacterium tuberculosis
RASDAVACALGLQRAPLAPIRLRI

SEQ ID NO: 1477853 - protein, 24 aa, Mycobacterium tuberculosis
RASGLPAAVINWGPWSEVGVAQAL

SEQ ID NO: 1477854 - protein, 19 aa, Mycobacterium tuberculosis
RASKPGARLYMFEFGEHNV

SEQ ID NO: 1477855 - protein, 22 aa, Mycobacterium tuberculosis
RATPGDGWASLASSIGGQVLLP

SEQ ID NO: 1477856 - protein, 18 aa, Mycobacterium tuberculosis
RATTHWAFAEHFAREFPA

SEQ ID NO: 1477857 - protein, 18 aa, Mycobacterium tuberculosis
RAVAELALLAAAETTTNG

SEQ ID NO: 1477858 - protein, 17 aa, Mycobacterium tuberculosis
RAVALLFEAEVRGISAA

SEQ ID NO: 1477859 - protein, 19 aa, Mycobacterium tuberculosis
RAVRLRFSATTAVGVDAIG

SEQ ID NO: 1477860 - protein, 27 aa, Mycobacterium tuberculosis
RCNQQIKFAALSARAVALGFDTVATGH

SEQ ID NO: 1477861 - protein, 22 aa, Mycobacterium tuberculosis
RDAYCRHIGVEYAHILDPEQKE

SEQ ID NO: 1477862 - protein, 23 aa, Mycobacterium tuberculosis
RDELTLRVGHQALHTGQRSSLGE

SEQ ID NO: 1477863 - protein, 21 aa, Mycobacterium tuberculosis
RDEVRAALAAGDWSSASESKL

SEQ ID NO: 1477864 - protein, 18 aa, Mycobacterium tuberculosis
RDGLHMASLAGAWTALVV

SEQ ID NO: 1477865 - protein, 21 aa, Mycobacterium tuberculosis
RDIEGHRKPPRYGWAGSTPSS

SEQ ID NO: 1477866 - protein, 22 aa, Mycobacterium tuberculosis
RDIEGHRKPPRYGWAGSTPSSI

SEQ ID NO: 1477867 - protein, 18 aa, Mycobacterium tuberculosis
RDIPVLIGGGGERKTLRL

SEQ ID NO: 1477868 - protein, 21 aa, Mycobacterium tuberculosis
RDLKQRPVVIEAAAQGCSPDQ

SEQ ID NO: 1477869 - protein, 20 aa, Mycobacterium tuberculosis
RDPMAMLPFLGYNVGDYFQH

SEQ ID NO: 1477870 - protein, 19 aa, Mycobacterium tuberculosis
RDRFCRFGSEYVHAALAAQ

SEQ ID NO: 1477871 - protein, 22 aa, Mycobacterium tuberculosis
RDRGPSQWLLRMLATQTQRAEL

SEQ ID NO: 1477872 - protein, 20 aa, Mycobacterium tuberculosis
REALDLVDSLGFTLSGLQPG

SEQ ID NO: 1477873 - protein, 24 aa, Mycobacterium tuberculosis
RECDAICQVVRVFVDDDVTHVTGR

SEQ ID NO: 1477874 - protein, 22 aa, Mycobacterium tuberculosis
REDKPFWWAHFDRLNYPVDEWS

SEQ ID NO: 1477875 - protein, 20 aa, Mycobacterium tuberculosis
REFDAKLGRGPAVAVDDELM

SEQ ID NO: 1477876 - protein, 24 aa, Mycobacterium tuberculosis
REFHLCVVDAPTLHNAAEALHRQF

SEQ ID NO: 1477877 - protein, 22 aa, Mycobacterium tuberculosis
REGVNLTFLPFFAKAVIDALKI

SEQ ID NO: 1477878 - protein, 21 aa, Mycobacterium tuberculosis
REHPRPVAAGLYGDLTATLSA

SEQ ID NO: 1477879 - protein, 21 aa, Mycobacterium tuberculosis
RELAEICGYIAGLPLDRDRPL

SEQ ID NO: 1477880 - protein, 18 aa, Mycobacterium tuberculosis
RELELCYAAIALVTDVDA

SEQ ID NO: 1477881 - protein, 22 aa, Mycobacterium tuberculosis
RELQTRMFACFAAGALAAGCEY

SEQ ID NO: 1477882 - protein, 25 aa, Mycobacterium tuberculosis
RELSDLPGAVPRMYVVTRGAQRVLA

SEQ ID NO: 1477883 - protein, 24 aa, Mycobacterium tuberculosis
RELTGGRRSFILVPGIDVPFHSRV

SEQ ID NO: 1477884 - protein, 19 aa, Mycobacterium tuberculosis
RENIREVHRADLIGQHIGE

SEQ ID NO: 1477885 - protein, 25 aa, Mycobacterium tuberculosis
REPIGMAGEITWRVPSMSITDEAVE

SEQ ID NO: 1477886 - protein, 17 aa, Mycobacterium tuberculosis
REPRGDLDMKLRSVRAA

SEQ ID NO: 1477887 - protein, 17 aa, Mycobacterium tuberculosis
RERAVVAGHSMGGITIA

SEQ ID NO: 1477888 - protein, 17 aa, Mycobacterium tuberculosis
RERVAPLIAKYRLAGDH

SEQ ID NO: 1477889 - protein, 20 aa, Mycobacterium tuberculosis
REVLPRDVVEKEPEPEPEPK

SEQ ID NO: 1477890 - protein, 20 aa, Mycobacterium tuberculosis
REYPPVRGVIHAAGVLDDAV

SEQ ID NO: 1477891 - protein, 27 aa, Mycobacterium tuberculosis
RFGTELPPLEGIYLAAFAGRPALLSEM

SEQ ID NO: 1477892 - protein, 17 aa, Mycobacterium tuberculosis
RFLPTTGPITMRSTALM

SEQ ID NO: 1477893 - protein, 18 aa, Mycobacterium tuberculosis
RFPGCDVPAEFCDIDHSA

SEQ ID NO: 1477894 - protein, 19 aa, Mycobacterium tuberculosis
RFSLFDVYTDIAFPGGIHA

SEQ ID NO: 1477895 - protein, 18 aa, Mycobacterium tuberculosis
RFTAELPFSLDDFQQRAC

SEQ ID NO: 1477896 - protein, 19 aa, Mycobacterium tuberculosis
RGAAGDIAAVAAGPAGTAG

SEQ ID NO: 1477897 - protein, 19 aa, Mycobacterium tuberculosis
RGADWIKVMATGGFVTTAS

SEQ ID NO: 1477898 - protein, 17 aa, Mycobacterium tuberculosis
RGGAVSGIGGHNAAMAV

SEQ ID NO: 1477899 - protein, 17 aa, Mycobacterium tuberculosis
RGHRPVRTAVLAATTAE

SEQ ID NO: 1477900 - protein, 17 aa, Mycobacterium tuberculosis
RGIGKVDRAALVRRFAG

SEQ ID NO: 1477901 - protein, 23 aa, Mycobacterium tuberculosis
RGLLLRLRFELDHHINLRPARLY

SEQ ID NO: 1477902 - protein, 20 aa, Mycobacterium tuberculosis
RGLMQLLAATNWFGQNAPAL

SEQ ID NO: 1477903 - protein, 18 aa, Mycobacterium tuberculosis
RGLTLGKQDVDGMSRLSG

SEQ ID NO: 1477904 - protein, 26 aa, Mycobacterium tuberculosis
RGLVCVWRVVGGAVEAAGWFGVAMIL

SEQ ID NO: 1477905 - protein, 19 aa, Mycobacterium tuberculosis
RGPLLSGMFGTFPVAQTFH

SEQ ID NO: 1477906 - protein, 28 aa, Mycobacterium tuberculosis
RGPSGCLVGFGWAMRRLLGLVDHVVAVD

SEQ ID NO: 1477907 - protein, 24 aa, Mycobacterium tuberculosis
RGQSGVVLEFQRLVKLIVDPLQLT

SEQ ID NO: 1477908 - protein, 20 aa, Mycobacterium tuberculosis
RGRMGAVRFGIYQAGCNSSL

SEQ ID NO: 1477909 - protein, 22 aa, Mycobacterium tuberculosis
RGRTGVFSLDARQWFQSFPAVA

SEQ ID NO: 1477910 - protein, 17 aa, Mycobacterium tuberculosis
RGVLVEMYREAKARLGD

SEQ ID NO: 1477911 - protein, 21 aa, Mycobacterium tuberculosis
RGVTVGRPLGLLLTRRSENAT

SEQ ID NO: 1477912 - protein, 21 aa, Mycobacterium tuberculosis
RGVWLRPFRNLVYAMPPYICT

SEQ ID NO: 1477913 - protein, 18 aa, Mycobacterium tuberculosis
RGWMSLAGAMGGHTVVAK

SEQ ID NO: 1477914 - protein, 18 aa, Mycobacterium tuberculosis
RHASLLPLLHNYREPAKP

SEQ ID NO: 1477915 - protein, 28 aa, Mycobacterium tuberculosis
RHAVAVDLRNDWPTALKNAGFDPARPTA

SEQ ID NO: 1477916 - protein, 23 aa, Mycobacterium tuberculosis
RHLEIRWDGQVALLADLNSTNGT

SEQ ID NO: 1477917 - protein, 20 aa, Mycobacterium tuberculosis
RHLGGVLYLFVRGMCGAATP

SEQ ID NO: 1477918 - protein, 21 aa, Mycobacterium tuberculosis
RHPIKRARTTFTYVAVAVAGS

SEQ ID NO: 1477919 - protein, 22 aa, Mycobacterium tuberculosis
RHQARRCRRAAAKERGNADEFV

SEQ ID NO: 1477920 - protein, 24 aa, Mycobacterium tuberculosis
RHQPKLGLACLHPGRDTRELLEHR

SEQ ID NO: 1477921 - protein, 17 aa, Mycobacterium tuberculosis
RHQRAGVEIARNRSRQH

SEQ ID NO: 1477922 - protein, 18 aa, Mycobacterium tuberculosis
RHQVEWTNYLTPQALIDL

SEQ ID NO: 1477923 - protein, 21 aa, Mycobacterium tuberculosis
RHRAMIQAFVQWRAQSRSELT

SEQ ID NO: 1477924 - protein, 24 aa, Mycobacterium tuberculosis
RHRAMIQAFVQWRAQSRSELTKVG

SEQ ID NO: 1477925 - protein, 25 aa, Mycobacterium tuberculosis
RHRDGPRPTLCVIHGFMGSSYLLNG

SEQ ID NO: 1477926 - protein, 29 aa, Mycobacterium tuberculosis
RHSAIGRAFMKKVWLRDSRNPSQFTDEVD

SEQ ID NO: 1477927 - protein, 19 aa, Mycobacterium tuberculosis
RIAHTLGLHGPAMTFDTAC

SEQ ID NO: 1477928 - protein, 21 aa, Mycobacterium tuberculosis
RIEGLPARLRKVTNRWTLRPA

SEQ ID NO: 1477929 - protein, 19 aa, Mycobacterium tuberculosis
RIGAEVRDGDILVGKVTPK

SEQ ID NO: 1477930 - protein, 19 aa, Mycobacterium tuberculosis
RIGGRWRSGTAYLLPDDDP

SEQ ID NO: 1477931 - protein, 20 aa, Mycobacterium tuberculosis
RIGNCSGFYGDRLSAMREML

SEQ ID NO: 1477932 - protein, 19 aa, Mycobacterium tuberculosis
RIHKLLRIFANPKLPTIGD

SEQ ID NO: 1477933 - protein, 18 aa, Mycobacterium tuberculosis
RILGFYRLAMVFRHRAAL

SEQ ID NO: 1477934 - protein, 21 aa, Mycobacterium tuberculosis
RIPEDLAFAESRIRPSTIAAE

SEQ ID NO: 1477935 - protein, 35 aa, Mycobacterium tuberculosis
RIPVDLHTTLSIGPFPFRWDYIPPTPANGPIPAVP

SEQ ID NO: 1477936 - protein, 21 aa, Mycobacterium tuberculosis
RIPVHMVEVINKLGRIQRELL

SEQ ID NO: 1477937 - protein, 21 aa, Mycobacterium tuberculosis
RIPYDPHLATGLAVDFSSLKR

SEQ ID NO: 1477938 - protein, 18 aa, Mycobacterium tuberculosis
RIRELLAAYPRMPATVIA

SEQ ID NO: 1477939 - protein, 21 aa, Mycobacterium tuberculosis
RISGAKAWLGTALALKPLLSV

SEQ ID NO: 1477940 - protein, 19 aa, Mycobacterium tuberculosis
RITSPEALLPVYTPQVISR

SEQ ID NO: 1477941 - protein, 21 aa, Mycobacterium tuberculosis
RIVPISDYLAALIRDTPHGYL

SEQ ID NO: 1477942 - protein, 26 aa, Mycobacterium tuberculosis
RIVVLGDAWELLKFFNDDQYVIDPKA

SEQ ID NO: 1477943 - protein, 22 aa, Mycobacterium tuberculosis
RIYSNGLWRDAPLRRREAMRPG

SEQ ID NO: 1477944 - protein, 21 aa, Mycobacterium tuberculosis
RKDTHAHAWALRMSPDGNVWG

SEQ ID NO: 1477945 - protein, 17 aa, Mycobacterium tuberculosis
RKFDCEAWIPTQGAYRE

SEQ ID NO: 1477946 - protein, 19 aa, Mycobacterium tuberculosis
RKKPPFGIGQIGKSFRNEI

SEQ ID NO: 1477947 - protein, 25 aa, Mycobacterium tuberculosis
RKLARNTFYGMARWQASLEKKQGFL

SEQ ID NO: 1477948 - protein, 19 aa, Mycobacterium tuberculosis
RKSVYRRLVQLWQARRAVT

SEQ ID NO: 1477949 - protein, 18 aa, Mycobacterium tuberculosis
RKTLRLVAEYADIWHSFT

SEQ ID NO: 1477950 - protein, 19 aa, Mycobacterium tuberculosis
RKYLGAYLAVLGHTDVVSF

SEQ ID NO: 1477951 - protein, 18 aa, Mycobacterium tuberculosis
RLAGQWGDRVRPLVGDLT

SEQ ID NO: 1477952 - protein, 19 aa, Mycobacterium tuberculosis
RLDGIPLAIEFAAARVRSM

SEQ ID NO: 1477953 - protein, 22 aa, Mycobacterium tuberculosis
RLDSGEQLKVWRAMEDADEVPV

SEQ ID NO: 1477954 - protein, 20 aa, Mycobacterium tuberculosis
RLDSLFRLDHLAARLRRNSA

SEQ ID NO: 1477955 - protein, 29 aa, Mycobacterium tuberculosis
RLGGEQAAKLCVQYLAPIVKNRQYNYPPL

SEQ ID NO: 1477956 - protein, 25 aa, Mycobacterium tuberculosis
RLGHFYRGAGLTIYEGYGLSETSGG

SEQ ID NO: 1477957 - protein, 18 aa, Mycobacterium tuberculosis
RLGKPVEFEHKAQVVDND

SEQ ID NO: 1477958 - protein, 19 aa, Mycobacterium tuberculosis
RLGVGYTVERRGRRRAEPL

SEQ ID NO: 1477959 - protein, 19 aa, Mycobacterium tuberculosis
RLIEEGFALYGDQPPFDLS

SEQ ID NO: 1477960 - protein, 18 aa, Mycobacterium tuberculosis
RLLAERLGVRQTIGLGTV

SEQ ID NO: 1477961 - protein, 18 aa, Mycobacterium tuberculosis
RLLAPFFHGKSMKNYETI

SEQ ID NO: 1477962 - protein, 24 aa, Mycobacterium tuberculosis
RLLLQAAKSLGWRAAPIPRNAPGC

SEQ ID NO: 1477963 - protein, 24 aa, Mycobacterium tuberculosis
RLMARIDAKLGFPQRDPHGDPIPG

SEQ ID NO: 1477964 - protein, 17 aa, Mycobacterium tuberculosis
RLPADHPGVNELFALLA

SEQ ID NO: 1477965 - protein, 18 aa, Mycobacterium tuberculosis
RLPDTCFGIIAADDVGYA

SEQ ID NO: 1477966 - protein, 23 aa, Mycobacterium tuberculosis
RLPQKVGIGLARRMSLTGYYLSA

SEQ ID NO: 1477967 - protein, 20 aa, Mycobacterium tuberculosis
RLRADRALVAFPEIRSISYF

SEQ ID NO: 1477968 - protein, 25 aa, Mycobacterium tuberculosis
RLREERARLQAHLERLQAEYDQLSV

SEQ ID NO: 1477969 - protein, 25 aa, Mycobacterium tuberculosis
RLRPDQRVAFVLHDGFAVPFAEVAE

SEQ ID NO: 1477970 - protein, 19 aa, Mycobacterium tuberculosis
RLRWPCPVPGAMPISEVGD

SEQ ID NO: 1477971 - protein, 17 aa, Mycobacterium tuberculosis
RLSGRRLTLGVASDGPR

SEQ ID NO: 1477972 - protein, 19 aa, Mycobacterium tuberculosis
RLSPSVQGWLADHSVAGVT

SEQ ID NO: 1477973 - protein, 20 aa, Mycobacterium tuberculosis
RLSYFLDLRGPSVAVDTACS

SEQ ID NO: 1477974 - protein, 21 aa, Mycobacterium tuberculosis
RLTCVFVDHGLLRAGERAQVQ

SEQ ID NO: 1477975 - protein, 24 aa, Mycobacterium tuberculosis
RLWQRLCTELELPALHVPPEHGGL

SEQ ID NO: 1477976 - protein, 23 aa, Mycobacterium tuberculosis
RMASLRGLLKFRTGVRPPVPLDE

SEQ ID NO: 1477977 - protein, 18 aa, Mycobacterium tuberculosis
RMGAVRFGIYQAGCNSSL

SEQ ID NO: 1477978 - protein, 18 aa, Mycobacterium tuberculosis
RMLLRVCREQGLELAASL

SEQ ID NO: 1477979 - protein, 24 aa, Mycobacterium tuberculosis
RNGEGLGACRYAKSQGERPPGGNA

SEQ ID NO: 1477980 - protein, 20 aa, Mycobacterium tuberculosis
RNRGAAARCRICNNELNTSA

SEQ ID NO: 1477981 - protein, 22 aa, Mycobacterium tuberculosis
RNYDGSWTKWGNAVRVPIVAGE

SEQ ID NO: 1477982 - protein, 21 aa, Mycobacterium tuberculosis
RPDQLAKLAARIMDCLNPDGD

SEQ ID NO: 1477983 - protein, 23 aa, Mycobacterium tuberculosis
RPEARWRQAREWLGERGYDSTLS

SEQ ID NO: 1477984 - protein, 21 aa, Mycobacterium tuberculosis
RPEELAGLYLYLASEASSYMT

SEQ ID NO: 1477985 - protein, 19 aa, Mycobacterium tuberculosis
RPEMPALLAELGLSDRQLA

SEQ ID NO: 1477986 - protein, 24 aa, Mycobacterium tuberculosis
RPGDIAIVSMHWGSNWGYATAPGN

SEQ ID NO: 1477987 - protein, 22 aa, Mycobacterium tuberculosis
RPGGVVSRGDLLRVLPGDGSDT

SEQ ID NO: 1477988 - protein, 24 aa, Mycobacterium tuberculosis
RPGVPRPGASPGSMPPRPGGAVGG

SEQ ID NO: 1477989 - protein, 17 aa, Mycobacterium tuberculosis
RPIRKGRLGKPVEFGYK

SEQ ID NO: 1477990 - protein, 24 aa, Mycobacterium tuberculosis
RPIVVRYCRARVGTVERSGLSADD

SEQ ID NO: 1477991 - protein, 17 aa, Mycobacterium tuberculosis
RPQRFQVTASRFGRSVD

SEQ ID NO: 1477992 - protein, 23 aa, Mycobacterium tuberculosis
RPSRIDGRFAGLRRWDGNTRAEY

SEQ ID NO: 1477993 - protein, 28 aa, Mycobacterium tuberculosis
RPTPDRVRELVVAWGKLYPQFGAVAALN

SEQ ID NO: 1477994 - protein, 20 aa, Mycobacterium tuberculosis
RPVRMGRLVLPGRTTVPAVT

SEQ ID NO: 1477995 - protein, 24 aa, Mycobacterium tuberculosis
RPYQQRGLAWLAFLSSLGLGSCLA

SEQ ID NO: 1477996 - protein, 20 aa, Mycobacterium tuberculosis
RQAFGRPSGVQGSFVAERVR

SEQ ID NO: 1477997 - protein, 19 aa, Mycobacterium tuberculosis
RQLARFALRGDRTMFLFVF

SEQ ID NO: 1477998 - protein, 23 aa, Mycobacterium tuberculosis
RQLVELVCFHAAIVLGRKSSHDI

SEQ ID NO: 1477999 - protein, 17 aa, Mycobacterium tuberculosis
RQPGLGGRLLGLRRRRA

SEQ ID NO: 1478000 - protein, 21 aa, Mycobacterium tuberculosis
RQQRGRFLCIADFIRSRELAA

SEQ ID NO: 1478001 - protein, 44 aa, Mycobacterium tuberculosis
RQRRQSRGHARCRRHRRAAARRERTQRLAIAGRPATTRGVEGIS

SEQ ID NO: 1478002 - protein, 20 aa, Mycobacterium tuberculosis
RRAAFGLATEIGRELTARTG

SEQ ID NO: 1478003 - protein, 18 aa, Mycobacterium tuberculosis
RRAAGTGARRVAVVRLPR

SEQ ID NO: 1478004 - protein, 19 aa, Mycobacterium tuberculosis
RRCNEADAGVPARRRGRGV

SEQ ID NO: 1478005 - protein, 19 aa, Mycobacterium tuberculosis
RRCRAKRWGGAAPVTRAGD

SEQ ID NO: 1478006 - protein, 27 aa, Mycobacterium tuberculosis
RRDGVACYPARFQLVLAANPCPCAPAD

SEQ ID NO: 1478007 - protein, 18 aa, Mycobacterium tuberculosis
RRDTRSCPQRNHDALNAG

SEQ ID NO: 1478008 - protein, 23 aa, Mycobacterium tuberculosis
RRFLPRCAAGAISAFLLTEPDVG

SEQ ID NO: 1478009 - protein, 23 aa, Mycobacterium tuberculosis
RRGIMFADVPWRGNRINRIRYFP

SEQ ID NO: 1478010 - protein, 29 aa, Mycobacterium tuberculosis
RRGPAHSAFTLPELIGLTAGADVVLDPGD

SEQ ID NO: 1478011 - protein, 24 aa, Mycobacterium tuberculosis
RRGTLPPGRLGVRRAKEIRNRARD

SEQ ID NO: 1478012 - protein, 22 aa, Mycobacterium tuberculosis
RRHLREIDRFGCTNPDIAGFHM

SEQ ID NO: 1478013 - protein, 18 aa, Mycobacterium tuberculosis
RRHQVVYQRLAPRCTARD

SEQ ID NO: 1478014 - protein, 18 aa, Mycobacterium tuberculosis
RRKALEAGYDLNQVLTTE

SEQ ID NO: 1478015 - protein, 18 aa, Mycobacterium tuberculosis
RRKLVNAGFTRKRVKDKE

SEQ ID NO: 1478016 - protein, 18 aa, Mycobacterium tuberculosis
RRLALLLTFPRFLPTTGP

SEQ ID NO: 1478017 - protein, 20 aa, Mycobacterium tuberculosis
RRLDAIAAELDRAVPDQDQL

SEQ ID NO: 1478018 - protein, 18 aa, Mycobacterium tuberculosis
RRLLQMVGRDLGLDIKRY

SEQ ID NO: 1478019 - protein, 20 aa, Mycobacterium tuberculosis
RRLPKPPSLKRIRGQLHPPS

SEQ ID NO: 1478020 - protein, 21 aa, Mycobacterium tuberculosis
RRPEMPALLAELGLSDRQLAS

SEQ ID NO: 1478021 - protein, 22 aa, Mycobacterium tuberculosis
RRQAETPLLLAVDGTLVGLISL

SEQ ID NO: 1478022 - protein, 18 aa, Mycobacterium tuberculosis
RRQLKPLGRQAEAAQRAA

SEQ ID NO: 1478023 - protein, 26 aa, Mycobacterium tuberculosis
RRRLAPWGARCCWTRRTGSGRCNRLG

SEQ ID NO: 1478024 - protein, 27 aa, Mycobacterium tuberculosis
RRRTVCFADKFGCVHIGNPDLYRPQTS

SEQ ID NO: 1478025 - protein, 23 aa, Mycobacterium tuberculosis
RRRVAMLRDWLDAELAEPSVTVL

SEQ ID NO: 1478026 - protein, 19 aa, Mycobacterium tuberculosis
RRRWNRRGAVVTDRYQRLC

SEQ ID NO: 1478027 - protein, 18 aa, Mycobacterium tuberculosis
RRRWPPTRGCRRRRSRRP

SEQ ID NO: 1478028 - protein, 23 aa, Mycobacterium tuberculosis
RRRWYPLTACLPLAPDHTNPDTP

SEQ ID NO: 1478029 - protein, 19 aa, Mycobacterium tuberculosis
RRSFWIQREHLLQAIKDVG

SEQ ID NO: 1478030 - protein, 25 aa, Mycobacterium tuberculosis
RRYIAKYTICPAIAHGMDHLIGSVE

SEQ ID NO: 1478031 - protein, 27 aa, Mycobacterium tuberculosis
RSAIARFTAAGIRKTWVFQAFDDAHEV

SEQ ID NO: 1478032 - protein, 18 aa, Mycobacterium tuberculosis
RSASIGYRASMDVTGPSE

SEQ ID NO: 1478033 - protein, 19 aa, Mycobacterium tuberculosis
RSGRARWVVGTAPGRAIPF

SEQ ID NO: 1478034 - protein, 17 aa, Mycobacterium tuberculosis
RSGTPVQVLGFREHASW

SEQ ID NO: 1478035 - protein, 21 aa, Mycobacterium tuberculosis
RSKAARKVWDTADKFTRDTLG

SEQ ID NO: 1478036 - protein, 27 aa, Mycobacterium tuberculosis
RSLAPRCQKVLEGTGFVISPDRVMTNA

SEQ ID NO: 1478037 - protein, 24 aa, Mycobacterium tuberculosis
RSLAYDRAWWFARFVAAAYGTAKL

SEQ ID NO: 1478038 - protein, 19 aa, Mycobacterium tuberculosis
RSLERLECLVRRLPAVGHA

SEQ ID NO: 1478039 - protein, 29 aa, Mycobacterium tuberculosis
RSPHSERLFCIPATIDLAGAEIELVSMVA

SEQ ID NO: 1478040 - protein, 17 aa, Mycobacterium tuberculosis
RSQLRSMLVEDVRARLR

SEQ ID NO: 1478041 - protein, 18 aa, Mycobacterium tuberculosis
RSRQHLHGLGGLVKPARG

SEQ ID NO: 1478042 - protein, 26 aa, Mycobacterium tuberculosis
RSSKEPGRFCWRDKWHRSAYYTTAHL

SEQ ID NO: 1478043 - protein, 21 aa, Mycobacterium tuberculosis
RSTPWPGGELPDWYRRCYDPV

SEQ ID NO: 1478044 - protein, 18 aa, Mycobacterium tuberculosis
RSTTVAMDFGRITLGEDL

SEQ ID NO: 1478045 - protein, 19 aa, Mycobacterium tuberculosis
RSTVCCWLNASSVGNVPLV

SEQ ID NO: 1478046 - protein, 25 aa, Mycobacterium tuberculosis
RSVGGDSGLFGMHGQTYQALSARAA

SEQ ID NO: 1478047 - protein, 18 aa, Mycobacterium tuberculosis
RTFVPSKGFGLLPPIVTP

SEQ ID NO: 1478048 - protein, 20 aa, Mycobacterium tuberculosis
RTGAASYMLAEATNVEQNLL

SEQ ID NO: 1478049 - protein, 17 aa, Mycobacterium tuberculosis
RTGAMAVPVGWAATVVG

SEQ ID NO: 1478050 - protein, 21 aa, Mycobacterium tuberculosis
RTGSWLRRDRRTFTATQLVLA

SEQ ID NO: 1478051 - protein, 24 aa, Mycobacterium tuberculosis
RTQLACPERSSIRFDGVGAATVTS

SEQ ID NO: 1478052 - protein, 20 aa, Mycobacterium tuberculosis
RTRRAGVSSFGISGTNAHVI

SEQ ID NO: 1478053 - protein, 34 aa, Mycobacterium tuberculosis
RTTIKRWFPGFMTFRFLECGLLTMVSNPLALRSD

SEQ ID NO: 1478054 - protein, 18 aa, Mycobacterium tuberculosis
RTVALTVYGDLETSTLRE

SEQ ID NO: 1478055 - protein, 23 aa, Mycobacterium tuberculosis
RTVEPWGVVTEKGRWYLVGHDRD

SEQ ID NO: 1478056 - protein, 19 aa, Mycobacterium tuberculosis
RVAELARMLAGLGDSDSGR

SEQ ID NO: 1478057 - protein, 19 aa, Mycobacterium tuberculosis
RVAPRLNRLMTNMMSSSTV

SEQ ID NO: 1478058 - protein, 17 aa, Mycobacterium tuberculosis
RVASPRYRCTTPQCGRA

SEQ ID NO: 1478059 - protein, 21 aa, Mycobacterium tuberculosis
RVCGAIGVIECDRPVDLAVAT

SEQ ID NO: 1478060 - protein, 18 aa, Mycobacterium tuberculosis
RVDPLRGLSRPDFDHDGE

SEQ ID NO: 1478061 - protein, 21 aa, Mycobacterium tuberculosis
RVERRAVPLPLEQKIFDAEWT

SEQ ID NO: 1478062 - protein, 17 aa, Mycobacterium tuberculosis
RVFAELSPHPLLTHAVE

SEQ ID NO: 1478063 - protein, 17 aa, Mycobacterium tuberculosis
RVFTELTPHPLLTHAVD

SEQ ID NO: 1478064 - protein, 24 aa, Mycobacterium tuberculosis
RVGAQGPRVGRGFDVRVADQRAVG

SEQ ID NO: 1478065 - protein, 19 aa, Mycobacterium tuberculosis
RVGVAEFRRSLDRVMPRDA

SEQ ID NO: 1478066 - protein, 26 aa, Mycobacterium tuberculosis
RVIDGEIKQRYELFKSVGARDANDYE

SEQ ID NO: 1478067 - protein, 19 aa, Mycobacterium tuberculosis
RVIHAAAPCPVQIKEQMIH

SEQ ID NO: 1478068 - protein, 21 aa, Mycobacterium tuberculosis
RVLARREFAGMISVAIDSADG

SEQ ID NO: 1478069 - protein, 23 aa, Mycobacterium tuberculosis
RVLGDPALPHLFFVEGGALAVEN

SEQ ID NO: 1478070 - protein, 18 aa, Mycobacterium tuberculosis
RVNCPTHGPTVVAVAWAR

SEQ ID NO: 1478071 - protein, 19 aa, Mycobacterium tuberculosis
RVQLASLLVGEWDVIALDE

SEQ ID NO: 1478072 - protein, 19 aa, Mycobacterium tuberculosis
RVQRPLWASTGVKNPDYSD

SEQ ID NO: 1478073 - protein, 19 aa, Mycobacterium tuberculosis
RVTAVRSRLMAPLSGQGTM

SEQ ID NO: 1478074 - protein, 18 aa, Mycobacterium tuberculosis
RVVGHKVGLSSPIMQQMM

SEQ ID NO: 1478075 - protein, 17 aa, Mycobacterium tuberculosis
RWEPSRVQPVRRTNPAV

SEQ ID NO: 1478076 - protein, 19 aa, Mycobacterium tuberculosis
RWLAEGVADFVARPKTPPP

SEQ ID NO: 1478077 - protein, 18 aa, Mycobacterium tuberculosis
RWLATVIQMDGRRIDLLE

SEQ ID NO: 1478078 - protein, 24 aa, Mycobacterium tuberculosis
RWMAAMRRHGYKGAFEMAATVDYL

SEQ ID NO: 1478079 - protein, 19 aa, Mycobacterium tuberculosis
RYDPAALRRTRISARSRDL

SEQ ID NO: 1478080 - protein, 18 aa, Mycobacterium tuberculosis
RYGGVEFYSAIAAGSPER

SEQ ID NO: 1478081 - protein, 19 aa, Mycobacterium tuberculosis
SAAIASLFAAHGQAYQAVS

SEQ ID NO: 1478082 - protein, 17 aa, Mycobacterium tuberculosis
SAAPAWPQASGVRAVTA

SEQ ID NO: 1478083 - protein, 18 aa, Mycobacterium tuberculosis
SAAVELVHNFTLLHDDVM

SEQ ID NO: 1478084 - protein, 21 aa, Mycobacterium tuberculosis
SAAVSRLFGAYGQQFQALNAR

SEQ ID NO: 1478085 - protein, 23 aa, Mycobacterium tuberculosis
SAEAAAFHGRFVQALTTGGGAYA

SEQ ID NO: 1478086 - protein, 25 aa, Mycobacterium tuberculosis
SAEGRVAALRRCVPMVGQIKDPTLR

SEQ ID NO: 1478087 - protein, 18 aa, Mycobacterium tuberculosis
SAEQVRWVLQDSEAVVLF

SEQ ID NO: 1478088 - protein, 22 aa, Mycobacterium tuberculosis
SAESRTLARLGLANYFAAATVL

SEQ ID NO: 1478089 - protein, 18 aa, Mycobacterium tuberculosis
SAFPKPQNYPGLPTVSFV

SEQ ID NO: 1478090 - protein, 18 aa, Mycobacterium tuberculosis
SAGIAALFSAHAQEYQAL

SEQ ID NO: 1478091 - protein, 24 aa, Mycobacterium tuberculosis
SAGRLRIGAAVGINGDVGAKARAL

SEQ ID NO: 1478092 - protein, 18 aa, Mycobacterium tuberculosis
SAKGEFLGGAIAPGVQVS

SEQ ID NO: 1478093 - protein, 20 aa, Mycobacterium tuberculosis
SAKPRGFLTGRITGAQTGAV

SEQ ID NO: 1478094 - protein, 19 aa, Mycobacterium tuberculosis
SALERGHGVLVCAPTGAGK

SEQ ID NO: 1478095 - protein, 17 aa, Mycobacterium tuberculosis
SALIGYAQGGSGGLGGF

SEQ ID NO: 1478096 - protein, 20 aa, Mycobacterium tuberculosis
SAPRPAPFRLRVVKRHTLGY

SEQ ID NO: 1478097 - protein, 17 aa, Mycobacterium tuberculosis
SAQAAAFHSQFVQALSG

SEQ ID NO: 1478098 - protein, 26 aa, Mycobacterium tuberculosis
SAQVSACNAVRCLMWSESPDPTPVQS

SEQ ID NO: 1478099 - protein, 25 aa, Mycobacterium tuberculosis
SARASQTWRYPAFFHAMLDAGVYPP

SEQ ID NO: 1478100 - protein, 24 aa, Mycobacterium tuberculosis
SARDLRFGYRTSVLKHADGLAVPT

SEQ ID NO: 1478101 - protein, 23 aa, Mycobacterium tuberculosis
SASELRDGLCFVDLAPITESGIV

SEQ ID NO: 1478102 - protein, 23 aa, Mycobacterium tuberculosis
SATLFIKPGWGFSFDYQPGQYIG

SEQ ID NO: 1478103 - protein, 24 aa, Mycobacterium tuberculosis
SATLFIKPGWGFSFDYQPGQYIGI

SEQ ID NO: 1478104 - protein, 19 aa, Mycobacterium tuberculosis
SCAEGGVLGIICASVASVM

SEQ ID NO: 1478105 - protein, 17 aa, Mycobacterium tuberculosis
SCGAAWRLLVASVVLPI

SEQ ID NO: 1478106 - protein, 19 aa, Mycobacterium tuberculosis
SCVPLLKQLLEAEGVEQSK

SEQ ID NO: 1478107 - protein, 31 aa, Mycobacterium tuberculosis
SDALVARRLLPRVPRCIPLAARLAPGTIGCP

SEQ ID NO: 1478108 - protein, 22 aa, Mycobacterium tuberculosis
SDEVLYRPLGMGSTSSRFTDFL

SEQ ID NO: 1478109 - protein, 31 aa, Mycobacterium tuberculosis
SDKPFSCLMLNAIPDLAFWGSSNGQFFPRWT

SEQ ID NO: 1478110 - protein, 25 aa, Mycobacterium tuberculosis
SDLAVLGYYEWREGLLRGLAAHHAG

SEQ ID NO: 1478111 - protein, 17 aa, Mycobacterium tuberculosis
SDRPRSVIWVTGRGTAE

SEQ ID NO: 1478112 - protein, 21 aa, Mycobacterium tuberculosis
SDSRRANLWAADRYNRAIARG

SEQ ID NO: 1478113 - protein, 18 aa, Mycobacterium tuberculosis
SDYARMWIQAATTMASYQ

SEQ ID NO: 1478114 - protein, 22 aa, Mycobacterium tuberculosis
SDYHLELAWPGRVWYQDYFAVQ

SEQ ID NO: 1478115 - protein, 57 aa, Mycobacterium tuberculosis
SEAVMLGGLALKWRWRQRVGSWKGRMPNLVMGSNVQVVWEKFCRYFDVEPRYLPMER

SEQ ID NO: 1478116 - protein, 17 aa, Mycobacterium tuberculosis
SECYVRNQVPFFVDYVR

SEQ ID NO: 1478117 - protein, 19 aa, Mycobacterium tuberculosis
SECYVRNQVPFFVDYVRRY

SEQ ID NO: 1478118 - protein, 23 aa, Mycobacterium tuberculosis
SECYVRNQVPFFVDYVRRYTDLP

SEQ ID NO: 1478119 - protein, 24 aa, Mycobacterium tuberculosis
SECYVRNQVPFFVDYVRRYTDLPF

SEQ ID NO: 1478120 - protein, 20 aa, Mycobacterium tuberculosis
SEDAKFVYVDGHLYSDLGQP

SEQ ID NO: 1478121 - protein, 21 aa, Mycobacterium tuberculosis
SEFSRHLKLLAKELEVPVVAI

SEQ ID NO: 1478122 - protein, 23 aa, Mycobacterium tuberculosis
SEPIAIVGMSCRFPGGVDSPEGL

SEQ ID NO: 1478123 - protein, 23 aa, Mycobacterium tuberculosis
SFSMASGRVAYAMRLHGPAITVD

SEQ ID NO: 1478124 - protein, 25 aa, Mycobacterium tuberculosis
SGAFADPAGGTGIFAPGMTGASSAE

SEQ ID NO: 1478125 - protein, 20 aa, Mycobacterium tuberculosis
SGAPGQRGGAGGAAGLIGNG

SEQ ID NO: 1478126 - protein, 22 aa, Mycobacterium tuberculosis
SGAPGQRGGAGGAAGLIGNGGN

SEQ ID NO: 1478127 - protein, 20 aa, Mycobacterium tuberculosis
SGATPAFAFPLEITIDRIPV

SEQ ID NO: 1478128 - protein, 20 aa, Mycobacterium tuberculosis
SGDHPGIDWAKYALKAPVMM

SEQ ID NO: 1478129 - protein, 25 aa, Mycobacterium tuberculosis
SGDREIDGNLALVIARHQEAIVEVA

SEQ ID NO: 1478130 - protein, 24 aa, Mycobacterium tuberculosis
SGELPQRHIGVGWAALRSLPPPAP

SEQ ID NO: 1478131 - protein, 17 aa, Mycobacterium tuberculosis
SGESGGSGNGRGDPGSG

SEQ ID NO: 1478132 - protein, 19 aa, Mycobacterium tuberculosis
SGGAASMFAAPAAATAAVT

SEQ ID NO: 1478133 - protein, 24 aa, Mycobacterium tuberculosis
SGGAGGNGGWLLGNGGIGGAGGTG

SEQ ID NO: 1478134 - protein, 27 aa, Mycobacterium tuberculosis
SGGAKGCPKETWCVVNAGNYRGSMNVT

SEQ ID NO: 1478135 - protein, 17 aa, Mycobacterium tuberculosis
SGGFGLDTGGAGGRGGD

SEQ ID NO: 1478136 - protein, 24 aa, Mycobacterium tuberculosis
SGGGGGTGGFGFAAGGQGGVGGSA

SEQ ID NO: 1478137 - protein, 19 aa, Mycobacterium tuberculosis
SGGMPAAAFGGRAEVMQRL

SEQ ID NO: 1478138 - protein, 18 aa, Mycobacterium tuberculosis
SGGNGAPGAPGQAGGAGG

SEQ ID NO: 1478139 - protein, 24 aa, Mycobacterium tuberculosis
SGGNWSINTGNGYLGGLQFTQSTW

SEQ ID NO: 1478140 - protein, 21 aa, Mycobacterium tuberculosis
SGGSALLWGDGGAGGAGGVGS

SEQ ID NO: 1478141 - protein, 18 aa, Mycobacterium tuberculosis
SGHRGPTGGVSRRRLLRA

SEQ ID NO: 1478142 - protein, 19 aa, Mycobacterium tuberculosis
SGLQRRLGTTTVYVTHDQV

SEQ ID NO: 1478143 - protein, 20 aa, Mycobacterium tuberculosis
SGNYLPRFGPYLSSASNPWG

SEQ ID NO: 1478144 - protein, 17 aa, Mycobacterium tuberculosis
SGSGRPWDGDQLLRALG

SEQ ID NO: 1478145 - protein, 17 aa, Mycobacterium tuberculosis
SGSGRPWDRDQLLRALG

SEQ ID NO: 1478146 - protein, 23 aa, Mycobacterium tuberculosis
SGVELRNRLQMAIGLPGLSLPRT

SEQ ID NO: 1478147 - protein, 21 aa, Mycobacterium tuberculosis
SGVSIDGLIAILTFPPAESVF

SEQ ID NO: 1478148 - protein, 24 aa, Mycobacterium tuberculosis
SGYAHVTGRVGVCMATSGPGATNL

SEQ ID NO: 1478149 - protein, 20 aa, Mycobacterium tuberculosis
SHFSCLPYRVGVGRANTRNR

SEQ ID NO: 1478150 - protein, 18 aa, Mycobacterium tuberculosis
SHGRFALGERLLGFGSVT

SEQ ID NO: 1478151 - protein, 17 aa, Mycobacterium tuberculosis
SHLAFGFGTHFCLGNQL

SEQ ID NO: 1478152 - protein, 19 aa, Mycobacterium tuberculosis
SHRACGFSSGPPELEEAAM

SEQ ID NO: 1478153 - protein, 23 aa, Mycobacterium tuberculosis
SHTRPDQLVAMPALPTTPIGKID

SEQ ID NO: 1478154 - protein, 19 aa, Mycobacterium tuberculosis
SHVYPTGASLYFTVVAGQR

SEQ ID NO: 1478155 - protein, 23 aa, Mycobacterium tuberculosis
SIEHARTWPGHMGAAMANAYSAN

SEQ ID NO: 1478156 - protein, 19 aa, Mycobacterium tuberculosis
SIGLRGADVTKTFTNIQKR

SEQ ID NO: 1478157 - protein, 19 aa, Mycobacterium tuberculosis
SIGSAARPRAVNHPSIEGQ

SEQ ID NO: 1478158 - protein, 21 aa, Mycobacterium tuberculosis
SIGVPEPLKLAGTAEQKRRFL

SEQ ID NO: 1478159 - protein, 23 aa, Mycobacterium tuberculosis
SIPEQPLPLAINVIGHINALSTP

SEQ ID NO: 1478160 - protein, 23 aa, Mycobacterium tuberculosis
SIVAVTGGLLWPTRQNDARMEDV

SEQ ID NO: 1478161 - protein, 19 aa, Mycobacterium tuberculosis
SIVEISCCPSAGPRGPYDN

SEQ ID NO: 1478162 - protein, 18 aa, Mycobacterium tuberculosis
SIVIRKLFWRNLPDEQPG

SEQ ID NO: 1478163 - protein, 29 aa, Mycobacterium tuberculosis
SKAAARLGSDMGEFYMPYPGTRINQETVS

SEQ ID NO: 1478164 - protein, 19 aa, Mycobacterium tuberculosis
SKTVWGVGIAPSITTASLR

SEQ ID NO: 1478165 - protein, 24 aa, Mycobacterium tuberculosis
SKTVWGVGIAPSITTASLRAVVSA

SEQ ID NO: 1478166 - protein, 28 aa, Mycobacterium tuberculosis
SLDARIAGRLGLRADVRRVPLFGLGCVA

SEQ ID NO: 1478167 - protein, 22 aa, Mycobacterium tuberculosis
SLDEPWCRTLASHLGHFATTDA

SEQ ID NO: 1478168 - protein, 26 aa, Mycobacterium tuberculosis
SLDVPRITIVDAHLDGGFGPVVLPPI

SEQ ID NO: 1478169 - protein, 20 aa, Mycobacterium tuberculosis
SLGFLMARFNIWGRPDLRRW

SEQ ID NO: 1478170 - protein, 17 aa, Mycobacterium tuberculosis
SLNCYHQSLPLAEMLYA

SEQ ID NO: 1478171 - protein, 22 aa, Mycobacterium tuberculosis
SLRSLPGCHLLVRPEVMRRDVD

SEQ ID NO: 1478172 - protein, 19 aa, Mycobacterium tuberculosis
SLTGRPLIGDGANGIDGTG

SEQ ID NO: 1478173 - protein, 24 aa, Mycobacterium tuberculosis
SMEQGRLAAYHAFGEPTDGITELQ

SEQ ID NO: 1478174 - protein, 17 aa, Mycobacterium tuberculosis
SNPRFSVSRVDIDRGGP

SEQ ID NO: 1478175 - protein, 18 aa, Mycobacterium tuberculosis
SNRPAIYVATYFGDPGAA

SEQ ID NO: 1478176 - protein, 23 aa, Mycobacterium tuberculosis
SNSALVVPVRFAGVHVYGDITRG

SEQ ID NO: 1478177 - protein, 23 aa, Mycobacterium tuberculosis
SPAAPRPGPQRGVLVRVGPQVQE

SEQ ID NO: 1478178 - protein, 19 aa, Mycobacterium tuberculosis
SPANIAFALGYPMDIGSYV

SEQ ID NO: 1478179 - protein, 17 aa, Mycobacterium tuberculosis
SPAQLGLDHGHAYVMQA

SEQ ID NO: 1478180 - protein, 19 aa, Mycobacterium tuberculosis
SPDEFSGKILAPAHLPQEQ

SEQ ID NO: 1478181 - protein, 18 aa, Mycobacterium tuberculosis
SPEVIAYLEAENDYTERT

SEQ ID NO: 1478182 - protein, 17 aa, Mycobacterium tuberculosis
SPIKADLTGGLAEANLD

SEQ ID NO: 1478183 - protein, 29 aa, Mycobacterium tuberculosis
SPLLRRPDLLVSLLTYWQRHPSLSYLFAG

SEQ ID NO: 1478184 - protein, 20 aa, Mycobacterium tuberculosis
SPVDACSPLGGSASSLAAIP

SEQ ID NO: 1478185 - protein, 19 aa, Mycobacterium tuberculosis
SPVRIIGYANAYDFFNMWR

SEQ ID NO: 1478186 - protein, 21 aa, Mycobacterium tuberculosis
SPVTIPGFAINPFGLNVPLSG

SEQ ID NO: 1478187 - protein, 17 aa, Mycobacterium tuberculosis
SQAWTLRADEVIQNVTV

SEQ ID NO: 1478188 - protein, 23 aa, Mycobacterium tuberculosis
SQIRIPSRRAAVVLRASNASDAA

SEQ ID NO: 1478189 - protein, 19 aa, Mycobacterium tuberculosis
SQMAAGLLTHLAGDRIEVR

SEQ ID NO: 1478190 - protein, 17 aa, Mycobacterium tuberculosis
SRAPRWAIAYKYPPEEA

SEQ ID NO: 1478191 - protein, 19 aa, Mycobacterium tuberculosis
SRESLFWVSGNGVRFGIAN

SEQ ID NO: 1478192 - protein, 20 aa, Mycobacterium tuberculosis
SREVGLSVLQVWQALTEAVS

SEQ ID NO: 1478193 - protein, 20 aa, Mycobacterium tuberculosis
SRFHFPRIYLDYIGHGDSDK

SEQ ID NO: 1478194 - protein, 19 aa, Mycobacterium tuberculosis
SRFPHIRFTTEAIAQTGNG

SEQ ID NO: 1478195 - protein, 23 aa, Mycobacterium tuberculosis
SRGEPHRDICLIPSSAHGTNAAS

SEQ ID NO: 1478196 - protein, 24 aa, Mycobacterium tuberculosis
SRITPELIKALGAVRRHHDELMRL

SEQ ID NO: 1478197 - protein, 22 aa, Mycobacterium tuberculosis
SRKAIHFQEWWVRYRAQVPTHS

SEQ ID NO: 1478198 - protein, 24 aa, Mycobacterium tuberculosis
SRLAAQGWVCLSIDYRVAPHHRWP

SEQ ID NO: 1478199 - protein, 18 aa, Mycobacterium tuberculosis
SRLEGRMAAIGVETHLSR

SEQ ID NO: 1478200 - protein, 20 aa, Mycobacterium tuberculosis
SRLGPARTAAICAVSPALWL

SEQ ID NO: 1478201 - protein, 19 aa, Mycobacterium tuberculosis
SRLRQVLRNLVANAIQHTP

SEQ ID NO: 1478202 - protein, 24 aa, Mycobacterium tuberculosis
SRRPCRMPVAPGCGSWPKTSTPTR

SEQ ID NO: 1478203 - protein, 20 aa, Mycobacterium tuberculosis
SRRRGIGTAMARAALAKTAG

SEQ ID NO: 1478204 - protein, 18 aa, Mycobacterium tuberculosis
SRYWPADDYRAGVVQTSF

SEQ ID NO: 1478205 - protein, 17 aa, Mycobacterium tuberculosis
SSEMIICGGVNIAPDEV

SEQ ID NO: 1478206 - protein, 39 aa, Mycobacterium tuberculosis; identical to SEQ ID NO: 211806

SEQ ID NO: 1478207 - protein, 24 aa, Mycobacterium tuberculosis
SSLNDMTHWLAMVLADGVYNGRRI

SEQ ID NO: 1478208 - protein, 17 aa, Mycobacterium tuberculosis
SSNGQFFPRWTYEKTEP

SEQ ID NO: 1478209 - protein, 19 aa, Mycobacterium tuberculosis
SSQTSRTPWCRSLPLNWRR

SEQ ID NO: 1478210 - protein, 19 aa, Mycobacterium tuberculosis
SSSQMRSWFNYRFDGPNAV

SEQ ID NO: 1478211 - protein, 20 aa, Mycobacterium tuberculosis
SSSWKGWGHVRWFIEEVPAG

SEQ ID NO: 1478212 - protein, 18 aa, Mycobacterium tuberculosis
STAIAALFGSHGQHYQAI

SEQ ID NO: 1478213 - protein, 19 aa, Mycobacterium tuberculosis
STCRSLEFHRAVEVIAVGR

SEQ ID NO: 1478214 - protein, 25 aa, Mycobacterium tuberculosis
STEFAELRPRLVYDRDTGTLTARPG

SEQ ID NO: 1478215 - protein, 23 aa, Mycobacterium tuberculosis
STEQDFRLFSGMSAHYDSLPRLI

SEQ ID NO: 1478216 - protein, 23 aa, Mycobacterium tuberculosis
STGKELFAAQGLPPFADDHITRF

SEQ ID NO: 1478217 - protein, 17 aa, Mycobacterium tuberculosis
STIRKPPIEHAAGPLGS

SEQ ID NO: 1478218 - protein, 33 aa, Mycobacterium tuberculosis
STLGLDFMRSCSIRHRMASVIFSLEMSKSEIVM

SEQ ID NO: 1478219 - protein, 18 aa, Mycobacterium tuberculosis
STLPGVLMTIPWAVISGF

SEQ ID NO: 1478220 - protein, 25 aa, Mycobacterium tuberculosis
STNTICLDIDWVIGGCMSVDPTHNT

SEQ ID NO: 1478221 - protein, 28 aa, Mycobacterium tuberculosis
STPGRALLFPSLCHFSGGIPAPAADPPY

SEQ ID NO: 1478222 - protein, 25 aa, Mycobacterium tuberculosis
STRSRGFCGKSRRSSSTGGAPPRSR

SEQ ID NO: 1478223 - protein, 24 aa, Mycobacterium tuberculosis
STSSRFTDFLARPNHAVNHVKVAD

SEQ ID NO: 1478224 - protein, 20 aa, Mycobacterium tuberculosis
SVAGLVAWKMGCSSGNAHTI

SEQ ID NO: 1478225 - protein, 17 aa, Mycobacterium tuberculosis
SVELWLTQVGSVDTASV

SEQ ID NO: 1478226 - protein, 24 aa, Mycobacterium tuberculosis
SVEVICAELLRLRDRFVSAAPEIT

SEQ ID NO: 1478227 - protein, 26 aa, Mycobacterium tuberculosis
SVGHRIRAAIHFDDLQWERRYRRVAA

SEQ ID NO: 1478228 - protein, 24 aa, Mycobacterium tuberculosis
SVGHVFRRAFSWLPAQFASQSDAP

SEQ ID NO: 1478229 - protein, 18 aa, Mycobacterium tuberculosis
SVGLLSVGAYRPERVVTN

SEQ ID NO: 1478230 - protein, 17 aa, Mycobacterium tuberculosis
SVLKAYPSHELTAVGDW

SEQ ID NO: 1478231 - protein, 18 aa, Mycobacterium tuberculosis
SVLPALGEEGIYIVTWAD

SEQ ID NO: 1478232 - protein, 30 aa, Mycobacterium tuberculosis
SVMTIPGMRLPFTSIVPFVVYYGPVELPQS

SEQ ID NO: 1478233 - protein, 17 aa, Mycobacterium tuberculosis
SVNGTVVVSVWQPGEPA

SEQ ID NO: 1478234 - protein, 24 aa, Mycobacterium tuberculosis
SVPDEVWPAVVFTLVTLLDDPVAA

SEQ ID NO: 1478235 - protein, 25 aa, Mycobacterium tuberculosis
SVPELGWPACPLPPAPPALAPLLPP

SEQ ID NO: 1478236 - protein, 41 aa, Mycobacterium tuberculosis
SVTSGLADAAWRGPAAVAMARAVAPYLGWLISATAQAEQAA

SEQ ID NO: 1478237 - protein, 17 aa, Mycobacterium tuberculosis
SVYAACLPERFADVMRV

SEQ ID NO: 1478238 - protein, 18 aa, Mycobacterium tuberculosis
SWAGTLIVVSHDRYLLER

SEQ ID NO: 1478239 - protein, 18 aa, Mycobacterium tuberculosis
SWLRPASCTTALRRPTAV

SEQ ID NO: 1478240 - protein, 26 aa, Mycobacterium tuberculosis
SWQQALRGLPGLGQVASAISGGAASM

SEQ ID NO: 1478241 - protein, 21 aa, Mycobacterium tuberculosis
SWSNPNDWWLVRLLGSITPTE

SEQ ID NO: 1478242 - protein, 24 aa, Mycobacterium tuberculosis
SYARQMLDPGGWVEADEDTFYDRA

SEQ ID NO: 1478243 - protein, 25 aa, Mycobacterium tuberculosis
SYGNRFGYNVVRDFTGHGIGTTFHN

SEQ ID NO: 1478244 - protein, 23 aa, Mycobacterium tuberculosis
SYHAELFCWTGAFETSEGIPHSS

SEQ ID NO: 1478245 - protein, 38 aa, Mycobacterium tuberculosis
SYQCAIDAMSSRCFPSYALRRRAKALGSLTQMELLMIS

SEQ ID NO: 1478246 - protein, 19 aa, Mycobacterium tuberculosis
SYVRVSAGLPRTMTFKVIK

SEQ ID NO: 1478247 - protein, 17 aa, Mycobacterium tuberculosis
TAAARAVSWPAVTSPAG

SEQ ID NO: 1478248 - protein, 29 aa, Mycobacterium tuberculosis
TAAELAPRVVAKVPQLVQLAPHAVQMSQN

SEQ ID NO: 1478249 - protein, 18 aa, Mycobacterium tuberculosis
TADALYDFYGRAVTGLPL

SEQ ID NO: 1478250 - protein, 20 aa, Mycobacterium tuberculosis
TADLAMWPPAGAVPVEVADG

SEQ ID NO: 1478251 - protein, 19 aa, Mycobacterium tuberculosis
TAEAVARFLSWVYATNPPA

SEQ ID NO: 1478252 - protein, 28 aa, Mycobacterium tuberculosis
TAGLLFGAGGAGGFGFGGAGGAGGLGGK

SEQ ID NO: 1478253 - protein, 21 aa, Mycobacterium tuberculosis
TAHVMKARRGALEGDPSGSQA

SEQ ID NO: 1478254 - protein, 20 aa, Mycobacterium tuberculosis
TAIPYRVPFPQSMPTQETAP

SEQ ID NO: 1478255 - protein, 18 aa, Mycobacterium tuberculosis
TAKLSYRGRAFATVPIEV

SEQ ID NO: 1478256 - protein, 25 aa, Mycobacterium tuberculosis
TAKVLSRYVDAIVWRTFGQERLDAM

SEQ ID NO: 1478257 - protein, 22 aa, Mycobacterium tuberculosis
TALCAGEKMMLLFESANFDEAV

SEQ ID NO: 1478258 - protein, 23 aa, Mycobacterium tuberculosis
TALLQPTRPGGVSTLGALINTAA

SEQ ID NO: 1478259 - protein, 17 aa, Mycobacterium tuberculosis
TAMPGLLNNGVLIDESA

SEQ ID NO: 1478260 - protein, 23 aa, Mycobacterium tuberculosis
TANAFVLRGGVPVFVDIRPDTLN

SEQ ID NO: 1478261 - protein, 33 aa, Mycobacterium tuberculosis; identical to SEQ ID NO: 234314

SEQ ID NO: 1478262 - protein, 27 aa, Mycobacterium tuberculosis
TAPEISARILMKLKRDAEAYLGEDITD

SEQ ID NO: 1478263 - protein, 19 aa, Mycobacterium tuberculosis
TAPLVPLAVSAFLTSRKKA

SEQ ID NO: 1478264 - protein, 18 aa, Mycobacterium tuberculosis
TAPQCTHYPLAEAADAIR

SEQ ID NO: 1478265 - protein, 17 aa, Mycobacterium tuberculosis
TAVAALFSSHAQAYQAA

SEQ ID NO: 1478266 - protein, 18 aa, Mycobacterium tuberculosis
TAVQFHFIARLVLVLLDE

SEQ ID NO: 1478267 - protein, 20 aa, Mycobacterium tuberculosis
TCDRSRLTADGLWLHCLYAI

SEQ ID NO: 1478268 - protein, 18 aa, Mycobacterium tuberculosis
TCNGRLAVEGFLELEKRT

SEQ ID NO: 1478269 - protein, 21 aa, Mycobacterium tuberculosis
TDEIKRRILAMAQPDADGNRP

SEQ ID NO: 1478270 - protein, 26 aa, Mycobacterium tuberculosis
TDELDFLRLAVFDALLVLQADTAPVP

SEQ ID NO: 1478271 - protein, 22 aa, Mycobacterium tuberculosis
TDLLAFTAFPKQIWRQIWSNNP

SEQ ID NO: 1478272 - protein, 23 aa, Mycobacterium tuberculosis
TDPMQWRVLERAFSRHSALILIG

SEQ ID NO: 1478273 - protein, 21 aa, Mycobacterium tuberculosis
TDRFPLVAADPERTAELATRF

SEQ ID NO: 1478274 - protein, 17 aa, Mycobacterium tuberculosis
TDRRTRQSFALSARAVI

SEQ ID NO: 1478275 - protein, 28 aa, Mycobacterium tuberculosis
TDSAGSSRKAFGGDGGVGGDGASALGTG

SEQ ID NO: 1478276 - protein, 28 aa, Mycobacterium tuberculosis
TDTGSFRWASVRGYRLAARLVEIGVDNA

SEQ ID NO: 1478277 - protein, 19 aa, Mycobacterium tuberculosis
TDVAARWPVPGPRDDKYTQ

SEQ ID NO: 1478278 - protein, 24 aa, Mycobacterium tuberculosis
TEAITGLDLVEWQLRVGAGEKLGF

SEQ ID NO: 1478279 - protein, 19 aa, Mycobacterium tuberculosis
TEDMDLSAFVVFSSMAGIV

SEQ ID NO: 1478280 - protein, 22 aa, Mycobacterium tuberculosis
TEFELLAAAARDAFGLDVHPAV

SEQ ID NO: 1478281 - protein, 23 aa, Mycobacterium tuberculosis
TEFLPGSLIDRAEFEAENRRVVA

SEQ ID NO: 1478282 - protein, 24 aa, Mycobacterium tuberculosis
TEIDNLRAAFVWNRENSDTEGALA

SEQ ID NO: 1478283 - protein, 23 aa, Mycobacterium tuberculosis
TEIPSPAAGVLTKIIAQEDDTVE

SEQ ID NO: 1478284 - protein, 23 aa, Mycobacterium tuberculosis
TEITRLVPFIEWLRGAYPDQLIS

SEQ ID NO: 1478285 - protein, 25 aa, Mycobacterium tuberculosis
TELRELRSAGAVFGLLDVDDEFFVI

SEQ ID NO: 1478286 - protein, 17 aa, Mycobacterium tuberculosis
TELSGFYQVVVRPKTPR

SEQ ID NO: 1478287 - protein, 20 aa, Mycobacterium tuberculosis
TEPIEVWSFDVMSFVDHTAT

SEQ ID NO: 1478288 - protein, 21 aa, Mycobacterium tuberculosis
TEPRKIFDLLEHAPVDVAVLT

SEQ ID NO: 1478289 - protein, 21 aa, Mycobacterium tuberculosis
TERMCARIAAVMGYTDQSTVE

SEQ ID NO: 1478290 - protein, 32 aa, Mycobacterium tuberculosis
TESAMRVCGGAAFSKHLPIERAFRDARAGSVM

SEQ ID NO: 1478291 - protein, 19 aa, Mycobacterium tuberculosis
TESWMGPASMAMVTAAQPY

SEQ ID NO: 1478292 - protein, 25 aa, Mycobacterium tuberculosis
TEVRLRLLDTLDLFGIALGMAAFRP

SEQ ID NO: 1478293 - protein, 19 aa, Mycobacterium tuberculosis
TFETEFFARHGFTEIEGTP

SEQ ID NO: 1478294 - protein, 17 aa, Mycobacterium tuberculosis
TFGPRTALWLLLAKCGG

SEQ ID NO: 1478295 - protein, 18 aa, Mycobacterium tuberculosis
TFQRCKLNWAEAGSGEHA

SEQ ID NO: 1478296 - protein, 26 aa, Mycobacterium tuberculosis
TFTAWRSTPAPVRGALVARLGELLTA

SEQ ID NO: 1478297 - protein, 24 aa, Mycobacterium tuberculosis
TGAAGGAGGWLFGNGGNGGHGATN

SEQ ID NO: 1478298 - protein, 23 aa, Mycobacterium tuberculosis
TGEWQIAALRAYWELPAMMLQFL

SEQ ID NO: 1478299 - protein, 20 aa, Mycobacterium tuberculosis
TGFGEIFLDDVFVPDRDVIG

SEQ ID NO: 1478300 - protein, 26 aa, Mycobacterium tuberculosis
TGGAGGAGFSRALIVAGDNGGDGGNG

SEQ ID NO: 1478301 - protein, 27 aa, Mycobacterium tuberculosis
TGGAGGAGFSRALIVAGDNGGDGGNGG

SEQ ID NO: 1478302 - protein, 20 aa, Mycobacterium tuberculosis
TGGAGGLLFGAGEDGTTPGG

SEQ ID NO: 1478303 - protein, 27 aa, Mycobacterium tuberculosis
TGGIPVTVEVPVGGILAPLQPFQATAV

SEQ ID NO: 1478304 - protein, 27 aa, Mycobacterium tuberculosis
TGGLGGLGLVVARWLVDRGAGRVVLGG

SEQ ID NO: 1478305 - protein, 20 aa, Mycobacterium tuberculosis
TGGLLPIKIPLIDIPAAPGF

SEQ ID NO: 1478306 - protein, 28 aa, Mycobacterium tuberculosis
TGGNGGDAEPGVPPGAGGAGGAGTTGGK

SEQ ID NO: 1478307 - protein, 18 aa, Mycobacterium tuberculosis
TGGPPLPGQAGMGAAGGA

SEQ ID NO: 1478308 - protein, 20 aa, Mycobacterium tuberculosis
TGGPPLPGQAGMGAAGGAGG

SEQ ID NO: 1478309 - protein, 28 aa, Mycobacterium tuberculosis
TGGSGGFGAPPPRSIGGGDGGDGGRGGD

SEQ ID NO: 1478310 - protein, 17 aa, Mycobacterium tuberculosis
TGGTLQAAVSGLVTALF

SEQ ID NO: 1478311 - protein, 25 aa, Mycobacterium tuberculosis
TGHAAELFGWLGPHPDTMVSSAATI

SEQ ID NO: 1478312 - protein, 26 aa, Mycobacterium tuberculosis
TGHPRRAGVSSFGFGGTNAHVVIEQG

SEQ ID NO: 1478313 - protein, 19 aa, Mycobacterium tuberculosis
TGKELFAAQGLPPFEDDHI

SEQ ID NO: 1478314 - protein, 17 aa, Mycobacterium tuberculosis
TGLRPNAVVGVRLAALA

SEQ ID NO: 1478315 - protein, 18 aa, Mycobacterium tuberculosis
TGRRFPRVAPRLNRLMTN

SEQ ID NO: 1478316 - protein, 20 aa, Mycobacterium tuberculosis
TGSSNWGFGNNGIGNIGFGN

SEQ ID NO: 1478317 - protein, 19 aa, Mycobacterium tuberculosis
TGVAFAFGPGVTVEGMLFD

SEQ ID NO: 1478318 - protein, 23 aa, Mycobacterium tuberculosis
TGVFAGACLSEYGAMASADLSQV

SEQ ID NO: 1478319 - protein, 26 aa, Mycobacterium tuberculosis
TGVKRQEDFIGIHFFSPVDKMPLVEI

SEQ ID NO: 1478320 - protein, 22 aa, Mycobacterium tuberculosis
TGYVMPHWPRPWGRAAGAVEQL

SEQ ID NO: 1478321 - protein, 19 aa, Mycobacterium tuberculosis
THDAYCLRIAITETMSDLS

SEQ ID NO: 1478322 - protein, 22 aa, Mycobacterium tuberculosis
THEVWKAGQPVSLSPTEFTLLR

SEQ ID NO: 1478323 - protein, 22 aa, Mycobacterium tuberculosis
THGHTEWLPPPHLDHGQPRTNT

SEQ ID NO: 1478324 - protein, 17 aa, Mycobacterium tuberculosis
THHLVKTFWGWRDQQLP

SEQ ID NO: 1478325 - protein, 23 aa, Mycobacterium tuberculosis
THLHGDVLITSWVTNFAADPAPL

SEQ ID NO: 1478326 - protein, 20 aa, Mycobacterium tuberculosis
THVYAKLGLASRVQLVDEAA

SEQ ID NO: 1478327 - protein, 19 aa, Mycobacterium tuberculosis
TIATSLRGALGSAPASVSD

SEQ ID NO: 1478328 - protein, 18 aa, Mycobacterium tuberculosis
TILARATPGDGWASLASS

SEQ ID NO: 1478329 - protein, 27 aa, Mycobacterium tuberculosis
TIPAIPIGLELNGGVGPITVLPIQILP

SEQ ID NO: 1478330 - protein, 17 aa, Mycobacterium tuberculosis
TIPEALAAVATDLAGIG

SEQ ID NO: 1478331 - protein, 25 aa, Mycobacterium tuberculosis
TIVRYRVGELIPVYRSQRALLQRLL

SEQ ID NO: 1478332 - protein, 26 aa, Mycobacterium tuberculosis
TKGYKFSTYATWWIRQAITRAMADQA

SEQ ID NO: 1478333 - protein, 22 aa, Mycobacterium tuberculosis
TKIRLLTRIAFGFRSPQALIAL

SEQ ID NO: 1478334 - protein, 27 aa, Mycobacterium tuberculosis
TKPPKVVSQRGWRHWVHALTRINLGLS

SEQ ID NO: 1478335 - protein, 27 aa, Mycobacterium tuberculosis
TLAGFNASGTPFVWDGSMVVNYQDPSW

SEQ ID NO: 1478336 - protein, 20 aa, Mycobacterium tuberculosis
TLAGGLWLRTVDEVGECYPD

SEQ ID NO: 1478337 - protein, 19 aa, Mycobacterium tuberculosis
TLASLKWVLANRAYTPWYL

SEQ ID NO: 1478338 - protein, 19 aa, Mycobacterium tuberculosis
TLLGRLLVYDALEMSYRTI

SEQ ID NO: 1478339 - protein, 20 aa, Mycobacterium tuberculosis
TLLGRPLIGDGAHGTAPGQP

SEQ ID NO: 1478340 - protein, 19 aa, Mycobacterium tuberculosis
TLLGRPLIGNGADGAPGTG

SEQ ID NO: 1478341 - protein, 18 aa, Mycobacterium tuberculosis
TLLYKKSSVMFGIDLAKR

SEQ ID NO: 1478342 - protein, 19 aa, Mycobacterium tuberculosis
TLMLRARLSGSGSIVKPPG

SEQ ID NO: 1478343 - protein, 17 aa, Mycobacterium tuberculosis
TLQRFAENLVFTEAPKL

SEQ ID NO: 1478344 - protein, 19 aa, Mycobacterium tuberculosis
TLTCVLPAYLNALAGNGVH

SEQ ID NO: 1478345 - protein, 20 aa, Mycobacterium tuberculosis
TLTEAFLWEEHRRVTKTATV

SEQ ID NO: 1478346 - protein, 19 aa, Mycobacterium tuberculosis
TLTGRPLIGNGANGTPGTG

SEQ ID NO: 1478347 - protein, 24 aa, Mycobacterium tuberculosis
TMALLGRPLIGHGADGAPGTGQAG

SEQ ID NO: 1478348 - protein, 20 aa, Mycobacterium tuberculosis
TMVELLPRFETITYRELWAR

SEQ ID NO: 1478349 - protein, 21 aa, Mycobacterium tuberculosis
TNLNPVWKVGFQVTEALRANT

SEQ ID NO: 1478350 - protein, 27 aa, Mycobacterium tuberculosis
TNPQIDLTIRWDTPPITLFPNGISAPD

SEQ ID NO: 1478351 - protein, 20 aa, Mycobacterium tuberculosis
TNVVTAWRLLRSVDPHLRTR

SEQ ID NO: 1478352 - protein, 24 aa, Mycobacterium tuberculosis
TPEFAIPPIGVGGFTLPQITTQEI

SEQ ID NO: 1478353 - protein, 27 aa, Mycobacterium tuberculosis
TPGGAGGDGGLLFGSGGNGAPGAPGQA

SEQ ID NO: 1478354 - protein, 17 aa, Mycobacterium tuberculosis
TPGSGPKRSVLFNSGAE

SEQ ID NO: 1478355 - protein, 18 aa, Mycobacterium tuberculosis
TPLFEFAIRAAIAEMDLD

SEQ ID NO: 1478356 - protein, 19 aa, Mycobacterium tuberculosis
TPLVGRLLMYEALDATYHQ

SEQ ID NO: 1478357 - protein, 20 aa, Mycobacterium tuberculosis
TPNPCVRCNQQIKFAALSAR

SEQ ID NO: 1478358 - protein, 23 aa, Mycobacterium tuberculosis
TPRPRWRSAQALTSRSCNGSLDT

SEQ ID NO: 1478359 - protein, 20 aa, Mycobacterium tuberculosis
TPTLYRPAGGLSNDAVRQAA

SEQ ID NO: 1478360 - protein, 22 aa, Mycobacterium tuberculosis
TPVVSKLPWFALRDPYVTGQVT

SEQ ID NO: 1478361 - protein, 18 aa, Mycobacterium tuberculosis
TPWWEDRFQQEPKQPPAP

SEQ ID NO: 1478362 - protein, 19 aa, Mycobacterium tuberculosis
TQIPANLLGQMALGSMTGG

SEQ ID NO: 1478363 - protein, 22 aa, Mycobacterium tuberculosis
TQLLLGRPLIGDGANGGPGQNG

SEQ ID NO: 1478364 - protein, 18 aa, Mycobacterium tuberculosis
TQQLLGWYSRVVTNLDEY

SEQ ID NO: 1478365 - protein, 20 aa, Mycobacterium tuberculosis
TQSYVRACHLVGYQHPDLTA

SEQ ID NO: 1478366 - protein, 24 aa, Mycobacterium tuberculosis
TQTLLGRPLIGNGADGVAGTGSNA

SEQ ID NO: 1478367 - protein, 22 aa, Mycobacterium tuberculosis
TRELARPYLAPGNRGTHLEQRS

SEQ ID NO: 1478368 - protein, 18 aa, Mycobacterium tuberculosis
TRGVEPCGDGWLAFSALV

SEQ ID NO: 1478369 - protein, 24 aa, Mycobacterium tuberculosis
TRNYRELYGLLAVNSIWFNHESPR

SEQ ID NO: 1478370 - protein, 20 aa, Mycobacterium tuberculosis
TRPTNIGGLGFSMKWNMGWM

SEQ ID NO: 1478371 - protein, 22 aa, Mycobacterium tuberculosis
TRSEGGGMLVLKRVDDARRDGD

SEQ ID NO: 1478372 - protein, 24 aa, Mycobacterium tuberculosis
TRVRTRLIELFELFDPADPEVVAG

SEQ ID NO: 1478373 - protein, 17 aa, Mycobacterium tuberculosis
TSAFTHWTARVLPAGSE

SEQ ID NO: 1478374 - protein, 27 aa, Mycobacterium tuberculosis
TSCDAFEHFPPPILKPVILAAKSATLF

SEQ ID NO: 1478375 - protein, 23 aa, Mycobacterium tuberculosis
TSGAADPRCKILIVMGRTNPDAA

SEQ ID NO: 1478376 - protein, 22 aa, Mycobacterium tuberculosis
TSGKLKRRAVAQAYRDGTLPRL

SEQ ID NO: 1478377 - protein, 18 aa, Mycobacterium tuberculosis
TSHHCCLGAAEGARPGWV

SEQ ID NO: 1478378 - protein, 17 aa, Mycobacterium tuberculosis
TSHLELRSPDGAVLPGY

SEQ ID NO: 1478379 - protein, 17 aa, Mycobacterium tuberculosis
TSICARLYGKRAAGNRA

SEQ ID NO: 1478380 - protein, 21 aa, Mycobacterium tuberculosis
TSLGQWSWRTETEVDLDYHVR

SEQ ID NO: 1478381 - protein, 17 aa, Mycobacterium tuberculosis
TSLMRSTVCCWLNASSV

SEQ ID NO: 1478382 - protein, 23 aa, Mycobacterium tuberculosis
TSLPVEYYPAGRLNFVDTAADPT

SEQ ID NO: 1478383 - protein, 18 aa, Mycobacterium tuberculosis
TSMCARLYGKRAAENRTK

SEQ ID NO: 1478384 - protein, 24 aa, Mycobacterium tuberculosis
TSPLRPWPGFVPMVYERYSQPFFG

SEQ ID NO: 1478385 - protein, 23 aa, Mycobacterium tuberculosis
TSRRSATRPACWRRPKTRCRRPS

SEQ ID NO: 1478386 - protein, 33 aa, Mycobacterium tuberculosis
TSTSGPTSEIWVKPSFFPGIRIAPSSGGGATST

SEQ ID NO: 1478387 - protein, 24 aa, Mycobacterium tuberculosis
TSTSSIPFDAHGGNGGAGGDAGHG

SEQ ID NO: 1478388 - protein, 18 aa, Mycobacterium tuberculosis
TTALFGHSYGSLLSGIAL

SEQ ID NO: 1478389 - protein, 27 aa, Mycobacterium tuberculosis
TTALFGHSYGSLLSGIALKDGASSLVD

SEQ ID NO: 1478390 - protein, 20 aa, Mycobacterium tuberculosis
TTAVGMPTFAGRAIAASLGL

SEQ ID NO: 1478391 - protein, 27 aa, Mycobacterium tuberculosis
TTCATTWRTHWMIWCSAGTITPLSTRS

SEQ ID NO: 1478392 - protein, 20 aa, Mycobacterium tuberculosis
TTGVPVQWSAVFAGSGGRRV

SEQ ID NO: 1478393 - protein, 19 aa, Mycobacterium tuberculosis
TTIGAFAIPGGPGYFNSST

SEQ ID NO: 1478394 - protein, 17 aa, Mycobacterium tuberculosis
TTPELLACLQRLEVERR

SEQ ID NO: 1478395 - protein, 30 aa, Mycobacterium tuberculosis
TTPGGNGGDGGWLFGSGGNGAPGAAGQSGG

SEQ ID NO: 1478396 - protein, 22 aa, Mycobacterium tuberculosis
TTYRQETIRIFGLPESSLADTL

SEQ ID NO: 1478397 - protein, 23 aa, Mycobacterium tuberculosis
TVDEGAVCTAMLDLYQNEGIIAE

SEQ ID NO: 1478398 - protein, 22 aa, Mycobacterium tuberculosis
TVELRRPGGPGVIMGRNVVRKD

SEQ ID NO: 1478399 - protein, 19 aa, Mycobacterium tuberculosis
TVILARLVARAMLQLPAQR

SEQ ID NO: 1478400 - protein, 17 aa, Mycobacterium tuberculosis
TVLEFSNTVTRVHEDPR

SEQ ID NO: 1478401 - protein, 18 aa, Mycobacterium tuberculosis
TVLGRGGVGLSLGQRQRL

SEQ ID NO: 1478402 - protein, 17 aa, Mycobacterium tuberculosis
TVLHIFPTLAANINQLY

SEQ ID NO: 1478403 - protein, 26 aa, Mycobacterium tuberculosis
TVNAVKLRLGIGYVIQDAGLMPHQRV

SEQ ID NO: 1478404 - protein, 23 aa, Mycobacterium tuberculosis
TVPDNMGMLFRKHLVMFGPREVL

SEQ ID NO: 1478405 - protein, 23 aa, Mycobacterium tuberculosis
TVPGDAWERLGAALVNAYPTLTQ

SEQ ID NO: 1478406 - protein, 26 aa, Mycobacterium tuberculosis
TVRSYNCLKREGVHTVGELVARTESD

SEQ ID NO: 1478407 - protein, 17 aa, Mycobacterium tuberculosis
TVSARVAVEAGVAQCWH

SEQ ID NO: 1478408 - protein, 34 aa, Mycobacterium tuberculosis
TVTLCKRLAAVTGLRLPETVGWDYGSISGLAQYL

SEQ ID NO: 1478409 - protein, 21 aa, Mycobacterium tuberculosis
TVVSPGDLWDLLRDGREATGS

SEQ ID NO: 1478410 - protein, 22 aa, Mycobacterium tuberculosis
TWPAHLRPALTTAGFATELRNL

SEQ ID NO: 1478411 - protein, 20 aa, Mycobacterium tuberculosis
TYAFQHQKFWLAPAPSVSDP

SEQ ID NO: 1478412 - protein, 26 aa, Mycobacterium tuberculosis
VAAALARTTRWGSFLPDIDAFDAEFF

SEQ ID NO: 1478413 - protein, 18 aa, Mycobacterium tuberculosis
VAAAVFGAMEAWMLGSDR

SEQ ID NO: 1478414 - protein, 20 aa, Mycobacterium tuberculosis
VAAGNGWRVSGLLRIDEVAS

SEQ ID NO: 1478415 - protein, 22 aa, Mycobacterium tuberculosis
VAAHTPYLAWLVQASANSAAMA

SEQ ID NO: 1478416 - protein, 17 aa, Mycobacterium tuberculosis
VAANRNAFVQLVLSNLF

SEQ ID NO: 1478417 - protein, 25 aa, Mycobacterium tuberculosis
VAANRSDLVSLVFSNFFGQNAPAIA

SEQ ID NO: 1478418 - protein, 17 aa, Mycobacterium tuberculosis
VAAPEIPSPAAALQATR

SEQ ID NO: 1478419 - protein, 19 aa, Mycobacterium tuberculosis
VAAPGRAMTSAGLIDIAPH

SEQ ID NO: 1478420 - protein, 17 aa, Mycobacterium tuberculosis
VAATVFTRPEIAAVGVP

SEQ ID NO: 1478421 - protein, 18 aa, Mycobacterium tuberculosis
VAAVPLMLEHSGGGVINI

SEQ ID NO: 1478422 - protein, 20 aa, Mycobacterium tuberculosis
VAAYQERFVLALSQASSTYA

SEQ ID NO: 1478423 - protein, 25 aa, Mycobacterium tuberculosis
VAAYQQRFVLALSQASSTYAVAEAA

SEQ ID NO: 1478424 - protein, 20 aa, Mycobacterium tuberculosis
VADAGWKYLSTGAYAGSLDD

SEQ ID NO: 1478425 - protein, 17 aa, Mycobacterium tuberculosis
VADTYFALMDRLGTDGL

SEQ ID NO: 1478426 - protein, 17 aa, Mycobacterium tuberculosis
VAEGPVYVRKQIVHNTV

SEQ ID NO: 1478427 - protein, 17 aa, Mycobacterium tuberculosis
VAEIHLWLDQHGARQEK

SEQ ID NO: 1478428 - protein, 23 aa, Mycobacterium tuberculosis
VAEPGALIGFLGPRVYELLYGDP

SEQ ID NO: 1478429 - protein, 22 aa, Mycobacterium tuberculosis
VAGCGVCPGCETHDPVMCFSGP

SEQ ID NO: 1478430 - protein, 20 aa, Mycobacterium tuberculosis
VAGCSFPIERLRQVAEHADA

SEQ ID NO: 1478431 - protein, 22 aa, Mycobacterium tuberculosis
VAGVPADMGGSFIGPTQDAVLA

SEQ ID NO: 1478432 - protein, 26 aa, Mycobacterium tuberculosis
VAHQLEFEFLPAVNRFLDEHVGAGRG

SEQ ID NO: 1478433 - protein, 17 aa, Mycobacterium tuberculosis
VAHRGMTVLPLAKSASG

SEQ ID NO: 1478434 - protein, 19 aa, Mycobacterium tuberculosis
VAIAAAFGAHGQAYQALSA

SEQ ID NO: 1478435 - protein, 32 aa, Mycobacterium tuberculosis
VAIPKLRQGSYFPDWLLQRRKRAERALTSVVA

SEQ ID NO: 1478436 - protein, 24 aa, Mycobacterium tuberculosis
VALGELFAYRWSRCGGREEWVMDT

SEQ ID NO: 1478437 - protein, 17 aa, Mycobacterium tuberculosis
VALRAFRRGAAALAAMI

SEQ ID NO: 1478438 - protein, 17 aa, Mycobacterium tuberculosis
VALSVPVSGTWVDIRFT

SEQ ID NO: 1478439 - protein, 24 aa, Mycobacterium tuberculosis
VANCGWPWPWLILRLVMSMCSRTG

SEQ ID NO: 1478440 - protein, 17 aa, Mycobacterium tuberculosis
VANLASIGNTWLADPAP

SEQ ID NO: 1478441 - protein, 24 aa, Mycobacterium tuberculosis
VANLASIGNTWLADPAPFLQQYLA

SEQ ID NO: 1478442 - protein, 17 aa, Mycobacterium tuberculosis
VAPNVGVSQRFFTSQCN

SEQ ID NO: 1478443 - protein, 19 aa, Mycobacterium tuberculosis
VARAYLDSRVQTIYGGTTE

SEQ ID NO: 1478444 - protein, 22 aa, Mycobacterium tuberculosis
VARHLVSRYGVRQVVLASRAGE

SEQ ID NO: 1478445 - protein, 18 aa, Mycobacterium tuberculosis
VARPDLLALGALLHDIGK

SEQ ID NO: 1478446 - protein, 23 aa, Mycobacterium tuberculosis
VASARWPAARFAVRNVAVQGPNA

SEQ ID NO: 1478447 - protein, 28 aa, Mycobacterium tuberculosis
VASVSWPNPNDWWLVRLLGSITPTERTT

SEQ ID NO: 1478448 - protein, 21 aa, Mycobacterium tuberculosis
VASYLKDDWFRDWGALQRLTP

SEQ ID NO: 1478449 - protein, 18 aa, Mycobacterium tuberculosis
VAVCRGVRAVARARLVER

SEQ ID NO: 1478450 - protein, 20 aa, Mycobacterium tuberculosis
VAVGAPGQPGGAGGHGGAGG

SEQ ID NO: 1478451 - protein, 26 aa, Mycobacterium tuberculosis
VAVGSELKAADSLAEYVLELARKLIK

SEQ ID NO: 1478452 - protein, 20 aa, Mycobacterium tuberculosis
VCAIRAWAYQIADLAGDYRV

SEQ ID NO: 1478453 - protein, 17 aa, Mycobacterium tuberculosis
VCGELGLPYLVLARPPW

SEQ ID NO: 1478454 - protein, 21 aa, Mycobacterium tuberculosis
VCTNTLCAVMGGDAIFDRLKE

SEQ ID NO: 1478455 - protein, 18 aa, Mycobacterium tuberculosis
VDAFPRGAGRMLAIMHAL

SEQ ID NO: 1478456 - protein, 25 aa, Mycobacterium tuberculosis
VDDRWRLAQILTFQAVDAVVAGDPV

SEQ ID NO: 1478457 - protein, 17 aa, Mycobacterium tuberculosis
VDFFVRMASGELDPDKL

SEQ ID NO: 1478458 - protein, 19 aa, Mycobacterium tuberculosis
VDGDCRGAQGVDVANHVDR

SEQ ID NO: 1478459 - protein, 17 aa, Mycobacterium tuberculosis
VDGDPVFRIGSTTKTFT

SEQ ID NO: 1478460 - protein, 20 aa, Mycobacterium tuberculosis
VDGRLICLVRAESDEDARRR

SEQ ID NO: 1478461 - protein, 19 aa, Mycobacterium tuberculosis
VDKPLWRWIKMGQTAPTSP

SEQ ID NO: 1478462 - protein, 25 aa, Mycobacterium tuberculosis
VDLSRLAEDIIVWSSTEFGYVTLHD

SEQ ID NO: 1478463 - protein, 19 aa, Mycobacterium tuberculosis
VDMAIKLGLRSYANPGTAR

SEQ ID NO: 1478464 - protein, 23 aa, Mycobacterium tuberculosis
VDRAILRVSVWELLHAADVPEPV

SEQ ID NO: 1478465 - protein, 21 aa, Mycobacterium tuberculosis
VDTEIPPPVAGVLVSISADED

SEQ ID NO: 1478466 - protein, 19 aa, Mycobacterium tuberculosis
VDTGAFISGSYSNGFLWSG

SEQ ID NO: 1478467 - protein, 19 aa, Mycobacterium tuberculosis
VDVVLRRVDAHYADPLDLR

SEQ ID NO: 1478468 - protein, 24 aa, Mycobacterium tuberculosis
VDVVLRSKVDAAWHLHELTRDLDV

SEQ ID NO: 1478469 - protein, 17 aa, Mycobacterium tuberculosis
VEEIVRAGGHFEVVSPH

SEQ ID NO: 1478470 - protein, 23 aa, Mycobacterium tuberculosis
VEELLGVVASDGWQGQAAEAFVA

SEQ ID NO: 1478471 - protein, 19 aa, Mycobacterium tuberculosis
VELFTAEAIWEMPPYTDWY

SEQ ID NO: 1478472 - protein, 17 aa, Mycobacterium tuberculosis
VELPLSVTIGPFVSPEI

SEQ ID NO: 1478473 - protein, 21 aa, Mycobacterium tuberculosis
VELRNRLKTATGLTLPPTLIF

SEQ ID NO: 1478474 - protein, 21 aa, Mycobacterium tuberculosis
VELRNRLKTATGLTLPPTVIF

SEQ ID NO: 1478475 - protein, 23 aa, Mycobacterium tuberculosis
VEMRNRLKSATGLALSPTLIFDY

SEQ ID NO: 1478476 - protein, 17 aa, Mycobacterium tuberculosis
VEQMLPLDGHTPLTTQL

SEQ ID NO: 1478477 - protein, 20 aa, Mycobacterium tuberculosis
VESMRVVARYGQPGQTERAR

SEQ ID NO: 1478478 - protein, 26 aa, Mycobacterium tuberculosis
VEVHSAPGWRAGSSPLGYAQLYLPTR

SEQ ID NO: 1478479 - protein, 17 aa, Mycobacterium tuberculosis
VEVPELEVPAMGVLPTV

SEQ ID NO: 1478480 - protein, 21 aa, Mycobacterium tuberculosis
VEYVDVRFCDLPGIMQHFTIP

SEQ ID NO: 1478481 - protein, 17 aa, Mycobacterium tuberculosis
VFDAFPLTHYVECVALL

SEQ ID NO: 1478482 - protein, 23 aa, Mycobacterium tuberculosis
VFGDGWIGAQACMWVNKFHEEST

SEQ ID NO: 1478483 - protein, 18 aa, Mycobacterium tuberculosis
VFGRRNRYVAHWDDTGQA

SEQ ID NO: 1478484 - protein, 24 aa, Mycobacterium tuberculosis
VFIPAFLRYDLRPVTGEWQIAALR

SEQ ID NO: 1478485 - protein, 21 aa, Mycobacterium tuberculosis
VFRPLLNLALRRFLRNLRRYT

SEQ ID NO: 1478486 - protein, 29 aa, Mycobacterium tuberculosis
VGAADPVFLDWLVGLAFPCQRPFGHQYGV

SEQ ID NO: 1478487 - protein, 17 aa, Mycobacterium tuberculosis
VGAYELAELLSPSLFAE

SEQ ID NO: 1478488 - protein, 18 aa, Mycobacterium tuberculosis
VGDLGVTLLRTIKATLDP

SEQ ID NO: 1478489 - protein, 17 aa, Mycobacterium tuberculosis
VGEICRRLDGIPLAIEF

SEQ ID NO: 1478490 - protein, 30 aa, Mycobacterium tuberculosis
VGEISRGVLFPKHRTDLLGCAVSVQRMLAG

SEQ ID NO: 1478491 - protein, 18 aa, Mycobacterium tuberculosis
VGFAIFRIEVNLPVDGRW

SEQ ID NO: 1478492 - protein, 17 aa, Mycobacterium tuberculosis
VGGAGGKGGDGGVGGVG

SEQ ID NO: 1478493 - protein, 20 aa, Mycobacterium tuberculosis
VGGAGGKGGQGHNTGVGDAF

SEQ ID NO: 1478494 - protein, 24 aa, Mycobacterium tuberculosis
VGGESSRPGATRVDPAVETSRVIP

SEQ ID NO: 1478495 - protein, 26 aa, Mycobacterium tuberculosis
VGGPGGGHGLLGLGGSHGAGGAGGSG

SEQ ID NO: 1478496 - protein, 22 aa, Mycobacterium tuberculosis
VGGPPLVFQLLWYPTTMADLSL

SEQ ID NO: 1478497 - protein, 25 aa, Mycobacterium tuberculosis
VGHIWRRIRAANLPIALSDRLTLDT

SEQ ID NO: 1478498 - protein, 20 aa, Mycobacterium tuberculosis
VGPAEKIYDPGIILDKDRGL

SEQ ID NO: 1478499 - protein, 26 aa, Mycobacterium tuberculosis
VGQAEILWDVIPFDWINDSNTAATRH

SEQ ID NO: 1478500 - protein, 23 aa, Mycobacterium tuberculosis
VGQPGGDGGILWGNGGNGGDSTS

SEQ ID NO: 1478501 - protein, 19 aa, Mycobacterium tuberculosis
VGRRRGFAMPWVSTARSGA

SEQ ID NO: 1478502 - protein, 17 aa, Mycobacterium tuberculosis
VGSHGVGGVGGDGGLGG

SEQ ID NO: 1478503 - protein, 25 aa, Mycobacterium tuberculosis
VGSRGGDGGVGGWLYGDGGGGGDGG

SEQ ID NO: 1478504 - protein, 25 aa, Mycobacterium tuberculosis
VGSTVCSAGKYARKHVPWVNFSNVP

SEQ ID NO: 1478505 - protein, 21 aa, Mycobacterium tuberculosis
VGTNPWRGPPIPYGTEVTDGR

SEQ ID NO: 1478506 - protein, 17 aa, Mycobacterium tuberculosis
VGVAGRVIFARNSGKLC

SEQ ID NO: 1478507 - protein, 19 aa, Mycobacterium tuberculosis
VHELVRRWSGHMVTSQGDG

SEQ ID NO: 1478508 - protein, 20 aa, Mycobacterium tuberculosis
VHRLRALIVELERLYNHAAD

SEQ ID NO: 1478509 - protein, 17 aa, Mycobacterium tuberculosis
VHSALLSSGPGPGSVLS

SEQ ID NO: 1478510 - protein, 18 aa, Mycobacterium tuberculosis
VIAANRSRLVSLALSNLF

SEQ ID NO: 1478511 - protein, 23 aa, Mycobacterium tuberculosis
VIACGDCALNRGVFADAYGVVGA

SEQ ID NO: 1478512 - protein, 23 aa, Mycobacterium tuberculosis
VIANGSFAPSFVGFGGNGGNGVN

SEQ ID NO: 1478513 - protein, 30 aa, Mycobacterium tuberculosis
VIATPEMMATAAFDLARIGSQVSAASAVAA

SEQ ID NO: 1478514 - protein, 25 aa, Mycobacterium tuberculosis
VIDGEIKQRYELFKSVGARDANDYE

SEQ ID NO: 1478515 - protein, 22 aa, Mycobacterium tuberculosis
VIDLLLKRAASLGIQIRYETGA

SEQ ID NO: 1478516 - protein, 18 aa, Mycobacterium tuberculosis
VIDRGQWKDHRDGARGRG

SEQ ID NO: 1478517 - protein, 20 aa, Mycobacterium tuberculosis
VIERGIPLTMEMAKFIRFIV

SEQ ID NO: 1478518 - protein, 17 aa, Mycobacterium tuberculosis
VIIAGYRADLDKFLDTN

SEQ ID NO: 1478519 - protein, 17 aa, Mycobacterium tuberculosis
VIRGRPALREYADAHAR

SEQ ID NO: 1478520 - protein, 17 aa, Mycobacterium tuberculosis
VKAVWRSGTQVPLQASA

SEQ ID NO: 1478521 - protein, 21 aa, Mycobacterium tuberculosis
VKTVPTTVWIASDGSSHLVQI

SEQ ID NO: 1478522 - protein, 20 aa, Mycobacterium tuberculosis
VKVRSGYEAALAAALGPAAD

SEQ ID NO: 1478523 - protein, 25 aa, Mycobacterium tuberculosis
VLAAARRLRIIPGIASRTRTGGSAT

SEQ ID NO: 1478524 - protein, 65 aa, Mycobacterium tuberculosis; identical to SEQ ID NO: 207905

SEQ ID NO: 1478525 - protein, 19 aa, Mycobacterium tuberculosis
VLARELLPERALMGDASAI

SEQ ID NO: 1478526 - protein, 19 aa, Mycobacterium tuberculosis
VLARREFAGMISVAIDSAD

SEQ ID NO: 1478527 - protein, 17 aa, Mycobacterium tuberculosis
VLAVFSIPGRFEAATGF

SEQ ID NO: 1478528 - protein, 18 aa, Mycobacterium tuberculosis
VLERGLLLRLRFELDHHI

SEQ ID NO: 1478529 - protein, 25 aa, Mycobacterium tuberculosis
VLERLRPGDFYRPAHQNVYDAILDL

SEQ ID NO: 1478530 - protein, 26 aa, Mycobacterium tuberculosis
VLERLRPGDFYRPAHQNVYDAILDLY

SEQ ID NO: 1478531 - protein, 18 aa, Mycobacterium tuberculosis
VLFGRANVVFTRLVVPTS

SEQ ID NO: 1478532 - protein, 26 aa, Mycobacterium tuberculosis
VLFVRDGRLHYVYNFLGERQQLVSSS

SEQ ID NO: 1478533 - protein, 25 aa, Mycobacterium tuberculosis
VLGPSGKRPGAIAERVKKTWELGEG

SEQ ID NO: 1478534 - protein, 25 aa, Mycobacterium tuberculosis
VLGPSGVWELFWPDFPCDGLYKFRV

SEQ ID NO: 1478535 - protein, 25 aa, Mycobacterium tuberculosis
VLQIRALVLGGALDWLKDNKASTNH

SEQ ID NO: 1478536 - protein, 19 aa, Mycobacterium tuberculosis
VLRACGFDTPYPPARLEKL

SEQ ID NO: 1478537 - protein, 24 aa, Mycobacterium tuberculosis
VLRALRLETEWPARQLVDDRWVWL

SEQ ID NO: 1478538 - protein, 25 aa, Mycobacterium tuberculosis
VLSEFPADRGWDLAGLFDPDPDAAG

SEQ ID NO: 1478539 - protein, 19 aa, Mycobacterium tuberculosis
VLTGRISVVAAPWLADHAV

SEQ ID NO: 1478540 - protein, 17 aa, Mycobacterium tuberculosis
VLTRARAALTSTEEPAK

SEQ ID NO: 1478541 - protein, 17 aa, Mycobacterium tuberculosis
VLYDFVNNEALPGTDID

SEQ ID NO: 1478542 - protein, 17 aa, Mycobacterium tuberculosis
VMENRWLPMKRTALALH

SEQ ID NO: 1478543 - protein, 18 aa, Mycobacterium tuberculosis
VMLVLELSAGRWLSSNDW

SEQ ID NO: 1478544 - protein, 17 aa, Mycobacterium tuberculosis
VMNKDRLEMLGAQNDPR

SEQ ID NO: 1478545 - protein, 23 aa, Mycobacterium tuberculosis
VNDYYDRSGLWPYLEKLGFYLVG

SEQ ID NO: 1478546 - protein, 27 aa, Mycobacterium tuberculosis
VNGPTQLLLGRPLIGDGANGGPGQNGG

SEQ ID NO: 1478547 - protein, 36 aa, Mycobacterium tuberculosis
VNGSWNWSSGCDHASWTFVGGPVIKDGRPVDFGSFL

SEQ ID NO: 1478548 - protein, 17 aa, Mycobacterium tuberculosis
VNTGAFITGNFNNGFLW

SEQ ID NO: 1478549 - protein, 21 aa, Mycobacterium tuberculosis
VPALDAVLFLNPRNSIVDVVQ

SEQ ID NO: 1478550 - protein, 18 aa, Mycobacterium tuberculosis
VPALTCLLRSITLRMTMA

SEQ ID NO: 1478551 - protein, 22 aa, Mycobacterium tuberculosis
VPDIPIPAIHIDFDGAADAGFT

SEQ ID NO: 1478552 - protein, 19 aa, Mycobacterium tuberculosis
VPEISRKAFGQSLDTHGYP

SEQ ID NO: 1478553 - protein, 18 aa, Mycobacterium tuberculosis
VPFSPRMSAPPISGRTAH

SEQ ID NO: 1478554 - protein, 17 aa, Mycobacterium tuberculosis
VPGFGLVMFGAIREAST

SEQ ID NO: 1478555 - protein, 19 aa, Mycobacterium tuberculosis
VPGHVLIHRLAEHCDTAEL

SEQ ID NO: 1478556 - protein, 25 aa, Mycobacterium tuberculosis
VPIKLRESPGLMILGRQGCGKTTAL

SEQ ID NO: 1478557 - protein, 22 aa, Mycobacterium tuberculosis
VPPEVPSAWLSTGMGPGPLLAA

SEQ ID NO: 1478558 - protein, 23 aa, Mycobacterium tuberculosis
VPPEVPSAWLSTGMGPGPLLAAA

SEQ ID NO: 1478559 - protein, 26 aa, Mycobacterium tuberculosis
VPRAELLRPGLLVLPVRGPARFFGSE

SEQ ID NO: 1478560 - protein, 24 aa, Mycobacterium tuberculosis
VPVNPSGGLACFGEAIPAQAIAQV

SEQ ID NO: 1478561 - protein, 25 aa, Mycobacterium tuberculosis
VPWEPICAPDLLLAQALLRTQHIKL

SEQ ID NO: 1478562 - protein, 26 aa, Mycobacterium tuberculosis
VPWEPICAPDLLLAQALLRTQHIKLA

SEQ ID NO: 1478563 - protein, 26 aa, Mycobacterium tuberculosis
VQAIKEAGWWRLGLAEEIGGMPAPPP

SEQ ID NO: 1478564 - protein, 34 aa, Mycobacterium tuberculosis
VQATGARWLCETFPTCLERGAGIPAVERLAYFAE

SEQ ID NO: 1478565 - protein, 19 aa, Mycobacterium tuberculosis
VQDHVASVFRHEDLASALA

SEQ ID NO: 1478566 - protein, 18 aa, Mycobacterium tuberculosis
VQEDFAYHQFLIKKSKMP

SEQ ID NO: 1478567 - protein, 18 aa, Mycobacterium tuberculosis
VQGVGGFGGQGGNGGQSG

SEQ ID NO: 1478568 - protein, 17 aa, Mycobacterium tuberculosis
VQRDGTCVLVIAPAPAL

SEQ ID NO: 1478569 - protein, 22 aa, Mycobacterium tuberculosis
VRANRLPKVSWLVPNILQSEHP

SEQ ID NO: 1478570 - protein, 20 aa, Mycobacterium tuberculosis
VRARWERRLAEVGVDRLHAE

SEQ ID NO: 1478571 - protein, 18 aa, Mycobacterium tuberculosis
VRATLVLDGDTLRVETNS

SEQ ID NO: 1478572 - protein, 18 aa, Mycobacterium tuberculosis
VREFACQRWQWHDLEVSR

SEQ ID NO: 1478573 - protein, 20 aa, Mycobacterium tuberculosis
VREIFEFATVTALAGHIDTL

SEQ ID NO: 1478574 - protein, 20 aa, Mycobacterium tuberculosis
VRLGGPRLKDVAGLSLTKLF

SEQ ID NO: 1478575 - protein, 27 aa, Mycobacterium tuberculosis
VRLLRACYHCRTCGRGMAPPGSGTWPP

SEQ ID NO: 1478576 - protein, 17 aa, Mycobacterium tuberculosis
VRTAFYYVRSGITVVPD

SEQ ID NO: 1478577 - protein, 20 aa, Mycobacterium tuberculosis
VRTLTVDAGAYASAEAANAG

SEQ ID NO: 1478578 - protein, 23 aa, Mycobacterium tuberculosis
VRTMCSRPAIRQGSLENAADQLA

SEQ ID NO: 1478579 - protein, 20 aa, Mycobacterium tuberculosis
VRTRLIELFELFDPADPEVV

SEQ ID NO: 1478580 - protein, 24 aa, Mycobacterium tuberculosis
VRTRWSRCWVRVWGSLRSTRPESV

SEQ ID NO: 1478581 - protein, 25 aa, Mycobacterium tuberculosis
VRVGGACLRCHRHARRAPSTLQGAR

SEQ ID NO: 1478582 - protein, 26 aa, Mycobacterium tuberculosis
VRYALRRLGALRVWPARARANTEIDD

SEQ ID NO: 1478583 - protein, 17 aa, Mycobacterium tuberculosis
VRYRAFDLFEPGPDRIA

SEQ ID NO: 1478584 - protein, 19 aa, Mycobacterium tuberculosis
VSAAIAALFSGHAQAYQAL

SEQ ID NO: 1478585 - protein, 20 aa, Mycobacterium tuberculosis
VSAAMAALFGAHAQEYQRLS

SEQ ID NO: 1478586 - protein, 20 aa, Mycobacterium tuberculosis
VSAAVAALFGSYAQSYQAFG

SEQ ID NO: 1478587 - protein, 22 aa, Mycobacterium tuberculosis
VSALTAAHFAAHAAMYQSVSAR

SEQ ID NO: 1478588 - protein, 17 aa, Mycobacterium tuberculosis
VSARSDANIAVMTRDLN

SEQ ID NO: 1478589 - protein, 21 aa, Mycobacterium tuberculosis
VSERLLTLGWQQRALPEVGDG

SEQ ID NO: 1478590 - protein, 20 aa, Mycobacterium tuberculosis
VSIGAILAVPGIRAALREAT

SEQ ID NO: 1478591 - protein, 50 aa, Mycobacterium tuberculosis
VSILYRLYRPLIFALYCLPLNWLRRKHGLSSLGWDLCRIFTDGDYTLYAD

SEQ ID NO: 1478592 - protein, 28 aa, Mycobacterium tuberculosis
VSNAVRFAFWGAEEFGLIGSRNYVESLD

SEQ ID NO: 1478593 - protein, 20 aa, Mycobacterium tuberculosis
VSSFGFGGANAHVVVREVLP

SEQ ID NO: 1478594 - protein, 23 aa, Mycobacterium tuberculosis
VSTAAADAARIGSAINTANTAAA

SEQ ID NO: 1478595 - protein, 19 aa, Mycobacterium tuberculosis
VSTAIAALFGSHGQHYQAI

SEQ ID NO: 1478596 - protein, 20 aa, Mycobacterium tuberculosis
VSTAVAALFGAHGQAYQALS

SEQ ID NO: 1478597 - protein, 22 aa, Mycobacterium tuberculosis
VSVELADGLGLPVLSVASMVAR

SEQ ID NO: 1478598 - protein, 17 aa, Mycobacterium tuberculosis
VSVGALFRHFETMGDFM

SEQ ID NO: 1478599 - protein, 23 aa, Mycobacterium tuberculosis
VTADICSRIVSLPVHDHMAPDDV

SEQ ID NO: 1478600 - protein, 19 aa, Mycobacterium tuberculosis
VTALQLVWADRRGRWPWAA

SEQ ID NO: 1478601 - protein, 19 aa, Mycobacterium tuberculosis
VTARLWPTLIEPLRTREQA

SEQ ID NO: 1478602 - protein, 17 aa, Mycobacterium tuberculosis
VTDGKMFIIGRIKDLLI

SEQ ID NO: 1478603 - protein, 18 aa, Mycobacterium tuberculosis
VTDSITWRRFCRIPLEGS

SEQ ID NO: 1478604 - protein, 20 aa, Mycobacterium tuberculosis
VTELLPFGRPQLAGGPLGSV

SEQ ID NO: 1478605 - protein, 17 aa, Mycobacterium tuberculosis
VTLWKQWDRCALHWFPG

SEQ ID NO: 1478606 - protein, 17 aa, Mycobacterium tuberculosis
VTPGDFGIGELVSATSP

SEQ ID NO: 1478607 - protein, 20 aa, Mycobacterium tuberculosis
VTPVAVIGMACRLPGGIDSP

SEQ ID NO: 1478608 - protein, 26 aa, Mycobacterium tuberculosis
VTTMFRPKLDALALLHRLSLKSPVRH

SEQ ID NO: 1478609 - protein, 18 aa, Mycobacterium tuberculosis
VTVDGDLVGAGWVSGGSD

SEQ ID NO: 1478610 - protein, 17 aa, Mycobacterium tuberculosis
VTVEVPVGGILAPLQPF

SEQ ID NO: 1478611 - protein, 25 aa, Mycobacterium tuberculosis
VVAAKLLRRKRFDIVGPPHHVEVEQ

SEQ ID NO: 1478612 - protein, 24 aa, Mycobacterium tuberculosis
VVAGETLSALALRFYGDAELNWLI

SEQ ID NO: 1478613 - protein, 25 aa, Mycobacterium tuberculosis
VVAGHSMGGITIAAWSDRYRHKVRR

SEQ ID NO: 1478614 - protein, 17 aa, Mycobacterium tuberculosis
VVASEGWQGQAAEAFVA

SEQ ID NO: 1478615 - protein, 19 aa, Mycobacterium tuberculosis
VVDVPAFRIGRVPVTNGEW

SEQ ID NO: 1478616 - protein, 26 aa, Mycobacterium tuberculosis
VVEARPGCRPSLAELDSFVRSEIAGY

SEQ ID NO: 1478617 - protein, 29 aa, Mycobacterium tuberculosis
VVGGAKRPVPRLGVLTVTIIQQTPDAGLA

SEQ ID NO: 1478618 - protein, 24 aa, Mycobacterium tuberculosis
VVIACGDCALNRGVFADAYGVVGA

SEQ ID NO: 1478619 - protein, 25 aa, Mycobacterium tuberculosis
VVLAGFPGTVASFWQQAGRSGRRGQ

SEQ ID NO: 1478620 - protein, 17 aa, Mycobacterium tuberculosis
VVNPCLAGGSLEIFLTP

SEQ ID NO: 1478621 - protein, 17 aa, Mycobacterium tuberculosis
VVSEFPTDRGWDVEGLY

SEQ ID NO: 1478622 - protein, 22 aa, Mycobacterium tuberculosis
VVSFRLAGDRGYTEFDVSHELR

SEQ ID NO: 1478623 - protein, 21 aa, Mycobacterium tuberculosis
VVVACSAISHASRRRAQRRLP

SEQ ID NO: 1478624 - protein, 19 aa, Mycobacterium tuberculosis
VWCGMTIPRVYPEMPENLV

SEQ ID NO: 1478625 - protein, 25 aa, Mycobacterium tuberculosis
VWCSDIRAGAGLVLAGLVADGDTEV

SEQ ID NO: 1478626 - protein, 17 aa, Mycobacterium tuberculosis
VWLAALATLPLVHQPGD

SEQ ID NO: 1478627 - protein, 20 aa, Mycobacterium tuberculosis
VWPRFRRRGLARGLLSTLAR

SEQ ID NO: 1478628 - protein, 21 aa, Mycobacterium tuberculosis
VWWPECSKEAYADGIAGAVDA

SEQ ID NO: 1478629 - protein, 18 aa, Mycobacterium tuberculosis
VYANDYWGPATVTYHDGQ

SEQ ID NO: 1478630 - protein, 24 aa, Mycobacterium tuberculosis
VYISRELISGGITTKLMPPALSRA

SEQ ID NO: 1478631 - protein, 25 aa, Mycobacterium tuberculosis
VYSPRLDRLAAEGILFTRAHATAPL

SEQ ID NO: 1478632 - protein, 19 aa, Mycobacterium tuberculosis
VYVPCEVCQGARYNRETLE

SEQ ID NO: 1478633 - protein, 22 aa, Mycobacterium tuberculosis
VYYRVFGGWLRQRRNIRDMTKT

SEQ ID NO: 1478634 - protein, 21 aa, Mycobacterium tuberculosis
WAATFLRRRGAAADAVLLNPD

SEQ ID NO: 1478635 - protein, 17 aa, Mycobacterium tuberculosis
WAGEIDPSLRLRPSRGT

SEQ ID NO: 1478636 - protein, 30 aa, Mycobacterium tuberculosis
WCAHSGWKVDAAKGVPDWAARLPDELLEAQ

SEQ ID NO: 1478637 - protein, 17 aa, Mycobacterium tuberculosis
WCALAETYGDDWHRWPK

SEQ ID NO: 1478638 - protein, 22 aa, Mycobacterium tuberculosis
WDEIWQCDGCSITHQRDDNAAI

SEQ ID NO: 1478639 - protein, 19 aa, Mycobacterium tuberculosis
WDIEPDLTNAVAFLSAAVV

SEQ ID NO: 1478640 - protein, 17 aa, Mycobacterium tuberculosis
WDKPSFAKELFLGRFPL

SEQ ID NO: 1478641 - protein, 32 aa, Mycobacterium tuberculosis
WDLGPLRASIDPFGWYRSWEEMLTGMAPLAGL

SEQ ID NO: 1478642 - protein, 20 aa, Mycobacterium tuberculosis
WDQVARCESGGNWSINTGNG

SEQ ID NO: 1478643 - protein, 17 aa, Mycobacterium tuberculosis
WDRHIAAGTEISLDLLD

SEQ ID NO: 1478644 - protein, 19 aa, Mycobacterium tuberculosis
WEALEHAGIPPGTLRRSAT

SEQ ID NO: 1478645 - protein, 20 aa, Mycobacterium tuberculosis
WEALEHARIPASSLRGQAVG

SEQ ID NO: 1478646 - protein, 19 aa, Mycobacterium tuberculosis
WEKACAWDPATGSRRRYPW

SEQ ID NO: 1478647 - protein, 18 aa, Mycobacterium tuberculosis
WELGEGWAKHVTVEVALG

SEQ ID NO: 1478648 - protein, 18 aa, Mycobacterium tuberculosis
WEPPMFEMDTTGLASGNC

SEQ ID NO: 1478649 - protein, 20 aa, Mycobacterium tuberculosis
WEQCRMVMLVLELSAGRWLS

SEQ ID NO: 1478650 - protein, 17 aa, Mycobacterium tuberculosis
WFGERWITSVLDLFQEN

SEQ ID NO: 1478651 - protein, 19 aa, Mycobacterium tuberculosis
WFTAAEALEYGFVDHIITR

SEQ ID NO: 1478652 - protein, 18 aa, Mycobacterium tuberculosis
WGAFDMSLGKAMYAGFTL

SEQ ID NO: 1478653 - protein, 18 aa, Mycobacterium tuberculosis
WGGPVAFIMMLRHPEKVT

SEQ ID NO: 1478654 - protein, 20 aa, Mycobacterium tuberculosis
WGLDPYLTPGFTELSSQAGF

SEQ ID NO: 1478655 - protein, 22 aa, Mycobacterium tuberculosis
WGPCPPRQDMAYSIEADIYLAL

SEQ ID NO: 1478656 - protein, 17 aa, Mycobacterium tuberculosis
WHLCTAITGRLRNISTT

SEQ ID NO: 1478657 - protein, 18 aa, Mycobacterium tuberculosis
WHRTDRPSVQWSPTARSR

SEQ ID NO: 1478658 - protein, 21 aa, Mycobacterium tuberculosis
WIGTHRARFADLMLALIDQKV

SEQ ID NO: 1478659 - protein, 18 aa, Mycobacterium tuberculosis
WIPPHVRLPANVTLLEPT

SEQ ID NO: 1478660 - protein, 17 aa, Mycobacterium tuberculosis
WKGWGHVRWFIEEVPAG

SEQ ID NO: 1478661 - protein, 18 aa, Mycobacterium tuberculosis
WKPSELTPLTALASQALL

SEQ ID NO: 1478662 - protein, 26 aa, Mycobacterium tuberculosis
WKQWDRCALHWFPGSHLLHVSQLDYL

SEQ ID NO: 1478663 - protein, 17 aa, Mycobacterium tuberculosis
WKSRWYADKQYAEYVKE

SEQ ID NO: 1478664 - protein, 19 aa, Mycobacterium tuberculosis
WKTVSPHLSPISNMVSMAN

SEQ ID NO: 1478665 - protein, 24 aa, Mycobacterium tuberculosis
WKVDAAKGVPDWAARLPDELLEAQ

SEQ ID NO: 1478666 - protein, 18 aa, Mycobacterium tuberculosis
WKVGFQVTEALRANTDGR

SEQ ID NO: 1478667 - protein, 23 aa, Mycobacterium tuberculosis
WLADHLRRRWARNTGGLLVVTHD

SEQ ID NO: 1478668 - protein, 27 aa, Mycobacterium tuberculosis
WLPMKRTALALHHLVCTRFRSDALQII

SEQ ID NO: 1478669 - protein, 17 aa, Mycobacterium tuberculosis
WMTAAALVRPRGAGGVV

SEQ ID NO: 1478670 - protein, 20 aa, Mycobacterium tuberculosis
WNFTVPFVCGATNLGEALRR

SEQ ID NO: 1478671 - protein, 20 aa, Mycobacterium tuberculosis
WNRIDYRPLDGFVYAITPFN

SEQ ID NO: 1478672 - protein, 17 aa, Mycobacterium tuberculosis
WNVDKADLDGLLDRLSK

SEQ ID NO: 1478673 - protein, 21 aa, Mycobacterium tuberculosis
WPADDYRAGVVQTSFDKQFVR

SEQ ID NO: 1478674 - protein, 19 aa, Mycobacterium tuberculosis
WPARQLVDDRWVWLPTLLA

SEQ ID NO: 1478675 - protein, 25 aa, Mycobacterium tuberculosis
WPDKPGVAGCAAMDGTVLVNLINTK

SEQ ID NO: 1478676 - protein, 18 aa, Mycobacterium tuberculosis
WPDPPGLVAASNRSALAR

SEQ ID NO: 1478677 - protein, 21 aa, Mycobacterium tuberculosis
WPNYDAVASIAWLGYDAPDGL

SEQ ID NO: 1478678 - protein, 17 aa, Mycobacterium tuberculosis
WPPNAAMATRRLHPLGA

SEQ ID NO: 1478679 - protein, 17 aa, Mycobacterium tuberculosis
WPSYVRVSAGLPRTMTF

SEQ ID NO: 1478680 - protein, 19 aa, Mycobacterium tuberculosis
WPTNGRQVPRRAAVSSYGF

SEQ ID NO: 1478681 - protein, 21 aa, Mycobacterium tuberculosis
WQAIEASGRFCVNVLTEKQKD

SEQ ID NO: 1478682 - protein, 17 aa, Mycobacterium tuberculosis
WRAAMWSKPAGHGINAP

SEQ ID NO: 1478683 - protein, 26 aa, Mycobacterium tuberculosis
WRADLLGKRLHRVLGPLAHVNLIPLN

SEQ ID NO: 1478684 - protein, 19 aa, Mycobacterium tuberculosis
WRDFCLRVADRIVLVAGDP

SEQ ID NO: 1478685 - protein, 18 aa, Mycobacterium tuberculosis
WRDVLLRLANDFRCVAID

SEQ ID NO: 1478686 - protein, 18 aa, Mycobacterium tuberculosis
WREGLLRGLAAHHAGMLP

SEQ ID NO: 1478687 - protein, 21 aa, Mycobacterium tuberculosis
WREWSLRCAALATHPAALDTR

SEQ ID NO: 1478688 - protein, 19 aa, Mycobacterium tuberculosis
WRNIRRLIDAGARVALSTD

SEQ ID NO: 1478689 - protein, 17 aa, Mycobacterium tuberculosis
WRRLGGTFPTNSQLTNE

SEQ ID NO: 1478690 - protein, 17 aa, Mycobacterium tuberculosis
WRRRKPYSWLRQVLPDP

SEQ ID NO: 1478691 - protein, 17 aa, Mycobacterium tuberculosis
WRSSGGVIAARIPAAAY

SEQ ID NO: 1478692 - protein, 17 aa, Mycobacterium tuberculosis
WRTDGYCHCMFTALDTL

SEQ ID NO: 1478693 - protein, 19 aa, Mycobacterium tuberculosis
WRTSTRLPRDHYVRLDGND

SEQ ID NO: 1478694 - protein, 20 aa, Mycobacterium tuberculosis
WRVVELDVSYGPRTGGKSKV

SEQ ID NO: 1478695 - protein, 20 aa, Mycobacterium tuberculosis
WSAAYRYPGSMCVGFPKVLA

SEQ ID NO: 1478696 - protein, 17 aa, Mycobacterium tuberculosis
WSALPLPEPDSTLRAHY

SEQ ID NO: 1478697 - protein, 18 aa, Mycobacterium tuberculosis
WSGSRFAQRPVLPEDIHR

SEQ ID NO: 1478698 - protein, 18 aa, Mycobacterium tuberculosis
WSIRRLSSLVGHGRARAM

SEQ ID NO: 1478699 - protein, 26 aa, Mycobacterium tuberculosis
WSLAVALRLAAYQLLRVDGGEPVLLL

SEQ ID NO: 1478700 - protein, 20 aa, Mycobacterium tuberculosis
WSNRIERGLVHITGVTRLEV

SEQ ID NO: 1478701 - protein, 17 aa, Mycobacterium tuberculosis
WSPAAAAHVFVRSACAA

SEQ ID NO: 1478702 - protein, 25 aa, Mycobacterium tuberculosis
WTATLKRHCVRVIPWEITGRHFRFG

SEQ ID NO: 1478703 - protein, 17 aa, Mycobacterium tuberculosis
WTCMIPRQVAEELGQPL

SEQ ID NO: 1478704 - protein, 19 aa, Mycobacterium tuberculosis
WTDRDTLLYAIGVGAGTGD

SEQ ID NO: 1478705 - protein, 20 aa, Mycobacterium tuberculosis
WTLAEPRVTPVAVIGMACRL

SEQ ID NO: 1478706 - protein, 18 aa, Mycobacterium tuberculosis
WTLDTAVAYAKVREQFGK

SEQ ID NO: 1478707 - protein, 17 aa, Mycobacterium tuberculosis
WTRDRLLIVTLADVASR

SEQ ID NO: 1478708 - protein, 25 aa, Mycobacterium tuberculosis
WVARVGTVVMSWRLRTRHRLPVHDI

SEQ ID NO: 1478709 - protein, 19 aa, Mycobacterium tuberculosis
WVGPRRFSGSSGQLAREWV

SEQ ID NO: 1478710 - protein, 17 aa, Mycobacterium tuberculosis
WVLGPSMTYTCAVFPNA

SEQ ID NO: 1478711 - protein, 17 aa, Mycobacterium tuberculosis
WWQVHRRAMIVAEELWI

SEQ ID NO: 1478712 - protein, 17 aa, Mycobacterium tuberculosis
WWSERGWQHRQRAGLTA

SEQ ID NO: 1478713 - protein, 29 aa, Mycobacterium tuberculosis
WYTATEIANAAAMRVVLGAVNAPTQTLLG

SEQ ID NO: 1478714 - protein, 18 aa, Mycobacterium tuberculosis
YAEAFCRAVGGSWADVLD

SEQ ID NO: 1478715 - protein, 17 aa, Mycobacterium tuberculosis
YAFDDTVAWLAVACSKT

SEQ ID NO: 1478716 - protein, 22 aa, Mycobacterium tuberculosis
YAFDKRRFWLSAEGSGADVSGL

SEQ ID NO: 1478717 - protein, 20 aa, Mycobacterium tuberculosis
YAHGWVTWFPPDAPPGTERF

SEQ ID NO: 1478718 - protein, 17 aa, Mycobacterium tuberculosis
YALAGTMDFDFQTQPLG

SEQ ID NO: 1478719 - protein, 18 aa, Mycobacterium tuberculosis
YANLRHTVRFDRAVESAI

SEQ ID NO: 1478720 - protein, 17 aa, Mycobacterium tuberculosis
YDIPAAALHHFPMQVNG

SEQ ID NO: 1478721 - protein, 23 aa, Mycobacterium tuberculosis
YEDVPGFCKSATLAEIKATDYAL

SEQ ID NO: 1478722 - protein, 17 aa, Mycobacterium tuberculosis
YEKFFRIGFKKQAEALG

SEQ ID NO: 1478723 - protein, 18 aa, Mycobacterium tuberculosis
YELMWAADVAAMAGYHSG

SEQ ID NO: 1478724 - protein, 23 aa, Mycobacterium tuberculosis
YEQMWAADVAAMVGYHGGASAAA

SEQ ID NO: 1478725 - protein, 17 aa, Mycobacterium tuberculosis
YERLGIPTITTVPWTTD

SEQ ID NO: 1478726 - protein, 18 aa, Mycobacterium tuberculosis
YEVHFACDPRFNKLLGPL

SEQ ID NO: 1478727 - protein, 18 aa, Mycobacterium tuberculosis
YGGADPVADCPEAGEPVG

SEQ ID NO: 1478728 - protein, 20 aa, Mycobacterium tuberculosis
YGLDPERIWTTVYFDDDEAV

SEQ ID NO: 1478729 - protein, 17 aa, Mycobacterium tuberculosis
YGLIPRAHRGIVAVNEL

SEQ ID NO: 1478730 - protein, 17 aa, Mycobacterium tuberculosis
YHRRAGLTAERFVADPF

SEQ ID NO: 1478731 - protein, 22 aa, Mycobacterium tuberculosis
YIGSKPSPFAWIPFGGGTRRCV

SEQ ID NO: 1478732 - protein, 18 aa, Mycobacterium tuberculosis
YILRRLKTDPAIIDDLPE

SEQ ID NO: 1478733 - protein, 24 aa, Mycobacterium tuberculosis
YIPILGAPWLADLVRRSPWGEMFA

SEQ ID NO: 1478734 - protein, 20 aa, Mycobacterium tuberculosis
YITARFLPDKAIDLVDEAAS

SEQ ID NO: 1478735 - protein, 25 aa, Mycobacterium tuberculosis
YKSYRGMGSLGAMRGRGGATSYSKD

SEQ ID NO: 1478736 - protein, 17 aa, Mycobacterium tuberculosis
YLATGMARFLTSIAQQL

SEQ ID NO: 1478737 - protein, 20 aa, Mycobacterium tuberculosis
YLGAFVKRVSNPVAGHTTWT

SEQ ID NO: 1478738 - protein, 17 aa, Mycobacterium tuberculosis
YLRHLIDGGGLEHVDGR

SEQ ID NO: 1478739 - protein, 21 aa, Mycobacterium tuberculosis
YLRNEVFAAWIEKVDALVQDE

SEQ ID NO: 1478740 - protein, 34 aa, Mycobacterium tuberculosis
YLSPLPLPLGFVDFACRVWRPGQGTVRTTINLPN

SEQ ID NO: 1478741 - protein, 17 aa, Mycobacterium tuberculosis
YLSRAGISKEQVATGGY

SEQ ID NO: 1478742 - protein, 22 aa, Mycobacterium tuberculosis
YMIRVKEMWESMKIVEQCLDKL

SEQ ID NO: 1478743 - protein, 19 aa, Mycobacterium tuberculosis
YMKMITPAALLRCLVEGAD

SEQ ID NO: 1478744 - protein, 23 aa, Mycobacterium tuberculosis
YPDLVPRLRFGDIVRVGSADEHL

SEQ ID NO: 1478745 - protein, 21 aa, Mycobacterium tuberculosis
YPEDAWQFAGRVRELTGGTGV

SEQ ID NO: 1478746 - protein, 18 aa, Mycobacterium tuberculosis
YPGVRYRAFDLFEPGPDR

SEQ ID NO: 1478747 - protein, 17 aa, Mycobacterium tuberculosis
YPQKPPVGAALWKLMER

SEQ ID NO: 1478748 - protein, 17 aa, Mycobacterium tuberculosis
YPRAGHVGDPEFLPLLR

SEQ ID NO: 1478749 - protein, 22 aa, Mycobacterium tuberculosis
YPRQGKTVLFLGRYDEPRKGMA

SEQ ID NO: 1478750 - protein, 41 aa, Mycobacterium tuberculosis; identical to SEQ ID NO: 210404

SEQ ID NO: 1478751 - protein, 18 aa, Mycobacterium tuberculosis
YQEVITMHECRSAKQLAT

SEQ ID NO: 1478752 - protein, 20 aa, Mycobacterium tuberculosis
YQPWLDRLLAMSWDDSEHRK

SEQ ID NO: 1478753 - protein, 23 aa, Mycobacterium tuberculosis
YQRLSAQAAGFHAQFVQALNAGV

SEQ ID NO: 1478754 - protein, 33 aa, Mycobacterium tuberculosis
YQRYLDILRPLGFRPALGFSRVDTTISWSSVEE

SEQ ID NO: 1478755 - protein, 17 aa, Mycobacterium tuberculosis
YQSKTGWVYDSGDYETT

SEQ ID NO: 1478756 - protein, 17 aa, Mycobacterium tuberculosis
YRAGMAMGTTLQVPPQM

SEQ ID NO: 1478757 - protein, 24 aa, Mycobacterium tuberculosis
YREAKARLGDPVAAWADIQADPRR

SEQ ID NO: 1478758 - protein, 20 aa, Mycobacterium tuberculosis
YRFGTAGSRLDDLAAALPRI

SEQ ID NO: 1478759 - protein, 28 aa, Mycobacterium tuberculosis
YRIGREIGCKLVSFGSGAHFCLGAHLAR

SEQ ID NO: 1478760 - protein, 23 aa, Mycobacterium tuberculosis
YRLGRGRYGPGYIPRSTEYRIHQ

SEQ ID NO: 1478761 - protein, 17 aa, Mycobacterium tuberculosis
YRLVALRETSPRIHELI

SEQ ID NO: 1478762 - protein, 18 aa, Mycobacterium tuberculosis
YRMDSGATIAVRITVDRA

SEQ ID NO: 1478763 - protein, 19 aa, Mycobacterium tuberculosis
YRRRIEPQVVRFTAATLPT

SEQ ID NO: 1478764 - protein, 17 aa, Mycobacterium tuberculosis
YRTVRIGAHQARILLAK

SEQ ID NO: 1478765 - protein, 17 aa, Mycobacterium tuberculosis
YRVDEVEYDPAYHELMR

SEQ ID NO: 1478766 - protein, 18 aa, Mycobacterium tuberculosis
YRWPAMAGAAVAVTRATP

SEQ ID NO: 1478767 - protein, 17 aa, Mycobacterium tuberculosis
YSDFLDFVGRERIFASL

SEQ ID NO: 1478768 - protein, 21 aa, Mycobacterium tuberculosis
YSHAIDVLGVIVSRIEDAPLY

SEQ ID NO: 1478769 - protein, 21 aa, Mycobacterium tuberculosis
YSLDNKRLWSNLDCAPSNETL

SEQ ID NO: 1478770 - protein, 18 aa, Mycobacterium tuberculosis
YSSGLADLAQDLANWKAG

SEQ ID NO: 1478771 - protein, 27 aa, Mycobacterium tuberculosis
YTAPEISARILMKLKRDAEAYLGEDIT

SEQ ID NO: 1478772 - protein, 18 aa, Mycobacterium tuberculosis
YTQSRWWSERGWQHRQRA

SEQ ID NO: 1478773 - protein, 18 aa, Mycobacterium tuberculosis
YTSEWKIRNLVKKYSDFI

SEQ ID NO: 1478774 - protein, 17 aa, Mycobacterium tuberculosis
YVIKHAQLIPVDRSVGA

SEQ ID NO: 1478775 - protein, 17 aa, Mycobacterium tuberculosis
YVRLGLAAQLARQLGAP

SEQ ID NO: 1478776 - protein, 23 aa, Mycobacterium tuberculosis
YVTPELRATIEAVWAKLAAPGMC

SEQ ID NO: 1478777 - protein, 20 aa, Mycobacterium tuberculosis
YWELPAMMLQFLRTGSGATR

SEQ ID NO: 1478778 - protein, 17 aa, Mycobacterium tuberculosis
YWSLPSIFDSGGNHGTL

SEQ ID NO: 1478779 - protein, 20 aa, Mycobacterium tuberculosis
AAAAAPYVTWMSGTSAQAKA

SEQ ID NO: 1478780 - protein, 20 aa, Mycobacterium tuberculosis
AAAADCLARAVLAGVLNAQP

SEQ ID NO: 1478781 - protein, 18 aa, Mycobacterium tuberculosis
AAAAEVLAAAGFSVLLLP

SEQ ID NO: 1478782 - protein, 17 aa, Mycobacterium tuberculosis
AAAAGELASIRSAINAA

SEQ ID NO: 1478783 - protein, 21 aa, Mycobacterium tuberculosis
AAAAGELRSLGATLKASNAAA

SEQ ID NO: 1478784 - protein, 21 aa, Mycobacterium tuberculosis
AAAAKGKWSLASVNVDVAPRV

SEQ ID NO: 1478785 - protein, 27 aa, Mycobacterium tuberculosis
AAAAKLAGLVFPQPPAPIAVSGTDSVV

SEQ ID NO: 1478786 - protein, 38 aa, Mycobacterium tuberculosis
AAAAQVAAFHSRFVQALTAGAGAYAFAEAANASPLQSA

SEQ ID NO: 1478787 - protein, 18 aa, Mycobacterium tuberculosis
AAAARPLAIPVIVLAGQV

SEQ ID NO: 1478788 - protein, 19 aa, Mycobacterium tuberculosis
AAAASPYVAWMSVTAGQAQ

SEQ ID NO: 1478789 - protein, 21 aa, Mycobacterium tuberculosis
AAAAVPYVAWMRATAASAEQA

SEQ ID NO: 1478790 - protein, 22 aa, Mycobacterium tuberculosis
AAAAVPYVAWMRATAASAEQAA

SEQ ID NO: 1478791 - protein, 25 aa, Mycobacterium tuberculosis
AAACLARAGLRVRLLERLAQTGGAA

SEQ ID NO: 1478792 - protein, 20 aa, Mycobacterium tuberculosis
AAADAARIGSAINTANTAAA

SEQ ID NO: 1478793 - protein, 19 aa, Mycobacterium tuberculosis
AAADAARIGSAINTTNTAA

SEQ ID NO: 1478794 - protein, 18 aa, Mycobacterium tuberculosis
AAADRLCYSYFRSYGLDV

SEQ ID NO: 1478795 - protein, 18 aa, Mycobacterium tuberculosis
AAAEFDYELMWAQDVAAM

SEQ ID NO: 1478796 - protein, 18 aa, Mycobacterium tuberculosis
AAAEFTRILTGVDIHPGA

SEQ ID NO: 1478797 - protein, 24 aa, Mycobacterium tuberculosis
AAAEGRLKGILKYYDAPIVSSDIV

SEQ ID NO: 1478798 - protein, 25 aa, Mycobacterium tuberculosis
AAAEIAAATGMVFAVFADDDSLAAF

SEQ ID NO: 1478799 - protein, 19 aa, Mycobacterium tuberculosis
AAAFAGIKPFLALYMGGMG

SEQ ID NO: 1478800 - protein, 18 aa, Mycobacterium tuberculosis
AAAFHERFIQALSTAAGA

SEQ ID NO: 1478801 - protein, 19 aa, Mycobacterium tuberculosis
AAAFVRGRRAEVFGISRAG

SEQ ID NO: 1478802 - protein, 24 aa, Mycobacterium tuberculosis
AAAFVRGRRAEVFGISRAGDGAGA

SEQ ID NO: 1478803 - protein, 25 aa, Mycobacterium tuberculosis
AAAGCGDGAFRLGTMPIEVESSVAR

SEQ ID NO: 1478804 - protein, 23 aa, Mycobacterium tuberculosis
AAAGEYHRAGGIHLLKRRPNGAR

SEQ ID NO: 1478805 - protein, 19 aa, Mycobacterium tuberculosis
AAAGIRWGAHRQAADAPQA

SEQ ID NO: 1478806 - protein, 22 aa, Mycobacterium tuberculosis
AAAGKRARDVGVRIVYVVDTTG

SEQ ID NO: 1478807 - protein, 19 aa, Mycobacterium tuberculosis
AAAGLSNATPREVLPASAA

SEQ ID NO: 1478808 - protein, 17 aa, Mycobacterium tuberculosis
AAAGPGPRAHARGAGQR

SEQ ID NO: 1478809 - protein, 19 aa, Mycobacterium tuberculosis
AAAGPRCRRTPRRRRVGDA

SEQ ID NO: 1478810 - protein, 17 aa, Mycobacterium tuberculosis
AAAGRLNPLITPSQTAN

SEQ ID NO: 1478811 - protein, 21 aa, Mycobacterium tuberculosis
AAAHRRVWRDREPALASPRRP

SEQ ID NO: 1478812 - protein, 18 aa, Mycobacterium tuberculosis
AAAIRITDYLSRDLTITQ

SEQ ID NO: 1478813 - protein, 22 aa, Mycobacterium tuberculosis
AAAKTRLAPVFSAQTRENVVLA

SEQ ID NO: 1478814 - protein, 22 aa, Mycobacterium tuberculosis
AAALARTTRWGSFLPDIDAFDA

SEQ ID NO: 1478815 - protein, 23 aa, Mycobacterium tuberculosis
AAALARTTRWGSFLPDIDAFDAE

SEQ ID NO: 1478816 - protein, 24 aa, Mycobacterium tuberculosis
AAALARTTRWGSFLPDIDAFDAEF

SEQ ID NO: 1478817 - protein, 17 aa, Mycobacterium tuberculosis
AAALGLLEASGFQVDTN

SEQ ID NO: 1478818 - protein, 22 aa, Mycobacterium tuberculosis
AAALPTVEVVAAAADEVSTQIA

SEQ ID NO: 1478819 - protein, 18 aa, Mycobacterium tuberculosis
AAANAFLDGLVAYRRSRG

SEQ ID NO: 1478820 - protein, 27 aa, Mycobacterium tuberculosis
AAANSWLDAFAHWRRAQGLPATSIAWG

SEQ ID NO: 1478821 - protein, 17 aa, Mycobacterium tuberculosis
AAAPYVAWMSATAVHAE

SEQ ID NO: 1478822 - protein, 17 aa, Mycobacterium tuberculosis
AAAQAMAIATAFEAALA

SEQ ID NO: 1478823 - protein, 23 aa, Mycobacterium tuberculosis
AAAQFPFDIIPTLLQGLATLSTQ

SEQ ID NO: 1478824 - protein, 17 aa, Mycobacterium tuberculosis
AAARAADLWRFTAGAVD

SEQ ID NO: 1478825 - protein, 22 aa, Mycobacterium tuberculosis
AAARAADLWRFTAGAVDQPNPV

SEQ ID NO: 1478826 - protein, 19 aa, Mycobacterium tuberculosis
AAARCPQLFIATADADRDA

SEQ ID NO: 1478827 - protein, 18 aa, Mycobacterium tuberculosis
AAARRVCRRLTTSAPALA

SEQ ID NO: 1478828 - protein, 22 aa, Mycobacterium tuberculosis
AAARSADLCRRELLSRRDQLTA

SEQ ID NO: 1478829 - protein, 17 aa, Mycobacterium tuberculosis
AAASAWDGLAEELHAAA

SEQ ID NO: 1478830 - protein, 26 aa, Mycobacterium tuberculosis
AAASDVARIGSSIGAANAAAAGSTTS

SEQ ID NO: 1478831 - protein, 17 aa, Mycobacterium tuberculosis
AAASFSLLISGLTAGPG

SEQ ID NO: 1478832 - protein, 22 aa, Mycobacterium tuberculosis
AAASLKGLVRVLAFEHPGHAHH

SEQ ID NO: 1478833 - protein, 17 aa, Mycobacterium tuberculosis
AAASPYVAWMSVTAGQA

SEQ ID NO: 1478834 - protein, 18 aa, Mycobacterium tuberculosis
AAASSYVAAEAVNVEQSL

SEQ ID NO: 1478835 - protein, 27 aa, Mycobacterium tuberculosis
AAATAWGELAEELLASIASLGSVTSEL

SEQ ID NO: 1478836 - protein, 25 aa, Mycobacterium tuberculosis
AAATAWGELAEKLLASIASLGSVTS

SEQ ID NO: 1478837 - protein, 27 aa, Mycobacterium tuberculosis
AAAVRKWTKRKGRIYSDDRIGVALDRI

SEQ ID NO: 1478838 - protein, 17 aa, Mycobacterium tuberculosis
AAAVYDLFVKTLGVSAG

SEQ ID NO: 1478839 - protein, 18 aa, Mycobacterium tuberculosis
AAAYAVAVPGGWRAPMLR

SEQ ID NO: 1478840 - protein, 22 aa, Mycobacterium tuberculosis
AAAYETAYRLTVPPPVIAENRT

SEQ ID NO: 1478841 - protein, 17 aa, Mycobacterium tuberculosis
AACGGPFARLTLNSPHN

SEQ ID NO: 1478842 - protein, 19 aa, Mycobacterium tuberculosis
AACGLRRLIPLYATVETAL

SEQ ID NO: 1478843 - protein, 20 aa, Mycobacterium tuberculosis
AACGLRRLIPLYATVETALA

SEQ ID NO: 1478844 - protein, 17 aa, Mycobacterium tuberculosis
AACRLAPARPFEYPGRR

SEQ ID NO: 1478845 - protein, 17 aa, Mycobacterium tuberculosis
  misc_feature (16)..(16): Xaa can be any naturally occurring amino acid
AADAITVSAADRPAHXA

SEQ ID NO: 1478846 - protein, 18 aa, Mycobacterium tuberculosis
AADAMGWRGAAMGATVVS

SEQ ID NO: 1478847 - protein, 24 aa, Mycobacterium tuberculosis
AADDCGFATLWVGEHVRDDDRPRR

SEQ ID NO: 1478848 - protein, 22 aa, Mycobacterium tuberculosis
AADELSGLFVPTDVCDQDAVNG

SEQ ID NO: 1478849 - protein, 25 aa, Mycobacterium tuberculosis
AADEVSAAMAALFGAHAQEYQRLSA

SEQ ID NO: 1478850 - protein, 29 aa, Mycobacterium tuberculosis
AADEVSAAVAALFGSYAQSYQAFGAQLSA

SEQ ID NO: 1478851 - protein, 24 aa, Mycobacterium tuberculosis
AADEVSAGIAALFGAQAQSYQAVS

SEQ ID NO: 1478852 - protein, 25 aa, Mycobacterium tuberculosis
AADEVSAHIAALFSGHGEGYQAIAR

SEQ ID NO: 1478853 - protein, 27 aa, Mycobacterium tuberculosis
AADEVSTQIAALFGAHARSYQTLSTQA

SEQ ID NO: 1478854 - protein, 29 aa, Mycobacterium tuberculosis
AADEVSTQIAALFGAHARSYQTLSTQAAA

SEQ ID NO: 1478855 - protein, 20 aa, Mycobacterium tuberculosis
AADIDGVLRWADEARARLAQ

SEQ ID NO: 1478856 - protein, 17 aa, Mycobacterium tuberculosis
AADLARLITPFAERHGV

SEQ ID NO: 1478857 - protein, 17 aa, Mycobacterium tuberculosis
AADRLELAEGLRALAAG

SEQ ID NO: 1478858 - protein, 18 aa, Mycobacterium tuberculosis
AADRLELAEGLRALAAGR

SEQ ID NO: 1478859 - protein, 18 aa, Mycobacterium tuberculosis
AAEADRAHLAAVWEEADR

SEQ ID NO: 1478860 - protein, 17 aa, Mycobacterium tuberculosis
AAEADWPDAYRVNRYVR

SEQ ID NO: 1478861 - protein, 18 aa, Mycobacterium tuberculosis
AAEAEYELMWAADVAAMA

SEQ ID NO: 1478862 - protein, 20 aa, Mycobacterium tuberculosis
AAEALSWGLVSAVYPAADFD

SEQ ID NO: 1478863 - protein, 23 aa, Mycobacterium tuberculosis
AAEIAAATGMVFAVFADDDSLAA

SEQ ID NO: 1478864 - protein, 26 aa, Mycobacterium tuberculosis
AAERLCRRGCAAVGGRWRRWRPEGLG

SEQ ID NO: 1478865 - protein, 25 aa, Mycobacterium tuberculosis
AAEYLGTVVQFHFIARLVLVLLDET

SEQ ID NO: 1478866 - protein, 17 aa, Mycobacterium tuberculosis
AAFCDGYAVASGIDPRD

SEQ ID NO: 1478867 - protein, 17 aa, Mycobacterium tuberculosis
AAFHGRFVQALTTGGAP

SEQ ID NO: 1478868 - protein, 17 aa, Mycobacterium tuberculosis
AAFHSRFVQALTTAAAS

SEQ ID NO: 1478869 - protein, 27 aa, Mycobacterium tuberculosis
AAFNWTIPEDIEWTGPMAARLWVQLDG

SEQ ID NO: 1478870 - protein, 17 aa, Mycobacterium tuberculosis
AAGAEAIQINDAHRSVR

SEQ ID NO: 1478871 - protein, 18 aa, Mycobacterium tuberculosis
AAGAGGRWSYRRASRRCQ

SEQ ID NO: 1478872 - protein, 29 aa, Mycobacterium tuberculosis
AAGALKNVFAIAVGMGYSLGIGENTRALV

SEQ ID NO: 1478873 - protein, 21 aa, Mycobacterium tuberculosis
AAGAMPVLTLYGIPHRDCGSY

SEQ ID NO: 1478874 - protein, 26 aa, Mycobacterium tuberculosis
AAGAVSFRFGDRTQINGVARDDAVAA

SEQ ID NO: 1478875 - protein, 23 aa, Mycobacterium tuberculosis
AAGCGDGAFRLGTMPIEVESSVA

SEQ ID NO: 1478876 - protein, 21 aa, Mycobacterium tuberculosis
AAGGLAGQIGNGGSGGSGGAG

SEQ ID NO: 1478877 - protein, 19 aa, Mycobacterium tuberculosis
AAGGPAWPGRTAAMALGGA

SEQ ID NO: 1478878 - protein, 18 aa, Mycobacterium tuberculosis
AAGGRGAVRPGRTVQGRV

SEQ ID NO: 1478879 - protein, 31 aa, Mycobacterium tuberculosis
AAGHGGAGGSARLIGAGGHGGDGGAGGNTAG

SEQ ID NO: 1478880 - protein, 19 aa, Mycobacterium tuberculosis
AAGIGELTFFAKIHYGGGA

SEQ ID NO: 1478881 - protein, 31 aa, Mycobacterium tuberculosis
AAGKRRARCSARWTAGIRCCSTGSSGAAGCT

SEQ ID NO: 1478882 - protein, 17 aa, Mycobacterium tuberculosis
AAGLFGIGGAGGAGGAG

SEQ ID NO: 1478883 - protein, 18 aa, Mycobacterium tuberculosis
AAGLKAAYHAHREAYQRI

SEQ ID NO: 1478884 - protein, 22 aa, Mycobacterium tuberculosis
AAGLPSLMVLTGVNSAWDAVYA

SEQ ID NO: 1478885 - protein, 25 aa, Mycobacterium tuberculosis
AAGLRAVCGRAAWTLNSSPARSWCP

SEQ ID NO: 1478886 - protein, 20 aa, Mycobacterium tuberculosis
AAGLRGVEKGYVLGPQAEDN

SEQ ID NO: 1478887 - protein, 21 aa, Mycobacterium tuberculosis
AAGLRVGDTVAVLGPKTGEQV

SEQ ID NO: 1478888 - protein, 17 aa, Mycobacterium tuberculosis
AAGMLFGAAGIGGLGGF

SEQ ID NO: 1478889 - protein, 26 aa, Mycobacterium tuberculosis
AAGMPGMPFGTMGGQGFGRAVPQYGF

SEQ ID NO: 1478890 - protein, 20 aa, Mycobacterium tuberculosis
AAGNLARLGSMISAANSAAA

SEQ ID NO: 1478891 - protein, 25 aa, Mycobacterium tuberculosis
AAGNYAQRLFPGMRVKYVSTEEFTN

SEQ ID NO: 1478892 - protein, 20 aa, Mycobacterium tuberculosis
AAGPTMGILAAGADEVSVAI

SEQ ID NO: 1478893 - protein, 26 aa, Mycobacterium tuberculosis
AAGPTRRGGACDWCKRQEPTPRSPSA

SEQ ID NO: 1478894 - protein, 25 aa, Mycobacterium tuberculosis
AAGQARGPGGRRCEGRQDPIGDRGA

SEQ ID NO: 1478895 - protein, 18 aa, Mycobacterium tuberculosis
AAGRARCRRSPDRGGAGD

SEQ ID NO: 1478896 - protein, 18 aa, Mycobacterium tuberculosis
AAGRGLRAACPMDPRTCW

SEQ ID NO: 1478897 - protein, 20 aa, Mycobacterium tuberculosis
AAGRLRFTTDYDMAADFADV

SEQ ID NO: 1478898 - protein, 21 aa, Mycobacterium tuberculosis
AAGRVTWRWCSRTTRLYPNMT

SEQ ID NO: 1478899 - protein, 22 aa, Mycobacterium tuberculosis
AAGSGRTGGTGGLIGDGGAGGA

SEQ ID NO: 1478900 - protein, 17 aa, Mycobacterium tuberculosis
AAGSGWCRSPRLVTLTV

SEQ ID NO: 1478901 - protein, 17 aa, Mycobacterium tuberculosis
AAGSLIGLGGGGGAGGV

SEQ ID NO: 1478902 - protein, 20 aa, Mycobacterium tuberculosis
AAGTVCTRGGSGAADPTSTT

SEQ ID NO: 1478903 - protein, 26 aa, Mycobacterium tuberculosis
AAGWFGVAMILDFSWLPPEINSARIY

SEQ ID NO: 1478904 - protein, 27 aa, Mycobacterium tuberculosis
AAGWFGVAMILDFSWLPPEINSARIYA

SEQ ID NO: 1478905 - protein, 19 aa, Mycobacterium tuberculosis
AAHLPRAVRWHHYSLDNGD

SEQ ID NO: 1478906 - protein, 24 aa, Mycobacterium tuberculosis
AAHLVHPGDLVILIAYATMDDARA

SEQ ID NO: 1478907 - protein, 25 aa, Mycobacterium tuberculosis
AAHRERLVLPGLRDWLRRQAKAGAG

SEQ ID NO: 1478908 - protein, 25 aa, Mycobacterium tuberculosis
AAHTRPDQLVAMPALPTTPIGKIDK

SEQ ID NO: 1478909 - protein, 17 aa, Mycobacterium tuberculosis
AAIAALFATHGQAYQEL

SEQ ID NO: 1478910 - protein, 17 aa, Mycobacterium tuberculosis
AAIAALFSGHAQAYQAL

SEQ ID NO: 1478911 - protein, 17 aa, Mycobacterium tuberculosis
AAIAALFSSHGQQYQAM

SEQ ID NO: 1478912 - protein, 18 aa, Mycobacterium tuberculosis
AAIAGRGWTLVWGGGHVS

SEQ ID NO: 1478913 - protein, 17 aa, Mycobacterium tuberculosis
AAIIGDFVMTAAEVQDV

SEQ ID NO: 1478914 - protein, 17 aa, Mycobacterium tuberculosis
AAILRRIRLTPAGPDTA

SEQ ID NO: 1478915 - protein, 19 aa, Mycobacterium tuberculosis
AAIPAPWPVLATLPSGPEL

SEQ ID NO: 1478916 - protein, 26 aa, Mycobacterium tuberculosis
AAIPLSFAQRRLWFLDQLQRPAPVYN

SEQ ID NO: 1478917 - protein, 26 aa, Mycobacterium tuberculosis
AAIRARRSLDSAAGWLAPLGGAHVRS

SEQ ID NO: 1478918 - protein, 17 aa, Mycobacterium tuberculosis
AAKHARKVAAWGADAMI

SEQ ID NO: 1478919 - protein, 22 aa, Mycobacterium tuberculosis
AAKLLRRKRFDIVGPPHHVEVE

SEQ ID NO: 1478920 - protein, 38 aa, Mycobacterium tuberculosis
AAKQALTEAVLWPLQHPDTFARLGVEPPRGVLLYGPPG

SEQ ID NO: 1478921 - protein, 24 aa, Mycobacterium tuberculosis
AAKVRPGVPVIFLDTGYHFVETIG

SEQ ID NO: 1478922 - protein, 23 aa, Mycobacterium tuberculosis
AALAIRAGALWVAANVDPTLPTE

SEQ ID NO: 1478923 - protein, 22 aa, Mycobacterium tuberculosis
AALARRGCVYVSVNYRLGALGC

SEQ ID NO: 1478924 - protein, 25 aa, Mycobacterium tuberculosis
AALASRVRKAPGFALLGEKGQPRDL

SEQ ID NO: 1478925 - protein, 24 aa, Mycobacterium tuberculosis
AALASRVRKAPGFALLGEKGQSRD

SEQ ID NO: 1478926 - protein, 23 aa, Mycobacterium tuberculosis
AALDIPILQGLCLTSPRDQWCAT

SEQ ID NO: 1478927 - protein, 24 aa, Mycobacterium tuberculosis
AALDVARIGSSIGVANSAAAGSTT

SEQ ID NO: 1478928 - protein, 26 aa, Mycobacterium tuberculosis
AALESRTHWFRSWVSKCWSRSLSGDR

SEQ ID NO: 1478929 - protein, 18 aa, Mycobacterium tuberculosis
AALGARRGGVGAVGAVAA

SEQ ID NO: 1478930 - protein, 19 aa, Mycobacterium tuberculosis
AALGRYGRLDGVLVASGSN

SEQ ID NO: 1478931 - protein, 17 aa, Mycobacterium tuberculosis
AALLRYNNSMPYAQNVL

SEQ ID NO: 1478932 - protein, 18 aa, Mycobacterium tuberculosis
AALMDIDTIYVWTHDSIG

SEQ ID NO: 1478933 - protein, 23 aa, Mycobacterium tuberculosis
AALNPPPMFPWMAPDPSAPMPGC

SEQ ID NO: 1478934 - protein, 18 aa, Mycobacterium tuberculosis
AALPDYFVSGGRAVPIPY

SEQ ID NO: 1478935 - protein, 29 aa, Mycobacterium tuberculosis
AALPLRRGPTSWPACRVRHDSRGTRRSSD

SEQ ID NO: 1478936 - protein, 25 aa, Mycobacterium tuberculosis
AALPTAPTSFGWPAGGAWSNDSVSC

SEQ ID NO: 1478937 - protein, 19 aa, Mycobacterium tuberculosis
AALPVLDTRAADTILGYDE

SEQ ID NO: 1478938 - protein, 20 aa, Mycobacterium tuberculosis
AALRRARRTVGHLAGVRRAL

SEQ ID NO: 1478939 - protein, 24 aa, Mycobacterium tuberculosis
AALSAAGYLCWRGKDLATPRGWIT

SEQ ID NO: 1478940 - protein, 25 aa, Mycobacterium tuberculosis
AALSAAGYLCWRGKDLATPRGWITA

SEQ ID NO: 1478941 - protein, 18 aa, Mycobacterium tuberculosis
AALSAEFLSATAPTAPRG

SEQ ID NO: 1478942 - protein, 19 aa, Mycobacterium tuberculosis
AALSGRPFIGNGTNGAPGT

SEQ ID NO: 1478943 - protein, 20 aa, Mycobacterium tuberculosis
AALSRLGRPYVWGATGPNQF

SEQ ID NO: 1478944 - protein, 24 aa, Mycobacterium tuberculosis
AALSTRWCSMRVQLQGSAGGRIET

SEQ ID NO: 1478945 - protein, 17 aa, Mycobacterium tuberculosis
AALVAEFEAVRAAMVQP

SEQ ID NO: 1478946 - protein, 18 aa, Mycobacterium tuberculosis
AALWGRLFATDAAMLDKR

SEQ ID NO: 1478947 - protein, 17 aa, Mycobacterium tuberculosis
AAMAALFSGHAQAYQAL

SEQ ID NO: 1478948 - protein, 24 aa, Mycobacterium tuberculosis
AAMAEAVAPYVAWMSAAATQAEQA

SEQ ID NO: 1478949 - protein, 27 aa, Mycobacterium tuberculosis
AAMAGYHFDASAAVAQLAPWQQVLRNL

SEQ ID NO: 1478950 - protein, 25 aa, Mycobacterium tuberculosis
AAMGPPERRLRCSSTTAADALTSSA

SEQ ID NO: 1478951 - protein, 18 aa, Mycobacterium tuberculosis
AAMIAEFEAVKTAVVQPM

SEQ ID NO: 1478952 - protein, 21 aa, Mycobacterium tuberculosis
AAMLGWPLRTFECTVPPRRLG

SEQ ID NO: 1478953 - protein, 18 aa, Mycobacterium tuberculosis
AANALPLQKAQGVVSELT

SEQ ID NO: 1478954 - protein, 22 aa, Mycobacterium tuberculosis
AANASPMQAVLDVVNGPTQLLL

SEQ ID NO: 1478955 - protein, 26 aa, Mycobacterium tuberculosis
AANFRDIMITLGMFIRTRSWALRPAA

SEQ ID NO: 1478956 - protein, 19 aa, Mycobacterium tuberculosis
AANRARLVALAVSNLLGQN

SEQ ID NO: 1478957 - protein, 17 aa, Mycobacterium tuberculosis
AANRIQLLALIATNFFG

SEQ ID NO: 1478958 - protein, 18 aa, Mycobacterium tuberculosis
AANSWVDVFAHWRRAQGL

SEQ ID NO: 1478959 - protein, 19 aa, Mycobacterium tuberculosis
AANVSAEFAERDQCAHPGT

SEQ ID NO: 1478960 - protein, 18 aa, Mycobacterium tuberculosis
AANYPRLSTLHISARASD

SEQ ID NO: 1478961 - protein, 27 aa, Mycobacterium tuberculosis
AAPAHSAVALPGWAAPAETAARQGRCW

SEQ ID NO: 1478962 - protein, 37 aa, Mycobacterium tuberculosis
AAPAPAAPNGFGGRPAGPADKGGAGGAGISFSNGSNG

SEQ ID NO: 1478963 - protein, 31 aa, Mycobacterium tuberculosis
AAPAPRASSAPTRAMAVRGHGAAENGNAAQG

SEQ ID NO: 1478964 - protein, 19 aa, Mycobacterium tuberculosis
AAPDLPCEVEVDSLEQLDA

SEQ ID NO: 1478965 - protein, 18 aa, Mycobacterium tuberculosis
AAPELAPGRALRCAEAVA

SEQ ID NO: 1478966 - protein, 30 aa, Mycobacterium tuberculosis
AAPFCRSRHGRGWCVGERVGAGQTIATIEA

SEQ ID NO: 1478967 - protein, 23 aa, Mycobacterium tuberculosis
AAPPAPPRPATPPTPPLPPVPPT

SEQ ID NO: 1478968 - protein, 19 aa, Mycobacterium tuberculosis
AAPQCRRIGVPHPSLAVPL

SEQ ID NO: 1478969 - protein, 18 aa, Mycobacterium tuberculosis
AAPSVGLMQPWRFIRITD

SEQ ID NO: 1478970 - protein, 17 aa, Mycobacterium tuberculosis
AAPTSKWSAGKVPAGCG

SEQ ID NO: 1478971 - protein, 18 aa, Mycobacterium tuberculosis
AAPVVRAAPVAAVATAGR

SEQ ID NO: 1478972 - protein, 19 aa, Mycobacterium tuberculosis
AAPYAGWLAAAAARAGGAA

SEQ ID NO: 1478973 - protein, 17 aa, Mycobacterium tuberculosis
AAQAAAMIAEFEAVKTA

SEQ ID NO: 1478974 - protein, 19 aa, Mycobacterium tuberculosis
AAQAGRLGRYVRARPALDV

SEQ ID NO: 1478975 - protein, 21 aa, Mycobacterium tuberculosis
AAQAGRLGRYVRARPALDVVG

SEQ ID NO: 1478976 - protein, 21 aa, Mycobacterium tuberculosis
AAQAIRFAKEFARNATESGGR

SEQ ID NO: 1478977 - protein, 18 aa, Mycobacterium tuberculosis
AAQENWPRVVGACASAAA

SEQ ID NO: 1478978 - protein, 26 aa, Mycobacterium tuberculosis
AAQGLAELGINFGFGNIGSLNLGSGN

SEQ ID NO: 1478979 - protein, 24 aa, Mycobacterium tuberculosis
AAQLASWQPALPNINLGVGNIGNL

SEQ ID NO: 1478980 - protein, 18 aa, Mycobacterium tuberculosis
AAQLPLAPAINYPPPCLT

SEQ ID NO: 1478981 - protein, 24 aa, Mycobacterium tuberculosis
AAQLRSACERRGHPDLAAQHAAAQ

SEQ ID NO: 1478982 - protein, 25 aa, Mycobacterium tuberculosis
AAQPLEWFCLFSSAAALVGSPGQGA

SEQ ID NO: 1478983 - protein, 26 aa, Mycobacterium tuberculosis
AAQPLEWFCLFSSAAALVGSPGQGAY

SEQ ID NO: 1478984 - protein, 24 aa, Mycobacterium tuberculosis
AAQRAGLELLAFGGRFRRNRQGRR

SEQ ID NO: 1478985 - protein, 23 aa, Mycobacterium tuberculosis
AAQRLASCGAREVIVTNTLPIGE

SEQ ID NO: 1478986 - protein, 18 aa, Mycobacterium tuberculosis
AARADGWMHGGGDPDELD

SEQ ID NO: 1478987 - protein, 26 aa, Mycobacterium tuberculosis
AARALTPPALVARVVEALRDGYAAVV

SEQ ID NO: 1478988 - protein, 28 aa, Mycobacterium tuberculosis
AARARDGGIPLTARMVFEHPVLCELAAA

SEQ ID NO: 1478989 - protein, 18 aa, Mycobacterium tuberculosis
AARAVSWPAVTSPAGPVT

SEQ ID NO: 1478990 - protein, 26 aa, Mycobacterium tuberculosis
AARDFAAEAAFVFAMIAVDLSRLAED

SEQ ID NO: 1478991 - protein, 17 aa, Mycobacterium tuberculosis
AARFVRTCDCFNIPIVM

SEQ ID NO: 1478992 - protein, 19 aa, Mycobacterium tuberculosis
AARHWGVSASRARAILSSR

SEQ ID NO: 1478993 - protein, 26 aa, Mycobacterium tuberculosis
AARPTGAFGRLLGRIWRAETADVNRI

SEQ ID NO: 1478994 - protein, 19 aa, Mycobacterium tuberculosis
AARQPQPVCEPWQPCGSAA

SEQ ID NO: 1478995 - protein, 24 aa, Mycobacterium tuberculosis
AARRADIAIVFALRAEGEGFDSAD

SEQ ID NO: 1478996 - protein, 18 aa, Mycobacterium tuberculosis
AARRAIVPLCALLPTAFR

SEQ ID NO: 1478997 - protein, 23 aa, Mycobacterium tuberculosis
AARRFLPGATILKASVGPMDNNA

SEQ ID NO: 1478998 - protein, 24 aa, Mycobacterium tuberculosis
AARRFLPGATILKASVGPMDNNAY

SEQ ID NO: 1478999 - protein, 20 aa, Mycobacterium tuberculosis
AARSAWPCALDYARQRTQFG

SEQ ID NO: 1479000 - protein, 20 aa, Mycobacterium tuberculosis
AARTRYFDAFFRDATSAGIR

SEQ ID NO: 1479001 - protein, 23 aa, Mycobacterium tuberculosis
AARYLCSGGLNLRDPAQVMAALL

SEQ ID NO: 1479002 - protein, 24 aa, Mycobacterium tuberculosis
AARYLCSGGLNLRDPAQVMAALLR

SEQ ID NO: 1479003 - protein, 28 aa, Mycobacterium tuberculosis
AASAARGWRRRGWIVAIDRHFQRRRHPR

SEQ ID NO: 1479004 - protein, 24 aa, Mycobacterium tuberculosis
AASDFWGGAGSAACQGFITQLGRN

SEQ ID NO: 1479005 - protein, 20 aa, Mycobacterium tuberculosis
AASDVARIGSSIGAANAAAA

SEQ ID NO: 1479006 - protein, 22 aa, Mycobacterium tuberculosis
AASDVARIGSSIGAANAAAAGS

SEQ ID NO: 1479007 - protein, 18 aa, Mycobacterium tuberculosis
AASDVVAWVRIQLAADGV

SEQ ID NO: 1479008 - protein, 22 aa, Mycobacterium tuberculosis
AASGRPGAVLVDIPKDVLQGQC

SEQ ID NO: 1479009 - protein, 19 aa, Mycobacterium tuberculosis
AASLRVALARVHPRATGIV

SEQ ID NO: 1479010 - protein, 19 aa, Mycobacterium tuberculosis
AASMGEFLLAAGTKGKRYA

SEQ ID NO: 1479011 - protein, 29 aa, Mycobacterium tuberculosis
AASPAKPSPWMRIGAGSVHPVTATRTSCS

SEQ ID NO: 1479012 - protein, 17 aa, Mycobacterium tuberculosis
AASRLAGAYGEHAAAEI

SEQ ID NO: 1479013 - protein, 24 aa, Mycobacterium tuberculosis
AASRLWARAPAVPAVPRAPFSRST

SEQ ID NO: 1479014 - protein, 24 aa, Mycobacterium tuberculosis
AASSVRLLDTIGLVSDAEHNMIVM

SEQ ID NO: 1479015 - protein, 20 aa, Mycobacterium tuberculosis
AASVFARRVPLAAAVWTQRG

SEQ ID NO: 1479016 - protein, 19 aa, Mycobacterium tuberculosis
AASWQRLRTAPATVPLARC

SEQ ID NO: 1479017 - protein, 17 aa, Mycobacterium tuberculosis
AATAALFSAYGREYQAV

SEQ ID NO: 1479018 - protein, 19 aa, Mycobacterium tuberculosis
AATAARLRRCTGASRHLLL

SEQ ID NO: 1479019 - protein, 24 aa, Mycobacterium tuberculosis
AATAARVAPQASPAVAGGAAGLIG

SEQ ID NO: 1479020 - protein, 19 aa, Mycobacterium tuberculosis
AATDQIRLRRAMNLLPASH

SEQ ID NO: 1479021 - protein, 25 aa, Mycobacterium tuberculosis
AATFGVAYLTAWHPAVRGRAPIPRR

SEQ ID NO: 1479022 - protein, 22 aa, Mycobacterium tuberculosis
AATMRRAWTMLALPWPALQRRR

SEQ ID NO: 1479023 - protein, 22 aa, Mycobacterium tuberculosis
AATNLAEIGSAISTANGAAALP

SEQ ID NO: 1479024 - protein, 22 aa, Mycobacterium tuberculosis
AATRGGWRAGGVRDGRIGTLVP

SEQ ID NO: 1479025 - protein, 23 aa, Mycobacterium tuberculosis
AATSTWPDMKIVNNIEVTGQAPP

SEQ ID NO: 1479026 - protein, 24 aa, Mycobacterium tuberculosis
AATSTWPDMKIVNNIEVTGQAPPG

SEQ ID NO: 1479027 - protein, 35 aa, Mycobacterium tuberculosis
AATTRAWPASPWATPSRCSPRWAPTSAAGSARLPC

SEQ ID NO: 1479028 - protein, 24 aa, Mycobacterium tuberculosis
AATTRAWPGFAVGLHPPAVHPRWA

SEQ ID NO: 1479029 - protein, 27 aa, Mycobacterium tuberculosis
AAVAANREAFLALIRSNWLGLNAPWIA

SEQ ID NO: 1479030 - protein, 24 aa, Mycobacterium tuberculosis
AAVAPSGAVLPVWGEALDEICSSE

SEQ ID NO: 1479031 - protein, 18 aa, Mycobacterium tuberculosis
AAVDLALRRLVRSPLSRE

SEQ ID NO: 1479032 - protein, 20 aa, Mycobacterium tuberculosis
AAVEGLKAIVLLANGADTYA

SEQ ID NO: 1479033 - protein, 18 aa, Mycobacterium tuberculosis
AAVMAAVFGENGAIDVFS

SEQ ID NO: 1479034 - protein, 25 aa, Mycobacterium tuberculosis
AAVNDLRLALGLMLEIGPRGPERLP

SEQ ID NO: 1479035 - protein, 24 aa, Mycobacterium tuberculosis
AAVNDLRLALGVMLEIGPRGPERL

SEQ ID NO: 1479036 - protein, 18 aa, Mycobacterium tuberculosis
AAVPVAFLTAFYGLSVLA

SEQ ID NO: 1479037 - protein, 17 aa, Mycobacterium tuberculosis
AAVQIAFALRAGANRYA

SEQ ID NO: 1479038 - protein, 17 aa, Mycobacterium tuberculosis
AAVQLARQWGVEVFVTA

SEQ ID NO: 1479039 - protein, 17 aa, Mycobacterium tuberculosis
AAVRAELAKRGWVPSPQ

SEQ ID NO: 1479040 - protein, 17 aa, Mycobacterium tuberculosis
AAVRGRRRSKRMAKSVT

SEQ ID NO: 1479041 - protein, 18 aa, Mycobacterium tuberculosis
AAVRRLGHAAGLRVPPAA

SEQ ID NO: 1479042 - protein, 26 aa, Mycobacterium tuberculosis
AAVRSPRPVRPGRVTGVAIAPPPTNN

SEQ ID NO: 1479043 - protein, 17 aa, Mycobacterium tuberculosis
AAVSGLVTALFGAPGQP

SEQ ID NO: 1479044 - protein, 19 aa, Mycobacterium tuberculosis
AAVSLARYWGAEVFVTASR

SEQ ID NO: 1479045 - protein, 18 aa, Mycobacterium tuberculosis
AAVSRLFGAYGQQFQALN

SEQ ID NO: 1479046 - protein, 19 aa, Mycobacterium tuberculosis
AAVSRLFGAYGQQFQALNA

SEQ ID NO: 1479047 - protein, 18 aa, Mycobacterium tuberculosis
AAVTEIRAALTALGMLDH

SEQ ID NO: 1479048 - protein, 18 aa, Mycobacterium tuberculosis
AAVTRYFAAYNLVCGPVV

SEQ ID NO: 1479049 - protein, 20 aa, Mycobacterium tuberculosis
AAWHIAELPAAAGRDADGIL

SEQ ID NO: 1479050 - protein, 18 aa, Mycobacterium tuberculosis
AAWQRSGLQRRWLAASEH

SEQ ID NO: 1479051 - protein, 21 aa, Mycobacterium tuberculosis
AAYETAYRLTVPPPVIAENRT

SEQ ID NO: 1479052 - protein, 24 aa, Mycobacterium tuberculosis
AAYPDRFLLGIGVGHAEMISEYRK

SEQ ID NO: 1479053 - protein, 24 aa, Mycobacterium tuberculosis
AAYPGRFLLGIGVGHAEMISEYRK

SEQ ID NO: 1479054 - protein, 17 aa, Mycobacterium tuberculosis
AAYQERFVLALSQASST

SEQ ID NO: 1479055 - protein, 21 aa, Mycobacterium tuberculosis
AAYRRRLCRESAKARNVDRVV

SEQ ID NO: 1479056 - protein, 19 aa, Mycobacterium tuberculosis
ACALELQLSTLAPMRPRVG

SEQ ID NO: 1479057 - protein, 18 aa, Mycobacterium tuberculosis
ACALVGRPQLVFLDEPIA

SEQ ID NO: 1479058 - protein, 20 aa, Mycobacterium tuberculosis
ACAWLASAIETAYCAPPPVR

SEQ ID NO: 1479059 - protein, 21 aa, Mycobacterium tuberculosis
ACAWLASAIETAYCAPPPVRR

SEQ ID NO: 1479060 - protein, 25 aa, Mycobacterium tuberculosis
ACDVPSLGWRVYRLVPRRRGARLGI

SEQ ID NO: 1479061 - protein, 17 aa, Mycobacterium tuberculosis
ACECPSGCPSCVQSPKC

SEQ ID NO: 1479062 - protein, 20 aa, Mycobacterium tuberculosis
ACLDAGVKVGCFRPPTVPAG

SEQ ID NO: 1479063 - protein, 18 aa, Mycobacterium tuberculosis
ACLPERFADVMRVTADVL

SEQ ID NO: 1479064 - protein, 25 aa, Mycobacterium tuberculosis
ACLSEARYGIVWGAMGAARSAWPCA

SEQ ID NO: 1479065 - protein, 17 aa, Mycobacterium tuberculosis
ACNTARCVDYVGAGTVE

SEQ ID NO: 1479066 - protein, 20 aa, Mycobacterium tuberculosis
ACPECSGLGIRKEVDPELVV

SEQ ID NO: 1479067 - protein, 19 aa, Mycobacterium tuberculosis
ACQAGHRVLFATASQWVDR

SEQ ID NO: 1479068 - protein, 20 aa, Mycobacterium tuberculosis
ACSTSAFGVDGARRQRRRGR

SEQ ID NO: 1479069 - protein, 27 aa, Mycobacterium tuberculosis
ACSTVAAFAAIAARPASPGGAAVGGAA

SEQ ID NO: 1479070 - protein, 24 aa, Mycobacterium tuberculosis
ACWRQCRPAVLSAAWFEPASTDLI

SEQ ID NO: 1479071 - protein, 18 aa, Mycobacterium tuberculosis
ADAAYVCRGRVCDLPVTS

SEQ ID NO: 1479072 - protein, 19 aa, Mycobacterium tuberculosis
ADAAYVCRGRVCDLPVTSA

SEQ ID NO: 1479073 - protein, 18 aa, Mycobacterium tuberculosis
ADAGWKYLSTGAYAGSLD

SEQ ID NO: 1479074 - protein, 19 aa, Mycobacterium tuberculosis
ADALHAWLVDGRRALVTAE

SEQ ID NO: 1479075 - protein, 17 aa, Mycobacterium tuberculosis
ADARLGVTLALSLHAPD

SEQ ID NO: 1479076 - protein, 17 aa, Mycobacterium tuberculosis
ADARPGPDQPMRRSNSC

SEQ ID NO: 1479077 - protein, 22 aa, Mycobacterium tuberculosis
ADARRLAPGGAIVVGDAAGSSA

SEQ ID NO: 1479078 - protein, 23 aa, Mycobacterium tuberculosis
ADARRPDRLAARRTGVSGGGPGR

SEQ ID NO: 1479079 - protein, 17 aa, Mycobacterium tuberculosis
ADARRVGFGVGVDAAAG

SEQ ID NO: 1479080 - protein, 24 aa, Mycobacterium tuberculosis
ADARSSAAVSGWWCSSRWRPAIDA

SEQ ID NO: 1479081 - protein, 21 aa, Mycobacterium tuberculosis
ADCQLVCPGSGIAEGAVNARH

SEQ ID NO: 1479082 - protein, 25 aa, Mycobacterium tuberculosis
ADDDCAPGWVWSPDLNQCVFWLPAV

SEQ ID NO: 1479083 - protein, 18 aa, Mycobacterium tuberculosis
ADDPRRVALLAVHTSPLA

SEQ ID NO: 1479084 - protein, 21 aa, Mycobacterium tuberculosis
ADDRGRFGAVMAQQLTQRDLD

SEQ ID NO: 1479085 - protein, 23 aa, Mycobacterium tuberculosis
ADDRYAFSFSGLKTAVARYVESH

SEQ ID NO: 1479086 - protein, 29 aa, Mycobacterium tuberculosis
ADDVPRGISFLLNRNRLNVAVSRAQYAAV

SEQ ID NO: 1479087 - protein, 21 aa, Mycobacterium tuberculosis
ADDVVVAWPHRYLAAQAEAGG

SEQ ID NO: 1479088 - protein, 21 aa, Mycobacterium tuberculosis
ADEAWRRGPLVALDRLVGPDT

SEQ ID NO: 1479089 - protein, 20 aa, Mycobacterium tuberculosis
ADELSGLFVPTDVCDEDAVN

SEQ ID NO: 1479090 - protein, 21 aa, Mycobacterium tuberculosis
ADELSGLFVPTDVCDEDAVNG

SEQ ID NO: 1479091 - protein, 17 aa, Mycobacterium tuberculosis
ADERPELVSALVVEDMA

SEQ ID NO: 1479092 - protein, 18 aa, Mycobacterium tuberculosis
ADESMLLSFERWAPDMGW

SEQ ID NO: 1479093 - protein, 25 aa, Mycobacterium tuberculosis
ADEVSAAVAALFGSYAQSYQAFGAQ

SEQ ID NO: 1479094 - protein, 23 aa, Mycobacterium tuberculosis
ADEVSAAVAAVFSSYAQQYQALS

SEQ ID NO: 1479095 - protein, 33 aa, Mycobacterium tuberculosis
ADEVSAAVSRLFGAYGQQFQALNARAATFHAEF

SEQ ID NO: 1479096 - protein, 27 aa, Mycobacterium tuberculosis
ADEVSIAVAALFGMHGQAYQALSVQAS

SEQ ID NO: 1479097 - protein, 28 aa, Mycobacterium tuberculosis
ADEVSQAIARLFSDYATHYQSLNAQAAA

SEQ ID NO: 1479098 - protein, 24 aa, Mycobacterium tuberculosis
ADEVSTAVAALFGAHGQAYQALSA

SEQ ID NO: 1479099 - protein, 17 aa, Mycobacterium tuberculosis
ADFKRLVTDWQLKGEKP

SEQ ID NO: 1479100 - protein, 18 aa, Mycobacterium tuberculosis
ADGCELVLVLGGDGTFLR

SEQ ID NO: 1479101 - protein, 19 aa, Mycobacterium tuberculosis
ADGDFACRYQPRSPRCRPP

SEQ ID NO: 1479102 - protein, 18 aa, Mycobacterium tuberculosis
ADGFAIRALYTAFDELPE

SEQ ID NO: 1479103 - protein, 24 aa, Mycobacterium tuberculosis
ADGGLLLPLGVRRLRSYGSARHAR

SEQ ID NO: 1479104 - protein, 18 aa, Mycobacterium tuberculosis
ADGGRDEQLLLLPLTSLR

SEQ ID NO: 1479105 - protein, 18 aa, Mycobacterium tuberculosis
ADGHYRIGLRPSGNGPTA

SEQ ID NO: 1479106 - protein, 17 aa, Mycobacterium tuberculosis
ADGIAGAVDAYWNWQQR

SEQ ID NO: 1479107 - protein, 18 aa, Mycobacterium tuberculosis
ADGIGGAVDAYWNWQNSR

SEQ ID NO: 1479108 - protein, 25 aa, Mycobacterium tuberculosis
ADGLDDCFRLLAGGVRGAVQRQQTL

SEQ ID NO: 1479109 - protein, 20 aa, Mycobacterium tuberculosis
ADGLFGVSGSSGLGGAAGSG

SEQ ID NO: 1479110 - protein, 17 aa, Mycobacterium tuberculosis
ADGLLRPGATILEPTSG

SEQ ID NO: 1479111 - protein, 18 aa, Mycobacterium tuberculosis
ADGLLRPGATILEPTSGN

SEQ ID NO: 1479112 - protein, 17 aa, Mycobacterium tuberculosis
ADGLPAYGSCAGMILLA

SEQ ID NO: 1479113 - protein, 25 aa, Mycobacterium tuberculosis
ADGMFPPMHIDAEYNADGSLRKPGQ

SEQ ID NO: 1479114 - protein, 17 aa, Mycobacterium tuberculosis
ADGRGECEFIIRLLPDG

SEQ ID NO: 1479115 - protein, 19 aa, Mycobacterium tuberculosis
ADGSYSLTGHKWFTSAPMC

SEQ ID NO: 1479116 - protein, 22 aa, Mycobacterium tuberculosis
ADGVGHPFWFSRTVFGELARLH

SEQ ID NO: 1479117 - protein, 17 aa, Mycobacterium tuberculosis
ADGVLAAGAIVRVEVAH

SEQ ID NO: 1479118 - protein, 18 aa, Mycobacterium tuberculosis
ADHPSCDAWDVAITAATA

SEQ ID NO: 1479119 - protein, 24 aa, Mycobacterium tuberculosis
ADHVVNGVVLFPGAGFVELVIRAG

SEQ ID NO: 1479120 - protein, 23 aa, Mycobacterium tuberculosis
ADIAGARVKQADVETARVGAADA

SEQ ID NO: 1479121 - protein, 17 aa, Mycobacterium tuberculosis
ADIALVVADAGWKYLST

SEQ ID NO: 1479122 - protein, 17 aa, Mycobacterium tuberculosis
ADIASAVAFLVSDAASW

SEQ ID NO: 1479123 - protein, 19 aa, Mycobacterium tuberculosis
ADILRPVADRLWYPLWDAN

SEQ ID NO: 1479124 - protein, 19 aa, Mycobacterium tuberculosis
ADIRFGSYRLFSLDAAPGP

SEQ ID NO: 1479125 - protein, 18 aa, Mycobacterium tuberculosis
ADISFGSAVAVIGLGAVG

SEQ ID NO: 1479126 - protein, 18 aa, Mycobacterium tuberculosis
ADKAGCCTATAARAATAG

SEQ ID NO: 1479127 - protein, 24 aa, Mycobacterium tuberculosis
ADKVLGYRNWLGLNKGDLAAAVDK

SEQ ID NO: 1479128 - protein, 17 aa, Mycobacterium tuberculosis
ADLADLFMLIFTSGTSG

SEQ ID NO: 1479129 - protein, 26 aa, Mycobacterium tuberculosis
ADLARPWLAEAVGLARAVGDKWRLAE

SEQ ID NO: 1479130 - protein, 28 aa, Mycobacterium tuberculosis
ADLARPWLAEAVGLARAVGDKWRLAEVL

SEQ ID NO: 1479131 - protein, 20 aa, Mycobacterium tuberculosis
ADLAYFRVLIHSTRNRALGL

SEQ ID NO: 1479132 - protein, 26 aa, Mycobacterium tuberculosis
ADLHAAPSQWSWRPWSLTVDVEPGPL

SEQ ID NO: 1479133 - protein, 20 aa, Mycobacterium tuberculosis
ADLHMIGKDIIRFHAVYWPA

SEQ ID NO: 1479134 - protein, 17 aa, Mycobacterium tuberculosis
ADLIARVRAQQSMLGAD

SEQ ID NO: 1479135 - protein, 18 aa, Mycobacterium tuberculosis
ADLIARVRAQQSMLGADL

SEQ ID NO: 1479136 - protein, 24 aa, Mycobacterium tuberculosis
ADLIGRGCAQYVAQNPTGPGSVAG

SEQ ID NO: 1479137 - protein, 22 aa, Mycobacterium tuberculosis
ADLPARLSLFGHTRLACTDVQL

SEQ ID NO: 1479138 - protein, 22 aa, Mycobacterium tuberculosis
ADLPQRILAGAGVTEADLVQPH

SEQ ID NO: 1479139 - protein, 19 aa, Mycobacterium tuberculosis
ADLRAIRAHQDCMEARTDA

SEQ ID NO: 1479140 - protein, 18 aa, Mycobacterium tuberculosis
ADLRHWLIDYLVTNIGCT

SEQ ID NO: 1479141 - protein, 20 aa, Mycobacterium tuberculosis
ADLRHWLIDYLVTNIGCTPD

SEQ ID NO: 1479142 - protein, 17 aa, Mycobacterium tuberculosis
ADLVSYARWGRACGRRW

SEQ ID NO: 1479143 - protein, 18 aa, Mycobacterium tuberculosis
ADMAMKVEAARLMVYSAA

SEQ ID NO: 1479144 - protein, 18 aa, Mycobacterium tuberculosis
ADPELKSTGFARDLADYI

SEQ ID NO: 1479145 - protein, 26 aa, Mycobacterium tuberculosis
ADPERTAELATRFGVESSIARLQKAL

SEQ ID NO: 1479146 - protein, 20 aa, Mycobacterium tuberculosis
ADPGGLFPIPGAGGKGGTGG

SEQ ID NO: 1479147 - protein, 20 aa, Mycobacterium tuberculosis
ADPGNPLAILVPLTAAAMDL

SEQ ID NO: 1479148 - protein, 21 aa, Mycobacterium tuberculosis
ADPMVREWLTVLLRRDLGLLV

SEQ ID NO: 1479149 - protein, 21 aa, Mycobacterium tuberculosis
ADPQLALELGVHFLSGSVVVV

SEQ ID NO: 1479150 - protein, 17 aa, Mycobacterium tuberculosis
ADPRAWLTTVVSRLGLD

SEQ ID NO: 1479151 - protein, 27 aa, Mycobacterium tuberculosis
ADPRLPRSRRWLLNLVITRGTPPRLEG

SEQ ID NO: 1479152 - protein, 24 aa, Mycobacterium tuberculosis
ADPRSNLARYGIAPTYPGDFAADV

SEQ ID NO: 1479153 - protein, 25 aa, Mycobacterium tuberculosis
ADQARAALASGAARGTRAADAAGTA

SEQ ID NO: 1479154 - protein, 28 aa, Mycobacterium tuberculosis
ADQARTIRIPVHMVEVINKLGRIQRELL

SEQ ID NO: 1479155 - protein, 17 aa, Mycobacterium tuberculosis
ADQPLDWFCSFSSAAAL

SEQ ID NO: 1479156 - protein, 17 aa, Mycobacterium tuberculosis
ADQPLDWFCSFSSAAAR

SEQ ID NO: 1479157 - protein, 25 aa, Mycobacterium tuberculosis
ADQRADWACDFWDCAAAEVAAALTI

SEQ ID NO: 1479158 - protein, 19 aa, Mycobacterium tuberculosis
ADRFNWLLMTIRLSISSLA

SEQ ID NO: 1479159 - protein, 20 aa, Mycobacterium tuberculosis
ADRGPVLLITAVHRDFASTD

SEQ ID NO: 1479160 - protein, 17 aa, Mycobacterium tuberculosis
ADRGRTGVFSLDARQWF

SEQ ID NO: 1479161 - protein, 25 aa, Mycobacterium tuberculosis
ADRHGRPLLRHRVELGAGSLADDVI

SEQ ID NO: 1479162 - protein, 22 aa, Mycobacterium tuberculosis
ADRLWLRGGLPPSFTARSNEDS

SEQ ID NO: 1479163 - protein, 17 aa, Mycobacterium tuberculosis
ADRPARTVAGVATAVRW

SEQ ID NO: 1479164 - protein, 18 aa, Mycobacterium tuberculosis
ADRRAAGRLGRRPRTRAG

SEQ ID NO: 1479165 - protein, 22 aa, Mycobacterium tuberculosis
ADRRAGGELARYVTAKEPWFLD

SEQ ID NO: 1479166 - protein, 26 aa, Mycobacterium tuberculosis
ADRREGLARWLARWRPCTPPVESFYS

SEQ ID NO: 1479167 - protein, 22 aa, Mycobacterium tuberculosis
ADRRIPTWASRVVSGLARDRPV

SEQ ID NO: 1479168 - protein, 17 aa, Mycobacterium tuberculosis
ADRSWGQRIREYTKPLV

SEQ ID NO: 1479169 - protein, 17 aa, Mycobacterium tuberculosis
ADSLFFASGQLRELAYS

SEQ ID NO: 1479170 - protein, 17 aa, Mycobacterium tuberculosis
ADSVLGVAGLVNAARAG

SEQ ID NO: 1479171 - protein, 18 aa, Mycobacterium tuberculosis
ADTATGLRGFARSTTAMD

SEQ ID NO: 1479172 - protein, 17 aa, Mycobacterium tuberculosis
ADTGCLRSLLSSPSQVN

SEQ ID NO: 1479173 - protein, 19 aa, Mycobacterium tuberculosis
ADTLGYISLRGMVAASEQP

SEQ ID NO: 1479174 - protein, 17 aa, Mycobacterium tuberculosis
ADTQVRKAILGLLDVDL

SEQ ID NO: 1479175 - protein, 22 aa, Mycobacterium tuberculosis
ADTRGGQLLVYGVDPLILRQAY

SEQ ID NO: 1479176 - protein, 19 aa, Mycobacterium tuberculosis
ADTWISTDYLFWRDDDGDY

SEQ ID NO: 1479177 - protein, 25 aa, Mycobacterium tuberculosis
ADVADFGCGSGRAVKLMAQAFGASR

SEQ ID NO: 1479178 - protein, 19 aa, Mycobacterium tuberculosis
ADVALDIGRSVGCSAYEND

SEQ ID NO: 1479179 - protein, 21 aa, Mycobacterium tuberculosis
ADVARLRERWEQIEAKAQETK

SEQ ID NO: 1479180 - protein, 21 aa, Mycobacterium tuberculosis
ADVEASGLWPGKVVTEVSPAG

SEQ ID NO: 1479181 - protein, 17 aa, Mycobacterium tuberculosis
ADVFAAFGENIELLKRL

SEQ ID NO: 1479182 - protein, 18 aa, Mycobacterium tuberculosis
ADVGRAQFFKDLGVEMIN

SEQ ID NO: 1479183 - protein, 30 aa, Mycobacterium tuberculosis
ADVLDRAWPANGPGWWPGEFRGAGQRIPRR

SEQ ID NO: 1479184 - protein, 22 aa, Mycobacterium tuberculosis
ADVLIAFGRYPSFEGHLPQLGT

SEQ ID NO: 1479185 - protein, 17 aa, Mycobacterium tuberculosis
ADVPFFVTLCKTLGKPV

SEQ ID NO: 1479186 - protein, 17 aa, Mycobacterium tuberculosis
ADVPGLIPGASRGRGLG

SEQ ID NO: 1479187 - protein, 20 aa, Mycobacterium tuberculosis
ADVPGLIPGASRGRGLGLDF

SEQ ID NO: 1479188 - protein, 18 aa, Mycobacterium tuberculosis
ADVPGRWSAETRLALVRR

SEQ ID NO: 1479189 - protein, 34 aa, Mycobacterium tuberculosis
ADVRVAHPLISRAHLLLRFDQGRWVAIDNGSLNG

SEQ ID NO: 1479190 - protein, 23 aa, Mycobacterium tuberculosis
ADVSLPVVRAFIHRIKERAAGPR

SEQ ID NO: 1479191 - protein, 23 aa, Mycobacterium tuberculosis
ADVSLPVVRAFIHRIKERARGPR

SEQ ID NO: 1479192 - protein, 19 aa, Mycobacterium tuberculosis
ADVSSEIDPITVLRPIHIP

SEQ ID NO: 1479193 - protein, 26 aa, Mycobacterium tuberculosis
ADVVDCVDGGMRLNILYMRSPLITTF

SEQ ID NO: 1479194 - protein, 17 aa, Mycobacterium tuberculosis
ADVYLCGPVAMVDAART

SEQ ID NO: 1479195 - protein, 33 aa, Mycobacterium tuberculosis
ADYHARNPLRFAAPCPGQHGWRAPAAAAPPLDQ

SEQ ID NO: 1479196 - protein, 23 aa, Mycobacterium tuberculosis
ADYPTVLLSGAWLSQEQTSAASA

SEQ ID NO: 1479197 - protein, 22 aa, Mycobacterium tuberculosis
AEAAAAAPLEGLLNIVNTPTQL

SEQ ID NO: 1479198 - protein, 21 aa, Mycobacterium tuberculosis
AEAAAFHGRFVQALTTGGGAY

SEQ ID NO: 1479199 - protein, 20 aa, Mycobacterium tuberculosis
AEAAAVYDLFVKTLGVSAGT

SEQ ID NO: 1479200 - protein, 21 aa, Mycobacterium tuberculosis
AEAALLRLVEERHIPVLMNGM

SEQ ID NO: 1479201 - protein, 19 aa, Mycobacterium tuberculosis
AEAALQCPATRAVLNSVRA

SEQ ID NO: 1479202 - protein, 23 aa, Mycobacterium tuberculosis
AEAANAGPNMLAAVNAPAQALLG

SEQ ID NO: 1479203 - protein, 20 aa, Mycobacterium tuberculosis
AEAAPVMRAVASVLPGTGAA

SEQ ID NO: 1479204 - protein, 27 aa, Mycobacterium tuberculosis
AEAEIACGRASAVIAELEALTFEPPPT

SEQ ID NO: 1479205 - protein, 25 aa, Mycobacterium tuberculosis
AEAEPAAWLRFWFPDPNGSNTEFQR

SEQ ID NO: 1479206 - protein, 23 aa, Mycobacterium tuberculosis
AEAIRASGLSAGIVDAGLSRGLA

SEQ ID NO: 1479207 - protein, 23 aa, Mycobacterium tuberculosis
AEAKARRGPLCLGIDPHPELLRG

SEQ ID NO: 1479208 - protein, 21 aa, Mycobacterium tuberculosis
AEAKYAAKRVRRWMRRRYLLL

SEQ ID NO: 1479209 - protein, 17 aa, Mycobacterium tuberculosis
AEALDWVRARNKPTTAA

SEQ ID NO: 1479210 - protein, 18 aa, Mycobacterium tuberculosis
AEALEMKDLLVVGDIPGF

SEQ ID NO: 1479211 - protein, 25 aa, Mycobacterium tuberculosis
AEALGEHVFDFFLRNKRTEWANYRS

SEQ ID NO: 1479212 - protein, 24 aa, Mycobacterium tuberculosis
AEALGKIYAGMGIVRHPEIREVRR

SEQ ID NO: 1479213 - protein, 24 aa, Mycobacterium tuberculosis
AEALTSLPGVGVWTAAETTQRVFG

SEQ ID NO: 1479214 - protein, 17 aa, Mycobacterium tuberculosis
AEAMYLTSGYVYGSAAV

SEQ ID NO: 1479215 - protein, 18 aa, Mycobacterium tuberculosis
AEANAAFEEARRRFEASW

SEQ ID NO: 1479216 - protein, 26 aa, Mycobacterium tuberculosis
AEAPARAYNPLFIWGESGLGKTHLLH

SEQ ID NO: 1479217 - protein, 19 aa, Mycobacterium tuberculosis
AEAQVEQQLLAAINAPTQA

SEQ ID NO: 1479218 - protein, 26 aa, Mycobacterium tuberculosis
AEARRVGRRFARLAPIVATHRKLTSA

SEQ ID NO: 1479219 - protein, 36 aa, Mycobacterium tuberculosis
AEARSVRSPGRWAAIPRWPTWWLTGSATKVVARSGG

SEQ ID NO: 1479220 - protein, 17 aa, Mycobacterium tuberculosis
AEARTTVLLDEIVTLVG

SEQ ID NO: 1479221 - protein, 19 aa, Mycobacterium tuberculosis
AEASVPVFTVRLADHPSCD

SEQ ID NO: 1479222 - protein, 25 aa, Mycobacterium tuberculosis
AEAVARLRRAGAIIMGKTNMPTGNQ

SEQ ID NO: 1479223 - protein, 18 aa, Mycobacterium tuberculosis
AEAVRPGARLILVGDADQ

SEQ ID NO: 1479224 - protein, 18 aa, Mycobacterium tuberculosis
AECRWIRENLGVDVPVHF

SEQ ID NO: 1479225 - protein, 22 aa, Mycobacterium tuberculosis
AEEFFDLIWRLMRFDKHGPLDL

SEQ ID NO: 1479226 - protein, 17 aa, Mycobacterium tuberculosis
AEELILLATRFSEFAVH

SEQ ID NO: 1479227 - protein, 20 aa, Mycobacterium tuberculosis
AEELRPGDIIEVRTHEVVPA

SEQ ID NO: 1479228 - protein, 25 aa, Mycobacterium tuberculosis
AEEVREYLAQLGFRTVNEAVGQAGA

SEQ ID NO: 1479229 - protein, 24 aa, Mycobacterium tuberculosis
AEFAELRSAAPIWWNGQDPGKGGG

SEQ ID NO: 1479230 - protein, 17 aa, Mycobacterium tuberculosis
AEFALHTPILGSEGLGG

SEQ ID NO: 1479231 - protein, 23 aa, Mycobacterium tuberculosis
AEFDRAGADIVLLDLMLPGMSGT

SEQ ID NO: 1479232 - protein, 21 aa, Mycobacterium tuberculosis
AEFGCKEALFTLGDRPEARWR

SEQ ID NO: 1479233 - protein, 18 aa, Mycobacterium tuberculosis
AEGADVVQIFLGNPQSWK

SEQ ID NO: 1479234 - protein, 18 aa, Mycobacterium tuberculosis
AEGARLKDAFVYPETMPA

SEQ ID NO: 1479235 - protein, 18 aa, Mycobacterium tuberculosis
AEGAWRRDDVTALSTASL

SEQ ID NO: 1479236 - protein, 24 aa, Mycobacterium tuberculosis
AEGDLLDLGNCYGRDGPGQRDGLV

SEQ ID NO: 1479237 - protein, 23 aa, Mycobacterium tuberculosis
AEGGAAYAAGPARAEQPTGAAGP

SEQ ID NO: 1479238 - protein, 25 aa, Mycobacterium tuberculosis
AEGISVNVTLIFSVQRYREVMDAYL

SEQ ID NO: 1479239 - protein, 17 aa, Mycobacterium tuberculosis
AEGLDVADGARLVDSVE

SEQ ID NO: 1479240 - protein, 19 aa, Mycobacterium tuberculosis
AEGPRRAAVSSFGLGGTNA

SEQ ID NO: 1479241 - protein, 25 aa, Mycobacterium tuberculosis
AEGSTHAFGGMPLMGSGAGRAFNNF

SEQ ID NO: 1479242 - protein, 28 aa, Mycobacterium tuberculosis
AEGVRLLRSGGVIVVHRAALGGRAGDPG

SEQ ID NO: 1479243 - protein, 18 aa, Mycobacterium tuberculosis
AEIACGRADSVISELEEL

SEQ ID NO: 1479244 - protein, 20 aa, Mycobacterium tuberculosis
AEIAESLLANTVIEDWTISR

SEQ ID NO: 1479245 - protein, 23 aa, Mycobacterium tuberculosis
AEIDARLRLVVGRRGDLADQESL

SEQ ID NO: 1479246 - protein, 17 aa, Mycobacterium tuberculosis
AEIDAVCELIDFWRFNV

SEQ ID NO: 1479247 - protein, 21 aa, Mycobacterium tuberculosis
AEIYRRSFAVIRAEADLARFP

SEQ ID NO: 1479248 - protein, 23 aa, Mycobacterium tuberculosis
AEKSGKSLPVFTFGEETGMTEFH

SEQ ID NO: 1479249 - protein, 19 aa, Mycobacterium tuberculosis
AEKVRDTFDLARHRAPSAS

SEQ ID NO: 1479250 - protein, 18 aa, Mycobacterium tuberculosis
AELAEAFHAAGRCTVEAN

SEQ ID NO: 1479251 - protein, 17 aa, Mycobacterium tuberculosis
AELAHRINAERALNDAY

SEQ ID NO: 1479252 - protein, 24 aa, Mycobacterium tuberculosis
AELALRLAEHGLRDERLADILTRY

SEQ ID NO: 1479253 - protein, 18 aa, Mycobacterium tuberculosis
AELDAGVPARGLNGEAYR

SEQ ID NO: 1479254 - protein, 20 aa, Mycobacterium tuberculosis
AELDFPVPSFAEFWRTGRLE

SEQ ID NO: 1479255 - protein, 25 aa, Mycobacterium tuberculosis
AELFVAAYVPYVAWLVQASADSAAA

SEQ ID NO: 1479256 - protein, 23 aa, Mycobacterium tuberculosis
AELFVAAYVPYVAWLVQASSDSA

SEQ ID NO: 1479257 - protein, 26 aa, Mycobacterium tuberculosis
AELGANHALHGVLMATNFFGINTIPI

SEQ ID NO: 1479258 - protein, 25 aa, Mycobacterium tuberculosis
AELGKARLVGAMSVPPTWEGSVPAR

SEQ ID NO: 1479259 - protein, 26 aa, Mycobacterium tuberculosis
AELGKARLVGAMSVPPTWEGSVPARM

SEQ ID NO: 1479260 - protein, 23 aa, Mycobacterium tuberculosis
AELIRGGAALSRVRHPGDLRSEP

SEQ ID NO: 1479261 - protein, 21 aa, Mycobacterium tuberculosis
AELKAALWELIWAGRVTGDTF

SEQ ID NO: 1479262 - protein, 26 aa, Mycobacterium tuberculosis
AELLADCARLLLQIPAVLGLAFDGGW

SEQ ID NO: 1479263 - protein, 18 aa, Mycobacterium tuberculosis
AELLEAGFDNVEEIGRGG

SEQ ID NO: 1479264 - protein, 17 aa, Mycobacterium tuberculosis
AELLRPLLELVPVHDVA

SEQ ID NO: 1479265 - protein, 17 aa, Mycobacterium tuberculosis
AELLRSLGISDPRELDV

SEQ ID NO: 1479266 - protein, 19 aa, Mycobacterium tuberculosis
AELLVPHLAARFGRAARDI

SEQ ID NO: 1479267 - protein, 17 aa, Mycobacterium tuberculosis
AELMAIWAAGDTAGVAT

SEQ ID NO: 1479268 - protein, 17 aa, Mycobacterium tuberculosis
AELRAIVDIAARHGARV

SEQ ID NO: 1479269 - protein, 20 aa, Mycobacterium tuberculosis
AELRAKHGLIPEDEALRAIH

SEQ ID NO: 1479270 - protein, 20 aa, Mycobacterium tuberculosis
AELRLRNLLRPNQFPYQSKT

SEQ ID NO: 1479271 - protein, 21 aa, Mycobacterium tuberculosis
AELRRANAILIDRVGFLRGRA

SEQ ID NO: 1479272 - protein, 20 aa, Mycobacterium tuberculosis
AELRRRRWSLCPAKRDNSGF

SEQ ID NO: 1479273 - protein, 19 aa, Mycobacterium tuberculosis
AELSRLRPLPFRLVLDGTE

SEQ ID NO: 1479274 - protein, 22 aa, Mycobacterium tuberculosis
AELTARLAALRSQRARRRLSTP

SEQ ID NO: 1479275 - protein, 20 aa, Mycobacterium tuberculosis
AELTLNLGVGNIGSLNLGSG

SEQ ID NO: 1479276 - protein, 17 aa, Mycobacterium tuberculosis
AELTMLILGRDRMKNPD

SEQ ID NO: 1479277 - protein, 20 aa, Mycobacterium tuberculosis
AELTRLFTAWVETVYHRSVH

SEQ ID NO: 1479278 - protein, 21 aa, Mycobacterium tuberculosis
AEMARRIDVARVYAHHVVERQ

SEQ ID NO: 1479279 - protein, 18 aa, Mycobacterium tuberculosis
AEMLRWCHEAGIDLATVY

SEQ ID NO: 1479280 - protein, 18 aa, Mycobacterium tuberculosis
AEMMRACRPITVPLTQAQ

SEQ ID NO: 1479281 - protein, 25 aa, Mycobacterium tuberculosis
AEMRIDPFEMWTQGTNGLGITFYSF

SEQ ID NO: 1479282 - protein, 23 aa, Mycobacterium tuberculosis
AENLPSAIYHRFGRVHTYAKARK

SEQ ID NO: 1479283 - protein, 19 aa, Mycobacterium tuberculosis
AENLRLYGRLLRRAIDPDP

SEQ ID NO: 1479284 - protein, 24 aa, Mycobacterium tuberculosis
AENLSCSVIKCVALTFDDGPGPYT

SEQ ID NO: 1479285 - protein, 23 aa, Mycobacterium tuberculosis
AENMARLLIVTRERYHVFRHQQD

SEQ ID NO: 1479286 - protein, 34 aa, Mycobacterium tuberculosis
AEPAARAGPAVSRWPPRARTAARALAVTAEPAGT

SEQ ID NO: 1479287 - protein, 21 aa, Mycobacterium tuberculosis
AEPCPMCAAASVLSGVRAIIF

SEQ ID NO: 1479288 - protein, 25 aa, Mycobacterium tuberculosis
AEPDLACSGLRFAYDGLIPLPDGVR

SEQ ID NO: 1479289 - protein, 19 aa, Mycobacterium tuberculosis
AEPDVVGGKGGDGGKGGSG

SEQ ID NO: 1479290 - protein, 32 aa, Mycobacterium tuberculosis
AEPGGRRAAPVLARGPMVWRPATTGRSAAATA

SEQ ID NO: 1479291 - protein, 18 aa, Mycobacterium tuberculosis
AEPGWARERGWPQFADRL

SEQ ID NO: 1479292 - protein, 18 aa, Mycobacterium tuberculosis
AEPLFLLDYIAVGRIVPE

SEQ ID NO: 1479293 - protein, 18 aa, Mycobacterium tuberculosis
AEPLPYVQPQPGRQVPAG

SEQ ID NO: 1479294 - protein, 19 aa, Mycobacterium tuberculosis
AEPRYGEGVYALRNMDEGF

SEQ ID NO: 1479295 - protein, 27 aa, Mycobacterium tuberculosis
AEPSGWAYWVAESLLGPGTQLADLKLT

SEQ ID NO: 1479296 - protein, 19 aa, Mycobacterium tuberculosis
AEQAELWGGTADEPFDPNY

SEQ ID NO: 1479297 - protein, 21 aa, Mycobacterium tuberculosis
AEQARFAMRMVRRPVHDPARY

SEQ ID NO: 1479298 - protein, 17 aa, Mycobacterium tuberculosis
AEQARVATRPAGATTSP

SEQ ID NO: 1479299 - protein, 20 aa, Mycobacterium tuberculosis
AEQMQGWRAGNAQMLQHRRA

SEQ ID NO: 1479300 - protein, 21 aa, Mycobacterium tuberculosis
AEQPARAAIPAGAAAKDAESA

SEQ ID NO: 1479301 - protein, 17 aa, Mycobacterium tuberculosis
AEQPRVPAGPACSAADS

SEQ ID NO: 1479302 - protein, 19 aa, Mycobacterium tuberculosis
AEQRLAVAPGDDGDGLNPF

SEQ ID NO: 1479303 - protein, 26 aa, Mycobacterium tuberculosis
AEQVGPMLADWAKWGQARHNYFLRPS

SEQ ID NO: 1479304 - protein, 22 aa, Mycobacterium tuberculosis
AEQYLWWVPHNVAGLVTALGGR

SEQ ID NO: 1479305 - protein, 20 aa, Mycobacterium tuberculosis
AERAVDCCRRGCVRGDVGRG

SEQ ID NO: 1479306 - protein, 23 aa, Mycobacterium tuberculosis
AERGFRRARTWLGATAEAIEACE

SEQ ID NO: 1479307 - protein, 17 aa, Mycobacterium tuberculosis
AERGYYRPMALASGVTF

SEQ ID NO: 1479308 - protein, 18 aa, Mycobacterium tuberculosis
AERIRRVAERIVATKKRG

SEQ ID NO: 1479309 - protein, 17 aa, Mycobacterium tuberculosis
AERKDLFTKLLAAETGQ

SEQ ID NO: 1479310 - protein, 17 aa, Mycobacterium tuberculosis
AERLCRRGCAAVGGRWR

SEQ ID NO: 1479311 - protein, 17 aa, Mycobacterium tuberculosis
AERMGRLTLAVGARSRD

SEQ ID NO: 1479312 - protein, 23 aa, Mycobacterium tuberculosis
AERRAALSAAEWGISTNIRSVRG

SEQ ID NO: 1479313 - protein, 27 aa, Mycobacterium tuberculosis
AERSWLPSPMPPASCVGRQCWWPAEIS

SEQ ID NO: 1479314 - protein, 20 aa, Mycobacterium tuberculosis
AESAFRSPLWSNQNIAELGG

SEQ ID NO: 1479315 - protein, 19 aa, Mycobacterium tuberculosis
AESQWFAAAGCNLVNMTGY

SEQ ID NO: 1479316 - protein, 20 aa, Mycobacterium tuberculosis
AETAELLYGTALLAEGGARD

SEQ ID NO: 1479317 - protein, 22 aa, Mycobacterium tuberculosis
AETAGCSSAWAVPAGPAAPALM

SEQ ID NO: 1479318 - protein, 20 aa, Mycobacterium tuberculosis
AETARLEGFYESVRRRAGEV

SEQ ID NO: 1479319 - protein, 31 aa, Mycobacterium tuberculosis
AETAVPPGSPGFCLPAFGGNGGSGGQPVETG

SEQ ID NO: 1479320 - protein, 27 aa, Mycobacterium tuberculosis
AETLLVVLCGVGFYIGFVGSYQRMATI

SEQ ID NO: 1479321 - protein, 28 aa, Mycobacterium tuberculosis
AETLLVVLCGVGFYIGFVGSYQRMATIT

SEQ ID NO: 1479322 - protein, 17 aa, Mycobacterium tuberculosis
AETRRLLTEAPFGSRNP

SEQ ID NO: 1479323 - protein, 18 aa, Mycobacterium tuberculosis
AETVARRGGIVILPQDLP

SEQ ID NO: 1479324 - protein, 33 aa, Mycobacterium tuberculosis; identical to SEQ ID NO: 620143

SEQ ID NO: 1479325 - protein, 25 aa, Mycobacterium tuberculosis
AEVELAWEILDPALEHWAAHGTPDA

SEQ ID NO: 1479326 - protein, 19 aa, Mycobacterium tuberculosis
AEVLKILLRHGRVYAAPYF

SEQ ID NO: 1479327 - protein, 20 aa, Mycobacterium tuberculosis
AEVPAAGGPMGMMPMGMGGA

SEQ ID NO: 1479328 - protein, 21 aa, Mycobacterium tuberculosis
AEVPAAGGPMGMMPMPMGMPA

SEQ ID NO: 1479329 - protein, 20 aa, Mycobacterium tuberculosis
AEVRAIWNLPPRPRTRPPSD

SEQ ID NO: 1479330 - protein, 17 aa, Mycobacterium tuberculosis
AEVRRIEHQVAHEVVAE

SEQ ID NO: 1479331 - protein, 19 aa, Mycobacterium tuberculosis
AEVSGPLLRRKFRPSSAAM

SEQ ID NO: 1479332 - protein, 35 aa, Mycobacterium tuberculosis
AEWMNRPHLAAAWEYDWPASRWRQHLNAQLEGTYS

SEQ ID NO: 1479333 - protein, 19 aa, Mycobacterium tuberculosis
AEYCGPQYRGLHAVPGNRD

SEQ ID NO: 1479334 - protein, 31 aa, Mycobacterium tuberculosis
AEYSLDLFALLPLGELWVAAARMRQVDQLQH

SEQ ID NO: 1479335 - protein, 27 aa, Mycobacterium tuberculosis
AFAEFLEVRGSLLPDDERLLAEQWLLV

SEQ ID NO: 1479336 - protein, 17 aa, Mycobacterium tuberculosis
AFAGRPALLSEMTDDDV

SEQ ID NO: 1479337 - protein, 23 aa, Mycobacterium tuberculosis
AFARAEQAVRCGIDIQDALRNSA

SEQ ID NO: 1479338 - protein, 20 aa, Mycobacterium tuberculosis
AFCDICVRAFADFAVVKPQV

SEQ ID NO: 1479339 - protein, 21 aa, Mycobacterium tuberculosis
AFDKRRFWLSAEGSGADVSGL

SEQ ID NO: 1479340 - protein, 18 aa, Mycobacterium tuberculosis
AFEAARAATVHPMLVAAN

SEQ ID NO: 1479341 - protein, 23 aa, Mycobacterium tuberculosis
AFEEARRRFEASWNRENGEHPIN

SEQ ID NO: 1479342 - protein, 19 aa, Mycobacterium tuberculosis
AFENAIAVGMAFGGSTNAV

SEQ ID NO: 1479343 - protein, 19 aa, Mycobacterium tuberculosis
AFGLARARSAEGDRVGAVR

SEQ ID NO: 1479344 - protein, 22 aa, Mycobacterium tuberculosis
AFGSRVSTLVFSRFTSLIRSCR

SEQ ID NO: 1479345 - protein, 17 aa, Mycobacterium tuberculosis
AFHAQFVQALTSGGGAY

SEQ ID NO: 1479346 - protein, 18 aa, Mycobacterium tuberculosis
AFHAQFVQALTSGGGAYA

SEQ ID NO: 1479347 - protein, 18 aa, Mycobacterium tuberculosis
AFHEQFVQLMSAGAAQYA

SEQ ID NO: 1479348 - protein, 26 aa, Mycobacterium tuberculosis
AFHGTVGYRRVRWRRTQLPVGTSQRR

SEQ ID NO: 1479349 - protein, 17 aa, Mycobacterium tuberculosis
AFHQQFVQTLAGGAGAY

SEQ ID NO: 1479350 - protein, 30 aa, Mycobacterium tuberculosis
AFHRPGPRLRYLLAVKACFAVFQNRDTGSP

SEQ ID NO: 1479351 - protein, 23 aa, Mycobacterium tuberculosis
AFIGGNFSNGAFWQSDHQGQWGA

SEQ ID NO: 1479352 - protein, 18 aa, Mycobacterium tuberculosis
AFISAGVEAVSRFAKGNS

SEQ ID NO: 1479353 - protein, 35 aa, Mycobacterium tuberculosis
AFITGNFNNGFLWRGDHQGLIFGSPGFFNSTSAPS

SEQ ID NO: 1479354 - protein, 30 aa, Mycobacterium tuberculosis
AFKQFSMCINCMLCYSACPVYALDPDFLGP

SEQ ID NO: 1479355 - protein, 25 aa, Mycobacterium tuberculosis
AFLSRSCRWALAAANLWQGNLEAAV

SEQ ID NO: 1479356 - protein, 29 aa, Mycobacterium tuberculosis
AFNSGSFNNGRCGPVTTTGWSASPSASTS

SEQ ID NO: 1479357 - protein, 20 aa, Mycobacterium tuberculosis
AFQTLLRYGRAYSGYAPIMG

SEQ ID NO: 1479358 - protein, 19 aa, Mycobacterium tuberculosis
AFRADRFFGAGQSRERMRK

SEQ ID NO: 1479359 - protein, 20 aa, Mycobacterium tuberculosis
AFRAGAPLKDMEFVQYHPTG

SEQ ID NO: 1479360 - protein, 18 aa, Mycobacterium tuberculosis
AFRPGALPELQSWARTVE

SEQ ID NO: 1479361 - protein, 29 aa, Mycobacterium tuberculosis
AFSIEPGIYFPGRWGARIEDIVIVTEDGA

SEQ ID NO: 1479362 - protein, 30 aa, Mycobacterium tuberculosis
AFSRMLSLFFRQHINYVLARPKLRPITGDD

SEQ ID NO: 1479363 - protein, 17 aa, Mycobacterium tuberculosis
AFTAARRIGTWIGAAAE

SEQ ID NO: 1479364 - protein, 17 aa, Mycobacterium tuberculosis
AFTPPARQYGLAKLGFT

SEQ ID NO: 1479365 - protein, 26 aa, Mycobacterium tuberculosis
AFTVRRRWCRRGSPYPRVALGRGGDA

SEQ ID NO: 1479366 - protein, 18 aa, Mycobacterium tuberculosis
AFVNRPLVLLADEPTGNL

SEQ ID NO: 1479367 - protein, 18 aa, Mycobacterium tuberculosis
AFVQLVLSNLFGQNAPAI

SEQ ID NO: 1479368 - protein, 19 aa, Mycobacterium tuberculosis
AFVQLVLSNLFGQNAPAIA

SEQ ID NO: 1479369 - protein, 20 aa, Mycobacterium tuberculosis
AFVRCLESGYAANVEAVVTA

SEQ ID NO: 1479370 - protein, 17 aa, Mycobacterium tuberculosis
AFWSFGGLFLVNSPEQR

SEQ ID NO: 1479371 - protein, 18 aa, Mycobacterium tuberculosis
AFYFACPSTVLGPYDDAP

SEQ ID NO: 1479372 - protein, 21 aa, Mycobacterium tuberculosis
AGAAVAGLVGRAGTAGPAVAK

SEQ ID NO: 1479373 - protein, 21 aa, Mycobacterium tuberculosis
AGAAVPAVRCSAAPARPARTA

SEQ ID NO: 1479374 - protein, 22 aa, Mycobacterium tuberculosis
AGAAVPAVRCSAAPARPARTAD

SEQ ID NO: 1479375 - protein, 19 aa, Mycobacterium tuberculosis
AGAAVRRRTITYPDQLPHW

SEQ ID NO: 1479376 - protein, 19 aa, Mycobacterium tuberculosis
AGADGGLFGNGGDGGSSTS

SEQ ID NO: 1479377 - protein, 19 aa, Mycobacterium tuberculosis
AGADLSALGAGVGDPAEPR

SEQ ID NO: 1479378 - protein, 17 aa, Mycobacterium tuberculosis
AGAEFDGQALARTVYGH

SEQ ID NO: 1479379 - protein, 23 aa, Mycobacterium tuberculosis
AGAELPALFSQLVAGPIRRIIDG

SEQ ID NO: 1479380 - protein, 25 aa, Mycobacterium tuberculosis
AGAFLRAGAINRILAYVAPILLGGP

SEQ ID NO: 1479381 - protein, 23 aa, Mycobacterium tuberculosis
AGAGGEHVVAPAGKGGTGGVGGD

SEQ ID NO: 1479382 - protein, 23 aa, Mycobacterium tuberculosis
AGAGGKGGENIIGDGGGGNGGAG

SEQ ID NO: 1479383 - protein, 17 aa, Mycobacterium tuberculosis
AGAGIVWAKVNTFGSTA

SEQ ID NO: 1479384 - protein, 31 aa, Mycobacterium tuberculosis
AGAGMPAGMMGPRWRKSACGAGSAQCGAAGR

SEQ ID NO: 1479385 - protein, 19 aa, Mycobacterium tuberculosis
AGAHLFRVAHQHRRAVGQL

SEQ ID NO: 1479386 - protein, 20 aa, Mycobacterium tuberculosis
AGALGARGLFACRQSLRPRY

SEQ ID NO: 1479387 - protein, 27 aa, Mycobacterium tuberculosis
AGALGREFAGELALGLGAGKDRVHLLG

SEQ ID NO: 1479388 - protein, 20 aa, Mycobacterium tuberculosis
AGALKPARLLVSGSAALPVP

SEQ ID NO: 1479389 - protein, 19 aa, Mycobacterium tuberculosis
AGALRYRAGQFAQLQVPGT

SEQ ID NO: 1479390 - protein, 18 aa, Mycobacterium tuberculosis
AGALVVLVDGELAWFLER

SEQ ID NO: 1479391 - protein, 23 aa, Mycobacterium tuberculosis
AGALWERLTRAVGMDARDAVWQH

SEQ ID NO: 1479392 - protein, 18 aa, Mycobacterium tuberculosis
AGAMPVLTLYGIPHRDCG

SEQ ID NO: 1479393 - protein, 18 aa, Mycobacterium tuberculosis
AGAPPWYADVLLPDLGAA

SEQ ID NO: 1479394 - protein, 32 aa, Mycobacterium tuberculosis
AGAPSPVGWYRWQQCPHRHSLAGGDERAGRTE

SEQ ID NO: 1479395 - protein, 21 aa, Mycobacterium tuberculosis
AGAQYKKLRDVLGLLHDAYCR

SEQ ID NO: 1479396 - protein, 18 aa, Mycobacterium tuberculosis
AGARNCRKQQGSLPPLAK

SEQ ID NO: 1479397 - protein, 26 aa, Mycobacterium tuberculosis
AGAVPSRLPAPLGLQCHADPDGRDAD

SEQ ID NO: 1479398 - protein, 31 aa, Mycobacterium tuberculosis
AGAVTPAVGALLCLLAKLSGGKAVAEVGTGA

SEQ ID NO: 1479399 - protein, 20 aa, Mycobacterium tuberculosis
AGCGVCPGCETHDPVMCFSG

SEQ ID NO: 1479400 - protein, 19 aa, Mycobacterium tuberculosis
AGCSFPIERLRQVAEHADA

SEQ ID NO: 1479401 - protein, 17 aa, Mycobacterium tuberculosis
AGCSRATLYRYFDSREA

SEQ ID NO: 1479402 - protein, 18 aa, Mycobacterium tuberculosis
AGCSSRPITDQRATQQRL

SEQ ID NO: 1479403 - protein, 17 aa, Mycobacterium tuberculosis
AGDAWHGPASLAMTRAA

SEQ ID NO: 1479404 - protein, 26 aa, Mycobacterium tuberculosis
AGDHAAICWPLLVGMAKAKYYLLTCE

SEQ ID NO: 1479405 - protein, 23 aa, Mycobacterium tuberculosis
AGDHAEGAWRRDDVTALSTASLA

SEQ ID NO: 1479406 - protein, 23 aa, Mycobacterium tuberculosis
AGDKLWARMDIHSVDERFGADIV

SEQ ID NO: 1479407 - protein, 20 aa, Mycobacterium tuberculosis
AGDRGGAGGTGFISSDGGAG

SEQ ID NO: 1479408 - protein, 22 aa, Mycobacterium tuberculosis
AGDRGGAGGTGFISSDGGAGGD

SEQ ID NO: 1479409 - protein, 17 aa, Mycobacterium tuberculosis
AGEAILTGWRMLLDEGR

SEQ ID NO: 1479410 - protein, 23 aa, Mycobacterium tuberculosis
AGEAILTGWRMLLDEGRLQDGEP

SEQ ID NO: 1479411 - protein, 23 aa, Mycobacterium tuberculosis
AGELLRLARVLGIAATRDRARDL

SEQ ID NO: 1479412 - protein, 17 aa, Mycobacterium tuberculosis
AGEPGLFTQPRHRIGAV

SEQ ID NO: 1479413 - protein, 17 aa, Mycobacterium tuberculosis
AGERGLRAITVDGPAFH

SEQ ID NO: 1479414 - protein, 27 aa, Mycobacterium tuberculosis
AGEVLRACLRVRPAVRHHDLPSRGSRA

SEQ ID NO: 1479415 - protein, 18 aa, Mycobacterium tuberculosis
AGFDAEFFGITPREAAAM

SEQ ID NO: 1479416 - protein, 22 aa, Mycobacterium tuberculosis
AGFDGVELVKALLFSVFEGGLR

SEQ ID NO: 1479417 - protein, 17 aa, Mycobacterium tuberculosis
AGFEAGFEADPVLLEIF

SEQ ID NO: 1479418 - protein, 18 aa, Mycobacterium tuberculosis
AGFGGSAGGGGWVGAVNF

SEQ ID NO: 1479419 - protein, 23 aa, Mycobacterium tuberculosis
AGFPLGWVHDVVWAPRPIGGPDA

SEQ ID NO: 1479420 - protein, 18 aa, Mycobacterium tuberculosis
AGFSRPGIELTKRTLWSG

SEQ ID NO: 1479421 - protein, 18 aa, Mycobacterium tuberculosis
AGFVNGVLRTIAGRDERS

SEQ ID NO: 1479422 - protein, 20 aa, Mycobacterium tuberculosis
AGGAAGLWGAGGGGGNGGNG

SEQ ID NO: 1479423 - protein, 22 aa, Mycobacterium tuberculosis
AGGAAGMLFGAAGVGGPGGFAA

SEQ ID NO: 1479424 - protein, 34 aa, Mycobacterium tuberculosis
AGGADGRQGRWWAQWCAACSAATLCDAAFSGGRL

SEQ ID NO: 1479425 - protein, 24 aa, Mycobacterium tuberculosis
AGGAGGAAGLWGHGGAGGAGGSAS

SEQ ID NO: 1479426 - protein, 18 aa, Mycobacterium tuberculosis
AGGAGGDAGMFFGSGGSG

SEQ ID NO: 1479427 - protein, 21 aa, Mycobacterium tuberculosis
AGGAGGFGFGGAGGAGGLGGK

SEQ ID NO: 1479428 - protein, 26 aa, Mycobacterium tuberculosis
AGGAGGHGGWLWGNGGVGGSGGAGVG

SEQ ID NO: 1479429 - protein, 20 aa, Mycobacterium tuberculosis
AGGAGGILWGGRRLGRARPS

SEQ ID NO: 1479430 - protein, 26 aa, Mycobacterium tuberculosis
AGGAGGNAGMLFGAAGVGGVGGFSNG

SEQ ID NO: 1479431 - protein, 25 aa, Mycobacterium tuberculosis
AGGAGGNAGMLFGSGGGGGTGGFGF

SEQ ID NO: 1479432 - protein, 28 aa, Mycobacterium tuberculosis
AGGAGGNARLWGVGGAGGAGGKGGSGLS

SEQ ID NO: 1479433 - protein, 23 aa, Mycobacterium tuberculosis
AGGAGGNAWLFGNGGAGGLGAAG

SEQ ID NO: 1479434 - protein, 23 aa, Mycobacterium tuberculosis
AGGAGGNAYLFGSGGAGGQGGMG

SEQ ID NO: 1479435 - protein, 26 aa, Mycobacterium tuberculosis
AGGAGGSGGWLYGNGGNGGIGGNAIV

SEQ ID NO: 1479436 - protein, 20 aa, Mycobacterium tuberculosis
AGGAGGSVGLWGSGGAGGDG

SEQ ID NO: 1479437 - protein, 24 aa, Mycobacterium tuberculosis
AGGAGGTGIEFGSVGGAGGAGGNA

SEQ ID NO: 1479438 - protein, 25 aa, Mycobacterium tuberculosis
AGGAGRPRALPFESRARTAETGRPR

SEQ ID NO: 1479439 - protein, 24 aa, Mycobacterium tuberculosis
AGGAGVAGGWLYGDGGAGGAGGGG

SEQ ID NO: 1479440 - protein, 22 aa, Mycobacterium tuberculosis
AGGAQRARRVGASPGAGAAGGG

SEQ ID NO: 1479441 - protein, 20 aa, Mycobacterium tuberculosis
AGGARWRLHHGGGRPIGLRR

SEQ ID NO: 1479442 - protein, 20 aa, Mycobacterium tuberculosis
AGGDAGWLGSGGVGGAGGFG

SEQ ID NO: 1479443 - protein, 24 aa, Mycobacterium tuberculosis
AGGDGGNAGMFFGSGGAGGAGGFG

SEQ ID NO: 1479444 - protein, 18 aa, Mycobacterium tuberculosis
AGGDLALFGSHAQGYQTL

SEQ ID NO: 1479445 - protein, 20 aa, Mycobacterium tuberculosis
AGGDRGSTMSAWNGSSLIDV

SEQ ID NO: 1479446 - protein, 25 aa, Mycobacterium tuberculosis
AGGDVSADFGGVGFGGKAVTAAPAG

SEQ ID NO: 1479447 - protein, 28 aa, Mycobacterium tuberculosis
AGGDVSYPVCAGLDRGPGLHAAPRRPPP

SEQ ID NO: 1479448 - protein, 18 aa, Mycobacterium tuberculosis
AGGFGIPVGSGGAGGSRG

SEQ ID NO: 1479449 - protein, 18 aa, Mycobacterium tuberculosis
AGGFGRTTGGIGGTGGNA

SEQ ID NO: 1479450 - protein, 18 aa, Mycobacterium tuberculosis
AGGGGGWLYGDGGAGGHG

SEQ ID NO: 1479451 - protein, 22 aa, Mycobacterium tuberculosis
AGGGGTMTHAWLLTGPPGSGRS

SEQ ID NO: 1479452 - protein, 20 aa, Mycobacterium tuberculosis
AGGHGAEGVAGAAGEDLSPH

SEQ ID NO: 1479453 - protein, 25 aa, Mycobacterium tuberculosis
AGGHGGAGGLIWGNGGAGGNGGNGG

SEQ ID NO: 1479454 - protein, 23 aa, Mycobacterium tuberculosis
AGGHSLLPMMKLRIANPEYLVDI

SEQ ID NO: 1479455 - protein, 25 aa, Mycobacterium tuberculosis
AGGHSLLPMMKLRIANPEYLVDIND

SEQ ID NO: 1479456 - protein, 21 aa, Mycobacterium tuberculosis
AGGIAQLFGTGGMGGSGGGIG

SEQ ID NO: 1479457 - protein, 24 aa, Mycobacterium tuberculosis
AGGIGGAAINILANAGAGGAGGAA

SEQ ID NO: 1479458 - protein, 19 aa, Mycobacterium tuberculosis
AGGIGGLIGSGGGGGDGGN

SEQ ID NO: 1479459 - protein, 21 aa, Mycobacterium tuberculosis
AGGIPGLIGNGGNGGDGGASV

SEQ ID NO: 1479460 - protein, 21 aa, Mycobacterium tuberculosis
AGGIVPALVNYAPTQLAQAIA

SEQ ID NO: 1479461 - protein, 19 aa, Mycobacterium tuberculosis
AGGKAGLLIGAGGAGGAGG

SEQ ID NO: 1479462 - protein, 21 aa, Mycobacterium tuberculosis
AGGKGGSGLVGGDGGNGGAGG

SEQ ID NO: 1479463 - protein, 18 aa, Mycobacterium tuberculosis
AGGLAQHYPAIRVRPRGE

SEQ ID NO: 1479464 - protein, 21 aa, Mycobacterium tuberculosis
AGGLFGVSGSSGLGGAAGSGG

SEQ ID NO: 1479465 - protein, 23 aa, Mycobacterium tuberculosis
AGGLHPRVALMLDVESGGNPPGD

SEQ ID NO: 1479466 - protein, 17 aa, Mycobacterium tuberculosis
AGGLLYGKRRGPAETAV

SEQ ID NO: 1479467 - protein, 18 aa, Mycobacterium tuberculosis
AGGLYAHGGTGGPGGNGG

SEQ ID NO: 1479468 - protein, 26 aa, Mycobacterium tuberculosis
AGGMFTDAGSVGWAEKAGSAGPAGPA

SEQ ID NO: 1479469 - protein, 23 aa, Mycobacterium tuberculosis
AGGNAGTFYGFGGAGGAGGESDN

SEQ ID NO: 1479470 - protein, 23 aa, Mycobacterium tuberculosis
AGGNGALLFGFGGAGGAGGHGGA

SEQ ID NO: 1479471 - protein, 19 aa, Mycobacterium tuberculosis
AGGNGAWLFGNGGAGGGGG

SEQ ID NO: 1479472 - protein, 24 aa, Mycobacterium tuberculosis
AGGNGGAGGLLFGDGGNGGAGGAG

SEQ ID NO: 1479473 - protein, 21 aa, Mycobacterium tuberculosis
AGGNGGWLWGKRRQRRVGGTR

SEQ ID NO: 1479474 - protein, 20 aa, Mycobacterium tuberculosis
AGGNGGWLYGNGGLGGAAGL

SEQ ID NO: 1479475 - protein, 20 aa, Mycobacterium tuberculosis
AGGNGGWLYGNGGLGGNGGA

SEQ ID NO: 1479476 - protein, 20 aa, Mycobacterium tuberculosis
AGGNGGWLYGNGGPGGAAGL

SEQ ID NO: 1479477 - protein, 20 aa, Mycobacterium tuberculosis
AGGNGGWLYGPGGLGGNGGA

SEQ ID NO: 1479478 - protein, 19 aa, Mycobacterium tuberculosis
AGGQVWLMPHNPAFDPIPG

SEQ ID NO: 1479479 - protein, 18 aa, Mycobacterium tuberculosis
AGGRAGGGVGGIGGAGGA

SEQ ID NO: 1479480 - protein, 24 aa, Mycobacterium tuberculosis
AGGRGGAGGLGFGSEAPGRPGGAG

SEQ ID NO: 1479481 - protein, 34 aa, Mycobacterium tuberculosis
AGGRGGAGGLGFGSEAPGRPGGAGGTGGAGGNGG

SEQ ID NO: 1479482 - protein, 17 aa, Mycobacterium tuberculosis
AGGRGGDAGLLFGAAGT

SEQ ID NO: 1479483 - protein, 17 aa, Mycobacterium tuberculosis
AGGRLILRFFPTPACAR

SEQ ID NO: 1479484 - protein, 18 aa, Mycobacterium tuberculosis
AGGRRFPGKPGVPPASRH

SEQ ID NO: 1479485 - protein, 20 aa, Mycobacterium tuberculosis
AGGSGGWLLGNGGVGGAGGR

SEQ ID NO: 1479486 - protein, 26 aa, Mycobacterium tuberculosis
AGGTGGFPWVPEVSGGAGGGGSTVVR

SEQ ID NO: 1479487 - protein, 21 aa, Mycobacterium tuberculosis
AGGTGGLLFGAGGNGGPGGSG

SEQ ID NO: 1479488 - protein, 20 aa, Mycobacterium tuberculosis
AGGTGGTLFGAPGTTGADGT

SEQ ID NO: 1479489 - protein, 21 aa, Mycobacterium tuberculosis
AGGVGGHVRLIANGGNGVACG

SEQ ID NO: 1479490 - protein, 17 aa, Mycobacterium tuberculosis
AGHARPMCCASPGRPSP

SEQ ID NO: 1479491 - protein, 24 aa, Mycobacterium tuberculosis
AGHFELRPGQALVITVPVSDAPYL

SEQ ID NO: 1479492 - protein, 24 aa, Mycobacterium tuberculosis
AGHSRWLSAEAMAARLNDVGVGRA

SEQ ID NO: 1479493 - protein, 23 aa, Mycobacterium tuberculosis
AGHSRWLSAEAMARQAQRCRCGP

SEQ ID NO: 1479494 - protein, 17 aa, Mycobacterium tuberculosis
AGIATHVAAFWAHGGRP

SEQ ID NO: 1479495 - protein, 22 aa, Mycobacterium tuberculosis
AGIDVAVCKPVQTGTAAVTTTS

SEQ ID NO: 1479496 - protein, 21 aa, Mycobacterium tuberculosis
AGIDVAVCKPVQTGTARGDDD

SEQ ID NO: 1479497 - protein, 22 aa, Mycobacterium tuberculosis
AGIDVAVCKPVQTGTARGDDDL

SEQ ID NO: 1479498 - protein, 22 aa, Mycobacterium tuberculosis
AGIDVAVCKPVQTGTARGDDEL

SEQ ID NO: 1479499 - protein, 19 aa, Mycobacterium tuberculosis
AGIDVAVCNPIQTGPARGA

SEQ ID NO: 1479500 - protein, 17 aa, Mycobacterium tuberculosis
AGIELRLANDVLEGRYT

SEQ ID NO: 1479501 - protein, 25 aa, Mycobacterium tuberculosis
AGILDVLDNYAFVRTSSYLPGPHDV

SEQ ID NO: 1479502 - protein, 17 aa, Mycobacterium tuberculosis
AGIPALLSPRDKLAQLL

SEQ ID NO: 1479503 - protein, 23 aa, Mycobacterium tuberculosis
AGIRCSRRVFAARRDRRRKRVGW

SEQ ID NO: 1479504 - protein, 18 aa, Mycobacterium tuberculosis
AGIRRWLDSPILMVADMF

SEQ ID NO: 1479505 - protein, 18 aa, Mycobacterium tuberculosis
AGITCAVLIPQGKIAMGK

SEQ ID NO: 1479506 - protein, 17 aa, Mycobacterium tuberculosis
AGITLSARSAGFAGIRA

SEQ ID NO: 1479507 - protein, 18 aa, Mycobacterium tuberculosis
AGIVEAIQLCRGLAEGPL

SEQ ID NO: 1479508 - protein, 23 aa, Mycobacterium tuberculosis
AGKDGGKGKIGFDGGRGGDGGPG

SEQ ID NO: 1479509 - protein, 19 aa, Mycobacterium tuberculosis
AGKMALLYWRGRGLPGKRR

SEQ ID NO: 1479510 - protein, 19 aa, Mycobacterium tuberculosis
AGKPARYFEAPKTRFNAPV

SEQ ID NO: 1479511 - protein, 17 aa, Mycobacterium tuberculosis
AGKRLAPHALEWDAAKH

SEQ ID NO: 1479512 - protein, 18 aa, Mycobacterium tuberculosis
AGKWPDKFLAGAAGVAHG

SEQ ID NO: 1479513 - protein, 21 aa, Mycobacterium tuberculosis
AGLAPWPGPSFTAARASPPGS

SEQ ID NO: 1479514 - protein, 20 aa, Mycobacterium tuberculosis
AGLAVGFWAAPSDLRANWRE

SEQ ID NO: 1479515 - protein, 28 aa, Mycobacterium tuberculosis
AGLDPRYPLKGVFHAAGVLDDAVITGLT

SEQ ID NO: 1479516 - protein, 18 aa, Mycobacterium tuberculosis
AGLFSIPNPFAVTYYLIK

SEQ ID NO: 1479517 - protein, 27 aa, Mycobacterium tuberculosis
AGLGGLGGQLIGLDGSNAPVSTSVHTL

SEQ ID NO: 1479518 - protein, 20 aa, Mycobacterium tuberculosis
AGLGLVSWVQTAAVAGAGQS

SEQ ID NO: 1479519 - protein, 17 aa, Mycobacterium tuberculosis
AGLIGIGGTGGAGGAGA

SEQ ID NO: 1479520 - protein, 18 aa, Mycobacterium tuberculosis
AGLLDEWTPVIAGAELGE

SEQ ID NO: 1479521 - protein, 32 aa, Mycobacterium tuberculosis
AGLLIGAAGLGGCGGGAFTAGVTTGGAGGTGG

SEQ ID NO: 1479522 - protein, 23 aa, Mycobacterium tuberculosis
AGLLPCPRFFAKASIASTRTAEP

SEQ ID NO: 1479523 - protein, 18 aa, Mycobacterium tuberculosis
AGLPEGLSTVLIGGAQAV

SEQ ID NO: 1479524 - protein, 18 aa, Mycobacterium tuberculosis
AGLRGVEKGYVLGPQAED

SEQ ID NO: 1479525 - protein, 21 aa, Mycobacterium tuberculosis
AGLRICARIAQARPLRDLLGS

SEQ ID NO: 1479526 - protein, 26 aa, Mycobacterium tuberculosis
AGLSHPMGPLRLSDLVGLDTLKLIAD

SEQ ID NO: 1479527 - protein, 27 aa, Mycobacterium tuberculosis
AGLTAGAGAWAMWGWVTPAAAAGGWPT

SEQ ID NO: 1479528 - protein, 19 aa, Mycobacterium tuberculosis
AGLVCGGVHTANATVYMID

SEQ ID NO: 1479529 - protein, 23 aa, Mycobacterium tuberculosis
AGLVGLRPVPAAPAGPVALVPAA

SEQ ID NO: 1479530 - protein, 29 aa, Mycobacterium tuberculosis
AGNGGLGGDGFTYLADFDGEPGGDGGDGG

SEQ ID NO: 1479531 - protein, 25 aa, Mycobacterium tuberculosis
AGNGGSGGNGFDSFASGGTGGAAEP

SEQ ID NO: 1479532 - protein, 24 aa, Mycobacterium tuberculosis
AGNGGSGGNGFDSFASGGTGGAGG

SEQ ID NO: 1479533 - protein, 26 aa, Mycobacterium tuberculosis
AGNGGSGGNGFDSFASGGTGGAGGTG

SEQ ID NO: 1479534 - protein, 19 aa, Mycobacterium tuberculosis
AGNLARLGSMISAANSAAA

SEQ ID NO: 1479535 - protein, 17 aa, Mycobacterium tuberculosis
AGPAALFDARFQKLGLH

SEQ ID NO: 1479536 - protein, 18 aa, Mycobacterium tuberculosis
AGPADCSAPAAPAAVVGA

SEQ ID NO: 1479537 - protein, 40 aa, Mycobacterium tuberculosis
AGPAFSLLLGTWGPRKRRAKRFAFEFGGAGGVGGSSEDVG

SEQ ID NO: 1479538 - protein, 18 aa, Mycobacterium tuberculosis
AGPAGCCSAPAAPVGPAE

SEQ ID NO: 1479539 - protein, 17 aa, Mycobacterium tuberculosis
AGPAGCRRSRSWLRRVR

SEQ ID NO: 1479540 - protein, 32 aa, Mycobacterium tuberculosis
AGPAHPQWPLCGWATRRRPGAENLRLYGRLLR

SEQ ID NO: 1479541 - protein, 25 aa, Mycobacterium tuberculosis
AGPARSRGGGVGRTVPAVTAVAEQP

SEQ ID NO: 1479542 - protein, 23 aa, Mycobacterium tuberculosis
AGPARVGGLAADAGDGGAGGDGG

SEQ ID NO: 1479543 - protein, 25 aa, Mycobacterium tuberculosis
AGPEPMAAAATAWDGLAMELASAAA

SEQ ID NO: 1479544 - protein, 21 aa, Mycobacterium tuberculosis
AGPGGYCGYLLNNLTTSGFRP

SEQ ID NO: 1479545 - protein, 23 aa, Mycobacterium tuberculosis
AGPGIPRHHRAAGGLQSVAKASA

SEQ ID NO: 1479546 - protein, 18 aa, Mycobacterium tuberculosis
AGPHTGRLLSCLRSSRKR

SEQ ID NO: 1479547 - protein, 17 aa, Mycobacterium tuberculosis
AGPIALDIVAEVIFGVA

SEQ ID NO: 1479548 - protein, 25 aa, Mycobacterium tuberculosis
AGPNGQDFSAFRQLARMADRAATAA

SEQ ID NO: 1479549 - protein, 19 aa, Mycobacterium tuberculosis
AGPPCFLAPELRHLNDDGS

SEQ ID NO: 1479550 - protein, 27 aa, Mycobacterium tuberculosis
AGPPEHLQWIGQWGIFDALRPGREVVR

SEQ ID NO: 1479551 - protein, 17 aa, Mycobacterium tuberculosis
AGPPRVGQPSWNPQRAS

SEQ ID NO: 1479552 - protein, 26 aa, Mycobacterium tuberculosis
AGPQLHRDRTLLLALLELEDGDGPLH

SEQ ID NO: 1479553 - protein, 21 aa, Mycobacterium tuberculosis
AGPRDKNRFIGVPAAFSKLFR

SEQ ID NO: 1479554 - protein, 30 aa, Mycobacterium tuberculosis
AGPRLRPPRPLKGWVFAAGAKRPGAKKTPP

SEQ ID NO: 1479555 - protein, 24 aa, Mycobacterium tuberculosis
AGPRRAAVSSFGLSGTNAHVVVEQ

SEQ ID NO: 1479556 - protein, 19 aa, Mycobacterium tuberculosis
AGPRSSWRATDPVLYAMSG

SEQ ID NO: 1479557 - protein, 20 aa, Mycobacterium tuberculosis
AGPRVKRTLTANGLRQLIAF

SEQ ID NO: 1479558 - protein, 18 aa, Mycobacterium tuberculosis
AGPSPVRTVLAVLAEPAG

SEQ ID NO: 1479559 - protein, 27 aa, Mycobacterium tuberculosis
AGPTGTSRTAIACGEVNAKGGAASTAL

SEQ ID NO: 1479560 - protein, 19 aa, Mycobacterium tuberculosis
AGPVVRLAPRHAHLRRSRR

SEQ ID NO: 1479561 - protein, 27 aa, Mycobacterium tuberculosis
AGQGCAITTRLVVPRARYEEAVAIAAA

SEQ ID NO: 1479562 - protein, 19 aa, Mycobacterium tuberculosis
AGQGCRRCGTLIAYDTTDE

SEQ ID NO: 1479563 - protein, 18 aa, Mycobacterium tuberculosis
AGQLARLVGPSGHPVFRH

SEQ ID NO: 1479564 - protein, 20 aa, Mycobacterium tuberculosis
AGQLICARPGARRGHHGVLW

SEQ ID NO: 1479565 - protein, 26 aa, Mycobacterium tuberculosis
AGQPGRWGRTVVCARLSSADQKVDLD

SEQ ID NO: 1479566 - protein, 17 aa, Mycobacterium tuberculosis
AGQPNSGTEPGFGGDGG

SEQ ID NO: 1479567 - protein, 18 aa, Mycobacterium tuberculosis
AGQPNSGTEPGFGGDGGL

SEQ ID NO: 1479568 - protein, 17 aa, Mycobacterium tuberculosis
AGQRFVIDVTVWIDLAE

SEQ ID NO: 1479569 - protein, 25 aa, Mycobacterium tuberculosis
AGQYLPAPITKRWLRVTLDTPGPNH

SEQ ID NO: 1479570 - protein, 23 aa, Mycobacterium tuberculosis
AGRAGVFRPLWAHDRTAERQALT

SEQ ID NO: 1479571 - protein, 29 aa, Mycobacterium tuberculosis
AGRCPAGKRLPCFGFWAGAGPGRAGIGGS

SEQ ID NO: 1479572 - protein, 19 aa, Mycobacterium tuberculosis
AGRESRWRGPGCPARTCGH

SEQ ID NO: 1479573 - protein, 24 aa, Mycobacterium tuberculosis
AGRGARFLLGLVVSTGVGGGLVRD

SEQ ID NO: 1479574 - protein, 21 aa, Mycobacterium tuberculosis
AGRGGDAGFFYGNGGAGGSGA

SEQ ID NO: 1479575 - protein, 19 aa, Mycobacterium tuberculosis
AGRHASWRGPCASTATRIG

SEQ ID NO: 1479576 - protein, 26 aa, Mycobacterium tuberculosis
AGRIPVPVPGFRVWALDSLRRANHYT

SEQ ID NO: 1479577 - protein, 19 aa, Mycobacterium tuberculosis
AGRLRRLLVEQASVILRRT

SEQ ID NO: 1479578 - protein, 24 aa, Mycobacterium tuberculosis
AGRLWPRRRKLSALRRGDTPGEVY

SEQ ID NO: 1479579 - protein, 27 aa, Mycobacterium tuberculosis
AGRPTVRTTVSWAWRRAGLDGIAELTG

SEQ ID NO: 1479580 - protein, 25 aa, Mycobacterium tuberculosis
AGRQRCIQEFSWAYIAEQTLDIYRK

SEQ ID NO: 1479581 - protein, 34 aa, Mycobacterium tuberculosis
AGRRCLPAVQCLRGMVRLGRFGRRGVRPDRQRAA

SEQ ID NO: 1479582 - protein, 17 aa, Mycobacterium tuberculosis
AGRRCSGHFPVTDRSAA

SEQ ID NO: 1479583 - protein, 18 aa, Mycobacterium tuberculosis
AGRRPRAWRGVVVAGAGR

SEQ ID NO: 1479584 - protein, 17 aa, Mycobacterium tuberculosis
AGRRYRAEFLFQHGCFA

SEQ ID NO: 1479585 - protein, 28 aa, Mycobacterium tuberculosis
AGRSAHGWANADLISWTFQGPNWAFGGA

SEQ ID NO: 1479586 - protein, 18 aa, Mycobacterium tuberculosis
AGRSWWVAVEDMGRLRDG

SEQ ID NO: 1479587 - protein, 22 aa, Mycobacterium tuberculosis
AGRVAGLIGTIGIRVGGADLPS

SEQ ID NO: 1479588 - protein, 25 aa, Mycobacterium tuberculosis
AGRVKRPQIAIATWIVPSIVAFGTD

SEQ ID NO: 1479589 - protein, 18 aa, Mycobacterium tuberculosis
AGRYAVGLHCGRQRDLHG

SEQ ID NO: 1479590 - protein, 26 aa, Mycobacterium tuberculosis
AGSAPMLAASVAWDGLAAELAVAASS

SEQ ID NO: 1479591 - protein, 30 aa, Mycobacterium tuberculosis
AGSDPDWDARVALRRARRPPTWLTVETADV

SEQ ID NO: 1479592 - protein, 34 aa, Mycobacterium tuberculosis
AGSDPLLAVPFSYPASLPTPFGPVTMTLNGSFDP

SEQ ID NO: 1479593 - protein, 24 aa, Mycobacterium tuberculosis
AGSIGPMSVPPSWATLRPGHDTGP

SEQ ID NO: 1479594 - protein, 23 aa, Mycobacterium tuberculosis
AGSLHVKMGWAFAADIPLTSITK

SEQ ID NO: 1479595 - protein, 19 aa, Mycobacterium tuberculosis
AGSLLRDYGLLLPLEPDTR

SEQ ID NO: 1479596 - protein, 17 aa, Mycobacterium tuberculosis
AGSLWRLEFLLQSTQDP

SEQ ID NO: 1479597 - protein, 24 aa, Mycobacterium tuberculosis
AGSPGAVCRWCGRVDPTLRCVRCG

SEQ ID NO: 1479598 - protein, 22 aa, Mycobacterium tuberculosis
AGSPGAVCRWCGRVDPTRRCVR

SEQ ID NO: 1479599 - protein, 23 aa, Mycobacterium tuberculosis
AGSPGAVCRWCGRVDPTRRCVRC

SEQ ID NO: 1479600 - protein, 22 aa, Mycobacterium tuberculosis
AGSRPARGFSVAHRLCQDQPRS

SEQ ID NO: 1479601 - protein, 24 aa, Mycobacterium tuberculosis
AGSSRKAFGGDGGVGGDGASALGT

SEQ ID NO: 1479602 - protein, 18 aa, Mycobacterium tuberculosis
AGSVALLLADRVGSTHLG

SEQ ID NO: 1479603 - protein, 18 aa, Mycobacterium tuberculosis
AGSVLAVVGELGRSAAGY

SEQ ID NO: 1479604 - protein, 30 aa, Mycobacterium tuberculosis
AGTAAAYWLGRHGYSVTMVERHPGLRPGGQ

SEQ ID NO: 1479605 - protein, 18 aa, Mycobacterium tuberculosis
AGTDIPGICSGGRVRSGV

SEQ ID NO: 1479606 - protein, 24 aa, Mycobacterium tuberculosis
AGTDPGCCPMVARGLRDRGRTPGS

SEQ ID NO: 1479607 - protein, 23 aa, Mycobacterium tuberculosis
AGTEPRKIFDLLEHAPVDIAVLT

SEQ ID NO: 1479608 - protein, 19 aa, Mycobacterium tuberculosis
AGTFMAGPLSGLRVVELAG

SEQ ID NO: 1479609 - protein, 24 aa, Mycobacterium tuberculosis
AGTGFLAQLCVDWETATRPAQQSG

SEQ ID NO: 1479610 - protein, 23 aa, Mycobacterium tuberculosis
AGTGGRGGLLAGQHANSGNGGGG

SEQ ID NO: 1479611 - protein, 24 aa, Mycobacterium tuberculosis
AGTGGRGGLLAGQHANSGNGGGGG

SEQ ID NO: 1479612 - protein, 18 aa, Mycobacterium tuberculosis
AGTGRPGPDRCRGRHHRP

SEQ ID NO: 1479613 - protein, 19 aa, Mycobacterium tuberculosis
AGTLREWADHALHRGVAPL

SEQ ID NO: 1479614 - protein, 18 aa, Mycobacterium tuberculosis
AGTQAPRTSACSTPAPTT

SEQ ID NO: 1479615 - protein, 25 aa, Mycobacterium tuberculosis
AGTRDFPENTVLAITNAVAAGVDGM

SEQ ID NO: 1479616 - protein, 23 aa, Mycobacterium tuberculosis
AGTTRFFGWPAIFRLRRLFQTRG

SEQ ID NO: 1479617 - protein, 20 aa, Mycobacterium tuberculosis
AGTVGFDCSGLVLYSFAGVG

SEQ ID NO: 1479618 - protein, 24 aa, Mycobacterium tuberculosis
AGVARWTLDTAVAYAKVREQFGKP

SEQ ID NO: 1479619 - protein, 21 aa, Mycobacterium tuberculosis
AGVCFPDLLLTKGEYQLKLTP

SEQ ID NO: 1479620 - protein, 17 aa, Mycobacterium tuberculosis
AGVEIAIDDNGSGVPEG

SEQ ID NO: 1479621 - protein, 21 aa, Mycobacterium tuberculosis
AGVGVDWRAAFADLGGRRVEL

SEQ ID NO: 1479622 - protein, 20 aa, Mycobacterium tuberculosis
AGVHGLHLRRGPAIPRHTCD

SEQ ID NO: 1479623 - protein, 26 aa, Mycobacterium tuberculosis
AGVIANGSFAPSFVGFGGNGGNGVNG

SEQ ID NO: 1479624 - protein, 18 aa, Mycobacterium tuberculosis
AGVKPSLALFAADYLLNQ

SEQ ID NO: 1479625 - protein, 24 aa, Mycobacterium tuberculosis
AGVLKGEVKDVLLLDVTPLSLGIE

SEQ ID NO: 1479626 - protein, 21 aa, Mycobacterium tuberculosis
AGVLLRYVPLTAKRVTGIVSR

SEQ ID NO: 1479627 - protein, 26 aa, Mycobacterium tuberculosis
AGVLLRYVPLTAKRVTGIVSRGGSIM

SEQ ID NO: 1479628 - protein, 32 aa, Mycobacterium tuberculosis
AGVMAGAVVSPVWPAPRALGLRAVAATATSAS

SEQ ID NO: 1479629 - protein, 17 aa, Mycobacterium tuberculosis
AGVPVLLAPAADAATAA

SEQ ID NO: 1479630 - protein, 19 aa, Mycobacterium tuberculosis
AGVPVVFLTAYYALRVLAQ

SEQ ID NO: 1479631 - protein, 18 aa, Mycobacterium tuberculosis
AGVSWKVYRNKTLGPISS

SEQ ID NO: 1479632 - protein, 31 aa, Mycobacterium tuberculosis
AGVTCGAAPEPWFGRDGGLGGNGGAGGQLYG

SEQ ID NO: 1479633 - protein, 20 aa, Mycobacterium tuberculosis
AGVVCPVHLGIMRGDLQTWG

SEQ ID NO: 1479634 - protein, 18 aa, Mycobacterium tuberculosis
AGVVGWWVNPQAPGIDAC

SEQ ID NO: 1479635 - protein, 19 aa, Mycobacterium tuberculosis
AGWACGVTVVLPPPGGPVE

SEQ ID NO: 1479636 - protein, 25 aa, Mycobacterium tuberculosis
AGWFGVAMILDFSWLPPEINSARIY

SEQ ID NO: 1479637 - protein, 27 aa, Mycobacterium tuberculosis
AGWPNLAAELQLAFQQLLVGDYNAAVA

SEQ ID NO: 1479638 - protein, 19 aa, Mycobacterium tuberculosis
AGWWASTRRAMAWRARPSW

SEQ ID NO: 1479639 - protein, 23 aa, Mycobacterium tuberculosis
AGYRGEIKVALINLDPAAPIVVH

SEQ ID NO: 1479640 - protein, 23 aa, Mycobacterium tuberculosis
AHAAIGLLRWWPAATADIGGLSA

SEQ ID NO: 1479641 - protein, 21 aa, Mycobacterium tuberculosis
AHAIPGLRQALGLAEDGTDER

SEQ ID NO: 1479642 - protein, 30 aa, Mycobacterium tuberculosis
AHAPPERLLRCIEAVLACREALAVNVKPKF

SEQ ID NO: 1479643 - protein, 28 aa, Mycobacterium tuberculosis
AHAQEYQRLSAQAAGFHAQFVQALNAGV

SEQ ID NO: 1479644 - protein, 21 aa, Mycobacterium tuberculosis
AHATAWYGLHELARIRAGDTV

SEQ ID NO: 1479645 - protein, 25 aa, Mycobacterium tuberculosis
AHGIDTVVVGWGYGRADFIDKTSTT

SEQ ID NO: 1479646 - protein, 20 aa, Mycobacterium tuberculosis
AHGKAGFGAPGGDGGDGGNG

SEQ ID NO: 1479647 - protein, 27 aa, Mycobacterium tuberculosis
AHGRPIRRSAQAAAFHTRVHPCALPTS

SEQ ID NO: 1479648 - protein, 19 aa, Mycobacterium tuberculosis
AHGRRRRARFFGRNVNVPL

SEQ ID NO: 1479649 - protein, 21 aa, Mycobacterium tuberculosis
AHHRESFLYTNFEELCDIFAR

SEQ ID NO: 1479650 - protein, 17 aa, Mycobacterium tuberculosis
AHHRLFSHVPWLASQLL

SEQ ID NO: 1479651 - protein, 31 aa, Mycobacterium tuberculosis
AHLLKFDSILGRLPCDVGLEGDDTIVVGRAK

SEQ ID NO: 1479652 - protein, 24 aa, Mycobacterium tuberculosis
AHLQRARVPMPIIAVSSLLRSHAV

SEQ ID NO: 1479653 - protein, 30 aa, Mycobacterium tuberculosis
AHLRHERDLGRLCLRRRSARRGPAEGAGRR

SEQ ID NO: 1479654 - protein, 41 aa, Mycobacterium tuberculosis
AHLRHPLFLDIMRPSAPAARSASPTPARPAVPGRDPVGGIG

SEQ ID NO: 1479655 - protein, 21 aa, Mycobacterium tuberculosis
AHLWWIRSQLRSMLVEDVRAR

SEQ ID NO: 1479656 - protein, 19 aa, Mycobacterium tuberculosis
AHNPFRVFTSMLAIEDRRY

SEQ ID NO: 1479657 - protein, 18 aa, Mycobacterium tuberculosis
AHQIHWLLLRFGVGSTVR

SEQ ID NO: 1479658 - protein, 22 aa, Mycobacterium tuberculosis
AHQIHWLLLRFGVGSTVRDYDP

SEQ ID NO: 1479659 - protein, 21 aa, Mycobacterium tuberculosis
AHRHSVGYARRSRQLRRATAV

SEQ ID NO: 1479660 - protein, 22 aa, Mycobacterium tuberculosis
AHRLIGLAMRGEQRRDGRRHLI

SEQ ID NO: 1479661 - protein, 17 aa, Mycobacterium tuberculosis
AHSRRWRAGCGVRTDSS

SEQ ID NO: 1479662 - protein, 27 aa, Mycobacterium tuberculosis
AHTAEFVFRPGPVFTNLLLADEINRTP

SEQ ID NO: 1479663 - protein, 18 aa, Mycobacterium tuberculosis
AHTWLRDHGVSLDTPARP

SEQ ID NO: 1479664 - protein, 20 aa, Mycobacterium tuberculosis
AHVDLYFEAAVAGAIPVIRP

SEQ ID NO: 1479665 - protein, 28 aa, Mycobacterium tuberculosis
AHWARRTGDPLARRVAAQTARFLLDELG

SEQ ID NO: 1479666 - protein, 24 aa, Mycobacterium tuberculosis
AHYGEMWAQDALAMYGYAASSAAA

SEQ ID NO: 1479667 - protein, 26 aa, Mycobacterium tuberculosis
AIAAFSAVKPSLAWAETYPGTLSYYL

SEQ ID NO: 1479668 - protein, 19 aa, Mycobacterium tuberculosis
AIADLRAAGLQVLATAVDG

SEQ ID NO: 1479669 - protein, 17 aa, Mycobacterium tuberculosis
AIARRSDGKLVLGSADG

SEQ ID NO: 1479670 - protein, 26 aa, Mycobacterium tuberculosis
AIASSARPRRHWAAQAATGGTGGYIE

SEQ ID NO: 1479671 - protein, 26 aa, Mycobacterium tuberculosis
AICSARTAAQFGIEPWVAMLSYSTGD

SEQ ID NO: 1479672 - protein, 17 aa, Mycobacterium tuberculosis
AIEDAWAATRWVAEHGP

SEQ ID NO: 1479673 - protein, 19 aa, Mycobacterium tuberculosis
AIELWKIVDRPNLFIKIPA

SEQ ID NO: 1479674 - protein, 22 aa, Mycobacterium tuberculosis
AIFDRGKALALYHTKRLASPAQ

SEQ ID NO: 1479675 - protein, 19 aa, Mycobacterium tuberculosis
AIGALKGRLHGGANEAVMH

SEQ ID NO: 1479676 - protein, 20 aa, Mycobacterium tuberculosis
AIGCPLINIHHSFLPAFTGA

SEQ ID NO: 1479677 - protein, 19 aa, Mycobacterium tuberculosis
AIHHVCCTRGCGRPSSFLI

SEQ ID NO: 1479678 - protein, 21 aa, Mycobacterium tuberculosis
AILDRTPWRAEEVTVIVAPMF

SEQ ID NO: 1479679 - protein, 19 aa, Mycobacterium tuberculosis
AILGIGDWGVGGIQIAVGK

SEQ ID NO: 1479680 - protein, 18 aa, Mycobacterium tuberculosis
AIRPDGQGLVAFVGVTHG

SEQ ID NO: 1479681 - protein, 21 aa, Mycobacterium tuberculosis
AIRQLAIRAFAAIDCRGLARV

SEQ ID NO: 1479682 - protein, 25 aa, Mycobacterium tuberculosis
AISAQCRLDHLLGIGQAVRPAGHDG

SEQ ID NO: 1479683 - protein, 25 aa, Mycobacterium tuberculosis
AISARSEWAPEFAIHDLDSLDALAA

SEQ ID NO: 1479684 - protein, 28 aa, Mycobacterium tuberculosis
AISDELWDLLPGYLIFRSIIPNRRSTPD

SEQ ID NO: 1479685 - protein, 23 aa, Mycobacterium tuberculosis
AISETYPPGSTFKVITTAAALAA

SEQ ID NO: 1479686 - protein, 30 aa, Mycobacterium tuberculosis
AISRANAEALVPITALLPAGADDVSAAIAA

SEQ ID NO: 1479687 - protein, 24 aa, Mycobacterium tuberculosis
AISRTSWDGIVVVCPPRANDESMP

SEQ ID NO: 1479688 - protein, 19 aa, Mycobacterium tuberculosis
AITAESFGSGAVGPITTGS

SEQ ID NO: 1479689 - protein, 18 aa, Mycobacterium tuberculosis
AITAYPDRGFTNAGTFAE

SEQ ID NO: 1479690 - protein, 17 aa, Mycobacterium tuberculosis
AITKVIWSEYFRRYTDL

SEQ ID NO: 1479691 - protein, 25 aa, Mycobacterium tuberculosis
AITLFPGGLTFPATSLLNLDVTAGA

SEQ ID NO: 1479692 - protein, 23 aa, Mycobacterium tuberculosis
AITTPALISGFFNTGSNMSGFFG

SEQ ID NO: 1479693 - protein, 24 aa, Mycobacterium tuberculosis
AITTPALISGFFNTGSNMSGFFGG

SEQ ID NO: 1479694 - protein, 17 aa, Mycobacterium tuberculosis
AIVAMFNQFCYLQLSGK

SEQ ID NO: 1479695 - protein, 18 aa, Mycobacterium tuberculosis
AIVDRIDYIVSLGETVMS

SEQ ID NO: 1479696 - protein, 22 aa, Mycobacterium tuberculosis
AIVDTAAGRICVESVTSGQRRY

SEQ ID NO: 1479697 - protein, 20 aa, Mycobacterium tuberculosis
AIVGDCVIHIMPMGTGVELS

SEQ ID NO: 1479698 - protein, 21 aa, Mycobacterium tuberculosis
AIVPLCALLPTAFRYGVNILA

SEQ ID NO: 1479699 - protein, 22 aa, Mycobacterium tuberculosis
AKAAELRYGRIPEVEKKLDAAL

SEQ ID NO: 1479700 - protein, 17 aa, Mycobacterium tuberculosis
AKAEAEIACGRASAVIA

SEQ ID NO: 1479701 - protein, 20 aa, Mycobacterium tuberculosis
AKAEALKCAKGFRYYAENAE

SEQ ID NO: 1479702 - protein, 26 aa, Mycobacterium tuberculosis
AKAGGLPGDLTFSWYAVDKTGQPWVV

SEQ ID NO: 1479703 - protein, 17 aa, Mycobacterium tuberculosis
AKAGRQVFKDYVAFPAL

SEQ ID NO: 1479704 - protein, 22 aa, Mycobacterium tuberculosis
AKAIATEIGRPVMVKAQVKIGG

SEQ ID NO: 1479705 - protein, 18 aa, Mycobacterium tuberculosis
AKAQALVAERGFEITTAA

SEQ ID NO: 1479706 - protein, 22 aa, Mycobacterium tuberculosis
AKARELATYFVGQVVGSLDRVR

SEQ ID NO: 1479707 - protein, 18 aa, Mycobacterium tuberculosis
AKARFIRRARRTKASRVS

SEQ ID NO: 1479708 - protein, 20 aa, Mycobacterium tuberculosis
AKARLSWAGRQMVGVGLARL

SEQ ID NO: 1479709 - protein, 25 aa, Mycobacterium tuberculosis
AKAVAGAFEAARVAMVDPVVVAANR

SEQ ID NO: 1479710 - protein, 20 aa, Mycobacterium tuberculosis
AKDFGGFGFHSVVIGTSGSG

SEQ ID NO: 1479711 - protein, 18 aa, Mycobacterium tuberculosis
AKDRGLWNLFLSAESGLT

SEQ ID NO: 1479712 - protein, 23 aa, Mycobacterium tuberculosis
AKESRGVHALRARGALIRIGHDA

SEQ ID NO: 1479713 - protein, 22 aa, Mycobacterium tuberculosis
AKFPELTAYQVINRIVQSAHNP

SEQ ID NO: 1479714 - protein, 22 aa, Mycobacterium tuberculosis
AKFPSGSFYLSISDLQINGPII

SEQ ID NO: 1479715 - protein, 17 aa, Mycobacterium tuberculosis
AKGEFLGGAIAPGVQVS

SEQ ID NO: 1479716 - protein, 21 aa, Mycobacterium tuberculosis
AKGGIVFRVQQELGVPVKLVG

SEQ ID NO: 1479717 - protein, 19 aa, Mycobacterium tuberculosis
AKGRIPCYVPVPTTIRGPV

SEQ ID NO: 1479718 - protein, 23 aa, Mycobacterium tuberculosis
AKHPRLRVRWVMRRDEKSLAEAI

SEQ ID NO: 1479719 - protein, 22 aa, Mycobacterium tuberculosis
AKKFYTSLFGWGYDDNPVPGGG

SEQ ID NO: 1479720 - protein, 18 aa, Mycobacterium tuberculosis
AKLGYPLDRSHTAAIIWY

SEQ ID NO: 1479721 - protein, 19 aa, Mycobacterium tuberculosis
AKLGYPLDRSHTAAIIWYD

SEQ ID NO: 1479722 - protein, 20 aa, Mycobacterium tuberculosis
AKLLFTNPVKAFQFLVDLIL

SEQ ID NO: 1479723 - protein, 19 aa, Mycobacterium tuberculosis
AKLPTIAAYAYKKSVGQPF

SEQ ID NO: 1479724 - protein, 25 aa, Mycobacterium tuberculosis
AKLSSAPMTTMWGAPLHRRWRGSRL

SEQ ID NO: 1479725 - protein, 19 aa, Mycobacterium tuberculosis
AKLVEWLLEQGITPDEIRA

SEQ ID NO: 1479726 - protein, 19 aa, Mycobacterium tuberculosis
AKMLRLPFGTPDFIEKIVT

SEQ ID NO: 1479727 - protein, 23 aa, Mycobacterium tuberculosis
AKMTARYSQWVRSRPLLLAGKSV

SEQ ID NO: 1479728 - protein, 25 aa, Mycobacterium tuberculosis
AKPEYWLSQQGRLAHPMVLRPVMTT

SEQ ID NO: 1479729 - protein, 21 aa, Mycobacterium tuberculosis
AKPGDLALLIGYGAGLSYAAP

SEQ ID NO: 1479730 - protein, 22 aa, Mycobacterium tuberculosis
AKPGDLALLIGYGAGLSYAAQV

SEQ ID NO: 1479731 - protein, 17 aa, Mycobacterium tuberculosis
AKPGQRIRIRIINSAAD

SEQ ID NO: 1479732 - protein, 17 aa, Mycobacterium tuberculosis
AKPKLLGPLGDLFTIMT

SEQ ID NO: 1479733 - protein, 27 aa, Mycobacterium tuberculosis
AKPKPPARCGWSRQRYQRDFCRPSAVR

SEQ ID NO: 1479734 - protein, 21 aa, Mycobacterium tuberculosis
AKQAPGWRVSTSVDENHTHTA

SEQ ID NO: 1479735 - protein, 18 aa, Mycobacterium tuberculosis
AKRKPGYANFAIADPPLK

SEQ ID NO: 1479736 - protein, 17 aa, Mycobacterium tuberculosis
AKRLPKLATGPFPPTTF

SEQ ID NO: 1479737 - protein, 25 aa, Mycobacterium tuberculosis
AKRLVDFAAGLAFALRGSFDKVATK

SEQ ID NO: 1479738 - protein, 26 aa, Mycobacterium tuberculosis
AKRVRRWMRRRYLLLEVPQLPGRGWV

SEQ ID NO: 1479739 - protein, 24 aa, Mycobacterium tuberculosis
AKRYTGRGMAFLDLIQEGNLGLIR

SEQ ID NO: 1479740 - protein, 20 aa, Mycobacterium tuberculosis
AKTARRPRVIGVVSNGDTAA

SEQ ID NO: 1479741 - protein, 21 aa, Mycobacterium tuberculosis
AKTARRPRVIGVVSNGDTAAA

SEQ ID NO: 1479742 - protein, 20 aa, Mycobacterium tuberculosis
AKTRLGDPVLAWADIQADPE

SEQ ID NO: 1479743 - protein, 18 aa, Mycobacterium tuberculosis
AKTRVFILAESLGGVESL

SEQ ID NO: 1479744 - protein, 19 aa, Mycobacterium tuberculosis
AKVDNGRCDPVAGTNTGES

SEQ ID NO: 1479745 - protein, 17 aa, Mycobacterium tuberculosis
AKVLQFAPGELKNLPGF

SEQ ID NO: 1479746 - protein, 17 aa, Mycobacterium tuberculosis
AKVWYDRLNAEDPTRKP

SEQ ID NO: 1479747 - protein, 22 aa, Mycobacterium tuberculosis
AKYADWARSHMAAMSHLAVGIQ

SEQ ID NO: 1479748 - protein, 24 aa, Mycobacterium tuberculosis
AKYADWARSHMAAMSHLAVGIQLA

SEQ ID NO: 1479749 - protein, 18 aa, Mycobacterium tuberculosis
ALADFLFDDERAMVRIDM

SEQ ID NO: 1479750 - protein, 18 aa, Mycobacterium tuberculosis
ALAEPADLIARVRAQQSM

SEQ ID NO: 1479751 - protein, 19 aa, Mycobacterium tuberculosis
ALAEPADLIARVRAQQSML

SEQ ID NO: 1479752 - protein, 18 aa, Mycobacterium tuberculosis
ALAEPADLIARVRSTTVD

SEQ ID NO: 1479753 - protein, 17 aa, Mycobacterium tuberculosis
ALAEVFAEVGLPEGVLS

SEQ ID NO: 1479754 - protein, 25 aa, Mycobacterium tuberculosis
ALAGEYGGPCYARIDAPADREQKAR

SEQ ID NO: 1479755 - protein, 25 aa, Mycobacterium tuberculosis
ALAIELARSGAKVAISDVDTDGLAD

SEQ ID NO: 1479756 - protein, 18 aa, Mycobacterium tuberculosis
ALAKLGVPPTTWRSSPST

SEQ ID NO: 1479757 - protein, 18 aa, Mycobacterium tuberculosis
ALALASSLLRVWMTRGRI

SEQ ID NO: 1479758 - protein, 23 aa, Mycobacterium tuberculosis
ALALLGRPLIGNGANGAPGTGAN

SEQ ID NO: 1479759 - protein, 19 aa, Mycobacterium tuberculosis
ALANAGLGLVSWVQTAAVA

SEQ ID NO: 1479760 - protein, 17 aa, Mycobacterium tuberculosis
ALAPARAARAATVATAV

SEQ ID NO: 1479761 - protein, 18 aa, Mycobacterium tuberculosis
ALARHIAEELPLLGSCTF

SEQ ID NO: 1479762 - protein, 23 aa, Mycobacterium tuberculosis
ALARPEEHVICIAGDGAFLMHGT

SEQ ID NO: 1479763 - protein, 22 aa, Mycobacterium tuberculosis
ALARRVSPTPVRLADERLTTVS

SEQ ID NO: 1479764 - protein, 26 aa, Mycobacterium tuberculosis
ALARVHPRATGIVLMLGDQPQLAPAT

SEQ ID NO: 1479765 - protein, 17 aa, Mycobacterium tuberculosis
ALASARLRRVEVDVVEG

SEQ ID NO: 1479766 - protein, 19 aa, Mycobacterium tuberculosis
ALASGERFAGVAIDGGVQV

SEQ ID NO: 1479767 - protein, 17 aa, Mycobacterium tuberculosis
ALASLPSGGFVPAGTTI

SEQ ID NO: 1479768 - protein, 22 aa, Mycobacterium tuberculosis
ALASRVRKAPGFALLGEKGQSR

SEQ ID NO: 1479769 - protein, 20 aa, Mycobacterium tuberculosis
ALCASRVPMSIAAIAGKLGV

SEQ ID NO: 1479770 - protein, 20 aa, Mycobacterium tuberculosis
ALCVGMCGQLIYVNRAAEVV

SEQ ID NO: 1479771 - protein, 19 aa, Mycobacterium tuberculosis
ALDASLLLVVLTRFLPPDD

SEQ ID NO: 1479772 - protein, 19 aa, Mycobacterium tuberculosis
ALDDPRGATPWTADLITGT

SEQ ID NO: 1479773 - protein, 17 aa, Mycobacterium tuberculosis
ALDELSAIVEEARGVPM

SEQ ID NO: 1479774 - protein, 19 aa, Mycobacterium tuberculosis
ALDGQRFLLTAGFFETHRP

SEQ ID NO: 1479775 - protein, 22 aa, Mycobacterium tuberculosis
ALDKLRIEALRNKDLEVDTSDL

SEQ ID NO: 1479776 - protein, 19 aa, Mycobacterium tuberculosis
ALDLARRYPVGKAVAAIDA

SEQ ID NO: 1479777 - protein, 20 aa, Mycobacterium tuberculosis
ALDLGDLVGALQCVVDPADH

SEQ ID NO: 1479778 - protein, 27 aa, Mycobacterium tuberculosis
ALDLLPTVRGAFCLTFMDENTLYACRD

SEQ ID NO: 1479779 - protein, 27 aa, Mycobacterium tuberculosis
ALDLLPTVRGAFCLTFMDENTLYAGRD

SEQ ID NO: 1479780 - protein, 21 aa, Mycobacterium tuberculosis
ALDQRIGLRYAMPPMTDTNTG

SEQ ID NO: 1479781 - protein, 18 aa, Mycobacterium tuberculosis
ALDRCARLLADIAGGEVS

SEQ ID NO: 1479782 - protein, 19 aa, Mycobacterium tuberculosis
ALDRMKAIVAQAVLDHVDR

SEQ ID NO: 1479783 - protein, 26 aa, Mycobacterium tuberculosis
ALDRNALHEVVGWWAKLPVTGMQPMQ

SEQ ID NO: 1479784 - protein, 18 aa, Mycobacterium tuberculosis
ALDVARIGSSIGAANAAT

SEQ ID NO: 1479785 - protein, 24 aa, Mycobacterium tuberculosis
ALDVRVAAVVTCVDCVRWLPQSLG

SEQ ID NO: 1479786 - protein, 26 aa, Mycobacterium tuberculosis
ALDVYRVGQNVAWQRWTEIAFGLTTD

SEQ ID NO: 1479787 - protein, 22 aa, Mycobacterium tuberculosis
ALEAHPAVLLFSHRSYIDGVVV

SEQ ID NO: 1479788 - protein, 19 aa, Mycobacterium tuberculosis
ALEGAGAGIVWAKVNTFGS

SEQ ID NO: 1479789 - protein, 17 aa, Mycobacterium tuberculosis
ALEHAGIDPLSLRGSAT

SEQ ID NO: 1479790 - protein, 20 aa, Mycobacterium tuberculosis
ALELDLHYLPCLEGHGAPGV

SEQ ID NO: 1479791 - protein, 18 aa, Mycobacterium tuberculosis
ALELDWYEHLGLCPKGEA

SEQ ID NO: 1479792 - protein, 17 aa, Mycobacterium tuberculosis
ALERGHGVLVCAPTGAG

SEQ ID NO: 1479793 - protein, 17 aa, Mycobacterium tuberculosis
ALFARARARGITPAMTL

SEQ ID NO: 1479794 - protein, 19 aa, Mycobacterium tuberculosis
ALFGRPLIGNGADGSPGTG

SEQ ID NO: 1479795 - protein, 19 aa, Mycobacterium tuberculosis
ALFRMWLPDPVRRVATGVL

SEQ ID NO: 1479796 - protein, 18 aa, Mycobacterium tuberculosis
ALFRWLKPLLSTRVGQRP

SEQ ID NO: 1479797 - protein, 18 aa, Mycobacterium tuberculosis
ALFSQLAAGPTRRRIDAA

SEQ ID NO: 1479798 - protein, 18 aa, Mycobacterium tuberculosis
ALGECDYLYVSHLHKDHF

SEQ ID NO: 1479799 - protein, 25 aa, Mycobacterium tuberculosis
ALGEGCCFRVSLPRVSDVDQLSLTP

SEQ ID NO: 1479800 - protein, 26 aa, Mycobacterium tuberculosis
ALGGNFRLTSLVSSRATSAPSRLAHS

SEQ ID NO: 1479801 - protein, 19 aa, Mycobacterium tuberculosis
ALGHPFGGSGARLMTTVLH

SEQ ID NO: 1479802 - protein, 18 aa, Mycobacterium tuberculosis
ALGPRVLGLSARRGAGAH

SEQ ID NO: 1479803 - protein, 24 aa, Mycobacterium tuberculosis
ALGRGDEALQWFLRSAAADIDGVT

SEQ ID NO: 1479804 - protein, 17 aa, Mycobacterium tuberculosis
ALGRRRPDIAVTILRLA

SEQ ID NO: 1479805 - protein, 19 aa, Mycobacterium tuberculosis
ALGRYGRLDGVLVASGSNH

SEQ ID NO: 1479806 - protein, 21 aa, Mycobacterium tuberculosis
ALGTQGAWTGSQWLMVEEAAN

SEQ ID NO: 1479807 - protein, 18 aa, Mycobacterium tuberculosis
ALHGVLMATNFFGINTIP

SEQ ID NO: 1479808 - protein, 18 aa, Mycobacterium tuberculosis
ALIDRRGYVLIVRPTTCR

SEQ ID NO: 1479809 - protein, 17 aa, Mycobacterium tuberculosis
ALIGPDVTREWVSDLPS

SEQ ID NO: 1479810 - protein, 17 aa, Mycobacterium tuberculosis
ALITIADLIEWRRKHEK

SEQ ID NO: 1479811 - protein, 26 aa, Mycobacterium tuberculosis
ALKAAECRAGARAWRRHEPQLALHAD

SEQ ID NO: 1479812 - protein, 22 aa, Mycobacterium tuberculosis
ALLALLPLVGVWRGEGEGRGPD

SEQ ID NO: 1479813 - protein, 18 aa, Mycobacterium tuberculosis
ALLDACFQSVGAHPGSQS

SEQ ID NO: 1479814 - protein, 25 aa, Mycobacterium tuberculosis
ALLDALRWLGLDWDEGPEVGGPYGP

SEQ ID NO: 1479815 - protein, 23 aa, Mycobacterium tuberculosis
ALLDIAARIAVPVVVSSALDSAV

SEQ ID NO: 1479816 - protein, 20 aa, Mycobacterium tuberculosis
ALLGRPLIGDGADGTAPGQN

SEQ ID NO: 1479817 - protein, 18 aa, Mycobacterium tuberculosis
ALLGRPLIGHGADGAPGT

SEQ ID NO: 1479818 - protein, 20 aa, Mycobacterium tuberculosis
ALLGRPLIGNGADGAAGTGQ

SEQ ID NO: 1479819 - protein, 20 aa, Mycobacterium tuberculosis
ALLGRPLIGNGADGAPGTGQ

SEQ ID NO: 1479820 - protein, 19 aa, Mycobacterium tuberculosis
ALLGRPLIGNGADGTAANP

SEQ ID NO: 1479821 - protein, 21 aa, Mycobacterium tuberculosis
ALLLNRISLAPGEAIFLPAGN

SEQ ID NO: 1479822 - protein, 26 aa, Mycobacterium tuberculosis
ALLLRGSPCAIGWVAGWLSAEFPALV

SEQ ID NO: 1479823 - protein, 17 aa, Mycobacterium tuberculosis
ALLPRAGAAAAAALPAL

SEQ ID NO: 1479824 - protein, 18 aa, Mycobacterium tuberculosis
ALLREFDAKLGRGPAVAV

SEQ ID NO: 1479825 - protein, 18 aa, Mycobacterium tuberculosis
ALLVPYLLSAIRMVEAGF

SEQ ID NO: 1479826 - protein, 26 aa, Mycobacterium tuberculosis
ALLYWRGRGLPGKRRLMTWRGGYHGD

SEQ ID NO: 1479827 - protein, 24 aa, Mycobacterium tuberculosis
ALMGAFPMRLILATMLVAGRLLAT

SEQ ID NO: 1479828 - protein, 22 aa, Mycobacterium tuberculosis
ALMMRRVMPLLTIGDQFPAYQL

SEQ ID NO: 1479829 - protein, 25 aa, Mycobacterium tuberculosis
ALMQPRARGRITLVSSDPQIPVRIE

SEQ ID NO: 1479830 - protein, 25 aa, Mycobacterium tuberculosis
ALMRSCTGWPSGVWIDQPRRTAPDG

SEQ ID NO: 1479831 - protein, 20 aa, Mycobacterium tuberculosis
ALNRSCRRWFGMTPRQYRAY

SEQ ID NO: 1479832 - protein, 18 aa, Mycobacterium tuberculosis
ALPAARATDEFPWCHNQT

SEQ ID NO: 1479833 - protein, 19 aa, Mycobacterium tuberculosis
ALPAWVYIDHRVMPGRPRP

SEQ ID NO: 1479834 - protein, 25 aa, Mycobacterium tuberculosis
ALPEEFRMAVYYADVEGFPYKEIAE

SEQ ID NO: 1479835 - protein, 18 aa, Mycobacterium tuberculosis
ALPLRAMNMTVRRNAFGS

SEQ ID NO: 1479836 - protein, 21 aa, Mycobacterium tuberculosis
ALPRHGRGSIVYARSTTIEAQ

SEQ ID NO: 1479837 - protein, 24 aa, Mycobacterium tuberculosis
ALPRLGPTDALPRCRQTVHRGAVI

SEQ ID NO: 1479838 - protein, 21 aa, Mycobacterium tuberculosis
ALPRRGISALVRRPKRRPLDE

SEQ ID NO: 1479839 - protein, 17 aa, Mycobacterium tuberculosis
ALPRWRGAAGRLEVWYA

SEQ ID NO: 1479840 - protein, 18 aa, Mycobacterium tuberculosis
ALPSRLAPLTANTITDRA

SEQ ID NO: 1479841 - protein, 18 aa, Mycobacterium tuberculosis
ALPTRVISPPGLSSPATW

SEQ ID NO: 1479842 - protein, 20 aa, Mycobacterium tuberculosis
ALPVCRRPGAKTVTALGGGY

SEQ ID NO: 1479843 - protein, 17 aa, Mycobacterium tuberculosis
ALQALPEDFRMAVYYAD

SEQ ID NO: 1479844 - protein, 20 aa, Mycobacterium tuberculosis
ALQCGRSVHTRRAYLGDLRS

SEQ ID NO: 1479845 - protein, 35 aa, Mycobacterium tuberculosis
ALQCMPLNWVRRRHGLSSLGWNLCRIFTDGDHTLY

SEQ ID NO: 1479846 - protein, 19 aa, Mycobacterium tuberculosis
ALQCRQFQHRCGQRRQLQH

SEQ ID NO: 1479847 - protein, 26 aa, Mycobacterium tuberculosis
ALQRRRGGGLSARVRASARSKGLNEL

SEQ ID NO: 1479848 - protein, 17 aa, Mycobacterium tuberculosis
ALQRVRRGAHVRRQNHR

SEQ ID NO: 1479849 - protein, 24 aa, Mycobacterium tuberculosis
ALRAAAQHWATWAMQKQELARNLI

SEQ ID NO: 1479850 - protein, 22 aa, Mycobacterium tuberculosis
ALRPPVFAGTIWVQQGSQPLAD

SEQ ID NO: 1479851 - protein, 17 aa, Mycobacterium tuberculosis
ALRRAARADGWMHGGGD

SEQ ID NO: 1479852 - protein, 24 aa, Mycobacterium tuberculosis
ALRRRLLQRFAIEPLAPVRDAEDA

SEQ ID NO: 1479853 - protein, 31 aa, Mycobacterium tuberculosis
ALRRRRQRRCPADSGTRTRRALPVGSAGPVE

SEQ ID NO: 1479854 - protein, 28 aa, Mycobacterium tuberculosis
ALRSWRPRVAVWGIHLLRRGGLTGDGIP

SEQ ID NO: 1479855 - protein, 29 aa, Mycobacterium tuberculosis
ALRSWRPRVAVWGIHLLRRGGLTGDGIPT

SEQ ID NO: 1479856 - protein, 24 aa, Mycobacterium tuberculosis
ALRYPARYLFVFLDHHGMLSVFGS

SEQ ID NO: 1479857 - protein, 17 aa, Mycobacterium tuberculosis
ALSAGRRPRAWRGVVVA

SEQ ID NO: 1479858 - protein, 25 aa, Mycobacterium tuberculosis
ALSAQAATFISIFVQPLTAGAGSYA

SEQ ID NO: 1479859 - protein, 21 aa, Mycobacterium tuberculosis
ALSASQALCFGRRPQRWSGRS

SEQ ID NO: 1479860 - protein, 23 aa, Mycobacterium tuberculosis
ALSDLQPGDVLTFYSDASHAGIY

SEQ ID NO: 1479861 - protein, 20 aa, Mycobacterium tuberculosis
ALSEGATPCEIAADELPQAG

SEQ ID NO: 1479862 - protein, 17 aa, Mycobacterium tuberculosis
ALSETLRRRRASGGPAE

SEQ ID NO: 1479863 - protein, 32 aa, Mycobacterium tuberculosis
ALSQYVEPVRPWPGSAAGLIVRLGTDPAGDGF

SEQ ID NO: 1479864 - protein, 43 aa, Mycobacterium tuberculosis
ALSYTSPLPPLPVVAAVSVVTGLPVPPPAPTVAQGELAAMVAP

SEQ ID NO: 1479865 - protein, 22 aa, Mycobacterium tuberculosis
ALTACGLIAVAVARADAAASYF

SEQ ID NO: 1479866 - protein, 17 aa, Mycobacterium tuberculosis
ALTALWRSYGVTPDAVI

SEQ ID NO: 1479867 - protein, 24 aa, Mycobacterium tuberculosis
ALTDLWPAAACGRAETERQVSREL

SEQ ID NO: 1479868 - protein, 17 aa, Mycobacterium tuberculosis
ALTEFKAMFQMKFYAVA

SEQ ID NO: 1479869 - protein, 18 aa, Mycobacterium tuberculosis
ALTGEWFGALAVIAPSVS

SEQ ID NO: 1479870 - protein, 18 aa, Mycobacterium tuberculosis
ALTGGLLYICFDGTSGML

SEQ ID NO: 1479871 - protein, 18 aa, Mycobacterium tuberculosis
ALTPRPAPTVATEHLHEL

SEQ ID NO: 1479872 - protein, 36 aa, Mycobacterium tuberculosis
ALTQVGAPYAWGGAAPGGFDCSGLVMWAFQQAGIAL

SEQ ID NO: 1479873 - protein, 25 aa, Mycobacterium tuberculosis
ALTRIPRVGVDWSQTTSFDEDTTAM

SEQ ID NO: 1479874 - protein, 18 aa, Mycobacterium tuberculosis
ALTRPRHPDYWTEIDSAA

SEQ ID NO: 1479875 - protein, 17 aa, Mycobacterium tuberculosis
ALVGLTLAPSSQVPAVP

SEQ ID NO: 1479876 - protein, 18 aa, Mycobacterium tuberculosis
ALVIKGGYMDGHPLTVAE

SEQ ID NO: 1479877 - protein, 18 aa, Mycobacterium tuberculosis
ALVPGRPAPTLVTAAAVE

SEQ ID NO: 1479878 - protein, 17 aa, Mycobacterium tuberculosis
ALVRTGVAVAVPFGMVG

SEQ ID NO: 1479879 - protein, 21 aa, Mycobacterium tuberculosis
ALWERLTRAVGMDARDAVWQH

SEQ ID NO: 1479880 - protein, 17 aa, Mycobacterium tuberculosis
ALWSLRPVLPMPGRGCQ

SEQ ID NO: 1479881 - protein, 21 aa, Mycobacterium tuberculosis
ALWTALKTLYPVGITADSLTR

SEQ ID NO: 1479882 - protein, 24 aa, Mycobacterium tuberculosis
ALYAEMWAQDALAMYGYAAASGAA

SEQ ID NO: 1479883 - protein, 20 aa, Mycobacterium tuberculosis
ALYRVAFECAQDLAADSVVY

SEQ ID NO: 1479884 - protein, 26 aa, Mycobacterium tuberculosis
ALYSPQRWKYLTSGLLGLQRGSDAGD

SEQ ID NO: 1479885 - protein, 20 aa, Mycobacterium tuberculosis
AMAFDEMFDAQGIVRGPYKG

SEQ ID NO: 1479886 - protein, 19 aa, Mycobacterium tuberculosis
AMAGYHFDASAAVAQLAPW

SEQ ID NO: 1479887 - protein, 21 aa, Mycobacterium tuberculosis
AMAGYHFDASAAVAQLRPGSR

SEQ ID NO: 1479888 - protein, 33 aa, Mycobacterium tuberculosis
AMDPRQRLALELTWELLEDAFVVPETLRGQPIA

SEQ ID NO: 1479889 - protein, 21 aa, Mycobacterium tuberculosis
AMFDLWFPAALGARAVITTED

SEQ ID NO: 1479890 - protein, 24 aa, Mycobacterium tuberculosis
AMGLVEIRPELRAVTVDGDLVGAG

SEQ ID NO: 1479891 - protein, 18 aa, Mycobacterium tuberculosis
AMGVRVATSFSARLFNLL

SEQ ID NO: 1479892 - protein, 19 aa, Mycobacterium tuberculosis
AMLERAHLAYGEIMDLAVG

SEQ ID NO: 1479893 - protein, 20 aa, Mycobacterium tuberculosis
AMLGWPLRTFECTVPPGQLG

SEQ ID NO: 1479894 - protein, 23 aa, Mycobacterium tuberculosis
AMLRRLGIEGDFKGGFRVTTPEV

SEQ ID NO: 1479895 - protein, 17 aa, Mycobacterium tuberculosis
AMNEAFVAMLGASADSY

SEQ ID NO: 1479896 - protein, 19 aa, Mycobacterium tuberculosis
AMPNTVWTTGCDSWYLNKD

SEQ ID NO: 1479897 - protein, 19 aa, Mycobacterium tuberculosis
AMPTFRQVFLAGASGMALE

SEQ ID NO: 1479898 - protein, 27 aa, Mycobacterium tuberculosis
AMQQGCYGPCKGAVVALEPSTGKILAL

SEQ ID NO: 1479899 - protein, 23 aa, Mycobacterium tuberculosis
AMRDGRVSVFMGMGGNFASATPD

SEQ ID NO: 1479900 - protein, 19 aa, Mycobacterium tuberculosis
AMRFLPWDRRRYQPTGRLA

SEQ ID NO: 1479901 - protein, 19 aa, Mycobacterium tuberculosis
AMRISHCRPPGSDRDVVLM

SEQ ID NO: 1479902 - protein, 17 aa, Mycobacterium tuberculosis
AMRPRRRRASAATFGPL

SEQ ID NO: 1479903 - protein, 18 aa, Mycobacterium tuberculosis
AMRPRRRRASAATFGPLW

SEQ ID NO: 1479904 - protein, 18 aa, Mycobacterium tuberculosis
AMSALPPAPPAPPGAPGA

SEQ ID NO: 1479905 - protein, 23 aa, Mycobacterium tuberculosis
AMSLKMKVCNHVIMRHHHMHGRR

SEQ ID NO: 1479906 - protein, 17 aa, Mycobacterium tuberculosis
AMSQNFTNVVMTVTDTT

SEQ ID NO: 1479907 - protein, 25 aa, Mycobacterium tuberculosis
AMSRELGVQFARQGIRVNALCPGPV

SEQ ID NO: 1479908 - protein, 17 aa, Mycobacterium tuberculosis
AMTADVFGAAPDVEAGQ

SEQ ID NO: 1479909 - protein, 18 aa, Mycobacterium tuberculosis
AMTNFLVTGVRHQRRDDR

SEQ ID NO: 1479910 - protein, 19 aa, Mycobacterium tuberculosis
AMVKMRQGRHFPDGIRQRR

SEQ ID NO: 1479911 - protein, 27 aa, Mycobacterium tuberculosis
AMYEQMWPADVAAMVGYHGGASAAAAQ

SEQ ID NO: 1479912 - protein, 22 aa, Mycobacterium tuberculosis
ANAFVLRGGVPVFVDIRPDTLN

SEQ ID NO: 1479913 - protein, 19 aa, Mycobacterium tuberculosis
ANAGDYGTGAFITGSMNNG

SEQ ID NO: 1479914 - protein, 19 aa, Mycobacterium tuberculosis
ANAIGYPIAASVALVTPAA

SEQ ID NO: 1479915 - protein, 18 aa, Mycobacterium tuberculosis
ANASPMQAVLDVVNGPTQ

SEQ ID NO: 1479916 - protein, 18 aa, Mycobacterium tuberculosis
ANAYDFFNMWRVRPAGLR

SEQ ID NO: 1479917 - protein, 26 aa, Mycobacterium tuberculosis
ANCRGGEYRRCVRHGLADMYGFIPVD

SEQ ID NO: 1479918 - protein, 20 aa, Mycobacterium tuberculosis
ANDGFTFFPGGLTFPRASAG

SEQ ID NO: 1479919 - protein, 18 aa, Mycobacterium tuberculosis
ANEMPEVQAGIGVAAGQI

SEQ ID NO: 1479920 - protein, 21 aa, Mycobacterium tuberculosis
ANFAALRPWPGLTVEIRKSAP

SEQ ID NO: 1479921 - protein, 22 aa, Mycobacterium tuberculosis
ANFAALRPWPGLTVEIRKSAPA

SEQ ID NO: 1479922 - protein, 17 aa, Mycobacterium tuberculosis
ANFKTPRSVRFVDVLPR

SEQ ID NO: 1479923 - protein, 20 aa, Mycobacterium tuberculosis
ANFRDVMIALGLYPDPDAVV

SEQ ID NO: 1479924 - protein, 20 aa, Mycobacterium tuberculosis
ANFTDGWLRTGDLGSLSAAG

SEQ ID NO: 1479925 - protein, 21 aa, Mycobacterium tuberculosis
ANFTDGWLRTGDLGSLSAAGD

SEQ ID NO: 1479926 - protein, 25 aa, Mycobacterium tuberculosis
ANGAQCPRCNEEYRQLCAALAAALS

SEQ ID NO: 1479927 - protein, 23 aa, Mycobacterium tuberculosis
ANGFDVGRRLGIGSRETYILALK

SEQ ID NO: 1479928 - protein, 26 aa, Mycobacterium tuberculosis
ANGGAGGAGGWLFGNGGAGGVGGAGG

SEQ ID NO: 1479929 - protein, 25 aa, Mycobacterium tuberculosis
ANGGAGGNGGWLYGNGGLGGNGGAA

SEQ ID NO: 1479930 - protein, 28 aa, Mycobacterium tuberculosis
ANGGAGGNGGWLYGNGGLGGNGGAATQI

SEQ ID NO: 1479931 - protein, 20 aa, Mycobacterium tuberculosis
ANGGDAGWLIGNGGAGGSGA

SEQ ID NO: 1479932 - protein, 23 aa, Mycobacterium tuberculosis
ANGGLRYAPRADLATREEQIAVA

SEQ ID NO: 1479933 - protein, 17 aa, Mycobacterium tuberculosis
ANGRAGGQLTGRRRHRP

SEQ ID NO: 1479934 - protein, 18 aa, Mycobacterium tuberculosis
ANGSFAPSFVGFGGNGGN

SEQ ID NO: 1479935 - protein, 26 aa, Mycobacterium tuberculosis
ANGSPSWSAAPNFAFELAVRKTTDAD

SEQ ID NO: 1479936 - protein, 17 aa, Mycobacterium tuberculosis
ANGSRIYVLLPQTTTGR

SEQ ID NO: 1479937 - protein, 24 aa, Mycobacterium tuberculosis
ANGVRRIATEAGITVIAGMFTPTG

SEQ ID NO: 1479938 - protein, 17 aa, Mycobacterium tuberculosis
ANHSVWFHRQVNFDDWV

SEQ ID NO: 1479939 - protein, 17 aa, Mycobacterium tuberculosis
ANIEKYLGWSRRQIDLH

SEQ ID NO: 1479940 - protein, 19 aa, Mycobacterium tuberculosis
ANIGSIMGIGFPPWDRWQC

SEQ ID NO: 1479941 - protein, 20 aa, Mycobacterium tuberculosis
ANLADIWRRRDLPRDAKAPV

SEQ ID NO: 1479942 - protein, 21 aa, Mycobacterium tuberculosis
ANLGGGNWGFANLGSGNIGNT

SEQ ID NO: 1479943 - protein, 20 aa, Mycobacterium tuberculosis
ANPAVRVRIGGRWRSGTAYL

SEQ ID NO: 1479944 - protein, 20 aa, Mycobacterium tuberculosis
ANPMLRMGIWFNAVPAADTP

SEQ ID NO: 1479945 - protein, 17 aa, Mycobacterium tuberculosis
ANPWLSGYMSQALNLLT

SEQ ID NO: 1479946 - protein, 22 aa, Mycobacterium tuberculosis
ANREAFLALIRSNWLGLNAPWI

SEQ ID NO: 1479947 - protein, 18 aa, Mycobacterium tuberculosis
ANRRTWIVLRADPERTRK

SEQ ID NO: 1479948 - protein, 23 aa, Mycobacterium tuberculosis
ANRSAFVQLVLSNVFGQNAPAIA

SEQ ID NO: 1479949 - protein, 18 aa, Mycobacterium tuberculosis
ANRSALDVMLDWDPTTAY

SEQ ID NO: 1479950 - protein, 22 aa, Mycobacterium tuberculosis
ANRVRTWLLAVSNVFGQNAPAI

SEQ ID NO: 1479951 - protein, 19 aa, Mycobacterium tuberculosis
ANSDFYAVCGWDAVNEAIG

SEQ ID NO: 1479952 - protein, 20 aa, Mycobacterium tuberculosis
ANSLPGQWTAHVTLARRVGG

SEQ ID NO: 1479953 - protein, 21 aa, Mycobacterium tuberculosis
ANSLQGLAFALAYQGELSAAR

SEQ ID NO: 1479954 - protein, 18 aa, Mycobacterium tuberculosis
ANTGRPLIGNGTNGAPGT

SEQ ID NO: 1479955 - protein, 20 aa, Mycobacterium tuberculosis
ANTPDSCWPTLPAPDTSAGV

SEQ ID NO: 1479956 - protein, 17 aa, Mycobacterium tuberculosis
ANVSRHHAVIVDTGTNY

SEQ ID NO: 1479957 - protein, 25 aa, Mycobacterium tuberculosis
ANVVGGIDWDGHGLLGLEDSLDAVL

SEQ ID NO: 1479958 - protein, 20 aa, Mycobacterium tuberculosis
ANYRRSRRPPPMPSANRYLP

SEQ ID NO: 1479959 - protein, 40 aa, Mycobacterium tuberculosis
APAAPAPPQARRGRPAASCTTGGKGRSRAATGAASGGNGG

SEQ ID NO: 1479960 - protein, 17 aa, Mycobacterium tuberculosis
APAETAARQGRCWRRRL

SEQ ID NO: 1479961 - protein, 17 aa, Mycobacterium tuberculosis
APAFVDAAAKDLATIGS

SEQ ID NO: 1479962 - protein, 17 aa, Mycobacterium tuberculosis
APANVSGMLNIGSNLAG

SEQ ID NO: 1479963 - protein, 25 aa, Mycobacterium tuberculosis
APAPPRPPVPPAPPRPPGEPTPVPP

SEQ ID NO: 1479964 - protein, 26 aa, Mycobacterium tuberculosis
APAPPVRRLAERGAPEIQAYDPVFSP

SEQ ID NO: 1479965 - protein, 19 aa, Mycobacterium tuberculosis
APARNRCGWARFSRPARNS

SEQ ID NO: 1479966 - protein, 18 aa, Mycobacterium tuberculosis
APARPARTADPWLAPIFA

SEQ ID NO: 1479967 - protein, 25 aa, Mycobacterium tuberculosis
APARPARTADPWLAPIFARSTLRHS

SEQ ID NO: 1479968 - protein, 28 aa, Mycobacterium tuberculosis
APARPARTADPWLAPIFARSTLRHSHHL

SEQ ID NO: 1479969 - protein, 17 aa, Mycobacterium tuberculosis
APARPGVEEARRRNGGG

SEQ ID NO: 1479970 - protein, 19 aa, Mycobacterium tuberculosis
APASASPLHTLKQQALAAI

SEQ ID NO: 1479971 - protein, 20 aa, Mycobacterium tuberculosis
APCAHVRQLLSTRIDEVRAQ

SEQ ID NO: 1479972 - protein, 20 aa, Mycobacterium tuberculosis
APCEPACVLGINQDPVTIKQ

SEQ ID NO: 1479973 - protein, 17 aa, Mycobacterium tuberculosis
APCRFGTRLRWWHCAAG

SEQ ID NO: 1479974 - protein, 19 aa, Mycobacterium tuberculosis
APCRLSTKHALALTNRGGA

SEQ ID NO: 1479975 - protein, 20 aa, Mycobacterium tuberculosis
APCRLSTKHALALTNRGGAT

SEQ ID NO: 1479976 - protein, 26 aa, Mycobacterium tuberculosis
APDAGPPQRWFVVWLGTANNPVDKGA

SEQ ID NO: 1479977 - protein, 18 aa, Mycobacterium tuberculosis
APDALSLPDAELRETFRA

SEQ ID NO: 1479978 - protein, 17 aa, Mycobacterium tuberculosis
APDDALWVRTGDYGTYF

SEQ ID NO: 1479979 - protein, 18 aa, Mycobacterium tuberculosis
APDGGFGGNGGKGGQGGI

SEQ ID NO: 1479980 - protein, 24 aa, Mycobacterium tuberculosis
APDGRDHAALAFRRDSRAAASRHR

SEQ ID NO: 1479981 - protein, 22 aa, Mycobacterium tuberculosis
APDRPRIGEILGAFDDKIAAND

SEQ ID NO: 1479982 - protein, 25 aa, Mycobacterium tuberculosis
APDSLCGVRVFFPDPWPKARHHKRR

SEQ ID NO: 1479983 - protein, 38 aa, Mycobacterium tuberculosis
APDYYRRAEICRERLGPVLRRLTVNYPPIMFHPLNTIT

SEQ ID NO: 1479984 - protein, 21 aa, Mycobacterium tuberculosis
APECCAVVAYGALLGGPLLAV

SEQ ID NO: 1479985 - protein, 24 aa, Mycobacterium tuberculosis
APECPDWLPPGAKDMWGRVVPELA

SEQ ID NO: 1479986 - protein, 21 aa, Mycobacterium tuberculosis
APEGMPPIWNTYIAVDDVDAV

SEQ ID NO: 1479987 - protein, 22 aa, Mycobacterium tuberculosis
APELRRAGGDPALLSPRDKLAQ

SEQ ID NO: 1479988 - protein, 24 aa, Mycobacterium tuberculosis
APEPAAPAGCCWAKTGSTGCRSRA

SEQ ID NO: 1479989 - protein, 24 aa, Mycobacterium tuberculosis
APEPPMPPAPPWPPVPPAPPEPLM

SEQ ID NO: 1479990 - protein, 18 aa, Mycobacterium tuberculosis
APFLQQYLANQFGYGQLT

SEQ ID NO: 1479991 - protein, 19 aa, Mycobacterium tuberculosis
APFLQQYLANQFGYGQLTL

SEQ ID NO: 1479992 - protein, 20 aa, Mycobacterium tuberculosis
APFLQQYLANQFGYGQLTLT

SEQ ID NO: 1479993 - protein, 17 aa, Mycobacterium tuberculosis
APFWVGRGFGLNLSVVT

SEQ ID NO: 1479994 - protein, 18 aa, Mycobacterium tuberculosis
APGACVVVNPCLAGGSLE

SEQ ID NO: 1479995 - protein, 22 aa, Mycobacterium tuberculosis
APGARLAWREDATWAPHGGESR

SEQ ID NO: 1479996 - protein, 22 aa, Mycobacterium tuberculosis
APGGASALTIGNWQQPPGPGRR

SEQ ID NO: 1479997 - protein, 29 aa, Mycobacterium tuberculosis
APGGHRACWLFGNELGFLLQKKKAAVPAA

SEQ ID NO: 1479998 - protein, 20 aa, Mycobacterium tuberculosis
APGGHRCSGPPRNHRAPKAT

SEQ ID NO: 1479999 - protein, 21 aa, Mycobacterium tuberculosis
APGGPGGLLLGNGGNGGSGAP

SEQ ID NO: 1480000 - protein, 25 aa, Mycobacterium tuberculosis
APGHMLGGLPLGHSVNAGRGINNAL

SEQ ID NO: 1480001 - protein, 22 aa, Mycobacterium tuberculosis
APGHMLGGLPLGQLTNSGGGFG

SEQ ID NO: 1480002 - protein, 18 aa, Mycobacterium tuberculosis
APGLYSWLPLGLRVLRNI

SEQ ID NO: 1480003 - protein, 18 aa, Mycobacterium tuberculosis
APGPARCCVVLKRCSAHD

SEQ ID NO: 1480004 - protein, 19 aa, Mycobacterium tuberculosis
APGSPPWPPAPPAPALKAW

SEQ ID NO: 1480005 - protein, 17 aa, Mycobacterium tuberculosis
APHLAQITCPALVLNAE

SEQ ID NO: 1480006 - protein, 18 aa, Mycobacterium tuberculosis
APICLTWELTYACNLACV

SEQ ID NO: 1480007 - protein, 19 aa, Mycobacterium tuberculosis
APIDRRRRETGIDGTGQAG

SEQ ID NO: 1480008 - protein, 17 aa, Mycobacterium tuberculosis
APIEIVGRFLALLELYR

SEQ ID NO: 1480009 - protein, 25 aa, Mycobacterium tuberculosis
APILKGDKGEPCWPDGVVGSLTHCA

SEQ ID NO: 1480010 - protein, 33 aa, Mycobacterium tuberculosis
APIRRGRRPGPSCRRWRPVKCCESVRRPVPGTP

SEQ ID NO: 1480011 - protein, 19 aa, Mycobacterium tuberculosis
APITLRGGQLVAFDSSSGR

SEQ ID NO: 1480012 - protein, 17 aa, Mycobacterium tuberculosis
APIWTGSRCVDTAGRRP

SEQ ID NO: 1480013 - protein, 19 aa, Mycobacterium tuberculosis
APLADVHKLAFVSAKGGVG

SEQ ID NO: 1480014 - protein, 22 aa, Mycobacterium tuberculosis
APLAHRLGMASVKWELEDLSFA

SEQ ID NO: 1480015 - protein, 25 aa, Mycobacterium tuberculosis
APLAPGVEPLPPWPPAPPTPGSPPW

SEQ ID NO: 1480016 - protein, 23 aa, Mycobacterium tuberculosis
APLAPIRLRIGMHTGEVSSPDEG

SEQ ID NO: 1480017 - protein, 24 aa, Mycobacterium tuberculosis
APLDARIGWRRATLAVCEALLANI

SEQ ID NO: 1480018 - protein, 18 aa, Mycobacterium tuberculosis
APLGGGLRRAELGVRRDL

SEQ ID NO: 1480019 - protein, 18 aa, Mycobacterium tuberculosis
APLHRRWRGSRLRDPRQA

SEQ ID NO: 1480020 - protein, 18 aa, Mycobacterium tuberculosis
APLMAMAPSSLALKSFRE

SEQ ID NO: 1480021 - protein, 19 aa, Mycobacterium tuberculosis
APLMWTSLVVTAWMGEHGG

SEQ ID NO: 1480022 - protein, 18 aa, Mycobacterium tuberculosis
APLNWCNPSGRALGAPPT

SEQ ID NO: 1480023 - protein, 17 aa, Mycobacterium tuberculosis
APLPAPAAERLCRRGCA

SEQ ID NO: 1480024 - protein, 20 aa, Mycobacterium tuberculosis
APLPAWTHARLFIDDDGQEQ

SEQ ID NO: 1480025 - protein, 21 aa, Mycobacterium tuberculosis
APLPISGRPSSVWAGALITSS

SEQ ID NO: 1480026 - protein, 20 aa, Mycobacterium tuberculosis
APLRYGELIAALNATSGERA

SEQ ID NO: 1480027 - protein, 17 aa, Mycobacterium tuberculosis
APLVPLAVSAFLTSRKK

SEQ ID NO: 1480028 - protein, 29 aa, Mycobacterium tuberculosis
APLVPLPISGRPVFARKNSLIGASSGEVA

SEQ ID NO: 1480029 - protein, 17 aa, Mycobacterium tuberculosis
APMPAPRAILAAAVEGA

SEQ ID NO: 1480030 - protein, 23 aa, Mycobacterium tuberculosis
APMPARSSVAIATKSGAAITKDI

SEQ ID NO: 1480031 - protein, 18 aa, Mycobacterium tuberculosis
APMRPRVGVHTGDVRLRG

SEQ ID NO: 1480032 - protein, 17 aa, Mycobacterium tuberculosis
APMTTMWGAPLHRSGED

SEQ ID NO: 1480033 - protein, 20 aa, Mycobacterium tuberculosis
APNFAYALLAKRLRRQAKPG

SEQ ID NO: 1480034 - protein, 33 aa, Mycobacterium tuberculosis
APNRIEGWMPFGRVFETLAWGRRHVVMGANQVD

SEQ ID NO: 1480035 - protein, 19 aa, Mycobacterium tuberculosis
APNSMTFPPTPPVPGDTTA

SEQ ID NO: 1480036 - protein, 43 aa, Mycobacterium tuberculosis
APPACPVPGAPLAPLPISGRPSNSWVGVFTMLSRPSNGAAAAA

SEQ ID NO: 1480037 - protein, 23 aa, Mycobacterium tuberculosis
APPAPKRAFEASAPITAGTTGAG

SEQ ID NO: 1480038 - protein, 31 aa, Mycobacterium tuberculosis
APPAPPLPYSRPALPPAPPAPAFMPTPNNDV

SEQ ID NO: 1480039 - protein, 18 aa, Mycobacterium tuberculosis
APPDPRRTQGLATPPRAG

SEQ ID NO: 1480040 - protein, 24 aa, Mycobacterium tuberculosis
APPHGGIAFGWDRTTALLAGMDSI

SEQ ID NO: 1480041 - protein, 24 aa, Mycobacterium tuberculosis
APPMPRLPPLPPLPPTPSPPLSNV

SEQ ID NO: 1480042 - protein, 18 aa, Mycobacterium tuberculosis
APPNLIRAILRAPVDLLF

SEQ ID NO: 1480043 - protein, 25 aa, Mycobacterium tuberculosis
APPPRSIGRRVTAGDGRAREGDGGR

SEQ ID NO: 1480044 - protein, 17 aa, Mycobacterium tuberculosis
APPRIGVLGIARIAPLA

SEQ ID NO: 1480045 - protein, 23 aa, Mycobacterium tuberculosis
APPRRATLVVPFLGAHRASRSPR

SEQ ID NO: 1480046 - protein, 25 aa, Mycobacterium tuberculosis
APPRRVSPGGAYAWRAPQGQFDRKP

SEQ ID NO: 1480047 - protein, 23 aa, Mycobacterium tuberculosis
APPSPPLLAWALKVPLPSPPAPP

SEQ ID NO: 1480048 - protein, 18 aa, Mycobacterium tuberculosis
APPTPGSPPWPPAPPTPP

SEQ ID NO: 1480049 - protein, 19 aa, Mycobacterium tuberculosis
APPTPGSPPWPPAPPTPPL

SEQ ID NO: 1480050 - protein, 27 aa, Mycobacterium tuberculosis
APPVRRLPARFGVEQVRELASRDTRQG

SEQ ID NO: 1480051 - protein, 18 aa, Mycobacterium tuberculosis
APPYPPSILLTGIIVNKL

SEQ ID NO: 1480052 - protein, 21 aa, Mycobacterium tuberculosis
APQPPSGGRNGSGGGDLFGGF

SEQ ID NO: 1480053 - protein, 18 aa, Mycobacterium tuberculosis
APQRLRVLALALAGERTV

SEQ ID NO: 1480054 - protein, 25 aa, Mycobacterium tuberculosis
APQRRGGAALSDFQSLIACCSGTRH

SEQ ID NO: 1480055 - protein, 18 aa, Mycobacterium tuberculosis
APRAHFEIPDDLGPGRQP

SEQ ID NO: 1480056 - protein, 17 aa, Mycobacterium tuberculosis
APRGFRAAFAAAYAVAV

SEQ ID NO: 1480057 - protein, 31 aa, Mycobacterium tuberculosis
APRHPGYRLHPVVLDAAFKAWVPRYPTARSR

SEQ ID NO: 1480058 - protein, 24 aa, Mycobacterium tuberculosis
APRHPGYRLHPVVLDAALQSVGAA

SEQ ID NO: 1480059 - protein, 22 aa, Mycobacterium tuberculosis
APRPVLAVGAARADRARSTHRD

SEQ ID NO: 1480060 - protein, 18 aa, Mycobacterium tuberculosis
APRSIWCSNIPMVGSAAS

SEQ ID NO: 1480061 - protein, 26 aa, Mycobacterium tuberculosis
APRTAGWRWCSAPAAIVTRASGPRWA

SEQ ID NO: 1480062 - protein, 20 aa, Mycobacterium tuberculosis
APRTSACSTPAPTTSASATR

SEQ ID NO: 1480063 - protein, 19 aa, Mycobacterium tuberculosis
APRWDTVIVGLDCQTTILD

SEQ ID NO: 1480064 - protein, 19 aa, Mycobacterium tuberculosis
APRYPYCRNSPRKCRCTPR

SEQ ID NO: 1480065 - protein, 30 aa, Mycobacterium tuberculosis
APSALLGGRFGCWQRGHPGLGCAQPGLRDL

SEQ ID NO: 1480066 - protein, 17 aa, Mycobacterium tuberculosis
APSKLAYIDAGLIDLIR

SEQ ID NO: 1480067 - protein, 18 aa, Mycobacterium tuberculosis
APSRGLRGRPADRWPVAR

SEQ ID NO: 1480068 - protein, 31 aa, Mycobacterium tuberculosis
APTAGRRAGIRRCHRRTGAGIRCSRRVFAAR

SEQ ID NO: 1480069 - protein, 18 aa, Mycobacterium tuberculosis
APTGLPDPGIEALAHTKI

SEQ ID NO: 1480070 - protein, 23 aa, Mycobacterium tuberculosis
APTLAGHALRFDEFGNIITDSAV

SEQ ID NO: 1480071 - protein, 27 aa, Mycobacterium tuberculosis
APTLIRMFMKWGREIPDSHDLSSLRLL

SEQ ID NO: 1480072 - protein, 20 aa, Mycobacterium tuberculosis
APTPVADRFVRYVNRDNTTA

SEQ ID NO: 1480073 - protein, 24 aa, Mycobacterium tuberculosis
APTQALWGRPLIGNGADGTAANPN

SEQ ID NO: 1480074 - protein, 23 aa, Mycobacterium tuberculosis
APTQTLLGLPLIGNGADGVAGTG

SEQ ID NO: 1480075 - protein, 18 aa, Mycobacterium tuberculosis
APTRAMIFDSVYDIYRGV

SEQ ID NO: 1480076 - protein, 25 aa, Mycobacterium tuberculosis
APTRGLVGWAARGGVDRCADPAVPA

SEQ ID NO: 1480077 - protein, 17 aa, Mycobacterium tuberculosis
APTTSVCSTRAPETSAL

SEQ ID NO: 1480078 - protein, 44 aa, Mycobacterium tuberculosis
APTWLKTVPKRLSALLNTSGLPAVWEPFSRTPVIPVASPDPALV

SEQ ID NO: 1480079 - protein, 21 aa, Mycobacterium tuberculosis
APVAEYWPEFGANGKFEVTVS

SEQ ID NO: 1480080 - protein, 17 aa, Mycobacterium tuberculosis
APVHGRDELVAGLMVDA

SEQ ID NO: 1480081 - protein, 22 aa, Mycobacterium tuberculosis
APVIRMLLRVCREQGLELAASL

SEQ ID NO: 1480082 - protein, 25 aa, Mycobacterium tuberculosis
APVKGLGIAAGAKRPGAKKTPPPAP

SEQ ID NO: 1480083 - protein, 17 aa, Mycobacterium tuberculosis
APVLWDEMPTLPLYRQQ

SEQ ID NO: 1480084 - protein, 24 aa, Mycobacterium tuberculosis
APVTGTATEGIWVGPPEPPAPPFA

SEQ ID NO: 1480085 - protein, 22 aa, Mycobacterium tuberculosis
APVTPCRGCLPAPSRTPSFGNC

SEQ ID NO: 1480086 - protein, 39 aa, Mycobacterium tuberculosis
APVVGFLQLRCGWGVGVWECRRDGVGWLESGSVGVAGWG

SEQ ID NO: 1480087 - protein, 17 aa, Mycobacterium tuberculosis
APVVILAHGFPELAYSW

SEQ ID NO: 1480088 - protein, 18 aa, Mycobacterium tuberculosis
APVVPRAVASSAMAATVG

SEQ ID NO: 1480089 - protein, 18 aa, Mycobacterium tuberculosis
APYACMGGACGTCRAKLI

SEQ ID NO: 1480090 - protein, 23 aa, Mycobacterium tuberculosis
AQAALFHDRFVQILQEGAAAYAM

SEQ ID NO: 1480091 - protein, 18 aa, Mycobacterium tuberculosis
AQALTLAARFQSALDGTL

SEQ ID NO: 1480092 - protein, 29 aa, Mycobacterium tuberculosis
AQAPKGIVMPARLPNRIHPFVQENCSRSA

SEQ ID NO: 1480093 - protein, 19 aa, Mycobacterium tuberculosis
AQARAARPQFVVKDEAFTT

SEQ ID NO: 1480094 - protein, 22 aa, Mycobacterium tuberculosis
AQARSGEFSWRQSAEALRSVLE

SEQ ID NO: 1480095 - protein, 25 aa, Mycobacterium tuberculosis
AQATTRAGPYVPLTMGYYTRQDIPI

SEQ ID NO: 1480096 - protein, 24 aa, Mycobacterium tuberculosis
AQAWAAEIARLAPLAILARQAVLT

SEQ ID NO: 1480097 - protein, 26 aa, Mycobacterium tuberculosis
AQCVKAEMLAASSWRVAVNAGADSTG

SEQ ID NO: 1480098 - protein, 20 aa, Mycobacterium tuberculosis
AQDLCAKTRVFILAESLGGV

SEQ ID NO: 1480099 - protein, 27 aa, Mycobacterium tuberculosis
AQDYAWRKGIKTLYYIRLRQMALEGTE

SEQ ID NO: 1480100 - protein, 17 aa, Mycobacterium tuberculosis
AQFEAAGLTYEHRLIDD

SEQ ID NO: 1480101 - protein, 22 aa, Mycobacterium tuberculosis
AQFWSQIHGFVMLELAGFYGDR

SEQ ID NO: 1480102 - protein, 27 aa, Mycobacterium tuberculosis
AQGDLWAAPSGWRGGGHMAPVRTAMRT

SEQ ID NO: 1480103 - protein, 17 aa, Mycobacterium tuberculosis
AQGELAAMVAPAGCYSG

SEQ ID NO: 1480104 - protein, 20 aa, Mycobacterium tuberculosis
AQGHPVIWKSAARDVEPLLA

SEQ ID NO: 1480105 - protein, 20 aa, Mycobacterium tuberculosis
AQGINLIIHYVHRAGALGKI

SEQ ID NO: 1480106 - protein, 25 aa, Mycobacterium tuberculosis
AQGPDDKAELVVPAGPVATADNSTA

SEQ ID NO: 1480107 - protein, 22 aa, Mycobacterium tuberculosis
AQGRIPRVYGRQASEYVIRRGM

SEQ ID NO: 1480108 - protein, 31 aa, Mycobacterium tuberculosis
AQHRWPSGACWRSSPRWDAHSFALLRPQSAL

SEQ ID NO: 1480109 - protein, 17 aa, Mycobacterium tuberculosis
AQILAELATLFGDGVLR

SEQ ID NO: 1480110 - protein, 28 aa, Mycobacterium tuberculosis
AQIRPARLQRPIVLEARISHAASGEVVE

SEQ ID NO: 1480111 - protein, 20 aa, Mycobacterium tuberculosis
AQIYAWRKGIKTLYYIRLRQ

SEQ ID NO: 1480112 - protein, 17 aa, Mycobacterium tuberculosis
AQLAPWQQVLRNLGIDI

SEQ ID NO: 1480113 - protein, 18 aa, Mycobacterium tuberculosis
AQLASWQPALPNINLGVG

SEQ ID NO: 1480114 - protein, 22 aa, Mycobacterium tuberculosis
AQLPSTALMDVLLRRPPRTRSG

SEQ ID NO: 1480115 - protein, 27 aa, Mycobacterium tuberculosis
AQLRAKALWLRSRRRGVLAGYSASAFH

SEQ ID NO: 1480116 - protein, 24 aa, Mycobacterium tuberculosis
AQLRKAGLVISDRRGMHVFHRVHP

SEQ ID NO: 1480117 - protein, 24 aa, Mycobacterium tuberculosis
AQLSGLRLGKVISISEASGAAPTH

SEQ ID NO: 1480118 - protein, 24 aa, Mycobacterium tuberculosis
AQMDWSFGEVIAYASRGVTLTPGD

SEQ ID NO: 1480119 - protein, 18 aa, Mycobacterium tuberculosis
AQMLAELVELFKTEALHR

SEQ ID NO: 1480120 - protein, 17 aa, Mycobacterium tuberculosis
AQMPSPLQQALNVINAP

SEQ ID NO: 1480121 - protein, 22 aa, Mycobacterium tuberculosis
AQMSAFHAQFVQTFTAGAGAYA

SEQ ID NO: 1480122 - protein, 22 aa, Mycobacterium tuberculosis
AQMSAFHAQFVQTFTAGDGEYA

SEQ ID NO: 1480123 - protein, 24 aa, Mycobacterium tuberculosis
AQPIGCPAFHAFPASRWRRYDKLE

SEQ ID NO: 1480124 - protein, 18 aa, Mycobacterium tuberculosis
AQPIPRECRFIYAETAVF

SEQ ID NO: 1480125 - protein, 18 aa, Mycobacterium tuberculosis
AQPWPGVRHCHTFANCAP

SEQ ID NO: 1480126 - protein, 22 aa, Mycobacterium tuberculosis
AQRAKIVADYLVARGVAGDHIA

SEQ ID NO: 1480127 - protein, 19 aa, Mycobacterium tuberculosis
AQRALHRVVTLLAAGRPVL

SEQ ID NO: 1480128 - protein, 21 aa, Mycobacterium tuberculosis
AQRAQCPQCAHPGVAGSPVDR

SEQ ID NO: 1480129 - protein, 21 aa, Mycobacterium tuberculosis
AQRAWAEGRFDREISPIQAPV

SEQ ID NO: 1480130 - protein, 18 aa, Mycobacterium tuberculosis
AQRLLAFVAANPDLDPID

SEQ ID NO: 1480131 - protein, 21 aa, Mycobacterium tuberculosis
AQRLLEYRVHVGRPVQVDPQL

SEQ ID NO: 1480132 - protein, 18 aa, Mycobacterium tuberculosis
AQRPAWLAAAEALTTEGA

SEQ ID NO: 1480133 - protein, 19 aa, Mycobacterium tuberculosis
AQRVAWMRELFPFDRVVHL

SEQ ID NO: 1480134 - protein, 28 aa, Mycobacterium tuberculosis
AQSPKETWLRLLLIRAGFPRPQMQIAVR

SEQ ID NO: 1480135 - protein, 19 aa, Mycobacterium tuberculosis
AQTAVFRALTAVPIVGKSP

SEQ ID NO: 1480136 - protein, 19 aa, Mycobacterium tuberculosis
AQTGQVWWPECSKEAYADG

SEQ ID NO: 1480137 - protein, 19 aa, Mycobacterium tuberculosis
AQTLPPGRGLLVGADGDVE

SEQ ID NO: 1480138 - protein, 27 aa, Mycobacterium tuberculosis
AQVATFHDRFVQTLSAAASSYVAAEAV

SEQ ID NO: 1480139 - protein, 19 aa, Mycobacterium tuberculosis
AQVCGELGLPYLVLARPPW

SEQ ID NO: 1480140 - protein, 31 aa, Mycobacterium tuberculosis
AQVNRPLRGCYRIAVLSLKGGIGKTTITATL

SEQ ID NO: 1480141 - protein, 23 aa, Mycobacterium tuberculosis
AQVTEFDGGVLVNWDVREGVFAP

SEQ ID NO: 1480142 - protein, 29 aa, Mycobacterium tuberculosis
AQVVPWAEFAAAISGFWVPAPPALLAVES

SEQ ID NO: 1480143 - protein, 19 aa, Mycobacterium tuberculosis
AQYGEMWAQDIVAMEGYAG

SEQ ID NO: 1480144 - protein, 26 aa, Mycobacterium tuberculosis
ARAAAARTGHPWWTLSQLSDESAIEL

SEQ ID NO: 1480145 - protein, 18 aa, Mycobacterium tuberculosis
ARAAAYTIPSYEDQYYSP

SEQ ID NO: 1480146 - protein, 26 aa, Mycobacterium tuberculosis
ARAACSASPVAPGWAVPPVAGVMAGA

SEQ ID NO: 1480147 - protein, 20 aa, Mycobacterium tuberculosis
ARAADLWRFTAGAVDQPNPV

SEQ ID NO: 1480148 - protein, 26 aa, Mycobacterium tuberculosis
ARAAMALPARPTGGTGGDGATATAGS

SEQ ID NO: 1480149 - protein, 19 aa, Mycobacterium tuberculosis
ARAASRFFVRKAHSQEDPW

SEQ ID NO: 1480150 - protein, 18 aa, Mycobacterium tuberculosis
ARACPARPAGRRVDAMTD

SEQ ID NO: 1480151 - protein, 23 aa, Mycobacterium tuberculosis
ARADALGRAFIDQGITFSLSGQE

SEQ ID NO: 1480152 - protein, 23 aa, Mycobacterium tuberculosis
ARAEAGGSIGWRTSMPAVGPQAS

SEQ ID NO: 1480153 - protein, 17 aa, Mycobacterium tuberculosis
ARAFFDFAAQHHIEVTT

SEQ ID NO: 1480154 - protein, 28 aa, Mycobacterium tuberculosis
ARAFIEISAHPALLFAIGQNCEGAANLP

SEQ ID NO: 1480155 - protein, 17 aa, Mycobacterium tuberculosis
ARAGAPEVSGWLDGLRA

SEQ ID NO: 1480156 - protein, 22 aa, Mycobacterium tuberculosis
ARAGFARGGGRGTGDTGHAVPA

SEQ ID NO: 1480157 - protein, 17 aa, Mycobacterium tuberculosis
ARAHFGFPDDARVLLVF

SEQ ID NO: 1480158 - protein, 24 aa, Mycobacterium tuberculosis
ARALIAVRGLHRFAAAEGLVELDV

SEQ ID NO: 1480159 - protein, 17 aa, Mycobacterium tuberculosis
ARALRPGGRLVLTSISD

SEQ ID NO: 1480160 - protein, 25 aa, Mycobacterium tuberculosis
ARAPRVSAVIKVDWRPRGHRRDDPE

SEQ ID NO: 1480161 - protein, 38 aa, Mycobacterium tuberculosis
ARAQHPWPPRVATLPHWPLICAGALEGLDHLELARTVD

SEQ ID NO: 1480162 - protein, 17 aa, Mycobacterium tuberculosis
ARARDGDNGNAGSGATG

SEQ ID NO: 1480163 - protein, 26 aa, Mycobacterium tuberculosis
ARARDGGIPLTARMVFEHPVLCELAA

SEQ ID NO: 1480164 - protein, 26 aa, Mycobacterium tuberculosis
ARARELAAAYGDRFLPPESLLLARPR

SEQ ID NO: 1480165 - protein, 20 aa, Mycobacterium tuberculosis
ARARLACSLADQGRAVAVVS

SEQ ID NO: 1480166 - protein, 19 aa, Mycobacterium tuberculosis
ARARTPLPVPTPRGERPDD

SEQ ID NO: 1480167 - protein, 19 aa, Mycobacterium tuberculosis
ARARYACFDHACADDGQAY

SEQ ID NO: 1480168 - protein, 17 aa, Mycobacterium tuberculosis
ARAVSWPAVTSPAGPVT

SEQ ID NO: 1480169 - protein, 20 aa, Mycobacterium tuberculosis
ARAWWNYDCREIAFTRVAPA

SEQ ID NO: 1480170 - protein, 26 aa, Mycobacterium tuberculosis
ARCATYPVLAVQAWAAFHDMTLRAVI

SEQ ID NO: 1480171 - protein, 27 aa, Mycobacterium tuberculosis
ARCATYPVLAVQAWAAFHDMTLRAVIG

SEQ ID NO: 1480172 - protein, 17 aa, Mycobacterium tuberculosis
ARCGVARRVPLIRDETG

SEQ ID NO: 1480173 - protein, 17 aa, Mycobacterium tuberculosis
ARCNAIAAAVLMPADVV

SEQ ID NO: 1480174 - protein, 26 aa, Mycobacterium tuberculosis
ARCSWRAGPCGMPILDDAAAWFIGRT

SEQ ID NO: 1480175 - protein, 20 aa, Mycobacterium tuberculosis
ARDAGAMAYLVKPFSISDLI

SEQ ID NO: 1480176 - protein, 24 aa, Mycobacterium tuberculosis
ARDLPCHTGIRLLGGGSHALGRVN

SEQ ID NO: 1480177 - protein, 20 aa, Mycobacterium tuberculosis
ARDRGATMIFTRTKRTAQKV

SEQ ID NO: 1480178 - protein, 17 aa, Mycobacterium tuberculosis
ARDSAPSLVFLDELDAL

SEQ ID NO: 1480179 - protein, 23 aa, Mycobacterium tuberculosis
ARDVDWWLTFSSAAALLGTPGQG

SEQ ID NO: 1480180 - protein, 17 aa, Mycobacterium tuberculosis
AREATWLTRSFARSQRA

SEQ ID NO: 1480181 - protein, 22 aa, Mycobacterium tuberculosis
AREDSEFAVLRRQIAVGGQVLQ

SEQ ID NO: 1480182 - protein, 20 aa, Mycobacterium tuberculosis
ARELSNLVELARRTAAADDP

SEQ ID NO: 1480183 - protein, 28 aa, Mycobacterium tuberculosis
ARERLGFVMPGDIPFQVQLPSTPLAPPQ

SEQ ID NO: 1480184 - protein, 23 aa, Mycobacterium tuberculosis
ARETLEVIAPLAHRLGMASVKWE

SEQ ID NO: 1480185 - protein, 21 aa, Mycobacterium tuberculosis
AREVAEVVAPVLGWTAADIDR

SEQ ID NO: 1480186 - protein, 21 aa, Mycobacterium tuberculosis
AREVHHMAALVGFGAAAINPY

SEQ ID NO: 1480187 - protein, 20 aa, Mycobacterium tuberculosis
ARFADLFAAVRMRLREAVDR

SEQ ID NO: 1480188 - protein, 26 aa, Mycobacterium tuberculosis
ARFADLFAAVRMRLREAVDRGEAHPD

SEQ ID NO: 1480189 - protein, 17 aa, Mycobacterium tuberculosis
ARFFVWLTVGLYDPPVR

SEQ ID NO: 1480190 - protein, 22 aa, Mycobacterium tuberculosis
ARFGSPELQQGWGVSAVSGDRI

SEQ ID NO: 1480191 - protein, 22 aa, Mycobacterium tuberculosis
ARFGVPVPNLTAWRDATVGDMT

SEQ ID NO: 1480192 - protein, 23 aa, Mycobacterium tuberculosis
ARFPELDVEAVLRRHPQVVLVDE

SEQ ID NO: 1480193 - protein, 17 aa, Mycobacterium tuberculosis
ARFPGPFIYTVHPSKIV

SEQ ID NO: 1480194 - protein, 20 aa, Mycobacterium tuberculosis
ARFRFVEEMIRLGADARTDG

SEQ ID NO: 1480195 - protein, 19 aa, Mycobacterium tuberculosis
ARFRSHPDLEVLTHGLTLW

SEQ ID NO: 1480196 - protein, 18 aa, Mycobacterium tuberculosis
ARFSMSRNRNWRRPTRVR

SEQ ID NO: 1480197 - protein, 18 aa, Mycobacterium tuberculosis
ARFVDFLERVVVQRTIDR

SEQ ID NO: 1480198 - protein, 17 aa, Mycobacterium tuberculosis
ARGAWRASRATAGYSSA

SEQ ID NO: 1480199 - protein, 28 aa, Mycobacterium tuberculosis
ARGDRRHGRRHLPIAAIERFCQITDPAA

SEQ ID NO: 1480200 - protein, 32 aa, Mycobacterium tuberculosis
ARGGPQRDPRIWARWAAAWRGHGGLRVQPRAA

SEQ ID NO: 1480201 - protein, 30 aa, Mycobacterium tuberculosis
ARGIWWRQSRWCGLIAMSEIFCITDHSEPM

SEQ ID NO: 1480202 - protein, 21 aa, Mycobacterium tuberculosis
ARGNLTPRERIELLVDPDSPF

SEQ ID NO: 1480203 - protein, 18 aa, Mycobacterium tuberculosis
ARGPPIWDPDVRHHGAQL

SEQ ID NO: 1480204 - protein, 21 aa, Mycobacterium tuberculosis
ARGRPVAEIDIDYSPAQLEDT

SEQ ID NO: 1480205 - protein, 26 aa, Mycobacterium tuberculosis
ARGSGLLPRMEPFVGELIGRGLADAG

SEQ ID NO: 1480206 - protein, 24 aa, Mycobacterium tuberculosis
ARGVERWLSQRLSLVLGCGPGRAD

SEQ ID NO: 1480207 - protein, 20 aa, Mycobacterium tuberculosis
ARGYRLPWPADTTVFEVDQP

SEQ ID NO: 1480208 - protein, 19 aa, Mycobacterium tuberculosis
ARHDYCWPHHESCHPDREG

SEQ ID NO: 1480209 - protein, 30 aa, Mycobacterium tuberculosis; identical to SEQ ID NO: 1379830

SEQ ID NO: 1480210 - protein, 18 aa, Mycobacterium tuberculosis
ARHPTVAGVEETRRRSGG

SEQ ID NO: 1480211 - protein, 20 aa, Mycobacterium tuberculosis
ARHRARRLAGRVVHDATCSI

SEQ ID NO: 1480212 - protein, 24 aa, Mycobacterium tuberculosis
ARHRARRLAVRVVHDATCSIGTEL

SEQ ID NO: 1480213 - protein, 18 aa, Mycobacterium tuberculosis
ARIAFLMLPGVGTKDDIK

SEQ ID NO: 1480214 - protein, 24 aa, Mycobacterium tuberculosis
ARIELRTGGAYRWTVTPGHSAAGT

SEQ ID NO: 1480215 - protein, 26 aa, Mycobacterium tuberculosis
ARIEQLRGSPLYTLRTKGKADLLKPS

SEQ ID NO: 1480216 - protein, 27 aa, Mycobacterium tuberculosis
ARINNERIRLGIALPAAVAADLLAPRT

SEQ ID NO: 1480217 - protein, 30 aa, Mycobacterium tuberculosis
ARIVGGRCLMPASSAARCAARIVGGPRLYG

SEQ ID NO: 1480218 - protein, 18 aa, Mycobacterium tuberculosis
ARKFDCEAWIPTQGAYRE

SEQ ID NO: 1480219 - protein, 31 aa, Mycobacterium tuberculosis
ARLASLDKFSTAWDYRARARAARALHGEPVR

SEQ ID NO: 1480220 - protein, 17 aa, Mycobacterium tuberculosis
ARLDALYLLSAPVDGAA

SEQ ID NO: 1480221 - protein, 22 aa, Mycobacterium tuberculosis
ARLGPSGVCTRAVRRSPTTGDS

SEQ ID NO: 1480222 - protein, 17 aa, Mycobacterium tuberculosis
ARLKVGIISAGRVGTAL

SEQ ID NO: 1480223 - protein, 18 aa, Mycobacterium tuberculosis
ARLLMMVITDSGRVDQRI

SEQ ID NO: 1480224 - protein, 20 aa, Mycobacterium tuberculosis
ARLLRLLGFDTRWSSAADDP

SEQ ID NO: 1480225 - protein, 24 aa, Mycobacterium tuberculosis
ARLPDGVANWTYAAGMDGTPGHDD

SEQ ID NO: 1480226 - protein, 23 aa, Mycobacterium tuberculosis
ARLPPGPPPSRRPRSPRRPPGQP

SEQ ID NO: 1480227 - protein, 21 aa, Mycobacterium tuberculosis
ARLRDELALVIKDLELACDKF

SEQ ID NO: 1480228 - protein, 21 aa, Mycobacterium tuberculosis
ARLRPAHGAAHRLASHSKAMQ

SEQ ID NO: 1480229 - protein, 22 aa, Mycobacterium tuberculosis
ARLRPPIRREGLGLVFETPTDE

SEQ ID NO: 1480230 - protein, 18 aa, Mycobacterium tuberculosis
ARLRQSWLERGATDAELG

SEQ ID NO: 1480231 - protein, 17 aa, Mycobacterium tuberculosis
ARLRWPKPIGSMGTDTS

SEQ ID NO: 1480232 - protein, 23 aa, Mycobacterium tuberculosis
ARLSALARNAAELALIPDTNHLE

SEQ ID NO: 1480233 - protein, 19 aa, Mycobacterium tuberculosis
ARLTSLVTHNVFGQNTASI

SEQ ID NO: 1480234 - protein, 21 aa, Mycobacterium tuberculosis
ARLVARAMLQLPAQRTHRIRA

SEQ ID NO: 1480235 - protein, 17 aa, Mycobacterium tuberculosis
ARLVVKLPNRWPLTDAA

SEQ ID NO: 1480236 - protein, 21 aa, Mycobacterium tuberculosis
ARLWPDGLLALLEPRIGRRAA

SEQ ID NO: 1480237 - protein, 20 aa, Mycobacterium tuberculosis
ARLYVGAGLAPMLDAAAAWD

SEQ ID NO: 1480238 - protein, 17 aa, Mycobacterium tuberculosis
ARMCGVACGAGLGECVG

SEQ ID NO: 1480239 - protein, 19 aa, Mycobacterium tuberculosis
ARMLRTAWTDEWDRPDSPD

SEQ ID NO: 1480240 - protein, 22 aa, Mycobacterium tuberculosis
ARMRSLLMPAFTRAALRGYRDM

SEQ ID NO: 1480241 - protein, 19 aa, Mycobacterium tuberculosis
ARMYIRYAERHGWAVTVLD

SEQ ID NO: 1480242 - protein, 17 aa, Mycobacterium tuberculosis
ARNALVLVRGKPTDQLP

SEQ ID NO: 1480243 - protein, 19 aa, Mycobacterium tuberculosis
ARPAAELLYDHRRPPAGIH

SEQ ID NO: 1480244 - protein, 21 aa, Mycobacterium tuberculosis
ARPAASDGLAADAGDGGAGGD

SEQ ID NO: 1480245 - protein, 21 aa, Mycobacterium tuberculosis
ARPAASPLAAPVDPSTPAPST

SEQ ID NO: 1480246 - protein, 21 aa, Mycobacterium tuberculosis
ARPAECPARGGGPHRTASRGQ

SEQ ID NO: 1480247 - protein, 20 aa, Mycobacterium tuberculosis
ARPAETAAMPVGYTAAAESA

SEQ ID NO: 1480248 - protein, 23 aa, Mycobacterium tuberculosis
ARPAETVRGWLRRFAERVEAVRS

SEQ ID NO: 1480249 - protein, 19 aa, Mycobacterium tuberculosis
ARPDAEWMGPLLDAMGLTV

SEQ ID NO: 1480250 - protein, 20 aa, Mycobacterium tuberculosis
ARPGARRGHHGVLWRDRAGR

SEQ ID NO: 1480251 - protein, 22 aa, Mycobacterium tuberculosis
ARPGCRPSLAELDSFVRSEIAG

SEQ ID NO: 1480252 - protein, 18 aa, Mycobacterium tuberculosis
ARPGNPLQRTDPAADAAK

SEQ ID NO: 1480253 - protein, 21 aa, Mycobacterium tuberculosis
ARPLAIPVIVLAGQVSLDKSA

SEQ ID NO: 1480254 - protein, 18 aa, Mycobacterium tuberculosis
ARPLVAWLDALATGIDLL

SEQ ID NO: 1480255 - protein, 18 aa, Mycobacterium tuberculosis
ARPMCCASPGRPSPTTSA

SEQ ID NO: 1480256 - protein, 18 aa, Mycobacterium tuberculosis
ARPPPECTPSCIAGDQCD

SEQ ID NO: 1480257 - protein, 21 aa, Mycobacterium tuberculosis
ARPRPTAADRLACQADSSGFH

SEQ ID NO: 1480258 - protein, 27 aa, Mycobacterium tuberculosis
ARPTVATGRCAVLAGAAGAAGAAVAEQ

SEQ ID NO: 1480259 - protein, 20 aa, Mycobacterium tuberculosis
ARPVPAGDTMVFFGGIEPVA

SEQ ID NO: 1480260 - protein, 17 aa, Mycobacterium tuberculosis
ARQEPRISWAAGLRDDG

SEQ ID NO: 1480261 - protein, 21 aa, Mycobacterium tuberculosis
ARQRAPVAIFVKHPSDSVVAG

SEQ ID NO: 1480262 - protein, 22 aa, Mycobacterium tuberculosis
ARQRYWGEPFPIVYDSDGRPHA

SEQ ID NO: 1480263 - protein, 23 aa, Mycobacterium tuberculosis
ARQVPDNGGMYFVPAFSGLFAPY

SEQ ID NO: 1480264 - protein, 27 aa, Mycobacterium tuberculosis
ARRAILRYPKWRVAEIDGELETVALDD

SEQ ID NO: 1480265 - protein, 20 aa, Mycobacterium tuberculosis
ARRAWQRFQAIEARGGFVEA

SEQ ID NO: 1480266 - protein, 24 aa, Mycobacterium tuberculosis
ARRCTPPTSRSCKLRQRLPPVAPT

SEQ ID NO: 1480267 - protein, 18 aa, Mycobacterium tuberculosis
ARRDPCLYPRTGQALPRT

SEQ ID NO: 1480268 - protein, 24 aa, Mycobacterium tuberculosis
ARRFPKGLAAFIGLRDQRCRMPYC

SEQ ID NO: 1480269 - protein, 25 aa, Mycobacterium tuberculosis
ARRGPGGQGGQAFGANNIGGTGGAG

SEQ ID NO: 1480270 - protein, 18 aa, Mycobacterium tuberculosis
ARRGPGRVPDGIDVHLLP

SEQ ID NO: 1480271 - protein, 17 aa, Mycobacterium tuberculosis
ARRHRPRRCSAKTGSSS

SEQ ID NO: 1480272 - protein, 18 aa, Mycobacterium tuberculosis
ARRHRPRRCSAKTGSSSS

SEQ ID NO: 1480273 - protein, 19 aa, Mycobacterium tuberculosis
ARRIGTWIGAAAEGQVSRQ

SEQ ID NO: 1480274 - protein, 20 aa, Mycobacterium tuberculosis
ARRITGWVAALGTGVCASDA

SEQ ID NO: 1480275 - protein, 19 aa, Mycobacterium tuberculosis
ARRLAGLFASYARQRPGLL

SEQ ID NO: 1480276 - protein, 28 aa, Mycobacterium tuberculosis
ARRLAIPELPDAVFIESLRQLIAVDQAW

SEQ ID NO: 1480277 - protein, 18 aa, Mycobacterium tuberculosis
ARRLAREEGLLVGISSGA

SEQ ID NO: 1480278 - protein, 27 aa, Mycobacterium tuberculosis
ARRLKASGIDTVFTLSGGHLFSIYDGC

SEQ ID NO: 1480279 - protein, 21 aa, Mycobacterium tuberculosis
ARRNDPLLGRHVIITGASSGI

SEQ ID NO: 1480280 - protein, 22 aa, Mycobacterium tuberculosis
ARRNDPLLGRHVIITGASSGIG

SEQ ID NO: 1480281 - protein, 17 aa, Mycobacterium tuberculosis
ARRPEYGGCTSWVQLPL

SEQ ID NO: 1480282 - protein, 20 aa, Mycobacterium tuberculosis
ARRRGHRPVRTAVLAATTAE

SEQ ID NO: 1480283 - protein, 25 aa, Mycobacterium tuberculosis
ARRRRDRRRCGPRSSNGSGHSVSID

SEQ ID NO: 1480284 - protein, 20 aa, Mycobacterium tuberculosis
ARRRSWRNGWQCSKNGGGRI

SEQ ID NO: 1480285 - protein, 19 aa, Mycobacterium tuberculosis
ARRTDLMFDQGLVEEVRTL

SEQ ID NO: 1480286 - protein, 18 aa, Mycobacterium tuberculosis
ARRTGLWGRLLPEWEPIR

SEQ ID NO: 1480287 - protein, 22 aa, Mycobacterium tuberculosis
ARRTTPLGARRSWGPPGPLVVA

SEQ ID NO: 1480288 - protein, 22 aa, Mycobacterium tuberculosis
ARRVADVLGIPFYVWDFAEKFK

SEQ ID NO: 1480289 - protein, 21 aa, Mycobacterium tuberculosis
ARRVFAPKVTGSWRLHVATPA

SEQ ID NO: 1480290 - protein, 18 aa, Mycobacterium tuberculosis
ARRVGRNRCRGLARHAFH

SEQ ID NO: 1480291 - protein, 24 aa, Mycobacterium tuberculosis
ARRVRARAAAAIEHGIELMLAERA

SEQ ID NO: 1480292 - protein, 22 aa, Mycobacterium tuberculosis
ARSACPCSRSTPAPVAPPTRRN

SEQ ID NO: 1480293 - protein, 20 aa, Mycobacterium tuberculosis
ARSALTTALLRSRTNGPCRA

SEQ ID NO: 1480294 - protein, 17 aa, Mycobacterium tuberculosis
ARSAMRRSWAVRSSPTT

SEQ ID NO: 1480295 - protein, 17 aa, Mycobacterium tuberculosis
ARSDWSWASVAPYSASP

SEQ ID NO: 1480296 - protein, 26 aa, Mycobacterium tuberculosis
ARSGCGCWRWRWPASGRWCRSGCRAR

SEQ ID NO: 1480297 - protein, 19 aa, Mycobacterium tuberculosis
ARSGRERPGPRRCGGLRRR

SEQ ID NO: 1480298 - protein, 17 aa, Mycobacterium tuberculosis
ARSGTGAARARVSALSA

SEQ ID NO: 1480299 - protein, 20 aa, Mycobacterium tuberculosis
ARSNHGTCANQCPIVDAGDR

SEQ ID NO: 1480300 - protein, 20 aa, Mycobacterium tuberculosis
ARSTLRRNLTLMVAAETERI

SEQ ID NO: 1480301 - protein, 21 aa, Mycobacterium tuberculosis
ARSVAQPRFGRVDLVDRYRDT

SEQ ID NO: 1480302 - protein, 25 aa, Mycobacterium tuberculosis
ARSWAETLWRMSVSIAGAVCTAAAR

SEQ ID NO: 1480303 - protein, 18 aa, Mycobacterium tuberculosis
ARTCSAGVFKRHRQIDRP

SEQ ID NO: 1480304 - protein, 17 aa, Mycobacterium tuberculosis
ARTGGFVDGVADFDPAS

SEQ ID NO: 1480305 - protein, 22 aa, Mycobacterium tuberculosis
ARTLSTLTWRVVTNATKLPGLR

SEQ ID NO: 1480306 - protein, 34 aa, Mycobacterium tuberculosis
ARTMPQLLSVEWLRGRCDPYDVALRFASRRIPGN

SEQ ID NO: 1480307 - protein, 30 aa, Mycobacterium tuberculosis
ARTPRCGLCPLDWCAWRHAGYPPSDGPPRR

SEQ ID NO: 1480308 - protein, 19 aa, Mycobacterium tuberculosis
ARTQPALDLDALIGGFKPL

SEQ ID NO: 1480309 - protein, 20 aa, Mycobacterium tuberculosis
ARTVDNIAFASGFGRSTPRC

SEQ ID NO: 1480310 - protein, 20 aa, Mycobacterium tuberculosis
ARTVGAPGWPGSDSSDHHAA

SEQ ID NO: 1480311 - protein, 23 aa, Mycobacterium tuberculosis
ARTVGRQALDMYFNLANYRNNWK

SEQ ID NO: 1480312 - protein, 21 aa, Mycobacterium tuberculosis
ARTVRIGDWPAAYAIGEHLSV

SEQ ID NO: 1480313 - protein, 24 aa, Mycobacterium tuberculosis
ARVAELLDIVGLRHGDASRYPAEF

SEQ ID NO: 1480314 - protein, 22 aa, Mycobacterium tuberculosis
ARVAELRPVYLPPDPASRTTYV

SEQ ID NO: 1480315 - protein, 25 aa, Mycobacterium tuberculosis
ARVASAAAVLADWMSGPGAAAPLGR

SEQ ID NO: 1480316 - protein, 27 aa, Mycobacterium tuberculosis
ARVERMHRACLILTFGGGTNEVQRDII

SEQ ID NO: 1480317 - protein, 22 aa, Mycobacterium tuberculosis
ARVHCDRFFGWYNHEHKHSGIG

SEQ ID NO: 1480318 - protein, 28 aa, Mycobacterium tuberculosis
ARVKRGMAEMLKGGVIMDVVTPEQARIA

SEQ ID NO: 1480319 - protein, 21 aa, Mycobacterium tuberculosis
ARVLQALLARWDHHPRVDLVT

SEQ ID NO: 1480320 - protein, 27 aa, Mycobacterium tuberculosis
ARVPGMIRLVRHSIALVAAGLAAGLSG

SEQ ID NO: 1480321 - protein, 21 aa, Mycobacterium tuberculosis
ARVPQRFVPDLTKYQYWNGDS

SEQ ID NO: 1480322 - protein, 20 aa, Mycobacterium tuberculosis
ARVQRPLWASTGVKNPDYSD

SEQ ID NO: 1480323 - protein, 19 aa, Mycobacterium tuberculosis
ARWCACTSAAIGGCPVAKL

SEQ ID NO: 1480324 - protein, 18 aa, Mycobacterium tuberculosis
ARWDLARIISALGDEVAF

SEQ ID NO: 1480325 - protein, 18 aa, Mycobacterium tuberculosis
ARWSTPIAQQRAQIVDTL

SEQ ID NO: 1480326 - protein, 24 aa, Mycobacterium tuberculosis
ARYAELNTAIGTNWFPGTTPEVVS

SEQ ID NO: 1480327 - protein, 20 aa, Mycobacterium tuberculosis
ARYAQRVMDWLHPDGDLTDT

SEQ ID NO: 1480328 - protein, 18 aa, Mycobacterium tuberculosis
ARYCDGIRTVGPAVNAAA

SEQ ID NO: 1480329 - protein, 24 aa, Mycobacterium tuberculosis
ARYDVTFSLGDWLRPGSIADANDA

SEQ ID NO: 1480330 - protein, 20 aa, Mycobacterium tuberculosis
ARYVPQRVVEHLPERVITAA

SEQ ID NO: 1480331 - protein, 18 aa, Mycobacterium tuberculosis
ASAAAFEAAFAMTVPPAE

SEQ ID NO: 1480332 - protein, 26 aa, Mycobacterium tuberculosis
ASAARACGGWTVGVIPKMLVYRELAD

SEQ ID NO: 1480333 - protein, 19 aa, Mycobacterium tuberculosis
ASAARRGRRDRRCRHQRRS

SEQ ID NO: 1480334 - protein, 17 aa, Mycobacterium tuberculosis
ASADVGGAGGFGGSGGR

SEQ ID NO: 1480335 - protein, 24 aa, Mycobacterium tuberculosis
ASAEAAAFHGRFVQALTTGGGAYA

SEQ ID NO: 1480336 - protein, 17 aa, Mycobacterium tuberculosis
ASALLTCVARDPDPANV

SEQ ID NO: 1480337 - protein, 19 aa, Mycobacterium tuberculosis
ASALLTCVARDPDPANVGR

SEQ ID NO: 1480338 - protein, 23 aa, Mycobacterium tuberculosis
ASANWRLRRGRIVLLEGDSPAGL

SEQ ID NO: 1480339 - protein, 19 aa, Mycobacterium tuberculosis
ASAPLRLAASAAVTAGTAG

SEQ ID NO: 1480340 - protein, 19 aa, Mycobacterium tuberculosis
ASAPPGYRLAVADNQYDVA

SEQ ID NO: 1480341 - protein, 22 aa, Mycobacterium tuberculosis
ASAPRPAPFRLRVVKRHTLGYD

SEQ ID NO: 1480342 - protein, 20 aa, Mycobacterium tuberculosis
ASAPSCIIIAASRRGDTPAV

SEQ ID NO: 1480343 - protein, 17 aa, Mycobacterium tuberculosis
ASARMVGPLASYLVVNV

SEQ ID NO: 1480344 - protein, 24 aa, Mycobacterium tuberculosis
ASARRLRLRSRRAGDIGLCHLTPR

SEQ ID NO: 1480345 - protein, 19 aa, Mycobacterium tuberculosis
ASASLPTPTSWWWATAARE

SEQ ID NO: 1480346 - protein, 24 aa, Mycobacterium tuberculosis
ASATIDAARAWLLGTPADDWVSMA

SEQ ID NO: 1480347 - protein, 24 aa, Mycobacterium tuberculosis
ASAVRARIAPVGPSAVSIELADGL

SEQ ID NO: 1480348 - protein, 23 aa, Mycobacterium tuberculosis
ASAYRCGEAWSTLVHHRPSGRRL

SEQ ID NO: 1480349 - protein, 29 aa, Mycobacterium tuberculosis
ASCRPVGQSRRERGPAMEYLIAAQDVLVA

SEQ ID NO: 1480350 - protein, 25 aa, Mycobacterium tuberculosis
ASCSVPGAWPPVTIAGRRYMDGGVA

SEQ ID NO: 1480351 - protein, 28 aa, Mycobacterium tuberculosis
ASCTRTALRRWPKCSTMSSASSRADDHH

SEQ ID NO: 1480352 - protein, 18 aa, Mycobacterium tuberculosis
ASDDLLLVGGMRVRQRDK

SEQ ID NO: 1480353 - protein, 20 aa, Mycobacterium tuberculosis
ASDIPPLSWFLGNSPPPLLN

SEQ ID NO: 1480354 - protein, 18 aa, Mycobacterium tuberculosis
ASDLANIGSTLGAANAAA

SEQ ID NO: 1480355 - protein, 19 aa, Mycobacterium tuberculosis
ASDPTCWWMHHFQMPSRVE

SEQ ID NO: 1480356 - protein, 19 aa, Mycobacterium tuberculosis
ASDVARIGSSIGAANAAAA

SEQ ID NO: 1480357 - protein, 19 aa, Mycobacterium tuberculosis
ASDVARIGSSIGVANSAAA

SEQ ID NO: 1480358 - protein, 21 aa, Mycobacterium tuberculosis
ASDVARIGSSIGVANSAAAGS

SEQ ID NO: 1480359 - protein, 33 aa, Mycobacterium tuberculosis
ASEAISGMNAVAGWRGAPRPVLARELLPERALM

SEQ ID NO: 1480360 - protein, 22 aa, Mycobacterium tuberculosis
ASELRPIAAMHRGGGRRRSSAV

SEQ ID NO: 1480361 - protein, 18 aa, Mycobacterium tuberculosis
ASENGVPVTVTWNADSSR

SEQ ID NO: 1480362 - protein, 18 aa, Mycobacterium tuberculosis
ASFDILWLVIRALSDLAG

SEQ ID NO: 1480363 - protein, 17 aa, Mycobacterium tuberculosis
ASFGPWADLVPHLDDLV

SEQ ID NO: 1480364 - protein, 18 aa, Mycobacterium tuberculosis
ASFMPKPFGQHPGLGDAH

SEQ ID NO: 1480365 - protein, 19 aa, Mycobacterium tuberculosis
ASFQPSVSVPVDLDGARKV

SEQ ID NO: 1480366 - protein, 24 aa, Mycobacterium tuberculosis
ASFVDDFVLYWGFLALAQVRSGRR

SEQ ID NO: 1480367 - protein, 27 aa, Mycobacterium tuberculosis
ASGGAGARGANGIDSIGGTGGAGGGGG

SEQ ID NO: 1480368 - protein, 27 aa, Mycobacterium tuberculosis
ASGGAYHRACAWRRRRRHRSSRTPVFP

SEQ ID NO: 1480369 - protein, 17 aa, Mycobacterium tuberculosis
ASGLEVRDEFVVGSLAG

SEQ ID NO: 1480370 - protein, 20 aa, Mycobacterium tuberculosis
ASGPAGMTGMPMVPPGALGA

SEQ ID NO: 1480371 - protein, 19 aa, Mycobacterium tuberculosis
ASGPLGLMKTILALRHGVV

SEQ ID NO: 1480372 - protein, 20 aa, Mycobacterium tuberculosis
ASGRMRVCVTGFNVDAVRAV

SEQ ID NO: 1480373 - protein, 17 aa, Mycobacterium tuberculosis
ASGRVAYVLGLEGPAVS

SEQ ID NO: 1480374 - protein, 17 aa, Mycobacterium tuberculosis
ASGRVAYVLGLQGPAVS

SEQ ID NO: 1480375 - protein, 25 aa, Mycobacterium tuberculosis
ASGVRLAIVASRWHGKICDALLDGA

SEQ ID NO: 1480376 - protein, 17 aa, Mycobacterium tuberculosis
ASHLRDGAVLLDVSRID

SEQ ID NO: 1480377 - protein, 18 aa, Mycobacterium tuberculosis
ASHNGMWDLSMLGIVPGI

SEQ ID NO: 1480378 - protein, 19 aa, Mycobacterium tuberculosis
ASHQDRGWAVIDVETLGFR

SEQ ID NO: 1480379 - protein, 19 aa, Mycobacterium tuberculosis
ASHSIASYVGALAFTEQRV

SEQ ID NO: 1480380 - protein, 18 aa, Mycobacterium tuberculosis
ASIGNTWLADPAPFLQQY

SEQ ID NO: 1480381 - protein, 27 aa, Mycobacterium tuberculosis
ASIPVKRLRQAGVLDLLLALANETETS

SEQ ID NO: 1480382 - protein, 28 aa, Mycobacterium tuberculosis
ASIQRTGRCVVMHEGPRSLGYGAGLAAR

SEQ ID NO: 1480383 - protein, 23 aa, Mycobacterium tuberculosis
ASKGGDPRSPGWYHNLKANPDVE

SEQ ID NO: 1480384 - protein, 22 aa, Mycobacterium tuberculosis
ASKRIAPIVVLTAFSQRDLVER

SEQ ID NO: 1480385 - protein, 19 aa, Mycobacterium tuberculosis
ASKRVMWQGIGHGASIYSS

SEQ ID NO: 1480386 - protein, 24 aa, Mycobacterium tuberculosis
ASLAKILAGFGYRVQESAFEAMLT

SEQ ID NO: 1480387 - protein, 19 aa, Mycobacterium tuberculosis
ASLEMQRFTAMGGAAPSAS

SEQ ID NO: 1480388 - protein, 19 aa, Mycobacterium tuberculosis
ASLKQAERVKALALAGGAR

SEQ ID NO: 1480389 - protein, 17 aa, Mycobacterium tuberculosis
ASLPATAVGDGFVEGVD

SEQ ID NO: 1480390 - protein, 20 aa, Mycobacterium tuberculosis
ASLRLLPRGGRFIEMGKTEF

SEQ ID NO: 1480391 - protein, 21 aa, Mycobacterium tuberculosis
ASLRLLPSGGRFIELGKTDIR

SEQ ID NO: 1480392 - protein, 19 aa, Mycobacterium tuberculosis
ASLVDDLVRRCRMVMAGES

SEQ ID NO: 1480393 - protein, 17 aa, Mycobacterium tuberculosis
ASNAYRDYLECTVSACS

SEQ ID NO: 1480394 - protein, 18 aa, Mycobacterium tuberculosis
ASPAGWLFVSRWTAGGNS

SEQ ID NO: 1480395 - protein, 26 aa, Mycobacterium tuberculosis
ASPGYPCYRNILSALGCEVVEIPCGP

SEQ ID NO: 1480396 - protein, 20 aa, Mycobacterium tuberculosis
ASPIGWCPTSSLGWPRHKVA

SEQ ID NO: 1480397 - protein, 19 aa, Mycobacterium tuberculosis
ASPLDAVVTRWTRSTTVID

SEQ ID NO: 1480398 - protein, 21 aa, Mycobacterium tuberculosis
ASPTARVPWRTGTEGMAGAPG

SEQ ID NO: 1480399 - protein, 27 aa, Mycobacterium tuberculosis
ASPTCPTRSSALVGQRFFAAIGSAVTD

SEQ ID NO: 1480400 - protein, 25 aa, Mycobacterium tuberculosis
ASPTCSTLWWSGCPIRVTASRWPPV

SEQ ID NO: 1480401 - protein, 26 aa, Mycobacterium tuberculosis
ASPTPVLCPCPPLPPAPPTPPSTPPV

SEQ ID NO: 1480402 - protein, 17 aa, Mycobacterium tuberculosis
ASPVERLSAIRASMRDG

SEQ ID NO: 1480403 - protein, 17 aa, Mycobacterium tuberculosis
ASPVRRVEAPADVRFAH

SEQ ID NO: 1480404 - protein, 17 aa, Mycobacterium tuberculosis
ASPYVGWLNTAAGQAAQ

SEQ ID NO: 1480405 - protein, 25 aa, Mycobacterium tuberculosis
ASQLMGVVMARYIVRIEPVCFVAGR

SEQ ID NO: 1480406 - protein, 19 aa, Mycobacterium tuberculosis
ASQNLIPRVFWMTYQNSRD

SEQ ID NO: 1480407 - protein, 28 aa, Mycobacterium tuberculosis
ASQSSSCVRPCWSRISRSGATGSVNAAG

SEQ ID NO: 1480408 - protein, 17 aa, Mycobacterium tuberculosis
ASRVPMSIAAIAGKLGV

SEQ ID NO: 1480409 - protein, 19 aa, Mycobacterium tuberculosis
ASRWEPSWVQPVRRTNPAV

SEQ ID NO: 1480410 - protein, 18 aa, Mycobacterium tuberculosis
ASSCCRRRSGGPGEFRCR

SEQ ID NO: 1480411 - protein, 17 aa, Mycobacterium tuberculosis
ASSDLSVLVRTMCSRPA

SEQ ID NO: 1480412 - protein, 27 aa, Mycobacterium tuberculosis
ASSEAVTRCPWRRVIGWVTKSRSTWAA

SEQ ID NO: 1480413 - protein, 20 aa, Mycobacterium tuberculosis
ASSGMPRRSSSSSSYPASTI

SEQ ID NO: 1480414 - protein, 17 aa, Mycobacterium tuberculosis
ASSIAIAAVMFSGVAGG

SEQ ID NO: 1480415 - protein, 19 aa, Mycobacterium tuberculosis
ASSIGALSVPPSWAGQANL

SEQ ID NO: 1480416 - protein, 19 aa, Mycobacterium tuberculosis
ASSLLRVWMTRGRIQEGRA

SEQ ID NO: 1480417 - protein, 17 aa, Mycobacterium tuberculosis
ASSPAVMASPYPSRTRN

SEQ ID NO: 1480418 - protein, 28 aa, Mycobacterium tuberculosis
ASSPDGQDGGLLFGNGGAGYNSAATPGM

SEQ ID NO: 1480419 - protein, 23 aa, Mycobacterium tuberculosis
ASSSRAGLGYEVIVSRLDDEANI

SEQ ID NO: 1480420 - protein, 20 aa, Mycobacterium tuberculosis
ASSTVPTRCTCAPSPAPSCR

SEQ ID NO: 1480421 - protein, 28 aa, Mycobacterium tuberculosis
ASTETRLPFCWRGVSLHAGGAGRVRARF

SEQ ID NO: 1480422 - protein, 27 aa, Mycobacterium tuberculosis
ASTGCRTGCCAPSWSRSWKAARGHEVS

SEQ ID NO: 1480423 - protein, 18 aa, Mycobacterium tuberculosis
ASTGHAAMAQQLAGTPGA

SEQ ID NO: 1480424 - protein, 19 aa, Mycobacterium tuberculosis
ASTIDELKTNSSLLTSILT

SEQ ID NO: 1480425 - protein, 18 aa, Mycobacterium tuberculosis
ASTMPAWNGSKSHRRDPE

SEQ ID NO: 1480426 - protein, 19 aa, Mycobacterium tuberculosis
ASTMPAWNGSKSHRRDPEA

SEQ ID NO: 1480427 - protein, 20 aa, Mycobacterium tuberculosis
ASTSARTARSIWASATPAAA

SEQ ID NO: 1480428 - protein, 18 aa, Mycobacterium tuberculosis
ASVATIAWMGYHPPPNPL

SEQ ID NO: 1480429 - protein, 19 aa, Mycobacterium tuberculosis
ASVATIAWMGYHPPPNPLD

SEQ ID NO: 1480430 - protein, 26 aa, Mycobacterium tuberculosis
ASVAWDRLAAELAVAASSFGSVTSGL

SEQ ID NO: 1480431 - protein, 18 aa, Mycobacterium tuberculosis
ASVDAIKVVEAWMGAERI

SEQ ID NO: 1480432 - protein, 18 aa, Mycobacterium tuberculosis
ASVFARRVPLAAAVWTQR

SEQ ID NO: 1480433 - protein, 24 aa, Mycobacterium tuberculosis
ASVGGLKVPAVWTATTPAASPTVL

SEQ ID NO: 1480434 - protein, 21 aa, Mycobacterium tuberculosis
ASVGHGVCGPGPARVVGPGGS

SEQ ID NO: 1480435 - protein, 24 aa, Mycobacterium tuberculosis
ASVGKLSVPPVWSGPLPGSVTPGA

SEQ ID NO: 1480436 - protein, 35 aa, Mycobacterium tuberculosis
ASVGSLMKLRMSCCRLCHGEVLSGALYPSAPSSNP

SEQ ID NO: 1480437 - protein, 20 aa, Mycobacterium tuberculosis
ASVLKQLVAYVGLERFLAGL

SEQ ID NO: 1480438 - protein, 22 aa, Mycobacterium tuberculosis
ASVLKQLVAYVGLERFLAGLRD

SEQ ID NO: 1480439 - protein, 21 aa, Mycobacterium tuberculosis
ASVPPSWAWPKPAVAPPVLFG

SEQ ID NO: 1480440 - protein, 25 aa, Mycobacterium tuberculosis
ASVSCAIQNLWLAARSEGLGMDGLS

SEQ ID NO: 1480441 - protein, 18 aa, Mycobacterium tuberculosis
ASVTAGLAGQAWQGPAAL

SEQ ID NO: 1480442 - protein, 26 aa, Mycobacterium tuberculosis
ASVTAGLAGQAWQGPAALAMAAAAAP

SEQ ID NO: 1480443 - protein, 17 aa, Mycobacterium tuberculosis
ASVVVWELESAGGQASS

SEQ ID NO: 1480444 - protein, 19 aa, Mycobacterium tuberculosis
ASWLSGLRGSRVVLRVPRR

SEQ ID NO: 1480445 - protein, 26 aa, Mycobacterium tuberculosis
ASYAMPDVHWGYGFPIGGVAATDVDN

SEQ ID NO: 1480446 - protein, 17 aa, Mycobacterium tuberculosis
ATAAAAVRKWTKRKGRI

SEQ ID NO: 1480447 - protein, 19 aa, Mycobacterium tuberculosis
ATAACSTLAPTTSVCSTRA

SEQ ID NO: 1480448 - protein, 22 aa, Mycobacterium tuberculosis
ATAAFDLARIGSQVSAASAVAA

SEQ ID NO: 1480449 - protein, 28 aa, Mycobacterium tuberculosis
ATAAFDLARIGSQVSAASAVAAMPTTEV

SEQ ID NO: 1480450 - protein, 18 aa, Mycobacterium tuberculosis
ATAARYGHREALVDMVAR

SEQ ID NO: 1480451 - protein, 19 aa, Mycobacterium tuberculosis
ATACDVCIATDDARFGIRW

SEQ ID NO: 1480452 - protein, 20 aa, Mycobacterium tuberculosis
ATAGCFFYSKCRYPRRPPAR

SEQ ID NO: 1480453 - protein, 18 aa, Mycobacterium tuberculosis
ATAGPPCPPAPPSPNNIP

SEQ ID NO: 1480454 - protein, 20 aa, Mycobacterium tuberculosis
ATAIMWAREQFGLELIWGIE

SEQ ID NO: 1480455 - protein, 21 aa, Mycobacterium tuberculosis
ATALEGSGWTVAAEEAGPVTG

SEQ ID NO: 1480456 - protein, 17 aa, Mycobacterium tuberculosis
ATALPGANRMPHWAAGT

SEQ ID NO: 1480457 - protein, 18 aa, Mycobacterium tuberculosis
ATALRGIWGFYGDHKPHG

SEQ ID NO: 1480458 - protein, 17 aa, Mycobacterium tuberculosis
ATALRPGHNTISVEAAA

SEQ ID NO: 1480459 - protein, 25 aa, Mycobacterium tuberculosis
ATAPPCAVLSPGAPIPPLPAAPPLP

SEQ ID NO: 1480460 - protein, 20 aa, Mycobacterium tuberculosis
ATARCRRLLDLDADPEAIVE

SEQ ID NO: 1480461 - protein, 19 aa, Mycobacterium tuberculosis
ATAVAWLAGKVESFGVRLR

SEQ ID NO: 1480462 - protein, 23 aa, Mycobacterium tuberculosis
ATAWGELAEELLASIASLGSVTS

SEQ ID NO: 1480463 - protein, 17 aa, Mycobacterium tuberculosis
ATAWGLTADTPWRGLDV

SEQ ID NO: 1480464 - protein, 25 aa, Mycobacterium tuberculosis
ATAYLECAQACGLGLLGGPPTPETA

SEQ ID NO: 1480465 - protein, 19 aa, Mycobacterium tuberculosis
ATDLCEFVEFPSQLLQVCG

SEQ ID NO: 1480466 - protein, 24 aa, Mycobacterium tuberculosis
ATDLKRIGASLAHENASAAASTTA

SEQ ID NO: 1480467 - protein, 25 aa, Mycobacterium tuberculosis
ATDLKRIGASLAHENASAAASTTAV

SEQ ID NO: 1480468 - protein, 18 aa, Mycobacterium tuberculosis
ATDPRLWRHRSLAGETPV

SEQ ID NO: 1480469 - protein, 18 aa, Mycobacterium tuberculosis
ATDQIRLRRAMNLLPASH

SEQ ID NO: 1480470 - protein, 25 aa, Mycobacterium tuberculosis
ATDRFRLAVRELKWSASSPDIEAAV

SEQ ID NO: 1480471 - protein, 17 aa, Mycobacterium tuberculosis
ATDVARPAETVRGWLRR

SEQ ID NO: 1480472 - protein, 29 aa, Mycobacterium tuberculosis
ATDVGCSWLPLYHDMGLAFVLSAALAGAP

SEQ ID NO: 1480473 - protein, 18 aa, Mycobacterium tuberculosis
ATEALNLVSYVLGDSRFE

SEQ ID NO: 1480474 - protein, 23 aa, Mycobacterium tuberculosis
ATEDAWRRVFEFFGQHLRTGSPG

SEQ ID NO: 1480475 - protein, 23 aa, Mycobacterium tuberculosis
ATEIMVCRYADGVGHPFWFSRTV

SEQ ID NO: 1480476 - protein, 21 aa, Mycobacterium tuberculosis
ATELLLAMVRRLSVADTGIEL

SEQ ID NO: 1480477 - protein, 18 aa, Mycobacterium tuberculosis
ATETLELAPAHPPALPDP

SEQ ID NO: 1480478 - protein, 17 aa, Mycobacterium tuberculosis
ATFHDRFVQTLSATASS

SEQ ID NO: 1480479 - protein, 17 aa, Mycobacterium tuberculosis
ATGCARVNVGTAALENP

SEQ ID NO: 1480480 - protein, 23 aa, Mycobacterium tuberculosis
ATGELRWSTTRLARRRRRRGRWR

SEQ ID NO: 1480481 - protein, 17 aa, Mycobacterium tuberculosis
ATGLPSMVVLHPATSAV

SEQ ID NO: 1480482 - protein, 17 aa, Mycobacterium tuberculosis
ATGLPVLTVRSLVTRPI

SEQ ID NO: 1480483 - protein, 19 aa, Mycobacterium tuberculosis
ATGTLTFFGSGGDGGPGGA

SEQ ID NO: 1480484 - protein, 23 aa, Mycobacterium tuberculosis
ATHATELFAVFDIYRTRFGALLT

SEQ ID NO: 1480485 - protein, 29 aa, Mycobacterium tuberculosis
ATHIGGLWWILTCLMHGGLCVTGGENTTS

SEQ ID NO: 1480486 - protein, 18 aa, Mycobacterium tuberculosis
ATIKARENPAPPAPPAPP

SEQ ID NO: 1480487 - protein, 17 aa, Mycobacterium tuberculosis
ATILLSWSQPTAQPLPQ

SEQ ID NO: 1480488 - protein, 20 aa, Mycobacterium tuberculosis
ATKIARSMVTEFGMSSKLGA

SEQ ID NO: 1480489 - protein, 20 aa, Mycobacterium tuberculosis
ATKRFGLTVTLAERERQLAI

SEQ ID NO: 1480490 - protein, 26 aa, Mycobacterium tuberculosis
ATLPAAAWQRCRTHYAANLMAATPEA

SEQ ID NO: 1480491 - protein, 18 aa, Mycobacterium tuberculosis
ATLPGGFTISARKAYGRN

SEQ ID NO: 1480492 - protein, 20 aa, Mycobacterium tuberculosis
ATMAGLAFHGTVGYRRVRWR

SEQ ID NO: 1480493 - protein, 18 aa, Mycobacterium tuberculosis
ATMAVLWITERCVCSQCG

SEQ ID NO: 1480494 - protein, 17 aa, Mycobacterium tuberculosis
ATMDGALKGTSNETFPK

SEQ ID NO: 1480495 - protein, 17 aa, Mycobacterium tuberculosis
ATMPDPIITLARTFMVR

SEQ ID NO: 1480496 - protein, 19 aa, Mycobacterium tuberculosis
ATMRGEFLWCQLFSEPGAG

SEQ ID NO: 1480497 - protein, 27 aa, Mycobacterium tuberculosis
ATNISPRCWIPFPASWRPSSPWPPPPN

SEQ ID NO: 1480498 - protein, 17 aa, Mycobacterium tuberculosis
ATPARLPFTLGAGAHLQ

SEQ ID NO: 1480499 - protein, 17 aa, Mycobacterium tuberculosis
ATPEMMATAAFDLARIG

SEQ ID NO: 1480500 - protein, 24 aa, Mycobacterium tuberculosis
ATPEMMATAAFDLARIGSQVSAAS

SEQ ID NO: 1480501 - protein, 23 aa, Mycobacterium tuberculosis
ATPIPRTVALTVYGDLETSTLRE

SEQ ID NO: 1480502 - protein, 30 aa, Mycobacterium tuberculosis
ATPPQPRRWWDTRRRPRHGGNGGAGGNGGD

SEQ ID NO: 1480503 - protein, 18 aa, Mycobacterium tuberculosis
ATPPTWPRAVRSALDATD

SEQ ID NO: 1480504 - protein, 18 aa, Mycobacterium tuberculosis
ATPRLSFSGGSVAGTGGN

SEQ ID NO: 1480505 - protein, 17 aa, Mycobacterium tuberculosis
ATPSAGWHCCARRHRTR

SEQ ID NO: 1480506 - protein, 17 aa, Mycobacterium tuberculosis
ATPSRRGLVDVWPSRLR

SEQ ID NO: 1480507 - protein, 24 aa, Mycobacterium tuberculosis
ATPTCWRQVCATWNGSPGAGCTAP

SEQ ID NO: 1480508 - protein, 30 aa, Mycobacterium tuberculosis
ATPYELAATIARRLGLTGALGTVAESVDGI

SEQ ID NO: 1480509 - protein, 17 aa, Mycobacterium tuberculosis
ATQAAALVAEFEAVRAA

SEQ ID NO: 1480510 - protein, 18 aa, Mycobacterium tuberculosis
ATRAYRLPARCPRARPRP

SEQ ID NO: 1480511 - protein, 17 aa, Mycobacterium tuberculosis
ATRFCAFDSGGLADAVA

SEQ ID NO: 1480512 - protein, 26 aa, Mycobacterium tuberculosis
ATRNWAEPQMHAFDAGRIHKNLVPGT

SEQ ID NO: 1480513 - protein, 25 aa, Mycobacterium tuberculosis
ATRPRRCTWRRSAVNGSRSPGCPSS

SEQ ID NO: 1480514 - protein, 18 aa, Mycobacterium tuberculosis
ATRRLALTGTPFRSDDSP

SEQ ID NO: 1480515 - protein, 19 aa, Mycobacterium tuberculosis
ATRRSWAVLGEMAELGEDA

SEQ ID NO: 1480516 - protein, 28 aa, Mycobacterium tuberculosis
ATRSGDVWLLNGFKWFASNCAGEAFVVL

SEQ ID NO: 1480517 - protein, 19 aa, Mycobacterium tuberculosis
ATSAAPLQDLLGVVNAPAQ

SEQ ID NO: 1480518 - protein, 24 aa, Mycobacterium tuberculosis
ATSAEFRKLLADWKAAGRASKDVD

SEQ ID NO: 1480519 - protein, 17 aa, Mycobacterium tuberculosis
ATSARRALVLNLVAEPG

SEQ ID NO: 1480520 - protein, 18 aa, Mycobacterium tuberculosis
ATSFKAKPGQRIRIRIIN

SEQ ID NO: 1480521 - protein, 24 aa, Mycobacterium tuberculosis
ATSPLLAPINEFFLANTGRPLIGN

SEQ ID NO: 1480522 - protein, 17 aa, Mycobacterium tuberculosis
ATSRAYSARAIGSMFPK

SEQ ID NO: 1480523 - protein, 20 aa, Mycobacterium tuberculosis
ATSTGVCATCYGRSMATGKL

SEQ ID NO: 1480524 - protein, 22 aa, Mycobacterium tuberculosis
ATSTWPDMKIVNNIEVTGQAPP

SEQ ID NO: 1480525 - protein, 24 aa, Mycobacterium tuberculosis
ATTDEPFAALAFKIATHPFFGKLT

SEQ ID NO: 1480526 - protein, 23 aa, Mycobacterium tuberculosis
ATTGGWPTWAWAISGWPTPAPAT

SEQ ID NO: 1480527 - protein, 24 aa, Mycobacterium tuberculosis
ATTGRRWRQWAVPAGFASTGLGCP

SEQ ID NO: 1480528 - protein, 18 aa, Mycobacterium tuberculosis
ATTREMIKTGGFDAVCFT

SEQ ID NO: 1480529 - protein, 31 aa, Mycobacterium tuberculosis
ATVAILTYRCIRSGDIFQLAFMRPLRKSRER

SEQ ID NO: 1480530 - protein, 28 aa, Mycobacterium tuberculosis
ATVASAGPGRPAFPVVPAGSADCSSATA

SEQ ID NO: 1480531 - protein, 18 aa, Mycobacterium tuberculosis
ATVATLCRGQPRLDVGHQ

SEQ ID NO: 1480532 - protein, 29 aa, Mycobacterium tuberculosis
ATVGPVAPVGLQRYLAPVSAVPAAAAAPR

SEQ ID NO: 1480533 - protein, 24 aa, Mycobacterium tuberculosis
ATVLSRNTFHWVLAFADSGLLTSA

SEQ ID NO: 1480534 - protein, 17 aa, Mycobacterium tuberculosis
ATVRYLREFRFRGDIDG

SEQ ID NO: 1480535 - protein, 21 aa, Mycobacterium tuberculosis
ATVSVAAWGIRLAREAERKAG

SEQ ID NO: 1480536 - protein, 20 aa, Mycobacterium tuberculosis
ATWTGWLRTRRSTLGHRNPA

SEQ ID NO: 1480537 - protein, 21 aa, Mycobacterium tuberculosis
AVAARHGFAQDVANVGFAGDA

SEQ ID NO: 1480538 - protein, 27 aa, Mycobacterium tuberculosis
AVAARYPDRFLPFAGRTRGCLLRSTPE

SEQ ID NO: 1480539 - protein, 17 aa, Mycobacterium tuberculosis
AVAASWFGSVTSGLADA

SEQ ID NO: 1480540 - protein, 19 aa, Mycobacterium tuberculosis
AVACAGHLPGHIGHQRNPR

SEQ ID NO: 1480541 - protein, 17 aa, Mycobacterium tuberculosis
AVAELALLAAAETTTNG

SEQ ID NO: 1480542 - protein, 18 aa, Mycobacterium tuberculosis
AVAGGGGRGMRRVGDIAA

SEQ ID NO: 1480543 - protein, 24 aa, Mycobacterium tuberculosis
AVAGLGLELSRLIKGSAELAIDAR

SEQ ID NO: 1480544 - protein, 24 aa, Mycobacterium tuberculosis
AVAISALQWRGSQTSDPVETPVEG

SEQ ID NO: 1480545 - protein, 17 aa, Mycobacterium tuberculosis
AVANILAELGMDTTTLV

SEQ ID NO: 1480546 - protein, 25 aa, Mycobacterium tuberculosis
AVAQLRSGMTIGIAGWGSRRKPMAF

SEQ ID NO: 1480547 - protein, 26 aa, Mycobacterium tuberculosis
AVAREVLRAGPGVPELRAAGERMRDA

SEQ ID NO: 1480548 - protein, 24 aa, Mycobacterium tuberculosis
AVARGDASAGWCVSIAITSALLVA

SEQ ID NO: 1480549 - protein, 18 aa, Mycobacterium tuberculosis
AVARLRLLCRGSGITDVT

SEQ ID NO: 1480550 - protein, 19 aa, Mycobacterium tuberculosis
AVASGAWTAVHHAFTAPKP

SEQ ID NO: 1480551 - protein, 32 aa, Mycobacterium tuberculosis
AVASRTGNLVTWWTGDALLVFDAGNLTQRYTI

SEQ ID NO: 1480552 - protein, 19 aa, Mycobacterium tuberculosis
AVATVWEDTALTGGAGDTR

SEQ ID NO: 1480553 - protein, 24 aa, Mycobacterium tuberculosis
AVAVDLRNDWPTALKNAGFDPARP

SEQ ID NO: 1480554 - protein, 19 aa, Mycobacterium tuberculosis
AVCGLRIGTGVSERDKHNR

SEQ ID NO: 1480555 - protein, 23 aa, Mycobacterium tuberculosis
AVDHGFSGILVGHVNGHMNRSTA

SEQ ID NO: 1480556 - protein, 21 aa, Mycobacterium tuberculosis
AVDKPLWRWIKMGQTAPTSPN

SEQ ID NO: 1480557 - protein, 22 aa, Mycobacterium tuberculosis
AVDLRDDWPTALQKAGFDNAQR

SEQ ID NO: 1480558 - protein, 28 aa, Mycobacterium tuberculosis
AVDTDLRWRIVTALATAGAIDADWPETP

SEQ ID NO: 1480559 - protein, 18 aa, Mycobacterium tuberculosis
AVEAEYELMWAADVAAMA

SEQ ID NO: 1480560 - protein, 20 aa, Mycobacterium tuberculosis
AVEEIVRWASPVVYMRRTLT

SEQ ID NO: 1480561 - protein, 21 aa, Mycobacterium tuberculosis
AVEEIVRWASPVVYMRRTLTQ

SEQ ID NO: 1480562 - protein, 18 aa, Mycobacterium tuberculosis
AVEHIGMIEVAQLRARVS

SEQ ID NO: 1480563 - protein, 20 aa, Mycobacterium tuberculosis
AVERIELFVDVLLKGGRTAD

SEQ ID NO: 1480564 - protein, 17 aa, Mycobacterium tuberculosis
AVERNGLHRLVNPRTGK

SEQ ID NO: 1480565 - protein, 24 aa, Mycobacterium tuberculosis
AVESGLRVARKWGADVNGLPAGRH

SEQ ID NO: 1480566 - protein, 17 aa, Mycobacterium tuberculosis
AVESVFDALAGRVELYR

SEQ ID NO: 1480567 - protein, 23 aa, Mycobacterium tuberculosis
AVEVLARGTAWLDTGTFDSLLDA

SEQ ID NO: 1480568 - protein, 22 aa, Mycobacterium tuberculosis
AVFDLPKGAPRRFIRDLYEAIS

SEQ ID NO: 1480569 - protein, 24 aa, Mycobacterium tuberculosis
AVGACSRGLMSRADVDAIERAICP

SEQ ID NO: 1480570 - protein, 19 aa, Mycobacterium tuberculosis
AVGAPGQPGGAGGHGGAGG

SEQ ID NO: 1480571 - protein, 27 aa, Mycobacterium tuberculosis
AVGDKWRLAEVLAWQAYVGFAGEVTRA

SEQ ID NO: 1480572 - protein, 26 aa, Mycobacterium tuberculosis
AVGGKGGTGGLLFGNGGAGGQGGLGL

SEQ ID NO: 1480573 - protein, 18 aa, Mycobacterium tuberculosis
AVGLAIRACQAGHRVLFA

SEQ ID NO: 1480574 - protein, 18 aa, Mycobacterium tuberculosis
AVGLALRGFVPVPEIQFD

SEQ ID NO: 1480575 - protein, 19 aa, Mycobacterium tuberculosis
AVGLPAIYVPLPIGNGEQR

SEQ ID NO: 1480576 - protein, 17 aa, Mycobacterium tuberculosis
AVGLRPVRRFEDRPDAV

SEQ ID NO: 1480577 - protein, 18 aa, Mycobacterium tuberculosis
AVGMPTFAGRAIAASLGL

SEQ ID NO: 1480578 - protein, 18 aa, Mycobacterium tuberculosis
AVGSGAWTAVHHAFTAPK

SEQ ID NO: 1480579 - protein, 25 aa, Mycobacterium tuberculosis
AVHRRCADVRYLGSWPTGPAAGVQP

SEQ ID NO: 1480580 - protein, 18 aa, Mycobacterium tuberculosis
AVHYPWLPLRRLLLDHYP

SEQ ID NO: 1480581 - protein, 20 aa, Mycobacterium tuberculosis
AVIKNAIDWLSRPFGDGALK

SEQ ID NO: 1480582 - protein, 25 aa, Mycobacterium tuberculosis
AVILQEIFRRFTITAAGPSKGETPL

SEQ ID NO: 1480583 - protein, 24 aa, Mycobacterium tuberculosis
AVIPRTRLAFVGALGPWGPLATPD

SEQ ID NO: 1480584 - protein, 26 aa, Mycobacterium tuberculosis
AVKEAVLPFHRFRRADGAAIDSLLGP

SEQ ID NO: 1480585 - protein, 24 aa, Mycobacterium tuberculosis
AVKHLCAQMLCRAEQADVAAADAA

SEQ ID NO: 1480586 - protein, 24 aa, Mycobacterium tuberculosis
AVKRRYLQGRAWTAPWSPPASTGC

SEQ ID NO: 1480587 - protein, 23 aa, Mycobacterium tuberculosis
AVKYGGLQWTWSQYLAESAARAA

SEQ ID NO: 1480588 - protein, 26 aa, Mycobacterium tuberculosis
AVLAAARRLRIIPGIASRTRTGGSAI

SEQ ID NO: 1480589 - protein, 17 aa, Mycobacterium tuberculosis
AVLADLVDGFSVRDDAL

SEQ ID NO: 1480590 - protein, 17 aa, Mycobacterium tuberculosis
AVLARELELCYAAIALV

SEQ ID NO: 1480591 - protein, 18 aa, Mycobacterium tuberculosis
AVLARELELCYAAIALVT

SEQ ID NO: 1480592 - protein, 24 aa, Mycobacterium tuberculosis
AVLGRLPMRVWLFGLRPMEGSPEG

SEQ ID NO: 1480593 - protein, 17 aa, Mycobacterium tuberculosis
AVLPSFTPMLLPDIGRT

SEQ ID NO: 1480594 - protein, 24 aa, Mycobacterium tuberculosis
AVLPVTGPTAATAREQGPSPAAAA

SEQ ID NO: 1480595 - protein, 22 aa, Mycobacterium tuberculosis
AVLRRLEGHFTLVFANADDPGT

SEQ ID NO: 1480596 - protein, 25 aa, Mycobacterium tuberculosis
AVLRRLEWHFTLVFANADDPGTLVA

SEQ ID NO: 1480597 - protein, 17 aa, Mycobacterium tuberculosis
AVMNRFSPQQAQLTLID

SEQ ID NO: 1480598 - protein, 22 aa, Mycobacterium tuberculosis
AVNANGIYVCRAIVSHRMPEGV

SEQ ID NO: 1480599 - protein, 26 aa, Mycobacterium tuberculosis
AVNFGPISVQGFGLFGHGGDGGNGGD

SEQ ID NO: 1480600 - protein, 24 aa, Mycobacterium tuberculosis
AVNRCGWTRRGRRTGGTGGAVSLA

SEQ ID NO: 1480601 - protein, 29 aa, Mycobacterium tuberculosis
AVPAAAAAPRCFSAAVGPVGTAALVGLTL

SEQ ID NO: 1480602 - protein, 30 aa, Mycobacterium tuberculosis
AVPAARVPPWARPVRQGRPAAPETGGVGGS

SEQ ID NO: 1480603 - protein, 20 aa, Mycobacterium tuberculosis
AVPGGTAFPHCSGVLVAGDE

SEQ ID NO: 1480604 - protein, 18 aa, Mycobacterium tuberculosis
AVPGRVVALGQTVQASDS

SEQ ID NO: 1480605 - protein, 23 aa, Mycobacterium tuberculosis
AVPHLPPPPLVFAAEPAKTGADV

SEQ ID NO: 1480606 - protein, 25 aa, Mycobacterium tuberculosis
AVPHRPSRSPIRRSRRLKTSHRATS

SEQ ID NO: 1480607 - protein, 17 aa, Mycobacterium tuberculosis
AVPNGQPVKGRLTVPPS

SEQ ID NO: 1480608 - protein, 21 aa, Mycobacterium tuberculosis
AVPPWARPVRQGRPAAPETVA

SEQ ID NO: 1480609 - protein, 23 aa, Mycobacterium tuberculosis
AVRAAMVQPALVAANRSDLVSLV

SEQ ID NO: 1480610 - protein, 20 aa, Mycobacterium tuberculosis
AVRAGALGARMTRGRLRGRR

SEQ ID NO: 1480611 - protein, 21 aa, Mycobacterium tuberculosis
AVRAGTWFPCCGSRPATGAVP

SEQ ID NO: 1480612 - protein, 17 aa, Mycobacterium tuberculosis
AVRAWLLSQRRIVTTYA

SEQ ID NO: 1480613 - protein, 23 aa, Mycobacterium tuberculosis
AVRESLRRSLSFNGYSVELAHDG

SEQ ID NO: 1480614 - protein, 29 aa, Mycobacterium tuberculosis
AVRGSCRRRAIAARHGCLARRAPLVRTKQ

SEQ ID NO: 1480615 - protein, 27 aa, Mycobacterium tuberculosis
AVRHRPDPTPAVGRGVGRGARLRGPVC

SEQ ID NO: 1480616 - protein, 17 aa, Mycobacterium tuberculosis
AVRLRFSATTAVGVDAI

SEQ ID NO: 1480617 - protein, 17 aa, Mycobacterium tuberculosis
AVRMRLREAVDRGEAHP

SEQ ID NO: 1480618 - protein, 17 aa, Mycobacterium tuberculosis
AVRQKYDPSRVMFSGLN

SEQ ID NO: 1480619 - protein, 17 aa, Mycobacterium tuberculosis
AVRQSCGRCSPARLRCI

SEQ ID NO: 1480620 - protein, 23 aa, Mycobacterium tuberculosis
AVRRRPYTVVLFDEIEKAHPDVF

SEQ ID NO: 1480621 - protein, 24 aa, Mycobacterium tuberculosis
AVRSYELPTRVLLISAHDEPAIVY

SEQ ID NO: 1480622 - protein, 17 aa, Mycobacterium tuberculosis
AVRVSQLHAGPRKSALD

SEQ ID NO: 1480623 - protein, 30 aa, Mycobacterium tuberculosis
AVSASAQTLLSRPLIGNGANATTPGGNGGD

SEQ ID NO: 1480624 - protein, 17 aa, Mycobacterium tuberculosis
AVSLMARPAARAVPEGT

SEQ ID NO: 1480625 - protein, 26 aa, Mycobacterium tuberculosis
AVSPLLDPINEFFLANTGRPLIGNGA

SEQ ID NO: 1480626 - protein, 26 aa, Mycobacterium tuberculosis
AVSPLLDPINEFFLANTGRPLIGNGT

SEQ ID NO: 1480627 - protein, 18 aa, Mycobacterium tuberculosis
AVSSFGLGGTNAHVIIEQ

SEQ ID NO: 1480628 - protein, 20 aa, Mycobacterium tuberculosis
AVTAEPAGTAGLLATAVTAP

SEQ ID NO: 1480629 - protein, 17 aa, Mycobacterium tuberculosis
AVTAGLAGSSWLGAAST

SEQ ID NO: 1480630 - protein, 17 aa, Mycobacterium tuberculosis
AVTALRAGPAVAAVAAL

SEQ ID NO: 1480631 - protein, 17 aa, Mycobacterium tuberculosis
AVTARRRRPPGLAGGAE

SEQ ID NO: 1480632 - protein, 21 aa, Mycobacterium tuberculosis
AVTDVLGAVVKVFVSGVDASD

SEQ ID NO: 1480633 - protein, 17 aa, Mycobacterium tuberculosis
AVTEVTIATSLRGALGS

SEQ ID NO: 1480634 - protein, 17 aa, Mycobacterium tuberculosis
AVTTLRFWHPGIDVLKL

SEQ ID NO: 1480635 - protein, 25 aa, Mycobacterium tuberculosis
AVVDARLVTMVPAGWSLVEAAAVPV

SEQ ID NO: 1480636 - protein, 24 aa, Mycobacterium tuberculosis
AVVDARRGKMFARLIKNIEVAARV

SEQ ID NO: 1480637 - protein, 28 aa, Mycobacterium tuberculosis
AVVDLADPAVVWALRLQGRVPHVVAQSL

SEQ ID NO: 1480638 - protein, 20 aa, Mycobacterium tuberculosis
AVVGIYGRYDWEDRSTPERA

SEQ ID NO: 1480639 - protein, 25 aa, Mycobacterium tuberculosis
AVVKQAAAFHSEFTRTLEAAGNAYA

SEQ ID NO: 1480640 - protein, 19 aa, Mycobacterium tuberculosis
AVVMAPMYLGLRVWSRATI

SEQ ID NO: 1480641 - protein, 18 aa, Mycobacterium tuberculosis
AVVPRAHGSALFERGETQ

SEQ ID NO: 1480642 - protein, 20 aa, Mycobacterium tuberculosis
AVVVPLDPTSTFALITQPDR

SEQ ID NO: 1480643 - protein, 17 aa, Mycobacterium tuberculosis
AVVYGYFPAVSEGNDIV

SEQ ID NO: 1480644 - protein, 19 aa, Mycobacterium tuberculosis
AVWHLCTAITGRLRNISTT

SEQ ID NO: 1480645 - protein, 24 aa, Mycobacterium tuberculosis
AVYRLTGELAEWFGIGAGTLRQGD

SEQ ID NO: 1480646 - protein, 19 aa, Mycobacterium tuberculosis
AWAATRWVAEHGRQVGADL

SEQ ID NO: 1480647 - protein, 20 aa, Mycobacterium tuberculosis
AWAIPRAANRFWMLNESERA

SEQ ID NO: 1480648 - protein, 18 aa, Mycobacterium tuberculosis
AWFPTSRLTAPPQPGETV

SEQ ID NO: 1480649 - protein, 19 aa, Mycobacterium tuberculosis
AWGPRAPFEVLLGKPRAGE

SEQ ID NO: 1480650 - protein, 26 aa, Mycobacterium tuberculosis
AWGRIRLRARPGWPRGDRRHEPPVPA

SEQ ID NO: 1480651 - protein, 17 aa, Mycobacterium tuberculosis
AWHAAVSSGWRAHHRPT

SEQ ID NO: 1480652 - protein, 27 aa, Mycobacterium tuberculosis
AWHPAVRGRAPIPRRTRAHPFPPPGGV

SEQ ID NO: 1480653 - protein, 18 aa, Mycobacterium tuberculosis
AWIRASNPIMVGWPSDWG

SEQ ID NO: 1480654 - protein, 26 aa, Mycobacterium tuberculosis
AWLRRARSRALIPWASVRAAVNHRTP

SEQ ID NO: 1480655 - protein, 18 aa, Mycobacterium tuberculosis
AWPPNAAMATRRLHPLGA

SEQ ID NO: 1480656 - protein, 18 aa, Mycobacterium tuberculosis
AWPRWCGDRVWASRRRPR

SEQ ID NO: 1480657 - protein, 33 aa, Mycobacterium tuberculosis
AWRAATRSSTKPALTCWKPFTATISKAGADAVE

SEQ ID NO: 1480658 - protein, 20 aa, Mycobacterium tuberculosis
AWRGERRFVERLSRATIDVS

SEQ ID NO: 1480659 - protein, 19 aa, Mycobacterium tuberculosis
AWRNLRFARAKMPADAVAV

SEQ ID NO: 1480660 - protein, 22 aa, Mycobacterium tuberculosis
AWSEGRDLWWHHVVGAASPAHT

SEQ ID NO: 1480661 - protein, 24 aa, Mycobacterium tuberculosis
AWSLAVALRLAAYQLLRVDGGEPV

SEQ ID NO: 1480662 - protein, 26 aa, Mycobacterium tuberculosis
AWSLAVALRLAAYQLLRVDGGEPVLL

SEQ ID NO: 1480663 - protein, 21 aa, Mycobacterium tuberculosis
AWSRMRMMRSGKHITYHSVRR

SEQ ID NO: 1480664 - protein, 27 aa, Mycobacterium tuberculosis
AWTLAMGHAMIRAGLRLKKLGTDRSWR

SEQ ID NO: 1480665 - protein, 18 aa, Mycobacterium tuberculosis
AWTSCRRPPVLSSASRSA

SEQ ID NO: 1480666 - protein, 23 aa, Mycobacterium tuberculosis
AWVFNEPFILIAVVQQARQPVCD

SEQ ID NO: 1480667 - protein, 19 aa, Mycobacterium tuberculosis
AWVLGWRRPQAYPLMSHLA

SEQ ID NO: 1480668 - protein, 19 aa, Mycobacterium tuberculosis
AWVPFGGGVKRCLGANFSM

SEQ ID NO: 1480669 - protein, 18 aa, Mycobacterium tuberculosis
AWWSRPLEKVYAAVFIDA

SEQ ID NO: 1480670 - protein, 20 aa, Mycobacterium tuberculosis
AYAARAGITCAVLIPQGKIA

SEQ ID NO: 1480671 - protein, 22 aa, Mycobacterium tuberculosis
AYAEGLRALYLYTATFQDAAVA

SEQ ID NO: 1480672 - protein, 25 aa, Mycobacterium tuberculosis
AYAELKPDPWLADVCREEMQRLGRE

SEQ ID NO: 1480673 - protein, 22 aa, Mycobacterium tuberculosis
AYCRHIGVEYAHILDPEQKEWL

SEQ ID NO: 1480674 - protein, 24 aa, Mycobacterium tuberculosis
AYDALCFPGLAAEWGGRRPFVGAL

SEQ ID NO: 1480675 - protein, 29 aa, Mycobacterium tuberculosis
AYDLAKGCALTVIRAAFQLARSDADIAAL

SEQ ID NO: 1480676 - protein, 22 aa, Mycobacterium tuberculosis
AYEPFPGMALADTFQISEAGDS

SEQ ID NO: 1480677 - protein, 20 aa, Mycobacterium tuberculosis
AYETAYRLTVPPPVIAENRA

SEQ ID NO: 1480678 - protein, 18 aa, Mycobacterium tuberculosis
AYFARFGGVRDYLRAVVE

SEQ ID NO: 1480679 - protein, 32 aa, Mycobacterium tuberculosis
AYGGAGGAGGCLWGNGRSGGNGGVGVAGDPGG

SEQ ID NO: 1480680 - protein, 18 aa, Mycobacterium tuberculosis
AYGPAGFLQYQFVIPTEA

SEQ ID NO: 1480681 - protein, 19 aa, Mycobacterium tuberculosis
AYGRYMIRVKEMWESMKIV

SEQ ID NO: 1480682 - protein, 19 aa, Mycobacterium tuberculosis
AYGVRPGAVIGHSMGESAA

SEQ ID NO: 1480683 - protein, 26 aa, Mycobacterium tuberculosis
AYHIAVKCGWPSGPMVASVPVRLELT

SEQ ID NO: 1480684 - protein, 18 aa, Mycobacterium tuberculosis
AYKPRPCDASDWLDAALG

SEQ ID NO: 1480685 - protein, 27 aa, Mycobacterium tuberculosis
AYLEHPKMPLVPLIDGWETVVEMEAAL

SEQ ID NO: 1480686 - protein, 32 aa, Mycobacterium tuberculosis
AYLFGSGGRGRAGRYGGSRGRRRQPHTHPAPL

SEQ ID NO: 1480687 - protein, 19 aa, Mycobacterium tuberculosis
AYLLPARNWSVMAATEVRS

SEQ ID NO: 1480688 - protein, 19 aa, Mycobacterium tuberculosis
AYQRLPFGQGPDVWLAALA

SEQ ID NO: 1480689 - protein, 17 aa, Mycobacterium tuberculosis
AYQWLRARGYRPEQIVL

SEQ ID NO: 1480690 - protein, 22 aa, Mycobacterium tuberculosis
AYRCGDWAQALAELRAARRMGS

SEQ ID NO: 1480691 - protein, 24 aa, Mycobacterium tuberculosis
AYRLRFLPKLDRAWDSGDHLAATL

SEQ ID NO: 1480692 - protein, 26 aa, Mycobacterium tuberculosis
AYRRTLRFPWGNGIVSLTPAPDHVRC

SEQ ID NO: 1480693 - protein, 26 aa, Mycobacterium tuberculosis
AYRRTLRLPWGNGIVSLTPAPDHVRC

SEQ ID NO: 1480694 - protein, 22 aa, Mycobacterium tuberculosis
AYRVAGYRAGWLAITGPKEHAS

SEQ ID NO: 1480695 - protein, 23 aa, Mycobacterium tuberculosis
AYRVAGYRAGWLARITDRRCSPP

SEQ ID NO: 1480696 - protein, 17 aa, Mycobacterium tuberculosis
AYSTRLKITPTRVWTTP

SEQ ID NO: 1480697 - protein, 17 aa, Mycobacterium tuberculosis
AYTASGLSHNLAPINLV

SEQ ID NO: 1480698 - protein, 18 aa, Mycobacterium tuberculosis
AYTPWYLVRYWRLLRFKL

SEQ ID NO: 1480699 - protein, 23 aa, Mycobacterium tuberculosis
AYVERLAAKLAFGYWGGGAPPPP

SEQ ID NO: 1480700 - protein, 25 aa, Mycobacterium tuberculosis
AYVMDSWLRLVPDGVAGELYLAGAQ

SEQ ID NO: 1480701 - protein, 20 aa, Mycobacterium tuberculosis
AYVRRAPLLDGIDEFDAGFF

SEQ ID NO: 1480702 - protein, 21 aa, Mycobacterium tuberculosis
AYVRRAPLLDGIDEFDAGFFG

SEQ ID NO: 1480703 - protein, 20 aa, Mycobacterium tuberculosis
CAAAMGALLLANRGGERDSR

SEQ ID NO: 1480704 - protein, 18 aa, Mycobacterium tuberculosis
CAADPTLAVDWPLVDGAA

SEQ ID NO: 1480705 - protein, 17 aa, Mycobacterium tuberculosis
CACARAVQRPGGAGPSA

SEQ ID NO: 1480706 - protein, 19 aa, Mycobacterium tuberculosis
CACTPGSAPSGGTCGTGMA

SEQ ID NO: 1480707 - protein, 19 aa, Mycobacterium tuberculosis
CADCGVTVDRMPRVETFGV

SEQ ID NO: 1480708 - protein, 18 aa, Mycobacterium tuberculosis
CAEGGVLGIICASVASVM

SEQ ID NO: 1480709 - protein, 29 aa, Mycobacterium tuberculosis
CAELLDWPAKLRLLDGFPAAGEPELVGAP

SEQ ID NO: 1480710 - protein, 18 aa, Mycobacterium tuberculosis
CAELLDWPAKLRLLDGFR

SEQ ID NO: 1480711 - protein, 17 aa, Mycobacterium tuberculosis
CAERAIAVARRGSNVAE

SEQ ID NO: 1480712 - protein, 19 aa, Mycobacterium tuberculosis
CAESVPMLRCVPLAIATRG

SEQ ID NO: 1480713 - protein, 18 aa, Mycobacterium tuberculosis
CAGDDEWCVISIRSDDEW

SEQ ID NO: 1480714 - protein, 20 aa, Mycobacterium tuberculosis
CAGPGCSAWTSRCRIWTPSC

SEQ ID NO: 1480715 - protein, 17 aa, Mycobacterium tuberculosis
CAGYRGAVVGRRDAVRS

SEQ ID NO: 1480716 - protein, 17 aa, Mycobacterium tuberculosis
CAIDAMSSRCFPSYALR

SEQ ID NO: 1480717 - protein, 22 aa, Mycobacterium tuberculosis
CAIESWDSSGSVYARLMDIERE

SEQ ID NO: 1480718 - protein, 18 aa, Mycobacterium tuberculosis
CAIFTPYRWMIEHVTTKR

SEQ ID NO: 1480719 - protein, 20 aa, Mycobacterium tuberculosis
CAKAQALVAERGFEITTAAG

SEQ ID NO: 1480720 - protein, 20 aa, Mycobacterium tuberculosis
CAKLEVPWSRDVRGACRGVE

SEQ ID NO: 1480721 - protein, 17 aa, Mycobacterium tuberculosis
CALADAFELEEFGVVGH

SEQ ID NO: 1480722 - protein, 21 aa, Mycobacterium tuberculosis
CALLGLDCVIYMGGIDTARQA

SEQ ID NO: 1480723 - protein, 18 aa, Mycobacterium tuberculosis
CAMGARRPDRSRGSRSCS

SEQ ID NO: 1480724 - protein, 30 aa, Mycobacterium tuberculosis
CANCRGGEYRRCVRHGLADMYGFIPVDREP

SEQ ID NO: 1480725 - protein, 18 aa, Mycobacterium tuberculosis
CAPFELSRDAPLRITVVR

SEQ ID NO: 1480726 - protein, 32 aa, Mycobacterium tuberculosis
CAPSRSLPLLECWTALAALCRDTMKLRLGTSV

SEQ ID NO: 1480727 - protein, 33 aa, Mycobacterium tuberculosis
CAQLHVCPQLRLWDWCPTPWTPHGGWVTVFSGP

SEQ ID NO: 1480728 - protein, 22 aa, Mycobacterium tuberculosis
CARARARLARLLGYLNTGVNIR

SEQ ID NO: 1480729 - protein, 21 aa, Mycobacterium tuberculosis
CARSCRNRRLPLRRLGAGVGR

SEQ ID NO: 1480730 - protein, 19 aa, Mycobacterium tuberculosis
CASSIAIAAVMFSGVAGGA

SEQ ID NO: 1480731 - protein, 38 aa, Mycobacterium tuberculosis
CASWPDTHAIAVWRGVFRRLKLAGMGRRVLSQRGGERD

SEQ ID NO: 1480732 - protein, 17 aa, Mycobacterium tuberculosis
CAVADALGIRTVLIPPM

SEQ ID NO: 1480733 - protein, 17 aa, Mycobacterium tuberculosis
CAVAEFVGVVNAPAQAL

SEQ ID NO: 1480734 - protein, 24 aa, Mycobacterium tuberculosis
CAWPTIRRDGSYDAGERWPDAQIV

SEQ ID NO: 1480735 - protein, 25 aa, Mycobacterium tuberculosis
CCAPDDVLPAIAFAVAHTGKPVIVY

SEQ ID NO: 1480736 - protein, 21 aa, Mycobacterium tuberculosis
CCPKLRLGGLRRAGRHPTCSA

SEQ ID NO: 1480737 - protein, 19 aa, Mycobacterium tuberculosis
CCPMAKCSARQPLPESAAA

SEQ ID NO: 1480738 - protein, 21 aa, Mycobacterium tuberculosis
CCQYDPLMSPLVWDLAHIGQQ

SEQ ID NO: 1480739 - protein, 27 aa, Mycobacterium tuberculosis
CCRPRTEPERGWFCAMSRAPKIYRPAS

SEQ ID NO: 1480740 - protein, 19 aa, Mycobacterium tuberculosis
CCRWWPGCDRRHRRPVRGA

SEQ ID NO: 1480741 - protein, 26 aa, Mycobacterium tuberculosis
CCTSCCDRSGWSRAGWWASTRRAMAW

SEQ ID NO: 1480742 - protein, 33 aa, Mycobacterium tuberculosis
CCWHHVCSRCGVPGAACKRGWPGSPPPWPTTMH

SEQ ID NO: 1480743 - protein, 33 aa, Mycobacterium tuberculosis
CCWHHVCSRCGVPGAACKRGWPGSPPPWPTTPN

SEQ ID NO: 1480744 - protein, 17 aa, Mycobacterium tuberculosis
CDAAFSGGRLGEGAQTV

SEQ ID NO: 1480745 - protein, 25 aa, Mycobacterium tuberculosis
CDAAGVPYRTQWDAGAVVLELYEHL

SEQ ID NO: 1480746 - protein, 25 aa, Mycobacterium tuberculosis
CDDALMKITHVLRGGGPAAVDAAPA

SEQ ID NO: 1480747 - protein, 24 aa, Mycobacterium tuberculosis
CDEADRLAARLARIDDIDGDRDRV

SEQ ID NO: 1480748 - protein, 22 aa, Mycobacterium tuberculosis
CDEVFAHVAAVFGVDAEVAEDI

SEQ ID NO: 1480749 - protein, 28 aa, Mycobacterium tuberculosis
CDGNRRWERRAAYHYVGYGYRDVVRPKI

SEQ ID NO: 1480750 - protein, 18 aa, Mycobacterium tuberculosis
CDIFARYDVTFSLGDGLR

SEQ ID NO: 1480751 - protein, 19 aa, Mycobacterium tuberculosis
CDKRKIPLLFLQNIAGFMV

SEQ ID NO: 1480752 - protein, 20 aa, Mycobacterium tuberculosis
CDLGRQIGYLLASQEPALAE

SEQ ID NO: 1480753 - protein, 19 aa, Mycobacterium tuberculosis
CDLQIKWNGFQAGGPVRTV

SEQ ID NO: 1480754 - protein, 20 aa, Mycobacterium tuberculosis
CDLQIKWNGFQAGGPVRTVK

SEQ ID NO: 1480755 - protein, 17 aa, Mycobacterium tuberculosis
CDLRVVAPDAFFQFPTS

SEQ ID NO: 1480756 - protein, 25 aa, Mycobacterium tuberculosis
CDPPPSVGVFARFVAAQRCAGASIG

SEQ ID NO: 1480757 - protein, 25 aa, Mycobacterium tuberculosis
CDPTCWSSSRSRSWRNTTPTKSWPS

SEQ ID NO: 1480758 - protein, 19 aa, Mycobacterium tuberculosis
CDRRRVCPRRGCRGSGAQS

SEQ ID NO: 1480759 - protein, 21 aa, Mycobacterium tuberculosis
CDVTCGGLFYATDEVQQSAFT

SEQ ID NO: 1480760 - protein, 32 aa, Mycobacterium tuberculosis
CEASARSTTAWILHMAKLSAAMAKQLHMSRTD

SEQ ID NO: 1480761 - protein, 17 aa, Mycobacterium tuberculosis
CEGKPWIDKPMIRRPDM

SEQ ID NO: 1480762 - protein, 17 aa, Mycobacterium tuberculosis
CEPFLVRAGMVARTPRG

SEQ ID NO: 1480763 - protein, 21 aa, Mycobacterium tuberculosis
CEPVAVVGIGCRFPGNVTGPE

SEQ ID NO: 1480764 - protein, 24 aa, Mycobacterium tuberculosis
CERCNYVKEAPGWRVSTDTDETGR

SEQ ID NO: 1480765 - protein, 17 aa, Mycobacterium tuberculosis
CETRSAWSFNRYAHLHT

SEQ ID NO: 1480766 - protein, 29 aa, Mycobacterium tuberculosis
CEVCGYHCWAEFFVAGLGWLPADASCATK

SEQ ID NO: 1480767 - protein, 23 aa, Mycobacterium tuberculosis
CFAGKDRTGFVVALVLEAVGLDR

SEQ ID NO: 1480768 - protein, 21 aa, Mycobacterium tuberculosis
CFASGRVAYAMGLQGPAITVD

SEQ ID NO: 1480769 - protein, 20 aa, Mycobacterium tuberculosis
CFGCGEGGDVYAFIQKIEHV

SEQ ID NO: 1480770 - protein, 21 aa, Mycobacterium tuberculosis
CFGCGEGGDVYAFIQKIEHVS

SEQ ID NO: 1480771 - protein, 17 aa, Mycobacterium tuberculosis
CFYGIDFPSPAELIANA

SEQ ID NO: 1480772 - protein, 25 aa, Mycobacterium tuberculosis
CGACGAYKIGSTWHRTTTPTVGAAT

SEQ ID NO: 1480773 - protein, 23 aa, Mycobacterium tuberculosis
CGADFRLTDAAVWERFYGSSHAG

SEQ ID NO: 1480774 - protein, 17 aa, Mycobacterium tuberculosis
CGAFYPAMFQAAIDAGR

SEQ ID NO: 1480775 - protein, 19 aa, Mycobacterium tuberculosis
CGAGLVHGSGGFGWTPTTS

SEQ ID NO: 1480776 - protein, 18 aa, Mycobacterium tuberculosis
CGAIGVIECDRPVDLAVA

SEQ ID NO: 1480777 - protein, 26 aa, Mycobacterium tuberculosis
CGARLSVVVAESWRASALAEMIQEAG

SEQ ID NO: 1480778 - protein, 24 aa, Mycobacterium tuberculosis
CGDACPYFPGVSYRNWKLPDPAGQ

SEQ ID NO: 1480779 - protein, 29 aa, Mycobacterium tuberculosis
CGFDTPYPPARLEKLWLPGPDRLLDCVER

SEQ ID NO: 1480780 - protein, 25 aa, Mycobacterium tuberculosis
CGGNRRAPGEFWYGNCGNGRARRTP

SEQ ID NO: 1480781 - protein, 23 aa, Mycobacterium tuberculosis
CGHGSRKWPMCSVSSRPSTCRNW

SEQ ID NO: 1480782 - protein, 19 aa, Mycobacterium tuberculosis
CGHVFDAVLAVAVKGGKDL

SEQ ID NO: 1480783 - protein, 20 aa, Mycobacterium tuberculosis
CGKTGFVRALCRANRRRRRT

SEQ ID NO: 1480784 - protein, 19 aa, Mycobacterium tuberculosis
CGKYLVVMHDLWLPLLTAA

SEQ ID NO: 1480785 - protein, 17 aa, Mycobacterium tuberculosis
CGPEGVLNQADKVWSSA

SEQ ID NO: 1480786 - protein, 20 aa, Mycobacterium tuberculosis
CGPPLVFQLLWYPTTMADLS

SEQ ID NO: 1480787 - protein, 26 aa, Mycobacterium tuberculosis
CGPPPPTGPTTVGWIPPANVNDGTRR

SEQ ID NO: 1480788 - protein, 22 aa, Mycobacterium tuberculosis
CGPSRARYLMLRLLERAGEQRV

SEQ ID NO: 1480789 - protein, 23 aa, Mycobacterium tuberculosis
CGQCAACATDGRTPCEPGSAANK

SEQ ID NO: 1480790 - protein, 29 aa, Mycobacterium tuberculosis
CGQRWPKMRISGPAVRWVMTGWQRLHFRF

SEQ ID NO: 1480791 - protein, 33 aa, Mycobacterium tuberculosis; identical to SEQ ID NO: 87245

SEQ ID NO: 1480792 - protein, 20 aa, Mycobacterium tuberculosis
CGRCRACTTTLAGTHADVRR

SEQ ID NO: 1480793 - protein, 23 aa, Mycobacterium tuberculosis
CGRLCAVCGVLVQASADSAAAAG

SEQ ID NO: 1480794 - protein, 18 aa, Mycobacterium tuberculosis
CGRRRRLPGRRGRRTLPD

SEQ ID NO: 1480795 - protein, 27 aa, Mycobacterium tuberculosis
CGSGGAGGVAWLLYGNGGNGGAGGIGG

SEQ ID NO: 1480796 - protein, 20 aa, Mycobacterium tuberculosis
CGSPLRCARRSTTGTESSPS

SEQ ID NO: 1480797 - protein, 25 aa, Mycobacterium tuberculosis
CGTIRVGSFRGRWLDPRHAGPARAA

SEQ ID NO: 1480798 - protein, 25 aa, Mycobacterium tuberculosis
CGTIRVGSFRGRWLDPRHAGPATGA

SEQ ID NO: 1480799 - protein, 24 aa, Mycobacterium tuberculosis
CGTIRVGSFRGRWLDPRHVDQARL

SEQ ID NO: 1480800 - protein, 31 aa, Mycobacterium tuberculosis
CGTIRVGSFRGRWLDRACGSSHGRRRRRLNA

SEQ ID NO: 1480801 - protein, 19 aa, Mycobacterium tuberculosis
CGTYHSMMNFEVRVVTPND

SEQ ID NO: 1480802 - protein, 25 aa, Mycobacterium tuberculosis
CGVEPNMRWRTFCDEVLAVIDKLNV

SEQ ID NO: 1480803 - protein, 20 aa, Mycobacterium tuberculosis
CGVGKPAGKTAFVFAGQGSQ

SEQ ID NO: 1480804 - protein, 18 aa, Mycobacterium tuberculosis
CGWPERPSSSAVWRCLSG

SEQ ID NO: 1480805 - protein, 19 aa, Mycobacterium tuberculosis
CGYVKGVAVRADWRGQRLV

SEQ ID NO: 1480806 - protein, 21 aa, Mycobacterium tuberculosis
CHPELRIDFPPLRVANDDVAH

SEQ ID NO: 1480807 - protein, 19 aa, Mycobacterium tuberculosis
CHREQWPVAGRMMGRLGWY

SEQ ID NO: 1480808 - protein, 21 aa, Mycobacterium tuberculosis
CHRLPARLGTAAGQARGPGGR

SEQ ID NO: 1480809 - protein, 25 aa, Mycobacterium tuberculosis
CHTMSLDWVAWRGLGLAADAQLVSE

SEQ ID NO: 1480810 - protein, 18 aa, Mycobacterium tuberculosis
CHTRCCSCPGSPSRYRRS

SEQ ID NO: 1480811 - protein, 22 aa, Mycobacterium tuberculosis
CHVAAFEFFDGVPARLVCDNLR

SEQ ID NO: 1480812 - protein, 21 aa, Mycobacterium tuberculosis
CIAAKRFIVHADIYDDFVDKF

SEQ ID NO: 1480813 - protein, 18 aa, Mycobacterium tuberculosis
CIEECPVDCIYEGARMLY

SEQ ID NO: 1480814 - protein, 23 aa, Mycobacterium tuberculosis
CIGGVFRECRPENVIAIDAVPSF

SEQ ID NO: 1480815 - protein, 21 aa, Mycobacterium tuberculosis
CISWCGYPKWVWQEKGRPPRR

SEQ ID NO: 1480816 - protein, 17 aa, Mycobacterium tuberculosis
CIVKDAPIRDWVKLAVT

SEQ ID NO: 1480817 - protein, 19 aa, Mycobacterium tuberculosis
CKPLRQILFRDDYGPIASE

SEQ ID NO: 1480818 - protein, 17 aa, Mycobacterium tuberculosis
CLARRRLDSSLLVPWPR

SEQ ID NO: 1480819 - protein, 19 aa, Mycobacterium tuberculosis
CLGATFAMVEMRVVLREIL

SEQ ID NO: 1480820 - protein, 26 aa, Mycobacterium tuberculosis
CLMAKFEIPEGWMVQAFRFTLDPTAE

SEQ ID NO: 1480821 - protein, 18 aa, Mycobacterium tuberculosis
CLPYYVSLFEQMKNEARA

SEQ ID NO: 1480822 - protein, 19 aa, Mycobacterium tuberculosis
CLQCGRRVTGVVGKRIGRQ

SEQ ID NO: 1480823 - protein, 22 aa, Mycobacterium tuberculosis
CLRHRWLGMVWPRSWRWRRPRL

SEQ ID NO: 1480824 - protein, 18 aa, Mycobacterium tuberculosis
CLVSIQFRLLPDGKDYVF

SEQ ID NO: 1480825 - protein, 22 aa, Mycobacterium tuberculosis
CLWWRPALRVRGSPISTACATW

SEQ ID NO: 1480826 - protein, 20 aa, Mycobacterium tuberculosis
CMGGRMSVVVAGRLPDRVAA

SEQ ID NO: 1480827 - protein, 17 aa, Mycobacterium tuberculosis
CMRGHWPTGPLIDAVAG

SEQ ID NO: 1480828 - protein, 19 aa, Mycobacterium tuberculosis
CNAMSRLGGVTLSKAGLRL

SEQ ID NO: 1480829 - protein, 23 aa, Mycobacterium tuberculosis
CNELCFVSGVLPTAPVSAVADPR

SEQ ID NO: 1480830 - protein, 21 aa, Mycobacterium tuberculosis
CNHPARLVPMLSKPETFAGAP

SEQ ID NO: 1480831 - protein, 21 aa, Mycobacterium tuberculosis
CNPYLTFAVLLAAGLRGVEKG

SEQ ID NO: 1480832 - protein, 17 aa, Mycobacterium tuberculosis
CPAAWPTPKSAAALAAA

SEQ ID NO: 1480833 - protein, 19 aa, Mycobacterium tuberculosis
CPAEKRRDMLFDHVGALAA

SEQ ID NO: 1480834 - protein, 18 aa, Mycobacterium tuberculosis
CPAFHAFPASRWRRYDKL

SEQ ID NO: 1480835 - protein, 24 aa, Mycobacterium tuberculosis
CPCLTVCANWRCQHKLLVTLEDNG

SEQ ID NO: 1480836 - protein, 18 aa, Mycobacterium tuberculosis
CPDPGIADTAAILLAAEQ

SEQ ID NO: 1480837 - protein, 21 aa, Mycobacterium tuberculosis
CPDRRRVVVHPAVIGLAGHRG

SEQ ID NO: 1480838 - protein, 23 aa, Mycobacterium tuberculosis
CPDTRARGRPGFDPPGGPALCDP

SEQ ID NO: 1480839 - protein, 18 aa, Mycobacterium tuberculosis
CPFIPGRVPEDLLAMVVA

SEQ ID NO: 1480840 - protein, 21 aa, Mycobacterium tuberculosis
CPGLPAGGGCPVRGRAFSPWH

SEQ ID NO: 1480841 - protein, 19 aa, Mycobacterium tuberculosis
CPGSPSRYRRSTVLAMPML

SEQ ID NO: 1480842 - protein, 28 aa, Mycobacterium tuberculosis
CPGVVRTRLAEALWKDHEDPLAATIALG

SEQ ID NO: 1480843 - protein, 17 aa, Mycobacterium tuberculosis
CPLTRRCSDDGAAIPRC

SEQ ID NO: 1480844 - protein, 24 aa, Mycobacterium tuberculosis
CPNHHSKMAFAMANFEPGSNEPTH

SEQ ID NO: 1480845 - protein, 26 aa, Mycobacterium tuberculosis
CPPAPPRPPCPPAPSSSAPRPPAPPA

SEQ ID NO: 1480846 - protein, 17 aa, Mycobacterium tuberculosis
CPPQHPWSGSLSKNRHQ

SEQ ID NO: 1480847 - protein, 21 aa, Mycobacterium tuberculosis
CPSFDHAASLGFTLTDQTPAQ

SEQ ID NO: 1480848 - protein, 18 aa, Mycobacterium tuberculosis
CPVIEACRSHALEVGEPY

SEQ ID NO: 1480849 - protein, 19 aa, Mycobacterium tuberculosis
CPVNTLPVPGLTIADLGEL

SEQ ID NO: 1480850 - protein, 20 aa, Mycobacterium tuberculosis
CPWMPSGEENSGAQQYQPGG

SEQ ID NO: 1480851 - protein, 19 aa, Mycobacterium tuberculosis
CPYCGSPYSFLPQLNPGHI

SEQ ID NO: 1480852 - protein, 17 aa, Mycobacterium tuberculosis
CQMSFVVTIPEALAAVA

SEQ ID NO: 1480853 - protein, 36 aa, Mycobacterium tuberculosis
CQPGWPGWPGWPGAPSGPNWPRLPSPPRPAGPTPGE

SEQ ID NO: 1480854 - protein, 19 aa, Mycobacterium tuberculosis
CQSGICGTCVATCTAGRYQ

SEQ ID NO: 1480855 - protein, 17 aa, Mycobacterium tuberculosis
CQTERGIVVELAERAPD

SEQ ID NO: 1480856 - protein, 25 aa, Mycobacterium tuberculosis
CQVAAMALRIGVAVAHRDRDYEAIR

SEQ ID NO: 1480857 - protein, 21 aa, Mycobacterium tuberculosis
CRAKHRLPGLQFVQGDAQNLP

SEQ ID NO: 1480858 - protein, 19 aa, Mycobacterium tuberculosis
CRAVRVVPFDPHLEEGAEI

SEQ ID NO: 1480859 - protein, 25 aa, Mycobacterium tuberculosis
CRAVVGRVGLVRALRDRGLQSAAQS

SEQ ID NO: 1480860 - protein, 18 aa, Mycobacterium tuberculosis
CRDRETFGRPLISRQSVQ

SEQ ID NO: 1480861 - protein, 25 aa, Mycobacterium tuberculosis
CRDTARVPLGSVVMRLARWKEAGRP

SEQ ID NO: 1480862 - protein, 26 aa, Mycobacterium tuberculosis
CRDTMKLRLGTSVLCNSYRHPSVLAK

SEQ ID NO: 1480863 - protein, 18 aa, Mycobacterium tuberculosis
CRFCRATSVIPICGSPIP

SEQ ID NO: 1480864 - protein, 42 aa, Mycobacterium tuberculosis
CRFGTRLRWWHCAAGCWCGWAVPAAWSRWPVASRRPRSWRPN

SEQ ID NO: 1480865 - protein, 17 aa, Mycobacterium tuberculosis
CRGAQGVDVANHVDRQR

SEQ ID NO: 1480866 - protein, 19 aa, Mycobacterium tuberculosis
CRGRPEWIAAGQFAQRYEQ

SEQ ID NO: 1480867 - protein, 20 aa, Mycobacterium tuberculosis
CRLIRRHGRVMVICSDPASQ

SEQ ID NO: 1480868 - protein, 19 aa, Mycobacterium tuberculosis
CRMTRTFWQPGFRTRSTCA

SEQ ID NO: 1480869 - protein, 18 aa, Mycobacterium tuberculosis
CRNGFQWSAHFDPRYGSE

SEQ ID NO: 1480870 - protein, 26 aa, Mycobacterium tuberculosis
CRNGRRSRAPAGWRGGVRRRCLESTG

SEQ ID NO: 1480871 - protein, 21 aa, Mycobacterium tuberculosis
CRNRPSPAPTFIATRHADGDT

SEQ ID NO: 1480872 - protein, 18 aa, Mycobacterium tuberculosis
CRNSPRKCRCTPRSPNHA

SEQ ID NO: 1480873 - protein, 22 aa, Mycobacterium tuberculosis
CRNYVRRYACRSRRGTRSSRRL

SEQ ID NO: 1480874 - protein, 17 aa, Mycobacterium tuberculosis
CRPELIERTFQACSGAP

SEQ ID NO: 1480875 - protein, 17 aa, Mycobacterium tuberculosis
CRPHSGTDLLAGIGGTP

SEQ ID NO: 1480876 - protein, 33 aa, Mycobacterium tuberculosis
CRPPAVLRCARMRFCGKAARWSYLGRRRDPAST

SEQ ID NO: 1480877 - protein, 18 aa, Mycobacterium tuberculosis
CRQAAAWHPGCPAASAPI

SEQ ID NO: 1480878 - protein, 19 aa, Mycobacterium tuberculosis
CRQQITATILLSWSQPTAQ

SEQ ID NO: 1480879 - protein, 22 aa, Mycobacterium tuberculosis
CRQQKGHVFEGGLWSGGAANAA

SEQ ID NO: 1480880 - protein, 26 aa, Mycobacterium tuberculosis
CRQQKGHVFEGGLWSGGAANAANGAL

SEQ ID NO: 1480881 - protein, 27 aa, Mycobacterium tuberculosis
CRQQKGHVFEGGLWSGGAANAANGALG

SEQ ID NO: 1480882 - protein, 17 aa, Mycobacterium tuberculosis
CRRRGCRADGPAHRRRA

SEQ ID NO: 1480883 - protein, 18 aa, Mycobacterium tuberculosis
CRRTETMSGPDGARPDGR

SEQ ID NO: 1480884 - protein, 19 aa, Mycobacterium tuberculosis
CRRWFGMTPRQYRAYGGVS

SEQ ID NO: 1480885 - protein, 17 aa, Mycobacterium tuberculosis
CRSPRLVTLTVVPRCCA

SEQ ID NO: 1480886 - protein, 27 aa, Mycobacterium tuberculosis
CRSRARLLGLRLRRLRYLRTAAARRPQ

SEQ ID NO: 1480887 - protein, 39 aa, Mycobacterium tuberculosis
CRTDRRAGRGWRRWKTPSRSIGWWLRIVANPGMSTTVKT

SEQ ID NO: 1480888 - protein, 25 aa, Mycobacterium tuberculosis
CRTTPPTWRCCGSWFGKDSPPTWRG

SEQ ID NO: 1480889 - protein, 19 aa, Mycobacterium tuberculosis
CSAIQAGSRLGYQESAELC

SEQ ID NO: 1480890 - protein, 18 aa, Mycobacterium tuberculosis
CSAMARSYLGPEFDIHCG

SEQ ID NO: 1480891 - protein, 34 aa, Mycobacterium tuberculosis
CSECRHVSAKWVGRCLECGRWGTVDEVAVLSAVG

SEQ ID NO: 1480892 - protein, 22 aa, Mycobacterium tuberculosis
CSHGSPFRSGPIRTLADLEDMA

SEQ ID NO: 1480893 - protein, 27 aa, Mycobacterium tuberculosis
CSKGSFYLRPIVRPVILVAGGTGLSAI

SEQ ID NO: 1480894 - protein, 19 aa, Mycobacterium tuberculosis
CSLDEVVFLTSRDAYEPHY

SEQ ID NO: 1480895 - protein, 23 aa, Mycobacterium tuberculosis
CSPSPSCRAMFSPTVSAPSTAPP

SEQ ID NO: 1480896 - protein, 17 aa, Mycobacterium tuberculosis
CSSCWGRTLGWDTTPWC

SEQ ID NO: 1480897 - protein, 17 aa, Mycobacterium tuberculosis
CSTEGGFLTSWQPDEFD

SEQ ID NO: 1480898 - protein, 27 aa, Mycobacterium tuberculosis
CSTLAPTTSVCSTRAPATSASATRAPA

SEQ ID NO: 1480899 - protein, 21 aa, Mycobacterium tuberculosis
CTAPCRGTPTSGWTPKMPSTY

SEQ ID NO: 1480900 - protein, 17 aa, Mycobacterium tuberculosis
CTGEVRWVSARDLRFGY

SEQ ID NO: 1480901 - protein, 18 aa, Mycobacterium tuberculosis
CTGEVRWVSARDLRFGYR

SEQ ID NO: 1480902 - protein, 25 aa, Mycobacterium tuberculosis
CTGWATGEACPPRWPTASSTTPTYS

SEQ ID NO: 1480903 - protein, 17 aa, Mycobacterium tuberculosis
CTLRRGVPAASRKRLHR

SEQ ID NO: 1480904 - protein, 18 aa, Mycobacterium tuberculosis
CTLRRGVPAASRNACTGW

SEQ ID NO: 1480905 - protein, 20 aa, Mycobacterium tuberculosis
CTPATRWSISGSRCSTAKPT

SEQ ID NO: 1480906 - protein, 26 aa, Mycobacterium tuberculosis
CTPIPHPDCDLDWMRLMHSDLGNFQR

SEQ ID NO: 1480907 - protein, 20 aa, Mycobacterium tuberculosis
CTQWRQCGSGAAGQAGGAGG

SEQ ID NO: 1480908 - protein, 17 aa, Mycobacterium tuberculosis
CTTRAYVMDSWLRLVPD

SEQ ID NO: 1480909 - protein, 19 aa, Mycobacterium tuberculosis
CTTSCPVFWHEGSYFGPAA

SEQ ID NO: 1480910 - protein, 19 aa, Mycobacterium tuberculosis
CVDLRRTFVPSKGFGLLPP

SEQ ID NO: 1480911 - protein, 20 aa, Mycobacterium tuberculosis
CVDLRRTFVPSKGFGLLPPI

SEQ ID NO: 1480912 - protein, 28 aa, Mycobacterium tuberculosis
CVGRQCWWPAEISLTIGGTRWGDPRQRL

SEQ ID NO: 1480913 - protein, 28 aa, Mycobacterium tuberculosis
CVHDPLIMRRALEICHRFGRADRPARRG

SEQ ID NO: 1480914 - protein, 18 aa, Mycobacterium tuberculosis
CVIGAPVLFGRANVVFTR

SEQ ID NO: 1480915 - protein, 24 aa, Mycobacterium tuberculosis
CVLERFRAIKPWLVGGRVRAPFWE

SEQ ID NO: 1480916 - protein, 18 aa, Mycobacterium tuberculosis
CVLGECLTGAPPYRADSV

SEQ ID NO: 1480917 - protein, 25 aa, Mycobacterium tuberculosis
CVNQTRILAPRSRYDEIVAAVTNFV

SEQ ID NO: 1480918 - protein, 26 aa, Mycobacterium tuberculosis
CVRGDVGRGCGRHVGVLLRGIGDCRA

SEQ ID NO: 1480919 - protein, 21 aa, Mycobacterium tuberculosis
CVSGRCGWSQRSAVSTIRSGQ

SEQ ID NO: 1480920 - protein, 26 aa, Mycobacterium tuberculosis
CVWVARLAVDFRQRFKKDVVIDMLCY

SEQ ID NO: 1480921 - protein, 24 aa, Mycobacterium tuberculosis
CWHAGRGSYPWLPTDNANWHMIGV

SEQ ID NO: 1480922 - protein, 26 aa, Mycobacterium tuberculosis
CWLGRRGRPGIAWPVAEAVVRGPLQI

SEQ ID NO: 1480923 - protein, 17 aa, Mycobacterium tuberculosis
CWPRCGSSTGMSLVSAG

SEQ ID NO: 1480924 - protein, 21 aa, Mycobacterium tuberculosis
CWRADGQLEFLGRTDDQVKIR

SEQ ID NO: 1480925 - protein, 18 aa, Mycobacterium tuberculosis
CWWMHHFQMPSRVETWVP

SEQ ID NO: 1480926 - protein, 21 aa, Mycobacterium tuberculosis
CYEEAHRACLIIGRRDAVVHD

SEQ ID NO: 1480927 - protein, 18 aa, Mycobacterium tuberculosis
CYGAAGVAMGTRFLLTSD

SEQ ID NO: 1480928 - protein, 18 aa, Mycobacterium tuberculosis
CYLPLTYDHRLIDGADAG

SEQ ID NO: 1480929 - protein, 22 aa, Mycobacterium tuberculosis
CYSGLELRDDRLVLSPQWPEAL

SEQ ID NO: 1480930 - protein, 17 aa, Mycobacterium tuberculosis
CYVRNQVPFFVDYVRRY

SEQ ID NO: 1480931 - protein, 17 aa, Mycobacterium tuberculosis
CYYPCLDTTRGRSFGAY

SEQ ID NO: 1480932 - protein, 18 aa, Mycobacterium tuberculosis
DAAAAWDGLADELGSAAA

SEQ ID NO: 1480933 - protein, 17 aa, Mycobacterium tuberculosis
DAAAVGFDVTVCIHPSQ

SEQ ID NO: 1480934 - protein, 18 aa, Mycobacterium tuberculosis
DAAGAWRTAAVELARALV

SEQ ID NO: 1480935 - protein, 18 aa, Mycobacterium tuberculosis
DAAGDLRRSLVRPDRVRL

SEQ ID NO: 1480936 - protein, 21 aa, Mycobacterium tuberculosis
DAAGVPVVFLTAYYALRVLAQ

SEQ ID NO: 1480937 - protein, 22 aa, Mycobacterium tuberculosis
DAALRVLAPLGLVFDENSPWLN

SEQ ID NO: 1480938 - protein, 18 aa, Mycobacterium tuberculosis
DAALRVNRSLVLPDPPRH

SEQ ID NO: 1480939 - protein, 29 aa, Mycobacterium tuberculosis
DAALSAAGYLCWRGKDLATPRGWITALRA

SEQ ID NO: 1480940 - protein, 25 aa, Mycobacterium tuberculosis
DAAMSFCVYCGAELADPTRCGACGA

SEQ ID NO: 1480941 - protein, 27 aa, Mycobacterium tuberculosis
DAAQPIWWVVRAIEFSKDFETFVQELF

SEQ ID NO: 1480942 - protein, 17 aa, Mycobacterium tuberculosis
DAARALDNFATRWRHGG

SEQ ID NO: 1480943 - protein, 20 aa, Mycobacterium tuberculosis
DAATRAGFEAGFEADPVLLE

SEQ ID NO: 1480944 - protein, 17 aa, Mycobacterium tuberculosis
DAAVHFVQRHCETGNSV

SEQ ID NO: 1480945 - protein, 23 aa, Mycobacterium tuberculosis
DAAVLPSHYEPFGLVAQEAAAAG

SEQ ID NO: 1480946 - protein, 17 aa, Mycobacterium tuberculosis
DAAWLLRVGDRATAGRC

SEQ ID NO: 1480947 - protein, 17 aa, Mycobacterium tuberculosis
DACAHALLDAISRLPQI

SEQ ID NO: 1480948 - protein, 20 aa, Mycobacterium tuberculosis
DADDAPAWWDGTVVEHIRVS

SEQ ID NO: 1480949 - protein, 17 aa, Mycobacterium tuberculosis
DADFKRPARTGGSTTPT

SEQ ID NO: 1480950 - protein, 23 aa, Mycobacterium tuberculosis
DAEHVRRLLARGDRAQALDGLVV

SEQ ID NO: 1480951 - protein, 28 aa, Mycobacterium tuberculosis
DAELRIAQAQLVGWLEGLFHGIQTALFA

SEQ ID NO: 1480952 - protein, 26 aa, Mycobacterium tuberculosis
DAGADYRPACDVMLALVAQLDPGQRD

SEQ ID NO: 1480953 - protein, 17 aa, Mycobacterium tuberculosis
DAGCDIVTITQYLRPSA

SEQ ID NO: 1480954 - protein, 17 aa, Mycobacterium tuberculosis
DAGGFCGPRQTCCGRSP

SEQ ID NO: 1480955 - protein, 19 aa, Mycobacterium tuberculosis
DAGMEVCCGGILGMGETLQ

SEQ ID NO: 1480956 - protein, 17 aa, Mycobacterium tuberculosis
DAGPPTMAARCARNLAE

SEQ ID NO: 1480957 - protein, 18 aa, Mycobacterium tuberculosis
DAGRCQRGYFIESLGGAQ

SEQ ID NO: 1480958 - protein, 18 aa, Mycobacterium tuberculosis
DAGRFLTTIKHRLEEGAF

SEQ ID NO: 1480959 - protein, 19 aa, Mycobacterium tuberculosis
DAGRFLTTIKHRLEEGAFE

SEQ ID NO: 1480960 - protein, 23 aa, Mycobacterium tuberculosis
DAGSGRYMLRCRVGERIRVCDWL

SEQ ID NO: 1480961 - protein, 18 aa, Mycobacterium tuberculosis
DAHKVLAMASNRKYGLDL

SEQ ID NO: 1480962 - protein, 17 aa, Mycobacterium tuberculosis
DAIREDRYCRGTPVDGH

SEQ ID NO: 1480963 - protein, 24 aa, Mycobacterium tuberculosis
DAKESRGVHALRARGALIRIGHDA

SEQ ID NO: 1480964 - protein, 24 aa, Mycobacterium tuberculosis
DAKIGYPPTRVWGGAGGGPVGAPA

SEQ ID NO: 1480965 - protein, 30 aa, Mycobacterium tuberculosis; identical to SEQ ID NO: 94945

SEQ ID NO: 1480966 - protein, 18 aa, Mycobacterium tuberculosis
DALDRMREQAARIGRATL

SEQ ID NO: 1480967 - protein, 19 aa, Mycobacterium tuberculosis
DALFARARARGITPAMTLA

SEQ ID NO: 1480968 - protein, 18 aa, Mycobacterium tuberculosis
DALGIAVAALRAGSADTS

SEQ ID NO: 1480969 - protein, 17 aa, Mycobacterium tuberculosis
DALHAWLVDGRRALVTA

SEQ ID NO: 1480970 - protein, 23 aa, Mycobacterium tuberculosis
DALINRVVPIPGLRSTEAQWART

SEQ ID NO: 1480971 - protein, 24 aa, Mycobacterium tuberculosis
DALINRVVPIPGLRSTEAQWARTL

SEQ ID NO: 1480972 - protein, 19 aa, Mycobacterium tuberculosis
DALRCFASLFGDEALDPLD

SEQ ID NO: 1480973 - protein, 20 aa, Mycobacterium tuberculosis
DALRCFASLFGDEALDPLDY

SEQ ID NO: 1480974 - protein, 20 aa, Mycobacterium tuberculosis
DALRVFERFYRADSSRARAS

SEQ ID NO: 1480975 - protein, 19 aa, Mycobacterium tuberculosis
DALSDFVRRCTWLEHHPEQ

SEQ ID NO: 1480976 - protein, 27 aa, Mycobacterium tuberculosis
DALSGRYRWPGGLVLEPVSTVSGILGY

SEQ ID NO: 1480977 - protein, 20 aa, Mycobacterium tuberculosis
DALSRPGSWLASNVPGAGFL

SEQ ID NO: 1480978 - protein, 29 aa, Mycobacterium tuberculosis
DALVARRLLPRVPRCIPLAARLAPGTIGC

SEQ ID NO: 1480979 - protein, 19 aa, Mycobacterium tuberculosis
DAMCRRLRSQGVRLVYETA

SEQ ID NO: 1480980 - protein, 24 aa, Mycobacterium tuberculosis
DAMGHPRWWFDLLTTEPLAFSSLD

SEQ ID NO: 1480981 - protein, 19 aa, Mycobacterium tuberculosis
DAMPTFRQVFLAGASGMAL

SEQ ID NO: 1480982 - protein, 22 aa, Mycobacterium tuberculosis
DAMPTFRQVFLAGASGMALERR

SEQ ID NO: 1480983 - protein, 26 aa, Mycobacterium tuberculosis
DAMTSGRRWRVWRERRLNRQRRRRGR

SEQ ID NO: 1480984 - protein, 20 aa, Mycobacterium tuberculosis
DANIGSIMGIGFPPWTGGSA

SEQ ID NO: 1480985 - protein, 17 aa, Mycobacterium tuberculosis
DAPCEPVPIRTPLAETV

SEQ ID NO: 1480986 - protein, 22 aa, Mycobacterium tuberculosis
DAPDCGRVAAPIVVDHDNHRPA

SEQ ID NO: 1480987 - protein, 23 aa, Mycobacterium tuberculosis
DAPLCSGPGCPNKLLSTEAKARR

SEQ ID NO: 1480988 - protein, 18 aa, Mycobacterium tuberculosis
DAPLIGWAATAGPAVSLL

SEQ ID NO: 1480989 - protein, 22 aa, Mycobacterium tuberculosis
DAPLPAWTHARLFIDDDGQEQR

SEQ ID NO: 1480990 - protein, 19 aa, Mycobacterium tuberculosis
DAPNDWRFAPSGRSERGNA

SEQ ID NO: 1480991 - protein, 19 aa, Mycobacterium tuberculosis
DAPWKDIEAQGWIAPAECV

SEQ ID NO: 1480992 - protein, 23 aa, Mycobacterium tuberculosis
DAQRRVHRVWADIRNEVLGGQYL

SEQ ID NO: 1480993 - protein, 25 aa, Mycobacterium tuberculosis
DAQSGSIGLGFAIPVDQAKRIADEL

SEQ ID NO: 1480994 - protein, 17 aa, Mycobacterium tuberculosis
DARAVLRDVLINELQPG

SEQ ID NO: 1480995 - protein, 21 aa, Mycobacterium tuberculosis
DARFDGWFVVAVLTTGVYCRP

SEQ ID NO: 1480996 - protein, 20 aa, Mycobacterium tuberculosis
DARLAQGHPVAWIHGTALRT

SEQ ID NO: 1480997 - protein, 21 aa, Mycobacterium tuberculosis
DARLAQGHPVAWIHGTALRTE

SEQ ID NO: 1480998 - protein, 24 aa, Mycobacterium tuberculosis
DARLVVKLPNRWPLTDAAGVPVVF

SEQ ID NO: 1480999 - protein, 21 aa, Mycobacterium tuberculosis
DARSRSAPNSMTFPPTPPVPG

SEQ ID NO: 1481000 - protein, 18 aa, Mycobacterium tuberculosis
DARSWWGACITRSRVCGR

SEQ ID NO: 1481001 - protein, 24 aa, Mycobacterium tuberculosis
DARVGRPLFSTQLANAVITRKRAE

SEQ ID NO: 1481002 - protein, 17 aa, Mycobacterium tuberculosis
DASAAVAQLAPWQQVLR

SEQ ID NO: 1481003 - protein, 17 aa, Mycobacterium tuberculosis
DASKHGPLTGGDGGVGG

SEQ ID NO: 1481004 - protein, 23 aa, Mycobacterium tuberculosis
DASLRLLPRGGRFIEMGKTEFGT

SEQ ID NO: 1481005 - protein, 21 aa, Mycobacterium tuberculosis
DASPAYLGFNLFQHAIARAVI

SEQ ID NO: 1481006 - protein, 25 aa, Mycobacterium tuberculosis
DASVRCARLYRAAVHAGAKGLTVRL

SEQ ID NO: 1481007 - protein, 17 aa, Mycobacterium tuberculosis
DATGRLRGVEGVWVADA

SEQ ID NO: 1481008 - protein, 25 aa, Mycobacterium tuberculosis
DATMRALTGRSWRAGLRQRAAVRVE

SEQ ID NO: 1481009 - protein, 18 aa, Mycobacterium tuberculosis
DATNGWHRMVALTIRARV

SEQ ID NO: 1481010 - protein, 18 aa, Mycobacterium tuberculosis
DAVAALTWQLPAEPGAVP

SEQ ID NO: 1481011 - protein, 17 aa, Mycobacterium tuberculosis
DAVDLISAVDIRYASAD

SEQ ID NO: 1481012 - protein, 18 aa, Mycobacterium tuberculosis
DAVGKLYVQRHFPPDAKS

SEQ ID NO: 1481013 - protein, 24 aa, Mycobacterium tuberculosis
DAVGTGLRVLGPIHTVGAGIQANT

SEQ ID NO: 1481014 - protein, 17 aa, Mycobacterium tuberculosis
DAVILCIGGCGRVFPFT

SEQ ID NO: 1481015 - protein, 36 aa, Mycobacterium tuberculosis
DAVNRPTPDRVRELVVAWGKLYPQFGAVAALNLVKC

SEQ ID NO: 1481016 - protein, 23 aa, Mycobacterium tuberculosis
DAVPRMRGMLTLFEGVATGAADG

SEQ ID NO: 1481017 - protein, 25 aa, Mycobacterium tuberculosis
DAVSDFPADRGWDVDGLFDPDPDAC

SEQ ID NO: 1481018 - protein, 26 aa, Mycobacterium tuberculosis
DAVSEFPADRGWDVAGLFDPDPDAVG

SEQ ID NO: 1481019 - protein, 22 aa, Mycobacterium tuberculosis
DAVTGMAGLLAWSQAPTRALGR

SEQ ID NO: 1481020 - protein, 18 aa, Mycobacterium tuberculosis
DAVWQHPDLLPATDDLDD

SEQ ID NO: 1481021 - protein, 23 aa, Mycobacterium tuberculosis
DAYIDYRALGGIDGRYPKIKQWL

SEQ ID NO: 1481022 - protein, 25 aa, Mycobacterium tuberculosis
DAYKTGRGSIRMRGVVEVEEDSRGR

SEQ ID NO: 1481023 - protein, 20 aa, Mycobacterium tuberculosis
DAYLSPVLRRYINQVADQMR

SEQ ID NO: 1481024 - protein, 19 aa, Mycobacterium tuberculosis
DAYRSIYVRKRLRCGNRHP

SEQ ID NO: 1481025 - protein, 29 aa, Mycobacterium tuberculosis
DAYTNPGTLMWWIARSLELLQDFQEFAKL

SEQ ID NO: 1481026 - protein, 17 aa, Mycobacterium tuberculosis
DCAQLRAAASVLMEALR

SEQ ID NO: 1481027 - protein, 19 aa, Mycobacterium tuberculosis
DCGEQFGVASWTPQGEFEF

SEQ ID NO: 1481028 - protein, 18 aa, Mycobacterium tuberculosis
DCGRSRRVLIELNAATTA

SEQ ID NO: 1481029 - protein, 20 aa, Mycobacterium tuberculosis
DCHDGYRWLRLLGYEPEQIV

SEQ ID NO: 1481030 - protein, 17 aa, Mycobacterium tuberculosis
DCHLIALAARYGGRLVT

SEQ ID NO: 1481031 - protein, 27 aa, Mycobacterium tuberculosis
DCRTPTIAAVQGWCIGDAVDLISAVDI

SEQ ID NO: 1481032 - protein, 26 aa, Mycobacterium tuberculosis
DCRTPTIAAVQGWCIGGAVDLISAVD

SEQ ID NO: 1481033 - protein, 23 aa, Mycobacterium tuberculosis
DCTGLLPLASVAAMQGRIAMYHA

SEQ ID NO: 1481034 - protein, 24 aa, Mycobacterium tuberculosis
DDAARMWARLRIHLAESGRRVRIN

SEQ ID NO: 1481035 - protein, 25 aa, Mycobacterium tuberculosis
DDAIDFRAAAGIYRAARRAGETVRS

SEQ ID NO: 1481036 - protein, 22 aa, Mycobacterium tuberculosis
DDAKEGAMRWGYHPLTGESGAR

SEQ ID NO: 1481037 - protein, 20 aa, Mycobacterium tuberculosis
DDARFGIPLGKLGVTTGFTE

SEQ ID NO: 1481038 - protein, 25 aa, Mycobacterium tuberculosis
DDELAGSAHFVWVRDTLRLGGKFPL

SEQ ID NO: 1481039 - protein, 37 aa, Mycobacterium tuberculosis
DDELAGSAHFVWVRDTLRLGGKFPLKAGMLTSLGFGH

SEQ ID NO: 1481040 - protein, 44 aa, Mycobacterium tuberculosis
DDELAGSAHFVWVRDTLRLGGKFPLKAGMLTSLGFGHVSGLVAL

SEQ ID NO: 1481041 - protein, 18 aa, Mycobacterium tuberculosis
DDGFKKKKIVDVLRESLY

SEQ ID NO: 1481042 - protein, 21 aa, Mycobacterium tuberculosis
DDGNGGLPFIGSTNAGNGGSA

SEQ ID NO: 1481043 - protein, 27 aa, Mycobacterium tuberculosis
DDGRITLWRDYFDVYDMFKGLLRGLVA

SEQ ID NO: 1481044 - protein, 17 aa, Mycobacterium tuberculosis
DDHSAWRLLEGLDDIAL

SEQ ID NO: 1481045 - protein, 24 aa, Mycobacterium tuberculosis
DDIAEVLALLGVRPVWDDASRRVI

SEQ ID NO: 1481046 - protein, 22 aa, Mycobacterium tuberculosis
DDIAQRGWPVFCVSTATRENLQ

SEQ ID NO: 1481047 - protein, 25 aa, Mycobacterium tuberculosis
DDIPANVMPIDWYLHVRHAVGGEIA

SEQ ID NO: 1481048 - protein, 25 aa, Mycobacterium tuberculosis
DDKWTLCQILYWRGVGTCISGDPNA

SEQ ID NO: 1481049 - protein, 25 aa, Mycobacterium tuberculosis
DDLGALSSWYVWAALGLYPSTPGTT

SEQ ID NO: 1481050 - protein, 25 aa, Mycobacterium tuberculosis
DDLLRLGELICREVGQHASTIRAVL

SEQ ID NO: 1481051 - protein, 17 aa, Mycobacterium tuberculosis
DDLPVAWKHRSERYTEK

SEQ ID NO: 1481052 - protein, 18 aa, Mycobacterium tuberculosis
DDLRPRRHRSPASVPAHP

SEQ ID NO: 1481053 - protein, 18 aa, Mycobacterium tuberculosis
DDMSEEFCRWEERIRLDQ

SEQ ID NO: 1481054 - protein, 24 aa, Mycobacterium tuberculosis
DDPDGLPAFGGLCRPHHQPRPLRA

SEQ ID NO: 1481055 - protein, 31 aa, Mycobacterium tuberculosis
DDPDILALRARQMRNMWATLMVSQGTPMIAH

SEQ ID NO: 1481056 - protein, 18 aa, Mycobacterium tuberculosis
DDPESWTLATYQRHDRYR

SEQ ID NO: 1481057 - protein, 26 aa, Mycobacterium tuberculosis
DDPLAMYLFDLCTLPLNLAGHCGMSV

SEQ ID NO: 1481058 - protein, 25 aa, Mycobacterium tuberculosis
DDPNWFRFHQMFADFLHRRLERGGS

SEQ ID NO: 1481059 - protein, 27 aa, Mycobacterium tuberculosis
DDPNWFRLHQMFADFLHRRLERGGSHR

SEQ ID NO: 1481060 - protein, 18 aa, Mycobacterium tuberculosis
DDQKWVWGGAGVIEPDYT

SEQ ID NO: 1481061 - protein, 17 aa, Mycobacterium tuberculosis
DDRLLYLDRYWREEEQV

SEQ ID NO: 1481062 - protein, 29 aa, Mycobacterium tuberculosis
DDRRPLGTLRCWRHSDIGPARGIVVTPAL

SEQ ID NO: 1481063 - protein, 21 aa, Mycobacterium tuberculosis
DDSRLRWLRAGEVPTLGNWFR

SEQ ID NO: 1481064 - protein, 22 aa, Mycobacterium tuberculosis
DDSRRLLQMVGRDLGLDIKRYS

SEQ ID NO: 1481065 - protein, 26 aa, Mycobacterium tuberculosis
DDSRWRCGWPRFALAPKQQLIARLIE

SEQ ID NO: 1481066 - protein, 24 aa, Mycobacterium tuberculosis
DDVAQLLLRIGIFSWITHAPKLGG

SEQ ID NO: 1481067 - protein, 17 aa, Mycobacterium tuberculosis
DDVHGWLDLVLDGPLAS

SEQ ID NO: 1481068 - protein, 18 aa, Mycobacterium tuberculosis
DDVSAHPASIGFPPYHPP

SEQ ID NO: 1481069 - protein, 17 aa, Mycobacterium tuberculosis
DDVSVYLAIYPRRDGGS

SEQ ID NO: 1481070 - protein, 25 aa, Mycobacterium tuberculosis
DDVYDAAAAWARRFLDGPPHALAAA

SEQ ID NO: 1481071 - protein, 23 aa, Mycobacterium tuberculosis
DDYLPCLVSIQFRLLPDGKDYVF

SEQ ID NO: 1481072 - protein, 17 aa, Mycobacterium tuberculosis
DEAHCPRSRRHAVVYNN

SEQ ID NO: 1481073 - protein, 22 aa, Mycobacterium tuberculosis
DEAKTLCRACPRRWLCARDAVE

SEQ ID NO: 1481074 - protein, 29 aa, Mycobacterium tuberculosis
DEARPRAGILRAREFVMKDSYSFDIDAAG

SEQ ID NO: 1481075 - protein, 24 aa, Mycobacterium tuberculosis
DEATRPLVICDLGMPHDVDPAVAR

SEQ ID NO: 1481076 - protein, 23 aa, Mycobacterium tuberculosis
DEDELRSAVSFFAEDAHIFATTV

SEQ ID NO: 1481077 - protein, 25 aa, Mycobacterium tuberculosis
DEDGEKRIPLDVAEGDTVIYSKYGG

SEQ ID NO: 1481078 - protein, 23 aa, Mycobacterium tuberculosis
DEEERRMSVMNGREVARESRDAQ

SEQ ID NO: 1481079 - protein, 17 aa, Mycobacterium tuberculosis
DEFGLGLADPDQLGRRL

SEQ ID NO: 1481080 - protein, 22 aa, Mycobacterium tuberculosis
DEFHPELQFDKPYLLAMANAGP

SEQ ID NO: 1481081 - protein, 23 aa, Mycobacterium tuberculosis
DEFLRWLARSAFHRRCLGRAGRN

SEQ ID NO: 1481082 - protein, 18 aa, Mycobacterium tuberculosis
DEGFARPGARRSREDFEI

SEQ ID NO: 1481083 - protein, 18 aa, Mycobacterium tuberculosis
DEGGRRVGARIVVVTHLA

SEQ ID NO: 1481084 - protein, 19 aa, Mycobacterium tuberculosis
DEGGRRVGARIVVVTHLAT

SEQ ID NO: 1481085 - protein, 22 aa, Mycobacterium tuberculosis
DEGGRRVGARIVVVTHLATDAA

SEQ ID NO: 1481086 - protein, 26 aa, Mycobacterium tuberculosis
DEHGRWPRSVGLSVWGTSVMRTAGGR

SEQ ID NO: 1481087 - protein, 18 aa, Mycobacterium tuberculosis
DEIARCATYPVLAVQAWA

SEQ ID NO: 1481088 - protein, 20 aa, Mycobacterium tuberculosis
DEIFGPVVVGLTFDDEADAI

SEQ ID NO: 1481089 - protein, 21 aa, Mycobacterium tuberculosis
DEIGSGLAVFHPKGGIVRREL

SEQ ID NO: 1481090 - protein, 17 aa, Mycobacterium tuberculosis
DEILIARNDRYWGPPSK

SEQ ID NO: 1481091 - protein, 19 aa, Mycobacterium tuberculosis
DEIQIVVTILSLDPGDLYD

SEQ ID NO: 1481092 - protein, 23 aa, Mycobacterium tuberculosis
DEISVLQAPLFTAYGTLYQQVSA

SEQ ID NO: 1481093 - protein, 23 aa, Mycobacterium tuberculosis
DEKTGTMGPRLVYTETKLNSAFS

SEQ ID NO: 1481094 - protein, 22 aa, Mycobacterium tuberculosis
DEKWQCDGCSITHQRDDNAAIN

SEQ ID NO: 1481095 - protein, 23 aa, Mycobacterium tuberculosis
DELAAEVMRRFGLTTKRAAVDLA

SEQ ID NO: 1481096 - protein, 18 aa, Mycobacterium tuberculosis
DELAAGPASRVAILLPAH

SEQ ID NO: 1481097 - protein, 17 aa, Mycobacterium tuberculosis
DELALPFAWQGVSLHAT

SEQ ID NO: 1481098 - protein, 19 aa, Mycobacterium tuberculosis
DELALPFAWQGVSLHATGA

SEQ ID NO: 1481099 - protein, 24 aa, Mycobacterium tuberculosis
DELDFLRLAVFDALLVLQADTAPV

SEQ ID NO: 1481100 - protein, 17 aa, Mycobacterium tuberculosis
DELGLWERFAALPYSEV

SEQ ID NO: 1481101 - protein, 20 aa, Mycobacterium tuberculosis
DELLARVGLSRANLNYSGGG

SEQ ID NO: 1481102 - protein, 17 aa, Mycobacterium tuberculosis
DELRASLSDQVRQAKRA

SEQ ID NO: 1481103 - protein, 24 aa, Mycobacterium tuberculosis
DELRELAVFITHYVGFPLGSRLNS

SEQ ID NO: 1481104 - protein, 17 aa, Mycobacterium tuberculosis
DELSCAEATLAVLQHVL

SEQ ID NO: 1481105 - protein, 17 aa, Mycobacterium tuberculosis
DEMGARVAAEFEDGQYV

SEQ ID NO: 1481106 - protein, 19 aa, Mycobacterium tuberculosis
DEMRAIVQIAARRPTTGHW

SEQ ID NO: 1481107 - protein, 17 aa, Mycobacterium tuberculosis
DEPAAGVKITWTPIEPT

SEQ ID NO: 1481108 - protein, 18 aa, Mycobacterium tuberculosis
DEPIEFALRLSNAIAAEV

SEQ ID NO: 1481109 - protein, 17 aa, Mycobacterium tuberculosis
DEPLGAVARRLPLDCVI

SEQ ID NO: 1481110 - protein, 17 aa, Mycobacterium tuberculosis
DEPLKRKVASTLLESFL

SEQ ID NO: 1481111 - protein, 27 aa, Mycobacterium tuberculosis
DEQLELLVGLVCLQAAAVLGRPSAEDV

SEQ ID NO: 1481112 - protein, 21 aa, Mycobacterium tuberculosis
DERALFLGQWGLRGQRGGEGP

SEQ ID NO: 1481113 - protein, 25 aa, Mycobacterium tuberculosis
DERARAALQRWSLMRSDHPVTSVGT

SEQ ID NO: 1481114 - protein, 22 aa, Mycobacterium tuberculosis
DERDFPASAVRFFASARSQGRK

SEQ ID NO: 1481115 - protein, 23 aa, Mycobacterium tuberculosis
DERYRTKMIWWDRRTLANHAEPK

SEQ ID NO: 1481116 - protein, 25 aa, Mycobacterium tuberculosis
DETGYPTILGRDWEYTTKTSRIGSC

SEQ ID NO: 1481117 - protein, 22 aa, Mycobacterium tuberculosis
DETRKSFSIAGTRVVDAIKLSV

SEQ ID NO: 1481118 - protein, 17 aa, Mycobacterium tuberculosis
DEVKIQMEAAGMCRSDH

SEQ ID NO: 1481119 - protein, 27 aa, Mycobacterium tuberculosis
DEVSAAIAALFSAHGRPIRRSAQAAAF

SEQ ID NO: 1481120 - protein, 22 aa, Mycobacterium tuberculosis
DEVSAAIAALFSGHGQDYQALS

SEQ ID NO: 1481121 - protein, 23 aa, Mycobacterium tuberculosis
DEVSAAIATLFGSHAREYQAIST

SEQ ID NO: 1481122 - protein, 23 aa, Mycobacterium tuberculosis
DEVSAAIATLFGSYALGYQAIST

SEQ ID NO: 1481123 - protein, 22 aa, Mycobacterium tuberculosis
DEVSAAMAALFGAHAQEYQRLS

SEQ ID NO: 1481124 - protein, 21 aa, Mycobacterium tuberculosis
DEVSAAMAALFSGHAQAYQAL

SEQ ID NO: 1481125 - protein, 23 aa, Mycobacterium tuberculosis
DEVSAAVASLFSGHAQAYQTLGT

SEQ ID NO: 1481126 - protein, 29 aa, Mycobacterium tuberculosis
DEVSALTAAHFAAHAAMYQSVSARAAAIH

SEQ ID NO: 1481127 - protein, 23 aa, Mycobacterium tuberculosis
DEVSQAIARLFSDYATHYQSLNA

SEQ ID NO: 1481128 - protein, 22 aa, Mycobacterium tuberculosis
DEVSSAIATLFGSHARGVSGDQ

SEQ ID NO: 1481129 - protein, 23 aa, Mycobacterium tuberculosis
DEVSTAIAALFGSHGQHYQAISA

SEQ ID NO: 1481130 - protein, 27 aa, Mycobacterium tuberculosis
DEWCVISIRSDDEWRRATSVFGQPELV

SEQ ID NO: 1481131 - protein, 18 aa, Mycobacterium tuberculosis
DEWRAEVMPEDKLAAVRE

SEQ ID NO: 1481132 - protein, 23 aa, Mycobacterium tuberculosis
DEYFRRAAAAGARQVVILAAGLD

SEQ ID NO: 1481133 - protein, 24 aa, Mycobacterium tuberculosis
DEYFRRAAAAGARQVVILAAGLDS

SEQ ID NO: 1481134 - protein, 17 aa, Mycobacterium tuberculosis
DEYPVLPPIGLQAPQVP

SEQ ID NO: 1481135 - protein, 24 aa, Mycobacterium tuberculosis
DFEEGLRTTIDWYRDNESWWRPLK

SEQ ID NO: 1481136 - protein, 18 aa, Mycobacterium tuberculosis
DFFNMWRVRPAGLRVIGA

SEQ ID NO: 1481137 - protein, 25 aa, Mycobacterium tuberculosis
DFGKREVMMVHTLLWPDEIRDPDFP

SEQ ID NO: 1481138 - protein, 26 aa, Mycobacterium tuberculosis
DFGSAAYWRRHIRQAVRFADSVRFAQ

SEQ ID NO: 1481139 - protein, 22 aa, Mycobacterium tuberculosis
DFIRHRVGALLATDRDIATRVS

SEQ ID NO: 1481140 - protein, 24 aa, Mycobacterium tuberculosis
DFKQCPLLYRFRAIDRLPEATSAA

SEQ ID NO: 1481141 - protein, 22 aa, Mycobacterium tuberculosis
DFLASAGTIRWPSFDRSVDRLK

SEQ ID NO: 1481142 - protein, 18 aa, Mycobacterium tuberculosis
DFRASVWGTGSFTVNDFL

SEQ ID NO: 1481143 - protein, 24 aa, Mycobacterium tuberculosis
DFTGVPCIVDLATMREAIADLGGN

SEQ ID NO: 1481144 - protein, 21 aa, Mycobacterium tuberculosis
DFVEVHWSRWGEAYVTPVEPD

SEQ ID NO: 1481145 - protein, 26 aa, Mycobacterium tuberculosis
DFVTSLQLLLTFPFPNFGIKQAVRGD

SEQ ID NO: 1481146 - protein, 17 aa, Mycobacterium tuberculosis
DFYGTVFGWAFESAGPD

SEQ ID NO: 1481147 - protein, 23 aa, Mycobacterium tuberculosis
DGAACDRVADVAGPVGGRAGQGG

SEQ ID NO: 1481148 - protein, 18 aa, Mycobacterium tuberculosis
DGAAELFAGEGACVLRPG

SEQ ID NO: 1481149 - protein, 18 aa, Mycobacterium tuberculosis
DGAGGYGGSGGRGGLLLG

SEQ ID NO: 1481150 - protein, 32 aa, Mycobacterium tuberculosis
DGAGTYRRLVGRAWRGRLGSRIGNAHNGSVFL

SEQ ID NO: 1481151 - protein, 21 aa, Mycobacterium tuberculosis
DGAIGRGGWFIGTGGMATIGG

SEQ ID NO: 1481152 - protein, 24 aa, Mycobacterium tuberculosis
DGALARIRLPGGMITAAQLATLAS

SEQ ID NO: 1481153 - protein, 17 aa, Mycobacterium tuberculosis
DGALARRNVVLDTMIEN

SEQ ID NO: 1481154 - protein, 18 aa, Mycobacterium tuberculosis
DGAPIPVQFSCKGANVAP

SEQ ID NO: 1481155 - protein, 24 aa, Mycobacterium tuberculosis
DGCVQRGRRVPAMQGDRTDRGQDG

SEQ ID NO: 1481156 - protein, 17 aa, Mycobacterium tuberculosis
DGDGLPMSVQLVGRPYD

SEQ ID NO: 1481157 - protein, 25 aa, Mycobacterium tuberculosis
DGDHLRLSGAMALVLAAAGGVTSSS

SEQ ID NO: 1481158 - protein, 25 aa, Mycobacterium tuberculosis
DGEFQEMFAPGAFRRSIAERGHKVK

SEQ ID NO: 1481159 - protein, 20 aa, Mycobacterium tuberculosis
DGEIAEAAWFTRDEVRAALA

SEQ ID NO: 1481160 - protein, 25 aa, Mycobacterium tuberculosis
DGELPTDHPAVWNHPVVDPHTVEPD

SEQ ID NO: 1481161 - protein, 23 aa, Mycobacterium tuberculosis
DGFGLRIVELRASMATPTSAIGW

SEQ ID NO: 1481162 - protein, 21 aa, Mycobacterium tuberculosis
DGFVFGEAGALMLIETEEHAK

SEQ ID NO: 1481163 - protein, 19 aa, Mycobacterium tuberculosis
DGFVGLRVVPWLWGAPPTD

SEQ ID NO: 1481164 - protein, 21 aa, Mycobacterium tuberculosis
DGFVSAPGHGRCEVICFSADH

SEQ ID NO: 1481165 - protein, 17 aa, Mycobacterium tuberculosis
DGFYRGQRLFRAPHLDP

SEQ ID NO: 1481166 - protein, 37 aa, Mycobacterium tuberculosis
DGGAAGLVRSRWHRRCRRARFSTVAPAGPEFAAGCST

SEQ ID NO: 1481167 - protein, 27 aa, Mycobacterium tuberculosis
DGGAGGDGELFFGVSGAGGADGTGTNV

SEQ ID NO: 1481168 - protein, 26 aa, Mycobacterium tuberculosis
DGGAGGNGGSWLAAGDGGAGGHGGDP

SEQ ID NO: 1481169 - protein, 27 aa, Mycobacterium tuberculosis
DGGEGGGAGFGSGVAGAAGAGGNGGKG

SEQ ID NO: 1481170 - protein, 24 aa, Mycobacterium tuberculosis
DGGGGKGGAIFNAGTHGAAGTGGD

SEQ ID NO: 1481171 - protein, 30 aa, Mycobacterium tuberculosis; identical to SEQ ID NO: 216901

SEQ ID NO: 1481172 - protein, 28 aa, Mycobacterium tuberculosis
DGGKGGFADEFTGGFAQGGRGGFGGNGN

SEQ ID NO: 1481173 - protein, 19 aa, Mycobacterium tuberculosis
DGGLHRFLLSAASAVCGGG

SEQ ID NO: 1481174 - protein, 23 aa, Mycobacterium tuberculosis
DGGLLLPLGVRRLRSYGSARNAR

SEQ ID NO: 1481175 - protein, 18 aa, Mycobacterium tuberculosis
DGGNGANGNFAFGDGNGG

SEQ ID NO: 1481176 - protein, 18 aa, Mycobacterium tuberculosis
DGGPGGQGGQAFGANNIG

SEQ ID NO: 1481177 - protein, 23 aa, Mycobacterium tuberculosis
DGGQGGAGRGLWGTGGAGGHGGQ

SEQ ID NO: 1481178 - protein, 21 aa, Mycobacterium tuberculosis
DGGRFALKIGDGRARCTPTDA

SEQ ID NO: 1481179 - protein, 24 aa, Mycobacterium tuberculosis
DGGTGGRGGWLAGAGGAGGDGGIG

SEQ ID NO: 1481180 - protein, 20 aa, Mycobacterium tuberculosis
DGGWILPGLVDAHCHVGLGK

SEQ ID NO: 1481181 - protein, 25 aa, Mycobacterium tuberculosis
DGHRRRRNCCPPCRGSGRADAGHGR

SEQ ID NO: 1481182 - protein, 20 aa, Mycobacterium tuberculosis
DGIGGARRTGGAGGAGGSGG

SEQ ID NO: 1481183 - protein, 17 aa, Mycobacterium tuberculosis
DGIGGAVDAYWNWQNSR

SEQ ID NO: 1481184 - protein, 19 aa, Mycobacterium tuberculosis
DGIGIVFRKGLPLEDMEFH

SEQ ID NO: 1481185 - protein, 17 aa, Mycobacterium tuberculosis
DGIRVLRSFDESMALRK

SEQ ID NO: 1481186 - protein, 22 aa, Mycobacterium tuberculosis
DGISEFLERIAVQAGSGGTPLP

SEQ ID NO: 1481187 - protein, 25 aa, Mycobacterium tuberculosis
DGKARWYRNRWVRTPAVCAALGEPI

SEQ ID NO: 1481188 - protein, 18 aa, Mycobacterium tuberculosis
DGLCAPGSRVALGALGSR

SEQ ID NO: 1481189 - protein, 17 aa, Mycobacterium tuberculosis
DGLGCPHKIFVQLNRGP

SEQ ID NO: 1481190 - protein, 17 aa, Mycobacterium tuberculosis
DGLLKKLGAEAVAQRVN

SEQ ID NO: 1481191 - protein, 35 aa, Mycobacterium tuberculosis
DGLVRRSRVHWVRARVVQLERGWVLRDETDGRWVG

SEQ ID NO: 1481192 - protein, 17 aa, Mycobacterium tuberculosis
DGLWPPKLPDIPIPGLP

SEQ ID NO: 1481193 - protein, 17 aa, Mycobacterium tuberculosis
DGLYRLTPTTGRTHQLR

SEQ ID NO: 1481194 - protein, 17 aa, Mycobacterium tuberculosis
DGMELPNKVYLASADHA

SEQ ID NO: 1481195 - protein, 26 aa, Mycobacterium tuberculosis
DGMGGLRLLLSLARAYADEPDEVGGP

SEQ ID NO: 1481196 - protein, 22 aa, Mycobacterium tuberculosis
DGMSRLSGYLTPQARATFEAVL

SEQ ID NO: 1481197 - protein, 17 aa, Mycobacterium tuberculosis
DGNGGKWRVRRRRRQRR

SEQ ID NO: 1481198 - protein, 17 aa, Mycobacterium tuberculosis
DGNGRWATQRGLARTEG

SEQ ID NO: 1481199 - protein, 18 aa, Mycobacterium tuberculosis
DGNGSFADAGDGGPGGNG

SEQ ID NO: 1481200 - protein, 19 aa, Mycobacterium tuberculosis
DGNPGMGGSPGSAGQPGQP

SEQ ID NO: 1481201 - protein, 21 aa, Mycobacterium tuberculosis
DGPGLPGRCKHSGSVAHVVYA

SEQ ID NO: 1481202 - protein, 27 aa, Mycobacterium tuberculosis
DGPGPKPSASIGQWPRHQPQAQGGGLT

SEQ ID NO: 1481203 - protein, 22 aa, Mycobacterium tuberculosis
DGPTGFPPGLWARQTTEIRSTN

SEQ ID NO: 1481204 - protein, 19 aa, Mycobacterium tuberculosis
DGQAGGPGGLLYGNGGNGG

SEQ ID NO: 1481205 - protein, 18 aa, Mycobacterium tuberculosis
DGQIGIGGLNSGTGNIGF

SEQ ID NO: 1481206 - protein, 21 aa, Mycobacterium tuberculosis
DGQNGGLLFGNGGNGFTQTTA

SEQ ID NO: 1481207 - protein, 19 aa, Mycobacterium tuberculosis
DGQVIGCGRTTRQINLNRP

SEQ ID NO: 1481208 - protein, 19 aa, Mycobacterium tuberculosis
DGQVIGCGRTTRQINRRLR

SEQ ID NO: 1481209 - protein, 24 aa, Mycobacterium tuberculosis
DGRAGRGRRARRVGASPEAGAAGG

SEQ ID NO: 1481210 - protein, 29 aa, Mycobacterium tuberculosis
DGRLGVGWPKEFGGLGFGPIEQQIFVNEA

SEQ ID NO: 1481211 - protein, 17 aa, Mycobacterium tuberculosis
DGRLRVVVLGSTGSIGT

SEQ ID NO: 1481212 - protein, 17 aa, Mycobacterium tuberculosis
DGRRPRILIAKMGQDGH

SEQ ID NO: 1481213 - protein, 18 aa, Mycobacterium tuberculosis
DGSHHLVRASIDLGSGSI

SEQ ID NO: 1481214 - protein, 19 aa, Mycobacterium tuberculosis
DGSLRYPPVPAVWQDKSVP

SEQ ID NO: 1481215 - protein, 26 aa, Mycobacterium tuberculosis
DGSSCLPEGVPSNWTIFFGAEDVDET

SEQ ID NO: 1481216 - protein, 22 aa, Mycobacterium tuberculosis
DGTIRFSYGAALAVGSAATATP

SEQ ID NO: 1481217 - protein, 25 aa, Mycobacterium tuberculosis
DGVADFLAARGIRLPPGSPTDLTDD

SEQ ID NO: 1481218 - protein, 26 aa, Mycobacterium tuberculosis
DGVAGWLLLCCGAMLDGAREALSIAE

SEQ ID NO: 1481219 - protein, 18 aa, Mycobacterium tuberculosis
DGVAHGFTVSRHGPDVYV

SEQ ID NO: 1481220 - protein, 17 aa, Mycobacterium tuberculosis
DGVIAVPAQADWLDPMI

SEQ ID NO: 1481221 - protein, 25 aa, Mycobacterium tuberculosis
DGVTGWPATVSHDFDAELPAADAVL

SEQ ID NO: 1481222 - protein, 20 aa, Mycobacterium tuberculosis
DGWIGAQACMWVNKFHEEST

SEQ ID NO: 1481223 - protein, 33 aa, Mycobacterium tuberculosis
DGYNAPESTSPWHNLQQDILSFINEPTEALTGR

SEQ ID NO: 1481224 - protein, 23 aa, Mycobacterium tuberculosis
DGYPQRFGIPDGLYAEPVAVKQG

SEQ ID NO: 1481225 - protein, 25 aa, Mycobacterium tuberculosis
DGYVPGDGGGLVLLKPVQAALDDGD

SEQ ID NO: 1481226 - protein, 28 aa, Mycobacterium tuberculosis
DHAAADRCGWLALPRRTHVSVLTGTEAA

SEQ ID NO: 1481227 - protein, 17 aa, Mycobacterium tuberculosis
DHADVLALLPHRATAPE

SEQ ID NO: 1481228 - protein, 18 aa, Mycobacterium tuberculosis
DHCLLDLLWRNRRGELEM

SEQ ID NO: 1481229 - protein, 17 aa, Mycobacterium tuberculosis
DHFTSVVCFTMLHHVAS

SEQ ID NO: 1481230 - protein, 34 aa, Mycobacterium tuberculosis
DHGVPPGRRRTMLREYLEAMRALWTQEEACYDGE

SEQ ID NO: 1481231 - protein, 26 aa, Mycobacterium tuberculosis
DHHGMLSVFGSPTWRTVTGGSANYVQ

SEQ ID NO: 1481232 - protein, 21 aa, Mycobacterium tuberculosis
DHHPRELLVVGIATFDQKRPA

SEQ ID NO: 1481233 - protein, 17 aa, Mycobacterium tuberculosis
DHIRICDHEFTFQISAG

SEQ ID NO: 1481234 - protein, 19 aa, Mycobacterium tuberculosis
DHLHGLATQLMDWLHPDGN

SEQ ID NO: 1481235 - protein, 20 aa, Mycobacterium tuberculosis
DHLRAAVAHGLDFTRSHRSD

SEQ ID NO: 1481236 - protein, 23 aa, Mycobacterium tuberculosis
DHPGHPRRGLRMTHIRLHRPQPQ

SEQ ID NO: 1481237 - protein, 17 aa, Mycobacterium tuberculosis
DHQCPRNPVADVPLRVP

SEQ ID NO: 1481238 - protein, 19 aa, Mycobacterium tuberculosis
DHRHPHPLVRHLLGASSPR

SEQ ID NO: 1481239 - protein, 18 aa, Mycobacterium tuberculosis
DHRRRPAGIHTWSDRVAD

SEQ ID NO: 1481240 - protein, 31 aa, Mycobacterium tuberculosis
DHRVQRAVIWPLVYLKSLTLKGFKSFAAPTT

SEQ ID NO: 1481241 - protein, 37 aa, Mycobacterium tuberculosis
DHVGGMSPNGCWGTFVTCDARLAATLPPGLGDAQAAA

SEQ ID NO: 1481242 - protein, 17 aa, Mycobacterium tuberculosis
DIAAGRPSIGWRTSTRL

SEQ ID NO: 1481243 - protein, 23 aa, Mycobacterium tuberculosis
DIALRRPSLDHVFLAMTTDPTES

SEQ ID NO: 1481244 - protein, 19 aa, Mycobacterium tuberculosis
DIAPRRDLAGLGHYRCRHR

SEQ ID NO: 1481245 - protein, 26 aa, Mycobacterium tuberculosis
DIARYNARCGRTFVLPNEQAAYDACI

SEQ ID NO: 1481246 - protein, 20 aa, Mycobacterium tuberculosis
DICRCSQAGVVDARDAVAQI

SEQ ID NO: 1481247 - protein, 25 aa, Mycobacterium tuberculosis
DIEEFSRRFGVQVEDGFGSTENAVI

SEQ ID NO: 1481248 - protein, 24 aa, Mycobacterium tuberculosis
DIELALRLGATVERVAEASGVDPW

SEQ ID NO: 1481249 - protein, 19 aa, Mycobacterium tuberculosis
DIEVALPFWLDRPDHEATD

SEQ ID NO: 1481250 - protein, 19 aa, Mycobacterium tuberculosis
DIGARCELLSGARVWPGVF

SEQ ID NO: 1481251 - protein, 19 aa, Mycobacterium tuberculosis
DIGEAVGIVAAQSIGEPGT

SEQ ID NO: 1481252 - protein, 21 aa, Mycobacterium tuberculosis
DIGKHFSVNVMLARDTIRRRL

SEQ ID NO: 1481253 - protein, 19 aa, Mycobacterium tuberculosis
DIGKLRYHKIVLMADADVD

SEQ ID NO: 1481254 - protein, 22 aa, Mycobacterium tuberculosis
DIGKLRYHKIVLMADADVDGQH

SEQ ID NO: 1481255 - protein, 29 aa, Mycobacterium tuberculosis
DIKAPLLPRLERPTWPWATVNELITNLRE

SEQ ID NO: 1481256 - protein, 22 aa, Mycobacterium tuberculosis
DILRPVADRLWYPLWDANIRLD

SEQ ID NO: 1481257 - protein, 19 aa, Mycobacterium tuberculosis
DIPAAPGFGNSTTTPSSGF

SEQ ID NO: 1481258 - protein, 21 aa, Mycobacterium tuberculosis
DIRARGRLIVGLDIGSNLFSF

SEQ ID NO: 1481259 - protein, 23 aa, Mycobacterium tuberculosis
DIRFVRLWFTDVLGFLKSVAIAP

SEQ ID NO: 1481260 - protein, 20 aa, Mycobacterium tuberculosis
DIRLRRWRWFDVLINTPTAR

SEQ ID NO: 1481261 - protein, 24 aa, Mycobacterium tuberculosis
DITKEVLGALGITVLSEPGFEADD

SEQ ID NO: 1481262 - protein, 26 aa, Mycobacterium tuberculosis
DITPSEAFTAWEFVDGYDVAQAVVVP

SEQ ID NO: 1481263 - protein, 18 aa, Mycobacterium tuberculosis
DIVDELTNWHGLVTSEMV

SEQ ID NO: 1481264 - protein, 23 aa, Mycobacterium tuberculosis
DIVIPAFGGGIGIPINIGPLTII

SEQ ID NO: 1481265 - protein, 24 aa, Mycobacterium tuberculosis
DIYGDTRLGLFPFGRQPVAVCRRL

SEQ ID NO: 1481266 - protein, 27 aa, Mycobacterium tuberculosis
DIYGDTRLGLFPFRRNLSLYAVDLALL

SEQ ID NO: 1481267 - protein, 17 aa, Mycobacterium tuberculosis
DKASGDFVWDEDESEAL

SEQ ID NO: 1481268 - protein, 17 aa, Mycobacterium tuberculosis
DKCVLRADRDLERHHGN

SEQ ID NO: 1481269 - protein, 20 aa, Mycobacterium tuberculosis
DKHLKRHSGTLNHHMHANDL

SEQ ID NO: 1481270 - protein, 20 aa, Mycobacterium tuberculosis
DKIARIGIRVADVLDPEQLT

SEQ ID NO: 1481271 - protein, 19 aa, Mycobacterium tuberculosis
DKIFYRSGQGVTLQAVSYG

SEQ ID NO: 1481272 - protein, 53 aa, Mycobacterium tuberculosis
DKKKRRRRCRRRAWPPRRLRPPTARVRCSVAWRCRAWLAALPPVLPATPSAAP

SEQ ID NO: 1481273 - protein, 23 aa, Mycobacterium tuberculosis
DKLISRLLAGPALAIAKTKNAIN

SEQ ID NO: 1481274 - protein, 22 aa, Mycobacterium tuberculosis
DKLKDAGFYWATRSGVTVSMAD

SEQ ID NO: 1481275 - protein, 19 aa, Mycobacterium tuberculosis
DKPWFAIGGINAQRLPAVL

SEQ ID NO: 1481276 - protein, 18 aa, Mycobacterium tuberculosis
DKRGPGIQQLACRVSDLD

SEQ ID NO: 1481277 - protein, 20 aa, Mycobacterium tuberculosis
DKRIPLELCPSSNVQTGAVA

SEQ ID NO: 1481278 - protein, 18 aa, Mycobacterium tuberculosis
DKRSLVFPVKRLADLGFR

SEQ ID NO: 1481279 - protein, 21 aa, Mycobacterium tuberculosis
DKTGHPFLQHLLAHRDVTRLK

SEQ ID NO: 1481280 - protein, 18 aa, Mycobacterium tuberculosis
DKVGIVFQAFNLVSSLTA

SEQ ID NO: 1481281 - protein, 19 aa, Mycobacterium tuberculosis
DKWHRRRVIEPIDMDAYRQ

SEQ ID NO: 1481282 - protein, 23 aa, Mycobacterium tuberculosis
DLAARLKAVWAPQGLIHRGQGRW

SEQ ID NO: 1481283 - protein, 25 aa, Mycobacterium tuberculosis
DLAARVGAPLVLRGIGVRRVTTDRG

SEQ ID NO: 1481284 - protein, 18 aa, Mycobacterium tuberculosis
DLAILIGPEQDWLNSEEF

SEQ ID NO: 1481285 - protein, 23 aa, Mycobacterium tuberculosis
DLARLWPSLLARPLRSRLLGCAP

SEQ ID NO: 1481286 - protein, 27 aa, Mycobacterium tuberculosis
DLASGWIPPHIRLPAHITLLEPAPRRR

SEQ ID NO: 1481287 - protein, 18 aa, Mycobacterium tuberculosis
DLAVTFRFGEEVTAVDVG

SEQ ID NO: 1481288 - protein, 25 aa, Mycobacterium tuberculosis
DLCTDGAEVLWRFAERSGEGSPDDL

SEQ ID NO: 1481289 - protein, 26 aa, Mycobacterium tuberculosis
DLDALIGGFKPVFRALDPAKVNNIAN

SEQ ID NO: 1481290 - protein, 20 aa, Mycobacterium tuberculosis
DLDGARKVFKLVDALEDSDD

SEQ ID NO: 1481291 - protein, 25 aa, Mycobacterium tuberculosis
DLDGRLPFDLRLAVLSNGSVILERA

SEQ ID NO: 1481292 - protein, 18 aa, Mycobacterium tuberculosis
DLDLARLGTTASTEEITD

SEQ ID NO: 1481293 - protein, 19 aa, Mycobacterium tuberculosis
DLDPKRPVAPAGPAAPAGP

SEQ ID NO: 1481294 - protein, 17 aa, Mycobacterium tuberculosis
DLEFGRIRLKIGGGEGG

SEQ ID NO: 1481295 - protein, 24 aa, Mycobacterium tuberculosis
DLEIAPGVVTTWMKLAIRDRILPD

SEQ ID NO: 1481296 - protein, 26 aa, Mycobacterium tuberculosis
DLEPFRCFYLSAPFVVPKKKEVARTI

SEQ ID NO: 1481297 - protein, 20 aa, Mycobacterium tuberculosis
DLERRRISLSLKQANEDYTE

SEQ ID NO: 1481298 - protein, 23 aa, Mycobacterium tuberculosis
DLETDWPIRAALLSTPEQTVLSL

SEQ ID NO: 1481299 - protein, 25 aa, Mycobacterium tuberculosis
DLFLRIAPELYLKRLCVGGVERVFE

SEQ ID NO: 1481300 - protein, 21 aa, Mycobacterium tuberculosis
DLGGGAIRAALRGDLHLHSNW

SEQ ID NO: 1481301 - protein, 31 aa, Mycobacterium tuberculosis
DLGPLRASIDPFGWYRSWEEMLTGMAPLAGL

SEQ ID NO: 1481302 - protein, 18 aa, Mycobacterium tuberculosis
DLHTRKVLDLTIRLAEVM

SEQ ID NO: 1481303 - protein, 21 aa, Mycobacterium tuberculosis
DLIAGVARYDGTPGTIADQDV

SEQ ID NO: 1481304 - protein, 26 aa, Mycobacterium tuberculosis
DLILFDWPTHMLQLATWLAENPQLLV

SEQ ID NO: 1481305 - protein, 33 aa, Mycobacterium tuberculosis
DLKPISAPERLRSGWLNGIKHWQVDYTGRCPVA

SEQ ID NO: 1481306 - protein, 26 aa, Mycobacterium tuberculosis
DLLCPYPKTRFSAVIERPSNHPKASK

SEQ ID NO: 1481307 - protein, 17 aa, Mycobacterium tuberculosis
DLLDAEWLVHLLECGLL

SEQ ID NO: 1481308 - protein, 25 aa, Mycobacterium tuberculosis
DLLERGRYDLVLALASIHTGDGTVE

SEQ ID NO: 1481309 - protein, 21 aa, Mycobacterium tuberculosis
DLLKCSFCGKSQKQVKKLIAG

SEQ ID NO: 1481310 - protein, 18 aa, Mycobacterium tuberculosis
DLLNALIDFLAAVRNGLV

SEQ ID NO: 1481311 - protein, 31 aa, Mycobacterium tuberculosis; identical to SEQ ID NO: 235096

SEQ ID NO: 1481312 - protein, 20 aa, Mycobacterium tuberculosis
DLNAIAAGGYYGHSATAFSD

SEQ ID NO: 1481313 - protein, 18 aa, Mycobacterium tuberculosis
DLPGPLSTVSPWLDQTIR

SEQ ID NO: 1481314 - protein, 22 aa, Mycobacterium tuberculosis
DLPLHPGFAASWQRLRTAPATL

SEQ ID NO: 1481315 - protein, 17 aa, Mycobacterium tuberculosis
DLPRQPVHPELRVVDLA

SEQ ID NO: 1481316 - protein, 19 aa, Mycobacterium tuberculosis
DLQPGSSIMPGKVNPVLPE

SEQ ID NO: 1481317 - protein, 20 aa, Mycobacterium tuberculosis
DLRDDWPTALQKAGFDNAQR

SEQ ID NO: 1481318 - protein, 17 aa, Mycobacterium tuberculosis
DLRINRIFEGSSEIMRL

SEQ ID NO: 1481319 - protein, 19 aa, Mycobacterium tuberculosis
DLRLPGSVAEILASPAGPK

SEQ ID NO: 1481320 - protein, 18 aa, Mycobacterium tuberculosis
DLRQDWPKALQKAGFDPS

SEQ ID NO: 1481321 - protein, 20 aa, Mycobacterium tuberculosis
DLRRRGHAAGRVVRGRHQGH

SEQ ID NO: 1481322 - protein, 22 aa, Mycobacterium tuberculosis
DLSELLWSFAPPPRPRPVDGSE

SEQ ID NO: 1481323 - protein, 25 aa, Mycobacterium tuberculosis
DLTDLLWRMGIRTIGQFAALSRTDV

SEQ ID NO: 1481324 - protein, 19 aa, Mycobacterium tuberculosis
DLTPARYAGDFGSGTTTVI

SEQ ID NO: 1481325 - protein, 17 aa, Mycobacterium tuberculosis
DLVELGRSLQHMAAGHV

SEQ ID NO: 1481326 - protein, 18 aa, Mycobacterium tuberculosis
DLVLAWAAQSGRFPGFDA

SEQ ID NO: 1481327 - protein, 20 aa, Mycobacterium tuberculosis
DLWLNESFATFASVLCQSEA

SEQ ID NO: 1481328 - protein, 18 aa, Mycobacterium tuberculosis
DLYWAARGAGPGFLASSP

SEQ ID NO: 1481329 - protein, 20 aa, Mycobacterium tuberculosis
DMIGPIWRRDEVFEFNGSLI

SEQ ID NO: 1481330 - protein, 21 aa, Mycobacterium tuberculosis
DMILGLRMITPVGVLDLGRVP

SEQ ID NO: 1481331 - protein, 31 aa, Mycobacterium tuberculosis
DMIMELLDAFGIAMAGAPGFEADDVLGTLAT

SEQ ID NO: 1481332 - protein, 24 aa, Mycobacterium tuberculosis
DMRRPRWLDVPGHHRALPQRRRAP

SEQ ID NO: 1481333 - protein, 22 aa, Mycobacterium tuberculosis
DMYTLGFRFRPWTGRQAIADGK

SEQ ID NO: 1481334 - protein, 25 aa, Mycobacterium tuberculosis
DNAFTADELAAWAGRIHAEVGDAAH

SEQ ID NO: 1481335 - protein, 17 aa, Mycobacterium tuberculosis
DNDRLSALVAHLVGADA

SEQ ID NO: 1481336 - protein, 23 aa, Mycobacterium tuberculosis
DNGPPPPFTSWMPPGYPPEPPQV

SEQ ID NO: 1481337 - protein, 18 aa, Mycobacterium tuberculosis
DNLFRGALLVALAERLRE

SEQ ID NO: 1481338 - protein, 22 aa, Mycobacterium tuberculosis
DNNAGDYGFFWITAVTTDGSIV

SEQ ID NO: 1481339 - protein, 20 aa, Mycobacterium tuberculosis
DNNEVWFCRTCSSRSGGSGP

SEQ ID NO: 1481340 - protein, 17 aa, Mycobacterium tuberculosis
DNPRYVIGIMLDNPARN

SEQ ID NO: 1481341 - protein, 22 aa, Mycobacterium tuberculosis
DNRAWRLYRRVGLHRHHPRLPL

SEQ ID NO: 1481342 - protein, 18 aa, Mycobacterium tuberculosis
DNRPAFRDGPAIPPGIHA

SEQ ID NO: 1481343 - protein, 17 aa, Mycobacterium tuberculosis
DNSALMFAGAGSGPTLA

SEQ ID NO: 1481344 - protein, 18 aa, Mycobacterium tuberculosis
DNSGLDWGALGECDYLYV

SEQ ID NO: 1481345 - protein, 19 aa, Mycobacterium tuberculosis
DNTCDLGRFVAEKTAGVHA

SEQ ID NO: 1481346 - protein, 17 aa, Mycobacterium tuberculosis
DNVARLILDSPIALGVS

SEQ ID NO: 1481347 - protein, 18 aa, Mycobacterium tuberculosis
DPAAGRFAVDVVLHDPAG

SEQ ID NO: 1481348 - protein, 25 aa, Mycobacterium tuberculosis
DPADPRLSPLLAESLSGLAPALIAV

SEQ ID NO: 1481349 - protein, 22 aa, Mycobacterium tuberculosis
DPAELRLRNLLRPNQFPYQSKT

SEQ ID NO: 1481350 - protein, 31 aa, Mycobacterium tuberculosis; identical to SEQ ID NO: 156507

SEQ ID NO: 1481351 - protein, 26 aa, Mycobacterium tuberculosis
DPALALELGTYLGYGALRIARAAPEA

SEQ ID NO: 1481352 - protein, 17 aa, Mycobacterium tuberculosis
DPALEHWAAHGTPDAYE

SEQ ID NO: 1481353 - protein, 19 aa, Mycobacterium tuberculosis
DPARFIDIVERFMDTTEPA

SEQ ID NO: 1481354 - protein, 18 aa, Mycobacterium tuberculosis
DPARRPRPVFGVGRTAPP

SEQ ID NO: 1481355 - protein, 18 aa, Mycobacterium tuberculosis
DPATGSRRRYPWGTEEPT

SEQ ID NO: 1481356 - protein, 31 aa, Mycobacterium tuberculosis
DPATLTDLVFAWRACRAVKSNAIVIAADGAT

SEQ ID NO: 1481357 - protein, 23 aa, Mycobacterium tuberculosis
DPAVVLAGWPAVERAARAVVDDG

SEQ ID NO: 1481358 - protein, 18 aa, Mycobacterium tuberculosis
DPDAWARLIDTYEVTALN

SEQ ID NO: 1481359 - protein, 17 aa, Mycobacterium tuberculosis
DPDRLRAAATRLALRHP

SEQ ID NO: 1481360 - protein, 24 aa, Mycobacterium tuberculosis
DPDRPLWECWIIEGLNGNRWAILI

SEQ ID NO: 1481361 - protein, 24 aa, Mycobacterium tuberculosis
DPDTRRVVLLAFNCHERPYDLDYN

SEQ ID NO: 1481362 - protein, 24 aa, Mycobacterium tuberculosis
DPELIPKLMSAGVIEVAPLAYMRG

SEQ ID NO: 1481363 - protein, 22 aa, Mycobacterium tuberculosis
DPELLTLWISRRVNTEALPGRR

SEQ ID NO: 1481364 - protein, 18 aa, Mycobacterium tuberculosis
DPFARRQPEGSGRRPHRE

SEQ ID NO: 1481365 - protein, 23 aa, Mycobacterium tuberculosis
DPGAGPVRPALAVPTRAAATTGV

SEQ ID NO: 1481366 - protein, 17 aa, Mycobacterium tuberculosis
DPGGIWRDGVYAHGDYP

SEQ ID NO: 1481367 - protein, 20 aa, Mycobacterium tuberculosis
DPGLVVAVWDRRLHTGAHAA

SEQ ID NO: 1481368 - protein, 17 aa, Mycobacterium tuberculosis
DPGRRAAARTSRPATAH

SEQ ID NO: 1481369 - protein, 19 aa, Mycobacterium tuberculosis
DPGRRRYPAVAGFAEPDGR

SEQ ID NO: 1481370 - protein, 22 aa, Mycobacterium tuberculosis
DPGVISYLWRTARMGVEDIESM

SEQ ID NO: 1481371 - protein, 19 aa, Mycobacterium tuberculosis
DPICPAPTTPTRWIASLTV

SEQ ID NO: 1481372 - protein, 28 aa, Mycobacterium tuberculosis
DPIDIAYPVLWRHLTAIVASVLDAIGQD

SEQ ID NO: 1481373 - protein, 27 aa, Mycobacterium tuberculosis
DPIRYPARLAPLHGWGSDGADTIGAVG

SEQ ID NO: 1481374 - protein, 19 aa, Mycobacterium tuberculosis
DPKACVWVARLAVDFRQRF

SEQ ID NO: 1481375 - protein, 24 aa, Mycobacterium tuberculosis
DPKAVPSRLAWEAGVALADSLLAR

SEQ ID NO: 1481376 - protein, 22 aa, Mycobacterium tuberculosis
DPKRKVRFLPYGIAVSVLDDPV

SEQ ID NO: 1481377 - protein, 23 aa, Mycobacterium tuberculosis
DPLELAAKLHAVYPALGRTPLVV

SEQ ID NO: 1481378 - protein, 24 aa, Mycobacterium tuberculosis
DPLFTRTGAGLAFTPGGLRLASRA

SEQ ID NO: 1481379 - protein, 17 aa, Mycobacterium tuberculosis
DPLRPSLVEMGRAVVRE

SEQ ID NO: 1481380 - protein, 18 aa, Mycobacterium tuberculosis
DPMLVGWTGPGGGLDPPA

SEQ ID NO: 1481381 - protein, 19 aa, Mycobacterium tuberculosis
DPMVREWLTVLLRRDLGLL

SEQ ID NO: 1481382 - protein, 33 aa, Mycobacterium tuberculosis
DPNVRPTRCAAWVAGLRGCRWRTTRLRSPSLSP

SEQ ID NO: 1481383 - protein, 18 aa, Mycobacterium tuberculosis
DPPCDDWSPPPIRMGVDV

SEQ ID NO: 1481384 - protein, 19 aa, Mycobacterium tuberculosis
DPPCDDWSPPPIRMGVDVP

SEQ ID NO: 1481385 - protein, 21 aa, Mycobacterium tuberculosis
DPPPCKGLRGKGRLTDADIDA

SEQ ID NO: 1481386 - protein, 18 aa, Mycobacterium tuberculosis
DPPTRLLHLARDIGCVFS

SEQ ID NO: 1481387 - protein, 25 aa, Mycobacterium tuberculosis
DPQQRLLLEVSWEALERAGIDPITL

SEQ ID NO: 1481388 - protein, 18 aa, Mycobacterium tuberculosis
DPQRPTHIGSLLGNTPEM

SEQ ID NO: 1481389 - protein, 17 aa, Mycobacterium tuberculosis
DPRRVRWIVGERADTNG

SEQ ID NO: 1481390 - protein, 22 aa, Mycobacterium tuberculosis
DPRSNLARYGIAPTYPGDFAAD

SEQ ID NO: 1481391 - protein, 21 aa, Mycobacterium tuberculosis
DPRTCWSCAVGLQGDPPYVAV

SEQ ID NO: 1481392 - protein, 19 aa, Mycobacterium tuberculosis
DPRVLVIKVADRLHNMRTM

SEQ ID NO: 1481393 - protein, 24 aa, Mycobacterium tuberculosis
DPSAPMPGCTLICIGSHGPPVGAP

SEQ ID NO: 1481394 - protein, 21 aa, Mycobacterium tuberculosis
DPSRLHPLATMERTFIAPSRF

SEQ ID NO: 1481395 - protein, 25 aa, Mycobacterium tuberculosis
DPTASRAVSRWSVQKHVSPVLDVAG

SEQ ID NO: 1481396 - protein, 25 aa, Mycobacterium tuberculosis
DPTASRAVSWWSVHEHVAPVLDACR

SEQ ID NO: 1481397 - protein, 23 aa, Mycobacterium tuberculosis
DPTKLEFGVGVVRLDHRAAPIGS

SEQ ID NO: 1481398 - protein, 20 aa, Mycobacterium tuberculosis
DPTLRRLLPDFYRPDDLDDD

SEQ ID NO: 1481399 - protein, 19 aa, Mycobacterium tuberculosis
DPVADCPEAGEPVGTPGRR

SEQ ID NO: 1481400 - protein, 17 aa, Mycobacterium tuberculosis
DPVALRAFRRGAAALAA

SEQ ID NO: 1481401 - protein, 23 aa, Mycobacterium tuberculosis
DPVCPGQTGATLPAGTTGPEPVG

SEQ ID NO: 1481402 - protein, 18 aa, Mycobacterium tuberculosis
DPVFFPGLAAEWSDRRPF

SEQ ID NO: 1481403 - protein, 29 aa, Mycobacterium tuberculosis
DPVLAEWFLRRFSLLDSLYMVPSVPIIGR

SEQ ID NO: 1481404 - protein, 26 aa, Mycobacterium tuberculosis
DPVPISPRRRWTWTRHTWRCTALRGP

SEQ ID NO: 1481405 - protein, 26 aa, Mycobacterium tuberculosis
DPVPRAWRMRITVQRVGDRVKVSDVG

SEQ ID NO: 1481406 - protein, 17 aa, Mycobacterium tuberculosis
DPVRLAALRKVMPRLLN

SEQ ID NO: 1481407 - protein, 17 aa, Mycobacterium tuberculosis
DPVSLQSAVGFSALGSE

SEQ ID NO: 1481408 - protein, 23 aa, Mycobacterium tuberculosis
DPVTSKTVWGCRYRTVNHHRVAA

SEQ ID NO: 1481409 - protein, 20 aa, Mycobacterium tuberculosis
DPWGAPPARPRRRRRGLPGA

SEQ ID NO: 1481410 - protein, 18 aa, Mycobacterium tuberculosis
DPYSFPSNLLIERLNTDL

SEQ ID NO: 1481411 - protein, 19 aa, Mycobacterium tuberculosis
DQAAAVAILQSWLDERLAA

SEQ ID NO: 1481412 - protein, 20 aa, Mycobacterium tuberculosis
DQALLLRVIDQFGYGDDVDP

SEQ ID NO: 1481413 - protein, 26 aa, Mycobacterium tuberculosis
DQARLSWACGLPYYSNLYTPNCTSDA

SEQ ID NO: 1481414 - protein, 24 aa, Mycobacterium tuberculosis
DQLADRVDLGLVHRLGLAEHGCGG

SEQ ID NO: 1481415 - protein, 17 aa, Mycobacterium tuberculosis
DQLQRPAPVYNMAVALR

SEQ ID NO: 1481416 - protein, 22 aa, Mycobacterium tuberculosis
DQLRRAQKVFARTGGLHAAALF

SEQ ID NO: 1481417 - protein, 23 aa, Mycobacterium tuberculosis
DQLRRAQKVFARTGGLHAAALFG

SEQ ID NO: 1481418 - protein, 17 aa, Mycobacterium tuberculosis
DQMHVFQDLPLMTPDQE

SEQ ID NO: 1481419 - protein, 21 aa, Mycobacterium tuberculosis
DQPGCHVVGLVAGRDFTADGT

SEQ ID NO: 1481420 - protein, 17 aa, Mycobacterium tuberculosis
DQPGKWSLMAQGVYAPA

SEQ ID NO: 1481421 - protein, 27 aa, Mycobacterium tuberculosis
DQPGVQRIGGWLPERDGALLVALAEHP

SEQ ID NO: 1481422 - protein, 19 aa, Mycobacterium tuberculosis
DQQRQWILHMAKLSAAMAK

SEQ ID NO: 1481423 - protein, 25 aa, Mycobacterium tuberculosis
DQQRQWILHMAKLSAAMAKQAQYVA

SEQ ID NO: 1481424 - protein, 23 aa, Mycobacterium tuberculosis
DQRADWACDFWDCAAAEVAAALT

SEQ ID NO: 1481425 - protein, 18 aa, Mycobacterium tuberculosis
DQRCRMPYCDAPIRHRDH

SEQ ID NO: 1481426 - protein, 26 aa, Mycobacterium tuberculosis
DQRCYRAQGVLFSRPVPGEAMRHMLS

SEQ ID NO: 1481427 - protein, 17 aa, Mycobacterium tuberculosis
DQRRLLLDDPEGIPDAV

SEQ ID NO: 1481428 - protein, 24 aa, Mycobacterium tuberculosis
DQRWPETRIDPSLTQISALMDLLG

SEQ ID NO: 1481429 - protein, 21 aa, Mycobacterium tuberculosis
DQRYRDRYIFAGLQPGQRIPS

SEQ ID NO: 1481430 - protein, 19 aa, Mycobacterium tuberculosis
DQTMFRKLFESVLKGHVKV

SEQ ID NO: 1481431 - protein, 21 aa, Mycobacterium tuberculosis
DQTMFRKLFESVLKGHVKVLV

SEQ ID NO: 1481432 - protein, 23 aa, Mycobacterium tuberculosis
DQVAALFRMWLRDAVRRVATGVL

SEQ ID NO: 1481433 - protein, 17 aa, Mycobacterium tuberculosis
DQVACYRPTPSANSIAW

SEQ ID NO: 1481434 - protein, 18 aa, Mycobacterium tuberculosis
DQVRCLLAGELGPELGPA

SEQ ID NO: 1481435 - protein, 21 aa, Mycobacterium tuberculosis
DRAIGGRRRCRGDRAGAFVWP

SEQ ID NO: 1481436 - protein, 25 aa, Mycobacterium tuberculosis
DRAIPCCYPPIPAWSRRRNGSAMTC

SEQ ID NO: 1481437 - protein, 20 aa, Mycobacterium tuberculosis
DRAKMFALLWQSLRRQRQLL

SEQ ID NO: 1481438 - protein, 25 aa, Mycobacterium tuberculosis
DRARRAGGMSGIGAYGGAGGAGGCL

SEQ ID NO: 1481439 - protein, 18 aa, Mycobacterium tuberculosis
DRAWTEAVIGNRRRQDSK

SEQ ID NO: 1481440 - protein, 23 aa, Mycobacterium tuberculosis
DRCGDLLLLRQGRLLAHTTPHRL

SEQ ID NO: 1481441 - protein, 19 aa, Mycobacterium tuberculosis
DRCTRRQAVRPARTLAKKG

SEQ ID NO: 1481442 - protein, 20 aa, Mycobacterium tuberculosis
DRCTRRQAVRPARTLAKKGN

SEQ ID NO: 1481443 - protein, 20 aa, Mycobacterium tuberculosis
DRDDPRGGEADFILAKHRNG

SEQ ID NO: 1481444 - protein, 21 aa, Mycobacterium tuberculosis
DRDGVLTSFDWTRAEEDVRRI

SEQ ID NO: 1481445 - protein, 24 aa, Mycobacterium tuberculosis
DRDPSGDWRRSAIKQVASARFGVT

SEQ ID NO: 1481446 - protein, 25 aa, Mycobacterium tuberculosis
DRDRGMHLLGLVGLGRRVAHALAGD

SEQ ID NO: 1481447 - protein, 20 aa, Mycobacterium tuberculosis
DRDRLVVIIAGYRADLDKFL

SEQ ID NO: 1481448 - protein, 23 aa, Mycobacterium tuberculosis
DRDWSPKVFGSWNLHRATLGQPL

SEQ ID NO: 1481449 - protein, 19 aa, Mycobacterium tuberculosis
DREGELFVPVEMDIDAVSH

SEQ ID NO: 1481450 - protein, 25 aa, Mycobacterium tuberculosis
DRFGAEIRTHYPLELEAEMGVIVQE

SEQ ID NO: 1481451 - protein, 27 aa, Mycobacterium tuberculosis
DRFNELVMRAGLTWQQVVLLRAYAKYL

SEQ ID NO: 1481452 - protein, 17 aa, Mycobacterium tuberculosis
DRFTRVRDIAVTDYVTA

SEQ ID NO: 1481453 - protein, 25 aa, Mycobacterium tuberculosis
DRFVRALSAAAGWYVDAEAANAALV

SEQ ID NO: 1481454 - protein, 26 aa, Mycobacterium tuberculosis
DRFVRALSAAAGWYVDAEAATRAVTR

SEQ ID NO: 1481455 - protein, 20 aa, Mycobacterium tuberculosis
DRGPSQWLLRMLATQTQRAE

SEQ ID NO: 1481456 - protein, 26 aa, Mycobacterium tuberculosis
DRGRPLWEVWVIAGLADSKWAILTKL

SEQ ID NO: 1481457 - protein, 22 aa, Mycobacterium tuberculosis
DRGVGWKTLRDAGPVVFMNGWY

SEQ ID NO: 1481458 - protein, 20 aa, Mycobacterium tuberculosis
DRIAAMLSEVVGLLAAGVLA

SEQ ID NO: 1481459 - protein, 19 aa, Mycobacterium tuberculosis
DRIRFSVFVSTDVSAKDLC

SEQ ID NO: 1481460 - protein, 17 aa, Mycobacterium tuberculosis
DRIRWNAKYECADPTEA

SEQ ID NO: 1481461 - protein, 21 aa, Mycobacterium tuberculosis
DRKPATCWSEVIRQLNAAGKP

SEQ ID NO: 1481462 - protein, 22 aa, Mycobacterium tuberculosis
DRKPVCYRMHPDNVPALTALRP

SEQ ID NO: 1481463 - protein, 19 aa, Mycobacterium tuberculosis
DRLAQLRPGDPILGEEGGG

SEQ ID NO: 1481464 - protein, 20 aa, Mycobacterium tuberculosis
DRLAQLRPGDPILGEEGGGP

SEQ ID NO: 1481465 - protein, 18 aa, Mycobacterium tuberculosis
DRLEELLALAHEVRMRWC

SEQ ID NO: 1481466 - protein, 17 aa, Mycobacterium tuberculosis
DRLEMLGAQNDPRSTYK

SEQ ID NO: 1481467 - protein, 23 aa, Mycobacterium tuberculosis
DRLGGPGSWLLAVPPYHIAGLAV

SEQ ID NO: 1481468 - protein, 27 aa, Mycobacterium tuberculosis
DRLGRDLRCGGCFALGQTDDPMIVAHR

SEQ ID NO: 1481469 - protein, 22 aa, Mycobacterium tuberculosis
DRLKELGESVAIAAAPPDSYSV

SEQ ID NO: 1481470 - protein, 19 aa, Mycobacterium tuberculosis
DRLLAQKLPDGWDADLPHW

SEQ ID NO: 1481471 - protein, 19 aa, Mycobacterium tuberculosis
DRLMALPINLLWNGQSVSS

SEQ ID NO: 1481472 - protein, 23 aa, Mycobacterium tuberculosis
DRLPLSASVWDIAQRYNKGGPTV

SEQ ID NO: 1481473 - protein, 17 aa, Mycobacterium tuberculosis
DRLPLVAADPERTADLA

SEQ ID NO: 1481474 - protein, 21 aa, Mycobacterium tuberculosis
DRLPMDKLLAGVAHVVHEMHG

SEQ ID NO: 1481475 - protein, 21 aa, Mycobacterium tuberculosis
DRLQVRYVIVSAVSGAMGGSA

SEQ ID NO: 1481476 - protein, 17 aa, Mycobacterium tuberculosis
DRLRRCHPHGGVRRGQD

SEQ ID NO: 1481477 - protein, 25 aa, Mycobacterium tuberculosis
DRLRSWTSRCRWAGGHICAGGSPER

SEQ ID NO: 1481478 - protein, 17 aa, Mycobacterium tuberculosis
DRLSALVAHLVGADALV

SEQ ID NO: 1481479 - protein, 20 aa, Mycobacterium tuberculosis
DRLSKQPGIHAVHVSNGDKP

SEQ ID NO: 1481480 - protein, 17 aa, Mycobacterium tuberculosis
DRLTLDVVVRQGGRIVN

SEQ ID NO: 1481481 - protein, 19 aa, Mycobacterium tuberculosis
DRLYGYEVSPVLWKKVAPK

SEQ ID NO: 1481482 - protein, 21 aa, Mycobacterium tuberculosis
DRMAAKLAGFGYVVLLPDVYY

SEQ ID NO: 1481483 - protein, 17 aa, Mycobacterium tuberculosis
DRMVRAIWVLRALLREY

SEQ ID NO: 1481484 - protein, 20 aa, Mycobacterium tuberculosis
DRNGALRMVRGVKNRFGAAD

SEQ ID NO: 1481485 - protein, 23 aa, Mycobacterium tuberculosis
DRNSRAFSAFRGWVTTQSTSWGA

SEQ ID NO: 1481486 - protein, 20 aa, Mycobacterium tuberculosis
DRPARRVGMSRIDRVLEAAR

SEQ ID NO: 1481487 - protein, 23 aa, Mycobacterium tuberculosis
DRPCDAPGWFLYLTDIPRAGVEY

SEQ ID NO: 1481488 - protein, 34 aa, Mycobacterium tuberculosis
DRPDVADRGEVHRDGRDVDGRNDGGGSPVVAGVN

SEQ ID NO: 1481489 - protein, 30 aa, Mycobacterium tuberculosis
DRPLARFGAWYEMFPRSTGGWDDDGNPVHG

SEQ ID NO: 1481490 - protein, 24 aa, Mycobacterium tuberculosis
DRPPRLRIDRLVACRVRGAARDGA

SEQ ID NO: 1481491 - protein, 27 aa, Mycobacterium tuberculosis
DRPRGGWRPACRRGRAVWRQIGTLCGA

SEQ ID NO: 1481492 - protein, 23 aa, Mycobacterium tuberculosis
DRPVFICGPGPFMQAARDALAAL

SEQ ID NO: 1481493 - protein, 24 aa, Mycobacterium tuberculosis
DRQHRRGHGDGHGPRCAVCTAPPG

SEQ ID NO: 1481494 - protein, 23 aa, Mycobacterium tuberculosis
DRQHRVAAVFLRELLAADLQPVV

SEQ ID NO: 1481495 - protein, 17 aa, Mycobacterium tuberculosis
DRQLPGEGVTRGAIQVP

SEQ ID NO: 1481496 - protein, 19 aa, Mycobacterium tuberculosis
DRQRKWLLGNRESRNGEGL

SEQ ID NO: 1481497 - protein, 18 aa, Mycobacterium tuberculosis
DRQSPWLATGFDRRMSQT

SEQ ID NO: 1481498 - protein, 19 aa, Mycobacterium tuberculosis
DRRERAQRPAIASEPALRT

SEQ ID NO: 1481499 - protein, 24 aa, Mycobacterium tuberculosis
DRRFTRTRLRTEVLPLLEEVLGGG

SEQ ID NO: 1481500 - protein, 18 aa, Mycobacterium tuberculosis
DRRGMHVFHRVHPEALQA

SEQ ID NO: 1481501 - protein, 17 aa, Mycobacterium tuberculosis
DRRMPYTVGLLGSVPRL

SEQ ID NO: 1481502 - protein, 17 aa, Mycobacterium tuberculosis
DRRPLGTLRCWRHSDIG

SEQ ID NO: 1481503 - protein, 24 aa, Mycobacterium tuberculosis
DRRRAGPAGQRWPAGARRIRGRGQ

SEQ ID NO: 1481504 - protein, 21 aa, Mycobacterium tuberculosis
DRSRQLAAIGCHFTQSADNPV

SEQ ID NO: 1481505 - protein, 18 aa, Mycobacterium tuberculosis
DRTGLWGRLLPEWEPIRD

SEQ ID NO: 1481506 - protein, 23 aa, Mycobacterium tuberculosis
DRTLRVAWSLADLAGRTSPGIDE

SEQ ID NO: 1481507 - protein, 17 aa, Mycobacterium tuberculosis
DRTRPCGRWSYARPDAS

SEQ ID NO: 1481508 - protein, 18 aa, Mycobacterium tuberculosis
DRTTYPHIGRLHRDSNRR

SEQ ID NO: 1481509 - protein, 25 aa, Mycobacterium tuberculosis
DRVAIWSPNTWHWVVACLAIHHAGA

SEQ ID NO: 1481510 - protein, 26 aa, Mycobacterium tuberculosis
DRVDTVLRAKVDGAWNLHELTEDMDL

SEQ ID NO: 1481511 - protein, 22 aa, Mycobacterium tuberculosis
DRVFRYQLIWEAADAAHSTKQR

SEQ ID NO: 1481512 - protein, 19 aa, Mycobacterium tuberculosis
DRVFSVFDGPIVDRPLYRF

SEQ ID NO: 1481513 - protein, 24 aa, Mycobacterium tuberculosis
DRVGIWAPNRWEWVLVQYATAEIG

SEQ ID NO: 1481514 - protein, 17 aa, Mycobacterium tuberculosis
DRVKPFRPFQLNSRLLA

SEQ ID NO: 1481515 - protein, 23 aa, Mycobacterium tuberculosis
DRYELGEILGFGGMSEVHLARDL

SEQ ID NO: 1481516 - protein, 20 aa, Mycobacterium tuberculosis
DRYVTCGDLSAAAHAALATA

SEQ ID NO: 1481517 - protein, 19 aa, Mycobacterium tuberculosis
DSAEAVGGAGGKGGDGGVG

SEQ ID NO: 1481518 - protein, 20 aa, Mycobacterium tuberculosis
DSAEAVGGAGGKGGDGGVGG

SEQ ID NO: 1481519 - protein, 20 aa, Mycobacterium tuberculosis
DSAFDGYEFSRACESLYHFA

SEQ ID NO: 1481520 - protein, 26 aa, Mycobacterium tuberculosis
DSAGSSRKAFGGDGGVGGDGASALGT

SEQ ID NO: 1481521 - protein, 23 aa, Mycobacterium tuberculosis
DSARRSGNEFLFQQLAQQAVETL

SEQ ID NO: 1481522 - protein, 19 aa, Mycobacterium tuberculosis
DSDEVLVPFVRAIVTSVSL

SEQ ID NO: 1481523 - protein, 23 aa, Mycobacterium tuberculosis
DSERRAALAMVRRHRLLETFLVN

SEQ ID NO: 1481524 - protein, 18 aa, Mycobacterium tuberculosis
DSGEGRWTAIAAIDEGVP

SEQ ID NO: 1481525 - protein, 17 aa, Mycobacterium tuberculosis
DSGGFNSIDFVSGFFHR

SEQ ID NO: 1481526 - protein, 24 aa, Mycobacterium tuberculosis
DSGGGARWLIPRLDLPAKKRDAIV

SEQ ID NO: 1481527 - protein, 17 aa, Mycobacterium tuberculosis
DSGRKMAALCGSPSQAR

SEQ ID NO: 1481528 - protein, 24 aa, Mycobacterium tuberculosis
DSGSGRLGIAIARRPRRHRNEKRF

SEQ ID NO: 1481529 - protein, 18 aa, Mycobacterium tuberculosis
DSLDWPYYIGQLSVEGSA

SEQ ID NO: 1481530 - protein, 20 aa, Mycobacterium tuberculosis
DSLLRRLKQYSGRLATEAVS

SEQ ID NO: 1481531 - protein, 18 aa, Mycobacterium tuberculosis
DSLTAVELRNRLKTATGL

SEQ ID NO: 1481532 - protein, 18 aa, Mycobacterium tuberculosis
DSLVKTALFGSDPNWGRV

SEQ ID NO: 1481533 - protein, 19 aa, Mycobacterium tuberculosis
DSLVKTALFGSDPNWGRVL

SEQ ID NO: 1481534 - protein, 20 aa, Mycobacterium tuberculosis
DSMLYIEGRLLGKPASIDEA

SEQ ID NO: 1481535 - protein, 24 aa, Mycobacterium tuberculosis
DSMRAGLQALAWIAHQPEATRRSW

SEQ ID NO: 1481536 - protein, 24 aa, Mycobacterium tuberculosis
DSMRAGLQALAWIALQPEATRRSW

SEQ ID NO: 1481537 - protein, 28 aa, Mycobacterium tuberculosis
DSNGMLWRGDHEGLFGLSYGITIPQFPI

SEQ ID NO: 1481538 - protein, 24 aa, Mycobacterium tuberculosis
DSNIEPQTSVLIGTQGGDGTPGGA

SEQ ID NO: 1481539 - protein, 23 aa, Mycobacterium tuberculosis
DSPDKLRRVVAHMMEKPESVQHW

SEQ ID NO: 1481540 - protein, 19 aa, Mycobacterium tuberculosis
DSPEVIAYLEAENDYTERT

SEQ ID NO: 1481541 - protein, 42 aa, Mycobacterium tuberculosis
DSPGAEASWVVGITWWSAVVGGFQMSFVIAVPETIAAAATDL

SEQ ID NO: 1481542 - protein, 26 aa, Mycobacterium tuberculosis
DSRAYRLDWPAGTIVYEIDQPKVLSY

SEQ ID NO: 1481543 - protein, 25 aa, Mycobacterium tuberculosis
DSRAYRLPWPDGTTVFELDRPQVLD

SEQ ID NO: 1481544 - protein, 18 aa, Mycobacterium tuberculosis
DSRFEHLVGYPFAPYYVD

SEQ ID NO: 1481545 - protein, 23 aa, Mycobacterium tuberculosis
DSTKLRAAAVAWRSAGTQFALTE

SEQ ID NO: 1481546 - protein, 22 aa, Mycobacterium tuberculosis
DSTRGVATFLVLRTRRDGSRNG

SEQ ID NO: 1481547 - protein, 26 aa, Mycobacterium tuberculosis
DSTSATCSKRWACIRDSDGAAPVIGG

SEQ ID NO: 1481548 - protein, 23 aa, Mycobacterium tuberculosis
DSTTETFAAITLEVDTRRWASVP

SEQ ID NO: 1481549 - protein, 17 aa, Mycobacterium tuberculosis
DSVKRLVGEIGERHGRL

SEQ ID NO: 1481550 - protein, 24 aa, Mycobacterium tuberculosis
DSVSCPRSGEVIVRKGPLSGRPLV

SEQ ID NO: 1481551 - protein, 19 aa, Mycobacterium tuberculosis
DSWRNYQWHQLARAFLMYV

SEQ ID NO: 1481552 - protein, 19 aa, Mycobacterium tuberculosis
DSYLAYGFAVHNCTAPIYK

SEQ ID NO: 1481553 - protein, 25 aa, Mycobacterium tuberculosis
DTADPRFGVVLILRGREVGGGDTRC

SEQ ID NO: 1481554 - protein, 18 aa, Mycobacterium tuberculosis
DTAGRLHTKVGLMDELDK

SEQ ID NO: 1481555 - protein, 25 aa, Mycobacterium tuberculosis
DTAHGRIWRCAEIPAVGTAGSANAA

SEQ ID NO: 1481556 - protein, 18 aa, Mycobacterium tuberculosis
DTAVLCDRCQGKGTNGDS

SEQ ID NO: 1481557 - protein, 17 aa, Mycobacterium tuberculosis
DTDFARFADLKWTDPLR

SEQ ID NO: 1481558 - protein, 24 aa, Mycobacterium tuberculosis
DTGHAVPAFAAGPAITNKPAVAAL

SEQ ID NO: 1481559 - protein, 21 aa, Mycobacterium tuberculosis
DTGRCCGHVDFGNLGVADRWA

SEQ ID NO: 1481560 - protein, 23 aa, Mycobacterium tuberculosis
DTHFGRLVRRWRWTTAEDPVKVE

SEQ ID NO: 1481561 - protein, 19 aa, Mycobacterium tuberculosis
DTKIAWKGDEAVELTSSTE

SEQ ID NO: 1481562 - protein, 31 aa, Mycobacterium tuberculosis
DTLRADRWSISRERGPAMEYLIAAQDVLVAA

SEQ ID NO: 1481563 - protein, 27 aa, Mycobacterium tuberculosis
DTLTSRPGGGGWGWGVEPPGAAVAEVI

SEQ ID NO: 1481564 - protein, 37 aa, Mycobacterium tuberculosis; identical to SEQ ID NO: 649186

SEQ ID NO: 1481565 - protein, 21 aa, Mycobacterium tuberculosis
DTNVPGPCRVVGSSDRTFGTD

SEQ ID NO: 1481566 - protein, 28 aa, Mycobacterium tuberculosis
DTNVYYRRALMLAACFGRGSEYPQRVVD

SEQ ID NO: 1481567 - protein, 17 aa, Mycobacterium tuberculosis
DTPAMPPPIFVAASGPQ

SEQ ID NO: 1481568 - protein, 18 aa, Mycobacterium tuberculosis
DTPAMPPPIFVAASGPQS

SEQ ID NO: 1481569 - protein, 23 aa, Mycobacterium tuberculosis
DTPASACGLPSTHLTGRTGFTRP

SEQ ID NO: 1481570 - protein, 20 aa, Mycobacterium tuberculosis
DTPAVVLVPPVAAAAVQLRP

SEQ ID NO: 1481571 - protein, 22 aa, Mycobacterium tuberculosis
DTPCDLLIAVGVSFGGLVTRSF

SEQ ID NO: 1481572 - protein, 22 aa, Mycobacterium tuberculosis
DTPDSCWPRLPMPDTAAGVPKG

SEQ ID NO: 1481573 - protein, 20 aa, Mycobacterium tuberculosis
DTPRGCSIPARRPSRESSGC

SEQ ID NO: 1481574 - protein, 24 aa, Mycobacterium tuberculosis
DTPTGRAALLVRLDEAITSPAAYV

SEQ ID NO: 1481575 - protein, 23 aa, Mycobacterium tuberculosis
DTPTLFTGVEWLEAARAAGIDAV

SEQ ID NO: 1481576 - protein, 17 aa, Mycobacterium tuberculosis
DTQLVTIIVSWLSGELP

SEQ ID NO: 1481577 - protein, 19 aa, Mycobacterium tuberculosis
DTRHGRPTLSAGTAIAQQH

SEQ ID NO: 1481578 - protein, 22 aa, Mycobacterium tuberculosis
DTRRWASVPFYLRTGKRLGRRV

SEQ ID NO: 1481579 - protein, 20 aa, Mycobacterium tuberculosis
DTSATCPLTSTVQDSSPVAG

SEQ ID NO: 1481580 - protein, 28 aa, Mycobacterium tuberculosis
DTSVCMFKPPFAWREYLLQCWFVARVST

SEQ ID NO: 1481581 - protein, 17 aa, Mycobacterium tuberculosis
DTTCAGPEPNLVQVEFD

SEQ ID NO: 1481582 - protein, 19 aa, Mycobacterium tuberculosis
DTTVPGIWVPDTPLSHRNT

SEQ ID NO: 1481583 - protein, 17 aa, Mycobacterium tuberculosis
DTTVPLFDSGVGGAGGA

SEQ ID NO: 1481584 - protein, 18 aa, Mycobacterium tuberculosis
DTTVPLFDSGVGGAGGAG

SEQ ID NO: 1481585 - protein, 17 aa, Mycobacterium tuberculosis
DTVARLIGPAALKYLLF

SEQ ID NO: 1481586 - protein, 18 aa, Mycobacterium tuberculosis
DTVLRAKVDGAWNLHELT

SEQ ID NO: 1481587 - protein, 18 aa, Mycobacterium tuberculosis
DTVVRGRIDAVFVDPDGG

SEQ ID NO: 1481588 - protein, 19 aa, Mycobacterium tuberculosis
DVAAALGISVTDARGLVDR

SEQ ID NO: 1481589 - protein, 24 aa, Mycobacterium tuberculosis
DVAADVWSVTSWGELNRDGVTIET

SEQ ID NO: 1481590 - protein, 17 aa, Mycobacterium tuberculosis
DVAAMVGYHGGASAAAA

SEQ ID NO: 1481591 - protein, 18 aa, Mycobacterium tuberculosis
DVADGRRQPRTDVAEPDV

SEQ ID NO: 1481592 - protein, 18 aa, Mycobacterium tuberculosis
DVAGLRADADFMVWTHAE

SEQ ID NO: 1481593 - protein, 23 aa, Mycobacterium tuberculosis
DVAHCRRAASPLVEHRPIADTEP

SEQ ID NO: 1481594 - protein, 24 aa, Mycobacterium tuberculosis
DVAHGLPVHLTRFVGRGAQITEVH

SEQ ID NO: 1481595 - protein, 18 aa, Mycobacterium tuberculosis
DVAHPVYLLYGVERTEDL

SEQ ID NO: 1481596 - protein, 23 aa, Mycobacterium tuberculosis
DVAHRSGLVHVWARAPQKAQQNL

SEQ ID NO: 1481597 - protein, 17 aa, Mycobacterium tuberculosis
DVALLRLSFGRIGDEPA

SEQ ID NO: 1481598 - protein, 21 aa, Mycobacterium tuberculosis
DVARWRPKPVFLENTGQILAD

SEQ ID NO: 1481599 - protein, 18 aa, Mycobacterium tuberculosis
DVCRQWNDAGAFTITGRP

SEQ ID NO: 1481600 - protein, 18 aa, Mycobacterium tuberculosis
DVDTGAFITGNYSNGLFL

SEQ ID NO: 1481601 - protein, 18 aa, Mycobacterium tuberculosis
DVEGFPYKEIAEIMDTPI

SEQ ID NO: 1481602 - protein, 25 aa, Mycobacterium tuberculosis
DVEKRPRLTMFDDFGGRIPSDKPPI

SEQ ID NO: 1481603 - protein, 22 aa, Mycobacterium tuberculosis
DVERPHYMPLFVAPQPIPEPLA

SEQ ID NO: 1481604 - protein, 17 aa, Mycobacterium tuberculosis
DVFWCTADIGWVTGHTY

SEQ ID NO: 1481605 - protein, 25 aa, Mycobacterium tuberculosis
DVGCGEAAISLALAERGHTTVGLDL

SEQ ID NO: 1481606 - protein, 33 aa, Mycobacterium tuberculosis
DVGGAGGFGGSGGRGGLLLGTGGAGGDGGVGGD

SEQ ID NO: 1481607 - protein, 20 aa, Mycobacterium tuberculosis
DVGGFDCDFFGLTEREATAI

SEQ ID NO: 1481608 - protein, 23 aa, Mycobacterium tuberculosis
DVGGTRWVVYEGSDENGAVEPVW

SEQ ID NO: 1481609 - protein, 18 aa, Mycobacterium tuberculosis
DVGKPCPFLIAEGVADST

SEQ ID NO: 1481610 - protein, 23 aa, Mycobacterium tuberculosis
DVGSRFALTHFGLFGFAVMSCGT

SEQ ID NO: 1481611 - protein, 20 aa, Mycobacterium tuberculosis
DVHVAPRVIFLPGPAAALTS

SEQ ID NO: 1481612 - protein, 19 aa, Mycobacterium tuberculosis
DVIAVGITPAGSWVLTDAN

SEQ ID NO: 1481613 - protein, 26 aa, Mycobacterium tuberculosis
DVIEVPGLLDLSSLWQIYAVDRPTLK

SEQ ID NO: 1481614 - protein, 20 aa, Mycobacterium tuberculosis
DVINELRAAGAEAIQINDAH

SEQ ID NO: 1481615 - protein, 19 aa, Mycobacterium tuberculosis
DVKGLRLTLTQAAWRVAED

SEQ ID NO: 1481616 - protein, 20 aa, Mycobacterium tuberculosis
DVLEAMGIPHTEVDLILVNG

SEQ ID NO: 1481617 - protein, 20 aa, Mycobacterium tuberculosis
DVLECLAGLASDAGTHHAAA

SEQ ID NO: 1481618 - protein, 28 aa, Mycobacterium tuberculosis
DVLLKVRLRQGLPFARLGAAERERAEAV

SEQ ID NO: 1481619 - protein, 20 aa, Mycobacterium tuberculosis
DVLLRAGIQGADAFAAVSSA

SEQ ID NO: 1481620 - protein, 18 aa, Mycobacterium tuberculosis
DVLRAGDVLIVIGTEDGI

SEQ ID NO: 1481621 - protein, 23 aa, Mycobacterium tuberculosis
DVLVLRRRVGLVAQAPVVLTDAV

SEQ ID NO: 1481622 - protein, 19 aa, Mycobacterium tuberculosis
DVMAAARIAGIAAAKRTGD

SEQ ID NO: 1481623 - protein, 17 aa, Mycobacterium tuberculosis
DVMMPGMDGFGVLRRLR

SEQ ID NO: 1481624 - protein, 17 aa, Mycobacterium tuberculosis
DVNGFGISLKIGSVDYQ

SEQ ID NO: 1481625 - protein, 21 aa, Mycobacterium tuberculosis
DVNGIVFNRAFTGAVQTIYDA

SEQ ID NO: 1481626 - protein, 18 aa, Mycobacterium tuberculosis
DVNTGFWNGGPFNTGFGN

SEQ ID NO: 1481627 - protein, 22 aa, Mycobacterium tuberculosis
DVNYRLTLRNGVLIHRKLPADP

SEQ ID NO: 1481628 - protein, 24 aa, Mycobacterium tuberculosis
DVPAPRIIASGLFNAIPEAPPLTA

SEQ ID NO: 1481629 - protein, 18 aa, Mycobacterium tuberculosis
DVPGFGLVMFGAIREAST

SEQ ID NO: 1481630 - protein, 18 aa, Mycobacterium tuberculosis
DVPIVPVVVWGAQRIWTK

SEQ ID NO: 1481631 - protein, 21 aa, Mycobacterium tuberculosis
DVPSPFGLFPDVDWAEVAADL

SEQ ID NO: 1481632 - protein, 17 aa, Mycobacterium tuberculosis
DVPTPWLRQALTQTSRL

SEQ ID NO: 1481633 - protein, 18 aa, Mycobacterium tuberculosis
DVRAMHPLSAARLVQALF

SEQ ID NO: 1481634 - protein, 21 aa, Mycobacterium tuberculosis
DVRCAPAAFRFMSQARHIGKV

SEQ ID NO: 1481635 - protein, 25 aa, Mycobacterium tuberculosis
DVRGGALAPGTVRQWLAEHAGDGRR

SEQ ID NO: 1481636 - protein, 20 aa, Mycobacterium tuberculosis
DVRNGIDFKIADLSLADFGR

SEQ ID NO: 1481637 - protein, 22 aa, Mycobacterium tuberculosis
DVRRAPHAGGREVLRVEVGAPS

SEQ ID NO: 1481638 - protein, 21 aa, Mycobacterium tuberculosis
DVRTARIVTPRVMQFTLRANV

SEQ ID NO: 1481639 - protein, 24 aa, Mycobacterium tuberculosis
DVRVAHPLISRAHLLLRFDQGRWV

SEQ ID NO: 1481640 - protein, 17 aa, Mycobacterium tuberculosis
DVSDFGHRLLAYLRAAD

SEQ ID NO: 1481641 - protein, 20 aa, Mycobacterium tuberculosis
DVSDRLVGITSDIGSVTVAG

SEQ ID NO: 1481642 - protein, 18 aa, Mycobacterium tuberculosis
DVSFPLGVLTSVTGVSGS

SEQ ID NO: 1481643 - protein, 23 aa, Mycobacterium tuberculosis
DVSPLPSLAKRAADILRQDVGGQ

SEQ ID NO: 1481644 - protein, 25 aa, Mycobacterium tuberculosis
DVSRALRLTGRRVMLVPTMGALHEG

SEQ ID NO: 1481645 - protein, 18 aa, Mycobacterium tuberculosis
DVSTAWQLDAYRFEIPVV

SEQ ID NO: 1481646 - protein, 23 aa, Mycobacterium tuberculosis
DVTEQFGTPGWIISQGPQVLLDA

SEQ ID NO: 1481647 - protein, 21 aa, Mycobacterium tuberculosis
DVTHITRWAGCIGNRSTVIAV

SEQ ID NO: 1481648 - protein, 17 aa, Mycobacterium tuberculosis
DVTRAEFEYAVTHEGAL

SEQ ID NO: 1481649 - protein, 24 aa, Mycobacterium tuberculosis
DVTTLPAVISRWLSSVLPGGAAPE

SEQ ID NO: 1481650 - protein, 22 aa, Mycobacterium tuberculosis
DVTWLDCLGIPTVQAVRPASLT

SEQ ID NO: 1481651 - protein, 19 aa, Mycobacterium tuberculosis
DVVDGRPHLRLENRVLPAG

SEQ ID NO: 1481652 - protein, 24 aa, Mycobacterium tuberculosis
DVVFASHHWPTWGREKIVEFLSQQ

SEQ ID NO: 1481653 - protein, 18 aa, Mycobacterium tuberculosis
DVVRKDTHAHAWALRMSP

SEQ ID NO: 1481654 - protein, 19 aa, Mycobacterium tuberculosis
DVVSAWTGIPAGRLLEGET

SEQ ID NO: 1481655 - protein, 34 aa, Mycobacterium tuberculosis
DWAARARWANPAAWRLPGDDVFAVRGYAENALLQ

SEQ ID NO: 1481656 - protein, 28 aa, Mycobacterium tuberculosis
DWAARARWANPAAWRLPGDDVTALRGTA

SEQ ID NO: 1481657 - protein, 27 aa, Mycobacterium tuberculosis
DWAKASWAGGLRRPRALFEAVAAGPPG

SEQ ID NO: 1481658 - protein, 25 aa, Mycobacterium tuberculosis
DWAKQRGHRGLAYVLVAEDGTLGGP

SEQ ID NO: 1481659 - protein, 24 aa, Mycobacterium tuberculosis
DWDARVALHRARRPPTWLTVETAD

SEQ ID NO: 1481660 - protein, 18 aa, Mycobacterium tuberculosis
DWFISFVSGPVFTFSPTW

SEQ ID NO: 1481661 - protein, 19 aa, Mycobacterium tuberculosis
DWLGTAAFYRPEDYWPEQW

SEQ ID NO: 1481662 - protein, 19 aa, Mycobacterium tuberculosis
DWPRVRRDIANLGQAAEAC

SEQ ID NO: 1481663 - protein, 24 aa, Mycobacterium tuberculosis
DWVECARCAGMRAYLVDRSGQTRD

SEQ ID NO: 1481664 - protein, 19 aa, Mycobacterium tuberculosis
DWVNLVALAVNEENASGGR

SEQ ID NO: 1481665 - protein, 17 aa, Mycobacterium tuberculosis
DWVSMAVVSDGSYGVPE

SEQ ID NO: 1481666 - protein, 19 aa, Mycobacterium tuberculosis
DWYADLPVASPQVFGDQTD

SEQ ID NO: 1481667 - protein, 23 aa, Mycobacterium tuberculosis
DYFYRPFRDLVIRAAERADAPLR

SEQ ID NO: 1481668 - protein, 26 aa, Mycobacterium tuberculosis
DYGPQLDRIGCDQGKYLAIMEHGRPA

SEQ ID NO: 1481669 - protein, 33 aa, Mycobacterium tuberculosis
DYHARNPLRFAAPCPGQHGWRAPAAAAPPLDQV

SEQ ID NO: 1481670 - protein, 24 aa, Mycobacterium tuberculosis
DYHETFDLGPLVIFPPMNIPATVI

SEQ ID NO: 1481671 - protein, 21 aa, Mycobacterium tuberculosis
DYHLELAWPGRVWYQDYFAVQ

SEQ ID NO: 1481672 - protein, 23 aa, Mycobacterium tuberculosis
DYLATVITWHRHIAGLIEQAKSD

SEQ ID NO: 1481673 - protein, 24 aa, Mycobacterium tuberculosis
DYLGIPGPHGRWWSPSSRGRAATS

SEQ ID NO: 1481674 - protein, 25 aa, Mycobacterium tuberculosis
DYLPCLVSIQFRLCQTAKITSSTRR

SEQ ID NO: 1481675 - protein, 19 aa, Mycobacterium tuberculosis
DYLPCLVSIQFRLLPDGKD

SEQ ID NO: 1481676 - protein, 22 aa, Mycobacterium tuberculosis
DYLVTFASLWASVNVEDWKCWA

SEQ ID NO: 1481677 - protein, 25 aa, Mycobacterium tuberculosis
DYPARLDEFLAWTTRVANLLNSRPV

SEQ ID NO: 1481678 - protein, 30 aa, Mycobacterium tuberculosis
DYPDIPPRPDWKPTGAEPIAAAPAAAVSLR

SEQ ID NO: 1481679 - protein, 20 aa, Mycobacterium tuberculosis
DYRIAIRRIADGGGGSIEMH

SEQ ID NO: 1481680 - protein, 25 aa, Mycobacterium tuberculosis
DYTRTVDILERFYGLVLTDCGTGLL

SEQ ID NO: 1481681 - protein, 17 aa, Mycobacterium tuberculosis
DYVQEYLSRAGISKEQV

SEQ ID NO: 1481682 - protein, 27 aa, Mycobacterium tuberculosis
DYVYPGHAIWWLARGLEFFQDGEQFGE

SEQ ID NO: 1481683 - protein, 17 aa, Mycobacterium tuberculosis
DYWPEQWAHAYVDFAAG

SEQ ID NO: 1481684 - protein, 21 aa, Mycobacterium tuberculosis
EAAAAAPLEGLLNIVNTPTQL

SEQ ID NO: 1481685 - protein, 20 aa, Mycobacterium tuberculosis
EAAAFHGRFVQALTTGGGAY

SEQ ID NO: 1481686 - protein, 20 aa, Mycobacterium tuberculosis
EAAELGEYFAGMGYSALTTA

SEQ ID NO: 1481687 - protein, 22 aa, Mycobacterium tuberculosis
EAAELGEYFAGMGYSALTTAAL

SEQ ID NO: 1481688 - protein, 28 aa, Mycobacterium tuberculosis
EAAGWFGVAMILDFSWLPPEINSARIYA

SEQ ID NO: 1481689 - protein, 24 aa, Mycobacterium tuberculosis
EAANASPLQSAMGAVSASAQTLLS

SEQ ID NO: 1481690 - protein, 18 aa, Mycobacterium tuberculosis
EAARIALNPTQEWLDEFD

SEQ ID NO: 1481691 - protein, 19 aa, Mycobacterium tuberculosis
EAARIALNPTQEWLDEFDR

SEQ ID NO: 1481692 - protein, 20 aa, Mycobacterium tuberculosis
EAARLLGWERIPVHVCHTIA

SEQ ID NO: 1481693 - protein, 19 aa, Mycobacterium tuberculosis
EAARRTLNRPGFGLTESLH

SEQ ID NO: 1481694 - protein, 17 aa, Mycobacterium tuberculosis
EAARTWADRLIGAAAAG

SEQ ID NO: 1481695 - protein, 25 aa, Mycobacterium tuberculosis
EAAYPGRFLLGIGVGHAKMISEYRK

SEQ ID NO: 1481696 - protein, 17 aa, Mycobacterium tuberculosis
EACAGLWRGDQHACSRT

SEQ ID NO: 1481697 - protein, 19 aa, Mycobacterium tuberculosis
EACKRLANLDLRRTQFDAV

SEQ ID NO: 1481698 - protein, 21 aa, Mycobacterium tuberculosis
EADRLRCQVVAATGLQLDELI

SEQ ID NO: 1481699 - protein, 22 aa, Mycobacterium tuberculosis
EAEEKFGFLLEAFMFGAPPHGG

SEQ ID NO: 1481700 - protein, 18 aa, Mycobacterium tuberculosis
EAEGRKVLAREVDIRDDA

SEQ ID NO: 1481701 - protein, 22 aa, Mycobacterium tuberculosis
EAELKAALWELIWAGRVTGDTF

SEQ ID NO: 1481702 - protein, 18 aa, Mycobacterium tuberculosis
EAERLWRNHQLPPVGDVT

SEQ ID NO: 1481703 - protein, 19 aa, Mycobacterium tuberculosis
EAETRRLLTEAPFGSRNPD

SEQ ID NO: 1481704 - protein, 21 aa, Mycobacterium tuberculosis
EAFDAARMCIELLKQEVPIWK

SEQ ID NO: 1481705 - protein, 18 aa, Mycobacterium tuberculosis
EAFVKSCNTAFVQLGIRT

SEQ ID NO: 1481706 - protein, 19 aa, Mycobacterium tuberculosis
EAGDGVWAIYTVDADGGAR

SEQ ID NO: 1481707 - protein, 19 aa, Mycobacterium tuberculosis
EAGFPDWRSPRSAWHPSLP

SEQ ID NO: 1481708 - protein, 20 aa, Mycobacterium tuberculosis
EAGFRSGYLDVYQWTLIREG

SEQ ID NO: 1481709 - protein, 21 aa, Mycobacterium tuberculosis
EAGIGPSRTRLISGRAQEVLT

SEQ ID NO: 1481710 - protein, 18 aa, Mycobacterium tuberculosis
EAGKARWAAQEEIVDLIA

SEQ ID NO: 1481711 - protein, 20 aa, Mycobacterium tuberculosis
EAGLPRRGTPDAIVVVRDAD

SEQ ID NO: 1481712 - protein, 28 aa, Mycobacterium tuberculosis
EAGNGGSGGNGFDSFASGGTGGAGGTGG

SEQ ID NO: 1481713 - protein, 24 aa, Mycobacterium tuberculosis
EAGPRPHCGDAFRGSGVASGRSVG

SEQ ID NO: 1481714 - protein, 20 aa, Mycobacterium tuberculosis
EAGQLARLVGPSGHPVFRHA

SEQ ID NO: 1481715 - protein, 17 aa, Mycobacterium tuberculosis
EAHLRRHAPWGAQVTVT

SEQ ID NO: 1481716 - protein, 20 aa, Mycobacterium tuberculosis
EAILTGWRMLLDEGRLQDGE

SEQ ID NO: 1481717 - protein, 19 aa, Mycobacterium tuberculosis
EAIPVQIIWGTKDVVLPVR

SEQ ID NO: 1481718 - protein, 25 aa, Mycobacterium tuberculosis
EAKIKLSDMRSGRMSDDDWTRLARR

SEQ ID NO: 1481719 - protein, 20 aa, Mycobacterium tuberculosis
EAKTLCQACPRRWLCARDAV

SEQ ID NO: 1481720 - protein, 20 aa, Mycobacterium tuberculosis
EAKYAAKRVRRWMRRRYLLL

SEQ ID NO: 1481721 - protein, 17 aa, Mycobacterium tuberculosis
EALAAVATDLAGIGSTI

SEQ ID NO: 1481722 - protein, 24 aa, Mycobacterium tuberculosis
EALADGVVRPVVFLAYSGQARWRD

SEQ ID NO: 1481723 - protein, 28 aa, Mycobacterium tuberculosis
EALALTRFHIFSHSWGGMLAQQYVLDKA

SEQ ID NO: 1481724 - protein, 27 aa, Mycobacterium tuberculosis
EALARARRALNEFGVEGLATVIPFHRA

SEQ ID NO: 1481725 - protein, 22 aa, Mycobacterium tuberculosis
EALDRVGLCGWLAGLPEGLSTV

SEQ ID NO: 1481726 - protein, 18 aa, Mycobacterium tuberculosis
EALEHARIPASSLRGQAV

SEQ ID NO: 1481727 - protein, 20 aa, Mycobacterium tuberculosis
EALEHGRIAVAIAGVPFKCP

SEQ ID NO: 1481728 - protein, 17 aa, Mycobacterium tuberculosis
EALERAGIDPITLRGSQ

SEQ ID NO: 1481729 - protein, 18 aa, Mycobacterium tuberculosis
EALERAGIDPTGLRGSAH

SEQ ID NO: 1481730 - protein, 17 aa, Mycobacterium tuberculosis
EALGCTVRFGRTWCGFE

SEQ ID NO: 1481731 - protein, 23 aa, Mycobacterium tuberculosis
EALGKIYAGMGIVRHPEIREVRR

SEQ ID NO: 1481732 - protein, 21 aa, Mycobacterium tuberculosis
EALLALYRWRGPLINAGVGGH

SEQ ID NO: 1481733 - protein, 20 aa, Mycobacterium tuberculosis
EALLANMLPASIAERLKEPE

SEQ ID NO: 1481734 - protein, 17 aa, Mycobacterium tuberculosis
EALTMAASDLANIGSTI

SEQ ID NO: 1481735 - protein, 24 aa, Mycobacterium tuberculosis
EALTNWYVRRSRSRFWAEDADAID

SEQ ID NO: 1481736 - protein, 23 aa, Mycobacterium tuberculosis
EANLRLVVSLAKRYTGRGMAFLD

SEQ ID NO: 1481737 - protein, 17 aa, Mycobacterium tuberculosis
EANWPQHLAGAYVSSGM

SEQ ID NO: 1481738 - protein, 24 aa, Mycobacterium tuberculosis
EAPTLAGHALRFDEFGNIITDSAV

SEQ ID NO: 1481739 - protein, 26 aa, Mycobacterium tuberculosis
EAPVARRLRESCGGSKPAPAKGTAKS

SEQ ID NO: 1481740 - protein, 24 aa, Mycobacterium tuberculosis
EAPVARRLRESFGGSKPAPAKGTA

SEQ ID NO: 1481741 - protein, 25 aa, Mycobacterium tuberculosis
EAPVARRLRESFGGSKPAPAKGTAK

SEQ ID NO: 1481742 - protein, 21 aa, Mycobacterium tuberculosis
EAQRYLCRLADGIEVSYHHRA

SEQ ID NO: 1481743 - protein, 21 aa, Mycobacterium tuberculosis
EARCNAIAAAVLMPADVVRAR

SEQ ID NO: 1481744 - protein, 28 aa, Mycobacterium tuberculosis
EARGVPMTAGCVVPRGDVLELIDDIKDA

SEQ ID NO: 1481745 - protein, 20 aa, Mycobacterium tuberculosis
EARVGRALGELIAQMRPDSQ

SEQ ID NO: 1481746 - protein, 21 aa, Mycobacterium tuberculosis
EASGGGCRRDRRRGRPTTHAI

SEQ ID NO: 1481747 - protein, 24 aa, Mycobacterium tuberculosis
EASPGFCVIGLLVGGNFTPKIRFW

SEQ ID NO: 1481748 - protein, 24 aa, Mycobacterium tuberculosis
EATAAFGRGECYVERYLDKPRHVE

SEQ ID NO: 1481749 - protein, 22 aa, Mycobacterium tuberculosis
EATASPVSRVRRPAHRVDPAPL

SEQ ID NO: 1481750 - protein, 17 aa, Mycobacterium tuberculosis
EATFFNFEFPRNGFQLR

SEQ ID NO: 1481751 - protein, 21 aa, Mycobacterium tuberculosis
EATRRSWAVLGEMAELGEDAI

SEQ ID NO: 1481752 - protein, 18 aa, Mycobacterium tuberculosis
EATRVAVLRSFKDHWDRE

SEQ ID NO: 1481753 - protein, 21 aa, Mycobacterium tuberculosis
EATSAAPLQDLLGVVNAPAQA

SEQ ID NO: 1481754 - protein, 19 aa, Mycobacterium tuberculosis
EATVGVIHFFATHGTSMTN

SEQ ID NO: 1481755 - protein, 19 aa, Mycobacterium tuberculosis
EAVAAIAPMPPGAPEGMPP

SEQ ID NO: 1481756 - protein, 25 aa, Mycobacterium tuberculosis
EAVDAEIPLLVVITEGIPVQDTAYA

SEQ ID NO: 1481757 - protein, 17 aa, Mycobacterium tuberculosis
EAVDEFKKIIGVIQTSG

SEQ ID NO: 1481758 - protein, 19 aa, Mycobacterium tuberculosis
EAVDFELPAPGSYATGIAF

SEQ ID NO: 1481759 - protein, 18 aa, Mycobacterium tuberculosis
EAVEMFCYRAQRVRPDFR

SEQ ID NO: 1481760 - protein, 17 aa, Mycobacterium tuberculosis
EAVNLFRANVIDVSPES

SEQ ID NO: 1481761 - protein, 24 aa, Mycobacterium tuberculosis
EAVRAAMVQPALVAANRSDLVSLV

SEQ ID NO: 1481762 - protein, 19 aa, Mycobacterium tuberculosis
EAWLRWDSQDTVIADPRAW

SEQ ID NO: 1481763 - protein, 24 aa, Mycobacterium tuberculosis
EAYADMPLFLFHLLEYMDVDYELD

SEQ ID NO: 1481764 - protein, 20 aa, Mycobacterium tuberculosis
ECDEYLALQCGRSVHTRRAY

SEQ ID NO: 1481765 - protein, 19 aa, Mycobacterium tuberculosis
ECDSVVAAVSRLTSAQAPP

SEQ ID NO: 1481766 - protein, 20 aa, Mycobacterium tuberculosis
ECDYLYVSHLHKDHFDAENL

SEQ ID NO: 1481767 - protein, 18 aa, Mycobacterium tuberculosis
ECEAWVARGLRFTGPGWV

SEQ ID NO: 1481768 - protein, 19 aa, Mycobacterium tuberculosis
ECLLDRNALIMGYSGVYSS

SEQ ID NO: 1481769 - protein, 23 aa, Mycobacterium tuberculosis
ECSTRRCSSRPKAARQLDEALIP

SEQ ID NO: 1481770 - protein, 18 aa, Mycobacterium tuberculosis
ECVPVLMAALGKITGYDT

SEQ ID NO: 1481771 - protein, 20 aa, Mycobacterium tuberculosis
EDARFAAMVVLERLRPDQRV

SEQ ID NO: 1481772 - protein, 23 aa, Mycobacterium tuberculosis
EDDGILMGYGWHRGRDEGQLLLL

SEQ ID NO: 1481773 - protein, 22 aa, Mycobacterium tuberculosis
EDELRAAVSKYWKIDEIRPAFI

SEQ ID NO: 1481774 - protein, 21 aa, Mycobacterium tuberculosis
EDERLTPALVPLGDGVLAAVR

SEQ ID NO: 1481775 - protein, 19 aa, Mycobacterium tuberculosis
EDGEKRIPLDVAEGDTVIY

SEQ ID NO: 1481776 - protein, 17 aa, Mycobacterium tuberculosis
EDGMHRAGRAERRDSRD

SEQ ID NO: 1481777 - protein, 31 aa, Mycobacterium tuberculosis
EDHPPTCAKCVARGRISALGSLDLRYHSLRC

SEQ ID NO: 1481778 - protein, 17 aa, Mycobacterium tuberculosis
EDIWSTFTKLAPKQLIV

SEQ ID NO: 1481779 - protein, 18 aa, Mycobacterium tuberculosis
EDLARLPVGAALLEVGGG

SEQ ID NO: 1481780 - protein, 21 aa, Mycobacterium tuberculosis
EDLSWLWDVRFEHFEKTRVVA

SEQ ID NO: 1481781 - protein, 17 aa, Mycobacterium tuberculosis
EDLVGMCLFLLSDSASW

SEQ ID NO: 1481782 - protein, 19 aa, Mycobacterium tuberculosis
EDPAREFLPTGGRVLAVFE

SEQ ID NO: 1481783 - protein, 17 aa, Mycobacterium tuberculosis
EDRELLESFDLSYGDDE

SEQ ID NO: 1481784 - protein, 24 aa, Mycobacterium tuberculosis
EDRYSEIFAHSFARPTAIADGLAE

SEQ ID NO: 1481785 - protein, 22 aa, Mycobacterium tuberculosis
EDRYVVSVSRRGEMSYSFADLK

SEQ ID NO: 1481786 - protein, 17 aa, Mycobacterium tuberculosis
EDSRLPYLIRLPVGAGL

SEQ ID NO: 1481787 - protein, 18 aa, Mycobacterium tuberculosis
EDVCRNFTGVYGYLRANP

SEQ ID NO: 1481788 - protein, 18 aa, Mycobacterium tuberculosis
EDVRFSGGLATAIADGDS

SEQ ID NO: 1481789 - protein, 20 aa, Mycobacterium tuberculosis
EDWMTRLLLGFGSDVRVLAP

SEQ ID NO: 1481790 - protein, 18 aa, Mycobacterium tuberculosis
EDWWGRWLGRWTAEEHLH

SEQ ID NO: 1481791 - protein, 19 aa, Mycobacterium tuberculosis
EDWWGRWLGRWTAEEHLHA

SEQ ID NO: 1481792 - protein, 18 aa, Mycobacterium tuberculosis
EEAIRIATAAKREYEASV

SEQ ID NO: 1481793 - protein, 17 aa, Mycobacterium tuberculosis
EEARAAAYTIPSYEDQY

SEQ ID NO: 1481794 - protein, 28 aa, Mycobacterium tuberculosis
EEDKGLRTRSEMIAQLVFAMGGRAAEEL

SEQ ID NO: 1481795 - protein, 21 aa, Mycobacterium tuberculosis
EEEMRRHPAFLGRQRAAERSA

SEQ ID NO: 1481796 - protein, 17 aa, Mycobacterium tuberculosis
EEFKAQFEAAGLTYEHR

SEQ ID NO: 1481797 - protein, 24 aa, Mycobacterium tuberculosis
EEFSKVLADVCVRAPRIGLVSNVT

SEQ ID NO: 1481798 - protein, 17 aa, Mycobacterium tuberculosis
EEGARASFMPKPFGQHP

SEQ ID NO: 1481799 - protein, 24 aa, Mycobacterium tuberculosis
EEGRWRCSPMGPKALTSLRAAETE

SEQ ID NO: 1481800 - protein, 18 aa, Mycobacterium tuberculosis
EEIRRLVNGAAYLFTNDY

SEQ ID NO: 1481801 - protein, 24 aa, Mycobacterium tuberculosis
EELQPRLPAVMDRLDRAIPRGVGT

SEQ ID NO: 1481802 - protein, 18 aa, Mycobacterium tuberculosis
EELRRLPEELARVDALLD

SEQ ID NO: 1481803 - protein, 19 aa, Mycobacterium tuberculosis
EELRVGTPRGPNLFENMGF

SEQ ID NO: 1481804 - protein, 31 aa, Mycobacterium tuberculosis
EEMLEMAACGAKVLMLRCVEYARRHNIPVHV

SEQ ID NO: 1481805 - protein, 17 aa, Mycobacterium tuberculosis
EEMRRHPAFLGRQRAAE

SEQ ID NO: 1481806 - protein, 20 aa, Mycobacterium tuberculosis
EEPPRLACQSELPRRRSDRS

SEQ ID NO: 1481807 - protein, 23 aa, Mycobacterium tuberculosis
EERGGKYGSHWLVDNRPDLFDGI

SEQ ID NO: 1481808 - protein, 23 aa, Mycobacterium tuberculosis
EESNFPAIVKFLSEQVLSRATER

SEQ ID NO: 1481809 - protein, 20 aa, Mycobacterium tuberculosis
EESPAWGRRSHRVVMEKARL

SEQ ID NO: 1481810 - protein, 25 aa, Mycobacterium tuberculosis
EEVAPWLDLVRKLGVLAGVLSDELP

SEQ ID NO: 1481811 - protein, 22 aa, Mycobacterium tuberculosis
EEVLRLEGLEVIPSVLPPAPAG

SEQ ID NO: 1481812 - protein, 22 aa, Mycobacterium tuberculosis
EEVRDRLAASFPKIGPLMDDAR

SEQ ID NO: 1481813 - protein, 23 aa, Mycobacterium tuberculosis
EEVREYLAQLGFRTVNEAVGQAG

SEQ ID NO: 1481814 - protein, 20 aa, Mycobacterium tuberculosis
EEYCKRRLGLDAALGSIDRS

SEQ ID NO: 1481815 - protein, 20 aa, Mycobacterium tuberculosis
EEYHPCVISRIALLCDSVGW

SEQ ID NO: 1481816 - protein, 24 aa, Mycobacterium tuberculosis
EEYLRELTIWSGRYGSVAGVPARN

SEQ ID NO: 1481817 - protein, 28 aa, Mycobacterium tuberculosis
EFAAAFKPPLRWGIRMTGHRFFREYPYR

SEQ ID NO: 1481818 - protein, 24 aa, Mycobacterium tuberculosis
EFADVGAAPAWRNLRAPLSAIPST

SEQ ID NO: 1481819 - protein, 23 aa, Mycobacterium tuberculosis
EFATYAPGLWRYWAEHLDPDRAR

SEQ ID NO: 1481820 - protein, 19 aa, Mycobacterium tuberculosis
EFDAKLGRGPAVAVDDELM

SEQ ID NO: 1481821 - protein, 21 aa, Mycobacterium tuberculosis
EFDEHLLVRAGHAFQQVTGYH

SEQ ID NO: 1481822 - protein, 19 aa, Mycobacterium tuberculosis
EFDHQLTRIELRRMGYLQR

SEQ ID NO: 1481823 - protein, 27 aa, Mycobacterium tuberculosis
EFDSRAIGPGGLFLALPGARADGHDHA

SEQ ID NO: 1481824 - protein, 18 aa, Mycobacterium tuberculosis
EFELLAAAARDAFGLDVH

SEQ ID NO: 1481825 - protein, 20 aa, Mycobacterium tuberculosis
EFESAVGYSRAVRIGPLVVV

SEQ ID NO: 1481826 - protein, 19 aa, Mycobacterium tuberculosis
EFFDLIWRLMRFDKHGPLD

SEQ ID NO: 1481827 - protein, 20 aa, Mycobacterium tuberculosis
EFGCKEALFTLGDRPEARWR

SEQ ID NO: 1481828 - protein, 21 aa, Mycobacterium tuberculosis
EFHERVALHFGAAYGSSVLLD

SEQ ID NO: 1481829 - protein, 22 aa, Mycobacterium tuberculosis
EFINRLDDVLIFEGLNPEELVR

SEQ ID NO: 1481830 - protein, 23 aa, Mycobacterium tuberculosis
EFINRLDDVLIFEGLNPEELVRI

SEQ ID NO: 1481831 - protein, 20 aa, Mycobacterium tuberculosis
EFITGVLFYTGARALPFGDR

SEQ ID NO: 1481832 - protein, 19 aa, Mycobacterium tuberculosis
EFLSAAATDLANLGSTISA

SEQ ID NO: 1481833 - protein, 19 aa, Mycobacterium tuberculosis
EFPPLSWRRDLSVDALLAR

SEQ ID NO: 1481834 - protein, 23 aa, Mycobacterium tuberculosis
EFPRLMVYRGPRRKGVRYFGPYS

SEQ ID NO: 1481835 - protein, 23 aa, Mycobacterium tuberculosis
EFPVLPPEINSVLMYSGAGSSPL

SEQ ID NO: 1481836 - protein, 25 aa, Mycobacterium tuberculosis
EFQAEARQLLDLMVHSVYSNKDAFL

SEQ ID NO: 1481837 - protein, 19 aa, Mycobacterium tuberculosis
EFQPRAGSMAAALPYCDLF

SEQ ID NO: 1481838 - protein, 19 aa, Mycobacterium tuberculosis
EFQPRAGSMAATLPYCDLF

SEQ ID NO: 1481839 - protein, 18 aa, Mycobacterium tuberculosis
EFRASKIMLDRARNNDKI

SEQ ID NO: 1481840 - protein, 20 aa, Mycobacterium tuberculosis
EFTQRLAAAANAFVNAEATN

SEQ ID NO: 1481841 - protein, 17 aa, Mycobacterium tuberculosis
EGAGAGIVWAKVNTFGS

SEQ ID NO: 1481842 - protein, 27 aa, Mycobacterium tuberculosis
EGALVTLDWLGAHGFGQLLQHTVVVLN

SEQ ID NO: 1481843 - protein, 20 aa, Mycobacterium tuberculosis
EGCALCPSHSDIARAAPGPG

SEQ ID NO: 1481844 - protein, 21 aa, Mycobacterium tuberculosis
EGEAMLFGEYIRLMALVEYSA

SEQ ID NO: 1481845 - protein, 25 aa, Mycobacterium tuberculosis
EGEAMLFGEYIRLMALVEYSADEIR

SEQ ID NO: 1481846 - protein, 22 aa, Mycobacterium tuberculosis
EGELYFPGSPVLSVRGSFAECV

SEQ ID NO: 1481847 - protein, 22 aa, Mycobacterium tuberculosis
EGERGRRHWNWGWRRYTWPSAF

SEQ ID NO: 1481848 - protein, 18 aa, Mycobacterium tuberculosis
EGFARWLRESAAVGVTDT

SEQ ID NO: 1481849 - protein, 19 aa, Mycobacterium tuberculosis
EGFHAATVRRIRPGEQLVL

SEQ ID NO: 1481850 - protein, 19 aa, Mycobacterium tuberculosis
EGFLSTHLVAGVKPGPLCG

SEQ ID NO: 1481851 - protein, 32 aa, Mycobacterium tuberculosis
EGGAGGLALAPRARTAARALAVTAEPAGTAGL

SEQ ID NO: 1481852 - protein, 26 aa, Mycobacterium tuberculosis
EGGFGGPGLAGGLFGNPGNGGVGGIG

SEQ ID NO: 1481853 - protein, 32 aa, Mycobacterium tuberculosis
EGGIGALAGKSGFGGFGGLLLGADGYNAPEST

SEQ ID NO: 1481854 - protein, 26 aa, Mycobacterium tuberculosis
EGGLMPGFGGAPWVGGHWGLGGEGHS

SEQ ID NO: 1481855 - protein, 28 aa, Mycobacterium tuberculosis
EGGLMPGFGGAPWVGGHWGLGGEGHSGA

SEQ ID NO: 1481856 - protein, 18 aa, Mycobacterium tuberculosis
EGGLRAMRNFLSDSPDDT

SEQ ID NO: 1481857 - protein, 23 aa, Mycobacterium tuberculosis
EGGPRPTHFAGVLTVVLKLLQIV

SEQ ID NO: 1481858 - protein, 27 aa, Mycobacterium tuberculosis
EGHQRACIRGRWFIVAARPGVGKSTLG

SEQ ID NO: 1481859 - protein, 19 aa, Mycobacterium tuberculosis
EGIGSALAAANRAAEAPTT

SEQ ID NO: 1481860 - protein, 24 aa, Mycobacterium tuberculosis
EGIIAAAAIRCMGGAIQAQLAPRD

SEQ ID NO: 1481861 - protein, 19 aa, Mycobacterium tuberculosis
EGKIRTVYEPVVKTTIIAP

SEQ ID NO: 1481862 - protein, 18 aa, Mycobacterium tuberculosis
EGLGPFPTDRGWALRELF

SEQ ID NO: 1481863 - protein, 19 aa, Mycobacterium tuberculosis
EGLNMVLIAAWGHPLPNQL

SEQ ID NO: 1481864 - protein, 22 aa, Mycobacterium tuberculosis
EGLPYFSIGMGNNFIQSTKTLG

SEQ ID NO: 1481865 - protein, 17 aa, Mycobacterium tuberculosis
EGLRFAIREGGRTVGAG

SEQ ID NO: 1481866 - protein, 21 aa, Mycobacterium tuberculosis
EGMGVPARRVTTCEEFADALR

SEQ ID NO: 1481867 - protein, 19 aa, Mycobacterium tuberculosis
EGMPPIWNTYIAVDDVDAV

SEQ ID NO: 1481868 - protein, 19 aa, Mycobacterium tuberculosis
EGPGSIVVEGRDIRNRGVS

SEQ ID NO: 1481869 - protein, 26 aa, Mycobacterium tuberculosis
EGPSYTRPASWRGLDVPEGPTLRRPC

SEQ ID NO: 1481870 - protein, 20 aa, Mycobacterium tuberculosis
EGRDMLALTSAQWDITDPAA

SEQ ID NO: 1481871 - protein, 19 aa, Mycobacterium tuberculosis
EGRDMLALTSSQWDITDPA

SEQ ID NO: 1481872 - protein, 19 aa, Mycobacterium tuberculosis
EGRFELGLGAGHRSPNTTP

SEQ ID NO: 1481873 - protein, 18 aa, Mycobacterium tuberculosis
EGRGWPVLGDKTIVDYLA

SEQ ID NO: 1481874 - protein, 20 aa, Mycobacterium tuberculosis
EGRHDAELIAAVWGADLRIE

SEQ ID NO: 1481875 - protein, 20 aa, Mycobacterium tuberculosis
EGRLRRFDCSQMTDGGAGLV

SEQ ID NO: 1481876 - protein, 20 aa, Mycobacterium tuberculosis
EGRPRLRYWLDRLSTDGILA

SEQ ID NO: 1481877 - protein, 20 aa, Mycobacterium tuberculosis
EGRTAYLVMELVNGEPLNSV

SEQ ID NO: 1481878 - protein, 24 aa, Mycobacterium tuberculosis
EGRVTELLARLCLGQSAREAFLPH

SEQ ID NO: 1481879 - protein, 18 aa, Mycobacterium tuberculosis
EGSLGRLVVELEPDADSD

SEQ ID NO: 1481880 - protein, 19 aa, Mycobacterium tuberculosis
EGSSGMGVLRGRTGSRPRL

SEQ ID NO: 1481881 - protein, 17 aa, Mycobacterium tuberculosis
EGTQFGPYRLRRLVGRG

SEQ ID NO: 1481882 - protein, 18 aa, Mycobacterium tuberculosis
EGVDVPALDAVLFLNPRN

SEQ ID NO: 1481883 - protein, 18 aa, Mycobacterium tuberculosis
EGVLDVINAPALALLGRL

SEQ ID NO: 1481884 - protein, 19 aa, Mycobacterium tuberculosis
EGVTLRFGSKVPGTAMEVR

SEQ ID NO: 1481885 - protein, 21 aa, Mycobacterium tuberculosis
EGWAFEYSRFQEAQKREIVEH

SEQ ID NO: 1481886 - protein, 26 aa, Mycobacterium tuberculosis
EGWRMYTRARFAPYVEKLLLDGARTK

SEQ ID NO: 1481887 - protein, 17 aa, Mycobacterium tuberculosis
EHAVARWRAAGLVSPLL

SEQ ID NO: 1481888 - protein, 22 aa, Mycobacterium tuberculosis
EHDPGLVLRVARRVGRHRIAHW

SEQ ID NO: 1481889 - protein, 24 aa, Mycobacterium tuberculosis
EHFAEELVRIIGVLRGMQLKKVPS

SEQ ID NO: 1481890 - protein, 25 aa, Mycobacterium tuberculosis
EHGCGGDLFPPRPGQQIGGAQEHRG

SEQ ID NO: 1481891 - protein, 25 aa, Mycobacterium tuberculosis
EHGGLRLRRRSVLASAARRVLGVLP

SEQ ID NO: 1481892 - protein, 25 aa, Mycobacterium tuberculosis
EHGRWPRSVGLSVWGTSAMRTAGDD

SEQ ID NO: 1481893 - protein, 26 aa, Mycobacterium tuberculosis
EHHGIPWPRCIFIRCEPMARSPFPRG

SEQ ID NO: 1481894 - protein, 21 aa, Mycobacterium tuberculosis
EHKERRLAEIAASGVTRSGGV

SEQ ID NO: 1481895 - protein, 18 aa, Mycobacterium tuberculosis
EHLPLLAPLRAIPVIGPW

SEQ ID NO: 1481896 - protein, 21 aa, Mycobacterium tuberculosis
EHPDRAVAVLAALPAWTGEPE

SEQ ID NO: 1481897 - protein, 20 aa, Mycobacterium tuberculosis
EHPFPVWTERGGPATIVPMF

SEQ ID NO: 1481898 - protein, 19 aa, Mycobacterium tuberculosis
EHREPLGFQDGVLGGPVGL

SEQ ID NO: 1481899 - protein, 22 aa, Mycobacterium tuberculosis
EHRPDIRLARWMSTGFRQEPNG

SEQ ID NO: 1481900 - protein, 25 aa, Mycobacterium tuberculosis
EHYEKLEGVPLTFAGKINRLAIMVR

SEQ ID NO: 1481901 - protein, 22 aa, Mycobacterium tuberculosis
EIANRLCAQILLLAAEDASKDI

SEQ ID NO: 1481902 - protein, 24 aa, Mycobacterium tuberculosis
EIAQTVARWLVLYLRRPGGQTQFA

SEQ ID NO: 1481903 - protein, 31 aa, Mycobacterium tuberculosis
EIDGAAVDRIWRAARHWYRPGMHPAIQLCIR

SEQ ID NO: 1481904 - protein, 24 aa, Mycobacterium tuberculosis
EIDKVFVVACGTAYHSGLLAKYAI

SEQ ID NO: 1481905 - protein, 18 aa, Mycobacterium tuberculosis
EIDLRRLLYREAQQRGIY

SEQ ID NO: 1481906 - protein, 21 aa, Mycobacterium tuberculosis
EIDNWRWAGVPIFVRAGKELP

SEQ ID NO: 1481907 - protein, 22 aa, Mycobacterium tuberculosis
EIEALGYGAVWVGGSPPAALSC

SEQ ID NO: 1481908 - protein, 21 aa, Mycobacterium tuberculosis
EIEEALRYGVVKMNVDTDTQY

SEQ ID NO: 1481909 - protein, 23 aa, Mycobacterium tuberculosis
EIEPRSGRHLGNFPQAFTHLALI

SEQ ID NO: 1481910 - protein, 32 aa, Mycobacterium tuberculosis
EIGDAFLSRSCRWTLAAANLWQGNLEAAVGLS

SEQ ID NO: 1481911 - protein, 20 aa, Mycobacterium tuberculosis
EIGDAFPFTFMSLGAGRGES

SEQ ID NO: 1481912 - protein, 18 aa, Mycobacterium tuberculosis
EIGGWRLPAGTVVNTSIL

SEQ ID NO: 1481913 - protein, 23 aa, Mycobacterium tuberculosis
EIKGARAYHPTLLRKGERLLVFL

SEQ ID NO: 1481914 - protein, 18 aa, Mycobacterium tuberculosis
EINGQFFVEMRMIDGTSL

SEQ ID NO: 1481915 - protein, 18 aa, Mycobacterium tuberculosis
EINSGRMFFGAGSGPMLA

SEQ ID NO: 1481916 - protein, 19 aa, Mycobacterium tuberculosis
EINSLRMFIGAGTAPMLAA

SEQ ID NO: 1481917 - protein, 23 aa, Mycobacterium tuberculosis
EINSLRMFTGAGSAPMLAASVAW

SEQ ID NO: 1481918 - protein, 20 aa, Mycobacterium tuberculosis
EIPANRPGRAVSMEKHHLMI

SEQ ID NO: 1481919 - protein, 22 aa, Mycobacterium tuberculosis
EIPDPPPPGAVVVFSAHGVSPA

SEQ ID NO: 1481920 - protein, 19 aa, Mycobacterium tuberculosis
EIPEARHPTVAGVEETRRR

SEQ ID NO: 1481921 - protein, 22 aa, Mycobacterium tuberculosis
EIPKSSLGAGLGLRSGLSAGLA

SEQ ID NO: 1481922 - protein, 24 aa, Mycobacterium tuberculosis
EIPLDVGGCPLHVHPGQGGGDTVH

SEQ ID NO: 1481923 - protein, 22 aa, Mycobacterium tuberculosis
EIPPGFSHCLLLSEARVVAAGL

SEQ ID NO: 1481924 - protein, 27 aa, Mycobacterium tuberculosis
EIQHNGRLGLIGTRWRPIDPGPDRPRR

SEQ ID NO: 1481925 - protein, 23 aa, Mycobacterium tuberculosis
EIQRRGGPAMATRHPQPATAPII

SEQ ID NO: 1481926 - protein, 20 aa, Mycobacterium tuberculosis
EIQTRGAVTIVIAEEGDETV

SEQ ID NO: 1481927 - protein, 20 aa, Mycobacterium tuberculosis
EIRHALPGFNLRPSEAPGFF

SEQ ID NO: 1481928 - protein, 21 aa, Mycobacterium tuberculosis
EISAAIAALFGAHGRAYQAAS

SEQ ID NO: 1481929 - protein, 18 aa, Mycobacterium tuberculosis
EIVVAAATDLAGIGSAIS

SEQ ID NO: 1481930 - protein, 25 aa, Mycobacterium tuberculosis
EKACKRGEVTIGKMFVVDTGQLDGP

SEQ ID NO: 1481931 - protein, 17 aa, Mycobacterium tuberculosis
EKAIDSWIDRYDPAALR

SEQ ID NO: 1481932 - protein, 19 aa, Mycobacterium tuberculosis
EKDLRIAVDGGFLSVTEEG

SEQ ID NO: 1481933 - protein, 20 aa, Mycobacterium tuberculosis
EKDRECFAISAGGVVAVGKG

SEQ ID NO: 1481934 - protein, 22 aa, Mycobacterium tuberculosis
EKELERVRMASARAAATNAAAG

SEQ ID NO: 1481935 - protein, 19 aa, Mycobacterium tuberculosis
EKERMLVVINRAVELACTV

SEQ ID NO: 1481936 - protein, 17 aa, Mycobacterium tuberculosis
EKFPVLLGGAALTRSYV

SEQ ID NO: 1481937 - protein, 22 aa, Mycobacterium tuberculosis
EKGEGWGGITEGYWDGKPGIDM

SEQ ID NO: 1481938 - protein, 23 aa, Mycobacterium tuberculosis
EKGEGWGGITEGYWDGKPGIDMY

SEQ ID NO: 1481939 - protein, 18 aa, Mycobacterium tuberculosis
EKGFGMDFGALPPEINSG

SEQ ID NO: 1481940 - protein, 17 aa, Mycobacterium tuberculosis
EKGPRLGVLGVVVEIDG

SEQ ID NO: 1481941 - protein, 22 aa, Mycobacterium tuberculosis
EKKCLLDLVELVGFDTEIDHRA

SEQ ID NO: 1481942 - protein, 21 aa, Mycobacterium tuberculosis
EKLFSLICRYAVAYHVVFIPS

SEQ ID NO: 1481943 - protein, 19 aa, Mycobacterium tuberculosis
EKLLFKKGIHLLDCGTSGG

SEQ ID NO: 1481944 - protein, 19 aa, Mycobacterium tuberculosis
EKLRTKWVPERTKMLRELN

SEQ ID NO: 1481945 - protein, 18 aa, Mycobacterium tuberculosis
EKNFKWIARSADGWITTP

SEQ ID NO: 1481946 - protein, 30 aa, Mycobacterium tuberculosis
EKRSWLRARGLKIFPLVGWAERGGYDAQGH

SEQ ID NO: 1481947 - protein, 30 aa, Mycobacterium tuberculosis; identical to SEQ ID NO: 198569

SEQ ID NO: 1481948 - protein, 19 aa, Mycobacterium tuberculosis
EKTIPNWFFEPDIAADIVG

SEQ ID NO: 1481949 - protein, 20 aa, Mycobacterium tuberculosis
EKTIPNWFFEPDIAADIVGN

SEQ ID NO: 1481950 - protein, 21 aa, Mycobacterium tuberculosis
EKWQCDGCSITHQRDDNAAIN

SEQ ID NO: 1481951 - protein, 19 aa, Mycobacterium tuberculosis
ELAAELWLAAASFESVCSG

SEQ ID NO: 1481952 - protein, 21 aa, Mycobacterium tuberculosis
ELAAMVAPAGCYSGDGGNGGA

SEQ ID NO: 1481953 - protein, 18 aa, Mycobacterium tuberculosis
ELAAVGARVRLCKGAYDE

SEQ ID NO: 1481954 - protein, 21 aa, Mycobacterium tuberculosis
ELADRGLRVLILDQENRANVG

SEQ ID NO: 1481955 - protein, 18 aa, Mycobacterium tuberculosis
ELAEAFHAAGRYTAEANA

SEQ ID NO: 1481956 - protein, 19 aa, Mycobacterium tuberculosis
ELAHLGIRVNAIAPGLIRS

SEQ ID NO: 1481957 - protein, 32 aa, Mycobacterium tuberculosis
ELAMYSVMWSEHWSYKSSKVHLRYFGETTSDE

SEQ ID NO: 1481958 - protein, 21 aa, Mycobacterium tuberculosis
ELASCPPILVLTGRPDDTWLA

SEQ ID NO: 1481959 - protein, 20 aa, Mycobacterium tuberculosis
ELDASVAMDTFGKWVSPARL

SEQ ID NO: 1481960 - protein, 29 aa, Mycobacterium tuberculosis
ELDCPDFGLRLARWQGLGILGPVAVIARN

SEQ ID NO: 1481961 - protein, 30 aa, Mycobacterium tuberculosis
ELDFMRSCSIRHRMASVIFSLEMSKSEIVM

SEQ ID NO: 1481962 - protein, 22 aa, Mycobacterium tuberculosis
ELDSAGDLGDWGGPDALADLDP

SEQ ID NO: 1481963 - protein, 21 aa, Mycobacterium tuberculosis
ELEAFLRISVEHADAAGGDEC

SEQ ID NO: 1481964 - protein, 18 aa, Mycobacterium tuberculosis
ELENGHKVLAHISGKMRQ

SEQ ID NO: 1481965 - protein, 25 aa, Mycobacterium tuberculosis
ELEPEFVAQGGFSLRDVIAGGKELV

SEQ ID NO: 1481966 - protein, 26 aa, Mycobacterium tuberculosis
ELEPEFVAQGGFSLRDVIAGGKELVG

SEQ ID NO: 1481967 - protein, 24 aa, Mycobacterium tuberculosis
ELERRYDARLGVYVPATGTTAAIE

SEQ ID NO: 1481968 - protein, 34 aa, Mycobacterium tuberculosis
ELESFFRGAGWNVIKVVWGREWDALLHADRDGAL

SEQ ID NO: 1481969 - protein, 18 aa, Mycobacterium tuberculosis
ELFCTIRNFYDADPLAKA

SEQ ID NO: 1481970 - protein, 17 aa, Mycobacterium tuberculosis
ELFTAEAIWEMPPYTDW

SEQ ID NO: 1481971 - protein, 19 aa, Mycobacterium tuberculosis
ELFWALRGGGGGNFGVTTS

SEQ ID NO: 1481972 - protein, 21 aa, Mycobacterium tuberculosis
ELGANHALHGVLMATNFFGIN

SEQ ID NO: 1481973 - protein, 24 aa, Mycobacterium tuberculosis
ELGANHALHGVLMATNFFGINTIP

SEQ ID NO: 1481974 - protein, 29 aa, Mycobacterium tuberculosis
ELGANHALHGVLMATNFFGINTIPIALNG

SEQ ID NO: 1481975 - protein, 17 aa, Mycobacterium tuberculosis
ELGDKFLAALVGTIRDT

SEQ ID NO: 1481976 - protein, 19 aa, Mycobacterium tuberculosis
ELGEILGFGGMSEVHLARD

SEQ ID NO: 1481977 - protein, 17 aa, Mycobacterium tuberculosis
ELGLLTRLLRGISALGG

SEQ ID NO: 1481978 - protein, 18 aa, Mycobacterium tuberculosis
ELGLRVCDWVDGDDPYGL

SEQ ID NO: 1481979 - protein, 20 aa, Mycobacterium tuberculosis
ELGLRVCDWVDGDDPYGLVS

SEQ ID NO: 1481980 - protein, 18 aa, Mycobacterium tuberculosis
ELGLSYLLPRAIGSSRAF

SEQ ID NO: 1481981 - protein, 25 aa, Mycobacterium tuberculosis
ELGYKGLLAPLTFICVFGYKAQAAF

SEQ ID NO: 1481982 - protein, 26 aa, Mycobacterium tuberculosis
ELGYKGLLAPLTFICVFGYKAQAAFF

SEQ ID NO: 1481983 - protein, 17 aa, Mycobacterium tuberculosis
ELHEELIQAVGLTRDEA

SEQ ID NO: 1481984 - protein, 21 aa, Mycobacterium tuberculosis
ELHLGTVIVPRAPTAAGTLDR

SEQ ID NO: 1481985 - protein, 32 aa, Mycobacterium tuberculosis
ELHVRIASPPVKWPCFYGIDFPSPAELIANAV

SEQ ID NO: 1481986 - protein, 23 aa, Mycobacterium tuberculosis
ELIGLLARLGYRFAPTQIPGTVD

SEQ ID NO: 1481987 - protein, 28 aa, Mycobacterium tuberculosis
ELIRVRISPAWLRLDARFGSVYRHRGDA

SEQ ID NO: 1481988 - protein, 29 aa, Mycobacterium tuberculosis
ELIRVRISPAWLRLDARFGSVYRHRGHAA

SEQ ID NO: 1481989 - protein, 18 aa, Mycobacterium tuberculosis
ELKIDGVALSLVYREGRL

SEQ ID NO: 1481990 - protein, 23 aa, Mycobacterium tuberculosis
ELKKKPGIHAVHMAGGNKAEIAP

SEQ ID NO: 1481991 - protein, 26 aa, Mycobacterium tuberculosis
ELKLDRKIAERRVFPAVDVNPSGTRK

SEQ ID NO: 1481992 - protein, 18 aa, Mycobacterium tuberculosis
ELLACLQRLEVERRRQGA

SEQ ID NO: 1481993 - protein, 19 aa, Mycobacterium tuberculosis
ELLAGLAGVVAGRPEAGVV

SEQ ID NO: 1481994 - protein, 26 aa, Mycobacterium tuberculosis
ELLDLWAAAYPGVWAGPTNSWSPVVI

SEQ ID NO: 1481995 - protein, 23 aa, Mycobacterium tuberculosis
ELLDSWRNYQWHQLARAFLMYVT

SEQ ID NO: 1481996 - protein, 20 aa, Mycobacterium tuberculosis
ELLGIPWVELNPHPLYLPSK

SEQ ID NO: 1481997 - protein, 17 aa, Mycobacterium tuberculosis
ELLGWRASVHTDELARI

SEQ ID NO: 1481998 - protein, 17 aa, Mycobacterium tuberculosis
ELLRACGDIDGLERVRF

SEQ ID NO: 1481999 - protein, 19 aa, Mycobacterium tuberculosis
ELLSAVGALAEATRDGVVA

SEQ ID NO: 1482000 - protein, 17 aa, Mycobacterium tuberculosis
ELLSVAAGMPFPLFVKA

SEQ ID NO: 1482001 - protein, 18 aa, Mycobacterium tuberculosis
ELLTGCGRERRRAASPGR

SEQ ID NO: 1482002 - protein, 19 aa, Mycobacterium tuberculosis
ELLTRADLVICGGGHGMVA

SEQ ID NO: 1482003 - protein, 22 aa, Mycobacterium tuberculosis
ELLTRADLVICGGGHGMVAKTL

SEQ ID NO: 1482004 - protein, 20 aa, Mycobacterium tuberculosis
ELLVWLRDRLSHFKCPRSIA

SEQ ID NO: 1482005 - protein, 19 aa, Mycobacterium tuberculosis
ELLWSFAPPPRPRPVDGSE

SEQ ID NO: 1482006 - protein, 18 aa, Mycobacterium tuberculosis
ELMRAGTALTDIARMYGD

SEQ ID NO: 1482007 - protein, 20 aa, Mycobacterium tuberculosis
ELNTGFGNAGFVNTGFDNSG

SEQ ID NO: 1482008 - protein, 18 aa, Mycobacterium tuberculosis
ELNVMGAMQLFAACQKAP

SEQ ID NO: 1482009 - protein, 25 aa, Mycobacterium tuberculosis
ELPGDLAWQPPLWRALVTTVGADPA

SEQ ID NO: 1482010 - protein, 24 aa, Mycobacterium tuberculosis
ELPRGCIAAGDRAFFCDYVQEYLS

SEQ ID NO: 1482011 - protein, 19 aa, Mycobacterium tuberculosis
ELPRWSMIDQALGLGSPDP

SEQ ID NO: 1482012 - protein, 20 aa, Mycobacterium tuberculosis
ELPSDITFHRWCAALSTRWC

SEQ ID NO: 1482013 - protein, 20 aa, Mycobacterium tuberculosis
ELQDPKGQRWVMQTWSQVVD

SEQ ID NO: 1482014 - protein, 20 aa, Mycobacterium tuberculosis
ELQLWVAACLYKGGVDVYRT

SEQ ID NO: 1482015 - protein, 25 aa, Mycobacterium tuberculosis
ELRARFRPIFRPQFTLDGGVGARRH

SEQ ID NO: 1482016 - protein, 19 aa, Mycobacterium tuberculosis
ELRDLLGTVYRLTAAGELP

SEQ ID NO: 1482017 - protein, 18 aa, Mycobacterium tuberculosis
ELRDQRCRTPYCDAPIRH

SEQ ID NO: 1482018 - protein, 20 aa, Mycobacterium tuberculosis
ELRDRVAFVVDGRIVALDSP

SEQ ID NO: 1482019 - protein, 19 aa, Mycobacterium tuberculosis
ELREAIAAFSAVKPSLAWA

SEQ ID NO: 1482020 - protein, 17 aa, Mycobacterium tuberculosis
ELREIFSAVQIIADTER

SEQ ID NO: 1482021 - protein, 19 aa, Mycobacterium tuberculosis
ELRERAVRMVAEIRGQHDS

SEQ ID NO: 1482022 - protein, 19 aa, Mycobacterium tuberculosis
ELRQLWEDRGCPRMPPRPR

SEQ ID NO: 1482023 - protein, 21 aa, Mycobacterium tuberculosis
ELRRLIPPWVTLGSRLAALPK

SEQ ID NO: 1482024 - protein, 22 aa, Mycobacterium tuberculosis
ELRRLIPPWVTLGSRLAALPRP

SEQ ID NO: 1482025 - protein, 19 aa, Mycobacterium tuberculosis
ELRSYFATLMTPERREALS

SEQ ID NO: 1482026 - protein, 18 aa, Mycobacterium tuberculosis
ELSDPAAMMNSCPRPRRL

SEQ ID NO: 1482027 - protein, 21 aa, Mycobacterium tuberculosis
ELSEAAFRRFVAALDEPDEAA

SEQ ID NO: 1482028 - protein, 24 aa, Mycobacterium tuberculosis
ELSENLPGYIFSGVAPVVTEMLWG

SEQ ID NO: 1482029 - protein, 22 aa, Mycobacterium tuberculosis
ELSVWSRAAVQIAFALRAGANR

SEQ ID NO: 1482030 - protein, 24 aa, Mycobacterium tuberculosis
ELSVWSRAAVQIAFALRAGANRYA

SEQ ID NO: 1482031 - protein, 24 aa, Mycobacterium tuberculosis
ELTEKGRALAIAVMRKHRLAERLL

SEQ ID NO: 1482032 - protein, 22 aa, Mycobacterium tuberculosis
ELTELVCSNAAIVLGHSGTEID

SEQ ID NO: 1482033 - protein, 17 aa, Mycobacterium tuberculosis
ELTGGRRSFILVPGIDV

SEQ ID NO: 1482034 - protein, 18 aa, Mycobacterium tuberculosis
ELTGGRRSFILVPGIDVP

SEQ ID NO: 1482035 - protein, 19 aa, Mycobacterium tuberculosis
ELTIKTGRPLIGINDGAGA

SEQ ID NO: 1482036 - protein, 19 aa, Mycobacterium tuberculosis
ELTIWSGRYGSVAGVPARN

SEQ ID NO: 1482037 - protein, 19 aa, Mycobacterium tuberculosis
ELTLHPGVMTGYAHGELAD

SEQ ID NO: 1482038 - protein, 22 aa, Mycobacterium tuberculosis
ELTRVRFGALDLRIDTKPDLTP

SEQ ID NO: 1482039 - protein, 23 aa, Mycobacterium tuberculosis
ELVDARYGALGVRGYDHRLVEFV

SEQ ID NO: 1482040 - protein, 19 aa, Mycobacterium tuberculosis
ELWARAGTLATALSAEPAI

SEQ ID NO: 1482041 - protein, 20 aa, Mycobacterium tuberculosis
ELWDKLTGWVTGLFSRGWSN

SEQ ID NO: 1482042 - protein, 20 aa, Mycobacterium tuberculosis
ELYEKFFRIGFKKQAEALGI

SEQ ID NO: 1482043 - protein, 18 aa, Mycobacterium tuberculosis
EMAFKIAGSQVLKKAAAL

SEQ ID NO: 1482044 - protein, 20 aa, Mycobacterium tuberculosis
EMCRRCPVIEACRSHALEVG

SEQ ID NO: 1482045 - protein, 20 aa, Mycobacterium tuberculosis
EMIKTGGFDAVCFTSSSTVR

SEQ ID NO: 1482046 - protein, 18 aa, Mycobacterium tuberculosis
EMLATAAADVDGIGSAIR

SEQ ID NO: 1482047 - protein, 17 aa, Mycobacterium tuberculosis
EMLGAAATDLASIGSAI

SEQ ID NO: 1482048 - protein, 21 aa, Mycobacterium tuberculosis
EMLTMGFADDVERILSETPKY

SEQ ID NO: 1482049 - protein, 20 aa, Mycobacterium tuberculosis
EMLTTAATDLAKIGSTITAA

SEQ ID NO: 1482050 - protein, 23 aa, Mycobacterium tuberculosis
EMMMPFLEHFVMRSRYVDNPGLF

SEQ ID NO: 1482051 - protein, 19 aa, Mycobacterium tuberculosis
EMNPNGGMLARFPDLTLPT

SEQ ID NO: 1482052 - protein, 20 aa, Mycobacterium tuberculosis
EMQRTEGFTALIDANRGCFA

SEQ ID NO: 1482053 - protein, 39 aa, Mycobacterium tuberculosis
EMQRTEGFTALIDAYRGCFAAFCAVLRVRGAVIAAVNGF

SEQ ID NO: 1482054 - protein, 25 aa, Mycobacterium tuberculosis
EMRGMCLYFDELPVIVLNGSDHPRP

SEQ ID NO: 1482055 - protein, 19 aa, Mycobacterium tuberculosis
EMRLNRQLADIEKLQVNVR

SEQ ID NO: 1482056 - protein, 17 aa, Mycobacterium tuberculosis
EMRQWLRNWVGKAVGKA

SEQ ID NO: 1482057 - protein, 23 aa, Mycobacterium tuberculosis
ENAIWKARTQGVGYLDLTGCMAL

SEQ ID NO: 1482058 - protein, 18 aa, Mycobacterium tuberculosis
ENFSRRFVPTSFIVSAIA

SEQ ID NO: 1482059 - protein, 30 aa, Mycobacterium tuberculosis
ENHRKRIGELWARFSAVAADNPHAWIRNPV

SEQ ID NO: 1482060 - protein, 25 aa, Mycobacterium tuberculosis
ENHRLVATRLCWPDQAKADELQHAL

SEQ ID NO: 1482061 - protein, 19 aa, Mycobacterium tuberculosis
ENLEDAGVSWKVYQNKGLG

SEQ ID NO: 1482062 - protein, 40 aa, Mycobacterium tuberculosis; identical to SEQ ID NO: 156675

SEQ ID NO: 1482063 - protein, 17 aa, Mycobacterium tuberculosis
ENLRRIEPLLATLRAIA

SEQ ID NO: 1482064 - protein, 17 aa, Mycobacterium tuberculosis
ENLRRWSGMHRRDGMAG

SEQ ID NO: 1482065 - protein, 23 aa, Mycobacterium tuberculosis
ENLSCSVIKCVALTFDDGPGPYT

SEQ ID NO: 1482066 - protein, 26 aa, Mycobacterium tuberculosis
ENPHFYQNFIHEFGMSGSRRHVTAAS

SEQ ID NO: 1482067 - protein, 17 aa, Mycobacterium tuberculosis
ENRCELLAFRHDLDPND

SEQ ID NO: 1482068 - protein, 23 aa, Mycobacterium tuberculosis
ENRLKIARLLALIDMLSDRFIGE

SEQ ID NO: 1482069 - protein, 23 aa, Mycobacterium tuberculosis
ENRPDCIYLGAAGHVLGTGHTLR

SEQ ID NO: 1482070 - protein, 29 aa, Mycobacterium tuberculosis
ENRVRHVPVLDGKKLIGIVSIGDVVKSRM

SEQ ID NO: 1482071 - protein, 32 aa, Mycobacterium tuberculosis
ENVPISPIWLCPLRLRDHAGWPLYPIRPDRSY

SEQ ID NO: 1482072 - protein, 19 aa, Mycobacterium tuberculosis
ENWARLGTFNVPNPVGSLA

SEQ ID NO: 1482073 - protein, 19 aa, Mycobacterium tuberculosis
ENYILLEWGIDRDFEHYRK

SEQ ID NO: 1482074 - protein, 20 aa, Mycobacterium tuberculosis
EPADLIARVRSTTVDAGRRF

SEQ ID NO: 1482075 - protein, 18 aa, Mycobacterium tuberculosis
EPAILRPSFRNWDHPYRR

SEQ ID NO: 1482076 - protein, 20 aa, Mycobacterium tuberculosis
EPARLLSQFIHGIKTLPVTW

SEQ ID NO: 1482077 - protein, 25 aa, Mycobacterium tuberculosis
EPARSSPIAGRWPGRSGTRPRAEAA

SEQ ID NO: 1482078 - protein, 20 aa, Mycobacterium tuberculosis
EPCSSLDPISTMAIEDLISE

SEQ ID NO: 1482079 - protein, 25 aa, Mycobacterium tuberculosis
EPDERGMRTVMCILNGQLRPVLVRD

SEQ ID NO: 1482080 - protein, 24 aa, Mycobacterium tuberculosis
EPEDFVGALIYLLSDALELLHRAG

SEQ ID NO: 1482081 - protein, 25 aa, Mycobacterium tuberculosis
EPEHLRLARQAFAEAGIGPSRTRLI

SEQ ID NO: 1482082 - protein, 22 aa, Mycobacterium tuberculosis
EPEPHWGPFGGAAPVSAGVGHA

SEQ ID NO: 1482083 - protein, 17 aa, Mycobacterium tuberculosis
EPFGCLKPAPPPDGVGV

SEQ ID NO: 1482084 - protein, 21 aa, Mycobacterium tuberculosis
EPFPLAPMQHAMWVGRHDHQQ

SEQ ID NO: 1482085 - protein, 25 aa, Mycobacterium tuberculosis
EPGFGVPWLYNYIGQPWKTQRTVDR

SEQ ID NO: 1482086 - protein, 21 aa, Mycobacterium tuberculosis
EPGGLRAAAYVNPSRPSSSPP

SEQ ID NO: 1482087 - protein, 24 aa, Mycobacterium tuberculosis
EPGHICPISMTYAVVPALRYNSEL

SEQ ID NO: 1482088 - protein, 26 aa, Mycobacterium tuberculosis
EPHYRPSAKLAEFVRMRDLTCRFPGC

SEQ ID NO: 1482089 - protein, 25 aa, Mycobacterium tuberculosis
EPITDSWYLTSIRAGLEHWSDGVGL

SEQ ID NO: 1482090 - protein, 23 aa, Mycobacterium tuberculosis
EPKPMVYSGLYPVDGSDYPNLRD

SEQ ID NO: 1482091 - protein, 22 aa, Mycobacterium tuberculosis
EPKYWGGVCVYVGCITSQALLR

SEQ ID NO: 1482092 - protein, 17 aa, Mycobacterium tuberculosis
EPLAVPVADSYARELAA

SEQ ID NO: 1482093 - protein, 18 aa, Mycobacterium tuberculosis
EPLPRWWRPAGSLFDQFL

SEQ ID NO: 1482094 - protein, 24 aa, Mycobacterium tuberculosis
EPLPRWWRPAGSLFDQFLGAAETD

SEQ ID NO: 1482095 - protein, 21 aa, Mycobacterium tuberculosis
EPNMRWRTFCDELLAVIDKLN

SEQ ID NO: 1482096 - protein, 21 aa, Mycobacterium tuberculosis
EPNQALGWLPMQDIDAAAEAA

SEQ ID NO: 1482097 - protein, 22 aa, Mycobacterium tuberculosis
EPNQALGWLPMQDIGAAAAAAA

SEQ ID NO: 1482098 - protein, 24 aa, Mycobacterium tuberculosis
EPPPEHVLVAFGLAGAQPILLGAG

SEQ ID NO: 1482099 - protein, 22 aa, Mycobacterium tuberculosis
EPPSAGVRPAIHLPLEDPYQMP

SEQ ID NO: 1482100 - protein, 24 aa, Mycobacterium tuberculosis
EPPTRPAPQHSRRARRGHRYRTDT

SEQ ID NO: 1482101 - protein, 32 aa, Mycobacterium tuberculosis
EPPTRPAPQHSRRARRGSPLSHRHRTKRREGS

SEQ ID NO: 1482102 - protein, 20 aa, Mycobacterium tuberculosis
EPQAGRFVSQYAIDLAHNAG

SEQ ID NO: 1482103 - protein, 25 aa, Mycobacterium tuberculosis
EPRESDIWLLGAIGPRMVYSTNLDA

SEQ ID NO: 1482104 - protein, 20 aa, Mycobacterium tuberculosis
EPRKIFDLLEHAPVDVAVLT

SEQ ID NO: 1482105 - protein, 20 aa, Mycobacterium tuberculosis
EPRLAELGGPVLVRSRRRPR

SEQ ID NO: 1482106 - protein, 28 aa, Mycobacterium tuberculosis
EPRRRGRRGVAEPWRRRDIDDRDAAVGH

SEQ ID NO: 1482107 - protein, 21 aa, Mycobacterium tuberculosis
EPRVYRRAVAYGMPGVSVDGN

SEQ ID NO: 1482108 - protein, 22 aa, Mycobacterium tuberculosis
EPRVYRRAVAYGMPGVSVDGND

SEQ ID NO: 1482109 - protein, 22 aa, Mycobacterium tuberculosis
EPSDFRLWVCLHEVTHRVQFTA

SEQ ID NO: 1482110 - protein, 24 aa, Mycobacterium tuberculosis
EPSDFRLWVCLHEVTHRVQFTANS

SEQ ID NO: 1482111 - protein, 28 aa, Mycobacterium tuberculosis
EPSPSGAPMRWARWPPALIGLPAAAVIP

SEQ ID NO: 1482112 - protein, 20 aa, Mycobacterium tuberculosis
EPTFRRSVIYIVEHNDGGTL

SEQ ID NO: 1482113 - protein, 20 aa, Mycobacterium tuberculosis
EPTFVPVLGRIAAGGPILAE

SEQ ID NO: 1482114 - protein, 22 aa, Mycobacterium tuberculosis
EPTGDGLVEWEGIGTVEAWTTP

SEQ ID NO: 1482115 - protein, 20 aa, Mycobacterium tuberculosis
EPTGVAAWQLARMNLARMTH

SEQ ID NO: 1482116 - protein, 26 aa, Mycobacterium tuberculosis
EPTRAAICRFATWWVVLERHGNLVRL

SEQ ID NO: 1482117 - protein, 24 aa, Mycobacterium tuberculosis
EPTVLPSRFPNLLANGSGGIAVGM

SEQ ID NO: 1482118 - protein, 20 aa, Mycobacterium tuberculosis
EPVAVVGMGCRYPGGVDSPE

SEQ ID NO: 1482119 - protein, 17 aa, Mycobacterium tuberculosis
EPVDISGIWPVRTVHDA

SEQ ID NO: 1482120 - protein, 18 aa, Mycobacterium tuberculosis
EPVVGGWTGGRITVSSSS

SEQ ID NO: 1482121 - protein, 20 aa, Mycobacterium tuberculosis
EPYLPLRAVRHLEKGRVVIF

SEQ ID NO: 1482122 - protein, 22 aa, Mycobacterium tuberculosis
EQDGIKFLCPVPGYDRHFAITE

SEQ ID NO: 1482123 - protein, 19 aa, Mycobacterium tuberculosis
EQDQPWMISELDLRQMLHV

SEQ ID NO: 1482124 - protein, 23 aa, Mycobacterium tuberculosis
EQIDPRWAKLVEMLGPESDILRG

SEQ ID NO: 1482125 - protein, 18 aa, Mycobacterium tuberculosis
EQIIAVDGAHLWHPYSSI

SEQ ID NO: 1482126 - protein, 25 aa, Mycobacterium tuberculosis
EQIIAVDGAHLWHPYSSIGREAVSP

SEQ ID NO: 1482127 - protein, 18 aa, Mycobacterium tuberculosis
EQLDRLGATRTRIVVSGD

SEQ ID NO: 1482128 - protein, 18 aa, Mycobacterium tuberculosis
EQLLHAFAGQGPTIGSLL

SEQ ID NO: 1482129 - protein, 17 aa, Mycobacterium tuberculosis
EQLTLVSWVFGEHLGAV

SEQ ID NO: 1482130 - protein, 22 aa, Mycobacterium tuberculosis
EQLWAADVAAMVSYHSGASAVA

SEQ ID NO: 1482131 - protein, 17 aa, Mycobacterium tuberculosis
EQMWAADVAAMVGYHSG

SEQ ID NO: 1482132 - protein, 27 aa, Mycobacterium tuberculosis
EQMWAQDVAAMFGYHAGASAAVSALTP

SEQ ID NO: 1482133 - protein, 18 aa, Mycobacterium tuberculosis
EQPPERRVSVLLHGDAAA

SEQ ID NO: 1482134 - protein, 17 aa, Mycobacterium tuberculosis
EQPRLFYMHFWAENDAV

SEQ ID NO: 1482135 - protein, 24 aa, Mycobacterium tuberculosis
EQRPSFRRTVKWRTGSEGRISTLK

SEQ ID NO: 1482136 - protein, 17 aa, Mycobacterium tuberculosis
EQRRADALGALAGGADR

SEQ ID NO: 1482137 - protein, 18 aa, Mycobacterium tuberculosis
EQRRADALGALAGGADRL

SEQ ID NO: 1482138 - protein, 25 aa, Mycobacterium tuberculosis
EQRRWAAEGVQRGWQATMVLTEPDA

SEQ ID NO: 1482139 - protein, 18 aa, Mycobacterium tuberculosis
ERAGAPGCREGFAEAVCR

SEQ ID NO: 1482140 - protein, 19 aa, Mycobacterium tuberculosis
ERAGAVVSGVCHAGVVATG

SEQ ID NO: 1482141 - protein, 29 aa, Mycobacterium tuberculosis
ERAHDYWSARFCPGRVFASPADFNAQLGA

SEQ ID NO: 1482142 - protein, 19 aa, Mycobacterium tuberculosis
ERALALMVNRVRNRVAFGR

SEQ ID NO: 1482143 - protein, 18 aa, Mycobacterium tuberculosis
ERAPAPALHRLTVGALRA

SEQ ID NO: 1482144 - protein, 17 aa, Mycobacterium tuberculosis
ERAQRFRCPGGVRRDSC

SEQ ID NO: 1482145 - protein, 19 aa, Mycobacterium tuberculosis
ERARARRCALCSDAVPDRR

SEQ ID NO: 1482146 - protein, 18 aa, Mycobacterium tuberculosis
ERARIMFMIGTLTPDRVT

SEQ ID NO: 1482147 - protein, 17 aa, Mycobacterium tuberculosis
ERARKHGDLESGPLKSV

SEQ ID NO: 1482148 - protein, 19 aa, Mycobacterium tuberculosis
ERATAQRFADWLVRVVEAF

SEQ ID NO: 1482149 - protein, 40 aa, Mycobacterium tuberculosis
ERAYPIRALPGCPGERCRRCPGCRNATGRQRLHGRVASRP

SEQ ID NO: 1482150 - protein, 20 aa, Mycobacterium tuberculosis
ERCAFGLQLIAPRLPPFDVP

SEQ ID NO: 1482151 - protein, 22 aa, Mycobacterium tuberculosis
ERCARVAGLAVRHARLRQVAPA

SEQ ID NO: 1482152 - protein, 20 aa, Mycobacterium tuberculosis
ERCGRFLKVLSQVGYQQADH

SEQ ID NO: 1482153 - protein, 22 aa, Mycobacterium tuberculosis
ERCNYVKEAPGWRVSTDTDETG

SEQ ID NO: 1482154 - protein, 24 aa, Mycobacterium tuberculosis
ERDRPRISLGPLQVAEHLRDCTAG

SEQ ID NO: 1482155 - protein, 24 aa, Mycobacterium tuberculosis
ERDVFPGGCFFAAAAADVDSQPGP

SEQ ID NO: 1482156 - protein, 23 aa, Mycobacterium tuberculosis
ERELRDQLIRCWSQVTTQRDGTV

SEQ ID NO: 1482157 - protein, 19 aa, Mycobacterium tuberculosis
ERERDRALGLLTFTTDLND

SEQ ID NO: 1482158 - protein, 18 aa, Mycobacterium tuberculosis
ERFYGSSHAGSWLYGLPE

SEQ ID NO: 1482159 - protein, 27 aa, Mycobacterium tuberculosis
ERGEPPVLRRCRWCGARAAKRTAAHVR

SEQ ID NO: 1482160 - protein, 19 aa, Mycobacterium tuberculosis
ERGGFRMAVDAAVQAAKSR

SEQ ID NO: 1482161 - protein, 25 aa, Mycobacterium tuberculosis
ERGRKLLTMRLPRALFQPSSDPKPR

SEQ ID NO: 1482162 - protein, 24 aa, Mycobacterium tuberculosis
ERGRKRISPATPQPRYCSMSSDPK

SEQ ID NO: 1482163 - protein, 17 aa, Mycobacterium tuberculosis
ERHAKAGVMTPVSACAS

SEQ ID NO: 1482164 - protein, 17 aa, Mycobacterium tuberculosis
ERHIACTRLPDLRESMR

SEQ ID NO: 1482165 - protein, 17 aa, Mycobacterium tuberculosis
ERIARGVPVAAPWDARR

SEQ ID NO: 1482166 - protein, 19 aa, Mycobacterium tuberculosis
ERIGVAACNTARCVDYVGA

SEQ ID NO: 1482167 - protein, 27 aa, Mycobacterium tuberculosis
ERIIARMLAVMLRRRMQEAGMDTGGVE

SEQ ID NO: 1482168 - protein, 17 aa, Mycobacterium tuberculosis
ERIKALIGTKCRGDRAP

SEQ ID NO: 1482169 - protein, 19 aa, Mycobacterium tuberculosis
ERILYYTGINYKIGEVHDG

SEQ ID NO: 1482170 - protein, 19 aa, Mycobacterium tuberculosis
ERISEKFPTSGIAVLRVAG

SEQ ID NO: 1482171 - protein, 20 aa, Mycobacterium tuberculosis
ERISNALVAMAIESLGAHAR

SEQ ID NO: 1482172 - protein, 24 aa, Mycobacterium tuberculosis
ERLAEMPRVLRLCAARTGAELNVS

SEQ ID NO: 1482173 - protein, 30 aa, Mycobacterium tuberculosis
ERLAFYRTLYRDLARYGAALWLVAANMASY

SEQ ID NO: 1482174 - protein, 27 aa, Mycobacterium tuberculosis
ERLCRRLADQAVRQWGFMQGLKQKLGP

SEQ ID NO: 1482175 - protein, 20 aa, Mycobacterium tuberculosis
ERLDDRFQFGVLLTAAPEAT

SEQ ID NO: 1482176 - protein, 22 aa, Mycobacterium tuberculosis
ERLDGSVLLARMRQIAARNADG

SEQ ID NO: 1482177 - protein, 18 aa, Mycobacterium tuberculosis
ERLPCGELSAHAVVPRTC

SEQ ID NO: 1482178 - protein, 28 aa, Mycobacterium tuberculosis
ERLRPDQRVAFVLHDGFAVPFAEVAEVL

SEQ ID NO: 1482179 - protein, 17 aa, Mycobacterium tuberculosis
ERLTECVARAADSGIAI

SEQ ID NO: 1482180 - protein, 17 aa, Mycobacterium tuberculosis
ERLVRRGVPAVVLNAKN

SEQ ID NO: 1482181 - protein, 25 aa, Mycobacterium tuberculosis
ERNLSVALNEVFAGFNPLDPRNLDV

SEQ ID NO: 1482182 - protein, 29 aa, Mycobacterium tuberculosis
ERPANLFVAGFIGSPAMNFFPARLTAIGL

SEQ ID NO: 1482183 - protein, 24 aa, Mycobacterium tuberculosis
ERPLPREWCAGGVRNSVLGNRQRP

SEQ ID NO: 1482184 - protein, 19 aa, Mycobacterium tuberculosis
ERRISESFAASRSTRRSPI

SEQ ID NO: 1482185 - protein, 18 aa, Mycobacterium tuberculosis
ERRYIMVIESLQPADDAT

SEQ ID NO: 1482186 - protein, 23 aa, Mycobacterium tuberculosis
ERRYRAWIRWNAAIMVHRAQRPG

SEQ ID NO: 1482187 - protein, 20 aa, Mycobacterium tuberculosis
ERSETRFARISPPRSCSPLV

SEQ ID NO: 1482188 - protein, 28 aa, Mycobacterium tuberculosis
ERTLFRRLAVFVGCFFVDDAQAVACSGD

SEQ ID NO: 1482189 - protein, 17 aa, Mycobacterium tuberculosis
ERTLRCLGPVFIGSGEK

SEQ ID NO: 1482190 - protein, 21 aa, Mycobacterium tuberculosis
ERTTLAWTRTAFALLVNGVLL

SEQ ID NO: 1482191 - protein, 24 aa, Mycobacterium tuberculosis
ERTWRYLKVPCVIEFWDENGGAAS

SEQ ID NO: 1482192 - protein, 19 aa, Mycobacterium tuberculosis
ERWREYCLSSVTTHDLPPT

SEQ ID NO: 1482193 - protein, 18 aa, Mycobacterium tuberculosis
ERYDAFFSLAHRLLPADG

SEQ ID NO: 1482194 - protein, 21 aa, Mycobacterium tuberculosis
ERYKLVWKNRLGFARLAIQHG

SEQ ID NO: 1482195 - protein, 20 aa, Mycobacterium tuberculosis
ERYMKLLAPRWQMMSDPHLT

SEQ ID NO: 1482196 - protein, 20 aa, Mycobacterium tuberculosis
ERYMKLLAPRWQMMSDPQLT

SEQ ID NO: 1482197 - protein, 22 aa, Mycobacterium tuberculosis
ERYRTKMIWWDRRTLANHAEPK

SEQ ID NO: 1482198 - protein, 19 aa, Mycobacterium tuberculosis
ESAARAAALITIADPQRPT

SEQ ID NO: 1482199 - protein, 20 aa, Mycobacterium tuberculosis
ESAARAAALITIADPQRPTH

SEQ ID NO: 1482200 - protein, 19 aa, Mycobacterium tuberculosis
ESAELRWVAENEVADLPLH

SEQ ID NO: 1482201 - protein, 24 aa, Mycobacterium tuberculosis
ESALFAADLARMYIRYAERHGWAV

SEQ ID NO: 1482202 - protein, 17 aa, Mycobacterium tuberculosis
ESALRFVGAATFEALSG

SEQ ID NO: 1482203 - protein, 22 aa, Mycobacterium tuberculosis
ESARELDVWLPVHPVTRRRWPN

SEQ ID NO: 1482204 - protein, 18 aa, Mycobacterium tuberculosis
ESCTAGLLAARLTDRPGS

SEQ ID NO: 1482205 - protein, 19 aa, Mycobacterium tuberculosis
ESEPMIIGKAFAVKVNANI

SEQ ID NO: 1482206 - protein, 19 aa, Mycobacterium tuberculosis
ESFGAHRRLALSTVGASGA

SEQ ID NO: 1482207 - protein, 19 aa, Mycobacterium tuberculosis
ESFLGGAYHPVFAAGPAAD

SEQ ID NO: 1482208 - protein, 17 aa, Mycobacterium tuberculosis
ESFWQLLADGVDTIEQV

SEQ ID NO: 1482209 - protein, 25 aa, Mycobacterium tuberculosis
ESGMLGGLSVPLSWGVAVPPDDYDH

SEQ ID NO: 1482210 - protein, 18 aa, Mycobacterium tuberculosis
ESGRRVRINDLWIAAVAA

SEQ ID NO: 1482211 - protein, 20 aa, Mycobacterium tuberculosis
ESIASMAAFAWLNSHGEGGS

SEQ ID NO: 1482212 - protein, 21 aa, Mycobacterium tuberculosis
ESILIRGLMNYTFWMPNGSPE

SEQ ID NO: 1482213 - protein, 20 aa, Mycobacterium tuberculosis
ESISTFQAVQFMLADMAMKV

SEQ ID NO: 1482214 - protein, 20 aa, Mycobacterium tuberculosis
ESIVRTGGDLTFSLAGTPNK

SEQ ID NO: 1482215 - protein, 18 aa, Mycobacterium tuberculosis
ESKAAVMPRSFRSPPGRR

SEQ ID NO: 1482216 - protein, 23 aa, Mycobacterium tuberculosis
ESKNWKPPKNALEDLLQQKSPPP

SEQ ID NO: 1482217 - protein, 20 aa, Mycobacterium tuberculosis
ESKVAIGQSVELAFDTARLA

SEQ ID NO: 1482218 - protein, 21 aa, Mycobacterium tuberculosis
ESLAELMGGPDIAPPSSGLQT

SEQ ID NO: 1482219 - protein, 21 aa, Mycobacterium tuberculosis
ESLDGWPVNFALLGKGNTVNP

SEQ ID NO: 1482220 - protein, 28 aa, Mycobacterium tuberculosis
ESLPLASIFKLYVLHALAGAVQHNTVSW

SEQ ID NO: 1482221 - protein, 26 aa, Mycobacterium tuberculosis
ESLYHFAWDEFCDWYLELAKTQLAQG

SEQ ID NO: 1482222 - protein, 19 aa, Mycobacterium tuberculosis
ESMRVVARYGQPGQTERAR

SEQ ID NO: 1482223 - protein, 19 aa, Mycobacterium tuberculosis
ESNIRWGFDPTHRRGYGLD

SEQ ID NO: 1482224 - protein, 19 aa, Mycobacterium tuberculosis
ESNIRWGFDPTHRRRYGLD

SEQ ID NO: 1482225 - protein, 20 aa, Mycobacterium tuberculosis
ESNIRWGFDPTHRRRYGLDT

SEQ ID NO: 1482226 - protein, 19 aa, Mycobacterium tuberculosis
ESNIRWGFDPTHRRSYGLD

SEQ ID NO: 1482227 - protein, 20 aa, Mycobacterium tuberculosis
ESNNGTVVSPPFAAGPTGTA

SEQ ID NO: 1482228 - protein, 28 aa, Mycobacterium tuberculosis
ESPDGMTPPVRWRSGRRVHFDLDPLLPF

SEQ ID NO: 1482229 - protein, 25 aa, Mycobacterium tuberculosis
ESPGYRSWRSQTRRSRVQRVATISP

SEQ ID NO: 1482230 - protein, 20 aa, Mycobacterium tuberculosis
ESPVALPVPAYMPFFDVLHV

SEQ ID NO: 1482231 - protein, 27 aa, Mycobacterium tuberculosis
ESRALEDWCHQLAWPIRPAVSADPPST

SEQ ID NO: 1482232 - protein, 23 aa, Mycobacterium tuberculosis
ESRKAIHFQEWWVRYRAQVPTHS

SEQ ID NO: 1482233 - protein, 18 aa, Mycobacterium tuberculosis
ESRLNRLLAQQIPPARKV

SEQ ID NO: 1482234 - protein, 24 aa, Mycobacterium tuberculosis
ESSGCSRARCVTASSFPAPTWSSS

SEQ ID NO: 1482235 - protein, 33 aa, Mycobacterium tuberculosis
ESSIHSASAPAAVPTKPEQPGIATITTQPTSGN

SEQ ID NO: 1482236 - protein, 20 aa, Mycobacterium tuberculosis
ESTFAKLGVRDEIVRALGEE

SEQ ID NO: 1482237 - protein, 18 aa, Mycobacterium tuberculosis
ESTMRFLLSAKSAYVDGQ

SEQ ID NO: 1482238 - protein, 17 aa, Mycobacterium tuberculosis
ESVFGGPAWTRVREPDG

SEQ ID NO: 1482239 - protein, 17 aa, Mycobacterium tuberculosis
ESVTEGTVTRWLKQEGD

SEQ ID NO: 1482240 - protein, 19 aa, Mycobacterium tuberculosis
ESWMGPASMAMVAAAQPYL

SEQ ID NO: 1482241 - protein, 20 aa, Mycobacterium tuberculosis
ESWMGPASMAMVAAAQPYLA

SEQ ID NO: 1482242 - protein, 17 aa, Mycobacterium tuberculosis
ESYVLLVRVASARALED

SEQ ID NO: 1482243 - protein, 17 aa, Mycobacterium tuberculosis
ETAELLYGTALLAEGGA

SEQ ID NO: 1482244 - protein, 17 aa, Mycobacterium tuberculosis
ETAYCLGVEKLLGITDE

SEQ ID NO: 1482245 - protein, 24 aa, Mycobacterium tuberculosis
ETAYGEWKGGWVDFDGIHLQVGSA

SEQ ID NO: 1482246 - protein, 17 aa, Mycobacterium tuberculosis
ETDEAGNLISEWDDTPE

SEQ ID NO: 1482247 - protein, 20 aa, Mycobacterium tuberculosis
ETDEAGNLISEWDDTPEGFG

SEQ ID NO: 1482248 - protein, 23 aa, Mycobacterium tuberculosis
ETEELPAYCAVALAGLDDLPDTI

SEQ ID NO: 1482249 - protein, 19 aa, Mycobacterium tuberculosis
ETGGNCPHRQRGGPVGSPG

SEQ ID NO: 1482250 - protein, 24 aa, Mycobacterium tuberculosis
ETGLRAPRPGNFVMSFLDASIAPL

SEQ ID NO: 1482251 - protein, 23 aa, Mycobacterium tuberculosis
ETHYGEMWAHDILAMDGYAGASG

SEQ ID NO: 1482252 - protein, 18 aa, Mycobacterium tuberculosis
ETIAYGLIPRAHRGIVAV

SEQ ID NO: 1482253 - protein, 20 aa, Mycobacterium tuberculosis
ETIGRPIARRNLIFSIFAEH

SEQ ID NO: 1482254 - protein, 19 aa, Mycobacterium tuberculosis
ETIKSALLTAYRHTQGHQT

SEQ ID NO: 1482255 - protein, 20 aa, Mycobacterium tuberculosis
ETIKSALLTAYRHTQGHQTD

SEQ ID NO: 1482256 - protein, 18 aa, Mycobacterium tuberculosis
ETILADAVILCIGGCGRV

SEQ ID NO: 1482257 - protein, 28 aa, Mycobacterium tuberculosis
ETLIAMPALRLDAAFAHLNLGDSHGNAA

SEQ ID NO: 1482258 - protein, 29 aa, Mycobacterium tuberculosis
ETLTILGRFSASFGETFASGPYFKVLLAN

SEQ ID NO: 1482259 - protein, 17 aa, Mycobacterium tuberculosis
ETPEVLVYAVVARSDRA

SEQ ID NO: 1482260 - protein, 19 aa, Mycobacterium tuberculosis
ETREIWSYGSGYGGNALLG

SEQ ID NO: 1482261 - protein, 22 aa, Mycobacterium tuberculosis
ETRLGALAARLWLPLLAAEGSV

SEQ ID NO: 1482262 - protein, 22 aa, Mycobacterium tuberculosis
ETRSAALPRWRGAAGRLEVWYA

SEQ ID NO: 1482263 - protein, 21 aa, Mycobacterium tuberculosis
ETSGAARIGRNGGTGDTGGLF

SEQ ID NO: 1482264 - protein, 19 aa, Mycobacterium tuberculosis
ETTCLISPAGSVEWLCVPR

SEQ ID NO: 1482265 - protein, 26 aa, Mycobacterium tuberculosis
ETTFSVGLANLGFWNLGSANIGNYNL

SEQ ID NO: 1482266 - protein, 17 aa, Mycobacterium tuberculosis
ETTRGSWLVLADATVDA

SEQ ID NO: 1482267 - protein, 19 aa, Mycobacterium tuberculosis
ETVAAAALDVARIGSSIGV

SEQ ID NO: 1482268 - protein, 19 aa, Mycobacterium tuberculosis
ETVAAAASDVARIGSSIGA

SEQ ID NO: 1482269 - protein, 17 aa, Mycobacterium tuberculosis
ETVAAVATDLKRIGASL

SEQ ID NO: 1482270 - protein, 19 aa, Mycobacterium tuberculosis
ETVGPRLGVKASGGIRTAA

SEQ ID NO: 1482271 - protein, 17 aa, Mycobacterium tuberculosis
ETVRRFAEKVLIEANRL

SEQ ID NO: 1482272 - protein, 20 aa, Mycobacterium tuberculosis
ETVVDARCGIGYLHTGIEKN

SEQ ID NO: 1482273 - protein, 32 aa, Mycobacterium tuberculosis
EVALYRLVMSWGVRPGLVLGHSVGELAAAHVA

SEQ ID NO: 1482274 - protein, 18 aa, Mycobacterium tuberculosis
EVAPRAAAVVGTRAATAY

SEQ ID NO: 1482275 - protein, 28 aa, Mycobacterium tuberculosis
EVARAQVCAAWHIAELPAAAGRDADGIL

SEQ ID NO: 1482276 - protein, 21 aa, Mycobacterium tuberculosis
EVARRLGRRLAPLGTGSKALA

SEQ ID NO: 1482277 - protein, 26 aa, Mycobacterium tuberculosis
EVARYLFRRVVSWGRSSNVFLRNGAR

SEQ ID NO: 1482278 - protein, 19 aa, Mycobacterium tuberculosis
EVASFAVLRDWGVLPDFVM

SEQ ID NO: 1482279 - protein, 24 aa, Mycobacterium tuberculosis
EVAVCSTGLIGDRLPMDKLLAGVA

SEQ ID NO: 1482280 - protein, 17 aa, Mycobacterium tuberculosis
EVDGRLLADGGILDPLP

SEQ ID NO: 1482281 - protein, 19 aa, Mycobacterium tuberculosis
EVDVLPFQLVTMGQPIADF

SEQ ID NO: 1482282 - protein, 19 aa, Mycobacterium tuberculosis
EVEYDPAYHELMRTAITHG

SEQ ID NO: 1482283 - protein, 18 aa, Mycobacterium tuberculosis
EVEYDPAYHELMRTPMAC

SEQ ID NO: 1482284 - protein, 17 aa, Mycobacterium tuberculosis
EVGAPIAERGWTLVWGG

SEQ ID NO: 1482285 - protein, 28 aa, Mycobacterium tuberculosis
EVGEARARPGRRAVRLVPPTRHRRTEVV

SEQ ID NO: 1482286 - protein, 21 aa, Mycobacterium tuberculosis
EVGGAGGNAGWLGFGGAGGIG

SEQ ID NO: 1482287 - protein, 19 aa, Mycobacterium tuberculosis
EVGPGLLLPIYIGVRLRRR

SEQ ID NO: 1482288 - protein, 27 aa, Mycobacterium tuberculosis
EVGRLSEWRATLIVRESACLDVEDRRA

SEQ ID NO: 1482289 - protein, 29 aa, Mycobacterium tuberculosis
EVGTGAGVSGLWLLSGMRDDGVLTTIDIE

SEQ ID NO: 1482290 - protein, 18 aa, Mycobacterium tuberculosis
EVGYSARNETEWQRLMVA

SEQ ID NO: 1482291 - protein, 20 aa, Mycobacterium tuberculosis
EVHLPRVWRGRGVCAVVSHP

SEQ ID NO: 1482292 - protein, 19 aa, Mycobacterium tuberculosis
EVHVLPFQLVTMGQPIADF

SEQ ID NO: 1482293 - protein, 19 aa, Mycobacterium tuberculosis
EVIAAAATDLASLESSISA

SEQ ID NO: 1482294 - protein, 20 aa, Mycobacterium tuberculosis
EVIADGPIALARLIPAGVDV

SEQ ID NO: 1482295 - protein, 21 aa, Mycobacterium tuberculosis
EVIALTPARLLMMVITDSGRV

SEQ ID NO: 1482296 - protein, 19 aa, Mycobacterium tuberculosis
EVIARIAAGVAEGNAKLSR

SEQ ID NO: 1482297 - protein, 22 aa, Mycobacterium tuberculosis
EVIKNFKKGFAATGGGSVVPDE

SEQ ID NO: 1482298 - protein, 24 aa, Mycobacterium tuberculosis
EVIKNFKKGFAATGGGSVVPDEHV

SEQ ID NO: 1482299 - protein, 19 aa, Mycobacterium tuberculosis
EVINALGALEERFALEHYQ

SEQ ID NO: 1482300 - protein, 23 aa, Mycobacterium tuberculosis
EVIPDVLRHRLVLTYDALADEIS

SEQ ID NO: 1482301 - protein, 18 aa, Mycobacterium tuberculosis
EVLACAHAGIPVTVVPGV

SEQ ID NO: 1482302 - protein, 19 aa, Mycobacterium tuberculosis
EVLEGRGAGPLKDYVYIDV

SEQ ID NO: 1482303 - protein, 18 aa, Mycobacterium tuberculosis
EVLERSLVHLGLKHYFLV

SEQ ID NO: 1482304 - protein, 18 aa, Mycobacterium tuberculosis
EVLETEYLKRPLIDGPAP

SEQ ID NO: 1482305 - protein, 24 aa, Mycobacterium tuberculosis
EVLGNWTGIPVFKLTEAETTRLLR

SEQ ID NO: 1482306 - protein, 17 aa, Mycobacterium tuberculosis
EVLNRIAHDYGQAMGAA

SEQ ID NO: 1482307 - protein, 17 aa, Mycobacterium tuberculosis
EVLPGAVARARRAAIAA

SEQ ID NO: 1482308 - protein, 17 aa, Mycobacterium tuberculosis
EVLSTILLECTMAGMAT

SEQ ID NO: 1482309 - protein, 19 aa, Mycobacterium tuberculosis
EVLVYAVVARSDRATTSPA

SEQ ID NO: 1482310 - protein, 19 aa, Mycobacterium tuberculosis
EVNSALMYAGPGSGPMLAG

SEQ ID NO: 1482311 - protein, 24 aa, Mycobacterium tuberculosis
EVNSARIFAGAGLGPMLAAASAWD

SEQ ID NO: 1482312 - protein, 20 aa, Mycobacterium tuberculosis
EVNSLRMYLGAGSGPMLAAA

SEQ ID NO: 1482313 - protein, 25 aa, Mycobacterium tuberculosis
EVPADLRQDWPAALRDAGFDPTART

SEQ ID NO: 1482314 - protein, 26 aa, Mycobacterium tuberculosis
EVPGAMARLGVWSGDGLQLDLHQPTF

SEQ ID NO: 1482315 - protein, 18 aa, Mycobacterium tuberculosis
EVQQARCAASTPVEEARR

SEQ ID NO: 1482316 - protein, 18 aa, Mycobacterium tuberculosis
EVRAALLHLRDVMVECEQ

SEQ ID NO: 1482317 - protein, 22 aa, Mycobacterium tuberculosis
EVRGAEVVDLLAALNTGHEGGF

SEQ ID NO: 1482318 - protein, 18 aa, Mycobacterium tuberculosis
EVRKNGVLPYLRPDGKTQ

SEQ ID NO: 1482319 - protein, 19 aa, Mycobacterium tuberculosis
EVRLGLGAVRYLGAELAEK

SEQ ID NO: 1482320 - protein, 21 aa, Mycobacterium tuberculosis
EVRPAPGQGLSPAVSTLVVAG

SEQ ID NO: 1482321 - protein, 21 aa, Mycobacterium tuberculosis
EVRPAPGQGLSPAVSTLVVAS

SEQ ID NO: 1482322 - protein, 20 aa, Mycobacterium tuberculosis
EVSAAIAGAVWRARAGVSDG

SEQ ID NO: 1482323 - protein, 21 aa, Mycobacterium tuberculosis
EVSAAVAALFGAHGQTYQVLS

SEQ ID NO: 1482324 - protein, 21 aa, Mycobacterium tuberculosis
EVSAAVAALFGSYAQSYQAFG

SEQ ID NO: 1482325 - protein, 21 aa, Mycobacterium tuberculosis
EVSAAVASLFSGHAQAYQTLG

SEQ ID NO: 1482326 - protein, 28 aa, Mycobacterium tuberculosis
EVSAAVSRLFGAYGQQFQALNARAATFH

SEQ ID NO: 1482327 - protein, 21 aa, Mycobacterium tuberculosis
EVSAGIAALFSAHAQEYQALS

SEQ ID NO: 1482328 - protein, 18 aa, Mycobacterium tuberculosis
EVSGPLLRRKFRPSSAAM

SEQ ID NO: 1482329 - protein, 24 aa, Mycobacterium tuberculosis
EVSLAISALFGQHAQAYQALSAQA

SEQ ID NO: 1482330 - protein, 21 aa, Mycobacterium tuberculosis
EVSTAIAALFGSHGQHYQEIS

SEQ ID NO: 1482331 - protein, 22 aa, Mycobacterium tuberculosis
EVTALNFMPGWLDMLLEVGGGR

SEQ ID NO: 1482332 - protein, 20 aa, Mycobacterium tuberculosis
EVTDSITWRRFCRIPLEGSV

SEQ ID NO: 1482333 - protein, 22 aa, Mycobacterium tuberculosis
EVTEIIPLDGFLDGLALYDELD

SEQ ID NO: 1482334 - protein, 27 aa, Mycobacterium tuberculosis
EVTVIVAPMFHAWGFSQLVLASSLACT

SEQ ID NO: 1482335 - protein, 19 aa, Mycobacterium tuberculosis
EVVFGWRSFELYPPQVRVA

SEQ ID NO: 1482336 - protein, 18 aa, Mycobacterium tuberculosis
EVVGFTVHVPHYLTQTDY

SEQ ID NO: 1482337 - protein, 18 aa, Mycobacterium tuberculosis
EVVRRPALTVSPIEMLEA

SEQ ID NO: 1482338 - protein, 19 aa, Mycobacterium tuberculosis
EVYELRGSELIRIEAPTDA

SEQ ID NO: 1482339 - protein, 28 aa, Mycobacterium tuberculosis
EWDAVIAVHLRGHFLLTRNAAAYWRDKA

SEQ ID NO: 1482340 - protein, 23 aa, Mycobacterium tuberculosis
EWGPDYYERIGVSFELPNHHQKL

SEQ ID NO: 1482341 - protein, 27 aa, Mycobacterium tuberculosis
EWLHKQRTGLPYVTWKYATSIDGRSAA

SEQ ID NO: 1482342 - protein, 23 aa, Mycobacterium tuberculosis
EYAEMWAQDAAVMYSYEGASAAT

SEQ ID NO: 1482343 - protein, 21 aa, Mycobacterium tuberculosis
EYDGAVAWLVGEEGRGVPTII

SEQ ID NO: 1482344 - protein, 28 aa, Mycobacterium tuberculosis
EYLSGRWAQAYGFPLMPIDGILVGTAAM

SEQ ID NO: 1482345 - protein, 25 aa, Mycobacterium tuberculosis
EYPCVFDHRGQRFMLYSGDGYGRTG

SEQ ID NO: 1482346 - protein, 24 aa, Mycobacterium tuberculosis
EYQPRSEKVLTEYNNKAALEPVNP

SEQ ID NO: 1482347 - protein, 23 aa, Mycobacterium tuberculosis
EYRRKVRLCLDVFETMLAQTRFE

SEQ ID NO: 1482348 - protein, 18 aa, Mycobacterium tuberculosis
EYRSCAKAQALVAERGFE

SEQ ID NO: 1482349 - protein, 25 aa, Mycobacterium tuberculosis
EYWYRSIRQPVQFERAVRNAFDGGY

SEQ ID NO: 1482350 - protein, 18 aa, Mycobacterium tuberculosis
FAAACERARVVFLGPPAR

SEQ ID NO: 1482351 - protein, 17 aa, Mycobacterium tuberculosis
FAAALHGPCDTNAFAAA

SEQ ID NO: 1482352 - protein, 18 aa, Mycobacterium tuberculosis
FAAEAAFVVRHDRRRPVP

SEQ ID NO: 1482353 - protein, 18 aa, Mycobacterium tuberculosis
FAAGADRIEGCLFGNGER

SEQ ID NO: 1482354 - protein, 19 aa, Mycobacterium tuberculosis
FAAIAARPASPGGAAVGGA

SEQ ID NO: 1482355 - protein, 28 aa, Mycobacterium tuberculosis
FAASLWCGYVGAFMCEGDTPLAERRAAA

SEQ ID NO: 1482356 - protein, 20 aa, Mycobacterium tuberculosis
FAASWQRLRTAPATLPLARC

SEQ ID NO: 1482357 - protein, 23 aa, Mycobacterium tuberculosis
FAATEVIPRLAGTATEIEQVLRA

SEQ ID NO: 1482358 - protein, 17 aa, Mycobacterium tuberculosis
FAATGGWQSFRVPCLPS

SEQ ID NO: 1482359 - protein, 18 aa, Mycobacterium tuberculosis
FAAVGGIGPIAIPDISVP

SEQ ID NO: 1482360 - protein, 23 aa, Mycobacterium tuberculosis
FADAIESLGRFSEVANRALAATR

SEQ ID NO: 1482361 - protein, 17 aa, Mycobacterium tuberculosis
FADDVERILSETPKYKQ

SEQ ID NO: 1482362 - protein, 31 aa, Mycobacterium tuberculosis
FADERSVISAKCRQLRSFADCGTGGAGGAGE

SEQ ID NO: 1482363 - protein, 18 aa, Mycobacterium tuberculosis
FADHSGVDWKGTLTGLAG

SEQ ID NO: 1482364 - protein, 19 aa, Mycobacterium tuberculosis
FADHSGVDWKGTLTGLAGY

SEQ ID NO: 1482365 - protein, 20 aa, Mycobacterium tuberculosis
FADLSFPAGVTVDRDDSVYV

SEQ ID NO: 1482366 - protein, 17 aa, Mycobacterium tuberculosis
FADRALVMYAGRVVESA

SEQ ID NO: 1482367 - protein, 23 aa, Mycobacterium tuberculosis
FADVGAAPAWRNLRAPLSAIPST

SEQ ID NO: 1482368 - protein, 25 aa, Mycobacterium tuberculosis
FAEFLEVRGSLLPDDERLLCRANGC

SEQ ID NO: 1482369 - protein, 21 aa, Mycobacterium tuberculosis
FAELGPPAFALKARVQLLRDY

SEQ ID NO: 1482370 - protein, 17 aa, Mycobacterium tuberculosis
FAELYRQGAARDVGMLL

SEQ ID NO: 1482371 - protein, 24 aa, Mycobacterium tuberculosis
FAERGFRRARTWLGATAEATKPAN

SEQ ID NO: 1482372 - protein, 20 aa, Mycobacterium tuberculosis
FAESRIRPSTIAAEDVLHDM

SEQ ID NO: 1482373 - protein, 17 aa, Mycobacterium tuberculosis
FAGACLSEYGAMASADL

SEQ ID NO: 1482374 - protein, 20 aa, Mycobacterium tuberculosis
FAGACLSEYGAMASADLSQV

SEQ ID NO: 1482375 - protein, 18 aa, Mycobacterium tuberculosis
FAGGDVKTMIQARPEDAG

SEQ ID NO: 1482376 - protein, 17 aa, Mycobacterium tuberculosis
FAGGVGGAGGEGLTDGS

SEQ ID NO: 1482377 - protein, 18 aa, Mycobacterium tuberculosis
FAGMISVAIDSADGATVD

SEQ ID NO: 1482378 - protein, 17 aa, Mycobacterium tuberculosis
FAGNGNAGGNGGTGGAS

SEQ ID NO: 1482379 - protein, 17 aa, Mycobacterium tuberculosis
FAINRFGLNVPLSGGTS

SEQ ID NO: 1482380 - protein, 19 aa, Mycobacterium tuberculosis
FALDLSWGGAGGNGGAATT

SEQ ID NO: 1482381 - protein, 38 aa, Mycobacterium tuberculosis
FALQCMPLNWVRRRHGLSSLGWNLCRIFTDGDHTLYAD

SEQ ID NO: 1482382 - protein, 17 aa, Mycobacterium tuberculosis
FALRGDRTMFLFVFRAE

SEQ ID NO: 1482383 - protein, 28 aa, Mycobacterium tuberculosis
FALTYPRRLGFGLGSSVVSLSWRTGDDI

SEQ ID NO: 1482384 - protein, 24 aa, Mycobacterium tuberculosis
FAMGGRAAEELVFREPTTGAVSDI

SEQ ID NO: 1482385 - protein, 18 aa, Mycobacterium tuberculosis
FANELFASNAYRDYLECT

SEQ ID NO: 1482386 - protein, 17 aa, Mycobacterium tuberculosis
FANELFASNAYRDYLEV

SEQ ID NO: 1482387 - protein, 18 aa, Mycobacterium tuberculosis
FANGEIFVRFHESVRGCD

SEQ ID NO: 1482388 - protein, 18 aa, Mycobacterium tuberculosis
FANHKKWIGLIIHIGQEG

SEQ ID NO: 1482389 - protein, 26 aa, Mycobacterium tuberculosis
FANPTPKGCVFEYVYLARPDSTIAGR

SEQ ID NO: 1482390 - protein, 19 aa, Mycobacterium tuberculosis
FAPRELVELAVAAEAHGMD

SEQ ID NO: 1482391 - protein, 23 aa, Mycobacterium tuberculosis
FAQYWSEICQIPISFITETVKRA

SEQ ID NO: 1482392 - protein, 17 aa, Mycobacterium tuberculosis
FARMWRGYARGVLEKLS

SEQ ID NO: 1482393 - protein, 25 aa, Mycobacterium tuberculosis
FARQRYWGEPFPIVYDSDGRPHALD

SEQ ID NO: 1482394 - protein, 19 aa, Mycobacterium tuberculosis
FARRGIRWPCAAGIDQPSE

SEQ ID NO: 1482395 - protein, 18 aa, Mycobacterium tuberculosis
FASAGIEPFGCLKPAPPP

SEQ ID NO: 1482396 - protein, 22 aa, Mycobacterium tuberculosis
FASGRVAYTLGLHGPAVTVDTA

SEQ ID NO: 1482397 - protein, 21 aa, Mycobacterium tuberculosis
FASLDRWPGTVGEYLNTMFDP

SEQ ID NO: 1482398 - protein, 21 aa, Mycobacterium tuberculosis
FASLGGFNFGGATIGHNNVGI

SEQ ID NO: 1482399 - protein, 18 aa, Mycobacterium tuberculosis
FASLRRWTGGSIPETDIP

SEQ ID NO: 1482400 - protein, 17 aa, Mycobacterium tuberculosis
FASTGLGCPGRRRRFPA

SEQ ID NO: 1482401 - protein, 25 aa, Mycobacterium tuberculosis
FATHPFGPVAVAGFVVYRLDDGAAV

SEQ ID NO: 1482402 - protein, 19 aa, Mycobacterium tuberculosis
FAVDPDRSAQFLLVLTQAE

SEQ ID NO: 1482403 - protein, 18 aa, Mycobacterium tuberculosis
FAVGDRVMGLFPEGTGTV

SEQ ID NO: 1482404 - protein, 26 aa, Mycobacterium tuberculosis
FAVIRAEADLARFPADVARVVVRLIH

SEQ ID NO: 1482405 - protein, 21 aa, Mycobacterium tuberculosis
FAVRQGSGGAGRWRGGDGAVR

SEQ ID NO: 1482406 - protein, 19 aa, Mycobacterium tuberculosis
FAVSPDEIVEFAMTALLSD

SEQ ID NO: 1482407 - protein, 17 aa, Mycobacterium tuberculosis
FAYRPDPRLGSANAALS

SEQ ID NO: 1482408 - protein, 17 aa, Mycobacterium tuberculosis
FCAFAQRKGDADAYSLS

SEQ ID NO: 1482409 - protein, 17 aa, Mycobacterium tuberculosis
FCAGVERAIETVKRVLD

SEQ ID NO: 1482410 - protein, 20 aa, Mycobacterium tuberculosis
FCAPFELSRDAPLRITVVRT

SEQ ID NO: 1482411 - protein, 18 aa, Mycobacterium tuberculosis
FCAYNSVGYREQVREQLT

SEQ ID NO: 1482412 - protein, 19 aa, Mycobacterium tuberculosis
FCDICVRAFADFAVVKPQV

SEQ ID NO: 1482413 - protein, 21 aa, Mycobacterium tuberculosis
FCESYRAFLDRHVAPYHDEWE

SEQ ID NO: 1482414 - protein, 17 aa, Mycobacterium tuberculosis
FCGYARPLADTASRCTR

SEQ ID NO: 1482415 - protein, 20 aa, Mycobacterium tuberculosis
FCHNGFRPIMMPKIVSVQHS

SEQ ID NO: 1482416 - protein, 18 aa, Mycobacterium tuberculosis
FCSTCDRTRLTADGQIRS

SEQ ID NO: 1482417 - protein, 22 aa, Mycobacterium tuberculosis
FDAGDFRWAATLLDHAVFADSE

SEQ ID NO: 1482418 - protein, 20 aa, Mycobacterium tuberculosis
FDAPRRLGLMHGDAHPGNFM

SEQ ID NO: 1482419 - protein, 18 aa, Mycobacterium tuberculosis
FDARCAPAAYRFVSQARH

SEQ ID NO: 1482420 - protein, 19 aa, Mycobacterium tuberculosis
FDATVCWMADNAVLEPGRD

SEQ ID NO: 1482421 - protein, 20 aa, Mycobacterium tuberculosis
FDDYGDFFARIDLGYEQLRV

SEQ ID NO: 1482422 - protein, 24 aa, Mycobacterium tuberculosis
FDELYAAGATAIFPPGTVIADAAI

SEQ ID NO: 1482423 - protein, 26 aa, Mycobacterium tuberculosis
FDFGRPEVRNFLVANALYWLQEFHID

SEQ ID NO: 1482424 - protein, 20 aa, Mycobacterium tuberculosis
FDFVREIIEQGAIPDDVTIQ

SEQ ID NO: 1482425 - protein, 19 aa, Mycobacterium tuberculosis
FDGDGLPMSVQLVGRPYDE

SEQ ID NO: 1482426 - protein, 17 aa, Mycobacterium tuberculosis
FDGLNYPEGLAVDTQGA

SEQ ID NO: 1482427 - protein, 17 aa, Mycobacterium tuberculosis
FDGTSGMLEWLLSAIPT

SEQ ID NO: 1482428 - protein, 22 aa, Mycobacterium tuberculosis
FDGYEYLFWVGCAGAYDDKAKK

SEQ ID NO: 1482429 - protein, 24 aa, Mycobacterium tuberculosis
FDIHELVNIGPFRIEPIDVPAVVL

SEQ ID NO: 1482430 - protein, 17 aa, Mycobacterium tuberculosis
FDLKPVHPEAARALHEH

SEQ ID NO: 1482431 - protein, 17 aa, Mycobacterium tuberculosis
FDLLAVVPPHVPSAAAR

SEQ ID NO: 1482432 - protein, 25 aa, Mycobacterium tuberculosis
FDLRGRATLYLTYWTAGDTRNRGRE

SEQ ID NO: 1482433 - protein, 17 aa, Mycobacterium tuberculosis
FDPEATLDLIDRHHATG

SEQ ID NO: 1482434 - protein, 24 aa, Mycobacterium tuberculosis
FDPKKAVVFDDRWAQRPRGPGEAV

SEQ ID NO: 1482435 - protein, 17 aa, Mycobacterium tuberculosis
FDPPTTLAYRIEGLPAR

SEQ ID NO: 1482436 - protein, 25 aa, Mycobacterium tuberculosis
FDQLGAIGIDLTDVFAVLEEEGVRK

SEQ ID NO: 1482437 - protein, 26 aa, Mycobacterium tuberculosis
FDQPLLALRIPWYVTVLDLGSAGAVY

SEQ ID NO: 1482438 - protein, 17 aa, Mycobacterium tuberculosis
FDRARKALFEEGISTSR

SEQ ID NO: 1482439 - protein, 19 aa, Mycobacterium tuberculosis
FDRELWRKLIDAGILSSAA

SEQ ID NO: 1482440 - protein, 24 aa, Mycobacterium tuberculosis
FDRIDERLVVVGLDKTVTYKNGDP

SEQ ID NO: 1482441 - protein, 17 aa, Mycobacterium tuberculosis
FDRLRNLAAIKDVAARP

SEQ ID NO: 1482442 - protein, 21 aa, Mycobacterium tuberculosis
FDRLRNLAAIKDVAARPTRTI

SEQ ID NO: 1482443 - protein, 20 aa, Mycobacterium tuberculosis
FDSARAGFVNGVLRTIAGRD

SEQ ID NO: 1482444 - protein, 24 aa, Mycobacterium tuberculosis
FDSRAIGPGGLFLALPGARADGHD

SEQ ID NO: 1482445 - protein, 17 aa, Mycobacterium tuberculosis
FDTELGPVVANFLLADE

SEQ ID NO: 1482446 - protein, 19 aa, Mycobacterium tuberculosis
FDTLLVMSVEPGFGGQRFI

SEQ ID NO: 1482447 - protein, 31 aa, Mycobacterium tuberculosis
FDTPCDLLIAVGVSFGGLVTRSFSPRWRGLK

SEQ ID NO: 1482448 - protein, 20 aa, Mycobacterium tuberculosis
FDTRRGMVVGSPVDLVDGID

SEQ ID NO: 1482449 - protein, 19 aa, Mycobacterium tuberculosis
FDTVVDCAFYHTFSTAPEL

SEQ ID NO: 1482450 - protein, 20 aa, Mycobacterium tuberculosis
FDVRYGELISHERILDLRAG

SEQ ID NO: 1482451 - protein, 18 aa, Mycobacterium tuberculosis
FDVVQAFTDDALTTCERC

SEQ ID NO: 1482452 - protein, 21 aa, Mycobacterium tuberculosis
FDVYADSTVIYPGHGDDTELG

SEQ ID NO: 1482453 - protein, 25 aa, Mycobacterium tuberculosis
FDYALVCGGGDWRRAGIPARSAQFS

SEQ ID NO: 1482454 - protein, 22 aa, Mycobacterium tuberculosis
FDYLRDTWRTHLDDLVQRGHHY

SEQ ID NO: 1482455 - protein, 18 aa, Mycobacterium tuberculosis
FEALSALSAGVKEVRAVI

SEQ ID NO: 1482456 - protein, 18 aa, Mycobacterium tuberculosis
FEASAPITAGTTGAGVAG

SEQ ID NO: 1482457 - protein, 18 aa, Mycobacterium tuberculosis
FEASWNRENGEHPINDSA

SEQ ID NO: 1482458 - protein, 23 aa, Mycobacterium tuberculosis
FEDAGRCQRGYFIESLGGAQFAS

SEQ ID NO: 1482459 - protein, 25 aa, Mycobacterium tuberculosis
FEDVRASGLLPRWEQTQRFIGGDAR

SEQ ID NO: 1482460 - protein, 20 aa, Mycobacterium tuberculosis
FEEARRRFEASWNRENGEHP

SEQ ID NO: 1482461 - protein, 19 aa, Mycobacterium tuberculosis
FEEHVRWYRMYGMSMRPVP

SEQ ID NO: 1482462 - protein, 17 aa, Mycobacterium tuberculosis
FEGTSFGGALMTTTDVE

SEQ ID NO: 1482463 - protein, 17 aa, Mycobacterium tuberculosis
FEHLVGYPFAPYYVDVT

SEQ ID NO: 1482464 - protein, 18 aa, Mycobacterium tuberculosis
FEIAGSVQFRTSSAVSSE

SEQ ID NO: 1482465 - protein, 21 aa, Mycobacterium tuberculosis
FEIVDPRPLTLLPEPNPGDCS

SEQ ID NO: 1482466 - protein, 21 aa, Mycobacterium tuberculosis
FEKGRSWPRERTRAKLEEVLQ

SEQ ID NO: 1482467 - protein, 25 aa, Mycobacterium tuberculosis
FEKPGRREGWDYPDMARESGTKALR

SEQ ID NO: 1482468 - protein, 25 aa, Mycobacterium tuberculosis
FEKTLRFWLDRGVEGFRIDMSHAMD

SEQ ID NO: 1482469 - protein, 18 aa, Mycobacterium tuberculosis
FENAIAVVMAFGGSTNAV

SEQ ID NO: 1482470 - protein, 19 aa, Mycobacterium tuberculosis
FEPDVRLSPYLALHGICRW

SEQ ID NO: 1482471 - protein, 17 aa, Mycobacterium tuberculosis
FEPTLDYVVVKAPRFAF

SEQ ID NO: 1482472 - protein, 24 aa, Mycobacterium tuberculosis
FEPWSVADFSRYLSTLGLPAAGDA

SEQ ID NO: 1482473 - protein, 25 aa, Mycobacterium tuberculosis
FEPWSVADFSRYLSTLGLPAAGDAV

SEQ ID NO: 1482474 - protein, 22 aa, Mycobacterium tuberculosis
FEQAADAVMHWGMQRNAGLRVR

SEQ ID NO: 1482475 - protein, 17 aa, Mycobacterium tuberculosis
FEQRPGEALALGQVLDT

SEQ ID NO: 1482476 - protein, 18 aa, Mycobacterium tuberculosis
FERGLRWSPPPAGIPATS

SEQ ID NO: 1482477 - protein, 26 aa, Mycobacterium tuberculosis
FERIARGVPVAAPWDARRARELDDVS

SEQ ID NO: 1482478 - protein, 27 aa, Mycobacterium tuberculosis
FESALDPCTRCWELGPDGQWTASPQEG

SEQ ID NO: 1482479 - protein, 18 aa, Mycobacterium tuberculosis
FEVIGEAGSPVWHQLTTR

SEQ ID NO: 1482480 - protein, 23 aa, Mycobacterium tuberculosis
FEVLQRVPSFDVVFVGHRRGEVR

SEQ ID NO: 1482481 - protein, 20 aa, Mycobacterium tuberculosis
FFARIDLGYEQLRVGVEYDG

SEQ ID NO: 1482482 - protein, 17 aa, Mycobacterium tuberculosis
FFGHSMGGMLAFEVALR

SEQ ID NO: 1482483 - protein, 19 aa, Mycobacterium tuberculosis
FFLDRGCKVLCTEPRGENL

SEQ ID NO: 1482484 - protein, 17 aa, Mycobacterium tuberculosis
FFNAGGVGIRASKTSAT

SEQ ID NO: 1482485 - protein, 19 aa, Mycobacterium tuberculosis
FFNFYLCDISLKVNGLQPG

SEQ ID NO: 1482486 - protein, 33 aa, Mycobacterium tuberculosis
FFNNYRPQFYFPHHRRVRCGDTCRGGRECDGPG

SEQ ID NO: 1482487 - protein, 17 aa, Mycobacterium tuberculosis
FFNTGMFNNGIYNSGVA

SEQ ID NO: 1482488 - protein, 19 aa, Mycobacterium tuberculosis
FFPHRARAVPGRDHRRTRR

SEQ ID NO: 1482489 - protein, 23 aa, Mycobacterium tuberculosis
FFQAAGPWLKNALISNLNIVSTV

SEQ ID NO: 1482490 - protein, 19 aa, Mycobacterium tuberculosis
FFRALDYTLPWDVDTVEDS

SEQ ID NO: 1482491 - protein, 24 aa, Mycobacterium tuberculosis
FFSLPWYYRSGYDVLLYTLPFHGQ

SEQ ID NO: 1482492 - protein, 17 aa, Mycobacterium tuberculosis
FFVWLTVGLYDPPVREL

SEQ ID NO: 1482493 - protein, 26 aa, Mycobacterium tuberculosis
FGAAGVGGPGGFAAAFGATGGAGGAG

SEQ ID NO: 1482494 - protein, 27 aa, Mycobacterium tuberculosis
FGAAGVGGPGGFAAAFGATGGAGGAGG

SEQ ID NO: 1482495 - protein, 24 aa, Mycobacterium tuberculosis
FGAARAELAGGWSIRDSPPQVRPL

SEQ ID NO: 1482496 - protein, 22 aa, Mycobacterium tuberculosis
FGACLNREMSRFIDALRSSINF

SEQ ID NO: 1482497 - protein, 19 aa, Mycobacterium tuberculosis
FGADRCFDTPLAESAIIGI

SEQ ID NO: 1482498 - protein, 26 aa, Mycobacterium tuberculosis
FGAGGAGGAGGFGFGGAGGAGGLGGK

SEQ ID NO: 1482499 - protein, 17 aa, Mycobacterium tuberculosis
FGAGGMGGAGGFGDHGT

SEQ ID NO: 1482500 - protein, 25 aa, Mycobacterium tuberculosis
FGAGGYPQMLLRVGWAPINADPLPP

SEQ ID NO: 1482501 - protein, 19 aa, Mycobacterium tuberculosis
FGAHAREYQAAAAQAAAYH

SEQ ID NO: 1482502 - protein, 29 aa, Mycobacterium tuberculosis
FGAIDFAAALARQGSFLGYRVTVCDARAV

SEQ ID NO: 1482503 - protein, 21 aa, Mycobacterium tuberculosis
FGANMSGWWNQAHTALAGAGS

SEQ ID NO: 1482504 - protein, 18 aa, Mycobacterium tuberculosis
FGARRKAYNWAVATLKAD

SEQ ID NO: 1482505 - protein, 23 aa, Mycobacterium tuberculosis
FGARRKAYNWAVATLKADIEAWR

SEQ ID NO: 1482506 - protein, 18 aa, Mycobacterium tuberculosis
FGASLPVRVCTICTDPWN

SEQ ID NO: 1482507 - protein, 18 aa, Mycobacterium tuberculosis
FGCFQRRHAAFGCAEFRL

SEQ ID NO: 1482508 - protein, 21 aa, Mycobacterium tuberculosis
FGDGGNGGFSFFDGNGGDGGT

SEQ ID NO: 1482509 - protein, 17 aa, Mycobacterium tuberculosis
FGDRRKAMLQDMAILTG

SEQ ID NO: 1482510 - protein, 18 aa, Mycobacterium tuberculosis
FGDRTQINGVARDDAVAA

SEQ ID NO: 1482511 - protein, 19 aa, Mycobacterium tuberculosis
FGEYIRLMALVEYSADEIR

SEQ ID NO: 1482512 - protein, 17 aa, Mycobacterium tuberculosis
FGFGNAFGDGNLGSGNV

SEQ ID NO: 1482513 - protein, 38 aa, Mycobacterium tuberculosis
FGGAGRGRGGGGHHRRRGRGAVALAACSAMVDSAGPVA

SEQ ID NO: 1482514 - protein, 19 aa, Mycobacterium tuberculosis
FGGARPGLSSAQRAGGDVS

SEQ ID NO: 1482515 - protein, 27 aa, Mycobacterium tuberculosis
FGGDRGWAGRQWPVMGAAGRCPAGKRL

SEQ ID NO: 1482516 - protein, 22 aa, Mycobacterium tuberculosis
FGGPDFPAPLDVATSPPNPDGP

SEQ ID NO: 1482517 - protein, 22 aa, Mycobacterium tuberculosis
FGGPKCLVKVIQKLSGLSINRF

SEQ ID NO: 1482518 - protein, 19 aa, Mycobacterium tuberculosis
FGGSGGRGGLLLGTGGAGG

SEQ ID NO: 1482519 - protein, 20 aa, Mycobacterium tuberculosis
FGGSGGRGGLLLGTGGAGGD

SEQ ID NO: 1482520 - protein, 21 aa, Mycobacterium tuberculosis
FGGYMKRQMVHGAHRAGDVAD

SEQ ID NO: 1482521 - protein, 19 aa, Mycobacterium tuberculosis
FGHLWQWVGTNIGRYHSYP

SEQ ID NO: 1482522 - protein, 21 aa, Mycobacterium tuberculosis
FGHRGRPVTGWSVSATGKAKE

SEQ ID NO: 1482523 - protein, 18 aa, Mycobacterium tuberculosis
FGILGPLEISAGFRSLPL

SEQ ID NO: 1482524 - protein, 19 aa, Mycobacterium tuberculosis
FGIPFTLQFQTNVPALQPP

SEQ ID NO: 1482525 - protein, 17 aa, Mycobacterium tuberculosis
FGIVLVEAMAAGTAVVA

SEQ ID NO: 1482526 - protein, 17 aa, Mycobacterium tuberculosis
FGMSGSRRHVTAASHRA

SEQ ID NO: 1482527 - protein, 17 aa, Mycobacterium tuberculosis
FGNFGANMSGWWNQAHT

SEQ ID NO: 1482528 - protein, 24 aa, Mycobacterium tuberculosis
FGNFGANMSGWWNQAHTALAGAGS

SEQ ID NO: 1482529 - protein, 38 aa, Mycobacterium tuberculosis
FGNGGDGGCRRVWRRYRRQRWCRRQRRADRQRRQRRQR

SEQ ID NO: 1482530 - protein, 17 aa, Mycobacterium tuberculosis
FGNGGFGGAGGLGAAGG

SEQ ID NO: 1482531 - protein, 29 aa, Mycobacterium tuberculosis
FGNKGTGLFSGFMSGFGNTGFLQSGFGNL

SEQ ID NO: 1482532 - protein, 17 aa, Mycobacterium tuberculosis
FGNNGIGNIGFGNTGNG

SEQ ID NO: 1482533 - protein, 29 aa, Mycobacterium tuberculosis
FGPGGLGTFSWPGAYGTWWQADPSADLIL

SEQ ID NO: 1482534 - protein, 21 aa, Mycobacterium tuberculosis
FGPKRRRPQLLAVDNVVVCAG

SEQ ID NO: 1482535 - protein, 26 aa, Mycobacterium tuberculosis
FGPLIRWPHVAAMWSGARRWWRRPCR

SEQ ID NO: 1482536 - protein, 18 aa, Mycobacterium tuberculosis
FGPVQADGRYLLRTDAGE

SEQ ID NO: 1482537 - protein, 19 aa, Mycobacterium tuberculosis
FGPVQADGRYLLRTDAGEE

SEQ ID NO: 1482538 - protein, 19 aa, Mycobacterium tuberculosis
FGPYAGWSPKFLKHGQISD

SEQ ID NO: 1482539 - protein, 21 aa, Mycobacterium tuberculosis
FGPYHLKRLLGRGGMGEVYEA

SEQ ID NO: 1482540 - protein, 20 aa, Mycobacterium tuberculosis
FGPYRLRRLVGRGGMGDVYE

SEQ ID NO: 1482541 - protein, 21 aa, Mycobacterium tuberculosis
FGQSGGFIWVDPKAVLALVVL

SEQ ID NO: 1482542 - protein, 25 aa, Mycobacterium tuberculosis
FGQVTSGLTAGVWQGAAAAAMAAAA

SEQ ID NO: 1482543 - protein, 21 aa, Mycobacterium tuberculosis
FGRLPEPLAMLSPDEGLLTAG

SEQ ID NO: 1482544 - protein, 18 aa, Mycobacterium tuberculosis
FGRLPFTMRGIRLEAVGV

SEQ ID NO: 1482545 - protein, 24 aa, Mycobacterium tuberculosis
FGSAAYWRRHIRQAVRFADSVRFA

SEQ ID NO: 1482546 - protein, 29 aa, Mycobacterium tuberculosis
FGSAHALGCTIKLLSICERITTDEGSHTE

SEQ ID NO: 1482547 - protein, 22 aa, Mycobacterium tuberculosis
FGSEAPGRPGGAGGTGGAGGNG

SEQ ID NO: 1482548 - protein, 27 aa, Mycobacterium tuberculosis
FGSGGAGGVCGLGFDAGGAGGAGGKAG

SEQ ID NO: 1482549 - protein, 30 aa, Mycobacterium tuberculosis
FGSGNLLGNGNFGFGNAFGDGNLGSGNVGS

SEQ ID NO: 1482550 - protein, 19 aa, Mycobacterium tuberculosis
FGSPELQQGWGVSAVSGDR

SEQ ID NO: 1482551 - protein, 17 aa, Mycobacterium tuberculosis
FGSSARNRALLAERAGL

SEQ ID NO: 1482552 - protein, 26 aa, Mycobacterium tuberculosis
FGSSSFRYAAPAGRNWTTADLAGMRI

SEQ ID NO: 1482553 - protein, 17 aa, Mycobacterium tuberculosis
FGSTAAIFPVDEETIKY

SEQ ID NO: 1482554 - protein, 17 aa, Mycobacterium tuberculosis
FGSTGALRRNTRRDAVI

SEQ ID NO: 1482555 - protein, 18 aa, Mycobacterium tuberculosis
FGTHAQEYQTVSAQVATF

SEQ ID NO: 1482556 - protein, 18 aa, Mycobacterium tuberculosis
FGTVVARDRTQAIAGLRA

SEQ ID NO: 1482557 - protein, 22 aa, Mycobacterium tuberculosis
FGVEPPVALILQGASLHDLTAG

SEQ ID NO: 1482558 - protein, 31 aa, Mycobacterium tuberculosis
FGVRLVKLLYRLERPLLFALQCMPLNWVRRR

SEQ ID NO: 1482559 - protein, 32 aa, Mycobacterium tuberculosis
FGVRLVKLLYRLERPLLFALQCMPLNWVRRRH

SEQ ID NO: 1482560 - protein, 20 aa, Mycobacterium tuberculosis
FGVTTSMTFARFPTADCDVV

SEQ ID NO: 1482561 - protein, 17 aa, Mycobacterium tuberculosis
FGYKFRPWRDVKVLADG

SEQ ID NO: 1482562 - protein, 17 aa, Mycobacterium tuberculosis
FHATRRLAAAMVASSAT

SEQ ID NO: 1482563 - protein, 19 aa, Mycobacterium tuberculosis
FHDRFTASRLFGAPPGYVG

SEQ ID NO: 1482564 - protein, 18 aa, Mycobacterium tuberculosis
FHERFIQALSTAAGAYGS

SEQ ID NO: 1482565 - protein, 20 aa, Mycobacterium tuberculosis
FHGDLSRFNILTAQGRLTGV

SEQ ID NO: 1482566 - protein, 25 aa, Mycobacterium tuberculosis
FHGFRQGRNPFWHRLSRAMYRLARP

SEQ ID NO: 1482567 - protein, 18 aa, Mycobacterium tuberculosis
FHHSWSWPPSSPNDTGVN

SEQ ID NO: 1482568 - protein, 19 aa, Mycobacterium tuberculosis
FHIRHHLRRVAMPAPGGRR

SEQ ID NO: 1482569 - protein, 24 aa, Mycobacterium tuberculosis
FHLRRYTPEWMVVAAAGNVDHDGL

SEQ ID NO: 1482570 - protein, 17 aa, Mycobacterium tuberculosis
FHNEFTQRLAAAANAFV

SEQ ID NO: 1482571 - protein, 19 aa, Mycobacterium tuberculosis
FHPHWDPRHLWLVPITQAV

SEQ ID NO: 1482572 - protein, 23 aa, Mycobacterium tuberculosis
FHSGDLNTGFGSPVDQPVMNSGF

SEQ ID NO: 1482573 - protein, 21 aa, Mycobacterium tuberculosis
FHTRVHPCALPTSAAGNDLSP

SEQ ID NO: 1482574 - protein, 17 aa, Mycobacterium tuberculosis
FHVVPVLAYSPDPGPVA

SEQ ID NO: 1482575 - protein, 18 aa, Mycobacterium tuberculosis
FHYLKKVAVELDETRARL

SEQ ID NO: 1482576 - protein, 18 aa, Mycobacterium tuberculosis
FIAARRFAIPAVESKGAL

SEQ ID NO: 1482577 - protein, 23 aa, Mycobacterium tuberculosis
FIAPSRFHVVPVLAYSPDPGPVA

SEQ ID NO: 1482578 - protein, 19 aa, Mycobacterium tuberculosis
FIDACHARRLGVLIDAVFN

SEQ ID NO: 1482579 - protein, 22 aa, Mycobacterium tuberculosis
FIDHLRHLGRIPATIRYTTQGL

SEQ ID NO: 1482580 - protein, 19 aa, Mycobacterium tuberculosis
FIDHRPCRPGPSRYTQLES

SEQ ID NO: 1482581 - protein, 19 aa, Mycobacterium tuberculosis
FIDRLRCAERAIAVARRGS

SEQ ID NO: 1482582 - protein, 22 aa, Mycobacterium tuberculosis
FIEGRSVAELVALGEEIYDEII

SEQ ID NO: 1482583 - protein, 24 aa, Mycobacterium tuberculosis
FIELLAWQFASPVRWIETQDLLFI

SEQ ID NO: 1482584 - protein, 18 aa, Mycobacterium tuberculosis
FIGECKVWSGPRTMDDAL

SEQ ID NO: 1482585 - protein, 18 aa, Mycobacterium tuberculosis
FIGECKVWSGPRTMDDVL

SEQ ID NO: 1482586 - protein, 26 aa, Mycobacterium tuberculosis
FIPEGLLNYLALLGWSIADDHDLFGL

SEQ ID NO: 1482587 - protein, 17 aa, Mycobacterium tuberculosis
FIRAPWVERVGDGVQVL

SEQ ID NO: 1482588 - protein, 33 aa, Mycobacterium tuberculosis
FITGNVNNGFLWRGDHQGLIFGSPGFFNSTSAP

SEQ ID NO: 1482589 - protein, 22 aa, Mycobacterium tuberculosis
FITGRIKELLVVDGANHYPEDI

SEQ ID NO: 1482590 - protein, 25 aa, Mycobacterium tuberculosis
FIWVDPKAVLALVVLTARDFGDWAL

SEQ ID NO: 1482591 - protein, 17 aa, Mycobacterium tuberculosis
FKAKPGQRIRIRIINSA

SEQ ID NO: 1482592 - protein, 20 aa, Mycobacterium tuberculosis
FKAQFEAAGLTYEHRLIDDM

SEQ ID NO: 1482593 - protein, 20 aa, Mycobacterium tuberculosis
FKAWVPRYPTARSRGRRKPA

SEQ ID NO: 1482594 - protein, 20 aa, Mycobacterium tuberculosis
FKDHLYIAGRIKDLVIIDGR

SEQ ID NO: 1482595 - protein, 22 aa, Mycobacterium tuberculosis
FKGLPGAQGRLKVAAPKPSKLE

SEQ ID NO: 1482596 - protein, 20 aa, Mycobacterium tuberculosis
FKGTGFYRTDSRESGKKSKS

SEQ ID NO: 1482597 - protein, 20 aa, Mycobacterium tuberculosis
FKHVAEMFAELEATSLRSYP

SEQ ID NO: 1482598 - protein, 17 aa, Mycobacterium tuberculosis
FKKRGISPEDFWRSAGL

SEQ ID NO: 1482599 - protein, 17 aa, Mycobacterium tuberculosis
FKLHEDWGSTPAAIDTC

SEQ ID NO: 1482600 - protein, 18 aa, Mycobacterium tuberculosis
FKLHEDWGSTPAAIDTCL

SEQ ID NO: 1482601 - protein, 19 aa, Mycobacterium tuberculosis
FKNTVLILRPIWAPPTSLS

SEQ ID NO: 1482602 - protein, 19 aa, Mycobacterium tuberculosis
FKPSYGIAEATLLVATIDH

SEQ ID NO: 1482603 - protein, 22 aa, Mycobacterium tuberculosis
FKQCPLLYRFRAIDRLPEATSA

SEQ ID NO: 1482604 - protein, 17 aa, Mycobacterium tuberculosis
FKQFSMCINCMLCYLAC

SEQ ID NO: 1482605 - protein, 20 aa, Mycobacterium tuberculosis
FKRKEHWLPAHFSGDGSTYM

SEQ ID NO: 1482606 - protein, 19 aa, Mycobacterium tuberculosis
FKRYAWWPYTLVMRRANVF

SEQ ID NO: 1482607 - protein, 20 aa, Mycobacterium tuberculosis
FKTFGFGFGRVDQWEPDEVY

SEQ ID NO: 1482608 - protein, 23 aa, Mycobacterium tuberculosis
FKTLKYRPDFPKRFESIEAARVH

SEQ ID NO: 1482609 - protein, 17 aa, Mycobacterium tuberculosis
FKTPRSVRFVDVLPRNA

SEQ ID NO: 1482610 - protein, 17 aa, Mycobacterium tuberculosis
FLDGLVAYRRSRGLAGL

SEQ ID NO: 1482611 - protein, 29 aa, Mycobacterium tuberculosis
FLEPFRLSDPFITIDAFQVVAGVLFLENI

SEQ ID NO: 1482612 - protein, 18 aa, Mycobacterium tuberculosis
FLGPAAIALGQRYNLDSR

SEQ ID NO: 1482613 - protein, 25 aa, Mycobacterium tuberculosis
FLGRYCTGYERFERYLLGLDDGITK

SEQ ID NO: 1482614 - protein, 25 aa, Mycobacterium tuberculosis
FLHECQEAGLGFGDRARVEDPADEP

SEQ ID NO: 1482615 - protein, 28 aa, Mycobacterium tuberculosis
FLHIPFPPVELFMQMPWRTEIIQGLLGA

SEQ ID NO: 1482616 - protein, 18 aa, Mycobacterium tuberculosis
FLKRLPMSTRLGIRLVIV

SEQ ID NO: 1482617 - protein, 17 aa, Mycobacterium tuberculosis
FLLDQAITSAGRHPDSD

SEQ ID NO: 1482618 - protein, 18 aa, Mycobacterium tuberculosis
FLLEGMPVQVAFHNGVPL

SEQ ID NO: 1482619 - protein, 19 aa, Mycobacterium tuberculosis
FLLNQMLVWGFTGQVISAV

SEQ ID NO: 1482620 - protein, 17 aa, Mycobacterium tuberculosis
FLMWVLADLFTFLPEVG

SEQ ID NO: 1482621 - protein, 18 aa, Mycobacterium tuberculosis
FLPFPFDSVIAGGASMAY

SEQ ID NO: 1482622 - protein, 22 aa, Mycobacterium tuberculosis
FLPKRPLVEVLRDLASRIYTDF

SEQ ID NO: 1482623 - protein, 17 aa, Mycobacterium tuberculosis
FLPRIRDVTELWCQGYS

SEQ ID NO: 1482624 - protein, 19 aa, Mycobacterium tuberculosis
FLPTGGRVLAVFEPAGPGV

SEQ ID NO: 1482625 - protein, 17 aa, Mycobacterium tuberculosis
FLQCAWHALEDAGADPA

SEQ ID NO: 1482626 - protein, 18 aa, Mycobacterium tuberculosis
FLQGAKWYLDNGGYAAWG

SEQ ID NO: 1482627 - protein, 19 aa, Mycobacterium tuberculosis
FLRQIIANHQVYWQQIAAA

SEQ ID NO: 1482628 - protein, 21 aa, Mycobacterium tuberculosis
FLRWGQGAFDDFKVVPPGTGI

SEQ ID NO: 1482629 - protein, 21 aa, Mycobacterium tuberculosis
FLRYGKGRHRAALNFGDCMTY

SEQ ID NO: 1482630 - protein, 18 aa, Mycobacterium tuberculosis
FLSAAATDLANLGSTISA

SEQ ID NO: 1482631 - protein, 26 aa, Mycobacterium tuberculosis
FLSGAQESAALTVFGGAGGAGGAGGA

SEQ ID NO: 1482632 - protein, 17 aa, Mycobacterium tuberculosis
FLTAGPKEARAWTIHQG

SEQ ID NO: 1482633 - protein, 19 aa, Mycobacterium tuberculosis
FLTEIGYLLPEPDDFTITT

SEQ ID NO: 1482634 - protein, 26 aa, Mycobacterium tuberculosis
FLTEKKCAITAYPDRGFTNAGTFAES

SEQ ID NO: 1482635 - protein, 24 aa, Mycobacterium tuberculosis
FLVSGDYQGLIGLPLLGIPVTPGY

SEQ ID NO: 1482636 - protein, 17 aa, Mycobacterium tuberculosis
FMAARTAFFDEYFLATA

SEQ ID NO: 1482637 - protein, 32 aa, Mycobacterium tuberculosis
FMEVAKLRAGRLLWSELVAQFAPRAPNPFRCV

SEQ ID NO: 1482638 - protein, 27 aa, Mycobacterium tuberculosis
FMEVAKLRAGRLLWSELVAQLAPKSAK

SEQ ID NO: 1482639 - protein, 18 aa, Mycobacterium tuberculosis
FMIGRPASDPAYFPCYAK

SEQ ID NO: 1482640 - protein, 18 aa, Mycobacterium tuberculosis
FNAGSLNTGFGAVGTGSG

SEQ ID NO: 1482641 - protein, 22 aa, Mycobacterium tuberculosis
FNAGSLNTGFGAVGTGSGPNSG

SEQ ID NO: 1482642 - protein, 17 aa, Mycobacterium tuberculosis
FNASAPGAAGSPGGNGG

SEQ ID NO: 1482643 - protein, 24 aa, Mycobacterium tuberculosis
FNCLAPGMWPAWWLSNDDPGRSGE

SEQ ID NO: 1482644 - protein, 26 aa, Mycobacterium tuberculosis
FNEPICPPCGSFIRSYASDIDTAVAD

SEQ ID NO: 1482645 - protein, 33 aa, Mycobacterium tuberculosis
FNGAGARVPGMIRLVRHSIALVAAGLAAALSGC

SEQ ID NO: 1482646 - protein, 19 aa, Mycobacterium tuberculosis
FNGRHYAVPYARSTPLFYY

SEQ ID NO: 1482647 - protein, 24 aa, Mycobacterium tuberculosis
FNLAACSTLAPTTSVCSTRAPATS

SEQ ID NO: 1482648 - protein, 27 aa, Mycobacterium tuberculosis
FNLTAWAVGWLPYIGILAPQINFFYYL

SEQ ID NO: 1482649 - protein, 29 aa, Mycobacterium tuberculosis
FNNELGHPWTVLRATRRTDYLILEMAARH

SEQ ID NO: 1482650 - protein, 19 aa, Mycobacterium tuberculosis
FNQFCYLQLSGKRSCRGQP

SEQ ID NO: 1482651 - protein, 18 aa, Mycobacterium tuberculosis
FNQFCYLQLSGKRSRRGQ

SEQ ID NO: 1482652 - protein, 21 aa, Mycobacterium tuberculosis
FNRSWMLVAHVDQLAKTGDYV

SEQ ID NO: 1482653 - protein, 18 aa, Mycobacterium tuberculosis
FNTPYKLFKRYASHEGGI

SEQ ID NO: 1482654 - protein, 22 aa, Mycobacterium tuberculosis
FNVRGARNIPCETVPGKRAPTV

SEQ ID NO: 1482655 - protein, 21 aa, Mycobacterium tuberculosis
FPDAPVKIFLTASAETRARRR

SEQ ID NO: 1482656 - protein, 22 aa, Mycobacterium tuberculosis
FPDLEVCVYAAPTQTVIGGPPE

SEQ ID NO: 1482657 - protein, 23 aa, Mycobacterium tuberculosis
FPDLEVCVYAAPTQTVIGGPPEQ

SEQ ID NO: 1482658 - protein, 17 aa, Mycobacterium tuberculosis
FPDVQLLIVGHGDADQL

SEQ ID NO: 1482659 - protein, 28 aa, Mycobacterium tuberculosis
FPEFPLPLGDPSVRCGGDLLSMMLMDEQ

SEQ ID NO: 1482660 - protein, 19 aa, Mycobacterium tuberculosis
FPENTVLAITNAVAAGVDG

SEQ ID NO: 1482661 - protein, 21 aa, Mycobacterium tuberculosis
FPEQWSGNFLFYNKQLFDDAG

SEQ ID NO: 1482662 - protein, 21 aa, Mycobacterium tuberculosis
FPFDGTRRWFHLECNPQYDDY

SEQ ID NO: 1482663 - protein, 18 aa, Mycobacterium tuberculosis
FPFERYRRLCDVGCADGL

SEQ ID NO: 1482664 - protein, 17 aa, Mycobacterium tuberculosis
FPFLRQIIANHQVYWQQ

SEQ ID NO: 1482665 - protein, 20 aa, Mycobacterium tuberculosis
FPFLRQIIANQQVYWQQIAA

SEQ ID NO: 1482666 - protein, 17 aa, Mycobacterium tuberculosis
FPGCDVPAEFCDIDHSA

SEQ ID NO: 1482667 - protein, 17 aa, Mycobacterium tuberculosis
FPGETLSTGIWRTEPGR

SEQ ID NO: 1482668 - protein, 17 aa, Mycobacterium tuberculosis
FPGISFPSLGVTATGAT

SEQ ID NO: 1482669 - protein, 17 aa, Mycobacterium tuberculosis
FPGRVLLAEANQWPGDV

SEQ ID NO: 1482670 - protein, 18 aa, Mycobacterium tuberculosis
FPLDPAVAAVDAHIQATD

SEQ ID NO: 1482671 - protein, 19 aa, Mycobacterium tuberculosis
FPLDPAVAAVDALIQATDL

SEQ ID NO: 1482672 - protein, 17 aa, Mycobacterium tuberculosis
FPLGPGYLLDGLPVILT

SEQ ID NO: 1482673 - protein, 19 aa, Mycobacterium tuberculosis
FPLGSRLNSAIERVAAKRK

SEQ ID NO: 1482674 - protein, 21 aa, Mycobacterium tuberculosis
FPLKAGMLTSLGFGHVSGLVA

SEQ ID NO: 1482675 - protein, 18 aa, Mycobacterium tuberculosis
FPLLSDFWPHGAVSQAYG

SEQ ID NO: 1482676 - protein, 21 aa, Mycobacterium tuberculosis
FPNCNGRIPADTALLPEVLAE

SEQ ID NO: 1482677 - protein, 20 aa, Mycobacterium tuberculosis
FPNNACRVVADSGDDCPDWV

SEQ ID NO: 1482678 - protein, 28 aa, Mycobacterium tuberculosis
FPPAPAVTRRGPPAPISRALPAGPAVAG

SEQ ID NO: 1482679 - protein, 18 aa, Mycobacterium tuberculosis
FPPNFNILHIDGNNAEVA

SEQ ID NO: 1482680 - protein, 22 aa, Mycobacterium tuberculosis
FPPWDRWQCPVHRRLLRPGRYR

SEQ ID NO: 1482681 - protein, 20 aa, Mycobacterium tuberculosis
FPRGNLIGIPGAPERMVQNT

SEQ ID NO: 1482682 - protein, 19 aa, Mycobacterium tuberculosis
FPSNLRKQLKGAPMPAPRA

SEQ ID NO: 1482683 - protein, 23 aa, Mycobacterium tuberculosis
FPSVREYSVRYGLTERRQAMLPG

SEQ ID NO: 1482684 - protein, 24 aa, Mycobacterium tuberculosis
FPSVREYSVRYGLTERRQAMLPGH

SEQ ID NO: 1482685 - protein, 29 aa, Mycobacterium tuberculosis
FPTDICEPVAVVGIGCRFPGNVTGPESFW

SEQ ID NO: 1482686 - protein, 19 aa, Mycobacterium tuberculosis
FPTDRGWALRELFDGSRRN

SEQ ID NO: 1482687 - protein, 17 aa, Mycobacterium tuberculosis
FPTDRGWDVEGLYDPDP

SEQ ID NO: 1482688 - protein, 17 aa, Mycobacterium tuberculosis
FPVKRLADLGFRVLATE

SEQ ID NO: 1482689 - protein, 24 aa, Mycobacterium tuberculosis
FQAEARQLLDLMVHSVYSNKDPFL

SEQ ID NO: 1482690 - protein, 20 aa, Mycobacterium tuberculosis
FQALFGRPLIGDGANGAPGQ

SEQ ID NO: 1482691 - protein, 21 aa, Mycobacterium tuberculosis
FQCRSRPGLPAAAAGAGHRAA

SEQ ID NO: 1482692 - protein, 25 aa, Mycobacterium tuberculosis
FQENRFWPPPCNIRIVGRSAAAAPR

SEQ ID NO: 1482693 - protein, 17 aa, Mycobacterium tuberculosis
FQGGGPHAWYLSDGILA

SEQ ID NO: 1482694 - protein, 21 aa, Mycobacterium tuberculosis
FQGLTAMWRRESELFADVAVP

SEQ ID NO: 1482695 - protein, 27 aa, Mycobacterium tuberculosis
FQGLTAMWRRESELFADVAVPDDVDVT

SEQ ID NO: 1482696 - protein, 25 aa, Mycobacterium tuberculosis
FQHTAAVLFGVWWIGAQAILDDSPA

SEQ ID NO: 1482697 - protein, 24 aa, Mycobacterium tuberculosis
FQHVRAAMLSHGWIDGPPPGQYFH

SEQ ID NO: 1482698 - protein, 17 aa, Mycobacterium tuberculosis
FQLVEPVAGMSRAAGIV

SEQ ID NO: 1482699 - protein, 31 aa, Mycobacterium tuberculosis
FQMASADVIHAFWVPEFLFKRDVMPNPVANN

SEQ ID NO: 1482700 - protein, 20 aa, Mycobacterium tuberculosis
FQMMGLCQILRDGVIPPNRS

SEQ ID NO: 1482701 - protein, 24 aa, Mycobacterium tuberculosis
FQPQLRVLVDLGYADYGPGGNYAD

SEQ ID NO: 1482702 - protein, 23 aa, Mycobacterium tuberculosis
FQPQLRVLVDLGYADYGPGGYYA

SEQ ID NO: 1482703 - protein, 18 aa, Mycobacterium tuberculosis
FQPRAGSMAATLPYCDLF

SEQ ID NO: 1482704 - protein, 19 aa, Mycobacterium tuberculosis
FQQALQQLPNLGIGNIGNA

SEQ ID NO: 1482705 - protein, 18 aa, Mycobacterium tuberculosis
FQQVESWLVAKPNTSVLI

SEQ ID NO: 1482706 - protein, 24 aa, Mycobacterium tuberculosis
FQRGPCWSWSRMVGSARPILLAPP

SEQ ID NO: 1482707 - protein, 32 aa, Mycobacterium tuberculosis
FQRRHAAFGCAEFRLWHVGAVQHQRVGVGCAG

SEQ ID NO: 1482708 - protein, 17 aa, Mycobacterium tuberculosis
FQSGLSWLIILRKRENF

SEQ ID NO: 1482709 - protein, 19 aa, Mycobacterium tuberculosis
FQSVVWGLTVGSWIGSSAG

SEQ ID NO: 1482710 - protein, 22 aa, Mycobacterium tuberculosis
FQTLTGRPLIGNGANGTPGTGA

SEQ ID NO: 1482711 - protein, 19 aa, Mycobacterium tuberculosis
FQVLCEAGLLPGALTCNVG

SEQ ID NO: 1482712 - protein, 32 aa, Mycobacterium tuberculosis
FQVLRYGFRPSKIAFLAWHAWNDAERGNWPPG

SEQ ID NO: 1482713 - protein, 17 aa, Mycobacterium tuberculosis
FQYCPTCQTGGKALADR

SEQ ID NO: 1482714 - protein, 23 aa, Mycobacterium tuberculosis
FRAALRELTLLLIYEATRDAPCE

SEQ ID NO: 1482715 - protein, 19 aa, Mycobacterium tuberculosis
FRAGFLTGRSAGLGLERSA

SEQ ID NO: 1482716 - protein, 19 aa, Mycobacterium tuberculosis
FRDICPPQHPWSGSLSKNR

SEQ ID NO: 1482717 - protein, 19 aa, Mycobacterium tuberculosis
FRDPDLWWPQLDQRSRRRC

SEQ ID NO: 1482718 - protein, 21 aa, Mycobacterium tuberculosis
FRDPRGWPHRGRRPGHQDHQV

SEQ ID NO: 1482719 - protein, 17 aa, Mycobacterium tuberculosis
FRDRVQHANGFVEDTDT

SEQ ID NO: 1482720 - protein, 19 aa, Mycobacterium tuberculosis
FRDVVAALGMYPGQAPPLG

SEQ ID NO: 1482721 - protein, 18 aa, Mycobacterium tuberculosis
FREALRAGPQLHRDRTLL

SEQ ID NO: 1482722 - protein, 17 aa, Mycobacterium tuberculosis
FRERFGIEVEELDEYAE

SEQ ID NO: 1482723 - protein, 21 aa, Mycobacterium tuberculosis
FREVSELAANFGVMNSGVAVG

SEQ ID NO: 1482724 - protein, 19 aa, Mycobacterium tuberculosis
FRGALLVALAERLRERPVK

SEQ ID NO: 1482725 - protein, 23 aa, Mycobacterium tuberculosis
FRGCEGDALLMLLDANGIECSTG

SEQ ID NO: 1482726 - protein, 19 aa, Mycobacterium tuberculosis
FRGPPSWNVGYKSIRSHNV

SEQ ID NO: 1482727 - protein, 18 aa, Mycobacterium tuberculosis
FRKHPRARAGWDRATGRI

SEQ ID NO: 1482728 - protein, 19 aa, Mycobacterium tuberculosis
FRKLVSRGFTPRQVETVEP

SEQ ID NO: 1482729 - protein, 20 aa, Mycobacterium tuberculosis
FRLIHIADTYTPIAPADLPG

SEQ ID NO: 1482730 - protein, 24 aa, Mycobacterium tuberculosis
FRLLPPRTMRALLARICEQEGVVV

SEQ ID NO: 1482731 - protein, 17 aa, Mycobacterium tuberculosis
FRLLTGGSRIAVRRQQT

SEQ ID NO: 1482732 - protein, 20 aa, Mycobacterium tuberculosis
FRLVAAEALKLTAADAALVA

SEQ ID NO: 1482733 - protein, 20 aa, Mycobacterium tuberculosis
FRMAELRSGEGRTVYGVIVP

SEQ ID NO: 1482734 - protein, 17 aa, Mycobacterium tuberculosis
FRPGALPELQSWARTVE

SEQ ID NO: 1482735 - protein, 17 aa, Mycobacterium tuberculosis
FRQNCRPSVRYPQTETE

SEQ ID NO: 1482736 - protein, 19 aa, Mycobacterium tuberculosis
FRQNLLGKRVDYSGRSVIV

SEQ ID NO: 1482737 - protein, 24 aa, Mycobacterium tuberculosis
FRQRRQRRVPAQPGQAVGAGGAAG

SEQ ID NO: 1482738 - protein, 23 aa, Mycobacterium tuberculosis
FRRAEPSPGMAAMVAEDRVYRLL

SEQ ID NO: 1482739 - protein, 21 aa, Mycobacterium tuberculosis
FRRLELARFLAALHATVLDNP

SEQ ID NO: 1482740 - protein, 17 aa, Mycobacterium tuberculosis
FRRNRRWALLENAPVMN

SEQ ID NO: 1482741 - protein, 26 aa, Mycobacterium tuberculosis
FRRRRSCPRSLAAVQPAHRMGCARTV

SEQ ID NO: 1482742 - protein, 20 aa, Mycobacterium tuberculosis
FRRWWCGGTGRVSDTSVRAS

SEQ ID NO: 1482743 - protein, 20 aa, Mycobacterium tuberculosis
FRSMLWPRVYADLRTAGVRG

SEQ ID NO: 1482744 - protein, 18 aa, Mycobacterium tuberculosis
FRSPEALIALAMLALGGR

SEQ ID NO: 1482745 - protein, 18 aa, Mycobacterium tuberculosis
FRSQSGMKVMGFAVKTVD

SEQ ID NO: 1482746 - protein, 20 aa, Mycobacterium tuberculosis
FRTARELREAVPLMPVEQLL

SEQ ID NO: 1482747 - protein, 25 aa, Mycobacterium tuberculosis
FRTGTLTVCTMVPMRSVPHRVVCLV

SEQ ID NO: 1482748 - protein, 19 aa, Mycobacterium tuberculosis
FRTGVTFVTFVGVTQHTST

SEQ ID NO: 1482749 - protein, 28 aa, Mycobacterium tuberculosis
FRTRKGRALDDFATWCALAETYGDDWHR

SEQ ID NO: 1482750 - protein, 20 aa, Mycobacterium tuberculosis
FRTRRYRPLHRPSDTDNRSH

SEQ ID NO: 1482751 - protein, 18 aa, Mycobacterium tuberculosis
FRVAVWAEDPHCPIDADV

SEQ ID NO: 1482752 - protein, 18 aa, Mycobacterium tuberculosis
FRYYASKNAISWGDFSTH

SEQ ID NO: 1482753 - protein, 21 aa, Mycobacterium tuberculosis
FSAAIPPNLPLPAKIVMQVLD

SEQ ID NO: 1482754 - protein, 18 aa, Mycobacterium tuberculosis
FSAASAFQSVVWGLTVGS

SEQ ID NO: 1482755 - protein, 26 aa, Mycobacterium tuberculosis
FSDELGMTFPQWRTQLRLQHALVLLA

SEQ ID NO: 1482756 - protein, 28 aa, Mycobacterium tuberculosis
FSDHRLILEGIAWRFRTGSPWRDLPAEF

SEQ ID NO: 1482757 - protein, 22 aa, Mycobacterium tuberculosis
FSDNGETRWHRRHPAGAGGAVS

SEQ ID NO: 1482758 - protein, 17 aa, Mycobacterium tuberculosis
FSDTRPAARRYFNTDAE

SEQ ID NO: 1482759 - protein, 17 aa, Mycobacterium tuberculosis
FSEQLLPEHLHKVSLSF

SEQ ID NO: 1482760 - protein, 18 aa, Mycobacterium tuberculosis
FSGAGGLGGLSGDGVTRA

SEQ ID NO: 1482761 - protein, 24 aa, Mycobacterium tuberculosis
FSGPARKVLELTFREALRAGPQLH

SEQ ID NO: 1482762 - protein, 21 aa, Mycobacterium tuberculosis
FSIAALRGEPVDSYGVGTSLV

SEQ ID NO: 1482763 - protein, 26 aa, Mycobacterium tuberculosis
FSIPEQPLPLAINVIRHINALSTPAI

SEQ ID NO: 1482764 - protein, 23 aa, Mycobacterium tuberculosis
FSIPGRFEAATGFLEGRVGLDGA

SEQ ID NO: 1482765 - protein, 23 aa, Mycobacterium tuberculosis
FSIPGRFEAATGFLEGRVGLGGA

SEQ ID NO: 1482766 - protein, 17 aa, Mycobacterium tuberculosis
FSLAGTPNKVWGTAASA

SEQ ID NO: 1482767 - protein, 24 aa, Mycobacterium tuberculosis
FSMCINCMLCYSACPVYALDPDFL

SEQ ID NO: 1482768 - protein, 25 aa, Mycobacterium tuberculosis
FSMCINCMLCYSACPVYALDPDFLG

SEQ ID NO: 1482769 - protein, 21 aa, Mycobacterium tuberculosis
FSMHGELYKAIARQAHVIHES

SEQ ID NO: 1482770 - protein, 24 aa, Mycobacterium tuberculosis
FSQHAQGCSLAWDDYSIGSGRDPY

SEQ ID NO: 1482771 - protein, 22 aa, Mycobacterium tuberculosis
FSRGSLNVIARRAGVAKGSLFQ

SEQ ID NO: 1482772 - protein, 18 aa, Mycobacterium tuberculosis
FSRHLKLLAKELEVPVVA

SEQ ID NO: 1482773 - protein, 18 aa, Mycobacterium tuberculosis
FSRLRSAELAECGALMHD

SEQ ID NO: 1482774 - protein, 17 aa, Mycobacterium tuberculosis
FSRRCRAVRVVPFDPHL

SEQ ID NO: 1482775 - protein, 26 aa, Mycobacterium tuberculosis
FSRTCKSLLRLLGIGSPTWGRWRAET

SEQ ID NO: 1482776 - protein, 17 aa, Mycobacterium tuberculosis
FSSGCAMGARRPDRSRG

SEQ ID NO: 1482777 - protein, 25 aa, Mycobacterium tuberculosis
FSSLDRWPGTVGEYLNTVFDPSLTF

SEQ ID NO: 1482778 - protein, 17 aa, Mycobacterium tuberculosis
FSTAWDYRARARAARAL

SEQ ID NO: 1482779 - protein, 17 aa, Mycobacterium tuberculosis
FSTGLFNPGHGNTGFLN

SEQ ID NO: 1482780 - protein, 17 aa, Mycobacterium tuberculosis
FSVGGGFIVTKQTSGNS

SEQ ID NO: 1482781 - protein, 18 aa, Mycobacterium tuberculosis
FTAAEALEYGFRRSHHHP

SEQ ID NO: 1482782 - protein, 25 aa, Mycobacterium tuberculosis
FTAALSGLVDRFGLAGERLDMVVGG

SEQ ID NO: 1482783 - protein, 17 aa, Mycobacterium tuberculosis
FTANILMYGRVVVVADP

SEQ ID NO: 1482784 - protein, 19 aa, Mycobacterium tuberculosis
FTAPHFASAWAHASNTPLQ

SEQ ID NO: 1482785 - protein, 19 aa, Mycobacterium tuberculosis
FTATPRTGMWRLNHDGRVS

SEQ ID NO: 1482786 - protein, 20 aa, Mycobacterium tuberculosis
FTDLRMKVVDTQTEWPATGH

SEQ ID NO: 1482787 - protein, 18 aa, Mycobacterium tuberculosis
FTDTPALRALSRARSMAA

SEQ ID NO: 1482788 - protein, 24 aa, Mycobacterium tuberculosis
FTENPAGSVLIEFGHTKVLCTASV

SEQ ID NO: 1482789 - protein, 19 aa, Mycobacterium tuberculosis
FTERAAPILADLRQLEAIA

SEQ ID NO: 1482790 - protein, 21 aa, Mycobacterium tuberculosis
FTEVIVAPGYAPGALDVLARK

SEQ ID NO: 1482791 - protein, 23 aa, Mycobacterium tuberculosis
FTGAFGPVVVPPIPVLAINAHLT

SEQ ID NO: 1482792 - protein, 24 aa, Mycobacterium tuberculosis
FTGAFGPVVVPPIPVLAINAHLTG

SEQ ID NO: 1482793 - protein, 18 aa, Mycobacterium tuberculosis
FTGAPLTHDLCVHGNPVV

SEQ ID NO: 1482794 - protein, 24 aa, Mycobacterium tuberculosis
FTGQRFFRIRGGQLYGQLRDVAYQ

SEQ ID NO: 1482795 - protein, 18 aa, Mycobacterium tuberculosis
FTGSGGIGGNGGAGGTGG

SEQ ID NO: 1482796 - protein, 17 aa, Mycobacterium tuberculosis
FTGVTPFADAYKPRPCD

SEQ ID NO: 1482797 - protein, 17 aa, Mycobacterium tuberculosis
FTHTCFMVTPYEGYVAV

SEQ ID NO: 1482798 - protein, 18 aa, Mycobacterium tuberculosis
FTIPGGTLIPQLPLGLGL

SEQ ID NO: 1482799 - protein, 20 aa, Mycobacterium tuberculosis
FTIPIIGFESFAFSFHIHTE

SEQ ID NO: 1482800 - protein, 22 aa, Mycobacterium tuberculosis
FTKLRIPGARVIPTIYFLRHST

SEQ ID NO: 1482801 - protein, 25 aa, Mycobacterium tuberculosis
FTKLRIPGARVIPTIYFLRHSTDPV

SEQ ID NO: 1482802 - protein, 17 aa, Mycobacterium tuberculosis
FTLNGGIGPISIPTTTV

SEQ ID NO: 1482803 - protein, 21 aa, Mycobacterium tuberculosis
FTLSGGHLFSIYDGCREEGIR

SEQ ID NO: 1482804 - protein, 18 aa, Mycobacterium tuberculosis
FTLYHLPVALQLPPGATG

SEQ ID NO: 1482805 - protein, 17 aa, Mycobacterium tuberculosis
FTNICYTGCRFCAFAQR

SEQ ID NO: 1482806 - protein, 23 aa, Mycobacterium tuberculosis
FTQPRHRIGAVGGLVDHGLEHAT

SEQ ID NO: 1482807 - protein, 24 aa, Mycobacterium tuberculosis
FTQQLKKLAGLSERLTSAAAAAAG

SEQ ID NO: 1482808 - protein, 24 aa, Mycobacterium tuberculosis
FTRDSSIWIGPRVVIPSLALRARV

SEQ ID NO: 1482809 - protein, 19 aa, Mycobacterium tuberculosis
FTRSFARYEPMPESAAARV

SEQ ID NO: 1482810 - protein, 22 aa, Mycobacterium tuberculosis
FTTGVPVQWSAVFAGSGGRRVQ

SEQ ID NO: 1482811 - protein, 20 aa, Mycobacterium tuberculosis
FTTPGTLGWVSKTYVGSRVR

SEQ ID NO: 1482812 - protein, 24 aa, Mycobacterium tuberculosis
FTVFPDGYSLPAIQLGIDVGGGLG

SEQ ID NO: 1482813 - protein, 17 aa, Mycobacterium tuberculosis
FTVRAGSLVAWNAEQSG

SEQ ID NO: 1482814 - protein, 18 aa, Mycobacterium tuberculosis
FVAALRAIWLAWQDGTQL

SEQ ID NO: 1482815 - protein, 24 aa, Mycobacterium tuberculosis
FVACPFGGSGARMYRTGDLVCWRA

SEQ ID NO: 1482816 - protein, 23 aa, Mycobacterium tuberculosis
FVAEAIAVLGARVAGSSLAGSAT

SEQ ID NO: 1482817 - protein, 17 aa, Mycobacterium tuberculosis
FVAPVVAYLCTEECADN

SEQ ID NO: 1482818 - protein, 19 aa, Mycobacterium tuberculosis
FVDQLGIEFQRQYITAAGR

SEQ ID NO: 1482819 - protein, 17 aa, Mycobacterium tuberculosis
FVENFFMFIAEEVREYL

SEQ ID NO: 1482820 - protein, 18 aa, Mycobacterium tuberculosis
FVFGEAGALMLIETEEHA

SEQ ID NO: 1482821 - protein, 17 aa, Mycobacterium tuberculosis
FVFGPLLNNPHRLGKPL

SEQ ID NO: 1482822 - protein, 17 aa, Mycobacterium tuberculosis
FVGAATFEALSGEPVCT

SEQ ID NO: 1482823 - protein, 17 aa, Mycobacterium tuberculosis
FVHIATATSTGGSGGFG

SEQ ID NO: 1482824 - protein, 17 aa, Mycobacterium tuberculosis
FVHTLTAAARWYTATEI

SEQ ID NO: 1482825 - protein, 23 aa, Mycobacterium tuberculosis
FVHTLTAAARWYTATEIANAAAM

SEQ ID NO: 1482826 - protein, 18 aa, Mycobacterium tuberculosis
FVIDVTVWIDLAEAANSD

SEQ ID NO: 1482827 - protein, 19 aa, Mycobacterium tuberculosis
FVIVDECHYYRGVFGSNVA

SEQ ID NO: 1482828 - protein, 29 aa, Mycobacterium tuberculosis
FVLAPWQIHDWILLTPWGLLSWLQINQQL

SEQ ID NO: 1482829 - protein, 30 aa, Mycobacterium tuberculosis
FVLAPWQIHDWILLTPWGLLSWLQINQQLG

SEQ ID NO: 1482830 - protein, 17 aa, Mycobacterium tuberculosis
FVLGQALELPQPGAQDC

SEQ ID NO: 1482831 - protein, 20 aa, Mycobacterium tuberculosis
FVLPNAWDVPSDLAYLAEGF

SEQ ID NO: 1482832 - protein, 27 aa, Mycobacterium tuberculosis
FVLRRPEMPALLAELGLSDRQLASTGA

SEQ ID NO: 1482833 - protein, 18 aa, Mycobacterium tuberculosis
FVNGKSWLVFGPYAGWSP

SEQ ID NO: 1482834 - protein, 19 aa, Mycobacterium tuberculosis
FVNSSGWPRQRESTSRGWA

SEQ ID NO: 1482835 - protein, 17 aa, Mycobacterium tuberculosis
FVPDLTKYQYWNGDSNS

SEQ ID NO: 1482836 - protein, 17 aa, Mycobacterium tuberculosis
FVPLRPERVVEVRYDRM

SEQ ID NO: 1482837 - protein, 24 aa, Mycobacterium tuberculosis
FVPLRPGHVSIYLCGATVQGLPHI

SEQ ID NO: 1482838 - protein, 18 aa, Mycobacterium tuberculosis
FVQALAGAMGAYAAAEAA

SEQ ID NO: 1482839 - protein, 17 aa, Mycobacterium tuberculosis
FVRCLESGYAANVEGGC

SEQ ID NO: 1482840 - protein, 21 aa, Mycobacterium tuberculosis
FVRGEGAGVVVLKRLTDAVRD

SEQ ID NO: 1482841 - protein, 22 aa, Mycobacterium tuberculosis
FVRTSGYLPGPHDVYVSMNMVR

SEQ ID NO: 1482842 - protein, 23 aa, Mycobacterium tuberculosis
FVRTSGYLPGPHDVYVSMNMVRK

SEQ ID NO: 1482843 - protein, 28 aa, Mycobacterium tuberculosis
FVSGAAGNLARLGSMISAANSAAAAQTT

SEQ ID NO: 1482844 - protein, 18 aa, Mycobacterium tuberculosis
FVVGMSLGGLTAIRLAAM

SEQ ID NO: 1482845 - protein, 17 aa, Mycobacterium tuberculosis
FVVGSAIQVVDRVQWFQ

SEQ ID NO: 1482846 - protein, 19 aa, Mycobacterium tuberculosis
FWDIWKASLQGVLATRPDF

SEQ ID NO: 1482847 - protein, 18 aa, Mycobacterium tuberculosis
FWRRGRRPLETKVVLDWD

SEQ ID NO: 1482848 - protein, 18 aa, Mycobacterium tuberculosis
FWRSGGRTRTRFGHVEDI

SEQ ID NO: 1482849 - protein, 27 aa, Mycobacterium tuberculosis
FWSAPVTTFRGCWSRPSTSRPPAVRAR

SEQ ID NO: 1482850 - protein, 26 aa, Mycobacterium tuberculosis
FYAALEFWSALHGFVLLEMTGVMDDI

SEQ ID NO: 1482851 - protein, 19 aa, Mycobacterium tuberculosis
FYAVCGWDAVNEAIGRPED

SEQ ID NO: 1482852 - protein, 19 aa, Mycobacterium tuberculosis
FYCVANMPASVPKTSTYAL

SEQ ID NO: 1482853 - protein, 22 aa, Mycobacterium tuberculosis
FYELVSRVGLERARRVVDLGCG

SEQ ID NO: 1482854 - protein, 25 aa, Mycobacterium tuberculosis
FYLPPEAFDNPDFQRGLKLFLSADG

SEQ ID NO: 1482855 - protein, 18 aa, Mycobacterium tuberculosis
FYNTEGLPYFSIGMGNNF

SEQ ID NO: 1482856 - protein, 20 aa, Mycobacterium tuberculosis
FYRGKIAVAAFFAKNMLPKL

SEQ ID NO: 1482857 - protein, 19 aa, Mycobacterium tuberculosis
FYRGVGQGSLQFSITTPDL

SEQ ID NO: 1482858 - protein, 25 aa, Mycobacterium tuberculosis
FYSKCRYPRRPPARGGDGGVGGTGA

SEQ ID NO: 1482859 - protein, 17 aa, Mycobacterium tuberculosis
FYSPRMAGMYNEWLDEG

SEQ ID NO: 1482860 - protein, 17 aa, Mycobacterium tuberculosis
FYWATRSGVTVSMADVL

SEQ ID NO: 1482861 - protein, 24 aa, Mycobacterium tuberculosis
GAAALPTVEVVAAAADEVSTQIAA

SEQ ID NO: 1482862 - protein, 17 aa, Mycobacterium tuberculosis
GAAAPYVGWLSAAAGQA

SEQ ID NO: 1482863 - protein, 23 aa, Mycobacterium tuberculosis
GAADADDAPAWWDGTVVEHIRVS

SEQ ID NO: 1482864 - protein, 20 aa, Mycobacterium tuberculosis
GAAESLWALLARVLPEPWRV

SEQ ID NO: 1482865 - protein, 23 aa, Mycobacterium tuberculosis
GAAGARGALTSGGLAGGVGAGGT

SEQ ID NO: 1482866 - protein, 17 aa, Mycobacterium tuberculosis
GAAGFAGGVGGAGGEGL

SEQ ID NO: 1482867 - protein, 17 aa, Mycobacterium tuberculosis
GAAGGDAGLLFGSGGAG

SEQ ID NO: 1482868 - protein, 24 aa, Mycobacterium tuberculosis
GAAGGVGGRGGWLLGNGGTGGAGG

SEQ ID NO: 1482869 - protein, 25 aa, Mycobacterium tuberculosis
GAAGGVGGRGGWLLGNGGTGGAGGA

SEQ ID NO: 1482870 - protein, 18 aa, Mycobacterium tuberculosis
GAAGHAGTIFGNGGNAGA

SEQ ID NO: 1482871 - protein, 19 aa, Mycobacterium tuberculosis
GAAGLFGHGGNGGAGGSNA

SEQ ID NO: 1482872 - protein, 18 aa, Mycobacterium tuberculosis
GAAGLFGIGGAGGAGGAG

SEQ ID NO: 1482873 - protein, 26 aa, Mycobacterium tuberculosis
GAAGLGGCGGGAFTAGVTTGGAGGTG

SEQ ID NO: 1482874 - protein, 17 aa, Mycobacterium tuberculosis
GAAGLWGSGGSGGTGGQ

SEQ ID NO: 1482875 - protein, 25 aa, Mycobacterium tuberculosis
GAAGPRIGKGGAVVVAPVAAGTDVA

SEQ ID NO: 1482876 - protein, 34 aa, Mycobacterium tuberculosis
GAAGVLRQRWQRRGRWCPERTPPPAAPPAGSSAS

SEQ ID NO: 1482877 - protein, 27 aa, Mycobacterium tuberculosis
GAAGYNGGFCGWLYGNGGARGAGGTSV

SEQ ID NO: 1482878 - protein, 24 aa, Mycobacterium tuberculosis
GAAHGSGGFCFARQRRNRCRRCRG

SEQ ID NO: 1482879 - protein, 17 aa, Mycobacterium tuberculosis
GAALAGDIAKADCQLVL

SEQ ID NO: 1482880 - protein, 25 aa, Mycobacterium tuberculosis
GAALDYSALYPAGWLVDAPLPAWTH

SEQ ID NO: 1482881 - protein, 23 aa, Mycobacterium tuberculosis
GAAMPHLSGPLAGVGVGGQAGAA

SEQ ID NO: 1482882 - protein, 26 aa, Mycobacterium tuberculosis
GAANGFRRFSGKGGPGGTGGRGGAAG

SEQ ID NO: 1482883 - protein, 25 aa, Mycobacterium tuberculosis
GAARLRWARRPDWGGLEVDVDVAGT

SEQ ID NO: 1482884 - protein, 26 aa, Mycobacterium tuberculosis
GAARLRWARRPDWGGLEVDVDVAGTT

SEQ ID NO: 1482885 - protein, 17 aa, Mycobacterium tuberculosis
GAARPAAGPARRRRPLA

SEQ ID NO: 1482886 - protein, 19 aa, Mycobacterium tuberculosis
GAATSLLGVGMNAGAGGAG

SEQ ID NO: 1482887 - protein, 21 aa, Mycobacterium tuberculosis
GAAVVGRFAGNGGAGGNAGLI

SEQ ID NO: 1482888 - protein, 21 aa, Mycobacterium tuberculosis
GACEHWRRVGGSAVRVLASVA

SEQ ID NO: 1482889 - protein, 25 aa, Mycobacterium tuberculosis
GACEPVCPVEAIFYEDDVPEQWSHY

SEQ ID NO: 1482890 - protein, 22 aa, Mycobacterium tuberculosis
GACRLRCISNAAALEDLVVGDP

SEQ ID NO: 1482891 - protein, 26 aa, Mycobacterium tuberculosis
GADEVSAAIATLFGSHAREYQAISTQ

SEQ ID NO: 1482892 - protein, 28 aa, Mycobacterium tuberculosis
GADEVSARIAALFGMYGLEYQAISAQVA

SEQ ID NO: 1482893 - protein, 29 aa, Mycobacterium tuberculosis
GADEVSARIAGLFGMYGLEYQAISAQVAR

SEQ ID NO: 1482894 - protein, 32 aa, Mycobacterium tuberculosis
GADGNKRRRQTCVSRAGAADDLLAGAHGPAGA

SEQ ID NO: 1482895 - protein, 30 aa, Mycobacterium tuberculosis
GADKSGLTALTWPVMANFAVDSAMAVALAN

SEQ ID NO: 1482896 - protein, 23 aa, Mycobacterium tuberculosis
GADRLTCGFGGPLAASAAPSIPA

SEQ ID NO: 1482897 - protein, 24 aa, Mycobacterium tuberculosis
GADRRGRAAIPGRSSTACTRVGRP

SEQ ID NO: 1482898 - protein, 18 aa, Mycobacterium tuberculosis
GAEALDWVRARNKPTTAA

SEQ ID NO: 1482899 - protein, 22 aa, Mycobacterium tuberculosis
GAECERLHLPPMCDRDTTHCVS

SEQ ID NO: 1482900 - protein, 18 aa, Mycobacterium tuberculosis
GAELGAPVIQGSTRTSER

SEQ ID NO: 1482901 - protein, 25 aa, Mycobacterium tuberculosis
GAESFPEETFPVIVALMTNVFDGAA

SEQ ID NO: 1482902 - protein, 25 aa, Mycobacterium tuberculosis
GAFILPPSIFHWLNYSVTAYQTGAT

SEQ ID NO: 1482903 - protein, 30 aa, Mycobacterium tuberculosis
GAFWTGDYQGLLGFSYRPAVLPQTPFLDLT

SEQ ID NO: 1482904 - protein, 25 aa, Mycobacterium tuberculosis
GAGAGMPAGMMGRGGANPHVVQARP

SEQ ID NO: 1482905 - protein, 18 aa, Mycobacterium tuberculosis
GAGALGFVGTAGKESVGQ

SEQ ID NO: 1482906 - protein, 17 aa, Mycobacterium tuberculosis
GAGFVELAIRAGDEVGC

SEQ ID NO: 1482907 - protein, 25 aa, Mycobacterium tuberculosis
GAGGAGGAGGFGFGGAGGAGGLGGK

SEQ ID NO: 1482908 - protein, 25 aa, Mycobacterium tuberculosis
GAGGAGGAGGWLSGHSGAHGAMGSG

SEQ ID NO: 1482909 - protein, 24 aa, Mycobacterium tuberculosis
GAGGAGGDGGWLFGDGGAAGAGGN

SEQ ID NO: 1482910 - protein, 25 aa, Mycobacterium tuberculosis
GAGGAGGFGAVLFGNGGAGGSGAPG

SEQ ID NO: 1482911 - protein, 23 aa, Mycobacterium tuberculosis
GAGGAGGLFGIGGAGGGCGSAVA

SEQ ID NO: 1482912 - protein, 26 aa, Mycobacterium tuberculosis
GAGGAGGNAWLFGNGGAGGLGAAGAA

SEQ ID NO: 1482913 - protein, 23 aa, Mycobacterium tuberculosis
GAGGAGGNAWLIGDGGAGGNGGD

SEQ ID NO: 1482914 - protein, 31 aa, Mycobacterium tuberculosis
GAGGAGGRGGKGIDGGFGGDGGNGGSNNGTG

SEQ ID NO: 1482915 - protein, 26 aa, Mycobacterium tuberculosis
GAGGAGGRGGWLVGNGGNGGNGGNGA

SEQ ID NO: 1482916 - protein, 21 aa, Mycobacterium tuberculosis
GAGGAGGWLYGDGGAGGAGGG

SEQ ID NO: 1482917 - protein, 19 aa, Mycobacterium tuberculosis
GAGGAGISFSNGSNGGTGG

SEQ ID NO: 1482918 - protein, 20 aa, Mycobacterium tuberculosis
GAGGDGGNAGFFGNGGNGGM

SEQ ID NO: 1482919 - protein, 24 aa, Mycobacterium tuberculosis
GAGGDRAGALVGRDGGPGGNGGAG

SEQ ID NO: 1482920 - protein, 26 aa, Mycobacterium tuberculosis
GAGGDVSADFGGVGFGGQGGNGGAGG

SEQ ID NO: 1482921 - protein, 27 aa, Mycobacterium tuberculosis
GAGGDVSADFGGVGFGGQGGNGGAGGL

SEQ ID NO: 1482922 - protein, 21 aa, Mycobacterium tuberculosis
GAGGFGIPVGSGGAGGSRGVL

SEQ ID NO: 1482923 - protein, 18 aa, Mycobacterium tuberculosis
GAGGFSFSTAGGAGGTVF

SEQ ID NO: 1482924 - protein, 18 aa, Mycobacterium tuberculosis
GAGGILWGNGGNGGSGAP

SEQ ID NO: 1482925 - protein, 24 aa, Mycobacterium tuberculosis
GAGGKADIANSLGDNATVTGGNGG

SEQ ID NO: 1482926 - protein, 18 aa, Mycobacterium tuberculosis
GAGGKALSPTGNNGSQGA

SEQ ID NO: 1482927 - protein, 22 aa, Mycobacterium tuberculosis
GAGGKGGSGLVGGDGGNGGAGG

SEQ ID NO: 1482928 - protein, 23 aa, Mycobacterium tuberculosis
GAGGKGGSGLVGGDGGNGGAGGA

SEQ ID NO: 1482929 - protein, 36 aa, Mycobacterium tuberculosis
GAGGKGRRQPPTVWPSIPVFGCNGGDTGNAGNGGNG

SEQ ID NO: 1482930 - protein, 23 aa, Mycobacterium tuberculosis
GAGGKSGAFGLGGDGGAGGATGL

SEQ ID NO: 1482931 - protein, 20 aa, Mycobacterium tuberculosis
GAGGLLIGNGGAGGVGGTAG

SEQ ID NO: 1482932 - protein, 17 aa, Mycobacterium tuberculosis
GAGGLLYRQRRGRRVRG

SEQ ID NO: 1482933 - protein, 18 aa, Mycobacterium tuberculosis
GAGGLPSAAIGGGVAVGE

SEQ ID NO: 1482934 - protein, 19 aa, Mycobacterium tuberculosis
GAGGNALFGNGGDGGSSTV

SEQ ID NO: 1482935 - protein, 20 aa, Mycobacterium tuberculosis
GAGGNARLIGDGGRGGNGGE

SEQ ID NO: 1482936 - protein, 25 aa, Mycobacterium tuberculosis
GAGGNGALLFGFGGAGGAGGHGGAA

SEQ ID NO: 1482937 - protein, 26 aa, Mycobacterium tuberculosis
GAGGNGGNAGLFGHGGAGGTGGAGLA

SEQ ID NO: 1482938 - protein, 18 aa, Mycobacterium tuberculosis
GAGGQGGLLFGDGGNGGA

SEQ ID NO: 1482939 - protein, 19 aa, Mycobacterium tuberculosis
GAGGRAGAIGNGGDGGNGG

SEQ ID NO: 1482940 - protein, 25 aa, Mycobacterium tuberculosis
GAGGRGGAGGLGFGSEAPGRPGGAG

SEQ ID NO: 1482941 - protein, 26 aa, Mycobacterium tuberculosis
GAGGRGGAGGLGFGSEAPGRPGGAGG

SEQ ID NO: 1482942 - protein, 21 aa, Mycobacterium tuberculosis
GAGGRGGDAGLFLGAAGTGGQ

SEQ ID NO: 1482943 - protein, 24 aa, Mycobacterium tuberculosis
GAGGRGGDAGLFLGAAGTGGQAAL

SEQ ID NO: 1482944 - protein, 18 aa, Mycobacterium tuberculosis
GAGGRGGDAGLLFGAAGT

SEQ ID NO: 1482945 - protein, 19 aa, Mycobacterium tuberculosis
GAGGRGGDAGLLFGAAGTG

SEQ ID NO: 1482946 - protein, 20 aa, Mycobacterium tuberculosis
GAGGSAFLIGSGGTGGVGGA

SEQ ID NO: 1482947 - protein, 26 aa, Mycobacterium tuberculosis
GAGGSAGLLGYVGRAGDGGAGGGGGL

SEQ ID NO: 1482948 - protein, 21 aa, Mycobacterium tuberculosis
GAGGSARLIGAGGHGGDGGAG

SEQ ID NO: 1482949 - protein, 21 aa, Mycobacterium tuberculosis
GAGGSGGAWAGNGGTGGAGGT

SEQ ID NO: 1482950 - protein, 21 aa, Mycobacterium tuberculosis
GAGGSGGWLLGNGGVGGAGGQ

SEQ ID NO: 1482951 - protein, 33 aa, Mycobacterium tuberculosis
GAGGSRGCAVRHPWSKRRRRLTRAPSERSRNPA

SEQ ID NO: 1482952 - protein, 17 aa, Mycobacterium tuberculosis
GAGGSRGQISGNPGTPG

SEQ ID NO: 1482953 - protein, 22 aa, Mycobacterium tuberculosis
GAGGYFCAGMDLKAATQKPPGA

SEQ ID NO: 1482954 - protein, 23 aa, Mycobacterium tuberculosis
GAGGYFCAGMDLKAATQKPPGDS

SEQ ID NO: 1482955 - protein, 24 aa, Mycobacterium tuberculosis
GAGGYPQMLLRVGWAPINADPLPP

SEQ ID NO: 1482956 - protein, 18 aa, Mycobacterium tuberculosis
GAGHLGFAGTARREAVAD

SEQ ID NO: 1482957 - protein, 18 aa, Mycobacterium tuberculosis
GAGHLGFAGTARREAVAH

SEQ ID NO: 1482958 - protein, 18 aa, Mycobacterium tuberculosis
GAGKTVLRFAELIDAESP

SEQ ID NO: 1482959 - protein, 18 aa, Mycobacterium tuberculosis
GAGKVLQTPKGRHLLVKA

SEQ ID NO: 1482960 - protein, 18 aa, Mycobacterium tuberculosis
GAGLMRAGSLPGEAGSAA

SEQ ID NO: 1482961 - protein, 23 aa, Mycobacterium tuberculosis
GAGLTLALAADWRVSGDNVTADG

SEQ ID NO: 1482962 - protein, 21 aa, Mycobacterium tuberculosis
GAGLTSRHPLAGGSSASAGAG

SEQ ID NO: 1482963 - protein, 29 aa, Mycobacterium tuberculosis
GAGNPWRQRWPTAACGTATVAPAGPPAKG

SEQ ID NO: 1482964 - protein, 31 aa, Mycobacterium tuberculosis
GAGPEPMAAAATAWDGLAMELASAAASFGSV

SEQ ID NO: 1482965 - protein, 23 aa, Mycobacterium tuberculosis
GAGPRIGRRIARVAGGAVRGRGG

SEQ ID NO: 1482966 - protein, 29 aa, Mycobacterium tuberculosis
GAGPRSPLRWPWGACPAPLRPPNVTISNV

SEQ ID NO: 1482967 - protein, 18 aa, Mycobacterium tuberculosis
GAGPRYGFRVTVMSRPPF

SEQ ID NO: 1482968 - protein, 22 aa, Mycobacterium tuberculosis
GAGQITGLRSGFGGAGGAGGAS

SEQ ID NO: 1482969 - protein, 25 aa, Mycobacterium tuberculosis
GAGQITGLRSGFGGAGGAGGASDTG

SEQ ID NO: 1482970 - protein, 17 aa, Mycobacterium tuberculosis
GAGSGWRQFDVVAQTGS

SEQ ID NO: 1482971 - protein, 19 aa, Mycobacterium tuberculosis
GAGSIGFNASAPGAAGSPG

SEQ ID NO: 1482972 - protein, 52 aa, Mycobacterium tuberculosis
GAGSMLPLGGRRWLPRTRRRHRARGRPRRGRHLLPARRRPITSTNPIAASLQ

SEQ ID NO: 1482973 - protein, 22 aa, Mycobacterium tuberculosis
GAGSNALGLFLGLGGSGGQGGV

SEQ ID NO: 1482974 - protein, 25 aa, Mycobacterium tuberculosis
GAGSPGAVCRWCERVDPTLRCVRCA

SEQ ID NO: 1482975 - protein, 23 aa, Mycobacterium tuberculosis
GAGSRPARGFSVAHRLCQDQPRS

SEQ ID NO: 1482976 - protein, 17 aa, Mycobacterium tuberculosis
GAGTLGFAGNNPQGQSR

SEQ ID NO: 1482977 - protein, 33 aa, Mycobacterium tuberculosis
GAGTWVKAVAGIRLALSLGFRVRVAATVASPAP

SEQ ID NO: 1482978 - protein, 24 aa, Mycobacterium tuberculosis
GAGVPGGNALVCFGAGGTLQRTPT

SEQ ID NO: 1482979 - protein, 25 aa, Mycobacterium tuberculosis
GAGYADMTAIFLGSSGTPGEDGGNG

SEQ ID NO: 1482980 - protein, 26 aa, Mycobacterium tuberculosis
GAHAGRRLTRRFGLGGAGTGEKPDPE

SEQ ID NO: 1482981 - protein, 18 aa, Mycobacterium tuberculosis
GAHAREYQAAAAQAAAYH

SEQ ID NO: 1482982 - protein, 21 aa, Mycobacterium tuberculosis
GAHRAGCRLRCGRCPNQSCPT

SEQ ID NO: 1482983 - protein, 25 aa, Mycobacterium tuberculosis
GAHRGCADPAIAIPAGLPVAQRDSV

SEQ ID NO: 1482984 - protein, 34 aa, Mycobacterium tuberculosis
GAIAYARARGLPVLGLCLGLQCIVIEAARSVGLT

SEQ ID NO: 1482985 - protein, 24 aa, Mycobacterium tuberculosis
GAIGAGRTLHGWNGALAAGPTLAG

SEQ ID NO: 1482986 - protein, 20 aa, Mycobacterium tuberculosis
GAIGRPRVPVEVNHEPFVTL

SEQ ID NO: 1482987 - protein, 26 aa, Mycobacterium tuberculosis
GAIPGGWWLTFGQILGLAQNAPGVAA

SEQ ID NO: 1482988 - protein, 24 aa, Mycobacterium tuberculosis
GAIPRRWRNPAPLWGDTSFHSVAP

SEQ ID NO: 1482989 - protein, 17 aa, Mycobacterium tuberculosis
GAIPVMCLPGHRAAELG

SEQ ID NO: 1482990 - protein, 18 aa, Mycobacterium tuberculosis
GAIRACPQAVKAGGAGGA

SEQ ID NO: 1482991 - protein, 18 aa, Mycobacterium tuberculosis
GAITPFALLQLADRGQFF

SEQ ID NO: 1482992 - protein, 18 aa, Mycobacterium tuberculosis
GAIVKRPRVVVDASGNES

SEQ ID NO: 1482993 - protein, 18 aa, Mycobacterium tuberculosis
GAIWRPVDPAPRLLPAPE

SEQ ID NO: 1482994 - protein, 23 aa, Mycobacterium tuberculosis
GAKFPSGSFYLSISDLQINGPII

SEQ ID NO: 1482995 - protein, 24 aa, Mycobacterium tuberculosis
GALALASSLLRVWMTRGRIQEGRA

SEQ ID NO: 1482996 - protein, 19 aa, Mycobacterium tuberculosis
GALEAFAIAVAGRRCLDAG

SEQ ID NO: 1482997 - protein, 18 aa, Mycobacterium tuberculosis
GALGLMKAVLALQHGVVP

SEQ ID NO: 1482998 - protein, 19 aa, Mycobacterium tuberculosis
GALGLRPTLAALKTGARLA

SEQ ID NO: 1482999 - protein, 18 aa, Mycobacterium tuberculosis
GALLMLPGVRGLGPGPVT

SEQ ID NO: 1483000 - protein, 18 aa, Mycobacterium tuberculosis
GALNSGIGNMGFGNSGNN

SEQ ID NO: 1483001 - protein, 21 aa, Mycobacterium tuberculosis
GALSRRYPHRVFDSGIAEQHL

SEQ ID NO: 1483002 - protein, 17 aa, Mycobacterium tuberculosis
GALTGGVAWEGLNNLGA

SEQ ID NO: 1483003 - protein, 22 aa, Mycobacterium tuberculosis
GALWERLTRAVGMDARDAVWQH

SEQ ID NO: 1483004 - protein, 18 aa, Mycobacterium tuberculosis
GAMALPREDVADLAGAAV

SEQ ID NO: 1483005 - protein, 22 aa, Mycobacterium tuberculosis
GAMAVPLGWAATVVGEGGFSVT

SEQ ID NO: 1483006 - protein, 18 aa, Mycobacterium tuberculosis
GAMSQNFTNVVMTVTDTT

SEQ ID NO: 1483007 - protein, 20 aa, Mycobacterium tuberculosis
GAMTPGALAIRERVRPPSMT

SEQ ID NO: 1483008 - protein, 17 aa, Mycobacterium tuberculosis
GANAYLLPARNWSVMAA

SEQ ID NO: 1483009 - protein, 25 aa, Mycobacterium tuberculosis
GANGGAGGNAWLFGAGGSGGAGTNG

SEQ ID NO: 1483010 - protein, 22 aa, Mycobacterium tuberculosis
GANGGDAGWLIGNGGAGGSGAK

SEQ ID NO: 1483011 - protein, 18 aa, Mycobacterium tuberculosis
GANGIAGNGGDGGDGAAG

SEQ ID NO: 1483012 - protein, 19 aa, Mycobacterium tuberculosis
GANGISAFMVHKDDEGFTV

SEQ ID NO: 1483013 - protein, 24 aa, Mycobacterium tuberculosis
GANGNFAFGDGNGGHGGNGGNPGA

SEQ ID NO: 1483014 - protein, 18 aa, Mycobacterium tuberculosis
GANVAPPLTWSSPAGAAE

SEQ ID NO: 1483015 - protein, 17 aa, Mycobacterium tuberculosis
GAPEHRAAAIVKATTFF

SEQ ID NO: 1483016 - protein, 20 aa, Mycobacterium tuberculosis
GAPEVSGWLDGLRAAKRALV

SEQ ID NO: 1483017 - protein, 18 aa, Mycobacterium tuberculosis
GAPGGWLIGNGGAGGSGA

SEQ ID NO: 1483018 - protein, 26 aa, Mycobacterium tuberculosis
GAPLAPGVEPLPPWPPAPPTPGSPPW

SEQ ID NO: 1483019 - protein, 29 aa, Mycobacterium tuberculosis
GAPLVPLPISGRPVFARKNSLIGSSSGDT

SEQ ID NO: 1483020 - protein, 28 aa, Mycobacterium tuberculosis
GAPMAKRLLDWPGGLTVFDVRVEAMAPF

SEQ ID NO: 1483021 - protein, 21 aa, Mycobacterium tuberculosis
GAPMGRAIPYHIGRHSHPKAK

SEQ ID NO: 1483022 - protein, 19 aa, Mycobacterium tuberculosis
GAPMPAPRAILAAAVEGAQ

SEQ ID NO: 1483023 - protein, 37 aa, Mycobacterium tuberculosis
GAPNRIEGWMPFGRVFETLAWGRRHVVMGANQVDRYG

SEQ ID NO: 1483024 - protein, 25 aa, Mycobacterium tuberculosis
GAPPHGGIAFGWDRTTALLAGMDSI

SEQ ID NO: 1483025 - protein, 18 aa, Mycobacterium tuberculosis
GAPRRGRKSKRQKRQEYD

SEQ ID NO: 1483026 - protein, 33 aa, Mycobacterium tuberculosis
GAPSFVEALRWGAEVYHALKSVLKKEGLSTGLG

SEQ ID NO: 1483027 - protein, 18 aa, Mycobacterium tuberculosis
GAPTDFFASGPISRVEGG

SEQ ID NO: 1483028 - protein, 21 aa, Mycobacterium tuberculosis
GAPTPVADRFVRYVNRDNTTA

SEQ ID NO: 1483029 - protein, 18 aa, Mycobacterium tuberculosis
GAQLCATAPVFAEHIHRC

SEQ ID NO: 1483030 - protein, 23 aa, Mycobacterium tuberculosis
GARAARHRIHRSGHGQPIPDAEL

SEQ ID NO: 1483031 - protein, 24 aa, Mycobacterium tuberculosis
GARCSRFARQVVRDEGVGRHVLQV

SEQ ID NO: 1483032 - protein, 17 aa, Mycobacterium tuberculosis
GAREHALLLALGKDLQV

SEQ ID NO: 1483033 - protein, 25 aa, Mycobacterium tuberculosis
GARGHRRRQGCRRPRRHRDPAIAGG

SEQ ID NO: 1483034 - protein, 18 aa, Mycobacterium tuberculosis
GARGRRLDVRQARTAVHQ

SEQ ID NO: 1483035 - protein, 17 aa, Mycobacterium tuberculosis
GARGYRGSGNGFSQSRV

SEQ ID NO: 1483036 - protein, 19 aa, Mycobacterium tuberculosis
GARLGSGRQYMSWISLEDE

SEQ ID NO: 1483037 - protein, 18 aa, Mycobacterium tuberculosis
GARPERWIDQTNFDNDEA

SEQ ID NO: 1483038 - protein, 20 aa, Mycobacterium tuberculosis
GARQRLMCRLPKRPDPHAWL

SEQ ID NO: 1483039 - protein, 25 aa, Mycobacterium tuberculosis
GARRLPRCIPMVAGARIPAGTDRVG

SEQ ID NO: 1483040 - protein, 17 aa, Mycobacterium tuberculosis
GARSAAATLDWLQAHGH

SEQ ID NO: 1483041 - protein, 17 aa, Mycobacterium tuberculosis
GASAIVFRDTAHAAELA

SEQ ID NO: 1483042 - protein, 17 aa, Mycobacterium tuberculosis
GASALSLSLLSISRSGN

SEQ ID NO: 1483043 - protein, 20 aa, Mycobacterium tuberculosis
GASFLRRDGSVWTTDKDGII

SEQ ID NO: 1483044 - protein, 18 aa, Mycobacterium tuberculosis
GASGLGIGNGGPGGSGGT

SEQ ID NO: 1483045 - protein, 22 aa, Mycobacterium tuberculosis
GASIGDGWWLTRVVEGDGRGTV

SEQ ID NO: 1483046 - protein, 22 aa, Mycobacterium tuberculosis
GASIPQCQRCDAVGVDMFGCTF

SEQ ID NO: 1483047 - protein, 37 aa, Mycobacterium tuberculosis
GASPRTGSGFPFRRVLHHHRWPGWAGLIPGREDGQRR

SEQ ID NO: 1483048 - protein, 23 aa, Mycobacterium tuberculosis
GASRAEQGLPFAREAALAKRLGS

SEQ ID NO: 1483049 - protein, 24 aa, Mycobacterium tuberculosis
GASVLKQLVAYVGLERFLAGLRDY

SEQ ID NO: 1483050 - protein, 25 aa, Mycobacterium tuberculosis
GATALEGSGWTVAAEEAGPVTGMMP

SEQ ID NO: 1483051 - protein, 17 aa, Mycobacterium tuberculosis
GATLRWYGVTDDGRIDL

SEQ ID NO: 1483052 - protein, 17 aa, Mycobacterium tuberculosis
GATPDFADTGGKGGNGG

SEQ ID NO: 1483053 - protein, 22 aa, Mycobacterium tuberculosis
GATRPALQLSRALLGNQGLGGT

SEQ ID NO: 1483054 - protein, 19 aa, Mycobacterium tuberculosis
GAVAGSVWKRPRACAFSAE

SEQ ID NO: 1483055 - protein, 22 aa, Mycobacterium tuberculosis
GAVDAYWNWQSCRAGKRAGKTV

SEQ ID NO: 1483056 - protein, 18 aa, Mycobacterium tuberculosis
GAVGARGGGVGAVAAGTA

SEQ ID NO: 1483057 - protein, 26 aa, Mycobacterium tuberculosis
GAVGGKGGTGGLLFGNGGAGGQGGLG

SEQ ID NO: 1483058 - protein, 20 aa, Mycobacterium tuberculosis
GAVLDHFRVAMAAAGTTANV

SEQ ID NO: 1483059 - protein, 27 aa, Mycobacterium tuberculosis
GAVLDHLRIAMTAAHWQANITRFPQPN

SEQ ID NO: 1483060 - protein, 21 aa, Mycobacterium tuberculosis
GAVLPGYGWIFPLGNGEVNIG

SEQ ID NO: 1483061 - protein, 20 aa, Mycobacterium tuberculosis
GAVSAWVELHARFGRLPFET

SEQ ID NO: 1483062 - protein, 21 aa, Mycobacterium tuberculosis
GAVSAWVELHARFGRLPFETL

SEQ ID NO: 1483063 - protein, 31 aa, Mycobacterium tuberculosis
GAVTEPMLFEWTDRNTLLYAIGVGAGTGDLA

SEQ ID NO: 1483064 - protein, 18 aa, Mycobacterium tuberculosis
GAVYAELAAQGWGGRWLV

SEQ ID NO: 1483065 - protein, 19 aa, Mycobacterium tuberculosis
GAVYAELAAQGWGGRWLVV

SEQ ID NO: 1483066 - protein, 20 aa, Mycobacterium tuberculosis
GAWLVCRAAGRVLLEQGQGG

SEQ ID NO: 1483067 - protein, 18 aa, Mycobacterium tuberculosis
GAWPPVTIAGRRYMDGGV

SEQ ID NO: 1483068 - protein, 26 aa, Mycobacterium tuberculosis
GAWRDPRVWWQLRNPFTPSWGEPYVD

SEQ ID NO: 1483069 - protein, 17 aa, Mycobacterium tuberculosis
GAYAEFCTAPASLTAKV

SEQ ID NO: 1483070 - protein, 22 aa, Mycobacterium tuberculosis
GAYALGSARGYRGLAAQLAAAA

SEQ ID NO: 1483071 - protein, 18 aa, Mycobacterium tuberculosis
GAYHGWGFHEDGAASGLR

SEQ ID NO: 1483072 - protein, 21 aa, Mycobacterium tuberculosis
GAYRILRCRREARRFPYSGPR

SEQ ID NO: 1483073 - protein, 19 aa, Mycobacterium tuberculosis
GCAEAMKGQGARVSVTEID

SEQ ID NO: 1483074 - protein, 19 aa, Mycobacterium tuberculosis
GCAGARRSAAVRGFPNRRS

SEQ ID NO: 1483075 - protein, 28 aa, Mycobacterium tuberculosis
GCGARLSVVVAESWRASALAEMIQEAGL

SEQ ID NO: 1483076 - protein, 25 aa, Mycobacterium tuberculosis
GCGCRPRIPLARAWLPGADLRAPCA

SEQ ID NO: 1483077 - protein, 17 aa, Mycobacterium tuberculosis
GCGLSGAARPVEGGLLI

SEQ ID NO: 1483078 - protein, 17 aa, Mycobacterium tuberculosis
GCKEALFTLGDRPEARW

SEQ ID NO: 1483079 - protein, 19 aa, Mycobacterium tuberculosis
GCPDVPVRVWGAQRHLDPR

SEQ ID NO: 1483080 - protein, 25 aa, Mycobacterium tuberculosis
GCRCVCSPTPTGIQCWSRSPWETTP

SEQ ID NO: 1483081 - protein, 25 aa, Mycobacterium tuberculosis
GCREGFAEAVCRGQGCAVTIGEMTF

SEQ ID NO: 1483082 - protein, 22 aa, Mycobacterium tuberculosis
GCSHNAHMYYVLLAPSADREEV

SEQ ID NO: 1483083 - protein, 22 aa, Mycobacterium tuberculosis
GCSLRSWAPSRCWLPRTRRWSR

SEQ ID NO: 1483084 - protein, 17 aa, Mycobacterium tuberculosis
GCSRPGCDAPAYHSEVH

SEQ ID NO: 1483085 - protein, 18 aa, Mycobacterium tuberculosis
GCVSCWPDRSTTTTSPKP

SEQ ID NO: 1483086 - protein, 19 aa, Mycobacterium tuberculosis
GCWRTFLTCDANLAVTLPP

SEQ ID NO: 1483087 - protein, 20 aa, Mycobacterium tuberculosis
GCWRTFLTCDANLAVTLPPG

SEQ ID NO: 1483088 - protein, 23 aa, Mycobacterium tuberculosis
GDADVYLCCPVAMVDAARTWLDH

SEQ ID NO: 1483089 - protein, 18 aa, Mycobacterium tuberculosis
GDAFRAGFLTGRSAGLGL

SEQ ID NO: 1483090 - protein, 17 aa, Mycobacterium tuberculosis
GDAHGLVVVAHRSARGE

SEQ ID NO: 1483091 - protein, 17 aa, Mycobacterium tuberculosis
GDAILFYTDGLIERPGR

SEQ ID NO: 1483092 - protein, 22 aa, Mycobacterium tuberculosis
GDARLLLIVAELPLPMQNVNEE

SEQ ID NO: 1483093 - protein, 20 aa, Mycobacterium tuberculosis
GDASAGWCVSIAITSALLVA

SEQ ID NO: 1483094 - protein, 21 aa, Mycobacterium tuberculosis
GDASFDWPRGPGGLSGTAATR

SEQ ID NO: 1483095 - protein, 17 aa, Mycobacterium tuberculosis
GDAVLGLLRSGEERIEF

SEQ ID NO: 1483096 - protein, 23 aa, Mycobacterium tuberculosis
GDDDRLHGMLTDRDIVIKGLAAG

SEQ ID NO: 1483097 - protein, 23 aa, Mycobacterium tuberculosis
GDDGGAGGWLFGNGGNGGAGAAG

SEQ ID NO: 1483098 - protein, 23 aa, Mycobacterium tuberculosis
GDDGGAGGWLFGNGGQRRGPGGA

SEQ ID NO: 1483099 - protein, 17 aa, Mycobacterium tuberculosis
GDEPLPGAVHFPNNPDI

SEQ ID NO: 1483100 - protein, 23 aa, Mycobacterium tuberculosis
GDEPRPGAALDVLSEAERQVYEG

SEQ ID NO: 1483101 - protein, 24 aa, Mycobacterium tuberculosis
GDEVSAAIAALFSIHGQQYQAMSA

SEQ ID NO: 1483102 - protein, 17 aa, Mycobacterium tuberculosis
GDFASRRGPPTGAAASP

SEQ ID NO: 1483103 - protein, 20 aa, Mycobacterium tuberculosis
GDFWGGAGLGGLPGVHYPVG

SEQ ID NO: 1483104 - protein, 29 aa, Mycobacterium tuberculosis
GDFWGGAGSVACQGFITQLGRNFQVIYEQ

SEQ ID NO: 1483105 - protein, 22 aa, Mycobacterium tuberculosis
GDGAFGFSGMEWDTLVRHNVAV

SEQ ID NO: 1483106 - protein, 21 aa, Mycobacterium tuberculosis
GDGGAGGIFFGTGGTGGAGGV

SEQ ID NO: 1483107 - protein, 25 aa, Mycobacterium tuberculosis
GDGGAGGRGGWLAGAGGAGGDGGIG

SEQ ID NO: 1483108 - protein, 22 aa, Mycobacterium tuberculosis
GDGGAGPLLIGNGGVGGLGGAG

SEQ ID NO: 1483109 - protein, 24 aa, Mycobacterium tuberculosis
GDGGDGGGLFSIGVGGDGGNAGNG

SEQ ID NO: 1483110 - protein, 18 aa, Mycobacterium tuberculosis
GDGGFCGYGAKAAASGCY

SEQ ID NO: 1483111 - protein, 30 aa, Mycobacterium tuberculosis
GDGGNGANGNFAFGDGNGGHGGNGGNPGAG

SEQ ID NO: 1483112 - protein, 21 aa, Mycobacterium tuberculosis
GDGGNGRLFGVDGAGGHGGFG

SEQ ID NO: 1483113 - protein, 25 aa, Mycobacterium tuberculosis
GDGGQGGAGRGLWGTGGAGGHGGQG

SEQ ID NO: 1483114 - protein, 19 aa, Mycobacterium tuberculosis
GDGNGSFADAGDGGPGGNG

SEQ ID NO: 1483115 - protein, 19 aa, Mycobacterium tuberculosis
GDGNVHMAIACKDPEKKKK

SEQ ID NO: 1483116 - protein, 20 aa, Mycobacterium tuberculosis
GDGNVHMAIACKDPEKKKKL

SEQ ID NO: 1483117 - protein, 21 aa, Mycobacterium tuberculosis
GDGQIGIGGLNSGTGNIGFGN

SEQ ID NO: 1483118 - protein, 18 aa, Mycobacterium tuberculosis
GDHFVLFGAVESLSEVPA

SEQ ID NO: 1483119 - protein, 17 aa, Mycobacterium tuberculosis
GDHGVEFVKVAMQPGMP

SEQ ID NO: 1483120 - protein, 23 aa, Mycobacterium tuberculosis
GDHRIHNVAAFPGAAYCEMALAA

SEQ ID NO: 1483121 - protein, 25 aa, Mycobacterium tuberculosis
GDHRMLPRATFCQPNVASFGLIEQQ

SEQ ID NO: 1483122 - protein, 19 aa, Mycobacterium tuberculosis
GDHRRYLLDRHTVQCRHTR

SEQ ID NO: 1483123 - protein, 28 aa, Mycobacterium tuberculosis
GDHSNALWCRWCLGYAQLMRGELAAAAA

SEQ ID NO: 1483124 - protein, 20 aa, Mycobacterium tuberculosis
GDIGATMSAYATAWVGDSPL

SEQ ID NO: 1483125 - protein, 23 aa, Mycobacterium tuberculosis
GDILTRLTAPVIRGLGIGIVPAA

SEQ ID NO: 1483126 - protein, 19 aa, Mycobacterium tuberculosis
GDINTGWFNTGIMNTGTRN

SEQ ID NO: 1483127 - protein, 18 aa, Mycobacterium tuberculosis
GDIPWRLPEDQAHFREIT

SEQ ID NO: 1483128 - protein, 19 aa, Mycobacterium tuberculosis
GDKLSVAKGMMLRRDPDRE

SEQ ID NO: 1483129 - protein, 22 aa, Mycobacterium tuberculosis
GDKMRVTLHYSNKYQVPATATA

SEQ ID NO: 1483130 - protein, 18 aa, Mycobacterium tuberculosis
GDLAELTQCFAPDVEQFV

SEQ ID NO: 1483131 - protein, 18 aa, Mycobacterium tuberculosis
GDLARYWHDGTLEFVGRA

SEQ ID NO: 1483132 - protein, 30 aa, Mycobacterium tuberculosis
GDLAYRDSEGWIYLAGRTADWMRVDGENLT

SEQ ID NO: 1483133 - protein, 31 aa, Mycobacterium tuberculosis
GDLAYRDSEGWIYLAGRTADWMRVDGENLTA

SEQ ID NO: 1483134 - protein, 17 aa, Mycobacterium tuberculosis
GDLGVTLLRTIKATLDP

SEQ ID NO: 1483135 - protein, 21 aa, Mycobacterium tuberculosis
GDLHRRYPFGGRRISHAYLRG

SEQ ID NO: 1483136 - protein, 18 aa, Mycobacterium tuberculosis
GDLLDFTALAKVFGYPTT

SEQ ID NO: 1483137 - protein, 39 aa, Mycobacterium tuberculosis
GDLLFIGCTPIVWAGPIANWVAACDAMIALDAPTVVPGH

SEQ ID NO: 1483138 - protein, 21 aa, Mycobacterium tuberculosis
GDLLIGWRLLVLAGVAHAALA

SEQ ID NO: 1483139 - protein, 17 aa, Mycobacterium tuberculosis
GDLNTGFGSPVDQPVMN

SEQ ID NO: 1483140 - protein, 20 aa, Mycobacterium tuberculosis
GDLPGWLALHGYQNSRKRAV

SEQ ID NO: 1483141 - protein, 17 aa, Mycobacterium tuberculosis
GDLPRPGAIVTSAADRV

SEQ ID NO: 1483142 - protein, 22 aa, Mycobacterium tuberculosis
GDLRVDFPWLGTVVQAYLRRTL

SEQ ID NO: 1483143 - protein, 22 aa, Mycobacterium tuberculosis
GDLSELALGWATYGVGDQMSHY

SEQ ID NO: 1483144 - protein, 18 aa, Mycobacterium tuberculosis
GDLVKGGAGETNFAANNG

SEQ ID NO: 1483145 - protein, 20 aa, Mycobacterium tuberculosis
GDLVSCRQWVVSVTAIGDLD

SEQ ID NO: 1483146 - protein, 17 aa, Mycobacterium tuberculosis
GDLYDVLAINAASASTQ

SEQ ID NO: 1483147 - protein, 17 aa, Mycobacterium tuberculosis
GDNVWPGILGFDDTVIP

SEQ ID NO: 1483148 - protein, 24 aa, Mycobacterium tuberculosis
GDPADRLIYATAIEHGWAAGDQGP

SEQ ID NO: 1483149 - protein, 26 aa, Mycobacterium tuberculosis
GDPGESRFYLSLGDELMRRFNGAALE

SEQ ID NO: 1483150 - protein, 17 aa, Mycobacterium tuberculosis
GDPLRDVHSGWKVAEAF

SEQ ID NO: 1483151 - protein, 24 aa, Mycobacterium tuberculosis
GDPMGLVNAVGYPLAADVALFTAA

SEQ ID NO: 1483152 - protein, 25 aa, Mycobacterium tuberculosis
GDPMGLVNAVGYPLAADVALFTAAG

SEQ ID NO: 1483153 - protein, 17 aa, Mycobacterium tuberculosis
GDPSGFVKLVADAKHGE

SEQ ID NO: 1483154 - protein, 22 aa, Mycobacterium tuberculosis
GDPSVDLIIAWTSCRRPPVLSS

SEQ ID NO: 1483155 - protein, 23 aa, Mycobacterium tuberculosis
GDPVALRAFRRGAAALAAMIASV

SEQ ID NO: 1483156 - protein, 24 aa, Mycobacterium tuberculosis
GDPYRLAAQLGMPPWRVQKAQKQA

SEQ ID NO: 1483157 - protein, 20 aa, Mycobacterium tuberculosis
GDQFPAYQLTALIGGDLSKV

SEQ ID NO: 1483158 - protein, 17 aa, Mycobacterium tuberculosis
GDQRLGVVLQFIVVGKR

SEQ ID NO: 1483159 - protein, 25 aa, Mycobacterium tuberculosis
GDQRVLGAALWYAATVKDAVIVAAA

SEQ ID NO: 1483160 - protein, 19 aa, Mycobacterium tuberculosis
GDRCVGAIATFAAVAAADR

SEQ ID NO: 1483161 - protein, 17 aa, Mycobacterium tuberculosis
GDRDFWLQVGIDPIQIR

SEQ ID NO: 1483162 - protein, 24 aa, Mycobacterium tuberculosis
GDRRLGGPAWARSGCCRAPAGTAG

SEQ ID NO: 1483163 - protein, 24 aa, Mycobacterium tuberculosis
GDRRPELFTLSAQRLLTMARAVVD

SEQ ID NO: 1483164 - protein, 17 aa, Mycobacterium tuberculosis
GDRRSARRCRPVQRIGG

SEQ ID NO: 1483165 - protein, 17 aa, Mycobacterium tuberculosis
GDRVGGMSPNGCWATFV

SEQ ID NO: 1483166 - protein, 26 aa, Mycobacterium tuberculosis
GDSQKQRLAVMVGLPDRVHPPRRRLR

SEQ ID NO: 1483167 - protein, 22 aa, Mycobacterium tuberculosis
GDSRPSLDRWTINLATGAVTAE

SEQ ID NO: 1483168 - protein, 26 aa, Mycobacterium tuberculosis
GDTDLAWSRITYWRALLTSAVDQPRH

SEQ ID NO: 1483169 - protein, 24 aa, Mycobacterium tuberculosis
GDTDRVTLFRAWYSRRNFGQLSGS

SEQ ID NO: 1483170 - protein, 29 aa, Mycobacterium tuberculosis
GDTLRPIEGRTAMSFVIANPEMLAAAATD

SEQ ID NO: 1483171 - protein, 19 aa, Mycobacterium tuberculosis
GDTPAREVMVPRTEMIWIE

SEQ ID NO: 1483172 - protein, 19 aa, Mycobacterium tuberculosis
GDTTVPLFDSGVGGAGGAG

SEQ ID NO: 1483173 - protein, 17 aa, Mycobacterium tuberculosis
GDTWAAIGVALGITRQA

SEQ ID NO: 1483174 - protein, 27 aa, Mycobacterium tuberculosis
GDVDTFYTCLYRSLLHPNTFNDVDGRY

SEQ ID NO: 1483175 - protein, 21 aa, Mycobacterium tuberculosis
GDVFLGWLVRGVVGFPDNVQN

SEQ ID NO: 1483176 - protein, 26 aa, Mycobacterium tuberculosis
GDVIEVPGLLDLSSLWQIYAVDRPTL

SEQ ID NO: 1483177 - protein, 25 aa, Mycobacterium tuberculosis
GDVLPARVRVPFLLDLLRALRGADD

SEQ ID NO: 1483178 - protein, 37 aa, Mycobacterium tuberculosis
GDWHLTAPLTLFGHCMGAIVAFEFARLAERNGVPVRA

SEQ ID NO: 1483179 - protein, 24 aa, Mycobacterium tuberculosis
GDYRCRSYQAGLFCVNYAHQSAVR

SEQ ID NO: 1483180 - protein, 17 aa, Mycobacterium tuberculosis
GEADFILAKHRNGPTKT

SEQ ID NO: 1483181 - protein, 20 aa, Mycobacterium tuberculosis
GEAHIKVIRALFRPPARRGG

SEQ ID NO: 1483182 - protein, 18 aa, Mycobacterium tuberculosis
GEALGFDVDTPWRKLPAK

SEQ ID NO: 1483183 - protein, 21 aa, Mycobacterium tuberculosis
GEALSDFVRRCTWLEHHPEQS

SEQ ID NO: 1483184 - protein, 20 aa, Mycobacterium tuberculosis
GEALVSMLKDHGVGFHPRKA

SEQ ID NO: 1483185 - protein, 25 aa, Mycobacterium tuberculosis
GEARLLSGRLRLHHLHRQLRAAARG

SEQ ID NO: 1483186 - protein, 26 aa, Mycobacterium tuberculosis
GEASKNCPSVERVLATQCWPPRVAGC

SEQ ID NO: 1483187 - protein, 24 aa, Mycobacterium tuberculosis
GEAWRYLKELRLERGPLSTEEATT

SEQ ID NO: 1483188 - protein, 23 aa, Mycobacterium tuberculosis
GEDLSWLWDVRFEHFETTRVVAA

SEQ ID NO: 1483189 - protein, 22 aa, Mycobacterium tuberculosis
GEETRLRLLVNEMFETMSRRSR

SEQ ID NO: 1483190 - protein, 20 aa, Mycobacterium tuberculosis
GEFDGQLWIAMDYVDGIDAT

SEQ ID NO: 1483191 - protein, 18 aa, Mycobacterium tuberculosis
GEFQEMFAPGAFRRSIAE

SEQ ID NO: 1483192 - protein, 24 aa, Mycobacterium tuberculosis
GEFQEMFAPGAFRRSIAERGHKLK

SEQ ID NO: 1483193 - protein, 17 aa, Mycobacterium tuberculosis
GEFRGAGQRIPRRRAVD

SEQ ID NO: 1483194 - protein, 19 aa, Mycobacterium tuberculosis
GEGAVGRWWARQPELTAAC

SEQ ID NO: 1483195 - protein, 18 aa, Mycobacterium tuberculosis
GEGGGRLVAERLSRAVGA

SEQ ID NO: 1483196 - protein, 18 aa, Mycobacterium tuberculosis
GEGRRLNPQLSWSPPAQR

SEQ ID NO: 1483197 - protein, 21 aa, Mycobacterium tuberculosis
GEGVGALLIRVGESGVAPDRL

SEQ ID NO: 1483198 - protein, 30 aa, Mycobacterium tuberculosis
GEHACSLGLLARAHCGVLYVDEVNLLHDHL

SEQ ID NO: 1483199 - protein, 25 aa, Mycobacterium tuberculosis
GEHRKSLTFALRFSCAGSHLNRRRR

SEQ ID NO: 1483200 - protein, 21 aa, Mycobacterium tuberculosis
GEIDPSLRLRPSRGTHLVFDA

SEQ ID NO: 1483201 - protein, 22 aa, Mycobacterium tuberculosis
GEKGLPRRGRGRFEGASPTCST

SEQ ID NO: 1483202 - protein, 20 aa, Mycobacterium tuberculosis
GEKIGALAITEPGGGSDVGH

SEQ ID NO: 1483203 - protein, 19 aa, Mycobacterium tuberculosis
GELALLRLACEAADAALTD

SEQ ID NO: 1483204 - protein, 18 aa, Mycobacterium tuberculosis
GELCERFDHLHLVRGAEV

SEQ ID NO: 1483205 - protein, 21 aa, Mycobacterium tuberculosis
GELESRIIIDSMHLGRYLGIS

SEQ ID NO: 1483206 - protein, 25 aa, Mycobacterium tuberculosis
GELGRSAAGYALWCNGIEDFAELRR

SEQ ID NO: 1483207 - protein, 23 aa, Mycobacterium tuberculosis
GELKISIPGFEIPQIATTRFLLD

SEQ ID NO: 1483208 - protein, 17 aa, Mycobacterium tuberculosis
GELLEWAEIHGGLHRSG

SEQ ID NO: 1483209 - protein, 19 aa, Mycobacterium tuberculosis
GELLRPARVLGIAATRDRA

SEQ ID NO: 1483210 - protein, 23 aa, Mycobacterium tuberculosis
GELLVRGGVVFSGYWRNEQATTE

SEQ ID NO: 1483211 - protein, 19 aa, Mycobacterium tuberculosis
GELNLLFTYELQRRLAPGG

SEQ ID NO: 1483212 - protein, 17 aa, Mycobacterium tuberculosis
GELRPQLLDRFGLTVDV

SEQ ID NO: 1483213 - protein, 17 aa, Mycobacterium tuberculosis
GELRRFQHYLGEPLGGF

SEQ ID NO: 1483214 - protein, 20 aa, Mycobacterium tuberculosis
GEMFSALGFDGLVRSARSRA

SEQ ID NO: 1483215 - protein, 19 aa, Mycobacterium tuberculosis
GEMWAQDAAAMFGYAATAA

SEQ ID NO: 1483216 - protein, 22 aa, Mycobacterium tuberculosis
GEMWAQDAAAMFGYAATAATAT

SEQ ID NO: 1483217 - protein, 23 aa, Mycobacterium tuberculosis
GENCRRCGAVIRRERFMNRLSST

SEQ ID NO: 1483218 - protein, 23 aa, Mycobacterium tuberculosis
GENGLNSGAMLPGGGTVGNPGTG

SEQ ID NO: 1483219 - protein, 24 aa, Mycobacterium tuberculosis
GEPAPHVKPAALAEQPGVPGQHAG

SEQ ID NO: 1483220 - protein, 24 aa, Mycobacterium tuberculosis
GEPCRVCGGVIRTALLEGRNVFWC

SEQ ID NO: 1483221 - protein, 19 aa, Mycobacterium tuberculosis
GEPELRPEDLLRVDSQGRG

SEQ ID NO: 1483222 - protein, 21 aa, Mycobacterium tuberculosis
GEPPMRRAVAFAKDIKTSKQV

SEQ ID NO: 1483223 - protein, 22 aa, Mycobacterium tuberculosis
GEPTIVAGLRLRRMMASIVGAD

SEQ ID NO: 1483224 - protein, 28 aa, Mycobacterium tuberculosis
GEPTRAAICRFATWWVVLERHGNLVRLY

SEQ ID NO: 1483225 - protein, 27 aa, Mycobacterium tuberculosis
GEPTRAAICRFATWWVVLERHGNVVRL

SEQ ID NO: 1483226 - protein, 17 aa, Mycobacterium tuberculosis
GEQRRWLQAELANARRD

SEQ ID NO: 1483227 - protein, 23 aa, Mycobacterium tuberculosis
GEQRSSNFMLWQAAYAEYIFQDK

SEQ ID NO: 1483228 - protein, 25 aa, Mycobacterium tuberculosis
GEQRWLADHVIAGVVLLAGAAFVEL

SEQ ID NO: 1483229 - protein, 19 aa, Mycobacterium tuberculosis
GEQWLKTTGLNTLRPDFEV

SEQ ID NO: 1483230 - protein, 18 aa, Mycobacterium tuberculosis
GERARTAIDAALARVGTT

SEQ ID NO: 1483231 - protein, 21 aa, Mycobacterium tuberculosis
GERARTAIDAALARVGTTQEG

SEQ ID NO: 1483232 - protein, 19 aa, Mycobacterium tuberculosis
GERGLCAGGDVVAVYHSAR

SEQ ID NO: 1483233 - protein, 19 aa, Mycobacterium tuberculosis
GERIRVVRRVHLRYEGTDT

SEQ ID NO: 1483234 - protein, 21 aa, Mycobacterium tuberculosis
GERIRVVRRVHLRYEGTDTAI

SEQ ID NO: 1483235 - protein, 23 aa, Mycobacterium tuberculosis
GERLAVGLPKAFYQLDGQTLIER

SEQ ID NO: 1483236 - protein, 26 aa, Mycobacterium tuberculosis
GERLRLLLREVFTAAGGTHDDWDEYD

SEQ ID NO: 1483237 - protein, 19 aa, Mycobacterium tuberculosis
GERRAWIEVRGLRSGGDDE

SEQ ID NO: 1483238 - protein, 24 aa, Mycobacterium tuberculosis
GERRQRLAMRAVRVEQHRVGGGAA

SEQ ID NO: 1483239 - protein, 20 aa, Mycobacterium tuberculosis
GERRTMAAVGRGSRRRVDPT

SEQ ID NO: 1483240 - protein, 21 aa, Mycobacterium tuberculosis
GERSPRWVLVLVTAVNRCGWT

SEQ ID NO: 1483241 - protein, 24 aa, Mycobacterium tuberculosis
GERVCSTAVGWNFGDGHLHNEQLI

SEQ ID NO: 1483242 - protein, 19 aa, Mycobacterium tuberculosis
GESVTEGTVTRWLKQEGDT

SEQ ID NO: 1483243 - protein, 22 aa, Mycobacterium tuberculosis
GETAVSAPPRWCQRRRRKIPSR

SEQ ID NO: 1483244 - protein, 17 aa, Mycobacterium tuberculosis
GETGCRIVLPEGADPFV

SEQ ID NO: 1483245 - protein, 19 aa, Mycobacterium tuberculosis
GETMFAHGYTFGGHPVSAA

SEQ ID NO: 1483246 - protein, 23 aa, Mycobacterium tuberculosis
GETPDFLPVVLEFAATVDPEAGR

SEQ ID NO: 1483247 - protein, 26 aa, Mycobacterium tuberculosis
GETRTRPSHLGLRLVPPTRAARTEIP

SEQ ID NO: 1483248 - protein, 20 aa, Mycobacterium tuberculosis
GETVDELHAALGLTPGQGQG

SEQ ID NO: 1483249 - protein, 25 aa, Mycobacterium tuberculosis
GEVFDLRPGAIIRDLNLLRPIYAPT

SEQ ID NO: 1483250 - protein, 24 aa, Mycobacterium tuberculosis
GEVGGMGGTGGWLMGNGGMGGAGG

SEQ ID NO: 1483251 - protein, 17 aa, Mycobacterium tuberculosis
GEVNPRLSGASPMTNLT

SEQ ID NO: 1483252 - protein, 20 aa, Mycobacterium tuberculosis
GEWFGALAVIAPRSPNGCVW

SEQ ID NO: 1483253 - protein, 17 aa, Mycobacterium tuberculosis
GEWFGALAVIAPSVSIQ

SEQ ID NO: 1483254 - protein, 21 aa, Mycobacterium tuberculosis
GEWRRLCARPDPAPLSTPATS

SEQ ID NO: 1483255 - protein, 19 aa, Mycobacterium tuberculosis
GEWVIPRGYSIIINIAQIH

SEQ ID NO: 1483256 - protein, 18 aa, Mycobacterium tuberculosis
GFAAYHWERTVGGADYLA

SEQ ID NO: 1483257 - protein, 33 aa, Mycobacterium tuberculosis; identical to SEQ ID NO: 157011

SEQ ID NO: 1483258 - protein, 24 aa, Mycobacterium tuberculosis
GFAGLAGLANRIVDAVDSLLGSVA

SEQ ID NO: 1483259 - protein, 19 aa, Mycobacterium tuberculosis
GFDAGDGFLGRLRGSDITR

SEQ ID NO: 1483260 - protein, 24 aa, Mycobacterium tuberculosis
GFDCGKLVRQGREVQILWDHAVLE

SEQ ID NO: 1483261 - protein, 19 aa, Mycobacterium tuberculosis
GFEAGACEHWRRVGGSAVR

SEQ ID NO: 1483262 - protein, 18 aa, Mycobacterium tuberculosis
GFEMPPHLHMAMVQSLLV

SEQ ID NO: 1483263 - protein, 27 aa, Mycobacterium tuberculosis
GFFEIPCPKFRKAAVSKGNGLRGDRWQ

SEQ ID NO: 1483264 - protein, 18 aa, Mycobacterium tuberculosis
GFFNTGMFNNGIYNSGVA

SEQ ID NO: 1483265 - protein, 17 aa, Mycobacterium tuberculosis
GFGGVEGLRGWLREERI

SEQ ID NO: 1483266 - protein, 26 aa, Mycobacterium tuberculosis
GFGNFGANMSGWWNQAHTALAGAGSG

SEQ ID NO: 1483267 - protein, 17 aa, Mycobacterium tuberculosis
GFHAQFVQALNAGVNSY

SEQ ID NO: 1483268 - protein, 26 aa, Mycobacterium tuberculosis
GFHGFRQGRNPFWDRLSRAMYRLARP

SEQ ID NO: 1483269 - protein, 19 aa, Mycobacterium tuberculosis
GFHPRKALARVDEAARTMH

SEQ ID NO: 1483270 - protein, 19 aa, Mycobacterium tuberculosis
GFHRTAQPPGRFLADQPQI

SEQ ID NO: 1483271 - protein, 17 aa, Mycobacterium tuberculosis
GFHVGERVSAFGVLGGY

SEQ ID NO: 1483272 - protein, 17 aa, Mycobacterium tuberculosis
GFIETRYYVSMNVADKP

SEQ ID NO: 1483273 - protein, 18 aa, Mycobacterium tuberculosis
GFIGSPAMNLFRLSIADF

SEQ ID NO: 1483274 - protein, 18 aa, Mycobacterium tuberculosis
GFLAEPWWCRMVVMSAER

SEQ ID NO: 1483275 - protein, 17 aa, Mycobacterium tuberculosis
GFLGRYLVLELLRRLDV

SEQ ID NO: 1483276 - protein, 19 aa, Mycobacterium tuberculosis
GFLIFKQPLLRSLVVVCNV

SEQ ID NO: 1483277 - protein, 19 aa, Mycobacterium tuberculosis
GFNPGGINIGWFNTGHANT

SEQ ID NO: 1483278 - protein, 22 aa, Mycobacterium tuberculosis
GFPDDARVLLVFGGSQGAVSLN

SEQ ID NO: 1483279 - protein, 20 aa, Mycobacterium tuberculosis
GFPVTIKGLSRFTDAAESRA

SEQ ID NO: 1483280 - protein, 17 aa, Mycobacterium tuberculosis
GFQAFVYGPIHATGQQW

SEQ ID NO: 1483281 - protein, 18 aa, Mycobacterium tuberculosis
GFQIPAITLRALGVTHFS

SEQ ID NO: 1483282 - protein, 24 aa, Mycobacterium tuberculosis
GFRAAARGAGRWLTLTTMQSGSSL

SEQ ID NO: 1483283 - protein, 22 aa, Mycobacterium tuberculosis
GFRFDLASTLARELHDVDRLSA

SEQ ID NO: 1483284 - protein, 22 aa, Mycobacterium tuberculosis
GFRSMLWPRVYADLRTAGVRGE

SEQ ID NO: 1483285 - protein, 23 aa, Mycobacterium tuberculosis
GFRSMLWPRVYADLRTAGVRGED

SEQ ID NO: 1483286 - protein, 19 aa, Mycobacterium tuberculosis
GFRTFYVPEHTHIPVKRQA

SEQ ID NO: 1483287 - protein, 22 aa, Mycobacterium tuberculosis
GFRYVWASDHLQPWQDNEGHSM

SEQ ID NO: 1483288 - protein, 24 aa, Mycobacterium tuberculosis
GFSAWQLGGSYSKNGKLRTVAQKT

SEQ ID NO: 1483289 - protein, 18 aa, Mycobacterium tuberculosis
GFSDTRPAARRYFNTDAE

SEQ ID NO: 1483290 - protein, 20 aa, Mycobacterium tuberculosis
GFSEGGCWRTFLTCDANLAV

SEQ ID NO: 1483291 - protein, 17 aa, Mycobacterium tuberculosis
GFSPAAIKALWDTILPF

SEQ ID NO: 1483292 - protein, 25 aa, Mycobacterium tuberculosis
GFSPLRLPPDLDFTSLFHGVDERVP

SEQ ID NO: 1483293 - protein, 21 aa, Mycobacterium tuberculosis
GFTFFPGGLTFPRASAGVTGL

SEQ ID NO: 1483294 - protein, 19 aa, Mycobacterium tuberculosis
GFTIPGGTLIPTLPLGLAL

SEQ ID NO: 1483295 - protein, 21 aa, Mycobacterium tuberculosis
GFVPDVAGFDAEFFGITPREA

SEQ ID NO: 1483296 - protein, 18 aa, Mycobacterium tuberculosis
GFWPVYRRVADPVKPRGN

SEQ ID NO: 1483297 - protein, 31 aa, Mycobacterium tuberculosis
GGAAEPGGAGGRGGLLIGDGGAGGAGGVGGT

SEQ ID NO: 1483298 - protein, 21 aa, Mycobacterium tuberculosis
GGAAGMLFGAAGVGGPGGFAA

SEQ ID NO: 1483299 - protein, 20 aa, Mycobacterium tuberculosis
GGAAGSLIGLGGGGGAGGVG

SEQ ID NO: 1483300 - protein, 21 aa, Mycobacterium tuberculosis
GGAAVGLFGPWRGRRGRRARQ

SEQ ID NO: 1483301 - protein, 19 aa, Mycobacterium tuberculosis
GGACSAGQFMVDFQQHRLI

SEQ ID NO: 1483302 - protein, 18 aa, Mycobacterium tuberculosis
GGAEMSRSEFYREGRVPL

SEQ ID NO: 1483303 - protein, 26 aa, Mycobacterium tuberculosis
GGAFILPPSIFHWLNYSVTAYQTGAT

SEQ ID NO: 1483304 - protein, 23 aa, Mycobacterium tuberculosis
GGAGGAAGLWGSGGSGGQGGNGL

SEQ ID NO: 1483305 - protein, 25 aa, Mycobacterium tuberculosis
GGAGGAARLIGHGGAGGLGGTGASG

SEQ ID NO: 1483306 - protein, 23 aa, Mycobacterium tuberculosis
GGAGGAGAWFGNVAPAASAGGGG

SEQ ID NO: 1483307 - protein, 17 aa, Mycobacterium tuberculosis
GGAGGAGGFGFGGAGGA

SEQ ID NO: 1483308 - protein, 24 aa, Mycobacterium tuberculosis
GGAGGAGGRAWLWGTGGAGGAGGD

SEQ ID NO: 1483309 - protein, 22 aa, Mycobacterium tuberculosis
GGAGGAGGWLFGNGGAGGNGGI

SEQ ID NO: 1483310 - protein, 23 aa, Mycobacterium tuberculosis
GGAGGAGGWLFGNGGAGGNGGIG

SEQ ID NO: 1483311 - protein, 23 aa, Mycobacterium tuberculosis
GGAGGAGGWLLGNGGAGGPQRPK

SEQ ID NO: 1483312 - protein, 23 aa, Mycobacterium tuberculosis
GGAGGAGGWLWGNGGAGGNGGVG

SEQ ID NO: 1483313 - protein, 25 aa, Mycobacterium tuberculosis
GGAGGAGGWLWGNGGAGGNGGVGVA

SEQ ID NO: 1483314 - protein, 23 aa, Mycobacterium tuberculosis
GGAGGDGFGFVGAGGNGGNAGTG

SEQ ID NO: 1483315 - protein, 24 aa, Mycobacterium tuberculosis
GGAGGDGGLFFGVGGAGGAGGTGT

SEQ ID NO: 1483316 - protein, 21 aa, Mycobacterium tuberculosis
GGAGGDGGWLFGDGGAGGTGG

SEQ ID NO: 1483317 - protein, 17 aa, Mycobacterium tuberculosis
GGAGGFGAGTGGYGGVG

SEQ ID NO: 1483318 - protein, 23 aa, Mycobacterium tuberculosis
GGAGGHGGWLWGNGGVGGSGGAG

SEQ ID NO: 1483319 - protein, 24 aa, Mycobacterium tuberculosis
GGAGGHGGWLWGNGGVGGSGGAGV

SEQ ID NO: 1483320 - protein, 19 aa, Mycobacterium tuberculosis
GGAGGHLFGNGGSGGHGGA

SEQ ID NO: 1483321 - protein, 24 aa, Mycobacterium tuberculosis
GGAGGKGGSGLVGGDGGNGGAGGA

SEQ ID NO: 1483322 - protein, 18 aa, Mycobacterium tuberculosis
GGAGGLFGAGGEGGSGGS

SEQ ID NO: 1483323 - protein, 32 aa, Mycobacterium tuberculosis; identical to SEQ ID NO: 199789

SEQ ID NO: 1483324 - protein, 20 aa, Mycobacterium tuberculosis
GGAGGLFMNGGDGGAGGQGG

SEQ ID NO: 1483325 - protein, 19 aa, Mycobacterium tuberculosis
GGAGGLIWGTAGTGGNGGF

SEQ ID NO: 1483326 - protein, 19 aa, Mycobacterium tuberculosis
GGAGGLLFGNGGNGAAGAV

SEQ ID NO: 1483327 - protein, 21 aa, Mycobacterium tuberculosis
GGAGGLLIGNGGAGGVGGTAG

SEQ ID NO: 1483328 - protein, 17 aa, Mycobacterium tuberculosis
GGAGGLLYGARRGPEAP

SEQ ID NO: 1483329 - protein, 25 aa, Mycobacterium tuberculosis
GGAGGLLYGNGGNGFSQTTPGLTGG

SEQ ID NO: 1483330 - protein, 20 aa, Mycobacterium tuberculosis
GGAGGMLYGAGGVGGNGGAA

SEQ ID NO: 1483331 - protein, 22 aa, Mycobacterium tuberculosis
GGAGGNALLFGNGGNGGSGASG

SEQ ID NO: 1483332 - protein, 27 aa, Mycobacterium tuberculosis
GGAGGNGAHGFNAVLVSDGGNGGDGGA

SEQ ID NO: 1483333 - protein, 22 aa, Mycobacterium tuberculosis
GGAGGNGGWLYGNGGPGGAAGL

SEQ ID NO: 1483334 - protein, 23 aa, Mycobacterium tuberculosis
GGAGGNGGWLYGNGGPGGAAGLG

SEQ ID NO: 1483335 - protein, 22 aa, Mycobacterium tuberculosis
GGAGGNGGWLYGSGGNGGAGGA

SEQ ID NO: 1483336 - protein, 37 aa, Mycobacterium tuberculosis
GGAGGRGGAGGLGFGSEAPGRPGGAGGTGGAGGNGGT

SEQ ID NO: 1483337 - protein, 21 aa, Mycobacterium tuberculosis
GGAGGRGGDFGGDGGTGGAGG

SEQ ID NO: 1483338 - protein, 24 aa, Mycobacterium tuberculosis
GGAGGRGGLLIGDGGAGGAGGVGG

SEQ ID NO: 1483339 - protein, 19 aa, Mycobacterium tuberculosis
GGAGGRRGGAAGAGTVVAG

SEQ ID NO: 1483340 - protein, 24 aa, Mycobacterium tuberculosis
GGAGGRSGLFEVLAAGGAGGTGGL

SEQ ID NO: 1483341 - protein, 19 aa, Mycobacterium tuberculosis
GGAGGSARGLIFALGGAGA

SEQ ID NO: 1483342 - protein, 24 aa, Mycobacterium tuberculosis
GGAGGSGFFGGKGGFGGDGGQGGP

SEQ ID NO: 1483343 - protein, 24 aa, Mycobacterium tuberculosis
GGAGGTGGTGLRGTTGATGATGTF

SEQ ID NO: 1483344 - protein, 23 aa, Mycobacterium tuberculosis
GGAGGTGGWLFGNGGAGGTGGAV

SEQ ID NO: 1483345 - protein, 33 aa, Mycobacterium tuberculosis
GGAGGTGRVGGPVGGHGLLGLGGSHGAGGAGGS

SEQ ID NO: 1483346 - protein, 19 aa, Mycobacterium tuberculosis
GGAGGTVFGGGKGGAGGAG

SEQ ID NO: 1483347 - protein, 24 aa, Mycobacterium tuberculosis
GGAGRWRGGDGAVRRLEFTEPMTV

SEQ ID NO: 1483348 - protein, 19 aa, Mycobacterium tuberculosis
GGAGTLLGLTVFGDNGGAG

SEQ ID NO: 1483349 - protein, 28 aa, Mycobacterium tuberculosis
GGAGTLLGLTVFGDNGGAGVLGDSTDPD

SEQ ID NO: 1483350 - protein, 26 aa, Mycobacterium tuberculosis
GGAHAGDCGNVWASGAATAALDAFAP

SEQ ID NO: 1483351 - protein, 17 aa, Mycobacterium tuberculosis
GGAINLGFGNSGQLNAG

SEQ ID NO: 1483352 - protein, 22 aa, Mycobacterium tuberculosis
GGAIYQRWQALGGMNSALGAPT

SEQ ID NO: 1483353 - protein, 17 aa, Mycobacterium tuberculosis
GGALAGIHPVDLGALAW

SEQ ID NO: 1483354 - protein, 18 aa, Mycobacterium tuberculosis
GGANGAFELNVYIPMMAR

SEQ ID NO: 1483355 - protein, 25 aa, Mycobacterium tuberculosis
GGAPDRVCASARYAVAAGPANASRT

SEQ ID NO: 1483356 - protein, 20 aa, Mycobacterium tuberculosis
GGARGVRRARPVRRVANALM

SEQ ID NO: 1483357 - protein, 20 aa, Mycobacterium tuberculosis
GGARWLIPRLDLPAKKRDAI

SEQ ID NO: 1483358 - protein, 27 aa, Mycobacterium tuberculosis
GGASHRRRPLVGWGVVHRSADRIPGPQ

SEQ ID NO: 1483359 - protein, 20 aa, Mycobacterium tuberculosis
GGAWNVGKLGLFGVGRIRAG

SEQ ID NO: 1483360 - protein, 20 aa, Mycobacterium tuberculosis
GGCMAAKFFTGLPLDGPDPE

SEQ ID NO: 1483361 - protein, 19 aa, Mycobacterium tuberculosis
GGCPVRGRAFSPWHRESQA

SEQ ID NO: 1483362 - protein, 19 aa, Mycobacterium tuberculosis
GGDAGMFFGSGGSGGAGGI

SEQ ID NO: 1483363 - protein, 23 aa, Mycobacterium tuberculosis
GGDAKPVLMPELGESVTEGTVIR

SEQ ID NO: 1483364 - protein, 23 aa, Mycobacterium tuberculosis
GGDARFLSLLSIRQLATEPSLSG

SEQ ID NO: 1483365 - protein, 18 aa, Mycobacterium tuberculosis
GGDARLIGHGGAGGAGGD

SEQ ID NO: 1483366 - protein, 19 aa, Mycobacterium tuberculosis
GGDGFRTAGAGGRGGDGGK

SEQ ID NO: 1483367 - protein, 28 aa, Mycobacterium tuberculosis
GGDGGDGGWGRPGGQGGFGSTSGAHGKV

SEQ ID NO: 1483368 - protein, 31 aa, Mycobacterium tuberculosis
GGDGGHGGDGFRTAGAGGRGGDGGKGADPGG

SEQ ID NO: 1483369 - protein, 18 aa, Mycobacterium tuberculosis
GGDGGIFTGNGGTGGTGG

SEQ ID NO: 1483370 - protein, 33 aa, Mycobacterium tuberculosis
GGDGGKGGFADEFTGGFAQGGRGGFGGNGNTGA

SEQ ID NO: 1483371 - protein, 17 aa, Mycobacterium tuberculosis
GGDGGRGAGGLTSGGVG

SEQ ID NO: 1483372 - protein, 19 aa, Mycobacterium tuberculosis
GGDGGRGAGGLTSGGVGSS

SEQ ID NO: 1483373 - protein, 23 aa, Mycobacterium tuberculosis
GGDGGRGGLLYGDGGAGGAGGNG

SEQ ID NO: 1483374 - protein, 21 aa, Mycobacterium tuberculosis
GGDGPPGVKGDGGNGGNGGNA

SEQ ID NO: 1483375 - protein, 17 aa, Mycobacterium tuberculosis
GGDLEFADELTLGRALA

SEQ ID NO: 1483376 - protein, 25 aa, Mycobacterium tuberculosis
GGDPGLGARLFQVGSRGGDGGVGGW

SEQ ID NO: 1483377 - protein, 21 aa, Mycobacterium tuberculosis
GGDPKGALVPTSWSHAMAVAA

SEQ ID NO: 1483378 - protein, 21 aa, Mycobacterium tuberculosis
GGDTTVPLFDSGVGGAGGAGG

SEQ ID NO: 1483379 - protein, 25 aa, Mycobacterium tuberculosis
GGEDRRPTLSWPRNLPIDGEPAEVV

SEQ ID NO: 1483380 - protein, 18 aa, Mycobacterium tuberculosis
GGEEGDASFDWPRGPGGL

SEQ ID NO: 1483381 - protein, 24 aa, Mycobacterium tuberculosis
GGEMWRVDFAWPDMRLAAEYESIE

SEQ ID NO: 1483382 - protein, 18 aa, Mycobacterium tuberculosis
GGEPFCVREDARILYHAA

SEQ ID NO: 1483383 - protein, 17 aa, Mycobacterium tuberculosis
GGEQWCDAEVLRILRRR

SEQ ID NO: 1483384 - protein, 21 aa, Mycobacterium tuberculosis
GGESSRPGATRVDPAVETSRV

SEQ ID NO: 1483385 - protein, 27 aa, Mycobacterium tuberculosis
GGFAVAPDFIGFGAAYGGAGGLGGAAT

SEQ ID NO: 1483386 - protein, 18 aa, Mycobacterium tuberculosis
GGFGHLLILGFDYSDNPG

SEQ ID NO: 1483387 - protein, 19 aa, Mycobacterium tuberculosis
GGFGVLGAVGFTPEQLEIE

SEQ ID NO: 1483388 - protein, 18 aa, Mycobacterium tuberculosis
GGFVPAGTTISVYTSDGQ

SEQ ID NO: 1483389 - protein, 24 aa, Mycobacterium tuberculosis
GGGAGGNGAWLFGNGGAGGGGGKG

SEQ ID NO: 1483390 - protein, 23 aa, Mycobacterium tuberculosis
GGGAGLFYGFGGAGGNGGMGGVA

SEQ ID NO: 1483391 - protein, 24 aa, Mycobacterium tuberculosis
GGGAGLFYGFGGAGGNGGMGGVAP

SEQ ID NO: 1483392 - protein, 23 aa, Mycobacterium tuberculosis
GGGALNQAGFFGTGGKGGNGGNG

SEQ ID NO: 1483393 - protein, 18 aa, Mycobacterium tuberculosis
GGGDGRPGAQHGRTRIRR

SEQ ID NO: 1483394 - protein, 17 aa, Mycobacterium tuberculosis
GGGDSRETPPYVPKATT

SEQ ID NO: 1483395 - protein, 24 aa, Mycobacterium tuberculosis
GGGGAAGFAGGVGGAGGEGLTDGS

SEQ ID NO: 1483396 - protein, 28 aa, Mycobacterium tuberculosis
GGGGAPKGWGWVAPYIGMIWPNGDSTKL

SEQ ID NO: 1483397 - protein, 27 aa, Mycobacterium tuberculosis
GGGGASGAGGWLLGTGGAGGAGGNGGN

SEQ ID NO: 1483398 - protein, 21 aa, Mycobacterium tuberculosis
GGGGNGRFMGNGGVGGAGGYG

SEQ ID NO: 1483399 - protein, 17 aa, Mycobacterium tuberculosis
GGGGRYDGLMHQLGGQD

SEQ ID NO: 1483400 - protein, 18 aa, Mycobacterium tuberculosis
GGGHGFGYSRLDDRRRQH

SEQ ID NO: 1483401 - protein, 19 aa, Mycobacterium tuberculosis
GGGHGFGYSRLDDRRRQRG

SEQ ID NO: 1483402 - protein, 19 aa, Mycobacterium tuberculosis
GGGHGLLGLGGSHGAGGAG

SEQ ID NO: 1483403 - protein, 18 aa, Mycobacterium tuberculosis
GGGLVGWMTYPECVADQP

SEQ ID NO: 1483404 - protein, 19 aa, Mycobacterium tuberculosis
GGGNFGVTTSMTFARFPTA

SEQ ID NO: 1483405 - protein, 19 aa, Mycobacterium tuberculosis
GGGNGRFMGNGGVGGAGGY

SEQ ID NO: 1483406 - protein, 26 aa, Mycobacterium tuberculosis
GGGRGGRWAPPAAWAGAVALAACSAM

SEQ ID NO: 1483407 - protein, 24 aa, Mycobacterium tuberculosis
GGGRVAKARGRRDVDDRDLDGTEQ

SEQ ID NO: 1483408 - protein, 21 aa, Mycobacterium tuberculosis
GGGSSMIGGKGGTGGNGGVGG

SEQ ID NO: 1483409 - protein, 22 aa, Mycobacterium tuberculosis
GGGSSMIGGKGGTGGNGGVGGT

SEQ ID NO: 1483410 - protein, 27 aa, Mycobacterium tuberculosis
GGGTAFGEGFPASATVAAVGAVASGAA

SEQ ID NO: 1483411 - protein, 17 aa, Mycobacterium tuberculosis
GGGTGFNPGAPGDPGTQ

SEQ ID NO: 1483412 - protein, 21 aa, Mycobacterium tuberculosis
GGGTGGLLFRQTAVPAGTAPP

SEQ ID NO: 1483413 - protein, 27 aa, Mycobacterium tuberculosis
GGGTGLRRQRRPGWRRHSDRQRRGRRE

SEQ ID NO: 1483414 - protein, 20 aa, Mycobacterium tuberculosis
GGGVGGLWGAGGAGGAGGTG

SEQ ID NO: 1483415 - protein, 17 aa, Mycobacterium tuberculosis
GGGWSLGGLDTHDPVAR

SEQ ID NO: 1483416 - protein, 22 aa, Mycobacterium tuberculosis
GGHGGAGGWLYGNGGAGGFGGA

SEQ ID NO: 1483417 - protein, 19 aa, Mycobacterium tuberculosis
GGHGGLFGAGGTGGAGGSS

SEQ ID NO: 1483418 - protein, 24 aa, Mycobacterium tuberculosis
GGHGRHRRRRRPTGTACTGGSGGT

SEQ ID NO: 1483419 - protein, 20 aa, Mycobacterium tuberculosis
GGHHSWEDLDDLLLATYSEL

SEQ ID NO: 1483420 - protein, 18 aa, Mycobacterium tuberculosis
GGHLRWLSVNCRARGTFV

SEQ ID NO: 1483421 - protein, 25 aa, Mycobacterium tuberculosis
GGHPACGSRAFADVVLQRHRHHPRR

SEQ ID NO: 1483422 - protein, 22 aa, Mycobacterium tuberculosis
GGHSLLPMMKLRIANPEYLVDI

SEQ ID NO: 1483423 - protein, 23 aa, Mycobacterium tuberculosis
GGHSRWLSAEAMAARLNDVGVGR

SEQ ID NO: 1483424 - protein, 18 aa, Mycobacterium tuberculosis
GGICHWFHSDVMYRSVLA

SEQ ID NO: 1483425 - protein, 18 aa, Mycobacterium tuberculosis
GGIDEYLQLAARVSAPAP

SEQ ID NO: 1483426 - protein, 22 aa, Mycobacterium tuberculosis
GGIGGAGGLLFGSGGAGGSGGF

SEQ ID NO: 1483427 - protein, 34 aa, Mycobacterium tuberculosis
GGIGGAGGNAGFGAGVPGDGGIGGTGGAGGAGGA

SEQ ID NO: 1483428 - protein, 17 aa, Mycobacterium tuberculosis
GGIGGLIGSGGGGGDGG

SEQ ID NO: 1483429 - protein, 17 aa, Mycobacterium tuberculosis
GGIGITVGGAGGVGGNG

SEQ ID NO: 1483430 - protein, 25 aa, Mycobacterium tuberculosis
GGIIQDIEELLGITFVQNAINGAVN

SEQ ID NO: 1483431 - protein, 17 aa, Mycobacterium tuberculosis
GGIPVTVEVPVGGILAP

SEQ ID NO: 1483432 - protein, 25 aa, Mycobacterium tuberculosis
GGIPVTVEVPVGGILAPLQPFQATA

SEQ ID NO: 1483433 - protein, 22 aa, Mycobacterium tuberculosis
GGISRKADKWVPLLENRTPVVP

SEQ ID NO: 1483434 - protein, 20 aa, Mycobacterium tuberculosis
GGIVPALVNYAPTQLAQAIA

SEQ ID NO: 1483435 - protein, 21 aa, Mycobacterium tuberculosis
GGKAGFSPGPTNFGLNGAGGG

SEQ ID NO: 1483436 - protein, 24 aa, Mycobacterium tuberculosis
GGKALKFYASVRMDVRRVETLKDG

SEQ ID NO: 1483437 - protein, 24 aa, Mycobacterium tuberculosis
GGKALKFYASVRMGRAASRDAQGR

SEQ ID NO: 1483438 - protein, 26 aa, Mycobacterium tuberculosis
GGKGGDTPNGLAINPGIGGNGGDTGN

SEQ ID NO: 1483439 - protein, 29 aa, Mycobacterium tuberculosis
GGKGGEGGVGSILGGPGGNGGTGGNASAT

SEQ ID NO: 1483440 - protein, 21 aa, Mycobacterium tuberculosis
GGKGGMGGIAGDGGPGGDGGN

SEQ ID NO: 1483441 - protein, 19 aa, Mycobacterium tuberculosis
GGKGGNGADGEVGGAGGAG

SEQ ID NO: 1483442 - protein, 19 aa, Mycobacterium tuberculosis
GGKLQWILENVDGVRAPPR

SEQ ID NO: 1483443 - protein, 30 aa, Mycobacterium tuberculosis
GGKRRDRWGRHQPRYRRAWWERRQRRADRR

SEQ ID NO: 1483444 - protein, 28 aa, Mycobacterium tuberculosis
GGKVLPAMLKRQLQLLLPLVEDRFVESV

SEQ ID NO: 1483445 - protein, 29 aa, Mycobacterium tuberculosis
GGKVLPAMLKRQLQLLLPLVEDRFVESVC

SEQ ID NO: 1483446 - protein, 17 aa, Mycobacterium tuberculosis
GGLAGIGGNAGFVGNGG

SEQ ID NO: 1483447 - protein, 17 aa, Mycobacterium tuberculosis
GGLAGQIGNGGSGGSGG

SEQ ID NO: 1483448 - protein, 23 aa, Mycobacterium tuberculosis
GGLAGRRLAAWLVDETGSQTASD

SEQ ID NO: 1483449 - protein, 26 aa, Mycobacterium tuberculosis
GGLAVLRPGHTIPLARTQPALDLDAL

SEQ ID NO: 1483450 - protein, 17 aa, Mycobacterium tuberculosis
GGLDVAPLFKVAWPGAL

SEQ ID NO: 1483451 - protein, 19 aa, Mycobacterium tuberculosis
GGLFAGITARYLALVATTL

SEQ ID NO: 1483452 - protein, 29 aa, Mycobacterium tuberculosis
GGLGGDGGGRGIFGQFGAGGAGGAGGVGG

SEQ ID NO: 1483453 - protein, 24 aa, Mycobacterium tuberculosis
GGLGGHIVNAILIRQNDTEPTYPN

SEQ ID NO: 1483454 - protein, 18 aa, Mycobacterium tuberculosis
GGLGHRSKHRGPRHLTDS

SEQ ID NO: 1483455 - protein, 23 aa, Mycobacterium tuberculosis
GGLHPRVALMLDVESGGNPPGDG

SEQ ID NO: 1483456 - protein, 21 aa, Mycobacterium tuberculosis
GGLIGWAGAAGGTGAGGTGGQ

SEQ ID NO: 1483457 - protein, 26 aa, Mycobacterium tuberculosis
GGLLIACLQFDLPIRLFEIGSSAGLN

SEQ ID NO: 1483458 - protein, 22 aa, Mycobacterium tuberculosis
GGLLYICFDGTSGMLEWLLSAI

SEQ ID NO: 1483459 - protein, 22 aa, Mycobacterium tuberculosis
GGLPIGACLAVGPAAELLTPGL

SEQ ID NO: 1483460 - protein, 17 aa, Mycobacterium tuberculosis
GGMGGNGGLVFGNGGPG

SEQ ID NO: 1483461 - protein, 17 aa, Mycobacterium tuberculosis
GGMPAAAFGGRAEVMQR

SEQ ID NO: 1483462 - protein, 20 aa, Mycobacterium tuberculosis
GGMPMMLMPMSISGAGAGMP

SEQ ID NO: 1483463 - protein, 19 aa, Mycobacterium tuberculosis
GGNAEIVISGGSVAGTGGN

SEQ ID NO: 1483464 - protein, 37 aa, Mycobacterium tuberculosis
GGNAGFAHRRGWARRVWRRRFSPQALTTGGRPAGLGG

SEQ ID NO: 1483465 - protein, 21 aa, Mycobacterium tuberculosis
GGNAGLWGNGGAGGAGAAGAA

SEQ ID NO: 1483466 - protein, 18 aa, Mycobacterium tuberculosis
GGNAGMLAGPGGAGGAGG

SEQ ID NO: 1483467 - protein, 26 aa, Mycobacterium tuberculosis
GGNAGWLGFGGAGGIGGIGGNANGGA

SEQ ID NO: 1483468 - protein, 25 aa, Mycobacterium tuberculosis
GGNAGWLGFGGAGGVGGSAGLIGTG

SEQ ID NO: 1483469 - protein, 17 aa, Mycobacterium tuberculosis
GGNAILFGQGGAGGPGG

SEQ ID NO: 1483470 - protein, 17 aa, Mycobacterium tuberculosis
GGNARLIGDGGRGGNGG

SEQ ID NO: 1483471 - protein, 18 aa, Mycobacterium tuberculosis
GGNAYLFGSGGAGGQGGM

SEQ ID NO: 1483472 - protein, 20 aa, Mycobacterium tuberculosis
GGNGAHAPVAGGHGGNGGAG

SEQ ID NO: 1483473 - protein, 33 aa, Mycobacterium tuberculosis
GGNGAHGTVGAQFVPATSLPTPNGGAGGNGGTG

SEQ ID NO: 1483474 - protein, 22 aa, Mycobacterium tuberculosis
GGNGATGTWGHNLVPAGPVAMA

SEQ ID NO: 1483475 - protein, 22 aa, Mycobacterium tuberculosis
GGNGGAGGMLLGDGGAGGQGGP

SEQ ID NO: 1483476 - protein, 23 aa, Mycobacterium tuberculosis
GGNGGAGGWIYGHGGHGGAGGNG

SEQ ID NO: 1483477 - protein, 22 aa, Mycobacterium tuberculosis
GGNGGARWNFVRQRRQRRGRRT

SEQ ID NO: 1483478 - protein, 24 aa, Mycobacterium tuberculosis
GGNGGDGGLVWGNGGTGGSGGADG

SEQ ID NO: 1483479 - protein, 30 aa, Mycobacterium tuberculosis
GGNGGKAGFSPGPTNFGLNGAGGGGGVGGN

SEQ ID NO: 1483480 - protein, 23 aa, Mycobacterium tuberculosis
GGNGGKGGAGLIAGLDGAGGAGG

SEQ ID NO: 1483481 - protein, 24 aa, Mycobacterium tuberculosis
GGNGGLSLGLGVAGGAGGAGGSGG

SEQ ID NO: 1483482 - protein, 22 aa, Mycobacterium tuberculosis
GGNGGNAGWLYGRGGVGGAGGI

SEQ ID NO: 1483483 - protein, 17 aa, Mycobacterium tuberculosis
GGNGGNGGWLYGDGGSG

SEQ ID NO: 1483484 - protein, 23 aa, Mycobacterium tuberculosis
GGNGGRGGLLVGNGGAGGAGGVG

SEQ ID NO: 1483485 - protein, 25 aa, Mycobacterium tuberculosis
GGNGGVCGSGGASALLTGNGSSAGA

SEQ ID NO: 1483486 - protein, 18 aa, Mycobacterium tuberculosis
GGNGGWLLGNGGIGGAGG

SEQ ID NO: 1483487 - protein, 19 aa, Mycobacterium tuberculosis
GGNGGWLYGNGGPGGAAGL

SEQ ID NO: 1483488 - protein, 17 aa, Mycobacterium tuberculosis
GGNGLLFGAGGTGGAGT

SEQ ID NO: 1483489 - protein, 18 aa, Mycobacterium tuberculosis
GGNPGFSGAGGLGGLSGD

SEQ ID NO: 1483490 - protein, 24 aa, Mycobacterium tuberculosis
GGNPGFSGAGGLGGLSGDGVTRAA

SEQ ID NO: 1483491 - protein, 27 aa, Mycobacterium tuberculosis
GGNTAGRRADAIAGTGGDGGNGGNGGL

SEQ ID NO: 1483492 - protein, 22 aa, Mycobacterium tuberculosis
GGPGGAAGLFGNGGAGGAGGTA

SEQ ID NO: 1483493 - protein, 27 aa, Mycobacterium tuberculosis
GGPGGHGGSVLSGPVGDSGNGGAGGDG

SEQ ID NO: 1483494 - protein, 28 aa, Mycobacterium tuberculosis
GGPGGLAGNLFGQNGIQGVGGSGGKGGA

SEQ ID NO: 1483495 - protein, 25 aa, Mycobacterium tuberculosis
GGPGGRPGCWQTITRELWPAPYLVM

SEQ ID NO: 1483496 - protein, 18 aa, Mycobacterium tuberculosis
GGPGSWLLAVPPYHIAGL

SEQ ID NO: 1483497 - protein, 17 aa, Mycobacterium tuberculosis
GGPPLVFQLLWYPTTMA

SEQ ID NO: 1483498 - protein, 24 aa, Mycobacterium tuberculosis
GGPRPSMVPWVISARSAEALTAQA

SEQ ID NO: 1483499 - protein, 19 aa, Mycobacterium tuberculosis
GGPSDRRFIWQRGARRHRR

SEQ ID NO: 1483500 - protein, 35 aa, Mycobacterium tuberculosis
GGPSFCCAAHNPFRCNRIGLLRVVRGPIRATHFRR

SEQ ID NO: 1483501 - protein, 24 aa, Mycobacterium tuberculosis
GGPSQGGGNPGFGGDGGTGGPGGV

SEQ ID NO: 1483502 - protein, 29 aa, Mycobacterium tuberculosis
GGQGGGGGFSILLGLGGLGGLGSPGSIAT

SEQ ID NO: 1483503 - protein, 26 aa, Mycobacterium tuberculosis
GGQGGKGGLNSTGLASAASGDGGNGG

SEQ ID NO: 1483504 - protein, 20 aa, Mycobacterium tuberculosis
GGQGGLGLAGINGGSGGQGG

SEQ ID NO: 1483505 - protein, 19 aa, Mycobacterium tuberculosis
GGQGHNTGVGDAFGGDGGI

SEQ ID NO: 1483506 - protein, 27 aa, Mycobacterium tuberculosis
GGQGHNTGVGDAFGGDGGIGGDGNGAL

SEQ ID NO: 1483507 - protein, 18 aa, Mycobacterium tuberculosis
GGQLAEFADFLINVPSRD

SEQ ID NO: 1483508 - protein, 17 aa, Mycobacterium tuberculosis
GGQQLPHPVERFGADLR

SEQ ID NO: 1483509 - protein, 56 aa, Mycobacterium tuberculosis
GGQRRRGRHRGHPGARRTRRVRRAWRPAVRPNRHGWRVAVAGRLAASAALASSQTS

SEQ ID NO: 1483510 - protein, 22 aa, Mycobacterium tuberculosis
GGQTLRPAPVGAYPAGASACGA

SEQ ID NO: 1483511 - protein, 17 aa, Mycobacterium tuberculosis
GGQVLLPANGRAFTSGK

SEQ ID NO: 1483512 - protein, 17 aa, Mycobacterium tuberculosis
GGRAGMAAITLRAGAEF

SEQ ID NO: 1483513 - protein, 28 aa, Mycobacterium tuberculosis
GGRGGNGGHGGLWIGNGGDGGAGGVGGV

SEQ ID NO: 1483514 - protein, 18 aa, Mycobacterium tuberculosis
GGRIRLQPQVGWEVNDPD

SEQ ID NO: 1483515 - protein, 24 aa, Mycobacterium tuberculosis
GGRVRCRRGAAVPTRARRRRDRRR

SEQ ID NO: 1483516 - protein, 24 aa, Mycobacterium tuberculosis
GGRWADSFGGLVFDATGITEPAGL

SEQ ID NO: 1483517 - protein, 17 aa, Mycobacterium tuberculosis
GGSAKVFEFNRVFRNEG

SEQ ID NO: 1483518 - protein, 26 aa, Mycobacterium tuberculosis
GGSDPTEGRGFGGLGGAGGAGGKGGA

SEQ ID NO: 1483519 - protein, 17 aa, Mycobacterium tuberculosis
GGSGDFGGNTTSGASGS

SEQ ID NO: 1483520 - protein, 19 aa, Mycobacterium tuberculosis
GGSGGFVYGNGGAGGIGGI

SEQ ID NO: 1483521 - protein, 29 aa, Mycobacterium tuberculosis
GGSGGLGSAFGPGGTGGMGGAGGTSTVSA

SEQ ID NO: 1483522 - protein, 31 aa, Mycobacterium tuberculosis
GGSGGLIARGQRRWRWCRRSGRRGWRRRHRR

SEQ ID NO: 1483523 - protein, 25 aa, Mycobacterium tuberculosis
GGSGGNGGNAWLTGQGGNGGNAAFG

SEQ ID NO: 1483524 - protein, 23 aa, Mycobacterium tuberculosis
GGSGGRGDMAFKDGDGGDRRRWW

SEQ ID NO: 1483525 - protein, 24 aa, Mycobacterium tuberculosis
GGSGGRGGLLFGNGGNGSVGGMGG

SEQ ID NO: 1483526 - protein, 24 aa, Mycobacterium tuberculosis
GGSGGRGGLLVGDGGAGGIGGTGG

SEQ ID NO: 1483527 - protein, 18 aa, Mycobacterium tuberculosis
GGSGGWLNGNGGAGGAGG

SEQ ID NO: 1483528 - protein, 21 aa, Mycobacterium tuberculosis
GGSGRPARPAAQVEPRGYSAT

SEQ ID NO: 1483529 - protein, 22 aa, Mycobacterium tuberculosis
GGSLVLRAARPGQIVPVDSEHS

SEQ ID NO: 1483530 - protein, 24 aa, Mycobacterium tuberculosis
GGSRRCTYIPAAADGVGGHRRSRV

SEQ ID NO: 1483531 - protein, 18 aa, Mycobacterium tuberculosis
GGTACSTSAFGVDGARRQ

SEQ ID NO: 1483532 - protein, 17 aa, Mycobacterium tuberculosis
GGTAGFLTGFRRAGRRP

SEQ ID NO: 1483533 - protein, 20 aa, Mycobacterium tuberculosis
GGTAGFTGSGGIGGNGGAGG

SEQ ID NO: 1483534 - protein, 19 aa, Mycobacterium tuberculosis
GGTAGLFGVGGAGGAGGNG

SEQ ID NO: 1483535 - protein, 24 aa, Mycobacterium tuberculosis
GGTAGVFGKKGDGGAGGFGAGTGG

SEQ ID NO: 1483536 - protein, 19 aa, Mycobacterium tuberculosis
GGTALLSSAAVGPVGTAAL

SEQ ID NO: 1483537 - protein, 25 aa, Mycobacterium tuberculosis
GGTGGAGGHAWLFGHGGTGGIGGGP

SEQ ID NO: 1483538 - protein, 36 aa, Mycobacterium tuberculosis
GGTGGAWGDGGFRRRGSARAVWLMGNGGQRGATAAP

SEQ ID NO: 1483539 - protein, 23 aa, Mycobacterium tuberculosis
GGTGGFAGFGGTAGNGGSGGTGG

SEQ ID NO: 1483540 - protein, 26 aa, Mycobacterium tuberculosis
GGTGGFPWGPADPAGPAGLGGFGGAW

SEQ ID NO: 1483541 - protein, 27 aa, Mycobacterium tuberculosis
GGTGGTNFAGGQGGAGGRGGAGGNGAN

SEQ ID NO: 1483542 - protein, 17 aa, Mycobacterium tuberculosis
GGTGGWLWGSGGAGGAG

SEQ ID NO: 1483543 - protein, 20 aa, Mycobacterium tuberculosis
GGTGGWLWGSGGAGGAGGSG

SEQ ID NO: 1483544 - protein, 17 aa, Mycobacterium tuberculosis
GGTGVGSPGGLGGAGGT

SEQ ID NO: 1483545 - protein, 22 aa, Mycobacterium tuberculosis
GGTMPNRLYWISATVNPDGDQG

SEQ ID NO: 1483546 - protein, 25 aa, Mycobacterium tuberculosis
GGTNFAGGQGGAGGRGGAGGNGANG

SEQ ID NO: 1483547 - protein, 20 aa, Mycobacterium tuberculosis
GGTPGDWGTGGTGGTGGTGG

SEQ ID NO: 1483548 - protein, 20 aa, Mycobacterium tuberculosis
GGTRRFSTTTVRSFTSAPPT

SEQ ID NO: 1483549 - protein, 45 aa, Mycobacterium tuberculosis
GGTRRRGRERWRRRRVRQWWIRRGRWPWRRRRRRRGGQLLRDRGR

SEQ ID NO: 1483550 - protein, 17 aa, Mycobacterium tuberculosis
GGTVFGGGKGRGRRSRR

SEQ ID NO: 1483551 - protein, 18 aa, Mycobacterium tuberculosis
GGTVLCAIEVAREEISAY

SEQ ID NO: 1483552 - protein, 23 aa, Mycobacterium tuberculosis
GGTWKGQRSGFVMVPDRNFAMTV

SEQ ID NO: 1483553 - protein, 18 aa, Mycobacterium tuberculosis
GGVAPSTGPSMGILPAGG

SEQ ID NO: 1483554 - protein, 26 aa, Mycobacterium tuberculosis
GGVAPSTGPSMGILPAGGVGGPGGSG

SEQ ID NO: 1483555 - protein, 21 aa, Mycobacterium tuberculosis
GGVATRFPGISFPSLGVTATG

SEQ ID NO: 1483556 - protein, 23 aa, Mycobacterium tuberculosis
GGVDPRRCLAVSLDVGTDNEQLL

SEQ ID NO: 1483557 - protein, 27 aa, Mycobacterium tuberculosis
GGVGGDGGRGGLLAGNGGTGGAGGNGG

SEQ ID NO: 1483558 - protein, 17 aa, Mycobacterium tuberculosis
GGVGGHGRHRRRRRPTG

SEQ ID NO: 1483559 - protein, 20 aa, Mycobacterium tuberculosis
GGVGGLGFDAGGAGGAGGKA

SEQ ID NO: 1483560 - protein, 25 aa, Mycobacterium tuberculosis
GGVGGMGGTGGWLMGNGGMGGAGVV

SEQ ID NO: 1483561 - protein, 26 aa, Mycobacterium tuberculosis
GGVGGNARLLGTGGAGGVGGGGGVGG

SEQ ID NO: 1483562 - protein, 28 aa, Mycobacterium tuberculosis
GGVGGNGATGPWLFGDGGAGGGGGAGGI

SEQ ID NO: 1483563 - protein, 25 aa, Mycobacterium tuberculosis
GGVGGRGGDGVFAGAGGQGGLGGQG

SEQ ID NO: 1483564 - protein, 24 aa, Mycobacterium tuberculosis
GGVGPRMGCPAARRPRRCAGEFNE

SEQ ID NO: 1483565 - protein, 23 aa, Mycobacterium tuberculosis
GGVKGFFEKTFAPLGLKKIQAEV

SEQ ID NO: 1483566 - protein, 17 aa, Mycobacterium tuberculosis
GGVRGRVGVVLRGQAVF

SEQ ID NO: 1483567 - protein, 19 aa, Mycobacterium tuberculosis
GGVSCPMSPALRKSGEGRL

SEQ ID NO: 1483568 - protein, 21 aa, Mycobacterium tuberculosis
GGVVLLMWAGILAYLDRYGYD

SEQ ID NO: 1483569 - protein, 17 aa, Mycobacterium tuberculosis
GGVVLYATCSPHLAETV

SEQ ID NO: 1483570 - protein, 17 aa, Mycobacterium tuberculosis
GGVWGRERGYCLMIGGD

SEQ ID NO: 1483571 - protein, 20 aa, Mycobacterium tuberculosis
GGWHRCLLDNGVHIGARHAI

SEQ ID NO: 1483572 - protein, 17 aa, Mycobacterium tuberculosis
GHAAMAQQLAGTPGATV

SEQ ID NO: 1483573 - protein, 18 aa, Mycobacterium tuberculosis
GHACGHNIIATSAVGTAL

SEQ ID NO: 1483574 - protein, 24 aa, Mycobacterium tuberculosis
GHAEAALLRLVEERHIPVLMNGMA

SEQ ID NO: 1483575 - protein, 24 aa, Mycobacterium tuberculosis
GHAGGCPHPLVVVAGAATRWVWVK

SEQ ID NO: 1483576 - protein, 23 aa, Mycobacterium tuberculosis
GHAGGGLSKATFAAVAAGAAGSL

SEQ ID NO: 1483577 - protein, 17 aa, Mycobacterium tuberculosis
GHALLLGARGRRLDVRQ

SEQ ID NO: 1483578 - protein, 22 aa, Mycobacterium tuberculosis
GHASPGIYARAFLEGRLTAEQL

SEQ ID NO: 1483579 - protein, 35 aa, Mycobacterium tuberculosis
GHDAGALWAHHFKPAGVDHGFGWTVEVVQQRIECR

SEQ ID NO: 1483580 - protein, 26 aa, Mycobacterium tuberculosis
GHDKNLFPDWVIADGPWVKWYPGIPG

SEQ ID NO: 1483581 - protein, 17 aa, Mycobacterium tuberculosis
GHDQLRAAHALAAAVPR

SEQ ID NO: 1483582 - protein, 17 aa, Mycobacterium tuberculosis
GHEVLIFRLFHAPPPSV

SEQ ID NO: 1483583 - protein, 17 aa, Mycobacterium tuberculosis
GHGALLLVDEAHGLGVR

SEQ ID NO: 1483584 - protein, 19 aa, Mycobacterium tuberculosis
GHGFLDWPAGAREATTARL

SEQ ID NO: 1483585 - protein, 21 aa, Mycobacterium tuberculosis
GHGGAGGLLIGNGGAGGAGGL

SEQ ID NO: 1483586 - protein, 29 aa, Mycobacterium tuberculosis
GHGGAGGWLYGNGGAGGFGGAGAVGGNGG

SEQ ID NO: 1483587 - protein, 24 aa, Mycobacterium tuberculosis
GHGGCSAPAHWRCWQQRRSHLRRK

SEQ ID NO: 1483588 - protein, 18 aa, Mycobacterium tuberculosis
GHGGLFGAGGTGGAGGSS

SEQ ID NO: 1483589 - protein, 19 aa, Mycobacterium tuberculosis
GHGGLIGVGGHGGDGGTGG

SEQ ID NO: 1483590 - protein, 23 aa, Mycobacterium tuberculosis
GHGGNGRRGRPWAPPAAPGGHRA

SEQ ID NO: 1483591 - protein, 22 aa, Mycobacterium tuberculosis
GHGNAKRWGWIHADLGDGDVLE

SEQ ID NO: 1483592 - protein, 17 aa, Mycobacterium tuberculosis
GHGNTGFFNAGSFNTGM

SEQ ID NO: 1483593 - protein, 17 aa, Mycobacterium tuberculosis
GHGRSGVPRAWRLQPQS

SEQ ID NO: 1483594 - protein, 18 aa, Mycobacterium tuberculosis
GHGVLVCAPTGAGKTVVG

SEQ ID NO: 1483595 - protein, 18 aa, Mycobacterium tuberculosis
GHHPGDVISVTWQTKSGG

SEQ ID NO: 1483596 - protein, 21 aa, Mycobacterium tuberculosis
GHHQHRLVQHRPHQYRHRQLG

SEQ ID NO: 1483597 - protein, 17 aa, Mycobacterium tuberculosis
GHIEFPYVYLDATYLNV

SEQ ID NO: 1483598 - protein, 33 aa, Mycobacterium tuberculosis
GHIELAAPVTHIWYFKGVPSRLGYLLDLAPKDL

SEQ ID NO: 1483599 - protein, 21 aa, Mycobacterium tuberculosis
GHLALRLDVYSGLQKTPKSLP

SEQ ID NO: 1483600 - protein, 20 aa, Mycobacterium tuberculosis
GHLEAAAGVAGFIKAVLAVQ

SEQ ID NO: 1483601 - protein, 18 aa, Mycobacterium tuberculosis
GHLFQQRFDADLCVAATE

SEQ ID NO: 1483602 - protein, 17 aa, Mycobacterium tuberculosis
GHLYVEFDGARVDPDRL

SEQ ID NO: 1483603 - protein, 21 aa, Mycobacterium tuberculosis
GHPENLCRPTAVVAAEHLGQL

SEQ ID NO: 1483604 - protein, 18 aa, Mycobacterium tuberculosis
GHPNVFVVGDLMFVPGVP

SEQ ID NO: 1483605 - protein, 25 aa, Mycobacterium tuberculosis
GHPRRAGVSSFGFGGTNAHVVIEQG

SEQ ID NO: 1483606 - protein, 17 aa, Mycobacterium tuberculosis
GHRNGGVVLLMWAGILA

SEQ ID NO: 1483607 - protein, 25 aa, Mycobacterium tuberculosis
GHRNGGVVLLMWAGILAYLDRYGYD

SEQ ID NO: 1483608 - protein, 19 aa, Mycobacterium tuberculosis
GHRRLRHRAGRRPPGQPPR

SEQ ID NO: 1483609 - protein, 24 aa, Mycobacterium tuberculosis
GHSAGGLMCRCGWTGCASAARSPA

SEQ ID NO: 1483610 - protein, 23 aa, Mycobacterium tuberculosis
GHSGALPAFGGRPVAAGSSCCPK

SEQ ID NO: 1483611 - protein, 19 aa, Mycobacterium tuberculosis
GHSLLPMMKLRIANPEYLV

SEQ ID NO: 1483612 - protein, 20 aa, Mycobacterium tuberculosis
GHSPLVLWALGPARLDEVAP

SEQ ID NO: 1483613 - protein, 19 aa, Mycobacterium tuberculosis
GHSWRKRPATGWESLTPTE

SEQ ID NO: 1483614 - protein, 17 aa, Mycobacterium tuberculosis
GHTEWLPPPHLDHGQPW

SEQ ID NO: 1483615 - protein, 24 aa, Mycobacterium tuberculosis
GHVEGFRPATLHQAYLALRAWGLP

SEQ ID NO: 1483616 - protein, 23 aa, Mycobacterium tuberculosis
GIAKRELRGVPARAVKSPADLDE

SEQ ID NO: 1483617 - protein, 18 aa, Mycobacterium tuberculosis
GIARFRDAFASDLAAHHR

SEQ ID NO: 1483618 - protein, 18 aa, Mycobacterium tuberculosis
GIARILLDAAGWSPGQTP

SEQ ID NO: 1483619 - protein, 19 aa, Mycobacterium tuberculosis
GIDEPRLGLILEIAAAAGL

SEQ ID NO: 1483620 - protein, 18 aa, Mycobacterium tuberculosis
GIDTVFTLSGGHLFSIYD

SEQ ID NO: 1483621 - protein, 24 aa, Mycobacterium tuberculosis
GIERGRIAILLKVHHALIDGEGGL

SEQ ID NO: 1483622 - protein, 20 aa, Mycobacterium tuberculosis
GIESRFPGTVTYYDRPEQPR

SEQ ID NO: 1483623 - protein, 22 aa, Mycobacterium tuberculosis
GIESRSAFGHVGFRSQLTVSLG

SEQ ID NO: 1483624 - protein, 17 aa, Mycobacterium tuberculosis
GIGARPGTIGVGSGLGR

SEQ ID NO: 1483625 - protein, 19 aa, Mycobacterium tuberculosis
GIGGLRPGALAIYPDGPTI

SEQ ID NO: 1483626 - protein, 18 aa, Mycobacterium tuberculosis
GIGKRVDLAYVEAGAQVA

SEQ ID NO: 1483627 - protein, 20 aa, Mycobacterium tuberculosis
GIGLLVDGRWRWRSYSLTSS

SEQ ID NO: 1483628 - protein, 24 aa, Mycobacterium tuberculosis
GIGLPRVETAGVVATRIDHTRIEP

SEQ ID NO: 1483629 - protein, 17 aa, Mycobacterium tuberculosis
GIGRAGLVGKLSVPQGW

SEQ ID NO: 1483630 - protein, 17 aa, Mycobacterium tuberculosis
GIHAAWFTDTWGRYNET

SEQ ID NO: 1483631 - protein, 19 aa, Mycobacterium tuberculosis
GIISAGRVGTALGVALQRA

SEQ ID NO: 1483632 - protein, 24 aa, Mycobacterium tuberculosis
GILAHAAVVYGYFPAVSEGNDIVV

SEQ ID NO: 1483633 - protein, 24 aa, Mycobacterium tuberculosis
GILDRGEKLMGFGHRVYRAEDPRA

SEQ ID NO: 1483634 - protein, 23 aa, Mycobacterium tuberculosis
GILDVLDNYAFVRTSGYLPGPHD

SEQ ID NO: 1483635 - protein, 24 aa, Mycobacterium tuberculosis
GILNRGAGISGVYNTGALGVVTAA

SEQ ID NO: 1483636 - protein, 17 aa, Mycobacterium tuberculosis
GILSRGMGWGCIDKPPA

SEQ ID NO: 1483637 - protein, 25 aa, Mycobacterium tuberculosis
GINALCGSASWRRQSGCPGDARGHS

SEQ ID NO: 1483638 - protein, 20 aa, Mycobacterium tuberculosis
GINGTGGAGGSRGQISGNPG

SEQ ID NO: 1483639 - protein, 19 aa, Mycobacterium tuberculosis
GIPKLRIEEAAARTQARID

SEQ ID NO: 1483640 - protein, 22 aa, Mycobacterium tuberculosis
GIPKLRIEEAAARTQARIDSGQ

SEQ ID NO: 1483641 - protein, 25 aa, Mycobacterium tuberculosis
GIPMTARAAWAWFRHLHPLADRTLA

SEQ ID NO: 1483642 - protein, 23 aa, Mycobacterium tuberculosis
GIPVRRVRATHAFHTSAMDPMLG

SEQ ID NO: 1483643 - protein, 35 aa, Mycobacterium tuberculosis
GIQIPRFCDHPLLEPVGACRQCLVEVEGQRKPLAS

SEQ ID NO: 1483644 - protein, 19 aa, Mycobacterium tuberculosis
GIRLPGRYNVANCLVALAI

SEQ ID NO: 1483645 - protein, 22 aa, Mycobacterium tuberculosis
GIRRRVAADLQILKRFAQTVEL

SEQ ID NO: 1483646 - protein, 18 aa, Mycobacterium tuberculosis
GISGLLLGADGFNAPASA

SEQ ID NO: 1483647 - protein, 17 aa, Mycobacterium tuberculosis
GISRKADKWVPLLENRT

SEQ ID NO: 1483648 - protein, 18 aa, Mycobacterium tuberculosis
GISRRRTEVATQVEAAPT

SEQ ID NO: 1483649 - protein, 25 aa, Mycobacterium tuberculosis
GISTNARMLIQFGFIERLAVAGDWR

SEQ ID NO: 1483650 - protein, 20 aa, Mycobacterium tuberculosis
GITARGAWEAVKRHFREIGI

SEQ ID NO: 1483651 - protein, 17 aa, Mycobacterium tuberculosis
GITMGKQEFDGMSRISG

SEQ ID NO: 1483652 - protein, 17 aa, Mycobacterium tuberculosis
GIVPALVNYAPTQLAQA

SEQ ID NO: 1483653 - protein, 17 aa, Mycobacterium tuberculosis
GIVRRELEDYSRRKHTE

SEQ ID NO: 1483654 - protein, 20 aa, Mycobacterium tuberculosis
GIVVAGRIIELVAGTTYEST

SEQ ID NO: 1483655 - protein, 23 aa, Mycobacterium tuberculosis
GIVYTYARPNWWANANTVRSMID

SEQ ID NO: 1483656 - protein, 18 aa, Mycobacterium tuberculosis
GIWHEGWFANTIHAATPA

SEQ ID NO: 1483657 - protein, 18 aa, Mycobacterium tuberculosis
GIYHPPHFVQKVVSANGQ

SEQ ID NO: 1483658 - protein, 20 aa, Mycobacterium tuberculosis
GIYQCRACGAELFRSTREIR

SEQ ID NO: 1483659 - protein, 19 aa, Mycobacterium tuberculosis
GKAGFSPGPTNFGLNGAGG

SEQ ID NO: 1483660 - protein, 17 aa, Mycobacterium tuberculosis
GKAGLIGNGGNGGAGGA

SEQ ID NO: 1483661 - protein, 22 aa, Mycobacterium tuberculosis
GKAGPAGSILHDGGNGGHGGHG

SEQ ID NO: 1483662 - protein, 26 aa, Mycobacterium tuberculosis
GKAGPAGSILHDGRQRAVTGGHGGCQ

SEQ ID NO: 1483663 - protein, 20 aa, Mycobacterium tuberculosis
GKAKPQRRNASTSPRVGQRR

SEQ ID NO: 1483664 - protein, 17 aa, Mycobacterium tuberculosis
GKAPNVRWRVENPDKIR

SEQ ID NO: 1483665 - protein, 18 aa, Mycobacterium tuberculosis
GKDLGARLLAGVLDSGLN

SEQ ID NO: 1483666 - protein, 25 aa, Mycobacterium tuberculosis
GKDTRGIIRVHQFDKVEGFVYCTPA

SEQ ID NO: 1483667 - protein, 20 aa, Mycobacterium tuberculosis
GKFVRSETIPEFLAALEKPR

SEQ ID NO: 1483668 - protein, 22 aa, Mycobacterium tuberculosis
GKGAIPAMKGATGADGTAPTSG

SEQ ID NO: 1483669 - protein, 23 aa, Mycobacterium tuberculosis
GKGCDICKPVVASILASTGSDHI

SEQ ID NO: 1483670 - protein, 19 aa, Mycobacterium tuberculosis
GKGGENIIGDGGGGGNGGA

SEQ ID NO: 1483671 - protein, 18 aa, Mycobacterium tuberculosis
GKGGNGADGEVGGAGGAG

SEQ ID NO: 1483672 - protein, 19 aa, Mycobacterium tuberculosis
GKGGSGLVGGDGGAGGAGG

SEQ ID NO: 1483673 - protein, 18 aa, Mycobacterium tuberculosis
GKGLSRLVRQNCDEVVSI

SEQ ID NO: 1483674 - protein, 20 aa, Mycobacterium tuberculosis
GKGVMRTWYLIGRKVAADPG

SEQ ID NO: 1483675 - protein, 18 aa, Mycobacterium tuberculosis
GKHLGVGVTSIYWYFRKK

SEQ ID NO: 1483676 - protein, 20 aa, Mycobacterium tuberculosis
GKHLRRLAALAAELEAVEVI

SEQ ID NO: 1483677 - protein, 19 aa, Mycobacterium tuberculosis
GKIRRAACVEQYRLQQFTR

SEQ ID NO: 1483678 - protein, 17 aa, Mycobacterium tuberculosis
GKISPRERIMMMSTGAT

SEQ ID NO: 1483679 - protein, 26 aa, Mycobacterium tuberculosis
GKKAARRRAVELLDLVGISQPQRRSR

SEQ ID NO: 1483680 - protein, 21 aa, Mycobacterium tuberculosis
GKNGQINLGFGNTGSGNIGNN

SEQ ID NO: 1483681 - protein, 23 aa, Mycobacterium tuberculosis
GKNSPGLVVLLTFGTGIGSAVIH

SEQ ID NO: 1483682 - protein, 34 aa, Mycobacterium tuberculosis
GKQASAAKFIWFFATRTRFGLWFRNVAMRTMNFG

SEQ ID NO: 1483683 - protein, 23 aa, Mycobacterium tuberculosis
GKQASAAKFIWFFRHPNPIRPVV

SEQ ID NO: 1483684 - protein, 21 aa, Mycobacterium tuberculosis
GKRSYAASVHRATRPGATLLL

SEQ ID NO: 1483685 - protein, 36 aa, Mycobacterium tuberculosis
GKSGDCGTGGYRRRLWRWWLAARATASPADTGGRSE

SEQ ID NO: 1483686 - protein, 26 aa, Mycobacterium tuberculosis
GKSGGAPGHRGAGGAGGLLLGENGLN

SEQ ID NO: 1483687 - protein, 28 aa, Mycobacterium tuberculosis
GKSYRFRRLELARFLAALHATVLDNPVQ

SEQ ID NO: 1483688 - protein, 19 aa, Mycobacterium tuberculosis
GKTLAAAKAEALKCAKGFR

SEQ ID NO: 1483689 - protein, 19 aa, Mycobacterium tuberculosis
GKTLAAFLWALDSLAGSEP

SEQ ID NO: 1483690 - protein, 17 aa, Mycobacterium tuberculosis
GKTLPGIEVLSREQPTG

SEQ ID NO: 1483691 - protein, 22 aa, Mycobacterium tuberculosis
GKTMVVTGLHLLGGARADATRV

SEQ ID NO: 1483692 - protein, 19 aa, Mycobacterium tuberculosis
GKTRGFPLGPGYLLDGLPV

SEQ ID NO: 1483693 - protein, 18 aa, Mycobacterium tuberculosis
GKTSSARILARSLNCAQG

SEQ ID NO: 1483694 - protein, 18 aa, Mycobacterium tuberculosis
GKVDKDWDADATKGIPFG

SEQ ID NO: 1483695 - protein, 17 aa, Mycobacterium tuberculosis
GKVKVELALARGKQARD

SEQ ID NO: 1483696 - protein, 27 aa, Mycobacterium tuberculosis
GKVLPAMLKRQLQLLLPLVEDRFVETV

SEQ ID NO: 1483697 - protein, 19 aa, Mycobacterium tuberculosis
GKVTAWRYIRAAVRAVLAC

SEQ ID NO: 1483698 - protein, 24 aa, Mycobacterium tuberculosis
GKWDPGNLSMDWFRAEVAKDTRGE

SEQ ID NO: 1483699 - protein, 19 aa, Mycobacterium tuberculosis
GLAAELAVAASSFGSVTSG

SEQ ID NO: 1483700 - protein, 22 aa, Mycobacterium tuberculosis
GLACVVLRVARFFVEGDDMPDL

SEQ ID NO: 1483701 - protein, 25 aa, Mycobacterium tuberculosis
GLADAAWRGPAAVAMARAVAPYLGW

SEQ ID NO: 1483702 - protein, 19 aa, Mycobacterium tuberculosis
GLADIEWTVQLLQLQHAHQ

SEQ ID NO: 1483703 - protein, 17 aa, Mycobacterium tuberculosis
GLAESLGARVFVEVGPG

SEQ ID NO: 1483704 - protein, 19 aa, Mycobacterium tuberculosis
GLAGLAVDTDLRWRIVTAL

SEQ ID NO: 1483705 - protein, 20 aa, Mycobacterium tuberculosis
GLAGQAWQGPAALAMAAAAA

SEQ ID NO: 1483706 - protein, 19 aa, Mycobacterium tuberculosis
GLAGSSWLGAASTAMTGAA

SEQ ID NO: 1483707 - protein, 23 aa, Mycobacterium tuberculosis
GLALKPRKAFSPIRVAATGTTVS

SEQ ID NO: 1483708 - protein, 18 aa, Mycobacterium tuberculosis
GLAPSSIYWHFGSKEGVL

SEQ ID NO: 1483709 - protein, 24 aa, Mycobacterium tuberculosis
GLASRYIRLLPRGLVKRVVPKPGT

SEQ ID NO: 1483710 - protein, 20 aa, Mycobacterium tuberculosis
GLCNSAGFGTSGRFWESPFA

SEQ ID NO: 1483711 - protein, 17 aa, Mycobacterium tuberculosis
GLCRGMDSSMFFHPDGE

SEQ ID NO: 1483712 - protein, 29 aa, Mycobacterium tuberculosis
GLDARAYRLPWPAGTVVYEIDQPQVIDFK

SEQ ID NO: 1483713 - protein, 27 aa, Mycobacterium tuberculosis
GLDPRYPLKGCFMPLSVDDAVITGLTP

SEQ ID NO: 1483714 - protein, 26 aa, Mycobacterium tuberculosis
GLDPRYPLKGVFHAAGVLDDAVITGL

SEQ ID NO: 1483715 - protein, 23 aa, Mycobacterium tuberculosis
GLDPVLRVELWDRFTALARRGTT

SEQ ID NO: 1483716 - protein, 24 aa, Mycobacterium tuberculosis
GLDRRPRANWGRRPFSCGPLSGTS

SEQ ID NO: 1483717 - protein, 19 aa, Mycobacterium tuberculosis
GLDRVKPFRPFQLNSRLLA

SEQ ID NO: 1483718 - protein, 17 aa, Mycobacterium tuberculosis
GLDRYGVRFRIEARDGD

SEQ ID NO: 1483719 - protein, 27 aa, Mycobacterium tuberculosis
GLDSRAFRLQWPIGTTIFELDRPQVLD

SEQ ID NO: 1483720 - protein, 26 aa, Mycobacterium tuberculosis
GLDSRAYRLPWPTMTVVYEIDQPKVM

SEQ ID NO: 1483721 - protein, 24 aa, Mycobacterium tuberculosis
GLDSRAYRLPWPTRTVVYEIDQPK

SEQ ID NO: 1483722 - protein, 24 aa, Mycobacterium tuberculosis
GLEEVRIAVCYRWDPDTREIGAPL

SEQ ID NO: 1483723 - protein, 17 aa, Mycobacterium tuberculosis
GLEIEWVGTASGEVRQR

SEQ ID NO: 1483724 - protein, 18 aa, Mycobacterium tuberculosis
GLEILRRVRESDVYTPTL

SEQ ID NO: 1483725 - protein, 24 aa, Mycobacterium tuberculosis
GLELIWGIEDCRNMSARLERDLLA

SEQ ID NO: 1483726 - protein, 20 aa, Mycobacterium tuberculosis
GLEPPRFCAQCGRRMVVQVR

SEQ ID NO: 1483727 - protein, 18 aa, Mycobacterium tuberculosis
GLETMCVGGGQGMAMVIE

SEQ ID NO: 1483728 - protein, 19 aa, Mycobacterium tuberculosis
GLETMCVGGGQGMAMVIER

SEQ ID NO: 1483729 - protein, 19 aa, Mycobacterium tuberculosis
GLFDPRLKRPIPYLPNMIG

SEQ ID NO: 1483730 - protein, 24 aa, Mycobacterium tuberculosis
GLFLPSNTIAPFLGLLGGVAAADA

SEQ ID NO: 1483731 - protein, 19 aa, Mycobacterium tuberculosis
GLGACRYAKSQGERPPGGN

SEQ ID NO: 1483732 - protein, 24 aa, Mycobacterium tuberculosis
GLGAIKPRPVVVGGEVVARPTMTL

SEQ ID NO: 1483733 - protein, 26 aa, Mycobacterium tuberculosis
GLGGGSFGLPGLNGSGGDGGDGGNGA

SEQ ID NO: 1483734 - protein, 28 aa, Mycobacterium tuberculosis
GLGGGSFGLPGLNGSGIHGGDGGNGAPG

SEQ ID NO: 1483735 - protein, 27 aa, Mycobacterium tuberculosis
GLGGIIQDIEELLGITFVQNAINGAVN

SEQ ID NO: 1483736 - protein, 20 aa, Mycobacterium tuberculosis
GLGGLECLSGIPGSAGATPV

SEQ ID NO: 1483737 - protein, 17 aa, Mycobacterium tuberculosis
GLGGLLLGNGGAGGVGG

SEQ ID NO: 1483738 - protein, 18 aa, Mycobacterium tuberculosis
GLGGQLIGLDGSNAPVST

SEQ ID NO: 1483739 - protein, 18 aa, Mycobacterium tuberculosis
GLGGRAGLIGHAGAGGNG

SEQ ID NO: 1483740 - protein, 18 aa, Mycobacterium tuberculosis
GLGGVFGDGGAGGTGGLG

SEQ ID NO: 1483741 - protein, 17 aa, Mycobacterium tuberculosis
GLGKAGFAGGAGGTGGT

SEQ ID NO: 1483742 - protein, 18 aa, Mycobacterium tuberculosis
GLGLDFLRHIERCAVLVH

SEQ ID NO: 1483743 - protein, 17 aa, Mycobacterium tuberculosis
GLGLRSAISSGLGSTAP

SEQ ID NO: 1483744 - protein, 40 aa, Mycobacterium tuberculosis
GLGNVGVFTGRRAMWVGRIWVSAMPVAPMSGSATSVTGMS

SEQ ID NO: 1483745 - protein, 18 aa, Mycobacterium tuberculosis
GLGPFPTDRGWALRELFD

SEQ ID NO: 1483746 - protein, 24 aa, Mycobacterium tuberculosis
GLGPINITSAPGFGNSTTTPSSGF

SEQ ID NO: 1483747 - protein, 19 aa, Mycobacterium tuberculosis
GLGRPRIDVTVRISGFFRD

SEQ ID NO: 1483748 - protein, 22 aa, Mycobacterium tuberculosis
GLHAGFARLLVQLRRDAAVGGG

SEQ ID NO: 1483749 - protein, 17 aa, Mycobacterium tuberculosis
GLIDELGTLTWRQLDER

SEQ ID NO: 1483750 - protein, 18 aa, Mycobacterium tuberculosis
GLLDPEARVRTRYLDLAV

SEQ ID NO: 1483751 - protein, 24 aa, Mycobacterium tuberculosis
GLLDRLSKQPGIHAVHVSNGDKPK

SEQ ID NO: 1483752 - protein, 25 aa, Mycobacterium tuberculosis
GLLDVKRWVTLIGVGGVGKTRLATQ

SEQ ID NO: 1483753 - protein, 18 aa, Mycobacterium tuberculosis
GLLKRPAIDFLDALVSLD

SEQ ID NO: 1483754 - protein, 20 aa, Mycobacterium tuberculosis
GLLPPTFSLVGFARRDWSTQ

SEQ ID NO: 1483755 - protein, 17 aa, Mycobacterium tuberculosis
GLLRPPAAQRLVSALRS

SEQ ID NO: 1483756 - protein, 25 aa, Mycobacterium tuberculosis
GLNAVIRAVVRTCHARYGSSVVGFQ

SEQ ID NO: 1483757 - protein, 23 aa, Mycobacterium tuberculosis
GLNIPTGIPLRYDLDSAMRPLVR

SEQ ID NO: 1483758 - protein, 28 aa, Mycobacterium tuberculosis
GLNPPPVPIPWSVLSLFVPGPTLSRADA

SEQ ID NO: 1483759 - protein, 20 aa, Mycobacterium tuberculosis
GLNSLMAMAIRREAEQFVGI

SEQ ID NO: 1483760 - protein, 25 aa, Mycobacterium tuberculosis
GLNSLMAMAIRREAEQFVGIELSAT

SEQ ID NO: 1483761 - protein, 22 aa, Mycobacterium tuberculosis
GLPAACSTCCRWNEVRIRRLPR

SEQ ID NO: 1483762 - protein, 25 aa, Mycobacterium tuberculosis
GLPGFPEFPAIPGFPALPGLPSIPN

SEQ ID NO: 1483763 - protein, 28 aa, Mycobacterium tuberculosis
GLPGNPGAVPGRAGGAGGLGGSGSDTSE

SEQ ID NO: 1483764 - protein, 29 aa, Mycobacterium tuberculosis
GLPGNPGAVPGRVGGAGGLGGSGSDTSEG

SEQ ID NO: 1483765 - protein, 24 aa, Mycobacterium tuberculosis
GLPGPRCAVGAVADQRTPQQQLGG

SEQ ID NO: 1483766 - protein, 20 aa, Mycobacterium tuberculosis
GLPKPDWQVLLAVSAELAGE

SEQ ID NO: 1483767 - protein, 30 aa, Mycobacterium tuberculosis
GLPLPAGAVGEIWLRGTTVVRGYLGDPTIT

SEQ ID NO: 1483768 - protein, 18 aa, Mycobacterium tuberculosis
GLPSVFVYDGNPCGAGFA

SEQ ID NO: 1483769 - protein, 18 aa, Mycobacterium tuberculosis
GLPYFPITPLFPLAGPVG

SEQ ID NO: 1483770 - protein, 18 aa, Mycobacterium tuberculosis
GLQRAMRAAAEWFGERGW

SEQ ID NO: 1483771 - protein, 17 aa, Mycobacterium tuberculosis
GLQRIGLVRSVRAPQFD

SEQ ID NO: 1483772 - protein, 20 aa, Mycobacterium tuberculosis
GLQRRLGTTTVYVTHDQVEA

SEQ ID NO: 1483773 - protein, 44 aa, Mycobacterium tuberculosis
GLRDPRGAGLLQLEHRAFVGLLQFRCGRQLGLRQQRLGPLGLVQ

SEQ ID NO: 1483774 - protein, 19 aa, Mycobacterium tuberculosis
GLREIRVPGRLEQIDRGQG

SEQ ID NO: 1483775 - protein, 22 aa, Mycobacterium tuberculosis
GLRELRPSAAVVELPGLGHYPQ

SEQ ID NO: 1483776 - protein, 20 aa, Mycobacterium tuberculosis
GLRGSRVVLRVPRRGDKRAL

SEQ ID NO: 1483777 - protein, 26 aa, Mycobacterium tuberculosis
GLRMVGRGVLRPGLAVLVGDETVGVT

SEQ ID NO: 1483778 - protein, 27 aa, Mycobacterium tuberculosis
GLRPGQKLRIVKYLAYGWSSLRSRPAL

SEQ ID NO: 1483779 - protein, 18 aa, Mycobacterium tuberculosis
GLRPPPRGLRSAAGADAA

SEQ ID NO: 1483780 - protein, 25 aa, Mycobacterium tuberculosis
GLRRLRRCWRLWGAARAPPQVGRVG

SEQ ID NO: 1483781 - protein, 25 aa, Mycobacterium tuberculosis
GLRRTHGWPAAMGILREMGMAHHRK

SEQ ID NO: 1483782 - protein, 19 aa, Mycobacterium tuberculosis
GLRSEARNGLMLPYVIELD

SEQ ID NO: 1483783 - protein, 17 aa, Mycobacterium tuberculosis
GLRVAWRTLENSGINPD

SEQ ID NO: 1483784 - protein, 27 aa, Mycobacterium tuberculosis
GLRVHARTGLPCPVCGDTVREVSFADK

SEQ ID NO: 1483785 - protein, 20 aa, Mycobacterium tuberculosis
GLRVRRRAKVWYDRLNAEDP

SEQ ID NO: 1483786 - protein, 21 aa, Mycobacterium tuberculosis
GLSCKELTGDIARRPIADAVI

SEQ ID NO: 1483787 - protein, 24 aa, Mycobacterium tuberculosis
GLSCKELTGDIARRPIADAVIFGT

SEQ ID NO: 1483788 - protein, 18 aa, Mycobacterium tuberculosis
GLSHPMGPLRLSDLVGLD

SEQ ID NO: 1483789 - protein, 23 aa, Mycobacterium tuberculosis
GLSHPMGPLRLSDLVGLDTLKLI

SEQ ID NO: 1483790 - protein, 18 aa, Mycobacterium tuberculosis
GLSRCILGAGTILHTGDI

SEQ ID NO: 1483791 - protein, 24 aa, Mycobacterium tuberculosis
GLSRPATGLPLSLTMVTAASTPSA

SEQ ID NO: 1483792 - protein, 20 aa, Mycobacterium tuberculosis
GLSRVVQCLGVVKIKDTLPF

SEQ ID NO: 1483793 - protein, 24 aa, Mycobacterium tuberculosis
GLSRWTWPARWRCPSSTAASSRFR

SEQ ID NO: 1483794 - protein, 23 aa, Mycobacterium tuberculosis
GLSVPHSWNLPPAVRQVAAMFPG

SEQ ID NO: 1483795 - protein, 19 aa, Mycobacterium tuberculosis
GLTDPRHTVRIAVGATALG

SEQ ID NO: 1483796 - protein, 21 aa, Mycobacterium tuberculosis
GLTDYLWRELIVFEDVTGDYD

SEQ ID NO: 1483797 - protein, 17 aa, Mycobacterium tuberculosis
GLTEALHNIGFGNIGGN

SEQ ID NO: 1483798 - protein, 21 aa, Mycobacterium tuberculosis
GLTLPPRRRRRIPVVIHEANA

SEQ ID NO: 1483799 - protein, 18 aa, Mycobacterium tuberculosis
GLTPGLMGLGNIGFGNAG

SEQ ID NO: 1483800 - protein, 19 aa, Mycobacterium tuberculosis
GLTPILCLTKTDLAPAEPF

SEQ ID NO: 1483801 - protein, 17 aa, Mycobacterium tuberculosis
GLTPPRWPAMNAGSTRP

SEQ ID NO: 1483802 - protein, 20 aa, Mycobacterium tuberculosis
GLTYNFTFKFEKAGQGSVMV

SEQ ID NO: 1483803 - protein, 17 aa, Mycobacterium tuberculosis
GLVALVMSACSLAVCRE

SEQ ID NO: 1483804 - protein, 17 aa, Mycobacterium tuberculosis
GLVAVGAGSAVTADATS

SEQ ID NO: 1483805 - protein, 24 aa, Mycobacterium tuberculosis
GLVDDIRINWVWNPPWGPDKITED

SEQ ID NO: 1483806 - protein, 18 aa, Mycobacterium tuberculosis
GLVDVALFAIAQVVQPTE

SEQ ID NO: 1483807 - protein, 19 aa, Mycobacterium tuberculosis
GLVEGRRLTKVLGLPGPHR

SEQ ID NO: 1483808 - protein, 17 aa, Mycobacterium tuberculosis
GLVGCGAAAGAAAASGL

SEQ ID NO: 1483809 - protein, 17 aa, Mycobacterium tuberculosis
GLVGKLSVPQGWTVGRP

SEQ ID NO: 1483810 - protein, 17 aa, Mycobacterium tuberculosis
GLVRLHIATVLGNITPE

SEQ ID NO: 1483811 - protein, 18 aa, Mycobacterium tuberculosis
GLVRRSRVHWVRARVVQL

SEQ ID NO: 1483812 - protein, 19 aa, Mycobacterium tuberculosis
GLVRVLPPFLSRKHLPSRL

SEQ ID NO: 1483813 - protein, 18 aa, Mycobacterium tuberculosis
GLVTALFGAPGQPGDTGQ

SEQ ID NO: 1483814 - protein, 21 aa, Mycobacterium tuberculosis
GLWANLACRKRFIGDKLDEAL

SEQ ID NO: 1483815 - protein, 33 aa, Mycobacterium tuberculosis
GLYEAKTTFGRIGVKVWIYKGDIVGGKRELAAA

SEQ ID NO: 1483816 - protein, 25 aa, Mycobacterium tuberculosis
GLYTPAQFQPWTGIPSLTYDQSVAE

SEQ ID NO: 1483817 - protein, 19 aa, Mycobacterium tuberculosis
GMAAVQLARQWGVEVFVTA

SEQ ID NO: 1483818 - protein, 19 aa, Mycobacterium tuberculosis
GMAGLPIAFSGPRWLALLL

SEQ ID NO: 1483819 - protein, 19 aa, Mycobacterium tuberculosis
GMALAFRAGAPLKDMEFVQ

SEQ ID NO: 1483820 - protein, 26 aa, Mycobacterium tuberculosis
GMAPGARPGPVPKPGIRTPRVGNNPF

SEQ ID NO: 1483821 - protein, 26 aa, Mycobacterium tuberculosis
GMAPGARPGPVPKPGIRTPRVGNNSF

SEQ ID NO: 1483822 - protein, 17 aa, Mycobacterium tuberculosis
GMASVKWELEDLSFAIL

SEQ ID NO: 1483823 - protein, 19 aa, Mycobacterium tuberculosis
GMGELHLDILVDRMRREFK

SEQ ID NO: 1483824 - protein, 17 aa, Mycobacterium tuberculosis
GMGLRLKGSDTLYSCLP

SEQ ID NO: 1483825 - protein, 18 aa, Mycobacterium tuberculosis
GMHPWGKWGNDFTEYGVV

SEQ ID NO: 1483826 - protein, 18 aa, Mycobacterium tuberculosis
GMKLARPDVFHPRVVLAG

SEQ ID NO: 1483827 - protein, 17 aa, Mycobacterium tuberculosis
GMLSPWLQLPGAADQIA

SEQ ID NO: 1483828 - protein, 23 aa, Mycobacterium tuberculosis
GMLTGPVTILAWSFVRDDQSLAD

SEQ ID NO: 1483829 - protein, 23 aa, Mycobacterium tuberculosis
GMPMVPPGAMGARGEGSGQEKPV

SEQ ID NO: 1483830 - protein, 17 aa, Mycobacterium tuberculosis
GMQRLPVSYRPGLLCVR

SEQ ID NO: 1483831 - protein, 21 aa, Mycobacterium tuberculosis
GMQRVFFGWAQIWRTKSRAAE

SEQ ID NO: 1483832 - protein, 21 aa, Mycobacterium tuberculosis
GMSRLSGYLTPQARATFEAVL

SEQ ID NO: 1483833 - protein, 19 aa, Mycobacterium tuberculosis
GMTEFKVFWQPPPAPEIPK

SEQ ID NO: 1483834 - protein, 24 aa, Mycobacterium tuberculosis
GMVSGLDRKNCWTIAEHRGDTTPM

SEQ ID NO: 1483835 - protein, 18 aa, Mycobacterium tuberculosis
GNADFRYNTVITKETCAG

SEQ ID NO: 1483836 - protein, 18 aa, Mycobacterium tuberculosis
GNAGIARFDSPDPEAEPD

SEQ ID NO: 1483837 - protein, 19 aa, Mycobacterium tuberculosis
GNAGIARFDSPDPEAEPDV

SEQ ID NO: 1483838 - protein, 19 aa, Mycobacterium tuberculosis
GNAGLWGNGGAGGAGAAGA

SEQ ID NO: 1483839 - protein, 22 aa, Mycobacterium tuberculosis
GNAGSFTLKASGGAGGSGGSSL

SEQ ID NO: 1483840 - protein, 18 aa, Mycobacterium tuberculosis
GNAGTVFGSGGAGGNGGV

SEQ ID NO: 1483841 - protein, 21 aa, Mycobacterium tuberculosis
GNAGVALSVGSTGGLGGNGGS

SEQ ID NO: 1483842 - protein, 17 aa, Mycobacterium tuberculosis
GNAIVAGGAGGNGGAGG

SEQ ID NO: 1483843 - protein, 24 aa, Mycobacterium tuberculosis
GNARLLCTGGAGGVGGGGGAGGDG

SEQ ID NO: 1483844 - protein, 22 aa, Mycobacterium tuberculosis
GNARLLGTGGAGGVGGGGGAGG

SEQ ID NO: 1483845 - protein, 17 aa, Mycobacterium tuberculosis
GNAVGLFGQGGAGGAGG

SEQ ID NO: 1483846 - protein, 24 aa, Mycobacterium tuberculosis
GNAVIPGDGVGKAPHGDAGGSGGY

SEQ ID NO: 1483847 - protein, 17 aa, Mycobacterium tuberculosis
GNCTGPPRTSRWTGSAH

SEQ ID NO: 1483848 - protein, 20 aa, Mycobacterium tuberculosis
GNEAPKFFNSKGEPLSDHSP

SEQ ID NO: 1483849 - protein, 26 aa, Mycobacterium tuberculosis
GNFGSGNGRAGLPGSGNVGNGNLGNS

SEQ ID NO: 1483850 - protein, 34 aa, Mycobacterium tuberculosis; identical to SEQ ID NO: 200121

SEQ ID NO: 1483851 - protein, 30 aa, Mycobacterium tuberculosis
GNGAAGGAGGRLFGNGGAGGNGGTAGQGGD

SEQ ID NO: 1483852 - protein, 18 aa, Mycobacterium tuberculosis
GNGALLIGGGGLGGAGGM

SEQ ID NO: 1483853 - protein, 27 aa, Mycobacterium tuberculosis
GNGDNHATGGWLYRNGGAGDQGAIAGA

SEQ ID NO: 1483854 - protein, 25 aa, Mycobacterium tuberculosis
GNGERTGNVCLVTLGLNLFSRGVDP

SEQ ID NO: 1483855 - protein, 22 aa, Mycobacterium tuberculosis
GNGGAFGALGGKGGSGGLIARG

SEQ ID NO: 1483856 - protein, 22 aa, Mycobacterium tuberculosis
GNGGAGGLLFGDGGNGGAGGAG

SEQ ID NO: 1483857 - protein, 17 aa, Mycobacterium tuberculosis
GNGGAGGNGGTAGQGGD

SEQ ID NO: 1483858 - protein, 26 aa, Mycobacterium tuberculosis
GNGGAGGNGGWLFGNGGAGGSGGDGG

SEQ ID NO: 1483859 - protein, 26 aa, Mycobacterium tuberculosis
GNGGAGGPQRPKVFPAGTGGAGGPRG

SEQ ID NO: 1483860 - protein, 55 aa, Mycobacterium tuberculosis
GNGGAGRHRGHPGARRTRRVRRAWRPAVRPNRHGWRVAVAGRLAASAALASSQTS

SEQ ID NO: 1483861 - protein, 18 aa, Mycobacterium tuberculosis
  misc_feature (14)..(14): Xaa can be any naturally occurring amino acid
GNGGAIFNAGTPGXAGTG

SEQ ID NO: 1483862 - protein, 17 aa, Mycobacterium tuberculosis
GNGGDAGLFGNGGAGGA

SEQ ID NO: 1483863 - protein, 23 aa, Mycobacterium tuberculosis
GNGGDALGLVGVGGNGGNAGTGF

SEQ ID NO: 1483864 - protein, 51 aa, Mycobacterium tuberculosis
GNGGGALNQAGFFGTGGKRRVTAGNGGARHDQRPASAAFGGAAGGDAFDVA

SEQ ID NO: 1483865 - protein, 29 aa, Mycobacterium tuberculosis
GNGGIGGSAARLFGGGGAGGAGGTGSTAG

SEQ ID NO: 1483866 - protein, 19 aa, Mycobacterium tuberculosis
GNGGIGITVGGAGGAGGNG

SEQ ID NO: 1483867 - protein, 20 aa, Mycobacterium tuberculosis
GNGGKGGFAQATTSVTGGNG

SEQ ID NO: 1483868 - protein, 20 aa, Mycobacterium tuberculosis
GNGGKGGPGRHWRRHSERDR

SEQ ID NO: 1483869 - protein, 24 aa, Mycobacterium tuberculosis
GNGGKGGTGLMPGINGTGGAGGSR

SEQ ID NO: 1483870 - protein, 18 aa, Mycobacterium tuberculosis
GNGGLLSGNAGAGGHGGA

SEQ ID NO: 1483871 - protein, 18 aa, Mycobacterium tuberculosis
GNGGLVFGNGGPGGLGGP

SEQ ID NO: 1483872 - protein, 25 aa, Mycobacterium tuberculosis
GNGGNGGIRGIGGAGGIGGAGSTAG

SEQ ID NO: 1483873 - protein, 24 aa, Mycobacterium tuberculosis
GNGGNGGNGGWLYGDGGSGGSTLQ

SEQ ID NO: 1483874 - protein, 20 aa, Mycobacterium tuberculosis
GNGGPAILSGNGGNGGAGGA

SEQ ID NO: 1483875 - protein, 26 aa, Mycobacterium tuberculosis
GNGGRGADATGFGQTGASGGRGGDGG

SEQ ID NO: 1483876 - protein, 17 aa, Mycobacterium tuberculosis
GNGGRGIDGTDGATAGA

SEQ ID NO: 1483877 - protein, 29 aa, Mycobacterium tuberculosis
GNGGSGGRGDMAFKDGDGGAGGDGGDPGA

SEQ ID NO: 1483878 - protein, 20 aa, Mycobacterium tuberculosis
GNGGTGWNGGKGDTGSGGGA

SEQ ID NO: 1483879 - protein, 17 aa, Mycobacterium tuberculosis
GNGGVWYGNGGAGGAAG

SEQ ID NO: 1483880 - protein, 24 aa, Mycobacterium tuberculosis
GNGGWMCGNGGFGGSLVPGKAGGA

SEQ ID NO: 1483881 - protein, 17 aa, Mycobacterium tuberculosis
GNGLALNGGNGIGGNGG

SEQ ID NO: 1483882 - protein, 17 aa, Mycobacterium tuberculosis
GNGLNLVGVPGTAGGGA

SEQ ID NO: 1483883 - protein, 20 aa, Mycobacterium tuberculosis
GNGNIGFGLTGNNQVGIGGL

SEQ ID NO: 1483884 - protein, 21 aa, Mycobacterium tuberculosis
GNGNIGFGLTGNNQVGIGGLN

SEQ ID NO: 1483885 - protein, 19 aa, Mycobacterium tuberculosis
GNGSLRGSGGAGGHGGNGG

SEQ ID NO: 1483886 - protein, 33 aa, Mycobacterium tuberculosis
GNIGFGITGDHQMGFGGFNSGSGNIGFGNSGTG

SEQ ID NO: 1483887 - protein, 17 aa, Mycobacterium tuberculosis
GNIGFGLTGNNQVGIGG

SEQ ID NO: 1483888 - protein, 34 aa, Mycobacterium tuberculosis
GNIGVPGTLFGSVRSGLNTGLFNMGTAISGLFNL

SEQ ID NO: 1483889 - protein, 27 aa, Mycobacterium tuberculosis
GNLDPAVVLAGWPAVERAARAVVDDGR

SEQ ID NO: 1483890 - protein, 20 aa, Mycobacterium tuberculosis
GNLGWLWPHPPEALAPRYVD

SEQ ID NO: 1483891 - protein, 17 aa, Mycobacterium tuberculosis
GNLHPLVADTADFRESS

SEQ ID NO: 1483892 - protein, 19 aa, Mycobacterium tuberculosis
GNLISEWDDTPEGFGRIAA

SEQ ID NO: 1483893 - protein, 17 aa, Mycobacterium tuberculosis
GNLLSGWANLGNTVSGF

SEQ ID NO: 1483894 - protein, 17 aa, Mycobacterium tuberculosis
GNLNFGSGNLLGNGNFG

SEQ ID NO: 1483895 - protein, 26 aa, Mycobacterium tuberculosis
GNLRLIRAVEKFDYTKGYKFSTYATW

SEQ ID NO: 1483896 - protein, 26 aa, Mycobacterium tuberculosis
GNPDGGWTLVSWDGIPVGPASLPTAL

SEQ ID NO: 1483897 - protein, 31 aa, Mycobacterium tuberculosis
GNPDYGLRLSWNFLARSTAGLWEWAERLGDE

SEQ ID NO: 1483898 - protein, 23 aa, Mycobacterium tuberculosis
GNPGAITGSGGRGGDGGVGGQGG

SEQ ID NO: 1483899 - protein, 22 aa, Mycobacterium tuberculosis
GNPSRLAALYGLQLAHESQCCQ

SEQ ID NO: 1483900 - protein, 19 aa, Mycobacterium tuberculosis
GNPTMASKSAWVTDPGRQT

SEQ ID NO: 1483901 - protein, 24 aa, Mycobacterium tuberculosis
GNPVCAAAALAVLRVLASDGLVRR

SEQ ID NO: 1483902 - protein, 26 aa, Mycobacterium tuberculosis
GNRFVSRQCRLFACLAQIWEGDANGA

SEQ ID NO: 1483903 - protein, 22 aa, Mycobacterium tuberculosis
GNRGKLGVGETGGHGGFGSAAG

SEQ ID NO: 1483904 - protein, 27 aa, Mycobacterium tuberculosis
GNSGNFGVDGEAGFSGGAGGNGGVGGA

SEQ ID NO: 1483905 - protein, 20 aa, Mycobacterium tuberculosis
GNSITLFLSVARLRVSSDPK

SEQ ID NO: 1483906 - protein, 25 aa, Mycobacterium tuberculosis
GNSLFITVNCWGRLVTGVGAALGKG

SEQ ID NO: 1483907 - protein, 40 aa, Mycobacterium tuberculosis
GNSLITSWRALGWIGSRGRRSCRAARRPSARVCGTGPVSA

SEQ ID NO: 1483908 - protein, 25 aa, Mycobacterium tuberculosis
GNTAGRRADAIAGTGGDGGNGGNGG

SEQ ID NO: 1483909 - protein, 25 aa, Mycobacterium tuberculosis
GNTVDWEFAASVGERLARPAPPSTE

SEQ ID NO: 1483910 - protein, 18 aa, Mycobacterium tuberculosis
GNVEAFLRLVEAGWDAEV

SEQ ID NO: 1483911 - protein, 21 aa, Mycobacterium tuberculosis
GNVGEVTWARPTSARTTWASE

SEQ ID NO: 1483912 - protein, 25 aa, Mycobacterium tuberculosis
GNWASIVPHTWLWAMPMSGPTGGEI

SEQ ID NO: 1483913 - protein, 20 aa, Mycobacterium tuberculosis
GNYGSLNWGSGNTGTGNAGS

SEQ ID NO: 1483914 - protein, 19 aa, Mycobacterium tuberculosis
GNYLPRFGPYLSSASNPWG

SEQ ID NO: 1483915 - protein, 39 aa, Mycobacterium tuberculosis
GNYSNGAFWRGDYQGLLDFSFPVGPLIPQTHLVHLRETV

SEQ ID NO: 1483916 - protein, 33 aa, Mycobacterium tuberculosis
GNYSNGAFWRGDYQGLLGFSYRPAVLPQTPFLD

SEQ ID NO: 1483917 - protein, 20 aa, Mycobacterium tuberculosis
GNYSNGAFWTGDYQGLLDFS

SEQ ID NO: 1483918 - protein, 19 aa, Mycobacterium tuberculosis
GNYSNGAFWTGDYQGLLGF

SEQ ID NO: 1483919 - protein, 30 aa, Mycobacterium tuberculosis
GNYSNGVLWRGDYQGLLGFSSGANVLPVIP

SEQ ID NO: 1483920 - protein, 30 aa, Mycobacterium tuberculosis
GNYSNGVLWRGDYQGLLGFSYTSTIIPEFT

SEQ ID NO: 1483921 - protein, 19 aa, Mycobacterium tuberculosis
GNYSVGFANSGNYHIGIAN

SEQ ID NO: 1483922 - protein, 19 aa, Mycobacterium tuberculosis
GPAAAMVRRASAGEWSSQI

SEQ ID NO: 1483923 - protein, 26 aa, Mycobacterium tuberculosis
GPAAPSAPVSPGWAGPAGPAGPADCS

SEQ ID NO: 1483924 - protein, 27 aa, Mycobacterium tuberculosis
GPAAWDGSMPVGRCACTPGSAPSGGTC

SEQ ID NO: 1483925 - protein, 17 aa, Mycobacterium tuberculosis
GPADKAGCCTATAARAA

SEQ ID NO: 1483926 - protein, 18 aa, Mycobacterium tuberculosis
GPADWALLGAALLGVGGS

SEQ ID NO: 1483927 - protein, 23 aa, Mycobacterium tuberculosis
GPAELLSAVGALAEATRDGVVAG

SEQ ID NO: 1483928 - protein, 20 aa, Mycobacterium tuberculosis
GPAGCPAQQALPAGPADSTI

SEQ ID NO: 1483929 - protein, 20 aa, Mycobacterium tuberculosis
GPAGLALPPGPARPGGGGGA

SEQ ID NO: 1483930 - protein, 17 aa, Mycobacterium tuberculosis
GPAGLFLARYPDQYGKR

SEQ ID NO: 1483931 - protein, 18 aa, Mycobacterium tuberculosis
GPAGPVLVEASRDAEMIC

SEQ ID NO: 1483932 - protein, 18 aa, Mycobacterium tuberculosis
GPAGRFASIYDRVHAWAS

SEQ ID NO: 1483933 - protein, 20 aa, Mycobacterium tuberculosis
GPALDAVYLPPGRSAYVAAR

SEQ ID NO: 1483934 - protein, 18 aa, Mycobacterium tuberculosis
GPALGVLGAHPLRPAGAD

SEQ ID NO: 1483935 - protein, 20 aa, Mycobacterium tuberculosis
GPAMGMGGVRGLDAAGSGEG

SEQ ID NO: 1483936 - protein, 18 aa, Mycobacterium tuberculosis
GPARRAARIASHRVHPGL

SEQ ID NO: 1483937 - protein, 19 aa, Mycobacterium tuberculosis
GPARTGSVLAELGVDPNRP

SEQ ID NO: 1483938 - protein, 21 aa, Mycobacterium tuberculosis
GPARTGSVLAELGVDPNRPMA

SEQ ID NO: 1483939 - protein, 22 aa, Mycobacterium tuberculosis
GPAVAAGCSRCWPPAVPAAPAG

SEQ ID NO: 1483940 - protein, 19 aa, Mycobacterium tuberculosis
GPCGKSIEIDGRCRGFRIA

SEQ ID NO: 1483941 - protein, 23 aa, Mycobacterium tuberculosis
GPDAPGAGSLFWVSDTGVRYGID

SEQ ID NO: 1483942 - protein, 28 aa, Mycobacterium tuberculosis
GPDELKARFSRPLAFGTAGLRGHLRGGP

SEQ ID NO: 1483943 - protein, 17 aa, Mycobacterium tuberculosis
GPDGGWNKPPTPLWPDQ

SEQ ID NO: 1483944 - protein, 20 aa, Mycobacterium tuberculosis
GPDLVLRWAALLHDIGKPAT

SEQ ID NO: 1483945 - protein, 17 aa, Mycobacterium tuberculosis
GPDRIAAMLSEVVGLLA

SEQ ID NO: 1483946 - protein, 19 aa, Mycobacterium tuberculosis
GPEAKLFRRGVTNSPAVTE

SEQ ID NO: 1483947 - protein, 22 aa, Mycobacterium tuberculosis
GPEARYRRWLAALRGSARLSDW

SEQ ID NO: 1483948 - protein, 22 aa, Mycobacterium tuberculosis
GPEARYRRWLAALRGSARLVIG

SEQ ID NO: 1483949 - protein, 19 aa, Mycobacterium tuberculosis
GPEDVLYPRGSRMEASYPV

SEQ ID NO: 1483950 - protein, 22 aa, Mycobacterium tuberculosis
GPEGLPSVFVYDGYPGGAGFAE

SEQ ID NO: 1483951 - protein, 19 aa, Mycobacterium tuberculosis
GPERLWDFLTEKKCAITAY

SEQ ID NO: 1483952 - protein, 17 aa, Mycobacterium tuberculosis
GPESMLAAAAAWDGVAA

SEQ ID NO: 1483953 - protein, 24 aa, Mycobacterium tuberculosis
GPETYLSCCVCKARGDRRHGRRHL

SEQ ID NO: 1483954 - protein, 26 aa, Mycobacterium tuberculosis
GPFDNWPLGWGFDHFWGFPSGAAGQY

SEQ ID NO: 1483955 - protein, 22 aa, Mycobacterium tuberculosis
GPFQALFGRPLIGDGANGAPGQ

SEQ ID NO: 1483956 - protein, 19 aa, Mycobacterium tuberculosis
GPFRGFRRIVVHRLVGRNR

SEQ ID NO: 1483957 - protein, 19 aa, Mycobacterium tuberculosis
GPFRGWSAADLEHVTPEQA

SEQ ID NO: 1483958 - protein, 17 aa, Mycobacterium tuberculosis
GPFVSWAQLCAQAGTGS

SEQ ID NO: 1483959 - protein, 19 aa, Mycobacterium tuberculosis
GPGAAFGGNGNTGGNGGNG

SEQ ID NO: 1483960 - protein, 22 aa, Mycobacterium tuberculosis
GPGAIRRLCCGADVVADTAVSA

SEQ ID NO: 1483961 - protein, 23 aa, Mycobacterium tuberculosis
GPGAIRRLCCGADVVADTAVSAA

SEQ ID NO: 1483962 - protein, 19 aa, Mycobacterium tuberculosis
GPGAPRPRRLPPLPPQPPR

SEQ ID NO: 1483963 - protein, 21 aa, Mycobacterium tuberculosis
GPGCTPTVLPVWRRSPWIAPM

SEQ ID NO: 1483964 - protein, 25 aa, Mycobacterium tuberculosis
GPGDGCGGRHRCDGPLGSHAADIYA

SEQ ID NO: 1483965 - protein, 19 aa, Mycobacterium tuberculosis
GPGEGPVAYGHLQVRIEEL

SEQ ID NO: 1483966 - protein, 22 aa, Mycobacterium tuberculosis
GPGGAAVGLFGHGGAGGAGGLG

SEQ ID NO: 1483967 - protein, 17 aa, Mycobacterium tuberculosis
GPGGLLYGNGGHGGAGA

SEQ ID NO: 1483968 - protein, 19 aa, Mycobacterium tuberculosis
GPGGNPFWHPLAPGGPGGV

SEQ ID NO: 1483969 - protein, 17 aa, Mycobacterium tuberculosis
GPGGRWTVRARKVGPGF

SEQ ID NO: 1483970 - protein, 18 aa, Mycobacterium tuberculosis
GPGGVGVPDGIGGANGAQ

SEQ ID NO: 1483971 - protein, 17 aa, Mycobacterium tuberculosis
GPGPARHAARLPADLAA

SEQ ID NO: 1483972 - protein, 25 aa, Mycobacterium tuberculosis
GPGPMLAAASAWTGLAGDLHSAAAS

SEQ ID NO: 1483973 - protein, 21 aa, Mycobacterium tuberculosis
GPGQPGTEFGQTGGTGGTGGT

SEQ ID NO: 1483974 - protein, 22 aa, Mycobacterium tuberculosis
GPGQPGTEFGQTGGTGGTGGTG

SEQ ID NO: 1483975 - protein, 23 aa, Mycobacterium tuberculosis
GPGRPRWATSATKLIPPRRFTGR

SEQ ID NO: 1483976 - protein, 18 aa, Mycobacterium tuberculosis
GPGRWRVFLGPGIPGGGA

SEQ ID NO: 1483977 - protein, 20 aa, Mycobacterium tuberculosis
GPGTGKCQQVWCPLCALAAL

SEQ ID NO: 1483978 - protein, 17 aa, Mycobacterium tuberculosis
GPHQLVLGLGGRDRRRV

SEQ ID NO: 1483979 - protein, 19 aa, Mycobacterium tuberculosis
GPIALARLIPAGVDVRGNA

SEQ ID NO: 1483980 - protein, 17 aa, Mycobacterium tuberculosis
GPIGFAGTVRKEAVVKA

SEQ ID NO: 1483981 - protein, 19 aa, Mycobacterium tuberculosis
GPILDLGHAFPLPRHQGIP

SEQ ID NO: 1483982 - protein, 24 aa, Mycobacterium tuberculosis
GPIVIGSFFLPAFNIPGIDVPAIN

SEQ ID NO: 1483983 - protein, 24 aa, Mycobacterium tuberculosis
GPLAHPGLVCDVAIGQSTVATQRV

SEQ ID NO: 1483984 - protein, 19 aa, Mycobacterium tuberculosis
GPLGYSYNTGCHLPAAWRT

SEQ ID NO: 1483985 - protein, 20 aa, Mycobacterium tuberculosis
GPLRAAVRRPLRHSPLPAGR

SEQ ID NO: 1483986 - protein, 23 aa, Mycobacterium tuberculosis
GPLRRLSEGIALLITTGFLPQRF

SEQ ID NO: 1483987 - protein, 24 aa, Mycobacterium tuberculosis
GPMAARLGLAGWPRAAEESIVARD

SEQ ID NO: 1483988 - protein, 25 aa, Mycobacterium tuberculosis
GPMAARLGLAGWPRAAEESIVARDA

SEQ ID NO: 1483989 - protein, 21 aa, Mycobacterium tuberculosis
GPMGMMPMPMGMGGAGAGMPA

SEQ ID NO: 1483990 - protein, 31 aa, Mycobacterium tuberculosis
GPMGMMPMPMGMPAGMMGRGGANPHVVQARP

SEQ ID NO: 1483991 - protein, 21 aa, Mycobacterium tuberculosis
GPMGRRPAVRGGRAHPTALAA

SEQ ID NO: 1483992 - protein, 18 aa, Mycobacterium tuberculosis
GPMTPKRAIEVIADACQA

SEQ ID NO: 1483993 - protein, 19 aa, Mycobacterium tuberculosis
GPNGRPRYVTAIDADTATV

SEQ ID NO: 1483994 - protein, 20 aa, Mycobacterium tuberculosis
GPNGRPRYVTAIDADTATVH

SEQ ID NO: 1483995 - protein, 25 aa, Mycobacterium tuberculosis
GPPAHAVAVAAGWRNDDGGEFLDNY

SEQ ID NO: 1483996 - protein, 24 aa, Mycobacterium tuberculosis
GPPGELLLYVFGRRAVARVEVSGP

SEQ ID NO: 1483997 - protein, 23 aa, Mycobacterium tuberculosis
GPPGELLLYVFGRRVNRPGMSGD

SEQ ID NO: 1483998 - protein, 17 aa, Mycobacterium tuberculosis
GPPGVKGDGGNGGNGGH

SEQ ID NO: 1483999 - protein, 26 aa, Mycobacterium tuberculosis
GPPRRWPPDSRRFRLFAAAQAGIFTG

SEQ ID NO: 1484000 - protein, 20 aa, Mycobacterium tuberculosis
GPPTMAARCARNLAEGLLLT

SEQ ID NO: 1484001 - protein, 18 aa, Mycobacterium tuberculosis
GPPVTRRAVLTLYPHCAP

SEQ ID NO: 1484002 - protein, 18 aa, Mycobacterium tuberculosis
GPQLPAPFINPGGTGGSG

SEQ ID NO: 1484003 - protein, 18 aa, Mycobacterium tuberculosis
GPQPSGCCGCWPTQDPAR

SEQ ID NO: 1484004 - protein, 19 aa, Mycobacterium tuberculosis
GPRDKNRFIGVPAAFSKLF

SEQ ID NO: 1484005 - protein, 29 aa, Mycobacterium tuberculosis
GPRPFVRLEGPAVFRWVGFKMGDVGRRAM

SEQ ID NO: 1484006 - protein, 19 aa, Mycobacterium tuberculosis
GPRPPRPVAAHGRKEAPRE

SEQ ID NO: 1484007 - protein, 21 aa, Mycobacterium tuberculosis
GPRVRTAVLTKLYPTRSHTGA

SEQ ID NO: 1484008 - protein, 22 aa, Mycobacterium tuberculosis
GPSGKRPGAIAERVKKTWELGE

SEQ ID NO: 1484009 - protein, 19 aa, Mycobacterium tuberculosis
GPSMGILPAGGVGGPGGSG

SEQ ID NO: 1484010 - protein, 21 aa, Mycobacterium tuberculosis
GPSRARYLMLRLLERAGEQRV

SEQ ID NO: 1484011 - protein, 19 aa, Mycobacterium tuberculosis
GPSRLPLSMIMRRPEMPRL

SEQ ID NO: 1484012 - protein, 20 aa, Mycobacterium tuberculosis
GPSSGFLNWGARSASGLLNF

SEQ ID NO: 1484013 - protein, 20 aa, Mycobacterium tuberculosis
GPTGARRCEPAEPAAAAAGE

SEQ ID NO: 1484014 - protein, 17 aa, Mycobacterium tuberculosis
GPTVPILLDTGSSSLVI

SEQ ID NO: 1484015 - protein, 17 aa, Mycobacterium tuberculosis
GPVDPGGAWAGNGGTGG

SEQ ID NO: 1484016 - protein, 17 aa, Mycobacterium tuberculosis
GPVGLILTRQGVPVLDG

SEQ ID NO: 1484017 - protein, 26 aa, Mycobacterium tuberculosis
GPVRLARSAPRRRWRLVNTPIAPASR

SEQ ID NO: 1484018 - protein, 18 aa, Mycobacterium tuberculosis
GPVTSEFSGKVHFVEQDR

SEQ ID NO: 1484019 - protein, 23 aa, Mycobacterium tuberculosis
GPWRLDPLPLVISAADWEVLEAG

SEQ ID NO: 1484020 - protein, 23 aa, Mycobacterium tuberculosis
GPYDYLLHIRVCDTADLDRLLRR

SEQ ID NO: 1484021 - protein, 22 aa, Mycobacterium tuberculosis
GQAALSQNFIGAGGTAGAGGTG

SEQ ID NO: 1484022 - protein, 21 aa, Mycobacterium tuberculosis
GQAFPCIPNGGSVFAANPVVH

SEQ ID NO: 1484023 - protein, 23 aa, Mycobacterium tuberculosis
GQAGGAGGILWGNGGNGGSGAPG

SEQ ID NO: 1484024 - protein, 17 aa, Mycobacterium tuberculosis
GQAGGPGGLLYGNGGNG

SEQ ID NO: 1484025 - protein, 31 aa, Mycobacterium tuberculosis
GQAGGTGWIRIAHHRARAAAGAGQRGEHPLP

SEQ ID NO: 1484026 - protein, 20 aa, Mycobacterium tuberculosis
GQAGNIARLSWLAAGYPEEV

SEQ ID NO: 1484027 - protein, 23 aa, Mycobacterium tuberculosis
GQAGNIARLSWLAAGYPEEVPGV

SEQ ID NO: 1484028 - protein, 20 aa, Mycobacterium tuberculosis
GQAKLANLLFTYELQRRLGE

SEQ ID NO: 1484029 - protein, 18 aa, Mycobacterium tuberculosis
GQAVFPHRAHRRAPPRRV

SEQ ID NO: 1484030 - protein, 20 aa, Mycobacterium tuberculosis
GQCDRRVIAVIGDGALTGGV

SEQ ID NO: 1484031 - protein, 21 aa, Mycobacterium tuberculosis
GQCDRRVIAVIGDGALTGGVA

SEQ ID NO: 1484032 - protein, 19 aa, Mycobacterium tuberculosis
GQCRGRQPGVGQHRPWQPG

SEQ ID NO: 1484033 - protein, 19 aa, Mycobacterium tuberculosis
GQDAEAMYGYAATAATATE

SEQ ID NO: 1484034 - protein, 24 aa, Mycobacterium tuberculosis
GQDGHWRLGPAITELATHVDDPLL

SEQ ID NO: 1484035 - protein, 23 aa, Mycobacterium tuberculosis
GQDPHRRRLWGARARGDRAQGSP

SEQ ID NO: 1484036 - protein, 26 aa, Mycobacterium tuberculosis
GQEVWTSQMIVAPAFVDAAAKDLATI

SEQ ID NO: 1484037 - protein, 17 aa, Mycobacterium tuberculosis
GQFGAARTDTGWPGRSV

SEQ ID NO: 1484038 - protein, 18 aa, Mycobacterium tuberculosis
GQGFAIPIGQAMAIAGQI

SEQ ID NO: 1484039 - protein, 17 aa, Mycobacterium tuberculosis
GQGFLALVDYAHKPESA

SEQ ID NO: 1484040 - protein, 21 aa, Mycobacterium tuberculosis
GQGGAGRGLWGTGGAGGHGGQ

SEQ ID NO: 1484041 - protein, 23 aa, Mycobacterium tuberculosis
GQGGEPRLTLPDAITGNPGDPRY

SEQ ID NO: 1484042 - protein, 25 aa, Mycobacterium tuberculosis
GQGGGGGFSILLGLGGLGGLGSPGS

SEQ ID NO: 1484043 - protein, 24 aa, Mycobacterium tuberculosis
GQGGRFLCTFPFSFEITEGEDRYV

SEQ ID NO: 1484044 - protein, 19 aa, Mycobacterium tuberculosis
GQGPDVWLAALATLPLVHQ

SEQ ID NO: 1484045 - protein, 20 aa, Mycobacterium tuberculosis
GQGPDVWLAALATLPLVHQP

SEQ ID NO: 1484046 - protein, 25 aa, Mycobacterium tuberculosis
GQGSQWLGMGIELLDTAPAFAQQID

SEQ ID NO: 1484047 - protein, 24 aa, Mycobacterium tuberculosis
GQHGDENFLLVGMDSRAGANANIG

SEQ ID NO: 1484048 - protein, 20 aa, Mycobacterium tuberculosis
GQIAIDLSVTTPFIPINEQM

SEQ ID NO: 1484049 - protein, 17 aa, Mycobacterium tuberculosis
GQINLGFGNTGSGNIGN

SEQ ID NO: 1484050 - protein, 25 aa, Mycobacterium tuberculosis
GQLAAPRASHEWARGKRDQLIGRAG

SEQ ID NO: 1484051 - protein, 17 aa, Mycobacterium tuberculosis
GQLLAGGGVVDVEQRRI

SEQ ID NO: 1484052 - protein, 24 aa, Mycobacterium tuberculosis
GQLPKLRLGKVLQISGPADLLQHF

SEQ ID NO: 1484053 - protein, 24 aa, Mycobacterium tuberculosis
GQLQRGQHQYGWLQPGPNVNTGWL

SEQ ID NO: 1484054 - protein, 25 aa, Mycobacterium tuberculosis
GQLSARLVLIIAWRTYLVRDPEALS

SEQ ID NO: 1484055 - protein, 20 aa, Mycobacterium tuberculosis
GQLTRSGLLPGDRVALRMGS

SEQ ID NO: 1484056 - protein, 18 aa, Mycobacterium tuberculosis
GQLVKWARESIGRTEKID

SEQ ID NO: 1484057 - protein, 19 aa, Mycobacterium tuberculosis
GQNGGLLFGNGGNGFTQTT

SEQ ID NO: 1484058 - protein, 19 aa, Mycobacterium tuberculosis
GQPAADALHAWLVDGRRAL

SEQ ID NO: 1484059 - protein, 17 aa, Mycobacterium tuberculosis
GQPGGAGGLLFGNGGNG

SEQ ID NO: 1484060 - protein, 23 aa, Mycobacterium tuberculosis
GQPSKFSMPGPWVGIAAPGENIA

SEQ ID NO: 1484061 - protein, 18 aa, Mycobacterium tuberculosis
GQPVKGRLTVPPSVPVKS

SEQ ID NO: 1484062 - protein, 25 aa, Mycobacterium tuberculosis
GQPWVVSFQLNWPRDHGPTVTGWML

SEQ ID NO: 1484063 - protein, 24 aa, Mycobacterium tuberculosis
GQQEELWLLRGGDPGQPGLLPPAV

SEQ ID NO: 1484064 - protein, 27 aa, Mycobacterium tuberculosis
GQQVGPRVARRFGRVLLKLGGNNAAIV

SEQ ID NO: 1484065 - protein, 17 aa, Mycobacterium tuberculosis
GQRALRFVTDPDSGRTM

SEQ ID NO: 1484066 - protein, 17 aa, Mycobacterium tuberculosis
GQRHRPRGPAPGRRHHR

SEQ ID NO: 1484067 - protein, 26 aa, Mycobacterium tuberculosis
GQRLLQRCPVCLYAGSIMPDDLLAQC

SEQ ID NO: 1484068 - protein, 21 aa, Mycobacterium tuberculosis
GQRLLYPIHERRWRGKWHGQC

SEQ ID NO: 1484069 - protein, 19 aa, Mycobacterium tuberculosis
GQRQRHWRRAPAANGGNGG

SEQ ID NO: 1484070 - protein, 24 aa, Mycobacterium tuberculosis
GQRRASPVAVEWGCGCGVAGSAAS

SEQ ID NO: 1484071 - protein, 17 aa, Mycobacterium tuberculosis
GQRRHRRVHVGQLQQRP

SEQ ID NO: 1484072 - protein, 23 aa, Mycobacterium tuberculosis
GQRRIARANAIFKDRVGFSSRPS

SEQ ID NO: 1484073 - protein, 21 aa, Mycobacterium tuberculosis
GQRTAQRRCCAAVHGGRVVWA

SEQ ID NO: 1484074 - protein, 25 aa, Mycobacterium tuberculosis
GQSGGPLDCHLMKLEDLRPPERAQV

SEQ ID NO: 1484075 - protein, 22 aa, Mycobacterium tuberculosis
GQTDVSGGLGGAGGNGGAGGGG

SEQ ID NO: 1484076 - protein, 20 aa, Mycobacterium tuberculosis
GQTLRPAPVGAYPAGASACG

SEQ ID NO: 1484077 - protein, 18 aa, Mycobacterium tuberculosis
GQVLIDWHCRAVPHVRLE

SEQ ID NO: 1484078 - protein, 29 aa, Mycobacterium tuberculosis
GQVLKEIRSRLGFLLDVGLEYLSLSRAAA

SEQ ID NO: 1484079 - protein, 17 aa, Mycobacterium tuberculosis
GQVLVFWDCYRPHDVQV

SEQ ID NO: 1484080 - protein, 17 aa, Mycobacterium tuberculosis
GQVLVLGGGESRDLDLP

SEQ ID NO: 1484081 - protein, 34 aa, Mycobacterium tuberculosis
GQVSKPVIGTVMRQGYQLGEQVLRHALVGVVDTV

SEQ ID NO: 1484082 - protein, 18 aa, Mycobacterium tuberculosis
GQVTSGLTAGVWQGAAAA

SEQ ID NO: 1484083 - protein, 22 aa, Mycobacterium tuberculosis
GQVTSGLTAGVWQGAAAASMAS

SEQ ID NO: 1484084 - protein, 19 aa, Mycobacterium tuberculosis
GQWAGPAGVGQAGGAGGSA

SEQ ID NO: 1484085 - protein, 21 aa, Mycobacterium tuberculosis
GQWWQRRAHWRYRLLCERRQW

SEQ ID NO: 1484086 - protein, 19 aa, Mycobacterium tuberculosis
GRAAHLTRIIGGVAGGRRI

SEQ ID NO: 1484087 - protein, 22 aa, Mycobacterium tuberculosis
GRAALQKAVPLWRGVQAEVTAS

SEQ ID NO: 1484088 - protein, 17 aa, Mycobacterium tuberculosis
GRAAPGLGLVRVAAELG

SEQ ID NO: 1484089 - protein, 28 aa, Mycobacterium tuberculosis
GRADLVLPMWQRLEPVWGPARDVRDNQP

SEQ ID NO: 1484090 - protein, 19 aa, Mycobacterium tuberculosis
GRADTYFDFGGVHAAFADA

SEQ ID NO: 1484091 - protein, 23 aa, Mycobacterium tuberculosis
GRAEALGLARLGATVVVNDVASA

SEQ ID NO: 1484092 - protein, 20 aa, Mycobacterium tuberculosis
GRAGGLMSALTPQFGSKTIN

SEQ ID NO: 1484093 - protein, 18 aa, Mycobacterium tuberculosis
GRAGGQLTGRRRHRPLGL

SEQ ID NO: 1484094 - protein, 21 aa, Mycobacterium tuberculosis
GRAGRRAAPGLQGRRHRSAHR

SEQ ID NO: 1484095 - protein, 28 aa, Mycobacterium tuberculosis
GRAGTAGGDRRGPVGGIGGAGGVGGAGG

SEQ ID NO: 1484096 - protein, 17 aa, Mycobacterium tuberculosis
GRAGWLVGPPVSTAAAG

SEQ ID NO: 1484097 - protein, 21 aa, Mycobacterium tuberculosis
GRAIPFGAFRHLISLPASGAD

SEQ ID NO: 1484098 - protein, 22 aa, Mycobacterium tuberculosis
GRAIPFGAFRHLISLPASGADI

SEQ ID NO: 1484099 - protein, 17 aa, Mycobacterium tuberculosis
GRALAGTAVRSGAGAAR

SEQ ID NO: 1484100 - protein, 19 aa, Mycobacterium tuberculosis
GRANWWPSELGRDPSTPPT

SEQ ID NO: 1484101 - protein, 19 aa, Mycobacterium tuberculosis
GRARDGRLVHFTAGQPRVR

SEQ ID NO: 1484102 - protein, 19 aa, Mycobacterium tuberculosis
GRATAAGARRARAGRPARR

SEQ ID NO: 1484103 - protein, 17 aa, Mycobacterium tuberculosis
GRATSGVQGMRFNIDDR

SEQ ID NO: 1484104 - protein, 18 aa, Mycobacterium tuberculosis
GRATSGVQGMRFNIDDRL

SEQ ID NO: 1484105 - protein, 31 aa, Mycobacterium tuberculosis
GRAYSPRFLWMWPNARISVMGGEQAASVLAT

SEQ ID NO: 1484106 - protein, 18 aa, Mycobacterium tuberculosis
GRCCGRCSPRTPGVPRPG

SEQ ID NO: 1484107 - protein, 19 aa, Mycobacterium tuberculosis
GRCIAFVLIFACRCALRWA

SEQ ID NO: 1484108 - protein, 18 aa, Mycobacterium tuberculosis
GRCKHSGSVAHVVYAQLF

SEQ ID NO: 1484109 - protein, 17 aa, Mycobacterium tuberculosis
GRCRRIFATRRVGHAGT

SEQ ID NO: 1484110 - protein, 24 aa, Mycobacterium tuberculosis
GRCVPGARGTFFARCEQALRAAGR

SEQ ID NO: 1484111 - protein, 19 aa, Mycobacterium tuberculosis
GRDDVCYVSMPLFHSNAVL

SEQ ID NO: 1484112 - protein, 20 aa, Mycobacterium tuberculosis
GREICGMPSSGGVAVAATLG

SEQ ID NO: 1484113 - protein, 17 aa, Mycobacterium tuberculosis
GRFALKIGDGRARCTPT

SEQ ID NO: 1484114 - protein, 19 aa, Mycobacterium tuberculosis
GRFAMYTKMHHALIDGVSA

SEQ ID NO: 1484115 - protein, 17 aa, Mycobacterium tuberculosis
GRFDAIVPDEVIAQLPY

SEQ ID NO: 1484116 - protein, 17 aa, Mycobacterium tuberculosis
GRFELGLGAGHRRSEYD

SEQ ID NO: 1484117 - protein, 18 aa, Mycobacterium tuberculosis
GRFGFECVQAVLAADGRE

SEQ ID NO: 1484118 - protein, 21 aa, Mycobacterium tuberculosis
GRFLRHRAGVAAGCDGGTGGR

SEQ ID NO: 1484119 - protein, 31 aa, Mycobacterium tuberculosis
GRFSFNVKGGRCEACTGDGTIKIEMNFLPDV

SEQ ID NO: 1484120 - protein, 18 aa, Mycobacterium tuberculosis
GRGAGGLTSGGVGSSGES

SEQ ID NO: 1484121 - protein, 19 aa, Mycobacterium tuberculosis
GRGAGGLTSGGVGSSGESG

SEQ ID NO: 1484122 - protein, 19 aa, Mycobacterium tuberculosis
GRGANVFFMLGGQRLDLSS

SEQ ID NO: 1484123 - protein, 21 aa, Mycobacterium tuberculosis
GRGAVRPGRTVQGRVRANTAG

SEQ ID NO: 1484124 - protein, 18 aa, Mycobacterium tuberculosis
GRGGHRGRLTPGGSHGGI

SEQ ID NO: 1484125 - protein, 21 aa, Mycobacterium tuberculosis
GRGGLRRRCRRDRGVDSTAAR

SEQ ID NO: 1484126 - protein, 23 aa, Mycobacterium tuberculosis
GRGGRGRPAARLPARGPGRRCRV

SEQ ID NO: 1484127 - protein, 30 aa, Mycobacterium tuberculosis; identical to SEQ ID NO: 1381745

SEQ ID NO: 1484128 - protein, 27 aa, Mycobacterium tuberculosis
GRGLGRGVACCHWAGAGGYLGQGGGTE

SEQ ID NO: 1484129 - protein, 21 aa, Mycobacterium tuberculosis
GRGPAGFGGDRGWAGRQWPVM

SEQ ID NO: 1484130 - protein, 26 aa, Mycobacterium tuberculosis
GRGPCYRCLHPAPPPPGLVPSCAEGG

SEQ ID NO: 1484131 - protein, 22 aa, Mycobacterium tuberculosis
GRGQQAGWCLRRARGRRDRRRA

SEQ ID NO: 1484132 - protein, 17 aa, Mycobacterium tuberculosis
GRGTDVWADLHPTADQQ

SEQ ID NO: 1484133 - protein, 22 aa, Mycobacterium tuberculosis
GRGVAWCTGFGGWHRCLLDNGV

SEQ ID NO: 1484134 - protein, 22 aa, Mycobacterium tuberculosis
GRGVTVGRPLGLLLTRRSENAT

SEQ ID NO: 1484135 - protein, 18 aa, Mycobacterium tuberculosis
GRHDAELIAAVWGADLRI

SEQ ID NO: 1484136 - protein, 18 aa, Mycobacterium tuberculosis
GRHGRGWAATARAQIILS

SEQ ID NO: 1484137 - protein, 19 aa, Mycobacterium tuberculosis
GRHIRVGIPSARDLVEQLR

SEQ ID NO: 1484138 - protein, 20 aa, Mycobacterium tuberculosis
GRHRAKAVAVADGITYREDS

SEQ ID NO: 1484139 - protein, 19 aa, Mycobacterium tuberculosis
GRIAAQLADLVVVTDDNPR

SEQ ID NO: 1484140 - protein, 23 aa, Mycobacterium tuberculosis
GRIAGASVTLEWSVDDFAISRFA

SEQ ID NO: 1484141 - protein, 18 aa, Mycobacterium tuberculosis
GRICSVTFVEWGDHSGRC

SEQ ID NO: 1484142 - protein, 17 aa, Mycobacterium tuberculosis
GRIGVIGTRATITSHAY

SEQ ID NO: 1484143 - protein, 20 aa, Mycobacterium tuberculosis
GRIKDLVIIDGRNHYPQDLE

SEQ ID NO: 1484144 - protein, 17 aa, Mycobacterium tuberculosis
GRIKDLVVRGGENISPR

SEQ ID NO: 1484145 - protein, 21 aa, Mycobacterium tuberculosis
GRIPGPWSGAGLSAAHRALRC

SEQ ID NO: 1484146 - protein, 19 aa, Mycobacterium tuberculosis
GRITLWRDYFDVYDMFKGL

SEQ ID NO: 1484147 - protein, 21 aa, Mycobacterium tuberculosis
GRKAFARFAGYSSVMHAIAGF

SEQ ID NO: 1484148 - protein, 18 aa, Mycobacterium tuberculosis
GRKFGGGALSVYIDDRQV

SEQ ID NO: 1484149 - protein, 22 aa, Mycobacterium tuberculosis
GRKMAALCGSPSQARKHADAGV

SEQ ID NO: 1484150 - protein, 23 aa, Mycobacterium tuberculosis
GRKREEPSHLGLPPAGRQTQNPE

SEQ ID NO: 1484151 - protein, 24 aa, Mycobacterium tuberculosis
GRKREEPSHLGLPPAGRQTQNPER

SEQ ID NO: 1484152 - protein, 19 aa, Mycobacterium tuberculosis
GRLAAQVGAYHLMRTQGGR

SEQ ID NO: 1484153 - protein, 19 aa, Mycobacterium tuberculosis
GRLAARGFAAYGTAKAALA

SEQ ID NO: 1484154 - protein, 20 aa, Mycobacterium tuberculosis
GRLAPRPVFRPPVDPASRQA

SEQ ID NO: 1484155 - protein, 26 aa, Mycobacterium tuberculosis
GRLFAEGVAVDWSSVFAGLGGRRVEL

SEQ ID NO: 1484156 - protein, 30 aa, Mycobacterium tuberculosis
GRLGAWAGPPPQWWAQRFGIEPELAEALVW

SEQ ID NO: 1484157 - protein, 22 aa, Mycobacterium tuberculosis
GRLGEMCSLAGIAMKRATQALL

SEQ ID NO: 1484158 - protein, 27 aa, Mycobacterium tuberculosis
GRLGVGWPKEFGGLGFGPIEQQIFVNE

SEQ ID NO: 1484159 - protein, 17 aa, Mycobacterium tuberculosis
GRLILRFFPTPACARLT

SEQ ID NO: 1484160 - protein, 20 aa, Mycobacterium tuberculosis
GRLLPEWEPIRDLPPRDVAH

SEQ ID NO: 1484161 - protein, 19 aa, Mycobacterium tuberculosis
GRLMAGWFAHTLRPAMLAA

SEQ ID NO: 1484162 - protein, 17 aa, Mycobacterium tuberculosis
GRLPDPSPAVLFDDPVD

SEQ ID NO: 1484163 - protein, 21 aa, Mycobacterium tuberculosis
GRLPVATPVLLAMKNSIGGAG

SEQ ID NO: 1484164 - protein, 28 aa, Mycobacterium tuberculosis
GRLRGHRGANRWTRCRRGFAAGGGKGHP

SEQ ID NO: 1484165 - protein, 18 aa, Mycobacterium tuberculosis
GRLRQSSWRGLRPDKKPS

SEQ ID NO: 1484166 - protein, 20 aa, Mycobacterium tuberculosis
GRLSPSVQGWLADHSVAGVT

SEQ ID NO: 1484167 - protein, 21 aa, Mycobacterium tuberculosis
GRLTGELPPGAVRIGRANDND

SEQ ID NO: 1484168 - protein, 17 aa, Mycobacterium tuberculosis
GRLVAAYGRPVHDRHGA

SEQ ID NO: 1484169 - protein, 18 aa, Mycobacterium tuberculosis
GRLVAAYGRPVHDRHGAL

SEQ ID NO: 1484170 - protein, 24 aa, Mycobacterium tuberculosis
GRMAARQRVAPAIPAAQRNVPAGT

SEQ ID NO: 1484171 - protein, 19 aa, Mycobacterium tuberculosis
GRMGAVRFGIYQAGCNSSL

SEQ ID NO: 1484172 - protein, 20 aa, Mycobacterium tuberculosis
GRMGRRLAALRSRREAEDQG

SEQ ID NO: 1484173 - protein, 17 aa, Mycobacterium tuberculosis
GRNALALARRGHPVDVV

SEQ ID NO: 1484174 - protein, 17 aa, Mycobacterium tuberculosis
GRNQQCWCGSGHKYKKC

SEQ ID NO: 1484175 - protein, 27 aa, Mycobacterium tuberculosis
GRPADGPPAWLRFFGCNPRHHSLAFLP

SEQ ID NO: 1484176 - protein, 24 aa, Mycobacterium tuberculosis
GRPARRFRHRCIDVAAAADLSAPG

SEQ ID NO: 1484177 - protein, 21 aa, Mycobacterium tuberculosis
GRPEALGGLGGGRIEPAVARG

SEQ ID NO: 1484178 - protein, 29 aa, Mycobacterium tuberculosis
GRPGCAPGPDGVRCAASMALAPEEPANLS

SEQ ID NO: 1484179 - protein, 19 aa, Mycobacterium tuberculosis
GRPGLAGRIEIDRAAGIGD

SEQ ID NO: 1484180 - protein, 18 aa, Mycobacterium tuberculosis
GRPGLRARSSTAGSGGSG

SEQ ID NO: 1484181 - protein, 19 aa, Mycobacterium tuberculosis
GRPGVGCRTVARALQGAGS

SEQ ID NO: 1484182 - protein, 27 aa, Mycobacterium tuberculosis
GRPMILKRFVKGIFAEAVFQKRAPANR

SEQ ID NO: 1484183 - protein, 26 aa, Mycobacterium tuberculosis
GRPPVPDRRRGGCARADHGSRSRGLT

SEQ ID NO: 1484184 - protein, 25 aa, Mycobacterium tuberculosis
GRPRCARLSPRFANRHDGHSLRYSG

SEQ ID NO: 1484185 - protein, 21 aa, Mycobacterium tuberculosis
GRPRRAGRCVVVRDQRHQRTC

SEQ ID NO: 1484186 - protein, 21 aa, Mycobacterium tuberculosis
GRPRRAGVSSFGISGTNAHVI

SEQ ID NO: 1484187 - protein, 18 aa, Mycobacterium tuberculosis
GRPYLQPRPRGAARKRSR

SEQ ID NO: 1484188 - protein, 32 aa, Mycobacterium tuberculosis; identical to SEQ ID NO: 233602

SEQ ID NO: 1484189 - protein, 24 aa, Mycobacterium tuberculosis
GRQGCAVRRGRRTARIRGTTVGLR

SEQ ID NO: 1484190 - protein, 26 aa, Mycobacterium tuberculosis
GRQGLCGYPGVLLLLIPQRTAQVVVQ

SEQ ID NO: 1484191 - protein, 28 aa, Mycobacterium tuberculosis
GRQLPRGGGCAYRRPGPRVRRLPQQRNR

SEQ ID NO: 1484192 - protein, 24 aa, Mycobacterium tuberculosis
GRQQLRIGQYRVRQRRVRQCRQQQ

SEQ ID NO: 1484193 - protein, 24 aa, Mycobacterium tuberculosis
GRQRRCRRVRRGGNDRQWPRRSRR

SEQ ID NO: 1484194 - protein, 24 aa, Mycobacterium tuberculosis
GRQRRYRRGAGRGPDGYPGGRRGG

SEQ ID NO: 1484195 - protein, 31 aa, Mycobacterium tuberculosis
GRQWRPQPQFGRPWLQVVAFHVGDLRRNAQA

SEQ ID NO: 1484196 - protein, 19 aa, Mycobacterium tuberculosis
GRQYMSWISLEDEVRALQF

SEQ ID NO: 1484197 - protein, 22 aa, Mycobacterium tuberculosis
GRRARVALLYWQPAAMGGVPAG

SEQ ID NO: 1484198 - protein, 17 aa, Mycobacterium tuberculosis
GRRCGRVDRQRWGRRSW

SEQ ID NO: 1484199 - protein, 20 aa, Mycobacterium tuberculosis
GRRDRRCRHQRRSRAAPAAT

SEQ ID NO: 1484200 - protein, 18 aa, Mycobacterium tuberculosis
GRREFVGLLETFVVKRKF

SEQ ID NO: 1484201 - protein, 18 aa, Mycobacterium tuberculosis
GRRLRRRRLDAGDQAGFP

SEQ ID NO: 1484202 - protein, 18 aa, Mycobacterium tuberculosis
GRRLSGTVTPVFGGRTVS

SEQ ID NO: 1484203 - protein, 23 aa, Mycobacterium tuberculosis
GRRPRPTRELSWVRGAPADAGSF

SEQ ID NO: 1484204 - protein, 18 aa, Mycobacterium tuberculosis
GRRPSLPALQPADQGEGH

SEQ ID NO: 1484205 - protein, 18 aa, Mycobacterium tuberculosis
GRRRALLTGTVAVVGLGP

SEQ ID NO: 1484206 - protein, 24 aa, Mycobacterium tuberculosis
GRRRPRPPIPAPAMRPRRRRASAA

SEQ ID NO: 1484207 - protein, 23 aa, Mycobacterium tuberculosis
GRRSAESLYDFNLATYDEGDSFD

SEQ ID NO: 1484208 - protein, 18 aa, Mycobacterium tuberculosis
GRRSFILVPGIDVPFHSR

SEQ ID NO: 1484209 - protein, 23 aa, Mycobacterium tuberculosis
GRRVGFPRFKSGRRDPGRVRFTT

SEQ ID NO: 1484210 - protein, 34 aa, Mycobacterium tuberculosis
GRRWAAAGGVGGDGGRGGLLAGNGGTGGAGGNGG

SEQ ID NO: 1484211 - protein, 18 aa, Mycobacterium tuberculosis
GRRYAPFTINIEHLKPFH

SEQ ID NO: 1484212 - protein, 21 aa, Mycobacterium tuberculosis
GRRYLGLEVLTRARAALTSTE

SEQ ID NO: 1484213 - protein, 17 aa, Mycobacterium tuberculosis
GRSGGKRVLVRDISEYT

SEQ ID NO: 1484214 - protein, 25 aa, Mycobacterium tuberculosis
GRSPPSLRRSPEMAVRELPGAWNFR

SEQ ID NO: 1484215 - protein, 38 aa, Mycobacterium tuberculosis
GRSPRPCRPRRSGPACWAPWWPGSAWPPTVAPTTLAIL

SEQ ID NO: 1484216 - protein, 20 aa, Mycobacterium tuberculosis
GRSRVLAITVRRNGTRIDAS

SEQ ID NO: 1484217 - protein, 27 aa, Mycobacterium tuberculosis
GRSVLRPDVDLRRTVGWFTTYYPVPLA

SEQ ID NO: 1484218 - protein, 29 aa, Mycobacterium tuberculosis
GRTAAAFALACQRAGVPMQRYEHRADLPC

SEQ ID NO: 1484219 - protein, 19 aa, Mycobacterium tuberculosis
GRTARWIEIAAEWGTRDYW

SEQ ID NO: 1484220 - protein, 27 aa, Mycobacterium tuberculosis
GRTGFTRPAKLPTRIRQTPQVLPLEMG

SEQ ID NO: 1484221 - protein, 24 aa, Mycobacterium tuberculosis
GRTQRFWVGLSVYRPGGTAEPAPT

SEQ ID NO: 1484222 - protein, 17 aa, Mycobacterium tuberculosis
GRTRTRFGHVEDIPADE

SEQ ID NO: 1484223 - protein, 23 aa, Mycobacterium tuberculosis
GRTTGPWEPCLRALPVEFDSAEQ

SEQ ID NO: 1484224 - protein, 19 aa, Mycobacterium tuberculosis
GRTVDFKNTVLIFTSNLGT

SEQ ID NO: 1484225 - protein, 29 aa, Mycobacterium tuberculosis
GRTVRGQVLTGCAGHTLRAVSSGTTVPAH

SEQ ID NO: 1484226 - protein, 20 aa, Mycobacterium tuberculosis
GRVAPVERIRLVNSGTEATM

SEQ ID NO: 1484227 - protein, 22 aa, Mycobacterium tuberculosis
GRVATAATAAWVGPGETVAPPV

SEQ ID NO: 1484228 - protein, 24 aa, Mycobacterium tuberculosis
GRVDGRSGVWLPGRPARKVAAIGV

SEQ ID NO: 1484229 - protein, 26 aa, Mycobacterium tuberculosis
GRVDRRGRLLWSLPKGHIELGETAEQ

SEQ ID NO: 1484230 - protein, 17 aa, Mycobacterium tuberculosis
GRVGALLALAALIHRDR

SEQ ID NO: 1484231 - protein, 22 aa, Mycobacterium tuberculosis
GRVKTRLAAAIGDKVAADIAAA

SEQ ID NO: 1484232 - protein, 18 aa, Mycobacterium tuberculosis
GRVLRQRWQRRGRQGPER

SEQ ID NO: 1484233 - protein, 29 aa, Mycobacterium tuberculosis
GRVRSQFTHCIDIAPTVLVAIGLPEPTHV

SEQ ID NO: 1484234 - protein, 21 aa, Mycobacterium tuberculosis
GRVRTGGLLLRTRVPGNRFAD

SEQ ID NO: 1484235 - protein, 18 aa, Mycobacterium tuberculosis
GRWLLNYRPQPLAVGAEI

SEQ ID NO: 1484236 - protein, 24 aa, Mycobacterium tuberculosis
GRWSAVLVGPWWPAPSAALRAAAQ

SEQ ID NO: 1484237 - protein, 30 aa, Mycobacterium tuberculosis
GRWYPGEPLPRWQIALYWRTDGRPLWTNDA

SEQ ID NO: 1484238 - protein, 19 aa, Mycobacterium tuberculosis
GRYMLRCRVGERIRVCDWL

SEQ ID NO: 1484239 - protein, 20 aa, Mycobacterium tuberculosis
GRYRLQRLIATGGMGQVWEA

SEQ ID NO: 1484240 - protein, 20 aa, Mycobacterium tuberculosis
GSAALFAWGLNQLVFLGLRP

SEQ ID NO: 1484241 - protein, 18 aa, Mycobacterium tuberculosis
GSAALPVPVFDKLVQLTG

SEQ ID NO: 1484242 - protein, 23 aa, Mycobacterium tuberculosis
GSADLPLAFAVRPHPPGCTDVQL

SEQ ID NO: 1484243 - protein, 22 aa, Mycobacterium tuberculosis
GSADYRGGDHGVEFVKVAMQPG

SEQ ID NO: 1484244 - protein, 17 aa, Mycobacterium tuberculosis
GSAELDASVAMDTFGKW

SEQ ID NO: 1484245 - protein, 18 aa, Mycobacterium tuberculosis
GSAFGPGGTGGMGGAGGT

SEQ ID NO: 1484246 - protein, 20 aa, Mycobacterium tuberculosis
GSAGGEQWCDAEVLRILRRR

SEQ ID NO: 1484247 - protein, 20 aa, Mycobacterium tuberculosis
GSAGGGGWVGAVNFGPISVQ

SEQ ID NO: 1484248 - protein, 18 aa, Mycobacterium tuberculosis
GSAGLFYGSGGAGGNGGY

SEQ ID NO: 1484249 - protein, 23 aa, Mycobacterium tuberculosis
GSAGQGGAAILIGNGGAGGNGAT

SEQ ID NO: 1484250 - protein, 18 aa, Mycobacterium tuberculosis
GSAITRPNVGDDCPNATP

SEQ ID NO: 1484251 - protein, 18 aa, Mycobacterium tuberculosis
GSAKRITAVMPFYPYARQ

SEQ ID NO: 1484252 - protein, 23 aa, Mycobacterium tuberculosis
GSALLFPALCTPTGDPPAPEPAR

SEQ ID NO: 1484253 - protein, 21 aa, Mycobacterium tuberculosis
GSALLRTFAGAGFTNLLVRSR

SEQ ID NO: 1484254 - protein, 26 aa, Mycobacterium tuberculosis
GSAMLFGAGGAGGFSFSTAGGAGGAG

SEQ ID NO: 1484255 - protein, 19 aa, Mycobacterium tuberculosis
GSAMQAVWIVAQQHGLAVQ

SEQ ID NO: 1484256 - protein, 21 aa, Mycobacterium tuberculosis
GSAPMLAAAAAWDDLASELHC

SEQ ID NO: 1484257 - protein, 24 aa, Mycobacterium tuberculosis
GSAPMLAASVAWDGLAAELAVAAS

SEQ ID NO: 1484258 - protein, 18 aa, Mycobacterium tuberculosis
GSAPRAGTLLGQHTTVAT

SEQ ID NO: 1484259 - protein, 20 aa, Mycobacterium tuberculosis
GSARPGDTLFAISTSGNSMS

SEQ ID NO: 1484260 - protein, 23 aa, Mycobacterium tuberculosis
GSARPYRGPIEHPGVEGDHRAIG

SEQ ID NO: 1484261 - protein, 18 aa, Mycobacterium tuberculosis
GSARWTRRAGPAMSATAT

SEQ ID NO: 1484262 - protein, 20 aa, Mycobacterium tuberculosis
GSASRCWWKAPPGSARPSWP

SEQ ID NO: 1484263 - protein, 17 aa, Mycobacterium tuberculosis
GSAVSHYRSNVRDQVFN

SEQ ID NO: 1484264 - protein, 18 aa, Mycobacterium tuberculosis
GSAYLARVPQRFVPDLTK

SEQ ID NO: 1484265 - protein, 24 aa, Mycobacterium tuberculosis
GSCRARSGAGAGRGSRSYPDDTDT

SEQ ID NO: 1484266 - protein, 21 aa, Mycobacterium tuberculosis
GSCSWKIYVKDGIITWETQET

SEQ ID NO: 1484267 - protein, 21 aa, Mycobacterium tuberculosis
GSDEFSGVVVLTGSNTGTPHQ

SEQ ID NO: 1484268 - protein, 33 aa, Mycobacterium tuberculosis
GSDKPFSCLMLNAIPDLAFWGSSNGQFFPRWTY

SEQ ID NO: 1484269 - protein, 18 aa, Mycobacterium tuberculosis
GSDPDWDARVALHRARRP

SEQ ID NO: 1484270 - protein, 23 aa, Mycobacterium tuberculosis
GSDRPAWATGFGRLIDHADARIA

SEQ ID NO: 1484271 - protein, 21 aa, Mycobacterium tuberculosis
GSEADAAVHFVQRHCETGNSV

SEQ ID NO: 1484272 - protein, 19 aa, Mycobacterium tuberculosis
GSEPMSPCPPSPPSLPAPP

SEQ ID NO: 1484273 - protein, 17 aa, Mycobacterium tuberculosis
GSGAARGCRWSRWMVAG

SEQ ID NO: 1484274 - protein, 21 aa, Mycobacterium tuberculosis
GSGADPLWFTSLFSQHTLDLL

SEQ ID NO: 1484275 - protein, 24 aa, Mycobacterium tuberculosis
GSGAPRPVPPVPPMPPAPKRMPAL

SEQ ID NO: 1484276 - protein, 18 aa, Mycobacterium tuberculosis
GSGARRGGAVSGIGGHNA

SEQ ID NO: 1484277 - protein, 19 aa, Mycobacterium tuberculosis
GSGARRGGAVSGIGGHNAA

SEQ ID NO: 1484278 - protein, 25 aa, Mycobacterium tuberculosis
GSGGAGGLIGWAGAAGGTGAGGTGG

SEQ ID NO: 1484279 - protein, 22 aa, Mycobacterium tuberculosis
GSGGAGGMLYGAGGVGGNGGAA

SEQ ID NO: 1484280 - protein, 23 aa, Mycobacterium tuberculosis
GSGGARRSRCGRRVRRTRRAAVR

SEQ ID NO: 1484281 - protein, 17 aa, Mycobacterium tuberculosis
GSGGAWAGNGGTGGAGG

SEQ ID NO: 1484282 - protein, 24 aa, Mycobacterium tuberculosis
GSGGDGGNGGWLFGSGASGGNGGQ

SEQ ID NO: 1484283 - protein, 23 aa, Mycobacterium tuberculosis
GSGGFGAPPPRSIGGGDGGDGGR

SEQ ID NO: 1484284 - protein, 19 aa, Mycobacterium tuberculosis
GSGGFGLDTGGAGGRGGDA

SEQ ID NO: 1484285 - protein, 25 aa, Mycobacterium tuberculosis
GSGGGGGTGGFGFAAGGQGGVGGSA

SEQ ID NO: 1484286 - protein, 26 aa, Mycobacterium tuberculosis
GSGGGGGTGGFGFAAGGQGGVGGSAG

SEQ ID NO: 1484287 - protein, 34 aa, Mycobacterium tuberculosis
GSGGIRGPLGLGFRVPCIVISPYSRGPLMVSDTF

SEQ ID NO: 1484288 - protein, 35 aa, Mycobacterium tuberculosis
GSGGIRGPLGLGFRVPCIVISPYSRGPLMVSDTFD

SEQ ID NO: 1484289 - protein, 27 aa, Mycobacterium tuberculosis
GSGGLGSAFGPGGTGGMGGAGGTSTVS

SEQ ID NO: 1484290 - protein, 21 aa, Mycobacterium tuberculosis
GSGGLLCGTGAAGVAGGNGGP

SEQ ID NO: 1484291 - protein, 19 aa, Mycobacterium tuberculosis
GSGGLLFGSGGAGGIGGAG

SEQ ID NO: 1484292 - protein, 19 aa, Mycobacterium tuberculosis
GSGGLLWGNGGAGGAGGNG

SEQ ID NO: 1484293 - protein, 25 aa, Mycobacterium tuberculosis
GSGGLPLDRAAVIIADLAQSTPTGI

SEQ ID NO: 1484294 - protein, 18 aa, Mycobacterium tuberculosis
GSGGNGFDSFASGGTGRS

SEQ ID NO: 1484295 - protein, 20 aa, Mycobacterium tuberculosis
GSGGNGGVWYGNGGAGGAAG

SEQ ID NO: 1484296 - protein, 17 aa, Mycobacterium tuberculosis
GSGGRGGLLVGDAAQVA

SEQ ID NO: 1484297 - protein, 17 aa, Mycobacterium tuberculosis
GSGHSFTDIACTDGVMI

SEQ ID NO: 1484298 - protein, 19 aa, Mycobacterium tuberculosis
GSGNVGWANMGLGNIGFGN

SEQ ID NO: 1484299 - protein, 24 aa, Mycobacterium tuberculosis
GSGPLRPAAAQVFAAVHAAAIPVV

SEQ ID NO: 1484300 - protein, 19 aa, Mycobacterium tuberculosis
GSGPVGLILTRQGVPVLDG

SEQ ID NO: 1484301 - protein, 22 aa, Mycobacterium tuberculosis
GSGRGPAPIKVIADKGTPFADL

SEQ ID NO: 1484302 - protein, 27 aa, Mycobacterium tuberculosis
GSGSGWRWAGRSCAGPGCSAWTSRCRI

SEQ ID NO: 1484303 - protein, 57 aa, Mycobacterium tuberculosis
GSGSTFRCDRLRQQLFTFICGNAGYGRQRRPCPQRQRRRPCGNGRQRSVSAACAVAV

SEQ ID NO: 1484304 - protein, 31 aa, Mycobacterium tuberculosis
GSGTVGAFPFGFGWQQSPGFFNSTTTPSSGF

SEQ ID NO: 1484305 - protein, 20 aa, Mycobacterium tuberculosis
GSGVALRLDDGCTINADLLL

SEQ ID NO: 1484306 - protein, 23 aa, Mycobacterium tuberculosis
GSGVRRCLGFGFALTEGAVILQE

SEQ ID NO: 1484307 - protein, 17 aa, Mycobacterium tuberculosis
GSHLLRDAIGRCVQAAD

SEQ ID NO: 1484308 - protein, 17 aa, Mycobacterium tuberculosis
GSHRRRIRRNIKNRKSV

SEQ ID NO: 1484309 - protein, 17 aa, Mycobacterium tuberculosis
GSIDRLAVWNMVATVDA

SEQ ID NO: 1484310 - protein, 18 aa, Mycobacterium tuberculosis
GSILLPLPEVSLRGRRPP

SEQ ID NO: 1484311 - protein, 17 aa, Mycobacterium tuberculosis
GSIPRYTTFTPKHMGVM

SEQ ID NO: 1484312 - protein, 17 aa, Mycobacterium tuberculosis
GSISEDVILAGARERAT

SEQ ID NO: 1484313 - protein, 19 aa, Mycobacterium tuberculosis
GSLLRDYGLLLPLEPDTRL

SEQ ID NO: 1484314 - protein, 18 aa, Mycobacterium tuberculosis
GSLNTGFGAVGTGSGPNS

SEQ ID NO: 1484315 - protein, 21 aa, Mycobacterium tuberculosis
GSLQLPLAVLAEAAAEVQAKI

SEQ ID NO: 1484316 - protein, 22 aa, Mycobacterium tuberculosis
GSMPPRPGGAVGGARSTTSWCA

SEQ ID NO: 1484317 - protein, 21 aa, Mycobacterium tuberculosis
GSMVFPGYGAELLRWLDRAPQ

SEQ ID NO: 1484318 - protein, 23 aa, Mycobacterium tuberculosis
GSNAPVAVPWVWAARSPQALTNQ

SEQ ID NO: 1484319 - protein, 20 aa, Mycobacterium tuberculosis
GSNGGLLMGIMLTGYPEKFG

SEQ ID NO: 1484320 - protein, 19 aa, Mycobacterium tuberculosis
GSNHVLPTAGCARHSSGLS

SEQ ID NO: 1484321 - protein, 30 aa, Mycobacterium tuberculosis
GSNMSGFFGGPPVFNLGLANRGVVNILGNA

SEQ ID NO: 1484322 - protein, 23 aa, Mycobacterium tuberculosis
GSPAEVYFCWATRNYRELYGLLA

SEQ ID NO: 1484323 - protein, 24 aa, Mycobacterium tuberculosis
GSPAEVYFCWATRNYRELYGLLAV

SEQ ID NO: 1484324 - protein, 17 aa, Mycobacterium tuberculosis
GSPEERAAVLGILAELL

SEQ ID NO: 1484325 - protein, 17 aa, Mycobacterium tuberculosis
GSPFVIWATTSSSAIPT

SEQ ID NO: 1484326 - protein, 22 aa, Mycobacterium tuberculosis
GSPGAVCRWCGRVDPTLRCVRC

SEQ ID NO: 1484327 - protein, 23 aa, Mycobacterium tuberculosis
GSPGAVCRWCGRVDPTLRCVRCG

SEQ ID NO: 1484328 - protein, 20 aa, Mycobacterium tuberculosis
GSPGLELYSPAQLGLDHGHA

SEQ ID NO: 1484329 - protein, 23 aa, Mycobacterium tuberculosis
GSPLNLLRWTSARSIKETFVAAT

SEQ ID NO: 1484330 - protein, 26 aa, Mycobacterium tuberculosis
GSPQYRLVPTPGDGNIGLFNSGSGKL

SEQ ID NO: 1484331 - protein, 26 aa, Mycobacterium tuberculosis
GSQGEGGLRIVGISAVGSIDDLSAFK

SEQ ID NO: 1484332 - protein, 18 aa, Mycobacterium tuberculosis
GSQWAGMGRQLLADEPAF

SEQ ID NO: 1484333 - protein, 23 aa, Mycobacterium tuberculosis
GSQWPGMGTELLVAEPVFAATVA

SEQ ID NO: 1484334 - protein, 17 aa, Mycobacterium tuberculosis
GSRSFIHRFLDLRRSPG

SEQ ID NO: 1484335 - protein, 22 aa, Mycobacterium tuberculosis
GSRSGVTPSMSWTASSAPSRWV

SEQ ID NO: 1484336 - protein, 17 aa, Mycobacterium tuberculosis
GSRTVLDVRRCRWRTCP

SEQ ID NO: 1484337 - protein, 19 aa, Mycobacterium tuberculosis
GSSCIYPKLAPQPIPESAL

SEQ ID NO: 1484338 - protein, 23 aa, Mycobacterium tuberculosis
GSSGEGLAGVASVGGQPSQATQL

SEQ ID NO: 1484339 - protein, 37 aa, Mycobacterium tuberculosis
GSSGPPGAAALAFPSLSSSVPILGPYEDLIANTVANL

SEQ ID NO: 1484340 - protein, 25 aa, Mycobacterium tuberculosis
GSSGTVFALDLSWGGAGGNGGAATT

SEQ ID NO: 1484341 - protein, 24 aa, Mycobacterium tuberculosis
GSSKVLRPSAWLGARSSIAHRMDA

SEQ ID NO: 1484342 - protein, 17 aa, Mycobacterium tuberculosis
GSSPQRTRCRRRRPKPS

SEQ ID NO: 1484343 - protein, 27 aa, Mycobacterium tuberculosis
GSSSGFKVRPSFSFFAVGPDGNARGRG

SEQ ID NO: 1484344 - protein, 21 aa, Mycobacterium tuberculosis
GSSVLDSWGPTIFAGPRANPC

SEQ ID NO: 1484345 - protein, 21 aa, Mycobacterium tuberculosis
GSSVPAAWPRSVVAATGSRSS

SEQ ID NO: 1484346 - protein, 26 aa, Mycobacterium tuberculosis
GSTLSFRLALRLRRERNEFDGDVDWL

SEQ ID NO: 1484347 - protein, 24 aa, Mycobacterium tuberculosis
GSTPGAKGAHGFTPTSGGDGGDGG

SEQ ID NO: 1484348 - protein, 25 aa, Mycobacterium tuberculosis
GSVGNSWTPLAPVVEPPTPPTPASA

SEQ ID NO: 1484349 - protein, 26 aa, Mycobacterium tuberculosis
GSVGNSWTPLAPVVEPPTPPTPASAA

SEQ ID NO: 1484350 - protein, 24 aa, Mycobacterium tuberculosis
GSVGVAGWGFGCFQRRHAAFGCAE

SEQ ID NO: 1484351 - protein, 19 aa, Mycobacterium tuberculosis
GSVLEVRTALSYVSVDGAR

SEQ ID NO: 1484352 - protein, 26 aa, Mycobacterium tuberculosis
GSVLSGLAALHWRGPAAESMAVTAAA

SEQ ID NO: 1484353 - protein, 19 aa, Mycobacterium tuberculosis
GSVPVELNVSAGFDVTELP

SEQ ID NO: 1484354 - protein, 24 aa, Mycobacterium tuberculosis
GSVRAIGPAGTRRSNAAGSAGSPG

SEQ ID NO: 1484355 - protein, 19 aa, Mycobacterium tuberculosis
GSVTSGLAGQSWQGAAAAM

SEQ ID NO: 1484356 - protein, 17 aa, Mycobacterium tuberculosis
GSVWARVRLSDGEVIDA

SEQ ID NO: 1484357 - protein, 19 aa, Mycobacterium tuberculosis
GSVWNSGGCRSWYLDEHGK

SEQ ID NO: 1484358 - protein, 18 aa, Mycobacterium tuberculosis
GSYQIAVVGLKGGAGKTT

SEQ ID NO: 1484359 - protein, 27 aa, Mycobacterium tuberculosis
GTAAPAGPVVSCYGNGGAGGANIAGGN

SEQ ID NO: 1484360 - protein, 28 aa, Mycobacterium tuberculosis
GTAAYWLGRHGYSVTMVERHPGLRPGGQ

SEQ ID NO: 1484361 - protein, 17 aa, Mycobacterium tuberculosis
GTADPFGTLAQVRSAAA

SEQ ID NO: 1484362 - protein, 23 aa, Mycobacterium tuberculosis
GTAFLAARGGYFVADLSSGSHRT

SEQ ID NO: 1484363 - protein, 26 aa, Mycobacterium tuberculosis
GTAGDGRCRAGFGGFGGQGRHRAGKG

SEQ ID NO: 1484364 - protein, 18 aa, Mycobacterium tuberculosis
GTAGLFGVGGAGGAGGNG

SEQ ID NO: 1484365 - protein, 18 aa, Mycobacterium tuberculosis
GTAGLLFGAGGAGGAGGF

SEQ ID NO: 1484366 - protein, 19 aa, Mycobacterium tuberculosis
GTAGPERTAAPAAPPAGSS

SEQ ID NO: 1484367 - protein, 19 aa, Mycobacterium tuberculosis
GTAGYAGGLTYNYNTTYST

SEQ ID NO: 1484368 - protein, 20 aa, Mycobacterium tuberculosis
GTATAALLMQATAGRVATAA

SEQ ID NO: 1484369 - protein, 29 aa, Mycobacterium tuberculosis
GTATGGLLLRWVCAACVPTGLPAMPATAT

SEQ ID NO: 1484370 - protein, 26 aa, Mycobacterium tuberculosis
GTATPRAYPFTKFDRSGIHKRHRGAE

SEQ ID NO: 1484371 - protein, 31 aa, Mycobacterium tuberculosis
GTATPRAYPFTKFDRSGIHKRHRGAELSDTS

SEQ ID NO: 1484372 - protein, 17 aa, Mycobacterium tuberculosis
GTCANQCPIVDAGDRVE

SEQ ID NO: 1484373 - protein, 22 aa, Mycobacterium tuberculosis
GTCRARGLLDAVIGAAAERSPQ

SEQ ID NO: 1484374 - protein, 29 aa, Mycobacterium tuberculosis
GTDFGRLKRWAGWNRNRCAGAINDIGMRG

SEQ ID NO: 1484375 - protein, 24 aa, Mycobacterium tuberculosis
GTDHRGRVRIGTVLLSPAEPDGAD

SEQ ID NO: 1484376 - protein, 18 aa, Mycobacterium tuberculosis
GTDVAVWLGTLSTLSRTA

SEQ ID NO: 1484377 - protein, 23 aa, Mycobacterium tuberculosis
GTEGRTALRFLPMEELIAAFLPV

SEQ ID NO: 1484378 - protein, 35 aa, Mycobacterium tuberculosis
GTEGRTALRLLPMEELIAAFLPVLFPGMEIVEHHA

SEQ ID NO: 1484379 - protein, 21 aa, Mycobacterium tuberculosis
GTELPADLVVVGIGSTPATEW

SEQ ID NO: 1484380 - protein, 22 aa, Mycobacterium tuberculosis
GTEVIVSPVTVYGARSVTLSGS

SEQ ID NO: 1484381 - protein, 28 aa, Mycobacterium tuberculosis
GTEVLQRLRGMFAFALWDTVTRELFCAR

SEQ ID NO: 1484382 - protein, 26 aa, Mycobacterium tuberculosis
GTGAAGGAGGWLFGNGGNGGHGATNT

SEQ ID NO: 1484383 - protein, 24 aa, Mycobacterium tuberculosis
GTGADGAPGGWLIGNGGAGGSGAA

SEQ ID NO: 1484384 - protein, 25 aa, Mycobacterium tuberculosis
GTGADGAPGGWLIGNGGAGGSGAAN

SEQ ID NO: 1484385 - protein, 27 aa, Mycobacterium tuberculosis
GTGADGGAGGWLFGNGGNGGHGATGAD

SEQ ID NO: 1484386 - protein, 25 aa, Mycobacterium tuberculosis
GTGADGGAGGWLFGNGGNGGQGTIG

SEQ ID NO: 1484387 - protein, 24 aa, Mycobacterium tuberculosis
GTGANGGDAGWLIGNGGAGGSGAK

SEQ ID NO: 1484388 - protein, 31 aa, Mycobacterium tuberculosis
GTGARHLRPASRRKIAQFRAELGDFASARRS

SEQ ID NO: 1484389 - protein, 23 aa, Mycobacterium tuberculosis
GTGCRPSRVWVMNRLREKMPHVY

SEQ ID NO: 1484390 - protein, 26 aa, Mycobacterium tuberculosis
GTGDDGGAGGWLFGNGGNGGAGAAGT

SEQ ID NO: 1484391 - protein, 29 aa, Mycobacterium tuberculosis
GTGGAGGAGGWLFGVGGAGGVGGAGGGTG

SEQ ID NO: 1484392 - protein, 32 aa, Mycobacterium tuberculosis
GTGGKAGTELGCRRAWTAPTASPPTAVTGGNG

SEQ ID NO: 1484393 - protein, 19 aa, Mycobacterium tuberculosis
GTGGLLYGSGGAGGNGGSA

SEQ ID NO: 1484394 - protein, 17 aa, Mycobacterium tuberculosis
GTGGLSVNGGTGGTGGT

SEQ ID NO: 1484395 - protein, 21 aa, Mycobacterium tuberculosis
GTGGNGGYAQLIGDGGDGGPG

SEQ ID NO: 1484396 - protein, 23 aa, Mycobacterium tuberculosis
GTGGNGRRPVGHGEAGGAADNLG

SEQ ID NO: 1484397 - protein, 21 aa, Mycobacterium tuberculosis
GTGGPPLPGQAGMGAAGGAGG

SEQ ID NO: 1484398 - protein, 23 aa, Mycobacterium tuberculosis
GTGGPPLPGQAGMGAAGGAGGLI

SEQ ID NO: 1484399 - protein, 18 aa, Mycobacterium tuberculosis
GTGGQLWGSGGAGGEGGA

SEQ ID NO: 1484400 - protein, 19 aa, Mycobacterium tuberculosis
GTGGSGRAGVNGSSAGADG

SEQ ID NO: 1484401 - protein, 19 aa, Mycobacterium tuberculosis
GTGKAAFRGPGPRAGGRLR

SEQ ID NO: 1484402 - protein, 19 aa, Mycobacterium tuberculosis
GTGKAAFVARARELAAAYG

SEQ ID NO: 1484403 - protein, 20 aa, Mycobacterium tuberculosis
GTGKSVFLKSLIGLLRPERG

SEQ ID NO: 1484404 - protein, 25 aa, Mycobacterium tuberculosis
GTGQPGGAGGLLWGNGGNGGSGAAG

SEQ ID NO: 1484405 - protein, 24 aa, Mycobacterium tuberculosis
GTGQPGGPGALWGNGGNGGSGVAG

SEQ ID NO: 1484406 - protein, 21 aa, Mycobacterium tuberculosis
GTGRNALALARRGHPVDVVEM

SEQ ID NO: 1484407 - protein, 17 aa, Mycobacterium tuberculosis
GTGRPGPDRCRGRHHRP

SEQ ID NO: 1484408 - protein, 28 aa, Mycobacterium tuberculosis
GTGRSRLTSLTWKRCGRSPDQLTTVGND

SEQ ID NO: 1484409 - protein, 25 aa, Mycobacterium tuberculosis
GTHAAVLVGGCKRLTALPTGSTATA

SEQ ID NO: 1484410 - protein, 27 aa, Mycobacterium tuberculosis
GTIGVGSGLGRLSMAVNVNAHAPDRGH

SEQ ID NO: 1484411 - protein, 22 aa, Mycobacterium tuberculosis
GTIRVGSFRGRWLDPRHAGPAT

SEQ ID NO: 1484412 - protein, 23 aa, Mycobacterium tuberculosis
GTKVEIRSASTPTPATLEDTAVL

SEQ ID NO: 1484413 - protein, 25 aa, Mycobacterium tuberculosis
GTLEARGKIAMLAKVRRAPALIKVE

SEQ ID NO: 1484414 - protein, 18 aa, Mycobacterium tuberculosis
GTLFFGVPTVWSRVAADQ

SEQ ID NO: 1484415 - protein, 25 aa, Mycobacterium tuberculosis
GTLIPQLPLGLGLSGGTPPFDLPTV

SEQ ID NO: 1484416 - protein, 17 aa, Mycobacterium tuberculosis
GTLPAVILGTGQTTGYA

SEQ ID NO: 1484417 - protein, 17 aa, Mycobacterium tuberculosis
GTLPNLTWSRLKVNVAV

SEQ ID NO: 1484418 - protein, 22 aa, Mycobacterium tuberculosis
GTLSTFFGVPLVLTYATLGAPF

SEQ ID NO: 1484419 - protein, 29 aa, Mycobacterium tuberculosis
GTMADPGSVSYLFSRKGVVTLEKNGLTED

SEQ ID NO: 1484420 - protein, 20 aa, Mycobacterium tuberculosis
GTMPNRLYWISATVNPDGDQ

SEQ ID NO: 1484421 - protein, 17 aa, Mycobacterium tuberculosis
GTMTHAWLLTGPPGSGR

SEQ ID NO: 1484422 - protein, 24 aa, Mycobacterium tuberculosis
GTPISANFAHRVSVLVDLSVASDD

SEQ ID NO: 1484423 - protein, 17 aa, Mycobacterium tuberculosis
GTPLLKLVRELRADRGP

SEQ ID NO: 1484424 - protein, 17 aa, Mycobacterium tuberculosis
GTPLLKLVRELRADRGT

SEQ ID NO: 1484425 - protein, 20 aa, Mycobacterium tuberculosis
GTPLLNWLRQRGVDEVDMVG

SEQ ID NO: 1484426 - protein, 21 aa, Mycobacterium tuberculosis
GTPLLNWLRQRGVDEVDVVGI

SEQ ID NO: 1484427 - protein, 24 aa, Mycobacterium tuberculosis
GTPPMAPLRVAPAVSAAPEAAPSR

SEQ ID NO: 1484428 - protein, 19 aa, Mycobacterium tuberculosis
GTPPTLTWRYRGRITECGQ

SEQ ID NO: 1484429 - protein, 17 aa, Mycobacterium tuberculosis
GTPRAGLRTYLAVRGGV

SEQ ID NO: 1484430 - protein, 17 aa, Mycobacterium tuberculosis
GTPRASGPAGMTGMPMV

SEQ ID NO: 1484431 - protein, 33 aa, Mycobacterium tuberculosis
GTPRRYGVRWHYRLPVWSDFVEVHWSRWGEAYV

SEQ ID NO: 1484432 - protein, 19 aa, Mycobacterium tuberculosis
GTRDFPENTVLAITNAVAA

SEQ ID NO: 1484433 - protein, 26 aa, Mycobacterium tuberculosis
GTRRPVKSVGTWRLQPVLAGGGLSTY

SEQ ID NO: 1484434 - protein, 24 aa, Mycobacterium tuberculosis
GTRRRRVRLSLRHRSARHRVRLGD

SEQ ID NO: 1484435 - protein, 22 aa, Mycobacterium tuberculosis
GTSEPFDLLAVVPPHVPSAAAR

SEQ ID NO: 1484436 - protein, 18 aa, Mycobacterium tuberculosis
GTSGMRKNELIAAIEEIR

SEQ ID NO: 1484437 - protein, 27 aa, Mycobacterium tuberculosis
GTSLRRSYTLLRPGGRLVGYGISNMQH

SEQ ID NO: 1484438 - protein, 17 aa, Mycobacterium tuberculosis
GTSPPPPFAPWDTPDGT

SEQ ID NO: 1484439 - protein, 17 aa, Mycobacterium tuberculosis
GTSRCFWPSTRLRRRCW

SEQ ID NO: 1484440 - protein, 25 aa, Mycobacterium tuberculosis
GTSSSRLPVSLPFVARTRTMQATGR

SEQ ID NO: 1484441 - protein, 22 aa, Mycobacterium tuberculosis
GTTCWRRPVSPVAIASAAEPGA

SEQ ID NO: 1484442 - protein, 19 aa, Mycobacterium tuberculosis
GTVALRPDAGPSWLRPLVD

SEQ ID NO: 1484443 - protein, 20 aa, Mycobacterium tuberculosis
GTVARAFLRQALGVEVLSHV

SEQ ID NO: 1484444 - protein, 22 aa, Mycobacterium tuberculosis
GTVARAFLRQALGVEVLSHVIS

SEQ ID NO: 1484445 - protein, 26 aa, Mycobacterium tuberculosis
GTVGAFPFGFGWQQSPGFFNSTTTPS

SEQ ID NO: 1484446 - protein, 22 aa, Mycobacterium tuberculosis
GTVGLCCLVLSYPGWVSWPLCS

SEQ ID NO: 1484447 - protein, 18 aa, Mycobacterium tuberculosis
GTVLLAVRGLRMGTGTSE

SEQ ID NO: 1484448 - protein, 23 aa, Mycobacterium tuberculosis
GTWKCVMCTIVNRPGMSGDSSSW

SEQ ID NO: 1484449 - protein, 17 aa, Mycobacterium tuberculosis
GTYQLLRTRVDAHAAVS

SEQ ID NO: 1484450 - protein, 19 aa, Mycobacterium tuberculosis
GVADPGVDIARNFQSEQGG

SEQ ID NO: 1484451 - protein, 26 aa, Mycobacterium tuberculosis
GVAKQALKIAREWSAERVQWGKPVGQ

SEQ ID NO: 1484452 - protein, 17 aa, Mycobacterium tuberculosis
GVAKRSGTGIVAGEPPM

SEQ ID NO: 1484453 - protein, 24 aa, Mycobacterium tuberculosis
GVAMPAALRAAQMLAAEWDVAADV

SEQ ID NO: 1484454 - protein, 17 aa, Mycobacterium tuberculosis
GVAPSYPASFAADVLAN

SEQ ID NO: 1484455 - protein, 30 aa, Mycobacterium tuberculosis
GVARLATRRAAMCPLALRARPSNDRLTPTK

SEQ ID NO: 1484456 - protein, 28 aa, Mycobacterium tuberculosis
GVASAARNSAGFGAPRYGVKPIVMPKPA

SEQ ID NO: 1484457 - protein, 27 aa, Mycobacterium tuberculosis
GVASAFGGGNAFGGRGGDGGDGGDGGT

SEQ ID NO: 1484458 - protein, 20 aa, Mycobacterium tuberculosis
GVASDAAGVVGWWVNPQAPG

SEQ ID NO: 1484459 - protein, 21 aa, Mycobacterium tuberculosis
GVASLRARRLCGRGAGHAAAG

SEQ ID NO: 1484460 - protein, 24 aa, Mycobacterium tuberculosis
GVAWVIAYRWFRAGLLPVPAQRVG

SEQ ID NO: 1484461 - protein, 29 aa, Mycobacterium tuberculosis
GVCAAWPSGLLAVRGRPRLLAGPSGRAGF

SEQ ID NO: 1484462 - protein, 17 aa, Mycobacterium tuberculosis
GVCGLIIVRLPLAPRDG

SEQ ID NO: 1484463 - protein, 19 aa, Mycobacterium tuberculosis
GVDACGRMIDVVGDIEQPG

SEQ ID NO: 1484464 - protein, 33 aa, Mycobacterium tuberculosis
GVDAKWASSISGYWRRGRTEEMFRKWKKELAEA

SEQ ID NO: 1484465 - protein, 24 aa, Mycobacterium tuberculosis
GVDKFPRMVDYVVPTGVRIADADR

SEQ ID NO: 1484466 - protein, 19 aa, Mycobacterium tuberculosis
GVDPGRIPGPWSGAGLSAA

SEQ ID NO: 1484467 - protein, 21 aa, Mycobacterium tuberculosis
GVDWKGTLTGLAGYASGDLDT

SEQ ID NO: 1484468 - protein, 22 aa, Mycobacterium tuberculosis
GVDWKGTLTGLAGYASGDLDTR

SEQ ID NO: 1484469 - protein, 18 aa, Mycobacterium tuberculosis
GVEEVWTRDGWVDRFGLD

SEQ ID NO: 1484470 - protein, 29 aa, Mycobacterium tuberculosis
GVEGALVTLDWLGAHGFGRLLQHTVVVLN

SEQ ID NO: 1484471 - protein, 17 aa, Mycobacterium tuberculosis
GVEKWRDGQFVAFEGAL

SEQ ID NO: 1484472 - protein, 17 aa, Mycobacterium tuberculosis
GVEPFGGYMKRQMVHGA

SEQ ID NO: 1484473 - protein, 20 aa, Mycobacterium tuberculosis
GVEPPVALILQGASLHDLTA

SEQ ID NO: 1484474 - protein, 25 aa, Mycobacterium tuberculosis
GVEQGWPAWSRRASQRSRWSASTAA

SEQ ID NO: 1484475 - protein, 22 aa, Mycobacterium tuberculosis
GVFAGACLSEYGAMASADLSQV

SEQ ID NO: 1484476 - protein, 17 aa, Mycobacterium tuberculosis
GVFTTPGTLGWVSKTYV

SEQ ID NO: 1484477 - protein, 25 aa, Mycobacterium tuberculosis
GVGAAGGLAGQIGNGGSGGSGGAGG

SEQ ID NO: 1484478 - protein, 24 aa, Mycobacterium tuberculosis
GVGGAGGLLFGYGGAGGAGGYSNI

SEQ ID NO: 1484479 - protein, 25 aa, Mycobacterium tuberculosis
GVGGNARLLGTGGAGGVGGGGGAGG

SEQ ID NO: 1484480 - protein, 26 aa, Mycobacterium tuberculosis
GVGGNGATGPWLFGDGGAGGGGGAGG

SEQ ID NO: 1484481 - protein, 28 aa, Mycobacterium tuberculosis
GVGGNGATGPWLFGDGGPTPGSTGAGAA

SEQ ID NO: 1484482 - protein, 28 aa, Mycobacterium tuberculosis
GVGGPGGGHGLLGLGGSHGAGGAGGSGG

SEQ ID NO: 1484483 - protein, 24 aa, Mycobacterium tuberculosis
GVGGRGGDGVFAGAGGQGGLGGQG

SEQ ID NO: 1484484 - protein, 17 aa, Mycobacterium tuberculosis
GVGKRRYAGNGRTAGLF

SEQ ID NO: 1484485 - protein, 24 aa, Mycobacterium tuberculosis
GVGPADHPVLWAGLPDLVSRNRVA

SEQ ID NO: 1484486 - protein, 21 aa, Mycobacterium tuberculosis
GVGPRLAMAALAVHDAPALRQ

SEQ ID NO: 1484487 - protein, 20 aa, Mycobacterium tuberculosis
GVGRIRAGLELSEVSIQCGL

SEQ ID NO: 1484488 - protein, 26 aa, Mycobacterium tuberculosis
GVGSCRDSAWLLVSILRQFGLAARFV

SEQ ID NO: 1484489 - protein, 19 aa, Mycobacterium tuberculosis
GVGSPFWAAIDLQRYGLTW

SEQ ID NO: 1484490 - protein, 30 aa, Mycobacterium tuberculosis
GVGVRRFQMACAVHRFGDRPALDVRGQACA

SEQ ID NO: 1484491 - protein, 17 aa, Mycobacterium tuberculosis
GVHAAFADPYCPTLRAA

SEQ ID NO: 1484492 - protein, 17 aa, Mycobacterium tuberculosis
GVHPVLLDACFQSVAAH

SEQ ID NO: 1484493 - protein, 24 aa, Mycobacterium tuberculosis
GVIANGSFAPSFVGFGGNGVNGGT

SEQ ID NO: 1484494 - protein, 25 aa, Mycobacterium tuberculosis
GVIANGSFAPSFVGFGGNGVNGGTG

SEQ ID NO: 1484495 - protein, 26 aa, Mycobacterium tuberculosis
GVIANGSFAPSFVGFGGNGVNGGTGG

SEQ ID NO: 1484496 - protein, 20 aa, Mycobacterium tuberculosis
GVIPACAPAEKAGRVTKVSS

SEQ ID NO: 1484497 - protein, 41 aa, Mycobacterium tuberculosis
GVKFKDAELLGMPWIVVVGRGWADGVVELRDRFSGQTRELV

SEQ ID NO: 1484498 - protein, 18 aa, Mycobacterium tuberculosis
GVKRCLGANFSMRELITV

SEQ ID NO: 1484499 - protein, 17 aa, Mycobacterium tuberculosis
GVLDLRYADFTSTEVDI

SEQ ID NO: 1484500 - protein, 18 aa, Mycobacterium tuberculosis
GVLLLRDIRRVFSDRDRM

SEQ ID NO: 1484501 - protein, 19 aa, Mycobacterium tuberculosis
GVLPARVAECLAAIEAPLV

SEQ ID NO: 1484502 - protein, 19 aa, Mycobacterium tuberculosis
GVLRPGASPGSMPPRPGGT

SEQ ID NO: 1484503 - protein, 21 aa, Mycobacterium tuberculosis
GVLRRLLISASEWSGRGLWAN

SEQ ID NO: 1484504 - protein, 18 aa, Mycobacterium tuberculosis
GVLSARWSGRYGDDAANT

SEQ ID NO: 1484505 - protein, 17 aa, Mycobacterium tuberculosis
GVLSAVAAEFAKREVSI

SEQ ID NO: 1484506 - protein, 23 aa, Mycobacterium tuberculosis
GVLVRGRHVAVSAVTLLPGATIT

SEQ ID NO: 1484507 - protein, 24 aa, Mycobacterium tuberculosis
GVNDFPKYPLNVFATANAIAGILF

SEQ ID NO: 1484508 - protein, 25 aa, Mycobacterium tuberculosis
GVNFRDVLVALGMYPGGGELGVDGA

SEQ ID NO: 1484509 - protein, 21 aa, Mycobacterium tuberculosis
GVNIMEFCKAYNAATENQRGN

SEQ ID NO: 1484510 - protein, 24 aa, Mycobacterium tuberculosis
GVNLLLSPAVFRGFDQVGALSPTG

SEQ ID NO: 1484511 - protein, 25 aa, Mycobacterium tuberculosis
GVNLLLSPAVFRGFDQVGALSPTGQ

SEQ ID NO: 1484512 - protein, 29 aa, Mycobacterium tuberculosis
GVNPASWYRAVVISMRLPQRRHAVNRWSS

SEQ ID NO: 1484513 - protein, 19 aa, Mycobacterium tuberculosis
GVPDPRYGQQVAAVVQARP

SEQ ID NO: 1484514 - protein, 26 aa, Mycobacterium tuberculosis
GVPGRSVSRWGAFLDDVGGFDCDFFG

SEQ ID NO: 1484515 - protein, 23 aa, Mycobacterium tuberculosis
GVPGRSVSRWGGFLDDVAGFDAE

SEQ ID NO: 1484516 - protein, 21 aa, Mycobacterium tuberculosis
GVPISGILFGGRRKTTVPLVT

SEQ ID NO: 1484517 - protein, 27 aa, Mycobacterium tuberculosis
GVPISRIPLTINIRIPVNITLNELPEP

SEQ ID NO: 1484518 - protein, 24 aa, Mycobacterium tuberculosis
GVPIWGDVELAWRLDAAGCYGPPR

SEQ ID NO: 1484519 - protein, 18 aa, Mycobacterium tuberculosis
GVPPMPVVDAIRRGAQAI

SEQ ID NO: 1484520 - protein, 20 aa, Mycobacterium tuberculosis
GVPRPNWRSKPISVVELHLD

SEQ ID NO: 1484521 - protein, 19 aa, Mycobacterium tuberculosis
GVPTFRMLRALRGFDPDVV

SEQ ID NO: 1484522 - protein, 20 aa, Mycobacterium tuberculosis
GVPTFRMLRALRGFDPDVVH

SEQ ID NO: 1484523 - protein, 18 aa, Mycobacterium tuberculosis
GVRGARYVGADGVFEVPA

SEQ ID NO: 1484524 - protein, 17 aa, Mycobacterium tuberculosis
GVRMRPTVGLMVHQRVG

SEQ ID NO: 1484525 - protein, 24 aa, Mycobacterium tuberculosis
GVRRRLGVDLAEVAGLRPEIAAAV

SEQ ID NO: 1484526 - protein, 20 aa, Mycobacterium tuberculosis
GVRVPPRIIKATVAPDGSRT

SEQ ID NO: 1484527 - protein, 17 aa, Mycobacterium tuberculosis
GVRYRAFDLFEPGRPRM

SEQ ID NO: 1484528 - protein, 19 aa, Mycobacterium tuberculosis
GVSASRARAILSSRHIHRV

SEQ ID NO: 1484529 - protein, 25 aa, Mycobacterium tuberculosis
GVSCVKPAGALYAFPRLDPEVYDID

SEQ ID NO: 1484530 - protein, 23 aa, Mycobacterium tuberculosis
GVSGVREAACYEIPDEEFGALVG

SEQ ID NO: 1484531 - protein, 26 aa, Mycobacterium tuberculosis
GVSRAELIRLLLNRALTTAGDDLASD

SEQ ID NO: 1484532 - protein, 24 aa, Mycobacterium tuberculosis
GVSSCATCDGFFFRDQDIAVIGGG

SEQ ID NO: 1484533 - protein, 19 aa, Mycobacterium tuberculosis
GVTYWRKAAQLKRNEANDL

SEQ ID NO: 1484534 - protein, 24 aa, Mycobacterium tuberculosis
GVVAGIHLEGPWLSPARCGAHDHT

SEQ ID NO: 1484535 - protein, 18 aa, Mycobacterium tuberculosis
GVVARAVSRLVTIATGLD

SEQ ID NO: 1484536 - protein, 19 aa, Mycobacterium tuberculosis
GVVASEGWQGQAAEAFVAA

SEQ ID NO: 1484537 - protein, 23 aa, Mycobacterium tuberculosis
GVVDVVCPLGWPATPARLPFTLG

SEQ ID NO: 1484538 - protein, 20 aa, Mycobacterium tuberculosis
GVVLGNTWFWPADTLAMKAF

SEQ ID NO: 1484539 - protein, 19 aa, Mycobacterium tuberculosis
GVVPQRMHGFPALAMQDRL

SEQ ID NO: 1484540 - protein, 20 aa, Mycobacterium tuberculosis
GVVRLRFGLTDGQPRTLDEI

SEQ ID NO: 1484541 - protein, 19 aa, Mycobacterium tuberculosis
GVVSPGLIRCPARARRSGS

SEQ ID NO: 1484542 - protein, 19 aa, Mycobacterium tuberculosis
GVWLRPFRNLVYAMPPYIC

SEQ ID NO: 1484543 - protein, 20 aa, Mycobacterium tuberculosis
GVWLRPFRNLVYVMPPYICT

SEQ ID NO: 1484544 - protein, 17 aa, Mycobacterium tuberculosis
GVWPDMTEHGWATDEWP

SEQ ID NO: 1484545 - protein, 19 aa, Mycobacterium tuberculosis
GWFWPAAAAHPSLPRGALL

SEQ ID NO: 1484546 - protein, 22 aa, Mycobacterium tuberculosis
GWGLDPYLTPGFTELSSQAGFD

SEQ ID NO: 1484547 - protein, 20 aa, Mycobacterium tuberculosis
GWGNKACRNSDRTTCSPVGT

SEQ ID NO: 1484548 - protein, 18 aa, Mycobacterium tuberculosis
GWHGRPWAHHVPVMRETI

SEQ ID NO: 1484549 - protein, 18 aa, Mycobacterium tuberculosis
GWHSLSIAYAETADELAA

SEQ ID NO: 1484550 - protein, 20 aa, Mycobacterium tuberculosis
GWKTPTRRGTSRPSDSKTLI

SEQ ID NO: 1484551 - protein, 35 aa, Mycobacterium tuberculosis
GWLFHAHWRYSLRQQRWWCLQPWRHTHRIVDGLRR

SEQ ID NO: 1484552 - protein, 18 aa, Mycobacterium tuberculosis
GWLMPVSYAGTVSEHNAT

SEQ ID NO: 1484553 - protein, 18 aa, Mycobacterium tuberculosis
GWMVQAFRFTLDPTAEQA

SEQ ID NO: 1484554 - protein, 19 aa, Mycobacterium tuberculosis
GWNTFNLTLQGDVKRVPGG

SEQ ID NO: 1484555 - protein, 26 aa, Mycobacterium tuberculosis
GWPGEERLLRLGLQSLRLWREGSFLD

SEQ ID NO: 1484556 - protein, 25 aa, Mycobacterium tuberculosis
GWPNLAAELQLAFQQLLVGDYNAAV

SEQ ID NO: 1484557 - protein, 25 aa, Mycobacterium tuberculosis
GWVRSGATVDWWWGAWGAWVGVSRA

SEQ ID NO: 1484558 - protein, 18 aa, Mycobacterium tuberculosis
GYAGATVRHLLDMRSGVA

SEQ ID NO: 1484559 - protein, 21 aa, Mycobacterium tuberculosis
GYAMPHWPRPWGRAAGAVEQL

SEQ ID NO: 1484560 - protein, 25 aa, Mycobacterium tuberculosis
GYANAYDFFNMWRVRPAGLRVIGAG

SEQ ID NO: 1484561 - protein, 17 aa, Mycobacterium tuberculosis
GYARPLADTASRCTRSP

SEQ ID NO: 1484562 - protein, 22 aa, Mycobacterium tuberculosis
GYARTLSTLTWRVVTQRYQAAR

SEQ ID NO: 1484563 - protein, 24 aa, Mycobacterium tuberculosis
GYAYFAGRLGDWMRVDGENLGTAP

SEQ ID NO: 1484564 - protein, 19 aa, Mycobacterium tuberculosis
GYDMVQRLTAQPKYVQAGA

SEQ ID NO: 1484565 - protein, 19 aa, Mycobacterium tuberculosis
GYFRKSLEDIIRFQAEFLW

SEQ ID NO: 1484566 - protein, 18 aa, Mycobacterium tuberculosis
GYGADLIACVARQVIAVD

SEQ ID NO: 1484567 - protein, 30 aa, Mycobacterium tuberculosis
GYGAGRWGCARCRWPRWCRPTEDGVRPEGA

SEQ ID NO: 1484568 - protein, 26 aa, Mycobacterium tuberculosis
GYGGSGGRGGLLLGTGGAGGDGGVGG

SEQ ID NO: 1484569 - protein, 33 aa, Mycobacterium tuberculosis
GYGPAFRGLTAMWRRGDEVFAEVALPADAGVSV

SEQ ID NO: 1484570 - protein, 17 aa, Mycobacterium tuberculosis
GYGPIPAAVARTMVASA

SEQ ID NO: 1484571 - protein, 24 aa, Mycobacterium tuberculosis
GYGQLKFSNLKARAAVGALDGSLL

SEQ ID NO: 1484572 - protein, 20 aa, Mycobacterium tuberculosis
GYHRSARRTGLWGRLLPEWE

SEQ ID NO: 1484573 - protein, 18 aa, Mycobacterium tuberculosis
GYIESLDGKGQAGNGGNG

SEQ ID NO: 1484574 - protein, 28 aa, Mycobacterium tuberculosis
GYIPILGAPWLADLVRRSPWGGMFASPG

SEQ ID NO: 1484575 - protein, 17 aa, Mycobacterium tuberculosis
GYLRLMRSGVYVNPVAP

SEQ ID NO: 1484576 - protein, 17 aa, Mycobacterium tuberculosis
GYPALVAPLTFLAIAGR

SEQ ID NO: 1484577 - protein, 18 aa, Mycobacterium tuberculosis
GYPREWRRRKPYSWLRQV

SEQ ID NO: 1484578 - protein, 23 aa, Mycobacterium tuberculosis
GYPRVIKRWRRGKPLADAETIFE

SEQ ID NO: 1484579 - protein, 17 aa, Mycobacterium tuberculosis
GYRELREANRWPDKPGR

SEQ ID NO: 1484580 - protein, 28 aa, Mycobacterium tuberculosis
GYRPMHWLRGPARGWQPSVGDWLMSGCR

SEQ ID NO: 1484581 - protein, 19 aa, Mycobacterium tuberculosis
GYRSGQWLRRGYRRRALAR

SEQ ID NO: 1484582 - protein, 21 aa, Mycobacterium tuberculosis
GYSCAGTVEFLLDERGEYVFI

SEQ ID NO: 1484583 - protein, 17 aa, Mycobacterium tuberculosis
GYTRFYNPQGVYIAQVS

SEQ ID NO: 1484584 - protein, 18 aa, Mycobacterium tuberculosis
GYVRFCVMAPRQWRGLRR

SEQ ID NO: 1484585 - protein, 18 aa, Mycobacterium tuberculosis
GYWSLPSIFDSGGNHGTL

SEQ ID NO: 1484586 - protein, 21 aa, Mycobacterium tuberculosis
HAAFADPYCPTLRAAVTGLPG

SEQ ID NO: 1484587 - protein, 24 aa, Mycobacterium tuberculosis
HAAFVHAHPRWIAQAFADALGAAV

SEQ ID NO: 1484588 - protein, 19 aa, Mycobacterium tuberculosis
HAAGARWILDLGPGDILTR

SEQ ID NO: 1484589 - protein, 18 aa, Mycobacterium tuberculosis
HAAGCVCSVFVESCDAGA

SEQ ID NO: 1484590 - protein, 19 aa, Mycobacterium tuberculosis
HAALPDYFVSGGRAVPIPY

SEQ ID NO: 1484591 - protein, 22 aa, Mycobacterium tuberculosis
HAALRAALRASAARSLMNRMAE

SEQ ID NO: 1484592 - protein, 17 aa, Mycobacterium tuberculosis
HAAQHATGVTFELIEAN

SEQ ID NO: 1484593 - protein, 21 aa, Mycobacterium tuberculosis
HACDPRCRHVGVGGVRSTHAI

SEQ ID NO: 1484594 - protein, 18 aa, Mycobacterium tuberculosis
HADELAVAAISWFELAWL

SEQ ID NO: 1484595 - protein, 18 aa, Mycobacterium tuberculosis
HAELARRDPAAAAAILPT

SEQ ID NO: 1484596 - protein, 23 aa, Mycobacterium tuberculosis
HAELGDKLLDVWTGTNHRGVQLN

SEQ ID NO: 1484597 - protein, 20 aa, Mycobacterium tuberculosis
HAEPGAWLLISTCDAADLVA

SEQ ID NO: 1484598 - protein, 23 aa, Mycobacterium tuberculosis
HAESIRKFRILPVDFTEDTGELT

SEQ ID NO: 1484599 - protein, 23 aa, Mycobacterium tuberculosis
HAFAGSLLRDYGLLLPLEPDTRL

SEQ ID NO: 1484600 - protein, 23 aa, Mycobacterium tuberculosis
HAGEGNHILGFVMGEHSVLMTDE

SEQ ID NO: 1484601 - protein, 17 aa, Mycobacterium tuberculosis
HAGMLDRSRPLWQVDLI

SEQ ID NO: 1484602 - protein, 22 aa, Mycobacterium tuberculosis
HAGMLDRSRPLWQVDLIEGLPG

SEQ ID NO: 1484603 - protein, 32 aa, Mycobacterium tuberculosis
HAGTAWPRRRARRRFGCAWSNGTRSGMTGPPT

SEQ ID NO: 1484604 - protein, 17 aa, Mycobacterium tuberculosis
HAIVQFVKAICSPMALA

SEQ ID NO: 1484605 - protein, 17 aa, Mycobacterium tuberculosis
HALALLLAASRQIPAAD

SEQ ID NO: 1484606 - protein, 21 aa, Mycobacterium tuberculosis
HALKERYSRITVHDKGKRFNT

SEQ ID NO: 1484607 - protein, 17 aa, Mycobacterium tuberculosis
HAMAVAIPRERTMPEVL

SEQ ID NO: 1484608 - protein, 24 aa, Mycobacterium tuberculosis
HAMGVRVATSFSARLFNLLITNAP

SEQ ID NO: 1484609 - protein, 20 aa, Mycobacterium tuberculosis
HAMIRAGLRLKKLGTDRSWR

SEQ ID NO: 1484610 - protein, 22 aa, Mycobacterium tuberculosis
HAPDRRKVLEEAFRVLRPGGEL

SEQ ID NO: 1484611 - protein, 18 aa, Mycobacterium tuberculosis
HAPKLGGHDSWRLHIHGA

SEQ ID NO: 1484612 - protein, 24 aa, Mycobacterium tuberculosis
HAPRPRTLVFGAIDFAAALARQGS

SEQ ID NO: 1484613 - protein, 17 aa, Mycobacterium tuberculosis
HAPTRLALLTGLAPHQV

SEQ ID NO: 1484614 - protein, 17 aa, Mycobacterium tuberculosis
HAQRVGRRPSLPALQPA

SEQ ID NO: 1484615 - protein, 23 aa, Mycobacterium tuberculosis
HARRRGAGIVEHLLGEPAQGNLL

SEQ ID NO: 1484616 - protein, 18 aa, Mycobacterium tuberculosis
HARTAGDVVQIFAGNDVV

SEQ ID NO: 1484617 - protein, 22 aa, Mycobacterium tuberculosis
HASMLFLPVRILTSPITTLASM

SEQ ID NO: 1484618 - protein, 18 aa, Mycobacterium tuberculosis
HAVASLPAVVADIQTGIK

SEQ ID NO: 1484619 - protein, 25 aa, Mycobacterium tuberculosis
HAVAVDLRNDWPTALKNAGFDPARP

SEQ ID NO: 1484620 - protein, 20 aa, Mycobacterium tuberculosis
HAVSYSFARGHRVQYSVIGT

SEQ ID NO: 1484621 - protein, 23 aa, Mycobacterium tuberculosis
HAYPRTASIVIWYSRAICDTAAI

SEQ ID NO: 1484622 - protein, 23 aa, Mycobacterium tuberculosis
HAYSRASAMASVFHRDDPEWRST

SEQ ID NO: 1484623 - protein, 18 aa, Mycobacterium tuberculosis
HCALWRALIGLDSMERIS

SEQ ID NO: 1484624 - protein, 25 aa, Mycobacterium tuberculosis
HCDESPRAQCRTGGADAAQRDITVR

SEQ ID NO: 1484625 - protein, 17 aa, Mycobacterium tuberculosis
HCLLDLLWRNRRGELEM

SEQ ID NO: 1484626 - protein, 19 aa, Mycobacterium tuberculosis
HCVHRAIVGRHLLEVNPCF

SEQ ID NO: 1484627 - protein, 19 aa, Mycobacterium tuberculosis
HCWRHWKPAHVGRRNMDLL

SEQ ID NO: 1484628 - protein, 18 aa, Mycobacterium tuberculosis
HDAEYLFDQFVELMAGEG

SEQ ID NO: 1484629 - protein, 19 aa, Mycobacterium tuberculosis
HDAYCLRIAITETMSDLSV

SEQ ID NO: 1484630 - protein, 17 aa, Mycobacterium tuberculosis
HDCQTERGIVVELAERA

SEQ ID NO: 1484631 - protein, 25 aa, Mycobacterium tuberculosis
HDEVSTAIAALFGSHGQHYQAISAQ

SEQ ID NO: 1484632 - protein, 18 aa, Mycobacterium tuberculosis
HDGQLRLSLGPKNQTFDL

SEQ ID NO: 1484633 - protein, 19 aa, Mycobacterium tuberculosis
HDGQLRLSLGPKNQTFDLT

SEQ ID NO: 1484634 - protein, 22 aa, Mycobacterium tuberculosis
HDITRLMSFDRGFDSYPGIKRL

SEQ ID NO: 1484635 - protein, 23 aa, Mycobacterium tuberculosis
HDRELAKLFGPVDRDEWFMTPQT

SEQ ID NO: 1484636 - protein, 18 aa, Mycobacterium tuberculosis
HDRFRLLTGGSRIAVRRQ

SEQ ID NO: 1484637 - protein, 21 aa, Mycobacterium tuberculosis
HDRFRLLTGGSRIAVRRQQTM

SEQ ID NO: 1484638 - protein, 17 aa, Mycobacterium tuberculosis
HDRFRLLTGGSRSAPPA

SEQ ID NO: 1484639 - protein, 25 aa, Mycobacterium tuberculosis
HDRWHSLARLAIRDDIYGALRSLCF

SEQ ID NO: 1484640 - protein, 25 aa, Mycobacterium tuberculosis
HDSAKRICKEAHYHGAGTVEYLVGQ

SEQ ID NO: 1484641 - protein, 30 aa, Mycobacterium tuberculosis
HDWCISRQLWWGHRIPIWYGPDGEQVCVGP

SEQ ID NO: 1484642 - protein, 18 aa, Mycobacterium tuberculosis
HEDDWLAPGGFNFDAWRF

SEQ ID NO: 1484643 - protein, 25 aa, Mycobacterium tuberculosis
HEDLKRFFDGFPRNAHPMPVLSSVV

SEQ ID NO: 1484644 - protein, 23 aa, Mycobacterium tuberculosis
HEEFPRIDPAVICLVHDGADRAV

SEQ ID NO: 1484645 - protein, 24 aa, Mycobacterium tuberculosis
HEIKGARAYHPTLLRKGERLLVFL

SEQ ID NO: 1484646 - protein, 25 aa, Mycobacterium tuberculosis
HEIKGARAYHPTLLRKGERLLVFLP

SEQ ID NO: 1484647 - protein, 30 aa, Mycobacterium tuberculosis
HEIKGARAYHPTLLRKGERLLVFLPLAHVL

SEQ ID NO: 1484648 - protein, 20 aa, Mycobacterium tuberculosis
HELADPLTPILAVGAAASAI

SEQ ID NO: 1484649 - protein, 17 aa, Mycobacterium tuberculosis
HELCGAATRIGPAVWAT

SEQ ID NO: 1484650 - protein, 20 aa, Mycobacterium tuberculosis
HELIAEAFGGKGYHVSTPTE

SEQ ID NO: 1484651 - protein, 17 aa, Mycobacterium tuberculosis
HELPRRLGGEHSDSTNT

SEQ ID NO: 1484652 - protein, 20 aa, Mycobacterium tuberculosis
HELQRWYQPMFRGVYVSRRS

SEQ ID NO: 1484653 - protein, 21 aa, Mycobacterium tuberculosis
HELRTPLTTIRGFAELYRQGA

SEQ ID NO: 1484654 - protein, 25 aa, Mycobacterium tuberculosis
HEMRDRWAGFFNEFDVLLLPVTPTP

SEQ ID NO: 1484655 - protein, 22 aa, Mycobacterium tuberculosis
HESARAVLRVAPLSVAELLATQ

SEQ ID NO: 1484656 - protein, 19 aa, Mycobacterium tuberculosis
HESHEVLGGHVFRPDMFRL

SEQ ID NO: 1484657 - protein, 18 aa, Mycobacterium tuberculosis
HEVDGRLLADGGILDPLP

SEQ ID NO: 1484658 - protein, 25 aa, Mycobacterium tuberculosis
HEWIRRSGDDTVRMGITDYAQSALG

SEQ ID NO: 1484659 - protein, 19 aa, Mycobacterium tuberculosis
HEWIRRSGDDTVRVGITDY

SEQ ID NO: 1484660 - protein, 29 aa, Mycobacterium tuberculosis
HFDLDPLLPFPRWHEHAAMVEEPVRRIPG

SEQ ID NO: 1484661 - protein, 27 aa, Mycobacterium tuberculosis
HFDYALVCGGGDWRRAGIPARSDQFCH

SEQ ID NO: 1484662 - protein, 25 aa, Mycobacterium tuberculosis
HFERELVHSPPFRSSDPKPREGTET

SEQ ID NO: 1484663 - protein, 20 aa, Mycobacterium tuberculosis
HFGQSGGFIWVDPKADLALV

SEQ ID NO: 1484664 - protein, 23 aa, Mycobacterium tuberculosis
HFLPRILSGEHRWCQASPSRRPG

SEQ ID NO: 1484665 - protein, 20 aa, Mycobacterium tuberculosis
HFPMGDGLLGGRTARNGTTR

SEQ ID NO: 1484666 - protein, 18 aa, Mycobacterium tuberculosis
HFPSVFGPSGDQPLDAGT

SEQ ID NO: 1484667 - protein, 25 aa, Mycobacterium tuberculosis
HFVQKYRIAKWFNEIRGRTRPDQEK

SEQ ID NO: 1484668 - protein, 26 aa, Mycobacterium tuberculosis
HGAKMVTAVACARVPKLTVVIGGSYG

SEQ ID NO: 1484669 - protein, 23 aa, Mycobacterium tuberculosis
HGASWPPRLIFGGRRVHRHGTDQ

SEQ ID NO: 1484670 - protein, 17 aa, Mycobacterium tuberculosis
HGAWGVRVHDVRASVDA

SEQ ID NO: 1484671 - protein, 21 aa, Mycobacterium tuberculosis
HGFHLDIWALNYAGRRHEVSG

SEQ ID NO: 1484672 - protein, 26 aa, Mycobacterium tuberculosis
HGGAGGAGGRAWLWGTGGAGGAGGDG

SEQ ID NO: 1484673 - protein, 27 aa, Mycobacterium tuberculosis
HGGAGGSARLIGAGGHGGDGGAGGNTA

SEQ ID NO: 1484674 - protein, 39 aa, Mycobacterium tuberculosis
HGGCGGFHRWFRWWPDHCRWPSSSACSLGRSPSTTRKRT

SEQ ID NO: 1484675 - protein, 22 aa, Mycobacterium tuberculosis
HGGDACALGAVKTNIGHLEAAA

SEQ ID NO: 1484676 - protein, 20 aa, Mycobacterium tuberculosis
HGGDGFRTAGAGGRGGDGGK

SEQ ID NO: 1484677 - protein, 19 aa, Mycobacterium tuberculosis
HGGDGGNAVGLIGNGGAGG

SEQ ID NO: 1484678 - protein, 18 aa, Mycobacterium tuberculosis
HGHAYVMQAPHDLITNLV

SEQ ID NO: 1484679 - protein, 36 aa, Mycobacterium tuberculosis
HGHRNRVRCHLHISRSPSAVPGRGGPLPVSPCGVLG

SEQ ID NO: 1484680 - protein, 17 aa, Mycobacterium tuberculosis
HGHSAWREDGNYSPQLN

SEQ ID NO: 1484681 - protein, 21 aa, Mycobacterium tuberculosis
HGHTEWLPPPHLDHGQPRTNT

SEQ ID NO: 1484682 - protein, 17 aa, Mycobacterium tuberculosis
HGIRVTWAVLNDGQMSA

SEQ ID NO: 1484683 - protein, 19 aa, Mycobacterium tuberculosis
HGKICDALLDGARKVAAGC

SEQ ID NO: 1484684 - protein, 19 aa, Mycobacterium tuberculosis
HGKVGFGAPGGDGGDGGNG

SEQ ID NO: 1484685 - protein, 17 aa, Mycobacterium tuberculosis
HGLLLLRHVADLVMTGW

SEQ ID NO: 1484686 - protein, 26 aa, Mycobacterium tuberculosis
HGLSLPRRLQIEFSQVIQKIAEGTAG

SEQ ID NO: 1484687 - protein, 24 aa, Mycobacterium tuberculosis
HGNSVPRFHITWGTGPALVDKFVR

SEQ ID NO: 1484688 - protein, 17 aa, Mycobacterium tuberculosis
HGPVVAVAGRFVHTSIR

SEQ ID NO: 1484689 - protein, 22 aa, Mycobacterium tuberculosis
HGRPLLRHRVELGAGSLADDVI

SEQ ID NO: 1484690 - protein, 17 aa, Mycobacterium tuberculosis
HGRRARCAGTSSDRHRS

SEQ ID NO: 1484691 - protein, 25 aa, Mycobacterium tuberculosis
HGTAFLAARGGYFVADLSSGHTGRV

SEQ ID NO: 1484692 - protein, 21 aa, Mycobacterium tuberculosis
HGTTVRAMRFLPWDRRRYQPT

SEQ ID NO: 1484693 - protein, 19 aa, Mycobacterium tuberculosis
HGTVLLAVRGLRMGTGTSE

SEQ ID NO: 1484694 - protein, 17 aa, Mycobacterium tuberculosis
HGVEAAERLATRRRQSL

SEQ ID NO: 1484695 - protein, 21 aa, Mycobacterium tuberculosis
HGVGRLKRPWLAGYLGPDVLA

SEQ ID NO: 1484696 - protein, 20 aa, Mycobacterium tuberculosis
HGYDFSAPVIEGYVLARGLG

SEQ ID NO: 1484697 - protein, 19 aa, Mycobacterium tuberculosis
HHGMLSVFGSPTWRTVTGG

SEQ ID NO: 1484698 - protein, 17 aa, Mycobacterium tuberculosis
HHLRRASAVLQQVSGEC

SEQ ID NO: 1484699 - protein, 21 aa, Mycobacterium tuberculosis
HHPPMRTFLGVPVRIRDEVFG

SEQ ID NO: 1484700 - protein, 23 aa, Mycobacterium tuberculosis
HHPRLPGHRLGRGRHRTQPPRIR

SEQ ID NO: 1484701 - protein, 32 aa, Mycobacterium tuberculosis
HHPRQLQRSAPGWRSTRGGNVYVTNFGSGTVS

SEQ ID NO: 1484702 - protein, 27 aa, Mycobacterium tuberculosis
HHRADRRGGLHHAPAHRSRHPPAQHHD

SEQ ID NO: 1484703 - protein, 17 aa, Mycobacterium tuberculosis
HHRNEVTEIIPLDGFLD

SEQ ID NO: 1484704 - protein, 18 aa, Mycobacterium tuberculosis
HHSHGYCPVPGRPRRART

SEQ ID NO: 1484705 - protein, 24 aa, Mycobacterium tuberculosis
HHVFKEWADRYAGRFDMGYERYRE

SEQ ID NO: 1484706 - protein, 21 aa, Mycobacterium tuberculosis
HIDRGYPLFVENLVSLGAEIE

SEQ ID NO: 1484707 - protein, 18 aa, Mycobacterium tuberculosis
HIDTAILPNGWRDRLVSW

SEQ ID NO: 1484708 - protein, 26 aa, Mycobacterium tuberculosis
HIEWKHGVCDALGWPHADQADIAAAW

SEQ ID NO: 1484709 - protein, 19 aa, Mycobacterium tuberculosis
HIITNLKYACLSIYTFTKK

SEQ ID NO: 1484710 - protein, 22 aa, Mycobacterium tuberculosis
HINTGFSIPVTFSYSTPALTLF

SEQ ID NO: 1484711 - protein, 17 aa, Mycobacterium tuberculosis
HIPSIPLGFAAIGHIGP

SEQ ID NO: 1484712 - protein, 21 aa, Mycobacterium tuberculosis
HIPSLFAIYPTNDWHERETYD

SEQ ID NO: 1484713 - protein, 25 aa, Mycobacterium tuberculosis
HIRAGDCGRDYRVLSAALLEVTFCG

SEQ ID NO: 1484714 - protein, 26 aa, Mycobacterium tuberculosis
HISQNWRLSGLAGEYITPVPAQQRLG

SEQ ID NO: 1484715 - protein, 27 aa, Mycobacterium tuberculosis
HISTLLLTLLFRFMRPLIENGHVFLAQ

SEQ ID NO: 1484716 - protein, 28 aa, Mycobacterium tuberculosis
HISTLLLTLLFRFMRPLIENGHVFLAQP

SEQ ID NO: 1484717 - protein, 24 aa, Mycobacterium tuberculosis
HIVDVKRALAWVKENIAAYGGEPN

SEQ ID NO: 1484718 - protein, 18 aa, Mycobacterium tuberculosis
HIVGAALFEALAETTTWD

SEQ ID NO: 1484719 - protein, 26 aa, Mycobacterium tuberculosis
HIVIDGWSLPLFVSELLALYRAGGHV

SEQ ID NO: 1484720 - protein, 23 aa, Mycobacterium tuberculosis
HIVRHYRPIVVVLFLSAEIAAFE

SEQ ID NO: 1484721 - protein, 18 aa, Mycobacterium tuberculosis
HIWADGGIRHPRDVALAL

SEQ ID NO: 1484722 - protein, 18 aa, Mycobacterium tuberculosis
HKERRLAEIAASGVTRIG

SEQ ID NO: 1484723 - protein, 17 aa, Mycobacterium tuberculosis
HKILPPDGVLLLHTITG

SEQ ID NO: 1484724 - protein, 18 aa, Mycobacterium tuberculosis
HKPEESKRTFGARIVTPS

SEQ ID NO: 1484725 - protein, 24 aa, Mycobacterium tuberculosis
HKSTWRSVPLVGHIPSAPGNPGRW

SEQ ID NO: 1484726 - protein, 23 aa, Mycobacterium tuberculosis
HKVCRKLDGGMPVNDIVDGLRND

SEQ ID NO: 1484727 - protein, 22 aa, Mycobacterium tuberculosis
HLAKLRMARLVRTRRDGTTIFY

SEQ ID NO: 1484728 - protein, 19 aa, Mycobacterium tuberculosis
HLDLPSWDLDPVLGVSVIT

SEQ ID NO: 1484729 - protein, 17 aa, Mycobacterium tuberculosis
HLEELRVGTPRGPNLFE

SEQ ID NO: 1484730 - protein, 20 aa, Mycobacterium tuberculosis
HLFVRPVIRMDQTAWCACHV

SEQ ID NO: 1484731 - protein, 17 aa, Mycobacterium tuberculosis
HLGALALHHALGALDVL

SEQ ID NO: 1484732 - protein, 23 aa, Mycobacterium tuberculosis
HLGARLFSIIAWRTYLVRDPHAL

SEQ ID NO: 1484733 - protein, 20 aa, Mycobacterium tuberculosis
HLHHTYSFLGVETYRQVSSE

SEQ ID NO: 1484734 - protein, 20 aa, Mycobacterium tuberculosis
HLHIPRTTWYDGVRVRGGVG

SEQ ID NO: 1484735 - protein, 27 aa, Mycobacterium tuberculosis
HLKLTGALGACIWHYLQATGQSDFKSA

SEQ ID NO: 1484736 - protein, 18 aa, Mycobacterium tuberculosis
HLLAMKVVAARGVRDGED

SEQ ID NO: 1484737 - protein, 19 aa, Mycobacterium tuberculosis
HLLAMKVVAARGVRDGEDI

SEQ ID NO: 1484738 - protein, 25 aa, Mycobacterium tuberculosis
HLLGCSPRWGADVSSEIDPITVLRP

SEQ ID NO: 1484739 - protein, 20 aa, Mycobacterium tuberculosis
HLLRLCAGPRGRVMSRAAAR

SEQ ID NO: 1484740 - protein, 18 aa, Mycobacterium tuberculosis
HLNRAASALFRRSDRPGT

SEQ ID NO: 1484741 - protein, 25 aa, Mycobacterium tuberculosis
HLPSARRLLLFKADGSVSVHADDRA

SEQ ID NO: 1484742 - protein, 22 aa, Mycobacterium tuberculosis
HLQRQGFRWPSATVKTIMRANG

SEQ ID NO: 1484743 - protein, 17 aa, Mycobacterium tuberculosis
HLREVVCEDSLGLAEEF

SEQ ID NO: 1484744 - protein, 19 aa, Mycobacterium tuberculosis
HLRGVAGALGREFAGELAL

SEQ ID NO: 1484745 - protein, 22 aa, Mycobacterium tuberculosis
HLRNMAFYNFGLRLLKRARDAD

SEQ ID NO: 1484746 - protein, 19 aa, Mycobacterium tuberculosis
HLRNRLVVAAMHWDGPKAQ

SEQ ID NO: 1484747 - protein, 27 aa, Mycobacterium tuberculosis
HLSHGRVSVGVGFGWNTDELVDHGVPP

SEQ ID NO: 1484748 - protein, 25 aa, Mycobacterium tuberculosis
HLSYKTVWYGSALVVADRWFPSSKT

SEQ ID NO: 1484749 - protein, 18 aa, Mycobacterium tuberculosis
HLTYEIFGPPGTVADISY

SEQ ID NO: 1484750 - protein, 17 aa, Mycobacterium tuberculosis
HLVGYPFAPYYVDVTAG

SEQ ID NO: 1484751 - protein, 27 aa, Mycobacterium tuberculosis
HLVKPTGWPRAWCCAGRSARSARSTAS

SEQ ID NO: 1484752 - protein, 20 aa, Mycobacterium tuberculosis
HLWQARLAPDAKPYQGGHRF

SEQ ID NO: 1484753 - protein, 21 aa, Mycobacterium tuberculosis
HLYPDSLRTMGYDVGSAGFEL

SEQ ID NO: 1484754 - protein, 17 aa, Mycobacterium tuberculosis
HMAIACKDPEKKKKLMT

SEQ ID NO: 1484755 - protein, 18 aa, Mycobacterium tuberculosis
HMERRFSADGTSWDPTEL

SEQ ID NO: 1484756 - protein, 24 aa, Mycobacterium tuberculosis
HMEVGSPYAVEYVWGRQVGDNTIN

SEQ ID NO: 1484757 - protein, 24 aa, Mycobacterium tuberculosis
HMGRQAFAAVLGRGLANTGQLVLD

SEQ ID NO: 1484758 - protein, 24 aa, Mycobacterium tuberculosis
HMGRQAFAAVLGRGLATRQLVLDP

SEQ ID NO: 1484759 - protein, 17 aa, Mycobacterium tuberculosis
HMLDTLRAFDAVAHELS

SEQ ID NO: 1484760 - protein, 24 aa, Mycobacterium tuberculosis
HNGTVYRWNPPVYDVVDGRPHLRL

SEQ ID NO: 1484761 - protein, 18 aa, Mycobacterium tuberculosis
HNLIHGFILAAAHLVPDG

SEQ ID NO: 1484762 - protein, 20 aa, Mycobacterium tuberculosis
HNLVEYGFRLPSACDNRPLT

SEQ ID NO: 1484763 - protein, 20 aa, Mycobacterium tuberculosis
HNPIAIIVPCHRVIGASGKL

SEQ ID NO: 1484764 - protein, 23 aa, Mycobacterium tuberculosis
HNTGVGDAFGGDGGIGGDGNGAL

SEQ ID NO: 1484765 - protein, 18 aa, Mycobacterium tuberculosis
HNTWRFGLDRILTGVAMS

SEQ ID NO: 1484766 - protein, 23 aa, Mycobacterium tuberculosis
HNTWRFGLDRILTGVAMSEDSQA

SEQ ID NO: 1484767 - protein, 24 aa, Mycobacterium tuberculosis
HNTWRFGLDRILTGVAMSEDSQAW

SEQ ID NO: 1484768 - protein, 17 aa, Mycobacterium tuberculosis
HNTWRLGLDRILTGVAM

SEQ ID NO: 1484769 - protein, 17 aa, Mycobacterium tuberculosis
HPAALRRAIPGGATSAR

SEQ ID NO: 1484770 - protein, 18 aa, Mycobacterium tuberculosis
HPAHRLRVRLADRALTQT

SEQ ID NO: 1484771 - protein, 25 aa, Mycobacterium tuberculosis
HPDLEVLTHGLTLWDLDRVSRSTAL

SEQ ID NO: 1484772 - protein, 23 aa, Mycobacterium tuberculosis
HPDRAVAVLAALPAWTGEPELAP

SEQ ID NO: 1484773 - protein, 22 aa, Mycobacterium tuberculosis
HPECGCATSALYLAGEGAFPAE

SEQ ID NO: 1484774 - protein, 19 aa, Mycobacterium tuberculosis
HPEIREVRRSDFCGHYIGE

SEQ ID NO: 1484775 - protein, 17 aa, Mycobacterium tuberculosis
HPEPLPPVSGLTIAVER

SEQ ID NO: 1484776 - protein, 20 aa, Mycobacterium tuberculosis
HPEVPGPRIEEPHIPGAGVE

SEQ ID NO: 1484777 - protein, 19 aa, Mycobacterium tuberculosis
HPGFRRDRCGAGARRPDQV

SEQ ID NO: 1484778 - protein, 25 aa, Mycobacterium tuberculosis
HPGINELFALLAYGEVAAFYRLTDE

SEQ ID NO: 1484779 - protein, 20 aa, Mycobacterium tuberculosis
HPGLARAVVNLHRRYRITTA

SEQ ID NO: 1484780 - protein, 17 aa, Mycobacterium tuberculosis
HPGRRSPLWQQRQRAAR

SEQ ID NO: 1484781 - protein, 23 aa, Mycobacterium tuberculosis
HPHADLARVLPCRRRGCRADGPA

SEQ ID NO: 1484782 - protein, 17 aa, Mycobacterium tuberculosis
HPHWDPRHLWLVPITQA

SEQ ID NO: 1484783 - protein, 25 aa, Mycobacterium tuberculosis
HPLAHLRAFVLIPWIAVDPTAQLTG

SEQ ID NO: 1484784 - protein, 18 aa, Mycobacterium tuberculosis
HPLFAHITLLRSERSPIA

SEQ ID NO: 1484785 - protein, 21 aa, Mycobacterium tuberculosis
HPLYCRRMQQKLVEFAEAGFP

SEQ ID NO: 1484786 - protein, 20 aa, Mycobacterium tuberculosis
HPMGPLRLSDLVGLDTLKLI

SEQ ID NO: 1484787 - protein, 21 aa, Mycobacterium tuberculosis
HPMWECYIIDGIERGRIAILL

SEQ ID NO: 1484788 - protein, 17 aa, Mycobacterium tuberculosis
HPNDWWIVRLLGSITPT

SEQ ID NO: 1484789 - protein, 20 aa, Mycobacterium tuberculosis
HPNGSCDFVAGANLRTPDGP

SEQ ID NO: 1484790 - protein, 18 aa, Mycobacterium tuberculosis
HPPDLVILDLGLPDMSGI

SEQ ID NO: 1484791 - protein, 17 aa, Mycobacterium tuberculosis
HPPDVVILDLGLPDMSS

SEQ ID NO: 1484792 - protein, 17 aa, Mycobacterium tuberculosis
HPPGRRIAPVGPPGTTP

SEQ ID NO: 1484793 - protein, 24 aa, Mycobacterium tuberculosis
HPPNPKATIAFCAGSRTVLDVRRC

SEQ ID NO: 1484794 - protein, 19 aa, Mycobacterium tuberculosis
HPQRIKLRRQYRIVHDPVP

SEQ ID NO: 1484795 - protein, 20 aa, Mycobacterium tuberculosis
HPRLMPDFWEFPTVSMGLGP

SEQ ID NO: 1484796 - protein, 19 aa, Mycobacterium tuberculosis
HPSQIPVVRKAYRPSHEKL

SEQ ID NO: 1484797 - protein, 22 aa, Mycobacterium tuberculosis
HPSRSASMFEYWDAPPTGHPLI

SEQ ID NO: 1484798 - protein, 18 aa, Mycobacterium tuberculosis
HPTFPRTRLTPICQLPTA

SEQ ID NO: 1484799 - protein, 23 aa, Mycobacterium tuberculosis
HPTSRFRELICSRAVDIAIGPAS

SEQ ID NO: 1484800 - protein, 21 aa, Mycobacterium tuberculosis
HPVPGDWLYFVTIDSQGTTLF

SEQ ID NO: 1484801 - protein, 28 aa, Mycobacterium tuberculosis
HPVYRRAAHLGRCWSRRGRDRRRLDPET

SEQ ID NO: 1484802 - protein, 17 aa, Mycobacterium tuberculosis
HPYARGVLVEMYREAKA

SEQ ID NO: 1484803 - protein, 30 aa, Mycobacterium tuberculosis
HPYTLTGPIVIGSFFLPAFNIPGIDVPAIN

SEQ ID NO: 1484804 - protein, 21 aa, Mycobacterium tuberculosis
HQELARRCVLAGKDVIVAGHS

SEQ ID NO: 1484805 - protein, 20 aa, Mycobacterium tuberculosis
HQGAPQWRLPGQVAGQLAEV

SEQ ID NO: 1484806 - protein, 17 aa, Mycobacterium tuberculosis
HQGCGPPPPTGPTTVGW

SEQ ID NO: 1484807 - protein, 25 aa, Mycobacterium tuberculosis
HQISRAGNMLSVFFGETPVTDFASA

SEQ ID NO: 1484808 - protein, 27 aa, Mycobacterium tuberculosis
HQISRAGWSGVRWRNLTGGIVALHAGY

SEQ ID NO: 1484809 - protein, 24 aa, Mycobacterium tuberculosis
HQKLTGYENLRFFASLYAGATADP

SEQ ID NO: 1484810 - protein, 19 aa, Mycobacterium tuberculosis
HQLLRSWYILYFQLPWLPE

SEQ ID NO: 1484811 - protein, 18 aa, Mycobacterium tuberculosis
HQLRRAAPEVDFRAVNDR

SEQ ID NO: 1484812 - protein, 17 aa, Mycobacterium tuberculosis
HQQAQFAGGWNSGTANI

SEQ ID NO: 1484813 - protein, 21 aa, Mycobacterium tuberculosis
HRAACIRTELVTGRSAADIYR

SEQ ID NO: 1484814 - protein, 17 aa, Mycobacterium tuberculosis
HRAAPIGSPGRRPGQAL

SEQ ID NO: 1484815 - protein, 17 aa, Mycobacterium tuberculosis
HRAFAYTSNIFIRDYGI

SEQ ID NO: 1484816 - protein, 23 aa, Mycobacterium tuberculosis
HRALPGALGIDVAVGAARYRTAA

SEQ ID NO: 1484817 - protein, 27 aa, Mycobacterium tuberculosis
HRAPALRLGPRMGPLVHRPQPGDRDVG

SEQ ID NO: 1484818 - protein, 28 aa, Mycobacterium tuberculosis
HRAPRRLGVPARWLAVVINYRAERWVGC

SEQ ID NO: 1484819 - protein, 32 aa, Mycobacterium tuberculosis
HRARCTRWICCWAAGLGRTGRWLACPANTGRT

SEQ ID NO: 1484820 - protein, 17 aa, Mycobacterium tuberculosis
HRARSTLRRNLTLMVAA

SEQ ID NO: 1484821 - protein, 27 aa, Mycobacterium tuberculosis
HRCAARPRLRPGIGFVGCRNAYHVGAS

SEQ ID NO: 1484822 - protein, 17 aa, Mycobacterium tuberculosis
HRCAPRFRSGSTANTES

SEQ ID NO: 1484823 - protein, 26 aa, Mycobacterium tuberculosis
HRCERALREHVEWSLLDVLRGAPGAP

SEQ ID NO: 1484824 - protein, 21 aa, Mycobacterium tuberculosis
HRCLSEHGIDISLPHCSSARP

SEQ ID NO: 1484825 - protein, 19 aa, Mycobacterium tuberculosis
HRCPGQLLAGGGVVDVEQR

SEQ ID NO: 1484826 - protein, 17 aa, Mycobacterium tuberculosis
HRDEALHLIRKRAKRLR

SEQ ID NO: 1484827 - protein, 17 aa, Mycobacterium tuberculosis
HRDGRFGPETIWTFCAY

SEQ ID NO: 1484828 - protein, 17 aa, Mycobacterium tuberculosis
HRDKPRSPEGLKRNLRL

SEQ ID NO: 1484829 - protein, 25 aa, Mycobacterium tuberculosis
HRDRTCVVPGCGGPPGVARPHIRHW

SEQ ID NO: 1484830 - protein, 24 aa, Mycobacterium tuberculosis
HRDWLLIELRTDWTVATTRYTAGS

SEQ ID NO: 1484831 - protein, 25 aa, Mycobacterium tuberculosis
HRDWLLIELRTDWTVGHHQVHCRLT

SEQ ID NO: 1484832 - protein, 26 aa, Mycobacterium tuberculosis
HRERLGLPGLRDWLRRQAKAGAGPPE

SEQ ID NO: 1484833 - protein, 22 aa, Mycobacterium tuberculosis
HRETCAGRYSGSVLACTTTSCA

SEQ ID NO: 1484834 - protein, 18 aa, Mycobacterium tuberculosis
HRFLDLRRSPGMLTDPAV

SEQ ID NO: 1484835 - protein, 21 aa, Mycobacterium tuberculosis
HRFYDSCRVLPQGDEQPTDLH

SEQ ID NO: 1484836 - protein, 23 aa, Mycobacterium tuberculosis
HRGHFRFRCVDRLLDSSSDGRSR

SEQ ID NO: 1484837 - protein, 25 aa, Mycobacterium tuberculosis
HRHLLSVLIDREWRHGVRVGVETAL

SEQ ID NO: 1484838 - protein, 21 aa, Mycobacterium tuberculosis
HRHRCPRRAVSTAGSRRTAAR

SEQ ID NO: 1484839 - protein, 19 aa, Mycobacterium tuberculosis
HRHRLPPLAEWGGSGQRRQ

SEQ ID NO: 1484840 - protein, 19 aa, Mycobacterium tuberculosis
HRHRRRFAGGGMRPCGADR

SEQ ID NO: 1484841 - protein, 27 aa, Mycobacterium tuberculosis
HRILKLNIGNPAPFGFEAPDVIMRDII

SEQ ID NO: 1484842 - protein, 19 aa, Mycobacterium tuberculosis
HRKSLTFALRFRAPDRTFN

SEQ ID NO: 1484843 - protein, 18 aa, Mycobacterium tuberculosis
HRLAHWLWQRGARLLARA

SEQ ID NO: 1484844 - protein, 18 aa, Mycobacterium tuberculosis
HRLGRPVFGPSFEVEVDT

SEQ ID NO: 1484845 - protein, 20 aa, Mycobacterium tuberculosis
HRLPGLYGYRVARHDEAKAG

SEQ ID NO: 1484846 - protein, 18 aa, Mycobacterium tuberculosis
HRLPRSPLGAALARTSPR

SEQ ID NO: 1484847 - protein, 23 aa, Mycobacterium tuberculosis
HRLRAEAFTTPELMSAAEIADEL

SEQ ID NO: 1484848 - protein, 21 aa, Mycobacterium tuberculosis
HRMLLEVAWEALEHAGIPPDS

SEQ ID NO: 1484849 - protein, 22 aa, Mycobacterium tuberculosis
HRPSWPAGIAVGKTVVSSSIID

SEQ ID NO: 1484850 - protein, 25 aa, Mycobacterium tuberculosis
HRQPRCLPQRIAVPVTKLKTCRLGI

SEQ ID NO: 1484851 - protein, 22 aa, Mycobacterium tuberculosis
HRRAHGLPAISLGWGLWDQASA

SEQ ID NO: 1484852 - protein, 18 aa, Mycobacterium tuberculosis
HRRDLLVAQHFLKHRAVQ

SEQ ID NO: 1484853 - protein, 24 aa, Mycobacterium tuberculosis
HRRERRGRCARRCRRQRRPRQRRI

SEQ ID NO: 1484854 - protein, 17 aa, Mycobacterium tuberculosis
HRRFQWYRGESRPSQAV

SEQ ID NO: 1484855 - protein, 21 aa, Mycobacterium tuberculosis
HRRHARVGPMAHLLGAEAVHL

SEQ ID NO: 1484856 - protein, 27 aa, Mycobacterium tuberculosis
HRRLRRRADLQLQHLLNDGGFRQWPSH

SEQ ID NO: 1484857 - protein, 23 aa, Mycobacterium tuberculosis
HRRRRPHRRGRTAPPAPPLPISS

SEQ ID NO: 1484858 - protein, 28 aa, Mycobacterium tuberculosis
HRRYWSRRWLGPRIRPYARRGGRQRRGQ

SEQ ID NO: 1484859 - protein, 18 aa, Mycobacterium tuberculosis
HRTRTMLALPPLPPAPGI

SEQ ID NO: 1484860 - protein, 23 aa, Mycobacterium tuberculosis
HRVARGCGVTGCGSRRGGRRRAA

SEQ ID NO: 1484861 - protein, 18 aa, Mycobacterium tuberculosis
HRVARSALSHALLRCPDP

SEQ ID NO: 1484862 - protein, 17 aa, Mycobacterium tuberculosis
HRVGFGSVCEFPGPYPG

SEQ ID NO: 1484863 - protein, 18 aa, Mycobacterium tuberculosis
HRVGFGSVCEFPGPYPGY

SEQ ID NO: 1484864 - protein, 22 aa, Mycobacterium tuberculosis
HRVKLERGVELLIGLEAISEPD

SEQ ID NO: 1484865 - protein, 20 aa, Mycobacterium tuberculosis
HRVLTRCQMSFVVTIPEALA

SEQ ID NO: 1484866 - protein, 21 aa, Mycobacterium tuberculosis
HRVPCAGLVALVMSACSLAVC

SEQ ID NO: 1484867 - protein, 20 aa, Mycobacterium tuberculosis
HRWHCGMLAPPAMMPSKSST

SEQ ID NO: 1484868 - protein, 17 aa, Mycobacterium tuberculosis
HRWPDRQLPGEGVTLGA

SEQ ID NO: 1484869 - protein, 22 aa, Mycobacterium tuberculosis
HRWPDRQLPGEGVTRGAIQVPP

SEQ ID NO: 1484870 - protein, 18 aa, Mycobacterium tuberculosis
HRYGGGLNRGEHLRGRRS

SEQ ID NO: 1484871 - protein, 24 aa, Mycobacterium tuberculosis
HSAAPLFHNIAGWLMQRENGPLSP

SEQ ID NO: 1484872 - protein, 19 aa, Mycobacterium tuberculosis
HSAPPWRSSAWEPSASARC

SEQ ID NO: 1484873 - protein, 17 aa, Mycobacterium tuberculosis
HSARWRPWRSYATQHLW

SEQ ID NO: 1484874 - protein, 19 aa, Mycobacterium tuberculosis
HSCLSRCCRLDCRRRGPAV

SEQ ID NO: 1484875 - protein, 19 aa, Mycobacterium tuberculosis
HSDLRSGHRYTHRIEDVVD

SEQ ID NO: 1484876 - protein, 17 aa, Mycobacterium tuberculosis
HSFDLATEIPLRTWLFR

SEQ ID NO: 1484877 - protein, 30 aa, Mycobacterium tuberculosis; identical to SEQ ID NO: 200853

SEQ ID NO: 1484878 - protein, 29 aa, Mycobacterium tuberculosis
HSGWWRAPLRWTLRGSLALRSHLMVRSSL

SEQ ID NO: 1484879 - protein, 17 aa, Mycobacterium tuberculosis
HSISPWGTWEWIGPPAL

SEQ ID NO: 1484880 - protein, 19 aa, Mycobacterium tuberculosis
HSLAWARLAPVVALEPAPG

SEQ ID NO: 1484881 - protein, 30 aa, Mycobacterium tuberculosis
HSLMPIPRAGRCAYNVHPRSSGDTAITVVL

SEQ ID NO: 1484882 - protein, 22 aa, Mycobacterium tuberculosis
HSLPTDRPIIYATLGSSGGKNL

SEQ ID NO: 1484883 - protein, 22 aa, Mycobacterium tuberculosis
HSMGALHSWCLADERPELVSAL

SEQ ID NO: 1484884 - protein, 25 aa, Mycobacterium tuberculosis
HSPARPRGALGYPEVHQMTKPIRAA

SEQ ID NO: 1484885 - protein, 26 aa, Mycobacterium tuberculosis
HSPDLDWKSVWDHGWSAAAEAADKPV

SEQ ID NO: 1484886 - protein, 32 aa, Mycobacterium tuberculosis
HSRFSTNTFPSWPLAHPFRRIAHNGEINTVTG

SEQ ID NO: 1484887 - protein, 21 aa, Mycobacterium tuberculosis
HSTCMPAAFGGHLGLGDRSRS

SEQ ID NO: 1484888 - protein, 17 aa, Mycobacterium tuberculosis
HSVCTGGLVLAAAGLLN

SEQ ID NO: 1484889 - protein, 26 aa, Mycobacterium tuberculosis
HTAKGLEFPVVFVTGWEDGMFPHMRA

SEQ ID NO: 1484890 - protein, 25 aa, Mycobacterium tuberculosis
HTAQNLYRGIGIAIGKLVARQDADD

SEQ ID NO: 1484891 - protein, 17 aa, Mycobacterium tuberculosis
HTARLALCQATRQVIAN

SEQ ID NO: 1484892 - protein, 18 aa, Mycobacterium tuberculosis
HTEECRKLGLAFAADPSQ

SEQ ID NO: 1484893 - protein, 18 aa, Mycobacterium tuberculosis
HTGGWRVDPLRGLSRPDF

SEQ ID NO: 1484894 - protein, 17 aa, Mycobacterium tuberculosis
HTKRALVRAGFLAGDAL

SEQ ID NO: 1484895 - protein, 18 aa, Mycobacterium tuberculosis
HTKRALVRAGFLAGDALR

SEQ ID NO: 1484896 - protein, 26 aa, Mycobacterium tuberculosis
HTKRLASPAQRIMLFANDRGCTKPGC

SEQ ID NO: 1484897 - protein, 20 aa, Mycobacterium tuberculosis
HTLRARTGRRHTHQPSAASF

SEQ ID NO: 1484898 - protein, 17 aa, Mycobacterium tuberculosis
HTPEIAQGLRAVTDRDV

SEQ ID NO: 1484899 - protein, 20 aa, Mycobacterium tuberculosis
HTPGSIALALGGPVTGGVTQ

SEQ ID NO: 1484900 - protein, 23 aa, Mycobacterium tuberculosis
HTPPPHWRPDVLLVAVGAMSRPC

SEQ ID NO: 1484901 - protein, 26 aa, Mycobacterium tuberculosis
HTRRGRLRAGVRRSIWAGSDEERLCR

SEQ ID NO: 1484902 - protein, 22 aa, Mycobacterium tuberculosis
HTSDAIAAWAAQLAAVTGQLQT

SEQ ID NO: 1484903 - protein, 24 aa, Mycobacterium tuberculosis
HTSGTLACLVRLANPPPRPETAYG

SEQ ID NO: 1484904 - protein, 19 aa, Mycobacterium tuberculosis
HTVAAWPAVCSGLRSEARN

SEQ ID NO: 1484905 - protein, 21 aa, Mycobacterium tuberculosis
HTYRITPLALWNARAAGHDAE

SEQ ID NO: 1484906 - protein, 23 aa, Mycobacterium tuberculosis
HVAEALTLLRCSPGIGKAKNVVA

SEQ ID NO: 1484907 - protein, 19 aa, Mycobacterium tuberculosis
HVAQRLCALAGESDERVAL

SEQ ID NO: 1484908 - protein, 20 aa, Mycobacterium tuberculosis
HVDGVPCCTHIGPDGSGHFV

SEQ ID NO: 1484909 - protein, 17 aa, Mycobacterium tuberculosis
HVENALRLMPENRPRTW

SEQ ID NO: 1484910 - protein, 18 aa, Mycobacterium tuberculosis
HVESARGPPIWDPDVRHH

SEQ ID NO: 1484911 - protein, 17 aa, Mycobacterium tuberculosis
HVFSTRNSANWATMPMD

SEQ ID NO: 1484912 - protein, 21 aa, Mycobacterium tuberculosis
HVGDPEFLPLLRRLGRFLPAD

SEQ ID NO: 1484913 - protein, 23 aa, Mycobacterium tuberculosis
HVGFSVWMLWSIVVVQMTAAAPG

SEQ ID NO: 1484914 - protein, 24 aa, Mycobacterium tuberculosis
HVGIQLYVKRVFIMGDCDQLMPEY

SEQ ID NO: 1484915 - protein, 20 aa, Mycobacterium tuberculosis
HVHVVPRWGGDANFITIIGG

SEQ ID NO: 1484916 - protein, 21 aa, Mycobacterium tuberculosis
HVHVVPRWGGDANFITIIGGL

SEQ ID NO: 1484917 - protein, 21 aa, Mycobacterium tuberculosis
HVINISSVFGLFSAPGQAAYN

SEQ ID NO: 1484918 - protein, 17 aa, Mycobacterium tuberculosis
HVLGAIVERARAGATVL

SEQ ID NO: 1484919 - protein, 36 aa, Mycobacterium tuberculosis
HVLGKLPDAYRIIGRAGGIYGDFFNFYLCDISLKVN

SEQ ID NO: 1484920 - protein, 22 aa, Mycobacterium tuberculosis
HVMCSAGGWIHGQRQSLLQNVT

SEQ ID NO: 1484921 - protein, 40 aa, Mycobacterium tuberculosis
HVPRGRSFPGCRGWPRRTRSSAGFGAPRYGAKPIVVPKPA

SEQ ID NO: 1484922 - protein, 22 aa, Mycobacterium tuberculosis
HVRADAPPFFVLHGRHDSLIPV

SEQ ID NO: 1484923 - protein, 21 aa, Mycobacterium tuberculosis
HVSRGKLLPRERVDRLLDPGS

SEQ ID NO: 1484924 - protein, 21 aa, Mycobacterium tuberculosis
HVVDVPAFRIGRVPVTNGEWQ

SEQ ID NO: 1484925 - protein, 25 aa, Mycobacterium tuberculosis
HVVLQRRQRCGVGRLRADIRADRGA

SEQ ID NO: 1484926 - protein, 22 aa, Mycobacterium tuberculosis
HVVNVLPRRGIGKVDRAALVRR

SEQ ID NO: 1484927 - protein, 20 aa, Mycobacterium tuberculosis
HVVQQRLALLLRDDAATPLL

SEQ ID NO: 1484928 - protein, 23 aa, Mycobacterium tuberculosis
HVVRAVHRCLLAGRFATALGADD

SEQ ID NO: 1484929 - protein, 23 aa, Mycobacterium tuberculosis
HVVRPRLPGGKVSRWPRAGRSMH

SEQ ID NO: 1484930 - protein, 19 aa, Mycobacterium tuberculosis
HVYTKLGFSSRLQLAQAAA

SEQ ID NO: 1484931 - protein, 18 aa, Mycobacterium tuberculosis
HWEVVRIEMPASVARYVV

SEQ ID NO: 1484932 - protein, 22 aa, Mycobacterium tuberculosis
HWFVDRPELIGADGVHPNDAGH

SEQ ID NO: 1484933 - protein, 19 aa, Mycobacterium tuberculosis
HWKAHKLDLAPVLHEPESA

SEQ ID NO: 1484934 - protein, 18 aa, Mycobacterium tuberculosis
HWVDPRPGDSGGRPGVAS

SEQ ID NO: 1484935 - protein, 32 aa, Mycobacterium tuberculosis
HYDCRSTRALRDWLLMRAWEAGVTPIGAQPVP

SEQ ID NO: 1484936 - protein, 17 aa, Mycobacterium tuberculosis
HYLRVYLAQLRRKLEDD

SEQ ID NO: 1484937 - protein, 17 aa, Mycobacterium tuberculosis
HYRMLRLLVGIPPSAKS

SEQ ID NO: 1484938 - protein, 17 aa, Mycobacterium tuberculosis
HYTRLAALDLCPRVRVN

SEQ ID NO: 1484939 - protein, 20 aa, Mycobacterium tuberculosis
HYTYKLDWLAALRDTAEGWL

SEQ ID NO: 1484940 - protein, 20 aa, Mycobacterium tuberculosis
IAAAEAMYEQMWPADVAAMV

SEQ ID NO: 1484941 - protein, 24 aa, Mycobacterium tuberculosis
IAAAMSVVRAFFNVVPFAVRARQS

SEQ ID NO: 1484942 - protein, 17 aa, Mycobacterium tuberculosis
IAAARIVARIGSTAMTV

SEQ ID NO: 1484943 - protein, 25 aa, Mycobacterium tuberculosis
IAAASEFRDGLCFVDLAPIADPGMV

SEQ ID NO: 1484944 - protein, 22 aa, Mycobacterium tuberculosis
IAACGLRRLIPLYATVETALAP

SEQ ID NO: 1484945 - protein, 30 aa, Mycobacterium tuberculosis
IAADLAGCLIFRIGPFFLRDNKVTVNPRFV

SEQ ID NO: 1484946 - protein, 18 aa, Mycobacterium tuberculosis
IAADLAVRLHDWRQRTAD

SEQ ID NO: 1484947 - protein, 23 aa, Mycobacterium tuberculosis
IAAEFAHVFSALGVRVTPGDPGQ

SEQ ID NO: 1484948 - protein, 21 aa, Mycobacterium tuberculosis
IAAFSAVKPSLAWAETYPGTL

SEQ ID NO: 1484949 - protein, 22 aa, Mycobacterium tuberculosis
IAAGTPPIYFGFGSTPVQTPVQ

SEQ ID NO: 1484950 - protein, 17 aa, Mycobacterium tuberculosis
IAALDGWVTDAVEYGGH

SEQ ID NO: 1484951 - protein, 18 aa, Mycobacterium tuberculosis
IAALRAGNLVLMVQPPRG

SEQ ID NO: 1484952 - protein, 23 aa, Mycobacterium tuberculosis
IAALSRLGAVAVLMRPDTDLSAS

SEQ ID NO: 1484953 - protein, 26 aa, Mycobacterium tuberculosis
IAANRARLTSLVTHNVFGQNTASIAA

SEQ ID NO: 1484954 - protein, 17 aa, Mycobacterium tuberculosis
IAAQARERLGFVMPGDI

SEQ ID NO: 1484955 - protein, 17 aa, Mycobacterium tuberculosis
IAARLFVSPRTVQTHLT

SEQ ID NO: 1484956 - protein, 21 aa, Mycobacterium tuberculosis
IAARSRHGRRYQPKRRPPGPP

SEQ ID NO: 1484957 - protein, 19 aa, Mycobacterium tuberculosis
IAATMGFVVGKLAKAPDGS

SEQ ID NO: 1484958 - protein, 20 aa, Mycobacterium tuberculosis
IACGIEAMSRVGLGANAGPD

SEQ ID NO: 1484959 - protein, 21 aa, Mycobacterium tuberculosis
IACGIEAMSRVGLGANAGPGP

SEQ ID NO: 1484960 - protein, 17 aa, Mycobacterium tuberculosis
IACPCAVGLSTPTAISA

SEQ ID NO: 1484961 - protein, 17 aa, Mycobacterium tuberculosis
IADAARWASTDRIVEPS

SEQ ID NO: 1484962 - protein, 20 aa, Mycobacterium tuberculosis
IADACAPAGITVSDVTVDTP

SEQ ID NO: 1484963 - protein, 21 aa, Mycobacterium tuberculosis
IADACAPAGITVSDVTVDTPG

SEQ ID NO: 1484964 - protein, 23 aa, Mycobacterium tuberculosis
IADPRAGLPAAIRVVKQSPLLAI

SEQ ID NO: 1484965 - protein, 23 aa, Mycobacterium tuberculosis
IADTRGGQLLVYGVDPLILRQAY

SEQ ID NO: 1484966 - protein, 19 aa, Mycobacterium tuberculosis
IAEANVLALKAGWNYGETT

SEQ ID NO: 1484967 - protein, 27 aa, Mycobacterium tuberculosis
IAEGMGVPARRVTTCEEFADALRAAFA

SEQ ID NO: 1484968 - protein, 23 aa, Mycobacterium tuberculosis
IAEHEMPGLMSLRREYAEVQPLK

SEQ ID NO: 1484969 - protein, 26 aa, Mycobacterium tuberculosis
IAEPLPRTLVWSAAWEMTREAELRAR

SEQ ID NO: 1484970 - protein, 24 aa, Mycobacterium tuberculosis
IAESPIDWDIAWPAGDLQVNLTPA

SEQ ID NO: 1484971 - protein, 19 aa, Mycobacterium tuberculosis
IAFETSWLDPFTEFRFPRI

SEQ ID NO: 1484972 - protein, 21 aa, Mycobacterium tuberculosis
IAGEFGRAWFVDLAPITDPDL

SEQ ID NO: 1484973 - protein, 17 aa, Mycobacterium tuberculosis
IAGSQVLKKAAALAQPV

SEQ ID NO: 1484974 - protein, 23 aa, Mycobacterium tuberculosis
IAGSVPVELNVSAGFDVTELPNA

SEQ ID NO: 1484975 - protein, 17 aa, Mycobacterium tuberculosis
IAGTGGRGGNGGHGGLW

SEQ ID NO: 1484976 - protein, 25 aa, Mycobacterium tuberculosis
IAGVGRAASHARHCKQDGKQQREDP

SEQ ID NO: 1484977 - protein, 17 aa, Mycobacterium tuberculosis
IAGWPLDRDRPLWEMWV

SEQ ID NO: 1484978 - protein, 24 aa, Mycobacterium tuberculosis
IAHCPTRCWASLAPVVRVTAAATP

SEQ ID NO: 1484979 - protein, 18 aa, Mycobacterium tuberculosis
IAHGRPTSHYRFRTSAGS

SEQ ID NO: 1484980 - protein, 18 aa, Mycobacterium tuberculosis
IAIDLSVTTPFIPINEQM

SEQ ID NO: 1484981 - protein, 17 aa, Mycobacterium tuberculosis
IAIVGMACRYPGGVNSP

SEQ ID NO: 1484982 - protein, 20 aa, Mycobacterium tuberculosis
IAKRELRGVPARAVKSPADL

SEQ ID NO: 1484983 - protein, 24 aa, Mycobacterium tuberculosis
IALNGSDYARMWIQAATTMASYQA

SEQ ID NO: 1484984 - protein, 19 aa, Mycobacterium tuberculosis
IALQFKRRYPEMFTAYEKA

SEQ ID NO: 1484985 - protein, 17 aa, Mycobacterium tuberculosis
IALRSQRYFRLLDALDA

SEQ ID NO: 1484986 - protein, 18 aa, Mycobacterium tuberculosis
IALSLPLGAGRLTREWLP

SEQ ID NO: 1484987 - protein, 17 aa, Mycobacterium tuberculosis
IALTPARLLMVVITDSG

SEQ ID NO: 1484988 - protein, 18 aa, Mycobacterium tuberculosis
IALTTRWIGTNANSSAHH

SEQ ID NO: 1484989 - protein, 26 aa, Mycobacterium tuberculosis
IAMLACARLGIMHSVVFGGFTAAALQ

SEQ ID NO: 1484990 - protein, 17 aa, Mycobacterium tuberculosis
IANPEMLAAAATDLAGI

SEQ ID NO: 1484991 - protein, 17 aa, Mycobacterium tuberculosis
IANQRGGIVLGTGDLSE

SEQ ID NO: 1484992 - protein, 29 aa, Mycobacterium tuberculosis
IANRLGLIDPDAWAFVWVVDPPLFEPADE

SEQ ID NO: 1484993 - protein, 23 aa, Mycobacterium tuberculosis
IANRVSYFYDFHGPSVTIDTACS

SEQ ID NO: 1484994 - protein, 25 aa, Mycobacterium tuberculosis
IAPRIEHPPVPGARVKEPHITGPRI

SEQ ID NO: 1484995 - protein, 18 aa, Mycobacterium tuberculosis
IAPSRFHVVPVLAYSPDP

SEQ ID NO: 1484996 - protein, 17 aa, Mycobacterium tuberculosis
IAQGIPRVHRWARGGTC

SEQ ID NO: 1484997 - protein, 17 aa, Mycobacterium tuberculosis
IAQVLDWFISFVSGPVF

SEQ ID NO: 1484998 - protein, 22 aa, Mycobacterium tuberculosis
IARAGTSGGAGRGPVGGIGGAG

SEQ ID NO: 1484999 - protein, 23 aa, Mycobacterium tuberculosis
IARDRAEAIAGLRALAAGQPRVG

SEQ ID NO: 1485000 - protein, 19 aa, Mycobacterium tuberculosis
IARLVWRLCKIDGKPSRYR

SEQ ID NO: 1485001 - protein, 18 aa, Mycobacterium tuberculosis
IARRVREARVFSEVIPHT

SEQ ID NO: 1485002 - protein, 24 aa, Mycobacterium tuberculosis
IARVESRLAYFFRIRGHGTDDSEA

SEQ ID NO: 1485003 - protein, 17 aa, Mycobacterium tuberculosis
IASIFAWTRGLQHRGKL

SEQ ID NO: 1485004 - protein, 17 aa, Mycobacterium tuberculosis
IASKGGYEAVQMRAVAD

SEQ ID NO: 1485005 - protein, 18 aa, Mycobacterium tuberculosis
IASLEMQHLISLGPNAPS

SEQ ID NO: 1485006 - protein, 17 aa, Mycobacterium tuberculosis
IATAVARTVTARLHADD

SEQ ID NO: 1485007 - protein, 24 aa, Mycobacterium tuberculosis
IATDDARFGIRWASSASRRASPRR

SEQ ID NO: 1485008 - protein, 24 aa, Mycobacterium tuberculosis
IATDHLMRFPGRFSEQLLPEHLHK

SEQ ID NO: 1485009 - protein, 17 aa, Mycobacterium tuberculosis
IAVAAFFAKNMLPKLTG

SEQ ID NO: 1485010 - protein, 22 aa, Mycobacterium tuberculosis
IAVDGAHLWHPYSSIGREAVSP

SEQ ID NO: 1485011 - protein, 21 aa, Mycobacterium tuberculosis
IAVDLRDDWPQALRDSGFDAA

SEQ ID NO: 1485012 - protein, 23 aa, Mycobacterium tuberculosis
IAVESRSGITPVTIDLSAVTHLG

SEQ ID NO: 1485013 - protein, 17 aa, Mycobacterium tuberculosis
IAVGVSFGGLVTRSFSP

SEQ ID NO: 1485014 - protein, 17 aa, Mycobacterium tuberculosis
IAVSATRPPAVLHRIRQ

SEQ ID NO: 1485015 - protein, 21 aa, Mycobacterium tuberculosis
IAVSQLFGRYGQEFQTVSNQL

SEQ ID NO: 1485016 - protein, 22 aa, Mycobacterium tuberculosis
IAWRGERRFVERLSRATIDVSK

SEQ ID NO: 1485017 - protein, 21 aa, Mycobacterium tuberculosis
IAYALAGTMDFDFQTQPLGQD

SEQ ID NO: 1485018 - protein, 19 aa, Mycobacterium tuberculosis
ICAPANHWSVRTVGDLGLI

SEQ ID NO: 1485019 - protein, 25 aa, Mycobacterium tuberculosis
ICGPETLRSLYFLSSRVSGGSPHAI

SEQ ID NO: 1485020 - protein, 17 aa, Mycobacterium tuberculosis
ICGTCVATCTAGRYQMG

SEQ ID NO: 1485021 - protein, 21 aa, Mycobacterium tuberculosis
ICSAIQAGSRLGYQESAELCA

SEQ ID NO: 1485022 - protein, 22 aa, Mycobacterium tuberculosis
ICSDGNRWRAHLGYVPGMTNQA

SEQ ID NO: 1485023 - protein, 25 aa, Mycobacterium tuberculosis
ICSDGNRWRAHLGYVPGMTNQAARF

SEQ ID NO: 1485024 - protein, 29 aa, Mycobacterium tuberculosis
ICTHRLLQTGVRWKDLGLVVVDQEQRFRV

SEQ ID NO: 1485025 - protein, 29 aa, Mycobacterium tuberculosis
IDAAEIYVPFSWFEPMWLENLGFAREGEG

SEQ ID NO: 1485026 - protein, 17 aa, Mycobacterium tuberculosis
IDACHARRLGVLIDAVF

SEQ ID NO: 1485027 - protein, 27 aa, Mycobacterium tuberculosis
IDAGALPTRYARGWHCLGVAKDYLEGK

SEQ ID NO: 1485028 - protein, 33 aa, Mycobacterium tuberculosis
IDAITLFPGGLTFPANSLLNLDVFVGTPGATIP

SEQ ID NO: 1485029 - protein, 21 aa, Mycobacterium tuberculosis
IDALSRPGSWLASNVPGAGFL

SEQ ID NO: 1485030 - protein, 32 aa, Mycobacterium tuberculosis
IDAMSSRCFPSYALRRRAKALGSLTQMELLMI

SEQ ID NO: 1485031 - protein, 17 aa, Mycobacterium tuberculosis
IDASGSVDIGILSGTVL

SEQ ID NO: 1485032 - protein, 21 aa, Mycobacterium tuberculosis
IDCGERWAVFNAGMGVDAEVV

SEQ ID NO: 1485033 - protein, 26 aa, Mycobacterium tuberculosis
IDDALELRGRILGAFEAAEVSTDHAE

SEQ ID NO: 1485034 - protein, 18 aa, Mycobacterium tuberculosis
IDDFAEWLQRFEANLGAL

SEQ ID NO: 1485035 - protein, 23 aa, Mycobacterium tuberculosis
IDEWRAEVMPEDKLAAVRELQDD

SEQ ID NO: 1485036 - protein, 23 aa, Mycobacterium tuberculosis
IDFRRKNEPPGIAQITLGKNKDR

SEQ ID NO: 1485037 - protein, 17 aa, Mycobacterium tuberculosis
IDGAFAHMALCMALSTS

SEQ ID NO: 1485038 - protein, 27 aa, Mycobacterium tuberculosis
IDGIERGRIAILLKVHHALIDGEGGLR

SEQ ID NO: 1485039 - protein, 17 aa, Mycobacterium tuberculosis
IDGLIAILTFPPAESVF

SEQ ID NO: 1485040 - protein, 23 aa, Mycobacterium tuberculosis
IDGLPFSWTVASWTQHSSNLTVA

SEQ ID NO: 1485041 - protein, 24 aa, Mycobacterium tuberculosis
IDGLPFSWTVASWTQHSSNLTVAI

SEQ ID NO: 1485042 - protein, 18 aa, Mycobacterium tuberculosis
IDGNYHWQGTVFDSLPET

SEQ ID NO: 1485043 - protein, 19 aa, Mycobacterium tuberculosis
IDGRCRGFRIAQLPSTALM

SEQ ID NO: 1485044 - protein, 22 aa, Mycobacterium tuberculosis
IDGRPVSAFGCDGVLVSTPTGS

SEQ ID NO: 1485045 - protein, 18 aa, Mycobacterium tuberculosis
IDGVPWSQMAVIVRSVPR

SEQ ID NO: 1485046 - protein, 18 aa, Mycobacterium tuberculosis
IDGYRVLTDPVWSDRCSP

SEQ ID NO: 1485047 - protein, 21 aa, Mycobacterium tuberculosis
IDHIIGLFRLWWIPDGAPPTQ

SEQ ID NO: 1485048 - protein, 22 aa, Mycobacterium tuberculosis
IDHIIGLFRLWWIPDGAPPTQG

SEQ ID NO: 1485049 - protein, 28 aa, Mycobacterium tuberculosis
IDHLRRHSLPLFGYAAMPAYDVARLGSH

SEQ ID NO: 1485050 - protein, 26 aa, Mycobacterium tuberculosis
IDHLRRHSLPLFGYAAMPAYDVVDGV

SEQ ID NO: 1485051 - protein, 22 aa, Mycobacterium tuberculosis
IDHSAPWPLGPTHPSNLKCACR

SEQ ID NO: 1485052 - protein, 17 aa, Mycobacterium tuberculosis
IDIGKNGQINLGFGNTG

SEQ ID NO: 1485053 - protein, 22 aa, Mycobacterium tuberculosis
IDIPITGSFTDLVVDNFTIPII

SEQ ID NO: 1485054 - protein, 24 aa, Mycobacterium tuberculosis
IDIPPMDFTLGLPVLGPITGQLGP

SEQ ID NO: 1485055 - protein, 19 aa, Mycobacterium tuberculosis
IDKVFVVACGTAYHSGLLA

SEQ ID NO: 1485056 - protein, 20 aa, Mycobacterium tuberculosis
IDKVFVVACGTAYHSGLLAK

SEQ ID NO: 1485057 - protein, 20 aa, Mycobacterium tuberculosis
IDLEMRRPTYVFAAVDHTGA

SEQ ID NO: 1485058 - protein, 17 aa, Mycobacterium tuberculosis
IDLGGGGLIYLENLPHV

SEQ ID NO: 1485059 - protein, 29 aa, Mycobacterium tuberculosis
IDLHDPPPCMTGFLPPPLVRSPADESVRE

SEQ ID NO: 1485060 - protein, 26 aa, Mycobacterium tuberculosis
IDLILPIGKVNAAFIVSAVQRVKTTI

SEQ ID NO: 1485061 - protein, 18 aa, Mycobacterium tuberculosis
IDLLELIKMGGHADPGSG

SEQ ID NO: 1485062 - protein, 17 aa, Mycobacterium tuberculosis
IDLNGQVLGVVFGAAVD

SEQ ID NO: 1485063 - protein, 18 aa, Mycobacterium tuberculosis
IDLNGQVLGVVFGAAVDD

SEQ ID NO: 1485064 - protein, 25 aa, Mycobacterium tuberculosis
IDLRADWPAALQAAWPGLVRHRTCM

SEQ ID NO: 1485065 - protein, 19 aa, Mycobacterium tuberculosis
IDLTIRWDTPPITLFPNGI

SEQ ID NO: 1485066 - protein, 25 aa, Mycobacterium tuberculosis
IDLVPEYIGNLLLYFQPDATVTMLD

SEQ ID NO: 1485067 - protein, 20 aa, Mycobacterium tuberculosis
IDNIRYFAELCGVDRQAADE

SEQ ID NO: 1485068 - protein, 21 aa, Mycobacterium tuberculosis
IDNLRAAFAVQPREWRYRPRV

SEQ ID NO: 1485069 - protein, 20 aa, Mycobacterium tuberculosis
IDPALVGRKVELVFDPFDLT

SEQ ID NO: 1485070 - protein, 22 aa, Mycobacterium tuberculosis
IDPDYLRRILTAVLDNAITHGD

SEQ ID NO: 1485071 - protein, 25 aa, Mycobacterium tuberculosis
IDPELRRPITELGMVKSIDTGPDGS

SEQ ID NO: 1485072 - protein, 27 aa, Mycobacterium tuberculosis
IDPITVLRPIHIPPIPVGFAAVGGIGP

SEQ ID NO: 1485073 - protein, 25 aa, Mycobacterium tuberculosis
IDPQHRLLLEVSWEAIEHAGVDPAT

SEQ ID NO: 1485074 - protein, 17 aa, Mycobacterium tuberculosis
IDPTGLRGSAHWGIRPG

SEQ ID NO: 1485075 - protein, 17 aa, Mycobacterium tuberculosis
IDPVRFIGNRSSGKQGY

SEQ ID NO: 1485076 - protein, 22 aa, Mycobacterium tuberculosis
IDPYLRPLHDALYDMMDPELIP

SEQ ID NO: 1485077 - protein, 25 aa, Mycobacterium tuberculosis
IDRCWAPKVHGAWNIHRATAAQPLE

SEQ ID NO: 1485078 - protein, 19 aa, Mycobacterium tuberculosis
IDRFPLEMVQRYVNDQRGD

SEQ ID NO: 1485079 - protein, 20 aa, Mycobacterium tuberculosis
IDRGYPLFVENLVSLGAEIE

SEQ ID NO: 1485080 - protein, 17 aa, Mycobacterium tuberculosis
IDRLAVWNMVATVDAFL

SEQ ID NO: 1485081 - protein, 24 aa, Mycobacterium tuberculosis
IDRMGRRPGVRWAADLLSAADALT

SEQ ID NO: 1485082 - protein, 25 aa, Mycobacterium tuberculosis
IDRPLRPSFVDGLRDEIQIVVTILS

SEQ ID NO: 1485083 - protein, 29 aa, Mycobacterium tuberculosis
IDSFAPRLSFFWGIGMNFFMEVAKLRAGR

SEQ ID NO: 1485084 - protein, 19 aa, Mycobacterium tuberculosis
IDTIYVWTHDSIGLGEDGP

SEQ ID NO: 1485085 - protein, 17 aa, Mycobacterium tuberculosis
IDTPVLVAFCARSPHGV

SEQ ID NO: 1485086 - protein, 17 aa, Mycobacterium tuberculosis
IDVARVYAHHVVERQLA

SEQ ID NO: 1485087 - protein, 19 aa, Mycobacterium tuberculosis
IDVGWSLVKTRAMFEHRAV

SEQ ID NO: 1485088 - protein, 19 aa, Mycobacterium tuberculosis
IDVHNVMTFGGNMITVTEA

SEQ ID NO: 1485089 - protein, 19 aa, Mycobacterium tuberculosis
IDVSFPLGVLTSVTGVSGS

SEQ ID NO: 1485090 - protein, 23 aa, Mycobacterium tuberculosis
IDVSPEYGYELVLSATRLAELLA

SEQ ID NO: 1485091 - protein, 18 aa, Mycobacterium tuberculosis
IDVSSIKELCRRWYPRIY

SEQ ID NO: 1485092 - protein, 17 aa, Mycobacterium tuberculosis
IDWQAYFHLRNRLVVAA

SEQ ID NO: 1485093 - protein, 18 aa, Mycobacterium tuberculosis
IDWVVVCMHQTAISTADD

SEQ ID NO: 1485094 - protein, 20 aa, Mycobacterium tuberculosis
IDYLHRWDPARWPLPVLPSS

SEQ ID NO: 1485095 - protein, 23 aa, Mycobacterium tuberculosis
IDYLRSRLTGIAGEGNKEIDDVL

SEQ ID NO: 1485096 - protein, 24 aa, Mycobacterium tuberculosis
IEANRLGDMVAELIELSRLQGAER

SEQ ID NO: 1485097 - protein, 17 aa, Mycobacterium tuberculosis
IEAQGWIAPAECVEVRV

SEQ ID NO: 1485098 - protein, 17 aa, Mycobacterium tuberculosis
IEARALGTVLGRGRPED

SEQ ID NO: 1485099 - protein, 18 aa, Mycobacterium tuberculosis
IEARALGTVLGRGRPEDS

SEQ ID NO: 1485100 - protein, 21 aa, Mycobacterium tuberculosis
IEARALGTVLGRGRPEDSPLL

SEQ ID NO: 1485101 - protein, 17 aa, Mycobacterium tuberculosis
IEDCARAEVAAGARRLS

SEQ ID NO: 1485102 - protein, 18 aa, Mycobacterium tuberculosis
IEDLHIWTAESVRADRLD

SEQ ID NO: 1485103 - protein, 19 aa, Mycobacterium tuberculosis
IEDLHIWTAESVRADRLDF

SEQ ID NO: 1485104 - protein, 21 aa, Mycobacterium tuberculosis
IEEARGALIEGIIEESEDESL

SEQ ID NO: 1485105 - protein, 19 aa, Mycobacterium tuberculosis
IEEHLRFISPIQNICRTTR

SEQ ID NO: 1485106 - protein, 26 aa, Mycobacterium tuberculosis
IEESIYGWKEFELELMRDGHDNVVVV

SEQ ID NO: 1485107 - protein, 27 aa, Mycobacterium tuberculosis
IEESIYGWKEFELELMRDGHDNVVVVC

SEQ ID NO: 1485108 - protein, 17 aa, Mycobacterium tuberculosis
IEFQRQYITAAGRTLAC

SEQ ID NO: 1485109 - protein, 19 aa, Mycobacterium tuberculosis
IEGRGWPVLGDKTIVDYLA

SEQ ID NO: 1485110 - protein, 20 aa, Mycobacterium tuberculosis
IEGRGWPVLGDKTIVDYLAE

SEQ ID NO: 1485111 - protein, 22 aa, Mycobacterium tuberculosis
IEHARTWPGHMGAAMANAYSAN

SEQ ID NO: 1485112 - protein, 18 aa, Mycobacterium tuberculosis
IEKPRIPDVCDALGVPWL

SEQ ID NO: 1485113 - protein, 21 aa, Mycobacterium tuberculosis
IEKYLGWSRRQIDLHNQGLRN

SEQ ID NO: 1485114 - protein, 23 aa, Mycobacterium tuberculosis
IELALRLGATVERVAEASGVDPW

SEQ ID NO: 1485115 - protein, 20 aa, Mycobacterium tuberculosis
IELGIKWLSLYAFSTENWKR

SEQ ID NO: 1485116 - protein, 24 aa, Mycobacterium tuberculosis
IELIPRPFTRTVIVDGQAHTDDML

SEQ ID NO: 1485117 - protein, 21 aa, Mycobacterium tuberculosis
IELLKGWCGPPSIGSPTSARA

SEQ ID NO: 1485118 - protein, 22 aa, Mycobacterium tuberculosis
IELRTGGAYRWTVTPGHSAAGT

SEQ ID NO: 1485119 - protein, 17 aa, Mycobacterium tuberculosis
IEMIPIPMLQDGPDVDL

SEQ ID NO: 1485120 - protein, 17 aa, Mycobacterium tuberculosis
IEMIPIPMLQDGTDVDL

SEQ ID NO: 1485121 - protein, 19 aa, Mycobacterium tuberculosis
IEMIPPRYVEYRGARFPEL

SEQ ID NO: 1485122 - protein, 18 aa, Mycobacterium tuberculosis
IEPAEPIANVILQTISDR

SEQ ID NO: 1485123 - protein, 17 aa, Mycobacterium tuberculosis
IEPEWLSSVSTIGVTAG

SEQ ID NO: 1485124 - protein, 32 aa, Mycobacterium tuberculosis
IEPNLKPGDALFFGHGLNVHFGLIKPPADVAV

SEQ ID NO: 1485125 - protein, 20 aa, Mycobacterium tuberculosis
IEPRSGRHLGNFPQAFTHLA

SEQ ID NO: 1485126 - protein, 18 aa, Mycobacterium tuberculosis
IEQMPLDAGHSWRRNIAL

SEQ ID NO: 1485127 - protein, 27 aa, Mycobacterium tuberculosis
IERGEPWPQPVPEPAFKAAIAQATQAA

SEQ ID NO: 1485128 - protein, 27 aa, Mycobacterium tuberculosis
IERLVRARGCAKWLASEDFSQAIDHLR

SEQ ID NO: 1485129 - protein, 18 aa, Mycobacterium tuberculosis
IERRCMLYAGTTVVSGTA

SEQ ID NO: 1485130 - protein, 17 aa, Mycobacterium tuberculosis
IESWDSSGSVYARLMDI

SEQ ID NO: 1485131 - protein, 20 aa, Mycobacterium tuberculosis
IEVFLVMPFTTDFMKLTPDR

SEQ ID NO: 1485132 - protein, 28 aa, Mycobacterium tuberculosis
IEVPAPPFWGSRIVKGLAVADYTGLLDE

SEQ ID NO: 1485133 - protein, 20 aa, Mycobacterium tuberculosis
IEVRLAGAPMGRAIPYHIGR

SEQ ID NO: 1485134 - protein, 20 aa, Mycobacterium tuberculosis
IEVVTPWRCSPRQAVLPART

SEQ ID NO: 1485135 - protein, 17 aa, Mycobacterium tuberculosis
IEVYPHPATGGAVSATP

SEQ ID NO: 1485136 - protein, 24 aa, Mycobacterium tuberculosis
IEVYPHPATVALFRLPRALKYKAK

SEQ ID NO: 1485137 - protein, 19 aa, Mycobacterium tuberculosis
IEWKLECRGMPKVCADIRD

SEQ ID NO: 1485138 - protein, 17 aa, Mycobacterium tuberculosis
IEYEIKDPGLAGVTITD

SEQ ID NO: 1485139 - protein, 33 aa, Mycobacterium tuberculosis; identical to SEQ ID NO: 233697

SEQ ID NO: 1485140 - protein, 17 aa, Mycobacterium tuberculosis
IFAEAVFQKRAPANRPD

SEQ ID NO: 1485141 - protein, 18 aa, Mycobacterium tuberculosis
IFGAYGRQCQVLSAQASA

SEQ ID NO: 1485142 - protein, 38 aa, Mycobacterium tuberculosis
IFGPTRDWECYCGKYKRVRFKGIICERCGVEVTRAKVR

SEQ ID NO: 1485143 - protein, 20 aa, Mycobacterium tuberculosis
IFIGECKVWSGPRTMDDALK

SEQ ID NO: 1485144 - protein, 20 aa, Mycobacterium tuberculosis
IFIGECKVWSGPRTMDDVLK

SEQ ID NO: 1485145 - protein, 33 aa, Mycobacterium tuberculosis
IFKDTLIMSYEWPEDRQSLSWTLESSSLLKSLE

SEQ ID NO: 1485146 - protein, 23 aa, Mycobacterium tuberculosis
IFTWDLPGRCNIRAMNYPINAHL

SEQ ID NO: 1485147 - protein, 17 aa, Mycobacterium tuberculosis
IFVMSRITGWTAHIMEQ

SEQ ID NO: 1485148 - protein, 18 aa, Mycobacterium tuberculosis
IGAGRGRPPVPDRRRGGC

SEQ ID NO: 1485149 - protein, 18 aa, Mycobacterium tuberculosis
IGAILPLLAGVADPSNFG

SEQ ID NO: 1485150 - protein, 19 aa, Mycobacterium tuberculosis
IGALNSGIGNLGFGNSGNN

SEQ ID NO: 1485151 - protein, 21 aa, Mycobacterium tuberculosis
IGALNSGIGNMGFGNSGNNNI

SEQ ID NO: 1485152 - protein, 18 aa, Mycobacterium tuberculosis
IGAPDAWEVQGRGELALA

SEQ ID NO: 1485153 - protein, 22 aa, Mycobacterium tuberculosis
IGATIAEVFARDGPHGAAIDVE

SEQ ID NO: 1485154 - protein, 18 aa, Mycobacterium tuberculosis
IGAYLWVRRHSRVPRLGD

SEQ ID NO: 1485155 - protein, 30 aa, Mycobacterium tuberculosis; identical to SEQ ID NO: 233700

SEQ ID NO: 1485156 - protein, 20 aa, Mycobacterium tuberculosis
IGEAGSPVWHQLTTRDYRSV

SEQ ID NO: 1485157 - protein, 17 aa, Mycobacterium tuberculosis
IGEGLRFVYTGNVHDAV

SEQ ID NO: 1485158 - protein, 18 aa, Mycobacterium tuberculosis
IGEICRYLLNQPAKPTDR

SEQ ID NO: 1485159 - protein, 23 aa, Mycobacterium tuberculosis
IGERSSHTWFVLTHLLGKADVRN

SEQ ID NO: 1485160 - protein, 31 aa, Mycobacterium tuberculosis
IGFAHTRTGYIRIGLVGDHRTGIGGLNSGIG

SEQ ID NO: 1485161 - protein, 17 aa, Mycobacterium tuberculosis
IGFEPLQWVRALAAEDP

SEQ ID NO: 1485162 - protein, 17 aa, Mycobacterium tuberculosis
IGFGGPDVREGPGRAPR

SEQ ID NO: 1485163 - protein, 18 aa, Mycobacterium tuberculosis
IGFRGWLAAAEGWGLANE

SEQ ID NO: 1485164 - protein, 19 aa, Mycobacterium tuberculosis
IGGAAINILANAGAGGAGG

SEQ ID NO: 1485165 - protein, 26 aa, Mycobacterium tuberculosis
IGGAGGRSGLFEVLAAGGAGGTGGLS

SEQ ID NO: 1485166 - protein, 17 aa, Mycobacterium tuberculosis
IGGFAVNVGNGVGGLGG

SEQ ID NO: 1485167 - protein, 19 aa, Mycobacterium tuberculosis
IGGLGGFVVAFGANGDVGR

SEQ ID NO: 1485168 - protein, 20 aa, Mycobacterium tuberculosis
IGGLNSGRGNIGLFNSGTNN

SEQ ID NO: 1485169 - protein, 17 aa, Mycobacterium tuberculosis
IGGNAIVAGGAGGNGGA

SEQ ID NO: 1485170 - protein, 23 aa, Mycobacterium tuberculosis
IGGQRAAAHWPGRSSGRRDFAGG

SEQ ID NO: 1485171 - protein, 18 aa, Mycobacterium tuberculosis
IGGQVLLPANGRAFTSGK

SEQ ID NO: 1485172 - protein, 23 aa, Mycobacterium tuberculosis
IGGSMGRYGGVWAHDETRKSFSI

SEQ ID NO: 1485173 - protein, 17 aa, Mycobacterium tuberculosis
IGGSVAARGGCHVAHQT

SEQ ID NO: 1485174 - protein, 20 aa, Mycobacterium tuberculosis
IGGTRWGDPRQRLMPANSDA

SEQ ID NO: 1485175 - protein, 19 aa, Mycobacterium tuberculosis
IGHGASIYSSCAVPPLVAY

SEQ ID NO: 1485176 - protein, 22 aa, Mycobacterium tuberculosis
IGHLEAAAGIAGFIKATLAVQR

SEQ ID NO: 1485177 - protein, 24 aa, Mycobacterium tuberculosis
IGIGLLVDGRWRWRSYSLTSSPAA

SEQ ID NO: 1485178 - protein, 20 aa, Mycobacterium tuberculosis
IGILPRHIPLVAQLVDDAMV

SEQ ID NO: 1485179 - protein, 22 aa, Mycobacterium tuberculosis
IGILPRHIPLVAQLVDDAMVRV

SEQ ID NO: 1485180 - protein, 18 aa, Mycobacterium tuberculosis
IGITCHRTGPNAPCVELS

SEQ ID NO: 1485181 - protein, 18 aa, Mycobacterium tuberculosis
IGKAAPVGLFVETFGTET

SEQ ID NO: 1485182 - protein, 17 aa, Mycobacterium tuberculosis
IGKRCLLGANSGLGISL

SEQ ID NO: 1485183 - protein, 29 aa, Mycobacterium tuberculosis
IGKSYRFRRLELARFLAALHATVLDNPVQ

SEQ ID NO: 1485184 - protein, 18 aa, Mycobacterium tuberculosis
IGLAIAKRAARDGANIAL

SEQ ID NO: 1485185 - protein, 17 aa, Mycobacterium tuberculosis
IGLAKRLEEVWVPSEPD

SEQ ID NO: 1485186 - protein, 17 aa, Mycobacterium tuberculosis
IGLALNCEIVPWCRFAR

SEQ ID NO: 1485187 - protein, 26 aa, Mycobacterium tuberculosis
IGLDPVLRVELWDRFTALARRGTTLL

SEQ ID NO: 1485188 - protein, 18 aa, Mycobacterium tuberculosis
IGLHRLPVTLVLDRAGVT

SEQ ID NO: 1485189 - protein, 18 aa, Mycobacterium tuberculosis
IGLLPRLEGTVHINIGLL

SEQ ID NO: 1485190 - protein, 18 aa, Mycobacterium tuberculosis
IGLRGADVTKTFTNIQKR

SEQ ID NO: 1485191 - protein, 17 aa, Mycobacterium tuberculosis
IGLVPRDRERVVAVAKE

SEQ ID NO: 1485192 - protein, 17 aa, Mycobacterium tuberculosis
IGMGNNFIQSTKTLGLI

SEQ ID NO: 1485193 - protein, 17 aa, Mycobacterium tuberculosis
IGMGYAIAAAVETGRPV

SEQ ID NO: 1485194 - protein, 23 aa, Mycobacterium tuberculosis
IGNGGDGGPGMFGGPGGAGGSGG

SEQ ID NO: 1485195 - protein, 18 aa, Mycobacterium tuberculosis
IGNPAPFGFEAPDVIMRD

SEQ ID NO: 1485196 - protein, 22 aa, Mycobacterium tuberculosis
IGNTEWPKWETVMAADPVDPAE

SEQ ID NO: 1485197 - protein, 19 aa, Mycobacterium tuberculosis
IGNTGNWNVGMGLTGHGQI

SEQ ID NO: 1485198 - protein, 34 aa, Mycobacterium tuberculosis
IGPGGDFTYRFSVPDPGTYWAHPHVGLQGDHGLY

SEQ ID NO: 1485199 - protein, 17 aa, Mycobacterium tuberculosis
IGPIPLSTFVLGVTLAG

SEQ ID NO: 1485200 - protein, 17 aa, Mycobacterium tuberculosis
IGPRASTGAARRPPGSA

SEQ ID NO: 1485201 - protein, 18 aa, Mycobacterium tuberculosis
IGQVAADLLRFGDSQGSV

SEQ ID NO: 1485202 - protein, 18 aa, Mycobacterium tuberculosis
IGQVGALAVVLGVGAAVT

SEQ ID NO: 1485203 - protein, 18 aa, Mycobacterium tuberculosis
IGRGSGLAAQGLAEVCAA

SEQ ID NO: 1485204 - protein, 18 aa, Mycobacterium tuberculosis
IGRLRWQFERIARGVPVA

SEQ ID NO: 1485205 - protein, 19 aa, Mycobacterium tuberculosis
IGRLRWQFERIARGVPVAA

SEQ ID NO: 1485206 - protein, 17 aa, Mycobacterium tuberculosis
IGRRPVVVLSRDAAIPR

SEQ ID NO: 1485207 - protein, 23 aa, Mycobacterium tuberculosis
IGSRCVVGAGALLLGDADADGVY

SEQ ID NO: 1485208 - protein, 23 aa, Mycobacterium tuberculosis
IGSRCVVGAGALLLRDADADGVY

SEQ ID NO: 1485209 - protein, 17 aa, Mycobacterium tuberculosis
IGSSIGAANAAAAGSTT

SEQ ID NO: 1485210 - protein, 17 aa, Mycobacterium tuberculosis
IGSSIGVANSAAAGSTT

SEQ ID NO: 1485211 - protein, 26 aa, Mycobacterium tuberculosis
IGVEAGLIGPEWFPDSYPWVPSINPG

SEQ ID NO: 1485212 - protein, 20 aa, Mycobacterium tuberculosis
IGVLYGRRELLAQMPPFLTG

SEQ ID NO: 1485213 - protein, 31 aa, Mycobacterium tuberculosis
IGVLYGRRELLAQMPPFLTGGSMIETVTMEG

SEQ ID NO: 1485214 - protein, 17 aa, Mycobacterium tuberculosis
IGWLTDCDYEWTQHWRV

SEQ ID NO: 1485215 - protein, 17 aa, Mycobacterium tuberculosis
IGWNPRFIVVGANADLG

SEQ ID NO: 1485216 - protein, 22 aa, Mycobacterium tuberculosis
IGYSCAGTVEFLLDERGEYVFI

SEQ ID NO: 1485217 - protein, 21 aa, Mycobacterium tuberculosis
IHFEPRIHRVIGLRDHSALTV

SEQ ID NO: 1485218 - protein, 17 aa, Mycobacterium tuberculosis
IHFRIEDDLYYPALSAA

SEQ ID NO: 1485219 - protein, 25 aa, Mycobacterium tuberculosis
IHIESRPAVTLSWIREFPSLGAAAY

SEQ ID NO: 1485220 - protein, 19 aa, Mycobacterium tuberculosis
IHIGLPLSLTIPGFTIPGG

SEQ ID NO: 1485221 - protein, 21 aa, Mycobacterium tuberculosis
IHKRAHGVAVVILEGRPIGLV

SEQ ID NO: 1485222 - protein, 19 aa, Mycobacterium tuberculosis
IHLTLIPFALRPTAEVPTT

SEQ ID NO: 1485223 - protein, 20 aa, Mycobacterium tuberculosis
IHLVDLDAAFGPRFQPRTAC

SEQ ID NO: 1485224 - protein, 27 aa, Mycobacterium tuberculosis
IHNTQPWRWRVCPTSLELFSRPDMQLR

SEQ ID NO: 1485225 - protein, 23 aa, Mycobacterium tuberculosis
IHPVAACATAAVSVEEGVDKIRV

SEQ ID NO: 1485226 - protein, 19 aa, Mycobacterium tuberculosis
IHRFLDLRRSPGMLTDPAV

SEQ ID NO: 1485227 - protein, 17 aa, Mycobacterium tuberculosis
IHRNRPVGIDSLIDAPQ

SEQ ID NO: 1485228 - protein, 19 aa, Mycobacterium tuberculosis
IHRRSFHVVAWATERSTSS

SEQ ID NO: 1485229 - protein, 19 aa, Mycobacterium tuberculosis
IHWLLLRFGVGSTVRDYDP

SEQ ID NO: 1485230 - protein, 19 aa, Mycobacterium tuberculosis
IIADHSRTAAILIGDGVSP

SEQ ID NO: 1485231 - protein, 24 aa, Mycobacterium tuberculosis
IIANRVSYFYDFHGPSVTIDTACS

SEQ ID NO: 1485232 - protein, 19 aa, Mycobacterium tuberculosis
IIIGKARNVGWRVAGEPGK

SEQ ID NO: 1485233 - protein, 20 aa, Mycobacterium tuberculosis
IISRAEWGADESLRCETPEY

SEQ ID NO: 1485234 - protein, 17 aa, Mycobacterium tuberculosis
IIWRPSRTSTQRWPRHT

SEQ ID NO: 1485235 - protein, 24 aa, Mycobacterium tuberculosis
IIYDEVHLLPAPVFRMTADLQSKR

SEQ ID NO: 1485236 - protein, 18 aa, Mycobacterium tuberculosis
IIYRMGVTPPQAQADPEH

SEQ ID NO: 1485237 - protein, 27 aa, Mycobacterium tuberculosis
IKAMPPSSVVGLWTFDGREGRTEVPAG

SEQ ID NO: 1485238 - protein, 20 aa, Mycobacterium tuberculosis
IKDLVVRGGENISPREIEEL

SEQ ID NO: 1485239 - protein, 20 aa, Mycobacterium tuberculosis
IKDVQIRDGLHILGQNPTGE

SEQ ID NO: 1485240 - protein, 22 aa, Mycobacterium tuberculosis
IKDWQIKICDTIADNASAAGFV

SEQ ID NO: 1485241 - protein, 20 aa, Mycobacterium tuberculosis
IKELCRRWYPRIYFGQPPKG

SEQ ID NO: 1485242 - protein, 17 aa, Mycobacterium tuberculosis
IKELINRGGEKISPERV

SEQ ID NO: 1485243 - protein, 17 aa, Mycobacterium tuberculosis
IKFEPYRLWQPPLTQPV

SEQ ID NO: 1485244 - protein, 23 aa, Mycobacterium tuberculosis
IKGILGEVWEFITNALNGLKELW

SEQ ID NO: 1485245 - protein, 21 aa, Mycobacterium tuberculosis
IKKGGEPAVATGPRGAPDQPT

SEQ ID NO: 1485246 - protein, 21 aa, Mycobacterium tuberculosis
IKSAVAFGALLSRGIGDTIRV

SEQ ID NO: 1485247 - protein, 21 aa, Mycobacterium tuberculosis
IKSREIYEAPGAMVLITAHTE

SEQ ID NO: 1485248 - protein, 22 aa, Mycobacterium tuberculosis
IKSREIYEAPGAMVLITAHTEL

SEQ ID NO: 1485249 - protein, 21 aa, Mycobacterium tuberculosis
IKVILRQAACARGVPVLMATS

SEQ ID NO: 1485250 - protein, 23 aa, Mycobacterium tuberculosis
ILAELRQLLGSPWTDEHGTRPLA

SEQ ID NO: 1485251 - protein, 19 aa, Mycobacterium tuberculosis
ILAQALIKGGLRLVAAGVN

SEQ ID NO: 1485252 - protein, 31 aa, Mycobacterium tuberculosis
ILAQALIKGGLRLVAAGVNPIALGVGIGKAA

SEQ ID NO: 1485253 - protein, 20 aa, Mycobacterium tuberculosis
ILCACCTTSCPVFWHEGSYF

SEQ ID NO: 1485254 - protein, 25 aa, Mycobacterium tuberculosis
ILCACCTTSCPVFWHEGSYFGPAAI

SEQ ID NO: 1485255 - protein, 23 aa, Mycobacterium tuberculosis
ILDEFDEYLALQCGRSVHHPSCL

SEQ ID NO: 1485256 - protein, 23 aa, Mycobacterium tuberculosis
ILDLRAGTLTRRAHWRSPAGKQV

SEQ ID NO: 1485257 - protein, 17 aa, Mycobacterium tuberculosis
ILDWLARPARIVVVSSG

SEQ ID NO: 1485258 - protein, 17 aa, Mycobacterium tuberculosis
ILEQWGADGWELVAVLP

SEQ ID NO: 1485259 - protein, 17 aa, Mycobacterium tuberculosis
ILGPQYKSPRLVKPEML

SEQ ID NO: 1485260 - protein, 17 aa, Mycobacterium tuberculosis
ILHAAAVEAARVAGAGR

SEQ ID NO: 1485261 - protein, 20 aa, Mycobacterium tuberculosis
ILIHWDDFFRPLSKPLRALP

SEQ ID NO: 1485262 - protein, 23 aa, Mycobacterium tuberculosis
ILLGAGWEGGWRCGEVVLSMVAD

SEQ ID NO: 1485263 - protein, 18 aa, Mycobacterium tuberculosis
ILLRHGRVYAAPYFHQFD

SEQ ID NO: 1485264 - protein, 17 aa, Mycobacterium tuberculosis
ILPDDFTILDGIFAAYA

SEQ ID NO: 1485265 - protein, 20 aa, Mycobacterium tuberculosis
ILPMPARPAARPEFPNPKLA

SEQ ID NO: 1485266 - protein, 26 aa, Mycobacterium tuberculosis
ILPNPRLPAPIFPKPRLCAPRLAAPR

SEQ ID NO: 1485267 - protein, 17 aa, Mycobacterium tuberculosis
ILQPWVDAAFKKRGIDP

SEQ ID NO: 1485268 - protein, 20 aa, Mycobacterium tuberculosis
ILQRRVVFRANRAEVQAIAT

SEQ ID NO: 1485269 - protein, 21 aa, Mycobacterium tuberculosis
ILRLHPNMVRQGGRRSAADPF

SEQ ID NO: 1485270 - protein, 20 aa, Mycobacterium tuberculosis
ILSSILFRMAELRSGEGRTV

SEQ ID NO: 1485271 - protein, 24 aa, Mycobacterium tuberculosis
ILTEHPDRFRAMIVERGNPAHSLA

SEQ ID NO: 1485272 - protein, 23 aa, Mycobacterium tuberculosis
ILTEHPDRFRAMIVESGNPAYSL

SEQ ID NO: 1485273 - protein, 22 aa, Mycobacterium tuberculosis
ILVDADDGWSYAVAEGTAQTDT

SEQ ID NO: 1485274 - protein, 23 aa, Mycobacterium tuberculosis
ILVYGHVPFELVSYVCCYNTETM

SEQ ID NO: 1485275 - protein, 18 aa, Mycobacterium tuberculosis
IMADFNVTDGRRFGFDVS

SEQ ID NO: 1485276 - protein, 17 aa, Mycobacterium tuberculosis
IMLARTVVRLAQTPDER

SEQ ID NO: 1485277 - protein, 21 aa, Mycobacterium tuberculosis
IMPGTRVGRGAVVRHAILDKN

SEQ ID NO: 1485278 - protein, 24 aa, Mycobacterium tuberculosis
IMPTTCPECRSPLAPEKEGDADIR

SEQ ID NO: 1485279 - protein, 29 aa, Mycobacterium tuberculosis
IMVCRYADGVGHPFWFSRTVFGELARLHG

SEQ ID NO: 1485280 - protein, 29 aa, Mycobacterium tuberculosis
INAPAQTLLGRPLIGNGADGSTPGQAGGP

SEQ ID NO: 1485281 - protein, 26 aa, Mycobacterium tuberculosis
INAPFLAALGRPLIGNGADGAPGTGA

SEQ ID NO: 1485282 - protein, 17 aa, Mycobacterium tuberculosis
INAPTLALLNRPLIGKG

SEQ ID NO: 1485283 - protein, 17 aa, Mycobacterium tuberculosis
INAPTLALLNRPLIGNG

SEQ ID NO: 1485284 - protein, 25 aa, Mycobacterium tuberculosis
INAPTMALLRRPQIGHGADEAPGTG

SEQ ID NO: 1485285 - protein, 25 aa, Mycobacterium tuberculosis
INDIYRCHPALWSLDTTPERLFLDR

SEQ ID NO: 1485286 - protein, 25 aa, Mycobacterium tuberculosis
INDRLKDMYICGGFNVYPAEVEQVL

SEQ ID NO: 1485287 - protein, 19 aa, Mycobacterium tuberculosis
INEARWVRGAVPFEGDVGS

SEQ ID NO: 1485288 - protein, 26 aa, Mycobacterium tuberculosis
INEPTEALTGRPLIGNGDSGTPGTGD

SEQ ID NO: 1485289 - protein, 17 aa, Mycobacterium tuberculosis
INGTGGAGGSRGQISGN

SEQ ID NO: 1485290 - protein, 24 aa, Mycobacterium tuberculosis
INIPINITSAPGFGNSTTTPSSGF

SEQ ID NO: 1485291 - protein, 25 aa, Mycobacterium tuberculosis
INKEINLRFVLGYTPLEFRDTLHML

SEQ ID NO: 1485292 - protein, 24 aa, Mycobacterium tuberculosis
INLDRPAYVYPIFEQALRIAYGES

SEQ ID NO: 1485293 - protein, 25 aa, Mycobacterium tuberculosis
INLELIDSPTLPTCERIAVLSQSGV

SEQ ID NO: 1485294 - protein, 21 aa, Mycobacterium tuberculosis
INPRKSCLRNVDRFRPGLLDL

SEQ ID NO: 1485295 - protein, 22 aa, Mycobacterium tuberculosis
INPTWCSRQPVPTCTGTRRPST

SEQ ID NO: 1485296 - protein, 25 aa, Mycobacterium tuberculosis
INRAVELACTVGRTLKSGTTVNLEV

SEQ ID NO: 1485297 - protein, 18 aa, Mycobacterium tuberculosis
INSARLYVGAGLAPMLDA

SEQ ID NO: 1485298 - protein, 18 aa, Mycobacterium tuberculosis
INSYARYCELRAAGRIDE

SEQ ID NO: 1485299 - protein, 19 aa, Mycobacterium tuberculosis
INTMPAIHHVCCTRGCGRP

SEQ ID NO: 1485300 - protein, 19 aa, Mycobacterium tuberculosis
INTMPGFTTISMYPRMWEA

SEQ ID NO: 1485301 - protein, 18 aa, Mycobacterium tuberculosis
INTRGDIHPVYRRAAHLG

SEQ ID NO: 1485302 - protein, 24 aa, Mycobacterium tuberculosis
INVKIDKGEFVFLIGPSGSGKSTF

SEQ ID NO: 1485303 - protein, 21 aa, Mycobacterium tuberculosis
INWLTNLPFLQAMFSGFDPWL

SEQ ID NO: 1485304 - protein, 22 aa, Mycobacterium tuberculosis
INWLTNLPFLQAMFSGFDPWLP

SEQ ID NO: 1485305 - protein, 21 aa, Mycobacterium tuberculosis
IPAAAPRRSRRLRHPRPSTGR

SEQ ID NO: 1485306 - protein, 18 aa, Mycobacterium tuberculosis
IPAALSAPSLNRGVGFTH

SEQ ID NO: 1485307 - protein, 17 aa, Mycobacterium tuberculosis
IPAAPGFGNSTQMPSSG

SEQ ID NO: 1485308 - protein, 22 aa, Mycobacterium tuberculosis
IPADRPALPAALTILRDITAGS

SEQ ID NO: 1485309 - protein, 18 aa, Mycobacterium tuberculosis
IPAFGGGIGIPINIGPLT

SEQ ID NO: 1485310 - protein, 21 aa, Mycobacterium tuberculosis
IPAGSLVLLAWGAANRDPRQY

SEQ ID NO: 1485311 - protein, 18 aa, Mycobacterium tuberculosis
IPAIPGIDHPMVLTYAEA

SEQ ID NO: 1485312 - protein, 27 aa, Mycobacterium tuberculosis
IPASRERVVAVSFPRDLAITPIQCEAW

SEQ ID NO: 1485313 - protein, 20 aa, Mycobacterium tuberculosis
IPATRCCWHHVCSRCGVPGA

SEQ ID NO: 1485314 - protein, 18 aa, Mycobacterium tuberculosis
IPDMAQWGIFLRNHDELT

SEQ ID NO: 1485315 - protein, 25 aa, Mycobacterium tuberculosis
IPDNEFRVVLARRGQHWVSAVRVGN

SEQ ID NO: 1485316 - protein, 18 aa, Mycobacterium tuberculosis
IPEADAVEQGRAVDFDDE

SEQ ID NO: 1485317 - protein, 22 aa, Mycobacterium tuberculosis
IPEFPIHWTSTGGIGPIIIPDT

SEQ ID NO: 1485318 - protein, 23 aa, Mycobacterium tuberculosis
IPEPTCSWLAQSLADRIHGMISI

SEQ ID NO: 1485319 - protein, 23 aa, Mycobacterium tuberculosis
IPESKKAVVVFPTYEDYAAVMRN

SEQ ID NO: 1485320 - protein, 26 aa, Mycobacterium tuberculosis
IPFADGMLSRLGRRGAALDLIEEFED

SEQ ID NO: 1485321 - protein, 17 aa, Mycobacterium tuberculosis
IPFCAYNSVGYREQVRE

SEQ ID NO: 1485322 - protein, 17 aa, Mycobacterium tuberculosis
IPFGAFRHLISLPASGA

SEQ ID NO: 1485323 - protein, 17 aa, Mycobacterium tuberculosis
IPFTDLRMKVVDTQTEW

SEQ ID NO: 1485324 - protein, 25 aa, Mycobacterium tuberculosis
IPGCARGPRCLLQRPAFLSNSSPTT

SEQ ID NO: 1485325 - protein, 18 aa, Mycobacterium tuberculosis
IPGEAALSETLRRRRASG

SEQ ID NO: 1485326 - protein, 20 aa, Mycobacterium tuberculosis
IPGGAVLPVYDPLFDSKKLR

SEQ ID NO: 1485327 - protein, 18 aa, Mycobacterium tuberculosis
IPGWNICVDFPIKDGLGK

SEQ ID NO: 1485328 - protein, 17 aa, Mycobacterium tuberculosis
IPIEIAGTPGFGNSTTT

SEQ ID NO: 1485329 - protein, 20 aa, Mycobacterium tuberculosis
IPIIDIPAAPGFGNSTQMPS

SEQ ID NO: 1485330 - protein, 22 aa, Mycobacterium tuberculosis
IPIIDIPAAPGFGNSTQMPSSG

SEQ ID NO: 1485331 - protein, 17 aa, Mycobacterium tuberculosis
IPIIDVPAVPGFGNTTT

SEQ ID NO: 1485332 - protein, 17 aa, Mycobacterium tuberculosis
IPIPAIHIGINGVVTVG

SEQ ID NO: 1485333 - protein, 18 aa, Mycobacterium tuberculosis
IPKIYGTRCEGIRLMSKT

SEQ ID NO: 1485334 - protein, 20 aa, Mycobacterium tuberculosis
IPKSALGAGLGLRSAISSGL

SEQ ID NO: 1485335 - protein, 24 aa, Mycobacterium tuberculosis
IPLALRLIEEGFALYGDQPPFDLS

SEQ ID NO: 1485336 - protein, 20 aa, Mycobacterium tuberculosis
IPLLEYAARFITPVHPGYTA

SEQ ID NO: 1485337 - protein, 18 aa, Mycobacterium tuberculosis
IPLTAHFLGGAVIGDDPE

SEQ ID NO: 1485338 - protein, 27 aa, Mycobacterium tuberculosis
IPMDRGDLRRCRLRQDRDRGAGGVQGG

SEQ ID NO: 1485339 - protein, 33 aa, Mycobacterium tuberculosis
IPMQPKLDVLDFWSIIKPELAGVHGLCTQVTAF

SEQ ID NO: 1485340 - protein, 23 aa, Mycobacterium tuberculosis
IPNAVFLGHAFAALNPATVTAAA

SEQ ID NO: 1485341 - protein, 17 aa, Mycobacterium tuberculosis
IPPAHRVAIEFDPPLPP

SEQ ID NO: 1485342 - protein, 22 aa, Mycobacterium tuberculosis
IPPRRLRYAPGQFLTLRVPSER

SEQ ID NO: 1485343 - protein, 19 aa, Mycobacterium tuberculosis
IPQFPIRITTTGGIGPIVI

SEQ ID NO: 1485344 - protein, 19 aa, Mycobacterium tuberculosis
IPRECRFIYAETAVFGSEI

SEQ ID NO: 1485345 - protein, 21 aa, Mycobacterium tuberculosis
IPRTKRGVISYAARDIGERLD

SEQ ID NO: 1485346 - protein, 19 aa, Mycobacterium tuberculosis
IPRVHRWARGGTCNVSRVG

SEQ ID NO: 1485347 - protein, 19 aa, Mycobacterium tuberculosis
IPTGILMRSDMDSSLRTLV

SEQ ID NO: 1485348 - protein, 18 aa, Mycobacterium tuberculosis
IPVIDIPAAPGIGNSTTS

SEQ ID NO: 1485349 - protein, 22 aa, Mycobacterium tuberculosis
IPVTVEVPVGGILAPLQPFQAT

SEQ ID NO: 1485350 - protein, 18 aa, Mycobacterium tuberculosis
IPVVKELAAQGITVSIDT

SEQ ID NO: 1485351 - protein, 24 aa, Mycobacterium tuberculosis
IPVVLRSAVLAKLMAGRTTLMVTG

SEQ ID NO: 1485352 - protein, 19 aa, Mycobacterium tuberculosis
IPYDPHLATGLAVDFSSLK

SEQ ID NO: 1485353 - protein, 17 aa, Mycobacterium tuberculosis
IPYVYPVDLRFVLAPPV

SEQ ID NO: 1485354 - protein, 28 aa, Mycobacterium tuberculosis
IQAQDFFFRKIVRDKGVALAHVSGQIQE

SEQ ID NO: 1485355 - protein, 31 aa, Mycobacterium tuberculosis
IQARGLVDVVIPRGGAGLIEAVVRDAQVPTI

SEQ ID NO: 1485356 - protein, 17 aa, Mycobacterium tuberculosis
IQGLRAAFEVSQTSRSA

SEQ ID NO: 1485357 - protein, 27 aa, Mycobacterium tuberculosis
IQILPTIPLNIHQTFSLGPLVVPDIVI

SEQ ID NO: 1485358 - protein, 30 aa, Mycobacterium tuberculosis
IQIRTVGRLLGWRLGMDDVDPRSMVDLQSA

SEQ ID NO: 1485359 - protein, 21 aa, Mycobacterium tuberculosis
IQKRLQVILDRQIMRKLAGHG

SEQ ID NO: 1485360 - protein, 18 aa, Mycobacterium tuberculosis
IQLHGGIAITWGTRHAPV

SEQ ID NO: 1485361 - protein, 17 aa, Mycobacterium tuberculosis
IQLLPLWRRVHSHILRI

SEQ ID NO: 1485362 - protein, 26 aa, Mycobacterium tuberculosis
IQPFINWLTNLPFLQAMFSGFDPWLP

SEQ ID NO: 1485363 - protein, 18 aa, Mycobacterium tuberculosis
IQREHLLQAIKDVGFDLV

SEQ ID NO: 1485364 - protein, 19 aa, Mycobacterium tuberculosis
IQSIYGWRGASATNLPRFT

SEQ ID NO: 1485365 - protein, 26 aa, Mycobacterium tuberculosis
IQSTFVGAICRWQAANPAGLIDITRF

SEQ ID NO: 1485366 - protein, 18 aa, Mycobacterium tuberculosis
IQVFDSWAGALSPIDYRQ

SEQ ID NO: 1485367 - protein, 19 aa, Mycobacterium tuberculosis
IQVLTQCRPELIERTFQAC

SEQ ID NO: 1485368 - protein, 17 aa, Mycobacterium tuberculosis
IQVPPNGLPVILGPDHP

SEQ ID NO: 1485369 - protein, 18 aa, Mycobacterium tuberculosis
IRAAGGICELQVWPDQMH

SEQ ID NO: 1485370 - protein, 19 aa, Mycobacterium tuberculosis
IRAARRCRWCQRGGKQPLA

SEQ ID NO: 1485371 - protein, 25 aa, Mycobacterium tuberculosis
IRAGEGVSYGHTWIAPRDTNLALLP

SEQ ID NO: 1485372 - protein, 17 aa, Mycobacterium tuberculosis
IRALELMSSPGSGKTTV

SEQ ID NO: 1485373 - protein, 29 aa, Mycobacterium tuberculosis
IRAPPPSTRFAVTWMIDRSSWAAMVGSVC

SEQ ID NO: 1485374 - protein, 26 aa, Mycobacterium tuberculosis
IRASLWPAQLVGLGIMRYGVRSEPLH

SEQ ID NO: 1485375 - protein, 19 aa, Mycobacterium tuberculosis
IRCHQWRSAGRSFAHGPAE

SEQ ID NO: 1485376 - protein, 17 aa, Mycobacterium tuberculosis
IRCPGRLPAIKDQPGRR

SEQ ID NO: 1485377 - protein, 26 aa, Mycobacterium tuberculosis
IRELQELRKSTGLDVSDRIRVVMSVP

SEQ ID NO: 1485378 - protein, 17 aa, Mycobacterium tuberculosis
IRFAEAAIQVMGKAEAR

SEQ ID NO: 1485379 - protein, 29 aa, Mycobacterium tuberculosis
IRGKMKGGPLPRGRGLLMAEDTGVFVQVA

SEQ ID NO: 1485380 - protein, 17 aa, Mycobacterium tuberculosis
IRHAVASLPAVVADIQT

SEQ ID NO: 1485381 - protein, 19 aa, Mycobacterium tuberculosis
IRHRWNWTDVRRWLTDPTG

SEQ ID NO: 1485382 - protein, 24 aa, Mycobacterium tuberculosis
IRIDLRKTYLFAFLDDHSRLVPGY

SEQ ID NO: 1485383 - protein, 21 aa, Mycobacterium tuberculosis
IRLARHANHYLAIFDRGKALA

SEQ ID NO: 1485384 - protein, 25 aa, Mycobacterium tuberculosis
IRLARHRPEIPIGVNIGKTKKTPAG

SEQ ID NO: 1485385 - protein, 26 aa, Mycobacterium tuberculosis
IRLARHRPEIPIGVNIGKTTKTPAGD

SEQ ID NO: 1485386 - protein, 20 aa, Mycobacterium tuberculosis
IRLLTRIAFGFRSPEALIAL

SEQ ID NO: 1485387 - protein, 23 aa, Mycobacterium tuberculosis
IRLPGRYNVANCLGRPGDSGHRR

SEQ ID NO: 1485388 - protein, 17 aa, Mycobacterium tuberculosis
IRLPGRYNVANCLVALA

SEQ ID NO: 1485389 - protein, 19 aa, Mycobacterium tuberculosis
IRLVTPVQWAMRQTVRDTE

SEQ ID NO: 1485390 - protein, 20 aa, Mycobacterium tuberculosis
IRNHKGCEMMNKTYKLSPTF

SEQ ID NO: 1485391 - protein, 17 aa, Mycobacterium tuberculosis
IRPAMAINKEINLRFVL

SEQ ID NO: 1485392 - protein, 19 aa, Mycobacterium tuberculosis
IRPCPEVQAPLQAGQVRVA

SEQ ID NO: 1485393 - protein, 17 aa, Mycobacterium tuberculosis
IRPDVVVGIPAVDRRPK

SEQ ID NO: 1485394 - protein, 18 aa, Mycobacterium tuberculosis
IRQDIDWITFAQNPSGPR

SEQ ID NO: 1485395 - protein, 17 aa, Mycobacterium tuberculosis
IRQLARMGAKTIVAMAR

SEQ ID NO: 1485396 - protein, 19 aa, Mycobacterium tuberculosis
IRQRRQWREPAEPVDDVSA

SEQ ID NO: 1485397 - protein, 23 aa, Mycobacterium tuberculosis
IRRHRRAPGRFLIGAGPRRNLLR

SEQ ID NO: 1485398 - protein, 17 aa, Mycobacterium tuberculosis
IRRNIKNRKSVNLDNPN

SEQ ID NO: 1485399 - protein, 18 aa, Mycobacterium tuberculosis
IRRSACVERYRSDGFKRL

SEQ ID NO: 1485400 - protein, 22 aa, Mycobacterium tuberculosis
IRSKGVGVFFCTQLPTDLPNDV

SEQ ID NO: 1485401 - protein, 19 aa, Mycobacterium tuberculosis
IRSTNRLAYLDAHATSQFE

SEQ ID NO: 1485402 - protein, 17 aa, Mycobacterium tuberculosis
IRTGVLAYMAYHQQNPE

SEQ ID NO: 1485403 - protein, 17 aa, Mycobacterium tuberculosis
IRTRLDRVLDWLGRADV

SEQ ID NO: 1485404 - protein, 18 aa, Mycobacterium tuberculosis
IRVADEVSVAFTAVRAKD

SEQ ID NO: 1485405 - protein, 19 aa, Mycobacterium tuberculosis
IRVAGWIDKLGAVWVEGQL

SEQ ID NO: 1485406 - protein, 24 aa, Mycobacterium tuberculosis
IRYEGPKGGPGMREMLAITGAIKG

SEQ ID NO: 1485407 - protein, 30 aa, Mycobacterium tuberculosis
IRYEGPKGGPGMREMLAITGAIKGAGLGKD

SEQ ID NO: 1485408 - protein, 22 aa, Mycobacterium tuberculosis
ISALRWGGSAPRVIFLHGGGQN

SEQ ID NO: 1485409 - protein, 27 aa, Mycobacterium tuberculosis
ISARWGRPGPLWSVSIERFLDTAWWVS

SEQ ID NO: 1485410 - protein, 19 aa, Mycobacterium tuberculosis
ISDDFFALFLDPTWVYTCA

SEQ ID NO: 1485411 - protein, 19 aa, Mycobacterium tuberculosis
ISDVIRLARHANHYLAIFD

SEQ ID NO: 1485412 - protein, 20 aa, Mycobacterium tuberculosis
ISDVLLPFLVTRQLICGAGK

SEQ ID NO: 1485413 - protein, 17 aa, Mycobacterium tuberculosis
ISEDVILAGARERATDI

SEQ ID NO: 1485414 - protein, 19 aa, Mycobacterium tuberculosis
ISGAKAWLGTALALKPLLS

SEQ ID NO: 1485415 - protein, 17 aa, Mycobacterium tuberculosis
ISGDLRVDFPWLGTVVQ

SEQ ID NO: 1485416 - protein, 24 aa, Mycobacterium tuberculosis
ISGDLRVDFPWLGTVVQAYLRRTL

SEQ ID NO: 1485417 - protein, 29 aa, Mycobacterium tuberculosis
ISGDLRVDFPWLGTVVQAYLRRTLADCAE

SEQ ID NO: 1485418 - protein, 18 aa, Mycobacterium tuberculosis
ISGGLMRLGSAVAPLLQV

SEQ ID NO: 1485419 - protein, 17 aa, Mycobacterium tuberculosis
ISGGRLIWDPAEGTMNG

SEQ ID NO: 1485420 - protein, 21 aa, Mycobacterium tuberculosis
ISGNFNNGVLWVGDYQGLFGV

SEQ ID NO: 1485421 - protein, 41 aa, Mycobacterium tuberculosis
ISGNYSNGAFWRGDYQGLLDFSFPVGPLIPQTHLVHLRETV

SEQ ID NO: 1485422 - protein, 37 aa, Mycobacterium tuberculosis
ISGNYSNGAFWRGDYQGLLGFSYRPAVLPQTPFLDLT

SEQ ID NO: 1485423 - protein, 18 aa, Mycobacterium tuberculosis
ISGRAQEVLTRLADASYD

SEQ ID NO: 1485424 - protein, 24 aa, Mycobacterium tuberculosis
ISGRLCWIGPPSGHTARPTHHRRH

SEQ ID NO: 1485425 - protein, 17 aa, Mycobacterium tuberculosis
ISGRRFGSTGALRRNTR

SEQ ID NO: 1485426 - protein, 25 aa, Mycobacterium tuberculosis
ISGSGSPVITRWVSAASTRVAATSA

SEQ ID NO: 1485427 - protein, 20 aa, Mycobacterium tuberculosis
ISHAYLRGREFYAYNSRFWE

SEQ ID NO: 1485428 - protein, 17 aa, Mycobacterium tuberculosis
ISHVVFKPGTIEQIRSV

SEQ ID NO: 1485429 - protein, 23 aa, Mycobacterium tuberculosis
ISIIDIPALPGFGNSTELPSSGF

SEQ ID NO: 1485430 - protein, 18 aa, Mycobacterium tuberculosis
ISIPPHEECEVLVGLGMR

SEQ ID NO: 1485431 - protein, 18 aa, Mycobacterium tuberculosis
ISLAPGEAIFLPAGNLHA

SEQ ID NO: 1485432 - protein, 17 aa, Mycobacterium tuberculosis
ISLHFQIGRRQVVKAEV

SEQ ID NO: 1485433 - protein, 18 aa, Mycobacterium tuberculosis
ISLHFQIGRRQVVKAEVS

SEQ ID NO: 1485434 - protein, 20 aa, Mycobacterium tuberculosis
ISNFPPKRHKTRVLAAAEDE

SEQ ID NO: 1485435 - protein, 32 aa, Mycobacterium tuberculosis; identical to SEQ ID NO: 233730

SEQ ID NO: 1485436 - protein, 20 aa, Mycobacterium tuberculosis
ISPSGPRLAGALGTSLLSLS

SEQ ID NO: 1485437 - protein, 27 aa, Mycobacterium tuberculosis
ISPWGTWEWIGPPALGAVLPARGMAKL

SEQ ID NO: 1485438 - protein, 24 aa, Mycobacterium tuberculosis
ISQGRLEALLNFQTLVTDLTGLEI

SEQ ID NO: 1485439 - protein, 19 aa, Mycobacterium tuberculosis
ISRAEWGADESLRCETPEY

SEQ ID NO: 1485440 - protein, 27 aa, Mycobacterium tuberculosis
ISRANAEALVPITALLPAGADDVSAAI

SEQ ID NO: 1485441 - protein, 17 aa, Mycobacterium tuberculosis
ISRRRTEVATQVEAAPT

SEQ ID NO: 1485442 - protein, 22 aa, Mycobacterium tuberculosis
ISTAQWCGVRLADILQAADVHI

SEQ ID NO: 1485443 - protein, 20 aa, Mycobacterium tuberculosis
ISTLPMAVPVNLRAEGDAAG

SEQ ID NO: 1485444 - protein, 20 aa, Mycobacterium tuberculosis
ISVLQAPLFTAYGTLYQQVS

SEQ ID NO: 1485445 - protein, 23 aa, Mycobacterium tuberculosis
ITAFNFPVAVWAWNTAVALVCGD

SEQ ID NO: 1485446 - protein, 17 aa, Mycobacterium tuberculosis
ITAPQYAAYDIWESLFT

SEQ ID NO: 1485447 - protein, 17 aa, Mycobacterium tuberculosis
ITARFLPDKAIDLVDEA

SEQ ID NO: 1485448 - protein, 18 aa, Mycobacterium tuberculosis
ITARRGALLVLDEVQTGM

SEQ ID NO: 1485449 - protein, 25 aa, Mycobacterium tuberculosis
ITDLPDGRWSEFLEEPRLAARVAGA

SEQ ID NO: 1485450 - protein, 18 aa, Mycobacterium tuberculosis
ITDPGVITPRIEHPPVPG

SEQ ID NO: 1485451 - protein, 17 aa, Mycobacterium tuberculosis
ITEQEWLAHWPTAVNDS

SEQ ID NO: 1485452 - protein, 19 aa, Mycobacterium tuberculosis
ITGAEAWLVSSYALCTQVL

SEQ ID NO: 1485453 - protein, 24 aa, Mycobacterium tuberculosis
ITGGAAFRRRTCPGSPPTSPYRTA

SEQ ID NO: 1485454 - protein, 38 aa, Mycobacterium tuberculosis
ITGNFSNGILWRGNYEGLAGFSFGYPIPLFPAVGADVT

SEQ ID NO: 1485455 - protein, 27 aa, Mycobacterium tuberculosis
ITGSAAFRIVVGSVRIPPVSVIVEQII

SEQ ID NO: 1485456 - protein, 24 aa, Mycobacterium tuberculosis
ITIERPAALRNCRHHGQDHISHGR

SEQ ID NO: 1485457 - protein, 33 aa, Mycobacterium tuberculosis
ITIPQLPLGLALSGATPAFAFPLEITIDRIPVV

SEQ ID NO: 1485458 - protein, 26 aa, Mycobacterium tuberculosis
ITKNSEVSTVWTWPDKPGVAGCAAMD

SEQ ID NO: 1485459 - protein, 19 aa, Mycobacterium tuberculosis
ITKRAGVSVGALFRHFETM

SEQ ID NO: 1485460 - protein, 19 aa, Mycobacterium tuberculosis
ITQEFDATVCWMADNAVLE

SEQ ID NO: 1485461 - protein, 41 aa, Mycobacterium tuberculosis
ITQQRPTRLAVCLDLDWRPQFRVDLIPSYKAHRVAEPEPNG

SEQ ID NO: 1485462 - protein, 18 aa, Mycobacterium tuberculosis
ITRKNTKGDTEWLPPPHL

SEQ ID NO: 1485463 - protein, 23 aa, Mycobacterium tuberculosis
ITSEVDGLVHLPPMKSLSYSVAT

SEQ ID NO: 1485464 - protein, 23 aa, Mycobacterium tuberculosis
ITSSRLPARCWAPESRCSASVSA

SEQ ID NO: 1485465 - protein, 18 aa, Mycobacterium tuberculosis
ITTLPRDELRTMTTKVSS

SEQ ID NO: 1485466 - protein, 41 aa, Mycobacterium tuberculosis; identical to SEQ ID NO: 929751

SEQ ID NO: 1485467 - protein, 27 aa, Mycobacterium tuberculosis
ITTPTDWPRYGGYALAGVSSFGFGGAN

SEQ ID NO: 1485468 - protein, 28 aa, Mycobacterium tuberculosis
ITTPTDWPRYGGYALAGVSSFGFGGANA

SEQ ID NO: 1485469 - protein, 23 aa, Mycobacterium tuberculosis
ITVLKGAVLFVTDLARAIPVPTQ

SEQ ID NO: 1485470 - protein, 26 aa, Mycobacterium tuberculosis
ITVPAFGIPFTLQFQTNVPALQPPGG

SEQ ID NO: 1485471 - protein, 17 aa, Mycobacterium tuberculosis
ITYRELWARAGTLATAL

SEQ ID NO: 1485472 - protein, 22 aa, Mycobacterium tuberculosis
IVAGGGPLPLAVSVDEEGGRVS

SEQ ID NO: 1485473 - protein, 25 aa, Mycobacterium tuberculosis
IVAIDMRRRRGLPPIAPHSGLGYAQ

SEQ ID NO: 1485474 - protein, 20 aa, Mycobacterium tuberculosis
IVATETFAPILYVLTYDDLD

SEQ ID NO: 1485475 - protein, 27 aa, Mycobacterium tuberculosis
IVDAFAALKRLTMVTSHVLAETKVDFG

SEQ ID NO: 1485476 - protein, 19 aa, Mycobacterium tuberculosis
IVDDIALVRDCCAPGESVR

SEQ ID NO: 1485477 - protein, 18 aa, Mycobacterium tuberculosis
IVDDIALVRDCCAPGSRF

SEQ ID NO: 1485478 - protein, 18 aa, Mycobacterium tuberculosis
IVDDIRAAIAVGHGVTVR

SEQ ID NO: 1485479 - protein, 18 aa, Mycobacterium tuberculosis
IVDPLALTAGDLVVHDQH

SEQ ID NO: 1485480 - protein, 17 aa, Mycobacterium tuberculosis
IVDPRPLTLLPEPNPGD

SEQ ID NO: 1485481 - protein, 18 aa, Mycobacterium tuberculosis
IVDPRPLTLLPEPNPGDL

SEQ ID NO: 1485482 - protein, 18 aa, Mycobacterium tuberculosis
IVDPRPLTLLPEQTPATC

SEQ ID NO: 1485483 - protein, 22 aa, Mycobacterium tuberculosis
IVDYRLIPKHSLGMALDDCHDA

SEQ ID NO: 1485484 - protein, 25 aa, Mycobacterium tuberculosis
IVEGFTRDGVHRWRSIPYARAPVGS

SEQ ID NO: 1485485 - protein, 18 aa, Mycobacterium tuberculosis
IVELYISYLRKKIDNGRE

SEQ ID NO: 1485486 - protein, 22 aa, Mycobacterium tuberculosis
IVELYISYLRKKIDNGREPMIH

SEQ ID NO: 1485487 - protein, 24 aa, Mycobacterium tuberculosis
IVEPHRVLTLPLVRARQPVADTSL

SEQ ID NO: 1485488 - protein, 17 aa, Mycobacterium tuberculosis
IVERARAGATVLVVAHR

SEQ ID NO: 1485489 - protein, 27 aa, Mycobacterium tuberculosis
IVGHDRLRLALLLCAVRPEIGGALIRG

SEQ ID NO: 1485490 - protein, 34 aa, Mycobacterium tuberculosis
IVGLERIGLRFVLEIRVPAGVDGRIMWSNWIDEQ

SEQ ID NO: 1485491 - protein, 17 aa, Mycobacterium tuberculosis
IVIGQACEFDYSGTQAC

SEQ ID NO: 1485492 - protein, 22 aa, Mycobacterium tuberculosis
IVIPAFGGGIGIPINIGPLTIT

SEQ ID NO: 1485493 - protein, 37 aa, Mycobacterium tuberculosis
IVNAIPFPSIVGDEFCLLDGLLAWYAMIGSINNINSM

SEQ ID NO: 1485494 - protein, 22 aa, Mycobacterium tuberculosis
IVPKHIPVTWWPKTDSVSPQLG

SEQ ID NO: 1485495 - protein, 28 aa, Mycobacterium tuberculosis
IVPQLDKGGGRLPITLWIVDTNASTPAP

SEQ ID NO: 1485496 - protein, 21 aa, Mycobacterium tuberculosis
IVRPEARAVLDYGSPSSARSG

SEQ ID NO: 1485497 - protein, 17 aa, Mycobacterium tuberculosis
IVRRSIMLVPRRGTRVR

SEQ ID NO: 1485498 - protein, 19 aa, Mycobacterium tuberculosis
IVRSSWGRRCSTRSRGFCG

SEQ ID NO: 1485499 - protein, 21 aa, Mycobacterium tuberculosis
IVSALNRPVSTTGEAGNQNTV

SEQ ID NO: 1485500 - protein, 17 aa, Mycobacterium tuberculosis
IVSCPDLLPDLWGRGRR

SEQ ID NO: 1485501 - protein, 17 aa, Mycobacterium tuberculosis
IVSCSLISVYSATASLG

SEQ ID NO: 1485502 - protein, 32 aa, Mycobacterium tuberculosis
IVSGWRLIGKCLRPLPNKWKGLLDPEARVRTR

SEQ ID NO: 1485503 - protein, 17 aa, Mycobacterium tuberculosis
IVTPRVMQFTLRANVPK

SEQ ID NO: 1485504 - protein, 20 aa, Mycobacterium tuberculosis
IVVTCPHCFNTIGKEYRQLG

SEQ ID NO: 1485505 - protein, 17 aa, Mycobacterium tuberculosis
IWADGGIRHPRDVALAL

SEQ ID NO: 1485506 - protein, 21 aa, Mycobacterium tuberculosis
IWAQDVAAMFGYHSAASAVAT

SEQ ID NO: 1485507 - protein, 18 aa, Mycobacterium tuberculosis
IWLHCLYALSGINLRESV

SEQ ID NO: 1485508 - protein, 21 aa, Mycobacterium tuberculosis
IWQRRPRRPSLFFLSFHFALG

SEQ ID NO: 1485509 - protein, 19 aa, Mycobacterium tuberculosis
IWRRDEVFEFNGSLIDSEE

SEQ ID NO: 1485510 - protein, 17 aa, Mycobacterium tuberculosis
IWRRPDLAPGPPGSGSS

SEQ ID NO: 1485511 - protein, 19 aa, Mycobacterium tuberculosis
IWYSDFLDFVGRERIFASL

SEQ ID NO: 1485512 - protein, 17 aa, Mycobacterium tuberculosis
IYAESFRGPQHLVEVQQ

SEQ ID NO: 1485513 - protein, 23 aa, Mycobacterium tuberculosis
IYGDTKLGLFPFRRNLSLLRRRP

SEQ ID NO: 1485514 - protein, 25 aa, Mycobacterium tuberculosis
IYGDTRLGLFPFRRNLSLYAVDLAL

SEQ ID NO: 1485515 - protein, 27 aa, Mycobacterium tuberculosis
IYGSGLPSDIWKATMDGALKGTSNETF

SEQ ID NO: 1485516 - protein, 30 aa, Mycobacterium tuberculosis
IYGSGLPSDIWKATMDGALKGTSNETFPKP

SEQ ID NO: 1485517 - protein, 17 aa, Mycobacterium tuberculosis
IYHPPHFVQKVVSANGQ

SEQ ID NO: 1485518 - protein, 18 aa, Mycobacterium tuberculosis
IYQCRACGAELFRSTEKF

SEQ ID NO: 1485519 - protein, 17 aa, Mycobacterium tuberculosis
IYQEMLANYRVGQANSV

SEQ ID NO: 1485520 - protein, 24 aa, Mycobacterium tuberculosis
IYRALRPGGVLLLVDIKASSQLED

SEQ ID NO: 1485521 - protein, 19 aa, Mycobacterium tuberculosis
IYRRTPSAPSRWLAGCSDL

SEQ ID NO: 1485522 - protein, 19 aa, Mycobacterium tuberculosis
IYSRTRGGEFCRHATAKVE

SEQ ID NO: 1485523 - protein, 25 aa, Mycobacterium tuberculosis
KAAAAGRPWWEWAATHERAFTAAYD

SEQ ID NO: 1485524 - protein, 20 aa, Mycobacterium tuberculosis
KAAAGGWLMQHRGGNTCSAT

SEQ ID NO: 1485525 - protein, 26 aa, Mycobacterium tuberculosis
KAAARLGSDMGEFYMPYPGTRINQET

SEQ ID NO: 1485526 - protein, 17 aa, Mycobacterium tuberculosis
KAAEAWSGGYFAKSVVP

SEQ ID NO: 1485527 - protein, 18 aa, Mycobacterium tuberculosis
KAAMTRRFYTRSVVKGEI

SEQ ID NO: 1485528 - protein, 25 aa, Mycobacterium tuberculosis
KAARRFLPGATILKASVGPMDNNAY

SEQ ID NO: 1485529 - protein, 24 aa, Mycobacterium tuberculosis
KAARSAPWCWTPDYVVNGDIADIV

SEQ ID NO: 1485530 - protein, 18 aa, Mycobacterium tuberculosis
KAERCRRRGVDVRLVSRD

SEQ ID NO: 1485531 - protein, 20 aa, Mycobacterium tuberculosis
KAFLGERIGVRRGVVVDADG

SEQ ID NO: 1485532 - protein, 18 aa, Mycobacterium tuberculosis
KAGALVVLVGRRVGLVPR

SEQ ID NO: 1485533 - protein, 21 aa, Mycobacterium tuberculosis
KAGEGDAFISAGVEAVSRFAK

SEQ ID NO: 1485534 - protein, 23 aa, Mycobacterium tuberculosis
KAGIPTHVAAFWANGGRPPVGVT

SEQ ID NO: 1485535 - protein, 20 aa, Mycobacterium tuberculosis
KAGQLWDAAGIEWAATSALS

SEQ ID NO: 1485536 - protein, 19 aa, Mycobacterium tuberculosis
KAGTDIPGICSGGRVRSGV

SEQ ID NO: 1485537 - protein, 17 aa, Mycobacterium tuberculosis
KAIAALDGWVTDAVEYG

SEQ ID NO: 1485538 - protein, 17 aa, Mycobacterium tuberculosis
KAIADIEAYPQWISEYK

SEQ ID NO: 1485539 - protein, 23 aa, Mycobacterium tuberculosis
KAIPLSRPAGIPFRAVGSAPALE

SEQ ID NO: 1485540 - protein, 26 aa, Mycobacterium tuberculosis
KAKAAPLWRVLVALSIRHVGPTAARA

SEQ ID NO: 1485541 - protein, 17 aa, Mycobacterium tuberculosis
KAKVLAICNTNGSQIPR

SEQ ID NO: 1485542 - protein, 17 aa, Mycobacterium tuberculosis
KALGHAYGGGSQYFSMW

SEQ ID NO: 1485543 - protein, 19 aa, Mycobacterium tuberculosis
KALKAFRTGGIDVLVATDV

SEQ ID NO: 1485544 - protein, 18 aa, Mycobacterium tuberculosis
KALLRRLVEAGTRVVQYG

SEQ ID NO: 1485545 - protein, 19 aa, Mycobacterium tuberculosis
KALLRRLVEAGTRVVQYGY

SEQ ID NO: 1485546 - protein, 17 aa, Mycobacterium tuberculosis
KALYCHRLDIADWPADP

SEQ ID NO: 1485547 - protein, 24 aa, Mycobacterium tuberculosis
KAMPEGFLIFNVVWNTILAIGFEW

SEQ ID NO: 1485548 - protein, 20 aa, Mycobacterium tuberculosis
KANEVALILVGHVTKDGAIA

SEQ ID NO: 1485549 - protein, 17 aa, Mycobacterium tuberculosis
KANGINLWRVDADHVSV

SEQ ID NO: 1485550 - protein, 18 aa, Mycobacterium tuberculosis
KANGYRLVTVSELLGPRA

SEQ ID NO: 1485551 - protein, 17 aa, Mycobacterium tuberculosis
KAPAGITPHLLVMTATP

SEQ ID NO: 1485552 - protein, 17 aa, Mycobacterium tuberculosis
KAPGATVALTFQDPSGG

SEQ ID NO: 1485553 - protein, 19 aa, Mycobacterium tuberculosis
KAPLGYRPALSTAVMSTMS

SEQ ID NO: 1485554 - protein, 19 aa, Mycobacterium tuberculosis
KAPVRRACYAADRTGHMIL

SEQ ID NO: 1485555 - protein, 19 aa, Mycobacterium tuberculosis
KAQDWLHNRVPALDGQRFL

SEQ ID NO: 1485556 - protein, 27 aa, Mycobacterium tuberculosis
KAQRRAWCVRARWPPSSRHALPNLIGA

SEQ ID NO: 1485557 - protein, 36 aa, Mycobacterium tuberculosis
KARETLEVIAPLAHRLGMASVKWELEDLSFAILHPK

SEQ ID NO: 1485558 - protein, 19 aa, Mycobacterium tuberculosis
KARFVPGNENFQMGAYLKS

SEQ ID NO: 1485559 - protein, 20 aa, Mycobacterium tuberculosis
KARNVGWRVAGEPGKNTVTM

SEQ ID NO: 1485560 - protein, 24 aa, Mycobacterium tuberculosis
KARVRALGVAGAFHTEFMAPALDG

SEQ ID NO: 1485561 - protein, 19 aa, Mycobacterium tuberculosis
KARYLRPLLDGEITSCYSM

SEQ ID NO: 1485562 - protein, 26 aa, Mycobacterium tuberculosis
KASATHRAGACGGVGAGTAGPAVAAG

SEQ ID NO: 1485563 - protein, 19 aa, Mycobacterium tuberculosis
KATGLPIDFTGFISDRHAV

SEQ ID NO: 1485564 - protein, 21 aa, Mycobacterium tuberculosis
KATQEDPWRHFARTHAIGQIV

SEQ ID NO: 1485565 - protein, 17 aa, Mycobacterium tuberculosis
KAVAGAFEAARAAMVDP

SEQ ID NO: 1485566 - protein, 20 aa, Mycobacterium tuberculosis
KAVGLHAVAAVAAVADQHPA

SEQ ID NO: 1485567 - protein, 21 aa, Mycobacterium tuberculosis
KAWFPLTKRWLGFEDAHITFE

SEQ ID NO: 1485568 - protein, 17 aa, Mycobacterium tuberculosis
KAYNWTVATLKADIDAW

SEQ ID NO: 1485569 - protein, 27 aa, Mycobacterium tuberculosis
KCQQVWCPLCALAALVTGEQHPLLTVI

SEQ ID NO: 1485570 - protein, 17 aa, Mycobacterium tuberculosis
KCREYRITPGVRRGPRG

SEQ ID NO: 1485571 - protein, 19 aa, Mycobacterium tuberculosis
KDAHKVLAMASNRKYGLDL

SEQ ID NO: 1485572 - protein, 19 aa, Mycobacterium tuberculosis
KDALGVNWRVRCETGEPAA

SEQ ID NO: 1485573 - protein, 23 aa, Mycobacterium tuberculosis
KDFLELLRYLAVELLPGPLGDLI

SEQ ID NO: 1485574 - protein, 19 aa, Mycobacterium tuberculosis
KDFTPSELLAAGRRIAELE

SEQ ID NO: 1485575 - protein, 30 aa, Mycobacterium tuberculosis
KDGLLAVTFCSRAAWRFVASRGAQKQADEI

SEQ ID NO: 1485576 - protein, 19 aa, Mycobacterium tuberculosis
KDGTAFLRVLNRDRNYTAP

SEQ ID NO: 1485577 - protein, 24 aa, Mycobacterium tuberculosis
KDHLELGESLGLIDMQRGAKVSGS

SEQ ID NO: 1485578 - protein, 18 aa, Mycobacterium tuberculosis
KDKASGDFVWDEDESEAL

SEQ ID NO: 1485579 - protein, 21 aa, Mycobacterium tuberculosis
KDKRVLRLVNWQRIRHRWNWT

SEQ ID NO: 1485580 - protein, 23 aa, Mycobacterium tuberculosis
KDLLRNTIVSFLRYIDANRASWI

SEQ ID NO: 1485581 - protein, 18 aa, Mycobacterium tuberculosis
KDQVVAHILNLLLTGKLR

SEQ ID NO: 1485582 - protein, 26 aa, Mycobacterium tuberculosis
KDRFGAEIRTHYPLELEAEMGVIVQE

SEQ ID NO: 1485583 - protein, 24 aa, Mycobacterium tuberculosis
KDRGCSFPNCDVPGYLTEVHHVTD

SEQ ID NO: 1485584 - protein, 26 aa, Mycobacterium tuberculosis
KDRGCSFPNCDVPGYLTEVHHVTDFA

SEQ ID NO: 1485585 - protein, 18 aa, Mycobacterium tuberculosis
KDRIGVAMLQAAEQAGLI

SEQ ID NO: 1485586 - protein, 23 aa, Mycobacterium tuberculosis
KDRMPTPYLPVGLKLNALEGTGE

SEQ ID NO: 1485587 - protein, 22 aa, Mycobacterium tuberculosis
KDRPELASALGAAGQVFTTGVP

SEQ ID NO: 1485588 - protein, 24 aa, Mycobacterium tuberculosis
KDRVYCPGWVALFRWLKPLLSTRV

SEQ ID NO: 1485589 - protein, 17 aa, Mycobacterium tuberculosis
KDRYAAIVNKLKAILVD

SEQ ID NO: 1485590 - protein, 19 aa, Mycobacterium tuberculosis
KDSPLARALAKLGVPPTTW

SEQ ID NO: 1485591 - protein, 19 aa, Mycobacterium tuberculosis
KDTAAPLWTFPRVAWEREL

SEQ ID NO: 1485592 - protein, 24 aa, Mycobacterium tuberculosis
KDVFVPRHRFLSYKAMNDHTAGGL

SEQ ID NO: 1485593 - protein, 20 aa, Mycobacterium tuberculosis
KDVGFPYRSALVPRRNAELD

SEQ ID NO: 1485594 - protein, 18 aa, Mycobacterium tuberculosis
KDVQIRDGLHILGQNPTG

SEQ ID NO: 1485595 - protein, 19 aa, Mycobacterium tuberculosis
KDVSTAWQLDAYRFEIPVV

SEQ ID NO: 1485596 - protein, 23 aa, Mycobacterium tuberculosis
KEAVLPFDRFRRADGAAIDSLLG

SEQ ID NO: 1485597 - protein, 27 aa, Mycobacterium tuberculosis
KEDYFKLGYRGARFAFGYGACPDLEDR

SEQ ID NO: 1485598 - protein, 19 aa, Mycobacterium tuberculosis
KEEDINMWESLTHESALTS

SEQ ID NO: 1485599 - protein, 18 aa, Mycobacterium tuberculosis
KEELARWTPILEQEEVRQ

SEQ ID NO: 1485600 - protein, 23 aa, Mycobacterium tuberculosis
KEGDDVFVALSWTKHPPPQTYDE

SEQ ID NO: 1485601 - protein, 17 aa, Mycobacterium tuberculosis
KEHVDFFPLTVDVEERM

SEQ ID NO: 1485602 - protein, 20 aa, Mycobacterium tuberculosis
KEILRSYGLHETDTGSPEAQ

SEQ ID NO: 1485603 - protein, 19 aa, Mycobacterium tuberculosis
KEKIMGFGHRVYRHGDSRV

SEQ ID NO: 1485604 - protein, 19 aa, Mycobacterium tuberculosis
KELERVRMASARAAATNAA

SEQ ID NO: 1485605 - protein, 17 aa, Mycobacterium tuberculosis
KELFAAQGLPPFEDDHI

SEQ ID NO: 1485606 - protein, 17 aa, Mycobacterium tuberculosis
KELWRRMSAAGDIYLDN

SEQ ID NO: 1485607 - protein, 24 aa, Mycobacterium tuberculosis
KEMAVTYIHGFPVMGLNQNADPEN

SEQ ID NO: 1485608 - protein, 17 aa, Mycobacterium tuberculosis
KEPLYRLYELRLRQGLA

SEQ ID NO: 1485609 - protein, 17 aa, Mycobacterium tuberculosis
KEPLYRLYELRLRQGLP

SEQ ID NO: 1485610 - protein, 20 aa, Mycobacterium tuberculosis
KEQRARCRRGPQTRATQSGG

SEQ ID NO: 1485611 - protein, 18 aa, Mycobacterium tuberculosis
KERPRVIAVDAVPTEVAA

SEQ ID NO: 1485612 - protein, 24 aa, Mycobacterium tuberculosis
KESQEFDATWSLGRSRVGMRASLA

SEQ ID NO: 1485613 - protein, 21 aa, Mycobacterium tuberculosis
KESRGVHALRARGALIRIGHD

SEQ ID NO: 1485614 - protein, 20 aa, Mycobacterium tuberculosis
KETCAGRYSGIGFGLHNDIV

SEQ ID NO: 1485615 - protein, 31 aa, Mycobacterium tuberculosis
KETLAFFAGIGIPIAEIWGMSELSCVATASH

SEQ ID NO: 1485616 - protein, 26 aa, Mycobacterium tuberculosis
KETLRLHPPLIILMRVAKGEFEVQGH

SEQ ID NO: 1485617 - protein, 18 aa, Mycobacterium tuberculosis
KEVREMQALLAKYGAGPR

SEQ ID NO: 1485618 - protein, 21 aa, Mycobacterium tuberculosis
KEVVAAHLVNLVWNGLTHLEA

SEQ ID NO: 1485619 - protein, 17 aa, Mycobacterium tuberculosis
KEYARKHPHSMGEWSMA

SEQ ID NO: 1485620 - protein, 18 aa, Mycobacterium tuberculosis
KFADEFHPELQFDKPYLL

SEQ ID NO: 1485621 - protein, 18 aa, Mycobacterium tuberculosis
KFAGIDWRPSELGSPIIE

SEQ ID NO: 1485622 - protein, 20 aa, Mycobacterium tuberculosis
KFASRNARRFTLTVGLMLPR

SEQ ID NO: 1485623 - protein, 25 aa, Mycobacterium tuberculosis
KFCVQRKFVETRWVHRAQQRHRIMT

SEQ ID NO: 1485624 - protein, 20 aa, Mycobacterium tuberculosis
KFDRSGIHKRHRGAELSDTS

SEQ ID NO: 1485625 - protein, 20 aa, Mycobacterium tuberculosis
KFRTGGYMIDFWGVGYQVAK

SEQ ID NO: 1485626 - protein, 19 aa, Mycobacterium tuberculosis
KFSPFSGFGYFTSGLSGFA

SEQ ID NO: 1485627 - protein, 17 aa, Mycobacterium tuberculosis
KFVRSETIPEFLAALEK

SEQ ID NO: 1485628 - protein, 19 aa, Mycobacterium tuberculosis
KFYTSLFGWGYDDNPVPGG

SEQ ID NO: 1485629 - protein, 22 aa, Mycobacterium tuberculosis
KGADPGGLFPIPGAGGKGGTGG

SEQ ID NO: 1485630 - protein, 22 aa, Mycobacterium tuberculosis
KGAPTPVAWTRMRAPRSLMAAI

SEQ ID NO: 1485631 - protein, 27 aa, Mycobacterium tuberculosis
KGARLTTQVSLAGRFLVYVPGASSTGI

SEQ ID NO: 1485632 - protein, 24 aa, Mycobacterium tuberculosis
KGASFTPSLEQWVSFWSGSSDLPT

SEQ ID NO: 1485633 - protein, 17 aa, Mycobacterium tuberculosis
KGAWVLARYDDGRPSQV

SEQ ID NO: 1485634 - protein, 19 aa, Mycobacterium tuberculosis
KGDSGGPVYLAPDGGPAQI

SEQ ID NO: 1485635 - protein, 27 aa, Mycobacterium tuberculosis
KGESYPTAMLMVFKLHRDFDIAEALKH

SEQ ID NO: 1485636 - protein, 20 aa, Mycobacterium tuberculosis
KGFFEKTFAPLGLKKIQAEV

SEQ ID NO: 1485637 - protein, 20 aa, Mycobacterium tuberculosis
KGFHWEPTAAYRRASVTSAS

SEQ ID NO: 1485638 - protein, 17 aa, Mycobacterium tuberculosis
KGGAAVFQMMGLCQILR

SEQ ID NO: 1485639 - protein, 28 aa, Mycobacterium tuberculosis
KGGAGTLLGLTVFGDNGGAGVLGDSTDP

SEQ ID NO: 1485640 - protein, 34 aa, Mycobacterium tuberculosis
KGGDGADAVNVVFMPTEPQAATGTAGSAGDPTGG

SEQ ID NO: 1485641 - protein, 20 aa, Mycobacterium tuberculosis
KGGDGGQFGAGGNGGAGGSV

SEQ ID NO: 1485642 - protein, 17 aa, Mycobacterium tuberculosis
KGGSAVKPFAGVPHVSR

SEQ ID NO: 1485643 - protein, 25 aa, Mycobacterium tuberculosis
KGGSGGNGGNAWLTGQGGNGGNAAF

SEQ ID NO: 1485644 - protein, 21 aa, Mycobacterium tuberculosis
KGGTGGWLWGSGGAGGARGVR

SEQ ID NO: 1485645 - protein, 17 aa, Mycobacterium tuberculosis
KGIPFGSVVTFVVRAGN

SEQ ID NO: 1485646 - protein, 18 aa, Mycobacterium tuberculosis
KGISIRRAPGPSWYHFTL

SEQ ID NO: 1485647 - protein, 17 aa, Mycobacterium tuberculosis
KGLPGARARRRGLSDAA

SEQ ID NO: 1485648 - protein, 20 aa, Mycobacterium tuberculosis
KGLRHSVYFTHGIRNAVDSG

SEQ ID NO: 1485649 - protein, 17 aa, Mycobacterium tuberculosis
KGLSRLVRQNCDEVVFI

SEQ ID NO: 1485650 - protein, 29 aa, Mycobacterium tuberculosis
KGNAMGPAFWSEMPEVFHALDADREVRAI

SEQ ID NO: 1485651 - protein, 33 aa, Mycobacterium tuberculosis
KGNPDYGLRLSWNFLARSTAGLWEWAERLGDEV

SEQ ID NO: 1485652 - protein, 20 aa, Mycobacterium tuberculosis
KGNTIAWLYSQRRFEVPSDK

SEQ ID NO: 1485653 - protein, 17 aa, Mycobacterium tuberculosis
KGVSVDVPENFDPTRRS

SEQ ID NO: 1485654 - protein, 26 aa, Mycobacterium tuberculosis
KGWEDKRLGIIIAGFDRRRIPLVAEI

SEQ ID NO: 1485655 - protein, 23 aa, Mycobacterium tuberculosis
KHHRRRRCLADLLSSQRPLPRTN

SEQ ID NO: 1485656 - protein, 19 aa, Mycobacterium tuberculosis
KHLDEKVARIHVEALGGHL

SEQ ID NO: 1485657 - protein, 23 aa, Mycobacterium tuberculosis
KHMRADVTVGAFLSGGIDSTAIA

SEQ ID NO: 1485658 - protein, 20 aa, Mycobacterium tuberculosis
KHMRGVYVAFRHNRTAADAM

SEQ ID NO: 1485659 - protein, 26 aa, Mycobacterium tuberculosis
KHRLARSLFLYALCNGWINENTTVVE

SEQ ID NO: 1485660 - protein, 17 aa, Mycobacterium tuberculosis
KIARPYPRYTRSDCDGD

SEQ ID NO: 1485661 - protein, 19 aa, Mycobacterium tuberculosis
KIERFFPHRARAVPGRDHR

SEQ ID NO: 1485662 - protein, 17 aa, Mycobacterium tuberculosis
KIGALAITEPGGGSDVG

SEQ ID NO: 1485663 - protein, 19 aa, Mycobacterium tuberculosis
KISPHPTIPLAPTVAERAA

SEQ ID NO: 1485664 - protein, 24 aa, Mycobacterium tuberculosis
KITLGTALARLGMFAPALSYLEEP

SEQ ID NO: 1485665 - protein, 25 aa, Mycobacterium tuberculosis
KKCYSLRIASAMAHDEGWLAEHMLI

SEQ ID NO: 1485666 - protein, 17 aa, Mycobacterium tuberculosis
KKLAGLSERLTSAAAAA

SEQ ID NO: 1485667 - protein, 21 aa, Mycobacterium tuberculosis
KKLDPRGVIVVIEAEHLCMAM

SEQ ID NO: 1485668 - protein, 32 aa, Mycobacterium tuberculosis
KKNLYSLKYWGVRGVWGGGGGGGGGGRGGGGG

SEQ ID NO: 1485669 - protein, 26 aa, Mycobacterium tuberculosis
KKPNRKCLRITVGGGRNKVTATFFNA

SEQ ID NO: 1485670 - protein, 27 aa, Mycobacterium tuberculosis
KKPNRKCLRITVGGGRNKVTATFFNAD

SEQ ID NO: 1485671 - protein, 22 aa, Mycobacterium tuberculosis
KKRPEFGKLTPLYPNSGLRLET

SEQ ID NO: 1485672 - protein, 26 aa, Mycobacterium tuberculosis
KLARWAELGVTEVLFGMPDRSADDAA

SEQ ID NO: 1485673 - protein, 19 aa, Mycobacterium tuberculosis
KLASIPVGFAGRAALGLGK

SEQ ID NO: 1485674 - protein, 17 aa, Mycobacterium tuberculosis
KLDTMAANLARLTDLTT

SEQ ID NO: 1485675 - protein, 17 aa, Mycobacterium tuberculosis
KLEKAIDSWIDRYDPAA

SEQ ID NO: 1485676 - protein, 17 aa, Mycobacterium tuberculosis
KLEKAIDSWIDRYDPGA

SEQ ID NO: 1485677 - protein, 18 aa, Mycobacterium tuberculosis
KLEQRFDRELWRKLIDAG

SEQ ID NO: 1485678 - protein, 20 aa, Mycobacterium tuberculosis
KLERFPRGIVPFGDAVASFN

SEQ ID NO: 1485679 - protein, 21 aa, Mycobacterium tuberculosis
KLERFPRGIVPFGDAVASFNP

SEQ ID NO: 1485680 - protein, 19 aa, Mycobacterium tuberculosis
KLFRSEIDWDYLTEPQPEL

SEQ ID NO: 1485681 - protein, 19 aa, Mycobacterium tuberculosis
KLGEADRIVTLLTRDHGLV

SEQ ID NO: 1485682 - protein, 18 aa, Mycobacterium tuberculosis
KLGGEMFGGGQVGLDPDV

SEQ ID NO: 1485683 - protein, 19 aa, Mycobacterium tuberculosis
KLHGLHVTDFLLVPPGALP

SEQ ID NO: 1485684 - protein, 35 aa, Mycobacterium tuberculosis
KLHQCGLPKLMALELFKPFVMKRLVDLNHAQNIKS

SEQ ID NO: 1485685 - protein, 17 aa, Mycobacterium tuberculosis
KLIRARFGVPVPNLTAW

SEQ ID NO: 1485686 - protein, 24 aa, Mycobacterium tuberculosis
KLLQRPEEVAARRGLPIEDVAPAG

SEQ ID NO: 1485687 - protein, 25 aa, Mycobacterium tuberculosis
KLLYKEDCRGFGWLPNIQNRAFLFA

SEQ ID NO: 1485688 - protein, 20 aa, Mycobacterium tuberculosis
KLMRDIPFRVGAVVQSPAYY

SEQ ID NO: 1485689 - protein, 26 aa, Mycobacterium tuberculosis
KLNVSGGVLYRFAVDPDRSAQFLLVV

SEQ ID NO: 1485690 - protein, 24 aa, Mycobacterium tuberculosis
KLPDWSPTSSRTWATKVLAAHPGD

SEQ ID NO: 1485691 - protein, 18 aa, Mycobacterium tuberculosis
KLPEAIAAVSHERIALLV

SEQ ID NO: 1485692 - protein, 21 aa, Mycobacterium tuberculosis
KLRDAWLTARRDLVDRRNRAR

SEQ ID NO: 1485693 - protein, 24 aa, Mycobacterium tuberculosis
KLRDRPRLGVSVLVEGHDAACMSL

SEQ ID NO: 1485694 - protein, 23 aa, Mycobacterium tuberculosis
KLRIPGARVIPTIYFLRHSTDPV

SEQ ID NO: 1485695 - protein, 19 aa, Mycobacterium tuberculosis
KLRSPRLPMPRLESPVLTK

SEQ ID NO: 1485696 - protein, 19 aa, Mycobacterium tuberculosis
KLRVEVFVVEQACPYPELD

SEQ ID NO: 1485697 - protein, 19 aa, Mycobacterium tuberculosis
KLSSAPMTTMWGAPLHRSG

SEQ ID NO: 1485698 - protein, 17 aa, Mycobacterium tuberculosis
KLTGVPMLGISVLGEAH

SEQ ID NO: 1485699 - protein, 17 aa, Mycobacterium tuberculosis
KLVRTFDDPATWTEPGV

SEQ ID NO: 1485700 - protein, 19 aa, Mycobacterium tuberculosis
KLWHPRAHLSARWKDGDQD

SEQ ID NO: 1485701 - protein, 20 aa, Mycobacterium tuberculosis
KMPCDGCSITHQRDDNAAIN

SEQ ID NO: 1485702 - protein, 18 aa, Mycobacterium tuberculosis
KMPPSPPVPPFPPAEPET

SEQ ID NO: 1485703 - protein, 18 aa, Mycobacterium tuberculosis
KMRARWRTPMNCGCSPMS

SEQ ID NO: 1485704 - protein, 18 aa, Mycobacterium tuberculosis
KMTVYRLVHNGELPAVRV

SEQ ID NO: 1485705 - protein, 21 aa, Mycobacterium tuberculosis
KNAKGDTEWLPPPHLDHGQPR

SEQ ID NO: 1485706 - protein, 18 aa, Mycobacterium tuberculosis
KNALARALLSTGAGSPPD

SEQ ID NO: 1485707 - protein, 18 aa, Mycobacterium tuberculosis
KNFIGGQWVAPVHGRYFE

SEQ ID NO: 1485708 - protein, 22 aa, Mycobacterium tuberculosis
KNGIEPCIARAKAYAPFADLIW

SEQ ID NO: 1485709 - protein, 20 aa, Mycobacterium tuberculosis
KNGWASCSRCTPTRRTRSIG

SEQ ID NO: 1485710 - protein, 19 aa, Mycobacterium tuberculosis
KNIGFGLTGDNLVGIGALN

SEQ ID NO: 1485711 - protein, 18 aa, Mycobacterium tuberculosis
KNIRDWDDLLLPGIEVIT

SEQ ID NO: 1485712 - protein, 22 aa, Mycobacterium tuberculosis
KNPRLDRAAGRIVRIRTGPVHP

SEQ ID NO: 1485713 - protein, 20 aa, Mycobacterium tuberculosis
KNPRLRARPRIKGLRLRATD

SEQ ID NO: 1485714 - protein, 19 aa, Mycobacterium tuberculosis
KNTFHGLLLLRHVADLVMT

SEQ ID NO: 1485715 - protein, 22 aa, Mycobacterium tuberculosis
KNTFHGLLLLRHVADLVMTGWP

SEQ ID NO: 1485716 - protein, 23 aa, Mycobacterium tuberculosis
KNTFHGLLLLRHVADLVMTGWPV

SEQ ID NO: 1485717 - protein, 22 aa, Mycobacterium tuberculosis
KNTKGDTEWLPPPHLDHGQPRT

SEQ ID NO: 1485718 - protein, 19 aa, Mycobacterium tuberculosis
KNVRCLLIYNQQWIGSTTT

SEQ ID NO: 1485719 - protein, 19 aa, Mycobacterium tuberculosis
KPACSPSLLSTERPARFAV

SEQ ID NO: 1485720 - protein, 20 aa, Mycobacterium tuberculosis
KPAECWPDPRALTVPSGTGP

SEQ ID NO: 1485721 - protein, 18 aa, Mycobacterium tuberculosis
KPDAPVRYRFHFPRQQRG

SEQ ID NO: 1485722 - protein, 21 aa, Mycobacterium tuberculosis
KPEYGRLRWPAYPAGTNNDRL

SEQ ID NO: 1485723 - protein, 17 aa, Mycobacterium tuberculosis
KPFAGSAPRAADPKLDA

SEQ ID NO: 1485724 - protein, 23 aa, Mycobacterium tuberculosis
KPGLLCVPERFRAMDLPMAAADA

SEQ ID NO: 1485725 - protein, 18 aa, Mycobacterium tuberculosis
KPHVNIGTIGHVDHGKTT

SEQ ID NO: 1485726 - protein, 18 aa, Mycobacterium tuberculosis
KPKFPLPALAAPKFCAPT

SEQ ID NO: 1485727 - protein, 17 aa, Mycobacterium tuberculosis
KPLWRWIKMGQTAPTSP

SEQ ID NO: 1485728 - protein, 17 aa, Mycobacterium tuberculosis
KPMAFVRAILRSDVTDL

SEQ ID NO: 1485729 - protein, 20 aa, Mycobacterium tuberculosis
KPPMPDWLSPVSPIPRLLVP

SEQ ID NO: 1485730 - protein, 19 aa, Mycobacterium tuberculosis
KPPPAWARPQQLQIETDDA

SEQ ID NO: 1485731 - protein, 21 aa, Mycobacterium tuberculosis
KPPRPPWAKPPVNSSANPPFP

SEQ ID NO: 1485732 - protein, 19 aa, Mycobacterium tuberculosis
KPRLCAPRLAAPRLTSPTL

SEQ ID NO: 1485733 - protein, 20 aa, Mycobacterium tuberculosis
KPSKLEVFNAALAAADGGPT

SEQ ID NO: 1485734 - protein, 25 aa, Mycobacterium tuberculosis
KPSRGRLPLEPEYRRLPVGIVANGV

SEQ ID NO: 1485735 - protein, 19 aa, Mycobacterium tuberculosis
KPTTAAFCDAKFERMRVEA

SEQ ID NO: 1485736 - protein, 32 aa, Mycobacterium tuberculosis
KPVLVDFWATWCGPCKMVAPVLEEIATERATD

SEQ ID NO: 1485737 - protein, 21 aa, Mycobacterium tuberculosis
KPVPVGVVGDVYYGGGPAVGA

SEQ ID NO: 1485738 - protein, 29 aa, Mycobacterium tuberculosis
KPVRLAEAIRRFGPIFAQYYGQSEAPMVI

SEQ ID NO: 1485739 - protein, 20 aa, Mycobacterium tuberculosis
KPWGSRFPLISIRDQVQADV

SEQ ID NO: 1485740 - protein, 21 aa, Mycobacterium tuberculosis
KPYSLLMGSIRVADEVSVAFT

SEQ ID NO: 1485741 - protein, 23 aa, Mycobacterium tuberculosis
KQARISTDIGAPGILDLRRVRTV

SEQ ID NO: 1485742 - protein, 22 aa, Mycobacterium tuberculosis
KQASAAKFIWFFRHPNPIRPVV

SEQ ID NO: 1485743 - protein, 19 aa, Mycobacterium tuberculosis
KQDGQWRIAYRRLRNDRLV

SEQ ID NO: 1485744 - protein, 19 aa, Mycobacterium tuberculosis
KQDVPIWKKEFALDGVEWV

SEQ ID NO: 1485745 - protein, 17 aa, Mycobacterium tuberculosis
KQELKWPSGCAQMSRPS

SEQ ID NO: 1485746 - protein, 32 aa, Mycobacterium tuberculosis
KQGLRLADKLTPWRAVDGWRTAAVSAFGMSGT

SEQ ID NO: 1485747 - protein, 25 aa, Mycobacterium tuberculosis
KQIGPRIVPIIPDEARTFGMDSWFP

SEQ ID NO: 1485748 - protein, 21 aa, Mycobacterium tuberculosis
KQLINSIKWARDETGIIPTAG

SEQ ID NO: 1485749 - protein, 17 aa, Mycobacterium tuberculosis
KQLRARSSVPVIMVTAR

SEQ ID NO: 1485750 - protein, 24 aa, Mycobacterium tuberculosis
KQPQRVLGLHFFNPVPVLPLVELV

SEQ ID NO: 1485751 - protein, 24 aa, Mycobacterium tuberculosis
KQRGEPVSCFLLRVEDNMESIGRS

SEQ ID NO: 1485752 - protein, 26 aa, Mycobacterium tuberculosis
KRAALRCLKRRLARTVFQALRTVHQP

SEQ ID NO: 1485753 - protein, 19 aa, Mycobacterium tuberculosis
KRAEALTELGWTDVRVTVE

SEQ ID NO: 1485754 - protein, 17 aa, Mycobacterium tuberculosis
KRAPTVKLCESDEPYLP

SEQ ID NO: 1485755 - protein, 17 aa, Mycobacterium tuberculosis
KRARRETRQVLRRLIDG

SEQ ID NO: 1485756 - protein, 24 aa, Mycobacterium tuberculosis
KRDSEWMGFVHRFLGLQVGVILAT

SEQ ID NO: 1485757 - protein, 22 aa, Mycobacterium tuberculosis
KRELDALGWRRSGAFREKDGRQ

SEQ ID NO: 1485758 - protein, 18 aa, Mycobacterium tuberculosis
KRFRVSARLPIEDVGELY

SEQ ID NO: 1485759 - protein, 17 aa, Mycobacterium tuberculosis
KRIPLDVAEGDTVIYSK

SEQ ID NO: 1485760 - protein, 20 aa, Mycobacterium tuberculosis
KRIVGAKGKAALLRELSDVV

SEQ ID NO: 1485761 - protein, 21 aa, Mycobacterium tuberculosis
KRLAPKGTGAVLSFELAGGIE

SEQ ID NO: 1485762 - protein, 17 aa, Mycobacterium tuberculosis
KRLAQALGINDLGNTPQ

SEQ ID NO: 1485763 - protein, 19 aa, Mycobacterium tuberculosis
KRLAQALGINDLGNTPQRV

SEQ ID NO: 1485764 - protein, 22 aa, Mycobacterium tuberculosis
KRLASPAQRIMLYAKDRGCSRP

SEQ ID NO: 1485765 - protein, 18 aa, Mycobacterium tuberculosis
KRLFARQMEVFAGFSENA

SEQ ID NO: 1485766 - protein, 19 aa, Mycobacterium tuberculosis
KRLPDALADGDRILAVIRG

SEQ ID NO: 1485767 - protein, 17 aa, Mycobacterium tuberculosis
KRLPITAPLVGAITSLA

SEQ ID NO: 1485768 - protein, 26 aa, Mycobacterium tuberculosis
KRLPRIAGPCGMVIFGVTGDLARKKV

SEQ ID NO: 1485769 - protein, 27 aa, Mycobacterium tuberculosis
KRLPRLTRMQRFWISLYFPLTMRSLCN

SEQ ID NO: 1485770 - protein, 19 aa, Mycobacterium tuberculosis
KRPAIDFLDALVSLDLLAR

SEQ ID NO: 1485771 - protein, 18 aa, Mycobacterium tuberculosis
KRPATGWESLTPTEIDVV

SEQ ID NO: 1485772 - protein, 17 aa, Mycobacterium tuberculosis
KRPQQKLPHPRVHRATL

SEQ ID NO: 1485773 - protein, 20 aa, Mycobacterium tuberculosis
KRQSRLGARLGLLDGQPEGM

SEQ ID NO: 1485774 - protein, 18 aa, Mycobacterium tuberculosis
KRRDMLFDHVGALAATVM

SEQ ID NO: 1485775 - protein, 17 aa, Mycobacterium tuberculosis
KRRLPLKTSLEFRERFG

SEQ ID NO: 1485776 - protein, 20 aa, Mycobacterium tuberculosis
KRSLNHWYRMFGPAFETSLG

SEQ ID NO: 1485777 - protein, 21 aa, Mycobacterium tuberculosis
KRSLNHWYRMFGPAFETSLGL

SEQ ID NO: 1485778 - protein, 19 aa, Mycobacterium tuberculosis
KRTEMRAPLSASGDAVPAE

SEQ ID NO: 1485779 - protein, 19 aa, Mycobacterium tuberculosis
KRVGGRMVVQQADRVDVTA

SEQ ID NO: 1485780 - protein, 18 aa, Mycobacterium tuberculosis
KRVLRLVNWQRIRHRWNW

SEQ ID NO: 1485781 - protein, 19 aa, Mycobacterium tuberculosis
KRVPWAPLPPSPPVPPVPP

SEQ ID NO: 1485782 - protein, 25 aa, Mycobacterium tuberculosis
KRVRRWMRRRYLLLEVPQLPGRGWV

SEQ ID NO: 1485783 - protein, 25 aa, Mycobacterium tuberculosis
KRVTFAAFPWRWVGGDGCIVRLVAI

SEQ ID NO: 1485784 - protein, 20 aa, Mycobacterium tuberculosis
KRYHLLLAGASWMAEYGDPD

SEQ ID NO: 1485785 - protein, 20 aa, Mycobacterium tuberculosis
KSAPQPAWLWSRGGGVIAGK

SEQ ID NO: 1485786 - protein, 27 aa, Mycobacterium tuberculosis
KSASSLGLDGTEVFDITGIDVLNDGKT

SEQ ID NO: 1485787 - protein, 23 aa, Mycobacterium tuberculosis
KSDLPRHIAVLCDGNRRWERRAA

SEQ ID NO: 1485788 - protein, 19 aa, Mycobacterium tuberculosis
KSGGCTRPKRRRRRRRACL

SEQ ID NO: 1485789 - protein, 19 aa, Mycobacterium tuberculosis
KSGLKGVTGLKNFWNCTMP

SEQ ID NO: 1485790 - protein, 21 aa, Mycobacterium tuberculosis
KSLADGLARFTWQLRAAAPAA

SEQ ID NO: 1485791 - protein, 21 aa, Mycobacterium tuberculosis
KSLADGLARFTWQLRAADPRL

SEQ ID NO: 1485792 - protein, 21 aa, Mycobacterium tuberculosis
KSLRIFKSEVRELQNENKAEA

SEQ ID NO: 1485793 - protein, 18 aa, Mycobacterium tuberculosis
KSNAEIVFKGRNVEIPDH

SEQ ID NO: 1485794 - protein, 19 aa, Mycobacterium tuberculosis
KSNIAFRIALRAESGDDSR

SEQ ID NO: 1485795 - protein, 24 aa, Mycobacterium tuberculosis
KSPRPHRRSACRQTQNPERGRKRG

SEQ ID NO: 1485796 - protein, 20 aa, Mycobacterium tuberculosis
KSTLLLEVAHRWAQSGRRAL

SEQ ID NO: 1485797 - protein, 22 aa, Mycobacterium tuberculosis
KTALLRLVGRYGIGEDDVDDLL

SEQ ID NO: 1485798 - protein, 23 aa, Mycobacterium tuberculosis
KTARRIAALVVQRAIFLNDRNTA

SEQ ID NO: 1485799 - protein, 17 aa, Mycobacterium tuberculosis
KTATGLTLSPTLIFDYP

SEQ ID NO: 1485800 - protein, 29 aa, Mycobacterium tuberculosis
KTDWLFPQYRELGVYLVRGIPPGHVGVAW

SEQ ID NO: 1485801 - protein, 24 aa, Mycobacterium tuberculosis
KTFCSAARMAIPATRCCWHHVCSR

SEQ ID NO: 1485802 - protein, 22 aa, Mycobacterium tuberculosis
KTFDARCAPAAYRFVSQARHIG

SEQ ID NO: 1485803 - protein, 22 aa, Mycobacterium tuberculosis
KTFTALKIAERIAADNGGSARI

SEQ ID NO: 1485804 - protein, 17 aa, Mycobacterium tuberculosis
KTGARYSFQVAKVDNGR

SEQ ID NO: 1485805 - protein, 20 aa, Mycobacterium tuberculosis
KTGLARLALHTGVPVIPVAM

SEQ ID NO: 1485806 - protein, 26 aa, Mycobacterium tuberculosis
KTGVWSRLMLDIARWRRRRREELAAL

SEQ ID NO: 1485807 - protein, 17 aa, Mycobacterium tuberculosis
KTHDGHHGCQARGALTQ

SEQ ID NO: 1485808 - protein, 18 aa, Mycobacterium tuberculosis
KTHDGHHGCQARGALTQR

SEQ ID NO: 1485809 - protein, 17 aa, Mycobacterium tuberculosis
KTLRLVAEYADIWHSFT

SEQ ID NO: 1485810 - protein, 26 aa, Mycobacterium tuberculosis
KTPEGLRWLYNFIKAQGEHNFGKIYV

SEQ ID NO: 1485811 - protein, 23 aa, Mycobacterium tuberculosis
KTRAEAMAALDIWRDRYPGAAAL

SEQ ID NO: 1485812 - protein, 18 aa, Mycobacterium tuberculosis
KTRKNAKGDTEWLPPPHL

SEQ ID NO: 1485813 - protein, 33 aa, Mycobacterium tuberculosis
KTSNTPSCWTWCARTSPPCWVAPAPKPSTRIGH

SEQ ID NO: 1485814 - protein, 18 aa, Mycobacterium tuberculosis
KTTYPVWMMNAIGDISFH

SEQ ID NO: 1485815 - protein, 17 aa, Mycobacterium tuberculosis
KTVCALLSDWLPATTGD

SEQ ID NO: 1485816 - protein, 20 aa, Mycobacterium tuberculosis
KTVDDYRLAHKIGLDAVLVD

SEQ ID NO: 1485817 - protein, 17 aa, Mycobacterium tuberculosis
KTVRAFAERDILPHVDE

SEQ ID NO: 1485818 - protein, 17 aa, Mycobacterium tuberculosis
KTVRGHLDGIVRMLESD

SEQ ID NO: 1485819 - protein, 17 aa, Mycobacterium tuberculosis
KTVSPHLSPISNMVSMA

SEQ ID NO: 1485820 - protein, 18 aa, Mycobacterium tuberculosis
KTYTRWGAFLDDATGFDA

SEQ ID NO: 1485821 - protein, 23 aa, Mycobacterium tuberculosis
KVDTEIPPPVAGVLVSISADEDA

SEQ ID NO: 1485822 - protein, 20 aa, Mycobacterium tuberculosis
KVEGILDCAELLVVALCDRR

SEQ ID NO: 1485823 - protein, 20 aa, Mycobacterium tuberculosis
KVGLFPRPLPREAAITQVAD

SEQ ID NO: 1485824 - protein, 19 aa, Mycobacterium tuberculosis
KVGLRRGKIIVVRPEHDHG

SEQ ID NO: 1485825 - protein, 19 aa, Mycobacterium tuberculosis
KVKGVSFLADEIGRFIRAA

SEQ ID NO: 1485826 - protein, 17 aa, Mycobacterium tuberculosis
KVLGVHNFYFWPDPRAS

SEQ ID NO: 1485827 - protein, 25 aa, Mycobacterium tuberculosis
KVLRLPRGEGLGVPASGYEIHHGRI

SEQ ID NO: 1485828 - protein, 22 aa, Mycobacterium tuberculosis
KVPRAARVAVRWLRVGRAGPDR

SEQ ID NO: 1485829 - protein, 17 aa, Mycobacterium tuberculosis
KVPSIAETIDWGRTVLA

SEQ ID NO: 1485830 - protein, 26 aa, Mycobacterium tuberculosis
KVPSYWPLGFRRLRWTMRAGRGERES

SEQ ID NO: 1485831 - protein, 31 aa, Mycobacterium tuberculosis
KVRDHPDFPAAAARLGSRLSIHDQPNLGGSG

SEQ ID NO: 1485832 - protein, 19 aa, Mycobacterium tuberculosis
KVRLGDHLDFSNGHTSVHT

SEQ ID NO: 1485833 - protein, 20 aa, Mycobacterium tuberculosis
KVTALQLVWADRRGRWPWAA

SEQ ID NO: 1485834 - protein, 17 aa, Mycobacterium tuberculosis
KVTGSWRLHVATPARDV

SEQ ID NO: 1485835 - protein, 18 aa, Mycobacterium tuberculosis
KVVLDWDALPPVARIELM

SEQ ID NO: 1485836 - protein, 17 aa, Mycobacterium tuberculosis
KVVLGFLGCRDTLPHLQ

SEQ ID NO: 1485837 - protein, 23 aa, Mycobacterium tuberculosis
KVVSERRLWLAVLRAQAELGVAV

SEQ ID NO: 1485838 - protein, 23 aa, Mycobacterium tuberculosis
KWDPGNLSMDWFRAEVAKDTRGE

SEQ ID NO: 1485839 - protein, 21 aa, Mycobacterium tuberculosis
KWELEDLSFAILHPKKYEEIV

SEQ ID NO: 1485840 - protein, 18 aa, Mycobacterium tuberculosis
KWPCFYGIDFPSPAELIA

SEQ ID NO: 1485841 - protein, 21 aa, Mycobacterium tuberculosis
KWSTSIAERVRALLGTPSVDP

SEQ ID NO: 1485842 - protein, 19 aa, Mycobacterium tuberculosis
KWVDARPAAELLYDHRRPP

SEQ ID NO: 1485843 - protein, 19 aa, Mycobacterium tuberculosis
KYAEAGIRAIDLTPAAVGP

SEQ ID NO: 1485844 - protein, 18 aa, Mycobacterium tuberculosis
KYGMTLCALGIAEEIRAD

SEQ ID NO: 1485845 - protein, 31 aa, Mycobacterium tuberculosis
KYKKCHLGREALPLAERVDWLYAKASQHALS

SEQ ID NO: 1485846 - protein, 21 aa, Mycobacterium tuberculosis
KYLAALRRSGLTGEFNSDANA

SEQ ID NO: 1485847 - protein, 27 aa, Mycobacterium tuberculosis
KYPARVKCALLGWMAFKDALAQASEAF

SEQ ID NO: 1485848 - protein, 27 aa, Mycobacterium tuberculosis
KYQLRRRKSRFLQLGQWKHRLLQHRFR

SEQ ID NO: 1485849 - protein, 17 aa, Mycobacterium tuberculosis
KYRGEFEERLKAVLDDI

SEQ ID NO: 1485850 - protein, 24 aa, Mycobacterium tuberculosis
KYTGLKLGGVYGFYPRFTGPQRST

SEQ ID NO: 1485851 - protein, 18 aa, Mycobacterium tuberculosis
KYWIQALAKHFQRQLKPS

SEQ ID NO: 1485852 - protein, 18 aa, Mycobacterium tuberculosis
LAAAAAWDGLAAELGLAA

SEQ ID NO: 1485853 - protein, 18 aa, Mycobacterium tuberculosis
LAAAAAWDGLAEELGTAA

SEQ ID NO: 1485854 - protein, 19 aa, Mycobacterium tuberculosis
LAAAAAWDGLATELQSTAA

SEQ ID NO: 1485855 - protein, 37 aa, Mycobacterium tuberculosis
LAAAARRAPADLVSSCGRRAGGNAGLLLSSGGAGGFG

SEQ ID NO: 1485856 - protein, 19 aa, Mycobacterium tuberculosis
LAAAGCGRIVLTARSQPNP

SEQ ID NO: 1485857 - protein, 18 aa, Mycobacterium tuberculosis
LAAALCYGAAGVAMGTRF

SEQ ID NO: 1485858 - protein, 18 aa, Mycobacterium tuberculosis
LAAAQGWNALASELEKTK

SEQ ID NO: 1485859 - protein, 34 aa, Mycobacterium tuberculosis
LAADCLQLSALLPEWRTELPLRYLESVITQLSQG

SEQ ID NO: 1485860 - protein, 23 aa, Mycobacterium tuberculosis
LAAEAPGALFGEMALSSLAGRAL

SEQ ID NO: 1485861 - protein, 27 aa, Mycobacterium tuberculosis
LAAEICDGWLPIFYSPRMAGMYNEWLD

SEQ ID NO: 1485862 - protein, 17 aa, Mycobacterium tuberculosis
LAAESFGLVTSGLAGGS

SEQ ID NO: 1485863 - protein, 17 aa, Mycobacterium tuberculosis
LAAFCDICVRAFADFAV

SEQ ID NO: 1485864 - protein, 18 aa, Mycobacterium tuberculosis
LAAGDFWGGAGLGGLPGV

SEQ ID NO: 1485865 - protein, 20 aa, Mycobacterium tuberculosis
LAAGGLYRQWALARRAQGDL

SEQ ID NO: 1485866 - protein, 22 aa, Mycobacterium tuberculosis
LAAGGLYRQWALARRAQGDLWA

SEQ ID NO: 1485867 - protein, 18 aa, Mycobacterium tuberculosis
LAAGGYRLAISELTGAYW

SEQ ID NO: 1485868 - protein, 29 aa, Mycobacterium tuberculosis
LAAGGYRLAISELTGAYWAGPAAASMVAA

SEQ ID NO: 1485869 - protein, 17 aa, Mycobacterium tuberculosis
LAAGHGRVDVVDDQTGS

SEQ ID NO: 1485870 - protein, 17 aa, Mycobacterium tuberculosis
LAAHLGLTRSNVSNHLS

SEQ ID NO: 1485871 - protein, 17 aa, Mycobacterium tuberculosis
LAAHLRFLGQVDDAGKA

SEQ ID NO: 1485872 - protein, 19 aa, Mycobacterium tuberculosis
LAAIAGFCAQAAVRRTPLL

SEQ ID NO: 1485873 - protein, 26 aa, Mycobacterium tuberculosis
LAALELIDWPVALVIATGHILANNHP

SEQ ID NO: 1485874 - protein, 31 aa, Mycobacterium tuberculosis
LAALEVGRLSEWRATLIVRESACLDVEDRRA

SEQ ID NO: 1485875 - protein, 17 aa, Mycobacterium tuberculosis
LAALRLGARGGVPRSAG

SEQ ID NO: 1485876 - protein, 19 aa, Mycobacterium tuberculosis
LAALVRLAVEWPLELFGHI

SEQ ID NO: 1485877 - protein, 17 aa, Mycobacterium tuberculosis
LAANVVGGIDWDGHGLL

SEQ ID NO: 1485878 - protein, 28 aa, Mycobacterium tuberculosis
LAAPRKIPPGIGWRKFVYSVSFHKINPG

SEQ ID NO: 1485879 - protein, 17 aa, Mycobacterium tuberculosis
LAAQLYGIGGDGGPGGQ

SEQ ID NO: 1485880 - protein, 17 aa, Mycobacterium tuberculosis
LAAQVGAYHLMRTQGGR

SEQ ID NO: 1485881 - protein, 19 aa, Mycobacterium tuberculosis
LAARARDAGLIATRCPAPA

SEQ ID NO: 1485882 - protein, 22 aa, Mycobacterium tuberculosis
LAARLKAVWAPQGLIHRGQGRW

SEQ ID NO: 1485883 - protein, 21 aa, Mycobacterium tuberculosis
LAATGRPLIGNGANGAPGTGA

SEQ ID NO: 1485884 - protein, 19 aa, Mycobacterium tuberculosis
LAAVTRYFAAYNLVCGPVV

SEQ ID NO: 1485885 - protein, 19 aa, Mycobacterium tuberculosis
LAAWSRRTSWGSTHRQSWR

SEQ ID NO: 1485886 - protein, 17 aa, Mycobacterium tuberculosis
LAAYQLLRVDGGEPVLL

SEQ ID NO: 1485887 - protein, 25 aa, Mycobacterium tuberculosis
LACDVPSLGWRVYRLVPADEAPGWE

SEQ ID NO: 1485888 - protein, 17 aa, Mycobacterium tuberculosis
LACPGLLGAMTVGATAV

SEQ ID NO: 1485889 - protein, 20 aa, Mycobacterium tuberculosis
LADACAHALLDAISRLPQIP

SEQ ID NO: 1485890 - protein, 23 aa, Mycobacterium tuberculosis
LADHARLDFLAGLRVVPAELGGA

SEQ ID NO: 1485891 - protein, 25 aa, Mycobacterium tuberculosis
LADHARLDFLAGLRVVPAELGGAAG

SEQ ID NO: 1485892 - protein, 20 aa, Mycobacterium tuberculosis
LADHLLRSLAIIGAAAGAQL

SEQ ID NO: 1485893 - protein, 18 aa, Mycobacterium tuberculosis
LADIWPVIDRDPAVRVVL

SEQ ID NO: 1485894 - protein, 17 aa, Mycobacterium tuberculosis
LADKAYSHPSTRAALRS

SEQ ID NO: 1485895 - protein, 24 aa, Mycobacterium tuberculosis
LADLFLPRPLRWLAGATRSGVLRR

SEQ ID NO: 1485896 - protein, 23 aa, Mycobacterium tuberculosis
LADLPPAYIAVAGYDPLRDDGIR

SEQ ID NO: 1485897 - protein, 19 aa, Mycobacterium tuberculosis
LADRGLRVLILDQENRANV

SEQ ID NO: 1485898 - protein, 18 aa, Mycobacterium tuberculosis
LADRGMRLTLRVYAYSSC

SEQ ID NO: 1485899 - protein, 23 aa, Mycobacterium tuberculosis
LADRLIPHRAWIFVYQLYLWDMR

SEQ ID NO: 1485900 - protein, 17 aa, Mycobacterium tuberculosis
LADRWWQGPSSRMMAAQ

SEQ ID NO: 1485901 - protein, 18 aa, Mycobacterium tuberculosis
LADRWWQGPSSRMMAAQA

SEQ ID NO: 1485902 - protein, 22 aa, Mycobacterium tuberculosis
LADVVARFLPYFTDVIVGDLRV

SEQ ID NO: 1485903 - protein, 20 aa, Mycobacterium tuberculosis
LAEAACRAFDALAARYDVVV

SEQ ID NO: 1485904 - protein, 23 aa, Mycobacterium tuberculosis
LAEARTTVLLDEIVTLVGTDQRL

SEQ ID NO: 1485905 - protein, 20 aa, Mycobacterium tuberculosis
LAEELRYSVIREVLPTRRAR

SEQ ID NO: 1485906 - protein, 25 aa, Mycobacterium tuberculosis
LAELLRCGQPLLPSTCRRSPALHAA

SEQ ID NO: 1485907 - protein, 18 aa, Mycobacterium tuberculosis
LAELRQLLGSPWTDEHGT

SEQ ID NO: 1485908 - protein, 17 aa, Mycobacterium tuberculosis
LAELRRVLDGAGLSGLT

SEQ ID NO: 1485909 - protein, 25 aa, Mycobacterium tuberculosis
LAELSRLRPLPFRLVLDGTEEIVAD

SEQ ID NO: 1485910 - protein, 25 aa, Mycobacterium tuberculosis
LAELVRRLSVVHGRVTLSSGREADY

SEQ ID NO: 1485911 - protein, 18 aa, Mycobacterium tuberculosis
LAEPRYLIGRKMLTPPAR

SEQ ID NO: 1485912 - protein, 25 aa, Mycobacterium tuberculosis
LAEPSGWAYWVAESLLGPGHSLPIS

SEQ ID NO: 1485913 - protein, 24 aa, Mycobacterium tuberculosis
LAESIPAFGRPAAGAGTGSCRARS

SEQ ID NO: 1485914 - protein, 17 aa, Mycobacterium tuberculosis
LAETLTILGRFSASFGE

SEQ ID NO: 1485915 - protein, 24 aa, Mycobacterium tuberculosis
LAFSREFADLILGERGARDQLSFP

SEQ ID NO: 1485916 - protein, 17 aa, Mycobacterium tuberculosis
LAFSSLDRWPGTVGEYL

SEQ ID NO: 1485917 - protein, 19 aa, Mycobacterium tuberculosis
LAGALLAWVSKVDAWFNGT

SEQ ID NO: 1485918 - protein, 20 aa, Mycobacterium tuberculosis
LAGDAWHGPASLAMTRAASP

SEQ ID NO: 1485919 - protein, 18 aa, Mycobacterium tuberculosis
LAGERPYREFPLDWMLGR

SEQ ID NO: 1485920 - protein, 24 aa, Mycobacterium tuberculosis
LAGEYGGPCYARIDAPADREQKAR

SEQ ID NO: 1485921 - protein, 22 aa, Mycobacterium tuberculosis
LAGLKLLALGGRFIENRQTRHL

SEQ ID NO: 1485922 - protein, 19 aa, Mycobacterium tuberculosis
LAGLLDEWTPVIAGAELGE

SEQ ID NO: 1485923 - protein, 37 aa, Mycobacterium tuberculosis
LAGSDPLLAVPFSYPASLPPFGPVTMTLNGSFDPLTQ

SEQ ID NO: 1485924 - protein, 20 aa, Mycobacterium tuberculosis
LAGSPGRVFAPLAGIGALGV

SEQ ID NO: 1485925 - protein, 27 aa, Mycobacterium tuberculosis
LAGSWAGGSLPRWPPPWSSTRSSKPSG

SEQ ID NO: 1485926 - protein, 28 aa, Mycobacterium tuberculosis
LAGVPYPSLKRMNPWKRFFHNQTKIDEI

SEQ ID NO: 1485927 - protein, 19 aa, Mycobacterium tuberculosis
LAHFADGWNTFNLTLQGDV

SEQ ID NO: 1485928 - protein, 17 aa, Mycobacterium tuberculosis
LAHKIGLDAVLVDSPLA

SEQ ID NO: 1485929 - protein, 23 aa, Mycobacterium tuberculosis
LAHTWKQGRRHPPFPPRNDLTLE

SEQ ID NO: 1485930 - protein, 17 aa, Mycobacterium tuberculosis
LAIEFAAARVRSMSPLE

SEQ ID NO: 1485931 - protein, 24 aa, Mycobacterium tuberculosis
LAIELARSGAKVAISDIDTDGLAD

SEQ ID NO: 1485932 - protein, 17 aa, Mycobacterium tuberculosis
LAIGCGGRHRCDGPRLG

SEQ ID NO: 1485933 - protein, 26 aa, Mycobacterium tuberculosis
LAKEVPRQTAGPAFSAVTALRAGPAV

SEQ ID NO: 1485934 - protein, 21 aa, Mycobacterium tuberculosis
LAKLPTIAAYAYKKSVGQPFL

SEQ ID NO: 1485935 - protein, 23 aa, Mycobacterium tuberculosis
LAKTIKGYALGKHFEGRNATHQM

SEQ ID NO: 1485936 - protein, 22 aa, Mycobacterium tuberculosis
LALAHEVRMGWCGPEVEVEGII

SEQ ID NO: 1485937 - protein, 26 aa, Mycobacterium tuberculosis
LALDKLHLEPGMTLLDIGCGWGGGLQ

SEQ ID NO: 1485938 - protein, 29 aa, Mycobacterium tuberculosis
LALGGRALRWPRFPLVIEAAVAAVDHQPL

SEQ ID NO: 1485939 - protein, 20 aa, Mycobacterium tuberculosis
LALIDVRDPVEWDIVHIDGA

SEQ ID NO: 1485940 - protein, 20 aa, Mycobacterium tuberculosis
LALLGRLLIGNGANGAPGTG

SEQ ID NO: 1485941 - protein, 20 aa, Mycobacterium tuberculosis
LALLGRPLIGNGANGAPGTG

SEQ ID NO: 1485942 - protein, 19 aa, Mycobacterium tuberculosis
LALLNRPLIGNGADGTAAN

SEQ ID NO: 1485943 - protein, 19 aa, Mycobacterium tuberculosis
LALMGRPLIGNEANGAPGT

SEQ ID NO: 1485944 - protein, 19 aa, Mycobacterium tuberculosis
LALQDWLGTAAFYRPEDYW

SEQ ID NO: 1485945 - protein, 25 aa, Mycobacterium tuberculosis
LALQKMSFEVAWRILQATPVTATGL

SEQ ID NO: 1485946 - protein, 17 aa, Mycobacterium tuberculosis
LALREGDTVYVRATRVP

SEQ ID NO: 1485947 - protein, 21 aa, Mycobacterium tuberculosis
LALTAIHLFAGAPPVDRSHTG

SEQ ID NO: 1485948 - protein, 17 aa, Mycobacterium tuberculosis
LALVAAHDDGDSLRVVY

SEQ ID NO: 1485949 - protein, 23 aa, Mycobacterium tuberculosis
LALVKACRGVRLLATCREPLRVE

SEQ ID NO: 1485950 - protein, 17 aa, Mycobacterium tuberculosis
LALYPGDKVQIMGVRVG

SEQ ID NO: 1485951 - protein, 27 aa, Mycobacterium tuberculosis
LAMAARLKGYRLICVMPENTSVERRQL

SEQ ID NO: 1485952 - protein, 21 aa, Mycobacterium tuberculosis
LAMPASTLWLANMGVGNIGFA

SEQ ID NO: 1485953 - protein, 21 aa, Mycobacterium tuberculosis
LANAIGYPIAASVALVTPATG

SEQ ID NO: 1485954 - protein, 27 aa, Mycobacterium tuberculosis
LANAKRWGVLHVIWRQGYYPGIGAPSW

SEQ ID NO: 1485955 - protein, 24 aa, Mycobacterium tuberculosis
LANALRSWSVLRFEVTEDPSPGVD

SEQ ID NO: 1485956 - protein, 18 aa, Mycobacterium tuberculosis
LANHAFYYGALRGLSEAD

SEQ ID NO: 1485957 - protein, 23 aa, Mycobacterium tuberculosis
LANLFPFQLFLVLYGLPLEDRDR

SEQ ID NO: 1485958 - protein, 20 aa, Mycobacterium tuberculosis
LANTGRPLIGNGANGAPGTG

SEQ ID NO: 1485959 - protein, 20 aa, Mycobacterium tuberculosis
LANTGRPLIGNGTNGAPGTG

SEQ ID NO: 1485960 - protein, 22 aa, Mycobacterium tuberculosis
LAPDAKPYQGGHRFHQVEVVPA

SEQ ID NO: 1485961 - protein, 18 aa, Mycobacterium tuberculosis
LAPENPYPAALGDCYSAL

SEQ ID NO: 1485962 - protein, 18 aa, Mycobacterium tuberculosis
LAPGGAIVCGRRGGFVGA

SEQ ID NO: 1485963 - protein, 19 aa, Mycobacterium tuberculosis
LAPGRALRCAEAVARGDAS

SEQ ID NO: 1485964 - protein, 17 aa, Mycobacterium tuberculosis
LAPGRRALVRTGVAVAV

SEQ ID NO: 1485965 - protein, 18 aa, Mycobacterium tuberculosis
LAPNFKGSIPRYTTFTPK

SEQ ID NO: 1485966 - protein, 17 aa, Mycobacterium tuberculosis
LAPPELLAELPPHVEVI

SEQ ID NO: 1485967 - protein, 18 aa, Mycobacterium tuberculosis
LAPPSPRYAPASWAAPLQ

SEQ ID NO: 1485968 - protein, 20 aa, Mycobacterium tuberculosis
LAPRRTTLPGGLRVVTEFLP

SEQ ID NO: 1485969 - protein, 25 aa, Mycobacterium tuberculosis
LAPWQIHDWILLTPWGLLSWPQINQ

SEQ ID NO: 1485970 - protein, 18 aa, Mycobacterium tuberculosis
LAPYTGSAIAQHWMYEGK

SEQ ID NO: 1485971 - protein, 17 aa, Mycobacterium tuberculosis
LAQALGINDLGNTPQRV

SEQ ID NO: 1485972 - protein, 25 aa, Mycobacterium tuberculosis
LAQLGKRWRSGGCSCRSRCRPSAGW

SEQ ID NO: 1485973 - protein, 20 aa, Mycobacterium tuberculosis
LAQLRPQPILQLPDTNSGWR

SEQ ID NO: 1485974 - protein, 26 aa, Mycobacterium tuberculosis
LAQRARQAWDGVRIVIGNAMATLNYE

SEQ ID NO: 1485975 - protein, 26 aa, Mycobacterium tuberculosis
LAQRQGIEILGPVGVAARTAATVGDA

SEQ ID NO: 1485976 - protein, 29 aa, Mycobacterium tuberculosis
LARAGSRAAPLLRLPDVRALLDAQLAGRP

SEQ ID NO: 1485977 - protein, 19 aa, Mycobacterium tuberculosis
LARAPRSAGHWLAVAEAVV

SEQ ID NO: 1485978 - protein, 22 aa, Mycobacterium tuberculosis
LARDRGRQMRKLGITIDFAPVV

SEQ ID NO: 1485979 - protein, 17 aa, Mycobacterium tuberculosis
LARHANHYLAIFDRGKA

SEQ ID NO: 1485980 - protein, 18 aa, Mycobacterium tuberculosis
LARLSRMSVLGPLGESFG

SEQ ID NO: 1485981 - protein, 25 aa, Mycobacterium tuberculosis
LARLWPSLLADRYGRGFSVARRLAL

SEQ ID NO: 1485982 - protein, 22 aa, Mycobacterium tuberculosis
LARPADIGWAAAFLASDAASYI

SEQ ID NO: 1485983 - protein, 20 aa, Mycobacterium tuberculosis
LARRAAQVIADRTGIGEHDV

SEQ ID NO: 1485984 - protein, 22 aa, Mycobacterium tuberculosis
LARRAWQRFQAIEARGGFVEAH

SEQ ID NO: 1485985 - protein, 21 aa, Mycobacterium tuberculosis
LARRRGHRPVRTAVLAATTAE

SEQ ID NO: 1485986 - protein, 24 aa, Mycobacterium tuberculosis
LARSWLISVVRIGPRPARRDGHLR

SEQ ID NO: 1485987 - protein, 25 aa, Mycobacterium tuberculosis
LARVHPRATGIVLMLGDQPQVAPAT

SEQ ID NO: 1485988 - protein, 17 aa, Mycobacterium tuberculosis
LARVLGIAATRDRARDL

SEQ ID NO: 1485989 - protein, 22 aa, Mycobacterium tuberculosis
LASAPPGYRLAVADNQYDVARF

SEQ ID NO: 1485990 - protein, 21 aa, Mycobacterium tuberculosis
LASCLQPLWRARGRLQEGLAW

SEQ ID NO: 1485991 - protein, 22 aa, Mycobacterium tuberculosis
LASCLQPLWRARGRLQEGLAWF

SEQ ID NO: 1485992 - protein, 25 aa, Mycobacterium tuberculosis
LASDPEGWIRCQLDGVLIEQSSAVH

SEQ ID NO: 1485993 - protein, 24 aa, Mycobacterium tuberculosis
LASELRRLRRCIAAAAGADHPLLP

SEQ ID NO: 1485994 - protein, 17 aa, Mycobacterium tuberculosis
LASLDKFSTAWDYRARA

SEQ ID NO: 1485995 - protein, 19 aa, Mycobacterium tuberculosis
LASMPGIDFDALYRGESPG

SEQ ID NO: 1485996 - protein, 20 aa, Mycobacterium tuberculosis
LASRACVVINHIMPGEPNVA

SEQ ID NO: 1485997 - protein, 21 aa, Mycobacterium tuberculosis
LASSLQPIWFGRAHLREGLSW

SEQ ID NO: 1485998 - protein, 18 aa, Mycobacterium tuberculosis
LASVCGSTGWVSSIVGVH

SEQ ID NO: 1485999 - protein, 27 aa, Mycobacterium tuberculosis
LATAETWPNPWPMYRALRDHDPVHHVV

SEQ ID NO: 1486000 - protein, 18 aa, Mycobacterium tuberculosis
LATDSWLSAASFQEATRV

SEQ ID NO: 1486001 - protein, 18 aa, Mycobacterium tuberculosis
LATDSWLSAASFQENHSR

SEQ ID NO: 1486002 - protein, 25 aa, Mycobacterium tuberculosis
LATDSWLSAISLQMSVSYADRCDDQ

SEQ ID NO: 1486003 - protein, 18 aa, Mycobacterium tuberculosis
LATEIPLRTWLFRIADDE

SEQ ID NO: 1486004 - protein, 24 aa, Mycobacterium tuberculosis
LATLARGGGIGTLGTTTTEPAVCA

SEQ ID NO: 1486005 - protein, 20 aa, Mycobacterium tuberculosis
LATLEHNGLNALNAPTQALL

SEQ ID NO: 1486006 - protein, 18 aa, Mycobacterium tuberculosis
LATMRARKTGRGGARQSP

SEQ ID NO: 1486007 - protein, 18 aa, Mycobacterium tuberculosis
LATPGFLSGIGNFGTNLA

SEQ ID NO: 1486008 - protein, 23 aa, Mycobacterium tuberculosis
LATQGRGAWPVCGRGLSNATPRE

SEQ ID NO: 1486009 - protein, 17 aa, Mycobacterium tuberculosis
LATWKRLCDPMAQQIST

SEQ ID NO: 1486010 - protein, 24 aa, Mycobacterium tuberculosis
LAVARRLADEGCHVLCADIDGDAA

SEQ ID NO: 1486011 - protein, 22 aa, Mycobacterium tuberculosis
LAVDHFRYFAAAIRAQEGALSQ

SEQ ID NO: 1486012 - protein, 17 aa, Mycobacterium tuberculosis
LAVDYLTSMGLRILNRN

SEQ ID NO: 1486013 - protein, 17 aa, Mycobacterium tuberculosis
LAVELDLAGIVATNTTV

SEQ ID NO: 1486014 - protein, 17 aa, Mycobacterium tuberculosis
LAVFHPKGGIVRRELED

SEQ ID NO: 1486015 - protein, 19 aa, Mycobacterium tuberculosis
LAVLQRLVSRWDRPLRDVD

SEQ ID NO: 1486016 - protein, 32 aa, Mycobacterium tuberculosis
LAVPPHGWVNLHFSLLPAWRGAAPVQAAIAAG

SEQ ID NO: 1486017 - protein, 17 aa, Mycobacterium tuberculosis
LAVPVADSYARELAAAR

SEQ ID NO: 1486018 - protein, 19 aa, Mycobacterium tuberculosis
LAVQVLKLPRLKAVAHATD

SEQ ID NO: 1486019 - protein, 20 aa, Mycobacterium tuberculosis
LAVRRIAERPGLTVGLEPLL

SEQ ID NO: 1486020 - protein, 17 aa, Mycobacterium tuberculosis
LAVVMVEHRADPHAFVL

SEQ ID NO: 1486021 - protein, 17 aa, Mycobacterium tuberculosis
LAWLHPPGIDFGPALLA

SEQ ID NO: 1486022 - protein, 17 aa, Mycobacterium tuberculosis
LCAAVLVSSGCARFNDA

SEQ ID NO: 1486023 - protein, 21 aa, Mycobacterium tuberculosis
LCADMSALDGWVMRGSPPRPG

SEQ ID NO: 1486024 - protein, 19 aa, Mycobacterium tuberculosis
LCALAGESDERVALAVAVA

SEQ ID NO: 1486025 - protein, 17 aa, Mycobacterium tuberculosis
LCALPEPARAVVDYLAI

SEQ ID NO: 1486026 - protein, 20 aa, Mycobacterium tuberculosis
LCDIFARYDVTFSLGDWLRP

SEQ ID NO: 1486027 - protein, 21 aa, Mycobacterium tuberculosis
LCDSVGWTADVERISAWLNGL

SEQ ID NO: 1486028 - protein, 19 aa, Mycobacterium tuberculosis
LCDWCPHQQRCPAFGGTPP

SEQ ID NO: 1486029 - protein, 18 aa, Mycobacterium tuberculosis
LCELKDIIDRSAAAGDPC

SEQ ID NO: 1486030 - protein, 27 aa, Mycobacterium tuberculosis
LCESDEPYLPLNDGYNWKGDPNATVPG

SEQ ID NO: 1486031 - protein, 20 aa, Mycobacterium tuberculosis
LCGVARGQTLVLYRPDPAGD

SEQ ID NO: 1486032 - protein, 17 aa, Mycobacterium tuberculosis
LCGYGPIPAAVARTMVA

SEQ ID NO: 1486033 - protein, 18 aa, Mycobacterium tuberculosis
LCNSAGFGTSGRFWSCRS

SEQ ID NO: 1486034 - protein, 23 aa, Mycobacterium tuberculosis
LCRDNCHYCTFVTVPGKLRAQGS

SEQ ID NO: 1486035 - protein, 19 aa, Mycobacterium tuberculosis
LCRFARCRRGASADRGLGS

SEQ ID NO: 1486036 - protein, 20 aa, Mycobacterium tuberculosis
LCRRGCAAVGGRWRRWRPEG

SEQ ID NO: 1486037 - protein, 19 aa, Mycobacterium tuberculosis
LCSPTRASLLTGRNATTVG

SEQ ID NO: 1486038 - protein, 19 aa, Mycobacterium tuberculosis
LCVTIRMVASIGGPRVEHT

SEQ ID NO: 1486039 - protein, 17 aa, Mycobacterium tuberculosis
LDAAAGRVDTGARSGRR

SEQ ID NO: 1486040 - protein, 20 aa, Mycobacterium tuberculosis
LDAEILALVKRRAEVSKAIG

SEQ ID NO: 1486041 - protein, 23 aa, Mycobacterium tuberculosis
LDAIEDLHIWTAESVRADRLDFR

SEQ ID NO: 1486042 - protein, 25 aa, Mycobacterium tuberculosis
LDAKITLDCFFDFRQPGHAEFEDRA

SEQ ID NO: 1486043 - protein, 17 aa, Mycobacterium tuberculosis
LDALYLLSAPVDGAALN

SEQ ID NO: 1486044 - protein, 23 aa, Mycobacterium tuberculosis
LDAMCRRLRSQGVRLVYETARRG

SEQ ID NO: 1486045 - protein, 28 aa, Mycobacterium tuberculosis
LDARAYRLPWPAGTVVYEIDQPQVIDFK

SEQ ID NO: 1486046 - protein, 27 aa, Mycobacterium tuberculosis
LDASTFLGRLALIRIYNGRIRKGQQVA

SEQ ID NO: 1486047 - protein, 17 aa, Mycobacterium tuberculosis
LDCRDFCVARTPVASLW

SEQ ID NO: 1486048 - protein, 18 aa, Mycobacterium tuberculosis
LDDEFLEIQAGYAQNIVV

SEQ ID NO: 1486049 - protein, 30 aa, Mycobacterium tuberculosis
LDDLAERVGWRWRLVWYRAVAELLTGDYDS

SEQ ID NO: 1486050 - protein, 18 aa, Mycobacterium tuberculosis
LDDLAKRLIVLVEPVEAI

SEQ ID NO: 1486051 - protein, 21 aa, Mycobacterium tuberculosis
LDDRFRLLTGGARSTVQRQQT

SEQ ID NO: 1486052 - protein, 20 aa, Mycobacterium tuberculosis
LDDVSAHPASIGFPPYHPPM

SEQ ID NO: 1486053 - protein, 35 aa, Mycobacterium tuberculosis
LDELPMSLMRCARGFRRWANPPLKTSAMPPRTDSV

SEQ ID NO: 1486054 - protein, 26 aa, Mycobacterium tuberculosis
LDEPIAVVGMGCRFPGGISCPEALWD

SEQ ID NO: 1486055 - protein, 23 aa, Mycobacterium tuberculosis
LDERGVLRLRALMESFWSDELDR

SEQ ID NO: 1486056 - protein, 17 aa, Mycobacterium tuberculosis
LDFARKILADHGVPVED

SEQ ID NO: 1486057 - protein, 17 aa, Mycobacterium tuberculosis
LDFARSIAEQGHLPAEV

SEQ ID NO: 1486058 - protein, 19 aa, Mycobacterium tuberculosis
LDFFAELTIYTSSACLIGK

SEQ ID NO: 1486059 - protein, 29 aa, Mycobacterium tuberculosis
LDFFKDPVKGFFRALDYTLPWDVDTVEDS

SEQ ID NO: 1486060 - protein, 25 aa, Mycobacterium tuberculosis
LDFMGSCAYAVLAQESVRCRRRGVN

SEQ ID NO: 1486061 - protein, 19 aa, Mycobacterium tuberculosis
LDFMRSCSIRHRMASVIFS

SEQ ID NO: 1486062 - protein, 23 aa, Mycobacterium tuberculosis
LDFPELVIVCGHVGYPWTEEMVA

SEQ ID NO: 1486063 - protein, 25 aa, Mycobacterium tuberculosis
LDFRPKHKLAVLVVCAIPLAEPVRL

SEQ ID NO: 1486064 - protein, 24 aa, Mycobacterium tuberculosis
LDFRPKHRLAVLVVCAIPLAEPVR

SEQ ID NO: 1486065 - protein, 24 aa, Mycobacterium tuberculosis
LDFRPKHRLAVLVVCASRWPSRSG

SEQ ID NO: 1486066 - protein, 21 aa, Mycobacterium tuberculosis
LDFVQRSVLLFAARGADGLVD

SEQ ID NO: 1486067 - protein, 21 aa, Mycobacterium tuberculosis
LDGFCSASLMVDHPACRRAVS

SEQ ID NO: 1486068 - protein, 27 aa, Mycobacterium tuberculosis
LDGHLIVTCCEVPAQALLGLQVTVGPI

SEQ ID NO: 1486069 - protein, 24 aa, Mycobacterium tuberculosis
LDGLNRVSAILARDKDNLGRALDT

SEQ ID NO: 1486070 - protein, 17 aa, Mycobacterium tuberculosis
LDGQRFLLTAGFFETHR

SEQ ID NO: 1486071 - protein, 20 aa, Mycobacterium tuberculosis
LDHACGLGTGGLFEEDVAEP

SEQ ID NO: 1486072 - protein, 17 aa, Mycobacterium tuberculosis
LDHPPVLLIMGLGAQML

SEQ ID NO: 1486073 - protein, 30 aa, Mycobacterium tuberculosis
LDINKYGAFCWSRCPSWPTRWTRNHSLEGT

SEQ ID NO: 1486074 - protein, 33 aa, Mycobacterium tuberculosis
LDISPLQARCGWAVGWRKDAFFGRAALLAEKAA

SEQ ID NO: 1486075 - protein, 19 aa, Mycobacterium tuberculosis
LDISRTNWLAALRTDVPRD

SEQ ID NO: 1486076 - protein, 21 aa, Mycobacterium tuberculosis
LDKLTKWSMPLIRPNGRMLAI

SEQ ID NO: 1486077 - protein, 18 aa, Mycobacterium tuberculosis
LDKRGHRLGPAFAGLVDA

SEQ ID NO: 1486078 - protein, 17 aa, Mycobacterium tuberculosis
LDLCAGPGGKTALLAGL

SEQ ID NO: 1486079 - protein, 18 aa, Mycobacterium tuberculosis
LDLERAMELCAPDECVEV

SEQ ID NO: 1486080 - protein, 21 aa, Mycobacterium tuberculosis
LDLFLLILVELFRRHLSSTEQ

SEQ ID NO: 1486081 - protein, 17 aa, Mycobacterium tuberculosis
LDLGKLLELKREWGVSM

SEQ ID NO: 1486082 - protein, 17 aa, Mycobacterium tuberculosis
LDLGSLVAGSRYRGDFE

SEQ ID NO: 1486083 - protein, 29 aa, Mycobacterium tuberculosis
LDLGSLVAGSRYRGDFEERLKKCSRRSHP

SEQ ID NO: 1486084 - protein, 25 aa, Mycobacterium tuberculosis
LDLGSLVAGSRYRGDFEERLKKVLK

SEQ ID NO: 1486085 - protein, 21 aa, Mycobacterium tuberculosis
LDLHAPVARYWPEFGQAGKQA

SEQ ID NO: 1486086 - protein, 22 aa, Mycobacterium tuberculosis
LDLRNRLKRSIGATVSLATLMG

SEQ ID NO: 1486087 - protein, 21 aa, Mycobacterium tuberculosis
LDLTSRFPLDPAVAAVDAHIQ

SEQ ID NO: 1486088 - protein, 25 aa, Mycobacterium tuberculosis
LDMARRMGPGLVHLHLCDGSGLPAD

SEQ ID NO: 1486089 - protein, 19 aa, Mycobacterium tuberculosis
LDMVVGGAVLKHSRDFNLM

SEQ ID NO: 1486090 - protein, 29 aa, Mycobacterium tuberculosis
LDNGNWVWRYDAIRTFGDFAGLWDDVDAL

SEQ ID NO: 1486091 - protein, 18 aa, Mycobacterium tuberculosis
LDNLTFVINCNLQRLDGP

SEQ ID NO: 1486092 - protein, 19 aa, Mycobacterium tuberculosis
LDPDLLIGEMVFVPNPSAR

SEQ ID NO: 1486093 - protein, 18 aa, Mycobacterium tuberculosis
LDPGDLYDVLAINAASAS

SEQ ID NO: 1486094 - protein, 19 aa, Mycobacterium tuberculosis
LDPINEFFLANRRPAEPKR

SEQ ID NO: 1486095 - protein, 20 aa, Mycobacterium tuberculosis
LDPLFEVLEKHVPPPKGEPD

SEQ ID NO: 1486096 - protein, 17 aa, Mycobacterium tuberculosis
LDPMIALSFAAAASSRV

SEQ ID NO: 1486097 - protein, 26 aa, Mycobacterium tuberculosis
LDPPLRLRACLRRRRLAARRHPGAQR

SEQ ID NO: 1486098 - protein, 19 aa, Mycobacterium tuberculosis
LDPRPAVDRHPGRRGEPRR

SEQ ID NO: 1486099 - protein, 17 aa, Mycobacterium tuberculosis
LDPRRGYGQPVFDGSGV

SEQ ID NO: 1486100 - protein, 18 aa, Mycobacterium tuberculosis
LDPSRDALTFARRRGVLV

SEQ ID NO: 1486101 - protein, 19 aa, Mycobacterium tuberculosis
LDPTMAYTCAYFEREDMTL

SEQ ID NO: 1486102 - protein, 18 aa, Mycobacterium tuberculosis
LDPVSTRRRAHRAVPAVH

SEQ ID NO: 1486103 - protein, 26 aa, Mycobacterium tuberculosis
LDQQRQWILHMAKLSAAMAKQAQYVA

SEQ ID NO: 1486104 - protein, 19 aa, Mycobacterium tuberculosis
LDRAADLFCHAVGSTRPLT

SEQ ID NO: 1486105 - protein, 26 aa, Mycobacterium tuberculosis
LDRERCILCARCTRFSDQIAGDPFID

SEQ ID NO: 1486106 - protein, 22 aa, Mycobacterium tuberculosis
LDRHLRLPLRNVLWEGDEALLT

SEQ ID NO: 1486107 - protein, 28 aa, Mycobacterium tuberculosis
LDRKELQPRLPAVMDRLDRAIPRGVGTA

SEQ ID NO: 1486108 - protein, 20 aa, Mycobacterium tuberculosis
LDRLSSWVVFTPVQNVTGVP

SEQ ID NO: 1486109 - protein, 21 aa, Mycobacterium tuberculosis
LDRPAEFVVGSAIQVVDRVQW

SEQ ID NO: 1486110 - protein, 19 aa, Mycobacterium tuberculosis
LDRRTRIGLVPRDRERVVA

SEQ ID NO: 1486111 - protein, 17 aa, Mycobacterium tuberculosis
LDRSHTAAIIWYDDPDD

SEQ ID NO: 1486112 - protein, 25 aa, Mycobacterium tuberculosis
LDSPELIRLAPRPGRANRSDAVGVD

SEQ ID NO: 1486113 - protein, 26 aa, Mycobacterium tuberculosis
LDSRAFRLQWPIGTTIFELDRPQVLD

SEQ ID NO: 1486114 - protein, 19 aa, Mycobacterium tuberculosis
LDSRLRVLARREFAGMISV

SEQ ID NO: 1486115 - protein, 17 aa, Mycobacterium tuberculosis
LDSWAGTLIVVSHDRYL

SEQ ID NO: 1486116 - protein, 18 aa, Mycobacterium tuberculosis
LDTAGAHCVHRGQRAVPG

SEQ ID NO: 1486117 - protein, 18 aa, Mycobacterium tuberculosis
LDTEDAWVAALRNSLRAR

SEQ ID NO: 1486118 - protein, 19 aa, Mycobacterium tuberculosis
LDTSTPRWAELVAGDGAFV

SEQ ID NO: 1486119 - protein, 19 aa, Mycobacterium tuberculosis
LDTVIGRYSRLIVVGADAG

SEQ ID NO: 1486120 - protein, 19 aa, Mycobacterium tuberculosis
LDVADGARLVDSVEGEPGL

SEQ ID NO: 1486121 - protein, 20 aa, Mycobacterium tuberculosis
LDVAEGPVYVRKQIVHNTVV

SEQ ID NO: 1486122 - protein, 17 aa, Mycobacterium tuberculosis
LDVALLFGNDPYVYPDN

SEQ ID NO: 1486123 - protein, 18 aa, Mycobacterium tuberculosis
LDVARLAVDAALRLSAGQ

SEQ ID NO: 1486124 - protein, 19 aa, Mycobacterium tuberculosis
LDVAWMIFAHRVFQELAGL

SEQ ID NO: 1486125 - protein, 19 aa, Mycobacterium tuberculosis
LDVEALALAAGERFGPDRV

SEQ ID NO: 1486126 - protein, 19 aa, Mycobacterium tuberculosis
LDVMLDWDPTTAYSCQQGF

SEQ ID NO: 1486127 - protein, 20 aa, Mycobacterium tuberculosis
LDVMMPRLDGLEVCRQLRGT

SEQ ID NO: 1486128 - protein, 23 aa, Mycobacterium tuberculosis
LDVRKARCRWDVAAQRYVTPELR

SEQ ID NO: 1486129 - protein, 18 aa, Mycobacterium tuberculosis
LDVVRLGRAIGVVYLPAT

SEQ ID NO: 1486130 - protein, 17 aa, Mycobacterium tuberculosis
LDWASVFSGYRPKRVEL

SEQ ID NO: 1486131 - protein, 20 aa, Mycobacterium tuberculosis
LDWFCLFSSGAALLGSPGQG

SEQ ID NO: 1486132 - protein, 19 aa, Mycobacterium tuberculosis
LDYADGIEPYFSVPATGIE

SEQ ID NO: 1486133 - protein, 20 aa, Mycobacterium tuberculosis
LDYDCPRSALKKATAITPGL

SEQ ID NO: 1486134 - protein, 18 aa, Mycobacterium tuberculosis
LDYFPEDFLLVIDESHVT

SEQ ID NO: 1486135 - protein, 17 aa, Mycobacterium tuberculosis
LDYRSRRPLMTFKTDHF

SEQ ID NO: 1486136 - protein, 21 aa, Mycobacterium tuberculosis
LEAFANFGFPESHALSFASLV

SEQ ID NO: 1486137 - protein, 22 aa, Mycobacterium tuberculosis
LEAFANFGFPESHALSFASLVF

SEQ ID NO: 1486138 - protein, 22 aa, Mycobacterium tuberculosis
LEAFQSGLSWLIILRKRENFRR

SEQ ID NO: 1486139 - protein, 17 aa, Mycobacterium tuberculosis
LEAGALYDLLAQAVAPK

SEQ ID NO: 1486140 - protein, 22 aa, Mycobacterium tuberculosis
LEAIPRISRAQVMDALSSQANV

SEQ ID NO: 1486141 - protein, 20 aa, Mycobacterium tuberculosis
LEALPQFRFDADACELLAQF

SEQ ID NO: 1486142 - protein, 26 aa, Mycobacterium tuberculosis
LEANLRLVVSLAKRYTGRGMAFLDLI

SEQ ID NO: 1486143 - protein, 36 aa, Mycobacterium tuberculosis
LEANLRLVVSLAKRYTGRGMAFLDLIQEGNLGLIRG

SEQ ID NO: 1486144 - protein, 36 aa, Mycobacterium tuberculosis
LEANLRLVVSLAKRYTGRGMAFLDLIQEGNLRLIRA

SEQ ID NO: 1486145 - protein, 19 aa, Mycobacterium tuberculosis
LECRACRKYAPISEMTAAA

SEQ ID NO: 1486146 - protein, 17 aa, Mycobacterium tuberculosis
LECRGMPKVCADIRDDR

SEQ ID NO: 1486147 - protein, 17 aa, Mycobacterium tuberculosis
LEELGVDVIFGIPGGAV

SEQ ID NO: 1486148 - protein, 20 aa, Mycobacterium tuberculosis
LEERYVREWLGGMTTGQIVE

SEQ ID NO: 1486149 - protein, 26 aa, Mycobacterium tuberculosis
LEESFAERGVRLFKNARAASVTRTGA

SEQ ID NO: 1486150 - protein, 17 aa, Mycobacterium tuberculosis
LEFRERFGIEVEELDEY

SEQ ID NO: 1486151 - protein, 18 aa, Mycobacterium tuberculosis
LEFVPAADVDPMMFDRSY

SEQ ID NO: 1486152 - protein, 17 aa, Mycobacterium tuberculosis
LEGGGRLVVELTPDEAA

SEQ ID NO: 1486153 - protein, 20 aa, Mycobacterium tuberculosis
LEGLIHHIERCSAAGYGLRC

SEQ ID NO: 1486154 - protein, 25 aa, Mycobacterium tuberculosis
LEGVLDVINAPALALLGRLLIGNGA

SEQ ID NO: 1486155 - protein, 26 aa, Mycobacterium tuberculosis
LEGVLDVINAPALALLGRPLIGNGAN

SEQ ID NO: 1486156 - protein, 26 aa, Mycobacterium tuberculosis
LEGVLDVINAPALALMGRPLIGNEAN

SEQ ID NO: 1486157 - protein, 17 aa, Mycobacterium tuberculosis
LEHRRIRGFPGRGGHQV

SEQ ID NO: 1486158 - protein, 17 aa, Mycobacterium tuberculosis
LEIEPRGAQALPPGGVL

SEQ ID NO: 1486159 - protein, 17 aa, Mycobacterium tuberculosis
LEIGRWVHIGDKNTIRA

SEQ ID NO: 1486160 - protein, 25 aa, Mycobacterium tuberculosis
LEIGTGWGELCIRAAARVAHIRSVT

SEQ ID NO: 1486161 - protein, 17 aa, Mycobacterium tuberculosis
LEILAQLLVLATGTRIT

SEQ ID NO: 1486162 - protein, 21 aa, Mycobacterium tuberculosis
LEILRSGPLALVEDLGRAGLA

SEQ ID NO: 1486163 - protein, 19 aa, Mycobacterium tuberculosis
LELEGLRRWVPPHLDGYKP

SEQ ID NO: 1486164 - protein, 27 aa, Mycobacterium tuberculosis
LELGFRSSIQREWQWRLSRGESLQNLQ

SEQ ID NO: 1486165 - protein, 20 aa, Mycobacterium tuberculosis
LELGTYLGYGALRIARAAPE

SEQ ID NO: 1486166 - protein, 23 aa, Mycobacterium tuberculosis
LELIWGIEDCRNMSARLERDLLA

SEQ ID NO: 1486167 - protein, 19 aa, Mycobacterium tuberculosis
LELKKFCPNCGKHQAHRET

SEQ ID NO: 1486168 - protein, 25 aa, Mycobacterium tuberculosis
LELPFSPVCRSDCSGLCSQCGCLAG

SEQ ID NO: 1486169 - protein, 17 aa, Mycobacterium tuberculosis
LELRFDVPLYTLAEASR

SEQ ID NO: 1486170 - protein, 32 aa, Mycobacterium tuberculosis
LELRNRLEASLGITLPVALVWAYPTISDLATA

SEQ ID NO: 1486171 - protein, 19 aa, Mycobacterium tuberculosis
LEMPIQAGVGITRMDLLER

SEQ ID NO: 1486172 - protein, 21 aa, Mycobacterium tuberculosis
LEMPIQAGVGITRMDLLERGR

SEQ ID NO: 1486173 - protein, 25 aa, Mycobacterium tuberculosis
LENFVPRLGSLLEHQCSKVNTLSWT

SEQ ID NO: 1486174 - protein, 22 aa, Mycobacterium tuberculosis
LEPEFVAQGGFSLRDVIAGGKE

SEQ ID NO: 1486175 - protein, 24 aa, Mycobacterium tuberculosis
LEPFRCFYLSAPFVVPKKKEVART

SEQ ID NO: 1486176 - protein, 17 aa, Mycobacterium tuberculosis
LEPLRSVPIVGNPLANL

SEQ ID NO: 1486177 - protein, 24 aa, Mycobacterium tuberculosis
LEPRLRVPDEFGLSRYLAAGLAAL

SEQ ID NO: 1486178 - protein, 21 aa, Mycobacterium tuberculosis
LEPVSVWAPECSEDLLYLSDL

SEQ ID NO: 1486179 - protein, 21 aa, Mycobacterium tuberculosis
LEQELACFWANPPPCCAPPDI

SEQ ID NO: 1486180 - protein, 17 aa, Mycobacterium tuberculosis
LEQLEFGLVREALYERE

SEQ ID NO: 1486181 - protein, 18 aa, Mycobacterium tuberculosis
LEQLRILTDLLVDRKEDL

SEQ ID NO: 1486182 - protein, 18 aa, Mycobacterium tuberculosis
LEREPEIRCALKHPPKSP

SEQ ID NO: 1486183 - protein, 24 aa, Mycobacterium tuberculosis
LERIGFAAQHTWDGSARRVLAHAT

SEQ ID NO: 1486184 - protein, 26 aa, Mycobacterium tuberculosis
LERIGQAALYAACPRCPSRGPDSGSA

SEQ ID NO: 1486185 - protein, 17 aa, Mycobacterium tuberculosis
LERLECLARRLPAAQHT

SEQ ID NO: 1486186 - protein, 17 aa, Mycobacterium tuberculosis
LERRGVVGQVHVVGGAA

SEQ ID NO: 1486187 - protein, 18 aa, Mycobacterium tuberculosis
LERRILLSRVPELAEHFA

SEQ ID NO: 1486188 - protein, 20 aa, Mycobacterium tuberculosis
LERRYIRDARWCDANDIAQL

SEQ ID NO: 1486189 - protein, 21 aa, Mycobacterium tuberculosis
LERVKRLLIDIHFDVEVIGWQ

SEQ ID NO: 1486190 - protein, 19 aa, Mycobacterium tuberculosis
LERVLARSAGILGIELGAD

SEQ ID NO: 1486191 - protein, 20 aa, Mycobacterium tuberculosis
LERVLARSAGILGIERGADA

SEQ ID NO: 1486192 - protein, 20 aa, Mycobacterium tuberculosis
LERYWRGEQRLATIAHQCEV

SEQ ID NO: 1486193 - protein, 19 aa, Mycobacterium tuberculosis
LESACAELVSLLVGTAPGS

SEQ ID NO: 1486194 - protein, 23 aa, Mycobacterium tuberculosis
LESLRYDLAVQEIFVFTPKGDVI

SEQ ID NO: 1486195 - protein, 19 aa, Mycobacterium tuberculosis
LETLSLRIERHVANAQRVA

SEQ ID NO: 1486196 - protein, 20 aa, Mycobacterium tuberculosis
LETRWKKRTTTPDVRAVVIT

SEQ ID NO: 1486197 - protein, 30 aa, Mycobacterium tuberculosis
LEVAAGIAGLIKTILCLKNKALPATLHYTS

SEQ ID NO: 1486198 - protein, 17 aa, Mycobacterium tuberculosis
LEVAHRWAQSGRRALYV

SEQ ID NO: 1486199 - protein, 25 aa, Mycobacterium tuberculosis
LEVLSGAVARARRAALAPREHPDES

SEQ ID NO: 1486200 - protein, 23 aa, Mycobacterium tuberculosis
LEVRLGPEMNRTVVVELDTSGTI

SEQ ID NO: 1486201 - protein, 17 aa, Mycobacterium tuberculosis
LEVRPSKGLQVFSFTYG

SEQ ID NO: 1486202 - protein, 21 aa, Mycobacterium tuberculosis
LEVSCGAGGGASYIARNLGPA

SEQ ID NO: 1486203 - protein, 19 aa, Mycobacterium tuberculosis
LFDARFQKLGLHPGGGATW

SEQ ID NO: 1486204 - protein, 24 aa, Mycobacterium tuberculosis
LFDGSDTVTLVWLGQRRVPGIDTG

SEQ ID NO: 1486205 - protein, 17 aa, Mycobacterium tuberculosis
LFDLGVDSMLALDLRNR

SEQ ID NO: 1486206 - protein, 30 aa, Mycobacterium tuberculosis; identical to SEQ ID NO: 235627

SEQ ID NO: 1486207 - protein, 25 aa, Mycobacterium tuberculosis
LFFSLPWYYRSGYDVLLYTLPFHGQ

SEQ ID NO: 1486208 - protein, 20 aa, Mycobacterium tuberculosis
LFGAGGIGGAGGRSGLFEVL

SEQ ID NO: 1486209 - protein, 17 aa, Mycobacterium tuberculosis
LFGLSRERVRQIERDVM

SEQ ID NO: 1486210 - protein, 24 aa, Mycobacterium tuberculosis
LFGPGGLGTFSWPRRVRDMVAGRP

SEQ ID NO: 1486211 - protein, 17 aa, Mycobacterium tuberculosis
LFGPRNQAPLSFPIPGW

SEQ ID NO: 1486212 - protein, 19 aa, Mycobacterium tuberculosis
LFGVDGAGGHGGFGSAAGG

SEQ ID NO: 1486213 - protein, 24 aa, Mycobacterium tuberculosis
LFITGRIKELLVVDGANHYPEDIE

SEQ ID NO: 1486214 - protein, 23 aa, Mycobacterium tuberculosis
LFKTEALHRLPVKSWDVRHAREA

SEQ ID NO: 1486215 - protein, 19 aa, Mycobacterium tuberculosis
LFLQCAWHALEDAGADPAR

SEQ ID NO: 1486216 - protein, 25 aa, Mycobacterium tuberculosis
LFNLSRLNNVVNMFIGNSYVDNVKT

SEQ ID NO: 1486217 - protein, 18 aa, Mycobacterium tuberculosis
LFQGLAFVVSRRRLLGRF

SEQ ID NO: 1486218 - protein, 19 aa, Mycobacterium tuberculosis
LFQSHMWDGSAVPVDENLA

SEQ ID NO: 1486219 - protein, 22 aa, Mycobacterium tuberculosis
LFQTRVIELAWALLTNSLAAGG

SEQ ID NO: 1486220 - protein, 17 aa, Mycobacterium tuberculosis
LFSAGYRVHVPEIPAHV

SEQ ID NO: 1486221 - protein, 24 aa, Mycobacterium tuberculosis
LFSMPIHQVMVMPGSVMTIPGMRL

SEQ ID NO: 1486222 - protein, 17 aa, Mycobacterium tuberculosis
LFSQLAAGPTRRRIDAA

SEQ ID NO: 1486223 - protein, 17 aa, Mycobacterium tuberculosis
LFSRGWSNLESFFAGVP

SEQ ID NO: 1486224 - protein, 18 aa, Mycobacterium tuberculosis
LFSRGWSNLESFFAGVPG

SEQ ID NO: 1486225 - protein, 25 aa, Mycobacterium tuberculosis
LFVDRPRAAVGLGARGHRRRPGRLR

SEQ ID NO: 1486226 - protein, 17 aa, Mycobacterium tuberculosis
LFVPQPSVADWAQLEYY

SEQ ID NO: 1486227 - protein, 17 aa, Mycobacterium tuberculosis
LFVPVELDIDAVSHLQY

SEQ ID NO: 1486228 - protein, 21 aa, Mycobacterium tuberculosis
LGACRRVRRVARVRVLRADTM

SEQ ID NO: 1486229 - protein, 26 aa, Mycobacterium tuberculosis
LGADWPRLVAPVFDPKKAVVFDDRWA

SEQ ID NO: 1486230 - protein, 19 aa, Mycobacterium tuberculosis
LGAELGAPVIQVSTRTSER

SEQ ID NO: 1486231 - protein, 17 aa, Mycobacterium tuberculosis
LGAERIHRAMALPGGIE

SEQ ID NO: 1486232 - protein, 20 aa, Mycobacterium tuberculosis
LGAEVRWASCNIFSTQDHAA

SEQ ID NO: 1486233 - protein, 25 aa, Mycobacterium tuberculosis
LGAGSRPLLAAAGAWDGLAEELHAA

SEQ ID NO: 1486234 - protein, 26 aa, Mycobacterium tuberculosis
LGAIWWRSSRARWSSAARLFRPTMTL

SEQ ID NO: 1486235 - protein, 18 aa, Mycobacterium tuberculosis
LGALAWRGLLDRTDIDPA

SEQ ID NO: 1486236 - protein, 18 aa, Mycobacterium tuberculosis
LGALCAGWTPVPLPEPLG

SEQ ID NO: 1486237 - protein, 17 aa, Mycobacterium tuberculosis
LGARLGLLDGQPEGMQH

SEQ ID NO: 1486238 - protein, 17 aa, Mycobacterium tuberculosis
LGARMTRGRLRGRRDRT

SEQ ID NO: 1486239 - protein, 17 aa, Mycobacterium tuberculosis
LGARPARFASDAAMAKL

SEQ ID NO: 1486240 - protein, 17 aa, Mycobacterium tuberculosis
LGASRLRRDRVQALADA

SEQ ID NO: 1486241 - protein, 17 aa, Mycobacterium tuberculosis
LGATFAMVEMRVVLREI

SEQ ID NO: 1486242 - protein, 17 aa, Mycobacterium tuberculosis
LGATGLAQCELTWQLRG

SEQ ID NO: 1486243 - protein, 18 aa, Mycobacterium tuberculosis
LGCGPGRADGVCAGIAFR

SEQ ID NO: 1486244 - protein, 26 aa, Mycobacterium tuberculosis
LGDEFITGVLFYTGARALPFGDRLMA

SEQ ID NO: 1486245 - protein, 18 aa, Mycobacterium tuberculosis
LGDGNFLLLGYQRCRVAD

SEQ ID NO: 1486246 - protein, 19 aa, Mycobacterium tuberculosis
LGDLLLQVLFHARIAEDAS

SEQ ID NO: 1486247 - protein, 26 aa, Mycobacterium tuberculosis
LGEDYLRLSALGSYGAFFNIYFCSVT

SEQ ID NO: 1486248 - protein, 23 aa, Mycobacterium tuberculosis
LGEGVSALLIRVGESGVAPDRLT

SEQ ID NO: 1486249 - protein, 17 aa, Mycobacterium tuberculosis
LGEIIGRDGDPVRDRVT

SEQ ID NO: 1486250 - protein, 24 aa, Mycobacterium tuberculosis
LGELERIGGRYGLQTMCEGGGTAN

SEQ ID NO: 1486251 - protein, 17 aa, Mycobacterium tuberculosis
LGEMRYLPVASRPFVQR

SEQ ID NO: 1486252 - protein, 19 aa, Mycobacterium tuberculosis
LGFSCYVHPEIEFFLLKPG

SEQ ID NO: 1486253 - protein, 17 aa, Mycobacterium tuberculosis
LGFYTGLVDGHFGLQTH

SEQ ID NO: 1486254 - protein, 23 aa, Mycobacterium tuberculosis
LGGAGRDGGAPGGDGGDGGTGGS

SEQ ID NO: 1486255 - protein, 18 aa, Mycobacterium tuberculosis
LGGARGGMELGTPARQAL

SEQ ID NO: 1486256 - protein, 18 aa, Mycobacterium tuberculosis
LGGCSTALFPAGGSTGSL

SEQ ID NO: 1486257 - protein, 22 aa, Mycobacterium tuberculosis
LGGDGGGRGIFGQFGAGGAGGA

SEQ ID NO: 1486258 - protein, 28 aa, Mycobacterium tuberculosis
LGGEQAAKLCVQYLAPIVKNRQYNYPPL

SEQ ID NO: 1486259 - protein, 39 aa, Mycobacterium tuberculosis
LGGFGGAWRLLFRPNRPGWRVAVAGRLAASAALASSQTS

SEQ ID NO: 1486260 - protein, 17 aa, Mycobacterium tuberculosis
LGGFGLFLAGELAAAGC

SEQ ID NO: 1486261 - protein, 21 aa, Mycobacterium tuberculosis
LGGGGGSLFGNGGAGGVGATG

SEQ ID NO: 1486262 - protein, 27 aa, Mycobacterium tuberculosis
LGGGKRLRPLFAYWGWHAVASREPDPD

SEQ ID NO: 1486263 - protein, 27 aa, Mycobacterium tuberculosis
LGGGKRLRPLFAYWGWHTVASREPDPD

SEQ ID NO: 1486264 - protein, 23 aa, Mycobacterium tuberculosis
LGGGSFGLPGLNGSGGDGGDGGN

SEQ ID NO: 1486265 - protein, 19 aa, Mycobacterium tuberculosis
LGGHPRLGHNLALHPATML

SEQ ID NO: 1486266 - protein, 24 aa, Mycobacterium tuberculosis
LGGHPRLGHNLALHPATMLAGLFD

SEQ ID NO: 1486267 - protein, 18 aa, Mycobacterium tuberculosis
LGGHVFRPDMFRLDLDGI

SEQ ID NO: 1486268 - protein, 17 aa, Mycobacterium tuberculosis
LGGIPLAGFFAAGEIGP

SEQ ID NO: 1486269 - protein, 21 aa, Mycobacterium tuberculosis
LGGKCLRASTGSIFAIPVVVA

SEQ ID NO: 1486270 - protein, 19 aa, Mycobacterium tuberculosis
LGGKFPLKAGMLTSLGFGH

SEQ ID NO: 1486271 - protein, 23 aa, Mycobacterium tuberculosis
LGGKLPFALAERLHISRGEASRR

SEQ ID NO: 1486272 - protein, 18 aa, Mycobacterium tuberculosis
LGGKRRRLRDWVWAAPAA

SEQ ID NO: 1486273 - protein, 21 aa, Mycobacterium tuberculosis
LGGLGGQLIGLDGSNAPVSTS

SEQ ID NO: 1486274 - protein, 22 aa, Mycobacterium tuberculosis
LGGLGGQLIGLDGSNAPVSTSV

SEQ ID NO: 1486275 - protein, 18 aa, Mycobacterium tuberculosis
LGGMALSGLAGRAAAGST

SEQ ID NO: 1486276 - protein, 20 aa, Mycobacterium tuberculosis
LGGPGSWLLAVPPYHIAGLA

SEQ ID NO: 1486277 - protein, 19 aa, Mycobacterium tuberculosis
LGGRPATRLVRHRIRRNGR

SEQ ID NO: 1486278 - protein, 25 aa, Mycobacterium tuberculosis
LGGRWADSFGGLVFDATGITEPAGL

SEQ ID NO: 1486279 - protein, 18 aa, Mycobacterium tuberculosis
LGGSCCWSCPDHPDYSER

SEQ ID NO: 1486280 - protein, 19 aa, Mycobacterium tuberculosis
LGGTIGWADPETGSAFGYV

SEQ ID NO: 1486281 - protein, 21 aa, Mycobacterium tuberculosis
LGGTLCCALANRLRITKPEAA

SEQ ID NO: 1486282 - protein, 24 aa, Mycobacterium tuberculosis
LGGTLCCALANRVTHHQARRRPTH

SEQ ID NO: 1486283 - protein, 25 aa, Mycobacterium tuberculosis
LGGTRYPLVVAWPARIRPDGRVRSQ

SEQ ID NO: 1486284 - protein, 17 aa, Mycobacterium tuberculosis
LGGTSLRRSYTLLRPGG

SEQ ID NO: 1486285 - protein, 17 aa, Mycobacterium tuberculosis
LGGVEVCSTTPLRDYEL

SEQ ID NO: 1486286 - protein, 19 aa, Mycobacterium tuberculosis
LGHDQLRAAHALAAAVPRL

SEQ ID NO: 1486287 - protein, 24 aa, Mycobacterium tuberculosis
LGHGRSPWAAPWTIDANVSALAAL

SEQ ID NO: 1486288 - protein, 18 aa, Mycobacterium tuberculosis
LGHLAGRLAGLARDLTAP

SEQ ID NO: 1486289 - protein, 25 aa, Mycobacterium tuberculosis
LGIDAAGLLARWQRWLMGLASAASR

SEQ ID NO: 1486290 - protein, 27 aa, Mycobacterium tuberculosis
LGIEFPIFAVTHCRDVVVAVSKAGGFG

SEQ ID NO: 1486291 - protein, 26 aa, Mycobacterium tuberculosis
LGIRLVIVLVRRWPKVISRAMVMRTV

SEQ ID NO: 1486292 - protein, 21 aa, Mycobacterium tuberculosis
LGITTDWKSRWYADKQYAEYV

SEQ ID NO: 1486293 - protein, 47 aa, Mycobacterium tuberculosis
LGLAQHRHQPGWGGCRTARPRRPSAWAWPTSGSGIWVAQTSATTTWA

SEQ ID NO: 1486294 - protein, 19 aa, Mycobacterium tuberculosis
LGLDHCFGPVMLHRVEATV

SEQ ID NO: 1486295 - protein, 19 aa, Mycobacterium tuberculosis
LGLEAVQVGGGLAIRRTGS

SEQ ID NO: 1486296 - protein, 19 aa, Mycobacterium tuberculosis
LGLEFIGFGGPDVREGLAA

SEQ ID NO: 1486297 - protein, 17 aa, Mycobacterium tuberculosis
LGLIKVVLALKHGVVPR

SEQ ID NO: 1486298 - protein, 17 aa, Mycobacterium tuberculosis
LGLPDDRVAAWEVGEVV

SEQ ID NO: 1486299 - protein, 19 aa, Mycobacterium tuberculosis
LGLPDKLAGRRAWGLAVQL

SEQ ID NO: 1486300 - protein, 17 aa, Mycobacterium tuberculosis
LGLRPPPPQRYPLSEAQ

SEQ ID NO: 1486301 - protein, 17 aa, Mycobacterium tuberculosis
LGLRVCDWVDGDDPYGL

SEQ ID NO: 1486302 - protein, 20 aa, Mycobacterium tuberculosis
LGNGNFGFGNAFGDGNLGSG

SEQ ID NO: 1486303 - protein, 27 aa, Mycobacterium tuberculosis
LGNTVDWEFAASVGERLARPAPPSTEY

SEQ ID NO: 1486304 - protein, 20 aa, Mycobacterium tuberculosis
LGNWFRAAGYDTHYDGKWHI

SEQ ID NO: 1486305 - protein, 17 aa, Mycobacterium tuberculosis
LGNWLMSRGEAVAPTAT

SEQ ID NO: 1486306 - protein, 18 aa, Mycobacterium tuberculosis
LGPARLDEVAPRAAAVVG

SEQ ID NO: 1486307 - protein, 18 aa, Mycobacterium tuberculosis
LGPDFLVELLEIRAALGP

SEQ ID NO: 1486308 - protein, 33 aa, Mycobacterium tuberculosis
LGPDRLPGVRLWLYTNFHCNLCCDYCCVSSSPS

SEQ ID NO: 1486309 - protein, 28 aa, Mycobacterium tuberculosis
LGPEARYRRWLAALRGSARLVIGTRSAV

SEQ ID NO: 1486310 - protein, 19 aa, Mycobacterium tuberculosis
LGPINITSAPGFGNSTTTP

SEQ ID NO: 1486311 - protein, 18 aa, Mycobacterium tuberculosis
LGPLGDLFTIMTIPAQEA

SEQ ID NO: 1486312 - protein, 17 aa, Mycobacterium tuberculosis
LGPLPFPHHPIHTVPSE

SEQ ID NO: 1486313 - protein, 17 aa, Mycobacterium tuberculosis
LGPMLAAASAWDGLAEE

SEQ ID NO: 1486314 - protein, 17 aa, Mycobacterium tuberculosis
LGPRDRLSQAFVHEHNK

SEQ ID NO: 1486315 - protein, 27 aa, Mycobacterium tuberculosis
LGQGRVALDWLDRVDVIGHSRSSGRFG

SEQ ID NO: 1486316 - protein, 18 aa, Mycobacterium tuberculosis
LGQPHLSATLGLLPEADA

SEQ ID NO: 1486317 - protein, 19 aa, Mycobacterium tuberculosis
LGQPMFTEYVWGRQYGENT

SEQ ID NO: 1486318 - protein, 19 aa, Mycobacterium tuberculosis
LGQRALRFVTDPDSGRTMV

SEQ ID NO: 1486319 - protein, 19 aa, Mycobacterium tuberculosis
LGRAGGLLVDVAIDTVPRG

SEQ ID NO: 1486320 - protein, 22 aa, Mycobacterium tuberculosis
LGRANLYSVCFDLATTDRKLIR

SEQ ID NO: 1486321 - protein, 22 aa, Mycobacterium tuberculosis
LGRANLYSVCFDLATTDRKLTP

SEQ ID NO: 1486322 - protein, 26 aa, Mycobacterium tuberculosis
LGRARPSRRGRRGRRVVRHRRGRWGR

SEQ ID NO: 1486323 - protein, 19 aa, Mycobacterium tuberculosis
LGRCGRVVVVGGTPEAAAS

SEQ ID NO: 1486324 - protein, 17 aa, Mycobacterium tuberculosis
LGRDRFVLSAGHSSLTL

SEQ ID NO: 1486325 - protein, 21 aa, Mycobacterium tuberculosis
LGRGMPCGQLGGPRPHVLAQQ

SEQ ID NO: 1486326 - protein, 20 aa, Mycobacterium tuberculosis
LGRLRAWRLTEIDREGDRQP

SEQ ID NO: 1486327 - protein, 17 aa, Mycobacterium tuberculosis
LGRNLLLEQLHYRHEVL

SEQ ID NO: 1486328 - protein, 17 aa, Mycobacterium tuberculosis
LGRPPRPLPFSAVSETT

SEQ ID NO: 1486329 - protein, 17 aa, Mycobacterium tuberculosis
LGRQIGYLLASQEPALA

SEQ ID NO: 1486330 - protein, 18 aa, Mycobacterium tuberculosis
LGRRELLPYSDLDVLLLH

SEQ ID NO: 1486331 - protein, 25 aa, Mycobacterium tuberculosis
LGRRVRRLAVSHAFHSVLMDPMVEE

SEQ ID NO: 1486332 - protein, 20 aa, Mycobacterium tuberculosis
LGRSRVGMRASLAQQLHSPA

SEQ ID NO: 1486333 - protein, 17 aa, Mycobacterium tuberculosis
LGRWFWWPNMIHSRPTV

SEQ ID NO: 1486334 - protein, 17 aa, Mycobacterium tuberculosis
LGSGGVGGAGGFGETGD

SEQ ID NO: 1486335 - protein, 31 aa, Mycobacterium tuberculosis
LGSGKPRLWKPRQRKLWQWEPGQWKHRKYQL

SEQ ID NO: 1486336 - protein, 17 aa, Mycobacterium tuberculosis
LGSGNRGDANLGSGNIG

SEQ ID NO: 1486337 - protein, 25 aa, Mycobacterium tuberculosis
LGSGSSWLDKLWALLDPNSNFWNTI

SEQ ID NO: 1486338 - protein, 18 aa, Mycobacterium tuberculosis
LGSHPKGAVSALLSAARS

SEQ ID NO: 1486339 - protein, 17 aa, Mycobacterium tuberculosis
LGSIELDLVKARFAGPV

SEQ ID NO: 1486340 - protein, 28 aa, Mycobacterium tuberculosis
LGSKMNRFFLRGALVARLLSQSAWKQYP

SEQ ID NO: 1486341 - protein, 17 aa, Mycobacterium tuberculosis
LGSKSWTARTWQMLAAR

SEQ ID NO: 1486342 - protein, 23 aa, Mycobacterium tuberculosis
LGSLVAGSRYRGDFEERLKKVLK

SEQ ID NO: 1486343 - protein, 17 aa, Mycobacterium tuberculosis
LGSRPAVRSDLVARVGG

SEQ ID NO: 1486344 - protein, 21 aa, Mycobacterium tuberculosis
LGSSCIYPKLAPQPIPESALL

SEQ ID NO: 1486345 - protein, 17 aa, Mycobacterium tuberculosis
LGTEHLVGTTLNVLAHP

SEQ ID NO: 1486346 - protein, 28 aa, Mycobacterium tuberculosis
LGTELKLNRFGAAVGVLAAGALVLSACG

SEQ ID NO: 1486347 - protein, 17 aa, Mycobacterium tuberculosis
LGTGAPWFESWVEHTDR

SEQ ID NO: 1486348 - protein, 17 aa, Mycobacterium tuberculosis
LGTLKRVDVVLRRVDAH

SEQ ID NO: 1486349 - protein, 17 aa, Mycobacterium tuberculosis
LGTLSMVPKLAGRVVDA

SEQ ID NO: 1486350 - protein, 24 aa, Mycobacterium tuberculosis
LGTVDYRTAWQLQRELADARVAGG

SEQ ID NO: 1486351 - protein, 24 aa, Mycobacterium tuberculosis
LGVEEELLRLGARSGCAVTIGEMT

SEQ ID NO: 1486352 - protein, 21 aa, Mycobacterium tuberculosis
LGVGAAGRRRRRRRSRRRRFG

SEQ ID NO: 1486353 - protein, 18 aa, Mycobacterium tuberculosis
LGVGMNAGAGGAGGNAGL

SEQ ID NO: 1486354 - protein, 20 aa, Mycobacterium tuberculosis
LGVGVTSIYWYFRKKDDLLN

SEQ ID NO: 1486355 - protein, 17 aa, Mycobacterium tuberculosis
LGVLPVLATDVLRRLRM

SEQ ID NO: 1486356 - protein, 22 aa, Mycobacterium tuberculosis
LGVRYLRTGTVPNRHTPVGDLE

SEQ ID NO: 1486357 - protein, 18 aa, Mycobacterium tuberculosis
LGVTVVAMTGEFGGQLAE

SEQ ID NO: 1486358 - protein, 24 aa, Mycobacterium tuberculosis
LGYTLSCRRAHRPVRTVVTASSFD

SEQ ID NO: 1486359 - protein, 17 aa, Mycobacterium tuberculosis
LHAALGLTPGQGQGRGV

SEQ ID NO: 1486360 - protein, 18 aa, Mycobacterium tuberculosis
LHAGRYPLHPGVTRGRRP

SEQ ID NO: 1486361 - protein, 19 aa, Mycobacterium tuberculosis
LHAHVLLQRDVHYIVRDDA

SEQ ID NO: 1486362 - protein, 25 aa, Mycobacterium tuberculosis
LHAPLRGVARGQTLVLYRPDPAGDE

SEQ ID NO: 1486363 - protein, 18 aa, Mycobacterium tuberculosis
LHAPRCSIGATGPGSPLG

SEQ ID NO: 1486364 - protein, 26 aa, Mycobacterium tuberculosis
LHDPPPCMTGFLPPPLVRSPADESVR

SEQ ID NO: 1486365 - protein, 22 aa, Mycobacterium tuberculosis
LHDRFRLLTGGSRIAVRRQQTM

SEQ ID NO: 1486366 - protein, 24 aa, Mycobacterium tuberculosis
LHFLGATLWRSGIQRVLRGFVERD

SEQ ID NO: 1486367 - protein, 17 aa, Mycobacterium tuberculosis
LHGARYSGWQGLLDAQR

SEQ ID NO: 1486368 - protein, 26 aa, Mycobacterium tuberculosis
LHGNHPVRLFIGSGMPTGLWERVVEA

SEQ ID NO: 1486369 - protein, 18 aa, Mycobacterium tuberculosis
LHHALALAGRHLRRHAGA

SEQ ID NO: 1486370 - protein, 19 aa, Mycobacterium tuberculosis
LHHTYSFLGVETYRQVPSE

SEQ ID NO: 1486371 - protein, 24 aa, Mycobacterium tuberculosis
LHKANSLQGLAFALAYQGELSAAR

SEQ ID NO: 1486372 - protein, 21 aa, Mycobacterium tuberculosis
LHKGDRVRIAGLGVGTVEGLK

SEQ ID NO: 1486373 - protein, 19 aa, Mycobacterium tuberculosis
LHLARDIGCVFSIDTDAHA

SEQ ID NO: 1486374 - protein, 23 aa, Mycobacterium tuberculosis
LHLARDIGCVFSIDTDAHAPGQL

SEQ ID NO: 1486375 - protein, 25 aa, Mycobacterium tuberculosis
LHLDLRFVNGKSWLVFGPYAGWSPK

SEQ ID NO: 1486376 - protein, 19 aa, Mycobacterium tuberculosis
LHLSGGPLGGARSRRRRRQ

SEQ ID NO: 1486377 - protein, 18 aa, Mycobacterium tuberculosis
LHLVDFPVTLGIRPNIPQ

SEQ ID NO: 1486378 - protein, 19 aa, Mycobacterium tuberculosis
LHNRVPALDGQRFLLTAGF

SEQ ID NO: 1486379 - protein, 24 aa, Mycobacterium tuberculosis
LHPNAIAALGIREWDAVSLTGSRT

SEQ ID NO: 1486380 - protein, 32 aa, Mycobacterium tuberculosis
LHQCGLPKLMALELFKPFVMKRLVDLNHAQNI

SEQ ID NO: 1486381 - protein, 21 aa, Mycobacterium tuberculosis
LHQHLPDILGHSGHRAGNGVF

SEQ ID NO: 1486382 - protein, 20 aa, Mycobacterium tuberculosis
LHQTYLRLGHSVDLIEPISG

SEQ ID NO: 1486383 - protein, 22 aa, Mycobacterium tuberculosis
LHQTYLRLGHSVDLIEPISGLP

SEQ ID NO: 1486384 - protein, 19 aa, Mycobacterium tuberculosis
LHRAFAYTSNIFIRDYGID

SEQ ID NO: 1486385 - protein, 20 aa, Mycobacterium tuberculosis
LHRAGACVRRGGAGRAPEGA

SEQ ID NO: 1486386 - protein, 25 aa, Mycobacterium tuberculosis
LHRCQRAGAVVAVYLGQAGVFDGVT

SEQ ID NO: 1486387 - protein, 18 aa, Mycobacterium tuberculosis
LHRETTRIGRTLAAEVQL

SEQ ID NO: 1486388 - protein, 18 aa, Mycobacterium tuberculosis
LHRHFNWVRSWYDFAVEG

SEQ ID NO: 1486389 - protein, 17 aa, Mycobacterium tuberculosis
LHRIVVNACLDRLRRAK

SEQ ID NO: 1486390 - protein, 19 aa, Mycobacterium tuberculosis
LHRLGRPVFGPSFEVEVDT

SEQ ID NO: 1486391 - protein, 24 aa, Mycobacterium tuberculosis
LHRLGRPVFGPSFEVEVDTDFAHP

SEQ ID NO: 1486392 - protein, 24 aa, Mycobacterium tuberculosis
LHRLGRPVFGPSFEVEVDTGLRIR

SEQ ID NO: 1486393 - protein, 34 aa, Mycobacterium tuberculosis
LHRLPLAIMRLRMLRRRSVRFFGTYDVLLTPTVA

SEQ ID NO: 1486394 - protein, 19 aa, Mycobacterium tuberculosis
LHRRRHGVRLLGTRIAVGR

SEQ ID NO: 1486395 - protein, 23 aa, Mycobacterium tuberculosis
LHSGVLNFGLWHVGAVQHQRVGV

SEQ ID NO: 1486396 - protein, 27 aa, Mycobacterium tuberculosis
LHTDPRVRDGLAWCYARVQIMRYRGYR

SEQ ID NO: 1486397 - protein, 18 aa, Mycobacterium tuberculosis
LHTKVGLMDELDKVKRVV

SEQ ID NO: 1486398 - protein, 20 aa, Mycobacterium tuberculosis
LHTLRADIDYGLYEAKTTFG

SEQ ID NO: 1486399 - protein, 18 aa, Mycobacterium tuberculosis
LHVFSTRNSANWATMPMD

SEQ ID NO: 1486400 - protein, 30 aa, Mycobacterium tuberculosis
LHVRIASPPVKWPCFYGIDFPSPAELIANA

SEQ ID NO: 1486401 - protein, 19 aa, Mycobacterium tuberculosis
LHVTAARLADWVDQNGNAG

SEQ ID NO: 1486402 - protein, 17 aa, Mycobacterium tuberculosis
LIAFGRERMRFIHAHHQ

SEQ ID NO: 1486403 - protein, 18 aa, Mycobacterium tuberculosis
LIAGVARYDGTPGTIADQ

SEQ ID NO: 1486404 - protein, 25 aa, Mycobacterium tuberculosis
LIAHTLWIAHCWFMEAWDSTPRIAF

SEQ ID NO: 1486405 - protein, 19 aa, Mycobacterium tuberculosis
LIALRRCPAETAFDELHNA

SEQ ID NO: 1486406 - protein, 21 aa, Mycobacterium tuberculosis
LIALRSQRYFRLLDALDALVS

SEQ ID NO: 1486407 - protein, 18 aa, Mycobacterium tuberculosis
LIDAARPFIFDTGLAPAA

SEQ ID NO: 1486408 - protein, 24 aa, Mycobacterium tuberculosis
LIDELRYGRIPARVSGPDPVPGCL

SEQ ID NO: 1486409 - protein, 25 aa, Mycobacterium tuberculosis
LIDFWRFNVAFARQILEQQPISGPG

SEQ ID NO: 1486410 - protein, 23 aa, Mycobacterium tuberculosis
LIDYSGLRVCEYLPGKAIVMQML

SEQ ID NO: 1486411 - protein, 21 aa, Mycobacterium tuberculosis
LIECTVCRGGGRTATKKKKKK

SEQ ID NO: 1486412 - protein, 40 aa, Mycobacterium tuberculosis
LIFALYCLPLNWLRRKHGLSSLGWDLCRIFTDGDYTLYAD

SEQ ID NO: 1486413 - protein, 18 aa, Mycobacterium tuberculosis
LIGACGRDSGRLGRRGRV

SEQ ID NO: 1486414 - protein, 19 aa, Mycobacterium tuberculosis
LIGAGVTRRRGCRPGTACA

SEQ ID NO: 1486415 - protein, 17 aa, Mycobacterium tuberculosis
LIGEHRFDALLAAAAEY

SEQ ID NO: 1486416 - protein, 17 aa, Mycobacterium tuberculosis
LIGHGGAGGAGGDRAGA

SEQ ID NO: 1486417 - protein, 25 aa, Mycobacterium tuberculosis
LIGNGGDGGPGMFGGPGGAGGSGGT

SEQ ID NO: 1486418 - protein, 18 aa, Mycobacterium tuberculosis
LIGPIHINTGFSIPVTFS

SEQ ID NO: 1486419 - protein, 18 aa, Mycobacterium tuberculosis
LIKGGLRLVAAGVNPIAL

SEQ ID NO: 1486420 - protein, 21 aa, Mycobacterium tuberculosis
LIKTILCLKNKALPATLHYTQ

SEQ ID NO: 1486421 - protein, 23 aa, Mycobacterium tuberculosis
LIMDSLRYWVIEMHVDGFRFDLA

SEQ ID NO: 1486422 - protein, 17 aa, Mycobacterium tuberculosis
LINDPFAEPLVRAVGLI

SEQ ID NO: 1486423 - protein, 25 aa, Mycobacterium tuberculosis
LINRYATACGMTGTALAAGEQLRQF

SEQ ID NO: 1486424 - protein, 21 aa, Mycobacterium tuberculosis
LIPFCAYNSVGYREQVREQLT

SEQ ID NO: 1486425 - protein, 17 aa, Mycobacterium tuberculosis
LIPRARAKISIRVAPGG

SEQ ID NO: 1486426 - protein, 21 aa, Mycobacterium tuberculosis
LIQHMIRWVISAGEFGEKVGE

SEQ ID NO: 1486427 - protein, 26 aa, Mycobacterium tuberculosis
LIRSNWLGLNAPWIAAVESLYEEYWA

SEQ ID NO: 1486428 - protein, 27 aa, Mycobacterium tuberculosis
LIRSNWLGLNAPWIAAVESLYEEYWAA

SEQ ID NO: 1486429 - protein, 17 aa, Mycobacterium tuberculosis
LIVGFPWETEEDFAATL

SEQ ID NO: 1486430 - protein, 20 aa, Mycobacterium tuberculosis
LIVWPPSRWGVVRSVNPQQG

SEQ ID NO: 1486431 - protein, 24 aa, Mycobacterium tuberculosis
LKAMSPRPPLPPLPGAPPAPPAPP

SEQ ID NO: 1486432 - protein, 20 aa, Mycobacterium tuberculosis
LKANGYRLVTVSELLGPRAP

SEQ ID NO: 1486433 - protein, 17 aa, Mycobacterium tuberculosis
LKANTPGAVTWLDTPKR

SEQ ID NO: 1486434 - protein, 17 aa, Mycobacterium tuberculosis
LKAPTLRESVSRLADRA

SEQ ID NO: 1486435 - protein, 17 aa, Mycobacterium tuberculosis
LKARADALGRAFIDQGI

SEQ ID NO: 1486436 - protein, 26 aa, Mycobacterium tuberculosis
LKAREFPVNFDVWWFKLPREGDAEFS

SEQ ID NO: 1486437 - protein, 18 aa, Mycobacterium tuberculosis
LKASVKRAARQRGVSEAQ

SEQ ID NO: 1486438 - protein, 19 aa, Mycobacterium tuberculosis
LKATLKHLACLEYSTVAIQ

SEQ ID NO: 1486439 - protein, 24 aa, Mycobacterium tuberculosis
LKCAIADGCGDVPALKSCTAAGTS

SEQ ID NO: 1486440 - protein, 20 aa, Mycobacterium tuberculosis
LKDAFVYPETMPAWFTEADL

SEQ ID NO: 1486441 - protein, 22 aa, Mycobacterium tuberculosis
LKDALGVNWRVRCETGEPAAAA

SEQ ID NO: 1486442 - protein, 19 aa, Mycobacterium tuberculosis
LKDDFVLRERGHINVKGKG

SEQ ID NO: 1486443 - protein, 20 aa, Mycobacterium tuberculosis
LKDDFVLRERGHINVKGKGV

SEQ ID NO: 1486444 - protein, 20 aa, Mycobacterium tuberculosis
LKDKGVRVGPVFNHDDSETQ

SEQ ID NO: 1486445 - protein, 17 aa, Mycobacterium tuberculosis
LKDRVGLRPDQVSFGKL

SEQ ID NO: 1486446 - protein, 17 aa, Mycobacterium tuberculosis
LKDVAGLSLTKLFVGSE

SEQ ID NO: 1486447 - protein, 18 aa, Mycobacterium tuberculosis
LKDVAGLSLTKLFVGSEG

SEQ ID NO: 1486448 - protein, 20 aa, Mycobacterium tuberculosis
LKENIKRQWWRSVVTGRDDV

SEQ ID NO: 1486449 - protein, 19 aa, Mycobacterium tuberculosis
LKESGFRLLAMTPHGNACK

SEQ ID NO: 1486450 - protein, 17 aa, Mycobacterium tuberculosis
LKGGDPFVFARGYEEVL

SEQ ID NO: 1486451 - protein, 21 aa, Mycobacterium tuberculosis
LKGHPLFAHITLLRSERSPIA

SEQ ID NO: 1486452 - protein, 19 aa, Mycobacterium tuberculosis
LKGLHEFFTPVLRNLGRCG

SEQ ID NO: 1486453 - protein, 19 aa, Mycobacterium tuberculosis
LKGLLPRFAGRATDQRARH

SEQ ID NO: 1486454 - protein, 19 aa, Mycobacterium tuberculosis
LKGRGLGGVRLVISDQHAG

SEQ ID NO: 1486455 - protein, 19 aa, Mycobacterium tuberculosis
LKGVDAVVVPGDFPTVTTS

SEQ ID NO: 1486456 - protein, 17 aa, Mycobacterium tuberculosis
LKIDGVALSLVYREGRL

SEQ ID NO: 1486457 - protein, 22 aa, Mycobacterium tuberculosis
LKISDPLHRLAVVRRTIPNFQN

SEQ ID NO: 1486458 - protein, 20 aa, Mycobacterium tuberculosis
LKLIADKMFEEFKEPHYGPP

SEQ ID NO: 1486459 - protein, 28 aa, Mycobacterium tuberculosis
LKLIRARFGVPVPNLTAWRDATVGDMTS

SEQ ID NO: 1486460 - protein, 18 aa, Mycobacterium tuberculosis
LKLWYAAAPHKHPGADRR

SEQ ID NO: 1486461 - protein, 20 aa, Mycobacterium tuberculosis
LKPDPWLADVCREEMQRLGR

SEQ ID NO: 1486462 - protein, 21 aa, Mycobacterium tuberculosis
LKPLRPAVVAFPPAPPNPPLP

SEQ ID NO: 1486463 - protein, 18 aa, Mycobacterium tuberculosis
LKPPVLVSPTLKLPVLYD

SEQ ID NO: 1486464 - protein, 20 aa, Mycobacterium tuberculosis
LKPTRGCSAPTDRFRAAVRA

SEQ ID NO: 1486465 - protein, 20 aa, Mycobacterium tuberculosis
LKQLQPFVASSLKQALQYAG

SEQ ID NO: 1486466 - protein, 20 aa, Mycobacterium tuberculosis
LKQVCNHPAQLLHDRSPVGR

SEQ ID NO: 1486467 - protein, 17 aa, Mycobacterium tuberculosis
LKRCMVGGSAKVFEFNR

SEQ ID NO: 1486468 - protein, 17 aa, Mycobacterium tuberculosis
LKRLCVGGVERVFELGR

SEQ ID NO: 1486469 - protein, 17 aa, Mycobacterium tuberculosis
LKRSYGWNRTELTGITG

SEQ ID NO: 1486470 - protein, 28 aa, Mycobacterium tuberculosis
LKSKHPGDALFAFLRSMVLQWGATDRGL

SEQ ID NO: 1486471 - protein, 28 aa, Mycobacterium tuberculosis
LKSPHLEAFKAKGYEVLLLTDPVDEVWV

SEQ ID NO: 1486472 - protein, 19 aa, Mycobacterium tuberculosis
LKSTGFARDLADYIQEQGW

SEQ ID NO: 1486473 - protein, 21 aa, Mycobacterium tuberculosis
LKTATGLTLPPTLIFDYPTAA

SEQ ID NO: 1486474 - protein, 23 aa, Mycobacterium tuberculosis
LKTATGLTLPPTLIFDYPTAAEL

SEQ ID NO: 1486475 - protein, 23 aa, Mycobacterium tuberculosis
LKTATGLTLPPTVIFDHPTPTAV

SEQ ID NO: 1486476 - protein, 18 aa, Mycobacterium tuberculosis
LKTHCKTALVVRREGPTI

SEQ ID NO: 1486477 - protein, 17 aa, Mycobacterium tuberculosis
LKTSLEFRERFGIEVEE

SEQ ID NO: 1486478 - protein, 19 aa, Mycobacterium tuberculosis
LKTSLEFRERFGIEVEELD

SEQ ID NO: 1486479 - protein, 19 aa, Mycobacterium tuberculosis
LKTVRGHLDGIVRMLESDA

SEQ ID NO: 1486480 - protein, 20 aa, Mycobacterium tuberculosis
LKWQRSDPEFAYSDRERDGL

SEQ ID NO: 1486481 - protein, 23 aa, Mycobacterium tuberculosis
LKWQRSDPEFAYSDRERDGLLEA

SEQ ID NO: 1486482 - protein, 18 aa, Mycobacterium tuberculosis
LLAACVRSRADSGHQERA

SEQ ID NO: 1486483 - protein, 17 aa, Mycobacterium tuberculosis
LLAAELWERGRIVQSLG

SEQ ID NO: 1486484 - protein, 25 aa, Mycobacterium tuberculosis
LLADRPVVVAARLDRAALAGAELRA

SEQ ID NO: 1486485 - protein, 17 aa, Mycobacterium tuberculosis
LLAELLGRVELRELLDP

SEQ ID NO: 1486486 - protein, 17 aa, Mycobacterium tuberculosis
LLAGGWVDAYARRILGW

SEQ ID NO: 1486487 - protein, 20 aa, Mycobacterium tuberculosis
LLAKLAELVAAAIADIISDV

SEQ ID NO: 1486488 - protein, 29 aa, Mycobacterium tuberculosis
LLAKYAIEHWTRLPVEVELASEFRYRDPV

SEQ ID NO: 1486489 - protein, 17 aa, Mycobacterium tuberculosis
LLALYRWRGPLINAGVG

SEQ ID NO: 1486490 - protein, 18 aa, Mycobacterium tuberculosis
LLALYRWRGPLINAGVGG

SEQ ID NO: 1486491 - protein, 26 aa, Mycobacterium tuberculosis
LLAPLRAIPVIGPWGLGFVAVAVAAA

SEQ ID NO: 1486492 - protein, 18 aa, Mycobacterium tuberculosis
LLAPRWQMMSDPQLTGYF

SEQ ID NO: 1486493 - protein, 18 aa, Mycobacterium tuberculosis
LLAQMRWVVLVDKRQLAV

SEQ ID NO: 1486494 - protein, 18 aa, Mycobacterium tuberculosis
LLARAAAEFTRILTGVDI

SEQ ID NO: 1486495 - protein, 18 aa, Mycobacterium tuberculosis
LLARELPVYIISIGRTFR

SEQ ID NO: 1486496 - protein, 34 aa, Mycobacterium tuberculosis
LLASCLQPLWRARGRLQDGLAWFAAALANHDAHS

SEQ ID NO: 1486497 - protein, 23 aa, Mycobacterium tuberculosis
LLASRLIDVTGWLATQPDTASLP

SEQ ID NO: 1486498 - protein, 17 aa, Mycobacterium tuberculosis
LLAVGDLLIGWRLLVLA

SEQ ID NO: 1486499 - protein, 18 aa, Mycobacterium tuberculosis
LLAVGDLLIGWRLLVLAG

SEQ ID NO: 1486500 - protein, 17 aa, Mycobacterium tuberculosis
LLDDYRHASTEYALGST

SEQ ID NO: 1486501 - protein, 24 aa, Mycobacterium tuberculosis
LLDERALFLGQWGLRGQRGGEGPS

SEQ ID NO: 1486502 - protein, 25 aa, Mycobacterium tuberculosis
LLDFFKDPVKGFFRALDYTLPWDVD

SEQ ID NO: 1486503 - protein, 30 aa, Mycobacterium tuberculosis
LLDFFKDPVKGFFRALDYTLPWDVDTVEDS

SEQ ID NO: 1486504 - protein, 25 aa, Mycobacterium tuberculosis
LLDIGCGWGATMRRAIAQYDINVVG

SEQ ID NO: 1486505 - protein, 21 aa, Mycobacterium tuberculosis
LLDIGCGWGTTMRRAVERLDV

SEQ ID NO: 1486506 - protein, 20 aa, Mycobacterium tuberculosis
LLDLGWTIIRFVGRVDAAMR

SEQ ID NO: 1486507 - protein, 21 aa, Mycobacterium tuberculosis
LLDLLRLGTYQLLRTRVDAHA

SEQ ID NO: 1486508 - protein, 17 aa, Mycobacterium tuberculosis
LLDRGHWVRSFDRAPSL

SEQ ID NO: 1486509 - protein, 25 aa, Mycobacterium tuberculosis
LLDWPAKLRLLDGFRQRENLSWSAP

SEQ ID NO: 1486510 - protein, 19 aa, Mycobacterium tuberculosis
LLEDLRRARGLTVVVVSHD

SEQ ID NO: 1486511 - protein, 18 aa, Mycobacterium tuberculosis
LLEFPGGILGVALNLDEH

SEQ ID NO: 1486512 - protein, 18 aa, Mycobacterium tuberculosis
LLEGIEMIPPRYVEYRGA

SEQ ID NO: 1486513 - protein, 21 aa, Mycobacterium tuberculosis
LLEVCRGHGALLLVDEAHGLG

SEQ ID NO: 1486514 - protein, 24 aa, Mycobacterium tuberculosis
LLGADRPLLHSSFGHLEGIQQPLI

SEQ ID NO: 1486515 - protein, 19 aa, Mycobacterium tuberculosis
LLGGIPLAGFFAAGEIGPI

SEQ ID NO: 1486516 - protein, 18 aa, Mycobacterium tuberculosis
LLGLPGFALLDQDLHPGR

SEQ ID NO: 1486517 - protein, 17 aa, Mycobacterium tuberculosis
LLGNGGNRWELVGLQGA

SEQ ID NO: 1486518 - protein, 19 aa, Mycobacterium tuberculosis
LLGRFVRRYGKAFTANILM

SEQ ID NO: 1486519 - protein, 17 aa, Mycobacterium tuberculosis
LLGRPLIGDGADGTAPG

SEQ ID NO: 1486520 - protein, 17 aa, Mycobacterium tuberculosis
LLGRPLIGDGANGGPGQ

SEQ ID NO: 1486521 - protein, 17 aa, Mycobacterium tuberculosis
LLGRPLIGNGADGAPGT

SEQ ID NO: 1486522 - protein, 17 aa, Mycobacterium tuberculosis
LLGRPLIGNGANGADGT

SEQ ID NO: 1486523 - protein, 17 aa, Mycobacterium tuberculosis
LLGSRWLAHYTATSAFL

SEQ ID NO: 1486524 - protein, 26 aa, Mycobacterium tuberculosis
LLGVDEVWAVGGAQAVALLAYGGTDT

SEQ ID NO: 1486525 - protein, 18 aa, Mycobacterium tuberculosis
LLHGDCLTVTGHTMAENL

SEQ ID NO: 1486526 - protein, 28 aa, Mycobacterium tuberculosis
LLHQLRLGDYDVLIGINLLREGLDLPEV

SEQ ID NO: 1486527 - protein, 17 aa, Mycobacterium tuberculosis
LLHRADAAVLPSHYEPF

SEQ ID NO: 1486528 - protein, 20 aa, Mycobacterium tuberculosis
LLHRRPDQRRLLLDDPEGIP

SEQ ID NO: 1486529 - protein, 17 aa, Mycobacterium tuberculosis
LLIACPCAVGLSTPTAI

SEQ ID NO: 1486530 - protein, 20 aa, Mycobacterium tuberculosis
LLIERIEAEYARYFTPTGRP

SEQ ID NO: 1486531 - protein, 20 aa, Mycobacterium tuberculosis
LLKIALAACSGMASDQPLAR

SEQ ID NO: 1486532 - protein, 22 aa, Mycobacterium tuberculosis
LLKLPIPVQRRVAAGVLSAGHA

SEQ ID NO: 1486533 - protein, 25 aa, Mycobacterium tuberculosis
LLKPEVRALLSAYCETWSVYVAAVQ

SEQ ID NO: 1486534 - protein, 23 aa, Mycobacterium tuberculosis
LLLARAVLSPARIVLLDEPVEHL

SEQ ID NO: 1486535 - protein, 18 aa, Mycobacterium tuberculosis
LLLETSWEAMEHGGLTPN

SEQ ID NO: 1486536 - protein, 19 aa, Mycobacterium tuberculosis
LLLGRPLIGDGANGGPGQN

SEQ ID NO: 1486537 - protein, 18 aa, Mycobacterium tuberculosis
LLLNRISLAPGEAIFLPA

SEQ ID NO: 1486538 - protein, 28 aa, Mycobacterium tuberculosis
LLLRPRARQRLCRWPSNLVADVVLNGRC

SEQ ID NO: 1486539 - protein, 20 aa, Mycobacterium tuberculosis
LLLTRMDPGDSWQVRRLLTH

SEQ ID NO: 1486540 - protein, 18 aa, Mycobacterium tuberculosis
LLLVPSIVEPSNFLENIS

SEQ ID NO: 1486541 - protein, 19 aa, Mycobacterium tuberculosis
LLMHRTRASALMMAAGWNT

SEQ ID NO: 1486542 - protein, 18 aa, Mycobacterium tuberculosis
LLMLAGGGLVGWMTYPEC

SEQ ID NO: 1486543 - protein, 18 aa, Mycobacterium tuberculosis
LLNEPQFDEPSINSGGQA

SEQ ID NO: 1486544 - protein, 19 aa, Mycobacterium tuberculosis
LLNLSFAIAVRKRAKADAQ

SEQ ID NO: 1486545 - protein, 19 aa, Mycobacterium tuberculosis
LLNRNRLNVAVSRAQYAAV

SEQ ID NO: 1486546 - protein, 24 aa, Mycobacterium tuberculosis
LLPDELYTAVGASIGDAWAADVVV

SEQ ID NO: 1486547 - protein, 21 aa, Mycobacterium tuberculosis
LLPEHLHKVSLSFLVDDLVMH

SEQ ID NO: 1486548 - protein, 17 aa, Mycobacterium tuberculosis
LLPELRIGGTERCLRGA

SEQ ID NO: 1486549 - protein, 18 aa, Mycobacterium tuberculosis
LLPESSRAPYGGIVYTQP

SEQ ID NO: 1486550 - protein, 21 aa, Mycobacterium tuberculosis
LLPISVVRPATKYERKAQLGG

SEQ ID NO: 1486551 - protein, 17 aa, Mycobacterium tuberculosis
LLPITKFFPATDVAILF

SEQ ID NO: 1486552 - protein, 17 aa, Mycobacterium tuberculosis
LLPPCPPAPPAPPANPV

SEQ ID NO: 1486553 - protein, 18 aa, Mycobacterium tuberculosis
LLPRASHIRRFWMPTRSV

SEQ ID NO: 1486554 - protein, 21 aa, Mycobacterium tuberculosis
LLPVPARKVGRLILVDELASE

SEQ ID NO: 1486555 - protein, 17 aa, Mycobacterium tuberculosis
LLQGVSICFDQLHEITE

SEQ ID NO: 1486556 - protein, 23 aa, Mycobacterium tuberculosis
LLQRPEKVAARRGFADRGRRPGR

SEQ ID NO: 1486557 - protein, 17 aa, Mycobacterium tuberculosis
LLQRRKRAERALTSVVA

SEQ ID NO: 1486558 - protein, 18 aa, Mycobacterium tuberculosis
LLQSAFRTQGCSDRPAAA

SEQ ID NO: 1486559 - protein, 31 aa, Mycobacterium tuberculosis
LLRAHVMATYLSRDWARDWGSLRKFDTLVDA

SEQ ID NO: 1486560 - protein, 19 aa, Mycobacterium tuberculosis
LLRALAVSDLDPFIDLLSE

SEQ ID NO: 1486561 - protein, 22 aa, Mycobacterium tuberculosis
LLRDRWGFQPAWNAEECLEDFT

SEQ ID NO: 1486562 - protein, 23 aa, Mycobacterium tuberculosis
LLRDRWGFQPAWNAEECLEDFTL

SEQ ID NO: 1486563 - protein, 17 aa, Mycobacterium tuberculosis
LLRFGLHQALRLGKPLQ

SEQ ID NO: 1486564 - protein, 18 aa, Mycobacterium tuberculosis
LLRGADMVFVTAGEGGGT

SEQ ID NO: 1486565 - protein, 22 aa, Mycobacterium tuberculosis
LLRIGHEVEEVIPLGPVDGPVT

SEQ ID NO: 1486566 - protein, 18 aa, Mycobacterium tuberculosis
LLRLWRPPLRPGEWRTLG

SEQ ID NO: 1486567 - protein, 18 aa, Mycobacterium tuberculosis
LLRRLPFELTAGQREVLD

SEQ ID NO: 1486568 - protein, 18 aa, Mycobacterium tuberculosis
LLRSLGISDPRELDVDRL

SEQ ID NO: 1486569 - protein, 21 aa, Mycobacterium tuberculosis
LLRVFGKVVALAFLAVPDEIR

SEQ ID NO: 1486570 - protein, 21 aa, Mycobacterium tuberculosis
LLRVVRRWRGGPAPGCTAPNR

SEQ ID NO: 1486571 - protein, 17 aa, Mycobacterium tuberculosis
LLSALGITGQFRFGPIT

SEQ ID NO: 1486572 - protein, 18 aa, Mycobacterium tuberculosis
LLSAVGALAEATRDGVVA

SEQ ID NO: 1486573 - protein, 18 aa, Mycobacterium tuberculosis
LLSERIIFLGSEVNDEIA

SEQ ID NO: 1486574 - protein, 18 aa, Mycobacterium tuberculosis
LLSNAECLGRRGHPQRHS

SEQ ID NO: 1486575 - protein, 24 aa, Mycobacterium tuberculosis
LLSVGYAACHWCHVMDLESFDDDE

SEQ ID NO: 1486576 - protein, 17 aa, Mycobacterium tuberculosis
LLTAWQGYPETLGKPDH

SEQ ID NO: 1486577 - protein, 18 aa, Mycobacterium tuberculosis
LLVADLAYVRGMVYRQLH

SEQ ID NO: 1486578 - protein, 21 aa, Mycobacterium tuberculosis
LLVKVPAGWSHTAAATTSAVF

SEQ ID NO: 1486579 - protein, 21 aa, Mycobacterium tuberculosis
LLVKVPAGWSHTAAATTSVVF

SEQ ID NO: 1486580 - protein, 18 aa, Mycobacterium tuberculosis
LLVNEMFETMSRRSRSLV

SEQ ID NO: 1486581 - protein, 17 aa, Mycobacterium tuberculosis
LLVPPSDRPWRLAMSTA

SEQ ID NO: 1486582 - protein, 24 aa, Mycobacterium tuberculosis
LLVSAEGWHSLSIAYAETADELAA

SEQ ID NO: 1486583 - protein, 23 aa, Mycobacterium tuberculosis
LLVVFPALFAAIITSAGGVPQDE

SEQ ID NO: 1486584 - protein, 20 aa, Mycobacterium tuberculosis
LLWDGKRSPIDLADHAVTSG

SEQ ID NO: 1486585 - protein, 23 aa, Mycobacterium tuberculosis
LLWGDARVGNVLYRDFQPVAVLD

SEQ ID NO: 1486586 - protein, 24 aa, Mycobacterium tuberculosis
LLWRGDHEGLFSLFYSLDVPRITI

SEQ ID NO: 1486587 - protein, 18 aa, Mycobacterium tuberculosis
LLYGARRGPEAPADAPVV

SEQ ID NO: 1486588 - protein, 49 aa, Mycobacterium tuberculosis
LLYRLERPLLFALQCMPLNWVRRRHGLSSLGWNLCRIFTDGDHTLYADV

SEQ ID NO: 1486589 - protein, 18 aa, Mycobacterium tuberculosis
LLYWTQVLMISRGLSLDD

SEQ ID NO: 1486590 - protein, 28 aa, Mycobacterium tuberculosis
LMAATPKPSWPWVRTLLHSIYDQPNAES

SEQ ID NO: 1486591 - protein, 22 aa, Mycobacterium tuberculosis
LMAEAIVAMFNQFCYLQLSGKR

SEQ ID NO: 1486592 - protein, 17 aa, Mycobacterium tuberculosis
LMATNFFGINTIPIALN

SEQ ID NO: 1486593 - protein, 17 aa, Mycobacterium tuberculosis
LMCRLPKRPDPHAWLGD

SEQ ID NO: 1486594 - protein, 29 aa, Mycobacterium tuberculosis
LMEAAKPFVRWLTDLCVQLSEVERQIHEI

SEQ ID NO: 1486595 - protein, 18 aa, Mycobacterium tuberculosis
LMENMGYRLVLKARTAGA

SEQ ID NO: 1486596 - protein, 32 aa, Mycobacterium tuberculosis
LMLDDASKIVGCWNGRAKRSGTGIVAGEPPMR

SEQ ID NO: 1486597 - protein, 26 aa, Mycobacterium tuberculosis
LMLDDASKIVGCWNGVAKRSGTGIVA

SEQ ID NO: 1486598 - protein, 17 aa, Mycobacterium tuberculosis
LMLPGLKPPVLVSPTLK

SEQ ID NO: 1486599 - protein, 22 aa, Mycobacterium tuberculosis
LMPASSAARCAARIVGGPRLYG

SEQ ID NO: 1486600 - protein, 19 aa, Mycobacterium tuberculosis
LMPVNSFAGTRGWGYDGVL

SEQ ID NO: 1486601 - protein, 18 aa, Mycobacterium tuberculosis
LMQAAAAWQRLANELTAT

SEQ ID NO: 1486602 - protein, 17 aa, Mycobacterium tuberculosis
LMQNICFLYHLVGGGTG

SEQ ID NO: 1486603 - protein, 21 aa, Mycobacterium tuberculosis
LMRRAGGLVFARKVRAEHRPG

SEQ ID NO: 1486604 - protein, 20 aa, Mycobacterium tuberculosis
LMRRGELVIVFPGGAREVNK

SEQ ID NO: 1486605 - protein, 19 aa, Mycobacterium tuberculosis
LMRRGELVMVFPGRAREVN

SEQ ID NO: 1486606 - protein, 17 aa, Mycobacterium tuberculosis
LMSPLVWDLAHIGQQEE

SEQ ID NO: 1486607 - protein, 18 aa, Mycobacterium tuberculosis
LMTIPWAVISGFLFNVLL

SEQ ID NO: 1486608 - protein, 18 aa, Mycobacterium tuberculosis
LMTLDVDRDCFARIAPGL

SEQ ID NO: 1486609 - protein, 22 aa, Mycobacterium tuberculosis
LMVTQFKDYFGLAHDLPKWASE

SEQ ID NO: 1486610 - protein, 17 aa, Mycobacterium tuberculosis
LNAKWPVYLSTKNTILK

SEQ ID NO: 1486611 - protein, 18 aa, Mycobacterium tuberculosis
LNALALLASQGVPLALGS

SEQ ID NO: 1486612 - protein, 25 aa, Mycobacterium tuberculosis
LNAQAAAFHHSFVQTLNAAGGAYSS

SEQ ID NO: 1486613 - protein, 23 aa, Mycobacterium tuberculosis
LNARAATFHAEFVSLLNGGAAAY

SEQ ID NO: 1486614 - protein, 24 aa, Mycobacterium tuberculosis
LNARAATFHAEFVSLLNGGAAAYT

SEQ ID NO: 1486615 - protein, 19 aa, Mycobacterium tuberculosis
LNARVLARFADLFAAVRMR

SEQ ID NO: 1486616 - protein, 21 aa, Mycobacterium tuberculosis
LNARVLARFADLFAAVRMRLR

SEQ ID NO: 1486617 - protein, 28 aa, Mycobacterium tuberculosis
LNATLLTARCPVLFAPAMHTEMWLHPAT

SEQ ID NO: 1486618 - protein, 23 aa, Mycobacterium tuberculosis
LNDNRVDAIVGWRQAGGNLATLL

SEQ ID NO: 1486619 - protein, 24 aa, Mycobacterium tuberculosis
LNDWLRGRCWTARCANKPSDVSNS

SEQ ID NO: 1486620 - protein, 23 aa, Mycobacterium tuberculosis
LNEAFASVVLKFQKDLNILDEKL

SEQ ID NO: 1486621 - protein, 17 aa, Mycobacterium tuberculosis
LNFAPKLALHKLTVEAT

SEQ ID NO: 1486622 - protein, 25 aa, Mycobacterium tuberculosis
LNFLNPRPGTPFADLEVMPVGDALK

SEQ ID NO: 1486623 - protein, 17 aa, Mycobacterium tuberculosis
LNGEAVAAIAPMPPGAP

SEQ ID NO: 1486624 - protein, 19 aa, Mycobacterium tuberculosis
LNGGSLIGLEWAEIVRGQI

SEQ ID NO: 1486625 - protein, 17 aa, Mycobacterium tuberculosis
LNHLGRQPQLFVGGDGS

SEQ ID NO: 1486626 - protein, 20 aa, Mycobacterium tuberculosis
LNIKGPELLNKFVGETERHI

SEQ ID NO: 1486627 - protein, 25 aa, Mycobacterium tuberculosis
LNILYMRSPLITTFRRNVVFSELMA

SEQ ID NO: 1486628 - protein, 31 aa, Mycobacterium tuberculosis
LNIPVNIPIHLDFGTLAVNGFQIPAITLRAL

SEQ ID NO: 1486629 - protein, 18 aa, Mycobacterium tuberculosis
LNLHAIGGVGPVDIVGGN

SEQ ID NO: 1486630 - protein, 19 aa, Mycobacterium tuberculosis
LNLHAIGGVGPVDIVGGNV

SEQ ID NO: 1486631 - protein, 19 aa, Mycobacterium tuberculosis
LNLLTTKPFLYVFNADEAV

SEQ ID NO: 1486632 - protein, 24 aa, Mycobacterium tuberculosis
LNLPPRCTTGFLPAQQRRIPTFED

SEQ ID NO: 1486633 - protein, 29 aa, Mycobacterium tuberculosis
LNLVIDMPLPISLGVNIPIDIPITASAGN

SEQ ID NO: 1486634 - protein, 26 aa, Mycobacterium tuberculosis
LNNRMLSQIWSHWSLLSAPSCAAQLD

SEQ ID NO: 1486635 - protein, 21 aa, Mycobacterium tuberculosis
LNNRRVPVVDIYDAQRVHIGN

SEQ ID NO: 1486636 - protein, 17 aa, Mycobacterium tuberculosis
LNPRIPEDLAFAESRIR

SEQ ID NO: 1486637 - protein, 20 aa, Mycobacterium tuberculosis
LNPVRRGAALAGDIAKADCQ

SEQ ID NO: 1486638 - protein, 21 aa, Mycobacterium tuberculosis
LNPVRRGAALAGDIAKADCQL

SEQ ID NO: 1486639 - protein, 23 aa, Mycobacterium tuberculosis
LNPVRRGAALAGDIAKADCQLVC

SEQ ID NO: 1486640 - protein, 24 aa, Mycobacterium tuberculosis
LNQLWMCGLPGYSPGDLIDFEFCG

SEQ ID NO: 1486641 - protein, 25 aa, Mycobacterium tuberculosis
LNQLWMCGLPGYSPGDLIDFEFCGD

SEQ ID NO: 1486642 - protein, 24 aa, Mycobacterium tuberculosis
LNRAPVCSTIRCHQWRSAGRSFAH

SEQ ID NO: 1486643 - protein, 26 aa, Mycobacterium tuberculosis
LNRIPQRGPGPMPLHHIHLGRAQPGI

SEQ ID NO: 1486644 - protein, 24 aa, Mycobacterium tuberculosis
LNRPGYLRFDFNWQGPLTDDQRTQ

SEQ ID NO: 1486645 - protein, 18 aa, Mycobacterium tuberculosis
LNSQYRWPAMAGAAVAVT

SEQ ID NO: 1486646 - protein, 25 aa, Mycobacterium tuberculosis
LNSSPARSWCPISWVDRTSGRADTY

SEQ ID NO: 1486647 - protein, 23 aa, Mycobacterium tuberculosis
LNSTDVHIGWVFTRTVRNNARTH

SEQ ID NO: 1486648 - protein, 17 aa, Mycobacterium tuberculosis
LNTAFTDLFVENGVVSG

SEQ ID NO: 1486649 - protein, 17 aa, Mycobacterium tuberculosis
LNTPLAVAVDSDRTVYV

SEQ ID NO: 1486650 - protein, 28 aa, Mycobacterium tuberculosis
LNVPRRDLRMLAARLGSDVPFALHGGTA

SEQ ID NO: 1486651 - protein, 25 aa, Mycobacterium tuberculosis
LNVSGGVLYRFAVDPDRSAQFLLVL

SEQ ID NO: 1486652 - protein, 29 aa, Mycobacterium tuberculosis
LPAAQRRDMMWICRDGDRAKNHLLEANLR

SEQ ID NO: 1486653 - protein, 18 aa, Mycobacterium tuberculosis
LPADLPALASGVIPAAPI

SEQ ID NO: 1486654 - protein, 26 aa, Mycobacterium tuberculosis
LPAGHYTLRAAIDWQQHKHERLPCGE

SEQ ID NO: 1486655 - protein, 19 aa, Mycobacterium tuberculosis
LPAHGGRLMAGWFAHTLRP

SEQ ID NO: 1486656 - protein, 17 aa, Mycobacterium tuberculosis
LPAILGFVPEKSLVLVS

SEQ ID NO: 1486657 - protein, 17 aa, Mycobacterium tuberculosis
LPALDVFMGGHAVACLG

SEQ ID NO: 1486658 - protein, 18 aa, Mycobacterium tuberculosis
LPALGRSGAFDILLAAYS

SEQ ID NO: 1486659 - protein, 22 aa, Mycobacterium tuberculosis
LPANHRYLGPVLWSPDVKPPTW

SEQ ID NO: 1486660 - protein, 24 aa, Mycobacterium tuberculosis
LPANHRYLGPVLWSPDVKPPTWWH

SEQ ID NO: 1486661 - protein, 23 aa, Mycobacterium tuberculosis
LPAPPAPPWPPVPPIPALPAAPT

SEQ ID NO: 1486662 - protein, 18 aa, Mycobacterium tuberculosis
LPAVPAIPVLDLAALYAE

SEQ ID NO: 1486663 - protein, 30 aa, Mycobacterium tuberculosis
LPCCRPSTSRPFRVGFAAVGWHRADRHPGH

SEQ ID NO: 1486664 - protein, 23 aa, Mycobacterium tuberculosis
LPCGSTIGARWPRRAPESPRSTS

SEQ ID NO: 1486665 - protein, 23 aa, Mycobacterium tuberculosis
LPDDQVCLVVEVFRMLADATRVQ

SEQ ID NO: 1486666 - protein, 20 aa, Mycobacterium tuberculosis
LPDECWHLVIVAHHIVIDGW

SEQ ID NO: 1486667 - protein, 21 aa, Mycobacterium tuberculosis
LPDECWHLVIVAHHIVIDGWS

SEQ ID NO: 1486668 - protein, 23 aa, Mycobacterium tuberculosis
LPDGARFYFELNLAGVADEHRDA

SEQ ID NO: 1486669 - protein, 17 aa, Mycobacterium tuberculosis
LPDGQWFPGQRVSRDFS

SEQ ID NO: 1486670 - protein, 25 aa, Mycobacterium tuberculosis
LPDPDIAQLVKWGYAATQLLEGLVE

SEQ ID NO: 1486671 - protein, 21 aa, Mycobacterium tuberculosis
LPDPYRPHRSAVLTASLTSPR

SEQ ID NO: 1486672 - protein, 23 aa, Mycobacterium tuberculosis
LPDQARAALIVLMQRYLVGDLAA

SEQ ID NO: 1486673 - protein, 18 aa, Mycobacterium tuberculosis
LPDRLRVHSLARTLGTTS

SEQ ID NO: 1486674 - protein, 23 aa, Mycobacterium tuberculosis
LPDRVAAAAAFHPGGLVANSPDS

SEQ ID NO: 1486675 - protein, 21 aa, Mycobacterium tuberculosis
LPEIPQLRWRVTGAPLGLDRP

SEQ ID NO: 1486676 - protein, 18 aa, Mycobacterium tuberculosis
LPEITHFVAGLGTTGTLM

SEQ ID NO: 1486677 - protein, 23 aa, Mycobacterium tuberculosis
LPELGLRRENIVFISGIGCSSRF

SEQ ID NO: 1486678 - protein, 17 aa, Mycobacterium tuberculosis
LPEPARAVVDYLAIAEP

SEQ ID NO: 1486679 - protein, 25 aa, Mycobacterium tuberculosis
LPEPLKCLTENLWALHTNRYDYVTT

SEQ ID NO: 1486680 - protein, 18 aa, Mycobacterium tuberculosis
LPEPMAAQLRRLRRHRPT

SEQ ID NO: 1486681 - protein, 25 aa, Mycobacterium tuberculosis
LPEPPRHVRRLQFLERMGSCQVVHR

SEQ ID NO: 1486682 - protein, 24 aa, Mycobacterium tuberculosis
LPESIVRTGGDLTFSLAGTPNKVW

SEQ ID NO: 1486683 - protein, 24 aa, Mycobacterium tuberculosis
LPEVVEATLALPVRDLVADGEAIA

SEQ ID NO: 1486684 - protein, 17 aa, Mycobacterium tuberculosis
LPFRARSRAAGANDGPC

SEQ ID NO: 1486685 - protein, 23 aa, Mycobacterium tuberculosis
LPFTDITAPWGIAVDEAGTVYVT

SEQ ID NO: 1486686 - protein, 25 aa, Mycobacterium tuberculosis
LPGADLRAPCALPVLVIDGRDEKAP

SEQ ID NO: 1486687 - protein, 26 aa, Mycobacterium tuberculosis
LPGADLRAPCALPVLVIDGRDEKHLR

SEQ ID NO: 1486688 - protein, 17 aa, Mycobacterium tuberculosis
LPGELRYDYPRCGGCCD

SEQ ID NO: 1486689 - protein, 30 aa, Mycobacterium tuberculosis
LPGFNLRPSEAPGFFVGFAAVGARQRREAR

SEQ ID NO: 1486690 - protein, 17 aa, Mycobacterium tuberculosis
LPGLDFVRGDAENLPFD

SEQ ID NO: 1486691 - protein, 21 aa, Mycobacterium tuberculosis
LPGMATGGLLGCFGLTEPDVG

SEQ ID NO: 1486692 - protein, 29 aa, Mycobacterium tuberculosis
LPGMLMAAARLDLAAVFLYAGSILPGRAK

SEQ ID NO: 1486693 - protein, 20 aa, Mycobacterium tuberculosis
LPGMVKRGAGAVLNIASIAG

SEQ ID NO: 1486694 - protein, 21 aa, Mycobacterium tuberculosis
LPGRLRAVGFTDIHVDVAGAR

SEQ ID NO: 1486695 - protein, 23 aa, Mycobacterium tuberculosis
LPGRLRAVGFTDIHVDVAGARLR

SEQ ID NO: 1486696 - protein, 17 aa, Mycobacterium tuberculosis
LPGRYAVAALGIGEQDA

SEQ ID NO: 1486697 - protein, 17 aa, Mycobacterium tuberculosis
LPGTALVIADLVWADGS

SEQ ID NO: 1486698 - protein, 18 aa, Mycobacterium tuberculosis
LPGTHKLARTCFVNEDGV

SEQ ID NO: 1486699 - protein, 19 aa, Mycobacterium tuberculosis
LPGTHKLARTCFVNEDGVP

SEQ ID NO: 1486700 - protein, 17 aa, Mycobacterium tuberculosis
LPGVCGHPAQARDSGGD

SEQ ID NO: 1486701 - protein, 18 aa, Mycobacterium tuberculosis
LPGVSQWRTLQRVPIGGE

SEQ ID NO: 1486702 - protein, 21 aa, Mycobacterium tuberculosis
LPHAQVRFVWLRGRRATSHWL

SEQ ID NO: 1486703 - protein, 17 aa, Mycobacterium tuberculosis
LPHDWRVDMPELDPSGA

SEQ ID NO: 1486704 - protein, 25 aa, Mycobacterium tuberculosis
LPHFNLSVGVTDAFLRAVERNGLHR

SEQ ID NO: 1486705 - protein, 17 aa, Mycobacterium tuberculosis
LPHISITHSPAYNLILS

SEQ ID NO: 1486706 - protein, 18 aa, Mycobacterium tuberculosis
LPHRVRLVAAGAKVSAVA

SEQ ID NO: 1486707 - protein, 27 aa, Mycobacterium tuberculosis
LPIAFSGPRWLALLLQPLSGPPSTSAK

SEQ ID NO: 1486708 - protein, 19 aa, Mycobacterium tuberculosis
LPICGQVKIPRPEHLAYYG

SEQ ID NO: 1486709 - protein, 17 aa, Mycobacterium tuberculosis
LPIGQGLSMTLLQMTGM

SEQ ID NO: 1486710 - protein, 29 aa, Mycobacterium tuberculosis
LPIQILPTIPLNIHQTFSLGPLVVPDIVI

SEQ ID NO: 1486711 - protein, 30 aa, Mycobacterium tuberculosis
LPIQILPTIPLNIHQTFSLGPLVVPDIVIP

SEQ ID NO: 1486712 - protein, 17 aa, Mycobacterium tuberculosis
LPKRCPPAPPAPPAAPL

SEQ ID NO: 1486713 - protein, 18 aa, Mycobacterium tuberculosis
LPLAPAINYPPPCLTGFL

SEQ ID NO: 1486714 - protein, 23 aa, Mycobacterium tuberculosis
LPLGVPTFRMLRALRGFDPDVVH

SEQ ID NO: 1486715 - protein, 17 aa, Mycobacterium tuberculosis
LPLPAGLQQFLNTLPNL

SEQ ID NO: 1486716 - protein, 24 aa, Mycobacterium tuberculosis
LPLPLKTSCAWAQARRDGQDPYPP

SEQ ID NO: 1486717 - protein, 18 aa, Mycobacterium tuberculosis
LPLPNAVPGLSRVRVLRG

SEQ ID NO: 1486718 - protein, 17 aa, Mycobacterium tuberculosis
LPLSGIASILGSTPGKV

SEQ ID NO: 1486719 - protein, 18 aa, Mycobacterium tuberculosis
LPLSMIMRRPEMPRLEIP

SEQ ID NO: 1486720 - protein, 20 aa, Mycobacterium tuberculosis
LPLYCASLRTAEPRLLERLG

SEQ ID NO: 1486721 - protein, 17 aa, Mycobacterium tuberculosis
LPLYHDMGLSMIGFPAV

SEQ ID NO: 1486722 - protein, 17 aa, Mycobacterium tuberculosis
LPMDKLLAGVAHVVHEM

SEQ ID NO: 1486723 - protein, 25 aa, Mycobacterium tuberculosis
LPMEELIAAFLPVLFAGMGNRRAPR

SEQ ID NO: 1486724 - protein, 24 aa, Mycobacterium tuberculosis
LPMEELIAAFLPVLFPGMEIVEHH

SEQ ID NO: 1486725 - protein, 17 aa, Mycobacterium tuberculosis
LPMLPRPTLPLPTLANP

SEQ ID NO: 1486726 - protein, 21 aa, Mycobacterium tuberculosis
LPMSTRLGIRLVIVLVRRWPK

SEQ ID NO: 1486727 - protein, 22 aa, Mycobacterium tuberculosis
LPNRLYWLSANIDPAGTDGGPQ

SEQ ID NO: 1486728 - protein, 23 aa, Mycobacterium tuberculosis
LPNRLYWLSANIDPAGTDGGPQL

SEQ ID NO: 1486729 - protein, 17 aa, Mycobacterium tuberculosis
LPNYAAADWGFVNSSGW

SEQ ID NO: 1486730 - protein, 18 aa, Mycobacterium tuberculosis
LPPAPPAPKRAFEASAPI

SEQ ID NO: 1486731 - protein, 23 aa, Mycobacterium tuberculosis
LPPDINSALMFAGPGSGPLIAAA

SEQ ID NO: 1486732 - protein, 23 aa, Mycobacterium tuberculosis
LPPDPPMPPAIWSALEAPNPPVP

SEQ ID NO: 1486733 - protein, 23 aa, Mycobacterium tuberculosis
LPPEINSARMFAGPGSGPLIAAA

SEQ ID NO: 1486734 - protein, 19 aa, Mycobacterium tuberculosis
LPPHRWRLAPLVLARPPGH

SEQ ID NO: 1486735 - protein, 21 aa, Mycobacterium tuberculosis
LPPIRALVCNAGLQVVSGIAF

SEQ ID NO: 1486736 - protein, 21 aa, Mycobacterium tuberculosis
LPPLRARPVPATPFPPAPPAP

SEQ ID NO: 1486737 - protein, 19 aa, Mycobacterium tuberculosis
LPPPLVLLTPLAPGSAGSG

SEQ ID NO: 1486738 - protein, 19 aa, Mycobacterium tuberculosis
LPPQRRLRLRRHHPRHHRP

SEQ ID NO: 1486739 - protein, 17 aa, Mycobacterium tuberculosis
LPPTLIFDYPTAAELAE

SEQ ID NO: 1486740 - protein, 18 aa, Mycobacterium tuberculosis
LPPTSCSGARGWGRQRRS

SEQ ID NO: 1486741 - protein, 23 aa, Mycobacterium tuberculosis
LPPTVGITLHLPFDGILVPPHPV

SEQ ID NO: 1486742 - protein, 26 aa, Mycobacterium tuberculosis
LPPVITRMSELFLRTLRDDPADAEVA

SEQ ID NO: 1486743 - protein, 17 aa, Mycobacterium tuberculosis
LPPVSGLTIAVERWERM

SEQ ID NO: 1486744 - protein, 18 aa, Mycobacterium tuberculosis
LPQAVPHSGAVVLNADDS

SEQ ID NO: 1486745 - protein, 18 aa, Mycobacterium tuberculosis
LPRAPRHCTPCSKMCSMW

SEQ ID NO: 1486746 - protein, 23 aa, Mycobacterium tuberculosis
LPRGCIAAGDRAFFCDYVQEYLS

SEQ ID NO: 1486747 - protein, 19 aa, Mycobacterium tuberculosis
LPRHGRGSIVYARSTTIEA

SEQ ID NO: 1486748 - protein, 25 aa, Mycobacterium tuberculosis
LPRLKPRVFYDLVVEVALIRPPGPS

SEQ ID NO: 1486749 - protein, 21 aa, Mycobacterium tuberculosis
LPRRHPGRRSPLWQQRQRAAR

SEQ ID NO: 1486750 - protein, 19 aa, Mycobacterium tuberculosis
LPRRNSACRLLRRRRDRPD

SEQ ID NO: 1486751 - protein, 27 aa, Mycobacterium tuberculosis
LPRSDWATKICELRKPVRLEVVTAVQG

SEQ ID NO: 1486752 - protein, 20 aa, Mycobacterium tuberculosis
LPRSRRIPASRVVEIAPTVR

SEQ ID NO: 1486753 - protein, 22 aa, Mycobacterium tuberculosis
LPRSRVRFLDRRGAAQPTQDRH

SEQ ID NO: 1486754 - protein, 20 aa, Mycobacterium tuberculosis
LPRTMLRFAGGREITLGDLG

SEQ ID NO: 1486755 - protein, 17 aa, Mycobacterium tuberculosis
LPRVAAIIEPDVSKIGV

SEQ ID NO: 1486756 - protein, 19 aa, Mycobacterium tuberculosis
LPRVNAHGGPGGRPGCWQT

SEQ ID NO: 1486757 - protein, 26 aa, Mycobacterium tuberculosis
LPRWRRCFWPSILVRGFSRSSPGGPT

SEQ ID NO: 1486758 - protein, 17 aa, Mycobacterium tuberculosis
LPSARAFAAVWTPAPFR

SEQ ID NO: 1486759 - protein, 17 aa, Mycobacterium tuberculosis
LPSAVYFRTTDVTGVVT

SEQ ID NO: 1486760 - protein, 24 aa, Mycobacterium tuberculosis
LPSHDWPDRVLRVTAIDIATGELV

SEQ ID NO: 1486761 - protein, 23 aa, Mycobacterium tuberculosis
LPSPPPPLFLPFPPPPAPSPPPP

SEQ ID NO: 1486762 - protein, 23 aa, Mycobacterium tuberculosis
LPSRLAANPSIAGWLRELEAVCT

SEQ ID NO: 1486763 - protein, 20 aa, Mycobacterium tuberculosis
LPSTALMDVLLRRPPRTRSG

SEQ ID NO: 1486764 - protein, 18 aa, Mycobacterium tuberculosis
LPTDRPIVYATLGTSGGR

SEQ ID NO: 1486765 - protein, 18 aa, Mycobacterium tuberculosis
LPTGIAYFSLEFGVAEVL

SEQ ID NO: 1486766 - protein, 21 aa, Mycobacterium tuberculosis
LPTGSMPRRWWSGPPGPRPNA

SEQ ID NO: 1486767 - protein, 17 aa, Mycobacterium tuberculosis
LPTPVGMEIMPPQPPLP

SEQ ID NO: 1486768 - protein, 18 aa, Mycobacterium tuberculosis
LPTRCISGAPGCCCPSAN

SEQ ID NO: 1486769 - protein, 21 aa, Mycobacterium tuberculosis
LPVDQLRYPVFSWQRITLQEM

SEQ ID NO: 1486770 - protein, 20 aa, Mycobacterium tuberculosis
LPVEAARGGPTGWQVTRTAS

SEQ ID NO: 1486771 - protein, 17 aa, Mycobacterium tuberculosis
LPVELLRVDGRHTDLDP

SEQ ID NO: 1486772 - protein, 20 aa, Mycobacterium tuberculosis
LPVFEVPGVEHARVGAARVA

SEQ ID NO: 1486773 - protein, 20 aa, Mycobacterium tuberculosis
LPVFPWDTLADAKALAGAHP

SEQ ID NO: 1486774 - protein, 20 aa, Mycobacterium tuberculosis
LPVLPRQRVLVISTGSELAS

SEQ ID NO: 1486775 - protein, 25 aa, Mycobacterium tuberculosis
LPVSYRPGLLCVRQIRFTHMGEYDF

SEQ ID NO: 1486776 - protein, 17 aa, Mycobacterium tuberculosis
LPVTGYADLVRAVKARV

SEQ ID NO: 1486777 - protein, 21 aa, Mycobacterium tuberculosis
LPWMADLVGEFALRAPPAEQI

SEQ ID NO: 1486778 - protein, 23 aa, Mycobacterium tuberculosis
LPWMADLVGEFALRAPPAEQIAA

SEQ ID NO: 1486779 - protein, 26 aa, Mycobacterium tuberculosis
LPWSDWLSRQRWYAGRNRELATVKPG

SEQ ID NO: 1486780 - protein, 19 aa, Mycobacterium tuberculosis
LPYIVMEYVDGVTLRDIVH

SEQ ID NO: 1486781 - protein, 23 aa, Mycobacterium tuberculosis
LPYLIRLPVGAGLVFATSDVWPR

SEQ ID NO: 1486782 - protein, 18 aa, Mycobacterium tuberculosis
LPYSLKVLAENLLRNEDG

SEQ ID NO: 1486783 - protein, 25 aa, Mycobacterium tuberculosis
LQADRAVVVAARLDRAALGRRWCCA

SEQ ID NO: 1486784 - protein, 17 aa, Mycobacterium tuberculosis
LQAFLHWAIIDGNKASF

SEQ ID NO: 1486785 - protein, 21 aa, Mycobacterium tuberculosis
LQALGAPPQRRQWWIDRVKAC

SEQ ID NO: 1486786 - protein, 28 aa, Mycobacterium tuberculosis
LQARIAAVKKTWSAWVAPGTSLNIVLID

SEQ ID NO: 1486787 - protein, 17 aa, Mycobacterium tuberculosis
LQCRQFQHRHRQPRVVQ

SEQ ID NO: 1486788 - protein, 26 aa, Mycobacterium tuberculosis
LQDYLATVITWHRHIAGLIEQAKSDI

SEQ ID NO: 1486789 - protein, 19 aa, Mycobacterium tuberculosis
LQEEARDAAAVGFDVTVCI

SEQ ID NO: 1486790 - protein, 25 aa, Mycobacterium tuberculosis
LQFAPGELKNLPGFQGSGDGSAATL

SEQ ID NO: 1486791 - protein, 21 aa, Mycobacterium tuberculosis
LQFDIRAHLVLGVAVGQIEHR

SEQ ID NO: 1486792 - protein, 17 aa, Mycobacterium tuberculosis
LQGGYGWTAGSTARRAR

SEQ ID NO: 1486793 - protein, 18 aa, Mycobacterium tuberculosis
LQGINFGFGNIGSLNLGS

SEQ ID NO: 1486794 - protein, 18 aa, Mycobacterium tuberculosis
LQGQPPLGPVLMTADARA

SEQ ID NO: 1486795 - protein, 29 aa, Mycobacterium tuberculosis
LQHRVRKCRGRQPGCGQHRWAQPGPGQCR

SEQ ID NO: 1486796 - protein, 24 aa, Mycobacterium tuberculosis
LQIRALVLGGALDWLKDNKASTNH

SEQ ID NO: 1486797 - protein, 23 aa, Mycobacterium tuberculosis
LQIVTELAPVFKAAGFRPNNSVP

SEQ ID NO: 1486798 - protein, 24 aa, Mycobacterium tuberculosis
LQLPDDRLEELLALAHEVRMGWCG

SEQ ID NO: 1486799 - protein, 25 aa, Mycobacterium tuberculosis
LQLSKRGGGVALLLTNIREHGAPIR

SEQ ID NO: 1486800 - protein, 18 aa, Mycobacterium tuberculosis
LQNGWLSRDGVWHTDTDN

SEQ ID NO: 1486801 - protein, 23 aa, Mycobacterium tuberculosis
LQPEIPYYSATSFDPREEPYCDP

SEQ ID NO: 1486802 - protein, 19 aa, Mycobacterium tuberculosis
LQPLFDVINAPTLALLNRP

SEQ ID NO: 1486803 - protein, 20 aa, Mycobacterium tuberculosis
LQPLFDVINAPTLALLNRPL

SEQ ID NO: 1486804 - protein, 19 aa, Mycobacterium tuberculosis
LQPTVPILLANLVSVGQVA

SEQ ID NO: 1486805 - protein, 19 aa, Mycobacterium tuberculosis
LQQFSWRIMPENLEDAGVS

SEQ ID NO: 1486806 - protein, 33 aa, Mycobacterium tuberculosis
LQQVCAEWTRRGWLAVRYNLPYRRRRPTGPPSG

SEQ ID NO: 1486807 - protein, 19 aa, Mycobacterium tuberculosis
LQRDMPGRFSLRERERVRD

SEQ ID NO: 1486808 - protein, 22 aa, Mycobacterium tuberculosis
LQRGMPVLGICRGTQVLNVALG

SEQ ID NO: 1486809 - protein, 22 aa, Mycobacterium tuberculosis
LQRLSPRWDDGRDGPHVRLWAK

SEQ ID NO: 1486810 - protein, 19 aa, Mycobacterium tuberculosis
LQRTAPWVESLGLDHLREV

SEQ ID NO: 1486811 - protein, 32 aa, Mycobacterium tuberculosis
LQRWRPFGLPPHRWRLAPWYWRGLQVTLEPGS

SEQ ID NO: 1486812 - protein, 19 aa, Mycobacterium tuberculosis
LQSFLPPPFDAIPNPIEDL

SEQ ID NO: 1486813 - protein, 17 aa, Mycobacterium tuberculosis
LQTSAPVTGLRPIVTET

SEQ ID NO: 1486814 - protein, 26 aa, Mycobacterium tuberculosis
LQVGDFVKIDFGALVAGYHSDMTRTF

SEQ ID NO: 1486815 - protein, 18 aa, Mycobacterium tuberculosis
LQVPRLELPTVSDGVDLG

SEQ ID NO: 1486816 - protein, 17 aa, Mycobacterium tuberculosis
LQVPRPLGGRRRPVRQV

SEQ ID NO: 1486817 - protein, 19 aa, Mycobacterium tuberculosis
LQVRPPVVTVMGHVDHGKT

SEQ ID NO: 1486818 - protein, 26 aa, Mycobacterium tuberculosis
LQVSLPAKRWLAQRGFDPVYGARPLR

SEQ ID NO: 1486819 - protein, 18 aa, Mycobacterium tuberculosis
LQYFVSCLVYMPEIATPP

SEQ ID NO: 1486820 - protein, 21 aa, Mycobacterium tuberculosis
LQYRRGGAAGGQRGNLDTHSR

SEQ ID NO: 1486821 - protein, 26 aa, Mycobacterium tuberculosis
LQYWRGRGLPGKRRLMTWRGGYHGDT

SEQ ID NO: 1486822 - protein, 19 aa, Mycobacterium tuberculosis
LRAAAGWLGFGSDMAVRGE

SEQ ID NO: 1486823 - protein, 17 aa, Mycobacterium tuberculosis
LRAAASVLMEALRMERS

SEQ ID NO: 1486824 - protein, 17 aa, Mycobacterium tuberculosis
LRAAKAEPLGVLPQPNE

SEQ ID NO: 1486825 - protein, 18 aa, Mycobacterium tuberculosis
LRAAKAEPLGVLPQPNEL

SEQ ID NO: 1486826 - protein, 22 aa, Mycobacterium tuberculosis
LRAAKCRTRNLPLIGAPANPGP

SEQ ID NO: 1486827 - protein, 31 aa, Mycobacterium tuberculosis
LRAALRAVPAERLWVNPDCGLKTRNVDEVTA

SEQ ID NO: 1486828 - protein, 23 aa, Mycobacterium tuberculosis
LRAAMPNTVWTTGCDSWYLNKDG

SEQ ID NO: 1486829 - protein, 17 aa, Mycobacterium tuberculosis
LRAASLLDKIGEDHIFM

SEQ ID NO: 1486830 - protein, 22 aa, Mycobacterium tuberculosis
LRAGECQRAMSVANNVVVDVNA

SEQ ID NO: 1486831 - protein, 20 aa, Mycobacterium tuberculosis
LRAGIELDDGPAFVDDFAVV

SEQ ID NO: 1486832 - protein, 21 aa, Mycobacterium tuberculosis
LRAGIPTLILWVTSDQPIWAA

SEQ ID NO: 1486833 - protein, 19 aa, Mycobacterium tuberculosis
LRAGLRAADCALFVIAANE

SEQ ID NO: 1486834 - protein, 19 aa, Mycobacterium tuberculosis
LRAGSMLASMSKIHPGVDV

SEQ ID NO: 1486835 - protein, 18 aa, Mycobacterium tuberculosis
LRAGTLTRRAHWRSPAGK

SEQ ID NO: 1486836 - protein, 19 aa, Mycobacterium tuberculosis
LRAGTLTRRAHWRSPAGKQ

SEQ ID NO: 1486837 - protein, 25 aa, Mycobacterium tuberculosis
LRAGVARSGFYFYFDSKYSVLAQIL

SEQ ID NO: 1486838 - protein, 21 aa, Mycobacterium tuberculosis
LRAHAVAVPPMFSDLASAPTR

SEQ ID NO: 1486839 - protein, 22 aa, Mycobacterium tuberculosis
LRAHAVAVPPMFSDLASAPTRR

SEQ ID NO: 1486840 - protein, 22 aa, Mycobacterium tuberculosis
LRAHAVAVPPMFSDLINAPTRR

SEQ ID NO: 1486841 - protein, 28 aa, Mycobacterium tuberculosis
LRAHVMATYLSRDWARDWGSLRKFDTLV

SEQ ID NO: 1486842 - protein, 18 aa, Mycobacterium tuberculosis
LRAIVDIAARHGARVIAD

SEQ ID NO: 1486843 - protein, 20 aa, Mycobacterium tuberculosis
LRAKVEALEHGRIAVAIAGV

SEQ ID NO: 1486844 - protein, 17 aa, Mycobacterium tuberculosis
LRALHAVAIVNENDTVA

SEQ ID NO: 1486845 - protein, 18 aa, Mycobacterium tuberculosis
LRALVLCDFESMTGALPT

SEQ ID NO: 1486846 - protein, 19 aa, Mycobacterium tuberculosis
LRALVLCDFESMTGALPTS

SEQ ID NO: 1486847 - protein, 22 aa, Mycobacterium tuberculosis
LRANGIRRIVMLTGDHPEIAQV

SEQ ID NO: 1486848 - protein, 20 aa, Mycobacterium tuberculosis
LRARALRVVRRLPRQEPRYR

SEQ ID NO: 1486849 - protein, 20 aa, Mycobacterium tuberculosis
LRARPADYMLALSVAGGSLP

SEQ ID NO: 1486850 - protein, 17 aa, Mycobacterium tuberculosis
LRASWTATTPDLGAHVQ

SEQ ID NO: 1486851 - protein, 18 aa, Mycobacterium tuberculosis
LRCESGWCTGTVADRAVL

SEQ ID NO: 1486852 - protein, 18 aa, Mycobacterium tuberculosis
LRCGEVLSTILLECTMAG

SEQ ID NO: 1486853 - protein, 17 aa, Mycobacterium tuberculosis
LRDAGCDIVTITQYLRP

SEQ ID NO: 1486854 - protein, 23 aa, Mycobacterium tuberculosis
LRDAYCRHIGVEYAHILDPEQKE

SEQ ID NO: 1486855 - protein, 24 aa, Mycobacterium tuberculosis
LRDAYCRHIGVEYAHILDPEQKEW

SEQ ID NO: 1486856 - protein, 22 aa, Mycobacterium tuberculosis
LRDDGACYAELLTAAGVSVELS

SEQ ID NO: 1486857 - protein, 26 aa, Mycobacterium tuberculosis
LRDGTAMDRFRWLVAAQGGDLSKPLP

SEQ ID NO: 1486858 - protein, 18 aa, Mycobacterium tuberculosis
LRDHCHTRILTPGPGNDA

SEQ ID NO: 1486859 - protein, 19 aa, Mycobacterium tuberculosis
LRDIEWRIGPGERIGIVGA

SEQ ID NO: 1486860 - protein, 25 aa, Mycobacterium tuberculosis
LRDLASRIYTDFTYRPGSTTISTGV

SEQ ID NO: 1486861 - protein, 20 aa, Mycobacterium tuberculosis
LRDPCRDLVAAIADERIAAT

SEQ ID NO: 1486862 - protein, 17 aa, Mycobacterium tuberculosis
LRDVLGLLHDAYCRHIG

SEQ ID NO: 1486863 - protein, 17 aa, Mycobacterium tuberculosis
LRDWLRRQAKAGAGPPE

SEQ ID NO: 1486864 - protein, 17 aa, Mycobacterium tuberculosis
LREAIAAFSAVKPSLAW

SEQ ID NO: 1486865 - protein, 24 aa, Mycobacterium tuberculosis
LREEAAKFGVEWLPAKGFITDRLP

SEQ ID NO: 1486866 - protein, 18 aa, Mycobacterium tuberculosis
LREFKTGAARMALEAQVP

SEQ ID NO: 1486867 - protein, 25 aa, Mycobacterium tuberculosis
LREGFPVELLSYFEVFTKTTISAEQ

SEQ ID NO: 1486868 - protein, 21 aa, Mycobacterium tuberculosis
LRELPRVAAIIEPDVSKIGVL

SEQ ID NO: 1486869 - protein, 28 aa, Mycobacterium tuberculosis
LRELYLGHLWCRTLRPGLPPPTTSSGID

SEQ ID NO: 1486870 - protein, 22 aa, Mycobacterium tuberculosis
LREPRGPWGPGRPVEAADAFEA

SEQ ID NO: 1486871 - protein, 18 aa, Mycobacterium tuberculosis
LRESFGGSKPAPAKGTAK

SEQ ID NO: 1486872 - protein, 17 aa, Mycobacterium tuberculosis
LRESVVAALARRYGITR

SEQ ID NO: 1486873 - protein, 23 aa, Mycobacterium tuberculosis
LRETFRAIGVDLMFDHIKQSLHE

SEQ ID NO: 1486874 - protein, 25 aa, Mycobacterium tuberculosis
LRFAAPCPGQHGWRAPAAAAPPLDQ

SEQ ID NO: 1486875 - protein, 23 aa, Mycobacterium tuberculosis
LRFLKEDPWERLATLRAAMPNIC

SEQ ID NO: 1486876 - protein, 19 aa, Mycobacterium tuberculosis
LRFQPRWKELFPTARQLAG

SEQ ID NO: 1486877 - protein, 18 aa, Mycobacterium tuberculosis
LRFRREAQNAAALNHPAI

SEQ ID NO: 1486878 - protein, 23 aa, Mycobacterium tuberculosis
LRGALVRDPRAWSGYLTEAIDTF

SEQ ID NO: 1486879 - protein, 27 aa, Mycobacterium tuberculosis
LRGEPIRNRICRGLRTGDHHRFGRVDR

SEQ ID NO: 1486880 - protein, 18 aa, Mycobacterium tuberculosis
LRGGFARPSPAPWPTRPA

SEQ ID NO: 1486881 - protein, 17 aa, Mycobacterium tuberculosis
LRGIAISPVEAHLTENH

SEQ ID NO: 1486882 - protein, 18 aa, Mycobacterium tuberculosis
LRGIAISPVEAHLTENHD

SEQ ID NO: 1486883 - protein, 18 aa, Mycobacterium tuberculosis
LRGLISICAAGGQGVAAI

SEQ ID NO: 1486884 - protein, 19 aa, Mycobacterium tuberculosis
LRGLPRPEWVMQLCHPDIR

SEQ ID NO: 1486885 - protein, 21 aa, Mycobacterium tuberculosis
LRGPGFAQLRRLADVVYDPWI

SEQ ID NO: 1486886 - protein, 23 aa, Mycobacterium tuberculosis
LRGRARPASTLIYPVHRRSSGHR

SEQ ID NO: 1486887 - protein, 22 aa, Mycobacterium tuberculosis
LRGRNTLKWNYFGPDVVPLWLA

SEQ ID NO: 1486888 - protein, 25 aa, Mycobacterium tuberculosis
LRGRPADRWPVARATPTLHVCPQNQ

SEQ ID NO: 1486889 - protein, 20 aa, Mycobacterium tuberculosis
LRGRTGALIVLGHDENVEAI

SEQ ID NO: 1486890 - protein, 17 aa, Mycobacterium tuberculosis
LRGSELIRIEAPTDASV

SEQ ID NO: 1486891 - protein, 19 aa, Mycobacterium tuberculosis
LRGVARGQTLVLYRPDPAG

SEQ ID NO: 1486892 - protein, 20 aa, Mycobacterium tuberculosis
LRGVARGQTLVLYRPDPAGD

SEQ ID NO: 1486893 - protein, 21 aa, Mycobacterium tuberculosis
LRGVCKRYGSITAVSNLDLDV

SEQ ID NO: 1486894 - protein, 17 aa, Mycobacterium tuberculosis
LRGVRDFILNRHAAPPQ

SEQ ID NO: 1486895 - protein, 19 aa, Mycobacterium tuberculosis
LRHDWPDALRRGGFDAAEP

SEQ ID NO: 1486896 - protein, 19 aa, Mycobacterium tuberculosis
LRHEFGDAVAIIGRPAYTP

SEQ ID NO: 1486897 - protein, 17 aa, Mycobacterium tuberculosis
LRHELRRPSWRRETVAL

SEQ ID NO: 1486898 - protein, 19 aa, Mycobacterium tuberculosis
LRHGVALWAGGLRVLAGSG

SEQ ID NO: 1486899 - protein, 31 aa, Mycobacterium tuberculosis
LRHGVCRRCCISIGCPMSFPTSRPGSLCRKR

SEQ ID NO: 1486900 - protein, 19 aa, Mycobacterium tuberculosis
LRHHLKLAGRDDALFSDDA

SEQ ID NO: 1486901 - protein, 17 aa, Mycobacterium tuberculosis
LRIEEAAARTQARIDSG

SEQ ID NO: 1486902 - protein, 21 aa, Mycobacterium tuberculosis
LRIGHEVEEVIPLGPVDGPVT

SEQ ID NO: 1486903 - protein, 23 aa, Mycobacterium tuberculosis
LRIGHEVEEVIPLGPVDGPVTVG

SEQ ID NO: 1486904 - protein, 17 aa, Mycobacterium tuberculosis
LRIGTGVSERDKHNRVL

SEQ ID NO: 1486905 - protein, 19 aa, Mycobacterium tuberculosis
LRIHCDGATDFARIPGSGI

SEQ ID NO: 1486906 - protein, 19 aa, Mycobacterium tuberculosis
LRILLGLVKADGGSVRLLG

SEQ ID NO: 1486907 - protein, 26 aa, Mycobacterium tuberculosis
LRILSDINAFMGYFYVHNTYPELMAT

SEQ ID NO: 1486908 - protein, 23 aa, Mycobacterium tuberculosis
LRISSQLLANWLRHGVITSADVR

SEQ ID NO: 1486909 - protein, 20 aa, Mycobacterium tuberculosis
LRIVIEIKRDAVAKVVINNL

SEQ ID NO: 1486910 - protein, 17 aa, Mycobacterium tuberculosis
LRKAAGLLNLDDLAESA

SEQ ID NO: 1486911 - protein, 18 aa, Mycobacterium tuberculosis
LRKELAWLRRGAPARTCK

SEQ ID NO: 1486912 - protein, 18 aa, Mycobacterium tuberculosis
LRKIPLTLVHTVSPEVAT

SEQ ID NO: 1486913 - protein, 26 aa, Mycobacterium tuberculosis
LRKLLAQEWLRFGWFFLATRRDPKGL

SEQ ID NO: 1486914 - protein, 22 aa, Mycobacterium tuberculosis
LRKSEPYCGYQHYEFDVITDDS

SEQ ID NO: 1486915 - protein, 19 aa, Mycobacterium tuberculosis
LRKTGLLGLVLPREIGGMG

SEQ ID NO: 1486916 - protein, 17 aa, Mycobacterium tuberculosis
LRKVFSAAVARQPFIAL

SEQ ID NO: 1486917 - protein, 17 aa, Mycobacterium tuberculosis
LRKVFSAAVARQQVAPW

SEQ ID NO: 1486918 - protein, 30 aa, Mycobacterium tuberculosis
LRLAELRASSGLKLPDCCVPDVAIHHQASL

SEQ ID NO: 1486919 - protein, 18 aa, Mycobacterium tuberculosis
LRLEGLEVIPSVLPPAPA

SEQ ID NO: 1486920 - protein, 22 aa, Mycobacterium tuberculosis
LRLEGYRRLAAASSDREVAAVV

SEQ ID NO: 1486921 - protein, 19 aa, Mycobacterium tuberculosis
LRLETEWPARQLVDDRWVW

SEQ ID NO: 1486922 - protein, 18 aa, Mycobacterium tuberculosis
LRLGEGRMVKRLKKVADY

SEQ ID NO: 1486923 - protein, 20 aa, Mycobacterium tuberculosis
LRLHPNMVRQGGRRSAVDPF

SEQ ID NO: 1486924 - protein, 20 aa, Mycobacterium tuberculosis
LRLHVHLEISPAYRDVFTIR

SEQ ID NO: 1486925 - protein, 18 aa, Mycobacterium tuberculosis
LRLLGPLPTLYDSRTTHT

SEQ ID NO: 1486926 - protein, 18 aa, Mycobacterium tuberculosis
LRLLHPVIPFLTEALWLA

SEQ ID NO: 1486927 - protein, 26 aa, Mycobacterium tuberculosis
LRLNVLPRRVIALWSDKGKHVALASV

SEQ ID NO: 1486928 - protein, 19 aa, Mycobacterium tuberculosis
LRLPADLLGSGADRAISSG

SEQ ID NO: 1486929 - protein, 18 aa, Mycobacterium tuberculosis
LRLPGSVAEILASPAGPK

SEQ ID NO: 1486930 - protein, 18 aa, Mycobacterium tuberculosis
LRLPLRNVLWEGDEALLT

SEQ ID NO: 1486931 - protein, 19 aa, Mycobacterium tuberculosis
LRLRHGRAIGHADGPDDAV

SEQ ID NO: 1486932 - protein, 22 aa, Mycobacterium tuberculosis
LRLRMADLQARVDLLRYALHGI

SEQ ID NO: 1486933 - protein, 23 aa, Mycobacterium tuberculosis
LRLSHPELLYHPTQSWVVDDNFD

SEQ ID NO: 1486934 - protein, 20 aa, Mycobacterium tuberculosis
LRLTGRRVMLVPTMGALHEG

SEQ ID NO: 1486935 - protein, 19 aa, Mycobacterium tuberculosis
LRLVQALQARGHVVAMTGD

SEQ ID NO: 1486936 - protein, 23 aa, Mycobacterium tuberculosis
LRNGLRTHVGFVRSGMAPRLVSD

SEQ ID NO: 1486937 - protein, 17 aa, Mycobacterium tuberculosis
LRNGVLIHRKLPADPAT

SEQ ID NO: 1486938 - protein, 24 aa, Mycobacterium tuberculosis
LRNHARWAVLLRNLRFVIVDECHY

SEQ ID NO: 1486939 - protein, 25 aa, Mycobacterium tuberculosis
LRNHARWAVLLRNLRFVIVDECHYY

SEQ ID NO: 1486940 - protein, 18 aa, Mycobacterium tuberculosis
LRNQAALGRVLRGTDVRA

SEQ ID NO: 1486941 - protein, 22 aa, Mycobacterium tuberculosis
LRNVHIRPGVPPLVIAAPVELS

SEQ ID NO: 1486942 - protein, 22 aa, Mycobacterium tuberculosis
LRPDAGPSWLRPLVDNVGQIPD

SEQ ID NO: 1486943 - protein, 23 aa, Mycobacterium tuberculosis
LRPDQRVAFVLHDGFAVPFAEVA

SEQ ID NO: 1486944 - protein, 22 aa, Mycobacterium tuberculosis
LRPEAAAGQLRPRVRQDPKIQM

SEQ ID NO: 1486945 - protein, 17 aa, Mycobacterium tuberculosis
LRPGGPVMVETVSQAIA

SEQ ID NO: 1486946 - protein, 25 aa, Mycobacterium tuberculosis
LRPIEGRTAMSFVIANPEMLAAAAT

SEQ ID NO: 1486947 - protein, 17 aa, Mycobacterium tuberculosis
LRPISGGLLIQQSDQLD

SEQ ID NO: 1486948 - protein, 18 aa, Mycobacterium tuberculosis
LRPLPFRLVLDGTEEIVA

SEQ ID NO: 1486949 - protein, 19 aa, Mycobacterium tuberculosis
LRPPVFGILRYITDAVDEI

SEQ ID NO: 1486950 - protein, 18 aa, Mycobacterium tuberculosis
LRPQLLDRFGLTVDVQAS

SEQ ID NO: 1486951 - protein, 17 aa, Mycobacterium tuberculosis
LRPRTVITGQRRWTLPA

SEQ ID NO: 1486952 - protein, 23 aa, Mycobacterium tuberculosis
LRPSDLARAIAFVAETPRGCVVV

SEQ ID NO: 1486953 - protein, 17 aa, Mycobacterium tuberculosis
LRPTRPRFGDTHPPASK

SEQ ID NO: 1486954 - protein, 29 aa, Mycobacterium tuberculosis
LRPVKPPPSEGWRRLLYLLSGRLINAGEG

SEQ ID NO: 1486955 - protein, 23 aa, Mycobacterium tuberculosis
LRQKANLKLIVFDYLQIDDLGQE

SEQ ID NO: 1486956 - protein, 17 aa, Mycobacterium tuberculosis
LRQLAIGSEGVFGVITR

SEQ ID NO: 1486957 - protein, 19 aa, Mycobacterium tuberculosis
LRQLEAIAVQATRISRITP

SEQ ID NO: 1486958 - protein, 27 aa, Mycobacterium tuberculosis
LRQLRLGDYDVLVGINLLREGLDLPEV

SEQ ID NO: 1486959 - protein, 18 aa, Mycobacterium tuberculosis
LRQQCPGLPAGGGCPVRG

SEQ ID NO: 1486960 - protein, 19 aa, Mycobacterium tuberculosis
LRRARPVLEPMAGKIIHCG

SEQ ID NO: 1486961 - protein, 20 aa, Mycobacterium tuberculosis
LRRAVRLLAQLTRQVAVVQY

SEQ ID NO: 1486962 - protein, 18 aa, Mycobacterium tuberculosis
LRRGGFDAAEPAAWIAEG

SEQ ID NO: 1486963 - protein, 17 aa, Mycobacterium tuberculosis
LRRGLVWRRRASELRTE

SEQ ID NO: 1486964 - protein, 25 aa, Mycobacterium tuberculosis
LRRIEIELDQCWDLLRQRRALRQTG

SEQ ID NO: 1486965 - protein, 20 aa, Mycobacterium tuberculosis
LRRIEPLLATLRAIAVDVDA

SEQ ID NO: 1486966 - protein, 17 aa, Mycobacterium tuberculosis
LRRKGCDLLVVNAVGEG

SEQ ID NO: 1486967 - protein, 20 aa, Mycobacterium tuberculosis
LRRLAPLAFVRFRIDGKDWP

SEQ ID NO: 1486968 - protein, 20 aa, Mycobacterium tuberculosis
LRRLSTLGIVPVEVYRQRRA

SEQ ID NO: 1486969 - protein, 24 aa, Mycobacterium tuberculosis
LRRPEMPALLAELGLSDRQLASTG

SEQ ID NO: 1486970 - protein, 19 aa, Mycobacterium tuberculosis
LRRPGGPGVIMGRNVVRKD

SEQ ID NO: 1486971 - protein, 19 aa, Mycobacterium tuberculosis
LRRPRATDGEWDQVARCES

SEQ ID NO: 1486972 - protein, 25 aa, Mycobacterium tuberculosis
LRRRGRHPRPRAALRVVGRRRSRRA

SEQ ID NO: 1486973 - protein, 18 aa, Mycobacterium tuberculosis
LRRRRHAGAQAGRRRPPR

SEQ ID NO: 1486974 - protein, 20 aa, Mycobacterium tuberculosis
LRRTHGWPAAMGILREMGMA

SEQ ID NO: 1486975 - protein, 31 aa, Mycobacterium tuberculosis
LRRTHRGHHGCRASRAITQRRLGCIGNPSKV

SEQ ID NO: 1486976 - protein, 18 aa, Mycobacterium tuberculosis
LRRVDAHYADPLDLRADS

SEQ ID NO: 1486977 - protein, 25 aa, Mycobacterium tuberculosis
LRRVELLRQLRLVVYDLLVVSIDPE

SEQ ID NO: 1486978 - protein, 23 aa, Mycobacterium tuberculosis
LRRVERRAVPLPLEQKIFDAEWT

SEQ ID NO: 1486979 - protein, 17 aa, Mycobacterium tuberculosis
LRRVHMVGIGGAGMSGI

SEQ ID NO: 1486980 - protein, 17 aa, Mycobacterium tuberculosis
LRSGFGGAGGAGGASDT

SEQ ID NO: 1486981 - protein, 22 aa, Mycobacterium tuberculosis
LRSLERLECLARRLPAVGHTLI

SEQ ID NO: 1486982 - protein, 19 aa, Mycobacterium tuberculosis
LRSLPGCHLLVRPEVMRRD

SEQ ID NO: 1486983 - protein, 24 aa, Mycobacterium tuberculosis
LRSPISISTGVLWRDPTAGVVKAG

SEQ ID NO: 1486984 - protein, 19 aa, Mycobacterium tuberculosis
LRSPLLAVVKDGSLLGVVT

SEQ ID NO: 1486985 - protein, 18 aa, Mycobacterium tuberculosis
LRSPLLRLATWNVNSIRT

SEQ ID NO: 1486986 - protein, 18 aa, Mycobacterium tuberculosis
LRSQRYFRLLDALDALVS

SEQ ID NO: 1486987 - protein, 18 aa, Mycobacterium tuberculosis
LRSRCRHVALVTPSTHAI

SEQ ID NO: 1486988 - protein, 25 aa, Mycobacterium tuberculosis
LRSSTCAPIAWSRSFRHVQALETDP

SEQ ID NO: 1486989 - protein, 24 aa, Mycobacterium tuberculosis
LRTELLRRGIVFAMARVKQDLRES

SEQ ID NO: 1486990 - protein, 19 aa, Mycobacterium tuberculosis
LRTGGAYRWTVTPGHSAAG

SEQ ID NO: 1486991 - protein, 22 aa, Mycobacterium tuberculosis
LRTHPVVLRRFRGCAGVPATQD

SEQ ID NO: 1486992 - protein, 17 aa, Mycobacterium tuberculosis
LRTLLSTVRTGGDPHLA

SEQ ID NO: 1486993 - protein, 18 aa, Mycobacterium tuberculosis
LRTLSAQAADTAARIRQQ

SEQ ID NO: 1486994 - protein, 25 aa, Mycobacterium tuberculosis
LRTNSEILSGIGISLLSPLALATNG

SEQ ID NO: 1486995 - protein, 17 aa, Mycobacterium tuberculosis
LRTPLAAIQGYAELTRQ

SEQ ID NO: 1486996 - protein, 24 aa, Mycobacterium tuberculosis
LRTQSAALDRIWANISAVAEQLRG

SEQ ID NO: 1486997 - protein, 24 aa, Mycobacterium tuberculosis
LRTRKAGAVGLVMAEPLTYFFSDP

SEQ ID NO: 1486998 - protein, 18 aa, Mycobacterium tuberculosis
LRTVKREVASAISRSHRL

SEQ ID NO: 1486999 - protein, 18 aa, Mycobacterium tuberculosis
LRVADLFDSQGIWLVSSM

SEQ ID NO: 1487000 - protein, 19 aa, Mycobacterium tuberculosis
LRVADLVLVSPGSIPITTS

SEQ ID NO: 1487001 - protein, 27 aa, Mycobacterium tuberculosis
LRVAPSASWMLEYYPIRELRQLPDGSC

SEQ ID NO: 1487002 - protein, 17 aa, Mycobacterium tuberculosis
LRVHRRRRCRLFRRCRV

SEQ ID NO: 1487003 - protein, 17 aa, Mycobacterium tuberculosis
LRVQFWVCGVFEVDDGR

SEQ ID NO: 1487004 - protein, 31 aa, Mycobacterium tuberculosis
LRVRHLAGGGARGCRAVCRVGRQQTVQGGVA

SEQ ID NO: 1487005 - protein, 22 aa, Mycobacterium tuberculosis
LRVVQHWVNHGVKFFRVDNPHT

SEQ ID NO: 1487006 - protein, 19 aa, Mycobacterium tuberculosis
LRWCHEAGIDLATVYLLST

SEQ ID NO: 1487007 - protein, 22 aa, Mycobacterium tuberculosis
LRWHSQRGGSAVSHYRSNVRDQ

SEQ ID NO: 1487008 - protein, 17 aa, Mycobacterium tuberculosis
LRWLCGSWYMGVVVSRS

SEQ ID NO: 1487009 - protein, 17 aa, Mycobacterium tuberculosis
LRWPCPVPGAMPISEVG

SEQ ID NO: 1487010 - protein, 18 aa, Mycobacterium tuberculosis
LRWPCPVPGAMPISEVGT

SEQ ID NO: 1487011 - protein, 20 aa, Mycobacterium tuberculosis
LRYRALDFGLDVGRAQPPAS

SEQ ID NO: 1487012 - protein, 38 aa, Mycobacterium tuberculosis
LSAARALGRYGVCANVICPRARTAMTADVFGAAPDVEA

SEQ ID NO: 1487013 - protein, 17 aa, Mycobacterium tuberculosis
LSADRIVLCAGAIQSAH

SEQ ID NO: 1487014 - protein, 18 aa, Mycobacterium tuberculosis
LSAGYTFMGFAEDLPAVG

SEQ ID NO: 1487015 - protein, 19 aa, Mycobacterium tuberculosis
LSAGYTFMGFAEDLPAVGS

SEQ ID NO: 1487016 - protein, 25 aa, Mycobacterium tuberculosis
LSAHAVAFHDQFVQLMSAGAAQYAS

SEQ ID NO: 1487017 - protein, 19 aa, Mycobacterium tuberculosis
LSAHAVAFHEQFVQLMSAG

SEQ ID NO: 1487018 - protein, 17 aa, Mycobacterium tuberculosis
LSALLHVARTVVRRAER

SEQ ID NO: 1487019 - protein, 19 aa, Mycobacterium tuberculosis
LSALVAHLVGADALVLLSD

SEQ ID NO: 1487020 - protein, 25 aa, Mycobacterium tuberculosis
LSAPGSRLAFEFVPDTAIFADERWR

SEQ ID NO: 1487021 - protein, 17 aa, Mycobacterium tuberculosis
LSAPRTAGWRWCSAPAA

SEQ ID NO: 1487022 - protein, 18 aa, Mycobacterium tuberculosis
LSAQAAGFHAQFVQALNA

SEQ ID NO: 1487023 - protein, 19 aa, Mycobacterium tuberculosis
LSARPVIEQALLDNGVETR

SEQ ID NO: 1487024 - protein, 22 aa, Mycobacterium tuberculosis
LSARSAGFAGIRACRRTTAGTS

SEQ ID NO: 1487025 - protein, 21 aa, Mycobacterium tuberculosis
LSATASSYVAAEAVNVEQSLL

SEQ ID NO: 1487026 - protein, 17 aa, Mycobacterium tuberculosis
LSATLGLLPEADAVLVV

SEQ ID NO: 1487027 - protein, 24 aa, Mycobacterium tuberculosis
LSAVEFLGSVGLKILAATSEKIGQ

SEQ ID NO: 1487028 - protein, 22 aa, Mycobacterium tuberculosis
LSAVSSRAGVEIAIDDNGSGVP

SEQ ID NO: 1487029 - protein, 17 aa, Mycobacterium tuberculosis
LSCLRGCGLVVATYEGR

SEQ ID NO: 1487030 - protein, 17 aa, Mycobacterium tuberculosis
LSCPGMKLARPDVFHPR

SEQ ID NO: 1487031 - protein, 21 aa, Mycobacterium tuberculosis
LSEAARQGFTIALVPPSDDPV

SEQ ID NO: 1487032 - protein, 22 aa, Mycobacterium tuberculosis
LSEEDRRFAVVFVHDQSDYARM

SEQ ID NO: 1487033 - protein, 23 aa, Mycobacterium tuberculosis
LSERLTALPGWELVDGKLRHTFG

SEQ ID NO: 1487034 - protein, 26 aa, Mycobacterium tuberculosis
LSGAKLDVIVPMSFLCDGYGLNVTLV

SEQ ID NO: 1487035 - protein, 17 aa, Mycobacterium tuberculosis
LSGDRRLGGPAWARSGC

SEQ ID NO: 1487036 - protein, 34 aa, Mycobacterium tuberculosis
LSGIASILVPRPGRCPPGFQILPISSTLGLGTGP

SEQ ID NO: 1487037 - protein, 20 aa, Mycobacterium tuberculosis
LSGLDLRPATSRAQCLRMVA

SEQ ID NO: 1487038 - protein, 22 aa, Mycobacterium tuberculosis
LSGRESIEIPAIRRSVDPRRQL

SEQ ID NO: 1487039 - protein, 18 aa, Mycobacterium tuberculosis
LSGSACSALVFATLAAGD

SEQ ID NO: 1487040 - protein, 19 aa, Mycobacterium tuberculosis
LSGTVTPVFGGRTVSVTYS

SEQ ID NO: 1487041 - protein, 18 aa, Mycobacterium tuberculosis
LSIAFAIGERHELGPVPI

SEQ ID NO: 1487042 - protein, 17 aa, Mycobacterium tuberculosis
LSKLVRHHLLLPITATR

SEQ ID NO: 1487043 - protein, 36 aa, Mycobacterium tuberculosis
LSLDISPLQARCGWAVGWRKDAFFGRAALLAEKAAE

SEQ ID NO: 1487044 - protein, 22 aa, Mycobacterium tuberculosis
LSLGQRQRLGLARALGSPAAVL

SEQ ID NO: 1487045 - protein, 22 aa, Mycobacterium tuberculosis
LSLGSSSGVVWGRVPITAPAGA

SEQ ID NO: 1487046 - protein, 24 aa, Mycobacterium tuberculosis
LSLMDAWAGPVVMQLMEAAKPFVR

SEQ ID NO: 1487047 - protein, 25 aa, Mycobacterium tuberculosis
LSLSAGDRYTLWAPRWRDAGDEWEA

SEQ ID NO: 1487048 - protein, 21 aa, Mycobacterium tuberculosis
LSPAACRRIAIAAHDGLARTI

SEQ ID NO: 1487049 - protein, 24 aa, Mycobacterium tuberculosis
LSPANIAFALGYPMDIGSYVAFLS

SEQ ID NO: 1487050 - protein, 26 aa, Mycobacterium tuberculosis
LSPAPTCCRTCGAWQTGFPRRSKSCW

SEQ ID NO: 1487051 - protein, 18 aa, Mycobacterium tuberculosis
LSPEIMGLGPIEASKKAL

SEQ ID NO: 1487052 - protein, 17 aa, Mycobacterium tuberculosis
LSPERKSRRFAYPPNLY

SEQ ID NO: 1487053 - protein, 19 aa, Mycobacterium tuberculosis
LSPETMRRFRAGDLRPGPG

SEQ ID NO: 1487054 - protein, 19 aa, Mycobacterium tuberculosis
LSPREARAMDPRQRLALEL

SEQ ID NO: 1487055 - protein, 25 aa, Mycobacterium tuberculosis
LSPSLRRPQPLFSLVNFFDAQVGPL

SEQ ID NO: 1487056 - protein, 19 aa, Mycobacterium tuberculosis
LSPYLALHGICRWGGSDSC

SEQ ID NO: 1487057 - protein, 21 aa, Mycobacterium tuberculosis
LSQRDIVLWAAHVVDRVAAGG

SEQ ID NO: 1487058 - protein, 26 aa, Mycobacterium tuberculosis
LSRLAAQGWVCLSIDYRVAPHHRWPR

SEQ ID NO: 1487059 - protein, 23 aa, Mycobacterium tuberculosis
LSRLAEDIIVWSSTEFGYVTLHD

SEQ ID NO: 1487060 - protein, 19 aa, Mycobacterium tuberculosis
LSRLPMIPGTSLKGKVRTL

SEQ ID NO: 1487061 - protein, 27 aa, Mycobacterium tuberculosis
LSRQDWTPSYCRHRRNLQLIGLNDAEK

SEQ ID NO: 1487062 - protein, 19 aa, Mycobacterium tuberculosis
LSRRIPGSHGHRAVKAKLA

SEQ ID NO: 1487063 - protein, 17 aa, Mycobacterium tuberculosis
LSRRLAHWTRLYPEVRV

SEQ ID NO: 1487064 - protein, 18 aa, Mycobacterium tuberculosis
LSRSGGWPMSASPAPGSG

SEQ ID NO: 1487065 - protein, 24 aa, Mycobacterium tuberculosis
LSSGPFFKAYVVNLLPGQFVQPFI

SEQ ID NO: 1487066 - protein, 18 aa, Mycobacterium tuberculosis
LSSLVGHGRARAMLLSAE

SEQ ID NO: 1487067 - protein, 19 aa, Mycobacterium tuberculosis
LSSLVGHGRARAMLLSAEK

SEQ ID NO: 1487068 - protein, 19 aa, Mycobacterium tuberculosis
LSSPATWATAPSGAATSRA

SEQ ID NO: 1487069 - protein, 22 aa, Mycobacterium tuberculosis
LSSPYSHWAFQHVEDFMPTTVI

SEQ ID NO: 1487070 - protein, 17 aa, Mycobacterium tuberculosis
LSTGIALAFPRGPFVPA

SEQ ID NO: 1487071 - protein, 17 aa, Mycobacterium tuberculosis
LSTLGIVPVEVYRQRRA

SEQ ID NO: 1487072 - protein, 21 aa, Mycobacterium tuberculosis
LSTLRLIPWLPGTALVIADLV

SEQ ID NO: 1487073 - protein, 19 aa, Mycobacterium tuberculosis
LSTLTWRVVTNATKLPGLR

SEQ ID NO: 1487074 - protein, 17 aa, Mycobacterium tuberculosis
LSTRLEVEIKRDGYEWS

SEQ ID NO: 1487075 - protein, 21 aa, Mycobacterium tuberculosis
LSTTDVGAWVPHPGGPKIINA

SEQ ID NO: 1487076 - protein, 25 aa, Mycobacterium tuberculosis
LSVAAGMPFPLFVKAVAGGGGRGMR

SEQ ID NO: 1487077 - protein, 26 aa, Mycobacterium tuberculosis
LSVAAGMPFPLFVKAVAGGGGRGMRR

SEQ ID NO: 1487078 - protein, 17 aa, Mycobacterium tuberculosis
LSVCAGRYHGCTRSPGT

SEQ ID NO: 1487079 - protein, 19 aa, Mycobacterium tuberculosis
LSVEVNGGIGPIVVPDITI

SEQ ID NO: 1487080 - protein, 17 aa, Mycobacterium tuberculosis
LSVPAGWSTAAPAMTSG

SEQ ID NO: 1487081 - protein, 18 aa, Mycobacterium tuberculosis
LSVPAGWSTAAPAMTSGT

SEQ ID NO: 1487082 - protein, 21 aa, Mycobacterium tuberculosis
LSVPHSWNLPPAVRQVAAMFP

SEQ ID NO: 1487083 - protein, 17 aa, Mycobacterium tuberculosis
LSVPTRRGNWWYYARTF

SEQ ID NO: 1487084 - protein, 17 aa, Mycobacterium tuberculosis
LSVQLSGWMLMEAAHSA

SEQ ID NO: 1487085 - protein, 19 aa, Mycobacterium tuberculosis
LSVQLSGWMLMEAAHSAAA

SEQ ID NO: 1487086 - protein, 18 aa, Mycobacterium tuberculosis
LSVVDVLLGSQVVNILWA

SEQ ID NO: 1487087 - protein, 21 aa, Mycobacterium tuberculosis
LSVVKHLAHQVAVMLAGTVVE

SEQ ID NO: 1487088 - protein, 19 aa, Mycobacterium tuberculosis
LSYFLDLRGPSVAVDTACS

SEQ ID NO: 1487089 - protein, 25 aa, Mycobacterium tuberculosis
LSYYLASAFGEVWMQPSGSVGLVGF

SEQ ID NO: 1487090 - protein, 17 aa, Mycobacterium tuberculosis
LTAAARWYTATEIANAA

SEQ ID NO: 1487091 - protein, 32 aa, Mycobacterium tuberculosis; identical to SEQ ID NO: 1382521

SEQ ID NO: 1487092 - protein, 19 aa, Mycobacterium tuberculosis
LTAELALALGAAAARRLSR

SEQ ID NO: 1487093 - protein, 31 aa, Mycobacterium tuberculosis
LTAGRWGPPNPGCWKGLGGADAMVKKKKKEK

SEQ ID NO: 1487094 - protein, 17 aa, Mycobacterium tuberculosis
LTAIRLAAMAPDLVGEL

SEQ ID NO: 1487095 - protein, 24 aa, Mycobacterium tuberculosis
LTALLERMAPLGPRSRALVTEGSA

SEQ ID NO: 1487096 - protein, 20 aa, Mycobacterium tuberculosis
LTAMVAKVGVFRPITRLSAE

SEQ ID NO: 1487097 - protein, 23 aa, Mycobacterium tuberculosis
LTAMVAKVGVFRPITRLSAERDY

SEQ ID NO: 1487098 - protein, 30 aa, Mycobacterium tuberculosis
LTANAYLGAWGIVDCFERGADVVVTGRVTD

SEQ ID NO: 1487099 - protein, 23 aa, Mycobacterium tuberculosis
LTAPVLPLRCSMPRRPQYGQRLT

SEQ ID NO: 1487100 - protein, 24 aa, Mycobacterium tuberculosis
LTARLRAAGIPILGKTNMDEFAMG

SEQ ID NO: 1487101 - protein, 18 aa, Mycobacterium tuberculosis
LTARSPLVGGEFVDLTDA

SEQ ID NO: 1487102 - protein, 27 aa, Mycobacterium tuberculosis
LTATLLTARCPVLFAPAMHTEMWLHPA

SEQ ID NO: 1487103 - protein, 18 aa, Mycobacterium tuberculosis
LTCVFVDHGLLRAGERAQ

SEQ ID NO: 1487104 - protein, 18 aa, Mycobacterium tuberculosis
LTDRPVRHLPIVRGATVG

SEQ ID NO: 1487105 - protein, 17 aa, Mycobacterium tuberculosis
LTDWRVTRGRLHEELLA

SEQ ID NO: 1487106 - protein, 18 aa, Mycobacterium tuberculosis
LTEAFLWEEHRRVTKTAT

SEQ ID NO: 1487107 - protein, 18 aa, Mycobacterium tuberculosis
LTEAMGLVEIRPELRAVT

SEQ ID NO: 1487108 - protein, 24 aa, Mycobacterium tuberculosis
LTEGLPRLRALTGELAAGVRLGMS

SEQ ID NO: 1487109 - protein, 19 aa, Mycobacterium tuberculosis
LTELAGRLGEMCSLAGIAM

SEQ ID NO: 1487110 - protein, 20 aa, Mycobacterium tuberculosis
LTELVCSNAAIVLGHSGTEI

SEQ ID NO: 1487111 - protein, 17 aa, Mycobacterium tuberculosis
LTEPRPWHVPGRPRRAG

SEQ ID NO: 1487112 - protein, 20 aa, Mycobacterium tuberculosis
LTERKQVLVVIGRSDEAGAK

SEQ ID NO: 1487113 - protein, 24 aa, Mycobacterium tuberculosis
LTESGLRPGWHRVPGVSASGSDSA

SEQ ID NO: 1487114 - protein, 18 aa, Mycobacterium tuberculosis
LTGAIAEYLADVTIHVSL

SEQ ID NO: 1487115 - protein, 18 aa, Mycobacterium tuberculosis
LTGAPWVGAASLSMEAAA

SEQ ID NO: 1487116 - protein, 21 aa, Mycobacterium tuberculosis
LTGCAEMFRIGYIDVNQFTCQ

SEQ ID NO: 1487117 - protein, 20 aa, Mycobacterium tuberculosis
LTGCAKLFRVGYIDVNQFTL

SEQ ID NO: 1487118 - protein, 17 aa, Mycobacterium tuberculosis
LTGDGLSGFSSLNSGAG

SEQ ID NO: 1487119 - protein, 18 aa, Mycobacterium tuberculosis
LTGDIARRPIADAVIFGT

SEQ ID NO: 1487120 - protein, 17 aa, Mycobacterium tuberculosis
LTGGPRGGCACHRCNQR

SEQ ID NO: 1487121 - protein, 17 aa, Mycobacterium tuberculosis
LTGGVAWEGLNNLGAAT

SEQ ID NO: 1487122 - protein, 21 aa, Mycobacterium tuberculosis
LTGLPECPRPVTATAGPELEP

SEQ ID NO: 1487123 - protein, 45 aa, Mycobacterium tuberculosis; identical to SEQ ID NO: 1382527

SEQ ID NO: 1487124 - protein, 25 aa, Mycobacterium tuberculosis
LTGPMPPACGFNWMAATTRTCSSEW

SEQ ID NO: 1487125 - protein, 18 aa, Mycobacterium tuberculosis
LTGPPWVGAASLSMVAAA

SEQ ID NO: 1487126 - protein, 23 aa, Mycobacterium tuberculosis
LTGPRWRLGARDLAALWRRALTL

SEQ ID NO: 1487127 - protein, 17 aa, Mycobacterium tuberculosis
LTGQAWQGPASAAMAAA

SEQ ID NO: 1487128 - protein, 19 aa, Mycobacterium tuberculosis
LTGQAWVTMDFLGFGLSDK

SEQ ID NO: 1487129 - protein, 20 aa, Mycobacterium tuberculosis
LTGQGGWPMTCFLTPNGRPF

SEQ ID NO: 1487130 - protein, 17 aa, Mycobacterium tuberculosis
LTGRLSPSVQGWLADHS

SEQ ID NO: 1487131 - protein, 17 aa, Mycobacterium tuberculosis
LTGRPLIGNGANGVAGT

SEQ ID NO: 1487132 - protein, 18 aa, Mycobacterium tuberculosis
LTGRRWFDEHGISFTRHY

SEQ ID NO: 1487133 - protein, 23 aa, Mycobacterium tuberculosis
LTGSGLLGFGGLNSGTGNIGLFN

SEQ ID NO: 1487134 - protein, 18 aa, Mycobacterium tuberculosis
LTGVPWVGAASLSMVAAA

SEQ ID NO: 1487135 - protein, 18 aa, Mycobacterium tuberculosis
LTGYRIAVTSARRAEELC

SEQ ID NO: 1487136 - protein, 24 aa, Mycobacterium tuberculosis
LTHLHGDVLITSWVTNFAADPAPL

SEQ ID NO: 1487137 - protein, 32 aa, Mycobacterium tuberculosis
LTIGNWQQPPGPGRRWAAQAAPGGTGGYIESL

SEQ ID NO: 1487138 - protein, 19 aa, Mycobacterium tuberculosis
LTINNVLLRDIRIQAVQTS

SEQ ID NO: 1487139 - protein, 17 aa, Mycobacterium tuberculosis
LTLAALMCYEAHIAGLG

SEQ ID NO: 1487140 - protein, 17 aa, Mycobacterium tuberculosis
LTLKGFKSFAAPTTLRF

SEQ ID NO: 1487141 - protein, 17 aa, Mycobacterium tuberculosis
LTLPPTLIFDYPTAAEL

SEQ ID NO: 1487142 - protein, 35 aa, Mycobacterium tuberculosis
LTLPRFPMPALRPPWFATPKFSVRLPVLSRNRPAR

SEQ ID NO: 1487143 - protein, 17 aa, Mycobacterium tuberculosis
LTLRGALVRDPRAWSGY

SEQ ID NO: 1487144 - protein, 17 aa, Mycobacterium tuberculosis
LTLVPALRDALAQVGRP

SEQ ID NO: 1487145 - protein, 22 aa, Mycobacterium tuberculosis
LTMGIGGGYVTSWVGDPGAVTE

SEQ ID NO: 1487146 - protein, 23 aa, Mycobacterium tuberculosis
LTMPRPNFPVVNFLDAGAAPLSV

SEQ ID NO: 1487147 - protein, 27 aa, Mycobacterium tuberculosis
LTMTGPRPGGFGALDGRTNEICAQGDL

SEQ ID NO: 1487148 - protein, 17 aa, Mycobacterium tuberculosis
LTNAVAFLSAAVVSGGT

SEQ ID NO: 1487149 - protein, 18 aa, Mycobacterium tuberculosis
LTNWHGLVTSEMVPAAVS

SEQ ID NO: 1487150 - protein, 19 aa, Mycobacterium tuberculosis
LTPDVRNGIDFKIADLSLA

SEQ ID NO: 1487151 - protein, 21 aa, Mycobacterium tuberculosis
LTPGYLTMGGFIPAQDEHGWY

SEQ ID NO: 1487152 - protein, 21 aa, Mycobacterium tuberculosis
LTPIAVNGWQQAWVVPAGNPG

SEQ ID NO: 1487153 - protein, 27 aa, Mycobacterium tuberculosis
LTPLEFDLLVALARKPRQVFTRDVLLE

SEQ ID NO: 1487154 - protein, 21 aa, Mycobacterium tuberculosis
LTPPRAVAIITQIASALDAAH

SEQ ID NO: 1487155 - protein, 22 aa, Mycobacterium tuberculosis
LTPPRAVAIITQIASALDAAHA

SEQ ID NO: 1487156 - protein, 17 aa, Mycobacterium tuberculosis
LTPPVPSIPGRRSKPTI

SEQ ID NO: 1487157 - protein, 20 aa, Mycobacterium tuberculosis
LTPYRGAWCGNDVWRGALPP

SEQ ID NO: 1487158 - protein, 23 aa, Mycobacterium tuberculosis
LTQCCYTMRTIFDVKPDSDVFWC

SEQ ID NO: 1487159 - protein, 17 aa, Mycobacterium tuberculosis
LTQELRFATTMTGGVSL

SEQ ID NO: 1487160 - protein, 17 aa, Mycobacterium tuberculosis
LTRAAAFIHHLPVDQVF

SEQ ID NO: 1487161 - protein, 20 aa, Mycobacterium tuberculosis
LTREVPWLKAGQIHIRAGSL

SEQ ID NO: 1487162 - protein, 17 aa, Mycobacterium tuberculosis
LTRGQLIDRVWGADYVG

SEQ ID NO: 1487163 - protein, 18 aa, Mycobacterium tuberculosis
LTRGQLIDRVWGADYVGD

SEQ ID NO: 1487164 - protein, 21 aa, Mycobacterium tuberculosis
LTRNLPRLIRPVATVLGPLLF

SEQ ID NO: 1487165 - protein, 23 aa, Mycobacterium tuberculosis
LTRSGGHCWFLGGVADSVEELVD

SEQ ID NO: 1487166 - protein, 26 aa, Mycobacterium tuberculosis
LTRTLKGWADRGVRVIGLDAGGAPRS

SEQ ID NO: 1487167 - protein, 25 aa, Mycobacterium tuberculosis
LTSIALPRIRDFRGLSPKQFDGVGN

SEQ ID NO: 1487168 - protein, 18 aa, Mycobacterium tuberculosis
LTSLRGLRHTLKKLSGLR

SEQ ID NO: 1487169 - protein, 18 aa, Mycobacterium tuberculosis
LTSPELATLMAHVKLGLK

SEQ ID NO: 1487170 - protein, 19 aa, Mycobacterium tuberculosis
LTSRIRRAIRRCYIALPNM

SEQ ID NO: 1487171 - protein, 18 aa, Mycobacterium tuberculosis
LTSVFRATRAALRYFRDA

SEQ ID NO: 1487172 - protein, 18 aa, Mycobacterium tuberculosis
LTSVLSHRSAEMALHRAN

SEQ ID NO: 1487173 - protein, 35 aa, Mycobacterium tuberculosis
LTTCERCSGRLRKLFNAVGVVFKGTGFYRTDSRES

SEQ ID NO: 1487174 - protein, 22 aa, Mycobacterium tuberculosis
LTTEQWLGPASMSMVVAAQPYL

SEQ ID NO: 1487175 - protein, 25 aa, Mycobacterium tuberculosis
LTTLFPPVRPRQWLEIRYLDSVPDE

SEQ ID NO: 1487176 - protein, 17 aa, Mycobacterium tuberculosis
LTTLVLRGQGGFGGARG

SEQ ID NO: 1487177 - protein, 25 aa, Mycobacterium tuberculosis
LTTSGFRPATFAAIFDGIVESVEHA

SEQ ID NO: 1487178 - protein, 19 aa, Mycobacterium tuberculosis
LTVAPWMGPSSITMAAAVA

SEQ ID NO: 1487179 - protein, 24 aa, Mycobacterium tuberculosis
LTVGAAVGRCPGLGVRLHVVQQRL

SEQ ID NO: 1487180 - protein, 19 aa, Mycobacterium tuberculosis
LTVLLRRDLGLLVTIGVPG

SEQ ID NO: 1487181 - protein, 18 aa, Mycobacterium tuberculosis
LTVSAGIGMFRRQVPHLR

SEQ ID NO: 1487182 - protein, 17 aa, Mycobacterium tuberculosis
LTVSLGYNHIWAMVPFP

SEQ ID NO: 1487183 - protein, 20 aa, Mycobacterium tuberculosis
LTVSSDWPFMVSKDSAADYA

SEQ ID NO: 1487184 - protein, 17 aa, Mycobacterium tuberculosis
LTYEIFGPPGTVADISY

SEQ ID NO: 1487185 - protein, 25 aa, Mycobacterium tuberculosis
LVAANRNAFVQLVLSNLFGQNAPAI

SEQ ID NO: 1487186 - protein, 17 aa, Mycobacterium tuberculosis
LVADGMAAVYDFSDNEV

SEQ ID NO: 1487187 - protein, 17 aa, Mycobacterium tuberculosis
LVAEILRIISGGRLIWD

SEQ ID NO: 1487188 - protein, 22 aa, Mycobacterium tuberculosis
LVALAQLRWHRVIPRTAHAYAE

SEQ ID NO: 1487189 - protein, 26 aa, Mycobacterium tuberculosis
LVALGELFAYRWSRCGGREEWVMDTM

SEQ ID NO: 1487190 - protein, 28 aa, Mycobacterium tuberculosis
LVALPNGRYGWRISLPAMGVLLERTGPR

SEQ ID NO: 1487191 - protein, 17 aa, Mycobacterium tuberculosis
LVAQRRGYKCVFVCPDK

SEQ ID NO: 1487192 - protein, 17 aa, Mycobacterium tuberculosis
LVAVRMVSEGVDVPRLS

SEQ ID NO: 1487193 - protein, 17 aa, Mycobacterium tuberculosis
LVCKFASRNARRFTLTV

SEQ ID NO: 1487194 - protein, 18 aa, Mycobacterium tuberculosis
LVEQRVGGGLSVGQRGGR

SEQ ID NO: 1487195 - protein, 19 aa, Mycobacterium tuberculosis
LVFPVKRLADLGFRVLATE

SEQ ID NO: 1487196 - protein, 27 aa, Mycobacterium tuberculosis
LVGAAGTEKNFKWIARSADGWITTPRD

SEQ ID NO: 1487197 - protein, 18 aa, Mycobacterium tuberculosis
LVGASRKRFLGALLAGPD

SEQ ID NO: 1487198 - protein, 19 aa, Mycobacterium tuberculosis
LVGASRKRFLGALLAGPDG

SEQ ID NO: 1487199 - protein, 17 aa, Mycobacterium tuberculosis
LVGAVWVGCLGRRNTGV

SEQ ID NO: 1487200 - protein, 22 aa, Mycobacterium tuberculosis
LVGGECSYWACVPSKALLRPVI

SEQ ID NO: 1487201 - protein, 20 aa, Mycobacterium tuberculosis
LVGMCLFLLSDSASWITGQI

SEQ ID NO: 1487202 - protein, 25 aa, Mycobacterium tuberculosis
LVGSCAPGWSAAVFDWSGVELESGS

SEQ ID NO: 1487203 - protein, 21 aa, Mycobacterium tuberculosis
LVHGLPLYHVHGLVLGLCSGR

SEQ ID NO: 1487204 - protein, 17 aa, Mycobacterium tuberculosis
LVHRPGGVVSRGDLLRV

SEQ ID NO: 1487205 - protein, 19 aa, Mycobacterium tuberculosis
LVHVHRSWLQIPGDHRRYL

SEQ ID NO: 1487206 - protein, 17 aa, Mycobacterium tuberculosis
LVIHEGWRSELPDQLGE

SEQ ID NO: 1487207 - protein, 17 aa, Mycobacterium tuberculosis
LVIKGGYMDGHPLTVAE

SEQ ID NO: 1487208 - protein, 26 aa, Mycobacterium tuberculosis
LVISGRRFGSTGALRRNTRRDAVIGD

SEQ ID NO: 1487209 - protein, 22 aa, Mycobacterium tuberculosis
LVKRGWMVRSVFDTIDGIDQLG

SEQ ID NO: 1487210 - protein, 25 aa, Mycobacterium tuberculosis
LVLGCGPGRADGVCAGIAFRNPQSL

SEQ ID NO: 1487211 - protein, 22 aa, Mycobacterium tuberculosis
LVLGDWKQFLIGDRVGSMVELV

SEQ ID NO: 1487212 - protein, 24 aa, Mycobacterium tuberculosis
LVLPPEVNSALMFAGAGSGPTLAA

SEQ ID NO: 1487213 - protein, 22 aa, Mycobacterium tuberculosis
LVLRHLAAKRIRVMEQFTVQAA

SEQ ID NO: 1487214 - protein, 24 aa, Mycobacterium tuberculosis
LVLRRGSGVSPGWNGLAEPSHHVL

SEQ ID NO: 1487215 - protein, 19 aa, Mycobacterium tuberculosis
LVLVAARGVERWLSQRLSL

SEQ ID NO: 1487216 - protein, 29 aa, Mycobacterium tuberculosis
LVLVAARGVERWLSQRLSLVLGCGPGRAD

SEQ ID NO: 1487217 - protein, 17 aa, Mycobacterium tuberculosis
LVMGPEVGHVFRVVYAQ

SEQ ID NO: 1487218 - protein, 21 aa, Mycobacterium tuberculosis
LVMKRCRPRAERLISRPWGGK

SEQ ID NO: 1487219 - protein, 20 aa, Mycobacterium tuberculosis
LVNLLVNRGPTVPILLDTGS

SEQ ID NO: 1487220 - protein, 19 aa, Mycobacterium tuberculosis
LVNLPNWLSLTFRIDGGAW

SEQ ID NO: 1487221 - protein, 17 aa, Mycobacterium tuberculosis
LVNRACLDIQRGRAGVV

SEQ ID NO: 1487222 - protein, 35 aa, Mycobacterium tuberculosis; identical to SEQ ID NO: 211347

SEQ ID NO: 1487223 - protein, 21 aa, Mycobacterium tuberculosis
LVPQHLMRRLFFTAATVDAVT

SEQ ID NO: 1487224 - protein, 25 aa, Mycobacterium tuberculosis
LVQLEHWGCPWSRKPDGRVAVRPFG

SEQ ID NO: 1487225 - protein, 22 aa, Mycobacterium tuberculosis
LVQRCGLSVAALWAGNAGGPAH

SEQ ID NO: 1487226 - protein, 18 aa, Mycobacterium tuberculosis
LVRAVGVDFFVRMASGEL

SEQ ID NO: 1487227 - protein, 30 aa, Mycobacterium tuberculosis
LVRAVPLVGGLWFRFLHSVKAGIKDSLSPQ

SEQ ID NO: 1487228 - protein, 23 aa, Mycobacterium tuberculosis
LVRDVRRIGFCGAGLVHGSGGFG

SEQ ID NO: 1487229 - protein, 17 aa, Mycobacterium tuberculosis
LVREGLRNVAAGANPLG

SEQ ID NO: 1487230 - protein, 17 aa, Mycobacterium tuberculosis
LVRELRADRGPVLLITA

SEQ ID NO: 1487231 - protein, 30 aa, Mycobacterium tuberculosis
LVREWLTQWSRPGLIPVALVVVNVFVENVL

SEQ ID NO: 1487232 - protein, 20 aa, Mycobacterium tuberculosis
LVRGRFVLVGVTPAVLASLL

SEQ ID NO: 1487233 - protein, 21 aa, Mycobacterium tuberculosis
LVRGRFVLVGVTPAVLASLLG

SEQ ID NO: 1487234 - protein, 21 aa, Mycobacterium tuberculosis
LVRHVEKWAKVRGDKLAYRFL

SEQ ID NO: 1487235 - protein, 18 aa, Mycobacterium tuberculosis
LVSAEGWHSLSIAYAETA

SEQ ID NO: 1487236 - protein, 23 aa, Mycobacterium tuberculosis
LVSGLRLRLPVIATALGTYDTAS

SEQ ID NO: 1487237 - protein, 22 aa, Mycobacterium tuberculosis
LVSGPKWTACRFEAGTVRIPSQ

SEQ ID NO: 1487238 - protein, 17 aa, Mycobacterium tuberculosis
LVSKPGWGAARTGTRRH

SEQ ID NO: 1487239 - protein, 26 aa, Mycobacterium tuberculosis
LVSSWQMPGGIYAPMMHPWSTGKDVY

SEQ ID NO: 1487240 - protein, 17 aa, Mycobacterium tuberculosis
LVTALFGAPGQPGDTGQ

SEQ ID NO: 1487241 - protein, 18 aa, Mycobacterium tuberculosis
LVTAPLRGPGFAQLRRLA

SEQ ID NO: 1487242 - protein, 26 aa, Mycobacterium tuberculosis
LVTPAFASGLMRDGMGTMTLNLGLAN

SEQ ID NO: 1487243 - protein, 18 aa, Mycobacterium tuberculosis
LVTPELVAAAAADLAGIG

SEQ ID NO: 1487244 - protein, 18 aa, Mycobacterium tuberculosis
LVTRRSWSASSWTPSPTD

SEQ ID NO: 1487245 - protein, 17 aa, Mycobacterium tuberculosis
LVVDHFLTAVVRNDGDL

SEQ ID NO: 1487246 - protein, 18 aa, Mycobacterium tuberculosis
LVVDHFLTAVVRNDGDLV

SEQ ID NO: 1487247 - protein, 18 aa, Mycobacterium tuberculosis
LVVFPALFAAIITSAGGV

SEQ ID NO: 1487248 - protein, 24 aa, Mycobacterium tuberculosis
LVVRRGRVYAARLAPVAAGLTLPS

SEQ ID NO: 1487249 - protein, 19 aa, Mycobacterium tuberculosis
LVWSHLALRCSRARDGCHP

SEQ ID NO: 1487250 - protein, 24 aa, Mycobacterium tuberculosis
LVYRADSLVNWCPGLGTVLANEEV

SEQ ID NO: 1487251 - protein, 21 aa, Mycobacterium tuberculosis
LWCRHPWPEVHGAGRERSGLA

SEQ ID NO: 1487252 - protein, 22 aa, Mycobacterium tuberculosis
LWERVVEAFAPAHVVEFFATTD

SEQ ID NO: 1487253 - protein, 20 aa, Mycobacterium tuberculosis
LWGEPGYRLGLDHGDDGTAC

SEQ ID NO: 1487254 - protein, 21 aa, Mycobacterium tuberculosis
LWIDRAEIWTRFASGDNPINR

SEQ ID NO: 1487255 - protein, 19 aa, Mycobacterium tuberculosis
LWLDLTYAGSRPVVLTGAM

SEQ ID NO: 1487256 - protein, 18 aa, Mycobacterium tuberculosis
LWLLRGGDPGQPGLLPPA

SEQ ID NO: 1487257 - protein, 18 aa, Mycobacterium tuberculosis
LWLNESFATFASVLCQSE

SEQ ID NO: 1487258 - protein, 18 aa, Mycobacterium tuberculosis
LWQARLAPDAKPYQGGHR

SEQ ID NO: 1487259 - protein, 19 aa, Mycobacterium tuberculosis
LYAIWHCWQDGAAYHPANH

SEQ ID NO: 1487260 - protein, 24 aa, Mycobacterium tuberculosis
LYCLPLNWLRRKHGLSSLAGICAA

SEQ ID NO: 1487261 - protein, 18 aa, Mycobacterium tuberculosis
LYDELCWAPKHTDFEEGL

SEQ ID NO: 1487262 - protein, 18 aa, Mycobacterium tuberculosis
LYGAWSANPFPFLRQIIA

SEQ ID NO: 1487263 - protein, 24 aa, Mycobacterium tuberculosis
LYGNGGKWRRRWAQPGRRRGRQRR

SEQ ID NO: 1487264 - protein, 18 aa, Mycobacterium tuberculosis
LYGRLLRRAIDPDPRQRF

SEQ ID NO: 1487265 - protein, 19 aa, Mycobacterium tuberculosis
LYHLSRPAEALAWMCDRAV

SEQ ID NO: 1487266 - protein, 26 aa, Mycobacterium tuberculosis
LYKLLRSEWLEPRWMVGIDPESDGLA

SEQ ID NO: 1487267 - protein, 18 aa, Mycobacterium tuberculosis
LYLRHLIDGGGLEHVDGR

SEQ ID NO: 1487268 - protein, 18 aa, Mycobacterium tuberculosis
LYPVRLTTTMTRFISAAV

SEQ ID NO: 1487269 - protein, 21 aa, Mycobacterium tuberculosis
LYRLYELRLRQGLPASKSDLP

SEQ ID NO: 1487270 - protein, 24 aa, Mycobacterium tuberculosis
LYRRRRPRLRGGLADRPLLTIFGQ

SEQ ID NO: 1487271 - protein, 18 aa, Mycobacterium tuberculosis
LYSALCVEALRMGGQQLL

SEQ ID NO: 1487272 - protein, 23 aa, Mycobacterium tuberculosis
LYSVPWRLIGQRLHARTAGDVVQ

SEQ ID NO: 1487273 - protein, 17 aa, Mycobacterium tuberculosis
LYTNFEKLCDIFARYDV

SEQ ID NO: 1487274 - protein, 18 aa, Mycobacterium tuberculosis
LYVSRAIVRSSWGPADAQ

SEQ ID NO: 1487275 - protein, 17 aa, Mycobacterium tuberculosis
LYVSRAIVRSSWGQPML

SEQ ID NO: 1487276 - protein, 24 aa, Mycobacterium tuberculosis
LYYEAYPAMVHRTLMDIIEECERQ

SEQ ID NO: 1487277 - protein, 20 aa, Mycobacterium tuberculosis
MAAAASPYVAWMSVTAGQAE

SEQ ID NO: 1487278 - protein, 19 aa, Mycobacterium tuberculosis
MAAAATPYVGWLAATAALA

SEQ ID NO: 1487279 - protein, 18 aa, Mycobacterium tuberculosis
MAAARAAGATVFLVPAKN

SEQ ID NO: 1487280 - protein, 23 aa, Mycobacterium tuberculosis
MAAAVAPYLGWLAAAAAQAQRSA

SEQ ID NO: 1487281 - protein, 24 aa, Mycobacterium tuberculosis
MAAEARFARDWLSEDLARLPVGAA

SEQ ID NO: 1487282 - protein, 17 aa, Mycobacterium tuberculosis
MAAQLRRLRRHRPTRTP

SEQ ID NO: 1487283 - protein, 21 aa, Mycobacterium tuberculosis
MAASMGEFLLAAGTKGKRYAL

SEQ ID NO: 1487284 - protein, 18 aa, Mycobacterium tuberculosis
MAATDCALRAMLRPGDHV

SEQ ID NO: 1487285 - protein, 26 aa, Mycobacterium tuberculosis
MAATPKPSWPWVRTLLHSIYDQPDAE

SEQ ID NO: 1487286 - protein, 23 aa, Mycobacterium tuberculosis
MAAVQLARLWGLEVFATASRGKW

SEQ ID NO: 1487287 - protein, 23 aa, Mycobacterium tuberculosis
MADLTRRALLRWGAGAGAGAAGV

SEQ ID NO: 1487288 - protein, 20 aa, Mycobacterium tuberculosis
MAETVARRGGIVILPQDLPI

SEQ ID NO: 1487289 - protein, 25 aa, Mycobacterium tuberculosis
MAGARHCARLRGAIVGKSKSDVIDA

SEQ ID NO: 1487290 - protein, 17 aa, Mycobacterium tuberculosis
MAGCCSAPAGPAASADS

SEQ ID NO: 1487291 - protein, 20 aa, Mycobacterium tuberculosis
MAGLLRPPAAQRLVSALRSR

SEQ ID NO: 1487292 - protein, 18 aa, Mycobacterium tuberculosis
MAGYHFDASAAVAQLAPW

SEQ ID NO: 1487293 - protein, 22 aa, Mycobacterium tuberculosis
MAHPAWSRMRPLRSPGPRRGNR

SEQ ID NO: 1487294 - protein, 18 aa, Mycobacterium tuberculosis
MAIRREAEQFVGIELSAT

SEQ ID NO: 1487295 - protein, 19 aa, Mycobacterium tuberculosis
MALELTWEALEHARIPASS

SEQ ID NO: 1487296 - protein, 24 aa, Mycobacterium tuberculosis
MALIHKRAHGVAVVILESRPIGLV

SEQ ID NO: 1487297 - protein, 21 aa, Mycobacterium tuberculosis
MALLGRPLIGHGADGAPGTGQ

SEQ ID NO: 1487298 - protein, 18 aa, Mycobacterium tuberculosis
MALPNARVLIHQPSLSGV

SEQ ID NO: 1487299 - protein, 22 aa, Mycobacterium tuberculosis
MANALRPNAIVSLHADGGPASG

SEQ ID NO: 1487300 - protein, 23 aa, Mycobacterium tuberculosis
MANHTTGWVRMDFVVPSRGLIGW

SEQ ID NO: 1487301 - protein, 24 aa, Mycobacterium tuberculosis
MAPRQWRGLRRWLGEPEDFQDPKY

SEQ ID NO: 1487302 - protein, 19 aa, Mycobacterium tuberculosis
MAPSSLALKSFREPINLPM

SEQ ID NO: 1487303 - protein, 19 aa, Mycobacterium tuberculosis
MAQARVRAIFYTPRGPHGV

SEQ ID NO: 1487304 - protein, 17 aa, Mycobacterium tuberculosis
MARAVAPYLGWLISATA

SEQ ID NO: 1487305 - protein, 17 aa, Mycobacterium tuberculosis
MARDLMVALVPRGASPR

SEQ ID NO: 1487306 - protein, 23 aa, Mycobacterium tuberculosis
MASGELRTTMALTEPGGGSDLQN

SEQ ID NO: 1487307 - protein, 21 aa, Mycobacterium tuberculosis
MASLRGLLKFRTGVRPPVPLD

SEQ ID NO: 1487308 - protein, 17 aa, Mycobacterium tuberculosis
MASRIVDAIVTFLAGCS

SEQ ID NO: 1487309 - protein, 23 aa, Mycobacterium tuberculosis
MATCKRCGDAVPYIILPNLQTGE

SEQ ID NO: 1487310 - protein, 23 aa, Mycobacterium tuberculosis
MATGDLLGCFGLTEPDVGSDPAA

SEQ ID NO: 1487311 - protein, 21 aa, Mycobacterium tuberculosis
MATGMACRTRFFDQFFLDATH

SEQ ID NO: 1487312 - protein, 20 aa, Mycobacterium tuberculosis
MAVRRLRAAHRVALTGTPME

SEQ ID NO: 1487313 - protein, 22 aa, Mycobacterium tuberculosis
MCINCMLCYLACPVYALDPDFL

SEQ ID NO: 1487314 - protein, 23 aa, Mycobacterium tuberculosis
MCRAYDGLFTRGGKWAINPMFID

SEQ ID NO: 1487315 - protein, 24 aa, Mycobacterium tuberculosis
MCRMWRGWCRPVRIARRRPGEHEA

SEQ ID NO: 1487316 - protein, 24 aa, Mycobacterium tuberculosis
MDAATPRASWGIALGPVAILLGDL

SEQ ID NO: 1487317 - protein, 23 aa, Mycobacterium tuberculosis
MDCTCSLPCWPPASVRSEPGRCA

SEQ ID NO: 1487318 - protein, 24 aa, Mycobacterium tuberculosis
MDDARWDAVLAVNLLAPLRLTEGL

SEQ ID NO: 1487319 - protein, 26 aa, Mycobacterium tuberculosis
MDFVVPSRGLIGWRTDFLTETRGSGV

SEQ ID NO: 1487320 - protein, 17 aa, Mycobacterium tuberculosis
MDGCIGVSLLVDRQSGR

SEQ ID NO: 1487321 - protein, 29 aa, Mycobacterium tuberculosis
MDHNFALRKAELDAGYILTCQSHPTTPFV

SEQ ID NO: 1487322 - protein, 17 aa, Mycobacterium tuberculosis
MDIDTIYVWTHDSIGLG

SEQ ID NO: 1487323 - protein, 19 aa, Mycobacterium tuberculosis
MDLDWRAVVGEAQFVELPT

SEQ ID NO: 1487324 - protein, 19 aa, Mycobacterium tuberculosis
MDPQHRMLLEVAWEALEHA

SEQ ID NO: 1487325 - protein, 26 aa, Mycobacterium tuberculosis
MDPQQRLLLEVAWEALEHAGIPPGTL

SEQ ID NO: 1487326 - protein, 17 aa, Mycobacterium tuberculosis
MDPSGAGKWLLISDCAA

SEQ ID NO: 1487327 - protein, 20 aa, Mycobacterium tuberculosis
MDTFGKWVSPARLMVTQFKD

SEQ ID NO: 1487328 - protein, 20 aa, Mycobacterium tuberculosis
MEPYLGVAVHGFPNYFFITG

SEQ ID NO: 1487329 - protein, 17 aa, Mycobacterium tuberculosis
MFGGTPGRRGVGDRGEC

SEQ ID NO: 1487330 - protein, 20 aa, Mycobacterium tuberculosis
MFNQFCYLQLSGKRSRRGQP

SEQ ID NO: 1487331 - protein, 18 aa, Mycobacterium tuberculosis
MFSALGFDGLVRSARSRA

SEQ ID NO: 1487332 - protein, 21 aa, Mycobacterium tuberculosis
MGAQLCATAPVFAEHIHRCER

SEQ ID NO: 1487333 - protein, 18 aa, Mycobacterium tuberculosis
MGARATAFVVGFGAPAET

SEQ ID NO: 1487334 - protein, 18 aa, Mycobacterium tuberculosis
MGCPRRWSTTPATPQPSP

SEQ ID NO: 1487335 - protein, 17 aa, Mycobacterium tuberculosis
MGDSHVGLQARLMSQAL

SEQ ID NO: 1487336 - protein, 17 aa, Mycobacterium tuberculosis
MGFIYLMQNLPQERISI

SEQ ID NO: 1487337 - protein, 18 aa, Mycobacterium tuberculosis
MGGACGTCRAKLIEGNVE

SEQ ID NO: 1487338 - protein, 25 aa, Mycobacterium tuberculosis
MGGAGCASGGWLARRAADRRRRGWR

SEQ ID NO: 1487339 - protein, 20 aa, Mycobacterium tuberculosis
MGGNAVGLFGQGGAGGAGGS

SEQ ID NO: 1487340 - protein, 21 aa, Mycobacterium tuberculosis
MGGNGGLVFGNGGPGGLGGPG

SEQ ID NO: 1487341 - protein, 17 aa, Mycobacterium tuberculosis
MGIDKLRVIHTGMDPVV

SEQ ID NO: 1487342 - protein, 19 aa, Mycobacterium tuberculosis
MGINLAGLLNSGSGNIGIG

SEQ ID NO: 1487343 - protein, 21 aa, Mycobacterium tuberculosis
MGLTIPVLLIRGKLSDVVSSD

SEQ ID NO: 1487344 - protein, 20 aa, Mycobacterium tuberculosis
MGLVEIRPELRAVTVDGDLV

SEQ ID NO: 1487345 - protein, 17 aa, Mycobacterium tuberculosis
MGLVPAMTVKCAVALVK

SEQ ID NO: 1487346 - protein, 17 aa, Mycobacterium tuberculosis
MGMMPMPMGMGGAGAGM

SEQ ID NO: 1487347 - protein, 18 aa, Mycobacterium tuberculosis
MGMMPMPMGMGGAGAGMP

SEQ ID NO: 1487348 - protein, 20 aa, Mycobacterium tuberculosis
MGNRCARPGIAAGPTRMPAP

SEQ ID NO: 1487349 - protein, 17 aa, Mycobacterium tuberculosis
MGPEVGHVFRVVYAQEG

SEQ ID NO: 1487350 - protein, 24 aa, Mycobacterium tuberculosis
MGPLMRRSGMIFIRRNIGNGPLYK

SEQ ID NO: 1487351 - protein, 17 aa, Mycobacterium tuberculosis
MGQDWGGPISMAVAVER

SEQ ID NO: 1487352 - protein, 18 aa, Mycobacterium tuberculosis
MGREHIKEIQAFFKELSA

SEQ ID NO: 1487353 - protein, 20 aa, Mycobacterium tuberculosis
MGSDHIRPAMAINKEINLRF

SEQ ID NO: 1487354 - protein, 20 aa, Mycobacterium tuberculosis
MGSIETRYYVSMNVADKPGV

SEQ ID NO: 1487355 - protein, 20 aa, Mycobacterium tuberculosis
MGTPWLTAFAQRSRFAEAFH

SEQ ID NO: 1487356 - protein, 17 aa, Mycobacterium tuberculosis
MGVRVATSFSARVVQSV

SEQ ID NO: 1487357 - protein, 18 aa, Mycobacterium tuberculosis
MGWFDGNLGWLWPHPPEA

SEQ ID NO: 1487358 - protein, 28 aa, Mycobacterium tuberculosis
MHMAGARHCARLRGAIVGKSKSDVIDAE

SEQ ID NO: 1487359 - protein, 17 aa, Mycobacterium tuberculosis
MIDRMLFAEALETQKCL

SEQ ID NO: 1487360 - protein, 20 aa, Mycobacterium tuberculosis
MIEMLRGGPDYLMFLYKTKG

SEQ ID NO: 1487361 - protein, 22 aa, Mycobacterium tuberculosis
MIGVECAWRPSGVTAPTTPVSA

SEQ ID NO: 1487362 - protein, 18 aa, Mycobacterium tuberculosis
MIHLATLYHDDVMDEAQV

SEQ ID NO: 1487363 - protein, 24 aa, Mycobacterium tuberculosis
MIHPVAACATAAVSVEEGVDKIRL

SEQ ID NO: 1487364 - protein, 31 aa, Mycobacterium tuberculosis
MIHVVGFRDGKAFYRNRFIRTDGFLAENEAG

SEQ ID NO: 1487365 - protein, 17 aa, Mycobacterium tuberculosis
MIIVVMFFSCRKPDQRA

SEQ ID NO: 1487366 - protein, 20 aa, Mycobacterium tuberculosis
MILHEILPIDVSINLEDAVF

SEQ ID NO: 1487367 - protein, 26 aa, Mycobacterium tuberculosis
MILQHPCALRHGVDLHPRLLVAPVRP

SEQ ID NO: 1487368 - protein, 25 aa, Mycobacterium tuberculosis
MIPDPMRVLRVGGCVAAYAQHRDGE

SEQ ID NO: 1487369 - protein, 18 aa, Mycobacterium tuberculosis
MIPLIGVRAACAATGRAP

SEQ ID NO: 1487370 - protein, 21 aa, Mycobacterium tuberculosis
MIPSPTLPLLLPLKQIGVPDW

SEQ ID NO: 1487371 - protein, 24 aa, Mycobacterium tuberculosis
MITVLKGAVLFVTDLARAIPVPTQ

SEQ ID NO: 1487372 - protein, 24 aa, Mycobacterium tuberculosis
MIVDEPFLAPARIDLTALRAHAVA

SEQ ID NO: 1487373 - protein, 26 aa, Mycobacterium tuberculosis
MIVDEPFMLPAHIDFTALRAHAVAVP

SEQ ID NO: 1487374 - protein, 21 aa, Mycobacterium tuberculosis
MKDERFVGIVGGAGIESRSAF

SEQ ID NO: 1487375 - protein, 21 aa, Mycobacterium tuberculosis
MKILRPGRLTGELPPGAVRIG

SEQ ID NO: 1487376 - protein, 22 aa, Mycobacterium tuberculosis
MKRKPSSSPVLFYKKKKPKNQK

SEQ ID NO: 1487377 - protein, 18 aa, Mycobacterium tuberculosis
MKTDHGLSLPRRLQIEFS

SEQ ID NO: 1487378 - protein, 18 aa, Mycobacterium tuberculosis
MKYLRGCEHYFTDEMLDC

SEQ ID NO: 1487379 - protein, 21 aa, Mycobacterium tuberculosis
MLAELFRRRVLVPPEGACPGP

SEQ ID NO: 1487380 - protein, 18 aa, Mycobacterium tuberculosis
MLAFLQKRPPRWVQPATM

SEQ ID NO: 1487381 - protein, 17 aa, Mycobacterium tuberculosis
MLAKVRRAPALIKVESV

SEQ ID NO: 1487382 - protein, 19 aa, Mycobacterium tuberculosis
MLAQRVGAWVPLGEVPEVW

SEQ ID NO: 1487383 - protein, 20 aa, Mycobacterium tuberculosis
MLCLGARGWQPGWFTGAGFF

SEQ ID NO: 1487384 - protein, 17 aa, Mycobacterium tuberculosis
MLDRSRPLWQVDLIEGL

SEQ ID NO: 1487385 - protein, 26 aa, Mycobacterium tuberculosis
MLDYDCPRPALKKATAITPGLESPTI

SEQ ID NO: 1487386 - protein, 18 aa, Mycobacterium tuberculosis
MLEAAVIAGLTSEGVDPL

SEQ ID NO: 1487387 - protein, 18 aa, Mycobacterium tuberculosis
MLERAHLAYGEIMDLAVG

SEQ ID NO: 1487388 - protein, 21 aa, Mycobacterium tuberculosis
MLGRAGGLLVDVAIDTVPRGY

SEQ ID NO: 1487389 - protein, 20 aa, Mycobacterium tuberculosis
MLIAGGRRAVLCGNIKQCGA

SEQ ID NO: 1487390 - protein, 20 aa, Mycobacterium tuberculosis
MLILPYLDIRLDYYDLGIEH

SEQ ID NO: 1487391 - protein, 23 aa, Mycobacterium tuberculosis
MLKGFASGGGRPGRANRGAKRGP

SEQ ID NO: 1487392 - protein, 19 aa, Mycobacterium tuberculosis
MLLEVAWEALEHAGIPPDS

SEQ ID NO: 1487393 - protein, 27 aa, Mycobacterium tuberculosis
MLLSFERWAPDMGWEIATGKSVLAGEL

SEQ ID NO: 1487394 - protein, 25 aa, Mycobacterium tuberculosis
MLMASQRTVICWAMGLTQHAHAVAT

SEQ ID NO: 1487395 - protein, 17 aa, Mycobacterium tuberculosis
MLMDAAIFKDTLIMSYE

SEQ ID NO: 1487396 - protein, 17 aa, Mycobacterium tuberculosis
MLPTGEVVRRCYTDVLA

SEQ ID NO: 1487397 - protein, 19 aa, Mycobacterium tuberculosis
MLPTGEVVRRCYTDVLAAA

SEQ ID NO: 1487398 - protein, 24 aa, Mycobacterium tuberculosis
MLPTGEVVRRCYTDVLAAARPATL

SEQ ID NO: 1487399 - protein, 20 aa, Mycobacterium tuberculosis
MLQAAAAWDGLAAELGTAAS

SEQ ID NO: 1487400 - protein, 17 aa, Mycobacterium tuberculosis
MLRANAKLAASTGVPQE

SEQ ID NO: 1487401 - protein, 21 aa, Mycobacterium tuberculosis
MLREYLEAMRALWTQEEACYD

SEQ ID NO: 1487402 - protein, 18 aa, Mycobacterium tuberculosis
MLSALPIERAIAATETLD

SEQ ID NO: 1487403 - protein, 23 aa, Mycobacterium tuberculosis
MLTCAIRPSGIWGNGDQTMFRKL

SEQ ID NO: 1487404 - protein, 19 aa, Mycobacterium tuberculosis
MLVQHLLDRDLRVEIPGVD

SEQ ID NO: 1487405 - protein, 17 aa, Mycobacterium tuberculosis
MMINLFWLGLKGAPVDR

SEQ ID NO: 1487406 - protein, 28 aa, Mycobacterium tuberculosis
MMLDRLFPRSVFHSLKLAEHNLAELMHN

SEQ ID NO: 1487407 - protein, 17 aa, Mycobacterium tuberculosis
MMMPFLEHFVMRSRYVD

SEQ ID NO: 1487408 - protein, 20 aa, Mycobacterium tuberculosis
MMTLEMGKTLAAAKAEALKC

SEQ ID NO: 1487409 - protein, 17 aa, Mycobacterium tuberculosis
MNCRNGFQWSAHFDPRY

SEQ ID NO: 1487410 - protein, 21 aa, Mycobacterium tuberculosis
MNCRNGFQWSAHFDPRYGSAS

SEQ ID NO: 1487411 - protein, 18 aa, Mycobacterium tuberculosis
MNDPWPRPTQGPAKTIET

SEQ ID NO: 1487412 - protein, 19 aa, Mycobacterium tuberculosis
MNDPWPRPTQGPAKTIETD

SEQ ID NO: 1487413 - protein, 18 aa, Mycobacterium tuberculosis
MNGGFFPSVREYSVRYGL

SEQ ID NO: 1487414 - protein, 17 aa, Mycobacterium tuberculosis
MNKTYKLSPTFSNTNPH

SEQ ID NO: 1487415 - protein, 18 aa, Mycobacterium tuberculosis
MNLLSALINRADTTRDTD

SEQ ID NO: 1487416 - protein, 17 aa, Mycobacterium tuberculosis
MNLYATMAAAAARLTPF

SEQ ID NO: 1487417 - protein, 18 aa, Mycobacterium tuberculosis
MNNGVPWSVPRMNPTHLN

SEQ ID NO: 1487418 - protein, 23 aa, Mycobacterium tuberculosis
MNNRCPLTSYVLIGFSQGAVIAG

SEQ ID NO: 1487419 - protein, 19 aa, Mycobacterium tuberculosis
MNTTGSVVFTSCSGTVALV

SEQ ID NO: 1487420 - protein, 20 aa, Mycobacterium tuberculosis
MPAGMMGRGGANPHVVQARP

SEQ ID NO: 1487421 - protein, 17 aa, Mycobacterium tuberculosis
MPAPRTPCWWRRVPMHI

SEQ ID NO: 1487422 - protein, 20 aa, Mycobacterium tuberculosis
MPASVARYVVEKGSITVDGI

SEQ ID NO: 1487423 - protein, 24 aa, Mycobacterium tuberculosis
MPAYAKMVMNFGRFAMPQVGEPFY

SEQ ID NO: 1487424 - protein, 20 aa, Mycobacterium tuberculosis
MPFTESLAFGATRNPWCLNR

SEQ ID NO: 1487425 - protein, 25 aa, Mycobacterium tuberculosis
MPGAGGNGGNANWFGSGGAGGQGGT

SEQ ID NO: 1487426 - protein, 27 aa, Mycobacterium tuberculosis
MPGAGGNGGNANWFGSGGAGGQGGTGL

SEQ ID NO: 1487427 - protein, 17 aa, Mycobacterium tuberculosis
MPGRFSLRERERVRDLF

SEQ ID NO: 1487428 - protein, 19 aa, Mycobacterium tuberculosis
MPGTRVGRGAVVRNAILDK

SEQ ID NO: 1487429 - protein, 20 aa, Mycobacterium tuberculosis
MPHKIILQYLRPLHRRRTPP

SEQ ID NO: 1487430 - protein, 18 aa, Mycobacterium tuberculosis
MPHLSGPLAGVGVGGQAG

SEQ ID NO: 1487431 - protein, 21 aa, Mycobacterium tuberculosis
MPLDAGHSWRRNIALSADDVL

SEQ ID NO: 1487432 - protein, 19 aa, Mycobacterium tuberculosis
MPLQEVVRIAADEAGVPPP

SEQ ID NO: 1487433 - protein, 17 aa, Mycobacterium tuberculosis
MPMVPPGAMGARGEGSG

SEQ ID NO: 1487434 - protein, 25 aa, Mycobacterium tuberculosis
MPNGYPVKASVSFGLYYPPGSALYH

SEQ ID NO: 1487435 - protein, 26 aa, Mycobacterium tuberculosis
MPNGYPVKASVSFGLYYPPGSALYHD

SEQ ID NO: 1487436 - protein, 33 aa, Mycobacterium tuberculosis
MPPHAGHVYLCEFARRWVDELTIVVGSTAAEPI

SEQ ID NO: 1487437 - protein, 18 aa, Mycobacterium tuberculosis
MPPLDHRAPGPVLALLCD

SEQ ID NO: 1487438 - protein, 17 aa, Mycobacterium tuberculosis
MPPPIFVAASGPQSATL

SEQ ID NO: 1487439 - protein, 17 aa, Mycobacterium tuberculosis
MPRAMPATAAFPPPAGP

SEQ ID NO: 1487440 - protein, 28 aa, Mycobacterium tuberculosis
MPRHPIRLARFGPRAALPATAMARRFHT

SEQ ID NO: 1487441 - protein, 18 aa, Mycobacterium tuberculosis
MPRKPGGDLARLPSRVWS

SEQ ID NO: 1487442 - protein, 37 aa, Mycobacterium tuberculosis
MPRNPAATWPGCRRGCGAPSGRPGTCSTMSTPTSSSV

SEQ ID NO: 1487443 - protein, 17 aa, Mycobacterium tuberculosis
MPTPGWPTRAPSAPAPS

SEQ ID NO: 1487444 - protein, 19 aa, Mycobacterium tuberculosis
MPVDGDPVFRIGSTTKTFT

SEQ ID NO: 1487445 - protein, 21 aa, Mycobacterium tuberculosis
MPVPAVVKLHRWLTESLDHLH

SEQ ID NO: 1487446 - protein, 25 aa, Mycobacterium tuberculosis
MQFISETWRLYGVAARNDGIANVDN

SEQ ID NO: 1487447 - protein, 28 aa, Mycobacterium tuberculosis
MQGHWLLARLGKRVLRPGGVELTRTLLA

SEQ ID NO: 1487448 - protein, 33 aa, Mycobacterium tuberculosis
MQLALTELWCSYGVRPDLVIGHSMGEVAAAVVA

SEQ ID NO: 1487449 - protein, 17 aa, Mycobacterium tuberculosis
MQPRARGRITLVSSDPQ

SEQ ID NO: 1487450 - protein, 22 aa, Mycobacterium tuberculosis
MQPRARGRITLVSSDPQIPVRI

SEQ ID NO: 1487451 - protein, 24 aa, Mycobacterium tuberculosis
MQQRCGFQPGEVRVVLLDAQPIHR

SEQ ID NO: 1487452 - protein, 18 aa, Mycobacterium tuberculosis
MRAAAEWFGERGWTAVAT

SEQ ID NO: 1487453 - protein, 17 aa, Mycobacterium tuberculosis
MRANGWRGVPLAAHITH

SEQ ID NO: 1487454 - protein, 27 aa, Mycobacterium tuberculosis
MRCHPEVSWAAMFLRLAEPRAPQKPSR

SEQ ID NO: 1487455 - protein, 29 aa, Mycobacterium tuberculosis
MRDVPCPVCAGTRLKPEILAVTLAGESKG

SEQ ID NO: 1487456 - protein, 17 aa, Mycobacterium tuberculosis
MRGLKTLVLRMQRHSEN

SEQ ID NO: 1487457 - protein, 20 aa, Mycobacterium tuberculosis
MRGMCLYFDELPVIVLNGSD

SEQ ID NO: 1487458 - protein, 19 aa, Mycobacterium tuberculosis
MRGYLRLGARACGEPAHDP

SEQ ID NO: 1487459 - protein, 22 aa, Mycobacterium tuberculosis
MRHEKLLFKKGIHLLDCGTSGG

SEQ ID NO: 1487460 - protein, 22 aa, Mycobacterium tuberculosis
MRIDPFEMWTQGTNGLGITFYS

SEQ ID NO: 1487461 - protein, 22 aa, Mycobacterium tuberculosis
MRLAGNAHFTFRGCEGDALLML

SEQ ID NO: 1487462 - protein, 20 aa, Mycobacterium tuberculosis
MRLECPAGLDLRTPNPEAYE

SEQ ID NO: 1487463 - protein, 17 aa, Mycobacterium tuberculosis
MRNPVRFHQAIAHAGAD

SEQ ID NO: 1487464 - protein, 19 aa, Mycobacterium tuberculosis
MRPLPGPQAHPAGMAVTVG

SEQ ID NO: 1487465 - protein, 25 aa, Mycobacterium tuberculosis
MRQRWLSCPWAGWYATNSVASTGWI

SEQ ID NO: 1487466 - protein, 20 aa, Mycobacterium tuberculosis
MRRAGGLVFARKVRAEHRPG

SEQ ID NO: 1487467 - protein, 20 aa, Mycobacterium tuberculosis
MRRAREEAEQLVAQATAEVE

SEQ ID NO: 1487468 - protein, 25 aa, Mycobacterium tuberculosis
MRRHHLPVPPAFCITTEVGVRYLAA

SEQ ID NO: 1487469 - protein, 17 aa, Mycobacterium tuberculosis
MRRHPAFLGRQRPAERS

SEQ ID NO: 1487470 - protein, 26 aa, Mycobacterium tuberculosis
MRRTNACDRRRFGLSLTIHEDACRII

SEQ ID NO: 1487471 - protein, 17 aa, Mycobacterium tuberculosis
MRSRYVDNPGLFKAASP

SEQ ID NO: 1487472 - protein, 18 aa, Mycobacterium tuberculosis
MRVPLEGGGRLVVELTPD

SEQ ID NO: 1487473 - protein, 17 aa, Mycobacterium tuberculosis
MRYRSGGPFADAVAAVR

SEQ ID NO: 1487474 - protein, 19 aa, Mycobacterium tuberculosis
MRYTCERLVRGLDTIAATG

SEQ ID NO: 1487475 - protein, 19 aa, Mycobacterium tuberculosis
MSAKSDWAALPFDERAAVF

SEQ ID NO: 1487476 - protein, 26 aa, Mycobacterium tuberculosis
MSAQAAAFHARFVQALAGAMGAYAAA

SEQ ID NO: 1487477 - protein, 19 aa, Mycobacterium tuberculosis
MSASPGARQRLYVSRAIVR

SEQ ID NO: 1487478 - protein, 18 aa, Mycobacterium tuberculosis
MSDEEWDAVIAVHLRGHF

SEQ ID NO: 1487479 - protein, 27 aa, Mycobacterium tuberculosis
MSDELRSLLRFVLDLLADYGLTDFYLE

SEQ ID NO: 1487480 - protein, 18 aa, Mycobacterium tuberculosis
MSEVHLARDLRLHRDVAV

SEQ ID NO: 1487481 - protein, 31 aa, Mycobacterium tuberculosis
MSGNFSNGILWRGNFEGLFGLNVGITIPEFP

SEQ ID NO: 1487482 - protein, 26 aa, Mycobacterium tuberculosis
MSIDERARAGLFLAMQYPVEVPGVSM

SEQ ID NO: 1487483 - protein, 25 aa, Mycobacterium tuberculosis
MSLHQPYLMGCLSPRNELSQISYGQ

SEQ ID NO: 1487484 - protein, 28 aa, Mycobacterium tuberculosis
MSNGCRLRWPTPRCCSRILRWCARRSAR

SEQ ID NO: 1487485 - protein, 17 aa, Mycobacterium tuberculosis
MSNLLVTPELVAAAAAD

SEQ ID NO: 1487486 - protein, 34 aa, Mycobacterium tuberculosis
MSPAERWHLLASAWLDLPGRPALIGTRGPDAKPY

SEQ ID NO: 1487487 - protein, 23 aa, Mycobacterium tuberculosis
MSSETIILTARWQQDGRSIQQKL

SEQ ID NO: 1487488 - protein, 19 aa, Mycobacterium tuberculosis
MSVPPSWAAATPAIRTVAA

SEQ ID NO: 1487489 - protein, 25 aa, Mycobacterium tuberculosis
MSVPPTWQGSIPISMASSAMSGLGV

SEQ ID NO: 1487490 - protein, 17 aa, Mycobacterium tuberculosis
MSVSIAGAVCTAAARAV

SEQ ID NO: 1487491 - protein, 33 aa, Mycobacterium tuberculosis
MSVTISGLRRDYRWAEADRHLWIADERGTWHLR

SEQ ID NO: 1487492 - protein, 24 aa, Mycobacterium tuberculosis
MTAHLRPGQLVLIHGGASGIGSHT

SEQ ID NO: 1487493 - protein, 24 aa, Mycobacterium tuberculosis
MTAHLRPGQLVLIHGGASGIGTHA

SEQ ID NO: 1487494 - protein, 18 aa, Mycobacterium tuberculosis
MTEILTSMCARLYGKRAA

SEQ ID NO: 1487495 - protein, 23 aa, Mycobacterium tuberculosis
MTEPDAFKWIQRAAMDRRTTMKR

SEQ ID NO: 1487496 - protein, 25 aa, Mycobacterium tuberculosis
MTEPDAFKWIQRAAMDRRTTMKRVA

SEQ ID NO: 1487497 - protein, 25 aa, Mycobacterium tuberculosis
MTKSLRAGKVFVDWSQNSGSKTTIA

SEQ ID NO: 1487498 - protein, 26 aa, Mycobacterium tuberculosis
MTRVIWKLIKDMLILPYLDIRLDYYD

SEQ ID NO: 1487499 - protein, 17 aa, Mycobacterium tuberculosis
MTSAGGLLEQAAAVEEA

SEQ ID NO: 1487500 - protein, 17 aa, Mycobacterium tuberculosis
MTVFVAKGLQFPIVYLP

SEQ ID NO: 1487501 - protein, 18 aa, Mycobacterium tuberculosis
MTVFVAKGLQFPIVYLPF

SEQ ID NO: 1487502 - protein, 18 aa, Mycobacterium tuberculosis
MTWRSMIRDGLTMRHGKE

SEQ ID NO: 1487503 - protein, 25 aa, Mycobacterium tuberculosis
MTYVRDSFWKGREFDSLAQMQQAAV

SEQ ID NO: 1487504 - protein, 21 aa, Mycobacterium tuberculosis
MVAAAQPYLAWLTYTAEAAAH

SEQ ID NO: 1487505 - protein, 20 aa, Mycobacterium tuberculosis
MVAAASAWNGLAAELSSAAT

SEQ ID NO: 1487506 - protein, 20 aa, Mycobacterium tuberculosis
MVDAAASYIGWLSTSAAHAE

SEQ ID NO: 1487507 - protein, 22 aa, Mycobacterium tuberculosis
MVEAVAPYVAWMRATAIQAEQA

SEQ ID NO: 1487508 - protein, 20 aa, Mycobacterium tuberculosis
MVGYTPSLSTAVWVGTVKGD

SEQ ID NO: 1487509 - protein, 21 aa, Mycobacterium tuberculosis
MVGYTPSLSTAVWVGTVKGDE

SEQ ID NO: 1487510 - protein, 19 aa, Mycobacterium tuberculosis
MVPPGAMGARGEGSGQEKP

SEQ ID NO: 1487511 - protein, 22 aa, Mycobacterium tuberculosis
MVSLAELWRSVGVVPDAVIGHS

SEQ ID NO: 1487512 - protein, 19 aa, Mycobacterium tuberculosis
MVSRLFAEQWTRAAEEAAL

SEQ ID NO: 1487513 - protein, 20 aa, Mycobacterium tuberculosis
MVTKDIGYHLTRIASSDRST

SEQ ID NO: 1487514 - protein, 18 aa, Mycobacterium tuberculosis
MVVHVIRGDGLAGGVRAA

SEQ ID NO: 1487515 - protein, 20 aa, Mycobacterium tuberculosis
MWAADVAAMVGYHSGASAAA

SEQ ID NO: 1487516 - protein, 25 aa, Mycobacterium tuberculosis
MWCPCRRKPTVCWVGGDPPRRPSTW

SEQ ID NO: 1487517 - protein, 27 aa, Mycobacterium tuberculosis
MWGRPRIRLTGAIAEYLADVTIHVSLT

SEQ ID NO: 1487518 - protein, 18 aa, Mycobacterium tuberculosis
MWPTVRDKVRLRSRTTEV

SEQ ID NO: 1487519 - protein, 17 aa, Mycobacterium tuberculosis
MYLGAGSAPMLQAAAAW

SEQ ID NO: 1487520 - protein, 17 aa, Mycobacterium tuberculosis
MYLGAGSGPMLAAAAAW

SEQ ID NO: 1487521 - protein, 19 aa, Mycobacterium tuberculosis
MYVGLLLILRRPRAGLSYE

SEQ ID NO: 1487522 - protein, 26 aa, Mycobacterium tuberculosis
NAAAGRAPRWGCWPRAPDEVSAAVAD

SEQ ID NO: 1487523 - protein, 24 aa, Mycobacterium tuberculosis
NAAGLPSLMVLTGVNSAWDAVYAE

SEQ ID NO: 1487524 - protein, 21 aa, Mycobacterium tuberculosis
NAAGPYASWLTAAGAQAELAA

SEQ ID NO: 1487525 - protein, 20 aa, Mycobacterium tuberculosis
NAAISALVLPSAFRPIPDPN

SEQ ID NO: 1487526 - protein, 17 aa, Mycobacterium tuberculosis
NACYLAFDCFHPHWDPR

SEQ ID NO: 1487527 - protein, 18 aa, Mycobacterium tuberculosis
NADAWRPVFAGLAGLGLF

SEQ ID NO: 1487528 - protein, 29 aa, Mycobacterium tuberculosis
NADLARPWLAEAVGLARAVGDKWRLAEVL

SEQ ID NO: 1487529 - protein, 25 aa, Mycobacterium tuberculosis
NAEELASWLSGLRGSRVVLRVPRRG

SEQ ID NO: 1487530 - protein, 24 aa, Mycobacterium tuberculosis
NAERMRHGMYWSGDLAYRDSEGWI

SEQ ID NO: 1487531 - protein, 19 aa, Mycobacterium tuberculosis
NAFGEMFARQGHLGATPAT

SEQ ID NO: 1487532 - protein, 17 aa, Mycobacterium tuberculosis
NAGFFNMGIGNAGNEDM

SEQ ID NO: 1487533 - protein, 28 aa, Mycobacterium tuberculosis
NAGLTAGAGAWAMWGWVTPAAAAGGWPT

SEQ ID NO: 1487534 - protein, 27 aa, Mycobacterium tuberculosis
NAGMFGDGGNGGFSFFDGNGGDGGTGG

SEQ ID NO: 1487535 - protein, 17 aa, Mycobacterium tuberculosis
NAGMLFGAAGVGGVGGF

SEQ ID NO: 1487536 - protein, 19 aa, Mycobacterium tuberculosis
NAGSGSWGLANVGVGNIGL

SEQ ID NO: 1487537 - protein, 19 aa, Mycobacterium tuberculosis
NAGVALSVGSTGGLGGNGG

SEQ ID NO: 1487538 - protein, 18 aa, Mycobacterium tuberculosis
NAGWKGERYHRIGANYVP

SEQ ID NO: 1487539 - protein, 19 aa, Mycobacterium tuberculosis
NAGWKGERYHRIGANYVPT

SEQ ID NO: 1487540 - protein, 23 aa, Mycobacterium tuberculosis
NAGWLGFGGAGGIGGIGGNANGG

SEQ ID NO: 1487541 - protein, 27 aa, Mycobacterium tuberculosis
NAITLFPGGLTFPATSLLNLDVTAGAG

SEQ ID NO: 1487542 - protein, 29 aa, Mycobacterium tuberculosis
NAKDCIQVLGGIGCTWGARRAFVSAPEPH

SEQ ID NO: 1487543 - protein, 20 aa, Mycobacterium tuberculosis
NAKGIAWRLLLLELSGPSRL

SEQ ID NO: 1487544 - protein, 17 aa, Mycobacterium tuberculosis
NALAEVFAEVGLPRGCC

SEQ ID NO: 1487545 - protein, 17 aa, Mycobacterium tuberculosis
NALGLFLGLGGSGGQGG

SEQ ID NO: 1487546 - protein, 22 aa, Mycobacterium tuberculosis
NALPRRAISALVRRPKRRPLDE

SEQ ID NO: 1487547 - protein, 17 aa, Mycobacterium tuberculosis
NALRCGYVKGVAVRADW

SEQ ID NO: 1487548 - protein, 18 aa, Mycobacterium tuberculosis
NALYMSGSVPGVIAQALV

SEQ ID NO: 1487549 - protein, 23 aa, Mycobacterium tuberculosis
NAMPPLDHRAPGPVLALLCDPRV

SEQ ID NO: 1487550 - protein, 17 aa, Mycobacterium tuberculosis
NAPAIAAAEAMYEQMWA

SEQ ID NO: 1487551 - protein, 22 aa, Mycobacterium tuberculosis
NAPGCRGCCQCAIGCPSNAKFG

SEQ ID NO: 1487552 - protein, 17 aa, Mycobacterium tuberculosis
NAPLVSFDETFKLVKVN

SEQ ID NO: 1487553 - protein, 28 aa, Mycobacterium tuberculosis
NAPTQALFGRPLIGNGADGSPGTGQAGG

SEQ ID NO: 1487554 - protein, 21 aa, Mycobacterium tuberculosis
NARLTWLTWVLADSTPRFMHG

SEQ ID NO: 1487555 - protein, 18 aa, Mycobacterium tuberculosis
NARLVLRRETVDDLLSLE

SEQ ID NO: 1487556 - protein, 23 aa, Mycobacterium tuberculosis
NARVRWDLPAAVVERRIRAVTPN

SEQ ID NO: 1487557 - protein, 20 aa, Mycobacterium tuberculosis
NASNARRIWAHAGVDDRVVC

SEQ ID NO: 1487558 - protein, 18 aa, Mycobacterium tuberculosis
NASRGMGGDGGTGGAGGN

SEQ ID NO: 1487559 - protein, 25 aa, Mycobacterium tuberculosis
NASRIPATHIRRWRHRRWWWERRHR

SEQ ID NO: 1487560 - protein, 22 aa, Mycobacterium tuberculosis
NATLHGLAGWVDVKPAVVSTAI

SEQ ID NO: 1487561 - protein, 29 aa, Mycobacterium tuberculosis
NATPELMPLPIALAHRLSRRLTEVRKNGV

SEQ ID NO: 1487562 - protein, 22 aa, Mycobacterium tuberculosis
NATPREVLPASAAMDAPLDAAA

SEQ ID NO: 1487563 - protein, 25 aa, Mycobacterium tuberculosis
NAVAPRCQRAAMAATAAILASAALA

SEQ ID NO: 1487564 - protein, 17 aa, Mycobacterium tuberculosis
NCGTCRYCCTGRQNLCD

SEQ ID NO: 1487565 - protein, 24 aa, Mycobacterium tuberculosis
NCNSPSKLLVEWIEGRRLPGPRGP

SEQ ID NO: 1487566 - protein, 21 aa, Mycobacterium tuberculosis
NCVTARLAGRLSSDPKPREGT

SEQ ID NO: 1487567 - protein, 22 aa, Mycobacterium tuberculosis
NDAAPPWLTRLCDERTVVAVLQ

SEQ ID NO: 1487568 - protein, 25 aa, Mycobacterium tuberculosis
NDAEGGASGDVWGECGDVDLRNGEC

SEQ ID NO: 1487569 - protein, 22 aa, Mycobacterium tuberculosis
NDARFLIYPAMKALTLDIASMV

SEQ ID NO: 1487570 - protein, 22 aa, Mycobacterium tuberculosis
NDARFLVYPAMKALTLDIASMV

SEQ ID NO: 1487571 - protein, 18 aa, Mycobacterium tuberculosis
NDEFATFAPGMKTIDDAL

SEQ ID NO: 1487572 - protein, 18 aa, Mycobacterium tuberculosis
NDPVAVPWVLSARSAQAL

SEQ ID NO: 1487573 - protein, 25 aa, Mycobacterium tuberculosis
NDQVAALFRMWLRDAVGRVATGVLD

SEQ ID NO: 1487574 - protein, 27 aa, Mycobacterium tuberculosis
NDQVALFLRHLWSAGGSVRWDPTNGQG

SEQ ID NO: 1487575 - protein, 17 aa, Mycobacterium tuberculosis
NDRRRLGFVEAQGGGTI

SEQ ID NO: 1487576 - protein, 18 aa, Mycobacterium tuberculosis
NEADKHLKRHSGTLNHHM

SEQ ID NO: 1487577 - protein, 21 aa, Mycobacterium tuberculosis
NEAFASVVLSWARVHEPDMDR

SEQ ID NO: 1487578 - protein, 24 aa, Mycobacterium tuberculosis
NEALDCFVYALAALRISISRWQLD

SEQ ID NO: 1487579 - protein, 24 aa, Mycobacterium tuberculosis
NEARRLRWAAPYLAVPRVLGVGVD

SEQ ID NO: 1487580 - protein, 19 aa, Mycobacterium tuberculosis
NECHRLCVDYAKTRTLWGR

SEQ ID NO: 1487581 - protein, 21 aa, Mycobacterium tuberculosis
NEGLRSRFTRNIDFPSYTSHE

SEQ ID NO: 1487582 - protein, 19 aa, Mycobacterium tuberculosis
NEIFGPILPVVTVKSLDDA

SEQ ID NO: 1487583 - protein, 17 aa, Mycobacterium tuberculosis
NEIPKAAGCSRATLYRY

SEQ ID NO: 1487584 - protein, 18 aa, Mycobacterium tuberculosis
NEIQIVVTILSLDPGDLY

SEQ ID NO: 1487585 - protein, 27 aa, Mycobacterium tuberculosis
NELDPAGARLCVRPMSEFQSNEAYREL

SEQ ID NO: 1487586 - protein, 27 aa, Mycobacterium tuberculosis
NEPCFNLVPRWARSPFWPDQSVHRHLN

SEQ ID NO: 1487587 - protein, 22 aa, Mycobacterium tuberculosis
NEPLCACGRLTVGTHVHHRVRI

SEQ ID NO: 1487588 - protein, 24 aa, Mycobacterium tuberculosis
NEPMIPIYIFYSMFGFQRTGDSFW

SEQ ID NO: 1487589 - protein, 25 aa, Mycobacterium tuberculosis
NEQMVIDVHNVMTFGGNMITVTEAS

SEQ ID NO: 1487590 - protein, 23 aa, Mycobacterium tuberculosis
NEVEINIACSLGMLTAEQVDQLA

SEQ ID NO: 1487591 - protein, 20 aa, Mycobacterium tuberculosis
NEVYRLPKHLDEKVARIHVE

SEQ ID NO: 1487592 - protein, 20 aa, Mycobacterium tuberculosis
NFAAPRYGFKPTVIAQPPAG

SEQ ID NO: 1487593 - protein, 21 aa, Mycobacterium tuberculosis
NFGGGASGFWNLASATSGLSG

SEQ ID NO: 1487594 - protein, 24 aa, Mycobacterium tuberculosis
NFGSGNGRAGLPGSGNVGNGNLGN

SEQ ID NO: 1487595 - protein, 25 aa, Mycobacterium tuberculosis
NFGSGNGRAGLPGSGNVGNGNLGNS

SEQ ID NO: 1487596 - protein, 17 aa, Mycobacterium tuberculosis
NFISDLNAVAGITFVHT

SEQ ID NO: 1487597 - protein, 22 aa, Mycobacterium tuberculosis
NFRDVLVALGMYPGGGELGVDG

SEQ ID NO: 1487598 - protein, 20 aa, Mycobacterium tuberculosis
NFRDVVAALGMYPGQAPPLG

SEQ ID NO: 1487599 - protein, 18 aa, Mycobacterium tuberculosis
NFTDGWLRTGDLGSLSAA

SEQ ID NO: 1487600 - protein, 17 aa, Mycobacterium tuberculosis
NFTQTRTLAGMKGLVTN

SEQ ID NO: 1487601 - protein, 17 aa, Mycobacterium tuberculosis
NFYLCDLQIKWNGFQAG

SEQ ID NO: 1487602 - protein, 20 aa, Mycobacterium tuberculosis
NGAPGGFGGGAGAGGLGGSG

SEQ ID NO: 1487603 - protein, 18 aa, Mycobacterium tuberculosis
NGDWRRSAIKQVASARFG

SEQ ID NO: 1487604 - protein, 19 aa, Mycobacterium tuberculosis
NGDWRRSAIKQVASARFGV

SEQ ID NO: 1487605 - protein, 24 aa, Mycobacterium tuberculosis
NGELPAVRVGRSFRVHAKAVHDML

SEQ ID NO: 1487606 - protein, 20 aa, Mycobacterium tuberculosis
NGERYQFLRWGQGAFDDFKV

SEQ ID NO: 1487607 - protein, 21 aa, Mycobacterium tuberculosis
NGESMAAVARELHYADVSALY

SEQ ID NO: 1487608 - protein, 18 aa, Mycobacterium tuberculosis
NGGAAVLIGNGGGGGAGG

SEQ ID NO: 1487609 - protein, 21 aa, Mycobacterium tuberculosis
NGGAGGLLFGTAGAGGNGGLS

SEQ ID NO: 1487610 - protein, 19 aa, Mycobacterium tuberculosis
NGGAGGNGGWLYGSGGNQG

SEQ ID NO: 1487611 - protein, 21 aa, Mycobacterium tuberculosis
NGGAGGTAWLFGVGGAVEPEA

SEQ ID NO: 1487612 - protein, 24 aa, Mycobacterium tuberculosis
NGGAGGTGGWLFGNGGAGGNSGGG

SEQ ID NO: 1487613 - protein, 20 aa, Mycobacterium tuberculosis
NGGAGGWIYGHGGHGGAGGN

SEQ ID NO: 1487614 - protein, 26 aa, Mycobacterium tuberculosis
NGGDPGLGARLFQVGSRGGDGGVGGW

SEQ ID NO: 1487615 - protein, 27 aa, Mycobacterium tuberculosis
NGGDPGLGARLFQVGSRGGDGGVGGWL

SEQ ID NO: 1487616 - protein, 39 aa, Mycobacterium tuberculosis
NGGDPGLGARLFQVGSRGGDGGVGGWLYGDGGGGGDDGN

SEQ ID NO: 1487617 - protein, 25 aa, Mycobacterium tuberculosis
NGGGAGLFYGFGGAGGNGGMGGVAP

SEQ ID NO: 1487618 - protein, 24 aa, Mycobacterium tuberculosis
NGGHGGSAAKLFGDGGAGGAGGMG

SEQ ID NO: 1487619 - protein, 25 aa, Mycobacterium tuberculosis
NGGHGGSAAKLFGDGGAGGAGGMGS

SEQ ID NO: 1487620 - protein, 28 aa, Mycobacterium tuberculosis
NGGIGGKGGDAFATFAKAGNGGAGGNGG

SEQ ID NO: 1487621 - protein, 18 aa, Mycobacterium tuberculosis
NGGIGITVGGAGGAGGNG

SEQ ID NO: 1487622 - protein, 23 aa, Mycobacterium tuberculosis
NGGKAGFSPGPTNFGLNGAGGGG

SEQ ID NO: 1487623 - protein, 27 aa, Mycobacterium tuberculosis
NGGKAGFSPGPTNFGLNGAGGGGGVGG

SEQ ID NO: 1487624 - protein, 27 aa, Mycobacterium tuberculosis
NGGLGGAGRDGGAPGGDGGDGGTGGSG

SEQ ID NO: 1487625 - protein, 18 aa, Mycobacterium tuberculosis
NGGMGGNAVGLFGQGGAG

SEQ ID NO: 1487626 - protein, 21 aa, Mycobacterium tuberculosis
NGGNAGQVFGDGGTGGTGGAG

SEQ ID NO: 1487627 - protein, 19 aa, Mycobacterium tuberculosis
NGGNAVVIGNGGNGGAGGF

SEQ ID NO: 1487628 - protein, 23 aa, Mycobacterium tuberculosis
NGGNGAQGGWLIGNGGQGGDSGA

SEQ ID NO: 1487629 - protein, 30 aa, Mycobacterium tuberculosis
NGGNGGAGGIGWAAINILANAGAGGAGGAA

SEQ ID NO: 1487630 - protein, 21 aa, Mycobacterium tuberculosis
NGGNGGSAAWLFGGGGAGAAD

SEQ ID NO: 1487631 - protein, 19 aa, Mycobacterium tuberculosis
NGGNGGWLYGDGGSGGSTL

SEQ ID NO: 1487632 - protein, 25 aa, Mycobacterium tuberculosis
NGGNGLNLVGVPGTAGGGADGANGS

SEQ ID NO: 1487633 - protein, 22 aa, Mycobacterium tuberculosis
NGGNGRAPGALGGKGGSGGLIG

SEQ ID NO: 1487634 - protein, 35 aa, Mycobacterium tuberculosis
NGGPGTPGSPMVAPPPPTPITQVQQGGDGGAGGTG

SEQ ID NO: 1487635 - protein, 17 aa, Mycobacterium tuberculosis
NGGRLYGTAGSWVSGSG

SEQ ID NO: 1487636 - protein, 23 aa, Mycobacterium tuberculosis
NGGSAARLFGGGGAGGAGGTGST

SEQ ID NO: 1487637 - protein, 22 aa, Mycobacterium tuberculosis
NGGSAGLWGNGGAGGAGGSGGA

SEQ ID NO: 1487638 - protein, 20 aa, Mycobacterium tuberculosis
NGGSGGNGFDSFASGGTGGA

SEQ ID NO: 1487639 - protein, 17 aa, Mycobacterium tuberculosis
NGGTGGNGLLFGAGGTG

SEQ ID NO: 1487640 - protein, 22 aa, Mycobacterium tuberculosis
NGGTGGNGLLFGAGGTGGAGTL

SEQ ID NO: 1487641 - protein, 21 aa, Mycobacterium tuberculosis
NGGTGGQLWGSGGAGGEGGAA

SEQ ID NO: 1487642 - protein, 22 aa, Mycobacterium tuberculosis
NGGTGGQLWGSGGAGGEGGAAL

SEQ ID NO: 1487643 - protein, 26 aa, Mycobacterium tuberculosis
NGGVGGRGGDGVFAGAGGQGGLGGQG

SEQ ID NO: 1487644 - protein, 21 aa, Mycobacterium tuberculosis
NGGVGGRGGNGGFSSAGTSGG

SEQ ID NO: 1487645 - protein, 19 aa, Mycobacterium tuberculosis
NGHTAEYFTRMMAGLGEAL

SEQ ID NO: 1487646 - protein, 17 aa, Mycobacterium tuberculosis
NGKCLRASTGSIFAIPV

SEQ ID NO: 1487647 - protein, 17 aa, Mycobacterium tuberculosis
NGKPRLMCMTRMSTFDE

SEQ ID NO: 1487648 - protein, 19 aa, Mycobacterium tuberculosis
NGLAQGGAHRGCADPAIAI

SEQ ID NO: 1487649 - protein, 18 aa, Mycobacterium tuberculosis
NGLATAYLFRCLSCGVHL

SEQ ID NO: 1487650 - protein, 27 aa, Mycobacterium tuberculosis
NGLDFMGCCAVAVLAHEAERCRRRGVD

SEQ ID NO: 1487651 - protein, 29 aa, Mycobacterium tuberculosis
NGLDFMGCCAVAVLAHKAERCRRRGVDVR

SEQ ID NO: 1487652 - protein, 27 aa, Mycobacterium tuberculosis
NGLDFMGCCTVAVLAHEAERCRRRGVD

SEQ ID NO: 1487653 - protein, 19 aa, Mycobacterium tuberculosis
NGNIGFGLTGNNQVGIGGL

SEQ ID NO: 1487654 - protein, 24 aa, Mycobacterium tuberculosis
NGPDPKTRWALRVDVDGDLVLLAK

SEQ ID NO: 1487655 - protein, 17 aa, Mycobacterium tuberculosis
NGPTQLLLGRPLIGDGA

SEQ ID NO: 1487656 - protein, 18 aa, Mycobacterium tuberculosis
NGPTQLLLGRPLIGDGAN

SEQ ID NO: 1487657 - protein, 25 aa, Mycobacterium tuberculosis
NGPTQLLLGRPLIGDGANGGPGQNG

SEQ ID NO: 1487658 - protein, 25 aa, Mycobacterium tuberculosis
NGPWPGRAFPSDAGGFCGPRQTCCG

SEQ ID NO: 1487659 - protein, 17 aa, Mycobacterium tuberculosis
NGQPCRPPHCVASVSPA

SEQ ID NO: 1487660 - protein, 17 aa, Mycobacterium tuberculosis
NGQTVFRVRLPMIEQQI

SEQ ID NO: 1487661 - protein, 18 aa, Mycobacterium tuberculosis
NGQTVFRVRLPMIEQQIA

SEQ ID NO: 1487662 - protein, 23 aa, Mycobacterium tuberculosis
NGRIRKGQQVAWIRQVDGQQTVT

SEQ ID NO: 1487663 - protein, 25 aa, Mycobacterium tuberculosis
NGSPSWSAAPNFAFELAVRKTTDAD

SEQ ID NO: 1487664 - protein, 19 aa, Mycobacterium tuberculosis
NGTMRRLHNAVALGLINID

SEQ ID NO: 1487665 - protein, 19 aa, Mycobacterium tuberculosis
NHAMMLVQHLLDRDLRVEI

SEQ ID NO: 1487666 - protein, 22 aa, Mycobacterium tuberculosis
NHEVGHAIGYLRHEPCDQQGGL

SEQ ID NO: 1487667 - protein, 37 aa, Mycobacterium tuberculosis
NHGHRNRVRCHLHISRSPSAVPGRGGPLPVSPCGVLG

SEQ ID NO: 1487668 - protein, 28 aa, Mycobacterium tuberculosis
NHPRAGCSGSPPSAPWRSQTPRLATMRA

SEQ ID NO: 1487669 - protein, 22 aa, Mycobacterium tuberculosis
NHTMMFQEMVNRVGADVPGLPR

SEQ ID NO: 1487670 - protein, 24 aa, Mycobacterium tuberculosis
NHWHLPLRWMTPTPRRQRRRSGRP

SEQ ID NO: 1487671 - protein, 20 aa, Mycobacterium tuberculosis
NHYPIGWAMAFNTPYKLFKR

SEQ ID NO: 1487672 - protein, 23 aa, Mycobacterium tuberculosis
NICYTGCRFCAFAQRKGDADAYS

SEQ ID NO: 1487673 - protein, 19 aa, Mycobacterium tuberculosis
NIEKPRIPDVCDALGVPWL

SEQ ID NO: 1487674 - protein, 19 aa, Mycobacterium tuberculosis
NIETGVVWWPECSKEAYAD

SEQ ID NO: 1487675 - protein, 21 aa, Mycobacterium tuberculosis
NIGNPAPFGFEAPDVIMRDII

SEQ ID NO: 1487676 - protein, 23 aa, Mycobacterium tuberculosis
NIHQIPLGFQVPGSIDAITLFPG

SEQ ID NO: 1487677 - protein, 24 aa, Mycobacterium tuberculosis
NIINSAVNTAAWYVNAAIPTAIFL

SEQ ID NO: 1487678 - protein, 17 aa, Mycobacterium tuberculosis
NIKRPERQVSYEPSVSS

SEQ ID NO: 1487679 - protein, 18 aa, Mycobacterium tuberculosis
NILGGTIFREPIVISNVP

SEQ ID NO: 1487680 - protein, 17 aa, Mycobacterium tuberculosis
NILWAHRAAVKHPVTCP

SEQ ID NO: 1487681 - protein, 18 aa, Mycobacterium tuberculosis
NIPCPVNTLPVPGLTIAD

SEQ ID NO: 1487682 - protein, 18 aa, Mycobacterium tuberculosis
NIVATVVKRGYRLAVDSR

SEQ ID NO: 1487683 - protein, 23 aa, Mycobacterium tuberculosis
NIWSGTAKFLFTRTTVGEIGILP

SEQ ID NO: 1487684 - protein, 17 aa, Mycobacterium tuberculosis
NIYRTGEHIGWRLWMGI

SEQ ID NO: 1487685 - protein, 28 aa, Mycobacterium tuberculosis
NKALADFAHRGWIRLAGKSVLISDSERL

SEQ ID NO: 1487686 - protein, 20 aa, Mycobacterium tuberculosis
NKGFAAYHWERTVGGADYLA

SEQ ID NO: 1487687 - protein, 34 aa, Mycobacterium tuberculosis
NKGLEVIETHLLFGIPYDRIDVVVHPQSIIHSMV

SEQ ID NO: 1487688 - protein, 18 aa, Mycobacterium tuberculosis
NKIGALSVPPSWVKTTAL

SEQ ID NO: 1487689 - protein, 20 aa, Mycobacterium tuberculosis
NKLFEERIIFLGVQVDDASA

SEQ ID NO: 1487690 - protein, 20 aa, Mycobacterium tuberculosis
NKNIGFGLTGDNLVGIGALN

SEQ ID NO: 1487691 - protein, 23 aa, Mycobacterium tuberculosis
NKPSMPYRLRVIVHEDENGRMTG

SEQ ID NO: 1487692 - protein, 30 aa, Mycobacterium tuberculosis
NLAPAAWWRQLSWLPQRPVLVPGTVRHNLV

SEQ ID NO: 1487693 - protein, 19 aa, Mycobacterium tuberculosis
NLGGGNWGFANLGSGNIGN

SEQ ID NO: 1487694 - protein, 31 aa, Mycobacterium tuberculosis
NLGWAGGSELGFRLAFAEGYSHAMTLNNDTR

SEQ ID NO: 1487695 - protein, 18 aa, Mycobacterium tuberculosis
NLHFCRLPDQLAEIDTEL

SEQ ID NO: 1487696 - protein, 20 aa, Mycobacterium tuberculosis
NLLLSPAVFRGFDQVGALSP

SEQ ID NO: 1487697 - protein, 20 aa, Mycobacterium tuberculosis
NLLLSPAVFRGFDQVGALSS

SEQ ID NO: 1487698 - protein, 18 aa, Mycobacterium tuberculosis
NLLSIAKLSDWVRENVSA

SEQ ID NO: 1487699 - protein, 18 aa, Mycobacterium tuberculosis
NLMLFAGRAHPELAEQVA

SEQ ID NO: 1487700 - protein, 31 aa, Mycobacterium tuberculosis
NLNFFPMGAWAKRTGAIFIRRQTKDIPVYRF

SEQ ID NO: 1487701 - protein, 19 aa, Mycobacterium tuberculosis
NLPLRTAMARRRYVETTNV

SEQ ID NO: 1487702 - protein, 18 aa, Mycobacterium tuberculosis
NLRSKRVLLAGWEQFDEP

SEQ ID NO: 1487703 - protein, 23 aa, Mycobacterium tuberculosis
NLRYRPAHGDSCINGHRDNPSAR

SEQ ID NO: 1487704 - protein, 19 aa, Mycobacterium tuberculosis
NLSDAGVSWKVYRNKTLGP

SEQ ID NO: 1487705 - protein, 22 aa, Mycobacterium tuberculosis
NLSDAGVSWKVYRNKTLGPISS

SEQ ID NO: 1487706 - protein, 18 aa, Mycobacterium tuberculosis
NLSIRDGWWDEWYDGENG

SEQ ID NO: 1487707 - protein, 25 aa, Mycobacterium tuberculosis
NLTGVMTFGLPLAMTLNAVGSPITT

SEQ ID NO: 1487708 - protein, 27 aa, Mycobacterium tuberculosis
NLTGVMTFGLPLAMTLNAVGSPITTAI

SEQ ID NO: 1487709 - protein, 25 aa, Mycobacterium tuberculosis
NLTTSGFRPATFAAIVDGIVESVEH

SEQ ID NO: 1487710 - protein, 17 aa, Mycobacterium tuberculosis
NLVGIGALNSGIGNLGF

SEQ ID NO: 1487711 - protein, 18 aa, Mycobacterium tuberculosis
NLVGIGALNSGIGNMGFG

SEQ ID NO: 1487712 - protein, 20 aa, Mycobacterium tuberculosis
NMANPLWIDRAEIWTRFASG

SEQ ID NO: 1487713 - protein, 20 aa, Mycobacterium tuberculosis
NMEQAMGIAKGYLANQENVM

SEQ ID NO: 1487714 - protein, 17 aa, Mycobacterium tuberculosis
NMFAFRADRFFGAGQSR

SEQ ID NO: 1487715 - protein, 25 aa, Mycobacterium tuberculosis
NMFEFARPVLEACGQRWPKMRISGP

SEQ ID NO: 1487716 - protein, 17 aa, Mycobacterium tuberculosis
NMIGIGALNSGIGNLGF

SEQ ID NO: 1487717 - protein, 25 aa, Mycobacterium tuberculosis
NMIKPMLARGELRLVGATTLDEYRK

SEQ ID NO: 1487718 - protein, 18 aa, Mycobacterium tuberculosis
NMSPEFGSTAAIFPIDEE

SEQ ID NO: 1487719 - protein, 17 aa, Mycobacterium tuberculosis
NMVYKLVEVDGVPVQKR

SEQ ID NO: 1487720 - protein, 21 aa, Mycobacterium tuberculosis
NNAGDYGFFWITAVTTDGSIV

SEQ ID NO: 1487721 - protein, 18 aa, Mycobacterium tuberculosis
NNANYAWIQHILYKLAPG

SEQ ID NO: 1487722 - protein, 22 aa, Mycobacterium tuberculosis
NNLPAKFLEGFVRTSNIKFQDA

SEQ ID NO: 1487723 - protein, 20 aa, Mycobacterium tuberculosis
NNNIGFGLTGDNLVGIGALN

SEQ ID NO: 1487724 - protein, 19 aa, Mycobacterium tuberculosis
NNNIGFGLTGDNQIGFGAL

SEQ ID NO: 1487725 - protein, 17 aa, Mycobacterium tuberculosis
NNPNGGILARFPGLYLQ

SEQ ID NO: 1487726 - protein, 18 aa, Mycobacterium tuberculosis
NNWESVFGGPAWTRVREP

SEQ ID NO: 1487727 - protein, 21 aa, Mycobacterium tuberculosis
NNWFAAYAYWYFKLYGHEKVK

SEQ ID NO: 1487728 - protein, 19 aa, Mycobacterium tuberculosis
NPAACRRIAIAAHDGLART

SEQ ID NO: 1487729 - protein, 24 aa, Mycobacterium tuberculosis
NPDAGMVLREVGLEVLGSARRVVV

SEQ ID NO: 1487730 - protein, 18 aa, Mycobacterium tuberculosis
NPECHLMVVLVDERPEEV

SEQ ID NO: 1487731 - protein, 26 aa, Mycobacterium tuberculosis
NPFTPKRAQVVWVLLDAPQLVYATLR

SEQ ID NO: 1487732 - protein, 17 aa, Mycobacterium tuberculosis
NPGAITGSGGRGGDGGV

SEQ ID NO: 1487733 - protein, 29 aa, Mycobacterium tuberculosis
NPGAQPRCGLGWRARVHRRRRAGVDPGRI

SEQ ID NO: 1487734 - protein, 22 aa, Mycobacterium tuberculosis
NPGTLNTGFFSAMTQAGPNSGF

SEQ ID NO: 1487735 - protein, 22 aa, Mycobacterium tuberculosis
NPGVCRGICGDGGAGGASDTGA

SEQ ID NO: 1487736 - protein, 26 aa, Mycobacterium tuberculosis
NPHIPFTDLRMKVVDTQTEWPATGHP

SEQ ID NO: 1487737 - protein, 22 aa, Mycobacterium tuberculosis
NPIARLVWRLCKIDGKPSRYRS

SEQ ID NO: 1487738 - protein, 17 aa, Mycobacterium tuberculosis
NPIASIFAWTRGLQHRG

SEQ ID NO: 1487739 - protein, 29 aa, Mycobacterium tuberculosis
NPPAPRRIKVPAHVAANFEGLVVRVDDTD

SEQ ID NO: 1487740 - protein, 17 aa, Mycobacterium tuberculosis
NPPKPPPAIKIDPPPPP

SEQ ID NO: 1487741 - protein, 18 aa, Mycobacterium tuberculosis
NPQFAFVRIDSGKPDFRI

SEQ ID NO: 1487742 - protein, 24 aa, Mycobacterium tuberculosis
NPQRPWEHPDFWDIWKASLQGVLA

SEQ ID NO: 1487743 - protein, 24 aa, Mycobacterium tuberculosis
NPRTRSGIMALELLDGTPDWDRFR

SEQ ID NO: 1487744 - protein, 24 aa, Mycobacterium tuberculosis
NPSSTKLRNGFRMQRQNTRIGQDV

SEQ ID NO: 1487745 - protein, 18 aa, Mycobacterium tuberculosis
NPVCAAAALAVLRVLASD

SEQ ID NO: 1487746 - protein, 21 aa, Mycobacterium tuberculosis
NPVSALLFFLASSRIFNRRKG

SEQ ID NO: 1487747 - protein, 35 aa, Mycobacterium tuberculosis
NPVSALVSFEVFIRPSLRMAMGLPDPYRPHRSAVL

SEQ ID NO: 1487748 - protein, 18 aa, Mycobacterium tuberculosis
NPYLQRKAQIIVDYYRGD

SEQ ID NO: 1487749 - protein, 20 aa, Mycobacterium tuberculosis
NPYLTFAVLLAAGLRGVEKG

SEQ ID NO: 1487750 - protein, 18 aa, Mycobacterium tuberculosis
NQAPLSFPIPGWNICVDF

SEQ ID NO: 1487751 - protein, 25 aa, Mycobacterium tuberculosis
NQHGFCAECHLDAPMVNRALAGAPD

SEQ ID NO: 1487752 - protein, 18 aa, Mycobacterium tuberculosis
NQIRWLFEKLLGESPRRS

SEQ ID NO: 1487753 - protein, 17 aa, Mycobacterium tuberculosis
NQLYVRWAGQDEWAAVP

SEQ ID NO: 1487754 - protein, 19 aa, Mycobacterium tuberculosis
NQLYVRWAGQDEWAAVPLH

SEQ ID NO: 1487755 - protein, 19 aa, Mycobacterium tuberculosis
NQRGNVIPVEITVYEDRSF

SEQ ID NO: 1487756 - protein, 17 aa, Mycobacterium tuberculosis
NQTRVGWWPAPTTTTGI

SEQ ID NO: 1487757 - protein, 18 aa, Mycobacterium tuberculosis
NQVLPEEVRNCFADMAKV

SEQ ID NO: 1487758 - protein, 23 aa, Mycobacterium tuberculosis
NRAGSGTAWPATYRDLLAAQGAG

SEQ ID NO: 1487759 - protein, 21 aa, Mycobacterium tuberculosis
NRAVELACTVGRTLKSGTVNL

SEQ ID NO: 1487760 - protein, 18 aa, Mycobacterium tuberculosis
NRDPITGVHFVFVSNSSP

SEQ ID NO: 1487761 - protein, 17 aa, Mycobacterium tuberculosis
NREKAREQRNWALADEI

SEQ ID NO: 1487762 - protein, 23 aa, Mycobacterium tuberculosis
NREPSRRGAARWRTQGAHQPRPR

SEQ ID NO: 1487763 - protein, 20 aa, Mycobacterium tuberculosis
NRGWFPQVFSIIDGQKVGVT

SEQ ID NO: 1487764 - protein, 21 aa, Mycobacterium tuberculosis
NRHQLVSLVLSNLFGQNAPAI

SEQ ID NO: 1487765 - protein, 17 aa, Mycobacterium tuberculosis
NRIQLLALIATNFFGQN

SEQ ID NO: 1487766 - protein, 24 aa, Mycobacterium tuberculosis
NRIVRRLLAAAGFPVEALVRTDIG

SEQ ID NO: 1487767 - protein, 22 aa, Mycobacterium tuberculosis
NRKFGNCRLYSMLVSSCSTDRC

SEQ ID NO: 1487768 - protein, 19 aa, Mycobacterium tuberculosis
NRLAHWFRQAGLREDDVVA

SEQ ID NO: 1487769 - protein, 17 aa, Mycobacterium tuberculosis
NRLPCPEDKALAAARAI

SEQ ID NO: 1487770 - protein, 23 aa, Mycobacterium tuberculosis
NRLPKVSWVLPGFLLSEHPAFPV

SEQ ID NO: 1487771 - protein, 20 aa, Mycobacterium tuberculosis
NRLPPVHMFGGINLSFGLMG

SEQ ID NO: 1487772 - protein, 23 aa, Mycobacterium tuberculosis
NRLPPVHMFGGINLSFGLMGPPH

SEQ ID NO: 1487773 - protein, 17 aa, Mycobacterium tuberculosis
NRLPWRTPLSLERHGRC

SEQ ID NO: 1487774 - protein, 30 aa, Mycobacterium tuberculosis; identical to SEQ ID NO: 211416

SEQ ID NO: 1487775 - protein, 20 aa, Mycobacterium tuberculosis
NRLSDLLFILSRVANPDGDV

SEQ ID NO: 1487776 - protein, 21 aa, Mycobacterium tuberculosis
NRNAFVQLVLSNLFGQNAPAI

SEQ ID NO: 1487777 - protein, 33 aa, Mycobacterium tuberculosis
NRPTPDRVRELVVAWGKLYPQFGAVAALNLVKC

SEQ ID NO: 1487778 - protein, 21 aa, Mycobacterium tuberculosis
NRQEIKQALLALQRVSEHDTD

SEQ ID NO: 1487779 - protein, 20 aa, Mycobacterium tuberculosis
NRQPLGRMPVHGGGQAAEHA

SEQ ID NO: 1487780 - protein, 21 aa, Mycobacterium tuberculosis
NRRCRACVRSGSRGGSSRSTA

SEQ ID NO: 1487781 - protein, 26 aa, Mycobacterium tuberculosis
NRRLPLRRLGAGVGRIAGSPKNGEQV

SEQ ID NO: 1487782 - protein, 21 aa, Mycobacterium tuberculosis
NRRPAEPKRGPTAPPDRGPKG

SEQ ID NO: 1487783 - protein, 20 aa, Mycobacterium tuberculosis
NRRSFWIQREHLLQAIKDVG

SEQ ID NO: 1487784 - protein, 21 aa, Mycobacterium tuberculosis
NRSAFVQLVLSNVFGQNAPAI

SEQ ID NO: 1487785 - protein, 19 aa, Mycobacterium tuberculosis
NRSGAGLFGSIAQLVKVRS

SEQ ID NO: 1487786 - protein, 28 aa, Mycobacterium tuberculosis
NRSIDYRCCREVKSIYTAQAVLSIASGT

SEQ ID NO: 1487787 - protein, 20 aa, Mycobacterium tuberculosis
NRTGCGRCSSRQTQNPERGR

SEQ ID NO: 1487788 - protein, 24 aa, Mycobacterium tuberculosis
NRVKTWLQFPQWFYLNIPVNTMVA

SEQ ID NO: 1487789 - protein, 25 aa, Mycobacterium tuberculosis
NRVRHVPVLDGKKLIGIVSIGDVVK

SEQ ID NO: 1487790 - protein, 19 aa, Mycobacterium tuberculosis
NRVVALSWAQRPSPTAELG

SEQ ID NO: 1487791 - protein, 17 aa, Mycobacterium tuberculosis
NRYALPDGTTFGIIAST

SEQ ID NO: 1487792 - protein, 19 aa, Mycobacterium tuberculosis
NRYALPDGTTFGIIASTTE

SEQ ID NO: 1487793 - protein, 20 aa, Mycobacterium tuberculosis
NRYFGGLVHGLWRGGIGTTW

SEQ ID NO: 1487794 - protein, 30 aa, Mycobacterium tuberculosis
NSAIVRPLLRFFFKSWFRVEVSGVENIPRD

SEQ ID NO: 1487795 - protein, 23 aa, Mycobacterium tuberculosis
NSARSKPRCSLPGVHAAAATVLP

SEQ ID NO: 1487796 - protein, 25 aa, Mycobacterium tuberculosis
NSFTIPGFQIRVLLGPAAVLVNEMI

SEQ ID NO: 1487797 - protein, 27 aa, Mycobacterium tuberculosis
NSGAPGSDALALGQPGGNGGQGDAGQA

SEQ ID NO: 1487798 - protein, 17 aa, Mycobacterium tuberculosis
NSGGFNVGFYNSGAGTV

SEQ ID NO: 1487799 - protein, 23 aa, Mycobacterium tuberculosis
NSGRMYCGPGSGPMLAAAAAWDG

SEQ ID NO: 1487800 - protein, 23 aa, Mycobacterium tuberculosis
NSGRMYCGPGSGPMLAAAAPWDG

SEQ ID NO: 1487801 - protein, 23 aa, Mycobacterium tuberculosis
NSGSFNNGALWTGDHHGLVGFSY

SEQ ID NO: 1487802 - protein, 18 aa, Mycobacterium tuberculosis
NSGSLFASPGGTGGAGGP

SEQ ID NO: 1487803 - protein, 19 aa, Mycobacterium tuberculosis
NSGTEPGFGGDGGLGGAGA

SEQ ID NO: 1487804 - protein, 19 aa, Mycobacterium tuberculosis
NSGTGNWGIGNSGNSYNTG

SEQ ID NO: 1487805 - protein, 19 aa, Mycobacterium tuberculosis
NSIAARFTKPVFPGETLST

SEQ ID NO: 1487806 - protein, 28 aa, Mycobacterium tuberculosis
NSLDEPIAVVGMGCRFPGGISCPEALWD

SEQ ID NO: 1487807 - protein, 20 aa, Mycobacterium tuberculosis
NSPGWRRAMAARKRIDDLID

SEQ ID NO: 1487808 - protein, 22 aa, Mycobacterium tuberculosis
NSRFMFDYIPPVFKGQYAETEE

SEQ ID NO: 1487809 - protein, 25 aa, Mycobacterium tuberculosis
NSTAECSGEICRRQAGGHQVDATDP

SEQ ID NO: 1487810 - protein, 23 aa, Mycobacterium tuberculosis
NTATRRLCEWAGCKFLGEHDTTN

SEQ ID NO: 1487811 - protein, 17 aa, Mycobacterium tuberculosis
NTGDGNRGIGLTGSGLL

SEQ ID NO: 1487812 - protein, 18 aa, Mycobacterium tuberculosis
NTGLPWPDVHDAGTVSLL

SEQ ID NO: 1487813 - protein, 21 aa, Mycobacterium tuberculosis
NTHGVSWLPLYHDMGLSMIGF

SEQ ID NO: 1487814 - protein, 17 aa, Mycobacterium tuberculosis
NTIGLRLATLGPLENAD

SEQ ID NO: 1487815 - protein, 18 aa, Mycobacterium tuberculosis
NTIGLRLATLGPLENADY

SEQ ID NO: 1487816 - protein, 25 aa, Mycobacterium tuberculosis
NTISDWLNASALDLATPGFLSGIGN

SEQ ID NO: 1487817 - protein, 18 aa, Mycobacterium tuberculosis
NTLCAVMGGDAIFDRLKE

SEQ ID NO: 1487818 - protein, 25 aa, Mycobacterium tuberculosis
NTNTGAFFIGHSGLLNSGGGQHVGI

SEQ ID NO: 1487819 - protein, 19 aa, Mycobacterium tuberculosis
NTPDSCWPTLPAPDTSAGV

SEQ ID NO: 1487820 - protein, 25 aa, Mycobacterium tuberculosis
NTPVVWRGPMLHRTLQQFLADVYWG

SEQ ID NO: 1487821 - protein, 19 aa, Mycobacterium tuberculosis
NTRMPSCRAHLLKEGLRHL

SEQ ID NO: 1487822 - protein, 22 aa, Mycobacterium tuberculosis
NTRRTGLCQFEDAFTQLSGATP

SEQ ID NO: 1487823 - protein, 23 aa, Mycobacterium tuberculosis
NTSTCMFACPAVRYLSPASRPDG

SEQ ID NO: 1487824 - protein, 46 aa, Mycobacterium tuberculosis
NTTIIWRRLLWPALYFYLCVHRSLYWSLHVLLCIASTRWVPSCPAS

SEQ ID NO: 1487825 - protein, 19 aa, Mycobacterium tuberculosis
NTTIPTKRSETFTTADDNQ

SEQ ID NO: 1487826 - protein, 17 aa, Mycobacterium tuberculosis
NTVEIVSGICECTAEAM

SEQ ID NO: 1487827 - protein, 18 aa, Mycobacterium tuberculosis
NTVRYRIRRIEQLLSTSL

SEQ ID NO: 1487828 - protein, 26 aa, Mycobacterium tuberculosis
NVATPFRLFPEVSPVVIADALVAGTQ

SEQ ID NO: 1487829 - protein, 23 aa, Mycobacterium tuberculosis
NVAVRWVQNALSFIGFVPPDEND

SEQ ID NO: 1487830 - protein, 30 aa, Mycobacterium tuberculosis
NVAYIQWAIRWTRRGAVIVVDNVIRGGGIL

SEQ ID NO: 1487831 - protein, 23 aa, Mycobacterium tuberculosis
NVEQNLLNLINAPTQTLLGRPLI

SEQ ID NO: 1487832 - protein, 18 aa, Mycobacterium tuberculosis
NVFVAGFIGSPAMNLFRL

SEQ ID NO: 1487833 - protein, 25 aa, Mycobacterium tuberculosis
NVGLHFICRDVWLRVASTSTAWTSR

SEQ ID NO: 1487834 - protein, 18 aa, Mycobacterium tuberculosis
NVGVWVRTDEQWRWLAHT

SEQ ID NO: 1487835 - protein, 22 aa, Mycobacterium tuberculosis
NVLSRAIVRLCLSYVSMPPEAD

SEQ ID NO: 1487836 - protein, 27 aa, Mycobacterium tuberculosis
NVPRLVPGWTKPIVIGRHAFGDQYRAT

SEQ ID NO: 1487837 - protein, 23 aa, Mycobacterium tuberculosis
NVQAGLRTDYLFRIANQRGGIVL

SEQ ID NO: 1487838 - protein, 18 aa, Mycobacterium tuberculosis
NVRASVIDRGQWKDHRDG

SEQ ID NO: 1487839 - protein, 22 aa, Mycobacterium tuberculosis
NVRGAWLVCWAAGRVLLEQGQG

SEQ ID NO: 1487840 - protein, 24 aa, Mycobacterium tuberculosis
NVRLPERTRYVLSITWSDVETPGP

SEQ ID NO: 1487841 - protein, 30 aa, Mycobacterium tuberculosis
NVTRRNGAVWKRVHTTSRLWAFQLQSILAR

SEQ ID NO: 1487842 - protein, 17 aa, Mycobacterium tuberculosis
NVVGRLPGRYAVAALGI

SEQ ID NO: 1487843 - protein, 20 aa, Mycobacterium tuberculosis
NVVGRLPGRYAVAALGIGEQ

SEQ ID NO: 1487844 - protein, 25 aa, Mycobacterium tuberculosis
NVYLRDLVLALRWVHDNIAEFGGDP

SEQ ID NO: 1487845 - protein, 22 aa, Mycobacterium tuberculosis
NWESVFGGPAWTRVREPDGNPG

SEQ ID NO: 1487846 - protein, 24 aa, Mycobacterium tuberculosis
NWGARSASGLLNFGNNSGLYNFAT

SEQ ID NO: 1487847 - protein, 18 aa, Mycobacterium tuberculosis
NWIRGFLPPLPPISPPGF

SEQ ID NO: 1487848 - protein, 17 aa, Mycobacterium tuberculosis
NWPALPVAMADTIVPDF

SEQ ID NO: 1487849 - protein, 31 aa, Mycobacterium tuberculosis
NWSSGCDHASWTFVGGPVIKDGRPVDFGSFL

SEQ ID NO: 1487850 - protein, 30 aa, Mycobacterium tuberculosis
NWTEPFPGLAWTLLSRNGFTICVKMMNVVR

SEQ ID NO: 1487851 - protein, 26 aa, Mycobacterium tuberculosis
NYDMSMARLLYWGCDVWLNNPLRPLE

SEQ ID NO: 1487852 - protein, 26 aa, Mycobacterium tuberculosis
NYFTKLRIPGARVIPTIYFLRHSTDP

SEQ ID NO: 1487853 - protein, 24 aa, Mycobacterium tuberculosis
NYPPPCLTGFLPASEWRSPADTSP

SEQ ID NO: 1487854 - protein, 22 aa, Mycobacterium tuberculosis
NYREAYGLFAVNGILFNHESPR

SEQ ID NO: 1487855 - protein, 28 aa, Mycobacterium tuberculosis
NYSLARWRKADAALGRPVVSNQVHFSLA

SEQ ID NO: 1487856 - protein, 17 aa, Mycobacterium tuberculosis
NYSMVFDSYSEVPANVS

SEQ ID NO: 1487857 - protein, 30 aa, Mycobacterium tuberculosis
NYSVLPPEINSLRMFTGAGSAPMLAASVAW

SEQ ID NO: 1487858 - protein, 17 aa, Mycobacterium tuberculosis
PAAAAHPSLPRGALLQI

SEQ ID NO: 1487859 - protein, 23 aa, Mycobacterium tuberculosis
PAAAWQRCRTHYAANLMAATPKP

SEQ ID NO: 1487860 - protein, 19 aa, Mycobacterium tuberculosis
PAAGRPVLMASRRRRWPPT

SEQ ID NO: 1487861 - protein, 20 aa, Mycobacterium tuberculosis
PAAGVKITWTPIEPTLPSID

SEQ ID NO: 1487862 - protein, 17 aa, Mycobacterium tuberculosis
PAALAIPALGIGNTGIG

SEQ ID NO: 1487863 - protein, 23 aa, Mycobacterium tuberculosis
PAALFDARFQKLGLHPGGGATWM

SEQ ID NO: 1487864 - protein, 26 aa, Mycobacterium tuberculosis
PAALGDCYSAWTWLASLPAVDPARVA

SEQ ID NO: 1487865 - protein, 17 aa, Mycobacterium tuberculosis
PAALLRCLVEGADEVHV

SEQ ID NO: 1487866 - protein, 18 aa, Mycobacterium tuberculosis
PAALLRLVNPILRSLLHT

SEQ ID NO: 1487867 - protein, 25 aa, Mycobacterium tuberculosis
PAAPCLELSTGIALAFPRGPFVPAA

SEQ ID NO: 1487868 - protein, 18 aa, Mycobacterium tuberculosis
PAAPEPPAAVPPSPQGTP

SEQ ID NO: 1487869 - protein, 18 aa, Mycobacterium tuberculosis
PAAPIPLASPNIYRGDAS

SEQ ID NO: 1487870 - protein, 19 aa, Mycobacterium tuberculosis
PAAPPWAAGLAGRPGPAGP

SEQ ID NO: 1487871 - protein, 19 aa, Mycobacterium tuberculosis
PAAPRTLSPPVPPAPPSPI

SEQ ID NO: 1487872 - protein, 25 aa, Mycobacterium tuberculosis
PAAQRLASCGAREVIVTNTLPIGED

SEQ ID NO: 1487873 - protein, 26 aa, Mycobacterium tuberculosis
PAARRAAHRAGHLGAMYPWQSGSDGS

SEQ ID NO: 1487874 - protein, 28 aa, Mycobacterium tuberculosis
PAARVLAIWPDWVRRWPTPSATATASTA

SEQ ID NO: 1487875 - protein, 30 aa, Mycobacterium tuberculosis
PAASTRPASTRVATTRDWPTRAMSTPAASS

SEQ ID NO: 1487876 - protein, 17 aa, Mycobacterium tuberculosis
PAASTRPASTRVATTRV

SEQ ID NO: 1487877 - protein, 17 aa, Mycobacterium tuberculosis
PAATCHHRVLAMTYPDP

SEQ ID NO: 1487878 - protein, 28 aa, Mycobacterium tuberculosis
PAATGSTRWPSGIGWCSSLATSWATAWR

SEQ ID NO: 1487879 - protein, 26 aa, Mycobacterium tuberculosis
PADLAGRARAAGPTVAPQDPAGPAGL

SEQ ID NO: 1487880 - protein, 23 aa, Mycobacterium tuberculosis
PADLPARLSLFGHTRLACTDVQL

SEQ ID NO: 1487881 - protein, 28 aa, Mycobacterium tuberculosis
PADYGHYGPLFIRMAWHAAGTYRIHDGR

SEQ ID NO: 1487882 - protein, 17 aa, Mycobacterium tuberculosis
PAETAALAPARAARAAT

SEQ ID NO: 1487883 - protein, 23 aa, Mycobacterium tuberculosis
PAEWKVFLNLLRTRFETDKDKWT

SEQ ID NO: 1487884 - protein, 24 aa, Mycobacterium tuberculosis
PAFALGDYEWILAFEAPELDRIVD

SEQ ID NO: 1487885 - protein, 19 aa, Mycobacterium tuberculosis
PAGAGVGCPAGATDPAVGE

SEQ ID NO: 1487886 - protein, 26 aa, Mycobacterium tuberculosis
PAGGMLRRMRPLFSVGLGARLGSGRQ

SEQ ID NO: 1487887 - protein, 26 aa, Mycobacterium tuberculosis
PAGIDDSWAALRWVGENAAELGGDPS

SEQ ID NO: 1487888 - protein, 31 aa, Mycobacterium tuberculosis
PAGLLYLVGPIAWTLGFPIVPMLAPGSTDVN

SEQ ID NO: 1487889 - protein, 17 aa, Mycobacterium tuberculosis
PAGLPRRQGPPPHFVSR

SEQ ID NO: 1487890 - protein, 17 aa, Mycobacterium tuberculosis
PAGLRRLLSVASAVPAE

SEQ ID NO: 1487891 - protein, 21 aa, Mycobacterium tuberculosis
PAGMPGMLAGPGGAGGAGGDG

SEQ ID NO: 1487892 - protein, 32 aa, Mycobacterium tuberculosis
PAGPEFAAGCSTCWPPSGAGGPRPDFSDNGET

SEQ ID NO: 1487893 - protein, 44 aa, Mycobacterium tuberculosis
PAGPPGAPVPGWPLAPLPISGRPVAAWMGALNTSIRLCNGDAAA

SEQ ID NO: 1487894 - protein, 25 aa, Mycobacterium tuberculosis
PAGQPRWLHTRVWPGSSPSAPAVGA

SEQ ID NO: 1487895 - protein, 17 aa, Mycobacterium tuberculosis
PAGRFASIYDRVHAWAS

SEQ ID NO: 1487896 - protein, 23 aa, Mycobacterium tuberculosis
PAGTERAPALLAGPAVTAGKAGT

SEQ ID NO: 1487897 - protein, 19 aa, Mycobacterium tuberculosis
PAHRAGAAYAELALLRGDP

SEQ ID NO: 1487898 - protein, 20 aa, Mycobacterium tuberculosis
PAIARRWLSSVAQRVSTAQI

SEQ ID NO: 1487899 - protein, 26 aa, Mycobacterium tuberculosis
PAIPAIPPFFPGFPPDYVTVSGQIGP

SEQ ID NO: 1487900 - protein, 21 aa, Mycobacterium tuberculosis
PAIPDRSDVVWLEHEDNHESA

SEQ ID NO: 1487901 - protein, 18 aa, Mycobacterium tuberculosis
PAITKWRKGAGVTGENRL

SEQ ID NO: 1487902 - protein, 20 aa, Mycobacterium tuberculosis
PAKPIAVNIIDFGADPDRAT

SEQ ID NO: 1487903 - protein, 22 aa, Mycobacterium tuberculosis
PAKRGRRGPDHDGVGPPPPDEV

SEQ ID NO: 1487904 - protein, 31 aa, Mycobacterium tuberculosis
PAKRSPNWQRWWPLDSRRPAALQTELHLGTV

SEQ ID NO: 1487905 - protein, 24 aa, Mycobacterium tuberculosis
PALDMAYKLVAYDGSGRTKFSSGK

SEQ ID NO: 1487906 - protein, 22 aa, Mycobacterium tuberculosis
PALDRLDLIVGDGEFVVLVGPS

SEQ ID NO: 1487907 - protein, 20 aa, Mycobacterium tuberculosis
PALLRHQQWMLGPSAGSVDG

SEQ ID NO: 1487908 - protein, 32 aa, Mycobacterium tuberculosis
PALMERLYKTSWRFAPFLWQEIEEGILPALYA

SEQ ID NO: 1487909 - protein, 25 aa, Mycobacterium tuberculosis
PALPRLGPTDALPRCRQTVHRGAVI

SEQ ID NO: 1487910 - protein, 19 aa, Mycobacterium tuberculosis
PALQRRRTCPLTRRCSDDG

SEQ ID NO: 1487911 - protein, 22 aa, Mycobacterium tuberculosis
PALQRRWWAARGRGAFASVDGA

SEQ ID NO: 1487912 - protein, 17 aa, Mycobacterium tuberculosis
PALSRDAALLARDTVPT

SEQ ID NO: 1487913 - protein, 18 aa, Mycobacterium tuberculosis
PALSRDAALLARDTVPTL

SEQ ID NO: 1487914 - protein, 17 aa, Mycobacterium tuberculosis
PALTLAALMCYEAHIAG

SEQ ID NO: 1487915 - protein, 17 aa, Mycobacterium tuberculosis
PALTLAQLRARLHTLDV

SEQ ID NO: 1487916 - protein, 22 aa, Mycobacterium tuberculosis
PALVAPLTFLAIAGRRVQLEIF

SEQ ID NO: 1487917 - protein, 18 aa, Mycobacterium tuberculosis
PALVGCIAQAIGAGRHEI

SEQ ID NO: 1487918 - protein, 26 aa, Mycobacterium tuberculosis
PALVVGWCCRRRRGGAGGRPGYRACP

SEQ ID NO: 1487919 - protein, 21 aa, Mycobacterium tuberculosis
PAMHTEMWLHPATVDNVATLR

SEQ ID NO: 1487920 - protein, 20 aa, Mycobacterium tuberculosis
PAMHTEMWLHPATVDNVDTL

SEQ ID NO: 1487921 - protein, 24 aa, Mycobacterium tuberculosis
PAMMPSKSSTRWSVTPATRGPQPL

SEQ ID NO: 1487922 - protein, 17 aa, Mycobacterium tuberculosis
PAMPMPCVRDTATTTRP

SEQ ID NO: 1487923 - protein, 18 aa, Mycobacterium tuberculosis
PANQWLFHAGEPADSIYI

SEQ ID NO: 1487924 - protein, 19 aa, Mycobacterium tuberculosis
PAPARRVGGHPAKRTFQAL

SEQ ID NO: 1487925 - protein, 25 aa, Mycobacterium tuberculosis
PAPDGVKLAAGWLVERAGFGKGYPD

SEQ ID NO: 1487926 - protein, 26 aa, Mycobacterium tuberculosis
PAPDGVKLAAGWLVERAGFGKGYPDA

SEQ ID NO: 1487927 - protein, 19 aa, Mycobacterium tuberculosis
PAPGPRNGVVVAIPTRVGD

SEQ ID NO: 1487928 - protein, 21 aa, Mycobacterium tuberculosis
PAPIFGCLREVRAWAQNTKDA

SEQ ID NO: 1487929 - protein, 24 aa, Mycobacterium tuberculosis
PAPLLRARGTFFAHADQLSIHRAY

SEQ ID NO: 1487930 - protein, 24 aa, Mycobacterium tuberculosis
PAPLPCTPRGIVHLLRRYDISIAG

SEQ ID NO: 1487931 - protein, 17 aa, Mycobacterium tuberculosis
PAPLRRGQIRPLGLDRY

SEQ ID NO: 1487932 - protein, 23 aa, Mycobacterium tuberculosis
PAPPAAPAPFALAPPLPPLQKKK

SEQ ID NO: 1487933 - protein, 25 aa, Mycobacterium tuberculosis
PAPPAPWPPSRLIRPPAPPGPPAPP

SEQ ID NO: 1487934 - protein, 29 aa, Mycobacterium tuberculosis
PAPPLPRSHPPRPPLPPTPPAPPSPPSDP

SEQ ID NO: 1487935 - protein, 19 aa, Mycobacterium tuberculosis
PAPPPRELDMLLTAGERIS

SEQ ID NO: 1487936 - protein, 19 aa, Mycobacterium tuberculosis
PAPPTWPGMCTYEDLIAAT

SEQ ID NO: 1487937 - protein, 25 aa, Mycobacterium tuberculosis
PAPPVRRLAERGAPEIQAYDPVFFP

SEQ ID NO: 1487938 - protein, 20 aa, Mycobacterium tuberculosis
PAPPWPPAPISPAFPPVPPL

SEQ ID NO: 1487939 - protein, 19 aa, Mycobacterium tuberculosis
PAPQRLRVLALALAGERTV

SEQ ID NO: 1487940 - protein, 26 aa, Mycobacterium tuberculosis
PAPSCPPHWWPTTAIRRRVPPENSAR

SEQ ID NO: 1487941 - protein, 26 aa, Mycobacterium tuberculosis
PAPTHRRWSQYLAWVADHIGLKVIHG

SEQ ID NO: 1487942 - protein, 19 aa, Mycobacterium tuberculosis
PAQAIAQVCELTWQLRGQA

SEQ ID NO: 1487943 - protein, 20 aa, Mycobacterium tuberculosis
PAQAIAQVCELTWQLRGQAT

SEQ ID NO: 1487944 - protein, 22 aa, Mycobacterium tuberculosis
PAQALFGRPLIGNGANGTAASP

SEQ ID NO: 1487945 - protein, 22 aa, Mycobacterium tuberculosis
PAQLCGYGPIPAAVARTMVASA

SEQ ID NO: 1487946 - protein, 18 aa, Mycobacterium tuberculosis
PAQRHFTRAGALRLSPSL

SEQ ID NO: 1487947 - protein, 22 aa, Mycobacterium tuberculosis
PAQVRVGFRLGEPAAGELGVRD

SEQ ID NO: 1487948 - protein, 23 aa, Mycobacterium tuberculosis
PAQVRVGFRLGEPAAGELGVRDA

SEQ ID NO: 1487949 - protein, 18 aa, Mycobacterium tuberculosis
PARAATQSTPAWAVVQAA

SEQ ID NO: 1487950 - protein, 24 aa, Mycobacterium tuberculosis
PARAEDRAAGAARAAVAAGSTAEA

SEQ ID NO: 1487951 - protein, 18 aa, Mycobacterium tuberculosis
PARGRFSAHTFWEDIKAV

SEQ ID NO: 1487952 - protein, 24 aa, Mycobacterium tuberculosis
PARKRRMFDLLVRMGYKEIEVGFP

SEQ ID NO: 1487953 - protein, 20 aa, Mycobacterium tuberculosis
PARLKVGIISAGRVGTALGV

SEQ ID NO: 1487954 - protein, 21 aa, Mycobacterium tuberculosis
PARLKVGIISAGRVGTALGVA

SEQ ID NO: 1487955 - protein, 19 aa, Mycobacterium tuberculosis
PARLRPATVTSSWTDGIPH

SEQ ID NO: 1487956 - protein, 20 aa, Mycobacterium tuberculosis
PARPVARRLFAVRAVVGLSL

SEQ ID NO: 1487957 - protein, 23 aa, Mycobacterium tuberculosis
PARRFRRRRRNWGLFMTQHRWAP

SEQ ID NO: 1487958 - protein, 25 aa, Mycobacterium tuberculosis
PARRHGRRSAFRDPRGWPHRGRRPG

SEQ ID NO: 1487959 - protein, 32 aa, Mycobacterium tuberculosis
PARTVAGVATAVRWVMAVPVGPVAAAGPAVSD

SEQ ID NO: 1487960 - protein, 18 aa, Mycobacterium tuberculosis
PASEGFLAAADRVGVDPQ

SEQ ID NO: 1487961 - protein, 24 aa, Mycobacterium tuberculosis
PASFEPWADLVPHLDDVVADCSDE

SEQ ID NO: 1487962 - protein, 22 aa, Mycobacterium tuberculosis
PASGAGCRRRSMPARRGPAGWG

SEQ ID NO: 1487963 - protein, 18 aa, Mycobacterium tuberculosis
PASGGVVLTGRLSPSVQG

SEQ ID NO: 1487964 - protein, 25 aa, Mycobacterium tuberculosis
PASGPAPFPAVPVDLPAPADIANGA

SEQ ID NO: 1487965 - protein, 29 aa, Mycobacterium tuberculosis
PASGRPLAMPRLDMVTGLYYLTTEVPEDT

SEQ ID NO: 1487966 - protein, 24 aa, Mycobacterium tuberculosis
PASIAALRRGRGALVTQQRGAGRG

SEQ ID NO: 1487967 - protein, 21 aa, Mycobacterium tuberculosis
PASLPTALFVDVRELITAPQY

SEQ ID NO: 1487968 - protein, 19 aa, Mycobacterium tuberculosis
PASPPRPPAPPMPATPMEF

SEQ ID NO: 1487969 - protein, 36 aa, Mycobacterium tuberculosis
PASRVAILLPAHWQTAAVLFGVWWIGAQAILDDSPA

SEQ ID NO: 1487970 - protein, 23 aa, Mycobacterium tuberculosis
PASSSQRFPPGWAAAVAGAATRG

SEQ ID NO: 1487971 - protein, 31 aa, Mycobacterium tuberculosis
PATAAAAVRKWTKRKGRIYSDDRIGVALDRI

SEQ ID NO: 1487972 - protein, 20 aa, Mycobacterium tuberculosis
PATFDGTILIGDIPIPIIDV

SEQ ID NO: 1487973 - protein, 26 aa, Mycobacterium tuberculosis
PATGACGTQAPAIWASPTWAPTTPVA

SEQ ID NO: 1487974 - protein, 22 aa, Mycobacterium tuberculosis
PATGARLRWAPAQGPSATPAQG

SEQ ID NO: 1487975 - protein, 17 aa, Mycobacterium tuberculosis
PATPMEFPPLPPVPPEP

SEQ ID NO: 1487976 - protein, 19 aa, Mycobacterium tuberculosis
PATRCCWHHVCSRCGVPGA

SEQ ID NO: 1487977 - protein, 30 aa, Mycobacterium tuberculosis
PATSSPARWCWKCWRDAAPDRSRTTSTSTS

SEQ ID NO: 1487978 - protein, 25 aa, Mycobacterium tuberculosis
PATTREMIKTGGFDAVCFTSSSTVR

SEQ ID NO: 1487979 - protein, 24 aa, Mycobacterium tuberculosis
PATVRYLREFRFRGDIDGYAEGEL

SEQ ID NO: 1487980 - protein, 18 aa, Mycobacterium tuberculosis
PATVYRWQCLFHDKDSER

SEQ ID NO: 1487981 - protein, 18 aa, Mycobacterium tuberculosis
PAVAAVADLAYVGETSDI

SEQ ID NO: 1487982 - protein, 25 aa, Mycobacterium tuberculosis
PAVAGSVGRRCHIAAGDVGPAGPAV

SEQ ID NO: 1487983 - protein, 17 aa, Mycobacterium tuberculosis
PAVGFGGRHERSDAELL

SEQ ID NO: 1487984 - protein, 20 aa, Mycobacterium tuberculosis
PAVHPRWAPTSAAGSAPITV

SEQ ID NO: 1487985 - protein, 24 aa, Mycobacterium tuberculosis
PAVLGLAFDGGWWVLGIRTPTAAE

SEQ ID NO: 1487986 - protein, 40 aa, Mycobacterium tuberculosis
PAVPDHSFFGLLWADVKFEWHALPYLLGFKKACAGFRSLG

SEQ ID NO: 1487987 - protein, 19 aa, Mycobacterium tuberculosis
PAVRDCAVFGLADDRLGQR

SEQ ID NO: 1487988 - protein, 17 aa, Mycobacterium tuberculosis
PAVRSDLVARVGGHVPG

SEQ ID NO: 1487989 - protein, 20 aa, Mycobacterium tuberculosis
PAVVDKLAAVSFGTPFQLLT

SEQ ID NO: 1487990 - protein, 18 aa, Mycobacterium tuberculosis
PAVVVVIRTGWRWRGRGK

SEQ ID NO: 1487991 - protein, 19 aa, Mycobacterium tuberculosis
PAWKWRARETPAAAVAPET

SEQ ID NO: 1487992 - protein, 18 aa, Mycobacterium tuberculosis
PAWLPNPLLANLSQTGGS

SEQ ID NO: 1487993 - protein, 19 aa, Mycobacterium tuberculosis
PCAQVGVGRQWRPQPQFGR

SEQ ID NO: 1487994 - protein, 17 aa, Mycobacterium tuberculosis
PCDASDWLDAALGNAPQ

SEQ ID NO: 1487995 - protein, 19 aa, Mycobacterium tuberculosis
PCEPACVLGINQDPVTIKQ

SEQ ID NO: 1487996 - protein, 26 aa, Mycobacterium tuberculosis
PCGYDLPDRHLRAGGGGGHRLSLSGE

SEQ ID NO: 1487997 - protein, 17 aa, Mycobacterium tuberculosis
PCQQCMGDGRIRARREI

SEQ ID NO: 1487998 - protein, 21 aa, Mycobacterium tuberculosis
PCRHGHGAPSRGLRGRPADRW

SEQ ID NO: 1487999 - protein, 19 aa, Mycobacterium tuberculosis
PCRLERAGHRLGLGRRPRG

SEQ ID NO: 1488000 - protein, 18 aa, Mycobacterium tuberculosis
PCRLSTKHALALTNRGGA

SEQ ID NO: 1488001 - protein, 26 aa, Mycobacterium tuberculosis
PCRPECAPGLPGTRCAAGRQQTEGVG

SEQ ID NO: 1488002 - protein, 24 aa, Mycobacterium tuberculosis
PCSTEVLTALGLPTEMDYMGYADA

SEQ ID NO: 1488003 - protein, 30 aa, Mycobacterium tuberculosis
PDAAGDWFRRLPALPGRRWRPRNRVRLGTV

SEQ ID NO: 1488004 - protein, 20 aa, Mycobacterium tuberculosis
PDATLRLVVDPRKDEVVVEA

SEQ ID NO: 1488005 - protein, 24 aa, Mycobacterium tuberculosis
PDAVGGLYVHWIVTGIAPGSGSTA

SEQ ID NO: 1488006 - protein, 25 aa, Mycobacterium tuberculosis
PDAVGGLYVHWIVTGIAPGSGSTAD

SEQ ID NO: 1488007 - protein, 25 aa, Mycobacterium tuberculosis
PDDERRPRIGFGSGPVGTRQRPRRP

SEQ ID NO: 1488008 - protein, 17 aa, Mycobacterium tuberculosis
PDDPVLHTATLLYSSDT

SEQ ID NO: 1488009 - protein, 27 aa, Mycobacterium tuberculosis
PDDVTVRFLLTAGAIGSLFKERASISG

SEQ ID NO: 1488010 - protein, 25 aa, Mycobacterium tuberculosis
PDEIGSGLAVFHPKGGIVRRELEDY

SEQ ID NO: 1488011 - protein, 25 aa, Mycobacterium tuberculosis
PDELAEALAGFIAEFGLSLVGDCCG

SEQ ID NO: 1488012 - protein, 22 aa, Mycobacterium tuberculosis
PDELNWRVGTVEMFTAATTANL

SEQ ID NO: 1488013 - protein, 18 aa, Mycobacterium tuberculosis
PDEPRAGAGACALQGADG

SEQ ID NO: 1488014 - protein, 21 aa, Mycobacterium tuberculosis
PDFRISLVSPTTVRGGCGYEF

SEQ ID NO: 1488015 - protein, 17 aa, Mycobacterium tuberculosis
PDGKLIHAALRINGFTV

SEQ ID NO: 1488016 - protein, 20 aa, Mycobacterium tuberculosis
PDGLPMLCLGARGWQPGWFT

SEQ ID NO: 1488017 - protein, 20 aa, Mycobacterium tuberculosis
PDGPDRVRISGVIGEPPPPT

SEQ ID NO: 1488018 - protein, 21 aa, Mycobacterium tuberculosis
PDGQGLVAFVGVTHGDDLDKA

SEQ ID NO: 1488019 - protein, 25 aa, Mycobacterium tuberculosis
PDGRLAALLRFSADRAADWYSLGLR

SEQ ID NO: 1488020 - protein, 28 aa, Mycobacterium tuberculosis
PDGVAGWLLLCCGAMLDGAREALSIAES

SEQ ID NO: 1488021 - protein, 30 aa, Mycobacterium tuberculosis
PDHRRRGRQPAWRFHRRQRGGGGRRRGVLH

SEQ ID NO: 1488022 - protein, 18 aa, Mycobacterium tuberculosis
PDIADVLYGIHRWLHGHA

SEQ ID NO: 1488023 - protein, 18 aa, Mycobacterium tuberculosis
PDIDPVLKMLLDTFPVTF

SEQ ID NO: 1488024 - protein, 18 aa, Mycobacterium tuberculosis
PDIKKGLAGVVVDTTAIS

SEQ ID NO: 1488025 - protein, 19 aa, Mycobacterium tuberculosis
PDIMIVVGGVIPPGDFDEL

SEQ ID NO: 1488026 - protein, 17 aa, Mycobacterium tuberculosis
PDIPIPAIHIGINGVVT

SEQ ID NO: 1488027 - protein, 19 aa, Mycobacterium tuberculosis
PDIPIPAIHIGINGVVTVG

SEQ ID NO: 1488028 - protein, 23 aa, Mycobacterium tuberculosis
PDKPCFSYVCPGAGHAPHHVFKE

SEQ ID NO: 1488029 - protein, 19 aa, Mycobacterium tuberculosis
PDKPTWIMPRDSWLIDRAT

SEQ ID NO: 1488030 - protein, 20 aa, Mycobacterium tuberculosis
PDKPTWIMPRDSWLIDRATL

SEQ ID NO: 1488031 - protein, 24 aa, Mycobacterium tuberculosis
PDLDLRVATVAARRRRPPPASLTA

SEQ ID NO: 1488032 - protein, 24 aa, Mycobacterium tuberculosis
PDLDWKSVCGHGWSAAAEAADKPV

SEQ ID NO: 1488033 - protein, 17 aa, Mycobacterium tuberculosis
PDLGFISAASKCFASDV

SEQ ID NO: 1488034 - protein, 17 aa, Mycobacterium tuberculosis
PDLKLGRGGLRDVQLLD

SEQ ID NO: 1488035 - protein, 22 aa, Mycobacterium tuberculosis
PDLRIPFDPREVIARIVDGSEF

SEQ ID NO: 1488036 - protein, 21 aa, Mycobacterium tuberculosis
PDLVPRLRFGDIVRVGSADEH

SEQ ID NO: 1488037 - protein, 21 aa, Mycobacterium tuberculosis
PDMADRVAALAAHAPPERLLR

SEQ ID NO: 1488038 - protein, 21 aa, Mycobacterium tuberculosis
PDMTEHGWATDEWPALYRRVL

SEQ ID NO: 1488039 - protein, 18 aa, Mycobacterium tuberculosis
PDPFCEIESTLLWHVATA

SEQ ID NO: 1488040 - protein, 19 aa, Mycobacterium tuberculosis
PDPPPPGAVVVFSAHGVSP

SEQ ID NO: 1488041 - protein, 17 aa, Mycobacterium tuberculosis
PDPRASLCDIARALRPG

SEQ ID NO: 1488042 - protein, 19 aa, Mycobacterium tuberculosis
PDPVRRVATGVLDVVGALA

SEQ ID NO: 1488043 - protein, 18 aa, Mycobacterium tuberculosis
PDPWPKARHHKRRLLQPA

SEQ ID NO: 1488044 - protein, 18 aa, Mycobacterium tuberculosis
PDQVAALVLLDPAVALDG

SEQ ID NO: 1488045 - protein, 23 aa, Mycobacterium tuberculosis
PDRCGRDGHLVAWLERFNAARAK

SEQ ID NO: 1488046 - protein, 20 aa, Mycobacterium tuberculosis
PDRLRRLLSKQVGLILRRTI

SEQ ID NO: 1488047 - protein, 21 aa, Mycobacterium tuberculosis
PDRLRSGADVADFGCGSGRAV

SEQ ID NO: 1488048 - protein, 19 aa, Mycobacterium tuberculosis
PDRPRIGEILGAFDDKIAA

SEQ ID NO: 1488049 - protein, 17 aa, Mycobacterium tuberculosis
PDRRAAGAARRCPEGAA

SEQ ID NO: 1488050 - protein, 20 aa, Mycobacterium tuberculosis
PDRRLGRRRSLLATNDDHAG

SEQ ID NO: 1488051 - protein, 19 aa, Mycobacterium tuberculosis
PDRRRVVVHPAVIGLAGHR

SEQ ID NO: 1488052 - protein, 19 aa, Mycobacterium tuberculosis
PDRSGIRGAIVVETASASN

SEQ ID NO: 1488053 - protein, 22 aa, Mycobacterium tuberculosis
PDRVAAAAAFHPGGLVANSRDS

SEQ ID NO: 1488054 - protein, 17 aa, Mycobacterium tuberculosis
PDRVDVVLRSKVDAAWH

SEQ ID NO: 1488055 - protein, 22 aa, Mycobacterium tuberculosis
PDRVIDRAPLWCAVDLRDGNQA

SEQ ID NO: 1488056 - protein, 19 aa, Mycobacterium tuberculosis
PDSARHMGLFRSRPAGRSA

SEQ ID NO: 1488057 - protein, 27 aa, Mycobacterium tuberculosis
PDSILRVLAMHRFAKAPMLVGGQMLNL

SEQ ID NO: 1488058 - protein, 23 aa, Mycobacterium tuberculosis
PDSLCGVRVFFPDPWPKARHHKR

SEQ ID NO: 1488059 - protein, 24 aa, Mycobacterium tuberculosis
PDSPEALPLLFGHIGEGNLHLNVL

SEQ ID NO: 1488060 - protein, 19 aa, Mycobacterium tuberculosis
PDTFAGLVALRLPTDEELA

SEQ ID NO: 1488061 - protein, 20 aa, Mycobacterium tuberculosis
PDTKLIVMIGEIGGDAEERA

SEQ ID NO: 1488062 - protein, 22 aa, Mycobacterium tuberculosis
PDVIRLAPPLIIAEAQLDGFVA

SEQ ID NO: 1488063 - protein, 21 aa, Mycobacterium tuberculosis
PDVKPPTWWHSLPTDRPIIYA

SEQ ID NO: 1488064 - protein, 19 aa, Mycobacterium tuberculosis
PDVMLGIVEVLRLITDRGD

SEQ ID NO: 1488065 - protein, 17 aa, Mycobacterium tuberculosis
PDVRVHRSLVCDKPARW

SEQ ID NO: 1488066 - protein, 17 aa, Mycobacterium tuberculosis
PDVVGGKGGDGGKGGSG

SEQ ID NO: 1488067 - protein, 21 aa, Mycobacterium tuberculosis
PDVVQRLSALGLLVSITVTSV

SEQ ID NO: 1488068 - protein, 19 aa, Mycobacterium tuberculosis
PDWDGRTGLVTDLLDERML

SEQ ID NO: 1488069 - protein, 22 aa, Mycobacterium tuberculosis
PDWPAEAVVVGPLHFEPTDRVL

SEQ ID NO: 1488070 - protein, 29 aa, Mycobacterium tuberculosis
PDWVNTIFLSTRFRAWRVGGYNEYLYTFF

SEQ ID NO: 1488071 - protein, 17 aa, Mycobacterium tuberculosis
PDYGLDLGPDNKPTGSR

SEQ ID NO: 1488072 - protein, 17 aa, Mycobacterium tuberculosis
PDYLMQVLARFARYLRE

SEQ ID NO: 1488073 - protein, 22 aa, Mycobacterium tuberculosis
PDYLVTFASLWVSVNVEDWKCW

SEQ ID NO: 1488074 - protein, 25 aa, Mycobacterium tuberculosis
PEAAPSRSVMAGRAAPVVPVGITVA

SEQ ID NO: 1488075 - protein, 26 aa, Mycobacterium tuberculosis
PEADGFQWSFAGPRRLRGIRGDVRLF

SEQ ID NO: 1488076 - protein, 25 aa, Mycobacterium tuberculosis
PEAGEAILTGWRMLLDEGRLQDGEP

SEQ ID NO: 1488077 - protein, 23 aa, Mycobacterium tuberculosis
PEAGGLARYGSPFVPLKPNSNPP

SEQ ID NO: 1488078 - protein, 24 aa, Mycobacterium tuberculosis
PEAGGLARYGSPFVPLKPNSNPPL

SEQ ID NO: 1488079 - protein, 27 aa, Mycobacterium tuberculosis
PEAGVVCGVGKPAGKTAFVFAGQGSQW

SEQ ID NO: 1488080 - protein, 20 aa, Mycobacterium tuberculosis
PEAIAYGLIPRAHRGIVAVN

SEQ ID NO: 1488081 - protein, 26 aa, Mycobacterium tuberculosis
PEAITRPRWLWKFAKTLRPPDLRVPN

SEQ ID NO: 1488082 - protein, 17 aa, Mycobacterium tuberculosis
PEALAWPLLAVIDASLD

SEQ ID NO: 1488083 - protein, 18 aa, Mycobacterium tuberculosis
PEALDLVYSLGFTLTGLL

SEQ ID NO: 1488084 - protein, 22 aa, Mycobacterium tuberculosis
PEALLGPWVRTLLHSIYDQPDA

SEQ ID NO: 1488085 - protein, 19 aa, Mycobacterium tuberculosis
PEALWDFLCERRSSISQVP

SEQ ID NO: 1488086 - protein, 25 aa, Mycobacterium tuberculosis
PEAPADAPVVGWAVLVGPAGPAAMA

SEQ ID NO: 1488087 - protein, 22 aa, Mycobacterium tuberculosis
PEAPRITAPRIRGGGRASVGLP

SEQ ID NO: 1488088 - protein, 17 aa, Mycobacterium tuberculosis
PEAPVFPLPPKPPRTPW

SEQ ID NO: 1488089 - protein, 28 aa, Mycobacterium tuberculosis
PEAVVIRRLPHPVLRGAVAGDRGLDRVG

SEQ ID NO: 1488090 - protein, 20 aa, Mycobacterium tuberculosis
PECGCATSALYLAGEGAFPA

SEQ ID NO: 1488091 - protein, 38 aa, Mycobacterium tuberculosis
PECWAAGADEVSVAGAVPCFFGHAQAYQTLGTQAAAFH

SEQ ID NO: 1488092 - protein, 17 aa, Mycobacterium tuberculosis
PEDLGWHTICAVMTTEF

SEQ ID NO: 1488093 - protein, 23 aa, Mycobacterium tuberculosis
PEETLRWLYEMMVVTRELDTEFV

SEQ ID NO: 1488094 - protein, 18 aa, Mycobacterium tuberculosis
PEETRYWYYALLGFGLNR

SEQ ID NO: 1488095 - protein, 19 aa, Mycobacterium tuberculosis
PEEVRNCFADMAKVAIALG

SEQ ID NO: 1488096 - protein, 20 aa, Mycobacterium tuberculosis
PEFAEDWVNLVALAVNEENA

SEQ ID NO: 1488097 - protein, 17 aa, Mycobacterium tuberculosis
PEFMLGDGMQRENPPQV

SEQ ID NO: 1488098 - protein, 17 aa, Mycobacterium tuberculosis
PEFPRLWAEMVGPGQGW

SEQ ID NO: 1488099 - protein, 22 aa, Mycobacterium tuberculosis
PEFTDTGAFPFLAVEGPGVYEI

SEQ ID NO: 1488100 - protein, 23 aa, Mycobacterium tuberculosis
PEFTDTGAFPFLAVEGPGVYEIP

SEQ ID NO: 1488101 - protein, 19 aa, Mycobacterium tuberculosis
PEGASAIVFRDTAHAAELA

SEQ ID NO: 1488102 - protein, 20 aa, Mycobacterium tuberculosis
PEGLRPDDAMIMFTGGTTGL

SEQ ID NO: 1488103 - protein, 17 aa, Mycobacterium tuberculosis
PEGTRFLVLAPVVRTRK

SEQ ID NO: 1488104 - protein, 18 aa, Mycobacterium tuberculosis
PEGTRYVLSITWSDVETP

SEQ ID NO: 1488105 - protein, 17 aa, Mycobacterium tuberculosis
PEHPPVGVVVFVGGASS

SEQ ID NO: 1488106 - protein, 21 aa, Mycobacterium tuberculosis
PEHPPVGVVVFVGGASSRLDD

SEQ ID NO: 1488107 - protein, 25 aa, Mycobacterium tuberculosis
PEIDSLRMYLGAGSAPMLQAAAAWD

SEQ ID NO: 1488108 - protein, 20 aa, Mycobacterium tuberculosis
PEINSGRMFFGAGSGPMLAA

SEQ ID NO: 1488109 - protein, 35 aa, Mycobacterium tuberculosis
PEINSGRMFFGAGSGPMLAAAAWDGLAAELGLAAE

SEQ ID NO: 1488110 - protein, 21 aa, Mycobacterium tuberculosis
PEINSLRMYLGAGSAPMLQAA

SEQ ID NO: 1488111 - protein, 22 aa, Mycobacterium tuberculosis
PEINSLRMYLGAGSAPMLQAAA

SEQ ID NO: 1488112 - protein, 23 aa, Mycobacterium tuberculosis
PEIPKSSLGAGLGLRSGLSAGLA

SEQ ID NO: 1488113 - protein, 18 aa, Mycobacterium tuberculosis
PEIREVRRSDFCGHYIGE

SEQ ID NO: 1488114 - protein, 20 aa, Mycobacterium tuberculosis
PEKHQLGLGDPHEHRGPADT

SEQ ID NO: 1488115 - protein, 23 aa, Mycobacterium tuberculosis
PEKIAAACVEFVFGPLLNNPHRL

SEQ ID NO: 1488116 - protein, 17 aa, Mycobacterium tuberculosis
PELAFAEYRSCAKAQAL

SEQ ID NO: 1488117 - protein, 21 aa, Mycobacterium tuberculosis
PELATLMAHVKLGLKEEVLAT

SEQ ID NO: 1488118 - protein, 18 aa, Mycobacterium tuberculosis
PELGYRLLQRLGADVADY

SEQ ID NO: 1488119 - protein, 25 aa, Mycobacterium tuberculosis
PELISRWAAYWPPAGAEALFRSLSE

SEQ ID NO: 1488120 - protein, 19 aa, Mycobacterium tuberculosis
PELMSELLWSRIGAQCDAT

SEQ ID NO: 1488121 - protein, 19 aa, Mycobacterium tuberculosis
PELRATIEAVWAKLAAPGM

SEQ ID NO: 1488122 - protein, 20 aa, Mycobacterium tuberculosis
PELRERAVRMVAEIRGQHDS

SEQ ID NO: 1488123 - protein, 21 aa, Mycobacterium tuberculosis
PELYDPEILTARYSVGAVDAV

SEQ ID NO: 1488124 - protein, 20 aa, Mycobacterium tuberculosis
PEMDPSGAGKWLLISDCAAS

SEQ ID NO: 1488125 - protein, 21 aa, Mycobacterium tuberculosis
PEMTVLVGGLRVLGANYKRLP

SEQ ID NO: 1488126 - protein, 29 aa, Mycobacterium tuberculosis
PENFWRSAGLPEFRWPDPNGTRFPNGAPP

SEQ ID NO: 1488127 - protein, 23 aa, Mycobacterium tuberculosis
PEPHGIGGFPRWDPGRWAASGYR

SEQ ID NO: 1488128 - protein, 17 aa, Mycobacterium tuberculosis
PEPISYTALDRGDLQRA

SEQ ID NO: 1488129 - protein, 26 aa, Mycobacterium tuberculosis
PEPLMPPAMALPPWPPTPPAPPANPV

SEQ ID NO: 1488130 - protein, 23 aa, Mycobacterium tuberculosis
PEPLRMARDLVRVGLDALALDIY

SEQ ID NO: 1488131 - protein, 18 aa, Mycobacterium tuberculosis
PEPPLPGQWPFVRGGDPL

SEQ ID NO: 1488132 - protein, 18 aa, Mycobacterium tuberculosis
PEPTEAWNSALLSGPSGR

SEQ ID NO: 1488133 - protein, 23 aa, Mycobacterium tuberculosis
PEPVGITAVAARAGHPAQDTRHG

SEQ ID NO: 1488134 - protein, 24 aa, Mycobacterium tuberculosis
PEPVGITAVAARAGHPAQDTRHGR

SEQ ID NO: 1488135 - protein, 23 aa, Mycobacterium tuberculosis
PEPWRVEALVLLAFSAYARGDGP

SEQ ID NO: 1488136 - protein, 18 aa, Mycobacterium tuberculosis
PEQLLKILARETGADLTL

SEQ ID NO: 1488137 - protein, 21 aa, Mycobacterium tuberculosis
PEQPLPLAINVIGHINALSTP

SEQ ID NO: 1488138 - protein, 28 aa, Mycobacterium tuberculosis
PEQYREGMARAWGPVRVAIAAEQAHGAK

SEQ ID NO: 1488139 - protein, 18 aa, Mycobacterium tuberculosis
PERLGVLASHHDNAAVDA

SEQ ID NO: 1488140 - protein, 20 aa, Mycobacterium tuberculosis
PERLPGNHPLAAHFNVYQWL

SEQ ID NO: 1488141 - protein, 22 aa, Mycobacterium tuberculosis
PERLPGNHPLAAHFNVYQWLTV

SEQ ID NO: 1488142 - protein, 22 aa, Mycobacterium tuberculosis
PERPSSSAVWRCLSGIRRSRLP

SEQ ID NO: 1488143 - protein, 24 aa, Mycobacterium tuberculosis
PERPSSWYRRPRTPINSTQVRRAA

SEQ ID NO: 1488144 - protein, 33 aa, Mycobacterium tuberculosis
PERTSALNATWRSATCRVLAAATGARTANAGPV

SEQ ID NO: 1488145 - protein, 23 aa, Mycobacterium tuberculosis
PERYYDMLRKFGLGQRTGVGLPG

SEQ ID NO: 1488146 - protein, 20 aa, Mycobacterium tuberculosis
PESLRLSRTGVFVGVSSTDY

SEQ ID NO: 1488147 - protein, 20 aa, Mycobacterium tuberculosis
PESLRRLDRVDAIVIDPRVL

SEQ ID NO: 1488148 - protein, 20 aa, Mycobacterium tuberculosis
PETIAYGLIPRAHRGIVAVN

SEQ ID NO: 1488149 - protein, 20 aa, Mycobacterium tuberculosis
PETVAAAASDVARIGSSIGA

SEQ ID NO: 1488150 - protein, 17 aa, Mycobacterium tuberculosis
PEVEVEGIISLKTGGCP

SEQ ID NO: 1488151 - protein, 19 aa, Mycobacterium tuberculosis
PEVHSALLSAGPGPGSLQA

SEQ ID NO: 1488152 - protein, 28 aa, Mycobacterium tuberculosis
PEVIGDRFGFCGYCMGGRMSVVVAGRLP

SEQ ID NO: 1488153 - protein, 33 aa, Mycobacterium tuberculosis
PEVIGDRFGVCGYCMGGRMSVVVAGRLPDRVAA

SEQ ID NO: 1488154 - protein, 25 aa, Mycobacterium tuberculosis
PEVLEWRYPVLLREFAVRQGSGGAG

SEQ ID NO: 1488155 - protein, 17 aa, Mycobacterium tuberculosis
PEVLSKVRAVRKMVDAG

SEQ ID NO: 1488156 - protein, 20 aa, Mycobacterium tuberculosis
PEVLWLAQRARQAWDGVRIV

SEQ ID NO: 1488157 - protein, 18 aa, Mycobacterium tuberculosis
PEVMSAAATDVASIGSVV

SEQ ID NO: 1488158 - protein, 23 aa, Mycobacterium tuberculosis
PEVRALLSAYCETWSVYVAAVQR

SEQ ID NO: 1488159 - protein, 31 aa, Mycobacterium tuberculosis
PEVSAPAAGPARPASPAVLAARAGFARGGGR

SEQ ID NO: 1488160 - protein, 23 aa, Mycobacterium tuberculosis
PFADPGNPLAILVPLTAAAMDLV

SEQ ID NO: 1488161 - protein, 19 aa, Mycobacterium tuberculosis
PFAELGLNSLMAMAIRREA

SEQ ID NO: 1488162 - protein, 20 aa, Mycobacterium tuberculosis
PFAELGLNSLMAMAIRREAE

SEQ ID NO: 1488163 - protein, 30 aa, Mycobacterium tuberculosis
PFAELGLNSLMAMAIRREAEQFVGIELSAT

SEQ ID NO: 1488164 - protein, 31 aa, Mycobacterium tuberculosis
PFAELGLNSLMAMAIRREAEQFVGIELSATM

SEQ ID NO: 1488165 - protein, 25 aa, Mycobacterium tuberculosis
PFAGHPTVGASWWLRERGTPINTLQ

SEQ ID NO: 1488166 - protein, 18 aa, Mycobacterium tuberculosis
PFAPCALPPTLAPPAPPA

SEQ ID NO: 1488167 - protein, 24 aa, Mycobacterium tuberculosis
PFAPPEPFRAGFALTPPAPPLPPT

SEQ ID NO: 1488168 - protein, 18 aa, Mycobacterium tuberculosis
PFDLLAVVPPHVPSAAAR

SEQ ID NO: 1488169 - protein, 20 aa, Mycobacterium tuberculosis
PFEDGGWVWFDITTDTAVTL

SEQ ID NO: 1488170 - protein, 18 aa, Mycobacterium tuberculosis
PFEKAVVVPLDPTSTFAL

SEQ ID NO: 1488171 - protein, 26 aa, Mycobacterium tuberculosis
PFEPWSVADFSRYLSTLGLPAAGDAV

SEQ ID NO: 1488172 - protein, 18 aa, Mycobacterium tuberculosis
PFFAQGLLNRRAVLKSSY

SEQ ID NO: 1488173 - protein, 22 aa, Mycobacterium tuberculosis
PFGCPERSTSIWRSAIAARTAI

SEQ ID NO: 1488174 - protein, 22 aa, Mycobacterium tuberculosis
PFGCRMGICQSCVVDLVEGHVR

SEQ ID NO: 1488175 - protein, 20 aa, Mycobacterium tuberculosis
PFGGSGARLMTTVLHHMPDK

SEQ ID NO: 1488176 - protein, 18 aa, Mycobacterium tuberculosis
PFHVLSMSGEIDVVAVTA

SEQ ID NO: 1488177 - protein, 18 aa, Mycobacterium tuberculosis
PFLEHFVMRSRYVDNPGL

SEQ ID NO: 1488178 - protein, 30 aa, Mycobacterium tuberculosis
PFLHPDLVWDFRLPRVVSINVSGHKYGLTY

SEQ ID NO: 1488179 - protein, 31 aa, Mycobacterium tuberculosis; identical to SEQ ID NO: 1245085

SEQ ID NO: 1488180 - protein, 19 aa, Mycobacterium tuberculosis
PFMEFTPGYVLRSLDELPK

SEQ ID NO: 1488181 - protein, 27 aa, Mycobacterium tuberculosis
PFPKECPAPGVMQGCLESTSGLIMGID

SEQ ID NO: 1488182 - protein, 22 aa, Mycobacterium tuberculosis
PFPPRVYLRLTLESRCESCQRR

SEQ ID NO: 1488183 - protein, 32 aa, Mycobacterium tuberculosis
PFPTTARLTGRWLRGRLPTLNDWLRGRCWTAR

SEQ ID NO: 1488184 - protein, 18 aa, Mycobacterium tuberculosis
PFRQNCRPSVRYPQTETE

SEQ ID NO: 1488185 - protein, 19 aa, Mycobacterium tuberculosis
PFVPYQNFDALRTLALPFG

SEQ ID NO: 1488186 - protein, 18 aa, Mycobacterium tuberculosis
PFVTLGIHIGARTTSIVA

SEQ ID NO: 1488187 - protein, 19 aa, Mycobacterium tuberculosis
PFYVWDFAEKFKEDVINDF

SEQ ID NO: 1488188 - protein, 17 aa, Mycobacterium tuberculosis
PGAAALAFPSLSSSVPI

SEQ ID NO: 1488189 - protein, 17 aa, Mycobacterium tuberculosis
PGAAGTGGDGGVGGTGA

SEQ ID NO: 1488190 - protein, 23 aa, Mycobacterium tuberculosis
PGADLRAPCALPVLVIDGRDEKH

SEQ ID NO: 1488191 - protein, 26 aa, Mycobacterium tuberculosis
PGAEASWVVGITWWSAVVGGFQMSFV

SEQ ID NO: 1488192 - protein, 19 aa, Mycobacterium tuberculosis
PGANGIAGNGGDGGDGAAG

SEQ ID NO: 1488193 - protein, 25 aa, Mycobacterium tuberculosis
PGAPAEMWLRAVMAHPVANGGQWWQ

SEQ ID NO: 1488194 - protein, 30 aa, Mycobacterium tuberculosis
PGAPLAPLPINGRPVFARKNSLIGSSSGDT

SEQ ID NO: 1488195 - protein, 21 aa, Mycobacterium tuberculosis
PGAPRPGGRPGAPGAGRSDAG

SEQ ID NO: 1488196 - protein, 17 aa, Mycobacterium tuberculosis
PGARLVSTPSWRTEITH

SEQ ID NO: 1488197 - protein, 17 aa, Mycobacterium tuberculosis
PGASVCTSIGSAARPRA

SEQ ID NO: 1488198 - protein, 27 aa, Mycobacterium tuberculosis
PGATAFPWRRQSALVQWYVETSGSPSE

SEQ ID NO: 1488199 - protein, 20 aa, Mycobacterium tuberculosis
PGATVALTFQDPSGGSRTVQ

SEQ ID NO: 1488200 - protein, 18 aa, Mycobacterium tuberculosis
PGAVARARRAALAAAGAS

SEQ ID NO: 1488201 - protein, 27 aa, Mycobacterium tuberculosis
PGCPFAPRCPLVIDECLTAEPELLDVA

SEQ ID NO: 1488202 - protein, 20 aa, Mycobacterium tuberculosis
PGCRGWPRRRAAARASVRHA

SEQ ID NO: 1488203 - protein, 19 aa, Mycobacterium tuberculosis
PGDEISLGATSWRITEITH

SEQ ID NO: 1488204 - protein, 21 aa, Mycobacterium tuberculosis
PGDERHMLWFELMKPMTSTAT

SEQ ID NO: 1488205 - protein, 28 aa, Mycobacterium tuberculosis
PGDGGNGATGTWGHNLGAGGTGGNGGNP

SEQ ID NO: 1488206 - protein, 18 aa, Mycobacterium tuberculosis
PGDGWRVAMATLTFERGV

SEQ ID NO: 1488207 - protein, 17 aa, Mycobacterium tuberculosis
PGDPGGFGAAGADGLPG

SEQ ID NO: 1488208 - protein, 20 aa, Mycobacterium tuberculosis
PGDQPGKWSLMAQGVYAPAI

SEQ ID NO: 1488209 - protein, 26 aa, Mycobacterium tuberculosis
PGDQRVLGAALWYAATVKDAVIVAAA

SEQ ID NO: 1488210 - protein, 32 aa, Mycobacterium tuberculosis; identical to SEQ ID NO: 233993

SEQ ID NO: 1488211 - protein, 17 aa, Mycobacterium tuberculosis
PGELAIERGEPWPQPVP

SEQ ID NO: 1488212 - protein, 17 aa, Mycobacterium tuberculosis
PGEPLWLGSVKSNMGHT

SEQ ID NO: 1488213 - protein, 23 aa, Mycobacterium tuberculosis
PGERIRVVRRVHLRYEGTDTAIP

SEQ ID NO: 1488214 - protein, 32 aa, Mycobacterium tuberculosis
PGFTIPGGTLIPQLPLGLGLSGGTPPFDLPTV

SEQ ID NO: 1488215 - protein, 20 aa, Mycobacterium tuberculosis
PGFTIPGGTLIPTLPLGLAL

SEQ ID NO: 1488216 - protein, 24 aa, Mycobacterium tuberculosis
PGGAGGTGGRGFLNDGGVGGAGGN

SEQ ID NO: 1488217 - protein, 26 aa, Mycobacterium tuberculosis
PGGARSGLRAAVDILEHIDHIHIAEL

SEQ ID NO: 1488218 - protein, 30 aa, Mycobacterium tuberculosis
PGGASRRWRPIWRVSGRRSAPAKRGRRGPD

SEQ ID NO: 1488219 - protein, 23 aa, Mycobacterium tuberculosis
PGGAVIIAGFPFLDLGNVTIGGF

SEQ ID NO: 1488220 - protein, 20 aa, Mycobacterium tuberculosis
PGGEGRLRLTEPDDMLTTGI

SEQ ID NO: 1488221 - protein, 17 aa, Mycobacterium tuberculosis
PGGFGGNGADGGNGGNG

SEQ ID NO: 1488222 - protein, 26 aa, Mycobacterium tuberculosis
PGGFWCWSRRLIVVVGHGGDGGPAAP

SEQ ID NO: 1488223 - protein, 21 aa, Mycobacterium tuberculosis
PGGGLLPAWSPGGHIDVQLPS

SEQ ID NO: 1488224 - protein, 34 aa, Mycobacterium tuberculosis
PGGHCRGVCLGGYLLQGGYGWNSRIYGPACESVI

SEQ ID NO: 1488225 - protein, 28 aa, Mycobacterium tuberculosis
PGGHCRGVCLGGYLLQGGYGWTAGSTAR

SEQ ID NO: 1488226 - protein, 28 aa, Mycobacterium tuberculosis
PGGHFPGWIPILASKVVFVGKHPADHIA

SEQ ID NO: 1488227 - protein, 23 aa, Mycobacterium tuberculosis
PGGHGGSVLSGPVGDSGNGGAGG

SEQ ID NO: 1488228 - protein, 18 aa, Mycobacterium tuberculosis
PGGHVFRPDMFRLDLDGI

SEQ ID NO: 1488229 - protein, 24 aa, Mycobacterium tuberculosis
PGGIGVNTGTGWAYGGNGGNGGDG

SEQ ID NO: 1488230 - protein, 25 aa, Mycobacterium tuberculosis
PGGIGVNTGTGWAYGGNGGNGGDGG

SEQ ID NO: 1488231 - protein, 19 aa, Mycobacterium tuberculosis
PGGPFDWRLPDLVGAQPSI

SEQ ID NO: 1488232 - protein, 21 aa, Mycobacterium tuberculosis
PGGPGQPGTEFGQTGGTGGTG

SEQ ID NO: 1488233 - protein, 26 aa, Mycobacterium tuberculosis
PGGRRCWRLIPLASAGRPCGGGRDPR

SEQ ID NO: 1488234 - protein, 23 aa, Mycobacterium tuberculosis
PGGSGGNGGVWYGNGGAAGAAGQ

SEQ ID NO: 1488235 - protein, 17 aa, Mycobacterium tuberculosis
PGGTAFPHCSGVLVAGD

SEQ ID NO: 1488236 - protein, 26 aa, Mycobacterium tuberculosis
PGGTIGVISWTCEGFFGRMLATIRPY

SEQ ID NO: 1488237 - protein, 24 aa, Mycobacterium tuberculosis
PGGYCGYLPYNLTTSGFRPATFAA

SEQ ID NO: 1488238 - protein, 22 aa, Mycobacterium tuberculosis
PGGYLKAAVDFALDRDDYGPDL

SEQ ID NO: 1488239 - protein, 17 aa, Mycobacterium tuberculosis
PGHAVLWGLGRSLALEH

SEQ ID NO: 1488240 - protein, 40 aa, Mycobacterium tuberculosis
PGHGLDGRVDCGQRLLLRGVQRVGAGRGVGAVQTQQQPTD

SEQ ID NO: 1488241 - protein, 18 aa, Mycobacterium tuberculosis
PGIDLVVAAEAGMTTGMP

SEQ ID NO: 1488242 - protein, 18 aa, Mycobacterium tuberculosis
PGIELTKRTLWSGLDAAS

SEQ ID NO: 1488243 - protein, 25 aa, Mycobacterium tuberculosis
PGIHHRDMMWICRDGDRAKNHLLEA

SEQ ID NO: 1488244 - protein, 22 aa, Mycobacterium tuberculosis
PGIPAWRRILDDLSYEPVMAPL

SEQ ID NO: 1488245 - protein, 25 aa, Mycobacterium tuberculosis
PGIPMSAPRAVRCCSPACATSAAAS

SEQ ID NO: 1488246 - protein, 18 aa, Mycobacterium tuberculosis
PGKLPAIRQQIWTLIRAA

SEQ ID NO: 1488247 - protein, 25 aa, Mycobacterium tuberculosis
PGKPVRLPIPWRDVGGYRPTGRSIA

SEQ ID NO: 1488248 - protein, 23 aa, Mycobacterium tuberculosis
PGKRAPTVQLCRDPRGYVPVGTN

SEQ ID NO: 1488249 - protein, 18 aa, Mycobacterium tuberculosis
PGLFAVLVGQHMQIADVQ

SEQ ID NO: 1488250 - protein, 19 aa, Mycobacterium tuberculosis
PGLGGRGGLLLGLPGANGT

SEQ ID NO: 1488251 - protein, 19 aa, Mycobacterium tuberculosis
PGLGGRGRLLLGLPGANGT

SEQ ID NO: 1488252 - protein, 17 aa, Mycobacterium tuberculosis
PGLGVGLLGLFDGSIAN

SEQ ID NO: 1488253 - protein, 20 aa, Mycobacterium tuberculosis
PGLIGHGGAGVTCGAAPEPW

SEQ ID NO: 1488254 - protein, 18 aa, Mycobacterium tuberculosis
PGLIPGASRGRGLGLDFL

SEQ ID NO: 1488255 - protein, 19 aa, Mycobacterium tuberculosis
PGLLDLPAPAPVDLRRLLP

SEQ ID NO: 1488256 - protein, 17 aa, Mycobacterium tuberculosis
PGLMILGRQGCGKTTAL

SEQ ID NO: 1488257 - protein, 31 aa, Mycobacterium tuberculosis; identical to SEQ ID NO: 1376437

SEQ ID NO: 1488258 - protein, 17 aa, Mycobacterium tuberculosis
PGLPRGLPPGVVANLAA

SEQ ID NO: 1488259 - protein, 17 aa, Mycobacterium tuberculosis
PGLRALQKYAVRTGGGV

SEQ ID NO: 1488260 - protein, 17 aa, Mycobacterium tuberculosis
PGMLHRHSAHNEAVARI

SEQ ID NO: 1488261 - protein, 18 aa, Mycobacterium tuberculosis
PGMNGIDVCRVLRADSGV

SEQ ID NO: 1488262 - protein, 18 aa, Mycobacterium tuberculosis
PGMSLFDIHELVNIGPFR

SEQ ID NO: 1488263 - protein, 19 aa, Mycobacterium tuberculosis
PGMVKRGAGAVLNIASIAG

SEQ ID NO: 1488264 - protein, 23 aa, Mycobacterium tuberculosis
PGNPRVLSIAQFWDRAAGHDRIN

SEQ ID NO: 1488265 - protein, 20 aa, Mycobacterium tuberculosis
PGNRCARPGIAAGPTRMPAP

SEQ ID NO: 1488266 - protein, 21 aa, Mycobacterium tuberculosis
PGNWRPEIRRELSTLDRATAD

SEQ ID NO: 1488267 - protein, 22 aa, Mycobacterium tuberculosis
PGPDIDGGIDLTDDEFQAFLQA

SEQ ID NO: 1488268 - protein, 17 aa, Mycobacterium tuberculosis
PGPDRIAQILAELATLF

SEQ ID NO: 1488269 - protein, 19 aa, Mycobacterium tuberculosis
PGPDSMLAAARAWRSLDVE

SEQ ID NO: 1488270 - protein, 19 aa, Mycobacterium tuberculosis
PGPGGFRGGLPVAGGRQDH

SEQ ID NO: 1488271 - protein, 23 aa, Mycobacterium tuberculosis
PGPPACFALCAGFHPHHPGPASG

SEQ ID NO: 1488272 - protein, 29 aa, Mycobacterium tuberculosis
PGPPFPLYMAGARLDSLVPLGPPVMDVAL

SEQ ID NO: 1488273 - protein, 30 aa, Mycobacterium tuberculosis
PGPPFPLYMAGARLDSLVPLGPPVMDVALN

SEQ ID NO: 1488274 - protein, 19 aa, Mycobacterium tuberculosis
PGPPSPPFPINRALPPLPP

SEQ ID NO: 1488275 - protein, 17 aa, Mycobacterium tuberculosis
PGPRAQFLTALAGVMRP

SEQ ID NO: 1488276 - protein, 18 aa, Mycobacterium tuberculosis
PGPSSARGAEEFVEVSWD

SEQ ID NO: 1488277 - protein, 19 aa, Mycobacterium tuberculosis
PGPTNFGLNGAGGGGGVGG

SEQ ID NO: 1488278 - protein, 25 aa, Mycobacterium tuberculosis
PGQGSQWLGMGIELLDTAPAFAQQI

SEQ ID NO: 1488279 - protein, 18 aa, Mycobacterium tuberculosis
PGQPGGAGGLLFGNGGNG

SEQ ID NO: 1488280 - protein, 23 aa, Mycobacterium tuberculosis
PGQPGGAGGLLFGNGGNGAAGAV

SEQ ID NO: 1488281 - protein, 19 aa, Mycobacterium tuberculosis
PGQPGGRGGAAGLIGNGGA

SEQ ID NO: 1488282 - protein, 19 aa, Mycobacterium tuberculosis
PGQVGFRGGQALPQAQLVE

SEQ ID NO: 1488283 - protein, 18 aa, Mycobacterium tuberculosis
PGRLPDLSPAVLFDDPVD

SEQ ID NO: 1488284 - protein, 24 aa, Mycobacterium tuberculosis
PGRLSSRFWRLLGASTEKNRRRSL

SEQ ID NO: 1488285 - protein, 18 aa, Mycobacterium tuberculosis
PGRPEWIAAGQFAQRYEQ

SEQ ID NO: 1488286 - protein, 18 aa, Mycobacterium tuberculosis
PGRPRWATSATKLIPPRR

SEQ ID NO: 1488287 - protein, 20 aa, Mycobacterium tuberculosis
PGRRCRVGLGRAVFTHVSGI

SEQ ID NO: 1488288 - protein, 23 aa, Mycobacterium tuberculosis
PGRRPYCGPGCSPRCRDSRLRRA

SEQ ID NO: 1488289 - protein, 21 aa, Mycobacterium tuberculosis
PGRTRIAVRLAGRVVACHGGL

SEQ ID NO: 1488290 - protein, 23 aa, Mycobacterium tuberculosis
PGRVKTRLAAAMGDKVAADIAAA

SEQ ID NO: 1488291 - protein, 23 aa, Mycobacterium tuberculosis
PGSARPSWPRAWPQPTDPVLFRR

SEQ ID NO: 1488292 - protein, 25 aa, Mycobacterium tuberculosis
PGSATRMSATPAWGTRAPATGACGT

SEQ ID NO: 1488293 - protein, 19 aa, Mycobacterium tuberculosis
PGSDGLGGDAFNGSRGTDG

SEQ ID NO: 1488294 - protein, 26 aa, Mycobacterium tuberculosis
PGSGAPRPVPPVPPMPPAPKRMPALP

SEQ ID NO: 1488295 - protein, 23 aa, Mycobacterium tuberculosis
PGSGARGRLRCGGRRCQPGGPGS

SEQ ID NO: 1488296 - protein, 35 aa, Mycobacterium tuberculosis
PGSGGIRGPLGLGFRVPCIVISPYSRGPLMVSDTF

SEQ ID NO: 1488297 - protein, 17 aa, Mycobacterium tuberculosis
PGSGLGLAIVKQVVLNH

SEQ ID NO: 1488298 - protein, 18 aa, Mycobacterium tuberculosis
PGSIDAITLFPGGLTFPA

SEQ ID NO: 1488299 - protein, 19 aa, Mycobacterium tuberculosis
PGSIICWHASPTAKAKARQ

SEQ ID NO: 1488300 - protein, 17 aa, Mycobacterium tuberculosis
PGSLGVSGTEGMAGAPG

SEQ ID NO: 1488301 - protein, 17 aa, Mycobacterium tuberculosis
PGSMASSGMPRRSSSSS

SEQ ID NO: 1488302 - protein, 18 aa, Mycobacterium tuberculosis
PGSMPWSVVTVVPTSTSA

SEQ ID NO: 1488303 - protein, 18 aa, Mycobacterium tuberculosis
PGSNVALCVGMCGQLIYV

SEQ ID NO: 1488304 - protein, 24 aa, Mycobacterium tuberculosis
PGSPCSYTPPADGLPRPWDPLPCA

SEQ ID NO: 1488305 - protein, 18 aa, Mycobacterium tuberculosis
PGSRSCGTSASTSARTAR

SEQ ID NO: 1488306 - protein, 19 aa, Mycobacterium tuberculosis
PGSVVKVYYTRQSDSDRSS

SEQ ID NO: 1488307 - protein, 26 aa, Mycobacterium tuberculosis
PGTGANGGDAGWLIGNGGAGGSGAKG

SEQ ID NO: 1488308 - protein, 22 aa, Mycobacterium tuberculosis
PGTGAPEVHRWWTSLTSEERQR

SEQ ID NO: 1488309 - protein, 27 aa, Mycobacterium tuberculosis
PGTGDDGGAGGWLFGNGGNGGAGAAGT

SEQ ID NO: 1488310 - protein, 19 aa, Mycobacterium tuberculosis
PGTGMPAAPMVPPTGSPGG

SEQ ID NO: 1488311 - protein, 25 aa, Mycobacterium tuberculosis
PGTGQARGAGGILWGNGGNGGSGAP

SEQ ID NO: 1488312 - protein, 29 aa, Mycobacterium tuberculosis
PGTRLRQEHLPWAAAIATRGRSCYDRVAR

SEQ ID NO: 1488313 - protein, 21 aa, Mycobacterium tuberculosis
PGVDLRAGIACQLRDLGVESI

SEQ ID NO: 1488314 - protein, 19 aa, Mycobacterium tuberculosis
PGVLRRRLRDRLREDHRHL

SEQ ID NO: 1488315 - protein, 25 aa, Mycobacterium tuberculosis
PGVPGRTDCKWGAYLDNVGDFDPEF

SEQ ID NO: 1488316 - protein, 26 aa, Mycobacterium tuberculosis
PGVPGRTDCKWGAYLDNVGDFDPEFF

SEQ ID NO: 1488317 - protein, 21 aa, Mycobacterium tuberculosis
PGVTVTIGITCHRTGPNAPCV

SEQ ID NO: 1488318 - protein, 24 aa, Mycobacterium tuberculosis
PGVTVTIGITCHRTGPNAPCVELS

SEQ ID NO: 1488319 - protein, 17 aa, Mycobacterium tuberculosis
PGWLWPHPPEALAPRYV

SEQ ID NO: 1488320 - protein, 20 aa, Mycobacterium tuberculosis
PGYGEMFSALGFDGLVRSAR

SEQ ID NO: 1488321 - protein, 18 aa, Mycobacterium tuberculosis
PGYRVRLQLRTRGNHVEP

SEQ ID NO: 1488322 - protein, 25 aa, Mycobacterium tuberculosis
PHECCRLRKVVPLGKDAAWLLRVGD

SEQ ID NO: 1488323 - protein, 24 aa, Mycobacterium tuberculosis
PHEECEVLVGLGMRTWADGRTLLL

SEQ ID NO: 1488324 - protein, 17 aa, Mycobacterium tuberculosis
PHERYRPADSAAVELPD

SEQ ID NO: 1488325 - protein, 17 aa, Mycobacterium tuberculosis
PHGVAVNPGGNVYVTNF

SEQ ID NO: 1488326 - protein, 20 aa, Mycobacterium tuberculosis
PHGYPIVLTHGFVCAIRAWA

SEQ ID NO: 1488327 - protein, 22 aa, Mycobacterium tuberculosis
PHGYPIVLTHGFVCAIRAWAYQ

SEQ ID NO: 1488328 - protein, 29 aa, Mycobacterium tuberculosis
PHHRWPRHILDVKSAIAWARANVDKFGGD

SEQ ID NO: 1488329 - protein, 19 aa, Mycobacterium tuberculosis
PHHRWPRHILDVKTAIAWA

SEQ ID NO: 1488330 - protein, 17 aa, Mycobacterium tuberculosis
PHLCSRAFITEQYDRYV

SEQ ID NO: 1488331 - protein, 17 aa, Mycobacterium tuberculosis
PHLDVAIVSKVYPMRSH

SEQ ID NO: 1488332 - protein, 17 aa, Mycobacterium tuberculosis
PHLIRQLARMGAKTIVA

SEQ ID NO: 1488333 - protein, 17 aa, Mycobacterium tuberculosis
PHPELLRGWDLATTADG

SEQ ID NO: 1488334 - protein, 19 aa, Mycobacterium tuberculosis
PHPPIPTTPWQHTRHWITT

SEQ ID NO: 1488335 - protein, 20 aa, Mycobacterium tuberculosis
PHPPIPTTPWQHTRHWITTK

SEQ ID NO: 1488336 - protein, 18 aa, Mycobacterium tuberculosis
PHPRPIPGPPVGPEGLTP

SEQ ID NO: 1488337 - protein, 25 aa, Mycobacterium tuberculosis
PHPRRPPRRRLPTAPAGGVDGNGGN

SEQ ID NO: 1488338 - protein, 22 aa, Mycobacterium tuberculosis
PHPRRQARRHLPKRHRRRPQLL

SEQ ID NO: 1488339 - protein, 23 aa, Mycobacterium tuberculosis
PHQHCWLRPGGQAITSWSPCAVR

SEQ ID NO: 1488340 - protein, 18 aa, Mycobacterium tuberculosis
PHQPRRTAPAPPWAKMPI

SEQ ID NO: 1488341 - protein, 27 aa, Mycobacterium tuberculosis
PHRRVGVTWWKEHRFLDEIPLSAFFGT

SEQ ID NO: 1488342 - protein, 25 aa, Mycobacterium tuberculosis
PHTGTAKFAYSWAVGPAVGRSGKAP

SEQ ID NO: 1488343 - protein, 17 aa, Mycobacterium tuberculosis
PHTLAALDWGGITCQSG

SEQ ID NO: 1488344 - protein, 19 aa, Mycobacterium tuberculosis
PHTRPPIGELLRGYEETVP

SEQ ID NO: 1488345 - protein, 21 aa, Mycobacterium tuberculosis
PHYRPSAKLAEFVRMRDLTCR

SEQ ID NO: 1488346 - protein, 24 aa, Mycobacterium tuberculosis
PHYRPSAKLAEFVRMRDLTCRFPG

SEQ ID NO: 1488347 - protein, 25 aa, Mycobacterium tuberculosis
PIAADDFWYLWQQMVTQPGVVDPAG

SEQ ID NO: 1488348 - protein, 24 aa, Mycobacterium tuberculosis
PIAAGPRRALIISVNVHAGLSQLP

SEQ ID NO: 1488349 - protein, 18 aa, Mycobacterium tuberculosis
PIADAVIFGTAFSAEDFK

SEQ ID NO: 1488350 - protein, 25 aa, Mycobacterium tuberculosis
PIAFSGPRWLALLLQPLSGPPSTSA

SEQ ID NO: 1488351 - protein, 18 aa, Mycobacterium tuberculosis
PIARSVMDAALLLDATTT

SEQ ID NO: 1488352 - protein, 20 aa, Mycobacterium tuberculosis
PIDIGLPVSLTIPGFTIPGG

SEQ ID NO: 1488353 - protein, 35 aa, Mycobacterium tuberculosis
PIGEACRRARRRGTKVAHAHLRYLNPFPANLGEVL

SEQ ID NO: 1488354 - protein, 17 aa, Mycobacterium tuberculosis
PIGKRNGWLSGLHATEL

SEQ ID NO: 1488355 - protein, 23 aa, Mycobacterium tuberculosis
PIKLRESPVLMILGRQGCGKTTA

SEQ ID NO: 1488356 - protein, 19 aa, Mycobacterium tuberculosis
PILDDAAAWFIGRTASRSD

SEQ ID NO: 1488357 - protein, 21 aa, Mycobacterium tuberculosis
PILGAPWLADLVRRSPWGEMF

SEQ ID NO: 1488358 - protein, 18 aa, Mycobacterium tuberculosis
PILVLTGRPDDTWLASWS

SEQ ID NO: 1488359 - protein, 26 aa, Mycobacterium tuberculosis
PINIPPRPPFPPAPPVPPLPPAAPSA

SEQ ID NO: 1488360 - protein, 18 aa, Mycobacterium tuberculosis
PIPDEFKSRLSTAVNAIA

SEQ ID NO: 1488361 - protein, 17 aa, Mycobacterium tuberculosis
PIPGFPTTVTVFGTPFM

SEQ ID NO: 1488362 - protein, 21 aa, Mycobacterium tuberculosis
PIPIIDVPAVPGFGNTTTAPS

SEQ ID NO: 1488363 - protein, 19 aa, Mycobacterium tuberculosis
PIPVGFAAVGGIGPIAIPD

SEQ ID NO: 1488364 - protein, 17 aa, Mycobacterium tuberculosis
PIPVLPNTHWLYEYGDP

SEQ ID NO: 1488365 - protein, 18 aa, Mycobacterium tuberculosis
PIPVLPNTHWLYEYGDPR

SEQ ID NO: 1488366 - protein, 22 aa, Mycobacterium tuberculosis
PIRARLPQRLRRSLRDHARDAN

SEQ ID NO: 1488367 - protein, 19 aa, Mycobacterium tuberculosis
PIRLPQLPGGWTPNSGGRG

SEQ ID NO: 1488368 - protein, 25 aa, Mycobacterium tuberculosis
PIRRASVTVMEWGLRGTRRAEAAAE

SEQ ID NO: 1488369 - protein, 21 aa, Mycobacterium tuberculosis
PISEADLLWDLASRLEGRMAA

SEQ ID NO: 1488370 - protein, 28 aa, Mycobacterium tuberculosis
PISIPIIDLRPAPGFFNATTGPSSGFLN

SEQ ID NO: 1488371 - protein, 18 aa, Mycobacterium tuberculosis
PISSAMTVGEQFGFTSPT

SEQ ID NO: 1488372 - protein, 18 aa, Mycobacterium tuberculosis
PITDSWYLTSIRAGLEPW

SEQ ID NO: 1488373 - protein, 19 aa, Mycobacterium tuberculosis
PITDSWYLTSIRAGLSPER

SEQ ID NO: 1488374 - protein, 24 aa, Mycobacterium tuberculosis
PIVDRPLYRFPVFGFFALSIGAAA

SEQ ID NO: 1488375 - protein, 21 aa, Mycobacterium tuberculosis
PIYPCRDGYVRFCVMAPRQWR

SEQ ID NO: 1488376 - protein, 17 aa, Mycobacterium tuberculosis
PKAMAISARCSTARRME

SEQ ID NO: 1488377 - protein, 23 aa, Mycobacterium tuberculosis
PKAPTRGAPLCGFRQTSRILAGL

SEQ ID NO: 1488378 - protein, 22 aa, Mycobacterium tuberculosis
PKAWRNLRFARAKMPADAVAVR

SEQ ID NO: 1488379 - protein, 18 aa, Mycobacterium tuberculosis
PKDLKVDVLLLGVQNDPI

SEQ ID NO: 1488380 - protein, 17 aa, Mycobacterium tuberculosis
PKFGTVVARDRTQAIAG

SEQ ID NO: 1488381 - protein, 21 aa, Mycobacterium tuberculosis
PKFRTGGYMIDFWGVGYHVAK

SEQ ID NO: 1488382 - protein, 21 aa, Mycobacterium tuberculosis
PKFRTGGYMIDFWGVGYQVAK

SEQ ID NO: 1488383 - protein, 19 aa, Mycobacterium tuberculosis
PKGAVSALLSAARSGDGPG

SEQ ID NO: 1488384 - protein, 18 aa, Mycobacterium tuberculosis
PKGPPRGFLNQKGRAGKL

SEQ ID NO: 1488385 - protein, 20 aa, Mycobacterium tuberculosis
PKGTLGLTVAEPIKVARNDD

SEQ ID NO: 1488386 - protein, 22 aa, Mycobacterium tuberculosis
PKHFRCVSVDLLARRPVVHRQG

SEQ ID NO: 1488387 - protein, 18 aa, Mycobacterium tuberculosis
PKHSGPCDVLYRDIGDYL

SEQ ID NO: 1488388 - protein, 19 aa, Mycobacterium tuberculosis
PKITFACEVCKHRNYITKK

SEQ ID NO: 1488389 - protein, 19 aa, Mycobacterium tuberculosis
PKITLACEVCKHRNYITKR

SEQ ID NO: 1488390 - protein, 24 aa, Mycobacterium tuberculosis
PKLNEPVIYPRGTLAMANAGPNTN

SEQ ID NO: 1488391 - protein, 22 aa, Mycobacterium tuberculosis
PKLRERAVRMVAEIRGQHDSEW

SEQ ID NO: 1488392 - protein, 17 aa, Mycobacterium tuberculosis
PKLSSPVTQNVTFVNQG

SEQ ID NO: 1488393 - protein, 18 aa, Mycobacterium tuberculosis
PKPLPNPFIVAATQNPIE

SEQ ID NO: 1488394 - protein, 25 aa, Mycobacterium tuberculosis
PKPRRRRGWCPGWGRRDMRAKGEEE

SEQ ID NO: 1488395 - protein, 19 aa, Mycobacterium tuberculosis
PKPSMRIISDIFAYTSAKM

SEQ ID NO: 1488396 - protein, 23 aa, Mycobacterium tuberculosis
PKRARMLMDAAIFKDTLIMSYEW

SEQ ID NO: 1488397 - protein, 20 aa, Mycobacterium tuberculosis
PKRKVRFLPYGIAVSVLDDP

SEQ ID NO: 1488398 - protein, 21 aa, Mycobacterium tuberculosis
PKRWRPKRCCVSSKDRFATRT

SEQ ID NO: 1488399 - protein, 18 aa, Mycobacterium tuberculosis
PKSWDPAAMESAIYQKWL

SEQ ID NO: 1488400 - protein, 23 aa, Mycobacterium tuberculosis
PKTAETAAEFGLRVDVQPDTAAI

SEQ ID NO: 1488401 - protein, 26 aa, Mycobacterium tuberculosis
PKVPRAARVAVRWLRAVALDRIGDVE

SEQ ID NO: 1488402 - protein, 22 aa, Mycobacterium tuberculosis
PKVVLVTGACRFLGGYLTARLA

SEQ ID NO: 1488403 - protein, 18 aa, Mycobacterium tuberculosis
PLAGQPLDRPFAWALIKL

SEQ ID NO: 1488404 - protein, 18 aa, Mycobacterium tuberculosis
PLAIEFAAARVRSMSPLE

SEQ ID NO: 1488405 - protein, 18 aa, Mycobacterium tuberculosis
PLAIPVIVLAGQVSLDKS

SEQ ID NO: 1488406 - protein, 28 aa, Mycobacterium tuberculosis
PLAPLHGWGLDPYLTPGFTELSSQAGFD

SEQ ID NO: 1488407 - protein, 18 aa, Mycobacterium tuberculosis
PLCDAVCPTQAWKTSPST

SEQ ID NO: 1488408 - protein, 17 aa, Mycobacterium tuberculosis
PLDAPRPMPPEVADHVA

SEQ ID NO: 1488409 - protein, 22 aa, Mycobacterium tuberculosis
PLDCVIGAPVLFGRANVVFTLL

SEQ ID NO: 1488410 - protein, 19 aa, Mycobacterium tuberculosis
PLDGMICDVHIYKETYAEA

SEQ ID NO: 1488411 - protein, 17 aa, Mycobacterium tuberculosis
PLDHTIIQVAVAISALQ

SEQ ID NO: 1488412 - protein, 26 aa, Mycobacterium tuberculosis
PLDLVPRVISAPEWTRLERGITQRVK

SEQ ID NO: 1488413 - protein, 22 aa, Mycobacterium tuberculosis
PLDWFCLFSSGAALLGSPGQGA

SEQ ID NO: 1488414 - protein, 17 aa, Mycobacterium tuberculosis
PLDWLVSKFAREVPGVA

SEQ ID NO: 1488415 - protein, 18 aa, Mycobacterium tuberculosis
PLEWSSFLPPQCTDPDVP

SEQ ID NO: 1488416 - protein, 20 aa, Mycobacterium tuberculosis
PLFQSHMWDGSAVPIDENLA

SEQ ID NO: 1488417 - protein, 19 aa, Mycobacterium tuberculosis
PLFRECLAPGTSISHRVVV

SEQ ID NO: 1488418 - protein, 18 aa, Mycobacterium tuberculosis
PLGAGRLTREWLPDDPPG

SEQ ID NO: 1488419 - protein, 23 aa, Mycobacterium tuberculosis
PLGGRPATRLVRHRIRRNGRRIR

SEQ ID NO: 1488420 - protein, 23 aa, Mycobacterium tuberculosis
PLGKVGRPRGYAVDEIQGLEEVE

SEQ ID NO: 1488421 - protein, 24 aa, Mycobacterium tuberculosis
PLGTLRCWRHSDIGPARGIVVTPA

SEQ ID NO: 1488422 - protein, 19 aa, Mycobacterium tuberculosis
PLHPGFAASWQRLRTAPAT

SEQ ID NO: 1488423 - protein, 29 aa, Mycobacterium tuberculosis
PLHPHRRGVSWRAAELFDAIGSEAITVAV

SEQ ID NO: 1488424 - protein, 24 aa, Mycobacterium tuberculosis
PLHVRLGQRPTLMFDNTTMMYHPI

SEQ ID NO: 1488425 - protein, 17 aa, Mycobacterium tuberculosis
PLHYERFSPPPVVDGVP

SEQ ID NO: 1488426 - protein, 18 aa, Mycobacterium tuberculosis
PLHYERFSPPPVVDGVPF

SEQ ID NO: 1488427 - protein, 18 aa, Mycobacterium tuberculosis
PLIFARRRLIAAGTTRGR

SEQ ID NO: 1488428 - protein, 25 aa, Mycobacterium tuberculosis
PLKTSLEFRERFGIEVEELDEYAEH

SEQ ID NO: 1488429 - protein, 29 aa, Mycobacterium tuberculosis
PLLAEADVPWVLMHWRAVSADTPHVPVRY

SEQ ID NO: 1488430 - protein, 17 aa, Mycobacterium tuberculosis
PLLANVETLRCWLDDER

SEQ ID NO: 1488431 - protein, 17 aa, Mycobacterium tuberculosis
PLLARLADMFVQPKRDP

SEQ ID NO: 1488432 - protein, 18 aa, Mycobacterium tuberculosis
PLLDGKIRSAFSMTEPAV

SEQ ID NO: 1488433 - protein, 17 aa, Mycobacterium tuberculosis
PLLGPWGTARVFAPQKG

SEQ ID NO: 1488434 - protein, 19 aa, Mycobacterium tuberculosis
PLLVADLAYVRGMVYRQLH

SEQ ID NO: 1488435 - protein, 18 aa, Mycobacterium tuberculosis
PLMAQLLEGHPRRWHRPP

SEQ ID NO: 1488436 - protein, 19 aa, Mycobacterium tuberculosis
PLMQAAAAWQRLANELTAT

SEQ ID NO: 1488437 - protein, 23 aa, Mycobacterium tuberculosis
PLMRGYLRLGARACGEPAHDPDF

SEQ ID NO: 1488438 - protein, 17 aa, Mycobacterium tuberculosis
PLMSDAMLRVFFEAYEI

SEQ ID NO: 1488439 - protein, 19 aa, Mycobacterium tuberculosis
PLMSNEIFGPILPVVTVKS

SEQ ID NO: 1488440 - protein, 24 aa, Mycobacterium tuberculosis
PLNRRCGPPLPTRRRRSARRGSDL

SEQ ID NO: 1488441 - protein, 23 aa, Mycobacterium tuberculosis
PLPAERWREYCLSSVTTHDLPPT

SEQ ID NO: 1488442 - protein, 20 aa, Mycobacterium tuberculosis
PLPANVFIALPAVTQLLTSG

SEQ ID NO: 1488443 - protein, 22 aa, Mycobacterium tuberculosis
PLPCTPRGIVHLLRRYDISIAG

SEQ ID NO: 1488444 - protein, 20 aa, Mycobacterium tuberculosis
PLPGEVADKFHATFDALLHN

SEQ ID NO: 1488445 - protein, 22 aa, Mycobacterium tuberculosis
PLPGNVEAFLRLVEAGWDAEVA

SEQ ID NO: 1488446 - protein, 17 aa, Mycobacterium tuberculosis
PLPLGDLVVDHFLTAVV

SEQ ID NO: 1488447 - protein, 30 aa, Mycobacterium tuberculosis
PLPLPLGFVDFACRVWRPGQGTVRTTINLP

SEQ ID NO: 1488448 - protein, 22 aa, Mycobacterium tuberculosis
PLPPAPVRPWPPLPPLPPLPPL

SEQ ID NO: 1488449 - protein, 30 aa, Mycobacterium tuberculosis
PLPPGPPLPIPRPLAPPWPPSPPLPPSLPD

SEQ ID NO: 1488450 - protein, 21 aa, Mycobacterium tuberculosis
PLPPLPMSWALPPTAPAPPLP

SEQ ID NO: 1488451 - protein, 19 aa, Mycobacterium tuberculosis
PLPPLPVPLPLPASPASPP

SEQ ID NO: 1488452 - protein, 23 aa, Mycobacterium tuberculosis
PLPPMLLPAFATLALPPAPPSPP

SEQ ID NO: 1488453 - protein, 25 aa, Mycobacterium tuberculosis
PLPPTVGITLHLPFDGILVPPHPVN

SEQ ID NO: 1488454 - protein, 19 aa, Mycobacterium tuberculosis
PLPTSRTAVTAPFPPSPAM

SEQ ID NO: 1488455 - protein, 26 aa, Mycobacterium tuberculosis
PLQPFQATAVIPVIGPVTVTLEGTPA

SEQ ID NO: 1488456 - protein, 17 aa, Mycobacterium tuberculosis
PLRDVHSGWKVAEAFPA

SEQ ID NO: 1488457 - protein, 22 aa, Mycobacterium tuberculosis
PLRMARDLVRVGLDALALDIYR

SEQ ID NO: 1488458 - protein, 17 aa, Mycobacterium tuberculosis
PLRPAGQGTGEWLRSRH

SEQ ID NO: 1488459 - protein, 23 aa, Mycobacterium tuberculosis
PLRPDRYLRIVAAMRREGMGFTA

SEQ ID NO: 1488460 - protein, 17 aa, Mycobacterium tuberculosis
PLRPEERQTTVVDHAEA

SEQ ID NO: 1488461 - protein, 17 aa, Mycobacterium tuberculosis
PLRPWKKEQLGGGYQVS

SEQ ID NO: 1488462 - protein, 18 aa, Mycobacterium tuberculosis
PLRPWKKEQLGGGYQVST

SEQ ID NO: 1488463 - protein, 19 aa, Mycobacterium tuberculosis
PLRRELAGTFSARRGTYRL

SEQ ID NO: 1488464 - protein, 29 aa, Mycobacterium tuberculosis
PLRRSRGPRPNCCMARWARPSRSTRKPGL

SEQ ID NO: 1488465 - protein, 19 aa, Mycobacterium tuberculosis
PLSLGRLDRGWVVASETAA

SEQ ID NO: 1488466 - protein, 21 aa, Mycobacterium tuberculosis
PLSRLPMIPGTSLKGKVRTLL

SEQ ID NO: 1488467 - protein, 18 aa, Mycobacterium tuberculosis
PLTLLPEPNPGDCSSTSR

SEQ ID NO: 1488468 - protein, 18 aa, Mycobacterium tuberculosis
PLVGRLLMYEALDATYHQ

SEQ ID NO: 1488469 - protein, 26 aa, Mycobacterium tuberculosis
PLVMARGIEIGHIFQLGSKYTDAFTA

SEQ ID NO: 1488470 - protein, 19 aa, Mycobacterium tuberculosis
PLVNLKVTLLDGAYHEVDS

SEQ ID NO: 1488471 - protein, 19 aa, Mycobacterium tuberculosis
PLYHDMGLMVGLFIPLFVG

SEQ ID NO: 1488472 - protein, 19 aa, Mycobacterium tuberculosis
PLYRFPVFGFFALSIGAAA

SEQ ID NO: 1488473 - protein, 20 aa, Mycobacterium tuberculosis
PMAAAATAWDGLAMELASAA

SEQ ID NO: 1488474 - protein, 21 aa, Mycobacterium tuberculosis
PMAAAATAWDGLAMELASAAA

SEQ ID NO: 1488475 - protein, 22 aa, Mycobacterium tuberculosis
PMAARLGLAGWPRAAEESIVAR

SEQ ID NO: 1488476 - protein, 20 aa, Mycobacterium tuberculosis
PMDRVICGDVGYGKTEIAVR

SEQ ID NO: 1488477 - protein, 17 aa, Mycobacterium tuberculosis
PMDVPVFSVDFYDKFGY

SEQ ID NO: 1488478 - protein, 26 aa, Mycobacterium tuberculosis
PMEFICSSIQAGSRLGYQESAELCAQ

SEQ ID NO: 1488479 - protein, 17 aa, Mycobacterium tuberculosis
PMIGGLGYVLAPGPAAY

SEQ ID NO: 1488480 - protein, 17 aa, Mycobacterium tuberculosis
PMIVWGAHRIWPKDHPK

SEQ ID NO: 1488481 - protein, 18 aa, Mycobacterium tuberculosis
PMLEEFARVAARVQAREP

SEQ ID NO: 1488482 - protein, 19 aa, Mycobacterium tuberculosis
PMLEEFARVAARVQAREPQ

SEQ ID NO: 1488483 - protein, 22 aa, Mycobacterium tuberculosis
PMLQAAAAWDGLAAELGTAASS

SEQ ID NO: 1488484 - protein, 17 aa, Mycobacterium tuberculosis
PMLRCQRTVEPLAEALC

SEQ ID NO: 1488485 - protein, 17 aa, Mycobacterium tuberculosis
PMLRLIRRYGPIMTMPI

SEQ ID NO: 1488486 - protein, 19 aa, Mycobacterium tuberculosis
PMMARNILESFKLLTNVSR

SEQ ID NO: 1488487 - protein, 17 aa, Mycobacterium tuberculosis
PMPNFPITDIAGQNSGG

SEQ ID NO: 1488488 - protein, 21 aa, Mycobacterium tuberculosis
PMPRAMPATAAFPPPAGPPPV

SEQ ID NO: 1488489 - protein, 20 aa, Mycobacterium tuberculosis
PMVYSGLYPVDGSDYPNLRD

SEQ ID NO: 1488490 - protein, 19 aa, Mycobacterium tuberculosis
PMYLGLRVWSRATIGLAYA

SEQ ID NO: 1488491 - protein, 21 aa, Mycobacterium tuberculosis
PNARPPVCKIMDYGKYKYEAA

SEQ ID NO: 1488492 - protein, 30 aa, Mycobacterium tuberculosis
PNCPTRRWICSPIWLTPASWKLRREASHDK

SEQ ID NO: 1488493 - protein, 20 aa, Mycobacterium tuberculosis
PNFFTVFGPYGYVGSSYFAL

SEQ ID NO: 1488494 - protein, 28 aa, Mycobacterium tuberculosis
PNGGILARFPGLYLQSLGLTFNGATPDT

SEQ ID NO: 1488495 - protein, 17 aa, Mycobacterium tuberculosis
PNGRPRYVTAIDADTAT

SEQ ID NO: 1488496 - protein, 23 aa, Mycobacterium tuberculosis
PNHPDPAVAPGHIRVTVDTNFSL

SEQ ID NO: 1488497 - protein, 29 aa, Mycobacterium tuberculosis
PNHRPSGAPMRWARWPPALIGLPAAAVIP

SEQ ID NO: 1488498 - protein, 17 aa, Mycobacterium tuberculosis
PNITGSAAFRIVVGSVR

SEQ ID NO: 1488499 - protein, 19 aa, Mycobacterium tuberculosis
PNLFIKIPATKAGLPAISA

SEQ ID NO: 1488500 - protein, 19 aa, Mycobacterium tuberculosis
PNLFWCVGYTNASWTLRAD

SEQ ID NO: 1488501 - protein, 20 aa, Mycobacterium tuberculosis
PNMWATLMVSQGTPMAPHGH

SEQ ID NO: 1488502 - protein, 17 aa, Mycobacterium tuberculosis
PNPAGLIETAKRLGANP

SEQ ID NO: 1488503 - protein, 19 aa, Mycobacterium tuberculosis
PNPRGSRDTLLRVAGTPNP

SEQ ID NO: 1488504 - protein, 23 aa, Mycobacterium tuberculosis
PNQFPYQSKTGWVYDSGDYETTM

SEQ ID NO: 1488505 - protein, 18 aa, Mycobacterium tuberculosis
PNQRLRLETSTERLTTRV

SEQ ID NO: 1488506 - protein, 23 aa, Mycobacterium tuberculosis
PNRRRYCRRFGRALITTRSGCCR

SEQ ID NO: 1488507 - protein, 17 aa, Mycobacterium tuberculosis
PNSAIALGHPFGGSGAR

SEQ ID NO: 1488508 - protein, 17 aa, Mycobacterium tuberculosis
PNSAWVGALIKPQHLLF

SEQ ID NO: 1488509 - protein, 23 aa, Mycobacterium tuberculosis
PNSDPRSGLSMGEHPQSPPSRWA

SEQ ID NO: 1488510 - protein, 20 aa, Mycobacterium tuberculosis
PNSDQSWMILPYDNALNGWK

SEQ ID NO: 1488511 - protein, 21 aa, Mycobacterium tuberculosis
PNSGTEPGFGGDGGLGGAGAT

SEQ ID NO: 1488512 - protein, 26 aa, Mycobacterium tuberculosis
PNSLVTWGAGVPAAMGTSTAGQVSIS

SEQ ID NO: 1488513 - protein, 17 aa, Mycobacterium tuberculosis
PNSMLVAAASWDALAAE

SEQ ID NO: 1488514 - protein, 17 aa, Mycobacterium tuberculosis
PNSSCWVSTSPASATRW

SEQ ID NO: 1488515 - protein, 22 aa, Mycobacterium tuberculosis
PNSTPLPAARIGPGTNNAPSAA

SEQ ID NO: 1488516 - protein, 28 aa, Mycobacterium tuberculosis
PNTRFRRSWPRHRCCGWNHGPHRLSPPR

SEQ ID NO: 1488517 - protein, 18 aa, Mycobacterium tuberculosis
PNVTGSLHMGHALEHTMM

SEQ ID NO: 1488518 - protein, 26 aa, Mycobacterium tuberculosis
PNYFGDACVWWGLWLITINDWAPLAT

SEQ ID NO: 1488519 - protein, 20 aa, Mycobacterium tuberculosis
PPAALLRLVNPILRSLLHTP

SEQ ID NO: 1488520 - protein, 17 aa, Mycobacterium tuberculosis
PPAALSWVEPILQATTT

SEQ ID NO: 1488521 - protein, 27 aa, Mycobacterium tuberculosis
PPAATHWGCSLAWAGPAVRAATRPWEA

SEQ ID NO: 1488522 - protein, 25 aa, Mycobacterium tuberculosis
PPADGKCGRPFFLKIESEVPVDVHP

SEQ ID NO: 1488523 - protein, 24 aa, Mycobacterium tuberculosis
PPAEVPVRCAAGSDAAWLRAELNN

SEQ ID NO: 1488524 - protein, 18 aa, Mycobacterium tuberculosis
PPAGTLNGIAKRELRGVP

SEQ ID NO: 1488525 - protein, 23 aa, Mycobacterium tuberculosis
PPAPEPRPAPPPAKPAPPAGPVD

SEQ ID NO: 1488526 - protein, 24 aa, Mycobacterium tuberculosis
PPAPEPRPAPPPAKPAPPAGPVDD

SEQ ID NO: 1488527 - protein, 17 aa, Mycobacterium tuberculosis
PPAPGSPPWPPAPPAPA

SEQ ID NO: 1488528 - protein, 30 aa, Mycobacterium tuberculosis
PPAPPAPMLPSWWVAASALPPCPPAPPPPP

SEQ ID NO: 1488529 - protein, 20 aa, Mycobacterium tuberculosis
PPAPPAPPWPNSPTALPPIP

SEQ ID NO: 1488530 - protein, 27 aa, Mycobacterium tuberculosis
PPAPPRPPAAPEPGGCPTVRQSARTAG

SEQ ID NO: 1488531 - protein, 19 aa, Mycobacterium tuberculosis
PPAPPRPPFAAGGAAAIAA

SEQ ID NO: 1488532 - protein, 35 aa, Mycobacterium tuberculosis
PPAPPWPNRMALPPWPPCPPLPPLIPARPSPPCPP

SEQ ID NO: 1488533 - protein, 17 aa, Mycobacterium tuberculosis
PPAPPWPPVPPTPTAPA

SEQ ID NO: 1488534 - protein, 18 aa, Mycobacterium tuberculosis
PPARECWQTNRFRPGDDD

SEQ ID NO: 1488535 - protein, 21 aa, Mycobacterium tuberculosis
PPARGRRSVCDRCAGCLSVFT

SEQ ID NO: 1488536 - protein, 24 aa, Mycobacterium tuberculosis
PPARYFGPNLSRLSAVRQKYDPSR

SEQ ID NO: 1488537 - protein, 19 aa, Mycobacterium tuberculosis
PPATPGRYLVTAAMLGPDR

SEQ ID NO: 1488538 - protein, 17 aa, Mycobacterium tuberculosis
PPAWCARCAAGPSSTST

SEQ ID NO: 1488539 - protein, 21 aa, Mycobacterium tuberculosis
PPCTRSWSWLRRNRDRSKSSA

SEQ ID NO: 1488540 - protein, 26 aa, Mycobacterium tuberculosis
PPDTSVCPRLVPSPPMPPAPPPTPGL

SEQ ID NO: 1488541 - protein, 19 aa, Mycobacterium tuberculosis
PPEAPVFPLPPKPPRPPWA

SEQ ID NO: 1488542 - protein, 20 aa, Mycobacterium tuberculosis
PPEELQFVLADLKGGSAVKP

SEQ ID NO: 1488543 - protein, 17 aa, Mycobacterium tuberculosis
PPEERYPVLTYVGPHDD

SEQ ID NO: 1488544 - protein, 20 aa, Mycobacterium tuberculosis
PPEHAHKLVFAVLRGVAAVA

SEQ ID NO: 1488545 - protein, 21 aa, Mycobacterium tuberculosis
PPEPPALPAFSAINPPPKEDQ

SEQ ID NO: 1488546 - protein, 21 aa, Mycobacterium tuberculosis
PPERLLRCIEAVLACREALAV

SEQ ID NO: 1488547 - protein, 22 aa, Mycobacterium tuberculosis
PPERLLRCIEAVLACREALAVN

SEQ ID NO: 1488548 - protein, 24 aa, Mycobacterium tuberculosis
PPFALCGPRGTLIARGVRTRYCDV

SEQ ID NO: 1488549 - protein, 17 aa, Mycobacterium tuberculosis
PPFDLPTVVIDRIPVEL

SEQ ID NO: 1488550 - protein, 19 aa, Mycobacterium tuberculosis
PPGAAHYLGQRHRPRGPAP

SEQ ID NO: 1488551 - protein, 26 aa, Mycobacterium tuberculosis
PPGAKFPSGSFYLSISDLQINGPIIG

SEQ ID NO: 1488552 - protein, 17 aa, Mycobacterium tuberculosis
PPGAPAPPMPPLPPAPP

SEQ ID NO: 1488553 - protein, 24 aa, Mycobacterium tuberculosis
PPGDERHMLWFALMKPMTSTATGR

SEQ ID NO: 1488554 - protein, 27 aa, Mycobacterium tuberculosis
PPGGWPEPLRTAALAGRGAARPTAQLA

SEQ ID NO: 1488555 - protein, 22 aa, Mycobacterium tuberculosis
PPGHKWARRSRVVSARELAQTP

SEQ ID NO: 1488556 - protein, 19 aa, Mycobacterium tuberculosis
PPGRLGWGWARFAFTSWKT

SEQ ID NO: 1488557 - protein, 20 aa, Mycobacterium tuberculosis
PPGRPDHRHRLLPHQRPART

SEQ ID NO: 1488558 - protein, 24 aa, Mycobacterium tuberculosis
PPGRVISAAGFSPVRGPAPMLAAA

SEQ ID NO: 1488559 - protein, 23 aa, Mycobacterium tuberculosis
PPGTRRFSPPGGGSGGNGGNGAL

SEQ ID NO: 1488560 - protein, 26 aa, Mycobacterium tuberculosis
PPHEECEVLVGLGMRTWADGRTLLLG

SEQ ID NO: 1488561 - protein, 21 aa, Mycobacterium tuberculosis
PPHMERRFSADGTSWDPTELT

SEQ ID NO: 1488562 - protein, 19 aa, Mycobacterium tuberculosis
PPHRCQGPRQIARRRRDRL

SEQ ID NO: 1488563 - protein, 17 aa, Mycobacterium tuberculosis
PPIYFGFGSTPVQTPVQ

SEQ ID NO: 1488564 - protein, 26 aa, Mycobacterium tuberculosis
PPLPNSRPPAPPAPPGVVALAPSPIN

SEQ ID NO: 1488565 - protein, 22 aa, Mycobacterium tuberculosis
PPLPNSRPPLPPAPPSLPSPPA

SEQ ID NO: 1488566 - protein, 17 aa, Mycobacterium tuberculosis
PPLPVKMPPSPPVPPFP

SEQ ID NO: 1488567 - protein, 24 aa, Mycobacterium tuberculosis
PPMPARCPPMPPVPPGGNRQPMPR

SEQ ID NO: 1488568 - protein, 35 aa, Mycobacterium tuberculosis
PPMRFRVCSRRGGYNWTGYCGSLIWGTTLCSTKIA

SEQ ID NO: 1488569 - protein, 20 aa, Mycobacterium tuberculosis
PPNARWHRYGLASMRSQWGY

SEQ ID NO: 1488570 - protein, 18 aa, Mycobacterium tuberculosis
PPNTAVTVIFFGPVDIDP

SEQ ID NO: 1488571 - protein, 19 aa, Mycobacterium tuberculosis
PPNVDIRWSTADLRPRVDL

SEQ ID NO: 1488572 - protein, 21 aa, Mycobacterium tuberculosis
PPPAPGRPSAQVWLVDPRRQL

SEQ ID NO: 1488573 - protein, 23 aa, Mycobacterium tuberculosis
PPPCSRWKKGNIYTRIGNPTTDV

SEQ ID NO: 1488574 - protein, 24 aa, Mycobacterium tuberculosis
PPPDVRISLSPLDFVTEGRSLIGS

SEQ ID NO: 1488575 - protein, 20 aa, Mycobacterium tuberculosis
PPPHFFHPVNKKKKKKKKIK

SEQ ID NO: 1488576 - protein, 17 aa, Mycobacterium tuberculosis
PPPLRWLERRTRGDQLH

SEQ ID NO: 1488577 - protein, 18 aa, Mycobacterium tuberculosis
PPPPFAPWDTPDGTPPPG

SEQ ID NO: 1488578 - protein, 18 aa, Mycobacterium tuberculosis
PPPPRGHCPPTAPTCAHR

SEQ ID NO: 1488579 - protein, 22 aa, Mycobacterium tuberculosis
PPPPRPPPRPPRPRRAAPAAPR

SEQ ID NO: 1488580 - protein, 22 aa, Mycobacterium tuberculosis
PPPSPKPGQKWVNVDPTKNKSG

SEQ ID NO: 1488581 - protein, 18 aa, Mycobacterium tuberculosis
PPPSRLWTRHLPKSTKPG

SEQ ID NO: 1488582 - protein, 25 aa, Mycobacterium tuberculosis
PPPVPIPWSVLSLFVPGPTLSRADA

SEQ ID NO: 1488583 - protein, 18 aa, Mycobacterium tuberculosis
PPPWPTTMHIRRGPTLGC

SEQ ID NO: 1488584 - protein, 17 aa, Mycobacterium tuberculosis
PPQCPPGTAIARLNSPR

SEQ ID NO: 1488585 - protein, 22 aa, Mycobacterium tuberculosis
PPRGMYWWLRWAELAIVQSCLL

SEQ ID NO: 1488586 - protein, 19 aa, Mycobacterium tuberculosis
PPRGRRSRCTTPQTRWTAW

SEQ ID NO: 1488587 - protein, 18 aa, Mycobacterium tuberculosis
PPRPCPFGRSHSCQIRVA

SEQ ID NO: 1488588 - protein, 29 aa, Mycobacterium tuberculosis
PPRPRRAAPAAPRRPPPRSAPPAGGGGAG

SEQ ID NO: 1488589 - protein, 21 aa, Mycobacterium tuberculosis
PPRPRTSPCSPARTTACRART

SEQ ID NO: 1488590 - protein, 18 aa, Mycobacterium tuberculosis
PPRPSLPGPPFVLTALPV

SEQ ID NO: 1488591 - protein, 27 aa, Mycobacterium tuberculosis
PPRRPKLARALRHLLLLWGALPESQPP

SEQ ID NO: 1488592 - protein, 21 aa, Mycobacterium tuberculosis
PPRTRSGAALPRSSDPVTDIA

SEQ ID NO: 1488593 - protein, 21 aa, Mycobacterium tuberculosis
PPRTVSVSTLMDGRIDHVELS

SEQ ID NO: 1488594 - protein, 21 aa, Mycobacterium tuberculosis
PPSAGVRPAIHLPLEDPYQMP

SEQ ID NO: 1488595 - protein, 18 aa, Mycobacterium tuberculosis
PPSEFRWEDMQPAVDREP

SEQ ID NO: 1488596 - protein, 17 aa, Mycobacterium tuberculosis
PPSGFGISARAVTVSTV

SEQ ID NO: 1488597 - protein, 17 aa, Mycobacterium tuberculosis
PPSINFAGPSPYIDFDA

SEQ ID NO: 1488598 - protein, 25 aa, Mycobacterium tuberculosis
PPSPPCAVLSPGAPIPPLPAAPPLP

SEQ ID NO: 1488599 - protein, 21 aa, Mycobacterium tuberculosis
PPSPPRPPGAPAPPMPPLPPA

SEQ ID NO: 1488600 - protein, 25 aa, Mycobacterium tuberculosis
PPSRPGEKNMPFWGTSFSAAYVSGV

SEQ ID NO: 1488601 - protein, 19 aa, Mycobacterium tuberculosis
PPSRRCGMAQRLRALAALP

SEQ ID NO: 1488602 - protein, 17 aa, Mycobacterium tuberculosis
PPSVKGILVTEGVRGDG

SEQ ID NO: 1488603 - protein, 32 aa, Mycobacterium tuberculosis
PPSVRELAVFWTARSIGCSWCVDFGAMLQRLD

SEQ ID NO: 1488604 - protein, 24 aa, Mycobacterium tuberculosis
PPTAPPWPRCQRWPSWAPTTPSTA

SEQ ID NO: 1488605 - protein, 21 aa, Mycobacterium tuberculosis
PPTAPRRPSDPGALVKAPSNL

SEQ ID NO: 1488606 - protein, 18 aa, Mycobacterium tuberculosis
PPTCHFAPVGRFPPRCPA

SEQ ID NO: 1488607 - protein, 20 aa, Mycobacterium tuberculosis
PPTDVPITPCELTAAKNAAQ

SEQ ID NO: 1488608 - protein, 18 aa, Mycobacterium tuberculosis
PPTIVAILSKLTGDIDPA

SEQ ID NO: 1488609 - protein, 17 aa, Mycobacterium tuberculosis
PPTPRRLGPFRASEETW

SEQ ID NO: 1488610 - protein, 21 aa, Mycobacterium tuberculosis
PPTPSRVGISSVLKIGRDLYV

SEQ ID NO: 1488611 - protein, 18 aa, Mycobacterium tuberculosis
PPTRGRVTRRLTDRRPVG

SEQ ID NO: 1488612 - protein, 24 aa, Mycobacterium tuberculosis
PPTRVWGVPAAGLWAHRLGDQRAK

SEQ ID NO: 1488613 - protein, 19 aa, Mycobacterium tuberculosis
PPTSRRYWPAGPPSPGGPW

SEQ ID NO: 1488614 - protein, 21 aa, Mycobacterium tuberculosis
PPTTWRSSPSTTPRRWPTIPT

SEQ ID NO: 1488615 - protein, 18 aa, Mycobacterium tuberculosis
PPVAEPPPPVAAPAPPGA

SEQ ID NO: 1488616 - protein, 18 aa, Mycobacterium tuberculosis
PPVPPAPPRPPGEPTPVP

SEQ ID NO: 1488617 - protein, 20 aa, Mycobacterium tuberculosis
PPVTLRQALLGKVMTVGDAV

SEQ ID NO: 1488618 - protein, 23 aa, Mycobacterium tuberculosis
PPWLTDLGKALGLTGHTWSSDGS

SEQ ID NO: 1488619 - protein, 20 aa, Mycobacterium tuberculosis
PPYSQWAFQHVEDFMPTTVI

SEQ ID NO: 1488620 - protein, 17 aa, Mycobacterium tuberculosis
PQAGRPRGWPEWAEPDV

SEQ ID NO: 1488621 - protein, 25 aa, Mycobacterium tuberculosis
PQAIFDHGKPLALYHTKRLASPAQR

SEQ ID NO: 1488622 - protein, 22 aa, Mycobacterium tuberculosis
PQARATFEAVLAKLAAPGATNP

SEQ ID NO: 1488623 - protein, 25 aa, Mycobacterium tuberculosis
PQATAGAPAHDWLTLTGGAIGYGIP

SEQ ID NO: 1488624 - protein, 17 aa, Mycobacterium tuberculosis
PQATRIVAWTDEDHDLT

SEQ ID NO: 1488625 - protein, 18 aa, Mycobacterium tuberculosis
PQFAGERVLGQGFDRDVL

SEQ ID NO: 1488626 - protein, 29 aa, Mycobacterium tuberculosis
PQFGAVAALNLVKCVHWPSSSPPQPPKDL

SEQ ID NO: 1488627 - protein, 30 aa, Mycobacterium tuberculosis; identical to SEQ ID NO: 234025

SEQ ID NO: 1488628 - protein, 17 aa, Mycobacterium tuberculosis
PQFGVVGGFSHGLCPFK

SEQ ID NO: 1488629 - protein, 18 aa, Mycobacterium tuberculosis
PQFPIRITTTGGIGPIVI

SEQ ID NO: 1488630 - protein, 18 aa, Mycobacterium tuberculosis
PQGAPPFGRYDMNSANGL

SEQ ID NO: 1488631 - protein, 17 aa, Mycobacterium tuberculosis
PQHRLFLQCAWHALEDA

SEQ ID NO: 1488632 - protein, 17 aa, Mycobacterium tuberculosis
PQHRLLLETSWEAMEHG

SEQ ID NO: 1488633 - protein, 22 aa, Mycobacterium tuberculosis
PQIRAASNHGHRNRVRCHLHIS

SEQ ID NO: 1488634 - protein, 21 aa, Mycobacterium tuberculosis
PQLGRSGWRSPVMATCCWGWR

SEQ ID NO: 1488635 - protein, 26 aa, Mycobacterium tuberculosis
PQLIRARRGVILACGGFEHNEQMRIK

SEQ ID NO: 1488636 - protein, 19 aa, Mycobacterium tuberculosis
PQLLPLLDDYRHASTEYAL

SEQ ID NO: 1488637 - protein, 17 aa, Mycobacterium tuberculosis
PQLPGGWTPNSGGRGGI

SEQ ID NO: 1488638 - protein, 22 aa, Mycobacterium tuberculosis
PQLPSTALMDVLLRRPPRTAQR

SEQ ID NO: 1488639 - protein, 17 aa, Mycobacterium tuberculosis
PQLRMSGYNLAAIAAGL

SEQ ID NO: 1488640 - protein, 21 aa, Mycobacterium tuberculosis
PQLRSKRPGRGKSYTLTGTGH

SEQ ID NO: 1488641 - protein, 19 aa, Mycobacterium tuberculosis
PQLSRESLAAITTAQQLAT

SEQ ID NO: 1488642 - protein, 18 aa, Mycobacterium tuberculosis
PQLVVPVLNARFALNAAN

SEQ ID NO: 1488643 - protein, 19 aa, Mycobacterium tuberculosis
PQMQIAVRNEWGWAEAHLD

SEQ ID NO: 1488644 - protein, 17 aa, Mycobacterium tuberculosis
PQPILQLPDTNSGWRLV

SEQ ID NO: 1488645 - protein, 19 aa, Mycobacterium tuberculosis
PQPLLPVFDVVDGFAAGFD

SEQ ID NO: 1488646 - protein, 19 aa, Mycobacterium tuberculosis
PQPVCGVAVAGHLTEAEAG

SEQ ID NO: 1488647 - protein, 18 aa, Mycobacterium tuberculosis
PQQETVGFVGFQIPGLER

SEQ ID NO: 1488648 - protein, 20 aa, Mycobacterium tuberculosis
PQQLLRSGLRRQRVHHAGDS

SEQ ID NO: 1488649 - protein, 23 aa, Mycobacterium tuberculosis
PQQRLLLETSWEAIEHAGLDPAS

SEQ ID NO: 1488650 - protein, 17 aa, Mycobacterium tuberculosis
PQQRLMLEVSWEALEHA

SEQ ID NO: 1488651 - protein, 18 aa, Mycobacterium tuberculosis
PQQVIMLGRPTLHRPVSV

SEQ ID NO: 1488652 - protein, 21 aa, Mycobacterium tuberculosis
PQRHIGVGWAALRSLPPPAPQ

SEQ ID NO: 1488653 - protein, 21 aa, Mycobacterium tuberculosis
PQRPAPMLRGARAERGHFTDS

SEQ ID NO: 1488654 - protein, 21 aa, Mycobacterium tuberculosis
PQRPPWWARRVRAPTPRPTAG

SEQ ID NO: 1488655 - protein, 19 aa, Mycobacterium tuberculosis
PQRRQWWIDRVKACYSLLV

SEQ ID NO: 1488656 - protein, 23 aa, Mycobacterium tuberculosis
PQRRSSPRFRVRRRPDSTSATCS

SEQ ID NO: 1488657 - protein, 18 aa, Mycobacterium tuberculosis
PQRTRCRRRRPKPSGSCC

SEQ ID NO: 1488658 - protein, 17 aa, Mycobacterium tuberculosis
PQSLWPRPARSTQPVQR

SEQ ID NO: 1488659 - protein, 18 aa, Mycobacterium tuberculosis
PQSYWLAQAFPPATVGGT

SEQ ID NO: 1488660 - protein, 17 aa, Mycobacterium tuberculosis
PQTFKIENPLAVVATST

SEQ ID NO: 1488661 - protein, 18 aa, Mycobacterium tuberculosis
PQTVPLAFTSYAGMDIGR

SEQ ID NO: 1488662 - protein, 17 aa, Mycobacterium tuberculosis
PQVAALFLAGHLGARLF

SEQ ID NO: 1488663 - protein, 17 aa, Mycobacterium tuberculosis
PQVTVAYVLPARRDWAR

SEQ ID NO: 1488664 - protein, 18 aa, Mycobacterium tuberculosis
PQVWDVLEEVIAEHPVLL

SEQ ID NO: 1488665 - protein, 21 aa, Mycobacterium tuberculosis
PRAAARARARYACFDHACADD

SEQ ID NO: 1488666 - protein, 21 aa, Mycobacterium tuberculosis
PRAACRLAPARPFEYPGRRDI

SEQ ID NO: 1488667 - protein, 29 aa, Mycobacterium tuberculosis
PRAAFFGRSGLRRNIRWDPLDSVYFAGYA

SEQ ID NO: 1488668 - protein, 18 aa, Mycobacterium tuberculosis
PRAARLARQLALDMDPLS

SEQ ID NO: 1488669 - protein, 17 aa, Mycobacterium tuberculosis
PRADGSTIFPFRRLFMV

SEQ ID NO: 1488670 - protein, 24 aa, Mycobacterium tuberculosis
PRAEGSTIFPFRGMFMATDVGGAR

SEQ ID NO: 1488671 - protein, 19 aa, Mycobacterium tuberculosis
PRAGILRAREFVMKDSYSF

SEQ ID NO: 1488672 - protein, 17 aa, Mycobacterium tuberculosis
PRAGTLLGQHTTVATVS

SEQ ID NO: 1488673 - protein, 20 aa, Mycobacterium tuberculosis
PRAHGSALFERGETQILGVT

SEQ ID NO: 1488674 - protein, 20 aa, Mycobacterium tuberculosis
PRAHRGIVAVNELPDLAERI

SEQ ID NO: 1488675 - protein, 23 aa, Mycobacterium tuberculosis
PRANPCVAGGCAVGVVQTPQPYW

SEQ ID NO: 1488676 - protein, 17 aa, Mycobacterium tuberculosis
PRAQFLTALAGVMRPGD

SEQ ID NO: 1488677 - protein, 20 aa, Mycobacterium tuberculosis
PRARAKISIRVAPGGDATAH

SEQ ID NO: 1488678 - protein, 17 aa, Mycobacterium tuberculosis
PRAWLTTVVSRLGLDKL

SEQ ID NO: 1488679 - protein, 33 aa, Mycobacterium tuberculosis
PRCCAPGRRPARCWPSSVSWAARLLAMRCGATG

SEQ ID NO: 1488680 - protein, 20 aa, Mycobacterium tuberculosis
PRCGPARPSNPAAPGSVGNS

SEQ ID NO: 1488681 - protein, 23 aa, Mycobacterium tuberculosis
PRCPLPRPAIGPGTYNLVVQLGN

SEQ ID NO: 1488682 - protein, 18 aa, Mycobacterium tuberculosis
PRCRQVPRLVAGILRKSF

SEQ ID NO: 1488683 - protein, 18 aa, Mycobacterium tuberculosis
PRDALSQWGTVRRRGGSG

SEQ ID NO: 1488684 - protein, 19 aa, Mycobacterium tuberculosis
PRDELIAFFVASDVMLVTP

SEQ ID NO: 1488685 - protein, 18 aa, Mycobacterium tuberculosis
PREAPACDARYWADNLRH

SEQ ID NO: 1488686 - protein, 19 aa, Mycobacterium tuberculosis
PREEPYCDAYYWVDNLRHT

SEQ ID NO: 1488687 - protein, 20 aa, Mycobacterium tuberculosis
PREEPYCDAYYWVDNLRHTV

SEQ ID NO: 1488688 - protein, 19 aa, Mycobacterium tuberculosis
PREEPYCDPTTGWTTCATP

SEQ ID NO: 1488689 - protein, 18 aa, Mycobacterium tuberculosis
PREGWPPALQGNWRSDSA

SEQ ID NO: 1488690 - protein, 20 aa, Mycobacterium tuberculosis
PRELTEAFANMGTEIFETMF

SEQ ID NO: 1488691 - protein, 18 aa, Mycobacterium tuberculosis
PRERAVVAGHSMGGITIA

SEQ ID NO: 1488692 - protein, 19 aa, Mycobacterium tuberculosis
PRFANARMAPSSGTSSAGV

SEQ ID NO: 1488693 - protein, 17 aa, Mycobacterium tuberculosis
PRFGHGVVTELGAGVRL

SEQ ID NO: 1488694 - protein, 20 aa, Mycobacterium tuberculosis
PRFVREFPFNLMLWDLDRRM

SEQ ID NO: 1488695 - protein, 21 aa, Mycobacterium tuberculosis
PRFVREFPFNLMLWDLDRRMR

SEQ ID NO: 1488696 - protein, 19 aa, Mycobacterium tuberculosis
PRGCGKTSSARILARSLNC

SEQ ID NO: 1488697 - protein, 22 aa, Mycobacterium tuberculosis
PRGCGKTSSARILARSLNCAQG

SEQ ID NO: 1488698 - protein, 20 aa, Mycobacterium tuberculosis
PRGDLAAAIYTTIKDQVETI

SEQ ID NO: 1488699 - protein, 19 aa, Mycobacterium tuberculosis
PRGKTVWFTGLSGSGKSSV

SEQ ID NO: 1488700 - protein, 18 aa, Mycobacterium tuberculosis
PRGLPPGVVANLAATLAA

SEQ ID NO: 1488701 - protein, 17 aa, Mycobacterium tuberculosis
PRGLSAVPLEPGQQTVG

SEQ ID NO: 1488702 - protein, 19 aa, Mycobacterium tuberculosis
PRGLSAVPLEPGQQTVGFS

SEQ ID NO: 1488703 - protein, 19 aa, Mycobacterium tuberculosis
PRGSYQIAVVGLKGGAGKT

SEQ ID NO: 1488704 - protein, 20 aa, Mycobacterium tuberculosis
PRGSYQIAVVGLKGGAGKTT

SEQ ID NO: 1488705 - protein, 19 aa, Mycobacterium tuberculosis
PRGVLAIAYRCPNGEPGVV

SEQ ID NO: 1488706 - protein, 24 aa, Mycobacterium tuberculosis
PRHPIRLARFGPRAALPATAMARR

SEQ ID NO: 1488707 - protein, 19 aa, Mycobacterium tuberculosis
PRHRGRFHGGVDIVVTAEL

SEQ ID NO: 1488708 - protein, 21 aa, Mycobacterium tuberculosis
PRIAAGDLHFSIGYSEPGAGT

SEQ ID NO: 1488709 - protein, 17 aa, Mycobacterium tuberculosis
PRIARPRANGCAMPSPI

SEQ ID NO: 1488710 - protein, 21 aa, Mycobacterium tuberculosis
PRIGLGALGLQLGQVGLQLLR

SEQ ID NO: 1488711 - protein, 23 aa, Mycobacterium tuberculosis
PRIPEDLAFAESRIRPSTIAAED

SEQ ID NO: 1488712 - protein, 20 aa, Mycobacterium tuberculosis
PRKCRCTPRSPNHATTTGQS

SEQ ID NO: 1488713 - protein, 18 aa, Mycobacterium tuberculosis
PRKIFDLLEHAPVDVAVL

SEQ ID NO: 1488714 - protein, 19 aa, Mycobacterium tuberculosis
PRKIFDLLEHAPVDVAVLT

SEQ ID NO: 1488715 - protein, 19 aa, Mycobacterium tuberculosis
PRKWARNLIREMSADRLYE

SEQ ID NO: 1488716 - protein, 20 aa, Mycobacterium tuberculosis
PRKWARNLIREMSADRLYER

SEQ ID NO: 1488717 - protein, 17 aa, Mycobacterium tuberculosis
PRLAERFEGAGHVVATQ

SEQ ID NO: 1488718 - protein, 17 aa, Mycobacterium tuberculosis
PRLARLVDGIAPRTHAA

SEQ ID NO: 1488719 - protein, 18 aa, Mycobacterium tuberculosis
PRLATHAWTADPDSAPKT

SEQ ID NO: 1488720 - protein, 19 aa, Mycobacterium tuberculosis
PRLGHNLALHPATMLAGLF

SEQ ID NO: 1488721 - protein, 19 aa, Mycobacterium tuberculosis
PRLGQPAGRLSGRTGGPGR

SEQ ID NO: 1488722 - protein, 20 aa, Mycobacterium tuberculosis
PRLGQRRLRILGAGQQRGEH

SEQ ID NO: 1488723 - protein, 23 aa, Mycobacterium tuberculosis
PRLKRPIPYLPNMIGLITGRASA

SEQ ID NO: 1488724 - protein, 19 aa, Mycobacterium tuberculosis
PRLPMPRLESPVLTKPMLT

SEQ ID NO: 1488725 - protein, 17 aa, Mycobacterium tuberculosis
PRLPWPMLPNPRLPSPT

SEQ ID NO: 1488726 - protein, 19 aa, Mycobacterium tuberculosis
PRLSRRILHQPYLGYPDSA

SEQ ID NO: 1488727 - protein, 23 aa, Mycobacterium tuberculosis
PRLVPGWTKPIVIGRHAFGDQYR

SEQ ID NO: 1488728 - protein, 20 aa, Mycobacterium tuberculosis
PRNPGSPAERLRALRRACAA

SEQ ID NO: 1488729 - protein, 24 aa, Mycobacterium tuberculosis
PRNRVRLGTVGPRQGRGVRFRCSR

SEQ ID NO: 1488730 - protein, 22 aa, Mycobacterium tuberculosis
PRPADCLRPLQIHALISEVLKT

SEQ ID NO: 1488731 - protein, 27 aa, Mycobacterium tuberculosis
PRPAWLDRCAAMNRHAIAAVREQLAAH

SEQ ID NO: 1488732 - protein, 18 aa, Mycobacterium tuberculosis
PRPCWPRPPRPTPPNCSG

SEQ ID NO: 1488733 - protein, 21 aa, Mycobacterium tuberculosis
PRPDSPSVFGAILDRSAGHFR

SEQ ID NO: 1488734 - protein, 17 aa, Mycobacterium tuberculosis
PRPDWPAEAVVVGPLHF

SEQ ID NO: 1488735 - protein, 20 aa, Mycobacterium tuberculosis
PRPEPLRVIHRAKGARNLHL

SEQ ID NO: 1488736 - protein, 21 aa, Mycobacterium tuberculosis
PRPGAFAYRPDPRLGSANAAL

SEQ ID NO: 1488737 - protein, 17 aa, Mycobacterium tuberculosis
PRPLRPDRLRPRPNHRP

SEQ ID NO: 1488738 - protein, 22 aa, Mycobacterium tuberculosis
PRPPKLPPRRRRPSAPRLAVPD

SEQ ID NO: 1488739 - protein, 21 aa, Mycobacterium tuberculosis
PRPPVPPAPPRPPGEPTPVPP

SEQ ID NO: 1488740 - protein, 19 aa, Mycobacterium tuberculosis
PRPQRRSCESLTRTQKLRP

SEQ ID NO: 1488741 - protein, 20 aa, Mycobacterium tuberculosis
PRPRGISVLSGTRRGYELDA

SEQ ID NO: 1488742 - protein, 20 aa, Mycobacterium tuberculosis
PRPRLCPPMLAAPRLTSPTF

SEQ ID NO: 1488743 - protein, 17 aa, Mycobacterium tuberculosis
PRPTAGWTPSPTGGEPK

SEQ ID NO: 1488744 - protein, 19 aa, Mycobacterium tuberculosis
PRPTTPFAQALRLALIDAA

SEQ ID NO: 1488745 - protein, 22 aa, Mycobacterium tuberculosis
PRPYRCRRSGCGGNAAAKGTAG

SEQ ID NO: 1488746 - protein, 19 aa, Mycobacterium tuberculosis
PRPYWRSKPISVVELHLDP

SEQ ID NO: 1488747 - protein, 25 aa, Mycobacterium tuberculosis
PRQQRGRFLCIADFIRSRELAAERG

SEQ ID NO: 1488748 - protein, 17 aa, Mycobacterium tuberculosis
PRQVPGASYWYAHTDQW

SEQ ID NO: 1488749 - protein, 20 aa, Mycobacterium tuberculosis
PRRCESGFGALKCAHPDATG

SEQ ID NO: 1488750 - protein, 21 aa, Mycobacterium tuberculosis
PRRFASGSALGMLSATGRCHA

SEQ ID NO: 1488751 - protein, 27 aa, Mycobacterium tuberculosis
PRRGHRVLTRCQMSFVVTIPEALAAVA

SEQ ID NO: 1488752 - protein, 25 aa, Mycobacterium tuberculosis
PRRGPRTRCGTYGYAAGRRAAGFRA

SEQ ID NO: 1488753 - protein, 20 aa, Mycobacterium tuberculosis
PRRKGVRYFGPYSHAWAIRE

SEQ ID NO: 1488754 - protein, 18 aa, Mycobacterium tuberculosis
PRRLLFRGRGRRRGLTAW

SEQ ID NO: 1488755 - protein, 17 aa, Mycobacterium tuberculosis
PRRLVRHAHWPDWHPMR

SEQ ID NO: 1488756 - protein, 25 aa, Mycobacterium tuberculosis
PRRQNLPPAPRRSATPVGVPSDAST

SEQ ID NO: 1488757 - protein, 22 aa, Mycobacterium tuberculosis
PRRRGDPLLLGHLPGDRRDRAG

SEQ ID NO: 1488758 - protein, 21 aa, Mycobacterium tuberculosis
PRRRRCRAKLWGGAAPVTRAG

SEQ ID NO: 1488759 - protein, 21 aa, Mycobacterium tuberculosis
PRRRSGCGRRRRLPGRRGRRT

SEQ ID NO: 1488760 - protein, 29 aa, Mycobacterium tuberculosis
PRRRSPARCSPRWGAGRGIRDDEQRHVRQ

SEQ ID NO: 1488761 - protein, 32 aa, Mycobacterium tuberculosis
PRRRWPRSWRLFKRFAAAAAKRAAQLASGNLG

SEQ ID NO: 1488762 - protein, 23 aa, Mycobacterium tuberculosis
PRRRYARNWGRAFACSARVRHWG

SEQ ID NO: 1488763 - protein, 21 aa, Mycobacterium tuberculosis
PRSGLPVIEVLDTELVRGRTA

SEQ ID NO: 1488764 - protein, 22 aa, Mycobacterium tuberculosis
PRSLHWLRPITPTFRPSWPDHS

SEQ ID NO: 1488765 - protein, 26 aa, Mycobacterium tuberculosis
PRSRPRQRARRLVPPARQVRPDVSEP

SEQ ID NO: 1488766 - protein, 17 aa, Mycobacterium tuberculosis
PRSRRHAVVYNNLPEPP

SEQ ID NO: 1488767 - protein, 19 aa, Mycobacterium tuberculosis
PRSVARWTAGQVVPQRLNK

SEQ ID NO: 1488768 - protein, 20 aa, Mycobacterium tuberculosis
PRTALWLLLAKCGGDTEVSA

SEQ ID NO: 1488769 - protein, 17 aa, Mycobacterium tuberculosis
PRTANMQSYLDASPVTH

SEQ ID NO: 1488770 - protein, 19 aa, Mycobacterium tuberculosis
PRTANMQSYLDASPVTHIS

SEQ ID NO: 1488771 - protein, 20 aa, Mycobacterium tuberculosis
PRTASVVIWYSPELGDTAAV

SEQ ID NO: 1488772 - protein, 24 aa, Mycobacterium tuberculosis
PRTCWRGCCPWPPSRFMCSPTRFA

SEQ ID NO: 1488773 - protein, 24 aa, Mycobacterium tuberculosis
PRTMPAALHWDRILFCAKEATYKA

SEQ ID NO: 1488774 - protein, 20 aa, Mycobacterium tuberculosis
PRTRSGAALPRSSDPVPISP

SEQ ID NO: 1488775 - protein, 22 aa, Mycobacterium tuberculosis
PRTSDMKALFTAIIDDDPLPLE

SEQ ID NO: 1488776 - protein, 17 aa, Mycobacterium tuberculosis
PRTTVGVVEYVRRRKNG

SEQ ID NO: 1488777 - protein, 19 aa, Mycobacterium tuberculosis
PRTVALTVYGDLETSTLRA

SEQ ID NO: 1488778 - protein, 20 aa, Mycobacterium tuberculosis
PRVAHCIYAGLATDTGSFRW

SEQ ID NO: 1488779 - protein, 18 aa, Mycobacterium tuberculosis
PRVASPRYRCTTPQCGRA

SEQ ID NO: 1488780 - protein, 17 aa, Mycobacterium tuberculosis
PRVEVEVGFILAADLPG

SEQ ID NO: 1488781 - protein, 18 aa, Mycobacterium tuberculosis
PRVFCMDEPLSNLDAKLR

SEQ ID NO: 1488782 - protein, 17 aa, Mycobacterium tuberculosis
PRVGQCGQLQHRVRKCR

SEQ ID NO: 1488783 - protein, 17 aa, Mycobacterium tuberculosis
PRVHLFFGARYACELYD

SEQ ID NO: 1488784 - protein, 29 aa, Mycobacterium tuberculosis
PRVLCTDDLRVARIRGCGADELSTAWNRA

SEQ ID NO: 1488785 - protein, 23 aa, Mycobacterium tuberculosis
PRVLGVGVDGDWAWLHTDALPGL

SEQ ID NO: 1488786 - protein, 26 aa, Mycobacterium tuberculosis
PRVLQIRALVLGGALDWLKDNKASTN

SEQ ID NO: 1488787 - protein, 17 aa, Mycobacterium tuberculosis
PRVPVEVNHEPFVTLGI

SEQ ID NO: 1488788 - protein, 34 aa, Mycobacterium tuberculosis
PRVRRKRGAAAFPWCCGRPVLAKLMAGRTTLMVT

SEQ ID NO: 1488789 - protein, 20 aa, Mycobacterium tuberculosis
PRVRRLGTSGSHLYWLETCR

SEQ ID NO: 1488790 - protein, 17 aa, Mycobacterium tuberculosis
PRVSAILDRPLQAVEHE

SEQ ID NO: 1488791 - protein, 24 aa, Mycobacterium tuberculosis
PRVWEKLKAGIEFTVARETDEMKR

SEQ ID NO: 1488792 - protein, 18 aa, Mycobacterium tuberculosis
PRWAGLRGTCATSCSAWY

SEQ ID NO: 1488793 - protein, 35 aa, Mycobacterium tuberculosis
PRWPQRSPTADGCWPGGCTGRWTGRRNCATRRPRN

SEQ ID NO: 1488794 - protein, 17 aa, Mycobacterium tuberculosis
PRYCSMSSDPKPREGTE

SEQ ID NO: 1488795 - protein, 18 aa, Mycobacterium tuberculosis
PRYLIGRKMLTPPARPVA

SEQ ID NO: 1488796 - protein, 17 aa, Mycobacterium tuberculosis
PSAAWKSNGLAAELLRR

SEQ ID NO: 1488797 - protein, 17 aa, Mycobacterium tuberculosis
PSACGKTNLAMLQPTIP

SEQ ID NO: 1488798 - protein, 17 aa, Mycobacterium tuberculosis
PSALAYLAEGFTAIGTT

SEQ ID NO: 1488799 - protein, 19 aa, Mycobacterium tuberculosis
PSALTWPMRSAHTGANSDL

SEQ ID NO: 1488800 - protein, 17 aa, Mycobacterium tuberculosis
PSANGWWCGGPGRRPGR

SEQ ID NO: 1488801 - protein, 24 aa, Mycobacterium tuberculosis
PSANLGANCQYPPSPDKAVKPVKL

SEQ ID NO: 1488802 - protein, 18 aa, Mycobacterium tuberculosis
PSAPPSKIFRTGALRVPG

SEQ ID NO: 1488803 - protein, 18 aa, Mycobacterium tuberculosis
PSAPRPPGAPAPPMPPLP

SEQ ID NO: 1488804 - protein, 19 aa, Mycobacterium tuberculosis
PSAPSRWLAGCSDLGAGCR

SEQ ID NO: 1488805 - protein, 17 aa, Mycobacterium tuberculosis
PSARVCGTGPVSAGLGN

SEQ ID NO: 1488806 - protein, 19 aa, Mycobacterium tuberculosis
PSAWIAEGLLVYLSAEAQQ

SEQ ID NO: 1488807 - protein, 25 aa, Mycobacterium tuberculosis
PSERRGPAAVRPFGQAGGGRANSGN

SEQ ID NO: 1488808 - protein, 18 aa, Mycobacterium tuberculosis
PSETGRCSKRDQIGIVFQ

SEQ ID NO: 1488809 - protein, 21 aa, Mycobacterium tuberculosis
PSGGFVPAGTTISVYTSDGQT

SEQ ID NO: 1488810 - protein, 17 aa, Mycobacterium tuberculosis
PSGHWPAILPMSTTTTC

SEQ ID NO: 1488811 - protein, 24 aa, Mycobacterium tuberculosis
PSGMTRWSPDSGETIAERLGLIVG

SEQ ID NO: 1488812 - protein, 20 aa, Mycobacterium tuberculosis
PSGNCLEVFHGTALEHRRVV

SEQ ID NO: 1488813 - protein, 25 aa, Mycobacterium tuberculosis
PSGNTRAFLGERIGVRRGVVVDADG

SEQ ID NO: 1488814 - protein, 22 aa, Mycobacterium tuberculosis
PSGRLAISYSRKVFIPVTRLCR

SEQ ID NO: 1488815 - protein, 19 aa, Mycobacterium tuberculosis
PSGSHLLPALIRRYDEAKA

SEQ ID NO: 1488816 - protein, 28 aa, Mycobacterium tuberculosis
PSGTEPKLKCYLEIRCAVTGDLPAARQL

SEQ ID NO: 1488817 - protein, 17 aa, Mycobacterium tuberculosis
PSGVLRPGTTSGYAEHI

SEQ ID NO: 1488818 - protein, 23 aa, Mycobacterium tuberculosis
PSGWAYWVAESLLGPGTQLADLK

SEQ ID NO: 1488819 - protein, 24 aa, Mycobacterium tuberculosis
PSHDIPRFVSLWQSGRLPVESLVT

SEQ ID NO: 1488820 - protein, 24 aa, Mycobacterium tuberculosis
PSHEGACVRATWLKVVPDQLGRSL

SEQ ID NO: 1488821 - protein, 21 aa, Mycobacterium tuberculosis
PSINPGLNFYFGEPQVTLLSL

SEQ ID NO: 1488822 - protein, 19 aa, Mycobacterium tuberculosis
PSIPLGFAAIGHIGPISIP

SEQ ID NO: 1488823 - protein, 17 aa, Mycobacterium tuberculosis
PSIVNGRRIQSKRQVFE

SEQ ID NO: 1488824 - protein, 29 aa, Mycobacterium tuberculosis
PSKSGLTWTQRLVSLLVFDGPDLPGPLST

SEQ ID NO: 1488825 - protein, 26 aa, Mycobacterium tuberculosis
PSLLSTERPARFAVLLRRLRRRDIDR

SEQ ID NO: 1488826 - protein, 22 aa, Mycobacterium tuberculosis
PSLRCAPAFDVDGMRTDSGSGP

SEQ ID NO: 1488827 - protein, 28 aa, Mycobacterium tuberculosis
PSLVARLAALASRVAVRPVLAVGSYLPH

SEQ ID NO: 1488828 - protein, 24 aa, Mycobacterium tuberculosis
PSLVPRTPLAPVLPAPPVPPMPPL

SEQ ID NO: 1488829 - protein, 17 aa, Mycobacterium tuberculosis
PSMADAWLGRIACGDRD

SEQ ID NO: 1488830 - protein, 22 aa, Mycobacterium tuberculosis
PSMADAWLGRIACGDRDLASLK

SEQ ID NO: 1488831 - protein, 17 aa, Mycobacterium tuberculosis
PSNLRKQLKGAPMPAPR

SEQ ID NO: 1488832 - protein, 20 aa, Mycobacterium tuberculosis
PSNTIAPFLGLLGGVAAADA

SEQ ID NO: 1488833 - protein, 22 aa, Mycobacterium tuberculosis
PSPFAASLLFGYVGAFMYEGDT

SEQ ID NO: 1488834 - protein, 27 aa, Mycobacterium tuberculosis
PSPFGPGRPGWHVECAAIALSRIGSGL

SEQ ID NO: 1488835 - protein, 27 aa, Mycobacterium tuberculosis
PSPINGRPSSAWVGALITPSTICSAAA

SEQ ID NO: 1488836 - protein, 17 aa, Mycobacterium tuberculosis
PSPKPGQKWVNVDPTKN

SEQ ID NO: 1488837 - protein, 18 aa, Mycobacterium tuberculosis
PSPLLRGGLAFIDTPGVG

SEQ ID NO: 1488838 - protein, 21 aa, Mycobacterium tuberculosis
PSPLSRPALPPAPPSPAVSPN

SEQ ID NO: 1488839 - protein, 20 aa, Mycobacterium tuberculosis
PSPPRPPAPPSPPLPPSDTS

SEQ ID NO: 1488840 - protein, 18 aa, Mycobacterium tuberculosis
PSPPRPPLPPVPALPPLP

SEQ ID NO: 1488841 - protein, 27 aa, Mycobacterium tuberculosis
PSPPTGWVPRALLPPWLAGTPPAPPVP

SEQ ID NO: 1488842 - protein, 24 aa, Mycobacterium tuberculosis
PSPPTPWLPARPAGASPPAPPAPP

SEQ ID NO: 1488843 - protein, 22 aa, Mycobacterium tuberculosis
PSPTCIIVGLPAGLRLAVDNAI

SEQ ID NO: 1488844 - protein, 23 aa, Mycobacterium tuberculosis
PSPTCIIVGLPAGLRLAVDNAIA

SEQ ID NO: 1488845 - protein, 18 aa, Mycobacterium tuberculosis
PSRGLGQRLLYPIHERRW

SEQ ID NO: 1488846 - protein, 17 aa, Mycobacterium tuberculosis
PSRGVWQFIAPTFAAYH

SEQ ID NO: 1488847 - protein, 19 aa, Mycobacterium tuberculosis
PSRIWPRLERTARAGPEPA

SEQ ID NO: 1488848 - protein, 17 aa, Mycobacterium tuberculosis
PSRLSDLELTGWPKRRS

SEQ ID NO: 1488849 - protein, 17 aa, Mycobacterium tuberculosis
PSRPAAAMMTLEMGKTL

SEQ ID NO: 1488850 - protein, 20 aa, Mycobacterium tuberculosis
PSRYRRSTVLAMPMLLPPML

SEQ ID NO: 1488851 - protein, 25 aa, Mycobacterium tuberculosis
PSSKARSTSCPRTRAAGTRRSSTTT

SEQ ID NO: 1488852 - protein, 22 aa, Mycobacterium tuberculosis
PSSKLGGLWKTVSPHLSPISNM

SEQ ID NO: 1488853 - protein, 33 aa, Mycobacterium tuberculosis
PSSKLGGLWKTVSPRLSPISNMVSMANNHMSMT

SEQ ID NO: 1488854 - protein, 22 aa, Mycobacterium tuberculosis
PSSKLGGLWTAVSPHLSPLSNM

SEQ ID NO: 1488855 - protein, 24 aa, Mycobacterium tuberculosis
PSSPPRWPTPCSDTSWVAGSCSTS

SEQ ID NO: 1488856 - protein, 22 aa, Mycobacterium tuberculosis
PSSSPRAAAFALCPNAAADPAT

SEQ ID NO: 1488857 - protein, 24 aa, Mycobacterium tuberculosis
PSSTKLRNGFRIQRQNTRIGQDVA

SEQ ID NO: 1488858 - protein, 24 aa, Mycobacterium tuberculosis
PSTGRRCPPARWSPAAGSPTSCAP

SEQ ID NO: 1488859 - protein, 21 aa, Mycobacterium tuberculosis
PSTLGYKGFPKSCCTSLNEVI

SEQ ID NO: 1488860 - protein, 24 aa, Mycobacterium tuberculosis
PSTTMGGFAIPAGPGYFNSSATPS

SEQ ID NO: 1488861 - protein, 26 aa, Mycobacterium tuberculosis
PSTTPRRWPTIPTRPSCMNGSPTPWA

SEQ ID NO: 1488862 - protein, 20 aa, Mycobacterium tuberculosis
PSVHRFDLFVPVFRNHLVEL

SEQ ID NO: 1488863 - protein, 29 aa, Mycobacterium tuberculosis
PSVRALFRGRGRYRFAHPQPHPGRQNRAL

SEQ ID NO: 1488864 - protein, 17 aa, Mycobacterium tuberculosis
PSVRELAVFWDRPAASA

SEQ ID NO: 1488865 - protein, 23 aa, Mycobacterium tuberculosis
PSWLRRWVRDGYAWVQPRLSPVA

SEQ ID NO: 1488866 - protein, 25 aa, Mycobacterium tuberculosis
PSYPHPRLMPDFWEFPTVSMGLGPL

SEQ ID NO: 1488867 - protein, 19 aa, Mycobacterium tuberculosis
PTAAPRWVVDPDFNLDFHV

SEQ ID NO: 1488868 - protein, 21 aa, Mycobacterium tuberculosis
PTADLAMWPPAGAVPVEVADG

SEQ ID NO: 1488869 - protein, 22 aa, Mycobacterium tuberculosis
PTADLAMWPPAGAVPVEVADGY

SEQ ID NO: 1488870 - protein, 26 aa, Mycobacterium tuberculosis
PTADLAMWPPAGVVPVEVADGYQQLA

SEQ ID NO: 1488871 - protein, 17 aa, Mycobacterium tuberculosis
PTAERHFHSIFYLRHNA

SEQ ID NO: 1488872 - protein, 19 aa, Mycobacterium tuberculosis
PTAGCARHSSGLSVQTFLR

SEQ ID NO: 1488873 - protein, 22 aa, Mycobacterium tuberculosis
PTAGWWPHWAPGSWPVRTPQRR

SEQ ID NO: 1488874 - protein, 20 aa, Mycobacterium tuberculosis
PTAPSYRTALSMVRQSMGAA

SEQ ID NO: 1488875 - protein, 24 aa, Mycobacterium tuberculosis
PTASRAVSWWSVHEYVAPTLAAAV

SEQ ID NO: 1488876 - protein, 21 aa, Mycobacterium tuberculosis
PTAWLAEGMLIYLPPDPRTGC

SEQ ID NO: 1488877 - protein, 19 aa, Mycobacterium tuberculosis
PTDLLVCRGPFVPIDSIDD

SEQ ID NO: 1488878 - protein, 17 aa, Mycobacterium tuberculosis
PTDTGWCEWPTATSPRT

SEQ ID NO: 1488879 - protein, 17 aa, Mycobacterium tuberculosis
PTDVPITPCELTAAKNA

SEQ ID NO: 1488880 - protein, 18 aa, Mycobacterium tuberculosis
PTDVPITPCELTAAKNAA

SEQ ID NO: 1488881 - protein, 17 aa, Mycobacterium tuberculosis
PTECEFFSLRGLALLTD

SEQ ID NO: 1488882 - protein, 18 aa, Mycobacterium tuberculosis
PTELSRSGGWPMSASPAP

SEQ ID NO: 1488883 - protein, 20 aa, Mycobacterium tuberculosis
PTFAGRAIAASLGLANVGGG

SEQ ID NO: 1488884 - protein, 19 aa, Mycobacterium tuberculosis
PTFGDWGFALARLTDIAPT

SEQ ID NO: 1488885 - protein, 17 aa, Mycobacterium tuberculosis
PTGKAVLRLSVQTQGQG

SEQ ID NO: 1488886 - protein, 19 aa, Mycobacterium tuberculosis
PTGLAGLGILISEAVRGEG

SEQ ID NO: 1488887 - protein, 18 aa, Mycobacterium tuberculosis
PTGLRPNAVVGVRLAALA

SEQ ID NO: 1488888 - protein, 27 aa, Mycobacterium tuberculosis
PTGRPTGEWSAAVSRLAAAEAAVADCA

SEQ ID NO: 1488889 - protein, 17 aa, Mycobacterium tuberculosis
PTGTFTFAELLAHELSV

SEQ ID NO: 1488890 - protein, 19 aa, Mycobacterium tuberculosis
PTIDLPVPDDWRLLPESSR

SEQ ID NO: 1488891 - protein, 19 aa, Mycobacterium tuberculosis
PTIELPGFVAGNGHWALTK

SEQ ID NO: 1488892 - protein, 25 aa, Mycobacterium tuberculosis
PTIRRRFSTRAKRRRATRVTGPTIC

SEQ ID NO: 1488893 - protein, 27 aa, Mycobacterium tuberculosis
PTITARLNFQLAFGARVGQRLADAREQ

SEQ ID NO: 1488894 - protein, 17 aa, Mycobacterium tuberculosis
PTLAAAVEWPMAGTPAW

SEQ ID NO: 1488895 - protein, 18 aa, Mycobacterium tuberculosis
PTLCRLFAELGVATQESE

SEQ ID NO: 1488896 - protein, 26 aa, Mycobacterium tuberculosis
PTLGRTTRAASMWVTPTPVVSTRAAS

SEQ ID NO: 1488897 - protein, 17 aa, Mycobacterium tuberculosis
PTLLRKGERLLVFLPLA

SEQ ID NO: 1488898 - protein, 17 aa, Mycobacterium tuberculosis
PTLMVSDLFDFSLYVDA

SEQ ID NO: 1488899 - protein, 26 aa, Mycobacterium tuberculosis
PTLNLKEWKAEWGVADPREARGALTT

SEQ ID NO: 1488900 - protein, 17 aa, Mycobacterium tuberculosis
PTLPKPALWLPTLANPI

SEQ ID NO: 1488901 - protein, 23 aa, Mycobacterium tuberculosis
PTLPLPTPVGMEIMPPQPPLPPD

SEQ ID NO: 1488902 - protein, 18 aa, Mycobacterium tuberculosis
PTLPRPGTPAVRPELPTP

SEQ ID NO: 1488903 - protein, 26 aa, Mycobacterium tuberculosis
PTLRRPCPNCRLAQRGLAAAHARTTP

SEQ ID NO: 1488904 - protein, 17 aa, Mycobacterium tuberculosis
PTLSAGTAIAQQHPAGT

SEQ ID NO: 1488905 - protein, 18 aa, Mycobacterium tuberculosis
PTLSRADALLAHDTLVPD

SEQ ID NO: 1488906 - protein, 27 aa, Mycobacterium tuberculosis
PTMFADVRRELAIRAAVEAATVTDSDG

SEQ ID NO: 1488907 - protein, 27 aa, Mycobacterium tuberculosis
PTMLSVPRWAVGPVMELGTDHRRIEGL

SEQ ID NO: 1488908 - protein, 18 aa, Mycobacterium tuberculosis
PTMTTPFIVEMLKRERDI

SEQ ID NO: 1488909 - protein, 18 aa, Mycobacterium tuberculosis
PTNAMTRQVYREVVAAAN

SEQ ID NO: 1488910 - protein, 17 aa, Mycobacterium tuberculosis
PTNFGLNGAGGGGGVGG

SEQ ID NO: 1488911 - protein, 18 aa, Mycobacterium tuberculosis
PTNVWVGALITPSTCCSV

SEQ ID NO: 1488912 - protein, 18 aa, Mycobacterium tuberculosis
PTPACSTRAPTTSVCSTR

SEQ ID NO: 1488913 - protein, 22 aa, Mycobacterium tuberculosis
PTPAGLFSIPNPFAVTYYLIKG

SEQ ID NO: 1488914 - protein, 18 aa, Mycobacterium tuberculosis
PTPAYGGAEQVWAAVAEM

SEQ ID NO: 1488915 - protein, 22 aa, Mycobacterium tuberculosis
PTPDSPTGWVYIVADSFTRGEP

SEQ ID NO: 1488916 - protein, 27 aa, Mycobacterium tuberculosis
PTPGPGRWRTRCCPWTVAEGLRSGLAS

SEQ ID NO: 1488917 - protein, 17 aa, Mycobacterium tuberculosis
PTPRPTAGWTPSPTGGE

SEQ ID NO: 1488918 - protein, 30 aa, Mycobacterium tuberculosis
PTPSSWRFRRRGWRASSMASRRAHMPPPGR

SEQ ID NO: 1488919 - protein, 26 aa, Mycobacterium tuberculosis
PTQALLGRPLIGDGAVGTASSPDGQD

SEQ ID NO: 1488920 - protein, 22 aa, Mycobacterium tuberculosis
PTQALWGRPLIGNGADGTAANP

SEQ ID NO: 1488921 - protein, 20 aa, Mycobacterium tuberculosis
PTQIPSVAVPVTGAGGTGGN

SEQ ID NO: 1488922 - protein, 23 aa, Mycobacterium tuberculosis
PTQLRFDRWFLPLAVPLGLGPKN

SEQ ID NO: 1488923 - protein, 22 aa, Mycobacterium tuberculosis
PTRAAATTGVAAWVPLPETGFR

SEQ ID NO: 1488924 - protein, 28 aa, Mycobacterium tuberculosis
PTRCTCAPSPAPSCRGRSPPSLRRSPEM

SEQ ID NO: 1488925 - protein, 21 aa, Mycobacterium tuberculosis
PTRRGNWWYYARTFEGKQYGV

SEQ ID NO: 1488926 - protein, 23 aa, Mycobacterium tuberculosis
PTRVWGVPAAGLWAHRLGDQRAK

SEQ ID NO: 1488927 - protein, 19 aa, Mycobacterium tuberculosis
PTSHYRFRTSAGSGRGCRI

SEQ ID NO: 1488928 - protein, 28 aa, Mycobacterium tuberculosis
PTSNALLFLPARLPATALPATTRAIAKA

SEQ ID NO: 1488929 - protein, 19 aa, Mycobacterium tuberculosis
PTSRGFERFYGFLGGETDQ

SEQ ID NO: 1488930 - protein, 17 aa, Mycobacterium tuberculosis
PTSVLLINHGFAHRDPD

SEQ ID NO: 1488931 - protein, 22 aa, Mycobacterium tuberculosis
PTSWLPVPVPPVPPVPPLPVKM

SEQ ID NO: 1488932 - protein, 17 aa, Mycobacterium tuberculosis
PTTAFRMGEKVDDPLAM

SEQ ID NO: 1488933 - protein, 23 aa, Mycobacterium tuberculosis
PTTAGATAWRTGPNSTPVILRCG

SEQ ID NO: 1488934 - protein, 24 aa, Mycobacterium tuberculosis
PTTEEVFSALGVVVNKGNVGALEE

SEQ ID NO: 1488935 - protein, 17 aa, Mycobacterium tuberculosis
PTTGLLAAGADEVSAAI

SEQ ID NO: 1488936 - protein, 22 aa, Mycobacterium tuberculosis
PTTGRPRRAGVSSFGVSGTNAH

SEQ ID NO: 1488937 - protein, 21 aa, Mycobacterium tuberculosis
PTTKHIPAFKLTRSSAAYWRG

SEQ ID NO: 1488938 - protein, 18 aa, Mycobacterium tuberculosis
PTTLAYRIEGLPARLRKV

SEQ ID NO: 1488939 - protein, 38 aa, Mycobacterium tuberculosis
PTTLHFPGFTIPTVPIHIGLPLSLTIPGFTIPGGTLIP

SEQ ID NO: 1488940 - protein, 19 aa, Mycobacterium tuberculosis
PTTMHIRRGPTLGCMRGHW

SEQ ID NO: 1488941 - protein, 19 aa, Mycobacterium tuberculosis
PTTPARRFGPTRLAQTKRA

SEQ ID NO: 1488942 - protein, 18 aa, Mycobacterium tuberculosis
PTTTAVHRLCRRCRLYRH

SEQ ID NO: 1488943 - protein, 18 aa, Mycobacterium tuberculosis
PTVAAFTTVLATLARGGG

SEQ ID NO: 1488944 - protein, 24 aa, Mycobacterium tuberculosis
PTVAECLIVLTARHGPVARTIFER

SEQ ID NO: 1488945 - protein, 23 aa, Mycobacterium tuberculosis
PTVPADVDYARPATTAGAAGAEQ

SEQ ID NO: 1488946 - protein, 18 aa, Mycobacterium tuberculosis
PTVRFAHRHQVDKLIVEG

SEQ ID NO: 1488947 - protein, 17 aa, Mycobacterium tuberculosis
PTVTALLQLAAYADALV

SEQ ID NO: 1488948 - protein, 25 aa, Mycobacterium tuberculosis
PTWAPTTPVATTWAAPTPASPTWAS

SEQ ID NO: 1488949 - protein, 23 aa, Mycobacterium tuberculosis
PTYAFARQRFWLDGLGAVGGDLG

SEQ ID NO: 1488950 - protein, 24 aa, Mycobacterium tuberculosis
PTYAFARQRFWLDGLGAVGGDLGG

SEQ ID NO: 1488951 - protein, 24 aa, Mycobacterium tuberculosis
PTYAFQRRRFWLSGDGVAADAAGL

SEQ ID NO: 1488952 - protein, 22 aa, Mycobacterium tuberculosis
PTYAVICCPAFGAAAKVGTFNP

SEQ ID NO: 1488953 - protein, 26 aa, Mycobacterium tuberculosis
PVAAARRHCRHHFPRWPMATGPPPRP

SEQ ID NO: 1488954 - protein, 28 aa, Mycobacterium tuberculosis
PVAALAAVPARAGRRSAVAADAAVAAVA

SEQ ID NO: 1488955 - protein, 20 aa, Mycobacterium tuberculosis
PVAALPCEREPIALPAEQQE

SEQ ID NO: 1488956 - protein, 25 aa, Mycobacterium tuberculosis
PVAALPCEREPIALPAGQQELLISP

SEQ ID NO: 1488957 - protein, 24 aa, Mycobacterium tuberculosis
PVADPALVPLFFVAREARKHVKVV

SEQ ID NO: 1488958 - protein, 17 aa, Mycobacterium tuberculosis
PVAEYWPAFGANGKATL

SEQ ID NO: 1488959 - protein, 31 aa, Mycobacterium tuberculosis
PVAGSEHLVAWMKAVVYGAAERWTDVIDQVK

SEQ ID NO: 1488960 - protein, 24 aa, Mycobacterium tuberculosis
PVAHRPAHRRWFAEEAGCRGGGSA

SEQ ID NO: 1488961 - protein, 17 aa, Mycobacterium tuberculosis
PVAPLRPMLPLWPPSRV

SEQ ID NO: 1488962 - protein, 20 aa, Mycobacterium tuberculosis
PVAPRRAGGAVAEVYAEARR

SEQ ID NO: 1488963 - protein, 21 aa, Mycobacterium tuberculosis
PVAVFRCGMILADTSYAGQLN

SEQ ID NO: 1488964 - protein, 25 aa, Mycobacterium tuberculosis
PVDAACYRTTFLVTVGFGQQLERAP

SEQ ID NO: 1488965 - protein, 17 aa, Mycobacterium tuberculosis
PVDEVWVGMVPEFDGKP

SEQ ID NO: 1488966 - protein, 18 aa, Mycobacterium tuberculosis
PVDEVWVGMVPEFDGKPL

SEQ ID NO: 1488967 - protein, 19 aa, Mycobacterium tuberculosis
PVEPAGCGRANASRRPGGI

SEQ ID NO: 1488968 - protein, 25 aa, Mycobacterium tuberculosis
PVEPQGPRCGRRYSRIRPSRASSTP

SEQ ID NO: 1488969 - protein, 17 aa, Mycobacterium tuberculosis
PVFGPSFEVEVDTDLRI

SEQ ID NO: 1488970 - protein, 18 aa, Mycobacterium tuberculosis
PVFGPSFEVEVDTDLRIR

SEQ ID NO: 1488971 - protein, 24 aa, Mycobacterium tuberculosis
PVFPGETLSTVIWRTEPGRAVFRT

SEQ ID NO: 1488972 - protein, 23 aa, Mycobacterium tuberculosis
PVFPTYRLDHQFEVIRLVGELTD

SEQ ID NO: 1488973 - protein, 19 aa, Mycobacterium tuberculosis
PVFVARAGGGIVEDVDGNR

SEQ ID NO: 1488974 - protein, 17 aa, Mycobacterium tuberculosis
PVGEVRSRFYARAPELH

SEQ ID NO: 1488975 - protein, 19 aa, Mycobacterium tuberculosis
PVGIVEVDGFPVFDVPPDA

SEQ ID NO: 1488976 - protein, 23 aa, Mycobacterium tuberculosis
PVGPGVAAAGCWAMVESAGPAAE

SEQ ID NO: 1488977 - protein, 17 aa, Mycobacterium tuberculosis
PVGSGIREKCCRTERQR

SEQ ID NO: 1488978 - protein, 21 aa, Mycobacterium tuberculosis
PVGTGGGCGATAANGGVGGTS

SEQ ID NO: 1488979 - protein, 18 aa, Mycobacterium tuberculosis
PVHAVRLAGLVAHQEVLF

SEQ ID NO: 1488980 - protein, 30 aa, Mycobacterium tuberculosis
PVHPARLAVPVGLPGYWATAGAAEPAGRAR

SEQ ID NO: 1488981 - protein, 17 aa, Mycobacterium tuberculosis
PVHRPLAGVPVVIPGGE

SEQ ID NO: 1488982 - protein, 20 aa, Mycobacterium tuberculosis
PVIDMWAPFVPSAEVIDDLR

SEQ ID NO: 1488983 - protein, 18 aa, Mycobacterium tuberculosis
PVIEQALLDNGVETRTGV

SEQ ID NO: 1488984 - protein, 17 aa, Mycobacterium tuberculosis
PVIIGPITFLLLSKAVD

SEQ ID NO: 1488985 - protein, 20 aa, Mycobacterium tuberculosis
PVISIPVWPTLGRTTRAASM

SEQ ID NO: 1488986 - protein, 17 aa, Mycobacterium tuberculosis
PVLAEWFLRRFSLLDSL

SEQ ID NO: 1488987 - protein, 22 aa, Mycobacterium tuberculosis
PVLECLRAGVPATALYVALGTE

SEQ ID NO: 1488988 - protein, 20 aa, Mycobacterium tuberculosis
PVLEPMAGKIIHCGAAGAGQ

SEQ ID NO: 1488989 - protein, 21 aa, Mycobacterium tuberculosis
PVLEVALRLGVGYVGAMGSRK

SEQ ID NO: 1488990 - protein, 22 aa, Mycobacterium tuberculosis
PVLEVALRLGVGYVGAMGSRKT

SEQ ID NO: 1488991 - protein, 30 aa, Mycobacterium tuberculosis
PVLGVCVGMQILFACGVEFGVQTPGCGHWP

SEQ ID NO: 1488992 - protein, 18 aa, Mycobacterium tuberculosis
PVLMPELGESVTEGTVIR

SEQ ID NO: 1488993 - protein, 25 aa, Mycobacterium tuberculosis
PVLNARFALNAANARWGSLYDALYG

SEQ ID NO: 1488994 - protein, 26 aa, Mycobacterium tuberculosis
PVLNARFALNAANARWGSLYDALYGT

SEQ ID NO: 1488995 - protein, 17 aa, Mycobacterium tuberculosis
PVLPFLGELVVEGGGLE

SEQ ID NO: 1488996 - protein, 17 aa, Mycobacterium tuberculosis
PVLPFTVVAARLADAAD

SEQ ID NO: 1488997 - protein, 22 aa, Mycobacterium tuberculosis
PVLVAFCARSPHGVSAGGSRLV

SEQ ID NO: 1488998 - protein, 23 aa, Mycobacterium tuberculosis
PVMCFSGPMIFGAGVLGGAQADL

SEQ ID NO: 1488999 - protein, 20 aa, Mycobacterium tuberculosis
PVMFDRIMDLPAEIRNRYDG

SEQ ID NO: 1489000 - protein, 18 aa, Mycobacterium tuberculosis
PVMNEVWVLAATPRIARR

SEQ ID NO: 1489001 - protein, 18 aa, Mycobacterium tuberculosis
PVNNRWRISEALDAARYY

SEQ ID NO: 1489002 - protein, 19 aa, Mycobacterium tuberculosis
PVPAGWRTIGRVLDGPARV

SEQ ID NO: 1489003 - protein, 20 aa, Mycobacterium tuberculosis
PVPDDWRLLPESSRAPYGGI

SEQ ID NO: 1489004 - protein, 24 aa, Mycobacterium tuberculosis
PVPEVLEVRGEVFFRLDDFQALNA

SEQ ID NO: 1489005 - protein, 20 aa, Mycobacterium tuberculosis
PVPGAEPVVGGWTGGRITVS

SEQ ID NO: 1489006 - protein, 19 aa, Mycobacterium tuberculosis
PVPHWPKYWIQALAKHFQR

SEQ ID NO: 1489007 - protein, 26 aa, Mycobacterium tuberculosis
PVPLPELRLPPLPPLPPGVAPAPPAP

SEQ ID NO: 1489008 - protein, 22 aa, Mycobacterium tuberculosis
PVPMLPGSWGPDLVGVAGDGGL

SEQ ID NO: 1489009 - protein, 21 aa, Mycobacterium tuberculosis
PVPPVRPLPAAPRTLSPPVPP

SEQ ID NO: 1489010 - protein, 18 aa, Mycobacterium tuberculosis
PVPVGVVGDVYYGGGPAV

SEQ ID NO: 1489011 - protein, 26 aa, Mycobacterium tuberculosis
PVPVPGFEVRALFTAGIDTPVAAEPR

SEQ ID NO: 1489012 - protein, 18 aa, Mycobacterium tuberculosis
PVPVPGFEVRHFHRRIDT

SEQ ID NO: 1489013 - protein, 17 aa, Mycobacterium tuberculosis
PVQDLAARCSFEQVAFL

SEQ ID NO: 1489014 - protein, 21 aa, Mycobacterium tuberculosis
PVQFICGGSFDTAAGPSAPDY

SEQ ID NO: 1489015 - protein, 19 aa, Mycobacterium tuberculosis
PVQLVRIGRLYLIGIPGEP

SEQ ID NO: 1489016 - protein, 25 aa, Mycobacterium tuberculosis
PVQRSVARFALIQALSAVLVGAGTR

SEQ ID NO: 1489017 - protein, 19 aa, Mycobacterium tuberculosis
PVRCACTKPPLTASSTGGS

SEQ ID NO: 1489018 - protein, 26 aa, Mycobacterium tuberculosis
PVRPHIGCAVHRGHGLVHRSACLPHV

SEQ ID NO: 1489019 - protein, 24 aa, Mycobacterium tuberculosis
PVRRARRNCCCGSVFSQRRRIIHH

SEQ ID NO: 1489020 - protein, 20 aa, Mycobacterium tuberculosis
PVRVGRDVPGFIGNRLQHAL

SEQ ID NO: 1489021 - protein, 26 aa, Mycobacterium tuberculosis
PVSATPGWPAPGWSTPAASTPVWQTP

SEQ ID NO: 1489022 - protein, 19 aa, Mycobacterium tuberculosis
PVSDRGACARRSCRPGEPP

SEQ ID NO: 1489023 - protein, 26 aa, Mycobacterium tuberculosis
PVSGRLRKGVAMDFGLQPPEITSGEM

SEQ ID NO: 1489024 - protein, 25 aa, Mycobacterium tuberculosis
PVSMLIPRVVGFRLTGEIQPGVTAT

SEQ ID NO: 1489025 - protein, 17 aa, Mycobacterium tuberculosis
PVSWLPFYHDMGLMLGI

SEQ ID NO: 1489026 - protein, 18 aa, Mycobacterium tuberculosis
PVTARGAEELIDAHYHVD

SEQ ID NO: 1489027 - protein, 19 aa, Mycobacterium tuberculosis
PVTGEVYVTNFAGDTVSVI

SEQ ID NO: 1489028 - protein, 17 aa, Mycobacterium tuberculosis
PVTGVVYVTNSLDDTVS

SEQ ID NO: 1489029 - protein, 18 aa, Mycobacterium tuberculosis
PVTLRQALLGKVMTVGDA

SEQ ID NO: 1489030 - protein, 26 aa, Mycobacterium tuberculosis
PVTMRNRLRLAATHAVRTSADVVRSM

SEQ ID NO: 1489031 - protein, 17 aa, Mycobacterium tuberculosis
PVTPKSLRLLQVGGSKL

SEQ ID NO: 1489032 - protein, 23 aa, Mycobacterium tuberculosis
PVTSCWPTWTMRVGTPSWLSICL

SEQ ID NO: 1489033 - protein, 20 aa, Mycobacterium tuberculosis
PVTVEVPVGGILAPLQPFQA

SEQ ID NO: 1489034 - protein, 17 aa, Mycobacterium tuberculosis
PVTVIAATAGRSDLKTV

SEQ ID NO: 1489035 - protein, 20 aa, Mycobacterium tuberculosis
PVTVNWSTPAVTIFPNGISI

SEQ ID NO: 1489036 - protein, 20 aa, Mycobacterium tuberculosis
PVTVSARLVSIVDDCAQHLG

SEQ ID NO: 1489037 - protein, 20 aa, Mycobacterium tuberculosis
PVVAVAGRFVHTSIRTTVGA

SEQ ID NO: 1489038 - protein, 19 aa, Mycobacterium tuberculosis
PVVGDEVVCPLQVGRRAVH

SEQ ID NO: 1489039 - protein, 24 aa, Mycobacterium tuberculosis
PVVGVAVGLLARVERGRRVVGDFR

SEQ ID NO: 1489040 - protein, 19 aa, Mycobacterium tuberculosis
PVVMPAKLFDEWFPANKLV

SEQ ID NO: 1489041 - protein, 21 aa, Mycobacterium tuberculosis
PVVPAGVGRTALRRRRQRRCP

SEQ ID NO: 1489042 - protein, 22 aa, Mycobacterium tuberculosis
PVVVHPSWWSAARVEVVTAAAR

SEQ ID NO: 1489043 - protein, 17 aa, Mycobacterium tuberculosis
PWAARGIGRLTSCALRR

SEQ ID NO: 1489044 - protein, 18 aa, Mycobacterium tuberculosis
PWAGPRRRAGRLGQLDLR

SEQ ID NO: 1489045 - protein, 20 aa, Mycobacterium tuberculosis
PWCRGDGWISPPVVAVALGW

SEQ ID NO: 1489046 - protein, 17 aa, Mycobacterium tuberculosis
PWCRTLASHLGHFATTD

SEQ ID NO: 1489047 - protein, 18 aa, Mycobacterium tuberculosis
PWCRTLASHLGHFATTDA

SEQ ID NO: 1489048 - protein, 18 aa, Mycobacterium tuberculosis
PWDGDQLLRALGLRPPGH

SEQ ID NO: 1489049 - protein, 18 aa, Mycobacterium tuberculosis
PWHIGLYGNAGGLGPMQG

SEQ ID NO: 1489050 - protein, 18 aa, Mycobacterium tuberculosis
PWHVPGRPRRAGRCVVVR

SEQ ID NO: 1489051 - protein, 18 aa, Mycobacterium tuberculosis
PWHVPGRPRRAGVSSFGI

SEQ ID NO: 1489052 - protein, 28 aa, Mycobacterium tuberculosis
PWIHCWSRNRHQLVSLVLSNLFGQNAPA

SEQ ID NO: 1489053 - protein, 27 aa, Mycobacterium tuberculosis
PWKSTCPSCMPPVCGRRCSRTGEIRGY

SEQ ID NO: 1489054 - protein, 17 aa, Mycobacterium tuberculosis
PWLPSLGNPLTFLSPAN

SEQ ID NO: 1489055 - protein, 18 aa, Mycobacterium tuberculosis
PWLPSLGNPLTFLSPANI

SEQ ID NO: 1489056 - protein, 20 aa, Mycobacterium tuberculosis
PWLPSLGNPLTFLSPANIAF

SEQ ID NO: 1489057 - protein, 20 aa, Mycobacterium tuberculosis
PWRHFARTHAIGQIVPGKVT

SEQ ID NO: 1489058 - protein, 19 aa, Mycobacterium tuberculosis
PWSPVSLGDYCAGSNHVLP

SEQ ID NO: 1489059 - protein, 29 aa, Mycobacterium tuberculosis
PWTPRRWSTRCWSRPRVSSIASPTPGCYS

SEQ ID NO: 1489060 - protein, 20 aa, Mycobacterium tuberculosis
PWVSLGAASAVTSRIRLATA

SEQ ID NO: 1489061 - protein, 19 aa, Mycobacterium tuberculosis
PWVVCAGTGRPGPDRCRGR

SEQ ID NO: 1489062 - protein, 17 aa, Mycobacterium tuberculosis
PYAAWLAAAAVQAEQTA

SEQ ID NO: 1489063 - protein, 18 aa, Mycobacterium tuberculosis
PYASPRRCKPPSKTATGS

SEQ ID NO: 1489064 - protein, 17 aa, Mycobacterium tuberculosis
PYCGSPYSFLPQLNPGD

SEQ ID NO: 1489065 - protein, 17 aa, Mycobacterium tuberculosis
PYDLSFSRFELLRLLAF

SEQ ID NO: 1489066 - protein, 25 aa, Mycobacterium tuberculosis
PYFGDRRKAFLEGLAVVTGGQVVNP

SEQ ID NO: 1489067 - protein, 18 aa, Mycobacterium tuberculosis
PYGDVFLIIDGWPGFVGE

SEQ ID NO: 1489068 - protein, 34 aa, Mycobacterium tuberculosis
PYLAYRPVCRPAWLPTLRRPWRRSPERPSSWYRR

SEQ ID NO: 1489069 - protein, 35 aa, Mycobacterium tuberculosis
PYLAYRPVCRPAWLPTLRRPWRRSPERPSSWYRRP

SEQ ID NO: 1489070 - protein, 18 aa, Mycobacterium tuberculosis
PYLPSHPQYDLAKRQMSG

SEQ ID NO: 1489071 - protein, 22 aa, Mycobacterium tuberculosis
PYNRGWFPQVFSIIDGQKVGVT

SEQ ID NO: 1489072 - protein, 19 aa, Mycobacterium tuberculosis
PYPTLRWHSQRGGSAVSHY

SEQ ID NO: 1489073 - protein, 17 aa, Mycobacterium tuberculosis
PYPTMYVNQPWTIRQYA

SEQ ID NO: 1489074 - protein, 21 aa, Mycobacterium tuberculosis
PYRANMWALRALWCAAGLRAV

SEQ ID NO: 1489075 - protein, 23 aa, Mycobacterium tuberculosis
PYRDAYLLREARLFRAELTIPLI

SEQ ID NO: 1489076 - protein, 18 aa, Mycobacterium tuberculosis
PYRFVYRKRFHKRCETEL

SEQ ID NO: 1489077 - protein, 19 aa, Mycobacterium tuberculosis
PYRGVEAAERLATRRRQSL

SEQ ID NO: 1489078 - protein, 18 aa, Mycobacterium tuberculosis
PYRPEPPAPPPGGPPPGP

SEQ ID NO: 1489079 - protein, 19 aa, Mycobacterium tuberculosis
PYSGPRRGAGRTALARGSS

SEQ ID NO: 1489080 - protein, 20 aa, Mycobacterium tuberculosis
PYSLLMGSIRVADEVSVAFT

SEQ ID NO: 1489081 - protein, 19 aa, Mycobacterium tuberculosis
PYSSCSQSVMIGSRSGVTP

SEQ ID NO: 1489082 - protein, 18 aa, Mycobacterium tuberculosis
PYYHPGLNAPEIRYMLDR

SEQ ID NO: 1489083 - protein, 19 aa, Mycobacterium tuberculosis
QAAAFHERFIQALSTAAGA

SEQ ID NO: 1489084 - protein, 23 aa, Mycobacterium tuberculosis
QAAAFHERFIQALSTAAGAYGSA

SEQ ID NO: 1489085 - protein, 21 aa, Mycobacterium tuberculosis
QAAAFHQQFVRALSSAAGSYA

SEQ ID NO: 1489086 - protein, 27 aa, Mycobacterium tuberculosis
QAAAGKRCPPTAFISGRLPAPPAADVT

SEQ ID NO: 1489087 - protein, 25 aa, Mycobacterium tuberculosis
QAAAQRLPFLPIRAGLGSSVPQFWA

SEQ ID NO: 1489088 - protein, 32 aa, Mycobacterium tuberculosis
QAAGPRRRRCWSAGRAGWRWLPRSRSPRKPGP

SEQ ID NO: 1489089 - protein, 21 aa, Mycobacterium tuberculosis
QAALFHDRFVQILQEGAAAYA

SEQ ID NO: 1489090 - protein, 22 aa, Mycobacterium tuberculosis
QAALKDGYRVFGELAPHPLLTY

SEQ ID NO: 1489091 - protein, 25 aa, Mycobacterium tuberculosis
QAAMFDGRFVGFADFLIRDGHRYRV

SEQ ID NO: 1489092 - protein, 25 aa, Mycobacterium tuberculosis
QAAQFGWQGASAMALNAKMDDWLDA

SEQ ID NO: 1489093 - protein, 19 aa, Mycobacterium tuberculosis
QAARCVANWDGARVDKGLR

SEQ ID NO: 1489094 - protein, 18 aa, Mycobacterium tuberculosis
QAAREGRDMLALTSAQWD

SEQ ID NO: 1489095 - protein, 17 aa, Mycobacterium tuberculosis
QAARKWVRDNGFDHPVR

SEQ ID NO: 1489096 - protein, 22 aa, Mycobacterium tuberculosis
QAATFHIQFVRALTAGAGSYAT

SEQ ID NO: 1489097 - protein, 24 aa, Mycobacterium tuberculosis
QAAVSGLVTALFGAPGQPGDTGQP

SEQ ID NO: 1489098 - protein, 22 aa, Mycobacterium tuberculosis
QACAAGARIISWARVERILHRA

SEQ ID NO: 1489099 - protein, 23 aa, Mycobacterium tuberculosis
QACAAGARIISWARVERILHRAG

SEQ ID NO: 1489100 - protein, 22 aa, Mycobacterium tuberculosis
QACQRAGALAAAIDGTRRPLAA

SEQ ID NO: 1489101 - protein, 17 aa, Mycobacterium tuberculosis
QACYEAHGTLFFGVPTV

SEQ ID NO: 1489102 - protein, 23 aa, Mycobacterium tuberculosis
QADPRPGVWHSSGMNRIRLSTTV

SEQ ID NO: 1489103 - protein, 23 aa, Mycobacterium tuberculosis
QAEGGAAAARWICDNRDALDGNQ

SEQ ID NO: 1489104 - protein, 24 aa, Mycobacterium tuberculosis
QAEGGAAAARWICDNRDSLDGNQW

SEQ ID NO: 1489105 - protein, 21 aa, Mycobacterium tuberculosis
QAEPWRPQAVLNHAGELARMC

SEQ ID NO: 1489106 - protein, 19 aa, Mycobacterium tuberculosis
QAEPWRPQTVLNHAGELAR

SEQ ID NO: 1489107 - protein, 18 aa, Mycobacterium tuberculosis
QAFGFPHHHEHRASPINR

SEQ ID NO: 1489108 - protein, 20 aa, Mycobacterium tuberculosis
QAFGRPSGVQGSFCGRACAP

SEQ ID NO: 1489109 - protein, 26 aa, Mycobacterium tuberculosis
QAFPCIPNGGSVFGCQPCSAPDRSLG

SEQ ID NO: 1489110 - protein, 18 aa, Mycobacterium tuberculosis
QAFWSFGGLFLVNSPEQR

SEQ ID NO: 1489111 - protein, 20 aa, Mycobacterium tuberculosis
QAGGDGGLFRQRRQRRVPAQ

SEQ ID NO: 1489112 - protein, 19 aa, Mycobacterium tuberculosis
QAGGKGWDGGPIGNGQVGE

SEQ ID NO: 1489113 - protein, 19 aa, Mycobacterium tuberculosis
QAGLAMLAPIWGYAPLLDI

SEQ ID NO: 1489114 - protein, 18 aa, Mycobacterium tuberculosis
QAGLATRPTGPAGVTGVT

SEQ ID NO: 1489115 - protein, 24 aa, Mycobacterium tuberculosis
QAGLPDRGPQSWSEFDEWGPELQR

SEQ ID NO: 1489116 - protein, 18 aa, Mycobacterium tuberculosis
QAGRVWVNCYHLYPAHAA

SEQ ID NO: 1489117 - protein, 29 aa, Mycobacterium tuberculosis
QAHPLLPKRRPSTCCSWPTAASSKSTVRR

SEQ ID NO: 1489118 - protein, 17 aa, Mycobacterium tuberculosis
QAIARQMAAFHDQFTLA

SEQ ID NO: 1489119 - protein, 30 aa, Mycobacterium tuberculosis
QAIGFKIARMEARAHVARTAYYDAAAKMLA

SEQ ID NO: 1489120 - protein, 18 aa, Mycobacterium tuberculosis
QAIKDVGVDLVMEEYDNL

SEQ ID NO: 1489121 - protein, 23 aa, Mycobacterium tuberculosis
QAISALLLPLAIEHTLQYRRGGA

SEQ ID NO: 1489122 - protein, 25 aa, Mycobacterium tuberculosis
QAKMWKKSMTVRELWVSVTDPDALV

SEQ ID NO: 1489123 - protein, 23 aa, Mycobacterium tuberculosis
QAKRVPGLVVYRYDAPLCFANAE

SEQ ID NO: 1489124 - protein, 25 aa, Mycobacterium tuberculosis
QALLGDARWLASIATPGRDEVGEAV

SEQ ID NO: 1489125 - protein, 21 aa, Mycobacterium tuberculosis
QALLGRPLIGDGADGTAPGQN

SEQ ID NO: 1489126 - protein, 23 aa, Mycobacterium tuberculosis
QALLGRPLIGNGANGLPGTGQNG

SEQ ID NO: 1489127 - protein, 24 aa, Mycobacterium tuberculosis
QALLGRPLIGNGANGLPGTGQNGG

SEQ ID NO: 1489128 - protein, 28 aa, Mycobacterium tuberculosis
QALNARAATFHAEFVSLLNGGAAAYTGA

SEQ ID NO: 1489129 - protein, 25 aa, Mycobacterium tuberculosis
QALPEDFRMAVYYADVEGFPYKEIA

SEQ ID NO: 1489130 - protein, 19 aa, Mycobacterium tuberculosis
QALPPGSGGPVFGALDGGY

SEQ ID NO: 1489131 - protein, 17 aa, Mycobacterium tuberculosis
QALRFGADLRMEDVESV

SEQ ID NO: 1489132 - protein, 22 aa, Mycobacterium tuberculosis
QALTGRPLIGNGANGTPGTGAD

SEQ ID NO: 1489133 - protein, 17 aa, Mycobacterium tuberculosis
QALVREGLRNVAAGANP

SEQ ID NO: 1489134 - protein, 20 aa, Mycobacterium tuberculosis
QANSLLLRRLQAERPGDAVL

SEQ ID NO: 1489135 - protein, 22 aa, Mycobacterium tuberculosis
QAPDASGYWAAPAVANYVLSVE

SEQ ID NO: 1489136 - protein, 25 aa, Mycobacterium tuberculosis
QARAHSWGAVGSRFGDEPTTQHRGL

SEQ ID NO: 1489137 - protein, 22 aa, Mycobacterium tuberculosis
QARGAGGPAGLIGHGGSGGAGG

SEQ ID NO: 1489138 - protein, 22 aa, Mycobacterium tuberculosis
QARRADLRAGVLGEHQDQRRDR

SEQ ID NO: 1489139 - protein, 17 aa, Mycobacterium tuberculosis
QARSWWRIGEPYEGVDV

SEQ ID NO: 1489140 - protein, 21 aa, Mycobacterium tuberculosis
QARVGSYLRYGAYPYAIVVRE

SEQ ID NO: 1489141 - protein, 17 aa, Mycobacterium tuberculosis
QASDCCRHGQPGAPSTN

SEQ ID NO: 1489142 - protein, 21 aa, Mycobacterium tuberculosis
QASHPRPGFHPFQKHVEPVWT

SEQ ID NO: 1489143 - protein, 19 aa, Mycobacterium tuberculosis
QASQWRRLGGTFPTNSQLT

SEQ ID NO: 1489144 - protein, 17 aa, Mycobacterium tuberculosis
QATAGAPAHDWLTLTGG

SEQ ID NO: 1489145 - protein, 24 aa, Mycobacterium tuberculosis
QATAGAPAHDWLTLTGGAIGYGIP

SEQ ID NO: 1489146 - protein, 32 aa, Mycobacterium tuberculosis; identical to SEQ ID NO: 1383011

SEQ ID NO: 1489147 - protein, 20 aa, Mycobacterium tuberculosis
QATSPLPGWDVKAVVSHIIG

SEQ ID NO: 1489148 - protein, 22 aa, Mycobacterium tuberculosis
QAVAARHGFAQDVANVGFAGDA

SEQ ID NO: 1489149 - protein, 17 aa, Mycobacterium tuberculosis
QAVPGLSGLLGGAANAP

SEQ ID NO: 1489150 - protein, 22 aa, Mycobacterium tuberculosis
QAWRAPKDVVARAYEFGALATA

SEQ ID NO: 1489151 - protein, 18 aa, Mycobacterium tuberculosis
QCANRFDVVQAFTDDALT

SEQ ID NO: 1489152 - protein, 17 aa, Mycobacterium tuberculosis
QCDRRVIAVIGDGALTG

SEQ ID NO: 1489153 - protein, 17 aa, Mycobacterium tuberculosis
QCMATIYRRTHCVVTGA

SEQ ID NO: 1489154 - protein, 24 aa, Mycobacterium tuberculosis
QCRHTRCIQFPEHLDCPSQYRHQP

SEQ ID NO: 1489155 - protein, 21 aa, Mycobacterium tuberculosis
QDAFCRPGSTFPRATRASTGW

SEQ ID NO: 1489156 - protein, 31 aa, Mycobacterium tuberculosis
QDCEVCGYHCWAEFFVAGLGWLPADASCATK

SEQ ID NO: 1489157 - protein, 30 aa, Mycobacterium tuberculosis
QDCEVCGYHCWVEFFVAGLGWLPADASCAT

SEQ ID NO: 1489158 - protein, 25 aa, Mycobacterium tuberculosis
QDGDARLLLIVAELPLPMQNVNEEV

SEQ ID NO: 1489159 - protein, 23 aa, Mycobacterium tuberculosis
QDGMRLGGWYFPHTSGGSGPAVL

SEQ ID NO: 1489160 - protein, 19 aa, Mycobacterium tuberculosis
QDGVKRVGGRMVVQQADRV

SEQ ID NO: 1489161 - protein, 18 aa, Mycobacterium tuberculosis
QDIGWDEKWQCDGWFDHA

SEQ ID NO: 1489162 - protein, 17 aa, Mycobacterium tuberculosis
QDIKVIVLRGAGRAFSG

SEQ ID NO: 1489163 - protein, 23 aa, Mycobacterium tuberculosis
QDKIARIGIRVADVLDPEQLTHK

SEQ ID NO: 1489164 - protein, 21 aa, Mycobacterium tuberculosis
QDLAARCSFEQVAFLLWRGEL

SEQ ID NO: 1489165 - protein, 22 aa, Mycobacterium tuberculosis
QDLAARCSFEQVAFLLWRGELP

SEQ ID NO: 1489166 - protein, 26 aa, Mycobacterium tuberculosis
QDLGGAHPSTWYKAFNYNLATSQPIT

SEQ ID NO: 1489167 - protein, 17 aa, Mycobacterium tuberculosis
QDLRAAEDALWRWMTAA

SEQ ID NO: 1489168 - protein, 22 aa, Mycobacterium tuberculosis
QDLRGLLGAFMFTGPQLEQPAG

SEQ ID NO: 1489169 - protein, 21 aa, Mycobacterium tuberculosis
QDLRLCRCQLLAGHGHTGRLR

SEQ ID NO: 1489170 - protein, 26 aa, Mycobacterium tuberculosis
QDNEGHSMFPWLTLALVGNSTSSILF

SEQ ID NO: 1489171 - protein, 18 aa, Mycobacterium tuberculosis
QDRRCARSCRNRRLPLRR

SEQ ID NO: 1489172 - protein, 19 aa, Mycobacterium tuberculosis
QDWIRLSGMNMIQGSETND

SEQ ID NO: 1489173 - protein, 22 aa, Mycobacterium tuberculosis
QDYGDVAYGWAMEDTSGIVKLI

SEQ ID NO: 1489174 - protein, 17 aa, Mycobacterium tuberculosis
QDYLANYHLAWYAVTTR

SEQ ID NO: 1489175 - protein, 22 aa, Mycobacterium tuberculosis
QDYRRYGGVEFYSAIAAGSPER

SEQ ID NO: 1489176 - protein, 24 aa, Mycobacterium tuberculosis
QEDSRLLTRELLYTAVTRAKRKVR

SEQ ID NO: 1489177 - protein, 18 aa, Mycobacterium tuberculosis
QEELWLLRGGDPGQPGLL

SEQ ID NO: 1489178 - protein, 26 aa, Mycobacterium tuberculosis
QEGDRGVSWLPFFHDMGLITVLLASV

SEQ ID NO: 1489179 - protein, 17 aa, Mycobacterium tuberculosis
QEIMIWFTTRAPFSRSA

SEQ ID NO: 1489180 - protein, 17 aa, Mycobacterium tuberculosis
QELARRCVLAGKDVIVA

SEQ ID NO: 1489181 - protein, 18 aa, Mycobacterium tuberculosis
QELVRYGVQPDWFELGDR

SEQ ID NO: 1489182 - protein, 25 aa, Mycobacterium tuberculosis
QEPGREWSALCIGRSKTRNHIGQKA

SEQ ID NO: 1489183 - protein, 22 aa, Mycobacterium tuberculosis
QEPRISWAAGLRDDGTTTLLVT

SEQ ID NO: 1489184 - protein, 24 aa, Mycobacterium tuberculosis
QEPVWRARCIVSAPWMGLAGVPSA

SEQ ID NO: 1489185 - protein, 23 aa, Mycobacterium tuberculosis
QEQDGIKFLCPVPGYDRHFAITE

SEQ ID NO: 1489186 - protein, 18 aa, Mycobacterium tuberculosis
QERLDAMASVATVPVINA

SEQ ID NO: 1489187 - protein, 26 aa, Mycobacterium tuberculosis
QERPAPTGKTRCPIRSRTRPMAPTAL

SEQ ID NO: 1489188 - protein, 23 aa, Mycobacterium tuberculosis
QEVRPAPGQGLSPAVSTLVVAGK

SEQ ID NO: 1489189 - protein, 23 aa, Mycobacterium tuberculosis
QFAVATWNGLVWINLDADAEPIA

SEQ ID NO: 1489190 - protein, 18 aa, Mycobacterium tuberculosis
QFGGRRVSVVGADHRLDQ

SEQ ID NO: 1489191 - protein, 32 aa, Mycobacterium tuberculosis
QFGQRECGIVQFGYRQCRVLQLRHREFGRIQF

SEQ ID NO: 1489192 - protein, 23 aa, Mycobacterium tuberculosis
QFISETWRLYGVAARNDGIANVD

SEQ ID NO: 1489193 - protein, 18 aa, Mycobacterium tuberculosis
QFKRSALPNGPKVSHGGA

SEQ ID NO: 1489194 - protein, 22 aa, Mycobacterium tuberculosis
QFLDPLIFARRRLIAAGTTRGR

SEQ ID NO: 1489195 - protein, 19 aa, Mycobacterium tuberculosis
QFLERMGSCQVVHRGGTRR

SEQ ID NO: 1489196 - protein, 22 aa, Mycobacterium tuberculosis
QFTLPGRSLMFVRNVGHLMTND

SEQ ID NO: 1489197 - protein, 27 aa, Mycobacterium tuberculosis
QFVHAVALAEVWRSCGVLPDLTVGHSL

SEQ ID NO: 1489198 - protein, 19 aa, Mycobacterium tuberculosis
QFWSQIHGFVMLELAGFYG

SEQ ID NO: 1489199 - protein, 28 aa, Mycobacterium tuberculosis
QGAARGGVCVRCCSRSALDRIGDVEAAE

SEQ ID NO: 1489200 - protein, 25 aa, Mycobacterium tuberculosis
QGADGLRRGGCVVVGHQLDAVAHRD

SEQ ID NO: 1489201 - protein, 18 aa, Mycobacterium tuberculosis
QGAGAFAGGGGGRGGDGG

SEQ ID NO: 1489202 - protein, 19 aa, Mycobacterium tuberculosis
QGAGPGHRGRRSRDREAIV

SEQ ID NO: 1489203 - protein, 19 aa, Mycobacterium tuberculosis
QGAGTLGFAGTTHKASPGQ

SEQ ID NO: 1489204 - protein, 19 aa, Mycobacterium tuberculosis
QGAPPFGRCDMNSANGLTP

SEQ ID NO: 1489205 - protein, 18 aa, Mycobacterium tuberculosis
QGASLAHFADGWNTFNLT

SEQ ID NO: 1489206 - protein, 19 aa, Mycobacterium tuberculosis
QGATPDFADTGGKGGNGGN

SEQ ID NO: 1489207 - protein, 22 aa, Mycobacterium tuberculosis
QGDGGRCMVVFQPHLYSRTKAF

SEQ ID NO: 1489208 - protein, 21 aa, Mycobacterium tuberculosis
QGFCGTCKVRVLAGQVDRRGR

SEQ ID NO: 1489209 - protein, 17 aa, Mycobacterium tuberculosis
QGFSLLVVERGMAGFER

SEQ ID NO: 1489210 - protein, 22 aa, Mycobacterium tuberculosis
QGGHGGNAILFGQGGAGGPGGT

SEQ ID NO: 1489211 - protein, 25 aa, Mycobacterium tuberculosis
QGHPRLCAPQCGWSTSRRRGWQAVA

SEQ ID NO: 1489212 - protein, 18 aa, Mycobacterium tuberculosis
QGLAELTLNLGVGNIGSL

SEQ ID NO: 1489213 - protein, 28 aa, Mycobacterium tuberculosis
QGLKVSIPEEVAWRMGWIDDEQLVQRAR

SEQ ID NO: 1489214 - protein, 18 aa, Mycobacterium tuberculosis
QGMRKRLGAFPIGPVFGD

SEQ ID NO: 1489215 - protein, 18 aa, Mycobacterium tuberculosis
QGNLNFGSGNLLGNGNFG

SEQ ID NO: 1489216 - protein, 19 aa, Mycobacterium tuberculosis
QGNLNFGSGNLLGNGNFGF

SEQ ID NO: 1489217 - protein, 17 aa, Mycobacterium tuberculosis
QGPFPMETVYPVGGRPR

SEQ ID NO: 1489218 - protein, 19 aa, Mycobacterium tuberculosis
QGQYRWEYRQLAGPTRWHA

SEQ ID NO: 1489219 - protein, 17 aa, Mycobacterium tuberculosis
QGRFRQNLLGKRVDYSG

SEQ ID NO: 1489220 - protein, 20 aa, Mycobacterium tuberculosis
QGRNPFWDRLSRAMYRLARP

SEQ ID NO: 1489221 - protein, 23 aa, Mycobacterium tuberculosis
QGRSEVRILFAFDPARQAIMLAP

SEQ ID NO: 1489222 - protein, 24 aa, Mycobacterium tuberculosis
QGSQWPGMGTELLVAEPVFAATVA

SEQ ID NO: 1489223 - protein, 19 aa, Mycobacterium tuberculosis
QGTWRLWLPGCSWPPNVPQ

SEQ ID NO: 1489224 - protein, 22 aa, Mycobacterium tuberculosis
QGVGFRWWTRCRALDLRLTGTR

SEQ ID NO: 1489225 - protein, 19 aa, Mycobacterium tuberculosis
QGVPFVLPNAWDVPSDLAY

SEQ ID NO: 1489226 - protein, 21 aa, Mycobacterium tuberculosis
QGVPISGILFGGRRTTTVPLV

SEQ ID NO: 1489227 - protein, 17 aa, Mycobacterium tuberculosis
QGVSICFDQLHEITEYA

SEQ ID NO: 1489228 - protein, 18 aa, Mycobacterium tuberculosis
QGWMCCIGSSWMHLSTGV

SEQ ID NO: 1489229 - protein, 22 aa, Mycobacterium tuberculosis
QGYGSLGLMTSVLMTADGKTVE

SEQ ID NO: 1489230 - protein, 20 aa, Mycobacterium tuberculosis
QHADWVCRLAYRSPATSTMP

SEQ ID NO: 1489231 - protein, 17 aa, Mycobacterium tuberculosis
QHALWREAIALVAEGVC

SEQ ID NO: 1489232 - protein, 17 aa, Mycobacterium tuberculosis
QHERIRSAVTLNDGDHI

SEQ ID NO: 1489233 - protein, 17 aa, Mycobacterium tuberculosis
QHFDHWQALQAVAAATG

SEQ ID NO: 1489234 - protein, 23 aa, Mycobacterium tuberculosis
QHIFRQCRGHPGADAVEIDADIG

SEQ ID NO: 1489235 - protein, 19 aa, Mycobacterium tuberculosis
QHLPDILGHSGHRAGNGVF

SEQ ID NO: 1489236 - protein, 42 aa, Mycobacterium tuberculosis
QHQPGRAVGRLGLSELRRAILGLFQPWQRRLRLRQQGHPAVL

SEQ ID NO: 1489237 - protein, 18 aa, Mycobacterium tuberculosis
QHRNRACRPVRDGRYVGT

SEQ ID NO: 1489238 - protein, 28 aa, Mycobacterium tuberculosis
QHTWIRRSRCWIRWATPPCGRTHCIGLE

SEQ ID NO: 1489239 - protein, 17 aa, Mycobacterium tuberculosis
QHVKPGKGPAFVRTKLK

SEQ ID NO: 1489240 - protein, 18 aa, Mycobacterium tuberculosis
QHVLGAIVERARAGATVL

SEQ ID NO: 1489241 - protein, 36 aa, Mycobacterium tuberculosis; identical to SEQ ID NO: 204689

SEQ ID NO: 1489242 - protein, 17 aa, Mycobacterium tuberculosis
QIGELNLLFTYELQRRL

SEQ ID NO: 1489243 - protein, 23 aa, Mycobacterium tuberculosis
QIGPRIVPIIPDEARTFGMDSWF

SEQ ID NO: 1489244 - protein, 22 aa, Mycobacterium tuberculosis
QIKEQMIHWWGPIIDEYYASSE

SEQ ID NO: 1489245 - protein, 23 aa, Mycobacterium tuberculosis
QIKEQMIHWWGQIIDEYYASSEA

SEQ ID NO: 1489246 - protein, 18 aa, Mycobacterium tuberculosis
QILRALRINLTVRGYQVI

SEQ ID NO: 1489247 - protein, 20 aa, Mycobacterium tuberculosis
QIRAASNHGHRNRVRCHLHI

SEQ ID NO: 1489248 - protein, 22 aa, Mycobacterium tuberculosis
QITGLRSGFGGAGGAGGASDTG

SEQ ID NO: 1489249 - protein, 17 aa, Mycobacterium tuberculosis
QIWPIDRPGLLFDDMDD

SEQ ID NO: 1489250 - protein, 25 aa, Mycobacterium tuberculosis
QKAGRFGALIPRLVRQGINGEGLTI

SEQ ID NO: 1489251 - protein, 22 aa, Mycobacterium tuberculosis
QKEKLAELTTRWQNEKNAIEIV

SEQ ID NO: 1489252 - protein, 19 aa, Mycobacterium tuberculosis
QKHGIVFAGGGRGIGDDRA

SEQ ID NO: 1489253 - protein, 24 aa, Mycobacterium tuberculosis
QKISELYDRVGFAAAGKFNEFDNL

SEQ ID NO: 1489254 - protein, 20 aa, Mycobacterium tuberculosis
QKKARVSFIPDRSVVDHSQL

SEQ ID NO: 1489255 - protein, 19 aa, Mycobacterium tuberculosis
QKLELLRSLLTYFHYASKE

SEQ ID NO: 1489256 - protein, 23 aa, Mycobacterium tuberculosis
QKLRIVKYLAYGWSSLRSRPALR

SEQ ID NO: 1489257 - protein, 17 aa, Mycobacterium tuberculosis
QKMRAVLVADNPGVWVM

SEQ ID NO: 1489258 - protein, 20 aa, Mycobacterium tuberculosis
QKQAGRWSRDTVATAMRLVA

SEQ ID NO: 1489259 - protein, 20 aa, Mycobacterium tuberculosis
QKQARRWSRDTVATAMRLVA

SEQ ID NO: 1489260 - protein, 18 aa, Mycobacterium tuberculosis
QKSHCPISPATYVARRRI

SEQ ID NO: 1489261 - protein, 17 aa, Mycobacterium tuberculosis
QLAALSIFANSGGKTAE

SEQ ID NO: 1489262 - protein, 26 aa, Mycobacterium tuberculosis
QLADYGFAWRDIARVVGVSVPAITKW

SEQ ID NO: 1489263 - protein, 26 aa, Mycobacterium tuberculosis
QLAGLIYPRHRALKAASGQSRPHTDR

SEQ ID NO: 1489264 - protein, 24 aa, Mycobacterium tuberculosis
QLAKLARAGFRVSDVKPPSSPVTS

SEQ ID NO: 1489265 - protein, 19 aa, Mycobacterium tuberculosis
QLALTALWRSYGVTPDAVI

SEQ ID NO: 1489266 - protein, 17 aa, Mycobacterium tuberculosis
QLAPLVFEGTSFGGALM

SEQ ID NO: 1489267 - protein, 18 aa, Mycobacterium tuberculosis
QLASSLQPIWFGRAHLRE

SEQ ID NO: 1489268 - protein, 26 aa, Mycobacterium tuberculosis
QLAVYRLAWAALRGCPTSSVRTAFYY

SEQ ID NO: 1489269 - protein, 19 aa, Mycobacterium tuberculosis
QLDLERAMELCAPDECVEV

SEQ ID NO: 1489270 - protein, 21 aa, Mycobacterium tuberculosis
QLDRIGARLAEPLRIALAGTL

SEQ ID NO: 1489271 - protein, 21 aa, Mycobacterium tuberculosis
QLDRYEMRVWGWGPGEESWLI

SEQ ID NO: 1489272 - protein, 22 aa, Mycobacterium tuberculosis
QLDWMVCRTVATLLRSKVSARP

SEQ ID NO: 1489273 - protein, 18 aa, Mycobacterium tuberculosis
QLEFKRVQFTPDLMPGDV

SEQ ID NO: 1489274 - protein, 25 aa, Mycobacterium tuberculosis
QLEPPYRGGPVLADNAVIPVERTQV

SEQ ID NO: 1489275 - protein, 23 aa, Mycobacterium tuberculosis
QLGKGGGRLPITLWIVDTNASTP

SEQ ID NO: 1489276 - protein, 17 aa, Mycobacterium tuberculosis
QLGRGYEYLDLDPETDH

SEQ ID NO: 1489277 - protein, 21 aa, Mycobacterium tuberculosis
QLGRRVHRVACDYQAVRTHFF

SEQ ID NO: 1489278 - protein, 23 aa, Mycobacterium tuberculosis
QLHCGWAATLELDRAAPQRPIPA

SEQ ID NO: 1489279 - protein, 17 aa, Mycobacterium tuberculosis
QLHVFGQVWGIGCKSRS

SEQ ID NO: 1489280 - protein, 17 aa, Mycobacterium tuberculosis
QLIRCNGALRLPELDLA

SEQ ID NO: 1489281 - protein, 18 aa, Mycobacterium tuberculosis
QLLERCWDAAYEARSNIV

SEQ ID NO: 1489282 - protein, 23 aa, Mycobacterium tuberculosis
QLLSQPIPRRGRRQQRARPRTRI

SEQ ID NO: 1489283 - protein, 24 aa, Mycobacterium tuberculosis
QLMKAALPFGLWVPVLPGTRQVTV

SEQ ID NO: 1489284 - protein, 19 aa, Mycobacterium tuberculosis
QLPDDRLEELLALAHEVRM

SEQ ID NO: 1489285 - protein, 23 aa, Mycobacterium tuberculosis
QLPDPRLGLICNRALRRTLVLRR

SEQ ID NO: 1489286 - protein, 37 aa, Mycobacterium tuberculosis
QLPEWFRPGDFFPVPCCFPSCRSITYLLTDGEHVVPI

SEQ ID NO: 1489287 - protein, 21 aa, Mycobacterium tuberculosis
QLPSTALMDVLLRRPPRTRSG

SEQ ID NO: 1489288 - protein, 19 aa, Mycobacterium tuberculosis
QLPVSNCTLEWATSGRRQR

SEQ ID NO: 1489289 - protein, 19 aa, Mycobacterium tuberculosis
QLQHRVWQRGSWVDRSAEQ

SEQ ID NO: 1489290 - protein, 17 aa, Mycobacterium tuberculosis
QLQPFVASSLKQALQYA

SEQ ID NO: 1489291 - protein, 20 aa, Mycobacterium tuberculosis
QLRAAASVLMEALRMERSQV

SEQ ID NO: 1489292 - protein, 21 aa, Mycobacterium tuberculosis
QLRALPWSHPHHRGHRHRAGY

SEQ ID NO: 1489293 - protein, 21 aa, Mycobacterium tuberculosis
QLRALPWSQPHHRGHRHRAGY

SEQ ID NO: 1489294 - protein, 17 aa, Mycobacterium tuberculosis
QLRARIVAFQDRLADVV

SEQ ID NO: 1489295 - protein, 22 aa, Mycobacterium tuberculosis
QLRHEARIRRATATSERRLLHS

SEQ ID NO: 1489296 - protein, 19 aa, Mycobacterium tuberculosis
QLRLEQVVLVGVWTEGSAA

SEQ ID NO: 1489297 - protein, 22 aa, Mycobacterium tuberculosis
QLRPPRAGRLCRSSRLRHPQTR

SEQ ID NO: 1489298 - protein, 25 aa, Mycobacterium tuberculosis
QLRRRSPRSAPPVDRSRAQRRPRTF

SEQ ID NO: 1489299 - protein, 26 aa, Mycobacterium tuberculosis
QLRVPRRRACAAPRLQGMGGQIRRPI

SEQ ID NO: 1489300 - protein, 25 aa, Mycobacterium tuberculosis
QLTRKRLRTGLIEAFSTSCPNCSGR

SEQ ID NO: 1489301 - protein, 27 aa, Mycobacterium tuberculosis
QLVALGELFAYRWSRCGGREEWVMDTI

SEQ ID NO: 1489302 - protein, 22 aa, Mycobacterium tuberculosis
QLVELVCFHAAIVLGRKSSHDI

SEQ ID NO: 1489303 - protein, 18 aa, Mycobacterium tuberculosis
QLVGSMSVPPTWQGSIPI

SEQ ID NO: 1489304 - protein, 17 aa, Mycobacterium tuberculosis
QLVSFIGPIVIDTTIPG

SEQ ID NO: 1489305 - protein, 18 aa, Mycobacterium tuberculosis
QLVTRVPQGWSFAQAAAV

SEQ ID NO: 1489306 - protein, 24 aa, Mycobacterium tuberculosis
QLVTRVPQGWSFAQAAAVPVVFLT

SEQ ID NO: 1489307 - protein, 24 aa, Mycobacterium tuberculosis
QMAEPKWVLAMGVCASSGGMFNNY

SEQ ID NO: 1489308 - protein, 20 aa, Mycobacterium tuberculosis
QMAGNFSFGGLFQTRVIELA

SEQ ID NO: 1489309 - protein, 19 aa, Mycobacterium tuberculosis
QMLDPGGWVEADEDTFYDR

SEQ ID NO: 1489310 - protein, 17 aa, Mycobacterium tuberculosis
QMLVWGFTGQVISAVLD

SEQ ID NO: 1489311 - protein, 26 aa, Mycobacterium tuberculosis
QMPWNSSPAWPARSVVTPKVSAFSVP

SEQ ID NO: 1489312 - protein, 28 aa, Mycobacterium tuberculosis
QMRDELRSLLRFVLDLLADYGLTDFYLE

SEQ ID NO: 1489313 - protein, 18 aa, Mycobacterium tuberculosis
QMVIDVHNVMTFGGNMIT

SEQ ID NO: 1489314 - protein, 22 aa, Mycobacterium tuberculosis
QMWAQDVAAMFGYHAGASAAVS

SEQ ID NO: 1489315 - protein, 20 aa, Mycobacterium tuberculosis
QNAPAIAAAEAMYEQMWAAD

SEQ ID NO: 1489316 - protein, 20 aa, Mycobacterium tuberculosis
QNAPAIAAAEAMYEQMWPAD

SEQ ID NO: 1489317 - protein, 19 aa, Mycobacterium tuberculosis
QNFYLCDLQIKWNGFQAGG

SEQ ID NO: 1489318 - protein, 17 aa, Mycobacterium tuberculosis
QNGGLLFGNGGNGFTQT

SEQ ID NO: 1489319 - protein, 21 aa, Mycobacterium tuberculosis
QNLAGLPAWLASGAPAAAMTA

SEQ ID NO: 1489320 - protein, 36 aa, Mycobacterium tuberculosis
QNRGELPCVPTIMAGLYCEWDNAGGFYRGGDADGGF

SEQ ID NO: 1489321 - protein, 22 aa, Mycobacterium tuberculosis
QNRRFGGFCVCSRVPRSGTARR

SEQ ID NO: 1489322 - protein, 23 aa, Mycobacterium tuberculosis
QPACGKAGCQTYKWETFLTSELP

SEQ ID NO: 1489323 - protein, 23 aa, Mycobacterium tuberculosis
QPDGRIPIWLPPAKRLPDGLASY

SEQ ID NO: 1489324 - protein, 23 aa, Mycobacterium tuberculosis
QPDRLRRWMAVAARIELRTGGAY

SEQ ID NO: 1489325 - protein, 21 aa, Mycobacterium tuberculosis
QPEHPGGRFVRYRNHRRDFEH

SEQ ID NO: 1489326 - protein, 22 aa, Mycobacterium tuberculosis
QPFPLPALTCLLRSITLRMTMA

SEQ ID NO: 1489327 - protein, 21 aa, Mycobacterium tuberculosis
QPGGPGGLLYRQRREQRQRRD

SEQ ID NO: 1489328 - protein, 24 aa, Mycobacterium tuberculosis
QPGKPSWNLEPWRPVVDDSEMLAS

SEQ ID NO: 1489329 - protein, 17 aa, Mycobacterium tuberculosis
QPIGCPAFHAFPASRWR

SEQ ID NO: 1489330 - protein, 22 aa, Mycobacterium tuberculosis
QPLDWFCSFSSAAALVGSPGQG

SEQ ID NO: 1489331 - protein, 27 aa, Mycobacterium tuberculosis
QPLDWFCSFSSAAARVGSPGQGAYAAA

SEQ ID NO: 1489332 - protein, 22 aa, Mycobacterium tuberculosis
QPLEWFCLFSSAAALVGSPGQG

SEQ ID NO: 1489333 - protein, 17 aa, Mycobacterium tuberculosis
QPLFDVINAPTLALLNR

SEQ ID NO: 1489334 - protein, 25 aa, Mycobacterium tuberculosis
QPLRVQRWVGLVLPAVRGKRLPEVA

SEQ ID NO: 1489335 - protein, 17 aa, Mycobacterium tuberculosis
QPMVAPPAPVPANGEQF

SEQ ID NO: 1489336 - protein, 29 aa, Mycobacterium tuberculosis
QPNLKVIVNPGLRRPELPAYFDELRRCAN

SEQ ID NO: 1489337 - protein, 23 aa, Mycobacterium tuberculosis
QPPARTAGPSGTPSRTESSIHSA

SEQ ID NO: 1489338 - protein, 18 aa, Mycobacterium tuberculosis
QPQLRMSGYNLAAIAAGL

SEQ ID NO: 1489339 - protein, 23 aa, Mycobacterium tuberculosis
QPQRVLGLHFFNPVPVLPLVELV

SEQ ID NO: 1489340 - protein, 19 aa, Mycobacterium tuberculosis
QPRDAYVLRVAATVGQLNY

SEQ ID NO: 1489341 - protein, 21 aa, Mycobacterium tuberculosis
QPRGGLPQRVLRAGRQREQQR

SEQ ID NO: 1489342 - protein, 21 aa, Mycobacterium tuberculosis
QPRLRPPFPAVAGLYGCPTVI

SEQ ID NO: 1489343 - protein, 25 aa, Mycobacterium tuberculosis
QPRPADCLRPLQIHALISEVLKTLP

SEQ ID NO: 1489344 - protein, 33 aa, Mycobacterium tuberculosis
QPRRRGRRGRRAVGPCGSGGPGCSVSGASWVGG

SEQ ID NO: 1489345 - protein, 19 aa, Mycobacterium tuberculosis
QPRYCSMSSDPKPREGTET

SEQ ID NO: 1489346 - protein, 20 aa, Mycobacterium tuberculosis
QPRYCSMSSDPKPREGTETH

SEQ ID NO: 1489347 - protein, 18 aa, Mycobacterium tuberculosis
QPSARLVLAAGPDGTTAA

SEQ ID NO: 1489348 - protein, 19 aa, Mycobacterium tuberculosis
QPSVGDWLMSGCRSPGRSQ

SEQ ID NO: 1489349 - protein, 17 aa, Mycobacterium tuberculosis
QPWEPVPACARPRPVTA

SEQ ID NO: 1489350 - protein, 22 aa, Mycobacterium tuberculosis
QPWEPVPACARPRPVTPARSSP

SEQ ID NO: 1489351 - protein, 19 aa, Mycobacterium tuberculosis
QQAGLATRPAGPAGSGGSG

SEQ ID NO: 1489352 - protein, 20 aa, Mycobacterium tuberculosis
QQARGKGGLVRVSWAEASEM

SEQ ID NO: 1489353 - protein, 24 aa, Mycobacterium tuberculosis
QQGFFKGTTCHRLTTSPMLAVLQC

SEQ ID NO: 1489354 - protein, 17 aa, Mycobacterium tuberculosis
QQKGHVFEGGLWSGGAA

SEQ ID NO: 1489355 - protein, 18 aa, Mycobacterium tuberculosis
QQKGHVFEGGLWSGGAAN

SEQ ID NO: 1489356 - protein, 17 aa, Mycobacterium tuberculosis
QQLFLSSLLRSMISTDT

SEQ ID NO: 1489357 - protein, 21 aa, Mycobacterium tuberculosis
QQLTLPFAAPHSMFNVKVGGA

SEQ ID NO: 1489358 - protein, 27 aa, Mycobacterium tuberculosis
QQRCPPRQFERARVVVFAGDHGVARSG

SEQ ID NO: 1489359 - protein, 18 aa, Mycobacterium tuberculosis
QQRGRFLCIADFIRSREL

SEQ ID NO: 1489360 - protein, 19 aa, Mycobacterium tuberculosis
QQSPRWPVPAGSKRTSLGR

SEQ ID NO: 1489361 - protein, 28 aa, Mycobacterium tuberculosis
QQTMLPFSWQGVCLHASGAARVRVRLAP

SEQ ID NO: 1489362 - protein, 18 aa, Mycobacterium tuberculosis
QQVLRNLGIDIGKNGQIN

SEQ ID NO: 1489363 - protein, 19 aa, Mycobacterium tuberculosis
QQVLRNLGIDIGKNGQINL

SEQ ID NO: 1489364 - protein, 29 aa, Mycobacterium tuberculosis
QQYQPGGWSAGSRGAHPPGKGEKKKKKKK

SEQ ID NO: 1489365 - protein, 22 aa, Mycobacterium tuberculosis
QRAAEVVEAELLRLDNRLPGLQ

SEQ ID NO: 1489366 - protein, 18 aa, Mycobacterium tuberculosis
QRAGGPLCIGRDRDHPGR

SEQ ID NO: 1489367 - protein, 17 aa, Mycobacterium tuberculosis
QRAIGITLARMMSRRQF

SEQ ID NO: 1489368 - protein, 21 aa, Mycobacterium tuberculosis
QRAKALPGRVHRRVEARGGVR

SEQ ID NO: 1489369 - protein, 27 aa, Mycobacterium tuberculosis
QRAKNMFALGLLSWMYGRELEHSEAFI

SEQ ID NO: 1489370 - protein, 18 aa, Mycobacterium tuberculosis
QRALVRMLREAGAVELHV

SEQ ID NO: 1489371 - protein, 30 aa, Mycobacterium tuberculosis
QRAMRCPLPRHRRLPESRGEVADRRRRLPR

SEQ ID NO: 1489372 - protein, 20 aa, Mycobacterium tuberculosis
QRAPIGWNMKDATPVAKTVC

SEQ ID NO: 1489373 - protein, 19 aa, Mycobacterium tuberculosis
QRAVLLLRDALQWKSAEVA

SEQ ID NO: 1489374 - protein, 17 aa, Mycobacterium tuberculosis
QRCDAVGVDMFGCTFQL

SEQ ID NO: 1489375 - protein, 25 aa, Mycobacterium tuberculosis
QRCPPRQFERARVVVFAGDHGVARS

SEQ ID NO: 1489376 - protein, 18 aa, Mycobacterium tuberculosis
QRDPPAWVQVLSRRTKNN

SEQ ID NO: 1489377 - protein, 17 aa, Mycobacterium tuberculosis
QRDQWCRNLLGRKLFQR

SEQ ID NO: 1489378 - protein, 19 aa, Mycobacterium tuberculosis
QRDRFLFKINVGYPSPEEE

SEQ ID NO: 1489379 - protein, 17 aa, Mycobacterium tuberculosis
QRDRWWSDFDGLAPTAV

SEQ ID NO: 1489380 - protein, 25 aa, Mycobacterium tuberculosis
QRENLSWSAPRLHLVDLQYSDVRLD

SEQ ID NO: 1489381 - protein, 25 aa, Mycobacterium tuberculosis
QRFADWLVRVVEAFADRPDQRLREV

SEQ ID NO: 1489382 - protein, 24 aa, Mycobacterium tuberculosis
QRFSRLPPILPISGQQRLSLNRIP

SEQ ID NO: 1489383 - protein, 24 aa, Mycobacterium tuberculosis
QRGETRPGGSQVRRTFTLVNRDAQ

SEQ ID NO: 1489384 - protein, 29 aa, Mycobacterium tuberculosis
QRGPLRGQCALLWRGSRSVQGRSREDLTR

SEQ ID NO: 1489385 - protein, 28 aa, Mycobacterium tuberculosis
QRHEAGLRRCLRPRPAVATELDLASNDY

SEQ ID NO: 1489386 - protein, 27 aa, Mycobacterium tuberculosis
QRIAAKHAQCLNVRWWSPQQVTQRRGF

SEQ ID NO: 1489387 - protein, 21 aa, Mycobacterium tuberculosis
QRIVPEPGVRPGSGARVLVVS

SEQ ID NO: 1489388 - protein, 18 aa, Mycobacterium tuberculosis
QRLATIAHQCEVKSDQSE

SEQ ID NO: 1489389 - protein, 19 aa, Mycobacterium tuberculosis
QRLDQVWRGDGVVDDQRHP

SEQ ID NO: 1489390 - protein, 25 aa, Mycobacterium tuberculosis
QRLFPRAILHFEDFGPANARKILDT

SEQ ID NO: 1489391 - protein, 17 aa, Mycobacterium tuberculosis
QRLGVVLQFIVVGKRDH

SEQ ID NO: 1489392 - protein, 28 aa, Mycobacterium tuberculosis
QRLHRARCWCPAWACRAGARRRWGGLGG

SEQ ID NO: 1489393 - protein, 20 aa, Mycobacterium tuberculosis
QRLLPRPLDHTIIQVAVAIS

SEQ ID NO: 1489394 - protein, 22 aa, Mycobacterium tuberculosis
QRLMLEVSWEALEHAGIDPLSL

SEQ ID NO: 1489395 - protein, 30 aa, Mycobacterium tuberculosis
QRLPRGRCTPIAAWLAGLGLFTKRSHEKCV

SEQ ID NO: 1489396 - protein, 18 aa, Mycobacterium tuberculosis
QRLSAPRVVWDTDAALSD

SEQ ID NO: 1489397 - protein, 21 aa, Mycobacterium tuberculosis
QRLSAQAAGFHAQFVQALNAG

SEQ ID NO: 1489398 - protein, 18 aa, Mycobacterium tuberculosis
QRMVPRGRGHVINVASLA

SEQ ID NO: 1489399 - protein, 17 aa, Mycobacterium tuberculosis
QRNADVLAEALKDALGV

SEQ ID NO: 1489400 - protein, 17 aa, Mycobacterium tuberculosis
QRPAGPPADREEAADTP

SEQ ID NO: 1489401 - protein, 18 aa, Mycobacterium tuberculosis
QRQGFRWPSATVKTIMRA

SEQ ID NO: 1489402 - protein, 23 aa, Mycobacterium tuberculosis
QRQLEMRLNRQLADIEKLQVNVR

SEQ ID NO: 1489403 - protein, 24 aa, Mycobacterium tuberculosis
QRQQTLRASIDWSHALLTETEQIL

SEQ ID NO: 1489404 - protein, 21 aa, Mycobacterium tuberculosis
QRRARVLMRFIELVNDTIDEL

SEQ ID NO: 1489405 - protein, 17 aa, Mycobacterium tuberculosis
QRRCRSKGIEAMINVQA

SEQ ID NO: 1489406 - protein, 20 aa, Mycobacterium tuberculosis
QRRFRDAFTATAHFQVNEAS

SEQ ID NO: 1489407 - protein, 17 aa, Mycobacterium tuberculosis
QRRNRCRRCRGPGWQWC

SEQ ID NO: 1489408 - protein, 19 aa, Mycobacterium tuberculosis
QRRRHRPRRPLPPPPTTHC

SEQ ID NO: 1489409 - protein, 17 aa, Mycobacterium tuberculosis
QRRRLQLMLTLLSEPNV

SEQ ID NO: 1489410 - protein, 20 aa, Mycobacterium tuberculosis
QRRSASVTAVAWRTSAGAAA

SEQ ID NO: 1489411 - protein, 17 aa, Mycobacterium tuberculosis
QRRTVEGLNRVEAAPRQ

SEQ ID NO: 1489412 - protein, 18 aa, Mycobacterium tuberculosis
QRSALRTALIPAIDSTKV

SEQ ID NO: 1489413 - protein, 22 aa, Mycobacterium tuberculosis
QRSREVWLLVSGAGKADACRAI

SEQ ID NO: 1489414 - protein, 27 aa, Mycobacterium tuberculosis
QRTCGARWPVWRSVVCCSTAAKSAVIV

SEQ ID NO: 1489415 - protein, 17 aa, Mycobacterium tuberculosis
QRTEGFTALIDANRGCF

SEQ ID NO: 1489416 - protein, 18 aa, Mycobacterium tuberculosis
QRTFGGWLLADLVTVDGS

SEQ ID NO: 1489417 - protein, 18 aa, Mycobacterium tuberculosis
QRTFLPAQVEPAGPAATP

SEQ ID NO: 1489418 - protein, 17 aa, Mycobacterium tuberculosis
QRTLGMTGGNIFHGALS

SEQ ID NO: 1489419 - protein, 38 aa, Mycobacterium tuberculosis
QRVACQRGRLGGFGGRLGFRLGFRFLFHHVTRQDLAHH

SEQ ID NO: 1489420 - protein, 20 aa, Mycobacterium tuberculosis
QRVGGGLSVGQRGGRVHRPA

SEQ ID NO: 1489421 - protein, 27 aa, Mycobacterium tuberculosis
QRVKANLFYRGLRFHRFPAVGDTLYTR

SEQ ID NO: 1489422 - protein, 17 aa, Mycobacterium tuberculosis
QRVVDWLVDKFKGTSGI

SEQ ID NO: 1489423 - protein, 25 aa, Mycobacterium tuberculosis
QRWLADHVIAGVVLLAGAAFVELAL

SEQ ID NO: 1489424 - protein, 31 aa, Mycobacterium tuberculosis
QRYEGGSTLFGRWELCALMQTVAELAEAMRD

SEQ ID NO: 1489425 - protein, 22 aa, Mycobacterium tuberculosis
QSAHRRLQCSAGAGGAAGTADP

SEQ ID NO: 1489426 - protein, 26 aa, Mycobacterium tuberculosis
QSASRAKWLALFPWAVSKDESTANIP

SEQ ID NO: 1489427 - protein, 18 aa, Mycobacterium tuberculosis
QSAVRFASAGIEPFGCLK

SEQ ID NO: 1489428 - protein, 17 aa, Mycobacterium tuberculosis
QSDETFVYLARAVDPAV

SEQ ID NO: 1489429 - protein, 18 aa, Mycobacterium tuberculosis
QSGWRGGAAAVYPQCGER

SEQ ID NO: 1489430 - protein, 22 aa, Mycobacterium tuberculosis
QSHRGGPRYGVHPSPSYEDQYY

SEQ ID NO: 1489431 - protein, 17 aa, Mycobacterium tuberculosis
QSIFPITLRSLINCNSP

SEQ ID NO: 1489432 - protein, 25 aa, Mycobacterium tuberculosis
QSLPANDPNTAWLRGQVADLQAHVA

SEQ ID NO: 1489433 - protein, 17 aa, Mycobacterium tuberculosis
QSNHAFGAEPGVAPMSD

SEQ ID NO: 1489434 - protein, 21 aa, Mycobacterium tuberculosis
QSRCGFGQFVATMRRLQDLAV

SEQ ID NO: 1489435 - protein, 17 aa, Mycobacterium tuberculosis
QSRPLWYLMPDGVVQYV

SEQ ID NO: 1489436 - protein, 22 aa, Mycobacterium tuberculosis
QSRRERGPAMEYLIAAQDVLVA

SEQ ID NO: 1489437 - protein, 23 aa, Mycobacterium tuberculosis
QSSDFLHGRWLVLRRGSGVSPGW

SEQ ID NO: 1489438 - protein, 17 aa, Mycobacterium tuberculosis
QSSTVLFLGRHVGYPVA

SEQ ID NO: 1489439 - protein, 25 aa, Mycobacterium tuberculosis
QSTALADVSIRWQLKQAAAPELFQQ

SEQ ID NO: 1489440 - protein, 21 aa, Mycobacterium tuberculosis
QSTSWAQRWLAGTGSRDYMDP

SEQ ID NO: 1489441 - protein, 19 aa, Mycobacterium tuberculosis
QSTWCSGILGKPLVRHTVH

SEQ ID NO: 1489442 - protein, 21 aa, Mycobacterium tuberculosis
QSVEIQGRMGVLERDRGTRRQ

SEQ ID NO: 1489443 - protein, 27 aa, Mycobacterium tuberculosis
QSVHVISWRWVKFVYIGDSAHPLQQAR

SEQ ID NO: 1489444 - protein, 27 aa, Mycobacterium tuberculosis
QSVQCRWPGCHPKDPTIYRRAASERDG

SEQ ID NO: 1489445 - protein, 18 aa, Mycobacterium tuberculosis
QSWHPARIEVRCRGGVHR

SEQ ID NO: 1489446 - protein, 33 aa, Mycobacterium tuberculosis
QSWRPKPSMPRCGLRTLWLCTATRPLREPPGCC

SEQ ID NO: 1489447 - protein, 18 aa, Mycobacterium tuberculosis
QTAAGLWLEACAAKQFRT

SEQ ID NO: 1489448 - protein, 24 aa, Mycobacterium tuberculosis
QTALPRECLLLFGQEGPGITDDAR

SEQ ID NO: 1489449 - protein, 17 aa, Mycobacterium tuberculosis
QTFRRNRRWALLENAPV

SEQ ID NO: 1489450 - protein, 18 aa, Mycobacterium tuberculosis
QTGMGRTGAFFAHQHDGI

SEQ ID NO: 1489451 - protein, 17 aa, Mycobacterium tuberculosis
QTGQAFAAVAAGAAGAA

SEQ ID NO: 1489452 - protein, 19 aa, Mycobacterium tuberculosis
QTITLAWPVSSITIPQIQQ

SEQ ID NO: 1489453 - protein, 20 aa, Mycobacterium tuberculosis
QTLLGRPLIGNGADGAPGTG

SEQ ID NO: 1489454 - protein, 22 aa, Mycobacterium tuberculosis
QTLLGRPLIGNGADGAPGTGQP

SEQ ID NO: 1489455 - protein, 22 aa, Mycobacterium tuberculosis
QTLLGRPLIGNGTNGAPGDGQA

SEQ ID NO: 1489456 - protein, 18 aa, Mycobacterium tuberculosis
QTLPQLLSESGWYSALFG

SEQ ID NO: 1489457 - protein, 27 aa, Mycobacterium tuberculosis
QTMELALRVALGVIRLLLGADYAPLAV

SEQ ID NO: 1489458 - protein, 19 aa, Mycobacterium tuberculosis
QTRAPRFGAYIASKAALDS

SEQ ID NO: 1489459 - protein, 25 aa, Mycobacterium tuberculosis
QTRAVPGCRWWWLSETTRLTHKKYD

SEQ ID NO: 1489460 - protein, 27 aa, Mycobacterium tuberculosis
QTRWTAWWPACGDPGISLEERDVASGA

SEQ ID NO: 1489461 - protein, 17 aa, Mycobacterium tuberculosis
QTTEIRSTNRLAYLDAH

SEQ ID NO: 1489462 - protein, 23 aa, Mycobacterium tuberculosis
QTVAALLRLQARRTSNAEGREAL

SEQ ID NO: 1489463 - protein, 19 aa, Mycobacterium tuberculosis
QVAAGIRSTGRWRGRPKNQ

SEQ ID NO: 1489464 - protein, 18 aa, Mycobacterium tuberculosis
QVAAYHQQFVQTLRTGAA

SEQ ID NO: 1489465 - protein, 26 aa, Mycobacterium tuberculosis
QVAAYQERFVLALSQAGSTYAVAEAA

SEQ ID NO: 1489466 - protein, 27 aa, Mycobacterium tuberculosis
QVAAYQERFVLALSQAGSTYAVAEAAS

SEQ ID NO: 1489467 - protein, 37 aa, Mycobacterium tuberculosis
QVAERLLPALGFRVRFGVLVIRCALCTDTVKRLGTLP

SEQ ID NO: 1489468 - protein, 19 aa, Mycobacterium tuberculosis
QVAPWWRRRPHRSLTSLGQ

SEQ ID NO: 1489469 - protein, 24 aa, Mycobacterium tuberculosis
QVASRIRSAGAIFVGPWSPVSLGD

SEQ ID NO: 1489470 - protein, 24 aa, Mycobacterium tuberculosis
QVFKMAAELAYLEFGDLIDAMVTD

SEQ ID NO: 1489471 - protein, 17 aa, Mycobacterium tuberculosis
QVGMPRAVVITKLDHAR

SEQ ID NO: 1489472 - protein, 24 aa, Mycobacterium tuberculosis
QVGRPDIMIVVGGVIPPGDFDELY

SEQ ID NO: 1489473 - protein, 23 aa, Mycobacterium tuberculosis
QVGSHGVGGVGGDGGLGGAGGNG

SEQ ID NO: 1489474 - protein, 24 aa, Mycobacterium tuberculosis
QVGSHGVGGVGGDGGLGGAGGNGG

SEQ ID NO: 1489475 - protein, 19 aa, Mycobacterium tuberculosis
QVIRCFLHQLPHHVCAYPP

SEQ ID NO: 1489476 - protein, 21 aa, Mycobacterium tuberculosis
QVIRLRFGLDDGQPRTLDQIG

SEQ ID NO: 1489477 - protein, 23 aa, Mycobacterium tuberculosis
QVLWRRGEVYTARVHGSRAVGGL

SEQ ID NO: 1489478 - protein, 17 aa, Mycobacterium tuberculosis
QVMPLLTAWQGYPETLG

SEQ ID NO: 1489479 - protein, 38 aa, Mycobacterium tuberculosis
QVPGSIDAITLFPGGLTFPANSLLNLDVFVGTPGATIP

SEQ ID NO: 1489480 - protein, 18 aa, Mycobacterium tuberculosis
QVPPQRWQPFEGGPPEVA

SEQ ID NO: 1489481 - protein, 24 aa, Mycobacterium tuberculosis
QVSESPWALMHFMVRLPEVGVAGE

SEQ ID NO: 1489482 - protein, 17 aa, Mycobacterium tuberculosis
QVSLCMTAIRVEPVSSN

SEQ ID NO: 1489483 - protein, 23 aa, Mycobacterium tuberculosis
QVSRLKSSVAMELVRKQRGLTVA

SEQ ID NO: 1489484 - protein, 18 aa, Mycobacterium tuberculosis
QVTEVLKLLTGVGTPLVG

SEQ ID NO: 1489485 - protein, 19 aa, Mycobacterium tuberculosis
QVVSIPTLILFKDGQPVKR

SEQ ID NO: 1489486 - protein, 22 aa, Mycobacterium tuberculosis
QVVYRSGARHVLRLQRRTSPGN

SEQ ID NO: 1489487 - protein, 22 aa, Mycobacterium tuberculosis
QWAIRLARRGAVIVVDNVIRGG

SEQ ID NO: 1489488 - protein, 21 aa, Mycobacterium tuberculosis
QWCRDRETFGRPLISRQSVQN

SEQ ID NO: 1489489 - protein, 20 aa, Mycobacterium tuberculosis
QWERRYRRVAAYGQAKLANL

SEQ ID NO: 1489490 - protein, 20 aa, Mycobacterium tuberculosis
QWERRYRRVAAYGQIGELNL

SEQ ID NO: 1489491 - protein, 21 aa, Mycobacterium tuberculosis
QWILHMAKLSAAMAKQAQYVA

SEQ ID NO: 1489492 - protein, 18 aa, Mycobacterium tuberculosis
QWKRELVARTSLTENEIG

SEQ ID NO: 1489493 - protein, 29 aa, Mycobacterium tuberculosis
QWLEGSAVQRIMFRDGLVLNFDDYNELVI

SEQ ID NO: 1489494 - protein, 21 aa, Mycobacterium tuberculosis
QWLRARGYRPEQIVLAGDSAG

SEQ ID NO: 1489495 - protein, 17 aa, Mycobacterium tuberculosis
QYAEMWAQDAAAMYGYA

SEQ ID NO: 1489496 - protein, 23 aa, Mycobacterium tuberculosis
QYAEMWSQDAMAMYGYAGASAAA

SEQ ID NO: 1489497 - protein, 17 aa, Mycobacterium tuberculosis
QYGEMWAQDIVAMEGYA

SEQ ID NO: 1489498 - protein, 24 aa, Mycobacterium tuberculosis
QYGIEPQQLFGYLQERNQLPTMFA

SEQ ID NO: 1489499 - protein, 19 aa, Mycobacterium tuberculosis
QYHLWRYGLDGRLRGAPHM

SEQ ID NO: 1489500 - protein, 24 aa, Mycobacterium tuberculosis
QYREGMARAWGPVRVAIAAEQAHG

SEQ ID NO: 1489501 - protein, 19 aa, Mycobacterium tuberculosis
QYRWPAMAGAAVAVTRATP

SEQ ID NO: 1489502 - protein, 20 aa, Mycobacterium tuberculosis
QYVVRFGLGYREEVHPDLQI

SEQ ID NO: 1489503 - protein, 19 aa, Mycobacterium tuberculosis
RAAAAWDGLAEELGTAAQS

SEQ ID NO: 1489504 - protein, 19 aa, Mycobacterium tuberculosis
RAAAELALPHRRRRDPFDD

SEQ ID NO: 1489505 - protein, 17 aa, Mycobacterium tuberculosis
RAAAFIHHLPVDQVFTL

SEQ ID NO: 1489506 - protein, 19 aa, Mycobacterium tuberculosis
RAAAGLHRLCDSLSGAQVR

SEQ ID NO: 1489507 - protein, 20 aa, Mycobacterium tuberculosis
RAAALPGVVDIVAASRTVLV

SEQ ID NO: 1489508 - protein, 20 aa, Mycobacterium tuberculosis
RAAARARARYACFDHACADD

SEQ ID NO: 1489509 - protein, 18 aa, Mycobacterium tuberculosis
RAAATRLALRHPMLRVQF

SEQ ID NO: 1489510 - protein, 17 aa, Mycobacterium tuberculosis
RAAAVALSAALTAAAHA

SEQ ID NO: 1489511 - protein, 20 aa, Mycobacterium tuberculosis
RAACIRTELVTGRSAADIYR

SEQ ID NO: 1489512 - protein, 26 aa, Mycobacterium tuberculosis
RAAELMGIQIPRFCDHPLLEPVGACR

SEQ ID NO: 1489513 - protein, 18 aa, Mycobacterium tuberculosis
RAAFAAATRGGWRAGGVR

SEQ ID NO: 1489514 - protein, 19 aa, Mycobacterium tuberculosis
RAAFAAATRGGWRAGGVRD

SEQ ID NO: 1489515 - protein, 23 aa, Mycobacterium tuberculosis
RAAFEHAGLDWQQYVKFDQRYLR

SEQ ID NO: 1489516 - protein, 17 aa, Mycobacterium tuberculosis
RAAFQALELMVVVDVAM

SEQ ID NO: 1489517 - protein, 17 aa, Mycobacterium tuberculosis
RAAGELRKGDRVAQPRR

SEQ ID NO: 1489518 - protein, 20 aa, Mycobacterium tuberculosis
RAAGIARRTLFRYYASKNAI

SEQ ID NO: 1489519 - protein, 21 aa, Mycobacterium tuberculosis
RAAGIARRTLFRYYASKNAIS

SEQ ID NO: 1489520 - protein, 22 aa, Mycobacterium tuberculosis
RAAHRPLEWDLRNGVIVRKARA

SEQ ID NO: 1489521 - protein, 21 aa, Mycobacterium tuberculosis
RAAKCRTRNLPLIGAPANPGA

SEQ ID NO: 1489522 - protein, 19 aa, Mycobacterium tuberculosis
RAALAMVRRHRLLETFLVN

SEQ ID NO: 1489523 - protein, 18 aa, Mycobacterium tuberculosis
RAALGGRAGDPGARDAEV

SEQ ID NO: 1489524 - protein, 25 aa, Mycobacterium tuberculosis
RAALGRRWCCATGIIQPVGCRSDPA

SEQ ID NO: 1489525 - protein, 18 aa, Mycobacterium tuberculosis
RAALLARLDEAITSPAAY

SEQ ID NO: 1489526 - protein, 24 aa, Mycobacterium tuberculosis
RAALMTEALRRVWAKDLDARALYE

SEQ ID NO: 1489527 - protein, 17 aa, Mycobacterium tuberculosis
RAALPRGGADVEAVLPT

SEQ ID NO: 1489528 - protein, 18 aa, Mycobacterium tuberculosis
RAALPRPRGISVLSGTRR

SEQ ID NO: 1489529 - protein, 31 aa, Mycobacterium tuberculosis
RAAMIAAVLEKHARLAIAVNDIYLSTVGGMR

SEQ ID NO: 1489530 - protein, 18 aa, Mycobacterium tuberculosis
RAAMLAGIGENAGVVDIG

SEQ ID NO: 1489531 - protein, 17 aa, Mycobacterium tuberculosis
RAAMPNTVWTTGCDSWY

SEQ ID NO: 1489532 - protein, 19 aa, Mycobacterium tuberculosis
RAAPLVAILWGRDASTLKP

SEQ ID NO: 1489533 - protein, 24 aa, Mycobacterium tuberculosis
RAAPVPVPRPAAPVATAVTAATPP

SEQ ID NO: 1489534 - protein, 18 aa, Mycobacterium tuberculosis
RAAQRRWARLAPAQRAAG

SEQ ID NO: 1489535 - protein, 19 aa, Mycobacterium tuberculosis
RAAQTDWAKRPVIERAAVI

SEQ ID NO: 1489536 - protein, 20 aa, Mycobacterium tuberculosis
RAARRARCGVARRVPLIRDE

SEQ ID NO: 1489537 - protein, 22 aa, Mycobacterium tuberculosis
RAARRQKAGPAAAPAPAAPNGF

SEQ ID NO: 1489538 - protein, 17 aa, Mycobacterium tuberculosis
RAARTMRALDWFEVQSI

SEQ ID NO: 1489539 - protein, 17 aa, Mycobacterium tuberculosis
RAASPYVGWLNTAAGQA

SEQ ID NO: 1489540 - protein, 19 aa, Mycobacterium tuberculosis
RAATLGPWTLVLDECHHLL

SEQ ID NO: 1489541 - protein, 27 aa, Mycobacterium tuberculosis
RAAVRSPRPVRPGRVTGVAIAPPPTNN

SEQ ID NO: 1489542 - protein, 18 aa, Mycobacterium tuberculosis
RAAVSKYWIIDEIKPARL

SEQ ID NO: 1489543 - protein, 20 aa, Mycobacterium tuberculosis
RAAVSSFGLSGTNAHVVVEQ

SEQ ID NO: 1489544 - protein, 20 aa, Mycobacterium tuberculosis
RAAVVGAGLMGRRIAGVLAS

SEQ ID NO: 1489545 - protein, 18 aa, Mycobacterium tuberculosis
RACSGLVGGDGGNGGAGG

SEQ ID NO: 1489546 - protein, 19 aa, Mycobacterium tuberculosis
RACWPSWTPPPLMSRWSNR

SEQ ID NO: 1489547 - protein, 20 aa, Mycobacterium tuberculosis
RACWPSWTPPPLMSRWSNRP

SEQ ID NO: 1489548 - protein, 19 aa, Mycobacterium tuberculosis
RADALLAHDTLVPDSRPAR

SEQ ID NO: 1489549 - protein, 18 aa, Mycobacterium tuberculosis
RADAPPFFVLHGRHDSLI

SEQ ID NO: 1489550 - protein, 25 aa, Mycobacterium tuberculosis
RADERLRSGVPLGEVVDYLGIPASA

SEQ ID NO: 1489551 - protein, 24 aa, Mycobacterium tuberculosis
RADERLRSGVPLGEVVDYLGIPGP

SEQ ID NO: 1489552 - protein, 18 aa, Mycobacterium tuberculosis
RADIALVVADAGWKYLST

SEQ ID NO: 1489553 - protein, 19 aa, Mycobacterium tuberculosis
RADLAAARRVCRRLTTSAP

SEQ ID NO: 1489554 - protein, 21 aa, Mycobacterium tuberculosis
RADMIAVAPSTLWSLTVDPDR

SEQ ID NO: 1489555 - protein, 17 aa, Mycobacterium tuberculosis
RADMIVRGCLPYNAEPP

SEQ ID NO: 1489556 - protein, 22 aa, Mycobacterium tuberculosis
RADRSLAGPALRCRHPRRPDGR

SEQ ID NO: 1489557 - protein, 18 aa, Mycobacterium tuberculosis
RADYPGLRVRVAMSVGPW

SEQ ID NO: 1489558 - protein, 20 aa, Mycobacterium tuberculosis
RAEDLLIRVNLGERMKHRPG

SEQ ID NO: 1489559 - protein, 18 aa, Mycobacterium tuberculosis
RAEEVTVIVAPMFHAWGF

SEQ ID NO: 1489560 - protein, 30 aa, Mycobacterium tuberculosis
RAEEVTVIVAPMFHAWGFSQLVLASSLACT

SEQ ID NO: 1489561 - protein, 22 aa, Mycobacterium tuberculosis
RAELARLVAPLAVAAAVDDPIH

SEQ ID NO: 1489562 - protein, 23 aa, Mycobacterium tuberculosis
RAELIRLLLNRALTTAGDDLASD

SEQ ID NO: 1489563 - protein, 18 aa, Mycobacterium tuberculosis
RAELKDRLKRGGTNLTQV

SEQ ID NO: 1489564 - protein, 18 aa, Mycobacterium tuberculosis
RAELTVACDGRWSIARHE

SEQ ID NO: 1489565 - protein, 20 aa, Mycobacterium tuberculosis
RAEPAHSWGTLTPGRRQGLW

SEQ ID NO: 1489566 - protein, 25 aa, Mycobacterium tuberculosis
RAEPRLAELGGRFWFGLDDGRADVS

SEQ ID NO: 1489567 - protein, 24 aa, Mycobacterium tuberculosis
RAEPVVQPRSGWISVPEPPRRPRS

SEQ ID NO: 1489568 - protein, 21 aa, Mycobacterium tuberculosis
RAERYLGIIERVRAAIPHAAI

SEQ ID NO: 1489569 - protein, 23 aa, Mycobacterium tuberculosis
RAERYLGIIERVRAAIPHAAITT

SEQ ID NO: 1489570 - protein, 18 aa, Mycobacterium tuberculosis
RAESSALFAMLSGQHAVD

SEQ ID NO: 1489571 - protein, 21 aa, Mycobacterium tuberculosis
RAETARVVGRFGRPGGQQQHN

SEQ ID NO: 1489572 - protein, 17 aa, Mycobacterium tuberculosis
RAEYRILATAIQISPAG

SEQ ID NO: 1489573 - protein, 19 aa, Mycobacterium tuberculosis
RAFAAIDCRGLARVDFFLT

SEQ ID NO: 1489574 - protein, 21 aa, Mycobacterium tuberculosis
RAFQTLLRYGRAYSGYAPIMG

SEQ ID NO: 1489575 - protein, 22 aa, Mycobacterium tuberculosis
RAFQTLLRYGRAYSGYAPIMGT

SEQ ID NO: 1489576 - protein, 17 aa, Mycobacterium tuberculosis
RAFSGVKIACVGESTAD

SEQ ID NO: 1489577 - protein, 17 aa, Mycobacterium tuberculosis
RAFSIVAALICARKLIP

SEQ ID NO: 1489578 - protein, 18 aa, Mycobacterium tuberculosis
RAFSRRLDAAAGRVDTGA

SEQ ID NO: 1489579 - protein, 19 aa, Mycobacterium tuberculosis
RAFVNRPLVLLADEPTGNL

SEQ ID NO: 1489580 - protein, 21 aa, Mycobacterium tuberculosis
RAGALKDFRVAVWAEDPHCPI

SEQ ID NO: 1489581 - protein, 22 aa, Mycobacterium tuberculosis
RAGALKDFRVAVWAEDPHCPID

SEQ ID NO: 1489582 - protein, 31 aa, Mycobacterium tuberculosis
RAGALRLSPSLKRSSLIGGIRYYDTVVDDAR

SEQ ID NO: 1489583 - protein, 17 aa, Mycobacterium tuberculosis
RAGALTVAYVDAALEEL

SEQ ID NO: 1489584 - protein, 17 aa, Mycobacterium tuberculosis
RAGARILLAPDGPDLRV

SEQ ID NO: 1489585 - protein, 24 aa, Mycobacterium tuberculosis
RAGDSRLVAVLAELDDADTRAAVT

SEQ ID NO: 1489586 - protein, 19 aa, Mycobacterium tuberculosis
RAGDVLIVIGTEDGIAGVE

SEQ ID NO: 1489587 - protein, 26 aa, Mycobacterium tuberculosis
RAGGRLRRPLPAAGVAAKLSASRRKS

SEQ ID NO: 1489588 - protein, 20 aa, Mycobacterium tuberculosis
RAGKHLVCTVFDLMLAHYGV

SEQ ID NO: 1489589 - protein, 20 aa, Mycobacterium tuberculosis
RAGLGSSVPQFWAGELQTVT

SEQ ID NO: 1489590 - protein, 30 aa, Mycobacterium tuberculosis
RAGLLLPLGWDPRLPVMGQKYISQGAISKG

SEQ ID NO: 1489591 - protein, 18 aa, Mycobacterium tuberculosis
RAGLRTACLDAKRYAGGM

SEQ ID NO: 1489592 - protein, 20 aa, Mycobacterium tuberculosis
RAGLVGKLSVPQGWTVAAPE

SEQ ID NO: 1489593 - protein, 20 aa, Mycobacterium tuberculosis
RAGLVGKLSVPQGWTVGGRP

SEQ ID NO: 1489594 - protein, 19 aa, Mycobacterium tuberculosis
RAGRRWHGNADGCRASGTM

SEQ ID NO: 1489595 - protein, 20 aa, Mycobacterium tuberculosis
RAGTAGGAGRGPVGGIGGAG

SEQ ID NO: 1489596 - protein, 21 aa, Mycobacterium tuberculosis
RAGVHGLHLRRGPAIPRHTCD

SEQ ID NO: 1489597 - protein, 20 aa, Mycobacterium tuberculosis
RAGVKDVILESAITTIMDFE

SEQ ID NO: 1489598 - protein, 28 aa, Mycobacterium tuberculosis
RAGVPMQRIRPSLDWLIKNVGPHALASQ

SEQ ID NO: 1489599 - protein, 21 aa, Mycobacterium tuberculosis
RAHAVAVPPMFSDLASAPTRR

SEQ ID NO: 1489600 - protein, 25 aa, Mycobacterium tuberculosis
RAHEGSLRFGDKVVLGRDNVINTYL

SEQ ID NO: 1489601 - protein, 20 aa, Mycobacterium tuberculosis
RAHLLLRFDQGRWVAIDNGS

SEQ ID NO: 1489602 - protein, 19 aa, Mycobacterium tuberculosis
RAHLLLRFDRGNWIAIDND

SEQ ID NO: 1489603 - protein, 22 aa, Mycobacterium tuberculosis
RAHQARCAALIGGYDPHGRSPR

SEQ ID NO: 1489604 - protein, 25 aa, Mycobacterium tuberculosis
RAHRCVQPRRAAVVPIVPRCGGVLA

SEQ ID NO: 1489605 - protein, 17 aa, Mycobacterium tuberculosis
RAIAPNGPMDRMLRPGG

SEQ ID NO: 1489606 - protein, 26 aa, Mycobacterium tuberculosis
RAIIANRVSFAFGLRGPSVTIDSGQS

SEQ ID NO: 1489607 - protein, 19 aa, Mycobacterium tuberculosis
RAILDEWKTISGVDRKVDD

SEQ ID NO: 1489608 - protein, 23 aa, Mycobacterium tuberculosis
RAISEIGGLVTRVSVSGDAIAPT

SEQ ID NO: 1489609 - protein, 18 aa, Mycobacterium tuberculosis
RAIVRRPRVFCMDEPLSN

SEQ ID NO: 1489610 - protein, 24 aa, Mycobacterium tuberculosis
RAKIKALAVREGPAALPWGDLGVD

SEQ ID NO: 1489611 - protein, 23 aa, Mycobacterium tuberculosis
RAKIVKFSGCYHGHVDALLADAG

SEQ ID NO: 1489612 - protein, 21 aa, Mycobacterium tuberculosis
RAKLARKEKIMGFGHRVYRHG

SEQ ID NO: 1489613 - protein, 26 aa, Mycobacterium tuberculosis
RAKNMFALGLLSWMYGRELEHSEAFI

SEQ ID NO: 1489614 - protein, 18 aa, Mycobacterium tuberculosis
RAKVLAFTAFPKAHWQKI

SEQ ID NO: 1489615 - protein, 17 aa, Mycobacterium tuberculosis
RAKYGWTDVSRFAALGI

SEQ ID NO: 1489616 - protein, 17 aa, Mycobacterium tuberculosis
RALALMVNRVRNRVAFG

SEQ ID NO: 1489617 - protein, 18 aa, Mycobacterium tuberculosis
RALDYPKVVIGVSGGLDS

SEQ ID NO: 1489618 - protein, 22 aa, Mycobacterium tuberculosis
RALEGRAAALIANHGLVAVGPR

SEQ ID NO: 1489619 - protein, 26 aa, Mycobacterium tuberculosis
RALESRPGVVLHPGQAVCHFGVSTGE

SEQ ID NO: 1489620 - protein, 17 aa, Mycobacterium tuberculosis
RALGTVLGRGRPEDSPL

SEQ ID NO: 1489621 - protein, 17 aa, Mycobacterium tuberculosis
RALKAPTLRESVSRLAD

SEQ ID NO: 1489622 - protein, 40 aa, Mycobacterium tuberculosis
RALLEHVWALMGMPCGKYLVVMLELWLPLEAAAGDLDKPF

SEQ ID NO: 1489623 - protein, 17 aa, Mycobacterium tuberculosis
RALPLPRRHPGRRSPLW

SEQ ID NO: 1489624 - protein, 18 aa, Mycobacterium tuberculosis
RALSGYSCPPDVRIRANI

SEQ ID NO: 1489625 - protein, 18 aa, Mycobacterium tuberculosis
RALSLPSLPCEVAVNEPE

SEQ ID NO: 1489626 - protein, 23 aa, Mycobacterium tuberculosis
RALTACGLIAVAVARADAAASYF

SEQ ID NO: 1489627 - protein, 19 aa, Mycobacterium tuberculosis
RALTTMPIPVIAAVQGLAV

SEQ ID NO: 1489628 - protein, 17 aa, Mycobacterium tuberculosis
RALVIPFDPVFPARRGT

SEQ ID NO: 1489629 - protein, 18 aa, Mycobacterium tuberculosis
RALVLCDFESMTGALPTS

SEQ ID NO: 1489630 - protein, 17 aa, Mycobacterium tuberculosis
RALVPRRDVNGIMDELA

SEQ ID NO: 1489631 - protein, 26 aa, Mycobacterium tuberculosis
RAMAWRARPSWVWRPPTRGWTGCWRS

SEQ ID NO: 1489632 - protein, 29 aa, Mycobacterium tuberculosis
RAMDPRQRLALELTWELLEDAFVVPETLR

SEQ ID NO: 1489633 - protein, 24 aa, Mycobacterium tuberculosis
RAMTRAGRHIPVFAHVTVETTGTM

SEQ ID NO: 1489634 - protein, 24 aa, Mycobacterium tuberculosis
RANAEALVPITALLPAGADDVSAA

SEQ ID NO: 1489635 - protein, 21 aa, Mycobacterium tuberculosis
RANGIRRIVMLTGDHPEIAQV

SEQ ID NO: 1489636 - protein, 22 aa, Mycobacterium tuberculosis
RANRLAHWFRQAGLREDDVVAI

SEQ ID NO: 1489637 - protein, 21 aa, Mycobacterium tuberculosis
RANVPITRRGGLSFDLRRINP

SEQ ID NO: 1489638 - protein, 18 aa, Mycobacterium tuberculosis
RAPALRPSPVRVFVTSQG

SEQ ID NO: 1489639 - protein, 20 aa, Mycobacterium tuberculosis
RAPALRWGMGSLQEIDHVPF

SEQ ID NO: 1489640 - protein, 17 aa, Mycobacterium tuberculosis
RAPGPRMTDDWLGRPTG

SEQ ID NO: 1489641 - protein, 26 aa, Mycobacterium tuberculosis
RAPPGTALCRRCRRRRRVQPVAARSP

SEQ ID NO: 1489642 - protein, 18 aa, Mycobacterium tuberculosis
RAPSGWIRSTSGWKPAGV

SEQ ID NO: 1489643 - protein, 17 aa, Mycobacterium tuberculosis
RAPWLTRALVAEDFEFY

SEQ ID NO: 1489644 - protein, 17 aa, Mycobacterium tuberculosis
RAQAIAGLRALAAGQHA

SEQ ID NO: 1489645 - protein, 17 aa, Mycobacterium tuberculosis
RAQARTGTRCAAPGRAR

SEQ ID NO: 1489646 - protein, 17 aa, Mycobacterium tuberculosis
RAQRVGAALGRVRGSSS

SEQ ID NO: 1489647 - protein, 19 aa, Mycobacterium tuberculosis
RAQWLRPLLDGKIRSAFSM

SEQ ID NO: 1489648 - protein, 17 aa, Mycobacterium tuberculosis
RAQWRMPMGPVVNLTRW

SEQ ID NO: 1489649 - protein, 17 aa, Mycobacterium tuberculosis
RARAFALGQLRSLAERN

SEQ ID NO: 1489650 - protein, 18 aa, Mycobacterium tuberculosis
RARALGVTLFDTAEIYGL

SEQ ID NO: 1489651 - protein, 21 aa, Mycobacterium tuberculosis
RARDAGAIAYLVKPFSISDLI

SEQ ID NO: 1489652 - protein, 22 aa, Mycobacterium tuberculosis
RARDAGAMAYLVKPFSISDLIP

SEQ ID NO: 1489653 - protein, 17 aa, Mycobacterium tuberculosis
RARFNLRYPLAHLRPFL

SEQ ID NO: 1489654 - protein, 19 aa, Mycobacterium tuberculosis
RARGELMGIEMSFFTEAVG

SEQ ID NO: 1489655 - protein, 18 aa, Mycobacterium tuberculosis
RARGELMGIGMSFFTEAV

SEQ ID NO: 1489656 - protein, 22 aa, Mycobacterium tuberculosis
RARGSRRWRRWPACSRWSRAAG

SEQ ID NO: 1489657 - protein, 26 aa, Mycobacterium tuberculosis
RARGVLRRPQLVGCRRGHGPAARRRW

SEQ ID NO: 1489658 - protein, 24 aa, Mycobacterium tuberculosis
RARHREHGFMLALVTAATCCGPPD

SEQ ID NO: 1489659 - protein, 25 aa, Mycobacterium tuberculosis
RARLFPRGLAAFIELRDQRCRTPYC

SEQ ID NO: 1489660 - protein, 17 aa, Mycobacterium tuberculosis
RARLIERINNLRVGHSL

SEQ ID NO: 1489661 - protein, 18 aa, Mycobacterium tuberculosis
RARLRRRGPVTVYGVDKF

SEQ ID NO: 1489662 - protein, 19 aa, Mycobacterium tuberculosis
RARLYLCTDARRERGDLAQ

SEQ ID NO: 1489663 - protein, 17 aa, Mycobacterium tuberculosis
RARPRPVWRRSAGAANP

SEQ ID NO: 1489664 - protein, 17 aa, Mycobacterium tuberculosis
RARQEWLAERLATLNRS

SEQ ID NO: 1489665 - protein, 26 aa, Mycobacterium tuberculosis
RARRFPKGLAAFIGLRDQRCRMPYCD

SEQ ID NO: 1489666 - protein, 19 aa, Mycobacterium tuberculosis
RARRHRPRRCSAKTGSSSS

SEQ ID NO: 1489667 - protein, 19 aa, Mycobacterium tuberculosis
RARRPGATLRRCRGGPGDG

SEQ ID NO: 1489668 - protein, 21 aa, Mycobacterium tuberculosis
RARSKAARKVWDTAGQVHPRH

SEQ ID NO: 1489669 - protein, 29 aa, Mycobacterium tuberculosis
RARTAETGRPRWMAVSANGGAGGNGGIGG

SEQ ID NO: 1489670 - protein, 19 aa, Mycobacterium tuberculosis
RARTVIDFAARRVNPPVYQ

SEQ ID NO: 1489671 - protein, 17 aa, Mycobacterium tuberculosis
RASAIAVAKRGATVFAL

SEQ ID NO: 1489672 - protein, 19 aa, Mycobacterium tuberculosis
RASGRRKAWLRQAINHLEK

SEQ ID NO: 1489673 - protein, 19 aa, Mycobacterium tuberculosis
RASGVPIEHIVCVDGAPPA

SEQ ID NO: 1489674 - protein, 21 aa, Mycobacterium tuberculosis
RASHIRRFWMPTRSVEPAASA

SEQ ID NO: 1489675 - protein, 18 aa, Mycobacterium tuberculosis
RASILPVAGTPAAATAAC

SEQ ID NO: 1489676 - protein, 25 aa, Mycobacterium tuberculosis
RASILVDADDGWSYAVAEGTGQLTP

SEQ ID NO: 1489677 - protein, 17 aa, Mycobacterium tuberculosis
RASLHGGAVRRDREGAP

SEQ ID NO: 1489678 - protein, 17 aa, Mycobacterium tuberculosis
RASRRCSAAHAQEYQAL

SEQ ID NO: 1489679 - protein, 20 aa, Mycobacterium tuberculosis
RASSIGALSVPPSWAGQANL

SEQ ID NO: 1489680 - protein, 20 aa, Mycobacterium tuberculosis
RASTGAARRPPGSASPTQAR

SEQ ID NO: 1489681 - protein, 21 aa, Mycobacterium tuberculosis
RASTTPAISVRALPTRVISPP

SEQ ID NO: 1489682 - protein, 18 aa, Mycobacterium tuberculosis
RATFEAVLAKLAAPGATN

SEQ ID NO: 1489683 - protein, 25 aa, Mycobacterium tuberculosis
RATGGCAQRICRRGPRGGKCHRCAR

SEQ ID NO: 1489684 - protein, 18 aa, Mycobacterium tuberculosis
RATNLWGYTDLMRELGAD

SEQ ID NO: 1489685 - protein, 22 aa, Mycobacterium tuberculosis
RATPMPIPIGLWMFQTKLHVNA

SEQ ID NO: 1489686 - protein, 24 aa, Mycobacterium tuberculosis
RATRPGATLLLSCFSNAMPPDEEW

SEQ ID NO: 1489687 - protein, 19 aa, Mycobacterium tuberculosis
RATTWCRELLTATGRSSDF

SEQ ID NO: 1489688 - protein, 20 aa, Mycobacterium tuberculosis
RAVASSAMAATVGPVAPVGL

SEQ ID NO: 1489689 - protein, 17 aa, Mycobacterium tuberculosis
RAVDAGAAGHIFNLGHG

SEQ ID NO: 1489690 - protein, 26 aa, Mycobacterium tuberculosis
RAVDANALGAAWWRGVELVVASMGGV

SEQ ID NO: 1489691 - protein, 20 aa, Mycobacterium tuberculosis
RAVEPRLTLLDAITGNPGDP

SEQ ID NO: 1489692 - protein, 21 aa, Mycobacterium tuberculosis
RAVFIRAPWVERVGDGVQVLA

SEQ ID NO: 1489693 - protein, 27 aa, Mycobacterium tuberculosis
RAVGLRARCFGFGAGDCHQSRRRLPAP

SEQ ID NO: 1489694 - protein, 21 aa, Mycobacterium tuberculosis
RAVGRYLAGRAGEAGVGKLGF

SEQ ID NO: 1489695 - protein, 19 aa, Mycobacterium tuberculosis
RAVGWRKDAFFGRAALLAE

SEQ ID NO: 1489696 - protein, 17 aa, Mycobacterium tuberculosis
RAVKCDHPAFFSEEAAA

SEQ ID NO: 1489697 - protein, 20 aa, Mycobacterium tuberculosis
RAVQVLRRLYDRVGDRLALI

SEQ ID NO: 1489698 - protein, 24 aa, Mycobacterium tuberculosis
RAVRQWLVRWAVHPGRATRGFHNH

SEQ ID NO: 1489699 - protein, 27 aa, Mycobacterium tuberculosis
RAVTVFGFTAVAGWRRRGLGFAYGRLL

SEQ ID NO: 1489700 - protein, 27 aa, Mycobacterium tuberculosis
RAVVTRYELVPGFPRFDVDDVYLGNGV

SEQ ID NO: 1489701 - protein, 20 aa, Mycobacterium tuberculosis
RAWARLWERCAIDLTGNTEE

SEQ ID NO: 1489702 - protein, 32 aa, Mycobacterium tuberculosis
RCAAGTRNAAGFGWLSTRRFKPPKAALSSSEL

SEQ ID NO: 1489703 - protein, 33 aa, Mycobacterium tuberculosis
RCAARIVGGRCLMPASSAARCAARIVGGPRLYG

SEQ ID NO: 1489704 - protein, 17 aa, Mycobacterium tuberculosis
RCACWSRHSMPRKPIYR

SEQ ID NO: 1489705 - protein, 18 aa, Mycobacterium tuberculosis
RCAPAALRYLSQARHTGK

SEQ ID NO: 1489706 - protein, 19 aa, Mycobacterium tuberculosis
RCARRRAEIFTWQRAAASM

SEQ ID NO: 1489707 - protein, 17 aa, Mycobacterium tuberculosis
RCARWSTPIAQQRAQIV

SEQ ID NO: 1489708 - protein, 19 aa, Mycobacterium tuberculosis
RCCDEATPSAGPRAAQPPY

SEQ ID NO: 1489709 - protein, 19 aa, Mycobacterium tuberculosis
RCEPAEPAAAAAGEQPAGP

SEQ ID NO: 1489710 - protein, 25 aa, Mycobacterium tuberculosis
RCERALREHVEWSLLDVLRGAPGAP

SEQ ID NO: 1489711 - protein, 18 aa, Mycobacterium tuberculosis
RCFEPRLQELIGYGLYAG

SEQ ID NO: 1489712 - protein, 19 aa, Mycobacterium tuberculosis
RCGDRGAVVGRVVVNDLEL

SEQ ID NO: 1489713 - protein, 26 aa, Mycobacterium tuberculosis
RCGMAQRLRALAALPELIAAKPDGPR

SEQ ID NO: 1489714 - protein, 30 aa, Mycobacterium tuberculosis
RCGMVSPTVFWPIPRVYSGLVRIDRYETSP

SEQ ID NO: 1489715 - protein, 31 aa, Mycobacterium tuberculosis
RCGMVSPTVFWPIPRVYSGLVRIDRYETSPW

SEQ ID NO: 1489716 - protein, 17 aa, Mycobacterium tuberculosis
RCMIAAGALVVAGTQIP

SEQ ID NO: 1489717 - protein, 18 aa, Mycobacterium tuberculosis
RCNEADAGVPARRRGRGV

SEQ ID NO: 1489718 - protein, 17 aa, Mycobacterium tuberculosis
RCNYAKQAPGWRVSTSV

SEQ ID NO: 1489719 - protein, 21 aa, Mycobacterium tuberculosis
RCPLPRPAIGPGTYNLVVQLG

SEQ ID NO: 1489720 - protein, 18 aa, Mycobacterium tuberculosis
RCPSEHWEVVRIEMPASV

SEQ ID NO: 1489721 - protein, 19 aa, Mycobacterium tuberculosis
RCRCGQIIVVGSQRYGSIL

SEQ ID NO: 1489722 - protein, 25 aa, Mycobacterium tuberculosis
RCRIPGCGAPRCLGSRSVRRSPRWN

SEQ ID NO: 1489723 - protein, 21 aa, Mycobacterium tuberculosis
RCRRPGPRPTRQSPRRRGRCR

SEQ ID NO: 1489724 - protein, 28 aa, Mycobacterium tuberculosis
RCRSRARLLGLRLRRLRYLRTAAARRPQ

SEQ ID NO: 1489725 - protein, 17 aa, Mycobacterium tuberculosis
RCRWCQRGGKQPLAAAK

SEQ ID NO: 1489726 - protein, 24 aa, Mycobacterium tuberculosis
RCRWRTCPHRPKRGSARSPRRSPK

SEQ ID NO: 1489727 - protein, 18 aa, Mycobacterium tuberculosis
RCRYCMPEEHYTWLPRQD

SEQ ID NO: 1489728 - protein, 18 aa, Mycobacterium tuberculosis
RCSARFAAEFVAQLHAAG

SEQ ID NO: 1489729 - protein, 23 aa, Mycobacterium tuberculosis
RCSGRLRKLFNAVGVVFKGTGFY

SEQ ID NO: 1489730 - protein, 28 aa, Mycobacterium tuberculosis
RCSKGSFYLRPIVRPVILVAGGTGLSAI

SEQ ID NO: 1489731 - protein, 22 aa, Mycobacterium tuberculosis
RCVDYARGRFDAIVPDEVIAQL

SEQ ID NO: 1489732 - protein, 25 aa, Mycobacterium tuberculosis
RCVDYARGRFDAIVPDEVIAQLPYD

SEQ ID NO: 1489733 - protein, 24 aa, Mycobacterium tuberculosis
RCWPRQRPGTGWPPNYSPTAADYG

SEQ ID NO: 1489734 - protein, 18 aa, Mycobacterium tuberculosis
RDAARMACLPNVSMAAVT

SEQ ID NO: 1489735 - protein, 20 aa, Mycobacterium tuberculosis
RDAEVIAVREAARLIAEDER

SEQ ID NO: 1489736 - protein, 17 aa, Mycobacterium tuberculosis
RDAKFTPAREALDNPNF

SEQ ID NO: 1489737 - protein, 18 aa, Mycobacterium tuberculosis
RDDAGKLAGTRRCNGGCA

SEQ ID NO: 1489738 - protein, 22 aa, Mycobacterium tuberculosis
RDDAVAAIVAWIADRGNAVPTA

SEQ ID NO: 1489739 - protein, 19 aa, Mycobacterium tuberculosis
RDDGACYAELLTAAGVSVE

SEQ ID NO: 1489740 - protein, 21 aa, Mycobacterium tuberculosis
RDDGACYAELLTAAGVSVELS

SEQ ID NO: 1489741 - protein, 24 aa, Mycobacterium tuberculosis
RDDIAQRGWPVFCVSTATRENLQP

SEQ ID NO: 1489742 - protein, 22 aa, Mycobacterium tuberculosis
RDDLSCSGLPPGGHTREAKPDP

SEQ ID NO: 1489743 - protein, 21 aa, Mycobacterium tuberculosis
RDEFRASKIMLDRARNNDKIR

SEQ ID NO: 1489744 - protein, 19 aa, Mycobacterium tuberculosis
RDELDRLGVRLRLDDTGAL

SEQ ID NO: 1489745 - protein, 25 aa, Mycobacterium tuberculosis
RDELPTAPNALVFPSYRGGHLPIEE

SEQ ID NO: 1489746 - protein, 17 aa, Mycobacterium tuberculosis
RDELRTMTTKVSSKTAP

SEQ ID NO: 1489747 - protein, 19 aa, Mycobacterium tuberculosis
RDEMICGMAEVVKAGFIAD

SEQ ID NO: 1489748 - protein, 25 aa, Mycobacterium tuberculosis
RDFAHCLGCKVAACVVDGYRPRDER

SEQ ID NO: 1489749 - protein, 20 aa, Mycobacterium tuberculosis
RDFRSWACVDLELHPGRTVF

SEQ ID NO: 1489750 - protein, 23 aa, Mycobacterium tuberculosis
RDFRSWACVDLELHPGRTVFVGP

SEQ ID NO: 1489751 - protein, 21 aa, Mycobacterium tuberculosis
RDFWLQVGIDPIQIRAPPPST

SEQ ID NO: 1489752 - protein, 20 aa, Mycobacterium tuberculosis
RDGAAPKWWFTVGGQVRPGE

SEQ ID NO: 1489753 - protein, 18 aa, Mycobacterium tuberculosis
RDGARFYLRAQPRRSRRR

SEQ ID NO: 1489754 - protein, 17 aa, Mycobacterium tuberculosis
RDGDILVGKVTPKGETE

SEQ ID NO: 1489755 - protein, 22 aa, Mycobacterium tuberculosis
RDGFVFGEAGALMLIETEEHAK

SEQ ID NO: 1489756 - protein, 17 aa, Mycobacterium tuberculosis
RDGLHMASLAGAWTALV

SEQ ID NO: 1489757 - protein, 22 aa, Mycobacterium tuberculosis
RDGMAGWYFTKWQRVLNDGLDA

SEQ ID NO: 1489758 - protein, 18 aa, Mycobacterium tuberculosis
RDGPHVRLWAKLEDRNPT

SEQ ID NO: 1489759 - protein, 18 aa, Mycobacterium tuberculosis
RDGPVVVHPSWWSAARVE

SEQ ID NO: 1489760 - protein, 46 aa, Mycobacterium tuberculosis
RDGRRHLISTGCQKFRRRAQCRGVGGPQRRPDVRQIRSGPHQRLGS

SEQ ID NO: 1489761 - protein, 22 aa, Mycobacterium tuberculosis
RDGRSTFRYPGGPIVHDAIHRS

SEQ ID NO: 1489762 - protein, 26 aa, Mycobacterium tuberculosis
RDGVACYPARFQLVLAANPCPCAPAD

SEQ ID NO: 1489763 - protein, 17 aa, Mycobacterium tuberculosis
RDGVMSFLVLPPEVNSA

SEQ ID NO: 1489764 - protein, 21 aa, Mycobacterium tuberculosis
RDGWRISWMPGVVVVVLGGDT

SEQ ID NO: 1489765 - protein, 20 aa, Mycobacterium tuberculosis
RDHMHACGVVDIATGLASTP

SEQ ID NO: 1489766 - protein, 17 aa, Mycobacterium tuberculosis
RDIGCVFSIDTDAHAPG

SEQ ID NO: 1489767 - protein, 22 aa, Mycobacterium tuberculosis
RDIPVAFLAGGPHAVYLLDAFN

SEQ ID NO: 1489768 - protein, 17 aa, Mycobacterium tuberculosis
RDKGGRAVANYDSVATE

SEQ ID NO: 1489769 - protein, 18 aa, Mycobacterium tuberculosis
RDKGGRAVANYDSVATED

SEQ ID NO: 1489770 - protein, 17 aa, Mycobacterium tuberculosis
RDKPALMERLYKTSWRF

SEQ ID NO: 1489771 - protein, 17 aa, Mycobacterium tuberculosis
RDKRARLLAQGRDPYPV

SEQ ID NO: 1489772 - protein, 24 aa, Mycobacterium tuberculosis
RDLASRIYTDFTYRSGSTTISTGV

SEQ ID NO: 1489773 - protein, 28 aa, Mycobacterium tuberculosis
RDLIPDLAELLAMRGIDGLPFSWTVASW

SEQ ID NO: 1489774 - protein, 29 aa, Mycobacterium tuberculosis
RDLIPDLAELLAMRGIDGLPFSWTVASWT

SEQ ID NO: 1489775 - protein, 21 aa, Mycobacterium tuberculosis
RDLTAPPVWFIKTIGDAVMLV

SEQ ID NO: 1489776 - protein, 25 aa, Mycobacterium tuberculosis
RDLTRPCAHLRSLLHEALIASGSAC

SEQ ID NO: 1489777 - protein, 18 aa, Mycobacterium tuberculosis
RDNLVAAGVHCSAAQADP

SEQ ID NO: 1489778 - protein, 26 aa, Mycobacterium tuberculosis
RDNRAVHALARIMLHGRISHIQTSWV

SEQ ID NO: 1489779 - protein, 18 aa, Mycobacterium tuberculosis
RDPERHPGLAIGAVAVVN

SEQ ID NO: 1489780 - protein, 18 aa, Mycobacterium tuberculosis
RDPPGPRCDDRCCAGKAR

SEQ ID NO: 1489781 - protein, 18 aa, Mycobacterium tuberculosis
RDPRLRRALTPDYEPMCK

SEQ ID NO: 1489782 - protein, 18 aa, Mycobacterium tuberculosis
RDQLSFPLPGRDDIGDQD

SEQ ID NO: 1489783 - protein, 25 aa, Mycobacterium tuberculosis
RDQRPPVRLDLALVFNEGTRLRRRR

SEQ ID NO: 1489784 - protein, 19 aa, Mycobacterium tuberculosis
RDRFALLTGGARTAAHRQQ

SEQ ID NO: 1489785 - protein, 18 aa, Mycobacterium tuberculosis
RDRFCRFGSEYVHAALAA

SEQ ID NO: 1489786 - protein, 19 aa, Mycobacterium tuberculosis
RDRGATMIFTRTKRTAQKS

SEQ ID NO: 1489787 - protein, 33 aa, Mycobacterium tuberculosis
RDRKRGHRKLGHRKLGRRKLRHRERGQHQHGLV

SEQ ID NO: 1489788 - protein, 23 aa, Mycobacterium tuberculosis
RDRLKELGESVAIAAAPPDSYSV

SEQ ID NO: 1489789 - protein, 26 aa, Mycobacterium tuberculosis
RDRPKKLFRPKVPVTIVVGERIEPTL

SEQ ID NO: 1489790 - protein, 18 aa, Mycobacterium tuberculosis
RDRRRAGLAAAWPSRGTA

SEQ ID NO: 1489791 - protein, 17 aa, Mycobacterium tuberculosis
RDRRTDPGRSWGTFDEA

SEQ ID NO: 1489792 - protein, 18 aa, Mycobacterium tuberculosis
RDRRVLLAGWEQFNEPVD

SEQ ID NO: 1489793 - protein, 26 aa, Mycobacterium tuberculosis
RDRVLPGWARSTCRQRFAAQGRELVV

SEQ ID NO: 1489794 - protein, 23 aa, Mycobacterium tuberculosis
RDRVPLRWRRWSTSSTCSRPSTS

SEQ ID NO: 1489795 - protein, 18 aa, Mycobacterium tuberculosis
RDSKLPPQYTVFGTIQAD

SEQ ID NO: 1489796 - protein, 24 aa, Mycobacterium tuberculosis
RDSPARGGRHLGFAKALVYEMPHT

SEQ ID NO: 1489797 - protein, 23 aa, Mycobacterium tuberculosis
RDSPELIRLAPRPAARTDPMLLA

SEQ ID NO: 1489798 - protein, 21 aa, Mycobacterium tuberculosis
RDSRTRTSIGLATAAAAGTSV

SEQ ID NO: 1489799 - protein, 18 aa, Mycobacterium tuberculosis
RDSVAWLAQRGILVAPGD

SEQ ID NO: 1489800 - protein, 17 aa, Mycobacterium tuberculosis
RDVACRRDFEDVALTLV

SEQ ID NO: 1489801 - protein, 17 aa, Mycobacterium tuberculosis
RDVDWWLTFSSAAALLG

SEQ ID NO: 1489802 - protein, 22 aa, Mycobacterium tuberculosis
RDVIDAFLAWYVPGLDISDHTM

SEQ ID NO: 1489803 - protein, 17 aa, Mycobacterium tuberculosis
RDVKRVKDRFGVTINDV

SEQ ID NO: 1489804 - protein, 20 aa, Mycobacterium tuberculosis
RDVLVALGIYPGAAELGAEG

SEQ ID NO: 1489805 - protein, 24 aa, Mycobacterium tuberculosis
RDWAPKVHGAWELHEATSGQPLDW

SEQ ID NO: 1489806 - protein, 29 aa, Mycobacterium tuberculosis
RDWRQWWDWVPGACWRHPFGRDSDIADRA

SEQ ID NO: 1489807 - protein, 24 aa, Mycobacterium tuberculosis
RDYEISSYFGSLRGLNDRPCSSLH

SEQ ID NO: 1489808 - protein, 18 aa, Mycobacterium tuberculosis
REAARLIAEDERLTPALV

SEQ ID NO: 1489809 - protein, 17 aa, Mycobacterium tuberculosis
REAAWRVLDQRPFDVQV

SEQ ID NO: 1489810 - protein, 26 aa, Mycobacterium tuberculosis
READRWPDKPGRYFTVRAGSLVAWNA

SEQ ID NO: 1489811 - protein, 31 aa, Mycobacterium tuberculosis
READRWPDKPGRYFTVRAGSLVAWNAEQSGH

SEQ ID NO: 1489812 - protein, 21 aa, Mycobacterium tuberculosis
REAEGVRLFRFDRIVDAAELG

SEQ ID NO: 1489813 - protein, 17 aa, Mycobacterium tuberculosis
REAEKLAALLTQPGRTY

SEQ ID NO: 1489814 - protein, 18 aa, Mycobacterium tuberculosis
REALIKTDIFGSAADVEK

SEQ ID NO: 1489815 - protein, 19 aa, Mycobacterium tuberculosis
REALRQAALVRFLAQGVEA

SEQ ID NO: 1489816 - protein, 31 aa, Mycobacterium tuberculosis
REANRWPDKPGRYFTVRAGSLVAWNAEQSGH

SEQ ID NO: 1489817 - protein, 20 aa, Mycobacterium tuberculosis
REAVDFELPAPGSYATGIAF

SEQ ID NO: 1489818 - protein, 17 aa, Mycobacterium tuberculosis
REDVERGQVSPSRHHHA

SEQ ID NO: 1489819 - protein, 22 aa, Mycobacterium tuberculosis
REEIIRMVDLMISRVAGQLRAR

SEQ ID NO: 1489820 - protein, 23 aa, Mycobacterium tuberculosis
REELGDLLLQVLFHARIAEDASQ

SEQ ID NO: 1489821 - protein, 24 aa, Mycobacterium tuberculosis
REELQPRLPAVMDRLDRAIPRGVG

SEQ ID NO: 1489822 - protein, 19 aa, Mycobacterium tuberculosis
REEQDRWGVRSQNRAEEAI

SEQ ID NO: 1489823 - protein, 20 aa, Mycobacterium tuberculosis
REEQDRWGVRSQNRAEEAIK

SEQ ID NO: 1489824 - protein, 21 aa, Mycobacterium tuberculosis
REFDAKLGRGPAVAVDDELMA

SEQ ID NO: 1489825 - protein, 17 aa, Mycobacterium tuberculosis
REGEVPGALVIERNVLE

SEQ ID NO: 1489826 - protein, 20 aa, Mycobacterium tuberculosis
REGFPVELLSYFEVFTKTTI

SEQ ID NO: 1489827 - protein, 18 aa, Mycobacterium tuberculosis
REGLARLAGQVETMRARV

SEQ ID NO: 1489828 - protein, 19 aa, Mycobacterium tuberculosis
REGLARLAGQVETMRARVE

SEQ ID NO: 1489829 - protein, 17 aa, Mycobacterium tuberculosis
REGVHTVGELVARTESD

SEQ ID NO: 1489830 - protein, 19 aa, Mycobacterium tuberculosis
REHPRPVAAGLYGDLTATL

SEQ ID NO: 1489831 - protein, 17 aa, Mycobacterium tuberculosis
REIAVDLRDDWPQALRD

SEQ ID NO: 1489832 - protein, 17 aa, Mycobacterium tuberculosis
REIHLTLIPFALRPTAE

SEQ ID NO: 1489833 - protein, 22 aa, Mycobacterium tuberculosis
REIHLTLIPFALRPTAEVPTTT

SEQ ID NO: 1489834 - protein, 23 aa, Mycobacterium tuberculosis
REIQTRGAVTIVIAEEGDETVRP

SEQ ID NO: 1489835 - protein, 23 aa, Mycobacterium tuberculosis
REISRPRVCVIDPPVATIGSSTM

SEQ ID NO: 1489836 - protein, 24 aa, Mycobacterium tuberculosis
REKGEGWGGITEGYWDGKPGIDMY

SEQ ID NO: 1489837 - protein, 18 aa, Mycobacterium tuberculosis
REKHGALRGSMTVLAVGR

SEQ ID NO: 1489838 - protein, 31 aa, Mycobacterium tuberculosis
RELALQVAEAFGRYGAYLSQLNVLPIYGGSS

SEQ ID NO: 1489839 - protein, 17 aa, Mycobacterium tuberculosis
RELDMLLTAGERISNAL

SEQ ID NO: 1489840 - protein, 24 aa, Mycobacterium tuberculosis
RELFCARDPFGIKPLFIATGAGGT

SEQ ID NO: 1489841 - protein, 24 aa, Mycobacterium tuberculosis
RELFVDKVWDWKRESGGAIGGQMR

SEQ ID NO: 1489842 - protein, 17 aa, Mycobacterium tuberculosis
RELGCTPSAEANLAAVL

SEQ ID NO: 1489843 - protein, 18 aa, Mycobacterium tuberculosis
RELIQVLGHAGVRSLVSQ

SEQ ID NO: 1489844 - protein, 22 aa, Mycobacterium tuberculosis
RELKLGSGGLRDVEFAVQLLQL

SEQ ID NO: 1489845 - protein, 20 aa, Mycobacterium tuberculosis
RELLPYSDLDVLLLHDGKPA

SEQ ID NO: 1489846 - protein, 17 aa, Mycobacterium tuberculosis
RELPEMDPSGAGKWLLI

SEQ ID NO: 1489847 - protein, 19 aa, Mycobacterium tuberculosis
RELPGAWNFRDVADTATAL

SEQ ID NO: 1489848 - protein, 22 aa, Mycobacterium tuberculosis
RELPVYIISIGRTFRTDELDAT

SEQ ID NO: 1489849 - protein, 23 aa, Mycobacterium tuberculosis
RELQTRMFACFAAGALAAGCEYE

SEQ ID NO: 1489850 - protein, 19 aa, Mycobacterium tuberculosis
RELRPSAAVVELPGLGHYP

SEQ ID NO: 1489851 - protein, 18 aa, Mycobacterium tuberculosis
RELSGSSNLLFRRNSVSG

SEQ ID NO: 1489852 - protein, 19 aa, Mycobacterium tuberculosis
RELSNLVELARRTAAADDP

SEQ ID NO: 1489853 - protein, 21 aa, Mycobacterium tuberculosis
RELSQRLSAPRVVWVMVPAGN

SEQ ID NO: 1489854 - protein, 18 aa, Mycobacterium tuberculosis
RELTAFVTYDHRLLSGCR

SEQ ID NO: 1489855 - protein, 17 aa, Mycobacterium tuberculosis
REMPAVRAALEAVRAEL

SEQ ID NO: 1489856 - protein, 21 aa, Mycobacterium tuberculosis
RENPIRRGIRGSPARREKARA

SEQ ID NO: 1489857 - protein, 21 aa, Mycobacterium tuberculosis
RENRLRTALAALDNFDFDYVF

SEQ ID NO: 1489858 - protein, 17 aa, Mycobacterium tuberculosis
REPELKALLDRLLAQKL

SEQ ID NO: 1489859 - protein, 18 aa, Mycobacterium tuberculosis
REPEPPRCGPARPSNPAA

SEQ ID NO: 1489860 - protein, 24 aa, Mycobacterium tuberculosis
REPIGMAGEITWRVPSMSITDEAV

SEQ ID NO: 1489861 - protein, 19 aa, Mycobacterium tuberculosis
REPLRVEGEVSYRVPSLSL

SEQ ID NO: 1489862 - protein, 26 aa, Mycobacterium tuberculosis
REPTGDGLVEWEGIGTVEAWTTPVNR

SEQ ID NO: 1489863 - protein, 20 aa, Mycobacterium tuberculosis
REQPLPLGLRRLLTDLHIAG

SEQ ID NO: 1489864 - protein, 24 aa, Mycobacterium tuberculosis
REREVLNRIACRQSIPAIAAERYV

SEQ ID NO: 1489865 - protein, 19 aa, Mycobacterium tuberculosis
RERGWPQFADRLLELAREA

SEQ ID NO: 1489866 - protein, 18 aa, Mycobacterium tuberculosis
RERIALSNVRIKSSVQNY

SEQ ID NO: 1489867 - protein, 23 aa, Mycobacterium tuberculosis
RERRCRRQRRVAIRQRWARRQRW

SEQ ID NO: 1489868 - protein, 27 aa, Mycobacterium tuberculosis
RERRRRRYPARPACDGRLEPQAVRGTR

SEQ ID NO: 1489869 - protein, 23 aa, Mycobacterium tuberculosis
RERYPQWDRFAAVRDRLDPDRVF

SEQ ID NO: 1489870 - protein, 18 aa, Mycobacterium tuberculosis
RESAARALLLPRRHPGRR

SEQ ID NO: 1489871 - protein, 18 aa, Mycobacterium tuberculosis
RESVRRLDAIAAELDRAV

SEQ ID NO: 1489872 - protein, 19 aa, Mycobacterium tuberculosis
RESVRRLDAIAAELDRAVP

SEQ ID NO: 1489873 - protein, 20 aa, Mycobacterium tuberculosis
RETLGEIGFADERSVISAKC

SEQ ID NO: 1489874 - protein, 17 aa, Mycobacterium tuberculosis
REVCDRYDLPYTTGSFL

SEQ ID NO: 1489875 - protein, 19 aa, Mycobacterium tuberculosis
REVDTMDPFMMIFTSGTSG

SEQ ID NO: 1489876 - protein, 21 aa, Mycobacterium tuberculosis
REVLAELMAIWAAGDTAGVAT

SEQ ID NO: 1489877 - protein, 22 aa, Mycobacterium tuberculosis
REWFTANATLGWATCPLTEAGF

SEQ ID NO: 1489878 - protein, 25 aa, Mycobacterium tuberculosis
REWRYRPRVAVGIMSAAVVACPGPP

SEQ ID NO: 1489879 - protein, 19 aa, Mycobacterium tuberculosis
REYLLQCWFVARVSTLPGV

SEQ ID NO: 1489880 - protein, 24 aa, Mycobacterium tuberculosis
RFADWLVRVVEAFADRPDQPLREV

SEQ ID NO: 1489881 - protein, 19 aa, Mycobacterium tuberculosis
RFAMYTKMHHALIDGVSAM

SEQ ID NO: 1489882 - protein, 29 aa, Mycobacterium tuberculosis
RFASTAWTSTWRRWCIPANAATSSTTCAP

SEQ ID NO: 1489883 - protein, 21 aa, Mycobacterium tuberculosis
RFATCCRALGIAVYQRKRPPD

SEQ ID NO: 1489884 - protein, 17 aa, Mycobacterium tuberculosis
RFDSLRTLVPVSTRSNS

SEQ ID NO: 1489885 - protein, 17 aa, Mycobacterium tuberculosis
RFENRCELLAFRHDLDP

SEQ ID NO: 1489886 - protein, 24 aa, Mycobacterium tuberculosis
RFEREMADLYGIRPVGHPKPRRLV

SEQ ID NO: 1489887 - protein, 20 aa, Mycobacterium tuberculosis
RFFREYPYRDAYLLREARLF

SEQ ID NO: 1489888 - protein, 17 aa, Mycobacterium tuberculosis
RFGDCLEGDLVRRDFTT

SEQ ID NO: 1489889 - protein, 26 aa, Mycobacterium tuberculosis
RFGIEPELAEALVWRGGPGKTFEESG

SEQ ID NO: 1489890 - protein, 19 aa, Mycobacterium tuberculosis
RFGPEPDRSQTFACEASSH

SEQ ID NO: 1489891 - protein, 19 aa, Mycobacterium tuberculosis
RFGPSVLYGVPNFFARVID

SEQ ID NO: 1489892 - protein, 20 aa, Mycobacterium tuberculosis
RFGPVQADGRYLLRTDAGEE

SEQ ID NO: 1489893 - protein, 19 aa, Mycobacterium tuberculosis
RFGSTGALRRNTRRDAVIG

SEQ ID NO: 1489894 - protein, 17 aa, Mycobacterium tuberculosis
RFITAVRLLAERLGVRQ

SEQ ID NO: 1489895 - protein, 20 aa, Mycobacterium tuberculosis
RFLLTAGFFETHRPYPHERY

SEQ ID NO: 1489896 - protein, 26 aa, Mycobacterium tuberculosis
RFLMSVGDLIIGWLLQRQAAVAVAAL

SEQ ID NO: 1489897 - protein, 18 aa, Mycobacterium tuberculosis
RFMTRWQGEPDPRHIEAI

SEQ ID NO: 1489898 - protein, 20 aa, Mycobacterium tuberculosis
RFPKFDWPRIDAPYMRPGLD

SEQ ID NO: 1489899 - protein, 19 aa, Mycobacterium tuberculosis
RFQQVESWLVAKPNTSVLI

SEQ ID NO: 1489900 - protein, 17 aa, Mycobacterium tuberculosis
RFRCPGGVRRDSCPSYP

SEQ ID NO: 1489901 - protein, 19 aa, Mycobacterium tuberculosis
RFRCSRVGGPGLGACAGAC

SEQ ID NO: 1489902 - protein, 24 aa, Mycobacterium tuberculosis
RFRQRGAVDFAMRGDRNLIQHNIG

SEQ ID NO: 1489903 - protein, 22 aa, Mycobacterium tuberculosis
RFRRVVGTSICWVTSTRVRGDV

SEQ ID NO: 1489904 - protein, 21 aa, Mycobacterium tuberculosis
RFRTRYAIPIERHGHTEPAER

SEQ ID NO: 1489905 - protein, 18 aa, Mycobacterium tuberculosis
RFSWKNTGQILADEGHHV

SEQ ID NO: 1489906 - protein, 21 aa, Mycobacterium tuberculosis
RFTFEMGDPKHLGHLLNAVRN

SEQ ID NO: 1489907 - protein, 21 aa, Mycobacterium tuberculosis
RFTLTVGLMLPRRAFLPPPHV

SEQ ID NO: 1489908 - protein, 24 aa, Mycobacterium tuberculosis
RFTPGGLVLTEWQGAAVYRELQPG

SEQ ID NO: 1489909 - protein, 18 aa, Mycobacterium tuberculosis
RFVLVGRPGPPPARTGAD

SEQ ID NO: 1489910 - protein, 18 aa, Mycobacterium tuberculosis
RFVVYPSDHELIAHTLWI

SEQ ID NO: 1489911 - protein, 34 aa, Mycobacterium tuberculosis
RFVWLRGRRATSHWLTLPALKAFGAIPVADERIV

SEQ ID NO: 1489912 - protein, 18 aa, Mycobacterium tuberculosis
RFWMGGPHIAVRKAPEVA

SEQ ID NO: 1489913 - protein, 17 aa, Mycobacterium tuberculosis
RGAAFSWYTYSPTRVRH

SEQ ID NO: 1489914 - protein, 18 aa, Mycobacterium tuberculosis
RGAAGVGRRLRNRSAVRR

SEQ ID NO: 1489915 - protein, 25 aa, Mycobacterium tuberculosis
RGAAWGAGVGLAIGLFSPALLASAA

SEQ ID NO: 1489916 - protein, 18 aa, Mycobacterium tuberculosis
RGADGRVIVACFASNVDR

SEQ ID NO: 1489917 - protein, 19 aa, Mycobacterium tuberculosis
RGAFHGRSGYTLSLTNTKP

SEQ ID NO: 1489918 - protein, 25 aa, Mycobacterium tuberculosis
RGAGCAPWNVGWPVRLPWLRRDSPA

SEQ ID NO: 1489919 - protein, 21 aa, Mycobacterium tuberculosis
RGAGGAGGFGGFGGDGGDGGI

SEQ ID NO: 1489920 - protein, 18 aa, Mycobacterium tuberculosis
RGAGTGRAVCHPGTHHQA

SEQ ID NO: 1489921 - protein, 18 aa, Mycobacterium tuberculosis
RGAQALPPGGVLPVGQST

SEQ ID NO: 1489922 - protein, 18 aa, Mycobacterium tuberculosis
RGAQRYVGRWSMISEYIG

SEQ ID NO: 1489923 - protein, 19 aa, Mycobacterium tuberculosis
RGARKRPTSGWGALTPTEL

SEQ ID NO: 1489924 - protein, 23 aa, Mycobacterium tuberculosis
RGARKRPTSGWGALTPTELEVAL

SEQ ID NO: 1489925 - protein, 17 aa, Mycobacterium tuberculosis
RGASFSWYSYSPTRVRY

SEQ ID NO: 1489926 - protein, 20 aa, Mycobacterium tuberculosis
RGATALRGIWGFYGDHKPHG

SEQ ID NO: 1489927 - protein, 18 aa, Mycobacterium tuberculosis
RGAWPRSGGASGRDAGGR

SEQ ID NO: 1489928 - protein, 30 aa, Mycobacterium tuberculosis
RGAWTSEPCCSAWTGWTWTGSRTSTITPPH

SEQ ID NO: 1489929 - protein, 21 aa, Mycobacterium tuberculosis
RGCQLLRLGGRWLSVVCCRNG

SEQ ID NO: 1489930 - protein, 18 aa, Mycobacterium tuberculosis
RGCRRHWSAPPSRPSTGC

SEQ ID NO: 1489931 - protein, 37 aa, Mycobacterium tuberculosis
RGCVARWHGAVGLGWPRCRRFYRPPHRQRRSTRRRCR

SEQ ID NO: 1489932 - protein, 20 aa, Mycobacterium tuberculosis
RGDFAWPDMRLAAEYESIEW

SEQ ID NO: 1489933 - protein, 26 aa, Mycobacterium tuberculosis
RGDFLRGGTQLALLVNALHQDEQQFV

SEQ ID NO: 1489934 - protein, 19 aa, Mycobacterium tuberculosis
RGDGGFGYDPVFVPYGDDR

SEQ ID NO: 1489935 - protein, 24 aa, Mycobacterium tuberculosis
RGDGGRGGLLAGNGVTGGAGGNGG

SEQ ID NO: 1489936 - protein, 18 aa, Mycobacterium tuberculosis
RGDGWVKLVGDWIDRQIG

SEQ ID NO: 1489937 - protein, 19 aa, Mycobacterium tuberculosis
RGDHCGLPPLAGRHADRDR

SEQ ID NO: 1489938 - protein, 19 aa, Mycobacterium tuberculosis
RGDKRALAETVHRNAEDAL

SEQ ID NO: 1489939 - protein, 18 aa, Mycobacterium tuberculosis
RGDLAAAIYTTIEDQVET

SEQ ID NO: 1489940 - protein, 19 aa, Mycobacterium tuberculosis
RGDLAELTQCFGPDVEQFV

SEQ ID NO: 1489941 - protein, 18 aa, Mycobacterium tuberculosis
RGEGAAVVVLKRLDDAVR

SEQ ID NO: 1489942 - protein, 18 aa, Mycobacterium tuberculosis
RGEGAGVVVLKRLTDAQR

SEQ ID NO: 1489943 - protein, 20 aa, Mycobacterium tuberculosis
RGEIKVALINLDPAAPIVVH

SEQ ID NO: 1489944 - protein, 26 aa, Mycobacterium tuberculosis
RGEPIRNRICRGLRTGDHHRFGRVDR

SEQ ID NO: 1489945 - protein, 18 aa, Mycobacterium tuberculosis
RGESLWAHAEGSISEDVI

SEQ ID NO: 1489946 - protein, 18 aa, Mycobacterium tuberculosis
RGFGCAKLEVPWSRDVRG

SEQ ID NO: 1489947 - protein, 25 aa, Mycobacterium tuberculosis
RGFGEKPSVCTLLLPSLATGVDDRR

SEQ ID NO: 1489948 - protein, 19 aa, Mycobacterium tuberculosis
RGGAAGAFGRPGGAPRRGR

SEQ ID NO: 1489949 - protein, 18 aa, Mycobacterium tuberculosis
RGGAGFATGTKWSFIPQG

SEQ ID NO: 1489950 - protein, 18 aa, Mycobacterium tuberculosis
RGGAVGTGGTGLRGTTGA

SEQ ID NO: 1489951 - protein, 20 aa, Mycobacterium tuberculosis
RGGGGRRRGVLHFAAGSTAV

SEQ ID NO: 1489952 - protein, 29 aa, Mycobacterium tuberculosis
RGGGRASVGLPGFLVGGVVRITRASGDEY

SEQ ID NO: 1489953 - protein, 20 aa, Mycobacterium tuberculosis
RGGIILCNDPAIAKKINCAV

SEQ ID NO: 1489954 - protein, 25 aa, Mycobacterium tuberculosis
RGGKISFTHLLGYALVQAVKKFPNM

SEQ ID NO: 1489955 - protein, 19 aa, Mycobacterium tuberculosis
RGGLAFRALHPVRQLGGRR

SEQ ID NO: 1489956 - protein, 20 aa, Mycobacterium tuberculosis
RGGLLAGQHANSGNGGGGGT

SEQ ID NO: 1489957 - protein, 27 aa, Mycobacterium tuberculosis
RGGLLVGDGGAAWHRGHRGRRRHRRPG

SEQ ID NO: 1489958 - protein, 18 aa, Mycobacterium tuberculosis
RGGLPPESGFTYLDDVPA

SEQ ID NO: 1489959 - protein, 24 aa, Mycobacterium tuberculosis
RGGLRARVLRRWSVPPVRPPVTVV

SEQ ID NO: 1489960 - protein, 20 aa, Mycobacterium tuberculosis
RGGLSHSISVASLVDRWRAV

SEQ ID NO: 1489961 - protein, 24 aa, Mycobacterium tuberculosis
RGGNGGHGGLWIGNGGDGGAGVSA

SEQ ID NO: 1489962 - protein, 17 aa, Mycobacterium tuberculosis
RGGPDYLMFLYKTKGPV

SEQ ID NO: 1489963 - protein, 22 aa, Mycobacterium tuberculosis
RGGPGRRCRVGLGRAVFTHVSG

SEQ ID NO: 1489964 - protein, 35 aa, Mycobacterium tuberculosis
RGGPGRRDRAVMPVGRCQMSFVIAAPEVIAAAATD

SEQ ID NO: 1489965 - protein, 17 aa, Mycobacterium tuberculosis
RGGPTGWQVTRTASGSS

SEQ ID NO: 1489966 - protein, 25 aa, Mycobacterium tuberculosis
RGGRRANVPITRRGGLSFDLRRINP

SEQ ID NO: 1489967 - protein, 19 aa, Mycobacterium tuberculosis
RGGRVRGQRGWIVEKPGEP

SEQ ID NO: 1489968 - protein, 21 aa, Mycobacterium tuberculosis
RGGRVRGQRGWIVEKPGEPGD

SEQ ID NO: 1489969 - protein, 23 aa, Mycobacterium tuberculosis
RGGSCPVPVAGILGCTTGFCHGP

SEQ ID NO: 1489970 - protein, 17 aa, Mycobacterium tuberculosis
RGGSFVRISFAGPSGDI

SEQ ID NO: 1489971 - protein, 24 aa, Mycobacterium tuberculosis
RGGSGRAVLCFFFCDLRAPTARLW

SEQ ID NO: 1489972 - protein, 25 aa, Mycobacterium tuberculosis
RGHIPRNLHFTRWNPAIDASATRLF

SEQ ID NO: 1489973 - protein, 28 aa, Mycobacterium tuberculosis
RGHPGPCQRCRGRARRLLCPGRRFRACD

SEQ ID NO: 1489974 - protein, 23 aa, Mycobacterium tuberculosis
RGHPMWECYIIDGIERGRIAILL

SEQ ID NO: 1489975 - protein, 18 aa, Mycobacterium tuberculosis
RGIFGQFGAGGAGGAGGV

SEQ ID NO: 1489976 - protein, 23 aa, Mycobacterium tuberculosis
RGIIVRGRIVGVSPRKAGVYKDV

SEQ ID NO: 1489977 - protein, 17 aa, Mycobacterium tuberculosis
RGIMFADVPWRGNRINR

SEQ ID NO: 1489978 - protein, 25 aa, Mycobacterium tuberculosis
RGIQHDCKGFRGCCLANTGLTLQQQ

SEQ ID NO: 1489979 - protein, 17 aa, Mycobacterium tuberculosis
RGIVAARELLPFADGRA

SEQ ID NO: 1489980 - protein, 28 aa, Mycobacterium tuberculosis
RGKAARRFLPGATILKASVGPMNNNAYL

SEQ ID NO: 1489981 - protein, 19 aa, Mycobacterium tuberculosis
RGKLTPRERIELLVDPDSP

SEQ ID NO: 1489982 - protein, 19 aa, Mycobacterium tuberculosis
RGLAKATLFGPAEVAERYG

SEQ ID NO: 1489983 - protein, 17 aa, Mycobacterium tuberculosis
RGLARVDFFLTDDGPVI

SEQ ID NO: 1489984 - protein, 25 aa, Mycobacterium tuberculosis
RGLGGEDEIAIAIGVAGQDHGVTAR

SEQ ID NO: 1489985 - protein, 30 aa, Mycobacterium tuberculosis
RGLLNRLSAFKVPHRFAVVDRLPRTPNGKL

SEQ ID NO: 1489986 - protein, 17 aa, Mycobacterium tuberculosis
RGLLTELHRAGAALDYS

SEQ ID NO: 1489987 - protein, 19 aa, Mycobacterium tuberculosis
RGLMMPRRRRTRAAELAHR

SEQ ID NO: 1489988 - protein, 21 aa, Mycobacterium tuberculosis
RGLMQLLAATNWFGQNAPALM

SEQ ID NO: 1489989 - protein, 24 aa, Mycobacterium tuberculosis
RGLPGGASWPGLVGCGAAAGAAAA

SEQ ID NO: 1489990 - protein, 26 aa, Mycobacterium tuberculosis
RGLQALWRRGAEVFADVTLPEGVPIR

SEQ ID NO: 1489991 - protein, 17 aa, Mycobacterium tuberculosis
RGLRLSGFEVATAVDGA

SEQ ID NO: 1489992 - protein, 27 aa, Mycobacterium tuberculosis
RGLRMVGRGVLRPGLAVLVGDETVGVT

SEQ ID NO: 1489993 - protein, 18 aa, Mycobacterium tuberculosis
RGLTAWPGARPHRRDRAG

SEQ ID NO: 1489994 - protein, 17 aa, Mycobacterium tuberculosis
RGLTLGKQDVDGMSRLS

SEQ ID NO: 1489995 - protein, 21 aa, Mycobacterium tuberculosis
RGLVCVWRVVGGAVEAAGWFG

SEQ ID NO: 1489996 - protein, 25 aa, Mycobacterium tuberculosis
RGLVCVWRVVGGAVEAAGWFGVAMI

SEQ ID NO: 1489997 - protein, 18 aa, Mycobacterium tuberculosis
RGMPVLGICNGFQVLCEA

SEQ ID NO: 1489998 - protein, 23 aa, Mycobacterium tuberculosis
RGMSQIGVPYSWGGGNAAGPSKG

SEQ ID NO: 1489999 - protein, 19 aa, Mycobacterium tuberculosis
RGPAGPVLVEASRDAEMIC

SEQ ID NO: 1490000 - protein, 17 aa, Mycobacterium tuberculosis
RGPGGLSGTAATRRTRP

SEQ ID NO: 1490001 - protein, 18 aa, Mycobacterium tuberculosis
RGPGQMLGGLPVGQMGAR

SEQ ID NO: 1490002 - protein, 19 aa, Mycobacterium tuberculosis
RGPGQMLGGLPVGQMGARA

SEQ ID NO: 1490003 - protein, 34 aa, Mycobacterium tuberculosis
RGPIPARHRCGAGWRPGLGRLHRRAAHRHLDRRR

SEQ ID NO: 1490004 - protein, 25 aa, Mycobacterium tuberculosis
RGPLRYAGCSSCFRREAGSHGKDTR

SEQ ID NO: 1490005 - protein, 23 aa, Mycobacterium tuberculosis
RGPNAGSRFLLDQAITSAGRHPD

SEQ ID NO: 1490006 - protein, 20 aa, Mycobacterium tuberculosis
RGPRGCRRRSSIGSARRLGP

SEQ ID NO: 1490007 - protein, 19 aa, Mycobacterium tuberculosis
RGPRGGKCHRCARVDSGIQ

SEQ ID NO: 1490008 - protein, 19 aa, Mycobacterium tuberculosis
RGPRRQPAGVVQPRHTRAE

SEQ ID NO: 1490009 - protein, 20 aa, Mycobacterium tuberculosis
RGPVATVLVQRGTLRVGDSG

SEQ ID NO: 1490010 - protein, 26 aa, Mycobacterium tuberculosis
RGPVGNGRTNFNGHRREPGGTGGKGA

SEQ ID NO: 1490011 - protein, 21 aa, Mycobacterium tuberculosis
RGQLRRRGCEESCGVVVYAWV

SEQ ID NO: 1490012 - protein, 17 aa, Mycobacterium tuberculosis
RGQRLAGRLTRRQTRAR

SEQ ID NO: 1490013 - protein, 17 aa, Mycobacterium tuberculosis
RGQRLFRAPHLDPSGGN

SEQ ID NO: 1490014 - protein, 18 aa, Mycobacterium tuberculosis
RGREMLAFAQTYRSTDVA

SEQ ID NO: 1490015 - protein, 24 aa, Mycobacterium tuberculosis
RGRGDALRLARRIAAALNASDNNA

SEQ ID NO: 1490016 - protein, 25 aa, Mycobacterium tuberculosis
RGRGDALRLARRIAAALNASDNNAG

SEQ ID NO: 1490017 - protein, 17 aa, Mycobacterium tuberculosis
RGRILGVRRETEDSATL

SEQ ID NO: 1490018 - protein, 27 aa, Mycobacterium tuberculosis
RGRKRPRGWRIALCAQRVVRPKNPERG

SEQ ID NO: 1490019 - protein, 17 aa, Mycobacterium tuberculosis
RGRLKRAGIEVTDTADG

SEQ ID NO: 1490020 - protein, 17 aa, Mycobacterium tuberculosis
RGRPEWIAAGQFAQRYE

SEQ ID NO: 1490021 - protein, 17 aa, Mycobacterium tuberculosis
RGRQVVFWQSPKTRKQS

SEQ ID NO: 1490022 - protein, 20 aa, Mycobacterium tuberculosis
RGRRAALRRRRGPAAPGGRA

SEQ ID NO: 1490023 - protein, 18 aa, Mycobacterium tuberculosis
RGRRGRRAALRRRRGPAA

SEQ ID NO: 1490024 - protein, 27 aa, Mycobacterium tuberculosis
RGRRRRWRCPAATGAPGGNGGNGGSVE

SEQ ID NO: 1490025 - protein, 24 aa, Mycobacterium tuberculosis
RGRSAGWRPPAAATTWGRSSRGVS

SEQ ID NO: 1490026 - protein, 30 aa, Mycobacterium tuberculosis
RGRSDCRQCRHAGCRAGRYAAGAAIAAGAP

SEQ ID NO: 1490027 - protein, 19 aa, Mycobacterium tuberculosis
RGSAEAFPAVTSTTPMKPV

SEQ ID NO: 1490028 - protein, 25 aa, Mycobacterium tuberculosis
RGSAKRITAVMPFYPYARQDKKHRG

SEQ ID NO: 1490029 - protein, 28 aa, Mycobacterium tuberculosis
RGSCRRRAIAARHGCLARRAPLVRTKQG

SEQ ID NO: 1490030 - protein, 19 aa, Mycobacterium tuberculosis
RGSDGVVIPGSYRNRHKAV

SEQ ID NO: 1490031 - protein, 19 aa, Mycobacterium tuberculosis
RGSLPASARKNGPRLPERQ

SEQ ID NO: 1490032 - protein, 20 aa, Mycobacterium tuberculosis
RGSSRRAGMVAGHRRHIGGP

SEQ ID NO: 1490033 - protein, 17 aa, Mycobacterium tuberculosis
RGSTALIRFRILAKLLS

SEQ ID NO: 1490034 - protein, 18 aa, Mycobacterium tuberculosis
RGSTWARQLPWLTLLGAV

SEQ ID NO: 1490035 - protein, 19 aa, Mycobacterium tuberculosis
RGSWFPAMRETSAPRNRYS

SEQ ID NO: 1490036 - protein, 19 aa, Mycobacterium tuberculosis
RGTPVVAMPLLRGGNKEVH

SEQ ID NO: 1490037 - protein, 23 aa, Mycobacterium tuberculosis
RGTRLPVWLTQWGYRRPAEDTVD

SEQ ID NO: 1490038 - protein, 26 aa, Mycobacterium tuberculosis
RGTVAKWRLQATQSRVRDVQVNVDVA

SEQ ID NO: 1490039 - protein, 32 aa, Mycobacterium tuberculosis
RGVAFDNPRPHTGQAPRPWVASTRSPTAICCS

SEQ ID NO: 1490040 - protein, 17 aa, Mycobacterium tuberculosis
RGVEAAERLATRRRQLL

SEQ ID NO: 1490041 - protein, 27 aa, Mycobacterium tuberculosis
RGVGRGARLRGPVCAGEDARADQQEHA

SEQ ID NO: 1490042 - protein, 18 aa, Mycobacterium tuberculosis
RGVLSVRAKIKVRLTQLR

SEQ ID NO: 1490043 - protein, 19 aa, Mycobacterium tuberculosis
RGVLSVRAKIKVRLTQLRP

SEQ ID NO: 1490044 - protein, 23 aa, Mycobacterium tuberculosis
RGVRRLESGCFARIRADQLAPVI

SEQ ID NO: 1490045 - protein, 18 aa, Mycobacterium tuberculosis
RGVRRLRDVLPLVDGGAA

SEQ ID NO: 1490046 - protein, 22 aa, Mycobacterium tuberculosis
RGVTFSRGWLPFLPTSDPPAHT

SEQ ID NO: 1490047 - protein, 17 aa, Mycobacterium tuberculosis
RGVVINPVLETSEIPET

SEQ ID NO: 1490048 - protein, 19 aa, Mycobacterium tuberculosis
RGWAGAHLLAAHRRARALH

SEQ ID NO: 1490049 - protein, 24 aa, Mycobacterium tuberculosis
RGYAPGWRPVRRVLRSPAGPRRRH

SEQ ID NO: 1490050 - protein, 35 aa, Mycobacterium tuberculosis
RGYIPSLACGRCWAIARCRSCTGPLSLQGAGSPGA

SEQ ID NO: 1490051 - protein, 17 aa, Mycobacterium tuberculosis
RGYPPLRAVVGPRSSPT

SEQ ID NO: 1490052 - protein, 18 aa, Mycobacterium tuberculosis
RHAETRALLAARGGTSLG

SEQ ID NO: 1490053 - protein, 18 aa, Mycobacterium tuberculosis
RHARVGPMAHLLGAEAVH

SEQ ID NO: 1490054 - protein, 33 aa, Mycobacterium tuberculosis
RHAVAVDLRNDWPSALKNAGFDPARPTAFSAEG

SEQ ID NO: 1490055 - protein, 23 aa, Mycobacterium tuberculosis
RHCAHRHGFGGFGGLGGGSNGTG

SEQ ID NO: 1490056 - protein, 19 aa, Mycobacterium tuberculosis
RHCSLWLSLAQMWAGNLTE

SEQ ID NO: 1490057 - protein, 44 aa, Mycobacterium tuberculosis
RHDAGIRWRAWRFATIFTVRYGRCVSTCWPWGNPARVASKRSPS

SEQ ID NO: 1490058 - protein, 18 aa, Mycobacterium tuberculosis
RHFLDGSPVARCSYPEEY

SEQ ID NO: 1490059 - protein, 20 aa, Mycobacterium tuberculosis
RHGKELTWSQVLMAANTPML

SEQ ID NO: 1490060 - protein, 30 aa, Mycobacterium tuberculosis
RHGLAILTFWRCRMSFLIASPEALAATATY

SEQ ID NO: 1490061 - protein, 18 aa, Mycobacterium tuberculosis
RHGLSMIGFPAVYGGHST

SEQ ID NO: 1490062 - protein, 20 aa, Mycobacterium tuberculosis
RHHGGAHLRHERDLGRLCLR

SEQ ID NO: 1490063 - protein, 17 aa, Mycobacterium tuberculosis
RHHLLLPITATRRDLND

SEQ ID NO: 1490064 - protein, 19 aa, Mycobacterium tuberculosis
RHHRARASWNYLVTPGQHQ

SEQ ID NO: 1490065 - protein, 17 aa, Mycobacterium tuberculosis
RHIEAIDAYWVSAAEHG

SEQ ID NO: 1490066 - protein, 21 aa, Mycobacterium tuberculosis
RHINAVWGVGEWVESFVGYVA

SEQ ID NO: 1490067 - protein, 17 aa, Mycobacterium tuberculosis
RHLAVLDLGAHRALAQT

SEQ ID NO: 1490068 - protein, 22 aa, Mycobacterium tuberculosis
RHLSYKTGWYGSQLVVADRWFP

SEQ ID NO: 1490069 - protein, 18 aa, Mycobacterium tuberculosis
RHLVSRYGVRQVVLASRA

SEQ ID NO: 1490070 - protein, 17 aa, Mycobacterium tuberculosis
RHPEFHHSWSWPPSSPN

SEQ ID NO: 1490071 - protein, 17 aa, Mycobacterium tuberculosis
RHPRVSSALARAEVMRA

SEQ ID NO: 1490072 - protein, 17 aa, Mycobacterium tuberculosis
RHPTGAGVEEPRRRGRR

SEQ ID NO: 1490073 - protein, 18 aa, Mycobacterium tuberculosis
RHPWPAPARCCRHEWRTM

SEQ ID NO: 1490074 - protein, 18 aa, Mycobacterium tuberculosis
RHPYARGVLVEMYREAKA

SEQ ID NO: 1490075 - protein, 19 aa, Mycobacterium tuberculosis
RHQLVSLVLSNLFGQNAPA

SEQ ID NO: 1490076 - protein, 23 aa, Mycobacterium tuberculosis
RHQRLVAWLPVRDVVDAALHGGA

SEQ ID NO: 1490077 - protein, 25 aa, Mycobacterium tuberculosis
RHRDGPRPTLCVIRGFMGSSYLLNG

SEQ ID NO: 1490078 - protein, 18 aa, Mycobacterium tuberculosis
RHRGAGRHASWRGPCAST

SEQ ID NO: 1490079 - protein, 22 aa, Mycobacterium tuberculosis
RHRGTVCVRHRAAPAVRAGFVR

SEQ ID NO: 1490080 - protein, 18 aa, Mycobacterium tuberculosis
RHRPIRLNFAPKLALHKL

SEQ ID NO: 1490081 - protein, 38 aa, Mycobacterium tuberculosis
RHRRAAVAAPGFHPRTAAAMGRPRCRPGRPGGDRRRRR

SEQ ID NO: 1490082 - protein, 18 aa, Mycobacterium tuberculosis
RHRWNWTDVRRWLTDPTG

SEQ ID NO: 1490083 - protein, 19 aa, Mycobacterium tuberculosis
RHRWPAFLMDRRVVDTALE

SEQ ID NO: 1490084 - protein, 26 aa, Mycobacterium tuberculosis
RHSDRQRRGRREWGDRWDRSRQHHSG

SEQ ID NO: 1490085 - protein, 18 aa, Mycobacterium tuberculosis
RHSSGLSVQTFLRGIHVV

SEQ ID NO: 1490086 - protein, 23 aa, Mycobacterium tuberculosis
RHTGRPYYNAIVWQDTRTDRIAS

SEQ ID NO: 1490087 - protein, 24 aa, Mycobacterium tuberculosis
RHTPPHAWYIAFAPAQAPKVAVAV

SEQ ID NO: 1490088 - protein, 17 aa, Mycobacterium tuberculosis
RHVIITWCVQRHREGIG

SEQ ID NO: 1490089 - protein, 23 aa, Mycobacterium tuberculosis
RHWPTSRGFERFYGFLGGETDQW

SEQ ID NO: 1490090 - protein, 17 aa, Mycobacterium tuberculosis
RHWRRALVGAVWVGCLG

SEQ ID NO: 1490091 - protein, 26 aa, Mycobacterium tuberculosis
RHWRRGWRRWADWPTRGRRRPRCRRL

SEQ ID NO: 1490092 - protein, 17 aa, Mycobacterium tuberculosis
RHYERTRSPAALEAVAR

SEQ ID NO: 1490093 - protein, 17 aa, Mycobacterium tuberculosis
RHYPRSYVEGAARVGIG

SEQ ID NO: 1490094 - protein, 17 aa, Mycobacterium tuberculosis
RIAAGIVRRRAKTPFTS

SEQ ID NO: 1490095 - protein, 20 aa, Mycobacterium tuberculosis
RIAGRPAAVLLHLGPGLGNG

SEQ ID NO: 1490096 - protein, 18 aa, Mycobacterium tuberculosis
RIAPPVCGTRSCAQPDRG

SEQ ID NO: 1490097 - protein, 20 aa, Mycobacterium tuberculosis
RIAQAIALPAVRKTGVLENE

SEQ ID NO: 1490098 - protein, 20 aa, Mycobacterium tuberculosis
RIAVTSARRAEELCALLRRQ

SEQ ID NO: 1490099 - protein, 20 aa, Mycobacterium tuberculosis
RIDDFAEWLQRFEASLGALP

SEQ ID NO: 1490100 - protein, 23 aa, Mycobacterium tuberculosis
  misc_feature (21)..(21): Xaa can be any naturally occurring amino acid
RIDHIIGLFRLWWIPDGAPPXQG

SEQ ID NO: 1490101 - protein, 19 aa, Mycobacterium tuberculosis
RIDLLELIKMGGHADPGSG

SEQ ID NO: 1490102 - protein, 18 aa, Mycobacterium tuberculosis
RIDVTVRISGFFRDAFPH

SEQ ID NO: 1490103 - protein, 23 aa, Mycobacterium tuberculosis
RIEAHALGMVFGRKRPGSGPLMI

SEQ ID NO: 1490104 - protein, 26 aa, Mycobacterium tuberculosis
RIEMPGFGGSLCRRKGLDHRRRDFSD

SEQ ID NO: 1490105 - protein, 20 aa, Mycobacterium tuberculosis
RIERGLWLTALLQATLSTVR

SEQ ID NO: 1490106 - protein, 19 aa, Mycobacterium tuberculosis
RIGDGGGRRRLPARAGCHR

SEQ ID NO: 1490107 - protein, 20 aa, Mycobacterium tuberculosis
RIGGAAGLGRWTAEEHLHAI

SEQ ID NO: 1490108 - protein, 19 aa, Mycobacterium tuberculosis
RIGHLAARLATLGPAATLA

SEQ ID NO: 1490109 - protein, 20 aa, Mycobacterium tuberculosis
RIGLGALGLQLGQVGLQLLR

SEQ ID NO: 1490110 - protein, 18 aa, Mycobacterium tuberculosis
RIGPACRPGVDAGGAVSV

SEQ ID NO: 1490111 - protein, 17 aa, Mycobacterium tuberculosis
RIGVPALADPGTGELVG

SEQ ID NO: 1490112 - protein, 20 aa, Mycobacterium tuberculosis
RIGWERSIRVLSARVAELRP

SEQ ID NO: 1490113 - protein, 19 aa, Mycobacterium tuberculosis
RIHRAMALPGGIEGALGVL

SEQ ID NO: 1490114 - protein, 21 aa, Mycobacterium tuberculosis
RILGVKGRVLPMCPVALQIEA

SEQ ID NO: 1490115 - protein, 19 aa, Mycobacterium tuberculosis
RILRRLGYAAYGWGLGRNI

SEQ ID NO: 1490116 - protein, 17 aa, Mycobacterium tuberculosis
RIMREARDLVLNLVNFD

SEQ ID NO: 1490117 - protein, 17 aa, Mycobacterium tuberculosis
RINPMIIEGQVHGGIFA

SEQ ID NO: 1490118 - protein, 19 aa, Mycobacterium tuberculosis
RINQSFPVTVNWSTPAVTI

SEQ ID NO: 1490119 - protein, 22 aa, Mycobacterium tuberculosis
RIPNQRGGIVLGTGDLSEKALG

SEQ ID NO: 1490120 - protein, 19 aa, Mycobacterium tuberculosis
RIPSLPDLDGIRVLRSFDE

SEQ ID NO: 1490121 - protein, 20 aa, Mycobacterium tuberculosis
RIPVHMVEVINKLGRIQREL

SEQ ID NO: 1490122 - protein, 19 aa, Mycobacterium tuberculosis
RIRDIVGMGHVQRIEPTTI

SEQ ID NO: 1490123 - protein, 21 aa, Mycobacterium tuberculosis
RIREELKFSGDRAMAAEDPEA

SEQ ID NO: 1490124 - protein, 17 aa, Mycobacterium tuberculosis
RIRELIREGARIALNPS

SEQ ID NO: 1490125 - protein, 27 aa, Mycobacterium tuberculosis
RIRRVGDAGCGVRCPGRTGGGRRAERY

SEQ ID NO: 1490126 - protein, 19 aa, Mycobacterium tuberculosis
RIRSAGAIFVGPWSPVSLG

SEQ ID NO: 1490127 - protein, 23 aa, Mycobacterium tuberculosis
RISIPSCRPGWYGPITASTECWD

SEQ ID NO: 1490128 - protein, 18 aa, Mycobacterium tuberculosis
RITARPPSGFGISARAVT

SEQ ID NO: 1490129 - protein, 20 aa, Mycobacterium tuberculosis
RITAVMPFYPYARQDKKHRG

SEQ ID NO: 1490130 - protein, 19 aa, Mycobacterium tuberculosis
RITDPGIITPRIEHPPVPG

SEQ ID NO: 1490131 - protein, 18 aa, Mycobacterium tuberculosis
RITDPGVIAPRIEHPPVP

SEQ ID NO: 1490132 - protein, 17 aa, Mycobacterium tuberculosis
RIVALKLMSETLSSDPV

SEQ ID NO: 1490133 - protein, 21 aa, Mycobacterium tuberculosis
RIVLPEMLYERVVEVDERVTA

SEQ ID NO: 1490134 - protein, 19 aa, Mycobacterium tuberculosis
RIVSFEAFDAFKKERYLTF

SEQ ID NO: 1490135 - protein, 19 aa, Mycobacterium tuberculosis
RIVSIGAFEHFGHERYDAF

SEQ ID NO: 1490136 - protein, 23 aa, Mycobacterium tuberculosis
RIVSLRLVTAGGEVLRLSEGDDY

SEQ ID NO: 1490137 - protein, 24 aa, Mycobacterium tuberculosis
RIVSPRTGSLLDHAQRVAESRLLD

SEQ ID NO: 1490138 - protein, 24 aa, Mycobacterium tuberculosis
RKAGFDGVELVKALLFSVFEGGLR

SEQ ID NO: 1490139 - protein, 23 aa, Mycobacterium tuberculosis
RKANLYRAALMLSLKDAISRDKR

SEQ ID NO: 1490140 - protein, 18 aa, Mycobacterium tuberculosis
RKARRVIDLVRGRSVSDA

SEQ ID NO: 1490141 - protein, 19 aa, Mycobacterium tuberculosis
RKASLPFTARRTLFNNTAK

SEQ ID NO: 1490142 - protein, 17 aa, Mycobacterium tuberculosis
RKAVTKMTFGRVNPEPS

SEQ ID NO: 1490143 - protein, 18 aa, Mycobacterium tuberculosis
RKAYNWTVATLKADIDAW

SEQ ID NO: 1490144 - protein, 18 aa, Mycobacterium tuberculosis
RKAYNWTVATLKADIQAW

SEQ ID NO: 1490145 - protein, 20 aa, Mycobacterium tuberculosis
RKFDCEAWIPTQGAYRELTS

SEQ ID NO: 1490146 - protein, 17 aa, Mycobacterium tuberculosis
RKFGGGALSVYIDDRQV

SEQ ID NO: 1490147 - protein, 21 aa, Mycobacterium tuberculosis
RKGALRGLRLSYFGDGANNMA

SEQ ID NO: 1490148 - protein, 20 aa, Mycobacterium tuberculosis
RKGALRGLRLSYFGDGAQQH

SEQ ID NO: 1490149 - protein, 20 aa, Mycobacterium tuberculosis
RKGAVAGRCVIRGKIVETEE

SEQ ID NO: 1490150 - protein, 17 aa, Mycobacterium tuberculosis
RKGKIVVEFGSVGVCTT

SEQ ID NO: 1490151 - protein, 23 aa, Mycobacterium tuberculosis
RKGTMKSQPWILAYEDHNVDAGL

SEQ ID NO: 1490152 - protein, 24 aa, Mycobacterium tuberculosis
RKGTMKSQPWILAYEDHNVDAGLA

SEQ ID NO: 1490153 - protein, 19 aa, Mycobacterium tuberculosis
RKHHLLKTFWTGWRDVQLP

SEQ ID NO: 1490154 - protein, 20 aa, Mycobacterium tuberculosis
RKHHLLKTFWTGWRDVQLPD

SEQ ID NO: 1490155 - protein, 18 aa, Mycobacterium tuberculosis
RKHPHSMGEWSMASRTHV

SEQ ID NO: 1490156 - protein, 17 aa, Mycobacterium tuberculosis
RKIIGRQFIRAFEGAVR

SEQ ID NO: 1490157 - protein, 20 aa, Mycobacterium tuberculosis
RKILTCQTFVTSDCRIELQY

SEQ ID NO: 1490158 - protein, 17 aa, Mycobacterium tuberculosis
RKISVPSTWAVETSAPP

SEQ ID NO: 1490159 - protein, 21 aa, Mycobacterium tuberculosis
RKLGRRWHRETVYGVAVRGYL

SEQ ID NO: 1490160 - protein, 21 aa, Mycobacterium tuberculosis
RKLHHPFPFPARHQSPPTPPT

SEQ ID NO: 1490161 - protein, 29 aa, Mycobacterium tuberculosis
RKLREAGALWERLTRAVGMDARDAVWQHP

SEQ ID NO: 1490162 - protein, 20 aa, Mycobacterium tuberculosis
RKNKGAVAYASWRKRCSNTG

SEQ ID NO: 1490163 - protein, 19 aa, Mycobacterium tuberculosis
RKPAPSWRHTACPVNELSK

SEQ ID NO: 1490164 - protein, 18 aa, Mycobacterium tuberculosis
RKPDGTELSGFYQVVVRP

SEQ ID NO: 1490165 - protein, 27 aa, Mycobacterium tuberculosis
RKPRLWKPRQRKLWQWEPGQWKHRKYQ

SEQ ID NO: 1490166 - protein, 21 aa, Mycobacterium tuberculosis
RKPTVPLGFPGPGCFTTTGRA

SEQ ID NO: 1490167 - protein, 20 aa, Mycobacterium tuberculosis
RKPVCYRMHPDNVPALTALR

SEQ ID NO: 1490168 - protein, 25 aa, Mycobacterium tuberculosis
RKQLTWSTERPSLWHFRDRGGAEVD

SEQ ID NO: 1490169 - protein, 28 aa, Mycobacterium tuberculosis
RKRGWWASWRWGLSQVVRPKTPRGDGNL

SEQ ID NO: 1490170 - protein, 17 aa, Mycobacterium tuberculosis
RKRLAGKGVDAHRIEIP

SEQ ID NO: 1490171 - protein, 19 aa, Mycobacterium tuberculosis
RKRPARGWGSLTPTERDVV

SEQ ID NO: 1490172 - protein, 20 aa, Mycobacterium tuberculosis
RKRPARGWGSLTPTERDVVR

SEQ ID NO: 1490173 - protein, 20 aa, Mycobacterium tuberculosis
RKRPGSGPLMIGSIKPNIGH

SEQ ID NO: 1490174 - protein, 22 aa, Mycobacterium tuberculosis
RKRWQCQSGQRKPRLWKPRQRK

SEQ ID NO: 1490175 - protein, 18 aa, Mycobacterium tuberculosis
RKSVRRGATDEVRGVIMT

SEQ ID NO: 1490176 - protein, 19 aa, Mycobacterium tuberculosis
RKTFASGRTRSVEWRKQQL

SEQ ID NO: 1490177 - protein, 26 aa, Mycobacterium tuberculosis
RKVLDLTIRLAEVMLSSGSGTADVVA

SEQ ID NO: 1490178 - protein, 24 aa, Mycobacterium tuberculosis
RKVVVFRPLYAVGGQELGYLPGSE

SEQ ID NO: 1490179 - protein, 18 aa, Mycobacterium tuberculosis
RLAAAGLTCLGWPEEHGG

SEQ ID NO: 1490180 - protein, 23 aa, Mycobacterium tuberculosis
RLAAAKTRLAPVFSAQTRENVVL

SEQ ID NO: 1490181 - protein, 26 aa, Mycobacterium tuberculosis
RLAAALPDYPFAYLITVDDGHRVHMV

SEQ ID NO: 1490182 - protein, 17 aa, Mycobacterium tuberculosis
RLAADPRLPLGRDALEA

SEQ ID NO: 1490183 - protein, 17 aa, Mycobacterium tuberculosis
RLAARGFAAYGTAKAAL

SEQ ID NO: 1490184 - protein, 17 aa, Mycobacterium tuberculosis
RLAARVCGYEITPALRG

SEQ ID NO: 1490185 - protein, 18 aa, Mycobacterium tuberculosis
RLAARVCGYEITPGPQGA

SEQ ID NO: 1490186 - protein, 17 aa, Mycobacterium tuberculosis
RLADILTRYAADTRDAS

SEQ ID NO: 1490187 - protein, 18 aa, Mycobacterium tuberculosis
RLADRGMRLTLRVYAYSS

SEQ ID NO: 1490188 - protein, 17 aa, Mycobacterium tuberculosis
RLAEAFGPDFAGFPQHI

SEQ ID NO: 1490189 - protein, 22 aa, Mycobacterium tuberculosis
RLAEIKSAPAFFDAENMAVTQY

SEQ ID NO: 1490190 - protein, 22 aa, Mycobacterium tuberculosis
RLAERRPAAALCEIVSPDNPVQ

SEQ ID NO: 1490191 - protein, 20 aa, Mycobacterium tuberculosis
RLAESHGFRTFYVPEHTHIP

SEQ ID NO: 1490192 - protein, 18 aa, Mycobacterium tuberculosis
RLAGCPLAGTPDVGLTAQ

SEQ ID NO: 1490193 - protein, 18 aa, Mycobacterium tuberculosis
RLAGLVAHQEVLFGTEGE

SEQ ID NO: 1490194 - protein, 20 aa, Mycobacterium tuberculosis
RLAGPAGPAGCCSAPAAPVG

SEQ ID NO: 1490195 - protein, 19 aa, Mycobacterium tuberculosis
RLAGRVVACHGGLGGAGPD

SEQ ID NO: 1490196 - protein, 27 aa, Mycobacterium tuberculosis
RLAHCGSILRPRLSWNAQVIRRRTAVS

SEQ ID NO: 1490197 - protein, 17 aa, Mycobacterium tuberculosis
RLAHRPKGIWAPECAYV

SEQ ID NO: 1490198 - protein, 17 aa, Mycobacterium tuberculosis
RLAIRTDTILGRKVLEI

SEQ ID NO: 1490199 - protein, 21 aa, Mycobacterium tuberculosis
RLAKCGPWHRGGWDPIPEGLT

SEQ ID NO: 1490200 - protein, 25 aa, Mycobacterium tuberculosis
RLAPDAKPYQGGHRFHQVEVVPASV

SEQ ID NO: 1490201 - protein, 17 aa, Mycobacterium tuberculosis
RLAPGAHRWWQAGHRSS

SEQ ID NO: 1490202 - protein, 17 aa, Mycobacterium tuberculosis
RLAQLFGELLGRDRVGA

SEQ ID NO: 1490203 - protein, 19 aa, Mycobacterium tuberculosis
RLAQLRPGDPILGEEGGGP

SEQ ID NO: 1490204 - protein, 21 aa, Mycobacterium tuberculosis
RLARECPVEADLVIGVPGIRH

SEQ ID NO: 1490205 - protein, 25 aa, Mycobacterium tuberculosis
RLARTELDGLIVLPDRTRAGIERGI

SEQ ID NO: 1490206 - protein, 32 aa, Mycobacterium tuberculosis
RLASLDKFSTAWDCRARARAARALHGEPVRCQ

SEQ ID NO: 1490207 - protein, 21 aa, Mycobacterium tuberculosis
RLATAPVITEWCELPTGSSPR

SEQ ID NO: 1490208 - protein, 20 aa, Mycobacterium tuberculosis
RLCDPMAQQISTVWASSLPE

SEQ ID NO: 1490209 - protein, 18 aa, Mycobacterium tuberculosis
RLCTACFDGKYPIELPRE

SEQ ID NO: 1490210 - protein, 17 aa, Mycobacterium tuberculosis
RLCVGGVERVFELGRAF

SEQ ID NO: 1490211 - protein, 19 aa, Mycobacterium tuberculosis
RLDFLAGLRVVPAELGGAA

SEQ ID NO: 1490212 - protein, 19 aa, Mycobacterium tuberculosis
RLDGLEVCRQLRGTGDDLP

SEQ ID NO: 1490213 - protein, 18 aa, Mycobacterium tuberculosis
RLDGMPLAIELAAARLRS

SEQ ID NO: 1490214 - protein, 19 aa, Mycobacterium tuberculosis
RLDKARFRSHPDLEVLTHG

SEQ ID NO: 1490215 - protein, 22 aa, Mycobacterium tuberculosis
RLDMVVGGAVLKHSRDFNLMRE

SEQ ID NO: 1490216 - protein, 21 aa, Mycobacterium tuberculosis
RLDPQLKSYAFVMPETALAAA

SEQ ID NO: 1490217 - protein, 31 aa, Mycobacterium tuberculosis
RLDRLAGELSVWSRAAVQIAFALRAGANRYA

SEQ ID NO: 1490218 - protein, 21 aa, Mycobacterium tuberculosis
RLDRPGWFYPPTVITDISKDM

SEQ ID NO: 1490219 - protein, 20 aa, Mycobacterium tuberculosis
RLEAEGHRILKLNIGNPAPF

SEQ ID NO: 1490220 - protein, 17 aa, Mycobacterium tuberculosis
RLEEVWVPSEPDPIIMP

SEQ ID NO: 1490221 - protein, 20 aa, Mycobacterium tuberculosis
RLETSCYNPSFGGMDRQSRV

SEQ ID NO: 1490222 - protein, 31 aa, Mycobacterium tuberculosis; identical to SEQ ID NO: 234150

SEQ ID NO: 1490223 - protein, 18 aa, Mycobacterium tuberculosis
RLGAERLIGLSVAGKQRR

SEQ ID NO: 1490224 - protein, 17 aa, Mycobacterium tuberculosis
RLGDRRSARRCRPVQRI

SEQ ID NO: 1490225 - protein, 19 aa, Mycobacterium tuberculosis
RLGDTFRWKGENVATTQVE

SEQ ID NO: 1490226 - protein, 23 aa, Mycobacterium tuberculosis
RLGDVRLAERLARAAPGLGRTAL

SEQ ID NO: 1490227 - protein, 23 aa, Mycobacterium tuberculosis
RLGEMCGLAGIAMERATQALLQA

SEQ ID NO: 1490228 - protein, 24 aa, Mycobacterium tuberculosis
RLGFARLAIQHGYPIVPFASVGAE

SEQ ID NO: 1490229 - protein, 17 aa, Mycobacterium tuberculosis
RLGFTSRAPRWAIAYKY

SEQ ID NO: 1490230 - protein, 18 aa, Mycobacterium tuberculosis
RLGGTWKKPGTSDIEIVC

SEQ ID NO: 1490231 - protein, 19 aa, Mycobacterium tuberculosis
RLGGWYFPHTSGGSGPAVL

SEQ ID NO: 1490232 - protein, 22 aa, Mycobacterium tuberculosis
RLGITTDWKSRWYADKQYAEYV

SEQ ID NO: 1490233 - protein, 19 aa, Mycobacterium tuberculosis
RLGLDRILTGVAMSEDSQA

SEQ ID NO: 1490234 - protein, 17 aa, Mycobacterium tuberculosis
RLGLKRLLRSDILPISF

SEQ ID NO: 1490235 - protein, 17 aa, Mycobacterium tuberculosis
RLGRRPRTRAGAGGSGP

SEQ ID NO: 1490236 - protein, 19 aa, Mycobacterium tuberculosis
RLGRRVTEIALVFRRAPHL

SEQ ID NO: 1490237 - protein, 17 aa, Mycobacterium tuberculosis
RLGVIPACAPAEKAGRV

SEQ ID NO: 1490238 - protein, 17 aa, Mycobacterium tuberculosis
RLHGCGLEIEWVGTGKR

SEQ ID NO: 1490239 - protein, 18 aa, Mycobacterium tuberculosis
RLHGCGLEIEWVGTGKRV

SEQ ID NO: 1490240 - protein, 27 aa, Mycobacterium tuberculosis
RLHPNAIAALGIREWDAVSLTGSRTTA

SEQ ID NO: 1490241 - protein, 28 aa, Mycobacterium tuberculosis
RLHPNAIAALGIREWDAVSLTGSRTTAA

SEQ ID NO: 1490242 - protein, 17 aa, Mycobacterium tuberculosis
RLICVMPENTSVERRQL

SEQ ID NO: 1490243 - protein, 20 aa, Mycobacterium tuberculosis
RLIDRAGRWLLNYRPQPLAV

SEQ ID NO: 1490244 - protein, 18 aa, Mycobacterium tuberculosis
RLIPKHSIGMALDDCHDG

SEQ ID NO: 1490245 - protein, 18 aa, Mycobacterium tuberculosis
RLIVELLYATGIRVSELC

SEQ ID NO: 1490246 - protein, 20 aa, Mycobacterium tuberculosis
RLKTQAGRALYALRKHTVEP

SEQ ID NO: 1490247 - protein, 19 aa, Mycobacterium tuberculosis
RLLAERLGVRQTIGLGTVP

SEQ ID NO: 1490248 - protein, 17 aa, Mycobacterium tuberculosis
RLLAGLLTGARIGTIAV

SEQ ID NO: 1490249 - protein, 19 aa, Mycobacterium tuberculosis
RLLETRFGVPVPNLTAWRR

SEQ ID NO: 1490250 - protein, 23 aa, Mycobacterium tuberculosis
RLLETWHPLGVVGVITAFNFPVA

SEQ ID NO: 1490251 - protein, 24 aa, Mycobacterium tuberculosis
RLLFKRNICHQAIFYRRGLFGTIG

SEQ ID NO: 1490252 - protein, 19 aa, Mycobacterium tuberculosis
RLLGELGLPPVITRMSELF

SEQ ID NO: 1490253 - protein, 17 aa, Mycobacterium tuberculosis
RLLPRPLADTTIHVAVA

SEQ ID NO: 1490254 - protein, 17 aa, Mycobacterium tuberculosis
RLLRQLGVEAARVRMLR

SEQ ID NO: 1490255 - protein, 19 aa, Mycobacterium tuberculosis
RLLVQLRRDAAVGGGLRSA

SEQ ID NO: 1490256 - protein, 23 aa, Mycobacterium tuberculosis
RLMEHLRALKATRGALLERMPTS

SEQ ID NO: 1490257 - protein, 20 aa, Mycobacterium tuberculosis
RLMLEVSWEALEHAGIDPLS

SEQ ID NO: 1490258 - protein, 17 aa, Mycobacterium tuberculosis
RLMLKLNGGPQAVADAA

SEQ ID NO: 1490259 - protein, 18 aa, Mycobacterium tuberculosis
RLMPTGRPPSGRFRRIAE

SEQ ID NO: 1490260 - protein, 17 aa, Mycobacterium tuberculosis
RLMRLDGGAGIWSPSAA

SEQ ID NO: 1490261 - protein, 19 aa, Mycobacterium tuberculosis
RLNRRYGQRARIIRGDGTQ

SEQ ID NO: 1490262 - protein, 18 aa, Mycobacterium tuberculosis
RLPDALADGDRILAVIRG

SEQ ID NO: 1490263 - protein, 19 aa, Mycobacterium tuberculosis
RLPDTCFGIIAADDVGYAI

SEQ ID NO: 1490264 - protein, 19 aa, Mycobacterium tuberculosis
RLPEELARVDALLDDPAFF

SEQ ID NO: 1490265 - protein, 22 aa, Mycobacterium tuberculosis
RLPEFDKPALIAWSSVCGGQSH

SEQ ID NO: 1490266 - protein, 22 aa, Mycobacterium tuberculosis
RLPQKVGIGLARRMSLTGDYLS

SEQ ID NO: 1490267 - protein, 22 aa, Mycobacterium tuberculosis
RLPQKVGIGLARRMSLTGYYLS

SEQ ID NO: 1490268 - protein, 26 aa, Mycobacterium tuberculosis
RLPRLTRMHRFWISLYFPLTMRSLCN

SEQ ID NO: 1490269 - protein, 17 aa, Mycobacterium tuberculosis
RLPRLTRMQRFWISLYF

SEQ ID NO: 1490270 - protein, 19 aa, Mycobacterium tuberculosis
RLPTVRDLAGQLGVAANTV

SEQ ID NO: 1490271 - protein, 22 aa, Mycobacterium tuberculosis
RLPTWNRRAPSPGSPPLPPPPP

SEQ ID NO: 1490272 - protein, 19 aa, Mycobacterium tuberculosis
RLQGQPPLGPVLMTADARA

SEQ ID NO: 1490273 - protein, 30 aa, Mycobacterium tuberculosis
RLQLQVSLPAKRWLAQRGFDPVYGARPFAP

SEQ ID NO: 1490274 - protein, 20 aa, Mycobacterium tuberculosis
RLQYFVSCLVYMPRDRYTTA

SEQ ID NO: 1490275 - protein, 18 aa, Mycobacterium tuberculosis
RLRAVVCAPACAVDDADR

SEQ ID NO: 1490276 - protein, 17 aa, Mycobacterium tuberculosis
RLRDWVWAAPAATAATA

SEQ ID NO: 1490277 - protein, 19 aa, Mycobacterium tuberculosis
RLRHAGGVAAAIARAGGPE

SEQ ID NO: 1490278 - protein, 19 aa, Mycobacterium tuberculosis
RLRHPRPSTGRRCPPARWS

SEQ ID NO: 1490279 - protein, 20 aa, Mycobacterium tuberculosis
RLRIMREARDLVLNLVNFDK

SEQ ID NO: 1490280 - protein, 22 aa, Mycobacterium tuberculosis
RLRIPAERWVYPQAGTDAHDTP

SEQ ID NO: 1490281 - protein, 20 aa, Mycobacterium tuberculosis
RLRIVKRDVAAAIFDSHGLS

SEQ ID NO: 1490282 - protein, 23 aa, Mycobacterium tuberculosis
RLRKEIFELYGYTAVVHVLSASG

SEQ ID NO: 1490283 - protein, 19 aa, Mycobacterium tuberculosis
RLRKIISRGFTPRAVGRLH

SEQ ID NO: 1490284 - protein, 21 aa, Mycobacterium tuberculosis
RLRMADLQARVDLLRYALHGI

SEQ ID NO: 1490285 - protein, 20 aa, Mycobacterium tuberculosis
RLRPPASWWCADPWRHVEST

SEQ ID NO: 1490286 - protein, 24 aa, Mycobacterium tuberculosis
RLRRGRRQRRQTGDAGTNASDSGA

SEQ ID NO: 1490287 - protein, 24 aa, Mycobacterium tuberculosis
RLRRRGPVHVVDWHNVAGLTPLAL

SEQ ID NO: 1490288 - protein, 20 aa, Mycobacterium tuberculosis
RLRRRQGHHVRCRHRTDGHR

SEQ ID NO: 1490289 - protein, 21 aa, Mycobacterium tuberculosis
RLRTAGIPFVDARTAAGTPSA

SEQ ID NO: 1490290 - protein, 19 aa, Mycobacterium tuberculosis
RLRVGPRQPGVQWHQARLR

SEQ ID NO: 1490291 - protein, 19 aa, Mycobacterium tuberculosis
RLRWAQRTVELPAGRYQTI

SEQ ID NO: 1490292 - protein, 18 aa, Mycobacterium tuberculosis
RLRWKGYLKPGSRDDASE

SEQ ID NO: 1490293 - protein, 21 aa, Mycobacterium tuberculosis
RLSALARNAAELALIPDTNHL

SEQ ID NO: 1490294 - protein, 23 aa, Mycobacterium tuberculosis
RLSDDELFFFAVLLLVAGYESTA

SEQ ID NO: 1490295 - protein, 24 aa, Mycobacterium tuberculosis
RLSDQEIIAFLFLMVIAGNETTTK

SEQ ID NO: 1490296 - protein, 24 aa, Mycobacterium tuberculosis
RLSDQEIMAFLFLMVIAGNETTTK

SEQ ID NO: 1490297 - protein, 17 aa, Mycobacterium tuberculosis
RLSEQRNADVLAEALKD

SEQ ID NO: 1490298 - protein, 19 aa, Mycobacterium tuberculosis
RLSGGGIFDAGRQCCGLLP

SEQ ID NO: 1490299 - protein, 17 aa, Mycobacterium tuberculosis
RLSIPFTTGLLVGIGET

SEQ ID NO: 1490300 - protein, 19 aa, Mycobacterium tuberculosis
RLSKQPGIHAVHVSNGDKP

SEQ ID NO: 1490301 - protein, 26 aa, Mycobacterium tuberculosis
RLSLSGECDWARELLAATGRRCGHNR

SEQ ID NO: 1490302 - protein, 21 aa, Mycobacterium tuberculosis
RLSLTDFPPNFNILHIDGNNA

SEQ ID NO: 1490303 - protein, 21 aa, Mycobacterium tuberculosis
RLSPSPAPPRRTPSSKARSTS

SEQ ID NO: 1490304 - protein, 17 aa, Mycobacterium tuberculosis
RLSRLAVVAAVGKYDAT

SEQ ID NO: 1490305 - protein, 41 aa, Mycobacterium tuberculosis
RLTCSPWLNAEWRLVSDHIRAIVALGGFAWQVALRLAGASG

SEQ ID NO: 1490306 - protein, 22 aa, Mycobacterium tuberculosis
RLTCVFVDHGLLRAGERAQVQR

SEQ ID NO: 1490307 - protein, 22 aa, Mycobacterium tuberculosis
RLTRMQRFWISLYFPLTMRSLC

SEQ ID NO: 1490308 - protein, 17 aa, Mycobacterium tuberculosis
RLTRTCASRAGAPPMTT

SEQ ID NO: 1490309 - protein, 20 aa, Mycobacterium tuberculosis
RLVARAMLQLPAQRTHRIRA

SEQ ID NO: 1490310 - protein, 19 aa, Mycobacterium tuberculosis
RLVGEIGERHGRLDMLVNN

SEQ ID NO: 1490311 - protein, 18 aa, Mycobacterium tuberculosis
RLVKAGKVDKDWDADATK

SEQ ID NO: 1490312 - protein, 19 aa, Mycobacterium tuberculosis
RLVKAGKVDKDWDADATKG

SEQ ID NO: 1490313 - protein, 19 aa, Mycobacterium tuberculosis
RLVSHDARTRYPVGRAVEL

SEQ ID NO: 1490314 - protein, 19 aa, Mycobacterium tuberculosis
RLVTLTVVPRCCAPGRRPA

SEQ ID NO: 1490315 - protein, 19 aa, Mycobacterium tuberculosis
RLVTMVPAGWSLVEAAAVP

SEQ ID NO: 1490316 - protein, 20 aa, Mycobacterium tuberculosis
RLVVAAMHWDGPKAQVIGLV

SEQ ID NO: 1490317 - protein, 17 aa, Mycobacterium tuberculosis
RLVVRGRIGTLLRYTQT

SEQ ID NO: 1490318 - protein, 17 aa, Mycobacterium tuberculosis
RLVWRLCKIDGKPSRYR

SEQ ID NO: 1490319 - protein, 41 aa, Mycobacterium tuberculosis
RLVYRKAACGTGWQLPRRRLRRRAAGCAAWSLLSRRRSHHL

SEQ ID NO: 1490320 - protein, 19 aa, Mycobacterium tuberculosis
RLYPVRLTTTMTRFISAAV

SEQ ID NO: 1490321 - protein, 19 aa, Mycobacterium tuberculosis
RMFFGAGSGPMLAAAAAWD

SEQ ID NO: 1490322 - protein, 23 aa, Mycobacterium tuberculosis
RMHLLRLASEFGLTPPPSSDWRW

SEQ ID NO: 1490323 - protein, 18 aa, Mycobacterium tuberculosis
RMITPVGVLDLGRVPASA

SEQ ID NO: 1490324 - protein, 19 aa, Mycobacterium tuberculosis
RMLLDEGRLQDGEPYLAGT

SEQ ID NO: 1490325 - protein, 23 aa, Mycobacterium tuberculosis
RMLPTDEPDDFVLATGRGFTVRE

SEQ ID NO: 1490326 - protein, 17 aa, Mycobacterium tuberculosis
RMLRSFDPRSGTHALDV

SEQ ID NO: 1490327 - protein, 17 aa, Mycobacterium tuberculosis
RMQGYEVLWQPGTDHAG

SEQ ID NO: 1490328 - protein, 18 aa, Mycobacterium tuberculosis
RMQRAGALTVAYVDAALE

SEQ ID NO: 1490329 - protein, 21 aa, Mycobacterium tuberculosis
RMRAGRRAAQDLCAKTRVFIL

SEQ ID NO: 1490330 - protein, 27 aa, Mycobacterium tuberculosis
RMRWPHGRMRYYIAMLAELSRLRPLPF

SEQ ID NO: 1490331 - protein, 17 aa, Mycobacterium tuberculosis
RMSKRAGTVLTLDDLVE

SEQ ID NO: 1490332 - protein, 24 aa, Mycobacterium tuberculosis
RMSSKRRLPGWKSGRRSSKGLNRH

SEQ ID NO: 1490333 - protein, 17 aa, Mycobacterium tuberculosis
RMVAEIRRSARFGVGSD

SEQ ID NO: 1490334 - protein, 18 aa, Mycobacterium tuberculosis
RMVEALGGVEVCSTTPLR

SEQ ID NO: 1490335 - protein, 18 aa, Mycobacterium tuberculosis
RMWLDAVGISEDLHRYLD

SEQ ID NO: 1490336 - protein, 18 aa, Mycobacterium tuberculosis
RMWRGYARGVLEKLSALL

SEQ ID NO: 1490337 - protein, 20 aa, Mycobacterium tuberculosis
RMYCGPGSGPMLAAAAAWDG

SEQ ID NO: 1490338 - protein, 19 aa, Mycobacterium tuberculosis
RNAFVQLVLSNLFGQNAPA

SEQ ID NO: 1490339 - protein, 24 aa, Mycobacterium tuberculosis
RNAPGCRGCCQCAIGCPSNAKFGV

SEQ ID NO: 1490340 - protein, 30 aa, Mycobacterium tuberculosis
RNEEDPRWRFGVPPANNANYAWIQHILYKL

SEQ ID NO: 1490341 - protein, 23 aa, Mycobacterium tuberculosis
RNEHKRHRYAFTPVRRRRAQVHR

SEQ ID NO: 1490342 - protein, 19 aa, Mycobacterium tuberculosis
RNGEGLGACRYAKSQGERP

SEQ ID NO: 1490343 - protein, 21 aa, Mycobacterium tuberculosis
RNGLMLPYVIELDGQFCGQLT

SEQ ID NO: 1490344 - protein, 17 aa, Mycobacterium tuberculosis
RNGWLSGLHATELLGAV

SEQ ID NO: 1490345 - protein, 20 aa, Mycobacterium tuberculosis
RNHGGYHFGRLVRRWRWTTA

SEQ ID NO: 1490346 - protein, 34 aa, Mycobacterium tuberculosis
RNILESFKLLTNVSRLFAQRCIAGLTANVEHLRR

SEQ ID NO: 1490347 - protein, 21 aa, Mycobacterium tuberculosis
RNIVDPLALTAGDLVVHDQHG

SEQ ID NO: 1490348 - protein, 24 aa, Mycobacterium tuberculosis
RNLRRPCFSRAEAPIGVYNGEQAI

SEQ ID NO: 1490349 - protein, 22 aa, Mycobacterium tuberculosis
RNPALTARPRRTIVKHERSCLM

SEQ ID NO: 1490350 - protein, 24 aa, Mycobacterium tuberculosis
RNPGNVFVAGFIGSPAMNLFRLSI

SEQ ID NO: 1490351 - protein, 26 aa, Mycobacterium tuberculosis
RNQNWRAMMLMLRWRAAPSCTSTRAC

SEQ ID NO: 1490352 - protein, 27 aa, Mycobacterium tuberculosis
RNRALGLLYRWVEHAFGGREHALTGAY

SEQ ID NO: 1490353 - protein, 19 aa, Mycobacterium tuberculosis
RNRPTWACPQRVVRPKTPR

SEQ ID NO: 1490354 - protein, 23 aa, Mycobacterium tuberculosis
RNRRGELELSVVMVIANHPDLAA

SEQ ID NO: 1490355 - protein, 26 aa, Mycobacterium tuberculosis
RNTGARLRRRAVTVATAATVASAAGP

SEQ ID NO: 1490356 - protein, 21 aa, Mycobacterium tuberculosis
RNVEIPDHFRIYVSQKLARLE

SEQ ID NO: 1490357 - protein, 20 aa, Mycobacterium tuberculosis
RNVHIRPGVPPLVIAAPVEL

SEQ ID NO: 1490358 - protein, 17 aa, Mycobacterium tuberculosis
RNVQFYCIDLGGGGLIY

SEQ ID NO: 1490359 - protein, 21 aa, Mycobacterium tuberculosis
RNVRYRYHCRQSRSTARGSRN

SEQ ID NO: 1490360 - protein, 24 aa, Mycobacterium tuberculosis
RNVWSNAVIFCGHFPDGAEKFTKT

SEQ ID NO: 1490361 - protein, 19 aa, Mycobacterium tuberculosis
RPAAGLRRAASRRVGLRTR

SEQ ID NO: 1490362 - protein, 20 aa, Mycobacterium tuberculosis
RPAAGPARRRRPLARAAGRG

SEQ ID NO: 1490363 - protein, 19 aa, Mycobacterium tuberculosis
RPAEFVVGSAIQVVDRVQW

SEQ ID NO: 1490364 - protein, 21 aa, Mycobacterium tuberculosis
RPAETVRGWLRRFAERVEAVR

SEQ ID NO: 1490365 - protein, 19 aa, Mycobacterium tuberculosis
RPAGCATAMASTRKPDRLR

SEQ ID NO: 1490366 - protein, 18 aa, Mycobacterium tuberculosis
RPAGRGGHRGRLTPGGSH

SEQ ID NO: 1490367 - protein, 17 aa, Mycobacterium tuberculosis
RPAGYIKPFSPFSPSSS

SEQ ID NO: 1490368 - protein, 19 aa, Mycobacterium tuberculosis
RPAHAEVCGLMAKASETER

SEQ ID NO: 1490369 - protein, 19 aa, Mycobacterium tuberculosis
RPAKTTAGPVWVFSGQRLA

SEQ ID NO: 1490370 - protein, 17 aa, Mycobacterium tuberculosis
RPALGQRALRFVTDPDS

SEQ ID NO: 1490371 - protein, 20 aa, Mycobacterium tuberculosis
RPALRDPLILPSMCTEWAPR

SEQ ID NO: 1490372 - protein, 22 aa, Mycobacterium tuberculosis
RPAPACRIDWEPADRAAHRDGV

SEQ ID NO: 1490373 - protein, 18 aa, Mycobacterium tuberculosis
RPAPAHEWHAMSVEQVRK

SEQ ID NO: 1490374 - protein, 21 aa, Mycobacterium tuberculosis
RPAQETWIALEIAYAAGSSTR

SEQ ID NO: 1490375 - protein, 24 aa, Mycobacterium tuberculosis
RPARRGAPADGRRRRARGTHGGAA

SEQ ID NO: 1490376 - protein, 22 aa, Mycobacterium tuberculosis
RPARTADPWLAPIFARSTLRHS

SEQ ID NO: 1490377 - protein, 18 aa, Mycobacterium tuberculosis
RPASWEQRALHVTSLRDP

SEQ ID NO: 1490378 - protein, 19 aa, Mycobacterium tuberculosis
RPATGCSIFARWGASGDRK

SEQ ID NO: 1490379 - protein, 17 aa, Mycobacterium tuberculosis
RPCPEVQAPLQAGQVRV

SEQ ID NO: 1490380 - protein, 19 aa, Mycobacterium tuberculosis
RPDAASGRRGKPQPSPVAR

SEQ ID NO: 1490381 - protein, 19 aa, Mycobacterium tuberculosis
RPDALVLDVMMPRLDGLEV

SEQ ID NO: 1490382 - protein, 19 aa, Mycobacterium tuberculosis
RPDDSPGPMPGRPVSASLV

SEQ ID NO: 1490383 - protein, 20 aa, Mycobacterium tuberculosis
RPDDTWLASWSRAEAAVPHP

SEQ ID NO: 1490384 - protein, 21 aa, Mycobacterium tuberculosis
RPDETVPCLTQRQVLDQAPDA

SEQ ID NO: 1490385 - protein, 19 aa, Mycobacterium tuberculosis
RPDIGPLFYEPTVLTNVAP

SEQ ID NO: 1490386 - protein, 17 aa, Mycobacterium tuberculosis
RPDLPPTPWLIPESAGL

SEQ ID NO: 1490387 - protein, 18 aa, Mycobacterium tuberculosis
RPDPPGPHLLVLARGPEG

SEQ ID NO: 1490388 - protein, 26 aa, Mycobacterium tuberculosis
RPDRLRPRPNHRPGLPPNTPDVRAGV

SEQ ID NO: 1490389 - protein, 30 aa, Mycobacterium tuberculosis
RPDRSTTLALRWLVGYSRQRREKTMIERLA

SEQ ID NO: 1490390 - protein, 19 aa, Mycobacterium tuberculosis
RPDVLTAWMDAAVIDENDP

SEQ ID NO: 1490391 - protein, 21 aa, Mycobacterium tuberculosis
RPDYSITGWVILTLIQHGTPW

SEQ ID NO: 1490392 - protein, 18 aa, Mycobacterium tuberculosis
RPEETRMTFGARLQSPLA

SEQ ID NO: 1490393 - protein, 22 aa, Mycobacterium tuberculosis
RPEHNVTVGLVFRARTSESELL

SEQ ID NO: 1490394 - protein, 19 aa, Mycobacterium tuberculosis
RPELFTLSAQRLLTMARAV

SEQ ID NO: 1490395 - protein, 19 aa, Mycobacterium tuberculosis
RPEMPALLADLGLSDRQLA

SEQ ID NO: 1490396 - protein, 30 aa, Mycobacterium tuberculosis
RPEMPRLEIPNGWCVQAFRFTLDPTAEQAH

SEQ ID NO: 1490397 - protein, 19 aa, Mycobacterium tuberculosis
RPFMCPPPSCKAVCTRRQT

SEQ ID NO: 1490398 - protein, 17 aa, Mycobacterium tuberculosis
RPFPLDLVPRVISAPEW

SEQ ID NO: 1490399 - protein, 20 aa, Mycobacterium tuberculosis
RPFRSSAYGRRECWICCSRW

SEQ ID NO: 1490400 - protein, 17 aa, Mycobacterium tuberculosis
RPFYELVSRVGLERARR

SEQ ID NO: 1490401 - protein, 18 aa, Mycobacterium tuberculosis
RPFYFGVLTWYMDRVLEL

SEQ ID NO: 1490402 - protein, 20 aa, Mycobacterium tuberculosis
RPGAFAYRPDPRLGSANAAL

SEQ ID NO: 1490403 - protein, 21 aa, Mycobacterium tuberculosis
RPGASRPGGRPGAPGAGRSDA

SEQ ID NO: 1490404 - protein, 17 aa, Mycobacterium tuberculosis
RPGCDAPAYHSEVHHVT

SEQ ID NO: 1490405 - protein, 21 aa, Mycobacterium tuberculosis
RPGCRPSLAELDSFVRSEIAG

SEQ ID NO: 1490406 - protein, 18 aa, Mycobacterium tuberculosis
RPGCRRRYHQGPRTLSRH

SEQ ID NO: 1490407 - protein, 18 aa, Mycobacterium tuberculosis
RPGDPTLRRLLPDFYRPD

SEQ ID NO: 1490408 - protein, 17 aa, Mycobacterium tuberculosis
RPGEDWTGSQQFSGDNP

SEQ ID NO: 1490409 - protein, 18 aa, Mycobacterium tuberculosis
RPGEGIVTLEHIARNQHG

SEQ ID NO: 1490410 - protein, 18 aa, Mycobacterium tuberculosis
RPGETVLAASLTRTPGGK

SEQ ID NO: 1490411 - protein, 17 aa, Mycobacterium tuberculosis
RPGGAPPALIVELPGER

SEQ ID NO: 1490412 - protein, 22 aa, Mycobacterium tuberculosis
RPGHPVHIYLQFDGLDEATHRR

SEQ ID NO: 1490413 - protein, 18 aa, Mycobacterium tuberculosis
RPGIAAGPTRMPAPGLIR

SEQ ID NO: 1490414 - protein, 19 aa, Mycobacterium tuberculosis
RPGIDLVVAAEAGMTTGMP

SEQ ID NO: 1490415 - protein, 26 aa, Mycobacterium tuberculosis
RPGLGRSRPRPGLLPRRRTAVRHRRQ

SEQ ID NO: 1490416 - protein, 24 aa, Mycobacterium tuberculosis
RPGLLRPSEGMAVAAAAVETAAMP

SEQ ID NO: 1490417 - protein, 27 aa, Mycobacterium tuberculosis
RPGLPSLPRPGRPLLPLPPAPPAPPLP

SEQ ID NO: 1490418 - protein, 19 aa, Mycobacterium tuberculosis
RPGQYEAPLGITLRELLDY

SEQ ID NO: 1490419 - protein, 20 aa, Mycobacterium tuberculosis
RPGRLRVGAGAYHQHLTAGR

SEQ ID NO: 1490420 - protein, 19 aa, Mycobacterium tuberculosis
RPGSRVNLERAAALGSRLG

SEQ ID NO: 1490421 - protein, 19 aa, Mycobacterium tuberculosis
RPHHPLLRRTIRRGQPIRR

SEQ ID NO: 1490422 - protein, 18 aa, Mycobacterium tuberculosis
RPHRSLTSLGQWSWRTET

SEQ ID NO: 1490423 - protein, 20 aa, Mycobacterium tuberculosis
RPHRSLTSLGQWSWRTETEV

SEQ ID NO: 1490424 - protein, 19 aa, Mycobacterium tuberculosis
RPHVSLAVAERIAPEVDEP

SEQ ID NO: 1490425 - protein, 19 aa, Mycobacterium tuberculosis
RPIADAVIFGTAFSAEDFK

SEQ ID NO: 1490426 - protein, 19 aa, Mycobacterium tuberculosis
RPIANSVMFGATFSAEDFK

SEQ ID NO: 1490427 - protein, 26 aa, Mycobacterium tuberculosis
RPIDPWGGSYYVEWLTHRLARRARAH

SEQ ID NO: 1490428 - protein, 25 aa, Mycobacterium tuberculosis
RPIEFRVIGGLLISFDRMNKVLEVD

SEQ ID NO: 1490429 - protein, 18 aa, Mycobacterium tuberculosis
RPIIFNLPATVEMTTPNV

SEQ ID NO: 1490430 - protein, 17 aa, Mycobacterium tuberculosis
RPIRINRVGDLGVLDSD

SEQ ID NO: 1490431 - protein, 25 aa, Mycobacterium tuberculosis
RPKGIWAPECAYVPGMEVDYATAGV

SEQ ID NO: 1490432 - protein, 23 aa, Mycobacterium tuberculosis
RPKRGRRGPQLCGQPVPGHRRRQ

SEQ ID NO: 1490433 - protein, 28 aa, Mycobacterium tuberculosis
RPKVWPAVRRIDGAYGDRNLVCSCPPVE

SEQ ID NO: 1490434 - protein, 29 aa, Mycobacterium tuberculosis
RPKVWPAVRRIDGAYGDRNLVCSCPPVEA

SEQ ID NO: 1490435 - protein, 17 aa, Mycobacterium tuberculosis
RPLETKVVLDWDALPPV

SEQ ID NO: 1490436 - protein, 17 aa, Mycobacterium tuberculosis
RPLGLDRYGVRFRIEAR

SEQ ID NO: 1490437 - protein, 17 aa, Mycobacterium tuberculosis
RPLGLLLTRRSENATVT

SEQ ID NO: 1490438 - protein, 25 aa, Mycobacterium tuberculosis
RPLGTLRCWRHSDIGPARGIVVTPA

SEQ ID NO: 1490439 - protein, 20 aa, Mycobacterium tuberculosis
RPLLQPLRAVPVIGDPLADL

SEQ ID NO: 1490440 - protein, 17 aa, Mycobacterium tuberculosis
RPLLSPRAGNWWWSTWL

SEQ ID NO: 1490441 - protein, 22 aa, Mycobacterium tuberculosis
RPLMQAAAAWQRLANELTATAA

SEQ ID NO: 1490442 - protein, 21 aa, Mycobacterium tuberculosis
RPLPGPRGVAVIFDKNSTRTR

SEQ ID NO: 1490443 - protein, 23 aa, Mycobacterium tuberculosis
RPLSLGRLDRGWVVASETAALDI

SEQ ID NO: 1490444 - protein, 21 aa, Mycobacterium tuberculosis
RPMEYRWAVGEGQRGILSRGM

SEQ ID NO: 1490445 - protein, 17 aa, Mycobacterium tuberculosis
RPMHDRLASAVVAEAHR

SEQ ID NO: 1490446 - protein, 18 aa, Mycobacterium tuberculosis
RPMHEKIVGRIAVSDLAR

SEQ ID NO: 1490447 - protein, 17 aa, Mycobacterium tuberculosis
RPMSEFQSNEAYRELHA

SEQ ID NO: 1490448 - protein, 19 aa, Mycobacterium tuberculosis
RPNGRVCGIFATATAPRSI

SEQ ID NO: 1490449 - protein, 20 aa, Mycobacterium tuberculosis
RPPERAQVRAGLPAGTLDDA

SEQ ID NO: 1490450 - protein, 18 aa, Mycobacterium tuberculosis
RPPFCPGPPVGAIANQRA

SEQ ID NO: 1490451 - protein, 21 aa, Mycobacterium tuberculosis
RPPIDVTVRISGFFRDAFPAC

SEQ ID NO: 1490452 - protein, 33 aa, Mycobacterium tuberculosis
RPPTARVRCSVAWRCRAWLAALPPVLPATPSAA

SEQ ID NO: 1490453 - protein, 23 aa, Mycobacterium tuberculosis
RPPVPLDAAILFAPVGDLVLPAL

SEQ ID NO: 1490454 - protein, 21 aa, Mycobacterium tuberculosis
RPPVRRLGGGLVEIPRAPDID

SEQ ID NO: 1490455 - protein, 18 aa, Mycobacterium tuberculosis
RPQLADPLSVVLDRLAVG

SEQ ID NO: 1490456 - protein, 17 aa, Mycobacterium tuberculosis
RPQPCGWCGRDVTDVGM

SEQ ID NO: 1490457 - protein, 22 aa, Mycobacterium tuberculosis
RPQRFQVTASRFGRSVDVAAAR

SEQ ID NO: 1490458 - protein, 18 aa, Mycobacterium tuberculosis
RPQRRSCESLTRTQKLRP

SEQ ID NO: 1490459 - protein, 18 aa, Mycobacterium tuberculosis
RPQRSCRNYVRRYACRSR

SEQ ID NO: 1490460 - protein, 19 aa, Mycobacterium tuberculosis
RPRANGCAMPSPISLPCSG

SEQ ID NO: 1490461 - protein, 26 aa, Mycobacterium tuberculosis
RPRCSPTSIWMCRWTTRVWVRPARCW

SEQ ID NO: 1490462 - protein, 18 aa, Mycobacterium tuberculosis
RPRFCAALTDAEPVAVVG

SEQ ID NO: 1490463 - protein, 20 aa, Mycobacterium tuberculosis
RPRLDHPPRRSRPRRTTRRM

SEQ ID NO: 1490464 - protein, 23 aa, Mycobacterium tuberculosis
RPRLRLRARAVLQARRPPGSAVT

SEQ ID NO: 1490465 - protein, 17 aa, Mycobacterium tuberculosis
RPRLVVHRSARHIHVQL

SEQ ID NO: 1490466 - protein, 19 aa, Mycobacterium tuberculosis
RPRNSTCARVFGARAVTGR

SEQ ID NO: 1490467 - protein, 19 aa, Mycobacterium tuberculosis
RPRPVPGRYANLMGLNSFC

SEQ ID NO: 1490468 - protein, 23 aa, Mycobacterium tuberculosis
RPRQCYPGRGHGCGDRSRAGPAA

SEQ ID NO: 1490469 - protein, 19 aa, Mycobacterium tuberculosis
RPRQKWRLSGREISAPICC

SEQ ID NO: 1490470 - protein, 19 aa, Mycobacterium tuberculosis
RPRRERPSGTRPRRSGASG

SEQ ID NO: 1490471 - protein, 18 aa, Mycobacterium tuberculosis
RPRRVPLAPTIRACFRRS

SEQ ID NO: 1490472 - protein, 27 aa, Mycobacterium tuberculosis
RPRWLGWPARSRVSACGCAKATSCYPG

SEQ ID NO: 1490473 - protein, 17 aa, Mycobacterium tuberculosis
RPRYIRIAADLPSTATH

SEQ ID NO: 1490474 - protein, 19 aa, Mycobacterium tuberculosis
RPSALVAIAALSRLGAVAV

SEQ ID NO: 1490475 - protein, 19 aa, Mycobacterium tuberculosis
RPSIGWRTSTRLPRDHYVR

SEQ ID NO: 1490476 - protein, 18 aa, Mycobacterium tuberculosis
RPSPAEWPTRAAPSACPV

SEQ ID NO: 1490477 - protein, 21 aa, Mycobacterium tuberculosis
RPSTQIPLLGVYGHPKYFLDM

SEQ ID NO: 1490478 - protein, 18 aa, Mycobacterium tuberculosis
RPSTTCYRKASSTPTGSP

SEQ ID NO: 1490479 - protein, 22 aa, Mycobacterium tuberculosis
RPSWLSSSAWPWQPYLLSHHQG

SEQ ID NO: 1490480 - protein, 18 aa, Mycobacterium tuberculosis
RPTCWKRRSQWQGRASRP

SEQ ID NO: 1490481 - protein, 19 aa, Mycobacterium tuberculosis
RPTGAFMFLGPTGVGKTEL

SEQ ID NO: 1490482 - protein, 21 aa, Mycobacterium tuberculosis
RPTIEMRGLLRWSPPNQDAQE

SEQ ID NO: 1490483 - protein, 17 aa, Mycobacterium tuberculosis
RPTPPNCSGSWRKTGTA

SEQ ID NO: 1490484 - protein, 20 aa, Mycobacterium tuberculosis
RPTQLFDVDGGLIFCSSQRR

SEQ ID NO: 1490485 - protein, 17 aa, Mycobacterium tuberculosis
RPTRPGGAWERSASGST

SEQ ID NO: 1490486 - protein, 17 aa, Mycobacterium tuberculosis
RPTSARTTWASEISAPA

SEQ ID NO: 1490487 - protein, 18 aa, Mycobacterium tuberculosis
RPTSRASRCRSPSTTFLV

SEQ ID NO: 1490488 - protein, 23 aa, Mycobacterium tuberculosis
RPTTAPTSFGWLPGGAWSNDSVS

SEQ ID NO: 1490489 - protein, 18 aa, Mycobacterium tuberculosis
RPTTFEVFARRLPTGRRY

SEQ ID NO: 1490490 - protein, 18 aa, Mycobacterium tuberculosis
RPVAAGLYGDLTATLSAL

SEQ ID NO: 1490491 - protein, 20 aa, Mycobacterium tuberculosis
RPVAARTGALIELSSGVTAA

SEQ ID NO: 1490492 - protein, 24 aa, Mycobacterium tuberculosis
RPVAARTGALIELSSGVTAAASAA

SEQ ID NO: 1490493 - protein, 19 aa, Mycobacterium tuberculosis
RPVALESLSHFPVTVAAHR

SEQ ID NO: 1490494 - protein, 18 aa, Mycobacterium tuberculosis
RPVDLWRHGPLDHRAVRG

SEQ ID NO: 1490495 - protein, 17 aa, Mycobacterium tuberculosis
RPVGQSRRERGPAMEYL

SEQ ID NO: 1490496 - protein, 17 aa, Mycobacterium tuberculosis
RPVIERQLLAAVSGSGP

SEQ ID NO: 1490497 - protein, 19 aa, Mycobacterium tuberculosis
RPVKSSFREGLTVLEYFIN

SEQ ID NO: 1490498 - protein, 19 aa, Mycobacterium tuberculosis
RPVMPARFLILGSASPDLV

SEQ ID NO: 1490499 - protein, 25 aa, Mycobacterium tuberculosis
RPVPHWPKYWIQALAKHFQRQLKPS

SEQ ID NO: 1490500 - protein, 24 aa, Mycobacterium tuberculosis
RPVPRLLAMGLLRRIDAETVILPR

SEQ ID NO: 1490501 - protein, 19 aa, Mycobacterium tuberculosis
RPVRMGRLVLPGRTTVPAV

SEQ ID NO: 1490502 - protein, 19 aa, Mycobacterium tuberculosis
RPVRQGRPAAPETVASAAV

SEQ ID NO: 1490503 - protein, 34 aa, Mycobacterium tuberculosis
RPVSVTPMVWVRPRQGPKLADLIAAPSTTRASGD

SEQ ID NO: 1490504 - protein, 25 aa, Mycobacterium tuberculosis
RPVWDVEPWDRWLRDFFGPAATTDW

SEQ ID NO: 1490505 - protein, 17 aa, Mycobacterium tuberculosis
RPWRLRAPGGRRELDEA

SEQ ID NO: 1490506 - protein, 18 aa, Mycobacterium tuberculosis
RPWRLRAPGGRRELDEAV

SEQ ID NO: 1490507 - protein, 23 aa, Mycobacterium tuberculosis
RPYRGVEAAERLATRRRQLLSAG

SEQ ID NO: 1490508 - protein, 18 aa, Mycobacterium tuberculosis
RQAAARLADAFGRDRVGF

SEQ ID NO: 1490509 - protein, 23 aa, Mycobacterium tuberculosis
RQAGARMAHQWAFPPRKNSSRGR

SEQ ID NO: 1490510 - protein, 19 aa, Mycobacterium tuberculosis
RQALADGIIDCVATDHAPH

SEQ ID NO: 1490511 - protein, 24 aa, Mycobacterium tuberculosis
RQALPPGSGGPVFGALDGGYQVLL

SEQ ID NO: 1490512 - protein, 19 aa, Mycobacterium tuberculosis
RQDIDDIFWLQATIAQELA

SEQ ID NO: 1490513 - protein, 17 aa, Mycobacterium tuberculosis
RQECERLGLPVFVKPAR

SEQ ID NO: 1490514 - protein, 20 aa, Mycobacterium tuberculosis
RQFVMATLFHKTRSWSNLFE

SEQ ID NO: 1490515 - protein, 22 aa, Mycobacterium tuberculosis
RQFVMATLFHKTRSWSNLLKVT

SEQ ID NO: 1490516 - protein, 18 aa, Mycobacterium tuberculosis
RQGEPAVSFLLISSGSAE

SEQ ID NO: 1490517 - protein, 17 aa, Mycobacterium tuberculosis
RQGLKVSISEEVAWRMG

SEQ ID NO: 1490518 - protein, 17 aa, Mycobacterium tuberculosis
RQGPGVLQHPDLVILRG

SEQ ID NO: 1490519 - protein, 19 aa, Mycobacterium tuberculosis
RQGRAYWIHLMMASQTIES

SEQ ID NO: 1490520 - protein, 17 aa, Mycobacterium tuberculosis
RQHPEFWVMSRIVDHPN

SEQ ID NO: 1490521 - protein, 18 aa, Mycobacterium tuberculosis
RQISRRTVCQAASILASI

SEQ ID NO: 1490522 - protein, 22 aa, Mycobacterium tuberculosis
RQKGLPGARARRRGLSDAALGT

SEQ ID NO: 1490523 - protein, 19 aa, Mycobacterium tuberculosis
RQKPAPAGDRRRWRRRRGS

SEQ ID NO: 1490524 - protein, 55 aa, Mycobacterium tuberculosis
RQKRGRRLRRCGVLVIRISVYGHRGCRGRWPADSGGRWHMSFVLAMPEVLGSAAT

SEQ ID NO: 1490525 - protein, 20 aa, Mycobacterium tuberculosis
RQLGSGGLGRFVVGAAGLGR

SEQ ID NO: 1490526 - protein, 19 aa, Mycobacterium tuberculosis
RQLKTLPLVERFYQADRSV

SEQ ID NO: 1490527 - protein, 20 aa, Mycobacterium tuberculosis
RQLLSAAFIDHLRHLGRIPA

SEQ ID NO: 1490528 - protein, 23 aa, Mycobacterium tuberculosis
RQLNAVAVAAGWRNDDGGEFLDN

SEQ ID NO: 1490529 - protein, 18 aa, Mycobacterium tuberculosis
RQLRRRADDLGRPTTAPT

SEQ ID NO: 1490530 - protein, 17 aa, Mycobacterium tuberculosis
RQMIADRELETWLVVDM

SEQ ID NO: 1490531 - protein, 17 aa, Mycobacterium tuberculosis
RQNGCGVLHSRRRRQRR

SEQ ID NO: 1490532 - protein, 21 aa, Mycobacterium tuberculosis
RQPGRLRIALSTRVPTPLPVR

SEQ ID NO: 1490533 - protein, 17 aa, Mycobacterium tuberculosis
RQPKFGTVVARDRTQAI

SEQ ID NO: 1490534 - protein, 24 aa, Mycobacterium tuberculosis
RQPPPRLANLLPLIRPHEHMPDSV

SEQ ID NO: 1490535 - protein, 17 aa, Mycobacterium tuberculosis
RQPVPTCTGTRRPSTPR

SEQ ID NO: 1490536 - protein, 22 aa, Mycobacterium tuberculosis
RQQPRPAIAALVIDVALHHLER

SEQ ID NO: 1490537 - protein, 22 aa, Mycobacterium tuberculosis
RQQTLWASVDWSYTLLTEPERT

SEQ ID NO: 1490538 - protein, 24 aa, Mycobacterium tuberculosis
RQRFLRALICRRWAGIAATAVSGL

SEQ ID NO: 1490539 - protein, 26 aa, Mycobacterium tuberculosis
RQRREARWVWPADGMVVMNFSVLPPE

SEQ ID NO: 1490540 - protein, 29 aa, Mycobacterium tuberculosis
RQRRPRCRCAKRSRTGGCRAAWLNRLSTR

SEQ ID NO: 1490541 - protein, 25 aa, Mycobacterium tuberculosis
RQRRRCGAPACARQIGAILTSQVIT

SEQ ID NO: 1490542 - protein, 29 aa, Mycobacterium tuberculosis
RQRRRRRCRRVWRRYRRQWRCRRQRRADR

SEQ ID NO: 1490543 - protein, 18 aa, Mycobacterium tuberculosis
RQRVKAGLGGARREPRHH

SEQ ID NO: 1490544 - protein, 28 aa, Mycobacterium tuberculosis
RQRWARRQRWGGHPDRGQWRQRRPRRQR

SEQ ID NO: 1490545 - protein, 17 aa, Mycobacterium tuberculosis
RQRWGRGARRGRRGGCR

SEQ ID NO: 1490546 - protein, 26 aa, Mycobacterium tuberculosis
RQSLRPRYLCMLAEILRFHRAALACC

SEQ ID NO: 1490547 - protein, 26 aa, Mycobacterium tuberculosis
RQTLRTIYQNLGWAFGYNTAAIPLAA

SEQ ID NO: 1490548 - protein, 22 aa, Mycobacterium tuberculosis
RQTRAALTRVLRANIGPASDSG

SEQ ID NO: 1490549 - protein, 18 aa, Mycobacterium tuberculosis
RQTWACGPEGVLNQADKV

SEQ ID NO: 1490550 - protein, 17 aa, Mycobacterium tuberculosis
RQVLGHRSPAELFTALL

SEQ ID NO: 1490551 - protein, 17 aa, Mycobacterium tuberculosis
RQVRAIWIICVGPSEWP

SEQ ID NO: 1490552 - protein, 24 aa, Mycobacterium tuberculosis
RQVSRLKSSVAMELVRKQRGLTVA

SEQ ID NO: 1490553 - protein, 17 aa, Mycobacterium tuberculosis
RRAARADGWMHGGGDPD

SEQ ID NO: 1490554 - protein, 21 aa, Mycobacterium tuberculosis
RRAARADGWMHGGGDPDELDR

SEQ ID NO: 1490555 - protein, 19 aa, Mycobacterium tuberculosis
RRADAIAGTGGDGGNGGNG

SEQ ID NO: 1490556 - protein, 18 aa, Mycobacterium tuberculosis
RRADARLLAGQRRLASAI

SEQ ID NO: 1490557 - protein, 22 aa, Mycobacterium tuberculosis
RRADCGHRRRGCVARWHGAVGL

SEQ ID NO: 1490558 - protein, 18 aa, Mycobacterium tuberculosis
RRADRRGAGQLDRYPGVQ

SEQ ID NO: 1490559 - protein, 17 aa, Mycobacterium tuberculosis
RRAELVQDLGIEVFLVM

SEQ ID NO: 1490560 - protein, 24 aa, Mycobacterium tuberculosis
RRAERYRRGSGRAFERGYGRGLGR

SEQ ID NO: 1490561 - protein, 22 aa, Mycobacterium tuberculosis
RRAEVGWGPGPCVNRLRLSTRC

SEQ ID NO: 1490562 - protein, 18 aa, Mycobacterium tuberculosis
RRAGKFAGPYSYFVCRSS

SEQ ID NO: 1490563 - protein, 17 aa, Mycobacterium tuberculosis
RRAGLAAAWPSRGTAEQ

SEQ ID NO: 1490564 - protein, 17 aa, Mycobacterium tuberculosis
RRAIQSFLESGVDLDDV

SEQ ID NO: 1490565 - protein, 19 aa, Mycobacterium tuberculosis
RRAIRRCYIALPNMGCCSP

SEQ ID NO: 1490566 - protein, 21 aa, Mycobacterium tuberculosis
RRALLPPGRPGAVHREGAGEG

SEQ ID NO: 1490567 - protein, 17 aa, Mycobacterium tuberculosis
RRALPIPYVGGSRIQPS

SEQ ID NO: 1490568 - protein, 18 aa, Mycobacterium tuberculosis
RRALSARSARHGPLTQLP

SEQ ID NO: 1490569 - protein, 20 aa, Mycobacterium tuberculosis
RRAPGPSWYHFTLNGAPGSI

SEQ ID NO: 1490570 - protein, 19 aa, Mycobacterium tuberculosis
RRARQEWLAERLATLNRSE

SEQ ID NO: 1490571 - protein, 21 aa, Mycobacterium tuberculosis
RRARRGGGRGRWCGDRLRPVL

SEQ ID NO: 1490572 - protein, 20 aa, Mycobacterium tuberculosis
RRASKPGARLYMFEFSEHNV

SEQ ID NO: 1490573 - protein, 18 aa, Mycobacterium tuberculosis
RRATSVFGQPELVNDPRF

SEQ ID NO: 1490574 - protein, 20 aa, Mycobacterium tuberculosis
RRAVLCGNIGSAVLDVLDEP

SEQ ID NO: 1490575 - protein, 25 aa, Mycobacterium tuberculosis
RRAVLKSSYAQFIFLLSGADHDQMD

SEQ ID NO: 1490576 - protein, 34 aa, Mycobacterium tuberculosis
RRAVVTRYELVPGFPRFDVDDVYLGNGVSELITM

SEQ ID NO: 1490577 - protein, 17 aa, Mycobacterium tuberculosis
RRAWHAYFRDARRAHAL

SEQ ID NO: 1490578 - protein, 26 aa, Mycobacterium tuberculosis
RRCGGLRRRRRGCPGGHQFSQQRGSR

SEQ ID NO: 1490579 - protein, 25 aa, Mycobacterium tuberculosis
RRCNEADAGLPARRRGRGVASEVAL

SEQ ID NO: 1490580 - protein, 24 aa, Mycobacterium tuberculosis
RRCNEADAGVPARRRGRGVASEVA

SEQ ID NO: 1490581 - protein, 19 aa, Mycobacterium tuberculosis
RRCPAETAFDELHNAAQRH

SEQ ID NO: 1490582 - protein, 19 aa, Mycobacterium tuberculosis
RRCSARFAAEFVAQLHAAG

SEQ ID NO: 1490583 - protein, 20 aa, Mycobacterium tuberculosis
RRCSARFAAEFVAQLHAAGQ

SEQ ID NO: 1490584 - protein, 21 aa, Mycobacterium tuberculosis
RRCSGHFPVTDRSAAMMAAGV

SEQ ID NO: 1490585 - protein, 20 aa, Mycobacterium tuberculosis
RRCVSGCARRRSMPAHGPGP

SEQ ID NO: 1490586 - protein, 18 aa, Mycobacterium tuberculosis
RRDALPQGHPRLCAPQCG

SEQ ID NO: 1490587 - protein, 17 aa, Mycobacterium tuberculosis
RRDGSVWTTDKDGIIMA

SEQ ID NO: 1490588 - protein, 39 aa, Mycobacterium tuberculosis
RRDGWMAGGWGRRRRYGWGWWWRRRGGWQRGPVRQRRRR

SEQ ID NO: 1490589 - protein, 19 aa, Mycobacterium tuberculosis
RRDGWWQGLGPYDVVLDAL

SEQ ID NO: 1490590 - protein, 19 aa, Mycobacterium tuberculosis
RRDLAGLGHYRCRHRRPKV

SEQ ID NO: 1490591 - protein, 24 aa, Mycobacterium tuberculosis
RRDLFRPAVFRSLWGRVEDAISAG

SEQ ID NO: 1490592 - protein, 26 aa, Mycobacterium tuberculosis
RRDREGAPGRVRRAAAGPRRGPAHRR

SEQ ID NO: 1490593 - protein, 25 aa, Mycobacterium tuberculosis
RRDWARSGPISHLKGTALGHYIANV

SEQ ID NO: 1490594 - protein, 18 aa, Mycobacterium tuberculosis
RRECRLPQFAVATWNGLV

SEQ ID NO: 1490595 - protein, 25 aa, Mycobacterium tuberculosis
RREDKPFWWAHFDRLNYPVDEWSDS

SEQ ID NO: 1490596 - protein, 27 aa, Mycobacterium tuberculosis
RREFDRIKLGPSLWHRDFHDAVIVECP

SEQ ID NO: 1490597 - protein, 20 aa, Mycobacterium tuberculosis
RREGSNWSIHPGAAAGRGSI

SEQ ID NO: 1490598 - protein, 24 aa, Mycobacterium tuberculosis
RRELLAQMPPFLTGGSMIETVTME

SEQ ID NO: 1490599 - protein, 19 aa, Mycobacterium tuberculosis
RRELLRDGQAFYVHNRVSS

SEQ ID NO: 1490600 - protein, 20 aa, Mycobacterium tuberculosis
RRELVKQAKHKGEEAKVSVR

SEQ ID NO: 1490601 - protein, 46 aa, Mycobacterium tuberculosis
RRERRVQQLWQRRGRRGRRRRGFARRLRRGRRGRRLRHRRRHRRGR

SEQ ID NO: 1490602 - protein, 19 aa, Mycobacterium tuberculosis
RRETWLIMRLPVIGNTQAL

SEQ ID NO: 1490603 - protein, 19 aa, Mycobacterium tuberculosis
RRFAEKVLIEANRLGDMVA

SEQ ID NO: 1490604 - protein, 21 aa, Mycobacterium tuberculosis
RRFARERSRWLFSNPEMTHLS

SEQ ID NO: 1490605 - protein, 19 aa, Mycobacterium tuberculosis
RRFATLCYMTDGLDDYFMP

SEQ ID NO: 1490606 - protein, 25 aa, Mycobacterium tuberculosis
RRFLERRLRETFGFDGSPIRVNVRV

SEQ ID NO: 1490607 - protein, 21 aa, Mycobacterium tuberculosis
RRFPDAAVVRLERDYRSTPQV

SEQ ID NO: 1490608 - protein, 20 aa, Mycobacterium tuberculosis
RRFSTVIEFFSYTPQELIAL

SEQ ID NO: 1490609 - protein, 18 aa, Mycobacterium tuberculosis
RRFTGRGGQRGRDLLERV

SEQ ID NO: 1490610 - protein, 19 aa, Mycobacterium tuberculosis
RRGAAGGLARPGRGMPGRD

SEQ ID NO: 1490611 - protein, 31 aa, Mycobacterium tuberculosis
RRGAGPAGLSAVVGRVGLVRALRDRGLQSAA

SEQ ID NO: 1490612 - protein, 25 aa, Mycobacterium tuberculosis
RRGCSRCGARIPRWLPSASWSLPTW

SEQ ID NO: 1490613 - protein, 22 aa, Mycobacterium tuberculosis
RRGEHVGRCFAAQLVEQKSRGL

SEQ ID NO: 1490614 - protein, 21 aa, Mycobacterium tuberculosis
RRGFLSQAWTLRADEVIQNVT

SEQ ID NO: 1490615 - protein, 17 aa, Mycobacterium tuberculosis
RRGFRFVGPTTAYALMQ

SEQ ID NO: 1490616 - protein, 19 aa, Mycobacterium tuberculosis
RRGFSFNCLTSYSDASKMR

SEQ ID NO: 1490617 - protein, 30 aa, Mycobacterium tuberculosis
RRGGAAGDRPRCRRHYRNQRQPGVGFRCGD

SEQ ID NO: 1490618 - protein, 17 aa, Mycobacterium tuberculosis
RRGGCRRGQPPDRPGGP

SEQ ID NO: 1490619 - protein, 19 aa, Mycobacterium tuberculosis
RRGIGKVDRAALVRRFAGE

SEQ ID NO: 1490620 - protein, 19 aa, Mycobacterium tuberculosis
RRGIPRPAATGSTRWPSGI

SEQ ID NO: 1490621 - protein, 20 aa, Mycobacterium tuberculosis
RRGKVLRRWPVTTRKVNEEW

SEQ ID NO: 1490622 - protein, 29 aa, Mycobacterium tuberculosis
RRGNRVLKASSWRTRRPAITSCFRSTNMR

SEQ ID NO: 1490623 - protein, 17 aa, Mycobacterium tuberculosis
RRGPGRVPDGIDVHLLP

SEQ ID NO: 1490624 - protein, 20 aa, Mycobacterium tuberculosis
RRGPRRQPAGVVQPRHTRAE

SEQ ID NO: 1490625 - protein, 21 aa, Mycobacterium tuberculosis
RRGRDRIPLTGRIAVIVDDGI

SEQ ID NO: 1490626 - protein, 18 aa, Mycobacterium tuberculosis
RRGRPEWIAAGQFAQRYE

SEQ ID NO: 1490627 - protein, 31 aa, Mycobacterium tuberculosis
RRGRRHRRRRRLALRLRRRRRERRVQQLWQR

SEQ ID NO: 1490628 - protein, 17 aa, Mycobacterium tuberculosis
RRHIHRYPELGRQEYAT

SEQ ID NO: 1490629 - protein, 17 aa, Mycobacterium tuberculosis
RRHLPNVALFHYADYQA

SEQ ID NO: 1490630 - protein, 17 aa, Mycobacterium tuberculosis
RRHPGRRSPLWQQRQRA

SEQ ID NO: 1490631 - protein, 21 aa, Mycobacterium tuberculosis
RRHPGRRSPLWQQRQRAARLL

SEQ ID NO: 1490632 - protein, 23 aa, Mycobacterium tuberculosis
RRIECACKVWAAGVAASPLGKMI

SEQ ID NO: 1490633 - protein, 17 aa, Mycobacterium tuberculosis
RRIEGLIAPGTFNIDPS

SEQ ID NO: 1490634 - protein, 18 aa, Mycobacterium tuberculosis
RRIFAHGFLHNRGEKMSK

SEQ ID NO: 1490635 - protein, 18 aa, Mycobacterium tuberculosis
RRIFCVRADIAVEGTAVT

SEQ ID NO: 1490636 - protein, 21 aa, Mycobacterium tuberculosis
RRIGETFFTTAYFDPNMAHMD

SEQ ID NO: 1490637 - protein, 17 aa, Mycobacterium tuberculosis
RRIPACFAGHHRRRTVP

SEQ ID NO: 1490638 - protein, 19 aa, Mycobacterium tuberculosis
RRIPGNGWPHACSNAQYLL

SEQ ID NO: 1490639 - protein, 19 aa, Mycobacterium tuberculosis
RRIPRPEAFTQPNRGLTAD

SEQ ID NO: 1490640 - protein, 24 aa, Mycobacterium tuberculosis
RRIREELKFSGDRAMAAEDPEAKE

SEQ ID NO: 1490641 - protein, 19 aa, Mycobacterium tuberculosis
RRIRGFPGRGGHQVDGFDG

SEQ ID NO: 1490642 - protein, 21 aa, Mycobacterium tuberculosis
RRIRRIPCRLSGITGGVRTRR

SEQ ID NO: 1490643 - protein, 23 aa, Mycobacterium tuberculosis
RRISSDYSPIAWLVVPTNEKMAI

SEQ ID NO: 1490644 - protein, 19 aa, Mycobacterium tuberculosis
RRITGWVAALGTGVCASDA

SEQ ID NO: 1490645 - protein, 23 aa, Mycobacterium tuberculosis
RRIVPISDYLAALIRDTPHGYLF

SEQ ID NO: 1490646 - protein, 19 aa, Mycobacterium tuberculosis
RRKAYNWTVATLKADIQAW

SEQ ID NO: 1490647 - protein, 18 aa, Mycobacterium tuberculosis
RRKHGLSSLAGICAAFSR

SEQ ID NO: 1490648 - protein, 25 aa, Mycobacterium tuberculosis
RRKPPAVATRLCWPDQAKADELQHA

SEQ ID NO: 1490649 - protein, 17 aa, Mycobacterium tuberculosis
RRKPYSWLRQVLPDPQY

SEQ ID NO: 1490650 - protein, 20 aa, Mycobacterium tuberculosis
RRKRVPGIRPGDHGDAHRPY

SEQ ID NO: 1490651 - protein, 18 aa, Mycobacterium tuberculosis
RRKVLEEAFRVLRPGGEL

SEQ ID NO: 1490652 - protein, 17 aa, Mycobacterium tuberculosis
RRLAITGVNEYPNLGEP

SEQ ID NO: 1490653 - protein, 17 aa, Mycobacterium tuberculosis
RRLAPGGAIVVGGAAGS

SEQ ID NO: 1490654 - protein, 18 aa, Mycobacterium tuberculosis
RRLAPGGAIVVGGAAGSS

SEQ ID NO: 1490655 - protein, 19 aa, Mycobacterium tuberculosis
RRLAPGGAIVVGGAAGSSA

SEQ ID NO: 1490656 - protein, 19 aa, Mycobacterium tuberculosis
RRLAPLAFVRFRIDGKDWP

SEQ ID NO: 1490657 - protein, 17 aa, Mycobacterium tuberculosis
RRLCKVHPVPAIIGESF

SEQ ID NO: 1490658 - protein, 34 aa, Mycobacterium tuberculosis
RRLEAARLLGWERIPVHVCHTIADVVDRAKAERS

SEQ ID NO: 1490659 - protein, 20 aa, Mycobacterium tuberculosis
RRLELLGDREYLRWLRRSVP

SEQ ID NO: 1490660 - protein, 22 aa, Mycobacterium tuberculosis
RRLFGRRLADFFTGRDPRGGNV

SEQ ID NO: 1490661 - protein, 17 aa, Mycobacterium tuberculosis
RRLFPTGFDEQRRAAEI

SEQ ID NO: 1490662 - protein, 17 aa, Mycobacterium tuberculosis
RRLGADAGVPVIFLHHL

SEQ ID NO: 1490663 - protein, 19 aa, Mycobacterium tuberculosis
RRLGAERLIGLSVAGKQRR

SEQ ID NO: 1490664 - protein, 35 aa, Mycobacterium tuberculosis
RRLGLKRLLRSDILPISFGFPFGFSAAIPPNLPLP

SEQ ID NO: 1490665 - protein, 19 aa, Mycobacterium tuberculosis
RRLHGCGLEIEWVGTASGE

SEQ ID NO: 1490666 - protein, 18 aa, Mycobacterium tuberculosis
RRLKAATARCTRSCWIVR

SEQ ID NO: 1490667 - protein, 20 aa, Mycobacterium tuberculosis
RRLKASGIDTVFTLSGGHLF

SEQ ID NO: 1490668 - protein, 21 aa, Mycobacterium tuberculosis
RRLLWPALDFHQGVHRALVWS

SEQ ID NO: 1490669 - protein, 17 aa, Mycobacterium tuberculosis
RRLLWPIRTSAGEVVGF

SEQ ID NO: 1490670 - protein, 20 aa, Mycobacterium tuberculosis
RRLPEELARVDALLDDPALF

SEQ ID NO: 1490671 - protein, 20 aa, Mycobacterium tuberculosis
RRLPEELARVDALLDDSAFF

SEQ ID NO: 1490672 - protein, 22 aa, Mycobacterium tuberculosis
RRLPGPRGPHRARAALTSTEEP

SEQ ID NO: 1490673 - protein, 18 aa, Mycobacterium tuberculosis
RRLQAERPGDAVLSEEAH

SEQ ID NO: 1490674 - protein, 17 aa, Mycobacterium tuberculosis
RRLRAAHRVALTGTPME

SEQ ID NO: 1490675 - protein, 23 aa, Mycobacterium tuberculosis
RRLREIRDLLAYMENVVSDALGR

SEQ ID NO: 1490676 - protein, 18 aa, Mycobacterium tuberculosis
RRLREMRDLLAYMENVVS

SEQ ID NO: 1490677 - protein, 19 aa, Mycobacterium tuberculosis
RRLREMRDLLAYMENVVSD

SEQ ID NO: 1490678 - protein, 20 aa, Mycobacterium tuberculosis
RRLRMPGPRLRSAGDQRGRT

SEQ ID NO: 1490679 - protein, 18 aa, Mycobacterium tuberculosis
RRLRRCDRGLGMLADQRR

SEQ ID NO: 1490680 - protein, 23 aa, Mycobacterium tuberculosis
RRLSEQRNADVLAEALKDALGVN

SEQ ID NO: 1490681 - protein, 28 aa, Mycobacterium tuberculosis
RRLSHFGALVRIPRSWRRSAVSTWSAST

SEQ ID NO: 1490682 - protein, 23 aa, Mycobacterium tuberculosis
RRLSPGSSAACWIIGTQLGQRRA

SEQ ID NO: 1490683 - protein, 19 aa, Mycobacterium tuberculosis
RRLSRLPVVAAVGKYDATF

SEQ ID NO: 1490684 - protein, 19 aa, Mycobacterium tuberculosis
RRLTAEPATPAELRDAVRS

SEQ ID NO: 1490685 - protein, 19 aa, Mycobacterium tuberculosis
RRLTKVLGLPGPHRRTQRS

SEQ ID NO: 1490686 - protein, 24 aa, Mycobacterium tuberculosis
RRLWSRARPGGGWRGDGTATAAVP

SEQ ID NO: 1490687 - protein, 23 aa, Mycobacterium tuberculosis
RRNDPLLGRHVIITWCVQRHREG

SEQ ID NO: 1490688 - protein, 18 aa, Mycobacterium tuberculosis
RRPAPVKFMLSAPTEHEG

SEQ ID NO: 1490689 - protein, 17 aa, Mycobacterium tuberculosis
RRPARPSSRAVLPSATE

SEQ ID NO: 1490690 - protein, 25 aa, Mycobacterium tuberculosis
RRPARREPRTCVAYVIWPSGSMIDF

SEQ ID NO: 1490691 - protein, 21 aa, Mycobacterium tuberculosis
RRPDIAVTILRLANMIGPAMD

SEQ ID NO: 1490692 - protein, 22 aa, Mycobacterium tuberculosis
RRPDRPGVRQLLRHGATDRVLL

SEQ ID NO: 1490693 - protein, 22 aa, Mycobacterium tuberculosis
RRPEMPALLAELGLSDRQLAST

SEQ ID NO: 1490694 - protein, 21 aa, Mycobacterium tuberculosis
RRPGARRLLDTEVRRCARRGH

SEQ ID NO: 1490695 - protein, 17 aa, Mycobacterium tuberculosis
RRPGATLRRCRGGPGDG

SEQ ID NO: 1490696 - protein, 26 aa, Mycobacterium tuberculosis
RRPGQHAGHALGVFVVAGTGHRPARG

SEQ ID NO: 1490697 - protein, 19 aa, Mycobacterium tuberculosis
RRPGQYSRCVMAYLDHAAT

SEQ ID NO: 1490698 - protein, 17 aa, Mycobacterium tuberculosis
RRPGRRPGGPHPHHAGR

SEQ ID NO: 1490699 - protein, 21 aa, Mycobacterium tuberculosis
RRPHRSLTSLGQWSWRTETEV

SEQ ID NO: 1490700 - protein, 18 aa, Mycobacterium tuberculosis
RRPLQIMGRRVLDLYPVS

SEQ ID NO: 1490701 - protein, 22 aa, Mycobacterium tuberculosis
RRPRCRCAKRSRTGGCRAAWLN

SEQ ID NO: 1490702 - protein, 20 aa, Mycobacterium tuberculosis
RRPRLGGAGVARWRSIVPAR

SEQ ID NO: 1490703 - protein, 21 aa, Mycobacterium tuberculosis
RRPRVFCMDEPLSNLDAKLRV

SEQ ID NO: 1490704 - protein, 33 aa, Mycobacterium tuberculosis
RRPSTPAWRSPTWPGCRLRCTPTLSMRPDSSRT

SEQ ID NO: 1490705 - protein, 21 aa, Mycobacterium tuberculosis
RRPTLVPVEAIEFLRGEVQYT

SEQ ID NO: 1490706 - protein, 17 aa, Mycobacterium tuberculosis
RRPVAGLHWPWVARVGT

SEQ ID NO: 1490707 - protein, 17 aa, Mycobacterium tuberculosis
RRPVIRPIPVDDSGFTV

SEQ ID NO: 1490708 - protein, 20 aa, Mycobacterium tuberculosis
RRPWYLAAQAGTGGGQLNDS

SEQ ID NO: 1490709 - protein, 21 aa, Mycobacterium tuberculosis
RRQAMLPGHAVVLHPGPMVRG

SEQ ID NO: 1490710 - protein, 19 aa, Mycobacterium tuberculosis
RRQGLWRGESQHGGDLPWH

SEQ ID NO: 1490711 - protein, 26 aa, Mycobacterium tuberculosis
RRQPHTHPAPLMPAVPAPTRRWGGKR

SEQ ID NO: 1490712 - protein, 23 aa, Mycobacterium tuberculosis
RRQPTRFPMSWSTTPSLATTPCP

SEQ ID NO: 1490713 - protein, 20 aa, Mycobacterium tuberculosis
RRRAGGGVEEAGRWPQVDDR

SEQ ID NO: 1490714 - protein, 17 aa, Mycobacterium tuberculosis
RRRAPRRLCEEVIVPDK

SEQ ID NO: 1490715 - protein, 18 aa, Mycobacterium tuberculosis
RRRCGSWNGPRRSRAIGP

SEQ ID NO: 1490716 - protein, 22 aa, Mycobacterium tuberculosis
RRRCGWFDAVIARYAARVNGIT

SEQ ID NO: 1490717 - protein, 20 aa, Mycobacterium tuberculosis
RRRDIDDRDAAVGHGEIQRQ

SEQ ID NO: 1490718 - protein, 25 aa, Mycobacterium tuberculosis
RRREFLRPQQLRWPLAGDQETARRG

SEQ ID NO: 1490719 - protein, 21 aa, Mycobacterium tuberculosis
RRREVYWARYCDGIRTVGPAV

SEQ ID NO: 1490720 - protein, 18 aa, Mycobacterium tuberculosis
RRRFRHVLVDEYQDTNHA

SEQ ID NO: 1490721 - protein, 18 aa, Mycobacterium tuberculosis
RRRGASARRLRLRSRRAG

SEQ ID NO: 1490722 - protein, 24 aa, Mycobacterium tuberculosis
RRRGRLVGALIVRRRQRAVCRHFR

SEQ ID NO: 1490723 - protein, 17 aa, Mycobacterium tuberculosis
RRRGRRGGRRCRTGTHR

SEQ ID NO: 1490724 - protein, 29 aa, Mycobacterium tuberculosis
RRRIAPGGFRYGPAFGVELQFWVYEETVI

SEQ ID NO: 1490725 - protein, 17 aa, Mycobacterium tuberculosis
RRRIIVVDAVFSMEGTV

SEQ ID NO: 1490726 - protein, 20 aa, Mycobacterium tuberculosis
RRRLIKYISQIDVERYRSLI

SEQ ID NO: 1490727 - protein, 21 aa, Mycobacterium tuberculosis
RRRLPGLTTFVVADAGIRTDR

SEQ ID NO: 1490728 - protein, 18 aa, Mycobacterium tuberculosis
RRRLRMICHGLGHVEGFR

SEQ ID NO: 1490729 - protein, 22 aa, Mycobacterium tuberculosis
RRRPAVCRAQCRACASTWGPTT

SEQ ID NO: 1490730 - protein, 17 aa, Mycobacterium tuberculosis
RRRPCRLERAGHRLGLG

SEQ ID NO: 1490731 - protein, 21 aa, Mycobacterium tuberculosis
RRRPGQYSRCVMAYLDHAATT

SEQ ID NO: 1490732 - protein, 23 aa, Mycobacterium tuberculosis
RRRPSWLSSRWSPLVNDPSPTGR

SEQ ID NO: 1490733 - protein, 17 aa, Mycobacterium tuberculosis
RRRPYLQLNTIQDIAGV

SEQ ID NO: 1490734 - protein, 25 aa, Mycobacterium tuberculosis
RRRQHGRCGLDNGVADRRRRRSVGG

SEQ ID NO: 1490735 - protein, 24 aa, Mycobacterium tuberculosis
RRRQRCCFRPGCFRRRRRDRRRRC

SEQ ID NO: 1490736 - protein, 26 aa, Mycobacterium tuberculosis
RRRQRGRCGLDNGVADRRRRRSVGGD

SEQ ID NO: 1490737 - protein, 28 aa, Mycobacterium tuberculosis
RRRRCGRSRWGGLAGRQRRCRRVRRGGN

SEQ ID NO: 1490738 - protein, 23 aa, Mycobacterium tuberculosis
RRRRGRSGWDRRGAVPAVPAAPP

SEQ ID NO: 1490739 - protein, 18 aa, Mycobacterium tuberculosis
RRRRLMAVFRRMVDEHGE

SEQ ID NO: 1490740 - protein, 21 aa, Mycobacterium tuberculosis
RRRRPCLAWSNGCHGSRRCPP

SEQ ID NO: 1490741 - protein, 17 aa, Mycobacterium tuberculosis
RRRRRNSAFADGGQGGP

SEQ ID NO: 1490742 - protein, 21 aa, Mycobacterium tuberculosis
RRRRSARMCGGRRPRHPHGAD

SEQ ID NO: 1490743 - protein, 26 aa, Mycobacterium tuberculosis
RRRRWCRRQRVAIRQRWGRGARRGRR

SEQ ID NO: 1490744 - protein, 19 aa, Mycobacterium tuberculosis
RRRSMPARRGPAGWGPAST

SEQ ID NO: 1490745 - protein, 20 aa, Mycobacterium tuberculosis
RRRTGFVLFSAGCRSTGERS

SEQ ID NO: 1490746 - protein, 19 aa, Mycobacterium tuberculosis
RRRTRAAELAHRINAERAL

SEQ ID NO: 1490747 - protein, 20 aa, Mycobacterium tuberculosis
RRRVPSLRRAFAAPAADPRG

SEQ ID NO: 1490748 - protein, 19 aa, Mycobacterium tuberculosis
RRRVTRRGYGDDFMDMNID

SEQ ID NO: 1490749 - protein, 18 aa, Mycobacterium tuberculosis
RRRYRRLAADQVPEAARR

SEQ ID NO: 1490750 - protein, 21 aa, Mycobacterium tuberculosis
RRSARRCRPVQRIGGPQHQPL

SEQ ID NO: 1490751 - protein, 23 aa, Mycobacterium tuberculosis
RRSCPAYRRDAAPSRCRTDAHRD

SEQ ID NO: 1490752 - protein, 17 aa, Mycobacterium tuberculosis
RRSCVSGRCGWSQRSAV

SEQ ID NO: 1490753 - protein, 17 aa, Mycobacterium tuberculosis
RRSDLQAVIAVDDPVRS

SEQ ID NO: 1490754 - protein, 21 aa, Mycobacterium tuberculosis
RRSGASWSDIGKSIGVTKQAA

SEQ ID NO: 1490755 - protein, 21 aa, Mycobacterium tuberculosis
RRSLDSAAGWLAPLGGAHLRS

SEQ ID NO: 1490756 - protein, 20 aa, Mycobacterium tuberculosis
RRSLRPVGIVEVDGFPVFDV

SEQ ID NO: 1490757 - protein, 28 aa, Mycobacterium tuberculosis
RRSLVRPDRVRLGAHLIECTVCRGGGRT

SEQ ID NO: 1490758 - protein, 22 aa, Mycobacterium tuberculosis
RRSRDREAIVIAFVDSSAGANR

SEQ ID NO: 1490759 - protein, 23 aa, Mycobacterium tuberculosis
RRSRGLAGLSVAWGLWEQASAMT

SEQ ID NO: 1490760 - protein, 26 aa, Mycobacterium tuberculosis
RRSRHGLAGMFTLRFDQFAHTLLSRA

SEQ ID NO: 1490761 - protein, 30 aa, Mycobacterium tuberculosis
RRSRVHWVRARVVQLERGWVLRDETGGRWQ

SEQ ID NO: 1490762 - protein, 26 aa, Mycobacterium tuberculosis
RRSVGGDSGLFGMHGQTYQALSARAA

SEQ ID NO: 1490763 - protein, 24 aa, Mycobacterium tuberculosis
RRTARWWSSIICRCNGLGILTDGQ

SEQ ID NO: 1490764 - protein, 21 aa, Mycobacterium tuberculosis
RRTATHLPLRLVYSDGTATGA

SEQ ID NO: 1490765 - protein, 19 aa, Mycobacterium tuberculosis
RRTCNHGGSARRRVPATST

SEQ ID NO: 1490766 - protein, 21 aa, Mycobacterium tuberculosis
RRTDPGRSWGTFDEAADQQPG

SEQ ID NO: 1490767 - protein, 17 aa, Mycobacterium tuberculosis
RRTDYRIAIRRIADGGG

SEQ ID NO: 1490768 - protein, 34 aa, Mycobacterium tuberculosis
RRTIVKHERSCLMKAAADARLAHAVRHRPDPTPA

SEQ ID NO: 1490769 - protein, 33 aa, Mycobacterium tuberculosis
RRTRPRYGPPRCRYPICRTPGYALGGPGPQHVH

SEQ ID NO: 1490770 - protein, 21 aa, Mycobacterium tuberculosis
RRTRQSFALSARAVINAAGVW

SEQ ID NO: 1490771 - protein, 17 aa, Mycobacterium tuberculosis
RRTRRARRWYRGGHPLP

SEQ ID NO: 1490772 - protein, 26 aa, Mycobacterium tuberculosis
RRTSAVKAFTAWAVRRGLLAGDPAAR

SEQ ID NO: 1490773 - protein, 26 aa, Mycobacterium tuberculosis
RRTSAVKAFTAWAVRRVLLAGDPAAR

SEQ ID NO: 1490774 - protein, 20 aa, Mycobacterium tuberculosis
RRTSWPAAYDRACRRDHRGV

SEQ ID NO: 1490775 - protein, 18 aa, Mycobacterium tuberculosis
RRTVLLIGDGAAQLTVQE

SEQ ID NO: 1490776 - protein, 21 aa, Mycobacterium tuberculosis
RRVADVLGIPFYVWDFAEKFK

SEQ ID NO: 1490777 - protein, 23 aa, Mycobacterium tuberculosis
RRVAWRCRLHRRRHQAQCRPSGD

SEQ ID NO: 1490778 - protein, 22 aa, Mycobacterium tuberculosis
RRVELLPQLRLGSTTCWSSSTC

SEQ ID NO: 1490779 - protein, 17 aa, Mycobacterium tuberculosis
RRVGARIVVVTHLATDA

SEQ ID NO: 1490780 - protein, 18 aa, Mycobacterium tuberculosis
RRVGCRRRRVVGDQLGRA

SEQ ID NO: 1490781 - protein, 17 aa, Mycobacterium tuberculosis
RRVGDGFVGLRVVPWLW

SEQ ID NO: 1490782 - protein, 17 aa, Mycobacterium tuberculosis
RRVGEGFVGLRVVPWLW

SEQ ID NO: 1490783 - protein, 17 aa, Mycobacterium tuberculosis
RRVGGCLMAKFEIPEGW

SEQ ID NO: 1490784 - protein, 19 aa, Mycobacterium tuberculosis
RRVGGDLYGSFLPGTQQNL

SEQ ID NO: 1490785 - protein, 18 aa, Mycobacterium tuberculosis
RRVGPIIGTVAMQLPRLS

SEQ ID NO: 1490786 - protein, 19 aa, Mycobacterium tuberculosis
RRVGWPRVGNARHRRGHRA

SEQ ID NO: 1490787 - protein, 41 aa, Mycobacterium tuberculosis
RRVHVGQLQQRPCCGGVITRACSACSTASTCPGSPSWTPTS

SEQ ID NO: 1490788 - protein, 18 aa, Mycobacterium tuberculosis
RRVIEPIDMDAYRQFLTE

SEQ ID NO: 1490789 - protein, 17 aa, Mycobacterium tuberculosis
RRVRVEYRGDGGGLETA

SEQ ID NO: 1490790 - protein, 17 aa, Mycobacterium tuberculosis
RRVTTCEEFADALRAAF

SEQ ID NO: 1490791 - protein, 30 aa, Mycobacterium tuberculosis
RRVVCHRVLRSAAVGACLPRRALRADPRRH

SEQ ID NO: 1490792 - protein, 17 aa, Mycobacterium tuberculosis
RRVVFPGVVGLFADLDS

SEQ ID NO: 1490793 - protein, 21 aa, Mycobacterium tuberculosis
RRVYPGAATAGCFFYSKCRYP

SEQ ID NO: 1490794 - protein, 23 aa, Mycobacterium tuberculosis
RRWCRRQRVAIRQRWGRGARRGR

SEQ ID NO: 1490795 - protein, 21 aa, Mycobacterium tuberculosis
RRWGRQADRARWRRRCRRGAR

SEQ ID NO: 1490796 - protein, 19 aa, Mycobacterium tuberculosis
RRWIAPAVHSARYWRLSWR

SEQ ID NO: 1490797 - protein, 17 aa, Mycobacterium tuberculosis
RRWLHEQGIALTMSDLR

SEQ ID NO: 1490798 - protein, 23 aa, Mycobacterium tuberculosis
RRWRPEGLGVGGPVYRDDLAERG

SEQ ID NO: 1490799 - protein, 24 aa, Mycobacterium tuberculosis
RRWRRRGRYHWNPAVPAPPAATHW

SEQ ID NO: 1490800 - protein, 24 aa, Mycobacterium tuberculosis
RRWWPRRYRRSSVYWRLMALDQRF

SEQ ID NO: 1490801 - protein, 26 aa, Mycobacterium tuberculosis
RRYAGNGRTAGLFGHGGAGGAGGIGS

SEQ ID NO: 1490802 - protein, 17 aa, Mycobacterium tuberculosis
RRYAPFTINIEHLKPFH

SEQ ID NO: 1490803 - protein, 22 aa, Mycobacterium tuberculosis
RRYGRRNGRRCGGANLRVLRYP

SEQ ID NO: 1490804 - protein, 19 aa, Mycobacterium tuberculosis
RRYGVSMSGLVSRLHALTP

SEQ ID NO: 1490805 - protein, 18 aa, Mycobacterium tuberculosis
RRYLDMFTFVASSALGMN

SEQ ID NO: 1490806 - protein, 20 aa, Mycobacterium tuberculosis
RRYLDMFTFVASSALGMNPP

SEQ ID NO: 1490807 - protein, 20 aa, Mycobacterium tuberculosis
RRYSAAITRLAPETDVRIVT

SEQ ID NO: 1490808 - protein, 21 aa, Mycobacterium tuberculosis
RSAAATLDWLQAHGHDDQVRN

SEQ ID NO: 1490809 - protein, 31 aa, Mycobacterium tuberculosis
RSAGAGLVPHCCWPTKPVPIAAHRAALKESQ

SEQ ID NO: 1490810 - protein, 19 aa, Mycobacterium tuberculosis
RSAGERWHLVRLFVCQRQR

SEQ ID NO: 1490811 - protein, 19 aa, Mycobacterium tuberculosis
RSAGLPAVGINWGRGPTLD

SEQ ID NO: 1490812 - protein, 19 aa, Mycobacterium tuberculosis
RSAGVKVLMALPVGMGCSD

SEQ ID NO: 1490813 - protein, 21 aa, Mycobacterium tuberculosis
RSALGRPLIGNGANGKPGTGQ

SEQ ID NO: 1490814 - protein, 19 aa, Mycobacterium tuberculosis
RSALVRPGWVINRCAGYLA

SEQ ID NO: 1490815 - protein, 17 aa, Mycobacterium tuberculosis
RSAMPAASVGRAEPEAP

SEQ ID NO: 1490816 - protein, 24 aa, Mycobacterium tuberculosis
RSANPRLLAALLYTEQPTTTTGEL

SEQ ID NO: 1490817 - protein, 26 aa, Mycobacterium tuberculosis
RSARFRGGCCFPSIAPTYSAARSACS

SEQ ID NO: 1490818 - protein, 17 aa, Mycobacterium tuberculosis
RSARSAIPKVDEFGPTL

SEQ ID NO: 1490819 - protein, 20 aa, Mycobacterium tuberculosis
RSAVDPFVIALAMVNNATVV

SEQ ID NO: 1490820 - protein, 20 aa, Mycobacterium tuberculosis
RSAWIGCWVPSAATGGGVAT

SEQ ID NO: 1490821 - protein, 18 aa, Mycobacterium tuberculosis
RSCFCGYARPLADTASRC

SEQ ID NO: 1490822 - protein, 18 aa, Mycobacterium tuberculosis
RSCGMTAIVKGLRTGTDF

SEQ ID NO: 1490823 - protein, 32 aa, Mycobacterium tuberculosis
RSDEVPVVVLLWSPRSEVCVDLLDTLSGLAAA

SEQ ID NO: 1490824 - protein, 24 aa, Mycobacterium tuberculosis
RSDPRPALDAIRAAVCNRHGLSVA

SEQ ID NO: 1490825 - protein, 25 aa, Mycobacterium tuberculosis
RSEALADDVARSFADAGLDSVLSAE

SEQ ID NO: 1490826 - protein, 18 aa, Mycobacterium tuberculosis
RSEFAYGSFVRTVSLPVG

SEQ ID NO: 1490827 - protein, 18 aa, Mycobacterium tuberculosis
RSEILTFLATREAAHHRL

SEQ ID NO: 1490828 - protein, 19 aa, Mycobacterium tuberculosis
RSEVIAALAAAFLNSLGPD

SEQ ID NO: 1490829 - protein, 24 aa, Mycobacterium tuberculosis
RSEVLNIGDTILFYTDGLIERPGR

SEQ ID NO: 1490830 - protein, 18 aa, Mycobacterium tuberculosis
RSGAGLFGSIAQLVKVLS

SEQ ID NO: 1490831 - protein, 18 aa, Mycobacterium tuberculosis
RSGAGLFGSIAQLVKVRS

SEQ ID NO: 1490832 - protein, 20 aa, Mycobacterium tuberculosis
RSGASWSDIGKSMGVTKQAA

SEQ ID NO: 1490833 - protein, 28 aa, Mycobacterium tuberculosis
RSGCPGPTCMPSWKRPQQKLPHPRVHRA

SEQ ID NO: 1490834 - protein, 26 aa, Mycobacterium tuberculosis
RSGGSGPRWPSRWGTCSKSMGMTPAA

SEQ ID NO: 1490835 - protein, 23 aa, Mycobacterium tuberculosis
RSGKLPPPEPVVYPLDQAAAAIA

SEQ ID NO: 1490836 - protein, 23 aa, Mycobacterium tuberculosis
RSGKNVVTPLGWFYPSEKEAAPL

SEQ ID NO: 1490837 - protein, 22 aa, Mycobacterium tuberculosis
RSGNHVCRWRPGHGDGDRAPRV

SEQ ID NO: 1490838 - protein, 20 aa, Mycobacterium tuberculosis
RSGQYVFKEIVEHYLQQISF

SEQ ID NO: 1490839 - protein, 20 aa, Mycobacterium tuberculosis
RSGSLALFEFWARSWRAKSV

SEQ ID NO: 1490840 - protein, 27 aa, Mycobacterium tuberculosis
RSGYPLELLVRAAAAGWRVVELDVKLR

SEQ ID NO: 1490841 - protein, 17 aa, Mycobacterium tuberculosis
RSHMAAMSHLAVGIQLA

SEQ ID NO: 1490842 - protein, 17 aa, Mycobacterium tuberculosis
RSKSCWSAVMTSRKAAT

SEQ ID NO: 1490843 - protein, 19 aa, Mycobacterium tuberculosis
RSLAHAVLMMIPEAWERHE

SEQ ID NO: 1490844 - protein, 18 aa, Mycobacterium tuberculosis
RSLAYLSFPAGRFEREMA

SEQ ID NO: 1490845 - protein, 22 aa, Mycobacterium tuberculosis
RSLCRIIWPSLWIRDQADVYTV

SEQ ID NO: 1490846 - protein, 20 aa, Mycobacterium tuberculosis
RSLPAVGIDGVYAACDADGR

SEQ ID NO: 1490847 - protein, 23 aa, Mycobacterium tuberculosis
RSLPIMFPIEVRFSAPDDSFLST

SEQ ID NO: 1490848 - protein, 17 aa, Mycobacterium tuberculosis
RSLPVPFILNQPPPPPG

SEQ ID NO: 1490849 - protein, 19 aa, Mycobacterium tuberculosis
RSLPVVPFFDPRMGRPSIP

SEQ ID NO: 1490850 - protein, 17 aa, Mycobacterium tuberculosis
RSLRGRLFSVLGSSLAL

SEQ ID NO: 1490851 - protein, 17 aa, Mycobacterium tuberculosis
RSLTSLGQWSWRTETEV

SEQ ID NO: 1490852 - protein, 21 aa, Mycobacterium tuberculosis
RSLVHLGLKHYFLVDFPQEPG

SEQ ID NO: 1490853 - protein, 21 aa, Mycobacterium tuberculosis
RSMVAPLLYIGMHTEISGFAG

SEQ ID NO: 1490854 - protein, 19 aa, Mycobacterium tuberculosis
RSNLARFGISPTYPLDFAA

SEQ ID NO: 1490855 - protein, 21 aa, Mycobacterium tuberculosis
RSNPPRGALRLVQTTGADTPV

SEQ ID NO: 1490856 - protein, 17 aa, Mycobacterium tuberculosis
RSPAGKPDYRWAKEQTE

SEQ ID NO: 1490857 - protein, 18 aa, Mycobacterium tuberculosis
RSPAGKPDYRWAKEQTEA

SEQ ID NO: 1490858 - protein, 31 aa, Mycobacterium tuberculosis
RSPAGPPVRTWPRWPRFRRMIRRCSRASKAP

SEQ ID NO: 1490859 - protein, 19 aa, Mycobacterium tuberculosis
RSPASCSWLIICILRAWPR

SEQ ID NO: 1490860 - protein, 20 aa, Mycobacterium tuberculosis
RSPEEVRFLMGFNRDVVRRR

SEQ ID NO: 1490861 - protein, 20 aa, Mycobacterium tuberculosis
RSPLGAALARTSPRSARADL

SEQ ID NO: 1490862 - protein, 21 aa, Mycobacterium tuberculosis
RSPRPCWPRPPRPTPPNCSGS

SEQ ID NO: 1490863 - protein, 25 aa, Mycobacterium tuberculosis
RSPRRSTCARSRWCPATTTPFTPTG

SEQ ID NO: 1490864 - protein, 19 aa, Mycobacterium tuberculosis
RSPTCTRGGCAASPVTTWC

SEQ ID NO: 1490865 - protein, 20 aa, Mycobacterium tuberculosis
RSPVWTGHMCILLRRLCKVH

SEQ ID NO: 1490866 - protein, 25 aa, Mycobacterium tuberculosis
RSPVWTGHMCILLRRLCKVHPVPAI

SEQ ID NO: 1490867 - protein, 25 aa, Mycobacterium tuberculosis
RSPVYCFTLPFAHQALMPINVVATA

SEQ ID NO: 1490868 - protein, 20 aa, Mycobacterium tuberculosis
RSPYGAAKVYSYWATRNYRE

SEQ ID NO: 1490869 - protein, 24 aa, Mycobacterium tuberculosis
RSRGAGRPGLARTLAMTPRSYCVV

SEQ ID NO: 1490870 - protein, 20 aa, Mycobacterium tuberculosis
RSRPVLRAVDYLRAQGYHEL

SEQ ID NO: 1490871 - protein, 21 aa, Mycobacterium tuberculosis
RSRRPHRCGASGSRRRRRPLP

SEQ ID NO: 1490872 - protein, 23 aa, Mycobacterium tuberculosis
RSRRPPIAIPDRWPARDQGGVDP

SEQ ID NO: 1490873 - protein, 24 aa, Mycobacterium tuberculosis
RSRRPPIAIPDRWPARDQGGVDPW

SEQ ID NO: 1490874 - protein, 17 aa, Mycobacterium tuberculosis
RSRSGCRTGSPGAPARA

SEQ ID NO: 1490875 - protein, 18 aa, Mycobacterium tuberculosis
RSRSTLRRLCSRAPLTIR

SEQ ID NO: 1490876 - protein, 20 aa, Mycobacterium tuberculosis
RSRTRPMAPTALPDPMATGP

SEQ ID NO: 1490877 - protein, 17 aa, Mycobacterium tuberculosis
RSRWFSDYLRTVTQRDV

SEQ ID NO: 1490878 - protein, 29 aa, Mycobacterium tuberculosis
RSSDVGGGVWPLGFGRFADAGAGGNEALG

SEQ ID NO: 1490879 - protein, 20 aa, Mycobacterium tuberculosis
RSSHTWFVLRELLGHQNVKN

SEQ ID NO: 1490880 - protein, 18 aa, Mycobacterium tuberculosis
RSSINFDQSPKDLLRNTI

SEQ ID NO: 1490881 - protein, 23 aa, Mycobacterium tuberculosis
RSSKEPGRFCWRDSGTDRHIIRL

SEQ ID NO: 1490882 - protein, 25 aa, Mycobacterium tuberculosis
RSSQQPLPPSVRMKRKPSSSPVLFY

SEQ ID NO: 1490883 - protein, 20 aa, Mycobacterium tuberculosis
RSSTATRCSSCTSTRKPRPL

SEQ ID NO: 1490884 - protein, 20 aa, Mycobacterium tuberculosis
RSSTRPPAWCARCAAGPSST

SEQ ID NO: 1490885 - protein, 18 aa, Mycobacterium tuberculosis
RSTALPVRSTRNCATCWA

SEQ ID NO: 1490886 - protein, 20 aa, Mycobacterium tuberculosis
RSTPAPVRGALVARLGELLT

SEQ ID NO: 1490887 - protein, 19 aa, Mycobacterium tuberculosis
RSTSLTILFSRRQTQNPER

SEQ ID NO: 1490888 - protein, 17 aa, Mycobacterium tuberculosis
RSVASRWRPSVRVAVIS

SEQ ID NO: 1490889 - protein, 20 aa, Mycobacterium tuberculosis
RSVGLLSVGAYRPERVVTND

SEQ ID NO: 1490890 - protein, 21 aa, Mycobacterium tuberculosis
RSVGLLSVGAYRPERVVTNDE

SEQ ID NO: 1490891 - protein, 17 aa, Mycobacterium tuberculosis
RSVPYAELQARLVDYEN

SEQ ID NO: 1490892 - protein, 17 aa, Mycobacterium tuberculosis
RSVRFVDVLPRNAAGKV

SEQ ID NO: 1490893 - protein, 17 aa, Mycobacterium tuberculosis
RSWHLGAGWPISRMANI

SEQ ID NO: 1490894 - protein, 19 aa, Mycobacterium tuberculosis
RTAEELGRAFPGTAVITSA

SEQ ID NO: 1490895 - protein, 30 aa, Mycobacterium tuberculosis
RTAGGRHRRSACAAGGFGRNGNDASRGVID

SEQ ID NO: 1490896 - protein, 26 aa, Mycobacterium tuberculosis
RTALAARLPLAYALGWQSRGREADAV

SEQ ID NO: 1490897 - protein, 18 aa, Mycobacterium tuberculosis
RTALPGPRGPHPSPSSTD

SEQ ID NO: 1490898 - protein, 17 aa, Mycobacterium tuberculosis
RTALSYVSVDGARANLD

SEQ ID NO: 1490899 - protein, 19 aa, Mycobacterium tuberculosis
RTALWLLLAKGGGDTEVSA

SEQ ID NO: 1490900 - protein, 25 aa, Mycobacterium tuberculosis
RTAPGVFPALFAAIITSAGGAPQDE

SEQ ID NO: 1490901 - protein, 18 aa, Mycobacterium tuberculosis
RTAVLDFIDRLRCAERAI

SEQ ID NO: 1490902 - protein, 19 aa, Mycobacterium tuberculosis
RTAVRRAKVLAGLDEDTEV

SEQ ID NO: 1490903 - protein, 20 aa, Mycobacterium tuberculosis
RTCRPRKDLVATRVALANQL

SEQ ID NO: 1490904 - protein, 22 aa, Mycobacterium tuberculosis
RTCWSCAVGLKVTHRTWRCPIW

SEQ ID NO: 1490905 - protein, 19 aa, Mycobacterium tuberculosis
RTDFHTEILRMQKAINAVA

SEQ ID NO: 1490906 - protein, 18 aa, Mycobacterium tuberculosis
RTEMGYPLHGHELSLDIS

SEQ ID NO: 1490907 - protein, 19 aa, Mycobacterium tuberculosis
RTEPGRAVFRTEVAGSGRG

SEQ ID NO: 1490908 - protein, 20 aa, Mycobacterium tuberculosis
RTEPPVAILAAPQQAMHLQR

SEQ ID NO: 1490909 - protein, 22 aa, Mycobacterium tuberculosis
RTFGMDSWFPSLKIYNRNGQLY

SEQ ID NO: 1490910 - protein, 25 aa, Mycobacterium tuberculosis
RTFGMDSWFPSLKIYNRNGQLYTAV

SEQ ID NO: 1490911 - protein, 19 aa, Mycobacterium tuberculosis
RTFSGLLDRFGRGKGCDIC

SEQ ID NO: 1490912 - protein, 17 aa, Mycobacterium tuberculosis
RTFTVKYKLAILDEYDR

SEQ ID NO: 1490913 - protein, 28 aa, Mycobacterium tuberculosis
RTGEHIGWRLWMGIAFELTSDPQELREL

SEQ ID NO: 1490914 - protein, 23 aa, Mycobacterium tuberculosis
RTGELIPLCHPLGIEAVTVTLEP

SEQ ID NO: 1490915 - protein, 25 aa, Mycobacterium tuberculosis
RTGELIPLCHRWGSRRSPSRSSRRA

SEQ ID NO: 1490916 - protein, 20 aa, Mycobacterium tuberculosis
RTGTRCAAPGRARGKSERPG

SEQ ID NO: 1490917 - protein, 17 aa, Mycobacterium tuberculosis
RTGVLGLLAGRHGGLAH

SEQ ID NO: 1490918 - protein, 18 aa, Mycobacterium tuberculosis
RTGVMMGLSSWDYTIVNI

SEQ ID NO: 1490919 - protein, 21 aa, Mycobacterium tuberculosis
RTHPHRPAAVADHSGLHHPGR

SEQ ID NO: 1490920 - protein, 19 aa, Mycobacterium tuberculosis
RTHTRFGPVQADGRYLLRT

SEQ ID NO: 1490921 - protein, 17 aa, Mycobacterium tuberculosis
RTIGRVLDGPARVLVDG

SEQ ID NO: 1490922 - protein, 18 aa, Mycobacterium tuberculosis
RTIHKHKVNLLFFTGDAM

SEQ ID NO: 1490923 - protein, 17 aa, Mycobacterium tuberculosis
RTIQIEAGVFLWCTPGD

SEQ ID NO: 1490924 - protein, 19 aa, Mycobacterium tuberculosis
RTKLLRLFPTIFKGAHVEL

SEQ ID NO: 1490925 - protein, 21 aa, Mycobacterium tuberculosis
RTLDGWQDWAKQRGHRGLAYV

SEQ ID NO: 1490926 - protein, 23 aa, Mycobacterium tuberculosis
RTLDSCVRDGLMSSRAAETAETL

SEQ ID NO: 1490927 - protein, 28 aa, Mycobacterium tuberculosis
RTLFRRDQIGIVFQFFNLIPTLTVLENI

SEQ ID NO: 1490928 - protein, 27 aa, Mycobacterium tuberculosis
RTLFRRDQIGIVFQFFNLIPTLTVLKN

SEQ ID NO: 1490929 - protein, 17 aa, Mycobacterium tuberculosis
RTLHGWNGALAAGPTLA

SEQ ID NO: 1490930 - protein, 23 aa, Mycobacterium tuberculosis
RTLQAGADIALWVTTKEVPAVLD

SEQ ID NO: 1490931 - protein, 19 aa, Mycobacterium tuberculosis
RTLTANGLRQLIAFLSRMT

SEQ ID NO: 1490932 - protein, 22 aa, Mycobacterium tuberculosis
RTLTFPGFLKAYVETVDELVGG

SEQ ID NO: 1490933 - protein, 22 aa, Mycobacterium tuberculosis
RTMRALDWFEVQSIRGHLVDGA

SEQ ID NO: 1490934 - protein, 22 aa, Mycobacterium tuberculosis
RTMVELLPRFETITYRELWARA

SEQ ID NO: 1490935 - protein, 20 aa, Mycobacterium tuberculosis
RTPIPKVYLCSAATPPGAGV

SEQ ID NO: 1490936 - protein, 27 aa, Mycobacterium tuberculosis
RTPSSKARSTSCPRTRAGGTRRFSTTT

SEQ ID NO: 1490937 - protein, 25 aa, Mycobacterium tuberculosis
RTQIRQIPRGCCHEFRCDQHERHGR

SEQ ID NO: 1490938 - protein, 19 aa, Mycobacterium tuberculosis
RTQSSWELVTDALARSRSG

SEQ ID NO: 1490939 - protein, 20 aa, Mycobacterium tuberculosis
RTRHECTGLSSPIDALDGVS

SEQ ID NO: 1490940 - protein, 20 aa, Mycobacterium tuberculosis
RTRHRRATALAGRPDQAQPG

SEQ ID NO: 1490941 - protein, 23 aa, Mycobacterium tuberculosis
RTRLWRPQRFRHHGAAGADVRRR

SEQ ID NO: 1490942 - protein, 24 aa, Mycobacterium tuberculosis
RTRPMGCAPFGRAQVPAGRALRCG

SEQ ID NO: 1490943 - protein, 19 aa, Mycobacterium tuberculosis
RTRQSFALSARAVINAAGV

SEQ ID NO: 1490944 - protein, 20 aa, Mycobacterium tuberculosis
RTRRALPVGSAGPVEPPSGC

SEQ ID NO: 1490945 - protein, 21 aa, Mycobacterium tuberculosis
RTRRIGIPAAAPRRSRRLRHP

SEQ ID NO: 1490946 - protein, 19 aa, Mycobacterium tuberculosis
RTRSGAALPRSSDRARPFV

SEQ ID NO: 1490947 - protein, 18 aa, Mycobacterium tuberculosis
RTRYAKCGDMDIAYQVLG

SEQ ID NO: 1490948 - protein, 17 aa, Mycobacterium tuberculosis
RTSAGPLNIPIIDIPAA

SEQ ID NO: 1490949 - protein, 18 aa, Mycobacterium tuberculosis
RTSAYPAARRSRKASERN

SEQ ID NO: 1490950 - protein, 22 aa, Mycobacterium tuberculosis
RTSDLLICQKMDMNVHGKHDGL

SEQ ID NO: 1490951 - protein, 22 aa, Mycobacterium tuberculosis
RTSEAYRVMSMLAMDDPAHLRM

SEQ ID NO: 1490952 - protein, 24 aa, Mycobacterium tuberculosis
RTSLAPIRLRIGLHTGEVQLRDEL

SEQ ID NO: 1490953 - protein, 23 aa, Mycobacterium tuberculosis
RTSNEAAFCYQLLVRSFGTNNLP

SEQ ID NO: 1490954 - protein, 19 aa, Mycobacterium tuberculosis
RTSTSMSRWSGVVCAGEGD

SEQ ID NO: 1490955 - protein, 19 aa, Mycobacterium tuberculosis
RTTCGRRDLADYVPTQDAE

SEQ ID NO: 1490956 - protein, 23 aa, Mycobacterium tuberculosis
RTTLYVTCEVVRIAALLIQPVMP

SEQ ID NO: 1490957 - protein, 17 aa, Mycobacterium tuberculosis
RTTPSIVAFARNGEVLV

SEQ ID NO: 1490958 - protein, 17 aa, Mycobacterium tuberculosis
RTTRAGERITVTRAAAM

SEQ ID NO: 1490959 - protein, 18 aa, Mycobacterium tuberculosis
RTTVPAVTVWQGRTGAMA

SEQ ID NO: 1490960 - protein, 17 aa, Mycobacterium tuberculosis
RTVALTVYGDLETSTLR

SEQ ID NO: 1490961 - protein, 32 aa, Mycobacterium tuberculosis
RTVCGWRRFARWRGTRARKCCAARRTLRRRRT

SEQ ID NO: 1490962 - protein, 17 aa, Mycobacterium tuberculosis
RTVDFKNTVLIFTSNLG

SEQ ID NO: 1490963 - protein, 18 aa, Mycobacterium tuberculosis
RTVDFKNTVLILRPIWAP

SEQ ID NO: 1490964 - protein, 17 aa, Mycobacterium tuberculosis
RTVLCKDPFRAVDERVK

SEQ ID NO: 1490965 - protein, 27 aa, Mycobacterium tuberculosis
RTVLRLDPRLAPVKAAVLPLSRHADLS

SEQ ID NO: 1490966 - protein, 20 aa, Mycobacterium tuberculosis
RTVRARIAGLDYRLDVNTLH

SEQ ID NO: 1490967 - protein, 21 aa, Mycobacterium tuberculosis
RVAAEARLRYLADHDDLTGLH

SEQ ID NO: 1490968 - protein, 27 aa, Mycobacterium tuberculosis
RVAALAAVNCFAWRPTGPLFRGMLAAM

SEQ ID NO: 1490969 - protein, 17 aa, Mycobacterium tuberculosis
RVAECLAAIEAPLVITP

SEQ ID NO: 1490970 - protein, 22 aa, Mycobacterium tuberculosis
RVAELLDIVGLRHGDASRYPAE

SEQ ID NO: 1490971 - protein, 17 aa, Mycobacterium tuberculosis
RVAGKPAPALMTEAVAR

SEQ ID NO: 1490972 - protein, 18 aa, Mycobacterium tuberculosis
RVAGLAVRHARLRQVAPA

SEQ ID NO: 1490973 - protein, 22 aa, Mycobacterium tuberculosis
RVALGALLRRIRNYEVDDDNVV

SEQ ID NO: 1490974 - protein, 18 aa, Mycobacterium tuberculosis
RVALGRGGDAGFFYGNGG

SEQ ID NO: 1490975 - protein, 20 aa, Mycobacterium tuberculosis
RVALVVGLELEKTVPGDTAA

SEQ ID NO: 1490976 - protein, 18 aa, Mycobacterium tuberculosis
RVAPADMIGPIWRRDEVF

SEQ ID NO: 1490977 - protein, 26 aa, Mycobacterium tuberculosis
RVAPLAAVNCFAWRPTGPLFRGMLAA

SEQ ID NO: 1490978 - protein, 19 aa, Mycobacterium tuberculosis
RVAPVERIRLVNSGTEATM

SEQ ID NO: 1490979 - protein, 22 aa, Mycobacterium tuberculosis
RVAVVDWLYWQYVTGLLDRALA

SEQ ID NO: 1490980 - protein, 17 aa, Mycobacterium tuberculosis
RVCGAIGVIECDRPVDL

SEQ ID NO: 1490981 - protein, 19 aa, Mycobacterium tuberculosis
RVCVAGGRQPLRRGRPVRG

SEQ ID NO: 1490982 - protein, 18 aa, Mycobacterium tuberculosis
RVCVARGTTSLRRIREIA

SEQ ID NO: 1490983 - protein, 23 aa, Mycobacterium tuberculosis
RVDPTRRCVRCGSDVVRAVVVGA

SEQ ID NO: 1490984 - protein, 22 aa, Mycobacterium tuberculosis
RVDQLPLIWQRLVDGGMESGHA

SEQ ID NO: 1490985 - protein, 25 aa, Mycobacterium tuberculosis
RVDTVLRAKVDGAWNLHELTEDMDL

SEQ ID NO: 1490986 - protein, 25 aa, Mycobacterium tuberculosis
RVELRSCSRRGAAIDVVAARARENR

SEQ ID NO: 1490987 - protein, 18 aa, Mycobacterium tuberculosis
RVFAELSPHPLLTHAVDQ

SEQ ID NO: 1490988 - protein, 29 aa, Mycobacterium tuberculosis
RVFGRRVAVVACEFDFLGGSIGVAAAERI

SEQ ID NO: 1490989 - protein, 20 aa, Mycobacterium tuberculosis
RVGAASAVWVGLVVAPAGRV

SEQ ID NO: 1490990 - protein, 20 aa, Mycobacterium tuberculosis
RVGARIILLNSEFSGPQIKE

SEQ ID NO: 1490991 - protein, 19 aa, Mycobacterium tuberculosis
RVGGSAVRVLASVAQARRG

SEQ ID NO: 1490992 - protein, 18 aa, Mycobacterium tuberculosis
RVGHSLDPKADYGPLVTG

SEQ ID NO: 1490993 - protein, 17 aa, Mycobacterium tuberculosis
RVGRDVPGFIGNRLQHA

SEQ ID NO: 1490994 - protein, 22 aa, Mycobacterium tuberculosis
RVGRRFGCVVMDGFGSTEGGVA

SEQ ID NO: 1490995 - protein, 24 aa, Mycobacterium tuberculosis
RVGRRHGCPSGRAHRGGGPRGAGR

SEQ ID NO: 1490996 - protein, 18 aa, Mycobacterium tuberculosis
RVGSYLRYGAYPYAIAVR

SEQ ID NO: 1490997 - protein, 21 aa, Mycobacterium tuberculosis
RVHGPLALAVGRRLRDRYGID

SEQ ID NO: 1490998 - protein, 23 aa, Mycobacterium tuberculosis
RVHRVPSRMFPKVTMLPLGVPTF

SEQ ID NO: 1490999 - protein, 25 aa, Mycobacterium tuberculosis
RVHVPEIPAHVTVEVPVNIPITASF

SEQ ID NO: 1491000 - protein, 18 aa, Mycobacterium tuberculosis
RVIAPRFSLFDVYTDIAF

SEQ ID NO: 1491001 - protein, 23 aa, Mycobacterium tuberculosis
RVICRRSALMTRIAGAGAMASVE

SEQ ID NO: 1491002 - protein, 21 aa, Mycobacterium tuberculosis
RVICRRSKLMTRIAGAGAMGS

SEQ ID NO: 1491003 - protein, 17 aa, Mycobacterium tuberculosis
RVIDRAPLWCAVDLRDG

SEQ ID NO: 1491004 - protein, 20 aa, Mycobacterium tuberculosis
RVIPVVKELAAQGITVSIDT

SEQ ID NO: 1491005 - protein, 20 aa, Mycobacterium tuberculosis
RVIRSAKLLGIDAAIVGDLM

SEQ ID NO: 1491006 - protein, 22 aa, Mycobacterium tuberculosis
RVISGLQMLLHQAFAQVEQFTG

SEQ ID NO: 1491007 - protein, 21 aa, Mycobacterium tuberculosis
RVISPPGLSSPATWATAPSGA

SEQ ID NO: 1491008 - protein, 24 aa, Mycobacterium tuberculosis
RVLAIWPDWVRRWPTPSATATAST

SEQ ID NO: 1491009 - protein, 20 aa, Mycobacterium tuberculosis
RVLARREFAGMISVAIDSAD

SEQ ID NO: 1491010 - protein, 25 aa, Mycobacterium tuberculosis
RVLHNYRPQFYFRPTDVTGVVTLPE

SEQ ID NO: 1491011 - protein, 17 aa, Mycobacterium tuberculosis
RVLKPGGRFVFAGEPTT

SEQ ID NO: 1491012 - protein, 24 aa, Mycobacterium tuberculosis
RVLPLLGGLAVMFGDLPPLPTTAR

SEQ ID NO: 1491013 - protein, 24 aa, Mycobacterium tuberculosis
RVLPLRPDVVIAFMDQFGDVIYNN

SEQ ID NO: 1491014 - protein, 17 aa, Mycobacterium tuberculosis
RVLTRCQMSFVVTIPEA

SEQ ID NO: 1491015 - protein, 33 aa, Mycobacterium tuberculosis
RVLVGRGQRTAWHPGAIGRRGAGRQGGRRSGAD

SEQ ID NO: 1491016 - protein, 34 aa, Mycobacterium tuberculosis
RVLVGRGQRTAWHPGAIGRRGAGRQGGRRSGADR

SEQ ID NO: 1491017 - protein, 19 aa, Mycobacterium tuberculosis
RVMGLLGLVGSEAVVDARL

SEQ ID NO: 1491018 - protein, 18 aa, Mycobacterium tuberculosis
RVMLKQLQPFVASSLKQA

SEQ ID NO: 1491019 - protein, 22 aa, Mycobacterium tuberculosis
RVNSPGWRRAMAARKRIDDLID

SEQ ID NO: 1491020 - protein, 20 aa, Mycobacterium tuberculosis
RVPAKALWRAQTQRAVQNFP

SEQ ID NO: 1491021 - protein, 25 aa, Mycobacterium tuberculosis
RVPCLPSDRLLNLLIYIKGYLDGTL

SEQ ID NO: 1491022 - protein, 26 aa, Mycobacterium tuberculosis
RVPGMIRLVRHSIALVAAGLAAALSG

SEQ ID NO: 1491023 - protein, 18 aa, Mycobacterium tuberculosis
RVPGSVVVVSIFVNPMQF

SEQ ID NO: 1491024 - protein, 20 aa, Mycobacterium tuberculosis
RVQELFEARVPRGKAPIADV

SEQ ID NO: 1491025 - protein, 22 aa, Mycobacterium tuberculosis
RVQELFEARVPRGKAPIADVTG

SEQ ID NO: 1491026 - protein, 18 aa, Mycobacterium tuberculosis
RVRACGLFLPALANARLT

SEQ ID NO: 1491027 - protein, 25 aa, Mycobacterium tuberculosis
RVRAKRPDGDWGPWYQTEYETEPRD

SEQ ID NO: 1491028 - protein, 20 aa, Mycobacterium tuberculosis
RVRARAIAWLDTSRSTRRGS

SEQ ID NO: 1491029 - protein, 18 aa, Mycobacterium tuberculosis
RVRCRRPGGSHLSPGGYR

SEQ ID NO: 1491030 - protein, 18 aa, Mycobacterium tuberculosis
RVRELRPLYLPPDPASRD

SEQ ID NO: 1491031 - protein, 28 aa, Mycobacterium tuberculosis
RVRGAALPWQDLRAAFTERGWLDLTHTR

SEQ ID NO: 1491032 - protein, 23 aa, Mycobacterium tuberculosis
RVRLCKRDAKLFARPQQLPQTDD

SEQ ID NO: 1491033 - protein, 17 aa, Mycobacterium tuberculosis
RVRLLLYTRVTQIDRAT

SEQ ID NO: 1491034 - protein, 19 aa, Mycobacterium tuberculosis
RVRPVLPDPVGLLRCAGGA

SEQ ID NO: 1491035 - protein, 20 aa, Mycobacterium tuberculosis
RVRQAIPLINTYVMSLGESL

SEQ ID NO: 1491036 - protein, 21 aa, Mycobacterium tuberculosis
RVRTEPPLPGTRYTQIAVLED

SEQ ID NO: 1491037 - protein, 18 aa, Mycobacterium tuberculosis
RVRVGALDLTVDFDAGRR

SEQ ID NO: 1491038 - protein, 20 aa, Mycobacterium tuberculosis
RVRVWCGGTLVADHDRIWAK

SEQ ID NO: 1491039 - protein, 24 aa, Mycobacterium tuberculosis
RVSAELRAAGFTLPPSQANFVWLP

SEQ ID NO: 1491040 - protein, 21 aa, Mycobacterium tuberculosis
RVSAQAWLAVTAVRAVPPGCG

SEQ ID NO: 1491041 - protein, 17 aa, Mycobacterium tuberculosis
RVSASSWYVDAGTASTE

SEQ ID NO: 1491042 - protein, 24 aa, Mycobacterium tuberculosis
RVSESPWALMHFMVRLPEVGVAGE

SEQ ID NO: 1491043 - protein, 18 aa, Mycobacterium tuberculosis
RVSHGWVRRRPVWPLRPH

SEQ ID NO: 1491044 - protein, 18 aa, Mycobacterium tuberculosis
RVSRAMFNELWAGFDPDE

SEQ ID NO: 1491045 - protein, 17 aa, Mycobacterium tuberculosis
RVTAAALRRCDLAQPRD

SEQ ID NO: 1491046 - protein, 17 aa, Mycobacterium tuberculosis
RVTGAPLGLDRPWFVED

SEQ ID NO: 1491047 - protein, 19 aa, Mycobacterium tuberculosis
RVTGCAEWSTGQGPLNSTA

SEQ ID NO: 1491048 - protein, 17 aa, Mycobacterium tuberculosis
RVTLPYTDESWKTICEV

SEQ ID NO: 1491049 - protein, 26 aa, Mycobacterium tuberculosis
RVTLVIRGSCLLRHCDDTICERFTRI

SEQ ID NO: 1491050 - protein, 26 aa, Mycobacterium tuberculosis
RVVAAARGRPVVDFGARRAHGTDAAC

SEQ ID NO: 1491051 - protein, 19 aa, Mycobacterium tuberculosis
RVVDRPAWIRSAAESMRAM

SEQ ID NO: 1491052 - protein, 18 aa, Mycobacterium tuberculosis
RVVGGAVEAAGWFGVAMI

SEQ ID NO: 1491053 - protein, 19 aa, Mycobacterium tuberculosis
RVVGHKVGLSSPIMQQMMG

SEQ ID NO: 1491054 - protein, 20 aa, Mycobacterium tuberculosis
RVVSKPAALVHGMFVALPAA

SEQ ID NO: 1491055 - protein, 32 aa, Mycobacterium tuberculosis
RVVTGVPLWTTRAKRWLRRRTGAEHPAVAWAT

SEQ ID NO: 1491056 - protein, 19 aa, Mycobacterium tuberculosis
RVVVCRRLGPAKGQRRWRP

SEQ ID NO: 1491057 - protein, 20 aa, Mycobacterium tuberculosis
RVVVMPWDRHIAAGTEISLD

SEQ ID NO: 1491058 - protein, 25 aa, Mycobacterium tuberculosis
RVVVPDFQLSLAIGKDGQNARLAAR

SEQ ID NO: 1491059 - protein, 17 aa, Mycobacterium tuberculosis
RVWRCAEPLTEDATADR

SEQ ID NO: 1491060 - protein, 18 aa, Mycobacterium tuberculosis
RVWWQLRNPFTPSWGEPY

SEQ ID NO: 1491061 - protein, 20 aa, Mycobacterium tuberculosis
RVYCPGWVALFRWLKPLLST

SEQ ID NO: 1491062 - protein, 25 aa, Mycobacterium tuberculosis
RVYRWKPAPLGGVFDHLVTAIARRQ

SEQ ID NO: 1491063 - protein, 23 aa, Mycobacterium tuberculosis
RWEYRQLAGPTRWHADAPPPHQI

SEQ ID NO: 1491064 - protein, 19 aa, Mycobacterium tuberculosis
RWHLVRLFVCQRQRRVGLL

SEQ ID NO: 1491065 - protein, 19 aa, Mycobacterium tuberculosis
RWIAEDHTVALFLDKDRVL

SEQ ID NO: 1491066 - protein, 22 aa, Mycobacterium tuberculosis
RWLADHVIAGVVLLAGAAFVEL

SEQ ID NO: 1491067 - protein, 22 aa, Mycobacterium tuberculosis
RWLAGCSDLGAGCRPVDTRLVI

SEQ ID NO: 1491068 - protein, 19 aa, Mycobacterium tuberculosis
RWLSAEAMAARLNDVGVGR

SEQ ID NO: 1491069 - protein, 22 aa, Mycobacterium tuberculosis
RWLSGQLGRPLSLIAETDRNDP

SEQ ID NO: 1491070 - protein, 22 aa, Mycobacterium tuberculosis
RWPERRWRHAAAGTGRAHRTGR

SEQ ID NO: 1491071 - protein, 21 aa, Mycobacterium tuberculosis
RWPSPMRKWDCWSPTRTRTGS

SEQ ID NO: 1491072 - protein, 18 aa, Mycobacterium tuberculosis
RWPVWEAAGVTMMVVTAG

SEQ ID NO: 1491073 - protein, 17 aa, Mycobacterium tuberculosis
RWREYCLSSVTTHDLPP

SEQ ID NO: 1491074 - protein, 20 aa, Mycobacterium tuberculosis
RWRHGAAVSVGLVFAAELAR

SEQ ID NO: 1491075 - protein, 21 aa, Mycobacterium tuberculosis
RWRHSTSPWLAVPGPVRTRRK

SEQ ID NO: 1491076 - protein, 18 aa, Mycobacterium tuberculosis
RWRPCTPPVESFYSSEGL

SEQ ID NO: 1491077 - protein, 20 aa, Mycobacterium tuberculosis
RWRPGHGDGDRAPRVSEALE

SEQ ID NO: 1491078 - protein, 18 aa, Mycobacterium tuberculosis
RWRPWRSYATQHLWTTLE

SEQ ID NO: 1491079 - protein, 25 aa, Mycobacterium tuberculosis
RWRRWRPEGLGVGGPVYRDDLAERG

SEQ ID NO: 1491080 - protein, 25 aa, Mycobacterium tuberculosis
RWRYRLRPEPAFCRRPRRPPTDAPK

SEQ ID NO: 1491081 - protein, 32 aa, Mycobacterium tuberculosis
RWSALLVGAWWPARPDAPMAGVTYWRKAAQLK

SEQ ID NO: 1491082 - protein, 23 aa, Mycobacterium tuberculosis
RWSAVLVGAWWPAPSAALRAAAQ

SEQ ID NO: 1491083 - protein, 22 aa, Mycobacterium tuberculosis
RWSAVLVGPWWPAPSAALRAAA

SEQ ID NO: 1491084 - protein, 17 aa, Mycobacterium tuberculosis
RWSRGRVLLIGDAAGCI

SEQ ID NO: 1491085 - protein, 18 aa, Mycobacterium tuberculosis
RWSVPPVRPPVTVVQALP

SEQ ID NO: 1491086 - protein, 20 aa, Mycobacterium tuberculosis
RWTAGQAPDASGYWAAPAVA

SEQ ID NO: 1491087 - protein, 20 aa, Mycobacterium tuberculosis
RWTTRVWVRPARCWGPRRWR

SEQ ID NO: 1491088 - protein, 23 aa, Mycobacterium tuberculosis
RWWERPYIAAGIFLYDRLGGAKS

SEQ ID NO: 1491089 - protein, 19 aa, Mycobacterium tuberculosis
RWWRPAGSLFDQFLGAAET

SEQ ID NO: 1491090 - protein, 25 aa, Mycobacterium tuberculosis
RYACELYDLPTLWQIAAHNPWLSVS

SEQ ID NO: 1491091 - protein, 20 aa, Mycobacterium tuberculosis
RYARCLGSAVNPVLRQGNSD

SEQ ID NO: 1491092 - protein, 20 aa, Mycobacterium tuberculosis
RYATMCGMTGTALAAGEQLR

SEQ ID NO: 1491093 - protein, 17 aa, Mycobacterium tuberculosis
RYCDGIRTVGPAVNAAA

SEQ ID NO: 1491094 - protein, 20 aa, Mycobacterium tuberculosis
RYDPAALRRTRISARSRDLC

SEQ ID NO: 1491095 - protein, 19 aa, Mycobacterium tuberculosis
RYDVTFSLGDGLRPGSIAD

SEQ ID NO: 1491096 - protein, 22 aa, Mycobacterium tuberculosis
RYEAWSFPDFATGVAALRTITQ

SEQ ID NO: 1491097 - protein, 21 aa, Mycobacterium tuberculosis
RYEVHFACDPRFNKLLGPLPF

SEQ ID NO: 1491098 - protein, 17 aa, Mycobacterium tuberculosis
RYFVPRFAASPITNDND

SEQ ID NO: 1491099 - protein, 24 aa, Mycobacterium tuberculosis
RYGGVTICQWTRYFPAGDPVAADV

SEQ ID NO: 1491100 - protein, 19 aa, Mycobacterium tuberculosis
RYGLDGRLRGAPHMAANLD

SEQ ID NO: 1491101 - protein, 24 aa, Mycobacterium tuberculosis
RYGSFRRSFWLPAHVTSEAIAASY

SEQ ID NO: 1491102 - protein, 26 aa, Mycobacterium tuberculosis
RYGSILCAAHCARFYGGESLKGTDGE

SEQ ID NO: 1491103 - protein, 20 aa, Mycobacterium tuberculosis
RYIAPHYLGYAFSGLYTPAQ

SEQ ID NO: 1491104 - protein, 17 aa, Mycobacterium tuberculosis
RYINRRSAGVIPDCGIT

SEQ ID NO: 1491105 - protein, 19 aa, Mycobacterium tuberculosis
RYLEVWNLVFMQNERGEGT

SEQ ID NO: 1491106 - protein, 26 aa, Mycobacterium tuberculosis
RYLLGSRSALGWIIDRYRVTTDKASG

SEQ ID NO: 1491107 - protein, 23 aa, Mycobacterium tuberculosis
RYLSPRVEVEVGFILAADLPGAG

SEQ ID NO: 1491108 - protein, 22 aa, Mycobacterium tuberculosis
RYLTPHSKWSFHSTYQDNLYML

SEQ ID NO: 1491109 - protein, 25 aa, Mycobacterium tuberculosis
RYNVANCLVALAILDTVGVSPEQAG

SEQ ID NO: 1491110 - protein, 17 aa, Mycobacterium tuberculosis
RYPATAFTDAIDARSTV

SEQ ID NO: 1491111 - protein, 19 aa, Mycobacterium tuberculosis
RYPAVAGFAEPDGRRHVCR

SEQ ID NO: 1491112 - protein, 23 aa, Mycobacterium tuberculosis
RYPPACPVPSIPVSRRRRSMGAP

SEQ ID NO: 1491113 - protein, 18 aa, Mycobacterium tuberculosis
RYPQLFRPILRQINIGVH

SEQ ID NO: 1491114 - protein, 28 aa, Mycobacterium tuberculosis
RYPTARSRGRRKPAICQCRSRPSGCTAT

SEQ ID NO: 1491115 - protein, 19 aa, Mycobacterium tuberculosis
RYPVFSWQRITLQEMTHMR

SEQ ID NO: 1491116 - protein, 19 aa, Mycobacterium tuberculosis
RYRALDFGLDVGRAQPPAS

SEQ ID NO: 1491117 - protein, 26 aa, Mycobacterium tuberculosis
RYRAQRGQSDWVRWFQFGQRECGIVQ

SEQ ID NO: 1491118 - protein, 17 aa, Mycobacterium tuberculosis
RYRGMRYSSCYVTMRDG

SEQ ID NO: 1491119 - protein, 22 aa, Mycobacterium tuberculosis
RYRIDRVPRYELVRCGLDVPDG

SEQ ID NO: 1491120 - protein, 17 aa, Mycobacterium tuberculosis
RYRIYRPAVVVGDSRTG

SEQ ID NO: 1491121 - protein, 22 aa, Mycobacterium tuberculosis
RYRLLCERRQWCHRRERRGRCA

SEQ ID NO: 1491122 - protein, 18 aa, Mycobacterium tuberculosis
RYRQLLQHILQHVADGKL

SEQ ID NO: 1491123 - protein, 24 aa, Mycobacterium tuberculosis
RYSGLLEHLASWGIVAAAPDSERG

SEQ ID NO: 1491124 - protein, 27 aa, Mycobacterium tuberculosis
RYSPAELACALGLFPPTAEQAAVIAAP

SEQ ID NO: 1491125 - protein, 19 aa, Mycobacterium tuberculosis
RYVRARPALDVVGVGYSLV

SEQ ID NO: 1491126 - protein, 27 aa, Mycobacterium tuberculosis
RYWGPPSKPGIILFRRAGAPAALADSV

SEQ ID NO: 1491127 - protein, 23 aa, Mycobacterium tuberculosis
SAAAFDRNWVAGLVGLMVHSIEL

SEQ ID NO: 1491128 - protein, 19 aa, Mycobacterium tuberculosis
SAADPFVIALAMVNNATVV

SEQ ID NO: 1491129 - protein, 27 aa, Mycobacterium tuberculosis
SAADWEVLEAGLVQRSRLLDAILADLY

SEQ ID NO: 1491130 - protein, 31 aa, Mycobacterium tuberculosis
SAAENYGSVIARLTGMHWWGPASTSMLAMSA

SEQ ID NO: 1491131 - protein, 19 aa, Mycobacterium tuberculosis
SAAIAALFGAHAQAYQTIS

SEQ ID NO: 1491132 - protein, 18 aa, Mycobacterium tuberculosis
SAAIAALFGAHGRAYQAA

SEQ ID NO: 1491133 - protein, 19 aa, Mycobacterium tuberculosis
SAAIAALFSAHGRAYQVAS

SEQ ID NO: 1491134 - protein, 18 aa, Mycobacterium tuberculosis
SAAIAALFSSHGQQYQAM

SEQ ID NO: 1491135 - protein, 18 aa, Mycobacterium tuberculosis
SAAIASLFSGNAQAYQAL

SEQ ID NO: 1491136 - protein, 19 aa, Mycobacterium tuberculosis
SAAIATLFGSHAREYQAIS

SEQ ID NO: 1491137 - protein, 19 aa, Mycobacterium tuberculosis
SAALAELLERIRASVERLS

SEQ ID NO: 1491138 - protein, 18 aa, Mycobacterium tuberculosis
SAAMAALFGAHAQEYQRL

SEQ ID NO: 1491139 - protein, 17 aa, Mycobacterium tuberculosis
SAAMLCVGSVGLDHVRG

SEQ ID NO: 1491140 - protein, 22 aa, Mycobacterium tuberculosis
SAAPLFHNIAGWLMQRENVPLS

SEQ ID NO: 1491141 - protein, 18 aa, Mycobacterium tuberculosis
SAARRAGDRAGRQARLGN

SEQ ID NO: 1491142 - protein, 18 aa, Mycobacterium tuberculosis
SAARRGRPLCADRPSASL

SEQ ID NO: 1491143 - protein, 17 aa, Mycobacterium tuberculosis
SAASAFQSVVWGLTVGS

SEQ ID NO: 1491144 - protein, 18 aa, Mycobacterium tuberculosis
SAAVAALFGSYAQSYQAF

SEQ ID NO: 1491145 - protein, 19 aa, Mycobacterium tuberculosis
SAAVARQQVAPWWRRRPHR

SEQ ID NO: 1491146 - protein, 27 aa, Mycobacterium tuberculosis
SAAVARQQVAPWWRRRPHRSLTSLGQW

SEQ ID NO: 1491147 - protein, 17 aa, Mycobacterium tuberculosis
SACLPVRSRPCGCQPTH

SEQ ID NO: 1491148 - protein, 17 aa, Mycobacterium tuberculosis
SACRPLYYLEMPPALFA

SEQ ID NO: 1491149 - protein, 18 aa, Mycobacterium tuberculosis
SACTAGPARAEDRAAGAA

SEQ ID NO: 1491150 - protein, 43 aa, Mycobacterium tuberculosis
SADDVPRGISFLLNRNRLNVAVSRAQYAAVIVRSELLTQYLPA

SEQ ID NO: 1491151 - protein, 26 aa, Mycobacterium tuberculosis
SADEVSVAVAALFGTHAQEYQTVSAQ

SEQ ID NO: 1491152 - protein, 21 aa, Mycobacterium tuberculosis
SADINVGLIYGIDVTGYSRVD

SEQ ID NO: 1491153 - protein, 20 aa, Mycobacterium tuberculosis
SADNMREYLAAGAKERQRLA

SEQ ID NO: 1491154 - protein, 23 aa, Mycobacterium tuberculosis
SADPRVSAILDRPLQAVEHERTE

SEQ ID NO: 1491155 - protein, 22 aa, Mycobacterium tuberculosis
SADSRAHCPLLCTDDPLPGTVP

SEQ ID NO: 1491156 - protein, 27 aa, Mycobacterium tuberculosis
SAEKRRWRQASTDVDGAGGYGGSGGRG

SEQ ID NO: 1491157 - protein, 18 aa, Mycobacterium tuberculosis
SAEVDVWFANKIGGADWV

SEQ ID NO: 1491158 - protein, 33 aa, Mycobacterium tuberculosis
SAFCSAHPLAKVQVCSRLAATELYRRLREFELD

SEQ ID NO: 1491159 - protein, 21 aa, Mycobacterium tuberculosis
SAFHPLGVGSPFWAAIDLQRY

SEQ ID NO: 1491160 - protein, 23 aa, Mycobacterium tuberculosis
SAFVVRISCHLRIQNQAADDDVK

SEQ ID NO: 1491161 - protein, 24 aa, Mycobacterium tuberculosis
SAGAGLMRAGSLPGEAGSAARTPL

SEQ ID NO: 1491162 - protein, 25 aa, Mycobacterium tuberculosis
SAGGDGGRGGFGGDGLDASSGGNGG

SEQ ID NO: 1491163 - protein, 17 aa, Mycobacterium tuberculosis
SAGGWRLVAGGGGTLAD

SEQ ID NO: 1491164 - protein, 24 aa, Mycobacterium tuberculosis
SAGHTATSWGHEGAALGSVDTVNA

SEQ ID NO: 1491165 - protein, 19 aa, Mycobacterium tuberculosis
SAGIAALFGARAQAYQAIS

SEQ ID NO: 1491166 - protein, 18 aa, Mycobacterium tuberculosis
SAGLIGIGGTGGAGGAGA

SEQ ID NO: 1491167 - protein, 17 aa, Mycobacterium tuberculosis
SAGPGLWSGPSWGFAAK

SEQ ID NO: 1491168 - protein, 23 aa, Mycobacterium tuberculosis
SAGRAVIVTGDFNARYSDDQSAL

SEQ ID NO: 1491169 - protein, 22 aa, Mycobacterium tuberculosis
SAGRGGDAGFFYGNGGEGGDGG

SEQ ID NO: 1491170 - protein, 23 aa, Mycobacterium tuberculosis
SAGSLPVPPDWAARARWANPAAW

SEQ ID NO: 1491171 - protein, 23 aa, Mycobacterium tuberculosis
SAHAGVVSPGFIGAPLALAALGQ

SEQ ID NO: 1491172 - protein, 24 aa, Mycobacterium tuberculosis
SAHAGVVSPGFIGAPLALAALGQM

SEQ ID NO: 1491173 - protein, 21 aa, Mycobacterium tuberculosis
SAHRRRDRCPGGRARGQRLAG

SEQ ID NO: 1491174 - protein, 25 aa, Mycobacterium tuberculosis
SAHRRVGRWFFRWERQTRRCMAAPG

SEQ ID NO: 1491175 - protein, 20 aa, Mycobacterium tuberculosis
SAIQRWPSWTLPPGASASKA

SEQ ID NO: 1491176 - protein, 21 aa, Mycobacterium tuberculosis
SAIRAIGGRGEVLAVGSGAPV

SEQ ID NO: 1491177 - protein, 19 aa, Mycobacterium tuberculosis
SALGLGRVEHVVCDVTSTA

SEQ ID NO: 1491178 - protein, 23 aa, Mycobacterium tuberculosis
SALGPKLPELWGGSADLAGSNNT

SEQ ID NO: 1491179 - protein, 19 aa, Mycobacterium tuberculosis
SALHLARRGIEVEIFTRAT

SEQ ID NO: 1491180 - protein, 28 aa, Mycobacterium tuberculosis
SALHRSPWEICWSCRVRSASQTWAVGVV

SEQ ID NO: 1491181 - protein, 18 aa, Mycobacterium tuberculosis
SALIGYAQGGSGGLGGFG

SEQ ID NO: 1491182 - protein, 21 aa, Mycobacterium tuberculosis
SALLFPALCTPTGDPPAPEPA

SEQ ID NO: 1491183 - protein, 19 aa, Mycobacterium tuberculosis
SALNVGRTGGVGGNGGSGG

SEQ ID NO: 1491184 - protein, 24 aa, Mycobacterium tuberculosis
SALQNAASIAGLFLTTEAVVADKP

SEQ ID NO: 1491185 - protein, 23 aa, Mycobacterium tuberculosis
SALRAELGVALRAAIAGPVAGLA

SEQ ID NO: 1491186 - protein, 22 aa, Mycobacterium tuberculosis
SALTPVRGWVVRKLGPVTIDPR

SEQ ID NO: 1491187 - protein, 17 aa, Mycobacterium tuberculosis
SALVAELGEDAQVGFHG

SEQ ID NO: 1491188 - protein, 21 aa, Mycobacterium tuberculosis
SALVVPVRFAGVHVYGDITRG

SEQ ID NO: 1491189 - protein, 20 aa, Mycobacterium tuberculosis
SALWGQLQSWLRGVSPGLPS

SEQ ID NO: 1491190 - protein, 17 aa, Mycobacterium tuberculosis
SAMARSYLGPEFDIHCG

SEQ ID NO: 1491191 - protein, 17 aa, Mycobacterium tuberculosis
SAMMRRAGYMYGTVLAR

SEQ ID NO: 1491192 - protein, 17 aa, Mycobacterium tuberculosis
SAMQAVWIVAQQHGLAV

SEQ ID NO: 1491193 - protein, 18 aa, Mycobacterium tuberculosis
SANELLLYEALGLCGPGE

SEQ ID NO: 1491194 - protein, 21 aa, Mycobacterium tuberculosis
SAPGAGSIHAWFGSDPGPRRA

SEQ ID NO: 1491195 - protein, 17 aa, Mycobacterium tuberculosis
SAPIWRENHFFRLGDRR

SEQ ID NO: 1491196 - protein, 21 aa, Mycobacterium tuberculosis
SAPLRYGELIAALNATSGERA

SEQ ID NO: 1491197 - protein, 22 aa, Mycobacterium tuberculosis
SAPMCYPRADFLVGDRDILLGV

SEQ ID NO: 1491198 - protein, 23 aa, Mycobacterium tuberculosis
SAPMCYPRADFLVGDRDILLGVL

SEQ ID NO: 1491199 - protein, 22 aa, Mycobacterium tuberculosis
SAPMLAAAVAWDGLAAELGSAA

SEQ ID NO: 1491200 - protein, 17 aa, Mycobacterium tuberculosis
SAPMLAASVAWDGLAAE

SEQ ID NO: 1491201 - protein, 17 aa, Mycobacterium tuberculosis
SAPRAGTLLGQHTTVAT

SEQ ID NO: 1491202 - protein, 17 aa, Mycobacterium tuberculosis
SAPRRRRFMTGSSNCLT

SEQ ID NO: 1491203 - protein, 22 aa, Mycobacterium tuberculosis
SAQAAAFHARFVQALVETINAY

SEQ ID NO: 1491204 - protein, 24 aa, Mycobacterium tuberculosis
SAQAAAFHQQFVRALSSAAGSYAA

SEQ ID NO: 1491205 - protein, 25 aa, Mycobacterium tuberculosis
SAQAAAFHQQFVRALSSAAGSYAAA

SEQ ID NO: 1491206 - protein, 25 aa, Mycobacterium tuberculosis
SAQAAMFHEQFVRALAAGGNSYAVA

SEQ ID NO: 1491207 - protein, 17 aa, Mycobacterium tuberculosis
SAQACAWLASAIETAYC

SEQ ID NO: 1491208 - protein, 18 aa, Mycobacterium tuberculosis
SAQACAWLASAIETAYCA

SEQ ID NO: 1491209 - protein, 23 aa, Mycobacterium tuberculosis
SAQARLAALSILVGAVGATGPGV

SEQ ID NO: 1491210 - protein, 24 aa, Mycobacterium tuberculosis
SAQISRAGGWLSQHCEPPYAPLWI

SEQ ID NO: 1491211 - protein, 29 aa, Mycobacterium tuberculosis
SAQVATFHDRFVQTLSATASSYVAAEAVN

SEQ ID NO: 1491212 - protein, 25 aa, Mycobacterium tuberculosis
SAQVSACNAVRCLMWSESPDPTPVQ

SEQ ID NO: 1491213 - protein, 19 aa, Mycobacterium tuberculosis
SAQWCPRPWPDRPRRRLTT

SEQ ID NO: 1491214 - protein, 22 aa, Mycobacterium tuberculosis
SARCVPEAAAAAAGRHDTGPRR

SEQ ID NO: 1491215 - protein, 22 aa, Mycobacterium tuberculosis
SARELIARIRAVLRRGGDDDSE

SEQ ID NO: 1491216 - protein, 20 aa, Mycobacterium tuberculosis
SARELRGRILGVRRETEDSA

SEQ ID NO: 1491217 - protein, 22 aa, Mycobacterium tuberculosis
SARGRCGKVSSCANSTAKPTEP

SEQ ID NO: 1491218 - protein, 17 aa, Mycobacterium tuberculosis
SARGVTFSRGWLPFLPT

SEQ ID NO: 1491219 - protein, 25 aa, Mycobacterium tuberculosis
SARGVTFSRGWLPFLPTSDPPAHTR

SEQ ID NO: 1491220 - protein, 21 aa, Mycobacterium tuberculosis
SARRGDYRVVYAIDDGPPPSR

SEQ ID NO: 1491221 - protein, 19 aa, Mycobacterium tuberculosis
SARSCIILVFHRVADNPGR

SEQ ID NO: 1491222 - protein, 18 aa, Mycobacterium tuberculosis
SARYRPWMPAAGNHENEV

SEQ ID NO: 1491223 - protein, 19 aa, Mycobacterium tuberculosis
SARYWRLSWRTRFANSSPG

SEQ ID NO: 1491224 - protein, 18 aa, Mycobacterium tuberculosis
SASREVDASIVWCRDSSA

SEQ ID NO: 1491225 - protein, 26 aa, Mycobacterium tuberculosis
SASRRKSPRTLGVSGVFTSARPPKLP

SEQ ID NO: 1491226 - protein, 19 aa, Mycobacterium tuberculosis
SASRWRHIIPAGVVCALIA

SEQ ID NO: 1491227 - protein, 20 aa, Mycobacterium tuberculosis
SASTPGYRPMHWLRGPARGW

SEQ ID NO: 1491228 - protein, 24 aa, Mycobacterium tuberculosis
SATASLGSRSWRKASSSHRFSKRQ

SEQ ID NO: 1491229 - protein, 17 aa, Mycobacterium tuberculosis
SATPQWVTDLGNLSTFL

SEQ ID NO: 1491230 - protein, 25 aa, Mycobacterium tuberculosis
SATRSSAGFGAPRYGAKPIVMPKPA

SEQ ID NO: 1491231 - protein, 19 aa, Mycobacterium tuberculosis
SATTPRWPGCTAGTAPCAS

SEQ ID NO: 1491232 - protein, 17 aa, Mycobacterium tuberculosis
SATVKTIMRANGWRGVP

SEQ ID NO: 1491233 - protein, 27 aa, Mycobacterium tuberculosis
SAVAAQLAPWAQAVRALPNPTAPALAS

SEQ ID NO: 1491234 - protein, 26 aa, Mycobacterium tuberculosis
SAVCALEPYWEALRKVYAPFESGLPG

SEQ ID NO: 1491235 - protein, 31 aa, Mycobacterium tuberculosis
SAVPAAAAAPRCFSAAVGPVGTAALVGLTLA

SEQ ID NO: 1491236 - protein, 23 aa, Mycobacterium tuberculosis
SAVRAGALGARMTGGGFGGAVIA

SEQ ID NO: 1491237 - protein, 19 aa, Mycobacterium tuberculosis
SAVRFCTGGTVAGAETGAG

SEQ ID NO: 1491238 - protein, 19 aa, Mycobacterium tuberculosis
SAVRSGLDLAGFNKLADEL

SEQ ID NO: 1491239 - protein, 19 aa, Mycobacterium tuberculosis
SAVSFTYARHRPIRLNFAP

SEQ ID NO: 1491240 - protein, 21 aa, Mycobacterium tuberculosis
SAVSSRAGVEIAIDDNGSGVP

SEQ ID NO: 1491241 - protein, 25 aa, Mycobacterium tuberculosis
SAVTAGLCRALARRGVGVAPFKAQN

SEQ ID NO: 1491242 - protein, 17 aa, Mycobacterium tuberculosis
SAYSEMWFTEAHWPAFR

SEQ ID NO: 1491243 - protein, 21 aa, Mycobacterium tuberculosis
SCAKAQALVAERGFEITTAAG

SEQ ID NO: 1491244 - protein, 25 aa, Mycobacterium tuberculosis
SCCTSRMRWVRWSARRWPARPERST

SEQ ID NO: 1491245 - protein, 17 aa, Mycobacterium tuberculosis
SCGGVLAGWGRAGSRQL

SEQ ID NO: 1491246 - protein, 20 aa, Mycobacterium tuberculosis
SCKLRQRLPPVAPTVPNPAP

SEQ ID NO: 1491247 - protein, 20 aa, Mycobacterium tuberculosis
SCLPVSVLVVAKAPEPGRVK

SEQ ID NO: 1491248 - protein, 18 aa, Mycobacterium tuberculosis
SCLQELRSAGPHRQGTGR

SEQ ID NO: 1491249 - protein, 17 aa, Mycobacterium tuberculosis
SCPASCCTDPPGLTAAP

SEQ ID NO: 1491250 - protein, 25 aa, Mycobacterium tuberculosis
SCPEALWDFLCERRSSISQVPPQRW

SEQ ID NO: 1491251 - protein, 22 aa, Mycobacterium tuberculosis
SCPSSGCPEFRPGDDLSAAVAA

SEQ ID NO: 1491252 - protein, 39 aa, Mycobacterium tuberculosis
SCQVVHRGGTRRSCVSGRCGWSQRSAVSTIRSGQRSVRS

SEQ ID NO: 1491253 - protein, 18 aa, Mycobacterium tuberculosis
SCTAGRTVAAPAAVADQP

SEQ ID NO: 1491254 - protein, 22 aa, Mycobacterium tuberculosis
SCVSGRCGWSQRSAVSTIRSGQ

SEQ ID NO: 1491255 - protein, 22 aa, Mycobacterium tuberculosis
SDAAWLRAELNNERGYVFDLET

SEQ ID NO: 1491256 - protein, 20 aa, Mycobacterium tuberculosis
SDADGLRALFTTWITAPQPD

SEQ ID NO: 1491257 - protein, 17 aa, Mycobacterium tuberculosis
SDALLARITPTADAADF

SEQ ID NO: 1491258 - protein, 19 aa, Mycobacterium tuberculosis
SDCSGLCSQCGCLAGQRAQ

SEQ ID NO: 1491259 - protein, 19 aa, Mycobacterium tuberculosis
SDDQWAPVAHRPAHRRWFA

SEQ ID NO: 1491260 - protein, 18 aa, Mycobacterium tuberculosis
SDEAPVFITFDVSPHADG

SEQ ID NO: 1491261 - protein, 25 aa, Mycobacterium tuberculosis
SDGEPATEWTLNWAHQLIENAPHPK

SEQ ID NO: 1491262 - protein, 20 aa, Mycobacterium tuberculosis
SDGFAGLGGSGGRGGDAGLI

SEQ ID NO: 1491263 - protein, 21 aa, Mycobacterium tuberculosis
SDGFGALARRIAGRSLGLVMA

SEQ ID NO: 1491264 - protein, 29 aa, Mycobacterium tuberculosis
SDGFWDEVFRELSIPYLPVRWSTDNPDSI

SEQ ID NO: 1491265 - protein, 23 aa, Mycobacterium tuberculosis
SDGGHGGNATLIGNGGDGGAGGA

SEQ ID NO: 1491266 - protein, 37 aa, Mycobacterium tuberculosis
SDGIPGAFLGGGRGGDGVFFSLFLGTFSGNSLSGRGG

SEQ ID NO: 1491267 - protein, 17 aa, Mycobacterium tuberculosis
SDGKLVLGSADGAVYTL

SEQ ID NO: 1491268 - protein, 20 aa, Mycobacterium tuberculosis
SDGWLGLLACGDHHLDTLAG

SEQ ID NO: 1491269 - protein, 21 aa, Mycobacterium tuberculosis
SDIALAGGVYVMLEPRRFASG

SEQ ID NO: 1491270 - protein, 27 aa, Mycobacterium tuberculosis
SDIERLRKLWDVPALAFVGIGNGTQVA

SEQ ID NO: 1491271 - protein, 28 aa, Mycobacterium tuberculosis
SDIERLRKLWDVPALAFVGIGNGTQVAL

SEQ ID NO: 1491272 - protein, 23 aa, Mycobacterium tuberculosis
SDLPRHIAVLCDGNRRWARSAGY

SEQ ID NO: 1491273 - protein, 17 aa, Mycobacterium tuberculosis
SDLRIDVFRSSGKGGQG

SEQ ID NO: 1491274 - protein, 35 aa, Mycobacterium tuberculosis
SDLRPPSWQPPACLRFLQRPVIRAPVAASASSAPI

SEQ ID NO: 1491275 - protein, 20 aa, Mycobacterium tuberculosis
SDNLPSCITKYIPLHTPAVV

SEQ ID NO: 1491276 - protein, 21 aa, Mycobacterium tuberculosis
SDNLPSCITKYIPLHTPAVVM

SEQ ID NO: 1491277 - protein, 23 aa, Mycobacterium tuberculosis
SDNTRWTNNFAILAGDYRFATAS

SEQ ID NO: 1491278 - protein, 24 aa, Mycobacterium tuberculosis
SDNTRWTNNFAILAGGYRFATASQ

SEQ ID NO: 1491279 - protein, 20 aa, Mycobacterium tuberculosis
SDPRKVLAAVGVGDVDNAER

SEQ ID NO: 1491280 - protein, 18 aa, Mycobacterium tuberculosis
SDPRKVLAAVGVGGVDNA

SEQ ID NO: 1491281 - protein, 21 aa, Mycobacterium tuberculosis
SDPTDWAALTFDERRDALART

SEQ ID NO: 1491282 - protein, 17 aa, Mycobacterium tuberculosis
SDQRSAAVIARNIEALG

SEQ ID NO: 1491283 - protein, 22 aa, Mycobacterium tuberculosis
SDRPIRACGQFEFDDVTGHRIG

SEQ ID NO: 1491284 - protein, 26 aa, Mycobacterium tuberculosis
SDRTTCSPVGTARCARYRSNDPSRDR

SEQ ID NO: 1491285 - protein, 17 aa, Mycobacterium tuberculosis
SDSASWITGQIFNVDGG

SEQ ID NO: 1491286 - protein, 18 aa, Mycobacterium tuberculosis
SDTAEFGGYLSGPRVIDA

SEQ ID NO: 1491287 - protein, 25 aa, Mycobacterium tuberculosis
SDTRTDVSLVLRMHHGGDFVIEPLP

SEQ ID NO: 1491288 - protein, 25 aa, Mycobacterium tuberculosis
SDTTRCGNGSWLSGHTVISQSRNGG

SEQ ID NO: 1491289 - protein, 18 aa, Mycobacterium tuberculosis
SDVARIGSSIGVANSAAA

SEQ ID NO: 1491290 - protein, 19 aa, Mycobacterium tuberculosis
SDVLKAMGVYPGLDGAAPV

SEQ ID NO: 1491291 - protein, 21 aa, Mycobacterium tuberculosis
SDVMYRSVLALLMLTGSMGRN

SEQ ID NO: 1491292 - protein, 17 aa, Mycobacterium tuberculosis
SDVVCDRGAGDYRGGAT

SEQ ID NO: 1491293 - protein, 19 aa, Mycobacterium tuberculosis
SDYARMWIQAATTMASYQA

SEQ ID NO: 1491294 - protein, 23 aa, Mycobacterium tuberculosis
SDYTPLMLCAKMIHALARLPQQG

SEQ ID NO: 1491295 - protein, 18 aa, Mycobacterium tuberculosis
SEAAFRRFVAALDEPDEA

SEQ ID NO: 1491296 - protein, 21 aa, Mycobacterium tuberculosis
SEAARQGFTIALVPPSDDPVP

SEQ ID NO: 1491297 - protein, 19 aa, Mycobacterium tuberculosis
SEAERSAARAWRNARQQRS

SEQ ID NO: 1491298 - protein, 22 aa, Mycobacterium tuberculosis
SEAFTAWEFVDGYDVAQAVVVP

SEQ ID NO: 1491299 - protein, 29 aa, Mycobacterium tuberculosis
SEAGLPAPFWPVMPSAVAPRRPRLQPPRP

SEQ ID NO: 1491300 - protein, 20 aa, Mycobacterium tuberculosis
SEAGRICASLGLPRAGADPS

SEQ ID NO: 1491301 - protein, 23 aa, Mycobacterium tuberculosis
SEALREYGVRVLVIPAPARCVPR

SEQ ID NO: 1491302 - protein, 19 aa, Mycobacterium tuberculosis
SECVPVLMAALGKITGYDT

SEQ ID NO: 1491303 - protein, 24 aa, Mycobacterium tuberculosis
SEDVKTVPTTVWIASDGSSHLVQI

SEQ ID NO: 1491304 - protein, 22 aa, Mycobacterium tuberculosis
SEDWMTRLLLGFGSDVRVLAPE

SEQ ID NO: 1491305 - protein, 23 aa, Mycobacterium tuberculosis
SEERKVNALKFIAFVTNPTNTAY

SEQ ID NO: 1491306 - protein, 23 aa, Mycobacterium tuberculosis
SEFPTDRGWDLAGLFDPDPDAAG

SEQ ID NO: 1491307 - protein, 17 aa, Mycobacterium tuberculosis
SEGMPGSLVHRLRTQYR

SEQ ID NO: 1491308 - protein, 19 aa, Mycobacterium tuberculosis
SEGMPGSLVHRLRTQYRDY

SEQ ID NO: 1491309 - protein, 27 aa, Mycobacterium tuberculosis
SEGPLPQTRFVLRKALAAHLPVILVVS

SEQ ID NO: 1491310 - protein, 24 aa, Mycobacterium tuberculosis
SEGTVRAVATLAAVTAVTDVAGVT

SEQ ID NO: 1491311 - protein, 20 aa, Mycobacterium tuberculosis
SEGVDVPALDAVLFLNPRNS

SEQ ID NO: 1491312 - protein, 24 aa, Mycobacterium tuberculosis
SEHRVWRADTEIRLSHKEFTLLEA

SEQ ID NO: 1491313 - protein, 17 aa, Mycobacterium tuberculosis
SEHWEVVRIEMPASVAR

SEQ ID NO: 1491314 - protein, 22 aa, Mycobacterium tuberculosis
SEIEEALRYGVVKMNVDTDTQY

SEQ ID NO: 1491315 - protein, 22 aa, Mycobacterium tuberculosis
SEIRTARCATVSVPVDYDQPGG

SEQ ID NO: 1491316 - protein, 20 aa, Mycobacterium tuberculosis
SEKVLIEYNNKAALEPVNPP

SEQ ID NO: 1491317 - protein, 19 aa, Mycobacterium tuberculosis
SELAGGAWQGPASAAMANA

SEQ ID NO: 1491318 - protein, 21 aa, Mycobacterium tuberculosis
SELGEWLVIHEGWRSELPDQL

SEQ ID NO: 1491319 - protein, 19 aa, Mycobacterium tuberculosis
SELKPAFRPNGTVTAGKCL

SEQ ID NO: 1491320 - protein, 19 aa, Mycobacterium tuberculosis
SELKPAFRPNGTVTAGNAC

SEQ ID NO: 1491321 - protein, 20 aa, Mycobacterium tuberculosis
SELPGWLQANRHVKPTGSAV

SEQ ID NO: 1491322 - protein, 21 aa, Mycobacterium tuberculosis
SELRPPVRSGFGSRIELRLAA

SEQ ID NO: 1491323 - protein, 21 aa, Mycobacterium tuberculosis
SELRWPGDPSLDAGIDVRSLE

SEQ ID NO: 1491324 - protein, 20 aa, Mycobacterium tuberculosis
SEMAFKIAGSQVLKKAAALA

SEQ ID NO: 1491325 - protein, 21 aa, Mycobacterium tuberculosis
SEMAFKIAGSQVLKKAAALAQ

SEQ ID NO: 1491326 - protein, 19 aa, Mycobacterium tuberculosis
SEPALRTPAGQPWSAGPDT

SEQ ID NO: 1491327 - protein, 23 aa, Mycobacterium tuberculosis
SEPHYRPSAKLAEFVRIRDMTCR

SEQ ID NO: 1491328 - protein, 30 aa, Mycobacterium tuberculosis
SEPLPRAHGGPVRMVVPGFIGARSVKWVTA

SEQ ID NO: 1491329 - protein, 21 aa, Mycobacterium tuberculosis
SEPRFIKLTGELASEQTLSFD

SEQ ID NO: 1491330 - protein, 19 aa, Mycobacterium tuberculosis
SESCGPRPLRCRQTRVGQS

SEQ ID NO: 1491331 - protein, 23 aa, Mycobacterium tuberculosis
SESERRYLLCDATFEAWFERDGQ

SEQ ID NO: 1491332 - protein, 22 aa, Mycobacterium tuberculosis
SESNAMWALSIPVPFTKPVGAG

SEQ ID NO: 1491333 - protein, 29 aa, Mycobacterium tuberculosis
SESRALEDWCHQLAWPIRPAVSADPPSTA

SEQ ID NO: 1491334 - protein, 21 aa, Mycobacterium tuberculosis
SESRYGTGWWVCSSRATPTKP

SEQ ID NO: 1491335 - protein, 26 aa, Mycobacterium tuberculosis
SETRFRCSRFPGAAGEPRGLRWTQGL

SEQ ID NO: 1491336 - protein, 18 aa, Mycobacterium tuberculosis
SEVCGTVEAVGPGVTAAD

SEQ ID NO: 1491337 - protein, 32 aa, Mycobacterium tuberculosis
SFAEFWRTGRLELPTRTGLTWLADFRADPAAH

SEQ ID NO: 1491338 - protein, 25 aa, Mycobacterium tuberculosis
SFAGQGVGFGGWYAPVALHVDTESI

SEQ ID NO: 1491339 - protein, 19 aa, Mycobacterium tuberculosis
SFAVGDRVMGLFPEGTGTV

SEQ ID NO: 1491340 - protein, 20 aa, Mycobacterium tuberculosis
SFEQVAFLLWRGELPTDAEL

SEQ ID NO: 1491341 - protein, 19 aa, Mycobacterium tuberculosis
SFERKRRWTQLGEHHAVVA

SEQ ID NO: 1491342 - protein, 31 aa, Mycobacterium tuberculosis
SFNNELGHPWTVLRATRRTDYLILEMGGTPS

SEQ ID NO: 1491343 - protein, 31 aa, Mycobacterium tuberculosis
SFPTSRPGSLCRKRLRRGPTVMITHRSGSRC

SEQ ID NO: 1491344 - protein, 22 aa, Mycobacterium tuberculosis
SFRSELRLLYLTVTDPASGNLI

SEQ ID NO: 1491345 - protein, 21 aa, Mycobacterium tuberculosis
SFSECNAGLVVDEVDADLLAA

SEQ ID NO: 1491346 - protein, 18 aa, Mycobacterium tuberculosis
SFSQSWRSAPPPLWCGPY

SEQ ID NO: 1491347 - protein, 35 aa, Mycobacterium tuberculosis
SFTFMTPAAFVRRPGRWVRELARKPGETGGTFSAA

SEQ ID NO: 1491348 - protein, 17 aa, Mycobacterium tuberculosis
SFYDWYADLPVASPQVF

SEQ ID NO: 1491349 - protein, 29 aa, Mycobacterium tuberculosis
SGAAGFDIASLWPVKPLLSLSALETHFAI

SEQ ID NO: 1491350 - protein, 27 aa, Mycobacterium tuberculosis
SGAAGGVGGRGGWLLGNGGTGGAGGAA

SEQ ID NO: 1491351 - protein, 21 aa, Mycobacterium tuberculosis
SGAAIPAFKPLGGRELGAGMS

SEQ ID NO: 1491352 - protein, 18 aa, Mycobacterium tuberculosis
SGAGRAFNNFAAPRYGFK

SEQ ID NO: 1491353 - protein, 18 aa, Mycobacterium tuberculosis
SGAIVFSIGVLTAETGAG

SEQ ID NO: 1491354 - protein, 22 aa, Mycobacterium tuberculosis
SGAIWYPMVYDMPARAKDAFGA

SEQ ID NO: 1491355 - protein, 17 aa, Mycobacterium tuberculosis
SGALVAMESRARRFPKG

SEQ ID NO: 1491356 - protein, 18 aa, Mycobacterium tuberculosis
SGALYVRVDDVWHPVLNL

SEQ ID NO: 1491357 - protein, 18 aa, Mycobacterium tuberculosis
SGAPEHRAAAIVKATTFF

SEQ ID NO: 1491358 - protein, 19 aa, Mycobacterium tuberculosis
SGAPGQRGGAGGAAGLIGN

SEQ ID NO: 1491359 - protein, 18 aa, Mycobacterium tuberculosis
SGARVALVAGDRDIEAGT

SEQ ID NO: 1491360 - protein, 18 aa, Mycobacterium tuberculosis
SGASRAAVRLQIDQPGRL

SEQ ID NO: 1491361 - protein, 21 aa, Mycobacterium tuberculosis
SGAYPRWALANSATGMMSGDS

SEQ ID NO: 1491362 - protein, 18 aa, Mycobacterium tuberculosis
SGAYRVALVVGLELEKTV

SEQ ID NO: 1491363 - protein, 17 aa, Mycobacterium tuberculosis
SGCGPRGAVCMASPLNR

SEQ ID NO: 1491364 - protein, 17 aa, Mycobacterium tuberculosis
SGCPSCVQSPKCGNGND

SEQ ID NO: 1491365 - protein, 17 aa, Mycobacterium tuberculosis
SGCQLALAGDNAATLAL

SEQ ID NO: 1491366 - protein, 20 aa, Mycobacterium tuberculosis
SGCVLLPGLPYLGLEHRAAW

SEQ ID NO: 1491367 - protein, 18 aa, Mycobacterium tuberculosis
SGCWTGSMLSVDGLSASS

SEQ ID NO: 1491368 - protein, 24 aa, Mycobacterium tuberculosis
SGDARRLATMVLLIAQSTIQSADI

SEQ ID NO: 1491369 - protein, 25 aa, Mycobacterium tuberculosis
SGDDCPDWVAGELWVSGRGIARGYR

SEQ ID NO: 1491370 - protein, 26 aa, Mycobacterium tuberculosis
SGDDCPDWVAGELWVSGRGIARGYRG

SEQ ID NO: 1491371 - protein, 19 aa, Mycobacterium tuberculosis
SGDHPGIDWAKYALKAPVM

SEQ ID NO: 1491372 - protein, 23 aa, Mycobacterium tuberculosis
SGDPRGGMKQVLGASRLRRDRVQ

SEQ ID NO: 1491373 - protein, 26 aa, Mycobacterium tuberculosis
SGDPYRLAAQLGMPPWRVQKAQKQAG

SEQ ID NO: 1491374 - protein, 24 aa, Mycobacterium tuberculosis
SGERLAAATVVWCAGMRASRLTEQ

SEQ ID NO: 1491375 - protein, 18 aa, Mycobacterium tuberculosis
SGEYGAGKVIIWDSGTYD

SEQ ID NO: 1491376 - protein, 31 aa, Mycobacterium tuberculosis
SGFAIAQARLGPGRIHHCMRALGAAERALAL

SEQ ID NO: 1491377 - protein, 25 aa, Mycobacterium tuberculosis
SGFANRGILPFSVASVVSGFANIGT

SEQ ID NO: 1491378 - protein, 17 aa, Mycobacterium tuberculosis
SGFGIHPLVLDAALHAM

SEQ ID NO: 1491379 - protein, 19 aa, Mycobacterium tuberculosis
SGFPRLAIARLMTSYFELT

SEQ ID NO: 1491380 - protein, 24 aa, Mycobacterium tuberculosis
SGGAAGHAGTIFGNGGNAGAGSGL

SEQ ID NO: 1491381 - protein, 23 aa, Mycobacterium tuberculosis
SGGAGARGANGIDSIGGTGGAGG

SEQ ID NO: 1491382 - protein, 24 aa, Mycobacterium tuberculosis
SGGAGARGANGIDSIGGTGGAGGG

SEQ ID NO: 1491383 - protein, 26 aa, Mycobacterium tuberculosis
SGGAGGASGWLMGNGGNGGNGGTGGS

SEQ ID NO: 1491384 - protein, 31 aa, Mycobacterium tuberculosis
SGGAGGDGGWLWGNGVVGGYGGVGVPGDPGG

SEQ ID NO: 1491385 - protein, 24 aa, Mycobacterium tuberculosis
SGGAGGGAFVHIATATSTGGSGDF

SEQ ID NO: 1491386 - protein, 25 aa, Mycobacterium tuberculosis
SGGAGGGAFVHIATATSTGGSGGFG

SEQ ID NO: 1491387 - protein, 21 aa, Mycobacterium tuberculosis
SGGAGGMLYGAGGVGGNGGAA

SEQ ID NO: 1491388 - protein, 23 aa, Mycobacterium tuberculosis
SGGAGSIGFNASAPGAAGSPGGN

SEQ ID NO: 1491389 - protein, 26 aa, Mycobacterium tuberculosis
SGGAGSIGFNASAPGAAGSPGGNGGN

SEQ ID NO: 1491390 - protein, 18 aa, Mycobacterium tuberculosis
SGGANFNGGTGGTGGTGG

SEQ ID NO: 1491391 - protein, 18 aa, Mycobacterium tuberculosis
SGGCSRHLAECPAGRRIG

SEQ ID NO: 1491392 - protein, 18 aa, Mycobacterium tuberculosis
SGGGTGFEGSAGQGGAAI

SEQ ID NO: 1491393 - protein, 26 aa, Mycobacterium tuberculosis
SGGKGGTGGWLWGSGGAGGAGGSGGG

SEQ ID NO: 1491394 - protein, 20 aa, Mycobacterium tuberculosis
SGGLIGRAGSDGGVGAGGAG

SEQ ID NO: 1491395 - protein, 25 aa, Mycobacterium tuberculosis
SGGLPRPLVYEMPHTLAALDCGASR

SEQ ID NO: 1491396 - protein, 24 aa, Mycobacterium tuberculosis
SGGNFRTGVTLVTFVGVTQHTSTM

SEQ ID NO: 1491397 - protein, 25 aa, Mycobacterium tuberculosis
SGGRRRGRRGPWRHRRAAVAAPGFH

SEQ ID NO: 1491398 - protein, 23 aa, Mycobacterium tuberculosis
SGGRVAKARGRRDINAVDQDRAD

SEQ ID NO: 1491399 - protein, 21 aa, Mycobacterium tuberculosis
SGGVGGVFGNGGFGGAGGLGA

SEQ ID NO: 1491400 - protein, 24 aa, Mycobacterium tuberculosis
SGGVGGVFGNGGFGGAGGLGAAGG

SEQ ID NO: 1491401 - protein, 17 aa, Mycobacterium tuberculosis
SGGVWGRERGYCLMIGG

SEQ ID NO: 1491402 - protein, 19 aa, Mycobacterium tuberculosis
SGHALLLGARGRRLDVRQA

SEQ ID NO: 1491403 - protein, 18 aa, Mycobacterium tuberculosis
SGHMTWITTVLTRQPDRS

SEQ ID NO: 1491404 - protein, 17 aa, Mycobacterium tuberculosis
SGIARILLDRGGLVSGS

SEQ ID NO: 1491405 - protein, 17 aa, Mycobacterium tuberculosis
SGIHDLWLADSKTAITV

SEQ ID NO: 1491406 - protein, 24 aa, Mycobacterium tuberculosis
SGILNRGAGISGVYNTGTLGLVTS

SEQ ID NO: 1491407 - protein, 19 aa, Mycobacterium tuberculosis
SGIPGDWALYDVDGKNGEH

SEQ ID NO: 1491408 - protein, 17 aa, Mycobacterium tuberculosis
SGIQGNMGPPGTQGADG

SEQ ID NO: 1491409 - protein, 20 aa, Mycobacterium tuberculosis
SGKLKRRAVAQAYRDGTLPR

SEQ ID NO: 1491410 - protein, 19 aa, Mycobacterium tuberculosis
SGKMTGRSRLEVVDPSAAA

SEQ ID NO: 1491411 - protein, 23 aa, Mycobacterium tuberculosis
SGKMTGRSRLEVVDPSAAAQLAD

SEQ ID NO: 1491412 - protein, 20 aa, Mycobacterium tuberculosis
SGKSELFLSLVYGIALTHSP

SEQ ID NO: 1491413 - protein, 18 aa, Mycobacterium tuberculosis
SGLAALCAAVLVSSGCAR

SEQ ID NO: 1491414 - protein, 23 aa, Mycobacterium tuberculosis
SGLAALCAAVLVSSGCARFNDAQ

SEQ ID NO: 1491415 - protein, 22 aa, Mycobacterium tuberculosis
SGLQRRLGTTTVYVTHDQVEAM

SEQ ID NO: 1491416 - protein, 20 aa, Mycobacterium tuberculosis
SGLRAARRLGADWPAAIPQE

SEQ ID NO: 1491417 - protein, 17 aa, Mycobacterium tuberculosis
SGLRRAEMVGVPVRASI

SEQ ID NO: 1491418 - protein, 17 aa, Mycobacterium tuberculosis
SGLRRAEVVGVPVRASI

SEQ ID NO: 1491419 - protein, 28 aa, Mycobacterium tuberculosis
SGLRVYARTGLPCPVCGDTVREVSFADK

SEQ ID NO: 1491420 - protein, 18 aa, Mycobacterium tuberculosis
SGLSRVAPYLARTMPQLL

SEQ ID NO: 1491421 - protein, 20 aa, Mycobacterium tuberculosis
SGLTHKRRLLALGPGGLSRE

SEQ ID NO: 1491422 - protein, 24 aa, Mycobacterium tuberculosis
SGLVRAAACTMFFGETAESLAAEG

SEQ ID NO: 1491423 - protein, 17 aa, Mycobacterium tuberculosis
SGMGAGCEFIKVARRGT

SEQ ID NO: 1491424 - protein, 18 aa, Mycobacterium tuberculosis
SGMPRLYREAPLMGIWEG

SEQ ID NO: 1491425 - protein, 18 aa, Mycobacterium tuberculosis
SGMYFWLDYADGIEPYFS

SEQ ID NO: 1491426 - protein, 20 aa, Mycobacterium tuberculosis
SGNSLSGRGGAVGTGGTGLR

SEQ ID NO: 1491427 - protein, 24 aa, Mycobacterium tuberculosis
SGNYLPRFGPYLSSASNPWGDGIN

SEQ ID NO: 1491428 - protein, 40 aa, Mycobacterium tuberculosis
SGNYSNGAFWRGDYQGLLDFSFPVGPLIPQTHLVHLRETV

SEQ ID NO: 1491429 - protein, 30 aa, Mycobacterium tuberculosis
SGPADHGWPAVGLMAGSRLQAVEPVLADDQ

SEQ ID NO: 1491430 - protein, 18 aa, Mycobacterium tuberculosis
SGPMLAAAAAWDGLADEL

SEQ ID NO: 1491431 - protein, 23 aa, Mycobacterium tuberculosis
SGPMLAGAAAWEALAAELQTTAS

SEQ ID NO: 1491432 - protein, 17 aa, Mycobacterium tuberculosis
SGPPGAAALAFPSLSSS

SEQ ID NO: 1491433 - protein, 18 aa, Mycobacterium tuberculosis
SGPVDCVVQVRAHGETVS

SEQ ID NO: 1491434 - protein, 20 aa, Mycobacterium tuberculosis
SGPYFKVLLANLVPGQILQP

SEQ ID NO: 1491435 - protein, 21 aa, Mycobacterium tuberculosis
SGPYRFVYRKRFHKRCETELT

SEQ ID NO: 1491436 - protein, 17 aa, Mycobacterium tuberculosis
SGQAWRAPKDVVARAYE

SEQ ID NO: 1491437 - protein, 19 aa, Mycobacterium tuberculosis
SGQLSTGWFNSATTSTGWF

SEQ ID NO: 1491438 - protein, 23 aa, Mycobacterium tuberculosis
SGQLTRWTRFSAQPVATMDPTRR

SEQ ID NO: 1491439 - protein, 17 aa, Mycobacterium tuberculosis
SGQPLDWFCLFSSAAAL

SEQ ID NO: 1491440 - protein, 30 aa, Mycobacterium tuberculosis
SGRLTFGIVYTYARPNWWANANTVRSMIDA

SEQ ID NO: 1491441 - protein, 22 aa, Mycobacterium tuberculosis
SGRNRLKYIDGLTIDRQPSNQT

SEQ ID NO: 1491442 - protein, 24 aa, Mycobacterium tuberculosis
SGRPTIVAGLRLRRMVASIVGADL

SEQ ID NO: 1491443 - protein, 34 aa, Mycobacterium tuberculosis; identical to SEQ ID NO: 158971

SEQ ID NO: 1491444 - protein, 24 aa, Mycobacterium tuberculosis
SGSACPGCAIGCAARPRRVPARRN

SEQ ID NO: 1491445 - protein, 19 aa, Mycobacterium tuberculosis
SGSARSEVGPGLLLPIYIG

SEQ ID NO: 1491446 - protein, 17 aa, Mycobacterium tuberculosis
SGSDNLKGVQWSTRHMS

SEQ ID NO: 1491447 - protein, 18 aa, Mycobacterium tuberculosis
SGSGWAWTGPCWRCGPRA

SEQ ID NO: 1491448 - protein, 31 aa, Mycobacterium tuberculosis
SGSGWRWAGRSCAGPGCSAWTSRCRIWTPSC

SEQ ID NO: 1491449 - protein, 23 aa, Mycobacterium tuberculosis
SGSQPPMRCTPGLVDGRRALVTA

SEQ ID NO: 1491450 - protein, 26 aa, Mycobacterium tuberculosis
SGSQSEIWWERPILTPIVIDVLDHAR

SEQ ID NO: 1491451 - protein, 27 aa, Mycobacterium tuberculosis
SGSQSEIWWERPILTPIVIDVLDHARN

SEQ ID NO: 1491452 - protein, 22 aa, Mycobacterium tuberculosis
SGSRMRPDVVIAFMDQFGDVIY

SEQ ID NO: 1491453 - protein, 18 aa, Mycobacterium tuberculosis
SGSRSATSTSAWKRVSHS

SEQ ID NO: 1491454 - protein, 19 aa, Mycobacterium tuberculosis
SGSSDYLAGRAFSFISAID

SEQ ID NO: 1491455 - protein, 18 aa, Mycobacterium tuberculosis
SGSTAIRIPATASVGPFD

SEQ ID NO: 1491456 - protein, 18 aa, Mycobacterium tuberculosis
SGTARVGADTAIAARAAG

SEQ ID NO: 1491457 - protein, 22 aa, Mycobacterium tuberculosis
SGTEFNSQFSAAVRKIYDSGHN

SEQ ID NO: 1491458 - protein, 18 aa, Mycobacterium tuberculosis
SGTEPGFGGDGGLGGAGA

SEQ ID NO: 1491459 - protein, 20 aa, Mycobacterium tuberculosis
SGTGAARARVSALSAAAARA

SEQ ID NO: 1491460 - protein, 23 aa, Mycobacterium tuberculosis
SGTIAGGVYKFFIARRDPVTMSG

SEQ ID NO: 1491461 - protein, 25 aa, Mycobacterium tuberculosis
SGTPRASGPAGMTGMPMVPPGALGA

SEQ ID NO: 1491462 - protein, 17 aa, Mycobacterium tuberculosis
SGTRPRRSGASGTTATG

SEQ ID NO: 1491463 - protein, 18 aa, Mycobacterium tuberculosis
SGTRPRRSGASGTTATGT

SEQ ID NO: 1491464 - protein, 25 aa, Mycobacterium tuberculosis
SGVELRNRLQMAIGLPGLSLPRTLI

SEQ ID NO: 1491465 - protein, 18 aa, Mycobacterium tuberculosis
SGVPRWDRSPGRASSAPR

SEQ ID NO: 1491466 - protein, 17 aa, Mycobacterium tuberculosis
SGVSIDGLIAILTFPPA

SEQ ID NO: 1491467 - protein, 18 aa, Mycobacterium tuberculosis
SGVVECRTSPAVRTATPS

SEQ ID NO: 1491468 - protein, 24 aa, Mycobacterium tuberculosis
SGYAHVTGRVGVCMATSGPGATKP

SEQ ID NO: 1491469 - protein, 19 aa, Mycobacterium tuberculosis
SHAAVAPHLGVNAADAVTV

SEQ ID NO: 1491470 - protein, 21 aa, Mycobacterium tuberculosis
SHFRLDWSTPQDVGRKAIAQN

SEQ ID NO: 1491471 - protein, 20 aa, Mycobacterium tuberculosis
SHGSPFRSGPIRTLADLEDI

SEQ ID NO: 1491472 - protein, 17 aa, Mycobacterium tuberculosis
SHSIASYVGALAFTEQR

SEQ ID NO: 1491473 - protein, 18 aa, Mycobacterium tuberculosis
SHVAYWWSAEPQRLSMAA

SEQ ID NO: 1491474 - protein, 20 aa, Mycobacterium tuberculosis
SHVRRYIPDFAVADESASAT

SEQ ID NO: 1491475 - protein, 18 aa, Mycobacterium tuberculosis
SHVVFKPGTIEQIRSVIR

SEQ ID NO: 1491476 - protein, 18 aa, Mycobacterium tuberculosis
SHVYPTGASLYFTVVAGQ

SEQ ID NO: 1491477 - protein, 24 aa, Mycobacterium tuberculosis
SHVYRLKSSVFISVGVLGIEPAEP

SEQ ID NO: 1491478 - protein, 18 aa, Mycobacterium tuberculosis
SHWPGRPVGEGAGLMNYS

SEQ ID NO: 1491479 - protein, 24 aa, Mycobacterium tuberculosis
SIAPRAALVQVHRDGEFVVATVTA

SEQ ID NO: 1491480 - protein, 23 aa, Mycobacterium tuberculosis
SIAREGLLPGGLRVRRRAKVWYD

SEQ ID NO: 1491481 - protein, 17 aa, Mycobacterium tuberculosis
SIARKLGALTVGVVTRP

SEQ ID NO: 1491482 - protein, 20 aa, Mycobacterium tuberculosis
SIDPEWSRPPGSITDDHVFD

SEQ ID NO: 1491483 - protein, 18 aa, Mycobacterium tuberculosis
SIERRWTGSVSDAGGVAA

SEQ ID NO: 1491484 - protein, 17 aa, Mycobacterium tuberculosis
SIGDGWWLTRVVEGDGR

SEQ ID NO: 1491485 - protein, 25 aa, Mycobacterium tuberculosis
SIHRAYRYARAMARWSPTSRSEVTD

SEQ ID NO: 1491486 - protein, 19 aa, Mycobacterium tuberculosis
SIHSLGLGPRRPWSAPSRS

SEQ ID NO: 1491487 - protein, 28 aa, Mycobacterium tuberculosis
SILADKALRLAIAKGIDRYTIARVAQYG

SEQ ID NO: 1491488 - protein, 24 aa, Mycobacterium tuberculosis
SILCDPWVNPAYFASWFPFPDNSG

SEQ ID NO: 1491489 - protein, 21 aa, Mycobacterium tuberculosis
SILQRRVVFRANRAEVQAIAT

SEQ ID NO: 1491490 - protein, 25 aa, Mycobacterium tuberculosis
SINPAECWPAVGGGVPSAYDLGTVI

SEQ ID NO: 1491491 - protein, 17 aa, Mycobacterium tuberculosis
SIPEQPLPLAINVIGHI

SEQ ID NO: 1491492 - protein, 23 aa, Mycobacterium tuberculosis
SIQRTGRCVVMHEGPRSLGYGAG

SEQ ID NO: 1491493 - protein, 19 aa, Mycobacterium tuberculosis
SIRVADEVSVAFTAVRAKD

SEQ ID NO: 1491494 - protein, 18 aa, Mycobacterium tuberculosis
SIRVFPGDHFYLNDNLPQ

SEQ ID NO: 1491495 - protein, 20 aa, Mycobacterium tuberculosis
SIYSSCAVPPLVAYLDTGKL

SEQ ID NO: 1491496 - protein, 21 aa, Mycobacterium tuberculosis
SIYSSCAVPPLVAYLDTGKLP

SEQ ID NO: 1491497 - protein, 30 aa, Mycobacterium tuberculosis; identical to SEQ ID NO: 234266

SEQ ID NO: 1491498 - protein, 23 aa, Mycobacterium tuberculosis
SKAPGATVALTFQDPSGGSRTVQ

SEQ ID NO: 1491499 - protein, 21 aa, Mycobacterium tuberculosis
SKARAGGLVEGRRLTKVLGLP

SEQ ID NO: 1491500 - protein, 18 aa, Mycobacterium tuberculosis
SKDLPFAQTRFCGAEGTE

SEQ ID NO: 1491501 - protein, 17 aa, Mycobacterium tuberculosis
SKDMALVLTDAAKALLA

SEQ ID NO: 1491502 - protein, 21 aa, Mycobacterium tuberculosis
SKGFAGFPIGGRFLRAGNPAL

SEQ ID NO: 1491503 - protein, 19 aa, Mycobacterium tuberculosis
SKHPWRVLMHYEKDAKILL

SEQ ID NO: 1491504 - protein, 18 aa, Mycobacterium tuberculosis
SKLGYTVAPMEQRAELVV

SEQ ID NO: 1491505 - protein, 25 aa, Mycobacterium tuberculosis
SKLPRHKMPLLSLPVMKAPVLTVPE

SEQ ID NO: 1491506 - protein, 19 aa, Mycobacterium tuberculosis
SKNAISWGDFSTHLAQLQG

SEQ ID NO: 1491507 - protein, 24 aa, Mycobacterium tuberculosis
SKNSRLNMVSALDPHSGDIVNPSG

SEQ ID NO: 1491508 - protein, 30 aa, Mycobacterium tuberculosis
SKPPLPRLQRRRVRHSDAAVSTKGLEPGDA

SEQ ID NO: 1491509 - protein, 19 aa, Mycobacterium tuberculosis
SKPRIPLVSNVTGQMAGAG

SEQ ID NO: 1491510 - protein, 19 aa, Mycobacterium tuberculosis
SKPSPFAWIPFGGGTRRCV

SEQ ID NO: 1491511 - protein, 27 aa, Mycobacterium tuberculosis
SKSGLTWTQRLVSLLVFDGPDLPGPLS

SEQ ID NO: 1491512 - protein, 23 aa, Mycobacterium tuberculosis
SKTGERARCAPMHALEQLADYGF

SEQ ID NO: 1491513 - protein, 20 aa, Mycobacterium tuberculosis
SKTQTVLPFTGLNDPDGVAV

SEQ ID NO: 1491514 - protein, 17 aa, Mycobacterium tuberculosis
SKVFPVAPFPAVIKNRE

SEQ ID NO: 1491515 - protein, 18 aa, Mycobacterium tuberculosis
SKVFPVAPFPAVIKNRER

SEQ ID NO: 1491516 - protein, 19 aa, Mycobacterium tuberculosis
SLADFVKRQNLGSFTLGPI

SEQ ID NO: 1491517 - protein, 19 aa, Mycobacterium tuberculosis
SLADGLARFTWQLRAADPR

SEQ ID NO: 1491518 - protein, 25 aa, Mycobacterium tuberculosis
SLAEIRHWLQIFVQRFYSFSQFKRS

SEQ ID NO: 1491519 - protein, 17 aa, Mycobacterium tuberculosis
SLAELWRSVGCGSRRGH

SEQ ID NO: 1491520 - protein, 18 aa, Mycobacterium tuberculosis
SLAGRSVFEHRAVVVGGD

SEQ ID NO: 1491521 - protein, 18 aa, Mycobacterium tuberculosis
SLAISALFGQHAQAYQAL

SEQ ID NO: 1491522 - protein, 20 aa, Mycobacterium tuberculosis
SLARERGWEIRDFPNRPQGP

SEQ ID NO: 1491523 - protein, 18 aa, Mycobacterium tuberculosis
SLARRRCGTEGRRWRSSS

SEQ ID NO: 1491524 - protein, 18 aa, Mycobacterium tuberculosis
SLARWARANGWSAPPGAG

SEQ ID NO: 1491525 - protein, 19 aa, Mycobacterium tuberculosis
SLATDSWLFGGVVPGDTRV

SEQ ID NO: 1491526 - protein, 23 aa, Mycobacterium tuberculosis
SLAYDRAWWFARFVAAAYGTAKL

SEQ ID NO: 1491527 - protein, 21 aa, Mycobacterium tuberculosis
SLCGVRVFFPDPWPKARHHKR

SEQ ID NO: 1491528 - protein, 17 aa, Mycobacterium tuberculosis
SLCKPLRQILFRDDYGP

SEQ ID NO: 1491529 - protein, 25 aa, Mycobacterium tuberculosis
SLDALTLSVLRSWLAATAGAGAART

SEQ ID NO: 1491530 - protein, 20 aa, Mycobacterium tuberculosis
SLDAPLLRQIVNRGVVTAAG

SEQ ID NO: 1491531 - protein, 23 aa, Mycobacterium tuberculosis
SLDEACLLMFARRDLTAAEASAA

SEQ ID NO: 1491532 - protein, 20 aa, Mycobacterium tuberculosis
SLDRRAACGRTWRRAASRWC

SEQ ID NO: 1491533 - protein, 28 aa, Mycobacterium tuberculosis
SLDTAYFGNAFPPNYLVNSHTSAEQVGE

SEQ ID NO: 1491534 - protein, 27 aa, Mycobacterium tuberculosis
SLEDIIRFQAEFLWRDYFQPGVSIDGE

SEQ ID NO: 1491535 - protein, 17 aa, Mycobacterium tuberculosis
SLEKPVPVPGFEVRALF

SEQ ID NO: 1491536 - protein, 25 aa, Mycobacterium tuberculosis
SLESCGWTGWCELVDNGRRLGTVGH

SEQ ID NO: 1491537 - protein, 18 aa, Mycobacterium tuberculosis
SLFAFWAVDAAYSLDGRR

SEQ ID NO: 1491538 - protein, 19 aa, Mycobacterium tuberculosis
SLFALSNGHIGLRGNLDEG

SEQ ID NO: 1491539 - protein, 20 aa, Mycobacterium tuberculosis
SLGGSCCWSCPDHPDYSERP

SEQ ID NO: 1491540 - protein, 20 aa, Mycobacterium tuberculosis
SLGLEFIGFGGPDVREGPGR

SEQ ID NO: 1491541 - protein, 19 aa, Mycobacterium tuberculosis
SLGQWSWRTETEVDLDYHV

SEQ ID NO: 1491542 - protein, 19 aa, Mycobacterium tuberculosis
SLGRGLRPVPALELDCTKS

SEQ ID NO: 1491543 - protein, 18 aa, Mycobacterium tuberculosis
SLGSAPRQAFVFPGQGGH

SEQ ID NO: 1491544 - protein, 18 aa, Mycobacterium tuberculosis
SLGWQWLDPDIRNLAQRD

SEQ ID NO: 1491545 - protein, 22 aa, Mycobacterium tuberculosis
SLHAGHLVPLLTLRRFQRAGHR

SEQ ID NO: 1491546 - protein, 17 aa, Mycobacterium tuberculosis
SLHLAPDDMRAMGVEIE

SEQ ID NO: 1491547 - protein, 21 aa, Mycobacterium tuberculosis
SLHVKMGWAFAADIPLTSPPA

SEQ ID NO: 1491548 - protein, 20 aa, Mycobacterium tuberculosis
SLLCTACFDGKYPIELPRET

SEQ ID NO: 1491549 - protein, 23 aa, Mycobacterium tuberculosis
SLLRCGEMLSAVLLDATMAGLAT

SEQ ID NO: 1491550 - protein, 21 aa, Mycobacterium tuberculosis
SLNGITILNLVVFIPTNITAC

SEQ ID NO: 1491551 - protein, 32 aa, Mycobacterium tuberculosis
SLNIPVNIPIHLDFGTLAVNGFQIPAITLRAL

SEQ ID NO: 1491552 - protein, 28 aa, Mycobacterium tuberculosis
SLNNGFHGKWPWQMTHPMDGAVQIDKYV

SEQ ID NO: 1491553 - protein, 23 aa, Mycobacterium tuberculosis
SLPANDPNTAWLRGQVADLQAHV

SEQ ID NO: 1491554 - protein, 23 aa, Mycobacterium tuberculosis
SLPDAMGALLARSIVGIVEQVEQ

SEQ ID NO: 1491555 - protein, 17 aa, Mycobacterium tuberculosis
SLPLTVTEWDEWGNPLN

SEQ ID NO: 1491556 - protein, 21 aa, Mycobacterium tuberculosis
SLPRGDLAAAIYTTIEDQVET

SEQ ID NO: 1491557 - protein, 18 aa, Mycobacterium tuberculosis
SLPTATAVLGRWPDIRLL

SEQ ID NO: 1491558 - protein, 20 aa, Mycobacterium tuberculosis
SLPTDRPIIYATLGSSGGKN

SEQ ID NO: 1491559 - protein, 25 aa, Mycobacterium tuberculosis
SLQRLRLPWWHLWRAAEAAGAATPK

SEQ ID NO: 1491560 - protein, 20 aa, Mycobacterium tuberculosis
SLQRVVLRSMGMRPSGAFSA

SEQ ID NO: 1491561 - protein, 19 aa, Mycobacterium tuberculosis
SLRLPRDHYVRCDSNDYSV

SEQ ID NO: 1491562 - protein, 22 aa, Mycobacterium tuberculosis
SLSKIHSVASFFVSRVDTEIDK

SEQ ID NO: 1491563 - protein, 22 aa, Mycobacterium tuberculosis
SLTRTPLMSQLIEKPVAPSVMP

SEQ ID NO: 1491564 - protein, 25 aa, Mycobacterium tuberculosis
SLTVATIVRRHWPTPSLARVDAEYE

SEQ ID NO: 1491565 - protein, 17 aa, Mycobacterium tuberculosis
SLVDGIDVRGCSALWGQ

SEQ ID NO: 1491566 - protein, 20 aa, Mycobacterium tuberculosis
SLVHLGLKHYFLVDFPQEPG

SEQ ID NO: 1491567 - protein, 23 aa, Mycobacterium tuberculosis
SLVQRCGLSVAALWAGNAGGPAH

SEQ ID NO: 1491568 - protein, 17 aa, Mycobacterium tuberculosis
SLWPVFADIPAGWRVVH

SEQ ID NO: 1491569 - protein, 24 aa, Mycobacterium tuberculosis
SLYDSYIRAFRWATDRIGDNGVVG

SEQ ID NO: 1491570 - protein, 24 aa, Mycobacterium tuberculosis
SMAAVQLARLWGLEVFATASRGKW

SEQ ID NO: 1491571 - protein, 17 aa, Mycobacterium tuberculosis
SMCARLYGKRAAQNRAK

SEQ ID NO: 1491572 - protein, 22 aa, Mycobacterium tuberculosis
SMGRNGGGWAHYVGQEKVRPLT

SEQ ID NO: 1491573 - protein, 17 aa, Mycobacterium tuberculosis
SMLVKLTCRGRDLPTAV

SEQ ID NO: 1491574 - protein, 19 aa, Mycobacterium tuberculosis
SMLYIEGRLLGKPASIDEA

SEQ ID NO: 1491575 - protein, 29 aa, Mycobacterium tuberculosis
SMNNGLLWRADRQGLLAANYTITIERPAA

SEQ ID NO: 1491576 - protein, 17 aa, Mycobacterium tuberculosis
SMPVSRQTAAPSIAHKA

SEQ ID NO: 1491577 - protein, 18 aa, Mycobacterium tuberculosis
SMPYVEACHHMYGGEHGQ

SEQ ID NO: 1491578 - protein, 22 aa, Mycobacterium tuberculosis
SMRKFFEAFAPYGLKQTAVKPS

SEQ ID NO: 1491579 - protein, 25 aa, Mycobacterium tuberculosis
SMVTVARRPVCPVTLTPGDPALASV

SEQ ID NO: 1491580 - protein, 26 aa, Mycobacterium tuberculosis
SMVVSRARLQLAIAWAKHSAATAGAG

SEQ ID NO: 1491581 - protein, 21 aa, Mycobacterium tuberculosis
SNAPVAVPWVLAARSPQALTN

SEQ ID NO: 1491582 - protein, 22 aa, Mycobacterium tuberculosis
SNAPVLLGLIGLWYSNFFGAQS

SEQ ID NO: 1491583 - protein, 18 aa, Mycobacterium tuberculosis
SNCTLEWATSGRRQRGRV

SEQ ID NO: 1491584 - protein, 22 aa, Mycobacterium tuberculosis
SNGLAAELLRRLPFELTAGQRE

SEQ ID NO: 1491585 - protein, 25 aa, Mycobacterium tuberculosis
SNLKCLCRKHHLLKTFWTGWRDVQL

SEQ ID NO: 1491586 - protein, 17 aa, Mycobacterium tuberculosis
SNLTGICDRSIQSNIDA

SEQ ID NO: 1491587 - protein, 23 aa, Mycobacterium tuberculosis
SNPPIGPACGRRSKGPNHFDSVG

SEQ ID NO: 1491588 - protein, 20 aa, Mycobacterium tuberculosis
SNPPPAWRFHPRSSSTTPTP

SEQ ID NO: 1491589 - protein, 17 aa, Mycobacterium tuberculosis
SNRPAIYVATYFGDPGA

SEQ ID NO: 1491590 - protein, 17 aa, Mycobacterium tuberculosis
SNSALVVPVRFAGVHVY

SEQ ID NO: 1491591 - protein, 24 aa, Mycobacterium tuberculosis
SNSPLRPPAPPAPPLKPGPPAPPM

SEQ ID NO: 1491592 - protein, 23 aa, Mycobacterium tuberculosis
SNSSARWAWRRHIARRRWPSPMR

SEQ ID NO: 1491593 - protein, 23 aa, Mycobacterium tuberculosis
SNVVDALAWVMGEQGAKTLRGGK

SEQ ID NO: 1491594 - protein, 24 aa, Mycobacterium tuberculosis
SNWFGLNAPLIAAVEGAYEQMWAA

SEQ ID NO: 1491595 - protein, 19 aa, Mycobacterium tuberculosis
SPADPAFWPLVPDSPAVVG

SEQ ID NO: 1491596 - protein, 32 aa, Mycobacterium tuberculosis
SPAGLLYLVGPIAWTLGFPIVPMLAPGSTDVN

SEQ ID NO: 1491597 - protein, 21 aa, Mycobacterium tuberculosis
SPANIAFALGYPMDIGSYVAF

SEQ ID NO: 1491598 - protein, 27 aa, Mycobacterium tuberculosis
SPARKRRMFDLLVRMGYKEIEVGFPSA

SEQ ID NO: 1491599 - protein, 30 aa, Mycobacterium tuberculosis
SPASGRPLAMPRLDMVTGLYYLTTEVPGDT

SEQ ID NO: 1491600 - protein, 25 aa, Mycobacterium tuberculosis
SPATRSRRRRCCGPQQVLTTGRLRA

SEQ ID NO: 1491601 - protein, 22 aa, Mycobacterium tuberculosis
SPDAMAGLIRTMFGNRERYQIA

SEQ ID NO: 1491602 - protein, 18 aa, Mycobacterium tuberculosis
SPDAYDLELMWDANDDNQ

SEQ ID NO: 1491603 - protein, 21 aa, Mycobacterium tuberculosis
SPDKLRRVVAHMMEKPESVQH

SEQ ID NO: 1491604 - protein, 25 aa, Mycobacterium tuberculosis
SPDLDWKSVWDHGWSAAAEAADKPV

SEQ ID NO: 1491605 - protein, 30 aa, Mycobacterium tuberculosis
SPDQLRLSGFRLVGIADVYPGHDAIFDEKI

SEQ ID NO: 1491606 - protein, 25 aa, Mycobacterium tuberculosis
SPEAFIRKPARWMQLLAKHQAPFSA

SEQ ID NO: 1491607 - protein, 22 aa, Mycobacterium tuberculosis
SPEIPPAAPFAAVIAQRARDMG

SEQ ID NO: 1491608 - protein, 23 aa, Mycobacterium tuberculosis
SPEKLELCRDLGAQITINYRDED

SEQ ID NO: 1491609 - protein, 31 aa, Mycobacterium tuberculosis
SPERVELRYTMPLGEIIFDFFDALKSRTRGY

SEQ ID NO: 1491610 - protein, 20 aa, Mycobacterium tuberculosis
SPESRKWLCDMFADARMLAH

SEQ ID NO: 1491611 - protein, 21 aa, Mycobacterium tuberculosis
SPESRKWLCDMFADARMLAHD

SEQ ID NO: 1491612 - protein, 18 aa, Mycobacterium tuberculosis
SPFHVCATVAGRLLGAGY

SEQ ID NO: 1491613 - protein, 24 aa, Mycobacterium tuberculosis
SPGAFCLTCGAPVREPTDIMRDVA

SEQ ID NO: 1491614 - protein, 19 aa, Mycobacterium tuberculosis
SPGAIALLVWHYGRVEERW

SEQ ID NO: 1491615 - protein, 23 aa, Mycobacterium tuberculosis
SPGEGLGGLVDRVEDLLLQGVQW

SEQ ID NO: 1491616 - protein, 17 aa, Mycobacterium tuberculosis
SPGFTLYSLSGHVTRPG

SEQ ID NO: 1491617 - protein, 23 aa, Mycobacterium tuberculosis
SPGRTRSGYRWIRDGGQDLQKND

SEQ ID NO: 1491618 - protein, 26 aa, Mycobacterium tuberculosis
SPGSTMTLPLISMRFEGEDWILGSTA

SEQ ID NO: 1491619 - protein, 24 aa, Mycobacterium tuberculosis
SPIGKRNGWLSGLHATELLGAVQK

SEQ ID NO: 1491620 - protein, 20 aa, Mycobacterium tuberculosis
SPIRLRTVAATVFTRPEIAA

SEQ ID NO: 1491621 - protein, 19 aa, Mycobacterium tuberculosis
SPISLAFLTFLPRFDCQDR

SEQ ID NO: 1491622 - protein, 26 aa, Mycobacterium tuberculosis
SPITASRLVFRRRAPVDPKRRPLITK

SEQ ID NO: 1491623 - protein, 18 aa, Mycobacterium tuberculosis
SPIWYPKWAILPARGVLA

SEQ ID NO: 1491624 - protein, 19 aa, Mycobacterium tuberculosis
SPKEMWDAFAEEYLAPVRP

SEQ ID NO: 1491625 - protein, 26 aa, Mycobacterium tuberculosis
SPLFPDLPSFPGFPGFPSLPGFPGLP

SEQ ID NO: 1491626 - protein, 20 aa, Mycobacterium tuberculosis
SPLHTLKQQALAAINAPTQT

SEQ ID NO: 1491627 - protein, 29 aa, Mycobacterium tuberculosis
SPLLQHRRRIPGGRGFGGVGGRRRDRPIG

SEQ ID NO: 1491628 - protein, 18 aa, Mycobacterium tuberculosis
SPLPPAVGPAGHRRGGPA

SEQ ID NO: 1491629 - protein, 24 aa, Mycobacterium tuberculosis
SPMSFLRRPARWMQLLATSGRCFS

SEQ ID NO: 1491630 - protein, 32 aa, Mycobacterium tuberculosis
SPMSLLRFIKFILTEIFPGGRLPRISQVDYYS

SEQ ID NO: 1491631 - protein, 20 aa, Mycobacterium tuberculosis
SPNCAAAIWCRSRPTATARR

SEQ ID NO: 1491632 - protein, 19 aa, Mycobacterium tuberculosis
SPNPRLPVVPGGDYIMGED

SEQ ID NO: 1491633 - protein, 25 aa, Mycobacterium tuberculosis
SPPESWPRPWHPPGSLAGITASARF

SEQ ID NO: 1491634 - protein, 17 aa, Mycobacterium tuberculosis
SPPEVHSALLSAGPGPG

SEQ ID NO: 1491635 - protein, 18 aa, Mycobacterium tuberculosis
SPPILFRPAALVNCGSRP

SEQ ID NO: 1491636 - protein, 20 aa, Mycobacterium tuberculosis
SPPLLAWVGRCRCRHRRRRR

SEQ ID NO: 1491637 - protein, 24 aa, Mycobacterium tuberculosis
SPPRKAPTPSRPCCATTAPTAATP

SEQ ID NO: 1491638 - protein, 27 aa, Mycobacterium tuberculosis
SPPRRTCCPTRRLGWKIGSVAAAVLAD

SEQ ID NO: 1491639 - protein, 26 aa, Mycobacterium tuberculosis
SPPTWRGPCTTTRSPRWLPWTRSSRV

SEQ ID NO: 1491640 - protein, 23 aa, Mycobacterium tuberculosis
SPQETWTRLVLIDAGLPKPQTQI

SEQ ID NO: 1491641 - protein, 25 aa, Mycobacterium tuberculosis
SPQLFKQLLMVAGMERYYQIARCYR

SEQ ID NO: 1491642 - protein, 17 aa, Mycobacterium tuberculosis
SPQRLWEALLRGDDLVG

SEQ ID NO: 1491643 - protein, 17 aa, Mycobacterium tuberculosis
SPRRQRLYVSRAIVRSS

SEQ ID NO: 1491644 - protein, 18 aa, Mycobacterium tuberculosis
SPRWLPWTRSSRVATSTH

SEQ ID NO: 1491645 - protein, 18 aa, Mycobacterium tuberculosis
SPSGLLLAELKPRRLVEN

SEQ ID NO: 1491646 - protein, 25 aa, Mycobacterium tuberculosis
SPSGTPFRCSPRWAPTSPATSAPPP

SEQ ID NO: 1491647 - protein, 23 aa, Mycobacterium tuberculosis
SPSRRCMRCWPRRFRRRVPGGVT

SEQ ID NO: 1491648 - protein, 31 aa, Mycobacterium tuberculosis
SPSWRGVAASGRICWPTWPLPAPTERHRPPT

SEQ ID NO: 1491649 - protein, 27 aa, Mycobacterium tuberculosis
SPTPSSMRFFFFLVVFFSSKECIHPFQ

SEQ ID NO: 1491650 - protein, 25 aa, Mycobacterium tuberculosis
SPTRACATSGWPTPAPATSGSGWWG

SEQ ID NO: 1491651 - protein, 17 aa, Mycobacterium tuberculosis
SPTRSRPRAPMPGSSTR

SEQ ID NO: 1491652 - protein, 21 aa, Mycobacterium tuberculosis
SPTRWPLPCTARFWASRKKTA

SEQ ID NO: 1491653 - protein, 17 aa, Mycobacterium tuberculosis
SPTTWVVSGPARRNTPL

SEQ ID NO: 1491654 - protein, 18 aa, Mycobacterium tuberculosis
SPTWKFTDTPALRALSRA

SEQ ID NO: 1491655 - protein, 23 aa, Mycobacterium tuberculosis
SPVNLPGRRIFIIDVARFPASVP

SEQ ID NO: 1491656 - protein, 20 aa, Mycobacterium tuberculosis
SPVRAAIVVPAFTEPAIALS

SEQ ID NO: 1491657 - protein, 21 aa, Mycobacterium tuberculosis
SPVVTDHVWHRGQQVGLVDVH

SEQ ID NO: 1491658 - protein, 27 aa, Mycobacterium tuberculosis
SPYVDAWLLRACAKLGVRLVHSTPGRP

SEQ ID NO: 1491659 - protein, 18 aa, Mycobacterium tuberculosis
SQAPSDWQIIGHTDAGPV

SEQ ID NO: 1491660 - protein, 23 aa, Mycobacterium tuberculosis
SQESMPLAGLVFNRTHPMLSALP

SEQ ID NO: 1491661 - protein, 19 aa, Mycobacterium tuberculosis
SQFKRSALPNGPKVSHGGA

SEQ ID NO: 1491662 - protein, 20 aa, Mycobacterium tuberculosis
SQFRGSELIAEKWNLSREEM

SEQ ID NO: 1491663 - protein, 17 aa, Mycobacterium tuberculosis
SQFYLAMYWAQELAAQT

SEQ ID NO: 1491664 - protein, 22 aa, Mycobacterium tuberculosis
SQGRLEALLNFQTLVTDLTGLE

SEQ ID NO: 1491665 - protein, 17 aa, Mycobacterium tuberculosis
SQLGFAVRNHCAPILGL

SEQ ID NO: 1491666 - protein, 18 aa, Mycobacterium tuberculosis
SQLPAGVVQINRRNYLMV

SEQ ID NO: 1491667 - protein, 21 aa, Mycobacterium tuberculosis
SQMLQCIVTLMPLGAAVVDTH

SEQ ID NO: 1491668 - protein, 19 aa, Mycobacterium tuberculosis
SQMSFVIAVPEALTMAASD

SEQ ID NO: 1491669 - protein, 20 aa, Mycobacterium tuberculosis
SQMSFVIAVPEALTMAASDL

SEQ ID NO: 1491670 - protein, 17 aa, Mycobacterium tuberculosis
SQNLIPRVFWMTYQNSR

SEQ ID NO: 1491671 - protein, 18 aa, Mycobacterium tuberculosis
SQPPRPPVPPSPASPPTP

SEQ ID NO: 1491672 - protein, 20 aa, Mycobacterium tuberculosis
SQQRLAFFADIHMIAVLTEN

SEQ ID NO: 1491673 - protein, 20 aa, Mycobacterium tuberculosis
SQRHFLHLLPQYGTYHPLYE

SEQ ID NO: 1491674 - protein, 38 aa, Mycobacterium tuberculosis
SQRRFRLCQYRHQPGGFLPRHHVLTLAGKRPTPLACQA

SEQ ID NO: 1491675 - protein, 17 aa, Mycobacterium tuberculosis
SQSDLIRVTRPCGHSVR

SEQ ID NO: 1491676 - protein, 20 aa, Mycobacterium tuberculosis
SQTPRLATMRARKTGRGGAR

SEQ ID NO: 1491677 - protein, 23 aa, Mycobacterium tuberculosis
SQTRRRVAVLGGNRIPFARSDGA

SEQ ID NO: 1491678 - protein, 17 aa, Mycobacterium tuberculosis
SQTSAKVAQLYMDNDPQ

SEQ ID NO: 1491679 - protein, 18 aa, Mycobacterium tuberculosis
SQTSRTPWCRSLPLNWRR

SEQ ID NO: 1491680 - protein, 18 aa, Mycobacterium tuberculosis
SQVTAPGMLAFRHIFLTL

SEQ ID NO: 1491681 - protein, 42 aa, Mycobacterium tuberculosis
SQVVGWPPRPAISARSAWPRGGPRAGAGSRGHRRACPASTVC

SEQ ID NO: 1491682 - protein, 17 aa, Mycobacterium tuberculosis
SQWCFVLARTEKGSQRH

SEQ ID NO: 1491683 - protein, 19 aa, Mycobacterium tuberculosis
SQWGYSARTARRGWRTIAV

SEQ ID NO: 1491684 - protein, 20 aa, Mycobacterium tuberculosis
SRAAAPVWPALCRPAGNPIS

SEQ ID NO: 1491685 - protein, 21 aa, Mycobacterium tuberculosis
SRACVRRVCRGGMWRGKEGRL

SEQ ID NO: 1491686 - protein, 20 aa, Mycobacterium tuberculosis
SRAGFLPWRAAHAARAQSPT

SEQ ID NO: 1491687 - protein, 20 aa, Mycobacterium tuberculosis
SRAGFLPWRAGPCGPRRFIP

SEQ ID NO: 1491688 - protein, 25 aa, Mycobacterium tuberculosis
SRAKWDTLRAMGFDDIHISDSRSLE

SEQ ID NO: 1491689 - protein, 26 aa, Mycobacterium tuberculosis
SRALEDWCHQLAWPIRPAVSADPPST

SEQ ID NO: 1491690 - protein, 18 aa, Mycobacterium tuberculosis
SRAPRWAIAYKYPPEEAQ

SEQ ID NO: 1491691 - protein, 19 aa, Mycobacterium tuberculosis
SRAVHIQGHLTATVPQTPR

SEQ ID NO: 1491692 - protein, 31 aa, Mycobacterium tuberculosis
SRAYPPRPLRCGGELWRFRGAGHVFLAVPGQ

SEQ ID NO: 1491693 - protein, 36 aa, Mycobacterium tuberculosis
SRAYSARAIGSMFPKYPHTSPWKFPSTSPSPPASPT

SEQ ID NO: 1491694 - protein, 21 aa, Mycobacterium tuberculosis
SRCAQGAVLATAFHPEMTGDR

SEQ ID NO: 1491695 - protein, 24 aa, Mycobacterium tuberculosis
SRCARCARCARGWHDQGRHVWGWR

SEQ ID NO: 1491696 - protein, 23 aa, Mycobacterium tuberculosis
SRCPLPAPKSCPISSVFTLFFNF

SEQ ID NO: 1491697 - protein, 21 aa, Mycobacterium tuberculosis
SRCRPSAGWRSADSTRCTGRG

SEQ ID NO: 1491698 - protein, 19 aa, Mycobacterium tuberculosis
SRDELIAGLAYHGPLNYRP

SEQ ID NO: 1491699 - protein, 20 aa, Mycobacterium tuberculosis
SRDLQPWLAVPDRLLHYRPG

SEQ ID NO: 1491700 - protein, 23 aa, Mycobacterium tuberculosis
SRESVSTWVFVVWPRSPPRTAHA

SEQ ID NO: 1491701 - protein, 23 aa, Mycobacterium tuberculosis
SRETLGRNCWRGERRAWIEVRGL

SEQ ID NO: 1491702 - protein, 21 aa, Mycobacterium tuberculosis
SREYPPVRGVIHAAGVLDDAV

SEQ ID NO: 1491703 - protein, 20 aa, Mycobacterium tuberculosis
SRFGENFFYILYFQEPGIAD

SEQ ID NO: 1491704 - protein, 18 aa, Mycobacterium tuberculosis
SRFSCSAGDFASRRGPPT

SEQ ID NO: 1491705 - protein, 20 aa, Mycobacterium tuberculosis
SRGFFTSRVIGTFVNEALAM

SEQ ID NO: 1491706 - protein, 20 aa, Mycobacterium tuberculosis
SRGHARGCGPLRQVVSRRVA

SEQ ID NO: 1491707 - protein, 22 aa, Mycobacterium tuberculosis
SRGKWDTLRAMGFDDDHIGDSR

SEQ ID NO: 1491708 - protein, 20 aa, Mycobacterium tuberculosis
SRGLAGLSVAWGLWEQASAM

SEQ ID NO: 1491709 - protein, 20 aa, Mycobacterium tuberculosis
SRGMGWGCIDKPPAEAWGST

SEQ ID NO: 1491710 - protein, 25 aa, Mycobacterium tuberculosis
SRGPLRYAGWSSCFRREAGSHGKDT

SEQ ID NO: 1491711 - protein, 25 aa, Mycobacterium tuberculosis
SRGPRRRPLDPARRAAFETLRAVSA

SEQ ID NO: 1491712 - protein, 18 aa, Mycobacterium tuberculosis
SRGRGLGLDFLRHIERCA

SEQ ID NO: 1491713 - protein, 20 aa, Mycobacterium tuberculosis
SRGSMKAGVFSDGALAEPAD

SEQ ID NO: 1491714 - protein, 18 aa, Mycobacterium tuberculosis
SRHSMPRKPIYRSTSSPA

SEQ ID NO: 1491715 - protein, 29 aa, Mycobacterium tuberculosis
SRIEAIAATGRWVPDFLSLPITVENSLKN

SEQ ID NO: 1491716 - protein, 20 aa, Mycobacterium tuberculosis
SRIPSLVSIGYEGRTVDELV

SEQ ID NO: 1491717 - protein, 25 aa, Mycobacterium tuberculosis
SRIRASAPSAAWCGRNAPGQASASR

SEQ ID NO: 1491718 - protein, 17 aa, Mycobacterium tuberculosis
SRIRPPELADIGWVQQE

SEQ ID NO: 1491719 - protein, 17 aa, Mycobacterium tuberculosis
SRKSTPFAAQLAAENAA

SEQ ID NO: 1491720 - protein, 25 aa, Mycobacterium tuberculosis
SRLAYPEVRAALAAAARNHDLTESE

SEQ ID NO: 1491721 - protein, 18 aa, Mycobacterium tuberculosis
SRLKGKQVEFFAAALGGP

SEQ ID NO: 1491722 - protein, 17 aa, Mycobacterium tuberculosis
SRLNRLLAQQIPPARKV

SEQ ID NO: 1491723 - protein, 17 aa, Mycobacterium tuberculosis
SRLRGVRDFILNRHAAP

SEQ ID NO: 1491724 - protein, 18 aa, Mycobacterium tuberculosis
SRLRPLLPDTPATATLRR

SEQ ID NO: 1491725 - protein, 18 aa, Mycobacterium tuberculosis
SRLVGAVLIGRDRAAVAE

SEQ ID NO: 1491726 - protein, 25 aa, Mycobacterium tuberculosis
SRNAPARGGVVVWHDGHQCARHCRA

SEQ ID NO: 1491727 - protein, 26 aa, Mycobacterium tuberculosis
SRNGLPRPSRGRRRWRSGQRGGAAGA

SEQ ID NO: 1491728 - protein, 28 aa, Mycobacterium tuberculosis
SRNRPARLAPMFAMPEPKAGVARSSVLV

SEQ ID NO: 1491729 - protein, 17 aa, Mycobacterium tuberculosis
SRPAVRSDLVARVGGHV

SEQ ID NO: 1491730 - protein, 31 aa, Mycobacterium tuberculosis
SRPFSPTCPPRWMCPPARPPKPTWPAKPLNI

SEQ ID NO: 1491731 - protein, 20 aa, Mycobacterium tuberculosis
SRPHVSLAVAERIAPEVDEP

SEQ ID NO: 1491732 - protein, 30 aa, Mycobacterium tuberculosis
SRPMCLRFSRPAAGLSTFTNGALIFGEFDL

SEQ ID NO: 1491733 - protein, 19 aa, Mycobacterium tuberculosis
SRPPWSNNAVRRLGVALRD

SEQ ID NO: 1491734 - protein, 18 aa, Mycobacterium tuberculosis
SRPRLRRCTAKSGEQKCG

SEQ ID NO: 1491735 - protein, 46 aa, Mycobacterium tuberculosis
SRPSTCTAIRSPPCWPGSTWPLIWLTCWRPTTWRWRRTPRPLSRST

SEQ ID NO: 1491736 - protein, 27 aa, Mycobacterium tuberculosis
SRQDWTPSYCRHRRNLQLIGLNDAEKR

SEQ ID NO: 1491737 - protein, 20 aa, Mycobacterium tuberculosis
SRQGLAQGYALRLADRLVDN

SEQ ID NO: 1491738 - protein, 17 aa, Mycobacterium tuberculosis
SRQLAALSIFANSGGKT

SEQ ID NO: 1491739 - protein, 23 aa, Mycobacterium tuberculosis
SRQRPELAWFPSLAHHLQDASRG

SEQ ID NO: 1491740 - protein, 19 aa, Mycobacterium tuberculosis
SRRCQAWILRRLAAALPAL

SEQ ID NO: 1491741 - protein, 19 aa, Mycobacterium tuberculosis
SRRFGVQVEDGFGSTENAV

SEQ ID NO: 1491742 - protein, 17 aa, Mycobacterium tuberculosis
SRRGRRLAPELAGVWTA

SEQ ID NO: 1491743 - protein, 17 aa, Mycobacterium tuberculosis
SRRHGAASGGNGGPGGH

SEQ ID NO: 1491744 - protein, 20 aa, Mycobacterium tuberculosis
SRRLTEVRKNGVLPYLRPDG

SEQ ID NO: 1491745 - protein, 23 aa, Mycobacterium tuberculosis
SRRRGASIARGFQCRSRPGLPAA

SEQ ID NO: 1491746 - protein, 18 aa, Mycobacterium tuberculosis
SRRRPEVSGPRHRKPMGD

SEQ ID NO: 1491747 - protein, 23 aa, Mycobacterium tuberculosis
SRRRRWPPTRGCRRRRSQETTCV

SEQ ID NO: 1491748 - protein, 18 aa, Mycobacterium tuberculosis
SRRRSFDRGAKRSLLRPM

SEQ ID NO: 1491749 - protein, 22 aa, Mycobacterium tuberculosis
SRRTVCQAASILASILLETVAG

SEQ ID NO: 1491750 - protein, 18 aa, Mycobacterium tuberculosis
SRRWLLNLVITRGTPPRL

SEQ ID NO: 1491751 - protein, 25 aa, Mycobacterium tuberculosis
SRRYRGRPRRGCPHLRSSEFRSIEI

SEQ ID NO: 1491752 - protein, 23 aa, Mycobacterium tuberculosis
SRSDIGGAVQRLIRRLPAGDEWY

SEQ ID NO: 1491753 - protein, 20 aa, Mycobacterium tuberculosis
SRSPIALSVTLQAVRRAAKL

SEQ ID NO: 1491754 - protein, 18 aa, Mycobacterium tuberculosis
SRSSWRTEHCSPGLTGAS

SEQ ID NO: 1491755 - protein, 24 aa, Mycobacterium tuberculosis
SRSTAARAFSRWSTTRTNRKRCGR

SEQ ID NO: 1491756 - protein, 19 aa, Mycobacterium tuberculosis
SRTAAILIGDGVSPGNDGR

SEQ ID NO: 1491757 - protein, 20 aa, Mycobacterium tuberculosis
SRTAFQLGVLERGLQMTAEY

SEQ ID NO: 1491758 - protein, 17 aa, Mycobacterium tuberculosis
SRTDLLSTLPQRVAVRV

SEQ ID NO: 1491759 - protein, 22 aa, Mycobacterium tuberculosis
SRTIRLPVHLVEQVNKLARIKR

SEQ ID NO: 1491760 - protein, 21 aa, Mycobacterium tuberculosis
SRTRLPGWSPRARPAVVVDCE

SEQ ID NO: 1491761 - protein, 21 aa, Mycobacterium tuberculosis
SRTSWDGIVVVCPPRANDESM

SEQ ID NO: 1491762 - protein, 18 aa, Mycobacterium tuberculosis
SRVLKWIVDRIEHKAGGG

SEQ ID NO: 1491763 - protein, 19 aa, Mycobacterium tuberculosis
SRVLRVGVAEFRRSLDRVM

SEQ ID NO: 1491764 - protein, 24 aa, Mycobacterium tuberculosis
SRVQRVATCWVQWRSQARRSRVRR

SEQ ID NO: 1491765 - protein, 29 aa, Mycobacterium tuberculosis
SRVVAIIAVNCSWLLGSFGLGAGDVGHEW

SEQ ID NO: 1491766 - protein, 37 aa, Mycobacterium tuberculosis
SRWRWQRMHIRTCRSTRWWRRSPPAVAVPHPLFDIVV

SEQ ID NO: 1491767 - protein, 26 aa, Mycobacterium tuberculosis
SRYEVHFACDPRFNKLLGPLPFPHHP

SEQ ID NO: 1491768 - protein, 27 aa, Mycobacterium tuberculosis
SRYGIDAHIDRVRWDDVVSRVFGRIDP

SEQ ID NO: 1491769 - protein, 19 aa, Mycobacterium tuberculosis
SRYHTPVSLIGWSLGGIFA

SEQ ID NO: 1491770 - protein, 17 aa, Mycobacterium tuberculosis
SSAGVPGLRCPLTGDCP

SEQ ID NO: 1491771 - protein, 19 aa, Mycobacterium tuberculosis
SSAPSRWVNTRPASSVGSH

SEQ ID NO: 1491772 - protein, 20 aa, Mycobacterium tuberculosis
SSARACIGHFCDPGHQAARL

SEQ ID NO: 1491773 - protein, 17 aa, Mycobacterium tuberculosis
SSARISVDVIWSATIAT

SEQ ID NO: 1491774 - protein, 20 aa, Mycobacterium tuberculosis
SSCLGRRSLHPGARYRRDGT

SEQ ID NO: 1491775 - protein, 18 aa, Mycobacterium tuberculosis
SSCWRDQRGPPRRCWGAP

SEQ ID NO: 1491776 - protein, 24 aa, Mycobacterium tuberculosis
SSEAVWWRVAANYAAQGSITRYPV

SEQ ID NO: 1491777 - protein, 31 aa, Mycobacterium tuberculosis
SSEIAIAVPAHWKPGAVHALRNGLRTHVGFV

SEQ ID NO: 1491778 - protein, 22 aa, Mycobacterium tuberculosis
SSEWNAALSRIAVAGRGPGDVD

SEQ ID NO: 1491779 - protein, 20 aa, Mycobacterium tuberculosis
SSEWRKWRDGQFVAFEGVLP

SEQ ID NO: 1491780 - protein, 20 aa, Mycobacterium tuberculosis
SSFNGTVVVSVWQPGEPAAK

SEQ ID NO: 1491781 - protein, 22 aa, Mycobacterium tuberculosis
SSFPDPTKLILQLLKDFLELLR

SEQ ID NO: 1491782 - protein, 23 aa, Mycobacterium tuberculosis
SSGCARPSTAWINRDRFGRAAAV

SEQ ID NO: 1491783 - protein, 24 aa, Mycobacterium tuberculosis
SSGCPTPVCHAVTWRSGGTGRSHC

SEQ ID NO: 1491784 - protein, 26 aa, Mycobacterium tuberculosis
SSGFARPTAGPAGLVGLRPVPAAPAG

SEQ ID NO: 1491785 - protein, 20 aa, Mycobacterium tuberculosis
SSGLTAIHLACRSLHDGESD

SEQ ID NO: 1491786 - protein, 18 aa, Mycobacterium tuberculosis
SSGPNLGRFGSFGRGVTP

SEQ ID NO: 1491787 - protein, 19 aa, Mycobacterium tuberculosis
SSGTPGYRAIGFGPKPQEP

SEQ ID NO: 1491788 - protein, 20 aa, Mycobacterium tuberculosis
SSGTVFALDLSWGGAGGNGG

SEQ ID NO: 1491789 - protein, 19 aa, Mycobacterium tuberculosis
SSHAGSWLYGLPELPGARD

SEQ ID NO: 1491790 - protein, 20 aa, Mycobacterium tuberculosis
SSIGSGVRRVEAYVGLDSFR

SEQ ID NO: 1491791 - protein, 24 aa, Mycobacterium tuberculosis
SSIPAIPIGLVLNGDIGPITIQPI

SEQ ID NO: 1491792 - protein, 17 aa, Mycobacterium tuberculosis
SSKVGLIAGCLVTSGVM

SEQ ID NO: 1491793 - protein, 20 aa, Mycobacterium tuberculosis
SSLEKPVPVPGFEVRHFHRR

SEQ ID NO: 1491794 - protein, 17 aa, Mycobacterium tuberculosis
SSLGWPRHKVATVAEAF

SEQ ID NO: 1491795 - protein, 19 aa, Mycobacterium tuberculosis
SSLQPIWFGRAHLREGLSW

SEQ ID NO: 1491796 - protein, 23 aa, Mycobacterium tuberculosis
SSLRAVAVGGDWVRPDLARRLQV

SEQ ID NO: 1491797 - protein, 21 aa, Mycobacterium tuberculosis
SSLTARRRGRRHRRRRRLALR

SEQ ID NO: 1491798 - protein, 17 aa, Mycobacterium tuberculosis
SSLVAVHLACRSLSTWD

SEQ ID NO: 1491799 - protein, 19 aa, Mycobacterium tuberculosis
SSPNSMWNLTSGEPTFSNE

SEQ ID NO: 1491800 - protein, 18 aa, Mycobacterium tuberculosis
SSQLPSAVYFRTTDVTGV

SEQ ID NO: 1491801 - protein, 24 aa, Mycobacterium tuberculosis
SSRACAAASAAARRTSGAVETPTP

SEQ ID NO: 1491802 - protein, 21 aa, Mycobacterium tuberculosis
SSRAPRIVFRTDRRTAVRVGE

SEQ ID NO: 1491803 - protein, 25 aa, Mycobacterium tuberculosis
SSRAPRIVFRTDRRTAVRVGESLAI

SEQ ID NO: 1491804 - protein, 18 aa, Mycobacterium tuberculosis
SSRPEAIEAYDIHRLTAD

SEQ ID NO: 1491805 - protein, 30 aa, Mycobacterium tuberculosis
SSRTRARRSPICWCPKLTASVTDGAVGVTV

SEQ ID NO: 1491806 - protein, 23 aa, Mycobacterium tuberculosis
SSSAPRPPAPPAPPVPPVPPVPP

SEQ ID NO: 1491807 - protein, 27 aa, Mycobacterium tuberculosis
SSSLNGPCSARILATAWVASNASATVA

SEQ ID NO: 1491808 - protein, 19 aa, Mycobacterium tuberculosis
SSSLVAIHLACQSLRLRET

SEQ ID NO: 1491809 - protein, 18 aa, Mycobacterium tuberculosis
SSSLVAIHQWGAGAAPRR

SEQ ID NO: 1491810 - protein, 24 aa, Mycobacterium tuberculosis
SSSPRVALALGSGGARGYAHIGVT

SEQ ID NO: 1491811 - protein, 20 aa, Mycobacterium tuberculosis
SSSQMRSWFNYRFDGPNAVN

SEQ ID NO: 1491812 - protein, 38 aa, Mycobacterium tuberculosis
SSSRNPSPCPLRSKWFRSSWAPAVTWTRCPSRTSGGSK

SEQ ID NO: 1491813 - protein, 18 aa, Mycobacterium tuberculosis
SSSVPILGPYEDLIANTV

SEQ ID NO: 1491814 - protein, 19 aa, Mycobacterium tuberculosis
SSSVPILGPYEDLIANTVA

SEQ ID NO: 1491815 - protein, 21 aa, Mycobacterium tuberculosis
SSSWKGWGHVRWFIEEVPAGA

SEQ ID NO: 1491816 - protein, 17 aa, Mycobacterium tuberculosis
SSVPILGPYEDLIANTV

SEQ ID NO: 1491817 - protein, 29 aa, Mycobacterium tuberculosis
SSVTQGGSGFFGGKGGFGGDGGQGGPNGG

SEQ ID NO: 1491818 - protein, 17 aa, Mycobacterium tuberculosis
SSVYRGAADLSFGDAPV

SEQ ID NO: 1491819 - protein, 23 aa, Mycobacterium tuberculosis
SSWGSGKDWQVWSGAKVADLVQL

SEQ ID NO: 1491820 - protein, 24 aa, Mycobacterium tuberculosis
SSWGSGKDWQVWSGAKVADLVQLN

SEQ ID NO: 1491821 - protein, 19 aa, Mycobacterium tuberculosis
SSWINRLYWNLADYAGSPV

SEQ ID NO: 1491822 - protein, 21 aa, Mycobacterium tuberculosis
SSWINRLYWNLADYAGSPVRI

SEQ ID NO: 1491823 - protein, 18 aa, Mycobacterium tuberculosis
STACATWTGWLRTRRSTL

SEQ ID NO: 1491824 - protein, 18 aa, Mycobacterium tuberculosis
STACCAPVKLATAADPTI

SEQ ID NO: 1491825 - protein, 24 aa, Mycobacterium tuberculosis
STAELLAGNGLRYNRFHTTALCSP

SEQ ID NO: 1491826 - protein, 18 aa, Mycobacterium tuberculosis
STAIAALFGAHGQAYPGA

SEQ ID NO: 1491827 - protein, 18 aa, Mycobacterium tuberculosis
STAIAALFGAHGQAYQAL

SEQ ID NO: 1491828 - protein, 19 aa, Mycobacterium tuberculosis
STAIAALFGAHGQAYQALS

SEQ ID NO: 1491829 - protein, 18 aa, Mycobacterium tuberculosis
STAIAALFGSHGQNYQAI

SEQ ID NO: 1491830 - protein, 19 aa, Mycobacterium tuberculosis
STAIATLFGIHAREYQAIS

SEQ ID NO: 1491831 - protein, 18 aa, Mycobacterium tuberculosis
STAVAALFGAHGQAYQAL

SEQ ID NO: 1491832 - protein, 19 aa, Mycobacterium tuberculosis
STAVAALFGAHGQAYQALS

SEQ ID NO: 1491833 - protein, 19 aa, Mycobacterium tuberculosis
STAVAALFSQHAQGYQAAA

SEQ ID NO: 1491834 - protein, 18 aa, Mycobacterium tuberculosis
STAVAHGIRVTWAVLNDG

SEQ ID NO: 1491835 - protein, 17 aa, Mycobacterium tuberculosis
STAVSCGAGGDGGNAGF

SEQ ID NO: 1491836 - protein, 24 aa, Mycobacterium tuberculosis
STEFAELRPRLVYDRDTGTLTARP

SEQ ID NO: 1491837 - protein, 22 aa, Mycobacterium tuberculosis
STEIPVLVLPSGKRIEFQMASA

SEQ ID NO: 1491838 - protein, 20 aa, Mycobacterium tuberculosis
STEVISNFASYLAIVLRVDE

SEQ ID NO: 1491839 - protein, 26 aa, Mycobacterium tuberculosis
STFTNGALIFGEFDLPQLVVHPYTLT

SEQ ID NO: 1491840 - protein, 29 aa, Mycobacterium tuberculosis
STFTNGALIFGEFDLPQLVVHPYTLTGPI

SEQ ID NO: 1491841 - protein, 18 aa, Mycobacterium tuberculosis
STGTNLWGAFGLLAEMVK

SEQ ID NO: 1491842 - protein, 24 aa, Mycobacterium tuberculosis
STGTPRPPFDYMQQVYDRYIAPHY

SEQ ID NO: 1491843 - protein, 19 aa, Mycobacterium tuberculosis
STGVLRCFSTVKPLPHRTP

SEQ ID NO: 1491844 - protein, 18 aa, Mycobacterium tuberculosis
STHFDWVLAPYDLTASRA

SEQ ID NO: 1491845 - protein, 17 aa, Mycobacterium tuberculosis
STIALGLLHRLTAMVAK

SEQ ID NO: 1491846 - protein, 17 aa, Mycobacterium tuberculosis
STICSAAAASAEAYAPA

SEQ ID NO: 1491847 - protein, 34 aa, Mycobacterium tuberculosis
STLGLDFMRSCSIRHRMASVIFSLEMSKSEIVMR

SEQ ID NO: 1491848 - protein, 24 aa, Mycobacterium tuberculosis
STLRLPLGLVGKGGDGGKRGHRRH

SEQ ID NO: 1491849 - protein, 25 aa, Mycobacterium tuberculosis
STLRRLCSRAPLTIRRSATLSLSLK

SEQ ID NO: 1491850 - protein, 18 aa, Mycobacterium tuberculosis
STLSRTAFQLGVLERGLQ

SEQ ID NO: 1491851 - protein, 17 aa, Mycobacterium tuberculosis
STMPELCCQYDPLMSPL

SEQ ID NO: 1491852 - protein, 17 aa, Mycobacterium tuberculosis
STNPIASIFAWTRGLQH

SEQ ID NO: 1491853 - protein, 19 aa, Mycobacterium tuberculosis
STPLPAARIGPGTNNAPSA

SEQ ID NO: 1491854 - protein, 17 aa, Mycobacterium tuberculosis
STPSWSPASPTRASVVG

SEQ ID NO: 1491855 - protein, 17 aa, Mycobacterium tuberculosis
STPTMLSVPRWAVGPVM

SEQ ID NO: 1491856 - protein, 24 aa, Mycobacterium tuberculosis
STPWPGGELPDWYRRCYDPVVPLD

SEQ ID NO: 1491857 - protein, 25 aa, Mycobacterium tuberculosis
STQAAAFHSRFVQALTTAAASYASV

SEQ ID NO: 1491858 - protein, 26 aa, Mycobacterium tuberculosis
STQAAAFHSRFVQALTTAAASYASVE

SEQ ID NO: 1491859 - protein, 27 aa, Mycobacterium tuberculosis
STQPVLLDWAVGLAFPCQQPMLHANGI

SEQ ID NO: 1491860 - protein, 24 aa, Mycobacterium tuberculosis
STREIRVALRLAVVLRPEKLRCGD

SEQ ID NO: 1491861 - protein, 21 aa, Mycobacterium tuberculosis
STRRYRPPGARWSRTCAWSPS

SEQ ID NO: 1491862 - protein, 20 aa, Mycobacterium tuberculosis
STRWWTEIARVLRAGGSYFA

SEQ ID NO: 1491863 - protein, 26 aa, Mycobacterium tuberculosis
STSATWARKCSRPSCPTSPSSPAPTW

SEQ ID NO: 1491864 - protein, 18 aa, Mycobacterium tuberculosis
STSKCLGLAQHRHQPGWG

SEQ ID NO: 1491865 - protein, 25 aa, Mycobacterium tuberculosis
STSPAAPCWTSTKPSTWAPSTSSRS

SEQ ID NO: 1491866 - protein, 24 aa, Mycobacterium tuberculosis
STSPACRCSTSTKSSRSDPSPSRR

SEQ ID NO: 1491867 - protein, 23 aa, Mycobacterium tuberculosis
STSRPPAVRARCWSTSPRTCCRA

SEQ ID NO: 1491868 - protein, 23 aa, Mycobacterium tuberculosis
STSWAQRWLAATGNRDYLGAFVK

SEQ ID NO: 1491869 - protein, 20 aa, Mycobacterium tuberculosis
STSWAQRWLAATGSRDYLGA

SEQ ID NO: 1491870 - protein, 22 aa, Mycobacterium tuberculosis
STTARSNVRFGYEVTEPGIPYP

SEQ ID NO: 1491871 - protein, 18 aa, Mycobacterium tuberculosis
STTEFSRLVTLKKRLDPD

SEQ ID NO: 1491872 - protein, 19 aa, Mycobacterium tuberculosis
STTEFSRLVTLKNRLDPDN

SEQ ID NO: 1491873 - protein, 25 aa, Mycobacterium tuberculosis
STTIGAFAIPGGPGYFNSSTAPSSG

SEQ ID NO: 1491874 - protein, 18 aa, Mycobacterium tuberculosis
STTPASPVTSCWPTWTMR

SEQ ID NO: 1491875 - protein, 18 aa, Mycobacterium tuberculosis
STTRVCGSPKGLPRWGFS

SEQ ID NO: 1491876 - protein, 20 aa, Mycobacterium tuberculosis
STTSAAWRAATRSSTKPALT

SEQ ID NO: 1491877 - protein, 17 aa, Mycobacterium tuberculosis
STTWPKLAVFARELVER

SEQ ID NO: 1491878 - protein, 19 aa, Mycobacterium tuberculosis
STVAAFAAIAARPASPGGA

SEQ ID NO: 1491879 - protein, 23 aa, Mycobacterium tuberculosis
STVARAFLRQALGVEVLSHVISI

SEQ ID NO: 1491880 - protein, 17 aa, Mycobacterium tuberculosis
STVGTLIGNGGDGGNSV

SEQ ID NO: 1491881 - protein, 23 aa, Mycobacterium tuberculosis
STVRGARNYPCQEFPGKRAPTVQ

SEQ ID NO: 1491882 - protein, 24 aa, Mycobacterium tuberculosis
STVRGARNYPCQEFPGKRAPTVQL

SEQ ID NO: 1491883 - protein, 17 aa, Mycobacterium tuberculosis
STVRPGIPVAFDAVIAR

SEQ ID NO: 1491884 - protein, 25 aa, Mycobacterium tuberculosis
STVTARPPYRLALQTREQHIRRDKA

SEQ ID NO: 1491885 - protein, 19 aa, Mycobacterium tuberculosis
STVWSVWGVGGAILLGDAL

SEQ ID NO: 1491886 - protein, 17 aa, Mycobacterium tuberculosis
STWCSGILGKPLVRHTV

SEQ ID NO: 1491887 - protein, 19 aa, Mycobacterium tuberculosis
SVAALWSVFSCRRHTTRDT

SEQ ID NO: 1491888 - protein, 23 aa, Mycobacterium tuberculosis
SVACQEFITALGRNFAVIYQQAN

SEQ ID NO: 1491889 - protein, 25 aa, Mycobacterium tuberculosis
SVAREDSEFAVLRRQIAVGGQVLQL

SEQ ID NO: 1491890 - protein, 24 aa, Mycobacterium tuberculosis
SVARLRFGPATHRKVKKWLAHGDF

SEQ ID NO: 1491891 - protein, 17 aa, Mycobacterium tuberculosis
SVARVRRASVSSVDATT

SEQ ID NO: 1491892 - protein, 21 aa, Mycobacterium tuberculosis
SVASGRVSYVLGLQGPAVSVD

SEQ ID NO: 1491893 - protein, 19 aa, Mycobacterium tuberculosis
SVAVAALFGTHAQEYQTVS

SEQ ID NO: 1491894 - protein, 18 aa, Mycobacterium tuberculosis
SVAYRLTGTVADAEDIVQ

SEQ ID NO: 1491895 - protein, 19 aa, Mycobacterium tuberculosis
SVCRRGGGQFGPRSAALAA

SEQ ID NO: 1491896 - protein, 25 aa, Mycobacterium tuberculosis
SVDAVLVAQAWHWVDPRPGDSGGRP

SEQ ID NO: 1491897 - protein, 24 aa, Mycobacterium tuberculosis
SVESRPGWADVPGLMVPGAAPVLP

SEQ ID NO: 1491898 - protein, 19 aa, Mycobacterium tuberculosis
SVEVGDGWFQRVALTNSAG

SEQ ID NO: 1491899 - protein, 17 aa, Mycobacterium tuberculosis
SVEYLVDAVFNYPTFSE

SEQ ID NO: 1491900 - protein, 17 aa, Mycobacterium tuberculosis
SVFPFDGTRRWFHLECN

SEQ ID NO: 1491901 - protein, 24 aa, Mycobacterium tuberculosis
SVGGACRRYLQELGDLPTNTLTAS

SEQ ID NO: 1491902 - protein, 23 aa, Mycobacterium tuberculosis
SVGGDSGLFGMHGQTYQALSARA

SEQ ID NO: 1491903 - protein, 19 aa, Mycobacterium tuberculosis
SVGGPVFERGLRWSPPPAG

SEQ ID NO: 1491904 - protein, 19 aa, Mycobacterium tuberculosis
SVGKFEFRASAVIVASGGI

SEQ ID NO: 1491905 - protein, 24 aa, Mycobacterium tuberculosis
SVGNSWTPLAPVVEPPTPPTPASA

SEQ ID NO: 1491906 - protein, 25 aa, Mycobacterium tuberculosis
SVHGRPRRAGVSSFGISGTNAHVIL

SEQ ID NO: 1491907 - protein, 25 aa, Mycobacterium tuberculosis
SVHHPSCLPGAILDRSSRFSPDRGS

SEQ ID NO: 1491908 - protein, 17 aa, Mycobacterium tuberculosis
SVISGLTGDDWLGPSAL

SEQ ID NO: 1491909 - protein, 25 aa, Mycobacterium tuberculosis
SVLGRSWPVVCDELLGHYEAVRGRR

SEQ ID NO: 1491910 - protein, 24 aa, Mycobacterium tuberculosis
SVLGRSWPVVCDELLGHYKAVRGR

SEQ ID NO: 1491911 - protein, 27 aa, Mycobacterium tuberculosis
SVLPALGEEGIYIFTWADLDQAERDRL

SEQ ID NO: 1491912 - protein, 24 aa, Mycobacterium tuberculosis
SVLPPEINSALMFAGAGPGPMLAA

SEQ ID NO: 1491913 - protein, 17 aa, Mycobacterium tuberculosis
SVMPLRSSIHPVAPTLR

SEQ ID NO: 1491914 - protein, 37 aa, Mycobacterium tuberculosis
SVNVEDWKCWARWRLIRARAPWLTRALVAEDFEFYGR

SEQ ID NO: 1491915 - protein, 17 aa, Mycobacterium tuberculosis
SVPHVLIEPGVRTGIPL

SEQ ID NO: 1491916 - protein, 17 aa, Mycobacterium tuberculosis
SVPPSWAAATPAIRTVA

SEQ ID NO: 1491917 - protein, 18 aa, Mycobacterium tuberculosis
SVPPSWAAPSTRPVSALS

SEQ ID NO: 1491918 - protein, 25 aa, Mycobacterium tuberculosis
SVPPSWAAPSTRPVSALSPAGLTTL

SEQ ID NO: 1491919 - protein, 22 aa, Mycobacterium tuberculosis
SVPSIILGGIDWFRSMGSEKSP

SEQ ID NO: 1491920 - protein, 17 aa, Mycobacterium tuberculosis
SVRLTCWTRQMHCLTRV

SEQ ID NO: 1491921 - protein, 17 aa, Mycobacterium tuberculosis
SVRSGLGVYSSRRDAAG

SEQ ID NO: 1491922 - protein, 27 aa, Mycobacterium tuberculosis
SVRSPAYCFTLPFAHQALMPINVVATA

SEQ ID NO: 1491923 - protein, 24 aa, Mycobacterium tuberculosis
SVRSPVYLVLAARRRCVSGCARRR

SEQ ID NO: 1491924 - protein, 19 aa, Mycobacterium tuberculosis
SVSARAAAIHDQFVATLAS

SEQ ID NO: 1491925 - protein, 17 aa, Mycobacterium tuberculosis
SVSAWRADGMQLGKPQL

SEQ ID NO: 1491926 - protein, 17 aa, Mycobacterium tuberculosis
SVSDFFDSSGTGDEGGN

SEQ ID NO: 1491927 - protein, 32 aa, Mycobacterium tuberculosis
SVTISGLRRDYRWAEADRHLWIADERGTWHLR

SEQ ID NO: 1491928 - protein, 20 aa, Mycobacterium tuberculosis
SVTMPGKFAALRFADERTAR

SEQ ID NO: 1491929 - protein, 24 aa, Mycobacterium tuberculosis
SVTMPGKFAALRFADERTARADLV

SEQ ID NO: 1491930 - protein, 23 aa, Mycobacterium tuberculosis
SVTSELAGGAWQGPASAAMANAA

SEQ ID NO: 1491931 - protein, 22 aa, Mycobacterium tuberculosis
SVTSELTSGAWLGPSAAAMMAV

SEQ ID NO: 1491932 - protein, 17 aa, Mycobacterium tuberculosis
SVTSGLADAAWRGPAAV

SEQ ID NO: 1491933 - protein, 19 aa, Mycobacterium tuberculosis
SVVATCYLLGVSTRRMERL

SEQ ID NO: 1491934 - protein, 21 aa, Mycobacterium tuberculosis
SVVINPFFDWAYDRSPRTPYH

SEQ ID NO: 1491935 - protein, 20 aa, Mycobacterium tuberculosis
SVWFQRGPLDAAIRASIAIP

SEQ ID NO: 1491936 - protein, 17 aa, Mycobacterium tuberculosis
SVYARLMDIERELVLEH

SEQ ID NO: 1491937 - protein, 24 aa, Mycobacterium tuberculosis
SVYSRGDVGTGWVLHAEGAAARRV

SEQ ID NO: 1491938 - protein, 25 aa, Mycobacterium tuberculosis
SVYSRGDVGTGWVLHAEGALRAGSA

SEQ ID NO: 1491939 - protein, 20 aa, Mycobacterium tuberculosis
SWATAWRPQRSCRNYVRRYA

SEQ ID NO: 1491940 - protein, 19 aa, Mycobacterium tuberculosis
SWCAGRRALAEAACRAFDA

SEQ ID NO: 1491941 - protein, 18 aa, Mycobacterium tuberculosis
SWDHPYRAPPKVWFHDLL

SEQ ID NO: 1491942 - protein, 24 aa, Mycobacterium tuberculosis
SWDIFKCVRQVLDVLDRVDDPLPA

SEQ ID NO: 1491943 - protein, 32 aa, Mycobacterium tuberculosis
SWGQPMLNPGVRGFCGKSRRSSSTGGAPPRSR

SEQ ID NO: 1491944 - protein, 19 aa, Mycobacterium tuberculosis
SWGRRCSTRSRGFCGKSRR

SEQ ID NO: 1491945 - protein, 28 aa, Mycobacterium tuberculosis
SWHSAIPTRRLNLLVAPMARLRWPKPIG

SEQ ID NO: 1491946 - protein, 18 aa, Mycobacterium tuberculosis
SWKGWGHVRWFIEEVPAG

SEQ ID NO: 1491947 - protein, 24 aa, Mycobacterium tuberculosis
SWLETETSCTFGRGPNPLLVSVRS

SEQ ID NO: 1491948 - protein, 25 aa, Mycobacterium tuberculosis
SWLNSYYDDMAWLALALERADRVAG

SEQ ID NO: 1491949 - protein, 19 aa, Mycobacterium tuberculosis
SWLPVPVPPVPPVPPLPVK

SEQ ID NO: 1491950 - protein, 19 aa, Mycobacterium tuberculosis
SWLRPASCTTALRRPTAVA

SEQ ID NO: 1491951 - protein, 18 aa, Mycobacterium tuberculosis
SWMLVAHVDQVAKTGDYV

SEQ ID NO: 1491952 - protein, 18 aa, Mycobacterium tuberculosis
SWRNYQWHQLARAFLMYV

SEQ ID NO: 1491953 - protein, 24 aa, Mycobacterium tuberculosis
SWRPTPDLRPAPMTQGSLVRFLVR

SEQ ID NO: 1491954 - protein, 24 aa, Mycobacterium tuberculosis
SWTARTWQMLAARGVRIAADVAAE

SEQ ID NO: 1491955 - protein, 18 aa, Mycobacterium tuberculosis
SWVSKCWSRSLSGDRERG

SEQ ID NO: 1491956 - protein, 26 aa, Mycobacterium tuberculosis
SWWKEERGARIFIDFTQNARDRTMAS

SEQ ID NO: 1491957 - protein, 18 aa, Mycobacterium tuberculosis
SWWLGPKCGRRVGRAIDR

SEQ ID NO: 1491958 - protein, 18 aa, Mycobacterium tuberculosis
SWYLTSIRAGLEPWSDGV

SEQ ID NO: 1491959 - protein, 18 aa, Mycobacterium tuberculosis
SYAEAAAISAVFTTAYYA

SEQ ID NO: 1491960 - protein, 18 aa, Mycobacterium tuberculosis
SYARQMLDPGGWVEADED

SEQ ID NO: 1491961 - protein, 25 aa, Mycobacterium tuberculosis
SYARQMLDPGGWVEADEDTFYDRAQ

SEQ ID NO: 1491962 - protein, 25 aa, Mycobacterium tuberculosis
SYDAPVAEYWPEFGANGKSEVTVSD

SEQ ID NO: 1491963 - protein, 22 aa, Mycobacterium tuberculosis
SYELFARAVIPYFKGQLAAPRA

SEQ ID NO: 1491964 - protein, 19 aa, Mycobacterium tuberculosis
SYETAGMRTTCGRRDLADY

SEQ ID NO: 1491965 - protein, 26 aa, Mycobacterium tuberculosis
SYLFQPGHRIRIAIAGADASHFAILP

SEQ ID NO: 1491966 - protein, 29 aa, Mycobacterium tuberculosis
SYLGFNEFRAIAGIGEMFDTLLVYENFPP

SEQ ID NO: 1491967 - protein, 24 aa, Mycobacterium tuberculosis
SYLPSELVAAFLWAQFEEAERITR

SEQ ID NO: 1491968 - protein, 19 aa, Mycobacterium tuberculosis
SYLRCLRVLTAGRGYPMVA

SEQ ID NO: 1491969 - protein, 20 aa, Mycobacterium tuberculosis
SYMGGAPFQPAVALALDTED

SEQ ID NO: 1491970 - protein, 25 aa, Mycobacterium tuberculosis
SYNEGGPCWSMRLNAVEPPKGPAWR

SEQ ID NO: 1491971 - protein, 21 aa, Mycobacterium tuberculosis
SYNGMLYFGINADRDAMSDVD

SEQ ID NO: 1491972 - protein, 19 aa, Mycobacterium tuberculosis
SYNRRALMRFVTSVKSGSD

SEQ ID NO: 1491973 - protein, 20 aa, Mycobacterium tuberculosis
SYPNRMRTTRAFPPSGSDLS

SEQ ID NO: 1491974 - protein, 19 aa, Mycobacterium tuberculosis
SYPPGDPFWPASVPPVPPL

SEQ ID NO: 1491975 - protein, 18 aa, Mycobacterium tuberculosis
SYQCAIDAMSSRCFPSYA

SEQ ID NO: 1491976 - protein, 21 aa, Mycobacterium tuberculosis
SYRLRAVSAVGLRFPLNGTAN

SEQ ID NO: 1491977 - protein, 17 aa, Mycobacterium tuberculosis
SYRNWKLPDPAGQPLDV

SEQ ID NO: 1491978 - protein, 21 aa, Mycobacterium tuberculosis
SYRYPERPDIPSVYRSATTAA

SEQ ID NO: 1491979 - protein, 19 aa, Mycobacterium tuberculosis
SYSESFGLVAVEAQACGTP

SEQ ID NO: 1491980 - protein, 29 aa, Mycobacterium tuberculosis
SYSNGILWRGDYQGLIGYSDTLSIPGIPL

SEQ ID NO: 1491981 - protein, 24 aa, Mycobacterium tuberculosis
SYYADFEGVLAFLQRKMSQTESEQ

SEQ ID NO: 1491982 - protein, 18 aa, Mycobacterium tuberculosis
TAAAMDLASIGSTVSAAS

SEQ ID NO: 1491983 - protein, 23 aa, Mycobacterium tuberculosis
TAAARAGLGWGMFPEKLAASPLA

SEQ ID NO: 1491984 - protein, 26 aa, Mycobacterium tuberculosis
TAAASAARRVTVVAIATVTAVTPGHA

SEQ ID NO: 1491985 - protein, 33 aa, Mycobacterium tuberculosis
TAAATPGWLEWFINWYLPISQLFTTPWVCHISP

SEQ ID NO: 1491986 - protein, 24 aa, Mycobacterium tuberculosis
TAAKRLCRSRVGIDAEAGPTEIAI

SEQ ID NO: 1491987 - protein, 20 aa, Mycobacterium tuberculosis
TAALLARCTGLRTCTTRLTR

SEQ ID NO: 1491988 - protein, 20 aa, Mycobacterium tuberculosis
TAALSGLVDRFGLAGERLDM

SEQ ID NO: 1491989 - protein, 18 aa, Mycobacterium tuberculosis
TAAPEVLAGPAAMADPEV

SEQ ID NO: 1491990 - protein, 18 aa, Mycobacterium tuberculosis
TAARPGRSLSGFSASRPI

SEQ ID NO: 1491991 - protein, 17 aa, Mycobacterium tuberculosis
TAARRIGTWIGAAAEGQ

SEQ ID NO: 1491992 - protein, 25 aa, Mycobacterium tuberculosis
TAAWRKLLVNALAGFMVLSGRRSAM

SEQ ID NO: 1491993 - protein, 18 aa, Mycobacterium tuberculosis
TADAMAWTDALRAAALPG

SEQ ID NO: 1491994 - protein, 18 aa, Mycobacterium tuberculosis
TADGYASNWLCDHAQVGM

SEQ ID NO: 1491995 - protein, 17 aa, Mycobacterium tuberculosis
TADIGWVTGHTYGVYGP

SEQ ID NO: 1491996 - protein, 26 aa, Mycobacterium tuberculosis
TADLRAGLPDGEFFGVIAQLPGASGR

SEQ ID NO: 1491997 - protein, 17 aa, Mycobacterium tuberculosis
TADSSQRLYSWAQERPY

SEQ ID NO: 1491998 - protein, 17 aa, Mycobacterium tuberculosis
TAELAARLERTWQENWA

SEQ ID NO: 1491999 - protein, 24 aa, Mycobacterium tuberculosis
TAELLRLALTGKRKPYIYTSTIAV

SEQ ID NO: 1492000 - protein, 18 aa, Mycobacterium tuberculosis
TAELRPGEGRTVYGVIVP

SEQ ID NO: 1492001 - protein, 28 aa, Mycobacterium tuberculosis
TAESRRATLRAPLAVMVANGSDGVAAGS

SEQ ID NO: 1492002 - protein, 26 aa, Mycobacterium tuberculosis
TAFAESVPIWGPRGAALIQAIPEATQ

SEQ ID NO: 1492003 - protein, 26 aa, Mycobacterium tuberculosis
TAFAESVPMWGPRGAALIPAIPEATQ

SEQ ID NO: 1492004 - protein, 18 aa, Mycobacterium tuberculosis
TAFPVVPAGVGRTALRRR

SEQ ID NO: 1492005 - protein, 17 aa, Mycobacterium tuberculosis
TAFQLGVLERGLQMTAE

SEQ ID NO: 1492006 - protein, 17 aa, Mycobacterium tuberculosis
TAFYYVRSGITVVPDEL

SEQ ID NO: 1492007 - protein, 21 aa, Mycobacterium tuberculosis
TAGAPAHDWLTLTGGAIGYGI

SEQ ID NO: 1492008 - protein, 17 aa, Mycobacterium tuberculosis
TAGDVVQIFAGNDVVAT

SEQ ID NO: 1492009 - protein, 18 aa, Mycobacterium tuberculosis
TAGHATAIMWAREQFGLE

SEQ ID NO: 1492010 - protein, 24 aa, Mycobacterium tuberculosis
TAGKGKWDTLRAMGFDDDHISDSR

SEQ ID NO: 1492011 - protein, 18 aa, Mycobacterium tuberculosis
TAGLLYGVGGAGGGGGAG

SEQ ID NO: 1492012 - protein, 18 aa, Mycobacterium tuberculosis
TAGLPFLIHAVSAAAVGR

SEQ ID NO: 1492013 - protein, 26 aa, Mycobacterium tuberculosis
TAGNPEIRPAHLLMALLTQNDGIAAP

SEQ ID NO: 1492014 - protein, 19 aa, Mycobacterium tuberculosis
TAGRGRHGRGWAATARAQI

SEQ ID NO: 1492015 - protein, 17 aa, Mycobacterium tuberculosis
TAHAWIRASNPIMVGWP

SEQ ID NO: 1492016 - protein, 19 aa, Mycobacterium tuberculosis
TAHRRVRHLSADQVITRPE

SEQ ID NO: 1492017 - protein, 21 aa, Mycobacterium tuberculosis
TAIARRSDGKLVLGSADGAVY

SEQ ID NO: 1492018 - protein, 20 aa, Mycobacterium tuberculosis
TAIGLTLPFGEVTLAPEVQG

SEQ ID NO: 1492019 - protein, 23 aa, Mycobacterium tuberculosis
TAIQARAAALAFEQAYAMTLPPP

SEQ ID NO: 1492020 - protein, 22 aa, Mycobacterium tuberculosis
TAKGGIVFRVQQELGVPVKLVG

SEQ ID NO: 1492021 - protein, 20 aa, Mycobacterium tuberculosis
TAKQGRRPTLPTTSSKVSPV

SEQ ID NO: 1492022 - protein, 22 aa, Mycobacterium tuberculosis
TAKREIRLLSRFTGANPTVPVV

SEQ ID NO: 1492023 - protein, 23 aa, Mycobacterium tuberculosis
TAKRRLRVCPDVCRRSGQRAPRT

SEQ ID NO: 1492024 - protein, 25 aa, Mycobacterium tuberculosis
TAKVFSRYVDAIVWRTFGQERLDAM

SEQ ID NO: 1492025 - protein, 33 aa, Mycobacterium tuberculosis
TAKYLNTWGQRGPAVAQGCCLAAAARRAPADLV

SEQ ID NO: 1492026 - protein, 20 aa, Mycobacterium tuberculosis
TALDRRGAAGLSVRRGAGPA

SEQ ID NO: 1492027 - protein, 23 aa, Mycobacterium tuberculosis
TALGAEVRWASCNIFSTQDHAAA

SEQ ID NO: 1492028 - protein, 17 aa, Mycobacterium tuberculosis
TALGCYAEPGWARERGW

SEQ ID NO: 1492029 - protein, 21 aa, Mycobacterium tuberculosis
TALGRANGTYGDFQNFYLCDL

SEQ ID NO: 1492030 - protein, 20 aa, Mycobacterium tuberculosis
TALNFMPGWLDMLLEVGGGR

SEQ ID NO: 1492031 - protein, 23 aa, Mycobacterium tuberculosis
TALREIALLWLADQVDAALEKYR

SEQ ID NO: 1492032 - protein, 20 aa, Mycobacterium tuberculosis
TALTDATRDFAIGLAGIPPS

SEQ ID NO: 1492033 - protein, 21 aa, Mycobacterium tuberculosis
TALTDATRDFAIGLAGIPPSL

SEQ ID NO: 1492034 - protein, 21 aa, Mycobacterium tuberculosis
TALYPPKRFLGAARNIEEGGS

SEQ ID NO: 1492035 - protein, 18 aa, Mycobacterium tuberculosis
TAMPGLLNNGVLIDESAG

SEQ ID NO: 1492036 - protein, 19 aa, Mycobacterium tuberculosis
TAMWYAVIDGEIWLETKAK

SEQ ID NO: 1492037 - protein, 28 aa, Mycobacterium tuberculosis
TANAYLGAWGIVDCFERGADVVVTGRVT

SEQ ID NO: 1492038 - protein, 25 aa, Mycobacterium tuberculosis
TANPCGVCESCVSLAPNAPGSIDVV

SEQ ID NO: 1492039 - protein, 25 aa, Mycobacterium tuberculosis
TAPARRVRFCVCSPVDFLGAEATRQ

SEQ ID NO: 1492040 - protein, 28 aa, Mycobacterium tuberculosis
TAPGASGRNRLKYIDGLTIDRQPSNQTF

SEQ ID NO: 1492041 - protein, 22 aa, Mycobacterium tuberculosis
TAPRARTAAFFDLDKTIIAKSS

SEQ ID NO: 1492042 - protein, 28 aa, Mycobacterium tuberculosis
TAPRLLLEVVCARLLLPSASDAESALLQ

SEQ ID NO: 1492043 - protein, 24 aa, Mycobacterium tuberculosis
TAPSRSAFVAGPWGAVASLSPELF

SEQ ID NO: 1492044 - protein, 18 aa, Mycobacterium tuberculosis
TAQPGLVRSLPGWSAAVA

SEQ ID NO: 1492045 - protein, 42 aa, Mycobacterium tuberculosis
TAQRHLADLASIWRRCGGRTVTLFRSEWRRPVELSTSVPEVV

SEQ ID NO: 1492046 - protein, 18 aa, Mycobacterium tuberculosis
TAQWRWDMLAAKLADFLR

SEQ ID NO: 1492047 - protein, 18 aa, Mycobacterium tuberculosis
TARIQLRLADPGESQMGH

SEQ ID NO: 1492048 - protein, 17 aa, Mycobacterium tuberculosis
TARIVPGATALDFQAKY

SEQ ID NO: 1492049 - protein, 28 aa, Mycobacterium tuberculosis
TARQRAHAAWLWSRRRAVVAGNSAAALL

SEQ ID NO: 1492050 - protein, 19 aa, Mycobacterium tuberculosis
TARRRGVVINPVLETSEIP

SEQ ID NO: 1492051 - protein, 20 aa, Mycobacterium tuberculosis
TASALLTCVARDPDPANVGR

SEQ ID NO: 1492052 - protein, 23 aa, Mycobacterium tuberculosis
TASCKHPMIFPLSNPTSRMEAIP

SEQ ID NO: 1492053 - protein, 21 aa, Mycobacterium tuberculosis
TASGDCRTWVGLTVVADDNLA

SEQ ID NO: 1492054 - protein, 25 aa, Mycobacterium tuberculosis
TASKGKWDTLRAMGFDDDHISDSRS

SEQ ID NO: 1492055 - protein, 19 aa, Mycobacterium tuberculosis
TASRILASFAPAIPDRSDV

SEQ ID NO: 1492056 - protein, 24 aa, Mycobacterium tuberculosis
TASYGGAITRAWPASPSGTPFRCS

SEQ ID NO: 1492057 - protein, 18 aa, Mycobacterium tuberculosis
TATDLGVCGGWNARTGAA

SEQ ID NO: 1492058 - protein, 24 aa, Mycobacterium tuberculosis
TATGLTLPPTLIFDYPTAAELAEH

SEQ ID NO: 1492059 - protein, 18 aa, Mycobacterium tuberculosis
TATGLTLSPTLIFDYPTP

SEQ ID NO: 1492060 - protein, 25 aa, Mycobacterium tuberculosis
TATLLTARCPVLFAPAMHTEMWLHP

SEQ ID NO: 1492061 - protein, 25 aa, Mycobacterium tuberculosis
TATPLRPGIWRAYADHRMAMAGAII

SEQ ID NO: 1492062 - protein, 26 aa, Mycobacterium tuberculosis
TATPLRPGIWRAYADHRTAMAGAIIG

SEQ ID NO: 1492063 - protein, 17 aa, Mycobacterium tuberculosis
TAVAALFSQTRPGLPSG

SEQ ID NO: 1492064 - protein, 19 aa, Mycobacterium tuberculosis
TAVAARARHPPRTPATAGP

SEQ ID NO: 1492065 - protein, 20 aa, Mycobacterium tuberculosis
TAVACLGSAVAALTASAASS

SEQ ID NO: 1492066 - protein, 20 aa, Mycobacterium tuberculosis
TAVACPRFVDFVERGVTSGR

SEQ ID NO: 1492067 - protein, 20 aa, Mycobacterium tuberculosis
TAVCELMRIAWRTVGAIVAR

SEQ ID NO: 1492068 - protein, 19 aa, Mycobacterium tuberculosis
TAVGDWMLLAAIEALIDEQ

SEQ ID NO: 1492069 - protein, 18 aa, Mycobacterium tuberculosis
TAVPAEPPASVARAGPAD

SEQ ID NO: 1492070 - protein, 26 aa, Mycobacterium tuberculosis
TAVPVKLHVPIFLDIPVTGTLVHVHR

SEQ ID NO: 1492071 - protein, 18 aa, Mycobacterium tuberculosis
TAVRRAGAVVVDRHSDTD

SEQ ID NO: 1492072 - protein, 22 aa, Mycobacterium tuberculosis
TAVSGVRPELLGVGGHGGAGGH

SEQ ID NO: 1492073 - protein, 26 aa, Mycobacterium tuberculosis
TAVSRARRAIAEFRIRGVSTNIPFLQ

SEQ ID NO: 1492074 - protein, 20 aa, Mycobacterium tuberculosis
TAVTAPFPPSPAMPLEPPVA

SEQ ID NO: 1492075 - protein, 20 aa, Mycobacterium tuberculosis
TCDRSRLTADGIWLHCLYAL

SEQ ID NO: 1492076 - protein, 31 aa, Mycobacterium tuberculosis
TCDRSRLTADGLWLHCLYAISGINLREPLRA

SEQ ID NO: 1492077 - protein, 17 aa, Mycobacterium tuberculosis
TCVVIPKSAGRRCSCDL

SEQ ID NO: 1492078 - protein, 28 aa, Mycobacterium tuberculosis
TDAAQPIWWVVRAIEFSKDFETFVQELF

SEQ ID NO: 1492079 - protein, 18 aa, Mycobacterium tuberculosis
TDAEAILGIGDWGVGGIQ

SEQ ID NO: 1492080 - protein, 17 aa, Mycobacterium tuberculosis
TDALRAAALPGVVDIVA

SEQ ID NO: 1492081 - protein, 19 aa, Mycobacterium tuberculosis
TDANWTVCDGLNAPSRGGA

SEQ ID NO: 1492082 - protein, 18 aa, Mycobacterium tuberculosis
TDARRREVYWARYCDGIR

SEQ ID NO: 1492083 - protein, 25 aa, Mycobacterium tuberculosis
TDARRREVYWARYCDGIRTVGPAVN

SEQ ID NO: 1492084 - protein, 17 aa, Mycobacterium tuberculosis
TDDCGPIIAGWLEQHGF

SEQ ID NO: 1492085 - protein, 18 aa, Mycobacterium tuberculosis
TDEGPGFHGFRQGRNPFW

SEQ ID NO: 1492086 - protein, 26 aa, Mycobacterium tuberculosis
TDERGRRFLIHTARIAYVEIDRVADA

SEQ ID NO: 1492087 - protein, 18 aa, Mycobacterium tuberculosis
TDFLAIVARRRRRHPNMH

SEQ ID NO: 1492088 - protein, 19 aa, Mycobacterium tuberculosis
TDFLAIVARRRRRHPNMHI

SEQ ID NO: 1492089 - protein, 21 aa, Mycobacterium tuberculosis
TDGRWSCVQWGLRKPPFCPDP

SEQ ID NO: 1492090 - protein, 19 aa, Mycobacterium tuberculosis
TDHSPRLTIANGLSPDRLR

SEQ ID NO: 1492091 - protein, 17 aa, Mycobacterium tuberculosis
TDICEPVAVVGIGCRFP

SEQ ID NO: 1492092 - protein, 24 aa, Mycobacterium tuberculosis
TDIPRAGVEYGQLLAVLPLQRMLP

SEQ ID NO: 1492093 - protein, 17 aa, Mycobacterium tuberculosis
TDIPVRVYWPPVVRDNL

SEQ ID NO: 1492094 - protein, 23 aa, Mycobacterium tuberculosis
TDIPVTVKFRIGIDDAHHTHLDA

SEQ ID NO: 1492095 - protein, 30 aa, Mycobacterium tuberculosis
TDIRYWCYLACWPATVSTWILRRILRRLGY

SEQ ID NO: 1492096 - protein, 26 aa, Mycobacterium tuberculosis
TDKPFLMPVEDVFTITGRGTVVTGRV

SEQ ID NO: 1492097 - protein, 18 aa, Mycobacterium tuberculosis
TDLAKIGSTITAANTAAA

SEQ ID NO: 1492098 - protein, 20 aa, Mycobacterium tuberculosis
TDLGAAFARLMRTEDARPVV

SEQ ID NO: 1492099 - protein, 22 aa, Mycobacterium tuberculosis
TDLGASTALAFTVEPGTGSPQP

SEQ ID NO: 1492100 - protein, 23 aa, Mycobacterium tuberculosis
TDLKRIGASLAHENASAAASTTA

SEQ ID NO: 1492101 - protein, 27 aa, Mycobacterium tuberculosis
TDLLAFTAFPKQIWRQIWSNNPQERLN

SEQ ID NO: 1492102 - protein, 18 aa, Mycobacterium tuberculosis
TDLLDGWVAYFAEHPRER

SEQ ID NO: 1492103 - protein, 31 aa, Mycobacterium tuberculosis
TDLLYKLLRSEWLEPRWMVGIDPESDGLARA

SEQ ID NO: 1492104 - protein, 23 aa, Mycobacterium tuberculosis
TDLTLEEGVVFNAEISAAIEERL

SEQ ID NO: 1492105 - protein, 23 aa, Mycobacterium tuberculosis
TDMFPALAVAVTSQFAEPDDAEY

SEQ ID NO: 1492106 - protein, 26 aa, Mycobacterium tuberculosis
TDPHARLPLPLARDEIRYLGTTFNDL

SEQ ID NO: 1492107 - protein, 24 aa, Mycobacterium tuberculosis
TDPPVEGGWAWLPDEAQGARVHWR

SEQ ID NO: 1492108 - protein, 17 aa, Mycobacterium tuberculosis
TDPRLLAGDARRAARER

SEQ ID NO: 1492109 - protein, 30 aa, Mycobacterium tuberculosis; identical to SEQ ID NO: 234321

SEQ ID NO: 1492110 - protein, 21 aa, Mycobacterium tuberculosis
TDQLPLVRALVDMAGLPPQAA

SEQ ID NO: 1492111 - protein, 20 aa, Mycobacterium tuberculosis
TDRFPLVAADPERTAELATR

SEQ ID NO: 1492112 - protein, 23 aa, Mycobacterium tuberculosis
TDRRTRQSFALSARAVINAAGVW

SEQ ID NO: 1492113 - protein, 26 aa, Mycobacterium tuberculosis
TDSEAMDAFGLLCRMEGIIPAIESAH

SEQ ID NO: 1492114 - protein, 18 aa, Mycobacterium tuberculosis
TDTILGRKVLEIEPRGAQ

SEQ ID NO: 1492115 - protein, 23 aa, Mycobacterium tuberculosis
TDTPGLPKMGSFEVMNRTIDIAQ

SEQ ID NO: 1492116 - protein, 20 aa, Mycobacterium tuberculosis
TDVSGGLGGAGGNGGAGGGG

SEQ ID NO: 1492117 - protein, 26 aa, Mycobacterium tuberculosis
TEAAHGRRLLRIAASSAFAEHAAPGL

SEQ ID NO: 1492118 - protein, 24 aa, Mycobacterium tuberculosis
TEACGDCPRVVLGSPLAGESLDEV

SEQ ID NO: 1492119 - protein, 29 aa, Mycobacterium tuberculosis
TEATMSAVRWPRFTAGPDRQVLGCYHGHV

SEQ ID NO: 1492120 - protein, 20 aa, Mycobacterium tuberculosis
TEDMDLSAFVVFSSMAGIVG

SEQ ID NO: 1492121 - protein, 24 aa, Mycobacterium tuberculosis
TEDMDLSAFVVFSSMAGIVGTPAQ

SEQ ID NO: 1492122 - protein, 25 aa, Mycobacterium tuberculosis
TEDMDLSAFVVFSSMAGIVGTPAQG

SEQ ID NO: 1492123 - protein, 24 aa, Mycobacterium tuberculosis
TEEITGLDLVEWQLRVGAGEKLGF

SEQ ID NO: 1492124 - protein, 24 aa, Mycobacterium tuberculosis
TEFAELRPRLVYDRDTGTLTARPG

SEQ ID NO: 1492125 - protein, 36 aa, Mycobacterium tuberculosis
TEFEAGLRFHPCPRARAGGTTPFFKQIPFAVLLSPP

SEQ ID NO: 1492126 - protein, 20 aa, Mycobacterium tuberculosis
TEHRLCFGVFCNDAAESVAQ

SEQ ID NO: 1492127 - protein, 26 aa, Mycobacterium tuberculosis
TEIAQTVARWLVLYLRRPGGQTQFAA

SEQ ID NO: 1492128 - protein, 20 aa, Mycobacterium tuberculosis
TEIMVCRYADGVGHPFWFSR

SEQ ID NO: 1492129 - protein, 18 aa, Mycobacterium tuberculosis
TEINWIRGFLPPLPPISP

SEQ ID NO: 1492130 - protein, 22 aa, Mycobacterium tuberculosis
TEITRLVPFIEWLRGAYPDQLI

SEQ ID NO: 1492131 - protein, 22 aa, Mycobacterium tuberculosis
TELLRALAVSDLDPFIDLLSEG

SEQ ID NO: 1492132 - protein, 22 aa, Mycobacterium tuberculosis
TELRAIAGLVLVAGFETAVNLL

SEQ ID NO: 1492133 - protein, 21 aa, Mycobacterium tuberculosis
TELRAIAGLVLVAGFETTVNL

SEQ ID NO: 1492134 - protein, 17 aa, Mycobacterium tuberculosis
TELVYRYLDTEAIAVVQ

SEQ ID NO: 1492135 - protein, 23 aa, Mycobacterium tuberculosis
TEPAGGTGAKCGDGGDGGAGGAG

SEQ ID NO: 1492136 - protein, 27 aa, Mycobacterium tuberculosis
TEPGYRPSVKLAAFVRARDLTCRAPGC

SEQ ID NO: 1492137 - protein, 19 aa, Mycobacterium tuberculosis
TEPLVPRPVHAINCTPAYL

SEQ ID NO: 1492138 - protein, 24 aa, Mycobacterium tuberculosis
TEPMLFEWTDRDTLLYAIGVGAGT

SEQ ID NO: 1492139 - protein, 20 aa, Mycobacterium tuberculosis
TEPNALVFPSYRGGHLPIEE

SEQ ID NO: 1492140 - protein, 24 aa, Mycobacterium tuberculosis
TEPVAVVGIGCRFPGGVDGPDGLW

SEQ ID NO: 1492141 - protein, 22 aa, Mycobacterium tuberculosis
TEQDFRLFSGMSAHYYSLPRLI

SEQ ID NO: 1492142 - protein, 21 aa, Mycobacterium tuberculosis
TESALRFVGAATFEALSGEPV

SEQ ID NO: 1492143 - protein, 20 aa, Mycobacterium tuberculosis
TETELMAWAIPRAANRFWML

SEQ ID NO: 1492144 - protein, 26 aa, Mycobacterium tuberculosis
TETPRGWRMRCARKCRQTQNPERGRK

SEQ ID NO: 1492145 - protein, 17 aa, Mycobacterium tuberculosis
TETSPLATMAWPPPGTP

SEQ ID NO: 1492146 - protein, 21 aa, Mycobacterium tuberculosis
TEVAAHLVARAYRHGETADDF

SEQ ID NO: 1492147 - protein, 18 aa, Mycobacterium tuberculosis
TEVISNFASYLAIVLRVD

SEQ ID NO: 1492148 - protein, 17 aa, Mycobacterium tuberculosis
TEVLEWLSPLPGGSVVS

SEQ ID NO: 1492149 - protein, 18 aa, Mycobacterium tuberculosis
TEVPPVIDGSIWDAIAGC

SEQ ID NO: 1492150 - protein, 26 aa, Mycobacterium tuberculosis
TEVRLFLRRVPALAFLPNRRPAEPNQ

SEQ ID NO: 1492151 - protein, 17 aa, Mycobacterium tuberculosis
TEWLPPPHLDHGQPRTN

SEQ ID NO: 1492152 - protein, 21 aa, Mycobacterium tuberculosis
TEWPLPLLDLARIASDRGDAE

SEQ ID NO: 1492153 - protein, 31 aa, Mycobacterium tuberculosis
TFAQPYPAWRELFTDILPAHIVKDIPGGFAS

SEQ ID NO: 1492154 - protein, 21 aa, Mycobacterium tuberculosis
TFDARCAPAAYRFVSQARHIG

SEQ ID NO: 1492155 - protein, 25 aa, Mycobacterium tuberculosis
TFDARCAPGGLPVCQSGPSYRQGRV

SEQ ID NO: 1492156 - protein, 22 aa, Mycobacterium tuberculosis
TFDFEPGEFVALLGQSGSGKST

SEQ ID NO: 1492157 - protein, 19 aa, Mycobacterium tuberculosis
TFEGYRQQLGIDFAGVVTA

SEQ ID NO: 1492158 - protein, 23 aa, Mycobacterium tuberculosis
TFEVSRQLAALSIFANSGGKTAE

SEQ ID NO: 1492159 - protein, 19 aa, Mycobacterium tuberculosis
TFFTLKRTVSRGVIMRVGI

SEQ ID NO: 1492160 - protein, 18 aa, Mycobacterium tuberculosis
TFGDFAGLWDDVDALSAP

SEQ ID NO: 1492161 - protein, 21 aa, Mycobacterium tuberculosis
TFGHLWQWVGTNIGRYHSYPR

SEQ ID NO: 1492162 - protein, 20 aa, Mycobacterium tuberculosis
TFGMDSWFPSLKIYNRNGQL

SEQ ID NO: 1492163 - protein, 18 aa, Mycobacterium tuberculosis
TFGPRTALWLLLAKCGGD

SEQ ID NO: 1492164 - protein, 25 aa, Mycobacterium tuberculosis
TFHEDPVAGVWAVGGVGGDGGSGGS

SEQ ID NO: 1492165 - protein, 26 aa, Mycobacterium tuberculosis
TFHEDPVAGVWAVGGVGGDGGSGGSS

SEQ ID NO: 1492166 - protein, 20 aa, Mycobacterium tuberculosis
TFIERQCRPVTFGRHGGFDG

SEQ ID NO: 1492167 - protein, 21 aa, Mycobacterium tuberculosis
TFLDQEGWDSLTINALATQLG

SEQ ID NO: 1492168 - protein, 18 aa, Mycobacterium tuberculosis
TFLHRAFDQLLFDIGLHR

SEQ ID NO: 1492169 - protein, 19 aa, Mycobacterium tuberculosis
TFRLIDKVFTRWDVQYTPV

SEQ ID NO: 1492170 - protein, 19 aa, Mycobacterium tuberculosis
TFRVLPWATSSGHHHSARM

SEQ ID NO: 1492171 - protein, 24 aa, Mycobacterium tuberculosis
TFTNGALIFGEFDLPQLVVHPYTL

SEQ ID NO: 1492172 - protein, 25 aa, Mycobacterium tuberculosis
TFVAEAIAVLGARVAGSSLAGFATY

SEQ ID NO: 1492173 - protein, 28 aa, Mycobacterium tuberculosis
TFVRCDARLAVTLPPELPVAAAAAVPTA

SEQ ID NO: 1492174 - protein, 22 aa, Mycobacterium tuberculosis
TFVTCDARLATRLPEGLTDAQA

SEQ ID NO: 1492175 - protein, 18 aa, Mycobacterium tuberculosis
TGAAGRAGNGGVGGSGGL

SEQ ID NO: 1492176 - protein, 25 aa, Mycobacterium tuberculosis
TGAARGRAGPPVAAVAAVTEPEGGS

SEQ ID NO: 1492177 - protein, 19 aa, Mycobacterium tuberculosis
TGADGAKGLDGATGGKGNN

SEQ ID NO: 1492178 - protein, 19 aa, Mycobacterium tuberculosis
TGAIVKRPRVVVDASGNES

SEQ ID NO: 1492179 - protein, 18 aa, Mycobacterium tuberculosis
TGALIELSSGVTAAASAA

SEQ ID NO: 1492180 - protein, 23 aa, Mycobacterium tuberculosis
TGANGGDAGWLIGNGGAGGSGAK

SEQ ID NO: 1492181 - protein, 23 aa, Mycobacterium tuberculosis
TGANGGPGGWLIGNGGAGGSGAP

SEQ ID NO: 1492182 - protein, 17 aa, Mycobacterium tuberculosis
TGAQPVFARLRRARRPS

SEQ ID NO: 1492183 - protein, 24 aa, Mycobacterium tuberculosis
TGARSVAGLVAWKMGCSSGNAHTI

SEQ ID NO: 1492184 - protein, 26 aa, Mycobacterium tuberculosis
TGATGNCWRCTPIARCRARCPPHRPT

SEQ ID NO: 1492185 - protein, 29 aa, Mycobacterium tuberculosis
TGAVYAELAAQGWGGRWLVVGSDVDPGRL

SEQ ID NO: 1492186 - protein, 17 aa, Mycobacterium tuberculosis
TGCAKLFRVGYIDVNQF

SEQ ID NO: 1492187 - protein, 19 aa, Mycobacterium tuberculosis
TGCELHLVEPLGFDLSEPK

SEQ ID NO: 1492188 - protein, 29 aa, Mycobacterium tuberculosis
TGDYSNGLLWRGGYEGLVGVRVGPTISQF

SEQ ID NO: 1492189 - protein, 25 aa, Mycobacterium tuberculosis
TGEEFSWRAAELFDAIGSEAITVAV

SEQ ID NO: 1492190 - protein, 27 aa, Mycobacterium tuberculosis
TGEIRGYSGSIVRRWKRVETRDGPRFR

SEQ ID NO: 1492191 - protein, 26 aa, Mycobacterium tuberculosis
TGELKISIPGFEIPQIATTRFLLDVN

SEQ ID NO: 1492192 - protein, 27 aa, Mycobacterium tuberculosis
TGEVLSVPVGDGFLGRVVNPLGQPIDG

SEQ ID NO: 1492193 - protein, 17 aa, Mycobacterium tuberculosis
TGFFDAGNYNFGSLNAG

SEQ ID NO: 1492194 - protein, 27 aa, Mycobacterium tuberculosis
TGGAGGAGFSRALIVAGDNGGDPGAGG

SEQ ID NO: 1492195 - protein, 39 aa, Mycobacterium tuberculosis
TGGAGGRGGLLIGDGGAAARAGVGGPVVSVPPGGGGGAG

SEQ ID NO: 1492196 - protein, 21 aa, Mycobacterium tuberculosis
TGGAGGTVFGGGKGGAGGAGG

SEQ ID NO: 1492197 - protein, 19 aa, Mycobacterium tuberculosis
TGGAGRCWTLLSYRRRSTP

SEQ ID NO: 1492198 - protein, 24 aa, Mycobacterium tuberculosis
TGGETIDLLARMRGGIDNARRAEL

SEQ ID NO: 1492199 - protein, 18 aa, Mycobacterium tuberculosis
TGGFAGNGNAGGNGGTGG

SEQ ID NO: 1492200 - protein, 17 aa, Mycobacterium tuberculosis
TGGFAQRLPRWLRRHGN

SEQ ID NO: 1492201 - protein, 27 aa, Mycobacterium tuberculosis
TGGGGAAGFAGGVGGAGGEGLTDGAGT

SEQ ID NO: 1492202 - protein, 26 aa, Mycobacterium tuberculosis
TGGGGGNGGTGWNGGKGDTGSGGGAG

SEQ ID NO: 1492203 - protein, 17 aa, Mycobacterium tuberculosis
TGGGGGVGGLWGAGGAG

SEQ ID NO: 1492204 - protein, 26 aa, Mycobacterium tuberculosis
TGGGRRGRRGRRRRPANGGVVYTGNG

SEQ ID NO: 1492205 - protein, 26 aa, Mycobacterium tuberculosis
TGGIPVTVEVPVGGILAPLQPFQATA

SEQ ID NO: 1492206 - protein, 21 aa, Mycobacterium tuberculosis
TGGLGGLGLFLAEKMAAAGCG

SEQ ID NO: 1492207 - protein, 30 aa, Mycobacterium tuberculosis
TGGLGGLGLVVARWLVDRGAGRVVLGGRSD

SEQ ID NO: 1492208 - protein, 24 aa, Mycobacterium tuberculosis
TGGNAGVALSVGSTGGLGGNGGSG

SEQ ID NO: 1492209 - protein, 23 aa, Mycobacterium tuberculosis
TGGNGALLFGFGGAGGAGGHGGA

SEQ ID NO: 1492210 - protein, 24 aa, Mycobacterium tuberculosis
TGGNGALLFGFGGAGGAGGHGGAA

SEQ ID NO: 1492211 - protein, 18 aa, Mycobacterium tuberculosis
TGGPVTRWAEETDRNPPR

SEQ ID NO: 1492212 - protein, 23 aa, Mycobacterium tuberculosis
TGGRIPREYIPSVDAGAQDAMQY

SEQ ID NO: 1492213 - protein, 21 aa, Mycobacterium tuberculosis
TGGSAGWLSGNGGAGGSGGSA

SEQ ID NO: 1492214 - protein, 25 aa, Mycobacterium tuberculosis
TGGTAHLGPLAIIGQSGQPGQFGSP

SEQ ID NO: 1492215 - protein, 18 aa, Mycobacterium tuberculosis
TGGTGGWLAGGGGVGGMG

SEQ ID NO: 1492216 - protein, 18 aa, Mycobacterium tuberculosis
  misc_feature (15)..(16): Xaa can be any naturally occurring amino acid
TGGTGGWLAGGGGVXXMG

SEQ ID NO: 1492217 - protein, 22 aa, Mycobacterium tuberculosis
TGGVEPWAYLIVGGVQLGTHSW

SEQ ID NO: 1492218 - protein, 18 aa, Mycobacterium tuberculosis
TGGVLDVVVGVALTVGGC

SEQ ID NO: 1492219 - protein, 26 aa, Mycobacterium tuberculosis
TGGVLKPILWCPGKATAVQRFAAEHD

SEQ ID NO: 1492220 - protein, 20 aa, Mycobacterium tuberculosis
TGHMCILLRRLCKVHPVPAI

SEQ ID NO: 1492221 - protein, 25 aa, Mycobacterium tuberculosis
TGHMPVRRLDLIWISARNAARRELD

SEQ ID NO: 1492222 - protein, 27 aa, Mycobacterium tuberculosis
TGHPRRAGVSSFGFGGTNAHVVIEQGQ

SEQ ID NO: 1492223 - protein, 30 aa, Mycobacterium tuberculosis
TGIALAMVCAARGYRCVLTMPETMSLERRM

SEQ ID NO: 1492224 - protein, 32 aa, Mycobacterium tuberculosis
TGIALAMVCAARGYRCVLTMPETMSLERRMLL

SEQ ID NO: 1492225 - protein, 29 aa, Mycobacterium tuberculosis
TGIEALRLVKSLARPVADTVWPTPFLAHQ

SEQ ID NO: 1492226 - protein, 18 aa, Mycobacterium tuberculosis
TGIIGWPALVMLFAGPRV

SEQ ID NO: 1492227 - protein, 24 aa, Mycobacterium tuberculosis
TGIIGWPALVMLFAGPRVGEPGKP

SEQ ID NO: 1492228 - protein, 24 aa, Mycobacterium tuberculosis
TGIWRTEPGRAMFRTEVAGSDGRR

SEQ ID NO: 1492229 - protein, 25 aa, Mycobacterium tuberculosis
TGKAFPYVVVTGIAMTTALATDAET

SEQ ID NO: 1492230 - protein, 22 aa, Mycobacterium tuberculosis
TGKELFAAQGLPPFADDHITRF

SEQ ID NO: 1492231 - protein, 17 aa, Mycobacterium tuberculosis
TGKELFAAQGLPPFEDD

SEQ ID NO: 1492232 - protein, 25 aa, Mycobacterium tuberculosis
TGKTFTALKIAERIAADNGGSARIL

SEQ ID NO: 1492233 - protein, 31 aa, Mycobacterium tuberculosis; identical to SEQ ID NO: 1380436

SEQ ID NO: 1492234 - protein, 28 aa, Mycobacterium tuberculosis
TGLGCPGRRRRFPAARATLPSGVGGVGG

SEQ ID NO: 1492235 - protein, 17 aa, Mycobacterium tuberculosis
TGLPGVLSRRIDPRNST

SEQ ID NO: 1492236 - protein, 24 aa, Mycobacterium tuberculosis
TGLRAGRNGGFALVIAVDAHGDAE

SEQ ID NO: 1492237 - protein, 25 aa, Mycobacterium tuberculosis
TGLSGAFHIGGKGGVGGSAVLIGNG

SEQ ID NO: 1492238 - protein, 26 aa, Mycobacterium tuberculosis
TGLSGAFHIGGKGGVGGSAVLIGNGG

SEQ ID NO: 1492239 - protein, 19 aa, Mycobacterium tuberculosis
TGMAQFFASIAQQLTFGPG

SEQ ID NO: 1492240 - protein, 19 aa, Mycobacterium tuberculosis
TGMELRAAIDAGDVVVADE

SEQ ID NO: 1492241 - protein, 24 aa, Mycobacterium tuberculosis
TGMQRVFFGWAQIWRTKSRAAEAI

SEQ ID NO: 1492242 - protein, 23 aa, Mycobacterium tuberculosis
TGMRKPRMHGMPPITSGSMVTRV

SEQ ID NO: 1492243 - protein, 20 aa, Mycobacterium tuberculosis
TGNGRAAIIGDFVMTAAEVQ

SEQ ID NO: 1492244 - protein, 18 aa, Mycobacterium tuberculosis
TGNRGLWNPGTGNMGVAN

SEQ ID NO: 1492245 - protein, 19 aa, Mycobacterium tuberculosis
TGNSGWGNKACRNSDRTTC

SEQ ID NO: 1492246 - protein, 18 aa, Mycobacterium tuberculosis
TGNWGLWNPGTGNMGVAN

SEQ ID NO: 1492247 - protein, 23 aa, Mycobacterium tuberculosis
TGPARHCWPRLPPCPPDGRGWPG

SEQ ID NO: 1492248 - protein, 24 aa, Mycobacterium tuberculosis
TGPGCKALLAALPQRLGEYRRAPV

SEQ ID NO: 1492249 - protein, 17 aa, Mycobacterium tuberculosis
TGPRWRLGARDLAALWR

SEQ ID NO: 1492250 - protein, 17 aa, Mycobacterium tuberculosis
TGPTGQRSGHIFLRYEH

SEQ ID NO: 1492251 - protein, 20 aa, Mycobacterium tuberculosis
TGQAGGNGGWLWGNGGNGGS

SEQ ID NO: 1492252 - protein, 22 aa, Mycobacterium tuberculosis
TGQAGGPGGILYGNGGNGGSGA

SEQ ID NO: 1492253 - protein, 20 aa, Mycobacterium tuberculosis
TGQAGGPGGLLYGNGGNGGS

SEQ ID NO: 1492254 - protein, 17 aa, Mycobacterium tuberculosis
TGQAWVTMDFLGFGLSD

SEQ ID NO: 1492255 - protein, 17 aa, Mycobacterium tuberculosis
TGQFRFGPITVSNVQLN

SEQ ID NO: 1492256 - protein, 18 aa, Mycobacterium tuberculosis
TGQHWALQCRQFQHRCGQ

SEQ ID NO: 1492257 - protein, 24 aa, Mycobacterium tuberculosis
TGQNGGAGGILWGNGGNGGSGAPG

SEQ ID NO: 1492258 - protein, 23 aa, Mycobacterium tuberculosis
TGQPGGPGGLLWGNGGNGGSGVA

SEQ ID NO: 1492259 - protein, 24 aa, Mycobacterium tuberculosis
TGQWARTAVGLARDVAEAFARDPE

SEQ ID NO: 1492260 - protein, 25 aa, Mycobacterium tuberculosis
TGQWARTAVGLARDVAEAFARGPRG

SEQ ID NO: 1492261 - protein, 20 aa, Mycobacterium tuberculosis
TGRAALLARLDEAITSPAAY

SEQ ID NO: 1492262 - protein, 28 aa, Mycobacterium tuberculosis
TGRCSKRDQIGIVFQFFNLIPTLTVLEN

SEQ ID NO: 1492263 - protein, 19 aa, Mycobacterium tuberculosis
TGRNALALARRGHPVDVVE

SEQ ID NO: 1492264 - protein, 26 aa, Mycobacterium tuberculosis
TGRPTGEWSAAVSRLAAAEAAVADCA

SEQ ID NO: 1492265 - protein, 27 aa, Mycobacterium tuberculosis
TGRRRRRRWPGWVRWHRGQRQRHWRRA

SEQ ID NO: 1492266 - protein, 19 aa, Mycobacterium tuberculosis
TGRSRLEVVDPSAAAQLAD

SEQ ID NO: 1492267 - protein, 20 aa, Mycobacterium tuberculosis
TGSGTGWRGPWQRPGGGAVG

SEQ ID NO: 1492268 - protein, 18 aa, Mycobacterium tuberculosis
TGSHLVAGWFAELPAHRF

SEQ ID NO: 1492269 - protein, 24 aa, Mycobacterium tuberculosis
TGSIPRPAPRPAPGTARQMCPASV

SEQ ID NO: 1492270 - protein, 25 aa, Mycobacterium tuberculosis
TGSIPRPAPRPAPGTARQMCPASVI

SEQ ID NO: 1492271 - protein, 22 aa, Mycobacterium tuberculosis
TGSPIPVGLDPTGVAVNPVTGV

SEQ ID NO: 1492272 - protein, 19 aa, Mycobacterium tuberculosis
TGSPVMWLPASLRRRHPEF

SEQ ID NO: 1492273 - protein, 24 aa, Mycobacterium tuberculosis
TGSRRPVSAPARRRPTARTRVSRH

SEQ ID NO: 1492274 - protein, 23 aa, Mycobacterium tuberculosis
TGSRWEMDPTLLVSADVTNNHPF

SEQ ID NO: 1492275 - protein, 19 aa, Mycobacterium tuberculosis
TGSSNWGFGNNGIGNIGFG

SEQ ID NO: 1492276 - protein, 17 aa, Mycobacterium tuberculosis
TGSYLRHHLKLAGRDDA

SEQ ID NO: 1492277 - protein, 26 aa, Mycobacterium tuberculosis
TGTASSPFGIAIAIGGAGAQGGAGTS

SEQ ID NO: 1492278 - protein, 19 aa, Mycobacterium tuberculosis
TGTYGINWYAFDPGSPFGG

SEQ ID NO: 1492279 - protein, 31 aa, Mycobacterium tuberculosis
TGVAYIRWLLRARPADYMLALSVAGGSLPVV

SEQ ID NO: 1492280 - protein, 17 aa, Mycobacterium tuberculosis
TGVGSPGGLGGAGGTGG

SEQ ID NO: 1492281 - protein, 18 aa, Mycobacterium tuberculosis
TGVNMLFTMRAAVVEADL

SEQ ID NO: 1492282 - protein, 18 aa, Mycobacterium tuberculosis
TGVPVQWSAVFAGSGGRR

SEQ ID NO: 1492283 - protein, 19 aa, Mycobacterium tuberculosis
TGWTGRFVSRILIDGSTLS

SEQ ID NO: 1492284 - protein, 27 aa, Mycobacterium tuberculosis
TGYDILFFWVARMMMFGTFVGDDAAIT

SEQ ID NO: 1492285 - protein, 17 aa, Mycobacterium tuberculosis
THALAAMRSRLAAAAEA

SEQ ID NO: 1492286 - protein, 19 aa, Mycobacterium tuberculosis
THFSRLVPQHLMRRLFFTA

SEQ ID NO: 1492287 - protein, 21 aa, Mycobacterium tuberculosis
THGHTEWLPPPHLDHGQPRTN

SEQ ID NO: 1492288 - protein, 24 aa, Mycobacterium tuberculosis
THGHTEWLPPPHLDHGQPWTNTFH

SEQ ID NO: 1492289 - protein, 17 aa, Mycobacterium tuberculosis
THGPTVVAVPWARHHAG

SEQ ID NO: 1492290 - protein, 24 aa, Mycobacterium tuberculosis
THHLVKTFWGWRDQQLPDGTLILT

SEQ ID NO: 1492291 - protein, 17 aa, Mycobacterium tuberculosis
THHYRFTLYHLPVALQL

SEQ ID NO: 1492292 - protein, 23 aa, Mycobacterium tuberculosis
THPVGFCRDTWPSAAAPIQVPMR

SEQ ID NO: 1492293 - protein, 22 aa, Mycobacterium tuberculosis
THRIGCGHAGYLASARERAVNL

SEQ ID NO: 1492294 - protein, 20 aa, Mycobacterium tuberculosis
THRTWRCPIWTGWSWPTPPP

SEQ ID NO: 1492295 - protein, 24 aa, Mycobacterium tuberculosis
THRWVKNLPDEPVWVNGDHARLHQ

SEQ ID NO: 1492296 - protein, 25 aa, Mycobacterium tuberculosis
THRWVKNLPDEPVWVNGDHARLHQL

SEQ ID NO: 1492297 - protein, 28 aa, Mycobacterium tuberculosis
THSTFWPSTRWRRLRWNRWMPTRGSTPC

SEQ ID NO: 1492298 - protein, 21 aa, Mycobacterium tuberculosis
THVYAKLGLPSRVQLVDEAAR

SEQ ID NO: 1492299 - protein, 20 aa, Mycobacterium tuberculosis
THVYTKLGFTSRLQLAQAAA

SEQ ID NO: 1492300 - protein, 24 aa, Mycobacterium tuberculosis
TIAELRAADVLVLADAKRGDIGAT

SEQ ID NO: 1492301 - protein, 17 aa, Mycobacterium tuberculosis
TIAFSIDTTNLTGVMTF

SEQ ID NO: 1492302 - protein, 18 aa, Mycobacterium tuberculosis
TIDASGALDPITIFPGGY

SEQ ID NO: 1492303 - protein, 21 aa, Mycobacterium tuberculosis
TIDRIPLNLGASVTVGPILIN

SEQ ID NO: 1492304 - protein, 18 aa, Mycobacterium tuberculosis
TIELPGFVAGNGHWALTK

SEQ ID NO: 1492305 - protein, 24 aa, Mycobacterium tuberculosis
TIGEIPFDLVAHSTLGPVHILIDL

SEQ ID NO: 1492306 - protein, 21 aa, Mycobacterium tuberculosis
TIGGGGAWDGLAEELHAAASS

SEQ ID NO: 1492307 - protein, 17 aa, Mycobacterium tuberculosis
TIHELLLSDGFWDEVFR

SEQ ID NO: 1492308 - protein, 17 aa, Mycobacterium tuberculosis
TIIARRWTCHHVTVSVK

SEQ ID NO: 1492309 - protein, 17 aa, Mycobacterium tuberculosis
TILGLSLAHGGHLTHGM

SEQ ID NO: 1492310 - protein, 18 aa, Mycobacterium tuberculosis
TILGLSLAHGGHLTHGMR

SEQ ID NO: 1492311 - protein, 18 aa, Mycobacterium tuberculosis
TIPEALAAVATDLAGIGS

SEQ ID NO: 1492312 - protein, 19 aa, Mycobacterium tuberculosis
TIPEALAAVATDLAGIGST

SEQ ID NO: 1492313 - protein, 22 aa, Mycobacterium tuberculosis
TIPEALAAVATDLAGIGSTIGT

SEQ ID NO: 1492314 - protein, 24 aa, Mycobacterium tuberculosis
TIPNAVFLGHAFAALNPATVTAAA

SEQ ID NO: 1492315 - protein, 20 aa, Mycobacterium tuberculosis
TIPQFRTLVILSNHGPINLA

SEQ ID NO: 1492316 - protein, 23 aa, Mycobacterium tuberculosis
TIPRVRCCCCYLGSANRDDRVFD

SEQ ID NO: 1492317 - protein, 25 aa, Mycobacterium tuberculosis
TIRDLRPRRVCPRAHRYRSLNTVSF

SEQ ID NO: 1492318 - protein, 31 aa, Mycobacterium tuberculosis
TIRGCGAPLLSLRTDRDWLADIVRFVASRRR

SEQ ID NO: 1492319 - protein, 20 aa, Mycobacterium tuberculosis
TIRRDGSYDAGERWPDAQIV

SEQ ID NO: 1492320 - protein, 24 aa, Mycobacterium tuberculosis
TISEIPIDLQVIGGIGPIHVQPID

SEQ ID NO: 1492321 - protein, 19 aa, Mycobacterium tuberculosis
TISELRYPATAFTDAIDAR

SEQ ID NO: 1492322 - protein, 20 aa, Mycobacterium tuberculosis
TISMYPRMWEASGVDYPTLL

SEQ ID NO: 1492323 - protein, 20 aa, Mycobacterium tuberculosis
TISRRVREALAMAESEAAVE

SEQ ID NO: 1492324 - protein, 21 aa, Mycobacterium tuberculosis
TITPSECRVILLDAAPAVLPP

SEQ ID NO: 1492325 - protein, 17 aa, Mycobacterium tuberculosis
TITSGAGPVVIPLLDIP

SEQ ID NO: 1492326 - protein, 24 aa, Mycobacterium tuberculosis
TIVRYRVGELIPVYRSQRALLQRL

SEQ ID NO: 1492327 - protein, 23 aa, Mycobacterium tuberculosis
TKALRVGYVAAFSVPANQLPQTV

SEQ ID NO: 1492328 - protein, 17 aa, Mycobacterium tuberculosis
TKARLSDGVLGVRAEYL

SEQ ID NO: 1492329 - protein, 17 aa, Mycobacterium tuberculosis
TKAVGWSPTNWVDNTLA

SEQ ID NO: 1492330 - protein, 21 aa, Mycobacterium tuberculosis
TKDIRHLPAGRCDLTVAHRYD

SEQ ID NO: 1492331 - protein, 19 aa, Mycobacterium tuberculosis
TKFFDEFFMDATRAGIRQV

SEQ ID NO: 1492332 - protein, 19 aa, Mycobacterium tuberculosis
TKGIPFGSVVTFVVRAGNP

SEQ ID NO: 1492333 - protein, 17 aa, Mycobacterium tuberculosis
TKIRLLTRIAFGFRSPE

SEQ ID NO: 1492334 - protein, 17 aa, Mycobacterium tuberculosis
TKKHWRAPSKLAYIDAG

SEQ ID NO: 1492335 - protein, 22 aa, Mycobacterium tuberculosis
TKLRAAAVAWRSAGTQFALTEI

SEQ ID NO: 1492336 - protein, 20 aa, Mycobacterium tuberculosis
TKLRNGFRIQRQNTRIGQDV

SEQ ID NO: 1492337 - protein, 24 aa, Mycobacterium tuberculosis
TKNSEVSTVWTWPDKPGVAGCAAM

SEQ ID NO: 1492338 - protein, 26 aa, Mycobacterium tuberculosis
TKQPQRVLGLHFFNPVPVLPLVELVR

SEQ ID NO: 1492339 - protein, 25 aa, Mycobacterium tuberculosis
TKRGCGAALPFKRRLFGQIVAAAVR

SEQ ID NO: 1492340 - protein, 26 aa, Mycobacterium tuberculosis
TKRLASPAQRIMLFAKDRGCTKPGCD

SEQ ID NO: 1492341 - protein, 22 aa, Mycobacterium tuberculosis
TKRLASPAQRIMLYAKDRGCSR

SEQ ID NO: 1492342 - protein, 17 aa, Mycobacterium tuberculosis
TKRREGSNWSIHPGAAA

SEQ ID NO: 1492343 - protein, 27 aa, Mycobacterium tuberculosis
TKSGAWCVAADFSVGMLAAGAARKVPN

SEQ ID NO: 1492344 - protein, 17 aa, Mycobacterium tuberculosis
TKTRFLVDQIRTIGIVY

SEQ ID NO: 1492345 - protein, 21 aa, Mycobacterium tuberculosis
TKVEIRSASTPTPATLEDTAV

SEQ ID NO: 1492346 - protein, 20 aa, Mycobacterium tuberculosis
TKVVTPRPGSAVAAVTGSSA

SEQ ID NO: 1492347 - protein, 31 aa, Mycobacterium tuberculosis
TKWAILRLLALRCLWVFRGFPARLRPPASWW

SEQ ID NO: 1492348 - protein, 19 aa, Mycobacterium tuberculosis
TKYLVPKQHWPFFSTYCAG

SEQ ID NO: 1492349 - protein, 21 aa, Mycobacterium tuberculosis
TKYPDRLTVLHWLESLQGLPS

SEQ ID NO: 1492350 - protein, 24 aa, Mycobacterium tuberculosis
TLAAKVWICKPVIPKPRGWSNVST

SEQ ID NO: 1492351 - protein, 17 aa, Mycobacterium tuberculosis
TLAELGANHALHGVLMA

SEQ ID NO: 1492352 - protein, 18 aa, Mycobacterium tuberculosis
TLAFSRAPLMAMAPSSLA

SEQ ID NO: 1492353 - protein, 18 aa, Mycobacterium tuberculosis
TLANRLAGNITEYSGIHV

SEQ ID NO: 1492354 - protein, 23 aa, Mycobacterium tuberculosis
TLARLKEVGVHIAIDDFGTGYSA

SEQ ID NO: 1492355 - protein, 26 aa, Mycobacterium tuberculosis
TLDKSLGRPAIKSFIVPREYPGVTVE

SEQ ID NO: 1492356 - protein, 26 aa, Mycobacterium tuberculosis
TLDRNALHEVVGWWAKLPVTGMQPVQ

SEQ ID NO: 1492357 - protein, 23 aa, Mycobacterium tuberculosis
TLDVPELEALLAYEQATKARAPF

SEQ ID NO: 1492358 - protein, 22 aa, Mycobacterium tuberculosis
TLEILRSGPLALVEDLGRAGLA

SEQ ID NO: 1492359 - protein, 17 aa, Mycobacterium tuberculosis
TLELGGKSPNIFFADVL

SEQ ID NO: 1492360 - protein, 17 aa, Mycobacterium tuberculosis
TLFGRPLIGDGANGTAE

SEQ ID NO: 1492361 - protein, 18 aa, Mycobacterium tuberculosis
TLFGRPLIGDGANGTAEN

SEQ ID NO: 1492362 - protein, 17 aa, Mycobacterium tuberculosis
TLFPGAVSQGLFTPEQF

SEQ ID NO: 1492363 - protein, 23 aa, Mycobacterium tuberculosis
TLFRPDTRLAVTIPTVDPQRGRL

SEQ ID NO: 1492364 - protein, 24 aa, Mycobacterium tuberculosis
TLGNPVCLCRNVPVVRLNHLGRQP

SEQ ID NO: 1492365 - protein, 25 aa, Mycobacterium tuberculosis
TLGNPVCLCRNVPVVRLNHLGRQPQ

SEQ ID NO: 1492366 - protein, 24 aa, Mycobacterium tuberculosis
TLHEVPVLSGLGLTMTGPRPGGFG

SEQ ID NO: 1492367 - protein, 24 aa, Mycobacterium tuberculosis
TLHHRASALIGRLMRELTADWDYS

SEQ ID NO: 1492368 - protein, 17 aa, Mycobacterium tuberculosis
TLHTALMRSCTGWPSGV

SEQ ID NO: 1492369 - protein, 18 aa, Mycobacterium tuberculosis
TLIEVALRFVNIRETAWR

SEQ ID NO: 1492370 - protein, 19 aa, Mycobacterium tuberculosis
TLIVEPWMGPAAAAMAAAA

SEQ ID NO: 1492371 - protein, 18 aa, Mycobacterium tuberculosis
TLLDRAYAKKFRFPTFLG

SEQ ID NO: 1492372 - protein, 20 aa, Mycobacterium tuberculosis
TLLDYFPEDFLLVIDESHVT

SEQ ID NO: 1492373 - protein, 19 aa, Mycobacterium tuberculosis
TLLGLTVFGDNGGAGVLGD

SEQ ID NO: 1492374 - protein, 19 aa, Mycobacterium tuberculosis
TLLGRPLIGDGAHGTAPGQ

SEQ ID NO: 1492375 - protein, 20 aa, Mycobacterium tuberculosis
TLLGRPLIGNGADGGPGQNG

SEQ ID NO: 1492376 - protein, 19 aa, Mycobacterium tuberculosis
TLLGRPLIGNGADGSTPGQ

SEQ ID NO: 1492377 - protein, 19 aa, Mycobacterium tuberculosis
TLLGRPLIGNGADGVAGTG

SEQ ID NO: 1492378 - protein, 18 aa, Mycobacterium tuberculosis
TLLGRPLIGNGTDGSTPG

SEQ ID NO: 1492379 - protein, 18 aa, Mycobacterium tuberculosis
TLLGRPLIGNGTNGAPGT

SEQ ID NO: 1492380 - protein, 20 aa, Mycobacterium tuberculosis
TLLGRPLIGNGTNGAPGTGQ

SEQ ID NO: 1492381 - protein, 17 aa, Mycobacterium tuberculosis
TLLPRRTPGSSGIADVP

SEQ ID NO: 1492382 - protein, 24 aa, Mycobacterium tuberculosis
TLMALMCSAATMYTPERVTFFCIG

SEQ ID NO: 1492383 - protein, 21 aa, Mycobacterium tuberculosis
TLPAHELATALNLMNERTLFA

SEQ ID NO: 1492384 - protein, 19 aa, Mycobacterium tuberculosis
TLPELPPIISRMRCCGDEF

SEQ ID NO: 1492385 - protein, 22 aa, Mycobacterium tuberculosis
TLQAGADIALWVTTKEVPAVLD

SEQ ID NO: 1492386 - protein, 19 aa, Mycobacterium tuberculosis
TLQGAGWTPAAPHGAAGTV

SEQ ID NO: 1492387 - protein, 22 aa, Mycobacterium tuberculosis
TLRAGIELDDGPAFVDDFAVVD

SEQ ID NO: 1492388 - protein, 17 aa, Mycobacterium tuberculosis
TLRCGGIRRKVRQPHAG

SEQ ID NO: 1492389 - protein, 20 aa, Mycobacterium tuberculosis
TLRLPLDVLVVASANPEDYT

SEQ ID NO: 1492390 - protein, 26 aa, Mycobacterium tuberculosis
TLRNGYFPRRHVFVVPASSARACIGH

SEQ ID NO: 1492391 - protein, 17 aa, Mycobacterium tuberculosis
TLRPARPRPPPPPTSAP

SEQ ID NO: 1492392 - protein, 27 aa, Mycobacterium tuberculosis
TLRPIEGRTAMSFVIANPEMLAAAATD

SEQ ID NO: 1492393 - protein, 26 aa, Mycobacterium tuberculosis
TLRRLLIKRRGCRQGHRRAAPRSNGV

SEQ ID NO: 1492394 - protein, 24 aa, Mycobacterium tuberculosis
TLRRRIRDLFPRIGRQTQNPERGR

SEQ ID NO: 1492395 - protein, 19 aa, Mycobacterium tuberculosis
TLRRSLRLLADFRYEQRDP

SEQ ID NO: 1492396 - protein, 21 aa, Mycobacterium tuberculosis
TLRTAVLDFIDRLRCAERAIA

SEQ ID NO: 1492397 - protein, 21 aa, Mycobacterium tuberculosis
TLRTEMGYPLHGHELSLDISP

SEQ ID NO: 1492398 - protein, 31 aa, Mycobacterium tuberculosis
TLRVAPSASWMLEYYPIRELRQLPDGSCEVA

SEQ ID NO: 1492399 - protein, 20 aa, Mycobacterium tuberculosis
TLSGGHLFSIYDGCREEGIR

SEQ ID NO: 1492400 - protein, 26 aa, Mycobacterium tuberculosis
TLSQQWGRLFVAVCYALRTPTTRSPL

SEQ ID NO: 1492401 - protein, 20 aa, Mycobacterium tuberculosis
TLSTFFGVPLVLTYATLGAP

SEQ ID NO: 1492402 - protein, 21 aa, Mycobacterium tuberculosis
TLSTFFGVPLVLTYATLGAPF

SEQ ID NO: 1492403 - protein, 17 aa, Mycobacterium tuberculosis
TLTGFKWLARADANLPG

SEQ ID NO: 1492404 - protein, 26 aa, Mycobacterium tuberculosis
TLTGPIVIGSFFLPAFNIPGIDVPAI

SEQ ID NO: 1492405 - protein, 17 aa, Mycobacterium tuberculosis
TLTGRLNFRLSPEQEQA

SEQ ID NO: 1492406 - protein, 26 aa, Mycobacterium tuberculosis
TLTLPRPTVVTGLRLAASRSMLPAHP

SEQ ID NO: 1492407 - protein, 27 aa, Mycobacterium tuberculosis
TLTLPRPTVVTGLRLAASRSMLPAHPT

SEQ ID NO: 1492408 - protein, 18 aa, Mycobacterium tuberculosis
TLVRAVCDGRRLVTLDGP

SEQ ID NO: 1492409 - protein, 27 aa, Mycobacterium tuberculosis
TLVSHYDVYPAFGFRFDLKKSGVSVTF

SEQ ID NO: 1492410 - protein, 28 aa, Mycobacterium tuberculosis
TLVSHYDVYPAFGFRFDLKKSGVSVTFS

SEQ ID NO: 1492411 - protein, 17 aa, Mycobacterium tuberculosis
TLWAAWQRSGLQRRWLA

SEQ ID NO: 1492412 - protein, 17 aa, Mycobacterium tuberculosis
TLWVHRVNVESGEFVEG

SEQ ID NO: 1492413 - protein, 20 aa, Mycobacterium tuberculosis
TMCAGLFAGVGRKFSDEELA

SEQ ID NO: 1492414 - protein, 21 aa, Mycobacterium tuberculosis
TMEALWWDRPFALAGVDIGAS

SEQ ID NO: 1492415 - protein, 22 aa, Mycobacterium tuberculosis
TMGDFMAATAYEVLRRQLETFT

SEQ ID NO: 1492416 - protein, 19 aa, Mycobacterium tuberculosis
TMGPRRCHRLPARLGTAAG

SEQ ID NO: 1492417 - protein, 18 aa, Mycobacterium tuberculosis
TMLALPPLPPAPGIPPRT

SEQ ID NO: 1492418 - protein, 21 aa, Mycobacterium tuberculosis
TMRQPPCRRRDPKAVSPTSMP

SEQ ID NO: 1492419 - protein, 37 aa, Mycobacterium tuberculosis
TMSPAERWHLLASAWLDLPGRPALIGTRRPDAKPYGA

SEQ ID NO: 1492420 - protein, 20 aa, Mycobacterium tuberculosis
TNALAGPGIELFRRLVEEYE

SEQ ID NO: 1492421 - protein, 26 aa, Mycobacterium tuberculosis
TNARCRGSLSPVWRKVSAHRWIRECT

SEQ ID NO: 1492422 - protein, 19 aa, Mycobacterium tuberculosis
TNEGSLWGGRFAGGPSDAL

SEQ ID NO: 1492423 - protein, 19 aa, Mycobacterium tuberculosis
TNFGFGNAGFQNMGHGNAG

SEQ ID NO: 1492424 - protein, 23 aa, Mycobacterium tuberculosis
TNKRVWVRLPARHMAHSLDDLVQ

SEQ ID NO: 1492425 - protein, 18 aa, Mycobacterium tuberculosis
TNLAEIGSAISTANGAAA

SEQ ID NO: 1492426 - protein, 19 aa, Mycobacterium tuberculosis
TNLGEGLVILAAIAVGVAL

SEQ ID NO: 1492427 - protein, 17 aa, Mycobacterium tuberculosis
TNLRPIAAGTGLLVLGL

SEQ ID NO: 1492428 - protein, 28 aa, Mycobacterium tuberculosis
TNLTGVMTFGLPLAMTLNAVGSPITTAI

SEQ ID NO: 1492429 - protein, 17 aa, Mycobacterium tuberculosis
TNMPGVFPQIGGFANTP

SEQ ID NO: 1492430 - protein, 17 aa, Mycobacterium tuberculosis
TNMRNPVRFQQAIASAG

SEQ ID NO: 1492431 - protein, 17 aa, Mycobacterium tuberculosis
TNPDCRRAGTVHLGGTF

SEQ ID NO: 1492432 - protein, 18 aa, Mycobacterium tuberculosis
TNPDCRRAGTVHLGGTFA

SEQ ID NO: 1492433 - protein, 25 aa, Mycobacterium tuberculosis
TNPHRQCILIFLTLYPPPHYYEKIS

SEQ ID NO: 1492434 - protein, 19 aa, Mycobacterium tuberculosis
TNRWTLRPADPVGAVTVVT

SEQ ID NO: 1492435 - protein, 18 aa, Mycobacterium tuberculosis
TNSLRMYLGAGSRPLLAA

SEQ ID NO: 1492436 - protein, 24 aa, Mycobacterium tuberculosis
TNVEFLRFLLADERVRVGGFGHRC

SEQ ID NO: 1492437 - protein, 17 aa, Mycobacterium tuberculosis
TNVLLLRGMIGKPGAGV

SEQ ID NO: 1492438 - protein, 29 aa, Mycobacterium tuberculosis
TPAARVLAIWPDWVRRWPTPSATATASTA

SEQ ID NO: 1492439 - protein, 20 aa, Mycobacterium tuberculosis
TPAFEWYDQSGLSVVMPVGG

SEQ ID NO: 1492440 - protein, 27 aa, Mycobacterium tuberculosis
TPAPLPCTPRGIVHLLRRYDISIAGAH

SEQ ID NO: 1492441 - protein, 25 aa, Mycobacterium tuberculosis
TPARIREAIRLSGPDIYGDPEPVTR

SEQ ID NO: 1492442 - protein, 26 aa, Mycobacterium tuberculosis
TPARIREAIRLSGPDIYGDPEPVTRD

SEQ ID NO: 1492443 - protein, 18 aa, Mycobacterium tuberculosis
TPASPTWATSTRASTTPA

SEQ ID NO: 1492444 - protein, 18 aa, Mycobacterium tuberculosis
TPATRSCCPSRFLRNHEL

SEQ ID NO: 1492445 - protein, 22 aa, Mycobacterium tuberculosis
TPCPYRLRGRLDAAPAVPRMVR

SEQ ID NO: 1492446 - protein, 43 aa, Mycobacterium tuberculosis
TPDEPKGVPVFAWKGETLEEYWWAAEQMLTWPDPDKSANMILD

SEQ ID NO: 1492447 - protein, 17 aa, Mycobacterium tuberculosis
TPDFADTGGKGGNGGNG

SEQ ID NO: 1492448 - protein, 30 aa, Mycobacterium tuberculosis
TPDGVWSRMKFEGGVHRVQRVPVTESQGRV

SEQ ID NO: 1492449 - protein, 28 aa, Mycobacterium tuberculosis
TPDRVDTVLRAKVDGAWNLHELTEDMDL

SEQ ID NO: 1492450 - protein, 19 aa, Mycobacterium tuberculosis
TPDRVDVVLRSKVDAACTC

SEQ ID NO: 1492451 - protein, 29 aa, Mycobacterium tuberculosis
TPDRVDVVLRSKVDAAWYLHELTRDLDVS

SEQ ID NO: 1492452 - protein, 30 aa, Mycobacterium tuberculosis; identical to SEQ ID NO: 234365

SEQ ID NO: 1492453 - protein, 18 aa, Mycobacterium tuberculosis
TPGAARWSPGDSATVTPR

SEQ ID NO: 1492454 - protein, 17 aa, Mycobacterium tuberculosis
TPGFGERRQRLAMRAVR

SEQ ID NO: 1492455 - protein, 22 aa, Mycobacterium tuberculosis
TPGGGNYRGWRRGCRSRNGLPR

SEQ ID NO: 1492456 - protein, 22 aa, Mycobacterium tuberculosis
TPGHPEFRHTPGVEITTGPLGQ

SEQ ID NO: 1492457 - protein, 24 aa, Mycobacterium tuberculosis
TPGHPEFRHTPGVEITTGPLGQGL

SEQ ID NO: 1492458 - protein, 25 aa, Mycobacterium tuberculosis
TPGILRVRFGEVEARGVALTPRGRE

SEQ ID NO: 1492459 - protein, 22 aa, Mycobacterium tuberculosis
TPGPRAQFLTALAGVMRPGDSL

SEQ ID NO: 1492460 - protein, 21 aa, Mycobacterium tuberculosis
TPGQPGGRGGAAGLIGNGGAG

SEQ ID NO: 1492461 - protein, 21 aa, Mycobacterium tuberculosis
TPGSWRREPLSGIPAATNTVI

SEQ ID NO: 1492462 - protein, 20 aa, Mycobacterium tuberculosis
TPGTGMPAAPMVPPTGSPGG

SEQ ID NO: 1492463 - protein, 20 aa, Mycobacterium tuberculosis
TPHAIALVLQQLVLGNALPP

SEQ ID NO: 1492464 - protein, 21 aa, Mycobacterium tuberculosis
TPHAIALVLQQLVLGNALPPD

SEQ ID NO: 1492465 - protein, 24 aa, Mycobacterium tuberculosis
TPHCAAVGRIAYLLGLRGPAVAVD

SEQ ID NO: 1492466 - protein, 17 aa, Mycobacterium tuberculosis
TPIKRIGVLGAGMMGAG

SEQ ID NO: 1492467 - protein, 19 aa, Mycobacterium tuberculosis
TPIKRIGVLGAGMMGAGIA

SEQ ID NO: 1492468 - protein, 17 aa, Mycobacterium tuberculosis
TPKAIAALDGWVTDAVE

SEQ ID NO: 1492469 - protein, 21 aa, Mycobacterium tuberculosis
TPLDFRFGRQPRNASGGDSRH

SEQ ID NO: 1492470 - protein, 18 aa, Mycobacterium tuberculosis
TPLLNWLRQRGVDEVDVV

SEQ ID NO: 1492471 - protein, 23 aa, Mycobacterium tuberculosis
TPNRWQVRPGPVAARRWDIEPDL

SEQ ID NO: 1492472 - protein, 17 aa, Mycobacterium tuberculosis
TPPCWISASPSWPTASA

SEQ ID NO: 1492473 - protein, 22 aa, Mycobacterium tuberculosis
TPPKGGAFGGLGGAGGAGGKGG

SEQ ID NO: 1492474 - protein, 23 aa, Mycobacterium tuberculosis
TPPLRVECWLCHGNWACNSLGRA

SEQ ID NO: 1492475 - protein, 19 aa, Mycobacterium tuberculosis
TPPNCSGSWRKTGTARVWV

SEQ ID NO: 1492476 - protein, 23 aa, Mycobacterium tuberculosis
TPPRGRCLRAPESARLGRRSAAH

SEQ ID NO: 1492477 - protein, 24 aa, Mycobacterium tuberculosis
TPQARATFEAVLAKLAAPGATNPD

SEQ ID NO: 1492478 - protein, 20 aa, Mycobacterium tuberculosis
TPQPLQWDCFLFGIIQSDDH

SEQ ID NO: 1492479 - protein, 18 aa, Mycobacterium tuberculosis
TPRGRFGVIASVSHAFCS

SEQ ID NO: 1492480 - protein, 17 aa, Mycobacterium tuberculosis
TPRPALSPSRATDFKQC

SEQ ID NO: 1492481 - protein, 32 aa, Mycobacterium tuberculosis
TPSKSIWGITIWRARFCLRCSTGVMTSSAVRC

SEQ ID NO: 1492482 - protein, 19 aa, Mycobacterium tuberculosis
TPSRGVWQFIAPTFAAYHE

SEQ ID NO: 1492483 - protein, 22 aa, Mycobacterium tuberculosis
TPTGRAALLARLDEAITSPAAY

SEQ ID NO: 1492484 - protein, 23 aa, Mycobacterium tuberculosis
TPTGRAALLARLDEAITSPAAYV

SEQ ID NO: 1492485 - protein, 26 aa, Mycobacterium tuberculosis
TPTGTRWLPHPGPLILQATASHLAES

SEQ ID NO: 1492486 - protein, 23 aa, Mycobacterium tuberculosis
TPTLCPGPTWSTCFPPTGRGRLS

SEQ ID NO: 1492487 - protein, 22 aa, Mycobacterium tuberculosis
TPTPRRWPAICVENCSAHHRKT

SEQ ID NO: 1492488 - protein, 19 aa, Mycobacterium tuberculosis
TPTSTRGASALSLSLLSIS

SEQ ID NO: 1492489 - protein, 20 aa, Mycobacterium tuberculosis
TPTWCRHTAELVGPACQQVI

SEQ ID NO: 1492490 - protein, 17 aa, Mycobacterium tuberculosis
TPVPAAPVVPRAVASSA

SEQ ID NO: 1492491 - protein, 25 aa, Mycobacterium tuberculosis
TPVPRPERQYYWFGEPIDTTEFMGQ

SEQ ID NO: 1492492 - protein, 17 aa, Mycobacterium tuberculosis
TPVSVCAGGVGGDARLI

SEQ ID NO: 1492493 - protein, 25 aa, Mycobacterium tuberculosis
TQAAAFHERFIQALSTAAGAYGSAE

SEQ ID NO: 1492494 - protein, 20 aa, Mycobacterium tuberculosis
TQAICAFVVLRANYAPHDRT

SEQ ID NO: 1492495 - protein, 24 aa, Mycobacterium tuberculosis
TQALERLETLLALIEGWVQTVVTA

SEQ ID NO: 1492496 - protein, 25 aa, Mycobacterium tuberculosis
TQALLGRPLIGDGADGTAPGQNGGA

SEQ ID NO: 1492497 - protein, 23 aa, Mycobacterium tuberculosis
TQALTGRPLIGNGANGTPGTGAD

SEQ ID NO: 1492498 - protein, 21 aa, Mycobacterium tuberculosis
TQCANRFDVVQAFTDDALTTC

SEQ ID NO: 1492499 - protein, 17 aa, Mycobacterium tuberculosis
TQGKVIPDLITWWCERD

SEQ ID NO: 1492500 - protein, 31 aa, Mycobacterium tuberculosis
TQHRLHLFGAPWPDDCQRFAGRRVKGPVLPV

SEQ ID NO: 1492501 - protein, 18 aa, Mycobacterium tuberculosis
TQIFEGDILFLEWTANSA

SEQ ID NO: 1492502 - protein, 24 aa, Mycobacterium tuberculosis
TQIPANLLGQMALGSMTGGALGAA

SEQ ID NO: 1492503 - protein, 22 aa, Mycobacterium tuberculosis
TQKEIFIPGGQMFRDLTRLSAA

SEQ ID NO: 1492504 - protein, 19 aa, Mycobacterium tuberculosis
TQKRPSIVNGRRIQSKRQV

SEQ ID NO: 1492505 - protein, 21 aa, Mycobacterium tuberculosis
TQKRPSIVNGRRIQSKRQVFE

SEQ ID NO: 1492506 - protein, 18 aa, Mycobacterium tuberculosis
TQLLKLLAKLAELVAAAI

SEQ ID NO: 1492507 - protein, 22 aa, Mycobacterium tuberculosis
TQLLLGRPLIGNGANGAPGTGQ

SEQ ID NO: 1492508 - protein, 23 aa, Mycobacterium tuberculosis
TQLLLGRPLIGNGANGAPGTGQA

SEQ ID NO: 1492509 - protein, 23 aa, Mycobacterium tuberculosis
TQLWLERPLIGDGVHGAPGTGQP

SEQ ID NO: 1492510 - protein, 19 aa, Mycobacterium tuberculosis
TQRAFLRYGKGRHRAALNF

SEQ ID NO: 1492511 - protein, 25 aa, Mycobacterium tuberculosis
TQTLLGRPLIGNGADGVAGTGSNAG

SEQ ID NO: 1492512 - protein, 17 aa, Mycobacterium tuberculosis
TQVLAAGADEVSARIAA

SEQ ID NO: 1492513 - protein, 22 aa, Mycobacterium tuberculosis
TRAAGNFGIGNAGTGNWGIGNS

SEQ ID NO: 1492514 - protein, 21 aa, Mycobacterium tuberculosis
TRAASGVDASDHGPGSGGNGG

SEQ ID NO: 1492515 - protein, 23 aa, Mycobacterium tuberculosis
TRAEGVACYQLFISGLLDVTDNV

SEQ ID NO: 1492516 - protein, 26 aa, Mycobacterium tuberculosis
TRAGVLRFLVLDGLAKPGRMVGPDPG

SEQ ID NO: 1492517 - protein, 19 aa, Mycobacterium tuberculosis
TRAHPFPPPGGVGMAAVSI

SEQ ID NO: 1492518 - protein, 17 aa, Mycobacterium tuberculosis
TRALLLAGEETRLRLLV

SEQ ID NO: 1492519 - protein, 24 aa, Mycobacterium tuberculosis
TRAPECRGSVEIDATGALSCAGVD

SEQ ID NO: 1492520 - protein, 26 aa, Mycobacterium tuberculosis
TRARGVLRRPQLVGAVEDMGRLRDGV

SEQ ID NO: 1492521 - protein, 19 aa, Mycobacterium tuberculosis
TRASALMMAAGWNTRSRFP

SEQ ID NO: 1492522 - protein, 22 aa, Mycobacterium tuberculosis
TRASARLAPAFTDTWVATTDND

SEQ ID NO: 1492523 - protein, 19 aa, Mycobacterium tuberculosis
TRASTGWAAVIDQLARRPD

SEQ ID NO: 1492524 - protein, 27 aa, Mycobacterium tuberculosis
TRAYFRGECLRRFGADIAAASWDSVIF

SEQ ID NO: 1492525 - protein, 28 aa, Mycobacterium tuberculosis
TRAYFRGECLRRFGADIAAASWDSVIFD

SEQ ID NO: 1492526 - protein, 17 aa, Mycobacterium tuberculosis
TRCAGLGFDDYATDNLW

SEQ ID NO: 1492527 - protein, 17 aa, Mycobacterium tuberculosis
TRCAGLGFDDYATRQPA

SEQ ID NO: 1492528 - protein, 26 aa, Mycobacterium tuberculosis
TRDYPARLDEFLAWTTRVANLLNSRP

SEQ ID NO: 1492529 - protein, 22 aa, Mycobacterium tuberculosis
TRELARPYLAPGNRGTHLEQRN

SEQ ID NO: 1492530 - protein, 17 aa, Mycobacterium tuberculosis
TRFFPMLTTAAGTVKPA

SEQ ID NO: 1492531 - protein, 21 aa, Mycobacterium tuberculosis
TRFGVPVPNLTAWRRSVTGDM

SEQ ID NO: 1492532 - protein, 17 aa, Mycobacterium tuberculosis
TRFKRKEHWLPAHFSGD

SEQ ID NO: 1492533 - protein, 18 aa, Mycobacterium tuberculosis
TRGADGLQTPSPGAVSGS

SEQ ID NO: 1492534 - protein, 19 aa, Mycobacterium tuberculosis
TRGGEFCRHATAKVEQSPR

SEQ ID NO: 1492535 - protein, 21 aa, Mycobacterium tuberculosis
TRGPGKWPTRWSSGSTGTTRR

SEQ ID NO: 1492536 - protein, 27 aa, Mycobacterium tuberculosis
TRGRRRPRCRRLRRGRRNRRCPREYHA

SEQ ID NO: 1492537 - protein, 18 aa, Mycobacterium tuberculosis
TRGVPTVRIRGFSLWGDV

SEQ ID NO: 1492538 - protein, 33 aa, Mycobacterium tuberculosis
TRHCDACAVGRTWCVPWWWGPGALPKSSAGHSR

SEQ ID NO: 1492539 - protein, 18 aa, Mycobacterium tuberculosis
TRIAFGFRSPQALIALAM

SEQ ID NO: 1492540 - protein, 32 aa, Mycobacterium tuberculosis
TRIRQTPQVLPLEMGCFLQPIFTGDRGGPGRR

SEQ ID NO: 1492541 - protein, 25 aa, Mycobacterium tuberculosis
TRLAFPLRRGLVWRRRASELRTEAG

SEQ ID NO: 1492542 - protein, 18 aa, Mycobacterium tuberculosis
TRLAWSVLNWNSDAIGLY

SEQ ID NO: 1492543 - protein, 19 aa, Mycobacterium tuberculosis
TRLDMSIPAPQAVPRPSAA

SEQ ID NO: 1492544 - protein, 20 aa, Mycobacterium tuberculosis
TRLDRVLDWLGRADVDVLAM

SEQ ID NO: 1492545 - protein, 22 aa, Mycobacterium tuberculosis
TRLIKRLQAILTDCTAPPASSG

SEQ ID NO: 1492546 - protein, 24 aa, Mycobacterium tuberculosis
TRLRIPAERWVYPQAGTDAHDTPA

SEQ ID NO: 1492547 - protein, 24 aa, Mycobacterium tuberculosis
TRLRRRLRQHRFEFLADDGRLTMP

SEQ ID NO: 1492548 - protein, 17 aa, Mycobacterium tuberculosis
TRLRVIPNHVCLTTNLV

SEQ ID NO: 1492549 - protein, 18 aa, Mycobacterium tuberculosis
TRNGRIGVIGTRATITSH

SEQ ID NO: 1492550 - protein, 19 aa, Mycobacterium tuberculosis
TRNIPRPVAAGLYGDLTAT

SEQ ID NO: 1492551 - protein, 20 aa, Mycobacterium tuberculosis
TRPCNPMCRGAARGGTDPAG

SEQ ID NO: 1492552 - protein, 19 aa, Mycobacterium tuberculosis
TRPGGAWERSASGSTRRAV

SEQ ID NO: 1492553 - protein, 23 aa, Mycobacterium tuberculosis
TRPGRRRRRGGTLAGNGGAGGTG

SEQ ID NO: 1492554 - protein, 33 aa, Mycobacterium tuberculosis
TRPTLRGRPVLVGGLGGRGVVAGASYEARAYGA

SEQ ID NO: 1492555 - protein, 20 aa, Mycobacterium tuberculosis
TRQYWALQCRQFQHRHRQPR

SEQ ID NO: 1492556 - protein, 17 aa, Mycobacterium tuberculosis
TRRAHWRSPAGKQVKVT

SEQ ID NO: 1492557 - protein, 19 aa, Mycobacterium tuberculosis
TRRARRWYRGGHPLPGHAR

SEQ ID NO: 1492558 - protein, 24 aa, Mycobacterium tuberculosis
TRRCVGDPWANRKFGNCRLYSMLV

SEQ ID NO: 1492559 - protein, 17 aa, Mycobacterium tuberculosis
TRRGAAGVGRRLRNRSA

SEQ ID NO: 1492560 - protein, 25 aa, Mycobacterium tuberculosis
TRRGRPTVWSVWGVGGAILLRDALH

SEQ ID NO: 1492561 - protein, 23 aa, Mycobacterium tuberculosis
TRRPPVFPEDIWVPERDPGTTRL

SEQ ID NO: 1492562 - protein, 17 aa, Mycobacterium tuberculosis
TRRQVLDHITFDFEPGE

SEQ ID NO: 1492563 - protein, 34 aa, Mycobacterium tuberculosis
TRRRGCRPGTACARPPSRHRAGLLPHRTPRRRAA

SEQ ID NO: 1492564 - protein, 25 aa, Mycobacterium tuberculosis
TRRSCVSGRCGWSQRSAVSTIRSGQ

SEQ ID NO: 1492565 - protein, 26 aa, Mycobacterium tuberculosis
TRRSCVSGRCGWSQRSAVSTIRSGQR

SEQ ID NO: 1492566 - protein, 18 aa, Mycobacterium tuberculosis
TRSAWSFNRYAHLHTERH

SEQ ID NO: 1492567 - protein, 21 aa, Mycobacterium tuberculosis
TRSEGAGMLVFKRVDDARRDG

SEQ ID NO: 1492568 - protein, 22 aa, Mycobacterium tuberculosis
TRSEGGGMLVLKRSTTPAATAT

SEQ ID NO: 1492569 - protein, 25 aa, Mycobacterium tuberculosis
TRSRISVRLSARRGLRIRNRSSSNS

SEQ ID NO: 1492570 - protein, 23 aa, Mycobacterium tuberculosis
TRSRTGKMLPPKLGLMSYVADAY

SEQ ID NO: 1492571 - protein, 24 aa, Mycobacterium tuberculosis
TRSRTGKMLPPKLGLMSYVADAYL

SEQ ID NO: 1492572 - protein, 17 aa, Mycobacterium tuberculosis
TRTAVCQPGLYNAEVKE

SEQ ID NO: 1492573 - protein, 20 aa, Mycobacterium tuberculosis
TRTGDLWLFRGRSRPDRAIQ

SEQ ID NO: 1492574 - protein, 21 aa, Mycobacterium tuberculosis
TRTLCWPRDSTSTSSACSCRM

SEQ ID NO: 1492575 - protein, 18 aa, Mycobacterium tuberculosis
TRTRACQSGVRLVPPPRH

SEQ ID NO: 1492576 - protein, 29 aa, Mycobacterium tuberculosis
TRTRDGGGHGHAWTSITYLVLDDAARLPA

SEQ ID NO: 1492577 - protein, 31 aa, Mycobacterium tuberculosis
TRVPQGWSFAQAAAVPVVFLTAWYGLADLAE

SEQ ID NO: 1492578 - protein, 27 aa, Mycobacterium tuberculosis
TRVPVGPVVRVGGCTATAAPAAPAAVV

SEQ ID NO: 1492579 - protein, 24 aa, Mycobacterium tuberculosis
TRVRTPLIELFELFDPADPEVVAR

SEQ ID NO: 1492580 - protein, 18 aa, Mycobacterium tuberculosis
TRWVPSCPASCCTDPPGL

SEQ ID NO: 1492581 - protein, 17 aa, Mycobacterium tuberculosis
TRYLRDRFGHFDFSGIK

SEQ ID NO: 1492582 - protein, 24 aa, Mycobacterium tuberculosis
TSAESRTLARLGLANYFAAATVLP

SEQ ID NO: 1492583 - protein, 20 aa, Mycobacterium tuberculosis
TSATALRPGHNTISVEAAAP

SEQ ID NO: 1492584 - protein, 24 aa, Mycobacterium tuberculosis
TSCECTWRALGIPIMGDPLYPNVI

SEQ ID NO: 1492585 - protein, 22 aa, Mycobacterium tuberculosis
TSCPNCSGRGILLHADPVDSAA

SEQ ID NO: 1492586 - protein, 26 aa, Mycobacterium tuberculosis
TSDIKNLLPMLAVFKPTVVVSVPRVF

SEQ ID NO: 1492587 - protein, 25 aa, Mycobacterium tuberculosis
TSDQPRPLVPAMFSAVLSRLRRTHT

SEQ ID NO: 1492588 - protein, 20 aa, Mycobacterium tuberculosis
TSDRRCAVGQSVRRVQITSR

SEQ ID NO: 1492589 - protein, 19 aa, Mycobacterium tuberculosis
TSFALRIAAELLRYHTVEQ

SEQ ID NO: 1492590 - protein, 19 aa, Mycobacterium tuberculosis
TSFRVGRHRAKAVAVADGI

SEQ ID NO: 1492591 - protein, 26 aa, Mycobacterium tuberculosis
TSGEQRLSGFLLWQSAYSEMWFTEAH

SEQ ID NO: 1492592 - protein, 18 aa, Mycobacterium tuberculosis
TSGGIGIAQTGGAGGAGG

SEQ ID NO: 1492593 - protein, 23 aa, Mycobacterium tuberculosis
TSGLPAGGWTRGRAVLAVVDGDG

SEQ ID NO: 1492594 - protein, 25 aa, Mycobacterium tuberculosis
TSGLQPVDCRFCHVTVTVKRLGPGH

SEQ ID NO: 1492595 - protein, 21 aa, Mycobacterium tuberculosis
TSGRPCPRRAPTVTASRCGPT

SEQ ID NO: 1492596 - protein, 18 aa, Mycobacterium tuberculosis
TSIAARFTKPVFPGETLS

SEQ ID NO: 1492597 - protein, 23 aa, Mycobacterium tuberculosis
TSILQRRVVFRANRAEVQAIATD

SEQ ID NO: 1492598 - protein, 21 aa, Mycobacterium tuberculosis
TSIPPGRWHPLQAAGDAVIVD

SEQ ID NO: 1492599 - protein, 18 aa, Mycobacterium tuberculosis
TSIRTRLTAIESVLGNAI

SEQ ID NO: 1492600 - protein, 17 aa, Mycobacterium tuberculosis
TSISAPIVESWRAQRGA

SEQ ID NO: 1492601 - protein, 18 aa, Mycobacterium tuberculosis
TSISAPIVESWRAQRGAQ

SEQ ID NO: 1492602 - protein, 19 aa, Mycobacterium tuberculosis
TSLATGPPAHFRALSTNST

SEQ ID NO: 1492603 - protein, 18 aa, Mycobacterium tuberculosis
TSLGRLPARHMAHSLDDL

SEQ ID NO: 1492604 - protein, 17 aa, Mycobacterium tuberculosis
TSLLDRHRPLWELHVVE

SEQ ID NO: 1492605 - protein, 19 aa, Mycobacterium tuberculosis
TSLLDRHRPLWELHVVEGL

SEQ ID NO: 1492606 - protein, 36 aa, Mycobacterium tuberculosis
TSLRDPYHAYTIDWLPEGWFIEVSEVAPGCGQPGGS

SEQ ID NO: 1492607 - protein, 17 aa, Mycobacterium tuberculosis
TSNDLLLVPSIVEPSNF

SEQ ID NO: 1492608 - protein, 17 aa, Mycobacterium tuberculosis
TSNLLVWISTLGTTDGK

SEQ ID NO: 1492609 - protein, 21 aa, Mycobacterium tuberculosis
TSPLLAPINEFFLANTGRPLI

SEQ ID NO: 1492610 - protein, 22 aa, Mycobacterium tuberculosis
TSPLLAPINEFFLANTGRPLIG

SEQ ID NO: 1492611 - protein, 25 aa, Mycobacterium tuberculosis
TSPLRPWPGFVPMVYERYSQPFFGG

SEQ ID NO: 1492612 - protein, 23 aa, Mycobacterium tuberculosis
TSPRPLPSGTYCKIPQDAQLQVR

SEQ ID NO: 1492613 - protein, 18 aa, Mycobacterium tuberculosis
TSQKVRWAARVSLDAAGD

SEQ ID NO: 1492614 - protein, 32 aa, Mycobacterium tuberculosis
TSRAKLNWWESRALYGWTVLVPRTKDQAGEMS

SEQ ID NO: 1492615 - protein, 19 aa, Mycobacterium tuberculosis
TSRAPRWAIAYKYPPEEAQ

SEQ ID NO: 1492616 - protein, 19 aa, Mycobacterium tuberculosis
TSRGGRWTRSYDRITGSRL

SEQ ID NO: 1492617 - protein, 18 aa, Mycobacterium tuberculosis
TSRIPRNWTLPRAVSSSV

SEQ ID NO: 1492618 - protein, 20 aa, Mycobacterium tuberculosis
TSRLRLTARASLNAGELELA

SEQ ID NO: 1492619 - protein, 23 aa, Mycobacterium tuberculosis
TSRNPRSLRVCTLLRKPDAVHAN

SEQ ID NO: 1492620 - protein, 24 aa, Mycobacterium tuberculosis
TSRPGSLCRKRYAVPNGMITHERS

SEQ ID NO: 1492621 - protein, 18 aa, Mycobacterium tuberculosis
TSSAAEWRWSAAVPAIPN

SEQ ID NO: 1492622 - protein, 20 aa, Mycobacterium tuberculosis
TSSTCSRPSTSVRCRSEVGG

SEQ ID NO: 1492623 - protein, 18 aa, Mycobacterium tuberculosis
TSSVRTAFYYVRSGITVV

SEQ ID NO: 1492624 - protein, 27 aa, Mycobacterium tuberculosis
TSVCMFKPPFAWREYLLQCWFVARVST

SEQ ID NO: 1492625 - protein, 17 aa, Mycobacterium tuberculosis
TSVCSTRAPATSASATR

SEQ ID NO: 1492626 - protein, 17 aa, Mycobacterium tuberculosis
TSVFRATRAALRYFRDA

SEQ ID NO: 1492627 - protein, 17 aa, Mycobacterium tuberculosis
TSVRMPLTLNIPAGIPL

SEQ ID NO: 1492628 - protein, 22 aa, Mycobacterium tuberculosis
TSYNGMLYFGINADRDAMSDVD

SEQ ID NO: 1492629 - protein, 31 aa, Mycobacterium tuberculosis
TSYNTPWIRRSRCWIRWATPPCGRTHCIGLE

SEQ ID NO: 1492630 - protein, 26 aa, Mycobacterium tuberculosis
TSYQEVRRGVTFAVVHFDWERLTDSV

SEQ ID NO: 1492631 - protein, 22 aa, Mycobacterium tuberculosis
TTAAIPHRWATVVATQRTATGA

SEQ ID NO: 1492632 - protein, 26 aa, Mycobacterium tuberculosis
TTADGALRVAPAVSAAPEAAPSRSGN

SEQ ID NO: 1492633 - protein, 25 aa, Mycobacterium tuberculosis
TTATRSSCSPRCCCPLDRKAFARPS

SEQ ID NO: 1492634 - protein, 21 aa, Mycobacterium tuberculosis
TTCCRIATRTLCWPRDSTSTS

SEQ ID NO: 1492635 - protein, 17 aa, Mycobacterium tuberculosis
TTDGLRIDTGMYLTGME

SEQ ID NO: 1492636 - protein, 28 aa, Mycobacterium tuberculosis
TTEVVGRPAPTRCRRASRRCSAAHAQEY

SEQ ID NO: 1492637 - protein, 17 aa, Mycobacterium tuberculosis
TTFTPKHMGVMFGAPGG

SEQ ID NO: 1492638 - protein, 21 aa, Mycobacterium tuberculosis
TTGAAAVWWHRGCGTITSSAM

SEQ ID NO: 1492639 - protein, 24 aa, Mycobacterium tuberculosis
TTGGPYAHGWVTWFPPDAPPGTER

SEQ ID NO: 1492640 - protein, 17 aa, Mycobacterium tuberculosis
TTGLIRQRRQWREPAEP

SEQ ID NO: 1492641 - protein, 31 aa, Mycobacterium tuberculosis
TTGRERRCWPRWPSWPPAVAAQLVAGGLTII

SEQ ID NO: 1492642 - protein, 21 aa, Mycobacterium tuberculosis
TTGRPRRAGVSSFGVSGTNAH

SEQ ID NO: 1492643 - protein, 31 aa, Mycobacterium tuberculosis
TTGTAGGLARACRRGGTVAADATGRRSGGAM

SEQ ID NO: 1492644 - protein, 21 aa, Mycobacterium tuberculosis
TTGVPVQWSAVFAGSGGRRVQ

SEQ ID NO: 1492645 - protein, 17 aa, Mycobacterium tuberculosis
TTGWMVTKDIGYHLTRI

SEQ ID NO: 1492646 - protein, 19 aa, Mycobacterium tuberculosis
TTKHIPAFKLTRSSAAYWR

SEQ ID NO: 1492647 - protein, 20 aa, Mycobacterium tuberculosis
TTLHFPGFTIPTGPIHIGLP

SEQ ID NO: 1492648 - protein, 17 aa, Mycobacterium tuberculosis
TTLRSMLAGNLGLANVG

SEQ ID NO: 1492649 - protein, 18 aa, Mycobacterium tuberculosis
TTLTAAITKVLHDKFPDL

SEQ ID NO: 1492650 - protein, 31 aa, Mycobacterium tuberculosis
TTLVPNLGCGLGWRGTRFTVRRRCRGLIPGR

SEQ ID NO: 1492651 - protein, 21 aa, Mycobacterium tuberculosis
TTMDGFAIPAGPGYFNSSATP

SEQ ID NO: 1492652 - protein, 18 aa, Mycobacterium tuberculosis
TTMRLLDELGLWERFAAL

SEQ ID NO: 1492653 - protein, 40 aa, Mycobacterium tuberculosis
TTNPPVEGAFYWLNNREVRWRPEHFWKPGTAVDVAVNTYG

SEQ ID NO: 1492654 - protein, 25 aa, Mycobacterium tuberculosis
TTPEFAIPPIGVGGFTLPQITTQAI

SEQ ID NO: 1492655 - protein, 24 aa, Mycobacterium tuberculosis
TTPEFAIPPIGVGGFTLPQITTQE

SEQ ID NO: 1492656 - protein, 21 aa, Mycobacterium tuberculosis
TTPKGRWQRRRHRPRRPLPPP

SEQ ID NO: 1492657 - protein, 19 aa, Mycobacterium tuberculosis
TTPQLKGLLPRFAGRATDQ

SEQ ID NO: 1492658 - protein, 17 aa, Mycobacterium tuberculosis
TTPTRWIASLTVPPQMR

SEQ ID NO: 1492659 - protein, 29 aa, Mycobacterium tuberculosis
TTRDYRSVIDFYRQVFGWRTEQISDTDEF

SEQ ID NO: 1492660 - protein, 26 aa, Mycobacterium tuberculosis
TTRLPGSGCARRCWTSHGGRRRRVDP

SEQ ID NO: 1492661 - protein, 18 aa, Mycobacterium tuberculosis
TTRRGRRPRSTSKRSTPC

SEQ ID NO: 1492662 - protein, 17 aa, Mycobacterium tuberculosis
TTRVIDLILPIGKVNAA

SEQ ID NO: 1492663 - protein, 17 aa, Mycobacterium tuberculosis
TTRVIDLIMPIGKGQRA

SEQ ID NO: 1492664 - protein, 17 aa, Mycobacterium tuberculosis
TTSCAVLAALATEEQSA

SEQ ID NO: 1492665 - protein, 23 aa, Mycobacterium tuberculosis
TTSVPQRVCSTTWPRCSERRRPR

SEQ ID NO: 1492666 - protein, 30 aa, Mycobacterium tuberculosis
TTTACWPRCGPCCARGSWANTTGYPRPSSC

SEQ ID NO: 1492667 - protein, 18 aa, Mycobacterium tuberculosis
TTTLGRACTPVWSGVGLH

SEQ ID NO: 1492668 - protein, 17 aa, Mycobacterium tuberculosis
TTTPDVRAVVITGAGDK

SEQ ID NO: 1492669 - protein, 18 aa, Mycobacterium tuberculosis
TTTRGRWTGYPNRRPGRR

SEQ ID NO: 1492670 - protein, 26 aa, Mycobacterium tuberculosis
TTVNLKACIKAAADRVVFINTGFLDR

SEQ ID NO: 1492671 - protein, 17 aa, Mycobacterium tuberculosis
TTVPGIWVPDTPLSHRN

SEQ ID NO: 1492672 - protein, 17 aa, Mycobacterium tuberculosis
TTVTWQWTIHPRSALAA

SEQ ID NO: 1492673 - protein, 24 aa, Mycobacterium tuberculosis
TTWVRYSTTAAWRCGSGTTARCRC

SEQ ID NO: 1492674 - protein, 29 aa, Mycobacterium tuberculosis
TVAAGVTVWPVFTRVGGVGTHATKRAVAA

SEQ ID NO: 1492675 - protein, 19 aa, Mycobacterium tuberculosis
TVAAVPLMLEHSGGGVINI

SEQ ID NO: 1492676 - protein, 19 aa, Mycobacterium tuberculosis
TVAELFVCRPTEPDVGDFV

SEQ ID NO: 1492677 - protein, 23 aa, Mycobacterium tuberculosis
TVAEPGWTMFMISHFHYDPVWWN

SEQ ID NO: 1492678 - protein, 26 aa, Mycobacterium tuberculosis
TVANLASIGNTWLADPAPFLQQYLAT

SEQ ID NO: 1492679 - protein, 20 aa, Mycobacterium tuberculosis
TVARVMRPAVFVPDSKPLDA

SEQ ID NO: 1492680 - protein, 23 aa, Mycobacterium tuberculosis
TVAVLLRITEVFGVDATFFASQD

SEQ ID NO: 1492681 - protein, 17 aa, Mycobacterium tuberculosis
TVCEPGREFGFAVLLGD

SEQ ID NO: 1492682 - protein, 18 aa, Mycobacterium tuberculosis
TVDEGAVCTAMLDLYQNE

SEQ ID NO: 1492683 - protein, 20 aa, Mycobacterium tuberculosis
TVDPFVIAANRSRLVSLALS

SEQ ID NO: 1492684 - protein, 24 aa, Mycobacterium tuberculosis
TVDPFVIAANRSRLVSLALSNLFG

SEQ ID NO: 1492685 - protein, 17 aa, Mycobacterium tuberculosis
TVEAWTTPVNRDGQPEK

SEQ ID NO: 1492686 - protein, 24 aa, Mycobacterium tuberculosis
TVEGLKIDGDHIVVKFSIGTNTIG

SEQ ID NO: 1492687 - protein, 23 aa, Mycobacterium tuberculosis
TVELRRPGGPGVIIGRNVVRKDI

SEQ ID NO: 1492688 - protein, 17 aa, Mycobacterium tuberculosis
TVFIELLAWQFASPVRW

SEQ ID NO: 1492689 - protein, 17 aa, Mycobacterium tuberculosis
TVFLNKPVISWAGDNGI

SEQ ID NO: 1492690 - protein, 20 aa, Mycobacterium tuberculosis
TVFVCPSVYEPLGIVNLEAI

SEQ ID NO: 1492691 - protein, 26 aa, Mycobacterium tuberculosis
TVGECARCLSPVRGRVQVALTELFAY

SEQ ID NO: 1492692 - protein, 18 aa, Mycobacterium tuberculosis
TVGKFSVAAVTELMLFDA

SEQ ID NO: 1492693 - protein, 19 aa, Mycobacterium tuberculosis
TVGRQALDMYFNLANYRNN

SEQ ID NO: 1492694 - protein, 24 aa, Mycobacterium tuberculosis
TVHAPRLSPAPALLALPAAESAWR

SEQ ID NO: 1492695 - protein, 17 aa, Mycobacterium tuberculosis
TVIARDRAEAIAGLRAL

SEQ ID NO: 1492696 - protein, 17 aa, Mycobacterium tuberculosis
TVIWTLPGNQTYVTTPG

SEQ ID NO: 1492697 - protein, 31 aa, Mycobacterium tuberculosis
TVLHEMAHMWFGDLVTMTWWDDLWLNESFAT

SEQ ID NO: 1492698 - protein, 21 aa, Mycobacterium tuberculosis
TVLPFTGLNTPLAVAVDSDRT

SEQ ID NO: 1492699 - protein, 31 aa, Mycobacterium tuberculosis
TVLPIQILPTIPLNIHQTFSLGPLVVPDIVI

SEQ ID NO: 1492700 - protein, 32 aa, Mycobacterium tuberculosis
TVLPIQILPTIPLNIHQTFSLGPLVVPDIVIP

SEQ ID NO: 1492701 - protein, 22 aa, Mycobacterium tuberculosis
TVLRIASRVGTGVGFAEDQVFE

SEQ ID NO: 1492702 - protein, 25 aa, Mycobacterium tuberculosis
TVPALCGGPGWPAKAELLTRADLVI

SEQ ID NO: 1492703 - protein, 25 aa, Mycobacterium tuberculosis
TVPPGQLGWGWARFAFTSWKTLGWV

SEQ ID NO: 1492704 - protein, 21 aa, Mycobacterium tuberculosis
TVPSPNLPPGFDFTDPAIYAE

SEQ ID NO: 1492705 - protein, 17 aa, Mycobacterium tuberculosis
TVRFGRTWCGFEVDHRL

SEQ ID NO: 1492706 - protein, 17 aa, Mycobacterium tuberculosis
TVRHNLVLLGPVDDLER

SEQ ID NO: 1492707 - protein, 38 aa, Mycobacterium tuberculosis
TVRRRCRGLIPGRIPGPVVWGWTFCRTSSACAELVHVV

SEQ ID NO: 1492708 - protein, 28 aa, Mycobacterium tuberculosis
TVRSYNCLKREGVHIVGELVARTESDLL

SEQ ID NO: 1492709 - protein, 27 aa, Mycobacterium tuberculosis
TVRYALRRLGALRVWPARARANTEIDD

SEQ ID NO: 1492710 - protein, 22 aa, Mycobacterium tuberculosis
TVRYRLKRITDFTGRDPTQPRD

SEQ ID NO: 1492711 - protein, 27 aa, Mycobacterium tuberculosis
TVVRCLRERSRICISVSRPRRGRHARA

SEQ ID NO: 1492712 - protein, 25 aa, Mycobacterium tuberculosis
TVVRRMRLQPGRMFLVDTAQGRIVS

SEQ ID NO: 1492713 - protein, 18 aa, Mycobacterium tuberculosis
TVVVSVWQPGEPAAKLVG

SEQ ID NO: 1492714 - protein, 17 aa, Mycobacterium tuberculosis
TVWGVGIAPSITTASLR

SEQ ID NO: 1492715 - protein, 20 aa, Mycobacterium tuberculosis
TVYSGEWWHFDGPGPGPGAG

SEQ ID NO: 1492716 - protein, 18 aa, Mycobacterium tuberculosis
TWASASARRTCHGSTPRW

SEQ ID NO: 1492717 - protein, 18 aa, Mycobacterium tuberculosis
TWDLLRLTRMPTVQVDIG

SEQ ID NO: 1492718 - protein, 25 aa, Mycobacterium tuberculosis
TWGVMGIGMGYAIAAAVETGRPVVA

SEQ ID NO: 1492719 - protein, 22 aa, Mycobacterium tuberculosis
TWIKEFDPRFNVRYRDDSPTLC

SEQ ID NO: 1492720 - protein, 17 aa, Mycobacterium tuberculosis
TWPAFSPPSIFYAALGE

SEQ ID NO: 1492721 - protein, 17 aa, Mycobacterium tuberculosis
TWRERRKLISVLRHRGR

SEQ ID NO: 1492722 - protein, 24 aa, Mycobacterium tuberculosis
TWSEVFRRTRIVAHEVRRHCTTGD

SEQ ID NO: 1492723 - protein, 18 aa, Mycobacterium tuberculosis
TWYTVDRPVYVALTLPSG

SEQ ID NO: 1492724 - protein, 25 aa, Mycobacterium tuberculosis
TYAFQRRRFWLSGDGVAAGRGRLGV

SEQ ID NO: 1492725 - protein, 19 aa, Mycobacterium tuberculosis
TYAKGWRPSARDAHPNLMI

SEQ ID NO: 1492726 - protein, 32 aa, Mycobacterium tuberculosis
TYARAMGPMQFLPGTWARYATDGDDDGVADPQ

SEQ ID NO: 1492727 - protein, 21 aa, Mycobacterium tuberculosis
TYARIGERWRIGSDGLVLEVS

SEQ ID NO: 1492728 - protein, 19 aa, Mycobacterium tuberculosis
TYDLVGWLADQSWRDGRVV

SEQ ID NO: 1492729 - protein, 17 aa, Mycobacterium tuberculosis
TYFKDHLYIAGRIKDLV

SEQ ID NO: 1492730 - protein, 17 aa, Mycobacterium tuberculosis
TYFSVGGGFIVTKQTSG

SEQ ID NO: 1492731 - protein, 18 aa, Mycobacterium tuberculosis
TYGLIVYQEQIMRIAQKV

SEQ ID NO: 1492732 - protein, 23 aa, Mycobacterium tuberculosis
TYNHYPIGWAMAFNTPYKLFKRY

SEQ ID NO: 1492733 - protein, 18 aa, Mycobacterium tuberculosis
TYRPGQAVEAVFVSALPN

SEQ ID NO: 1492734 - protein, 27 aa, Mycobacterium tuberculosis
TYSSVCRRVGQPPCWAPPGPGRGCPGA

SEQ ID NO: 1492735 - protein, 17 aa, Mycobacterium tuberculosis
VAAAAKVNTLLDIAQAN

SEQ ID NO: 1492736 - protein, 32 aa, Mycobacterium tuberculosis
VAAAGWSEAVGALGAWGRAGATATALPAGAGV

SEQ ID NO: 1492737 - protein, 34 aa, Mycobacterium tuberculosis
VAAAIAFATDCARIARVRPCGAVGAVAAGPAGAA

SEQ ID NO: 1492738 - protein, 22 aa, Mycobacterium tuberculosis
VAAAPYAGWLAAAAARAGGAAV

SEQ ID NO: 1492739 - protein, 30 aa, Mycobacterium tuberculosis
VAAARGAARLAQPWPNRGMFGGAYGEAKSA

SEQ ID NO: 1492740 - protein, 17 aa, Mycobacterium tuberculosis
VAAASWDALAAELASAA

SEQ ID NO: 1492741 - protein, 17 aa, Mycobacterium tuberculosis
VAAAVFGAMEAWMLGSD

SEQ ID NO: 1492742 - protein, 17 aa, Mycobacterium tuberculosis
VAAAVPVYGRYDWFTTD

SEQ ID NO: 1492743 - protein, 19 aa, Mycobacterium tuberculosis
VAACCSRCWPPAVPAAPLG

SEQ ID NO: 1492744 - protein, 20 aa, Mycobacterium tuberculosis
VAACRRRRPVGAVRRAGAGD

SEQ ID NO: 1492745 - protein, 23 aa, Mycobacterium tuberculosis
VAAEAAIAFGASRTAVAAVAAGA

SEQ ID NO: 1492746 - protein, 17 aa, Mycobacterium tuberculosis
VAAEFGAGPGVCAHRRR

SEQ ID NO: 1492747 - protein, 22 aa, Mycobacterium tuberculosis
VAAEPRYGEGVYALRNMDEGFV

SEQ ID NO: 1492748 - protein, 17 aa, Mycobacterium tuberculosis
VAAGIAMHAWIPQHADL

SEQ ID NO: 1492749 - protein, 31 aa, Mycobacterium tuberculosis
VAAGLDCRAYRLGWQPGTTVFEIDVPKVLEF

SEQ ID NO: 1492750 - protein, 18 aa, Mycobacterium tuberculosis
VAAGLNFSDVLKAMGVYP

SEQ ID NO: 1492751 - protein, 27 aa, Mycobacterium tuberculosis
VAAGNRGLDALGFAGTIPKSAPGSATG

SEQ ID NO: 1492752 - protein, 17 aa, Mycobacterium tuberculosis
VAAGPLREWLHKQRTGL

SEQ ID NO: 1492753 - protein, 25 aa, Mycobacterium tuberculosis
VAAGRASGVLPRYRGSAHGDGPPTR

SEQ ID NO: 1492754 - protein, 23 aa, Mycobacterium tuberculosis
VAAGRRKALAFIEGRSVAELVAL

SEQ ID NO: 1492755 - protein, 23 aa, Mycobacterium tuberculosis
VAAHAPYLAWLMRASETSAEAAA

SEQ ID NO: 1492756 - protein, 24 aa, Mycobacterium tuberculosis
VAAHDLRPGTVLTPGDVRLEKRSA

SEQ ID NO: 1492757 - protein, 25 aa, Mycobacterium tuberculosis
VAAITVGLSRGWSLIKSVRLGNAAG

SEQ ID NO: 1492758 - protein, 18 aa, Mycobacterium tuberculosis
VAAKDIWVRPTERAHAEV

SEQ ID NO: 1492759 - protein, 25 aa, Mycobacterium tuberculosis
VAALAAVNCFAWRPTGPLFRGMLAA

SEQ ID NO: 1492760 - protein, 24 aa, Mycobacterium tuberculosis
VAALAAVNCFAWRPTGSAVPGHAR

SEQ ID NO: 1492761 - protein, 18 aa, Mycobacterium tuberculosis
VAALDEIAAEPGHLRLVD

SEQ ID NO: 1492762 - protein, 19 aa, Mycobacterium tuberculosis
VAALTFNIPSGDRMAPGVH

SEQ ID NO: 1492763 - protein, 28 aa, Mycobacterium tuberculosis
VAAMAGYHFDASAAVAQLAPWQQVLRNL

SEQ ID NO: 1492764 - protein, 28 aa, Mycobacterium tuberculosis
VAAMMKATCRARSSSDLTARRRSTPSTS

SEQ ID NO: 1492765 - protein, 23 aa, Mycobacterium tuberculosis
VAANRNAFVQLVLSNLFGQNAPA

SEQ ID NO: 1492766 - protein, 17 aa, Mycobacterium tuberculosis
VAAPGMLPAFSTRTGRQ

SEQ ID NO: 1492767 - protein, 17 aa, Mycobacterium tuberculosis
VAAPKPSKLEVFNAALA

SEQ ID NO: 1492768 - protein, 23 aa, Mycobacterium tuberculosis
VAAPRPGLRAALADRQREQRQPI

SEQ ID NO: 1492769 - protein, 18 aa, Mycobacterium tuberculosis
VAARFGVRYCRPLGELDW

SEQ ID NO: 1492770 - protein, 17 aa, Mycobacterium tuberculosis
VAARGVRDGEDIRLLLD

SEQ ID NO: 1492771 - protein, 19 aa, Mycobacterium tuberculosis
VAARPPAAVVLFSPLIDLT

SEQ ID NO: 1492772 - protein, 18 aa, Mycobacterium tuberculosis
VAARPSAAVVLFSPLIDL

SEQ ID NO: 1492773 - protein, 23 aa, Mycobacterium tuberculosis
VAASLRCPWCVDAHTTMLYAAGQ

SEQ ID NO: 1492774 - protein, 19 aa, Mycobacterium tuberculosis
VAAYQERFVLALSQASSTY

SEQ ID NO: 1492775 - protein, 21 aa, Mycobacterium tuberculosis
VAAYQERFVLALSQASSTYAV

SEQ ID NO: 1492776 - protein, 23 aa, Mycobacterium tuberculosis
VAAYQERFVLALSQASSTYAVAE

SEQ ID NO: 1492777 - protein, 17 aa, Mycobacterium tuberculosis
VACGAGLGECVGDPWSS

SEQ ID NO: 1492778 - protein, 21 aa, Mycobacterium tuberculosis
VACRSDLGGALVLSEFTGAAA

SEQ ID NO: 1492779 - protein, 22 aa, Mycobacterium tuberculosis
VACSRPPWTCCPASTHPPSSLS

SEQ ID NO: 1492780 - protein, 21 aa, Mycobacterium tuberculosis
VADGSAIHWIMRPSMTAINTE

SEQ ID NO: 1492781 - protein, 22 aa, Mycobacterium tuberculosis
VADKCIREGRRPAWAGHLGGLS

SEQ ID NO: 1492782 - protein, 25 aa, Mycobacterium tuberculosis
VAEELGQPLPLFIKWDDADYGLRAA

SEQ ID NO: 1492783 - protein, 27 aa, Mycobacterium tuberculosis
VAEGGRFACGGARPADREVGFYIEPTV

SEQ ID NO: 1492784 - protein, 21 aa, Mycobacterium tuberculosis
VAEGRVAGVHFLMKKNKITEI

SEQ ID NO: 1492785 - protein, 17 aa, Mycobacterium tuberculosis
VAEKFPVLLGGAALTRS

SEQ ID NO: 1492786 - protein, 21 aa, Mycobacterium tuberculosis
VAEKLRTKWVPERAKMLRELN

SEQ ID NO: 1492787 - protein, 18 aa, Mycobacterium tuberculosis
VAELHQLGLGKWLADHIR

SEQ ID NO: 1492788 - protein, 17 aa, Mycobacterium tuberculosis
VAELLGVPVSKVAQQLR

SEQ ID NO: 1492789 - protein, 23 aa, Mycobacterium tuberculosis
VAELLPQVFRWARTVDPVQPLTS

SEQ ID NO: 1492790 - protein, 22 aa, Mycobacterium tuberculosis
VAELRSGGLGVREFKRLAKATG

SEQ ID NO: 1492791 - protein, 17 aa, Mycobacterium tuberculosis
VAEMPKQILAARPLLAR

SEQ ID NO: 1492792 - protein, 21 aa, Mycobacterium tuberculosis
VAEPGWTMFMISHFHYDPVWW

SEQ ID NO: 1492793 - protein, 24 aa, Mycobacterium tuberculosis
VAEPPCAQLAALVRCVGPVEAADR

SEQ ID NO: 1492794 - protein, 25 aa, Mycobacterium tuberculosis
VAEPPCAQLAALVRCVGPVEAADRV

SEQ ID NO: 1492795 - protein, 23 aa, Mycobacterium tuberculosis
VAEPYLPLRAVRHLEKGRVVIFG

SEQ ID NO: 1492796 - protein, 19 aa, Mycobacterium tuberculosis
VAEQARVATRPAGATTSPT

SEQ ID NO: 1492797 - protein, 18 aa, Mycobacterium tuberculosis
VAERLAPGAHRWWQAGHR

SEQ ID NO: 1492798 - protein, 22 aa, Mycobacterium tuberculosis
VAERLAPGAHRWWQAGHRSSEP

SEQ ID NO: 1492799 - protein, 18 aa, Mycobacterium tuberculosis
VAETLIEVALRFVNIRET

SEQ ID NO: 1492800 - protein, 18 aa, Mycobacterium tuberculosis
VAFGRYPTFEGYRQQLGI

SEQ ID NO: 1492801 - protein, 24 aa, Mycobacterium tuberculosis
VAFGSRVSTLVFSRFTSLIRSAGG

SEQ ID NO: 1492802 - protein, 25 aa, Mycobacterium tuberculosis
VAFLRAGDAIACALELQLSTLAPMR

SEQ ID NO: 1492803 - protein, 25 aa, Mycobacterium tuberculosis
VAFRGTAPAGRGFWFPPTVLTPKRG

SEQ ID NO: 1492804 - protein, 18 aa, Mycobacterium tuberculosis
VAFVGRIQPLKAPDIVLR

SEQ ID NO: 1492805 - protein, 24 aa, Mycobacterium tuberculosis
VAGDARLPASGMLFVGTPDGQIVA

SEQ ID NO: 1492806 - protein, 24 aa, Mycobacterium tuberculosis
VAGDVRLLLPMPADWSYAEAAAIS

SEQ ID NO: 1492807 - protein, 19 aa, Mycobacterium tuberculosis
VAGEAFGRAAEPWEVAATI

SEQ ID NO: 1492808 - protein, 25 aa, Mycobacterium tuberculosis
VAGGAGGSVGLWGSGGAGGDGGAAT

SEQ ID NO: 1492809 - protein, 19 aa, Mycobacterium tuberculosis
VAGGGPLPLAVSVDEEGGR

SEQ ID NO: 1492810 - protein, 30 aa, Mycobacterium tuberculosis
VAGGGQLVLVYAFDAHLLGGAGGVGGSSED

SEQ ID NO: 1492811 - protein, 19 aa, Mycobacterium tuberculosis
VAGGRGVGSAENFSVVEAL

SEQ ID NO: 1492812 - protein, 30 aa, Mycobacterium tuberculosis; identical to SEQ ID NO: 207493

SEQ ID NO: 1492813 - protein, 17 aa, Mycobacterium tuberculosis
VAGLETLDCGRIRIGER

SEQ ID NO: 1492814 - protein, 28 aa, Mycobacterium tuberculosis
VAGRLSPDGLRWSTTEQLGYNRRYTLNA

SEQ ID NO: 1492815 - protein, 18 aa, Mycobacterium tuberculosis
VAGRRMAETVARRGGIVI

SEQ ID NO: 1492816 - protein, 23 aa, Mycobacterium tuberculosis
VAGVCIEPTLALPGLRAAVDGAG

SEQ ID NO: 1492817 - protein, 25 aa, Mycobacterium tuberculosis
VAHDLCGPAGFLAAARRGDRVAALA

SEQ ID NO: 1492818 - protein, 20 aa, Mycobacterium tuberculosis
VAHDQCDAWTGLAAAGDQSI

SEQ ID NO: 1492819 - protein, 20 aa, Mycobacterium tuberculosis
VAHPDRRTVLLIGDGAAQLT

SEQ ID NO: 1492820 - protein, 19 aa, Mycobacterium tuberculosis
VAIDMRRRRGLPPIAPHSG

SEQ ID NO: 1492821 - protein, 17 aa, Mycobacterium tuberculosis
VAISRFTFEMGDPKHLG

SEQ ID NO: 1492822 - protein, 22 aa, Mycobacterium tuberculosis
VAIWRRGSELFAEVVAPGEAGV

SEQ ID NO: 1492823 - protein, 27 aa, Mycobacterium tuberculosis
VAKFRPGPRRRLGVLVDHLVAGSKEAR

SEQ ID NO: 1492824 - protein, 17 aa, Mycobacterium tuberculosis
VAKLTYYGLYALQHRGQ

SEQ ID NO: 1492825 - protein, 18 aa, Mycobacterium tuberculosis
VALAEGKNALARALLSTG

SEQ ID NO: 1492826 - protein, 31 aa, Mycobacterium tuberculosis
VALARCGPAVRWPWWPRPAILEHMFDLVSLA

SEQ ID NO: 1492827 - protein, 24 aa, Mycobacterium tuberculosis
VALARPEEHVICIAGDGAFLMHGT

SEQ ID NO: 1492828 - protein, 24 aa, Mycobacterium tuberculosis
VALCDRRGSYIFGRRTLPQMDLAS

SEQ ID NO: 1492829 - protein, 19 aa, Mycobacterium tuberculosis
VALGYDFLPGTTVNRYCSS

SEQ ID NO: 1492830 - protein, 20 aa, Mycobacterium tuberculosis
VALQKYHWVEKINHVHTGGN

SEQ ID NO: 1492831 - protein, 25 aa, Mycobacterium tuberculosis
VALQPYGGVWLHSWLDRDLGISGRL

SEQ ID NO: 1492832 - protein, 25 aa, Mycobacterium tuberculosis
VALQPYGGVWLHSWLDRDRGISGRL

SEQ ID NO: 1492833 - protein, 17 aa, Mycobacterium tuberculosis
VALSPGIPFGAAVGSGF

SEQ ID NO: 1492834 - protein, 24 aa, Mycobacterium tuberculosis
VALSVPVSGTWVDIRFTLPANTVD

SEQ ID NO: 1492835 - protein, 25 aa, Mycobacterium tuberculosis
VAMVLRRLLRLCARYSAHPTVIFAS

SEQ ID NO: 1492836 - protein, 18 aa, Mycobacterium tuberculosis
VAMVVDMHGRRSRDIVDK

SEQ ID NO: 1492837 - protein, 24 aa, Mycobacterium tuberculosis
VANADFMGGFALWVDEQRHLHHTT

SEQ ID NO: 1492838 - protein, 19 aa, Mycobacterium tuberculosis
VANVCAWVPSATSARSVCA

SEQ ID NO: 1492839 - protein, 25 aa, Mycobacterium tuberculosis
VAPECPDWLPPGAKDMWGRVVPELA

SEQ ID NO: 1492840 - protein, 17 aa, Mycobacterium tuberculosis
VAPEVFAPAAGPASPAD

SEQ ID NO: 1492841 - protein, 18 aa, Mycobacterium tuberculosis
VAPLFKVAWPGALAGGHG

SEQ ID NO: 1492842 - protein, 18 aa, Mycobacterium tuberculosis
VAPPSDWGTGGTGGTGGT

SEQ ID NO: 1492843 - protein, 18 aa, Mycobacterium tuberculosis
VAPRLNRLMTNMMSSSTV

SEQ ID NO: 1492844 - protein, 18 aa, Mycobacterium tuberculosis
VAPRRAGGAVAEVYAEAR

SEQ ID NO: 1492845 - protein, 19 aa, Mycobacterium tuberculosis
VAPRRAGGAVAEVYAEARR

SEQ ID NO: 1492846 - protein, 18 aa, Mycobacterium tuberculosis
VAPSTLWSLTVDPDRPGS

SEQ ID NO: 1492847 - protein, 17 aa, Mycobacterium tuberculosis
VAPYLARTMPQLLSVEW

SEQ ID NO: 1492848 - protein, 24 aa, Mycobacterium tuberculosis
VAQGRLLVAAALGWTSEQIVERFG

SEQ ID NO: 1492849 - protein, 20 aa, Mycobacterium tuberculosis
VAQLAPWQQVLRNLGIDIGK

SEQ ID NO: 1492850 - protein, 18 aa, Mycobacterium tuberculosis
VAQLHVWARREHPTYEDI

SEQ ID NO: 1492851 - protein, 19 aa, Mycobacterium tuberculosis
VAQTRAAPHLAQITCPALV

SEQ ID NO: 1492852 - protein, 22 aa, Mycobacterium tuberculosis
VARAQVCAAWHIAELPAAAGRD

SEQ ID NO: 1492853 - protein, 18 aa, Mycobacterium tuberculosis
VARDRAQAIAGLRALAAG

SEQ ID NO: 1492854 - protein, 24 aa, Mycobacterium tuberculosis
VAREDSEFAVLRRQIAVGGQVLQL

SEQ ID NO: 1492855 - protein, 24 aa, Mycobacterium tuberculosis
VARENRLRTALAALDNFDFDYVFV

SEQ ID NO: 1492856 - protein, 18 aa, Mycobacterium tuberculosis
VARIDLGYEQLRVGVEYD

SEQ ID NO: 1492857 - protein, 20 aa, Mycobacterium tuberculosis
VARRLAGLFASYARQRPGLL

SEQ ID NO: 1492858 - protein, 19 aa, Mycobacterium tuberculosis
VARVIAYRWLRVGRLPVPA

SEQ ID NO: 1492859 - protein, 24 aa, Mycobacterium tuberculosis
VARVLTKPRFRGWIHVYSAGTAVF

SEQ ID NO: 1492860 - protein, 25 aa, Mycobacterium tuberculosis
VARYLFRRVVSWGRSSNVFLRNGAR

SEQ ID NO: 1492861 - protein, 29 aa, Mycobacterium tuberculosis
VASAARACGGWTVGVIPKMLVYRELADHD

SEQ ID NO: 1492862 - protein, 17 aa, Mycobacterium tuberculosis
VASDRGAGHLGFAGTAR

SEQ ID NO: 1492863 - protein, 18 aa, Mycobacterium tuberculosis
VASMPVGLGPDIVHVVPQ

SEQ ID NO: 1492864 - protein, 24 aa, Mycobacterium tuberculosis
VASRLIRLPMWVGLQEVDQSRVVE

SEQ ID NO: 1492865 - protein, 19 aa, Mycobacterium tuberculosis
VASRVGAPLGHDYAVISLS

SEQ ID NO: 1492866 - protein, 17 aa, Mycobacterium tuberculosis
VASTRSPTAICCSRLAS

SEQ ID NO: 1492867 - protein, 23 aa, Mycobacterium tuberculosis
VASVAFLPWPLRAVAGPFNLFAT

SEQ ID NO: 1492868 - protein, 17 aa, Mycobacterium tuberculosis
VATEPIEVWSFDVMSFV

SEQ ID NO: 1492869 - protein, 19 aa, Mycobacterium tuberculosis
VATRFCAFDSGGLADAVAA

SEQ ID NO: 1492870 - protein, 40 aa, Mycobacterium tuberculosis
VATRTRRRHRARGRPRRGRHLLPARRRPITSTNPIAASLQ

SEQ ID NO: 1492871 - protein, 18 aa, Mycobacterium tuberculosis
VAVATSMPKRGVGAAVLI

SEQ ID NO: 1492872 - protein, 23 aa, Mycobacterium tuberculosis
VAVDLRDDWPTALQKAGFDNAQR

SEQ ID NO: 1492873 - protein, 27 aa, Mycobacterium tuberculosis
VAVDLRDEWQIALCNNGFDANRPSAWD

SEQ ID NO: 1492874 - protein, 19 aa, Mycobacterium tuberculosis
VAVEGRGGGKADLAQGSGK

SEQ ID NO: 1492875 - protein, 20 aa, Mycobacterium tuberculosis
VAVEGRGGGKADLAQGSGKN

SEQ ID NO: 1492876 - protein, 37 aa, Mycobacterium tuberculosis
VAVGQRVVLVFLPRCGQCAACATDGRTPCEPGSAANK

SEQ ID NO: 1492877 - protein, 20 aa, Mycobacterium tuberculosis
VAVGVCWHAGRGSYPWLPTD

SEQ ID NO: 1492878 - protein, 25 aa, Mycobacterium tuberculosis
VAVLEGRLAAWAIELDAAAGRGVGA

SEQ ID NO: 1492879 - protein, 26 aa, Mycobacterium tuberculosis
VAVLEGRLAAWAIELDAAAGRGVSAE

SEQ ID NO: 1492880 - protein, 18 aa, Mycobacterium tuberculosis
VAVLQLRGAGGLPSAAIG

SEQ ID NO: 1492881 - protein, 21 aa, Mycobacterium tuberculosis
VAVMRRLAAGHGRVDVVDDQT

SEQ ID NO: 1492882 - protein, 18 aa, Mycobacterium tuberculosis
VAVNCALGSHPKGAVSAL

SEQ ID NO: 1492883 - protein, 18 aa, Mycobacterium tuberculosis
VAVPGGWRAPMLRLIRRY

SEQ ID NO: 1492884 - protein, 17 aa, Mycobacterium tuberculosis
VAVRPVLAVGSYLPHAP

SEQ ID NO: 1492885 - protein, 22 aa, Mycobacterium tuberculosis
VAVRRISMSLVNVAPQLVSTAA

SEQ ID NO: 1492886 - protein, 17 aa, Mycobacterium tuberculosis
VAVYSTFLHRAFDQLLF

SEQ ID NO: 1492887 - protein, 17 aa, Mycobacterium tuberculosis
VAYRASTMPAWNGSKSH

SEQ ID NO: 1492888 - protein, 20 aa, Mycobacterium tuberculosis
VAYRLGGPADHGGLRGGHHR

SEQ ID NO: 1492889 - protein, 27 aa, Mycobacterium tuberculosis
VAYRRSRGLAGLSVAWGLWEQASAMTR

SEQ ID NO: 1492890 - protein, 20 aa, Mycobacterium tuberculosis
VCDCGGLIRPDIVWFGEPLP

SEQ ID NO: 1492891 - protein, 24 aa, Mycobacterium tuberculosis
VCDRCAGCLSVFTVRATRCRDPRI

SEQ ID NO: 1492892 - protein, 17 aa, Mycobacterium tuberculosis
VCELMRIAWRTVGAIVA

SEQ ID NO: 1492893 - protein, 27 aa, Mycobacterium tuberculosis
VCEPWQPCGSAARFSRRPGHRPRRRRI

SEQ ID NO: 1492894 - protein, 20 aa, Mycobacterium tuberculosis
VCGHVGYPWTEEMVAVARKH

SEQ ID NO: 1492895 - protein, 17 aa, Mycobacterium tuberculosis
VCGSTGWVSSIVGVHNW

SEQ ID NO: 1492896 - protein, 17 aa, Mycobacterium tuberculosis
VCLAVPPNLIGFVETAG

SEQ ID NO: 1492897 - protein, 18 aa, Mycobacterium tuberculosis
VCLAVPPNLIGFVETAGL

SEQ ID NO: 1492898 - protein, 24 aa, Mycobacterium tuberculosis
VCTLDRPRHAQLIHDVRATGARIR

SEQ ID NO: 1492899 - protein, 21 aa, Mycobacterium tuberculosis
VCVHDPLIMRRALEYATGLGV

SEQ ID NO: 1492900 - protein, 22 aa, Mycobacterium tuberculosis
VCVHDPLIMRRALEYATGLGVL

SEQ ID NO: 1492901 - protein, 31 aa, Mycobacterium tuberculosis
VCVNAETGAVWWPECSKEAYADGIGGAVDAY

SEQ ID NO: 1492902 - protein, 31 aa, Mycobacterium tuberculosis
VCVNAETGTVWWPECSKEAYADGIAGAVDAY

SEQ ID NO: 1492903 - protein, 22 aa, Mycobacterium tuberculosis
VCVSHQLPVWTLRLYLTGKRLW

SEQ ID NO: 1492904 - protein, 23 aa, Mycobacterium tuberculosis
VCWPTPRPPMRIWPRRFDAPPGT

SEQ ID NO: 1492905 - protein, 19 aa, Mycobacterium tuberculosis
VCYLPLTYDHRLIDGADAG

SEQ ID NO: 1492906 - protein, 20 aa, Mycobacterium tuberculosis
VCYQFGNAKLVYALEGSIAV

SEQ ID NO: 1492907 - protein, 21 aa, Mycobacterium tuberculosis
VDAALHYLARILVAGEDPRFI

SEQ ID NO: 1492908 - protein, 18 aa, Mycobacterium tuberculosis
VDAELALRVRGWPSMTRG

SEQ ID NO: 1492909 - protein, 24 aa, Mycobacterium tuberculosis
VDAKPAQVALAWLISLPGVVAIPA

SEQ ID NO: 1492910 - protein, 25 aa, Mycobacterium tuberculosis
VDAKWASSISGYWRRGRTEEMFRKW

SEQ ID NO: 1492911 - protein, 27 aa, Mycobacterium tuberculosis
VDAKWASSISGYWRRGRTEEMFRKWKK

SEQ ID NO: 1492912 - protein, 26 aa, Mycobacterium tuberculosis
VDALCARFRISGLPVVDDDGALVGII

SEQ ID NO: 1492913 - protein, 22 aa, Mycobacterium tuberculosis
VDAPLPAWSHRVLFYDREGVDN

SEQ ID NO: 1492914 - protein, 25 aa, Mycobacterium tuberculosis
VDARLVVKLPNRWPLTDAAGVPVVF

SEQ ID NO: 1492915 - protein, 19 aa, Mycobacterium tuberculosis
VDAYARRILGWRVASTMAT

SEQ ID NO: 1492916 - protein, 22 aa, Mycobacterium tuberculosis
VDAYLSPVLRRYINQVADQMRG

SEQ ID NO: 1492917 - protein, 23 aa, Mycobacterium tuberculosis
VDDAARLTAVWIADWADDTVHLS

SEQ ID NO: 1492918 - protein, 26 aa, Mycobacterium tuberculosis
VDDVSARFRGALGLGGQGGNGGAGGL

SEQ ID NO: 1492919 - protein, 26 aa, Mycobacterium tuberculosis
VDDYLRVIGVPAMFAAGDVAAARMDD

SEQ ID NO: 1492920 - protein, 20 aa, Mycobacterium tuberculosis
VDELQEWPVVAGRPRRAGVS

SEQ ID NO: 1492921 - protein, 19 aa, Mycobacterium tuberculosis
VDEPLGAVARRLPLDCVIG

SEQ ID NO: 1492922 - protein, 17 aa, Mycobacterium tuberculosis
VDERVVAFVGRIQPLKA

SEQ ID NO: 1492923 - protein, 17 aa, Mycobacterium tuberculosis
VDEVWVGMVPEFDGKPL

SEQ ID NO: 1492924 - protein, 19 aa, Mycobacterium tuberculosis
VDFAKAFWNVVNWADVQSR

SEQ ID NO: 1492925 - protein, 20 aa, Mycobacterium tuberculosis
VDFPVTLGIRPNIPQEDLRD

SEQ ID NO: 1492926 - protein, 17 aa, Mycobacterium tuberculosis
VDGDCRGAQGVDVANHV

SEQ ID NO: 1492927 - protein, 23 aa, Mycobacterium tuberculosis
VDGETRIASAALTTVAADAAGPA

SEQ ID NO: 1492928 - protein, 18 aa, Mycobacterium tuberculosis
VDGGCVVRASVVRPKTPR

SEQ ID NO: 1492929 - protein, 17 aa, Mycobacterium tuberculosis
VDGGLIFCSSQRRDRPR

SEQ ID NO: 1492930 - protein, 19 aa, Mycobacterium tuberculosis
VDGLPVFGAFWDREAELPT

SEQ ID NO: 1492931 - protein, 18 aa, Mycobacterium tuberculosis
VDGQKRLKNARVLVIGAG

SEQ ID NO: 1492932 - protein, 19 aa, Mycobacterium tuberculosis
VDIARVPDCAVVGAAAGGV

SEQ ID NO: 1492933 - protein, 20 aa, Mycobacterium tuberculosis
VDISGIWPVRTVHDAISEAL

SEQ ID NO: 1492934 - protein, 17 aa, Mycobacterium tuberculosis
VDKDGTAFLRVLNRDRN

SEQ ID NO: 1492935 - protein, 26 aa, Mycobacterium tuberculosis
VDKLKDAGFYWATRSGVTVSMADVLV

SEQ ID NO: 1492936 - protein, 17 aa, Mycobacterium tuberculosis
VDLAALVRAAAAHVLPD

SEQ ID NO: 1492937 - protein, 22 aa, Mycobacterium tuberculosis
VDLCTRVGVATRFCAFDSGGLA

SEQ ID NO: 1492938 - protein, 17 aa, Mycobacterium tuberculosis
VDLLPGLLSQALDELLE

SEQ ID NO: 1492939 - protein, 19 aa, Mycobacterium tuberculosis
VDLRDDWPQALRDSGFDAT

SEQ ID NO: 1492940 - protein, 24 aa, Mycobacterium tuberculosis
VDLRYLGSLTHGFLNLFQLGGGSA

SEQ ID NO: 1492941 - protein, 17 aa, Mycobacterium tuberculosis
VDLSGFPNAPMRAVPMW

SEQ ID NO: 1492942 - protein, 25 aa, Mycobacterium tuberculosis
VDNKLGYGLVDPVAALTFNIPSGDR

SEQ ID NO: 1492943 - protein, 27 aa, Mycobacterium tuberculosis
VDPAHPFPFVSGLSLNLAVTVRQPEDG

SEQ ID NO: 1492944 - protein, 17 aa, Mycobacterium tuberculosis
VDPGGAWAGNGGTGGAG

SEQ ID NO: 1492945 - protein, 21 aa, Mycobacterium tuberculosis
VDPLILRQAYPVRQAPYGLAG

SEQ ID NO: 1492946 - protein, 20 aa, Mycobacterium tuberculosis
VDPQVPLPGFVLKRAIKGTI

SEQ ID NO: 1492947 - protein, 22 aa, Mycobacterium tuberculosis
VDPTRRCVRCGSDVVRAVVVGA

SEQ ID NO: 1492948 - protein, 24 aa, Mycobacterium tuberculosis
VDQWLRFLTSWRKDRIATVENLRE

SEQ ID NO: 1492949 - protein, 20 aa, Mycobacterium tuberculosis
VDRTAGRRTLIPLAGDPVSS

SEQ ID NO: 1492950 - protein, 24 aa, Mycobacterium tuberculosis
VDRTLRVAWSLADLAGRTSPGIDE

SEQ ID NO: 1492951 - protein, 20 aa, Mycobacterium tuberculosis
VDRVKDMIVTGGFNVFPREV

SEQ ID NO: 1492952 - protein, 17 aa, Mycobacterium tuberculosis
VDSLDFQDGIAFVHAED

SEQ ID NO: 1492953 - protein, 18 aa, Mycobacterium tuberculosis
VDTGAFITGSYSNGFLVS

SEQ ID NO: 1492954 - protein, 17 aa, Mycobacterium tuberculosis
VDTVVRIRSFVRQLQPR

SEQ ID NO: 1492955 - protein, 18 aa, Mycobacterium tuberculosis
VDVAEAIAYFASPASNAV

SEQ ID NO: 1492956 - protein, 18 aa, Mycobacterium tuberculosis
VDVLRRLLDHAATTPGRA

SEQ ID NO: 1492957 - protein, 17 aa, Mycobacterium tuberculosis
VDVPRLVSFHDLTIEDP

SEQ ID NO: 1492958 - protein, 19 aa, Mycobacterium tuberculosis
VDVSGFFNTASGGTVINGQ

SEQ ID NO: 1492959 - protein, 32 aa, Mycobacterium tuberculosis
VDVTLRPAQYLPWHPCRCAQVFVGESSVGHAG

SEQ ID NO: 1492960 - protein, 25 aa, Mycobacterium tuberculosis
VDVVLRSKVDAAWHLHELTRDLDVS

SEQ ID NO: 1492961 - protein, 17 aa, Mycobacterium tuberculosis
VDWWLTFSSAAALLGTP

SEQ ID NO: 1492962 - protein, 17 aa, Mycobacterium tuberculosis
VDYAKTRTLWGRNIGQF

SEQ ID NO: 1492963 - protein, 25 aa, Mycobacterium tuberculosis
VEAPTGWRSTATSGHMTWITTVLTR

SEQ ID NO: 1492964 - protein, 26 aa, Mycobacterium tuberculosis
VEAPVARRLRESFGGSKPAPAKGTAK

SEQ ID NO: 1492965 - protein, 17 aa, Mycobacterium tuberculosis
VEDAGWRDFCLRVADRI

SEQ ID NO: 1492966 - protein, 18 aa, Mycobacterium tuberculosis
VEDAGWRDFCLRVADRIV

SEQ ID NO: 1492967 - protein, 23 aa, Mycobacterium tuberculosis
VEEPPEHLIFIFATPNRRRYCRR

SEQ ID NO: 1492968 - protein, 18 aa, Mycobacterium tuberculosis
VEGDARRARGVSAAGAVT

SEQ ID NO: 1492969 - protein, 21 aa, Mycobacterium tuberculosis
VEGVERWGRHTTCPGGGDPTD

SEQ ID NO: 1492970 - protein, 18 aa, Mycobacterium tuberculosis
VEHFILEDWWGRWLGRWT

SEQ ID NO: 1492971 - protein, 17 aa, Mycobacterium tuberculosis
VEIAPGITIPIGPPTTI

SEQ ID NO: 1492972 - protein, 17 aa, Mycobacterium tuberculosis
VEIDGRPVSAFGCDGVL

SEQ ID NO: 1492973 - protein, 18 aa, Mycobacterium tuberculosis
VEIGDGFQTARRRGSRAH

SEQ ID NO: 1492974 - protein, 18 aa, Mycobacterium tuberculosis
VEILKWAKDQGISITAEV

SEQ ID NO: 1492975 - protein, 22 aa, Mycobacterium tuberculosis
VEINEAFAPVVMAWLKEIKADP

SEQ ID NO: 1492976 - protein, 22 aa, Mycobacterium tuberculosis
VEKEAFALLALQHPVAGELREI

SEQ ID NO: 1492977 - protein, 17 aa, Mycobacterium tuberculosis
VELANALYMSGSVPGVI

SEQ ID NO: 1492978 - protein, 20 aa, Mycobacterium tuberculosis
VELLRQAWLTATRARNALVL

SEQ ID NO: 1492979 - protein, 31 aa, Mycobacterium tuberculosis
VELLRQAWLTATRARNALVLVRGKPTDQLPG

SEQ ID NO: 1492980 - protein, 18 aa, Mycobacterium tuberculosis
VELLSYFEVFTKTTISAE

SEQ ID NO: 1492981 - protein, 25 aa, Mycobacterium tuberculosis
VELPLCALLTAWVRGQARPEARAQV

SEQ ID NO: 1492982 - protein, 21 aa, Mycobacterium tuberculosis
VELPLSVTIGPFVSPEITIPQ

SEQ ID NO: 1492983 - protein, 21 aa, Mycobacterium tuberculosis
VELRNRLKTATGLTLSPTLIF

SEQ ID NO: 1492984 - protein, 17 aa, Mycobacterium tuberculosis
VELRRPGGPGVIMGRNV

SEQ ID NO: 1492985 - protein, 22 aa, Mycobacterium tuberculosis
VELSKLYLLPGYHGTGAAAALM

SEQ ID NO: 1492986 - protein, 20 aa, Mycobacterium tuberculosis
VEMRNRLKSATGLSLSPTLI

SEQ ID NO: 1492987 - protein, 17 aa, Mycobacterium tuberculosis
VENFLRLTFGFPAEPYQ

SEQ ID NO: 1492988 - protein, 19 aa, Mycobacterium tuberculosis
VENNFPLVNLLVNRGPTVP

SEQ ID NO: 1492989 - protein, 33 aa, Mycobacterium tuberculosis
VEPEAMASTMLLFFCQFSDGYGTAGRDYEISSY

SEQ ID NO: 1492990 - protein, 24 aa, Mycobacterium tuberculosis
VEPGGLRAAAYVNPSRPSSSPPAP

SEQ ID NO: 1492991 - protein, 19 aa, Mycobacterium tuberculosis
VEPGHAFYMIGVNDHVANT

SEQ ID NO: 1492992 - protein, 26 aa, Mycobacterium tuberculosis
VEPLRPGPPPTVWSRRWRQPWAPPTS

SEQ ID NO: 1492993 - protein, 18 aa, Mycobacterium tuberculosis
VEPRARWERLYHLVNHVL

SEQ ID NO: 1492994 - protein, 22 aa, Mycobacterium tuberculosis
VEPRLWNMSTVLPILQDTTIVA

SEQ ID NO: 1492995 - protein, 29 aa, Mycobacterium tuberculosis
VEQMLADCGLEWVAVRCALIFGRNVDNWV

SEQ ID NO: 1492996 - protein, 22 aa, Mycobacterium tuberculosis
VEQNLLNLINAPTQTLLGRPLI

SEQ ID NO: 1492997 - protein, 22 aa, Mycobacterium tuberculosis
VERLEGWAITKARGDDVTVVFE

SEQ ID NO: 1492998 - protein, 23 aa, Mycobacterium tuberculosis
VERLEPRLSPASRHITEAKAFGT

SEQ ID NO: 1492999 - protein, 24 aa, Mycobacterium tuberculosis
VERLEPRLSPASRHITVNRPGESG

SEQ ID NO: 1493000 - protein, 17 aa, Mycobacterium tuberculosis
VERLLGLGLTKGHGAAD

SEQ ID NO: 1493001 - protein, 22 aa, Mycobacterium tuberculosis
VERLRCRIEDGMHRAGRAERRD

SEQ ID NO: 1493002 - protein, 17 aa, Mycobacterium tuberculosis
VERPVKWPISACCLGVV

SEQ ID NO: 1493003 - protein, 24 aa, Mycobacterium tuberculosis
VERRYRAWIRWNAAIMVHRAQRPG

SEQ ID NO: 1493004 - protein, 19 aa, Mycobacterium tuberculosis
VESLPLIASSIMSKKLAEG

SEQ ID NO: 1493005 - protein, 19 aa, Mycobacterium tuberculosis
VEVEARLAVRTAGGTRQRG

SEQ ID NO: 1493006 - protein, 22 aa, Mycobacterium tuberculosis
VEVLARGTAWLDTGTFDSLLDA

SEQ ID NO: 1493007 - protein, 27 aa, Mycobacterium tuberculosis
VEVSEFFVKIRTCWQKELEVPVVAISQ

SEQ ID NO: 1493008 - protein, 18 aa, Mycobacterium tuberculosis
VFARMWELYLAYSEAGFR

SEQ ID NO: 1493009 - protein, 18 aa, Mycobacterium tuberculosis
VFEGGLWSGGAANAANGA

SEQ ID NO: 1493010 - protein, 22 aa, Mycobacterium tuberculosis
VFEIDVPKVLEFKAQVLSERGA

SEQ ID NO: 1493011 - protein, 19 aa, Mycobacterium tuberculosis
VFERIWLRTTLLGAELQPF

SEQ ID NO: 1493012 - protein, 18 aa, Mycobacterium tuberculosis
VFGDGWIGAQACMWVNKF

SEQ ID NO: 1493013 - protein, 18 aa, Mycobacterium tuberculosis
VFGGPAWTRVREPDGNPG

SEQ ID NO: 1493014 - protein, 19 aa, Mycobacterium tuberculosis
VFGLGRLTGSWVGHHGYQF

SEQ ID NO: 1493015 - protein, 41 aa, Mycobacterium tuberculosis
VFGNGGDGGCRRVWRRYRRQRWCRRQRRADRQRRQRRQRRQ

SEQ ID NO: 1493016 - protein, 31 aa, Mycobacterium tuberculosis
VFGPVRRVLCRLRLLLGPPRGPPRHRTTVRG

SEQ ID NO: 1493017 - protein, 26 aa, Mycobacterium tuberculosis
VFGRRVAVVACEFDFLGGSIGVAAAE

SEQ ID NO: 1493018 - protein, 18 aa, Mycobacterium tuberculosis
VFLKSLIGLLRPERGSII

SEQ ID NO: 1493019 - protein, 17 aa, Mycobacterium tuberculosis
VFNGFLPAVARMRALDP

SEQ ID NO: 1493020 - protein, 19 aa, Mycobacterium tuberculosis
VFPCPEFQPPVLKLPEFPM

SEQ ID NO: 1493021 - protein, 22 aa, Mycobacterium tuberculosis
VFPNLFATHRVRAVDDYASHLL

SEQ ID NO: 1493022 - protein, 19 aa, Mycobacterium tuberculosis
VFPVKRLADLGFRVLATEG

SEQ ID NO: 1493023 - protein, 18 aa, Mycobacterium tuberculosis
VFRECRPENVIAIDAVPS

SEQ ID NO: 1493024 - protein, 19 aa, Mycobacterium tuberculosis
VFRPLWAHDRTAERQALTD

SEQ ID NO: 1493025 - protein, 17 aa, Mycobacterium tuberculosis
VFRTDRRTAVRVGESLA

SEQ ID NO: 1493026 - protein, 18 aa, Mycobacterium tuberculosis
VFTAEAWGSDAYTPLAWW

SEQ ID NO: 1493027 - protein, 19 aa, Mycobacterium tuberculosis
VFVCPSVYEPLGIVNLEAM

SEQ ID NO: 1493028 - protein, 24 aa, Mycobacterium tuberculosis
VFVVGDLMFVPGVPGVAQGAIQGP

SEQ ID NO: 1493029 - protein, 22 aa, Mycobacterium tuberculosis
VFYLHSRLLERCAKLSDDLGGG

SEQ ID NO: 1493030 - protein, 17 aa, Mycobacterium tuberculosis
VGAALGRVRGSSSHTPW

SEQ ID NO: 1493031 - protein, 17 aa, Mycobacterium tuberculosis
VGACPPLPPSPAAAAAA

SEQ ID NO: 1493032 - protein, 19 aa, Mycobacterium tuberculosis
VGAGIPAVTFWAAVPHYVS

SEQ ID NO: 1493033 - protein, 18 aa, Mycobacterium tuberculosis
VGAIATFAAVAAADRPVV

SEQ ID NO: 1493034 - protein, 17 aa, Mycobacterium tuberculosis
VGAKGKAALLRELSDVV

SEQ ID NO: 1493035 - protein, 18 aa, Mycobacterium tuberculosis
VGALLALAALIHRDRTGG

SEQ ID NO: 1493036 - protein, 17 aa, Mycobacterium tuberculosis
VGANWQASGGWTDGAHR

SEQ ID NO: 1493037 - protein, 24 aa, Mycobacterium tuberculosis
VGAPAAPRRPAVLRCPAGQGPVQP

SEQ ID NO: 1493038 - protein, 18 aa, Mycobacterium tuberculosis
VGAPGQPGGAGGHGGAGG

SEQ ID NO: 1493039 - protein, 17 aa, Mycobacterium tuberculosis
VGAPLGHDYAVISLSDR

SEQ ID NO: 1493040 - protein, 32 aa, Mycobacterium tuberculosis
VGAQPSIRCSPGWPGWRPSGGGPQAAGVIPAH

SEQ ID NO: 1493041 - protein, 25 aa, Mycobacterium tuberculosis
VGARQRLMCRLPKRPDPHAWLGDAF

SEQ ID NO: 1493042 - protein, 18 aa, Mycobacterium tuberculosis
VGARRRGARLGIGTRHRH

SEQ ID NO: 1493043 - protein, 17 aa, Mycobacterium tuberculosis
VGAVVGRYAAGGYEVDF

SEQ ID NO: 1493044 - protein, 19 aa, Mycobacterium tuberculosis
VGCGPGPFTGLRAGMASAA

SEQ ID NO: 1493045 - protein, 21 aa, Mycobacterium tuberculosis
VGCRRGHGPAARRRWRGGSGG

SEQ ID NO: 1493046 - protein, 20 aa, Mycobacterium tuberculosis
VGDAFPLSSLTQIYASDGES

SEQ ID NO: 1493047 - protein, 25 aa, Mycobacterium tuberculosis
VGDKWRLAEVLAWQAYVGFAGEGDP

SEQ ID NO: 1493048 - protein, 20 aa, Mycobacterium tuberculosis
VGDLGVTLLRTIKATLDPAG

SEQ ID NO: 1493049 - protein, 19 aa, Mycobacterium tuberculosis
VGDLGVTLLRTIKATLDPG

SEQ ID NO: 1493050 - protein, 17 aa, Mycobacterium tuberculosis
VGDLNWGAANIGAQNLG

SEQ ID NO: 1493051 - protein, 17 aa, Mycobacterium tuberculosis
VGDPGLVVAVWDRRLHT

SEQ ID NO: 1493052 - protein, 22 aa, Mycobacterium tuberculosis
VGDPGLVVAVWDRRLHTGAHAA

SEQ ID NO: 1493053 - protein, 23 aa, Mycobacterium tuberculosis
VGDPIQSIYGWRGASATNLPRFT

SEQ ID NO: 1493054 - protein, 24 aa, Mycobacterium tuberculosis
VGEAWRYLKELRLERGPLSTEEAT

SEQ ID NO: 1493055 - protein, 18 aa, Mycobacterium tuberculosis
VGEIAAYAIAGVIAADDA

SEQ ID NO: 1493056 - protein, 27 aa, Mycobacterium tuberculosis
VGELGRSAAGYALWCNGIEDFAELRRR

SEQ ID NO: 1493057 - protein, 20 aa, Mycobacterium tuberculosis
VGFHPRKALARVDEAARTMH

SEQ ID NO: 1493058 - protein, 23 aa, Mycobacterium tuberculosis
VGFHPRKALARVDEAARTMHFGD

SEQ ID NO: 1493059 - protein, 22 aa, Mycobacterium tuberculosis
VGGAGCSGGTALLSSAAVGPVG

SEQ ID NO: 1493060 - protein, 25 aa, Mycobacterium tuberculosis
VGGAGGAGWLVGNGGAGGFGGVGTT

SEQ ID NO: 1493061 - protein, 31 aa, Mycobacterium tuberculosis
VGGAGGFGGSGGRGGLLLGTGGAGGDGGDGG

SEQ ID NO: 1493062 - protein, 32 aa, Mycobacterium tuberculosis
VGGAGGFGGSGGRGGLLLGTGGAGGDGGDGGN

SEQ ID NO: 1493063 - protein, 31 aa, Mycobacterium tuberculosis
VGGAGGFGGSGGRGGLLLGTGGAGGDGGVGG

SEQ ID NO: 1493064 - protein, 24 aa, Mycobacterium tuberculosis
VGGAGGKAGLLIGNGGAGGAGGQG

SEQ ID NO: 1493065 - protein, 25 aa, Mycobacterium tuberculosis
VGGAGGQGGLLFGDGGNGGAGGAGG

SEQ ID NO: 1493066 - protein, 21 aa, Mycobacterium tuberculosis
VGGATHWAWEKVFTKANMLES

SEQ ID NO: 1493067 - protein, 38 aa, Mycobacterium tuberculosis
VGGATWCAGPACGRGDAVGACPCGRIRRVGDAGCGVRC

SEQ ID NO: 1493068 - protein, 25 aa, Mycobacterium tuberculosis
VGGDGGRGGLLAGNGGTGGAGGNGG

SEQ ID NO: 1493069 - protein, 21 aa, Mycobacterium tuberculosis
VGGDSGLFGMHGQTYQALSAR

SEQ ID NO: 1493070 - protein, 22 aa, Mycobacterium tuberculosis
VGGECSYWACVPSKALLRPVIA

SEQ ID NO: 1493071 - protein, 18 aa, Mycobacterium tuberculosis
VGGELAVIGDAKDAGEAA

SEQ ID NO: 1493072 - protein, 20 aa, Mycobacterium tuberculosis
VGGFGHLLILGFDYSDNPGP

SEQ ID NO: 1493073 - protein, 20 aa, Mycobacterium tuberculosis
VGGGRWRPRKGWGWVARISG

SEQ ID NO: 1493074 - protein, 17 aa, Mycobacterium tuberculosis
VGGHGGTAILFGDGGAG

SEQ ID NO: 1493075 - protein, 22 aa, Mycobacterium tuberculosis
VGGLRGGFEYARTGNPTRAALE

SEQ ID NO: 1493076 - protein, 20 aa, Mycobacterium tuberculosis
VGGLSGARPLVAWLDALATG

SEQ ID NO: 1493077 - protein, 23 aa, Mycobacterium tuberculosis
VGGLTLGGGVGWTTPTFRTELRQ

SEQ ID NO: 1493078 - protein, 26 aa, Mycobacterium tuberculosis
VGGMGGLGFVVARWLAEQGAGLIVLN

SEQ ID NO: 1493079 - protein, 24 aa, Mycobacterium tuberculosis
VGGMSPNGCWATFVTCDARLATRL

SEQ ID NO: 1493080 - protein, 24 aa, Mycobacterium tuberculosis
VGGNGGAGGLLFGDGGNGGAGGAG

SEQ ID NO: 1493081 - protein, 20 aa, Mycobacterium tuberculosis
VGGNTSGLWNLASAASGVSG

SEQ ID NO: 1493082 - protein, 20 aa, Mycobacterium tuberculosis
VGGPPLVFQLLWYPTTMADL

SEQ ID NO: 1493083 - protein, 21 aa, Mycobacterium tuberculosis
VGGPPLVFQLLWYPTTMADLS

SEQ ID NO: 1493084 - protein, 26 aa, Mycobacterium tuberculosis
VGGPRRGWRGPPPKTGGIGGAGGLGV

SEQ ID NO: 1493085 - protein, 19 aa, Mycobacterium tuberculosis
VGGPVFERGLRVVAATRGD

SEQ ID NO: 1493086 - protein, 25 aa, Mycobacterium tuberculosis
VGGRRAGAGLDHWVDPLGGRPATRL

SEQ ID NO: 1493087 - protein, 26 aa, Mycobacterium tuberculosis
VGGRRAGAGLDHWVDPLGGRPATRLV

SEQ ID NO: 1493088 - protein, 21 aa, Mycobacterium tuberculosis
VGGRRWCRRTETMSGPDGARP

SEQ ID NO: 1493089 - protein, 25 aa, Mycobacterium tuberculosis
VGGTRIALSRGLRPDRFVAEVRQYG

SEQ ID NO: 1493090 - protein, 22 aa, Mycobacterium tuberculosis
VGGTRWVVYEGSDENGAVEPVW

SEQ ID NO: 1493091 - protein, 19 aa, Mycobacterium tuberculosis
VGGTWHWNTYPGIAVDIPS

SEQ ID NO: 1493092 - protein, 29 aa, Mycobacterium tuberculosis
VGGVGPGPPGLWGHWGGRAGRAAAPSGAL

SEQ ID NO: 1493093 - protein, 17 aa, Mycobacterium tuberculosis
VGHPKPRRLVRHAHWPD

SEQ ID NO: 1493094 - protein, 18 aa, Mycobacterium tuberculosis
VGHPKPRRLVRHAHWPDW

SEQ ID NO: 1493095 - protein, 19 aa, Mycobacterium tuberculosis
VGIAEAYVLNAFRRAGVPM

SEQ ID NO: 1493096 - protein, 20 aa, Mycobacterium tuberculosis
VGIAEAYVLNAFRRAGVPMQ

SEQ ID NO: 1493097 - protein, 17 aa, Mycobacterium tuberculosis
VGIGCRFPGNVTGPESF

SEQ ID NO: 1493098 - protein, 20 aa, Mycobacterium tuberculosis
VGITPAGSWVLTDANPDALT

SEQ ID NO: 1493099 - protein, 25 aa, Mycobacterium tuberculosis
VGLAAWRLGAGRSRPGARVQHGAGV

SEQ ID NO: 1493100 - protein, 17 aa, Mycobacterium tuberculosis
VGLRIVIEIKRDAVAKV

SEQ ID NO: 1493101 - protein, 27 aa, Mycobacterium tuberculosis
VGLVGMSVDCARYWLDADKPISKSDAV

SEQ ID NO: 1493102 - protein, 26 aa, Mycobacterium tuberculosis
VGLYCRNRIEIVIAMLGIVKAGAILV

SEQ ID NO: 1493103 - protein, 18 aa, Mycobacterium tuberculosis
VGPDHCRRGHRVVRRRLA

SEQ ID NO: 1493104 - protein, 17 aa, Mycobacterium tuberculosis
VGPGGWFVGQRRPTADR

SEQ ID NO: 1493105 - protein, 23 aa, Mycobacterium tuberculosis
VGPPEPPAPPFADQQRAVASVPA

SEQ ID NO: 1493106 - protein, 24 aa, Mycobacterium tuberculosis
VGQAGGKGWDGGPIGNGQVGEQHG

SEQ ID NO: 1493107 - protein, 17 aa, Mycobacterium tuberculosis
VGQCGQLQHRVRKCRGR

SEQ ID NO: 1493108 - protein, 49 aa, Mycobacterium tuberculosis
VGQHRPWQPGVCQLGPDRRRGGGGQCWFWQCRHQQLWLGEHGCGQYWVC

SEQ ID NO: 1493109 - protein, 20 aa, Mycobacterium tuberculosis
VGQRVVLVFLPRCGQCAACA

SEQ ID NO: 1493110 - protein, 29 aa, Mycobacterium tuberculosis
VGQTLFLFDFRDGIELNPIVIPGSSIPIT

SEQ ID NO: 1493111 - protein, 22 aa, Mycobacterium tuberculosis
VGRAGFDRCGEFGPIPSSRWKL

SEQ ID NO: 1493112 - protein, 25 aa, Mycobacterium tuberculosis
VGRKRPIVRILRRVHHRKYLTDGRP

SEQ ID NO: 1493113 - protein, 25 aa, Mycobacterium tuberculosis
VGRLSEWRATLIVRESACLDVEDRR

SEQ ID NO: 1493114 - protein, 19 aa, Mycobacterium tuberculosis
VGRMKDLIIQDGVNHYPDD

SEQ ID NO: 1493115 - protein, 35 aa, Mycobacterium tuberculosis
VGRNRCRGLARHAFHPEPHRFSARCARARTANDGR

SEQ ID NO: 1493116 - protein, 32 aa, Mycobacterium tuberculosis
VGRQWRPQPQFGRPWLQVVAFHVGDLRRNAQA

SEQ ID NO: 1493117 - protein, 18 aa, Mycobacterium tuberculosis
VGRRARAARLLRFGDGTP

SEQ ID NO: 1493118 - protein, 22 aa, Mycobacterium tuberculosis
VGRYSPFAVYLPRGDPGRLAPV

SEQ ID NO: 1493119 - protein, 25 aa, Mycobacterium tuberculosis
VGSFRVRVATSWPRRLHSKPTAAQG

SEQ ID NO: 1493120 - protein, 21 aa, Mycobacterium tuberculosis
VGSGGSGFWNIAGNLGNSGFL

SEQ ID NO: 1493121 - protein, 18 aa, Mycobacterium tuberculosis
VGSHGVGGVGGDGGLGGA

SEQ ID NO: 1493122 - protein, 18 aa, Mycobacterium tuberculosis
VGSMFGPYHLKRLLGRGG

SEQ ID NO: 1493123 - protein, 25 aa, Mycobacterium tuberculosis
VGSMFGPYHLKRLLGRGGMGEVYEA

SEQ ID NO: 1493124 - protein, 25 aa, Mycobacterium tuberculosis
VGSRGGDGGVGGWLYGDGGGGDGGN

SEQ ID NO: 1493125 - protein, 26 aa, Mycobacterium tuberculosis
VGSRGGDGGVGGWLYGDGGGGGDGGN

SEQ ID NO: 1493126 - protein, 29 aa, Mycobacterium tuberculosis
VGSTQPVLLDWAVGLAFPCQQPMLHANGI

SEQ ID NO: 1493127 - protein, 27 aa, Mycobacterium tuberculosis
VGSWSFVWRDVLLRLANDFRCVAIDAP

SEQ ID NO: 1493128 - protein, 18 aa, Mycobacterium tuberculosis
VGTALGVALQRADHVVVA

SEQ ID NO: 1493129 - protein, 23 aa, Mycobacterium tuberculosis
VGTPSWLSICLPRCGSPRVWWAT

SEQ ID NO: 1493130 - protein, 23 aa, Mycobacterium tuberculosis
VGVCTNTLCAVMGGDAIFDRLKE

SEQ ID NO: 1493131 - protein, 19 aa, Mycobacterium tuberculosis
VGWPSRLSGVRLHLVTGKG

SEQ ID NO: 1493132 - protein, 29 aa, Mycobacterium tuberculosis
VGYELARDALREWLRRGGKPARLIEIATR

SEQ ID NO: 1493133 - protein, 24 aa, Mycobacterium tuberculosis
VGYPDRVRAGLLLAVGARATADQI

SEQ ID NO: 1493134 - protein, 19 aa, Mycobacterium tuberculosis
VGYPREWRRRKPYSWLRQV

SEQ ID NO: 1493135 - protein, 33 aa, Mycobacterium tuberculosis
VHAATLLPFIGRLLAALAAPAPRSARTGFRAPR

SEQ ID NO: 1493136 - protein, 23 aa, Mycobacterium tuberculosis
VHAATLLPFIGRLLAARYAELNT

SEQ ID NO: 1493137 - protein, 27 aa, Mycobacterium tuberculosis
VHACQHPRPGIANVWPIRQDLADLLVG

SEQ ID NO: 1493138 - protein, 19 aa, Mycobacterium tuberculosis
VHAYPRTASVVIWYSPELG

SEQ ID NO: 1493139 - protein, 21 aa, Mycobacterium tuberculosis
VHFGLPGLNGSGGDGGDGGNG

SEQ ID NO: 1493140 - protein, 21 aa, Mycobacterium tuberculosis
VHGFSTLWLDDAVNTDVKQTS

SEQ ID NO: 1493141 - protein, 18 aa, Mycobacterium tuberculosis
VHGLWRGGIGTTWEARIK

SEQ ID NO: 1493142 - protein, 22 aa, Mycobacterium tuberculosis
VHHCHREQWPVAGRMMGRLGWY

SEQ ID NO: 1493143 - protein, 17 aa, Mycobacterium tuberculosis
VHHLPVFERFAADPPAP

SEQ ID NO: 1493144 - protein, 24 aa, Mycobacterium tuberculosis
VHILIDLPAVPGFGNTTGAPVVGF

SEQ ID NO: 1493145 - protein, 17 aa, Mycobacterium tuberculosis
VHLARGHAVNWVLVTDD

SEQ ID NO: 1493146 - protein, 17 aa, Mycobacterium tuberculosis
VHMFGGINLSFGLMGPL

SEQ ID NO: 1493147 - protein, 20 aa, Mycobacterium tuberculosis
VHNFYFWPDPRASLCDIARA

SEQ ID NO: 1493148 - protein, 17 aa, Mycobacterium tuberculosis
VHPEAARALHEHASVQA

SEQ ID NO: 1493149 - protein, 17 aa, Mycobacterium tuberculosis
VHQAGSPFVIWATTSSS

SEQ ID NO: 1493150 - protein, 22 aa, Mycobacterium tuberculosis
VHRGQARIAYRLAERYQDKLLH

SEQ ID NO: 1493151 - protein, 17 aa, Mycobacterium tuberculosis
VHRQLRVTIGSIVKIGA

SEQ ID NO: 1493152 - protein, 18 aa, Mycobacterium tuberculosis
VHRQLRVTIGSIVKIGAG

SEQ ID NO: 1493153 - protein, 17 aa, Mycobacterium tuberculosis
VHSALLSAGPGPGSLQA

SEQ ID NO: 1493154 - protein, 22 aa, Mycobacterium tuberculosis
VHSAVTAPVWGMRHGQHRVVQR

SEQ ID NO: 1493155 - protein, 23 aa, Mycobacterium tuberculosis
VHSEAPPFFVLHGEKDPMVPSAQ

SEQ ID NO: 1493156 - protein, 23 aa, Mycobacterium tuberculosis
VHSRRLWSLLPHRCSSSMRYTAA

SEQ ID NO: 1493157 - protein, 19 aa, Mycobacterium tuberculosis
VHTEFRKLVSRGFTPRQVE

SEQ ID NO: 1493158 - protein, 18 aa, Mycobacterium tuberculosis
VHVCHTIADVVDRAKAER

SEQ ID NO: 1493159 - protein, 25 aa, Mycobacterium tuberculosis
VHWVAPPEAVWACRSLAATHYASGG

SEQ ID NO: 1493160 - protein, 24 aa, Mycobacterium tuberculosis
VHYPERLGALVLTSCDAFEHFPPP

SEQ ID NO: 1493161 - protein, 17 aa, Mycobacterium tuberculosis
VHYPWLPLRRLLLDHYP

SEQ ID NO: 1493162 - protein, 17 aa, Mycobacterium tuberculosis
VIAGALGNWLMSRGEAV

SEQ ID NO: 1493163 - protein, 17 aa, Mycobacterium tuberculosis
VIAPRFSLFDVYTDIAF

SEQ ID NO: 1493164 - protein, 23 aa, Mycobacterium tuberculosis
VIAVYRLRASRGREGPRPARGDP

SEQ ID NO: 1493165 - protein, 20 aa, Mycobacterium tuberculosis
VICRHCPVMQECAADALDNK

SEQ ID NO: 1493166 - protein, 22 aa, Mycobacterium tuberculosis
VIDEFYEWFRIMPTAVDVLDSI

SEQ ID NO: 1493167 - protein, 20 aa, Mycobacterium tuberculosis
VIDEYRLVYRADSLVNWCPG

SEQ ID NO: 1493168 - protein, 31 aa, Mycobacterium tuberculosis
VIDEYRLVYRADSLVNWCPGLGTVLANEEVT

SEQ ID NO: 1493169 - protein, 18 aa, Mycobacterium tuberculosis
VIDLGPMQPAELGRPPID

SEQ ID NO: 1493170 - protein, 19 aa, Mycobacterium tuberculosis
VIDPLDWVEMFGADALRFT

SEQ ID NO: 1493171 - protein, 25 aa, Mycobacterium tuberculosis
VIEVIPDVLRHRLVLTYDALADEIS

SEQ ID NO: 1493172 - protein, 18 aa, Mycobacterium tuberculosis
VIGGNAGVLGNGGTGGNG

SEQ ID NO: 1493173 - protein, 26 aa, Mycobacterium tuberculosis
VIGGSMGRYGGVWAHDETRKSFSIAG

SEQ ID NO: 1493174 - protein, 18 aa, Mycobacterium tuberculosis
VIISDFLGPINWMRPLRA

SEQ ID NO: 1493175 - protein, 17 aa, Mycobacterium tuberculosis
VILHSPYGLRVHGPLAL

SEQ ID NO: 1493176 - protein, 26 aa, Mycobacterium tuberculosis
VILPTRRRARDLGHTTALFRAQTLQC

SEQ ID NO: 1493177 - protein, 18 aa, Mycobacterium tuberculosis
VINAPALALLGRLLIGNG

SEQ ID NO: 1493178 - protein, 18 aa, Mycobacterium tuberculosis
VINAPALALLGRPLIGNG

SEQ ID NO: 1493179 - protein, 18 aa, Mycobacterium tuberculosis
VIPDLAIREALENLWSAS

SEQ ID NO: 1493180 - protein, 21 aa, Mycobacterium tuberculosis
VIPGLLCWVGEYAGQVREEYC

SEQ ID NO: 1493181 - protein, 30 aa, Mycobacterium tuberculosis
VIQTEFNVALPWRKEVSLSKSSLHPASVTI

SEQ ID NO: 1493182 - protein, 22 aa, Mycobacterium tuberculosis
VIRALPVTGRRVMLVPTMGALA

SEQ ID NO: 1493183 - protein, 21 aa, Mycobacterium tuberculosis
VIRPCPEVQAPLQAGQVRVAV

SEQ ID NO: 1493184 - protein, 19 aa, Mycobacterium tuberculosis
VISACGWPPKSWACLHNDE

SEQ ID NO: 1493185 - protein, 32 aa, Mycobacterium tuberculosis
VISDGELFIMGRIKDLLIVDGRNHYPDDIEAT

SEQ ID NO: 1493186 - protein, 20 aa, Mycobacterium tuberculosis
VISGLQMLLHQAFAQVEQFT

SEQ ID NO: 1493187 - protein, 19 aa, Mycobacterium tuberculosis
VISGLQMLPHQAFAQVEQF

SEQ ID NO: 1493188 - protein, 19 aa, Mycobacterium tuberculosis
VISGRRFGSTGALRRNTRR

SEQ ID NO: 1493189 - protein, 25 aa, Mycobacterium tuberculosis
VISPIARPRDVHVVPELPKTRSGKI

SEQ ID NO: 1493190 - protein, 25 aa, Mycobacterium tuberculosis
VITKRAGVSVGALFRHFETMGDFMA

SEQ ID NO: 1493191 - protein, 23 aa, Mycobacterium tuberculosis
VIVDECHYYRGVFRLECGDGTAP

SEQ ID NO: 1493192 - protein, 17 aa, Mycobacterium tuberculosis
VIVESAVLLGQSNAHTL

SEQ ID NO: 1493193 - protein, 23 aa, Mycobacterium tuberculosis
VKAHLRTRLQTMLTSLTTEDDDI

SEQ ID NO: 1493194 - protein, 20 aa, Mycobacterium tuberculosis
VKAQVKIGGRGKAGGVKYAA

SEQ ID NO: 1493195 - protein, 28 aa, Mycobacterium tuberculosis
VKAVAGIRLALSLGFRVRVAATVASPAP

SEQ ID NO: 1493196 - protein, 20 aa, Mycobacterium tuberculosis
VKDGYGRNFLLPRGLAIVAS

SEQ ID NO: 1493197 - protein, 22 aa, Mycobacterium tuberculosis
VKDWDPAPGVLVLWHPTPASCA

SEQ ID NO: 1493198 - protein, 24 aa, Mycobacterium tuberculosis
VKEAVLPFHRFRRADGAAIDSLLG

SEQ ID NO: 1493199 - protein, 21 aa, Mycobacterium tuberculosis
VKEVKAAMAALDIDPAFAERS

SEQ ID NO: 1493200 - protein, 18 aa, Mycobacterium tuberculosis
VKEVRLSTRLTESPACLI

SEQ ID NO: 1493201 - protein, 21 aa, Mycobacterium tuberculosis
VKEVRLSTRLTESPACLITDA

SEQ ID NO: 1493202 - protein, 19 aa, Mycobacterium tuberculosis
VKFSMVLPSFVNTELIAGT

SEQ ID NO: 1493203 - protein, 17 aa, Mycobacterium tuberculosis
VKGAWVLARYDDGRPSQ

SEQ ID NO: 1493204 - protein, 17 aa, Mycobacterium tuberculosis
VKGTWAFIPPGEAAISD

SEQ ID NO: 1493205 - protein, 22 aa, Mycobacterium tuberculosis
VKHLCAQMLCRAEQADVAAADA

SEQ ID NO: 1493206 - protein, 22 aa, Mycobacterium tuberculosis
VKHPVTCPVPIAHTGDRKPIRS

SEQ ID NO: 1493207 - protein, 17 aa, Mycobacterium tuberculosis
VKIQMEAAGMCRSDHHL

SEQ ID NO: 1493208 - protein, 18 aa, Mycobacterium tuberculosis
VKKAYQLLAPESRSASIG

SEQ ID NO: 1493209 - protein, 18 aa, Mycobacterium tuberculosis
VKLLKPLPPLLAGAAGPV

SEQ ID NO: 1493210 - protein, 17 aa, Mycobacterium tuberculosis
VKLPRTGKVPTDPAQVS

SEQ ID NO: 1493211 - protein, 17 aa, Mycobacterium tuberculosis
VKLVGDWIDRQIGDLAP

SEQ ID NO: 1493212 - protein, 19 aa, Mycobacterium tuberculosis
VKPFRPFQLNSRLLALADS

SEQ ID NO: 1493213 - protein, 27 aa, Mycobacterium tuberculosis
VKPGKGPAFVRTKLKNVLSGKVVDKTF

SEQ ID NO: 1493214 - protein, 18 aa, Mycobacterium tuberculosis
VKPKLTRRAPPQGQNPET

SEQ ID NO: 1493215 - protein, 17 aa, Mycobacterium tuberculosis
VKPPTWWHSLPTDRPII

SEQ ID NO: 1493216 - protein, 17 aa, Mycobacterium tuberculosis
VKPRPLLFYGGEYTGIE

SEQ ID NO: 1493217 - protein, 21 aa, Mycobacterium tuberculosis
VKQRLRIAVVTRSVLREASPE

SEQ ID NO: 1493218 - protein, 21 aa, Mycobacterium tuberculosis
VKSCNTAFVQLGIRTGADALR

SEQ ID NO: 1493219 - protein, 30 aa, Mycobacterium tuberculosis
VKVIQKLSGLSINRFIAIDFVGFARMVEAL

SEQ ID NO: 1493220 - protein, 17 aa, Mycobacterium tuberculosis
VKVLMALPVGMGCSDHP

SEQ ID NO: 1493221 - protein, 19 aa, Mycobacterium tuberculosis
VKVPGVLTARIVPGATALD

SEQ ID NO: 1493222 - protein, 19 aa, Mycobacterium tuberculosis
VKVVRLGGVGRGFGSGVSM

SEQ ID NO: 1493223 - protein, 23 aa, Mycobacterium tuberculosis
VKWYDPDKGFGFLSQEGGEDVYV

SEQ ID NO: 1493224 - protein, 17 aa, Mycobacterium tuberculosis
VKYKLAILDEYDRADRT

SEQ ID NO: 1493225 - protein, 19 aa, Mycobacterium tuberculosis
VLAAAPPGYRLSIPDNTCD

SEQ ID NO: 1493226 - protein, 20 aa, Mycobacterium tuberculosis
VLAASASMRPLPGPQAHPAG

SEQ ID NO: 1493227 - protein, 24 aa, Mycobacterium tuberculosis
VLAATGRPLIGNGANGAPGTGANG

SEQ ID NO: 1493228 - protein, 17 aa, Mycobacterium tuberculosis
VLAEAAAEVQAKIDEQV

SEQ ID NO: 1493229 - protein, 24 aa, Mycobacterium tuberculosis
VLAGFPGTVASFWQQAGRSGRRGQ

SEQ ID NO: 1493230 - protein, 25 aa, Mycobacterium tuberculosis
VLAHPCPMCYGSLYYCSLDEVVFLT

SEQ ID NO: 1493231 - protein, 28 aa, Mycobacterium tuberculosis
VLAHPGLPQAVPVTRLWLSKQQTSDLMA

SEQ ID NO: 1493232 - protein, 19 aa, Mycobacterium tuberculosis
VLAQREFCAPFELSRDAPL

SEQ ID NO: 1493233 - protein, 31 aa, Mycobacterium tuberculosis
VLARAGSRAAPLLRLPDVRALLDAQLAGRPT

SEQ ID NO: 1493234 - protein, 20 aa, Mycobacterium tuberculosis
VLARELLPERALMATPRRSC

SEQ ID NO: 1493235 - protein, 22 aa, Mycobacterium tuberculosis
VLASTGWHLMMALIARAQVAIA

SEQ ID NO: 1493236 - protein, 28 aa, Mycobacterium tuberculosis
VLATQCWPPRVAGCAAAGLSNATPREVL

SEQ ID NO: 1493237 - protein, 22 aa, Mycobacterium tuberculosis
VLCDGNRRWARSAGYDDVSYGY

SEQ ID NO: 1493238 - protein, 19 aa, Mycobacterium tuberculosis
VLDAGCDWQRARGQLLALP

SEQ ID NO: 1493239 - protein, 19 aa, Mycobacterium tuberculosis
VLDRNGLRPSRIWVTDDGL

SEQ ID NO: 1493240 - protein, 20 aa, Mycobacterium tuberculosis
VLDWDLRRGGGFSYRIYLFA

SEQ ID NO: 1493241 - protein, 19 aa, Mycobacterium tuberculosis
VLDWITGSALVPVRERLSD

SEQ ID NO: 1493242 - protein, 17 aa, Mycobacterium tuberculosis
VLELLHLGGRSLAHAVL

SEQ ID NO: 1493243 - protein, 22 aa, Mycobacterium tuberculosis
VLERFRAIKPWLVGGRIHAPFW

SEQ ID NO: 1493244 - protein, 23 aa, Mycobacterium tuberculosis
VLERFRAIKPWLVGGRVHAPFWE

SEQ ID NO: 1493245 - protein, 19 aa, Mycobacterium tuberculosis
VLERLRPGDFYRPAHQNVY

SEQ ID NO: 1493246 - protein, 20 aa, Mycobacterium tuberculosis
VLEVALRLGVGYVGAMGSRK

SEQ ID NO: 1493247 - protein, 18 aa, Mycobacterium tuberculosis
VLFCGVVGPGPAHIRTVR

SEQ ID NO: 1493248 - protein, 18 aa, Mycobacterium tuberculosis
VLFGRANVVFTLLVVPTS

SEQ ID NO: 1493249 - protein, 25 aa, Mycobacterium tuberculosis
VLGAGIPLFGICFGNQILGRALGLP

SEQ ID NO: 1493250 - protein, 19 aa, Mycobacterium tuberculosis
VLGCGPGRADGVCAGIAFR

SEQ ID NO: 1493251 - protein, 17 aa, Mycobacterium tuberculosis
VLGRGAAPFKPRRDRTP

SEQ ID NO: 1493252 - protein, 24 aa, Mycobacterium tuberculosis
VLGRWPDIRLLAGAPTRHVDRRHR

SEQ ID NO: 1493253 - protein, 18 aa, Mycobacterium tuberculosis
VLHEVRIMLDQYWPVGAA

SEQ ID NO: 1493254 - protein, 23 aa, Mycobacterium tuberculosis
VLICGYGDVGKGCAEAMKGQGAR

SEQ ID NO: 1493255 - protein, 23 aa, Mycobacterium tuberculosis
VLKLLKITGDWQKFKGLPGAQGR

SEQ ID NO: 1493256 - protein, 24 aa, Mycobacterium tuberculosis
VLKRTGRLSLRHALDMLEQTGRAL

SEQ ID NO: 1493257 - protein, 19 aa, Mycobacterium tuberculosis
VLLGLGWLAPSHVDQWRQG

SEQ ID NO: 1493258 - protein, 25 aa, Mycobacterium tuberculosis
VLLPSWWDRRRKLGLVLSAYTPVDG

SEQ ID NO: 1493259 - protein, 24 aa, Mycobacterium tuberculosis
VLLRNIIENPAWYTAYTPYQPEIS

SEQ ID NO: 1493260 - protein, 18 aa, Mycobacterium tuberculosis
VLMATNFFGINTIPIALN

SEQ ID NO: 1493261 - protein, 19 aa, Mycobacterium tuberculosis
VLMTIPWAVISGFLFNVLL

SEQ ID NO: 1493262 - protein, 23 aa, Mycobacterium tuberculosis
VLNARFALNAANARWGSLYDALY

SEQ ID NO: 1493263 - protein, 17 aa, Mycobacterium tuberculosis
VLNMPRHPIRLARFGPR

SEQ ID NO: 1493264 - protein, 27 aa, Mycobacterium tuberculosis
VLPTAGCARHSSGLSVQTFLRGIHVVE

SEQ ID NO: 1493265 - protein, 33 aa, Mycobacterium tuberculosis
VLRAEARAHFGFPDDARVLLVFGGSQGAVSLNR

SEQ ID NO: 1493266 - protein, 23 aa, Mycobacterium tuberculosis
VLRALRLETEWPARQLVDDRWVW

SEQ ID NO: 1493267 - protein, 18 aa, Mycobacterium tuberculosis
VLRHAKASTVGTITEAGL

SEQ ID NO: 1493268 - protein, 21 aa, Mycobacterium tuberculosis
VLRILRRRSLAALRAQAEPVS

SEQ ID NO: 1493269 - protein, 17 aa, Mycobacterium tuberculosis
VLRRAVAALDEIAAEPG

SEQ ID NO: 1493270 - protein, 18 aa, Mycobacterium tuberculosis
VLRRAVAALDEIAAEPGH

SEQ ID NO: 1493271 - protein, 17 aa, Mycobacterium tuberculosis
VLRSMGIPCRYVSGYLH

SEQ ID NO: 1493272 - protein, 22 aa, Mycobacterium tuberculosis
VLRSRVFITRFVGALRGGAVAY

SEQ ID NO: 1493273 - protein, 25 aa, Mycobacterium tuberculosis
VLRTPESWLLIDFEGEPGQPLDERR

SEQ ID NO: 1493274 - protein, 30 aa, Mycobacterium tuberculosis
VLRWDRPAGHSACWRRPVVGGQHGVAGAGG

SEQ ID NO: 1493275 - protein, 24 aa, Mycobacterium tuberculosis
VLSRAQLLELVWGYDFAADTNVVD

SEQ ID NO: 1493276 - protein, 25 aa, Mycobacterium tuberculosis
VLSRKTRRSTPRIGHGPRPSLVTVG

SEQ ID NO: 1493277 - protein, 25 aa, Mycobacterium tuberculosis
VLTALDRLRFAAGNFYVNDKPTGAV

SEQ ID NO: 1493278 - protein, 17 aa, Mycobacterium tuberculosis
VLTARRRARRHLAALRA

SEQ ID NO: 1493279 - protein, 19 aa, Mycobacterium tuberculosis
VLTPLAVDPAHPFPFVSGL

SEQ ID NO: 1493280 - protein, 34 aa, Mycobacterium tuberculosis
VLTPLAVDPAHPFPFVSGLSLNLAVTVRQPEDGT

SEQ ID NO: 1493281 - protein, 18 aa, Mycobacterium tuberculosis
VLTRLPAQVLGRVAFQVL

SEQ ID NO: 1493282 - protein, 26 aa, Mycobacterium tuberculosis
VLTRNPRWWGARPRLDSITYLVLDDA

SEQ ID NO: 1493283 - protein, 18 aa, Mycobacterium tuberculosis
VLTSVYLFGFERPMRGRI

SEQ ID NO: 1493284 - protein, 20 aa, Mycobacterium tuberculosis
VLVAFCARSPHGVSAGGSRL

SEQ ID NO: 1493285 - protein, 17 aa, Mycobacterium tuberculosis
VLVDKRQLAVLLLENEG

SEQ ID NO: 1493286 - protein, 24 aa, Mycobacterium tuberculosis
VLVEHRFNVGLAVREARLAQVLRV

SEQ ID NO: 1493287 - protein, 26 aa, Mycobacterium tuberculosis
VLVLHDWGSALGFDWANQHRDRVQGI

SEQ ID NO: 1493288 - protein, 21 aa, Mycobacterium tuberculosis
VMAALVLRAGDTFDPDAFEAF

SEQ ID NO: 1493289 - protein, 18 aa, Mycobacterium tuberculosis
VMARLRSPLLAVVKDGSL

SEQ ID NO: 1493290 - protein, 18 aa, Mycobacterium tuberculosis
VMFDRIMDLPAEIRNRTT

SEQ ID NO: 1493291 - protein, 17 aa, Mycobacterium tuberculosis
VMIHRALFGSIERFFGI

SEQ ID NO: 1493292 - protein, 17 aa, Mycobacterium tuberculosis
VMLVCPDPAPLLDTVLK

SEQ ID NO: 1493293 - protein, 22 aa, Mycobacterium tuberculosis
VMQRWVYHSTRLAVPTHTYSDS

SEQ ID NO: 1493294 - protein, 18 aa, Mycobacterium tuberculosis
VMSCGTLRELLTIAMRYF

SEQ ID NO: 1493295 - protein, 24 aa, Mycobacterium tuberculosis
VMSTSTWRWRLSLLEGCTVSSGAF

SEQ ID NO: 1493296 - protein, 29 aa, Mycobacterium tuberculosis
VMTGWQRLHFRFGFPAPLLEPLAVERLYL

SEQ ID NO: 1493297 - protein, 17 aa, Mycobacterium tuberculosis
VMVKAQVKIGGRGKAGG

SEQ ID NO: 1493298 - protein, 17 aa, Mycobacterium tuberculosis
VNAAIPTAIFLANALNS

SEQ ID NO: 1493299 - protein, 23 aa, Mycobacterium tuberculosis
VNAEGFPVFSGRKDAVVKISGKR

SEQ ID NO: 1493300 - protein, 19 aa, Mycobacterium tuberculosis
VNAGPVLKVHPNLRYATDG

SEQ ID NO: 1493301 - protein, 28 aa, Mycobacterium tuberculosis
VNALNCGRPPRFCRRVGVRPPAPAALPG

SEQ ID NO: 1493302 - protein, 28 aa, Mycobacterium tuberculosis
VNAPAQALLGRPLIGNGANGADGTGAPG

SEQ ID NO: 1493303 - protein, 22 aa, Mycobacterium tuberculosis
VNARYLRICVLTQYKSHSLDRH

SEQ ID NO: 1493304 - protein, 19 aa, Mycobacterium tuberculosis
VNATLPIFADISAVQPNKD

SEQ ID NO: 1493305 - protein, 23 aa, Mycobacterium tuberculosis
VNAVNPGLATPVTPAANGGNGLN

SEQ ID NO: 1493306 - protein, 23 aa, Mycobacterium tuberculosis
VNDFPKYPLNVFATANAIAGILF

SEQ ID NO: 1493307 - protein, 19 aa, Mycobacterium tuberculosis
VNGIVFNRAFTGAVQTIYD

SEQ ID NO: 1493308 - protein, 20 aa, Mycobacterium tuberculosis
VNGIVFNRAFTGAVQTIYDA

SEQ ID NO: 1493309 - protein, 18 aa, Mycobacterium tuberculosis
VNGKIRFPANTNLVRHVE

SEQ ID NO: 1493310 - protein, 29 aa, Mycobacterium tuberculosis
VNGPTQLLLGRPLIGDGANGGPGQNGGDG

SEQ ID NO: 1493311 - protein, 18 aa, Mycobacterium tuberculosis
VNGVVLFPGAGFVELVIR

SEQ ID NO: 1493312 - protein, 19 aa, Mycobacterium tuberculosis
VNGVVLFPGAGFVELVIRA

SEQ ID NO: 1493313 - protein, 19 aa, Mycobacterium tuberculosis
VNHEPFVTLGIHIGARTTS

SEQ ID NO: 1493314 - protein, 27 aa, Mycobacterium tuberculosis
VNHLGHFALVTGILDWLARPARIVVVS

SEQ ID NO: 1493315 - protein, 22 aa, Mycobacterium tuberculosis
VNHLPLTLPLRYLGMSDAEVDQ

SEQ ID NO: 1493316 - protein, 20 aa, Mycobacterium tuberculosis
VNIETGVVWWPECSKEAYAD

SEQ ID NO: 1493317 - protein, 17 aa, Mycobacterium tuberculosis
VNILWAHRAAVEHPVTC

SEQ ID NO: 1493318 - protein, 23 aa, Mycobacterium tuberculosis
VNIPIHIPITASFTDIVYSGLDL

SEQ ID NO: 1493319 - protein, 24 aa, Mycobacterium tuberculosis
VNISARLTSWIALVTSMPRGQDSV

SEQ ID NO: 1493320 - protein, 22 aa, Mycobacterium tuberculosis
VNLLLSPAVFRGFDQVGALSPT

SEQ ID NO: 1493321 - protein, 27 aa, Mycobacterium tuberculosis
VNPPGDERHMLWFALMKPMTSTATGRE

SEQ ID NO: 1493322 - protein, 20 aa, Mycobacterium tuberculosis
VNRARRIERFLSQNMMAAEQ

SEQ ID NO: 1493323 - protein, 26 aa, Mycobacterium tuberculosis
VNRHRRLAVQVLKLPRLKAVAHATDC

SEQ ID NO: 1493324 - protein, 18 aa, Mycobacterium tuberculosis
VNSALMYAGPGSGPMLAA

SEQ ID NO: 1493325 - protein, 18 aa, Mycobacterium tuberculosis
VNSFVSLAQQGFFKGTTC

SEQ ID NO: 1493326 - protein, 26 aa, Mycobacterium tuberculosis
VNSGRMYCGPGSAPMVAAASAWNGLA

SEQ ID NO: 1493327 - protein, 27 aa, Mycobacterium tuberculosis
VNSGTCFRPSLAVQRRWRDEFGLGLAD

SEQ ID NO: 1493328 - protein, 29 aa, Mycobacterium tuberculosis
VNSGTCFRPSLAVQRRWRDEFGLGLADPD

SEQ ID NO: 1493329 - protein, 18 aa, Mycobacterium tuberculosis
VNSYPLPGATGYPVGVSV

SEQ ID NO: 1493330 - protein, 28 aa, Mycobacterium tuberculosis
VNTGAFIGGNFSNGAFWQSDHQGQWGAH

SEQ ID NO: 1493331 - protein, 17 aa, Mycobacterium tuberculosis
VNTGFWNGGPFNTGFGN

SEQ ID NO: 1493332 - protein, 24 aa, Mycobacterium tuberculosis
VNTHCNLDCPICFADSGHQPDGYA

SEQ ID NO: 1493333 - protein, 33 aa, Mycobacterium tuberculosis
VNTTEPVVFISLNGGQMVPVLLDTGSTGLVMDS

SEQ ID NO: 1493334 - protein, 31 aa, Mycobacterium tuberculosis
VNVEDWKCWARWRLIRARAPWLTRALVAEDF

SEQ ID NO: 1493335 - protein, 18 aa, Mycobacterium tuberculosis
VNVLPRRGIGKVDRAALV

SEQ ID NO: 1493336 - protein, 19 aa, Mycobacterium tuberculosis
VNVLPRRGIGKVDRAALVR

SEQ ID NO: 1493337 - protein, 23 aa, Mycobacterium tuberculosis
VNWDVREGVFAPGVIDAMFHPPG

SEQ ID NO: 1493338 - protein, 17 aa, Mycobacterium tuberculosis
VPAAGGPMGMMPMPMGM

SEQ ID NO: 1493339 - protein, 17 aa, Mycobacterium tuberculosis
VPAAIAKGVEEARKSFF

SEQ ID NO: 1493340 - protein, 19 aa, Mycobacterium tuberculosis
VPAAKAWIKEELKANPDGA

SEQ ID NO: 1493341 - protein, 23 aa, Mycobacterium tuberculosis
VPAAPVVPRAVASSAMAATVGPV

SEQ ID NO: 1493342 - protein, 19 aa, Mycobacterium tuberculosis
VPAAVRFLSCEPLLGPLDG

SEQ ID NO: 1493343 - protein, 27 aa, Mycobacterium tuberculosis
VPAFALGDYEWILAFEAPELDRIVDLM

SEQ ID NO: 1493344 - protein, 26 aa, Mycobacterium tuberculosis
VPALPRLGPTDALPRCRQTVYRVVFI

SEQ ID NO: 1493345 - protein, 19 aa, Mycobacterium tuberculosis
VPALTCLLRSITLRMTMAP

SEQ ID NO: 1493346 - protein, 20 aa, Mycobacterium tuberculosis
VPAPPARPGGEEGDASFDWP

SEQ ID NO: 1493347 - protein, 19 aa, Mycobacterium tuberculosis
VPAQADWLDPMIALSFAAA

SEQ ID NO: 1493348 - protein, 17 aa, Mycobacterium tuberculosis
VPAYMPFFDVLHVTGRQ

SEQ ID NO: 1493349 - protein, 18 aa, Mycobacterium tuberculosis
VPCARLRATNPLRALARC

SEQ ID NO: 1493350 - protein, 19 aa, Mycobacterium tuberculosis
VPCGQWCVDQSAGGVEHGE

SEQ ID NO: 1493351 - protein, 28 aa, Mycobacterium tuberculosis
VPDALVGPCWPAVFAAIGSAVTDTGEPV

SEQ ID NO: 1493352 - protein, 17 aa, Mycobacterium tuberculosis
VPDLRRLFPTGFDEQRR

SEQ ID NO: 1493353 - protein, 18 aa, Mycobacterium tuberculosis
VPDPRYVPAGGRRGAGPA

SEQ ID NO: 1493354 - protein, 24 aa, Mycobacterium tuberculosis
VPEGDFVRWKKLRGGIGALTTHLS

SEQ ID NO: 1493355 - protein, 19 aa, Mycobacterium tuberculosis
VPEKDSRVVVPPGMEDDAD

SEQ ID NO: 1493356 - protein, 22 aa, Mycobacterium tuberculosis
VPELPVGVRLIFQAAEELMPGG

SEQ ID NO: 1493357 - protein, 25 aa, Mycobacterium tuberculosis
VPGAMARLGVWSGDGLQLDLHQPTF

SEQ ID NO: 1493358 - protein, 17 aa, Mycobacterium tuberculosis
VPGASYWYAHTDQWRYD

SEQ ID NO: 1493359 - protein, 24 aa, Mycobacterium tuberculosis
VPGGFRAGFHATLPMIDMPPVPRL

SEQ ID NO: 1493360 - protein, 18 aa, Mycobacterium tuberculosis
VPGGTAFPHCSGVLVAGD

SEQ ID NO: 1493361 - protein, 23 aa, Mycobacterium tuberculosis
VPGLPRRLRWVSPLVPLVAGPLP

SEQ ID NO: 1493362 - protein, 25 aa, Mycobacterium tuberculosis
VPGLRTLCWCPATIGGPPGQSRAGH

SEQ ID NO: 1493363 - protein, 18 aa, Mycobacterium tuberculosis
VPGPLQGINFGFGNIGSL

SEQ ID NO: 1493364 - protein, 22 aa, Mycobacterium tuberculosis
VPGRSVSRWGGFLDDVAGFDAE

SEQ ID NO: 1493365 - protein, 18 aa, Mycobacterium tuberculosis
VPGTNVWRNYSYAHPARR

SEQ ID NO: 1493366 - protein, 21 aa, Mycobacterium tuberculosis
VPHLPPPPLVFAAEPAKTGAD

SEQ ID NO: 1493367 - protein, 25 aa, Mycobacterium tuberculosis
VPHRPVAEYFVWFKGEYDVDDTDRL

SEQ ID NO: 1493368 - protein, 17 aa, Mycobacterium tuberculosis
VPIAGFGGAPGFGNSTT

SEQ ID NO: 1493369 - protein, 24 aa, Mycobacterium tuberculosis
VPIPRAGGLGAPRIRDVELVEMVA

SEQ ID NO: 1493370 - protein, 23 aa, Mycobacterium tuberculosis
VPIPRAGGLGARRIRDVELVQMV

SEQ ID NO: 1493371 - protein, 19 aa, Mycobacterium tuberculosis
VPIPYVYPVDLRFVLAPPV

SEQ ID NO: 1493372 - protein, 23 aa, Mycobacterium tuberculosis
VPIRELPSRLALRRRTSTSRGGR

SEQ ID NO: 1493373 - protein, 21 aa, Mycobacterium tuberculosis
VPKHIPVTWWPKTDSVSPQLG

SEQ ID NO: 1493374 - protein, 19 aa, Mycobacterium tuberculosis
VPKLAGRVVDARWDGPQAG

SEQ ID NO: 1493375 - protein, 25 aa, Mycobacterium tuberculosis
VPKTLIQHLIRWVISAGEFGEKWVR

SEQ ID NO: 1493376 - protein, 32 aa, Mycobacterium tuberculosis
VPLAAAVWTQRGWRFPDRLDRVYVNSRARRDL

SEQ ID NO: 1493377 - protein, 19 aa, Mycobacterium tuberculosis
VPLMLARNAEALYWNRSLR

SEQ ID NO: 1493378 - protein, 18 aa, Mycobacterium tuberculosis
VPLPELPHGLRITDVSLA

SEQ ID NO: 1493379 - protein, 25 aa, Mycobacterium tuberculosis
VPLWTTRAKRWLRRRTGAEHPAVAW

SEQ ID NO: 1493380 - protein, 21 aa, Mycobacterium tuberculosis
VPMLPGSWGPDLVGVAGDGGL

SEQ ID NO: 1493381 - protein, 22 aa, Mycobacterium tuberculosis
VPMWAHPEPLPPVSGLTIAVER

SEQ ID NO: 1493382 - protein, 23 aa, Mycobacterium tuberculosis
VPPCPPEPLVPPTPVLPPAPPAP

SEQ ID NO: 1493383 - protein, 18 aa, Mycobacterium tuberculosis
VPPHGRRARCAGTSSDRH

SEQ ID NO: 1493384 - protein, 19 aa, Mycobacterium tuberculosis
VPPMAALLIKESVNQTVDA

SEQ ID NO: 1493385 - protein, 19 aa, Mycobacterium tuberculosis
VPPMPAPVEPQGPRCGRRY

SEQ ID NO: 1493386 - protein, 17 aa, Mycobacterium tuberculosis
VPPPLIAANRARLTSLV

SEQ ID NO: 1493387 - protein, 17 aa, Mycobacterium tuberculosis
VPPVPPVPPLPVKMPPS

SEQ ID NO: 1493388 - protein, 21 aa, Mycobacterium tuberculosis
VPPVTLRQALLGKVMTVGDAV

SEQ ID NO: 1493389 - protein, 19 aa, Mycobacterium tuberculosis
VPPWFPWSSGEKCQARSAK

SEQ ID NO: 1493390 - protein, 24 aa, Mycobacterium tuberculosis
VPQHLMRRLFFTGGHRGRGHLAAL

SEQ ID NO: 1493391 - protein, 25 aa, Mycobacterium tuberculosis
VPRAELLRPGLLVLPVRGPARFFGS

SEQ ID NO: 1493392 - protein, 19 aa, Mycobacterium tuberculosis
VPRALNIVDAFTEMVSSRG

SEQ ID NO: 1493393 - protein, 17 aa, Mycobacterium tuberculosis
VPRNVSFSQSWRSAPPP

SEQ ID NO: 1493394 - protein, 17 aa, Mycobacterium tuberculosis
VPRRAAVSSYGFSGTNV

SEQ ID NO: 1493395 - protein, 25 aa, Mycobacterium tuberculosis
VPRVPMPPPRASVARTVVKGGNGGV

SEQ ID NO: 1493396 - protein, 25 aa, Mycobacterium tuberculosis
VPSAYDLGTVIGFYGLTIDEPPTGT

SEQ ID NO: 1493397 - protein, 17 aa, Mycobacterium tuberculosis
VPSCAEGGVLGAICATI

SEQ ID NO: 1493398 - protein, 17 aa, Mycobacterium tuberculosis
VPSCPASCCTDPPGLTA

SEQ ID NO: 1493399 - protein, 17 aa, Mycobacterium tuberculosis
VPSDLAYLAEGFTAIGT

SEQ ID NO: 1493400 - protein, 26 aa, Mycobacterium tuberculosis
VPSDVLRCYLDLVLDGLLARLASGED

SEQ ID NO: 1493401 - protein, 24 aa, Mycobacterium tuberculosis
VPSSSPPRPPLPPKPPAPPTSAEA

SEQ ID NO: 1493402 - protein, 17 aa, Mycobacterium tuberculosis
VPSWISDIANIFNIGAG

SEQ ID NO: 1493403 - protein, 20 aa, Mycobacterium tuberculosis
VPSWISDIANIFNIGAGNWA

SEQ ID NO: 1493404 - protein, 26 aa, Mycobacterium tuberculosis
VPTGPRGTAIFTCAPGPTVCCRLQRC

SEQ ID NO: 1493405 - protein, 17 aa, Mycobacterium tuberculosis
VPTHDWAHHDALHRIDE

SEQ ID NO: 1493406 - protein, 19 aa, Mycobacterium tuberculosis
VPTPASLFAPINPIAVASA

SEQ ID NO: 1493407 - protein, 24 aa, Mycobacterium tuberculosis
VPTSWRAARATLRLPADTAARVAT

SEQ ID NO: 1493408 - protein, 21 aa, Mycobacterium tuberculosis
VPVDPPPGFGYTRSGVPVKSF

SEQ ID NO: 1493409 - protein, 25 aa, Mycobacterium tuberculosis
VPVNPSGGLACFGEAIPVQAIAQVC

SEQ ID NO: 1493410 - protein, 22 aa, Mycobacterium tuberculosis
VPVQAWGWLSLAAGLAVLDSVA

SEQ ID NO: 1493411 - protein, 18 aa, Mycobacterium tuberculosis
VPVSHLMATFAGRNLTER

SEQ ID NO: 1493412 - protein, 18 aa, Mycobacterium tuberculosis
VPVTVTWNADSSRPIEFR

SEQ ID NO: 1493413 - protein, 23 aa, Mycobacterium tuberculosis
VPYRANMWALRALGVRRVFGPCA

SEQ ID NO: 1493414 - protein, 21 aa, Mycobacterium tuberculosis
VQAGLRTDYLLRIPNQRGGIV

SEQ ID NO: 1493415 - protein, 26 aa, Mycobacterium tuberculosis
VQANRVRTWLLAVSNVFGQNAPAIAA

SEQ ID NO: 1493416 - protein, 17 aa, Mycobacterium tuberculosis
VQARPGCRPSLAELDSF

SEQ ID NO: 1493417 - protein, 24 aa, Mycobacterium tuberculosis
VQARPGCRPSLAELDSFVRSEIAG

SEQ ID NO: 1493418 - protein, 22 aa, Mycobacterium tuberculosis
VQAVDAYSLFGAVGDDDAPNEH

SEQ ID NO: 1493419 - protein, 20 aa, Mycobacterium tuberculosis
VQDIGWDEQWQCDRCSVVHQ

SEQ ID NO: 1493420 - protein, 18 aa, Mycobacterium tuberculosis
VQDLGIEVFLVMPFTTDF

SEQ ID NO: 1493421 - protein, 19 aa, Mycobacterium tuberculosis
VQERRLVFERFYRSASARA

SEQ ID NO: 1493422 - protein, 21 aa, Mycobacterium tuberculosis
VQERRLVFERFYRSASARALP

SEQ ID NO: 1493423 - protein, 19 aa, Mycobacterium tuberculosis
VQFSCKGANVAPPLTWSSP

SEQ ID NO: 1493424 - protein, 25 aa, Mycobacterium tuberculosis
VQFSCKGANVAPPLTWSSPAGAAEL

SEQ ID NO: 1493425 - protein, 18 aa, Mycobacterium tuberculosis
VQGGRPEALGGLGGGRIE

SEQ ID NO: 1493426 - protein, 25 aa, Mycobacterium tuberculosis
VQHERIRSAVTLNDGDHIRICDHEF

SEQ ID NO: 1493427 - protein, 19 aa, Mycobacterium tuberculosis
VQHVMKGLPSREVHAGRDP

SEQ ID NO: 1493428 - protein, 19 aa, Mycobacterium tuberculosis
VQIPCIERNAISAGKAINA

SEQ ID NO: 1493429 - protein, 18 aa, Mycobacterium tuberculosis
VQLERGWVLRDETGGRWQ

SEQ ID NO: 1493430 - protein, 21 aa, Mycobacterium tuberculosis
VQLGLPRLAARINNERIRLGI

SEQ ID NO: 1493431 - protein, 21 aa, Mycobacterium tuberculosis
VQLHAPLCGVARGQTLVLYRP

SEQ ID NO: 1493432 - protein, 28 aa, Mycobacterium tuberculosis
VQLHAPLRGVARGQTLVLYRPDPAGDEV

SEQ ID NO: 1493433 - protein, 20 aa, Mycobacterium tuberculosis
VQLIEPVAFCIGFEHPPTIR

SEQ ID NO: 1493434 - protein, 19 aa, Mycobacterium tuberculosis
VQLPVKGTWAFIPPGEAAI

SEQ ID NO: 1493435 - protein, 27 aa, Mycobacterium tuberculosis
VQLRPGDRLSSLIPEVVAYSEECTYND

SEQ ID NO: 1493436 - protein, 23 aa, Mycobacterium tuberculosis
VQPELRKGRYPDRKTARRVAEVV

SEQ ID NO: 1493437 - protein, 20 aa, Mycobacterium tuberculosis
VQPNLKVIVNLGYGDPAYGY

SEQ ID NO: 1493438 - protein, 24 aa, Mycobacterium tuberculosis
VQRAVVDPVPFPRATDRLLLQNLS

SEQ ID NO: 1493439 - protein, 18 aa, Mycobacterium tuberculosis
VQRLRKERSIGLSEAVNE

SEQ ID NO: 1493440 - protein, 19 aa, Mycobacterium tuberculosis
VQRMGKLLGGQLWESAGSP

SEQ ID NO: 1493441 - protein, 25 aa, Mycobacterium tuberculosis
VQTPQPYWYWALDRESIGGSVSAAL

SEQ ID NO: 1493442 - protein, 22 aa, Mycobacterium tuberculosis
VQTRRVVGVGGQLQHRRPVLEG

SEQ ID NO: 1493443 - protein, 19 aa, Mycobacterium tuberculosis
VQVGHGLVVDFVRSCGMTA

SEQ ID NO: 1493444 - protein, 21 aa, Mycobacterium tuberculosis
VQVIRCFLHSYPTCDYPPGRK

SEQ ID NO: 1493445 - protein, 19 aa, Mycobacterium tuberculosis
VQVLARAAGHIVAVRQGAV

SEQ ID NO: 1493446 - protein, 24 aa, Mycobacterium tuberculosis
VQVPGGAWVLGWRRPQAYPLMSHL

SEQ ID NO: 1493447 - protein, 22 aa, Mycobacterium tuberculosis
VQVVVCGKPSFYTGRGTFSLRL

SEQ ID NO: 1493448 - protein, 21 aa, Mycobacterium tuberculosis
VRAAARAGAYCARTRAAPAQA

SEQ ID NO: 1493449 - protein, 17 aa, Mycobacterium tuberculosis
VRAARDYHNGILDGDAV

SEQ ID NO: 1493450 - protein, 18 aa, Mycobacterium tuberculosis
VRAEAGAVLTEISDTASR

SEQ ID NO: 1493451 - protein, 17 aa, Mycobacterium tuberculosis
VRAHLPERLAALDQLST

SEQ ID NO: 1493452 - protein, 17 aa, Mycobacterium tuberculosis
VRASVIDRGQWKDHCDG

SEQ ID NO: 1493453 - protein, 27 aa, Mycobacterium tuberculosis
VRAVVGLSLPGTVAWHAVPAGSHETRI

SEQ ID NO: 1493454 - protein, 21 aa, Mycobacterium tuberculosis
VRDGRACLVEAHLQRLTQSAR

SEQ ID NO: 1493455 - protein, 22 aa, Mycobacterium tuberculosis
VRDGRACLVEAHLQRLTQSARL

SEQ ID NO: 1493456 - protein, 21 aa, Mycobacterium tuberculosis
VREDARILYHAALAHASNHIV

SEQ ID NO: 1493457 - protein, 18 aa, Mycobacterium tuberculosis
VREDFRMGGPGVADHAGG

SEQ ID NO: 1493458 - protein, 23 aa, Mycobacterium tuberculosis
VREFKRLAKATGIDEPRLGLILE

SEQ ID NO: 1493459 - protein, 17 aa, Mycobacterium tuberculosis
VRESSCLGRRSLHPGAR

SEQ ID NO: 1493460 - protein, 17 aa, Mycobacterium tuberculosis
VRFNWDPLRWFEEDEPI

SEQ ID NO: 1493461 - protein, 20 aa, Mycobacterium tuberculosis
VRGARNIPCVDVPGKRAATP

SEQ ID NO: 1493462 - protein, 21 aa, Mycobacterium tuberculosis
VRGARNIPCVDVPGKRAATPK

SEQ ID NO: 1493463 - protein, 20 aa, Mycobacterium tuberculosis
VRGARNYPCQEFPGKRAPTV

SEQ ID NO: 1493464 - protein, 17 aa, Mycobacterium tuberculosis
VRGAVIAAVNGFCVGGG

SEQ ID NO: 1493465 - protein, 21 aa, Mycobacterium tuberculosis
VRGCDAFVLQSCPAPVNRWLM

SEQ ID NO: 1493466 - protein, 22 aa, Mycobacterium tuberculosis
VRGCDAFVLQSCPAPVNRWLME

SEQ ID NO: 1493467 - protein, 24 aa, Mycobacterium tuberculosis
VRGEGRGAALGFPTANVAPPMYSA

SEQ ID NO: 1493468 - protein, 23 aa, Mycobacterium tuberculosis
VRGGALAPGTVRQWLAEHAGDGR

SEQ ID NO: 1493469 - protein, 19 aa, Mycobacterium tuberculosis
VRGGVYWDAYRDPVSVVVL

SEQ ID NO: 1493470 - protein, 19 aa, Mycobacterium tuberculosis
VRGPKLFQGLAFVVSRRRL

SEQ ID NO: 1493471 - protein, 20 aa, Mycobacterium tuberculosis
VRGRRAEVFGISRAGDGDGA

SEQ ID NO: 1493472 - protein, 17 aa, Mycobacterium tuberculosis
VRGVLDRLRNRTVHEPT

SEQ ID NO: 1493473 - protein, 17 aa, Mycobacterium tuberculosis
VRHCARIALDQLGVPPA

SEQ ID NO: 1493474 - protein, 17 aa, Mycobacterium tuberculosis
VRHELTVLAALLGPADA

SEQ ID NO: 1493475 - protein, 18 aa, Mycobacterium tuberculosis
VRHYIIDCALRWMRDFHA

SEQ ID NO: 1493476 - protein, 24 aa, Mycobacterium tuberculosis
VRIKPSHLAGGYGQHAFAFNYLGP

SEQ ID NO: 1493477 - protein, 19 aa, Mycobacterium tuberculosis
VRKLGAPGHDEFAVGALAS

SEQ ID NO: 1493478 - protein, 20 aa, Mycobacterium tuberculosis
VRLAPAVGCQPTMPAEFHED

SEQ ID NO: 1493479 - protein, 17 aa, Mycobacterium tuberculosis
VRLAREGADIVALDICA

SEQ ID NO: 1493480 - protein, 27 aa, Mycobacterium tuberculosis
VRLAVEWPLELFGHITAMPGSGGGQAA

SEQ ID NO: 1493481 - protein, 18 aa, Mycobacterium tuberculosis
VRLGLGAVRYLGAELAEK

SEQ ID NO: 1493482 - protein, 29 aa, Mycobacterium tuberculosis
VRLHPNAIAALGIREWDAVSLTGSRTTAA

SEQ ID NO: 1493483 - protein, 17 aa, Mycobacterium tuberculosis
VRLKARLWFVHRGIEKL

SEQ ID NO: 1493484 - protein, 19 aa, Mycobacterium tuberculosis
VRLKGGDPFVFARGYEEVL

SEQ ID NO: 1493485 - protein, 20 aa, Mycobacterium tuberculosis
VRLKGGDPFVFARGYEEVLA

SEQ ID NO: 1493486 - protein, 22 aa, Mycobacterium tuberculosis
VRLPGMRGVPVVSQGCRPIGYP

SEQ ID NO: 1493487 - protein, 19 aa, Mycobacterium tuberculosis
VRLPIPWRDVGGYRPTGRS

SEQ ID NO: 1493488 - protein, 17 aa, Mycobacterium tuberculosis
VRLSTRLTESPACLITD

SEQ ID NO: 1493489 - protein, 22 aa, Mycobacterium tuberculosis
VRMPLTLNIPAGIPLEPGIYEW

SEQ ID NO: 1493490 - protein, 19 aa, Mycobacterium tuberculosis
VRNGIDFKIADLSLADFGR

SEQ ID NO: 1493491 - protein, 19 aa, Mycobacterium tuberculosis
VRNNFSWLNSYYDDMAWLA

SEQ ID NO: 1493492 - protein, 19 aa, Mycobacterium tuberculosis
VRNVSRGLVDVALFAIAQV

SEQ ID NO: 1493493 - protein, 18 aa, Mycobacterium tuberculosis
VRPAPGQGLSPAVSTLVV

SEQ ID NO: 1493494 - protein, 20 aa, Mycobacterium tuberculosis
VRPATPWKPPSKGLLARHPN

SEQ ID NO: 1493495 - protein, 21 aa, Mycobacterium tuberculosis
VRPGIPVAFDAVIARGMAKNP

SEQ ID NO: 1493496 - protein, 17 aa, Mycobacterium tuberculosis
VRPTVWGAVPRVWEKLK

SEQ ID NO: 1493497 - protein, 19 aa, Mycobacterium tuberculosis
VRQALRMRPDRIVVGEVRG

SEQ ID NO: 1493498 - protein, 17 aa, Mycobacterium tuberculosis
VRQAQVDAGAWPGTTTE

SEQ ID NO: 1493499 - protein, 17 aa, Mycobacterium tuberculosis
VRQFLNLDVPLFVESAF

SEQ ID NO: 1493500 - protein, 30 aa, Mycobacterium tuberculosis; identical to SEQ ID NO: 937625

SEQ ID NO: 1493501 - protein, 19 aa, Mycobacterium tuberculosis
VRQWLVRWAAHPGRATRGF

SEQ ID NO: 1493502 - protein, 17 aa, Mycobacterium tuberculosis
VRRAIGMVFQRPNPFPA

SEQ ID NO: 1493503 - protein, 21 aa, Mycobacterium tuberculosis
VRRAPHAGGREVLRVEVGAPS

SEQ ID NO: 1493504 - protein, 22 aa, Mycobacterium tuberculosis
VRRFARERSRWLFSNPEMTHLS

SEQ ID NO: 1493505 - protein, 17 aa, Mycobacterium tuberculosis
VRRGRVYAARLAPVAAG

SEQ ID NO: 1493506 - protein, 19 aa, Mycobacterium tuberculosis
VRRNPRGSYQIAVVGLKGG

SEQ ID NO: 1493507 - protein, 31 aa, Mycobacterium tuberculosis
VRRPLRHSPLPAGRRSWWRIAPARRRKSGAL

SEQ ID NO: 1493508 - protein, 17 aa, Mycobacterium tuberculosis
VRRRRTGGSGDHGTPAA

SEQ ID NO: 1493509 - protein, 18 aa, Mycobacterium tuberculosis
VRRRRTWTSKGHFPMGDG

SEQ ID NO: 1493510 - protein, 28 aa, Mycobacterium tuberculosis
VRRSNALLDWAYGRRFRYSETMSVGSTV

SEQ ID NO: 1493511 - protein, 21 aa, Mycobacterium tuberculosis
VRRSPRWNRCGAASRGAGHTS

SEQ ID NO: 1493512 - protein, 20 aa, Mycobacterium tuberculosis
VRRSPRWTARCCEPRRGHTS

SEQ ID NO: 1493513 - protein, 22 aa, Mycobacterium tuberculosis
VRSEGCAMVLLKRLPDALRDGN

SEQ ID NO: 1493514 - protein, 17 aa, Mycobacterium tuberculosis
VRSETIPEFLAALEKPR

SEQ ID NO: 1493515 - protein, 18 aa, Mycobacterium tuberculosis
VRSGWDDLVLAGGVESMS

SEQ ID NO: 1493516 - protein, 17 aa, Mycobacterium tuberculosis
VRSLPGWSAAVASHEGL

SEQ ID NO: 1493517 - protein, 19 aa, Mycobacterium tuberculosis
VRSLVAWFWDQPLRAPLIR

SEQ ID NO: 1493518 - protein, 30 aa, Mycobacterium tuberculosis
VRSPGRWAAIPRWPDFVAARFPRPSRGPVV

SEQ ID NO: 1493519 - protein, 24 aa, Mycobacterium tuberculosis
VRSREVAAEFAARFANLIGARTKD

SEQ ID NO: 1493520 - protein, 25 aa, Mycobacterium tuberculosis
VRSREVAAEFAARFANLIGARTQDA

SEQ ID NO: 1493521 - protein, 21 aa, Mycobacterium tuberculosis
VRSRFPSSGPYKIESVLDDGA

SEQ ID NO: 1493522 - protein, 18 aa, Mycobacterium tuberculosis
VRSRIVKRRGHLQAVCEP

SEQ ID NO: 1493523 - protein, 17 aa, Mycobacterium tuberculosis
VRSRTDLLSTLPQRVAV

SEQ ID NO: 1493524 - protein, 29 aa, Mycobacterium tuberculosis
VRSTRNCATCWACCAMPTAATSAWSTPIS

SEQ ID NO: 1493525 - protein, 23 aa, Mycobacterium tuberculosis
VRSTTVDAGRRFWPARSAPRSRM

SEQ ID NO: 1493526 - protein, 19 aa, Mycobacterium tuberculosis
VRTAFYYVRSGITVVPDEL

SEQ ID NO: 1493527 - protein, 18 aa, Mycobacterium tuberculosis
VRTDELLDLWAAAYPGVW

SEQ ID NO: 1493528 - protein, 18 aa, Mycobacterium tuberculosis
VRTLRVAHRLTTSAEQDL

SEQ ID NO: 1493529 - protein, 26 aa, Mycobacterium tuberculosis
VRTSSYLPGPHDVYVSMNMVRKNGMR

SEQ ID NO: 1493530 - protein, 23 aa, Mycobacterium tuberculosis
VRTWQGFCYTAFVTDVCTRKIVV

SEQ ID NO: 1493531 - protein, 19 aa, Mycobacterium tuberculosis
VRVAHVLSVNLARVRANPD

SEQ ID NO: 1493532 - protein, 17 aa, Mycobacterium tuberculosis
VRVCTICTDPWNLDHAT

SEQ ID NO: 1493533 - protein, 18 aa, Mycobacterium tuberculosis
VRVGRDVPGFIGNRLQHA

SEQ ID NO: 1493534 - protein, 19 aa, Mycobacterium tuberculosis
VRVGRDVPGFIGNRLQHAL

SEQ ID NO: 1493535 - protein, 24 aa, Mycobacterium tuberculosis
VRVICRRSALMTRIAGAGAMASVE

SEQ ID NO: 1493536 - protein, 22 aa, Mycobacterium tuberculosis
VRVICRRSKLMATIAGSAAMAS

SEQ ID NO: 1493537 - protein, 18 aa, Mycobacterium tuberculosis
VRWCRRPQRAAVRRAGGE

SEQ ID NO: 1493538 - protein, 20 aa, Mycobacterium tuberculosis
VRYPYARGVLVEMYREAKTR

SEQ ID NO: 1493539 - protein, 20 aa, Mycobacterium tuberculosis
VSAAIAALFATHGQAYQELS

SEQ ID NO: 1493540 - protein, 21 aa, Mycobacterium tuberculosis
VSAAIAGLFGAHARQYQALSV

SEQ ID NO: 1493541 - protein, 18 aa, Mycobacterium tuberculosis
VSAAIASLFGAHGWRISL

SEQ ID NO: 1493542 - protein, 19 aa, Mycobacterium tuberculosis
VSAAIASLFSGNAQAYQAL

SEQ ID NO: 1493543 - protein, 20 aa, Mycobacterium tuberculosis
VSAAIATLFGSHAREYQAIS

SEQ ID NO: 1493544 - protein, 21 aa, Mycobacterium tuberculosis
VSAALAALFGAHAREYQAAAQ

SEQ ID NO: 1493545 - protein, 20 aa, Mycobacterium tuberculosis
VSAAVAALFSGHAQTYQALS

SEQ ID NO: 1493546 - protein, 20 aa, Mycobacterium tuberculosis
VSAAVASLFSGHAQAYQTLG

SEQ ID NO: 1493547 - protein, 24 aa, Mycobacterium tuberculosis
VSAAVSRLFGAYGQQFQALNARAA

SEQ ID NO: 1493548 - protein, 25 aa, Mycobacterium tuberculosis
VSAAVSRLFGAYGQQFQALNARAAT

SEQ ID NO: 1493549 - protein, 26 aa, Mycobacterium tuberculosis
VSAAVSRLFGAYGQQFQALNARAATF

SEQ ID NO: 1493550 - protein, 17 aa, Mycobacterium tuberculosis
VSACRYLNPEAAAPAAA

SEQ ID NO: 1493551 - protein, 17 aa, Mycobacterium tuberculosis
VSACSAPGHIRYKQLQD

SEQ ID NO: 1493552 - protein, 17 aa, Mycobacterium tuberculosis
VSAIAWGAWGEVGRATF

SEQ ID NO: 1493553 - protein, 22 aa, Mycobacterium tuberculosis
VSALTAAQFAAHAQIYQAVSAQ

SEQ ID NO: 1493554 - protein, 17 aa, Mycobacterium tuberculosis
VSAPIYLGGAGRWRDSG

SEQ ID NO: 1493555 - protein, 17 aa, Mycobacterium tuberculosis
VSARFAIAAAETVAAAA

SEQ ID NO: 1493556 - protein, 18 aa, Mycobacterium tuberculosis
VSARFAIAAAETVAAAAR

SEQ ID NO: 1493557 - protein, 17 aa, Mycobacterium tuberculosis
VSATAGMLADWMEGPGA

SEQ ID NO: 1493558 - protein, 26 aa, Mycobacterium tuberculosis
VSATRPPAVLHRIRQTLAIQPVSIGS

SEQ ID NO: 1493559 - protein, 30 aa, Mycobacterium tuberculosis
VSATRSWAARWACRPTRWCLGTAASTSRSS

SEQ ID NO: 1493560 - protein, 22 aa, Mycobacterium tuberculosis
VSCGHVARSLWAVIVDPDTGPE

SEQ ID NO: 1493561 - protein, 23 aa, Mycobacterium tuberculosis
VSCGHVARSLWAVIVDRDTGPEA

SEQ ID NO: 1493562 - protein, 17 aa, Mycobacterium tuberculosis
VSDFLGVIYGRRMGARK

SEQ ID NO: 1493563 - protein, 17 aa, Mycobacterium tuberculosis
VSDLFDFSLYVDARIED

SEQ ID NO: 1493564 - protein, 18 aa, Mycobacterium tuberculosis
VSDVVLFPGTGFVDLAIR

SEQ ID NO: 1493565 - protein, 20 aa, Mycobacterium tuberculosis
VSEGFPPYLVGGGGPRNRSS

SEQ ID NO: 1493566 - protein, 17 aa, Mycobacterium tuberculosis
VSELVGFISTPRCIQAM

SEQ ID NO: 1493567 - protein, 21 aa, Mycobacterium tuberculosis
VSFTTLRLIYQEMLANYRVGQ

SEQ ID NO: 1493568 - protein, 17 aa, Mycobacterium tuberculosis
VSGAAGNLARLGSMISA

SEQ ID NO: 1493569 - protein, 26 aa, Mycobacterium tuberculosis
VSGARWAPAVGVGQCSRVSRSAGASV

SEQ ID NO: 1493570 - protein, 24 aa, Mycobacterium tuberculosis
VSGEGCVMLALKRLPDALADGDRI

SEQ ID NO: 1493571 - protein, 22 aa, Mycobacterium tuberculosis
VSGEGCVVLLLKRLPDAVRDGD

SEQ ID NO: 1493572 - protein, 26 aa, Mycobacterium tuberculosis
VSGENVFFCATGSPTATCSRECVTTP

SEQ ID NO: 1493573 - protein, 26 aa, Mycobacterium tuberculosis
VSGFANRGILPFSVASVVSGFANIGT

SEQ ID NO: 1493574 - protein, 20 aa, Mycobacterium tuberculosis
VSGMGLDWASVFSGYRPKRV

SEQ ID NO: 1493575 - protein, 24 aa, Mycobacterium tuberculosis
VSGPLRPAAAQVFAAVQAAAIPVV

SEQ ID NO: 1493576 - protein, 38 aa, Mycobacterium tuberculosis
VSGRRCLCWIAGCARYRPGWPESCTLPVRASVLGIGGG

SEQ ID NO: 1493577 - protein, 17 aa, Mycobacterium tuberculosis
VSGSSGLGGAAGSGGNG

SEQ ID NO: 1493578 - protein, 18 aa, Mycobacterium tuberculosis
VSHAPALLAPDTENAAVR

SEQ ID NO: 1493579 - protein, 17 aa, Mycobacterium tuberculosis
VSHARGVGGPGGAGGAG

SEQ ID NO: 1493580 - protein, 19 aa, Mycobacterium tuberculosis
VSHQLPVWTLRLYLTGKRL

SEQ ID NO: 1493581 - protein, 25 aa, Mycobacterium tuberculosis
VSHQLRVLRNLGLVVGDRAGRSIVY

SEQ ID NO: 1493582 - protein, 17 aa, Mycobacterium tuberculosis
VSIDGLIAILTFPPAES

SEQ ID NO: 1493583 - protein, 19 aa, Mycobacterium tuberculosis
VSIDGLIAILTFPPAESVF

SEQ ID NO: 1493584 - protein, 17 aa, Mycobacterium tuberculosis
VSIDVPKMMALTPLSTL

SEQ ID NO: 1493585 - protein, 18 aa, Mycobacterium tuberculosis
VSIERFLDTAWWVSDLPS

SEQ ID NO: 1493586 - protein, 24 aa, Mycobacterium tuberculosis
VSILYRLYRPLIFALYCLPLNWLR

SEQ ID NO: 1493587 - protein, 25 aa, Mycobacterium tuberculosis
VSILYRLYRPLIFALYCLPLNWLRR

SEQ ID NO: 1493588 - protein, 27 aa, Mycobacterium tuberculosis
VSKARAGGLVEGRRLTKVLGLPGPHRR

SEQ ID NO: 1493589 - protein, 21 aa, Mycobacterium tuberculosis
VSLAISALFGQHAQAYQALSA

SEQ ID NO: 1493590 - protein, 27 aa, Mycobacterium tuberculosis
VSLCRSVDIPARFVLGQALELPQPGAQ

SEQ ID NO: 1493591 - protein, 20 aa, Mycobacterium tuberculosis
VSLGKRKGKIVVEFGSVGVC

SEQ ID NO: 1493592 - protein, 18 aa, Mycobacterium tuberculosis
VSLGRAGTAGGDRRGPVG

SEQ ID NO: 1493593 - protein, 24 aa, Mycobacterium tuberculosis
VSLPAKRWLAQRGFDPVYGARPLR

SEQ ID NO: 1493594 - protein, 25 aa, Mycobacterium tuberculosis
VSNASGRMRVCVTGFNVDAVRAVAI

SEQ ID NO: 1493595 - protein, 22 aa, Mycobacterium tuberculosis
VSNNFYEWVLGPSMTYTCAVFP

SEQ ID NO: 1493596 - protein, 19 aa, Mycobacterium tuberculosis
VSPASMRKFFEAFAPYGLK

SEQ ID NO: 1493597 - protein, 26 aa, Mycobacterium tuberculosis
VSPDLVRRLCWEWEDISQSSPDPIAA

SEQ ID NO: 1493598 - protein, 19 aa, Mycobacterium tuberculosis
VSPEQKLRLVQALQARGHV

SEQ ID NO: 1493599 - protein, 20 aa, Mycobacterium tuberculosis
VSPLPPFQPVPPFPPPPPVP

SEQ ID NO: 1493600 - protein, 19 aa, Mycobacterium tuberculosis
VSPMPLAFVEYDLDTGDPL

SEQ ID NO: 1493601 - protein, 26 aa, Mycobacterium tuberculosis
VSQAIARLFSDYATHYQSLNAQAAAF

SEQ ID NO: 1493602 - protein, 24 aa, Mycobacterium tuberculosis
VSRAELIRLLLNRALTTAGDDLAS

SEQ ID NO: 1493603 - protein, 19 aa, Mycobacterium tuberculosis
VSRAGDWFGSPVNVASRVT

SEQ ID NO: 1493604 - protein, 24 aa, Mycobacterium tuberculosis
VSRALRLTGRRVMLVPTMGALHEG

SEQ ID NO: 1493605 - protein, 28 aa, Mycobacterium tuberculosis
VSRASAFRRLRAGLRQPTGRRGAGRHRR

SEQ ID NO: 1493606 - protein, 19 aa, Mycobacterium tuberculosis
VSRRDRLSVCAGRYHGCTR

SEQ ID NO: 1493607 - protein, 21 aa, Mycobacterium tuberculosis
VSRRRRWLGGWTIAPAPCGWL

SEQ ID NO: 1493608 - protein, 25 aa, Mycobacterium tuberculosis
VSRSVWWARSWPGTSRCFWPSTRLR

SEQ ID NO: 1493609 - protein, 17 aa, Mycobacterium tuberculosis
VSSDWPFMVSKDSAADY

SEQ ID NO: 1493610 - protein, 18 aa, Mycobacterium tuberculosis
VSSPSWFSDYVLSVGAVD

SEQ ID NO: 1493611 - protein, 27 aa, Mycobacterium tuberculosis
VSTAIAALFGSHGQHYQAISAQVAAYQ

SEQ ID NO: 1493612 - protein, 21 aa, Mycobacterium tuberculosis
VSTQIAALFGAHARSYQTLST

SEQ ID NO: 1493613 - protein, 27 aa, Mycobacterium tuberculosis
VSTQIAALFGAHARSYQTLSTQAAAFH

SEQ ID NO: 1493614 - protein, 23 aa, Mycobacterium tuberculosis
VSTWQGSPTWAFVTDAYARRILG

SEQ ID NO: 1493615 - protein, 20 aa, Mycobacterium tuberculosis
VSVAVAALFGTHAQEYQTVS

SEQ ID NO: 1493616 - protein, 23 aa, Mycobacterium tuberculosis
VSVPPGCVCPLQIALTKVAAEEH

SEQ ID NO: 1493617 - protein, 31 aa, Mycobacterium tuberculosis
VSYADLNRLRWCCWWDSSPKTSRRSCFCGYA

SEQ ID NO: 1493618 - protein, 25 aa, Mycobacterium tuberculosis
VTAAGATAAWAIGRWTPGTERRTAT

SEQ ID NO: 1493619 - protein, 17 aa, Mycobacterium tuberculosis
VTACLPAAAPGDQRVLG

SEQ ID NO: 1493620 - protein, 26 aa, Mycobacterium tuberculosis
VTADPRLNTGLTPFLLGPVYISNNPS

SEQ ID NO: 1493621 - protein, 22 aa, Mycobacterium tuberculosis
VTADVTLTRAWCLRELGDDDAA

SEQ ID NO: 1493622 - protein, 20 aa, Mycobacterium tuberculosis
VTAFLGVADKCIREGRRPAW

SEQ ID NO: 1493623 - protein, 21 aa, Mycobacterium tuberculosis
VTALNFMPGWLDMLLEVGGGR

SEQ ID NO: 1493624 - protein, 19 aa, Mycobacterium tuberculosis
VTATRARLMAPLSGQGGMA

SEQ ID NO: 1493625 - protein, 19 aa, Mycobacterium tuberculosis
VTCPIYRYHPATVAQAFAS

SEQ ID NO: 1493626 - protein, 19 aa, Mycobacterium tuberculosis
VTDDLRPGGPVMVETVSQA

SEQ ID NO: 1493627 - protein, 24 aa, Mycobacterium tuberculosis
VTDQPRPSTQTAIASPAASTEVSH

SEQ ID NO: 1493628 - protein, 17 aa, Mycobacterium tuberculosis
VTDVLGAVVKVFVSGVD

SEQ ID NO: 1493629 - protein, 21 aa, Mycobacterium tuberculosis
VTEIIPLDGFLDGLALYDELD

SEQ ID NO: 1493630 - protein, 17 aa, Mycobacterium tuberculosis
VTEWFAVDWHREIVDKW

SEQ ID NO: 1493631 - protein, 34 aa, Mycobacterium tuberculosis; identical to SEQ ID NO: 208255

SEQ ID NO: 1493632 - protein, 17 aa, Mycobacterium tuberculosis
VTGRRVYGTLPWHPDLW

SEQ ID NO: 1493633 - protein, 23 aa, Mycobacterium tuberculosis
VTGSPIPVGLDPTGVAVNPVTGV

SEQ ID NO: 1493634 - protein, 18 aa, Mycobacterium tuberculosis
VTGTLVHVHRSWLQIPGD

SEQ ID NO: 1493635 - protein, 19 aa, Mycobacterium tuberculosis
VTGVPILFASTGEKLEDFD

SEQ ID NO: 1493636 - protein, 20 aa, Mycobacterium tuberculosis
VTGVPILFASTGEKLEDFDV

SEQ ID NO: 1493637 - protein, 20 aa, Mycobacterium tuberculosis
VTHRTEYRYSDVVTSSYGRG

SEQ ID NO: 1493638 - protein, 19 aa, Mycobacterium tuberculosis
VTHRTEYRYSEVVTSSYGR

SEQ ID NO: 1493639 - protein, 18 aa, Mycobacterium tuberculosis
VTIAELWELFVAEDATLV

SEQ ID NO: 1493640 - protein, 18 aa, Mycobacterium tuberculosis
VTIAKLWELFVAEDATLV

SEQ ID NO: 1493641 - protein, 19 aa, Mycobacterium tuberculosis
VTIRWCPRAASSVASAAPM

SEQ ID NO: 1493642 - protein, 18 aa, Mycobacterium tuberculosis
VTKSTRRILVVPNDDKVK

SEQ ID NO: 1493643 - protein, 19 aa, Mycobacterium tuberculosis
VTLGGTMAKYDWTINGEPY

SEQ ID NO: 1493644 - protein, 18 aa, Mycobacterium tuberculosis
VTLMEFHLMYAAVVGGHA

SEQ ID NO: 1493645 - protein, 25 aa, Mycobacterium tuberculosis
VTMPVPEPMVKMLLNNVLEHLAENL

SEQ ID NO: 1493646 - protein, 26 aa, Mycobacterium tuberculosis
VTNCGNSWPMARLTLALSPATLPKMG

SEQ ID NO: 1493647 - protein, 23 aa, Mycobacterium tuberculosis
VTNPARWALLYGSPVPGYHAPPD

SEQ ID NO: 1493648 - protein, 21 aa, Mycobacterium tuberculosis
VTNRWTLRPADPVGAVTVVTL

SEQ ID NO: 1493649 - protein, 22 aa, Mycobacterium tuberculosis
VTPELRATIEAVWAKLAAPGMC

SEQ ID NO: 1493650 - protein, 28 aa, Mycobacterium tuberculosis
VTPSPRSLRPATAVPAATAANVGVAGQG

SEQ ID NO: 1493651 - protein, 20 aa, Mycobacterium tuberculosis
VTRARVSAVRGVNVDAVAGD

SEQ ID NO: 1493652 - protein, 27 aa, Mycobacterium tuberculosis
VTRRLLPRVPRCIPLAARLAPGTIGCP

SEQ ID NO: 1493653 - protein, 27 aa, Mycobacterium tuberculosis
VTRRSQRCPTCRASGSVWPGAPHRCAV

SEQ ID NO: 1493654 - protein, 24 aa, Mycobacterium tuberculosis
VTSRIRLATAVALPVEHDPITLAK

SEQ ID NO: 1493655 - protein, 19 aa, Mycobacterium tuberculosis
VTSVKWARLDSAPFTDRLV

SEQ ID NO: 1493656 - protein, 25 aa, Mycobacterium tuberculosis
VTTGRTGTGAAWGWGPPSPPMPPAP

SEQ ID NO: 1493657 - protein, 20 aa, Mycobacterium tuberculosis
VTTLCVTWTPAQPGAARVAF

SEQ ID NO: 1493658 - protein, 17 aa, Mycobacterium tuberculosis
VTTLPAVISRWLSSVLP

SEQ ID NO: 1493659 - protein, 24 aa, Mycobacterium tuberculosis
VTTMAACIGGVFRECRPENVIAID

SEQ ID NO: 1493660 - protein, 29 aa, Mycobacterium tuberculosis
VTTMAACIGGVFRECRPENVIAIDAVPSF

SEQ ID NO: 1493661 - protein, 18 aa, Mycobacterium tuberculosis
VTVGEVWVHDNARWAEYL

SEQ ID NO: 1493662 - protein, 18 aa, Mycobacterium tuberculosis
VTVHAIGGVGPLHVAPVP

SEQ ID NO: 1493663 - protein, 19 aa, Mycobacterium tuberculosis
VTVKTTWTGAGGVKGFFEK

SEQ ID NO: 1493664 - protein, 18 aa, Mycobacterium tuberculosis
VTVWQGRTGAMAVPVGWA

SEQ ID NO: 1493665 - protein, 28 aa, Mycobacterium tuberculosis
VVAADWPLLAAAYRTRGALRIVDDLLPA

SEQ ID NO: 1493666 - protein, 31 aa, Mycobacterium tuberculosis
VVAADWPLLAAAYRTRGALRIVDDLLPAPED

SEQ ID NO: 1493667 - protein, 27 aa, Mycobacterium tuberculosis
VVAANRSAFVQLVLSNVFGQNAPAIAA

SEQ ID NO: 1493668 - protein, 20 aa, Mycobacterium tuberculosis
VVAAQPYLAWLTYTAESAAH

SEQ ID NO: 1493669 - protein, 23 aa, Mycobacterium tuberculosis
VVAARLPFGWSADSGVTADIIEA

SEQ ID NO: 1493670 - protein, 19 aa, Mycobacterium tuberculosis
VVAFVGRIQPLKAPDIVLR

SEQ ID NO: 1493671 - protein, 24 aa, Mycobacterium tuberculosis
VVAIGALCFPLGSTGTTKTGATAY

SEQ ID NO: 1493672 - protein, 18 aa, Mycobacterium tuberculosis
VVAPDAFFQFPTSKYGLA

SEQ ID NO: 1493673 - protein, 24 aa, Mycobacterium tuberculosis
VVARDRAQAIAGLRALAAGQHAPG

SEQ ID NO: 1493674 - protein, 18 aa, Mycobacterium tuberculosis
VVASEGWQGQAAEAFVAA

SEQ ID NO: 1493675 - protein, 19 aa, Mycobacterium tuberculosis
VVCEDSLGLAEEFEAAMQR

SEQ ID NO: 1493676 - protein, 19 aa, Mycobacterium tuberculosis
VVCFPDRWLDLRYVGPASA

SEQ ID NO: 1493677 - protein, 17 aa, Mycobacterium tuberculosis
VVCLHSYLYPGHEREIG

SEQ ID NO: 1493678 - protein, 19 aa, Mycobacterium tuberculosis
VVDALAWVMGEQGAKTLRG

SEQ ID NO: 1493679 - protein, 23 aa, Mycobacterium tuberculosis
VVDAPWAPFAVDFHLANVGGPSA

SEQ ID NO: 1493680 - protein, 17 aa, Mycobacterium tuberculosis
VVDPDFNLDFHVRRVRV

SEQ ID NO: 1493681 - protein, 19 aa, Mycobacterium tuberculosis
VVDPRARIVILVDDGIATG

SEQ ID NO: 1493682 - protein, 18 aa, Mycobacterium tuberculosis
VVDRPAWIRSAAESMRAM

SEQ ID NO: 1493683 - protein, 19 aa, Mycobacterium tuberculosis
VVDRPAWIRSAAESMRAMT

SEQ ID NO: 1493684 - protein, 18 aa, Mycobacterium tuberculosis
VVEALRDGYAAVVPVLPL

SEQ ID NO: 1493685 - protein, 20 aa, Mycobacterium tuberculosis
VVEGVKLVDGRAFSVQYHPE

SEQ ID NO: 1493686 - protein, 22 aa, Mycobacterium tuberculosis
VVEGVKLVDGRAFSVQYHPEAA

SEQ ID NO: 1493687 - protein, 24 aa, Mycobacterium tuberculosis
VVEKRFNLSWSIEGTRSRTGKMLP

SEQ ID NO: 1493688 - protein, 38 aa, Mycobacterium tuberculosis; identical to SEQ ID NO: 1375822

SEQ ID NO: 1493689 - protein, 18 aa, Mycobacterium tuberculosis
VVFAGAYHGWGFHEDGAA

SEQ ID NO: 1493690 - protein, 23 aa, Mycobacterium tuberculosis
VVFAGAYHGWGFHEDGAASGLRA

SEQ ID NO: 1493691 - protein, 17 aa, Mycobacterium tuberculosis
VVFNAEISAAIEERLSR

SEQ ID NO: 1493692 - protein, 17 aa, Mycobacterium tuberculosis
VVFPDAPVKIFLTASAE

SEQ ID NO: 1493693 - protein, 23 aa, Mycobacterium tuberculosis
VVGFIWEVLGRIGIGRKDALVSL

SEQ ID NO: 1493694 - protein, 17 aa, Mycobacterium tuberculosis
VVGLGRNGGDGGDGGGL

SEQ ID NO: 1493695 - protein, 21 aa, Mycobacterium tuberculosis
VVGMAGRFPGAKDVSAFWSNL

SEQ ID NO: 1493696 - protein, 18 aa, Mycobacterium tuberculosis
VVGMSGLLVKSTVVMKEN

SEQ ID NO: 1493697 - protein, 25 aa, Mycobacterium tuberculosis
VVGRGRPADRPALLGAVKTNVGHLE

SEQ ID NO: 1493698 - protein, 17 aa, Mycobacterium tuberculosis
VVGRKAFARFAGYSSVM

SEQ ID NO: 1493699 - protein, 17 aa, Mycobacterium tuberculosis
VVGRVGALLALAALIHR

SEQ ID NO: 1493700 - protein, 17 aa, Mycobacterium tuberculosis
VVHPRSWLLRQASSGVS

SEQ ID NO: 1493701 - protein, 18 aa, Mycobacterium tuberculosis
VVHWYAGDLDRLYAKPDQ

SEQ ID NO: 1493702 - protein, 19 aa, Mycobacterium tuberculosis
VVIDGRICRPGWVHTADGR

SEQ ID NO: 1493703 - protein, 17 aa, Mycobacterium tuberculosis
VVINPFFDWAYDRSPRT

SEQ ID NO: 1493704 - protein, 17 aa, Mycobacterium tuberculosis
VVITGNPVTGWRLVEWD

SEQ ID NO: 1493705 - protein, 20 aa, Mycobacterium tuberculosis
VVKLLNRFFAIVVNEVDRHH

SEQ ID NO: 1493706 - protein, 22 aa, Mycobacterium tuberculosis
VVKQAAAFHSEFTRTLEAAGNA

SEQ ID NO: 1493707 - protein, 18 aa, Mycobacterium tuberculosis
VVLPWRRVRWSDTAHTAE

SEQ ID NO: 1493708 - protein, 18 aa, Mycobacterium tuberculosis
VVMSYSYFVELPRLEDIE

SEQ ID NO: 1493709 - protein, 19 aa, Mycobacterium tuberculosis
VVNILWAHRAAVEHPVTCP

SEQ ID NO: 1493710 - protein, 18 aa, Mycobacterium tuberculosis
VVNLHRRYRITTAQLAAA

SEQ ID NO: 1493711 - protein, 25 aa, Mycobacterium tuberculosis
VVNLHRRYRITTARLAAATEERFSD

SEQ ID NO: 1493712 - protein, 22 aa, Mycobacterium tuberculosis
VVPELPKTRSGKIMRRLLRDVA

SEQ ID NO: 1493713 - protein, 19 aa, Mycobacterium tuberculosis
VVPETFVPQAFVPEAVAPE

SEQ ID NO: 1493714 - protein, 19 aa, Mycobacterium tuberculosis
VVPGAARVIPAWRPRSCTP

SEQ ID NO: 1493715 - protein, 23 aa, Mycobacterium tuberculosis
VVPIDLWNPDGVTVDLADAVYVA

SEQ ID NO: 1493716 - protein, 17 aa, Mycobacterium tuberculosis
VVPQPRLGWRGRASTRI

SEQ ID NO: 1493717 - protein, 26 aa, Mycobacterium tuberculosis
VVQARPGCRPSLAELDSFVRSEIAGY

SEQ ID NO: 1493718 - protein, 25 aa, Mycobacterium tuberculosis
VVQRLRAGSVPHLPGSVPQLPGSVL

SEQ ID NO: 1493719 - protein, 17 aa, Mycobacterium tuberculosis
VVRAQRLAVTATLGGNG

SEQ ID NO: 1493720 - protein, 23 aa, Mycobacterium tuberculosis
VVRAVHRCLLAGRFATALGADDD

SEQ ID NO: 1493721 - protein, 17 aa, Mycobacterium tuberculosis
VVRCLRERIPNLHFSVS

SEQ ID NO: 1493722 - protein, 19 aa, Mycobacterium tuberculosis
VVRKAYRPSHEKLAWARRV

SEQ ID NO: 1493723 - protein, 17 aa, Mycobacterium tuberculosis
VVRKDTHAHAWALRMSP

SEQ ID NO: 1493724 - protein, 24 aa, Mycobacterium tuberculosis
VVRRGRHATVHRCPAQWLRADDRR

SEQ ID NO: 1493725 - protein, 24 aa, Mycobacterium tuberculosis
VVRTLTVDAGAYVSAEAANAGPNM

SEQ ID NO: 1493726 - protein, 20 aa, Mycobacterium tuberculosis
VVRVLKPGGRFVFAGEPTTV

SEQ ID NO: 1493727 - protein, 22 aa, Mycobacterium tuberculosis
VVSALDRTAHEIVLTRTRDGGG

SEQ ID NO: 1493728 - protein, 24 aa, Mycobacterium tuberculosis
VVSELFLRAAQAYGVKRGQRMLGL

SEQ ID NO: 1493729 - protein, 23 aa, Mycobacterium tuberculosis
VVSLSWRTGDDIVVTRTDAAHPV

SEQ ID NO: 1493730 - protein, 19 aa, Mycobacterium tuberculosis
VVSPGDLWDLLRDGREAAG

SEQ ID NO: 1493731 - protein, 18 aa, Mycobacterium tuberculosis
VVSVARCSHRLEHVEMVT

SEQ ID NO: 1493732 - protein, 17 aa, Mycobacterium tuberculosis
VVTDHVWHRGQQVGLVD

SEQ ID NO: 1493733 - protein, 20 aa, Mycobacterium tuberculosis
VVVACSAISHASRRRAQRRL

SEQ ID NO: 1493734 - protein, 20 aa, Mycobacterium tuberculosis
VVVEIAERLVLVAGAEVAAV

SEQ ID NO: 1493735 - protein, 17 aa, Mycobacterium tuberculosis
VVVLKRLPDALADGDRI

SEQ ID NO: 1493736 - protein, 18 aa, Mycobacterium tuberculosis
VVVLKRLPDALADGDRIL

SEQ ID NO: 1493737 - protein, 25 aa, Mycobacterium tuberculosis
VVVSGRWPFCSGINHADIMFAGCFV

SEQ ID NO: 1493738 - protein, 18 aa, Mycobacterium tuberculosis
VWCGMTIPRVYPEMPENL

SEQ ID NO: 1493739 - protein, 24 aa, Mycobacterium tuberculosis
VWCSDIRAGAGLVLAGLVADGDTE

SEQ ID NO: 1493740 - protein, 18 aa, Mycobacterium tuberculosis
VWHLCTAITGRLRNISTT

SEQ ID NO: 1493741 - protein, 17 aa, Mycobacterium tuberculosis
VWKGIRYAAPPLGDLRF

SEQ ID NO: 1493742 - protein, 20 aa, Mycobacterium tuberculosis
VWLEAGKQGFLGMAVPEEYG

SEQ ID NO: 1493743 - protein, 22 aa, Mycobacterium tuberculosis
VWNTILAIGFEWGVALQHLEIG

SEQ ID NO: 1493744 - protein, 20 aa, Mycobacterium tuberculosis
VWPALCRPAGNPISMRSLAP

SEQ ID NO: 1493745 - protein, 18 aa, Mycobacterium tuberculosis
VWRAGGYRRRTFALERGE

SEQ ID NO: 1493746 - protein, 21 aa, Mycobacterium tuberculosis
VWRAGTALHQGLVLNFGLADV

SEQ ID NO: 1493747 - protein, 26 aa, Mycobacterium tuberculosis
VWRDREPALASPRRPQAPVVPIISSA

SEQ ID NO: 1493748 - protein, 19 aa, Mycobacterium tuberculosis
VWRTFGQERLDAMASVATV

SEQ ID NO: 1493749 - protein, 17 aa, Mycobacterium tuberculosis
VWSRRWRQPWAPPTSVA

SEQ ID NO: 1493750 - protein, 18 aa, Mycobacterium tuberculosis
VWTERGGPATIVPMFLLY

SEQ ID NO: 1493751 - protein, 26 aa, Mycobacterium tuberculosis
VWVRDTLRLGGKFPLKAGMLTSLGFG

SEQ ID NO: 1493752 - protein, 22 aa, Mycobacterium tuberculosis
VWWPECSKEAYADGIAGAVDAY

SEQ ID NO: 1493753 - protein, 19 aa, Mycobacterium tuberculosis
VWWPECSKEAYADGIDGAV

SEQ ID NO: 1493754 - protein, 20 aa, Mycobacterium tuberculosis
VWWPECSKEAYADGIDGAVD

SEQ ID NO: 1493755 - protein, 17 aa, Mycobacterium tuberculosis
VYEPLVVLLPAMPAAAP

SEQ ID NO: 1493756 - protein, 20 aa, Mycobacterium tuberculosis
VYERLGIPTIATVPWTTDRL

SEQ ID NO: 1493757 - protein, 17 aa, Mycobacterium tuberculosis
VYERLKDDFVLRERGHI

SEQ ID NO: 1493758 - protein, 17 aa, Mycobacterium tuberculosis
VYFDYWSARGVDVTPFF

SEQ ID NO: 1493759 - protein, 26 aa, Mycobacterium tuberculosis
VYGNTRLGLFPFRRGLTFYYLDLALM

SEQ ID NO: 1493760 - protein, 26 aa, Mycobacterium tuberculosis
VYGVDPLILRQAYPVRQAPYGLAGSR

SEQ ID NO: 1493761 - protein, 22 aa, Mycobacterium tuberculosis
VYLADCRKLGITVLPPDVNESG

SEQ ID NO: 1493762 - protein, 18 aa, Mycobacterium tuberculosis
VYLPPGRSAYVAARSLSG

SEQ ID NO: 1493763 - protein, 23 aa, Mycobacterium tuberculosis
VYRRPHTRRWAGPAFLLNQMLVW

SEQ ID NO: 1493764 - protein, 24 aa, Mycobacterium tuberculosis
VYSRGDVGTGWVLHAEGALRAGSR

SEQ ID NO: 1493765 - protein, 26 aa, Mycobacterium tuberculosis
VYTETKLNSAFSFGGPKCLVKVIQKL

SEQ ID NO: 1493766 - protein, 20 aa, Mycobacterium tuberculosis
VYYRVFGGWLRQRRNIRDMT

SEQ ID NO: 1493767 - protein, 25 aa, Mycobacterium tuberculosis
WAAAGRDGLPQIVALDVKPVPDKLA

SEQ ID NO: 1493768 - protein, 19 aa, Mycobacterium tuberculosis
WAADVAAMLGYHGEASAVA

SEQ ID NO: 1493769 - protein, 22 aa, Mycobacterium tuberculosis
WAAEACGEYAPDLDIVGAVLGS

SEQ ID NO: 1493770 - protein, 19 aa, Mycobacterium tuberculosis
WAAPSTRPVSALSPAGLTT

SEQ ID NO: 1493771 - protein, 22 aa, Mycobacterium tuberculosis
WAAPTPASPTWASPTRAATTPA

SEQ ID NO: 1493772 - protein, 17 aa, Mycobacterium tuberculosis
WACVDLELHPGRTVFVG

SEQ ID NO: 1493773 - protein, 21 aa, Mycobacterium tuberculosis
WADAIDHLLRLCAGPRGRVMS

SEQ ID NO: 1493774 - protein, 23 aa, Mycobacterium tuberculosis
WADKYRGRFDVGWAGTHCERKPS

SEQ ID NO: 1493775 - protein, 19 aa, Mycobacterium tuberculosis
WADLRRRVAALAGALSGRG

SEQ ID NO: 1493776 - protein, 19 aa, Mycobacterium tuberculosis
WADSFRLALVAAHDDGDSL

SEQ ID NO: 1493777 - protein, 21 aa, Mycobacterium tuberculosis
WAEGAAAPWTRRSPTHNAVAA

SEQ ID NO: 1493778 - protein, 23 aa, Mycobacterium tuberculosis
WAERRGRGDDRWCEIPVGAKPNG

SEQ ID NO: 1493779 - protein, 21 aa, Mycobacterium tuberculosis
WAETYPGTLSYYLASAFGEVW

SEQ ID NO: 1493780 - protein, 18 aa, Mycobacterium tuberculosis
WAEVRPGPDAQLYRDYHD

SEQ ID NO: 1493781 - protein, 20 aa, Mycobacterium tuberculosis
WAGAVALAACSAMVDSAGPV

SEQ ID NO: 1493782 - protein, 23 aa, Mycobacterium tuberculosis
WAGEIDPSLRLRPSRGTHLVFDA

SEQ ID NO: 1493783 - protein, 27 aa, Mycobacterium tuberculosis
WAGGSELGFRLAFAEGYSHAMTLNNDT

SEQ ID NO: 1493784 - protein, 17 aa, Mycobacterium tuberculosis
WAGSAHRKTRPGPAADI

SEQ ID NO: 1493785 - protein, 17 aa, Mycobacterium tuberculosis
WAGTLIVVSHDRYLLER

SEQ ID NO: 1493786 - protein, 17 aa, Mycobacterium tuberculosis
WAGVPIFVRAGKELPAK

SEQ ID NO: 1493787 - protein, 29 aa, Mycobacterium tuberculosis
WAGVTSVSIPSWWQPYVLSVASLTSAGQP

SEQ ID NO: 1493788 - protein, 21 aa, Mycobacterium tuberculosis
WAISELDLAPVYLNFAENSHL

SEQ ID NO: 1493789 - protein, 21 aa, Mycobacterium tuberculosis
WAQAYGFPLMPIDGILVGTAA

SEQ ID NO: 1493790 - protein, 17 aa, Mycobacterium tuberculosis
WAQDVAVMAGYHAASSA

SEQ ID NO: 1493791 - protein, 26 aa, Mycobacterium tuberculosis
WAQRLSHRWECSRSGTVVDRLADIAV

SEQ ID NO: 1493792 - protein, 17 aa, Mycobacterium tuberculosis
WARAGTLATALSAEPAI

SEQ ID NO: 1493793 - protein, 18 aa, Mycobacterium tuberculosis
WARSGCCRAPAGTAGRPE

SEQ ID NO: 1493794 - protein, 17 aa, Mycobacterium tuberculosis
WASVFSGYRPKRVELPT

SEQ ID NO: 1493795 - protein, 18 aa, Mycobacterium tuberculosis
WATLRPGHDTGPRHASGR

SEQ ID NO: 1493796 - protein, 19 aa, Mycobacterium tuberculosis
WATPPSRARTSWCGMAATA

SEQ ID NO: 1493797 - protein, 18 aa, Mycobacterium tuberculosis
WAVGEGQRGILSRGMGWG

SEQ ID NO: 1493798 - protein, 21 aa, Mycobacterium tuberculosis
WAYAASRPDNVARLILDSPIA

SEQ ID NO: 1493799 - protein, 18 aa, Mycobacterium tuberculosis
WCALAETYGDDWHRWPKS

SEQ ID NO: 1493800 - protein, 17 aa, Mycobacterium tuberculosis
WCHEAGIELATVYLLST

SEQ ID NO: 1493801 - protein, 23 aa, Mycobacterium tuberculosis
WCSDIRAGAGLVLAGLVADGDTE

SEQ ID NO: 1493802 - protein, 17 aa, Mycobacterium tuberculosis
WCSRTTRLYPNMTVAAK

SEQ ID NO: 1493803 - protein, 25 aa, Mycobacterium tuberculosis
WDAVIAVHLRGHFLLTRNAAAYCGT

SEQ ID NO: 1493804 - protein, 26 aa, Mycobacterium tuberculosis
WDAVIAVHLRGHFLLTRNAAAYWRDK

SEQ ID NO: 1493805 - protein, 19 aa, Mycobacterium tuberculosis
WDDLLLPGIEVITPSPLSS

SEQ ID NO: 1493806 - protein, 23 aa, Mycobacterium tuberculosis
WDDPESWTLATYQRHDRYRGYQA

SEQ ID NO: 1493807 - protein, 20 aa, Mycobacterium tuberculosis
WDEQWQCDRCSVVHQRDDCA

SEQ ID NO: 1493808 - protein, 21 aa, Mycobacterium tuberculosis
WDGEGAVGRWWARQPELTAAC

SEQ ID NO: 1493809 - protein, 18 aa, Mycobacterium tuberculosis
WDITPGDLATIWRGGCII

SEQ ID NO: 1493810 - protein, 23 aa, Mycobacterium tuberculosis
WDLFRYPGIRSDSDMYTLGFRFR

SEQ ID NO: 1493811 - protein, 23 aa, Mycobacterium tuberculosis
WDLLCAGRSGIVRVPAQRWDADA

SEQ ID NO: 1493812 - protein, 20 aa, Mycobacterium tuberculosis
WDLLQRSRISAVSVDASTLQ

SEQ ID NO: 1493813 - protein, 18 aa, Mycobacterium tuberculosis
WDPAELGPVVSDLLAKSR

SEQ ID NO: 1493814 - protein, 21 aa, Mycobacterium tuberculosis
WDPARWPLPVLPSSRSGPAPQ

SEQ ID NO: 1493815 - protein, 26 aa, Mycobacterium tuberculosis
WDPFPEFLGGLRFAGAQVVPIRVYRW

SEQ ID NO: 1493816 - protein, 17 aa, Mycobacterium tuberculosis
WDQLMQAVTAYREQGFI

SEQ ID NO: 1493817 - protein, 17 aa, Mycobacterium tuberculosis
WDQRAPIGWNMKDATPV

SEQ ID NO: 1493818 - protein, 19 aa, Mycobacterium tuberculosis
WDQRLCAVPDADMFKAIRD

SEQ ID NO: 1493819 - protein, 18 aa, Mycobacterium tuberculosis
WDRPFALAGVDIGASVAA

SEQ ID NO: 1493820 - protein, 26 aa, Mycobacterium tuberculosis
WDVAADVWSVTSWGELNRDGVAIETE

SEQ ID NO: 1493821 - protein, 19 aa, Mycobacterium tuberculosis
WDWAVDWDTWVSMSALPPP

SEQ ID NO: 1493822 - protein, 18 aa, Mycobacterium tuberculosis
WEALEHAGIPPGTLRRSA

SEQ ID NO: 1493823 - protein, 20 aa, Mycobacterium tuberculosis
WEALERAGIDPITLRGSQTG

SEQ ID NO: 1493824 - protein, 23 aa, Mycobacterium tuberculosis
WEGRAVGLAQRWGSRNPIPWSGL

SEQ ID NO: 1493825 - protein, 17 aa, Mycobacterium tuberculosis
WEHLSASRVARARRTLD

SEQ ID NO: 1493826 - protein, 18 aa, Mycobacterium tuberculosis
WEPPMFEMDITGLASGNC

SEQ ID NO: 1493827 - protein, 20 aa, Mycobacterium tuberculosis
WEPVPACARPRPVTAGEVVA

SEQ ID NO: 1493828 - protein, 17 aa, Mycobacterium tuberculosis
WERIPVHVCHTIADVVD

SEQ ID NO: 1493829 - protein, 21 aa, Mycobacterium tuberculosis
WERLWPELGLLALPQSPRGTP

SEQ ID NO: 1493830 - protein, 20 aa, Mycobacterium tuberculosis
WERVVEAFAPAHVVEFFATT

SEQ ID NO: 1493831 - protein, 17 aa, Mycobacterium tuberculosis
WEVPYYPQYYIPLADVR

SEQ ID NO: 1493832 - protein, 21 aa, Mycobacterium tuberculosis
WEYTTKTSRIGSCAIGETTQT

SEQ ID NO: 1493833 - protein, 23 aa, Mycobacterium tuberculosis
WFERDGQVIGCGRTTRQINLNRP

SEQ ID NO: 1493834 - protein, 18 aa, Mycobacterium tuberculosis
WFEVQSIRGHLVDGAVAH

SEQ ID NO: 1493835 - protein, 22 aa, Mycobacterium tuberculosis
WFLRRFSLLDSLYMVPSVPIIG

SEQ ID NO: 1493836 - protein, 20 aa, Mycobacterium tuberculosis
WFPFPDNSGLDWGALGECDY

SEQ ID NO: 1493837 - protein, 20 aa, Mycobacterium tuberculosis
WFSSALWPFSTLGWPDKTAE

SEQ ID NO: 1493838 - protein, 21 aa, Mycobacterium tuberculosis
WFSSALWPFSTLGWPDKTAEL

SEQ ID NO: 1493839 - protein, 19 aa, Mycobacterium tuberculosis
WFSYVCPGAGHAPHHVFKE

SEQ ID NO: 1493840 - protein, 18 aa, Mycobacterium tuberculosis
WGDVAMMLSLPYQGLGNA

SEQ ID NO: 1493841 - protein, 17 aa, Mycobacterium tuberculosis
WGEFGAFVEYQSAQACA

SEQ ID NO: 1493842 - protein, 22 aa, Mycobacterium tuberculosis
WGELYLPRFLFGVFLSEQMIAA

SEQ ID NO: 1493843 - protein, 19 aa, Mycobacterium tuberculosis
WGFDPTHRRGYGLDTVVHN

SEQ ID NO: 1493844 - protein, 19 aa, Mycobacterium tuberculosis
WGFDPTHRRSYGLDTVVHN

SEQ ID NO: 1493845 - protein, 19 aa, Mycobacterium tuberculosis
WGFGNNGIGNIGFGNTGNG

SEQ ID NO: 1493846 - protein, 18 aa, Mycobacterium tuberculosis
WGGFPLRDRVAAAVPGVP

SEQ ID NO: 1493847 - protein, 17 aa, Mycobacterium tuberculosis
WGGPVAFIMMLRHPEKV

SEQ ID NO: 1493848 - protein, 17 aa, Mycobacterium tuberculosis
WGHDRVAQVITFGTIKT

SEQ ID NO: 1493849 - protein, 18 aa, Mycobacterium tuberculosis
WGIAAAMTRGDISVAGVD

SEQ ID NO: 1493850 - protein, 17 aa, Mycobacterium tuberculosis
WGLDPYLTPGFTELSSQ

SEQ ID NO: 1493851 - protein, 19 aa, Mycobacterium tuberculosis
WGLDPYLTPGFTELSSQAG

SEQ ID NO: 1493852 - protein, 18 aa, Mycobacterium tuberculosis
WGLVSAVYPAADFDAEVD

SEQ ID NO: 1493853 - protein, 23 aa, Mycobacterium tuberculosis
WGQWCGPCRAEVSQLQRVYDATR

SEQ ID NO: 1493854 - protein, 27 aa, Mycobacterium tuberculosis
WGRGARRGRRGGCRRGQPPDRPGGPGQ

SEQ ID NO: 1493855 - protein, 17 aa, Mycobacterium tuberculosis
WGSARRRPAGWPLSCST

SEQ ID NO: 1493856 - protein, 19 aa, Mycobacterium tuberculosis
WGTLTPGRRQGLWRGESQH

SEQ ID NO: 1493857 - protein, 26 aa, Mycobacterium tuberculosis
WGTPRPRWRSAQALTSRSCNGSLDTQ

SEQ ID NO: 1493858 - protein, 18 aa, Mycobacterium tuberculosis
WGTSVMRTAGGRHRRSAC

SEQ ID NO: 1493859 - protein, 20 aa, Mycobacterium tuberculosis
WGVSASRARAILSSRHIHRV

SEQ ID NO: 1493860 - protein, 17 aa, Mycobacterium tuberculosis
WHAESSWAARVSLAHAL

SEQ ID NO: 1493861 - protein, 24 aa, Mycobacterium tuberculosis
WHAPGWPPRSSHRPSYSGEPAPTY

SEQ ID NO: 1493862 - protein, 17 aa, Mycobacterium tuberculosis
WHDGTLEFVGRADHRVK

SEQ ID NO: 1493863 - protein, 26 aa, Mycobacterium tuberculosis
WHKEYGSACNLVFPIGIIDRPYKHDQ

SEQ ID NO: 1493864 - protein, 19 aa, Mycobacterium tuberculosis
WHRMVALTIRARVATARGE

SEQ ID NO: 1493865 - protein, 23 aa, Mycobacterium tuberculosis
WHRRVPDRYPEVIVQAVSADDIV

SEQ ID NO: 1493866 - protein, 18 aa, Mycobacterium tuberculosis
WHRYGLASMRSQWGYSAR

SEQ ID NO: 1493867 - protein, 23 aa, Mycobacterium tuberculosis
WHSLPTDRPIIYATLGSSGGKNL

SEQ ID NO: 1493868 - protein, 19 aa, Mycobacterium tuberculosis
WHSQRGGSAVSHYRSNVRD

SEQ ID NO: 1493869 - protein, 19 aa, Mycobacterium tuberculosis
WIARSADGWITTPRDVDID

SEQ ID NO: 1493870 - protein, 19 aa, Mycobacterium tuberculosis
WIIILDDWTDGIGKSPQQL

SEQ ID NO: 1493871 - protein, 20 aa, Mycobacterium tuberculosis
WIKAQAYRLQTFGTVTRLAA

SEQ ID NO: 1493872 - protein, 24 aa, Mycobacterium tuberculosis
WILRRILRRLGYAAYGWGLGRNIG

SEQ ID NO: 1493873 - protein, 17 aa, Mycobacterium tuberculosis
WISKAYIDSYRGPRDDS

SEQ ID NO: 1493874 - protein, 24 aa, Mycobacterium tuberculosis
WITSPRIPAAHARLCGSKVPRSSV

SEQ ID NO: 1493875 - protein, 21 aa, Mycobacterium tuberculosis
WKAPAVTTVRAFDATPMTTLP

SEQ ID NO: 1493876 - protein, 17 aa, Mycobacterium tuberculosis
WKDGRRLVASVVAPTRD

SEQ ID NO: 1493877 - protein, 28 aa, Mycobacterium tuberculosis
WKPFSSARCPITICAAAAPTSKWSAGKV

SEQ ID NO: 1493878 - protein, 19 aa, Mycobacterium tuberculosis
WKPPKNALEDLLQQKSPPP

SEQ ID NO: 1493879 - protein, 26 aa, Mycobacterium tuberculosis
WKPSELTPLTALACQALLSRAAADVA

SEQ ID NO: 1493880 - protein, 19 aa, Mycobacterium tuberculosis
WKPSELTPLTALASQALLS

SEQ ID NO: 1493881 - protein, 24 aa, Mycobacterium tuberculosis
WKPVGGFPVTFGWIHASRRGHARL

SEQ ID NO: 1493882 - protein, 25 aa, Mycobacterium tuberculosis
WKQWDRCALHWFPGSHLLACEPVGL

SEQ ID NO: 1493883 - protein, 18 aa, Mycobacterium tuberculosis
WKTCSLTPSSGWPTRASA

SEQ ID NO: 1493884 - protein, 22 aa, Mycobacterium tuberculosis
WLAALRGSARLSDWHPQRGVRA

SEQ ID NO: 1493885 - protein, 17 aa, Mycobacterium tuberculosis
WLAALRGSARLVIGTRS

SEQ ID NO: 1493886 - protein, 17 aa, Mycobacterium tuberculosis
WLADPAPFLQQYLATSS

SEQ ID NO: 1493887 - protein, 19 aa, Mycobacterium tuberculosis
WLADQSWRDGRVVMLGVSY

SEQ ID NO: 1493888 - protein, 17 aa, Mycobacterium tuberculosis
WLAHNRSGAGLFGSIAQ

SEQ ID NO: 1493889 - protein, 20 aa, Mycobacterium tuberculosis
WLAPGGFNFDAWRFENRCEL

SEQ ID NO: 1493890 - protein, 21 aa, Mycobacterium tuberculosis
WLAPGGFNFDAWRFENRCELL

SEQ ID NO: 1493891 - protein, 29 aa, Mycobacterium tuberculosis
WLDPFTEFRFPRIGTAVFDGIEIELRGAI

SEQ ID NO: 1493892 - protein, 18 aa, Mycobacterium tuberculosis
WLDSPSLMVADMFAARTI

SEQ ID NO: 1493893 - protein, 20 aa, Mycobacterium tuberculosis
WLEGLFHGIQTALFAQQMAA

SEQ ID NO: 1493894 - protein, 19 aa, Mycobacterium tuberculosis
WLEVPLPPGVLRWQQDHGR

SEQ ID NO: 1493895 - protein, 25 aa, Mycobacterium tuberculosis
WLEYELDAAKLLDFPVMTDMRDPLT

SEQ ID NO: 1493896 - protein, 20 aa, Mycobacterium tuberculosis
WLGDGNFLLLGYQRCRVADG

SEQ ID NO: 1493897 - protein, 23 aa, Mycobacterium tuberculosis
WLGRHGYSVTMVERHPGLRPGGQ

SEQ ID NO: 1493898 - protein, 17 aa, Mycobacterium tuberculosis
WLHEQGIALTMSDLRFL

SEQ ID NO: 1493899 - protein, 17 aa, Mycobacterium tuberculosis
WLLGNGESPQWSADAKF

SEQ ID NO: 1493900 - protein, 26 aa, Mycobacterium tuberculosis
WLLGNGGGRRGRRGRLNQGCHWWAGW

SEQ ID NO: 1493901 - protein, 19 aa, Mycobacterium tuberculosis
WLLGNRESRNGEGLGACRY

SEQ ID NO: 1493902 - protein, 20 aa, Mycobacterium tuberculosis
WLLNAECLLGVAAADTPMDL

SEQ ID NO: 1493903 - protein, 27 aa, Mycobacterium tuberculosis
WLPFGGGVRRCLGFGFALTEGAVILQE

SEQ ID NO: 1493904 - protein, 17 aa, Mycobacterium tuberculosis
WLPGCSWPPNVPQRRGQ

SEQ ID NO: 1493905 - protein, 19 aa, Mycobacterium tuberculosis
WLRELWGGPFMLKGVMRVD

SEQ ID NO: 1493906 - protein, 20 aa, Mycobacterium tuberculosis
WLRERPREMARTVFIELLAW

SEQ ID NO: 1493907 - protein, 17 aa, Mycobacterium tuberculosis
WLRPASCTTALRRPTAV

SEQ ID NO: 1493908 - protein, 17 aa, Mycobacterium tuberculosis
WLRRRTGAEHPAVAWAT

SEQ ID NO: 1493909 - protein, 18 aa, Mycobacterium tuberculosis
WLRTADRGSWALADATVD

SEQ ID NO: 1493910 - protein, 20 aa, Mycobacterium tuberculosis
WLSGQLGRPLSLIAETDRND

SEQ ID NO: 1493911 - protein, 17 aa, Mycobacterium tuberculosis
WLSLYAFSTENWKRSPE

SEQ ID NO: 1493912 - protein, 21 aa, Mycobacterium tuberculosis
WLTATRARNALVLVRGKPTDQ

SEQ ID NO: 1493913 - protein, 24 aa, Mycobacterium tuberculosis
WLTATRARNALVLVRGKPTDQLPG

SEQ ID NO: 1493914 - protein, 21 aa, Mycobacterium tuberculosis
WLTDCDYEWTQHWRVASGLGV

SEQ ID NO: 1493915 - protein, 18 aa, Mycobacterium tuberculosis
WLTSPRHWPCSAAAVRHS

SEQ ID NO: 1493916 - protein, 20 aa, Mycobacterium tuberculosis
WMISELDLRQMLHVTPRHRC

SEQ ID NO: 1493917 - protein, 17 aa, Mycobacterium tuberculosis
WMLLAAIEALIDEQDYL

SEQ ID NO: 1493918 - protein, 23 aa, Mycobacterium tuberculosis
WMLQSRLKALRIFDRKPIPKWGS

SEQ ID NO: 1493919 - protein, 17 aa, Mycobacterium tuberculosis
WMRAREALIKTDIFGSA

SEQ ID NO: 1493920 - protein, 18 aa, Mycobacterium tuberculosis
WNAGNVNTGFGIITDSGL

SEQ ID NO: 1493921 - protein, 20 aa, Mycobacterium tuberculosis
WNGFQAGGPVRTVKLFSQPT

SEQ ID NO: 1493922 - protein, 18 aa, Mycobacterium tuberculosis
WNIAGNLGNSGFLNVGPL

SEQ ID NO: 1493923 - protein, 18 aa, Mycobacterium tuberculosis
WNPEFLREGFAVHDTLNP

SEQ ID NO: 1493924 - protein, 19 aa, Mycobacterium tuberculosis
WNPETGKYGPIYDEKTGTM

SEQ ID NO: 1493925 - protein, 25 aa, Mycobacterium tuberculosis
WNPQRASSMPVNRYRPFAEEVEPIR

SEQ ID NO: 1493926 - protein, 17 aa, Mycobacterium tuberculosis
WNPRFIVVGANADLGAV

SEQ ID NO: 1493927 - protein, 22 aa, Mycobacterium tuberculosis
WNQAMGGSRAGLPSVPASTTPD

SEQ ID NO: 1493928 - protein, 17 aa, Mycobacterium tuberculosis
WNRSWGRAGSSSRPRGY

SEQ ID NO: 1493929 - protein, 17 aa, Mycobacterium tuberculosis
WNSALLSGPSGRANRNE

SEQ ID NO: 1493930 - protein, 17 aa, Mycobacterium tuberculosis
WNTAFAGIGNSGLQNFG

SEQ ID NO: 1493931 - protein, 20 aa, Mycobacterium tuberculosis
WNTLYRKWLTVLGPAPAPPT

SEQ ID NO: 1493932 - protein, 21 aa, Mycobacterium tuberculosis
WNTLYRKWLTVLGPAPAPPTP

SEQ ID NO: 1493933 - protein, 40 aa, Mycobacterium tuberculosis
WNWGWRRYTWPSAFDKVWRGGARPVFWLSLDGGRPRCARL

SEQ ID NO: 1493934 - protein, 17 aa, Mycobacterium tuberculosis
WPAAPPAPPRPATPPTP

SEQ ID NO: 1493935 - protein, 18 aa, Mycobacterium tuberculosis
WPAGGAWSNDSVSCPRSG

SEQ ID NO: 1493936 - protein, 23 aa, Mycobacterium tuberculosis
WPAHRRAGPHGGLQEHRADLYVQ

SEQ ID NO: 1493937 - protein, 24 aa, Mycobacterium tuberculosis
WPALAPRMPIWRGSGWAPNRRGRP

SEQ ID NO: 1493938 - protein, 26 aa, Mycobacterium tuberculosis
WPANPRFLMCTPLSHAGAAFFTPTVI

SEQ ID NO: 1493939 - protein, 17 aa, Mycobacterium tuberculosis
WPAPARCCRHEWRTMRR

SEQ ID NO: 1493940 - protein, 21 aa, Mycobacterium tuberculosis
WPARQLVDDRWVWLPTLLAGR

SEQ ID NO: 1493941 - protein, 21 aa, Mycobacterium tuberculosis
WPATPARLPFTLGAGAHLQAD

SEQ ID NO: 1493942 - protein, 20 aa, Mycobacterium tuberculosis
WPAVCSGLRSEARNGLMLPY

SEQ ID NO: 1493943 - protein, 18 aa, Mycobacterium tuberculosis
WPDRLAVADAGDRPGHGG

SEQ ID NO: 1493944 - protein, 18 aa, Mycobacterium tuberculosis
WPELIPLLQSGRLDVDGI

SEQ ID NO: 1493945 - protein, 21 aa, Mycobacterium tuberculosis
WPEPLRTATLAGRGAARPTAQ

SEQ ID NO: 1493946 - protein, 32 aa, Mycobacterium tuberculosis
WPFDQLSELWKAISPHLSPLSNIVSMLNNHVS

SEQ ID NO: 1493947 - protein, 20 aa, Mycobacterium tuberculosis
WPGLVRHRTCMVGRRHADLP

SEQ ID NO: 1493948 - protein, 25 aa, Mycobacterium tuberculosis
WPGPTGERADWWWYEPFQPQPPPIS

SEQ ID NO: 1493949 - protein, 17 aa, Mycobacterium tuberculosis
WPGTVGEYLNTMFDPSL

SEQ ID NO: 1493950 - protein, 20 aa, Mycobacterium tuberculosis
WPKLTGMPMLGISVLGEAHD

SEQ ID NO: 1493951 - protein, 17 aa, Mycobacterium tuberculosis
WPLIYAGALEGLDHLEL

SEQ ID NO: 1493952 - protein, 19 aa, Mycobacterium tuberculosis
WPMAGTPAWCDLDDTDPVK

SEQ ID NO: 1493953 - protein, 19 aa, Mycobacterium tuberculosis
WPMRCAKSSRTLRYHCGMR

SEQ ID NO: 1493954 - protein, 19 aa, Mycobacterium tuberculosis
WPNRLNLKVLHQNPAVADP

SEQ ID NO: 1493955 - protein, 24 aa, Mycobacterium tuberculosis
WPPAPPAPALKAWLPGPPAPPSPP

SEQ ID NO: 1493956 - protein, 17 aa, Mycobacterium tuberculosis
WPPTRGCRRRRSRRPLA

SEQ ID NO: 1493957 - protein, 17 aa, Mycobacterium tuberculosis
WPPTRGCRRRRSRRPTR

SEQ ID NO: 1493958 - protein, 22 aa, Mycobacterium tuberculosis
WPRELTEAFANMGIRDLRDDVW

SEQ ID NO: 1493959 - protein, 19 aa, Mycobacterium tuberculosis
WPRERTRAKLEEVLQWPAG

SEQ ID NO: 1493960 - protein, 25 aa, Mycobacterium tuberculosis
WPRHILDVKTAIAWARANVDKFGGD

SEQ ID NO: 1493961 - protein, 20 aa, Mycobacterium tuberculosis
WPRHKVATVAEAFDATQAVA

SEQ ID NO: 1493962 - protein, 20 aa, Mycobacterium tuberculosis
WPRHRRLSIGADDGRSAALA

SEQ ID NO: 1493963 - protein, 42 aa, Mycobacterium tuberculosis
WPSGCAQMSRPSMPFRLHWAAIRASRTWCCPAAGCSSSATSP

SEQ ID NO: 1493964 - protein, 18 aa, Mycobacterium tuberculosis
WPSRRSLFSTNTVQVLLG

SEQ ID NO: 1493965 - protein, 23 aa, Mycobacterium tuberculosis
WPSSPIPSPMRWAVRESSCSADW

SEQ ID NO: 1493966 - protein, 20 aa, Mycobacterium tuberculosis
WPSTCRRWNKHGDAAVDMNE

SEQ ID NO: 1493967 - protein, 22 aa, Mycobacterium tuberculosis
WPSTRLRRRCWPAAPSCSSPPP

SEQ ID NO: 1493968 - protein, 17 aa, Mycobacterium tuberculosis
WPTALKNAGFDPARPTA

SEQ ID NO: 1493969 - protein, 18 aa, Mycobacterium tuberculosis
WPTNGRQVPRRAAVSSYG

SEQ ID NO: 1493970 - protein, 32 aa, Mycobacterium tuberculosis
WPVCGRGLSNATPREVLPASAAMDAPLDAAAV

SEQ ID NO: 1493971 - protein, 19 aa, Mycobacterium tuberculosis
WPVFADIPAGWRVVHGEAS

SEQ ID NO: 1493972 - protein, 29 aa, Mycobacterium tuberculosis
WPVVAGRPRRAGVSSFGFGGTNARCRGSL

SEQ ID NO: 1493973 - protein, 20 aa, Mycobacterium tuberculosis
WPVVIAGDFLGVWDPPPSLP

SEQ ID NO: 1493974 - protein, 18 aa, Mycobacterium tuberculosis
WQASGGWTDGAHRLGTSP

SEQ ID NO: 1493975 - protein, 17 aa, Mycobacterium tuberculosis
WQDIFLRQTLQQYRHLR

SEQ ID NO: 1493976 - protein, 17 aa, Mycobacterium tuberculosis
WQDSCRLAPQLLLRQNG

SEQ ID NO: 1493977 - protein, 18 aa, Mycobacterium tuberculosis
WQGASAMALNAKMDDWLD

SEQ ID NO: 1493978 - protein, 17 aa, Mycobacterium tuberculosis
WQGPAALAMAAAAAPYA

SEQ ID NO: 1493979 - protein, 22 aa, Mycobacterium tuberculosis
WQGRTGAMAVPVGWAATVVGEG

SEQ ID NO: 1493980 - protein, 18 aa, Mycobacterium tuberculosis
WQGWAGGPDGGWNKPPTP

SEQ ID NO: 1493981 - protein, 17 aa, Mycobacterium tuberculosis
WQLSLFIPDGVPPPPGD

SEQ ID NO: 1493982 - protein, 23 aa, Mycobacterium tuberculosis
WQQALRGLPGLGQVASAISGGAA

SEQ ID NO: 1493983 - protein, 20 aa, Mycobacterium tuberculosis
WQQVLRNLGIDIGKNGQINL

SEQ ID NO: 1493984 - protein, 22 aa, Mycobacterium tuberculosis
WQQVLRNLGIDIGKNGQINLGF

SEQ ID NO: 1493985 - protein, 19 aa, Mycobacterium tuberculosis
WQRWTEIAFGLTTDPQELH

SEQ ID NO: 1493986 - protein, 25 aa, Mycobacterium tuberculosis
WQSDHQGQWGAHYAITVPQIPLLNF

SEQ ID NO: 1493987 - protein, 17 aa, Mycobacterium tuberculosis
WQTGFPRRSKSCWSAVM

SEQ ID NO: 1493988 - protein, 22 aa, Mycobacterium tuberculosis
WQTTECWRQWINIGNFPDHPWR

SEQ ID NO: 1493989 - protein, 17 aa, Mycobacterium tuberculosis
WQTYGDVVVRFEQSSNL

SEQ ID NO: 1493990 - protein, 17 aa, Mycobacterium tuberculosis
WRAAFADLGGRRVELPT

SEQ ID NO: 1493991 - protein, 18 aa, Mycobacterium tuberculosis
WRAAGELRKGDRVAQPRR

SEQ ID NO: 1493992 - protein, 17 aa, Mycobacterium tuberculosis
WRASALAEMIQEAGLVP

SEQ ID NO: 1493993 - protein, 21 aa, Mycobacterium tuberculosis
WRCLCRRCRRGTAAPIPGTET

SEQ ID NO: 1493994 - protein, 20 aa, Mycobacterium tuberculosis
WRCSPRQAVLPARTARKEGQ

SEQ ID NO: 1493995 - protein, 17 aa, Mycobacterium tuberculosis
WRDEFGLGLADPDQLGR

SEQ ID NO: 1493996 - protein, 18 aa, Mycobacterium tuberculosis
WRDNEWYVARLCPTPLRP

SEQ ID NO: 1493997 - protein, 20 aa, Mycobacterium tuberculosis
WRDVGGYRPTGRSIAACRRG

SEQ ID NO: 1493998 - protein, 17 aa, Mycobacterium tuberculosis
WRGAAPVQAAIAAGDTI

SEQ ID NO: 1493999 - protein, 20 aa, Mycobacterium tuberculosis
WRGGAAAVYPQCGERCPRTD

SEQ ID NO: 1494000 - protein, 17 aa, Mycobacterium tuberculosis
WRGKDLATPRGWITALR

SEQ ID NO: 1494001 - protein, 18 aa, Mycobacterium tuberculosis
WRGRGVCAVVSHPSLAPL

SEQ ID NO: 1494002 - protein, 17 aa, Mycobacterium tuberculosis
WRGVPLAAHITHHRTRP

SEQ ID NO: 1494003 - protein, 26 aa, Mycobacterium tuberculosis
WRHRSGRWCGWRGRADRSRRGRRSGW

SEQ ID NO: 1494004 - protein, 19 aa, Mycobacterium tuberculosis
WRIMPENLEDAGVSWKVYQ

SEQ ID NO: 1494005 - protein, 18 aa, Mycobacterium tuberculosis
WRISEALDAARYYANVTG

SEQ ID NO: 1494006 - protein, 20 aa, Mycobacterium tuberculosis
WRKDAFFGRAALLAEKAAGP

SEQ ID NO: 1494007 - protein, 22 aa, Mycobacterium tuberculosis
WRKGIKTLYYIRLRQMALEGTE

SEQ ID NO: 1494008 - protein, 19 aa, Mycobacterium tuberculosis
WRKVAPRLAESGWHVVAPF

SEQ ID NO: 1494009 - protein, 19 aa, Mycobacterium tuberculosis
WRLATMAWNIKRMHRLTAG

SEQ ID NO: 1494010 - protein, 19 aa, Mycobacterium tuberculosis
WRLHHGGGRPIGLRRRTAR

SEQ ID NO: 1494011 - protein, 21 aa, Mycobacterium tuberculosis
WRMLLDEGRLQDGEPYLAGTA

SEQ ID NO: 1494012 - protein, 19 aa, Mycobacterium tuberculosis
WRNGWQCSKNGGGRILRID

SEQ ID NO: 1494013 - protein, 28 aa, Mycobacterium tuberculosis
WRPGVYRHGLNLARRRCGSWNGPRRSRA

SEQ ID NO: 1494014 - protein, 25 aa, Mycobacterium tuberculosis
WRPPLRPGEWRTLGLFAADDNGELE

SEQ ID NO: 1494015 - protein, 17 aa, Mycobacterium tuberculosis
WRPQTVLNHAGELARMC

SEQ ID NO: 1494016 - protein, 18 aa, Mycobacterium tuberculosis
WRPVFAGLAGLGLFGVAV

SEQ ID NO: 1494017 - protein, 21 aa, Mycobacterium tuberculosis
WRQGYYPGIGAPSWTADYGSE

SEQ ID NO: 1494018 - protein, 17 aa, Mycobacterium tuberculosis
WRRFKAAQDSFFTARNG

SEQ ID NO: 1494019 - protein, 17 aa, Mycobacterium tuberculosis
WRRGCRSRNGLPRPSRG

SEQ ID NO: 1494020 - protein, 20 aa, Mycobacterium tuberculosis
WRRGRTEEMFRKWKKELAEA

SEQ ID NO: 1494021 - protein, 17 aa, Mycobacterium tuberculosis
WRRGTWRALPDRLDADG

SEQ ID NO: 1494022 - protein, 23 aa, Mycobacterium tuberculosis
WRRWAGGAGGAFLGDGGNGGAGG

SEQ ID NO: 1494023 - protein, 18 aa, Mycobacterium tuberculosis
WRSALATALAAPANSTSI

SEQ ID NO: 1494024 - protein, 21 aa, Mycobacterium tuberculosis
WRSAPPPLWCGPYNSINASLH

SEQ ID NO: 1494025 - protein, 23 aa, Mycobacterium tuberculosis
WRSATCRVLAAATGARTANAGPV

SEQ ID NO: 1494026 - protein, 24 aa, Mycobacterium tuberculosis
WRSPVMATCCWGWRSTPSRIGIGT

SEQ ID NO: 1494027 - protein, 21 aa, Mycobacterium tuberculosis
WRTDFLNDMGLVIADSIKPFA

SEQ ID NO: 1494028 - protein, 21 aa, Mycobacterium tuberculosis
WRTGPNSTPVILRCGLDRPAE

SEQ ID NO: 1494029 - protein, 17 aa, Mycobacterium tuberculosis
WRTQLRLQHALVLLAER

SEQ ID NO: 1494030 - protein, 19 aa, Mycobacterium tuberculosis
WRVAMATLTFERGVSTLGQ

SEQ ID NO: 1494031 - protein, 17 aa, Mycobacterium tuberculosis
WRVVEAVDEPSAITNPG

SEQ ID NO: 1494032 - protein, 19 aa, Mycobacterium tuberculosis
WRVVELDVSYGPRTGGKSK

SEQ ID NO: 1494033 - protein, 21 aa, Mycobacterium tuberculosis
WSAAYRYPGSMCVGFPKVLAA

SEQ ID NO: 1494034 - protein, 24 aa, Mycobacterium tuberculosis
WSARELRGRILGVRRETEDSATLF

SEQ ID NO: 1494035 - protein, 17 aa, Mycobacterium tuberculosis
WSDLRRAAMAAGLQEIA

SEQ ID NO: 1494036 - protein, 25 aa, Mycobacterium tuberculosis
WSEACDRGGPGLLLRAKHAVFDRLV

SEQ ID NO: 1494037 - protein, 20 aa, Mycobacterium tuberculosis
WSEGRDLWWHHVVGSASPAH

SEQ ID NO: 1494038 - protein, 23 aa, Mycobacterium tuberculosis
WSMPLIRPNGRMLAIKGERAHDE

SEQ ID NO: 1494039 - protein, 24 aa, Mycobacterium tuberculosis
WSPDLNQCVFWLPAVNRPGGPGGP

SEQ ID NO: 1494040 - protein, 21 aa, Mycobacterium tuberculosis
WSPRARPAVVVDCETSYVRLG

SEQ ID NO: 1494041 - protein, 30 aa, Mycobacterium tuberculosis
WSRRRGYHRRGRWSRRRGRVAVWQRRRRGF

SEQ ID NO: 1494042 - protein, 18 aa, Mycobacterium tuberculosis
WSRSWKAARGHEVSRPRC

SEQ ID NO: 1494043 - protein, 19 aa, Mycobacterium tuberculosis
WSSGEKCQARSAKLGAHLH

SEQ ID NO: 1494044 - protein, 17 aa, Mycobacterium tuberculosis
WSSKLVHGGLRYLASGN

SEQ ID NO: 1494045 - protein, 18 aa, Mycobacterium tuberculosis
WSSKLVHGGLRYLASGNV

SEQ ID NO: 1494046 - protein, 18 aa, Mycobacterium tuberculosis
WSSVFAGLGGRRVELPTY

SEQ ID NO: 1494047 - protein, 20 aa, Mycobacterium tuberculosis
WTCTPPFLLAPSRSGGTTSR

SEQ ID NO: 1494048 - protein, 19 aa, Mycobacterium tuberculosis
WTERWPDLVASFTAATRAE

SEQ ID NO: 1494049 - protein, 22 aa, Mycobacterium tuberculosis
WTGCWRSPINPTWCSRQPVPTC

SEQ ID NO: 1494050 - protein, 18 aa, Mycobacterium tuberculosis
WTIVSGLEIDEFSGGRID

SEQ ID NO: 1494051 - protein, 27 aa, Mycobacterium tuberculosis
WTLAEPRVTPVAVIGMACRLPGGIDSP

SEQ ID NO: 1494052 - protein, 31 aa, Mycobacterium tuberculosis
WTLAMGHAMIRAGLRLKKLGTDRSWRPDVVH

SEQ ID NO: 1494053 - protein, 20 aa, Mycobacterium tuberculosis
WTMLALPWPALQRRRTCPLT

SEQ ID NO: 1494054 - protein, 19 aa, Mycobacterium tuberculosis
WTQFGMRLAAIGAHVQRFA

SEQ ID NO: 1494055 - protein, 24 aa, Mycobacterium tuberculosis
WTRDAIEALAPYGLGTAYVNFTAD

SEQ ID NO: 1494056 - protein, 27 aa, Mycobacterium tuberculosis
WTSAAHKAWWGVCLARTDPDAPKHKGI

SEQ ID NO: 1494057 - protein, 25 aa, Mycobacterium tuberculosis
WTSGAADPRCKILIVMGRTNPDAAA

SEQ ID NO: 1494058 - protein, 24 aa, Mycobacterium tuberculosis
WTTRPRPRLRSGFPSAPKARSPPR

SEQ ID NO: 1494059 - protein, 27 aa, Mycobacterium tuberculosis
WTTSPLRPWPGFVPMVYERYSQPFFGG

SEQ ID NO: 1494060 - protein, 18 aa, Mycobacterium tuberculosis
WTVCDGLNAPSRGGADGV

SEQ ID NO: 1494061 - protein, 18 aa, Mycobacterium tuberculosis
WTVCEPGREFGFAVLLGD

SEQ ID NO: 1494062 - protein, 19 aa, Mycobacterium tuberculosis
WTVCEPGREFGFAVLLGDR

SEQ ID NO: 1494063 - protein, 17 aa, Mycobacterium tuberculosis
WTYAAGMDGTPGHDDMP

SEQ ID NO: 1494064 - protein, 17 aa, Mycobacterium tuberculosis
WVARGLRFTGPGWVPGY

SEQ ID NO: 1494065 - protein, 18 aa, Mycobacterium tuberculosis
WVASTRSPTAICCSRLAS

SEQ ID NO: 1494066 - protein, 19 aa, Mycobacterium tuberculosis
WVATWRWNGSTAWTWSTAS

SEQ ID NO: 1494067 - protein, 21 aa, Mycobacterium tuberculosis
WVDVFAHWRRAQGLPVSAIAW

SEQ ID NO: 1494068 - protein, 22 aa, Mycobacterium tuberculosis
WVEFPHGASLCSAAAQRRAVWT

SEQ ID NO: 1494069 - protein, 22 aa, Mycobacterium tuberculosis
WVGDAFPLSSLTQIYASDGESN

SEQ ID NO: 1494070 - protein, 20 aa, Mycobacterium tuberculosis
WVGGDGCIVRLVAIVDPTGS

SEQ ID NO: 1494071 - protein, 24 aa, Mycobacterium tuberculosis
WVGGSPPAALSCVEPILQATTTLC

SEQ ID NO: 1494072 - protein, 22 aa, Mycobacterium tuberculosis
WVGNHCKRVFVEAVDVVSGIGY

SEQ ID NO: 1494073 - protein, 18 aa, Mycobacterium tuberculosis
WVGPRRFSGSSGQLAREW

SEQ ID NO: 1494074 - protein, 32 aa, Mycobacterium tuberculosis
WVKLAVTRARISGMPVLFWLDPYRPHENELIK

SEQ ID NO: 1494075 - protein, 17 aa, Mycobacterium tuberculosis
WVLDADIKACFDRIDHA

SEQ ID NO: 1494076 - protein, 20 aa, Mycobacterium tuberculosis
WVLTKGKLPTSLWIEIVTTA

SEQ ID NO: 1494077 - protein, 19 aa, Mycobacterium tuberculosis
WVLVLVTAVNRCGWTRRGR

SEQ ID NO: 1494078 - protein, 23 aa, Mycobacterium tuberculosis
WVRTDEQWRWLAHTLTVELLKEL

SEQ ID NO: 1494079 - protein, 24 aa, Mycobacterium tuberculosis
WVRTDEQWRWLAHTLTVELLKELL

SEQ ID NO: 1494080 - protein, 18 aa, Mycobacterium tuberculosis
WVSGRGWKQKDYDEYGYR

SEQ ID NO: 1494081 - protein, 19 aa, Mycobacterium tuberculosis
WVVDPDFNLDFHVRRVRVS

SEQ ID NO: 1494082 - protein, 21 aa, Mycobacterium tuberculosis
WVWLPTLLAGRVFTHRLGADE

SEQ ID NO: 1494083 - protein, 20 aa, Mycobacterium tuberculosis
WVYIDHRVMPGRPRPGYLPR

SEQ ID NO: 1494084 - protein, 23 aa, Mycobacterium tuberculosis
WWCSSRWRPAIDAGRPDSRRHPR

SEQ ID NO: 1494085 - protein, 17 aa, Mycobacterium tuberculosis
WWDDLWLNESFATFASV

SEQ ID NO: 1494086 - protein, 17 aa, Mycobacterium tuberculosis
WWHRGCGTITSSAMWQR

SEQ ID NO: 1494087 - protein, 19 aa, Mycobacterium tuberculosis
WWKAPPGSARPSWPRAWPQ

SEQ ID NO: 1494088 - protein, 21 aa, Mycobacterium tuberculosis
WWPECSKEAYADGIAGAVDAY

SEQ ID NO: 1494089 - protein, 18 aa, Mycobacterium tuberculosis
WWRPAGSLFDQFLGAAET

SEQ ID NO: 1494090 - protein, 19 aa, Mycobacterium tuberculosis
WWYYARTFEGKQYGVHCRC

SEQ ID NO: 1494091 - protein, 19 aa, Mycobacterium tuberculosis
WYEHLGLCPKGEAERLLRS

SEQ ID NO: 1494092 - protein, 26 aa, Mycobacterium tuberculosis
WYLTSIRAGLSPERRCGSGGRFVSAK

SEQ ID NO: 1494093 - protein, 27 aa, Mycobacterium tuberculosis
WYPGEPLPRWQIALYWRTDGRPLWTND

SEQ ID NO: 1494094 - protein, 17 aa, Mycobacterium tuberculosis
WYQAHGWLVGANYITSN

SEQ ID NO: 1494095 - protein, 17 aa, Mycobacterium tuberculosis
WYQPMFRGVYVSRRSVP

SEQ ID NO: 1494096 - protein, 23 aa, Mycobacterium tuberculosis
  misc_feature (1)..(1): Xaa can be any naturally occurring amino acid
XAPGGAGGLLFGNGGAGGPGASG

SEQ ID NO: 1494097 - protein, 20 aa, Mycobacterium tuberculosis
YAAANAFLDGLVAYRRSRGL

SEQ ID NO: 1494098 - protein, 23 aa, Mycobacterium tuberculosis
YAAGHLPGAVSIPLDELAERLDE

SEQ ID NO: 1494099 - protein, 17 aa, Mycobacterium tuberculosis
YAAGLAVGFWAAPSDLR

SEQ ID NO: 1494100 - protein, 18 aa, Mycobacterium tuberculosis
YAALMAGADLVLPDRHLD

SEQ ID NO: 1494101 - protein, 19 aa, Mycobacterium tuberculosis
YAASRPDNVARLILDSPIA

SEQ ID NO: 1494102 - protein, 24 aa, Mycobacterium tuberculosis
YAASRPDNVARLILDSPIALGVSA

SEQ ID NO: 1494103 - protein, 28 aa, Mycobacterium tuberculosis
YADGDIWDWAVDWDTWVSMSALPPPAAK

SEQ ID NO: 1494104 - protein, 30 aa, Mycobacterium tuberculosis
YADGDIWDWAVDWDTWVSMSALPPPAAKPA

SEQ ID NO: 1494105 - protein, 23 aa, Mycobacterium tuberculosis
YADGVGHPFWFSRTVFGELARLH

SEQ ID NO: 1494106 - protein, 23 aa, Mycobacterium tuberculosis
YADPLGALRRSGALDARLQDTAP

SEQ ID NO: 1494107 - protein, 20 aa, Mycobacterium tuberculosis
YAEAFCRAVGGSWADVLDGK

SEQ ID NO: 1494108 - protein, 21 aa, Mycobacterium tuberculosis
YAEMWAQDAAVMYSYEGASAA

SEQ ID NO: 1494109 - protein, 22 aa, Mycobacterium tuberculosis
YAEMWAQDAMAMYGYAGSSATA

SEQ ID NO: 1494110 - protein, 21 aa, Mycobacterium tuberculosis
YAEPGQVLGLTFTRKAAGQLL

SEQ ID NO: 1494111 - protein, 18 aa, Mycobacterium tuberculosis
YAERHGWAVTVLDETTSD

SEQ ID NO: 1494112 - protein, 22 aa, Mycobacterium tuberculosis
YAEVQPLKGARISGSLHMTVQT

SEQ ID NO: 1494113 - protein, 17 aa, Mycobacterium tuberculosis
YAFAGSLLRDYGLLLPL

SEQ ID NO: 1494114 - protein, 20 aa, Mycobacterium tuberculosis
YAGADRVLGRLVKVTPTSKV

SEQ ID NO: 1494115 - protein, 21 aa, Mycobacterium tuberculosis
YAGGEILRLLLGHPAYADGRL

SEQ ID NO: 1494116 - protein, 19 aa, Mycobacterium tuberculosis
YAGGLTYNYNTYSTTVDFG

SEQ ID NO: 1494117 - protein, 17 aa, Mycobacterium tuberculosis
YAGGVLFVAENPSRSLQ

SEQ ID NO: 1494118 - protein, 17 aa, Mycobacterium tuberculosis
YAGLLGAYPLVSIEDPL

SEQ ID NO: 1494119 - protein, 17 aa, Mycobacterium tuberculosis
YAKCGDMDIAYQVLGDG

SEQ ID NO: 1494120 - protein, 17 aa, Mycobacterium tuberculosis
YALAARALAPGGLMVVQ

SEQ ID NO: 1494121 - protein, 23 aa, Mycobacterium tuberculosis
YALACVLGECLTGAPPYRADSVE

SEQ ID NO: 1494122 - protein, 17 aa, Mycobacterium tuberculosis
YALALTAIHLFAGAPPV

SEQ ID NO: 1494123 - protein, 19 aa, Mycobacterium tuberculosis
YAPPDVREFVLGKLNSGEW

SEQ ID NO: 1494124 - protein, 19 aa, Mycobacterium tuberculosis
YAPPDVREFVLGKLNSGRV

SEQ ID NO: 1494125 - protein, 19 aa, Mycobacterium tuberculosis
YARPRFDDDYGRYDGRDYD

SEQ ID NO: 1494126 - protein, 18 aa, Mycobacterium tuberculosis
YARTGGFVDDVADFDPAF

SEQ ID NO: 1494127 - protein, 19 aa, Mycobacterium tuberculosis
YATMCGMTGTALAAGEQLR

SEQ ID NO: 1494128 - protein, 17 aa, Mycobacterium tuberculosis
YAVNNSFGFGGHNVALA

SEQ ID NO: 1494129 - protein, 23 aa, Mycobacterium tuberculosis
YAYFAGRLGDWMRVDGENLGTAP

SEQ ID NO: 1494130 - protein, 27 aa, Mycobacterium tuberculosis
YCALACAELLYRAGLPRALYAIVPGPG

SEQ ID NO: 1494131 - protein, 18 aa, Mycobacterium tuberculosis
YCPCRRGRRDGSGAAQAH

SEQ ID NO: 1494132 - protein, 25 aa, Mycobacterium tuberculosis
YCPNHHSKMAFAMANFEPGSNEPTH

SEQ ID NO: 1494133 - protein, 20 aa, Mycobacterium tuberculosis
YCQGLRIILDGLVIGDKNAD

SEQ ID NO: 1494134 - protein, 23 aa, Mycobacterium tuberculosis
YCRPSCPVRPPFARNVRFLPTAA

SEQ ID NO: 1494135 - protein, 18 aa, Mycobacterium tuberculosis
YDAGLIYRAERLVNWSPV

SEQ ID NO: 1494136 - protein, 22 aa, Mycobacterium tuberculosis
YDDFCRRQHTFSSTLTVESPQV

SEQ ID NO: 1494137 - protein, 22 aa, Mycobacterium tuberculosis
YDESACDAWIGRIRCGDTDRVT

SEQ ID NO: 1494138 - protein, 27 aa, Mycobacterium tuberculosis
YDGEFVKFGPSWAWPKPVQPHIPVLVG

SEQ ID NO: 1494139 - protein, 17 aa, Mycobacterium tuberculosis
YDHVKRGDIVEVVNTVG

SEQ ID NO: 1494140 - protein, 17 aa, Mycobacterium tuberculosis
YDMVQRLTAQPKYVQAG

SEQ ID NO: 1494141 - protein, 19 aa, Mycobacterium tuberculosis
YDPAMRTLIAFGGKYPTSV

SEQ ID NO: 1494142 - protein, 19 aa, Mycobacterium tuberculosis
YDPDKGFGFLSQEGGEDVY

SEQ ID NO: 1494143 - protein, 27 aa, Mycobacterium tuberculosis
YDRGRLPVVAGFVFRYIAYHGRSRENG

SEQ ID NO: 1494144 - protein, 19 aa, Mycobacterium tuberculosis
YDRRYGLDDTHLRAIAQLN

SEQ ID NO: 1494145 - protein, 18 aa, Mycobacterium tuberculosis
YDTGLSLSAVCALEPYWE

SEQ ID NO: 1494146 - protein, 17 aa, Mycobacterium tuberculosis
YDVALRFASRRIPGNGW

SEQ ID NO: 1494147 - protein, 20 aa, Mycobacterium tuberculosis
YEADYWKARLAETPVDVATL

SEQ ID NO: 1494148 - protein, 20 aa, Mycobacterium tuberculosis
YECAVPVIAAVNGFCVGGGI

SEQ ID NO: 1494149 - protein, 21 aa, Mycobacterium tuberculosis
YECAVPVIAAVNGFCVGGGIG

SEQ ID NO: 1494150 - protein, 28 aa, Mycobacterium tuberculosis
YEGPKGGPGMREMLAITGAIKGAGLGKD

SEQ ID NO: 1494151 - protein, 29 aa, Mycobacterium tuberculosis
YEHPYPHCWRCRNPLIYRSVSSWFVRVTD

SEQ ID NO: 1494152 - protein, 19 aa, Mycobacterium tuberculosis
YEIRSAAVAGNIPCITTVQ

SEQ ID NO: 1494153 - protein, 18 aa, Mycobacterium tuberculosis
YELLGRGDTLGVFQLDGG

SEQ ID NO: 1494154 - protein, 24 aa, Mycobacterium tuberculosis
YEQMWAADVAAMVGYHGGASAAAA

SEQ ID NO: 1494155 - protein, 23 aa, Mycobacterium tuberculosis
YEQMWAADVAAMVGYHSGASAAA

SEQ ID NO: 1494156 - protein, 24 aa, Mycobacterium tuberculosis
YEQMWAADVAAMVGYHSGASAAAE

SEQ ID NO: 1494157 - protein, 22 aa, Mycobacterium tuberculosis
YERKPACAVGPCCRSLGRCRCA

SEQ ID NO: 1494158 - protein, 18 aa, Mycobacterium tuberculosis
YERLGIPTITTVPWTTDR

SEQ ID NO: 1494159 - protein, 22 aa, Mycobacterium tuberculosis
YERWKETAFQYGWLLATADSDR

SEQ ID NO: 1494160 - protein, 23 aa, Mycobacterium tuberculosis
YETSSAEQVRWVLQDSEAVVLFA

SEQ ID NO: 1494161 - protein, 26 aa, Mycobacterium tuberculosis
YEVKGCIAHGGLGWIYLALDRNVNGR

SEQ ID NO: 1494162 - protein, 18 aa, Mycobacterium tuberculosis
YFAGMGYSALTTAALAAG

SEQ ID NO: 1494163 - protein, 22 aa, Mycobacterium tuberculosis
YFALLARRRMDLYGATVEDFAQ

SEQ ID NO: 1494164 - protein, 21 aa, Mycobacterium tuberculosis
YFAQGELLPSFVGACQAQVPR

SEQ ID NO: 1494165 - protein, 18 aa, Mycobacterium tuberculosis
YFDELPVIVLNGSDHPRP

SEQ ID NO: 1494166 - protein, 19 aa, Mycobacterium tuberculosis
YFGNAFPRNYLVNSHTSAE

SEQ ID NO: 1494167 - protein, 18 aa, Mycobacterium tuberculosis
YFHQFDAYRSIYVRKRLR

SEQ ID NO: 1494168 - protein, 19 aa, Mycobacterium tuberculosis
YFLDMGWEDIMLAVEYDGE

SEQ ID NO: 1494169 - protein, 30 aa, Mycobacterium tuberculosis
YFNAFPASYWRRWTTCKSVVLRVQVTGAGR

SEQ ID NO: 1494170 - protein, 23 aa, Mycobacterium tuberculosis
YFQDGNALVGMVVSGGTVEYDAD

SEQ ID NO: 1494171 - protein, 18 aa, Mycobacterium tuberculosis
YFVERLVDCLAFELKMDP

SEQ ID NO: 1494172 - protein, 26 aa, Mycobacterium tuberculosis
YGAFFNIYFCSVTIKINGPAGSDILL

SEQ ID NO: 1494173 - protein, 25 aa, Mycobacterium tuberculosis
YGAGKNNPWLSGTAHIRNRDRVRGH

SEQ ID NO: 1494174 - protein, 19 aa, Mycobacterium tuberculosis
YGAPAGWHAPGWPPRSSHR

SEQ ID NO: 1494175 - protein, 23 aa, Mycobacterium tuberculosis
YGARCATGILDCWLVHDGDHAEI

SEQ ID NO: 1494176 - protein, 22 aa, Mycobacterium tuberculosis
YGDCSKLAAITGWQQEICLTQT

SEQ ID NO: 1494177 - protein, 23 aa, Mycobacterium tuberculosis
YGDTKLGLFPFRRNLSFYAVDLG

SEQ ID NO: 1494178 - protein, 24 aa, Mycobacterium tuberculosis
YGDYRYAVNNSFGFGGHNVALAFG

SEQ ID NO: 1494179 - protein, 21 aa, Mycobacterium tuberculosis
YGEINGQFFVEMRMIDGTSLR

SEQ ID NO: 1494180 - protein, 17 aa, Mycobacterium tuberculosis
YGGCTSWVQLPLTPQLA

SEQ ID NO: 1494181 - protein, 25 aa, Mycobacterium tuberculosis
YGHLPGYALPLFVRVVGSLAHTTTF

SEQ ID NO: 1494182 - protein, 24 aa, Mycobacterium tuberculosis
YGIDAHIDRVRWDDVVSRVFGRID

SEQ ID NO: 1494183 - protein, 25 aa, Mycobacterium tuberculosis
YGIDAHIDRVRWDDVVSRVFGRIDP

SEQ ID NO: 1494184 - protein, 25 aa, Mycobacterium tuberculosis
YGLAWRTKRLIVFDVDSTLVQGEVI

SEQ ID NO: 1494185 - protein, 20 aa, Mycobacterium tuberculosis
YGLTYPGVGFVVWRGPEHLP

SEQ ID NO: 1494186 - protein, 17 aa, Mycobacterium tuberculosis
YGPAGFLQYQFVIPTEA

SEQ ID NO: 1494187 - protein, 23 aa, Mycobacterium tuberculosis
YGPLASHHLRWLASANGLLDIPE

SEQ ID NO: 1494188 - protein, 19 aa, Mycobacterium tuberculosis
YGPPGHRYPRHHGASAAAR

SEQ ID NO: 1494189 - protein, 18 aa, Mycobacterium tuberculosis
YGRLSPWGRLAEWRRQYD

SEQ ID NO: 1494190 - protein, 20 aa, Mycobacterium tuberculosis
YGRLSPWGRLAEWRRQYDTV

SEQ ID NO: 1494191 - protein, 18 aa, Mycobacterium tuberculosis
YGRRECWICCSRWQMKPK

SEQ ID NO: 1494192 - protein, 21 aa, Mycobacterium tuberculosis
YGRRRRRRCFWWQSRSRHSTG

SEQ ID NO: 1494193 - protein, 17 aa, Mycobacterium tuberculosis
YGSLNWGSGNTGTGNAG

SEQ ID NO: 1494194 - protein, 28 aa, Mycobacterium tuberculosis
YGSVLSGLAALHWRGPAAESMAVTAAPY

SEQ ID NO: 1494195 - protein, 23 aa, Mycobacterium tuberculosis
YGVDPLILRQAYPVRQAPYGLAG

SEQ ID NO: 1494196 - protein, 21 aa, Mycobacterium tuberculosis
YGWSSLRSRPALRDQAAGALH

SEQ ID NO: 1494197 - protein, 22 aa, Mycobacterium tuberculosis
YGWSSLRSRPALRDQAAGALHG

SEQ ID NO: 1494198 - protein, 24 aa, Mycobacterium tuberculosis
YHALRASNRIAIERGTHFKGFERS

SEQ ID NO: 1494199 - protein, 20 aa, Mycobacterium tuberculosis
YHARNPLRFAAPCPGQHGWR

SEQ ID NO: 1494200 - protein, 31 aa, Mycobacterium tuberculosis
YHARNPLRFAAPCPGQHGWRAPAAAAPPLDQ

SEQ ID NO: 1494201 - protein, 18 aa, Mycobacterium tuberculosis
YHEALWRQLIAAYYVSER

SEQ ID NO: 1494202 - protein, 17 aa, Mycobacterium tuberculosis
YHEFWSCTVSILDSKVI

SEQ ID NO: 1494203 - protein, 19 aa, Mycobacterium tuberculosis
YHGERPLWAWLVLEPGDIS

SEQ ID NO: 1494204 - protein, 20 aa, Mycobacterium tuberculosis
YHGVVFAELGPPAFALKARV

SEQ ID NO: 1494205 - protein, 26 aa, Mycobacterium tuberculosis
YHRSRRHRRGLLHTRLIGNGGNGGDG

SEQ ID NO: 1494206 - protein, 17 aa, Mycobacterium tuberculosis
YHRVNLRSGDSQASAAV

SEQ ID NO: 1494207 - protein, 19 aa, Mycobacterium tuberculosis
YHWIDYPGPDRAAAIVRRT

SEQ ID NO: 1494208 - protein, 18 aa, Mycobacterium tuberculosis
YIAELVLRQQAQHCEIET

SEQ ID NO: 1494209 - protein, 17 aa, Mycobacterium tuberculosis
YIGPIPLSTFVLGVTLA

SEQ ID NO: 1494210 - protein, 17 aa, Mycobacterium tuberculosis
YIGYKCQRGLADLTDAE

SEQ ID NO: 1494211 - protein, 21 aa, Mycobacterium tuberculosis
YIIDCALRWMRDFHADGLRLD

SEQ ID NO: 1494212 - protein, 18 aa, Mycobacterium tuberculosis
YILPSFIEHSSFGVKESN

SEQ ID NO: 1494213 - protein, 25 aa, Mycobacterium tuberculosis
YIPILGAPWLADLVRRSPWGEMFAS

SEQ ID NO: 1494214 - protein, 33 aa, Mycobacterium tuberculosis
YIPSLACGRCRAIARCRSCTGPLSLQGAGSPGA

SEQ ID NO: 1494215 - protein, 21 aa, Mycobacterium tuberculosis
YIQLYLGGFGLELSDIESLRT

SEQ ID NO: 1494216 - protein, 19 aa, Mycobacterium tuberculosis
YIQRAAGVRRCAGSVRVAL

SEQ ID NO: 1494217 - protein, 22 aa, Mycobacterium tuberculosis
YITAAGRTLACHKVIGAQRGLN

SEQ ID NO: 1494218 - protein, 17 aa, Mycobacterium tuberculosis
YKKCHLGREALPLAERV

SEQ ID NO: 1494219 - protein, 18 aa, Mycobacterium tuberculosis
YKKCHLGREALPLAERVD

SEQ ID NO: 1494220 - protein, 29 aa, Mycobacterium tuberculosis
YKKCHLGREALPLAERVDWLYAKASQHAL

SEQ ID NO: 1494221 - protein, 21 aa, Mycobacterium tuberculosis
YKMVFGHRGINIPVVDHATGR

SEQ ID NO: 1494222 - protein, 17 aa, Mycobacterium tuberculosis
YKRHAFLRSAVRRVSSS

SEQ ID NO: 1494223 - protein, 22 aa, Mycobacterium tuberculosis
YKVGLGSVRFLMSVGDLIIGWL

SEQ ID NO: 1494224 - protein, 22 aa, Mycobacterium tuberculosis
YKVGLGSVRYLLAVGDLLIGWR

SEQ ID NO: 1494225 - protein, 17 aa, Mycobacterium tuberculosis
YKVPRSLWFVDEVKRSP

SEQ ID NO: 1494226 - protein, 19 aa, Mycobacterium tuberculosis
YKYVLKEYVGYVVEKRFNL

SEQ ID NO: 1494227 - protein, 27 aa, Mycobacterium tuberculosis
YLAGLCGALRRYHEALGVPISTLPMAV

SEQ ID NO: 1494228 - protein, 17 aa, Mycobacterium tuberculosis
YLANYHLAWYAVTTRRG

SEQ ID NO: 1494229 - protein, 22 aa, Mycobacterium tuberculosis
YLARAVRPARCAAGTRNAAGFG

SEQ ID NO: 1494230 - protein, 23 aa, Mycobacterium tuberculosis
YLDRGPEMLSFVLKHTPLKMCWV

SEQ ID NO: 1494231 - protein, 19 aa, Mycobacterium tuberculosis
YLFQPGHRIRIAIAGADAS

SEQ ID NO: 1494232 - protein, 20 aa, Mycobacterium tuberculosis
YLFQPGHRIRIAIAGADASH

SEQ ID NO: 1494233 - protein, 22 aa, Mycobacterium tuberculosis
YLGDLRSLFAFLADRGSSLDAL

SEQ ID NO: 1494234 - protein, 21 aa, Mycobacterium tuberculosis
YLGEKICAAVVFAGAPITLAE

SEQ ID NO: 1494235 - protein, 25 aa, Mycobacterium tuberculosis
YLGFGSLRPLLEVAAAHGRGVFVLA

SEQ ID NO: 1494236 - protein, 17 aa, Mycobacterium tuberculosis
YLISFFGALYSGRIAVP

SEQ ID NO: 1494237 - protein, 21 aa, Mycobacterium tuberculosis
YLKRLTADLRRTRRRLSDLEA

SEQ ID NO: 1494238 - protein, 20 aa, Mycobacterium tuberculosis
YLLAVGDLLIGWRLLVLAGV

SEQ ID NO: 1494239 - protein, 17 aa, Mycobacterium tuberculosis
YLLPARNWSVMAATEVR

SEQ ID NO: 1494240 - protein, 18 aa, Mycobacterium tuberculosis
YLLRRLTAEPATPAELRD

SEQ ID NO: 1494241 - protein, 19 aa, Mycobacterium tuberculosis
YLMQVLARFARYLRESRSI

SEQ ID NO: 1494242 - protein, 22 aa, Mycobacterium tuberculosis
YLPDCQPRRALATLIDHAVSAC

SEQ ID NO: 1494243 - protein, 18 aa, Mycobacterium tuberculosis
YLQLAARVSAPAPAERPA

SEQ ID NO: 1494244 - protein, 20 aa, Mycobacterium tuberculosis
YLQRWRRRRALWVGVTLDGA

SEQ ID NO: 1494245 - protein, 18 aa, Mycobacterium tuberculosis
YLREFRFRGDIDGYAEGE

SEQ ID NO: 1494246 - protein, 18 aa, Mycobacterium tuberculosis
YLRFTGRTPEQVALVEAY

SEQ ID NO: 1494247 - protein, 23 aa, Mycobacterium tuberculosis
YLRMDDFPARLVVVPGEHDRLLE

SEQ ID NO: 1494248 - protein, 20 aa, Mycobacterium tuberculosis
YLRNCRIGLRVPVTGTTGSS

SEQ ID NO: 1494249 - protein, 18 aa, Mycobacterium tuberculosis
YLSEASMALLYPDSDNAV

SEQ ID NO: 1494250 - protein, 20 aa, Mycobacterium tuberculosis
YLSGRWAQAYGFPLMPIDGI

SEQ ID NO: 1494251 - protein, 20 aa, Mycobacterium tuberculosis
YLTPHSKWSFHSTYQDNLYM

SEQ ID NO: 1494252 - protein, 20 aa, Mycobacterium tuberculosis
YMRAIWTGSIAFGLVNVPVK

SEQ ID NO: 1494253 - protein, 25 aa, Mycobacterium tuberculosis
YNAVEPWVQYGFNLTAWAVGWLPYI

SEQ ID NO: 1494254 - protein, 21 aa, Mycobacterium tuberculosis
YNPEYTCFLQGAKWYLDNGGY

SEQ ID NO: 1494255 - protein, 17 aa, Mycobacterium tuberculosis
YNPSFGGMDRQSRVFIN

SEQ ID NO: 1494256 - protein, 17 aa, Mycobacterium tuberculosis
YNRKALDPAQVVDALLE

SEQ ID NO: 1494257 - protein, 24 aa, Mycobacterium tuberculosis
YNVANCLVALAILDTVGVSPEQAV

SEQ ID NO: 1494258 - protein, 18 aa, Mycobacterium tuberculosis
YPAAFPVGMLPTNQNDAG

SEQ ID NO: 1494259 - protein, 17 aa, Mycobacterium tuberculosis
YPAGHSALLHRIAQHGV

SEQ ID NO: 1494260 - protein, 19 aa, Mycobacterium tuberculosis
YPAMRAHAGDMAGYAGTLQ

SEQ ID NO: 1494261 - protein, 20 aa, Mycobacterium tuberculosis
YPDAPKLPAVVGYEVAGTVE

SEQ ID NO: 1494262 - protein, 18 aa, Mycobacterium tuberculosis
YPDAPWIDRDGHVLIDDG

SEQ ID NO: 1494263 - protein, 23 aa, Mycobacterium tuberculosis
YPEDAWQFAGRVRELTGGTGVQA

SEQ ID NO: 1494264 - protein, 29 aa, Mycobacterium tuberculosis
YPGCKRIVLGTAWAAALCSLTVSNVQTTT

SEQ ID NO: 1494265 - protein, 19 aa, Mycobacterium tuberculosis
YPGIPGYIDQQWVTQAEAA

SEQ ID NO: 1494266 - protein, 19 aa, Mycobacterium tuberculosis
YPGRRYYGGCEFVDGVEQL

SEQ ID NO: 1494267 - protein, 21 aa, Mycobacterium tuberculosis
YPGVRYRAFDLFEPGPDRIAQ

SEQ ID NO: 1494268 - protein, 25 aa, Mycobacterium tuberculosis
YPGYVCAIVASLLLDKPVKWMEDRS

SEQ ID NO: 1494269 - protein, 20 aa, Mycobacterium tuberculosis
YPHLRPNRGVDYLLHNDTHR

SEQ ID NO: 1494270 - protein, 22 aa, Mycobacterium tuberculosis
YPIRSGIDPIVFGVVRELLSNV

SEQ ID NO: 1494271 - protein, 19 aa, Mycobacterium tuberculosis
YPLDRSHTAAIIWYDDPDD

SEQ ID NO: 1494272 - protein, 23 aa, Mycobacterium tuberculosis
YPLELLVRAAAAGWRVVELDVSY

SEQ ID NO: 1494273 - protein, 18 aa, Mycobacterium tuberculosis
YPLHPGVTRGRRPRRHLV

SEQ ID NO: 1494274 - protein, 18 aa, Mycobacterium tuberculosis
YPLTIATTVRKQSGRLDR

SEQ ID NO: 1494275 - protein, 17 aa, Mycobacterium tuberculosis
YPPLFVGRFFDMMRIEA

SEQ ID NO: 1494276 - protein, 17 aa, Mycobacterium tuberculosis
YPPSILLTGIIVNKLGQ

SEQ ID NO: 1494277 - protein, 24 aa, Mycobacterium tuberculosis
YPRGDAGGCHRPCARGQHAGADPR

SEQ ID NO: 1494278 - protein, 17 aa, Mycobacterium tuberculosis
YPRHHGASAAARRRTRP

SEQ ID NO: 1494279 - protein, 17 aa, Mycobacterium tuberculosis
YPSHELTAVGDWMLLAA

SEQ ID NO: 1494280 - protein, 18 aa, Mycobacterium tuberculosis
YPSLSVALGEEITPQTTV

SEQ ID NO: 1494281 - protein, 20 aa, Mycobacterium tuberculosis
YPTLCRLFAELGVATQESEM

SEQ ID NO: 1494282 - protein, 22 aa, Mycobacterium tuberculosis
YPVKRGDTVLVHAGAGGVGLIL

SEQ ID NO: 1494283 - protein, 25 aa, Mycobacterium tuberculosis
YPVPGAEPVVGGWTGGRITVSSSSA

SEQ ID NO: 1494284 - protein, 19 aa, Mycobacterium tuberculosis
YPYLPSHPQYDLAKRQMSG

SEQ ID NO: 1494285 - protein, 25 aa, Mycobacterium tuberculosis
YPYRDAYLLREARLFRAELTIPLIL

SEQ ID NO: 1494286 - protein, 18 aa, Mycobacterium tuberculosis
YQAIARQMAAFHDQFTLA

SEQ ID NO: 1494287 - protein, 17 aa, Mycobacterium tuberculosis
YQELVCLTQPTPEEQAW

SEQ ID NO: 1494288 - protein, 18 aa, Mycobacterium tuberculosis
YQLRRRKISVPSTWAVET

SEQ ID NO: 1494289 - protein, 18 aa, Mycobacterium tuberculosis
YQRLPFGQGPDVWLAALA

SEQ ID NO: 1494290 - protein, 18 aa, Mycobacterium tuberculosis
YRAEFLFQHGCFACQVEV

SEQ ID NO: 1494291 - protein, 17 aa, Mycobacterium tuberculosis
YRASTMPAWNGSKSHRR

SEQ ID NO: 1494292 - protein, 22 aa, Mycobacterium tuberculosis
YRDVHRCLSHWPGRPVGEGAGL

SEQ ID NO: 1494293 - protein, 17 aa, Mycobacterium tuberculosis
YREIICGATNFAVGDLV

SEQ ID NO: 1494294 - protein, 18 aa, Mycobacterium tuberculosis
YRFLLRRNRRLYGVAYTL

SEQ ID NO: 1494295 - protein, 20 aa, Mycobacterium tuberculosis
YRGQFELNRPATLIAALPAI

SEQ ID NO: 1494296 - protein, 18 aa, Mycobacterium tuberculosis
YRHLVALSITDFGAAGPR

SEQ ID NO: 1494297 - protein, 17 aa, Mycobacterium tuberculosis
YRHPRSGALVAMESRAR

SEQ ID NO: 1494298 - protein, 17 aa, Mycobacterium tuberculosis
YRIGCKRILNSSTYYPA

SEQ ID NO: 1494299 - protein, 17 aa, Mycobacterium tuberculosis
YRIKELVGDVVGVLDSY

SEQ ID NO: 1494300 - protein, 17 aa, Mycobacterium tuberculosis
YRIRRIEQLLSTSLGDP

SEQ ID NO: 1494301 - protein, 28 aa, Mycobacterium tuberculosis
YRISEFAEIMGFYGLSYWYPFQVTALGL

SEQ ID NO: 1494302 - protein, 17 aa, Mycobacterium tuberculosis
YRITPGVRRGPRGPEHP

SEQ ID NO: 1494303 - protein, 19 aa, Mycobacterium tuberculosis
YRLAARLVEIGVDNATVSR

SEQ ID NO: 1494304 - protein, 20 aa, Mycobacterium tuberculosis
YRLAARLVEIGVDNATVSRT

SEQ ID NO: 1494305 - protein, 17 aa, Mycobacterium tuberculosis
YRLAHKIGLDAVLVDSP

SEQ ID NO: 1494306 - protein, 22 aa, Mycobacterium tuberculosis
YRLAISELTGAYWAGPAAASMV

SEQ ID NO: 1494307 - protein, 21 aa, Mycobacterium tuberculosis
YRLGCGRYGPGYIPRSTEYRI

SEQ ID NO: 1494308 - protein, 17 aa, Mycobacterium tuberculosis
YRLIPKHSLGMALDDCH

SEQ ID NO: 1494309 - protein, 17 aa, Mycobacterium tuberculosis
YRLRAVSAVGLRFPLNG

SEQ ID NO: 1494310 - protein, 26 aa, Mycobacterium tuberculosis
YRLTSCGRPTLFARVARLDEHGKPVK

SEQ ID NO: 1494311 - protein, 21 aa, Mycobacterium tuberculosis
YRLYELRLRQGLAASKSDLPR

SEQ ID NO: 1494312 - protein, 17 aa, Mycobacterium tuberculosis
YRPGWQVSAESKCWCVT

SEQ ID NO: 1494313 - protein, 18 aa, Mycobacterium tuberculosis
YRPLDGFVYAITPFNFTS

SEQ ID NO: 1494314 - protein, 19 aa, Mycobacterium tuberculosis
YRPLDGFVYAITPFNFTSI

SEQ ID NO: 1494315 - protein, 18 aa, Mycobacterium tuberculosis
YRPSAKLAEFVRMRDLTC

SEQ ID NO: 1494316 - protein, 24 aa, Mycobacterium tuberculosis
YRQFVMATLFHKTRSWSNLLKVTE

SEQ ID NO: 1494317 - protein, 21 aa, Mycobacterium tuberculosis
YRQLDYWARTSLVVPSIRSAA

SEQ ID NO: 1494318 - protein, 21 aa, Mycobacterium tuberculosis
YRRLRHRAAKPVGTLRRTRPG

SEQ ID NO: 1494319 - protein, 21 aa, Mycobacterium tuberculosis
YRRRIEPQGGPVYGSDAAHLG

SEQ ID NO: 1494320 - protein, 17 aa, Mycobacterium tuberculosis
YRRSFAVIRAEADLARF

SEQ ID NO: 1494321 - protein, 30 aa, Mycobacterium tuberculosis; identical to SEQ ID NO: 1384276

SEQ ID NO: 1494322 - protein, 17 aa, Mycobacterium tuberculosis
YRTALSMVRQSMGAAPP

SEQ ID NO: 1494323 - protein, 18 aa, Mycobacterium tuberculosis
YRVDEVEYDPAYHELMRT

SEQ ID NO: 1494324 - protein, 19 aa, Mycobacterium tuberculosis
YRVFTELTPHPLLTHAVDQ

SEQ ID NO: 1494325 - protein, 17 aa, Mycobacterium tuberculosis
YSAADCVALLREAALTA

SEQ ID NO: 1494326 - protein, 18 aa, Mycobacterium tuberculosis
YSAGTAVFGRCVAGRVFV

SEQ ID NO: 1494327 - protein, 22 aa, Mycobacterium tuberculosis
YSARNETEWQRLMVALSAFDLI

SEQ ID NO: 1494328 - protein, 21 aa, Mycobacterium tuberculosis
YSARTARRGWRTIAVAQGFSV

SEQ ID NO: 1494329 - protein, 24 aa, Mycobacterium tuberculosis
YSDGRPVTCDDLVLAWAAQSGRFP

SEQ ID NO: 1494330 - protein, 22 aa, Mycobacterium tuberculosis
YSETDWDALRAAYPRDAERVKR

SEQ ID NO: 1494331 - protein, 18 aa, Mycobacterium tuberculosis
YSFQVAKVDNGRCDPVAG

SEQ ID NO: 1494332 - protein, 19 aa, Mycobacterium tuberculosis
YSGLELRDDRLVLSPQWPE

SEQ ID NO: 1494333 - protein, 20 aa, Mycobacterium tuberculosis
YSGLELRDDRLVLSPQWPEA

SEQ ID NO: 1494334 - protein, 22 aa, Mycobacterium tuberculosis
YSGLLEHLASWGIVAAAPDSER

SEQ ID NO: 1494335 - protein, 17 aa, Mycobacterium tuberculosis
YSGRSVIVVGPQLKLHQ

SEQ ID NO: 1494336 - protein, 26 aa, Mycobacterium tuberculosis
YSLARWRKADAALGRPVVSNQVRFSL

SEQ ID NO: 1494337 - protein, 20 aa, Mycobacterium tuberculosis
YSLTGHKWFTSAPMCDIFLV

SEQ ID NO: 1494338 - protein, 27 aa, Mycobacterium tuberculosis
YSNGILWRGDYQGLIGYSDTLSIPAIP

SEQ ID NO: 1494339 - protein, 22 aa, Mycobacterium tuberculosis
YSPRVEGVHLRFGPVARGGLRW

SEQ ID NO: 1494340 - protein, 17 aa, Mycobacterium tuberculosis
YSRLARHRIALKLVDRC

SEQ ID NO: 1494341 - protein, 17 aa, Mycobacterium tuberculosis
YSVGFANSGNYHIGIAN

SEQ ID NO: 1494342 - protein, 26 aa, Mycobacterium tuberculosis
YSVLPPEINSLRMFTGAGSAPMLAAS

SEQ ID NO: 1494343 - protein, 19 aa, Mycobacterium tuberculosis
YSYLVSLLPSRIVADLGAP

SEQ ID NO: 1494344 - protein, 18 aa, Mycobacterium tuberculosis
YTALEAIMRPGATELDIA

SEQ ID NO: 1494345 - protein, 28 aa, Mycobacterium tuberculosis
YTATEIANAAAMRVVLGAVNAPTQTLLG

SEQ ID NO: 1494346 - protein, 30 aa, Mycobacterium tuberculosis
YTDPVPFPSFKNGVGLMLQLPQATVVGTVA

SEQ ID NO: 1494347 - protein, 25 aa, Mycobacterium tuberculosis
YTEEMPVAVPWSLPAARSAHAGNDA

SEQ ID NO: 1494348 - protein, 23 aa, Mycobacterium tuberculosis
YTIKRLPGKLVRFMKTDTGQAQG

SEQ ID NO: 1494349 - protein, 29 aa, Mycobacterium tuberculosis
YTKGYKFSTYATWWIRQAITPRHGRPGPH

SEQ ID NO: 1494350 - protein, 17 aa, Mycobacterium tuberculosis
YTLACDLLLTGRHITAA

SEQ ID NO: 1494351 - protein, 17 aa, Mycobacterium tuberculosis
YTLGVNWRSDRALVESL

SEQ ID NO: 1494352 - protein, 20 aa, Mycobacterium tuberculosis
YTLRFKDLRTGGQYPDEIAG

SEQ ID NO: 1494353 - protein, 20 aa, Mycobacterium tuberculosis
YTQSRWWSERGWQHRQRAGL

SEQ ID NO: 1494354 - protein, 21 aa, Mycobacterium tuberculosis
YTTACRRRRRGFGEKPSVCTL

SEQ ID NO: 1494355 - protein, 18 aa, Mycobacterium tuberculosis
YVAPRLSRRILHQPYLGY

SEQ ID NO: 1494356 - protein, 24 aa, Mycobacterium tuberculosis
YVDFDPIYCWPKPVTKPYPPLYVG

SEQ ID NO: 1494357 - protein, 25 aa, Mycobacterium tuberculosis
YVDLVCSWGPMILGHAHPAVVEAVA

SEQ ID NO: 1494358 - protein, 18 aa, Mycobacterium tuberculosis
YVDNPGLFKAASPISYVH

SEQ ID NO: 1494359 - protein, 27 aa, Mycobacterium tuberculosis
YVEILPTPFLPAGVFDLWGLEADDSRR

SEQ ID NO: 1494360 - protein, 20 aa, Mycobacterium tuberculosis
YVPAGGRRGAGPAGLSAVVG

SEQ ID NO: 1494361 - protein, 19 aa, Mycobacterium tuberculosis
YVPLTAKRVTGIVSRGGSI

SEQ ID NO: 1494362 - protein, 18 aa, Mycobacterium tuberculosis
YVPSRPHLEWQLRRRVLQ

SEQ ID NO: 1494363 - protein, 20 aa, Mycobacterium tuberculosis
YVQRMGKLLGGQLWESAGSP

SEQ ID NO: 1494364 - protein, 20 aa, Mycobacterium tuberculosis
YVRKRLRCGNRHPLQRVKRR

SEQ ID NO: 1494365 - protein, 17 aa, Mycobacterium tuberculosis
YVSRAIVRSSWGRRCST

SEQ ID NO: 1494366 - protein, 26 aa, Mycobacterium tuberculosis
YVSRRSCVRLGASRCSTRSRGFCGKS

SEQ ID NO: 1494367 - protein, 24 aa, Mycobacterium tuberculosis
YVVEKRFNLSWSIEGTRSRTGKML

SEQ ID NO: 1494368 - protein, 19 aa, Mycobacterium tuberculosis
YVVSGWRADTFVAGAPEPR

SEQ ID NO: 1494369 - protein, 26 aa, Mycobacterium tuberculosis
YVYPGHAIWWLARGLEFFQDGEQFGE

SEQ ID NO: 1494370 - protein, 21 aa, Mycobacterium tuberculosis
YVYYPDCADVGIGAAVEIRGR

SEQ ID NO: 1494371 - protein, 22 aa, Mycobacterium tuberculosis
YVYYPDCADVGIGAAVEIRGRS

SEQ ID NO: 1494372 - protein, 28 aa, Mycobacterium tuberculosis
YWADNLRHTVRFSAAGALGARRRVPSLR

SEQ ID NO: 1494373 - protein, 19 aa, Mycobacterium tuberculosis
YWDQLKWNALANIAGTPAT

SEQ ID NO: 1494374 - protein, 18 aa, Mycobacterium tuberculosis
YWELPAMMLQFLRTGSGA

SEQ ID NO: 1494375 - protein, 21 aa, Mycobacterium tuberculosis
YWGCGCAGCATCAPPRQDDPR

SEQ ID NO: 1494376 - protein, 25 aa, Mycobacterium tuberculosis
YWSARGVDVTPFFAVLNGPRIAAPG

SEQ ID NO: 1494377 - protein, 23 aa, Mycobacterium tuberculosis
YWVEHVRKPVRFFDGVGLAESLG

SEQ ID NO: 1494378 - protein, 25 aa, Mycobacterium tuberculosis
YYAMTGWRLGWLLVPTVLRRAVDCL

SEQ ID NO: 1494379 - protein, 17 aa, Mycobacterium tuberculosis
LATARWVDWFNHRRLYQ

SEQ ID NO: 1494380 - protein, 21 aa, Mycobacterium tuberculosis
ATPKPSWPWVRTLLHSIYDQP

SEQ ID NO: 1494381 - protein, 19 aa, Mycobacterium tuberculosis
PKLRQGSYFPDWLLQRRKR

SEQ ID NO: 1494382 - protein, 18 aa, Mycobacterium tuberculosis
GARHCARLRGAIVGKSKS

SEQ ID NO: 1494383 - protein, 19 aa, Mycobacterium tuberculosis
AALRCLKRRLARTVFQALR

SEQ ID NO: 1494384 - protein, 18 aa, Mycobacterium tuberculosis
ENRAELMILIATNLLGQN

SEQ ID NO: 1494385 - protein, 22 aa, Mycobacterium tuberculosis
ALGELFAYRWSRCGGREEWVMD

SEQ ID NO: 1494386 - protein, 22 aa, Mycobacterium tuberculosis
VAVRRISMSFVNVAPQLVSTAA

SEQ ID NO: 1494387 - protein, 19 aa, Mycobacterium tuberculosis
ARLVGAMSVPPTWEGSVPA

SEQ ID NO: 1494388 - protein, 17 aa, Mycobacterium tuberculosis
FPSLCHFSGGIPAPEAD

SEQ ID NO: 1494389 - protein, 19 aa, Mycobacterium tuberculosis
RSAFVQLVLSNVFGQNAPA

SEQ ID NO: 1494390 - protein, 18 aa, Mycobacterium tuberculosis
HSYGSLLSGIALKDGASS

SEQ ID NO: 1494391 - protein, 18 aa, Mycobacterium tuberculosis
IRYPARLAPLHGWGSDGA

SEQ ID NO: 1494392 - protein, 19 aa, Mycobacterium tuberculosis
VSLRLPVRAPFAFEGVFGH

SEQ ID NO: 1494393 - protein, 20 aa, Mycobacterium tuberculosis
AADGSFEWRLRPSAPGQLVI

SEQ ID NO: 1494394 - protein, 19 aa, Mycobacterium tuberculosis
AAMALRIGVAVAHRDRDYE

SEQ ID NO: 1494395 - protein, 22 aa, Mycobacterium tuberculosis
AARRFPVPIAMFAELIDGARME

SEQ ID NO: 1494396 - protein, 28 aa, Mycobacterium tuberculosis
ADALALAICHCWRAPTIARMAEATSRAE

SEQ ID NO: 1494397 - protein, 20 aa, Mycobacterium tuberculosis
ADELGCRSLALVAFGTGVGG

SEQ ID NO: 1494398 - protein, 21 aa, Mycobacterium tuberculosis
ADGPPAWLRFFGCNPRHHSLA

SEQ ID NO: 1494399 - protein, 21 aa, Mycobacterium tuberculosis
ADLPPAVGVLVEYRGDDAAAA

SEQ ID NO: 1494400 - protein, 18 aa, Mycobacterium tuberculosis
AEEMLYLAMEDFRVDVVV

SEQ ID NO: 1494401 - protein, 17 aa, Mycobacterium tuberculosis
AEGFSWTPVHTMAGPDT

SEQ ID NO: 1494402 - protein, 18 aa, Mycobacterium tuberculosis
AEIARLALFLTTPAARHI

SEQ ID NO: 1494403 - protein, 21 aa, Mycobacterium tuberculosis
AELRIAQAQLVGWLEGLFHGI

SEQ ID NO: 1494404 - protein, 28 aa, Mycobacterium tuberculosis
AEPALPRLLRRLVIMGGMFDGQPITEWN

SEQ ID NO: 1494405 - protein, 20 aa, Mycobacterium tuberculosis
AGGMGIPAFYTPAGVGTQVA

SEQ ID NO: 1494406 - protein, 17 aa, Mycobacterium tuberculosis
AGLGWGMFPEKLAASPL

SEQ ID NO: 1494407 - protein, 17 aa, Mycobacterium tuberculosis
AGLKLLAFRGRFVEIGK

SEQ ID NO: 1494408 - protein, 23 aa, Mycobacterium tuberculosis
AGYRAVHVWLRLPAGRVEIQIRT

SEQ ID NO: 1494409 - protein, 20 aa, Mycobacterium tuberculosis
AHAAWLWSRRRAVVAGNSAA

SEQ ID NO: 1494410 - protein, 19 aa, Mycobacterium tuberculosis
AHLLPVFRLRYLPTPLGLH

SEQ ID NO: 1494411 - protein, 18 aa, Mycobacterium tuberculosis
AIGGGLCLALAADIRVAS

SEQ ID NO: 1494412 - protein, 19 aa, Mycobacterium tuberculosis
AIHRFPGSMAKRIQALAQI

SEQ ID NO: 1494413 - protein, 17 aa, Mycobacterium tuberculosis
AILPLYYLRRAGIAESD

SEQ ID NO: 1494414 - protein, 20 aa, Mycobacterium tuberculosis
AIVKGLRTGTDFEYELQMAQ

SEQ ID NO: 1494415 - protein, 19 aa, Mycobacterium tuberculosis
AKALWLRSRRRGVLAGYSA

SEQ ID NO: 1494416 - protein, 17 aa, Mycobacterium tuberculosis
ALAECLGQLLGGQHESS

SEQ ID NO: 1494417 - protein, 19 aa, Mycobacterium tuberculosis
AMDAFGLLCRMEGIIPAIE

SEQ ID NO: 1494418 - protein, 24 aa, Mycobacterium tuberculosis
AMSKFEVLTAMAFAAFADAPVDVA

SEQ ID NO: 1494419 - protein, 18 aa, Mycobacterium tuberculosis
APVAPGLALPRLVRSRIV

SEQ ID NO: 1494420 - protein, 24 aa, Mycobacterium tuberculosis
AQRLAEACGLDLVALGKVVRHSDS

SEQ ID NO: 1494421 - protein, 19 aa, Mycobacterium tuberculosis
AREALAWGLISAVYPDSDF

SEQ ID NO: 1494422 - protein, 19 aa, Mycobacterium tuberculosis
ARGLFPRHLDTIVNVPAPS

SEQ ID NO: 1494423 - protein, 20 aa, Mycobacterium tuberculosis
ARGPAVVEFNCRFGDPETQA

SEQ ID NO: 1494424 - protein, 21 aa, Mycobacterium tuberculosis
ARPTYAGGLLKIWNERNYRFW

SEQ ID NO: 1494425 - protein, 23 aa, Mycobacterium tuberculosis
ASPKETWLRLLLIDAGLPVPTTQ

SEQ ID NO: 1494426 - protein, 23 aa, Mycobacterium tuberculosis
ASREARAAYRWMRANQPVFRDRN

SEQ ID NO: 1494427 - protein, 17 aa, Mycobacterium tuberculosis
ATVSHDFDAELPAADAV

SEQ ID NO: 1494428 - protein, 17 aa, Mycobacterium tuberculosis
AVADLFAAFGMLPVGYY

SEQ ID NO: 1494429 - protein, 17 aa, Mycobacterium tuberculosis
AVEEFRFHVGLARAAGN

SEQ ID NO: 1494430 - protein, 19 aa, Mycobacterium tuberculosis
AWPRFGLELPELLPDKLAG

SEQ ID NO: 1494431 - protein, 19 aa, Mycobacterium tuberculosis
CGPIGLAVICMLKSRGVHT

SEQ ID NO: 1494432 - protein, 18 aa, Mycobacterium tuberculosis
CKKRHRLPGLDFVRGDAE

SEQ ID NO: 1494433 - protein, 17 aa, Mycobacterium tuberculosis
CQQRFPFPMTVFDSDCG

SEQ ID NO: 1494434 - protein, 25 aa, Mycobacterium tuberculosis
CQQVWCPLCALAALVTGEQHPLLTV

SEQ ID NO: 1494435 - protein, 24 aa, Mycobacterium tuberculosis
CSKGFPSYFLIVADLISYARSAGI

SEQ ID NO: 1494436 - protein, 20 aa, Mycobacterium tuberculosis
DAWEDFLFWLAADRKTARRI

SEQ ID NO: 1494437 - protein, 18 aa, Mycobacterium tuberculosis
DDVARAWSLLGLTVAGPD

SEQ ID NO: 1494438 - protein, 23 aa, Mycobacterium tuberculosis
DEARLQRLLAFVARQEPRLNWAV

SEQ ID NO: 1494439 - protein, 20 aa, Mycobacterium tuberculosis
DEPKGVPVFAWKGETLEEYW

SEQ ID NO: 1494440 - protein, 22 aa, Mycobacterium tuberculosis
DGRFALVLCRLFWHPPTFRQAC

SEQ ID NO: 1494441 - protein, 22 aa, Mycobacterium tuberculosis
DGTDSIELWAWVGAYDHVALCQ

SEQ ID NO: 1494442 - protein, 20 aa, Mycobacterium tuberculosis
DIDFAFGVGQLFANVPYAQL

SEQ ID NO: 1494443 - protein, 19 aa, Mycobacterium tuberculosis
DIGQLGWWSASPARASALE

SEQ ID NO: 1494444 - protein, 20 aa, Mycobacterium tuberculosis
DKVVRWWLPERWAFVDEIPR

SEQ ID NO: 1494445 - protein, 18 aa, Mycobacterium tuberculosis
DMRSGVAFSENYDDPAAE

SEQ ID NO: 1494446 - protein, 24 aa, Mycobacterium tuberculosis
DPGESRFYLSLGDELMRRFNGAAL

SEQ ID NO: 1494447 - protein, 22 aa, Mycobacterium tuberculosis
DQDRCRGWRMCVSGCPYKKVYF

SEQ ID NO: 1494448 - protein, 20 aa, Mycobacterium tuberculosis
DQPFAVWPWAAPKLGGARPA

SEQ ID NO: 1494449 - protein, 24 aa, Mycobacterium tuberculosis
DRMAFRSAAYWDILAKLDASVSDP

SEQ ID NO: 1494450 - protein, 17 aa, Mycobacterium tuberculosis
DRNALHEVVGWWAKLPV

SEQ ID NO: 1494451 - protein, 26 aa, Mycobacterium tuberculosis
DSFAPRLSFFWGIGMNFFMEVAKLRA

SEQ ID NO: 1494452 - protein, 24 aa, Mycobacterium tuberculosis
DSLGWLRDFLRLHTGGLVVISHNV

SEQ ID NO: 1494453 - protein, 17 aa, Mycobacterium tuberculosis
DVGCSWLPLYHDMGLAF

SEQ ID NO: 1494454 - protein, 23 aa, Mycobacterium tuberculosis
DVLNRLKPGIVMCREKQDTTSAV

SEQ ID NO: 1494455 - protein, 18 aa, Mycobacterium tuberculosis
EAAISLALAERGHTTVGL

SEQ ID NO: 1494456 - protein, 18 aa, Mycobacterium tuberculosis
EAECARWVAEQLAEVGYQ

SEQ ID NO: 1494457 - protein, 17 aa, Mycobacterium tuberculosis
EAFRPGTMEKLGLGPDD

SEQ ID NO: 1494458 - protein, 22 aa, Mycobacterium tuberculosis
EDSRWTVQLAWKAGRSDNLAHF

SEQ ID NO: 1494459 - protein, 21 aa, Mycobacterium tuberculosis
EEMPVAVPWSLPAARSAHAGN

SEQ ID NO: 1494460 - protein, 19 aa, Mycobacterium tuberculosis
EGVAVDWSSVFAGLGGRRV

SEQ ID NO: 1494461 - protein, 26 aa, Mycobacterium tuberculosis
EGVPRWRKATGLGWLTAEYAMLPSAT

SEQ ID NO: 1494462 - protein, 19 aa, Mycobacterium tuberculosis
EICDGWLPIFYSPRMAGMY

SEQ ID NO: 1494463 - protein, 21 aa, Mycobacterium tuberculosis
EKEAWLSMVMLEWGSCGQVAT

SEQ ID NO: 1494464 - protein, 21 aa, Mycobacterium tuberculosis
EKRFSMPWGHPARRMREFVAA

SEQ ID NO: 1494465 - protein, 18 aa, Mycobacterium tuberculosis
ELLRRLKGLPGFGEQKAR

SEQ ID NO: 1494466 - protein, 23 aa, Mycobacterium tuberculosis
ELMPRTPFIGGLGIVFERYEPDD

SEQ ID NO: 1494467 - protein, 18 aa, Mycobacterium tuberculosis
EPLKCLTENLWALHTNRY

SEQ ID NO: 1494468 - protein, 18 aa, Mycobacterium tuberculosis
EWPGIDWPATQSMAEQVL

SEQ ID NO: 1494469 - protein, 20 aa, Mycobacterium tuberculosis
FATASAREWWGLVWADRILQ

SEQ ID NO: 1494470 - protein, 19 aa, Mycobacterium tuberculosis
FDPIYCWPKPVTKPYPPLY

SEQ ID NO: 1494471 - protein, 25 aa, Mycobacterium tuberculosis
FHVYARIAPCWSFPQVRLAAQTVAR

SEQ ID NO: 1494472 - protein, 19 aa, Mycobacterium tuberculosis
FKDAELLGMPWIVVVGRGW

SEQ ID NO: 1494473 - protein, 20 aa, Mycobacterium tuberculosis
FPQSFGFSTLGGWLATRSGG

SEQ ID NO: 1494474 - protein, 21 aa, Mycobacterium tuberculosis
FQRPNPFPAMSIRNNVVAGLK

SEQ ID NO: 1494475 - protein, 24 aa, Mycobacterium tuberculosis
FRPEVSDGLFLRLAITSVDSLACA

SEQ ID NO: 1494476 - protein, 23 aa, Mycobacterium tuberculosis
FSALELLHAWALVHDDLIDRSAT

SEQ ID NO: 1494477 - protein, 17 aa, Mycobacterium tuberculosis
FSALTGWEAPDPAWWTA

SEQ ID NO: 1494478 - protein, 18 aa, Mycobacterium tuberculosis
FSGSSGQLAREWVAAGAR

SEQ ID NO: 1494479 - protein, 19 aa, Mycobacterium tuberculosis
FSLLPAWRGAAPVQAAIAA

SEQ ID NO: 1494480 - protein, 17 aa, Mycobacterium tuberculosis
FSPRSQYLVGHLAPVKL

SEQ ID NO: 1494481 - protein, 18 aa, Mycobacterium tuberculosis
FTAAGIRKTWVFQAFDDA

SEQ ID NO: 1494482 - protein, 20 aa, Mycobacterium tuberculosis
FTADFFATWGKLAAVRTPTI

SEQ ID NO: 1494483 - protein, 19 aa, Mycobacterium tuberculosis
GAELRKCWNIDFDDAGAIG

SEQ ID NO: 1494484 - protein, 19 aa, Mycobacterium tuberculosis
GALKLGVELGRGAVIVVNL

SEQ ID NO: 1494485 - protein, 19 aa, Mycobacterium tuberculosis
GDFVKIDFGALVAGYHSDM

SEQ ID NO: 1494486 - protein, 22 aa, Mycobacterium tuberculosis
GFADHFLPVAFDRFTRADTARG

SEQ ID NO: 1494487 - protein, 17 aa, Mycobacterium tuberculosis
GFELAYRLLSYPKPVVM

SEQ ID NO: 1494488 - protein, 19 aa, Mycobacterium tuberculosis
GFVFPTCRWVHPIGPGNRS

SEQ ID NO: 1494489 - protein, 21 aa, Mycobacterium tuberculosis
GGRTGRPFPWHSLGEAYLGRR

SEQ ID NO: 1494490 - protein, 19 aa, Mycobacterium tuberculosis
GGSMGRYGGVWAHDETRKS

SEQ ID NO: 1494491 - protein, 19 aa, Mycobacterium tuberculosis
GGVLYRFAVDPDRSAQFLL

SEQ ID NO: 1494492 - protein, 19 aa, Mycobacterium tuberculosis
GLLRPDAGLVRLGDRVLTD

SEQ ID NO: 1494493 - protein, 18 aa, Mycobacterium tuberculosis
GRHVPKLRQVIGCVFQDF

SEQ ID NO: 1494494 - protein, 26 aa, Mycobacterium tuberculosis
GSIRIPCTWCGLFGLKPQRDRISLEP

SEQ ID NO: 1494495 - protein, 18 aa, Mycobacterium tuberculosis
GSMSLSFSDPRFDDVKAP

SEQ ID NO: 1494496 - protein, 18 aa, Mycobacterium tuberculosis
GTAKFLFTRTTVGEIGIL

SEQ ID NO: 1494497 - protein, 20 aa, Mycobacterium tuberculosis
GVTPAMWAWWFGWHGSDTRR

SEQ ID NO: 1494498 - protein, 17 aa, Mycobacterium tuberculosis
HCGDAFYHRGTLDGRFR

SEQ ID NO: 1494499 - protein, 19 aa, Mycobacterium tuberculosis
HGFPESWYSWRHQIPALAG

SEQ ID NO: 1494500 - protein, 24 aa, Mycobacterium tuberculosis
HPGKWRVVFFWPKDFTFVCPTEIA

SEQ ID NO: 1494501 - protein, 25 aa, Mycobacterium tuberculosis
HPVAAFPQWFGRSWRRVAMLRYGEN

SEQ ID NO: 1494502 - protein, 18 aa, Mycobacterium tuberculosis
HWPMMVFRIGHARAPSVR

SEQ ID NO: 1494503 - protein, 25 aa, Mycobacterium tuberculosis
IDEALKLADLVAVFAPGGALAQYDE

SEQ ID NO: 1494504 - protein, 23 aa, Mycobacterium tuberculosis
IDERARAGLFLAMQYPVEVPGVS

SEQ ID NO: 1494505 - protein, 19 aa, Mycobacterium tuberculosis
IDFFTRWAAGNIKATDVDD

SEQ ID NO: 1494506 - protein, 20 aa, Mycobacterium tuberculosis
IEIELDQCWDLLRQRRALRQ

SEQ ID NO: 1494507 - protein, 19 aa, Mycobacterium tuberculosis
IERFLQLWAEGSMTIAMPS

SEQ ID NO: 1494508 - protein, 20 aa, Mycobacterium tuberculosis
IGRIKDLLIVYGRNHAPDDI

SEQ ID NO: 1494509 - protein, 17 aa, Mycobacterium tuberculosis
IKASMGMGAIRVQPLAP

SEQ ID NO: 1494510 - protein, 24 aa, Mycobacterium tuberculosis
ILATEILDPLGFRWTNFGVAERDV

SEQ ID NO: 1494511 - protein, 17 aa, Mycobacterium tuberculosis
ILEEARVPFLKDAFGAD

SEQ ID NO: 1494512 - protein, 25 aa, Mycobacterium tuberculosis
ILSDLNAFMGIRWVHNAYPFTAAEV

SEQ ID NO: 1494513 - protein, 18 aa, Mycobacterium tuberculosis
ILSSIRLPGGHFRSDIGL

SEQ ID NO: 1494514 - protein, 23 aa, Mycobacterium tuberculosis
INEPRFPSFKGIMAAKKKEVTVL

SEQ ID NO: 1494515 - protein, 23 aa, Mycobacterium tuberculosis
INYLRCIGCGLCIEACPTRALTM

SEQ ID NO: 1494516 - protein, 22 aa, Mycobacterium tuberculosis
IPGGWWLTFGQILGLAQNAPGV

SEQ ID NO: 1494517 - protein, 19 aa, Mycobacterium tuberculosis
IPVGPRLGNVVVEVDHLDK

SEQ ID NO: 1494518 - protein, 19 aa, Mycobacterium tuberculosis
IRALYAFKRYAWWPYTLVM

SEQ ID NO: 1494519 - protein, 19 aa, Mycobacterium tuberculosis
ISARSEWAPEFAIHDLDSL

SEQ ID NO: 1494520 - protein, 24 aa, Mycobacterium tuberculosis
KAREFPVNFDVWWFKLPREGDAEF

SEQ ID NO: 1494521 - protein, 24 aa, Mycobacterium tuberculosis
KGTFRLAFGIGDFRRDTGFGEDPA

SEQ ID NO: 1494522 - protein, 20 aa, Mycobacterium tuberculosis
KIDKGEFVFLIGPSGSGKST

SEQ ID NO: 1494523 - protein, 22 aa, Mycobacterium tuberculosis
KKLFCRMAEVFAGFLSYTDAQI

SEQ ID NO: 1494524 - protein, 17 aa, Mycobacterium tuberculosis
KPLTFSALTGWEAPDPA

SEQ ID NO: 1494525 - protein, 19 aa, Mycobacterium tuberculosis
KPVGGFPVTFGWIHASRRG

SEQ ID NO: 1494526 - protein, 17 aa, Mycobacterium tuberculosis
KQRSRLALWSRRLLGEA

SEQ ID NO: 1494527 - protein, 20 aa, Mycobacterium tuberculosis
KRLVDFAAGLAFALRGSFDK

SEQ ID NO: 1494528 - protein, 20 aa, Mycobacterium tuberculosis
KRQALAWAMSVAGKRANALL

SEQ ID NO: 1494529 - protein, 25 aa, Mycobacterium tuberculosis
KRWVTECLRAAYPLGRGHGPVSPLF

SEQ ID NO: 1494530 - protein, 18 aa, Mycobacterium tuberculosis
KVIRCFREGGGVPYSEYP

SEQ ID NO: 1494531 - protein, 19 aa, Mycobacterium tuberculosis
KVPGARCALAWSVQTAALA

SEQ ID NO: 1494532 - protein, 17 aa, Mycobacterium tuberculosis
KVPRRLKELHLRLGTAT

SEQ ID NO: 1494533 - protein, 19 aa, Mycobacterium tuberculosis
KVSELPAGHGLNVNTLSYG

SEQ ID NO: 1494534 - protein, 17 aa, Mycobacterium tuberculosis
LAPLHGWGSDGADTIGT

SEQ ID NO: 1494535 - protein, 18 aa, Mycobacterium tuberculosis
LAVLAGRLRAAGVRVDLA

SEQ ID NO: 1494536 - protein, 20 aa, Mycobacterium tuberculosis
LCTELKLPLVVDAAQGLGHV

SEQ ID NO: 1494537 - protein, 17 aa, Mycobacterium tuberculosis
LDGLGGWFIDGVQGNPS

SEQ ID NO: 1494538 - protein, 19 aa, Mycobacterium tuberculosis
LDLVPRVISAPEWTRLERG

SEQ ID NO: 1494539 - protein, 19 aa, Mycobacterium tuberculosis
LDRYLPFLATTKVLMAAVR

SEQ ID NO: 1494540 - protein, 18 aa, Mycobacterium tuberculosis
LFALLAYGEVAAFYRLTD

SEQ ID NO: 1494541 - protein, 18 aa, Mycobacterium tuberculosis
LFWDAAIFHRACEAVMPG

SEQ ID NO: 1494542 - protein, 22 aa, Mycobacterium tuberculosis
LGELRPLYRPGLVHIYHALTWG

SEQ ID NO: 1494543 - protein, 17 aa, Mycobacterium tuberculosis
LGIPYAWSRMRMMRSGK

SEQ ID NO: 1494544 - protein, 23 aa, Mycobacterium tuberculosis
LGVGWPKEFGGLGFGPIEQQIFV

SEQ ID NO: 1494545 - protein, 17 aa, Mycobacterium tuberculosis
LGVLPGMGGSQRLTRAI

SEQ ID NO: 1494546 - protein, 22 aa, Mycobacterium tuberculosis
LHSVKVIPSRGAWLEFDVDKRD

SEQ ID NO: 1494547 - protein, 21 aa, Mycobacterium tuberculosis
LKNVFAIAVGMGYSLGIGENT

SEQ ID NO: 1494548 - protein, 17 aa, Mycobacterium tuberculosis
LLAPHWPAPYGRGASPA

SEQ ID NO: 1494549 - protein, 18 aa, Mycobacterium tuberculosis
LLFARLLQYRAFKHVAEM

SEQ ID NO: 1494550 - protein, 19 aa, Mycobacterium tuberculosis
LLFGIPYDRIDVVVHPQSI

SEQ ID NO: 1494551 - protein, 21 aa, Mycobacterium tuberculosis
LLQRCPVCLYAGSIMPDDLLA

SEQ ID NO: 1494552 - protein, 23 aa, Mycobacterium tuberculosis
LLSGLPVRRLWGIGPVAEEKLHR

SEQ ID NO: 1494553 - protein, 17 aa, Mycobacterium tuberculosis
LNFAWPTARIAVIGADG

SEQ ID NO: 1494554 - protein, 19 aa, Mycobacterium tuberculosis
LNMAIPWIAAERGFIDAVI

SEQ ID NO: 1494555 - protein, 17 aa, Mycobacterium tuberculosis
LPQAVPVTRLWLSKQQT

SEQ ID NO: 1494556 - protein, 18 aa, Mycobacterium tuberculosis
LPSALGVTNHLAFRAQTY

SEQ ID NO: 1494557 - protein, 21 aa, Mycobacterium tuberculosis
LPVDWEPLGAIAIGYADEPSG

SEQ ID NO: 1494558 - protein, 23 aa, Mycobacterium tuberculosis
LPVKLCYAGPFFRYERPQAGRYR

SEQ ID NO: 1494559 - protein, 24 aa, Mycobacterium tuberculosis
LRKSRSEMAWAFPAVPMVARAPAA

SEQ ID NO: 1494560 - protein, 17 aa, Mycobacterium tuberculosis
LRLVALVDRLYDAGIPV

SEQ ID NO: 1494561 - protein, 24 aa, Mycobacterium tuberculosis
LRMLRPDLTIGFFLHIPFPPVELF

SEQ ID NO: 1494562 - protein, 19 aa, Mycobacterium tuberculosis
LRPCTRFGQRLRLRPFDLG

SEQ ID NO: 1494563 - protein, 18 aa, Mycobacterium tuberculosis
LRPLRIVVPEGSMLAPTH

SEQ ID NO: 1494564 - protein, 20 aa, Mycobacterium tuberculosis
LRRYPWPQGHTMSVLSNALT

SEQ ID NO: 1494565 - protein, 19 aa, Mycobacterium tuberculosis
LRTDRDWLADIVRFVASRR

SEQ ID NO: 1494566 - protein, 18 aa, Mycobacterium tuberculosis
LRTGTDFEYELQMAQMNK

SEQ ID NO: 1494567 - protein, 20 aa, Mycobacterium tuberculosis
LRYKMCVDAVAFARHIGYSC

SEQ ID NO: 1494568 - protein, 20 aa, Mycobacterium tuberculosis
LRYPLPAAWCTDVDVELYLK

SEQ ID NO: 1494569 - protein, 23 aa, Mycobacterium tuberculosis
LTRIPRVGVDWSQTTSFDEDTTA

SEQ ID NO: 1494570 - protein, 24 aa, Mycobacterium tuberculosis
LVLHDWGSALGFDWANQHRDRVQG

SEQ ID NO: 1494571 - protein, 18 aa, Mycobacterium tuberculosis
LWNAAEWSVQAQLDYLRT

SEQ ID NO: 1494572 - protein, 24 aa, Mycobacterium tuberculosis
LYSRLRLATAASWSIRYVVERRAI

SEQ ID NO: 1494573 - protein, 19 aa, Mycobacterium tuberculosis
MDCGIPFCHNGCPLGNLIP

SEQ ID NO: 1494574 - protein, 21 aa, Mycobacterium tuberculosis
MDRKVWLPSGGTLVIDRTEAM

SEQ ID NO: 1494575 - protein, 22 aa, Mycobacterium tuberculosis
MGRDGWLALGWPKEYGGQGRSA

SEQ ID NO: 1494576 - protein, 24 aa, Mycobacterium tuberculosis
MPGGFPIELGMTIRLAREKNYDLL

SEQ ID NO: 1494577 - protein, 18 aa, Mycobacterium tuberculosis
MPYKSGFGPFAPEIYRAP

SEQ ID NO: 1494578 - protein, 21 aa, Mycobacterium tuberculosis
NCGRPPRFCRRVGVRPPAPAA

SEQ ID NO: 1494579 - protein, 22 aa, Mycobacterium tuberculosis
NMFALGLLSWMYGRELEHSEAF

SEQ ID NO: 1494580 - protein, 23 aa, Mycobacterium tuberculosis
NQIWQCPVVLLADVRSVGVQGDG

SEQ ID NO: 1494581 - protein, 20 aa, Mycobacterium tuberculosis
PAAVCPHVEWALSSTLQAKA

SEQ ID NO: 1494582 - protein, 19 aa, Mycobacterium tuberculosis
PARLYARFPAGFAGMPALL

SEQ ID NO: 1494583 - protein, 23 aa, Mycobacterium tuberculosis
PEKLHELQRLWLIEATRYNVLPL

SEQ ID NO: 1494584 - protein, 23 aa, Mycobacterium tuberculosis
PELRAIFINSVWAPRLRIVESIL

SEQ ID NO: 1494585 - protein, 19 aa, Mycobacterium tuberculosis
PEPPIGHAMVRRSGTDVTV

SEQ ID NO: 1494586 - protein, 25 aa, Mycobacterium tuberculosis
PGVLARVAALFSRRGFNIESLAVGA

SEQ ID NO: 1494587 - protein, 20 aa, Mycobacterium tuberculosis
PKLMRRLLLWEVRRRLGRSV

SEQ ID NO: 1494588 - protein, 18 aa, Mycobacterium tuberculosis
PKPLGMPLQYMVSGMAVK

SEQ ID NO: 1494589 - protein, 17 aa, Mycobacterium tuberculosis
PQARLALITAIRAAGLD

SEQ ID NO: 1494590 - protein, 22 aa, Mycobacterium tuberculosis
PRGRGLMCAFSLPTTADRDELI

SEQ ID NO: 1494591 - protein, 19 aa, Mycobacterium tuberculosis
PRIATPMLARIGGAALAED

SEQ ID NO: 1494592 - protein, 21 aa, Mycobacterium tuberculosis
PRVDPALLLNCMLLAATERSV

SEQ ID NO: 1494593 - protein, 18 aa, Mycobacterium tuberculosis
PTARRILRHFGIEQHFEV

SEQ ID NO: 1494594 - protein, 19 aa, Mycobacterium tuberculosis
QADKYDVPRICFVNKMDKI

SEQ ID NO: 1494595 - protein, 17 aa, Mycobacterium tuberculosis
QESFGLKESAWVIDELR

SEQ ID NO: 1494596 - protein, 22 aa, Mycobacterium tuberculosis
QIPKLRAGSFFPSLLERRRRID

SEQ ID NO: 1494597 - protein, 19 aa, Mycobacterium tuberculosis
QKARIFLALLGKQYGVTPK

SEQ ID NO: 1494598 - protein, 23 aa, Mycobacterium tuberculosis
QPDLRVLVDLGYGYGYADVPTPA

SEQ ID NO: 1494599 - protein, 23 aa, Mycobacterium tuberculosis
QSSNGPLSWLWQILFGTPNFPTS

SEQ ID NO: 1494600 - protein, 22 aa, Mycobacterium tuberculosis
QYKDVILGLVFLKYVSDAYDER

SEQ ID NO: 1494601 - protein, 20 aa, Mycobacterium tuberculosis
RACQVRFAIYLGDLGRDTAA

SEQ ID NO: 1494602 - protein, 20 aa, Mycobacterium tuberculosis
RADPGEIVWTWVAYEQDPTR

SEQ ID NO: 1494603 - protein, 18 aa, Mycobacterium tuberculosis
RAEPDCLLDSLLLEDPGL

SEQ ID NO: 1494604 - protein, 18 aa, Mycobacterium tuberculosis
RALIAVRGLHRFAAAEGL

SEQ ID NO: 1494605 - protein, 20 aa, Mycobacterium tuberculosis
RAQLLELVWGYDFAADTNVV

SEQ ID NO: 1494606 - protein, 20 aa, Mycobacterium tuberculosis
REMLSRLGVEYVGDSRSVDF

SEQ ID NO: 1494607 - protein, 23 aa, Mycobacterium tuberculosis
RFYPEIPSRFAVVARRGNDIRWF

SEQ ID NO: 1494608 - protein, 20 aa, Mycobacterium tuberculosis
RGDIKIALFGNHAPKTVANF

SEQ ID NO: 1494609 - protein, 18 aa, Mycobacterium tuberculosis
RHHLPVPPAFCITTEVGV

SEQ ID NO: 1494610 - protein, 21 aa, Mycobacterium tuberculosis
RISSIPVEYVLAFVEGSNMGQ

SEQ ID NO: 1494611 - protein, 26 aa, Mycobacterium tuberculosis
RLDEWRCLECIRALRANQQAAQRLRG

SEQ ID NO: 1494612 - protein, 17 aa, Mycobacterium tuberculosis
RLEKLWLPGPDRLLDCV

SEQ ID NO: 1494613 - protein, 22 aa, Mycobacterium tuberculosis
RLRDIGGIVVIDFIDMVLESNR

SEQ ID NO: 1494614 - protein, 19 aa, Mycobacterium tuberculosis
RLSAFKVPHRFAVVDRLPR

SEQ ID NO: 1494615 - protein, 24 aa, Mycobacterium tuberculosis
RMLTLPATFGLYVERAWPRHRRLS

SEQ ID NO: 1494616 - protein, 21 aa, Mycobacterium tuberculosis
RNVEIPDHFRIYVSQKLARLE

SEQ ID NO: 1494617 - protein, 19 aa, Mycobacterium tuberculosis
RPAGTSIRILFAFDPARQA

SEQ ID NO: 1494618 - protein, 25 aa, Mycobacterium tuberculosis
RPDFATGLMPLRWGTGFMLGSAKYG

SEQ ID NO: 1494619 - protein, 23 aa, Mycobacterium tuberculosis
RPDLDVDLVYRFIRDTTWVSVRW

SEQ ID NO: 1494620 - protein, 25 aa, Mycobacterium tuberculosis
RPQLAVTFRNGWQWATVEGRAQLVG

SEQ ID NO: 1494621 - protein, 19 aa, Mycobacterium tuberculosis
RPSEVARLGYLAGIVATML

SEQ ID NO: 1494622 - protein, 18 aa, Mycobacterium tuberculosis
RQLVEVPVGFKWFVDGLI

SEQ ID NO: 1494623 - protein, 21 aa, Mycobacterium tuberculosis
RREVWRLLASFRVQPATEVIA

SEQ ID NO: 1494624 - protein, 18 aa, Mycobacterium tuberculosis
RRRQWLPAAEVIGELVRL

SEQ ID NO: 1494625 - protein, 25 aa, Mycobacterium tuberculosis
RRVGRPRIRLAYRLTPRRVLGQRRA

SEQ ID NO: 1494626 - protein, 18 aa, Mycobacterium tuberculosis
RTLAVAVYNHYKRIQAGE

SEQ ID NO: 1494627 - protein, 19 aa, Mycobacterium tuberculosis
RVAALRRCVPMVGQIKDPT

SEQ ID NO: 1494628 - protein, 17 aa, Mycobacterium tuberculosis
RVADAWIKAQAYRLQTF

SEQ ID NO: 1494629 - protein, 23 aa, Mycobacterium tuberculosis
RVVTKCFLLWAGVVGAISLEVFG

SEQ ID NO: 1494630 - protein, 18 aa, Mycobacterium tuberculosis
SAGLRPGADVALALDAAA

SEQ ID NO: 1494631 - protein, 19 aa, Mycobacterium tuberculosis
SARWPAARFAVRNVAVQGP

SEQ ID NO: 1494632 - protein, 22 aa, Mycobacterium tuberculosis
SGKYRRVLALAWEKQSESNAMW

SEQ ID NO: 1494633 - protein, 26 aa, Mycobacterium tuberculosis
SKPLVRLRVPFTLSRNEIDDVERGSK

SEQ ID NO: 1494634 - protein, 24 aa, Mycobacterium tuberculosis
SLYHFAWDEFCDWYLELAKTQLAQ

SEQ ID NO: 1494635 - protein, 24 aa, Mycobacterium tuberculosis
SMVKRLPLARALRTAQRHDYLGHY

SEQ ID NO: 1494636 - protein, 24 aa, Mycobacterium tuberculosis
SQALRPAMFSTFLMWVLADLFTFL

SEQ ID NO: 1494637 - protein, 20 aa, Mycobacterium tuberculosis
SVNMFAPWIRRIFIATDSTP

SEQ ID NO: 1494638 - protein, 22 aa, Mycobacterium tuberculosis
SWCGYCLRLKTALTANRIAYDE

SEQ ID NO: 1494639 - protein, 22 aa, Mycobacterium tuberculosis
SWHGRFPFDWGVSAHPKVDNKT

SEQ ID NO: 1494640 - protein, 21 aa, Mycobacterium tuberculosis
SWTEPKGGYFISLDVLPGTAR

SEQ ID NO: 1494641 - protein, 18 aa, Mycobacterium tuberculosis
TALPRLLAALQHAGVTVH

SEQ ID NO: 1494642 - protein, 27 aa, Mycobacterium tuberculosis
TALVAALCRQLRGELSLAVLTNDIYTT

SEQ ID NO: 1494643 - protein, 19 aa, Mycobacterium tuberculosis
TDVAILFRLGCRSVGESRE

SEQ ID NO: 1494644 - protein, 21 aa, Mycobacterium tuberculosis
TDVRAAWDWLAHVCGLAAEHM

SEQ ID NO: 1494645 - protein, 24 aa, Mycobacterium tuberculosis
TEHRPEILLSFGFVPKVETRIGLI

SEQ ID NO: 1494646 - protein, 22 aa, Mycobacterium tuberculosis
TENPAGSVLIEFGHTKVLCTAS

SEQ ID NO: 1494647 - protein, 21 aa, Mycobacterium tuberculosis
TEPKLKCYLEIRCAVTGDLPA

SEQ ID NO: 1494648 - protein, 19 aa, Mycobacterium tuberculosis
TFRKLRGGFDLILNTVSAN

SEQ ID NO: 1494649 - protein, 18 aa, Mycobacterium tuberculosis
TKLYKAMNARGWKTKEPG

SEQ ID NO: 1494650 - protein, 23 aa, Mycobacterium tuberculosis
TKSLRAGKVFVDWSQNSGSKTTI

SEQ ID NO: 1494651 - protein, 18 aa, Mycobacterium tuberculosis
TLDFPRQVDVLGLAAKAG

SEQ ID NO: 1494652 - protein, 18 aa, Mycobacterium tuberculosis
TMKVSWRLYAYVSKDADR

SEQ ID NO: 1494653 - protein, 18 aa, Mycobacterium tuberculosis
TRKSFSIAGTRVVDAIKL

SEQ ID NO: 1494654 - protein, 18 aa, Mycobacterium tuberculosis
TRRPSVCNAAETLLVDAA

SEQ ID NO: 1494655 - protein, 17 aa, Mycobacterium tuberculosis
TVADMMIYLGWSMAGRG

SEQ ID NO: 1494656 - protein, 19 aa, Mycobacterium tuberculosis
VAAGMPFPLFVKAVAGGGG

SEQ ID NO: 1494657 - protein, 22 aa, Mycobacterium tuberculosis
VAFGPQCRRGMFGSGRARTRAS

SEQ ID NO: 1494658 - protein, 24 aa, Mycobacterium tuberculosis
VDVWKGWADRAGWVPWSADSAPMV

SEQ ID NO: 1494659 - protein, 21 aa, Mycobacterium tuberculosis
VEVPVGFKWFVDGLIGATLGF

SEQ ID NO: 1494660 - protein, 18 aa, Mycobacterium tuberculosis
VFISARWQADFRADVPVL

SEQ ID NO: 1494661 - protein, 22 aa, Mycobacterium tuberculosis
VFPRYHPRWAWWLTSVPVLREF

SEQ ID NO: 1494662 - protein, 21 aa, Mycobacterium tuberculosis
VGERVLAGYGFRTDQRAHAEI

SEQ ID NO: 1494663 - protein, 20 aa, Mycobacterium tuberculosis
VGGARRCAAQSWSLDRIKSV

SEQ ID NO: 1494664 - protein, 18 aa, Mycobacterium tuberculosis
VGLSRGWSLIKSVRLGNA

SEQ ID NO: 1494665 - protein, 23 aa, Mycobacterium tuberculosis
VMARGIEIGHIFQLGSKYTDAFT

SEQ ID NO: 1494666 - protein, 19 aa, Mycobacterium tuberculosis
VQLILKFIPGMRERHFGHI

SEQ ID NO: 1494667 - protein, 23 aa, Mycobacterium tuberculosis
VRPEPFGALLYHFGTRKLSFLKN

SEQ ID NO: 1494668 - protein, 18 aa, Mycobacterium tuberculosis
VRRGEVIGLLGPNGAGKT

SEQ ID NO: 1494669 - protein, 19 aa, Mycobacterium tuberculosis
VWLRGRRATSHWLTLPALK

SEQ ID NO: 1494670 - protein, 18 aa, Mycobacterium tuberculosis
WERRAIAVFGHRPYIGVS

SEQ ID NO: 1494671 - protein, 17 aa, Mycobacterium tuberculosis
WGAEVYHALKSVLKKEG

SEQ ID NO: 1494672 - protein, 17 aa, Mycobacterium tuberculosis
WGGMVRYAARRGVRVIG

SEQ ID NO: 1494673 - protein, 17 aa, Mycobacterium tuberculosis
WGGYRIAPEIVEFWQGR

SEQ ID NO: 1494674 - protein, 23 aa, Mycobacterium tuberculosis
WGREVIGIAAGVVRFIGVDGYRW

SEQ ID NO: 1494675 - protein, 22 aa, Mycobacterium tuberculosis
WKQFGKSLIHWDEWTTNPNEAL

SEQ ID NO: 1494676 - protein, 20 aa, Mycobacterium tuberculosis
WLVGNGGLDWAVKRTADSSQ

SEQ ID NO: 1494677 - protein, 28 aa, Mycobacterium tuberculosis
WMRPMFRGLRHWRVLRLLRTVGMHHALG

SEQ ID NO: 1494678 - protein, 19 aa, Mycobacterium tuberculosis
WPDKPGRYFTVRAGSLVAW

SEQ ID NO: 1494679 - protein, 18 aa, Mycobacterium tuberculosis
WPNPWPMYRALRDHDPVH

SEQ ID NO: 1494680 - protein, 17 aa, Mycobacterium tuberculosis
WPTLDGMFAPHASDVVF

SEQ ID NO: 1494681 - protein, 17 aa, Mycobacterium tuberculosis
WSETCYRYTGAHRDALS

SEQ ID NO: 1494682 - protein, 18 aa, Mycobacterium tuberculosis
YAVPRLLARNGLSLQDFD

SEQ ID NO: 1494683 - protein, 18 aa, Mycobacterium tuberculosis
YEFWREFLASLKARGLTG

SEQ ID NO: 1494684 - protein, 24 aa, Mycobacterium tuberculosis
YELARDALREWLRRGGKPARLIEI

SEQ ID NO: 1494685 - protein, 22 aa, Mycobacterium tuberculosis
YESFSRCFGCGRIYWPGSHHAR

SEQ ID NO: 1494686 - protein, 19 aa, Mycobacterium tuberculosis
YFTGTGLKGWINRWFYSVS

SEQ ID NO: 1494687 - protein, 17 aa, Mycobacterium tuberculosis
YGGPCYARIDAPADREQ

SEQ ID NO: 1494688 - protein, 20 aa, Mycobacterium tuberculosis
YRAAAEFVPRIGALIDTVHR

SEQ ID NO: 1494689 - protein, 18 aa, Mycobacterium tuberculosis
YRPFYLRNLLDAVQGRNL

SEQ ID NO: 1494690 - protein, 21 aa, Mycobacterium tuberculosis
YRSVIDFYRQVFGWRTEQISD

SEQ ID NO: 1494691 - protein, 19 aa, Mycobacterium tuberculosis
YSEIFAHSFARPTAIADGL

SEQ ID NO: 1494692 - protein, 29 aa, Mycobacterium tuberculosis
YSNGFFWRGDYQGLIGFSGTLTIPAAGLD

SEQ ID NO: 1494693 - protein, 18 aa, Mycobacterium tuberculosis
AAEARYAEMWAQDAAAMY

SEQ ID NO: 1494694 - protein, 21 aa, Mycobacterium tuberculosis
AARLRLPIDVIATVPMAENMP

SEQ ID NO: 1494695 - protein, 20 aa, Mycobacterium tuberculosis
AARMWARLRIHLAESGRRVR

SEQ ID NO: 1494696 - protein, 19 aa, Mycobacterium tuberculosis
ADEIVRWATPVTAFQRTAL

SEQ ID NO: 1494697 - protein, 18 aa, Mycobacterium tuberculosis
ADFGELRWRDGVAVTVVL

SEQ ID NO: 1494698 - protein, 22 aa, Mycobacterium tuberculosis
ADGKRSGLWPGLRETFKSGSSQ

SEQ ID NO: 1494699 - protein, 23 aa, Mycobacterium tuberculosis
ADSGLRTSVQFVGPLSVVDSALA

SEQ ID NO: 1494700 - protein, 20 aa, Mycobacterium tuberculosis
ADVMPLDWYLHVRHAVHGDI

SEQ ID NO: 1494701 - protein, 21 aa, Mycobacterium tuberculosis
AEAIRRFGPIFAQYYGQSEAP

SEQ ID NO: 1494702 - protein, 22 aa, Mycobacterium tuberculosis
AEAYRAISLLLRRPPGREAYPG

SEQ ID NO: 1494703 - protein, 17 aa, Mycobacterium tuberculosis
AEELPLLGSCTFKAAGH

SEQ ID NO: 1494704 - protein, 26 aa, Mycobacterium tuberculosis
AEGFLPALLDWCRKNHVVFIADEVQT

SEQ ID NO: 1494705 - protein, 24 aa, Mycobacterium tuberculosis
AELGPWRWAPTFAFIDQQAAEVHW

SEQ ID NO: 1494706 - protein, 19 aa, Mycobacterium tuberculosis
AFILPPSIFHWLNYSVTAY

SEQ ID NO: 1494707 - protein, 20 aa, Mycobacterium tuberculosis
AGLVFPQPPAPIAVSGTDSV

SEQ ID NO: 1494708 - protein, 19 aa, Mycobacterium tuberculosis
AGPALACGNAFVLKPSERD

SEQ ID NO: 1494709 - protein, 21 aa, Mycobacterium tuberculosis
AGTGWLPGWRLTFGGEDIGWE

SEQ ID NO: 1494710 - protein, 24 aa, Mycobacterium tuberculosis
AGVRALRDGVVWRIAAETFTDMLE

SEQ ID NO: 1494711 - protein, 23 aa, Mycobacterium tuberculosis
AHTQLAWVLGCFTGFGQASRMTQ

SEQ ID NO: 1494712 - protein, 22 aa, Mycobacterium tuberculosis
AITRPRWLWKFAKTLRPPDLRV

SEQ ID NO: 1494713 - protein, 17 aa, Mycobacterium tuberculosis
AKIALPGTEVWAIDGDG

SEQ ID NO: 1494714 - protein, 21 aa, Mycobacterium tuberculosis
AKLDVIVPMSFLCDGYGLNVT

SEQ ID NO: 1494715 - protein, 19 aa, Mycobacterium tuberculosis
AKTTFGRIGVKVWIYKGDI

SEQ ID NO: 1494716 - protein, 17 aa, Mycobacterium tuberculosis
ALAGFGLTEPGAGSDAG

SEQ ID NO: 1494717 - protein, 23 aa, Mycobacterium tuberculosis
ALARARRALNEFGVEGLATVIPF

SEQ ID NO: 1494718 - protein, 22 aa, Mycobacterium tuberculosis
ALCARFRISGLPVVDDDGALVG

SEQ ID NO: 1494719 - protein, 20 aa, Mycobacterium tuberculosis
ALDDVVKFLLPRGSTRKAAK

SEQ ID NO: 1494720 - protein, 22 aa, Mycobacterium tuberculosis
ALDGAGLGTVWGRQLATSMLAD

SEQ ID NO: 1494721 - protein, 22 aa, Mycobacterium tuberculosis
ALRGQHSWAAAIPWSDIQKYWM

SEQ ID NO: 1494722 - protein, 19 aa, Mycobacterium tuberculosis
ANALRSWSVLRFEVTEDPS

SEQ ID NO: 1494723 - protein, 18 aa, Mycobacterium tuberculosis
ANAMSWFWYLMALNPQAR

SEQ ID NO: 1494724 - protein, 22 aa, Mycobacterium tuberculosis
APARAYNPLFIWGESGLGKTHL

SEQ ID NO: 1494725 - protein, 20 aa, Mycobacterium tuberculosis
APMFHAWGFSQLVLASSLAC

SEQ ID NO: 1494726 - protein, 20 aa, Mycobacterium tuberculosis
APVDGCIRIGLRYINEIRAS

SEQ ID NO: 1494727 - protein, 17 aa, Mycobacterium tuberculosis
APVVLGWAGFRDVAQRY

SEQ ID NO: 1494728 - protein, 18 aa, Mycobacterium tuberculosis
AQAIRFAKEFARNATESG

SEQ ID NO: 1494729 - protein, 22 aa, Mycobacterium tuberculosis
AQLLERFGMFGIRMSIAVLAAG

SEQ ID NO: 1494730 - protein, 18 aa, Mycobacterium tuberculosis
AQVAVRWAARDAELRKIP

SEQ ID NO: 1494731 - protein, 18 aa, Mycobacterium tuberculosis
ARHLDCWVLGTVCKGGKQ

SEQ ID NO: 1494732 - protein, 18 aa, Mycobacterium tuberculosis
ARIEFKLRDWLFARQRYW

SEQ ID NO: 1494733 - protein, 20 aa, Mycobacterium tuberculosis
ARPARAWLFTVARNMIIDER

SEQ ID NO: 1494734 - protein, 23 aa, Mycobacterium tuberculosis
ARRLYASRGWLPWHGPTSVLAPT

SEQ ID NO: 1494735 - protein, 20 aa, Mycobacterium tuberculosis
ARSTGWTGLIVHGAVRDAAA

SEQ ID NO: 1494736 - protein, 18 aa, Mycobacterium tuberculosis
ASAYSRMCLTTFFTSLTQ

SEQ ID NO: 1494737 - protein, 20 aa, Mycobacterium tuberculosis
ASYLLSLRAAWQADNNIPNS

SEQ ID NO: 1494738 - protein, 21 aa, Mycobacterium tuberculosis
ATRLVAEWPPRLNIPDPDPLR

SEQ ID NO: 1494739 - protein, 23 aa, Mycobacterium tuberculosis
ATTCGRPFADFELRIADDGEVLL

SEQ ID NO: 1494740 - protein, 24 aa, Mycobacterium tuberculosis
AVAGIRLALSLGFRVRVAATVASP

SEQ ID NO: 1494741 - protein, 19 aa, Mycobacterium tuberculosis
AVDSLWFDALRSVAVDHRD

SEQ ID NO: 1494742 - protein, 24 aa, Mycobacterium tuberculosis
AVESGLRVARKWGADVNGLPAGRH

SEQ ID NO: 1494743 - protein, 18 aa, Mycobacterium tuberculosis
CAAQSWSLDRIKSVKQAA

SEQ ID NO: 1494744 - protein, 19 aa, Mycobacterium tuberculosis
CGGGRRWASAEARRHVTQG

SEQ ID NO: 1494745 - protein, 25 aa, Mycobacterium tuberculosis
CLDKYARLFAWLGLWERHTDLAVIP

SEQ ID NO: 1494746 - protein, 19 aa, Mycobacterium tuberculosis
CLQFDLPIRLFEIGSSAGL

SEQ ID NO: 1494747 - protein, 18 aa, Mycobacterium tuberculosis
CRLYCGACDAGARSTTSL

SEQ ID NO: 1494748 - protein, 18 aa, Mycobacterium tuberculosis
CTTMSWPQRADHAAQAAR

SEQ ID NO: 1494749 - protein, 20 aa, Mycobacterium tuberculosis
DAVVCSLVLCSVSDPGAVLA

SEQ ID NO: 1494750 - protein, 19 aa, Mycobacterium tuberculosis
DELKARFSRPLAFGTAGLR

SEQ ID NO: 1494751 - protein, 17 aa, Mycobacterium tuberculosis
DERGMRTVMCILNGQLR

SEQ ID NO: 1494752 - protein, 18 aa, Mycobacterium tuberculosis
DESLWRLLCEQVGAAALV

SEQ ID NO: 1494753 - protein, 17 aa, Mycobacterium tuberculosis
DGVFPLAAFRKIVDINL

SEQ ID NO: 1494754 - protein, 21 aa, Mycobacterium tuberculosis
DIYRCHPALWSLDTTPEGYSW

SEQ ID NO: 1494755 - protein, 24 aa, Mycobacterium tuberculosis
DMKLPISLALGWPRRVSGAAAACD

SEQ ID NO: 1494756 - protein, 24 aa, Mycobacterium tuberculosis
DNRAWRLYRRLGFTDIIRGYHFAG

SEQ ID NO: 1494757 - protein, 21 aa, Mycobacterium tuberculosis
DPGSVSYLFSRKGVVTLEKNG

SEQ ID NO: 1494758 - protein, 26 aa, Mycobacterium tuberculosis
DVALIVGVPMDFRLGFGGVFGSTTQL

SEQ ID NO: 1494759 - protein, 18 aa, Mycobacterium tuberculosis
DVKFEWHALPYLLGFKKA

SEQ ID NO: 1494760 - protein, 25 aa, Mycobacterium tuberculosis
DVVRRARFAAAFTFQYSKRPGTPAA

SEQ ID NO: 1494761 - protein, 24 aa, Mycobacterium tuberculosis
DWAEMLMRMYIRWAEQHKYPVEVF

SEQ ID NO: 1494762 - protein, 19 aa, Mycobacterium tuberculosis
EADLARFPADVARVVVRLI

SEQ ID NO: 1494763 - protein, 18 aa, Mycobacterium tuberculosis
EAGMMWREVYRLRQPVLL

SEQ ID NO: 1494764 - protein, 17 aa, Mycobacterium tuberculosis
ECLRTGAWEGLKPAELA

SEQ ID NO: 1494765 - protein, 20 aa, Mycobacterium tuberculosis
EDRLRTRFEWGLITDVQPPE

SEQ ID NO: 1494766 - protein, 20 aa, Mycobacterium tuberculosis
EIWRFTPLRRLRGLHDGSAR

SEQ ID NO: 1494767 - protein, 18 aa, Mycobacterium tuberculosis
ELFLRAAQAYGVKRGQRM

SEQ ID NO: 1494768 - protein, 18 aa, Mycobacterium tuberculosis
ELYFPGSPVLSVRGSFAE

SEQ ID NO: 1494769 - protein, 18 aa, Mycobacterium tuberculosis
EMTRPRFGSWLRNSTRGA

SEQ ID NO: 1494770 - protein, 21 aa, Mycobacterium tuberculosis
EPLPRTLVWSAAWEMTREAEL

SEQ ID NO: 1494771 - protein, 21 aa, Mycobacterium tuberculosis
EPRLSLQWWVRVESLAKAAGD

SEQ ID NO: 1494772 - protein, 21 aa, Mycobacterium tuberculosis
EPWRGEPLLAYLRKMVFWSMV

SEQ ID NO: 1494773 - protein, 21 aa, Mycobacterium tuberculosis
EQMKMFLTRLGFGSKVVVTGD

SEQ ID NO: 1494774 - protein, 23 aa, Mycobacterium tuberculosis
ETARGAVCAAEIAAADPTVGMMW

SEQ ID NO: 1494775 - protein, 23 aa, Mycobacterium tuberculosis
ETNVEFWAAVVLDFARVPANMMP

SEQ ID NO: 1494776 - protein, 20 aa, Mycobacterium tuberculosis
EVFRRTRIVAHEVRRHCTTG

SEQ ID NO: 1494777 - protein, 17 aa, Mycobacterium tuberculosis
EVPEVWAAVTSVFRDYG

SEQ ID NO: 1494778 - protein, 22 aa, Mycobacterium tuberculosis
EVPMKRFDLMNGIQVRGTYAVS

SEQ ID NO: 1494779 - protein, 25 aa, Mycobacterium tuberculosis
FAAAFKPPLRWGIRMTGHRFFREYP

SEQ ID NO: 1494780 - protein, 24 aa, Mycobacterium tuberculosis
FAGIGIPIAEIWGMSELSCVATAS

SEQ ID NO: 1494781 - protein, 24 aa, Mycobacterium tuberculosis
FGPLRIRFWACGIFEVQRARYGIT

SEQ ID NO: 1494782 - protein, 18 aa, Mycobacterium tuberculosis
FGVPMGFGGPHAGYLAVH

SEQ ID NO: 1494783 - protein, 23 aa, Mycobacterium tuberculosis
FILAEIFPGGWLPSIPTVHEYAE

SEQ ID NO: 1494784 - protein, 17 aa, Mycobacterium tuberculosis
FKIPGWRDALTRTGVVE

SEQ ID NO: 1494785 - protein, 19 aa, Mycobacterium tuberculosis
FKKACAGFRSLGRGATEEP

SEQ ID NO: 1494786 - protein, 18 aa, Mycobacterium tuberculosis
FLHKELYREYSLRPPKGV

SEQ ID NO: 1494787 - protein, 18 aa, Mycobacterium tuberculosis
FLPDRWVYEFGRRRNIAI

SEQ ID NO: 1494788 - protein, 18 aa, Mycobacterium tuberculosis
FMGCCAFAALADEAQRCR

SEQ ID NO: 1494789 - protein, 20 aa, Mycobacterium tuberculosis
FNEFRAIAGIGEMFDTLLVY

SEQ ID NO: 1494790 - protein, 17 aa, Mycobacterium tuberculosis
FNLSWSIEGTRSRTGKM

SEQ ID NO: 1494791 - protein, 18 aa, Mycobacterium tuberculosis
FRDGLCFVDLAPIADPGM

SEQ ID NO: 1494792 - protein, 19 aa, Mycobacterium tuberculosis
FSLPLARMVLTSAPVTVLE

SEQ ID NO: 1494793 - protein, 17 aa, Mycobacterium tuberculosis
FSPLRLPPDLDFTSLFH

SEQ ID NO: 1494794 - protein, 24 aa, Mycobacterium tuberculosis
FSRFELLRLLAFSRIGALPITKAS

SEQ ID NO: 1494795 - protein, 17 aa, Mycobacterium tuberculosis
FTKLAARFLGPVLGGVQ

SEQ ID NO: 1494796 - protein, 21 aa, Mycobacterium tuberculosis
GACPGPFGAPIPGFARSYQPS

SEQ ID NO: 1494797 - protein, 20 aa, Mycobacterium tuberculosis
GAGVSGLWLLSGMRDDGVLT

SEQ ID NO: 1494798 - protein, 23 aa, Mycobacterium tuberculosis
GAKMVTAVACARVPKLTVVIGGS

SEQ ID NO: 1494799 - protein, 21 aa, Mycobacterium tuberculosis
GAPLLSLRTDRDWLADIVRFV

SEQ ID NO: 1494800 - protein, 22 aa, Mycobacterium tuberculosis
GASSEAARAWWGNFLAQKANEA

SEQ ID NO: 1494801 - protein, 19 aa, Mycobacterium tuberculosis
GATLWRSGIQRVLRGFVER

SEQ ID NO: 1494802 - protein, 17 aa, Mycobacterium tuberculosis
GAWSDIGQLGWWSASPA

SEQ ID NO: 1494803 - protein, 19 aa, Mycobacterium tuberculosis
GCAGLRYNLFFDDRTLDGD

SEQ ID NO: 1494804 - protein, 24 aa, Mycobacterium tuberculosis
GCPYRCTFCGTGAMSAMLGKDSYR

SEQ ID NO: 1494805 - protein, 19 aa, Mycobacterium tuberculosis
GDAALALLRAELRPGDVVL

SEQ ID NO: 1494806 - protein, 19 aa, Mycobacterium tuberculosis
GEGGLRIVGISAVGSIDDL

SEQ ID NO: 1494807 - protein, 25 aa, Mycobacterium tuberculosis
GEHIGWRFWMGIAFELTSDPQELRE

SEQ ID NO: 1494808 - protein, 18 aa, Mycobacterium tuberculosis
GELERIGGRYGLQTMCEG

SEQ ID NO: 1494809 - protein, 20 aa, Mycobacterium tuberculosis
GELYLPRFLFGVFLSEQMIA

SEQ ID NO: 1494810 - protein, 20 aa, Mycobacterium tuberculosis
GETLSALALRFYGDAELYRL

SEQ ID NO: 1494811 - protein, 20 aa, Mycobacterium tuberculosis
GETRRLRVCGPLNTVVNAAW

SEQ ID NO: 1494812 - protein, 18 aa, Mycobacterium tuberculosis
GEYRRCVRHGLADMYGFI

SEQ ID NO: 1494813 - protein, 18 aa, Mycobacterium tuberculosis
GFATLWVGEHVVMVDRPA

SEQ ID NO: 1494814 - protein, 18 aa, Mycobacterium tuberculosis
GFPDGCFQTLLVSSGAVE

SEQ ID NO: 1494815 - protein, 19 aa, Mycobacterium tuberculosis
GGACRRYLQELGDLPTNTL

SEQ ID NO: 1494816 - protein, 25 aa, Mycobacterium tuberculosis
GGGKRLRPLFAYWGWHAVASREPDP

SEQ ID NO: 1494817 - protein, 19 aa, Mycobacterium tuberculosis
GGPCARTVLDTALLHQVIA

SEQ ID NO: 1494818 - protein, 21 aa, Mycobacterium tuberculosis
GGTVGEMFGRKVARLMEWCAM

SEQ ID NO: 1494819 - protein, 21 aa, Mycobacterium tuberculosis
GHDTFCPVGPWIVTDLAPFDP

SEQ ID NO: 1494820 - protein, 17 aa, Mycobacterium tuberculosis
GHRCGACRIEIGRGELA

SEQ ID NO: 1494821 - protein, 17 aa, Mycobacterium tuberculosis
GISRPTFYFYFPSKEAV

SEQ ID NO: 1494822 - protein, 23 aa, Mycobacterium tuberculosis
GKQAASAFAMWFPIEGGSKYGGY

SEQ ID NO: 1494823 - protein, 19 aa, Mycobacterium tuberculosis
GKVPFVFRTLPGYTFYASQ

SEQ ID NO: 1494824 - protein, 18 aa, Mycobacterium tuberculosis
GLGLRSGLSAGLAHAASA

SEQ ID NO: 1494825 - protein, 25 aa, Mycobacterium tuberculosis
GLLRLPERIPYAIAMELALTGDNLP

SEQ ID NO: 1494826 - protein, 18 aa, Mycobacterium tuberculosis
GLQARLGLDSGKWTHEQM

SEQ ID NO: 1494827 - protein, 22 aa, Mycobacterium tuberculosis
GLQCGFCTPGMLITARALLDRN

SEQ ID NO: 1494828 - protein, 19 aa, Mycobacterium tuberculosis
GLSSRAEWLPAWEEGLRRA

SEQ ID NO: 1494829 - protein, 20 aa, Mycobacterium tuberculosis
GNSWPMARLTLALSPATLPK

SEQ ID NO: 1494830 - protein, 20 aa, Mycobacterium tuberculosis
GQCAACATDGRTPCEPGSAA

SEQ ID NO: 1494831 - protein, 20 aa, Mycobacterium tuberculosis
GRFGALIPRLVRQGINGEGL

SEQ ID NO: 1494832 - protein, 20 aa, Mycobacterium tuberculosis
GRIKDLLIVYGRNHSPDDIE

SEQ ID NO: 1494833 - protein, 19 aa, Mycobacterium tuberculosis
GRSGFLLAPWTAEQIVSEL

SEQ ID NO: 1494834 - protein, 18 aa, Mycobacterium tuberculosis
GSARCRDVLALKLNAQLI

SEQ ID NO: 1494835 - protein, 19 aa, Mycobacterium tuberculosis
GTVAKWRLQATQSRVRDVQ

SEQ ID NO: 1494836 - protein, 19 aa, Mycobacterium tuberculosis
GYDLTRWLATKGMELTWRS

SEQ ID NO: 1494837 - protein, 17 aa, Mycobacterium tuberculosis
GYENLRFFASLYAGATA

SEQ ID NO: 1494838 - protein, 18 aa, Mycobacterium tuberculosis
HDAQCTTMSWPQRADHAA

SEQ ID NO: 1494839 - protein, 22 aa, Mycobacterium tuberculosis
HERETYDFFGIIFDGHPALTRI

SEQ ID NO: 1494840 - protein, 19 aa, Mycobacterium tuberculosis
HFNLSVGVTDAFLRAVERN

SEQ ID NO: 1494841 - protein, 23 aa, Mycobacterium tuberculosis
HGIDTVVVGWGYGRADFIDKTST

SEQ ID NO: 1494842 - protein, 20 aa, Mycobacterium tuberculosis
HIAQLLPWIEANFRTYAEYD

SEQ ID NO: 1494843 - protein, 17 aa, Mycobacterium tuberculosis
HKKGSALVPSWVAFAVT

SEQ ID NO: 1494844 - protein, 19 aa, Mycobacterium tuberculosis
HLPKGLGVIGLLIEDPKPL

SEQ ID NO: 1494845 - protein, 19 aa, Mycobacterium tuberculosis
HNGCPLGNLIPEWNDLVRR

SEQ ID NO: 1494846 - protein, 23 aa, Mycobacterium tuberculosis
HVTRLRADLCPEWPQPAQPGGSY

SEQ ID NO: 1494847 - protein, 24 aa, Mycobacterium tuberculosis
IAMPALRLDAAFAHLNLGDSHGNA

SEQ ID NO: 1494848 - protein, 23 aa, Mycobacterium tuberculosis
IATDHLMRFPGRFSEQLLPEHLH

SEQ ID NO: 1494849 - protein, 19 aa, Mycobacterium tuberculosis
ICAFGRIGSMFACEDLGYV

SEQ ID NO: 1494850 - protein, 19 aa, Mycobacterium tuberculosis
IDAPALWPGLPIRPVKGEV

SEQ ID NO: 1494851 - protein, 22 aa, Mycobacterium tuberculosis
IDNLRAAFTWSRGNGDIAAALQ

SEQ ID NO: 1494852 - protein, 18 aa, Mycobacterium tuberculosis
IEADIVRRGWPIGASLGS

SEQ ID NO: 1494853 - protein, 17 aa, Mycobacterium tuberculosis
IGGRYGLQTMCEGGGTA

SEQ ID NO: 1494854 - protein, 19 aa, Mycobacterium tuberculosis
IGRELDRYLPFLATTKVLM

SEQ ID NO: 1494855 - protein, 17 aa, Mycobacterium tuberculosis
IGRRAANAVTVFFDGAT

SEQ ID NO: 1494856 - protein, 21 aa, Mycobacterium tuberculosis
IGTKELIAWLPTLLGLGGADL

SEQ ID NO: 1494857 - protein, 25 aa, Mycobacterium tuberculosis
INAAICCAAAEFATRTQATATGVAA

SEQ ID NO: 1494858 - protein, 23 aa, Mycobacterium tuberculosis
INGHVRAGGFGLVGACDMVVAGP

SEQ ID NO: 1494859 - protein, 18 aa, Mycobacterium tuberculosis
INLRFVLGYTPLEFRDTL

SEQ ID NO: 1494860 - protein, 18 aa, Mycobacterium tuberculosis
IPKPRFVLMPTPIWDQLF

SEQ ID NO: 1494861 - protein, 19 aa, Mycobacterium tuberculosis
IPSLFAIYPTNDWHERETY

SEQ ID NO: 1494862 - protein, 19 aa, Mycobacterium tuberculosis
IPSPAAGVLTKIIAQEDDT

SEQ ID NO: 1494863 - protein, 17 aa, Mycobacterium tuberculosis
IRALMALPPGQAPDPSR

SEQ ID NO: 1494864 - protein, 21 aa, Mycobacterium tuberculosis
IRFGSLYLRDGVSLAGQQVVP

SEQ ID NO: 1494865 - protein, 17 aa, Mycobacterium tuberculosis
ITATPAWDALRRHHDQI

SEQ ID NO: 1494866 - protein, 20 aa, Mycobacterium tuberculosis
ITKARWVYFLTRMRNPTGDT

SEQ ID NO: 1494867 - protein, 18 aa, Mycobacterium tuberculosis
IVLCAGAIQSAHLLMLSG

SEQ ID NO: 1494868 - protein, 23 aa, Mycobacterium tuberculosis
IVSRGGSIMAAWCLAHHRESFLY

SEQ ID NO: 1494869 - protein, 21 aa, Mycobacterium tuberculosis
KAGYEVLERVGLDPKVATRYP

SEQ ID NO: 1494870 - protein, 21 aa, Mycobacterium tuberculosis
KELCRRWYPRIYFGQPPKGLT

SEQ ID NO: 1494871 - protein, 24 aa, Mycobacterium tuberculosis
KGIFTSSFGYRWGVLHAGIDLANA

SEQ ID NO: 1494872 - protein, 21 aa, Mycobacterium tuberculosis
KGSALVPSWVAFAVTGLLEQH

SEQ ID NO: 1494873 - protein, 17 aa, Mycobacterium tuberculosis
KNTVLWCGYTWQYWLTT

SEQ ID NO: 1494874 - protein, 21 aa, Mycobacterium tuberculosis
KRALAGLPYRAAEIGLLVLAT

SEQ ID NO: 1494875 - protein, 20 aa, Mycobacterium tuberculosis
KRVCRDCGFFLPLAGSLGAM

SEQ ID NO: 1494876 - protein, 17 aa, Mycobacterium tuberculosis
KVERPDLVIGWWAAPTI

SEQ ID NO: 1494877 - protein, 17 aa, Mycobacterium tuberculosis
LADGRELLFFSLPGPRT

SEQ ID NO: 1494878 - protein, 21 aa, Mycobacterium tuberculosis
LAEMPRVLRLCAARTGAELNV

SEQ ID NO: 1494879 - protein, 23 aa, Mycobacterium tuberculosis
LAHPCPMCYGSLYYCSPDEVVFL

SEQ ID NO: 1494880 - protein, 17 aa, Mycobacterium tuberculosis
LAIPRDEVRVMRKERNG

SEQ ID NO: 1494881 - protein, 17 aa, Mycobacterium tuberculosis
LAKRLGNRFDVRAVRLD

SEQ ID NO: 1494882 - protein, 17 aa, Mycobacterium tuberculosis
LAPQRLIVVLGHDHQRI

SEQ ID NO: 1494883 - protein, 24 aa, Mycobacterium tuberculosis
LDDGMLEWRLAGLPVDEGAPVGHG

SEQ ID NO: 1494884 - protein, 20 aa, Mycobacterium tuberculosis
LDKARPVLILTREVVRPHLT

SEQ ID NO: 1494885 - protein, 18 aa, Mycobacterium tuberculosis
LDMFGEWNRAYGPAGFLQ

SEQ ID NO: 1494886 - protein, 21 aa, Mycobacterium tuberculosis
LDRYLPVLADLRMRYLDDGDW

SEQ ID NO: 1494887 - protein, 23 aa, Mycobacterium tuberculosis
LDVGCGWGGALVRAVEKYDVNVI

SEQ ID NO: 1494888 - protein, 21 aa, Mycobacterium tuberculosis
LEALLRVLEPFGIREIAQSGM

SEQ ID NO: 1494889 - protein, 20 aa, Mycobacterium tuberculosis
LEPDLKWERFITAVRLLAER

SEQ ID NO: 1494890 - protein, 22 aa, Mycobacterium tuberculosis
LFALGRLPGWIAHWREMHDEGD

SEQ ID NO: 1494891 - protein, 18 aa, Mycobacterium tuberculosis
LGYYEWREGLLRGLAAHH

SEQ ID NO: 1494892 - protein, 17 aa, Mycobacterium tuberculosis
LILADAIVRACEDKPDY

SEQ ID NO: 1494893 - protein, 23 aa, Mycobacterium tuberculosis
LLGKSAYHALTFGWLMSGLARAV

SEQ ID NO: 1494894 - protein, 23 aa, Mycobacterium tuberculosis
LLGSLRFGNRFVHTGKPTPAGYA

SEQ ID NO: 1494895 - protein, 20 aa, Mycobacterium tuberculosis
LLKPFARRYFQAIPGVWARR

SEQ ID NO: 1494896 - protein, 21 aa, Mycobacterium tuberculosis
LLLEVVCARLLLPSASDAESA

SEQ ID NO: 1494897 - protein, 19 aa, Mycobacterium tuberculosis
LLMCRAEVAPILLGAIADA

SEQ ID NO: 1494898 - protein, 18 aa, Mycobacterium tuberculosis
LLPGDGAQAFACSRKHGW

SEQ ID NO: 1494899 - protein, 19 aa, Mycobacterium tuberculosis
LLRFFFKSWFRVEVSGVEN

SEQ ID NO: 1494900 - protein, 25 aa, Mycobacterium tuberculosis
LNDVLKGAWGYRGWVMSDWGGTPSW

SEQ ID NO: 1494901 - protein, 19 aa, Mycobacterium tuberculosis
LNSKTRRPSVCNAAETLLV

SEQ ID NO: 1494902 - protein, 18 aa, Mycobacterium tuberculosis
LNTAIGTNWFPGTTPEVV

SEQ ID NO: 1494903 - protein, 18 aa, Mycobacterium tuberculosis
LPAGHGLNVNTLSYGDLA

SEQ ID NO: 1494904 - protein, 19 aa, Mycobacterium tuberculosis
LPGGHFRSDIGLRAAEGKI

SEQ ID NO: 1494905 - protein, 20 aa, Mycobacterium tuberculosis
LPMSFTFARFLKFIVTEIFP

SEQ ID NO: 1494906 - protein, 18 aa, Mycobacterium tuberculosis
LPYFSIGMGNNFIQSAKT

SEQ ID NO: 1494907 - protein, 20 aa, Mycobacterium tuberculosis
LQHRPRWQVTVSVVFDDWAA

SEQ ID NO: 1494908 - protein, 18 aa, Mycobacterium tuberculosis
LREPVVWQRLHQVDPAHL

SEQ ID NO: 1494909 - protein, 19 aa, Mycobacterium tuberculosis
LRFWLDRGVDGFRIDVAHG

SEQ ID NO: 1494910 - protein, 17 aa, Mycobacterium tuberculosis
LRLPRGEGLGVPASGYE

SEQ ID NO: 1494911 - protein, 18 aa, Mycobacterium tuberculosis
LRLRGMSAMLARIKRRLR

SEQ ID NO: 1494912 - protein, 17 aa, Mycobacterium tuberculosis
LRPGLRMNIIANPGIPK

SEQ ID NO: 1494913 - protein, 17 aa, Mycobacterium tuberculosis
LRPGQALVITVPVSDAP

SEQ ID NO: 1494914 - protein, 18 aa, Mycobacterium tuberculosis
LSPLLAESLSGLAPALIA

SEQ ID NO: 1494915 - protein, 17 aa, Mycobacterium tuberculosis
LSRAHTAAIIWSDELDG

SEQ ID NO: 1494916 - protein, 25 aa, Mycobacterium tuberculosis
LTDLVFAWRACRAVKSNAIVIAADG

SEQ ID NO: 1494917 - protein, 20 aa, Mycobacterium tuberculosis
LTGCAKAFRMGYIDCNQFTL

SEQ ID NO: 1494918 - protein, 23 aa, Mycobacterium tuberculosis
LVDDIRINWVWNPPWGPDKITED

SEQ ID NO: 1494919 - protein, 24 aa, Mycobacterium tuberculosis
LVPDDLRPEWVLPRADEIAFGYSD

SEQ ID NO: 1494920 - protein, 17 aa, Mycobacterium tuberculosis
LVSRVGLERARRVVDLG

SEQ ID NO: 1494921 - protein, 21 aa, Mycobacterium tuberculosis
LYCRNRIEIVIAMLGIVKAGA

SEQ ID NO: 1494922 - protein, 17 aa, Mycobacterium tuberculosis
LYIALGISGAIQHRAGM

SEQ ID NO: 1494923 - protein, 22 aa, Mycobacterium tuberculosis
MASQRTVICWAMGLTQHAHAVA

SEQ ID NO: 1494924 - protein, 20 aa, Mycobacterium tuberculosis
MGLAELLAALGIPYDSEEAV

SEQ ID NO: 1494925 - protein, 17 aa, Mycobacterium tuberculosis
MLCALPIERAIDAAETL

SEQ ID NO: 1494926 - protein, 18 aa, Mycobacterium tuberculosis
MPFSVPWTRASREDLPFN

SEQ ID NO: 1494927 - protein, 20 aa, Mycobacterium tuberculosis
MPGEFFALTVDHLFGRIWTR

SEQ ID NO: 1494928 - protein, 17 aa, Mycobacterium tuberculosis
MRRAFPSWMAWSPFAPA

SEQ ID NO: 1494929 - protein, 21 aa, Mycobacterium tuberculosis
MSMARLLYWGCDVWLNNPLRP

SEQ ID NO: 1494930 - protein, 22 aa, Mycobacterium tuberculosis
NGILWRGDYQGLIGYSDTLSIP

SEQ ID NO: 1494931 - protein, 21 aa, Mycobacterium tuberculosis
NPPPRVAFMLGDAVPVAAVTT

SEQ ID NO: 1494932 - protein, 23 aa, Mycobacterium tuberculosis
NPRTRSGIMALELLDGTPDWDRF

SEQ ID NO: 1494933 - protein, 22 aa, Mycobacterium tuberculosis
NQLWMCGLPGYSPGDLIDFEFC

SEQ ID NO: 1494934 - protein, 20 aa, Mycobacterium tuberculosis
NSYYDDMAWLALALERADRV

SEQ ID NO: 1494935 - protein, 34 aa, Mycobacterium tuberculosis; identical to SEQ ID NO: 213604

SEQ ID NO: 1494936 - protein, 18 aa, Mycobacterium tuberculosis
NVIREFVEHTGIPFLPMS

SEQ ID NO: 1494937 - protein, 21 aa, Mycobacterium tuberculosis
PAMSAFNAWVLLKGLETLAIR

SEQ ID NO: 1494938 - protein, 22 aa, Mycobacterium tuberculosis
PANPRFLMCTPLSHAGAAFFTP

SEQ ID NO: 1494939 - protein, 21 aa, Mycobacterium tuberculosis
PANVMPIDWYLHVRHAVGGEI

SEQ ID NO: 1494940 - protein, 23 aa, Mycobacterium tuberculosis
PDAGLRLARRFAHLTYRGEIELD

SEQ ID NO: 1494941 - protein, 17 aa, Mycobacterium tuberculosis
PDGSWGFFDGQATAEET

SEQ ID NO: 1494942 - protein, 23 aa, Mycobacterium tuberculosis
PDLVWDFRLPRVVSINVSGHKYG

SEQ ID NO: 1494943 - protein, 22 aa, Mycobacterium tuberculosis
PDNEFRVVLARRGQHWVSAVRV

SEQ ID NO: 1494944 - protein, 20 aa, Mycobacterium tuberculosis
PEIPAHLDVNIPIDIPITGS

SEQ ID NO: 1494945 - protein, 22 aa, Mycobacterium tuberculosis
PETSVALGFGFRCGFLGLLHME

SEQ ID NO: 1494946 - protein, 18 aa, Mycobacterium tuberculosis
PFLRRFDIPPGIEHQEDA

SEQ ID NO: 1494947 - protein, 20 aa, Mycobacterium tuberculosis
PGDEAELFRAIALALERPLD

SEQ ID NO: 1494948 - protein, 26 aa, Mycobacterium tuberculosis
PGLRALLRLGIYWAQEALAYGMTKRP

SEQ ID NO: 1494949 - protein, 19 aa, Mycobacterium tuberculosis
PGRREGWDYPDMARESGTK

SEQ ID NO: 1494950 - protein, 19 aa, Mycobacterium tuberculosis
PGRTVCKWGGFLDNPADFD

SEQ ID NO: 1494951 - protein, 18 aa, Mycobacterium tuberculosis
PGYQGWQWAVVVASYSGA

SEQ ID NO: 1494952 - protein, 19 aa, Mycobacterium tuberculosis
PKLGERLNLPAGWSYHTRV

SEQ ID NO: 1494953 - protein, 19 aa, Mycobacterium tuberculosis
PKVVICLVNGWAAGGGHSL

SEQ ID NO: 1494954 - protein, 17 aa, Mycobacterium tuberculosis
PLVPAMFSAVLSRLRRT

SEQ ID NO: 1494955 - protein, 18 aa, Mycobacterium tuberculosis
PNLFATHRVRAVDDYASH

SEQ ID NO: 1494956 - protein, 18 aa, Mycobacterium tuberculosis
PSVREYSVRYGLTERRQA

SEQ ID NO: 1494957 - protein, 20 aa, Mycobacterium tuberculosis
PSYTRPASWRGLDVPEVLLS

SEQ ID NO: 1494958 - protein, 22 aa, Mycobacterium tuberculosis
PTLIRMFMKWGREIPDSHDLSS

SEQ ID NO: 1494959 - protein, 18 aa, Mycobacterium tuberculosis
PWEHPDFWDIWKASLQGV

SEQ ID NO: 1494960 - protein, 18 aa, Mycobacterium tuberculosis
QEDFIGIHFFSPVDKMPL

SEQ ID NO: 1494961 - protein, 19 aa, Mycobacterium tuberculosis
QEIFRRFTITAAGPSKGET

SEQ ID NO: 1494962 - protein, 18 aa, Mycobacterium tuberculosis
QELGLTWLAEIGAHGVVA

SEQ ID NO: 1494963 - protein, 19 aa, Mycobacterium tuberculosis
QPIEWRYANDPAWIMRDKG

SEQ ID NO: 1494964 - protein, 21 aa, Mycobacterium tuberculosis
QPKLDVLDFWSIIKPELAGVH

SEQ ID NO: 1494965 - protein, 21 aa, Mycobacterium tuberculosis
QQYPLDRLKAIGAQYDATIND

SEQ ID NO: 1494966 - protein, 20 aa, Mycobacterium tuberculosis
QRLCTELELPALHVPPEHGG

SEQ ID NO: 1494967 - protein, 23 aa, Mycobacterium tuberculosis
QRWPETRIDPSLTRISALMDLLG

SEQ ID NO: 1494968 - protein, 22 aa, Mycobacterium tuberculosis
QVGPMLADWAKWGQARHNYFLR

SEQ ID NO: 1494969 - protein, 25 aa, Mycobacterium tuberculosis
QVLKEIRSRLGFLLDVGLEYLSLSR

SEQ ID NO: 1494970 - protein, 18 aa, Mycobacterium tuberculosis
RAAGIPILGKTNMDEFAM

SEQ ID NO: 1494971 - protein, 21 aa, Mycobacterium tuberculosis
RAELIRLLLNRALTTAGDDLA

SEQ ID NO: 1494972 - protein, 24 aa, Mycobacterium tuberculosis
RAQGRHCVAVKWGLWQAPKAGEPA

SEQ ID NO: 1494973 - protein, 19 aa, Mycobacterium tuberculosis
RARVLRRWSVPPVRPPVTV

SEQ ID NO: 1494974 - protein, 22 aa, Mycobacterium tuberculosis
RASRLSAVVVRWSRARKRYERQ

SEQ ID NO: 1494975 - protein, 19 aa, Mycobacterium tuberculosis
RATSHWLTLPALKAFGAIP

SEQ ID NO: 1494976 - protein, 19 aa, Mycobacterium tuberculosis
RDHIAGAIKLDWRTDLQDP

SEQ ID NO: 1494977 - protein, 23 aa, Mycobacterium tuberculosis
RERPGRLLGFHWTKVHPDHPGLG

SEQ ID NO: 1494978 - protein, 21 aa, Mycobacterium tuberculosis
RGCLGRPWLFAELSAAFTGSP

SEQ ID NO: 1494979 - protein, 20 aa, Mycobacterium tuberculosis
RGPFPGALWLQVRDLEATQT

SEQ ID NO: 1494980 - protein, 24 aa, Mycobacterium tuberculosis
RIEQLRGSPLYTLRTKGKADLLKA

SEQ ID NO: 1494981 - protein, 24 aa, Mycobacterium tuberculosis
RIFKRIRPAFTYRRSLGVLTAARD

SEQ ID NO: 1494982 - protein, 19 aa, Mycobacterium tuberculosis
RIGFPAIVGIIADVLHAAD

SEQ ID NO: 1494983 - protein, 19 aa, Mycobacterium tuberculosis
RKFGCGFAPSGWDSLTKHL

SEQ ID NO: 1494984 - protein, 18 aa, Mycobacterium tuberculosis
RLETLLALIEGWVQTVVT

SEQ ID NO: 1494985 - protein, 19 aa, Mycobacterium tuberculosis
RLFPRSVFHSLKLAEHNLA

SEQ ID NO: 1494986 - protein, 17 aa, Mycobacterium tuberculosis
RLRAVDFTLGYEVRSVN

SEQ ID NO: 1494987 - protein, 17 aa, Mycobacterium tuberculosis
RMEIDWTGCRDFDELIV

SEQ ID NO: 1494988 - protein, 19 aa, Mycobacterium tuberculosis
RPAGWWVRRRLHEVAVHRA

SEQ ID NO: 1494989 - protein, 21 aa, Mycobacterium tuberculosis
RPDELHLGFNFRLARTEFDAA

SEQ ID NO: 1494990 - protein, 17 aa, Mycobacterium tuberculosis
RPLRPSFVDGLRNEIQI

SEQ ID NO: 1494991 - protein, 23 aa, Mycobacterium tuberculosis
RPRSCAALPRILRDNGYVTGAFG

SEQ ID NO: 1494992 - protein, 18 aa, Mycobacterium tuberculosis
RPTLSWPRNLPIDGEPAE

SEQ ID NO: 1494993 - protein, 17 aa, Mycobacterium tuberculosis
RQYSRWALRLRVPFTVP

SEQ ID NO: 1494994 - protein, 21 aa, Mycobacterium tuberculosis
RRLAIECLRQLAAVAPAVFAD

SEQ ID NO: 1494995 - protein, 17 aa, Mycobacterium tuberculosis
RRSIKFPTFMAGIDAVR

SEQ ID NO: 1494996 - protein, 18 aa, Mycobacterium tuberculosis
RRTLRLPWGNGIVSLTPA

SEQ ID NO: 1494997 - protein, 22 aa, Mycobacterium tuberculosis
RSACIKAMIEKVVDRMYAEIDD

SEQ ID NO: 1494998 - protein, 24 aa, Mycobacterium tuberculosis
RSLALEHPEIWGGIIDLDDSMPAE

SEQ ID NO: 1494999 - protein, 18 aa, Mycobacterium tuberculosis
RSPISISTGVLWRDPTAG

SEQ ID NO: 1495000 - protein, 22 aa, Mycobacterium tuberculosis
RSTTLALRWLVGYSRQRREKTM

SEQ ID NO: 1495001 - protein, 21 aa, Mycobacterium tuberculosis
RSVDIPARFVLGQALELPQPG

SEQ ID NO: 1495002 - protein, 21 aa, Mycobacterium tuberculosis
RWADSFGGLVFDATGITEPAG

SEQ ID NO: 1495003 - protein, 19 aa, Mycobacterium tuberculosis
RWDTDWFWCSRSFGAQNPR

SEQ ID NO: 1495004 - protein, 19 aa, Mycobacterium tuberculosis
RYRGLRAPHKIKLGVSGCA

SEQ ID NO: 1495005 - protein, 25 aa, Mycobacterium tuberculosis
SAAHKARWGVCLARTDPDAPKHKGI

SEQ ID NO: 1495006 - protein, 23 aa, Mycobacterium tuberculosis
SEIYPVLCGSAFKNKGVQPMLDA

SEQ ID NO: 1495007 - protein, 18 aa, Mycobacterium tuberculosis
SGLGYPASTPVLGAQPID

SEQ ID NO: 1495008 - protein, 25 aa, Mycobacterium tuberculosis
SGWWRAPLRWTLRGSLALRSHLMVR

SEQ ID NO: 1495009 - protein, 21 aa, Mycobacterium tuberculosis
SNEFFKLWLDPSMTYSCAYFE

SEQ ID NO: 1495010 - protein, 23 aa, Mycobacterium tuberculosis
SRDGLLRFCRYMEALAAYKKYLD

SEQ ID NO: 1495011 - protein, 20 aa, Mycobacterium tuberculosis
SRIDPVLARSWLLVNGAHGD

SEQ ID NO: 1495012 - protein, 18 aa, Mycobacterium tuberculosis
SRLWRLLLAPGRGIGRLI

SEQ ID NO: 1495013 - protein, 19 aa, Mycobacterium tuberculosis
SRMAIAMARAGGMGVLHRN

SEQ ID NO: 1495014 - protein, 26 aa, Mycobacterium tuberculosis
SRSSPRAGDGFIRLDVDGVVSYASPN

SEQ ID NO: 1495015 - protein, 17 aa, Mycobacterium tuberculosis
SRVLFTWDIGPTWRPET

SEQ ID NO: 1495016 - protein, 23 aa, Mycobacterium tuberculosis
STLLLTLLFRFMRPLIENGHVFL

SEQ ID NO: 1495017 - protein, 19 aa, Mycobacterium tuberculosis
SVPPFTWWRGLRARELLEN

SEQ ID NO: 1495018 - protein, 20 aa, Mycobacterium tuberculosis
TELRLRYGACVNVERRSASA

SEQ ID NO: 1495019 - protein, 20 aa, Mycobacterium tuberculosis
TFAAFPWRWVGGDGCIVRLV

SEQ ID NO: 1495020 - protein, 19 aa, Mycobacterium tuberculosis
TFLDREGWDSLTINALATQ

SEQ ID NO: 1495021 - protein, 20 aa, Mycobacterium tuberculosis
TFTGRSWPLADVRLLAPILA

SEQ ID NO: 1495022 - protein, 25 aa, Mycobacterium tuberculosis
TGEVLSVPVGDGFLGRVVNPLGQPI

SEQ ID NO: 1495023 - protein, 27 aa, Mycobacterium tuberculosis
TIAEVVNGFGWRGPLGVTYPGVVTHGV

SEQ ID NO: 1495024 - protein, 19 aa, Mycobacterium tuberculosis
TISELWLRLLESYRDSFYL

SEQ ID NO: 1495025 - protein, 18 aa, Mycobacterium tuberculosis
TKLSCPIYAFIGDKDWIA

SEQ ID NO: 1495026 - protein, 17 aa, Mycobacterium tuberculosis
TLFRRFGSRAGLMMVLL

SEQ ID NO: 1495027 - protein, 17 aa, Mycobacterium tuberculosis
TRLAAAIMRERKRGAIV

SEQ ID NO: 1495028 - protein, 19 aa, Mycobacterium tuberculosis
TRLHWYVPRSIRWIDRLKG

SEQ ID NO: 1495029 - protein, 18 aa, Mycobacterium tuberculosis
TTPPIKWPTVIRHPKTGQ

SEQ ID NO: 1495030 - protein, 24 aa, Mycobacterium tuberculosis
VAKQALKIAREWSVERVQWGKPVG

SEQ ID NO: 1495031 - protein, 20 aa, Mycobacterium tuberculosis
VCGYHCWAEFFVAGLGWLPA

SEQ ID NO: 1495032 - protein, 23 aa, Mycobacterium tuberculosis
VCYDIRFPALYTELARRGAQLIA

SEQ ID NO: 1495033 - protein, 26 aa, Mycobacterium tuberculosis
VELPAWYRPNPGLARDLAFIAFSSAD

SEQ ID NO: 1495034 - protein, 23 aa, Mycobacterium tuberculosis
VERMHRACLILTFGGGTNEVQRD

SEQ ID NO: 1495035 - protein, 22 aa, Mycobacterium tuberculosis
VETRGRFGTFISRFDPTDAAMA

SEQ ID NO: 1495036 - protein, 22 aa, Mycobacterium tuberculosis
VEVALRSARRFGAPVIVHVVTR

SEQ ID NO: 1495037 - protein, 17 aa, Mycobacterium tuberculosis
VFICGPGPFMQAARDAL

SEQ ID NO: 1495038 - protein, 18 aa, Mycobacterium tuberculosis
VGALLCLLAKLSGGKAVA

SEQ ID NO: 1495039 - protein, 23 aa, Mycobacterium tuberculosis
VGGPSTWRMGGAINCGKAQPGQV

SEQ ID NO: 1495040 - protein, 22 aa, Mycobacterium tuberculosis
VGLRARAKAAFAEREGVNLTFL

SEQ ID NO: 1495041 - protein, 18 aa, Mycobacterium tuberculosis
VHGLPLYHVHGLVLGLLG

SEQ ID NO: 1495042 - protein, 21 aa, Mycobacterium tuberculosis
VKALGGRGVFGVELMINGDEV

SEQ ID NO: 1495043 - protein, 22 aa, Mycobacterium tuberculosis
VKGPDFPTAGLIVGSQGTADAY

SEQ ID NO: 1495044 - protein, 23 aa, Mycobacterium tuberculosis
VNDCGRYGLADCAGRVLVGEPTD

SEQ ID NO: 1495045 - protein, 22 aa, Mycobacterium tuberculosis
VNSWSAAFARYGRTVGQVLLTA

SEQ ID NO: 1495046 - protein, 21 aa, Mycobacterium tuberculosis
VQIGKFRLVFLTGPKQGEDDG

SEQ ID NO: 1495047 - protein, 18 aa, Mycobacterium tuberculosis
VREACLWSAGLAGSGIRR

SEQ ID NO: 1495048 - protein, 26 aa, Mycobacterium tuberculosis
VRSGVAFDILRRWLLARGYDVAFIRN

SEQ ID NO: 1495049 - protein, 22 aa, Mycobacterium tuberculosis
VRSRLMLDIARWRRRRREELAA

SEQ ID NO: 1495050 - protein, 19 aa, Mycobacterium tuberculosis
VSLAELFRRSGLDVRAADD

SEQ ID NO: 1495051 - protein, 24 aa, Mycobacterium tuberculosis
VSRRWSALCTMVIDILHRKLAEPG

SEQ ID NO: 1495052 - protein, 19 aa, Mycobacterium tuberculosis
VTFSRGWLPFLPTSDPPAH

SEQ ID NO: 1495053 - protein, 18 aa, Mycobacterium tuberculosis
VTGWPATVSHDFDAELPA

SEQ ID NO: 1495054 - protein, 19 aa, Mycobacterium tuberculosis
VTLCKRLAAVTGLRLPETV

SEQ ID NO: 1495055 - protein, 19 aa, Mycobacterium tuberculosis
VTRCPRNILTFSHGAHHCL

SEQ ID NO: 1495056 - protein, 18 aa, Mycobacterium tuberculosis
VVFKELRVLGALGVDATA

SEQ ID NO: 1495057 - protein, 20 aa, Mycobacterium tuberculosis
VVGAYRFLQRVWRLVVDEHT

SEQ ID NO: 1495058 - protein, 24 aa, Mycobacterium tuberculosis
VVSRARLQLAIAWANILLQRPAPA

SEQ ID NO: 1495059 - protein, 19 aa, Mycobacterium tuberculosis
VWVHPEWRGIGLGTAGTAT

SEQ ID NO: 1495060 - protein, 22 aa, Mycobacterium tuberculosis
VYDAAAAWARRFLDGPPHALAA

SEQ ID NO: 1495061 - protein, 24 aa, Mycobacterium tuberculosis
VYFELRLADAWVWDMYRPARFVKQ

SEQ ID NO: 1495062 - protein, 25 aa, Mycobacterium tuberculosis
VYSDGRYSYQLSIYVIRVEQGTAVA

SEQ ID NO: 1495063 - protein, 23 aa, Mycobacterium tuberculosis
WASWCGPCRAFAPTFAESSEKHP

SEQ ID NO: 1495064 - protein, 19 aa, Mycobacterium tuberculosis
WDLLPGYLIFRSIIPNRPP

SEQ ID NO: 1495065 - protein, 20 aa, Mycobacterium tuberculosis
WEEVPGCDPAVFTMATVPSR

SEQ ID NO: 1495066 - protein, 21 aa, Mycobacterium tuberculosis
WGAEFPFCYEDRLLSTLAAMI

SEQ ID NO: 1495067 - protein, 17 aa, Mycobacterium tuberculosis
WLMPGQRAFQIATQLAL

SEQ ID NO: 1495068 - protein, 19 aa, Mycobacterium tuberculosis
WLNAEWRLVSDHIRAIVAL

SEQ ID NO: 1495069 - protein, 21 aa, Mycobacterium tuberculosis
WPEPLRTAALAGRGAARPTAQ

SEQ ID NO: 1495070 - protein, 19 aa, Mycobacterium tuberculosis
WPTVADWVRWISGDGTKPE

SEQ ID NO: 1495071 - protein, 18 aa, Mycobacterium tuberculosis
WQFHHVIDVAPTILEAAG

SEQ ID NO: 1495072 - protein, 18 aa, Mycobacterium tuberculosis
WTQWIFLQIYNAWFDTTA

SEQ ID NO: 1495073 - protein, 18 aa, Mycobacterium tuberculosis
YAAEMAHIIGCEPAEVLR

SEQ ID NO: 1495074 - protein, 18 aa, Mycobacterium tuberculosis
YDDLRPGLRMNIIANPGI

SEQ ID NO: 1495075 - protein, 17 aa, Mycobacterium tuberculosis
YEMFPRSTGGWDDDGNP

SEQ ID NO: 1495076 - protein, 17 aa, Mycobacterium tuberculosis
YGTLPWHPDLWLDSEDA

SEQ ID NO: 1495077 - protein, 17 aa, Mycobacterium tuberculosis
YGYKWPTLDGMFAPHAS

SEQ ID NO: 1495078 - protein, 19 aa, Mycobacterium tuberculosis
YHPPMRTFLGVPVRVRDES

SEQ ID NO: 1495079 - protein, 18 aa, Mycobacterium tuberculosis
YLAAKGWQPEGVSLAELF

SEQ ID NO: 1495080 - protein, 19 aa, Mycobacterium tuberculosis
YPGHIARMFGLVYGGESRD

SEQ ID NO: 1495081 - protein, 20 aa, Mycobacterium tuberculosis
YRLAAQLGMPPWRVQKAQKQ

SEQ ID NO: 1495082 - protein, 17 aa, Mycobacterium tuberculosis
YVLPRLVPVAGDSAGGV

SEQ ID NO: 1495083 - protein, 18 aa, Mycobacterium tuberculosis
YWGGVCLNVGCIPSKALL

SEQ ID NO: 1495084 - protein, 24 aa, Mycobacterium tuberculosis
AAGFDIASLWPVKPLLSLSALETH

SEQ ID NO: 1495085 - protein, 24 aa, Mycobacterium tuberculosis
AAGRASGVLPRYGVRLTVMAHPPA

SEQ ID NO: 1495086 - protein, 18 aa, Mycobacterium tuberculosis
AAILASIAFHTRVTADDV

SEQ ID NO: 1495087 - protein, 22 aa, Mycobacterium tuberculosis
AAKDWLCLLEAFDAPQRSGLVR

SEQ ID NO: 1495088 - protein, 18 aa, Mycobacterium tuberculosis
AALRAVPAERLWVNPDCG

SEQ ID NO: 1495089 - protein, 18 aa, Mycobacterium tuberculosis
AAQFPFDIIPTLLQGLAT

SEQ ID NO: 1495090 - protein, 20 aa, Mycobacterium tuberculosis
ACARLGIMHSVVFGGFTAAA

SEQ ID NO: 1495091 - protein, 23 aa, Mycobacterium tuberculosis
ACSSSLVAIHWAMSSLRSGECDL

SEQ ID NO: 1495092 - protein, 19 aa, Mycobacterium tuberculosis
ADAFRSWRLLVSKYGTQAP

SEQ ID NO: 1495093 - protein, 20 aa, Mycobacterium tuberculosis
ADLRQDWPAALRDAGFDPTA

SEQ ID NO: 1495094 - protein, 22 aa, Mycobacterium tuberculosis
AEYLRWAVGAFRLATSGVSDAT

SEQ ID NO: 1495095 - protein, 18 aa, Mycobacterium tuberculosis
AGFYASICNAVWDGNVSL

SEQ ID NO: 1495096 - protein, 19 aa, Mycobacterium tuberculosis
AIRAFRAAYELGVGTVAVY

SEQ ID NO: 1495097 - protein, 17 aa, Mycobacterium tuberculosis
AIVASSWHGKICDALLD

SEQ ID NO: 1495098 - protein, 17 aa, Mycobacterium tuberculosis
AKLACDWFIDHLCGPGP

SEQ ID NO: 1495099 - protein, 23 aa, Mycobacterium tuberculosis
ALGCTIKLLSICERITTDEGSQR

SEQ ID NO: 1495100 - protein, 19 aa, Mycobacterium tuberculosis
ALGLLYRWVEHAFGGREHA

SEQ ID NO: 1495101 - protein, 20 aa, Mycobacterium tuberculosis
AQEWLRFGWFFLVTRRDPKG

SEQ ID NO: 1495102 - protein, 18 aa, Mycobacterium tuberculosis
AQYSQWGALLARTDPSAP

SEQ ID NO: 1495103 - protein, 20 aa, Mycobacterium tuberculosis
ARAALQRWSLMRSDHPVTSV

SEQ ID NO: 1495104 - protein, 19 aa, Mycobacterium tuberculosis
ARAFGLPIVEVIAGGNISE

SEQ ID NO: 1495105 - protein, 18 aa, Mycobacterium tuberculosis
ARLDLPVGVARVLVGDLV

SEQ ID NO: 1495106 - protein, 19 aa, Mycobacterium tuberculosis
ARPSPFYIMDEVEAALDDV

SEQ ID NO: 1495107 - protein, 18 aa, Mycobacterium tuberculosis
ARYLRICVLTQYKSHSLD

SEQ ID NO: 1495108 - protein, 18 aa, Mycobacterium tuberculosis
ARYLWPSMFAQVADEYDR

SEQ ID NO: 1495109 - protein, 23 aa, Mycobacterium tuberculosis
ASRARFGDVLPFLVKVLAADEPL

SEQ ID NO: 1495110 - protein, 22 aa, Mycobacterium tuberculosis
ATLLTARCPVLFAPAMHTEMWL

SEQ ID NO: 1495111 - protein, 17 aa, Mycobacterium tuberculosis
ATNEIRALMALPPGQAP

SEQ ID NO: 1495112 - protein, 19 aa, Mycobacterium tuberculosis
AVGSVCWLVGCSSGASSTT

SEQ ID NO: 1495113 - protein, 25 aa, Mycobacterium tuberculosis
AVPPHGWVNLHFSLLPAWRGAAPVQ

SEQ ID NO: 1495114 - protein, 20 aa, Mycobacterium tuberculosis
AVPSRLAWEAGVALADSLLA

SEQ ID NO: 1495115 - protein, 18 aa, Mycobacterium tuberculosis
AVRAWRSADDFPCTEHMA

SEQ ID NO: 1495116 - protein, 23 aa, Mycobacterium tuberculosis
AVRDWPKPLGFVWGLDDPVATTN

SEQ ID NO: 1495117 - protein, 18 aa, Mycobacterium tuberculosis
AVVLRATWAVARVLTDRG

SEQ ID NO: 1495118 - protein, 18 aa, Mycobacterium tuberculosis
AYAKMVMNFGRFAMPQVG

SEQ ID NO: 1495119 - protein, 17 aa, Mycobacterium tuberculosis
AYPVLWRNLTAIVASVL

SEQ ID NO: 1495120 - protein, 18 aa, Mycobacterium tuberculosis
CAPFLHLFVAYGRLTLEG

SEQ ID NO: 1495121 - protein, 21 aa, Mycobacterium tuberculosis
CAVQRIMFRDGLVLNFDDYNE

SEQ ID NO: 1495122 - protein, 23 aa, Mycobacterium tuberculosis
CDKALEGFTMFALNQGEVCTCPS

SEQ ID NO: 1495123 - protein, 18 aa, Mycobacterium tuberculosis
CTGYERFERYLLGLDDGI

SEQ ID NO: 1495124 - protein, 20 aa, Mycobacterium tuberculosis
CWRIKLPHVEAAKFDAALQS

SEQ ID NO: 1495125 - protein, 22 aa, Mycobacterium tuberculosis
DCIQVLGGIGCTWEHDAHLYLR

SEQ ID NO: 1495126 - protein, 17 aa, Mycobacterium tuberculosis
DEISRALTLLAELWSRY

SEQ ID NO: 1495127 - protein, 17 aa, Mycobacterium tuberculosis
DEISVLVPDDFVGAVLG

SEQ ID NO: 1495128 - protein, 25 aa, Mycobacterium tuberculosis
DGISRLRFRLRWRGFRLIVDANHTD

SEQ ID NO: 1495129 - protein, 21 aa, Mycobacterium tuberculosis
DIAEVLALLGVRPVWDDASRR

SEQ ID NO: 1495130 - protein, 24 aa, Mycobacterium tuberculosis
DIWRRPDLAPGRRAPVLIQVPGGA

SEQ ID NO: 1495131 - protein, 22 aa, Mycobacterium tuberculosis
DPRVRDGLAWCYARVQIMRYRG

SEQ ID NO: 1495132 - protein, 24 aa, Mycobacterium tuberculosis
DPTGRHAFGASFLARIFPPGSHIP

SEQ ID NO: 1495133 - protein, 17 aa, Mycobacterium tuberculosis
DVFAHWRRAQGLPVSAI

SEQ ID NO: 1495134 - protein, 17 aa, Mycobacterium tuberculosis
DVHIGPSDHVGWLDDRK

SEQ ID NO: 1495135 - protein, 17 aa, Mycobacterium tuberculosis
DVLPLWVAEMDVKLPPT

SEQ ID NO: 1495136 - protein, 17 aa, Mycobacterium tuberculosis
DVYRVGQNVAWQRWTEI

SEQ ID NO: 1495137 - protein, 19 aa, Mycobacterium tuberculosis
EADRWPDKPGRYFTVRAGS

SEQ ID NO: 1495138 - protein, 18 aa, Mycobacterium tuberculosis
EELWLRLGNTTSLAHGPF

SEQ ID NO: 1495139 - protein, 20 aa, Mycobacterium tuberculosis
EEVAGFLADYGWRLTEQAGP

SEQ ID NO: 1495140 - protein, 19 aa, Mycobacterium tuberculosis
EGPARAWERGRFAAPYLRD

SEQ ID NO: 1495141 - protein, 18 aa, Mycobacterium tuberculosis
EGTVIRWLKKIGDSVQVD

SEQ ID NO: 1495142 - protein, 19 aa, Mycobacterium tuberculosis
EHLPGIAVPTVFTHGTADP

SEQ ID NO: 1495143 - protein, 25 aa, Mycobacterium tuberculosis
EHPYPHCWRCRNPLIYRSVSSWFVR

SEQ ID NO: 1495144 - protein, 22 aa, Mycobacterium tuberculosis
EIPAIPPFFPGFPPDYVTVSGQ

SEQ ID NO: 1495145 - protein, 21 aa, Mycobacterium tuberculosis
ELRARFNLRYPLAHLRPFLST

SEQ ID NO: 1495146 - protein, 17 aa, Mycobacterium tuberculosis
ERRPGWVGLPLAGVQTR

SEQ ID NO: 1495147 - protein, 28 aa, Mycobacterium tuberculosis
EVLTELWALIGYRIPTPIPRIGYAEAMR

SEQ ID NO: 1495148 - protein, 19 aa, Mycobacterium tuberculosis
EVRLFLRRVPALAFLPNRR

SEQ ID NO: 1495149 - protein, 24 aa, Mycobacterium tuberculosis
EWAARAGPRWSYADVLGYFRRIEN

SEQ ID NO: 1495150 - protein, 19 aa, Mycobacterium tuberculosis
FAIGAVLSMHFAKQAARFF

SEQ ID NO: 1495151 - protein, 17 aa, Mycobacterium tuberculosis
FAIYIKMHHSLIDGYTG

SEQ ID NO: 1495152 - protein, 17 aa, Mycobacterium tuberculosis
FAKAFWNVVNWADVQSR

SEQ ID NO: 1495153 - protein, 18 aa, Mycobacterium tuberculosis
FDGRIITVPFSFKEIDDD

SEQ ID NO: 1495154 - protein, 21 aa, Mycobacterium tuberculosis
FDPKKAVVFDDRWASAREDLV

SEQ ID NO: 1495155 - protein, 25 aa, Mycobacterium tuberculosis
FEVFIRPPLRMAMGLPDPYRPHRSA

SEQ ID NO: 1495156 - protein, 19 aa, Mycobacterium tuberculosis
FGTELPPLEGIYLAAFAGR

SEQ ID NO: 1495157 - protein, 19 aa, Mycobacterium tuberculosis
FHIFSHSWGGMLAQQYVLD

SEQ ID NO: 1495158 - protein, 18 aa, Mycobacterium tuberculosis
FLGPRPAGWWVRRRLHEV

SEQ ID NO: 1495159 - protein, 18 aa, Mycobacterium tuberculosis
FMGGFALWVDEQRHLHHT

SEQ ID NO: 1495160 - protein, 19 aa, Mycobacterium tuberculosis
FPKFDWPRIDAPYMRPGLD

SEQ ID NO: 1495161 - protein, 20 aa, Mycobacterium tuberculosis
FPPVELFMQMPWRTEIIQGL

SEQ ID NO: 1495162 - protein, 20 aa, Mycobacterium tuberculosis
FRLLVLRTAWLIDKHHDYQK

SEQ ID NO: 1495163 - protein, 17 aa, Mycobacterium tuberculosis
FVDDFVLYWGFLALAQV

SEQ ID NO: 1495164 - protein, 17 aa, Mycobacterium tuberculosis
FVEHTGIPFLPMSMAKG

SEQ ID NO: 1495165 - protein, 17 aa, Mycobacterium tuberculosis
FWDEVFRELSIPYLPVR

SEQ ID NO: 1495166 - protein, 24 aa, Mycobacterium tuberculosis
GASPRFLLDFSRRFPDAAVVRLER

SEQ ID NO: 1495167 - protein, 19 aa, Mycobacterium tuberculosis
GAVGEIWLRGTTVVRGYLG

SEQ ID NO: 1495168 - protein, 17 aa, Mycobacterium tuberculosis
GFRRLRALFTHRRDNGL

SEQ ID NO: 1495169 - protein, 22 aa, Mycobacterium tuberculosis
GHRIRAAIHFDDLQWERRYRRV

SEQ ID NO: 1495170 - protein, 20 aa, Mycobacterium tuberculosis
GKFLNNWRMAELHAKEAPDR

SEQ ID NO: 1495171 - protein, 24 aa, Mycobacterium tuberculosis
GLCSARMYFAYGLGNSVWFPLATG

SEQ ID NO: 1495172 - protein, 20 aa, Mycobacterium tuberculosis
GLDDCFRLLAGGVRGAVQRQ

SEQ ID NO: 1495173 - protein, 19 aa, Mycobacterium tuberculosis
GLEFPVVFVTGWEDGMFPH

SEQ ID NO: 1495174 - protein, 24 aa, Mycobacterium tuberculosis
GMGGLRLLLSLARAYAGEPDEVGG

SEQ ID NO: 1495175 - protein, 18 aa, Mycobacterium tuberculosis
GQLRLSVRQVMWGADAGL

SEQ ID NO: 1495176 - protein, 23 aa, Mycobacterium tuberculosis
GQRAAGLSQIWSRQLGRAIGPDS

SEQ ID NO: 1495177 - protein, 22 aa, Mycobacterium tuberculosis
HAAKGLEWDAVFLVGLADGTLP

SEQ ID NO: 1495178 - protein, 19 aa, Mycobacterium tuberculosis
HAELEWWTSPFVLAHGVPP

SEQ ID NO: 1495179 - protein, 19 aa, Mycobacterium tuberculosis
HAPWPWGVIDQAARVLLPA

SEQ ID NO: 1495180 - protein, 21 aa, Mycobacterium tuberculosis
HGFGSFWWSWRHQLCGLTGAR

SEQ ID NO: 1495181 - protein, 19 aa, Mycobacterium tuberculosis
HPDRAVAVLAALPAWTGEP

SEQ ID NO: 1495182 - protein, 24 aa, Mycobacterium tuberculosis
HQISRAGNMLSVFFGETPVTDFAS

SEQ ID NO: 1495183 - protein, 17 aa, Mycobacterium tuberculosis
HRAGHLGAMYPWQSGSD

SEQ ID NO: 1495184 - protein, 17 aa, Mycobacterium tuberculosis
HRKAFRRTIKWRTGCEG

SEQ ID NO: 1495185 - protein, 25 aa, Mycobacterium tuberculosis
HRLPLAIMRLRMLRRRSVRFFGTYD

SEQ ID NO: 1495186 - protein, 17 aa, Mycobacterium tuberculosis
HVVPRWGGDANFITIIG

SEQ ID NO: 1495187 - protein, 25 aa, Mycobacterium tuberculosis
IAQARLGPGRIHHCMRALGAAERAL

SEQ ID NO: 1495188 - protein, 18 aa, Mycobacterium tuberculosis
IDATHAWASVWTPQQPGR

SEQ ID NO: 1495189 - protein, 19 aa, Mycobacterium tuberculosis
IDLLLKRAASLGIQIRYET

SEQ ID NO: 1495190 - protein, 19 aa, Mycobacterium tuberculosis
IDPWGGSYYVEWLTHRLAR

SEQ ID NO: 1495191 - protein, 19 aa, Mycobacterium tuberculosis
IELGIKWLSLYAFSTENWK

SEQ ID NO: 1495192 - protein, 19 aa, Mycobacterium tuberculosis
IIPWNFPILMAAWKLAPAL

SEQ ID NO: 1495193 - protein, 17 aa, Mycobacterium tuberculosis
ILMGYGWHRGRDEGQLL

SEQ ID NO: 1495194 - protein, 17 aa, Mycobacterium tuberculosis
IPAVESKGALLLEDVGV

SEQ ID NO: 1495195 - protein, 17 aa, Mycobacterium tuberculosis
IQLYVKRVFIMGDCDQL

SEQ ID NO: 1495196 - protein, 17 aa, Mycobacterium tuberculosis
IRLARFGPRAALPATAM

SEQ ID NO: 1495197 - protein, 21 aa, Mycobacterium tuberculosis
IRPGQYVRLHWARPRSRLPGQ

SEQ ID NO: 1495198 - protein, 25 aa, Mycobacterium tuberculosis
ISRQLWWGHRIPIWYGPDGEQVCVG

SEQ ID NO: 1495199 - protein, 22 aa, Mycobacterium tuberculosis
ITRARVHLALSWALSRSPGGRQ

SEQ ID NO: 1495200 - protein, 17 aa, Mycobacterium tuberculosis
IVSIGAFEAFKMERYAA

SEQ ID NO: 1495201 - protein, 19 aa, Mycobacterium tuberculosis
KLLAFRGRFVEIGKRDIYG

SEQ ID NO: 1495202 - protein, 21 aa, Mycobacterium tuberculosis
KRFDFAFSLNVMEHIDLPDEA

SEQ ID NO: 1495203 - protein, 18 aa, Mycobacterium tuberculosis
KVIRRYRVKGAREAVNLA

SEQ ID NO: 1495204 - protein, 21 aa, Mycobacterium tuberculosis
KWPRRMRKMFLSLIQRQLPEG

SEQ ID NO: 1495205 - protein, 18 aa, Mycobacterium tuberculosis
LADAILIRKVDWVDEITR

SEQ ID NO: 1495206 - protein, 20 aa, Mycobacterium tuberculosis
LAELRLALMHGRLSADDKDA

SEQ ID NO: 1495207 - protein, 20 aa, Mycobacterium tuberculosis
LAFERQWWKFAGVKEEAIKE

SEQ ID NO: 1495208 - protein, 18 aa, Mycobacterium tuberculosis
LAHLRAFVLIPWIAVDPT

SEQ ID NO: 1495209 - protein, 18 aa, Mycobacterium tuberculosis
LAQMPPFLTGGSMIETVT

SEQ ID NO: 1495210 - protein, 21 aa, Mycobacterium tuberculosis
LARLYGWHRAMRIFDGPDEVH

SEQ ID NO: 1495211 - protein, 25 aa, Mycobacterium tuberculosis
LAVTRARISGMPVLFWLDPYRPHEN

SEQ ID NO: 1495212 - protein, 18 aa, Mycobacterium tuberculosis
LDGTEVFDITGIDVLNDG

SEQ ID NO: 1495213 - protein, 19 aa, Mycobacterium tuberculosis
LDGWLLRAGHGAVLAANSA

SEQ ID NO: 1495214 - protein, 19 aa, Mycobacterium tuberculosis
LDIGCGWGGGLQRAIENYD

SEQ ID NO: 1495215 - protein, 17 aa, Mycobacterium tuberculosis
LEFVRPVAVDLTYIPVV

SEQ ID NO: 1495216 - protein, 20 aa, Mycobacterium tuberculosis
LEVIETHLLFGIPYDRIDVV

SEQ ID NO: 1495217 - protein, 17 aa, Mycobacterium tuberculosis
LGAPCWIDLTTSDVDRA

SEQ ID NO: 1495218 - protein, 20 aa, Mycobacterium tuberculosis
LGTFSWPGAYGTWWQADPSA

SEQ ID NO: 1495219 - protein, 23 aa, Mycobacterium tuberculosis
LHLPGVAFGHDWLTGTSRYSGLL

SEQ ID NO: 1495220 - protein, 17 aa, Mycobacterium tuberculosis
LKAAFDWKSRHNQAHGI

SEQ ID NO: 1495221 - protein, 17 aa, Mycobacterium tuberculosis
LKGWINRWFYSVSGQVP

SEQ ID NO: 1495222 - protein, 20 aa, Mycobacterium tuberculosis
LKWRWRQRVGSWKGRMPNLV

SEQ ID NO: 1495223 - protein, 19 aa, Mycobacterium tuberculosis
LLIKDGRLAPDFDDEVIAQ

SEQ ID NO: 1495224 - protein, 18 aa, Mycobacterium tuberculosis
LLRFCLERGYQLRVIEQM

SEQ ID NO: 1495225 - protein, 25 aa, Mycobacterium tuberculosis
LNWWESRALYGWTVLVPRTKDQAGE

SEQ ID NO: 1495226 - protein, 22 aa, Mycobacterium tuberculosis
LPDIKCVYWAGGNPFHHHQNLP

SEQ ID NO: 1495227 - protein, 22 aa, Mycobacterium tuberculosis
LPLTLWLARFLKFIATEIFPGG

SEQ ID NO: 1495228 - protein, 17 aa, Mycobacterium tuberculosis
LPWGNGIVSLTPAPDHV

SEQ ID NO: 1495229 - protein, 19 aa, Mycobacterium tuberculosis
LQKEGLNWVTWVVGETTYS

SEQ ID NO: 1495230 - protein, 19 aa, Mycobacterium tuberculosis
LQLRWPLRMLLGGKPLQHI

SEQ ID NO: 1495231 - protein, 19 aa, Mycobacterium tuberculosis
LQTGVRWKDLGLVVVDEEQ

SEQ ID NO: 1495232 - protein, 18 aa, Mycobacterium tuberculosis
LRLALGVMLEIGPRGPER

SEQ ID NO: 1495233 - protein, 19 aa, Mycobacterium tuberculosis
LRLLLEFANELPALPSHLA

SEQ ID NO: 1495234 - protein, 18 aa, Mycobacterium tuberculosis
LRMADLQARVDLLRYALH

SEQ ID NO: 1495235 - protein, 20 aa, Mycobacterium tuberculosis
LRRAHGIGGFLGGSGRWLRR

SEQ ID NO: 1495236 - protein, 17 aa, Mycobacterium tuberculosis
LRTALRMQISAGYTVVE

SEQ ID NO: 1495237 - protein, 17 aa, Mycobacterium tuberculosis
LSFLSVSSVDYWAYRPA

SEQ ID NO: 1495238 - protein, 20 aa, Mycobacterium tuberculosis
LSPGLKRSSLIGGIRYYDTV

SEQ ID NO: 1495239 - protein, 18 aa, Mycobacterium tuberculosis
LSQRWGRLFVAVCYALRT

SEQ ID NO: 1495240 - protein, 20 aa, Mycobacterium tuberculosis
LSYKTGWYGSALVVADRWFP

SEQ ID NO: 1495241 - protein, 19 aa, Mycobacterium tuberculosis
LSYKTGWYGSSLVVADRWF

SEQ ID NO: 1495242 - protein, 18 aa, Mycobacterium tuberculosis
LVSGDYQGLIGLPLLGIP

SEQ ID NO: 1495243 - protein, 18 aa, Mycobacterium tuberculosis
LYDRVGFAAAGKFNEFDN

SEQ ID NO: 1495244 - protein, 20 aa, Mycobacterium tuberculosis
MELGCDAVLLASAVTRAADP

SEQ ID NO: 1495245 - protein, 18 aa, Mycobacterium tuberculosis
MGGTGGWLMGNGGMGGAG

SEQ ID NO: 1495246 - protein, 20 aa, Mycobacterium tuberculosis
MKPDVCWQLPIRRSQEWVTR

SEQ ID NO: 1495247 - protein, 24 aa, Mycobacterium tuberculosis
MLDDASKIVGCWNGLAKRSGTGIV

SEQ ID NO: 1495248 - protein, 17 aa, Mycobacterium tuberculosis
MYDRVHWSLTHMSQAGL

SEQ ID NO: 1495249 - protein, 21 aa, Mycobacterium tuberculosis
NAVKLRLGIGYVIQNAGLMPH

SEQ ID NO: 1495250 - protein, 19 aa, Mycobacterium tuberculosis
NCYHLYPAHAAFGGYKQSG

SEQ ID NO: 1495251 - protein, 28 aa, Mycobacterium tuberculosis
NHRKRIGELWARFSAVAADNPHAWIRNP

SEQ ID NO: 1495252 - protein, 18 aa, Mycobacterium tuberculosis
NHVLDYLAAKGWQPEGVS

SEQ ID NO: 1495253 - protein, 19 aa, Mycobacterium tuberculosis
NKTRLAALRVKDFGKREVM

SEQ ID NO: 1495254 - protein, 17 aa, Mycobacterium tuberculosis
NTQRPDGSWGFFDGQAT

SEQ ID NO: 1495255 - protein, 19 aa, Mycobacterium tuberculosis
NVAWPKVFRPPVIAATVTT

SEQ ID NO: 1495256 - protein, 17 aa, Mycobacterium tuberculosis
PAIAAVRAEYERVLRQR

SEQ ID NO: 1495257 - protein, 20 aa, Mycobacterium tuberculosis
PAPQFEVMYLLAVCDAAAAD

SEQ ID NO: 1495258 - protein, 17 aa, Mycobacterium tuberculosis
PDLRLPIYIGDDLTDED

SEQ ID NO: 1495259 - protein, 18 aa, Mycobacterium tuberculosis
PELLSRAAALNWDTTAPA

SEQ ID NO: 1495260 - protein, 21 aa, Mycobacterium tuberculosis
PELRSDVRLDFKPVVQTRYEP

SEQ ID NO: 1495261 - protein, 17 aa, Mycobacterium tuberculosis
PHLEAFKAKGYEVLLLT

SEQ ID NO: 1495262 - protein, 18 aa, Mycobacterium tuberculosis
PIAVIGMGCRFPGGVNNP

SEQ ID NO: 1495263 - protein, 25 aa, Mycobacterium tuberculosis
PLDFPRLNWAPIEWRNLEDEQEKML

SEQ ID NO: 1495264 - protein, 20 aa, Mycobacterium tuberculosis
PLLGICGGFQMLGRVIRDPY

SEQ ID NO: 1495265 - protein, 18 aa, Mycobacterium tuberculosis
PNAGSRFLLDQAITSAGR

SEQ ID NO: 1495266 - protein, 22 aa, Mycobacterium tuberculosis
PNFCTGELITAIAMTEPGTGSD

SEQ ID NO: 1495267 - protein, 17 aa, Mycobacterium tuberculosis
PPECLYGSLKMWAHLQR

SEQ ID NO: 1495268 - protein, 24 aa, Mycobacterium tuberculosis
PQVARAALLFGMCFDAESAVRHGL

SEQ ID NO: 1495269 - protein, 18 aa, Mycobacterium tuberculosis
PRTGLSMGEHAAVTAKQM

SEQ ID NO: 1495270 - protein, 24 aa, Mycobacterium tuberculosis
PTRAAICRFATWWVVLERHGNLVR

SEQ ID NO: 1495271 - protein, 19 aa, Mycobacterium tuberculosis
PVAVFRCGMILADTSYAGQ

SEQ ID NO: 1495272 - protein, 20 aa, Mycobacterium tuberculosis
PVPTCPGWSLGQLFRHVGRG

SEQ ID NO: 1495273 - protein, 18 aa, Mycobacterium tuberculosis
PWADAVWDTGIEFGTVGV

SEQ ID NO: 1495274 - protein, 18 aa, Mycobacterium tuberculosis
PWQIHDWILLTPWGLLSW

SEQ ID NO: 1495275 - protein, 17 aa, Mycobacterium tuberculosis
PWTVPKFYWTVLGLSAL

SEQ ID NO: 1495276 - protein, 22 aa, Mycobacterium tuberculosis
QGVPMCAGYVPGIPRLGVPALL

SEQ ID NO: 1495277 - protein, 17 aa, Mycobacterium tuberculosis
QIRSIPTIMAFKNGKLL

SEQ ID NO: 1495278 - protein, 19 aa, Mycobacterium tuberculosis
QMSALLMAIVWRGMDRGEI

SEQ ID NO: 1495279 - protein, 19 aa, Mycobacterium tuberculosis
RAFRLQWPIGTTIFELDRP

SEQ ID NO: 1495280 - protein, 20 aa, Mycobacterium tuberculosis
RAGDPFQHWIGRRFDAVATD

SEQ ID NO: 1495281 - protein, 25 aa, Mycobacterium tuberculosis
RAIPRGVGTAGVWRLPDRNTLQEVL

SEQ ID NO: 1495282 - protein, 18 aa, Mycobacterium tuberculosis
RALAVFGGMGLRLKGSDT

SEQ ID NO: 1495283 - protein, 21 aa, Mycobacterium tuberculosis
RARRAIAEFRIRGVSTNIPFL

SEQ ID NO: 1495284 - protein, 26 aa, Mycobacterium tuberculosis
RAVVTRYELVPGFPRFDVDDVYLGNG

SEQ ID NO: 1495285 - protein, 21 aa, Mycobacterium tuberculosis
RAYRLPWPAGTVVYEIDQPQV

SEQ ID NO: 1495286 - protein, 18 aa, Mycobacterium tuberculosis
RDHIAGAIKLDWRTDLQD

SEQ ID NO: 1495287 - protein, 20 aa, Mycobacterium tuberculosis
RDVPCPVCAGTRLKPEILAV

SEQ ID NO: 1495288 - protein, 17 aa, Mycobacterium tuberculosis
REAGWRPSIALRDGIEA

SEQ ID NO: 1495289 - protein, 23 aa, Mycobacterium tuberculosis
REKLFPLICRYAVAYHVVFIPSA

SEQ ID NO: 1495290 - protein, 21 aa, Mycobacterium tuberculosis
RELGVQFARQGIRVNALCPGP

SEQ ID NO: 1495291 - protein, 21 aa, Mycobacterium tuberculosis
RETFRAIGVDLMFDHIKQSLH

SEQ ID NO: 1495292 - protein, 20 aa, Mycobacterium tuberculosis
REVAELLLLGMPYRDIGARL

SEQ ID NO: 1495293 - protein, 19 aa, Mycobacterium tuberculosis
RGGCIIRAKFLNHIKEAFD

SEQ ID NO: 1495294 - protein, 18 aa, Mycobacterium tuberculosis
RGGLRWSDRRDDFRTEIL

SEQ ID NO: 1495295 - protein, 22 aa, Mycobacterium tuberculosis
RGVIPRDHIKAVLDAADVLIWM

SEQ ID NO: 1495296 - protein, 17 aa, Mycobacterium tuberculosis
RHARFMVNYATHWTEAR

SEQ ID NO: 1495297 - protein, 20 aa, Mycobacterium tuberculosis
RHLLSVLIDREWRHGVRVGV

SEQ ID NO: 1495298 - protein, 18 aa, Mycobacterium tuberculosis
RIAPEIVEFWQGRENRMH

SEQ ID NO: 1495299 - protein, 18 aa, Mycobacterium tuberculosis
RIGVKVWIYKGDIVGGKR

SEQ ID NO: 1495300 - protein, 24 aa, Mycobacterium tuberculosis
RILPETRRYLGWRLSLLDLIGADT

SEQ ID NO: 1495301 - protein, 20 aa, Mycobacterium tuberculosis
RIPLISIPAAPGFGNSTTNP

SEQ ID NO: 1495302 - protein, 17 aa, Mycobacterium tuberculosis
RKIAERRVFPAVDVNPS

SEQ ID NO: 1495303 - protein, 19 aa, Mycobacterium tuberculosis
RLAISELTGAYWAGPAAAS

SEQ ID NO: 1495304 - protein, 23 aa, Mycobacterium tuberculosis
RLARSLFLYALCNGWINENTTVV

SEQ ID NO: 1495305 - protein, 17 aa, Mycobacterium tuberculosis
RLRCYVVGVTRGAREPL

SEQ ID NO: 1495306 - protein, 17 aa, Mycobacterium tuberculosis
RLRTLLCTEAIAAADLM

SEQ ID NO: 1495307 - protein, 20 aa, Mycobacterium tuberculosis
RPADCLRPLQIHALISEVLK

SEQ ID NO: 1495308 - protein, 20 aa, Mycobacterium tuberculosis
RPKHYWSIYQKMIVKGRDFD

SEQ ID NO: 1495309 - protein, 25 aa, Mycobacterium tuberculosis
RRFLERRLRETFGFDGSPIRVNVRV

SEQ ID NO: 1495310 - protein, 22 aa, Mycobacterium tuberculosis
RRGHRKLVRFQARRAIGPIRPT

SEQ ID NO: 1495311 - protein, 18 aa, Mycobacterium tuberculosis
RRGSMQWFSPELQQYAPA

SEQ ID NO: 1495312 - protein, 19 aa, Mycobacterium tuberculosis
RRLELLGDREYLRWLRRSV

SEQ ID NO: 1495313 - protein, 17 aa, Mycobacterium tuberculosis
RRVEFWPTVAIRSALES

SEQ ID NO: 1495314 - protein, 20 aa, Mycobacterium tuberculosis
RSEWLEPRWMVGIDPESDGL

SEQ ID NO: 1495315 - protein, 19 aa, Mycobacterium tuberculosis
RSGMTIGIAGWGSRRKPMA

SEQ ID NO: 1495316 - protein, 26 aa, Mycobacterium tuberculosis
RSSRYPGGLALRFARVVRYRADKDPA

SEQ ID NO: 1495317 - protein, 21 aa, Mycobacterium tuberculosis
RTLRVAWSLADLAGRTSPGID

SEQ ID NO: 1495318 - protein, 18 aa, Mycobacterium tuberculosis
RTMRGYKVERRFGWDTHG

SEQ ID NO: 1495319 - protein, 22 aa, Mycobacterium tuberculosis
RTRKAGAVGLVMAEPLTYFFSD

SEQ ID NO: 1495320 - protein, 27 aa, Mycobacterium tuberculosis
RVNGRIPLPVDWRWPWGEALAVLENTA

SEQ ID NO: 1495321 - protein, 18 aa, Mycobacterium tuberculosis
RVPDEFGLSRYLAAGLAA

SEQ ID NO: 1495322 - protein, 19 aa, Mycobacterium tuberculosis
RVRTWLLAVSNVFGQNAPA

SEQ ID NO: 1495323 - protein, 18 aa, Mycobacterium tuberculosis
RWRGKKALLLQGRLWQGN

SEQ ID NO: 1495324 - protein, 25 aa, Mycobacterium tuberculosis
RYDLVLSFHCKQRFPAALIDGVRCV

SEQ ID NO: 1495325 - protein, 18 aa, Mycobacterium tuberculosis
SAAGYALWCNGIEDFAEL

SEQ ID NO: 1495326 - protein, 19 aa, Mycobacterium tuberculosis
SAMRVCGGAAFSKHLPIER

SEQ ID NO: 1495327 - protein, 19 aa, Mycobacterium tuberculosis
SAPMTLRWLTDRFAGKPLT

SEQ ID NO: 1495328 - protein, 20 aa, Mycobacterium tuberculosis
SAYPRVLDFAAFRSIADEVG

SEQ ID NO: 1495329 - protein, 21 aa, Mycobacterium tuberculosis
SDPLLAVPFSYPASLPTPFGP

SEQ ID NO: 1495330 - protein, 20 aa, Mycobacterium tuberculosis
SGGMCQRALIAIGLAGRPRL

SEQ ID NO: 1495331 - protein, 24 aa, Mycobacterium tuberculosis
SHGRVSVGVGFGWNTDELVDHGVP

SEQ ID NO: 1495332 - protein, 18 aa, Mycobacterium tuberculosis
SNYVYRPASLDQWRMLMG

SEQ ID NO: 1495333 - protein, 20 aa, Mycobacterium tuberculosis
SPGYPCYRNILSALGCEVVE

SEQ ID NO: 1495334 - protein, 20 aa, Mycobacterium tuberculosis
SSCLPEGVPSNWTIFFGAED

SEQ ID NO: 1495335 - protein, 20 aa, Mycobacterium tuberculosis
SSKLGGLWTAVSPHLSPLSN

SEQ ID NO: 1495336 - protein, 18 aa, Mycobacterium tuberculosis
SSLVTGWARLHGYPLGIL

SEQ ID NO: 1495337 - protein, 22 aa, Mycobacterium tuberculosis
STRTRFSFELGIAQLGGHAVVV

SEQ ID NO: 1495338 - protein, 18 aa, Mycobacterium tuberculosis
TAPLTLFGHCMGAIVAFE

SEQ ID NO: 1495339 - protein, 18 aa, Mycobacterium tuberculosis
TDHPAVWNHPVVDPHTVE

SEQ ID NO: 1495340 - protein, 17 aa, Mycobacterium tuberculosis
TEFPYVFCDATFCKVRV

SEQ ID NO: 1495341 - protein, 17 aa, Mycobacterium tuberculosis
TESRMAIAMARAGGMGV

SEQ ID NO: 1495342 - protein, 18 aa, Mycobacterium tuberculosis
THHRWLRALAVFGGMGLR

SEQ ID NO: 1495343 - protein, 17 aa, Mycobacterium tuberculosis
TIAHGFMTLALLPRLQH

SEQ ID NO: 1495344 - protein, 26 aa, Mycobacterium tuberculosis
TIPEIPYRYDLSVPIDIPITGTVVAT

SEQ ID NO: 1495345 - protein, 21 aa, Mycobacterium tuberculosis
TNTFPSWPLAHPFRRIAHNGE

SEQ ID NO: 1495346 - protein, 22 aa, Mycobacterium tuberculosis
TPAQVLLRWNLQLGNAVVVRSA

SEQ ID NO: 1495347 - protein, 19 aa, Mycobacterium tuberculosis
TPLKMCWVPGYSDYYPEAP

SEQ ID NO: 1495348 - protein, 17 aa, Mycobacterium tuberculosis
TQCCYTMRTIFDVKPDS

SEQ ID NO: 1495349 - protein, 17 aa, Mycobacterium tuberculosis
TQWTRWRQPVIGMPSTP

SEQ ID NO: 1495350 - protein, 17 aa, Mycobacterium tuberculosis
TRWHPVSSLPPMAFDHG

SEQ ID NO: 1495351 - protein, 17 aa, Mycobacterium tuberculosis
TSWDGIVVVCPPRANDE

SEQ ID NO: 1495352 - protein, 24 aa, Mycobacterium tuberculosis
VAACLKWEGGYVWACKNYDGDVQS

SEQ ID NO: 1495353 - protein, 26 aa, Mycobacterium tuberculosis
VAILLPAHWQTAAVLFGVWWIGAQAI

SEQ ID NO: 1495354 - protein, 18 aa, Mycobacterium tuberculosis
VDAAKGVPDWAARLPDEL

SEQ ID NO: 1495355 - protein, 18 aa, Mycobacterium tuberculosis
VDGAHLWHPYSSIGREAV

SEQ ID NO: 1495356 - protein, 22 aa, Mycobacterium tuberculosis
VGDGTCYWKRMGNPDGALIDNA

SEQ ID NO: 1495357 - protein, 18 aa, Mycobacterium tuberculosis
VGQLVKWARESIGRTEKI

SEQ ID NO: 1495358 - protein, 17 aa, Mycobacterium tuberculosis
VICCPAFGAAAKVGTFN

SEQ ID NO: 1495359 - protein, 20 aa, Mycobacterium tuberculosis
VIDMPLPISLGVNIPIDIPI

SEQ ID NO: 1495360 - protein, 21 aa, Mycobacterium tuberculosis
VKAIAAFSRWYAGEIDLHNPP

SEQ ID NO: 1495361 - protein, 18 aa, Mycobacterium tuberculosis
VLIALGWPNHVHHAAAQR

SEQ ID NO: 1495362 - protein, 22 aa, Mycobacterium tuberculosis
VLKQAAAFHGEFTRALAAAGAA

SEQ ID NO: 1495363 - protein, 19 aa, Mycobacterium tuberculosis
VLLHLAAEGWARWSGTVCE

SEQ ID NO: 1495364 - protein, 19 aa, Mycobacterium tuberculosis
VLTEYGWRAAGELRKGDRV

SEQ ID NO: 1495365 - protein, 17 aa, Mycobacterium tuberculosis
VMADAAAALAEFDIPAE

SEQ ID NO: 1495366 - protein, 20 aa, Mycobacterium tuberculosis
VNGFCVGGGIGLVGNSDVIV

SEQ ID NO: 1495367 - protein, 23 aa, Mycobacterium tuberculosis
VRTFARRRIDAILADVAPADGPD

SEQ ID NO: 1495368 - protein, 21 aa, Mycobacterium tuberculosis
VSWPNPNDWWLVRLLGSITPT

SEQ ID NO: 1495369 - protein, 19 aa, Mycobacterium tuberculosis
VTNATKLPGLRGWRRPQGE

SEQ ID NO: 1495370 - protein, 19 aa, Mycobacterium tuberculosis
VVLGDAWELLKFFNDDQYV

SEQ ID NO: 1495371 - protein, 19 aa, Mycobacterium tuberculosis
WAAEIARLAPLAIQHAKRV

SEQ ID NO: 1495372 - protein, 17 aa, Mycobacterium tuberculosis
WDAVLAVNLLAPLRLTE

SEQ ID NO: 1495373 - protein, 17 aa, Mycobacterium tuberculosis
WDPGKDFAMVTARETGP

SEQ ID NO: 1495374 - protein, 20 aa, Mycobacterium tuberculosis
WGAPVAWTFAWLHPDRCAGV

SEQ ID NO: 1495375 - protein, 20 aa, Mycobacterium tuberculosis
WGGTPSWECALAGLDQECGA

SEQ ID NO: 1495376 - protein, 17 aa, Mycobacterium tuberculosis
WHPVSSLPPMAFDHGPM

SEQ ID NO: 1495377 - protein, 18 aa, Mycobacterium tuberculosis
WKVFLNLLRTRFETDKDK

SEQ ID NO: 1495378 - protein, 25 aa, Mycobacterium tuberculosis
WLRRKHGLSSLGWDLCRIFTDGDYT

SEQ ID NO: 1495379 - protein, 17 aa, Mycobacterium tuberculosis
WMARMGFQMMDPLKTAK

SEQ ID NO: 1495380 - protein, 18 aa, Mycobacterium tuberculosis
WPLADVRLLAPILASKVV

SEQ ID NO: 1495381 - protein, 23 aa, Mycobacterium tuberculosis
WREVYRLRQPVLLIWGREDRVNP

SEQ ID NO: 1495382 - protein, 20 aa, Mycobacterium tuberculosis
WRNDQWYTARLCPAPLRPEE

SEQ ID NO: 1495383 - protein, 19 aa, Mycobacterium tuberculosis
WYTARLCPAPLRPEERQTT

SEQ ID NO: 1495384 - protein, 24 aa, Mycobacterium tuberculosis
YGLAGLRIGYAIGHPDVITALDKV

SEQ ID NO: 1495385 - protein, 20 aa, Mycobacterium tuberculosis
YGLRLSWNFLARSTAGLWEW

SEQ ID NO: 1495386 - protein, 19 aa, Mycobacterium tuberculosis
YKLLRSEWLEPRWMVGIDP

SEQ ID NO: 1495387 - protein, 18 aa, Mycobacterium tuberculosis
YLIRGVIGPDEFHSGYPG

SEQ ID NO: 1495388 - protein, 25 aa, Mycobacterium tuberculosis
YLVGPIAWTLGFPIVPMLAPGSTDV

SEQ ID NO: 1495389 - protein, 18 aa, Mycobacterium tuberculosis
YPQWDRFAAVRDRLDPDR

SEQ ID NO: 1495390 - protein, 22 aa, Mycobacterium tuberculosis
YYADFEGVLAFLQRKMSQTESE

SEQ ID NO: 1495391 - protein, 21 aa, Mycobacterium tuberculosis
YYQRFGFRVTREIALPDAGPP

SEQ ID NO: 1495392 - protein, 17 aa, Mycobacterium tuberculosis
AAAAGFPRPILHGLCTY

SEQ ID NO: 1495393 - protein, 18 aa, Mycobacterium tuberculosis
AAALPEYMLPAAYVVLDE

SEQ ID NO: 1495394 - protein, 21 aa, Mycobacterium tuberculosis
AASARGSLRLSLGHTSVEADV

SEQ ID NO: 1495395 - protein, 17 aa, Mycobacterium tuberculosis
ADEIAELLLKWKKTPQR

SEQ ID NO: 1495396 - protein, 19 aa, Mycobacterium tuberculosis
ADLLPGCAGLRVVESVYGH

SEQ ID NO: 1495397 - protein, 25 aa, Mycobacterium tuberculosis
AELAPRVVATVPQLVQLAPHAVQMS

SEQ ID NO: 1495398 - protein, 17 aa, Mycobacterium tuberculosis
AELLYRAGLPRALYAIV

SEQ ID NO: 1495399 - protein, 21 aa, Mycobacterium tuberculosis
AELVRRLSVVHGRVTLSSGRE

SEQ ID NO: 1495400 - protein, 17 aa, Mycobacterium tuberculosis
AEMTVALLLAVARHLIP

SEQ ID NO: 1495401 - protein, 22 aa, Mycobacterium tuberculosis
AEPPCAQLAALVRCVGPVEAAD

SEQ ID NO: 1495402 - protein, 18 aa, Mycobacterium tuberculosis
AGALCLPDAAMLVAARGR

SEQ ID NO: 1495403 - protein, 18 aa, Mycobacterium tuberculosis
AGVLRFVVLDGLAKPGRM

SEQ ID NO: 1495404 - protein, 20 aa, Mycobacterium tuberculosis
AGWSGVRWRNLTGGIVALHA

SEQ ID NO: 1495405 - protein, 17 aa, Mycobacterium tuberculosis
AIGRGGWFIGTGGMATI

SEQ ID NO: 1495406 - protein, 19 aa, Mycobacterium tuberculosis
AIPRRWRSPAPLWGDTSFH

SEQ ID NO: 1495407 - protein, 22 aa, Mycobacterium tuberculosis
ALCRAAGVPARIAFQTIDAPDK

SEQ ID NO: 1495408 - protein, 19 aa, Mycobacterium tuberculosis
AQAAWLWSRRRGVIAGQSA

SEQ ID NO: 1495409 - protein, 19 aa, Mycobacterium tuberculosis
ARLGHRLTIAMTRWQALVN

SEQ ID NO: 1495410 - protein, 19 aa, Mycobacterium tuberculosis
ARQLLDLMVHSVYSNKDAF

SEQ ID NO: 1495411 - protein, 17 aa, Mycobacterium tuberculosis
ASCPPILVLTGRPDDTW

SEQ ID NO: 1495412 - protein, 17 aa, Mycobacterium tuberculosis
ASLDRLGLDYVDLYLIH

SEQ ID NO: 1495413 - protein, 27 aa, Mycobacterium tuberculosis
ASSTWADSPRAWPIRAPSRLQVWRTRA

SEQ ID NO: 1495414 - protein, 18 aa, Mycobacterium tuberculosis
ATEARYGEMWAQDASAMY

SEQ ID NO: 1495415 - protein, 21 aa, Mycobacterium tuberculosis
ATLVGRLSVPAAWSTAAPATT

SEQ ID NO: 1495416 - protein, 17 aa, Mycobacterium tuberculosis
AVLARLDLGSVLIPMPA

SEQ ID NO: 1495417 - protein, 17 aa, Mycobacterium tuberculosis
AVLDRLAVYRARSVDID

SEQ ID NO: 1495418 - protein, 17 aa, Mycobacterium tuberculosis
AVLGLAFDGGWWVLGIR

SEQ ID NO: 1495419 - protein, 24 aa, Mycobacterium tuberculosis
AWERGRFAAPYLRDSLLAAGALCE

SEQ ID NO: 1495420 - protein, 20 aa, Mycobacterium tuberculosis
CGVCESCVSLAPNAPGSIDV

SEQ ID NO: 1495421 - protein, 17 aa, Mycobacterium tuberculosis
CNRTSCAQRAFPYLGGR

SEQ ID NO: 1495422 - protein, 20 aa, Mycobacterium tuberculosis
CWRADGQLEFLGRTDDQVKI

SEQ ID NO: 1495423 - protein, 20 aa, Mycobacterium tuberculosis
CWRIAAKSLRPLPVAHKEMS

SEQ ID NO: 1495424 - protein, 23 aa, Mycobacterium tuberculosis
DAKWASSISGYWRRGRTEEMFRK

SEQ ID NO: 1495425 - protein, 17 aa, Mycobacterium tuberculosis
DASVAMDTFGKWVSPAR

SEQ ID NO: 1495426 - protein, 25 aa, Mycobacterium tuberculosis
DATARFGLLPLRWALACLLIDIGTV

SEQ ID NO: 1495427 - protein, 17 aa, Mycobacterium tuberculosis
DEHLLVRAGHAFQQVTG

SEQ ID NO: 1495428 - protein, 17 aa, Mycobacterium tuberculosis
DFLHGRWLVLRRGKRSI

SEQ ID NO: 1495429 - protein, 19 aa, Mycobacterium tuberculosis
DGGNGGWLFGSGASGGNGG

SEQ ID NO: 1495430 - protein, 24 aa, Mycobacterium tuberculosis
DLAAECWMHIGIDLFWFALPPEQL

SEQ ID NO: 1495431 - protein, 29 aa, Mycobacterium tuberculosis
DLIDYPAGAAFSWWPTMLLPPGSHQDNMT

SEQ ID NO: 1495432 - protein, 17 aa, Mycobacterium tuberculosis
DVPWVLMHWRAVSADTP

SEQ ID NO: 1495433 - protein, 25 aa, Mycobacterium tuberculosis
EAEIACGRASAVIAELEALTFEHPY

SEQ ID NO: 1495434 - protein, 22 aa, Mycobacterium tuberculosis
EASLGITLPVALVWAYPTISDL

SEQ ID NO: 1495435 - protein, 17 aa, Mycobacterium tuberculosis
EAVTAIWHGRVEIDRFN

SEQ ID NO: 1495436 - protein, 25 aa, Mycobacterium tuberculosis
EDYFKLGYRGARFAFGYGACPDLED

SEQ ID NO: 1495437 - protein, 19 aa, Mycobacterium tuberculosis
EEYWWAAEQMLTWPDPDKP

SEQ ID NO: 1495438 - protein, 19 aa, Mycobacterium tuberculosis
EGLLNYLALLGWSIADDHD

SEQ ID NO: 1495439 - protein, 19 aa, Mycobacterium tuberculosis
EGVVSLGLYSRIFRNNILA

SEQ ID NO: 1495440 - protein, 21 aa, Mycobacterium tuberculosis
EHFNWLEGLGFQFERSYFPGK

SEQ ID NO: 1495441 - protein, 18 aa, Mycobacterium tuberculosis
ELAAAGLHRIRWWTDEAG

SEQ ID NO: 1495442 - protein, 21 aa, Mycobacterium tuberculosis
ELPAVRVGRSFRVHAKAVHDM

SEQ ID NO: 1495443 - protein, 19 aa, Mycobacterium tuberculosis
EQFSCWRIKLPHVEAAKFD

SEQ ID NO: 1495444 - protein, 18 aa, Mycobacterium tuberculosis
ERALFLGQWGLRGQRGGE

SEQ ID NO: 1495445 - protein, 19 aa, Mycobacterium tuberculosis
ESAGFKWLAPYTGSAIAQH

SEQ ID NO: 1495446 - protein, 25 aa, Mycobacterium tuberculosis
ETLLVVLCGVGFYIGFVGSYQRMAT

SEQ ID NO: 1495447 - protein, 25 aa, Mycobacterium tuberculosis
EVALFRLLGSWGVRPDFVMGHSIGE

SEQ ID NO: 1495448 - protein, 22 aa, Mycobacterium tuberculosis
FAKPYAEWRGMFAGNGMLLPAS

SEQ ID NO: 1495449 - protein, 18 aa, Mycobacterium tuberculosis
FALLPLGELWVAAARMRQ

SEQ ID NO: 1495450 - protein, 26 aa, Mycobacterium tuberculosis
FDQLSELWKAISPHLSPLSNIVSMLN

SEQ ID NO: 1495451 - protein, 24 aa, Mycobacterium tuberculosis
FGHCMGAIVAFEFARLAERNGVPV

SEQ ID NO: 1495452 - protein, 17 aa, Mycobacterium tuberculosis
FGSLMSGFANFDDEVSG

SEQ ID NO: 1495453 - protein, 18 aa, Mycobacterium tuberculosis
FMLHPVMMDIALQTLGAT

SEQ ID NO: 1495454 - protein, 17 aa, Mycobacterium tuberculosis
FRFELDAGLWLLATGSE

SEQ ID NO: 1495455 - protein, 25 aa, Mycobacterium tuberculosis
FRPSKIAFLAWHAWNDAERGNWPPG

SEQ ID NO: 1495456 - protein, 24 aa, Mycobacterium tuberculosis
FVHAVALAEVWRSCGVLPDLTVGH

SEQ ID NO: 1495457 - protein, 18 aa, Mycobacterium tuberculosis
FVVLDGLAKPGRMVGPDP

SEQ ID NO: 1495458 - protein, 17 aa, Mycobacterium tuberculosis
FVVPSRGLIGWRTDFLT

SEQ ID NO: 1495459 - protein, 17 aa, Mycobacterium tuberculosis
FYVWRAFARYSPVLPAG

SEQ ID NO: 1495460 - protein, 21 aa, Mycobacterium tuberculosis
GAGTFPWVLAITMPYSDAAQR

SEQ ID NO: 1495461 - protein, 17 aa, Mycobacterium tuberculosis
GAMARLGVWSGDGLQLD

SEQ ID NO: 1495462 - protein, 20 aa, Mycobacterium tuberculosis
GDLRTGMMGVWIGAIQNMYP

SEQ ID NO: 1495463 - protein, 19 aa, Mycobacterium tuberculosis
GDRWYWHWDPQFIGGIAAF

SEQ ID NO: 1495464 - protein, 17 aa, Mycobacterium tuberculosis
GDYQGLIGLPLLGIPVT

SEQ ID NO: 1495465 - protein, 17 aa, Mycobacterium tuberculosis
GFLGRYLALEWLDRMDL

SEQ ID NO: 1495466 - protein, 18 aa, Mycobacterium tuberculosis
GFTGWRPQLPVTQWSVTK

SEQ ID NO: 1495467 - protein, 23 aa, Mycobacterium tuberculosis
GHAAELFGWLGPHPDTMVSSAAT

SEQ ID NO: 1495468 - protein, 21 aa, Mycobacterium tuberculosis
GKAEKCTLCYPRIEVGLPTVC

SEQ ID NO: 1495469 - protein, 18 aa, Mycobacterium tuberculosis
GRAARLGHRLTIAMTRWQ

SEQ ID NO: 1495470 - protein, 20 aa, Mycobacterium tuberculosis
GRPKPVPIWAALDTDRGDRL

SEQ ID NO: 1495471 - protein, 21 aa, Mycobacterium tuberculosis
GRTPLPFYVWRAFARYSPVLP

SEQ ID NO: 1495472 - protein, 18 aa, Mycobacterium tuberculosis
GSCPLWVVHDAFAQPERI

SEQ ID NO: 1495473 - protein, 17 aa, Mycobacterium tuberculosis
GSDSLREPVVWQRLHQV

SEQ ID NO: 1495474 - protein, 21 aa, Mycobacterium tuberculosis
GVACYPARFQLVLAANPCPCA

SEQ ID NO: 1495475 - protein, 18 aa, Mycobacterium tuberculosis
GVEAGLIGPEWFPDSYPW

SEQ ID NO: 1495476 - protein, 18 aa, Mycobacterium tuberculosis
GVRDVVLCPGSRNAPLAF

SEQ ID NO: 1495477 - protein, 18 aa, Mycobacterium tuberculosis
GYHLGWWNADRSTAAGSS

SEQ ID NO: 1495478 - protein, 17 aa, Mycobacterium tuberculosis
GYPTACFVSINRHKSVA

SEQ ID NO: 1495479 - protein, 19 aa, Mycobacterium tuberculosis
HDIGYRIAHHADLTTPPPI

SEQ ID NO: 1495480 - protein, 21 aa, Mycobacterium tuberculosis
HGGPHYLCLAIHAMVTDDSSR

SEQ ID NO: 1495481 - protein, 18 aa, Mycobacterium tuberculosis
HLDFGTLAVNGFQIPAIT

SEQ ID NO: 1495482 - protein, 18 aa, Mycobacterium tuberculosis
HMWFGDLVTMTWWDDLWL

SEQ ID NO: 1495483 - protein, 18 aa, Mycobacterium tuberculosis
ICSARTAAQFGIEPRVAM

SEQ ID NO: 1495484 - protein, 17 aa, Mycobacterium tuberculosis
IDRVRWDDVVSRVFGRI

SEQ ID NO: 1495485 - protein, 22 aa, Mycobacterium tuberculosis
IIANRVSFAFGLRGPSVTIDSG

SEQ ID NO: 1495486 - protein, 17 aa, Mycobacterium tuberculosis
ILRRNGIEVSRYFAELD

SEQ ID NO: 1495487 - protein, 17 aa, Mycobacterium tuberculosis
ILTCLMHGGLCVTGGEN

SEQ ID NO: 1495488 - protein, 17 aa, Mycobacterium tuberculosis
INELLNWQVASAGEDIN

SEQ ID NO: 1495489 - protein, 20 aa, Mycobacterium tuberculosis
IPAFLRYDLRPVTGEWQIAA

SEQ ID NO: 1495490 - protein, 18 aa, Mycobacterium tuberculosis
IPLLDIPPAPGFGNSTTG

SEQ ID NO: 1495491 - protein, 21 aa, Mycobacterium tuberculosis
IRAPSRLQVWRTRATTARECS

SEQ ID NO: 1495492 - protein, 18 aa, Mycobacterium tuberculosis
IVPHTWLWAMPMSGPTGG

SEQ ID NO: 1495493 - protein, 19 aa, Mycobacterium tuberculosis
IYGKLAWEKTIPNWFFEPD

SEQ ID NO: 1495494 - protein, 20 aa, Mycobacterium tuberculosis
KEERGARIFIDFNQNARDRT

SEQ ID NO: 1495495 - protein, 18 aa, Mycobacterium tuberculosis
KPLYGSSLVTGWARLHGY

SEQ ID NO: 1495496 - protein, 17 aa, Mycobacterium tuberculosis
KQVRCVYVAIGQKGTTI

SEQ ID NO: 1495497 - protein, 23 aa, Mycobacterium tuberculosis
LAEIRHWLQIFVQRFYSFSQFKR

SEQ ID NO: 1495498 - protein, 23 aa, Mycobacterium tuberculosis
LEHPKMPLVPLIDGWETVVEMEA

SEQ ID NO: 1495499 - protein, 17 aa, Mycobacterium tuberculosis
LEPMAGKIIHCGAAGAG

SEQ ID NO: 1495500 - protein, 23 aa, Mycobacterium tuberculosis
LFFKEKRYDLARVGRYKVNKKLG

SEQ ID NO: 1495501 - protein, 17 aa, Mycobacterium tuberculosis
LGLDYVDLYLIHWPAPP

SEQ ID NO: 1495502 - protein, 19 aa, Mycobacterium tuberculosis
LGPRGRHVVLAKAFGGPTV

SEQ ID NO: 1495503 - protein, 22 aa, Mycobacterium tuberculosis
LGTRYLPPFAYFMDWPNAFQVL

SEQ ID NO: 1495504 - protein, 18 aa, Mycobacterium tuberculosis
LHGLAGWVDVKPAVVSTA

SEQ ID NO: 1495505 - protein, 24 aa, Mycobacterium tuberculosis
LIDFWRFNVAFARQILEQQPISGP

SEQ ID NO: 1495506 - protein, 22 aa, Mycobacterium tuberculosis
LLDALRWLGLDWDEGPEVGGPY

SEQ ID NO: 1495507 - protein, 21 aa, Mycobacterium tuberculosis
LLERGRYDLVLALASTHTGDG

SEQ ID NO: 1495508 - protein, 17 aa, Mycobacterium tuberculosis
LLETSWEAIEHAGLDPA

SEQ ID NO: 1495509 - protein, 17 aa, Mycobacterium tuberculosis
LLLPLGVRSLRAYGPTR

SEQ ID NO: 1495510 - protein, 18 aa, Mycobacterium tuberculosis
LMAAARLDLAAVFLYAGS

SEQ ID NO: 1495511 - protein, 20 aa, Mycobacterium tuberculosis
LPFDSPMYWHLFEPALRDAV

SEQ ID NO: 1495512 - protein, 17 aa, Mycobacterium tuberculosis
LPVYIISIGRTFRTDEL

SEQ ID NO: 1495513 - protein, 19 aa, Mycobacterium tuberculosis
LRAGLPPTLAVAGSYLDGI

SEQ ID NO: 1495514 - protein, 17 aa, Mycobacterium tuberculosis
LRDGLCFVDLAPITESG

SEQ ID NO: 1495515 - protein, 18 aa, Mycobacterium tuberculosis
LREDPPRRLAGFPATVTD

SEQ ID NO: 1495516 - protein, 19 aa, Mycobacterium tuberculosis
LRFGLELVECTDFFSDTTF

SEQ ID NO: 1495517 - protein, 18 aa, Mycobacterium tuberculosis
LRRACAAGALATLVSGAG

SEQ ID NO: 1495518 - protein, 18 aa, Mycobacterium tuberculosis
LRYGFRPSKIAFLAWHAW

SEQ ID NO: 1495519 - protein, 17 aa, Mycobacterium tuberculosis
LSVPAAWSTAAPATTAG

SEQ ID NO: 1495520 - protein, 21 aa, Mycobacterium tuberculosis
LSVVVAESWRASALAEMIQEA

SEQ ID NO: 1495521 - protein, 17 aa, Mycobacterium tuberculosis
LTAQDVFNNVARTCIEA

SEQ ID NO: 1495522 - protein, 18 aa, Mycobacterium tuberculosis
LTLTELWRSYGVQPDLVI

SEQ ID NO: 1495523 - protein, 17 aa, Mycobacterium tuberculosis
LVPAHLRDGHYSGAAAL

SEQ ID NO: 1495524 - protein, 19 aa, Mycobacterium tuberculosis
LYAEMWAQDALAMYGYAAA

SEQ ID NO: 1495525 - protein, 25 aa, Mycobacterium tuberculosis
MDPRQRLALELTWELLEDAFVVPET

SEQ ID NO: 1495526 - protein, 18 aa, Mycobacterium tuberculosis
MGGAINCGKAQPGQVAAV

SEQ ID NO: 1495527 - protein, 25 aa, Mycobacterium tuberculosis
MIDVIRFWLGLGIDGFRLDAVPYLF

SEQ ID NO: 1495528 - protein, 19 aa, Mycobacterium tuberculosis
MRWGLIPSWIKAGPGGAPD

SEQ ID NO: 1495529 - protein, 17 aa, Mycobacterium tuberculosis
MVFGHRGINIPVVDHAT

SEQ ID NO: 1495530 - protein, 21 aa, Mycobacterium tuberculosis
NAINPSVLWTLTPRIVSLDVE

SEQ ID NO: 1495531 - protein, 20 aa, Mycobacterium tuberculosis
NGGAGGWIYGHGGHGGAGGN

SEQ ID NO: 1495532 - protein, 21 aa, Mycobacterium tuberculosis
NPEIRPAHLLMALLTQNDGIA

SEQ ID NO: 1495533 - protein, 20 aa, Mycobacterium tuberculosis
NRPHLAAAWEYDWPASRWRQ

SEQ ID NO: 1495534 - protein, 18 aa, Mycobacterium tuberculosis
NVQVVWEKFCRYFDVEPR

SEQ ID NO: 1495535 - protein, 17 aa, Mycobacterium tuberculosis
NVYRVVSNLGVFDFGGP

SEQ ID NO: 1495536 - protein, 20 aa, Mycobacterium tuberculosis
PDFGLRLARWQGLGILGPVA

SEQ ID NO: 1495537 - protein, 17 aa, Mycobacterium tuberculosis
PELRRPITELGMVKSID

SEQ ID NO: 1495538 - protein, 19 aa, Mycobacterium tuberculosis
PFGPVAVAGFVVYRLDDGP

SEQ ID NO: 1495539 - protein, 19 aa, Mycobacterium tuberculosis
PGDGGGLVLLKPVQAALDD

SEQ ID NO: 1495540 - protein, 17 aa, Mycobacterium tuberculosis
PGSAIAWIVRLTGGFEE

SEQ ID NO: 1495541 - protein, 21 aa, Mycobacterium tuberculosis
PLPQTRFVLRKALAAHLPVIL

SEQ ID NO: 1495542 - protein, 19 aa, Mycobacterium tuberculosis
PPPSEGWRRLLYLLSGRLI

SEQ ID NO: 1495543 - protein, 17 aa, Mycobacterium tuberculosis
PQQRLLIEVAWEALEDA

SEQ ID NO: 1495544 - protein, 18 aa, Mycobacterium tuberculosis
PRLREFALREGLADAQLR

SEQ ID NO: 1495545 - protein, 20 aa, Mycobacterium tuberculosis
PTTARLTGRWLRGRLPTLND

SEQ ID NO: 1495546 - protein, 18 aa, Mycobacterium tuberculosis
PTYKRIRILGGHRLGMMM

SEQ ID NO: 1495547 - protein, 17 aa, Mycobacterium tuberculosis
PVALPVPAYMPFFDVLH

SEQ ID NO: 1495548 - protein, 18 aa, Mycobacterium tuberculosis
PYWYWALDRESIGGSVSA

SEQ ID NO: 1495549 - protein, 18 aa, Mycobacterium tuberculosis
QCANRFDVVQAFTDDALT

SEQ ID NO: 1495550 - protein, 22 aa, Mycobacterium tuberculosis
QPGCDAWCLAALAAVLVQENLC

SEQ ID NO: 1495551 - protein, 21 aa, Mycobacterium tuberculosis
QRLAATIPRARFEVIEGARTF

SEQ ID NO: 1495552 - protein, 23 aa, Mycobacterium tuberculosis
QRRFGVSYWTVFDEWAGRASAMR

SEQ ID NO: 1495553 - protein, 23 aa, Mycobacterium tuberculosis
RAEGRYALMPGIIGALAASGTPL

SEQ ID NO: 1495554 - protein, 20 aa, Mycobacterium tuberculosis
RAYRLDWPAGTIVYEIDQPK

SEQ ID NO: 1495555 - protein, 17 aa, Mycobacterium tuberculosis
RCPDRPGLIDELGTLTW

SEQ ID NO: 1495556 - protein, 23 aa, Mycobacterium tuberculosis
RCSGRLRKLFNAVGVVFKGTGFY

SEQ ID NO: 1495557 - protein, 23 aa, Mycobacterium tuberculosis
REGHCGACACTLRAGKVNMGVND

SEQ ID NO: 1495558 - protein, 21 aa, Mycobacterium tuberculosis
RFADWLVRVVEAFADRPDQPL

SEQ ID NO: 1495559 - protein, 18 aa, Mycobacterium tuberculosis
RGLRCIAPTWPLGAHPKP

SEQ ID NO: 1495560 - protein, 18 aa, Mycobacterium tuberculosis
RIAILLKVHHALIDGEGG

SEQ ID NO: 1495561 - protein, 20 aa, Mycobacterium tuberculosis
RLNLPAGWSYHTRVLTSELR

SEQ ID NO: 1495562 - protein, 23 aa, Mycobacterium tuberculosis
RRAGWRAARWLAVVINYRAERWS

SEQ ID NO: 1495563 - protein, 18 aa, Mycobacterium tuberculosis
RRLIPPWVTLGSRLAALP

SEQ ID NO: 1495564 - protein, 18 aa, Mycobacterium tuberculosis
RRLKASGIDTVFTLSGGH

SEQ ID NO: 1495565 - protein, 24 aa, Mycobacterium tuberculosis
RSRARLLGLRLRRLRYLRTAAARR

SEQ ID NO: 1495566 - protein, 22 aa, Mycobacterium tuberculosis
RSYNCLKREGVHTVGELVARTE

SEQ ID NO: 1495567 - protein, 18 aa, Mycobacterium tuberculosis
RTGVFSLDARQWFQSFPA

SEQ ID NO: 1495568 - protein, 17 aa, Mycobacterium tuberculosis
RVDFPWLGTVVQAYLRR

SEQ ID NO: 1495569 - protein, 18 aa, Mycobacterium tuberculosis
RYDLAVQEIFVFTPKGDV

SEQ ID NO: 1495570 - protein, 26 aa, Mycobacterium tuberculosis
RYLTALMPMVWRACEREDFVVEVQAM

SEQ ID NO: 1495571 - protein, 18 aa, Mycobacterium tuberculosis
SDDGRWRIVGNIPRGMFV

SEQ ID NO: 1495572 - protein, 18 aa, Mycobacterium tuberculosis
SFTIPGFQIRVLLGPAAV

SEQ ID NO: 1495573 - protein, 19 aa, Mycobacterium tuberculosis
SGAFAHRYGFRHSVVARPP

SEQ ID NO: 1495574 - protein, 23 aa, Mycobacterium tuberculosis
SGEQRLSGFLLWQSAYSEMWFTE

SEQ ID NO: 1495575 - protein, 19 aa, Mycobacterium tuberculosis
SGVPPSVWGGLAAARFQDV

SEQ ID NO: 1495576 - protein, 17 aa, Mycobacterium tuberculosis
SGWSLTAQDVFNNVART

SEQ ID NO: 1495577 - protein, 20 aa, Mycobacterium tuberculosis
SIFLMCLPDRVLAYGDCAII

SEQ ID NO: 1495578 - protein, 23 aa, Mycobacterium tuberculosis
SPKETWLRLLLIRAGFPRPQTQI

SEQ ID NO: 1495579 - protein, 18 aa, Mycobacterium tuberculosis
SRGLIGWRTDFLTETRGS

SEQ ID NO: 1495580 - protein, 24 aa, Mycobacterium tuberculosis
TAHFCSMCGPKFCSMRITQDVREY

SEQ ID NO: 1495581 - protein, 18 aa, Mycobacterium tuberculosis
TALLRLVGRYGIGEDDVD

SEQ ID NO: 1495582 - protein, 22 aa, Mycobacterium tuberculosis
TAYRWFRAGLLSVMARRVGRLI

SEQ ID NO: 1495583 - protein, 20 aa, Mycobacterium tuberculosis
TFRRRSCCLFYRVPAGGKCG

SEQ ID NO: 1495584 - protein, 24 aa, Mycobacterium tuberculosis
TLSFFRLALRLRRERNEFDGDVDW

SEQ ID NO: 1495585 - protein, 25 aa, Mycobacterium tuberculosis
TPRRYGVRWHYRLPVWSDFVEVHWS

SEQ ID NO: 1495586 - protein, 21 aa, Mycobacterium tuberculosis
TQLPLGFMVEFDRAGVLVEAE

SEQ ID NO: 1495587 - protein, 18 aa, Mycobacterium tuberculosis
VAGRMMGRLGWYVESMLS

SEQ ID NO: 1495588 - protein, 24 aa, Mycobacterium tuberculosis
VDAAWRPDTVWRYRLGSGESSERV

SEQ ID NO: 1495589 - protein, 17 aa, Mycobacterium tuberculosis
VDHFRYFAAAIRAQEGA

SEQ ID NO: 1495590 - protein, 23 aa, Mycobacterium tuberculosis
VDTDLRWRIVTALATAGAIDADG

SEQ ID NO: 1495591 - protein, 23 aa, Mycobacterium tuberculosis
VNQTRILAPRSRYDEIVAAVTNF

SEQ ID NO: 1495592 - protein, 23 aa, Mycobacterium tuberculosis
VPPGRLGWGWARFAFTSWKTLGW

SEQ ID NO: 1495593 - protein, 24 aa, Mycobacterium tuberculosis
VQRPAGRARSRWFSDYLRTVTQRD

SEQ ID NO: 1495594 - protein, 17 aa, Mycobacterium tuberculosis
VRASGLLPRWEQTQRFI

SEQ ID NO: 1495595 - protein, 17 aa, Mycobacterium tuberculosis
VRVVEAFADRPDQPLRE

SEQ ID NO: 1495596 - protein, 23 aa, Mycobacterium tuberculosis
VRYFIDRLAGWYVITSSDRMSRE

SEQ ID NO: 1495597 - protein, 23 aa, Mycobacterium tuberculosis
VSCVKPAGALYAFPRLDPEVYDI

SEQ ID NO: 1495598 - protein, 17 aa, Mycobacterium tuberculosis
VVPLDPTSTFALITQPD

SEQ ID NO: 1495599 - protein, 22 aa, Mycobacterium tuberculosis
VVRRMRLQPGRMFLVDTAQGRI

SEQ ID NO: 1495600 - protein, 25 aa, Mycobacterium tuberculosis
WAARARWANPAAWRLPGDDVTALRG

SEQ ID NO: 1495601 - protein, 31 aa, Mycobacterium tuberculosis; identical to SEQ ID NO: 214423

SEQ ID NO: 1495602 - protein, 20 aa, Mycobacterium tuberculosis
WEGRAVGLAQRWGSRNPIPW

SEQ ID NO: 1495603 - protein, 17 aa, Mycobacterium tuberculosis
WRLSGLGLRVIAHDPYR

SEQ ID NO: 1495604 - protein, 19 aa, Mycobacterium tuberculosis
WTLTPRIVSLDVEYFGVMW

SEQ ID NO: 1495605 - protein, 19 aa, Mycobacterium tuberculosis
YANRFGYNVVRDFTGHGIG

SEQ ID NO: 1495606 - protein, 17 aa, Mycobacterium tuberculosis
YDVSHLELPLPADGSTM

SEQ ID NO: 1495607 - protein, 17 aa, Mycobacterium tuberculosis
YFMDWPNAFQVLAGDFV

SEQ ID NO: 1495608 - protein, 18 aa, Mycobacterium tuberculosis
YRGVGQGSLQFAITSPDL

SEQ ID NO: 1495609 - protein, 21 aa, Mycobacterium tuberculosis
YRVGQNVAWQRWTEIAFGLTT

SEQ ID NO: 1495610 - protein, 20 aa, Mycobacterium tuberculosis
YRVLPYCWRDETPLSNHELR

SEQ ID NO: 1495611 - protein, 30 aa, Mycobacterium tuberculosis; identical to SEQ ID NO: 214545

SEQ ID NO: 1495612 - protein, 26 aa, Mycobacterium tuberculosis
YSNGILWRGDYQGLIGYSYALTIPEI

SEQ ID NO: 1495613 - protein, 24 aa, Mycobacterium tuberculosis
YVDLVCSWGPMILGHAHPAVVEAV

SEQ ID NO: 1495614 - protein, 28 aa, Mycobacterium tuberculosis
AAATPGWLEWFINWYLPISQLFYNTVGL

SEQ ID NO: 1495615 - protein, 18 aa, Mycobacterium tuberculosis
AADRCGRLALPRRTHVSV

SEQ ID NO: 1495616 - protein, 17 aa, Mycobacterium tuberculosis
AAIAALFATHGQAYQEL

SEQ ID NO: 1495617 - protein, 20 aa, Mycobacterium tuberculosis
AARLKGYRLICVMPENTSVE

SEQ ID NO: 1495618 - protein, 19 aa, Mycobacterium tuberculosis
ADLTRRALLRWGAGAGAGA

SEQ ID NO: 1495619 - protein, 19 aa, Mycobacterium tuberculosis
AEAGWPVRVWAAALPQQTT

SEQ ID NO: 1495620 - protein, 23 aa, Mycobacterium tuberculosis
AEAKARRGPLCLGIDPHPELLRG

SEQ ID NO: 1495621 - protein, 23 aa, Mycobacterium tuberculosis
AEDPRVAGLIARVQLPPSPAGAV

SEQ ID NO: 1495622 - protein, 18 aa, Mycobacterium tuberculosis
AEGVACYQLFISGLLDVT

SEQ ID NO: 1495623 - protein, 17 aa, Mycobacterium tuberculosis
AEYFVWFKGEYDVDDTD

SEQ ID NO: 1495624 - protein, 18 aa, Mycobacterium tuberculosis
AFPRLSVIRAPRHDRVVG

SEQ ID NO: 1495625 - protein, 19 aa, Mycobacterium tuberculosis
ALGVTHFSVGPIIVPRIAG

SEQ ID NO: 1495626 - protein, 20 aa, Mycobacterium tuberculosis
ALVTLDWLGAHGFGRLLQHT

SEQ ID NO: 1495627 - protein, 17 aa, Mycobacterium tuberculosis
APVKIFLTASAETRARR

SEQ ID NO: 1495628 - protein, 18 aa, Mycobacterium tuberculosis
ARLGYPLDRSHTAAVIWG

SEQ ID NO: 1495629 - protein, 18 aa, Mycobacterium tuberculosis
ARYGIVWGAMGAARSAWQ

SEQ ID NO: 1495630 - protein, 18 aa, Mycobacterium tuberculosis
ASATLIWRRPRWARRLQP

SEQ ID NO: 1495631 - protein, 26 aa, Mycobacterium tuberculosis
ASHCYPHFRRFLAEVVRVLRPGGYFP

SEQ ID NO: 1495632 - protein, 23 aa, Mycobacterium tuberculosis
ATERYQVLVGWDFEPASEYGTKA

SEQ ID NO: 1495633 - protein, 19 aa, Mycobacterium tuberculosis
AWRTKRLIVFDVDSTLVQG

SEQ ID NO: 1495634 - protein, 19 aa, Mycobacterium tuberculosis
CSDPAKLAGWWAEQFDGTT

SEQ ID NO: 1495635 - protein, 24 aa, Mycobacterium tuberculosis
DALVGPCWPAVFAAIGSAVTDTGE

SEQ ID NO: 1495636 - protein, 18 aa, Mycobacterium tuberculosis
DAVIAVHLRGHFLLTRNA

SEQ ID NO: 1495637 - protein, 18 aa, Mycobacterium tuberculosis
DDIPADVMPLDWYLHVRH

SEQ ID NO: 1495638 - protein, 24 aa, Mycobacterium tuberculosis
DEPELRFELCLGVSGVHYPHETGR

SEQ ID NO: 1495639 - protein, 23 aa, Mycobacterium tuberculosis
DGTRIPVSIVHRADIEFPAPALI

SEQ ID NO: 1495640 - protein, 18 aa, Mycobacterium tuberculosis
DIPNDFVVGYGLDYDERY

SEQ ID NO: 1495641 - protein, 18 aa, Mycobacterium tuberculosis
DLLKCSFCGKSQKQVKKL

SEQ ID NO: 1495642 - protein, 17 aa, Mycobacterium tuberculosis
DSAWLLVSILRQFGLAA

SEQ ID NO: 1495643 - protein, 20 aa, Mycobacterium tuberculosis
DTHARVGLLPTWGLSVRLPQ

SEQ ID NO: 1495644 - protein, 19 aa, Mycobacterium tuberculosis
EARGKIAMLAKVRRAPALI

SEQ ID NO: 1495645 - protein, 19 aa, Mycobacterium tuberculosis
EEPPEHLIFIFATTEPEKV

SEQ ID NO: 1495646 - protein, 21 aa, Mycobacterium tuberculosis
EGFGWPWSVCRWVAGENPSAA

SEQ ID NO: 1495647 - protein, 17 aa, Mycobacterium tuberculosis
EGGRFACGGARPADREV

SEQ ID NO: 1495648 - protein, 18 aa, Mycobacterium tuberculosis
ERGRRFLIHTARIAYVEI

SEQ ID NO: 1495649 - protein, 18 aa, Mycobacterium tuberculosis
ERLRLSGTRIELEELLQL

SEQ ID NO: 1495650 - protein, 28 aa, Mycobacterium tuberculosis
ESFFRGAGWNVIKVVWGREWDALLHADR

SEQ ID NO: 1495651 - protein, 17 aa, Mycobacterium tuberculosis
ETARLWLSLGHHDRHGV

SEQ ID NO: 1495652 - protein, 23 aa, Mycobacterium tuberculosis
FAESVPMWGPRGAALIQAIPEAT

SEQ ID NO: 1495653 - protein, 17 aa, Mycobacterium tuberculosis
FELLAARRRDQLIDIDV

SEQ ID NO: 1495654 - protein, 17 aa, Mycobacterium tuberculosis
FHFQRWAEFEGFVYDQK

SEQ ID NO: 1495655 - protein, 17 aa, Mycobacterium tuberculosis
GAGRWRGGDGAVRRLEF

SEQ ID NO: 1495656 - protein, 20 aa, Mycobacterium tuberculosis
GALSEWRATLIVRESACLDV

SEQ ID NO: 1495657 - protein, 20 aa, Mycobacterium tuberculosis
GCGMACPFCATGQGGLTRNL

SEQ ID NO: 1495658 - protein, 19 aa, Mycobacterium tuberculosis
GDCLFPGGVGKTWQPADFT

SEQ ID NO: 1495659 - protein, 25 aa, Mycobacterium tuberculosis
GGLMPGFGGAPWVGGHWGLGGEGHS

SEQ ID NO: 1495660 - protein, 23 aa, Mycobacterium tuberculosis
GGSGGRGGLLFGNGGNGSVGGMG

SEQ ID NO: 1495661 - protein, 19 aa, Mycobacterium tuberculosis
GILNRGAGISGVYNTGALG

SEQ ID NO: 1495662 - protein, 23 aa, Mycobacterium tuberculosis
GLGGLGLVVARWLVDRGAGRVVL

SEQ ID NO: 1495663 - protein, 23 aa, Mycobacterium tuberculosis
GLPSRLRLGVCVTDAGRRNPAVT

SEQ ID NO: 1495664 - protein, 23 aa, Mycobacterium tuberculosis
GLVGEKARYMWVSTFHSTCVRIL

SEQ ID NO: 1495665 - protein, 25 aa, Mycobacterium tuberculosis
GNPEGGWTLVSWDGIPVGPASLPTA

SEQ ID NO: 1495666 - protein, 17 aa, Mycobacterium tuberculosis
GPPMGFFRIGWVRTLAN

SEQ ID NO: 1495667 - protein, 18 aa, Mycobacterium tuberculosis
GRDAWEFALLRGALQRGM

SEQ ID NO: 1495668 - protein, 19 aa, Mycobacterium tuberculosis
GRIKDLLIVYGRNHSPDDI

SEQ ID NO: 1495669 - protein, 17 aa, Mycobacterium tuberculosis
GRSWSRWSFIGAGAPTA

SEQ ID NO: 1495670 - protein, 18 aa, Mycobacterium tuberculosis
GVVLLMWAGILAYLDRYG

SEQ ID NO: 1495671 - protein, 22 aa, Mycobacterium tuberculosis
HPDFLRLFYLLSMERSQDPAVA

SEQ ID NO: 1495672 - protein, 20 aa, Mycobacterium tuberculosis
HVPEIPAHVTVEVPVNIPIT

SEQ ID NO: 1495673 - protein, 17 aa, Mycobacterium tuberculosis
IALPRRTVVTFTPEHTG

SEQ ID NO: 1495674 - protein, 20 aa, Mycobacterium tuberculosis
IATGPRWRCPAGRCRRRPSD

SEQ ID NO: 1495675 - protein, 18 aa, Mycobacterium tuberculosis
IGLAAAKYWVCKRSTAHA

SEQ ID NO: 1495676 - protein, 17 aa, Mycobacterium tuberculosis
IGLRIAGGAIVWATPDH

SEQ ID NO: 1495677 - protein, 19 aa, Mycobacterium tuberculosis
IPEDLAFAESRIRPSTIAA

SEQ ID NO: 1495678 - protein, 19 aa, Mycobacterium tuberculosis
IPGPLKWDLTRGVATDTPE

SEQ ID NO: 1495679 - protein, 20 aa, Mycobacterium tuberculosis
IPLIDIPAAPGFGNSTTTPS

SEQ ID NO: 1495680 - protein, 20 aa, Mycobacterium tuberculosis
IRWSLDLLRRRFAKVIWVPG

SEQ ID NO: 1495681 - protein, 17 aa, Mycobacterium tuberculosis
ISARLDLPVGVARVLVG

SEQ ID NO: 1495682 - protein, 17 aa, Mycobacterium tuberculosis
ISFADGRVIVWSEELGE

SEQ ID NO: 1495683 - protein, 19 aa, Mycobacterium tuberculosis
KIVKFSGCYHGHVDALLAD

SEQ ID NO: 1495684 - protein, 19 aa, Mycobacterium tuberculosis
KPRPGRIVFVGSGPGDPGL

SEQ ID NO: 1495685 - protein, 21 aa, Mycobacterium tuberculosis
KSELWPDLNLGLPFTYHQGYQ

SEQ ID NO: 1495686 - protein, 18 aa, Mycobacterium tuberculosis
LACQRAGVPMQRYEHRAD

SEQ ID NO: 1495687 - protein, 18 aa, Mycobacterium tuberculosis
LADCWRIAAKSLRPLPVA

SEQ ID NO: 1495688 - protein, 23 aa, Mycobacterium tuberculosis
LAMGHAMIRAGLRLKKLGTDRSW

SEQ ID NO: 1495689 - protein, 17 aa, Mycobacterium tuberculosis
LDEYVDWLIEAGYPIRR

SEQ ID NO: 1495690 - protein, 23 aa, Mycobacterium tuberculosis
LDSRAWRLPWPDGTVVYELDQPK

SEQ ID NO: 1495691 - protein, 17 aa, Mycobacterium tuberculosis
LELGFAAARRFSADPQS

SEQ ID NO: 1495692 - protein, 17 aa, Mycobacterium tuberculosis
LESRTITFLKIDPAPGI

SEQ ID NO: 1495693 - protein, 21 aa, Mycobacterium tuberculosis
LFGRWELCALMQTVAELAEAM

SEQ ID NO: 1495694 - protein, 24 aa, Mycobacterium tuberculosis
LFGSVRSGLNTGLFNMGTAISGLF

SEQ ID NO: 1495695 - protein, 17 aa, Mycobacterium tuberculosis
LGGGVGWTTRRFGLSCD

SEQ ID NO: 1495696 - protein, 18 aa, Mycobacterium tuberculosis
LGYDEAWFGEHHSGGYEL

SEQ ID NO: 1495697 - protein, 19 aa, Mycobacterium tuberculosis
LLEYHWGPDWVVWDAAKTA

SEQ ID NO: 1495698 - protein, 24 aa, Mycobacterium tuberculosis
LLLRGSPCAIGWVAGWLSAEFPAR

SEQ ID NO: 1495699 - protein, 17 aa, Mycobacterium tuberculosis
LLSGLLRAGRQVKDLVV

SEQ ID NO: 1495700 - protein, 17 aa, Mycobacterium tuberculosis
LLYLDGRALLGTRYQDR

SEQ ID NO: 1495701 - protein, 17 aa, Mycobacterium tuberculosis
LMRRSGMIFIRRNIGND

SEQ ID NO: 1495702 - protein, 23 aa, Mycobacterium tuberculosis
LPLPQRRFGGVVGRTMAESVGDW

SEQ ID NO: 1495703 - protein, 20 aa, Mycobacterium tuberculosis
LPPHPAHFLWLNWGPCPPRQ

SEQ ID NO: 1495704 - protein, 18 aa, Mycobacterium tuberculosis
LPPRTMRALLARICEQEG

SEQ ID NO: 1495705 - protein, 17 aa, Mycobacterium tuberculosis
LQARLRLAITRRRSTLA

SEQ ID NO: 1495706 - protein, 17 aa, Mycobacterium tuberculosis
LRHTVRFSAAVRSALDD

SEQ ID NO: 1495707 - protein, 25 aa, Mycobacterium tuberculosis
LRIAPELFLKRCIVGGFDKVFELNR

SEQ ID NO: 1495708 - protein, 18 aa, Mycobacterium tuberculosis
LRSAAPIWWNGQDPGKGG

SEQ ID NO: 1495709 - protein, 19 aa, Mycobacterium tuberculosis
LRYFWSRVIADTGWQLLDS

SEQ ID NO: 1495710 - protein, 25 aa, Mycobacterium tuberculosis
LSFSSLSGWARLGLRERFIGLTDTV

SEQ ID NO: 1495711 - protein, 17 aa, Mycobacterium tuberculosis
LSKRGGGVALLLTNIRE

SEQ ID NO: 1495712 - protein, 18 aa, Mycobacterium tuberculosis
LVSAEGWHSLSIAYAETA

SEQ ID NO: 1495713 - protein, 17 aa, Mycobacterium tuberculosis
MEALDLLPLTDRRHLIE

SEQ ID NO: 1495714 - protein, 18 aa, Mycobacterium tuberculosis
MGGMPCIRGLRIPVATVV

SEQ ID NO: 1495715 - protein, 17 aa, Mycobacterium tuberculosis
MLEVSWEALEHAGIDPL

SEQ ID NO: 1495716 - protein, 18 aa, Mycobacterium tuberculosis
MLIELDIHFRIEDDLYYP

SEQ ID NO: 1495717 - protein, 25 aa, Mycobacterium tuberculosis
MTGWQRLHFRFGFPAPLLEPLAVER

SEQ ID NO: 1495718 - protein, 20 aa, Mycobacterium tuberculosis
MWRRGDEVFAEVALPADAGV

SEQ ID NO: 1495719 - protein, 25 aa, Mycobacterium tuberculosis
NGIAAKGEMRWQFHHVIDVAPTILE

SEQ ID NO: 1495720 - protein, 20 aa, Mycobacterium tuberculosis
NSLITSWRALGWIGPEAAEA

SEQ ID NO: 1495721 - protein, 20 aa, Mycobacterium tuberculosis
NWYTEFARLAPLMEKDVHYE

SEQ ID NO: 1495722 - protein, 18 aa, Mycobacterium tuberculosis
PDAFKWIQRAAMDRRTTM

SEQ ID NO: 1495723 - protein, 20 aa, Mycobacterium tuberculosis
PEEVAWRMGWIDDEQLVQRA

SEQ ID NO: 1495724 - protein, 17 aa, Mycobacterium tuberculosis
PEIKLGVLPGMGGSQRL

SEQ ID NO: 1495725 - protein, 18 aa, Mycobacterium tuberculosis
PETQIAISAWGLLSPQGR

SEQ ID NO: 1495726 - protein, 18 aa, Mycobacterium tuberculosis
PGGYFPYADLRPNNEIAA

SEQ ID NO: 1495727 - protein, 25 aa, Mycobacterium tuberculosis
PHSERLFCIPATIDLAGAEIELVSM

SEQ ID NO: 1495728 - protein, 24 aa, Mycobacterium tuberculosis
PLHTDLKEFGRWAADRIAEAIEFE

SEQ ID NO: 1495729 - protein, 21 aa, Mycobacterium tuberculosis
PLRPGPPPTVWSRRWRQRWAP

SEQ ID NO: 1495730 - protein, 17 aa, Mycobacterium tuberculosis
PLRVKAAAVGLAADEYH

SEQ ID NO: 1495731 - protein, 18 aa, Mycobacterium tuberculosis
PPHVPAMLVAGCDPRPNA

SEQ ID NO: 1495732 - protein, 22 aa, Mycobacterium tuberculosis
PRETWLRLLLIRAGFPRPQTQI

SEQ ID NO: 1495733 - protein, 21 aa, Mycobacterium tuberculosis
PRKIPPGTGWRKFVYSVSFHK

SEQ ID NO: 1495734 - protein, 17 aa, Mycobacterium tuberculosis
PVAVVGIGCRFPGDVDG

SEQ ID NO: 1495735 - protein, 26 aa, Mycobacterium tuberculosis
QCGLPKLMALELFKPFVMKRLVDLNH

SEQ ID NO: 1495736 - protein, 21 aa, Mycobacterium tuberculosis
QELHELLTLPFRSASEFIDAT

SEQ ID NO: 1495737 - protein, 23 aa, Mycobacterium tuberculosis
QLDRFAIRLELRYLSERDETSML

SEQ ID NO: 1495738 - protein, 27 aa, Mycobacterium tuberculosis
QLHCKIMWCPSVSLSIWANAWLAGKAA

SEQ ID NO: 1495739 - protein, 18 aa, Mycobacterium tuberculosis
QLLLLPLTSLRGLRHTLK

SEQ ID NO: 1495740 - protein, 25 aa, Mycobacterium tuberculosis
QVCAEWTRRGWLAVRYNLPYRRRRP

SEQ ID NO: 1495741 - protein, 22 aa, Mycobacterium tuberculosis
QVLGFREHASWALASDTLEFVD

SEQ ID NO: 1495742 - protein, 18 aa, Mycobacterium tuberculosis
RALEDWCHQLAWPIRPAV

SEQ ID NO: 1495743 - protein, 21 aa, Mycobacterium tuberculosis
RALGRYGVCANVICPRARTAM

SEQ ID NO: 1495744 - protein, 22 aa, Mycobacterium tuberculosis
RARLAAAIGLPGNRVVWMNQVH

SEQ ID NO: 1495745 - protein, 17 aa, Mycobacterium tuberculosis
RATREFLVWAVNDAIER

SEQ ID NO: 1495746 - protein, 19 aa, Mycobacterium tuberculosis
RAYRLPWPDGTTVFELDRP

SEQ ID NO: 1495747 - protein, 24 aa, Mycobacterium tuberculosis
RDFARASFSYGLNAKWPVYLSTKN

SEQ ID NO: 1495748 - protein, 25 aa, Mycobacterium tuberculosis
RFIRDTTWVSVRWYRPGGPLTAQQV

SEQ ID NO: 1495749 - protein, 18 aa, Mycobacterium tuberculosis
RGPMLHRALQQFLADVYW

SEQ ID NO: 1495750 - protein, 20 aa, Mycobacterium tuberculosis
RHPHCAWTVIIDESYPEAEG

SEQ ID NO: 1495751 - protein, 18 aa, Mycobacterium tuberculosis
RISPAWLRLDARFGSVYR

SEQ ID NO: 1495752 - protein, 20 aa, Mycobacterium tuberculosis
RLCLRFSSRLGITVASVDYR

SEQ ID NO: 1495753 - protein, 17 aa, Mycobacterium tuberculosis
RLLRLGLQSLRLWREGS

SEQ ID NO: 1495754 - protein, 19 aa, Mycobacterium tuberculosis
RLVMSGGFYRAIQRDDVEL

SEQ ID NO: 1495755 - protein, 21 aa, Mycobacterium tuberculosis
RNPRWWGARPRLDSITYLVLD

SEQ ID NO: 1495756 - protein, 19 aa, Mycobacterium tuberculosis
RPITELGMVKSIDTGPDGS

SEQ ID NO: 1495757 - protein, 25 aa, Mycobacterium tuberculosis
RPNRLAVCLDLDWRPQFRVDLIPSY

SEQ ID NO: 1495758 - protein, 20 aa, Mycobacterium tuberculosis
RPYDPPWCRPLLGVRRSVTH

SEQ ID NO: 1495759 - protein, 22 aa, Mycobacterium tuberculosis
RQQTLRASIDWSHALLTETEQI

SEQ ID NO: 1495760 - protein, 24 aa, Mycobacterium tuberculosis
RQQTLRASMDWSYALLTDTERILF

SEQ ID NO: 1495761 - protein, 19 aa, Mycobacterium tuberculosis
RTDEQWRWLAHTLTVELLK

SEQ ID NO: 1495762 - protein, 23 aa, Mycobacterium tuberculosis
RTLKGWADRGVRVIGLDAGGGTA

SEQ ID NO: 1495763 - protein, 23 aa, Mycobacterium tuberculosis
RTSAVKAFTAWAVRRGLLAGDPA

SEQ ID NO: 1495764 - protein, 20 aa, Mycobacterium tuberculosis
RVIRTLRRLGIRSVAVYSDP

SEQ ID NO: 1495765 - protein, 20 aa, Mycobacterium tuberculosis
RYGLRHRIRFGATVVSARFD

SEQ ID NO: 1495766 - protein, 18 aa, Mycobacterium tuberculosis
SASLSFSSLSGWARLGLR

SEQ ID NO: 1495767 - protein, 22 aa, Mycobacterium tuberculosis
SDIKNLLPMLAVFKPTVVVSVP

SEQ ID NO: 1495768 - protein, 21 aa, Mycobacterium tuberculosis
SGLPFGTCLDAAYLHPCGSDE

SEQ ID NO: 1495769 - protein, 30 aa, Mycobacterium tuberculosis; identical to SEQ ID NO: 214076

SEQ ID NO: 1495770 - protein, 25 aa, Mycobacterium tuberculosis
SIPIIDLRPAPGFFNATTGPSSGFL

SEQ ID NO: 1495771 - protein, 19 aa, Mycobacterium tuberculosis
SKTVIGLNMLRLWDDRRTL

SEQ ID NO: 1495772 - protein, 17 aa, Mycobacterium tuberculosis
SLAEVGIGFCFAPRFHP

SEQ ID NO: 1495773 - protein, 21 aa, Mycobacterium tuberculosis
SRTITFLKIDPAPGIGNSTTN

SEQ ID NO: 1495774 - protein, 20 aa, Mycobacterium tuberculosis
SYGSRCVRPPILYGDVSRPR

SEQ ID NO: 1495775 - protein, 17 aa, Mycobacterium tuberculosis
TAVMMGVYFNEYQSMLA

SEQ ID NO: 1495776 - protein, 17 aa, Mycobacterium tuberculosis
TMPSGPGPFGLPIPNPN

SEQ ID NO: 1495777 - protein, 20 aa, Mycobacterium tuberculosis
TNPGTLMWWIARSLELLQDF

SEQ ID NO: 1495778 - protein, 17 aa, Mycobacterium tuberculosis
TRAKRWLRRRTGAEHPA

SEQ ID NO: 1495779 - protein, 18 aa, Mycobacterium tuberculosis
TREFLVWAVNDAIERGEL

SEQ ID NO: 1495780 - protein, 17 aa, Mycobacterium tuberculosis
TRFAEAMAPFGFDAGAV

SEQ ID NO: 1495781 - protein, 21 aa, Mycobacterium tuberculosis
TTSICPWKGLAHYYNVVVDGP

SEQ ID NO: 1495782 - protein, 17 aa, Mycobacterium tuberculosis
VAACATAAVSVEEGVDK

SEQ ID NO: 1495783 - protein, 18 aa, Mycobacterium tuberculosis
VAYLTAWHSLCEVGRLSP

SEQ ID NO: 1495784 - protein, 25 aa, Mycobacterium tuberculosis
VDPGKRVVFTWGWEDHGDPPPGGST

SEQ ID NO: 1495785 - protein, 22 aa, Mycobacterium tuberculosis
VEFWAFDLLYLDGRALLGTRYQ

SEQ ID NO: 1495786 - protein, 18 aa, Mycobacterium tuberculosis
VEGLRMTWGRAVILEAMR

SEQ ID NO: 1495787 - protein, 21 aa, Mycobacterium tuberculosis
VETCWRKAIQMDYETDTDTEL

SEQ ID NO: 1495788 - protein, 20 aa, Mycobacterium tuberculosis
VGPRVARRFGRVLLELGGNN

SEQ ID NO: 1495789 - protein, 22 aa, Mycobacterium tuberculosis
VLVHPRPRLSVMAVGGELVDIS

SEQ ID NO: 1495790 - protein, 24 aa, Mycobacterium tuberculosis
VNFGPISVQGFGLFGHGGDGGNGG

SEQ ID NO: 1495791 - protein, 17 aa, Mycobacterium tuberculosis
VNLTFLPFFAKAVIDAL

SEQ ID NO: 1495792 - protein, 25 aa, Mycobacterium tuberculosis
VPSYRGSCWIPFSLEIEGDAAGFVA

SEQ ID NO: 1495793 - protein, 22 aa, Mycobacterium tuberculosis
VSPDLVRRLCWEWEDISQSSPD

SEQ ID NO: 1495794 - protein, 24 aa, Mycobacterium tuberculosis
VTLVIRGSCLLRHCDDTICERFTR

SEQ ID NO: 1495795 - protein, 17 aa, Mycobacterium tuberculosis
VVFRPLYAVGGQELGYL

SEQ ID NO: 1495796 - protein, 24 aa, Mycobacterium tuberculosis
VVVSGRWPFCSGINHADIMFAGCF

SEQ ID NO: 1495797 - protein, 17 aa, Mycobacterium tuberculosis
WALVGGFAVSARSEPRF

SEQ ID NO: 1495798 - protein, 18 aa, Mycobacterium tuberculosis
WHPGRCAQVFVGESSVGH

SEQ ID NO: 1495799 - protein, 18 aa, Mycobacterium tuberculosis
WNPKMKRFIFTDRNGIYI

SEQ ID NO: 1495800 - protein, 22 aa, Mycobacterium tuberculosis
WPNLAAELQLAFQQLLVGDYNA

SEQ ID NO: 1495801 - protein, 20 aa, Mycobacterium tuberculosis
WRRAGLTASRFVACPFGGSG

SEQ ID NO: 1495802 - protein, 18 aa, Mycobacterium tuberculosis
WVARLAVDFRQRFKKDVV

SEQ ID NO: 1495803 - protein, 21 aa, Mycobacterium tuberculosis
AALGLICPWADLAVDIEATRP

SEQ ID NO: 1495804 - protein, 17 aa, Mycobacterium tuberculosis
ACRQCLVEVEGQRKPLA

SEQ ID NO: 1495805 - protein, 17 aa, Mycobacterium tuberculosis
ADFRLTDAAVWERFYGS

SEQ ID NO: 1495806 - protein, 18 aa, Mycobacterium tuberculosis
ADLGAPVYFCDSRSPWQR

SEQ ID NO: 1495807 - protein, 18 aa, Mycobacterium tuberculosis
ADYRGRRVIVYFYPAAST

SEQ ID NO: 1495808 - protein, 17 aa, Mycobacterium tuberculosis
AEHYLHFGGVSPINGIN

SEQ ID NO: 1495809 - protein, 18 aa, Mycobacterium tuberculosis
AETGIIYIDEVDKIARKS

SEQ ID NO: 1495810 - protein, 18 aa, Mycobacterium tuberculosis
AGDAIACALELQLSTLAP

SEQ ID NO: 1495811 - protein, 17 aa, Mycobacterium tuberculosis
AHLRPGQLVLIHGGASG

SEQ ID NO: 1495812 - protein, 26 aa, Mycobacterium tuberculosis
ALIKSIGLRLGVPWYAYDTVTFSGEV

SEQ ID NO: 1495813 - protein, 17 aa, Mycobacterium tuberculosis
ALSRGLRPDRFVAEVRQ

SEQ ID NO: 1495814 - protein, 17 aa, Mycobacterium tuberculosis
APAALGLICPWADLAVD

SEQ ID NO: 1495815 - protein, 17 aa, Mycobacterium tuberculosis
AQLCERAELAAHWLSHG

SEQ ID NO: 1495816 - protein, 20 aa, Mycobacterium tuberculosis
AQLVMSNWFGLNAPLIAAVE

SEQ ID NO: 1495817 - protein, 19 aa, Mycobacterium tuberculosis
ARCPLCPGPTGLSSEVPAP

SEQ ID NO: 1495818 - protein, 19 aa, Mycobacterium tuberculosis
ARLTSLVTHNVFGQNTASI

SEQ ID NO: 1495819 - protein, 17 aa, Mycobacterium tuberculosis
ARSGVDVVRLVAGDPLT

SEQ ID NO: 1495820 - protein, 21 aa, Mycobacterium tuberculosis
ARSRSALGWIIERYRVTTDKA

SEQ ID NO: 1495821 - protein, 22 aa, Mycobacterium tuberculosis
ARVKCALLGWMAFKDALAQASE

SEQ ID NO: 1495822 - protein, 17 aa, Mycobacterium tuberculosis
ATFGVAYLTAWHSLCEV

SEQ ID NO: 1495823 - protein, 20 aa, Mycobacterium tuberculosis
ATGRPPRWVRPIVDALGFAP

SEQ ID NO: 1495824 - protein, 17 aa, Mycobacterium tuberculosis
ATLTRFLGIGVRTVLSQ

SEQ ID NO: 1495825 - protein, 23 aa, Mycobacterium tuberculosis
AVAKRRGWPILKFNSRGGVGIRR

SEQ ID NO: 1495826 - protein, 23 aa, Mycobacterium tuberculosis
AVLREFPSYIAFRERTKAKQPVD

SEQ ID NO: 1495827 - protein, 26 aa, Mycobacterium tuberculosis
AVVGLSLPGTVAWHAVPRWFARNKDR

SEQ ID NO: 1495828 - protein, 20 aa, Mycobacterium tuberculosis
AWLDALVGWRRASGLPAAVI

SEQ ID NO: 1495829 - protein, 20 aa, Mycobacterium tuberculosis
CAAVGRIAYLLGLRGPAVAV

SEQ ID NO: 1495830 - protein, 25 aa, Mycobacterium tuberculosis
CGKYKRVRFKGIICERCGVEVTRAK

SEQ ID NO: 1495831 - protein, 24 aa, Mycobacterium tuberculosis
CIECPAGTIGEIWVKGDNVAEGYW

SEQ ID NO: 1495832 - protein, 17 aa, Mycobacterium tuberculosis
CRSWPGCTAVAFERDER

SEQ ID NO: 1495833 - protein, 20 aa, Mycobacterium tuberculosis
DAARLTAVWIADWADDTVHL

SEQ ID NO: 1495834 - protein, 24 aa, Mycobacterium tuberculosis
DESRLTFLAVRRWYGWSAGRILNL

SEQ ID NO: 1495835 - protein, 20 aa, Mycobacterium tuberculosis
DFMGCCAVAVLAHEAERCRR

SEQ ID NO: 1495836 - protein, 18 aa, Mycobacterium tuberculosis
DGGRAVLVLSDWPAPQAP

SEQ ID NO: 1495837 - protein, 20 aa, Mycobacterium tuberculosis
DGLLEIGRALNIPPLATNDC

SEQ ID NO: 1495838 - protein, 19 aa, Mycobacterium tuberculosis
DGLRYLDWLAAYSAVNLGH

SEQ ID NO: 1495839 - protein, 23 aa, Mycobacterium tuberculosis
DIDRFGRRFGCVVMDGFGSTEGG

SEQ ID NO: 1495840 - protein, 19 aa, Mycobacterium tuberculosis
DKPFLMPVEDVFTITGRGT

SEQ ID NO: 1495841 - protein, 22 aa, Mycobacterium tuberculosis
DWIPRLATMGVIASYCLTEPGA

SEQ ID NO: 1495842 - protein, 18 aa, Mycobacterium tuberculosis
EACDRGGPGLLLRAKHAV

SEQ ID NO: 1495843 - protein, 26 aa, Mycobacterium tuberculosis
EEDPRWRFGVPPANNANYAWIQHILY

SEQ ID NO: 1495844 - protein, 22 aa, Mycobacterium tuberculosis
EHAELPPGWVLTTSGRISGVTE

SEQ ID NO: 1495845 - protein, 19 aa, Mycobacterium tuberculosis
EINSALIFAGAGPEPMAAA

SEQ ID NO: 1495846 - protein, 20 aa, Mycobacterium tuberculosis
EITRLVPFIEWLRGAYPDQL

SEQ ID NO: 1495847 - protein, 18 aa, Mycobacterium tuberculosis
ELRIGLATAEDIRQWSYG

SEQ ID NO: 1495848 - protein, 17 aa, Mycobacterium tuberculosis
ENYRGAMGLNWYLTDPT

SEQ ID NO: 1495849 - protein, 19 aa, Mycobacterium tuberculosis
EPMLFEWTDRDTLLYAIGV

SEQ ID NO: 1495850 - protein, 18 aa, Mycobacterium tuberculosis
ERNYRFWADLTEALKTGK

SEQ ID NO: 1495851 - protein, 17 aa, Mycobacterium tuberculosis
EVTIGKMFVVDTGQLDG

SEQ ID NO: 1495852 - protein, 18 aa, Mycobacterium tuberculosis
FAACPICHLHLRSFANRH

SEQ ID NO: 1495853 - protein, 19 aa, Mycobacterium tuberculosis
FALLARRRMDLYGATVEDF

SEQ ID NO: 1495854 - protein, 17 aa, Mycobacterium tuberculosis
FAQAAAVPVVFLTAWYG

SEQ ID NO: 1495855 - protein, 18 aa, Mycobacterium tuberculosis
FDGLRLAGRRVRRPELTL

SEQ ID NO: 1495856 - protein, 17 aa, Mycobacterium tuberculosis
FLWAPRLGCYGIQRIHP

SEQ ID NO: 1495857 - protein, 19 aa, Mycobacterium tuberculosis
FPLPLGDPSVRCGGDLLSM

SEQ ID NO: 1495858 - protein, 20 aa, Mycobacterium tuberculosis
FPLYCCANGKALLAALPPER

SEQ ID NO: 1495859 - protein, 19 aa, Mycobacterium tuberculosis
FRAAAGIYRAARRAGETVR

SEQ ID NO: 1495860 - protein, 20 aa, Mycobacterium tuberculosis
FRGTAPAGRGFWFPPTVLTP

SEQ ID NO: 1495861 - protein, 17 aa, Mycobacterium tuberculosis
FYFPRFRALCMAENATH

SEQ ID NO: 1495862 - protein, 19 aa, Mycobacterium tuberculosis
GDHQMGFGGFNSGSGNIGF

SEQ ID NO: 1495863 - protein, 23 aa, Mycobacterium tuberculosis
GESRLRLLGFERVELEPGQTRRV

SEQ ID NO: 1495864 - protein, 18 aa, Mycobacterium tuberculosis
GGLRRFLDELGELPNKSL

SEQ ID NO: 1495865 - protein, 25 aa, Mycobacterium tuberculosis
GHIELAAPVTHIWYFKGVPSRLGYL

SEQ ID NO: 1495866 - protein, 21 aa, Mycobacterium tuberculosis
GKPGAGVCPVRGHSNVQGDRT

SEQ ID NO: 1495867 - protein, 19 aa, Mycobacterium tuberculosis
GLIGPEWFPDSYPWVPSIN

SEQ ID NO: 1495868 - protein, 18 aa, Mycobacterium tuberculosis
GLLAARLARRIPYVTAVD

SEQ ID NO: 1495869 - protein, 18 aa, Mycobacterium tuberculosis
GPCKMVAPVLEEIATERA

SEQ ID NO: 1495870 - protein, 20 aa, Mycobacterium tuberculosis
GPHFECWTVLGAWAEQTSHI

SEQ ID NO: 1495871 - protein, 23 aa, Mycobacterium tuberculosis
GPHMAGGGWAWADFVAEADPSNP

SEQ ID NO: 1495872 - protein, 26 aa, Mycobacterium tuberculosis
GQEVWTSQMIVAPAFVDAAAKDLATI

SEQ ID NO: 1495873 - protein, 18 aa, Mycobacterium tuberculosis
GRDDWAVHIALWRRSSNG

SEQ ID NO: 1495874 - protein, 18 aa, Mycobacterium tuberculosis
GRGSIRMRGVVEVEEDSR

SEQ ID NO: 1495875 - protein, 19 aa, Mycobacterium tuberculosis
GRLSEWRATLIVRESACLD

SEQ ID NO: 1495876 - protein, 19 aa, Mycobacterium tuberculosis
GRLTLPAKFRDALAGGLMV

SEQ ID NO: 1495877 - protein, 20 aa, Mycobacterium tuberculosis
GSLLKELRSILAPECAARAR

SEQ ID NO: 1495878 - protein, 20 aa, Mycobacterium tuberculosis
GTGLFSGFMSGFGNTGFLQS

SEQ ID NO: 1495879 - protein, 19 aa, Mycobacterium tuberculosis
GYRVRRFAARVVWKLAPDA

SEQ ID NO: 1495880 - protein, 20 aa, Mycobacterium tuberculosis
HCSWSVAGTGQFLAHDGASP

SEQ ID NO: 1495881 - protein, 17 aa, Mycobacterium tuberculosis
HESLCFAGANLIPLRGG

SEQ ID NO: 1495882 - protein, 17 aa, Mycobacterium tuberculosis
HRIRFGATVVSARFDDG

SEQ ID NO: 1495883 - protein, 19 aa, Mycobacterium tuberculosis
IAKGSLRGGLVLGLEDSSS

SEQ ID NO: 1495884 - protein, 19 aa, Mycobacterium tuberculosis
IATTRFLLDVNISGGLPAF

SEQ ID NO: 1495885 - protein, 20 aa, Mycobacterium tuberculosis
IEHWTRLPVEVELASEFRYR

SEQ ID NO: 1495886 - protein, 17 aa, Mycobacterium tuberculosis
ISIPSCRPGWCGPITAS

SEQ ID NO: 1495887 - protein, 17 aa, Mycobacterium tuberculosis
ITEVIALQERLGLDVLV

SEQ ID NO: 1495888 - protein, 19 aa, Mycobacterium tuberculosis
ITIVDAHLDGGFGPVVLPP

SEQ ID NO: 1495889 - protein, 18 aa, Mycobacterium tuberculosis
ITLHAALQLARRGSGVGV

SEQ ID NO: 1495890 - protein, 17 aa, Mycobacterium tuberculosis
IVGFCMGGQFALVLSPR

SEQ ID NO: 1495891 - protein, 19 aa, Mycobacterium tuberculosis
IVVHLAPWLEPQPICWAID

SEQ ID NO: 1495892 - protein, 20 aa, Mycobacterium tuberculosis
KASEVVEPWSLRLSHPELLY

SEQ ID NO: 1495893 - protein, 22 aa, Mycobacterium tuberculosis
KEGDDVFVALSWTKHPPPQTYD

SEQ ID NO: 1495894 - protein, 20 aa, Mycobacterium tuberculosis
KEIAGRLAARIGSGLLVDVV

SEQ ID NO: 1495895 - protein, 18 aa, Mycobacterium tuberculosis
KGVPGRWRLCVLMRDDAT

SEQ ID NO: 1495896 - protein, 19 aa, Mycobacterium tuberculosis
KLVPFGAFVRVEEGIEGLV

SEQ ID NO: 1495897 - protein, 24 aa, Mycobacterium tuberculosis
KVPRAARVAVRWLRAVALDRIGDV

SEQ ID NO: 1495898 - protein, 18 aa, Mycobacterium tuberculosis
LADLSFADYLMWVRRDDG

SEQ ID NO: 1495899 - protein, 26 aa, Mycobacterium tuberculosis
LAERVGWRWRLVWYRAVAELLTGDYD

SEQ ID NO: 1495900 - protein, 18 aa, Mycobacterium tuberculosis
LAGLPAWLASGAPAAAMT

SEQ ID NO: 1495901 - protein, 18 aa, Mycobacterium tuberculosis
LALTELWRSYGVIPDAVI

SEQ ID NO: 1495902 - protein, 17 aa, Mycobacterium tuberculosis
LAMPRLDMVTGLYYLTT

SEQ ID NO: 1495903 - protein, 17 aa, Mycobacterium tuberculosis
LCARCTRFSDQIAGDPF

SEQ ID NO: 1495904 - protein, 17 aa, Mycobacterium tuberculosis
LEAAITFYSRLFNAEPA

SEQ ID NO: 1495905 - protein, 18 aa, Mycobacterium tuberculosis
LELIDWPVALVIATGHIL

SEQ ID NO: 1495906 - protein, 17 aa, Mycobacterium tuberculosis
LEPVGACRQCLVEVEGQ

SEQ ID NO: 1495907 - protein, 20 aa, Mycobacterium tuberculosis
LFYSGFYLPMYWSSRAKLTN

SEQ ID NO: 1495908 - protein, 18 aa, Mycobacterium tuberculosis
LLESFLFYSGFYLPMYWS

SEQ ID NO: 1495909 - protein, 19 aa, Mycobacterium tuberculosis
LLNRLWPLVSLRCNFFTPT

SEQ ID NO: 1495910 - protein, 19 aa, Mycobacterium tuberculosis
LLTRGRYQYRPEPPFVLGA

SEQ ID NO: 1495911 - protein, 18 aa, Mycobacterium tuberculosis
LNGPRYWLMNAIEKAPQG

SEQ ID NO: 1495912 - protein, 17 aa, Mycobacterium tuberculosis
LNMMAHLLSTIDYADVE

SEQ ID NO: 1495913 - protein, 19 aa, Mycobacterium tuberculosis
LPGIWYAGSHGFELTAPDG

SEQ ID NO: 1495914 - protein, 17 aa, Mycobacterium tuberculosis
LPGYIFSGVAPVVTEML

SEQ ID NO: 1495915 - protein, 21 aa, Mycobacterium tuberculosis
LPLEFARLAGYYLAEGHACLT

SEQ ID NO: 1495916 - protein, 22 aa, Mycobacterium tuberculosis
LPPEINSALMFAGPGSGPLIAA

SEQ ID NO: 1495917 - protein, 19 aa, Mycobacterium tuberculosis
LRAEERWRPGLPPPPEQFY

SEQ ID NO: 1495918 - protein, 23 aa, Mycobacterium tuberculosis
LRALKRLKVVAAFQQSGNSPMGM

SEQ ID NO: 1495919 - protein, 18 aa, Mycobacterium tuberculosis
LRDLLKFDFYFADSTAFR

SEQ ID NO: 1495920 - protein, 19 aa, Mycobacterium tuberculosis
LRELCKMDGAVVLSTDGSR

SEQ ID NO: 1495921 - protein, 17 aa, Mycobacterium tuberculosis
LRPGQLVLIHGGASGIG

SEQ ID NO: 1495922 - protein, 20 aa, Mycobacterium tuberculosis
LRPLGFRPALGFSRVDTTIS

SEQ ID NO: 1495923 - protein, 17 aa, Mycobacterium tuberculosis
LRTEIWPLLADRSPITK

SEQ ID NO: 1495924 - protein, 19 aa, Mycobacterium tuberculosis
LRYGRIPARVSGPDPVPGC

SEQ ID NO: 1495925 - protein, 20 aa, Mycobacterium tuberculosis
LRYTMPLGEIIFDFFDALKS

SEQ ID NO: 1495926 - protein, 22 aa, Mycobacterium tuberculosis
LSSKEWPGMLAFYRNLAMALVG

SEQ ID NO: 1495927 - protein, 17 aa, Mycobacterium tuberculosis
LTARTGGVVGRRVCAVV

SEQ ID NO: 1495928 - protein, 17 aa, Mycobacterium tuberculosis
LTFPGFLKAYVETVDEL

SEQ ID NO: 1495929 - protein, 19 aa, Mycobacterium tuberculosis
LVSDHIRAIVALGGFAWQV

SEQ ID NO: 1495930 - protein, 20 aa, Mycobacterium tuberculosis
LYWQCWKLDSPIIARITDTV

SEQ ID NO: 1495931 - protein, 19 aa, Mycobacterium tuberculosis
MLLELSWEALERAGIDPTG

SEQ ID NO: 1495932 - protein, 20 aa, Mycobacterium tuberculosis
NALCAAAVALECGASVEQVA

SEQ ID NO: 1495933 - protein, 17 aa, Mycobacterium tuberculosis
NEAAFCYQLLVRSFGTN

SEQ ID NO: 1495934 - protein, 24 aa, Mycobacterium tuberculosis
NGMLWRGDHEGLFGLSYGITIPQF

SEQ ID NO: 1495935 - protein, 20 aa, Mycobacterium tuberculosis
NLRCSYCMPERGLRWLPGEQ

SEQ ID NO: 1495936 - protein, 18 aa, Mycobacterium tuberculosis
NQQFALLFVDWLAANPGA

SEQ ID NO: 1495937 - protein, 22 aa, Mycobacterium tuberculosis
NSPLSDFFIKWMSRINTWMYRR

SEQ ID NO: 1495938 - protein, 19 aa, Mycobacterium tuberculosis
PDLVIGWWAAPTILEHGTP

SEQ ID NO: 1495939 - protein, 22 aa, Mycobacterium tuberculosis
PEFSELFAAFPSFAGLRPTFDT

SEQ ID NO: 1495940 - protein, 18 aa, Mycobacterium tuberculosis
PELRPMVQLDGGRFATSD

SEQ ID NO: 1495941 - protein, 23 aa, Mycobacterium tuberculosis
PFWDRLRFPAALDRVQVPVLLVG

SEQ ID NO: 1495942 - protein, 21 aa, Mycobacterium tuberculosis
PGFADSLLRGWQAKKRTSTRI

SEQ ID NO: 1495943 - protein, 23 aa, Mycobacterium tuberculosis
PGGFRYGPAFGVELQFWVYEETV

SEQ ID NO: 1495944 - protein, 20 aa, Mycobacterium tuberculosis
PICAPDLLLAQALLRTQQIK

SEQ ID NO: 1495945 - protein, 22 aa, Mycobacterium tuberculosis
PLARFGAWYEMFPRSTGGWDDD

SEQ ID NO: 1495946 - protein, 23 aa, Mycobacterium tuberculosis
PLPSTRQRLGWALRDLPSRLGKI

SEQ ID NO: 1495947 - protein, 19 aa, Mycobacterium tuberculosis
PLRPWPGFVPMVYERYSQP

SEQ ID NO: 1495948 - protein, 23 aa, Mycobacterium tuberculosis
PMTAWAVGLLMRLPQRGVVTVAT

SEQ ID NO: 1495949 - protein, 18 aa, Mycobacterium tuberculosis
PPNFWAWLIAQVKTVDPD

SEQ ID NO: 1495950 - protein, 18 aa, Mycobacterium tuberculosis
PRIRGGKVPFVFRTLPGY

SEQ ID NO: 1495951 - protein, 20 aa, Mycobacterium tuberculosis
PRPALTINFCVGFVRQQVNQ

SEQ ID NO: 1495952 - protein, 18 aa, Mycobacterium tuberculosis
PTLAGAVPTIWNDVMHYL

SEQ ID NO: 1495953 - protein, 17 aa, Mycobacterium tuberculosis
PYPKLLLADRDSIFEYT

SEQ ID NO: 1495954 - protein, 17 aa, Mycobacterium tuberculosis
QDVAAMFGYHAGASAAV

SEQ ID NO: 1495955 - protein, 23 aa, Mycobacterium tuberculosis
QLTRKRLGTGLIEAFSTSCPNCS

SEQ ID NO: 1495956 - protein, 19 aa, Mycobacterium tuberculosis
QPRCLPQRIAVPVTKLKTC

SEQ ID NO: 1495957 - protein, 21 aa, Mycobacterium tuberculosis
QRMSTVLSRRLWENAGSPEVD

SEQ ID NO: 1495958 - protein, 18 aa, Mycobacterium tuberculosis
QTTECWRQWINIGNFPDH

SEQ ID NO: 1495959 - protein, 17 aa, Mycobacterium tuberculosis
RAAMKWCRKAQELGTLD

SEQ ID NO: 1495960 - protein, 18 aa, Mycobacterium tuberculosis
RAFLADKVVRWWLPERWA

SEQ ID NO: 1495961 - protein, 18 aa, Mycobacterium tuberculosis
RAHRGIVAVNELPDLAER

SEQ ID NO: 1495962 - protein, 22 aa, Mycobacterium tuberculosis
RAVARLRIAVVRAIRTALQRRG

SEQ ID NO: 1495963 - protein, 25 aa, Mycobacterium tuberculosis
RCGSPAWNLPVVFGPIAVTYNLNSV

SEQ ID NO: 1495964 - protein, 17 aa, Mycobacterium tuberculosis
RDIYKFAAGSVFSRPFQ

SEQ ID NO: 1495965 - protein, 20 aa, Mycobacterium tuberculosis
RFAERFGRFNFAAAALRPAY

SEQ ID NO: 1495966 - protein, 18 aa, Mycobacterium tuberculosis
RFGLAAPLPRAGTQMRAF

SEQ ID NO: 1495967 - protein, 19 aa, Mycobacterium tuberculosis
RFPEELGKMGFVFNFITYG

SEQ ID NO: 1495968 - protein, 17 aa, Mycobacterium tuberculosis
RGTKVAHAHLRYLNPFP

SEQ ID NO: 1495969 - protein, 18 aa, Mycobacterium tuberculosis
RITLPTPRPPFHEELPRI

SEQ ID NO: 1495970 - protein, 19 aa, Mycobacterium tuberculosis
RLAIPELPDAVFIESLRQL

SEQ ID NO: 1495971 - protein, 17 aa, Mycobacterium tuberculosis
RLAKACAAEGAHGLLVV

SEQ ID NO: 1495972 - protein, 22 aa, Mycobacterium tuberculosis
RLFPRGLAAFIELRDQRCRTPY

SEQ ID NO: 1495973 - protein, 17 aa, Mycobacterium tuberculosis
RLGIIIAGFDRRRIPLV

SEQ ID NO: 1495974 - protein, 20 aa, Mycobacterium tuberculosis
RLLLREVFTAAGGTHDDWDE

SEQ ID NO: 1495975 - protein, 23 aa, Mycobacterium tuberculosis
RLPRIAGPCGMVIFGVTGDLARK

SEQ ID NO: 1495976 - protein, 21 aa, Mycobacterium tuberculosis
RLRGGQTLIGFLAPRNADNSI

SEQ ID NO: 1495977 - protein, 20 aa, Mycobacterium tuberculosis
RLSDPFITIDAFQVVAGVLF

SEQ ID NO: 1495978 - protein, 19 aa, Mycobacterium tuberculosis
RMHMPGVSICYGMTETSPV

SEQ ID NO: 1495979 - protein, 19 aa, Mycobacterium tuberculosis
RMKFEGGVHRVQRVPVTES

SEQ ID NO: 1495980 - protein, 20 aa, Mycobacterium tuberculosis
RMRQEITEVIALQERLGLDV

SEQ ID NO: 1495981 - protein, 18 aa, Mycobacterium tuberculosis
RRTHGWPAAMGILREMGM

SEQ ID NO: 1495982 - protein, 19 aa, Mycobacterium tuberculosis
RRYRFRAGIAKVDFVLSDE

SEQ ID NO: 1495983 - protein, 18 aa, Mycobacterium tuberculosis
RSGDVWLLNGFKWFASNC

SEQ ID NO: 1495984 - protein, 17 aa, Mycobacterium tuberculosis
RVVRAHVPLSEMFGYVG

SEQ ID NO: 1495985 - protein, 24 aa, Mycobacterium tuberculosis
RVYRFGGSLHLDWWYDTRRIPAAT

SEQ ID NO: 1495986 - protein, 17 aa, Mycobacterium tuberculosis
RYLDILRPLGFRPALGF

SEQ ID NO: 1495987 - protein, 18 aa, Mycobacterium tuberculosis
SLCRSVDIPARFVLGQAL

SEQ ID NO: 1495988 - protein, 18 aa, Mycobacterium tuberculosis
SLLPRYLTTRVYAALLES

SEQ ID NO: 1495989 - protein, 21 aa, Mycobacterium tuberculosis
SLPAKRWLAQRGFDPVYGARP

SEQ ID NO: 1495990 - protein, 25 aa, Mycobacterium tuberculosis
SNGLLWRGDHEGLFSLFYSLDVPRI

SEQ ID NO: 1495991 - protein, 23 aa, Mycobacterium tuberculosis
SPKETWLRLLLINAGFPRPSTQI

SEQ ID NO: 1495992 - protein, 19 aa, Mycobacterium tuberculosis
SPPYVVRWLVNGHETTVYP

SEQ ID NO: 1495993 - protein, 17 aa, Mycobacterium tuberculosis
SRAGLGYEVIVSRLDDE

SEQ ID NO: 1495994 - protein, 18 aa, Mycobacterium tuberculosis
SRIPMWVEETLRYDTSSQ

SEQ ID NO: 1495995 - protein, 18 aa, Mycobacterium tuberculosis
SVVGRLSVPASWSTAAPA

SEQ ID NO: 1495996 - protein, 18 aa, Mycobacterium tuberculosis
SVWCFATASAREWWGLVW

SEQ ID NO: 1495997 - protein, 25 aa, Mycobacterium tuberculosis
TDSFYRPKRPGSYPIVLATYEIVCS

SEQ ID NO: 1495998 - protein, 18 aa, Mycobacterium tuberculosis
TGVPVQWSAVFAGSGGRR

SEQ ID NO: 1495999 - protein, 23 aa, Mycobacterium tuberculosis
TPEGLRWLYNFIKAQGERNFGKI

SEQ ID NO: 1496000 - protein, 18 aa, Mycobacterium tuberculosis
TRFGQRLRLRPFDLGAPK

SEQ ID NO: 1496001 - protein, 22 aa, Mycobacterium tuberculosis
TSVEVAELWSTFMQKWIAYTAA

SEQ ID NO: 1496002 - protein, 23 aa, Mycobacterium tuberculosis
TTSWLKSRHSFSFGDHYDPDNTH

SEQ ID NO: 1496003 - protein, 18 aa, Mycobacterium tuberculosis
VARRRARVVVPFQPRLLM

SEQ ID NO: 1496004 - protein, 18 aa, Mycobacterium tuberculosis
VDLWGADGAEGWTADPII

SEQ ID NO: 1496005 - protein, 23 aa, Mycobacterium tuberculosis
VDRRGRLLWSLPKGHIELGETAE

SEQ ID NO: 1496006 - protein, 21 aa, Mycobacterium tuberculosis
VEMGGPFSLELCGGTHVSNTA

SEQ ID NO: 1496007 - protein, 18 aa, Mycobacterium tuberculosis
VHAPRLSPAPALLALPAA

SEQ ID NO: 1496008 - protein, 17 aa, Mycobacterium tuberculosis
VHLRGHFLLTRNAAAYW

SEQ ID NO: 1496009 - protein, 18 aa, Mycobacterium tuberculosis
VLIDREWRHGVRVGVETA

SEQ ID NO: 1496010 - protein, 23 aa, Mycobacterium tuberculosis
VQSVLLPRLLDWMSYAPDPDGGL

SEQ ID NO: 1496011 - protein, 18 aa, Mycobacterium tuberculosis
VRLMRWGLIPSWIKAGPG

SEQ ID NO: 1496012 - protein, 25 aa, Mycobacterium tuberculosis
VSQGRFRFGVGVGWLREEVANHGVD

SEQ ID NO: 1496013 - protein, 21 aa, Mycobacterium tuberculosis
VTLGEEFPRLMVYRGPRRKGV

SEQ ID NO: 1496014 - protein, 19 aa, Mycobacterium tuberculosis
VTNPARWALLYGSPVPGYH

SEQ ID NO: 1496015 - protein, 25 aa, Mycobacterium tuberculosis
VVCSEILPRWGVQTVFVDGDDLSQW

SEQ ID NO: 1496016 - protein, 18 aa, Mycobacterium tuberculosis
VWVGHDWGAVVVWNAPLL

SEQ ID NO: 1496017 - protein, 22 aa, Mycobacterium tuberculosis
VYYRRALMLAACFGRGSEYPQR

SEQ ID NO: 1496018 - protein, 17 aa, Mycobacterium tuberculosis
WASLPLKLFAGGNAKFW

SEQ ID NO: 1496019 - protein, 17 aa, Mycobacterium tuberculosis
WLGAHGFGRLLQHTVVV

SEQ ID NO: 1496020 - protein, 23 aa, Mycobacterium tuberculosis
WLSVKRLAGWLAAAGYCGRAPRP

SEQ ID NO: 1496021 - protein, 18 aa, Mycobacterium tuberculosis
WNFPMVIASWAIAPALAA

SEQ ID NO: 1496022 - protein, 17 aa, Mycobacterium tuberculosis
WTLLILREAFFGVRRFG

SEQ ID NO: 1496023 - protein, 19 aa, Mycobacterium tuberculosis
WVIAYRWFRAGLLPVPAQR

SEQ ID NO: 1496024 - protein, 20 aa, Mycobacterium tuberculosis
WWLQRRLLLCGIRATCPAVD

SEQ ID NO: 1496025 - protein, 17 aa, Mycobacterium tuberculosis
YISALALLAKREQWAEF

SEQ ID NO: 1496026 - protein, 17 aa, Mycobacterium tuberculosis
YKWPTLDGMFAPHASDV

SEQ ID NO: 1496027 - protein, 18 aa, Mycobacterium tuberculosis
YLGAWGIVDCFERGADVV

SEQ ID NO: 1496028 - protein, 19 aa, Mycobacterium tuberculosis
YLPLVVRRRIWFLAKSEYF

SEQ ID NO: 1496029 - protein, 19 aa, Mycobacterium tuberculosis
YQYRPEPPFVLGAEIAGVV

SEQ ID NO: 1496030 - protein, 17 aa, Mycobacterium tuberculosis
YRAAGYWSGRTLDTVLS

SEQ ID NO: 1496031 - protein, 22 aa, Mycobacterium tuberculosis
YRGCSHACRYCFARPTHEYLDF

SEQ ID NO: 1496032 - protein, 19 aa, Mycobacterium tuberculosis
YYAMTGWRLGWLLVPTVLR

SEQ ID NO: 1496033 - protein, 18 aa, Mycobacterium tuberculosis
AAHARFVAAAAKVNTLLD

SEQ ID NO: 1496034 - protein, 17 aa, Mycobacterium tuberculosis
AAYAMRWVAKNVVAAGL

SEQ ID NO: 1496035 - protein, 18 aa, Mycobacterium tuberculosis
ACIKAAADRVVFINTGFL

SEQ ID NO: 1496036 - protein, 18 aa, Mycobacterium tuberculosis
ADIEACWNLGATVAAQLM

SEQ ID NO: 1496037 - protein, 21 aa, Mycobacterium tuberculosis
ADVIRYLRWFTFLSADELAEL

SEQ ID NO: 1496038 - protein, 17 aa, Mycobacterium tuberculosis
AEGRLKGILKYYDAPIV

SEQ ID NO: 1496039 - protein, 21 aa, Mycobacterium tuberculosis
AEIYVPFSWFEPMWLENLGFA

SEQ ID NO: 1496040 - protein, 22 aa, Mycobacterium tuberculosis
AELGERCAFGLQLIAPRLPPFD

SEQ ID NO: 1496041 - protein, 19 aa, Mycobacterium tuberculosis
AEPKWVLAMGVCASSGGMF

SEQ ID NO: 1496042 - protein, 17 aa, Mycobacterium tuberculosis
AGAPIRVGAFLAEDHAL

SEQ ID NO: 1496043 - protein, 18 aa, Mycobacterium tuberculosis
AGGFGVLGAVGFTPEQLE

SEQ ID NO: 1496044 - protein, 19 aa, Mycobacterium tuberculosis
AIELARSGAKVAISDVDTD

SEQ ID NO: 1496045 - protein, 23 aa, Mycobacterium tuberculosis
AKAAPLWRVLVALSIRHVGPTAA

SEQ ID NO: 1496046 - protein, 17 aa, Mycobacterium tuberculosis
AKLRLAVLAGRLRAAGV

SEQ ID NO: 1496047 - protein, 23 aa, Mycobacterium tuberculosis
ALDLCPRVRVNAIAPGSILTSAL

SEQ ID NO: 1496048 - protein, 23 aa, Mycobacterium tuberculosis
ALSTARFEFRWNDQFALSLDPDT

SEQ ID NO: 1496049 - protein, 18 aa, Mycobacterium tuberculosis
APKGWGWVAPYIGMIWPN

SEQ ID NO: 1496050 - protein, 17 aa, Mycobacterium tuberculosis
AQVALAWLISLPGVVAI

SEQ ID NO: 1496051 - protein, 20 aa, Mycobacterium tuberculosis
ARLYVGAGLAPMLDAAAAWD

SEQ ID NO: 1496052 - protein, 18 aa, Mycobacterium tuberculosis
ARQILGHRAMIVAGGSNR

SEQ ID NO: 1496053 - protein, 19 aa, Mycobacterium tuberculosis
ARQRPGLLAAWLDGDLGEL

SEQ ID NO: 1496054 - protein, 23 aa, Mycobacterium tuberculosis
ATAFPWRRQSALVQWYVETSGSP

SEQ ID NO: 1496055 - protein, 19 aa, Mycobacterium tuberculosis
AVDRIWRAARHWYRAGMHP

SEQ ID NO: 1496056 - protein, 23 aa, Mycobacterium tuberculosis
AVQAWRGFSRWLMRAYDVLVDED

SEQ ID NO: 1496057 - protein, 17 aa, Mycobacterium tuberculosis
CDPEVVEALKFHLRDLA

SEQ ID NO: 1496058 - protein, 23 aa, Mycobacterium tuberculosis
DEFQCGPRMPMLPGAWDLGTWDR

SEQ ID NO: 1496059 - protein, 18 aa, Mycobacterium tuberculosis
DEPKCSLCQALTAASSQI

SEQ ID NO: 1496060 - protein, 23 aa, Mycobacterium tuberculosis
DIVLFPAWVWRSPLKPSPLDPPH

SEQ ID NO: 1496061 - protein, 19 aa, Mycobacterium tuberculosis
DLKSLRWAWNRAKDDVAPW

SEQ ID NO: 1496062 - protein, 20 aa, Mycobacterium tuberculosis
DLRDEWQIALCNNGFDANRP

SEQ ID NO: 1496063 - protein, 18 aa, Mycobacterium tuberculosis
DMRLDMPLVDFFSHGGAL

SEQ ID NO: 1496064 - protein, 21 aa, Mycobacterium tuberculosis
DMTYLQWLRRYVELAIGEGNS

SEQ ID NO: 1496065 - protein, 18 aa, Mycobacterium tuberculosis
DNPVLWRRLELLGDREYL

SEQ ID NO: 1496066 - protein, 18 aa, Mycobacterium tuberculosis
DRVLLCLPDSPDLVQLLL

SEQ ID NO: 1496067 - protein, 25 aa, Mycobacterium tuberculosis
DSIRMMSLVGRWRRKGIAVDFATLA

SEQ ID NO: 1496068 - protein, 18 aa, Mycobacterium tuberculosis
DTGRCRVPLILRLDPKIG

SEQ ID NO: 1496069 - protein, 19 aa, Mycobacterium tuberculosis
DVEPCAAVGVELRRRGHAV

SEQ ID NO: 1496070 - protein, 22 aa, Mycobacterium tuberculosis
DVGCGWGATMMRAVEKYDVNVV

SEQ ID NO: 1496071 - protein, 18 aa, Mycobacterium tuberculosis
DVPSLGWRVYRLVPADEA

SEQ ID NO: 1496072 - protein, 20 aa, Mycobacterium tuberculosis
EFLGGLRFAGAQVVPIRVYR

SEQ ID NO: 1496073 - protein, 24 aa, Mycobacterium tuberculosis
EGHPGHGPRYLWTRTVAGRGTKGR

SEQ ID NO: 1496074 - protein, 17 aa, Mycobacterium tuberculosis
EGNLWFEWSRSLDDPAE

SEQ ID NO: 1496075 - protein, 23 aa, Mycobacterium tuberculosis
ELDGLRLITWRGASRAEQGLPFA

SEQ ID NO: 1496076 - protein, 18 aa, Mycobacterium tuberculosis
ELHEIYKLGVVSIPTNMP

SEQ ID NO: 1496077 - protein, 20 aa, Mycobacterium tuberculosis
ELLDRVSSKYALVIYAAKRA

SEQ ID NO: 1496078 - protein, 20 aa, Mycobacterium tuberculosis
EPQPICWAIDHVRVCVGHGY

SEQ ID NO: 1496079 - protein, 22 aa, Mycobacterium tuberculosis
ERFRYGFAIAPELVRTVLRDNE

SEQ ID NO: 1496080 - protein, 20 aa, Mycobacterium tuberculosis
ESPIDWDIAWPAGDLQVNLT

SEQ ID NO: 1496081 - protein, 21 aa, Mycobacterium tuberculosis
ESYPTAMLMVFKLHRDFDIAE

SEQ ID NO: 1496082 - protein, 17 aa, Mycobacterium tuberculosis
ETIDWGRTVLALGLDTI

SEQ ID NO: 1496083 - protein, 26 aa, Mycobacterium tuberculosis
EVPAPPFWGSRIVKGLAVADYTGLLD

SEQ ID NO: 1496084 - protein, 17 aa, Mycobacterium tuberculosis
FAALAFKIATHPFFGKL

SEQ ID NO: 1496085 - protein, 19 aa, Mycobacterium tuberculosis
FGLTEAIAAYSTRLKITPT

SEQ ID NO: 1496086 - protein, 18 aa, Mycobacterium tuberculosis
FGMQDVIWRGAYYTPNGA

SEQ ID NO: 1496087 - protein, 17 aa, Mycobacterium tuberculosis
FLADYGWRLTEQAGPEE

SEQ ID NO: 1496088 - protein, 20 aa, Mycobacterium tuberculosis
FLVDCGRGVLQRAAAVGVGA

SEQ ID NO: 1496089 - protein, 18 aa, Mycobacterium tuberculosis
FNYLDLVRYLAVGNLNPS

SEQ ID NO: 1496090 - protein, 17 aa, Mycobacterium tuberculosis
FRACKRCRPDASPGSPE

SEQ ID NO: 1496091 - protein, 17 aa, Mycobacterium tuberculosis
FRFVEEMIRLGADARTD

SEQ ID NO: 1496092 - protein, 17 aa, Mycobacterium tuberculosis
FRLTDAAVWERFYGSSH

SEQ ID NO: 1496093 - protein, 23 aa, Mycobacterium tuberculosis
FRPGPRRRLGVLVDHLVAGSKEA

SEQ ID NO: 1496094 - protein, 19 aa, Mycobacterium tuberculosis
FRYVMMVLRHIPRSIFRKL

SEQ ID NO: 1496095 - protein, 18 aa, Mycobacterium tuberculosis
FVAAYMPFLAWLIQASAD

SEQ ID NO: 1496096 - protein, 17 aa, Mycobacterium tuberculosis
GEPFPYPVTVGYMYIMK

SEQ ID NO: 1496097 - protein, 23 aa, Mycobacterium tuberculosis
GGKCPQCGTYVFPPRADNCPNPA

SEQ ID NO: 1496098 - protein, 17 aa, Mycobacterium tuberculosis
GGLFLNWVDRVIGPGDP

SEQ ID NO: 1496099 - protein, 23 aa, Mycobacterium tuberculosis
GHCRGVCLGGYLLQGGYGWNSRI

SEQ ID NO: 1496100 - protein, 22 aa, Mycobacterium tuberculosis
GPRLRYLLAVKACFAVFQTGTP

SEQ ID NO: 1496101 - protein, 17 aa, Mycobacterium tuberculosis
GPTRDWECYCGKYKRVR

SEQ ID NO: 1496102 - protein, 17 aa, Mycobacterium tuberculosis
GQGSVLVPFSWQGVSLH

SEQ ID NO: 1496103 - protein, 19 aa, Mycobacterium tuberculosis
GREIGCKLVSFGSGAHFCL

SEQ ID NO: 1496104 - protein, 17 aa, Mycobacterium tuberculosis
GRHIPVFAHVTVETTGT

SEQ ID NO: 1496105 - protein, 20 aa, Mycobacterium tuberculosis
GRLWLARGGTYALANIRGGG

SEQ ID NO: 1496106 - protein, 21 aa, Mycobacterium tuberculosis
GRSEVRILFAFDPARQAIMLA

SEQ ID NO: 1496107 - protein, 18 aa, Mycobacterium tuberculosis
GRTDCKWGAYLDNVGDFD

SEQ ID NO: 1496108 - protein, 19 aa, Mycobacterium tuberculosis
GSTIFPFRRLFMVAEVGGA

SEQ ID NO: 1496109 - protein, 17 aa, Mycobacterium tuberculosis
GVLGRDCLLSWCMTSNQ

SEQ ID NO: 1496110 - protein, 23 aa, Mycobacterium tuberculosis
GVPMQRIRPSLDWLIKNVGPHAL

SEQ ID NO: 1496111 - protein, 17 aa, Mycobacterium tuberculosis
GWVGLPLAGVQTRLVDD

SEQ ID NO: 1496112 - protein, 18 aa, Mycobacterium tuberculosis
HFELRPGQALVITVPVSD

SEQ ID NO: 1496113 - protein, 17 aa, Mycobacterium tuberculosis
HPIRLARFGPRAALPAT

SEQ ID NO: 1496114 - protein, 17 aa, Mycobacterium tuberculosis
HRRFRFYLNVEIGKHLG

SEQ ID NO: 1496115 - protein, 17 aa, Mycobacterium tuberculosis
IAAGDLHFSIGYSEPGA

SEQ ID NO: 1496116 - protein, 18 aa, Mycobacterium tuberculosis
IAAVQGWCIGGAVDLISA

SEQ ID NO: 1496117 - protein, 27 aa, Mycobacterium tuberculosis
IALTFGVDIPIHIPINIDAGVVTLQGF

SEQ ID NO: 1496118 - protein, 23 aa, Mycobacterium tuberculosis
IARYNARCGRTFVLPNEQAAYDA

SEQ ID NO: 1496119 - protein, 22 aa, Mycobacterium tuberculosis
IASPPVKWPCFYGIDFPSPAEL

SEQ ID NO: 1496120 - protein, 20 aa, Mycobacterium tuberculosis
ICVSGPLLAGGYWNLPDETS

SEQ ID NO: 1496121 - protein, 19 aa, Mycobacterium tuberculosis
IGIVEGWRGTIVHRVEIDV

SEQ ID NO: 1496122 - protein, 18 aa, Mycobacterium tuberculosis
IPLIKIPAAPGFGNSTTS

SEQ ID NO: 1496123 - protein, 18 aa, Mycobacterium tuberculosis
ISGMNAVAGWRGAPRPVL

SEQ ID NO: 1496124 - protein, 22 aa, Mycobacterium tuberculosis
ITAPEGWAFEYSRFQEAQKREI

SEQ ID NO: 1496125 - protein, 18 aa, Mycobacterium tuberculosis
IVGNIPRGMFVGGRRGSS

SEQ ID NO: 1496126 - protein, 19 aa, Mycobacterium tuberculosis
KAATFLVEYARKYRQTIAA

SEQ ID NO: 1496127 - protein, 17 aa, Mycobacterium tuberculosis
KATIALLRRVEDVLDVE

SEQ ID NO: 1496128 - protein, 23 aa, Mycobacterium tuberculosis
KCYSLRIASAMAHDEGWLAEHML

SEQ ID NO: 1496129 - protein, 21 aa, Mycobacterium tuberculosis
KELPMEYALELNRLIELQMEG

SEQ ID NO: 1496130 - protein, 19 aa, Mycobacterium tuberculosis
KEPFSRWASLLIHAGEPGA

SEQ ID NO: 1496131 - protein, 20 aa, Mycobacterium tuberculosis
KKLPTLRGRTVVTMFYENST

SEQ ID NO: 1496132 - protein, 20 aa, Mycobacterium tuberculosis
KNEYPGKIFAILDSDHSMNH

SEQ ID NO: 1496133 - protein, 20 aa, Mycobacterium tuberculosis
KTSRDAWCYNFSRGALEANI

SEQ ID NO: 1496134 - protein, 17 aa, Mycobacterium tuberculosis
LACGAAYVIDREMGEYQ

SEQ ID NO: 1496135 - protein, 18 aa, Mycobacterium tuberculosis
LACGNAFVLKPSERDPSV

SEQ ID NO: 1496136 - protein, 23 aa, Mycobacterium tuberculosis
LALQFGWRLFAPMLRSATGIDEL

SEQ ID NO: 1496137 - protein, 17 aa, Mycobacterium tuberculosis
LDIGNALALGNVGGVNL

SEQ ID NO: 1496138 - protein, 24 aa, Mycobacterium tuberculosis
LDIYRIGQNVAWRRWTDIAFGLTS

SEQ ID NO: 1496139 - protein, 20 aa, Mycobacterium tuberculosis
LDVGCGWGGMVRYAARRGVR

SEQ ID NO: 1496140 - protein, 17 aa, Mycobacterium tuberculosis
LDYLAAKGWQPEGVSLA

SEQ ID NO: 1496141 - protein, 18 aa, Mycobacterium tuberculosis
LEHWRWMWDTNVLGTLRV

SEQ ID NO: 1496142 - protein, 19 aa, Mycobacterium tuberculosis
LGLNAPWIAAVESLYEEYW

SEQ ID NO: 1496143 - protein, 18 aa, Mycobacterium tuberculosis
LHCGPCGSGHFVKMVHNG

SEQ ID NO: 1496144 - protein, 19 aa, Mycobacterium tuberculosis
LHTPLPLLAFTAWPEVRSQ

SEQ ID NO: 1496145 - protein, 25 aa, Mycobacterium tuberculosis
LLKVRLRQGLPLARLGAAERERAEA

SEQ ID NO: 1496146 - protein, 19 aa, Mycobacterium tuberculosis
LLVRGGVVFSGYWRNEQAT

SEQ ID NO: 1496147 - protein, 17 aa, Mycobacterium tuberculosis
LPVALVWAYPTISDLAT

SEQ ID NO: 1496148 - protein, 20 aa, Mycobacterium tuberculosis
LRARGLKIFPLVGWAERGGY

SEQ ID NO: 1496149 - protein, 18 aa, Mycobacterium tuberculosis
LRPGAIIRDLNLLRPIYA

SEQ ID NO: 1496150 - protein, 18 aa, Mycobacterium tuberculosis
LSCGSALGFSLGRMALLV

SEQ ID NO: 1496151 - protein, 19 aa, Mycobacterium tuberculosis
LTRMQRFWISLYFPLTMRS

SEQ ID NO: 1496152 - protein, 18 aa, Mycobacterium tuberculosis
LVAPLTFLAIAGRRVQLE

SEQ ID NO: 1496153 - protein, 17 aa, Mycobacterium tuberculosis
LWPGMKIGQLCMLRLTS

SEQ ID NO: 1496154 - protein, 19 aa, Mycobacterium tuberculosis
MAAAATAWDGLAMELASAA

SEQ ID NO: 1496155 - protein, 17 aa, Mycobacterium tuberculosis
MNARGWKTKEPGIESIV

SEQ ID NO: 1496156 - protein, 18 aa, Mycobacterium tuberculosis
MRGGKFLNNWRMAELHAK

SEQ ID NO: 1496157 - protein, 17 aa, Mycobacterium tuberculosis
MRTVMCILNGQLRPVLV

SEQ ID NO: 1496158 - protein, 18 aa, Mycobacterium tuberculosis
MRVVHELSALPAEVEAAR

SEQ ID NO: 1496159 - protein, 20 aa, Mycobacterium tuberculosis
NIAPWLRAAHRYGAKVKWAE

SEQ ID NO: 1496160 - protein, 22 aa, Mycobacterium tuberculosis
NLPKGRLSDMVRRILRSMFAVG

SEQ ID NO: 1496161 - protein, 17 aa, Mycobacterium tuberculosis
NNTRFWAPLSLTAEQKH

SEQ ID NO: 1496162 - protein, 22 aa, Mycobacterium tuberculosis
NRKVLPGYILVRMDLTDDSWAA

SEQ ID NO: 1496163 - protein, 18 aa, Mycobacterium tuberculosis
PAWGMYCGYELFEHRAVR

SEQ ID NO: 1496164 - protein, 17 aa, Mycobacterium tuberculosis
PEHLHKVSLSFLVDDLV

SEQ ID NO: 1496165 - protein, 22 aa, Mycobacterium tuberculosis
PEIYRAPLSYPYRDGLLDKQLA

SEQ ID NO: 1496166 - protein, 22 aa, Mycobacterium tuberculosis
PFAPRCPLVIDECLTAEPELLD

SEQ ID NO: 1496167 - protein, 20 aa, Mycobacterium tuberculosis
PGAFCLTCGAPVREPTDIMR

SEQ ID NO: 1496168 - protein, 18 aa, Mycobacterium tuberculosis
PLELARTWVGLAGTMTTL

SEQ ID NO: 1496169 - protein, 18 aa, Mycobacterium tuberculosis
PREALALALDQERTVTDQ

SEQ ID NO: 1496170 - protein, 18 aa, Mycobacterium tuberculosis
PRGISFLLNRNRLNVAVS

SEQ ID NO: 1496171 - protein, 22 aa, Mycobacterium tuberculosis
PRKLLEEWLAMWSGHYQLKDKL

SEQ ID NO: 1496172 - protein, 24 aa, Mycobacterium tuberculosis
PTQVRWRPFEFWPANTAVNIDAAG

SEQ ID NO: 1496173 - protein, 17 aa, Mycobacterium tuberculosis
PVGRLSVPPSWAVAAPA

SEQ ID NO: 1496174 - protein, 17 aa, Mycobacterium tuberculosis
QHLDIGNALALGNVGGV

SEQ ID NO: 1496175 - protein, 22 aa, Mycobacterium tuberculosis
QIKLAVLVATNFFGINTIPIAI

SEQ ID NO: 1496176 - protein, 20 aa, Mycobacterium tuberculosis
QLFKQLLMVAGMERYYQIAR

SEQ ID NO: 1496177 - protein, 19 aa, Mycobacterium tuberculosis
QPDAVRHWNVDKADLDGLL

SEQ ID NO: 1496178 - protein, 17 aa, Mycobacterium tuberculosis
QRSWRMFAPFLRPVFSR

SEQ ID NO: 1496179 - protein, 20 aa, Mycobacterium tuberculosis
RAFDALAAWVRAAAAKNMVD

SEQ ID NO: 1496180 - protein, 20 aa, Mycobacterium tuberculosis
RAVLVLSDWPAPQAPQSASG

SEQ ID NO: 1496181 - protein, 21 aa, Mycobacterium tuberculosis
RCAAQSWPLDRVKAVKDAAGV

SEQ ID NO: 1496182 - protein, 20 aa, Mycobacterium tuberculosis
RCAVGIPTVSGWRMLSGDET

SEQ ID NO: 1496183 - protein, 20 aa, Mycobacterium tuberculosis
RERLGLPGLRDWLRRQAKAG

SEQ ID NO: 1496184 - protein, 18 aa, Mycobacterium tuberculosis
RGGALAPGTVRQWLAEHA

SEQ ID NO: 1496185 - protein, 19 aa, Mycobacterium tuberculosis
RGVLFPKHRTDLLGCAVSV

SEQ ID NO: 1496186 - protein, 20 aa, Mycobacterium tuberculosis
RHGLCGYRRFFSITSLAGLR

SEQ ID NO: 1496187 - protein, 17 aa, Mycobacterium tuberculosis
RLLFKDEVRAVGRELGL

SEQ ID NO: 1496188 - protein, 17 aa, Mycobacterium tuberculosis
RLLIEFCLLATQYDAIA

SEQ ID NO: 1496189 - protein, 21 aa, Mycobacterium tuberculosis
RPGGRLGLVWNTRDERLGWVR

SEQ ID NO: 1496190 - protein, 19 aa, Mycobacterium tuberculosis
RPRRAGVSSFGFGGTNAHV

SEQ ID NO: 1496191 - protein, 18 aa, Mycobacterium tuberculosis
RRAVELLDLVGISQPQRR

SEQ ID NO: 1496192 - protein, 17 aa, Mycobacterium tuberculosis
RRDLRMLAARLGSDVPF

SEQ ID NO: 1496193 - protein, 21 aa, Mycobacterium tuberculosis
RRVGRRFARLAPIVATHRKLT

SEQ ID NO: 1496194 - protein, 22 aa, Mycobacterium tuberculosis
RTNACDRRRFGLSLTIHEDACR

SEQ ID NO: 1496195 - protein, 19 aa, Mycobacterium tuberculosis
RTPESWLLIDFEGEPGQPL

SEQ ID NO: 1496196 - protein, 23 aa, Mycobacterium tuberculosis
RTRAIARLGSFFSDRRMAALRAA

SEQ ID NO: 1496197 - protein, 21 aa, Mycobacterium tuberculosis
RVKRPQIAIATWIVPSIVAFG

SEQ ID NO: 1496198 - protein, 19 aa, Mycobacterium tuberculosis
SAGRGRARIEFKLRDWLFA

SEQ ID NO: 1496199 - protein, 18 aa, Mycobacterium tuberculosis
SGPLRPAAAQVFAAVQAA

SEQ ID NO: 1496200 - protein, 23 aa, Mycobacterium tuberculosis
SLLGKPAVLWFWAPWCPTCQGEA

SEQ ID NO: 1496201 - protein, 18 aa, Mycobacterium tuberculosis
SLLRSCPRLTILTTSTEA

SEQ ID NO: 1496202 - protein, 18 aa, Mycobacterium tuberculosis
SMGGITIAAWSDRYRHKV

SEQ ID NO: 1496203 - protein, 19 aa, Mycobacterium tuberculosis
SSAAFQAAHARFVAAAAKV

SEQ ID NO: 1496204 - protein, 21 aa, Mycobacterium tuberculosis
SSSFRYAAPAGRNWTTADLAG

SEQ ID NO: 1496205 - protein, 18 aa, Mycobacterium tuberculosis
TDGRWDPGKDFAMVTARE

SEQ ID NO: 1496206 - protein, 17 aa, Mycobacterium tuberculosis
TDHLRLVGLHSHIGSQI

SEQ ID NO: 1496207 - protein, 22 aa, Mycobacterium tuberculosis
TETRLPFCWRGVSLHAGGAGRV

SEQ ID NO: 1496208 - protein, 21 aa, Mycobacterium tuberculosis
TGLRQRWALVGGFAVSARSEP

SEQ ID NO: 1496209 - protein, 18 aa, Mycobacterium tuberculosis
TGQLRARFAAGLSAMYAA

SEQ ID NO: 1496210 - protein, 26 aa, Mycobacterium tuberculosis
TGSAAFRIVVGSVRIPPVSVIVEQII

SEQ ID NO: 1496211 - protein, 26 aa, Mycobacterium tuberculosis
TIKRWFPGFMTFRFLECGLLTMVSNP

SEQ ID NO: 1496212 - protein, 24 aa, Mycobacterium tuberculosis
TIRLRKTVLCAAAHGLGRPPADVT

SEQ ID NO: 1496213 - protein, 21 aa, Mycobacterium tuberculosis
TISAFVVRISCHLRIQNQAAD

SEQ ID NO: 1496214 - protein, 18 aa, Mycobacterium tuberculosis
TMRNRLRLAATHAVRTSA

SEQ ID NO: 1496215 - protein, 20 aa, Mycobacterium tuberculosis
TPELCALSWMVYSLPGAPVL

SEQ ID NO: 1496216 - protein, 22 aa, Mycobacterium tuberculosis
TPEQWWPFIGNLSLDQSIAQGV

SEQ ID NO: 1496217 - protein, 23 aa, Mycobacterium tuberculosis
TPLPLALAKLFWTARFNTSQPCE

SEQ ID NO: 1496218 - protein, 19 aa, Mycobacterium tuberculosis
TRARLWPRSMTTLSTHDTK

SEQ ID NO: 1496219 - protein, 24 aa, Mycobacterium tuberculosis
TVGAFPFGFGWQQSPGFFNSTTTP

SEQ ID NO: 1496220 - protein, 26 aa, Mycobacterium tuberculosis
VALPNGRYGWRISLPAMVCYWSELAR

SEQ ID NO: 1496221 - protein, 21 aa, Mycobacterium tuberculosis
VGLPMRCVFALTAMGFLPQSA

SEQ ID NO: 1496222 - protein, 23 aa, Mycobacterium tuberculosis
VKANLFYRGLRFHRFPAVGDTLY

SEQ ID NO: 1496223 - protein, 23 aa, Mycobacterium tuberculosis
VKISLMRRIKQSFDPAGILNPGV

SEQ ID NO: 1496224 - protein, 18 aa, Mycobacterium tuberculosis
VMRAGLTWQQVVLLRAYA

SEQ ID NO: 1496225 - protein, 19 aa, Mycobacterium tuberculosis
VQVCSRLAATELYRRLREF

SEQ ID NO: 1496226 - protein, 18 aa, Mycobacterium tuberculosis
VRLAELFIEAGLPAGVFQ

SEQ ID NO: 1496227 - protein, 22 aa, Mycobacterium tuberculosis
VRLEGPAVFRWAAFKMGDVGRR

SEQ ID NO: 1496228 - protein, 18 aa, Mycobacterium tuberculosis
VVRLRFGLTDGQPRTLDE

SEQ ID NO: 1496229 - protein, 18 aa, Mycobacterium tuberculosis
VVVMPWDRHIAAGTEISL

SEQ ID NO: 1496230 - protein, 19 aa, Mycobacterium tuberculosis
WAGPPPQWWAQRFGIEPDL

SEQ ID NO: 1496231 - protein, 18 aa, Mycobacterium tuberculosis
WFRYAGGGKWNWQRDFFD

SEQ ID NO: 1496232 - protein, 17 aa, Mycobacterium tuberculosis
WPFAPAKHRAMLANLHP

SEQ ID NO: 1496233 - protein, 21 aa, Mycobacterium tuberculosis
WQGWEELFELARFVGVSRPGY

SEQ ID NO: 1496234 - protein, 17 aa, Mycobacterium tuberculosis
WRAARHWYRAGMHPAIQ

SEQ ID NO: 1496235 - protein, 18 aa, Mycobacterium tuberculosis
WRGERRFVERLSRATIDV

SEQ ID NO: 1496236 - protein, 19 aa, Mycobacterium tuberculosis
WRLLCEQVGAAALVIPEEL

SEQ ID NO: 1496237 - protein, 19 aa, Mycobacterium tuberculosis
WSDWLPRQRWYAGRNRELA

SEQ ID NO: 1496238 - protein, 17 aa, Mycobacterium tuberculosis
WVNTIFLSTRFRAWRVG

SEQ ID NO: 1496239 - protein, 25 aa, Mycobacterium tuberculosis
WVRDTLRLGGKFPLKAGMLTSLGFG

SEQ ID NO: 1496240 - protein, 17 aa, Mycobacterium tuberculosis
YAIWHCWQDGAAYHPAN

SEQ ID NO: 1496241 - protein, 21 aa, Mycobacterium tuberculosis
YDILFFWVARMMMFGTFVGDD

SEQ ID NO: 1496242 - protein, 19 aa, Mycobacterium tuberculosis
YELPTRVLLISAHDEPAIV

SEQ ID NO: 1496243 - protein, 17 aa, Mycobacterium tuberculosis
YHALKSVLKKEGLSTGL

SEQ ID NO: 1496244 - protein, 20 aa, Mycobacterium tuberculosis
YPQDRLDFILADCDAKLVLR

SEQ ID NO: 1496245 - protein, 17 aa, Mycobacterium tuberculosis
YRLLMSWGVRPGLVLGH

SEQ ID NO: 1496246 - protein, 17 aa, Mycobacterium tuberculosis
YRYLRALDTKHWDDFTD

SEQ ID NO: 1496247 - protein, 26 aa, Mycobacterium tuberculosis
YSNGFFWRGDYQGLIGLSTTITIPEI

SEQ ID NO: 1496248 - protein, 20 aa, Mycobacterium tuberculosis
YSNGLLWRGGYEGLVGVRVG

SEQ ID NO: 1496249 - protein, 17 aa, Mycobacterium tuberculosis
YVPKHWQKLCYLIGRPD

SEQ ID NO: 1496250 - protein, 19 aa, Mycobacterium tuberculosis
AAACLRKTDWLFPQYRELG

SEQ ID NO: 1496251 - protein, 17 aa, Mycobacterium tuberculosis
AALPDYPFAYLITVDDG

SEQ ID NO: 1496252 - protein, 17 aa, Mycobacterium tuberculosis
AEIPLLVVITEGIPVQD

SEQ ID NO: 1496253 - protein, 24 aa, Mycobacterium tuberculosis
AGDARPPFWQNLAELGWLGLHIDE

SEQ ID NO: 1496254 - protein, 17 aa, Mycobacterium tuberculosis
AGFDWVSWVTALGSAPD

SEQ ID NO: 1496255 - protein, 17 aa, Mycobacterium tuberculosis
AGMSLGIMADLAVGVHP

SEQ ID NO: 1496256 - protein, 19 aa, Mycobacterium tuberculosis
AHRPRPGYLPVLRAYDYAG

SEQ ID NO: 1496257 - protein, 17 aa, Mycobacterium tuberculosis
AKLFGPVDRDEWFMTPQ

SEQ ID NO: 1496258 - protein, 18 aa, Mycobacterium tuberculosis
AKQRGHRGLAYVLVAEDG

SEQ ID NO: 1496259 - protein, 23 aa, Mycobacterium tuberculosis
APERLRSGWLNGIKHWQVDYTGR

SEQ ID NO: 1496260 - protein, 17 aa, Mycobacterium tuberculosis
AQGGWLIGNGGQGGDSG

SEQ ID NO: 1496261 - protein, 27 aa, Mycobacterium tuberculosis
AQHPWPPRVATLPHWPLIYAGALEGLD

SEQ ID NO: 1496262 - protein, 18 aa, Mycobacterium tuberculosis
ARFSRPLAFGTAGLRGHL

SEQ ID NO: 1496263 - protein, 19 aa, Mycobacterium tuberculosis
ARGCAKWLASEDFSQAIDH

SEQ ID NO: 1496264 - protein, 17 aa, Mycobacterium tuberculosis
ARLKAVWAPQGLIHRGQ

SEQ ID NO: 1496265 - protein, 18 aa, Mycobacterium tuberculosis
ARLKVGIISAGRVGTALG

SEQ ID NO: 1496266 - protein, 17 aa, Mycobacterium tuberculosis
ASGELRATMALTEPGGG

SEQ ID NO: 1496267 - protein, 24 aa, Mycobacterium tuberculosis
AVARGDFRAALVVGDRLDTDIEGA

SEQ ID NO: 1496268 - protein, 20 aa, Mycobacterium tuberculosis
AVPAERLWVNPDCGLKTRNV

SEQ ID NO: 1496269 - protein, 20 aa, Mycobacterium tuberculosis
AYLARAGLRVRLLERLAQTG

SEQ ID NO: 1496270 - protein, 18 aa, Mycobacterium tuberculosis
AYRLNWPAGTVVYEIDQP

SEQ ID NO: 1496271 - protein, 19 aa, Mycobacterium tuberculosis
CAECHLDAPMVNRALAGAP

SEQ ID NO: 1496272 - protein, 18 aa, Mycobacterium tuberculosis
CREYRITPVFVEVREGQS

SEQ ID NO: 1496273 - protein, 17 aa, Mycobacterium tuberculosis
CRPSCPVRPPFARNVRF

SEQ ID NO: 1496274 - protein, 17 aa, Mycobacterium tuberculosis
CSAFEAWFVSAALDDAA

SEQ ID NO: 1496275 - protein, 18 aa, Mycobacterium tuberculosis
CVDLLKPRKAQPLLPGIG

SEQ ID NO: 1496276 - protein, 19 aa, Mycobacterium tuberculosis
CVIATEFELVMPFVERAQS

SEQ ID NO: 1496277 - protein, 24 aa, Mycobacterium tuberculosis
DHCLDLPGLFVWRRYHPSRPSGKA

SEQ ID NO: 1496278 - protein, 23 aa, Mycobacterium tuberculosis
DPLLPEVAWSWLVDALTARTDQV

SEQ ID NO: 1496279 - protein, 21 aa, Mycobacterium tuberculosis
DRLRRWMAVAARIELRTGGAY

SEQ ID NO: 1496280 - protein, 19 aa, Mycobacterium tuberculosis
DRVLLRFGLHQALRLGKPL

SEQ ID NO: 1496281 - protein, 19 aa, Mycobacterium tuberculosis
DRWSRGRVALVGDAGYCCS

SEQ ID NO: 1496282 - protein, 18 aa, Mycobacterium tuberculosis
DTPDGVWSRMKFEGGVHR

SEQ ID NO: 1496283 - protein, 18 aa, Mycobacterium tuberculosis
EAFRLLGHVDVVFSNAGI

SEQ ID NO: 1496284 - protein, 19 aa, Mycobacterium tuberculosis
EAGMKLGWHPYHFPDEPDS

SEQ ID NO: 1496285 - protein, 19 aa, Mycobacterium tuberculosis
EAICPWCIADGSAASRFDA

SEQ ID NO: 1496286 - protein, 17 aa, Mycobacterium tuberculosis
EALGEGWFWPAAAAHPS

SEQ ID NO: 1496287 - protein, 18 aa, Mycobacterium tuberculosis
EHPSVCLLASWVPPDTPA

SEQ ID NO: 1496288 - protein, 23 aa, Mycobacterium tuberculosis
EIDNLRAAFAWSRENGHITEALQ

SEQ ID NO: 1496289 - protein, 17 aa, Mycobacterium tuberculosis
EIREFLEGYVIGQDTAK

SEQ ID NO: 1496290 - protein, 19 aa, Mycobacterium tuberculosis
EISARILMKLKRDAEAYLG

SEQ ID NO: 1496291 - protein, 18 aa, Mycobacterium tuberculosis
ETLWRMSVSIAGAVCTAA

SEQ ID NO: 1496292 - protein, 25 aa, Mycobacterium tuberculosis
EWCVISIRSDDEWRRATSVFGQPEL

SEQ ID NO: 1496293 - protein, 17 aa, Mycobacterium tuberculosis
FALPDCAGHPTWYEPSE

SEQ ID NO: 1496294 - protein, 17 aa, Mycobacterium tuberculosis
FEPGEFVALLGQSGSGK

SEQ ID NO: 1496295 - protein, 19 aa, Mycobacterium tuberculosis
FIRKPARWMQLLAKHQAPF

SEQ ID NO: 1496296 - protein, 18 aa, Mycobacterium tuberculosis
FLWMWPNARISVMGGEQA

SEQ ID NO: 1496297 - protein, 19 aa, Mycobacterium tuberculosis
FQVSAEWSWLVLVGAVVGD

SEQ ID NO: 1496298 - protein, 17 aa, Mycobacterium tuberculosis
FRILPTLWEPGGDEITL

SEQ ID NO: 1496299 - protein, 18 aa, Mycobacterium tuberculosis
GAALPFKRRLFGQIVAAA

SEQ ID NO: 1496300 - protein, 22 aa, Mycobacterium tuberculosis
GAELLVEIARFWVGLAKLDDSR

SEQ ID NO: 1496301 - protein, 22 aa, Mycobacterium tuberculosis
GERLAVGVPKAFYQLDGQTLIE

SEQ ID NO: 1496302 - protein, 17 aa, Mycobacterium tuberculosis
GEVKDVLLLDVTPLSLG

SEQ ID NO: 1496303 - protein, 18 aa, Mycobacterium tuberculosis
GGARGLAHFGVYQELTEA

SEQ ID NO: 1496304 - protein, 21 aa, Mycobacterium tuberculosis
GIHVFLRIATDWDFVEVRRAG

SEQ ID NO: 1496305 - protein, 20 aa, Mycobacterium tuberculosis
GIKVARRLLANVAHVAVFDT

SEQ ID NO: 1496306 - protein, 25 aa, Mycobacterium tuberculosis
GILWRGDYQGLAGFAVGYTLPLFPA

SEQ ID NO: 1496307 - protein, 27 aa, Mycobacterium tuberculosis
GLADAAWRGPAAVAMARAVAPYLGWLI

SEQ ID NO: 1496308 - protein, 23 aa, Mycobacterium tuberculosis
GLAGRWLRPGGLFAVEHDDTTSS

SEQ ID NO: 1496309 - protein, 18 aa, Mycobacterium tuberculosis
GMPWIVVVGRGWADGVVE

SEQ ID NO: 1496310 - protein, 17 aa, Mycobacterium tuberculosis
GNTGNWNIGIGITGNGQ

SEQ ID NO: 1496311 - protein, 23 aa, Mycobacterium tuberculosis
GPSIACSRWGMLSPEGRCKTFDA

SEQ ID NO: 1496312 - protein, 18 aa, Mycobacterium tuberculosis
GRVKQLLLKIGWPAEDLA

SEQ ID NO: 1496313 - protein, 17 aa, Mycobacterium tuberculosis
GSFYLRPIVRPVILVAG

SEQ ID NO: 1496314 - protein, 17 aa, Mycobacterium tuberculosis
GSTHAFGGMPLMGSGAG

SEQ ID NO: 1496315 - protein, 25 aa, Mycobacterium tuberculosis
GSVLSGLAALHWRGPAAESMAVTAA

SEQ ID NO: 1496316 - protein, 19 aa, Mycobacterium tuberculosis
GVERTWLDGWLLRAGHGAV

SEQ ID NO: 1496317 - protein, 18 aa, Mycobacterium tuberculosis
GVGHPFWFSRTVFGELAR

SEQ ID NO: 1496318 - protein, 23 aa, Mycobacterium tuberculosis
HIESRPAVTLSWIREFPSLGAAA

SEQ ID NO: 1496319 - protein, 17 aa, Mycobacterium tuberculosis
HILIDLPAVPGFGNTTG

SEQ ID NO: 1496320 - protein, 20 aa, Mycobacterium tuberculosis
HSPKRLESELTWIEEHTGGK

SEQ ID NO: 1496321 - protein, 19 aa, Mycobacterium tuberculosis
IEKMRVAGRIAAGALAEAG

SEQ ID NO: 1496322 - protein, 24 aa, Mycobacterium tuberculosis
IGGGMCFTFLAAQGFSVGTSLLED

SEQ ID NO: 1496323 - protein, 18 aa, Mycobacterium tuberculosis
IKLGPSLWHRDFHDAVIV

SEQ ID NO: 1496324 - protein, 18 aa, Mycobacterium tuberculosis
IQREWQWRLSRGESLQNL

SEQ ID NO: 1496325 - protein, 19 aa, Mycobacterium tuberculosis
IREELKFSGDRAMAAEDPE

SEQ ID NO: 1496326 - protein, 17 aa, Mycobacterium tuberculosis
ISRAGWSGVRWRNLTGG

SEQ ID NO: 1496327 - protein, 19 aa, Mycobacterium tuberculosis
ISRALTLLAELWSRYHNVL

SEQ ID NO: 1496328 - protein, 19 aa, Mycobacterium tuberculosis
IVMPARLPNRIHPFVQEIV

SEQ ID NO: 1496329 - protein, 19 aa, Mycobacterium tuberculosis
KDLQDIIAILGIDELSEED

SEQ ID NO: 1496330 - protein, 18 aa, Mycobacterium tuberculosis
KIRRAQCVQLYRRREFTR

SEQ ID NO: 1496331 - protein, 20 aa, Mycobacterium tuberculosis
KRAFSEPVALNWAADGTDVD

SEQ ID NO: 1496332 - protein, 18 aa, Mycobacterium tuberculosis
LAAWRLGAGRSRPGARVQ

SEQ ID NO: 1496333 - protein, 17 aa, Mycobacterium tuberculosis
LAGMFTLRFDQFAHTLL

SEQ ID NO: 1496334 - protein, 17 aa, Mycobacterium tuberculosis
LAGNGLRYNRFHTTALC

SEQ ID NO: 1496335 - protein, 17 aa, Mycobacterium tuberculosis
LDGARILAGRLTQPDVA

SEQ ID NO: 1496336 - protein, 17 aa, Mycobacterium tuberculosis
LDLLPRLLFRNGELDIS

SEQ ID NO: 1496337 - protein, 19 aa, Mycobacterium tuberculosis
LDPKIGLPDIRAVLTAVVN

SEQ ID NO: 1496338 - protein, 21 aa, Mycobacterium tuberculosis
LEFTEGIGFDKGFLSAYFVTD

SEQ ID NO: 1496339 - protein, 17 aa, Mycobacterium tuberculosis
LESELTWIEEHTGGKPY

SEQ ID NO: 1496340 - protein, 21 aa, Mycobacterium tuberculosis
LEVEEVYLPLARLIHLQVAAR

SEQ ID NO: 1496341 - protein, 17 aa, Mycobacterium tuberculosis
LFRAIALALERPLDPDR

SEQ ID NO: 1496342 - protein, 18 aa, Mycobacterium tuberculosis
LGSYRWLRPSGRRTAKEI

SEQ ID NO: 1496343 - protein, 18 aa, Mycobacterium tuberculosis
LLELSWEALERAGIDPTG

SEQ ID NO: 1496344 - protein, 18 aa, Mycobacterium tuberculosis
LLKIWNERNYRFWADLTE

SEQ ID NO: 1496345 - protein, 20 aa, Mycobacterium tuberculosis
LLRSDILPISFGFPFGFSAA

SEQ ID NO: 1496346 - protein, 18 aa, Mycobacterium tuberculosis
LLYRLERPLLFALQCMPL

SEQ ID NO: 1496347 - protein, 29 aa, Mycobacterium tuberculosis
LNFFPMGAWAKRTGAIFIRRQTKDIPVYR

SEQ ID NO: 1496348 - protein, 22 aa, Mycobacterium tuberculosis
LNLKEWKAEWGVADPREARGAL

SEQ ID NO: 1496349 - protein, 17 aa, Mycobacterium tuberculosis
LPAMVCYWSELARDIVL

SEQ ID NO: 1496350 - protein, 17 aa, Mycobacterium tuberculosis
LPSAIYHRFGRVHTYAK

SEQ ID NO: 1496351 - protein, 17 aa, Mycobacterium tuberculosis
LQSVLYLRFREWFLPAM

SEQ ID NO: 1496352 - protein, 19 aa, Mycobacterium tuberculosis
LRDLLKFEFLFSGRAQFEK

SEQ ID NO: 1496353 - protein, 17 aa, Mycobacterium tuberculosis
LRLPETVGWDYGSISGL

SEQ ID NO: 1496354 - protein, 20 aa, Mycobacterium tuberculosis
LRPDFPRPALLSGAGDAVEF

SEQ ID NO: 1496355 - protein, 18 aa, Mycobacterium tuberculosis
LSGGHLFSIYDGCREEGI

SEQ ID NO: 1496356 - protein, 17 aa, Mycobacterium tuberculosis
LSPAPALLALPAAESAW

SEQ ID NO: 1496357 - protein, 17 aa, Mycobacterium tuberculosis
LTELALGLGRQFVAQGR

SEQ ID NO: 1496358 - protein, 20 aa, Mycobacterium tuberculosis
LVFGRRAGLGAADYVRALSS

SEQ ID NO: 1496359 - protein, 17 aa, Mycobacterium tuberculosis
LVNGWAAGGGHSLHVVC

SEQ ID NO: 1496360 - protein, 17 aa, Mycobacterium tuberculosis
LVSFGSGAHFCLGAHLA

SEQ ID NO: 1496361 - protein, 25 aa, Mycobacterium tuberculosis
LVSHYDVYPAFGFRFDLKKSGVSVT

SEQ ID NO: 1496362 - protein, 17 aa, Mycobacterium tuberculosis
LWEVWVIEGLADSKWAI

SEQ ID NO: 1496363 - protein, 23 aa, Mycobacterium tuberculosis
LWYCGPWTLWVMAGRGVASGAGV

SEQ ID NO: 1496364 - protein, 18 aa, Mycobacterium tuberculosis
MTVALLLAVARHLIPADA

SEQ ID NO: 1496365 - protein, 17 aa, Mycobacterium tuberculosis
NEAFAPVVMAWLKEIKA

SEQ ID NO: 1496366 - protein, 17 aa, Mycobacterium tuberculosis
NGLRPEIWDEFTTRFGV

SEQ ID NO: 1496367 - protein, 27 aa, Mycobacterium tuberculosis
NRRPTGQRGFFCWFRVGSDVLVDNAFR

SEQ ID NO: 1496368 - protein, 17 aa, Mycobacterium tuberculosis
NTFYGMARWQASLEKKQ

SEQ ID NO: 1496369 - protein, 17 aa, Mycobacterium tuberculosis
PCWLVGLLFPSADGCAG

SEQ ID NO: 1496370 - protein, 23 aa, Mycobacterium tuberculosis
PGELRFGPLQARDELAACEILAD

SEQ ID NO: 1496371 - protein, 17 aa, Mycobacterium tuberculosis
PGQLVLIHGGASGIGSH

SEQ ID NO: 1496372 - protein, 23 aa, Mycobacterium tuberculosis
PISRIPLTINIRIPVNITLNELP

SEQ ID NO: 1496373 - protein, 19 aa, Mycobacterium tuberculosis
PKAGPLIAVKLHILTRKTL

SEQ ID NO: 1496374 - protein, 20 aa, Mycobacterium tuberculosis
PKMRISGPAVRWVMTGWQRL

SEQ ID NO: 1496375 - protein, 17 aa, Mycobacterium tuberculosis
PLSAYLFTKSRAVRERV

SEQ ID NO: 1496376 - protein, 18 aa, Mycobacterium tuberculosis
PSHEKLAWARRVLAASRS

SEQ ID NO: 1496377 - protein, 17 aa, Mycobacterium tuberculosis
PTGEWSAAVSRLAAAEA

SEQ ID NO: 1496378 - protein, 19 aa, Mycobacterium tuberculosis
PTWQWESLISKSTRLVAVN

SEQ ID NO: 1496379 - protein, 18 aa, Mycobacterium tuberculosis
PYGGVWLHSWLDRDLGIS

SEQ ID NO: 1496380 - protein, 20 aa, Mycobacterium tuberculosis
PYPSLKRMNPWKRFFHNQTK

SEQ ID NO: 1496381 - protein, 22 aa, Mycobacterium tuberculosis
QCRDLLHWRFCRGVPPRATNDT

SEQ ID NO: 1496382 - protein, 24 aa, Mycobacterium tuberculosis
QEVRWCPGCGDYVILNTIRNFLPE

SEQ ID NO: 1496383 - protein, 18 aa, Mycobacterium tuberculosis
QFARVHLDACDRWSVGLS

SEQ ID NO: 1496384 - protein, 23 aa, Mycobacterium tuberculosis
QQYDAVWRWIDWPERRGRTDTGI

SEQ ID NO: 1496385 - protein, 18 aa, Mycobacterium tuberculosis
QTGFARTGAMFACEHEGP

SEQ ID NO: 1496386 - protein, 17 aa, Mycobacterium tuberculosis
RAAELLEQFSLVHAGKR

SEQ ID NO: 1496387 - protein, 20 aa, Mycobacterium tuberculosis
RAIWRINELLNWQVASAGED

SEQ ID NO: 1496388 - protein, 17 aa, Mycobacterium tuberculosis
RALELGCGTGFFLLNLI

SEQ ID NO: 1496389 - protein, 24 aa, Mycobacterium tuberculosis
RANAEALVPITALLPAGADDVSAA

SEQ ID NO: 1496390 - protein, 19 aa, Mycobacterium tuberculosis
RCGWFDAVIARYAARVNGI

SEQ ID NO: 1496391 - protein, 19 aa, Mycobacterium tuberculosis
RDSEGWIYLAGRTADWMRV

SEQ ID NO: 1496392 - protein, 26 aa, Mycobacterium tuberculosis
REWLTQWSRPGLIPVALVVVNVFVEN

SEQ ID NO: 1496393 - protein, 17 aa, Mycobacterium tuberculosis
RHILDVKTAIAWARANV

SEQ ID NO: 1496394 - protein, 18 aa, Mycobacterium tuberculosis
RLRAVLVPHALRLREAAL

SEQ ID NO: 1496395 - protein, 21 aa, Mycobacterium tuberculosis
RLRPAMLEFMDSVAINAVEDT

SEQ ID NO: 1496396 - protein, 17 aa, Mycobacterium tuberculosis
RPGEFVFVLGYLGHVRA

SEQ ID NO: 1496397 - protein, 20 aa, Mycobacterium tuberculosis
RPTELCFVPRIWDMVFAEFH

SEQ ID NO: 1496398 - protein, 17 aa, Mycobacterium tuberculosis
RRADIAIVFAIRAEGEG

SEQ ID NO: 1496399 - protein, 17 aa, Mycobacterium tuberculosis
RRAKLYYLRELRGKKAK

SEQ ID NO: 1496400 - protein, 18 aa, Mycobacterium tuberculosis
RRDMGVGELLGMVQAGLN

SEQ ID NO: 1496401 - protein, 25 aa, Mycobacterium tuberculosis
RTGEEFSWRAAELFDAIGSEAITVA

SEQ ID NO: 1496402 - protein, 18 aa, Mycobacterium tuberculosis
RWASLLIHAGEPGAGTRM

SEQ ID NO: 1496403 - protein, 26 aa, Mycobacterium tuberculosis
RWAYYPWRRMVVAILGLRGFRAVRLD

SEQ ID NO: 1496404 - protein, 17 aa, Mycobacterium tuberculosis
RYLKVPCVIEFWDENGG

SEQ ID NO: 1496405 - protein, 20 aa, Mycobacterium tuberculosis
SCAIQNLWLAARSEGLGMGW

SEQ ID NO: 1496406 - protein, 21 aa, Mycobacterium tuberculosis
SDFIICYRLSMADYVAEGQSW

SEQ ID NO: 1496407 - protein, 17 aa, Mycobacterium tuberculosis
SDIRAGAGLVLAGLVAD

SEQ ID NO: 1496408 - protein, 27 aa, Mycobacterium tuberculosis
SGFERFPAWMWRNTVVRDFVEWLRTRN

SEQ ID NO: 1496409 - protein, 20 aa, Mycobacterium tuberculosis
SHAWVQAWTGGWWHYDPTND

SEQ ID NO: 1496410 - protein, 19 aa, Mycobacterium tuberculosis
SQANFVWLPLGSRTQDFVE

SEQ ID NO: 1496411 - protein, 17 aa, Mycobacterium tuberculosis
SQLRTALRMQISAGYTV

SEQ ID NO: 1496412 - protein, 18 aa, Mycobacterium tuberculosis
SRRFGVQVEDGFGSTENA

SEQ ID NO: 1496413 - protein, 17 aa, Mycobacterium tuberculosis
SSIWYRIRINLQHVPAD

SEQ ID NO: 1496414 - protein, 18 aa, Mycobacterium tuberculosis
SVDCARYWLDADKPISKS

SEQ ID NO: 1496415 - protein, 22 aa, Mycobacterium tuberculosis
SWEPFTRMAFRFNECSTRAVGA

SEQ ID NO: 1496416 - protein, 18 aa, Mycobacterium tuberculosis
TARSWAWLSGRDYVTPDD

SEQ ID NO: 1496417 - protein, 20 aa, Mycobacterium tuberculosis
TDLAWSRITYWRALLTSAVD

SEQ ID NO: 1496418 - protein, 19 aa, Mycobacterium tuberculosis
TGELIPLCHPLGIEAVTVT

SEQ ID NO: 1496419 - protein, 17 aa, Mycobacterium tuberculosis
THITRWAGCIGNRSTVI

SEQ ID NO: 1496420 - protein, 20 aa, Mycobacterium tuberculosis
TRLGALAARLWLPLLAAEGS

SEQ ID NO: 1496421 - protein, 21 aa, Mycobacterium tuberculosis
TVIDPRWVLPVSDGVRELAVQ

SEQ ID NO: 1496422 - protein, 23 aa, Mycobacterium tuberculosis
VDLRDDWPAALIAAGFDGTQPTA

SEQ ID NO: 1496423 - protein, 17 aa, Mycobacterium tuberculosis
VGACSRGLMSRADVDAI

SEQ ID NO: 1496424 - protein, 25 aa, Mycobacterium tuberculosis
VGDKWRLAEVLAWQAYVGFAGEGDP

SEQ ID NO: 1496425 - protein, 24 aa, Mycobacterium tuberculosis
VHLLECGLLRGWLIPPADIKAARD

SEQ ID NO: 1496426 - protein, 17 aa, Mycobacterium tuberculosis
VMPWNFPLWQAVRFAAP

SEQ ID NO: 1496427 - protein, 19 aa, Mycobacterium tuberculosis
VPLILRLDPKIGLPDIRAV

SEQ ID NO: 1496428 - protein, 20 aa, Mycobacterium tuberculosis
VRYRVGELIPVYRSQRALLQ

SEQ ID NO: 1496429 - protein, 22 aa, Mycobacterium tuberculosis
VSPSLRFGLAFCEASGPRLVRH

SEQ ID NO: 1496430 - protein, 19 aa, Mycobacterium tuberculosis
WATWCGPCKMVAPVLEEIA

SEQ ID NO: 1496431 - protein, 19 aa, Mycobacterium tuberculosis
WEDKRLGIIIAGFDRRRIP

SEQ ID NO: 1496432 - protein, 23 aa, Mycobacterium tuberculosis
WKDGEALFLRCNIWREAAENVAE

SEQ ID NO: 1496433 - protein, 17 aa, Mycobacterium tuberculosis
YDLPTLWQIAAHNPWLS

SEQ ID NO: 1496434 - protein, 17 aa, Mycobacterium tuberculosis
YERKEIRDIVAYLRVLD

SEQ ID NO: 1496435 - protein, 19 aa, Mycobacterium tuberculosis
YRGAMGLNWYLTDPTLQFI

SEQ ID NO: 1496436 - protein, 17 aa, Mycobacterium tuberculosis
YRITPVFVEVREGQSTR

SEQ ID NO: 1496437 - protein, 17 aa, Mycobacterium tuberculosis
YRLAPRYRFPTAATDVR

SEQ ID NO: 1496438 - protein, 18 aa, Mycobacterium tuberculosis
YTGLKLGGVYGFYPRFTG

SEQ ID NO: 1496439 - protein, 19 aa, Mycobacterium tuberculosis
AAALARQGSFLGYRVTVCD

SEQ ID NO: 1496440 - protein, 18 aa, Mycobacterium tuberculosis
AAPSWRKGPRHIAGRGPR

SEQ ID NO: 1496441 - protein, 17 aa, Mycobacterium tuberculosis
AEEAWPKIEIADVDSTG

SEQ ID NO: 1496442 - protein, 24 aa, Mycobacterium tuberculosis
AEVWRRGSVIGSWLLDLTAIALRE

SEQ ID NO: 1496443 - protein, 19 aa, Mycobacterium tuberculosis
AGGFTLDGLGGWFIDGVQG

SEQ ID NO: 1496444 - protein, 24 aa, Mycobacterium tuberculosis
AGHYTLRAAIDWQQHKPNGSHVVN

SEQ ID NO: 1496445 - protein, 23 aa, Mycobacterium tuberculosis
AIKRVLPGLGYRLTSRGVRVATS

SEQ ID NO: 1496446 - protein, 17 aa, Mycobacterium tuberculosis
ALGPKLPELWGGSADLA

SEQ ID NO: 1496447 - protein, 18 aa, Mycobacterium tuberculosis
ANMWALRALGVRRVFGPC

SEQ ID NO: 1496448 - protein, 17 aa, Mycobacterium tuberculosis
APGGFNFDAWRFENRCE

SEQ ID NO: 1496449 - protein, 18 aa, Mycobacterium tuberculosis
APLPAFWVNIARKKILHA

SEQ ID NO: 1496450 - protein, 25 aa, Mycobacterium tuberculosis
APSRSLPLLECWTALAALSRDTTKL

SEQ ID NO: 1496451 - protein, 20 aa, Mycobacterium tuberculosis
APSSGIGIVEGWRGTIVHRV

SEQ ID NO: 1496452 - protein, 18 aa, Mycobacterium tuberculosis
ARCALAWSVQTAALAREH

SEQ ID NO: 1496453 - protein, 19 aa, Mycobacterium tuberculosis
ARFLSVVLRRIRGMRSDTR

SEQ ID NO: 1496454 - protein, 17 aa, Mycobacterium tuberculosis
ARLADRLAVNRGLAPVA

SEQ ID NO: 1496455 - protein, 17 aa, Mycobacterium tuberculosis
ARLSVVVAESWRASALA

SEQ ID NO: 1496456 - protein, 18 aa, Mycobacterium tuberculosis
ARVLLVWDAPNLDMGLGS

SEQ ID NO: 1496457 - protein, 20 aa, Mycobacterium tuberculosis
ARVSRRLVAMLARRGYGQTL

SEQ ID NO: 1496458 - protein, 17 aa, Mycobacterium tuberculosis
ASAGWCVSIAITSALLV

SEQ ID NO: 1496459 - protein, 17 aa, Mycobacterium tuberculosis
ASYRMEQGFTFELNLAG

SEQ ID NO: 1496460 - protein, 19 aa, Mycobacterium tuberculosis
ATYRLVKRSGFVASSTYAD

SEQ ID NO: 1496461 - protein, 19 aa, Mycobacterium tuberculosis
AVAGWRGAPRPVLARELLP

SEQ ID NO: 1496462 - protein, 17 aa, Mycobacterium tuberculosis
AVHQCQWPKAVWAVIDN

SEQ ID NO: 1496463 - protein, 23 aa, Mycobacterium tuberculosis
AVYRLAWAALRGCPTSSVRTAFY

SEQ ID NO: 1496464 - protein, 20 aa, Mycobacterium tuberculosis
AWEYDWPASRWRQHLNAQLE

SEQ ID NO: 1496465 - protein, 20 aa, Mycobacterium tuberculosis
DCELDWWLGFSSAASLLGSP

SEQ ID NO: 1496466 - protein, 17 aa, Mycobacterium tuberculosis
DDVLPAIAFAVAHTGKP

SEQ ID NO: 1496467 - protein, 17 aa, Mycobacterium tuberculosis
DGESYNRSWNCGVEGPT

SEQ ID NO: 1496468 - protein, 17 aa, Mycobacterium tuberculosis
DGIGLDEYVDWLIEAGY

SEQ ID NO: 1496469 - protein, 18 aa, Mycobacterium tuberculosis
DRVGIAWLRHTCGVCKYC

SEQ ID NO: 1496470 - protein, 19 aa, Mycobacterium tuberculosis
EALTSLPGVGVWTAAETTQ

SEQ ID NO: 1496471 - protein, 19 aa, Mycobacterium tuberculosis
EDFVGALIYLLSDASSFYT

SEQ ID NO: 1496472 - protein, 17 aa, Mycobacterium tuberculosis
EFAHVFSALGVRVTLVI

SEQ ID NO: 1496473 - protein, 20 aa, Mycobacterium tuberculosis
ELGQPLPLFIKWDDADYGLR

SEQ ID NO: 1496474 - protein, 20 aa, Mycobacterium tuberculosis
ELMPLPIALAHRLSRRLTEV

SEQ ID NO: 1496475 - protein, 27 aa, Mycobacterium tuberculosis
EPGETRFALVLSRLFWDAAIFHRACEA

SEQ ID NO: 1496476 - protein, 21 aa, Mycobacterium tuberculosis
ESFGFKYGLPMDADMVMDVRF

SEQ ID NO: 1496477 - protein, 21 aa, Mycobacterium tuberculosis
EVSARAGVEVTVFEPAEALIT

SEQ ID NO: 1496478 - protein, 17 aa, Mycobacterium tuberculosis
FAFSLVYEVSFGTPGEE

SEQ ID NO: 1496479 - protein, 17 aa, Mycobacterium tuberculosis
FDLCIEAMGAIDTQQRL

SEQ ID NO: 1496480 - protein, 18 aa, Mycobacterium tuberculosis
FLPRPLRWLAGATRSAVL

SEQ ID NO: 1496481 - protein, 18 aa, Mycobacterium tuberculosis
GALIGFLGPRVYELLYGD

SEQ ID NO: 1496482 - protein, 22 aa, Mycobacterium tuberculosis
GERFVLGVGFGWNVEELADHGV

SEQ ID NO: 1496483 - protein, 24 aa, Mycobacterium tuberculosis
GGVLKPILWCPGKATAVQRFAAEH

SEQ ID NO: 1496484 - protein, 18 aa, Mycobacterium tuberculosis
GLRRCLRPRPAVATELDL

SEQ ID NO: 1496485 - protein, 19 aa, Mycobacterium tuberculosis
GTLGTFTVHGFRFPEITGD

SEQ ID NO: 1496486 - protein, 18 aa, Mycobacterium tuberculosis
GTTQRFGVPMGFGGPHAG

SEQ ID NO: 1496487 - protein, 17 aa, Mycobacterium tuberculosis
GVFCRRWGVPLIDGGTV

SEQ ID NO: 1496488 - protein, 18 aa, Mycobacterium tuberculosis
GVMWKRFSETGAIKAKSV

SEQ ID NO: 1496489 - protein, 19 aa, Mycobacterium tuberculosis
GWLAFTFELCRQRIMDPST

SEQ ID NO: 1496490 - protein, 17 aa, Mycobacterium tuberculosis
HRRVPDRYPEVIVQAVS

SEQ ID NO: 1496491 - protein, 19 aa, Mycobacterium tuberculosis
HSLARLAIRDDIYGALRSL

SEQ ID NO: 1496492 - protein, 17 aa, Mycobacterium tuberculosis
IGLDEYVDWLIEAGYPI

SEQ ID NO: 1496493 - protein, 18 aa, Mycobacterium tuberculosis
IRAGAGLVLAGLVADGDT

SEQ ID NO: 1496494 - protein, 20 aa, Mycobacterium tuberculosis
IWWQRAVAVWPDYASYQTKT

SEQ ID NO: 1496495 - protein, 20 aa, Mycobacterium tuberculosis
KESLRLLAHEVMPRLNARLA

SEQ ID NO: 1496496 - protein, 22 aa, Mycobacterium tuberculosis
KGKRYALPHARILMHQPLGGVT

SEQ ID NO: 1496497 - protein, 25 aa, Mycobacterium tuberculosis
KKFRFPTFLGAFKYYTSYTLKTFDG

SEQ ID NO: 1496498 - protein, 21 aa, Mycobacterium tuberculosis
KKLSGLRARNGLLTASGDNAS

SEQ ID NO: 1496499 - protein, 23 aa, Mycobacterium tuberculosis
KLQKRLTEELAWVRSGAKARQAK

SEQ ID NO: 1496500 - protein, 24 aa, Mycobacterium tuberculosis
KPQRGRISTWPLPEAFNGVTVNGV

SEQ ID NO: 1496501 - protein, 17 aa, Mycobacterium tuberculosis
LCPGSRNAPLAFALQDA

SEQ ID NO: 1496502 - protein, 17 aa, Mycobacterium tuberculosis
LDMLRWHGAEEVEHKAV

SEQ ID NO: 1496503 - protein, 24 aa, Mycobacterium tuberculosis
LERIGLRFVLEIRVPAGVDGRITW

SEQ ID NO: 1496504 - protein, 23 aa, Mycobacterium tuberculosis
LFSMPIHQVMVMPGSVMTIPGMR

SEQ ID NO: 1496505 - protein, 20 aa, Mycobacterium tuberculosis
LGAPGARVLLVWDAPNLDMG

SEQ ID NO: 1496506 - protein, 17 aa, Mycobacterium tuberculosis
LGNLIPEWNDLVRRGRW

SEQ ID NO: 1496507 - protein, 22 aa, Mycobacterium tuberculosis
LGSRSALGWIIDRYRVTTDKAS

SEQ ID NO: 1496508 - protein, 19 aa, Mycobacterium tuberculosis
LHCAAMSFGSVTSGLVVGW

SEQ ID NO: 1496509 - protein, 18 aa, Mycobacterium tuberculosis
LLDVNISGGLPAFTLFAG

SEQ ID NO: 1496510 - protein, 17 aa, Mycobacterium tuberculosis
LLNGFKWFASNCAGEAF

SEQ ID NO: 1496511 - protein, 18 aa, Mycobacterium tuberculosis
LPTAVRWAMRIPGGKAVH

SEQ ID NO: 1496512 - protein, 18 aa, Mycobacterium tuberculosis
LPTVRGAFCLTFMDENTL

SEQ ID NO: 1496513 - protein, 17 aa, Mycobacterium tuberculosis
LRLPIYIGDDLTDEDAF

SEQ ID NO: 1496514 - protein, 22 aa, Mycobacterium tuberculosis
LSGDYQGLVGLNLVIDMPLPIS

SEQ ID NO: 1496515 - protein, 27 aa, Mycobacterium tuberculosis
LTDPEVLEWRYPVLLREFAVRQGSGGA

SEQ ID NO: 1496516 - protein, 19 aa, Mycobacterium tuberculosis
LYREYSLRPPKGVLLYGPP

SEQ ID NO: 1496517 - protein, 17 aa, Mycobacterium tuberculosis
MDFTLGLPVLGPITGQL

SEQ ID NO: 1496518 - protein, 27 aa, Mycobacterium tuberculosis
MTIPGMRLPFTSIVPFVVYYGPVELPQ

SEQ ID NO: 1496519 - protein, 25 aa, Mycobacterium tuberculosis
NELGHPWTVLRATRRTDYLILEMAA

SEQ ID NO: 1496520 - protein, 20 aa, Mycobacterium tuberculosis
NPLRFLRAAMKWCRKAQELG

SEQ ID NO: 1496521 - protein, 17 aa, Mycobacterium tuberculosis
NSARLYVGAGLAPMLDA

SEQ ID NO: 1496522 - protein, 17 aa, Mycobacterium tuberculosis
PDGYRLSVDYAVRITSR

SEQ ID NO: 1496523 - protein, 23 aa, Mycobacterium tuberculosis
PDSPEALPLLFGHIGEGNLHLNV

SEQ ID NO: 1496524 - protein, 19 aa, Mycobacterium tuberculosis
PGHPEFRHTPGVEITTGPL

SEQ ID NO: 1496525 - protein, 20 aa, Mycobacterium tuberculosis
PKECPAPGVMQGCLESTSGL

SEQ ID NO: 1496526 - protein, 17 aa, Mycobacterium tuberculosis
PKIPLGRLGRPEELAGL

SEQ ID NO: 1496527 - protein, 21 aa, Mycobacterium tuberculosis
PLRPGEWRTLGLFAADDNGEL

SEQ ID NO: 1496528 - protein, 22 aa, Mycobacterium tuberculosis
PLVRRLWVLKVWGDVVDDRRGT

SEQ ID NO: 1496529 - protein, 17 aa, Mycobacterium tuberculosis
PSMRGVPFTFVRVDRAG

SEQ ID NO: 1496530 - protein, 18 aa, Mycobacterium tuberculosis
PTTAAFCDAEFERMRVEA

SEQ ID NO: 1496531 - protein, 20 aa, Mycobacterium tuberculosis
QAAAVPVVFLTAWYGLADLA

SEQ ID NO: 1496532 - protein, 17 aa, Mycobacterium tuberculosis
QFTHCIDIAPTVLAAIG

SEQ ID NO: 1496533 - protein, 17 aa, Mycobacterium tuberculosis
QRIPSRWLDSGVIVQAD

SEQ ID NO: 1496534 - protein, 17 aa, Mycobacterium tuberculosis
QRPGRRRVLTIANQKGG

SEQ ID NO: 1496535 - protein, 18 aa, Mycobacterium tuberculosis
RALGCPQPLIAVASAATR

SEQ ID NO: 1496536 - protein, 19 aa, Mycobacterium tuberculosis
RAVHRCLLAGRFATALGAD

SEQ ID NO: 1496537 - protein, 23 aa, Mycobacterium tuberculosis
RAYFRGECLRRFGADIAAASWDS

SEQ ID NO: 1496538 - protein, 18 aa, Mycobacterium tuberculosis
RFAAPCPGQHGWRAPAAA

SEQ ID NO: 1496539 - protein, 18 aa, Mycobacterium tuberculosis
RFTAKLSYRGRAFATVPI

SEQ ID NO: 1496540 - protein, 19 aa, Mycobacterium tuberculosis
RFVREFPFNLMLWDLDRRM

SEQ ID NO: 1496541 - protein, 24 aa, Mycobacterium tuberculosis
RGPCYRCLHPAPPPPGLVPSCAEG

SEQ ID NO: 1496542 - protein, 17 aa, Mycobacterium tuberculosis
RHLRLPLRNVLWEGDEA

SEQ ID NO: 1496543 - protein, 19 aa, Mycobacterium tuberculosis
RIGQRIAAWLNYYGAGNHS

SEQ ID NO: 1496544 - protein, 17 aa, Mycobacterium tuberculosis
RLAMAMAAIRARRSLDS

SEQ ID NO: 1496545 - protein, 19 aa, Mycobacterium tuberculosis
RLYWMSAWIDPDGTDGGPV

SEQ ID NO: 1496546 - protein, 18 aa, Mycobacterium tuberculosis
RPDLRRWLPLDVYRPLKS

SEQ ID NO: 1496547 - protein, 18 aa, Mycobacterium tuberculosis
RPGAPFGEYAEGWLKQRG

SEQ ID NO: 1496548 - protein, 24 aa, Mycobacterium tuberculosis
RPLRIAHAWSFTFDAAWQPLVALL

SEQ ID NO: 1496549 - protein, 17 aa, Mycobacterium tuberculosis
RPWVPVVSLVKGLEQGT

SEQ ID NO: 1496550 - protein, 17 aa, Mycobacterium tuberculosis
RRAPHLGFHIDFDDAKI

SEQ ID NO: 1496551 - protein, 19 aa, Mycobacterium tuberculosis
RRFLIHTARIAYVEIGVAD

SEQ ID NO: 1496552 - protein, 19 aa, Mycobacterium tuberculosis
RRGRRGRGRGRGEQGGSDG

SEQ ID NO: 1496553 - protein, 17 aa, Mycobacterium tuberculosis
RRLPPGAIWQVIAIGKA

SEQ ID NO: 1496554 - protein, 18 aa, Mycobacterium tuberculosis
RRRCAPLGAGRCLLGSGS

SEQ ID NO: 1496555 - protein, 24 aa, Mycobacterium tuberculosis
RRYIAKYTICPAIAHGMDHLIGSV

SEQ ID NO: 1496556 - protein, 17 aa, Mycobacterium tuberculosis
RSNWLGLNAPWIAAVES

SEQ ID NO: 1496557 - protein, 24 aa, Mycobacterium tuberculosis
RTIVELCALWAVHLHFDPSPEPWS

SEQ ID NO: 1496558 - protein, 22 aa, Mycobacterium tuberculosis
RTLPRWQRIVALTMIGISTALI

SEQ ID NO: 1496559 - protein, 20 aa, Mycobacterium tuberculosis
RVHLDACDRWSVGLSGGPDS

SEQ ID NO: 1496560 - protein, 17 aa, Mycobacterium tuberculosis
RVHPRATGIVLMLGDQP

SEQ ID NO: 1496561 - protein, 19 aa, Mycobacterium tuberculosis
RWLPGPRELRAWTLAAGSP

SEQ ID NO: 1496562 - protein, 18 aa, Mycobacterium tuberculosis
RYLCMLAEILRFHRAAAR

SEQ ID NO: 1496563 - protein, 19 aa, Mycobacterium tuberculosis
SAILPRFFYTKEIGKRLNA

SEQ ID NO: 1496564 - protein, 17 aa, Mycobacterium tuberculosis
SGFPDFLAKDVIDIQVT

SEQ ID NO: 1496565 - protein, 17 aa, Mycobacterium tuberculosis
SKFPYRWWWVALTDEAF

SEQ ID NO: 1496566 - protein, 24 aa, Mycobacterium tuberculosis
SLEEVLIRAGIPYKVVGGVRFYER

SEQ ID NO: 1496567 - protein, 18 aa, Mycobacterium tuberculosis
SLPRRLQIEFSQVIQKIA

SEQ ID NO: 1496568 - protein, 17 aa, Mycobacterium tuberculosis
SYFATGMAQFFASIAQQ

SEQ ID NO: 1496569 - protein, 18 aa, Mycobacterium tuberculosis
TALALHHLVCTRFRSDAL

SEQ ID NO: 1496570 - protein, 20 aa, Mycobacterium tuberculosis
TCAPLTWPEGWRRWPQRVYG

SEQ ID NO: 1496571 - protein, 23 aa, Mycobacterium tuberculosis
TGQPAAVVPWDFDGDGLPMSVQL

SEQ ID NO: 1496572 - protein, 23 aa, Mycobacterium tuberculosis
TLPPEINSALIFGGAGSEPMSAA

SEQ ID NO: 1496573 - protein, 18 aa, Mycobacterium tuberculosis
TPPPHWRPDVLLVAVGAM

SEQ ID NO: 1496574 - protein, 18 aa, Mycobacterium tuberculosis
TRVPEFLERLGVGAPEAE

SEQ ID NO: 1496575 - protein, 17 aa, Mycobacterium tuberculosis
VACSAISHASRRRAQRR

SEQ ID NO: 1496576 - protein, 17 aa, Mycobacterium tuberculosis
VELLEIRAALGPLIGRL

SEQ ID NO: 1496577 - protein, 20 aa, Mycobacterium tuberculosis
VFWPIPRVYSGLVRIDRYET

SEQ ID NO: 1496578 - protein, 20 aa, Mycobacterium tuberculosis
VLEYHWGPDWVCWDADQTFQ

SEQ ID NO: 1496579 - protein, 17 aa, Mycobacterium tuberculosis
VNIPIHLDFGTLAVNGF

SEQ ID NO: 1496580 - protein, 19 aa, Mycobacterium tuberculosis
VRFPAPVPVGSRVRATSSL

SEQ ID NO: 1496581 - protein, 17 aa, Mycobacterium tuberculosis
VSSPGYEHAWLNPDNTE

SEQ ID NO: 1496582 - protein, 17 aa, Mycobacterium tuberculosis
WCSDIRAGAGLVLAGLV

SEQ ID NO: 1496583 - protein, 19 aa, Mycobacterium tuberculosis
WMGRVHRFLGLQVGVILAT

SEQ ID NO: 1496584 - protein, 19 aa, Mycobacterium tuberculosis
WRKADAALGRPVVSNQVHF

SEQ ID NO: 1496585 - protein, 17 aa, Mycobacterium tuberculosis
WTNNFAILAGDYRFATA

SEQ ID NO: 1496586 - protein, 17 aa, Mycobacterium tuberculosis
YLFRCLSCGVHLAYADF

SEQ ID NO: 1496587 - protein, 21 aa, Mycobacterium tuberculosis
AALVDRWAPGRVMLNAYGPTE

SEQ ID NO: 1496588 - protein, 23 aa, Mycobacterium tuberculosis
AAYWPRYGLGMGETYESVTVETK

SEQ ID NO: 1496589 - protein, 30 aa, Mycobacterium tuberculosis
ADFWFDPLCPWCWITSRWILEVAKVRDIEV

SEQ ID NO: 1496590 - protein, 17 aa, Mycobacterium tuberculosis
AFSAVKPSLAWAETYPG

SEQ ID NO: 1496591 - protein, 18 aa, Mycobacterium tuberculosis
AGVARSGFYFYFDSKYSV

SEQ ID NO: 1496592 - protein, 24 aa, Mycobacterium tuberculosis
ALAARLPLAYALGWQGRGREADAV

SEQ ID NO: 1496593 - protein, 17 aa, Mycobacterium tuberculosis
ALHWFPGSHLLHVSQLD

SEQ ID NO: 1496594 - protein, 17 aa, Mycobacterium tuberculosis
ALSRLGAVAVVMRPDTD

SEQ ID NO: 1496595 - protein, 19 aa, Mycobacterium tuberculosis
ANLYRAALMLSLKDAISRD

SEQ ID NO: 1496596 - protein, 21 aa, Mycobacterium tuberculosis
APRPRMLVFGAIDFAAALARQ

SEQ ID NO: 1496597 - protein, 21 aa, Mycobacterium tuberculosis
ARGPYRLGPEITRMATTVRLG

SEQ ID NO: 1496598 - protein, 17 aa, Mycobacterium tuberculosis
ASAWLDALVGWRRASGL

SEQ ID NO: 1496599 - protein, 20 aa, Mycobacterium tuberculosis
ASVTCGIGFADLSSFTALTQ

SEQ ID NO: 1496600 - protein, 20 aa, Mycobacterium tuberculosis
ATARAYRAAAEFVPRIGALI

SEQ ID NO: 1496601 - protein, 18 aa, Mycobacterium tuberculosis
CRTPTIAAVQGWCIGGAV

SEQ ID NO: 1496602 - protein, 17 aa, Mycobacterium tuberculosis
CTTMRWPLHDDQLAAAD

SEQ ID NO: 1496603 - protein, 21 aa, Mycobacterium tuberculosis
CVKAEMLAASSWRVAVNAGAD

SEQ ID NO: 1496604 - protein, 20 aa, Mycobacterium tuberculosis
DALIELCGLLGYDARRDTDP

SEQ ID NO: 1496605 - protein, 23 aa, Mycobacterium tuberculosis
DFVKLAEALGCVGLRCEREEDVV

SEQ ID NO: 1496606 - protein, 23 aa, Mycobacterium tuberculosis
DLRCPGLLPPGCHQPVLVVGLVG

SEQ ID NO: 1496607 - protein, 18 aa, Mycobacterium tuberculosis
DVRLLLPMPADWSYAEAA

SEQ ID NO: 1496608 - protein, 25 aa, Mycobacterium tuberculosis
DVTLRPAQYLPWHPGRCAQVFVGES

SEQ ID NO: 1496609 - protein, 18 aa, Mycobacterium tuberculosis
EANGDRYLPIWIGQSEAA

SEQ ID NO: 1496610 - protein, 17 aa, Mycobacterium tuberculosis
ELLLKWKKTPQRPVSLP

SEQ ID NO: 1496611 - protein, 22 aa, Mycobacterium tuberculosis
EPGIYFPGRWGARIEDIVIVTE

SEQ ID NO: 1496612 - protein, 19 aa, Mycobacterium tuberculosis
ESRGRLSAVVQRELADEAY

SEQ ID NO: 1496613 - protein, 18 aa, Mycobacterium tuberculosis
ETELMAWAIPRAANRFWM

SEQ ID NO: 1496614 - protein, 22 aa, Mycobacterium tuberculosis
EYPSAVAKARFVRVSPRKARRV

SEQ ID NO: 1496615 - protein, 23 aa, Mycobacterium tuberculosis
FDNWPLGWGFDHFWGFPSGAAGQ

SEQ ID NO: 1496616 - protein, 18 aa, Mycobacterium tuberculosis
FGRSGLRRNIRWDPLDSV

SEQ ID NO: 1496617 - protein, 21 aa, Mycobacterium tuberculosis
FPDAVRYSVRFAKPVLLPATA

SEQ ID NO: 1496618 - protein, 22 aa, Mycobacterium tuberculosis
FRVRFGVLVIRCALCTDTVKRL

SEQ ID NO: 1496619 - protein, 20 aa, Mycobacterium tuberculosis
GDARGGAALSVREVTGVPIL

SEQ ID NO: 1496620 - protein, 24 aa, Mycobacterium tuberculosis
GDYFKRGAIELAWALLTNSLAAGG

SEQ ID NO: 1496621 - protein, 20 aa, Mycobacterium tuberculosis
GQDGHWRLGPAITELATHVD

SEQ ID NO: 1496622 - protein, 23 aa, Mycobacterium tuberculosis
GSAPMLAAAVAWDGLAAELGSAA

SEQ ID NO: 1496623 - protein, 18 aa, Mycobacterium tuberculosis
GSGLLPRMEPFVGELIGR

SEQ ID NO: 1496624 - protein, 19 aa, Mycobacterium tuberculosis
GVCANVICPRARTAMTADV

SEQ ID NO: 1496625 - protein, 19 aa, Mycobacterium tuberculosis
GVRRFALRPVIGIDPAAVS

SEQ ID NO: 1496626 - protein, 19 aa, Mycobacterium tuberculosis
GVVIGRGCLGRPWLFAELS

SEQ ID NO: 1496627 - protein, 19 aa, Mycobacterium tuberculosis
GWGVPGLSWLPGEDPDPFG

SEQ ID NO: 1496628 - protein, 21 aa, Mycobacterium tuberculosis
HDRLRLALLLCAVRPEIGGAL

SEQ ID NO: 1496629 - protein, 22 aa, Mycobacterium tuberculosis
ICIPVPFYHCFGMVMGNLAATS

SEQ ID NO: 1496630 - protein, 21 aa, Mycobacterium tuberculosis
IPRGGRRLFVFLGSTIGNLTP

SEQ ID NO: 1496631 - protein, 18 aa, Mycobacterium tuberculosis
KLRQGSYFPDWLLQRRKR

SEQ ID NO: 1496632 - protein, 19 aa, Mycobacterium tuberculosis
KRRMFDLLVRMGYKEIEVG

SEQ ID NO: 1496633 - protein, 18 aa, Mycobacterium tuberculosis
LAAQGWVCLSIDYRVAPH

SEQ ID NO: 1496634 - protein, 17 aa, Mycobacterium tuberculosis
LADYAIGATLAYPERVE

SEQ ID NO: 1496635 - protein, 17 aa, Mycobacterium tuberculosis
LAELGCFGLKIPSEYGG

SEQ ID NO: 1496636 - protein, 17 aa, Mycobacterium tuberculosis
LALQIGAQIAHEFTYGR

SEQ ID NO: 1496637 - protein, 19 aa, Mycobacterium tuberculosis
LALRLAEHGLRDERLADIL

SEQ ID NO: 1496638 - protein, 24 aa, Mycobacterium tuberculosis
LAMVCAARGYRCVLTMPETMSLER

SEQ ID NO: 1496639 - protein, 18 aa, Mycobacterium tuberculosis
LAQRLALAAGRRLDDAQP

SEQ ID NO: 1496640 - protein, 17 aa, Mycobacterium tuberculosis
LASRIYTDFTYRSGSTT

SEQ ID NO: 1496641 - protein, 17 aa, Mycobacterium tuberculosis
LDLPRDALIVFTGLSGS

SEQ ID NO: 1496642 - protein, 19 aa, Mycobacterium tuberculosis
LDVPRITIVDAHLDGGFGP

SEQ ID NO: 1496643 - protein, 17 aa, Mycobacterium tuberculosis
LGALVLTSCDAFEHFPP

SEQ ID NO: 1496644 - protein, 19 aa, Mycobacterium tuberculosis
LISRWAAYWPPAGAEALFR

SEQ ID NO: 1496645 - protein, 27 aa, Mycobacterium tuberculosis
LMERLYKTSWRFAPFLWQEIEEGILPA

SEQ ID NO: 1496646 - protein, 20 aa, Mycobacterium tuberculosis
LPEGSGFEFLDKVVGGAVPR

SEQ ID NO: 1496647 - protein, 19 aa, Mycobacterium tuberculosis
LQVAEAFGRYGAYLSQLNV

SEQ ID NO: 1496648 - protein, 17 aa, Mycobacterium tuberculosis
LRHTVRFAAAVQAALED

SEQ ID NO: 1496649 - protein, 18 aa, Mycobacterium tuberculosis
LRQVIGCVFQDFRLLQQK

SEQ ID NO: 1496650 - protein, 22 aa, Mycobacterium tuberculosis
LVEGRVALTIPADWSTQRVVSG

SEQ ID NO: 1496651 - protein, 18 aa, Mycobacterium tuberculosis
MAARLGLAGWPRAAEESI

SEQ ID NO: 1496652 - protein, 17 aa, Mycobacterium tuberculosis
MHARISGLADYFALDEL

SEQ ID NO: 1496653 - protein, 18 aa, Mycobacterium tuberculosis
MPPALFAPIVENLANVRL

SEQ ID NO: 1496654 - protein, 18 aa, Mycobacterium tuberculosis
MVGRNVLHALGFDAFGLP

SEQ ID NO: 1496655 - protein, 23 aa, Mycobacterium tuberculosis
NGAFWRGDYQGLLGFSYTSTIIP

SEQ ID NO: 1496656 - protein, 26 aa, Mycobacterium tuberculosis
NGNWVWRYDAIRTFGDFAGLWDDVDA

SEQ ID NO: 1496657 - protein, 20 aa, Mycobacterium tuberculosis
NRGRAGYRLLYSVRQYALEK

SEQ ID NO: 1496658 - protein, 19 aa, Mycobacterium tuberculosis
NRPKIGWRRLEAQAVLSRL

SEQ ID NO: 1496659 - protein, 18 aa, Mycobacterium tuberculosis
NVGRIVVHLAPWLEPQPI

SEQ ID NO: 1496660 - protein, 18 aa, Mycobacterium tuberculosis
NWFGLNAPLIAAVEGAYE

SEQ ID NO: 1496661 - protein, 19 aa, Mycobacterium tuberculosis
PAAAARLGSRLSIHDQPNL

SEQ ID NO: 1496662 - protein, 18 aa, Mycobacterium tuberculosis
PDLPTGKALVIAEGVLVV

SEQ ID NO: 1496663 - protein, 18 aa, Mycobacterium tuberculosis
PEPMVKMLLNNVLEHLAE

SEQ ID NO: 1496664 - protein, 17 aa, Mycobacterium tuberculosis
PFYHDMGLMLGIILPMI

SEQ ID NO: 1496665 - protein, 17 aa, Mycobacterium tuberculosis
PGDLAWQPPLWRALVTT

SEQ ID NO: 1496666 - protein, 21 aa, Mycobacterium tuberculosis
PGECVALLFERCAPAVVAMVA

SEQ ID NO: 1496667 - protein, 17 aa, Mycobacterium tuberculosis
PGYLPVLRAYDYAGDEV

SEQ ID NO: 1496668 - protein, 17 aa, Mycobacterium tuberculosis
PPMDFTLGLPVLGPITG

SEQ ID NO: 1496669 - protein, 17 aa, Mycobacterium tuberculosis
PPPGRWVRRKPAAAARL

SEQ ID NO: 1496670 - protein, 24 aa, Mycobacterium tuberculosis
PQTFYLSGLFFFGPVNLSASTLTV

SEQ ID NO: 1496671 - protein, 17 aa, Mycobacterium tuberculosis
PRPRIALAAPTGKAAAR

SEQ ID NO: 1496672 - protein, 23 aa, Mycobacterium tuberculosis
QARTIRIPVHMVEVINKLGRIQR

SEQ ID NO: 1496673 - protein, 18 aa, Mycobacterium tuberculosis
QGLKVSIPEEVAWRMGWI

SEQ ID NO: 1496674 - protein, 21 aa, Mycobacterium tuberculosis
RAAVRPEWPVLVAAIAEWAKR

SEQ ID NO: 1496675 - protein, 25 aa, Mycobacterium tuberculosis
RAVPLVGGLWFRFLHSVKAGIKDSL

SEQ ID NO: 1496676 - protein, 17 aa, Mycobacterium tuberculosis
RFLFAWPSAKSAVMGGA

SEQ ID NO: 1496677 - protein, 18 aa, Mycobacterium tuberculosis
RGMAARNRLDIVAALQNF

SEQ ID NO: 1496678 - protein, 17 aa, Mycobacterium tuberculosis
RGRFRWWGLYTQREQGY

SEQ ID NO: 1496679 - protein, 18 aa, Mycobacterium tuberculosis
RIVSFDAAGGWNIEEEGY

SEQ ID NO: 1496680 - protein, 18 aa, Mycobacterium tuberculosis
RKVLELAAALSDDFERAG

SEQ ID NO: 1496681 - protein, 19 aa, Mycobacterium tuberculosis
RLLPALGFRVRFGVLVIRC

SEQ ID NO: 1496682 - protein, 22 aa, Mycobacterium tuberculosis
RLQRLRLPWWHLWRAAEAAGAA

SEQ ID NO: 1496683 - protein, 21 aa, Mycobacterium tuberculosis
RPLRGCYRIAVLSLKGGVGKT

SEQ ID NO: 1496684 - protein, 19 aa, Mycobacterium tuberculosis
RPSDSVAIALRVGVPIYVE

SEQ ID NO: 1496685 - protein, 18 aa, Mycobacterium tuberculosis
RRLQIEFSQVIQKIAEGT

SEQ ID NO: 1496686 - protein, 27 aa, Mycobacterium tuberculosis
RVEAVWKPRERWGLGIDNIEYFRPTGE

SEQ ID NO: 1496687 - protein, 20 aa, Mycobacterium tuberculosis
RYLALEWLDRMDLVNGKLIC

SEQ ID NO: 1496688 - protein, 19 aa, Mycobacterium tuberculosis
SALLFPSLCHFSGGIPAPE

SEQ ID NO: 1496689 - protein, 17 aa, Mycobacterium tuberculosis
SGLLPRWEQTQRFIGEM

SEQ ID NO: 1496690 - protein, 22 aa, Mycobacterium tuberculosis
SKMNRFFLRGALVARLLSQSAW

SEQ ID NO: 1496691 - protein, 19 aa, Mycobacterium tuberculosis
SKPCAWLAEGLVRYLPARA

SEQ ID NO: 1496692 - protein, 19 aa, Mycobacterium tuberculosis
THRPSWPAGIAVGKTVVSS

SEQ ID NO: 1496693 - protein, 17 aa, Mycobacterium tuberculosis
TRSCPRLTDSIEHAVAE

SEQ ID NO: 1496694 - protein, 18 aa, Mycobacterium tuberculosis
VALYRLLMSWGVRPGLVL

SEQ ID NO: 1496695 - protein, 22 aa, Mycobacterium tuberculosis
VAPWLDLVRKLGVLAGVLSDEL

SEQ ID NO: 1496696 - protein, 19 aa, Mycobacterium tuberculosis
VCGPPGMLEAVRVARNQHA

SEQ ID NO: 1496697 - protein, 23 aa, Mycobacterium tuberculosis
VDEPFMLPAHIDFAALKVKFDGG

SEQ ID NO: 1496698 - protein, 23 aa, Mycobacterium tuberculosis
VEDWKCWARWRLIRARAPWLTRA

SEQ ID NO: 1496699 - protein, 17 aa, Mycobacterium tuberculosis
VGIAAYRCGDWAQALAE

SEQ ID NO: 1496700 - protein, 17 aa, Mycobacterium tuberculosis
VHPSWWSAARVEVVTAA

SEQ ID NO: 1496701 - protein, 17 aa, Mycobacterium tuberculosis
VKTPAQVLLRWNLQLGN

SEQ ID NO: 1496702 - protein, 19 aa, Mycobacterium tuberculosis
VLGNWTGIPVFKLTEAETT

SEQ ID NO: 1496703 - protein, 19 aa, Mycobacterium tuberculosis
VLMDREWKHGVAAAVDVTL

SEQ ID NO: 1496704 - protein, 17 aa, Mycobacterium tuberculosis
VSCAGLVIGSWPDPPGL

SEQ ID NO: 1496705 - protein, 22 aa, Mycobacterium tuberculosis
WLDQPCSFYDWRRSAADGPRLH

SEQ ID NO: 1496706 - protein, 17 aa, Mycobacterium tuberculosis
WPAKLRLLDGFRQRENL

SEQ ID NO: 1496707 - protein, 17 aa, Mycobacterium tuberculosis
WPVRVWAAALPQQTTSA

SEQ ID NO: 1496708 - protein, 20 aa, Mycobacterium tuberculosis
WTLCQILYWRGVGTCISGDP

SEQ ID NO: 1496709 - protein, 19 aa, Mycobacterium tuberculosis
YARVCVDLLKPRKAQPLLP

SEQ ID NO: 1496710 - protein, 19 aa, Mycobacterium tuberculosis
YEKLEGVPLTFAGKINRLA

SEQ ID NO: 1496711 - protein, 17 aa, Mycobacterium tuberculosis
YRGHVFWDALFVAPVLS

SEQ ID NO: 1496712 - protein, 21 aa, Mycobacterium tuberculosis
YRRMSLPDGRYVFTTRVIISA

SEQ ID NO: 1496713 - protein, 23 aa, Mycobacterium tuberculosis
YSGVMWACVFMRTGARRVHFGEI

SEQ ID NO: 1496714 - protein, 23 aa, Mycobacterium tuberculosis
ADEVSVAISALFGSHAQGYQTLS

SEQ ID NO: 1496715 - protein, 17 aa, Mycobacterium tuberculosis
AFPAWLAPVQVVGIPVA

SEQ ID NO: 1496716 - protein, 19 aa, Mycobacterium tuberculosis
AGPEPMAAAATAWDGLAME

SEQ ID NO: 1496717 - protein, 17 aa, Mycobacterium tuberculosis
AKHAQGLNVRWWSPQQV

SEQ ID NO: 1496718 - protein, 23 aa, Mycobacterium tuberculosis
AKLWTIADLGGWGSVDPQLFDKA

SEQ ID NO: 1496719 - protein, 18 aa, Mycobacterium tuberculosis
ALLFPSLCHFSGGIPAPE

SEQ ID NO: 1496720 - protein, 25 aa, Mycobacterium tuberculosis
APYNDIVSWNWTELPSALGVTNHLA

SEQ ID NO: 1496721 - protein, 17 aa, Mycobacterium tuberculosis
AQILAGFCDVALVIGAD

SEQ ID NO: 1496722 - protein, 18 aa, Mycobacterium tuberculosis
AQTVARWLVLYLRRPGGQ

SEQ ID NO: 1496723 - protein, 18 aa, Mycobacterium tuberculosis
AVSFRFGDRTQINGVARD

SEQ ID NO: 1496724 - protein, 19 aa, Mycobacterium tuberculosis
CGALRRYHEALGVPISTLP

SEQ ID NO: 1496725 - protein, 21 aa, Mycobacterium tuberculosis
CRLHHLLATFCGWRAQQLPDG

SEQ ID NO: 1496726 - protein, 18 aa, Mycobacterium tuberculosis
DFVRWKKLRGGIGALTTH

SEQ ID NO: 1496727 - protein, 24 aa, Mycobacterium tuberculosis
DGSIFLRPFLKYQIITVVAPNSPL

SEQ ID NO: 1496728 - protein, 17 aa, Mycobacterium tuberculosis
DNLRHTVRFAAAVQAAL

SEQ ID NO: 1496729 - protein, 24 aa, Mycobacterium tuberculosis
DPYQAFVLMAAWLAMRYGELTELR

SEQ ID NO: 1496730 - protein, 20 aa, Mycobacterium tuberculosis
DRERCILCARCTRFSDQIAG

SEQ ID NO: 1496731 - protein, 20 aa, Mycobacterium tuberculosis
EDKPFWWAHFDRLNYPVDEW

SEQ ID NO: 1496732 - protein, 19 aa, Mycobacterium tuberculosis
EFIGRLPVVASVTNLDKES

SEQ ID NO: 1496733 - protein, 17 aa, Mycobacterium tuberculosis
ELEAMPDLVARVIAATG

SEQ ID NO: 1496734 - protein, 17 aa, Mycobacterium tuberculosis
ETFHIAQLLPWIEANFR

SEQ ID NO: 1496735 - protein, 21 aa, Mycobacterium tuberculosis
EYKEFYKHVAHAWDDPLEIIA

SEQ ID NO: 1496736 - protein, 17 aa, Mycobacterium tuberculosis
FGGKGRAAIAIGNPDTA

SEQ ID NO: 1496737 - protein, 20 aa, Mycobacterium tuberculosis
FLFYSGFYLPMYWSSRGKLT

SEQ ID NO: 1496738 - protein, 19 aa, Mycobacterium tuberculosis
FRASVCVLGPLVGRCKRAR

SEQ ID NO: 1496739 - protein, 17 aa, Mycobacterium tuberculosis
FRAVISLDMRRFDRLHR

SEQ ID NO: 1496740 - protein, 18 aa, Mycobacterium tuberculosis
FSTYATWWIRQAITRAMA

SEQ ID NO: 1496741 - protein, 18 aa, Mycobacterium tuberculosis
FVTCDARLAATLPPGLGD

SEQ ID NO: 1496742 - protein, 17 aa, Mycobacterium tuberculosis
FWSEMPEVFHALDADRE

SEQ ID NO: 1496743 - protein, 19 aa, Mycobacterium tuberculosis
GCADLHRSDRDAAWPAIAA

SEQ ID NO: 1496744 - protein, 18 aa, Mycobacterium tuberculosis
GDARRLATMVLLIAQSTI

SEQ ID NO: 1496745 - protein, 20 aa, Mycobacterium tuberculosis
GMAPEEWRAFAARASLHAAR

SEQ ID NO: 1496746 - protein, 17 aa, Mycobacterium tuberculosis
GRIPIWLPPAKRLPDGL

SEQ ID NO: 1496747 - protein, 19 aa, Mycobacterium tuberculosis
IEAIKLVALVADRGAQVRM

SEQ ID NO: 1496748 - protein, 17 aa, Mycobacterium tuberculosis
IPAERWVYPQAGTDAHD

SEQ ID NO: 1496749 - protein, 19 aa, Mycobacterium tuberculosis
IPCSAPLPAPRVSPYPAVF

SEQ ID NO: 1496750 - protein, 21 aa, Mycobacterium tuberculosis
IPVKRLRQAGVLDLLLALANE

SEQ ID NO: 1496751 - protein, 17 aa, Mycobacterium tuberculosis
IVKYLAYGWSSLRSRPA

SEQ ID NO: 1496752 - protein, 18 aa, Mycobacterium tuberculosis
IVSIEAFEHFGHENYDDF

SEQ ID NO: 1496753 - protein, 18 aa, Mycobacterium tuberculosis
KPGMTLLDIGCGWGTTMR

SEQ ID NO: 1496754 - protein, 20 aa, Mycobacterium tuberculosis
KRFADRFARFNLQERVIRPS

SEQ ID NO: 1496755 - protein, 20 aa, Mycobacterium tuberculosis
KSKLRTGGLLLNHCITRHDN

SEQ ID NO: 1496756 - protein, 17 aa, Mycobacterium tuberculosis
KSTGFARDLADYIQEQG

SEQ ID NO: 1496757 - protein, 20 aa, Mycobacterium tuberculosis
LAALGRPLIGNGADGAPGTG

SEQ ID NO: 1496758 - protein, 23 aa, Mycobacterium tuberculosis
LAHEFDFRFLVGVLSVLGDKDVD

SEQ ID NO: 1496759 - protein, 19 aa, Mycobacterium tuberculosis
LDAFAHWRQAQGLPATAIA

SEQ ID NO: 1496760 - protein, 21 aa, Mycobacterium tuberculosis
LEKHARLAIAVNDIYLSTVGG

SEQ ID NO: 1496761 - protein, 17 aa, Mycobacterium tuberculosis
LLAARWALQTHGAIGFT

SEQ ID NO: 1496762 - protein, 17 aa, Mycobacterium tuberculosis
LLDAMGLTVGWITADST

SEQ ID NO: 1496763 - protein, 17 aa, Mycobacterium tuberculosis
LLSRAPGALGLHAALTG

SEQ ID NO: 1496764 - protein, 22 aa, Mycobacterium tuberculosis
LMSVGDLIIGWLLQRQAAVAVA

SEQ ID NO: 1496765 - protein, 18 aa, Mycobacterium tuberculosis
LPSWWDRRRKLGLVLSAY

SEQ ID NO: 1496766 - protein, 20 aa, Mycobacterium tuberculosis
LQHPDTFARLGVEPPRGVLL

SEQ ID NO: 1496767 - protein, 19 aa, Mycobacterium tuberculosis
LRSRFGFLAIHGGGLEQVT

SEQ ID NO: 1496768 - protein, 23 aa, Mycobacterium tuberculosis
LSKLARPTSTWTYMVNDNPLSDD

SEQ ID NO: 1496769 - protein, 19 aa, Mycobacterium tuberculosis
LVVSLAKRYTGRGMAFLDL

SEQ ID NO: 1496770 - protein, 18 aa, Mycobacterium tuberculosis
MVEAAICDGDWVVVRQQN

SEQ ID NO: 1496771 - protein, 17 aa, Mycobacterium tuberculosis
NMRWRTFCDELLAVIDK

SEQ ID NO: 1496772 - protein, 17 aa, Mycobacterium tuberculosis
PDIDPVLKMLLDTFPVT

SEQ ID NO: 1496773 - protein, 17 aa, Mycobacterium tuberculosis
PDIPGYAAKVFRAVADA

SEQ ID NO: 1496774 - protein, 20 aa, Mycobacterium tuberculosis
PEVVEALKFHLRDLAVTFRF

SEQ ID NO: 1496775 - protein, 22 aa, Mycobacterium tuberculosis
PGEPLPRWQIALYWRTDGRPLW

SEQ ID NO: 1496776 - protein, 18 aa, Mycobacterium tuberculosis
PGRWGRTAVCARLSSADQ

SEQ ID NO: 1496777 - protein, 17 aa, Mycobacterium tuberculosis
PRGYRAMAGIPRLQFAH

SEQ ID NO: 1496778 - protein, 19 aa, Mycobacterium tuberculosis
PSGGLACFGEAIPAQAIAQ

SEQ ID NO: 1496779 - protein, 27 aa, Mycobacterium tuberculosis
PVGGLLARFPGFYIPFLDVPFNGATPA

SEQ ID NO: 1496780 - protein, 17 aa, Mycobacterium tuberculosis
QALTEAVLWPLQHPDTF

SEQ ID NO: 1496781 - protein, 17 aa, Mycobacterium tuberculosis
QVTSGLTAGVWQGAAAA

SEQ ID NO: 1496782 - protein, 17 aa, Mycobacterium tuberculosis
RAGKIPAVLYGHGAEPQ

SEQ ID NO: 1496783 - protein, 20 aa, Mycobacterium tuberculosis
RAGLPDGEFFGVIAQLPGAS

SEQ ID NO: 1496784 - protein, 17 aa, Mycobacterium tuberculosis
RARVVQLERGWVLRDET

SEQ ID NO: 1496785 - protein, 20 aa, Mycobacterium tuberculosis
RAYRLRWPAGTIVFEVDQPQ

SEQ ID NO: 1496786 - protein, 19 aa, Mycobacterium tuberculosis
RERTVLVLRFFDSMTQTQI

SEQ ID NO: 1496787 - protein, 19 aa, Mycobacterium tuberculosis
RGSFFPVIPVCSSTGVGTL

SEQ ID NO: 1496788 - protein, 17 aa, Mycobacterium tuberculosis
RKCLRITVGGGRNKVTA

SEQ ID NO: 1496789 - protein, 18 aa, Mycobacterium tuberculosis
RLLARNGLSLQDFDFYEI

SEQ ID NO: 1496790 - protein, 19 aa, Mycobacterium tuberculosis
RLLIEVAWEALEDAGVPQH

SEQ ID NO: 1496791 - protein, 19 aa, Mycobacterium tuberculosis
RLVAPVFDPKKAVVFDDRW

SEQ ID NO: 1496792 - protein, 17 aa, Mycobacterium tuberculosis
RNKHGWVTVGDVGYLDD

SEQ ID NO: 1496793 - protein, 20 aa, Mycobacterium tuberculosis
RPGQKLRIVKYLAYGWSSLR

SEQ ID NO: 1496794 - protein, 24 aa, Mycobacterium tuberculosis
RPPARLVGWTARFLGMVRPGDEVD

SEQ ID NO: 1496795 - protein, 18 aa, Mycobacterium tuberculosis
RRRICWQAYLGAETDSHP

SEQ ID NO: 1496796 - protein, 19 aa, Mycobacterium tuberculosis
RSDFPVLWPVGTRWADNDM

SEQ ID NO: 1496797 - protein, 19 aa, Mycobacterium tuberculosis
RTERFWVGLSVYRPGGTAE

SEQ ID NO: 1496798 - protein, 25 aa, Mycobacterium tuberculosis
SALKALEGDAKWVASVEELMNAVDE

SEQ ID NO: 1496799 - protein, 18 aa, Mycobacterium tuberculosis
SAVPRALQGLALPTASQS

SEQ ID NO: 1496800 - protein, 18 aa, Mycobacterium tuberculosis
SDAFDIPLVFVVDTPGFL

SEQ ID NO: 1496801 - protein, 19 aa, Mycobacterium tuberculosis
SDEWTDWRWNRILIEGSNC

SEQ ID NO: 1496802 - protein, 19 aa, Mycobacterium tuberculosis
SDWNALNLFTGWVDVGLTD

SEQ ID NO: 1496803 - protein, 20 aa, Mycobacterium tuberculosis
SGLFPFHFTLNGGIGPISIP

SEQ ID NO: 1496804 - protein, 20 aa, Mycobacterium tuberculosis
SILYRLYRPLIFALYCLPLN

SEQ ID NO: 1496805 - protein, 20 aa, Mycobacterium tuberculosis
TCAPIAWSRSFRHVQALETD

SEQ ID NO: 1496806 - protein, 19 aa, Mycobacterium tuberculosis
TDWRWNRILIEGSNCRDII

SEQ ID NO: 1496807 - protein, 21 aa, Mycobacterium tuberculosis
TGLRPPRPGNFVMSFLDASIA

SEQ ID NO: 1496808 - protein, 17 aa, Mycobacterium tuberculosis
TGLSIRETVLFPIVRPH

SEQ ID NO: 1496809 - protein, 24 aa, Mycobacterium tuberculosis
TSRPCPTCRGVGVVIPDPCQQCMG

SEQ ID NO: 1496810 - protein, 17 aa, Mycobacterium tuberculosis
VAGCVFRYIAYHGRSRE

SEQ ID NO: 1496811 - protein, 24 aa, Mycobacterium tuberculosis
VARYLFRRVVSWGRSSNVFLRNGA

SEQ ID NO: 1496812 - protein, 22 aa, Mycobacterium tuberculosis
VEVLRLSALRGLFSAVIEDAVT

SEQ ID NO: 1496813 - protein, 27 aa, Mycobacterium tuberculosis
VHGFRFPEITGDIFLIGIPFNAATLDA

SEQ ID NO: 1496814 - protein, 17 aa, Mycobacterium tuberculosis
VIAAWLWSGRKGVIAGA

SEQ ID NO: 1496815 - protein, 21 aa, Mycobacterium tuberculosis
VNQRWLGGMLTNFSTVHKRLQ

SEQ ID NO: 1496816 - protein, 21 aa, Mycobacterium tuberculosis
VPRRCCRPGCPHYAVATLTFV

SEQ ID NO: 1496817 - protein, 17 aa, Mycobacterium tuberculosis
VPSRGLIGWRTDFLTET

SEQ ID NO: 1496818 - protein, 18 aa, Mycobacterium tuberculosis
VQAQKLWAQAGFRPVDPA

SEQ ID NO: 1496819 - protein, 18 aa, Mycobacterium tuberculosis
VSERRLWLAVLRAQAELG

SEQ ID NO: 1496820 - protein, 17 aa, Mycobacterium tuberculosis
VTWGAGVPAAMGTSTAG

SEQ ID NO: 1496821 - protein, 19 aa, Mycobacterium tuberculosis
WLLRACAKLGVRLVHSTPG

SEQ ID NO: 1496822 - protein, 19 aa, Mycobacterium tuberculosis
WRATLIVRESACLDVADRR

SEQ ID NO: 1496823 - protein, 18 aa, Mycobacterium tuberculosis
WRATLIVRESACLDVEDR

SEQ ID NO: 1496824 - protein, 18 aa, Mycobacterium tuberculosis
WWTSPFVLAHGVPPDTLA

SEQ ID NO: 1496825 - protein, 22 aa, Mycobacterium tuberculosis
YAMPDVHWGYGFPIGGVAATDV

SEQ ID NO: 1496826 - protein, 18 aa, Mycobacterium tuberculosis
YRCGEAWSTLVHHRPSGR

SEQ ID NO: 1496827 - protein, 24 aa, Mycobacterium tuberculosis
YSPAELACALGLFPPTAEQAAVIA

SEQ ID NO: 1496828 - protein, 22 aa, Mycobacterium tuberculosis
AAAGRPWWEWAATHERAFTAAY

SEQ ID NO: 1496829 - protein, 25 aa, Mycobacterium tuberculosis
ACFRCPQCTERLRASDDLLLVGGMR

SEQ ID NO: 1496830 - protein, 22 aa, Mycobacterium tuberculosis
ACTLRGWLGMWSLRVAQTRAAP

SEQ ID NO: 1496831 - protein, 20 aa, Mycobacterium tuberculosis
ADGKAKWSAPLGFLAQTPPA

SEQ ID NO: 1496832 - protein, 18 aa, Mycobacterium tuberculosis
ADGVVRPVVFLAYSGQAR

SEQ ID NO: 1496833 - protein, 17 aa, Mycobacterium tuberculosis
ADWEASYLLSLRAAWQA

SEQ ID NO: 1496834 - protein, 17 aa, Mycobacterium tuberculosis
AEVGIGFCFAPRFHPSY

SEQ ID NO: 1496835 - protein, 17 aa, Mycobacterium tuberculosis
AGLPRLTWRADAWHRQR

SEQ ID NO: 1496836 - protein, 19 aa, Mycobacterium tuberculosis
AGLVGKLSVPQGWTVAAPE

SEQ ID NO: 1496837 - protein, 17 aa, Mycobacterium tuberculosis
AGPRYGFRPTVMARPPF

SEQ ID NO: 1496838 - protein, 19 aa, Mycobacterium tuberculosis
ALASIMSWQGWEELFELAR

SEQ ID NO: 1496839 - protein, 19 aa, Mycobacterium tuberculosis
ALHEVVGWWAKLPVTGMQP

SEQ ID NO: 1496840 - protein, 25 aa, Mycobacterium tuberculosis
AQVVPWASLLQRFPGLGAGATGATG

SEQ ID NO: 1496841 - protein, 21 aa, Mycobacterium tuberculosis
ARLAELLVRYRVGVQAVQTVE

SEQ ID NO: 1496842 - protein, 26 aa, Mycobacterium tuberculosis
ASVAWDRLAAELAVAASSFGSVTSGL

SEQ ID NO: 1496843 - protein, 24 aa, Mycobacterium tuberculosis
CPGLCPQCGVPLASEPGHRHEQID

SEQ ID NO: 1496844 - protein, 17 aa, Mycobacterium tuberculosis
DNLRHTVRFSAAVRSAL

SEQ ID NO: 1496845 - protein, 17 aa, Mycobacterium tuberculosis
DRGYPLFVENLVSLGAE

SEQ ID NO: 1496846 - protein, 22 aa, Mycobacterium tuberculosis
DTLRRAGERFGFAVESMSLVSE

SEQ ID NO: 1496847 - protein, 23 aa, Mycobacterium tuberculosis
DTRAYRLPWPPGTVVYEIDQPAV

SEQ ID NO: 1496848 - protein, 18 aa, Mycobacterium tuberculosis
EAGWWRLGLAEEIGGMPA

SEQ ID NO: 1496849 - protein, 17 aa, Mycobacterium tuberculosis
EDLRFLVRLARQQGERL

SEQ ID NO: 1496850 - protein, 20 aa, Mycobacterium tuberculosis
ELYKRLPGDLSILTPSPASD

SEQ ID NO: 1496851 - protein, 17 aa, Mycobacterium tuberculosis
FGELRWALSGAAPIPKE

SEQ ID NO: 1496852 - protein, 18 aa, Mycobacterium tuberculosis
FRTKRWPDVLAQFPEATQ

SEQ ID NO: 1496853 - protein, 25 aa, Mycobacterium tuberculosis
FSNGILWRGNYEGLFSYSYSLDVPR

SEQ ID NO: 1496854 - protein, 18 aa, Mycobacterium tuberculosis
GCSFPNCDVPGYLTEVHH

SEQ ID NO: 1496855 - protein, 21 aa, Mycobacterium tuberculosis
GDLPPRFPIVGGHEGSGVIEE

SEQ ID NO: 1496856 - protein, 19 aa, Mycobacterium tuberculosis
GILNRGAGISGVYNTGTLG

SEQ ID NO: 1496857 - protein, 18 aa, Mycobacterium tuberculosis
GRGARFLLGLVVSTGVGG

SEQ ID NO: 1496858 - protein, 18 aa, Mycobacterium tuberculosis
GSAHFVWVRDTLRLGGKF

SEQ ID NO: 1496859 - protein, 18 aa, Mycobacterium tuberculosis
GVAWVIAYRWFRAGLLPV

SEQ ID NO: 1496860 - protein, 21 aa, Mycobacterium tuberculosis
GVGFRWWTRCRALELGLTGYA

SEQ ID NO: 1496861 - protein, 17 aa, Mycobacterium tuberculosis
GWHSLSIAYAETADELA

SEQ ID NO: 1496862 - protein, 19 aa, Mycobacterium tuberculosis
HCNIEHGCVVARAETLRGA

SEQ ID NO: 1496863 - protein, 31 aa, Mycobacterium tuberculosis
HYDCRSTRALRDWLLMRAWEAGVTPIGAQPV

SEQ ID NO: 1496864 - protein, 19 aa, Mycobacterium tuberculosis
IGLLARLGYRFAPTQIPGT

SEQ ID NO: 1496865 - protein, 26 aa, Mycobacterium tuberculosis
ILWRGNYEGLAGFSFGYPIPLFPAVG

SEQ ID NO: 1496866 - protein, 20 aa, Mycobacterium tuberculosis
IRIDRFELLAARRRDQLIDI

SEQ ID NO: 1496867 - protein, 21 aa, Mycobacterium tuberculosis
KAFAFAGGRLGYLIATPAVID

SEQ ID NO: 1496868 - protein, 24 aa, Mycobacterium tuberculosis
LDFMRSCSIRHRMASVIFSLEMSK

SEQ ID NO: 1496869 - protein, 18 aa, Mycobacterium tuberculosis
LKARGSGQWASFSELVAD

SEQ ID NO: 1496870 - protein, 21 aa, Mycobacterium tuberculosis
LPFPLSSAILPRFFYTKEIGK

SEQ ID NO: 1496871 - protein, 18 aa, Mycobacterium tuberculosis
LPPGAIWQVIAIGKANME

SEQ ID NO: 1496872 - protein, 22 aa, Mycobacterium tuberculosis
LPVYRPPLDMARLFNQPELGPT

SEQ ID NO: 1496873 - protein, 18 aa, Mycobacterium tuberculosis
LRKTDWLFPQYRELGVYL

SEQ ID NO: 1496874 - protein, 17 aa, Mycobacterium tuberculosis
LRSILAPECAARAREIS

SEQ ID NO: 1496875 - protein, 17 aa, Mycobacterium tuberculosis
LRVLGALGVDATAYRAA

SEQ ID NO: 1496876 - protein, 17 aa, Mycobacterium tuberculosis
LVPFSWQGVSLHAAGAS

SEQ ID NO: 1496877 - protein, 18 aa, Mycobacterium tuberculosis
MDTEWPLPLLDLARIASD

SEQ ID NO: 1496878 - protein, 21 aa, Mycobacterium tuberculosis
MLSLFFRQHINYVLARPKLRP

SEQ ID NO: 1496879 - protein, 17 aa, Mycobacterium tuberculosis
NLHFTRWNPAIDASATR

SEQ ID NO: 1496880 - protein, 19 aa, Mycobacterium tuberculosis
NSLPGQWTAHVTLARRVGG

SEQ ID NO: 1496881 - protein, 19 aa, Mycobacterium tuberculosis
PDIRCCILTGAGGYFCAGM

SEQ ID NO: 1496882 - protein, 20 aa, Mycobacterium tuberculosis
PEALRAFGIRECADAARALD

SEQ ID NO: 1496883 - protein, 18 aa, Mycobacterium tuberculosis
PIAKELPMEYALELNRLI

SEQ ID NO: 1496884 - protein, 23 aa, Mycobacterium tuberculosis
PLRASIDPFGWYRSWEEMLTGMA

SEQ ID NO: 1496885 - protein, 17 aa, Mycobacterium tuberculosis
PRPRWRSAQALTSRSCN

SEQ ID NO: 1496886 - protein, 21 aa, Mycobacterium tuberculosis
QAGALPALFSGLARRPRRRQI

SEQ ID NO: 1496887 - protein, 23 aa, Mycobacterium tuberculosis
QFVKRLGTHAAIFTVPNFLELDY

SEQ ID NO: 1496888 - protein, 20 aa, Mycobacterium tuberculosis
RAATHAALWAVDEAVNRDIP

SEQ ID NO: 1496889 - protein, 23 aa, Mycobacterium tuberculosis
RDAIRHAVAWARPGDVVLIAGKG

SEQ ID NO: 1496890 - protein, 17 aa, Mycobacterium tuberculosis
RLMEFFGGIPILDGIGS

SEQ ID NO: 1496891 - protein, 18 aa, Mycobacterium tuberculosis
RPLWECWIIEGLNGNRWA

SEQ ID NO: 1496892 - protein, 18 aa, Mycobacterium tuberculosis
RPQFSAVLECASAARQLG

SEQ ID NO: 1496893 - protein, 22 aa, Mycobacterium tuberculosis
RPSGLPGLRHKYSLDIAPGNFV

SEQ ID NO: 1496894 - protein, 24 aa, Mycobacterium tuberculosis
RREMAYEGKIDWAFGELLALGSLV

SEQ ID NO: 1496895 - protein, 19 aa, Mycobacterium tuberculosis
RVGPTILRHWSHPATVLVA

SEQ ID NO: 1496896 - protein, 17 aa, Mycobacterium tuberculosis
RYLPIWIGQSEAAAIAL

SEQ ID NO: 1496897 - protein, 21 aa, Mycobacterium tuberculosis
SAQFPRPAPRSSYSALSSRQW

SEQ ID NO: 1496898 - protein, 19 aa, Mycobacterium tuberculosis
SDWLTARLVDLDSGDIETL

SEQ ID NO: 1496899 - protein, 25 aa, Mycobacterium tuberculosis
SGGIRGPIGLGFRVPCLVISPYSRG

SEQ ID NO: 1496900 - protein, 18 aa, Mycobacterium tuberculosis
SGQVGWLARDRWAVPLVH

SEQ ID NO: 1496901 - protein, 25 aa, Mycobacterium tuberculosis
SLDVPRITILDAHFTGAFGPVVVPP

SEQ ID NO: 1496902 - protein, 17 aa, Mycobacterium tuberculosis
SRFASAFGPAASLEYLP

SEQ ID NO: 1496903 - protein, 23 aa, Mycobacterium tuberculosis
SRGGDGGVGGWLYGDGGGGGDGG

SEQ ID NO: 1496904 - protein, 18 aa, Mycobacterium tuberculosis
SRVFFDWFDAMGVDDIPA

SEQ ID NO: 1496905 - protein, 18 aa, Mycobacterium tuberculosis
SSIPPVPGKFYWMSPTQV

SEQ ID NO: 1496906 - protein, 21 aa, Mycobacterium tuberculosis
SSLVRRAGCPVAVIHSDDAVI

SEQ ID NO: 1496907 - protein, 25 aa, Mycobacterium tuberculosis
SSSGFKVRPSFSFFAVGPDGMPGGE

SEQ ID NO: 1496908 - protein, 22 aa, Mycobacterium tuberculosis
STNARMLIQFGFIERLAVAGDR

SEQ ID NO: 1496909 - protein, 24 aa, Mycobacterium tuberculosis
TCHFVRPGWRLPRRTAESALRASL

SEQ ID NO: 1496910 - protein, 24 aa, Mycobacterium tuberculosis
TPRCGLCPLDWCAWRHAGYPPSDG

SEQ ID NO: 1496911 - protein, 18 aa, Mycobacterium tuberculosis
TSWAQRWLAATGNRDYLG

SEQ ID NO: 1496912 - protein, 23 aa, Mycobacterium tuberculosis
TVARQEPGLSWAAGLRDNGQTTL

SEQ ID NO: 1496913 - protein, 18 aa, Mycobacterium tuberculosis
VAEYWPEFGANGKSEVTV

SEQ ID NO: 1496914 - protein, 17 aa, Mycobacterium tuberculosis
VFETLAWGRRHVVMGAN

SEQ ID NO: 1496915 - protein, 18 aa, Mycobacterium tuberculosis
VGHIPGAVKIDWHTDLND

SEQ ID NO: 1496916 - protein, 22 aa, Mycobacterium tuberculosis
VQEVKLGLARPVWIDDRDFDIT

SEQ ID NO: 1496917 - protein, 17 aa, Mycobacterium tuberculosis
VSLDVEYFGVMWPNNAA

SEQ ID NO: 1496918 - protein, 20 aa, Mycobacterium tuberculosis
WAGSLKRHGEWIVPTRLALV

SEQ ID NO: 1496919 - protein, 19 aa, Mycobacterium tuberculosis
WDWAVDWDTWVSMSALPPP

SEQ ID NO: 1496920 - protein, 17 aa, Mycobacterium tuberculosis
WRLGPAITELATHVDDP

SEQ ID NO: 1496921 - protein, 18 aa, Mycobacterium tuberculosis
WSPKVFGSWNLHRATLGQ

SEQ ID NO: 1496922 - protein, 23 aa, Mycobacterium tuberculosis
YPGHAIWWLARGLEFFQDGEQFG

SEQ ID NO: 1496923 - protein, 22 aa, Mycobacterium tuberculosis
YPGRFLLGIGVGHAEMISEYRK

SEQ ID NO: 1496924 - protein, 17 aa, Mycobacterium tuberculosis
YSPRFLWMWPNARISVM

SEQ ID NO: 1496925 - protein, 20 aa, Mycobacterium tuberculosis
AAEHPRPDYVLLHISDTHLI

SEQ ID NO: 1496926 - protein, 23 aa, Mycobacterium tuberculosis
AAGRAAPRLTVWVPVAVNPGAAA

SEQ ID NO: 1496927 - protein, 23 aa, Mycobacterium tuberculosis
ACTLRGWLGMWSLRVAQTRAAPH

SEQ ID NO: 1496928 - protein, 20 aa, Mycobacterium tuberculosis
ADHARLDFLAGLRVVPAELG

SEQ ID NO: 1496929 - protein, 17 aa, Mycobacterium tuberculosis
ADSFRLALVAAHDDGDS

SEQ ID NO: 1496930 - protein, 17 aa, Mycobacterium tuberculosis
AERAVWVGHDWGAVVVW

SEQ ID NO: 1496931 - protein, 20 aa, Mycobacterium tuberculosis
AFAFAGGRLGYLIATPAVID

SEQ ID NO: 1496932 - protein, 18 aa, Mycobacterium tuberculosis
AFGTSRWSSKLVHGGLRY

SEQ ID NO: 1496933 - protein, 19 aa, Mycobacterium tuberculosis
AFRRTIKWRTGCEGRISHL

SEQ ID NO: 1496934 - protein, 21 aa, Mycobacterium tuberculosis
AMFDGRFVGFADFLIRDGHRY

SEQ ID NO: 1496935 - protein, 18 aa, Mycobacterium tuberculosis
CATYPVLAVQAWAAFHDM

SEQ ID NO: 1496936 - protein, 18 aa, Mycobacterium tuberculosis
CFLAMVRRFTNWASRSSM

SEQ ID NO: 1496937 - protein, 17 aa, Mycobacterium tuberculosis
CRNGSMNLVVWAEGNGV

SEQ ID NO: 1496938 - protein, 22 aa, Mycobacterium tuberculosis
DGDLPPRFPIVGGHEGSGVIEE

SEQ ID NO: 1496939 - protein, 23 aa, Mycobacterium tuberculosis
DLVPEYIGNLLLYFQPDATVTML

SEQ ID NO: 1496940 - protein, 22 aa, Mycobacterium tuberculosis
DPPVEGGWAWLPDEAQGARVHW

SEQ ID NO: 1496941 - protein, 19 aa, Mycobacterium tuberculosis
DRMQFCSEFEWIAPSGRGL

SEQ ID NO: 1496942 - protein, 19 aa, Mycobacterium tuberculosis
EINSALIFAGAGSGPMLAA

SEQ ID NO: 1496943 - protein, 18 aa, Mycobacterium tuberculosis
EINSLRMYLGAGSAPMLQ

SEQ ID NO: 1496944 - protein, 21 aa, Mycobacterium tuberculosis
ELQPRLPAVMDRLDRAIPRGV

SEQ ID NO: 1496945 - protein, 19 aa, Mycobacterium tuberculosis
EMRAGTVALVIREDRGWAV

SEQ ID NO: 1496946 - protein, 17 aa, Mycobacterium tuberculosis
ETDWPIRAALLSTPEQT

SEQ ID NO: 1496947 - protein, 19 aa, Mycobacterium tuberculosis
FFKRCFNIMPADGRMTVQS

SEQ ID NO: 1496948 - protein, 23 aa, Mycobacterium tuberculosis
FLFDFRDGIELNPIVIPGSSIPI

SEQ ID NO: 1496949 - protein, 17 aa, Mycobacterium tuberculosis
FLLGLVVSTGVGGGLVL

SEQ ID NO: 1496950 - protein, 17 aa, Mycobacterium tuberculosis
FTLPGERIHVVFRSDES

SEQ ID NO: 1496951 - protein, 17 aa, Mycobacterium tuberculosis
GDARRLATMVLLIAQST

SEQ ID NO: 1496952 - protein, 17 aa, Mycobacterium tuberculosis
GILPFSVASVVSGFANI

SEQ ID NO: 1496953 - protein, 19 aa, Mycobacterium tuberculosis
GLGARLFQVGSRGGDGGVG

SEQ ID NO: 1496954 - protein, 17 aa, Mycobacterium tuberculosis
GSVIARLTGMHWWGPAS

SEQ ID NO: 1496955 - protein, 19 aa, Mycobacterium tuberculosis
GTGWRWRTWHLYPSASGGT

SEQ ID NO: 1496956 - protein, 23 aa, Mycobacterium tuberculosis
GVRTNTWWLPAMQSLYETDYGPV

SEQ ID NO: 1496957 - protein, 20 aa, Mycobacterium tuberculosis
HPFMKFEGWTPLAQLKVGDR

SEQ ID NO: 1496958 - protein, 27 aa, Mycobacterium tuberculosis
HTTLSIGPFPFRWDYIPPTPANGPIPA

SEQ ID NO: 1496959 - protein, 24 aa, Mycobacterium tuberculosis
IEDWAEIWPCAGMAYPKALADDLR

SEQ ID NO: 1496960 - protein, 20 aa, Mycobacterium tuberculosis
IFTKFNIPINIARVFHRDQK

SEQ ID NO: 1496961 - protein, 17 aa, Mycobacterium tuberculosis
IPLLVVITEGIPVQDTA

SEQ ID NO: 1496962 - protein, 21 aa, Mycobacterium tuberculosis
KNPKEHFDFFPLTVDVEERMY

SEQ ID NO: 1496963 - protein, 17 aa, Mycobacterium tuberculosis
KVHGAWELHEATSGQPL

SEQ ID NO: 1496964 - protein, 18 aa, Mycobacterium tuberculosis
LASIMSWQGWEELFELAR

SEQ ID NO: 1496965 - protein, 18 aa, Mycobacterium tuberculosis
LDDGWLTLLRRWLNDAQR

SEQ ID NO: 1496966 - protein, 17 aa, Mycobacterium tuberculosis
LGAAMTRLACERASVGD

SEQ ID NO: 1496967 - protein, 26 aa, Mycobacterium tuberculosis
LGPVGDLFPILSIPGAMSQNFTNVVM

SEQ ID NO: 1496968 - protein, 18 aa, Mycobacterium tuberculosis
LHLPGFPVQFFVYKQIAA

SEQ ID NO: 1496969 - protein, 20 aa, Mycobacterium tuberculosis
LILRRPRAGLSYEALLETVE

SEQ ID NO: 1496970 - protein, 17 aa, Mycobacterium tuberculosis
LKARGSGQWASFSELVA

SEQ ID NO: 1496971 - protein, 24 aa, Mycobacterium tuberculosis
LMRSCTGWPSGVWIDQPRRTAPDG

SEQ ID NO: 1496972 - protein, 20 aa, Mycobacterium tuberculosis
LPIFGFGGAPGFGNDTTAPS

SEQ ID NO: 1496973 - protein, 18 aa, Mycobacterium tuberculosis
LPPSGVPYLLGIQSVLVT

SEQ ID NO: 1496974 - protein, 21 aa, Mycobacterium tuberculosis
LQGQCTFSWPPRMELPGYKPN

SEQ ID NO: 1496975 - protein, 17 aa, Mycobacterium tuberculosis
LRHKYSLDIAPGNFVTI

SEQ ID NO: 1496976 - protein, 17 aa, Mycobacterium tuberculosis
LRPRYLCMLAEILRFHR

SEQ ID NO: 1496977 - protein, 17 aa, Mycobacterium tuberculosis
MFRPKLDALALLHRRSL

SEQ ID NO: 1496978 - protein, 21 aa, Mycobacterium tuberculosis
NVANCLVALAILDTVGVSPEQ

SEQ ID NO: 1496979 - protein, 17 aa, Mycobacterium tuberculosis
PGDFFPVPCCFPSCRSI

SEQ ID NO: 1496980 - protein, 17 aa, Mycobacterium tuberculosis
PLPAPRVSPYPAVFQDV

SEQ ID NO: 1496981 - protein, 18 aa, Mycobacterium tuberculosis
PPGTIGEIWVHGDNVAGG

SEQ ID NO: 1496982 - protein, 20 aa, Mycobacterium tuberculosis
PRLAELGGRFWFGLDDGRAD

SEQ ID NO: 1496983 - protein, 17 aa, Mycobacterium tuberculosis
PSSGVAFVLGERLGRVD

SEQ ID NO: 1496984 - protein, 18 aa, Mycobacterium tuberculosis
PYAHGWVTWFPPDAPPGT

SEQ ID NO: 1496985 - protein, 22 aa, Mycobacterium tuberculosis
QGRVALDWLDRVDVIGHSRSSE

SEQ ID NO: 1496986 - protein, 18 aa, Mycobacterium tuberculosis
QSQVVAWWAPTFDEVNGG

SEQ ID NO: 1496987 - protein, 17 aa, Mycobacterium tuberculosis
RAAIGLGDGVVRISVGL

SEQ ID NO: 1496988 - protein, 19 aa, Mycobacterium tuberculosis
RAPGALGLHAALTGAPFSG

SEQ ID NO: 1496989 - protein, 22 aa, Mycobacterium tuberculosis
RARIGVLSQVPWLWAKFIGHAQ

SEQ ID NO: 1496990 - protein, 18 aa, Mycobacterium tuberculosis
REAFLALIRSNWLGLNAP

SEQ ID NO: 1496991 - protein, 23 aa, Mycobacterium tuberculosis
REMAYEGKIDWAFGELLALGSLV

SEQ ID NO: 1496992 - protein, 18 aa, Mycobacterium tuberculosis
RENLSWSAPRLHLVDLQY

SEQ ID NO: 1496993 - protein, 22 aa, Mycobacterium tuberculosis
RGRCTPIAAWLAGLGLFTKRSH

SEQ ID NO: 1496994 - protein, 21 aa, Mycobacterium tuberculosis
RGRPVLVGGLGGRGVVAGASY

SEQ ID NO: 1496995 - protein, 18 aa, Mycobacterium tuberculosis
RIAQAVVVAATRNYGVPD

SEQ ID NO: 1496996 - protein, 22 aa, Mycobacterium tuberculosis
RPIADVCPVEWARMANRSVLQW

SEQ ID NO: 1496997 - protein, 18 aa, Mycobacterium tuberculosis
RPVDAYADFDSCQSWTER

SEQ ID NO: 1496998 - protein, 19 aa, Mycobacterium tuberculosis
RPVDAYADFDSCQSWTERG

SEQ ID NO: 1496999 - protein, 21 aa, Mycobacterium tuberculosis
RRLADQAVRQWGFMQGLKQKL

SEQ ID NO: 1497000 - protein, 19 aa, Mycobacterium tuberculosis
RSRVFFDWFDAMGVDDIPA

SEQ ID NO: 1497001 - protein, 17 aa, Mycobacterium tuberculosis
RSWLRARGLKIFPLVGW

SEQ ID NO: 1497002 - protein, 20 aa, Mycobacterium tuberculosis
RTIRLPVHLVEQVNKLARIK

SEQ ID NO: 1497003 - protein, 17 aa, Mycobacterium tuberculosis
SELWQLERERIFNRSWM

SEQ ID NO: 1497004 - protein, 25 aa, Mycobacterium tuberculosis
SGGIRGPIGLGFRVPCFVISPYSRG

SEQ ID NO: 1497005 - protein, 17 aa, Mycobacterium tuberculosis
SKLGGLWKTVSPHRSPI

SEQ ID NO: 1497006 - protein, 20 aa, Mycobacterium tuberculosis
SRAPGALGLHAALTGAPFSG

SEQ ID NO: 1497007 - protein, 20 aa, Mycobacterium tuberculosis
SSLVRRAGCPVAVIHSDDAV

SEQ ID NO: 1497008 - protein, 21 aa, Mycobacterium tuberculosis
TDMPGRFVVAAAMVRHLLTDP

SEQ ID NO: 1497009 - protein, 24 aa, Mycobacterium tuberculosis
TGHMPVRRLDLIWISARNAARREL

SEQ ID NO: 1497010 - protein, 17 aa, Mycobacterium tuberculosis
TGNVCLVTLGLNLFSRG

SEQ ID NO: 1497011 - protein, 20 aa, Mycobacterium tuberculosis
TIEMADWWAYLNGVRKTYPL

SEQ ID NO: 1497012 - protein, 21 aa, Mycobacterium tuberculosis
TLSFRWSCRMGICGSSGMTIN

SEQ ID NO: 1497013 - protein, 18 aa, Mycobacterium tuberculosis
TRSSAGFGAPRYGAKPIV

SEQ ID NO: 1497014 - protein, 18 aa, Mycobacterium tuberculosis
VAPYLGWLISATAQAEQA

SEQ ID NO: 1497015 - protein, 17 aa, Mycobacterium tuberculosis
VEVHWSRWGEAYVTPVE

SEQ ID NO: 1497016 - protein, 20 aa, Mycobacterium tuberculosis
VGHIPGAVKIDWHTDLNDPR

SEQ ID NO: 1497017 - protein, 17 aa, Mycobacterium tuberculosis
VGLLPTWGLSVRLPQKV

SEQ ID NO: 1497018 - protein, 17 aa, Mycobacterium tuberculosis
VLVGGLGGRGVVAGASY

SEQ ID NO: 1497019 - protein, 17 aa, Mycobacterium tuberculosis
VMVRPLIRLSLGKRHPM

SEQ ID NO: 1497020 - protein, 19 aa, Mycobacterium tuberculosis
VPCCFPSCRSITYLLTDGE

SEQ ID NO: 1497021 - protein, 23 aa, Mycobacterium tuberculosis
VQRYEVVDLLSLLADKSLVVTDD

SEQ ID NO: 1497022 - protein, 17 aa, Mycobacterium tuberculosis
VVAELRAGLPPTLAVAG

SEQ ID NO: 1497023 - protein, 17 aa, Mycobacterium tuberculosis
WGKRRLAYEIAKHAEGI

SEQ ID NO: 1497024 - protein, 19 aa, Mycobacterium tuberculosis
WLDDGWLTLLRRWLNDAQR

SEQ ID NO: 1497025 - protein, 25 aa, Mycobacterium tuberculosis
WRARGRLQEGLAWFAAALADHDAHP

SEQ ID NO: 1497026 - protein, 17 aa, Mycobacterium tuberculosis
WSPDGKPIVGFVGRLAP

SEQ ID NO: 1497027 - protein, 18 aa, Mycobacterium tuberculosis
YIPFKGCVKHVSVTIPIT

SEQ ID NO: 1497028 - protein, 17 aa, Mycobacterium tuberculosis
YSRFWHKVLYDLGHVSS

SEQ ID NO: 1497029 - protein, 20 aa, Mycobacterium tuberculosis
YVFCDATFCKVRVGAHVVSQ

SEQ ID NO: 1497030 - protein, 18 aa, Mycobacterium tuberculosis
AATHAALWAVDEAVNRDI

SEQ ID NO: 1497031 - protein, 18 aa, Mycobacterium tuberculosis
AENGRSWSRWSFIGAGAP

SEQ ID NO: 1497032 - protein, 17 aa, Mycobacterium tuberculosis
AGGKGWDGGPIGNGQVG

SEQ ID NO: 1497033 - protein, 17 aa, Mycobacterium tuberculosis
AHWLMPGQRAFQIATQL

SEQ ID NO: 1497034 - protein, 18 aa, Mycobacterium tuberculosis
AITLRALGVTHFSVGPII

SEQ ID NO: 1497035 - protein, 17 aa, Mycobacterium tuberculosis
ARKLPDWPTGPLPKVRV

SEQ ID NO: 1497036 - protein, 17 aa, Mycobacterium tuberculosis
ATLAFAFSHRSYLDGML

SEQ ID NO: 1497037 - protein, 24 aa, Mycobacterium tuberculosis
ATPLRPGIWRAYADHRMAMAGAII

SEQ ID NO: 1497038 - protein, 17 aa, Mycobacterium tuberculosis
CGRRRLGAIGAEIENAV

SEQ ID NO: 1497039 - protein, 20 aa, Mycobacterium tuberculosis
CPVCLGLPGSLPVLNRAAVE

SEQ ID NO: 1497040 - protein, 18 aa, Mycobacterium tuberculosis
DAFAHWRQAQGLPATAIA

SEQ ID NO: 1497041 - protein, 18 aa, Mycobacterium tuberculosis
DRYLPIWIGQSEAAAIAL

SEQ ID NO: 1497042 - protein, 19 aa, Mycobacterium tuberculosis
EPMCKRLVMSGGFYRAIQR

SEQ ID NO: 1497043 - protein, 19 aa, Mycobacterium tuberculosis
ERARNGLSIVIAPEGTRLD

SEQ ID NO: 1497044 - protein, 19 aa, Mycobacterium tuberculosis
FACRVWRPGQGTVRTTINL

SEQ ID NO: 1497045 - protein, 17 aa, Mycobacterium tuberculosis
FAIPPIGVGGFTLPQIT

SEQ ID NO: 1497046 - protein, 18 aa, Mycobacterium tuberculosis
FFGGPPVFNLGLANRGVV

SEQ ID NO: 1497047 - protein, 17 aa, Mycobacterium tuberculosis
FGGAPGFGNDTTAPSSG

SEQ ID NO: 1497048 - protein, 17 aa, Mycobacterium tuberculosis
FGGPPVFNLGLANRGVV

SEQ ID NO: 1497049 - protein, 17 aa, Mycobacterium tuberculosis
FGTSRWSSKLVHGGLRY

SEQ ID NO: 1497050 - protein, 25 aa, Mycobacterium tuberculosis
FIEDWAEIWPCAGMAYPKALADDLR

SEQ ID NO: 1497051 - protein, 25 aa, Mycobacterium tuberculosis
FLNGEARLPLALPTSATGGIPVTVE

SEQ ID NO: 1497052 - protein, 26 aa, Mycobacterium tuberculosis
FNNGFLWRGDHQGLIFGSPGFFNSTS

SEQ ID NO: 1497053 - protein, 17 aa, Mycobacterium tuberculosis
FPVGPLIPQTHLVHLRE

SEQ ID NO: 1497054 - protein, 18 aa, Mycobacterium tuberculosis
GAFPAWLAPVQVVGIPVA

SEQ ID NO: 1497055 - protein, 19 aa, Mycobacterium tuberculosis
GAVSFRFGDRTQINGVARD

SEQ ID NO: 1497056 - protein, 17 aa, Mycobacterium tuberculosis
GDQQGLFSAGYRVHVPE

SEQ ID NO: 1497057 - protein, 18 aa, Mycobacterium tuberculosis
GDQQGLFSAGYRVHVPEI

SEQ ID NO: 1497058 - protein, 17 aa, Mycobacterium tuberculosis
GGDGGNGGWLFGSGASG

SEQ ID NO: 1497059 - protein, 19 aa, Mycobacterium tuberculosis
GKGGGRLPITLWIVDTNAS

SEQ ID NO: 1497060 - protein, 18 aa, Mycobacterium tuberculosis
GLVIGSWPDPPGLVAASN

SEQ ID NO: 1497061 - protein, 26 aa, Mycobacterium tuberculosis
GNYSNGFWWRGDYQGLAGISQTITVP

SEQ ID NO: 1497062 - protein, 19 aa, Mycobacterium tuberculosis
GQRAHFGPITIPNITVVGP

SEQ ID NO: 1497063 - protein, 18 aa, Mycobacterium tuberculosis
GRIPIWLPPAKRLPDGLA

SEQ ID NO: 1497064 - protein, 24 aa, Mycobacterium tuberculosis
GRRCAPRVAIGWHTPIGDPLAVEG

SEQ ID NO: 1497065 - protein, 20 aa, Mycobacterium tuberculosis
GWCIADRRIGVITGEVGAGK

SEQ ID NO: 1497066 - protein, 18 aa, Mycobacterium tuberculosis
HAAICWPLLVGMAKAKYY

SEQ ID NO: 1497067 - protein, 19 aa, Mycobacterium tuberculosis
HAGGCPHPLVVVAGAATRW

SEQ ID NO: 1497068 - protein, 17 aa, Mycobacterium tuberculosis
HGAVHQCQWPKAVWAVI

SEQ ID NO: 1497069 - protein, 17 aa, Mycobacterium tuberculosis
IAIVGMSCRFPGGVDSP

SEQ ID NO: 1497070 - protein, 18 aa, Mycobacterium tuberculosis
IEAIKLVALVADRGAQVR

SEQ ID NO: 1497071 - protein, 19 aa, Mycobacterium tuberculosis
IFTKFNIPINIARVFHRDQ

SEQ ID NO: 1497072 - protein, 18 aa, Mycobacterium tuberculosis
IGLLARLGYRFAPTQIPG

SEQ ID NO: 1497073 - protein, 17 aa, Mycobacterium tuberculosis
IHAGEAFGLPSIHEAIA

SEQ ID NO: 1497074 - protein, 17 aa, Mycobacterium tuberculosis
ITLRALGVTHFSVGPII

SEQ ID NO: 1497075 - protein, 20 aa, Mycobacterium tuberculosis
KDPKRPSGSFIFAGPSGVGK

SEQ ID NO: 1497076 - protein, 20 aa, Mycobacterium tuberculosis
LAGTVLRFVPPLAALGSVPV

SEQ ID NO: 1497077 - protein, 22 aa, Mycobacterium tuberculosis
LAHEFDFRFLVGVLSVLGDKDV

SEQ ID NO: 1497078 - protein, 19 aa, Mycobacterium tuberculosis
LAPLRGGYIADITPLGGGA

SEQ ID NO: 1497079 - protein, 19 aa, Mycobacterium tuberculosis
LDPAGARLCVRPMSEFQSN

SEQ ID NO: 1497080 - protein, 18 aa, Mycobacterium tuberculosis
LKCLCRLHHLLATFCGWR

SEQ ID NO: 1497081 - protein, 19 aa, Mycobacterium tuberculosis
LKTSCAWAQARRDGQDPYP

SEQ ID NO: 1497082 - protein, 23 aa, Mycobacterium tuberculosis
LPVYRPPLDMARLFNQPELGPTD

SEQ ID NO: 1497083 - protein, 20 aa, Mycobacterium tuberculosis
LQWLGIDCIWLPPFYDSPLR

SEQ ID NO: 1497084 - protein, 18 aa, Mycobacterium tuberculosis
LRADACFVIGFGILRHIR

SEQ ID NO: 1497085 - protein, 27 aa, Mycobacterium tuberculosis
LRPEIWDEFTTRFGVARVCEFYAASEG

SEQ ID NO: 1497086 - protein, 18 aa, Mycobacterium tuberculosis
LRSLLRFVLDLLADYGLT

SEQ ID NO: 1497087 - protein, 20 aa, Mycobacterium tuberculosis
LSFRWSCRMGICGSSGMTIN

SEQ ID NO: 1497088 - protein, 21 aa, Mycobacterium tuberculosis
LTNRSTIRWTLHQMVASGVVS

SEQ ID NO: 1497089 - protein, 25 aa, Mycobacterium tuberculosis
LTSRPCPTCRGVGVVIPDPCQQCMG

SEQ ID NO: 1497090 - protein, 17 aa, Mycobacterium tuberculosis
LVEFRWELAVGDDPLSE

SEQ ID NO: 1497091 - protein, 18 aa, Mycobacterium tuberculosis
MARAVAPYLGWLISATAQ

SEQ ID NO: 1497092 - protein, 18 aa, Mycobacterium tuberculosis
PDIRCCILTGAGGYFCAG

SEQ ID NO: 1497093 - protein, 20 aa, Mycobacterium tuberculosis
PEFIGRLPVVASVTNLDKES

SEQ ID NO: 1497094 - protein, 19 aa, Mycobacterium tuberculosis
PEFRAAVVLCDIEGLSYEE

SEQ ID NO: 1497095 - protein, 18 aa, Mycobacterium tuberculosis
PRFVCALPKEFFAAVRAE

SEQ ID NO: 1497096 - protein, 19 aa, Mycobacterium tuberculosis
PRLLARNGLSLQDFDFYEI

SEQ ID NO: 1497097 - protein, 17 aa, Mycobacterium tuberculosis
PSGSFIFAGPSGVGKTE

SEQ ID NO: 1497098 - protein, 22 aa, Mycobacterium tuberculosis
QGRVALDWLDRVDVIGHSRSSG

SEQ ID NO: 1497099 - protein, 19 aa, Mycobacterium tuberculosis
QIAHCLAELVTLDTPTVSI

SEQ ID NO: 1497100 - protein, 17 aa, Mycobacterium tuberculosis
RAGGWLSQHCEPPYAPL

SEQ ID NO: 1497101 - protein, 18 aa, Mycobacterium tuberculosis
RDEGRWHVRWTTSGLHPK

SEQ ID NO: 1497102 - protein, 17 aa, Mycobacterium tuberculosis
REAFLALIRSNWLGLNA

SEQ ID NO: 1497103 - protein, 22 aa, Mycobacterium tuberculosis
RFNKPGTFPLRFQTEVRDGCPS

SEQ ID NO: 1497104 - protein, 20 aa, Mycobacterium tuberculosis
RIAGRLGLRADVRRVPLFGL

SEQ ID NO: 1497105 - protein, 20 aa, Mycobacterium tuberculosis
RLMFLKFRYRLGYESLCREV

SEQ ID NO: 1497106 - protein, 20 aa, Mycobacterium tuberculosis
RPDLLVSLLTYWQRHPSLSY

SEQ ID NO: 1497107 - protein, 17 aa, Mycobacterium tuberculosis
RRAGERFGFAVESMSLV

SEQ ID NO: 1497108 - protein, 17 aa, Mycobacterium tuberculosis
RTKRWPDVLAQFPEATQ

SEQ ID NO: 1497109 - protein, 17 aa, Mycobacterium tuberculosis
SADDFPCTEHMAYKIAQ

SEQ ID NO: 1497110 - protein, 25 aa, Mycobacterium tuberculosis
SPWGTWEWIGPPALGAVLPARGMAK

SEQ ID NO: 1497111 - protein, 20 aa, Mycobacterium tuberculosis
SRRIKLAWFLLNAARYMPAQ

SEQ ID NO: 1497112 - protein, 22 aa, Mycobacterium tuberculosis
TCHFVRPGWRLPRRTAESALRA

SEQ ID NO: 1497113 - protein, 24 aa, Mycobacterium tuberculosis
TGTVAYRFSWHLPKDRIWTYDGQL

SEQ ID NO: 1497114 - protein, 19 aa, Mycobacterium tuberculosis
THCNLDCPICFADSGHQPD

SEQ ID NO: 1497115 - protein, 17 aa, Mycobacterium tuberculosis
TLKKLSGLRARNGLLTA

SEQ ID NO: 1497116 - protein, 19 aa, Mycobacterium tuberculosis
TVVCAALASAARQAGIDVA

SEQ ID NO: 1497117 - protein, 19 aa, Mycobacterium tuberculosis
VDIAFTWDHFFPLYGDPDG

SEQ ID NO: 1497118 - protein, 21 aa, Mycobacterium tuberculosis
VEVLRLSALRGLFSAVIEDAV

SEQ ID NO: 1497119 - protein, 20 aa, Mycobacterium tuberculosis
VGFRWWTRCRALELGLTGYA

SEQ ID NO: 1497120 - protein, 17 aa, Mycobacterium tuberculosis
VLSQVPWLWAKFIGHAQ

SEQ ID NO: 1497121 - protein, 20 aa, Mycobacterium tuberculosis
VNQRWLGGMLTNFSTVHKRL

SEQ ID NO: 1497122 - protein, 17 aa, Mycobacterium tuberculosis
VRGAFCLTFMDENTLYA

SEQ ID NO: 1497123 - protein, 17 aa, Mycobacterium tuberculosis
VVSPGFIGAPLALAALG

SEQ ID NO: 1497124 - protein, 17 aa, Mycobacterium tuberculosis
VWIRGCLHQIPPAELVE

SEQ ID NO: 1497125 - protein, 18 aa, Mycobacterium tuberculosis
VYPPCSAFEAWFVSAALD

SEQ ID NO: 1497126 - protein, 17 aa, Mycobacterium tuberculosis
WAALRWVGENAAELGGD

SEQ ID NO: 1497127 - protein, 21 aa, Mycobacterium tuberculosis
WAGSLKRHGEWIVPTRLALVR

SEQ ID NO: 1497128 - protein, 19 aa, Mycobacterium tuberculosis
WPSKAELVLAAFIEGIRQV

SEQ ID NO: 1497129 - protein, 17 aa, Mycobacterium tuberculosis
WWTSPFVLAHGVPPDTL

SEQ ID NO: 1497130 - protein, 30 aa, Mycobacterium tuberculosis; identical to SEQ ID NO: 214497

SEQ ID NO: 1497131 - protein, 21 aa, Mycobacterium tuberculosis
YKSCFLAMVRRFYELGVKELN

SEQ ID NO: 1497132 - protein, 20 aa, Mycobacterium tuberculosis
YPRVIKRWRRGKPLADAETI

SEQ ID NO: 1497133 - protein, 19 aa, Mycobacterium tuberculosis
ADWPRLVAPVFDPKKAVVF

SEQ ID NO: 1497134 - protein, 17 aa, Mycobacterium tuberculosis
AGNWRYLADYAIGATLA

SEQ ID NO: 1497135 - protein, 24 aa, Mycobacterium tuberculosis
AGTGGRGGLLAGQHANSGNGGGGG

SEQ ID NO: 1497136 - protein, 18 aa, Mycobacterium tuberculosis
AIRPEFSANVAIDSFTVP

SEQ ID NO: 1497137 - protein, 20 aa, Mycobacterium tuberculosis
ALHEVVGWWAKLPVTGMQPV

SEQ ID NO: 1497138 - protein, 25 aa, Mycobacterium tuberculosis
ALWTGDYHGLVGFSFSIDIAGSTLL

SEQ ID NO: 1497139 - protein, 23 aa, Mycobacterium tuberculosis
AMVCAARGYRCVLTMPETMSLER

SEQ ID NO: 1497140 - protein, 19 aa, Mycobacterium tuberculosis
ANLRLVVSLAKRYTGRGMA

SEQ ID NO: 1497141 - protein, 18 aa, Mycobacterium tuberculosis
AQILAGFCDVALVIGADT

SEQ ID NO: 1497142 - protein, 25 aa, Mycobacterium tuberculosis
ARPPARLVGWTARFLGMVRPGDEVD

SEQ ID NO: 1497143 - protein, 18 aa, Mycobacterium tuberculosis
ARPTSTWTYMVNDNPLSD

SEQ ID NO: 1497144 - protein, 17 aa, Mycobacterium tuberculosis
ARRCAAQSWPLDRVKAV

SEQ ID NO: 1497145 - protein, 18 aa, Mycobacterium tuberculosis
CGRRRLGAIGAEIENAVA

SEQ ID NO: 1497146 - protein, 19 aa, Mycobacterium tuberculosis
DAHGVPFLGIRGMSDGPGD

SEQ ID NO: 1497147 - protein, 19 aa, Mycobacterium tuberculosis
DGKAKWSAPLGFLAQTPPA

SEQ ID NO: 1497148 - protein, 17 aa, Mycobacterium tuberculosis
DILERFYGLVLTDCGTG

SEQ ID NO: 1497149 - protein, 20 aa, Mycobacterium tuberculosis
DRHTAGWAMRELVVLHEVAH

SEQ ID NO: 1497150 - protein, 25 aa, Mycobacterium tuberculosis
DTGSFRWASVRGYRLAARLVEIGVD

SEQ ID NO: 1497151 - protein, 22 aa, Mycobacterium tuberculosis
DTRAYRLPWPPGTVVYEIDQPA

SEQ ID NO: 1497152 - protein, 19 aa, Mycobacterium tuberculosis
EANGDRYLPIWIGQSEAAA

SEQ ID NO: 1497153 - protein, 22 aa, Mycobacterium tuberculosis
EDWKCWARWRLIRARAPWLTRA

SEQ ID NO: 1497154 - protein, 17 aa, Mycobacterium tuberculosis
EGSLRFGDKVVLGRDNV

SEQ ID NO: 1497155 - protein, 18 aa, Mycobacterium tuberculosis
EHPDRFRAMIVERGNPAH

SEQ ID NO: 1497156 - protein, 22 aa, Mycobacterium tuberculosis
EIDNLRAAFAFSRENGDTGHAL

SEQ ID NO: 1497157 - protein, 17 aa, Mycobacterium tuberculosis
ENGRSWSRWSFIGAGAP

SEQ ID NO: 1497158 - protein, 17 aa, Mycobacterium tuberculosis
EPLRMARDLVRRGLDTV

SEQ ID NO: 1497159 - protein, 20 aa, Mycobacterium tuberculosis
EPMCKRLVMSGGFYRAIQRD

SEQ ID NO: 1497160 - protein, 18 aa, Mycobacterium tuberculosis
EQFSCWRIKLPHVEAAKF

SEQ ID NO: 1497161 - protein, 18 aa, Mycobacterium tuberculosis
ERGHPNWSKAFGYLPGPN

SEQ ID NO: 1497162 - protein, 22 aa, Mycobacterium tuberculosis
ESMSGRLIGKVALVSGGARGMG

SEQ ID NO: 1497163 - protein, 19 aa, Mycobacterium tuberculosis
EVVRALDMLFILHADHEQN

SEQ ID NO: 1497164 - protein, 17 aa, Mycobacterium tuberculosis
FGVPVPNLTAWRDATVG

SEQ ID NO: 1497165 - protein, 23 aa, Mycobacterium tuberculosis
FHEDPVAGVWAVGGVGGDGGSGG

SEQ ID NO: 1497166 - protein, 17 aa, Mycobacterium tuberculosis
FLPKRPLVEVLRDLASR

SEQ ID NO: 1497167 - protein, 25 aa, Mycobacterium tuberculosis
FNNGFLWRGDHQGLIFGSPGFFNST

SEQ ID NO: 1497168 - protein, 17 aa, Mycobacterium tuberculosis
FPIAAHYFAVFPLAKHM

SEQ ID NO: 1497169 - protein, 17 aa, Mycobacterium tuberculosis
GAGGLLFGNGGAGGPGA

SEQ ID NO: 1497170 - protein, 18 aa, Mycobacterium tuberculosis
GCADLHRSDRDAAWPAIA

SEQ ID NO: 1497171 - protein, 20 aa, Mycobacterium tuberculosis
GDPNNLLWRAFRPGTHVPII

SEQ ID NO: 1497172 - protein, 17 aa, Mycobacterium tuberculosis
GLYVHWIVTGIAPGSGS

SEQ ID NO: 1497173 - protein, 19 aa, Mycobacterium tuberculosis
GMAPEEWRAFAARASLHAA

SEQ ID NO: 1497174 - protein, 20 aa, Mycobacterium tuberculosis
GNFLSRSGAVGVLGIGPNNG

SEQ ID NO: 1497175 - protein, 21 aa, Mycobacterium tuberculosis
GNGAFWRGDQQGLFSAGYRVH

SEQ ID NO: 1497176 - protein, 17 aa, Mycobacterium tuberculosis
GRSGLRRNIRWDPLDSV

SEQ ID NO: 1497177 - protein, 22 aa, Mycobacterium tuberculosis
GSTMTLPLISMRFEGEDWILGS

SEQ ID NO: 1497178 - protein, 18 aa, Mycobacterium tuberculosis
GTGWRWRTWHLYPSASGG

SEQ ID NO: 1497179 - protein, 22 aa, Mycobacterium tuberculosis
GVRTNTWWLPAMQSLYETDYGP

SEQ ID NO: 1497180 - protein, 17 aa, Mycobacterium tuberculosis
GWRLPRRTAESALRASL

SEQ ID NO: 1497181 - protein, 17 aa, Mycobacterium tuberculosis
HWDRVGSGWPRPGRDGT

SEQ ID NO: 1497182 - protein, 17 aa, Mycobacterium tuberculosis
INSLRMYLGAGSAPMLQ

SEQ ID NO: 1497183 - protein, 21 aa, Mycobacterium tuberculosis
ISGGLPAFTLFAGGLTIPTNA

SEQ ID NO: 1497184 - protein, 20 aa, Mycobacterium tuberculosis
KAFRRTIKWRTGCEGRISHL

SEQ ID NO: 1497185 - protein, 19 aa, Mycobacterium tuberculosis
KHARLAIAVNDIYLSTVGG

SEQ ID NO: 1497186 - protein, 17 aa, Mycobacterium tuberculosis
KLGYPLSRAHTAAIIWS

SEQ ID NO: 1497187 - protein, 18 aa, Mycobacterium tuberculosis
KPFVRWLTDLCVQLSEVE

SEQ ID NO: 1497188 - protein, 17 aa, Mycobacterium tuberculosis
KPGMTLLDIGCGWGTTM

SEQ ID NO: 1497189 - protein, 19 aa, Mycobacterium tuberculosis
KWVGRCLECGRWGTVDEVA

SEQ ID NO: 1497190 - protein, 19 aa, Mycobacterium tuberculosis
LAAQGWVCLSIDYRVAPHH

SEQ ID NO: 1497191 - protein, 18 aa, Mycobacterium tuberculosis
LAPLRGGYIGDITPLGGG

SEQ ID NO: 1497192 - protein, 17 aa, Mycobacterium tuberculosis
LDWSGAPFAKWFVGGEL

SEQ ID NO: 1497193 - protein, 19 aa, Mycobacterium tuberculosis
LHHPCCGDLVYGADPKLAK

SEQ ID NO: 1497194 - protein, 18 aa, Mycobacterium tuberculosis
LLDFSFPVGPLIPQTHLV

SEQ ID NO: 1497195 - protein, 28 aa, Mycobacterium tuberculosis
LLGPVGDLFPILSIPGAMSQNFTNVVMT

SEQ ID NO: 1497196 - protein, 18 aa, Mycobacterium tuberculosis
LLIEVAWEALEDAGVPQH

SEQ ID NO: 1497197 - protein, 19 aa, Mycobacterium tuberculosis
LLSESGWYSALFGMQHETS

SEQ ID NO: 1497198 - protein, 17 aa, Mycobacterium tuberculosis
LPPEFRAAVVLCDIEGL

SEQ ID NO: 1497199 - protein, 22 aa, Mycobacterium tuberculosis
LPPEINSALMFAGAGPGPMLAA

SEQ ID NO: 1497200 - protein, 19 aa, Mycobacterium tuberculosis
LQHPDTFARLGVEPPRGVL

SEQ ID NO: 1497201 - protein, 27 aa, Mycobacterium tuberculosis
LRNPERVWGWYLWRHYLVANVEPNDGH

SEQ ID NO: 1497202 - protein, 19 aa, Mycobacterium tuberculosis
LRQVIGCVFQDFRLLQQKT

SEQ ID NO: 1497203 - protein, 19 aa, Mycobacterium tuberculosis
LSKLARPTSTWTYMVNDNP

SEQ ID NO: 1497204 - protein, 18 aa, Mycobacterium tuberculosis
LVEWSHPLGHRWRWEFES

SEQ ID NO: 1497205 - protein, 22 aa, Mycobacterium tuberculosis
NGLLWRADRQGLLAANYTITIE

SEQ ID NO: 1497206 - protein, 18 aa, Mycobacterium tuberculosis
NSLPGQWTAHVTLARRVG

SEQ ID NO: 1497207 - protein, 23 aa, Mycobacterium tuberculosis
NTQPWRWRVCPTSLELFSRPDMQ

SEQ ID NO: 1497208 - protein, 17 aa, Mycobacterium tuberculosis
PGSIALALGGPVTGGVT

SEQ ID NO: 1497209 - protein, 18 aa, Mycobacterium tuberculosis
PIWCFPKFDVPLPTAVRW

SEQ ID NO: 1497210 - protein, 17 aa, Mycobacterium tuberculosis
PLWECWIIEGLNGNRWA

SEQ ID NO: 1497211 - protein, 20 aa, Mycobacterium tuberculosis
PRALQGLALPTASQSASATP

SEQ ID NO: 1497212 - protein, 19 aa, Mycobacterium tuberculosis
PRLAELGGRFWFGLDDGRA

SEQ ID NO: 1497213 - protein, 26 aa, Mycobacterium tuberculosis
PVGGLLARFPGFYIPFLDVPFNGATP

SEQ ID NO: 1497214 - protein, 24 aa, Mycobacterium tuberculosis
PWGTWEWIGPPALGAVLPARGMAK

SEQ ID NO: 1497215 - protein, 18 aa, Mycobacterium tuberculosis
PYWYVYEHNLWPSREDAL

SEQ ID NO: 1497216 - protein, 18 aa, Mycobacterium tuberculosis
QAGGKGWDGGPIGNGQVG

SEQ ID NO: 1497217 - protein, 20 aa, Mycobacterium tuberculosis
QMPGGIYAPMMHPWSTGKDV

SEQ ID NO: 1497218 - protein, 19 aa, Mycobacterium tuberculosis
QQQCTDWAKALFRAVGPQR

SEQ ID NO: 1497219 - protein, 20 aa, Mycobacterium tuberculosis
RAAVRPEWPVLVAAIAEWAK

SEQ ID NO: 1497220 - protein, 18 aa, Mycobacterium tuberculosis
RARKLPDWPTGPLPKVRV

SEQ ID NO: 1497221 - protein, 20 aa, Mycobacterium tuberculosis
REALPLAERVDWLYAKASQH

SEQ ID NO: 1497222 - protein, 19 aa, Mycobacterium tuberculosis
RFADRFARFNLQERVIRPS

SEQ ID NO: 1497223 - protein, 19 aa, Mycobacterium tuberculosis
RGLTAMWRRGDEVFAEVAL

SEQ ID NO: 1497224 - protein, 18 aa, Mycobacterium tuberculosis
RHLFTVLMDREWKHGVAA

SEQ ID NO: 1497225 - protein, 17 aa, Mycobacterium tuberculosis
RIVSFDAAGGWNIEEEG

SEQ ID NO: 1497226 - protein, 19 aa, Mycobacterium tuberculosis
RLGTHAAIFTVPNFLELDY

SEQ ID NO: 1497227 - protein, 19 aa, Mycobacterium tuberculosis
RPDLLVSLLTYWQRHPSLS

SEQ ID NO: 1497228 - protein, 20 aa, Mycobacterium tuberculosis
RSDFPVLWPVGTRWADNDMF

SEQ ID NO: 1497229 - protein, 18 aa, Mycobacterium tuberculosis
RSGAVGVLGIGPNNGFPG

SEQ ID NO: 1497230 - protein, 18 aa, Mycobacterium tuberculosis
RTRSCPRLTDSIEHAVAE

SEQ ID NO: 1497231 - protein, 17 aa, Mycobacterium tuberculosis
SAHFVWVRDTLRLGGKF

SEQ ID NO: 1497232 - protein, 18 aa, Mycobacterium tuberculosis
SCRWALAAANLWQGNLEA

SEQ ID NO: 1497233 - protein, 23 aa, Mycobacterium tuberculosis
SDEWTDWRWNRILIEGSNCRDII

SEQ ID NO: 1497234 - protein, 17 aa, Mycobacterium tuberculosis
SERRLWLAVLRAQAELG

SEQ ID NO: 1497235 - protein, 20 aa, Mycobacterium tuberculosis
SGGLPAFTLFAGGLTIPTNA

SEQ ID NO: 1497236 - protein, 22 aa, Mycobacterium tuberculosis
SGVMWACVFMRTGARRVHFGEI

SEQ ID NO: 1497237 - protein, 19 aa, Mycobacterium tuberculosis
SGWPRPGRDGTRIRSMLPM

SEQ ID NO: 1497238 - protein, 19 aa, Mycobacterium tuberculosis
TARAYRAAAEFVPRIGALI

SEQ ID NO: 1497239 - protein, 17 aa, Mycobacterium tuberculosis
TAVMPFYPYARQDKKHR

SEQ ID NO: 1497240 - protein, 19 aa, Mycobacterium tuberculosis
TDVAARWPVPGPRDDKYTQ

SEQ ID NO: 1497241 - protein, 22 aa, Mycobacterium tuberculosis
TGLRPPRPGNFVMSFLDASIAP

SEQ ID NO: 1497242 - protein, 19 aa, Mycobacterium tuberculosis
TIRLPVHLVEQVNKLARIK

SEQ ID NO: 1497243 - protein, 21 aa, Mycobacterium tuberculosis
VAPWLDLVRKLGVLAGVLSDE

SEQ ID NO: 1497244 - protein, 19 aa, Mycobacterium tuberculosis
VCGGGDWRRAGIPARSAQF

SEQ ID NO: 1497245 - protein, 18 aa, Mycobacterium tuberculosis
VDGRPRRAAVSSFGISGT

SEQ ID NO: 1497246 - protein, 26 aa, Mycobacterium tuberculosis
VEAVWKPRERWGLGIDNIEYFRPTGE

SEQ ID NO: 1497247 - protein, 18 aa, Mycobacterium tuberculosis
VFETLAWGRRHVVMGANQ

SEQ ID NO: 1497248 - protein, 23 aa, Mycobacterium tuberculosis
VGGKGGASGMLIGNGGNGGSGGV

SEQ ID NO: 1497249 - protein, 21 aa, Mycobacterium tuberculosis
VGYAACHWCHVMAHESFDDDE

SEQ ID NO: 1497250 - protein, 20 aa, Mycobacterium tuberculosis
VIPVCTRLGLSPPDVRTLSK

SEQ ID NO: 1497251 - protein, 21 aa, Mycobacterium tuberculosis
VKLAEALGCVGLRCEREEDVV

SEQ ID NO: 1497252 - protein, 17 aa, Mycobacterium tuberculosis
VKLHVPIFLDIPVTGTL

SEQ ID NO: 1497253 - protein, 17 aa, Mycobacterium tuberculosis
VPDRHTAGWAMRELVVL

SEQ ID NO: 1497254 - protein, 21 aa, Mycobacterium tuberculosis
VQEVKLGLARPVWIDDRDFDI

SEQ ID NO: 1497255 - protein, 17 aa, Mycobacterium tuberculosis
VREAACYEIPDEEFGAL

SEQ ID NO: 1497256 - protein, 18 aa, Mycobacterium tuberculosis
WCIADRRIGVITGEVGAG

SEQ ID NO: 1497257 - protein, 17 aa, Mycobacterium tuberculosis
WDIFKCVRQVLDVLDRV

SEQ ID NO: 1497258 - protein, 20 aa, Mycobacterium tuberculosis
YHKIHLYDAFGFTESRTVAP

SEQ ID NO: 1497259 - protein, 18 aa, Mycobacterium tuberculosis
YLADYAIGATLAYPERVE

SEQ ID NO: 1497260 - protein, 17 aa, Mycobacterium tuberculosis
YRCGEAWSTLVHHRPSG

SEQ ID NO: 1497261 - protein, 22 aa, Mycobacterium tuberculosis
YRRMSLPDGRYVFTTRVIISAR

SEQ ID NO: 1497262 - protein, 17 aa, Mycobacterium tuberculosis
YYLEMPPALFAPIVENL

SEQ ID NO: 1497263 - protein, 18 aa, Mycobacterium tuberculosis
AALIGVGADEMWDIRNRG

SEQ ID NO: 1497264 - protein, 17 aa, Mycobacterium tuberculosis
AALRPIIDRAYQPGPAP

SEQ ID NO: 1497265 - protein, 17 aa, Mycobacterium tuberculosis
AGGKAGLLFGSGGAGGS

SEQ ID NO: 1497266 - protein, 18 aa, Mycobacterium tuberculosis
AKLGYPLSRAHTAAIIWS

SEQ ID NO: 1497267 - protein, 19 aa, Mycobacterium tuberculosis
AKPFVRWLTDLCVQLSEVE

SEQ ID NO: 1497268 - protein, 18 aa, Mycobacterium tuberculosis
ALLGRPLIGNGANGAPGT

SEQ ID NO: 1497269 - protein, 21 aa, Mycobacterium tuberculosis
ALWTGDYHGLVGFSFSIDIAG

SEQ ID NO: 1497270 - protein, 17 aa, Mycobacterium tuberculosis
APLPAFWVNIARKKILH

SEQ ID NO: 1497271 - protein, 18 aa, Mycobacterium tuberculosis
ARFLSVVLRRIRGMRSDT

SEQ ID NO: 1497272 - protein, 17 aa, Mycobacterium tuberculosis
ARMACPYLNPGRYVQGR

SEQ ID NO: 1497273 - protein, 22 aa, Mycobacterium tuberculosis
ASRRIKLAWFLLNAARYMGAGV

SEQ ID NO: 1497274 - protein, 17 aa, Mycobacterium tuberculosis
ASVTCGIGFADLSSFTA

SEQ ID NO: 1497275 - protein, 24 aa, Mycobacterium tuberculosis
AVGGVGGNGGWLYGNGGAGGLGGT

SEQ ID NO: 1497276 - protein, 19 aa, Mycobacterium tuberculosis
CAPLTWPEGWRRWPQRVYG

SEQ ID NO: 1497277 - protein, 17 aa, Mycobacterium tuberculosis
CKACHGVAILADNIEPI

SEQ ID NO: 1497278 - protein, 18 aa, Mycobacterium tuberculosis
CVDRMGFSFLANIGTASV

SEQ ID NO: 1497279 - protein, 19 aa, Mycobacterium tuberculosis
CWRIKLPHVEAAKFDAALQ

SEQ ID NO: 1497280 - protein, 19 aa, Mycobacterium tuberculosis
DAVRYSVRFAKPVLLPATA

SEQ ID NO: 1497281 - protein, 20 aa, Mycobacterium tuberculosis
DELRSLLRFVLDLLADYGLT

SEQ ID NO: 1497282 - protein, 17 aa, Mycobacterium tuberculosis
DPMLLAWTVPVVDLDPT

SEQ ID NO: 1497283 - protein, 17 aa, Mycobacterium tuberculosis
DRVGSGWPRPGRDGTRI

SEQ ID NO: 1497284 - protein, 17 aa, Mycobacterium tuberculosis
DVCPVEWARMANRSVLQ

SEQ ID NO: 1497285 - protein, 18 aa, Mycobacterium tuberculosis
ECRHVSAKWVGRCLECGR

SEQ ID NO: 1497286 - protein, 19 aa, Mycobacterium tuberculosis
EDKPFWWAHFDRLNYPVDE

SEQ ID NO: 1497287 - protein, 18 aa, Mycobacterium tuberculosis
EFAFSLVYEVSFGTPGEE

SEQ ID NO: 1497288 - protein, 26 aa, Mycobacterium tuberculosis
EPGETRFALVLSRLFWDAAIFHRACE

SEQ ID NO: 1497289 - protein, 27 aa, Mycobacterium tuberculosis
EYRGCYGLSVAALMKWHLPRLEVLVDA

SEQ ID NO: 1497290 - protein, 19 aa, Mycobacterium tuberculosis
FAAEAAFVFAMIAVDLSRL

SEQ ID NO: 1497291 - protein, 18 aa, Mycobacterium tuberculosis
FGVFCRRWGVPLIDGGTV

SEQ ID NO: 1497292 - protein, 17 aa, Mycobacterium tuberculosis
FPDAVRYSVRFAKPVLL

SEQ ID NO: 1497293 - protein, 17 aa, Mycobacterium tuberculosis
FPYRWWWVALTDEAFPR

SEQ ID NO: 1497294 - protein, 19 aa, Mycobacterium tuberculosis
FQPVRRFGWRIMPQNLSDA

SEQ ID NO: 1497295 - protein, 24 aa, Mycobacterium tuberculosis
GADWPRLVAPVFDPKKAVVFDDRW

SEQ ID NO: 1497296 - protein, 21 aa, Mycobacterium tuberculosis
GDARGGAALSVREVTGVPILF

SEQ ID NO: 1497297 - protein, 19 aa, Mycobacterium tuberculosis
GGNGGWLYGNGGLGGNGGA

SEQ ID NO: 1497298 - protein, 23 aa, Mycobacterium tuberculosis
GPESWGFTGWRWFSGTAPRYIRD

SEQ ID NO: 1497299 - protein, 19 aa, Mycobacterium tuberculosis
GQCTFSWPPRMELPGYKPN

SEQ ID NO: 1497300 - protein, 21 aa, Mycobacterium tuberculosis
GREALPLAERVDWLYAKASQH

SEQ ID NO: 1497301 - protein, 18 aa, Mycobacterium tuberculosis
GSFFPVIPVCSSTGVGTL

SEQ ID NO: 1497302 - protein, 19 aa, Mycobacterium tuberculosis
GSGLLPRMEPFVGELIGRG

SEQ ID NO: 1497303 - protein, 19 aa, Mycobacterium tuberculosis
HPDLFWALRGGGGGNFGVT

SEQ ID NO: 1497304 - protein, 20 aa, Mycobacterium tuberculosis
HPDLFWALRGGGGGNFGVTT

SEQ ID NO: 1497305 - protein, 18 aa, Mycobacterium tuberculosis
IAGRLGLRADVRRVPLFG

SEQ ID NO: 1497306 - protein, 18 aa, Mycobacterium tuberculosis
IEMADWWAYLNGVRKTYP

SEQ ID NO: 1497307 - protein, 18 aa, Mycobacterium tuberculosis
INPITLWPAQNFNQTITL

SEQ ID NO: 1497308 - protein, 17 aa, Mycobacterium tuberculosis
IPAIPIGLVLNGDIGPI

SEQ ID NO: 1497309 - protein, 17 aa, Mycobacterium tuberculosis
IPGAVKIDWHTDLNDPR

SEQ ID NO: 1497310 - protein, 19 aa, Mycobacterium tuberculosis
IRIDRFELLAARRRDQLID

SEQ ID NO: 1497311 - protein, 23 aa, Mycobacterium tuberculosis
ISTNARMLIQFGFIERLAVAGDR

SEQ ID NO: 1497312 - protein, 24 aa, Mycobacterium tuberculosis
IVDEPFMLPAHIDFAALKVKFDGG

SEQ ID NO: 1497313 - protein, 19 aa, Mycobacterium tuberculosis
KEAGWWRLGLAEEIGGMPA

SEQ ID NO: 1497314 - protein, 19 aa, Mycobacterium tuberculosis
KESLRLLAHEVMPRLNARL

SEQ ID NO: 1497315 - protein, 18 aa, Mycobacterium tuberculosis
KLQKRLTEELAWVRSGAK

SEQ ID NO: 1497316 - protein, 21 aa, Mycobacterium tuberculosis
KPSRVPVWFMRQAGRSLPEYR

SEQ ID NO: 1497317 - protein, 20 aa, Mycobacterium tuberculosis
KRLTEELAWVRSGAKARQAK

SEQ ID NO: 1497318 - protein, 23 aa, Mycobacterium tuberculosis
LCETFPTCLERGAGIPAVERLAY

SEQ ID NO: 1497319 - protein, 21 aa, Mycobacterium tuberculosis
LCPQCGVPLASEPGHRHEQID

SEQ ID NO: 1497320 - protein, 23 aa, Mycobacterium tuberculosis
LDIPRVPVTLNYLFGSQPGGPLK

SEQ ID NO: 1497321 - protein, 18 aa, Mycobacterium tuberculosis
LGEPWRAVHVGDELPLAE

SEQ ID NO: 1497322 - protein, 17 aa, Mycobacterium tuberculosis
LGQRCAPVFVMAAPGQP

SEQ ID NO: 1497323 - protein, 18 aa, Mycobacterium tuberculosis
LLGGLAVMFGDLPPLPTT

SEQ ID NO: 1497324 - protein, 17 aa, Mycobacterium tuberculosis
LLRACAKLGVRLVHSTP

SEQ ID NO: 1497325 - protein, 23 aa, Mycobacterium tuberculosis
LNGEARLPLALPTSATGGIPVTV

SEQ ID NO: 1497326 - protein, 17 aa, Mycobacterium tuberculosis
LPPGAIWQVIAIGKANM

SEQ ID NO: 1497327 - protein, 20 aa, Mycobacterium tuberculosis
LQPRLPAVMDRLDRAIPRGV

SEQ ID NO: 1497328 - protein, 17 aa, Mycobacterium tuberculosis
LRLAYRLLSPMLRVLPF

SEQ ID NO: 1497329 - protein, 18 aa, Mycobacterium tuberculosis
LRPWVPVVSLVKGLEQGT

SEQ ID NO: 1497330 - protein, 22 aa, Mycobacterium tuberculosis
NGVLWRGDYQGLLGFSSGANVL

SEQ ID NO: 1497331 - protein, 18 aa, Mycobacterium tuberculosis
NLRIARVLYDFVNNEALP

SEQ ID NO: 1497332 - protein, 17 aa, Mycobacterium tuberculosis
NLTDVHIGWVFTRTVRN

SEQ ID NO: 1497333 - protein, 19 aa, Mycobacterium tuberculosis
NVGRIVVHLAPWLEPQPIC

SEQ ID NO: 1497334 - protein, 18 aa, Mycobacterium tuberculosis
PDDVLPAIAFAVAHTGKP

SEQ ID NO: 1497335 - protein, 19 aa, Mycobacterium tuberculosis
PGTEISIADVLRCIDGPLA

SEQ ID NO: 1497336 - protein, 20 aa, Mycobacterium tuberculosis
PHLGGWAVVSGVLHWRHSGK

SEQ ID NO: 1497337 - protein, 20 aa, Mycobacterium tuberculosis
PKLRQGSYFPDWLLQRRKRA

SEQ ID NO: 1497338 - protein, 18 aa, Mycobacterium tuberculosis
PSDSVAIALRVGVPIYVE

SEQ ID NO: 1497339 - protein, 19 aa, Mycobacterium tuberculosis
PVAEYWPEFGANGKSEVTV

SEQ ID NO: 1497340 - protein, 22 aa, Mycobacterium tuberculosis
QCVKAEMLAASSWRVAVNAGAD

SEQ ID NO: 1497341 - protein, 19 aa, Mycobacterium tuberculosis
QFVKRLGTHAAIFTVPNFL

SEQ ID NO: 1497342 - protein, 17 aa, Mycobacterium tuberculosis
QLLLRVGIFSWITHAPK

SEQ ID NO: 1497343 - protein, 17 aa, Mycobacterium tuberculosis
QSQVVAWWAPTFDEVNG

SEQ ID NO: 1497344 - protein, 19 aa, Mycobacterium tuberculosis
RAGLPDGEFFGVIAQLPGA

SEQ ID NO: 1497345 - protein, 17 aa, Mycobacterium tuberculosis
RDAALCLAVLRVGADPE

SEQ ID NO: 1497346 - protein, 19 aa, Mycobacterium tuberculosis
RMHLLRLASEFGLTPAAEQ

SEQ ID NO: 1497347 - protein, 19 aa, Mycobacterium tuberculosis
RPDLRRWLPLDVYRPLKST

SEQ ID NO: 1497348 - protein, 19 aa, Mycobacterium tuberculosis
RPIADVCPVEWARMANRSV

SEQ ID NO: 1497349 - protein, 17 aa, Mycobacterium tuberculosis
RRPPAFPEDIWVPERDP

SEQ ID NO: 1497350 - protein, 18 aa, Mycobacterium tuberculosis
RTERFWVGLSVYRPGGTA

SEQ ID NO: 1497351 - protein, 18 aa, Mycobacterium tuberculosis
RVAHCIYAGLATDTGSFR

SEQ ID NO: 1497352 - protein, 26 aa, Mycobacterium tuberculosis
RWSALLVGAWWPARPDAPMAGVTYWR

SEQ ID NO: 1497353 - protein, 23 aa, Mycobacterium tuberculosis
SLPPEFRAAVVLCDIEGLSYEEI

SEQ ID NO: 1497354 - protein, 18 aa, Mycobacterium tuberculosis
SPVTGLVFVTNFDSNTVS

SEQ ID NO: 1497355 - protein, 18 aa, Mycobacterium tuberculosis
SQAIARLFSDYATHYQSL

SEQ ID NO: 1497356 - protein, 18 aa, Mycobacterium tuberculosis
STAIAALFGSHGQHYQAI

SEQ ID NO: 1497357 - protein, 18 aa, Mycobacterium tuberculosis
TAVGDWMLLAAIEALIDE

SEQ ID NO: 1497358 - protein, 18 aa, Mycobacterium tuberculosis
THRPSWPAGIAVGKTVVS

SEQ ID NO: 1497359 - protein, 23 aa, Mycobacterium tuberculosis
TPRCGLCPLDWCAWRHAGYPPSD

SEQ ID NO: 1497360 - protein, 17 aa, Mycobacterium tuberculosis
TPRMRIGIHTGRPQRLA

SEQ ID NO: 1497361 - protein, 25 aa, Mycobacterium tuberculosis
VAAYQQRFVLALSQAGSTYAVAEAA

SEQ ID NO: 1497362 - protein, 20 aa, Mycobacterium tuberculosis
VFPGGCFFAAAAADVDSQPG

SEQ ID NO: 1497363 - protein, 19 aa, Mycobacterium tuberculosis
VFWPIPRVYSGLVRIDRYE

SEQ ID NO: 1497364 - protein, 22 aa, Mycobacterium tuberculosis
VPDRHTAGWAMRELVVLHEVAH

SEQ ID NO: 1497365 - protein, 23 aa, Mycobacterium tuberculosis
VPLVGGLWFRFLHSVKAGIKDSL

SEQ ID NO: 1497366 - protein, 22 aa, Mycobacterium tuberculosis
VQRYEVVDLLSLLADKSLVVTD

SEQ ID NO: 1497367 - protein, 20 aa, Mycobacterium tuberculosis
VSPVTGLVFVTNFDSNTVSV

SEQ ID NO: 1497368 - protein, 20 aa, Mycobacterium tuberculosis
VSTAIAALFGSHGQHYQAIS

SEQ ID NO: 1497369 - protein, 18 aa, Mycobacterium tuberculosis
VTCGIGFADLSSFTALTQ

SEQ ID NO: 1497370 - protein, 17 aa, Mycobacterium tuberculosis
VVCLSRLVPRKGQDTLV

SEQ ID NO: 1497371 - protein, 17 aa, Mycobacterium tuberculosis
VYPPCSAFEAWFVSAAL

SEQ ID NO: 1497372 - protein, 18 aa, Mycobacterium tuberculosis
WGVPGLSWLPGEDPDPFG

SEQ ID NO: 1497373 - protein, 18 aa, Mycobacterium tuberculosis
WLAFTFELCRQRIMDPST

SEQ ID NO: 1497374 - protein, 18 aa, Mycobacterium tuberculosis
WLEPGQWWALVRVGCAGQ

SEQ ID NO: 1497375 - protein, 20 aa, Mycobacterium tuberculosis
WPRFVCALPKEFFAAVRAEL

SEQ ID NO: 1497376 - protein, 20 aa, Mycobacterium tuberculosis
WPSKAELVLAAFIEGIRQVA

SEQ ID NO: 1497377 - protein, 17 aa, Mycobacterium tuberculosis
WQCDGCSITHQRDDNAA

SEQ ID NO: 1497378 - protein, 17 aa, Mycobacterium tuberculosis
WSAPRLHLVDLQYSDVR

SEQ ID NO: 1497379 - protein, 20 aa, Mycobacterium tuberculosis
YKEFYKHVAHAWDDPLEIIA

SEQ ID NO: 1497380 - protein, 18 aa, Mycobacterium tuberculosis
YREYSLRPPKGVLLYGPP

SEQ ID NO: 1497381 - protein, 17 aa, Mycobacterium tuberculosis
AELRYGRIPEVEKKLDA

SEQ ID NO: 1497382 - protein, 17 aa, Mycobacterium tuberculosis
AGGCPHPLVVVAGAATR

SEQ ID NO: 1497383 - protein, 18 aa, Mycobacterium tuberculosis
AGGFTLDGLGGWFIDGVQ

SEQ ID NO: 1497384 - protein, 23 aa, Mycobacterium tuberculosis
AGGNGGRGGMLIGNGGAGGAGGT

SEQ ID NO: 1497385 - protein, 19 aa, Mycobacterium tuberculosis
AKACARIMLGATIAQLRAE

SEQ ID NO: 1497386 - protein, 19 aa, Mycobacterium tuberculosis
ALIELCGLLGYDARRDTDP

SEQ ID NO: 1497387 - protein, 25 aa, Mycobacterium tuberculosis
ALNARAATFHAEFVSLLNGGAAAYT

SEQ ID NO: 1497388 - protein, 18 aa, Mycobacterium tuberculosis
ALPPRFQASAAFAANLST

SEQ ID NO: 1497389 - protein, 20 aa, Mycobacterium tuberculosis
AMFDGRFVGFADFLIRDGHR

SEQ ID NO: 1497390 - protein, 17 aa, Mycobacterium tuberculosis
AMHFVPSLLGLFLSLPG

SEQ ID NO: 1497391 - protein, 24 aa, Mycobacterium tuberculosis
APERLRSGWLNGIKHWQVDYTGRC

SEQ ID NO: 1497392 - protein, 28 aa, Mycobacterium tuberculosis
APSRSLPLLECWTALAALCRDTTKLRLG

SEQ ID NO: 1497393 - protein, 19 aa, Mycobacterium tuberculosis
APYNDIVSWNWTELPSALG

SEQ ID NO: 1497394 - protein, 17 aa, Mycobacterium tuberculosis
ARFLLGLVVSTGVGGGL

SEQ ID NO: 1497395 - protein, 22 aa, Mycobacterium tuberculosis
ASWYRAVVISMRLPQRRHAVNR

SEQ ID NO: 1497396 - protein, 26 aa, Mycobacterium tuberculosis
AVPNYRGSCWIPFSIELEGDAASFVG

SEQ ID NO: 1497397 - protein, 18 aa, Mycobacterium tuberculosis
CAECHLDAPMVNRALAGA

SEQ ID NO: 1497398 - protein, 17 aa, Mycobacterium tuberculosis
DFVRWKKLRGGIGALTT

SEQ ID NO: 1497399 - protein, 19 aa, Mycobacterium tuberculosis
DFWCDAEWAGLRGPVAAGL

SEQ ID NO: 1497400 - protein, 17 aa, Mycobacterium tuberculosis
DGVVRPVVFLAYSGQAR

SEQ ID NO: 1497401 - protein, 18 aa, Mycobacterium tuberculosis
DLQDIIAILGIDELSEED

SEQ ID NO: 1497402 - protein, 17 aa, Mycobacterium tuberculosis
DNPDRWAPPYAEAGAYN

SEQ ID NO: 1497403 - protein, 25 aa, Mycobacterium tuberculosis
DPYQAFVLMAAWLAMRYGELTELRR

SEQ ID NO: 1497404 - protein, 17 aa, Mycobacterium tuberculosis
DTDRVTLFRAWYSRRNF

SEQ ID NO: 1497405 - protein, 17 aa, Mycobacterium tuberculosis
DVQRLPLNVTWVNLTTG

SEQ ID NO: 1497406 - protein, 17 aa, Mycobacterium tuberculosis
DYALVCGGGDWRRAGIP

SEQ ID NO: 1497407 - protein, 21 aa, Mycobacterium tuberculosis
EFRCARCGVPYTDALPEMPEP

SEQ ID NO: 1497408 - protein, 21 aa, Mycobacterium tuberculosis
EIDNLRAAFAFSRENGDTGHA

SEQ ID NO: 1497409 - protein, 18 aa, Mycobacterium tuberculosis
ELLLKWKKTPQRPVSLPL

SEQ ID NO: 1497410 - protein, 19 aa, Mycobacterium tuberculosis
ELMPLPIALAHRLSRRLTE

SEQ ID NO: 1497411 - protein, 21 aa, Mycobacterium tuberculosis
ETMVIPPIVFLPSMTIGGQTY

SEQ ID NO: 1497412 - protein, 26 aa, Mycobacterium tuberculosis
EYRGCYGLSVAALMKWHLPRLEVLVD

SEQ ID NO: 1497413 - protein, 22 aa, Mycobacterium tuberculosis
FDNWPLGWGFDHFWGFPSGAAG

SEQ ID NO: 1497414 - protein, 17 aa, Mycobacterium tuberculosis
FLGRFPLGLIHPFPKPS

SEQ ID NO: 1497415 - protein, 17 aa, Mycobacterium tuberculosis
FNLSLWSAYNVMLMHTV

SEQ ID NO: 1497416 - protein, 17 aa, Mycobacterium tuberculosis
GADEMWDIRNRGVIPAG

SEQ ID NO: 1497417 - protein, 17 aa, Mycobacterium tuberculosis
GCSFPNCDVPGYLTEVH

SEQ ID NO: 1497418 - protein, 17 aa, Mycobacterium tuberculosis
GCSICWHGPAGTPTMSV

SEQ ID NO: 1497419 - protein, 18 aa, Mycobacterium tuberculosis
GDDTAIWRRIRVVPFEVV

SEQ ID NO: 1497420 - protein, 20 aa, Mycobacterium tuberculosis
GECVALLFERCAPAVVAMVA

SEQ ID NO: 1497421 - protein, 23 aa, Mycobacterium tuberculosis
GGAGGRGGLLIGDGGAGGAGGVG

SEQ ID NO: 1497422 - protein, 17 aa, Mycobacterium tuberculosis
GGALGVLGGMGGDGGDG

SEQ ID NO: 1497423 - protein, 20 aa, Mycobacterium tuberculosis
GIHVFLRIATDWDFVEVRRA

SEQ ID NO: 1497424 - protein, 20 aa, Mycobacterium tuberculosis
GKGGSGLGVGGAGGTGGAGG

SEQ ID NO: 1497425 - protein, 20 aa, Mycobacterium tuberculosis
GLLWRADRQGLLAANYTITI

SEQ ID NO: 1497426 - protein, 17 aa, Mycobacterium tuberculosis
GSYRWLRPSGRRTAKEI

SEQ ID NO: 1497427 - protein, 17 aa, Mycobacterium tuberculosis
GVELGRGAVIVVNLSGR

SEQ ID NO: 1497428 - protein, 18 aa, Mycobacterium tuberculosis
GYCGYLLYNLTTSGFRPA

SEQ ID NO: 1497429 - protein, 18 aa, Mycobacterium tuberculosis
HLGGWAVVSGVLHWRHSG

SEQ ID NO: 1497430 - protein, 17 aa, Mycobacterium tuberculosis
HLLRYPLPAAWCTDVDV

SEQ ID NO: 1497431 - protein, 22 aa, Mycobacterium tuberculosis
HSPKRLESELTWIEEHTGGKPY

SEQ ID NO: 1497432 - protein, 25 aa, Mycobacterium tuberculosis
IDVSGGLPAFTLFPGGLNIPQNAIP

SEQ ID NO: 1497433 - protein, 19 aa, Mycobacterium tuberculosis
IERYRAATLMARVRAAKGM

SEQ ID NO: 1497434 - protein, 20 aa, Mycobacterium tuberculosis
IERYRAATLMARVRAAKGMK

SEQ ID NO: 1497435 - protein, 18 aa, Mycobacterium tuberculosis
IGPGGLFLALPGARADGH

SEQ ID NO: 1497436 - protein, 17 aa, Mycobacterium tuberculosis
IGSFFLPAFNIPGIDVP

SEQ ID NO: 1497437 - protein, 17 aa, Mycobacterium tuberculosis
INSIKWARDETGIIPTA

SEQ ID NO: 1497438 - protein, 18 aa, Mycobacterium tuberculosis
ITAVMPFYPYARQDKKHR

SEQ ID NO: 1497439 - protein, 23 aa, Mycobacterium tuberculosis
KDPKRPSGSFIFAGPSGVGKTEL

SEQ ID NO: 1497440 - protein, 24 aa, Mycobacterium tuberculosis
KKFRFPTFLGAFKYYTSYTLKTFD

SEQ ID NO: 1497441 - protein, 24 aa, Mycobacterium tuberculosis
KPPKVVSQRGWRHWVHALTRINLG

SEQ ID NO: 1497442 - protein, 17 aa, Mycobacterium tuberculosis
LADRLAVNRGLAPVADV

SEQ ID NO: 1497443 - protein, 20 aa, Mycobacterium tuberculosis
LAKACARIMLGATIAQLRAE

SEQ ID NO: 1497444 - protein, 17 aa, Mycobacterium tuberculosis
LAQRLALAAGRRLDDAQ

SEQ ID NO: 1497445 - protein, 20 aa, Mycobacterium tuberculosis
LCGALRRYHEALGVPISTLP

SEQ ID NO: 1497446 - protein, 17 aa, Mycobacterium tuberculosis
LDRKNCWTIAEHRGDTT

SEQ ID NO: 1497447 - protein, 19 aa, Mycobacterium tuberculosis
LEYHWGPDWVCWDADQTFQ

SEQ ID NO: 1497448 - protein, 23 aa, Mycobacterium tuberculosis
LGAPGARVLLVWDAPNLDMGLGS

SEQ ID NO: 1497449 - protein, 17 aa, Mycobacterium tuberculosis
LKCLCRLHHLLATFCGW

SEQ ID NO: 1497450 - protein, 17 aa, Mycobacterium tuberculosis
LLELSWEALERAGIDPT

SEQ ID NO: 1497451 - protein, 17 aa, Mycobacterium tuberculosis
LLGGLAVMFGDLPPLPT

SEQ ID NO: 1497452 - protein, 17 aa, Mycobacterium tuberculosis
LLKIWNERNYRFWADLT

SEQ ID NO: 1497453 - protein, 19 aa, Mycobacterium tuberculosis
LLTGWRDAWELGRAARDNS

SEQ ID NO: 1497454 - protein, 19 aa, Mycobacterium tuberculosis
LPEGSGFEFLDKVVGGAVP

SEQ ID NO: 1497455 - protein, 20 aa, Mycobacterium tuberculosis
LPFPLSSAILPRFFYTKEIG

SEQ ID NO: 1497456 - protein, 18 aa, Mycobacterium tuberculosis
LRSILAPECAARAREIST

SEQ ID NO: 1497457 - protein, 23 aa, Mycobacterium tuberculosis
LRWGEYRAGGLARARWGLLEPPE

SEQ ID NO: 1497458 - protein, 17 aa, Mycobacterium tuberculosis
LWFDALRSVAVDHRDGP

SEQ ID NO: 1497459 - protein, 18 aa, Mycobacterium tuberculosis
MLPHNAVEYFVSYYDYYQ

SEQ ID NO: 1497460 - protein, 17 aa, Mycobacterium tuberculosis
MPPALFAPIVENLANVR

SEQ ID NO: 1497461 - protein, 18 aa, Mycobacterium tuberculosis
MRAGTVALVIREDRGWAV

SEQ ID NO: 1497462 - protein, 17 aa, Mycobacterium tuberculosis
MVRRLPPGAIWQVIAIG

SEQ ID NO: 1497463 - protein, 21 aa, Mycobacterium tuberculosis
NEAICPWCIADGSAASRFDAT

SEQ ID NO: 1497464 - protein, 17 aa, Mycobacterium tuberculosis
NLVEYGFRLPSACDNRP

SEQ ID NO: 1497465 - protein, 18 aa, Mycobacterium tuberculosis
NLVEYGFRLPSACDNRPL

SEQ ID NO: 1497466 - protein, 19 aa, Mycobacterium tuberculosis
NPLRFLRAAMKWCRKAQEL

SEQ ID NO: 1497467 - protein, 24 aa, Mycobacterium tuberculosis
NYSNGVLWRGDYQGLIGADIALEI

SEQ ID NO: 1497468 - protein, 18 aa, Mycobacterium tuberculosis
PERQYYWFGEPIDTTEFM

SEQ ID NO: 1497469 - protein, 18 aa, Mycobacterium tuberculosis
PGHPEFRHTPGVEITTGP

SEQ ID NO: 1497470 - protein, 20 aa, Mycobacterium tuberculosis
PLKTSCAWAQARRDGQDPYP

SEQ ID NO: 1497471 - protein, 22 aa, Mycobacterium tuberculosis
PLLPEVAWSWLVDALTARTDQV

SEQ ID NO: 1497472 - protein, 19 aa, Mycobacterium tuberculosis
PPGTIGEIWVHGDNVAGGY

SEQ ID NO: 1497473 - protein, 20 aa, Mycobacterium tuberculosis
PRGGRRLFVFLGSTIGNLTP

SEQ ID NO: 1497474 - protein, 17 aa, Mycobacterium tuberculosis
PRIPRIWNITSLPSEMA

SEQ ID NO: 1497475 - protein, 19 aa, Mycobacterium tuberculosis
PVPRPERQYYWFGEPIDTT

SEQ ID NO: 1497476 - protein, 19 aa, Mycobacterium tuberculosis
QDGHWRLGPAITELATHVD

SEQ ID NO: 1497477 - protein, 25 aa, Mycobacterium tuberculosis
QDGILTIVGFAWRGDHVQILDSLPE

SEQ ID NO: 1497478 - protein, 18 aa, Mycobacterium tuberculosis
QEPGLSWAAGLRDNGQTT

SEQ ID NO: 1497479 - protein, 19 aa, Mycobacterium tuberculosis
QTGFARTGAMFACEHEGPD

SEQ ID NO: 1497480 - protein, 17 aa, Mycobacterium tuberculosis
QTVARWLVLYLRRPGGQ

SEQ ID NO: 1497481 - protein, 19 aa, Mycobacterium tuberculosis
RAAPGVRRPRAWCSRIGRW

SEQ ID NO: 1497482 - protein, 20 aa, Mycobacterium tuberculosis
RELRSAGAVFGLLDVDDEFF

SEQ ID NO: 1497483 - protein, 20 aa, Mycobacterium tuberculosis
REMLPHNAVEYFVSYYDYYQ

SEQ ID NO: 1497484 - protein, 17 aa, Mycobacterium tuberculosis
RFLSVVLRRIRGMRSDT

SEQ ID NO: 1497485 - protein, 18 aa, Mycobacterium tuberculosis
RGHEWKFAITKNGRHSLT

SEQ ID NO: 1497486 - protein, 17 aa, Mycobacterium tuberculosis
RGMAARNRLDIVAALQN

SEQ ID NO: 1497487 - protein, 18 aa, Mycobacterium tuberculosis
RIPAERWVYPQAGTDAHD

SEQ ID NO: 1497488 - protein, 17 aa, Mycobacterium tuberculosis
RIRVVPFEVVIPADEQD

SEQ ID NO: 1497489 - protein, 17 aa, Mycobacterium tuberculosis
RLETEWPARQLVDDRWV

SEQ ID NO: 1497490 - protein, 17 aa, Mycobacterium tuberculosis
RLGEVGRAFVVARPGTG

SEQ ID NO: 1497491 - protein, 18 aa, Mycobacterium tuberculosis
RLLPALGFRVRFGVLVIR

SEQ ID NO: 1497492 - protein, 21 aa, Mycobacterium tuberculosis
RLQRLRLPWWHLWRAAEAAGA

SEQ ID NO: 1497493 - protein, 18 aa, Mycobacterium tuberculosis
RLRELRAAQSLTQVQVAA

SEQ ID NO: 1497494 - protein, 20 aa, Mycobacterium tuberculosis
RLRPAMLEFMDSVAINAVED

SEQ ID NO: 1497495 - protein, 17 aa, Mycobacterium tuberculosis
RMTWRSCRAGDFIDICN

SEQ ID NO: 1497496 - protein, 17 aa, Mycobacterium tuberculosis
RPPPAPRLTFRPADSAA

SEQ ID NO: 1497497 - protein, 25 aa, Mycobacterium tuberculosis
RRPTGQRGFFAWFRVGSDVLVRNAF

SEQ ID NO: 1497498 - protein, 20 aa, Mycobacterium tuberculosis
RRRGRRGRGRGRGEQGGSDG

SEQ ID NO: 1497499 - protein, 19 aa, Mycobacterium tuberculosis
RVSRRLVAMLARRGYGQTL

SEQ ID NO: 1497500 - protein, 21 aa, Mycobacterium tuberculosis
RWSALLVGAWWPARPDAPMAG

SEQ ID NO: 1497501 - protein, 18 aa, Mycobacterium tuberculosis
RWSAVLVGPWWPAPSAAL

SEQ ID NO: 1497502 - protein, 19 aa, Mycobacterium tuberculosis
RYLALEWLDRMDLVNGKLI

SEQ ID NO: 1497503 - protein, 21 aa, Mycobacterium tuberculosis
SAAVSRLFGAYGQQFQALNAR

SEQ ID NO: 1497504 - protein, 20 aa, Mycobacterium tuberculosis
SALNRPAMRFERPVLAIAAT

SEQ ID NO: 1497505 - protein, 20 aa, Mycobacterium tuberculosis
SFGFKYGLPMDADMVMDVRF

SEQ ID NO: 1497506 - protein, 25 aa, Mycobacterium tuberculosis
SGGIRGPLGLGFRVPCIVISPYSRG

SEQ ID NO: 1497507 - protein, 18 aa, Mycobacterium tuberculosis
SGGLACFGEAIPAQAIAQ

SEQ ID NO: 1497508 - protein, 23 aa, Mycobacterium tuberculosis
SPAELACALGLFPPTAEQAAVIA

SEQ ID NO: 1497509 - protein, 19 aa, Mycobacterium tuberculosis
SRAVSWWSVHEHVAPVLDA

SEQ ID NO: 1497510 - protein, 18 aa, Mycobacterium tuberculosis
SRIYTDFTYRSGSTTIST

SEQ ID NO: 1497511 - protein, 19 aa, Mycobacterium tuberculosis
SRKAFGGDGGVGGDGASAL

SEQ ID NO: 1497512 - protein, 17 aa, Mycobacterium tuberculosis
SSFYRPTQPGSYPIVLA

SEQ ID NO: 1497513 - protein, 17 aa, Mycobacterium tuberculosis
SSVPILGPYEDLIANTV

SEQ ID NO: 1497514 - protein, 24 aa, Mycobacterium tuberculosis
SVLPPEINSALMFAGAGPGPMLAA

SEQ ID NO: 1497515 - protein, 19 aa, Mycobacterium tuberculosis
TLLGRPLIGNGTNGAPGTG

SEQ ID NO: 1497516 - protein, 19 aa, Mycobacterium tuberculosis
TRSSAGFGAPRYGAKPIVV

SEQ ID NO: 1497517 - protein, 17 aa, Mycobacterium tuberculosis
TTQRFGVPMGFGGPHAG

SEQ ID NO: 1497518 - protein, 22 aa, Mycobacterium tuberculosis
TVPVGILCLEFLVHAWDFAIAT

SEQ ID NO: 1497519 - protein, 17 aa, Mycobacterium tuberculosis
VAPYVAWMRATAIQAEQ

SEQ ID NO: 1497520 - protein, 23 aa, Mycobacterium tuberculosis
VAVRRISMSFVNVAPQLVSTAAA

SEQ ID NO: 1497521 - protein, 17 aa, Mycobacterium tuberculosis
VEWSHPLGHRWRWEFES

SEQ ID NO: 1497522 - protein, 18 aa, Mycobacterium tuberculosis
VPHSWNLPPAVRQVAAMF

SEQ ID NO: 1497523 - protein, 20 aa, Mycobacterium tuberculosis
VSAAVASLFSGHAQAYQTLG

SEQ ID NO: 1497524 - protein, 17 aa, Mycobacterium tuberculosis
VTVEVPVGGILAPLQPF

SEQ ID NO: 1497525 - protein, 24 aa, Mycobacterium tuberculosis
WCVISIRSDDEWRRATSVFGQPEL

SEQ ID NO: 1497526 - protein, 18 aa, Mycobacterium tuberculosis
WWAAYALWVFTLFGHADV

SEQ ID NO: 1497527 - protein, 17 aa, Mycobacterium tuberculosis
YELARPGTEISIADVLR

SEQ ID NO: 1497528 - protein, 19 aa, Mycobacterium tuberculosis
YHGLVGFSFSIDIAGSTLL

SEQ ID NO: 1497529 - protein, 17 aa, Mycobacterium tuberculosis
YPSHELTAVGDWMLLAA

SEQ ID NO: 1497530 - protein, 21 aa, Mycobacterium tuberculosis
YRPTQPGSYPIVLATYEIVCS

SEQ ID NO: 1497531 - protein, 18 aa, Mycobacterium tuberculosis
YVKTPAQVLLRWNLQLGN

SEQ ID NO: 1497532 - protein, 18 aa, Mycobacterium tuberculosis
AAKLRLAVLAGRLRAAGV

SEQ ID NO: 1497533 - protein, 17 aa, Mycobacterium tuberculosis
AALPFKRRLFGQIVAAA

SEQ ID NO: 1497534 - protein, 22 aa, Mycobacterium tuberculosis
AAYQQRFVLALSQAGSTYAVAE

SEQ ID NO: 1497535 - protein, 17 aa, Mycobacterium tuberculosis
ADIEACWNLGATVAAQL

SEQ ID NO: 1497536 - protein, 18 aa, Mycobacterium tuberculosis
AEIREFLEGYVIGQDTAK

SEQ ID NO: 1497537 - protein, 20 aa, Mycobacterium tuberculosis
AENRAELMILIATNLLGQNT

SEQ ID NO: 1497538 - protein, 17 aa, Mycobacterium tuberculosis
AEVLKLINWELASSQSG

SEQ ID NO: 1497539 - protein, 21 aa, Mycobacterium tuberculosis
AEVWRRGSVIGSWLLDLTAIA

SEQ ID NO: 1497540 - protein, 20 aa, Mycobacterium tuberculosis
AGGAGGWLIGQSGSTGGGGA

SEQ ID NO: 1497541 - protein, 23 aa, Mycobacterium tuberculosis
AGGRGGAGGLGFGSEAPGRPGGA

SEQ ID NO: 1497542 - protein, 18 aa, Mycobacterium tuberculosis
AHRPRPGYLPVLRAYDYA

SEQ ID NO: 1497543 - protein, 17 aa, Mycobacterium tuberculosis
AIPEIALTFGVDIPIHI

SEQ ID NO: 1497544 - protein, 18 aa, Mycobacterium tuberculosis
AKACARIMLGATIAQLRA

SEQ ID NO: 1497545 - protein, 22 aa, Mycobacterium tuberculosis
ALSTARFEFRWNDQFALSLDPD

SEQ ID NO: 1497546 - protein, 20 aa, Mycobacterium tuberculosis
ALVDRWAPGRVMLNAYGPTE

SEQ ID NO: 1497547 - protein, 17 aa, Mycobacterium tuberculosis
ALYRLLMSWGVRPGLVL

SEQ ID NO: 1497548 - protein, 17 aa, Mycobacterium tuberculosis
AMLKRQLQLLLPLVEDR

SEQ ID NO: 1497549 - protein, 18 aa, Mycobacterium tuberculosis
AQLAPWAQAVRALPNPTA

SEQ ID NO: 1497550 - protein, 24 aa, Mycobacterium tuberculosis
AQVVPWASLLQRFPGLGAGATGAT

SEQ ID NO: 1497551 - protein, 17 aa, Mycobacterium tuberculosis
ARFSRPLAFGTAGLRGH

SEQ ID NO: 1497552 - protein, 22 aa, Mycobacterium tuberculosis
ARLAELLVRYRVGVQAVQTVEL

SEQ ID NO: 1497553 - protein, 23 aa, Mycobacterium tuberculosis
ARYLFRRVVSWGRSSNVFLRNGA

SEQ ID NO: 1497554 - protein, 18 aa, Mycobacterium tuberculosis
AVAGWRGAPRPVLARELL

SEQ ID NO: 1497555 - protein, 22 aa, Mycobacterium tuberculosis
AVYRLAWAALRGCPTSSVRTAF

SEQ ID NO: 1497556 - protein, 20 aa, Mycobacterium tuberculosis
CAAQSWPLDRVKAVKDAAGV

SEQ ID NO: 1497557 - protein, 19 aa, Mycobacterium tuberculosis
CATYPVLAVQAWAAFHDMT

SEQ ID NO: 1497558 - protein, 18 aa, Mycobacterium tuberculosis
CGPPGMLEAVRVARNQHA

SEQ ID NO: 1497559 - protein, 17 aa, Mycobacterium tuberculosis
CPGLCPQCGVPLASEPG

SEQ ID NO: 1497560 - protein, 21 aa, Mycobacterium tuberculosis
CRDLLHWRFCRGVPPRATNDT

SEQ ID NO: 1497561 - protein, 19 aa, Mycobacterium tuberculosis
CRTPTIAAVQGWCIGGAVD

SEQ ID NO: 1497562 - protein, 21 aa, Mycobacterium tuberculosis
CYSLRIASAMAHDEGWLAEHM

SEQ ID NO: 1497563 - protein, 21 aa, Mycobacterium tuberculosis
DAIRHAVAWARPGDVVLIAGK

SEQ ID NO: 1497564 - protein, 17 aa, Mycobacterium tuberculosis
DEFLRWLAGVRFTGDVW

SEQ ID NO: 1497565 - protein, 19 aa, Mycobacterium tuberculosis
DFTLPGERIHVVFRSDESG

SEQ ID NO: 1497566 - protein, 18 aa, Mycobacterium tuberculosis
DFVGALIYLLSDASSFYT

SEQ ID NO: 1497567 - protein, 29 aa, Mycobacterium tuberculosis
DFWFDPLCPWCWITSRWILEVAKVRDIEV

SEQ ID NO: 1497568 - protein, 21 aa, Mycobacterium tuberculosis
DGGPGGAAFGLGNGGNGGNGG

SEQ ID NO: 1497569 - protein, 21 aa, Mycobacterium tuberculosis
DIVSWNWTELPSALGVTNHLA

SEQ ID NO: 1497570 - protein, 19 aa, Mycobacterium tuberculosis
DNLRHTVRFAAAVQAALED

SEQ ID NO: 1497571 - protein, 18 aa, Mycobacterium tuberculosis
DPMLLAWTVPVVDLDPTA

SEQ ID NO: 1497572 - protein, 17 aa, Mycobacterium tuberculosis
DRFKAISQRGTHYKVIE

SEQ ID NO: 1497573 - protein, 19 aa, Mycobacterium tuberculosis
DRHTAGWAMRELVVLHEVA

SEQ ID NO: 1497574 - protein, 17 aa, Mycobacterium tuberculosis
DRMQFCSEFEWIAPSGR

SEQ ID NO: 1497575 - protein, 17 aa, Mycobacterium tuberculosis
DRVGIAWLRHTCGVCKY

SEQ ID NO: 1497576 - protein, 20 aa, Mycobacterium tuberculosis
DVGCGWGATMMRAVEKYDVN

SEQ ID NO: 1497577 - protein, 17 aa, Mycobacterium tuberculosis
DVKRFRGFDNWEGDAAT

SEQ ID NO: 1497578 - protein, 19 aa, Mycobacterium tuberculosis
DVKRFRGFDNWEGDAATAC

SEQ ID NO: 1497579 - protein, 20 aa, Mycobacterium tuberculosis
EALTSLPGVGVWTAAETTQR

SEQ ID NO: 1497580 - protein, 19 aa, Mycobacterium tuberculosis
EFLSAAATDLANLGSTISA

SEQ ID NO: 1497581 - protein, 20 aa, Mycobacterium tuberculosis
EFTEGIGFDKGFLSAYFVTD

SEQ ID NO: 1497582 - protein, 18 aa, Mycobacterium tuberculosis
EGSLRFGDKVVLGRDNVI

SEQ ID NO: 1497583 - protein, 19 aa, Mycobacterium tuberculosis
EHPDRFRAMIVERGNPAHS

SEQ ID NO: 1497584 - protein, 17 aa, Mycobacterium tuberculosis
EHPSVCLLASWVPPDTP

SEQ ID NO: 1497585 - protein, 20 aa, Mycobacterium tuberculosis
EIYVPFSWFEPMWLENLGFA

SEQ ID NO: 1497586 - protein, 22 aa, Mycobacterium tuberculosis
ELDGLRLITWRGASRAEQGLPF

SEQ ID NO: 1497587 - protein, 20 aa, Mycobacterium tuberculosis
ELLPQVFRWARTVDPVQPLT

SEQ ID NO: 1497588 - protein, 20 aa, Mycobacterium tuberculosis
EMGGPFSLELCGGTHVSNTA

SEQ ID NO: 1497589 - protein, 17 aa, Mycobacterium tuberculosis
EPLPRIGLDSLPEQGAW

SEQ ID NO: 1497590 - protein, 21 aa, Mycobacterium tuberculosis
ERFRYGFAIAPELVRTVLRDN

SEQ ID NO: 1497591 - protein, 17 aa, Mycobacterium tuberculosis
FAAEAAFVFAMIAVDLS

SEQ ID NO: 1497592 - protein, 18 aa, Mycobacterium tuberculosis
FAIPPIGVGGFTLPQITT

SEQ ID NO: 1497593 - protein, 20 aa, Mycobacterium tuberculosis
FAPRCPLVIDECLTAEPELL

SEQ ID NO: 1497594 - protein, 17 aa, Mycobacterium tuberculosis
FELRPGQALVITVPVSD

SEQ ID NO: 1497595 - protein, 24 aa, Mycobacterium tuberculosis
FGGSGGRGGLLLGTGGAGGDGGVG

SEQ ID NO: 1497596 - protein, 19 aa, Mycobacterium tuberculosis
FLGGLRFAGAQVVPIRVYR

SEQ ID NO: 1497597 - protein, 23 aa, Mycobacterium tuberculosis
FLSGDYQGLVGLNLVIDMPLPIS

SEQ ID NO: 1497598 - protein, 19 aa, Mycobacterium tuberculosis
FLVDCGRGVLQRAAAVGVG

SEQ ID NO: 1497599 - protein, 17 aa, Mycobacterium tuberculosis
FPAPVPVGSRVRATSSL

SEQ ID NO: 1497600 - protein, 17 aa, Mycobacterium tuberculosis
FPRLMVYRGPRRKGVRY

SEQ ID NO: 1497601 - protein, 17 aa, Mycobacterium tuberculosis
FQASAAFAANLSTINTL

SEQ ID NO: 1497602 - protein, 18 aa, Mycobacterium tuberculosis
FRAAAGIYRAARRAGETV

SEQ ID NO: 1497603 - protein, 19 aa, Mycobacterium tuberculosis
FWSEMPEVFHALDADREVR

SEQ ID NO: 1497604 - protein, 26 aa, Mycobacterium tuberculosis
GAAGGVGGRGGWLLGNGGTGGAGGAA

SEQ ID NO: 1497605 - protein, 20 aa, Mycobacterium tuberculosis
GAELLVEIARFWVGLAKLDD

SEQ ID NO: 1497606 - protein, 17 aa, Mycobacterium tuberculosis
GDGGILWGNGGNGGDST

SEQ ID NO: 1497607 - protein, 20 aa, Mycobacterium tuberculosis
GDVKRFRGFDNWEGDAATAC

SEQ ID NO: 1497608 - protein, 17 aa, Mycobacterium tuberculosis
GELLRLARVLGIAATRD

SEQ ID NO: 1497609 - protein, 19 aa, Mycobacterium tuberculosis
GFDISARMGAAISDAAPQL

SEQ ID NO: 1497610 - protein, 19 aa, Mycobacterium tuberculosis
GFGELRWALSGAAPIPKET

SEQ ID NO: 1497611 - protein, 23 aa, Mycobacterium tuberculosis
GGAGGNGAWLFGNGGAGGGGGKG

SEQ ID NO: 1497612 - protein, 21 aa, Mycobacterium tuberculosis
GGAGMNSLDPLLAAQDGGQGG

SEQ ID NO: 1497613 - protein, 18 aa, Mycobacterium tuberculosis
GGAGPLLIGNGGVGGLGG

SEQ ID NO: 1497614 - protein, 22 aa, Mycobacterium tuberculosis
GGGMCFTFLAAQGFSVGTSLLE

SEQ ID NO: 1497615 - protein, 17 aa, Mycobacterium tuberculosis
GGIGVNTGTGWAYGGNG

SEQ ID NO: 1497616 - protein, 22 aa, Mycobacterium tuberculosis
GGNGGHGGLWIGNGGDGGAGGV

SEQ ID NO: 1497617 - protein, 22 aa, Mycobacterium tuberculosis
GHCRGVCLGGYLLQGGYGWNSR

SEQ ID NO: 1497618 - protein, 17 aa, Mycobacterium tuberculosis
GIGKRGAERMVLELRDK

SEQ ID NO: 1497619 - protein, 17 aa, Mycobacterium tuberculosis
GKAGLLFGSGGAGGSGG

SEQ ID NO: 1497620 - protein, 21 aa, Mycobacterium tuberculosis
GKRYALPHARILMHQPLGGVT

SEQ ID NO: 1497621 - protein, 18 aa, Mycobacterium tuberculosis
GLPAGGWTRGRAVLAVVD

SEQ ID NO: 1497622 - protein, 19 aa, Mycobacterium tuberculosis
GLSSPVILGIGIGGAGGDG

SEQ ID NO: 1497623 - protein, 20 aa, Mycobacterium tuberculosis
GNGAFWRGDQQGLFSAGYRV

SEQ ID NO: 1497624 - protein, 19 aa, Mycobacterium tuberculosis
GNGGNAWLTGQGGNGGNAA

SEQ ID NO: 1497625 - protein, 17 aa, Mycobacterium tuberculosis
GNGGWLYGNGGLGGNGG

SEQ ID NO: 1497626 - protein, 20 aa, Mycobacterium tuberculosis
GQIAHCLAELVTLDTPTVSI

SEQ ID NO: 1497627 - protein, 19 aa, Mycobacterium tuberculosis
GRPQFSAVLECASAARQLG

SEQ ID NO: 1497628 - protein, 17 aa, Mycobacterium tuberculosis
GRPVLVGGLGGRGVVAG

SEQ ID NO: 1497629 - protein, 17 aa, Mycobacterium tuberculosis
GRWHWHWDPAMMTAPGH

SEQ ID NO: 1497630 - protein, 18 aa, Mycobacterium tuberculosis
GSGGLGGLLFGQTGTAGV

SEQ ID NO: 1497631 - protein, 18 aa, Mycobacterium tuberculosis
GSMIIQFVVKTLVAMLDW

SEQ ID NO: 1497632 - protein, 18 aa, Mycobacterium tuberculosis
GSTHAFGGMPLMGSGAGR

SEQ ID NO: 1497633 - protein, 18 aa, Mycobacterium tuberculosis
GSVIGSWLLDLTAIALRE

SEQ ID NO: 1497634 - protein, 21 aa, Mycobacterium tuberculosis
GVLWRGDYQGLLGFSSGANVL

SEQ ID NO: 1497635 - protein, 18 aa, Mycobacterium tuberculosis
GVRRFALRPVIGIDPAAV

SEQ ID NO: 1497636 - protein, 19 aa, Mycobacterium tuberculosis
HGAVHQCQWPKAVWAVIDN

SEQ ID NO: 1497637 - protein, 22 aa, Mycobacterium tuberculosis
HIESRPAVTLSWIREFPSLGAA

SEQ ID NO: 1497638 - protein, 18 aa, Mycobacterium tuberculosis
HTPLPLLAFTAWPEVRSQ

SEQ ID NO: 1497639 - protein, 21 aa, Mycobacterium tuberculosis
HYHKIHLYDAFGFTESRTVAP

SEQ ID NO: 1497640 - protein, 19 aa, Mycobacterium tuberculosis
IANGSFAPSFVGFGGNGGN

SEQ ID NO: 1497641 - protein, 24 aa, Mycobacterium tuberculosis
IARYNARCGRTFVLPNEQAAYDAC

SEQ ID NO: 1497642 - protein, 20 aa, Mycobacterium tuberculosis
IEKMRVAGRIAAGALAEAGK

SEQ ID NO: 1497643 - protein, 20 aa, Mycobacterium tuberculosis
IKINPITLWPAQNFNQTITL

SEQ ID NO: 1497644 - protein, 18 aa, Mycobacterium tuberculosis
IPCSAPLPAPRVSPYPAV

SEQ ID NO: 1497645 - protein, 22 aa, Mycobacterium tuberculosis
IPVKRLRQAGVLDLLLALANET

SEQ ID NO: 1497646 - protein, 18 aa, Mycobacterium tuberculosis
ISRALTLLAELWSRYHNV

SEQ ID NO: 1497647 - protein, 17 aa, Mycobacterium tuberculosis
IWCFPKFDVPLPTAVRW

SEQ ID NO: 1497648 - protein, 18 aa, Mycobacterium tuberculosis
KAATFLVEYARKYRQTIA

SEQ ID NO: 1497649 - protein, 25 aa, Mycobacterium tuberculosis
KPPKVVSQRGWRHWVHALTRINLGL

SEQ ID NO: 1497650 - protein, 20 aa, Mycobacterium tuberculosis
KPSRVPVWFMRQAGRSLPEY

SEQ ID NO: 1497651 - protein, 21 aa, Mycobacterium tuberculosis
KRAFSEPVALNWAADGTDVDF

SEQ ID NO: 1497652 - protein, 17 aa, Mycobacterium tuberculosis
KRFRGFDNWEGDAATAC

SEQ ID NO: 1497653 - protein, 23 aa, Mycobacterium tuberculosis
LAARLPLAYALGWQGRGREADAV

SEQ ID NO: 1497654 - protein, 17 aa, Mycobacterium tuberculosis
LAAWRLGAGRSRPGARV

SEQ ID NO: 1497655 - protein, 17 aa, Mycobacterium tuberculosis
LAKILAGFGYRVQESAF

SEQ ID NO: 1497656 - protein, 17 aa, Mycobacterium tuberculosis
LASEFGLTPAAEQRLAV

SEQ ID NO: 1497657 - protein, 19 aa, Mycobacterium tuberculosis
LCETFPTCLERGAGIPAVE

SEQ ID NO: 1497658 - protein, 22 aa, Mycobacterium tuberculosis
LDLCPRVRVNAIAPGSILTSAL

SEQ ID NO: 1497659 - protein, 18 aa, Mycobacterium tuberculosis
LDPKIGLPDIRAVLTAVV

SEQ ID NO: 1497660 - protein, 19 aa, Mycobacterium tuberculosis
LDVGCGWGGMVRYAARRGV

SEQ ID NO: 1497661 - protein, 17 aa, Mycobacterium tuberculosis
LELARTWVGLAGTMTTL

SEQ ID NO: 1497662 - protein, 18 aa, Mycobacterium tuberculosis
LGDYDVLVGINLLREGLD

SEQ ID NO: 1497663 - protein, 20 aa, Mycobacterium tuberculosis
LGKGGGRLPITLWIVDTNAS

SEQ ID NO: 1497664 - protein, 18 aa, Mycobacterium tuberculosis
LKSLRWAWNRAKDDVAPW

SEQ ID NO: 1497665 - protein, 19 aa, Mycobacterium tuberculosis
LLDRVSSKYALVIYAAKRA

SEQ ID NO: 1497666 - protein, 22 aa, Mycobacterium tuberculosis
LLGKPAVLWFWAPWCPTCQGEA

SEQ ID NO: 1497667 - protein, 19 aa, Mycobacterium tuberculosis
LMFLKFRYRLGYESLCREV

SEQ ID NO: 1497668 - protein, 17 aa, Mycobacterium tuberculosis
LMRSGERPMVWSLDERL

SEQ ID NO: 1497669 - protein, 24 aa, Mycobacterium tuberculosis
LNARAATFHAEFVSLLNGGAAAYT

SEQ ID NO: 1497670 - protein, 20 aa, Mycobacterium tuberculosis
LNLKEWKAEWGVADPREARG

SEQ ID NO: 1497671 - protein, 18 aa, Mycobacterium tuberculosis
LPAMVCYWSELARDIVLP

SEQ ID NO: 1497672 - protein, 22 aa, Mycobacterium tuberculosis
LPLPHLRAWDGAPWIWNLATAI

SEQ ID NO: 1497673 - protein, 20 aa, Mycobacterium tuberculosis
LQVAEAFGRYGAYLSQLNVL

SEQ ID NO: 1497674 - protein, 21 aa, Mycobacterium tuberculosis
LQWLGIDCIWLPPFYDSPLRD

SEQ ID NO: 1497675 - protein, 17 aa, Mycobacterium tuberculosis
LRLASEFGLTPAAEQRL

SEQ ID NO: 1497676 - protein, 21 aa, Mycobacterium tuberculosis
LRPAQYLPWHPGRCAQVFVGE

SEQ ID NO: 1497677 - protein, 19 aa, Mycobacterium tuberculosis
LRPGEWRTLGLFAADDNGE

SEQ ID NO: 1497678 - protein, 17 aa, Mycobacterium tuberculosis
LSWSAPRLHLVDLQYSD

SEQ ID NO: 1497679 - protein, 23 aa, Mycobacterium tuberculosis
LVEGRVALTIPADWSTQRVVSGP

SEQ ID NO: 1497680 - protein, 20 aa, Mycobacterium tuberculosis
LVEWSHPLGHRWRWEFESLS

SEQ ID NO: 1497681 - protein, 20 aa, Mycobacterium tuberculosis
MAEPKWVLAMGVCASSGGMF

SEQ ID NO: 1497682 - protein, 20 aa, Mycobacterium tuberculosis
MTYLQWLRRYVELAIGEGNS

SEQ ID NO: 1497683 - protein, 17 aa, Mycobacterium tuberculosis
NASPMQAVLDVVNGPTQ

SEQ ID NO: 1497684 - protein, 19 aa, Mycobacterium tuberculosis
NIAPWLRAAHRYGAKVKWA

SEQ ID NO: 1497685 - protein, 26 aa, Mycobacterium tuberculosis
NLTGVMTFGLPLAMTLNAVGSPITTA

SEQ ID NO: 1497686 - protein, 20 aa, Mycobacterium tuberculosis
PAAVVPWDFDGDGLPMSVQL

SEQ ID NO: 1497687 - protein, 23 aa, Mycobacterium tuberculosis
PAIQPKLTFTWRIMPQNLSDAGI

SEQ ID NO: 1497688 - protein, 18 aa, Mycobacterium tuberculosis
PAPHVKPAALAEQPGVPG

SEQ ID NO: 1497689 - protein, 25 aa, Mycobacterium tuberculosis
PAPPPFRLPLLFVNALGDNWIVGAS

SEQ ID NO: 1497690 - protein, 19 aa, Mycobacterium tuberculosis
PAWGMYCGYELFEHRAVRE

SEQ ID NO: 1497691 - protein, 18 aa, Mycobacterium tuberculosis
PDAVRHWNVDKADLDGLL

SEQ ID NO: 1497692 - protein, 23 aa, Mycobacterium tuberculosis
PDPGKWAGFELHRDVTVTEEFTL

SEQ ID NO: 1497693 - protein, 19 aa, Mycobacterium tuberculosis
PEALRAFGIRECADAARAL

SEQ ID NO: 1497694 - protein, 17 aa, Mycobacterium tuberculosis
PEPMVKMLLNNVLEHLA

SEQ ID NO: 1497695 - protein, 22 aa, Mycobacterium tuberculosis
PFQATAVIPVIGPVTVTLEGTP

SEQ ID NO: 1497696 - protein, 19 aa, Mycobacterium tuberculosis
PHLGGWAVVSGVLHWRHSG

SEQ ID NO: 1497697 - protein, 24 aa, Mycobacterium tuberculosis
PIAKELPMEYALELNRLIELQMEG

SEQ ID NO: 1497698 - protein, 23 aa, Mycobacterium tuberculosis
PQRGRISTWPLPEAFNGVTVNGV

SEQ ID NO: 1497699 - protein, 18 aa, Mycobacterium tuberculosis
PSSGVAFVLGERLGRVDV

SEQ ID NO: 1497700 - protein, 20 aa, Mycobacterium tuberculosis
PVGILCLEFLVHAWDFAIAT

SEQ ID NO: 1497701 - protein, 22 aa, Mycobacterium tuberculosis
QAGALPALFSGLARRPRRRQID

SEQ ID NO: 1497702 - protein, 18 aa, Mycobacterium tuberculosis
QIAHCLAELVTLDTPTVS

SEQ ID NO: 1497703 - protein, 21 aa, Mycobacterium tuberculosis
QLSGLRLGKVISISEASGAAP

SEQ ID NO: 1497704 - protein, 18 aa, Mycobacterium tuberculosis
QRAHFGPITIPNITVVGP

SEQ ID NO: 1497705 - protein, 20 aa, Mycobacterium tuberculosis
QTLLGRPLIGNGADGSTPGQ

SEQ ID NO: 1497706 - protein, 24 aa, Mycobacterium tuberculosis
RARGRLQEGLAWFAAALADHDAHP

SEQ ID NO: 1497707 - protein, 17 aa, Mycobacterium tuberculosis
RATLIVRESACLDVEDR

SEQ ID NO: 1497708 - protein, 18 aa, Mycobacterium tuberculosis
RAVHRCLLAGRFATALGA

SEQ ID NO: 1497709 - protein, 17 aa, Mycobacterium tuberculosis
RDGPRPTLCVIHGFMGS

SEQ ID NO: 1497710 - protein, 17 aa, Mycobacterium tuberculosis
RFACDYALLAVPYLTLR

SEQ ID NO: 1497711 - protein, 18 aa, Mycobacterium tuberculosis
RFLIHTARIAYVEIGVAD

SEQ ID NO: 1497712 - protein, 18 aa, Mycobacterium tuberculosis
RFRILPTLWEPGGDEITL

SEQ ID NO: 1497713 - protein, 18 aa, Mycobacterium tuberculosis
RFVREFPFNLMLWDLDRR

SEQ ID NO: 1497714 - protein, 17 aa, Mycobacterium tuberculosis
RGLTAMWRRGDEVFAEV

SEQ ID NO: 1497715 - protein, 19 aa, Mycobacterium tuberculosis
RGRPVLVGGLGGRGVVAGA

SEQ ID NO: 1497716 - protein, 22 aa, Mycobacterium tuberculosis
RKEVFRLRLASGREVEATGSHP

SEQ ID NO: 1497717 - protein, 19 aa, Mycobacterium tuberculosis
RLGDYDVLVGINLLREGLD

SEQ ID NO: 1497718 - protein, 19 aa, Mycobacterium tuberculosis
RPGQKLRIVKYLAYGWSSL

SEQ ID NO: 1497719 - protein, 17 aa, Mycobacterium tuberculosis
RPMLDRALTVLIDAPEP

SEQ ID NO: 1497720 - protein, 17 aa, Mycobacterium tuberculosis
RPSMVPWVISARSAEAL

SEQ ID NO: 1497721 - protein, 19 aa, Mycobacterium tuberculosis
RRFTAKLSYRGRAFATVPI

SEQ ID NO: 1497722 - protein, 26 aa, Mycobacterium tuberculosis
RSDLARYGIAPAYPWDFIRDVINNTL

SEQ ID NO: 1497723 - protein, 18 aa, Mycobacterium tuberculosis
RSRFGFLAIHGGGLEQVT

SEQ ID NO: 1497724 - protein, 19 aa, Mycobacterium tuberculosis
RTALALHHLVCTRFRSDAL

SEQ ID NO: 1497725 - protein, 23 aa, Mycobacterium tuberculosis
RTIVELCALWAVHLHFDPSPEPW

SEQ ID NO: 1497726 - protein, 17 aa, Mycobacterium tuberculosis
RVLLCLPDSPDLVQLLL

SEQ ID NO: 1497727 - protein, 23 aa, Mycobacterium tuberculosis
RYIAKYTICPAIAHGMDHLIGSV

SEQ ID NO: 1497728 - protein, 21 aa, Mycobacterium tuberculosis
SAQFPRPAPRPSYSALSSRQW

SEQ ID NO: 1497729 - protein, 26 aa, Mycobacterium tuberculosis
SGFERFPAWMWRNTVVRDFVEWLRTR

SEQ ID NO: 1497730 - protein, 19 aa, Mycobacterium tuberculosis
SIQREWQWRLSRGESLQNL

SEQ ID NO: 1497731 - protein, 21 aa, Mycobacterium tuberculosis
SKMNRFFLRGALVARLLSQSA

SEQ ID NO: 1497732 - protein, 22 aa, Mycobacterium tuberculosis
SKNPKEHFDFFPLTVDVEERMY

SEQ ID NO: 1497733 - protein, 25 aa, Mycobacterium tuberculosis
SLEEVLIRAGIPYKVVGGVRFYERK

SEQ ID NO: 1497734 - protein, 18 aa, Mycobacterium tuberculosis
SQANFVWLPLGSRTQDFV

SEQ ID NO: 1497735 - protein, 17 aa, Mycobacterium tuberculosis
SSIGALSVPPSWAGQAN

SEQ ID NO: 1497736 - protein, 20 aa, Mycobacterium tuberculosis
STSSIPFDAHGGNGGAGGDA

SEQ ID NO: 1497737 - protein, 20 aa, Mycobacterium tuberculosis
SYPTAMLMVFKLHRDFDIAE

SEQ ID NO: 1497738 - protein, 18 aa, Mycobacterium tuberculosis
TGQPAAVVPWDFDGDGLP

SEQ ID NO: 1497739 - protein, 20 aa, Mycobacterium tuberculosis
TNRSTIRWTLHQMVASGVVS

SEQ ID NO: 1497740 - protein, 28 aa, Mycobacterium tuberculosis
TVHGFRFPEITGDIFLIGIPFNAATLDA

SEQ ID NO: 1497741 - protein, 18 aa, Mycobacterium tuberculosis
TWQWESLISKSTRLVAVN

SEQ ID NO: 1497742 - protein, 17 aa, Mycobacterium tuberculosis
VALRLVALVDRLYDAGI

SEQ ID NO: 1497743 - protein, 23 aa, Mycobacterium tuberculosis
VARGDFRAALVVGDRLDTDIEGA

SEQ ID NO: 1497744 - protein, 20 aa, Mycobacterium tuberculosis
VDVVCPLGWPATPARLPFTL

SEQ ID NO: 1497745 - protein, 17 aa, Mycobacterium tuberculosis
VEIARFWVGLAKLDDSR

SEQ ID NO: 1497746 - protein, 18 aa, Mycobacterium tuberculosis
VFCDATFCKVRVGAHVVS

SEQ ID NO: 1497747 - protein, 19 aa, Mycobacterium tuberculosis
VFCDATFCKVRVGAHVVSQ

SEQ ID NO: 1497748 - protein, 23 aa, Mycobacterium tuberculosis
VGAAARGGRRLVIAMMYGLVKEG

SEQ ID NO: 1497749 - protein, 22 aa, Mycobacterium tuberculosis
VGLPMRCVFALTAMGFLPQSAE

SEQ ID NO: 1497750 - protein, 20 aa, Mycobacterium tuberculosis
VLAIWPDWVRRWPTPSATAT

SEQ ID NO: 1497751 - protein, 21 aa, Mycobacterium tuberculosis
VLAIWPDWVRRWPTPSATATA

SEQ ID NO: 1497752 - protein, 18 aa, Mycobacterium tuberculosis
VLVPFSWQGVSLHAAGAS

SEQ ID NO: 1497753 - protein, 18 aa, Mycobacterium tuberculosis
VMVRPLIRLSLGKRHPMR

SEQ ID NO: 1497754 - protein, 17 aa, Mycobacterium tuberculosis
VRFPAPVPVGSRVRATS

SEQ ID NO: 1497755 - protein, 17 aa, Mycobacterium tuberculosis
VRLAELFIEAGLPAGVF

SEQ ID NO: 1497756 - protein, 17 aa, Mycobacterium tuberculosis
VSGPLLAGGYWNLPDET

SEQ ID NO: 1497757 - protein, 23 aa, Mycobacterium tuberculosis
VSPSLRFGLAFCEASGPRLVRHT

SEQ ID NO: 1497758 - protein, 18 aa, Mycobacterium tuberculosis
VVIGRGCLGRPWLFAELS

SEQ ID NO: 1497759 - protein, 21 aa, Mycobacterium tuberculosis
WEPFTRMAFRFNECSTRAVGA

SEQ ID NO: 1497760 - protein, 18 aa, Mycobacterium tuberculosis
WGKRRLAYEIAKHAEGIY

SEQ ID NO: 1497761 - protein, 17 aa, Mycobacterium tuberculosis
WKAEWGVADPREARGAL

SEQ ID NO: 1497762 - protein, 22 aa, Mycobacterium tuberculosis
WKDGEALFLRCNIWREAAENVA

SEQ ID NO: 1497763 - protein, 21 aa, Mycobacterium tuberculosis
WPKMRISGPAVRWVMTGWQRL

SEQ ID NO: 1497764 - protein, 20 aa, Mycobacterium tuberculosis
WQGWEELFELARFVGVSRPG

SEQ ID NO: 1497765 - protein, 17 aa, Mycobacterium tuberculosis
WRALGWIGPEAAEAAAA

SEQ ID NO: 1497766 - protein, 18 aa, Mycobacterium tuberculosis
WRATLIVRESACLDVADR

SEQ ID NO: 1497767 - protein, 20 aa, Mycobacterium tuberculosis
WRTRATTARECSIRVIISRV

SEQ ID NO: 1497768 - protein, 18 aa, Mycobacterium tuberculosis
YHKIHLYDAFGFTESRTV

SEQ ID NO: 1497769 - protein, 21 aa, Mycobacterium tuberculosis
YPRVIKRWRRGKPLADAETIF

SEQ ID NO: 1497770 - protein, 23 aa, Mycobacterium tuberculosis
YSNGVLWRGDYQGLIGADIALEI

SEQ ID NO: 1497771 - protein, 21 aa, Mycobacterium tuberculosis
AAAGRPWWEWAATHERAFTAA

SEQ ID NO: 1497772 - protein, 21 aa, Mycobacterium tuberculosis
AAEHPRPDYVLLHISDTHLIG

SEQ ID NO: 1497773 - protein, 17 aa, Mycobacterium tuberculosis
AAHARFVAAAAKVNTLL

SEQ ID NO: 1497774 - protein, 17 aa, Mycobacterium tuberculosis
AAIAALFGAHAQAYQTI

SEQ ID NO: 1497775 - protein, 20 aa, Mycobacterium tuberculosis
AARCPLCPGPTGLSSEVPAP

SEQ ID NO: 1497776 - protein, 24 aa, Mycobacterium tuberculosis
ADEVSVAVAALFGTHAQEYQTVSA

SEQ ID NO: 1497777 - protein, 17 aa, Mycobacterium tuberculosis
AEHLASWVRLCPGNHES

SEQ ID NO: 1497778 - protein, 19 aa, Mycobacterium tuberculosis
AEHPRPDYVLLHISDTHLI

SEQ ID NO: 1497779 - protein, 29 aa, Mycobacterium tuberculosis
AERCGSPAWDLPTVFGPIAITYNIKGVST

SEQ ID NO: 1497780 - protein, 18 aa, Mycobacterium tuberculosis
AETIDWGRTVLALGLDTI

SEQ ID NO: 1497781 - protein, 19 aa, Mycobacterium tuberculosis
AFDGLRLAGRRVRRPELTL

SEQ ID NO: 1497782 - protein, 18 aa, Mycobacterium tuberculosis
AGAPIRVGAFLAEDHALR

SEQ ID NO: 1497783 - protein, 23 aa, Mycobacterium tuberculosis
AGGDRAGALVGRDGGPGGNGGAG

SEQ ID NO: 1497784 - protein, 17 aa, Mycobacterium tuberculosis
AGGFGVLGAVGFTPEQL

SEQ ID NO: 1497785 - protein, 19 aa, Mycobacterium tuberculosis
AGGKCPDVLMAWELTYAEL

SEQ ID NO: 1497786 - protein, 19 aa, Mycobacterium tuberculosis
AGGNAWLFGNGGAGGLGAA

SEQ ID NO: 1497787 - protein, 20 aa, Mycobacterium tuberculosis
AGQITGLRSGFGGAGGAGGA

SEQ ID NO: 1497788 - protein, 17 aa, Mycobacterium tuberculosis
AGSIGFNASAPGAAGSP

SEQ ID NO: 1497789 - protein, 20 aa, Mycobacterium tuberculosis
AHGKAGFGAPGGDGGDGGNG

SEQ ID NO: 1497790 - protein, 19 aa, Mycobacterium tuberculosis
AHLRPGQLVLIHGGASGIG

SEQ ID NO: 1497791 - protein, 22 aa, Mycobacterium tuberculosis
AIKRVLPGLGYRLTSRGVRVAT

SEQ ID NO: 1497792 - protein, 18 aa, Mycobacterium tuberculosis
AKGSLRGGLVLGLEDSSS

SEQ ID NO: 1497793 - protein, 20 aa, Mycobacterium tuberculosis
ALELIDWPVALVIATGHILA

SEQ ID NO: 1497794 - protein, 24 aa, Mycobacterium tuberculosis
ALKALEGDAKWVASVEELMNAVDE

SEQ ID NO: 1497795 - protein, 18 aa, Mycobacterium tuberculosis
ANLRLVVSLAKRYTGRGM

SEQ ID NO: 1497796 - protein, 17 aa, Mycobacterium tuberculosis
AQAAAFHHSFVQTLNAA

SEQ ID NO: 1497797 - protein, 26 aa, Mycobacterium tuberculosis
AQHPWPPRVATLPHWPLIYAGALEGL

SEQ ID NO: 1497798 - protein, 17 aa, Mycobacterium tuberculosis
ARCALAWSVQTAALARE

SEQ ID NO: 1497799 - protein, 17 aa, Mycobacterium tuberculosis
ARIGVLSQVPWLWAKFI

SEQ ID NO: 1497800 - protein, 17 aa, Mycobacterium tuberculosis
ARNGLSIVIAPEGTRLD

SEQ ID NO: 1497801 - protein, 19 aa, Mycobacterium tuberculosis
ASSPFGIAIAIGGAGAQGG

SEQ ID NO: 1497802 - protein, 18 aa, Mycobacterium tuberculosis
ATYRLVKRSGFVASSTYA

SEQ ID NO: 1497803 - protein, 22 aa, Mycobacterium tuberculosis
AVAKRRGWPILKFNSRGGVGIR

SEQ ID NO: 1497804 - protein, 22 aa, Mycobacterium tuberculosis
AVLREFPSYIAFRERTKAKQPV

SEQ ID NO: 1497805 - protein, 19 aa, Mycobacterium tuberculosis
CAIQNLWLAARSEGLGMGW

SEQ ID NO: 1497806 - protein, 19 aa, Mycobacterium tuberculosis
CAVGIPTVSGWRMLSGDET

SEQ ID NO: 1497807 - protein, 19 aa, Mycobacterium tuberculosis
CFRCPQCTERLRASDDLLL

SEQ ID NO: 1497808 - protein, 17 aa, Mycobacterium tuberculosis
CGWFDAVIARYAARVNG

SEQ ID NO: 1497809 - protein, 21 aa, Mycobacterium tuberculosis
CPVCLGLPGSLPVLNRAAVES

SEQ ID NO: 1497810 - protein, 19 aa, Mycobacterium tuberculosis
CSWSVAGTGQFLAHDGASP

SEQ ID NO: 1497811 - protein, 17 aa, Mycobacterium tuberculosis
DELRSLLRFVLDLLADY

SEQ ID NO: 1497812 - protein, 17 aa, Mycobacterium tuberculosis
DEPKCSLCQALTAASSQ

SEQ ID NO: 1497813 - protein, 22 aa, Mycobacterium tuberculosis
DEVSAAIASLFSGNAQAYQALS

SEQ ID NO: 1497814 - protein, 19 aa, Mycobacterium tuberculosis
DGLLEIGRALNIPPLATND

SEQ ID NO: 1497815 - protein, 18 aa, Mycobacterium tuberculosis
DGSRAATHAALWAVDEAV

SEQ ID NO: 1497816 - protein, 19 aa, Mycobacterium tuberculosis
DHAAICWPLLVGMAKAKYY

SEQ ID NO: 1497817 - protein, 23 aa, Mycobacterium tuberculosis
DHCLDLPGLFVWRRYHPSRPSGK

SEQ ID NO: 1497818 - protein, 22 aa, Mycobacterium tuberculosis
DIVLFPAWVWRSPLKPSPLDPP

SEQ ID NO: 1497819 - protein, 18 aa, Mycobacterium tuberculosis
DLASRIYTDFTYRSGSTT

SEQ ID NO: 1497820 - protein, 18 aa, Mycobacterium tuberculosis
DLAWSRITYWRALLTSAV

SEQ ID NO: 1497821 - protein, 21 aa, Mycobacterium tuberculosis
DLSNILLLGPVGDLFPILSIP

SEQ ID NO: 1497822 - protein, 17 aa, Mycobacterium tuberculosis
DNPVLWRRLELLGDREY

SEQ ID NO: 1497823 - protein, 18 aa, Mycobacterium tuberculosis
DPAGARLCVRPMSEFQSN

SEQ ID NO: 1497824 - protein, 19 aa, Mycobacterium tuberculosis
DRERCILCARCTRFSDQIA

SEQ ID NO: 1497825 - protein, 24 aa, Mycobacterium tuberculosis
DSIRMMSLVGRWRRKGIAVDFATL

SEQ ID NO: 1497826 - protein, 24 aa, Mycobacterium tuberculosis
DSLPRIAQAIALPAVRKTGVLENE

SEQ ID NO: 1497827 - protein, 17 aa, Mycobacterium tuberculosis
DTEWPLPLLDLARIASD

SEQ ID NO: 1497828 - protein, 17 aa, Mycobacterium tuberculosis
DVAARWPVPGPRDDKYT

SEQ ID NO: 1497829 - protein, 20 aa, Mycobacterium tuberculosis
DVIRYLRWFTFLSADELAEL

SEQ ID NO: 1497830 - protein, 18 aa, Mycobacterium tuberculosis
DVTLRPAQYLPWHPGRCA

SEQ ID NO: 1497831 - protein, 18 aa, Mycobacterium tuberculosis
DWNALNLFTGWVDVGLTD

SEQ ID NO: 1497832 - protein, 25 aa, Mycobacterium tuberculosis
EDPRWRFGVPPANNANYAWIQHILY

SEQ ID NO: 1497833 - protein, 20 aa, Mycobacterium tuberculosis
EFPLPLGDPSVRCGGDLLSM

SEQ ID NO: 1497834 - protein, 18 aa, Mycobacterium tuberculosis
EGNLWFEWSRSLDDPAEY

SEQ ID NO: 1497835 - protein, 19 aa, Mycobacterium tuberculosis
EIAGRLAARIGSGLLVDVV

SEQ ID NO: 1497836 - protein, 18 aa, Mycobacterium tuberculosis
EISARILMKLKRDAEAYL

SEQ ID NO: 1497837 - protein, 21 aa, Mycobacterium tuberculosis
EIYRAPLSYPYRDGLLDKQLA

SEQ ID NO: 1497838 - protein, 19 aa, Mycobacterium tuberculosis
ELHEIYKLGVVSIPTNMPM

SEQ ID NO: 1497839 - protein, 17 aa, Mycobacterium tuberculosis
ELVLAAFIEGIRQVAVP

SEQ ID NO: 1497840 - protein, 18 aa, Mycobacterium tuberculosis
EPDRAAAIVRRTVPGATA

SEQ ID NO: 1497841 - protein, 17 aa, Mycobacterium tuberculosis
ERARNGLSIVIAPEGTR

SEQ ID NO: 1497842 - protein, 20 aa, Mycobacterium tuberculosis
ERERTVLVLRFFDSMTQTQI

SEQ ID NO: 1497843 - protein, 22 aa, Mycobacterium tuberculosis
ERIGLRFVLEIRVPAGVDGRIT

SEQ ID NO: 1497844 - protein, 18 aa, Mycobacterium tuberculosis
ERLMEFFGGIPILDGIGS

SEQ ID NO: 1497845 - protein, 17 aa, Mycobacterium tuberculosis
ERNYRFWADLTEALKTG

SEQ ID NO: 1497846 - protein, 18 aa, Mycobacterium tuberculosis
ESRGRLSAVVQRELADEA

SEQ ID NO: 1497847 - protein, 20 aa, Mycobacterium tuberculosis
EVSARAGVEVTVFEPAEALI

SEQ ID NO: 1497848 - protein, 17 aa, Mycobacterium tuberculosis
FAACPICHLHLRSFANR

SEQ ID NO: 1497849 - protein, 19 aa, Mycobacterium tuberculosis
FAERFGRFNFAAAALRPAY

SEQ ID NO: 1497850 - protein, 25 aa, Mycobacterium tuberculosis
FAVAPDFIGFGAAYGGAGGLGGAAT

SEQ ID NO: 1497851 - protein, 18 aa, Mycobacterium tuberculosis
FGELRWALSGAAPIPKET

SEQ ID NO: 1497852 - protein, 21 aa, Mycobacterium tuberculosis
FLFDFRDGIELNPIVIPGSSI

SEQ ID NO: 1497853 - protein, 21 aa, Mycobacterium tuberculosis
FLFYSGFYLPMYWSSRGKLTN

SEQ ID NO: 1497854 - protein, 25 aa, Mycobacterium tuberculosis
FPQTFYLSGLFFFGPVNLSASTLTV

SEQ ID NO: 1497855 - protein, 20 aa, Mycobacterium tuberculosis
FRYVMMVLRHIPRSIFRKLP

SEQ ID NO: 1497856 - protein, 17 aa, Mycobacterium tuberculosis
FSFPVGPLIPQTHLVHL

SEQ ID NO: 1497857 - protein, 17 aa, Mycobacterium tuberculosis
FVQALAGAMGAYAAAEA

SEQ ID NO: 1497858 - protein, 19 aa, Mycobacterium tuberculosis
FVTCDARLAATLPPGLGDA

SEQ ID NO: 1497859 - protein, 17 aa, Mycobacterium tuberculosis
GAEVRWASCNIFSTQDH

SEQ ID NO: 1497860 - protein, 22 aa, Mycobacterium tuberculosis
GAGGDGGLFFGVGGAGGAGGTG

SEQ ID NO: 1497861 - protein, 27 aa, Mycobacterium tuberculosis
GAGGHGGAGGWLYGNGGAGGFGGAGAV

SEQ ID NO: 1497862 - protein, 18 aa, Mycobacterium tuberculosis
GAGGILFGAGGAGGAGGA

SEQ ID NO: 1497863 - protein, 17 aa, Mycobacterium tuberculosis
GALIGFLGPRVYELLYG

SEQ ID NO: 1497864 - protein, 17 aa, Mycobacterium tuberculosis
GARLAWREDATWAPHGG

SEQ ID NO: 1497865 - protein, 18 aa, Mycobacterium tuberculosis
GDGGLVWGNGGTGGSGGA

SEQ ID NO: 1497866 - protein, 18 aa, Mycobacterium tuberculosis
GELIPLCHPLGIEAVTVT

SEQ ID NO: 1497867 - protein, 21 aa, Mycobacterium tuberculosis
GEPLPRWQIALYWRTDGRPLW

SEQ ID NO: 1497868 - protein, 17 aa, Mycobacterium tuberculosis
GEPWRAVHVGDELPLAE

SEQ ID NO: 1497869 - protein, 20 aa, Mycobacterium tuberculosis
GERLAVGVPKAFYQLDGQTL

SEQ ID NO: 1497870 - protein, 23 aa, Mycobacterium tuberculosis
GGAGGAAGLWGHGGAGGAGGSAS

SEQ ID NO: 1497871 - protein, 19 aa, Mycobacterium tuberculosis
GGAGGLLFGNGGNGGNAGA

SEQ ID NO: 1497872 - protein, 18 aa, Mycobacterium tuberculosis
GGAGGWLFGNGGAGGNGG

SEQ ID NO: 1497873 - protein, 17 aa, Mycobacterium tuberculosis
GGALAPGTVRQWLAEHA

SEQ ID NO: 1497874 - protein, 22 aa, Mycobacterium tuberculosis
GGFRYGPAFGVELQFWVYEETV

SEQ ID NO: 1497875 - protein, 22 aa, Mycobacterium tuberculosis
GGKCPQCGTYVFPPRADNCPNP

SEQ ID NO: 1497876 - protein, 19 aa, Mycobacterium tuberculosis
GGLIGRAGSDGGVGAGGAG

SEQ ID NO: 1497877 - protein, 17 aa, Mycobacterium tuberculosis
GGLLVGDGGAGGIGGTG

SEQ ID NO: 1497878 - protein, 17 aa, Mycobacterium tuberculosis
GGLRRFLDELGELPNKS

SEQ ID NO: 1497879 - protein, 18 aa, Mycobacterium tuberculosis
GGLYVHWIVTGIAPGSGS

SEQ ID NO: 1497880 - protein, 21 aa, Mycobacterium tuberculosis
GGSGGSLFGFGGAGGTGGSSG

SEQ ID NO: 1497881 - protein, 18 aa, Mycobacterium tuberculosis
GGVGGVFGNGGFGGAGGL

SEQ ID NO: 1497882 - protein, 20 aa, Mycobacterium tuberculosis
GIANFLGFSVLHGGAGGAGG

SEQ ID NO: 1497883 - protein, 19 aa, Mycobacterium tuberculosis
GIKVARRLLANVAHVAVFD

SEQ ID NO: 1497884 - protein, 18 aa, Mycobacterium tuberculosis
GKGGGRLPITLWIVDTNA

SEQ ID NO: 1497885 - protein, 21 aa, Mycobacterium tuberculosis
GLAGRWLRPGGLFAVEHDDTT

SEQ ID NO: 1497886 - protein, 17 aa, Mycobacterium tuberculosis
GMPWIVVVGRGWADGVV

SEQ ID NO: 1497887 - protein, 27 aa, Mycobacterium tuberculosis
GNYSNGFWWRGDYQGLAGISQTITVPD

SEQ ID NO: 1497888 - protein, 23 aa, Mycobacterium tuberculosis
GPCYRCLHPAPPPPGLVPSCAEG

SEQ ID NO: 1497889 - protein, 18 aa, Mycobacterium tuberculosis
GPIVIGSFFLPAFNIPGI

SEQ ID NO: 1497890 - protein, 22 aa, Mycobacterium tuberculosis
GPIVIGSFFLPAFNIPGIDVPA

SEQ ID NO: 1497891 - protein, 17 aa, Mycobacterium tuberculosis
GRDDWAVHIALWRRSSN

SEQ ID NO: 1497892 - protein, 26 aa, Mycobacterium tuberculosis
GSGAPGGHGGWLFGGGGTGGSGVSGG

SEQ ID NO: 1497893 - protein, 18 aa, Mycobacterium tuberculosis
GSPIPVGLDPTGVAVNPV

SEQ ID NO: 1497894 - protein, 25 aa, Mycobacterium tuberculosis
GTGGKGGDGFGVFGKGGAGGTGGRG

SEQ ID NO: 1497895 - protein, 18 aa, Mycobacterium tuberculosis
GTGGQLWGSGGAGGEGGA

SEQ ID NO: 1497896 - protein, 17 aa, Mycobacterium tuberculosis
GVMWKRFSETGAIKAKS

SEQ ID NO: 1497897 - protein, 20 aa, Mycobacterium tuberculosis
GWPALVMLFAGPRVGEPGKP

SEQ ID NO: 1497898 - protein, 18 aa, Mycobacterium tuberculosis
GYRVRRFAARVVWKLAPD

SEQ ID NO: 1497899 - protein, 18 aa, Mycobacterium tuberculosis
HCAAMSFGSVTSGLVVGW

SEQ ID NO: 1497900 - protein, 17 aa, Mycobacterium tuberculosis
HLFTVLMDREWKHGVAA

SEQ ID NO: 1497901 - protein, 17 aa, Mycobacterium tuberculosis
IACLRANGLAACYVSGY

SEQ ID NO: 1497902 - protein, 19 aa, Mycobacterium tuberculosis
IAGRLGLRPDVRRMPLFGL

SEQ ID NO: 1497903 - protein, 17 aa, Mycobacterium tuberculosis
IAKELPMEYALELNRLI

SEQ ID NO: 1497904 - protein, 21 aa, Mycobacterium tuberculosis
ICIPVPFYHCFGMVMGNLAAT

SEQ ID NO: 1497905 - protein, 18 aa, Mycobacterium tuberculosis
IDSPTLPTCERIAVLSQS

SEQ ID NO: 1497906 - protein, 23 aa, Mycobacterium tuberculosis
IECPAGTIGEIWVKGDNVAEGYW

SEQ ID NO: 1497907 - protein, 18 aa, Mycobacterium tuberculosis
IELARSGAKVAISDVDTD

SEQ ID NO: 1497908 - protein, 17 aa, Mycobacterium tuberculosis
IGVLSQVPWLWAKFIGH

SEQ ID NO: 1497909 - protein, 17 aa, Mycobacterium tuberculosis
IKLGPSLWHRDFHDAVI

SEQ ID NO: 1497910 - protein, 19 aa, Mycobacterium tuberculosis
ILYRLYRPLIFALYCLPLN

SEQ ID NO: 1497911 - protein, 18 aa, Mycobacterium tuberculosis
IPAIPIGLVLNGDIGPIT

SEQ ID NO: 1497912 - protein, 20 aa, Mycobacterium tuberculosis
ISAFVVRISCHLRIQNQAAD

SEQ ID NO: 1497913 - protein, 17 aa, Mycobacterium tuberculosis
ISRWAAYWPPAGAEALF

SEQ ID NO: 1497914 - protein, 22 aa, Mycobacterium tuberculosis
KCREYRITLVFVEVREGQSTRH

SEQ ID NO: 1497915 - protein, 19 aa, Mycobacterium tuberculosis
KECPAPGVMQGCLESTSGL

SEQ ID NO: 1497916 - protein, 17 aa, Mycobacterium tuberculosis
KEHFDFFPLTVDVEERM

SEQ ID NO: 1497917 - protein, 20 aa, Mycobacterium tuberculosis
KEPFSRWASLLIHAGEPGAG

SEQ ID NO: 1497918 - protein, 23 aa, Mycobacterium tuberculosis
KGADPGGLFPIPGAGGKGGTGGT

SEQ ID NO: 1497919 - protein, 19 aa, Mycobacterium tuberculosis
KLPTLRGRTVVTMFYENST

SEQ ID NO: 1497920 - protein, 18 aa, Mycobacterium tuberculosis
KNEYPGKIFAILDSDHSM

SEQ ID NO: 1497921 - protein, 18 aa, Mycobacterium tuberculosis
KNPKEHFDFFPLTVDVEE

SEQ ID NO: 1497922 - protein, 20 aa, Mycobacterium tuberculosis
KPGAGVCPVRGHSNVQGDRT

SEQ ID NO: 1497923 - protein, 19 aa, Mycobacterium tuberculosis
KRPQIAIATWIVPSIVAFG

SEQ ID NO: 1497924 - protein, 19 aa, Mycobacterium tuberculosis
KSKLRTGGLLLNHCITRHD

SEQ ID NO: 1497925 - protein, 17 aa, Mycobacterium tuberculosis
LACGNAFVLKPSERDPS

SEQ ID NO: 1497926 - protein, 25 aa, Mycobacterium tuberculosis
LADAAWRGPAAVAMARAVAPYLGWL

SEQ ID NO: 1497927 - protein, 19 aa, Mycobacterium tuberculosis
LADQAVRQWGFMQGLKQKL

SEQ ID NO: 1497928 - protein, 18 aa, Mycobacterium tuberculosis
LAIPELPDAVFIESLRQL

SEQ ID NO: 1497929 - protein, 22 aa, Mycobacterium tuberculosis
LALQFGWRLFAPMLRSATGIDE

SEQ ID NO: 1497930 - protein, 18 aa, Mycobacterium tuberculosis
LCQILYWRGVGTCISGDP

SEQ ID NO: 1497931 - protein, 17 aa, Mycobacterium tuberculosis
LCRSVDIPARFVLGQAL

SEQ ID NO: 1497932 - protein, 23 aa, Mycobacterium tuberculosis
LDIYRIGQNVAWRRWTDIAFGLT

SEQ ID NO: 1497933 - protein, 17 aa, Mycobacterium tuberculosis
LEHWRWMWDTNVLGTLR

SEQ ID NO: 1497934 - protein, 22 aa, Mycobacterium tuberculosis
LEVEEVYLPLARLIHLQVAARQ

SEQ ID NO: 1497935 - protein, 19 aa, Mycobacterium tuberculosis
LFYSGFYLPMYWSSRGKLT

SEQ ID NO: 1497936 - protein, 21 aa, Mycobacterium tuberculosis
LGELFAYRWSRCGGREEWVMD

SEQ ID NO: 1497937 - protein, 17 aa, Mycobacterium tuberculosis
LGFAAARRFSADPQSVA

SEQ ID NO: 1497938 - protein, 25 aa, Mycobacterium tuberculosis
LIKSIGLRLGVPWYAYDTVTFSGEV

SEQ ID NO: 1497939 - protein, 22 aa, Mycobacterium tuberculosis
LLECGLLRGWLIPPADIKAARD

SEQ ID NO: 1497940 - protein, 17 aa, Mycobacterium tuberculosis
LLESFLFYSGFYLPMYW

SEQ ID NO: 1497941 - protein, 19 aa, Mycobacterium tuberculosis
LLFKRNICHQAIFYRRGLF

SEQ ID NO: 1497942 - protein, 24 aa, Mycobacterium tuberculosis
LLILRRPRAGLSYEALLETVEQRL

SEQ ID NO: 1497943 - protein, 19 aa, Mycobacterium tuberculosis
LLLGRPLIGDGANGGPGQN

SEQ ID NO: 1497944 - protein, 18 aa, Mycobacterium tuberculosis
LLTRGRYQYRPEPPFVLG

SEQ ID NO: 1497945 - protein, 21 aa, Mycobacterium tuberculosis
LMSVGDLIIGWLLQRQAAVAV

SEQ ID NO: 1497946 - protein, 17 aa, Mycobacterium tuberculosis
LPPGWVLTTSGRISGVT

SEQ ID NO: 1497947 - protein, 17 aa, Mycobacterium tuberculosis
LPRPLRWLAGATRSAVL

SEQ ID NO: 1497948 - protein, 19 aa, Mycobacterium tuberculosis
LRAVGDWLVRPGAQLQAVG

SEQ ID NO: 1497949 - protein, 18 aa, Mycobacterium tuberculosis
LRELCKMDGAVVLSTDGS

SEQ ID NO: 1497950 - protein, 20 aa, Mycobacterium tuberculosis
LRLHPDIRLFTAIPEQRSST

SEQ ID NO: 1497951 - protein, 17 aa, Mycobacterium tuberculosis
LRPEIWDEFTTRFGVAR

SEQ ID NO: 1497952 - protein, 22 aa, Mycobacterium tuberculosis
LSGLAALHWRGPAAESMAVTAA

SEQ ID NO: 1497953 - protein, 19 aa, Mycobacterium tuberculosis
LSLFFRQHINYVLARPKLR

SEQ ID NO: 1497954 - protein, 17 aa, Mycobacterium tuberculosis
LTAMWRRGDEVFAEVAL

SEQ ID NO: 1497955 - protein, 26 aa, Mycobacterium tuberculosis
LTDPEVLEWRYPVLLREFAVRQGSGG

SEQ ID NO: 1497956 - protein, 19 aa, Mycobacterium tuberculosis
LVFGRRAGLGAADYVRALS

SEQ ID NO: 1497957 - protein, 18 aa, Mycobacterium tuberculosis
LVPFGAFVRVEEGIEGLV

SEQ ID NO: 1497958 - protein, 19 aa, Mycobacterium tuberculosis
LWRAFRPGTHVPIIDYTVP

SEQ ID NO: 1497959 - protein, 19 aa, Mycobacterium tuberculosis
LYERLWRPASFHLASRITT

SEQ ID NO: 1497960 - protein, 19 aa, Mycobacterium tuberculosis
LYWQCWKLDSPIIARITDT

SEQ ID NO: 1497961 - protein, 18 aa, Mycobacterium tuberculosis
MATCKRCGDAVPYIILPN

SEQ ID NO: 1497962 - protein, 17 aa, Mycobacterium tuberculosis
MEMKVLLWAVQRLIGGL

SEQ ID NO: 1497963 - protein, 20 aa, Mycobacterium tuberculosis
MLSLFFRQHINYVLARPKLR

SEQ ID NO: 1497964 - protein, 25 aa, Mycobacterium tuberculosis
MSAQAAAFHARFVQALAGAMGAYAA

SEQ ID NO: 1497965 - protein, 17 aa, Mycobacterium tuberculosis
MTVALLLAVARHLIPAD

SEQ ID NO: 1497966 - protein, 17 aa, Mycobacterium tuberculosis
MVEAAICDGDWVVVRQQ

SEQ ID NO: 1497967 - protein, 19 aa, Mycobacterium tuberculosis
MVRRLPPGAIWQVIAIGKA

SEQ ID NO: 1497968 - protein, 17 aa, Mycobacterium tuberculosis
NEIRALMALPPGQAPDP

SEQ ID NO: 1497969 - protein, 19 aa, Mycobacterium tuberculosis
NGAFWRGDQQGLFSAGYRV

SEQ ID NO: 1497970 - protein, 29 aa, Mycobacterium tuberculosis
NGLRPEIWDEFTTRFGVARVCEFYAASEG

SEQ ID NO: 1497971 - protein, 24 aa, Mycobacterium tuberculosis
NGSKGLPGLGRLGNPGLDGGTGGN

SEQ ID NO: 1497972 - protein, 18 aa, Mycobacterium tuberculosis
NLGKLLTKRARVIGTTLR

SEQ ID NO: 1497973 - protein, 19 aa, Mycobacterium tuberculosis
NLRCSYCMPERGLRWLPGE

SEQ ID NO: 1497974 - protein, 19 aa, Mycobacterium tuberculosis
NRGRAGYRLLYSVRQYALE

SEQ ID NO: 1497975 - protein, 18 aa, Mycobacterium tuberculosis
NRPKIGWRRLEAQAVLSR

SEQ ID NO: 1497976 - protein, 26 aa, Mycobacterium tuberculosis
NRRPTGQRGFFCWFRVGSDVLVDNAF

SEQ ID NO: 1497977 - protein, 25 aa, Mycobacterium tuberculosis
NSGNFGVDGEAGFSGGAGGNGGVGG

SEQ ID NO: 1497978 - protein, 27 aa, Mycobacterium tuberculosis
NYSNGFFWRGDYQGLIGLSTTITIPEI

SEQ ID NO: 1497979 - protein, 17 aa, Mycobacterium tuberculosis
PDLPTGKALVIAEGVLV

SEQ ID NO: 1497980 - protein, 21 aa, Mycobacterium tuberculosis
PEFSELFAAFPSFAGLRPTFD

SEQ ID NO: 1497981 - protein, 25 aa, Mycobacterium tuberculosis
PEIWDEFTTRFGVARVCEFYAASEG

SEQ ID NO: 1497982 - protein, 19 aa, Mycobacterium tuberculosis
PELCALSWMVYSLPGAPVL

SEQ ID NO: 1497983 - protein, 19 aa, Mycobacterium tuberculosis
PGAFCLTCGAPVREPTDIM

SEQ ID NO: 1497984 - protein, 23 aa, Mycobacterium tuberculosis
PGAGGNGGNANWFGSGGAGGQGG

SEQ ID NO: 1497985 - protein, 25 aa, Mycobacterium tuberculosis
PGKPVRLPIPWRDVGGYRPTGRSIA

SEQ ID NO: 1497986 - protein, 20 aa, Mycobacterium tuberculosis
PGRLSSRFWRLLGASTEKNR

SEQ ID NO: 1497987 - protein, 22 aa, Mycobacterium tuberculosis
PGRWGRTAVCARLSSADQKVDL

SEQ ID NO: 1497988 - protein, 22 aa, Mycobacterium tuberculosis
PLPSTRQRLGWALRDLPSRLGK

SEQ ID NO: 1497989 - protein, 21 aa, Mycobacterium tuberculosis
PLVRRLWVLKVWGDVVDDRRG

SEQ ID NO: 1497990 - protein, 22 aa, Mycobacterium tuberculosis
PMTAWAVGLLMRLPQRGVVTVA

SEQ ID NO: 1497991 - protein, 17 aa, Mycobacterium tuberculosis
PNFWAWLIAQVKTVDPD

SEQ ID NO: 1497992 - protein, 17 aa, Mycobacterium tuberculosis
PPPHWRPDVLLVAVGAM

SEQ ID NO: 1497993 - protein, 20 aa, Mycobacterium tuberculosis
PQCTERLRASDDLLLVGGMR

SEQ ID NO: 1497994 - protein, 19 aa, Mycobacterium tuberculosis
PQPICWAIDHVRVCVGHGY

SEQ ID NO: 1497995 - protein, 19 aa, Mycobacterium tuberculosis
PREALALALDQERTVTDQV

SEQ ID NO: 1497996 - protein, 19 aa, Mycobacterium tuberculosis
PRVIKRWRRGKPLADAETI

SEQ ID NO: 1497997 - protein, 17 aa, Mycobacterium tuberculosis
PTLAGAVPTIWNDVMHY

SEQ ID NO: 1497998 - protein, 17 aa, Mycobacterium tuberculosis
PTTAAFCDAEFERMRVE

SEQ ID NO: 1497999 - protein, 19 aa, Mycobacterium tuberculosis
PYPSLKRMNPWKRFFHNQT

SEQ ID NO: 1498000 - protein, 20 aa, Mycobacterium tuberculosis
QALLGRPLIGNGANGADGTG

SEQ ID NO: 1498001 - protein, 19 aa, Mycobacterium tuberculosis
QAVTGRPLIGNGANGAPGS

SEQ ID NO: 1498002 - protein, 25 aa, Mycobacterium tuberculosis
QEGHPGHGPRYLWTRTVAGRGTKGR

SEQ ID NO: 1498003 - protein, 21 aa, Mycobacterium tuberculosis
QRLSAQAAGFHAQFVQALNAG

SEQ ID NO: 1498004 - protein, 20 aa, Mycobacterium tuberculosis
QRMSTVLSRRLWENAGSPEV

SEQ ID NO: 1498005 - protein, 17 aa, Mycobacterium tuberculosis
QVCSRLAATELYRRLRE

SEQ ID NO: 1498006 - protein, 17 aa, Mycobacterium tuberculosis
RAFLADKVVRWWLPERW

SEQ ID NO: 1498007 - protein, 17 aa, Mycobacterium tuberculosis
RAGTVALVIREDRGWAV

SEQ ID NO: 1498008 - protein, 18 aa, Mycobacterium tuberculosis
RAIWRINELLNWQVASAG

SEQ ID NO: 1498009 - protein, 17 aa, Mycobacterium tuberculosis
RALGCPQPLIAVASAAT

SEQ ID NO: 1498010 - protein, 18 aa, Mycobacterium tuberculosis
RARLWPRSMTTLSTHDTK

SEQ ID NO: 1498011 - protein, 22 aa, Mycobacterium tuberculosis
RENLSWSAPRLHLVDLQYSDVR

SEQ ID NO: 1498012 - protein, 25 aa, Mycobacterium tuberculosis
REWLTQWSRPGLIPVALVVVNVFVE

SEQ ID NO: 1498013 - protein, 20 aa, Mycobacterium tuberculosis
RGCSHACRYCFARPTHEYLD

SEQ ID NO: 1498014 - protein, 17 aa, Mycobacterium tuberculosis
RGGGVALLLTNIREHGA

SEQ ID NO: 1498015 - protein, 17 aa, Mycobacterium tuberculosis
RICASLGLPERVLTQRL

SEQ ID NO: 1498016 - protein, 18 aa, Mycobacterium tuberculosis
RIGQRIAAWLNYYGAGNH

SEQ ID NO: 1498017 - protein, 21 aa, Mycobacterium tuberculosis
RKEVFRLRLASGREVEATGSH

SEQ ID NO: 1498018 - protein, 18 aa, Mycobacterium tuberculosis
RLLCEQVGAAALVIPEEL

SEQ ID NO: 1498019 - protein, 19 aa, Mycobacterium tuberculosis
RLLLREVFTAAGGTHDDWD

SEQ ID NO: 1498020 - protein, 18 aa, Mycobacterium tuberculosis
RLTLPAKFRDALAGGLMV

SEQ ID NO: 1498021 - protein, 20 aa, Mycobacterium tuberculosis
RPDLVIGWWAAPTILEHGTP

SEQ ID NO: 1498022 - protein, 17 aa, Mycobacterium tuberculosis
RPGAPFGEYAEGWLKQR

SEQ ID NO: 1498023 - protein, 23 aa, Mycobacterium tuberculosis
RPLRIAHAWSFTFDAAWQPLVAL

SEQ ID NO: 1498024 - protein, 19 aa, Mycobacterium tuberculosis
RPTELCFVPRIWDMVFAEF

SEQ ID NO: 1498025 - protein, 17 aa, Mycobacterium tuberculosis
RQILGHRAMIVAGGSNR

SEQ ID NO: 1498026 - protein, 18 aa, Mycobacterium tuberculosis
RRISMSFVNVAPQLVSTA

SEQ ID NO: 1498027 - protein, 18 aa, Mycobacterium tuberculosis
RRYRFRAGIAKVDFVLSD

SEQ ID NO: 1498028 - protein, 21 aa, Mycobacterium tuberculosis
RVKCALLGWMAFKDALAQASE

SEQ ID NO: 1498029 - protein, 17 aa, Mycobacterium tuberculosis
RVKQLLLKIGWPAEDLA

SEQ ID NO: 1498030 - protein, 17 aa, Mycobacterium tuberculosis
RVKRPQIAIATWIVPSI

SEQ ID NO: 1498031 - protein, 26 aa, Mycobacterium tuberculosis
RWAYYPWRRMVVAILGPRGFRAVRLD

SEQ ID NO: 1498032 - protein, 18 aa, Mycobacterium tuberculosis
RWLPGPRELRAWTLAAGS

SEQ ID NO: 1498033 - protein, 19 aa, Mycobacterium tuberculosis
RYTMPLGEIIFDFFDALKS

SEQ ID NO: 1498034 - protein, 17 aa, Mycobacterium tuberculosis
SAAFQAAHARFVAAAAK

SEQ ID NO: 1498035 - protein, 18 aa, Mycobacterium tuberculosis
SAAIASLFSGNAQAYQAL

SEQ ID NO: 1498036 - protein, 20 aa, Mycobacterium tuberculosis
SAQFPRPAPRSSYSALSSRQ

SEQ ID NO: 1498037 - protein, 18 aa, Mycobacterium tuberculosis
SEVVEPWSLRLSHPELLY

SEQ ID NO: 1498038 - protein, 24 aa, Mycobacterium tuberculosis
SGGIRGPIGLGFRVPCLVISPYSR

SEQ ID NO: 1498039 - protein, 25 aa, Mycobacterium tuberculosis
SGGKGGTGGWLWGSGGAGGAGGSGG

SEQ ID NO: 1498040 - protein, 19 aa, Mycobacterium tuberculosis
SGQVGWLARDRWAVPLVHT

SEQ ID NO: 1498041 - protein, 19 aa, Mycobacterium tuberculosis
SKFPYRWWWVALTDEAFPR

SEQ ID NO: 1498042 - protein, 18 aa, Mycobacterium tuberculosis
SKLRTGGLLLNHCITRHD

SEQ ID NO: 1498043 - protein, 17 aa, Mycobacterium tuberculosis
SKPCAWLAEGLVRYLPA

SEQ ID NO: 1498044 - protein, 18 aa, Mycobacterium tuberculosis
SLARLAIRDDIYGALRSL

SEQ ID NO: 1498045 - protein, 17 aa, Mycobacterium tuberculosis
SLLPRYLTTRVYAALLE

SEQ ID NO: 1498046 - protein, 23 aa, Mycobacterium tuberculosis
SLPRIAQAIALPAVRKTGVLENE

SEQ ID NO: 1498047 - protein, 21 aa, Mycobacterium tuberculosis
SPLSDFFIKWMSRINTWMYRR

SEQ ID NO: 1498048 - protein, 19 aa, Mycobacterium tuberculosis
SRIPMWVEETLRYDTSSQI

SEQ ID NO: 1498049 - protein, 17 aa, Mycobacterium tuberculosis
SRRFGVQVEDGFGSTEN

SEQ ID NO: 1498050 - protein, 17 aa, Mycobacterium tuberculosis
SRSGIAPVTIDLSAVTH

SEQ ID NO: 1498051 - protein, 20 aa, Mycobacterium tuberculosis
SSFRYAAPAGRNWTTADLAG

SEQ ID NO: 1498052 - protein, 18 aa, Mycobacterium tuberculosis
STIFPFRRLFMVAEVGGA

SEQ ID NO: 1498053 - protein, 21 aa, Mycobacterium tuberculosis
SVEVAELWSTFMQKWIAYTAA

SEQ ID NO: 1498054 - protein, 17 aa, Mycobacterium tuberculosis
SVVGRLSVPASWSTAAP

SEQ ID NO: 1498055 - protein, 17 aa, Mycobacterium tuberculosis
SVWCFATASAREWWGLV

SEQ ID NO: 1498056 - protein, 17 aa, Mycobacterium tuberculosis
SWAQRWLAATGNRDYLG

SEQ ID NO: 1498057 - protein, 17 aa, Mycobacterium tuberculosis
TDGRWDPGKDFAMVTAR

SEQ ID NO: 1498058 - protein, 17 aa, Mycobacterium tuberculosis
TGARWLCETFPTCLERG

SEQ ID NO: 1498059 - protein, 24 aa, Mycobacterium tuberculosis
TGEEFSWRAAELFDAIGSEAITVA

SEQ ID NO: 1498060 - protein, 26 aa, Mycobacterium tuberculosis
TGGNGGRAGLLLGVGGMGGNGGATSV

SEQ ID NO: 1498061 - protein, 19 aa, Mycobacterium tuberculosis
TGIIGWPALVMLFAGPRVG

SEQ ID NO: 1498062 - protein, 24 aa, Mycobacterium tuberculosis
TGQPGGPGGLLWGNGGNGGSGVAG

SEQ ID NO: 1498063 - protein, 17 aa, Mycobacterium tuberculosis
TLFPPVRPRQWLEIRYL

SEQ ID NO: 1498064 - protein, 17 aa, Mycobacterium tuberculosis
TLHAALQLARRGSGVGV

SEQ ID NO: 1498065 - protein, 17 aa, Mycobacterium tuberculosis
TLKRFVDRFSRFNLREF

SEQ ID NO: 1498066 - protein, 17 aa, Mycobacterium tuberculosis
TLKRHCVRVIPWEITGR

SEQ ID NO: 1498067 - protein, 19 aa, Mycobacterium tuberculosis
TLLGRPLIGNGADGAPGTG

SEQ ID NO: 1498068 - protein, 18 aa, Mycobacterium tuberculosis
TNPARWALLYGSPVPGYH

SEQ ID NO: 1498069 - protein, 17 aa, Mycobacterium tuberculosis
TPDGVWSRMKFEGGVHR

SEQ ID NO: 1498070 - protein, 18 aa, Mycobacterium tuberculosis
TPESWLLIDFEGEPGQPL

SEQ ID NO: 1498071 - protein, 25 aa, Mycobacterium tuberculosis
TPGGNGGDGGWLFGSGGNGAPGAAG

SEQ ID NO: 1498072 - protein, 18 aa, Mycobacterium tuberculosis
TPGSIALALGGPVTGGVT

SEQ ID NO: 1498073 - protein, 20 aa, Mycobacterium tuberculosis
TPRPRWRSAQALTSRSCNGS

SEQ ID NO: 1498074 - protein, 24 aa, Mycobacterium tuberculosis
TQAAAFHERFIQALSTAAGAYGSA

SEQ ID NO: 1498075 - protein, 17 aa, Mycobacterium tuberculosis
TRVPEFLERLGVGAPEA

SEQ ID NO: 1498076 - protein, 17 aa, Mycobacterium tuberculosis
TVPVGILCLEFLVHAWD

SEQ ID NO: 1498077 - protein, 18 aa, Mycobacterium tuberculosis
VAGCVFRYIAYHGRSREN

SEQ ID NO: 1498078 - protein, 17 aa, Mycobacterium tuberculosis
VALWFIREVFEVMRATP

SEQ ID NO: 1498079 - protein, 18 aa, Mycobacterium tuberculosis
VAVAALFGTHAQEYQTVS

SEQ ID NO: 1498080 - protein, 18 aa, Mycobacterium tuberculosis
VCANVICPRARTAMTADV

SEQ ID NO: 1498081 - protein, 17 aa, Mycobacterium tuberculosis
VCLGLPGSLPVLNRAAV

SEQ ID NO: 1498082 - protein, 17 aa, Mycobacterium tuberculosis
VDRIWRAARHWYRAGMH

SEQ ID NO: 1498083 - protein, 17 aa, Mycobacterium tuberculosis
VGHPFWFSRTVFGELAR

SEQ ID NO: 1498084 - protein, 22 aa, Mycobacterium tuberculosis
VGYAACHWCHVMAHESFDDDEV

SEQ ID NO: 1498085 - protein, 18 aa, Mycobacterium tuberculosis
VIATEFELVMPFVERAQS

SEQ ID NO: 1498086 - protein, 18 aa, Mycobacterium tuberculosis
VIRRSRRGGRGWVVPAGG

SEQ ID NO: 1498087 - protein, 20 aa, Mycobacterium tuberculosis
VLRAEERWRPGLPPPPEQFY

SEQ ID NO: 1498088 - protein, 18 aa, Mycobacterium tuberculosis
VMAAAATDLANIGSSISA

SEQ ID NO: 1498089 - protein, 18 aa, Mycobacterium tuberculosis
VNTGTGWAYGGNGGNGGD

SEQ ID NO: 1498090 - protein, 19 aa, Mycobacterium tuberculosis
VPAERLWVNPDCGLKTRNV

SEQ ID NO: 1498091 - protein, 18 aa, Mycobacterium tuberculosis
VPLILRLDPKIGLPDIRA

SEQ ID NO: 1498092 - protein, 22 aa, Mycobacterium tuberculosis
VQSVLLPRLLDWMSYAPDPDGG

SEQ ID NO: 1498093 - protein, 19 aa, Mycobacterium tuberculosis
VRCDARLAVTLPPELPVAA

SEQ ID NO: 1498094 - protein, 17 aa, Mycobacterium tuberculosis
VRFGVLVIRCALCTDTV

SEQ ID NO: 1498095 - protein, 17 aa, Mycobacterium tuberculosis
VRILFAFDPARQAIMLA

SEQ ID NO: 1498096 - protein, 19 aa, Mycobacterium tuberculosis
VSAGIAALFGAQAQSYQAV

SEQ ID NO: 1498097 - protein, 17 aa, Mycobacterium tuberculosis
VTCDARLAATLPPGLGD

SEQ ID NO: 1498098 - protein, 17 aa, Mycobacterium tuberculosis
VVCPLGWPATPARLPFT

SEQ ID NO: 1498099 - protein, 21 aa, Mycobacterium tuberculosis
VVDVVCPLGWPATPARLPFTL

SEQ ID NO: 1498100 - protein, 17 aa, Mycobacterium tuberculosis
VVRALDMLFILHADHEQ

SEQ ID NO: 1498101 - protein, 21 aa, Mycobacterium tuberculosis
VYYRRALMLAACFGRGSEYPQ

SEQ ID NO: 1498102 - protein, 18 aa, Mycobacterium tuberculosis
WATWCGPCKMVAPVLEEI

SEQ ID NO: 1498103 - protein, 19 aa, Mycobacterium tuberculosis
WEYDWPASRWRQHLNAQLE

SEQ ID NO: 1498104 - protein, 17 aa, Mycobacterium tuberculosis
WFRYAGGGKWNWQRDFF

SEQ ID NO: 1498105 - protein, 18 aa, Mycobacterium tuberculosis
WLLNGFKWFASNCAGEAF

SEQ ID NO: 1498106 - protein, 20 aa, Mycobacterium tuberculosis
WRDVGGYRPTGRSIAACRRG

SEQ ID NO: 1498107 - protein, 19 aa, Mycobacterium tuberculosis
WRGFSRWLMRAYDVLVDED

SEQ ID NO: 1498108 - protein, 25 aa, Mycobacterium tuberculosis
WSPDSDLKGFDGFDGGSGGAGGDGG

SEQ ID NO: 1498109 - protein, 18 aa, Mycobacterium tuberculosis
YARVCVDLLKPRKAQPLL

SEQ ID NO: 1498110 - protein, 17 aa, Mycobacterium tuberculosis
YGGVWLHSWLDRDLGIS

SEQ ID NO: 1498111 - protein, 18 aa, Mycobacterium tuberculosis
YLPLVVRRRIWFLAKSEY

SEQ ID NO: 1498112 - protein, 22 aa, Mycobacterium tuberculosis
YPGHAIWWLARGLEFFQDGEQF

SEQ ID NO: 1498113 - protein, 21 aa, Mycobacterium tuberculosis
YPGRFLLGIGVGHAEMISEYR

SEQ ID NO: 1498114 - protein, 21 aa, Mycobacterium tuberculosis
YPQDRLDFILADCDAKLVLRT

SEQ ID NO: 1498115 - protein, 21 aa, Mycobacterium tuberculosis
YPSAVAKARFVRVSPRKARRV

SEQ ID NO: 1498116 - protein, 23 aa, Mycobacterium tuberculosis
AAAAGRPWWEWAATHERAFTAAY

SEQ ID NO: 1498117 - protein, 36 aa, Mycobacterium tuberculosis; identical to SEQ ID NO: 212157

SEQ ID NO: 1498118 - protein, 29 aa, Mycobacterium tuberculosis
AADEVSTAVAALFSQHAQGYQAAAAQVAA

SEQ ID NO: 1498119 - protein, 18 aa, Mycobacterium tuberculosis
AAGARGALTSGGLAGGVG

SEQ ID NO: 1498120 - protein, 26 aa, Mycobacterium tuberculosis
AAGGNGGNGGWLFGAGGTGGIGGTGA

SEQ ID NO: 1498121 - protein, 24 aa, Mycobacterium tuberculosis
AAQPIWWVVRAIEFSKDFETFVQE

SEQ ID NO: 1498122 - protein, 17 aa, Mycobacterium tuberculosis
AARLGLAGWPRAAEESI

SEQ ID NO: 1498123 - protein, 17 aa, Mycobacterium tuberculosis
AAVAALFSGHAQTYQAL

SEQ ID NO: 1498124 - protein, 17 aa, Mycobacterium tuberculosis
AAYQERFVLALSQASST

SEQ ID NO: 1498125 - protein, 17 aa, Mycobacterium tuberculosis
ACIKAAADRVVFINTGF

SEQ ID NO: 1498126 - protein, 17 aa, Mycobacterium tuberculosis
ADIAIVFAIRAEGEGFD

SEQ ID NO: 1498127 - protein, 18 aa, Mycobacterium tuberculosis
AEFLEVRGSLLPDDERLL

SEQ ID NO: 1498128 - protein, 18 aa, Mycobacterium tuberculosis
AEGGRFACGGARPADREV

SEQ ID NO: 1498129 - protein, 18 aa, Mycobacterium tuberculosis
AELLVRYRVGVQAVQTVE

SEQ ID NO: 1498130 - protein, 17 aa, Mycobacterium tuberculosis
AELPRIAGMGFDVVYLP

SEQ ID NO: 1498131 - protein, 22 aa, Mycobacterium tuberculosis
AERFVLGVGFGWNVEELADHGV

SEQ ID NO: 1498132 - protein, 17 aa, Mycobacterium tuberculosis
AFRLLGHVDVVFSNAGI

SEQ ID NO: 1498133 - protein, 19 aa, Mycobacterium tuberculosis
AGGAGGFGAVLFGNGGAGG

SEQ ID NO: 1498134 - protein, 21 aa, Mycobacterium tuberculosis
AGGAGGWLWGNGGAGGNGGVG

SEQ ID NO: 1498135 - protein, 20 aa, Mycobacterium tuberculosis
AGGSGFFGGKGGFGGDGGQG

SEQ ID NO: 1498136 - protein, 19 aa, Mycobacterium tuberculosis
AGGSGGWLLGNGGVGGAGG

SEQ ID NO: 1498137 - protein, 18 aa, Mycobacterium tuberculosis
AGLVGKLSVPQGWTVAAP

SEQ ID NO: 1498138 - protein, 18 aa, Mycobacterium tuberculosis
AGPEPMAAAATAWDGLAM

SEQ ID NO: 1498139 - protein, 18 aa, Mycobacterium tuberculosis
AHGVPFLGIRGMSDGPGD

SEQ ID NO: 1498140 - protein, 17 aa, Mycobacterium tuberculosis
AHLRAFRAYAAHSQEIA

SEQ ID NO: 1498141 - protein, 18 aa, Mycobacterium tuberculosis
AILPRFFYTKEIGKRLNA

SEQ ID NO: 1498142 - protein, 18 aa, Mycobacterium tuberculosis
AKMLRLNAGLGNVGNYNV

SEQ ID NO: 1498143 - protein, 18 aa, Mycobacterium tuberculosis
ALFGRPLIGNGANGTAAS

SEQ ID NO: 1498144 - protein, 18 aa, Mycobacterium tuberculosis
ALIFGEFDLPQLVVHPYT

SEQ ID NO: 1498145 - protein, 18 aa, Mycobacterium tuberculosis
ALLARRRMDLYGATVEDF

SEQ ID NO: 1498146 - protein, 18 aa, Mycobacterium tuberculosis
ALPRRHKLVLSRGPYGYH

SEQ ID NO: 1498147 - protein, 18 aa, Mycobacterium tuberculosis
ALQGLALPTASQSASATP

SEQ ID NO: 1498148 - protein, 23 aa, Mycobacterium tuberculosis
ANAEALVPITALLPAGADDVSAA

SEQ ID NO: 1498149 - protein, 19 aa, Mycobacterium tuberculosis
ANGDPGFAGGKGGNGGIGG

SEQ ID NO: 1498150 - protein, 19 aa, Mycobacterium tuberculosis
ANGNFAFGDGNGGHGGNGG

SEQ ID NO: 1498151 - protein, 23 aa, Mycobacterium tuberculosis
APAALGLICPWADLAVDIEATRP

SEQ ID NO: 1498152 - protein, 24 aa, Mycobacterium tuberculosis
APSSGIGIVEGWRGTIVHRVEIDV

SEQ ID NO: 1498153 - protein, 17 aa, Mycobacterium tuberculosis
ARFGAWYEMFPRSTGGW

SEQ ID NO: 1498154 - protein, 18 aa, Mycobacterium tuberculosis
ARGCAKWLASEDFSQAID

SEQ ID NO: 1498155 - protein, 18 aa, Mycobacterium tuberculosis
ARGKIAMLAKVRRAPALI

SEQ ID NO: 1498156 - protein, 17 aa, Mycobacterium tuberculosis
ARLGYPLDRSHTAAVIW

SEQ ID NO: 1498157 - protein, 17 aa, Mycobacterium tuberculosis
ARRELIASIPGIGVGAS

SEQ ID NO: 1498158 - protein, 20 aa, Mycobacterium tuberculosis
ARSRSALGWIIERYRVTTDK

SEQ ID NO: 1498159 - protein, 17 aa, Mycobacterium tuberculosis
ASDAAACALDLQRTSLA

SEQ ID NO: 1498160 - protein, 17 aa, Mycobacterium tuberculosis
ASLRLLVRGGRFLEMGK

SEQ ID NO: 1498161 - protein, 17 aa, Mycobacterium tuberculosis
ASRACVVINHIMPGEPN

SEQ ID NO: 1498162 - protein, 19 aa, Mycobacterium tuberculosis
ATGRPPRWVRPIVDALGFA

SEQ ID NO: 1498163 - protein, 20 aa, Mycobacterium tuberculosis
AVADWLYWQYVTGLLDRALA

SEQ ID NO: 1498164 - protein, 17 aa, Mycobacterium tuberculosis
AVLWRYALRLTGDAAQA

SEQ ID NO: 1498165 - protein, 17 aa, Mycobacterium tuberculosis
AVRWRLSGLGLRVIAHD

SEQ ID NO: 1498166 - protein, 18 aa, Mycobacterium tuberculosis
AVSEIPWSYDIGSNIEIP

SEQ ID NO: 1498167 - protein, 17 aa, Mycobacterium tuberculosis
AWLASAIETAYCAPPPV

SEQ ID NO: 1498168 - protein, 19 aa, Mycobacterium tuberculosis
AYDRAWWFARFVAAAYGTA

SEQ ID NO: 1498169 - protein, 18 aa, Mycobacterium tuberculosis
CASAWLDALVGWRRASGL

SEQ ID NO: 1498170 - protein, 17 aa, Mycobacterium tuberculosis
CLVALAILDTVGVSPEQ

SEQ ID NO: 1498171 - protein, 17 aa, Mycobacterium tuberculosis
DDQVCLVVEVFRMLADA

SEQ ID NO: 1498172 - protein, 23 aa, Mycobacterium tuberculosis
DEVSAAIATLFGSHAREYQAIST

SEQ ID NO: 1498173 - protein, 19 aa, Mycobacterium tuberculosis
DLRDEWQIALCNNGFDANR

SEQ ID NO: 1498174 - protein, 18 aa, Mycobacterium tuberculosis
DLVRRYAPKLALIVTSHQ

SEQ ID NO: 1498175 - protein, 25 aa, Mycobacterium tuberculosis
DQLSELWKAISPHLSPLSNIVSMLN

SEQ ID NO: 1498176 - protein, 17 aa, Mycobacterium tuberculosis
DSEGWIYLAGRTADWMR

SEQ ID NO: 1498177 - protein, 17 aa, Mycobacterium tuberculosis
DTGRCRVPLILRLDPKI

SEQ ID NO: 1498178 - protein, 38 aa, Mycobacterium tuberculosis; identical to SEQ ID NO: 212602

SEQ ID NO: 1498179 - protein, 20 aa, Mycobacterium tuberculosis
EFLSAAATDLANLGSTISAA

SEQ ID NO: 1498180 - protein, 19 aa, Mycobacterium tuberculosis
EHAELPPGWVLTTSGRISG

SEQ ID NO: 1498181 - protein, 23 aa, Mycobacterium tuberculosis
EIDNLRAAFAWSRENDHITEALQ

SEQ ID NO: 1498182 - protein, 22 aa, Mycobacterium tuberculosis
ELGLRPRLAIGIHQPGVGALRP

SEQ ID NO: 1498183 - protein, 17 aa, Mycobacterium tuberculosis
ERQYYWFGEPIDTTEFM

SEQ ID NO: 1498184 - protein, 17 aa, Mycobacterium tuberculosis
ETELMAWAIPRAANRFW

SEQ ID NO: 1498185 - protein, 18 aa, Mycobacterium tuberculosis
ETLVRAASDLANIGSTLG

SEQ ID NO: 1498186 - protein, 32 aa, Mycobacterium tuberculosis; identical to SEQ ID NO: 198861

SEQ ID NO: 1498187 - protein, 19 aa, Mycobacterium tuberculosis
EVNSALMFAGAGSGPTLAA

SEQ ID NO: 1498188 - protein, 21 aa, Mycobacterium tuberculosis
EVSAAMAALFGAHAQEYQRLS

SEQ ID NO: 1498189 - protein, 22 aa, Mycobacterium tuberculosis
EVSAAVAALFGSYAQSYQAFGA

SEQ ID NO: 1498190 - protein, 18 aa, Mycobacterium tuberculosis
EVVRALDMLFILHADHEQ

SEQ ID NO: 1498191 - protein, 18 aa, Mycobacterium tuberculosis
FAAEAAFVFAMIAVDLSR

SEQ ID NO: 1498192 - protein, 19 aa, Mycobacterium tuberculosis
FDIPNDFVVGYGLDYDERY

SEQ ID NO: 1498193 - protein, 17 aa, Mycobacterium tuberculosis
FFKRCFNIMPADGRMTV

SEQ ID NO: 1498194 - protein, 21 aa, Mycobacterium tuberculosis
FGAGGAGGFGFGGAGGAGGLG

SEQ ID NO: 1498195 - protein, 18 aa, Mycobacterium tuberculosis
FGAWYEMFPRSTGGWDDD

SEQ ID NO: 1498196 - protein, 17 aa, Mycobacterium tuberculosis
FGMQDVIWRGAYYTPNG

SEQ ID NO: 1498197 - protein, 17 aa, Mycobacterium tuberculosis
FGVLVIRCALCTDTVKR

SEQ ID NO: 1498198 - protein, 18 aa, Mycobacterium tuberculosis
FIRKPARWMQLLAKHQAP

SEQ ID NO: 1498199 - protein, 18 aa, Mycobacterium tuberculosis
FPEELGKMGFVFNFITYG

SEQ ID NO: 1498200 - protein, 19 aa, Mycobacterium tuberculosis
FPTCLERGAGIPAVERLAY

SEQ ID NO: 1498201 - protein, 21 aa, Mycobacterium tuberculosis
FRGLTAMWRRGDEVFAEVALP

SEQ ID NO: 1498202 - protein, 18 aa, Mycobacterium tuberculosis
FRLTDAAVWERFYGSSHA

SEQ ID NO: 1498203 - protein, 21 aa, Mycobacterium tuberculosis
FRPGPRRRLGVLVDHLVAGSK

SEQ ID NO: 1498204 - protein, 25 aa, Mycobacterium tuberculosis
FSNGILWRGNFEGLFGLNVGITIPE

SEQ ID NO: 1498205 - protein, 20 aa, Mycobacterium tuberculosis
GADAVNVVFMPTEPQAATGT

SEQ ID NO: 1498206 - protein, 20 aa, Mycobacterium tuberculosis
GADWPRLVAPVFDPKKAVVF

SEQ ID NO: 1498207 - protein, 23 aa, Mycobacterium tuberculosis
GAEASWVVGITWWSAVVGGFQMS

SEQ ID NO: 1498208 - protein, 26 aa, Mycobacterium tuberculosis
GAGGAGPVLFGHGGAGGMGGQGGTGG

SEQ ID NO: 1498209 - protein, 21 aa, Mycobacterium tuberculosis
GAGGLIGWAGAAGGTGAGGTG

SEQ ID NO: 1498210 - protein, 18 aa, Mycobacterium tuberculosis
GAGGLIWGNGGAGGNGGN

SEQ ID NO: 1498211 - protein, 25 aa, Mycobacterium tuberculosis
GAGGNGGRGGMLIGNGGAGGAGGTG

SEQ ID NO: 1498212 - protein, 17 aa, Mycobacterium tuberculosis
GAGGPGFNGGAGGAGGR

SEQ ID NO: 1498213 - protein, 22 aa, Mycobacterium tuberculosis
GAGGRGGKGIDGGFGGDGGNGG

SEQ ID NO: 1498214 - protein, 18 aa, Mycobacterium tuberculosis
GAGGRSGLFEVLAAGGAG

SEQ ID NO: 1498215 - protein, 19 aa, Mycobacterium tuberculosis
GAIYQRWQALGGMNSALGA

SEQ ID NO: 1498216 - protein, 17 aa, Mycobacterium tuberculosis
GARGLAHFGVYQELTEA

SEQ ID NO: 1498217 - protein, 19 aa, Mycobacterium tuberculosis
GAWWPARPDAPMAGVTYWR

SEQ ID NO: 1498218 - protein, 22 aa, Mycobacterium tuberculosis
GESRLRLLGFERVELEPGQTRR

SEQ ID NO: 1498219 - protein, 21 aa, Mycobacterium tuberculosis
GGAGGFGFLGGDGGAGGNAGL

SEQ ID NO: 1498220 - protein, 18 aa, Mycobacterium tuberculosis
GGDAGWLIGNGGAGGSGA

SEQ ID NO: 1498221 - protein, 21 aa, Mycobacterium tuberculosis
GGDGGRGGLLAGNGGTGGAGG

SEQ ID NO: 1498222 - protein, 22 aa, Mycobacterium tuberculosis
GGDGGRGGLLYGDGGAGGAGGN

SEQ ID NO: 1498223 - protein, 23 aa, Mycobacterium tuberculosis
GGEGGVGSILGGPGGNGGTGGNA

SEQ ID NO: 1498224 - protein, 24 aa, Mycobacterium tuberculosis
GGGGGNGGTGWNGGKGDTGSGGGA

SEQ ID NO: 1498225 - protein, 24 aa, Mycobacterium tuberculosis
GGIRGPIGLGFRVPCFVISPYSRG

SEQ ID NO: 1498226 - protein, 21 aa, Mycobacterium tuberculosis
GGNGATGTWGHNLGAGGTGGN

SEQ ID NO: 1498227 - protein, 17 aa, Mycobacterium tuberculosis
GGQGNHTGGHGGAGGSA

SEQ ID NO: 1498228 - protein, 22 aa, Mycobacterium tuberculosis
GGTGGPGGFGIFGGGAGGDGGS

SEQ ID NO: 1498229 - protein, 24 aa, Mycobacterium tuberculosis
GGVGGRGGDGVFAGAGGQGGLGGQ

SEQ ID NO: 1498230 - protein, 23 aa, Mycobacterium tuberculosis
GHMPVRRLDLIWISARNAARREL

SEQ ID NO: 1498231 - protein, 18 aa, Mycobacterium tuberculosis
GILCLEFLVHAWDFAIAT

SEQ ID NO: 1498232 - protein, 18 aa, Mycobacterium tuberculosis
GLDLLPRLLFRNGELDIS

SEQ ID NO: 1498233 - protein, 17 aa, Mycobacterium tuberculosis
GLKVSIPEEVAWRMGWI

SEQ ID NO: 1498234 - protein, 21 aa, Mycobacterium tuberculosis
GLLWRADRQGLLAANYTITIE

SEQ ID NO: 1498235 - protein, 22 aa, Mycobacterium tuberculosis
GLPSRLRLGVCVTDAGRRNPAV

SEQ ID NO: 1498236 - protein, 17 aa, Mycobacterium tuberculosis
GLTEAIAAYSTRLKITP

SEQ ID NO: 1498237 - protein, 26 aa, Mycobacterium tuberculosis
GNFSNGVLWRGDYEGLWGLSGGSTIP

SEQ ID NO: 1498238 - protein, 25 aa, Mycobacterium tuberculosis
GNGADAAAVVGFGANGDPGFAGGKG

SEQ ID NO: 1498239 - protein, 18 aa, Mycobacterium tuberculosis
GNGGWLYGNGGPGGAAGL

SEQ ID NO: 1498240 - protein, 17 aa, Mycobacterium tuberculosis
GPCKMVAPVLEEIATER

SEQ ID NO: 1498241 - protein, 22 aa, Mycobacterium tuberculosis
GPGGGHGLLGLGGSHGAGGAGG

SEQ ID NO: 1498242 - protein, 17 aa, Mycobacterium tuberculosis
GPGGLFLALPGARADGH

SEQ ID NO: 1498243 - protein, 21 aa, Mycobacterium tuberculosis
GPIVIGSFFLPAFNIPGIDVP

SEQ ID NO: 1498244 - protein, 21 aa, Mycobacterium tuberculosis
GPRLRYLLAVKACFAVFQTGT

SEQ ID NO: 1498245 - protein, 19 aa, Mycobacterium tuberculosis
GPYAHGWVTWFPPDAPPGT

SEQ ID NO: 1498246 - protein, 17 aa, Mycobacterium tuberculosis
GQLRARFAAGLSAMYAA

SEQ ID NO: 1498247 - protein, 18 aa, Mycobacterium tuberculosis
GRCLMPASSAARCAARIV

SEQ ID NO: 1498248 - protein, 20 aa, Mycobacterium tuberculosis
GRCTPIAAWLAGLGLFTKRS

SEQ ID NO: 1498249 - protein, 17 aa, Mycobacterium tuberculosis
GRDAWEFALLRGALQRG

SEQ ID NO: 1498250 - protein, 18 aa, Mycobacterium tuberculosis
GRHIPVFAHVTVETTGTM

SEQ ID NO: 1498251 - protein, 18 aa, Mycobacterium tuberculosis
GRLSDMVRRILRSMFAVG

SEQ ID NO: 1498252 - protein, 19 aa, Mycobacterium tuberculosis
GRSEVRILFAFDPARQAIM

SEQ ID NO: 1498253 - protein, 18 aa, Mycobacterium tuberculosis
GSAFGPGGTGGMGGAGGT

SEQ ID NO: 1498254 - protein, 20 aa, Mycobacterium tuberculosis
GSEAPGRPGGAGGTGGAGGN

SEQ ID NO: 1498255 - protein, 25 aa, Mycobacterium tuberculosis
GSGGAGGLIGWAGAAGGTGAGGTGG

SEQ ID NO: 1498256 - protein, 27 aa, Mycobacterium tuberculosis
GSGGAGGLIGWAGAAGGTGAGGTGGQG

SEQ ID NO: 1498257 - protein, 23 aa, Mycobacterium tuberculosis
GSIFLRPFLKYQIITVVAPNSPL

SEQ ID NO: 1498258 - protein, 20 aa, Mycobacterium tuberculosis
GSTMTLPLISMRFEGEDWIL

SEQ ID NO: 1498259 - protein, 21 aa, Mycobacterium tuberculosis
GSTMTLPLISMRFEGEDWILG

SEQ ID NO: 1498260 - protein, 18 aa, Mycobacterium tuberculosis
GSVLSGLAALHWRGPAAE

SEQ ID NO: 1498261 - protein, 26 aa, Mycobacterium tuberculosis
GTVGAFPFGFGWQQSPGFFNSTTTPS

SEQ ID NO: 1498262 - protein, 17 aa, Mycobacterium tuberculosis
GVAWVIAYRWFRAGLLP

SEQ ID NO: 1498263 - protein, 19 aa, Mycobacterium tuberculosis
GWCIADRRIGVITGEVGAG

SEQ ID NO: 1498264 - protein, 17 aa, Mycobacterium tuberculosis
HAAICWPLLVGMAKAKY

SEQ ID NO: 1498265 - protein, 19 aa, Mycobacterium tuberculosis
HAWVQAWTGGWWHYDPTND

SEQ ID NO: 1498266 - protein, 20 aa, Mycobacterium tuberculosis
HCNIEHGCVVARAETLRGAE

SEQ ID NO: 1498267 - protein, 22 aa, Mycobacterium tuberculosis
HGGDGFRTAGAGGRGGDGGKGA

SEQ ID NO: 1498268 - protein, 17 aa, Mycobacterium tuberculosis
HRLRALIVELERLYNHA

SEQ ID NO: 1498269 - protein, 19 aa, Mycobacterium tuberculosis
IALTFGVDIPIHIPINIDA

SEQ ID NO: 1498270 - protein, 21 aa, Mycobacterium tuberculosis
IAVETCWRKAIQMDYETDTDT

SEQ ID NO: 1498271 - protein, 17 aa, Mycobacterium tuberculosis
IAYRWFRAGLLPVPAQR

SEQ ID NO: 1498272 - protein, 19 aa, Mycobacterium tuberculosis
ICIPVPFYHCFGMVMGNLA

SEQ ID NO: 1498273 - protein, 17 aa, Mycobacterium tuberculosis
IDSPTLPTCERIAVLSQ

SEQ ID NO: 1498274 - protein, 19 aa, Mycobacterium tuberculosis
IEMADWWAYLNGVRKTYPL

SEQ ID NO: 1498275 - protein, 21 aa, Mycobacterium tuberculosis
IGNRPKIGWRRLEAQAVLSRL

SEQ ID NO: 1498276 - protein, 17 aa, Mycobacterium tuberculosis
IKINPITLWPAQNFNQT

SEQ ID NO: 1498277 - protein, 17 aa, Mycobacterium tuberculosis
IKLGVLPGMGGSQRLTR

SEQ ID NO: 1498278 - protein, 17 aa, Mycobacterium tuberculosis
IPPEHAHKLVFAVLRGV

SEQ ID NO: 1498279 - protein, 17 aa, Mycobacterium tuberculosis
IPWSYDIGSNIEIPIEG

SEQ ID NO: 1498280 - protein, 21 aa, Mycobacterium tuberculosis
IPYYSATLWDPRERPSFTGEY

SEQ ID NO: 1498281 - protein, 17 aa, Mycobacterium tuberculosis
ITLPTPRPPFHEELPRI

SEQ ID NO: 1498282 - protein, 19 aa, Mycobacterium tuberculosis
IWWQRAVAVWPDYASYQTK

SEQ ID NO: 1498283 - protein, 22 aa, Mycobacterium tuberculosis
KAAPLWRVLVALSIRHVGPTAA

SEQ ID NO: 1498284 - protein, 18 aa, Mycobacterium tuberculosis
KANLFYRGLRFHRFPAVG

SEQ ID NO: 1498285 - protein, 17 aa, Mycobacterium tuberculosis
KASEVVEPWSLRLSHPE

SEQ ID NO: 1498286 - protein, 20 aa, Mycobacterium tuberculosis
KEGDDVFVALSWTKHPPPQT

SEQ ID NO: 1498287 - protein, 21 aa, Mycobacterium tuberculosis
KGGTGGWLWGSGGAGGAGGSG

SEQ ID NO: 1498288 - protein, 18 aa, Mycobacterium tuberculosis
KHFRCVSVDLLARRPVVH

SEQ ID NO: 1498289 - protein, 17 aa, Mycobacterium tuberculosis
KRCFNIMPADGRMTVQS

SEQ ID NO: 1498290 - protein, 18 aa, Mycobacterium tuberculosis
KTVIGLNMLRLWDDRRTL

SEQ ID NO: 1498291 - protein, 20 aa, Mycobacterium tuberculosis
LACVVLRVARFFVEGDDMPD

SEQ ID NO: 1498292 - protein, 17 aa, Mycobacterium tuberculosis
LADCRKLGITVLPPDVN

SEQ ID NO: 1498293 - protein, 17 aa, Mycobacterium tuberculosis
LADLSFADYLMWVRRDD

SEQ ID NO: 1498294 - protein, 18 aa, Mycobacterium tuberculosis
LADQAVRQWGFMQGLKQK

SEQ ID NO: 1498295 - protein, 17 aa, Mycobacterium tuberculosis
LALRLAEHGLRDERLAD

SEQ ID NO: 1498296 - protein, 19 aa, Mycobacterium tuberculosis
LAPLRGGYIGDITPLGGGA

SEQ ID NO: 1498297 - protein, 20 aa, Mycobacterium tuberculosis
LARARWRRVRSLPHLQDRWV

SEQ ID NO: 1498298 - protein, 19 aa, Mycobacterium tuberculosis
LCLRFSSRLGITVASVDYR

SEQ ID NO: 1498299 - protein, 21 aa, Mycobacterium tuberculosis
LDQPCSFYDWRRSAADGPRLH

SEQ ID NO: 1498300 - protein, 21 aa, Mycobacterium tuberculosis
LDVINAPALALLGRPLIGNGA

SEQ ID NO: 1498301 - protein, 18 aa, Mycobacterium tuberculosis
LDVPRITIVDAHLDGGFG

SEQ ID NO: 1498302 - protein, 19 aa, Mycobacterium tuberculosis
LEGVLDVINAPALALLGRP

SEQ ID NO: 1498303 - protein, 19 aa, Mycobacterium tuberculosis
LFYRGLRFHRFPAVGDTLY

SEQ ID NO: 1498304 - protein, 19 aa, Mycobacterium tuberculosis
LFYSGFYLPMYWSSRAKLT

SEQ ID NO: 1498305 - protein, 21 aa, Mycobacterium tuberculosis
LGRLWLARGGTYALANIRGGG

SEQ ID NO: 1498306 - protein, 19 aa, Mycobacterium tuberculosis
LILRRPRAGLSYEALLETV

SEQ ID NO: 1498307 - protein, 17 aa, Mycobacterium tuberculosis
LLAARLARRIPYVTAVD

SEQ ID NO: 1498308 - protein, 17 aa, Mycobacterium tuberculosis
LLEVSWEALEHAGIIPE

SEQ ID NO: 1498309 - protein, 18 aa, Mycobacterium tuberculosis
LLEYHWGPDWVVWDAAKT

SEQ ID NO: 1498310 - protein, 24 aa, Mycobacterium tuberculosis
LLKVRLRQGLPLARLGAAERERAE

SEQ ID NO: 1498311 - protein, 19 aa, Mycobacterium tuberculosis
LLLGRPLIGNGANGAPGTG

SEQ ID NO: 1498312 - protein, 24 aa, Mycobacterium tuberculosis
LLRATKYTVCFKFMSRIVPYPGTP

SEQ ID NO: 1498313 - protein, 18 aa, Mycobacterium tuberculosis
LLTGWRDAWELGRAARDN

SEQ ID NO: 1498314 - protein, 20 aa, Mycobacterium tuberculosis
LLWRAFRPGTHVPIIDYTVP

SEQ ID NO: 1498315 - protein, 19 aa, Mycobacterium tuberculosis
LMRRIKQSFDPAGILNPGV

SEQ ID NO: 1498316 - protein, 18 aa, Mycobacterium tuberculosis
LPDIPGYAAKVFRAVADA

SEQ ID NO: 1498317 - protein, 20 aa, Mycobacterium tuberculosis
LPGIWYAGSHGFELTAPDGT

SEQ ID NO: 1498318 - protein, 20 aa, Mycobacterium tuberculosis
LPLEFARLAGYYLAEGHACL

SEQ ID NO: 1498319 - protein, 17 aa, Mycobacterium tuberculosis
LPTRVLLISAHDEPAIV

SEQ ID NO: 1498320 - protein, 17 aa, Mycobacterium tuberculosis
LPTVRGAFCLTFMDENT

SEQ ID NO: 1498321 - protein, 18 aa, Mycobacterium tuberculosis
LQARLRLAITRRRSTLAG

SEQ ID NO: 1498322 - protein, 17 aa, Mycobacterium tuberculosis
LQSVLYLRFREWFLPAI

SEQ ID NO: 1498323 - protein, 17 aa, Mycobacterium tuberculosis
LRAVLVPHALRLREAAL

SEQ ID NO: 1498324 - protein, 22 aa, Mycobacterium tuberculosis
LRCPGLLPPGCHQPVLVVGLVG

SEQ ID NO: 1498325 - protein, 17 aa, Mycobacterium tuberculosis
LRDGGCNDVILVLGAVE

SEQ ID NO: 1498326 - protein, 17 aa, Mycobacterium tuberculosis
LRELRAAQSLTQVQVAA

SEQ ID NO: 1498327 - protein, 17 aa, Mycobacterium tuberculosis
LRLAEHGLRDERLADIL

SEQ ID NO: 1498328 - protein, 17 aa, Mycobacterium tuberculosis
LRLNAGLGNVGNYNVGL

SEQ ID NO: 1498329 - protein, 19 aa, Mycobacterium tuberculosis
LRPDFPRPALLSGAGDAVE

SEQ ID NO: 1498330 - protein, 22 aa, Mycobacterium tuberculosis
LRPGGRLGLVWNTRDERLGWVR

SEQ ID NO: 1498331 - protein, 19 aa, Mycobacterium tuberculosis
LRSAAPIWWNGQDPGKGGG

SEQ ID NO: 1498332 - protein, 18 aa, Mycobacterium tuberculosis
LRSDILPISFGFPFGFSA

SEQ ID NO: 1498333 - protein, 17 aa, Mycobacterium tuberculosis
LRSLLRFVLDLLADYGL

SEQ ID NO: 1498334 - protein, 19 aa, Mycobacterium tuberculosis
LRSRFGFLAIHGGGLEQAT

SEQ ID NO: 1498335 - protein, 25 aa, Mycobacterium tuberculosis
LRVYRFGGSLHLDWWYDTRRIPAAT

SEQ ID NO: 1498336 - protein, 20 aa, Mycobacterium tuberculosis
LSGQVGWLARDRWAVPLVHT

SEQ ID NO: 1498337 - protein, 22 aa, Mycobacterium tuberculosis
LSLPRRLQIEFSQVIQKIAEGT

SEQ ID NO: 1498338 - protein, 19 aa, Mycobacterium tuberculosis
LSNILLLGPVGDLFPILSI

SEQ ID NO: 1498339 - protein, 17 aa, Mycobacterium tuberculosis
LVIVLVRRWPKVISRAM

SEQ ID NO: 1498340 - protein, 18 aa, Mycobacterium tuberculosis
LWRMGIRTIGQFAALSRT

SEQ ID NO: 1498341 - protein, 18 aa, Mycobacterium tuberculosis
LYSRFWHKVLYDLGHVSS

SEQ ID NO: 1498342 - protein, 20 aa, Mycobacterium tuberculosis
MALLGRPLIGHGADGAPGTG

SEQ ID NO: 1498343 - protein, 26 aa, Mycobacterium tuberculosis
MERLYKTSWRFAPFLWQEIEEGILPA

SEQ ID NO: 1498344 - protein, 17 aa, Mycobacterium tuberculosis
MFRPKLDALALLHRLSL

SEQ ID NO: 1498345 - protein, 18 aa, Mycobacterium tuberculosis
MMATAAFDLARIGSQVSA

SEQ ID NO: 1498346 - protein, 17 aa, Mycobacterium tuberculosis
MRAGLTWQQVVLLRAYA

SEQ ID NO: 1498347 - protein, 17 aa, Mycobacterium tuberculosis
MRVVHELSALPAEVEAA

SEQ ID NO: 1498348 - protein, 18 aa, Mycobacterium tuberculosis
NAVIPGDGVGKAPHGDAG

SEQ ID NO: 1498349 - protein, 27 aa, Mycobacterium tuberculosis
NGAFWRGDYQGLLGFSYRPAVLPQTPF

SEQ ID NO: 1498350 - protein, 22 aa, Mycobacterium tuberculosis
NGAFWRGDYQGLLGFSYTSTII

SEQ ID NO: 1498351 - protein, 24 aa, Mycobacterium tuberculosis
NGAHGTVGAQFVPATSLPTPNGGA

SEQ ID NO: 1498352 - protein, 25 aa, Mycobacterium tuberculosis
NGGSGGRGDMAFKDGDGGAGGDGGD

SEQ ID NO: 1498353 - protein, 19 aa, Mycobacterium tuberculosis
NGIAAKGEMRWQFHHVIDV

SEQ ID NO: 1498354 - protein, 25 aa, Mycobacterium tuberculosis
NGNWVWRYDAIRTFGDFAGLWDDVD

SEQ ID NO: 1498355 - protein, 17 aa, Mycobacterium tuberculosis
NGPRYWLMNAIEKAPQG

SEQ ID NO: 1498356 - protein, 17 aa, Mycobacterium tuberculosis
NITAYWKGYTEYHQLGL

SEQ ID NO: 1498357 - protein, 19 aa, Mycobacterium tuberculosis
NLPKGRLSDMVRRILRSMF

SEQ ID NO: 1498358 - protein, 18 aa, Mycobacterium tuberculosis
NLYRAALMLSLKDAISRD

SEQ ID NO: 1498359 - protein, 21 aa, Mycobacterium tuberculosis
NPGAVPGRAGGAGGLGGSGSD

SEQ ID NO: 1498360 - protein, 17 aa, Mycobacterium tuberculosis
NQQFALLFVDWLAANPG

SEQ ID NO: 1498361 - protein, 25 aa, Mycobacterium tuberculosis
NYSNGVLWRGDYQGLIGADIALEIP

SEQ ID NO: 1498362 - protein, 17 aa, Mycobacterium tuberculosis
PCAWLAEGLVRYLPARA

SEQ ID NO: 1498363 - protein, 19 aa, Mycobacterium tuberculosis
PEFPIHWTSTGGIGPIIIP

SEQ ID NO: 1498364 - protein, 22 aa, Mycobacterium tuberculosis
PEGLRWLYNFIKAQGERNFGKI

SEQ ID NO: 1498365 - protein, 20 aa, Mycobacterium tuberculosis
PEINSALMFAGAGPGPMLAA

SEQ ID NO: 1498366 - protein, 17 aa, Mycobacterium tuberculosis
PETEAILAWATAQSLPA

SEQ ID NO: 1498367 - protein, 22 aa, Mycobacterium tuberculosis
PFWDRLRFPAALDRVQVPVLLV

SEQ ID NO: 1498368 - protein, 22 aa, Mycobacterium tuberculosis
PGELRFGPLQARDELAACEILA

SEQ ID NO: 1498369 - protein, 24 aa, Mycobacterium tuberculosis
PGGIGVNTGTGWAYGGNGGNGGDG

SEQ ID NO: 1498370 - protein, 18 aa, Mycobacterium tuberculosis
PIAIVGMSCRFPGGVDSP

SEQ ID NO: 1498371 - protein, 20 aa, Mycobacterium tuberculosis
PICAPDLLLAQALLRTQHIK

SEQ ID NO: 1498372 - protein, 17 aa, Mycobacterium tuberculosis
PIDLQVIGGIGPIHVQP

SEQ ID NO: 1498373 - protein, 18 aa, Mycobacterium tuberculosis
PIGLELNGGVGPITVLPI

SEQ ID NO: 1498374 - protein, 24 aa, Mycobacterium tuberculosis
PISRIPLTINIRIPVNITLNELPF

SEQ ID NO: 1498375 - protein, 22 aa, Mycobacterium tuberculosis
PKLRQGSYFPDWLLQRRKRAER

SEQ ID NO: 1498376 - protein, 17 aa, Mycobacterium tuberculosis
PLWEMYLVEGLEKNRIA

SEQ ID NO: 1498377 - protein, 17 aa, Mycobacterium tuberculosis
PPFWQNLAELGWLGLHI

SEQ ID NO: 1498378 - protein, 19 aa, Mycobacterium tuberculosis
PPHPAHFLWLNWGPCPPRQ

SEQ ID NO: 1498379 - protein, 17 aa, Mycobacterium tuberculosis
PPVRRLAERGAPEIQAY

SEQ ID NO: 1498380 - protein, 17 aa, Mycobacterium tuberculosis
PRALQGLALPTASQSAS

SEQ ID NO: 1498381 - protein, 17 aa, Mycobacterium tuberculosis
PRCLPQRIAVPVTKLKT

SEQ ID NO: 1498382 - protein, 21 aa, Mycobacterium tuberculosis
PRKLLEEWLAMWSGHYQLKDK

SEQ ID NO: 1498383 - protein, 17 aa, Mycobacterium tuberculosis
PRSQYLVGHLAPVKLTG

SEQ ID NO: 1498384 - protein, 17 aa, Mycobacterium tuberculosis
PRWVLPVSDGVRELAVQ

SEQ ID NO: 1498385 - protein, 17 aa, Mycobacterium tuberculosis
PSHEKLAWARRVLAASR

SEQ ID NO: 1498386 - protein, 22 aa, Mycobacterium tuberculosis
PSIACSRWGMLSPEGRCKTFDA

SEQ ID NO: 1498387 - protein, 22 aa, Mycobacterium tuberculosis
QAAAFHSRFVQALTTAAASYAS

SEQ ID NO: 1498388 - protein, 23 aa, Mycobacterium tuberculosis
QADRAVVVAARLDRAALAGAGAA

SEQ ID NO: 1498389 - protein, 23 aa, Mycobacterium tuberculosis
QEVRWCPGCGDYVILNTIRNFLP

SEQ ID NO: 1498390 - protein, 20 aa, Mycobacterium tuberculosis
QGQCTFSWPPRMELPGYKPN

SEQ ID NO: 1498391 - protein, 24 aa, Mycobacterium tuberculosis
QGSARWRRWLLLLALVGAGDQRRP

SEQ ID NO: 1498392 - protein, 19 aa, Mycobacterium tuberculosis
QLFKQLLMVAGMERYYQIA

SEQ ID NO: 1498393 - protein, 23 aa, Mycobacterium tuberculosis
QLGCAGAACLGEFGGRDNSVIAG

SEQ ID NO: 1498394 - protein, 24 aa, Mycobacterium tuberculosis
QLTRKRLGTGLIEAFSTSCPNCSG

SEQ ID NO: 1498395 - protein, 17 aa, Mycobacterium tuberculosis
QSVVWGLTVGSWIGSSA

SEQ ID NO: 1498396 - protein, 23 aa, Mycobacterium tuberculosis
QVLGFREHASWALASDTLEFVDL

SEQ ID NO: 1498397 - protein, 19 aa, Mycobacterium tuberculosis
RAETGIIYIDEVDKIARKS

SEQ ID NO: 1498398 - protein, 19 aa, Mycobacterium tuberculosis
RAFDALAAWVRAAAAKNMV

SEQ ID NO: 1498399 - protein, 21 aa, Mycobacterium tuberculosis
RASIDPFGWYRSWEEMLTGMA

SEQ ID NO: 1498400 - protein, 17 aa, Mycobacterium tuberculosis
RAVELLDLVGISQPQRR

SEQ ID NO: 1498401 - protein, 22 aa, Mycobacterium tuberculosis
RCATYPVLAVQAWAAFHDMTLR

SEQ ID NO: 1498402 - protein, 17 aa, Mycobacterium tuberculosis
RDLLKFDFYFADSTAFR

SEQ ID NO: 1498403 - protein, 18 aa, Mycobacterium tuberculosis
RERTVLVLRFFDSMTQTQ

SEQ ID NO: 1498404 - protein, 19 aa, Mycobacterium tuberculosis
REYGVRVLVIRPGQVRTRM

SEQ ID NO: 1498405 - protein, 24 aa, Mycobacterium tuberculosis
RFIRDTTWVSVRWYRPGGPLTAQQ

SEQ ID NO: 1498406 - protein, 18 aa, Mycobacterium tuberculosis
RGAMGLNWYLTDPTLQFI

SEQ ID NO: 1498407 - protein, 17 aa, Mycobacterium tuberculosis
RGGKFLNNWRMAELHAK

SEQ ID NO: 1498408 - protein, 18 aa, Mycobacterium tuberculosis
RGILPFSVASVVSGFANI

SEQ ID NO: 1498409 - protein, 19 aa, Mycobacterium tuberculosis
RGPYRLGPEITRMATTVRL

SEQ ID NO: 1498410 - protein, 18 aa, Mycobacterium tuberculosis
RGTAPAGRGFWFPPTVLT

SEQ ID NO: 1498411 - protein, 17 aa, Mycobacterium tuberculosis
RGVTFAVVHFDWERLTD

SEQ ID NO: 1498412 - protein, 19 aa, Mycobacterium tuberculosis
RHGLCGYRRFFSITSLAGL

SEQ ID NO: 1498413 - protein, 17 aa, Mycobacterium tuberculosis
RIFPPGSHIPIPFIEYT

SEQ ID NO: 1498414 - protein, 19 aa, Mycobacterium tuberculosis
RIGLAAAKYWVCKRSTAHA

SEQ ID NO: 1498415 - protein, 17 aa, Mycobacterium tuberculosis
RKTDWLFPQYRELGVYL

SEQ ID NO: 1498416 - protein, 21 aa, Mycobacterium tuberculosis
RKVLPGYILVRMDLTDDSWAA

SEQ ID NO: 1498417 - protein, 18 aa, Mycobacterium tuberculosis
RLGPINIPIEIAGTPGFG

SEQ ID NO: 1498418 - protein, 20 aa, Mycobacterium tuberculosis
RLHHLLATFCGWRAQQLPDG

SEQ ID NO: 1498419 - protein, 20 aa, Mycobacterium tuberculosis
RLRGGQTLIGFLAPRNADNS

SEQ ID NO: 1498420 - protein, 19 aa, Mycobacterium tuberculosis
RLVALRLATVGLRAQSLGR

SEQ ID NO: 1498421 - protein, 18 aa, Mycobacterium tuberculosis
RMHMPGVSICYGMTETSP

SEQ ID NO: 1498422 - protein, 18 aa, Mycobacterium tuberculosis
RMKFEGGVHRVQRVPVTE

SEQ ID NO: 1498423 - protein, 17 aa, Mycobacterium tuberculosis
RNICHQAIFYRRGLFGT

SEQ ID NO: 1498424 - protein, 19 aa, Mycobacterium tuberculosis
RPALTINFCVGFVRQQVNQ

SEQ ID NO: 1498425 - protein, 19 aa, Mycobacterium tuberculosis
RPDLPTGKALVIAEGVLVV

SEQ ID NO: 1498426 - protein, 17 aa, Mycobacterium tuberculosis
RPGAIIRDLNLLRPIYA

SEQ ID NO: 1498427 - protein, 20 aa, Mycobacterium tuberculosis
RPGGGGWGWGVEPPGAAVAE

SEQ ID NO: 1498428 - protein, 20 aa, Mycobacterium tuberculosis
RPLRGCYRIAVLSLKGGVGK

SEQ ID NO: 1498429 - protein, 23 aa, Mycobacterium tuberculosis
RQQTLRASMDWSYALLTDTERIL

SEQ ID NO: 1498430 - protein, 18 aa, Mycobacterium tuberculosis
RRMFDLLVRMGYKEIEVG

SEQ ID NO: 1498431 - protein, 18 aa, Mycobacterium tuberculosis
RRPPAFPEDIWVPERDPG

SEQ ID NO: 1498432 - protein, 19 aa, Mycobacterium tuberculosis
RSGLFEVLAAGGAGGTGGL

SEQ ID NO: 1498433 - protein, 21 aa, Mycobacterium tuberculosis
RTIRIPVHMVEVINKLGRIQR

SEQ ID NO: 1498434 - protein, 24 aa, Mycobacterium tuberculosis
RTRAIARLGSFFSDRRMAALRAAE

SEQ ID NO: 1498435 - protein, 20 aa, Mycobacterium tuberculosis
RVGRRFARLAPIVATHRKLT

SEQ ID NO: 1498436 - protein, 18 aa, Mycobacterium tuberculosis
RVLLRFGLHQALRLGKPL

SEQ ID NO: 1498437 - protein, 19 aa, Mycobacterium tuberculosis
RVRLMRWGLIPSWIKAGPG

SEQ ID NO: 1498438 - protein, 18 aa, Mycobacterium tuberculosis
RVVRAHVPLSEMFGYVGD

SEQ ID NO: 1498439 - protein, 19 aa, Mycobacterium tuberculosis
RWNPKMKRFIFTDRNGIYI

SEQ ID NO: 1498440 - protein, 19 aa, Mycobacterium tuberculosis
SAAIAALFGAHAQAYQTIS

SEQ ID NO: 1498441 - protein, 18 aa, Mycobacterium tuberculosis
SAAYAMRWVAKNVVAAGL

SEQ ID NO: 1498442 - protein, 22 aa, Mycobacterium tuberculosis
SAFGGGNAFGGRGGDGGDGGDG

SEQ ID NO: 1498443 - protein, 21 aa, Mycobacterium tuberculosis
SALLFPSLCHFSGGIPAPEAD

SEQ ID NO: 1498444 - protein, 17 aa, Mycobacterium tuberculosis
SAMAAWLFGRPAAVPEI

SEQ ID NO: 1498445 - protein, 22 aa, Mycobacterium tuberculosis
SAPMLAAAVAWDGLAAELGSAA

SEQ ID NO: 1498446 - protein, 20 aa, Mycobacterium tuberculosis
SDFIICYRLSMADYVAEGQS

SEQ ID NO: 1498447 - protein, 20 aa, Mycobacterium tuberculosis
SDFWCDAEWAGLRGPVAAGL

SEQ ID NO: 1498448 - protein, 17 aa, Mycobacterium tuberculosis
SGGHLFSIYDGCREEGI

SEQ ID NO: 1498449 - protein, 21 aa, Mycobacterium tuberculosis
SGGLIGRAGSDGGVGAGGAGG

SEQ ID NO: 1498450 - protein, 17 aa, Mycobacterium tuberculosis
SGTVFALDLSWGGAGGN

SEQ ID NO: 1498451 - protein, 17 aa, Mycobacterium tuberculosis
SIPPVPGKFYWMSPTQV

SEQ ID NO: 1498452 - protein, 18 aa, Mycobacterium tuberculosis
SKLGGLWKTVSPHLSPIS

SEQ ID NO: 1498453 - protein, 18 aa, Mycobacterium tuberculosis
SKLGGLWKTVSPHRSPIS

SEQ ID NO: 1498454 - protein, 19 aa, Mycobacterium tuberculosis
SLAEVGIGFCFAPRFHPSY

SEQ ID NO: 1498455 - protein, 20 aa, Mycobacterium tuberculosis
SRRIKLAWFLLNAARYMGAG

SEQ ID NO: 1498456 - protein, 17 aa, Mycobacterium tuberculosis
SSSEWMADAALRYLDWL

SEQ ID NO: 1498457 - protein, 19 aa, Mycobacterium tuberculosis
STAVAALFGAHGQAYQALS

SEQ ID NO: 1498458 - protein, 21 aa, Mycobacterium tuberculosis
STEHWMVPASLSMAAAVQPYL

SEQ ID NO: 1498459 - protein, 19 aa, Mycobacterium tuberculosis
SVAVAALFGTHAQEYQTVS

SEQ ID NO: 1498460 - protein, 23 aa, Mycobacterium tuberculosis
SYAMPDVHWGYGFPIGGVAATDV

SEQ ID NO: 1498461 - protein, 24 aa, Mycobacterium tuberculosis
SYAMPDVHWGYGFPIGGVAATDVD

SEQ ID NO: 1498462 - protein, 17 aa, Mycobacterium tuberculosis
TARSWAWLSGRDYVTPD

SEQ ID NO: 1498463 - protein, 18 aa, Mycobacterium tuberculosis
TDVAARWPVPGPRDDKYT

SEQ ID NO: 1498464 - protein, 24 aa, Mycobacterium tuberculosis
TGADGGAGGWLFGNGGNGGHGATG

SEQ ID NO: 1498465 - protein, 19 aa, Mycobacterium tuberculosis
TGLFSGFMSGFGNTGFLQS

SEQ ID NO: 1498466 - protein, 18 aa, Mycobacterium tuberculosis
TGNVCLVTLGLNLFSRGV

SEQ ID NO: 1498467 - protein, 28 aa, Mycobacterium tuberculosis
TGNYSNGFWWRGDYQGLAGISQTITVPD

SEQ ID NO: 1498468 - protein, 19 aa, Mycobacterium tuberculosis
TLLGRPLIGNGADGGPGQN

SEQ ID NO: 1498469 - protein, 22 aa, Mycobacterium tuberculosis
TLPPEINSALIFGGAGSEPMSA

SEQ ID NO: 1498470 - protein, 22 aa, Mycobacterium tuberculosis
TQALFGRPLIGNGADGSPGTGQ

SEQ ID NO: 1498471 - protein, 17 aa, Mycobacterium tuberculosis
TRFGQRLRLRPFDLGAP

SEQ ID NO: 1498472 - protein, 22 aa, Mycobacterium tuberculosis
TSPLLAPINEFFLANTGRPLIG

SEQ ID NO: 1498473 - protein, 22 aa, Mycobacterium tuberculosis
TSWLKSRHSFSFGDHYDPDNTH

SEQ ID NO: 1498474 - protein, 26 aa, Mycobacterium tuberculosis
TTLSIGPFPFRWDYIPPTPANGPIPA

SEQ ID NO: 1498475 - protein, 20 aa, Mycobacterium tuberculosis
TTSICPWKGLAHYYNVVVDG

SEQ ID NO: 1498476 - protein, 19 aa, Mycobacterium tuberculosis
TVIDPRWVLPVSDGVRELA

SEQ ID NO: 1498477 - protein, 17 aa, Mycobacterium tuberculosis
VADLGAPVRLARRPFSS

SEQ ID NO: 1498478 - protein, 17 aa, Mycobacterium tuberculosis
VAPYLGWLISATAQAEQ

SEQ ID NO: 1498479 - protein, 20 aa, Mycobacterium tuberculosis
VARRRARVVVPFQPRLLMVG

SEQ ID NO: 1498480 - protein, 21 aa, Mycobacterium tuberculosis
VAVRRISMSFVNVAPQLVSTA

SEQ ID NO: 1498481 - protein, 18 aa, Mycobacterium tuberculosis
VDIAFTWDHFFPLYGDPD

SEQ ID NO: 1498482 - protein, 17 aa, Mycobacterium tuberculosis
VDLLKPRKAQPLLPGIG

SEQ ID NO: 1498483 - protein, 21 aa, Mycobacterium tuberculosis
VEERARNGLSIVIAPEGTRLD

SEQ ID NO: 1498484 - protein, 21 aa, Mycobacterium tuberculosis
VEFWAFDLLYLDGRALLGTRY

SEQ ID NO: 1498485 - protein, 17 aa, Mycobacterium tuberculosis
VEIGDGFQTARRRGSRA

SEQ ID NO: 1498486 - protein, 18 aa, Mycobacterium tuberculosis
VERTWLDGWLLRAGHGAV

SEQ ID NO: 1498487 - protein, 19 aa, Mycobacterium tuberculosis
VFMPTEPQAATGTAGSAGD

SEQ ID NO: 1498488 - protein, 17 aa, Mycobacterium tuberculosis
VFVALSWTKHPPPQTYD

SEQ ID NO: 1498489 - protein, 23 aa, Mycobacterium tuberculosis
VGGAGGAGWLVGNGGAGGFGGVG

SEQ ID NO: 1498490 - protein, 23 aa, Mycobacterium tuberculosis
VGGKGGTGGLLFGNGGAGGQGGL

SEQ ID NO: 1498491 - protein, 17 aa, Mycobacterium tuberculosis
VGITAVAARAGHPAQDT

SEQ ID NO: 1498492 - protein, 17 aa, Mycobacterium tuberculosis
VGVPKAFYQLDGQTLIE

SEQ ID NO: 1498493 - protein, 19 aa, Mycobacterium tuberculosis
VICRRSRLMSRIAGSGAMA

SEQ ID NO: 1498494 - protein, 19 aa, Mycobacterium tuberculosis
VKISLMRRIKQSFDPAGIL

SEQ ID NO: 1498495 - protein, 19 aa, Mycobacterium tuberculosis
VLPPSGVPYLLGIQSVLVT

SEQ ID NO: 1498496 - protein, 17 aa, Mycobacterium tuberculosis
VPFYHCFGMVMGNLAAT

SEQ ID NO: 1498497 - protein, 22 aa, Mycobacterium tuberculosis
VPMQRIRPSLDWLIKNVGPHAL

SEQ ID NO: 1498498 - protein, 19 aa, Mycobacterium tuberculosis
VRRLDLIWISARNAARREL

SEQ ID NO: 1498499 - protein, 17 aa, Mycobacterium tuberculosis
VRVGFRLGEPAAGELGV

SEQ ID NO: 1498500 - protein, 19 aa, Mycobacterium tuberculosis
VRYRVGELIPVYRSQRALL

SEQ ID NO: 1498501 - protein, 20 aa, Mycobacterium tuberculosis
VSAAIASLFAAHGQAYQAVS

SEQ ID NO: 1498502 - protein, 19 aa, Mycobacterium tuberculosis
VSAAMAALFSGHAQAYQAL

SEQ ID NO: 1498503 - protein, 28 aa, Mycobacterium tuberculosis
VSASAQTLLSRPLIGNGANATTPGGNGG

SEQ ID NO: 1498504 - protein, 18 aa, Mycobacterium tuberculosis
VSDHIRAIVALGGFAWQV

SEQ ID NO: 1498505 - protein, 17 aa, Mycobacterium tuberculosis
VVCAALASAARQAGIDV

SEQ ID NO: 1498506 - protein, 18 aa, Mycobacterium tuberculosis
VVHYGNGVSIVYADVPTT

SEQ ID NO: 1498507 - protein, 17 aa, Mycobacterium tuberculosis
VWPAVVFTLVTLLDDPV

SEQ ID NO: 1498508 - protein, 18 aa, Mycobacterium tuberculosis
WAGPPPQWWAQRFGIEPD

SEQ ID NO: 1498509 - protein, 18 aa, Mycobacterium tuberculosis
WEDKRLGIIIAGFDRRRI

SEQ ID NO: 1498510 - protein, 17 aa, Mycobacterium tuberculosis
WGATMMRAVEKYDVNVV

SEQ ID NO: 1498511 - protein, 24 aa, Mycobacterium tuberculosis
WLCETFPTCLERGAGIPAVERLAY

SEQ ID NO: 1498512 - protein, 18 aa, Mycobacterium tuberculosis
WPSKAELVLAAFIEGIRQ

SEQ ID NO: 1498513 - protein, 17 aa, Mycobacterium tuberculosis
WRFPDRLDRVYVNSRAR

SEQ ID NO: 1498514 - protein, 20 aa, Mycobacterium tuberculosis
WRYDAIRTFGDFAGLWDDVD

SEQ ID NO: 1498515 - protein, 17 aa, Mycobacterium tuberculosis
WSHPLGHRWRWEFESLS

SEQ ID NO: 1498516 - protein, 24 aa, Mycobacterium tuberculosis
WVRDTLRLGGKFPLKAGMLTSLGF

SEQ ID NO: 1498517 - protein, 20 aa, Mycobacterium tuberculosis
YDILFFWVARMMMFGTFVGD

SEQ ID NO: 1498518 - protein, 17 aa, Mycobacterium tuberculosis
YEKLEGVPLTFAGKINR

SEQ ID NO: 1498519 - protein, 18 aa, Mycobacterium tuberculosis
YEKLEGVPLTFAGKINRL

SEQ ID NO: 1498520 - protein, 18 aa, Mycobacterium tuberculosis
YERKEIRDIVAYLRVLDN

SEQ ID NO: 1498521 - protein, 18 aa, Mycobacterium tuberculosis
YQYRPEPPFVLGAEIAGV

SEQ ID NO: 1498522 - protein, 17 aa, Mycobacterium tuberculosis
AAARRLRIIPGIASRTR

SEQ ID NO: 1498523 - protein, 19 aa, Mycobacterium tuberculosis
AAAVPVVFLTAWYGLADLA

SEQ ID NO: 1498524 - protein, 17 aa, Mycobacterium tuberculosis
AAAVWRIRRAAPLLPTV

SEQ ID NO: 1498525 - protein, 26 aa, Mycobacterium tuberculosis
AADEVSTQIAALFGAHARSYQTLSTQ

SEQ ID NO: 1498526 - protein, 17 aa, Mycobacterium tuberculosis
AAPSWRKGPRHIAGRGP

SEQ ID NO: 1498527 - protein, 19 aa, Mycobacterium tuberculosis
AARMACPYLNPGRYVQGRP

SEQ ID NO: 1498528 - protein, 18 aa, Mycobacterium tuberculosis
AARRERTQRLAIAGRPAT

SEQ ID NO: 1498529 - protein, 19 aa, Mycobacterium tuberculosis
AATEARYGEMWAQDASAMY

SEQ ID NO: 1498530 - protein, 17 aa, Mycobacterium tuberculosis
AAVQGWCIGGAVDLISA

SEQ ID NO: 1498531 - protein, 23 aa, Mycobacterium tuberculosis
ADEVSAAIASLFSGNAQAYQALS

SEQ ID NO: 1498532 - protein, 25 aa, Mycobacterium tuberculosis
ADEVSAAIATLFGSHAREYQAISTQ

SEQ ID NO: 1498533 - protein, 18 aa, Mycobacterium tuberculosis
ADGAEGWTADPIIGVGSA

SEQ ID NO: 1498534 - protein, 21 aa, Mycobacterium tuberculosis
AEAGWPVRVWAAALPQQTTSA

SEQ ID NO: 1498535 - protein, 22 aa, Mycobacterium tuberculosis
AEGFGWPWSVCRWVAGENPSAA

SEQ ID NO: 1498536 - protein, 21 aa, Mycobacterium tuberculosis
AENGRSWSRWSFIGAGAPTAL

SEQ ID NO: 1498537 - protein, 19 aa, Mycobacterium tuberculosis
AENRAELMILIATNLLGQN

SEQ ID NO: 1498538 - protein, 21 aa, Mycobacterium tuberculosis
AGDRGGAGGTGFISSDGGAGG

SEQ ID NO: 1498539 - protein, 20 aa, Mycobacterium tuberculosis
AGGSGGWLLGNGGVGGAGGQ

SEQ ID NO: 1498540 - protein, 24 aa, Mycobacterium tuberculosis
AGGTAGWFFGFGGNGGAGGIGVAG

SEQ ID NO: 1498541 - protein, 17 aa, Mycobacterium tuberculosis
AGMFSQPGVHGAGGTGG

SEQ ID NO: 1498542 - protein, 21 aa, Mycobacterium tuberculosis
AGPPQRWFVVWLGTANNPVDK

SEQ ID NO: 1498543 - protein, 17 aa, Mycobacterium tuberculosis
AGPRYGFRVTVMSRPPF

SEQ ID NO: 1498544 - protein, 23 aa, Mycobacterium tuberculosis
AHFCSMCGPKFCSMRITQDVREY

SEQ ID NO: 1498545 - protein, 21 aa, Mycobacterium tuberculosis
AKGEMRWQFHHVIDVAPTILE

SEQ ID NO: 1498546 - protein, 17 aa, Mycobacterium tuberculosis
ALFGRPLIGNGANGTAA

SEQ ID NO: 1498547 - protein, 19 aa, Mycobacterium tuberculosis
ALLGRPLIGNGANGAPGTG

SEQ ID NO: 1498548 - protein, 24 aa, Mycobacterium tuberculosis
ALPNGRYGWRISLPAMVCYWSELA

SEQ ID NO: 1498549 - protein, 17 aa, Mycobacterium tuberculosis
ANLERWAPLLPEGATLV

SEQ ID NO: 1498550 - protein, 17 aa, Mycobacterium tuberculosis
APRLTVWVPVAVNPGAA

SEQ ID NO: 1498551 - protein, 19 aa, Mycobacterium tuberculosis
APSSGIGIVEGWRGTIVHR

SEQ ID NO: 1498552 - protein, 18 aa, Mycobacterium tuberculosis
AQVALAWLISLPGVVAIP

SEQ ID NO: 1498553 - protein, 23 aa, Mycobacterium tuberculosis
AQVSACNAVRCLMWSESPDPTPV

SEQ ID NO: 1498554 - protein, 21 aa, Mycobacterium tuberculosis
ARASFSYGLNAKWPVYLSTKN

SEQ ID NO: 1498555 - protein, 18 aa, Mycobacterium tuberculosis
AREAGRIAAREALPQIME

SEQ ID NO: 1498556 - protein, 19 aa, Mycobacterium tuberculosis
ARIGVLSQVPWLWAKFIGH

SEQ ID NO: 1498557 - protein, 19 aa, Mycobacterium tuberculosis
ARNRSCRRWFGMTPRQYRA

SEQ ID NO: 1498558 - protein, 23 aa, Mycobacterium tuberculosis
ARQEPRISWAAGLRDDGTTTLLV

SEQ ID NO: 1498559 - protein, 19 aa, Mycobacterium tuberculosis
ASDAAACALDLQRTSLAPI

SEQ ID NO: 1498560 - protein, 19 aa, Mycobacterium tuberculosis
ASDVARIGSSIGVANSAAA

SEQ ID NO: 1498561 - protein, 26 aa, Mycobacterium tuberculosis
ASHCYPHFRRFLAEVVRVLRPGRYFP

SEQ ID NO: 1498562 - protein, 19 aa, Mycobacterium tuberculosis
ASLGITLPVALVWAYPTIS

SEQ ID NO: 1498563 - protein, 22 aa, Mycobacterium tuberculosis
ASRGADSWLIRRCSVVQGCLDD

SEQ ID NO: 1498564 - protein, 20 aa, Mycobacterium tuberculosis
ASRNKHGWVTVGYLDDDGYL

SEQ ID NO: 1498565 - protein, 17 aa, Mycobacterium tuberculosis
ATFHDRFVQTLSAAASS

SEQ ID NO: 1498566 - protein, 18 aa, Mycobacterium tuberculosis
ATLKRHCVRVIPWEITGR

SEQ ID NO: 1498567 - protein, 18 aa, Mycobacterium tuberculosis
ATPRFGFEQVCATPAFPH

SEQ ID NO: 1498568 - protein, 18 aa, Mycobacterium tuberculosis
AVQAWRGFSRWLMRAYDV

SEQ ID NO: 1498569 - protein, 18 aa, Mycobacterium tuberculosis
AVVAREFGFPCVVDAQGA

SEQ ID NO: 1498570 - protein, 17 aa, Mycobacterium tuberculosis
AYLTAWHSLCEVGRLSP

SEQ ID NO: 1498571 - protein, 20 aa, Mycobacterium tuberculosis
CAGLVIGSWPDPPGLVAASN

SEQ ID NO: 1498572 - protein, 18 aa, Mycobacterium tuberculosis
CGMACPFCATGQGGLTRN

SEQ ID NO: 1498573 - protein, 17 aa, Mycobacterium tuberculosis
CRWALAAANLWQGNLEA

SEQ ID NO: 1498574 - protein, 17 aa, Mycobacterium tuberculosis
DAKPAQVALAWLISLPG

SEQ ID NO: 1498575 - protein, 17 aa, Mycobacterium tuberculosis
DDALKRKASSVMLESFL

SEQ ID NO: 1498576 - protein, 18 aa, Mycobacterium tuberculosis
DEHLLVRAGHAFQQVTGY

SEQ ID NO: 1498577 - protein, 25 aa, Mycobacterium tuberculosis
DESRLTFLAVRRWYGWSAGRILNLD

SEQ ID NO: 1498578 - protein, 23 aa, Mycobacterium tuberculosis
DEVSAGIAALFSAHAQEYQALSA

SEQ ID NO: 1498579 - protein, 20 aa, Mycobacterium tuberculosis
DGAEFLVRWLTTGWPRQVAE

SEQ ID NO: 1498580 - protein, 29 aa, Mycobacterium tuberculosis
DGGDGGDGGWGRPGGQGGFGSTSGAHGKA

SEQ ID NO: 1498581 - protein, 29 aa, Mycobacterium tuberculosis
DGGKGGFADEFTGGFAQGGRGGFGGNGNT

SEQ ID NO: 1498582 - protein, 21 aa, Mycobacterium tuberculosis
DGPHFECWTVLGAWAEQTSHI

SEQ ID NO: 1498583 - protein, 29 aa, Mycobacterium tuberculosis
DGVVWWQVVLQLPLLPGWPSSPSSPSAPP

SEQ ID NO: 1498584 - protein, 17 aa, Mycobacterium tuberculosis
DHIAGAIKLDWRTDLQD

SEQ ID NO: 1498585 - protein, 18 aa, Mycobacterium tuberculosis
DIGYRIAHHADLTTPPPI

SEQ ID NO: 1498586 - protein, 20 aa, Mycobacterium tuberculosis
DKPFLMPVEDVFTITGRGTV

SEQ ID NO: 1498587 - protein, 17 aa, Mycobacterium tuberculosis
DLRNDWPTALKNAGFDP

SEQ ID NO: 1498588 - protein, 17 aa, Mycobacterium tuberculosis
DPAGARLCVRPMSEFQS

SEQ ID NO: 1498589 - protein, 22 aa, Mycobacterium tuberculosis
DRRGRLLWSLPKGHIELGETAE

SEQ ID NO: 1498590 - protein, 18 aa, Mycobacterium tuberculosis
DRWYWHWDPQFIGGIAAF

SEQ ID NO: 1498591 - protein, 19 aa, Mycobacterium tuberculosis
DWTYPKWAKQVIRVLIAIE

SEQ ID NO: 1498592 - protein, 23 aa, Mycobacterium tuberculosis
DYFKRGAIELAWALLTNSLAAGG

SEQ ID NO: 1498593 - protein, 20 aa, Mycobacterium tuberculosis
EAAAFHGRFVQALTTGGGAY

SEQ ID NO: 1498594 - protein, 20 aa, Mycobacterium tuberculosis
EAGMMLGWHPYQFPDEPDSK

SEQ ID NO: 1498595 - protein, 17 aa, Mycobacterium tuberculosis
EAGWWRLGLAEEIGGMP

SEQ ID NO: 1498596 - protein, 19 aa, Mycobacterium tuberculosis
EALPLAERVDWLYAKASQH

SEQ ID NO: 1498597 - protein, 22 aa, Mycobacterium tuberculosis
EFQCGPRMPMLPGAWDLGTWDR

SEQ ID NO: 1498598 - protein, 20 aa, Mycobacterium tuberculosis
ELLNRLWPLVSLRCNFFTPT

SEQ ID NO: 1498599 - protein, 23 aa, Mycobacterium tuberculosis
EPELRFELCLGVSGVHYPHETGR

SEQ ID NO: 1498600 - protein, 17 aa, Mycobacterium tuberculosis
EPIGMAGEITWRVPSMS

SEQ ID NO: 1498601 - protein, 24 aa, Mycobacterium tuberculosis
EQFSCWRIKLPHVEAAKFDAALQS

SEQ ID NO: 1498602 - protein, 17 aa, Mycobacterium tuberculosis
EVPSAWLSTGMGPGPLL

SEQ ID NO: 1498603 - protein, 19 aa, Mycobacterium tuberculosis
FAIRLELRYLSERDETSML

SEQ ID NO: 1498604 - protein, 22 aa, Mycobacterium tuberculosis
FEFRCARCGVPYTDALPEMPEP

SEQ ID NO: 1498605 - protein, 17 aa, Mycobacterium tuberculosis
FEQVCATPAFPHDSRDW

SEQ ID NO: 1498606 - protein, 23 aa, Mycobacterium tuberculosis
FGVDIPIHIPINIDAGVVTLQGF

SEQ ID NO: 1498607 - protein, 18 aa, Mycobacterium tuberculosis
FMGCCAVAVLAHEAERCR

SEQ ID NO: 1498608 - protein, 18 aa, Mycobacterium tuberculosis
FRRARTWLGATAEAIEAC

SEQ ID NO: 1498609 - protein, 25 aa, Mycobacterium tuberculosis
GADEISAAIAALFGAHGRAYQAASA

SEQ ID NO: 1498610 - protein, 21 aa, Mycobacterium tuberculosis
GAGGHGGWLWGNGGVGGSGGA

SEQ ID NO: 1498611 - protein, 17 aa, Mycobacterium tuberculosis
GAGGLIWGNGGAGGNGG

SEQ ID NO: 1498612 - protein, 20 aa, Mycobacterium tuberculosis
GAGGNAWLFGNGGAGGLGAA

SEQ ID NO: 1498613 - protein, 25 aa, Mycobacterium tuberculosis
GAGGTAGWFFGFGGNGGAGGIGVAG

SEQ ID NO: 1498614 - protein, 24 aa, Mycobacterium tuberculosis
GAGYADMTAIFLGSSGTPGEDGGN

SEQ ID NO: 1498615 - protein, 22 aa, Mycobacterium tuberculosis
GAGYQFPAWRLVGGHQPVNPPA

SEQ ID NO: 1498616 - protein, 23 aa, Mycobacterium tuberculosis
GAIARLPAIFTHRDVGNTDCPGN

SEQ ID NO: 1498617 - protein, 18 aa, Mycobacterium tuberculosis
GAPAHDWLTLTGGAIGYG

SEQ ID NO: 1498618 - protein, 18 aa, Mycobacterium tuberculosis
GAQGGWLIGNGGQGGDSG

SEQ ID NO: 1498619 - protein, 17 aa, Mycobacterium tuberculosis
GCNLACKFCQNWDISKS

SEQ ID NO: 1498620 - protein, 23 aa, Mycobacterium tuberculosis
GDEVSAAIAALFSSHGQQYQAMS

SEQ ID NO: 1498621 - protein, 20 aa, Mycobacterium tuberculosis
GDLLDLGNCYGRDGPGQRDG

SEQ ID NO: 1498622 - protein, 17 aa, Mycobacterium tuberculosis
GDYGFFWITAVTTDGSI

SEQ ID NO: 1498623 - protein, 17 aa, Mycobacterium tuberculosis
GEGCVMLALKRLPDALA

SEQ ID NO: 1498624 - protein, 17 aa, Mycobacterium tuberculosis
GFTGWRPQLPVTQWSVT

SEQ ID NO: 1498625 - protein, 17 aa, Mycobacterium tuberculosis
GGAGGFGAVLFGNGGAG

SEQ ID NO: 1498626 - protein, 22 aa, Mycobacterium tuberculosis
GGAGGGAFVHIATATSTGGSGG

SEQ ID NO: 1498627 - protein, 19 aa, Mycobacterium tuberculosis
GGAGGLLFGDGGNGGAGGA

SEQ ID NO: 1498628 - protein, 19 aa, Mycobacterium tuberculosis
GGAGRDGGAPGGDGGDGGT

SEQ ID NO: 1498629 - protein, 27 aa, Mycobacterium tuberculosis
GGDGGDGGWGRPGGQGGFGSTSGAHGK

SEQ ID NO: 1498630 - protein, 19 aa, Mycobacterium tuberculosis
GGDSGLFGMHGQTYQALSA

SEQ ID NO: 1498631 - protein, 20 aa, Mycobacterium tuberculosis
GGFGAPPPRSIGGGDGGDGG

SEQ ID NO: 1498632 - protein, 22 aa, Mycobacterium tuberculosis
GGHGGAGGWLYGNGGAGGFGGA

SEQ ID NO: 1498633 - protein, 23 aa, Mycobacterium tuberculosis
GGNGATGPWLFGDGGAGGGGGAG

SEQ ID NO: 1498634 - protein, 18 aa, Mycobacterium tuberculosis
GHDYTWFVLNAKIIEKEF

SEQ ID NO: 1498635 - protein, 19 aa, Mycobacterium tuberculosis
GHMPVRRLDLIWISARNAA

SEQ ID NO: 1498636 - protein, 24 aa, Mycobacterium tuberculosis
GISRLRFRLRWRGFRLIVDANHTD

SEQ ID NO: 1498637 - protein, 20 aa, Mycobacterium tuberculosis
GIVMPARLPNRIHPFVQEIV

SEQ ID NO: 1498638 - protein, 22 aa, Mycobacterium tuberculosis
GKAEKCTLCYPRIEVGLPTVCS

SEQ ID NO: 1498639 - protein, 18 aa, Mycobacterium tuberculosis
GLGARLFQVGSRGGDGGV

SEQ ID NO: 1498640 - protein, 17 aa, Mycobacterium tuberculosis
GLGGCGGGAFTAGVTTG

SEQ ID NO: 1498641 - protein, 20 aa, Mycobacterium tuberculosis
GLGGDGFTYLADFDGEPGGD

SEQ ID NO: 1498642 - protein, 20 aa, Mycobacterium tuberculosis
GLIGPEWFPDSYPWVPSINP

SEQ ID NO: 1498643 - protein, 20 aa, Mycobacterium tuberculosis
GLRQRWALVGGFAVSARSEP

SEQ ID NO: 1498644 - protein, 17 aa, Mycobacterium tuberculosis
GNAGMLFGSGGGGGTGG

SEQ ID NO: 1498645 - protein, 21 aa, Mycobacterium tuberculosis
GNAGVALSVGSTGGLGGNGGS

SEQ ID NO: 1498646 - protein, 23 aa, Mycobacterium tuberculosis
GNFLSRSGAVGVLGIGPNNGFPG

SEQ ID NO: 1498647 - protein, 22 aa, Mycobacterium tuberculosis
GPAVLGAPAWKPPHPLSDSITA

SEQ ID NO: 1498648 - protein, 17 aa, Mycobacterium tuberculosis
GPLRPAAAQVFAAVQAA

SEQ ID NO: 1498649 - protein, 19 aa, Mycobacterium tuberculosis
GRLLGWRLGMDDVDPRSMV

SEQ ID NO: 1498650 - protein, 23 aa, Mycobacterium tuberculosis
GRRCAPRVAIGWHTPIGDPLAVE

SEQ ID NO: 1498651 - protein, 19 aa, Mycobacterium tuberculosis
GSAGLLGYVGRAGDGGAGG

SEQ ID NO: 1498652 - protein, 17 aa, Mycobacterium tuberculosis
GSCPLWVVHDAFAQPER

SEQ ID NO: 1498653 - protein, 22 aa, Mycobacterium tuberculosis
GSGGFGAPPPRSIGGGDGGDGG

SEQ ID NO: 1498654 - protein, 17 aa, Mycobacterium tuberculosis
GSGGRGGLLVGDGGAGG

SEQ ID NO: 1498655 - protein, 18 aa, Mycobacterium tuberculosis
GSGGRGGLLVGDGGAGGI

SEQ ID NO: 1498656 - protein, 20 aa, Mycobacterium tuberculosis
GTLGTFTVHGFRFPEITGDI

SEQ ID NO: 1498657 - protein, 23 aa, Mycobacterium tuberculosis
GVAQGDIASAFGGDGGNGSDGVA

SEQ ID NO: 1498658 - protein, 22 aa, Mycobacterium tuberculosis
GVFEGIAVLGLGFGGAAGAGGA

SEQ ID NO: 1498659 - protein, 26 aa, Mycobacterium tuberculosis
GVGGNGGRGGWLLGNGGAGGVGGVGG

SEQ ID NO: 1498660 - protein, 18 aa, Mycobacterium tuberculosis
GVNLTFLPFFAKAVIDAL

SEQ ID NO: 1498661 - protein, 23 aa, Mycobacterium tuberculosis
GVQLFRPAFLLAVPTALGGVGSL

SEQ ID NO: 1498662 - protein, 19 aa, Mycobacterium tuberculosis
HAWVQAWNGGWWHYDPTND

SEQ ID NO: 1498663 - protein, 18 aa, Mycobacterium tuberculosis
HILIDLPAVPGFGNTTGA

SEQ ID NO: 1498664 - protein, 17 aa, Mycobacterium tuberculosis
HLPGFPVQFFVYKQIAA

SEQ ID NO: 1498665 - protein, 18 aa, Mycobacterium tuberculosis
HRRVPDRYPEVIVQAVSA

SEQ ID NO: 1498666 - protein, 17 aa, Mycobacterium tuberculosis
HRSCYPSAGAIVVLRVP

SEQ ID NO: 1498667 - protein, 21 aa, Mycobacterium tuberculosis
IASPPVKWPCFYGIDFPSPAE

SEQ ID NO: 1498668 - protein, 20 aa, Mycobacterium tuberculosis
IDGLRYLDWLAAYSAVNLGH

SEQ ID NO: 1498669 - protein, 21 aa, Mycobacterium tuberculosis
IEHWTRLPVEVELASEFRYRD

SEQ ID NO: 1498670 - protein, 22 aa, Mycobacterium tuberculosis
IEPGRPCWLVGLLFPSADGCAG

SEQ ID NO: 1498671 - protein, 22 aa, Mycobacterium tuberculosis
IPGMRLPFTSIVPFVVYYGPVE

SEQ ID NO: 1498672 - protein, 18 aa, Mycobacterium tuberculosis
IPVCTRLGLSPPDVRTLS

SEQ ID NO: 1498673 - protein, 20 aa, Mycobacterium tuberculosis
ISARLDLPVGVARVLVGDLV

SEQ ID NO: 1498674 - protein, 17 aa, Mycobacterium tuberculosis
ISPAWLRLDARFGSVYR

SEQ ID NO: 1498675 - protein, 27 aa, Mycobacterium tuberculosis
IVGDEFCLLDGLLAWYATIGSINNINS

SEQ ID NO: 1498676 - protein, 20 aa, Mycobacterium tuberculosis
IVVHLAPWLEPQPICWAIDH

SEQ ID NO: 1498677 - protein, 18 aa, Mycobacterium tuberculosis
IYGKLAWEKTIPNWFFEP

SEQ ID NO: 1498678 - protein, 17 aa, Mycobacterium tuberculosis
KAYAGFRSFRHGTNLKA

SEQ ID NO: 1498679 - protein, 20 aa, Mycobacterium tuberculosis
KEVFRLRLASGREVEATGSH

SEQ ID NO: 1498680 - protein, 20 aa, Mycobacterium tuberculosis
KLSGLRARNGLLTASGDNAS

SEQ ID NO: 1498681 - protein, 17 aa, Mycobacterium tuberculosis
KPAQVALAWLISLPGVV

SEQ ID NO: 1498682 - protein, 17 aa, Mycobacterium tuberculosis
KPFVRWLTDLCVQLSEV

SEQ ID NO: 1498683 - protein, 19 aa, Mycobacterium tuberculosis
KRLPVPLFPGFDTLGTLEY

SEQ ID NO: 1498684 - protein, 19 aa, Mycobacterium tuberculosis
KYTGLKLGGVYGFYPRFTG

SEQ ID NO: 1498685 - protein, 17 aa, Mycobacterium tuberculosis
LACQRAGVPMQRYEHRA

SEQ ID NO: 1498686 - protein, 17 aa, Mycobacterium tuberculosis
LADCARLLLQIPAVLGL

SEQ ID NO: 1498687 - protein, 19 aa, Mycobacterium tuberculosis
LADGVVRPVVFLAYSGQAR

SEQ ID NO: 1498688 - protein, 25 aa, Mycobacterium tuberculosis
LAERVGWRWRLVWYRAVAELLTGDY

SEQ ID NO: 1498689 - protein, 26 aa, Mycobacterium tuberculosis
LALTELWCSYGVRPDLVIGHSMGEVA

SEQ ID NO: 1498690 - protein, 17 aa, Mycobacterium tuberculosis
LAMGHAMIRAGLRLKKL

SEQ ID NO: 1498691 - protein, 18 aa, Mycobacterium tuberculosis
LAPGGFNFDAWRFENRCE

SEQ ID NO: 1498692 - protein, 17 aa, Mycobacterium tuberculosis
LAPWGARCCWTRRTGSG

SEQ ID NO: 1498693 - protein, 18 aa, Mycobacterium tuberculosis
LAPWGARCCWTRRTGSGR

SEQ ID NO: 1498694 - protein, 17 aa, Mycobacterium tuberculosis
LARDRWAVPLVHTAHTL

SEQ ID NO: 1498695 - protein, 19 aa, Mycobacterium tuberculosis
LDAFAHWRRAQGLPATSIA

SEQ ID NO: 1498696 - protein, 17 aa, Mycobacterium tuberculosis
LDALVGWRRASGLPAAV

SEQ ID NO: 1498697 - protein, 18 aa, Mycobacterium tuberculosis
LDILERFYGLVLTDCGTG

SEQ ID NO: 1498698 - protein, 17 aa, Mycobacterium tuberculosis
LDIPPAPGFGNSTTGPS

SEQ ID NO: 1498699 - protein, 22 aa, Mycobacterium tuberculosis
LDIPRVPVTLNYLFGSQPGGPL

SEQ ID NO: 1498700 - protein, 22 aa, Mycobacterium tuberculosis
LFFKEKRYDLARVGRYKVNKKL

SEQ ID NO: 1498701 - protein, 18 aa, Mycobacterium tuberculosis
LGALAARLWLPLLAAEGS

SEQ ID NO: 1498702 - protein, 22 aa, Mycobacterium tuberculosis
LGGAGRDGGAPGGDGGDGGTGG

SEQ ID NO: 1498703 - protein, 27 aa, Mycobacterium tuberculosis
LGGGSFGLPGLNGSCGDGGDGGNGAPG

SEQ ID NO: 1498704 - protein, 18 aa, Mycobacterium tuberculosis
LGGVYGFYPRFTGPQRST

SEQ ID NO: 1498705 - protein, 19 aa, Mycobacterium tuberculosis
LGSDMGEFYMPYPGTRINQ

SEQ ID NO: 1498706 - protein, 26 aa, Mycobacterium tuberculosis
LHCKIMWCPSVSLSIWANAWLAGKAA

SEQ ID NO: 1498707 - protein, 19 aa, Mycobacterium tuberculosis
LKCLCRLHHLLATFCGWRA

SEQ ID NO: 1498708 - protein, 17 aa, Mycobacterium tuberculosis
LKTSCAWAQARRDGQDP

SEQ ID NO: 1498709 - protein, 18 aa, Mycobacterium tuberculosis
LLCTACFDGKYPIELPRE

SEQ ID NO: 1498710 - protein, 17 aa, Mycobacterium tuberculosis
LLFPSLCHFSGGIPAPE

SEQ ID NO: 1498711 - protein, 18 aa, Mycobacterium tuberculosis
LLLEVAWEALEHAGIPPG

SEQ ID NO: 1498712 - protein, 18 aa, Mycobacterium tuberculosis
LLLEVSWEALEHAGIIPE

SEQ ID NO: 1498713 - protein, 24 aa, Mycobacterium tuberculosis
LLLRGSPCAIGWVAGWLSAEFPAL

SEQ ID NO: 1498714 - protein, 17 aa, Mycobacterium tuberculosis
LLRSCPRLTILTTSTEA

SEQ ID NO: 1498715 - protein, 19 aa, Mycobacterium tuberculosis
LPFDSPMYWHLFEPALRDA

SEQ ID NO: 1498716 - protein, 22 aa, Mycobacterium tuberculosis
LPLPQRRFGGVVGRTMAESVGD

SEQ ID NO: 1498717 - protein, 22 aa, Mycobacterium tuberculosis
LPPEFRAAVVLCDIEGLSYEEI

SEQ ID NO: 1498718 - protein, 18 aa, Mycobacterium tuberculosis
LRDLLKFEFLFSGRAQFE

SEQ ID NO: 1498719 - protein, 17 aa, Mycobacterium tuberculosis
LRLSPDLTNLIERYLAN

SEQ ID NO: 1498720 - protein, 17 aa, Mycobacterium tuberculosis
LRPGGLFAVEHDDTTSS

SEQ ID NO: 1498721 - protein, 19 aa, Mycobacterium tuberculosis
LRPRMRVVNEFQRRYPDIK

SEQ ID NO: 1498722 - protein, 17 aa, Mycobacterium tuberculosis
LRQAPILALGGRPEELR

SEQ ID NO: 1498723 - protein, 18 aa, Mycobacterium tuberculosis
LRRACAAGALATLVSGVG

SEQ ID NO: 1498724 - protein, 18 aa, Mycobacterium tuberculosis
LRRPRAGLSYEALLETVE

SEQ ID NO: 1498725 - protein, 17 aa, Mycobacterium tuberculosis
LRVLDGWRERGHGDFRD

SEQ ID NO: 1498726 - protein, 27 aa, Mycobacterium tuberculosis
LSFSSLSGWARPGLRERFIGLTDTVWR

SEQ ID NO: 1498727 - protein, 23 aa, Mycobacterium tuberculosis
LSSKEWPGMLAFYRNLAIALVGD

SEQ ID NO: 1498728 - protein, 21 aa, Mycobacterium tuberculosis
LSVAALMKWHLPRLEVLVDAG

SEQ ID NO: 1498729 - protein, 17 aa, Mycobacterium tuberculosis
LTGWRDAWELGRAARDN

SEQ ID NO: 1498730 - protein, 20 aa, Mycobacterium tuberculosis
LVKFACAWTYIALDPAVVQS

SEQ ID NO: 1498731 - protein, 28 aa, Mycobacterium tuberculosis
LYLNRDCGIGKFIWERVVEELKLEVNVE

SEQ ID NO: 1498732 - protein, 17 aa, Mycobacterium tuberculosis
MARAVAPYLGWLISATA

SEQ ID NO: 1498733 - protein, 22 aa, Mycobacterium tuberculosis
MGAWAKRTGAIFIRRQTKDIPV

SEQ ID NO: 1498734 - protein, 24 aa, Mycobacterium tuberculosis
MGAWAKRTGAIFIRRQTKDIPVYR

SEQ ID NO: 1498735 - protein, 17 aa, Mycobacterium tuberculosis
MGGITIAAWSDRYRHKV

SEQ ID NO: 1498736 - protein, 21 aa, Mycobacterium tuberculosis
MGHAMIRAGLRLKKLGTDRSW

SEQ ID NO: 1498737 - protein, 17 aa, Mycobacterium tuberculosis
MLAEDGIDLQTCGLVAV

SEQ ID NO: 1498738 - protein, 18 aa, Mycobacterium tuberculosis
MRDRWAGFFNEFDVLLLP

SEQ ID NO: 1498739 - protein, 19 aa, Mycobacterium tuberculosis
MSVDCARYWLDADKPISKS

SEQ ID NO: 1498740 - protein, 26 aa, Mycobacterium tuberculosis
MTGWQRLHFRFGFPAPLLEPLAVERL

SEQ ID NO: 1498741 - protein, 17 aa, Mycobacterium tuberculosis
MVTAAKFEVEWPADPQR

SEQ ID NO: 1498742 - protein, 19 aa, Mycobacterium tuberculosis
NALCAAAVALECGASVEQV

SEQ ID NO: 1498743 - protein, 18 aa, Mycobacterium tuberculosis
NFFPMGAWAKRTGAIFIR

SEQ ID NO: 1498744 - protein, 18 aa, Mycobacterium tuberculosis
NGNWVWRYDAIRTFGDFA

SEQ ID NO: 1498745 - protein, 27 aa, Mycobacterium tuberculosis
NGVLWRGDYQGLLGFSYRPAVLPQTPF

SEQ ID NO: 1498746 - protein, 20 aa, Mycobacterium tuberculosis
NPDYLPGALLPPSIHATADA

SEQ ID NO: 1498747 - protein, 23 aa, Mycobacterium tuberculosis
NPEGGWTLVSWDGIPVGPASLPT

SEQ ID NO: 1498748 - protein, 24 aa, Mycobacterium tuberculosis
NREVRWRPEHFWKPGTAVDVAVNT

SEQ ID NO: 1498749 - protein, 17 aa, Mycobacterium tuberculosis
NRFSWKNTGQILADEGH

SEQ ID NO: 1498750 - protein, 21 aa, Mycobacterium tuberculosis
NRGRAGYRLLYSVRQYALEKL

SEQ ID NO: 1498751 - protein, 18 aa, Mycobacterium tuberculosis
NRKCLRITVGGGRNKVTA

SEQ ID NO: 1498752 - protein, 19 aa, Mycobacterium tuberculosis
NRSTIRWTLHQMVASGVVS

SEQ ID NO: 1498753 - protein, 19 aa, Mycobacterium tuberculosis
PARLKVGIISAGRVGTALG

SEQ ID NO: 1498754 - protein, 26 aa, Mycobacterium tuberculosis
PCTCARASWRRAIWRWYRARYVSPKP

SEQ ID NO: 1498755 - protein, 22 aa, Mycobacterium tuberculosis
PCYRCLHPAPPPPGLVPSCAEG

SEQ ID NO: 1498756 - protein, 20 aa, Mycobacterium tuberculosis
PEGLPSVFVYDGYPGGAGFA

SEQ ID NO: 1498757 - protein, 19 aa, Mycobacterium tuberculosis
PFMKFEGWTPLAQLKVGDR

SEQ ID NO: 1498758 - protein, 19 aa, Mycobacterium tuberculosis
PFRCFYLSAPFVVPKKKEV

SEQ ID NO: 1498759 - protein, 25 aa, Mycobacterium tuberculosis
PGAEASWVVGITWWSAVVGGFQMSF

SEQ ID NO: 1498760 - protein, 23 aa, Mycobacterium tuberculosis
PGAKSARPATVWIAQDGSHHLVR

SEQ ID NO: 1498761 - protein, 20 aa, Mycobacterium tuberculosis
PGRTDCKWGAYLDNVGDFDP

SEQ ID NO: 1498762 - protein, 18 aa, Mycobacterium tuberculosis
PKVHGAWELHEATSGQPL

SEQ ID NO: 1498763 - protein, 23 aa, Mycobacterium tuberculosis
PLHTDLKEFGRWAADRIAEAIEF

SEQ ID NO: 1498764 - protein, 17 aa, Mycobacterium tuberculosis
PLPLAINVIGHINALST

SEQ ID NO: 1498765 - protein, 18 aa, Mycobacterium tuberculosis
PLYCCANGKALLAALPPE

SEQ ID NO: 1498766 - protein, 23 aa, Mycobacterium tuberculosis
PPKVVSQRGWRHWVHALTRINLG

SEQ ID NO: 1498767 - protein, 20 aa, Mycobacterium tuberculosis
PPLRLRACLRRRRLAARRHP

SEQ ID NO: 1498768 - protein, 18 aa, Mycobacterium tuberculosis
PPYVVRWLVNGHETTVYP

SEQ ID NO: 1498769 - protein, 20 aa, Mycobacterium tuberculosis
PRIRGGKVPFVFRTLPGYTF

SEQ ID NO: 1498770 - protein, 19 aa, Mycobacterium tuberculosis
PRISWAAGLRDDGTTTLLV

SEQ ID NO: 1498771 - protein, 21 aa, Mycobacterium tuberculosis
PRKTRCCVHVAKPNRIRLADQ

SEQ ID NO: 1498772 - protein, 18 aa, Mycobacterium tuberculosis
PVAACATAAVSVEEGVDK

SEQ ID NO: 1498773 - protein, 19 aa, Mycobacterium tuberculosis
PYDPPWCRPLLGVRRSVTH

SEQ ID NO: 1498774 - protein, 18 aa, Mycobacterium tuberculosis
QCTERLRASDDLLLVGGM

SEQ ID NO: 1498775 - protein, 20 aa, Mycobacterium tuberculosis
QELHELLTLPFRSASEFIDA

SEQ ID NO: 1498776 - protein, 17 aa, Mycobacterium tuberculosis
QFSCWRIKLPHVEAAKF

SEQ ID NO: 1498777 - protein, 19 aa, Mycobacterium tuberculosis
QLDRFAIRLELRYLSERDE

SEQ ID NO: 1498778 - protein, 18 aa, Mycobacterium tuberculosis
QPEIKLGVLPGMGGSQRL

SEQ ID NO: 1498779 - protein, 23 aa, Mycobacterium tuberculosis
QQYDAVWRWIDWPERRGRTGTGI

SEQ ID NO: 1498780 - protein, 26 aa, Mycobacterium tuberculosis
QRPNRLAVCLDLDWRPQFRVDLIPSY

SEQ ID NO: 1498781 - protein, 19 aa, Mycobacterium tuberculosis
QWLGIDCIWLPPFYDSPLR

SEQ ID NO: 1498782 - protein, 23 aa, Mycobacterium tuberculosis
QYDAVWWWIDWPERRGRTDTGID

SEQ ID NO: 1498783 - protein, 22 aa, Mycobacterium tuberculosis
RAEGRYALMPGIIGALAASGTP

SEQ ID NO: 1498784 - protein, 19 aa, Mycobacterium tuberculosis
RAGDAIACALELQLSTLAP

SEQ ID NO: 1498785 - protein, 17 aa, Mycobacterium tuberculosis
RAGHQVRWTILLDGAVR

SEQ ID NO: 1498786 - protein, 19 aa, Mycobacterium tuberculosis
RAKAAYFMIVFSGPIPDDK

SEQ ID NO: 1498787 - protein, 17 aa, Mycobacterium tuberculosis
RALAAAVGISWTSELLT

SEQ ID NO: 1498788 - protein, 17 aa, Mycobacterium tuberculosis
RALVLGGALDWLKDNKA

SEQ ID NO: 1498789 - protein, 20 aa, Mycobacterium tuberculosis
RARIGVLSQVPWLWAKFIGH

SEQ ID NO: 1498790 - protein, 18 aa, Mycobacterium tuberculosis
RASVCVLGPLVGRCKRAR

SEQ ID NO: 1498791 - protein, 18 aa, Mycobacterium tuberculosis
RDFARASFSYGLNAKWPV

SEQ ID NO: 1498792 - protein, 18 aa, Mycobacterium tuberculosis
REELKFSGDRAMAAEDPE

SEQ ID NO: 1498793 - protein, 24 aa, Mycobacterium tuberculosis
REGHCGACACTLRAGKVNIGVNDV

SEQ ID NO: 1498794 - protein, 25 aa, Mycobacterium tuberculosis
RGHARCRRHRRAAARRERTQRLAIA

SEQ ID NO: 1498795 - protein, 17 aa, Mycobacterium tuberculosis
RGPCWSWSRMVGSARSI

SEQ ID NO: 1498796 - protein, 18 aa, Mycobacterium tuberculosis
RGPYRLGPEITRMATTVR

SEQ ID NO: 1498797 - protein, 18 aa, Mycobacterium tuberculosis
RGRFRWWGLYTQREQGYD

SEQ ID NO: 1498798 - protein, 18 aa, Mycobacterium tuberculosis
RGRLGLLELRGFEMPPHL

SEQ ID NO: 1498799 - protein, 18 aa, Mycobacterium tuberculosis
RHILDVKTAIAWARANVD

SEQ ID NO: 1498800 - protein, 18 aa, Mycobacterium tuberculosis
RIPVHMVEVINKLGRIQR

SEQ ID NO: 1498801 - protein, 18 aa, Mycobacterium tuberculosis
RKVNALKFIAFVTNPTNT

SEQ ID NO: 1498802 - protein, 19 aa, Mycobacterium tuberculosis
RLHHLLATFCGWRAQQLPD

SEQ ID NO: 1498803 - protein, 18 aa, Mycobacterium tuberculosis
RMTWRSCRAGDFIDICNL

SEQ ID NO: 1498804 - protein, 19 aa, Mycobacterium tuberculosis
RPHLAAAWEYDWPASRWRQ

SEQ ID NO: 1498805 - protein, 17 aa, Mycobacterium tuberculosis
RPRCMRRHWPPGWHVPT

SEQ ID NO: 1498806 - protein, 17 aa, Mycobacterium tuberculosis
RRARVVVPFQPRLLMVG

SEQ ID NO: 1498807 - protein, 24 aa, Mycobacterium tuberculosis
RRDAIRHAVAWARPGDVVLIAGKG

SEQ ID NO: 1498808 - protein, 24 aa, Mycobacterium tuberculosis
RRQRGRCGLDNGVADRRRRRSVGG

SEQ ID NO: 1498809 - protein, 17 aa, Mycobacterium tuberculosis
RRRICWQAYLGAETDSH

SEQ ID NO: 1498810 - protein, 17 aa, Mycobacterium tuberculosis
RSDILPISFGFPFGFSA

SEQ ID NO: 1498811 - protein, 17 aa, Mycobacterium tuberculosis
RSGLISLVISNLFGQNA

SEQ ID NO: 1498812 - protein, 18 aa, Mycobacterium tuberculosis
RSNLARYGIAPTYPGDFA

SEQ ID NO: 1498813 - protein, 17 aa, Mycobacterium tuberculosis
RVETAGVVATRIDHTRI

SEQ ID NO: 1498814 - protein, 23 aa, Mycobacterium tuberculosis
RVLAIWPDWVRRWPTPSATATAS

SEQ ID NO: 1498815 - protein, 18 aa, Mycobacterium tuberculosis
RYFWSRVIADTGWQLLDS

SEQ ID NO: 1498816 - protein, 17 aa, Mycobacterium tuberculosis
SAHAQEYQALSAQAAAF

SEQ ID NO: 1498817 - protein, 26 aa, Mycobacterium tuberculosis
SALKALEGDAKWVASVEELMNAVDES

SEQ ID NO: 1498818 - protein, 17 aa, Mycobacterium tuberculosis
SAQAAAFHARFVQALAG

SEQ ID NO: 1498819 - protein, 18 aa, Mycobacterium tuberculosis
SASLSFSSLSGWARPGLR

SEQ ID NO: 1498820 - protein, 23 aa, Mycobacterium tuberculosis
SAVPRALQGLALPTASQSASATP

SEQ ID NO: 1498821 - protein, 17 aa, Mycobacterium tuberculosis
SDAFDIPLVFVVDTPGF

SEQ ID NO: 1498822 - protein, 19 aa, Mycobacterium tuberculosis
SEAPGRPGGAGGTGGAGGN

SEQ ID NO: 1498823 - protein, 18 aa, Mycobacterium tuberculosis
SGAFAHRYGFRHSVVARP

SEQ ID NO: 1498824 - protein, 19 aa, Mycobacterium tuberculosis
SGLFPFHFTLNGGIGPISI

SEQ ID NO: 1498825 - protein, 22 aa, Mycobacterium tuberculosis
SGLPFGTCLDAAYLHPCGSDEF

SEQ ID NO: 1498826 - protein, 17 aa, Mycobacterium tuberculosis
SGNGRAGLPGSGNVGNG

SEQ ID NO: 1498827 - protein, 17 aa, Mycobacterium tuberculosis
SKAAMWSATESMRIELA

SEQ ID NO: 1498828 - protein, 19 aa, Mycobacterium tuberculosis
SNVQVVWEKFCRYFDVEPR

SEQ ID NO: 1498829 - protein, 23 aa, Mycobacterium tuberculosis
SPDSDLKGFDGFDGGSGGAGGDG

SEQ ID NO: 1498830 - protein, 40 aa, Mycobacterium tuberculosis; identical to SEQ ID NO: 1473759

SEQ ID NO: 1498831 - protein, 26 aa, Mycobacterium tuberculosis
SPHSERLFCIPATIDLAGAEIELVSM

SEQ ID NO: 1498832 - protein, 24 aa, Mycobacterium tuberculosis
SPPRLPTWNRRAPSPGSPPLPPPP

SEQ ID NO: 1498833 - protein, 20 aa, Mycobacterium tuberculosis
SRGVLFPKHRTDLLGCAVSV

SEQ ID NO: 1498834 - protein, 19 aa, Mycobacterium tuberculosis
SRPHCAWLAIASWSTVPMR

SEQ ID NO: 1498835 - protein, 19 aa, Mycobacterium tuberculosis
SRSALGWIIDRYRVTTDKA

SEQ ID NO: 1498836 - protein, 18 aa, Mycobacterium tuberculosis
STAVAALFSSHAQAYQAA

SEQ ID NO: 1498837 - protein, 21 aa, Mycobacterium tuberculosis
SYGSRCVRPPILYGDVSRPRA

SEQ ID NO: 1498838 - protein, 19 aa, Mycobacterium tuberculosis
TALPRRHKLVLSRGPYGYH

SEQ ID NO: 1498839 - protein, 22 aa, Mycobacterium tuberculosis
TAPERWAFEYSRFQEAQKREIV

SEQ ID NO: 1498840 - protein, 26 aa, Mycobacterium tuberculosis
TAPYNDIVSWNWTELPSALGVTNHLA

SEQ ID NO: 1498841 - protein, 17 aa, Mycobacterium tuberculosis
TAVAALFSSHAQAYQAA

SEQ ID NO: 1498842 - protein, 17 aa, Mycobacterium tuberculosis
TFHAQFVQTLSAGAGAY

SEQ ID NO: 1498843 - protein, 26 aa, Mycobacterium tuberculosis
TGGGGGNGGTGWNGGKGDTGSGGGAG

SEQ ID NO: 1498844 - protein, 23 aa, Mycobacterium tuberculosis
TGPIVIGSFFLPAFNIPGIDVPA

SEQ ID NO: 1498845 - protein, 23 aa, Mycobacterium tuberculosis
TGQPGGPGGLLWGNGGNGGSGVA

SEQ ID NO: 1498846 - protein, 19 aa, Mycobacterium tuberculosis
TLLGRPLIGDGAHGTAPGQ

SEQ ID NO: 1498847 - protein, 18 aa, Mycobacterium tuberculosis
TLLGRPLIGNGADGVAGT

SEQ ID NO: 1498848 - protein, 19 aa, Mycobacterium tuberculosis
TLLGRPLIGNGADGVAGTG

SEQ ID NO: 1498849 - protein, 20 aa, Mycobacterium tuberculosis
TLTAAARWYTATEIANAAAM

SEQ ID NO: 1498850 - protein, 20 aa, Mycobacterium tuberculosis
TPEQWWPFIGNLSLDQSIAQ

SEQ ID NO: 1498851 - protein, 17 aa, Mycobacterium tuberculosis
TQLPNWWGPILAPALAG

SEQ ID NO: 1498852 - protein, 19 aa, Mycobacterium tuberculosis
TRSGDVWLLNGFKWFASNC

SEQ ID NO: 1498853 - protein, 19 aa, Mycobacterium tuberculosis
TRSSAGFGAPRYGAKPIVM

SEQ ID NO: 1498854 - protein, 19 aa, Mycobacterium tuberculosis
TTARLTGRWLRGRLPTLND

SEQ ID NO: 1498855 - protein, 17 aa, Mycobacterium tuberculosis
TTECWRQWINIGNFPDH

SEQ ID NO: 1498856 - protein, 18 aa, Mycobacterium tuberculosis
TVVCAALASAARQAGIDV

SEQ ID NO: 1498857 - protein, 17 aa, Mycobacterium tuberculosis
VARLAVDFRQRFKKDVV

SEQ ID NO: 1498858 - protein, 24 aa, Mycobacterium tuberculosis
VCSEILPRWGVQTVFVDGDDLSQW

SEQ ID NO: 1498859 - protein, 17 aa, Mycobacterium tuberculosis
VDLWGADGAEGWTADPI

SEQ ID NO: 1498860 - protein, 22 aa, Mycobacterium tuberculosis
VGAAARGGRRLVIAMMYGLVKE

SEQ ID NO: 1498861 - protein, 19 aa, Mycobacterium tuberculosis
VGILCLEFLVHAWDFAIAT

SEQ ID NO: 1498862 - protein, 17 aa, Mycobacterium tuberculosis
VGNIPRGMFVGGRRGSS

SEQ ID NO: 1498863 - protein, 18 aa, Mycobacterium tuberculosis
VKLFDDWSNLGSISELST

SEQ ID NO: 1498864 - protein, 19 aa, Mycobacterium tuberculosis
VLAIWPDWVRRWPTPSATA

SEQ ID NO: 1498865 - protein, 19 aa, Mycobacterium tuberculosis
VLIDREWRHGVRVGVETAL

SEQ ID NO: 1498866 - protein, 18 aa, Mycobacterium tuberculosis
VLWRGDYQGLIGADIALE

SEQ ID NO: 1498867 - protein, 25 aa, Mycobacterium tuberculosis
VPAPPFWGSRIVKGLAVADYTGLLD

SEQ ID NO: 1498868 - protein, 17 aa, Mycobacterium tuberculosis
VPDEVWPAVVFTLVTLL

SEQ ID NO: 1498869 - protein, 17 aa, Mycobacterium tuberculosis
VPHSWNLPPAVRQVAAM

SEQ ID NO: 1498870 - protein, 19 aa, Mycobacterium tuberculosis
VPRGISFLLNRNRLNVAVS

SEQ ID NO: 1498871 - protein, 18 aa, Mycobacterium tuberculosis
VPRPERQYYWFGEPIDTT

SEQ ID NO: 1498872 - protein, 21 aa, Mycobacterium tuberculosis
VRTNTWWLPAMQSLYETDYGP

SEQ ID NO: 1498873 - protein, 19 aa, Mycobacterium tuberculosis
VSAAIAALFSGHAQAYQAL

SEQ ID NO: 1498874 - protein, 19 aa, Mycobacterium tuberculosis
VSYPGSSLWDMVRPRPSSR

SEQ ID NO: 1498875 - protein, 18 aa, Mycobacterium tuberculosis
VVEALKFHLRDLAVTFRF

SEQ ID NO: 1498876 - protein, 17 aa, Mycobacterium tuberculosis
WAKQVIRVLIAIENAIW

SEQ ID NO: 1498877 - protein, 18 aa, Mycobacterium tuberculosis
WEYDWPASRWRQHLNAQL

SEQ ID NO: 1498878 - protein, 17 aa, Mycobacterium tuberculosis
WGLIPSWIKAGPGGAPD

SEQ ID NO: 1498879 - protein, 20 aa, Mycobacterium tuberculosis
WLDAFAHWRRAQGLPATSIA

SEQ ID NO: 1498880 - protein, 17 aa, Mycobacterium tuberculosis
WPFIGNLSLDQSIAQGV

SEQ ID NO: 1498881 - protein, 18 aa, Mycobacterium tuberculosis
WRIKLPHVEAAKFDAALQ

SEQ ID NO: 1498882 - protein, 17 aa, Mycobacterium tuberculosis
WRRWCIPANAATSSTTC

SEQ ID NO: 1498883 - protein, 17 aa, Mycobacterium tuberculosis
WVIAYRWFRAGLLPVPA

SEQ ID NO: 1498884 - protein, 19 aa, Mycobacterium tuberculosis
WWLQRRLLLCGIRATCPAV

SEQ ID NO: 1498885 - protein, 29 aa, Mycobacterium tuberculosis
WYTATEIANAAAMRVVLGAVNAPTQTLLG

SEQ ID NO: 1498886 - protein, 25 aa, Mycobacterium tuberculosis
YRGCYGLSVAALMKWHLPRLEVLVD

SEQ ID NO: 1498887 - protein, 20 aa, Mycobacterium tuberculosis
YSEPRLQPPNGYKDTTVPGI

SEQ ID NO: 1498888 - protein, 17 aa, Mycobacterium tuberculosis
YSNGVLWRGDYQGLLGF

SEQ ID NO: 1498889 - protein, 17 aa, Mycobacterium tuberculosis
YSPRFLWMWPNARISVI

SEQ ID NO: 1498890 - protein, 20 aa, Mycobacterium tuberculosis
YYAMTGWRLGWLLVPTVLRR

SEQ ID NO: 1498891 - protein, 22 aa, Mycobacterium tuberculosis
AAACLRKTDWLFPQYRELGVYL

SEQ ID NO: 1498892 - protein, 19 aa, Mycobacterium tuberculosis
AAADRCGRLALPRRTHVSV

SEQ ID NO: 1498893 - protein, 18 aa, Mycobacterium tuberculosis
AAAGRPWWEWAATHERAF

SEQ ID NO: 1498894 - protein, 23 aa, Mycobacterium tuberculosis
AADPAGWPRLDWSMDAALLLAAL

SEQ ID NO: 1498895 - protein, 30 aa, Mycobacterium tuberculosis
AAERCGSPAWDLPTVFGPIAITYNIKGVST

SEQ ID NO: 1498896 - protein, 18 aa, Mycobacterium tuberculosis
AAFHARFVQALAGAMGAY

SEQ ID NO: 1498897 - protein, 26 aa, Mycobacterium tuberculosis
AAGGAGGRLFGNGGAGGNGGTAGQGG

SEQ ID NO: 1498898 - protein, 23 aa, Mycobacterium tuberculosis
AAGGVGGRGGWLLGNGGTGGAGG

SEQ ID NO: 1498899 - protein, 19 aa, Mycobacterium tuberculosis
AAGRAAPRLTVWVPVAVNP

SEQ ID NO: 1498900 - protein, 17 aa, Mycobacterium tuberculosis
AAIAALFSSHGQQYQAM

SEQ ID NO: 1498901 - protein, 17 aa, Mycobacterium tuberculosis
AAIASLFSGNAQAYQAL

SEQ ID NO: 1498902 - protein, 17 aa, Mycobacterium tuberculosis
AAIATLFGSHAREYQAI

SEQ ID NO: 1498903 - protein, 21 aa, Mycobacterium tuberculosis
AALGSPGWAFGVLAAAGGGGA

SEQ ID NO: 1498904 - protein, 19 aa, Mycobacterium tuberculosis
AAQFPFDIIPTLLQGLATL

SEQ ID NO: 1498905 - protein, 22 aa, Mycobacterium tuberculosis
AAQPIWWVVRAIEFSKDFETFV

SEQ ID NO: 1498906 - protein, 24 aa, Mycobacterium tuberculosis
AAQPIWWVVRAIEFSKDFETFVQK

SEQ ID NO: 1498907 - protein, 17 aa, Mycobacterium tuberculosis
AAVASLFSGHAQAYQTL

SEQ ID NO: 1498908 - protein, 18 aa, Mycobacterium tuberculosis
AAVASLFSGHAQAYQTLG

SEQ ID NO: 1498909 - protein, 21 aa, Mycobacterium tuberculosis
AAVQAPWPLLRTFAAGPALSR

SEQ ID NO: 1498910 - protein, 21 aa, Mycobacterium tuberculosis
AAYQQRFVLALSQAGSTYAVA

SEQ ID NO: 1498911 - protein, 19 aa, Mycobacterium tuberculosis
ACARLGIMHSVVFGGFTAA

SEQ ID NO: 1498912 - protein, 21 aa, Mycobacterium tuberculosis
ACLARAGLRVRLLERLAQTGG

SEQ ID NO: 1498913 - protein, 17 aa, Mycobacterium tuberculosis
ADAILIRKVDWVDEITR

SEQ ID NO: 1498914 - protein, 25 aa, Mycobacterium tuberculosis
ADEVSTQIAALFGAHARSYQTLSTQ

SEQ ID NO: 1498915 - protein, 25 aa, Mycobacterium tuberculosis
ADPVFLDWLVGLAFPCQRPFGHQYG

SEQ ID NO: 1498916 - protein, 18 aa, Mycobacterium tuberculosis
ADVQRLPLNVTWVNLTTG

SEQ ID NO: 1498917 - protein, 20 aa, Mycobacterium tuberculosis
AELCAQYLAPVLDAIKFNYF

SEQ ID NO: 1498918 - protein, 17 aa, Mycobacterium tuberculosis
AELGERCAFGLQLIAPR

SEQ ID NO: 1498919 - protein, 19 aa, Mycobacterium tuberculosis
AELLRPGLLVLPVRGPARF

SEQ ID NO: 1498920 - protein, 18 aa, Mycobacterium tuberculosis
AEVYFCWATRNYRELYGL

SEQ ID NO: 1498921 - protein, 30 aa, Mycobacterium tuberculosis
AGADEVSARIAALFGMYGLEYQAISAQVAA

SEQ ID NO: 1498922 - protein, 17 aa, Mycobacterium tuberculosis
AGDAIACALELQLSTLA

SEQ ID NO: 1498923 - protein, 18 aa, Mycobacterium tuberculosis
AGDARPPFWQNLAELGWL

SEQ ID NO: 1498924 - protein, 20 aa, Mycobacterium tuberculosis
AGGAGFSRALIVAGDNGGDG

SEQ ID NO: 1498925 - protein, 20 aa, Mycobacterium tuberculosis
AGGAGGWLFGNGGAGGNGGI

SEQ ID NO: 1498926 - protein, 18 aa, Mycobacterium tuberculosis
AGGCPHPLVVVAGAATRW

SEQ ID NO: 1498927 - protein, 17 aa, Mycobacterium tuberculosis
AGGFGFGGAGGAGGLGG

SEQ ID NO: 1498928 - protein, 19 aa, Mycobacterium tuberculosis
AGGKADIANSLGDNATVTG

SEQ ID NO: 1498929 - protein, 20 aa, Mycobacterium tuberculosis
AGGNGAWLFGNGGAGGGGGK

SEQ ID NO: 1498930 - protein, 21 aa, Mycobacterium tuberculosis
AGGQAALLFGRGGTGGAGGYG

SEQ ID NO: 1498931 - protein, 17 aa, Mycobacterium tuberculosis
AGIAALFGAQAQSYQAV

SEQ ID NO: 1498932 - protein, 18 aa, Mycobacterium tuberculosis
AGKMTNWAIARPPGQTQA

SEQ ID NO: 1498933 - protein, 18 aa, Mycobacterium tuberculosis
AGLLAGAVTMVWQREKLL

SEQ ID NO: 1498934 - protein, 17 aa, Mycobacterium tuberculosis
AGLTASRFVACPFGGSG

SEQ ID NO: 1498935 - protein, 22 aa, Mycobacterium tuberculosis
AHGGPHYLCLAIHAMVTDDSSR

SEQ ID NO: 1498936 - protein, 19 aa, Mycobacterium tuberculosis
AISGMNAVAGWRGAPRPVL

SEQ ID NO: 1498937 - protein, 17 aa, Mycobacterium tuberculosis
AIWRINELLNWQVASAG

SEQ ID NO: 1498938 - protein, 17 aa, Mycobacterium tuberculosis
AKIVADYLVARGVAGDH

SEQ ID NO: 1498939 - protein, 20 aa, Mycobacterium tuberculosis
AKYTICPAIAHGMDHLIGSV

SEQ ID NO: 1498940 - protein, 23 aa, Mycobacterium tuberculosis
ALCRAAGVPARIAFQTIDAPDKE

SEQ ID NO: 1498941 - protein, 22 aa, Mycobacterium tuberculosis
ALKWRWRQRVGSWKGRMPNLVM

SEQ ID NO: 1498942 - protein, 18 aa, Mycobacterium tuberculosis
ALLGRPLIGHGADGAPGT

SEQ ID NO: 1498943 - protein, 19 aa, Mycobacterium tuberculosis
ALNLVKCVHWPSSSPPQPP

SEQ ID NO: 1498944 - protein, 19 aa, Mycobacterium tuberculosis
ALVDRWAPGRVMLNAYGPT

SEQ ID NO: 1498945 - protein, 23 aa, Mycobacterium tuberculosis
ALVGPCWPAVFAAIGSAVTDTGE

SEQ ID NO: 1498946 - protein, 19 aa, Mycobacterium tuberculosis
ALVTLDWLGAHGFGRLLQH

SEQ ID NO: 1498947 - protein, 26 aa, Mycobacterium tuberculosis
APAPPPFRLPLLFVNALGDNWIVGAS

SEQ ID NO: 1498948 - protein, 29 aa, Mycobacterium tuberculosis
APGGNGGNAGWLYGRGGVGGAGGIGGGTG

SEQ ID NO: 1498949 - protein, 23 aa, Mycobacterium tuberculosis
APRKIPPGTGWRKFVYSVSFHKI

SEQ ID NO: 1498950 - protein, 19 aa, Mycobacterium tuberculosis
AQRWKAIRGEAGWMTTYAY

SEQ ID NO: 1498951 - protein, 19 aa, Mycobacterium tuberculosis
AQTVARWLVLYLRRPGGQT

SEQ ID NO: 1498952 - protein, 17 aa, Mycobacterium tuberculosis
AQYAAVIVRSELLTQYL

SEQ ID NO: 1498953 - protein, 19 aa, Mycobacterium tuberculosis
ARCALAWSVQTAALAREHN

SEQ ID NO: 1498954 - protein, 19 aa, Mycobacterium tuberculosis
AREAGRIAAREALPQIMEL

SEQ ID NO: 1498955 - protein, 20 aa, Mycobacterium tuberculosis
ARIFPPGSHIPIPFIEYTMP

SEQ ID NO: 1498956 - protein, 17 aa, Mycobacterium tuberculosis
ARLKVGIISAGRVGTAL

SEQ ID NO: 1498957 - protein, 17 aa, Mycobacterium tuberculosis
ARLVSIIAWRTYLVRDP

SEQ ID NO: 1498958 - protein, 21 aa, Mycobacterium tuberculosis
ARPPFWQNLAELGWLGLHIDE

SEQ ID NO: 1498959 - protein, 21 aa, Mycobacterium tuberculosis
ARQEPGLSWAAGLRDNGQTTL

SEQ ID NO: 1498960 - protein, 17 aa, Mycobacterium tuberculosis
ARQEPRISWAAGLRDDG

SEQ ID NO: 1498961 - protein, 24 aa, Mycobacterium tuberculosis
ARQEPRISWAAGLRDDGTTTLLVT

SEQ ID NO: 1498962 - protein, 17 aa, Mycobacterium tuberculosis
ARYGIVWGAMGAARSAW

SEQ ID NO: 1498963 - protein, 23 aa, Mycobacterium tuberculosis
ASDVARIGSSIGVANSAAAGSTT

SEQ ID NO: 1498964 - protein, 19 aa, Mycobacterium tuberculosis
ASGAGGWLLGTGGAGGAGG

SEQ ID NO: 1498965 - protein, 20 aa, Mycobacterium tuberculosis
ASGTPFVWDGSMVVNYQDPS

SEQ ID NO: 1498966 - protein, 17 aa, Mycobacterium tuberculosis
ASLRCPWCVDAHTTMLY

SEQ ID NO: 1498967 - protein, 20 aa, Mycobacterium tuberculosis
ASPPVKWPCFYGIDFPSPAE

SEQ ID NO: 1498968 - protein, 24 aa, Mycobacterium tuberculosis
ATARFGLLPLRWALACLLIDIGTV

SEQ ID NO: 1498969 - protein, 17 aa, Mycobacterium tuberculosis
ATCKRCGDAVPYIILPN

SEQ ID NO: 1498970 - protein, 24 aa, Mycobacterium tuberculosis
ATERYQVLVGWDFEPASEYGTKAA

SEQ ID NO: 1498971 - protein, 17 aa, Mycobacterium tuberculosis
ATFHAEFVSLLNGGAAA

SEQ ID NO: 1498972 - protein, 17 aa, Mycobacterium tuberculosis
ATRPACWRRPKTRCRRP

SEQ ID NO: 1498973 - protein, 17 aa, Mycobacterium tuberculosis
ATVTRLALAIAAIASAA

SEQ ID NO: 1498974 - protein, 25 aa, Mycobacterium tuberculosis
AVGGKRGTGGLLFGNGGAGGQGGLG

SEQ ID NO: 1498975 - protein, 23 aa, Mycobacterium tuberculosis
AVGGVGGNGGWLYGNGGAGGLGG

SEQ ID NO: 1498976 - protein, 19 aa, Mycobacterium tuberculosis
AVLVLSDWPAPQAPQSASG

SEQ ID NO: 1498977 - protein, 19 aa, Mycobacterium tuberculosis
AVQAWRGFSRWLMRAYDVL

SEQ ID NO: 1498978 - protein, 17 aa, Mycobacterium tuberculosis
AVTRATPRFGFEQVCAT

SEQ ID NO: 1498979 - protein, 23 aa, Mycobacterium tuberculosis
AWERGRFAAPYLRDSLLAAGALC

SEQ ID NO: 1498980 - protein, 18 aa, Mycobacterium tuberculosis
AYSPRFLWMWPNARISVM

SEQ ID NO: 1498981 - protein, 17 aa, Mycobacterium tuberculosis
CELDWWLGFSSAASLLG

SEQ ID NO: 1498982 - protein, 23 aa, Mycobacterium tuberculosis
CERALREHVEWSLLDVLRGAPGA

SEQ ID NO: 1498983 - protein, 17 aa, Mycobacterium tuberculosis
CFRCPQCTERLRASDDL

SEQ ID NO: 1498984 - protein, 24 aa, Mycobacterium tuberculosis
CFRCPQCTERLRASDDLLLVGGMR

SEQ ID NO: 1498985 - protein, 18 aa, Mycobacterium tuberculosis
CGALRRYHEALGVPISTL

SEQ ID NO: 1498986 - protein, 18 aa, Mycobacterium tuberculosis
CPGLCPQCGVPLASEPGH

SEQ ID NO: 1498987 - protein, 27 aa, Mycobacterium tuberculosis
CRPVGQSRRERGPAMEYLIAAQDVLVA

SEQ ID NO: 1498988 - protein, 19 aa, Mycobacterium tuberculosis
CWRADGQLEFLGRTDDQVK

SEQ ID NO: 1498989 - protein, 17 aa, Mycobacterium tuberculosis
DAAACALDLQRTSLAPI

SEQ ID NO: 1498990 - protein, 25 aa, Mycobacterium tuberculosis
DAAQPIWWVVRAIEFSKDFETFVQK

SEQ ID NO: 1498991 - protein, 19 aa, Mycobacterium tuberculosis
DAARLTAVWIADWADNTVH

SEQ ID NO: 1498992 - protein, 21 aa, Mycobacterium tuberculosis
DCGIPSIPPGHGWSPAAAAHV

SEQ ID NO: 1498993 - protein, 19 aa, Mycobacterium tuberculosis
DERHMLWFALMKPMTSTAT

SEQ ID NO: 1498994 - protein, 18 aa, Mycobacterium tuberculosis
DERHMLWFELMKPMTSTA

SEQ ID NO: 1498995 - protein, 22 aa, Mycobacterium tuberculosis
DEVSAAIAALFSSHGQQYQAMS

SEQ ID NO: 1498996 - protein, 17 aa, Mycobacterium tuberculosis
DEVWPAVVFTLVTLLDD

SEQ ID NO: 1498997 - protein, 19 aa, Mycobacterium tuberculosis
DEVWPAVVFTLVTLLDDPV

SEQ ID NO: 1498998 - protein, 18 aa, Mycobacterium tuberculosis
DFLHGRWLVLRRGKRSIA

SEQ ID NO: 1498999 - protein, 17 aa, Mycobacterium tuberculosis
DGAEGWTADPIIGVGSA

SEQ ID NO: 1499000 - protein, 30 aa, Mycobacterium tuberculosis; identical to SEQ ID NO: 214614

SEQ ID NO: 1499001 - protein, 23 aa, Mycobacterium tuberculosis
DGGRAVLVLSDWPAPQAPQSASG

SEQ ID NO: 1499002 - protein, 26 aa, Mycobacterium tuberculosis
DGGTGGRGGLLMGAGAGGHGGTGGAG

SEQ ID NO: 1499003 - protein, 17 aa, Mycobacterium tuberculosis
DGIELNPIVIPGSSIPI

SEQ ID NO: 1499004 - protein, 17 aa, Mycobacterium tuberculosis
DGRPRRAAVSSFGISGT

SEQ ID NO: 1499005 - protein, 17 aa, Mycobacterium tuberculosis
DKLHLEPGMTLLDIGCG

SEQ ID NO: 1499006 - protein, 22 aa, Mycobacterium tuberculosis
DKLPRYIAGVLARLQEVWLGRQ

SEQ ID NO: 1499007 - protein, 18 aa, Mycobacterium tuberculosis
DKPFWWAHFDRLNYPVDE

SEQ ID NO: 1499008 - protein, 19 aa, Mycobacterium tuberculosis
DLAWSRITYWRALLTSAVD

SEQ ID NO: 1499009 - protein, 20 aa, Mycobacterium tuberculosis
DLGDRFGFCIPDLAVWDNPS

SEQ ID NO: 1499010 - protein, 23 aa, Mycobacterium tuberculosis
DLVFAWRACRAVKSNAIVIAADG

SEQ ID NO: 1499011 - protein, 17 aa, Mycobacterium tuberculosis
DLVRRYAPKLALIVTSH

SEQ ID NO: 1499012 - protein, 17 aa, Mycobacterium tuberculosis
DLVSLVFSNFFGQNAPA

SEQ ID NO: 1499013 - protein, 21 aa, Mycobacterium tuberculosis
DNWPLGWGFDHFWGFPSGAAG

SEQ ID NO: 1499014 - protein, 20 aa, Mycobacterium tuberculosis
DRLRLALLLCAVRPEIGGAL

SEQ ID NO: 1499015 - protein, 20 aa, Mycobacterium tuberculosis
DRLRRWMAVAARIELRTGGA

SEQ ID NO: 1499016 - protein, 17 aa, Mycobacterium tuberculosis
DRWRLAQILTFQAVDAV

SEQ ID NO: 1499017 - protein, 19 aa, Mycobacterium tuberculosis
DTHARVGLLPTWGLSVRLP

SEQ ID NO: 1499018 - protein, 22 aa, Mycobacterium tuberculosis
DTHARVGLLPTWGLSVRLPQKV

SEQ ID NO: 1499019 - protein, 19 aa, Mycobacterium tuberculosis
DVRLLLPMPADWSYAEAAA

SEQ ID NO: 1499020 - protein, 21 aa, Mycobacterium tuberculosis
DWGAPVAWTFAWLHPDRCAGV

SEQ ID NO: 1499021 - protein, 23 aa, Mycobacterium tuberculosis
DYPARLDEFLAWTTRVANLLNSR

SEQ ID NO: 1499022 - protein, 17 aa, Mycobacterium tuberculosis
EAAHLRAFRAYAAHSQE

SEQ ID NO: 1499023 - protein, 19 aa, Mycobacterium tuberculosis
EAFPRLSVIRAPRHDRVVG

SEQ ID NO: 1499024 - protein, 19 aa, Mycobacterium tuberculosis
EAFRLLGHVDVVFSNAGIV

SEQ ID NO: 1499025 - protein, 19 aa, Mycobacterium tuberculosis
EARYLWPSMFAQVADEYDR

SEQ ID NO: 1499026 - protein, 21 aa, Mycobacterium tuberculosis
ECPPGTIGEIWVHGDNVAGGY

SEQ ID NO: 1499027 - protein, 21 aa, Mycobacterium tuberculosis
EEERARWSLGRHVKLRGHDQP

SEQ ID NO: 1499028 - protein, 20 aa, Mycobacterium tuberculosis
EERARNGLSIVIAPEGTRLD

SEQ ID NO: 1499029 - protein, 20 aa, Mycobacterium tuberculosis
EFRCARCGVPYTDALPEMPE

SEQ ID NO: 1499030 - protein, 17 aa, Mycobacterium tuberculosis
EGARLQLLLSRNEIDRA

SEQ ID NO: 1499031 - protein, 24 aa, Mycobacterium tuberculosis
EGKYIPRLGGMAFRDPDWADEVYV

SEQ ID NO: 1499032 - protein, 19 aa, Mycobacterium tuberculosis
EGMARAWGPVRVAIAAEQA

SEQ ID NO: 1499033 - protein, 18 aa, Mycobacterium tuberculosis
EGPARAWERGRFAAPYLR

SEQ ID NO: 1499034 - protein, 22 aa, Mycobacterium tuberculosis
EIANAAAMRVVLGAVNAPTQTL

SEQ ID NO: 1499035 - protein, 24 aa, Mycobacterium tuberculosis
ELAPRVVAKVPQLVQLAPHAVQMS

SEQ ID NO: 1499036 - protein, 25 aa, Mycobacterium tuberculosis
EMMATAAFDLARIGSQVSAASAVAA

SEQ ID NO: 1499037 - protein, 20 aa, Mycobacterium tuberculosis
EPIRNRICRGLRTGDHHRFG

SEQ ID NO: 1499038 - protein, 17 aa, Mycobacterium tuberculosis
EPPEHLIFIFATTEPEK

SEQ ID NO: 1499039 - protein, 23 aa, Mycobacterium tuberculosis
EQNAWWWYVLKFGRSSAYAEFFD

SEQ ID NO: 1499040 - protein, 21 aa, Mycobacterium tuberculosis
ERFVLGVGFGWNVEELADHGV

SEQ ID NO: 1499041 - protein, 21 aa, Mycobacterium tuberculosis
ERLNLPAGWSYHTRVLTSELR

SEQ ID NO: 1499042 - protein, 27 aa, Mycobacterium tuberculosis
ERYLTALMPMVWRACEREDFVVEVQAM

SEQ ID NO: 1499043 - protein, 19 aa, Mycobacterium tuberculosis
ESPIDWDIAWPAGDLQVNL

SEQ ID NO: 1499044 - protein, 20 aa, Mycobacterium tuberculosis
ESRGRLSAVVQRELADEAYH

SEQ ID NO: 1499045 - protein, 21 aa, Mycobacterium tuberculosis
ETRLGALAARLWLPLLAAEGS

SEQ ID NO: 1499046 - protein, 25 aa, Mycobacterium tuberculosis
ETVAAAALDVARIGSSIGAANAAAA

SEQ ID NO: 1499047 - protein, 19 aa, Mycobacterium tuberculosis
EVAELLLLGMPYRDIGARL

SEQ ID NO: 1499048 - protein, 19 aa, Mycobacterium tuberculosis
EVVEALKFHLRDLAVTFRF

SEQ ID NO: 1499049 - protein, 17 aa, Mycobacterium tuberculosis
EWFCLFSSAAALVGSPG

SEQ ID NO: 1499050 - protein, 18 aa, Mycobacterium tuberculosis
EWFCLFSSAAALVGSPGQ

SEQ ID NO: 1499051 - protein, 24 aa, Mycobacterium tuberculosis
EWLTQWSRPGLIPVALVVVNVFVE

SEQ ID NO: 1499052 - protein, 28 aa, Mycobacterium tuberculosis
EYRGCYGLSVAALMKWHLPRLEVLVDAG

SEQ ID NO: 1499053 - protein, 17 aa, Mycobacterium tuberculosis
FAAGLAFALRGSFDKVA

SEQ ID NO: 1499054 - protein, 19 aa, Mycobacterium tuberculosis
FAALSARAVALGFDTVATG

SEQ ID NO: 1499055 - protein, 20 aa, Mycobacterium tuberculosis
FACRVWRPGQGTVRTTINLP

SEQ ID NO: 1499056 - protein, 17 aa, Mycobacterium tuberculosis
FAIGAVLSMHFAKQAAR

SEQ ID NO: 1499057 - protein, 17 aa, Mycobacterium tuberculosis
FCGKSRRSSSTGGAPPR

SEQ ID NO: 1499058 - protein, 17 aa, Mycobacterium tuberculosis
FDALAAWVRAAAAKNMV

SEQ ID NO: 1499059 - protein, 20 aa, Mycobacterium tuberculosis
FEGIAVLGLGFGGAAGAGGA

SEQ ID NO: 1499060 - protein, 19 aa, Mycobacterium tuberculosis
FGGNGFAGVGGRGGMGGSG

SEQ ID NO: 1499061 - protein, 24 aa, Mycobacterium tuberculosis
FGGSGGRGGLLLGTGGAGGDGGDG

SEQ ID NO: 1499062 - protein, 21 aa, Mycobacterium tuberculosis
FGSGNGRAGLPGSGNVGNGNL

SEQ ID NO: 1499063 - protein, 18 aa, Mycobacterium tuberculosis
FGVLVIRCALCTDTVKRL

SEQ ID NO: 1499064 - protein, 17 aa, Mycobacterium tuberculosis
FGYNVVRDFTGHGIGTT

SEQ ID NO: 1499065 - protein, 17 aa, Mycobacterium tuberculosis
FHLCVVDAPTLHNAAEA

SEQ ID NO: 1499066 - protein, 21 aa, Mycobacterium tuberculosis
FIPAFLRYDLRPVTGEWQIAA

SEQ ID NO: 1499067 - protein, 19 aa, Mycobacterium tuberculosis
FLLDVNISGGLPAFTLFAG

SEQ ID NO: 1499068 - protein, 24 aa, Mycobacterium tuberculosis
FLNGEARLPLALPTSATGGIPVTV

SEQ ID NO: 1499069 - protein, 22 aa, Mycobacterium tuberculosis
FNRNTWGVAMIGNFDDVAPTPI

SEQ ID NO: 1499070 - protein, 17 aa, Mycobacterium tuberculosis
FPFSLVFARIYAARGYH

SEQ ID NO: 1499071 - protein, 17 aa, Mycobacterium tuberculosis
FRLLAGGVRGAVQRQQT

SEQ ID NO: 1499072 - protein, 20 aa, Mycobacterium tuberculosis
FRPGPRRRLGVLVDHLVAGS

SEQ ID NO: 1499073 - protein, 19 aa, Mycobacterium tuberculosis
FRVRFGVLVIRCALCTDTV

SEQ ID NO: 1499074 - protein, 17 aa, Mycobacterium tuberculosis
FTIPGFQIRVLLGPAAV

SEQ ID NO: 1499075 - protein, 19 aa, Mycobacterium tuberculosis
FYRGVGQGSLQFAITSPDL

SEQ ID NO: 1499076 - protein, 22 aa, Mycobacterium tuberculosis
GADGGAGGWLFGNGGNGGSGAT

SEQ ID NO: 1499077 - protein, 23 aa, Mycobacterium tuberculosis
GAGGAGFSRALIVAGDNGGDGGN

SEQ ID NO: 1499078 - protein, 18 aa, Mycobacterium tuberculosis
GAGGFGFGGAGGAGGLGG

SEQ ID NO: 1499079 - protein, 18 aa, Mycobacterium tuberculosis
GAGGLLFGDGGNGGAGGA

SEQ ID NO: 1499080 - protein, 17 aa, Mycobacterium tuberculosis
GAGGLLFGNGGNGAAGA

SEQ ID NO: 1499081 - protein, 17 aa, Mycobacterium tuberculosis
GAGGLLFGNGGNGGNAG

SEQ ID NO: 1499082 - protein, 18 aa, Mycobacterium tuberculosis
GAGGLLFGNGGNGGNAGA

SEQ ID NO: 1499083 - protein, 18 aa, Mycobacterium tuberculosis
GAGGTGFTPRRRRQRRQR

SEQ ID NO: 1499084 - protein, 18 aa, Mycobacterium tuberculosis
GAGRWRGGDGAVRRLEFT

SEQ ID NO: 1499085 - protein, 19 aa, Mycobacterium tuberculosis
GAGSIGFNASAPGAAGSPG

SEQ ID NO: 1499086 - protein, 23 aa, Mycobacterium tuberculosis
GAGTFPWVLAITMPYSDAAQRGA

SEQ ID NO: 1499087 - protein, 18 aa, Mycobacterium tuberculosis
GAMARLGVWSGDGLQLDL

SEQ ID NO: 1499088 - protein, 18 aa, Mycobacterium tuberculosis
GAVTMVWQREKLLQVNEI

SEQ ID NO: 1499089 - protein, 21 aa, Mycobacterium tuberculosis
GDAEPGVPPGAGGAGGAGTTG

SEQ ID NO: 1499090 - protein, 20 aa, Mycobacterium tuberculosis
GDALRLARRIAAALNASDNN

SEQ ID NO: 1499091 - protein, 19 aa, Mycobacterium tuberculosis
GDERHMLWFELMKPMTSTA

SEQ ID NO: 1499092 - protein, 30 aa, Mycobacterium tuberculosis
GDGGCRRVWRRYRRQRWCRRQRRADRQRRQ

SEQ ID NO: 1499093 - protein, 17 aa, Mycobacterium tuberculosis
GDGPWRLGLGSAGTFEN

SEQ ID NO: 1499094 - protein, 19 aa, Mycobacterium tuberculosis
GDGPWRLGLGSAGTFENLR

SEQ ID NO: 1499095 - protein, 21 aa, Mycobacterium tuberculosis
GDLGDRFGFCIPDLAVWDNPS

SEQ ID NO: 1499096 - protein, 17 aa, Mycobacterium tuberculosis
GDLRTGMMGVWIGAIQN

SEQ ID NO: 1499097 - protein, 22 aa, Mycobacterium tuberculosis
GDREIDGNLALVIARHQEAIVE

SEQ ID NO: 1499098 - protein, 19 aa, Mycobacterium tuberculosis
GDRVGIAWLRHTCGVCKYC

SEQ ID NO: 1499099 - protein, 18 aa, Mycobacterium tuberculosis
GELLRLARVLGIAATRDR

SEQ ID NO: 1499100 - protein, 20 aa, Mycobacterium tuberculosis
GEPLPRWQIALYWRTDGRPL

SEQ ID NO: 1499101 - protein, 17 aa, Mycobacterium tuberculosis
GEQKLDLVLAILRARQL

SEQ ID NO: 1499102 - protein, 18 aa, Mycobacterium tuberculosis
GERRPGWVGLPLAGVQTR

SEQ ID NO: 1499103 - protein, 17 aa, Mycobacterium tuberculosis
GEYGGPCYARIDAPADR

SEQ ID NO: 1499104 - protein, 24 aa, Mycobacterium tuberculosis
GFETGRRFPCDVVDDLVEGVTDGQ

SEQ ID NO: 1499105 - protein, 25 aa, Mycobacterium tuberculosis
GFGGNGFAGVGGRGGMGGSGGTGGT

SEQ ID NO: 1499106 - protein, 22 aa, Mycobacterium tuberculosis
GGAGGHGGWLWGNGGVGGSGGA

SEQ ID NO: 1499107 - protein, 26 aa, Mycobacterium tuberculosis
GGAGGQAALLFGRGGTGGAGGYGGDG

SEQ ID NO: 1499108 - protein, 24 aa, Mycobacterium tuberculosis
GGAGGRGGLLIGDGGAGGAGGVGG

SEQ ID NO: 1499109 - protein, 19 aa, Mycobacterium tuberculosis
GGAGGWLLGNGGNGGAGAA

SEQ ID NO: 1499110 - protein, 19 aa, Mycobacterium tuberculosis
GGAGGWLWGNGGAGGNGGV

SEQ ID NO: 1499111 - protein, 20 aa, Mycobacterium tuberculosis
GGAGMFSQPGVHGAGGTGGQ

SEQ ID NO: 1499112 - protein, 24 aa, Mycobacterium tuberculosis
GGAKRPVPRLGVLTVTIIQQTPDA

SEQ ID NO: 1499113 - protein, 20 aa, Mycobacterium tuberculosis
GGDGGRGGLLAGNGGTGGAG

SEQ ID NO: 1499114 - protein, 20 aa, Mycobacterium tuberculosis
GGDGGVGGWLYGDGGGGGDG

SEQ ID NO: 1499115 - protein, 17 aa, Mycobacterium tuberculosis
GGDGGWLIGNGGAGGSG

SEQ ID NO: 1499116 - protein, 19 aa, Mycobacterium tuberculosis
GGEGGEVGGAGGTGGAAGN

SEQ ID NO: 1499117 - protein, 19 aa, Mycobacterium tuberculosis
GGGGFSILLGLGGLGGLGS

SEQ ID NO: 1499118 - protein, 26 aa, Mycobacterium tuberculosis
GGGGGDGFDGTMAGLGGTGGSGGTGG

SEQ ID NO: 1499119 - protein, 22 aa, Mycobacterium tuberculosis
GGGSFGLPGLNGSGGDGGDGGN

SEQ ID NO: 1499120 - protein, 30 aa, Mycobacterium tuberculosis; identical to SEQ ID NO: 212873

SEQ ID NO: 1499121 - protein, 27 aa, Mycobacterium tuberculosis
GGHGGNGGNPGWLLGTAGGGGNGGAGS

SEQ ID NO: 1499122 - protein, 24 aa, Mycobacterium tuberculosis
GGLGDPRVGGSGGDGGTGGSGGAA

SEQ ID NO: 1499123 - protein, 19 aa, Mycobacterium tuberculosis
GGMRKRAGLARVLVLDPQI

SEQ ID NO: 1499124 - protein, 27 aa, Mycobacterium tuberculosis
GGNGGDAEPGVPPGAGGAGGAGTTGGK

SEQ ID NO: 1499125 - protein, 26 aa, Mycobacterium tuberculosis
GGNGGHGGNGGWLLGNGGNGGLGGDG

SEQ ID NO: 1499126 - protein, 24 aa, Mycobacterium tuberculosis
GGNGGNAGWLYGRGGVGGAGGIGG

SEQ ID NO: 1499127 - protein, 22 aa, Mycobacterium tuberculosis
GGNGGNPGWLLGTAGGGGNGGA

SEQ ID NO: 1499128 - protein, 25 aa, Mycobacterium tuberculosis
GGNGGRAGLLLGVGGMGGNGGATSV

SEQ ID NO: 1499129 - protein, 18 aa, Mycobacterium tuberculosis
GGNGGWLLGNGGIGGAGG

SEQ ID NO: 1499130 - protein, 19 aa, Mycobacterium tuberculosis
GGPRGARGAAGDIAAVAAG

SEQ ID NO: 1499131 - protein, 17 aa, Mycobacterium tuberculosis
GGRAVLVLSDWPAPQAP

SEQ ID NO: 1499132 - protein, 20 aa, Mycobacterium tuberculosis
GGRCLMPASSAARCAARIVG

SEQ ID NO: 1499133 - protein, 24 aa, Mycobacterium tuberculosis
GGRCLMPASSAARCAARIVGGPRL

SEQ ID NO: 1499134 - protein, 23 aa, Mycobacterium tuberculosis
GGRRAGAGLDHWVDPLGGRPATR

SEQ ID NO: 1499135 - protein, 19 aa, Mycobacterium tuberculosis
GGSAAKLFGDGGAGGAGGM

SEQ ID NO: 1499136 - protein, 17 aa, Mycobacterium tuberculosis
GGSGFWNIAGNLGNSGF

SEQ ID NO: 1499137 - protein, 24 aa, Mycobacterium tuberculosis
GGSGGFGAPPPRSIGGGDGGDGGR

SEQ ID NO: 1499138 - protein, 19 aa, Mycobacterium tuberculosis
GGSGGNGFDSFASGGTGGA

SEQ ID NO: 1499139 - protein, 17 aa, Mycobacterium tuberculosis
GGSGLGVGGAGGTGGAG

SEQ ID NO: 1499140 - protein, 18 aa, Mycobacterium tuberculosis
GGSIPFIAEFAAAFPQAT

SEQ ID NO: 1499141 - protein, 26 aa, Mycobacterium tuberculosis
GGTGGAGGHAWLFGHGGTGGIGGGPG

SEQ ID NO: 1499142 - protein, 23 aa, Mycobacterium tuberculosis
GHCMGAIVAFEFARLAERNGVPV

SEQ ID NO: 1499143 - protein, 17 aa, Mycobacterium tuberculosis
GHEWKFAITKNGRHSLT

SEQ ID NO: 1499144 - protein, 26 aa, Mycobacterium tuberculosis
GIGGGPGGNGGWLLGNGGHGGAGGIG

SEQ ID NO: 1499145 - protein, 22 aa, Mycobacterium tuberculosis
GILWRGDYQGLAGFAVGYTLPL

SEQ ID NO: 1499146 - protein, 21 aa, Mycobacterium tuberculosis
GKGGASGMLIGNGGNGGSGGV

SEQ ID NO: 1499147 - protein, 28 aa, Mycobacterium tuberculosis
GKGGSGGLIGRAGSDGGVGAGGAGGAGG

SEQ ID NO: 1499148 - protein, 23 aa, Mycobacterium tuberculosis
GLCSARMYFAYGLGNSVWFPLAT

SEQ ID NO: 1499149 - protein, 19 aa, Mycobacterium tuberculosis
GLDDCFRLLAGGVRGAVQR

SEQ ID NO: 1499150 - protein, 26 aa, Mycobacterium tuberculosis
GLDFMRSCSIRHRMASVIFSLEMSKS

SEQ ID NO: 1499151 - protein, 19 aa, Mycobacterium tuberculosis
GLDLLPRLLFRNGELDISV

SEQ ID NO: 1499152 - protein, 26 aa, Mycobacterium tuberculosis
GLGGAGGAGGWLIGQSGSTGGGGAGG

SEQ ID NO: 1499153 - protein, 24 aa, Mycobacterium tuberculosis
GLGGAGRDGGAPGGDGGDGGTGGS

SEQ ID NO: 1499154 - protein, 27 aa, Mycobacterium tuberculosis
GLPGNPGAVPGRAGGAGGLGGSGSDTS

SEQ ID NO: 1499155 - protein, 17 aa, Mycobacterium tuberculosis
GLRCIAPTWPLGAHPKP

SEQ ID NO: 1499156 - protein, 17 aa, Mycobacterium tuberculosis
GLVGFSFSIDIAGSTLL

SEQ ID NO: 1499157 - protein, 17 aa, Mycobacterium tuberculosis
GLVIGSWPDPPGLVAAS

SEQ ID NO: 1499158 - protein, 18 aa, Mycobacterium tuberculosis
GLVTALFGAPGQPGDTGQ

SEQ ID NO: 1499159 - protein, 17 aa, Mycobacterium tuberculosis
GNGGWLLGNGGHGGAGG

SEQ ID NO: 1499160 - protein, 17 aa, Mycobacterium tuberculosis
GNGNFGFGNAFGDGNLG

SEQ ID NO: 1499161 - protein, 17 aa, Mycobacterium tuberculosis
GPAGSILHDGGNGGHGG

SEQ ID NO: 1499162 - protein, 17 aa, Mycobacterium tuberculosis
GPAPFPAVPVDLPAPAD

SEQ ID NO: 1499163 - protein, 17 aa, Mycobacterium tuberculosis
GPIVIGSFFLPAFNIPG

SEQ ID NO: 1499164 - protein, 21 aa, Mycobacterium tuberculosis
GQGGAGRGLWGTGGAGGHGGQ

SEQ ID NO: 1499165 - protein, 18 aa, Mycobacterium tuberculosis
GQGSVLVPFSWQGVSLHA

SEQ ID NO: 1499166 - protein, 18 aa, Mycobacterium tuberculosis
GQITGLRSGFGGAGGAGG

SEQ ID NO: 1499167 - protein, 17 aa, Mycobacterium tuberculosis
GQLRLSVRQVMWGADAG

SEQ ID NO: 1499168 - protein, 22 aa, Mycobacterium tuberculosis
GQPGGAGGLLFGNGGNGAAGAV

SEQ ID NO: 1499169 - protein, 18 aa, Mycobacterium tuberculosis
GQVTSGLTAGVWQGAAAA

SEQ ID NO: 1499170 - protein, 22 aa, Mycobacterium tuberculosis
GRALLFPSLCHFSGGIPAPAAD

SEQ ID NO: 1499171 - protein, 20 aa, Mycobacterium tuberculosis
GRGGLLMGAGAGGHGGTGGA

SEQ ID NO: 1499172 - protein, 17 aa, Mycobacterium tuberculosis
GRLQLWHGYRLGLIEIT

SEQ ID NO: 1499173 - protein, 25 aa, Mycobacterium tuberculosis
GRPLRIAHAWSFTFDAAWQPLVALL

SEQ ID NO: 1499174 - protein, 20 aa, Mycobacterium tuberculosis
GRPQFSAVLECASAARQLGG

SEQ ID NO: 1499175 - protein, 20 aa, Mycobacterium tuberculosis
GRPRRAGVSSFGFGGTNAHV

SEQ ID NO: 1499176 - protein, 19 aa, Mycobacterium tuberculosis
GRWELCALMQTVAELAEAM

SEQ ID NO: 1499177 - protein, 25 aa, Mycobacterium tuberculosis
GSAAFRIVVGSVRIPPVSVIVEQII

SEQ ID NO: 1499178 - protein, 20 aa, Mycobacterium tuberculosis
GSFMLCAAFNVLLRGLCGRD

SEQ ID NO: 1499179 - protein, 26 aa, Mycobacterium tuberculosis
GSGGAGGLIGWAGAAGGTGAGGTGGQ

SEQ ID NO: 1499180 - protein, 26 aa, Mycobacterium tuberculosis
GSGGAGGNGGWLLGNGGIGGAGGTGG

SEQ ID NO: 1499181 - protein, 22 aa, Mycobacterium tuberculosis
GSSRKAFGGDGGVGGDGASALG

SEQ ID NO: 1499182 - protein, 18 aa, Mycobacterium tuberculosis
GSTMTLPLISMRFEGEDW

SEQ ID NO: 1499183 - protein, 25 aa, Mycobacterium tuberculosis
GTGADGGAGGWLFGNGGNGGHGATG

SEQ ID NO: 1499184 - protein, 17 aa, Mycobacterium tuberculosis
GTGGRGGLLMGAGAGGH

SEQ ID NO: 1499185 - protein, 20 aa, Mycobacterium tuberculosis
GTGGRGGWLAGAGGAGGAGG

SEQ ID NO: 1499186 - protein, 20 aa, Mycobacterium tuberculosis
GTGWRWRTWHLYPSASGGTV

SEQ ID NO: 1499187 - protein, 20 aa, Mycobacterium tuberculosis
GTPGSPMVAPPPPTPITQVQ

SEQ ID NO: 1499188 - protein, 26 aa, Mycobacterium tuberculosis
GVLWRGDYQGLLGFSYRPAVLPQTPF

SEQ ID NO: 1499189 - protein, 18 aa, Mycobacterium tuberculosis
GVSPSVWGGLAAARFQDV

SEQ ID NO: 1499190 - protein, 18 aa, Mycobacterium tuberculosis
GVVSPGFIGAPLALAALG

SEQ ID NO: 1499191 - protein, 18 aa, Mycobacterium tuberculosis
GWPWPWLILRLVMSMCSR

SEQ ID NO: 1499192 - protein, 21 aa, Mycobacterium tuberculosis
HAAELFGWLGPHPDTMVSSAA

SEQ ID NO: 1499193 - protein, 17 aa, Mycobacterium tuberculosis
HCRTCGRGMAPPGSGTW

SEQ ID NO: 1499194 - protein, 19 aa, Mycobacterium tuberculosis
HEGSLRFGDKVVLGRDNVI

SEQ ID NO: 1499195 - protein, 18 aa, Mycobacterium tuberculosis
HHRRDRCGDTAGGHRDGD

SEQ ID NO: 1499196 - protein, 17 aa, Mycobacterium tuberculosis
HMWFGDLVTMTWWDDLW

SEQ ID NO: 1499197 - protein, 20 aa, Mycobacterium tuberculosis
HPADVLPLWVAEMDVKLPPT

SEQ ID NO: 1499198 - protein, 20 aa, Mycobacterium tuberculosis
HQLEFEFLPAVNRFLDEHVG

SEQ ID NO: 1499199 - protein, 24 aa, Mycobacterium tuberculosis
HRLARSLFLYALCNGWINENTTVV

SEQ ID NO: 1499200 - protein, 24 aa, Mycobacterium tuberculosis
HSNALWCRWCLGYAQLMRGELAAA

SEQ ID NO: 1499201 - protein, 28 aa, Mycobacterium tuberculosis
HTTLSIGPFPFRWDYIPPTPANGPIPAV

SEQ ID NO: 1499202 - protein, 17 aa, Mycobacterium tuberculosis
IAPEIVEFWQGRENRMH

SEQ ID NO: 1499203 - protein, 28 aa, Mycobacterium tuberculosis
IATPEMMATAAFDLARIGSQVSAASAVA

SEQ ID NO: 1499204 - protein, 18 aa, Mycobacterium tuberculosis
IDNLRAAFAFSRENGDTG

SEQ ID NO: 1499205 - protein, 20 aa, Mycobacterium tuberculosis
IDPWGGSYYVEWLTHRLARR

SEQ ID NO: 1499206 - protein, 19 aa, Mycobacterium tuberculosis
IEIRRAAGLSVELTVVESA

SEQ ID NO: 1499207 - protein, 23 aa, Mycobacterium tuberculosis
IEPGRPCWLVGLLFPSADGCAGH

SEQ ID NO: 1499208 - protein, 19 aa, Mycobacterium tuberculosis
IFLMCLPDRVLAYGDCAII

SEQ ID NO: 1499209 - protein, 17 aa, Mycobacterium tuberculosis
IGVLFKRIFDRPARRPV

SEQ ID NO: 1499210 - protein, 17 aa, Mycobacterium tuberculosis
IKLAVLVATNFFGINTI

SEQ ID NO: 1499211 - protein, 25 aa, Mycobacterium tuberculosis
IKRWFPGFMTFRFLECGLLTMVSNP

SEQ ID NO: 1499212 - protein, 17 aa, Mycobacterium tuberculosis
ILNRGAGISGVYNTGAL

SEQ ID NO: 1499213 - protein, 17 aa, Mycobacterium tuberculosis
ILNRGAGISGVYNTGTL

SEQ ID NO: 1499214 - protein, 18 aa, Mycobacterium tuberculosis
ILYRLYRPLIFALYCLPL

SEQ ID NO: 1499215 - protein, 18 aa, Mycobacterium tuberculosis
IPEDLAFAESRIRPSTIA

SEQ ID NO: 1499216 - protein, 22 aa, Mycobacterium tuberculosis
IPGFADSLLRVWQAKKRTSTRI

SEQ ID NO: 1499217 - protein, 17 aa, Mycobacterium tuberculosis
IPPGHGWSPAAAAHVFV

SEQ ID NO: 1499218 - protein, 17 aa, Mycobacterium tuberculosis
IPRVRRRWWHCIWRCSH

SEQ ID NO: 1499219 - protein, 22 aa, Mycobacterium tuberculosis
IRGPIGLGFRVPCFVISPYSRG

SEQ ID NO: 1499220 - protein, 17 aa, Mycobacterium tuberculosis
IRRAQCVQLYRRREFTR

SEQ ID NO: 1499221 - protein, 17 aa, Mycobacterium tuberculosis
IRTLRRLGIRSVAVYSD

SEQ ID NO: 1499222 - protein, 19 aa, Mycobacterium tuberculosis
ISAAIAALFGAHGRAYQAA

SEQ ID NO: 1499223 - protein, 17 aa, Mycobacterium tuberculosis
ISGMNAVAGWRGAPRPV

SEQ ID NO: 1499224 - protein, 17 aa, Mycobacterium tuberculosis
ITLPVALVWAYPTISDL

SEQ ID NO: 1499225 - protein, 19 aa, Mycobacterium tuberculosis
ITRLVPFIEWLRGAYPDQL

SEQ ID NO: 1499226 - protein, 18 aa, Mycobacterium tuberculosis
IVAQGVWCGMTIPRVYPE

SEQ ID NO: 1499227 - protein, 18 aa, Mycobacterium tuberculosis
IVMPARLPNRIHPFVQEI

SEQ ID NO: 1499228 - protein, 19 aa, Mycobacterium tuberculosis
IYFPGRWGARIEDIVIVTE

SEQ ID NO: 1499229 - protein, 18 aa, Mycobacterium tuberculosis
IYQNLGWAFGYNTAAIPL

SEQ ID NO: 1499230 - protein, 17 aa, Mycobacterium tuberculosis
KAGPLIAVKLHILTRKT

SEQ ID NO: 1499231 - protein, 17 aa, Mycobacterium tuberculosis
KECQQRFPFPMTVFDSD

SEQ ID NO: 1499232 - protein, 19 aa, Mycobacterium tuberculosis
KEERGARIFIDFNQNARDR

SEQ ID NO: 1499233 - protein, 18 aa, Mycobacterium tuberculosis
KEFRCVSVDLLARRPVVH

SEQ ID NO: 1499234 - protein, 19 aa, Mycobacterium tuberculosis
KFLNNWRMAELHAKEAPDR

SEQ ID NO: 1499235 - protein, 19 aa, Mycobacterium tuberculosis
KGGSGLGVGGAGGTGGAGG

SEQ ID NO: 1499236 - protein, 18 aa, Mycobacterium tuberculosis
KISLMRRIKQSFDPAGIL

SEQ ID NO: 1499237 - protein, 18 aa, Mycobacterium tuberculosis
KQVRCVYVAIGQKGTTIA

SEQ ID NO: 1499238 - protein, 18 aa, Mycobacterium tuberculosis
KRDIYKFAAGSVFSRPFQ

SEQ ID NO: 1499239 - protein, 17 aa, Mycobacterium tuberculosis
KRLQVILDRQIMRKLAG

SEQ ID NO: 1499240 - protein, 20 aa, Mycobacterium tuberculosis
KSELWPDLNLGLPFTYHQGY

SEQ ID NO: 1499241 - protein, 21 aa, Mycobacterium tuberculosis
KTSRDAWCYNFSRGALEANIG

SEQ ID NO: 1499242 - protein, 17 aa, Mycobacterium tuberculosis
LAGFPGTVASFWQQAGR

SEQ ID NO: 1499243 - protein, 19 aa, Mycobacterium tuberculosis
LALTELWRSYGVIPDAVIG

SEQ ID NO: 1499244 - protein, 17 aa, Mycobacterium tuberculosis
LAQILTFQAVDAVVAGD

SEQ ID NO: 1499245 - protein, 18 aa, Mycobacterium tuberculosis
LARGDAYWDTVVEITSIG

SEQ ID NO: 1499246 - protein, 20 aa, Mycobacterium tuberculosis
LAWRTKRLIVFDVDSTLVQG

SEQ ID NO: 1499247 - protein, 21 aa, Mycobacterium tuberculosis
LDPLLPFPRWHEHAAMVEEPV

SEQ ID NO: 1499248 - protein, 22 aa, Mycobacterium tuberculosis
LDPLLPFPRWHEHAAMVEEPVR

SEQ ID NO: 1499249 - protein, 17 aa, Mycobacterium tuberculosis
LEGGRFAIYIKMHHSLI

SEQ ID NO: 1499250 - protein, 23 aa, Mycobacterium tuberculosis
LERIGLRFVLEIRVPAGVDGRIM

SEQ ID NO: 1499251 - protein, 23 aa, Mycobacterium tuberculosis
LFGAGGAGGFGFGGAGGAGGLGG

SEQ ID NO: 1499252 - protein, 20 aa, Mycobacterium tuberculosis
LFGSHAREYQAISTQVAAFH

SEQ ID NO: 1499253 - protein, 20 aa, Mycobacterium tuberculosis
LGAIGIDLTDVFAVLEEEGV

SEQ ID NO: 1499254 - protein, 20 aa, Mycobacterium tuberculosis
LGERCAFGLQLIAPRLPPFD

SEQ ID NO: 1499255 - protein, 24 aa, Mycobacterium tuberculosis
LGGAGGAGGWLIGQSGSTGGGGAG

SEQ ID NO: 1499256 - protein, 17 aa, Mycobacterium tuberculosis
LGLNAPWIAAVESLYEE

SEQ ID NO: 1499257 - protein, 18 aa, Mycobacterium tuberculosis
LGLNAPWIAAVESLYEEY

SEQ ID NO: 1499258 - protein, 18 aa, Mycobacterium tuberculosis
LGLVVARWLVDRGAGRVV

SEQ ID NO: 1499259 - protein, 19 aa, Mycobacterium tuberculosis
LGMPWIVVVGRGWADGVVE

SEQ ID NO: 1499260 - protein, 17 aa, Mycobacterium tuberculosis
LIFGEFDLPQLVVHPYT

SEQ ID NO: 1499261 - protein, 18 aa, Mycobacterium tuberculosis
LKAAFDWKSRHNQAHGID

SEQ ID NO: 1499262 - protein, 17 aa, Mycobacterium tuberculosis
LKSSVAMELVRKQRGLT

SEQ ID NO: 1499263 - protein, 18 aa, Mycobacterium tuberculosis
LKSTGFARDLADYIQEQG

SEQ ID NO: 1499264 - protein, 17 aa, Mycobacterium tuberculosis
LKYCYNLGGIKHFYAES

SEQ ID NO: 1499265 - protein, 17 aa, Mycobacterium tuberculosis
LLCCGAMLDGAREALSI

SEQ ID NO: 1499266 - protein, 19 aa, Mycobacterium tuberculosis
LLLEVAWEALEHAGIPPGT

SEQ ID NO: 1499267 - protein, 18 aa, Mycobacterium tuberculosis
LLLGRPLIGDGANGGPGQ

SEQ ID NO: 1499268 - protein, 17 aa, Mycobacterium tuberculosis
LLLSPAVFRGFDQVGAL

SEQ ID NO: 1499269 - protein, 19 aa, Mycobacterium tuberculosis
LLPQVFRWARTVDPVQPLT

SEQ ID NO: 1499270 - protein, 18 aa, Mycobacterium tuberculosis
LLVRGGVVFSGYWRNEQA

SEQ ID NO: 1499271 - protein, 19 aa, Mycobacterium tuberculosis
LLYRLERPLLFALQCMPLN

SEQ ID NO: 1499272 - protein, 18 aa, Mycobacterium tuberculosis
LMFLKFRYRLGYESLCRE

SEQ ID NO: 1499273 - protein, 18 aa, Mycobacterium tuberculosis
LNARAATFHAEFVSLLNG

SEQ ID NO: 1499274 - protein, 23 aa, Mycobacterium tuberculosis
LNARAATFHAEFVSLLNGGAAAY

SEQ ID NO: 1499275 - protein, 22 aa, Mycobacterium tuberculosis
LNEGRGDFFAVVRSLALFVNAL

SEQ ID NO: 1499276 - protein, 21 aa, Mycobacterium tuberculosis
LNGEARLPLALPTSATGGIPV

SEQ ID NO: 1499277 - protein, 17 aa, Mycobacterium tuberculosis
LNTGLTPFLLGPVYISN

SEQ ID NO: 1499278 - protein, 18 aa, Mycobacterium tuberculosis
LPAEGNCWVSIWTRGGYA

SEQ ID NO: 1499279 - protein, 18 aa, Mycobacterium tuberculosis
LPIFGFGGAPGFGNDTTA

SEQ ID NO: 1499280 - protein, 19 aa, Mycobacterium tuberculosis
LPMSFTFARFLKFIVTEIF

SEQ ID NO: 1499281 - protein, 19 aa, Mycobacterium tuberculosis
LPSDIWKATMDGALKGTSN

SEQ ID NO: 1499282 - protein, 17 aa, Mycobacterium tuberculosis
LPSWWDRRRKLGLVLSA

SEQ ID NO: 1499283 - protein, 18 aa, Mycobacterium tuberculosis
LPTHCWFEGRGWGFQVYP

SEQ ID NO: 1499284 - protein, 17 aa, Mycobacterium tuberculosis
LPTLMAFKKGKLVFKQA

SEQ ID NO: 1499285 - protein, 18 aa, Mycobacterium tuberculosis
LPVYIISIGRTFRTDELD

SEQ ID NO: 1499286 - protein, 18 aa, Mycobacterium tuberculosis
LPWGNGIVSLTPAPDHVR

SEQ ID NO: 1499287 - protein, 19 aa, Mycobacterium tuberculosis
LQPRLPAVMDRLDRAIPRG

SEQ ID NO: 1499288 - protein, 17 aa, Mycobacterium tuberculosis
LQPTRPGGVSTLGALIN

SEQ ID NO: 1499289 - protein, 22 aa, Mycobacterium tuberculosis
LRASIDPFGWYRSWEEMLTGMA

SEQ ID NO: 1499290 - protein, 17 aa, Mycobacterium tuberculosis
LRASIDWSHALLTETEQ

SEQ ID NO: 1499291 - protein, 19 aa, Mycobacterium tuberculosis
LREDPPRRLAGFPATVTDI

SEQ ID NO: 1499292 - protein, 18 aa, Mycobacterium tuberculosis
LRFGLELVECTDFFSDTT

SEQ ID NO: 1499293 - protein, 17 aa, Mycobacterium tuberculosis
LRIPGARVIPTIYFLRH

SEQ ID NO: 1499294 - protein, 21 aa, Mycobacterium tuberculosis
LRKTVLCAAAHGLGRPPADVT

SEQ ID NO: 1499295 - protein, 17 aa, Mycobacterium tuberculosis
LRLSWNFLARSTAGLWE

SEQ ID NO: 1499296 - protein, 17 aa, Mycobacterium tuberculosis
LRLWRCGRVGPMRVAVV

SEQ ID NO: 1499297 - protein, 21 aa, Mycobacterium tuberculosis
LRRPEIRAGQLARHVRHQPKL

SEQ ID NO: 1499298 - protein, 18 aa, Mycobacterium tuberculosis
LRSDVRLDFKPVVQTRYE

SEQ ID NO: 1499299 - protein, 18 aa, Mycobacterium tuberculosis
LRSKVIRCLYRVSEGGAG

SEQ ID NO: 1499300 - protein, 18 aa, Mycobacterium tuberculosis
LRTGMMGVWIGAIQNMYP

SEQ ID NO: 1499301 - protein, 22 aa, Mycobacterium tuberculosis
LRWGEYRAGGLARARWGLLEPP

SEQ ID NO: 1499302 - protein, 17 aa, Mycobacterium tuberculosis
LSALRAIPRLSVVRPAD

SEQ ID NO: 1499303 - protein, 18 aa, Mycobacterium tuberculosis
LSPAPALLALPAAESAWR

SEQ ID NO: 1499304 - protein, 21 aa, Mycobacterium tuberculosis
LSVKRLAGWLAAAGYCGRAPR

SEQ ID NO: 1499305 - protein, 19 aa, Mycobacterium tuberculosis
LSYKTGWYGSALVVADRWF

SEQ ID NO: 1499306 - protein, 24 aa, Mycobacterium tuberculosis
LTGVMTFGLPLAMTLNAVGSPITT

SEQ ID NO: 1499307 - protein, 25 aa, Mycobacterium tuberculosis
LTGVMTFGLPLAMTLNAVGSPITTA

SEQ ID NO: 1499308 - protein, 18 aa, Mycobacterium tuberculosis
LTGWQWLGPSSVRMGAAV

SEQ ID NO: 1499309 - protein, 19 aa, Mycobacterium tuberculosis
LTRMQRFWIALYFPLTMRS

SEQ ID NO: 1499310 - protein, 22 aa, Mycobacterium tuberculosis
LVEGRVALTIPADWSTQPVVSG

SEQ ID NO: 1499311 - protein, 21 aa, Mycobacterium tuberculosis
LVGPIAWTLGFPIVPMLAPGS

SEQ ID NO: 1499312 - protein, 18 aa, Mycobacterium tuberculosis
LVWIRGCLHQIPPAELVE

SEQ ID NO: 1499313 - protein, 18 aa, Mycobacterium tuberculosis
MALELTWEALEHARIPAS

SEQ ID NO: 1499314 - protein, 18 aa, Mycobacterium tuberculosis
MEALDLLPLTDRRHLIEK

SEQ ID NO: 1499315 - protein, 25 aa, Mycobacterium tuberculosis
MERLYKTSWRFAPFLWQEIEEGILP

SEQ ID NO: 1499316 - protein, 18 aa, Mycobacterium tuberculosis
MFDGRFVGFADFLIRDGH

SEQ ID NO: 1499317 - protein, 19 aa, Mycobacterium tuberculosis
MGGAINCGKAQPGQVAAVS

SEQ ID NO: 1499318 - protein, 17 aa, Mycobacterium tuberculosis
MLPHNAVEYFVSYYDYY

SEQ ID NO: 1499319 - protein, 17 aa, Mycobacterium tuberculosis
MRNRLKSATGLALSPTL

SEQ ID NO: 1499320 - protein, 17 aa, Mycobacterium tuberculosis
MRNRLRLAATHAVRTSA

SEQ ID NO: 1499321 - protein, 17 aa, Mycobacterium tuberculosis
MRWGLIPSWIKAGPGGA

SEQ ID NO: 1499322 - protein, 17 aa, Mycobacterium tuberculosis
MVGRNVLHALGFDAFGL

SEQ ID NO: 1499323 - protein, 21 aa, Mycobacterium tuberculosis
NAVKLRLGIGYVIQDAGLMPH

SEQ ID NO: 1499324 - protein, 23 aa, Mycobacterium tuberculosis
NAVRFAFWGAEEFGLIGSRNYVE

SEQ ID NO: 1499325 - protein, 18 aa, Mycobacterium tuberculosis
NDIAVVWSPTGVPYVVAV

SEQ ID NO: 1499326 - protein, 21 aa, Mycobacterium tuberculosis
NELGHPWTVLRATRRTDYLIL

SEQ ID NO: 1499327 - protein, 17 aa, Mycobacterium tuberculosis
NFRDIMITLGMFTHDAL

SEQ ID NO: 1499328 - protein, 17 aa, Mycobacterium tuberculosis
NGGDAEPGVPPGAGGAG

SEQ ID NO: 1499329 - protein, 22 aa, Mycobacterium tuberculosis
NGGHGGNGGWLLGNGGNGGLGG

SEQ ID NO: 1499330 - protein, 23 aa, Mycobacterium tuberculosis
NGGKGGTGLMPGINGTGGAGGSR

SEQ ID NO: 1499331 - protein, 23 aa, Mycobacterium tuberculosis
NGGLGGDGFTYLADFDGEPGGDG

SEQ ID NO: 1499332 - protein, 18 aa, Mycobacterium tuberculosis
NGGNANWFGSGGAGGQGG

SEQ ID NO: 1499333 - protein, 18 aa, Mycobacterium tuberculosis
NHEPGWVVAPGMQGMQVQ

SEQ ID NO: 1499334 - protein, 24 aa, Mycobacterium tuberculosis
NNYRPQFYFPHHRRDRCGDTAGGH

SEQ ID NO: 1499335 - protein, 17 aa, Mycobacterium tuberculosis
NPVAAWRAFSPTVINAC

SEQ ID NO: 1499336 - protein, 22 aa, Mycobacterium tuberculosis
NQTRILAPRSRYDEIVAAVTNF

SEQ ID NO: 1499337 - protein, 23 aa, Mycobacterium tuberculosis
NRARLAAAIGLPGNRVVWMNQVH

SEQ ID NO: 1499338 - protein, 25 aa, Mycobacterium tuberculosis
NREVRWRPEHFWKPGTAVDVAVNTY

SEQ ID NO: 1499339 - protein, 18 aa, Mycobacterium tuberculosis
PDDSMRWLATVIQMDGRR

SEQ ID NO: 1499340 - protein, 21 aa, Mycobacterium tuberculosis
PDFLRLFYLLSMERSQDPAVA

SEQ ID NO: 1499341 - protein, 17 aa, Mycobacterium tuberculosis
PELRSDVRLDFKPVVQT

SEQ ID NO: 1499342 - protein, 18 aa, Mycobacterium tuberculosis
PFYHDMGLMLGIILPMIN

SEQ ID NO: 1499343 - protein, 26 aa, Mycobacterium tuberculosis
PGAEASWVVGITWWSAVVGGFQMSFV

SEQ ID NO: 1499344 - protein, 17 aa, Mycobacterium tuberculosis
PGARPGPVPKPGIRTPR

SEQ ID NO: 1499345 - protein, 18 aa, Mycobacterium tuberculosis
PGELRFGPLQARDELAAC

SEQ ID NO: 1499346 - protein, 17 aa, Mycobacterium tuberculosis
PGGAAFGLGNGGNGGNG

SEQ ID NO: 1499347 - protein, 21 aa, Mycobacterium tuberculosis
PGHAIWWLARGLEFFQDGEQF

SEQ ID NO: 1499348 - protein, 17 aa, Mycobacterium tuberculosis
PGRWGRTAVCARLSSAD

SEQ ID NO: 1499349 - protein, 20 aa, Mycobacterium tuberculosis
PGSHIPIPFIEYTMPQQVDS

SEQ ID NO: 1499350 - protein, 17 aa, Mycobacterium tuberculosis
PHVPAMLVAGCDPRPNA

SEQ ID NO: 1499351 - protein, 17 aa, Mycobacterium tuberculosis
PLQSAMGAVSASAQTLL

SEQ ID NO: 1499352 - protein, 24 aa, Mycobacterium tuberculosis
PMEFVSFKGGWQLSRQTAEMLLAM

SEQ ID NO: 1499353 - protein, 20 aa, Mycobacterium tuberculosis
PNAIAALGIREWDAVSLTGS

SEQ ID NO: 1499354 - protein, 21 aa, Mycobacterium tuberculosis
PPEHLQWIGQWGIFDALRAGR

SEQ ID NO: 1499355 - protein, 19 aa, Mycobacterium tuberculosis
PPHVPAMLVAGCDPRPNAE

SEQ ID NO: 1499356 - protein, 17 aa, Mycobacterium tuberculosis
PPVRWRSGRRVHFDLDP

SEQ ID NO: 1499357 - protein, 17 aa, Mycobacterium tuberculosis
PPYVVRWLVNGHETTVY

SEQ ID NO: 1499358 - protein, 17 aa, Mycobacterium tuberculosis
PQAGRFVSQYAIDLAHN

SEQ ID NO: 1499359 - protein, 17 aa, Mycobacterium tuberculosis
PQFSAVLECASAARQLG

SEQ ID NO: 1499360 - protein, 24 aa, Mycobacterium tuberculosis
PQLGRWKWHDPWVHASLLAQNNTR

SEQ ID NO: 1499361 - protein, 17 aa, Mycobacterium tuberculosis
PQQRLLLEVAWEALEHA

SEQ ID NO: 1499362 - protein, 17 aa, Mycobacterium tuberculosis
PQRGRISTWPLPEAFNG

SEQ ID NO: 1499363 - protein, 20 aa, Mycobacterium tuberculosis
PRAYPFTKFDRSGIHKRHRG

SEQ ID NO: 1499364 - protein, 17 aa, Mycobacterium tuberculosis
PRFSDVSSRIFGTPHDV

SEQ ID NO: 1499365 - protein, 18 aa, Mycobacterium tuberculosis
PRGWPEWAEPDVVDAFAD

SEQ ID NO: 1499366 - protein, 20 aa, Mycobacterium tuberculosis
PRLRYLLAVKACFAVFQTGT

SEQ ID NO: 1499367 - protein, 18 aa, Mycobacterium tuberculosis
PRPRWRSAQALTSRSCNG

SEQ ID NO: 1499368 - protein, 24 aa, Mycobacterium tuberculosis
PRRYGVRWHYRLPVWSDFVEVHWS

SEQ ID NO: 1499369 - protein, 21 aa, Mycobacterium tuberculosis
PRTAVDFAVPFSPRMSAPPIS

SEQ ID NO: 1499370 - protein, 20 aa, Mycobacterium tuberculosis
PTTARCGWLLSLGGAATDRL

SEQ ID NO: 1499371 - protein, 20 aa, Mycobacterium tuberculosis
PVKRLRQAGVLDLLLALANE

SEQ ID NO: 1499372 - protein, 17 aa, Mycobacterium tuberculosis
PVLDRLIAFTGRQPTAG

SEQ ID NO: 1499373 - protein, 17 aa, Mycobacterium tuberculosis
PVPEWIEGDIFRIYFSG

SEQ ID NO: 1499374 - protein, 17 aa, Mycobacterium tuberculosis
PYAHGWVTWFPPDAPPG

SEQ ID NO: 1499375 - protein, 22 aa, Mycobacterium tuberculosis
QAAAFHERFIQALSTAAGAYGS

SEQ ID NO: 1499376 - protein, 24 aa, Mycobacterium tuberculosis
QAAKDWLCLLEAFDAPQRSGLVRA

SEQ ID NO: 1499377 - protein, 18 aa, Mycobacterium tuberculosis
QAAVSGLVTALFGAPGQP

SEQ ID NO: 1499378 - protein, 19 aa, Mycobacterium tuberculosis
QATAVIPVIGPVTVTLEGT

SEQ ID NO: 1499379 - protein, 20 aa, Mycobacterium tuberculosis
QEGVVSLGLYSRIFRNNILA

SEQ ID NO: 1499380 - protein, 21 aa, Mycobacterium tuberculosis
QEPRISWAAGLRDDGTTTLLV

SEQ ID NO: 1499381 - protein, 20 aa, Mycobacterium tuberculosis
QEVKLGLARPVWIDDRDFDI

SEQ ID NO: 1499382 - protein, 19 aa, Mycobacterium tuberculosis
QGGAGRGLWGTGGAGGHGG

SEQ ID NO: 1499383 - protein, 20 aa, Mycobacterium tuberculosis
QGGAGRGLWGTGGAGGHGGQ

SEQ ID NO: 1499384 - protein, 22 aa, Mycobacterium tuberculosis
QGRTPLPFYVWRAFARYSPVLP

SEQ ID NO: 1499385 - protein, 21 aa, Mycobacterium tuberculosis
QGVPMCAGYVPGIPRLGVPAL

SEQ ID NO: 1499386 - protein, 17 aa, Mycobacterium tuberculosis
QKLDLVLAILRARQLFG

SEQ ID NO: 1499387 - protein, 18 aa, Mycobacterium tuberculosis
QRGWRFPDRLDRVYVNSR

SEQ ID NO: 1499388 - protein, 24 aa, Mycobacterium tuberculosis
QSARRCRWPRSWATSPVMDLSRNS

SEQ ID NO: 1499389 - protein, 17 aa, Mycobacterium tuberculosis
QTLRASIDWSHALLTET

SEQ ID NO: 1499390 - protein, 22 aa, Mycobacterium tuberculosis
QVGPRVARRFGRVLLELGGNNA

SEQ ID NO: 1499391 - protein, 18 aa, Mycobacterium tuberculosis
QVSCAGLVIGSWPDPPGL

SEQ ID NO: 1499392 - protein, 17 aa, Mycobacterium tuberculosis
RAAAMVIRGLVEKPARI

SEQ ID NO: 1499393 - protein, 20 aa, Mycobacterium tuberculosis
RAAPGVRRPRAWCSRIGRWP

SEQ ID NO: 1499394 - protein, 17 aa, Mycobacterium tuberculosis
RAATFHAEFVSLLNGGA

SEQ ID NO: 1499395 - protein, 17 aa, Mycobacterium tuberculosis
RAFDALAAWVRAAAAKN

SEQ ID NO: 1499396 - protein, 17 aa, Mycobacterium tuberculosis
RAHRGIVAVNELPDLAE

SEQ ID NO: 1499397 - protein, 18 aa, Mycobacterium tuberculosis
RAILRYPKWRVAEIDGEL

SEQ ID NO: 1499398 - protein, 17 aa, Mycobacterium tuberculosis
RASIDPFGWYRSWEEML

SEQ ID NO: 1499399 - protein, 19 aa, Mycobacterium tuberculosis
RCTPIAAWLAGLGLFTKRS

SEQ ID NO: 1499400 - protein, 20 aa, Mycobacterium tuberculosis
RETFRAIGVDLMFDHIKQSL

SEQ ID NO: 1499401 - protein, 21 aa, Mycobacterium tuberculosis
RETWLRLLLIRAGFPRPQTQI

SEQ ID NO: 1499402 - protein, 18 aa, Mycobacterium tuberculosis
RFAIYIKMHHSLIDGYTG

SEQ ID NO: 1499403 - protein, 19 aa, Mycobacterium tuberculosis
RFLWMWPNARISVMGGEQA

SEQ ID NO: 1499404 - protein, 21 aa, Mycobacterium tuberculosis
RGDALRLARRIAAALNASDNN

SEQ ID NO: 1499405 - protein, 21 aa, Mycobacterium tuberculosis
RGVIPRDHIKAVLDAADVLIW

SEQ ID NO: 1499406 - protein, 18 aa, Mycobacterium tuberculosis
RGVRACRGPGAGTRAPAW

SEQ ID NO: 1499407 - protein, 24 aa, Mycobacterium tuberculosis
RHLFTVLMDREWKHGVAAAVDVTL

SEQ ID NO: 1499408 - protein, 17 aa, Mycobacterium tuberculosis
RHLRLPLRDVIWGADAD

SEQ ID NO: 1499409 - protein, 19 aa, Mycobacterium tuberculosis
RISTWPLPEAFNGVTVNGV

SEQ ID NO: 1499410 - protein, 20 aa, Mycobacterium tuberculosis
RKLLEEWLAMWSGHYQLKDK

SEQ ID NO: 1499411 - protein, 17 aa, Mycobacterium tuberculosis
RLQEVWLGRQIAEVKSK

SEQ ID NO: 1499412 - protein, 26 aa, Mycobacterium tuberculosis
RNPERVWGWYLWRHYLVANVEPNDGH

SEQ ID NO: 1499413 - protein, 18 aa, Mycobacterium tuberculosis
RPLGFRPALGFSRVDTTI

SEQ ID NO: 1499414 - protein, 21 aa, Mycobacterium tuberculosis
RPLRGCYRIAVLSLKGGIGKT

SEQ ID NO: 1499415 - protein, 19 aa, Mycobacterium tuberculosis
RPRLFSLLHEFVHVVLHTE

SEQ ID NO: 1499416 - protein, 17 aa, Mycobacterium tuberculosis
RPRLSVMAVGGELVDIS

SEQ ID NO: 1499417 - protein, 17 aa, Mycobacterium tuberculosis
RPRWRRMANGLLHSKTR

SEQ ID NO: 1499418 - protein, 17 aa, Mycobacterium tuberculosis
RRAGLTASRFVACPFGG

SEQ ID NO: 1499419 - protein, 17 aa, Mycobacterium tuberculosis
RRLCGGWYGGLFQDQMR

SEQ ID NO: 1499420 - protein, 19 aa, Mycobacterium tuberculosis
RRRCAPLGAGRCLLGSGSA

SEQ ID NO: 1499421 - protein, 22 aa, Mycobacterium tuberculosis
RSWRPRVAVWGIHLLRRGGLTG

SEQ ID NO: 1499422 - protein, 18 aa, Mycobacterium tuberculosis
RTQRLAIAGRPATTRGVE

SEQ ID NO: 1499423 - protein, 21 aa, Mycobacterium tuberculosis
RTRKAGAVGLVMAEPLTYFFS

SEQ ID NO: 1499424 - protein, 20 aa, Mycobacterium tuberculosis
RTVCFADKFGCVHIGNPDLY

SEQ ID NO: 1499425 - protein, 17 aa, Mycobacterium tuberculosis
RVLLRFGLHQALRLGKP

SEQ ID NO: 1499426 - protein, 19 aa, Mycobacterium tuberculosis
RWPFCSGINHADIMFAGCF

SEQ ID NO: 1499427 - protein, 20 aa, Mycobacterium tuberculosis
RWRKADAALGRPVVSNQVRF

SEQ ID NO: 1499428 - protein, 17 aa, Mycobacterium tuberculosis
RYDLAVQEIFVFTPKGD

SEQ ID NO: 1499429 - protein, 21 aa, Mycobacterium tuberculosis
RYFIDRLAGWYVITSSDRMSR

SEQ ID NO: 1499430 - protein, 17 aa, Mycobacterium tuberculosis
RYLGLEVLTRARAALTS

SEQ ID NO: 1499431 - protein, 18 aa, Mycobacterium tuberculosis
RYLKVPCVIEFWDENGGA

SEQ ID NO: 1499432 - protein, 17 aa, Mycobacterium tuberculosis
RYRVGELIPVYRSQRAL

SEQ ID NO: 1499433 - protein, 19 aa, Mycobacterium tuberculosis
SAAIASLFAAHGQAYQAVS

SEQ ID NO: 1499434 - protein, 18 aa, Mycobacterium tuberculosis
SAAVAALFSGHAQTYQAL

SEQ ID NO: 1499435 - protein, 23 aa, Mycobacterium tuberculosis
SAAVSRLFGAYGQQFQALNARAA

SEQ ID NO: 1499436 - protein, 19 aa, Mycobacterium tuberculosis
SAELPDWLAANRGLAPGGH

SEQ ID NO: 1499437 - protein, 22 aa, Mycobacterium tuberculosis
SALLFPSLCHFSGGIPAPEADP

SEQ ID NO: 1499438 - protein, 18 aa, Mycobacterium tuberculosis
SCAYAVWAQESVRCRRRG

SEQ ID NO: 1499439 - protein, 19 aa, Mycobacterium tuberculosis
SCRWALAAANLWQGNLEAA

SEQ ID NO: 1499440 - protein, 17 aa, Mycobacterium tuberculosis
SDLPGAVPRMYVVTRGA

SEQ ID NO: 1499441 - protein, 18 aa, Mycobacterium tuberculosis
SDVARIGSSIGVANSAAA

SEQ ID NO: 1499442 - protein, 17 aa, Mycobacterium tuberculosis
SDWLTARLVDLDSGDIE

SEQ ID NO: 1499443 - protein, 20 aa, Mycobacterium tuberculosis
SEERLRPPPGYKDTTVPGIF

SEQ ID NO: 1499444 - protein, 17 aa, Mycobacterium tuberculosis
SGANYHLAWAIAAISTR

SEQ ID NO: 1499445 - protein, 18 aa, Mycobacterium tuberculosis
SGGHCWFLGGVADSVEEL

SEQ ID NO: 1499446 - protein, 20 aa, Mycobacterium tuberculosis
SGGLIGRAGSDGGVGAGGAG

SEQ ID NO: 1499447 - protein, 19 aa, Mycobacterium tuberculosis
SGGMCQRALIAIGLAGRPR

SEQ ID NO: 1499448 - protein, 19 aa, Mycobacterium tuberculosis
SIDPFGWYRSWEEMLTGMA

SEQ ID NO: 1499449 - protein, 17 aa, Mycobacterium tuberculosis
SKGKWDTLRAMGFDDDH

SEQ ID NO: 1499450 - protein, 17 aa, Mycobacterium tuberculosis
SLARLAIRDDIYGALRS

SEQ ID NO: 1499451 - protein, 20 aa, Mycobacterium tuberculosis
SLWRSSFSWWWKVLVRGWPW

SEQ ID NO: 1499452 - protein, 24 aa, Mycobacterium tuberculosis
SNGAFWRGDYQGLLDFSFPVGPLI

SEQ ID NO: 1499453 - protein, 24 aa, Mycobacterium tuberculosis
SNGAFWRGDYQGLLGFSYTSTIIP

SEQ ID NO: 1499454 - protein, 18 aa, Mycobacterium tuberculosis
SNILLLGPVGDLFPILSI

SEQ ID NO: 1499455 - protein, 17 aa, Mycobacterium tuberculosis
SPIPVGLDPTGVAVNPV

SEQ ID NO: 1499456 - protein, 19 aa, Mycobacterium tuberculosis
SPRGYRAMAGIPRLQFAHA

SEQ ID NO: 1499457 - protein, 18 aa, Mycobacterium tuberculosis
SQMSFVIAVPEALTMAAS

SEQ ID NO: 1499458 - protein, 22 aa, Mycobacterium tuberculosis
SRARLLGLRLRRLRYLRTAAAR

SEQ ID NO: 1499459 - protein, 23 aa, Mycobacterium tuberculosis
SRTRRALALCVPRDAIARDAGVP

SEQ ID NO: 1499460 - protein, 17 aa, Mycobacterium tuberculosis
STPGAKGAHGFTPTSGG

SEQ ID NO: 1499461 - protein, 23 aa, Mycobacterium tuberculosis
STPGAKGAHGFTPTSGGDGGDGG

SEQ ID NO: 1499462 - protein, 22 aa, Mycobacterium tuberculosis
SVSWPNPNDWWLVRLLGSITPT

SEQ ID NO: 1499463 - protein, 17 aa, Mycobacterium tuberculosis
SYARQMLDPGGWVEADE

SEQ ID NO: 1499464 - protein, 22 aa, Mycobacterium tuberculosis
TAGAGAWAMWGWVTPAAAAGGW

SEQ ID NO: 1499465 - protein, 17 aa, Mycobacterium tuberculosis
TAGAGGRGGDGGKGADP

SEQ ID NO: 1499466 - protein, 17 aa, Mycobacterium tuberculosis
TAIAALFGSHGQHYQAI

SEQ ID NO: 1499467 - protein, 24 aa, Mycobacterium tuberculosis
TAIKRVLPGLGYRLTSRGVRVATS

SEQ ID NO: 1499468 - protein, 17 aa, Mycobacterium tuberculosis
TALALHHLVCTRFRSDA

SEQ ID NO: 1499469 - protein, 19 aa, Mycobacterium tuberculosis
TAVGDWMLLAAIEALIDEQ

SEQ ID NO: 1499470 - protein, 26 aa, Mycobacterium tuberculosis
TDPEVLEWRYPVLLREFAVRQGSGGA

SEQ ID NO: 1499471 - protein, 20 aa, Mycobacterium tuberculosis
TGDCLFPGGVGKTWQPADFT

SEQ ID NO: 1499472 - protein, 18 aa, Mycobacterium tuberculosis
TGGRGGWLAGAGGAGGAG

SEQ ID NO: 1499473 - protein, 19 aa, Mycobacterium tuberculosis
TGNPWAARLQKGWRESSTT

SEQ ID NO: 1499474 - protein, 17 aa, Mycobacterium tuberculosis
TGVMSSGFFNFGTGNSG

SEQ ID NO: 1499475 - protein, 18 aa, Mycobacterium tuberculosis
TIRLRKTVLCAAAHGLGR

SEQ ID NO: 1499476 - protein, 19 aa, Mycobacterium tuberculosis
TLCQILYWRGVGTCISGDP

SEQ ID NO: 1499477 - protein, 25 aa, Mycobacterium tuberculosis
TLFGSVRSGLNTGLFNMGTAISGLF

SEQ ID NO: 1499478 - protein, 21 aa, Mycobacterium tuberculosis
TLSAVAGRPAGAAGASGAAGA

SEQ ID NO: 1499479 - protein, 23 aa, Mycobacterium tuberculosis
TLVIRGSCLLRHCDDTICERFTR

SEQ ID NO: 1499480 - protein, 17 aa, Mycobacterium tuberculosis
TLVRAASDLANIGSTLG

SEQ ID NO: 1499481 - protein, 20 aa, Mycobacterium tuberculosis
TMRNRLRLAATHAVRTSADV

SEQ ID NO: 1499482 - protein, 17 aa, Mycobacterium tuberculosis
TPAPVRGALVARLGELL

SEQ ID NO: 1499483 - protein, 21 aa, Mycobacterium tuberculosis
TPEALRAFGIRECADAARALD

SEQ ID NO: 1499484 - protein, 18 aa, Mycobacterium tuberculosis
TPGSPMVAPPPPTPITQV

SEQ ID NO: 1499485 - protein, 17 aa, Mycobacterium tuberculosis
TPNRLYWMSAWIDPDGT

SEQ ID NO: 1499486 - protein, 18 aa, Mycobacterium tuberculosis
TPRMRIGIHTGRPQRLAA

SEQ ID NO: 1499487 - protein, 25 aa, Mycobacterium tuberculosis
TQAAAFHERFIQALSTAAGAYGSAE

SEQ ID NO: 1499488 - protein, 24 aa, Mycobacterium tuberculosis
TQAAAFHSRFVQALTTAAASYASV

SEQ ID NO: 1499489 - protein, 19 aa, Mycobacterium tuberculosis
TRARVHLALSWALSRSPGG

SEQ ID NO: 1499490 - protein, 25 aa, Mycobacterium tuberculosis
VAACLKWEGGYVWACKNYDGDVQSD

SEQ ID NO: 1499491 - protein, 22 aa, Mycobacterium tuberculosis
VAGETLSALALRFYGDAELNWL

SEQ ID NO: 1499492 - protein, 25 aa, Mycobacterium tuberculosis
VALPNGRYGWRISLPAMVCYWSELA

SEQ ID NO: 1499493 - protein, 18 aa, Mycobacterium tuberculosis
VANCLVALAILDTVGVSP

SEQ ID NO: 1499494 - protein, 20 aa, Mycobacterium tuberculosis
VANCLVALAILDTVGVSPEQ

SEQ ID NO: 1499495 - protein, 17 aa, Mycobacterium tuberculosis
VAVAALFGTHAQEYQTV

SEQ ID NO: 1499496 - protein, 18 aa, Mycobacterium tuberculosis
VCGGGDWRRAGIPARSAQ

SEQ ID NO: 1499497 - protein, 18 aa, Mycobacterium tuberculosis
VCLGLPGSLPVLNRAAVE

SEQ ID NO: 1499498 - protein, 19 aa, Mycobacterium tuberculosis
VDLRNDWPTALKNAGFDPA

SEQ ID NO: 1499499 - protein, 22 aa, Mycobacterium tuberculosis
VEERARNGLSIVIAPEGTRLDT

SEQ ID NO: 1499500 - protein, 17 aa, Mycobacterium tuberculosis
VERTWLDGWLLRAGHGA

SEQ ID NO: 1499501 - protein, 18 aa, Mycobacterium tuberculosis
VEYYPAGRLNFVDTAADP

SEQ ID NO: 1499502 - protein, 20 aa, Mycobacterium tuberculosis
VGAWWPARPDAPMAGVTYWR

SEQ ID NO: 1499503 - protein, 24 aa, Mycobacterium tuberculosis
VGGDGGRGGLLAGNGGTGGAGGNG

SEQ ID NO: 1499504 - protein, 23 aa, Mycobacterium tuberculosis
VGGNGGRGGWLLGNGGAGGVGGV

SEQ ID NO: 1499505 - protein, 24 aa, Mycobacterium tuberculosis
VGLVGEKARYMWVSTFHSTCVRIL

SEQ ID NO: 1499506 - protein, 17 aa, Mycobacterium tuberculosis
VGPTILRHWSHPATVLV

SEQ ID NO: 1499507 - protein, 23 aa, Mycobacterium tuberculosis
VHLLECGLLRGWLIPPADIKAAR

SEQ ID NO: 1499508 - protein, 17 aa, Mycobacterium tuberculosis
VIATEFELVMPFVERAQ

SEQ ID NO: 1499509 - protein, 18 aa, Mycobacterium tuberculosis
VKLHVPIFLDIPVTGTLG

SEQ ID NO: 1499510 - protein, 19 aa, Mycobacterium tuberculosis
VKRLRQAGVLDLLLALANE

SEQ ID NO: 1499511 - protein, 18 aa, Mycobacterium tuberculosis
VNGFCVGGGIGLVGNSDV

SEQ ID NO: 1499512 - protein, 18 aa, Mycobacterium tuberculosis
VNLKLQFLHDAFPNEFPD

SEQ ID NO: 1499513 - protein, 19 aa, Mycobacterium tuberculosis
VNLKLQFLHDAFPNEFPDP

SEQ ID NO: 1499514 - protein, 18 aa, Mycobacterium tuberculosis
VNVYRVVSNLGVFDFGGP

SEQ ID NO: 1499515 - protein, 24 aa, Mycobacterium tuberculosis
VPAPPFWGSRIVKGLAVADYTGLL

SEQ ID NO: 1499516 - protein, 20 aa, Mycobacterium tuberculosis
VPCCFPSCRSITYLLTDGEH

SEQ ID NO: 1499517 - protein, 25 aa, Mycobacterium tuberculosis
VPLPELRLPPLPPLPPVPASPPSPP

SEQ ID NO: 1499518 - protein, 24 aa, Mycobacterium tuberculosis
VPPHGWVNLHFSLLPAWRGAAPVQ

SEQ ID NO: 1499519 - protein, 25 aa, Mycobacterium tuberculosis
VQTLRTGAASYMLAEATNVEQNLLN

SEQ ID NO: 1499520 - protein, 20 aa, Mycobacterium tuberculosis
VRAVHRCLLAGRFATALGAD

SEQ ID NO: 1499521 - protein, 17 aa, Mycobacterium tuberculosis
VRLLLPMPADWSYAEAA

SEQ ID NO: 1499522 - protein, 20 aa, Mycobacterium tuberculosis
VSAAVAALFSGHAQTYQALR

SEQ ID NO: 1499523 - protein, 25 aa, Mycobacterium tuberculosis
VSAAVSRLFGAYGQQFQALNARAAT

SEQ ID NO: 1499524 - protein, 20 aa, Mycobacterium tuberculosis
VSAGIAALFSAHAQEYQALS

SEQ ID NO: 1499525 - protein, 19 aa, Mycobacterium tuberculosis
VSAHIAALFSGHGEGYQAI

SEQ ID NO: 1499526 - protein, 21 aa, Mycobacterium tuberculosis
VSPDLVRRLCWEWEDISQSSP

SEQ ID NO: 1499527 - protein, 20 aa, Mycobacterium tuberculosis
VSTQIAALFGAHARSYQTLS

SEQ ID NO: 1499528 - protein, 18 aa, Mycobacterium tuberculosis
VSTVWTWPDKPGVAGCAA

SEQ ID NO: 1499529 - protein, 20 aa, Mycobacterium tuberculosis
VSVAISALFGSHAQGYQTLS

SEQ ID NO: 1499530 - protein, 18 aa, Mycobacterium tuberculosis
VVHPSWWSAARVEVVTAA

SEQ ID NO: 1499531 - protein, 17 aa, Mycobacterium tuberculosis
VVIGRGCLGRPWLFAEL

SEQ ID NO: 1499532 - protein, 17 aa, Mycobacterium tuberculosis
VVLLMWAGILAYLDRYG

SEQ ID NO: 1499533 - protein, 17 aa, Mycobacterium tuberculosis
VVPDFQLSLAIGKEGQN

SEQ ID NO: 1499534 - protein, 25 aa, Mycobacterium tuberculosis
VVQRPAGRARSRWFSDYLRTVTQRD

SEQ ID NO: 1499535 - protein, 18 aa, Mycobacterium tuberculosis
VVVFRPLYAVGGQELGYL

SEQ ID NO: 1499536 - protein, 20 aa, Mycobacterium tuberculosis
VVVSGRWPFCSGINHADIMF

SEQ ID NO: 1499537 - protein, 30 aa, Mycobacterium tuberculosis
WALMGMPCGKYLVVMLELWLPLEAAAGDLD

SEQ ID NO: 1499538 - protein, 17 aa, Mycobacterium tuberculosis
WASLLIHAGEPGAGTRM

SEQ ID NO: 1499539 - protein, 17 aa, Mycobacterium tuberculosis
WIGQWGIFDALRAGREV

SEQ ID NO: 1499540 - protein, 21 aa, Mycobacterium tuberculosis
WIPRLATMGVIASYCLTEPGA

SEQ ID NO: 1499541 - protein, 22 aa, Mycobacterium tuberculosis
WLSVKRLAGWLAAAGYCGRAPR

SEQ ID NO: 1499542 - protein, 18 aa, Mycobacterium tuberculosis
WMGRVHRFLGLQVGVILA

SEQ ID NO: 1499543 - protein, 17 aa, Mycobacterium tuberculosis
WMLLAAIEALIDEQDYL

SEQ ID NO: 1499544 - protein, 17 aa, Mycobacterium tuberculosis
WQPPLWRALVTTVGADP

SEQ ID NO: 1499545 - protein, 22 aa, Mycobacterium tuberculosis
WREVYRLRQPVLLIWGREDRVN

SEQ ID NO: 1499546 - protein, 20 aa, Mycobacterium tuberculosis
WRGGCIIRAKFLNHIKEAFD

SEQ ID NO: 1499547 - protein, 17 aa, Mycobacterium tuberculosis
WRGKKALLLQGRLWQGN

SEQ ID NO: 1499548 - protein, 18 aa, Mycobacterium tuberculosis
WRKADAALGRPVVSNQVH

SEQ ID NO: 1499549 - protein, 19 aa, Mycobacterium tuberculosis
WRNDQWYTARLCPAPLRPE

SEQ ID NO: 1499550 - protein, 17 aa, Mycobacterium tuberculosis
WSPKVFGSWNLHRATLG

SEQ ID NO: 1499551 - protein, 20 aa, Mycobacterium tuberculosis
WTLTPRIVSLDVEYFGVMWP

SEQ ID NO: 1499552 - protein, 19 aa, Mycobacterium tuberculosis
WTVLRATRRTDYLILEMAA

SEQ ID NO: 1499553 - protein, 17 aa, Mycobacterium tuberculosis
WVGHDWGAVVVWNAPLL

SEQ ID NO: 1499554 - protein, 19 aa, Mycobacterium tuberculosis
WWQRAVAVWPDYASYQTKT

SEQ ID NO: 1499555 - protein, 17 aa, Mycobacterium tuberculosis
YAHGWVTWFPPDAPPGT

SEQ ID NO: 1499556 - protein, 17 aa, Mycobacterium tuberculosis
YAPKLALIVTSHQHFDH

SEQ ID NO: 1499557 - protein, 20 aa, Mycobacterium tuberculosis
YARQRPGLLAAWLDGDLGEL

SEQ ID NO: 1499558 - protein, 17 aa, Mycobacterium tuberculosis
YCRRMQQKLVEFAEAGF

SEQ ID NO: 1499559 - protein, 18 aa, Mycobacterium tuberculosis
YDVSHLELPLPADGSTMP

SEQ ID NO: 1499560 - protein, 17 aa, Mycobacterium tuberculosis
YELMGVPFAKRGKRIDE

SEQ ID NO: 1499561 - protein, 21 aa, Mycobacterium tuberculosis
YETIGGLVLRELGHIPVAGET

SEQ ID NO: 1499562 - protein, 19 aa, Mycobacterium tuberculosis
YGNRFGYNVVRDFTGHGIG

SEQ ID NO: 1499563 - protein, 17 aa, Mycobacterium tuberculosis
YLRFREWFLPAIHRKYG

SEQ ID NO: 1499564 - protein, 17 aa, Mycobacterium tuberculosis
YPLKGVFHAAGVLDDAV

SEQ ID NO: 1499565 - protein, 18 aa, Mycobacterium tuberculosis
YQGLAGFAVGYTLPLFPA

SEQ ID NO: 1499566 - protein, 20 aa, Mycobacterium tuberculosis
YRGAMGLNWYLTDPTLQFIM

SEQ ID NO: 1499567 - protein, 18 aa, Mycobacterium tuberculosis
YRTDVDWATQISYSGVFV

SEQ ID NO: 1499568 - protein, 19 aa, Mycobacterium tuberculosis
YRTDVDWATQISYSGVFVH

SEQ ID NO: 1499569 - protein, 20 aa, Mycobacterium tuberculosis
YRVGQNVAWQRWTEIAFGLT

SEQ ID NO: 1499570 - protein, 25 aa, Mycobacterium tuberculosis
YSPAELACALGLFPPTAEQAAVIAA

SEQ ID NO: 1499571 - protein, 17 aa, Mycobacterium tuberculosis
YTGLKLGGVYGFYPRFT

SEQ ID NO: 1499572 - protein, 25 aa, Mycobacterium tuberculosis
YVKTPAQVLLRWNLQLGNAVVVRSA

SEQ ID NO: 1499573 - protein, 26 aa, Mycobacterium tuberculosis
AAAAAPRCFSAAVGPVGTAALVGLTL

SEQ ID NO: 1499574 - protein, 18 aa, Mycobacterium tuberculosis
AAAATAWDGLAMELASAA

SEQ ID NO: 1499575 - protein, 18 aa, Mycobacterium tuberculosis
AAAAWARRFLDGPPHALA

SEQ ID NO: 1499576 - protein, 18 aa, Mycobacterium tuberculosis
AAACLRKTDWLFPQYREL

SEQ ID NO: 1499577 - protein, 24 aa, Mycobacterium tuberculosis
AAADRCGWLALPRRTHVSVLTGTE

SEQ ID NO: 1499578 - protein, 17 aa, Mycobacterium tuberculosis
AAAFQGAHARFVAAAAK

SEQ ID NO: 1499579 - protein, 25 aa, Mycobacterium tuberculosis
AAAGGWPTWVWAISGWPTPAPATSG

SEQ ID NO: 1499580 - protein, 22 aa, Mycobacterium tuberculosis
AAAGRAPRWGCWPRAPDEVSAA

SEQ ID NO: 1499581 - protein, 28 aa, Mycobacterium tuberculosis
AAAIAFATDCARIARVRPCGAVGAVAAG

SEQ ID NO: 1499582 - protein, 21 aa, Mycobacterium tuberculosis
AAAPRCFSAAVGPVGTAALVG

SEQ ID NO: 1499583 - protein, 17 aa, Mycobacterium tuberculosis
AAARAWRSLDVEMTAVQ

SEQ ID NO: 1499584 - protein, 17 aa, Mycobacterium tuberculosis
AAATVVWCAGMRASRLT

SEQ ID NO: 1499585 - protein, 19 aa, Mycobacterium tuberculosis
AAAVVGFGANGDPGFAGGK

SEQ ID NO: 1499586 - protein, 20 aa, Mycobacterium tuberculosis
AACYRTTFLVTVGFGQQLER

SEQ ID NO: 1499587 - protein, 17 aa, Mycobacterium tuberculosis
AADRCGRLALPRRTHVS

SEQ ID NO: 1499588 - protein, 18 aa, Mycobacterium tuberculosis
AADWGFVNSSGWPRQRES

SEQ ID NO: 1499589 - protein, 18 aa, Mycobacterium tuberculosis
AAEIARLAPLAILARQAV

SEQ ID NO: 1499590 - protein, 23 aa, Mycobacterium tuberculosis
AAELGERCAFGLQLIAPRLPPFD

SEQ ID NO: 1499591 - protein, 18 aa, Mycobacterium tuberculosis
AAELRYGRIPEVEKKLDA

SEQ ID NO: 1499592 - protein, 17 aa, Mycobacterium tuberculosis
AAFHARFVQALAGAMGA

SEQ ID NO: 1499593 - protein, 18 aa, Mycobacterium tuberculosis
AAFSAVKPSLAWAETYPG

SEQ ID NO: 1499594 - protein, 38 aa, Mycobacterium tuberculosis; identical to SEQ ID NO: 214558

SEQ ID NO: 1499595 - protein, 39 aa, Mycobacterium tuberculosis; identical to SEQ ID NO: 214829

SEQ ID NO: 1499596 - protein, 25 aa, Mycobacterium tuberculosis
AAGGNGGNGGWLFGAGGTGGIGGTG

SEQ ID NO: 1499597 - protein, 17 aa, Mycobacterium tuberculosis
AAGIPILGKTNMDEFAM

SEQ ID NO: 1499598 - protein, 18 aa, Mycobacterium tuberculosis
AAGRAAPRLTVWVPVAVN

SEQ ID NO: 1499599 - protein, 20 aa, Mycobacterium tuberculosis
AAGRAAPRLTVWVPVAVNPG

SEQ ID NO: 1499600 - protein, 25 aa, Mycobacterium tuberculosis
AAGRASGVLPRYGVRLTVMAHPPAA

SEQ ID NO: 1499601 - protein, 24 aa, Mycobacterium tuberculosis
AAGTRNAAGFGWLSTRRFKPPKAA

SEQ ID NO: 1499602 - protein, 27 aa, Mycobacterium tuberculosis
AAGWSEAVGALGAWGRAGATATALPAG

SEQ ID NO: 1499603 - protein, 18 aa, Mycobacterium tuberculosis
AAGYLCWRGKDLATPRGW

SEQ ID NO: 1499604 - protein, 19 aa, Mycobacterium tuberculosis
AAGYLCWRGKDLATPRGWI

SEQ ID NO: 1499605 - protein, 21 aa, Mycobacterium tuberculosis
AAHKAWWGVCLARTDPDAPKH

SEQ ID NO: 1499606 - protein, 17 aa, Mycobacterium tuberculosis
AAIAALFSGHAQAYQAL

SEQ ID NO: 1499607 - protein, 17 aa, Mycobacterium tuberculosis
AAILASIAFHTRVTADD

SEQ ID NO: 1499608 - protein, 18 aa, Mycobacterium tuberculosis
AAIPHRWATVVATQRTAT

SEQ ID NO: 1499609 - protein, 17 aa, Mycobacterium tuberculosis
AAISGFWVPAPPALLAV

SEQ ID NO: 1499610 - protein, 18 aa, Mycobacterium tuberculosis
AAKLCVQYLAPIVKNRQY

SEQ ID NO: 1499611 - protein, 17 aa, Mycobacterium tuberculosis
AALAALFGAHAREYQAA

SEQ ID NO: 1499612 - protein, 18 aa, Mycobacterium tuberculosis
AALAALFGAHAREYQAAA

SEQ ID NO: 1499613 - protein, 18 aa, Mycobacterium tuberculosis
AALARQGSFLGYRVTVCD

SEQ ID NO: 1499614 - protein, 23 aa, Mycobacterium tuberculosis
AALGRRWCCATGIIQPVGCRSDP

SEQ ID NO: 1499615 - protein, 20 aa, Mycobacterium tuberculosis
AALNLVKCVHWPSSSPPQPP

SEQ ID NO: 1499616 - protein, 17 aa, Mycobacterium tuberculosis
AALRAVPAERLWVNPDC

SEQ ID NO: 1499617 - protein, 25 aa, Mycobacterium tuberculosis
AALRAVPAERLWVNPDCGLKTRNVD

SEQ ID NO: 1499618 - protein, 17 aa, Mycobacterium tuberculosis
AAMAALFGAHAQEYQRL

SEQ ID NO: 1499619 - protein, 18 aa, Mycobacterium tuberculosis
AAPAAPRRPPPRSAPPAG

SEQ ID NO: 1499620 - protein, 18 aa, Mycobacterium tuberculosis
AAPGVRRPRAWCSRIGRW

SEQ ID NO: 1499621 - protein, 25 aa, Mycobacterium tuberculosis
AAPRKIPPGIGWRKFVYSVSFHKIN

SEQ ID NO: 1499622 - protein, 20 aa, Mycobacterium tuberculosis
AAQLAPWAQAVRALPNPTAP

SEQ ID NO: 1499623 - protein, 23 aa, Mycobacterium tuberculosis
AAQPIWWVVRAIEFSKDFETFVQ

SEQ ID NO: 1499624 - protein, 18 aa, Mycobacterium tuberculosis
AARAFSRWSTTRTNRKRC

SEQ ID NO: 1499625 - protein, 23 aa, Mycobacterium tuberculosis
AARGGVCVRCCSRSALDRIGDVE

SEQ ID NO: 1499626 - protein, 18 aa, Mycobacterium tuberculosis
AARGWRRRGWIVAIDRHF

SEQ ID NO: 1499627 - protein, 23 aa, Mycobacterium tuberculosis
AARLRWARRPDWGGLEVDVDVAG

SEQ ID NO: 1499628 - protein, 24 aa, Mycobacterium tuberculosis
AARLRWARRPDWGGLEVDVDVAGT

SEQ ID NO: 1499629 - protein, 27 aa, Mycobacterium tuberculosis
AARRRGRCRRAPLRQWRVRRPRRSRHG

SEQ ID NO: 1499630 - protein, 20 aa, Mycobacterium tuberculosis
AASARGSLRLSLGHTSVEAD

SEQ ID NO: 1499631 - protein, 18 aa, Mycobacterium tuberculosis
AASSSPRYIHCWTGPRPT

SEQ ID NO: 1499632 - protein, 17 aa, Mycobacterium tuberculosis
AATGMVFAVFADDDSLA

SEQ ID NO: 1499633 - protein, 18 aa, Mycobacterium tuberculosis
AATGRPLIGNGANGAPGT

SEQ ID NO: 1499634 - protein, 27 aa, Mycobacterium tuberculosis
AATPGWLEWFINWYLPISQLFYNTVGL

SEQ ID NO: 1499635 - protein, 18 aa, Mycobacterium tuberculosis
AAVGRIAYLLGLRGPAVA

SEQ ID NO: 1499636 - protein, 19 aa, Mycobacterium tuberculosis
AAVGRIAYLLGLRGPAVAV

SEQ ID NO: 1499637 - protein, 17 aa, Mycobacterium tuberculosis
AAVPVVFLTAWYGLADL

SEQ ID NO: 1499638 - protein, 18 aa, Mycobacterium tuberculosis
AAVSRLFGAYGQQFQALN

SEQ ID NO: 1499639 - protein, 17 aa, Mycobacterium tuberculosis
AAYQERFVLALSQAGST

SEQ ID NO: 1499640 - protein, 23 aa, Mycobacterium tuberculosis
AAYQQRFVLALSQAGSTYAVAEA

SEQ ID NO: 1499641 - protein, 19 aa, Mycobacterium tuberculosis
AAYQQRFVLALSQASSTYA

SEQ ID NO: 1499642 - protein, 21 aa, Mycobacterium tuberculosis
AAYQQRFVLALSQASSTYAVA

SEQ ID NO: 1499643 - protein, 20 aa, Mycobacterium tuberculosis
ACATSGWPTPAPATSGSGWW

SEQ ID NO: 1499644 - protein, 26 aa, Mycobacterium tuberculosis
ACAVGRTWCVPWWWGPGALPKSSAGH

SEQ ID NO: 1499645 - protein, 17 aa, Mycobacterium tuberculosis
ACDRGGPGLLLRAKHAV

SEQ ID NO: 1499646 - protein, 17 aa, Mycobacterium tuberculosis
ACKRLANLDLRRTQFDA

SEQ ID NO: 1499647 - protein, 18 aa, Mycobacterium tuberculosis
ACLARAGLRVRLLERLAQ

SEQ ID NO: 1499648 - protein, 20 aa, Mycobacterium tuberculosis
ACLARAGLRVRLLERLAQTG

SEQ ID NO: 1499649 - protein, 19 aa, Mycobacterium tuberculosis
ACPGPFGAPIPGFARSYQP

SEQ ID NO: 1499650 - protein, 34 aa, Mycobacterium tuberculosis
ACQRGRLGGFGGRLGFRLGFRFLFHHVTRQDLAH

SEQ ID NO: 1499651 - protein, 18 aa, Mycobacterium tuberculosis
ACVVLRVARFFVEGDDMP

SEQ ID NO: 1499652 - protein, 19 aa, Mycobacterium tuberculosis
ADAAWRGPAAVAMARAVAP

SEQ ID NO: 1499653 - protein, 18 aa, Mycobacterium tuberculosis
ADCGLEWVAVRCALIFGR

SEQ ID NO: 1499654 - protein, 18 aa, Mycobacterium tuberculosis
ADEIVRWATPVTAFQRTA

SEQ ID NO: 1499655 - protein, 18 aa, Mycobacterium tuberculosis
ADELAAWAGRIHAEVGDA

SEQ ID NO: 1499656 - protein, 26 aa, Mycobacterium tuberculosis
ADEVSARIAALFGMYGLEYQAISAQV

SEQ ID NO: 1499657 - protein, 26 aa, Mycobacterium tuberculosis
ADEVSARIAGLFGMYGLEYQAISAQV

SEQ ID NO: 1499658 - protein, 24 aa, Mycobacterium tuberculosis
ADEVSTAVAALFSQHAQGYQAAAA

SEQ ID NO: 1499659 - protein, 28 aa, Mycobacterium tuberculosis
ADEVSVAGAVPCFFGHAQAYQTLGTQAA

SEQ ID NO: 1499660 - protein, 21 aa, Mycobacterium tuberculosis
ADFAHRGWIRLAGKSVLISDS

SEQ ID NO: 1499661 - protein, 17 aa, Mycobacterium tuberculosis
ADGALRVAPAVSAAPEA

SEQ ID NO: 1499662 - protein, 18 aa, Mycobacterium tuberculosis
ADGLGLPVFFGGLRWVAP

SEQ ID NO: 1499663 - protein, 27 aa, Mycobacterium tuberculosis
ADGRQGRWWAQWCAACSAATLCDAAFS

SEQ ID NO: 1499664 - protein, 17 aa, Mycobacterium tuberculosis
ADLGAPVYFCDSRSPWQ

SEQ ID NO: 1499665 - protein, 18 aa, Mycobacterium tuberculosis
ADLLPGCAGLRVVESVYG

SEQ ID NO: 1499666 - protein, 17 aa, Mycobacterium tuberculosis
ADLTRRALLRWGAGAGA

SEQ ID NO: 1499667 - protein, 22 aa, Mycobacterium tuberculosis
ADPAGWPRLDWSMDAALLLAAL

SEQ ID NO: 1499668 - protein, 17 aa, Mycobacterium tuberculosis
ADRAVVVAARLDRAALG

SEQ ID NO: 1499669 - protein, 17 aa, Mycobacterium tuberculosis
ADRGEVHRDGRDVDGRN

SEQ ID NO: 1499670 - protein, 17 aa, Mycobacterium tuberculosis
ADRWPDKPGRYFTVRAG

SEQ ID NO: 1499671 - protein, 23 aa, Mycobacterium tuberculosis
ADSGGRWHMSFVLAMPEVLGSAA

SEQ ID NO: 1499672 - protein, 17 aa, Mycobacterium tuberculosis
ADSGLRTSVQFVGPLSV

SEQ ID NO: 1499673 - protein, 27 aa, Mycobacterium tuberculosis
ADVALIVGVPMDFRLGFGGVFGSTTQL

SEQ ID NO: 1499674 - protein, 19 aa, Mycobacterium tuberculosis
ADVKFEWHALPYLLGFKKA

SEQ ID NO: 1499675 - protein, 19 aa, Mycobacterium tuberculosis
ADVPWVLMHWRAVSADTPH

SEQ ID NO: 1499676 - protein, 20 aa, Mycobacterium tuberculosis
ADYRPACDVMLALVAQLDPG

SEQ ID NO: 1499677 - protein, 26 aa, Mycobacterium tuberculosis
AEAEIACGRASAVIAELEALTFEHPY

SEQ ID NO: 1499678 - protein, 27 aa, Mycobacterium tuberculosis
AEAEIACGRASAVIAELEALTFEHPYR

SEQ ID NO: 1499679 - protein, 20 aa, Mycobacterium tuberculosis
AEAIRRFGPIFAQYYGQSEA

SEQ ID NO: 1499680 - protein, 20 aa, Mycobacterium tuberculosis
AEARSGVDVVRLVAGDPLTV

SEQ ID NO: 1499681 - protein, 22 aa, Mycobacterium tuberculosis
AEASWVVGITWWSAVVGGFQMS

SEQ ID NO: 1499682 - protein, 21 aa, Mycobacterium tuberculosis
AEAYRAISLLLRRPPGREAYP

SEQ ID NO: 1499683 - protein, 17 aa, Mycobacterium tuberculosis
AEDIIVWSSTEFGYVTL

SEQ ID NO: 1499684 - protein, 20 aa, Mycobacterium tuberculosis
AEELWLRLGNTTSLAHGPFP

SEQ ID NO: 1499685 - protein, 21 aa, Mycobacterium tuberculosis
AEGFLPALLDWCRKNHVVFIA

SEQ ID NO: 1499686 - protein, 18 aa, Mycobacterium tuberculosis
AEHPRPDYVLLHISDTHL

SEQ ID NO: 1499687 - protein, 20 aa, Mycobacterium tuberculosis
AEIACGRASAVIAELEALTF

SEQ ID NO: 1499688 - protein, 24 aa, Mycobacterium tuberculosis
AELAPRVVATVPQLVQLAPHAVQM

SEQ ID NO: 1499689 - protein, 19 aa, Mycobacterium tuberculosis
AELCAQYLAPVLDAIKFNY

SEQ ID NO: 1499690 - protein, 17 aa, Mycobacterium tuberculosis
AELCAQYLAPVLDALKF

SEQ ID NO: 1499691 - protein, 18 aa, Mycobacterium tuberculosis
AELLRPGLLVLPVRGPAR

SEQ ID NO: 1499692 - protein, 17 aa, Mycobacterium tuberculosis
AELLVRYRVGVQAVQTV

SEQ ID NO: 1499693 - protein, 17 aa, Mycobacterium tuberculosis
AELPPGWVLTTSGRISG

SEQ ID NO: 1499694 - protein, 17 aa, Mycobacterium tuberculosis
AELQLAFQQLLVGDYNA

SEQ ID NO: 1499695 - protein, 20 aa, Mycobacterium tuberculosis
AENGRSWSRWSFIGAGAPTA

SEQ ID NO: 1499696 - protein, 21 aa, Mycobacterium tuberculosis
AEPPCAQLAALVRCVGPVEAA

SEQ ID NO: 1499697 - protein, 17 aa, Mycobacterium tuberculosis
AETGIIYIDEVDKIARK

SEQ ID NO: 1499698 - protein, 23 aa, Mycobacterium tuberculosis
AETLRPATKFSRCTRSISRGRRR

SEQ ID NO: 1499699 - protein, 20 aa, Mycobacterium tuberculosis
AEVWRRGSVIGSWLLDLTAI

SEQ ID NO: 1499700 - protein, 18 aa, Mycobacterium tuberculosis
AEYFVWFKGEYDVDDTDR

SEQ ID NO: 1499701 - protein, 18 aa, Mycobacterium tuberculosis
AFALPDCAGHPTWYEPSE

SEQ ID NO: 1499702 - protein, 17 aa, Mycobacterium tuberculosis
AFEAARVAMVDPVVVAA

SEQ ID NO: 1499703 - protein, 19 aa, Mycobacterium tuberculosis
AFERQWWKFAGVKEEAIKE

SEQ ID NO: 1499704 - protein, 18 aa, Mycobacterium tuberculosis
AFILPPSIFHWLNYSVTA

SEQ ID NO: 1499705 - protein, 21 aa, Mycobacterium tuberculosis
AFSLLLGTWGPRKRRAKRFAF

SEQ ID NO: 1499706 - protein, 24 aa, Mycobacterium tuberculosis
AGAGIANFLGFSVLHGGAGGAGGT

SEQ ID NO: 1499707 - protein, 19 aa, Mycobacterium tuberculosis
AGATAAWAIGRWTPGTERR

SEQ ID NO: 1499708 - protein, 20 aa, Mycobacterium tuberculosis
AGAVGEIWLRGTTVVRGYLG

SEQ ID NO: 1499709 - protein, 24 aa, Mycobacterium tuberculosis
AGAVVSPVWPAPRALGLRAVAATA

SEQ ID NO: 1499710 - protein, 22 aa, Mycobacterium tuberculosis
AGCLIFRIGPFFLRDNKVTVNP

SEQ ID NO: 1499711 - protein, 20 aa, Mycobacterium tuberculosis
AGDRGGAGGTGFISSDGGAG

SEQ ID NO: 1499712 - protein, 18 aa, Mycobacterium tuberculosis
AGDYGFFWITAVTTDGSI

SEQ ID NO: 1499713 - protein, 17 aa, Mycobacterium tuberculosis
AGELLPVEIPEIPEHTP

SEQ ID NO: 1499714 - protein, 17 aa, Mycobacterium tuberculosis
AGFDIASLWPVKPLLSL

SEQ ID NO: 1499715 - protein, 23 aa, Mycobacterium tuberculosis
AGFDIASLWPVKPLLSLSALETH

SEQ ID NO: 1499716 - protein, 19 aa, Mycobacterium tuberculosis
AGGAARLIGHGGAGGLGGT

SEQ ID NO: 1499717 - protein, 24 aa, Mycobacterium tuberculosis
AGGAGGRLFGNGGAGGNGGTAGQG

SEQ ID NO: 1499718 - protein, 19 aa, Mycobacterium tuberculosis
AGGAGGSVGLWGSGGAGGD

SEQ ID NO: 1499719 - protein, 17 aa, Mycobacterium tuberculosis
AGGAIVWATPDHKVLTE

SEQ ID NO: 1499720 - protein, 21 aa, Mycobacterium tuberculosis
AGGDGGLFFGVGGAGGAGGTG

SEQ ID NO: 1499721 - protein, 17 aa, Mycobacterium tuberculosis
AGGDGGLLFGSGGNGAP

SEQ ID NO: 1499722 - protein, 23 aa, Mycobacterium tuberculosis
AGGDGGWLWGNGVVGGYGGVGVP

SEQ ID NO: 1499723 - protein, 20 aa, Mycobacterium tuberculosis
AGGFTLDGLGGWFIDGVQGN

SEQ ID NO: 1499724 - protein, 18 aa, Mycobacterium tuberculosis
AGGGAFVHIATATSTGGS

SEQ ID NO: 1499725 - protein, 25 aa, Mycobacterium tuberculosis
AGGGQLVLVYAFDAHLLGGAGGVGG

SEQ ID NO: 1499726 - protein, 19 aa, Mycobacterium tuberculosis
AGGHGGWLWGNGGVGGSGG

SEQ ID NO: 1499727 - protein, 17 aa, Mycobacterium tuberculosis
AGGKAGLLIGNGGAGGA

SEQ ID NO: 1499728 - protein, 32 aa, Mycobacterium tuberculosis
AGGKGRRQPPTVWPSIPVFGCNGGDTGNAGNG

SEQ ID NO: 1499729 - protein, 24 aa, Mycobacterium tuberculosis
AGGNARLWGVGGAGGAGGKGGSGL

SEQ ID NO: 1499730 - protein, 20 aa, Mycobacterium tuberculosis
AGGNGGWLYGNGGLGGNGGA

SEQ ID NO: 1499731 - protein, 17 aa, Mycobacterium tuberculosis
AGGQGGLLFGDGGNGGA

SEQ ID NO: 1499732 - protein, 22 aa, Mycobacterium tuberculosis
AGGRGGAGGLGFGSEAPGRPGG

SEQ ID NO: 1499733 - protein, 17 aa, Mycobacterium tuberculosis
AGGRGGDAGLLFGAAGT

SEQ ID NO: 1499734 - protein, 30 aa, Mycobacterium tuberculosis
AGGSRGCAVRHPWSKRRRRLTRAPSERSRN

SEQ ID NO: 1499735 - protein, 24 aa, Mycobacterium tuberculosis
AGGTGGNAAWLLGGGGTGGAGGIG

SEQ ID NO: 1499736 - protein, 25 aa, Mycobacterium tuberculosis
AGGWGRRRRYGWGWWWRRRGGWQRG

SEQ ID NO: 1499737 - protein, 24 aa, Mycobacterium tuberculosis
AGHYTLRAAIDWQQHKHERLPCGE

SEQ ID NO: 1499738 - protein, 17 aa, Mycobacterium tuberculosis
AGIAALFSAHAQEYQAL

SEQ ID NO: 1499739 - protein, 23 aa, Mycobacterium tuberculosis
AGIGIPIAEIWGMSELSCVATAS

SEQ ID NO: 1499740 - protein, 19 aa, Mycobacterium tuberculosis
AGIRRCHRRTGAGIRCSRR

SEQ ID NO: 1499741 - protein, 17 aa, Mycobacterium tuberculosis
AGISGVYNTGALGVVTA

SEQ ID NO: 1499742 - protein, 25 aa, Mycobacterium tuberculosis
AGKRRARCSARWTAGIRCCSTGSSG

SEQ ID NO: 1499743 - protein, 19 aa, Mycobacterium tuberculosis
AGLGGCGGGAFTAGVTTGG

SEQ ID NO: 1499744 - protein, 20 aa, Mycobacterium tuberculosis
AGLRRCLRPRPAVATELDLA

SEQ ID NO: 1499745 - protein, 17 aa, Mycobacterium tuberculosis
AGLSSLAGRGDEESGEP

SEQ ID NO: 1499746 - protein, 21 aa, Mycobacterium tuberculosis
AGMMGPRWRKSACGAGSAQCG

SEQ ID NO: 1499747 - protein, 24 aa, Mycobacterium tuberculosis
AGNGGARHDQRPASAAFGGAAGGD

SEQ ID NO: 1499748 - protein, 24 aa, Mycobacterium tuberculosis
AGNPEIRPAHLLMALLTQNDGIAA

SEQ ID NO: 1499749 - protein, 18 aa, Mycobacterium tuberculosis
AGPAGSILHDGGNGGHGG

SEQ ID NO: 1499750 - protein, 19 aa, Mycobacterium tuberculosis
AGPAGSILHDGRQRAVTGG

SEQ ID NO: 1499751 - protein, 18 aa, Mycobacterium tuberculosis
AGPALACGNAFVLKPSER

SEQ ID NO: 1499752 - protein, 19 aa, Mycobacterium tuberculosis
AGPARVGGLAADAGDGGAG

SEQ ID NO: 1499753 - protein, 30 aa, Mycobacterium tuberculosis
AGPEFAAGCSTCWPPSGAGGPRPDFSDNGE

SEQ ID NO: 1499754 - protein, 20 aa, Mycobacterium tuberculosis
AGPPQRWFVVWLGTANNPVD

SEQ ID NO: 1499755 - protein, 18 aa, Mycobacterium tuberculosis
AGPRIGKGGAVVVAPVAA

SEQ ID NO: 1499756 - protein, 23 aa, Mycobacterium tuberculosis
AGSSRKAFGGDGGVGGDGASALG

SEQ ID NO: 1499757 - protein, 20 aa, Mycobacterium tuberculosis
AGSVGRRCHIAAGDVGPAGP

SEQ ID NO: 1499758 - protein, 20 aa, Mycobacterium tuberculosis
AGTGWLPGWRLTFGGEDIGW

SEQ ID NO: 1499759 - protein, 17 aa, Mycobacterium tuberculosis
AGVEYGQLLAVLPLQRM

SEQ ID NO: 1499760 - protein, 17 aa, Mycobacterium tuberculosis
AGVLRFLVLDGLAKPGR

SEQ ID NO: 1499761 - protein, 17 aa, Mycobacterium tuberculosis
AGVPAAMGTSTAGQVSI

SEQ ID NO: 1499762 - protein, 25 aa, Mycobacterium tuberculosis
AGWFGVAMILDFSWLPPEINSARIY

SEQ ID NO: 1499763 - protein, 17 aa, Mycobacterium tuberculosis
AGYLCWRGKDLATPRGW

SEQ ID NO: 1499764 - protein, 23 aa, Mycobacterium tuberculosis
AGYNGGFCGWLYGNGGARGAGGT

SEQ ID NO: 1499765 - protein, 18 aa, Mycobacterium tuberculosis
AHCLGCKVAACVVDGYRP

SEQ ID NO: 1499766 - protein, 18 aa, Mycobacterium tuberculosis
AHDLRPGTVLTPGDVRLE

SEQ ID NO: 1499767 - protein, 18 aa, Mycobacterium tuberculosis
AHGWANADLISWTFQGPN

SEQ ID NO: 1499768 - protein, 17 aa, Mycobacterium tuberculosis
AHLRAFVLIPWIAVDPT

SEQ ID NO: 1499769 - protein, 28 aa, Mycobacterium tuberculosis
AHLRHPLFLDIMRPSAPAARSASPTPAR

SEQ ID NO: 1499770 - protein, 19 aa, Mycobacterium tuberculosis
AHMWFGDLVTMTWWDDLWL

SEQ ID NO: 1499771 - protein, 17 aa, Mycobacterium tuberculosis
AHRRVWRDREPALASPR

SEQ ID NO: 1499772 - protein, 25 aa, Mycobacterium tuberculosis
AIASSARPRRHWAAQAATGGTGGYI

SEQ ID NO: 1499773 - protein, 19 aa, Mycobacterium tuberculosis
AIELARSGAKVAISDIDTD

SEQ ID NO: 1499774 - protein, 18 aa, Mycobacterium tuberculosis
AIGRGGWFIGTGGMATIG

SEQ ID NO: 1499775 - protein, 17 aa, Mycobacterium tuberculosis
AIGRHIHDPYALYDALA

SEQ ID NO: 1499776 - protein, 23 aa, Mycobacterium tuberculosis
AIIANRVSFAFGLRGPSVTIDSG

SEQ ID NO: 1499777 - protein, 17 aa, Mycobacterium tuberculosis
AIKRVLPGLGYRLTSRG

SEQ ID NO: 1499778 - protein, 22 aa, Mycobacterium tuberculosis
AIMMRFWPRCGACWPPVSWANT

SEQ ID NO: 1499779 - protein, 20 aa, Mycobacterium tuberculosis
AINPSVLWTLTPRIVSLDVE

SEQ ID NO: 1499780 - protein, 18 aa, Mycobacterium tuberculosis
AIPRGVGTAGVWRLPDRN

SEQ ID NO: 1499781 - protein, 18 aa, Mycobacterium tuberculosis
AIPRRWRNPAPLWGDTSF

SEQ ID NO: 1499782 - protein, 18 aa, Mycobacterium tuberculosis
AIPRRWRSPAPLWGDTSF

SEQ ID NO: 1499783 - protein, 19 aa, Mycobacterium tuberculosis
AIPRWPTWWLTGSATKVVA

SEQ ID NO: 1499784 - protein, 20 aa, Mycobacterium tuberculosis
AIRAFRAAYELGVGTVAVYP

SEQ ID NO: 1499785 - protein, 17 aa, Mycobacterium tuberculosis
AIRPEFSANVAIDSFTV

SEQ ID NO: 1499786 - protein, 24 aa, Mycobacterium tuberculosis
AKEVPRQTAGPAFSAVTALRAGPA

SEQ ID NO: 1499787 - protein, 18 aa, Mycobacterium tuberculosis
AKFGVEWLPAKGFITDRL

SEQ ID NO: 1499788 - protein, 18 aa, Mycobacterium tuberculosis
AKGAHGFTPTSGGDGGDG

SEQ ID NO: 1499789 - protein, 20 aa, Mycobacterium tuberculosis
AKGEMRWQFHHVIDVAPTIL

SEQ ID NO: 1499790 - protein, 18 aa, Mycobacterium tuberculosis
AKIALPGTEVWAIDGDGC

SEQ ID NO: 1499791 - protein, 17 aa, Mycobacterium tuberculosis
AKLCVQYLAPIVKNRQY

SEQ ID NO: 1499792 - protein, 22 aa, Mycobacterium tuberculosis
AKMVTAVACARVPKLTVVIGGS

SEQ ID NO: 1499793 - protein, 20 aa, Mycobacterium tuberculosis
AKPFVRWLTDLCVQLSEVER

SEQ ID NO: 1499794 - protein, 17 aa, Mycobacterium tuberculosis
AKQRGHRGLAYVLVAED

SEQ ID NO: 1499795 - protein, 18 aa, Mycobacterium tuberculosis
AKVERPDLVIGWWAAPTI

SEQ ID NO: 1499796 - protein, 23 aa, Mycobacterium tuberculosis
ALAARLPLAYALGWQSRGREADA

SEQ ID NO: 1499797 - protein, 23 aa, Mycobacterium tuberculosis
ALAAVPARAGRRSAVAADAAVAA

SEQ ID NO: 1499798 - protein, 20 aa, Mycobacterium tuberculosis
ALAGKSGFGGFGGLLLGADG

SEQ ID NO: 1499799 - protein, 21 aa, Mycobacterium tuberculosis
ALAPRARTAARALAVTAEPAG

SEQ ID NO: 1499800 - protein, 20 aa, Mycobacterium tuberculosis
ALARARRALNEFGVEGLATV

SEQ ID NO: 1499801 - protein, 18 aa, Mycobacterium tuberculosis
ALDRLRFAAGNFYVNDKP

SEQ ID NO: 1499802 - protein, 19 aa, Mycobacterium tuberculosis
ALDVARIGSSIGVANSAAA

SEQ ID NO: 1499803 - protein, 24 aa, Mycobacterium tuberculosis
ALESRTITFLKIDPAPGIGNSTTN

SEQ ID NO: 1499804 - protein, 18 aa, Mycobacterium tuberculosis
ALFRMWLRDAVGRVATGV

SEQ ID NO: 1499805 - protein, 23 aa, Mycobacterium tuberculosis
ALGCTIKLLSICERITTDEGSHT

SEQ ID NO: 1499806 - protein, 18 aa, Mycobacterium tuberculosis
ALGLLYRWVEHAFGGREH

SEQ ID NO: 1499807 - protein, 20 aa, Mycobacterium tuberculosis
ALGVTHFSVGPIIVPRIAGT

SEQ ID NO: 1499808 - protein, 17 aa, Mycobacterium tuberculosis
ALIELCGLLGYDARRDT

SEQ ID NO: 1499809 - protein, 17 aa, Mycobacterium tuberculosis
ALIGVGADEMWDIRNRG

SEQ ID NO: 1499810 - protein, 18 aa, Mycobacterium tuberculosis
ALINRVVPIPGLRSTEAQ

SEQ ID NO: 1499811 - protein, 20 aa, Mycobacterium tuberculosis
ALLDWCRKNHVVFIADEVQT

SEQ ID NO: 1499812 - protein, 19 aa, Mycobacterium tuberculosis
ALLGRPLIGDGADGTAPGQ

SEQ ID NO: 1499813 - protein, 19 aa, Mycobacterium tuberculosis
ALLGRPLIGDGAVGTASSP

SEQ ID NO: 1499814 - protein, 19 aa, Mycobacterium tuberculosis
ALLGRPLIGNGANGADGTG

SEQ ID NO: 1499815 - protein, 17 aa, Mycobacterium tuberculosis
ALLRLVGRYGIGEDDVD

SEQ ID NO: 1499816 - protein, 18 aa, Mycobacterium tuberculosis
ALLSGLLRAGRQVKDLVV

SEQ ID NO: 1499817 - protein, 18 aa, Mycobacterium tuberculosis
ALRCLKRRLARTVFQALR

SEQ ID NO: 1499818 - protein, 24 aa, Mycobacterium tuberculosis
ALSYTSPLPPLPVVAAVSVVTGLP

SEQ ID NO: 1499819 - protein, 17 aa, Mycobacterium tuberculosis
ALTRFHIFSHSWGGMLA

SEQ ID NO: 1499820 - protein, 18 aa, Mycobacterium tuberculosis
ALTSLPGVGVWTAAETTQ

SEQ ID NO: 1499821 - protein, 23 aa, Mycobacterium tuberculosis
ALTYPRRLGFGLGSSVVSLSWRT

SEQ ID NO: 1499822 - protein, 19 aa, Mycobacterium tuberculosis
ALVGPCWPAVFRGHRIGGH

SEQ ID NO: 1499823 - protein, 20 aa, Mycobacterium tuberculosis
ALVTLDWLGAHGFGQLLQHT

SEQ ID NO: 1499824 - protein, 21 aa, Mycobacterium tuberculosis
AMELGCDAVLLASAVTRAADP

SEQ ID NO: 1499825 - protein, 19 aa, Mycobacterium tuberculosis
AMFDGRFVGFADFLIRDGH

SEQ ID NO: 1499826 - protein, 23 aa, Mycobacterium tuberculosis
AMPPSSVVGLWTFDGREGRTEVP

SEQ ID NO: 1499827 - protein, 17 aa, Mycobacterium tuberculosis
AMSALPPAPPAPPGAPG

SEQ ID NO: 1499828 - protein, 24 aa, Mycobacterium tuberculosis
ANAKRWGVLHVIWRQGYYPGIGAP

SEQ ID NO: 1499829 - protein, 17 aa, Mycobacterium tuberculosis
ANCLVALAILDTVGVSP

SEQ ID NO: 1499830 - protein, 20 aa, Mycobacterium tuberculosis
ANGFRRFSGKGGPGGTGGRG

SEQ ID NO: 1499831 - protein, 20 aa, Mycobacterium tuberculosis
ANGGDAGWLIGNGGAGGSGA

SEQ ID NO: 1499832 - protein, 18 aa, Mycobacterium tuberculosis
ANGIRRIVMLTGDHPEIA

SEQ ID NO: 1499833 - protein, 17 aa, Mycobacterium tuberculosis
ANGSFAPSFVGFGGNGG

SEQ ID NO: 1499834 - protein, 17 aa, Mycobacterium tuberculosis
ANHRYLGPVLWSPDVKP

SEQ ID NO: 1499835 - protein, 17 aa, Mycobacterium tuberculosis
ANLRLVVSLAKRYTGRG

SEQ ID NO: 1499836 - protein, 23 aa, Mycobacterium tuberculosis
ANLRLVVSLAKRYTGRGMAFLDL

SEQ ID NO: 1499837 - protein, 17 aa, Mycobacterium tuberculosis
ANMSGWWNQAHTALAGA

SEQ ID NO: 1499838 - protein, 19 aa, Mycobacterium tuberculosis
ANVMPIDWYLHVRHAVGGE

SEQ ID NO: 1499839 - protein, 23 aa, Mycobacterium tuberculosis
APALRLGPRMGPLVHRPQPGDRD

SEQ ID NO: 1499840 - protein, 24 aa, Mycobacterium tuberculosis
APAPRASSAPTRAMAVRGHGAAEN

SEQ ID NO: 1499841 - protein, 20 aa, Mycobacterium tuberculosis
APARAYNPLFIWGESGLGKT

SEQ ID NO: 1499842 - protein, 17 aa, Mycobacterium tuberculosis
APDAKPYQGGHRFHQVE

SEQ ID NO: 1499843 - protein, 17 aa, Mycobacterium tuberculosis
APGALGLHAALTGAPFS

SEQ ID NO: 1499844 - protein, 21 aa, Mycobacterium tuberculosis
APGARPGPVPKPGIRTPRVGN

SEQ ID NO: 1499845 - protein, 17 aa, Mycobacterium tuberculosis
APGEFWYGNCGNGRARR

SEQ ID NO: 1499846 - protein, 17 aa, Mycobacterium tuberculosis
APGGWLIGNGGAGGSGA

SEQ ID NO: 1499847 - protein, 19 aa, Mycobacterium tuberculosis
APKGWGWVAPYIGMIWPNG

SEQ ID NO: 1499848 - protein, 25 aa, Mycobacterium tuberculosis
APLAPLPINGRPVFARKNSLIGSSS

SEQ ID NO: 1499849 - protein, 20 aa, Mycobacterium tuberculosis
APLLSLRTDRDWLADIVRFV

SEQ ID NO: 1499850 - protein, 18 aa, Mycobacterium tuberculosis
APLPAPRVSPYPAVFQDV

SEQ ID NO: 1499851 - protein, 22 aa, Mycobacterium tuberculosis
APLRAIPVIGPWGLGFVAVAVA

SEQ ID NO: 1499852 - protein, 18 aa, Mycobacterium tuberculosis
APMTLRWLTDRFAGKPLT

SEQ ID NO: 1499853 - protein, 17 aa, Mycobacterium tuberculosis
APPFFVLHGEKDPMVPS

SEQ ID NO: 1499854 - protein, 21 aa, Mycobacterium tuberculosis
APPQARRGRPAASCTTGGKGR

SEQ ID NO: 1499855 - protein, 18 aa, Mycobacterium tuberculosis
APQFEVMYLLAVCDAAAA

SEQ ID NO: 1499856 - protein, 17 aa, Mycobacterium tuberculosis
APRCQKVLEGTGFVISP

SEQ ID NO: 1499857 - protein, 18 aa, Mycobacterium tuberculosis
APRLTVWVPVAVNPGAAA

SEQ ID NO: 1499858 - protein, 20 aa, Mycobacterium tuberculosis
APRPRMLVFGAIDFAAALAR

SEQ ID NO: 1499859 - protein, 18 aa, Mycobacterium tuberculosis
APSASWMLEYYPIRELRQ

SEQ ID NO: 1499860 - protein, 29 aa, Mycobacterium tuberculosis
APSRSLPLLECWTALAALCRDTMKLRLGT

SEQ ID NO: 1499861 - protein, 21 aa, Mycobacterium tuberculosis
APTMALLRRPQIGHGADEAPG

SEQ ID NO: 1499862 - protein, 18 aa, Mycobacterium tuberculosis
APVTTFRGCWSRPSTSRP

SEQ ID NO: 1499863 - protein, 17 aa, Mycobacterium tuberculosis
APYVEWLERTAAQTKQT

SEQ ID NO: 1499864 - protein, 19 aa, Mycobacterium tuberculosis
AQDVAAMFGYHAGASAAVS

SEQ ID NO: 1499865 - protein, 24 aa, Mycobacterium tuberculosis
AQGLAELGINFGFGNIGSLNLGSG

SEQ ID NO: 1499866 - protein, 23 aa, Mycobacterium tuberculosis
AQGRHCVAVKWGLWQAPKAGEPA

SEQ ID NO: 1499867 - protein, 22 aa, Mycobacterium tuberculosis
AQHPWPPRVATLPHWPLICAGA

SEQ ID NO: 1499868 - protein, 19 aa, Mycobacterium tuberculosis
AQLLLRIGIFSWITHAPKL

SEQ ID NO: 1499869 - protein, 19 aa, Mycobacterium tuberculosis
AQLVMSNWFGLNAPLIAAV

SEQ ID NO: 1499870 - protein, 21 aa, Mycobacterium tuberculosis
AQRGQSDWVRWFQFGQRECGI

SEQ ID NO: 1499871 - protein, 22 aa, Mycobacterium tuberculosis
AQTLLSRPLIGNGANATTPGGN

SEQ ID NO: 1499872 - protein, 23 aa, Mycobacterium tuberculosis
AQVAAFHSRFVQALTAGAGAYAF

SEQ ID NO: 1499873 - protein, 23 aa, Mycobacterium tuberculosis
AQVAAYHQQFVQTLRTGAASYML

SEQ ID NO: 1499874 - protein, 23 aa, Mycobacterium tuberculosis
ARAAMALPARPTGGTGGDGATAT

SEQ ID NO: 1499875 - protein, 20 aa, Mycobacterium tuberculosis
ARAFGLPIVEVIAGGNISES

SEQ ID NO: 1499876 - protein, 22 aa, Mycobacterium tuberculosis
ARAHSWGAVGSRFGDEPTTQHR

SEQ ID NO: 1499877 - protein, 18 aa, Mycobacterium tuberculosis
ARAKAAFAEREGVNLTFL

SEQ ID NO: 1499878 - protein, 23 aa, Mycobacterium tuberculosis
ARAVARLRIAVVRAIRTALQRRG

SEQ ID NO: 1499879 - protein, 28 aa, Mycobacterium tuberculosis
ARCTRWICCWAAGLGRTGRWLACPANTG

SEQ ID NO: 1499880 - protein, 19 aa, Mycobacterium tuberculosis
ARFLLGLVVSTGVGGGLVL

SEQ ID NO: 1499881 - protein, 17 aa, Mycobacterium tuberculosis
ARFRPIFRPQFTLDGGV

SEQ ID NO: 1499882 - protein, 17 aa, Mycobacterium tuberculosis
ARGDAYWDTVVEITSIG

SEQ ID NO: 1499883 - protein, 22 aa, Mycobacterium tuberculosis
ARGDFRAALVVGDRLDTDIEGA

SEQ ID NO: 1499884 - protein, 17 aa, Mycobacterium tuberculosis
ARHLDCWVLGTVCKGGK

SEQ ID NO: 1499885 - protein, 17 aa, Mycobacterium tuberculosis
ARHRPEIPIGVNIGKTK

SEQ ID NO: 1499886 - protein, 18 aa, Mycobacterium tuberculosis
ARIGLPRVETAGVVATRI

SEQ ID NO: 1499887 - protein, 19 aa, Mycobacterium tuberculosis
ARIGLPRVETAGVVATRID

SEQ ID NO: 1499888 - protein, 17 aa, Mycobacterium tuberculosis
ARLGHRLTIAMTRWQAL

SEQ ID NO: 1499889 - protein, 18 aa, Mycobacterium tuberculosis
ARLKAVWAPQGLIHRGQG

SEQ ID NO: 1499890 - protein, 19 aa, Mycobacterium tuberculosis
ARLKGYRLICVMPENTSVE

SEQ ID NO: 1499891 - protein, 20 aa, Mycobacterium tuberculosis
ARLRLPIDVIATVPMAENMP

SEQ ID NO: 1499892 - protein, 22 aa, Mycobacterium tuberculosis
ARLSWACGLPYYSNLYTPNCTS

SEQ ID NO: 1499893 - protein, 17 aa, Mycobacterium tuberculosis
ARLTAVWIADWADDTVH

SEQ ID NO: 1499894 - protein, 20 aa, Mycobacterium tuberculosis
ARLTSLVTHNVFGQNTASIA

SEQ ID NO: 1499895 - protein, 18 aa, Mycobacterium tuberculosis
ARLVLIIAWRTYLVRDPE

SEQ ID NO: 1499896 - protein, 19 aa, Mycobacterium tuberculosis
ARMLIQFGFIERLAVAGDR

SEQ ID NO: 1499897 - protein, 19 aa, Mycobacterium tuberculosis
ARMLIQFGFIERLAVAGDW

SEQ ID NO: 1499898 - protein, 18 aa, Mycobacterium tuberculosis
ARMWARLRIHLAESGRRV

SEQ ID NO: 1499899 - protein, 20 aa, Mycobacterium tuberculosis
ARPAASDGLAADAGDGGAGG

SEQ ID NO: 1499900 - protein, 19 aa, Mycobacterium tuberculosis
ARPSWVWRPPTRGWTGCWR

SEQ ID NO: 1499901 - protein, 17 aa, Mycobacterium tuberculosis
ARPTSTWTYMVNDNPLS

SEQ ID NO: 1499902 - protein, 19 aa, Mycobacterium tuberculosis
ARQILGHRAMIVAGGSNRT

SEQ ID NO: 1499903 - protein, 19 aa, Mycobacterium tuberculosis
ARQLLDLMVHSVYSNKDPF

SEQ ID NO: 1499904 - protein, 19 aa, Mycobacterium tuberculosis
ARRAIAEFRIRGVSTNIPF

SEQ ID NO: 1499905 - protein, 18 aa, Mycobacterium tuberculosis
ARRGVILACGGFEHNEQM

SEQ ID NO: 1499906 - protein, 17 aa, Mycobacterium tuberculosis
ARRRSWRNGWQCSKNGG

SEQ ID NO: 1499907 - protein, 18 aa, Mycobacterium tuberculosis
ARRVTVVAIATVTAVTPG

SEQ ID NO: 1499908 - protein, 23 aa, Mycobacterium tuberculosis
ARSACRGLLRLLAQPKLPGPAGR

SEQ ID NO: 1499909 - protein, 18 aa, Mycobacterium tuberculosis
ARSGVDVVRLVAGDPLTV

SEQ ID NO: 1499910 - protein, 17 aa, Mycobacterium tuberculosis
ARSTGWTGLIVHGAVRD

SEQ ID NO: 1499911 - protein, 17 aa, Mycobacterium tuberculosis
ARTAGPSGTPSRTESSI

SEQ ID NO: 1499912 - protein, 19 aa, Mycobacterium tuberculosis
ARVAVRWLRAVALDRIGDV

SEQ ID NO: 1499913 - protein, 18 aa, Mycobacterium tuberculosis
ARVHPRATGIVLMLGDQP

SEQ ID NO: 1499914 - protein, 17 aa, Mycobacterium tuberculosis
ARVRCSVAWRCRAWLAA

SEQ ID NO: 1499915 - protein, 18 aa, Mycobacterium tuberculosis
ARWPVWRSVVCCSTAAKS

SEQ ID NO: 1499916 - protein, 18 aa, Mycobacterium tuberculosis
ARYGIVWGAMGAARSAWP

SEQ ID NO: 1499917 - protein, 19 aa, Mycobacterium tuberculosis
ARYLFRRVVSWGRSSNVFL

SEQ ID NO: 1499918 - protein, 23 aa, Mycobacterium tuberculosis
ASAFGGGNAFGGRGGDGGDGGDG

SEQ ID NO: 1499919 - protein, 17 aa, Mycobacterium tuberculosis
ASATLIWRRPRWARRLQ

SEQ ID NO: 1499920 - protein, 19 aa, Mycobacterium tuberculosis
ASDVARIGSSIGAANAAAA

SEQ ID NO: 1499921 - protein, 24 aa, Mycobacterium tuberculosis
ASDVARIGSSIGVANSAAAGSTTS

SEQ ID NO: 1499922 - protein, 17 aa, Mycobacterium tuberculosis
ASFGETFASGPYFKVLL

SEQ ID NO: 1499923 - protein, 19 aa, Mycobacterium tuberculosis
ASGRICWPTWPLPAPTERH

SEQ ID NO: 1499924 - protein, 17 aa, Mycobacterium tuberculosis
ASGRPLAMPRLDMVTGL

SEQ ID NO: 1499925 - protein, 17 aa, Mycobacterium tuberculosis
ASGRVAYAMGLQGPAIT

SEQ ID NO: 1499926 - protein, 19 aa, Mycobacterium tuberculosis
ASGVLPRYRGSAHGDGPPT

SEQ ID NO: 1499927 - protein, 24 aa, Mycobacterium tuberculosis
ASGVRLAIVASRWHGKICDALLDG

SEQ ID NO: 1499928 - protein, 25 aa, Mycobacterium tuberculosis
ASHCYPHFRRFLAEVVRVLRPGRYF

SEQ ID NO: 1499929 - protein, 19 aa, Mycobacterium tuberculosis
ASKNCPSVERVLATQCWPP

SEQ ID NO: 1499930 - protein, 17 aa, Mycobacterium tuberculosis
ASPRTGSGFPFRRVLHH

SEQ ID NO: 1499931 - protein, 21 aa, Mycobacterium tuberculosis
ASQRTVICWAMGLTQHAHAVA

SEQ ID NO: 1499932 - protein, 23 aa, Mycobacterium tuberculosis
ASRAKWLALFPWAVSKDESTANI

SEQ ID NO: 1499933 - protein, 17 aa, Mycobacterium tuberculosis
ASSAARCAARIVGGPRL

SEQ ID NO: 1499934 - protein, 17 aa, Mycobacterium tuberculosis
ASSAARCAARIVGGRCL

SEQ ID NO: 1499935 - protein, 21 aa, Mycobacterium tuberculosis
ASSEAARAWWGNFLAQKANEA

SEQ ID NO: 1499936 - protein, 19 aa, Mycobacterium tuberculosis
ASTACRACGLSSPNCSASQ

SEQ ID NO: 1499937 - protein, 19 aa, Mycobacterium tuberculosis
ASYLLSLRAAWQADNNIPN

SEQ ID NO: 1499938 - protein, 18 aa, Mycobacterium tuberculosis
ASYWRRWTTCKSVVLRVQ

SEQ ID NO: 1499939 - protein, 18 aa, Mycobacterium tuberculosis
ATAAFDLARIGSQVSAAS

SEQ ID NO: 1499940 - protein, 22 aa, Mycobacterium tuberculosis
ATAAFDLARIGSQVSAASAVAA

SEQ ID NO: 1499941 - protein, 18 aa, Mycobacterium tuberculosis
ATAFPWRRQSALVQWYVE

SEQ ID NO: 1499942 - protein, 21 aa, Mycobacterium tuberculosis
ATASACSARAAPAGPAGEAVP

SEQ ID NO: 1499943 - protein, 19 aa, Mycobacterium tuberculosis
ATCRARSSSDLTARRRSTP

SEQ ID NO: 1499944 - protein, 17 aa, Mycobacterium tuberculosis
ATFHDRFVQTLSATASS

SEQ ID NO: 1499945 - protein, 17 aa, Mycobacterium tuberculosis
ATFHIQFVRALTAGAGS

SEQ ID NO: 1499946 - protein, 19 aa, Mycobacterium tuberculosis
ATGACGTQAPAIWASPTWA

SEQ ID NO: 1499947 - protein, 17 aa, Mycobacterium tuberculosis
ATGRPLIGNGANGAPGT

SEQ ID NO: 1499948 - protein, 24 aa, Mycobacterium tuberculosis
ATGSTRWPSGIGWCSSLATSWATA

SEQ ID NO: 1499949 - protein, 21 aa, Mycobacterium tuberculosis
ATLLTARCPVLFAPAMHTEMW

SEQ ID NO: 1499950 - protein, 20 aa, Mycobacterium tuberculosis
ATLVGRLSVPAAWSTAAPAT

SEQ ID NO: 1499951 - protein, 24 aa, Mycobacterium tuberculosis
ATLVGRLSVPAAWSTAAPATTAGA

SEQ ID NO: 1499952 - protein, 17 aa, Mycobacterium tuberculosis
ATLYLTYWTAGDTRNRG

SEQ ID NO: 1499953 - protein, 25 aa, Mycobacterium tuberculosis
ATPGWLEWFINWYLPISQLFTTPWV

SEQ ID NO: 1499954 - protein, 23 aa, Mycobacterium tuberculosis
ATPLRPGIWRAYADHRMAMAGAI

SEQ ID NO: 1499955 - protein, 23 aa, Mycobacterium tuberculosis
ATPLRPGIWRAYADHRTAMAGAI

SEQ ID NO: 1499956 - protein, 24 aa, Mycobacterium tuberculosis
ATTCGRPFADFELRIADDGEVLLR

SEQ ID NO: 1499957 - protein, 17 aa, Mycobacterium tuberculosis
ATTRAWPASPWATPSRC

SEQ ID NO: 1499958 - protein, 17 aa, Mycobacterium tuberculosis
ATYFSGGKLQWILENVD

SEQ ID NO: 1499959 - protein, 19 aa, Mycobacterium tuberculosis
AVAPRCQRAAMAATAAILA

SEQ ID NO: 1499960 - protein, 21 aa, Mycobacterium tuberculosis
AVARLRLLWRDSPHLPTDGHG

SEQ ID NO: 1499961 - protein, 17 aa, Mycobacterium tuberculosis
AVCAAEIAAADPTVGMM

SEQ ID NO: 1499962 - protein, 22 aa, Mycobacterium tuberculosis
AVDRIWRAARHWYRPGMHPAIQ

SEQ ID NO: 1499963 - protein, 18 aa, Mycobacterium tuberculosis
AVDSLWFDALRSVAVDHR

SEQ ID NO: 1499964 - protein, 17 aa, Mycobacterium tuberculosis
AVFRCGMILADTSYAGQ

SEQ ID NO: 1499965 - protein, 24 aa, Mycobacterium tuberculosis
AVGGKGGTGGLLFGNGGAGGQGGL

SEQ ID NO: 1499966 - protein, 25 aa, Mycobacterium tuberculosis
AVGGVGGNGGWLYGNGGAGGLGGTG

SEQ ID NO: 1499967 - protein, 25 aa, Mycobacterium tuberculosis
AVLHPGCGRWRWRAPRSRVACPACC

SEQ ID NO: 1499968 - protein, 24 aa, Mycobacterium tuberculosis
AVMPVGRCQMSFVIAAPEVIAAAA

SEQ ID NO: 1499969 - protein, 27 aa, Mycobacterium tuberculosis
AVPPGSPGFCLPAFGGNGGSGGQPVET

SEQ ID NO: 1499970 - protein, 18 aa, Mycobacterium tuberculosis
AVPPWARPVRQGRPAAPE

SEQ ID NO: 1499971 - protein, 19 aa, Mycobacterium tuberculosis
AVQRIMFRDGLVLNFDDYN

SEQ ID NO: 1499972 - protein, 17 aa, Mycobacterium tuberculosis
AVRAWRSADDFPCTEHM

SEQ ID NO: 1499973 - protein, 19 aa, Mycobacterium tuberculosis
AVRDWPKPLGFVWGLDDPV

SEQ ID NO: 1499974 - protein, 17 aa, Mycobacterium tuberculosis
AVSSRAGVEIAIDDNGS

SEQ ID NO: 1499975 - protein, 18 aa, Mycobacterium tuberculosis
AVSSRAGVEIAIDDNGSG

SEQ ID NO: 1499976 - protein, 23 aa, Mycobacterium tuberculosis
AVTFCSRAAWRFVASRGAQKQAD

SEQ ID NO: 1499977 - protein, 17 aa, Mycobacterium tuberculosis
AVTMVWQREKLLQVNEI

SEQ ID NO: 1499978 - protein, 24 aa, Mycobacterium tuberculosis
AVTRARISGMPVLFWLDPYRPHEN

SEQ ID NO: 1499979 - protein, 19 aa, Mycobacterium tuberculosis
AVTRCPWRRVIGWVTKSRS

SEQ ID NO: 1499980 - protein, 19 aa, Mycobacterium tuberculosis
AVVCSLVLCSVSDPGAVLA

SEQ ID NO: 1499981 - protein, 24 aa, Mycobacterium tuberculosis
AVVGLSLPGTVAWHAVPAGSHETR

SEQ ID NO: 1499982 - protein, 25 aa, Mycobacterium tuberculosis
AVVGLSLPGTVAWHAVPRWFARNKD

SEQ ID NO: 1499983 - protein, 17 aa, Mycobacterium tuberculosis
AVVPWDFDGDGLPMSVQ

SEQ ID NO: 1499984 - protein, 18 aa, Mycobacterium tuberculosis
AVVPWDFDGDGLPMSVQL

SEQ ID NO: 1499985 - protein, 24 aa, Mycobacterium tuberculosis
AVVTRYELVPGFPRFDVDDVYLGN

SEQ ID NO: 1499986 - protein, 25 aa, Mycobacterium tuberculosis
AVVTRYELVPGFPRFDVDDVYLGNG

SEQ ID NO: 1499987 - protein, 22 aa, Mycobacterium tuberculosis
AWPANGPGWWPGEFRGAGQRIP

SEQ ID NO: 1499988 - protein, 17 aa, Mycobacterium tuberculosis
AWPASPWATPSRCSPRW

SEQ ID NO: 1499989 - protein, 21 aa, Mycobacterium tuberculosis
AWPRRRARRRFGCAWSNGTRS

SEQ ID NO: 1499990 - protein, 18 aa, Mycobacterium tuberculosis
AWRTKRLIVFDVDSTLVQ

SEQ ID NO: 1499991 - protein, 21 aa, Mycobacterium tuberculosis
AWWPACGDPGISLEERDVASG

SEQ ID NO: 1499992 - protein, 17 aa, Mycobacterium tuberculosis
AWWPARPDAPMAGVTYW

SEQ ID NO: 1499993 - protein, 19 aa, Mycobacterium tuberculosis
AYAKMVMNFGRFAMPQVGE

SEQ ID NO: 1499994 - protein, 18 aa, Mycobacterium tuberculosis
AYFRGECLRRFGADIAAA

SEQ ID NO: 1499995 - protein, 18 aa, Mycobacterium tuberculosis
AYLARAGLRVRLLERLAQ

SEQ ID NO: 1499996 - protein, 19 aa, Mycobacterium tuberculosis
AYLARAGLRVRLLERLAQT

SEQ ID NO: 1499997 - protein, 21 aa, Mycobacterium tuberculosis
AYLARAGLRVRLLERLAQTGG

SEQ ID NO: 1499998 - protein, 17 aa, Mycobacterium tuberculosis
AYPEVRAALAAAARNHD

SEQ ID NO: 1499999 - protein, 21 aa, Mycobacterium tuberculosis
AYPGHIARMFGLVYGGESRDH

SEQ ID NO: 1500000 - protein, 20 aa, Mycobacterium tuberculosis
AYPVLWRHLTAIVASVLDAI

SEQ ID NO: 1500001 - protein, 20 aa, Mycobacterium tuberculosis
AYQQRFVLALSQAGSTYAVA

SEQ ID NO: 1500002 - protein, 18 aa, Mycobacterium tuberculosis
AYRLDWPAGTIVYEIDQP

SEQ ID NO: 1500003 - protein, 19 aa, Mycobacterium tuberculosis
AYRLRWPAGTIVFEVDQPQ

SEQ ID NO: 1500004 - protein, 24 aa, Mycobacterium tuberculosis
AYRQLRYFWSRVIADTGWQLLDSK

SEQ ID NO: 1500005 - protein, 20 aa, Mycobacterium tuberculosis
AYSARAIGSMFPKYPHTSPW

SEQ ID NO: 1500006 - protein, 18 aa, Mycobacterium tuberculosis
AYSPRFLWMWPNARISVI

SEQ ID NO: 1500007 - protein, 18 aa, Mycobacterium tuberculosis
AYSRASAMASVFHRDDPE

SEQ ID NO: 1500008 - protein, 18 aa, Mycobacterium tuberculosis
CAALPRILRDNGYVTGAF

SEQ ID NO: 1500009 - protein, 19 aa, Mycobacterium tuberculosis
CAAQSWSLDRIKSVKQAAG

SEQ ID NO: 1500010 - protein, 18 aa, Mycobacterium tuberculosis
CAELLYRAGLPRALYAIV

SEQ ID NO: 1500011 - protein, 18 aa, Mycobacterium tuberculosis
CAGLRYNLFFDDRTLDGD

SEQ ID NO: 1500012 - protein, 19 aa, Mycobacterium tuberculosis
CARCARCARGWHDQGRHVW

SEQ ID NO: 1500013 - protein, 19 aa, Mycobacterium tuberculosis
CARCRWPRWCRPTEDGVRP

SEQ ID NO: 1500014 - protein, 20 aa, Mycobacterium tuberculosis
CATYPVLAVQAWAAFHDMTL

SEQ ID NO: 1500015 - protein, 18 aa, Mycobacterium tuberculosis
CEPVCPVEAIFYEDDVPE

SEQ ID NO: 1500016 - protein, 26 aa, Mycobacterium tuberculosis
CERCSGRLRKLFNAVGVVFKGTGFYR

SEQ ID NO: 1500017 - protein, 18 aa, Mycobacterium tuberculosis
CFRCPQCTERLRASDDLL

SEQ ID NO: 1500018 - protein, 17 aa, Mycobacterium tuberculosis
CGAGWRPGLGRLHRRAA

SEQ ID NO: 1500019 - protein, 17 aa, Mycobacterium tuberculosis
CGARWPVWRSVVCCSTA

SEQ ID NO: 1500020 - protein, 24 aa, Mycobacterium tuberculosis
CGKYKRVRFKGIICERCGVEVTRA

SEQ ID NO: 1500021 - protein, 22 aa, Mycobacterium tuberculosis
CGLPKLMALELFKPFVMKRLVD

SEQ ID NO: 1500022 - protein, 18 aa, Mycobacterium tuberculosis
CGNGSWLSGHTVISQSRN

SEQ ID NO: 1500023 - protein, 17 aa, Mycobacterium tuberculosis
CGPPGMLEAVRVARNQH

SEQ ID NO: 1500024 - protein, 29 aa, Mycobacterium tuberculosis
CGTGGYRRRLWRWWLAARATASPADTGGR

SEQ ID NO: 1500025 - protein, 19 aa, Mycobacterium tuberculosis
CINCMLCYSACPVYALDPD

SEQ ID NO: 1500026 - protein, 17 aa, Mycobacterium tuberculosis
CKALLAALPQRLGEYRR

SEQ ID NO: 1500027 - protein, 18 aa, Mycobacterium tuberculosis
CLDIDWVIGGCMSVDPTH

SEQ ID NO: 1500028 - protein, 20 aa, Mycobacterium tuberculosis
CLWWRPALRVRGSPISTACA

SEQ ID NO: 1500029 - protein, 18 aa, Mycobacterium tuberculosis
CNIEHGCVVARAETLRGA

SEQ ID NO: 1500030 - protein, 18 aa, Mycobacterium tuberculosis
CPCLTVCANWRCQHKLLV

SEQ ID NO: 1500031 - protein, 18 aa, Mycobacterium tuberculosis
CPGQHGWRAPAAAAPPLD

SEQ ID NO: 1500032 - protein, 20 aa, Mycobacterium tuberculosis
CPPGCWAHGRDRGGPEAPAH

SEQ ID NO: 1500033 - protein, 24 aa, Mycobacterium tuberculosis
CPQRQRRRPCGNGRQRSVSAACAV

SEQ ID NO: 1500034 - protein, 17 aa, Mycobacterium tuberculosis
CPTPVCHAVTWRSGGTG

SEQ ID NO: 1500035 - protein, 23 aa, Mycobacterium tuberculosis
CPTRRWICSPIWLTPASWKLRRE

SEQ ID NO: 1500036 - protein, 19 aa, Mycobacterium tuberculosis
CPWMPSGEENSGAQQYQPG

SEQ ID NO: 1500037 - protein, 18 aa, Mycobacterium tuberculosis
CQGRLGATPARGRADRQT

SEQ ID NO: 1500038 - protein, 17 aa, Mycobacterium tuberculosis
CQLVCPGSGIAEGAVNA

SEQ ID NO: 1500039 - protein, 22 aa, Mycobacterium tuberculosis
CQPGWPGWPGWPGAPSGPNWPR

SEQ ID NO: 1500040 - protein, 19 aa, Mycobacterium tuberculosis
CRAYRLGWQPGTTVFEIDV

SEQ ID NO: 1500041 - protein, 18 aa, Mycobacterium tuberculosis
CRPVGQSRRERGPAMEYL

SEQ ID NO: 1500042 - protein, 19 aa, Mycobacterium tuberculosis
CRQCRHAGCRAGRYAAGAA

SEQ ID NO: 1500043 - protein, 22 aa, Mycobacterium tuberculosis
CRRLADQAVRQWGFMQGLKQKL

SEQ ID NO: 1500044 - protein, 20 aa, Mycobacterium tuberculosis
CRSTRWWRRSPPAVAVPHPL

SEQ ID NO: 1500045 - protein, 18 aa, Mycobacterium tuberculosis
CRTPTIAAVQGWCIGDAV

SEQ ID NO: 1500046 - protein, 18 aa, Mycobacterium tuberculosis
CRYPICRTPGYALGGPGP

SEQ ID NO: 1500047 - protein, 18 aa, Mycobacterium tuberculosis
CSAFEAWFVSAALDDAAF

SEQ ID NO: 1500048 - protein, 17 aa, Mycobacterium tuberculosis
CSARTAAQFGIEPRVAM

SEQ ID NO: 1500049 - protein, 20 aa, Mycobacterium tuberculosis
CSRLFEVFNGPPLGDFGNRP

SEQ ID NO: 1500050 - protein, 18 aa, Mycobacterium tuberculosis
CSVPGAWPPVTIAGRRYM

SEQ ID NO: 1500051 - protein, 23 aa, Mycobacterium tuberculosis
CTTSGCGRWRWRAPRSRVACPAC

SEQ ID NO: 1500052 - protein, 18 aa, Mycobacterium tuberculosis
CYHLYPAHAAFGGYKQSG

SEQ ID NO: 1500053 - protein, 20 aa, Mycobacterium tuberculosis
DAAGLLARWQRWLMGLASAA

SEQ ID NO: 1500054 - protein, 19 aa, Mycobacterium tuberculosis
DAARLTAVWIADWADDTVH

SEQ ID NO: 1500055 - protein, 20 aa, Mycobacterium tuberculosis
DAARLTAVWIADWADNTVHL

SEQ ID NO: 1500056 - protein, 22 aa, Mycobacterium tuberculosis
DAGLRLARRFAHLTYRGEIELD

SEQ ID NO: 1500057 - protein, 21 aa, Mycobacterium tuberculosis
DAHGVPFLGIRGMSDGPGDPL

SEQ ID NO: 1500058 - protein, 22 aa, Mycobacterium tuberculosis
DAIRHAVAWARPGDVVLIAGKG

SEQ ID NO: 1500059 - protein, 19 aa, Mycobacterium tuberculosis
DAITLFPGGLTFPANSLLN

SEQ ID NO: 1500060 - protein, 22 aa, Mycobacterium tuberculosis
DAKWASSISGYWRRGRTEEMFR

SEQ ID NO: 1500061 - protein, 23 aa, Mycobacterium tuberculosis
DALELRGRILGAFEAAEVSTDHA

SEQ ID NO: 1500062 - protein, 17 aa, Mycobacterium tuberculosis
DALMKITHVLRGGGPAA

SEQ ID NO: 1500063 - protein, 17 aa, Mycobacterium tuberculosis
DAQCTTMSWPQRADHAA

SEQ ID NO: 1500064 - protein, 18 aa, Mycobacterium tuberculosis
DARCAPGGLPVCQSGPSY

SEQ ID NO: 1500065 - protein, 17 aa, Mycobacterium tuberculosis
DAVWRWIDWPERRGRTD

SEQ ID NO: 1500066 - protein, 19 aa, Mycobacterium tuberculosis
DCELDWWLGFSSAASLLGS

SEQ ID NO: 1500067 - protein, 21 aa, Mycobacterium tuberculosis
DCIQVLGGIGCTWEHDAHLYL

SEQ ID NO: 1500068 - protein, 24 aa, Mycobacterium tuberculosis
DCIQVLGGIGCTWGARRAFVSAPE

SEQ ID NO: 1500069 - protein, 17 aa, Mycobacterium tuberculosis
DDGRWRIVGNIPRGMFV

SEQ ID NO: 1500070 - protein, 19 aa, Mycobacterium tuberculosis
DDKAELVVPAGPVATADNS

SEQ ID NO: 1500071 - protein, 17 aa, Mycobacterium tuberculosis
DDVARSFADAGLDSVLS

SEQ ID NO: 1500072 - protein, 24 aa, Mycobacterium tuberculosis
DDYLRVIGVPAMFAAGDVAAARMD

SEQ ID NO: 1500073 - protein, 21 aa, Mycobacterium tuberculosis
DEFTTRFGVARVCEFYAASEG

SEQ ID NO: 1500074 - protein, 17 aa, Mycobacterium tuberculosis
DEIRWSLDLLRRRFAKV

SEQ ID NO: 1500075 - protein, 22 aa, Mycobacterium tuberculosis
DEISAAIAALFGAHGRAYQAAS

SEQ ID NO: 1500076 - protein, 23 aa, Mycobacterium tuberculosis
DELKARFSRPLAFGTAGLRGHLR

SEQ ID NO: 1500077 - protein, 21 aa, Mycobacterium tuberculosis
DELRSLLRFVLDLLADYGLTD

SEQ ID NO: 1500078 - protein, 23 aa, Mycobacterium tuberculosis
DERGRRFLIHTARIAYVEIGVAD

SEQ ID NO: 1500079 - protein, 23 aa, Mycobacterium tuberculosis
DEVSAAVAALFGSYAQSYQAFGA

SEQ ID NO: 1500080 - protein, 17 aa, Mycobacterium tuberculosis
DEVSAHIAALFSGHGEG

SEQ ID NO: 1500081 - protein, 21 aa, Mycobacterium tuberculosis
DEVSAHIAALFSGHGEGYQAI

SEQ ID NO: 1500082 - protein, 17 aa, Mycobacterium tuberculosis
DEVSVAISALFGSHAQG

SEQ ID NO: 1500083 - protein, 18 aa, Mycobacterium tuberculosis
DFAKAFWNVVNWADVQSR

SEQ ID NO: 1500084 - protein, 17 aa, Mycobacterium tuberculosis
DFGELRWRDGVAVTVVL

SEQ ID NO: 1500085 - protein, 17 aa, Mycobacterium tuberculosis
DFGKRWVTECLRAAYPL

SEQ ID NO: 1500086 - protein, 18 aa, Mycobacterium tuberculosis
DFGLRLARWQGLGILGPV

SEQ ID NO: 1500087 - protein, 19 aa, Mycobacterium tuberculosis
DFMGCCAVAVLAHKAERCR

SEQ ID NO: 1500088 - protein, 18 aa, Mycobacterium tuberculosis
DFMGCCTVAVLAHEAERC

SEQ ID NO: 1500089 - protein, 18 aa, Mycobacterium tuberculosis
DFVGALIYLLSDALELLH

SEQ ID NO: 1500090 - protein, 17 aa, Mycobacterium tuberculosis
DFVKLAEALGCVGLRCE

SEQ ID NO: 1500091 - protein, 17 aa, Mycobacterium tuberculosis
DGARFYFELNLAGVADE

SEQ ID NO: 1500092 - protein, 25 aa, Mycobacterium tuberculosis
DGEFVKFGPSWAWPKPVQPHIPVLV

SEQ ID NO: 1500093 - protein, 20 aa, Mycobacterium tuberculosis
DGGAGGWLFGNGGNGGQGTI

SEQ ID NO: 1500094 - protein, 17 aa, Mycobacterium tuberculosis
DGGCRRVWRRYRRQRWC

SEQ ID NO: 1500095 - protein, 24 aa, Mycobacterium tuberculosis
DGGDGGWGRPGGQGGFGSTSGAHG

SEQ ID NO: 1500096 - protein, 24 aa, Mycobacterium tuberculosis
DGGNGATGTWGHNLGAGGTGGNGG

SEQ ID NO: 1500097 - protein, 19 aa, Mycobacterium tuberculosis
DGIPGAFLGGGRGGDGVFF

SEQ ID NO: 1500098 - protein, 18 aa, Mycobacterium tuberculosis
DGKAKWSAPLGFLAQTPP

SEQ ID NO: 1500099 - protein, 18 aa, Mycobacterium tuberculosis
DGLNRVSAILARDKDNLG

SEQ ID NO: 1500100 - protein, 19 aa, Mycobacterium tuberculosis
DGLRRGGCVVVGHQLDAVA

SEQ ID NO: 1500101 - protein, 17 aa, Mycobacterium tuberculosis
DGLRWSTTEQLGYNRRY

SEQ ID NO: 1500102 - protein, 17 aa, Mycobacterium tuberculosis
DGLRYLDWLAAYSAVNL

SEQ ID NO: 1500103 - protein, 24 aa, Mycobacterium tuberculosis
DGNKRRRQTCVSRAGAADDLLAGA

SEQ ID NO: 1500104 - protein, 20 aa, Mycobacterium tuberculosis
DGRLPFDLRLAVLSNGSVIL

SEQ ID NO: 1500105 - protein, 30 aa, Mycobacterium tuberculosis
DGRVDCGQRLLLRGVQRVGAGRGVGAVQTQ

SEQ ID NO: 1500106 - protein, 18 aa, Mycobacterium tuberculosis
DGRWHWHWDPAMMTAPGH

SEQ ID NO: 1500107 - protein, 19 aa, Mycobacterium tuberculosis
DGTAMDRFRWLVAAQGGDL

SEQ ID NO: 1500108 - protein, 23 aa, Mycobacterium tuberculosis
DGVFEGIAVLGLGFGGAAGAGGA

SEQ ID NO: 1500109 - protein, 25 aa, Mycobacterium tuberculosis
DGVVWWQVVLQLPLLPGWPSSPSSP

SEQ ID NO: 1500110 - protein, 30 aa, Mycobacterium tuberculosis; identical to SEQ ID NO: 1471464

SEQ ID NO: 1500111 - protein, 17 aa, Mycobacterium tuberculosis
DGWLLRAGHGAVLAANS

SEQ ID NO: 1500112 - protein, 20 aa, Mycobacterium tuberculosis
DHAAICWPLLVGMAKAKYYL

SEQ ID NO: 1500113 - protein, 18 aa, Mycobacterium tuberculosis
DHARLDFLAGLRVVPAEL

SEQ ID NO: 1500114 - protein, 18 aa, Mycobacterium tuberculosis
DHQMGFGGFNSGSGNIGF

SEQ ID NO: 1500115 - protein, 23 aa, Mycobacterium tuberculosis
DIDRFGRRFGCVVMDGFGSTEGY

SEQ ID NO: 1500116 - protein, 17 aa, Mycobacterium tuberculosis
DIGCGWGATMRRAIAQY

SEQ ID NO: 1500117 - protein, 19 aa, Mycobacterium tuberculosis
DILFFWVARMMMFGTFVGD

SEQ ID NO: 1500118 - protein, 24 aa, Mycobacterium tuberculosis
DINKYGAFCWSRCPSWPTRWTRNH

SEQ ID NO: 1500119 - protein, 17 aa, Mycobacterium tuberculosis
DIRCCILTGAGGYFCAG

SEQ ID NO: 1500120 - protein, 20 aa, Mycobacterium tuberculosis
DIVSWNWTELPSALGVTNHL

SEQ ID NO: 1500121 - protein, 23 aa, Mycobacterium tuberculosis
DIWRRPDLAPGRRAPVLIQVPGG

SEQ ID NO: 1500122 - protein, 21 aa, Mycobacterium tuberculosis
DIYRCHPALWSLDTTPERLFL

SEQ ID NO: 1500123 - protein, 22 aa, Mycobacterium tuberculosis
DKALEGFTMFALNQGEVCTCPS

SEQ ID NO: 1500124 - protein, 24 aa, Mycobacterium tuberculosis
DLADPAVVWALRLQGRVPHVVAQS

SEQ ID NO: 1500125 - protein, 19 aa, Mycobacterium tuberculosis
DLAELLAMRGIDGLPFSWT

SEQ ID NO: 1500126 - protein, 27 aa, Mycobacterium tuberculosis
DLAERVGWRWRLVWYRAVAELLTGDYD

SEQ ID NO: 1500127 - protein, 17 aa, Mycobacterium tuberculosis
DLFWALRGGGGGNFGVT

SEQ ID NO: 1500128 - protein, 19 aa, Mycobacterium tuberculosis
DLGDRFGFCIPDLAVWDNP

SEQ ID NO: 1500129 - protein, 17 aa, Mycobacterium tuberculosis
DLKLCSSMTLFARATDA

SEQ ID NO: 1500130 - protein, 17 aa, Mycobacterium tuberculosis
DLKRIGASLAHENASAA

SEQ ID NO: 1500131 - protein, 20 aa, Mycobacterium tuberculosis
DLLMCRAEVAPILLGAIADA

SEQ ID NO: 1500132 - protein, 17 aa, Mycobacterium tuberculosis
DLLPGCAGLRVVESVYG

SEQ ID NO: 1500133 - protein, 26 aa, Mycobacterium tuberculosis
DLPPRWFAGWSRLGLRTSLRYKVPRM

SEQ ID NO: 1500134 - protein, 22 aa, Mycobacterium tuberculosis
DLRAGLPDGEFFGVIAQLPGAS

SEQ ID NO: 1500135 - protein, 22 aa, Mycobacterium tuberculosis
DLRDDWPAALIAAGFDGTQPTA

SEQ ID NO: 1500136 - protein, 18 aa, Mycobacterium tuberculosis
DLRQDWPAALRDAGFDPT

SEQ ID NO: 1500137 - protein, 19 aa, Mycobacterium tuberculosis
DLVPRLRFGDIVRVGSADE

SEQ ID NO: 1500138 - protein, 23 aa, Mycobacterium tuberculosis
DLVRRYAPKLALIVTSHQHFDHW

SEQ ID NO: 1500139 - protein, 22 aa, Mycobacterium tuberculosis
DLVWDFRLPRVVSINVSGHKYG

SEQ ID NO: 1500140 - protein, 21 aa, Mycobacterium tuberculosis
DNEFRVVLARRGQHWVSAVRV

SEQ ID NO: 1500141 - protein, 17 aa, Mycobacterium tuberculosis
DNLRAAFAWSRENDHIT

SEQ ID NO: 1500142 - protein, 21 aa, Mycobacterium tuberculosis
DNLRAAFAWSRENGHITEALQ

SEQ ID NO: 1500143 - protein, 17 aa, Mycobacterium tuberculosis
DNLRAAFVWNRENSDTE

SEQ ID NO: 1500144 - protein, 18 aa, Mycobacterium tuberculosis
DPGCCPMVARGLRDRGRT

SEQ ID NO: 1500145 - protein, 22 aa, Mycobacterium tuberculosis
DPGSVSYLFSRKGVVTLEKNGL

SEQ ID NO: 1500146 - protein, 19 aa, Mycobacterium tuberculosis
DPKKAVVFDDRWAQRPRGP

SEQ ID NO: 1500147 - protein, 17 aa, Mycobacterium tuberculosis
DPKRPSGSFIFAGPSGV

SEQ ID NO: 1500148 - protein, 18 aa, Mycobacterium tuberculosis
DPKTRWALRVDVDGDLVL

SEQ ID NO: 1500149 - protein, 19 aa, Mycobacterium tuberculosis
DPPPSVGVFARFVAAQRCA

SEQ ID NO: 1500150 - protein, 21 aa, Mycobacterium tuberculosis
DPPVEGGWAWLPDEAQGARVH

SEQ ID NO: 1500151 - protein, 21 aa, Mycobacterium tuberculosis
DPTCWSSSRSRSWRNTTPTKS

SEQ ID NO: 1500152 - protein, 21 aa, Mycobacterium tuberculosis
DPTEGRGFGGLGGAGGAGGKG

SEQ ID NO: 1500153 - protein, 18 aa, Mycobacterium tuberculosis
DPVAGVWAVGGVGGDGGS

SEQ ID NO: 1500154 - protein, 22 aa, Mycobacterium tuberculosis
DQRVLGAALWYAATVKDAVIVA

SEQ ID NO: 1500155 - protein, 23 aa, Mycobacterium tuberculosis
DRARRAGGMSGIGAYGGAGGAGG

SEQ ID NO: 1500156 - protein, 19 aa, Mycobacterium tuberculosis
DRFLLGIGVGHAEMISEYR

SEQ ID NO: 1500157 - protein, 20 aa, Mycobacterium tuberculosis
DRLAAELAVAASSFGSVTSG

SEQ ID NO: 1500158 - protein, 21 aa, Mycobacterium tuberculosis
DRLAAELAVAASSFGSVTSGL

SEQ ID NO: 1500159 - protein, 17 aa, Mycobacterium tuberculosis
DRRRFGLSLTIHEDACR

SEQ ID NO: 1500160 - protein, 18 aa, Mycobacterium tuberculosis
DRWSRGRVALVGDAGYCC

SEQ ID NO: 1500161 - protein, 20 aa, Mycobacterium tuberculosis
DRYLPVLADLRMRYLDDGDW

SEQ ID NO: 1500162 - protein, 22 aa, Mycobacterium tuberculosis
DSPEALPLLFGHIGEGNLHLNV

SEQ ID NO: 1500163 - protein, 24 aa, Mycobacterium tuberculosis
DSRWRCGWPRFALAPKQQLIARLI

SEQ ID NO: 1500164 - protein, 18 aa, Mycobacterium tuberculosis
DVFAHWRRAQGLPVSAIA

SEQ ID NO: 1500165 - protein, 23 aa, Mycobacterium tuberculosis
DVGGGVWPLGFGRFADAGAGGNE

SEQ ID NO: 1500166 - protein, 20 aa, Mycobacterium tuberculosis
DVINAPALALLGRPLIGNGA

SEQ ID NO: 1500167 - protein, 19 aa, Mycobacterium tuberculosis
DVIRYLRWFTFLSADELAE

SEQ ID NO: 1500168 - protein, 17 aa, Mycobacterium tuberculosis
DVLRCYLDLVLDGLLAR

SEQ ID NO: 1500169 - protein, 19 aa, Mycobacterium tuberculosis
DVMPLDWYLHVRHAVHGDI

SEQ ID NO: 1500170 - protein, 19 aa, Mycobacterium tuberculosis
DVPSLGWRVYRLVPRRRGA

SEQ ID NO: 1500171 - protein, 21 aa, Mycobacterium tuberculosis
DVRASGLLPRWEQTQRFIGEM

SEQ ID NO: 1500172 - protein, 23 aa, Mycobacterium tuberculosis
DVSARFRGALGLGGQGGNGGAGG

SEQ ID NO: 1500173 - protein, 17 aa, Mycobacterium tuberculosis
DVSIRWQLKQAAAPELF

SEQ ID NO: 1500174 - protein, 24 aa, Mycobacterium tuberculosis
DVTLRPAQYLPWHPCRCAQVFVGE

SEQ ID NO: 1500175 - protein, 23 aa, Mycobacterium tuberculosis
DWAEMLMRMYIRWAEQHKYPVEV

SEQ ID NO: 1500176 - protein, 23 aa, Mycobacterium tuberculosis
DWIPRLATMGVIASYCLTEPGAG

SEQ ID NO: 1500177 - protein, 17 aa, Mycobacterium tuberculosis
DWNALNLFTGWVDVGLT

SEQ ID NO: 1500178 - protein, 19 aa, Mycobacterium tuberculosis
DYFKLGYRGARFAFGYGAC

SEQ ID NO: 1500179 - protein, 22 aa, Mycobacterium tuberculosis
DYWSARFCPGRVFASPADFNAQ

SEQ ID NO: 1500180 - protein, 21 aa, Mycobacterium tuberculosis
EAAGACGWVPTAIPARFLSAI

SEQ ID NO: 1500181 - protein, 18 aa, Mycobacterium tuberculosis
EAEGLRYRSVLGLADLGL

SEQ ID NO: 1500182 - protein, 20 aa, Mycobacterium tuberculosis
EAEPAAWLRFWFPDPNGSNT

SEQ ID NO: 1500183 - protein, 17 aa, Mycobacterium tuberculosis
EAGMMWREVYRLRQPVL

SEQ ID NO: 1500184 - protein, 24 aa, Mycobacterium tuberculosis
EANLRLVVSLAKRYTGRGMAFLDL

SEQ ID NO: 1500185 - protein, 19 aa, Mycobacterium tuberculosis
EANRWPDKPGRYFTVRAGS

SEQ ID NO: 1500186 - protein, 17 aa, Mycobacterium tuberculosis
EAPADAPVVGWAVLVGP

SEQ ID NO: 1500187 - protein, 24 aa, Mycobacterium tuberculosis
EARARPGRRAVRLVPPTRHRRTEV

SEQ ID NO: 1500188 - protein, 24 aa, Mycobacterium tuberculosis
EARSVRSPGRWAAIPRWPTWWLTG

SEQ ID NO: 1500189 - protein, 17 aa, Mycobacterium tuberculosis
EATNFWPLCSRLFEVFN

SEQ ID NO: 1500190 - protein, 17 aa, Mycobacterium tuberculosis
ECCRLRKVVPLGKDAAW

SEQ ID NO: 1500191 - protein, 17 aa, Mycobacterium tuberculosis
ECPAPGVMQGCLESTSG

SEQ ID NO: 1500192 - protein, 17 aa, Mycobacterium tuberculosis
ECRHVSAKWVGRCLECG

SEQ ID NO: 1500193 - protein, 18 aa, Mycobacterium tuberculosis
EDEIAIAIGVAGQDHGVT

SEQ ID NO: 1500194 - protein, 25 aa, Mycobacterium tuberculosis
EDFWRSAGLPAYRWPDPNGTRFPNG

SEQ ID NO: 1500195 - protein, 24 aa, Mycobacterium tuberculosis
EDIIRFQAEFLWRDYFQPGVSIDG

SEQ ID NO: 1500196 - protein, 21 aa, Mycobacterium tuberculosis
EDPRVAGLIARVQLPPSPAGA

SEQ ID NO: 1500197 - protein, 19 aa, Mycobacterium tuberculosis
EDRLRTRFEWGLITDVQPP

SEQ ID NO: 1500198 - protein, 24 aa, Mycobacterium tuberculosis
EDYFKLGYRGARFAFGYGACPDLE

SEQ ID NO: 1500199 - protein, 17 aa, Mycobacterium tuberculosis
EELWLRLGNTTSLAHGP

SEQ ID NO: 1500200 - protein, 19 aa, Mycobacterium tuberculosis
EEVAGFLADYGWRLTEQAG

SEQ ID NO: 1500201 - protein, 23 aa, Mycobacterium tuberculosis
EEVAGFLADYGWRLTEQAGPEEL

SEQ ID NO: 1500202 - protein, 19 aa, Mycobacterium tuberculosis
EEYWWAAEQMLTWPDPDKS

SEQ ID NO: 1500203 - protein, 19 aa, Mycobacterium tuberculosis
EGDDVFVALSWTKHPPPQT

SEQ ID NO: 1500204 - protein, 20 aa, Mycobacterium tuberculosis
EGGASGDVWGECGDVDLRNG

SEQ ID NO: 1500205 - protein, 21 aa, Mycobacterium tuberculosis
EGGGAGFGSGVAGAAGAGGNG

SEQ ID NO: 1500206 - protein, 17 aa, Mycobacterium tuberculosis
EGGPCWSMRLNAVEPPK

SEQ ID NO: 1500207 - protein, 23 aa, Mycobacterium tuberculosis
EGHPGHGPRYLWTRTVAGRGTKG

SEQ ID NO: 1500208 - protein, 21 aa, Mycobacterium tuberculosis
EGHSMFPWLTLALVGNSTSSI

SEQ ID NO: 1500209 - protein, 20 aa, Mycobacterium tuberculosis
EGMARAWGPVRVAIAAEQAH

SEQ ID NO: 1500210 - protein, 19 aa, Mycobacterium tuberculosis
EGRAVGLAQRWGSRNPIPW

SEQ ID NO: 1500211 - protein, 19 aa, Mycobacterium tuberculosis
EGTVIRWLKKIGDSVQVDE

SEQ ID NO: 1500212 - protein, 17 aa, Mycobacterium tuberculosis
EGVACYQLFISGLLDVT

SEQ ID NO: 1500213 - protein, 18 aa, Mycobacterium tuberculosis
EGVLDVINAPALALLGRP

SEQ ID NO: 1500214 - protein, 18 aa, Mycobacterium tuberculosis
EGVVSLGLYSRIFRNNIL

SEQ ID NO: 1500215 - protein, 18 aa, Mycobacterium tuberculosis
EGWAFEYSRFQEAQKREI

SEQ ID NO: 1500216 - protein, 24 aa, Mycobacterium tuberculosis
EHACSLGLLARAHCGVLYVDEVNL

SEQ ID NO: 1500217 - protein, 22 aa, Mycobacterium tuberculosis
EHPKMPLVPLIDGWETVVEMEA

SEQ ID NO: 1500218 - protein, 19 aa, Mycobacterium tuberculosis
EIDNLRAAFAFSRENGDTG

SEQ ID NO: 1500219 - protein, 23 aa, Mycobacterium tuberculosis
EIDNLRAAFTWSRGNGDIAAALQ

SEQ ID NO: 1500220 - protein, 18 aa, Mycobacterium tuberculosis
EIDSLRMYLGAGSAPMLQ

SEQ ID NO: 1500221 - protein, 20 aa, Mycobacterium tuberculosis
EINLRFVLGYTPLEFRDTLH

SEQ ID NO: 1500222 - protein, 22 aa, Mycobacterium tuberculosis
EIYPVLCGSAFKNKGVQPMLDA

SEQ ID NO: 1500223 - protein, 17 aa, Mycobacterium tuberculosis
EIYRAPLSYPYRDGLLD

SEQ ID NO: 1500224 - protein, 19 aa, Mycobacterium tuberculosis
EKRPRLTMFDDFGGRIPSD

SEQ ID NO: 1500225 - protein, 23 aa, Mycobacterium tuberculosis
ELDELRCRRARWVRARKEPIRTS

SEQ ID NO: 1500226 - protein, 18 aa, Mycobacterium tuberculosis
ELEAMPDLVARVIAATGP

SEQ ID NO: 1500227 - protein, 18 aa, Mycobacterium tuberculosis
ELGHPWTVLRATRRTDYL

SEQ ID NO: 1500228 - protein, 20 aa, Mycobacterium tuberculosis
ELHCAAMSFGSVTSGLVVGW

SEQ ID NO: 1500229 - protein, 17 aa, Mycobacterium tuberculosis
ELIRLLLNRALTTAGDD

SEQ ID NO: 1500230 - protein, 17 aa, Mycobacterium tuberculosis
ELLKEVWGPAYATETHY

SEQ ID NO: 1500231 - protein, 25 aa, Mycobacterium tuberculosis
ELPAWYRPNPGLARDLAFIAFSSAD

SEQ ID NO: 1500232 - protein, 20 aa, Mycobacterium tuberculosis
ELPMSLMRCARGFRRWANPP

SEQ ID NO: 1500233 - protein, 18 aa, Mycobacterium tuberculosis
ELPTRVLLISAHDEPAIV

SEQ ID NO: 1500234 - protein, 22 aa, Mycobacterium tuberculosis
ELRARFNLRYPLAHLRPFLSTH

SEQ ID NO: 1500235 - protein, 19 aa, Mycobacterium tuberculosis
ELVRRLSVVHGRVTLSSGR

SEQ ID NO: 1500236 - protein, 18 aa, Mycobacterium tuberculosis
ELYLPRFLFGVFLSEQMI

SEQ ID NO: 1500237 - protein, 20 aa, Mycobacterium tuberculosis
EMMATAAFDLARIGSQVSAA

SEQ ID NO: 1500238 - protein, 17 aa, Mycobacterium tuberculosis
EMPRVLRLCAARTGAEL

SEQ ID NO: 1500239 - protein, 17 aa, Mycobacterium tuberculosis
ENLSWSAPRLHLVDLQY

SEQ ID NO: 1500240 - protein, 26 aa, Mycobacterium tuberculosis
EPAARAGPAVSRWPPRARTAARALAV

SEQ ID NO: 1500241 - protein, 20 aa, Mycobacterium tuberculosis
EPAPHVKPAALAEQPGVPGQ

SEQ ID NO: 1500242 - protein, 18 aa, Mycobacterium tuberculosis
EPFSRWASLLIHAGEPGA

SEQ ID NO: 1500243 - protein, 26 aa, Mycobacterium tuberculosis
EPGGAGGRGGLLIGDGGAGGAGGVGG

SEQ ID NO: 1500244 - protein, 24 aa, Mycobacterium tuberculosis
EPLMPPAMALPPWPPTPPAPPANP

SEQ ID NO: 1500245 - protein, 25 aa, Mycobacterium tuberculosis
EPLPRAHGGPVRMVVPGFIGARSVK

SEQ ID NO: 1500246 - protein, 22 aa, Mycobacterium tuberculosis
EPLPRTLVWSAAWEMTREAELR

SEQ ID NO: 1500247 - protein, 23 aa, Mycobacterium tuberculosis
EPLVRRLWVLKVWGDVVDDRRGT

SEQ ID NO: 1500248 - protein, 24 aa, Mycobacterium tuberculosis
EPMLFEWTDRNTLLYAIGVGAGTG

SEQ ID NO: 1500249 - protein, 24 aa, Mycobacterium tuberculosis
EPPKGPAWRRIRGVAVAHRGVGGS

SEQ ID NO: 1500250 - protein, 18 aa, Mycobacterium tuberculosis
EPPYRGGPVLADNAVIPV

SEQ ID NO: 1500251 - protein, 20 aa, Mycobacterium tuberculosis
EQMKMFLTRLGFGSKVVVTG

SEQ ID NO: 1500252 - protein, 20 aa, Mycobacterium tuberculosis
EQPLPLAINVIRHINALSTP

SEQ ID NO: 1500253 - protein, 23 aa, Mycobacterium tuberculosis
EQVGPMLADWAKWGQARHNYFLR

SEQ ID NO: 1500254 - protein, 18 aa, Mycobacterium tuberculosis
ERCAFGLQLIAPRLPPFD

SEQ ID NO: 1500255 - protein, 20 aa, Mycobacterium tuberculosis
ERETYDFFGIIFDGHPALTR

SEQ ID NO: 1500256 - protein, 22 aa, Mycobacterium tuberculosis
ERGRRFLIHTARIAYVEIDRVA

SEQ ID NO: 1500257 - protein, 18 aa, Mycobacterium tuberculosis
ERHMLWFALMKPMTSTAT

SEQ ID NO: 1500258 - protein, 22 aa, Mycobacterium tuberculosis
ERIGLRFVLEIRVPAGVDGRIM

SEQ ID NO: 1500259 - protein, 17 aa, Mycobacterium tuberculosis
ERLGLPGLRDWLRRQAK

SEQ ID NO: 1500260 - protein, 22 aa, Mycobacterium tuberculosis
ERLYKTSWRFAPFLWQEIEEGI

SEQ ID NO: 1500261 - protein, 24 aa, Mycobacterium tuberculosis
ERRAGWRAARWLAVVINYRAERWS

SEQ ID NO: 1500262 - protein, 17 aa, Mycobacterium tuberculosis
ERTVLVLRFFDSMTQTQ

SEQ ID NO: 1500263 - protein, 26 aa, Mycobacterium tuberculosis
ESFFRGAGWNVIKVVWGREWDALLHA

SEQ ID NO: 1500264 - protein, 17 aa, Mycobacterium tuberculosis
ESFGARRRLALSTVGAS

SEQ ID NO: 1500265 - protein, 18 aa, Mycobacterium tuberculosis
ESKKAVVVFPTYEDYAAV

SEQ ID NO: 1500266 - protein, 17 aa, Mycobacterium tuberculosis
ESPRAQCRTGGADAAQR

SEQ ID NO: 1500267 - protein, 23 aa, Mycobacterium tuberculosis
ESRLTFLAVRRWYGWSAGRILNL

SEQ ID NO: 1500268 - protein, 20 aa, Mycobacterium tuberculosis
ESVPIWGPRGAALIQAIPEA

SEQ ID NO: 1500269 - protein, 17 aa, Mycobacterium tuberculosis
ESWPRPWHPPGSLAGIT

SEQ ID NO: 1500270 - protein, 20 aa, Mycobacterium tuberculosis
ETARGAVCAAEIAAADPTVG

SEQ ID NO: 1500271 - protein, 24 aa, Mycobacterium tuberculosis
ETLLVVLCGVGFYIGFVGSYQRMA

SEQ ID NO: 1500272 - protein, 17 aa, Mycobacterium tuberculosis
ETLRWLYEMMVVTRELD

SEQ ID NO: 1500273 - protein, 21 aa, Mycobacterium tuberculosis
ETRLPFCWRGVSLHAGGAGRV

SEQ ID NO: 1500274 - protein, 21 aa, Mycobacterium tuberculosis
ETSVALGFGFRCGFLGLLHME

SEQ ID NO: 1500275 - protein, 19 aa, Mycobacterium tuberculosis
ETVAAVATDLKRIGASLAH

SEQ ID NO: 1500276 - protein, 22 aa, Mycobacterium tuberculosis
EVCGYHCWVEFFVAGLGWLPAD

SEQ ID NO: 1500277 - protein, 19 aa, Mycobacterium tuberculosis
EVIETHLLFGIPYDRIDVV

SEQ ID NO: 1500278 - protein, 21 aa, Mycobacterium tuberculosis
EVLLHLAAEGWARWSGTVCEQ

SEQ ID NO: 1500279 - protein, 26 aa, Mycobacterium tuberculosis
EVLTELWALIGYRIPTPIPRIGYAEA

SEQ ID NO: 1500280 - protein, 23 aa, Mycobacterium tuberculosis
EVPMKRFDLMNGIQVRGTYAVSQ

SEQ ID NO: 1500281 - protein, 21 aa, Mycobacterium tuberculosis
EVSAAIAALFSGHAQAYQALS

SEQ ID NO: 1500282 - protein, 21 aa, Mycobacterium tuberculosis
EVSAAVAALFGSYAQSYQAFG

SEQ ID NO: 1500283 - protein, 23 aa, Mycobacterium tuberculosis
EVSARAGVEVTVFEPAEALITAG

SEQ ID NO: 1500284 - protein, 20 aa, Mycobacterium tuberculosis
EVVSAAAGDLANVGSTISAA

SEQ ID NO: 1500285 - protein, 21 aa, Mycobacterium tuberculosis
EVVSAAAGDLANVGSTISAAN

SEQ ID NO: 1500286 - protein, 21 aa, Mycobacterium tuberculosis
EVWTSQMIVAPAFVDAAAKDL

SEQ ID NO: 1500287 - protein, 17 aa, Mycobacterium tuberculosis
EYLRWAVGAFRLATSGV

SEQ ID NO: 1500288 - protein, 21 aa, Mycobacterium tuberculosis
EYLRWAVGAFRLATSGVSDAT

SEQ ID NO: 1500289 - protein, 17 aa, Mycobacterium tuberculosis
EYWWAAEQMLTWPDPDK

SEQ ID NO: 1500290 - protein, 24 aa, Mycobacterium tuberculosis
FAAAFKPPLRWGIRMTGHRFFREY

SEQ ID NO: 1500291 - protein, 18 aa, Mycobacterium tuberculosis
FAAFPWRWVGGDGCIVRL

SEQ ID NO: 1500292 - protein, 17 aa, Mycobacterium tuberculosis
FAAPGWLVSPGVRTALP

SEQ ID NO: 1500293 - protein, 20 aa, Mycobacterium tuberculosis
FAEAVTAIWHGRVEIDRFNE

SEQ ID NO: 1500294 - protein, 17 aa, Mycobacterium tuberculosis
FAESVPIWGPRGAALIQ

SEQ ID NO: 1500295 - protein, 23 aa, Mycobacterium tuberculosis
FAESVPMWGPRGAALIPAIPEAT

SEQ ID NO: 1500296 - protein, 22 aa, Mycobacterium tuberculosis
FAESVPMWGPRGAALIQAIPEA

SEQ ID NO: 1500297 - protein, 19 aa, Mycobacterium tuberculosis
FAGAPIRVGAFLAEDHALR

SEQ ID NO: 1500298 - protein, 18 aa, Mycobacterium tuberculosis
FAGELALGLGAGKDRVHL

SEQ ID NO: 1500299 - protein, 17 aa, Mycobacterium tuberculosis
FALLPLGELWVAAARMR

SEQ ID NO: 1500300 - protein, 19 aa, Mycobacterium tuberculosis
FAPGELKNLPGFQGSGDGS

SEQ ID NO: 1500301 - protein, 18 aa, Mycobacterium tuberculosis
FATIFTVRYGRCVSTCWP

SEQ ID NO: 1500302 - protein, 17 aa, Mycobacterium tuberculosis
FCGTGAMSAMLGKDSYR

SEQ ID NO: 1500303 - protein, 20 aa, Mycobacterium tuberculosis
FDIASLWPVKPLLSLSALET

SEQ ID NO: 1500304 - protein, 20 aa, Mycobacterium tuberculosis
FDILRRWLLARGYDVAFIRN

SEQ ID NO: 1500305 - protein, 18 aa, Mycobacterium tuberculosis
FDLCIEAMGAIDTQQRLG

SEQ ID NO: 1500306 - protein, 24 aa, Mycobacterium tuberculosis
FEAGLRFHPCPRARAGGTTPFFKQ

SEQ ID NO: 1500307 - protein, 23 aa, Mycobacterium tuberculosis
FEIPCPKFRKAAVSKGNGLRGDR

SEQ ID NO: 1500308 - protein, 19 aa, Mycobacterium tuberculosis
FEIPEGWMVQAFRFTLDPT

SEQ ID NO: 1500309 - protein, 19 aa, Mycobacterium tuberculosis
FFGGPPVFNLGLANRGVVN

SEQ ID NO: 1500310 - protein, 30 aa, Mycobacterium tuberculosis
FFGSGGRRRPRRGWRQHRRHPGVSALFGGA

SEQ ID NO: 1500311 - protein, 22 aa, Mycobacterium tuberculosis
FFNFGSLMSGFANFDDEVSGYL

SEQ ID NO: 1500312 - protein, 17 aa, Mycobacterium tuberculosis
FGAGGMGGAGGFGDHGT

SEQ ID NO: 1500313 - protein, 17 aa, Mycobacterium tuberculosis
FGAWYEMFPRSTGGWDD

SEQ ID NO: 1500314 - protein, 17 aa, Mycobacterium tuberculosis
FGFGNAFGDGNLGSGNV

SEQ ID NO: 1500315 - protein, 18 aa, Mycobacterium tuberculosis
FGGAPGFGNDTTAPSSGF

SEQ ID NO: 1500316 - protein, 25 aa, Mycobacterium tuberculosis
FGGSGGRGGLLLGTGGAGGDGGVGG

SEQ ID NO: 1500317 - protein, 17 aa, Mycobacterium tuberculosis
FGLPLAMTLNAVGSPIT

SEQ ID NO: 1500318 - protein, 18 aa, Mycobacterium tuberculosis
FGNAFPPNYLVNSHTSAE

SEQ ID NO: 1500319 - protein, 20 aa, Mycobacterium tuberculosis
FGPISVQGFGLFGHGGDGGN

SEQ ID NO: 1500320 - protein, 17 aa, Mycobacterium tuberculosis
FGPLQARDELAACEILA

SEQ ID NO: 1500321 - protein, 18 aa, Mycobacterium tuberculosis
FGPVAVAGFVVYRLDDGA

SEQ ID NO: 1500322 - protein, 20 aa, Mycobacterium tuberculosis
FGRWELCALMQTVAELAEAM

SEQ ID NO: 1500323 - protein, 22 aa, Mycobacterium tuberculosis
FGSEAPGRPGGAGGTGGAGGNG

SEQ ID NO: 1500324 - protein, 19 aa, Mycobacterium tuberculosis
FGSHAREYQAISTQVAAFH

SEQ ID NO: 1500325 - protein, 18 aa, Mycobacterium tuberculosis
FGTAFAMTVPPSLVAANR

SEQ ID NO: 1500326 - protein, 17 aa, Mycobacterium tuberculosis
FHAHWRYSLRQQRWWCL

SEQ ID NO: 1500327 - protein, 18 aa, Mycobacterium tuberculosis
FHERFIQALSTAAGAYGS

SEQ ID NO: 1500328 - protein, 18 aa, Mycobacterium tuberculosis
FHERVALHFGAAYGSSVL

SEQ ID NO: 1500329 - protein, 19 aa, Mycobacterium tuberculosis
FHGKWPWQMTHPMDGAVQI

SEQ ID NO: 1500330 - protein, 20 aa, Mycobacterium tuberculosis
FHIFSHSWGGMLAQQYVLDK

SEQ ID NO: 1500331 - protein, 17 aa, Mycobacterium tuberculosis
FIDALRSSINFDQSPKD

SEQ ID NO: 1500332 - protein, 17 aa, Mycobacterium tuberculosis
FKKACAGFRSLGRGATE

SEQ ID NO: 1500333 - protein, 17 aa, Mycobacterium tuberculosis
FKQLLMVAGMERYYQIA

SEQ ID NO: 1500334 - protein, 18 aa, Mycobacterium tuberculosis
FLAWHAWNDAERGNWPPG

SEQ ID NO: 1500335 - protein, 18 aa, Mycobacterium tuberculosis
FLDQEGWDSLTINALATQ

SEQ ID NO: 1500336 - protein, 20 aa, Mycobacterium tuberculosis
FLFDFRDGIELNPIVIPGSS

SEQ ID NO: 1500337 - protein, 17 aa, Mycobacterium tuberculosis
FLGPRPAGWWVRRRLHE

SEQ ID NO: 1500338 - protein, 17 aa, Mycobacterium tuberculosis
FLLGIGVGHAEMISEYR

SEQ ID NO: 1500339 - protein, 17 aa, Mycobacterium tuberculosis
FLMCTPLSHAGAAFFTP

SEQ ID NO: 1500340 - protein, 18 aa, Mycobacterium tuberculosis
FLPGSLIDRAEFEAENRR

SEQ ID NO: 1500341 - protein, 19 aa, Mycobacterium tuberculosis
FLPRPLRWLAGATRSAVLR

SEQ ID NO: 1500342 - protein, 18 aa, Mycobacterium tuberculosis
FLPRPLRWLAGATRSGVL

SEQ ID NO: 1500343 - protein, 20 aa, Mycobacterium tuberculosis
FLRRFSLLDSLYMVPSVPII

SEQ ID NO: 1500344 - protein, 18 aa, Mycobacterium tuberculosis
FLVLDGLAKPGRMVGPDP

SEQ ID NO: 1500345 - protein, 17 aa, Mycobacterium tuberculosis
FMGGFALWVDEQRHLHH

SEQ ID NO: 1500346 - protein, 18 aa, Mycobacterium tuberculosis
FMKFEGWTPLAQLKVGDR

SEQ ID NO: 1500347 - protein, 21 aa, Mycobacterium tuberculosis
FNFGSLMSGFANFDDEVSGYL

SEQ ID NO: 1500348 - protein, 17 aa, Mycobacterium tuberculosis
FNGAPGFGGPGGSGGAS

SEQ ID NO: 1500349 - protein, 21 aa, Mycobacterium tuberculosis
FNKPGTFPLRFQTEVRDGCPS

SEQ ID NO: 1500350 - protein, 20 aa, Mycobacterium tuberculosis
FNLVPRWARSPFWPDQSVHR

SEQ ID NO: 1500351 - protein, 27 aa, Mycobacterium tuberculosis
FNNGFLWRGDHQGLIFGSPGFFNSTSA

SEQ ID NO: 1500352 - protein, 20 aa, Mycobacterium tuberculosis
FNVALPWRKEVSLSKSSLHP

SEQ ID NO: 1500353 - protein, 17 aa, Mycobacterium tuberculosis
FNYLDLVRYLAVGNLNP

SEQ ID NO: 1500354 - protein, 21 aa, Mycobacterium tuberculosis
FPAAAARLGSRLSIHDQPNLG

SEQ ID NO: 1500355 - protein, 17 aa, Mycobacterium tuberculosis
FPARLRPPASWWCADPW

SEQ ID NO: 1500356 - protein, 19 aa, Mycobacterium tuberculosis
FPDDARVLLVFGGSQGAVS

SEQ ID NO: 1500357 - protein, 19 aa, Mycobacterium tuberculosis
FPDLPSFPGFPGFPSLPGF

SEQ ID NO: 1500358 - protein, 18 aa, Mycobacterium tuberculosis
FPGLAWTLLSRNGFTICV

SEQ ID NO: 1500359 - protein, 18 aa, Mycobacterium tuberculosis
FPIAAHYFAVFPLAKHME

SEQ ID NO: 1500360 - protein, 19 aa, Mycobacterium tuberculosis
FPLYCCANGKALLAALPPE

SEQ ID NO: 1500361 - protein, 17 aa, Mycobacterium tuberculosis
FPRGLAAFIELRDQRCR

SEQ ID NO: 1500362 - protein, 19 aa, Mycobacterium tuberculosis
FPRGLAAFIELRDQRCRTP

SEQ ID NO: 1500363 - protein, 17 aa, Mycobacterium tuberculosis
FPTAGLIVGSQGTADAY

SEQ ID NO: 1500364 - protein, 17 aa, Mycobacterium tuberculosis
FPWRRQSALVQWYVETS

SEQ ID NO: 1500365 - protein, 21 aa, Mycobacterium tuberculosis
FQATAVIPVIGPVTVTLEGTP

SEQ ID NO: 1500366 - protein, 17 aa, Mycobacterium tuberculosis
FRAAVVLCDIEGLSYEE

SEQ ID NO: 1500367 - protein, 35 aa, Mycobacterium tuberculosis
FRCDRLRQQLFTFICGNAGYGRQRRPCPQRQRRRP

SEQ ID NO: 1500368 - protein, 17 aa, Mycobacterium tuberculosis
FRDGLCFVDLAPIADPG

SEQ ID NO: 1500369 - protein, 17 aa, Mycobacterium tuberculosis
FRFPRIGTAVFDGIEIE

SEQ ID NO: 1500370 - protein, 20 aa, Mycobacterium tuberculosis
FRGLTAMWRRGDEVFAEVAL

SEQ ID NO: 1500371 - protein, 17 aa, Mycobacterium tuberculosis
FRLAFAEGYSHAMTLNN

SEQ ID NO: 1500372 - protein, 19 aa, Mycobacterium tuberculosis
FRLFPEVSPVVIADALVAG

SEQ ID NO: 1500373 - protein, 22 aa, Mycobacterium tuberculosis
FRPSKIAFLAWHAWNDAERGNW

SEQ ID NO: 1500374 - protein, 23 aa, Mycobacterium tuberculosis
FRRRAQCRGVGGPQRRPDVRQIR

SEQ ID NO: 1500375 - protein, 19 aa, Mycobacterium tuberculosis
FRRRSCCLFYRVPAGGKCG

SEQ ID NO: 1500376 - protein, 18 aa, Mycobacterium tuberculosis
FRRTIKWRTGCEGRISHL

SEQ ID NO: 1500377 - protein, 18 aa, Mycobacterium tuberculosis
FRRVLHHHRWPGWAGLIP

SEQ ID NO: 1500378 - protein, 17 aa, Mycobacterium tuberculosis
FRSEWRRPVELSTSVPE

SEQ ID NO: 1500379 - protein, 18 aa, Mycobacterium tuberculosis
FRWSCRMGICGSSGMTIN

SEQ ID NO: 1500380 - protein, 17 aa, Mycobacterium tuberculosis
FRYPGIRSDSDMYTLGF

SEQ ID NO: 1500381 - protein, 19 aa, Mycobacterium tuberculosis
FRYVWASDHLQPWQDNEGH

SEQ ID NO: 1500382 - protein, 17 aa, Mycobacterium tuberculosis
FSGKGGPGGTGGRGGAA

SEQ ID NO: 1500383 - protein, 18 aa, Mycobacterium tuberculosis
FSMPIHQVMVMPGSVMTI

SEQ ID NO: 1500384 - protein, 19 aa, Mycobacterium tuberculosis
FSMPIHQVMVMPGSVMTIP

SEQ ID NO: 1500385 - protein, 17 aa, Mycobacterium tuberculosis
FSPVCRSDCSGLCSQCG

SEQ ID NO: 1500386 - protein, 19 aa, Mycobacterium tuberculosis
FSRRFGVQVEDGFGSTENA

SEQ ID NO: 1500387 - protein, 23 aa, Mycobacterium tuberculosis
FSTAWDCRARARAARALHGEPVR

SEQ ID NO: 1500388 - protein, 23 aa, Mycobacterium tuberculosis
FSYPASLPPFGPVTMTLNGSFDP

SEQ ID NO: 1500389 - protein, 18 aa, Mycobacterium tuberculosis
FTKFNIPINIARVFHRDQ

SEQ ID NO: 1500390 - protein, 18 aa, Mycobacterium tuberculosis
FTLPGERIHVVFRSDESG

SEQ ID NO: 1500391 - protein, 17 aa, Mycobacterium tuberculosis
FTNGALIFGEFDLPQLV

SEQ ID NO: 1500392 - protein, 17 aa, Mycobacterium tuberculosis
FTVLMDREWKHGVAAAV

SEQ ID NO: 1500393 - protein, 23 aa, Mycobacterium tuberculosis
FTVRRRWCRRGSPYPRVALGRGG

SEQ ID NO: 1500394 - protein, 17 aa, Mycobacterium tuberculosis
FVAAYVPYVAWLVQASA

SEQ ID NO: 1500395 - protein, 17 aa, Mycobacterium tuberculosis
FVHAVALAEVWRSCGVL

SEQ ID NO: 1500396 - protein, 22 aa, Mycobacterium tuberculosis
FVVGRLAGRHGIRVGLRGPVTG

SEQ ID NO: 1500397 - protein, 22 aa, Mycobacterium tuberculosis
FVVPSRGLIGWRTDFLTETRGS

SEQ ID NO: 1500398 - protein, 20 aa, Mycobacterium tuberculosis
FWATWCGPCKMVAPVLEEIA

SEQ ID NO: 1500399 - protein, 21 aa, Mycobacterium tuberculosis
FWATWCGPCKMVAPVLEEIAT

SEQ ID NO: 1500400 - protein, 19 aa, Mycobacterium tuberculosis
FWRGDYQGLLDFSFPVGPL

SEQ ID NO: 1500401 - protein, 18 aa, Mycobacterium tuberculosis
FWSEMPEVFHALDADREV

SEQ ID NO: 1500402 - protein, 24 aa, Mycobacterium tuberculosis
FWTGDYQGLLGFSYRPAVLPQTPF

SEQ ID NO: 1500403 - protein, 18 aa, Mycobacterium tuberculosis
FYRGLRFHRFPAVGDTLY

SEQ ID NO: 1500404 - protein, 19 aa, Mycobacterium tuberculosis
FYTCLYRSLLHPNTFNDVD

SEQ ID NO: 1500405 - protein, 23 aa, Mycobacterium tuberculosis
GAAGGAGGWLFGNGGNGGHGATN

SEQ ID NO: 1500406 - protein, 25 aa, Mycobacterium tuberculosis
GAAGGVGGRGGWLLGNGGTGGAGGA

SEQ ID NO: 1500407 - protein, 18 aa, Mycobacterium tuberculosis
GAAGHAGTIFGNGGNAGA

SEQ ID NO: 1500408 - protein, 19 aa, Mycobacterium tuberculosis
GAALPFKRRLFGQIVAAAV

SEQ ID NO: 1500409 - protein, 18 aa, Mycobacterium tuberculosis
GAAPGGFDCSGLVMWAFQ

SEQ ID NO: 1500410 - protein, 19 aa, Mycobacterium tuberculosis
GAAVVGRFAGNGGAGGNAG

SEQ ID NO: 1500411 - protein, 19 aa, Mycobacterium tuberculosis
GADATGFGQTGASGGRGGD

SEQ ID NO: 1500412 - protein, 17 aa, Mycobacterium tuberculosis
GAEGVWCGSVWLTTEEA

SEQ ID NO: 1500413 - protein, 18 aa, Mycobacterium tuberculosis
GAERAVWVGHDWGAVVVW

SEQ ID NO: 1500414 - protein, 19 aa, Mycobacterium tuberculosis
GAFHIGGKGGVGGSAVLIG

SEQ ID NO: 1500415 - protein, 20 aa, Mycobacterium tuberculosis
GAFLGGGRGGDGVFFSLFLG

SEQ ID NO: 1500416 - protein, 25 aa, Mycobacterium tuberculosis
GAFWRGDYQGLLGFSYRPAVLPQTP

SEQ ID NO: 1500417 - protein, 26 aa, Mycobacterium tuberculosis
GAFWRGDYQGLLGFSYRPAVLPQTPF

SEQ ID NO: 1500418 - protein, 21 aa, Mycobacterium tuberculosis
GAFWRGDYQGLLGFSYTSTII

SEQ ID NO: 1500419 - protein, 19 aa, Mycobacterium tuberculosis
GAGFDWVSWVTALGSAPDA

SEQ ID NO: 1500420 - protein, 23 aa, Mycobacterium tuberculosis
GAGGAGFSRALIVAGDNGGDPGA

SEQ ID NO: 1500421 - protein, 18 aa, Mycobacterium tuberculosis
GAGGAGWLVGNGGAGGFG

SEQ ID NO: 1500422 - protein, 24 aa, Mycobacterium tuberculosis
GAGGDGELFFGVSGAGGADGTGTN

SEQ ID NO: 1500423 - protein, 18 aa, Mycobacterium tuberculosis
GAGGDGGLLFGSGGNGAP

SEQ ID NO: 1500424 - protein, 24 aa, Mycobacterium tuberculosis
GAGGDRAGALVGRDGGPGGNGGAG

SEQ ID NO: 1500425 - protein, 19 aa, Mycobacterium tuberculosis
GAGGFGFLGGDGGAGGNAG

SEQ ID NO: 1500426 - protein, 21 aa, Mycobacterium tuberculosis
GAGGGAFVHIATATSTGGSGG

SEQ ID NO: 1500427 - protein, 19 aa, Mycobacterium tuberculosis
GAGGHAWLFGHGGTGGIGG

SEQ ID NO: 1500428 - protein, 20 aa, Mycobacterium tuberculosis
GAGGLIGWAGAAGGTGAGGT

SEQ ID NO: 1500429 - protein, 18 aa, Mycobacterium tuberculosis
GAGGLLFGNGGAGGPGAS

SEQ ID NO: 1500430 - protein, 17 aa, Mycobacterium tuberculosis
GAGGLLWGNGGNGGSGA

SEQ ID NO: 1500431 - protein, 17 aa, Mycobacterium tuberculosis
GAGGMLLGDGGAGGQGG

SEQ ID NO: 1500432 - protein, 20 aa, Mycobacterium tuberculosis
GAGGNAGFGAGVPGDGGIGG

SEQ ID NO: 1500433 - protein, 21 aa, Mycobacterium tuberculosis
GAGGNAWLFGNGGAGGLGAAG

SEQ ID NO: 1500434 - protein, 17 aa, Mycobacterium tuberculosis
GAGGRAWLWGTGGAGGA

SEQ ID NO: 1500435 - protein, 25 aa, Mycobacterium tuberculosis
GAGGRGGAGGLGFGSEAPGRPGGAG

SEQ ID NO: 1500436 - protein, 20 aa, Mycobacterium tuberculosis
GAGGRGGLLIGDGGAGGAGG

SEQ ID NO: 1500437 - protein, 22 aa, Mycobacterium tuberculosis
GAGGRGGLLIGDGGAGGAGGVG

SEQ ID NO: 1500438 - protein, 20 aa, Mycobacterium tuberculosis
GAGGRGGWLAGAGGAGGDGG

SEQ ID NO: 1500439 - protein, 17 aa, Mycobacterium tuberculosis
GAGGRSGLFEVLAAGGA

SEQ ID NO: 1500440 - protein, 20 aa, Mycobacterium tuberculosis
GAGGSARLIGAGGHGGDGGA

SEQ ID NO: 1500441 - protein, 25 aa, Mycobacterium tuberculosis
GAGGTGGNAAWLLGGGGTGGAGGIG

SEQ ID NO: 1500442 - protein, 24 aa, Mycobacterium tuberculosis
GAGGTGRVGGPVGGHGLLGLGGSH

SEQ ID NO: 1500443 - protein, 17 aa, Mycobacterium tuberculosis
GAGGWLFGNGGAGGNGG

SEQ ID NO: 1500444 - protein, 17 aa, Mycobacterium tuberculosis
GAGGWLFGNGGNGGHGA

SEQ ID NO: 1500445 - protein, 17 aa, Mycobacterium tuberculosis
GAGGWLWGNGGAGGNGG

SEQ ID NO: 1500446 - protein, 17 aa, Mycobacterium tuberculosis
GAGLDWKTSLQELTAAR

SEQ ID NO: 1500447 - protein, 19 aa, Mycobacterium tuberculosis
GAGRGRGGGGHHRRRGRGA

SEQ ID NO: 1500448 - protein, 19 aa, Mycobacterium tuberculosis
GAGRPRALPFESRARTAET

SEQ ID NO: 1500449 - protein, 25 aa, Mycobacterium tuberculosis
GAGYADMTAIFLGSSGTPGEDGGNG

SEQ ID NO: 1500450 - protein, 17 aa, Mycobacterium tuberculosis
GAHARFVAAAAKVNTLL

SEQ ID NO: 1500451 - protein, 20 aa, Mycobacterium tuberculosis
GAIARLPAIFTHRDVGNTDC

SEQ ID NO: 1500452 - protein, 17 aa, Mycobacterium tuberculosis
GALCLPDAAMLVAARGR

SEQ ID NO: 1500453 - protein, 19 aa, Mycobacterium tuberculosis
GALGREFAGELALGLGAGK

SEQ ID NO: 1500454 - protein, 17 aa, Mycobacterium tuberculosis
GALKDFRVAVWAEDPHC

SEQ ID NO: 1500455 - protein, 18 aa, Mycobacterium tuberculosis
GALLFGFGGAGGAGGHGG

SEQ ID NO: 1500456 - protein, 17 aa, Mycobacterium tuberculosis
GAMAVPLGWAATVVGEG

SEQ ID NO: 1500457 - protein, 17 aa, Mycobacterium tuberculosis
GAMGLNWYLTDPTLQFI

SEQ ID NO: 1500458 - protein, 22 aa, Mycobacterium tuberculosis
GANGGDAGWLIGNGGAGGSGAK

SEQ ID NO: 1500459 - protein, 22 aa, Mycobacterium tuberculosis
GAPGSDALALGQPGGNGGQGDA

SEQ ID NO: 1500460 - protein, 19 aa, Mycobacterium tuberculosis
GAPMRWARWPPALIGLPAA

SEQ ID NO: 1500461 - protein, 36 aa, Mycobacterium tuberculosis
GAPVPGWPLAPLPISGRPVAAWMGALNTSIRLCNGD

SEQ ID NO: 1500462 - protein, 28 aa, Mycobacterium tuberculosis
GAQPSIRCSPGWPGWRPSGGGPQAAGVI

SEQ ID NO: 1500463 - protein, 33 aa, Mycobacterium tuberculosis
GASAGLRWGRRRKRGFGWSRWTVVRQRRQRLGR

SEQ ID NO: 1500464 - protein, 25 aa, Mycobacterium tuberculosis
GASPRFLLDFSRRFPDAAVVRLERD

SEQ ID NO: 1500465 - protein, 19 aa, Mycobacterium tuberculosis
GATGNCWRCTPIARCRARC

SEQ ID NO: 1500466 - protein, 19 aa, Mycobacterium tuberculosis
GATPGHRRRRGPPGAPGGH

SEQ ID NO: 1500467 - protein, 19 aa, Mycobacterium tuberculosis
GATWCAGPACGRGDAVGAC

SEQ ID NO: 1500468 - protein, 21 aa, Mycobacterium tuberculosis
GAVPSRLPAPLGLQCHADPDG

SEQ ID NO: 1500469 - protein, 25 aa, Mycobacterium tuberculosis
GAVTPAVGALLCLLAKLSGGKAVAE

SEQ ID NO: 1500470 - protein, 18 aa, Mycobacterium tuberculosis
GAYHRACAWRRRRRHRSS

SEQ ID NO: 1500471 - protein, 19 aa, Mycobacterium tuberculosis
GCGPWPRRRCWGLKVRCTS

SEQ ID NO: 1500472 - protein, 17 aa, Mycobacterium tuberculosis
GCGTGFFLLNLIQAGVA

SEQ ID NO: 1500473 - protein, 17 aa, Mycobacterium tuberculosis
GCPGRRRRFPAARATLP

SEQ ID NO: 1500474 - protein, 22 aa, Mycobacterium tuberculosis
GCPYRCTFCGTGAMSAMLGKDS

SEQ ID NO: 1500475 - protein, 20 aa, Mycobacterium tuberculosis
GCRRGELGLSRRARRSGSRG

SEQ ID NO: 1500476 - protein, 27 aa, Mycobacterium tuberculosis
GCRRVWRRYRRQRWCRRQRRADRQRRQ

SEQ ID NO: 1500477 - protein, 19 aa, Mycobacterium tuberculosis
GCSFPNCDVPGYLTEVHHV

SEQ ID NO: 1500478 - protein, 18 aa, Mycobacterium tuberculosis
GCSPRWGADVSSEIDPIT

SEQ ID NO: 1500479 - protein, 22 aa, Mycobacterium tuberculosis
GDDGGAGGWLFGNGGNGGAGAA

SEQ ID NO: 1500480 - protein, 21 aa, Mycobacterium tuberculosis
GDERHMLWFALMKPMTSTATG

SEQ ID NO: 1500481 - protein, 24 aa, Mycobacterium tuberculosis
GDFLRGGTQLALLVNALHQDEQQF

SEQ ID NO: 1500482 - protein, 26 aa, Mycobacterium tuberculosis
GDGGDGGWGRPGGQGGFGSTSGAHGK

SEQ ID NO: 1500483 - protein, 18 aa, Mycobacterium tuberculosis
GDGGGRGIFGQFGAGGAG

SEQ ID NO: 1500484 - protein, 30 aa, Mycobacterium tuberculosis; identical to SEQ ID NO: 214931

SEQ ID NO: 1500485 - protein, 17 aa, Mycobacterium tuberculosis
GDGGLLFGSGGNGAPGA

SEQ ID NO: 1500486 - protein, 24 aa, Mycobacterium tuberculosis
GDGGRGAHGTLFSSLAGTGGTGGN

SEQ ID NO: 1500487 - protein, 24 aa, Mycobacterium tuberculosis
GDKWRLAEVLAWQAYVGFAGEVTR

SEQ ID NO: 1500488 - protein, 21 aa, Mycobacterium tuberculosis
GDLRTGMMGVWIGAIQNMYPE

SEQ ID NO: 1500489 - protein, 17 aa, Mycobacterium tuberculosis
GDPRFSDVSSRIFGTPH

SEQ ID NO: 1500490 - protein, 23 aa, Mycobacterium tuberculosis
GDQRVLGAALWYAATVKDAVIVA

SEQ ID NO: 1500491 - protein, 22 aa, Mycobacterium tuberculosis
GDRGVSWLPFFHDMGLITVLLA

SEQ ID NO: 1500492 - protein, 23 aa, Mycobacterium tuberculosis
GDRGWAGRQWPVMGAAGRCPAGK

SEQ ID NO: 1500493 - protein, 20 aa, Mycobacterium tuberculosis
GDVRLLLPMPADWSYAEAAA

SEQ ID NO: 1500494 - protein, 17 aa, Mycobacterium tuberculosis
GDVSADFGGVGFGGQGG

SEQ ID NO: 1500495 - protein, 24 aa, Mycobacterium tuberculosis
GDWFRRLPALPGRRWRPRNRVRLG

SEQ ID NO: 1500496 - protein, 17 aa, Mycobacterium tuberculosis
GDYDVLVGINLLREGLD

SEQ ID NO: 1500497 - protein, 24 aa, Mycobacterium tuberculosis
GEDYLRLSALGSYGAFFNIYFCSV

SEQ ID NO: 1500498 - protein, 23 aa, Mycobacterium tuberculosis
GEEFSWRAAELFDAIGSEAITVA

SEQ ID NO: 1500499 - protein, 25 aa, Mycobacterium tuberculosis
GEHIGWRLWMGIAFELTSDPQELRE

SEQ ID NO: 1500500 - protein, 17 aa, Mycobacterium tuberculosis
GEIPLGIYCRASLAEYM

SEQ ID NO: 1500501 - protein, 17 aa, Mycobacterium tuberculosis
GEITAEMAFIAAREDMS

SEQ ID NO: 1500502 - protein, 17 aa, Mycobacterium tuberculosis
GELERIGGRYGLQTMCE

SEQ ID NO: 1500503 - protein, 17 aa, Mycobacterium tuberculosis
GEMWAQDALAMYGYAAS

SEQ ID NO: 1500504 - protein, 20 aa, Mycobacterium tuberculosis
GEMWAQDTMAMFGYASSSAT

SEQ ID NO: 1500505 - protein, 17 aa, Mycobacterium tuberculosis
GESSRPGATRVDPAVET

SEQ ID NO: 1500506 - protein, 18 aa, Mycobacterium tuberculosis
GEVLSVPVGDGFLGRVVN

SEQ ID NO: 1500507 - protein, 17 aa, Mycobacterium tuberculosis
GEYRRCVRHGLADMYGF

SEQ ID NO: 1500508 - protein, 23 aa, Mycobacterium tuberculosis
GFADEFTGGFAQGGRGGFGGNGN

SEQ ID NO: 1500509 - protein, 20 aa, Mycobacterium tuberculosis
GFGAGVPGDGGIGGTGGAGG

SEQ ID NO: 1500510 - protein, 26 aa, Mycobacterium tuberculosis
GFGGNGFAGVGGRGGMGGSGGTGGTG

SEQ ID NO: 1500511 - protein, 22 aa, Mycobacterium tuberculosis
GFGGPGLAGGLFGNPGNGGVGG

SEQ ID NO: 1500512 - protein, 26 aa, Mycobacterium tuberculosis
GFGGSGGRGGLLLGTGGAGGDGGVGG

SEQ ID NO: 1500513 - protein, 19 aa, Mycobacterium tuberculosis
GFGSFWWSWRHQLCGLTGA

SEQ ID NO: 1500514 - protein, 18 aa, Mycobacterium tuberculosis
GFLGRYLALEWLDRMDLV

SEQ ID NO: 1500515 - protein, 23 aa, Mycobacterium tuberculosis
GFNLRPSEAPGFFVGFAAVGARQ

SEQ ID NO: 1500516 - protein, 18 aa, Mycobacterium tuberculosis
GFRRRGSARAVWLMGNGG

SEQ ID NO: 1500517 - protein, 19 aa, Mycobacterium tuberculosis
GFWCWSRRLIVVVGHGGDG

SEQ ID NO: 1500518 - protein, 18 aa, Mycobacterium tuberculosis
GGAAINILANAGAGGAGG

SEQ ID NO: 1500519 - protein, 20 aa, Mycobacterium tuberculosis
GGACRRYLQELGDLPTNTLT

SEQ ID NO: 1500520 - protein, 19 aa, Mycobacterium tuberculosis
GGAGCASGGWLARRAADRR

SEQ ID NO: 1500521 - protein, 22 aa, Mycobacterium tuberculosis
GGAGGAGWLVGNGGAGGFGGVG

SEQ ID NO: 1500522 - protein, 23 aa, Mycobacterium tuberculosis
GGAGGASGWLMGNGGNGGNGGTG

SEQ ID NO: 1500523 - protein, 18 aa, Mycobacterium tuberculosis
GGAGGFGAVLFGNGGAGG

SEQ ID NO: 1500524 - protein, 18 aa, Mycobacterium tuberculosis
GGAGGFGGSGGRGGLLLG

SEQ ID NO: 1500525 - protein, 20 aa, Mycobacterium tuberculosis
GGAGGLLFGYGGAGGAGGYS

SEQ ID NO: 1500526 - protein, 21 aa, Mycobacterium tuberculosis
GGAGGLLFGYGGAGGAGGYSN

SEQ ID NO: 1500527 - protein, 23 aa, Mycobacterium tuberculosis
GGAGGNAGMLFGAAGVGGVGGFS

SEQ ID NO: 1500528 - protein, 22 aa, Mycobacterium tuberculosis
GGAGGNGGWLFGNGGAGGSGGD

SEQ ID NO: 1500529 - protein, 27 aa, Mycobacterium tuberculosis
GGAGGRGGKGIDGGFGGDGGNGGSNNG

SEQ ID NO: 1500530 - protein, 25 aa, Mycobacterium tuberculosis
GGAGGRGGLLIGDGGAAARAGVGGP

SEQ ID NO: 1500531 - protein, 21 aa, Mycobacterium tuberculosis
GGAGGRGGWLVGNGGNGGNGG

SEQ ID NO: 1500532 - protein, 19 aa, Mycobacterium tuberculosis
GGAGGRSGLFEVLAAGGAG

SEQ ID NO: 1500533 - protein, 19 aa, Mycobacterium tuberculosis
GGAGGWLFGNGGAGGNGGI

SEQ ID NO: 1500534 - protein, 18 aa, Mycobacterium tuberculosis
GGAGGWLFGNGGAGGVGG

SEQ ID NO: 1500535 - protein, 18 aa, Mycobacterium tuberculosis
GGAGRDGGAPGGDGGDGG

SEQ ID NO: 1500536 - protein, 23 aa, Mycobacterium tuberculosis
GGAGRHRGHPGARRTRRVRRAWR

SEQ ID NO: 1500537 - protein, 22 aa, Mycobacterium tuberculosis
GGALNQAGFFGTGGKRRVTAGN

SEQ ID NO: 1500538 - protein, 18 aa, Mycobacterium tuberculosis
GGAPGCWQPITRDLWPAP

SEQ ID NO: 1500539 - protein, 22 aa, Mycobacterium tuberculosis
GGASGAGGWLLGTGGAGGAGGN

SEQ ID NO: 1500540 - protein, 19 aa, Mycobacterium tuberculosis
GGASGMLIGNGGNGGSGGV

SEQ ID NO: 1500541 - protein, 20 aa, Mycobacterium tuberculosis
GGCAQRICRRGPRGGKCHRC

SEQ ID NO: 1500542 - protein, 34 aa, Mycobacterium tuberculosis
GGCRTARPRRPSAWAWPTSGSGIWVAQTSATTTW

SEQ ID NO: 1500543 - protein, 24 aa, Mycobacterium tuberculosis
GGDGADAVNVVFMPTEPQAATGTA

SEQ ID NO: 1500544 - protein, 18 aa, Mycobacterium tuberculosis
GGDGGILWGNGGNGGDST

SEQ ID NO: 1500545 - protein, 23 aa, Mycobacterium tuberculosis
GGDGGRGGLLYGDGGAGGAGGNG

SEQ ID NO: 1500546 - protein, 19 aa, Mycobacterium tuberculosis
GGFGAPPPRSIGGGDGGDG

SEQ ID NO: 1500547 - protein, 36 aa, Mycobacterium tuberculosis
GGFGGAWRLLFRPNRPGWRVAVAGRLAASAALASSQ

SEQ ID NO: 1500548 - protein, 27 aa, Mycobacterium tuberculosis
GGFGGNGFAGVGGRGGMGGSGGTGGTG

SEQ ID NO: 1500549 - protein, 17 aa, Mycobacterium tuberculosis
GGFGVLGAVGFTPEQLE

SEQ ID NO: 1500550 - protein, 17 aa, Mycobacterium tuberculosis
GGFRAGFHATLPMIDMP

SEQ ID NO: 1500551 - protein, 19 aa, Mycobacterium tuberculosis
GGGAAGFAGGVGGAGGEGL

SEQ ID NO: 1500552 - protein, 24 aa, Mycobacterium tuberculosis
GGGAGGNGAWLFGNGGAGGGGGKG

SEQ ID NO: 1500553 - protein, 19 aa, Mycobacterium tuberculosis
GGGALGVLGGMGGDGGDGG

SEQ ID NO: 1500554 - protein, 18 aa, Mycobacterium tuberculosis
GGGARGCRAVCRVGRQQT

SEQ ID NO: 1500555 - protein, 18 aa, Mycobacterium tuberculosis
GGGFSILLGLGGLGGLGS

SEQ ID NO: 1500556 - protein, 20 aa, Mycobacterium tuberculosis
GGGGFSILLGLGGLGGLGSP

SEQ ID NO: 1500557 - protein, 25 aa, Mycobacterium tuberculosis
GGGGGNGGTGWNGGKGDTGSGGGAG

SEQ ID NO: 1500558 - protein, 27 aa, Mycobacterium tuberculosis
GGGGGVVYCFFFFFVKERGGSGRAVLC

SEQ ID NO: 1500559 - protein, 25 aa, Mycobacterium tuberculosis
GGGKRLRPLFAYWGWHTVASREPDP

SEQ ID NO: 1500560 - protein, 18 aa, Mycobacterium tuberculosis
GGGRRWASAEARRHVTQG

SEQ ID NO: 1500561 - protein, 23 aa, Mycobacterium tuberculosis
GGGSFGLPGLNGSCGDGGDGGNG

SEQ ID NO: 1500562 - protein, 21 aa, Mycobacterium tuberculosis
GGGSFGLPGLNGSGGDGGDGG

SEQ ID NO: 1500563 - protein, 19 aa, Mycobacterium tuberculosis
GGHGHAWTSITYLVLDDAA

SEQ ID NO: 1500564 - protein, 25 aa, Mycobacterium tuberculosis
GGIGGKGGDAFATFAKAGNGGAGGN

SEQ ID NO: 1500565 - protein, 17 aa, Mycobacterium tuberculosis
GGIRGPIGLGFRVPCFV

SEQ ID NO: 1500566 - protein, 17 aa, Mycobacterium tuberculosis
GGKADIANSLGDNATVT

SEQ ID NO: 1500567 - protein, 18 aa, Mycobacterium tuberculosis
GGKCPDVLMAWELTYAEL

SEQ ID NO: 1500568 - protein, 29 aa, Mycobacterium tuberculosis
GGKGGSGGLIGRAGSDGGVGAGGAGGAGG

SEQ ID NO: 1500569 - protein, 21 aa, Mycobacterium tuberculosis
GGKGGTGLMPGINGTGGAGGS

SEQ ID NO: 1500570 - protein, 19 aa, Mycobacterium tuberculosis
GGKRRVTAGNGGARHDQRP

SEQ ID NO: 1500571 - protein, 19 aa, Mycobacterium tuberculosis
GGLGGQLIGLDGSNAPVST

SEQ ID NO: 1500572 - protein, 17 aa, Mycobacterium tuberculosis
GGLHHAPAHRSRHPPAQ

SEQ ID NO: 1500573 - protein, 18 aa, Mycobacterium tuberculosis
GGLIGRAGSDGGVGAGGA

SEQ ID NO: 1500574 - protein, 24 aa, Mycobacterium tuberculosis
GGLMPGFGGAPWVGGHWGLGGEGH

SEQ ID NO: 1500575 - protein, 17 aa, Mycobacterium tuberculosis
GGLRAAAYVNPSRPSSS

SEQ ID NO: 1500576 - protein, 17 aa, Mycobacterium tuberculosis
GGLRWSDRRDDFRTEIL

SEQ ID NO: 1500577 - protein, 21 aa, Mycobacterium tuberculosis
GGLSSPVILGIGIGGAGGDGG

SEQ ID NO: 1500578 - protein, 18 aa, Mycobacterium tuberculosis
GGLTFPANSLLNLDVFVG

SEQ ID NO: 1500579 - protein, 24 aa, Mycobacterium tuberculosis
GGMFTDAGSVGWAEKAGSAGPAGP

SEQ ID NO: 1500580 - protein, 17 aa, Mycobacterium tuberculosis
GGMKQVLGASRLRRDRV

SEQ ID NO: 1500581 - protein, 18 aa, Mycobacterium tuberculosis
GGMLRRMRPLFSVGLGAR

SEQ ID NO: 1500582 - protein, 18 aa, Mycobacterium tuberculosis
GGMRKRAGLARVLVLDPQ

SEQ ID NO: 1500583 - protein, 19 aa, Mycobacterium tuberculosis
GGNAGMLFGSGGGGGTGGF

SEQ ID NO: 1500584 - protein, 18 aa, Mycobacterium tuberculosis
GGNARLLGTGGAGGVGGG

SEQ ID NO: 1500585 - protein, 22 aa, Mycobacterium tuberculosis
GGNGATGPWLFGDGGAGGGGGA

SEQ ID NO: 1500586 - protein, 20 aa, Mycobacterium tuberculosis
GGNGATGTWGHNLGAGGTGG

SEQ ID NO: 1500587 - protein, 20 aa, Mycobacterium tuberculosis
GGNGGGCRDLIWQRRPRRPS

SEQ ID NO: 1500588 - protein, 24 aa, Mycobacterium tuberculosis
GGNGGRAGLLLGVGGMGGNGGATS

SEQ ID NO: 1500589 - protein, 18 aa, Mycobacterium tuberculosis
GGNGGWLYGNGGLGGNGG

SEQ ID NO: 1500590 - protein, 19 aa, Mycobacterium tuberculosis
GGNGGWLYGNGGPGGAAGL

SEQ ID NO: 1500591 - protein, 17 aa, Mycobacterium tuberculosis
GGNGRLFGVDGAGGHGG

SEQ ID NO: 1500592 - protein, 20 aa, Mycobacterium tuberculosis
GGPGGAAFGLGNGGNGGNGG

SEQ ID NO: 1500593 - protein, 19 aa, Mycobacterium tuberculosis
GGPLPRGRGLLMAEDTGVF

SEQ ID NO: 1500594 - protein, 23 aa, Mycobacterium tuberculosis
GGPRRGWRGPPPKTGGIGGAGGL

SEQ ID NO: 1500595 - protein, 18 aa, Mycobacterium tuberculosis
GGQMVPVLLDTGSTGLVM

SEQ ID NO: 1500596 - protein, 18 aa, Mycobacterium tuberculosis
GGRFGCWQRGHPGLGCAQ

SEQ ID NO: 1500597 - protein, 17 aa, Mycobacterium tuberculosis
GGRHRCDGPLGSHAADI

SEQ ID NO: 1500598 - protein, 17 aa, Mycobacterium tuberculosis
GGRIEGIEHVVLQRRQR

SEQ ID NO: 1500599 - protein, 21 aa, Mycobacterium tuberculosis
GGSAGLLGYVGRAGDGGAGGG

SEQ ID NO: 1500600 - protein, 17 aa, Mycobacterium tuberculosis
GGSAMLFGAGGAGGAGG

SEQ ID NO: 1500601 - protein, 19 aa, Mycobacterium tuberculosis
GGSELGFRLAFAEGYSHAM

SEQ ID NO: 1500602 - protein, 22 aa, Mycobacterium tuberculosis
GGSFGLPGLNGSGIHGGDGGNG

SEQ ID NO: 1500603 - protein, 24 aa, Mycobacterium tuberculosis
GGSGGRGGLLFGNGGNGSVGGMGG

SEQ ID NO: 1500604 - protein, 23 aa, Mycobacterium tuberculosis
GGSGGRGGLLLGTGGAGGDGGVG

SEQ ID NO: 1500605 - protein, 18 aa, Mycobacterium tuberculosis
GGSGGWLYGNGGNGGIGG

SEQ ID NO: 1500606 - protein, 19 aa, Mycobacterium tuberculosis
GGSLPRWPPPWSSTRSSKP

SEQ ID NO: 1500607 - protein, 18 aa, Mycobacterium tuberculosis
GGSVGLWGSGGAGGDGGA

SEQ ID NO: 1500608 - protein, 18 aa, Mycobacterium tuberculosis
GGTAHLGPLAIIGQSGQP

SEQ ID NO: 1500609 - protein, 17 aa, Mycobacterium tuberculosis
GGTGAKCGDGGDGGAGG

SEQ ID NO: 1500610 - protein, 17 aa, Mycobacterium tuberculosis
GGTGLMPGINGTGGAGG

SEQ ID NO: 1500611 - protein, 17 aa, Mycobacterium tuberculosis
GGVAWLLYGNGGNGGAG

SEQ ID NO: 1500612 - protein, 20 aa, Mycobacterium tuberculosis
GGVGGRGGDGVFAGAGGQGG

SEQ ID NO: 1500613 - protein, 18 aa, Mycobacterium tuberculosis
GGVLKPILWCPGKATAVQ

SEQ ID NO: 1500614 - protein, 19 aa, Mycobacterium tuberculosis
GGVRDVVLCPGSRNAPLAF

SEQ ID NO: 1500615 - protein, 19 aa, Mycobacterium tuberculosis
GHAIWWLARGLEFFQDGEQ

SEQ ID NO: 1500616 - protein, 20 aa, Mycobacterium tuberculosis
GHAIWWLARGLEFFQDGEQF

SEQ ID NO: 1500617 - protein, 22 aa, Mycobacterium tuberculosis
GHCRGVCLGGYLLQGGYGWTAG

SEQ ID NO: 1500618 - protein, 23 aa, Mycobacterium tuberculosis
GHFPGWIPILASKVVFVGKHPAD

SEQ ID NO: 1500619 - protein, 20 aa, Mycobacterium tuberculosis
GHGGAGGWLYGNGGAGGFGG

SEQ ID NO: 1500620 - protein, 23 aa, Mycobacterium tuberculosis
GHGGAGGWLYGNGGAGGFGGAGA

SEQ ID NO: 1500621 - protein, 17 aa, Mycobacterium tuberculosis
GHGGLWIGNGGDGGAGV

SEQ ID NO: 1500622 - protein, 19 aa, Mycobacterium tuberculosis
GHGGNAILFGQGGAGGPGG

SEQ ID NO: 1500623 - protein, 18 aa, Mycobacterium tuberculosis
GHRIRAAIHFDDLQWERR

SEQ ID NO: 1500624 - protein, 19 aa, Mycobacterium tuberculosis
GHRRRQGCRRPRRHRDPAI

SEQ ID NO: 1500625 - protein, 21 aa, Mycobacterium tuberculosis
GHSMGGITIAAWSDRYRHKVR

SEQ ID NO: 1500626 - protein, 17 aa, Mycobacterium tuberculosis
GHVGVAWRGTWHGGLQF

SEQ ID NO: 1500627 - protein, 18 aa, Mycobacterium tuberculosis
GIDDSWAALRWVGENAAE

SEQ ID NO: 1500628 - protein, 18 aa, Mycobacterium tuberculosis
GIEFPIFAVTHCRDVVVA

SEQ ID NO: 1500629 - protein, 17 aa, Mycobacterium tuberculosis
GIEPELAEALVWRGGPG

SEQ ID NO: 1500630 - protein, 20 aa, Mycobacterium tuberculosis
GILWRGDYQGLIGYSDTLSI

SEQ ID NO: 1500631 - protein, 24 aa, Mycobacterium tuberculosis
GIQHDCKGFRGCCLANTGLTLQQQ

SEQ ID NO: 1500632 - protein, 21 aa, Mycobacterium tuberculosis
GIRWRAWRFATIFTVRYGRCV

SEQ ID NO: 1500633 - protein, 18 aa, Mycobacterium tuberculosis
GIVEGWRGTIVHRVEIDV

SEQ ID NO: 1500634 - protein, 20 aa, Mycobacterium tuberculosis
GIVMPARLPNRIHPFVQENC

SEQ ID NO: 1500635 - protein, 19 aa, Mycobacterium tuberculosis
GKGGAIFNAGTHGAAGTGG

SEQ ID NO: 1500636 - protein, 24 aa, Mycobacterium tuberculosis
GKGGDTPNGLAINPGIGGNGGDTG

SEQ ID NO: 1500637 - protein, 26 aa, Mycobacterium tuberculosis
GKGGEGGVGSILGGPGGNGGTGGNAS

SEQ ID NO: 1500638 - protein, 27 aa, Mycobacterium tuberculosis
GKGGSGGLIGRAGSDGGVGAGGAGGAG

SEQ ID NO: 1500639 - protein, 20 aa, Mycobacterium tuberculosis
GKLPDAYRIIGRAGGIYGDF

SEQ ID NO: 1500640 - protein, 26 aa, Mycobacterium tuberculosis
GKPRLWKPRQRKLWQWEPGQWKHRKY

SEQ ID NO: 1500641 - protein, 22 aa, Mycobacterium tuberculosis
GKQAASAFAMWFPIEGGSKYGG

SEQ ID NO: 1500642 - protein, 17 aa, Mycobacterium tuberculosis
GKWDTLRAMGFDDDHIS

SEQ ID NO: 1500643 - protein, 18 aa, Mycobacterium tuberculosis
GLCTYGVAGRDCWISLET

SEQ ID NO: 1500644 - protein, 19 aa, Mycobacterium tuberculosis
GLDALGFAGTIPKSAPGSA

SEQ ID NO: 1500645 - protein, 18 aa, Mycobacterium tuberculosis
GLEFPVVFVTGWEDGMFP

SEQ ID NO: 1500646 - protein, 18 aa, Mycobacterium tuberculosis
GLEHWSDGVGLGVDSFSA

SEQ ID NO: 1500647 - protein, 18 aa, Mycobacterium tuberculosis
GLELLAFGGRFRRNRQGR

SEQ ID NO: 1500648 - protein, 25 aa, Mycobacterium tuberculosis
GLERIGLRFVLEIRVPAGVDGRITW

SEQ ID NO: 1500649 - protein, 18 aa, Mycobacterium tuberculosis
GLFPFHFTLNGGIGPISI

SEQ ID NO: 1500650 - protein, 25 aa, Mycobacterium tuberculosis
GLGGAGGAGGWLIGQSGSTGGGGAG

SEQ ID NO: 1500651 - protein, 20 aa, Mycobacterium tuberculosis
GLGGHIVNAILIRQNDTEPT

SEQ ID NO: 1500652 - protein, 23 aa, Mycobacterium tuberculosis
GLGRGVACCHWAGAGGYLGQGGG

SEQ ID NO: 1500653 - protein, 18 aa, Mycobacterium tuberculosis
GLGRLSMAVNVNAHAPDR

SEQ ID NO: 1500654 - protein, 22 aa, Mycobacterium tuberculosis
GLGSAFGPGGTGGMGGAGGTST

SEQ ID NO: 1500655 - protein, 18 aa, Mycobacterium tuberculosis
GLKGWINRWFYSVSGQVP

SEQ ID NO: 1500656 - protein, 17 aa, Mycobacterium tuberculosis
GLLSGAVTMVWQREKLL

SEQ ID NO: 1500657 - protein, 20 aa, Mycobacterium tuberculosis
GLLVRWGCAESVPMLRCVPL

SEQ ID NO: 1500658 - protein, 18 aa, Mycobacterium tuberculosis
GLNLARRRCGSWNGPRRS

SEQ ID NO: 1500659 - protein, 17 aa, Mycobacterium tuberculosis
GLPAGGWTRGRAVLAVV

SEQ ID NO: 1500660 - protein, 20 aa, Mycobacterium tuberculosis
GLRARCFGFGAGDCHQSRRR

SEQ ID NO: 1500661 - protein, 19 aa, Mycobacterium tuberculosis
GLRQRWALVGGFAVSARSE

SEQ ID NO: 1500662 - protein, 19 aa, Mycobacterium tuberculosis
GLRRCLRPRPAVATELDLA

SEQ ID NO: 1500663 - protein, 20 aa, Mycobacterium tuberculosis
GLRTLWLCTATRPLREPPGC

SEQ ID NO: 1500664 - protein, 18 aa, Mycobacterium tuberculosis
GLSSPVILGIGIGGAGGD

SEQ ID NO: 1500665 - protein, 18 aa, Mycobacterium tuberculosis
GLSSRAEWLPAWEEGLRR

SEQ ID NO: 1500666 - protein, 19 aa, Mycobacterium tuberculosis
GLTALTWPVMANFAVDSAM

SEQ ID NO: 1500667 - protein, 18 aa, Mycobacterium tuberculosis
GLTEAIAAYSTRLKITPT

SEQ ID NO: 1500668 - protein, 18 aa, Mycobacterium tuberculosis
GLVFPQPPAPIAVSGTDS

SEQ ID NO: 1500669 - protein, 18 aa, Mycobacterium tuberculosis
GLVPAHLRDGHYSGAAAL

SEQ ID NO: 1500670 - protein, 24 aa, Mycobacterium tuberculosis
GMGGLRLLLSLARAYADEPDEVGG

SEQ ID NO: 1500671 - protein, 22 aa, Mycobacterium tuberculosis
GMLWRGDHEGLFGLSYGITIPQ

SEQ ID NO: 1500672 - protein, 23 aa, Mycobacterium tuberculosis
GMLWRGDHEGLFGLSYGITIPQF

SEQ ID NO: 1500673 - protein, 20 aa, Mycobacterium tuberculosis
GNARLLCTGGAGGVGGGGGA

SEQ ID NO: 1500674 - protein, 17 aa, Mycobacterium tuberculosis
GNARLLGTGGAGGVGGG

SEQ ID NO: 1500675 - protein, 23 aa, Mycobacterium tuberculosis
GNAVIPGDGVGKAPHGDAGGSGG

SEQ ID NO: 1500676 - protein, 24 aa, Mycobacterium tuberculosis
GNFLSRSGAVGVLGIGPNNGFPGT

SEQ ID NO: 1500677 - protein, 31 aa, Mycobacterium tuberculosis; identical to SEQ ID NO: 200122

SEQ ID NO: 1500678 - protein, 22 aa, Mycobacterium tuberculosis
GNGATGPWLFGDGGPTPGSTGA

SEQ ID NO: 1500679 - protein, 18 aa, Mycobacterium tuberculosis
GNGGSWLAAGDGGAGGHG

SEQ ID NO: 1500680 - protein, 18 aa, Mycobacterium tuberculosis
GNGGTGWNGGKGDTGSGG

SEQ ID NO: 1500681 - protein, 17 aa, Mycobacterium tuberculosis
GNGGWLWGNGGNGGSGA

SEQ ID NO: 1500682 - protein, 26 aa, Mycobacterium tuberculosis
GNGSKGLPGLGRLGNPGLDGGTGGNG

SEQ ID NO: 1500683 - protein, 19 aa, Mycobacterium tuberculosis
GNRRWERRAAYHYVGYGYR

SEQ ID NO: 1500684 - protein, 25 aa, Mycobacterium tuberculosis
GNTAGRRADAIAGTGGDGGNGGNGG

SEQ ID NO: 1500685 - protein, 22 aa, Mycobacterium tuberculosis
GPACWAPWWPGSAWPPTVAPTT

SEQ ID NO: 1500686 - protein, 17 aa, Mycobacterium tuberculosis
GPAGFLAAARRGDRVAA

SEQ ID NO: 1500687 - protein, 17 aa, Mycobacterium tuberculosis
GPCKGAVVALEPSTGKI

SEQ ID NO: 1500688 - protein, 19 aa, Mycobacterium tuberculosis
GPDGVRCAASMALAPEEPA

SEQ ID NO: 1500689 - protein, 17 aa, Mycobacterium tuberculosis
GPEPMAAAATAWDGLAM

SEQ ID NO: 1500690 - protein, 19 aa, Mycobacterium tuberculosis
GPFPGALWLQVRDLEATQT

SEQ ID NO: 1500691 - protein, 21 aa, Mycobacterium tuberculosis
GPGGGHGLLGLGGSHGAGGAG

SEQ ID NO: 1500692 - protein, 17 aa, Mycobacterium tuberculosis
GPGGRRCEGRQDPIGDR

SEQ ID NO: 1500693 - protein, 21 aa, Mycobacterium tuberculosis
GPGGYCGYLLYNLTTSGFRPA

SEQ ID NO: 1500694 - protein, 17 aa, Mycobacterium tuberculosis
GPGQPGTEFGQTGGTGG

SEQ ID NO: 1500695 - protein, 25 aa, Mycobacterium tuberculosis
GPGTPGSPMVAPPPPTPITQVQQGG

SEQ ID NO: 1500696 - protein, 19 aa, Mycobacterium tuberculosis
GPIVIGSFFLPAFNIPGID

SEQ ID NO: 1500697 - protein, 17 aa, Mycobacterium tuberculosis
GPMPPACGFNWMAATTR

SEQ ID NO: 1500698 - protein, 17 aa, Mycobacterium tuberculosis
GPPERRLRCSSTTAADA

SEQ ID NO: 1500699 - protein, 18 aa, Mycobacterium tuberculosis
GPRWSYADVLGYFRRIEN

SEQ ID NO: 1500700 - protein, 22 aa, Mycobacterium tuberculosis
GPTRRGGACDWCKRQEPTPRSP

SEQ ID NO: 1500701 - protein, 28 aa, Mycobacterium tuberculosis
GPTSEIWVKPSFFPGIRIAPSSGGGATS

SEQ ID NO: 1500702 - protein, 18 aa, Mycobacterium tuberculosis
GPTVCCRLQRCRGATYSP

SEQ ID NO: 1500703 - protein, 17 aa, Mycobacterium tuberculosis
GPVGNGRTNFNGHRREP

SEQ ID NO: 1500704 - protein, 17 aa, Mycobacterium tuberculosis
GPWRLGLGSAGTFENLR

SEQ ID NO: 1500705 - protein, 18 aa, Mycobacterium tuberculosis
GPYHLKRLLGRGGMGEVY

SEQ ID NO: 1500706 - protein, 17 aa, Mycobacterium tuberculosis
GQAGGNGGWLWGNGGNG

SEQ ID NO: 1500707 - protein, 20 aa, Mycobacterium tuberculosis
GQEWRMVWDSALDRAEIGRG

SEQ ID NO: 1500708 - protein, 19 aa, Mycobacterium tuberculosis
GQGSVLVPFSWQGVSLHAA

SEQ ID NO: 1500709 - protein, 18 aa, Mycobacterium tuberculosis
GQHQYGWLQPGPNVNTGW

SEQ ID NO: 1500710 - protein, 19 aa, Mycobacterium tuberculosis
GQITGLRSGFGGAGGAGGA

SEQ ID NO: 1500711 - protein, 17 aa, Mycobacterium tuberculosis
GQLVKWARESIGRTEKI

SEQ ID NO: 1500712 - protein, 17 aa, Mycobacterium tuberculosis
GQPGGAGGLLFGNGGNG

SEQ ID NO: 1500713 - protein, 17 aa, Mycobacterium tuberculosis
GQWRLSPKAMRRLGETA

SEQ ID NO: 1500714 - protein, 19 aa, Mycobacterium tuberculosis
GRAFMKKVWLRDSRNPSQF

SEQ ID NO: 1500715 - protein, 22 aa, Mycobacterium tuberculosis
GRALRWPRFPLVIEAAVAAVDH

SEQ ID NO: 1500716 - protein, 17 aa, Mycobacterium tuberculosis
GRCARRCRRQRRPRQRR

SEQ ID NO: 1500717 - protein, 19 aa, Mycobacterium tuberculosis
GRERWRRRRVRQWWIRRGR

SEQ ID NO: 1500718 - protein, 19 aa, Mycobacterium tuberculosis
GRFLLGIGVGHAEMISEYR

SEQ ID NO: 1500719 - protein, 22 aa, Mycobacterium tuberculosis
GRGARFLLGLVVSTGVGGGLVL

SEQ ID NO: 1500720 - protein, 20 aa, Mycobacterium tuberculosis
GRGGLLVGDGGAGGIGGTGG

SEQ ID NO: 1500721 - protein, 19 aa, Mycobacterium tuberculosis
GRHLLPARRRPITSTNPIA

SEQ ID NO: 1500722 - protein, 18 aa, Mycobacterium tuberculosis
GRIKDLLIVYGRNHSPDD

SEQ ID NO: 1500723 - protein, 22 aa, Mycobacterium tuberculosis
GRIRLRARPGWPRGDRRHEPPV

SEQ ID NO: 1500724 - protein, 22 aa, Mycobacterium tuberculosis
GRKRPIVRILRRVHHRKYLTDG

SEQ ID NO: 1500725 - protein, 17 aa, Mycobacterium tuberculosis
GRLEALLNFQTLVTDLT

SEQ ID NO: 1500726 - protein, 17 aa, Mycobacterium tuberculosis
GRLGLLELRGFEMPPHL

SEQ ID NO: 1500727 - protein, 17 aa, Mycobacterium tuberculosis
GRLSDMVRRILRSMFAV

SEQ ID NO: 1500728 - protein, 18 aa, Mycobacterium tuberculosis
GRLSEWRATLIVRESACL

SEQ ID NO: 1500729 - protein, 20 aa, Mycobacterium tuberculosis
GRLSEWRATLIVRESACLDV

SEQ ID NO: 1500730 - protein, 18 aa, Mycobacterium tuberculosis
GRLSSRFWRLLGASTEKN

SEQ ID NO: 1500731 - protein, 19 aa, Mycobacterium tuberculosis
GRLSSRFWRLLGASTEKNR

SEQ ID NO: 1500732 - protein, 19 aa, Mycobacterium tuberculosis
GRLWLARGGTYALANIRGG

SEQ ID NO: 1500733 - protein, 19 aa, Mycobacterium tuberculosis
GRPATTRGVEGISCSPQMM

SEQ ID NO: 1500734 - protein, 20 aa, Mycobacterium tuberculosis
GRPSSAWVGALITPSTICSA

SEQ ID NO: 1500735 - protein, 17 aa, Mycobacterium tuberculosis
GRPTLFARVARLDEHGK

SEQ ID NO: 1500736 - protein, 25 aa, Mycobacterium tuberculosis
GRPTVRTTVSWAWRRAGLDGIAELT

SEQ ID NO: 1500737 - protein, 17 aa, Mycobacterium tuberculosis
GRPWWEWAATHERAFTA

SEQ ID NO: 1500738 - protein, 20 aa, Mycobacterium tuberculosis
GRQRRPCPQRQRRRPCGNGR

SEQ ID NO: 1500739 - protein, 17 aa, Mycobacterium tuberculosis
GRRLFVFLGSTIGNLTP

SEQ ID NO: 1500740 - protein, 22 aa, Mycobacterium tuberculosis
GRRWAAAGGVGGDGGRGGLLAG

SEQ ID NO: 1500741 - protein, 17 aa, Mycobacterium tuberculosis
GRSEVRILFAFDPARQA

SEQ ID NO: 1500742 - protein, 27 aa, Mycobacterium tuberculosis
GRSGRNRGRRWPRRAADRRRRRRRRGR

SEQ ID NO: 1500743 - protein, 18 aa, Mycobacterium tuberculosis
GRSVSRWGAFLDDVGGFD

SEQ ID NO: 1500744 - protein, 20 aa, Mycobacterium tuberculosis
GRTPLPFYVWRAFARYSPVL

SEQ ID NO: 1500745 - protein, 20 aa, Mycobacterium tuberculosis
GRTQRFWVGLSVYRPGGTAE

SEQ ID NO: 1500746 - protein, 21 aa, Mycobacterium tuberculosis
GRVALDWLDRVDVIGHSRSSG

SEQ ID NO: 1500747 - protein, 17 aa, Mycobacterium tuberculosis
GRYDLVLALASTHTGDG

SEQ ID NO: 1500748 - protein, 19 aa, Mycobacterium tuberculosis
GRYRWPGGLVLEPVSTVSG

SEQ ID NO: 1500749 - protein, 17 aa, Mycobacterium tuberculosis
GSFFPVIPVCSSTGVGT

SEQ ID NO: 1500750 - protein, 23 aa, Mycobacterium tuberculosis
GSFNNGRCGPVTTTGWSASPSAS

SEQ ID NO: 1500751 - protein, 24 aa, Mycobacterium tuberculosis
GSGAPRPVPPVPPMPPAPKRMPAL

SEQ ID NO: 1500752 - protein, 18 aa, Mycobacterium tuberculosis
GSGGNGFDSFASGGTGGA

SEQ ID NO: 1500753 - protein, 23 aa, Mycobacterium tuberculosis
GSGGRGGLLVGDGGAGGIGGTGG

SEQ ID NO: 1500754 - protein, 19 aa, Mycobacterium tuberculosis
GSGNGRAGLPGSGNVGNGN

SEQ ID NO: 1500755 - protein, 20 aa, Mycobacterium tuberculosis
GSGPRWPSRWGTCSKSMGMT

SEQ ID NO: 1500756 - protein, 20 aa, Mycobacterium tuberculosis
GSGRLGIAIARRPRRHRNEK

SEQ ID NO: 1500757 - protein, 21 aa, Mycobacterium tuberculosis
GSLLKELRSILAPECAARARE

SEQ ID NO: 1500758 - protein, 23 aa, Mycobacterium tuberculosis
GSQSEIWWERPILTPIVIDVLDH

SEQ ID NO: 1500759 - protein, 21 aa, Mycobacterium tuberculosis
GSSRKAFGGDGGVGGDGASAL

SEQ ID NO: 1500760 - protein, 19 aa, Mycobacterium tuberculosis
GSTIFPFRRLFMVADVGGA

SEQ ID NO: 1500761 - protein, 17 aa, Mycobacterium tuberculosis
GSVIGSWLLDLTAIALR

SEQ ID NO: 1500762 - protein, 23 aa, Mycobacterium tuberculosis
GTAFLAARGGYFVADLSSGHTGR

SEQ ID NO: 1500763 - protein, 19 aa, Mycobacterium tuberculosis
GTAGGDRRGPVGGIGGAGG

SEQ ID NO: 1500764 - protein, 17 aa, Mycobacterium tuberculosis
GTAPAGRGFWFPPTVLT

SEQ ID NO: 1500765 - protein, 19 aa, Mycobacterium tuberculosis
GTARSWAWLSGRDYVTPDD

SEQ ID NO: 1500766 - protein, 25 aa, Mycobacterium tuberculosis
GTDKRASGVIPRYGVRLTVMSRPPA

SEQ ID NO: 1500767 - protein, 21 aa, Mycobacterium tuberculosis
GTDQRPGCLCGAAAYHSFQFS

SEQ ID NO: 1500768 - protein, 18 aa, Mycobacterium tuberculosis
GTELPPLEGIYLAAFAGR

SEQ ID NO: 1500769 - protein, 25 aa, Mycobacterium tuberculosis
GTGDDGGAGGWLFGNGGNGGAGAAG

SEQ ID NO: 1500770 - protein, 18 aa, Mycobacterium tuberculosis
GTGGFGFAAGGQGGVGGS

SEQ ID NO: 1500771 - protein, 24 aa, Mycobacterium tuberculosis
GTGGFPWGPADPAGPAGLGGFGGA

SEQ ID NO: 1500772 - protein, 19 aa, Mycobacterium tuberculosis
GTGGFPWVPEVSGGAGGGG

SEQ ID NO: 1500773 - protein, 18 aa, Mycobacterium tuberculosis
GTGGRGGLLAGQHANSGN

SEQ ID NO: 1500774 - protein, 17 aa, Mycobacterium tuberculosis
GTGIEFGSVGGAGGAGG

SEQ ID NO: 1500775 - protein, 22 aa, Mycobacterium tuberculosis
GTGLFSGFMSGFGNTGFLQSGF

SEQ ID NO: 1500776 - protein, 24 aa, Mycobacterium tuberculosis
GTGLRRQRRPGWRRHSDRQRRGRR

SEQ ID NO: 1500777 - protein, 28 aa, Mycobacterium tuberculosis
GTGVHRLHRRPGCQRRPHRRRGGTVRQR

SEQ ID NO: 1500778 - protein, 17 aa, Mycobacterium tuberculosis
GTLRCWRHSDIGPARGI

SEQ ID NO: 1500779 - protein, 25 aa, Mycobacterium tuberculosis
GTRLRWWHCAAGCWCGWAVPAAWSR

SEQ ID NO: 1500780 - protein, 20 aa, Mycobacterium tuberculosis
GTVGEMFGRKVARLMEWCAM

SEQ ID NO: 1500781 - protein, 22 aa, Mycobacterium tuberculosis
GVACYPARFQLVLAANPCPCAP

SEQ ID NO: 1500782 - protein, 22 aa, Mycobacterium tuberculosis
GVAQGDIASAFGGDGGNGSDGV

SEQ ID NO: 1500783 - protein, 17 aa, Mycobacterium tuberculosis
GVARSGFYFYFDSKYSV

SEQ ID NO: 1500784 - protein, 17 aa, Mycobacterium tuberculosis
GVAVSPVTGLVFVTNFD

SEQ ID NO: 1500785 - protein, 18 aa, Mycobacterium tuberculosis
GVCESCVSLAPNAPGSID

SEQ ID NO: 1500786 - protein, 19 aa, Mycobacterium tuberculosis
GVCESCVSLAPNAPGSIDV

SEQ ID NO: 1500787 - protein, 18 aa, Mycobacterium tuberculosis
GVCRGICGDGGAGGASDT

SEQ ID NO: 1500788 - protein, 33 aa, Mycobacterium tuberculosis
GVFTGRRAMWVGRIWVSAMPVAPMSGSATSVTG

SEQ ID NO: 1500789 - protein, 23 aa, Mycobacterium tuberculosis
GVGGMGGTGGWLMGNGGMGGAGV

SEQ ID NO: 1500790 - protein, 27 aa, Mycobacterium tuberculosis
GVGGNGGRGGWLLGNGGAGGVGGVGGA

SEQ ID NO: 1500791 - protein, 18 aa, Mycobacterium tuberculosis
GVGGRGGDGVFAGAGGQG

SEQ ID NO: 1500792 - protein, 17 aa, Mycobacterium tuberculosis
GVGGVFGNGGFGGAGGL

SEQ ID NO: 1500793 - protein, 25 aa, Mycobacterium tuberculosis
GVGPGPPGLWGHWGGRAGRAAAPSG

SEQ ID NO: 1500794 - protein, 27 aa, Mycobacterium tuberculosis
GVLRQRWQRRGRWCPERTPPPAAPPAG

SEQ ID NO: 1500795 - protein, 20 aa, Mycobacterium tuberculosis
GVLWRGDYQGLLGFSSGANV

SEQ ID NO: 1500796 - protein, 21 aa, Mycobacterium tuberculosis
GVLWRGDYQGLLGFSYTSTII

SEQ ID NO: 1500797 - protein, 21 aa, Mycobacterium tuberculosis
GVQLFRPAFLLAVPTALGGVG

SEQ ID NO: 1500798 - protein, 18 aa, Mycobacterium tuberculosis
GVSWRAAELFDAIGSEAI

SEQ ID NO: 1500799 - protein, 19 aa, Mycobacterium tuberculosis
GVTGWPATVSHDFDAELPA

SEQ ID NO: 1500800 - protein, 19 aa, Mycobacterium tuberculosis
GVTPAMWAWWFGWHGSDTR

SEQ ID NO: 1500801 - protein, 24 aa, Mycobacterium tuberculosis
GVTVWPVFTRVGGVGTHATKRAVA

SEQ ID NO: 1500802 - protein, 20 aa, Mycobacterium tuberculosis
GVVIGRGCLGRPWLFAELSA

SEQ ID NO: 1500803 - protein, 20 aa, Mycobacterium tuberculosis
GVVRLRFGLTDGQPRTLDEI

SEQ ID NO: 1500804 - protein, 17 aa, Mycobacterium tuberculosis
GWCTVTVRYDRASVRND

SEQ ID NO: 1500805 - protein, 17 aa, Mycobacterium tuberculosis
GWFGVAMILDFSWLPPE

SEQ ID NO: 1500806 - protein, 24 aa, Mycobacterium tuberculosis
GWPNLAAELQLAFQQLLVGDYNAA

SEQ ID NO: 1500807 - protein, 18 aa, Mycobacterium tuberculosis
GWPSGVWIDQPRRTAPDG

SEQ ID NO: 1500808 - protein, 18 aa, Mycobacterium tuberculosis
GWVGLPLAGVQTRLVDDD

SEQ ID NO: 1500809 - protein, 21 aa, Mycobacterium tuberculosis
GWWASWRWGLSQVVRPKTPRG

SEQ ID NO: 1500810 - protein, 17 aa, Mycobacterium tuberculosis
GYADMTAIFLGSSGTPG

SEQ ID NO: 1500811 - protein, 17 aa, Mycobacterium tuberculosis
GYCGYLLYNLTTSGFRP

SEQ ID NO: 1500812 - protein, 18 aa, Mycobacterium tuberculosis
GYDLTRWLATKGMELTWR

SEQ ID NO: 1500813 - protein, 18 aa, Mycobacterium tuberculosis
GYENLRFFASLYAGATAD

SEQ ID NO: 1500814 - protein, 18 aa, Mycobacterium tuberculosis
GYGLRIGYFAQEHDTLDN

SEQ ID NO: 1500815 - protein, 17 aa, Mycobacterium tuberculosis
GYLPYNLTTSGFRPATF

SEQ ID NO: 1500816 - protein, 17 aa, Mycobacterium tuberculosis
GYQGWQWAVVVASYSGA

SEQ ID NO: 1500817 - protein, 17 aa, Mycobacterium tuberculosis
GYRSWRSQTRRSRVQRV

SEQ ID NO: 1500818 - protein, 25 aa, Mycobacterium tuberculosis
HACQHPRPGIANVWPIRQDLADLLV

SEQ ID NO: 1500819 - protein, 18 aa, Mycobacterium tuberculosis
HAELEWWTSPFVLAHGVP

SEQ ID NO: 1500820 - protein, 20 aa, Mycobacterium tuberculosis
HAELEWWTSPFVLAHGVPPD

SEQ ID NO: 1500821 - protein, 19 aa, Mycobacterium tuberculosis
HAMIRAGLRLKKLGTDRSW

SEQ ID NO: 1500822 - protein, 22 aa, Mycobacterium tuberculosis
HAVALAEVWRSCGVLPDLTVGH

SEQ ID NO: 1500823 - protein, 22 aa, Mycobacterium tuberculosis
HCLDLPGLFVWRRYHPSRPSGK

SEQ ID NO: 1500824 - protein, 18 aa, Mycobacterium tuberculosis
HDTFCPVGPWIVTDLAPF

SEQ ID NO: 1500825 - protein, 20 aa, Mycobacterium tuberculosis
HFNWLEGLGFQFERSYFPGK

SEQ ID NO: 1500826 - protein, 18 aa, Mycobacterium tuberculosis
HGEIPLGIYCRASLAEYM

SEQ ID NO: 1500827 - protein, 20 aa, Mycobacterium tuberculosis
HGGAGGLIWGNGGAGGNGGN

SEQ ID NO: 1500828 - protein, 26 aa, Mycobacterium tuberculosis
HGGAGGSARLIGAGGHGGDGGAGGNT

SEQ ID NO: 1500829 - protein, 19 aa, Mycobacterium tuberculosis
HGGAGGWLYGNGGAGGFGG

SEQ ID NO: 1500830 - protein, 24 aa, Mycobacterium tuberculosis
HGGDGFRTAGAGGRGGDGGKGADP

SEQ ID NO: 1500831 - protein, 20 aa, Mycobacterium tuberculosis
HGIDTVVVGWGYGRADFIDK

SEQ ID NO: 1500832 - protein, 18 aa, Mycobacterium tuberculosis
HGLCGYRRFFSITSLAGL

SEQ ID NO: 1500833 - protein, 17 aa, Mycobacterium tuberculosis
HGMYWSGDLAYRDSEGW

SEQ ID NO: 1500834 - protein, 23 aa, Mycobacterium tuberculosis
HGPAVLGAPAWKPPHPLSDSITA

SEQ ID NO: 1500835 - protein, 21 aa, Mycobacterium tuberculosis
HHPSCLPGAILDRSSRFSPDR

SEQ ID NO: 1500836 - protein, 24 aa, Mycobacterium tuberculosis
HIELAAPVTHIWYFKGVPSRLGYL

SEQ ID NO: 1500837 - protein, 17 aa, Mycobacterium tuberculosis
HKIHLYDAFGFTESRTV

SEQ ID NO: 1500838 - protein, 18 aa, Mycobacterium tuberculosis
HKQRTGLPYVTWKYATSI

SEQ ID NO: 1500839 - protein, 20 aa, Mycobacterium tuberculosis
HLADLASIWRRCGGRTVTLF

SEQ ID NO: 1500840 - protein, 18 aa, Mycobacterium tuberculosis
HLDPRLLIEFCLLATQYD

SEQ ID NO: 1500841 - protein, 17 aa, Mycobacterium tuberculosis
HLLGCSPRWGADVSSEI

SEQ ID NO: 1500842 - protein, 17 aa, Mycobacterium tuberculosis
HLPGIAVPTVFTHGTAD

SEQ ID NO: 1500843 - protein, 17 aa, Mycobacterium tuberculosis
HPDFPAAAARLGSRLSI

SEQ ID NO: 1500844 - protein, 18 aa, Mycobacterium tuberculosis
HPDRAVAVLAALPAWTGE

SEQ ID NO: 1500845 - protein, 17 aa, Mycobacterium tuberculosis
HPDRFRAMIVERGNPAH

SEQ ID NO: 1500846 - protein, 18 aa, Mycobacterium tuberculosis
HPEVSWAAMFLRLAEPRA

SEQ ID NO: 1500847 - protein, 18 aa, Mycobacterium tuberculosis
HPPTCAKCVARGRISALG

SEQ ID NO: 1500848 - protein, 18 aa, Mycobacterium tuberculosis
HPRRAGVSSFGFGGTNAH

SEQ ID NO: 1500849 - protein, 18 aa, Mycobacterium tuberculosis
HRACWLFGNELGFLLQKK

SEQ ID NO: 1500850 - protein, 23 aa, Mycobacterium tuberculosis
HRARCWCPAWACRAGARRRWGGL

SEQ ID NO: 1500851 - protein, 17 aa, Mycobacterium tuberculosis
HRARRLAVRVVHDATCS

SEQ ID NO: 1500852 - protein, 25 aa, Mycobacterium tuberculosis
HRATLRWARGYSCCRPRPATHCARR

SEQ ID NO: 1500853 - protein, 21 aa, Mycobacterium tuberculosis
HRCQRAGAVVAVYLGQAGVFD

SEQ ID NO: 1500854 - protein, 19 aa, Mycobacterium tuberculosis
HRDGPRPTLCVIRGFMGSS

SEQ ID NO: 1500855 - protein, 17 aa, Mycobacterium tuberculosis
HRPSWPAGIAVGKTVVS

SEQ ID NO: 1500856 - protein, 27 aa, Mycobacterium tuberculosis
HRRGWARRVWRRRFSPQALTTGGRPAG

SEQ ID NO: 1500857 - protein, 19 aa, Mycobacterium tuberculosis
HRRSACAAGGFGRNGNDAS

SEQ ID NO: 1500858 - protein, 21 aa, Mycobacterium tuberculosis
HRSGRWCGWRGRADRSRRGRR

SEQ ID NO: 1500859 - protein, 21 aa, Mycobacterium tuberculosis
HRSPWEICWSCRVRSASQTWA

SEQ ID NO: 1500860 - protein, 21 aa, Mycobacterium tuberculosis
HSAVALPGWAAPAETAARQGR

SEQ ID NO: 1500861 - protein, 18 aa, Mycobacterium tuberculosis
HSPLPAGRRSWWRIAPAR

SEQ ID NO: 1500862 - protein, 17 aa, Mycobacterium tuberculosis
HSWNLPPAVRQSCGRCS

SEQ ID NO: 1500863 - protein, 20 aa, Mycobacterium tuberculosis
HTGQAPRPWVASTRSPTAIC

SEQ ID NO: 1500864 - protein, 17 aa, Mycobacterium tuberculosis
HTLLDFHFRPHLTAASG

SEQ ID NO: 1500865 - protein, 22 aa, Mycobacterium tuberculosis
HTQLAWVLGCFTGFGQASRMTQ

SEQ ID NO: 1500866 - protein, 17 aa, Mycobacterium tuberculosis
HVLDYLAAKGWQPEGVS

SEQ ID NO: 1500867 - protein, 19 aa, Mycobacterium tuberculosis
HVMATYLSRDWARDWGSLR

SEQ ID NO: 1500868 - protein, 19 aa, Mycobacterium tuberculosis
HVPEIPAHVTVEVPVNIPI

SEQ ID NO: 1500869 - protein, 18 aa, Mycobacterium tuberculosis
HVPLSEMFGYVGDLRSKT

SEQ ID NO: 1500870 - protein, 22 aa, Mycobacterium tuberculosis
HVTRLRADLCPEWPQPAQPGGS

SEQ ID NO: 1500871 - protein, 21 aa, Mycobacterium tuberculosis
HWDRVGSGWPRPGRDGTRIRS

SEQ ID NO: 1500872 - protein, 32 aa, Mycobacterium tuberculosis; identical to SEQ ID NO: 1484935

SEQ ID NO: 1500873 - protein, 17 aa, Mycobacterium tuberculosis
IAAFSRWYAGEIDLHNP

SEQ ID NO: 1500874 - protein, 24 aa, Mycobacterium tuberculosis
IAAKHAQCLNVRWWSPQQVTQRRG

SEQ ID NO: 1500875 - protein, 18 aa, Mycobacterium tuberculosis
IAAVKKTWSAWVAPGTSL

SEQ ID NO: 1500876 - protein, 23 aa, Mycobacterium tuberculosis
IAFSGPRWLALLLQPLSGPPSTS

SEQ ID NO: 1500877 - protein, 22 aa, Mycobacterium tuberculosis
IAIAVPAHWKPGAVHALRNGLR

SEQ ID NO: 1500878 - protein, 17 aa, Mycobacterium tuberculosis
IAILLKVHHALIDGEGG

SEQ ID NO: 1500879 - protein, 19 aa, Mycobacterium tuberculosis
IANAAAMRVVLGAVNAPTQ

SEQ ID NO: 1500880 - protein, 20 aa, Mycobacterium tuberculosis
IANGSFAPSFVGFGGNGGNG

SEQ ID NO: 1500881 - protein, 19 aa, Mycobacterium tuberculosis
IANGSFAPSFVGFGGNGVN

SEQ ID NO: 1500882 - protein, 20 aa, Mycobacterium tuberculosis
IANGSFAPSFVGFGGNGVNG

SEQ ID NO: 1500883 - protein, 24 aa, Mycobacterium tuberculosis
IAQARLGPGRIHHCMRALGAAERA

SEQ ID NO: 1500884 - protein, 17 aa, Mycobacterium tuberculosis
IAQRGWPVFCVSTATRE

SEQ ID NO: 1500885 - protein, 19 aa, Mycobacterium tuberculosis
IAQRGWPVFCVSTATRENL

SEQ ID NO: 1500886 - protein, 22 aa, Mycobacterium tuberculosis
IARVESRLAYFFRIRGHGTDDS

SEQ ID NO: 1500887 - protein, 18 aa, Mycobacterium tuberculosis
IATTRFLLDVNISGGLPA

SEQ ID NO: 1500888 - protein, 20 aa, Mycobacterium tuberculosis
IAVKCGWPSGPMVASVPVRL

SEQ ID NO: 1500889 - protein, 17 aa, Mycobacterium tuberculosis
IAVLGARVAGSSLAGFA

SEQ ID NO: 1500890 - protein, 20 aa, Mycobacterium tuberculosis
IAVNCSWLLGSFGLGAGDVG

SEQ ID NO: 1500891 - protein, 18 aa, Mycobacterium tuberculosis
ICSARTAAQFGIEPWVAM

SEQ ID NO: 1500892 - protein, 17 aa, Mycobacterium tuberculosis
IDATHAWASVWTPQQPG

SEQ ID NO: 1500893 - protein, 22 aa, Mycobacterium tuberculosis
IDFWRFNVAFARQILEQQPISG

SEQ ID NO: 1500894 - protein, 22 aa, Mycobacterium tuberculosis
IDNLRAAFAWSRENGHITEALQ

SEQ ID NO: 1500895 - protein, 20 aa, Mycobacterium tuberculosis
IDNLRAAFVWNRENSDTEGA

SEQ ID NO: 1500896 - protein, 23 aa, Mycobacterium tuberculosis
IEDWAEIWPCAGMAYPKALADDL

SEQ ID NO: 1500897 - protein, 18 aa, Mycobacterium tuberculosis
IEEALRYGVVKMNVDTDT

SEQ ID NO: 1500898 - protein, 18 aa, Mycobacterium tuberculosis
IELGIKWLSLYAFSTENW

SEQ ID NO: 1500899 - protein, 19 aa, Mycobacterium tuberculosis
IELGIYFPGRWGARIEDIV

SEQ ID NO: 1500900 - protein, 23 aa, Mycobacterium tuberculosis
IELGIYFPGRWGARIEDIVIVTE

SEQ ID NO: 1500901 - protein, 24 aa, Mycobacterium tuberculosis
IEPGIYFPGRWGARIEDIVIVTED

SEQ ID NO: 1500902 - protein, 18 aa, Mycobacterium tuberculosis
IERYRAATLMARVRAAKG

SEQ ID NO: 1500903 - protein, 19 aa, Mycobacterium tuberculosis
IGALCFPLGSTGTTKTGAT

SEQ ID NO: 1500904 - protein, 17 aa, Mycobacterium tuberculosis
IGAVLSMHFAKQAARFF

SEQ ID NO: 1500905 - protein, 23 aa, Mycobacterium tuberculosis
IGGGMCFTFLAAQGFSVGTSLLE

SEQ ID NO: 1500906 - protein, 17 aa, Mycobacterium tuberculosis
IGLELNGGVGPITVLPI

SEQ ID NO: 1500907 - protein, 17 aa, Mycobacterium tuberculosis
IGNALALGNVGGVNLGL

SEQ ID NO: 1500908 - protein, 19 aa, Mycobacterium tuberculosis
IGPGGLFLALPGARADGHD

SEQ ID NO: 1500909 - protein, 18 aa, Mycobacterium tuberculosis
IGRELDRYLPFLATTKVL

SEQ ID NO: 1500910 - protein, 20 aa, Mycobacterium tuberculosis
IGVEAGLIGPEWFPDSYPWV

SEQ ID NO: 1500911 - protein, 25 aa, Mycobacterium tuberculosis
IGVEAGLIGPEWFPDSYPWVPSINP

SEQ ID NO: 1500912 - protein, 17 aa, Mycobacterium tuberculosis
IGYAIGHPDVITALDKV

SEQ ID NO: 1500913 - protein, 18 aa, Mycobacterium tuberculosis
IHLEGPWLSPARCGAHDH

SEQ ID NO: 1500914 - protein, 17 aa, Mycobacterium tuberculosis
IHLYDAFGFTESRTVAP

SEQ ID NO: 1500915 - protein, 18 aa, Mycobacterium tuberculosis
IHQVMVMPGSVMTIPGMR

SEQ ID NO: 1500916 - protein, 18 aa, Mycobacterium tuberculosis
IIPWNFPILMAAWKLAPA

SEQ ID NO: 1500917 - protein, 19 aa, Mycobacterium tuberculosis
IKLAVLVATNFFGINTIPI

SEQ ID NO: 1500918 - protein, 17 aa, Mycobacterium tuberculosis
IKRRGCRQGHRRAAPRS

SEQ ID NO: 1500919 - protein, 18 aa, Mycobacterium tuberculosis
IKVARRLLANVAHVAVFD

SEQ ID NO: 1500920 - protein, 25 aa, Mycobacterium tuberculosis
ILRLLALRCLWVFRGFPARLRPPAS

SEQ ID NO: 1500921 - protein, 27 aa, Mycobacterium tuberculosis
ILVPRPGRCPPGFQILPISSTLGLGTG

SEQ ID NO: 1500922 - protein, 17 aa, Mycobacterium tuberculosis
ILYRLYRPLIFALYCLP

SEQ ID NO: 1500923 - protein, 17 aa, Mycobacterium tuberculosis
INAFMGYFYVHNTYPEL

SEQ ID NO: 1500924 - protein, 17 aa, Mycobacterium tuberculosis
INAPALALLGRLLIGNG

SEQ ID NO: 1500925 - protein, 17 aa, Mycobacterium tuberculosis
INAPALALLGRPLIGNG

SEQ ID NO: 1500926 - protein, 17 aa, Mycobacterium tuberculosis
INPITLWPAQNFNQTIT

SEQ ID NO: 1500927 - protein, 17 aa, Mycobacterium tuberculosis
INSALIFAGAGPEPMAA

SEQ ID NO: 1500928 - protein, 17 aa, Mycobacterium tuberculosis
INSALIFGGAGSEPMSA

SEQ ID NO: 1500929 - protein, 17 aa, Mycobacterium tuberculosis
INSALMFAGAGPGPMLA

SEQ ID NO: 1500930 - protein, 17 aa, Mycobacterium tuberculosis
IPAFGRPAAGAGTGSCR

SEQ ID NO: 1500931 - protein, 19 aa, Mycobacterium tuberculosis
IPAFLRYDLRPVTGEWQIA

SEQ ID NO: 1500932 - protein, 21 aa, Mycobacterium tuberculosis
IPAIPPFFPGFPPDYVTVSGQ

SEQ ID NO: 1500933 - protein, 25 aa, Mycobacterium tuberculosis
IPEIPYRYDLSVPIDIPITGTVVAT

SEQ ID NO: 1500934 - protein, 21 aa, Mycobacterium tuberculosis
IPGGWWLTFGQILGLAQNAPG

SEQ ID NO: 1500935 - protein, 17 aa, Mycobacterium tuberculosis
IPIGLVLNGDIGPITIQ

SEQ ID NO: 1500936 - protein, 18 aa, Mycobacterium tuberculosis
IPLTINIRIPVNITLNEL

SEQ ID NO: 1500937 - protein, 18 aa, Mycobacterium tuberculosis
IPNGGSVFGCQPCSAPDR

SEQ ID NO: 1500938 - protein, 17 aa, Mycobacterium tuberculosis
IPSFIPEDFTFLDAIFA

SEQ ID NO: 1500939 - protein, 29 aa, Mycobacterium tuberculosis
IPSLACGRCWAIARCRSCTGPLSLQGAGS

SEQ ID NO: 1500940 - protein, 20 aa, Mycobacterium tuberculosis
IPSPAAGVLTKIIAQEDDTV

SEQ ID NO: 1500941 - protein, 19 aa, Mycobacterium tuberculosis
IPVCTRLGLSPPDVRTLSK

SEQ ID NO: 1500942 - protein, 18 aa, Mycobacterium tuberculosis
IQHLIRWVISAGEFGEKW

SEQ ID NO: 1500943 - protein, 21 aa, Mycobacterium tuberculosis
IQWAIRWTRRGAVIVVDNVIR

SEQ ID NO: 1500944 - protein, 19 aa, Mycobacterium tuberculosis
IRAAIHFDDLQWERRYRRV

SEQ ID NO: 1500945 - protein, 18 aa, Mycobacterium tuberculosis
IRAFRAAYELGVGTVAVY

SEQ ID NO: 1500946 - protein, 17 aa, Mycobacterium tuberculosis
IRAGAGLVLAGLVADGD

SEQ ID NO: 1500947 - protein, 18 aa, Mycobacterium tuberculosis
IRALPGCPGERCRRCPGC

SEQ ID NO: 1500948 - protein, 20 aa, Mycobacterium tuberculosis
IRAPSRLQVWRTRATTAREC

SEQ ID NO: 1500949 - protein, 22 aa, Mycobacterium tuberculosis
IRIDRFELLAARRRDQLIDIDV

SEQ ID NO: 1500950 - protein, 17 aa, Mycobacterium tuberculosis
IRINWVWNPPWGPDKIT

SEQ ID NO: 1500951 - protein, 17 aa, Mycobacterium tuberculosis
IRLPVHLVEQVNKLARI

SEQ ID NO: 1500952 - protein, 19 aa, Mycobacterium tuberculosis
IRLTLYIRIYGWIFSIAGS

SEQ ID NO: 1500953 - protein, 21 aa, Mycobacterium tuberculosis
IRPNPGIGHPCWANYFPVTRA

SEQ ID NO: 1500954 - protein, 17 aa, Mycobacterium tuberculosis
IRQPVQFERAVRNAFDG

SEQ ID NO: 1500955 - protein, 18 aa, Mycobacterium tuberculosis
IRRLPHPVLRGAVAGDRG

SEQ ID NO: 1500956 - protein, 20 aa, Mycobacterium tuberculosis
ISAAIAALFGAHGRAYQAAS

SEQ ID NO: 1500957 - protein, 17 aa, Mycobacterium tuberculosis
ISAQVAAYHQQFVQTLR

SEQ ID NO: 1500958 - protein, 25 aa, Mycobacterium tuberculosis
ISAQVAAYHQQFVQTLRTGAASYML

SEQ ID NO: 1500959 - protein, 20 aa, Mycobacterium tuberculosis
ISARSAWPRGGPRAGAGSRG

SEQ ID NO: 1500960 - protein, 18 aa, Mycobacterium tuberculosis
ISELWLRLLESYRDSFYL

SEQ ID NO: 1500961 - protein, 22 aa, Mycobacterium tuberculosis
ISGGLPAFTLFAGGLTIPTNAI

SEQ ID NO: 1500962 - protein, 17 aa, Mycobacterium tuberculosis
ISGLQMLLHQAFAQVEQ

SEQ ID NO: 1500963 - protein, 18 aa, Mycobacterium tuberculosis
ISIPSCRPGWCGPITAST

SEQ ID NO: 1500964 - protein, 19 aa, Mycobacterium tuberculosis
ISIPSCRPGWCGPITASTE

SEQ ID NO: 1500965 - protein, 17 aa, Mycobacterium tuberculosis
ISPPGLSSPATWATAPS

SEQ ID NO: 1500966 - protein, 23 aa, Mycobacterium tuberculosis
ITGDHQMGFGGFNSGSGNIGFGN

SEQ ID NO: 1500967 - protein, 18 aa, Mycobacterium tuberculosis
ITKARWVYFLTRMRNPTG

SEQ ID NO: 1500968 - protein, 18 aa, Mycobacterium tuberculosis
ITPELIKALGAVRRHHDE

SEQ ID NO: 1500969 - protein, 19 aa, Mycobacterium tuberculosis
ITPELIKALGAVRRHHDEL

SEQ ID NO: 1500970 - protein, 21 aa, Mycobacterium tuberculosis
ITRPRWLWKFAKTLRPPDLRV

SEQ ID NO: 1500971 - protein, 24 aa, Mycobacterium tuberculosis
IVDEPFMLPAHIDFTALRAHAVAV

SEQ ID NO: 1500972 - protein, 27 aa, Mycobacterium tuberculosis
IVGDEFCLLDGLLAWYAMIGSINNINS

SEQ ID NO: 1500973 - protein, 18 aa, Mycobacterium tuberculosis
IVKFSGCYHGHVDALLAD

SEQ ID NO: 1500974 - protein, 17 aa, Mycobacterium tuberculosis
IVRPLLRFFFKSWFRVE

SEQ ID NO: 1500975 - protein, 21 aa, Mycobacterium tuberculosis
IVVLGDAWELLKFFNDDQYVI

SEQ ID NO: 1500976 - protein, 19 aa, Mycobacterium tuberculosis
KAAPLWRVLVALSIRHVGP

SEQ ID NO: 1500977 - protein, 17 aa, Mycobacterium tuberculosis
KAGAILVNVNFRYVEGE

SEQ ID NO: 1500978 - protein, 20 aa, Mycobacterium tuberculosis
KAGYEVLERVGLDPKVATRY

SEQ ID NO: 1500979 - protein, 17 aa, Mycobacterium tuberculosis
KAIAAFSRWYAGEIDLH

SEQ ID NO: 1500980 - protein, 22 aa, Mycobacterium tuberculosis
KALEGDAKWVASVEELMNAVDE

SEQ ID NO: 1500981 - protein, 20 aa, Mycobacterium tuberculosis
KAMSPRPPLPPLPGAPPAPP

SEQ ID NO: 1500982 - protein, 17 aa, Mycobacterium tuberculosis
KANLFYRGLRFHRFPAV

SEQ ID NO: 1500983 - protein, 18 aa, Mycobacterium tuberculosis
KASWAGGLRRPRALFEAV

SEQ ID NO: 1500984 - protein, 18 aa, Mycobacterium tuberculosis
KATIALLRRVEDVLDVEV

SEQ ID NO: 1500985 - protein, 26 aa, Mycobacterium tuberculosis
KAVAGIRLALSLGFRVRVAATVASPA

SEQ ID NO: 1500986 - protein, 21 aa, Mycobacterium tuberculosis
KAVPSRLAWEAGVALADSLLA

SEQ ID NO: 1500987 - protein, 17 aa, Mycobacterium tuberculosis
KCRYPRRPPARGGDGGV

SEQ ID NO: 1500988 - protein, 20 aa, Mycobacterium tuberculosis
KEERGARIFIDFTQNARDRT

SEQ ID NO: 1500989 - protein, 22 aa, Mycobacterium tuberculosis
KELQPRLPAVMDRLDRAIPRGV

SEQ ID NO: 1500990 - protein, 19 aa, Mycobacterium tuberculosis
KEVFRLRLASGREVEATGS

SEQ ID NO: 1500991 - protein, 17 aa, Mycobacterium tuberculosis
KFAYSWAVGPAVGRSGK

SEQ ID NO: 1500992 - protein, 20 aa, Mycobacterium tuberculosis
KGCPKETWCVVNAGNYRGSM

SEQ ID NO: 1500993 - protein, 21 aa, Mycobacterium tuberculosis
KGCPKETWCVVNAGNYRGSMN

SEQ ID NO: 1500994 - protein, 17 aa, Mycobacterium tuberculosis
KGCVFEYVYLARPDSTI

SEQ ID NO: 1500995 - protein, 21 aa, Mycobacterium tuberculosis
KGDKGEPCWPDGVVGSLTHCA

SEQ ID NO: 1500996 - protein, 18 aa, Mycobacterium tuberculosis
KGFAGFPIGGRFLRAGNP

SEQ ID NO: 1500997 - protein, 17 aa, Mycobacterium tuberculosis
KGFHWEPTAAYRRASVT

SEQ ID NO: 1500998 - protein, 19 aa, Mycobacterium tuberculosis
KGLEFVRPVAVDLTYIPVV

SEQ ID NO: 1500999 - protein, 21 aa, Mycobacterium tuberculosis
KGLRTRSEMIAQLVFAMGGRA

SEQ ID NO: 1501000 - protein, 19 aa, Mycobacterium tuberculosis
KGPDFPTAGLIVGSQGTAD

SEQ ID NO: 1501001 - protein, 20 aa, Mycobacterium tuberculosis
KGSALVPSWVAFAVTGLLEQ

SEQ ID NO: 1501002 - protein, 18 aa, Mycobacterium tuberculosis
KGVPGRWRLCVLMTTPPA

SEQ ID NO: 1501003 - protein, 19 aa, Mycobacterium tuberculosis
KHFRCVSVDLLARRPVVHR

SEQ ID NO: 1501004 - protein, 18 aa, Mycobacterium tuberculosis
KHLCAQMLCRAEQADVAA

SEQ ID NO: 1501005 - protein, 26 aa, Mycobacterium tuberculosis
KIDVSGGLPAFTLFPGGLNIPQNAIP

SEQ ID NO: 1501006 - protein, 23 aa, Mycobacterium tuberculosis
KKFRFPTFLGAFKYYTSYTLKTF

SEQ ID NO: 1501007 - protein, 31 aa, Mycobacterium tuberculosis
KKRRRRCRRRAWPPRRLRPPTARVRCSVAWR

SEQ ID NO: 1501008 - protein, 19 aa, Mycobacterium tuberculosis
KLREIRMALTLDKTFTKSE

SEQ ID NO: 1501009 - protein, 17 aa, Mycobacterium tuberculosis
KLRQGSYFPDWLLQRRK

SEQ ID NO: 1501010 - protein, 19 aa, Mycobacterium tuberculosis
KMNRFFLRGALVARLLSQS

SEQ ID NO: 1501011 - protein, 20 aa, Mycobacterium tuberculosis
KMNRFFLRGALVARLLSQSA

SEQ ID NO: 1501012 - protein, 18 aa, Mycobacterium tuberculosis
KMRISGPAVRWVMTGWQR

SEQ ID NO: 1501013 - protein, 17 aa, Mycobacterium tuberculosis
KNNPWLSGTAHIRNRDR

SEQ ID NO: 1501014 - protein, 17 aa, Mycobacterium tuberculosis
KPFLMPVEDVFTITGRG

SEQ ID NO: 1501015 - protein, 25 aa, Mycobacterium tuberculosis
KPRLWKPRQRKLWQWEPGQWKHRKY

SEQ ID NO: 1501016 - protein, 20 aa, Mycobacterium tuberculosis
KPSPWMRIGAGSVHPVTATR

SEQ ID NO: 1501017 - protein, 19 aa, Mycobacterium tuberculosis
KPSVCTLLLPSLATGVDDR

SEQ ID NO: 1501018 - protein, 17 aa, Mycobacterium tuberculosis
KQCPLLYRFRAIDRLPE

SEQ ID NO: 1501019 - protein, 17 aa, Mycobacterium tuberculosis
KQLFGYLVWRDTKAAIL

SEQ ID NO: 1501020 - protein, 28 aa, Mycobacterium tuberculosis
KRGAAAFPWCCGRPVLAKLMAGRTTLMV

SEQ ID NO: 1501021 - protein, 20 aa, Mycobacterium tuberculosis
KRSPNWQRWWPLDSRRPAAL

SEQ ID NO: 1501022 - protein, 19 aa, Mycobacterium tuberculosis
KRVCRDCGFFLPLAGSLGA

SEQ ID NO: 1501023 - protein, 20 aa, Mycobacterium tuberculosis
KRVLPGLGYRLTSRGVRVAT

SEQ ID NO: 1501024 - protein, 17 aa, Mycobacterium tuberculosis
KRVPWAPLPPSPPVPPV

SEQ ID NO: 1501025 - protein, 19 aa, Mycobacterium tuberculosis
KRYALPHARILMHQPLGGV

SEQ ID NO: 1501026 - protein, 20 aa, Mycobacterium tuberculosis
KRYALPHARILMHQPLGGVT

SEQ ID NO: 1501027 - protein, 20 aa, Mycobacterium tuberculosis
KSAYHALTFGWLMSGLARAV

SEQ ID NO: 1501028 - protein, 18 aa, Mycobacterium tuberculosis
KSLLRLLGIGSPTWGRWR

SEQ ID NO: 1501029 - protein, 21 aa, Mycobacterium tuberculosis
KSTWRSVPLVGHIPSAPGNPG

SEQ ID NO: 1501030 - protein, 28 aa, Mycobacterium tuberculosis
KTIAEVVNGFGWRGPLGVTYPGVVTHGV

SEQ ID NO: 1501031 - protein, 22 aa, Mycobacterium tuberculosis
KTLRFWLDRGVEGFRIDMSHAM

SEQ ID NO: 1501032 - protein, 18 aa, Mycobacterium tuberculosis
KTRLAALRVKDFGKREVM

SEQ ID NO: 1501033 - protein, 17 aa, Mycobacterium tuberculosis
KVFLNLLRTRFETDKDK

SEQ ID NO: 1501034 - protein, 18 aa, Mycobacterium tuberculosis
KVPRAARVAVRWLRAVAL

SEQ ID NO: 1501035 - protein, 17 aa, Mycobacterium tuberculosis
KVVICLVNGWAAGGGHS

SEQ ID NO: 1501036 - protein, 24 aa, Mycobacterium tuberculosis
KVWRGGARPVFWLSLDGGRPRCAR

SEQ ID NO: 1501037 - protein, 19 aa, Mycobacterium tuberculosis
KYLPLAPFRISYAYTNFGV

SEQ ID NO: 1501038 - protein, 17 aa, Mycobacterium tuberculosis
LAAAVGISWTSELLTVT

SEQ ID NO: 1501039 - protein, 17 aa, Mycobacterium tuberculosis
LAAELAVAASSFGSVTS

SEQ ID NO: 1501040 - protein, 19 aa, Mycobacterium tuberculosis
LAALGRPLIGNGADGAPGT

SEQ ID NO: 1501041 - protein, 19 aa, Mycobacterium tuberculosis
LAATIARRLGLTGALGTVA

SEQ ID NO: 1501042 - protein, 17 aa, Mycobacterium tuberculosis
LADCWRIAAKSLRPLPV

SEQ ID NO: 1501043 - protein, 17 aa, Mycobacterium tuberculosis
LADHVIAGVVLLAGAAF

SEQ ID NO: 1501044 - protein, 17 aa, Mycobacterium tuberculosis
LADQAVRQWGFMQGLKQ

SEQ ID NO: 1501045 - protein, 17 aa, Mycobacterium tuberculosis
LADRPVVVAARLDRAAL

SEQ ID NO: 1501046 - protein, 22 aa, Mycobacterium tuberculosis
LAEAGWPVRVWAAALPQQTTSA

SEQ ID NO: 1501047 - protein, 22 aa, Mycobacterium tuberculosis
LAEIRHWLQIFVQRFYSFSQFK

SEQ ID NO: 1501048 - protein, 18 aa, Mycobacterium tuberculosis
LAELLAMRGIDGLPFSWT

SEQ ID NO: 1501049 - protein, 21 aa, Mycobacterium tuberculosis
LAELRLALMHGRLSADDKDAA

SEQ ID NO: 1501050 - protein, 18 aa, Mycobacterium tuberculosis
LAEVLAWQAYVGFAGEGD

SEQ ID NO: 1501051 - protein, 17 aa, Mycobacterium tuberculosis
LAFTAFPKKIWRQIWSN

SEQ ID NO: 1501052 - protein, 17 aa, Mycobacterium tuberculosis
LAFTAFPKQIWRQIWSN

SEQ ID NO: 1501053 - protein, 17 aa, Mycobacterium tuberculosis
LAGNLFGQNGIQGVGGS

SEQ ID NO: 1501054 - protein, 17 aa, Mycobacterium tuberculosis
LAHAWLRRGALRIGRAT

SEQ ID NO: 1501055 - protein, 23 aa, Mycobacterium tuberculosis
LAHPCPMCYGSLYYCSLDEVVFL

SEQ ID NO: 1501056 - protein, 20 aa, Mycobacterium tuberculosis
LAIMRLRMLRRRSVRFFGTY

SEQ ID NO: 1501057 - protein, 17 aa, Mycobacterium tuberculosis
LAISALFGQHAQAYQAL

SEQ ID NO: 1501058 - protein, 19 aa, Mycobacterium tuberculosis
LAKLARAGFRVSDVKPPSS

SEQ ID NO: 1501059 - protein, 21 aa, Mycobacterium tuberculosis
LALQFGWRLFAPMLRSATGID

SEQ ID NO: 1501060 - protein, 25 aa, Mycobacterium tuberculosis
LALTELWCSYGVRPDLVIGHSMGEV

SEQ ID NO: 1501061 - protein, 19 aa, Mycobacterium tuberculosis
LANAGAWRIGCAGSAQVGA

SEQ ID NO: 1501062 - protein, 17 aa, Mycobacterium tuberculosis
LAPLHGWGSDGADTIGA

SEQ ID NO: 1501063 - protein, 18 aa, Mycobacterium tuberculosis
LAPLRGGYIADITPLGGG

SEQ ID NO: 1501064 - protein, 23 aa, Mycobacterium tuberculosis
LAPRCQKVLEGTGFVISPDRVMT

SEQ ID NO: 1501065 - protein, 17 aa, Mycobacterium tuberculosis
LARALRHLLLLWGALPE

SEQ ID NO: 1501066 - protein, 18 aa, Mycobacterium tuberculosis
LARDRWAVPLVHTAHTLA

SEQ ID NO: 1501067 - protein, 18 aa, Mycobacterium tuberculosis
LARFGAWYEMFPRSTGGW

SEQ ID NO: 1501068 - protein, 22 aa, Mycobacterium tuberculosis
LARLYGWHRAMRIFDGPDEVHL

SEQ ID NO: 1501069 - protein, 18 aa, Mycobacterium tuberculosis
LASCPPILVLTGRPDDTW

SEQ ID NO: 1501070 - protein, 17 aa, Mycobacterium tuberculosis
LASRIYTDFTYRPGSTT

SEQ ID NO: 1501071 - protein, 20 aa, Mycobacterium tuberculosis
LATQCWPPRVAGCAAAGLSN

SEQ ID NO: 1501072 - protein, 18 aa, Mycobacterium tuberculosis
LATVITWHRHIAGLIEQA

SEQ ID NO: 1501073 - protein, 17 aa, Mycobacterium tuberculosis
LAVLVATNFFGINTIPI

SEQ ID NO: 1501074 - protein, 20 aa, Mycobacterium tuberculosis
LAVVLRATWAVARVLTDRGL

SEQ ID NO: 1501075 - protein, 24 aa, Mycobacterium tuberculosis
LAVYRLAWAALRGCPTSSVRTAFY

SEQ ID NO: 1501076 - protein, 29 aa, Mycobacterium tuberculosis
LAYRPVCRPAWLPTLRRPWRRSPERPSSW

SEQ ID NO: 1501077 - protein, 21 aa, Mycobacterium tuberculosis
LCGALRRYHEALGVPISTLPM

SEQ ID NO: 1501078 - protein, 21 aa, Mycobacterium tuberculosis
LCPGPSWRAWRVRRSCARSSP

SEQ ID NO: 1501079 - protein, 20 aa, Mycobacterium tuberculosis
LCPQCGVPLASEPGHRHEQI

SEQ ID NO: 1501080 - protein, 17 aa, Mycobacterium tuberculosis
LCQILYWRGVGTCISGD

SEQ ID NO: 1501081 - protein, 19 aa, Mycobacterium tuberculosis
LCRAAGVPARIAFQTIDAP

SEQ ID NO: 1501082 - protein, 19 aa, Mycobacterium tuberculosis
LCTDDLRVARIRGCGADEL

SEQ ID NO: 1501083 - protein, 26 aa, Mycobacterium tuberculosis
LCWIAGCARYRPGWPESCTLPVRASV

SEQ ID NO: 1501084 - protein, 17 aa, Mycobacterium tuberculosis
LDDGWLTLLRRWLNDAQ

SEQ ID NO: 1501085 - protein, 18 aa, Mycobacterium tuberculosis
LDEYVDWLIEAGYPIRRI

SEQ ID NO: 1501086 - protein, 17 aa, Mycobacterium tuberculosis
LDGAGWLVHVLLDPRRV

SEQ ID NO: 1501087 - protein, 17 aa, Mycobacterium tuberculosis
LDIDWVIGGCMSVDPTH

SEQ ID NO: 1501088 - protein, 18 aa, Mycobacterium tuberculosis
LDIGCGWGGGLQRAIENY

SEQ ID NO: 1501089 - protein, 20 aa, Mycobacterium tuberculosis
LDIPRVPVTLNYLFGSQPGG

SEQ ID NO: 1501090 - protein, 18 aa, Mycobacterium tuberculosis
LDKGGGRLPITLWIVDTN

SEQ ID NO: 1501091 - protein, 24 aa, Mycobacterium tuberculosis
LDKYARLFAWLGLWERHTDLAVIP

SEQ ID NO: 1501092 - protein, 17 aa, Mycobacterium tuberculosis
LDLRVATVAARRRRPPP

SEQ ID NO: 1501093 - protein, 18 aa, Mycobacterium tuberculosis
LDLWAAAYPGVWAGPTNS

SEQ ID NO: 1501094 - protein, 17 aa, Mycobacterium tuberculosis
LDPLCRVNSAMAGRQQG

SEQ ID NO: 1501095 - protein, 20 aa, Mycobacterium tuberculosis
LDQPCSFYDWRRSAADGPRL

SEQ ID NO: 1501096 - protein, 22 aa, Mycobacterium tuberculosis
LDSRAWRLPWPDGTVVYELDQP

SEQ ID NO: 1501097 - protein, 20 aa, Mycobacterium tuberculosis
LDVGCGWGGALVRAVEKYDV

SEQ ID NO: 1501098 - protein, 18 aa, Mycobacterium tuberculosis
LDVYRVGQNVAWQRWTEI

SEQ ID NO: 1501099 - protein, 17 aa, Mycobacterium tuberculosis
LDWKSVWDHGWSAAAEA

SEQ ID NO: 1501100 - protein, 20 aa, Mycobacterium tuberculosis
LDYDCPRPALKKATAITPGL

SEQ ID NO: 1501101 - protein, 21 aa, Mycobacterium tuberculosis
LEAGMKLGWHPYHFPDEPDSK

SEQ ID NO: 1501102 - protein, 21 aa, Mycobacterium tuberculosis
LEAGMKLGWHPYQFPDEPDSK

SEQ ID NO: 1501103 - protein, 17 aa, Mycobacterium tuberculosis
LEALLNFQTLVTDLTGL

SEQ ID NO: 1501104 - protein, 17 aa, Mycobacterium tuberculosis
LEGGYAVGFARMGFQVL

SEQ ID NO: 1501105 - protein, 17 aa, Mycobacterium tuberculosis
LELGFAAARRFSSDPQS

SEQ ID NO: 1501106 - protein, 17 aa, Mycobacterium tuberculosis
LELLRYLAVELLPGPLG

SEQ ID NO: 1501107 - protein, 18 aa, Mycobacterium tuberculosis
LEMGCFLQPIFTGDRGGP

SEQ ID NO: 1501108 - protein, 20 aa, Mycobacterium tuberculosis
LEPGSAIAWIVRLTGGFEET

SEQ ID NO: 1501109 - protein, 18 aa, Mycobacterium tuberculosis
LERGRYDLVLALASTHTG

SEQ ID NO: 1501110 - protein, 20 aa, Mycobacterium tuberculosis
LEVEEVYLPLARLIHLQVAA

SEQ ID NO: 1501111 - protein, 21 aa, Mycobacterium tuberculosis
LEVIETHLLFGIPYDRIDVVV

SEQ ID NO: 1501112 - protein, 18 aa, Mycobacterium tuberculosis
LEYHWGPDWVCWDADQTF

SEQ ID NO: 1501113 - protein, 17 aa, Mycobacterium tuberculosis
LFFWVARMMMFGTFVGD

SEQ ID NO: 1501114 - protein, 19 aa, Mycobacterium tuberculosis
LFGSVRSGLNTGLFNMGTA

SEQ ID NO: 1501115 - protein, 17 aa, Mycobacterium tuberculosis
LFIKPGWGFSFDYQPGQ

SEQ ID NO: 1501116 - protein, 17 aa, Mycobacterium tuberculosis
LFLRAAQAYGVKRGQRM

SEQ ID NO: 1501117 - protein, 20 aa, Mycobacterium tuberculosis
LFPRGLAAFIELRDQRCRTP

SEQ ID NO: 1501118 - protein, 18 aa, Mycobacterium tuberculosis
LFPRSVFHSLKLAEHNLA

SEQ ID NO: 1501119 - protein, 18 aa, Mycobacterium tuberculosis
LFRAIALALERPLDPDRP

SEQ ID NO: 1501120 - protein, 18 aa, Mycobacterium tuberculosis
LFYSGFYLPMYWSSRAKL

SEQ ID NO: 1501121 - protein, 18 aa, Mycobacterium tuberculosis
LGAAMTRLACERASVGDD

SEQ ID NO: 1501122 - protein, 17 aa, Mycobacterium tuberculosis
LGADRPLLHSSFGHLEG

SEQ ID NO: 1501123 - protein, 19 aa, Mycobacterium tuberculosis
LGAIGIDLTDVFAVLEEEG

SEQ ID NO: 1501124 - protein, 21 aa, Mycobacterium tuberculosis
LGALSSWYVWAALGLYPSTPG

SEQ ID NO: 1501125 - protein, 17 aa, Mycobacterium tuberculosis
LGASFAEFGGWLMPVSY

SEQ ID NO: 1501126 - protein, 19 aa, Mycobacterium tuberculosis
LGCGTGFFLLNLIQAGVAR

SEQ ID NO: 1501127 - protein, 18 aa, Mycobacterium tuberculosis
LGDARWLASIATPGRDEV

SEQ ID NO: 1501128 - protein, 18 aa, Mycobacterium tuberculosis
LGEGCCFRVSLPRVSDVD

SEQ ID NO: 1501129 - protein, 20 aa, Mycobacterium tuberculosis
LGELFAYRWSRCGGREEWVM

SEQ ID NO: 1501130 - protein, 17 aa, Mycobacterium tuberculosis
LGELWVAAARMRQVDQL

SEQ ID NO: 1501131 - protein, 17 aa, Mycobacterium tuberculosis
LGGGNWGFANLGSGNIG

SEQ ID NO: 1501132 - protein, 18 aa, Mycobacterium tuberculosis
LGGGNWGFANLGSGNIGN

SEQ ID NO: 1501133 - protein, 23 aa, Mycobacterium tuberculosis
LGGGSFGLPGLNGSGGDGGDGGN

SEQ ID NO: 1501134 - protein, 24 aa, Mycobacterium tuberculosis
LGGKCPQCGTYVFPPRADNCPNPA

SEQ ID NO: 1501135 - protein, 17 aa, Mycobacterium tuberculosis
LGGKFPLKAGMLTSLGF

SEQ ID NO: 1501136 - protein, 17 aa, Mycobacterium tuberculosis
LGHRLTIAMTRWQALVN

SEQ ID NO: 1501137 - protein, 17 aa, Mycobacterium tuberculosis
LGIDCIWLPPFYDSPLR

SEQ ID NO: 1501138 - protein, 17 aa, Mycobacterium tuberculosis
LGKLLTKRARVIGTTLR

SEQ ID NO: 1501139 - protein, 17 aa, Mycobacterium tuberculosis
LGLIGTRWRPIDPGPDR

SEQ ID NO: 1501140 - protein, 17 aa, Mycobacterium tuberculosis
LGLRSGLSAGLAHAASA

SEQ ID NO: 1501141 - protein, 18 aa, Mycobacterium tuberculosis
LGLSRAWDKATLRIVSKA

SEQ ID NO: 1501142 - protein, 17 aa, Mycobacterium tuberculosis
LGLVVARWLVDRGAGRV

SEQ ID NO: 1501143 - protein, 20 aa, Mycobacterium tuberculosis
LGNGNFGFGNAFGDGNLGSG

SEQ ID NO: 1501144 - protein, 18 aa, Mycobacterium tuberculosis
LGPRGRHVVLAKAFGGPT

SEQ ID NO: 1501145 - protein, 24 aa, Mycobacterium tuberculosis
LGRDLRCGGCFALGQTDDPMIVAH

SEQ ID NO: 1501146 - protein, 20 aa, Mycobacterium tuberculosis
LGSAFGPGGTGGMGGAGGTS

SEQ ID NO: 1501147 - protein, 21 aa, Mycobacterium tuberculosis
LGSRSALGWIIDRYRVTTDKA

SEQ ID NO: 1501148 - protein, 19 aa, Mycobacterium tuberculosis
LGTFSWPGAYGTWWQADPS

SEQ ID NO: 1501149 - protein, 19 aa, Mycobacterium tuberculosis
LGVDEVWAVGGAQAVALLA

SEQ ID NO: 1501150 - protein, 18 aa, Mycobacterium tuberculosis
LGVQFARQGIRVNALCPG

SEQ ID NO: 1501151 - protein, 19 aa, Mycobacterium tuberculosis
LHCGPCGSGHFVKMVHNGI

SEQ ID NO: 1501152 - protein, 17 aa, Mycobacterium tuberculosis
LHEIYKLGVVSIPTNMP

SEQ ID NO: 1501153 - protein, 18 aa, Mycobacterium tuberculosis
LHEVVGWWAKLPVTGMQP

SEQ ID NO: 1501154 - protein, 33 aa, Mycobacterium tuberculosis
LHHFGAFYKRSWRANDWMWGRLDGAGWLVHVLL

SEQ ID NO: 1501155 - protein, 17 aa, Mycobacterium tuberculosis
LHKELYREYSLRPPKGV

SEQ ID NO: 1501156 - protein, 18 aa, Mycobacterium tuberculosis
LHLPGVAFGHDWLTGTSR

SEQ ID NO: 1501157 - protein, 19 aa, Mycobacterium tuberculosis
LHQPYLMGCLSPRNELSQI

SEQ ID NO: 1501158 - protein, 25 aa, Mycobacterium tuberculosis
LIAMPALRLDAAFAHLNLGDSHGNA

SEQ ID NO: 1501159 - protein, 17 aa, Mycobacterium tuberculosis
LIDREWRHGVRVGVETA

SEQ ID NO: 1501160 - protein, 17 aa, Mycobacterium tuberculosis
LIGKCLRPLPNKWKGLL

SEQ ID NO: 1501161 - protein, 18 aa, Mycobacterium tuberculosis
LIGPEWFPDSYPWVPSIN

SEQ ID NO: 1501162 - protein, 18 aa, Mycobacterium tuberculosis
LIKDGRLAPDFDDEVIAQ

SEQ ID NO: 1501163 - protein, 20 aa, Mycobacterium tuberculosis
LIYPRHRALKAASGQSRPHT

SEQ ID NO: 1501164 - protein, 19 aa, Mycobacterium tuberculosis
LKAAECRAGARAWRRHEPQ

SEQ ID NO: 1501165 - protein, 17 aa, Mycobacterium tuberculosis
LKACIKAAADRVVFINT

SEQ ID NO: 1501166 - protein, 17 aa, Mycobacterium tuberculosis
LKFYASVRMDVRRVETL

SEQ ID NO: 1501167 - protein, 18 aa, Mycobacterium tuberculosis
LKGFDGFDGGSGGAGGDG

SEQ ID NO: 1501168 - protein, 20 aa, Mycobacterium tuberculosis
LKGVPGRWRLCVIMRDDATR

SEQ ID NO: 1501169 - protein, 20 aa, Mycobacterium tuberculosis
LKLLAFRGRFVEIGKRDIYG

SEQ ID NO: 1501170 - protein, 20 aa, Mycobacterium tuberculosis
LKLNRFGAAVGVLAAGALVL

SEQ ID NO: 1501171 - protein, 19 aa, Mycobacterium tuberculosis
LKNEYPGKIFAILDSDHSM

SEQ ID NO: 1501172 - protein, 20 aa, Mycobacterium tuberculosis
LKPILWCPGKATAVQRFAAE

SEQ ID NO: 1501173 - protein, 18 aa, Mycobacterium tuberculosis
LKQLFGYLVWRDTKAAIL

SEQ ID NO: 1501174 - protein, 18 aa, Mycobacterium tuberculosis
LKTSCAWAQARRDGQDPY

SEQ ID NO: 1501175 - protein, 23 aa, Mycobacterium tuberculosis
LKVRLRQGLPLARLGAAERERAE

SEQ ID NO: 1501176 - protein, 21 aa, Mycobacterium tuberculosis
LKYLPLAPFRISYAYTNFGVT

SEQ ID NO: 1501177 - protein, 18 aa, Mycobacterium tuberculosis
LLAFRGRFVEIGKRDIYG

SEQ ID NO: 1501178 - protein, 20 aa, Mycobacterium tuberculosis
LLALRIPWYVTVLDLGSAGA

SEQ ID NO: 1501179 - protein, 20 aa, Mycobacterium tuberculosis
LLDFSFPVGPLIPQTHLVHL

SEQ ID NO: 1501180 - protein, 23 aa, Mycobacterium tuberculosis
LLERGRYDLVLALASIHTGDGTV

SEQ ID NO: 1501181 - protein, 18 aa, Mycobacterium tuberculosis
LLGKSAYHALTFGWLMSG

SEQ ID NO: 1501182 - protein, 27 aa, Mycobacterium tuberculosis
LLGPVGDLFPILSIPGAMSQNFTNVVM

SEQ ID NO: 1501183 - protein, 17 aa, Mycobacterium tuberculosis
LLGRPLIGDGANGGPGQ

SEQ ID NO: 1501184 - protein, 17 aa, Mycobacterium tuberculosis
LLGRPLIGNGANGAPGT

SEQ ID NO: 1501185 - protein, 23 aa, Mycobacterium tuberculosis
LLGSRSALGWIIDRYRVTTDKAS

SEQ ID NO: 1501186 - protein, 20 aa, Mycobacterium tuberculosis
LLIKDGRLAPDFDDEVIAQS

SEQ ID NO: 1501187 - protein, 19 aa, Mycobacterium tuberculosis
LLKPFARRYFQAIPGVWAR

SEQ ID NO: 1501188 - protein, 25 aa, Mycobacterium tuberculosis
LLKVRLRQGLPFARLGAAERERAEA

SEQ ID NO: 1501189 - protein, 17 aa, Mycobacterium tuberculosis
LLLEFANELPALPSHLA

SEQ ID NO: 1501190 - protein, 17 aa, Mycobacterium tuberculosis
LLLETSWEAMEHAGLTQ

SEQ ID NO: 1501191 - protein, 18 aa, Mycobacterium tuberculosis
LLLETSWEAMEHAGLTQQ

SEQ ID NO: 1501192 - protein, 19 aa, Mycobacterium tuberculosis
LLLEVSWEALERAGIDPIT

SEQ ID NO: 1501193 - protein, 18 aa, Mycobacterium tuberculosis
LLLRGSPCAIGWVAGWLS

SEQ ID NO: 1501194 - protein, 17 aa, Mycobacterium tuberculosis
LLNRLWPLVSLRCNFFT

SEQ ID NO: 1501195 - protein, 18 aa, Mycobacterium tuberculosis
LLNRLWPLVSLRCNFFTP

SEQ ID NO: 1501196 - protein, 23 aa, Mycobacterium tuberculosis
LLPKRRPSTCCSWPTAASSKSTV

SEQ ID NO: 1501197 - protein, 18 aa, Mycobacterium tuberculosis
LLPQVFRWARTVDPVQPL

SEQ ID NO: 1501198 - protein, 21 aa, Mycobacterium tuberculosis
LLPTVRGAFCLTFMDENTLYA

SEQ ID NO: 1501199 - protein, 20 aa, Mycobacterium tuberculosis
LLQFRCGRQLGLRQQRLGPL

SEQ ID NO: 1501200 - protein, 18 aa, Mycobacterium tuberculosis
LLSESGWYSALFGMQHET

SEQ ID NO: 1501201 - protein, 24 aa, Mycobacterium tuberculosis
LLSFERWAPDMGWEIATGKSVLAG

SEQ ID NO: 1501202 - protein, 20 aa, Mycobacterium tuberculosis
LLSVEWLRGRCDPYDVALRF

SEQ ID NO: 1501203 - protein, 22 aa, Mycobacterium tuberculosis
LLVFGRRAGLGAADYVRALSSR

SEQ ID NO: 1501204 - protein, 21 aa, Mycobacterium tuberculosis
LLWRGDHEGLFSLFYSLDVPR

SEQ ID NO: 1501205 - protein, 28 aa, Mycobacterium tuberculosis
LMERLYKTSWRFAPFLWQEIEEGILPAL

SEQ ID NO: 1501206 - protein, 20 aa, Mycobacterium tuberculosis
LMPASSAARCAARIVGGPRL

SEQ ID NO: 1501207 - protein, 18 aa, Mycobacterium tuberculosis
LMPLPIALAHRLSRRLTE

SEQ ID NO: 1501208 - protein, 17 aa, Mycobacterium tuberculosis
LMRRSGMIFIRRNIGNG

SEQ ID NO: 1501209 - protein, 20 aa, Mycobacterium tuberculosis
LMRSCTGWPSGVWIDQPRRT

SEQ ID NO: 1501210 - protein, 18 aa, Mycobacterium tuberculosis
LNAEWRLVSDHIRAIVAL

SEQ ID NO: 1501211 - protein, 17 aa, Mycobacterium tuberculosis
LNARFALNAANARWGSL

SEQ ID NO: 1501212 - protein, 23 aa, Mycobacterium tuberculosis
LNCGRPPRFCRRVGVRPPAPAAL

SEQ ID NO: 1501213 - protein, 17 aa, Mycobacterium tuberculosis
LNGSCGDGGDGGNGAPG

SEQ ID NO: 1501214 - protein, 23 aa, Mycobacterium tuberculosis
LNLKEWKAEWGVADPREARGALT

SEQ ID NO: 1501215 - protein, 17 aa, Mycobacterium tuberculosis
LNLLRWTSARSIKETFV

SEQ ID NO: 1501216 - protein, 19 aa, Mycobacterium tuberculosis
LNPQLSWSPPAQRRMNPMA

SEQ ID NO: 1501217 - protein, 17 aa, Mycobacterium tuberculosis
LNRIACRQSIPAIAAEL

SEQ ID NO: 1501218 - protein, 18 aa, Mycobacterium tuberculosis
LNSAFSFGGPKCLVKVIQ

SEQ ID NO: 1501219 - protein, 17 aa, Mycobacterium tuberculosis
LNSKTRRPSVCNAAETL

SEQ ID NO: 1501220 - protein, 22 aa, Mycobacterium tuberculosis
LNVLPRRVIALWSDKGKHVALA

SEQ ID NO: 1501221 - protein, 17 aa, Mycobacterium tuberculosis
LPAGHGLNVNTLSYGDL

SEQ ID NO: 1501222 - protein, 18 aa, Mycobacterium tuberculosis
LPAKRWLAQRGFDPVYGA

SEQ ID NO: 1501223 - protein, 17 aa, Mycobacterium tuberculosis
LPAPLGLQCHADPDGRD

SEQ ID NO: 1501224 - protein, 17 aa, Mycobacterium tuberculosis
LPARFGVEQVRELASRD

SEQ ID NO: 1501225 - protein, 18 aa, Mycobacterium tuberculosis
LPASIPWTALWLSQAWQQ

SEQ ID NO: 1501226 - protein, 20 aa, Mycobacterium tuberculosis
LPAVRVGRSFRVHAKAVHDM

SEQ ID NO: 1501227 - protein, 17 aa, Mycobacterium tuberculosis
LPDFKWPPTPGSPLFPD

SEQ ID NO: 1501228 - protein, 17 aa, Mycobacterium tuberculosis
LPGDGAQAFACSRKHGW

SEQ ID NO: 1501229 - protein, 18 aa, Mycobacterium tuberculosis
LPGGHFRSDIGLRAAEGK

SEQ ID NO: 1501230 - protein, 17 aa, Mycobacterium tuberculosis
LPGLRGWRRPQGELDES

SEQ ID NO: 1501231 - protein, 17 aa, Mycobacterium tuberculosis
LPGSLIDRAEFEAENRR

SEQ ID NO: 1501232 - protein, 23 aa, Mycobacterium tuberculosis
LPIFGFGGAPGFGNDTTAPSSGF

SEQ ID NO: 1501233 - protein, 17 aa, Mycobacterium tuberculosis
LPITLWPGMKIGQLCML

SEQ ID NO: 1501234 - protein, 17 aa, Mycobacterium tuberculosis
LPKGLGVIGLLIEDPKP

SEQ ID NO: 1501235 - protein, 18 aa, Mycobacterium tuberculosis
LPKGRLSDMVRRILRSMF

SEQ ID NO: 1501236 - protein, 26 aa, Mycobacterium tuberculosis
LPKLGERLNLPAGWSYHTRVLTSELR

SEQ ID NO: 1501237 - protein, 18 aa, Mycobacterium tuberculosis
LPKLRLGKVLQISGPADL

SEQ ID NO: 1501238 - protein, 19 aa, Mycobacterium tuberculosis
LPLDRAAVIIADLAQSTPT

SEQ ID NO: 1501239 - protein, 17 aa, Mycobacterium tuberculosis
LPLFGYAAMPAYDVVDG

SEQ ID NO: 1501240 - protein, 19 aa, Mycobacterium tuberculosis
LPLGFMVEFDRAGVLVEAE

SEQ ID NO: 1501241 - protein, 21 aa, Mycobacterium tuberculosis
LPLKTSCAWAQARRDGQDPYP

SEQ ID NO: 1501242 - protein, 21 aa, Mycobacterium tuberculosis
LPLPHLRAWDGAPWIWNLATA

SEQ ID NO: 1501243 - protein, 18 aa, Mycobacterium tuberculosis
LPLRRLGAGVGRIAGSPK

SEQ ID NO: 1501244 - protein, 21 aa, Mycobacterium tuberculosis
LPLTLWLARFLKFIATEIFPG

SEQ ID NO: 1501245 - protein, 21 aa, Mycobacterium tuberculosis
LPPDINSALMFAGPGSGPLIA

SEQ ID NO: 1501246 - protein, 21 aa, Mycobacterium tuberculosis
LPPEFRAAVVLCDIEGLSYEE

SEQ ID NO: 1501247 - protein, 17 aa, Mycobacterium tuberculosis
LPPILPISGQQRLSLNR

SEQ ID NO: 1501248 - protein, 18 aa, Mycobacterium tuberculosis
LPPLRYWVLPGKRPTRAP

SEQ ID NO: 1501249 - protein, 17 aa, Mycobacterium tuberculosis
LPPSGVPYLLGIQSVLV

SEQ ID NO: 1501250 - protein, 17 aa, Mycobacterium tuberculosis
LPRGGGCAYRRPGPRVR

SEQ ID NO: 1501251 - protein, 18 aa, Mycobacterium tuberculosis
LPRPLRWLAGATRSAVLR

SEQ ID NO: 1501252 - protein, 23 aa, Mycobacterium tuberculosis
LPRSHPPRPPLPPTPPAPPSPPS

SEQ ID NO: 1501253 - protein, 20 aa, Mycobacterium tuberculosis
LPRSRRWLLNLVITRGTPPR

SEQ ID NO: 1501254 - protein, 20 aa, Mycobacterium tuberculosis
LPTVRGAFCLTFMDENTLYA

SEQ ID NO: 1501255 - protein, 17 aa, Mycobacterium tuberculosis
LPVVAGCVFRYIAYHGR

SEQ ID NO: 1501256 - protein, 17 aa, Mycobacterium tuberculosis
LPVWLTQWGYRRPAEDT

SEQ ID NO: 1501257 - protein, 20 aa, Mycobacterium tuberculosis
LPVYRPPLDMARLFNQPELG

SEQ ID NO: 1501258 - protein, 18 aa, Mycobacterium tuberculosis
LPYFSIGMGNNFIQSTKT

SEQ ID NO: 1501259 - protein, 25 aa, Mycobacterium tuberculosis
LQAAVSGLVTALFGAPGQPGDTGQP

SEQ ID NO: 1501260 - protein, 24 aa, Mycobacterium tuberculosis
LQADRAVVVAARLDRAALAGAGAA

SEQ ID NO: 1501261 - protein, 17 aa, Mycobacterium tuberculosis
LQARLGLDSGKWTHEQM

SEQ ID NO: 1501262 - protein, 18 aa, Mycobacterium tuberculosis
LQFDLPIRLFEIGSSAGL

SEQ ID NO: 1501263 - protein, 18 aa, Mycobacterium tuberculosis
LQKEGLNWVTWVVGETTY

SEQ ID NO: 1501264 - protein, 17 aa, Mycobacterium tuberculosis
LQLAIAWAKHSAATAGA

SEQ ID NO: 1501265 - protein, 23 aa, Mycobacterium tuberculosis
LQRRRGGGLSARVRASARSKGLN

SEQ ID NO: 1501266 - protein, 18 aa, Mycobacterium tuberculosis
LQTGVRWKDLGLVVVDQE

SEQ ID NO: 1501267 - protein, 21 aa, Mycobacterium tuberculosis
LQVAEAFGRYGAYLSQLNVLP

SEQ ID NO: 1501268 - protein, 23 aa, Mycobacterium tuberculosis
LQVAEAFGRYGAYLSQLNVLPIY

SEQ ID NO: 1501269 - protein, 17 aa, Mycobacterium tuberculosis
LQYRAFKHVAEMFAELE

SEQ ID NO: 1501270 - protein, 17 aa, Mycobacterium tuberculosis
LRAAAYVNPSRPSSSPP

SEQ ID NO: 1501271 - protein, 17 aa, Mycobacterium tuberculosis
LRAAFAFSRENGDTGHA

SEQ ID NO: 1501272 - protein, 18 aa, Mycobacterium tuberculosis
LRAAFAWSRENDHITEAL

SEQ ID NO: 1501273 - protein, 17 aa, Mycobacterium tuberculosis
LRAANALDFDDLIGETV

SEQ ID NO: 1501274 - protein, 21 aa, Mycobacterium tuberculosis
LRALKRLKVVAAFQQSGNSPM

SEQ ID NO: 1501275 - protein, 18 aa, Mycobacterium tuberculosis
LRASIDWSHALLTETGQI

SEQ ID NO: 1501276 - protein, 17 aa, Mycobacterium tuberculosis
LRAVCGRAAWTLNSSPA

SEQ ID NO: 1501277 - protein, 18 aa, Mycobacterium tuberculosis
LRDEWQIALCNNGFDANR

SEQ ID NO: 1501278 - protein, 18 aa, Mycobacterium tuberculosis
LRDGLCFVDLAPITESGI

SEQ ID NO: 1501279 - protein, 18 aa, Mycobacterium tuberculosis
LREIRMALTLDKTFTKSE

SEQ ID NO: 1501280 - protein, 17 aa, Mycobacterium tuberculosis
LRELTIWSGRYGSVAGV

SEQ ID NO: 1501281 - protein, 17 aa, Mycobacterium tuberculosis
LRFGPLQARDELAACEI

SEQ ID NO: 1501282 - protein, 19 aa, Mycobacterium tuberculosis
LRFGPLQARDELAACEILA

SEQ ID NO: 1501283 - protein, 17 aa, Mycobacterium tuberculosis
LRFGYRTSVLKHADGLA

SEQ ID NO: 1501284 - protein, 19 aa, Mycobacterium tuberculosis
LRGGQTLIGFLAPRNADNS

SEQ ID NO: 1501285 - protein, 19 aa, Mycobacterium tuberculosis
LRGMAARNRLDIVAALQNF

SEQ ID NO: 1501286 - protein, 19 aa, Mycobacterium tuberculosis
LRGRATLYLTYWTAGDTRN

SEQ ID NO: 1501287 - protein, 17 aa, Mycobacterium tuberculosis
LRKEIFELYGYTAVVHV

SEQ ID NO: 1501288 - protein, 20 aa, Mycobacterium tuberculosis
LRLADAWVWDMYRPARFVKQ

SEQ ID NO: 1501289 - protein, 18 aa, Mycobacterium tuberculosis
LRLALGLMLEIGPRGPER

SEQ ID NO: 1501290 - protein, 17 aa, Mycobacterium tuberculosis
LRLGDYDVLVGINLLRE

SEQ ID NO: 1501291 - protein, 19 aa, Mycobacterium tuberculosis
LRLPRGEGLGVPASGYEIH

SEQ ID NO: 1501292 - protein, 26 aa, Mycobacterium tuberculosis
LRNPERVWGWYLWRHYLVANVEPNDG

SEQ ID NO: 1501293 - protein, 20 aa, Mycobacterium tuberculosis
LRPGEWRTLGLFAADDNGEL

SEQ ID NO: 1501294 - protein, 20 aa, Mycobacterium tuberculosis
LRPGPPPTVWSRRWRQRWAP

SEQ ID NO: 1501295 - protein, 24 aa, Mycobacterium tuberculosis
LRPIEGRTAMSFVIANPEMLAAAA

SEQ ID NO: 1501296 - protein, 25 aa, Mycobacterium tuberculosis
LRPIEGRTAMSFVIANPEMLAAAAT

SEQ ID NO: 1501297 - protein, 18 aa, Mycobacterium tuberculosis
LRPMLDRALTVLIDAPEP

SEQ ID NO: 1501298 - protein, 18 aa, Mycobacterium tuberculosis
LRPQQLRWPLAGDQETAR

SEQ ID NO: 1501299 - protein, 17 aa, Mycobacterium tuberculosis
LRPRPNHRPGLPPNTPD

SEQ ID NO: 1501300 - protein, 19 aa, Mycobacterium tuberculosis
LRPRRVCPRAHRYRSLNTV

SEQ ID NO: 1501301 - protein, 17 aa, Mycobacterium tuberculosis
LRPWPGFVPMVYERYSQ

SEQ ID NO: 1501302 - protein, 17 aa, Mycobacterium tuberculosis
LRQLRLVVYDLLVVSID

SEQ ID NO: 1501303 - protein, 19 aa, Mycobacterium tuberculosis
LRRAHGIGGFLGGSGRWLR

SEQ ID NO: 1501304 - protein, 18 aa, Mycobacterium tuberculosis
LRRFSLLDSLYMVPSVPI

SEQ ID NO: 1501305 - protein, 18 aa, Mycobacterium tuberculosis
LRRLEWHFTLVFANADDP

SEQ ID NO: 1501306 - protein, 17 aa, Mycobacterium tuberculosis
LRRLWALPGTQLAVVAW

SEQ ID NO: 1501307 - protein, 17 aa, Mycobacterium tuberculosis
LRRPRATDGEWDQVARC

SEQ ID NO: 1501308 - protein, 20 aa, Mycobacterium tuberculosis
LRSGMTIGIAGWGSRRKPMA

SEQ ID NO: 1501309 - protein, 18 aa, Mycobacterium tuberculosis
LRVDFPWLGTVVQAYLRR

SEQ ID NO: 1501310 - protein, 18 aa, Mycobacterium tuberculosis
LRWAVGAFRLATSGVSDA

SEQ ID NO: 1501311 - protein, 17 aa, Mycobacterium tuberculosis
LRYGRIPARVSGPDPVP

SEQ ID NO: 1501312 - protein, 17 aa, Mycobacterium tuberculosis
LRYNLFFDDRTLDGDQT

SEQ ID NO: 1501313 - protein, 17 aa, Mycobacterium tuberculosis
LSAQAAGFHAQFVQALN

SEQ ID NO: 1501314 - protein, 23 aa, Mycobacterium tuberculosis
LSAQAATFISIFVQPLTAGAGSY

SEQ ID NO: 1501315 - protein, 17 aa, Mycobacterium tuberculosis
LSCCVCKARGDRRHGRR

SEQ ID NO: 1501316 - protein, 18 aa, Mycobacterium tuberculosis
LSGLRARNGLLTASGDNA

SEQ ID NO: 1501317 - protein, 20 aa, Mycobacterium tuberculosis
LSGLRLGKVISISEASGAAP

SEQ ID NO: 1501318 - protein, 21 aa, Mycobacterium tuberculosis
LSGQVGWLARDRWAVPLVHTA

SEQ ID NO: 1501319 - protein, 26 aa, Mycobacterium tuberculosis
LSHGRVSVGVGFGWNTDELVDHGVPP

SEQ ID NO: 1501320 - protein, 18 aa, Mycobacterium tuberculosis
LSKLARPTSTWTYMVNDN

SEQ ID NO: 1501321 - protein, 18 aa, Mycobacterium tuberculosis
LSKRGGGVALLLTNIREH

SEQ ID NO: 1501322 - protein, 23 aa, Mycobacterium tuberculosis
LSLPRRLQIEFSQVIQKIAEGTA

SEQ ID NO: 1501323 - protein, 20 aa, Mycobacterium tuberculosis
LSNILLLGPVGDLFPILSIP

SEQ ID NO: 1501324 - protein, 17 aa, Mycobacterium tuberculosis
LSQRWGRLFVAVCYALR

SEQ ID NO: 1501325 - protein, 20 aa, Mycobacterium tuberculosis
LSSSVPILGPYEDLIANTVA

SEQ ID NO: 1501326 - protein, 17 aa, Mycobacterium tuberculosis
LSVLRSWLAATAGAGAA

SEQ ID NO: 1501327 - protein, 21 aa, Mycobacterium tuberculosis
LSVPVGDGFLGRVVNPLGQPI

SEQ ID NO: 1501328 - protein, 20 aa, Mycobacterium tuberculosis
LSVVVAESWRASALAEMIQE

SEQ ID NO: 1501329 - protein, 18 aa, Mycobacterium tuberculosis
LSYKTGWYGSSLVVADRW

SEQ ID NO: 1501330 - protein, 17 aa, Mycobacterium tuberculosis
LTAAARWYTATEIANAA

SEQ ID NO: 1501331 - protein, 18 aa, Mycobacterium tuberculosis
LTAAARWYTATEIANAAA

SEQ ID NO: 1501332 - protein, 24 aa, Mycobacterium tuberculosis
LTAWAVGWLPYIGILAPQINFFYY

SEQ ID NO: 1501333 - protein, 17 aa, Mycobacterium tuberculosis
LTEFSVWVVFMMESGSR

SEQ ID NO: 1501334 - protein, 18 aa, Mycobacterium tuberculosis
LTEYGWRAAGELRKGDRV

SEQ ID NO: 1501335 - protein, 17 aa, Mycobacterium tuberculosis
LTGAWPGLRCDVDTPAD

SEQ ID NO: 1501336 - protein, 17 aa, Mycobacterium tuberculosis
LTGRPLIGNGANGTPGT

SEQ ID NO: 1501337 - protein, 24 aa, Mycobacterium tuberculosis
LTLPRPTVVTGLRLAASRSMLPAH

SEQ ID NO: 1501338 - protein, 19 aa, Mycobacterium tuberculosis
LTLTELWRSYGVQPDLVIG

SEQ ID NO: 1501339 - protein, 19 aa, Mycobacterium tuberculosis
LTRMHRFWISLYFPLTMRS

SEQ ID NO: 1501340 - protein, 17 aa, Mycobacterium tuberculosis
LTRPCAHLRSLLHEALI

SEQ ID NO: 1501341 - protein, 18 aa, Mycobacterium tuberculosis
LVAQAWHWVDPRPGDSGG

SEQ ID NO: 1501342 - protein, 21 aa, Mycobacterium tuberculosis
LVIPVCTRLGLSPPDVRTLSK

SEQ ID NO: 1501343 - protein, 24 aa, Mycobacterium tuberculosis
LVNSWSAAFARYGRTVGQVLLTAH

SEQ ID NO: 1501344 - protein, 22 aa, Mycobacterium tuberculosis
LVPEYIGNLLLYFQPDATVTML

SEQ ID NO: 1501345 - protein, 18 aa, Mycobacterium tuberculosis
LVPGWTKPIVIGRHAFGD

SEQ ID NO: 1501346 - protein, 19 aa, Mycobacterium tuberculosis
LVPHCCWPTKPVPIAAHRA

SEQ ID NO: 1501347 - protein, 18 aa, Mycobacterium tuberculosis
LVPTPGDGNIGLFNSGSG

SEQ ID NO: 1501348 - protein, 17 aa, Mycobacterium tuberculosis
LVRAAACTMFFGETAES

SEQ ID NO: 1501349 - protein, 18 aa, Mycobacterium tuberculosis
LVRAAACTMFFGETAESL

SEQ ID NO: 1501350 - protein, 27 aa, Mycobacterium tuberculosis
LVSFEVFIRPSLRMAMGLPDPYRPHRS

SEQ ID NO: 1501351 - protein, 26 aa, Mycobacterium tuberculosis
LVSHYDVYPAFGFRFDLKKSGVSVTF

SEQ ID NO: 1501352 - protein, 17 aa, Mycobacterium tuberculosis
LWPAQLVGLGIMRYGVR

SEQ ID NO: 1501353 - protein, 25 aa, Mycobacterium tuberculosis
LWRGNYEGLAGFSFGYPIPLFPAVG

SEQ ID NO: 1501354 - protein, 20 aa, Mycobacterium tuberculosis
LWTGDYHGLVGFSFSIDIAG

SEQ ID NO: 1501355 - protein, 22 aa, Mycobacterium tuberculosis
LYCRNRIEIVIAMLGIVKAGAI

SEQ ID NO: 1501356 - protein, 20 aa, Mycobacterium tuberculosis
LYMAGARLDSLVPLGPPVMD

SEQ ID NO: 1501357 - protein, 18 aa, Mycobacterium tuberculosis
LYRGIGIAIGKLVARQDA

SEQ ID NO: 1501358 - protein, 18 aa, Mycobacterium tuberculosis
LYWMSAWIDPDGTDGGPV

SEQ ID NO: 1501359 - protein, 24 aa, Mycobacterium tuberculosis
MAIACTRWQSSRCCANSPTTPMAT

SEQ ID NO: 1501360 - protein, 19 aa, Mycobacterium tuberculosis
MARAVAPYLGWLISATAQA

SEQ ID NO: 1501361 - protein, 17 aa, Mycobacterium tuberculosis
MARDLVRRGLDTVAFNI

SEQ ID NO: 1501362 - protein, 17 aa, Mycobacterium tuberculosis
MATAAFDLARIGSQVSA

SEQ ID NO: 1501363 - protein, 18 aa, Mycobacterium tuberculosis
MCRMWRGWCRPVRIARRR

SEQ ID NO: 1501364 - protein, 21 aa, Mycobacterium tuberculosis
MDFSSATHCGRVISELVITAT

SEQ ID NO: 1501365 - protein, 26 aa, Mycobacterium tuberculosis
MDPRQRLALELTWELLEDAFVVPETL

SEQ ID NO: 1501366 - protein, 17 aa, Mycobacterium tuberculosis
MEQGRLAAYHAFGEPTD

SEQ ID NO: 1501367 - protein, 20 aa, Mycobacterium tuberculosis
MFPALAVAVTSQFAEPDDAE

SEQ ID NO: 1501368 - protein, 20 aa, Mycobacterium tuberculosis
MGAWAKRTGAIFIRRQTKDI

SEQ ID NO: 1501369 - protein, 17 aa, Mycobacterium tuberculosis
MGGTGGWLMGNGGMGGA

SEQ ID NO: 1501370 - protein, 17 aa, Mycobacterium tuberculosis
MGPLRLSDLVGLDTLKL

SEQ ID NO: 1501371 - protein, 19 aa, Mycobacterium tuberculosis
MGPMQFLPGTWARYATDGD

SEQ ID NO: 1501372 - protein, 17 aa, Mycobacterium tuberculosis
MGRVHRFLGLQVGVILA

SEQ ID NO: 1501373 - protein, 17 aa, Mycobacterium tuberculosis
MGSCAYAVWAQESVRCR

SEQ ID NO: 1501374 - protein, 18 aa, Mycobacterium tuberculosis
MHLLRLASEFGLTPPPSS

SEQ ID NO: 1501375 - protein, 17 aa, Mycobacterium tuberculosis
MHMPGVSICYGMTETSP

SEQ ID NO: 1501376 - protein, 18 aa, Mycobacterium tuberculosis
MLACGAAYVIDREMGEYQ

SEQ ID NO: 1501377 - protein, 25 aa, Mycobacterium tuberculosis
MLDDASKIVGCWNGRAKRSGTGIVA

SEQ ID NO: 1501378 - protein, 24 aa, Mycobacterium tuberculosis
MLDDASKIVGCWNGVAKRSGTGIV

SEQ ID NO: 1501379 - protein, 18 aa, Mycobacterium tuberculosis
MLDPGGWVEADEDTFYDR

SEQ ID NO: 1501380 - protein, 17 aa, Mycobacterium tuberculosis
MLIELDIHFRIEDDLYY

SEQ ID NO: 1501381 - protein, 23 aa, Mycobacterium tuberculosis
MLSVPRWAVGPVMELGTDHRRIE

SEQ ID NO: 1501382 - protein, 19 aa, Mycobacterium tuberculosis
MMATAAFDLARIGSQVSAA

SEQ ID NO: 1501383 - protein, 17 aa, Mycobacterium tuberculosis
MPASSAARCAARIVGGR

SEQ ID NO: 1501384 - protein, 17 aa, Mycobacterium tuberculosis
MPFSVPWTRASREDLPF

SEQ ID NO: 1501385 - protein, 18 aa, Mycobacterium tuberculosis
MPGGIYAPMMHPWSTGKD

SEQ ID NO: 1501386 - protein, 20 aa, Mycobacterium tuberculosis
MPPACGFNWMAATTRTCSSE

SEQ ID NO: 1501387 - protein, 21 aa, Mycobacterium tuberculosis
MPVRRLDLIWISARNAARREL

SEQ ID NO: 1501388 - protein, 17 aa, Mycobacterium tuberculosis
MRDRWAGFFNEFDVLLL

SEQ ID NO: 1501389 - protein, 18 aa, Mycobacterium tuberculosis
MRLQPGRMFLVDTAQGRI

SEQ ID NO: 1501390 - protein, 19 aa, Mycobacterium tuberculosis
MRRAFPSWMAWSPFAPAMR

SEQ ID NO: 1501391 - protein, 18 aa, Mycobacterium tuberculosis
MRSCTGWPSGVWIDQPRR

SEQ ID NO: 1501392 - protein, 20 aa, Mycobacterium tuberculosis
MSGVPPSVWGGLAAARFQDV

SEQ ID NO: 1501393 - protein, 20 aa, Mycobacterium tuberculosis
MSVDCARYWLDADKPISKSD

SEQ ID NO: 1501394 - protein, 24 aa, Mycobacterium tuberculosis
MTGWQRLHFRFGFPAPLLEPLAVE

SEQ ID NO: 1501395 - protein, 26 aa, Mycobacterium tuberculosis
MTIPGMRLPFTSIVPFVVYYGPVELP

SEQ ID NO: 1501396 - protein, 17 aa, Mycobacterium tuberculosis
MTPAAFVRRPGRWVREL

SEQ ID NO: 1501397 - protein, 17 aa, Mycobacterium tuberculosis
MTRPRFGSWLRNSTRGA

SEQ ID NO: 1501398 - protein, 18 aa, Mycobacterium tuberculosis
MYDRVHWSLTHMSQAGLL

SEQ ID NO: 1501399 - protein, 17 aa, Mycobacterium tuberculosis
MYELFSVGWGKPDLRDQ

SEQ ID NO: 1501400 - protein, 21 aa, Mycobacterium tuberculosis
NAEALVPITALLPAGADDVSA

SEQ ID NO: 1501401 - protein, 17 aa, Mycobacterium tuberculosis
NAGSRFLLDQAITSAGR

SEQ ID NO: 1501402 - protein, 19 aa, Mycobacterium tuberculosis
NAGVALSVGSTGGLGGNGG

SEQ ID NO: 1501403 - protein, 17 aa, Mycobacterium tuberculosis
NAIAALGIREWDAVSLT

SEQ ID NO: 1501404 - protein, 20 aa, Mycobacterium tuberculosis
NAINPSVLWTLTPRIVSLDV

SEQ ID NO: 1501405 - protein, 19 aa, Mycobacterium tuberculosis
NALGAAWWRGVELVVASMG

SEQ ID NO: 1501406 - protein, 21 aa, Mycobacterium tuberculosis
NALHEVVGWWAKLPVTGMQPV

SEQ ID NO: 1501407 - protein, 18 aa, Mycobacterium tuberculosis
NALRSWSVLRFEVTEDPS

SEQ ID NO: 1501408 - protein, 17 aa, Mycobacterium tuberculosis
NAMSWFWYLMALNPQAR

SEQ ID NO: 1501409 - protein, 17 aa, Mycobacterium tuberculosis
NAVDVALRPCARANRCD

SEQ ID NO: 1501410 - protein, 17 aa, Mycobacterium tuberculosis
NAVEPWVQYGFNLTAWA

SEQ ID NO: 1501411 - protein, 20 aa, Mycobacterium tuberculosis
NELGHPWTVLRATRRTDYLI

SEQ ID NO: 1501412 - protein, 24 aa, Mycobacterium tuberculosis
NEPICPPCGSFIRSYASDIDTAVA

SEQ ID NO: 1501413 - protein, 22 aa, Mycobacterium tuberculosis
NFGPISVQGFGLFGHGGDGGNG

SEQ ID NO: 1501414 - protein, 18 aa, Mycobacterium tuberculosis
NFLSRSGAVGVLGIGPNN

SEQ ID NO: 1501415 - protein, 22 aa, Mycobacterium tuberculosis
NFRDIMITLGMFIRTRSWALRP

SEQ ID NO: 1501416 - protein, 18 aa, Mycobacterium tuberculosis
NFWPLCSRLFEVFNGPPL

SEQ ID NO: 1501417 - protein, 24 aa, Mycobacterium tuberculosis
NFWRSAGLPEFRWPDPNGTRFPNG

SEQ ID NO: 1501418 - protein, 17 aa, Mycobacterium tuberculosis
NGADAAAVVGFGANGDP

SEQ ID NO: 1501419 - protein, 19 aa, Mycobacterium tuberculosis
NGAQCPRCNEEYRQLCAAL

SEQ ID NO: 1501420 - protein, 18 aa, Mycobacterium tuberculosis
NGCPLGNLIPEWNDLVRR

SEQ ID NO: 1501421 - protein, 25 aa, Mycobacterium tuberculosis
NGCRLRWPTPRCCSRILRWCARRSA

SEQ ID NO: 1501422 - protein, 25 aa, Mycobacterium tuberculosis
NGDNHATGGWLYRNGGAGDQGAIAG

SEQ ID NO: 1501423 - protein, 23 aa, Mycobacterium tuberculosis
NGGAGGIGWAAINILANAGAGGA

SEQ ID NO: 1501424 - protein, 22 aa, Mycobacterium tuberculosis
NGGAGGNAWLFGAGGSGGAGTN

SEQ ID NO: 1501425 - protein, 36 aa, Mycobacterium tuberculosis
NGGDGGCRRVWRRYRRQRWCRRQRRADRQRRQRRQR

SEQ ID NO: 1501426 - protein, 25 aa, Mycobacterium tuberculosis
NGGIGGSAARLFGGGGAGGAGGTGS

SEQ ID NO: 1501427 - protein, 22 aa, Mycobacterium tuberculosis
NGGKGGTGLMPGINGTGGAGGS

SEQ ID NO: 1501428 - protein, 18 aa, Mycobacterium tuberculosis
NGGNAGWLYGRGGVGGAG

SEQ ID NO: 1501429 - protein, 17 aa, Mycobacterium tuberculosis
NGGNAWLTGQGGNGGNA

SEQ ID NO: 1501430 - protein, 25 aa, Mycobacterium tuberculosis
NGGPPPMRLEGGTGVSRHRRQRHRV

SEQ ID NO: 1501431 - protein, 21 aa, Mycobacterium tuberculosis
NGGSGGNGFDSFASGGTGGAG

SEQ ID NO: 1501432 - protein, 22 aa, Mycobacterium tuberculosis
NGGSGGSLFGFGGAGGTGGSSG

SEQ ID NO: 1501433 - protein, 23 aa, Mycobacterium tuberculosis
NGGSGGSLFGFGGAGGTGGSSGI

SEQ ID NO: 1501434 - protein, 18 aa, Mycobacterium tuberculosis
NGGVCGSGGASALLTGNG

SEQ ID NO: 1501435 - protein, 22 aa, Mycobacterium tuberculosis
NGILWRGNFEGLFGLNVGITIP

SEQ ID NO: 1501436 - protein, 18 aa, Mycobacterium tuberculosis
NGNFAFGDGNGGHGGNGG

SEQ ID NO: 1501437 - protein, 23 aa, Mycobacterium tuberculosis
NGSKGLPGLGRLGNPGLDGGTGG

SEQ ID NO: 1501438 - protein, 21 aa, Mycobacterium tuberculosis
NGVLWRGDYQGLIGADIALEI

SEQ ID NO: 1501439 - protein, 19 aa, Mycobacterium tuberculosis
NGYPVKASVSFGLYYPPGS

SEQ ID NO: 1501440 - protein, 27 aa, Mycobacterium tuberculosis
NHRKRIGELWARFSAVAADNPHAWIRN

SEQ ID NO: 1501441 - protein, 18 aa, Mycobacterium tuberculosis
NIGVPGTLFGSVRSGLNT

SEQ ID NO: 1501442 - protein, 22 aa, Mycobacterium tuberculosis
NIPPRPPFPPAPPVPPLPPAAP

SEQ ID NO: 1501443 - protein, 20 aa, Mycobacterium tuberculosis
NKTRLAALRVKDFGKREVMM

SEQ ID NO: 1501444 - protein, 26 aa, Mycobacterium tuberculosis
NLYSLKYWGVRGVWGGGGGGGGGGRG

SEQ ID NO: 1501445 - protein, 17 aa, Mycobacterium tuberculosis
NMWALRALGVRRVFGPC

SEQ ID NO: 1501446 - protein, 24 aa, Mycobacterium tuberculosis
NNRMLSQIWSHWSLLSAPSCAAQL

SEQ ID NO: 1501447 - protein, 24 aa, Mycobacterium tuberculosis
NPDGGWTLVSWDGIPVGPASLPTA

SEQ ID NO: 1501448 - protein, 24 aa, Mycobacterium tuberculosis
NPEGGWTLVSWDGIPVGPASLPTA

SEQ ID NO: 1501449 - protein, 21 aa, Mycobacterium tuberculosis
NPGAVPGRVGGAGGLGGSGSD

SEQ ID NO: 1501450 - protein, 19 aa, Mycobacterium tuberculosis
NPGTLMWWIARSLELLQDF

SEQ ID NO: 1501451 - protein, 22 aa, Mycobacterium tuberculosis
NPHRQCILIFLTLYPPPHYYEK

SEQ ID NO: 1501452 - protein, 19 aa, Mycobacterium tuberculosis
NPRWWGARPRLDSITYLVL

SEQ ID NO: 1501453 - protein, 24 aa, Mycobacterium tuberculosis
NQNWRAMMLMLRWRAAPSCTSTRA

SEQ ID NO: 1501454 - protein, 22 aa, Mycobacterium tuberculosis
NRCARWCSCMSRTPCRGSALPT

SEQ ID NO: 1501455 - protein, 17 aa, Mycobacterium tuberculosis
NRCPLTSYVLIGFSQGA

SEQ ID NO: 1501456 - protein, 19 aa, Mycobacterium tuberculosis
NRLRWCCWWDSSPKTSRRS

SEQ ID NO: 1501457 - protein, 24 aa, Mycobacterium tuberculosis
NRPARLAPMFAMPEPKAGVARSSV

SEQ ID NO: 1501458 - protein, 26 aa, Mycobacterium tuberculosis
NRPLRGCYRIAVLSLKGGIGKTTITA

SEQ ID NO: 1501459 - protein, 21 aa, Mycobacterium tuberculosis
NRVRCHLHISRSPSAVPGRGG

SEQ ID NO: 1501460 - protein, 20 aa, Mycobacterium tuberculosis
NRVRTWLLAVSNVFGQNAPA

SEQ ID NO: 1501461 - protein, 35 aa, Mycobacterium tuberculosis
NSGAMLSGGGICRNSRYSAATAATAARLRRCTGAS

SEQ ID NO: 1501462 - protein, 24 aa, Mycobacterium tuberculosis
NSGTCFRPSLAVQRRWRDEFGLGL

SEQ ID NO: 1501463 - protein, 19 aa, Mycobacterium tuberculosis
NSSPAWPARSVVTPKVSAF

SEQ ID NO: 1501464 - protein, 18 aa, Mycobacterium tuberculosis
NSVPRFHITWGTGPALVD

SEQ ID NO: 1501465 - protein, 20 aa, Mycobacterium tuberculosis
NTFPSWPLAHPFRRIAHNGE

SEQ ID NO: 1501466 - protein, 17 aa, Mycobacterium tuberculosis
NTGTGWAYGGNGGNGGD

SEQ ID NO: 1501467 - protein, 17 aa, Mycobacterium tuberculosis
NTICLDIDWVIGGCMSV

SEQ ID NO: 1501468 - protein, 18 aa, Mycobacterium tuberculosis
NVAWPKVFRPPVIAATVT

SEQ ID NO: 1501469 - protein, 24 aa, Mycobacterium tuberculosis
NWWESRALYGWTVLVPRTKDQAGE

SEQ ID NO: 1501470 - protein, 24 aa, Mycobacterium tuberculosis
NYFGDACVWWGLWLITINDWAPLA

SEQ ID NO: 1501471 - protein, 17 aa, Mycobacterium tuberculosis
PAAFVRRPGRWVRELAR

SEQ ID NO: 1501472 - protein, 19 aa, Mycobacterium tuberculosis
PAAPCWTSTKPSTWAPSTS

SEQ ID NO: 1501473 - protein, 24 aa, Mycobacterium tuberculosis
PAAPSAPVSPGWAGPAGPAGPADC

SEQ ID NO: 1501474 - protein, 19 aa, Mycobacterium tuberculosis
PAAPSWRKGPRHIAGRGPR

SEQ ID NO: 1501475 - protein, 20 aa, Mycobacterium tuberculosis
PADHGWPAVGLMAGSRLQAV

SEQ ID NO: 1501476 - protein, 17 aa, Mycobacterium tuberculosis
PAEAVVVGPLHFEPTDR

SEQ ID NO: 1501477 - protein, 19 aa, Mycobacterium tuberculosis
PAGMPGMLAGPGGAGGAGG

SEQ ID NO: 1501478 - protein, 17 aa, Mycobacterium tuberculosis
PAHAVAVAAGWRNDDGG

SEQ ID NO: 1501479 - protein, 17 aa, Mycobacterium tuberculosis
PAIFTHRDVGNTDCPGN

SEQ ID NO: 1501480 - protein, 17 aa, Mycobacterium tuberculosis
PALTSLLPVTGPTGQRS

SEQ ID NO: 1501481 - protein, 19 aa, Mycobacterium tuberculosis
PAMLKRQLQLLLPLVEDRF

SEQ ID NO: 1501482 - protein, 22 aa, Mycobacterium tuberculosis
PAMLPGFNSGFANIGSFNAGIA

SEQ ID NO: 1501483 - protein, 23 aa, Mycobacterium tuberculosis
PAMLPGFNSGFANIGSFNAGIAN

SEQ ID NO: 1501484 - protein, 20 aa, Mycobacterium tuberculosis
PANPRFLMCTPLSHAGAAFF

SEQ ID NO: 1501485 - protein, 25 aa, Mycobacterium tuberculosis
PAPAAPNGFGGRPAGPADKGGAGGA

SEQ ID NO: 1501486 - protein, 18 aa, Mycobacterium tuberculosis
PAPKRAFEASAPITAGTT

SEQ ID NO: 1501487 - protein, 21 aa, Mycobacterium tuberculosis
PAPMLPSWWVAASALPPCPPA

SEQ ID NO: 1501488 - protein, 21 aa, Mycobacterium tuberculosis
PARCSPRWGAGRGIRDDEQRH

SEQ ID NO: 1501489 - protein, 20 aa, Mycobacterium tuberculosis
PARLQRPIVLEARISHAASG

SEQ ID NO: 1501490 - protein, 21 aa, Mycobacterium tuberculosis
PARSRGGGVGRTVPAVTAVAE

SEQ ID NO: 1501491 - protein, 24 aa, Mycobacterium tuberculosis
PASLIPWPLLSVPFAPVLGSQSSR

SEQ ID NO: 1501492 - protein, 24 aa, Mycobacterium tuberculosis
PASWYRAVVISMRLPQRRHAVNRW

SEQ ID NO: 1501493 - protein, 19 aa, Mycobacterium tuberculosis
PATRSRRRRCCGPQQVLTT

SEQ ID NO: 1501494 - protein, 19 aa, Mycobacterium tuberculosis
PCAPFLHLFVAYGRLTLEG

SEQ ID NO: 1501495 - protein, 17 aa, Mycobacterium tuberculosis
PCCSAWTGWTWTGSRTS

SEQ ID NO: 1501496 - protein, 18 aa, Mycobacterium tuberculosis
PCMTGFLPPPLVRSPADE

SEQ ID NO: 1501497 - protein, 18 aa, Mycobacterium tuberculosis
PCVPTIMAGLYCEWDNAG

SEQ ID NO: 1501498 - protein, 23 aa, Mycobacterium tuberculosis
PCWPGSTWPLIWLTCWRPTTWRW

SEQ ID NO: 1501499 - protein, 17 aa, Mycobacterium tuberculosis
PDAFKWIQRAAMDRRTT

SEQ ID NO: 1501500 - protein, 23 aa, Mycobacterium tuberculosis
PDERGMRTVMCILNGQLRPVLVR

SEQ ID NO: 1501501 - protein, 19 aa, Mycobacterium tuberculosis
PDFGLRLARWQGLGILGPV

SEQ ID NO: 1501502 - protein, 21 aa, Mycobacterium tuberculosis
PDFGLRLARWQGLGILGPVAV

SEQ ID NO: 1501503 - protein, 18 aa, Mycobacterium tuberculosis
PDGLRWSTTEQLGYNRRY

SEQ ID NO: 1501504 - protein, 19 aa, Mycobacterium tuberculosis
PDGLRWSTTEQLGYNRRYT

SEQ ID NO: 1501505 - protein, 18 aa, Mycobacterium tuberculosis
PDLFWALRGGGGGNFGVT

SEQ ID NO: 1501506 - protein, 18 aa, Mycobacterium tuberculosis
PDQLRLSGFRLVGIADVY

SEQ ID NO: 1501507 - protein, 24 aa, Mycobacterium tuberculosis
PDRRRGGGGQCWFWQCRHQQLWLG

SEQ ID NO: 1501508 - protein, 19 aa, Mycobacterium tuberculosis
PDSDLKGFDGFDGGSGGAG

SEQ ID NO: 1501509 - protein, 23 aa, Mycobacterium tuberculosis
PEAMASTMLLFFCQFSDGYGTAG

SEQ ID NO: 1501510 - protein, 19 aa, Mycobacterium tuberculosis
PECWAAGADEVSVAGAVPC

SEQ ID NO: 1501511 - protein, 21 aa, Mycobacterium tuberculosis
PEGLLNYLALLGWSIADDHDL

SEQ ID NO: 1501512 - protein, 17 aa, Mycobacterium tuberculosis
PEINSALIFGGAGSEPM

SEQ ID NO: 1501513 - protein, 17 aa, Mycobacterium tuberculosis
PEIPYYSATLFDPREAP

SEQ ID NO: 1501514 - protein, 19 aa, Mycobacterium tuberculosis
PEIWDEFTTRFGVARVCEF

SEQ ID NO: 1501515 - protein, 18 aa, Mycobacterium tuberculosis
PEPPRHVRRLQFLERMGS

SEQ ID NO: 1501516 - protein, 19 aa, Mycobacterium tuberculosis
PERLLRCIEAVLACREALA

SEQ ID NO: 1501517 - protein, 23 aa, Mycobacterium tuberculosis
PEVLEWRYPVLLREFAVRQGSGG

SEQ ID NO: 1501518 - protein, 19 aa, Mycobacterium tuberculosis
PEVPSAWLSTGMGPGPLLA

SEQ ID NO: 1501519 - protein, 17 aa, Mycobacterium tuberculosis
PFLRRFDIPPGIEHQED

SEQ ID NO: 1501520 - protein, 17 aa, Mycobacterium tuberculosis
PFPGMALADTFQISEAG

SEQ ID NO: 1501521 - protein, 19 aa, Mycobacterium tuberculosis
PGAGGNGGNANWFGSGGAG

SEQ ID NO: 1501522 - protein, 20 aa, Mycobacterium tuberculosis
PGAGGNGGNANWFGSGGAGG

SEQ ID NO: 1501523 - protein, 24 aa, Mycobacterium tuberculosis
PGAGGNGGNANWFGSGGAGGQGGT

SEQ ID NO: 1501524 - protein, 20 aa, Mycobacterium tuberculosis
PGAKGAHGFTPTSGGDGGDG

SEQ ID NO: 1501525 - protein, 21 aa, Mycobacterium tuberculosis
PGAKGAHGFTPTSGGDGGDGG

SEQ ID NO: 1501526 - protein, 19 aa, Mycobacterium tuberculosis
PGALIGFLGPRVYELLYGD

SEQ ID NO: 1501527 - protein, 18 aa, Mycobacterium tuberculosis
PGARPGPVPKPGIRTPRV

SEQ ID NO: 1501528 - protein, 19 aa, Mycobacterium tuberculosis
PGARPGPVPKPGIRTPRVG

SEQ ID NO: 1501529 - protein, 19 aa, Mycobacterium tuberculosis
PGAVPGRAGGAGGLGGSGS

SEQ ID NO: 1501530 - protein, 20 aa, Mycobacterium tuberculosis
PGAVPGRAGGAGGLGGSGSD

SEQ ID NO: 1501531 - protein, 17 aa, Mycobacterium tuberculosis
PGCDVPGYYCEVHHVTP

SEQ ID NO: 1501532 - protein, 17 aa, Mycobacterium tuberculosis
PGCRGWPRRRAAARASV

SEQ ID NO: 1501533 - protein, 18 aa, Mycobacterium tuberculosis
PGDFFPVPCCFPSCRSIT

SEQ ID NO: 1501534 - protein, 20 aa, Mycobacterium tuberculosis
PGDGPWRLGLGSAGTFENLR

SEQ ID NO: 1501535 - protein, 18 aa, Mycobacterium tuberculosis
PGDLAWQPPLWRALVTTV

SEQ ID NO: 1501536 - protein, 21 aa, Mycobacterium tuberculosis
PGFADSLLRVWQAKKRTSTRI

SEQ ID NO: 1501537 - protein, 20 aa, Mycobacterium tuberculosis
PGGAGGLLFGNGGNGAAGAV

SEQ ID NO: 1501538 - protein, 23 aa, Mycobacterium tuberculosis
PGGFLPRHHVLTLAGKRPTPLAC

SEQ ID NO: 1501539 - protein, 23 aa, Mycobacterium tuberculosis
PGGHGGSVLSGPVGDSGNGGAGG

SEQ ID NO: 1501540 - protein, 17 aa, Mycobacterium tuberculosis
PGGRGFGGVGGRRRDRP

SEQ ID NO: 1501541 - protein, 28 aa, Mycobacterium tuberculosis
PGGRRAAPVLARGPMVWRPATTGRSAAA

SEQ ID NO: 1501542 - protein, 18 aa, Mycobacterium tuberculosis
PGIWYAGSHGFELTAPDG

SEQ ID NO: 1501543 - protein, 17 aa, Mycobacterium tuberculosis
PGMPTPGWPTRAPSAPA

SEQ ID NO: 1501544 - protein, 23 aa, Mycobacterium tuberculosis
PGPGRWRTRCCPWTVAEGLRSGL

SEQ ID NO: 1501545 - protein, 23 aa, Mycobacterium tuberculosis
PGPKPSASIGQWPRHQPQAQGGG

SEQ ID NO: 1501546 - protein, 17 aa, Mycobacterium tuberculosis
PGPLWSVSIERFLDTAW

SEQ ID NO: 1501547 - protein, 19 aa, Mycobacterium tuberculosis
PGPRCAVGAVADQRTPQQQ

SEQ ID NO: 1501548 - protein, 17 aa, Mycobacterium tuberculosis
PGQLVLIHGGASGIGTH

SEQ ID NO: 1501549 - protein, 17 aa, Mycobacterium tuberculosis
PGQYVRLHWARPRSRLP

SEQ ID NO: 1501550 - protein, 18 aa, Mycobacterium tuberculosis
PGQYVRLHWARPRSRLPG

SEQ ID NO: 1501551 - protein, 23 aa, Mycobacterium tuberculosis
PGRIPGPVVWGWTFCRTSSACAE

SEQ ID NO: 1501552 - protein, 17 aa, Mycobacterium tuberculosis
PGRRRRFPAARATLPSG

SEQ ID NO: 1501553 - protein, 18 aa, Mycobacterium tuberculosis
PGRTVCKWGGFLDNPADF

SEQ ID NO: 1501554 - protein, 21 aa, Mycobacterium tuberculosis
PGRWGRTAVCARLSSADQKVD

SEQ ID NO: 1501555 - protein, 18 aa, Mycobacterium tuberculosis
PGSAAGLIVRLGTDPAGD

SEQ ID NO: 1501556 - protein, 18 aa, Mycobacterium tuberculosis
PGSDALALGQPGGNGGQG

SEQ ID NO: 1501557 - protein, 20 aa, Mycobacterium tuberculosis
PGVAFGHDWLTGTSRYSGLL

SEQ ID NO: 1501558 - protein, 19 aa, Mycobacterium tuberculosis
PGYPCYRNILSALGCEVVE

SEQ ID NO: 1501559 - protein, 21 aa, Mycobacterium tuberculosis
PHARLPLPLARDEIRYLGTTF

SEQ ID NO: 1501560 - protein, 18 aa, Mycobacterium tuberculosis
PHHQSGWRRWRRCTDGAW

SEQ ID NO: 1501561 - protein, 22 aa, Mycobacterium tuberculosis
PHMAGGGWAWADFVAEADPSNP

SEQ ID NO: 1501562 - protein, 24 aa, Mycobacterium tuberculosis
PHPRRPPRRRLPTAPAGGVDGNGG

SEQ ID NO: 1501563 - protein, 17 aa, Mycobacterium tuberculosis
PHRRSACRQTQNPERGR

SEQ ID NO: 1501564 - protein, 21 aa, Mycobacterium tuberculosis
PIKINPITLWPAQNFNQTITL

SEQ ID NO: 1501565 - protein, 18 aa, Mycobacterium tuberculosis
PILKGDKGEPCWPDGVVG

SEQ ID NO: 1501566 - protein, 25 aa, Mycobacterium tuberculosis
PIPEIPQLPPGIPQVPGIGQFSAIS

SEQ ID NO: 1501567 - protein, 17 aa, Mycobacterium tuberculosis
PITELGMVKSIDTGPDG

SEQ ID NO: 1501568 - protein, 18 aa, Mycobacterium tuberculosis
PKAGPLIAVKLHILTRKT

SEQ ID NO: 1501569 - protein, 19 aa, Mycobacterium tuberculosis
PKATIALLRRVEDVLDVEV

SEQ ID NO: 1501570 - protein, 18 aa, Mycobacterium tuberculosis
PKHYWSIYQKMIVKGRDF

SEQ ID NO: 1501571 - protein, 20 aa, Mycobacterium tuberculosis
PKLDVLDFWSIIKPELAGVH

SEQ ID NO: 1501572 - protein, 19 aa, Mycobacterium tuberculosis
PKPPARCGWSRQRYQRDFC

SEQ ID NO: 1501573 - protein, 17 aa, Mycobacterium tuberculosis
PKRAQVVWVLLDAPQLV

SEQ ID NO: 1501574 - protein, 21 aa, Mycobacterium tuberculosis
PKVVSQRGWRHWVHALTRINL

SEQ ID NO: 1501575 - protein, 22 aa, Mycobacterium tuberculosis
PKVVSQRGWRHWVHALTRINLG

SEQ ID NO: 1501576 - protein, 19 aa, Mycobacterium tuberculosis
PLAMPRLDMVTGLYYLTTE

SEQ ID NO: 1501577 - protein, 19 aa, Mycobacterium tuberculosis
PLEFARLAGYYLAEGHACL

SEQ ID NO: 1501578 - protein, 17 aa, Mycobacterium tuberculosis
PLEPEYRRLPVGIVANG

SEQ ID NO: 1501579 - protein, 18 aa, Mycobacterium tuberculosis
PLGNLIPEWNDLVRRGRW

SEQ ID NO: 1501580 - protein, 17 aa, Mycobacterium tuberculosis
PLIGHGALRGVGDRAGR

SEQ ID NO: 1501581 - protein, 17 aa, Mycobacterium tuberculosis
PLILRLDPKIGLPDIRA

SEQ ID NO: 1501582 - protein, 17 aa, Mycobacterium tuberculosis
PLLAAAYRTRGALRIVD

SEQ ID NO: 1501583 - protein, 18 aa, Mycobacterium tuberculosis
PLLAVPFSYPASLPTPFG

SEQ ID NO: 1501584 - protein, 17 aa, Mycobacterium tuberculosis
PLLDLPWDIQESPAGMA

SEQ ID NO: 1501585 - protein, 18 aa, Mycobacterium tuberculosis
PLLDLPWDIQESPAGMAV

SEQ ID NO: 1501586 - protein, 18 aa, Mycobacterium tuberculosis
PLMRRSGMIFIRRNIGND

SEQ ID NO: 1501587 - protein, 28 aa, Mycobacterium tuberculosis
PLPISGRPSNSWVGVFTMLSRPSNGAAA

SEQ ID NO: 1501588 - protein, 20 aa, Mycobacterium tuberculosis
PLPQTRFVLRKALAAHLPVI

SEQ ID NO: 1501589 - protein, 19 aa, Mycobacterium tuberculosis
PLRLRACLRRRRLAARRHP

SEQ ID NO: 1501590 - protein, 21 aa, Mycobacterium tuberculosis
PLRPGPPPTVWSRRWRQPWAP

SEQ ID NO: 1501591 - protein, 17 aa, Mycobacterium tuberculosis
PLVRRLWVLKVWGDVVD

SEQ ID NO: 1501592 - protein, 17 aa, Mycobacterium tuberculosis
PLVYEMPHTLAALDCGA

SEQ ID NO: 1501593 - protein, 17 aa, Mycobacterium tuberculosis
PLWEPKIPLGRLGRPEE

SEQ ID NO: 1501594 - protein, 18 aa, Mycobacterium tuberculosis
PMAVPAFALALMRRSLAG

SEQ ID NO: 1501595 - protein, 20 aa, Mycobacterium tuberculosis
PMRFRVCSRRGGYNWTGYCG

SEQ ID NO: 1501596 - protein, 19 aa, Mycobacterium tuberculosis
PNLAAELQLAFQQLLVGDY

SEQ ID NO: 1501597 - protein, 19 aa, Mycobacterium tuberculosis
PNMWATLMVSQGTPMAPHG

SEQ ID NO: 1501598 - protein, 19 aa, Mycobacterium tuberculosis
PNSVWSWDITKLRGPASGA

SEQ ID NO: 1501599 - protein, 24 aa, Mycobacterium tuberculosis
PPAPPRPPCPPAPSSSAPRPPAPP

SEQ ID NO: 1501600 - protein, 20 aa, Mycobacterium tuberculosis
PPCMTGFLPPPLVRSPADES

SEQ ID NO: 1501601 - protein, 23 aa, Mycobacterium tuberculosis
PPEHLQWIGQWGIFDALRAGREV

SEQ ID NO: 1501602 - protein, 21 aa, Mycobacterium tuberculosis
PPEHLQWIGQWGIFDALRPGR

SEQ ID NO: 1501603 - protein, 18 aa, Mycobacterium tuberculosis
PPGTALCRRCRRRRRVQP

SEQ ID NO: 1501604 - protein, 19 aa, Mycobacterium tuberculosis
PPGTRRFSPPGGGSGGNGG

SEQ ID NO: 1501605 - protein, 18 aa, Mycobacterium tuberculosis
PPHPAHFLWLNWGPCPPR

SEQ ID NO: 1501606 - protein, 17 aa, Mycobacterium tuberculosis
PPLDMARLFNQPELGPT

SEQ ID NO: 1501607 - protein, 19 aa, Mycobacterium tuberculosis
PPLPIPRPLAPPWPPSPPL

SEQ ID NO: 1501608 - protein, 26 aa, Mycobacterium tuberculosis
PPLPYSRPALPPAPPAPAFMPTPNND

SEQ ID NO: 1501609 - protein, 19 aa, Mycobacterium tuberculosis
PPMDFTLGLPVLGPITGQL

SEQ ID NO: 1501610 - protein, 20 aa, Mycobacterium tuberculosis
PPMDFTLGLPVLGPITGQLG

SEQ ID NO: 1501611 - protein, 18 aa, Mycobacterium tuberculosis
PPMPRLPPLPPLPPTPSP

SEQ ID NO: 1501612 - protein, 19 aa, Mycobacterium tuberculosis
PPNPGCWKGLGGADAMVKK

SEQ ID NO: 1501613 - protein, 18 aa, Mycobacterium tuberculosis
PPPHFFHPVNKKKKKKKK

SEQ ID NO: 1501614 - protein, 17 aa, Mycobacterium tuberculosis
PPPPTGPTTVGWIPPAN

SEQ ID NO: 1501615 - protein, 18 aa, Mycobacterium tuberculosis
PPPPTPITQVQQGGDGGA

SEQ ID NO: 1501616 - protein, 23 aa, Mycobacterium tuberculosis
PPPSTRFAVTWMIDRSSWAAMVG

SEQ ID NO: 1501617 - protein, 17 aa, Mycobacterium tuberculosis
PPRTMRALLARICEQEG

SEQ ID NO: 1501618 - protein, 17 aa, Mycobacterium tuberculosis
PPVELFMQMPWRTEIIQ

SEQ ID NO: 1501619 - protein, 19 aa, Mycobacterium tuberculosis
PPVELFMQMPWRTEIIQGL

SEQ ID NO: 1501620 - protein, 19 aa, Mycobacterium tuberculosis
PPVPIPWSVLSLFVPGPTL

SEQ ID NO: 1501621 - protein, 18 aa, Mycobacterium tuberculosis
PPVRWRSGRRVHFDLDPL

SEQ ID NO: 1501622 - protein, 19 aa, Mycobacterium tuberculosis
PQPQFGRPWLQVVAFHVGD

SEQ ID NO: 1501623 - protein, 20 aa, Mycobacterium tuberculosis
PQPQFGRPWLQVVAFHVGDL

SEQ ID NO: 1501624 - protein, 19 aa, Mycobacterium tuberculosis
PQRVLGLHFFNPVPVLPLV

SEQ ID NO: 1501625 - protein, 23 aa, Mycobacterium tuberculosis
PQTFYLSGLFFFGPVNLSASTLT

SEQ ID NO: 1501626 - protein, 18 aa, Mycobacterium tuberculosis
PQTSVLIGTQGGDGTPGG

SEQ ID NO: 1501627 - protein, 23 aa, Mycobacterium tuberculosis
PQVARAALLFGMCFDAESAVRHG

SEQ ID NO: 1501628 - protein, 17 aa, Mycobacterium tuberculosis
PQYRLVPTPGDGNIGLF

SEQ ID NO: 1501629 - protein, 18 aa, Mycobacterium tuberculosis
PRAGRCAYNVHPRSSGDT

SEQ ID NO: 1501630 - protein, 18 aa, Mycobacterium tuberculosis
PRARAGGTTPFFKQIPFA

SEQ ID NO: 1501631 - protein, 18 aa, Mycobacterium tuberculosis
PRCARLSPRFANRHDGHS

SEQ ID NO: 1501632 - protein, 19 aa, Mycobacterium tuberculosis
PRCCWPARCTTAIPCRSTS

SEQ ID NO: 1501633 - protein, 20 aa, Mycobacterium tuberculosis
PRCGPCCARGSWANTTGYPR

SEQ ID NO: 1501634 - protein, 17 aa, Mycobacterium tuberculosis
PRFHITWGTGPALVDKF

SEQ ID NO: 1501635 - protein, 24 aa, Mycobacterium tuberculosis
PRFPMPALRPPWFATPKFSVRLPV

SEQ ID NO: 1501636 - protein, 21 aa, Mycobacterium tuberculosis
PRGAGLLQLEHRAFVGLLQFR

SEQ ID NO: 1501637 - protein, 23 aa, Mycobacterium tuberculosis
PRGGWRPACRRGRAVWRQIGTLC

SEQ ID NO: 1501638 - protein, 34 aa, Mycobacterium tuberculosis
PRGRSFPGCRGWPRRTRSSAGFGAPRYGAKPIVV

SEQ ID NO: 1501639 - protein, 26 aa, Mycobacterium tuberculosis
PRKRRAKRFAFEFGGAGGVGGSSEDV

SEQ ID NO: 1501640 - protein, 19 aa, Mycobacterium tuberculosis
PRLATMGVIASYCLTEPGA

SEQ ID NO: 1501641 - protein, 22 aa, Mycobacterium tuberculosis
PRLEIPNGWCVQAFRFTLDPTA

SEQ ID NO: 1501642 - protein, 19 aa, Mycobacterium tuberculosis
PRLLIEFCLLATQYDAIAA

SEQ ID NO: 1501643 - protein, 20 aa, Mycobacterium tuberculosis
PRLNTGLTPFLLGPVYISNN

SEQ ID NO: 1501644 - protein, 18 aa, Mycobacterium tuberculosis
PRLQRRRVRHSDAAVSTK

SEQ ID NO: 1501645 - protein, 20 aa, Mycobacterium tuberculosis
PRLRYLLAVKACFAVFQNRD

SEQ ID NO: 1501646 - protein, 20 aa, Mycobacterium tuberculosis
PRLSLQWWVRVESLAKAAGD

SEQ ID NO: 1501647 - protein, 17 aa, Mycobacterium tuberculosis
PRPAISARSAWPRGGPR

SEQ ID NO: 1501648 - protein, 18 aa, Mycobacterium tuberculosis
PRPALKKATAITPGLESP

SEQ ID NO: 1501649 - protein, 17 aa, Mycobacterium tuberculosis
PRPASVITIARPGTSLS

SEQ ID NO: 1501650 - protein, 28 aa, Mycobacterium tuberculosis
PRQLQRSAPGWRSTRGGNVYVTNFGSGT

SEQ ID NO: 1501651 - protein, 17 aa, Mycobacterium tuberculosis
PRRAGVSSFGFGGTNAH

SEQ ID NO: 1501652 - protein, 19 aa, Mycobacterium tuberculosis
PRRRRGWCPGWGRRDMRAK

SEQ ID NO: 1501653 - protein, 20 aa, Mycobacterium tuberculosis
PRTAAAMGRPRCRPGRPGGD

SEQ ID NO: 1501654 - protein, 21 aa, Mycobacterium tuberculosis
PRTGSGFPFRRVLHHHRWPGW

SEQ ID NO: 1501655 - protein, 20 aa, Mycobacterium tuberculosis
PRTRSGIMALELLDGTPDWD

SEQ ID NO: 1501656 - protein, 20 aa, Mycobacterium tuberculosis
PRVATLPHWPLIYAGALEGL

SEQ ID NO: 1501657 - protein, 18 aa, Mycobacterium tuberculosis
PRVRCCCCYLGSANRDDR

SEQ ID NO: 1501658 - protein, 21 aa, Mycobacterium tuberculosis
PRVRDGLAWCYARVQIMRYRG

SEQ ID NO: 1501659 - protein, 17 aa, Mycobacterium tuberculosis
PRWLDVPGHHRALPQRR

SEQ ID NO: 1501660 - protein, 17 aa, Mycobacterium tuberculosis
PRYWLMNAIEKAPQGPP

SEQ ID NO: 1501661 - protein, 19 aa, Mycobacterium tuberculosis
PSAPMPGCTLICIGSHGPP

SEQ ID NO: 1501662 - protein, 23 aa, Mycobacterium tuberculosis
PSAYDLGTVIGFYGLTIDEPPTG

SEQ ID NO: 1501663 - protein, 19 aa, Mycobacterium tuberculosis
PSCPPHWWPTTAIRRRVPP

SEQ ID NO: 1501664 - protein, 17 aa, Mycobacterium tuberculosis
PSDSVAIALRVGVPIYV

SEQ ID NO: 1501665 - protein, 22 aa, Mycobacterium tuberculosis
PSERRGPAAVRPFGQAGGGRAN

SEQ ID NO: 1501666 - protein, 24 aa, Mycobacterium tuberculosis
PSGACWRSSPRWDAHSFALLRPQS

SEQ ID NO: 1501667 - protein, 19 aa, Mycobacterium tuberculosis
PSGGLACFGEAIPVQAIAQ

SEQ ID NO: 1501668 - protein, 18 aa, Mycobacterium tuberculosis
PSHLGLRLVPPTRAARTE

SEQ ID NO: 1501669 - protein, 17 aa, Mycobacterium tuberculosis
PSIACSRWGMLSPEGRC

SEQ ID NO: 1501670 - protein, 21 aa, Mycobacterium tuberculosis
PSIACSRWGMLSPEGRCKTFD

SEQ ID NO: 1501671 - protein, 17 aa, Mycobacterium tuberculosis
PSKAELVLAAFIEGIRQ

SEQ ID NO: 1501672 - protein, 18 aa, Mycobacterium tuberculosis
PSLARWARANGWSAPPGA

SEQ ID NO: 1501673 - protein, 17 aa, Mycobacterium tuberculosis
PSLFAIYPTNDWHERET

SEQ ID NO: 1501674 - protein, 21 aa, Mycobacterium tuberculosis
PSLRCAPAFDVDGMRTDSGSG

SEQ ID NO: 1501675 - protein, 17 aa, Mycobacterium tuberculosis
PSLSSSVPILGPYEDLI

SEQ ID NO: 1501676 - protein, 25 aa, Mycobacterium tuberculosis
PSPRSLRPATAVPAATAANVGVAGQ

SEQ ID NO: 1501677 - protein, 18 aa, Mycobacterium tuberculosis
PSPVGWYRWQQCPHRHSL

SEQ ID NO: 1501678 - protein, 19 aa, Mycobacterium tuberculosis
PSPWLKRARANSCVASGAL

SEQ ID NO: 1501679 - protein, 18 aa, Mycobacterium tuberculosis
PSTCTAIRSPPCWPGSTW

SEQ ID NO: 1501680 - protein, 20 aa, Mycobacterium tuberculosis
PSTRWRRLRWNRWMPTRGST

SEQ ID NO: 1501681 - protein, 20 aa, Mycobacterium tuberculosis
PSYTRPASWRGLDVPEGPTL

SEQ ID NO: 1501682 - protein, 18 aa, Mycobacterium tuberculosis
PTCLERGAGIPAVERLAY

SEQ ID NO: 1501683 - protein, 19 aa, Mycobacterium tuberculosis
PTDHPAVWNHPVVDPHTVE

SEQ ID NO: 1501684 - protein, 18 aa, Mycobacterium tuberculosis
PTELCFVPRIWDMVFAEF

SEQ ID NO: 1501685 - protein, 22 aa, Mycobacterium tuberculosis
PTGRHAFGASFLARIFPPGSHI

SEQ ID NO: 1501686 - protein, 18 aa, Mycobacterium tuberculosis
PTGTRWLPHPGPLILQAT

SEQ ID NO: 1501687 - protein, 23 aa, Mycobacterium tuberculosis
PTLIRMFMKWGREIPDSHDLSSL

SEQ ID NO: 1501688 - protein, 17 aa, Mycobacterium tuberculosis
PTLSWPRNLPIDGEPAE

SEQ ID NO: 1501689 - protein, 18 aa, Mycobacterium tuberculosis
PTPDRVRELVVAWGKLYP

SEQ ID NO: 1501690 - protein, 18 aa, Mycobacterium tuberculosis
PTPKGCVFEYVYLARPDS

SEQ ID NO: 1501691 - protein, 17 aa, Mycobacterium tuberculosis
PTPRPASVITIARPGTS

SEQ ID NO: 1501692 - protein, 22 aa, Mycobacterium tuberculosis
PTPVLCPCPPLPPAPPTPPSTP

SEQ ID NO: 1501693 - protein, 26 aa, Mycobacterium tuberculosis
PTQTLLGRPLIGDGANATTPGGAGGD

SEQ ID NO: 1501694 - protein, 24 aa, Mycobacterium tuberculosis
PTRAAICRFATWWVVLERHGNVVR

SEQ ID NO: 1501695 - protein, 17 aa, Mycobacterium tuberculosis
PTRAPARGWTRWSDGAG

SEQ ID NO: 1501696 - protein, 18 aa, Mycobacterium tuberculosis
PTRCAAWVAGLRGCRWRT

SEQ ID NO: 1501697 - protein, 19 aa, Mycobacterium tuberculosis
PTRRLNLLVAPMARLRWPK

SEQ ID NO: 1501698 - protein, 19 aa, Mycobacterium tuberculosis
PTTARCGWLLSLGGAATDR

SEQ ID NO: 1501699 - protein, 23 aa, Mycobacterium tuberculosis
PTVATGRCAVLAGAAGAAGAAVA

SEQ ID NO: 1501700 - protein, 20 aa, Mycobacterium tuberculosis
PTWRPAAPRTRLRRLQTCPA

SEQ ID NO: 1501701 - protein, 19 aa, Mycobacterium tuberculosis
PVAACATAAVSVEEGVDKI

SEQ ID NO: 1501702 - protein, 21 aa, Mycobacterium tuberculosis
PVAAFKWRAQLPIEDSGRVEQ

SEQ ID NO: 1501703 - protein, 20 aa, Mycobacterium tuberculosis
PVAEYWPEFGANGKSEVTVS

SEQ ID NO: 1501704 - protein, 18 aa, Mycobacterium tuberculosis
PVARRLRESFGGSKPAPA

SEQ ID NO: 1501705 - protein, 19 aa, Mycobacterium tuberculosis
PVCLGLPGSLPVLNRAAVE

SEQ ID NO: 1501706 - protein, 21 aa, Mycobacterium tuberculosis
PVEALARVEFCGQGVDLIAEL

SEQ ID NO: 1501707 - protein, 28 aa, Mycobacterium tuberculosis
PVHPARLAVPVGLPGYWATAGAAEPAGR

SEQ ID NO: 1501708 - protein, 17 aa, Mycobacterium tuberculosis
PVITRWVSAASTRVAAT

SEQ ID NO: 1501709 - protein, 25 aa, Mycobacterium tuberculosis
PVPFPSFKNGVGLMLQLPQATVVGT

SEQ ID NO: 1501710 - protein, 18 aa, Mycobacterium tuberculosis
PVPIPWSVLSLFVPGPTL

SEQ ID NO: 1501711 - protein, 17 aa, Mycobacterium tuberculosis
PVVVAARLDRAALAGAE

SEQ ID NO: 1501712 - protein, 22 aa, Mycobacterium tuberculosis
PVYCFTLPFAHQALMPINVVAT

SEQ ID NO: 1501713 - protein, 21 aa, Mycobacterium tuberculosis
PWAEFAAAISGFWVPAPPALL

SEQ ID NO: 1501714 - protein, 18 aa, Mycobacterium tuberculosis
PWHNLQQDILSFINEPTE

SEQ ID NO: 1501715 - protein, 20 aa, Mycobacterium tuberculosis
PWHPGRCAQVFVGESSVGHA

SEQ ID NO: 1501716 - protein, 26 aa, Mycobacterium tuberculosis
PWIHCWSRNRHQLVSLVLSNLFGQNA

SEQ ID NO: 1501717 - protein, 24 aa, Mycobacterium tuberculosis
PWIRRSRCWIRWATPPCGRTHCIG

SEQ ID NO: 1501718 - protein, 22 aa, Mycobacterium tuberculosis
PWQPCGSAARFSRRPGHRPRRR

SEQ ID NO: 1501719 - protein, 18 aa, Mycobacterium tuberculosis
PWVQYGFNLTAWAVGWLP

SEQ ID NO: 1501720 - protein, 18 aa, Mycobacterium tuberculosis
PYGGVWLHSWLDRDRGIS

SEQ ID NO: 1501721 - protein, 17 aa, Mycobacterium tuberculosis
PYHLKRLLGRGGMGEVY

SEQ ID NO: 1501722 - protein, 17 aa, Mycobacterium tuberculosis
QAAAAWDGLAAELGTAA

SEQ ID NO: 1501723 - protein, 23 aa, Mycobacterium tuberculosis
QAAAFHERFIQALSTAAGAYGSA

SEQ ID NO: 1501724 - protein, 17 aa, Mycobacterium tuberculosis
QAAAFHSEFTRTLEAAG

SEQ ID NO: 1501725 - protein, 22 aa, Mycobacterium tuberculosis
QAEARQLLDLMVHSVYSNKDAF

SEQ ID NO: 1501726 - protein, 21 aa, Mycobacterium tuberculosis
QALFGRPLIGNGADGSPGTGQ

SEQ ID NO: 1501727 - protein, 21 aa, Mycobacterium tuberculosis
QALLGRPLIGNGANGADGTGA

SEQ ID NO: 1501728 - protein, 20 aa, Mycobacterium tuberculosis
QATAVIPVIGPVTVTLEGTP

SEQ ID NO: 1501729 - protein, 19 aa, Mycobacterium tuberculosis
QCTTMSWPQRADHAAQAAR

SEQ ID NO: 1501730 - protein, 18 aa, Mycobacterium tuberculosis
QDGHWRLGPAITELATHV

SEQ ID NO: 1501731 - protein, 17 aa, Mycobacterium tuberculosis
QDTMAMFGYASSSATAS

SEQ ID NO: 1501732 - protein, 22 aa, Mycobacterium tuberculosis
QEVRWCPGCGDYVILNTIRNFL

SEQ ID NO: 1501733 - protein, 17 aa, Mycobacterium tuberculosis
QEWLRFGWFFLATRRDP

SEQ ID NO: 1501734 - protein, 17 aa, Mycobacterium tuberculosis
QFTHCIDIAPTVLVAIG

SEQ ID NO: 1501735 - protein, 18 aa, Mycobacterium tuberculosis
QFVKRLGTHAAIFTVPNF

SEQ ID NO: 1501736 - protein, 22 aa, Mycobacterium tuberculosis
QGLCGYPGVLLLLIPQRTAQVV

SEQ ID NO: 1501737 - protein, 17 aa, Mycobacterium tuberculosis
QGPRVGRGFDVRVADQR

SEQ ID NO: 1501738 - protein, 23 aa, Mycobacterium tuberculosis
QGRVALDWLDRVDVIGHSRSSGR

SEQ ID NO: 1501739 - protein, 17 aa, Mycobacterium tuberculosis
QGYYPGIGAPSWTADYG

SEQ ID NO: 1501740 - protein, 20 aa, Mycobacterium tuberculosis
QHNGRLGLIGTRWRPIDPGP

SEQ ID NO: 1501741 - protein, 20 aa, Mycobacterium tuberculosis
QHPWPPRVATLPHWPLIYAG

SEQ ID NO: 1501742 - protein, 19 aa, Mycobacterium tuberculosis
QHRPRWQVTVSVVFDDWAA

SEQ ID NO: 1501743 - protein, 19 aa, Mycobacterium tuberculosis
QIGKFRLVFLTGPKQGEDD

SEQ ID NO: 1501744 - protein, 20 aa, Mycobacterium tuberculosis
QIKLAVLVATNFFGINTIPI

SEQ ID NO: 1501745 - protein, 17 aa, Mycobacterium tuberculosis
QITGLRSGFGGAGGAGG

SEQ ID NO: 1501746 - protein, 18 aa, Mycobacterium tuberculosis
QLDRIGCDQGKYLAIMEH

SEQ ID NO: 1501747 - protein, 21 aa, Mycobacterium tuberculosis
QLFKQLLMVAGMERYYQIARC

SEQ ID NO: 1501748 - protein, 20 aa, Mycobacterium tuberculosis
QLLLGRPLIGDGANGGPGQN

SEQ ID NO: 1501749 - protein, 17 aa, Mycobacterium tuberculosis
QLNAVAVAAGWRNDDGG

SEQ ID NO: 1501750 - protein, 19 aa, Mycobacterium tuberculosis
QLPLLPGWPSSPSSPSAPP

SEQ ID NO: 1501751 - protein, 18 aa, Mycobacterium tuberculosis
QLRWPLRMLLGGKPLQHI

SEQ ID NO: 1501752 - protein, 18 aa, Mycobacterium tuberculosis
QMSALLMAIVWRGMDRGE

SEQ ID NO: 1501753 - protein, 18 aa, Mycobacterium tuberculosis
QNFIHEFGMSGSRRHVTA

SEQ ID NO: 1501754 - protein, 24 aa, Mycobacterium tuberculosis
QPGGWSAGSRGAHPPGKGEKKKKK

SEQ ID NO: 1501755 - protein, 17 aa, Mycobacterium tuberculosis
QPGRAVGRLGLSELRRA

SEQ ID NO: 1501756 - protein, 19 aa, Mycobacterium tuberculosis
QPGRWGRTVVCARLSSADQ

SEQ ID NO: 1501757 - protein, 21 aa, Mycobacterium tuberculosis
QPHTHPAPLMPAVPAPTRRWG

SEQ ID NO: 1501758 - protein, 26 aa, Mycobacterium tuberculosis
QPPACLRFLQRPVIRAPVAASASSAP

SEQ ID NO: 1501759 - protein, 22 aa, Mycobacterium tuberculosis
QPRCGLGWRARVHRRRRAGVDP

SEQ ID NO: 1501760 - protein, 17 aa, Mycobacterium tuberculosis
QPVDCRFCHVTVTVKRL

SEQ ID NO: 1501761 - protein, 20 aa, Mycobacterium tuberculosis
QPVLLDWAVGLAFPCQQPML

SEQ ID NO: 1501762 - protein, 24 aa, Mycobacterium tuberculosis
QPVLLDWAVGLAFPCQQPMLHANG

SEQ ID NO: 1501763 - protein, 17 aa, Mycobacterium tuberculosis
QPVRRFGWRIMPQNLSD

SEQ ID NO: 1501764 - protein, 19 aa, Mycobacterium tuberculosis
QPYWYWALDRESIGGSVSA

SEQ ID NO: 1501765 - protein, 17 aa, Mycobacterium tuberculosis
QQAGWCLRRARGRRDRR

SEQ ID NO: 1501766 - protein, 21 aa, Mycobacterium tuberculosis
QQALRGLPGLGQVASAISGGA

SEQ ID NO: 1501767 - protein, 23 aa, Mycobacterium tuberculosis
QQPPGPGRRWAAQAAPGGTGGYI

SEQ ID NO: 1501768 - protein, 26 aa, Mycobacterium tuberculosis
QQVCAEWTRRGWLAVRYNLPYRRRRP

SEQ ID NO: 1501769 - protein, 17 aa, Mycobacterium tuberculosis
QQYPLDRLKAIGAQYDA

SEQ ID NO: 1501770 - protein, 22 aa, Mycobacterium tuberculosis
QRAVIWPLVYLKSLTLKGFKSF

SEQ ID NO: 1501771 - protein, 23 aa, Mycobacterium tuberculosis
QRECGIVQFGYRQCRVLQLRHRE

SEQ ID NO: 1501772 - protein, 17 aa, Mycobacterium tuberculosis
QRGWPVFCVSTATRENL

SEQ ID NO: 1501773 - protein, 19 aa, Mycobacterium tuberculosis
QRLRLPWWHLWRAAEAAGA

SEQ ID NO: 1501774 - protein, 17 aa, Mycobacterium tuberculosis
QRLSHRWECSRSGTVVD

SEQ ID NO: 1501775 - protein, 27 aa, Mycobacterium tuberculosis
QRPTRLAVCLDLDWRPQFRVDLIPSYK

SEQ ID NO: 1501776 - protein, 17 aa, Mycobacterium tuberculosis
QRRASPVAVEWGCGCGV

SEQ ID NO: 1501777 - protein, 17 aa, Mycobacterium tuberculosis
QRVLGLHFFNPVPVLPL

SEQ ID NO: 1501778 - protein, 17 aa, Mycobacterium tuberculosis
QRWCGSGLLGALSPRPL

SEQ ID NO: 1501779 - protein, 18 aa, Mycobacterium tuberculosis
QRWGGHPDRGQWRQRRPR

SEQ ID NO: 1501780 - protein, 18 aa, Mycobacterium tuberculosis
QRWPETRIDPSLTQISAL

SEQ ID NO: 1501781 - protein, 18 aa, Mycobacterium tuberculosis
QRWWPLDSRRPAALQTEL

SEQ ID NO: 1501782 - protein, 17 aa, Mycobacterium tuberculosis
QRYEVVDLLSLLADKSL

SEQ ID NO: 1501783 - protein, 21 aa, Mycobacterium tuberculosis
QSGSIGLGFAIPVDQAKRIAD

SEQ ID NO: 1501784 - protein, 17 aa, Mycobacterium tuberculosis
QSLRFTAALDELLAPLA

SEQ ID NO: 1501785 - protein, 24 aa, Mycobacterium tuberculosis
QSPKETWLRLLLIRAGFPRPQTQI

SEQ ID NO: 1501786 - protein, 22 aa, Mycobacterium tuberculosis
QSRRERGPAMEYLIAAQDVLVA

SEQ ID NO: 1501787 - protein, 18 aa, Mycobacterium tuberculosis
QVAEAFGRYGAYLSQLNV

SEQ ID NO: 1501788 - protein, 22 aa, Mycobacterium tuberculosis
QVARAALLFGMCFDAESAVRHG

SEQ ID NO: 1501789 - protein, 26 aa, Mycobacterium tuberculosis
QVLKEIRSRLGFLLDVGLEYLSLSRA

SEQ ID NO: 1501790 - protein, 21 aa, Mycobacterium tuberculosis
QVPRWCQVAGAGGARSAGAGG

SEQ ID NO: 1501791 - protein, 18 aa, Mycobacterium tuberculosis
QVRVGFRLGEPAAGELGV

SEQ ID NO: 1501792 - protein, 23 aa, Mycobacterium tuberculosis
QVVPWASLLQRFPGLGAGATGAT

SEQ ID NO: 1501793 - protein, 17 aa, Mycobacterium tuberculosis
QWLGIDCIWLPPFYDSP

SEQ ID NO: 1501794 - protein, 17 aa, Mycobacterium tuberculosis
QWWPFIGNLSLDQSIAQ

SEQ ID NO: 1501795 - protein, 17 aa, Mycobacterium tuberculosis
QYSQWGALLARTDPSAP

SEQ ID NO: 1501796 - protein, 17 aa, Mycobacterium tuberculosis
RAAAAWDGLAEELGTAA

SEQ ID NO: 1501797 - protein, 24 aa, Mycobacterium tuberculosis
RAACSASPVAPGWAVPPVAGVMAG

SEQ ID NO: 1501798 - protein, 19 aa, Mycobacterium tuberculosis
RAALASGAARGTRAADAAG

SEQ ID NO: 1501799 - protein, 19 aa, Mycobacterium tuberculosis
RAALQRWSLMRSDHPVTSV

SEQ ID NO: 1501800 - protein, 18 aa, Mycobacterium tuberculosis
RAAMKWCRKAQELGTLDE

SEQ ID NO: 1501801 - protein, 17 aa, Mycobacterium tuberculosis
RAARLGHRLTIAMTRWQ

SEQ ID NO: 1501802 - protein, 18 aa, Mycobacterium tuberculosis
RAARRQKAGPAAAPAPAA

SEQ ID NO: 1501803 - protein, 17 aa, Mycobacterium tuberculosis
RAARVAVRWLRAVALDR

SEQ ID NO: 1501804 - protein, 21 aa, Mycobacterium tuberculosis
RACIRGRWFIVAARPGVGKST

SEQ ID NO: 1501805 - protein, 20 aa, Mycobacterium tuberculosis
RADERFAFCSTFKAPLVAAV

SEQ ID NO: 1501806 - protein, 18 aa, Mycobacterium tuberculosis
RADIAIVFALRAEGEGFD

SEQ ID NO: 1501807 - protein, 19 aa, Mycobacterium tuberculosis
RAEGVACYQLFISGLLDVT

SEQ ID NO: 1501808 - protein, 18 aa, Mycobacterium tuberculosis
RAFRLQWPIGTTIFELDR

SEQ ID NO: 1501809 - protein, 21 aa, Mycobacterium tuberculosis
RAGCSGSPPSAPWRSQTPRLA

SEQ ID NO: 1501810 - protein, 18 aa, Mycobacterium tuberculosis
RAGDCGRDYRVLSAALLE

SEQ ID NO: 1501811 - protein, 19 aa, Mycobacterium tuberculosis
RAGDCGRDYRVLSAALLEV

SEQ ID NO: 1501812 - protein, 17 aa, Mycobacterium tuberculosis
RAGEITAEMAFIAARED

SEQ ID NO: 1501813 - protein, 18 aa, Mycobacterium tuberculosis
RAGLPPTLAVAGSYLDGI

SEQ ID NO: 1501814 - protein, 18 aa, Mycobacterium tuberculosis
RAGRGRRARRVGASPEAG

SEQ ID NO: 1501815 - protein, 28 aa, Mycobacterium tuberculosis
RAGRGWRRWKTPSRSIGWWLRIVANPGM

SEQ ID NO: 1501816 - protein, 19 aa, Mycobacterium tuberculosis
RAGVLRFVVLDGLAKPGRM

SEQ ID NO: 1501817 - protein, 22 aa, Mycobacterium tuberculosis
RAGWSGVRWRNLTGGIVALHAG

SEQ ID NO: 1501818 - protein, 19 aa, Mycobacterium tuberculosis
RALEDWCHQLAWPIRPAVS

SEQ ID NO: 1501819 - protein, 18 aa, Mycobacterium tuberculosis
RALELGCGTGFFLLNLIQ

SEQ ID NO: 1501820 - protein, 20 aa, Mycobacterium tuberculosis
RALGRYGVCANVICPRARTA

SEQ ID NO: 1501821 - protein, 18 aa, Mycobacterium tuberculosis
RANLERWAPLLPEGATLV

SEQ ID NO: 1501822 - protein, 17 aa, Mycobacterium tuberculosis
RAPHAGGREVLRVEVGA

SEQ ID NO: 1501823 - protein, 20 aa, Mycobacterium tuberculosis
RARGCAKWLASEDFSQAIDH

SEQ ID NO: 1501824 - protein, 23 aa, Mycobacterium tuberculosis
RARGRLQDGLAWFAAALANHDAH

SEQ ID NO: 1501825 - protein, 23 aa, Mycobacterium tuberculosis
RARGRLQEGLAWFAAALADHDAH

SEQ ID NO: 1501826 - protein, 21 aa, Mycobacterium tuberculosis
RARLAAAIGLPGNRVVWMNQV

SEQ ID NO: 1501827 - protein, 17 aa, Mycobacterium tuberculosis
RARLYLCTDARRERGDL

SEQ ID NO: 1501828 - protein, 21 aa, Mycobacterium tuberculosis
RARQRLCRWPSNLVADVVLNG

SEQ ID NO: 1501829 - protein, 20 aa, Mycobacterium tuberculosis
RARRAIAEFRIRGVSTNIPF

SEQ ID NO: 1501830 - protein, 28 aa, Mycobacterium tuberculosis
RASAVTTPRWQCCSGESKKKNLYSLKYW

SEQ ID NO: 1501831 - protein, 19 aa, Mycobacterium tuberculosis
RASPVAVEWGCGCGVAGSA

SEQ ID NO: 1501832 - protein, 29 aa, Mycobacterium tuberculosis
RASSTWADSPRAWPIRAPSRLQVWRTRAT

SEQ ID NO: 1501833 - protein, 17 aa, Mycobacterium tuberculosis
RASVCVLGPLVGRCKRA

SEQ ID NO: 1501834 - protein, 22 aa, Mycobacterium tuberculosis
RASVGLPGFLVGGVVRITRASG

SEQ ID NO: 1501835 - protein, 20 aa, Mycobacterium tuberculosis
RATLRWARGYSCCRPRPATH

SEQ ID NO: 1501836 - protein, 18 aa, Mycobacterium tuberculosis
RATSHWLTLPALKAFGAI

SEQ ID NO: 1501837 - protein, 17 aa, Mycobacterium tuberculosis
RAVGDWLVRPGAQLQAV

SEQ ID NO: 1501838 - protein, 20 aa, Mycobacterium tuberculosis
RAVGRLGLSELRRAILGLFQ

SEQ ID NO: 1501839 - protein, 21 aa, Mycobacterium tuberculosis
RAVPAERLWVNPDCGLKTRNV

SEQ ID NO: 1501840 - protein, 17 aa, Mycobacterium tuberculosis
RAVPLVGGLWFRFLHSV

SEQ ID NO: 1501841 - protein, 21 aa, Mycobacterium tuberculosis
RAWCVRARWPPSSRHALPNLI

SEQ ID NO: 1501842 - protein, 25 aa, Mycobacterium tuberculosis
RAWERGRFAAPYLRDSLLAAGALCE

SEQ ID NO: 1501843 - protein, 24 aa, Mycobacterium tuberculosis
RAYFRGECLRRFGADIAAASWDSV

SEQ ID NO: 1501844 - protein, 19 aa, Mycobacterium tuberculosis
RAYRLDWPAGTIVYEIDQP

SEQ ID NO: 1501845 - protein, 22 aa, Mycobacterium tuberculosis
RAYRLPWPAGTVVYEIDQPQVI

SEQ ID NO: 1501846 - protein, 17 aa, Mycobacterium tuberculosis
RAYRLPWPDGTTVFELD

SEQ ID NO: 1501847 - protein, 19 aa, Mycobacterium tuberculosis
RAYRLPWPTMTVVYEIDQP

SEQ ID NO: 1501848 - protein, 21 aa, Mycobacterium tuberculosis
RAYRLRWPAGTIVFEVDQPQV

SEQ ID NO: 1501849 - protein, 25 aa, Mycobacterium tuberculosis
RCAARPRLRPGIGFVGCRNAYHVGA

SEQ ID NO: 1501850 - protein, 22 aa, Mycobacterium tuberculosis
RCAVGIPTVSGWRMLSGDETGW

SEQ ID NO: 1501851 - protein, 25 aa, Mycobacterium tuberculosis
RCCAPGRRPARCWPSSVSWAARLLA

SEQ ID NO: 1501852 - protein, 24 aa, Mycobacterium tuberculosis
RCGRSRWGGLAGRQRRCRRVRRGG

SEQ ID NO: 1501853 - protein, 20 aa, Mycobacterium tuberculosis
RCGVPGAACKRGWPGSPPPW

SEQ ID NO: 1501854 - protein, 26 aa, Mycobacterium tuberculosis
RCPAGKRLPCFGFWAGAGPGRAGIGG

SEQ ID NO: 1501855 - protein, 18 aa, Mycobacterium tuberculosis
RCPDRPGLIDELGTLTWR

SEQ ID NO: 1501856 - protein, 19 aa, Mycobacterium tuberculosis
RCQKVLEGTGFVISPDRVM

SEQ ID NO: 1501857 - protein, 17 aa, Mycobacterium tuberculosis
RCRCAKRSRTGGCRAAW

SEQ ID NO: 1501858 - protein, 23 aa, Mycobacterium tuberculosis
RCWPRQRPGTGWPPNYSPTAADY

SEQ ID NO: 1501859 - protein, 18 aa, Mycobacterium tuberculosis
RDAALCLAVLRVGADPEG

SEQ ID NO: 1501860 - protein, 22 aa, Mycobacterium tuberculosis
RDGLLRFCRYMEALAAYKKYLD

SEQ ID NO: 1501861 - protein, 17 aa, Mycobacterium tuberculosis
RDLRFGYRTSVLKHADG

SEQ ID NO: 1501862 - protein, 17 aa, Mycobacterium tuberculosis
RDPRGAGLLQLEHRAFV

SEQ ID NO: 1501863 - protein, 21 aa, Mycobacterium tuberculosis
RDPRIWARWAAAWRGHGGLRV

SEQ ID NO: 1501864 - protein, 19 aa, Mycobacterium tuberculosis
RDQIGIVFQFFNLIPTLTV

SEQ ID NO: 1501865 - protein, 20 aa, Mycobacterium tuberculosis
RDRGGRRGPARSVGVRRQRG

SEQ ID NO: 1501866 - protein, 17 aa, Mycobacterium tuberculosis
RDVLVALGMYPGGGELG

SEQ ID NO: 1501867 - protein, 21 aa, Mycobacterium tuberculosis
RDVPCPVCAGTRLKPEILAVT

SEQ ID NO: 1501868 - protein, 20 aa, Mycobacterium tuberculosis
REARWVWPADGMVVMNFSVL

SEQ ID NO: 1501869 - protein, 17 aa, Mycobacterium tuberculosis
REDPPRRLAGFPATVTD

SEQ ID NO: 1501870 - protein, 18 aa, Mycobacterium tuberculosis
RELTEAFANMGIRDLRDD

SEQ ID NO: 1501871 - protein, 17 aa, Mycobacterium tuberculosis
REPRPVLAPTPASSEPT

SEQ ID NO: 1501872 - protein, 17 aa, Mycobacterium tuberculosis
RERCILCARCTRFSDQI

SEQ ID NO: 1501873 - protein, 18 aa, Mycobacterium tuberculosis
RERCILCARCTRFSDQIA

SEQ ID NO: 1501874 - protein, 18 aa, Mycobacterium tuberculosis
RERLGLPGLRDWLRRQAK

SEQ ID NO: 1501875 - protein, 22 aa, Mycobacterium tuberculosis
RERPGRLLGFHWTKVHPDHPGL

SEQ ID NO: 1501876 - protein, 25 aa, Mycobacterium tuberculosis
RERRCWPRWPSWPPAVAAQLVAGGL

SEQ ID NO: 1501877 - protein, 18 aa, Mycobacterium tuberculosis
RERSRICISVSRPRRGRH

SEQ ID NO: 1501878 - protein, 17 aa, Mycobacterium tuberculosis
RERTQRLAIAGRPATTR

SEQ ID NO: 1501879 - protein, 20 aa, Mycobacterium tuberculosis
RERTQRLAIAGRPATTRGVE

SEQ ID NO: 1501880 - protein, 17 aa, Mycobacterium tuberculosis
REYRITPVFVEVREGQS

SEQ ID NO: 1501881 - protein, 19 aa, Mycobacterium tuberculosis
RFAAPCPGQHGWRAPAAAA

SEQ ID NO: 1501882 - protein, 20 aa, Mycobacterium tuberculosis
RFADWLVRVVEAFADRPDQR

SEQ ID NO: 1501883 - protein, 20 aa, Mycobacterium tuberculosis
RFDFAFSLNVMEHIDLPDEA

SEQ ID NO: 1501884 - protein, 19 aa, Mycobacterium tuberculosis
RFGALIPRLVRQGINGEGL

SEQ ID NO: 1501885 - protein, 20 aa, Mycobacterium tuberculosis
RFGSLYLRDGVSLAGQQVVP

SEQ ID NO: 1501886 - protein, 21 aa, Mycobacterium tuberculosis
RFHIFSHSWGGMLAQQYVLDK

SEQ ID NO: 1501887 - protein, 24 aa, Mycobacterium tuberculosis
RFLERRLRETFGFDGSPIRVNVRV

SEQ ID NO: 1501888 - protein, 20 aa, Mycobacterium tuberculosis
RFPKFDWPRIDAPYMRPGLD

SEQ ID NO: 1501889 - protein, 19 aa, Mycobacterium tuberculosis
RFQMACAVHRFGDRPALDV

SEQ ID NO: 1501890 - protein, 17 aa, Mycobacterium tuberculosis
RFRCSRFPGAAGEPRGL

SEQ ID NO: 1501891 - protein, 22 aa, Mycobacterium tuberculosis
RFRRRGWRASSMASRRAHMPPP

SEQ ID NO: 1501892 - protein, 23 aa, Mycobacterium tuberculosis
RFRRSWPRHRCCGWNHGPHRLSP

SEQ ID NO: 1501893 - protein, 23 aa, Mycobacterium tuberculosis
RFVRALSAAAGWYVDAEAANAAL

SEQ ID NO: 1501894 - protein, 23 aa, Mycobacterium tuberculosis
RFVRALSAAAGWYVDAEAATRAV

SEQ ID NO: 1501895 - protein, 19 aa, Mycobacterium tuberculosis
RFVVLDGLAKPGRMVGPDP

SEQ ID NO: 1501896 - protein, 17 aa, Mycobacterium tuberculosis
RGAEVFADVTLPEGVPI

SEQ ID NO: 1501897 - protein, 18 aa, Mycobacterium tuberculosis
RGAVALAACSAMVDSAGP

SEQ ID NO: 1501898 - protein, 20 aa, Mycobacterium tuberculosis
RGCLGRPWLFAELSAAFTGS

SEQ ID NO: 1501899 - protein, 18 aa, Mycobacterium tuberculosis
RGDAGGCHRPCARGQHAG

SEQ ID NO: 1501900 - protein, 22 aa, Mycobacterium tuberculosis
RGDAVGACPCGRIRRVGDAGCG

SEQ ID NO: 1501901 - protein, 18 aa, Mycobacterium tuberculosis
RGFSRWLMRAYDVLVDED

SEQ ID NO: 1501902 - protein, 19 aa, Mycobacterium tuberculosis
RGGAGGLGFGSEAPGRPGG

SEQ ID NO: 1501903 - protein, 19 aa, Mycobacterium tuberculosis
RGGALAPGTVRQWLAEHAG

SEQ ID NO: 1501904 - protein, 21 aa, Mycobacterium tuberculosis
RGGDGGVGGWLYGDGGGGDGG

SEQ ID NO: 1501905 - protein, 21 aa, Mycobacterium tuberculosis
RGGDGGVGGWLYGDGGGGGDG

SEQ ID NO: 1501906 - protein, 18 aa, Mycobacterium tuberculosis
RGGDGVFAGAGGQGGLGG

SEQ ID NO: 1501907 - protein, 19 aa, Mycobacterium tuberculosis
RGGDGVFAGAGGQGGLGGQ

SEQ ID NO: 1501908 - protein, 22 aa, Mycobacterium tuberculosis
RGGDGVFFSLFLGTFSGNSLSG

SEQ ID NO: 1501909 - protein, 17 aa, Mycobacterium tuberculosis
RGGGGHHRRRGRGAVAL

SEQ ID NO: 1501910 - protein, 19 aa, Mycobacterium tuberculosis
RGGLLAGQHANSGNGGGGG

SEQ ID NO: 1501911 - protein, 24 aa, Mycobacterium tuberculosis
RGGNGGHGGLWIGNGGDGGAGGVG

SEQ ID NO: 1501912 - protein, 25 aa, Mycobacterium tuberculosis
RGGNGGHGGLWIGNGGDGGAGGVGG

SEQ ID NO: 1501913 - protein, 17 aa, Mycobacterium tuberculosis
RGGRRLFVFLGSTIGNL

SEQ ID NO: 1501914 - protein, 21 aa, Mycobacterium tuberculosis
RGHRKLVRFQARRAIGPIRPT

SEQ ID NO: 1501915 - protein, 17 aa, Mycobacterium tuberculosis
RGLAAFIELRDQRCRTP

SEQ ID NO: 1501916 - protein, 17 aa, Mycobacterium tuberculosis
RGLVCVWRVVGGAVEAA

SEQ ID NO: 1501917 - protein, 25 aa, Mycobacterium tuberculosis
RGPLRGQCALLWRGSRSVQGRSRED

SEQ ID NO: 1501918 - protein, 18 aa, Mycobacterium tuberculosis
RGRAGYRLLYSVRQYALE

SEQ ID NO: 1501919 - protein, 19 aa, Mycobacterium tuberculosis
RGRCDPYDVALRFASRRIP

SEQ ID NO: 1501920 - protein, 23 aa, Mycobacterium tuberculosis
RGRLPVVAGFVFRYIAYHGRSRE

SEQ ID NO: 1501921 - protein, 19 aa, Mycobacterium tuberculosis
RGRLRAGVRRSIWAGSDEE

SEQ ID NO: 1501922 - protein, 22 aa, Mycobacterium tuberculosis
RGRRGRRAVGPCGSGGPGCSVS

SEQ ID NO: 1501923 - protein, 23 aa, Mycobacterium tuberculosis
RGRRLRRCGVLVIRISVYGHRGC

SEQ ID NO: 1501924 - protein, 24 aa, Mycobacterium tuberculosis
RGRRRPRCRRLRRGRRNRRCPREY

SEQ ID NO: 1501925 - protein, 26 aa, Mycobacterium tuberculosis
RGRRRRWRCPAATGAPGGNGGNGGSV

SEQ ID NO: 1501926 - protein, 20 aa, Mycobacterium tuberculosis
RGSPCAIGWVAGWLSAEFPA

SEQ ID NO: 1501927 - protein, 20 aa, Mycobacterium tuberculosis
RGVFRRLKLAGMGRRVLSQR

SEQ ID NO: 1501928 - protein, 20 aa, Mycobacterium tuberculosis
RGVGTAGVWRLPDRNTLQEV

SEQ ID NO: 1501929 - protein, 18 aa, Mycobacterium tuberculosis
RGVPMTAGCVVPRGDVLE

SEQ ID NO: 1501930 - protein, 17 aa, Mycobacterium tuberculosis
RGVRACRGPGAGTRAPA

SEQ ID NO: 1501931 - protein, 17 aa, Mycobacterium tuberculosis
RGWRFPDRLDRVYVNSR

SEQ ID NO: 1501932 - protein, 21 aa, Mycobacterium tuberculosis
RHCAHRHGFGGFGGLGGGSNG

SEQ ID NO: 1501933 - protein, 30 aa, Mycobacterium tuberculosis; identical to SEQ ID NO: 1490060

SEQ ID NO: 1501934 - protein, 18 aa, Mycobacterium tuberculosis
RHILDVKSAIAWARANVD

SEQ ID NO: 1501935 - protein, 19 aa, Mycobacterium tuberculosis
RHKMPLLSLPVMKAPVLTV

SEQ ID NO: 1501936 - protein, 18 aa, Mycobacterium tuberculosis
RHLLPARRRPITSTNPIA

SEQ ID NO: 1501937 - protein, 19 aa, Mycobacterium tuberculosis
RHLLSVLIDREWRHGVRVG

SEQ ID NO: 1501938 - protein, 20 aa, Mycobacterium tuberculosis
RHQPGWGGCRTARPRRPSAW

SEQ ID NO: 1501939 - protein, 18 aa, Mycobacterium tuberculosis
RHTVRFSAAGALGARRRV

SEQ ID NO: 1501940 - protein, 17 aa, Mycobacterium tuberculosis
RHWPTTGSTGWGRLMRR

SEQ ID NO: 1501941 - protein, 19 aa, Mycobacterium tuberculosis
RIAGRLGLRADVRRVPLFG

SEQ ID NO: 1501942 - protein, 17 aa, Mycobacterium tuberculosis
RIAQAVVVAATRNYGVP

SEQ ID NO: 1501943 - protein, 18 aa, Mycobacterium tuberculosis
RIAVLSLKGGVGKTTITA

SEQ ID NO: 1501944 - protein, 23 aa, Mycobacterium tuberculosis
RIEQLRGSPLYTLRTKGKADLLK

SEQ ID NO: 1501945 - protein, 24 aa, Mycobacterium tuberculosis
RIEQLRGSPLYTLRTKGKADLLKP

SEQ ID NO: 1501946 - protein, 23 aa, Mycobacterium tuberculosis
RIFKRIRPAFTYRRSLGVLTAAR

SEQ ID NO: 1501947 - protein, 18 aa, Mycobacterium tuberculosis
RIGQRIAAWLNYYGAGKH

SEQ ID NO: 1501948 - protein, 19 aa, Mycobacterium tuberculosis
RILAPRSRYDEIVAAVTNF

SEQ ID NO: 1501949 - protein, 17 aa, Mycobacterium tuberculosis
RIRGGKVPFVFRTLPGY

SEQ ID NO: 1501950 - protein, 18 aa, Mycobacterium tuberculosis
RISLGPLQVAEHLRDCTA

SEQ ID NO: 1501951 - protein, 17 aa, Mycobacterium tuberculosis
RIYTDFTYRPGSTTIST

SEQ ID NO: 1501952 - protein, 17 aa, Mycobacterium tuberculosis
RIYTDFTYRSGSTTIST

SEQ ID NO: 1501953 - protein, 21 aa, Mycobacterium tuberculosis
RKAACGTGWQLPRRRLRRRAA

SEQ ID NO: 1501954 - protein, 17 aa, Mycobacterium tuberculosis
RKAELDAGYILTCQSHP

SEQ ID NO: 1501955 - protein, 17 aa, Mycobacterium tuberculosis
RKAFGGDGGVGGDGASA

SEQ ID NO: 1501956 - protein, 18 aa, Mycobacterium tuberculosis
RKFFEAFAPYGLKQTAVK

SEQ ID NO: 1501957 - protein, 18 aa, Mycobacterium tuberculosis
RKLWDVPALAFVGIGNGT

SEQ ID NO: 1501958 - protein, 18 aa, Mycobacterium tuberculosis
RKRLRTGLIEAFSTSCPN

SEQ ID NO: 1501959 - protein, 21 aa, Mycobacterium tuberculosis
RKRRMFDLLVRMGYKEIEVGF

SEQ ID NO: 1501960 - protein, 17 aa, Mycobacterium tuberculosis
RKVLELAAALSDDFERA

SEQ ID NO: 1501961 - protein, 20 aa, Mycobacterium tuberculosis
RKVLPGYILVRMDLTDDSWA

SEQ ID NO: 1501962 - protein, 17 aa, Mycobacterium tuberculosis
RKVNALKFIAFVTNPTN

SEQ ID NO: 1501963 - protein, 20 aa, Mycobacterium tuberculosis
RLAAQGWVCLSIDYRVAPHH

SEQ ID NO: 1501964 - protein, 19 aa, Mycobacterium tuberculosis
RLAAQLGMPPWRVQKAQKQ

SEQ ID NO: 1501965 - protein, 20 aa, Mycobacterium tuberculosis
RLAATIPRARFEVIEGARTF

SEQ ID NO: 1501966 - protein, 20 aa, Mycobacterium tuberculosis
RLADQAVRQWGFMQGLKQKL

SEQ ID NO: 1501967 - protein, 17 aa, Mycobacterium tuberculosis
RLAELGGRFWFGLDDGR

SEQ ID NO: 1501968 - protein, 17 aa, Mycobacterium tuberculosis
RLAPRPVFRPPVDPASR

SEQ ID NO: 1501969 - protein, 26 aa, Mycobacterium tuberculosis
RLATRRAAMCPLALRARPSNDRLTPT

SEQ ID NO: 1501970 - protein, 18 aa, Mycobacterium tuberculosis
RLCRSRVGIDAEAGPTEI

SEQ ID NO: 1501971 - protein, 17 aa, Mycobacterium tuberculosis
RLDRAIGGRRRCRGDRA

SEQ ID NO: 1501972 - protein, 21 aa, Mycobacterium tuberculosis
RLEGPAVFRWAAFKMGDVGRR

SEQ ID NO: 1501973 - protein, 17 aa, Mycobacterium tuberculosis
RLFAEGVAVDWSSVFAG

SEQ ID NO: 1501974 - protein, 17 aa, Mycobacterium tuberculosis
RLGDYDVLIGINLLREG

SEQ ID NO: 1501975 - protein, 19 aa, Mycobacterium tuberculosis
RLGPEMNRTVVVELDTSGT

SEQ ID NO: 1501976 - protein, 18 aa, Mycobacterium tuberculosis
RLHWYVPRSIRWIDRLKG

SEQ ID NO: 1501977 - protein, 17 aa, Mycobacterium tuberculosis
RLIPPWVTLGSRLAALP

SEQ ID NO: 1501978 - protein, 17 aa, Mycobacterium tuberculosis
RLKASGIDTVFTLSGGH

SEQ ID NO: 1501979 - protein, 23 aa, Mycobacterium tuberculosis
RLLLEVVCARLLLPSASDAESAL

SEQ ID NO: 1501980 - protein, 17 aa, Mycobacterium tuberculosis
RLLRLCARYSAHPTVIF

SEQ ID NO: 1501981 - protein, 17 aa, Mycobacterium tuberculosis
RLLSGRLRLHHLHRQLR

SEQ ID NO: 1501982 - protein, 18 aa, Mycobacterium tuberculosis
RLLWPALDFHQGVHRALV

SEQ ID NO: 1501983 - protein, 21 aa, Mycobacterium tuberculosis
RLPGSGCARRCWTSHGGRRRR

SEQ ID NO: 1501984 - protein, 17 aa, Mycobacterium tuberculosis
RLPLAIMRLRMLRRRSV

SEQ ID NO: 1501985 - protein, 20 aa, Mycobacterium tuberculosis
RLPTWNRRAPSPGSPPLPPP

SEQ ID NO: 1501986 - protein, 18 aa, Mycobacterium tuberculosis
RLRFLPKLDRAWDSGDHL

SEQ ID NO: 1501987 - protein, 25 aa, Mycobacterium tuberculosis
RLRGHRGANRWTRCRRGFAAGGGKG

SEQ ID NO: 1501988 - protein, 18 aa, Mycobacterium tuberculosis
RLRGPVCAGEDARADQQE

SEQ ID NO: 1501989 - protein, 25 aa, Mycobacterium tuberculosis
RLRPPRPLKGWVFAAGAKRPGAKKT

SEQ ID NO: 1501990 - protein, 21 aa, Mycobacterium tuberculosis
RLRRGRRQRRQTGDAGTNASD

SEQ ID NO: 1501991 - protein, 17 aa, Mycobacterium tuberculosis
RLSEWRATLIVRESACL

SEQ ID NO: 1501992 - protein, 19 aa, Mycobacterium tuberculosis
RLSPAPALLALPAAESAWR

SEQ ID NO: 1501993 - protein, 21 aa, Mycobacterium tuberculosis
RLSPGLKRSSLIGGIRYYDTV

SEQ ID NO: 1501994 - protein, 21 aa, Mycobacterium tuberculosis
RLSPSLKRSSLIGGIRYYDTV

SEQ ID NO: 1501995 - protein, 17 aa, Mycobacterium tuberculosis
RLTSLTWKRCGRSPDQL

SEQ ID NO: 1501996 - protein, 18 aa, Mycobacterium tuberculosis
RLTSLVTHNVFGQNTASI

SEQ ID NO: 1501997 - protein, 20 aa, Mycobacterium tuberculosis
RLVALRLATVGLRAQSLGRH

SEQ ID NO: 1501998 - protein, 18 aa, Mycobacterium tuberculosis
RLVIVLVRRWPKVISRAM

SEQ ID NO: 1501999 - protein, 17 aa, Mycobacterium tuberculosis
RLWRLLLAPGRGIGRLI

SEQ ID NO: 1502000 - protein, 17 aa, Mycobacterium tuberculosis
RLYCGACDAGARSTTSL

SEQ ID NO: 1502001 - protein, 19 aa, Mycobacterium tuberculosis
RLYVGAGLAPMLDAAAAWD

SEQ ID NO: 1502002 - protein, 17 aa, Mycobacterium tuberculosis
RMFDLLVRMGYKEIEVG

SEQ ID NO: 1502003 - protein, 19 aa, Mycobacterium tuberculosis
RMHIRTCRSTRWWRRSPPA

SEQ ID NO: 1502004 - protein, 23 aa, Mycobacterium tuberculosis
RMHLLRLASEFGLTPAAEQRLAV

SEQ ID NO: 1502005 - protein, 22 aa, Mycobacterium tuberculosis
RMRQEITEVIALQERLGLDVLV

SEQ ID NO: 1502006 - protein, 23 aa, Mycobacterium tuberculosis
RMRQEITEVIALQERLGLDVLVH

SEQ ID NO: 1502007 - protein, 18 aa, Mycobacterium tuberculosis
RNAPARGGVVVWHDGHQC

SEQ ID NO: 1502008 - protein, 18 aa, Mycobacterium tuberculosis
RNCCPPCRGSGRADAGHG

SEQ ID NO: 1502009 - protein, 18 aa, Mycobacterium tuberculosis
RNGRRSRAPAGWRGGVRR

SEQ ID NO: 1502010 - protein, 20 aa, Mycobacterium tuberculosis
RNGYFPRRHVFVVPASSARA

SEQ ID NO: 1502011 - protein, 18 aa, Mycobacterium tuberculosis
RNICHQAIFYRRGLFGTI

SEQ ID NO: 1502012 - protein, 25 aa, Mycobacterium tuberculosis
RPAASCTTGGKGRSRAATGAASGGN

SEQ ID NO: 1502013 - protein, 19 aa, Mycobacterium tuberculosis
RPADCLRPLQIHALISEVL

SEQ ID NO: 1502014 - protein, 18 aa, Mycobacterium tuberculosis
RPAIAAVRAEYERVLRQR

SEQ ID NO: 1502015 - protein, 18 aa, Mycobacterium tuberculosis
RPALTINFCVGFVRQQVN

SEQ ID NO: 1502016 - protein, 17 aa, Mycobacterium tuberculosis
RPAPTRCRRASRRCSAA

SEQ ID NO: 1502017 - protein, 19 aa, Mycobacterium tuberculosis
RPARAWLFTVARNMIIDER

SEQ ID NO: 1502018 - protein, 17 aa, Mycobacterium tuberculosis
RPARFAVLLRRLRRRDI

SEQ ID NO: 1502019 - protein, 18 aa, Mycobacterium tuberculosis
RPDFPRPALLSGAGDAVE

SEQ ID NO: 1502020 - protein, 23 aa, Mycobacterium tuberculosis
RPECAPGLPGTRCAAGRQQTEGV

SEQ ID NO: 1502021 - protein, 18 aa, Mycobacterium tuberculosis
RPEMPALLAELGLSDRQL

SEQ ID NO: 1502022 - protein, 20 aa, Mycobacterium tuberculosis
RPGCAPGPDGVRCAASMALA

SEQ ID NO: 1502023 - protein, 19 aa, Mycobacterium tuberculosis
RPGDFFPVPCCFPSCRSIT

SEQ ID NO: 1502024 - protein, 17 aa, Mycobacterium tuberculosis
RPGIAWPVAEAVVRGPL

SEQ ID NO: 1502025 - protein, 24 aa, Mycobacterium tuberculosis
RPGQHAGHALGVFVVAGTGHRPAR

SEQ ID NO: 1502026 - protein, 17 aa, Mycobacterium tuberculosis
RPGVVLHPGQAVCHFGV

SEQ ID NO: 1502027 - protein, 21 aa, Mycobacterium tuberculosis
RPIADVCPVEWARMANRSVLQ

SEQ ID NO: 1502028 - protein, 22 aa, Mycobacterium tuberculosis
RPIEGRTAMSFVIANPEMLAAA

SEQ ID NO: 1502029 - protein, 18 aa, Mycobacterium tuberculosis
RPIHIPPIPVGFAAVGGI

SEQ ID NO: 1502030 - protein, 19 aa, Mycobacterium tuberculosis
RPKHYWSIYQKMIVKGRDF

SEQ ID NO: 1502031 - protein, 19 aa, Mycobacterium tuberculosis
RPLGFRPALGFSRVDTTIS

SEQ ID NO: 1502032 - protein, 17 aa, Mycobacterium tuberculosis
RPLLFALQCMPLNWVRR

SEQ ID NO: 1502033 - protein, 20 aa, Mycobacterium tuberculosis
RPLRGCYRIAVLSLKGGIGK

SEQ ID NO: 1502034 - protein, 18 aa, Mycobacterium tuberculosis
RPLRPSFVDGLRDEIQIV

SEQ ID NO: 1502035 - protein, 19 aa, Mycobacterium tuberculosis
RPLVPAMFSAVLSRLRRTH

SEQ ID NO: 1502036 - protein, 19 aa, Mycobacterium tuberculosis
RPLWECWIIEGLNGNRWAI

SEQ ID NO: 1502037 - protein, 17 aa, Mycobacterium tuberculosis
RPLWEVWVIAGLADSKW

SEQ ID NO: 1502038 - protein, 20 aa, Mycobacterium tuberculosis
RPPECLYGSLKMWAHLQRQG

SEQ ID NO: 1502039 - protein, 27 aa, Mycobacterium tuberculosis
RPPTARVRCSVAWRCRAWLAALPPVLP

SEQ ID NO: 1502040 - protein, 19 aa, Mycobacterium tuberculosis
RPPVRLDLALVFNEGTRLR

SEQ ID NO: 1502041 - protein, 18 aa, Mycobacterium tuberculosis
RPQIAIATWIVPSIVAFG

SEQ ID NO: 1502042 - protein, 20 aa, Mycobacterium tuberculosis
RPRAAVGLGARGHRRRPGRL

SEQ ID NO: 1502043 - protein, 21 aa, Mycobacterium tuberculosis
RPRCRCAKRSRTGGCRAAWLN

SEQ ID NO: 1502044 - protein, 17 aa, Mycobacterium tuberculosis
RPRIGFGSGPVGTRQRP

SEQ ID NO: 1502045 - protein, 17 aa, Mycobacterium tuberculosis
RPRPGLLPRRRTAVRHR

SEQ ID NO: 1502046 - protein, 18 aa, Mycobacterium tuberculosis
RPRQRARRLVPPARQVRP

SEQ ID NO: 1502047 - protein, 17 aa, Mycobacterium tuberculosis
RPRRAAPAAPRRPPPRS

SEQ ID NO: 1502048 - protein, 18 aa, Mycobacterium tuberculosis
RPRRAGVSSFGFGGTNAR

SEQ ID NO: 1502049 - protein, 17 aa, Mycobacterium tuberculosis
RPRSCAALPRILRDNGY

SEQ ID NO: 1502050 - protein, 23 aa, Mycobacterium tuberculosis
RPRTEPERGWFCAMSRAPKIYRP

SEQ ID NO: 1502051 - protein, 18 aa, Mycobacterium tuberculosis
RPRWRRMANGLLHSKTRD

SEQ ID NO: 1502052 - protein, 21 aa, Mycobacterium tuberculosis
RPSHEKLAWARRVLAASRSER

SEQ ID NO: 1502053 - protein, 18 aa, Mycobacterium tuberculosis
RPTGEWSAAVSRLAAAEA

SEQ ID NO: 1502054 - protein, 17 aa, Mycobacterium tuberculosis
RPVGQSRRERGPAMEYL

SEQ ID NO: 1502055 - protein, 19 aa, Mycobacterium tuberculosis
RPVVVAARLDRAALAGAEL

SEQ ID NO: 1502056 - protein, 20 aa, Mycobacterium tuberculosis
RQEDFIGIHFFSPVDKMPLV

SEQ ID NO: 1502057 - protein, 21 aa, Mycobacterium tuberculosis
RQEHLPWAAAIATRGRSCYDR

SEQ ID NO: 1502058 - protein, 22 aa, Mycobacterium tuberculosis
RQHGRCGLDNGVADRRRRRSVG

SEQ ID NO: 1502059 - protein, 17 aa, Mycobacterium tuberculosis
RQLLDLMVHSVYSNKDA

SEQ ID NO: 1502060 - protein, 17 aa, Mycobacterium tuberculosis
RQLRLGDYDVLVGINLL

SEQ ID NO: 1502061 - protein, 19 aa, Mycobacterium tuberculosis
RQQTLRASIDWSHALLTET

SEQ ID NO: 1502062 - protein, 22 aa, Mycobacterium tuberculosis
RQQTLRASIDWSHALLTETGQI

SEQ ID NO: 1502063 - protein, 18 aa, Mycobacterium tuberculosis
RQRRCRRVRRGGNDRQWP

SEQ ID NO: 1502064 - protein, 17 aa, Mycobacterium tuberculosis
RQSRWCGLIAMSEIFCI

SEQ ID NO: 1502065 - protein, 22 aa, Mycobacterium tuberculosis
RQTCSRLTVEIAEVSAMDVPHE

SEQ ID NO: 1502066 - protein, 23 aa, Mycobacterium tuberculosis
RQTCSRLTVEIAEVSAMDVPHEQ

SEQ ID NO: 1502067 - protein, 19 aa, Mycobacterium tuberculosis
RQWLVRWAVHPGRATRGFH

SEQ ID NO: 1502068 - protein, 19 aa, Mycobacterium tuberculosis
RRADAIAGTGGDGGNGGNG

SEQ ID NO: 1502069 - protein, 18 aa, Mycobacterium tuberculosis
RRALNEFGVEGLATVIPF

SEQ ID NO: 1502070 - protein, 26 aa, Mycobacterium tuberculosis
RRAPADLVSSCGRRAGGNAGLLLSSG

SEQ ID NO: 1502071 - protein, 20 aa, Mycobacterium tuberculosis
RRARQRWPRRHGWRLTRRRQ

SEQ ID NO: 1502072 - protein, 19 aa, Mycobacterium tuberculosis
RRCCISIGCPMSFPTSRPG

SEQ ID NO: 1502073 - protein, 18 aa, Mycobacterium tuberculosis
RRCLCWIAGCARYRPGWP

SEQ ID NO: 1502074 - protein, 31 aa, Mycobacterium tuberculosis
RRCLPAVQCLRGMVRLGRFGRRGVRPDRQRA

SEQ ID NO: 1502075 - protein, 20 aa, Mycobacterium tuberculosis
RRCRRVWRRYRRQWRCRRQR

SEQ ID NO: 1502076 - protein, 18 aa, Mycobacterium tuberculosis
RRCTWRRSAVNGSRSPGC

SEQ ID NO: 1502077 - protein, 17 aa, Mycobacterium tuberculosis
RRDMGVGELLGMVQAGL

SEQ ID NO: 1502078 - protein, 22 aa, Mycobacterium tuberculosis
RREGLARWLARWRPCTPPVESF

SEQ ID NO: 1502079 - protein, 20 aa, Mycobacterium tuberculosis
RRFLPGATILKASVGPMNNN

SEQ ID NO: 1502080 - protein, 22 aa, Mycobacterium tuberculosis
RRFRLCQYRHQPGGFLPRHHVL

SEQ ID NO: 1502081 - protein, 18 aa, Mycobacterium tuberculosis
RRGGTVAADATGRRSGGA

SEQ ID NO: 1502082 - protein, 17 aa, Mycobacterium tuberculosis
RRGRCARRCRRQRRPRQ

SEQ ID NO: 1502083 - protein, 20 aa, Mycobacterium tuberculosis
RRGRLLWSLPKGHIELGETA

SEQ ID NO: 1502084 - protein, 18 aa, Mycobacterium tuberculosis
RRGRREWGDRWDRSRQHH

SEQ ID NO: 1502085 - protein, 26 aa, Mycobacterium tuberculosis
RRHAAFGCAEFRLWHVGAVQHQRVGV

SEQ ID NO: 1502086 - protein, 22 aa, Mycobacterium tuberculosis
RRIRVGAALPRRRGAARRHSRI

SEQ ID NO: 1502087 - protein, 19 aa, Mycobacterium tuberculosis
RRLGALRVWPARARANTEI

SEQ ID NO: 1502088 - protein, 21 aa, Mycobacterium tuberculosis
RRLPRCIPMVAGARIPAGTDR

SEQ ID NO: 1502089 - protein, 17 aa, Mycobacterium tuberculosis
RRLPSWRILVGRAAPLS

SEQ ID NO: 1502090 - protein, 17 aa, Mycobacterium tuberculosis
RRLQIEFSQVIQKIAEG

SEQ ID NO: 1502091 - protein, 19 aa, Mycobacterium tuberculosis
RRLRRCWRLWGAARAPPQV

SEQ ID NO: 1502092 - protein, 17 aa, Mycobacterium tuberculosis
RRLRVCPDVCRRSGQRA

SEQ ID NO: 1502093 - protein, 20 aa, Mycobacterium tuberculosis
RRMGPGLVHLHLCDGSGLPA

SEQ ID NO: 1502094 - protein, 21 aa, Mycobacterium tuberculosis
RRPDLLVSLLTYWQRHPSLSY

SEQ ID NO: 1502095 - protein, 18 aa, Mycobacterium tuberculosis
RRPGPSCRRWRPVKCCES

SEQ ID NO: 1502096 - protein, 18 aa, Mycobacterium tuberculosis
RRPWYLAAQAGTGGGQLN

SEQ ID NO: 1502097 - protein, 17 aa, Mycobacterium tuberculosis
RRQCSVAGLRAGRQRPW

SEQ ID NO: 1502098 - protein, 23 aa, Mycobacterium tuberculosis
RRQRGRCGLDNGVADRRRRRSVG

SEQ ID NO: 1502099 - protein, 18 aa, Mycobacterium tuberculosis
RRQRLAMRAVRVEQHRVG

SEQ ID NO: 1502100 - protein, 19 aa, Mycobacterium tuberculosis
RRRARDLGHTTALFRAQTL

SEQ ID NO: 1502101 - protein, 20 aa, Mycobacterium tuberculosis
RRRDRRRCGPRSSNGSGHSV

SEQ ID NO: 1502102 - protein, 22 aa, Mycobacterium tuberculosis
RRRGRHRGHPGARRTRRVRRAW

SEQ ID NO: 1502103 - protein, 21 aa, Mycobacterium tuberculosis
RRRGRQPAWRFHRRQRGGGGR

SEQ ID NO: 1502104 - protein, 17 aa, Mycobacterium tuberculosis
RRRGWIVAIDRHFQRRR

SEQ ID NO: 1502105 - protein, 24 aa, Mycobacterium tuberculosis
RRRQRRCPADSGTRTRRALPVGSA

SEQ ID NO: 1502106 - protein, 18 aa, Mycobacterium tuberculosis
RRRRCLADLLSSQRPLPR

SEQ ID NO: 1502107 - protein, 19 aa, Mycobacterium tuberculosis
RRRRCWSAGRAGWRWLPRS

SEQ ID NO: 1502108 - protein, 19 aa, Mycobacterium tuberculosis
RRRRFPAARATLPSGVGGV

SEQ ID NO: 1502109 - protein, 22 aa, Mycobacterium tuberculosis
RRRRGRRGRGRGRGEQGGSDGD

SEQ ID NO: 1502110 - protein, 23 aa, Mycobacterium tuberculosis
RRRRRLALRLRRRRRERRVQQLW

SEQ ID NO: 1502111 - protein, 19 aa, Mycobacterium tuberculosis
RRRRWPGWVRWHRGQRQRH

SEQ ID NO: 1502112 - protein, 18 aa, Mycobacterium tuberculosis
RRRSCPRSLAAVQPAHRM

SEQ ID NO: 1502113 - protein, 23 aa, Mycobacterium tuberculosis
RRRWCRRQRVAIRQRWGRGARRG

SEQ ID NO: 1502114 - protein, 19 aa, Mycobacterium tuberculosis
RRTLRLPWGNGIVSLTPAP

SEQ ID NO: 1502115 - protein, 18 aa, Mycobacterium tuberculosis
RRTRRVRRAWRPAVRPNR

SEQ ID NO: 1502116 - protein, 24 aa, Mycobacterium tuberculosis
RRTSAVKAFTAWAVRRGLLAGDPA

SEQ ID NO: 1502117 - protein, 24 aa, Mycobacterium tuberculosis
RRVGDAGCGVRCPGRTGGGRRAER

SEQ ID NO: 1502118 - protein, 30 aa, Mycobacterium tuberculosis
RRVQQLWQRRGRRGRRRRGFARRLRRGRRG

SEQ ID NO: 1502119 - protein, 19 aa, Mycobacterium tuberculosis
RRVSPGGAYAWRAPQGQFD

SEQ ID NO: 1502120 - protein, 20 aa, Mycobacterium tuberculosis
RRVTVDGGRGCARRGDVGHG

SEQ ID NO: 1502121 - protein, 25 aa, Mycobacterium tuberculosis
RRWPRSWRLFKRFAAAAAKRAAQLA

SEQ ID NO: 1502122 - protein, 21 aa, Mycobacterium tuberculosis
RRWRGGRAFLFGDGGAGGAAL

SEQ ID NO: 1502123 - protein, 17 aa, Mycobacterium tuberculosis
RRYCRRFGRALITTRSG

SEQ ID NO: 1502124 - protein, 22 aa, Mycobacterium tuberculosis
RRYGVRWHYRLPVWSDFVEVHW

SEQ ID NO: 1502125 - protein, 18 aa, Mycobacterium tuberculosis
RRYPARPACDGRLEPQAV

SEQ ID NO: 1502126 - protein, 21 aa, Mycobacterium tuberculosis
RRYTWPSAFDKVWRGGARPVF

SEQ ID NO: 1502127 - protein, 19 aa, Mycobacterium tuberculosis
RSAAGYALWCNGIEDFAEL

SEQ ID NO: 1502128 - protein, 19 aa, Mycobacterium tuberculosis
RSAAYAMRWVAKNVVAAGL

SEQ ID NO: 1502129 - protein, 21 aa, Mycobacterium tuberculosis
RSACIKAMIEKVVDRMYAEID

SEQ ID NO: 1502130 - protein, 20 aa, Mycobacterium tuberculosis
RSAFVQLVLSNVFGQNAPAI

SEQ ID NO: 1502131 - protein, 18 aa, Mycobacterium tuberculosis
RSAGFAGIRACRRTTAGT

SEQ ID NO: 1502132 - protein, 21 aa, Mycobacterium tuberculosis
RSCRWTLAAANLWQGNLEAAV

SEQ ID NO: 1502133 - protein, 24 aa, Mycobacterium tuberculosis
RSIDYRCCREVKSIYTAQAVLSIA

SEQ ID NO: 1502134 - protein, 17 aa, Mycobacterium tuberculosis
RSKVIRCLYRVSEGGAG

SEQ ID NO: 1502135 - protein, 19 aa, Mycobacterium tuberculosis
RSNLARYGIAPTYPGDFAA

SEQ ID NO: 1502136 - protein, 24 aa, Mycobacterium tuberculosis
RSPAYCFTLPFAHQALMPINVVAT

SEQ ID NO: 1502137 - protein, 25 aa, Mycobacterium tuberculosis
RSRGPRPNCCMARWARPSRSTRKPG

SEQ ID NO: 1502138 - protein, 18 aa, Mycobacterium tuberculosis
RSRSALGWIIERYRVTTD

SEQ ID NO: 1502139 - protein, 19 aa, Mycobacterium tuberculosis
RSTTAWILHMAKLSAAMAK

SEQ ID NO: 1502140 - protein, 23 aa, Mycobacterium tuberculosis
RSTTLALRWLVGYSRQRREKTMI

SEQ ID NO: 1502141 - protein, 24 aa, Mycobacterium tuberculosis
RSYNCLKREGVHIVGELVARTESD

SEQ ID NO: 1502142 - protein, 18 aa, Mycobacterium tuberculosis
RTALRRWPKCSTMSSASS

SEQ ID NO: 1502143 - protein, 17 aa, Mycobacterium tuberculosis
RTDCKWGAYLDNVGDFD

SEQ ID NO: 1502144 - protein, 17 aa, Mycobacterium tuberculosis
RTERFWVGLSVYRPGGT

SEQ ID NO: 1502145 - protein, 19 aa, Mycobacterium tuberculosis
RTGNVCLVTLGLNLFSRGV

SEQ ID NO: 1502146 - protein, 24 aa, Mycobacterium tuberculosis
RTGYIRIGLVGDHRTGIGGLNSGI

SEQ ID NO: 1502147 - protein, 20 aa, Mycobacterium tuberculosis
RTIYQNLGWAFGYNTAAIPL

SEQ ID NO: 1502148 - protein, 22 aa, Mycobacterium tuberculosis
RTLKGWADRGVRVIGLDAGGAP

SEQ ID NO: 1502149 - protein, 22 aa, Mycobacterium tuberculosis
RTLKGWADRGVRVIGLDAGGGT

SEQ ID NO: 1502150 - protein, 23 aa, Mycobacterium tuberculosis
RTMLREYLEAMRALWTQEEACYD

SEQ ID NO: 1502151 - protein, 20 aa, Mycobacterium tuberculosis
RTNACDRRRFGLSLTIHEDA

SEQ ID NO: 1502152 - protein, 23 aa, Mycobacterium tuberculosis
RTRAIARLGSFFSDRRMAACGPP

SEQ ID NO: 1502153 - protein, 23 aa, Mycobacterium tuberculosis
RTSAVKAFTAWAVRRVLLAGDPA

SEQ ID NO: 1502154 - protein, 23 aa, Mycobacterium tuberculosis
RTTCSPVGTARCARYRSNDPSRD

SEQ ID NO: 1502155 - protein, 23 aa, Mycobacterium tuberculosis
RTTPPTWRCCGSWFGKDSPPTWR

SEQ ID NO: 1502156 - protein, 26 aa, Mycobacterium tuberculosis
RTVAGVATAVRWVMAVPVGPVAAAGP

SEQ ID NO: 1502157 - protein, 17 aa, Mycobacterium tuberculosis
RVAGYRAGWLARITDRR

SEQ ID NO: 1502158 - protein, 17 aa, Mycobacterium tuberculosis
RVAHCIYAGLATDTGSF

SEQ ID NO: 1502159 - protein, 17 aa, Mycobacterium tuberculosis
RVFITRFVGALRGGAVA

SEQ ID NO: 1502160 - protein, 17 aa, Mycobacterium tuberculosis
RVIKRWRRGKPLADAET

SEQ ID NO: 1502161 - protein, 19 aa, Mycobacterium tuberculosis
RVLPYCWRDETPLSNHELR

SEQ ID NO: 1502162 - protein, 17 aa, Mycobacterium tuberculosis
RVLRNLGLVVGDRAGRS

SEQ ID NO: 1502163 - protein, 19 aa, Mycobacterium tuberculosis
RVRCHLHISRSPSAVPGRG

SEQ ID NO: 1502164 - protein, 26 aa, Mycobacterium tuberculosis
RVRQWWIRRGRWPWRRRRRRRGGQLL

SEQ ID NO: 1502165 - protein, 34 aa, Mycobacterium tuberculosis
RVRRAWRPAVRPNRHGWRVAVAGRLAASAALASS

SEQ ID NO: 1502166 - protein, 35 aa, Mycobacterium tuberculosis
RVRRAWRPAVRPNRHGWRVAVAGRLAASAALASSQ

SEQ ID NO: 1502167 - protein, 18 aa, Mycobacterium tuberculosis
RVRTWLLAVSNVFGQNAP

SEQ ID NO: 1502168 - protein, 18 aa, Mycobacterium tuberculosis
RVSRRLVAMLARRGYGQT

SEQ ID NO: 1502169 - protein, 18 aa, Mycobacterium tuberculosis
RVTVDGGRGCARRGDVGH

SEQ ID NO: 1502170 - protein, 17 aa, Mycobacterium tuberculosis
RVVLLAFNCHERPYDLD

SEQ ID NO: 1502171 - protein, 20 aa, Mycobacterium tuberculosis
RVVRAHVPLSEMFGYVGDLR

SEQ ID NO: 1502172 - protein, 18 aa, Mycobacterium tuberculosis
RVWSRATIGLAYASALII

SEQ ID NO: 1502173 - protein, 25 aa, Mycobacterium tuberculosis
RWDRPAGHSACWRRPVVGGQHGVAG

SEQ ID NO: 1502174 - protein, 31 aa, Mycobacterium tuberculosis
RWHGAVGLGWPRCRRFYRPPHRQRRSTRRRC

SEQ ID NO: 1502175 - protein, 24 aa, Mycobacterium tuberculosis
RWHRRCRRARFSTVAPAGPEFAAG

SEQ ID NO: 1502176 - protein, 18 aa, Mycobacterium tuberculosis
RWLDRACGSSHGRRRRRL

SEQ ID NO: 1502177 - protein, 18 aa, Mycobacterium tuberculosis
RWLSCPWAGWYATNSVAS

SEQ ID NO: 1502178 - protein, 20 aa, Mycobacterium tuberculosis
RWPPDSRRFRLFAAAQAGIF

SEQ ID NO: 1502179 - protein, 20 aa, Mycobacterium tuberculosis
RWRKADAALGRPVVSNQVHF

SEQ ID NO: 1502180 - protein, 18 aa, Mycobacterium tuberculosis
RWRPIWRVSGRRSAPAKR

SEQ ID NO: 1502181 - protein, 23 aa, Mycobacterium tuberculosis
RWRRCFWPSILVRGFSRSSPGGP

SEQ ID NO: 1502182 - protein, 21 aa, Mycobacterium tuberculosis
RWSAVLVGAWWPAPSAALRAA

SEQ ID NO: 1502183 - protein, 17 aa, Mycobacterium tuberculosis
RWSPSRRDGSLCADDDR

SEQ ID NO: 1502184 - protein, 18 aa, Mycobacterium tuberculosis
RWTLLILREAFFGVRRFG

SEQ ID NO: 1502185 - protein, 21 aa, Mycobacterium tuberculosis
RYDLVLSFHCKQRFPAALIDG

SEQ ID NO: 1502186 - protein, 17 aa, Mycobacterium tuberculosis
RYFQAIPGVWARRSSEV

SEQ ID NO: 1502187 - protein, 21 aa, Mycobacterium tuberculosis
RYLRFGWAAARLDDWANYVGA

SEQ ID NO: 1502188 - protein, 17 aa, Mycobacterium tuberculosis
RYLRICVLTQYKSHSLD

SEQ ID NO: 1502189 - protein, 19 aa, Mycobacterium tuberculosis
RYPLKGVFHAAGVLDDAVI

SEQ ID NO: 1502190 - protein, 18 aa, Mycobacterium tuberculosis
RYRGLRAPHKIKLGVSGC

SEQ ID NO: 1502191 - protein, 18 aa, Mycobacterium tuberculosis
RYTGRGMAFLDLIQEGNL

SEQ ID NO: 1502192 - protein, 18 aa, Mycobacterium tuberculosis
RYVMMVLRHIPRSIFRKL

SEQ ID NO: 1502193 - protein, 17 aa, Mycobacterium tuberculosis
SAAFRIVVGSVRIPPVS

SEQ ID NO: 1502194 - protein, 18 aa, Mycobacterium tuberculosis
SAAIAALFGAHGRAYQAA

SEQ ID NO: 1502195 - protein, 19 aa, Mycobacterium tuberculosis
SAAIAALFSIHGQQYQAMS

SEQ ID NO: 1502196 - protein, 18 aa, Mycobacterium tuberculosis
SAAMAALFSGHAQAYQAL

SEQ ID NO: 1502197 - protein, 17 aa, Mycobacterium tuberculosis
SAARLFGGGGAGGAGGT

SEQ ID NO: 1502198 - protein, 21 aa, Mycobacterium tuberculosis
SAEKRRWRQASTDVDGAGGYG

SEQ ID NO: 1502199 - protein, 19 aa, Mycobacterium tuberculosis
SAFVVRISCHLRIQNQAAD

SEQ ID NO: 1502200 - protein, 17 aa, Mycobacterium tuberculosis
SAGFKWLAPYTGSAIAQ

SEQ ID NO: 1502201 - protein, 18 aa, Mycobacterium tuberculosis
SAGIAALFGAQAQSYQAV

SEQ ID NO: 1502202 - protein, 25 aa, Mycobacterium tuberculosis
SAGSSRKAFGGDGGVGGDGASALGT

SEQ ID NO: 1502203 - protein, 18 aa, Mycobacterium tuberculosis
SAKCRQLRSFADCGTGGA

SEQ ID NO: 1502204 - protein, 18 aa, Mycobacterium tuberculosis
SALQWRGSQTSDPVETPV

SEQ ID NO: 1502205 - protein, 20 aa, Mycobacterium tuberculosis
SAMRVCGGAAFSKHLPIERA

SEQ ID NO: 1502206 - protein, 21 aa, Mycobacterium tuberculosis
SAPMLAAAVAWDGLAAELGSA

SEQ ID NO: 1502207 - protein, 18 aa, Mycobacterium tuberculosis
SAPWCWTPDYVVNGDIAD

SEQ ID NO: 1502208 - protein, 24 aa, Mycobacterium tuberculosis
SARFRGGCCFPSIAPTYSAARSAC

SEQ ID NO: 1502209 - protein, 17 aa, Mycobacterium tuberculosis
SARGVDVTPFFAVLNGP

SEQ ID NO: 1502210 - protein, 17 aa, Mycobacterium tuberculosis
SATHRAGACGGVGAGTA

SEQ ID NO: 1502211 - protein, 21 aa, Mycobacterium tuberculosis
SAVQRIMFRDGLVLNFDDYNE

SEQ ID NO: 1502212 - protein, 19 aa, Mycobacterium tuberculosis
SAVRWPRFTAGPDRQVLGC

SEQ ID NO: 1502213 - protein, 17 aa, Mycobacterium tuberculosis
SCLPEGVPSNWTIFFGA

SEQ ID NO: 1502214 - protein, 18 aa, Mycobacterium tuberculosis
SCSPRCCCPLDRKAFARP

SEQ ID NO: 1502215 - protein, 20 aa, Mycobacterium tuberculosis
SCVKPAGALYAFPRLDPEVY

SEQ ID NO: 1502216 - protein, 18 aa, Mycobacterium tuberculosis
SDEWTDWRWNRILIEGSN

SEQ ID NO: 1502217 - protein, 17 aa, Mycobacterium tuberculosis
SDFELVQGFLLAEGVVA

SEQ ID NO: 1502218 - protein, 18 aa, Mycobacterium tuberculosis
SDFPVLWPVGTRWADNDM

SEQ ID NO: 1502219 - protein, 18 aa, Mycobacterium tuberculosis
SDGNRWRAHLGYVPGMTN

SEQ ID NO: 1502220 - protein, 19 aa, Mycobacterium tuberculosis
SDLQPGDVLTFYSDASHAG

SEQ ID NO: 1502221 - protein, 17 aa, Mycobacterium tuberculosis
SDPEGWIRCQLDGVLIE

SEQ ID NO: 1502222 - protein, 23 aa, Mycobacterium tuberculosis
SDPLLAVPFSYPASLPPFGPVTM

SEQ ID NO: 1502223 - protein, 17 aa, Mycobacterium tuberculosis
SDVARIGSSIGAANAAA

SEQ ID NO: 1502224 - protein, 17 aa, Mycobacterium tuberculosis
SDVARIGSSIGVANSAA

SEQ ID NO: 1502225 - protein, 18 aa, Mycobacterium tuberculosis
SDWLPRQRWYAGRNRELA

SEQ ID NO: 1502226 - protein, 20 aa, Mycobacterium tuberculosis
SEAFTAWEFVDGYDVAQAVV

SEQ ID NO: 1502227 - protein, 17 aa, Mycobacterium tuberculosis
SEIAIAVPAHWKPGAVH

SEQ ID NO: 1502228 - protein, 17 aa, Mycobacterium tuberculosis
SETWRLYGVAARNDGIA

SEQ ID NO: 1502229 - protein, 17 aa, Mycobacterium tuberculosis
SEVRILFAFDPARQAIM

SEQ ID NO: 1502230 - protein, 18 aa, Mycobacterium tuberculosis
SFGFKYGLPMDADMVMDV

SEQ ID NO: 1502231 - protein, 19 aa, Mycobacterium tuberculosis
SFGLPGLNGSCGDGGDGGN

SEQ ID NO: 1502232 - protein, 18 aa, Mycobacterium tuberculosis
SFHCKQRFPAALIDGVRC

SEQ ID NO: 1502233 - protein, 18 aa, Mycobacterium tuberculosis
SFIPEDFTFLDAIFAGYA

SEQ ID NO: 1502234 - protein, 19 aa, Mycobacterium tuberculosis
SFIPEDFTFLDAIFAGYAT

SEQ ID NO: 1502235 - protein, 18 aa, Mycobacterium tuberculosis
SGAGGWLLGTGGAGGAGG

SEQ ID NO: 1502236 - protein, 23 aa, Mycobacterium tuberculosis
SGAKLDVIVPMSFLCDGYGLNVT

SEQ ID NO: 1502237 - protein, 17 aa, Mycobacterium tuberculosis
SGAVGVLGIGPNNGFPG

SEQ ID NO: 1502238 - protein, 19 aa, Mycobacterium tuberculosis
SGCSRARCVTASSFPAPTW

SEQ ID NO: 1502239 - protein, 24 aa, Mycobacterium tuberculosis
SGEQRLSGFLLWQSAYSEMWFTEA

SEQ ID NO: 1502240 - protein, 17 aa, Mycobacterium tuberculosis
SGFRPATFAAIFDGIVE

SEQ ID NO: 1502241 - protein, 23 aa, Mycobacterium tuberculosis
SGGAGARGANGIDSIGGTGGAGG

SEQ ID NO: 1502242 - protein, 24 aa, Mycobacterium tuberculosis
SGGAGGVCGLGFDAGGAGGAGGKA

SEQ ID NO: 1502243 - protein, 18 aa, Mycobacterium tuberculosis
SGGFCFARQRRNRCRRCR

SEQ ID NO: 1502244 - protein, 17 aa, Mycobacterium tuberculosis
SGGRGGLLFGNGGNGSV

SEQ ID NO: 1502245 - protein, 17 aa, Mycobacterium tuberculosis
SGLFEVLAAGGAGGTGG

SEQ ID NO: 1502246 - protein, 17 aa, Mycobacterium tuberculosis
SGLLPRMEPFVGELIGR

SEQ ID NO: 1502247 - protein, 20 aa, Mycobacterium tuberculosis
SGLRTSVQFVGPLSVVDSAL

SEQ ID NO: 1502248 - protein, 18 aa, Mycobacterium tuberculosis
SGMTIGIAGWGSRRKPMA

SEQ ID NO: 1502249 - protein, 24 aa, Mycobacterium tuberculosis
SGNFGVDGEAGFSGGAGGNGGVGG

SEQ ID NO: 1502250 - protein, 19 aa, Mycobacterium tuberculosis
SGPAPFPAVPVDLPAPADI

SEQ ID NO: 1502251 - protein, 18 aa, Mycobacterium tuberculosis
SGPLRPAAAQVFAAVHAA

SEQ ID NO: 1502252 - protein, 19 aa, Mycobacterium tuberculosis
SGPLRPAAAQVFAAVQAAA

SEQ ID NO: 1502253 - protein, 20 aa, Mycobacterium tuberculosis
SGRNRLKYIDGLTIDRQPSN

SEQ ID NO: 1502254 - protein, 23 aa, Mycobacterium tuberculosis
SGTCFRPSLAVQRRWRDEFGLGL

SEQ ID NO: 1502255 - protein, 18 aa, Mycobacterium tuberculosis
SGVAVSPVTGLVFVTNFD

SEQ ID NO: 1502256 - protein, 17 aa, Mycobacterium tuberculosis
SGWPRPGRDGTRIRSML

SEQ ID NO: 1502257 - protein, 24 aa, Mycobacterium tuberculosis
SGWWRAPLRWTLRDHWRCVPTSWV

SEQ ID NO: 1502258 - protein, 17 aa, Mycobacterium tuberculosis
SHIPIPFIEYTMPQQVD

SEQ ID NO: 1502259 - protein, 17 aa, Mycobacterium tuberculosis
SHQLPVWTLRLYLTGKR

SEQ ID NO: 1502260 - protein, 18 aa, Mycobacterium tuberculosis
SIDPFGWYRSWEEMLTGM

SEQ ID NO: 1502261 - protein, 19 aa, Mycobacterium tuberculosis
SIPAIPIGLVLNGDIGPIT

SEQ ID NO: 1502262 - protein, 19 aa, Mycobacterium tuberculosis
SKLGGLWKTVSPRLSPISN

SEQ ID NO: 1502263 - protein, 17 aa, Mycobacterium tuberculosis
SKMAFAMANFEPGSNEP

SEQ ID NO: 1502264 - protein, 18 aa, Mycobacterium tuberculosis
SKMAFAMANFEPGSNEPT

SEQ ID NO: 1502265 - protein, 17 aa, Mycobacterium tuberculosis
SKTRRPSVCNAAETLLV

SEQ ID NO: 1502266 - protein, 17 aa, Mycobacterium tuberculosis
SLHWLRPITPTFRPSWP

SEQ ID NO: 1502267 - protein, 25 aa, Mycobacterium tuberculosis
SLITSWRALGWIGSRGRRSCRAARR

SEQ ID NO: 1502268 - protein, 18 aa, Mycobacterium tuberculosis
SLPLARMVLTSAPVTVLE

SEQ ID NO: 1502269 - protein, 18 aa, Mycobacterium tuberculosis
SLPRPGRPLLPLPPAPPA

SEQ ID NO: 1502270 - protein, 18 aa, Mycobacterium tuberculosis
SLVPRTPLAPVLPAPPVP

SEQ ID NO: 1502271 - protein, 19 aa, Mycobacterium tuberculosis
SLVTWGAGVPAAMGTSTAG

SEQ ID NO: 1502272 - protein, 18 aa, Mycobacterium tuberculosis
SLWCGYVGAFMCEGDTPL

SEQ ID NO: 1502273 - protein, 19 aa, Mycobacterium tuberculosis
SNALLDWAYGRRFRYSETM

SEQ ID NO: 1502274 - protein, 17 aa, Mycobacterium tuberculosis
SNLARYGIAPTYPGDFA

SEQ ID NO: 1502275 - protein, 20 aa, Mycobacterium tuberculosis
SNWFGLNAPLIAAVEGAYEQ

SEQ ID NO: 1502276 - protein, 17 aa, Mycobacterium tuberculosis
SNYVYRPASLDQWRMLM

SEQ ID NO: 1502277 - protein, 19 aa, Mycobacterium tuberculosis
SPARSWCPISWVDRTSGRA

SEQ ID NO: 1502278 - protein, 24 aa, Mycobacterium tuberculosis
SPARWCWKCWRDAAPDRSRTTSTS

SEQ ID NO: 1502279 - protein, 27 aa, Mycobacterium tuberculosis
SPHSERLFCIPATIDLAGAEIELVSMV

SEQ ID NO: 1502280 - protein, 18 aa, Mycobacterium tuberculosis
SPIAGRWPGRSGTRPRAE

SEQ ID NO: 1502281 - protein, 17 aa, Mycobacterium tuberculosis
SPIDWDIAWPADDLQVN

SEQ ID NO: 1502282 - protein, 18 aa, Mycobacterium tuberculosis
SPIDWDIAWPAGDLQVNL

SEQ ID NO: 1502283 - protein, 19 aa, Mycobacterium tuberculosis
SPINGRPSSAWVGALITPS

SEQ ID NO: 1502284 - protein, 23 aa, Mycobacterium tuberculosis
SPKETWLRLLLIRAGFPRPQMQI

SEQ ID NO: 1502285 - protein, 18 aa, Mycobacterium tuberculosis
SPKGLPRWGFSFSDGLAP

SEQ ID NO: 1502286 - protein, 17 aa, Mycobacterium tuberculosis
SPLGCWPGSSALPTIAV

SEQ ID NO: 1502287 - protein, 20 aa, Mycobacterium tuberculosis
SPLRPWPGFVPMVYERYSQP

SEQ ID NO: 1502288 - protein, 17 aa, Mycobacterium tuberculosis
SPLRWPWGACPAPLRPP

SEQ ID NO: 1502289 - protein, 18 aa, Mycobacterium tuberculosis
SPPSAPWRSQTPRLATMR

SEQ ID NO: 1502290 - protein, 18 aa, Mycobacterium tuberculosis
SPRGYRAMAGIPRLQFAH

SEQ ID NO: 1502291 - protein, 17 aa, Mycobacterium tuberculosis
SPRIVGWIMRTDSSDLP

SEQ ID NO: 1502292 - protein, 23 aa, Mycobacterium tuberculosis
SPRRSTCARSRWCPATTTPFTPT

SEQ ID NO: 1502293 - protein, 21 aa, Mycobacterium tuberculosis
SPSLRFGLAFCEASGPRLVRH

SEQ ID NO: 1502294 - protein, 21 aa, Mycobacterium tuberculosis
SPTCPPRWMCPPARPPKPTWP

SEQ ID NO: 1502295 - protein, 19 aa, Mycobacterium tuberculosis
SPVTGLVFVTNFDSNTVSV

SEQ ID NO: 1502296 - protein, 19 aa, Mycobacterium tuberculosis
SQAIARLFSDYATHYQSLN

SEQ ID NO: 1502297 - protein, 22 aa, Mycobacterium tuberculosis
SQKQRLAVMVGLPDRVHPPRRR

SEQ ID NO: 1502298 - protein, 17 aa, Mycobacterium tuberculosis
SQQPLPPSVRMKRKPSS

SEQ ID NO: 1502299 - protein, 19 aa, Mycobacterium tuberculosis
SQSEIWWERPILTPIVIDV

SEQ ID NO: 1502300 - protein, 24 aa, Mycobacterium tuberculosis
SQSSSCVRPCWSRISRSGATGSVN

SEQ ID NO: 1502301 - protein, 18 aa, Mycobacterium tuberculosis
SRALIPWASVRAAVNHRT

SEQ ID NO: 1502302 - protein, 18 aa, Mycobacterium tuberculosis
SRAPAGWRGGVRRRCLES

SEQ ID NO: 1502303 - protein, 22 aa, Mycobacterium tuberculosis
SRARFGDVLPFLVKVLAADEPL

SEQ ID NO: 1502304 - protein, 21 aa, Mycobacterium tuberculosis
SRCGVPGAACKRGWPGSPPPW

SEQ ID NO: 1502305 - protein, 18 aa, Mycobacterium tuberculosis
SRCSPRWAPTSAAGSARL

SEQ ID NO: 1502306 - protein, 23 aa, Mycobacterium tuberculosis
SRGGDGGVGGWLYGDGGGGGDDG

SEQ ID NO: 1502307 - protein, 37 aa, Mycobacterium tuberculosis
SRGHARCRRHRRAAARRERTQRLAIAGRPATTRGVEG

SEQ ID NO: 1502308 - protein, 17 aa, Mycobacterium tuberculosis
SRGRLSAVVQRELADEA

SEQ ID NO: 1502309 - protein, 21 aa, Mycobacterium tuberculosis
SRHGRGWCVGERVGAGQTIAT

SEQ ID NO: 1502310 - protein, 17 aa, Mycobacterium tuberculosis
SRLPPILPISGQQRLSL

SEQ ID NO: 1502311 - protein, 18 aa, Mycobacterium tuberculosis
SRNKHGWVTVGDVGYLDD

SEQ ID NO: 1502312 - protein, 22 aa, Mycobacterium tuberculosis
SRPGEKNMPFWGTSFSAAYVSG

SEQ ID NO: 1502313 - protein, 28 aa, Mycobacterium tuberculosis
SRPMCLRFSRPAAGLSTFTNGALIFGEF

SEQ ID NO: 1502314 - protein, 25 aa, Mycobacterium tuberculosis
SRPSMPFRLHWAAIRASRTWCCPAA

SEQ ID NO: 1502315 - protein, 23 aa, Mycobacterium tuberculosis
SRQLWWGHRIPIWYGPDGEQVCV

SEQ ID NO: 1502316 - protein, 24 aa, Mycobacterium tuberculosis
SRQLWWGHRIPIWYGPDGEQVCVG

SEQ ID NO: 1502317 - protein, 20 aa, Mycobacterium tuberculosis
SRRHRRGLLHTRLIGNGGNG

SEQ ID NO: 1502318 - protein, 21 aa, Mycobacterium tuberculosis
SRRIKLAWFLLNAARYMGAGV

SEQ ID NO: 1502319 - protein, 22 aa, Mycobacterium tuberculosis
SRRSCVRLGASRCSTRSRGFCG

SEQ ID NO: 1502320 - protein, 26 aa, Mycobacterium tuberculosis
SRTRARRSPICWCPKLTASVTDGAVG

SEQ ID NO: 1502321 - protein, 19 aa, Mycobacterium tuberculosis
SSARWAWRRHIARRRWPSP

SEQ ID NO: 1502322 - protein, 21 aa, Mycobacterium tuberculosis
SSCLPEGVPSNWTIFFGAEDV

SEQ ID NO: 1502323 - protein, 19 aa, Mycobacterium tuberculosis
SSFRYAAPAGRNWTTADLA

SEQ ID NO: 1502324 - protein, 23 aa, Mycobacterium tuberculosis
SSPDGQDGGLLFGNGGAGYNSAA

SEQ ID NO: 1502325 - protein, 24 aa, Mycobacterium tuberculosis
SSSGFKVRPSFSFFAVGPDGNARG

SEQ ID NO: 1502326 - protein, 20 aa, Mycobacterium tuberculosis
SSSPPRPPLPPKPPAPPTSA

SEQ ID NO: 1502327 - protein, 23 aa, Mycobacterium tuberculosis
SSSRLPVSLPFVARTRTMQATGR

SEQ ID NO: 1502328 - protein, 17 aa, Mycobacterium tuberculosis
STGWTGLIVHGAVRDAA

SEQ ID NO: 1502329 - protein, 18 aa, Mycobacterium tuberculosis
STKLRNGFRIQRQNTRIG

SEQ ID NO: 1502330 - protein, 22 aa, Mycobacterium tuberculosis
STKPALTCWKPFTATISKAGAD

SEQ ID NO: 1502331 - protein, 22 aa, Mycobacterium tuberculosis
STLLLTLLFRFMRPLIENGHVF

SEQ ID NO: 1502332 - protein, 24 aa, Mycobacterium tuberculosis
STLSFRLALRLRRERNEFDGDVDW

SEQ ID NO: 1502333 - protein, 18 aa, Mycobacterium tuberculosis
STNARMLIQFGFIERLAV

SEQ ID NO: 1502334 - protein, 18 aa, Mycobacterium tuberculosis
STQIAALFGAHARSYQTL

SEQ ID NO: 1502335 - protein, 19 aa, Mycobacterium tuberculosis
STWRMGGAINCGKAQPGQV

SEQ ID NO: 1502336 - protein, 24 aa, Mycobacterium tuberculosis
SVCMFKPPFAWREYLLQCWFVARV

SEQ ID NO: 1502337 - protein, 17 aa, Mycobacterium tuberculosis
SVDCARYWLDADKPISK

SEQ ID NO: 1502338 - protein, 20 aa, Mycobacterium tuberculosis
SVDIPARFVLGQALELPQPG

SEQ ID NO: 1502339 - protein, 23 aa, Mycobacterium tuberculosis
SVGNSWTPLAPVVEPPTPPTPAS

SEQ ID NO: 1502340 - protein, 17 aa, Mycobacterium tuberculosis
SVLSGLAALHWRGPAAE

SEQ ID NO: 1502341 - protein, 24 aa, Mycobacterium tuberculosis
SVQCRWPGCHPKDPTIYRRAASER

SEQ ID NO: 1502342 - protein, 17 aa, Mycobacterium tuberculosis
SVVRAFFNVVPFAVRAR

SEQ ID NO: 1502343 - protein, 19 aa, Mycobacterium tuberculosis
SVVVAESWRASALAEMIQE

SEQ ID NO: 1502344 - protein, 24 aa, Mycobacterium tuberculosis
SVYGHRGCRGRWPADSGGRWHMSF

SEQ ID NO: 1502345 - protein, 19 aa, Mycobacterium tuberculosis
SWAALRWVGENAAELGGDP

SEQ ID NO: 1502346 - protein, 24 aa, Mycobacterium tuberculosis
SWAARWACRPTRWCLGTAASTSRS

SEQ ID NO: 1502347 - protein, 21 aa, Mycobacterium tuberculosis
SWLKSRHSFSFGDHYDPDNTH

SEQ ID NO: 1502348 - protein, 19 aa, Mycobacterium tuberculosis
SWTPLAPVVEPPTPPTPAS

SEQ ID NO: 1502349 - protein, 22 aa, Mycobacterium tuberculosis
SYKSCFLAMVRRFYELGVKELN

SEQ ID NO: 1502350 - protein, 21 aa, Mycobacterium tuberculosis
SYNCLKREGVHTVGELVARTE

SEQ ID NO: 1502351 - protein, 17 aa, Mycobacterium tuberculosis
TAAAMDLASIGSTVSAA

SEQ ID NO: 1502352 - protein, 26 aa, Mycobacterium tuberculosis
TAAPAAPPVCPVLSTSAARAASAAAP

SEQ ID NO: 1502353 - protein, 24 aa, Mycobacterium tuberculosis
TAAPAGPVVSCYGNGGAGGANIAG

SEQ ID NO: 1502354 - protein, 17 aa, Mycobacterium tuberculosis
TAAQFGIEPWVAMLSYS

SEQ ID NO: 1502355 - protein, 20 aa, Mycobacterium tuberculosis
TAARAFSRWSTTRTNRKRCG

SEQ ID NO: 1502356 - protein, 25 aa, Mycobacterium tuberculosis
TADGCWPGGCTGRWTGRRNCATRRP

SEQ ID NO: 1502357 - protein, 19 aa, Mycobacterium tuberculosis
TADPGATPGHRRRRGPPGA

SEQ ID NO: 1502358 - protein, 27 aa, Mycobacterium tuberculosis
TAESRRATLRAPLAVMVANGSDGVAAG

SEQ ID NO: 1502359 - protein, 25 aa, Mycobacterium tuberculosis
TAETGRPRWMAVSANGGAGGNGGIG

SEQ ID NO: 1502360 - protein, 20 aa, Mycobacterium tuberculosis
TAFGEGFPASATVAAVGAVA

SEQ ID NO: 1502361 - protein, 20 aa, Mycobacterium tuberculosis
TAGAGAWAMWGWVTPAAAAG

SEQ ID NO: 1502362 - protein, 23 aa, Mycobacterium tuberculosis
TAGAGAWAMWGWVTPAAAAGGWP

SEQ ID NO: 1502363 - protein, 17 aa, Mycobacterium tuberculosis
TAGCARHSSGLSVQTFL

SEQ ID NO: 1502364 - protein, 17 aa, Mycobacterium tuberculosis
TAGQALDASGYWPAPAV

SEQ ID NO: 1502365 - protein, 19 aa, Mycobacterium tuberculosis
TALLRLVGRYGIGEDDVDD

SEQ ID NO: 1502366 - protein, 19 aa, Mycobacterium tuberculosis
TAPTSFGWPAGGAWSNDSV

SEQ ID NO: 1502367 - protein, 20 aa, Mycobacterium tuberculosis
TASRAVSRWSVQKHVSPVLD

SEQ ID NO: 1502368 - protein, 22 aa, Mycobacterium tuberculosis
TASSPFGIAIAIGGAGAQGGAG

SEQ ID NO: 1502369 - protein, 18 aa, Mycobacterium tuberculosis
TATEGIWVGPPEPPAPPF

SEQ ID NO: 1502370 - protein, 17 aa, Mycobacterium tuberculosis
TAVAALFGAHGQAYQAL

SEQ ID NO: 1502371 - protein, 21 aa, Mycobacterium tuberculosis
TAYRWFRAGLLSVMARRVGRL

SEQ ID NO: 1502372 - protein, 19 aa, Mycobacterium tuberculosis
TCCRTCGAWQTGFPRRSKS

SEQ ID NO: 1502373 - protein, 17 aa, Mycobacterium tuberculosis
TDFGRLKRWAGWNRNRC

SEQ ID NO: 1502374 - protein, 23 aa, Mycobacterium tuberculosis
TDLKRIGASLAHENASAAASTTA

SEQ ID NO: 1502375 - protein, 18 aa, Mycobacterium tuberculosis
TDQPRPSTQTAIASPAAS

SEQ ID NO: 1502376 - protein, 18 aa, Mycobacterium tuberculosis
TDRRAGRGWRRWKTPSRS

SEQ ID NO: 1502377 - protein, 18 aa, Mycobacterium tuberculosis
TDWRWNRILIEGSNCRDI

SEQ ID NO: 1502378 - protein, 20 aa, Mycobacterium tuberculosis
TEGTVIRWLKKIGDSVQVDE

SEQ ID NO: 1502379 - protein, 17 aa, Mycobacterium tuberculosis
TEHAWRIGVVAQSHATV

SEQ ID NO: 1502380 - protein, 19 aa, Mycobacterium tuberculosis
TELRLRYGACVNVERRSAS

SEQ ID NO: 1502381 - protein, 26 aa, Mycobacterium tuberculosis
TEVLQRLRGMFAFALWDTVTRELFCA

SEQ ID NO: 1502382 - protein, 21 aa, Mycobacterium tuberculosis
TFVGAICRWQAANPAGLIDIT

SEQ ID NO: 1502383 - protein, 18 aa, Mycobacterium tuberculosis
TGAFGRLLGRIWRAETAD

SEQ ID NO: 1502384 - protein, 19 aa, Mycobacterium tuberculosis
TGCAKAFRMGYIDCNQFTL

SEQ ID NO: 1502385 - protein, 21 aa, Mycobacterium tuberculosis
TGDCLFPGGVGKTWQPADFTQ

SEQ ID NO: 1502386 - protein, 26 aa, Mycobacterium tuberculosis
TGGAGGAGGWLFGVGGAGGVGGAGGG

SEQ ID NO: 1502387 - protein, 19 aa, Mycobacterium tuberculosis
TGGAWGDGGFRRRGSARAV

SEQ ID NO: 1502388 - protein, 29 aa, Mycobacterium tuberculosis
TGGKAGTELGCRRAWTAPTASPPTAVTGG

SEQ ID NO: 1502389 - protein, 18 aa, Mycobacterium tuberculosis
TGGLLLRWVCAACVPTGL

SEQ ID NO: 1502390 - protein, 19 aa, Mycobacterium tuberculosis
TGGRGGWLAGAGGAGGAGG

SEQ ID NO: 1502391 - protein, 19 aa, Mycobacterium tuberculosis
TGGRGGWLAGAGGAGGDGG

SEQ ID NO: 1502392 - protein, 20 aa, Mycobacterium tuberculosis
TGHMPVRRLDLIWISARNAA

SEQ ID NO: 1502393 - protein, 17 aa, Mycobacterium tuberculosis
TGIIGWPALVMLFAGPR

SEQ ID NO: 1502394 - protein, 17 aa, Mycobacterium tuberculosis
TGLPCPVCGDTVREVSF

SEQ ID NO: 1502395 - protein, 18 aa, Mycobacterium tuberculosis
TGLSIRETVLFPIVRPHS

SEQ ID NO: 1502396 - protein, 22 aa, Mycobacterium tuberculosis
TGQARGAGGILWGNGGNGGSGA

SEQ ID NO: 1502397 - protein, 17 aa, Mycobacterium tuberculosis
TGRPPRWVRPIVDALGF

SEQ ID NO: 1502398 - protein, 22 aa, Mycobacterium tuberculosis
TGRTGTGAAWGWGPPSPPMPPA

SEQ ID NO: 1502399 - protein, 26 aa, Mycobacterium tuberculosis
TGTAGGLARACRRGGTVAADATGRRS

SEQ ID NO: 1502400 - protein, 17 aa, Mycobacterium tuberculosis
TGTLTVCTMVPMRSVPH

SEQ ID NO: 1502401 - protein, 18 aa, Mycobacterium tuberculosis
TGVMSSGFFNFGTGNSGL

SEQ ID NO: 1502402 - protein, 18 aa, Mycobacterium tuberculosis
TGVMTFGLPLAMTLNAVG

SEQ ID NO: 1502403 - protein, 24 aa, Mycobacterium tuberculosis
TGVWSRLMLDIARWRRRRREELAA

SEQ ID NO: 1502404 - protein, 18 aa, Mycobacterium tuberculosis
THCNLDCPICFADSGHQP

SEQ ID NO: 1502405 - protein, 17 aa, Mycobacterium tuberculosis
THGLTLWDLDRVSRSTA

SEQ ID NO: 1502406 - protein, 19 aa, Mycobacterium tuberculosis
THRAGACGGVGAGTAGPAV

SEQ ID NO: 1502407 - protein, 19 aa, Mycobacterium tuberculosis
TILGRFSASFGETFASGPY

SEQ ID NO: 1502408 - protein, 23 aa, Mycobacterium tuberculosis
TIPGMRLPFTSIVPFVVYYGPVE

SEQ ID NO: 1502409 - protein, 25 aa, Mycobacterium tuberculosis
TIPGMRLPFTSIVPFVVYYGPVELP

SEQ ID NO: 1502410 - protein, 18 aa, Mycobacterium tuberculosis
TIRLPVHLVEQVNKLARI

SEQ ID NO: 1502411 - protein, 18 aa, Mycobacterium tuberculosis
TIRRRFSTRAKRRRATRV

SEQ ID NO: 1502412 - protein, 26 aa, Mycobacterium tuberculosis
TISGLRRDYRWAEADRHLWIADERGT

SEQ ID NO: 1502413 - protein, 24 aa, Mycobacterium tuberculosis
TITARLNFQLAFGARVGQRLADAR

SEQ ID NO: 1502414 - protein, 17 aa, Mycobacterium tuberculosis
TIVDAHLDGGFGPVVLP

SEQ ID NO: 1502415 - protein, 27 aa, Mycobacterium tuberculosis
TIVKHERSCLMKAAADARLAHAVRHRP

SEQ ID NO: 1502416 - protein, 17 aa, Mycobacterium tuberculosis
TLCWCPATIGGPPGQSR

SEQ ID NO: 1502417 - protein, 26 aa, Mycobacterium tuberculosis
TLFGSVRSGLNTGLFNMGTAISGLFN

SEQ ID NO: 1502418 - protein, 24 aa, Mycobacterium tuberculosis
TLFRRLAVFVGCFFVDDAQAVACS

SEQ ID NO: 1502419 - protein, 19 aa, Mycobacterium tuberculosis
TLGRTTRAASMWVTPTPVV

SEQ ID NO: 1502420 - protein, 18 aa, Mycobacterium tuberculosis
TLGTFTVHGFRFPEITGD

SEQ ID NO: 1502421 - protein, 23 aa, Mycobacterium tuberculosis
TLKKLSGLRARNGLLTASGDNAS

SEQ ID NO: 1502422 - protein, 18 aa, Mycobacterium tuberculosis
TLLGLPLIGNGADGVAGT

SEQ ID NO: 1502423 - protein, 18 aa, Mycobacterium tuberculosis
TLLGRPLIGNGADGGPGQ

SEQ ID NO: 1502424 - protein, 18 aa, Mycobacterium tuberculosis
TLLGRPLIGNGTNGAPGT

SEQ ID NO: 1502425 - protein, 17 aa, Mycobacterium tuberculosis
TLLTARCPVLFAPAMHT

SEQ ID NO: 1502426 - protein, 18 aa, Mycobacterium tuberculosis
TLPPEINSALIFGGAGSE

SEQ ID NO: 1502427 - protein, 23 aa, Mycobacterium tuberculosis
TLPRPTVVTGLRLAASRSMLPAH

SEQ ID NO: 1502428 - protein, 21 aa, Mycobacterium tuberculosis
TLRDHWRCVPTSWVRSSLRRS

SEQ ID NO: 1502429 - protein, 19 aa, Mycobacterium tuberculosis
TLRLPLGLVGKGGDGGKRG

SEQ ID NO: 1502430 - protein, 17 aa, Mycobacterium tuberculosis
TLRTIYQNLGWAFGYNT

SEQ ID NO: 1502431 - protein, 19 aa, Mycobacterium tuberculosis
TLRVAWSLADLAGRTSPGI

SEQ ID NO: 1502432 - protein, 23 aa, Mycobacterium tuberculosis
TLSFFRLALRLRRERNEFDGDVD

SEQ ID NO: 1502433 - protein, 18 aa, Mycobacterium tuberculosis
TLTGRPLIGNGANGTPGT

SEQ ID NO: 1502434 - protein, 18 aa, Mycobacterium tuberculosis
TLTVDAGAYVSAEAANAG

SEQ ID NO: 1502435 - protein, 17 aa, Mycobacterium tuberculosis
TLWRMSVSIAGAVCTAA

SEQ ID NO: 1502436 - protein, 24 aa, Mycobacterium tuberculosis
TMTGPRPGGFGALDGRTNEICAQG

SEQ ID NO: 1502437 - protein, 20 aa, Mycobacterium tuberculosis
TMVIPPIVFLPSMTIGGQTY

SEQ ID NO: 1502438 - protein, 17 aa, Mycobacterium tuberculosis
TNARMLIQFGFIERLAV

SEQ ID NO: 1502439 - protein, 18 aa, Mycobacterium tuberculosis
TPDGVWSRMKFEGGVHRV

SEQ ID NO: 1502440 - protein, 23 aa, Mycobacterium tuberculosis
TPEGLRWLYNFIKAQGEHNFGKI

SEQ ID NO: 1502441 - protein, 18 aa, Mycobacterium tuberculosis
TPEQWWPFIGNLSLDQSI

SEQ ID NO: 1502442 - protein, 17 aa, Mycobacterium tuberculosis
TPIPVHWVAAAVLDGVA

SEQ ID NO: 1502443 - protein, 19 aa, Mycobacterium tuberculosis
TPISANFAHRVSVLVDLSV

SEQ ID NO: 1502444 - protein, 20 aa, Mycobacterium tuberculosis
TPKPSWPWVRTLLHSIYDQP

SEQ ID NO: 1502445 - protein, 19 aa, Mycobacterium tuberculosis
TPPPHWRPDVLLVAVGAMS

SEQ ID NO: 1502446 - protein, 19 aa, Mycobacterium tuberculosis
TPPVRWRSGRRVHFDLDPL

SEQ ID NO: 1502447 - protein, 17 aa, Mycobacterium tuberculosis
TPRFGFEQVCATPAFPH

SEQ ID NO: 1502448 - protein, 21 aa, Mycobacterium tuberculosis
TPRGWRMRCARKCRQTQNPER

SEQ ID NO: 1502449 - protein, 17 aa, Mycobacterium tuberculosis
TPRRWSTRCWSRPRVSS

SEQ ID NO: 1502450 - protein, 22 aa, Mycobacterium tuberculosis
TPSEAFTAWEFVDGYDVAQAVV

SEQ ID NO: 1502451 - protein, 18 aa, Mycobacterium tuberculosis
TPWLPARPAGASPPAPPA

SEQ ID NO: 1502452 - protein, 17 aa, Mycobacterium tuberculosis
TQAPAIWASPTWAPTTP

SEQ ID NO: 1502453 - protein, 20 aa, Mycobacterium tuberculosis
TQFLRGGPWTRWGCCPPRGW

SEQ ID NO: 1502454 - protein, 17 aa, Mycobacterium tuberculosis
TQIAALFGAHARSYQTL

SEQ ID NO: 1502455 - protein, 17 aa, Mycobacterium tuberculosis
TQLPLGFMVEFDRAGVL

SEQ ID NO: 1502456 - protein, 22 aa, Mycobacterium tuberculosis
TQLWLERPLIGDGVHGAPGTGQ

SEQ ID NO: 1502457 - protein, 25 aa, Mycobacterium tuberculosis
TQTLLGRPLIGDGANATTPGGAGGD

SEQ ID NO: 1502458 - protein, 21 aa, Mycobacterium tuberculosis
TRAAGNFGIGNAGTGNWGIGN

SEQ ID NO: 1502459 - protein, 18 aa, Mycobacterium tuberculosis
TRAASMWVTPTPVVSTRA

SEQ ID NO: 1502460 - protein, 17 aa, Mycobacterium tuberculosis
TRACATSGWPTPAPATS

SEQ ID NO: 1502461 - protein, 17 aa, Mycobacterium tuberculosis
TRAWPASPWATPSRCSP

SEQ ID NO: 1502462 - protein, 21 aa, Mycobacterium tuberculosis
TRAYRLPWPPGTVVYEIDQPA

SEQ ID NO: 1502463 - protein, 17 aa, Mycobacterium tuberculosis
TREFLVWAVNDAIERGE

SEQ ID NO: 1502464 - protein, 17 aa, Mycobacterium tuberculosis
TRMQRFWISLYFPLTMR

SEQ ID NO: 1502465 - protein, 20 aa, Mycobacterium tuberculosis
TRMSATPAWGTRAPATGACG

SEQ ID NO: 1502466 - protein, 24 aa, Mycobacterium tuberculosis
TRNCATCWACCAMPTAATSAWSTP

SEQ ID NO: 1502467 - protein, 24 aa, Mycobacterium tuberculosis
TRNWAEPQMHAFDAGRIHKNLVPG

SEQ ID NO: 1502468 - protein, 21 aa, Mycobacterium tuberculosis
TRPGRRRRRGGTLAGNGGAGG

SEQ ID NO: 1502469 - protein, 26 aa, Mycobacterium tuberculosis
TRRSCVSGRCGWSQRSAVSTIRSGQR

SEQ ID NO: 1502470 - protein, 20 aa, Mycobacterium tuberculosis
TRSGDVWLLNGFKWFASNCA

SEQ ID NO: 1502471 - protein, 25 aa, Mycobacterium tuberculosis
TRTLKGWADRGVRVIGLDAGGGTAL

SEQ ID NO: 1502472 - protein, 22 aa, Mycobacterium tuberculosis
TRVPVGPVVRVGGCTATAAPAA

SEQ ID NO: 1502473 - protein, 20 aa, Mycobacterium tuberculosis
TRWLPHPGPLILQATASHLA

SEQ ID NO: 1502474 - protein, 20 aa, Mycobacterium tuberculosis
TRWSRCWVRVWGSLRSTRPE

SEQ ID NO: 1502475 - protein, 20 aa, Mycobacterium tuberculosis
TRYLPPFAYFMDWPNAFQVL

SEQ ID NO: 1502476 - protein, 17 aa, Mycobacterium tuberculosis
TRYPLVVAWPARIRPDG

SEQ ID NO: 1502477 - protein, 24 aa, Mycobacterium tuberculosis
TSGEQRLSGFLLWQSAYSEMWFTE

SEQ ID NO: 1502478 - protein, 19 aa, Mycobacterium tuberculosis
TSRDAWCYNFSRGALEANI

SEQ ID NO: 1502479 - protein, 18 aa, Mycobacterium tuberculosis
TSRPSRWASPRSATSGRS

SEQ ID NO: 1502480 - protein, 18 aa, Mycobacterium tuberculosis
TSSIPFDAHGGNGGAGGD

SEQ ID NO: 1502481 - protein, 25 aa, Mycobacterium tuberculosis
TSVCMFKPPFAWREYLLQCWFVARV

SEQ ID NO: 1502482 - protein, 21 aa, Mycobacterium tuberculosis
TSVCPRLVPSPPMPPAPPPTP

SEQ ID NO: 1502483 - protein, 17 aa, Mycobacterium tuberculosis
TSVCSTRAPATSASATR

SEQ ID NO: 1502484 - protein, 18 aa, Mycobacterium tuberculosis
TSVPAFRPGAQFKAVVSG

SEQ ID NO: 1502485 - protein, 22 aa, Mycobacterium tuberculosis
TSVSIPSWWQPYVLSVASLTSA

SEQ ID NO: 1502486 - protein, 17 aa, Mycobacterium tuberculosis
TTARCGWLLSLGGAATD

SEQ ID NO: 1502487 - protein, 26 aa, Mycobacterium tuberculosis
TTLVPNLGCGLGWRGTRFTVRRRCRG

SEQ ID NO: 1502488 - protein, 17 aa, Mycobacterium tuberculosis
TVAECLIVLTARHGPVA

SEQ ID NO: 1502489 - protein, 18 aa, Mycobacterium tuberculosis
TVAKWRLQATQSRVRDVQ

SEQ ID NO: 1502490 - protein, 17 aa, Mycobacterium tuberculosis
TVGETWGLPSPEEAAAA

SEQ ID NO: 1502491 - protein, 19 aa, Mycobacterium tuberculosis
TVHAPRLSPAPALLALPAA

SEQ ID NO: 1502492 - protein, 17 aa, Mycobacterium tuberculosis
TVNRCPVYMPFDDVDIA

SEQ ID NO: 1502493 - protein, 22 aa, Mycobacterium tuberculosis
TVPIHIGLPLSLTIPGFTIPGG

SEQ ID NO: 1502494 - protein, 17 aa, Mycobacterium tuberculosis
TVSPRLSPISNMVSMAN

SEQ ID NO: 1502495 - protein, 20 aa, Mycobacterium tuberculosis
TVVCAALASAARQAGIDVAV

SEQ ID NO: 1502496 - protein, 24 aa, Mycobacterium tuberculosis
TWIRRSRCWIRWATPPCGRTHCIG

SEQ ID NO: 1502497 - protein, 17 aa, Mycobacterium tuberculosis
TWPARWRCPSSTAASSR

SEQ ID NO: 1502498 - protein, 21 aa, Mycobacterium tuberculosis
TWPRFVCALPKEFFAAVRAEL

SEQ ID NO: 1502499 - protein, 17 aa, Mycobacterium tuberculosis
TYATWWIRQAITPRHGR

SEQ ID NO: 1502500 - protein, 17 aa, Mycobacterium tuberculosis
TYIHGFPVMGLNQNADP

SEQ ID NO: 1502501 - protein, 23 aa, Mycobacterium tuberculosis
VAALNLVKCVHWPSSSPPQPPKD

SEQ ID NO: 1502502 - protein, 23 aa, Mycobacterium tuberculosis
VAAYQERFVLALSQAGSTYAVAE

SEQ ID NO: 1502503 - protein, 20 aa, Mycobacterium tuberculosis
VACYPARFQLVLAANPCPCA

SEQ ID NO: 1502504 - protein, 18 aa, Mycobacterium tuberculosis
VAEMTVALLLAVARHLIP

SEQ ID NO: 1502505 - protein, 29 aa, Mycobacterium tuberculosis
VAFDNPRPHTGQAPRPWVASTRSPTAICC

SEQ ID NO: 1502506 - protein, 24 aa, Mycobacterium tuberculosis
VAKQALKIAREWSAERVQWGKPVG

SEQ ID NO: 1502507 - protein, 19 aa, Mycobacterium tuberculosis
VALAEVWRSCGVLPDLTVG

SEQ ID NO: 1502508 - protein, 24 aa, Mycobacterium tuberculosis
VALPNGRYGWRISLPAMGVLLERT

SEQ ID NO: 1502509 - protein, 17 aa, Mycobacterium tuberculosis
VAQGVWCGMTIPRVYPE

SEQ ID NO: 1502510 - protein, 22 aa, Mycobacterium tuberculosis
VASAGPGRPAFPVVPAGSADCS

SEQ ID NO: 1502511 - protein, 23 aa, Mycobacterium tuberculosis
VASRTGNLVTWWTGDALLVFDAG

SEQ ID NO: 1502512 - protein, 26 aa, Mycobacterium tuberculosis
VATDLKRIGASLAHENASAAASTTAV

SEQ ID NO: 1502513 - protein, 17 aa, Mycobacterium tuberculosis
VAVCSTGLIGDRLPMDK

SEQ ID NO: 1502514 - protein, 17 aa, Mycobacterium tuberculosis
VAVRRISMSFVNVAPQL

SEQ ID NO: 1502515 - protein, 18 aa, Mycobacterium tuberculosis
VAVTRATPRFGFEQVCAT

SEQ ID NO: 1502516 - protein, 18 aa, Mycobacterium tuberculosis
VAYLTAWHPAVRGRAPIP

SEQ ID NO: 1502517 - protein, 18 aa, Mycobacterium tuberculosis
VCANWRCQHKLLVTLEDN

SEQ ID NO: 1502518 - protein, 19 aa, Mycobacterium tuberculosis
VCGGGDWRRAGIPARSDQF

SEQ ID NO: 1502519 - protein, 19 aa, Mycobacterium tuberculosis
VCKACHGVAILADNIEPIL

SEQ ID NO: 1502520 - protein, 17 aa, Mycobacterium tuberculosis
VCSTGLIGDRLPMDKLL

SEQ ID NO: 1502521 - protein, 17 aa, Mycobacterium tuberculosis
VDAAKGVPDWAARLPDE

SEQ ID NO: 1502522 - protein, 18 aa, Mycobacterium tuberculosis
VDHFRYFAAAIRAQEGAL

SEQ ID NO: 1502523 - protein, 18 aa, Mycobacterium tuberculosis
VDILERFYGLVLTDCGTG

SEQ ID NO: 1502524 - protein, 21 aa, Mycobacterium tuberculosis
VDIPIHIPINIDAGVVTLQGF

SEQ ID NO: 1502525 - protein, 19 aa, Mycobacterium tuberculosis
VDLRNDWPSALKNAGFDPA

SEQ ID NO: 1502526 - protein, 20 aa, Mycobacterium tuberculosis
VDLVCSWGPMILGHAHPAVV

SEQ ID NO: 1502527 - protein, 22 aa, Mycobacterium tuberculosis
VDLVCSWGPMILGHAHPAVVEA

SEQ ID NO: 1502528 - protein, 24 aa, Mycobacterium tuberculosis
VDPGKRVVFTWGWEDHGDPPPGGS

SEQ ID NO: 1502529 - protein, 24 aa, Mycobacterium tuberculosis
VDPGKRVVFTWGWEDHGDPRRAGR

SEQ ID NO: 1502530 - protein, 21 aa, Mycobacterium tuberculosis
VDTDLRWRIVTALATAGAIDA

SEQ ID NO: 1502531 - protein, 24 aa, Mycobacterium tuberculosis
VDTDLRWRIVTALATAGAIDADGP

SEQ ID NO: 1502532 - protein, 23 aa, Mycobacterium tuberculosis
VDTDLRWRIVTALATAGAIDADW

SEQ ID NO: 1502533 - protein, 17 aa, Mycobacterium tuberculosis
VDVVCPLGWPATPARLP

SEQ ID NO: 1502534 - protein, 19 aa, Mycobacterium tuberculosis
VDVVCPLGWPATPARLPFT

SEQ ID NO: 1502535 - protein, 18 aa, Mycobacterium tuberculosis
VDYARGRFDAIVPDEVIA

SEQ ID NO: 1502536 - protein, 19 aa, Mycobacterium tuberculosis
VEFLRFLLADERVRVGDLD

SEQ ID NO: 1502537 - protein, 17 aa, Mycobacterium tuberculosis
VEGAFYWLNNREVRWRP

SEQ ID NO: 1502538 - protein, 18 aa, Mycobacterium tuberculosis
VEGAFYWLNNREVRWRPE

SEQ ID NO: 1502539 - protein, 17 aa, Mycobacterium tuberculosis
VELFMQMPWRTEIIQGL

SEQ ID NO: 1502540 - protein, 22 aa, Mycobacterium tuberculosis
VERMHRACLILTFGGGTNEVQR

SEQ ID NO: 1502541 - protein, 22 aa, Mycobacterium tuberculosis
VESGLRVARKWGADVNGLPAGR

SEQ ID NO: 1502542 - protein, 18 aa, Mycobacterium tuberculosis
VEVHWSRWGEAYVTPVEP

SEQ ID NO: 1502543 - protein, 18 aa, Mycobacterium tuberculosis
VFGRRAGLGAADYVRALS

SEQ ID NO: 1502544 - protein, 19 aa, Mycobacterium tuberculosis
VFPGGCFFAAAAADVDSQP

SEQ ID NO: 1502545 - protein, 19 aa, Mycobacterium tuberculosis
VFRRTRIVAHEVRRHCTTG

SEQ ID NO: 1502546 - protein, 18 aa, Mycobacterium tuberculosis
VGADEMWDIRNRGVIPAG

SEQ ID NO: 1502547 - protein, 35 aa, Mycobacterium tuberculosis
VGFLQLRCGWGVGVWECRRDGVGWLESGSVGVAGW

SEQ ID NO: 1502548 - protein, 23 aa, Mycobacterium tuberculosis
VGGDGGRGGLLAGNGGTGGAGGN

SEQ ID NO: 1502549 - protein, 25 aa, Mycobacterium tuberculosis
VGGLLARFPGFYIPFLDVPFNGATP

SEQ ID NO: 1502550 - protein, 19 aa, Mycobacterium tuberculosis
VGGNARLLGTGGAGGVGGG

SEQ ID NO: 1502551 - protein, 24 aa, Mycobacterium tuberculosis
VGGNGATGPWLFGDGGAGGGGGAG

SEQ ID NO: 1502552 - protein, 18 aa, Mycobacterium tuberculosis
VGGNGGWLYGNGGAGGLG

SEQ ID NO: 1502553 - protein, 19 aa, Mycobacterium tuberculosis
VGGNGGWLYGNGGAGGLGG

SEQ ID NO: 1502554 - protein, 25 aa, Mycobacterium tuberculosis
VGGPGGGHGLLGLGGSHGAGGAGGS

SEQ ID NO: 1502555 - protein, 19 aa, Mycobacterium tuberculosis
VGGPSTWRMGGAINCGKAQ

SEQ ID NO: 1502556 - protein, 17 aa, Mycobacterium tuberculosis
VGGRGGWLLGNGGTGGA

SEQ ID NO: 1502557 - protein, 22 aa, Mycobacterium tuberculosis
VGGVGGNGGWLYGNGGAGGLGG

SEQ ID NO: 1502558 - protein, 23 aa, Mycobacterium tuberculosis
VGGVGGNGGWLYGNGGAGGLGGT

SEQ ID NO: 1502559 - protein, 19 aa, Mycobacterium tuberculosis
VGLRARAKAAFAEREGVNL

SEQ ID NO: 1502560 - protein, 17 aa, Mycobacterium tuberculosis
VGNSWTPLAPVVEPPTP

SEQ ID NO: 1502561 - protein, 21 aa, Mycobacterium tuberculosis
VGPRVARRFGRVLLKLGGNNA

SEQ ID NO: 1502562 - protein, 26 aa, Mycobacterium tuberculosis
VGQLQQRPCCGGVITRACSACSTAST

SEQ ID NO: 1502563 - protein, 18 aa, Mycobacterium tuberculosis
VGQPGGDGGILWGNGGNG

SEQ ID NO: 1502564 - protein, 18 aa, Mycobacterium tuberculosis
VGQPPCWAPPGPGRGCPG

SEQ ID NO: 1502565 - protein, 17 aa, Mycobacterium tuberculosis
VGQSRRERGPAMEYLIA

SEQ ID NO: 1502566 - protein, 24 aa, Mycobacterium tuberculosis
VGQSRRERGPAMEYLIAAQDVLVA

SEQ ID NO: 1502567 - protein, 20 aa, Mycobacterium tuberculosis
VGRGARLRGPVCAGEDARAD

SEQ ID NO: 1502568 - protein, 17 aa, Mycobacterium tuberculosis
VGRRFARLAPIVATHRK

SEQ ID NO: 1502569 - protein, 20 aa, Mycobacterium tuberculosis
VGSFRGRWLDRACGSSHGRR

SEQ ID NO: 1502570 - protein, 26 aa, Mycobacterium tuberculosis
VGSLMKLRMSCCRLCHGEVLSGALYP

SEQ ID NO: 1502571 - protein, 27 aa, Mycobacterium tuberculosis
VGTGAGVSGLWLLSGMRDDGVLTTIDI

SEQ ID NO: 1502572 - protein, 19 aa, Mycobacterium tuberculosis
VGYRTRLRPVAARHRTGHT

SEQ ID NO: 1502573 - protein, 17 aa, Mycobacterium tuberculosis
VHAPRLSPAPALLALPA

SEQ ID NO: 1502574 - protein, 17 aa, Mycobacterium tuberculosis
VHFGLPGLNGSGGDGGD

SEQ ID NO: 1502575 - protein, 17 aa, Mycobacterium tuberculosis
VHGLPLYHVHGLVLGLC

SEQ ID NO: 1502576 - protein, 19 aa, Mycobacterium tuberculosis
VHLDACDRWSVGLSGGPDS

SEQ ID NO: 1502577 - protein, 17 aa, Mycobacterium tuberculosis
VHRCLSHWPGRPVGEGA

SEQ ID NO: 1502578 - protein, 22 aa, Mycobacterium tuberculosis
VHRDGRDVDGRNDGGGSPVVAG

SEQ ID NO: 1502579 - protein, 22 aa, Mycobacterium tuberculosis
VHVISWRWVKFVYIGDSAHPLQ

SEQ ID NO: 1502580 - protein, 22 aa, Mycobacterium tuberculosis
VIANGSFAPSFVGFGGNGGNGV

SEQ ID NO: 1502581 - protein, 18 aa, Mycobacterium tuberculosis
VIDPRWVLPVSDGVRELA

SEQ ID NO: 1502582 - protein, 17 aa, Mycobacterium tuberculosis
VIRAEADLARFPADVAR

SEQ ID NO: 1502583 - protein, 19 aa, Mycobacterium tuberculosis
VIRTLRRLGIRSVAVYSDP

SEQ ID NO: 1502584 - protein, 18 aa, Mycobacterium tuberculosis
VKGLGIAAGAKRPGAKKT

SEQ ID NO: 1502585 - protein, 17 aa, Mycobacterium tuberculosis
VKIRTCWQKELEVPVVA

SEQ ID NO: 1502586 - protein, 17 aa, Mycobacterium tuberculosis
VKQAAAFHSEFTRTLEA

SEQ ID NO: 1502587 - protein, 17 aa, Mycobacterium tuberculosis
VKRDAALCLAVLRVGAD

SEQ ID NO: 1502588 - protein, 22 aa, Mycobacterium tuberculosis
VLAIWPDWVRRWPTPSATATAS

SEQ ID NO: 1502589 - protein, 17 aa, Mycobacterium tuberculosis
VLDLTIRLAEVMLSSGS

SEQ ID NO: 1502590 - protein, 22 aa, Mycobacterium tuberculosis
VLEGRLAAWAIELDAAAGRGVS

SEQ ID NO: 1502591 - protein, 17 aa, Mycobacterium tuberculosis
VLIALGWPNHVHHAAAQ

SEQ ID NO: 1502592 - protein, 17 aa, Mycobacterium tuberculosis
VLKLLKITGDWQKFKGL

SEQ ID NO: 1502593 - protein, 21 aa, Mycobacterium tuberculosis
VLKQAAAFHGEFTRALAAAGA

SEQ ID NO: 1502594 - protein, 18 aa, Mycobacterium tuberculosis
VLPPEINSALMFAGAGPG

SEQ ID NO: 1502595 - protein, 19 aa, Mycobacterium tuberculosis
VLVHPRPRLSVMAVGGELV

SEQ ID NO: 1502596 - protein, 20 aa, Mycobacterium tuberculosis
VLVHPRPRLSVMAVGGELVD

SEQ ID NO: 1502597 - protein, 18 aa, Mycobacterium tuberculosis
VLVLSDWPAPQAPQSASG

SEQ ID NO: 1502598 - protein, 19 aa, Mycobacterium tuberculosis
VLWRGDYQGLLGFSSGANV

SEQ ID NO: 1502599 - protein, 17 aa, Mycobacterium tuberculosis
VMPHWPRPWGRAAGAVE

SEQ ID NO: 1502600 - protein, 19 aa, Mycobacterium tuberculosis
VMRAGLTWQQVVLLRAYAK

SEQ ID NO: 1502601 - protein, 21 aa, Mycobacterium tuberculosis
VMWSEHWSYKSSKVHLRYFGE

SEQ ID NO: 1502602 - protein, 25 aa, Mycobacterium tuberculosis
VNGRIPLPVDWRWPWGEALAVLENT

SEQ ID NO: 1502603 - protein, 25 aa, Mycobacterium tuberculosis
VNNGFLWRGDHQGLIFGSPGFFNST

SEQ ID NO: 1502604 - protein, 17 aa, Mycobacterium tuberculosis
VNVTLIFSVQRYREVMD

SEQ ID NO: 1502605 - protein, 17 aa, Mycobacterium tuberculosis
VPAAAAAPRCFSAAVGP

SEQ ID NO: 1502606 - protein, 23 aa, Mycobacterium tuberculosis
VPAPPFWGSRIVKGLAVADYTGL

SEQ ID NO: 1502607 - protein, 17 aa, Mycobacterium tuberculosis
VPDEFGLSRYLAAGLAA

SEQ ID NO: 1502608 - protein, 21 aa, Mycobacterium tuberculosis
VPDEVWPAVVFTLVTLLDDPV

SEQ ID NO: 1502609 - protein, 21 aa, Mycobacterium tuberculosis
VPGDGGGLVLLKPVQAALDDG

SEQ ID NO: 1502610 - protein, 17 aa, Mycobacterium tuberculosis
VPHTWLWAMPMSGPTGG

SEQ ID NO: 1502611 - protein, 25 aa, Mycobacterium tuberculosis
VPISRIPLTINIRIPVNITLNELPF

SEQ ID NO: 1502612 - protein, 24 aa, Mycobacterium tuberculosis
VPLPELRLPPLPPLPPGVAPAPPA

SEQ ID NO: 1502613 - protein, 20 aa, Mycobacterium tuberculosis
VPMQRIRPSLDWLIKNVGPH

SEQ ID NO: 1502614 - protein, 21 aa, Mycobacterium tuberculosis
VPMQRIRPSLDWLIKNVGPHA

SEQ ID NO: 1502615 - protein, 18 aa, Mycobacterium tuberculosis
VPPFTWWRGLRARELLEN

SEQ ID NO: 1502616 - protein, 17 aa, Mycobacterium tuberculosis
VPPTWQGSIPISMASSA

SEQ ID NO: 1502617 - protein, 19 aa, Mycobacterium tuberculosis
VPRAWRMRITVQRVGDRVK

SEQ ID NO: 1502618 - protein, 17 aa, Mycobacterium tuberculosis
VPRPERQYYWFGEPIDT

SEQ ID NO: 1502619 - protein, 20 aa, Mycobacterium tuberculosis
VPRRRACAAPRLQGMGGQIR

SEQ ID NO: 1502620 - protein, 17 aa, Mycobacterium tuberculosis
VPTAIPARFLSAIRCTP

SEQ ID NO: 1502621 - protein, 19 aa, Mycobacterium tuberculosis
VPTCPGWSLGQLFRHVGRG

SEQ ID NO: 1502622 - protein, 18 aa, Mycobacterium tuberculosis
VPVSGTWVDIRFTLPANT

SEQ ID NO: 1502623 - protein, 17 aa, Mycobacterium tuberculosis
VPVTLNYLFGSQPGGPL

SEQ ID NO: 1502624 - protein, 21 aa, Mycobacterium tuberculosis
VPYPSLKRMNPWKRFFHNQTK

SEQ ID NO: 1502625 - protein, 23 aa, Mycobacterium tuberculosis
VQALTAGAGAYAFAEAANASPLQ

SEQ ID NO: 1502626 - protein, 17 aa, Mycobacterium tuberculosis
VQAWRGFSRWLMRAYDV

SEQ ID NO: 1502627 - protein, 18 aa, Mycobacterium tuberculosis
VRASGLLPRWEQTQRFIG

SEQ ID NO: 1502628 - protein, 20 aa, Mycobacterium tuberculosis
VRCSVAWRCRAWLAALPPVL

SEQ ID NO: 1502629 - protein, 22 aa, Mycobacterium tuberculosis
VRDTLRLGGKFPLKAGMLTSLG

SEQ ID NO: 1502630 - protein, 17 aa, Mycobacterium tuberculosis
VRLALLIMLERLGPAER

SEQ ID NO: 1502631 - protein, 23 aa, Mycobacterium tuberculosis
VRLEGPAVFRWAAFKMGDVGRRA

SEQ ID NO: 1502632 - protein, 22 aa, Mycobacterium tuberculosis
VRLEGPAVFRWVGFKMGDVGRR

SEQ ID NO: 1502633 - protein, 18 aa, Mycobacterium tuberculosis
VRLFLRRVPALAFLPNRR

SEQ ID NO: 1502634 - protein, 22 aa, Mycobacterium tuberculosis
VRLLRSGGVIVVHRAALGGRAG

SEQ ID NO: 1502635 - protein, 17 aa, Mycobacterium tuberculosis
VRLMRWGLIPSWIKAGP

SEQ ID NO: 1502636 - protein, 18 aa, Mycobacterium tuberculosis
VRQRPRPPVDCRALVMER

SEQ ID NO: 1502637 - protein, 18 aa, Mycobacterium tuberculosis
VRRKRGAAAFPWCCGRPV

SEQ ID NO: 1502638 - protein, 19 aa, Mycobacterium tuberculosis
VRRLWVLKVWGDVVDDRRG

SEQ ID NO: 1502639 - protein, 17 aa, Mycobacterium tuberculosis
VRRMRLQPGRMFLVDTA

SEQ ID NO: 1502640 - protein, 18 aa, Mycobacterium tuberculosis
VRRMRLQPGRMFLVDTAQ

SEQ ID NO: 1502641 - protein, 23 aa, Mycobacterium tuberculosis
VRRVLCRLRLLLGPPRGPPRHRT

SEQ ID NO: 1502642 - protein, 21 aa, Mycobacterium tuberculosis
VRSGVAFDILRRWLLARGYDV

SEQ ID NO: 1502643 - protein, 17 aa, Mycobacterium tuberculosis
VRTRWSRCWVRVWGSLR

SEQ ID NO: 1502644 - protein, 17 aa, Mycobacterium tuberculosis
VRVVEAFADRPDQRLRE

SEQ ID NO: 1502645 - protein, 20 aa, Mycobacterium tuberculosis
VSAAIAALFSGHAQAYQALS

SEQ ID NO: 1502646 - protein, 20 aa, Mycobacterium tuberculosis
VSAAMAALFGAHAQEYQRLS

SEQ ID NO: 1502647 - protein, 20 aa, Mycobacterium tuberculosis
VSAAVAALFGSYAQSYQAFG

SEQ ID NO: 1502648 - protein, 19 aa, Mycobacterium tuberculosis
VSAAVAALFSGHAQTYQAL

SEQ ID NO: 1502649 - protein, 20 aa, Mycobacterium tuberculosis
VSAAVAALFSGHAQTYQALS

SEQ ID NO: 1502650 - protein, 24 aa, Mycobacterium tuberculosis
VSAAVSRLFGAYGQQFQALNARAA

SEQ ID NO: 1502651 - protein, 26 aa, Mycobacterium tuberculosis
VSAAVSRLFGAYGQQFQALNARAATF

SEQ ID NO: 1502652 - protein, 17 aa, Mycobacterium tuberculosis
VSAEGWHSLSIAYAETA

SEQ ID NO: 1502653 - protein, 23 aa, Mycobacterium tuberculosis
VSATPGWPAPGWSTPAASTPVWQ

SEQ ID NO: 1502654 - protein, 21 aa, Mycobacterium tuberculosis
VSCAIQNLWLAARSEGLGMDG

SEQ ID NO: 1502655 - protein, 22 aa, Mycobacterium tuberculosis
VSCVKPAGALYAFPRLDPEVYD

SEQ ID NO: 1502656 - protein, 17 aa, Mycobacterium tuberculosis
VSDHIRAIVALGGFAWQ

SEQ ID NO: 1502657 - protein, 24 aa, Mycobacterium tuberculosis
VSGRLRKGVAMDFGLQPPEITSGE

SEQ ID NO: 1502658 - protein, 22 aa, Mycobacterium tuberculosis
VSIAVAALFGMHGQAYQALSVQ

SEQ ID NO: 1502659 - protein, 17 aa, Mycobacterium tuberculosis
VSIEAFEHFGHENYDDF

SEQ ID NO: 1502660 - protein, 17 aa, Mycobacterium tuberculosis
VSNLGVFDFGGPDHSMR

SEQ ID NO: 1502661 - protein, 24 aa, Mycobacterium tuberculosis
VSQGRFRFGVGVGWLREEVANHGV

SEQ ID NO: 1502662 - protein, 22 aa, Mycobacterium tuberculosis
VSTQIAALFGAHARSYQTLSTQ

SEQ ID NO: 1502663 - protein, 19 aa, Mycobacterium tuberculosis
VSVAISALFGSHAQGYQTL

SEQ ID NO: 1502664 - protein, 17 aa, Mycobacterium tuberculosis
VSWPNPNDWWLVRLLGS

SEQ ID NO: 1502665 - protein, 22 aa, Mycobacterium tuberculosis
VSWPNPNDWWLVRLLGSITPTE

SEQ ID NO: 1502666 - protein, 17 aa, Mycobacterium tuberculosis
VSYPGSSLWDMVRPRPS

SEQ ID NO: 1502667 - protein, 26 aa, Mycobacterium tuberculosis
VTCGAAPEPWFGRDGGLGGNGGAGGQ

SEQ ID NO: 1502668 - protein, 17 aa, Mycobacterium tuberculosis
VTCGIGFADLSSFTALT

SEQ ID NO: 1502669 - protein, 19 aa, Mycobacterium tuberculosis
VTEHAWRIGVVAQSHATVE

SEQ ID NO: 1502670 - protein, 20 aa, Mycobacterium tuberculosis
VTLGEEFPRLMVYRGPRRKG

SEQ ID NO: 1502671 - protein, 17 aa, Mycobacterium tuberculosis
VTLRPAQYLPWHPGRCA

SEQ ID NO: 1502672 - protein, 23 aa, Mycobacterium tuberculosis
VTMRNRLRLAATHAVRTSADVVR

SEQ ID NO: 1502673 - protein, 20 aa, Mycobacterium tuberculosis
VTNATKLPGLRGWRRPQGEL

SEQ ID NO: 1502674 - protein, 22 aa, Mycobacterium tuberculosis
VVAARLPFGWSADSGVTADIIE

SEQ ID NO: 1502675 - protein, 19 aa, Mycobacterium tuberculosis
VVAGCVFRYIAYHGRSREN

SEQ ID NO: 1502676 - protein, 17 aa, Mycobacterium tuberculosis
VVDVGLIGGRTRQNLAH

SEQ ID NO: 1502677 - protein, 17 aa, Mycobacterium tuberculosis
VVDWLYWQYVTGLLDRA

SEQ ID NO: 1502678 - protein, 19 aa, Mycobacterium tuberculosis
VVFKELRVLGALGVDATAY

SEQ ID NO: 1502679 - protein, 21 aa, Mycobacterium tuberculosis
VVFMPTEPQAATGTAGSAGDP

SEQ ID NO: 1502680 - protein, 19 aa, Mycobacterium tuberculosis
VVGGFQMSFVIAVPETIAA

SEQ ID NO: 1502681 - protein, 18 aa, Mycobacterium tuberculosis
VVHLAPWLEPQPICWAID

SEQ ID NO: 1502682 - protein, 17 aa, Mycobacterium tuberculosis
VVLRATWAVARVLTDRG

SEQ ID NO: 1502683 - protein, 18 aa, Mycobacterium tuberculosis
VVSGRWPFCSGINHADIM

SEQ ID NO: 1502684 - protein, 17 aa, Mycobacterium tuberculosis
VVSLAKRYTGRGMAFLD

SEQ ID NO: 1502685 - protein, 21 aa, Mycobacterium tuberculosis
VVSRARLQLAIAWAKHSAATA

SEQ ID NO: 1502686 - protein, 20 aa, Mycobacterium tuberculosis
VVTGLPVPPPAPTVAQGELA

SEQ ID NO: 1502687 - protein, 18 aa, Mycobacterium tuberculosis
VVVGWGYGRADFIDKTST

SEQ ID NO: 1502688 - protein, 17 aa, Mycobacterium tuberculosis
VWMLWSIVVVQMTAAAP

SEQ ID NO: 1502689 - protein, 17 aa, Mycobacterium tuberculosis
VWSVWGVGVAILLGDAL

SEQ ID NO: 1502690 - protein, 18 aa, Mycobacterium tuberculosis
VWTSQMIVAPAFVDAAAK

SEQ ID NO: 1502691 - protein, 20 aa, Mycobacterium tuberculosis
VWVHPEWRGIGLGTAGTATL

SEQ ID NO: 1502692 - protein, 18 aa, Mycobacterium tuberculosis
VYAVSWCWPGSRRLSAII

SEQ ID NO: 1502693 - protein, 19 aa, Mycobacterium tuberculosis
VYFELRLADAWVWDMYRPA

SEQ ID NO: 1502694 - protein, 19 aa, Mycobacterium tuberculosis
VYPPCSAFEAWFVSAALDD

SEQ ID NO: 1502695 - protein, 21 aa, Mycobacterium tuberculosis
VYVCGPPGMLEAVRVARNQHA

SEQ ID NO: 1502696 - protein, 18 aa, Mycobacterium tuberculosis
WAARAGPRWSYADVLGYF

SEQ ID NO: 1502697 - protein, 25 aa, Mycobacterium tuberculosis
WAARARWANPAAWRLPGDDVFAVRG

SEQ ID NO: 1502698 - protein, 18 aa, Mycobacterium tuberculosis
WADSFGGLVFDATGITEP

SEQ ID NO: 1502699 - protein, 29 aa, Mycobacterium tuberculosis
WALMGMPCGKYLVVMLELWLPLEAAAGDL

SEQ ID NO: 1502700 - protein, 18 aa, Mycobacterium tuberculosis
WAPAVGVGQCSRVSRSAG

SEQ ID NO: 1502701 - protein, 17 aa, Mycobacterium tuberculosis
WAPTTPVATTWAAPTPA

SEQ ID NO: 1502702 - protein, 19 aa, Mycobacterium tuberculosis
WARKCSRPSCPTSPSSPAP

SEQ ID NO: 1502703 - protein, 18 aa, Mycobacterium tuberculosis
WASLPLKLFAGGNAKFWD

SEQ ID NO: 1502704 - protein, 17 aa, Mycobacterium tuberculosis
WASSISGYWRRGRTEEM

SEQ ID NO: 1502705 - protein, 17 aa, Mycobacterium tuberculosis
WATPSRCSPRWAPTSAA

SEQ ID NO: 1502706 - protein, 17 aa, Mycobacterium tuberculosis
WAVGLAFPCQQPMLHAN

SEQ ID NO: 1502707 - protein, 17 aa, Mycobacterium tuberculosis
WAVHIALWRRSSNGQPE

SEQ ID NO: 1502708 - protein, 19 aa, Mycobacterium tuberculosis
WAYAASRPDNVARLILDSP

SEQ ID NO: 1502709 - protein, 19 aa, Mycobacterium tuberculosis
WCGLIAMSEIFCITDHSEP

SEQ ID NO: 1502710 - protein, 20 aa, Mycobacterium tuberculosis
WCGSGLLGALSPRPLGRCSA

SEQ ID NO: 1502711 - protein, 18 aa, Mycobacterium tuberculosis
WCYLACWPATVSTWILRR

SEQ ID NO: 1502712 - protein, 19 aa, Mycobacterium tuberculosis
WDLLPGYLIFRSIIPNRRS

SEQ ID NO: 1502713 - protein, 18 aa, Mycobacterium tuberculosis
WDTDWFWCSRSFGAQNPR

SEQ ID NO: 1502714 - protein, 19 aa, Mycobacterium tuberculosis
WEEVPGCDPAVFTMATVPS

SEQ ID NO: 1502715 - protein, 17 aa, Mycobacterium tuberculosis
WEHPDFWDIWKASLQGV

SEQ ID NO: 1502716 - protein, 20 aa, Mycobacterium tuberculosis
WEPFTRMAFRFNECSTRAVG

SEQ ID NO: 1502717 - protein, 19 aa, Mycobacterium tuberculosis
WFRLHQMFADFLHRRLERG

SEQ ID NO: 1502718 - protein, 17 aa, Mycobacterium tuberculosis
WFWQCRHQQLWLGEHGC

SEQ ID NO: 1502719 - protein, 17 aa, Mycobacterium tuberculosis
WGAGVPAAMGTSTAGQV

SEQ ID NO: 1502720 - protein, 19 aa, Mycobacterium tuberculosis
WGGTPSWECALAGLDQECG

SEQ ID NO: 1502721 - protein, 19 aa, Mycobacterium tuberculosis
WGITIWRARFCLRCSTGVM

SEQ ID NO: 1502722 - protein, 19 aa, Mycobacterium tuberculosis
WGRTVVCARLSSADQKVDL

SEQ ID NO: 1502723 - protein, 17 aa, Mycobacterium tuberculosis
WHHVCSRCGVPGAACKR

SEQ ID NO: 1502724 - protein, 25 aa, Mycobacterium tuberculosis
WHKEYGSACNLVFPIGIIDRPYKHD

SEQ ID NO: 1502725 - protein, 18 aa, Mycobacterium tuberculosis
WHPCRCAQVFVGESSVGH

SEQ ID NO: 1502726 - protein, 18 aa, Mycobacterium tuberculosis
WHSQRGGSAVSHYRSNVR

SEQ ID NO: 1502727 - protein, 17 aa, Mycobacterium tuberculosis
WIGQWGIFDALRPGREV

SEQ ID NO: 1502728 - protein, 17 aa, Mycobacterium tuberculosis
WIPRLATMGVIASYCLT

SEQ ID NO: 1502729 - protein, 24 aa, Mycobacterium tuberculosis
WKSTCPSCMPPVCGRRCSRTGEIR

SEQ ID NO: 1502730 - protein, 17 aa, Mycobacterium tuberculosis
WKTPTRRGTSRPSDSKT

SEQ ID NO: 1502731 - protein, 17 aa, Mycobacterium tuberculosis
WLDVPGHHRALPQRRRA

SEQ ID NO: 1502732 - protein, 17 aa, Mycobacterium tuberculosis
WLEPGQWWALVRVGCAG

SEQ ID NO: 1502733 - protein, 17 aa, Mycobacterium tuberculosis
WLGAHGFGQLLQHTVVV

SEQ ID NO: 1502734 - protein, 17 aa, Mycobacterium tuberculosis
WLGRHGYSVTMVERHPG

SEQ ID NO: 1502735 - protein, 18 aa, Mycobacterium tuberculosis
WLGWPARSRVSACGCAKA

SEQ ID NO: 1502736 - protein, 19 aa, Mycobacterium tuberculosis
WLLNGFKWFASNCAGEAFV

SEQ ID NO: 1502737 - protein, 18 aa, Mycobacterium tuberculosis
WLLRACAKLGVRLVHSTP

SEQ ID NO: 1502738 - protein, 17 aa, Mycobacterium tuberculosis
WLPGPRELRAWTLAAGS

SEQ ID NO: 1502739 - protein, 24 aa, Mycobacterium tuberculosis
WLRARGLKIFRWWAGPSVVVTTRR

SEQ ID NO: 1502740 - protein, 17 aa, Mycobacterium tuberculosis
WLTARLVDLDSGDIETL

SEQ ID NO: 1502741 - protein, 17 aa, Mycobacterium tuberculosis
WLTNLPFLQAMFSGFDP

SEQ ID NO: 1502742 - protein, 17 aa, Mycobacterium tuberculosis
WMCPPARPPKPTWPAKP

SEQ ID NO: 1502743 - protein, 17 aa, Mycobacterium tuberculosis
WNVGWPVRLPWLRRDSP

SEQ ID NO: 1502744 - protein, 19 aa, Mycobacterium tuberculosis
WPAKLRLLDGFPAAGEPEL

SEQ ID NO: 1502745 - protein, 18 aa, Mycobacterium tuberculosis
WPAVGLMAGSRLQAVEPV

SEQ ID NO: 1502746 - protein, 17 aa, Mycobacterium tuberculosis
WPFCSGINHADIMFAGC

SEQ ID NO: 1502747 - protein, 17 aa, Mycobacterium tuberculosis
WPKPLGFVWGLDDPVAT

SEQ ID NO: 1502748 - protein, 19 aa, Mycobacterium tuberculosis
WPLCGWATRRRPGAENLRL

SEQ ID NO: 1502749 - protein, 20 aa, Mycobacterium tuberculosis
WPLICAGALEGLDHLELART

SEQ ID NO: 1502750 - protein, 23 aa, Mycobacterium tuberculosis
WPNLAAELQLAFQQLLVGDYNAA

SEQ ID NO: 1502751 - protein, 19 aa, Mycobacterium tuberculosis
WPNPNDWWLVRLLGSITPT

SEQ ID NO: 1502752 - protein, 19 aa, Mycobacterium tuberculosis
WPPRARTAARALAVTAEPA

SEQ ID NO: 1502753 - protein, 21 aa, Mycobacterium tuberculosis
WPRKAGQPAAWPRWCGDRVWA

SEQ ID NO: 1502754 - protein, 17 aa, Mycobacterium tuberculosis
WPRPVDAYADFDSCQSW

SEQ ID NO: 1502755 - protein, 17 aa, Mycobacterium tuberculosis
WPRRLKAATARCTRSCW

SEQ ID NO: 1502756 - protein, 17 aa, Mycobacterium tuberculosis
WQFHHVIDVAPTILEAA

SEQ ID NO: 1502757 - protein, 17 aa, Mycobacterium tuberculosis
WQIHDWILLTPWGLLSW

SEQ ID NO: 1502758 - protein, 17 aa, Mycobacterium tuberculosis
WQLLDMRLSRAFQCTNF

SEQ ID NO: 1502759 - protein, 23 aa, Mycobacterium tuberculosis
WQQALRGLPGLGQVASAISGGAA

SEQ ID NO: 1502760 - protein, 17 aa, Mycobacterium tuberculosis
WRAQLPIEDSGRVEQQL

SEQ ID NO: 1502761 - protein, 20 aa, Mycobacterium tuberculosis
WRARFCLRCSTGVMTSSAVR

SEQ ID NO: 1502762 - protein, 19 aa, Mycobacterium tuberculosis
WRATLIVRESACLDVEDRR

SEQ ID NO: 1502763 - protein, 19 aa, Mycobacterium tuberculosis
WRGEPLLAYLRKMVFWSMV

SEQ ID NO: 1502764 - protein, 18 aa, Mycobacterium tuberculosis
WRGGDGAVRRLEFTEPMT

SEQ ID NO: 1502765 - protein, 21 aa, Mycobacterium tuberculosis
WRHGLCGYRRFFSITSLAGLR

SEQ ID NO: 1502766 - protein, 19 aa, Mycobacterium tuberculosis
WRIAAKSLRPLPVAHKEMS

SEQ ID NO: 1502767 - protein, 17 aa, Mycobacterium tuberculosis
WRIVTALATAGAIDADG

SEQ ID NO: 1502768 - protein, 19 aa, Mycobacterium tuberculosis
WRKADAALGRPVVSNQVRF

SEQ ID NO: 1502769 - protein, 20 aa, Mycobacterium tuberculosis
WRLLCEQVGAAALVIPEELG

SEQ ID NO: 1502770 - protein, 17 aa, Mycobacterium tuberculosis
WRNGWCRAKRGAIRSST

SEQ ID NO: 1502771 - protein, 18 aa, Mycobacterium tuberculosis
WRPQFRVDLIPSYKAHRV

SEQ ID NO: 1502772 - protein, 18 aa, Mycobacterium tuberculosis
WRQLSWLPQRPVLVPGTV

SEQ ID NO: 1502773 - protein, 18 aa, Mycobacterium tuberculosis
WRQRWPTAACGTATVAPA

SEQ ID NO: 1502774 - protein, 19 aa, Mycobacterium tuberculosis
WRRGDEVFAEVALPADAGV

SEQ ID NO: 1502775 - protein, 21 aa, Mycobacterium tuberculosis
WRRGWRRWADWPTRGRRRPRC

SEQ ID NO: 1502776 - protein, 22 aa, Mycobacterium tuberculosis
WRRLLWPALYFYLCVHRSLYWS

SEQ ID NO: 1502777 - protein, 18 aa, Mycobacterium tuberculosis
WRRQSALVQWYVETSGSP

SEQ ID NO: 1502778 - protein, 20 aa, Mycobacterium tuberculosis
WRRWAGGAGGAFLGDGGNGG

SEQ ID NO: 1502779 - protein, 24 aa, Mycobacterium tuberculosis
WRSPTWPGCRLRCTPTLSMRPDSS

SEQ ID NO: 1502780 - protein, 19 aa, Mycobacterium tuberculosis
WRTELPLRYLESVITQLSQ

SEQ ID NO: 1502781 - protein, 17 aa, Mycobacterium tuberculosis
WRTFGQERLDAMASVAT

SEQ ID NO: 1502782 - protein, 19 aa, Mycobacterium tuberculosis
WSPKVFGSWNLHRATLGQP

SEQ ID NO: 1502783 - protein, 17 aa, Mycobacterium tuberculosis
WSRCWVRVWGSLRSTRP

SEQ ID NO: 1502784 - protein, 20 aa, Mycobacterium tuberculosis
WSTRCWSRPRVSSIASPTPG

SEQ ID NO: 1502785 - protein, 17 aa, Mycobacterium tuberculosis
WTALWLSQAWQQRVLEE

SEQ ID NO: 1502786 - protein, 21 aa, Mycobacterium tuberculosis
WTIPEDIEWTGPMAARLWVQL

SEQ ID NO: 1502787 - protein, 19 aa, Mycobacterium tuberculosis
WTLRPRRRICLPVGEDDAV

SEQ ID NO: 1502788 - protein, 18 aa, Mycobacterium tuberculosis
WTNNFAILAGGYRFATAS

SEQ ID NO: 1502789 - protein, 17 aa, Mycobacterium tuberculosis
WTPLAPVVEPPTPPTPA

SEQ ID NO: 1502790 - protein, 17 aa, Mycobacterium tuberculosis
WTVLRATRRTDYLILEM

SEQ ID NO: 1502791 - protein, 17 aa, Mycobacterium tuberculosis
WTWCARTSPPCWVAPAP

SEQ ID NO: 1502792 - protein, 17 aa, Mycobacterium tuberculosis
WVLAITMPYSDAAQRGA

SEQ ID NO: 1502793 - protein, 22 aa, Mycobacterium tuberculosis
WWPDHCRWPSSSACSLGRSPST

SEQ ID NO: 1502794 - protein, 18 aa, Mycobacterium tuberculosis
WWQRAVAVWPDYASYQTK

SEQ ID NO: 1502795 - protein, 17 aa, Mycobacterium tuberculosis
WWSAVVGGFQMSFVIAV

SEQ ID NO: 1502796 - protein, 17 aa, Mycobacterium tuberculosis
YAAEMAHIIGCEPAEVL

SEQ ID NO: 1502797 - protein, 22 aa, Mycobacterium tuberculosis
YAGNGRTAGLFGHGGAGGAGGI

SEQ ID NO: 1502798 - protein, 18 aa, Mycobacterium tuberculosis
YAMTGWRLGWLLVPTVLR

SEQ ID NO: 1502799 - protein, 18 aa, Mycobacterium tuberculosis
YATACGMTGTALAAGEQL

SEQ ID NO: 1502800 - protein, 20 aa, Mycobacterium tuberculosis
YDESLWRLLCEQVGAAALVI

SEQ ID NO: 1502801 - protein, 18 aa, Mycobacterium tuberculosis
YDRAWWFARFVAAAYGTA

SEQ ID NO: 1502802 - protein, 24 aa, Mycobacterium tuberculosis
YEQMWPADVAAMVGYHGGASAAAA

SEQ ID NO: 1502803 - protein, 17 aa, Mycobacterium tuberculosis
YFPGRWGARIEDIVIVT

SEQ ID NO: 1502804 - protein, 20 aa, Mycobacterium tuberculosis
YGDFFAFYLCDVVLKVNGKG

SEQ ID NO: 1502805 - protein, 29 aa, Mycobacterium tuberculosis
YGGAGGAGGCLWGNGRSGGNGGVGVAGDP

SEQ ID NO: 1502806 - protein, 22 aa, Mycobacterium tuberculosis
YGLAGLRIGYAIGHPDVITALD

SEQ ID NO: 1502807 - protein, 24 aa, Mycobacterium tuberculosis
YGSILCAAHCARFYGGESLKGTDG

SEQ ID NO: 1502808 - protein, 17 aa, Mycobacterium tuberculosis
YGWCPRPDWVRVVPDVL

SEQ ID NO: 1502809 - protein, 18 aa, Mycobacterium tuberculosis
YHPPMRTFLGVPVRVRDE

SEQ ID NO: 1502810 - protein, 20 aa, Mycobacterium tuberculosis
YIPFKGCVKHVSVTIPITTE

SEQ ID NO: 1502811 - protein, 17 aa, Mycobacterium tuberculosis
YKEFYKHVAHAWDDPLE

SEQ ID NO: 1502812 - protein, 19 aa, Mycobacterium tuberculosis
YKEFYKHVAHAWDDPLEII

SEQ ID NO: 1502813 - protein, 20 aa, Mycobacterium tuberculosis
YLATVITWHRHIAGLIEQAK

SEQ ID NO: 1502814 - protein, 31 aa, Mycobacterium tuberculosis
YLAYRPVCRPAWLPTLRRPWRRSPERPSSWY

SEQ ID NO: 1502815 - protein, 17 aa, Mycobacterium tuberculosis
YLGAWGIVDCFERGADV

SEQ ID NO: 1502816 - protein, 17 aa, Mycobacterium tuberculosis
YLIRGVIGPDEFHSGYP

SEQ ID NO: 1502817 - protein, 17 aa, Mycobacterium tuberculosis
YLRSRLTGIAGEGNKEI

SEQ ID NO: 1502818 - protein, 18 aa, Mycobacterium tuberculosis
YMAGARLDSLVPLGPPVM

SEQ ID NO: 1502819 - protein, 17 aa, Mycobacterium tuberculosis
YPAMVHRTLMDIIEECE

SEQ ID NO: 1502820 - protein, 23 aa, Mycobacterium tuberculosis
YPAWRELFTDILPAHIVKDIPGG

SEQ ID NO: 1502821 - protein, 18 aa, Mycobacterium tuberculosis
YPGARCFLVNNGDITEDL

SEQ ID NO: 1502822 - protein, 17 aa, Mycobacterium tuberculosis
YPGRFLLGIGVGHAEMI

SEQ ID NO: 1502823 - protein, 21 aa, Mycobacterium tuberculosis
YPGRFLLGIGVGHAKMISEYR

SEQ ID NO: 1502824 - protein, 18 aa, Mycobacterium tuberculosis
YPLDRLKAIGAQYDATIN

SEQ ID NO: 1502825 - protein, 18 aa, Mycobacterium tuberculosis
YPLVVAWPARIRPDGRVR

SEQ ID NO: 1502826 - protein, 17 aa, Mycobacterium tuberculosis
YPVKASVSFGLYYPPGS

SEQ ID NO: 1502827 - protein, 19 aa, Mycobacterium tuberculosis
YQQRFVLALSQAGSTYAVA

SEQ ID NO: 1502828 - protein, 17 aa, Mycobacterium tuberculosis
YQYRPEPPFVLGAEIAG

SEQ ID NO: 1502829 - protein, 19 aa, Mycobacterium tuberculosis
YRAPLSYPYRDGLLDKQLA

SEQ ID NO: 1502830 - protein, 17 aa, Mycobacterium tuberculosis
YRGGPVLADNAVIPVER

SEQ ID NO: 1502831 - protein, 17 aa, Mycobacterium tuberculosis
YRGVGQGSLQFAITSPD

SEQ ID NO: 1502832 - protein, 17 aa, Mycobacterium tuberculosis
YRGVGQGSLQFSITTPD

SEQ ID NO: 1502833 - protein, 25 aa, Mycobacterium tuberculosis
YRIIGRAGGIYGDFFNFYLCDISLK

SEQ ID NO: 1502834 - protein, 17 aa, Mycobacterium tuberculosis
YRIPTPIPRIGYAEAMR

SEQ ID NO: 1502835 - protein, 18 aa, Mycobacterium tuberculosis
YRIRRAAGALGELPYHGS

SEQ ID NO: 1502836 - protein, 21 aa, Mycobacterium tuberculosis
YRLAVDPERGGRCRRWCRTAA

SEQ ID NO: 1502837 - protein, 17 aa, Mycobacterium tuberculosis
YRLNWPAGTVVYEIDQP

SEQ ID NO: 1502838 - protein, 23 aa, Mycobacterium tuberculosis
YRPQFYFPHHRRVRCGDTCRGGR

SEQ ID NO: 1502839 - protein, 18 aa, Mycobacterium tuberculosis
YRQLRYFWSRVIADTGWQ

SEQ ID NO: 1502840 - protein, 22 aa, Mycobacterium tuberculosis
YRRAAHLGRCWSRRGRDRRRLD

SEQ ID NO: 1502841 - protein, 19 aa, Mycobacterium tuberculosis
YRRAEICRERLGPVLRRLT

SEQ ID NO: 1502842 - protein, 24 aa, Mycobacterium tuberculosis
YRRTLRFPWGNGIVSLTPAPDHVR

SEQ ID NO: 1502843 - protein, 17 aa, Mycobacterium tuberculosis
YRWAEADRHLWIADERG

SEQ ID NO: 1502844 - protein, 18 aa, Mycobacterium tuberculosis
YRWFRAGLLSVMARRVGR

SEQ ID NO: 1502845 - protein, 20 aa, Mycobacterium tuberculosis
YRWQQCPHRHSLAGGDERAG

SEQ ID NO: 1502846 - protein, 17 aa, Mycobacterium tuberculosis
YSAWTWLASLPAVDPAR

SEQ ID NO: 1502847 - protein, 23 aa, Mycobacterium tuberculosis
YSDGRYSYQLSIYVIRVEQGTAV

SEQ ID NO: 1502848 - protein, 20 aa, Mycobacterium tuberculosis
YSLRQQRWWCLQPWRHTHRI

SEQ ID NO: 1502849 - protein, 25 aa, Mycobacterium tuberculosis
YSNGILWRGDYQGLIGYSYALTIPE

SEQ ID NO: 1502850 - protein, 27 aa, Mycobacterium tuberculosis
YSNGILWRGDYQGLIGYSYALTIPEIP

SEQ ID NO: 1502851 - protein, 17 aa, Mycobacterium tuberculosis
YTGRGMAFLDLIQEGLP

SEQ ID NO: 1502852 - protein, 23 aa, Mycobacterium tuberculosis
YTPEQWWPFIGNLSLDQSIAQGV

SEQ ID NO: 1502853 - protein, 18 aa, Mycobacterium tuberculosis
YWQCWKLDSPIIARITDT

SEQ ID NO: 1502854 - protein, 23 aa, Mycobacterium tuberculosis
YWSRRWLGPRIRPYARRGGRQRR

SEQ ID NO: 1502855 - protein, 20 aa, Mycobacterium tuberculosis
YWYRSIRQPVQFERAVRNAF

SEQ ID NO: 1502856 - protein, 17 aa, Mycobacterium tuberculosis
YWYVYEHNLWPSREDAL

SEQ ID NO: 1502857 - protein, 20 aa, Mycobacterium tuberculosis
YYARVCVDLLKPRKAQPLLP

SEQ ID NO: 1502858 - protein, 23 aa, Mycobacterium tuberculosis
YYARVCVDLLKPRKAQPLLPGIG

SEQ ID NO: 1502859 - protein, 20 aa, Mycobacterium tuberculosis
YYQRFGFRVTREIALPDAGP

SEQ ID NO: 1502860 - protein, 24 aa, Mycobacterium tuberculosis
TDAYARRILGWRVASTMATSMVLD

SEQ ID NO: 1502861 - protein, 27 aa, Mycobacterium tuberculosis
TYVSTWAGFAYVAFVTDAYARRILGWR

SEQ ID NO: 1502862 - protein, 18 aa, Mycobacterium tuberculosis
APNRLWVADLTYVSTWAG

SEQ ID NO: 1502863 - protein, 25 aa, Mycobacterium tuberculosis
PADLVQRRFGPPAPNRLWVADLTYV

SEQ ID NO: 1502864 - protein, 17 aa, Mycobacterium tuberculosis
WVDWFNHRRLYQYCGDV

SEQ ID NO: 1502865 - protein, 26 aa, Mycobacterium tuberculosis
RQGSYFPDWLLQRRKRAERALTSVVA

SEQ ID NO: 1502866 - protein, 24 aa, Mycobacterium tuberculosis
EDGAGWLAFFRDLVARGLSGVALV

SEQ ID NO: 1502867 - protein, 19 aa, Mycobacterium tuberculosis
VGIFPDRASIIRLVGAVLA

SEQ ID NO: 1502868 - protein, 18 aa, Mycobacterium tuberculosis
LLSTFIAALMGAEADALC

SEQ ID NO: 1502869 - protein, 24 aa, Mycobacterium tuberculosis
TPKPSWPWVRTLLHSIYDQPDAES

SEQ ID NO: 1502870 - protein, 22 aa, Mycobacterium tuberculosis
RPLDAGPYTFLAADALVLKVRE

SEQ ID NO: 1502871 - protein, 21 aa, Mycobacterium tuberculosis
ATLPAAAWQRCRTHYAANLMA

SEQ ID NO: 1502872 - protein, 28 aa, Mycobacterium tuberculosis
ARTDLLAFTAFPKKIWRQIWSNNPQERL

SEQ ID NO: 1502873 - protein, 30 aa, Mycobacterium tuberculosis; identical to SEQ ID NO: 114408

SEQ ID NO: 1502874 - protein, 17 aa, Mycobacterium tuberculosis
DDPFTVPNLVWASFLRL

SEQ ID NO: 1502875 - protein, 38 aa, Mycobacterium tuberculosis; identical to SEQ ID NO: 217447

SEQ ID NO: 1502876 - protein, 31 aa, Mycobacterium tuberculosis; identical to SEQ ID NO: 221384

SEQ ID NO: 1502877 - protein, 25 aa, Mycobacterium tuberculosis
RRFSDHRLILEGIAWRFRTGSPWRD

SEQ ID NO: 1502878 - protein, 22 aa, Mycobacterium tuberculosis
AKPLALYHTKRLASPAQRIMLY

SEQ ID NO: 1502879 - protein, 22 aa, Mycobacterium tuberculosis
ARYAQRVMDWLHPDGDLTDTER

SEQ ID NO: 1502880 - protein, 33 aa, Mycobacterium tuberculosis; identical to SEQ ID NO: 215201

SEQ ID NO: 1502881 - protein, 25 aa, Mycobacterium tuberculosis
RSVFEHRAVVVGGDRDRLLAGLDEL

SEQ ID NO: 1502882 - protein, 22 aa, Mycobacterium tuberculosis
GATLPAAAWQRCRTHYAANLMA

SEQ ID NO: 1502883 - protein, 24 aa, Mycobacterium tuberculosis
VVPRREAGWAGPVVPWVVSAKSES

SEQ ID NO: 1502884 - protein, 21 aa, Mycobacterium tuberculosis
SAACQGFITQLGRNFQVIYEQ

SEQ ID NO: 1502885 - protein, 31 aa, Mycobacterium tuberculosis; identical to SEQ ID NO: 215325

SEQ ID NO: 1502886 - protein, 27 aa, Mycobacterium tuberculosis
ARTDLLAFTAFPKQIWRQIWSNNPQER

SEQ ID NO: 1502887 - protein, 25 aa, Mycobacterium tuberculosis
HLVKTFWGWRDQQLPDGTLILTSPS

SEQ ID NO: 1502888 - protein, 24 aa, Mycobacterium tuberculosis
HGLATQLMDWLHPDGNFSDQERAR

SEQ ID NO: 1502889 - protein, 19 aa, Mycobacterium tuberculosis
LVLQRLSDARRLGHPVLAV

SEQ ID NO: 1502890 - protein, 22 aa, Mycobacterium tuberculosis
ERSSHTWFVLRELLGHQNVKNY

SEQ ID NO: 1502891 - protein, 17 aa, Mycobacterium tuberculosis
GRYPQAIFDHGTPLALY

SEQ ID NO: 1502892 - protein, 20 aa, Mycobacterium tuberculosis
HGHTEWLPPPHLDHGQPRTN

SEQ ID NO: 1502893 - protein, 26 aa, Mycobacterium tuberculosis
KRFEVAAHEFLLFPTVAHSHAERVRP

SEQ ID NO: 1502894 - protein, 17 aa, Mycobacterium tuberculosis
RPLPVTTFDVRCAPAAL

SEQ ID NO: 1502895 - protein, 20 aa, Mycobacterium tuberculosis
YCRTHHLVKTFWGWRDQQLP

SEQ ID NO: 1502896 - protein, 17 aa, Mycobacterium tuberculosis
SFLDALAAHRRAHGLPA

SEQ ID NO: 1502897 - protein, 29 aa, Mycobacterium tuberculosis
AAAAMVVAAAPYAGWLAAAAARAGGAAVQ

SEQ ID NO: 1502898 - protein, 22 aa, Mycobacterium tuberculosis
TGERADWWWYEPFQPQPPPISN

SEQ ID NO: 1502899 - protein, 26 aa, Mycobacterium tuberculosis
VAETLTPFSVPPLDLAGLASQAGAQL

SEQ ID NO: 1502900 - protein, 20 aa, Mycobacterium tuberculosis
SAFVQLVLSNVFGQNAPAIA

SEQ ID NO: 1502901 - protein, 20 aa, Mycobacterium tuberculosis
ALAAHRRAHGLPAISLGWGL

SEQ ID NO: 1502902 - protein, 23 aa, Mycobacterium tuberculosis
GSAACQGFITQLGRNFQVIYEQA

SEQ ID NO: 1502903 - protein, 24 aa, Mycobacterium tuberculosis
TDPRLYRAYLLKESLRHVFSVKGE

SEQ ID NO: 1502904 - protein, 25 aa, Mycobacterium tuberculosis
AMAGAAAPYVGWLSAAAGQAELSAG

SEQ ID NO: 1502905 - protein, 27 aa, Mycobacterium tuberculosis
EHQAIVRDVLAAGDFWGGAGSVACQEF

SEQ ID NO: 1502906 - protein, 18 aa, Mycobacterium tuberculosis
FTVFPDGYSLPAIPLGID

SEQ ID NO: 1502907 - protein, 32 aa, Mycobacterium tuberculosis; identical to SEQ ID NO: 219676

SEQ ID NO: 1502908 - protein, 17 aa, Mycobacterium tuberculosis
NTKIRLLTRIAFGFRSP

SEQ ID NO: 1502909 - protein, 24 aa, Mycobacterium tuberculosis
PMTARFLSVVLRRIRGMRSDTREE

SEQ ID NO: 1502910 - protein, 18 aa, Mycobacterium tuberculosis
QRCRIPVFVELAARIKRH

SEQ ID NO: 1502911 - protein, 22 aa, Mycobacterium tuberculosis
TPAIAATEFDYVEMWAQDVGAM

SEQ ID NO: 1502912 - protein, 18 aa, Mycobacterium tuberculosis
YPASMLIGPMMQLAQMGT

SEQ ID NO: 1502913 - protein, 25 aa, Mycobacterium tuberculosis
EDGAGWLAFFRDLVARGLSGVALVT

SEQ ID NO: 1502914 - protein, 25 aa, Mycobacterium tuberculosis
IYAGAGSGPLFMAAAAWEGLAADLR

SEQ ID NO: 1502915 - protein, 21 aa, Mycobacterium tuberculosis
NKRHAYFRSISKTPHIRARGV

SEQ ID NO: 1502916 - protein, 25 aa, Mycobacterium tuberculosis
RTRPLDAGPYTFLAADALVLKVREA

SEQ ID NO: 1502917 - protein, 23 aa, Mycobacterium tuberculosis
VIKMVLAMRHELLPATLHVDVPS

SEQ ID NO: 1502918 - protein, 27 aa, Mycobacterium tuberculosis
VSWPNPNDWWLVRLLGSITPTERTTIV

SEQ ID NO: 1502919 - protein, 24 aa, Mycobacterium tuberculosis
ANRELKHLLINDLPIERQAQDVSW

SEQ ID NO: 1502920 - protein, 25 aa, Mycobacterium tuberculosis
ASGAAEWFAGRLPEDWFDGDPTVIV

SEQ ID NO: 1502921 - protein, 23 aa, Mycobacterium tuberculosis
ATEALLPFEDAPLITNPGGLLEQ

SEQ ID NO: 1502922 - protein, 25 aa, Mycobacterium tuberculosis
DAEVRAIWNLPPRPRTRPPSDGSSL

SEQ ID NO: 1502923 - protein, 24 aa, Mycobacterium tuberculosis
DQVVAHILNLLLTGKLRSGDRVDR

SEQ ID NO: 1502924 - protein, 19 aa, Mycobacterium tuberculosis
DREVLFCPDQFLGAHVRRV

SEQ ID NO: 1502925 - protein, 21 aa, Mycobacterium tuberculosis
EADIYLALYGSWKDPADEAKY

SEQ ID NO: 1502926 - protein, 24 aa, Mycobacterium tuberculosis
EMRSRFWMGGPHIAVRKAPEVASK

SEQ ID NO: 1502927 - protein, 24 aa, Mycobacterium tuberculosis
ENVATIAWVGYQPPPVLASWNTVD

SEQ ID NO: 1502928 - protein, 24 aa, Mycobacterium tuberculosis
ERTTLWHSTFAQCSMLGSVFVACR

SEQ ID NO: 1502929 - protein, 26 aa, Mycobacterium tuberculosis
FQQRVWKALLTIPYGETRSYGEIADQ

SEQ ID NO: 1502930 - protein, 20 aa, Mycobacterium tuberculosis
GIRRFGDAFIPMDETLAHAA

SEQ ID NO: 1502931 - protein, 41 aa, Mycobacterium tuberculosis; identical to SEQ ID NO: 218760

SEQ ID NO: 1502932 - protein, 17 aa, Mycobacterium tuberculosis
HPRAHLSARWKDGDQDS

SEQ ID NO: 1502933 - protein, 20 aa, Mycobacterium tuberculosis
IALAFPRGPFVPAAAAWELQ

SEQ ID NO: 1502934 - protein, 24 aa, Mycobacterium tuberculosis
KQERLAALDHSRGSWRGRDFTGTE

SEQ ID NO: 1502935 - protein, 24 aa, Mycobacterium tuberculosis
KVRPGVPVIFLDTGYHFVETIGTR

SEQ ID NO: 1502936 - protein, 22 aa, Mycobacterium tuberculosis
MLAELFRRRVLVPPEGACPGPF

SEQ ID NO: 1502937 - protein, 23 aa, Mycobacterium tuberculosis
NGHNPIAIIVPCHRVIGASGKLT

SEQ ID NO: 1502938 - protein, 28 aa, Mycobacterium tuberculosis
PDKGRVLTAMSAFFFGLVDAPNHLAGPP

SEQ ID NO: 1502939 - protein, 24 aa, Mycobacterium tuberculosis
PNIQQRTYYLPSEGRRIRLRVSTK

SEQ ID NO: 1502940 - protein, 20 aa, Mycobacterium tuberculosis
QALGDKRGIRRFGDAFIPMD

SEQ ID NO: 1502941 - protein, 19 aa, Mycobacterium tuberculosis
QLRGSPLYTLRTKGKADLL

SEQ ID NO: 1502942 - protein, 25 aa, Mycobacterium tuberculosis
RASQNLIPRVFWMTYQNSRDDVLPF

SEQ ID NO: 1502943 - protein, 17 aa, Mycobacterium tuberculosis
RGLNLTGCRLRETSLVD

SEQ ID NO: 1502944 - protein, 21 aa, Mycobacterium tuberculosis
RHTGKVVMLMPGSWAAGTVLI

SEQ ID NO: 1502945 - protein, 19 aa, Mycobacterium tuberculosis
RIALHVRVLYGRDPHHITE

SEQ ID NO: 1502946 - protein, 18 aa, Mycobacterium tuberculosis
RRSFIRRVGISPDQYRKA

SEQ ID NO: 1502947 - protein, 17 aa, Mycobacterium tuberculosis
RTEFALLEMLIANPRRV

SEQ ID NO: 1502948 - protein, 19 aa, Mycobacterium tuberculosis
SALYLAGEGAFPAERVKIL

SEQ ID NO: 1502949 - protein, 31 aa, Mycobacterium tuberculosis; identical to SEQ ID NO: 222878

SEQ ID NO: 1502950 - protein, 37 aa, Mycobacterium tuberculosis; identical to SEQ ID NO: 223427

SEQ ID NO: 1502951 - protein, 23 aa, Mycobacterium tuberculosis
TKTLRFYENSGLLPPPARTASGY

SEQ ID NO: 1502952 - protein, 19 aa, Mycobacterium tuberculosis
VEASRFATPLFTPATKAAL

SEQ ID NO: 1502953 - protein, 25 aa, Mycobacterium tuberculosis
VFVACRLRPLTLDDVDFTLAVLGGN

SEQ ID NO: 1502954 - protein, 17 aa, Mycobacterium tuberculosis
VGAMSVPPTWEGSVPAR

SEQ ID NO: 1502955 - protein, 24 aa, Mycobacterium tuberculosis
VGGERILFTHIAVPVMTRLKQPER

SEQ ID NO: 1502956 - protein, 17 aa, Mycobacterium tuberculosis
VRVLYGRDPHHITEAQY

SEQ ID NO: 1502957 - protein, 27 aa, Mycobacterium tuberculosis
AAAGASGFYAKWLPKLVFGEGQLPTTY

SEQ ID NO: 1502958 - protein, 18 aa, Mycobacterium tuberculosis
AAALAFYERTRSGHHIGP

SEQ ID NO: 1502959 - protein, 21 aa, Mycobacterium tuberculosis
AAAPPRFDGLRALFINATLKR

SEQ ID NO: 1502960 - protein, 25 aa, Mycobacterium tuberculosis
AAARPLAIPVIVLAGQVSLDKSALR

SEQ ID NO: 1502961 - protein, 22 aa, Mycobacterium tuberculosis
AACWDARRWLGRPGLDDRASAD

SEQ ID NO: 1502962 - protein, 18 aa, Mycobacterium tuberculosis
AAFGMLPVGYYDLRTAES

SEQ ID NO: 1502963 - protein, 30 aa, Mycobacterium tuberculosis; identical to SEQ ID NO: 215492

SEQ ID NO: 1502964 - protein, 21 aa, Mycobacterium tuberculosis
AAGVNPRRYLAELRLDDSDAA

SEQ ID NO: 1502965 - protein, 25 aa, Mycobacterium tuberculosis
AAIEELIDAVKFTPALTGPHARLGG

SEQ ID NO: 1502966 - protein, 19 aa, Mycobacterium tuberculosis
AALDRFGPPAGDPAWVVKD

SEQ ID NO: 1502967 - protein, 17 aa, Mycobacterium tuberculosis
AALPKLPSFSLTSTSIT

SEQ ID NO: 1502968 - protein, 32 aa, Mycobacterium tuberculosis; identical to SEQ ID NO: 215532

SEQ ID NO: 1502969 - protein, 19 aa, Mycobacterium tuberculosis
AAPNFAFELAVRKTTDADI

SEQ ID NO: 1502970 - protein, 18 aa, Mycobacterium tuberculosis
AAPSLDIGIPWRQYLRVQ

SEQ ID NO: 1502971 - protein, 30 aa, Mycobacterium tuberculosis; identical to SEQ ID NO: 215559

SEQ ID NO: 1502972 - protein, 23 aa, Mycobacterium tuberculosis
AASDAFFPFPDGLETLAAAGVTA

SEQ ID NO: 1502973 - protein, 25 aa, Mycobacterium tuberculosis
AATPRIARRRLFDARLALTLRHHGV

SEQ ID NO: 1502974 - protein, 18 aa, Mycobacterium tuberculosis
AATVPPPLIAANRASLMQ

SEQ ID NO: 1502975 - protein, 28 aa, Mycobacterium tuberculosis
AAVAGYALGGGCELAMMCDVLIAADTAK

SEQ ID NO: 1502976 - protein, 20 aa, Mycobacterium tuberculosis
AAVRELLYAIGEDPDRDGLV

SEQ ID NO: 1502977 - protein, 18 aa, Mycobacterium tuberculosis
AAVVPPPQIAANRSQLIS

SEQ ID NO: 1502978 - protein, 31 aa, Mycobacterium tuberculosis; identical to SEQ ID NO: 215606

SEQ ID NO: 1502979 - protein, 23 aa, Mycobacterium tuberculosis
AAYESFLQFRPWGFDLAEVAVPT

SEQ ID NO: 1502980 - protein, 26 aa, Mycobacterium tuberculosis
AAYQYVRDFLSFLPSNCFDKPPVVNP

SEQ ID NO: 1502981 - protein, 27 aa, Mycobacterium tuberculosis
ACPSTWPWNLLGWPSINVPAGFTSDGL

SEQ ID NO: 1502982 - protein, 28 aa, Mycobacterium tuberculosis
ACQIAGITYRQLDYWARTSLVVPSIRSA

SEQ ID NO: 1502983 - protein, 24 aa, Mycobacterium tuberculosis
ACVEFVFGPLLNNPHRLGKPLRND

SEQ ID NO: 1502984 - protein, 23 aa, Mycobacterium tuberculosis
ADAELFIVGAQLGGKPALFIVES

SEQ ID NO: 1502985 - protein, 23 aa, Mycobacterium tuberculosis
ADALLVDLDPWAGGIDLLVGGET

SEQ ID NO: 1502986 - protein, 27 aa, Mycobacterium tuberculosis
ADDDQFMTLAKMRALRQLWARVAEVVG

SEQ ID NO: 1502987 - protein, 24 aa, Mycobacterium tuberculosis
ADEDSLQLLGWTEATATPQVDAAL

SEQ ID NO: 1502988 - protein, 27 aa, Mycobacterium tuberculosis
ADEERVVWLADPLIAEDLPDGLPEALN

SEQ ID NO: 1502989 - protein, 23 aa, Mycobacterium tuberculosis
ADEFHPELQFDKPYLLAMANAGP

SEQ ID NO: 1502990 - protein, 26 aa, Mycobacterium tuberculosis
ADGGGLVIGFLPRGTPWADLYALRAA

SEQ ID NO: 1502991 - protein, 25 aa, Mycobacterium tuberculosis
ADGPPAWLRFFGCNPRHHSLAFLPM

SEQ ID NO: 1502992 - protein, 27 aa, Mycobacterium tuberculosis
ADGTKAGFDLALLRAVRAAVTVPVIAS

SEQ ID NO: 1502993 - protein, 20 aa, Mycobacterium tuberculosis
ADLRTDWPTPLTAAGFDPQR

SEQ ID NO: 1502994 - protein, 17 aa, Mycobacterium tuberculosis
ADLVSCMVALPTQLFRS

SEQ ID NO: 1502995 - protein, 22 aa, Mycobacterium tuberculosis
ADNPALLGDLPDIGIDTTELIG

SEQ ID NO: 1502996 - protein, 25 aa, Mycobacterium tuberculosis
ADPATLTDLVFAWRACRAVKSNAIV

SEQ ID NO: 1502997 - protein, 24 aa, Mycobacterium tuberculosis
ADQLLIVVALADPPPRTGLVDRAL

SEQ ID NO: 1502998 - protein, 20 aa, Mycobacterium tuberculosis
ADQLSRGPLLSGMFGTFPVA

SEQ ID NO: 1502999 - protein, 22 aa, Mycobacterium tuberculosis
ADRAENLRRLSHVATLLADCGH

SEQ ID NO: 1503000 - protein, 21 aa, Mycobacterium tuberculosis
ADRFAECPTFPAPPPREILDA

SEQ ID NO: 1503001 - protein, 31 aa, Mycobacterium tuberculosis; identical to SEQ ID NO: 215670

SEQ ID NO: 1503002 - protein, 31 aa, Mycobacterium tuberculosis; identical to SEQ ID NO: 215676

SEQ ID NO: 1503003 - protein, 28 aa, Mycobacterium tuberculosis
ADVLFSRYETLLAAGARLFRAQGYPAVN

SEQ ID NO: 1503004 - protein, 23 aa, Mycobacterium tuberculosis
ADVMPLDWYLHVRHAVHGDIAML

SEQ ID NO: 1503005 - protein, 25 aa, Mycobacterium tuberculosis
ADVVRTRIYVTDISRWREVGEVHAQ

SEQ ID NO: 1503006 - protein, 19 aa, Mycobacterium tuberculosis
ADWYSLGLRLIPHLDRRSA

SEQ ID NO: 1503007 - protein, 37 aa, Mycobacterium tuberculosis; identical to SEQ ID NO: 215689

SEQ ID NO: 1503008 - protein, 37 aa, Mycobacterium tuberculosis; identical to SEQ ID NO: 215693

SEQ ID NO: 1503009 - protein, 25 aa, Mycobacterium tuberculosis
AEAGFVIVAIPPAHRVAIEFDPPLP

SEQ ID NO: 1503010 - protein, 26 aa, Mycobacterium tuberculosis
AEALVNLVRRLATPAWLSYTINGTRT

SEQ ID NO: 1503011 - protein, 26 aa, Mycobacterium tuberculosis
AEAPARAYNPLFIWGESGLGKTHLLH

SEQ ID NO: 1503012 - protein, 29 aa, Mycobacterium tuberculosis
AEDWDLDALWTALKTLYPVGITADSLTRK

SEQ ID NO: 1503013 - protein, 24 aa, Mycobacterium tuberculosis
AEGHATKLLNLRSTLLTLAGGDPM

SEQ ID NO: 1503014 - protein, 22 aa, Mycobacterium tuberculosis
AELAIRFRDKGVVGFDIAGAEA

SEQ ID NO: 1503015 - protein, 25 aa, Mycobacterium tuberculosis
AELARWIAEPLSPTRPGRGSALTDS

SEQ ID NO: 1503016 - protein, 47 aa, Mycobacterium tuberculosis; identical to SEQ ID NO: 215733

SEQ ID NO: 1503017 - protein, 20 aa, Mycobacterium tuberculosis
AELLDVVLAIVRDQPVQPVA

SEQ ID NO: 1503018 - protein, 33 aa, Mycobacterium tuberculosis; identical to SEQ ID NO: 215740

SEQ ID NO: 1503019 - protein, 23 aa, Mycobacterium tuberculosis
AELWSTFMQKWIAYTAAVIDAER

SEQ ID NO: 1503020 - protein, 19 aa, Mycobacterium tuberculosis
AEMVELIEKMLACGAAYVI

SEQ ID NO: 1503021 - protein, 21 aa, Mycobacterium tuberculosis
AEQMKMFLTRLGFGSKVVVTG

SEQ ID NO: 1503022 - protein, 25 aa, Mycobacterium tuberculosis
AEQSRPLWYLMPDGVVQYVSKCRLY

SEQ ID NO: 1503023 - protein, 29 aa, Mycobacterium tuberculosis
AERALRARFRPILRPQFTLGDGANGLPLA

SEQ ID NO: 1503024 - protein, 24 aa, Mycobacterium tuberculosis
AESDLVDKYLITPAVDVLAGLAES

SEQ ID NO: 1503025 - protein, 18 aa, Mycobacterium tuberculosis
AEWMNRPHLAAAWEYDWP

SEQ ID NO: 1503026 - protein, 26 aa, Mycobacterium tuberculosis
AFDVRSGIIPISRWQYGIVATEHGCR

SEQ ID NO: 1503027 - protein, 29 aa, Mycobacterium tuberculosis
AFPDALLTRGRYQYRPEPPFVLGAEIAGV

SEQ ID NO: 1503028 - protein, 25 aa, Mycobacterium tuberculosis
AFQRIKEPFSRWASLLIHAGEPGAG

SEQ ID NO: 1503029 - protein, 27 aa, Mycobacterium tuberculosis
AGAAEALRWAMMRGEPLVVLADALAEA

SEQ ID NO: 1503030 - protein, 34 aa, Mycobacterium tuberculosis; identical to SEQ ID NO: 215809

SEQ ID NO: 1503031 - protein, 25 aa, Mycobacterium tuberculosis
AGARDFQRFLIGKLKDIREVVATAS

SEQ ID NO: 1503032 - protein, 25 aa, Mycobacterium tuberculosis
AGDIAWLTRPLIDSYHTVWFELHEE

SEQ ID NO: 1503033 - protein, 23 aa, Mycobacterium tuberculosis
AGELLLKPPRSGLPVIEVLDTEL

SEQ ID NO: 1503034 - protein, 22 aa, Mycobacterium tuberculosis
AGENLFRPLLMRVTSEGVGKGI

SEQ ID NO: 1503035 - protein, 28 aa, Mycobacterium tuberculosis
AGFSHFTLLLVHALRQQFSRVRVFAFID

SEQ ID NO: 1503036 - protein, 26 aa, Mycobacterium tuberculosis
AGHDVTRLFYEAYPPMVIRTLMSIIG

SEQ ID NO: 1503037 - protein, 21 aa, Mycobacterium tuberculosis
AGIKPIIGVEAYIAPGSRFDT

SEQ ID NO: 1503038 - protein, 27 aa, Mycobacterium tuberculosis
AGISRPTFYFYFPSKEAVLLTLLDRVV

SEQ ID NO: 1503039 - protein, 25 aa, Mycobacterium tuberculosis
AGLIDALRWLAANVPIYAVNVLLST

SEQ ID NO: 1503040 - protein, 27 aa, Mycobacterium tuberculosis
AGLRSLLAYQWAHPGKQLLFMGQEFGQ

SEQ ID NO: 1503041 - protein, 32 aa, Mycobacterium tuberculosis; identical to SEQ ID NO: 215880

SEQ ID NO: 1503042 - protein, 18 aa, Mycobacterium tuberculosis
AGNADFAIAIRTALMRNG

SEQ ID NO: 1503043 - protein, 26 aa, Mycobacterium tuberculosis
AGPEHTYRVPLPAPGEPKRAILDSYT

SEQ ID NO: 1503044 - protein, 31 aa, Mycobacterium tuberculosis; identical to SEQ ID NO: 215182

SEQ ID NO: 1503045 - protein, 20 aa, Mycobacterium tuberculosis
AGPGLYRSFSSKQAILDALI

SEQ ID NO: 1503046 - protein, 18 aa, Mycobacterium tuberculosis
AGPRYGFRPTVMARPPFA

SEQ ID NO: 1503047 - protein, 23 aa, Mycobacterium tuberculosis
AGPWTEGLLFALGGPIYAGTNEI

SEQ ID NO: 1503048 - protein, 26 aa, Mycobacterium tuberculosis
AGRVKRPQIAIATWIVPSIVAFGTDN

SEQ ID NO: 1503049 - protein, 45 aa, Mycobacterium tuberculosis; identical to SEQ ID NO: 215922

SEQ ID NO: 1503050 - protein, 25 aa, Mycobacterium tuberculosis
AGVKFSMVLPSFVNTELIAGTGGIK

SEQ ID NO: 1503051 - protein, 23 aa, Mycobacterium tuberculosis
AGVLGWGRLWELTDEQWETVIGV

SEQ ID NO: 1503052 - protein, 31 aa, Mycobacterium tuberculosis; identical to SEQ ID NO: 215933

SEQ ID NO: 1503053 - protein, 24 aa, Mycobacterium tuberculosis
AGWLLLCCGAMLDGAREALSIAES

SEQ ID NO: 1503054 - protein, 24 aa, Mycobacterium tuberculosis
AGYRAVHVWLRLPAGRVEIQIRTI

SEQ ID NO: 1503055 - protein, 24 aa, Mycobacterium tuberculosis
AGYVRKNSLWPATFGLACCAIEMM

SEQ ID NO: 1503056 - protein, 27 aa, Mycobacterium tuberculosis
AHALALQFGWRLFAPMLRSATGIDELT

SEQ ID NO: 1503057 - protein, 20 aa, Mycobacterium tuberculosis
AHCHMHTNPHLLIFGAAKSG

SEQ ID NO: 1503058 - protein, 27 aa, Mycobacterium tuberculosis
AHESVDWDLKSLRWAWNRAKDDVAPWW

SEQ ID NO: 1503059 - protein, 25 aa, Mycobacterium tuberculosis
AHLEALGPAMRRALAAAGLKQPDIV

SEQ ID NO: 1503060 - protein, 19 aa, Mycobacterium tuberculosis
AHNVAFDYAFLAAEAEIAE

SEQ ID NO: 1503061 - protein, 28 aa, Mycobacterium tuberculosis
AIAEGGWVLPYLPKPWGRAASPVEQIII

SEQ ID NO: 1503062 - protein, 17 aa, Mycobacterium tuberculosis
AIDPIGLSGFTLPQVNI

SEQ ID NO: 1503063 - protein, 25 aa, Mycobacterium tuberculosis
AIGCPLINIHHSFLPAFTGAAPYQR

SEQ ID NO: 1503064 - protein, 18 aa, Mycobacterium tuberculosis
AIGRAFMKKVWLRDSRNP

SEQ ID NO: 1503065 - protein, 24 aa, Mycobacterium tuberculosis
AIGVALGITRQAAFQRFGPHSTAS

SEQ ID NO: 1503066 - protein, 21 aa, Mycobacterium tuberculosis
AIHEMFVNTLVASSGSYAATE

SEQ ID NO: 1503067 - protein, 17 aa, Mycobacterium tuberculosis
AIIAACPSTWPWNLLGW

SEQ ID NO: 1503068 - protein, 17 aa, Mycobacterium tuberculosis
AIKDLAALATALQELTT

SEQ ID NO: 1503069 - protein, 19 aa, Mycobacterium tuberculosis
AILQSWLDERLAAMAGTQE

SEQ ID NO: 1503070 - protein, 21 aa, Mycobacterium tuberculosis
AIMEEVLLPVMYDIPSRDDVA

SEQ ID NO: 1503071 - protein, 18 aa, Mycobacterium tuberculosis
AIQRKLYQACRRWPKLMR

SEQ ID NO: 1503072 - protein, 26 aa, Mycobacterium tuberculosis
AITGRRYLDMFTFVASSALGMNPPAL

SEQ ID NO: 1503073 - protein, 19 aa, Mycobacterium tuberculosis
AIVNIPFLGQRIKPPYVAA

SEQ ID NO: 1503074 - protein, 36 aa, Mycobacterium tuberculosis; identical to SEQ ID NO: 216012

SEQ ID NO: 1503075 - protein, 29 aa, Mycobacterium tuberculosis
AKAYSAAWGVPFYAVNHLGGHLAADVYEH

SEQ ID NO: 1503076 - protein, 22 aa, Mycobacterium tuberculosis
AKDRGLWNLFLSAESGLTNLEY

SEQ ID NO: 1503077 - protein, 30 aa, Mycobacterium tuberculosis; identical to SEQ ID NO: 216028

SEQ ID NO: 1503078 - protein, 29 aa, Mycobacterium tuberculosis
AKTSWDLRKFLWAPRLGCYGIQRIHPLRN

SEQ ID NO: 1503079 - protein, 26 aa, Mycobacterium tuberculosis
ALAGLTPLRHWRSALATALAAPANST

SEQ ID NO: 1503080 - protein, 23 aa, Mycobacterium tuberculosis
ALDALRIPIAYLAELFTAGDTEV

SEQ ID NO: 1503081 - protein, 21 aa, Mycobacterium tuberculosis
ALDTLALLEGRWLHVVETLDR

SEQ ID NO: 1503082 - protein, 20 aa, Mycobacterium tuberculosis
ALGLATFYNGLAQEKLLSRE

SEQ ID NO: 1503083 - protein, 26 aa, Mycobacterium tuberculosis
ALGLDVLPAEWLAVPLAGGGIVRRMP

SEQ ID NO: 1503084 - protein, 25 aa, Mycobacterium tuberculosis
ALGLRPTLAALKTGARLALANKESL

SEQ ID NO: 1503085 - protein, 23 aa, Mycobacterium tuberculosis
ALIDVAHWASEFPWCGQAAEVLR

SEQ ID NO: 1503086 - protein, 18 aa, Mycobacterium tuberculosis
ALIHQHVLFTGSPPDREQ

SEQ ID NO: 1503087 - protein, 26 aa, Mycobacterium tuberculosis
ALLEVRDLLFARLLQYRAFKHVAEMF

SEQ ID NO: 1503088 - protein, 18 aa, Mycobacterium tuberculosis
ALLRRTNMSLLDRWYAAI

SEQ ID NO: 1503089 - protein, 29 aa, Mycobacterium tuberculosis
ALNCEIVPWCRFARKNYFYPDMPKNYQIS

SEQ ID NO: 1503090 - protein, 21 aa, Mycobacterium tuberculosis
ALNDDTRPRKLRPGDSLLVDT

SEQ ID NO: 1503091 - protein, 17 aa, Mycobacterium tuberculosis
ALNLWSVVTGMAGLPHV

SEQ ID NO: 1503092 - protein, 17 aa, Mycobacterium tuberculosis
ALPPPTGVFPRYQPPQP

SEQ ID NO: 1503093 - protein, 22 aa, Mycobacterium tuberculosis
ALQAGRIAVPLPVPHAGAHDER

SEQ ID NO: 1503094 - protein, 21 aa, Mycobacterium tuberculosis
ALRAGGFKHRAKVEICWVASD

SEQ ID NO: 1503095 - protein, 18 aa, Mycobacterium tuberculosis
ALREAALASLRLLAADIG

SEQ ID NO: 1503096 - protein, 24 aa, Mycobacterium tuberculosis
ALVSLVLDWHRPVKIFVETKHPVR

SEQ ID NO: 1503097 - protein, 28 aa, Mycobacterium tuberculosis
AMAPENVSPLVVWLGSAESRDVTGKVFE

SEQ ID NO: 1503098 - protein, 19 aa, Mycobacterium tuberculosis
AMDLIGERCPILIQLSTGV

SEQ ID NO: 1503099 - protein, 17 aa, Mycobacterium tuberculosis
AMIARRYMHLSGATSRD

SEQ ID NO: 1503100 - protein, 26 aa, Mycobacterium tuberculosis
AMLGQPVSMLIPRVVGFRLTGEIQPG

SEQ ID NO: 1503101 - protein, 19 aa, Mycobacterium tuberculosis
AMNMGMDGAWGQWVNRWTA

SEQ ID NO: 1503102 - protein, 17 aa, Mycobacterium tuberculosis
AMPVLKVLHDEARLVRL

SEQ ID NO: 1503103 - protein, 32 aa, Mycobacterium tuberculosis; identical to SEQ ID NO: 216187

SEQ ID NO: 1503104 - protein, 20 aa, Mycobacterium tuberculosis
ANHSVWFHRQVNFDDWVLYS

SEQ ID NO: 1503105 - protein, 25 aa, Mycobacterium tuberculosis
ANIAPWLRAAHRYGAKVKWAEVDIE

SEQ ID NO: 1503106 - protein, 19 aa, Mycobacterium tuberculosis
ANKLPGQPLVRIAGFGYNE

SEQ ID NO: 1503107 - protein, 19 aa, Mycobacterium tuberculosis
ANLLGQMALGSMTGGALGA

SEQ ID NO: 1503108 - protein, 24 aa, Mycobacterium tuberculosis
ANPDLVYGLITDLPTLASLAEEVV

SEQ ID NO: 1503109 - protein, 19 aa, Mycobacterium tuberculosis
ANSAPWLPIERAAALDGGA

SEQ ID NO: 1503110 - protein, 23 aa, Mycobacterium tuberculosis
ANTLYVPPEPFFADQQWSHITDW

SEQ ID NO: 1503111 - protein, 26 aa, Mycobacterium tuberculosis
APAGRGFWFPPTVLTPKRGDRTVTDE

SEQ ID NO: 1503112 - protein, 24 aa, Mycobacterium tuberculosis
APANAFVMSFLGAVSTLNGSLVRP

SEQ ID NO: 1503113 - protein, 17 aa, Mycobacterium tuberculosis
APDVLRYVMGFGGTPDS

SEQ ID NO: 1503114 - protein, 18 aa, Mycobacterium tuberculosis
APLFPLVVVVHADVELRV

SEQ ID NO: 1503115 - protein, 33 aa, Mycobacterium tuberculosis; identical to SEQ ID NO: 216248

SEQ ID NO: 1503116 - protein, 27 aa, Mycobacterium tuberculosis
APTGAQWDTALVYWQRLRTDVGAVFDT

SEQ ID NO: 1503117 - protein, 26 aa, Mycobacterium tuberculosis
APVVAPPWEPPPLPSTRQRLGWALRD

SEQ ID NO: 1503118 - protein, 25 aa, Mycobacterium tuberculosis
AQARHELALLPDVPGRRALAALVDY

SEQ ID NO: 1503119 - protein, 26 aa, Mycobacterium tuberculosis
AQGRTPLPFYVWRAFARYSPVLPAGR

SEQ ID NO: 1503120 - protein, 23 aa, Mycobacterium tuberculosis
AQNVRLPWRVDKTDYVLHLIDTP

SEQ ID NO: 1503121 - protein, 25 aa, Mycobacterium tuberculosis
AQTLAHEFDFRFLVGVLSVLGDKDV

SEQ ID NO: 1503122 - protein, 26 aa, Mycobacterium tuberculosis
AQTVARWLVLYLRRPGGQTQFAAPVW

SEQ ID NO: 1503123 - protein, 26 aa, Mycobacterium tuberculosis
AQWDGMPHPTILAAARLLGVDEVWAV

SEQ ID NO: 1503124 - protein, 23 aa, Mycobacterium tuberculosis
ARALAADPPILLMDEPFSAVDPV

SEQ ID NO: 1503125 - protein, 18 aa, Mycobacterium tuberculosis
ARAWWVLTAAGIANVRIL

SEQ ID NO: 1503126 - protein, 22 aa, Mycobacterium tuberculosis
ARCALAWSVQTAALAREHNNAQ

SEQ ID NO: 1503127 - protein, 20 aa, Mycobacterium tuberculosis
ARFVRTCDCFNIPIVMLVDV

SEQ ID NO: 1503128 - protein, 24 aa, Mycobacterium tuberculosis
ARGPMGLPELTSTKWIAWGAGHTR

SEQ ID NO: 1503129 - protein, 28 aa, Mycobacterium tuberculosis
ARHGQRGPFEQWLAYWDPDHDFLTSRVT

SEQ ID NO: 1503130 - protein, 22 aa, Mycobacterium tuberculosis
ARHPIIMLAEHVADTFIAMGWE

SEQ ID NO: 1503131 - protein, 19 aa, Mycobacterium tuberculosis
ARLNPLTRPSHITNPAGLA

SEQ ID NO: 1503132 - protein, 24 aa, Mycobacterium tuberculosis
ARLRPWQQLLHELPRRLGGEHSDS

SEQ ID NO: 1503133 - protein, 21 aa, Mycobacterium tuberculosis
ARPIGRIDGWGHRTVGLGLRQ

SEQ ID NO: 1503134 - protein, 18 aa, Mycobacterium tuberculosis
ARQILGHRAMIVAGGSNR

SEQ ID NO: 1503135 - protein, 25 aa, Mycobacterium tuberculosis
ARRFDRSIGYFWTATHQQIYRTLRV

SEQ ID NO: 1503136 - protein, 31 aa, Mycobacterium tuberculosis; identical to SEQ ID NO: 216373

SEQ ID NO: 1503137 - protein, 24 aa, Mycobacterium tuberculosis
ARRRRLMVDLYKRVLDGVADLGFP

SEQ ID NO: 1503138 - protein, 22 aa, Mycobacterium tuberculosis
ARSYREMFAGLYTDPDSVLNTM

SEQ ID NO: 1503139 - protein, 28 aa, Mycobacterium tuberculosis
ARTGARPRVLLLPLGPLAEHNIRTTFAT

SEQ ID NO: 1503140 - protein, 17 aa, Mycobacterium tuberculosis
ARTLDLWAEALQAHKDE

SEQ ID NO: 1503141 - protein, 23 aa, Mycobacterium tuberculosis
ASAARLDGYPRQGKTVLFLGRYD

SEQ ID NO: 1503142 - protein, 24 aa, Mycobacterium tuberculosis
ASDGGLWLAIMSPAALSRIEAIAA

SEQ ID NO: 1503143 - protein, 22 aa, Mycobacterium tuberculosis
ASGFKGPLPMPPSKHIAIVACM

SEQ ID NO: 1503144 - protein, 29 aa, Mycobacterium tuberculosis
ASGKQRSRLALWSRRLLGEAITQAQLVLA

SEQ ID NO: 1503145 - protein, 25 aa, Mycobacterium tuberculosis
ASGLDSRAYRLAWPAQTVVYEIDQP

SEQ ID NO: 1503146 - protein, 25 aa, Mycobacterium tuberculosis
ASGSDIARIRRFAHPVLLERSRAAE

SEQ ID NO: 1503147 - protein, 22 aa, Mycobacterium tuberculosis
ASHDPFLPLLLAAEHTSRLELG

SEQ ID NO: 1503148 - protein, 24 aa, Mycobacterium tuberculosis
ASINDVPIAESERRYLGARSASEY

SEQ ID NO: 1503149 - protein, 27 aa, Mycobacterium tuberculosis
ASPKETWLRLLLIDAGLPVPTTQIPVV

SEQ ID NO: 1503150 - protein, 24 aa, Mycobacterium tuberculosis
ASRDIPLRLLYAIEPDDPGYAAHG

SEQ ID NO: 1503151 - protein, 19 aa, Mycobacterium tuberculosis
ASRLIPFAAPPKTTNSAGV

SEQ ID NO: 1503152 - protein, 18 aa, Mycobacterium tuberculosis
ASWDNRRSFWIQREHLLQ

SEQ ID NO: 1503153 - protein, 24 aa, Mycobacterium tuberculosis
ATDRFRLAVRELKWSASSPDIEAA

SEQ ID NO: 1503154 - protein, 28 aa, Mycobacterium tuberculosis
ATEAAVAHLIPALQQLHDALAAKALDWH

SEQ ID NO: 1503155 - protein, 26 aa, Mycobacterium tuberculosis
ATEAEQTFLLRLLGGELRQGAKGGIM

SEQ ID NO: 1503156 - protein, 22 aa, Mycobacterium tuberculosis
ATERLLRPIGRVSAAELAQLDE

SEQ ID NO: 1503157 - protein, 24 aa, Mycobacterium tuberculosis
ATGRTLTFPGFLKAYVETVDELVG

SEQ ID NO: 1503158 - protein, 21 aa, Mycobacterium tuberculosis
ATIKKVFLELGGKSAFVVLDD

SEQ ID NO: 1503159 - protein, 23 aa, Mycobacterium tuberculosis
ATLAGWRTDFLNDMGLVIADSIK

SEQ ID NO: 1503160 - protein, 20 aa, Mycobacterium tuberculosis
ATMHPSRYLTLIEGVTAVFL

SEQ ID NO: 1503161 - protein, 23 aa, Mycobacterium tuberculosis
ATMPYVLELADHGWRAACRSNPA

SEQ ID NO: 1503162 - protein, 29 aa, Mycobacterium tuberculosis
ATNASTPLFFAQAIGRFVRSRRPGETASI

SEQ ID NO: 1503163 - protein, 29 aa, Mycobacterium tuberculosis
ATQESTLGLIFHWADQRGLPLLDLKDLRA

SEQ ID NO: 1503164 - protein, 18 aa, Mycobacterium tuberculosis
ATRRYPGTDRPALDRLDL

SEQ ID NO: 1503165 - protein, 20 aa, Mycobacterium tuberculosis
ATVPVLKGQPRRAARKAGYE

SEQ ID NO: 1503166 - protein, 25 aa, Mycobacterium tuberculosis
ATVQTCIIHLIRNTFRYASRKYWDK

SEQ ID NO: 1503167 - protein, 30 aa, Mycobacterium tuberculosis; identical to SEQ ID NO: 216512

SEQ ID NO: 1503168 - protein, 25 aa, Mycobacterium tuberculosis
AVADRCSWRRWWPDLRLQVTEDRAD

SEQ ID NO: 1503169 - protein, 25 aa, Mycobacterium tuberculosis
AVAKRLMHVLGTSAYVPDLLMRAPR

SEQ ID NO: 1503170 - protein, 26 aa, Mycobacterium tuberculosis
AVARHLLSRRYGAAVLGPHGSKRSLP

SEQ ID NO: 1503171 - protein, 29 aa, Mycobacterium tuberculosis
AVAVALPAFALPLRLPAGLAAGPAAVVTA

SEQ ID NO: 1503172 - protein, 18 aa, Mycobacterium tuberculosis
AVDNGFVPTIPPVLVRPE

SEQ ID NO: 1503173 - protein, 25 aa, Mycobacterium tuberculosis
AVGHAAWFLHMQGVLVPAAGGVGLV

SEQ ID NO: 1503174 - protein, 24 aa, Mycobacterium tuberculosis
AVGVVHSLWQPMAGRFKDYIAQPR

SEQ ID NO: 1503175 - protein, 23 aa, Mycobacterium tuberculosis
AVILAPQGIEYVVGFLGALQAGR

SEQ ID NO: 1503176 - protein, 26 aa, Mycobacterium tuberculosis
AVLPEKPELILLDNFAVWQTQTAVQR

SEQ ID NO: 1503177 - protein, 26 aa, Mycobacterium tuberculosis
AVLSRAQLLELVWGYDFAADTNVVDV

SEQ ID NO: 1503178 - protein, 17 aa, Mycobacterium tuberculosis
AVMRKHRLAERLLVDVI

SEQ ID NO: 1503179 - protein, 20 aa, Mycobacterium tuberculosis
AVRRQHGLPWISAMPTNLYG

SEQ ID NO: 1503180 - protein, 26 aa, Mycobacterium tuberculosis
AVRTRKPLLPPPPQPPGREPVHRRAL

SEQ ID NO: 1503181 - protein, 23 aa, Mycobacterium tuberculosis
AVRVRIGGRWRSGTAYLLPDDDP

SEQ ID NO: 1503182 - protein, 31 aa, Mycobacterium tuberculosis; identical to SEQ ID NO: 216586

SEQ ID NO: 1503183 - protein, 25 aa, Mycobacterium tuberculosis
AVSEQVEQLLLWDRAVRADAYDAVH

SEQ ID NO: 1503184 - protein, 25 aa, Mycobacterium tuberculosis
AVTPYASATFPWYQLGRQAHVQGPV

SEQ ID NO: 1503185 - protein, 27 aa, Mycobacterium tuberculosis
AVTTFNKAFAPYGLPRTAFKPSYGIAE

SEQ ID NO: 1503186 - protein, 34 aa, Mycobacterium tuberculosis; identical to SEQ ID NO: 216598

SEQ ID NO: 1503187 - protein, 34 aa, Mycobacterium tuberculosis; identical to SEQ ID NO: 215272

SEQ ID NO: 1503188 - protein, 24 aa, Mycobacterium tuberculosis
AWSAEGLLRYLPPEAQDRLLDNVT

SEQ ID NO: 1503189 - protein, 26 aa, Mycobacterium tuberculosis
CAGYVPGIPRLGVPALLMSDAGLGVT

SEQ ID NO: 1503190 - protein, 24 aa, Mycobacterium tuberculosis
CAPDDVLPAIAFAVAHTGKPVIVY

SEQ ID NO: 1503191 - protein, 23 aa, Mycobacterium tuberculosis
CAQQAIRRRAFARALRIAGSPDT

SEQ ID NO: 1503192 - protein, 18 aa, Mycobacterium tuberculosis
CCARSRILVQRSVYDRFM

SEQ ID NO: 1503193 - protein, 19 aa, Mycobacterium tuberculosis
CEFIDASPSPFHVCATVAG

SEQ ID NO: 1503194 - protein, 17 aa, Mycobacterium tuberculosis
CELLSGARVWPGVFLPD

SEQ ID NO: 1503195 - protein, 18 aa, Mycobacterium tuberculosis
CEYLPGKAIVMQMLVRYV

SEQ ID NO: 1503196 - protein, 24 aa, Mycobacterium tuberculosis
CGARAFIEISAHPALLFAIGQNCE

SEQ ID NO: 1503197 - protein, 26 aa, Mycobacterium tuberculosis
CGKTYLAQTLAKMLNVPFAIADATAL

SEQ ID NO: 1503198 - protein, 19 aa, Mycobacterium tuberculosis
CGLLYVGLAITARGPAVVE

SEQ ID NO: 1503199 - protein, 18 aa, Mycobacterium tuberculosis
CIDVLTQISAVTSALRSV

SEQ ID NO: 1503200 - protein, 17 aa, Mycobacterium tuberculosis
CIRALRANQQAAQRLRG

SEQ ID NO: 1503201 - protein, 23 aa, Mycobacterium tuberculosis
CLDPGRVGLFRHVLRPAFLQAET

SEQ ID NO: 1503202 - protein, 24 aa, Mycobacterium tuberculosis
CPTAARARRLVYAPDLDGRADPGE

SEQ ID NO: 1503203 - protein, 20 aa, Mycobacterium tuberculosis
CRRLDGMPLAIELAAARLRS

SEQ ID NO: 1503204 - protein, 26 aa, Mycobacterium tuberculosis
CRRWPKLMRRLLLWEVRRRLGRSVDM

SEQ ID NO: 1503205 - protein, 17 aa, Mycobacterium tuberculosis
CRTGPPQSTSWAQRWLA

SEQ ID NO: 1503206 - protein, 24 aa, Mycobacterium tuberculosis
CSETCVGRLRYLGLVLYDVDQVLQ

SEQ ID NO: 1503207 - protein, 24 aa, Mycobacterium tuberculosis
CSGAHIVMIGILPTLMPEHLTDGW

SEQ ID NO: 1503208 - protein, 22 aa, Mycobacterium tuberculosis
CSSETLLIVPTPAGVLFTQATA

SEQ ID NO: 1503209 - protein, 17 aa, Mycobacterium tuberculosis
CTFVTVPGKLRAQGSST

SEQ ID NO: 1503210 - protein, 17 aa, Mycobacterium tuberculosis
CVGMQILFACGVEFGVQ

SEQ ID NO: 1503211 - protein, 17 aa, Mycobacterium tuberculosis
DAAAKMLAGKPFKKEAA

SEQ ID NO: 1503212 - protein, 30 aa, Mycobacterium tuberculosis; identical to SEQ ID NO: 216711

SEQ ID NO: 1503213 - protein, 28 aa, Mycobacterium tuberculosis
DADLEHWRWMWDTNVLGTLRVTRALLPK

SEQ ID NO: 1503214 - protein, 22 aa, Mycobacterium tuberculosis
DAFADFLAGFHIIDRHFATAPL

SEQ ID NO: 1503215 - protein, 19 aa, Mycobacterium tuberculosis
DAFFALFQDPTRTYSCAYF

SEQ ID NO: 1503216 - protein, 22 aa, Mycobacterium tuberculosis
DAHLYCAIAIFGDKVTALQLVW

SEQ ID NO: 1503217 - protein, 19 aa, Mycobacterium tuberculosis
DALIWNGSLWHTAAANRTD

SEQ ID NO: 1503218 - protein, 21 aa, Mycobacterium tuberculosis
DALRRYLRTRHPRVSSALARA

SEQ ID NO: 1503219 - protein, 20 aa, Mycobacterium tuberculosis
DAMALVAQPKTDILSEVWVS

SEQ ID NO: 1503220 - protein, 29 aa, Mycobacterium tuberculosis
DAMTQGWFTGLIPITVPIAGSAFGDAARA

SEQ ID NO: 1503221 - protein, 33 aa, Mycobacterium tuberculosis; identical to SEQ ID NO: 216758

SEQ ID NO: 1503222 - protein, 23 aa, Mycobacterium tuberculosis
DAPRVVLLGIPTRGVTLANRLAG

SEQ ID NO: 1503223 - protein, 18 aa, Mycobacterium tuberculosis
DARALYELLKLRVEVFVV

SEQ ID NO: 1503224 - protein, 21 aa, Mycobacterium tuberculosis
DAVRVFLTPESARQFATRSYR

SEQ ID NO: 1503225 - protein, 25 aa, Mycobacterium tuberculosis
DAWEDFLFWLAADRKTARRITRLIG

SEQ ID NO: 1503226 - protein, 25 aa, Mycobacterium tuberculosis
DCFNIPIVMLVDVPGFLPGTDQEYN

SEQ ID NO: 1503227 - protein, 27 aa, Mycobacterium tuberculosis
DCHDGYRWLRLLGYEPEQIVLAGDSAG

SEQ ID NO: 1503228 - protein, 23 aa, Mycobacterium tuberculosis
DDAARMWARLRIHLAESGRRVRI

SEQ ID NO: 1503229 - protein, 24 aa, Mycobacterium tuberculosis
DDANLVRLTELPAGSPVAVVVRQL

SEQ ID NO: 1503230 - protein, 21 aa, Mycobacterium tuberculosis
DDFFALFQDPTRTYSCAYFEP

SEQ ID NO: 1503231 - protein, 24 aa, Mycobacterium tuberculosis
DDLVEIVAKFRPGPRRRLGVLVDH

SEQ ID NO: 1503232 - protein, 30 aa, Mycobacterium tuberculosis; identical to SEQ ID NO: 216811

SEQ ID NO: 1503233 - protein, 24 aa, Mycobacterium tuberculosis
DDVPSDVLRCYLDLVLDGLLARLA

SEQ ID NO: 1503234 - protein, 25 aa, Mycobacterium tuberculosis
DDVRASLDRWLARWQPRYPDVRVQS

SEQ ID NO: 1503235 - protein, 24 aa, Mycobacterium tuberculosis
DEHLARVAALGRIALVLISHRHGD

SEQ ID NO: 1503236 - protein, 28 aa, Mycobacterium tuberculosis
DEHPGKWRVVFFWPKDFTFVCPTEIAAF

SEQ ID NO: 1503237 - protein, 24 aa, Mycobacterium tuberculosis
DELDALLWRAARPGEPSWPSPFGP

SEQ ID NO: 1503238 - protein, 21 aa, Mycobacterium tuberculosis
DELEPYCRGGKLSLRVIALVN

SEQ ID NO: 1503239 - protein, 18 aa, Mycobacterium tuberculosis
DELRRRGENIGLTTVYRT

SEQ ID NO: 1503240 - protein, 24 aa, Mycobacterium tuberculosis
DENALAEIADWGPAEDWADWADAA

SEQ ID NO: 1503241 - protein, 17 aa, Mycobacterium tuberculosis
DFAKILDAAAKSGANAI

SEQ ID NO: 1503242 - protein, 25 aa, Mycobacterium tuberculosis
DFGKRWVTECLRAAYPLGRGHGPVS

SEQ ID NO: 1503243 - protein, 19 aa, Mycobacterium tuberculosis
DFQRLQRELSGTGTDRLDG

SEQ ID NO: 1503244 - protein, 22 aa, Mycobacterium tuberculosis
DGAAQLLMKRFPDPNAPEAQAI

SEQ ID NO: 1503245 - protein, 26 aa, Mycobacterium tuberculosis
DGAAVGPFTYLRPGTALGADGKLGAF

SEQ ID NO: 1503246 - protein, 18 aa, Mycobacterium tuberculosis
DGDLLRLGDLALPVAPGS

SEQ ID NO: 1503247 - protein, 17 aa, Mycobacterium tuberculosis
DGDPLDALVLLPQPVFP

SEQ ID NO: 1503248 - protein, 17 aa, Mycobacterium tuberculosis
DGETHTWAYWRAPLQAM

SEQ ID NO: 1503249 - protein, 18 aa, Mycobacterium tuberculosis
DGFELAAHRVIGLLRDVV

SEQ ID NO: 1503250 - protein, 27 aa, Mycobacterium tuberculosis
DGGRIHKLLRIFANPKLPTIGDYYEPW

SEQ ID NO: 1503251 - protein, 26 aa, Mycobacterium tuberculosis
DGHTHAWYTTPLLTSPLGAAITPIGQ

SEQ ID NO: 1503252 - protein, 21 aa, Mycobacterium tuberculosis
DGLLELLPAGAWLDHTSDHAQ

SEQ ID NO: 1503253 - protein, 26 aa, Mycobacterium tuberculosis
DGNDHFEFFVFPYADKALTRTMHRSD

SEQ ID NO: 1503254 - protein, 23 aa, Mycobacterium tuberculosis
DGPAVLVGSARRGERFVDALSAN

SEQ ID NO: 1503255 - protein, 20 aa, Mycobacterium tuberculosis
DGPGPGEVLVKYTAAGLCHS

SEQ ID NO: 1503256 - protein, 24 aa, Mycobacterium tuberculosis
DGQRVLVDRIWPHGIRKDDQRVGI

SEQ ID NO: 1503257 - protein, 24 aa, Mycobacterium tuberculosis
DGRTYGHPIVLRPVSSEDAMTADW

SEQ ID NO: 1503258 - protein, 25 aa, Mycobacterium tuberculosis
DGRVKVWKGIRYAAPPLGDLRFRTP

SEQ ID NO: 1503259 - protein, 29 aa, Mycobacterium tuberculosis
DGSSVLIQMMWAMRATGMWTDTRGANMLD

SEQ ID NO: 1503260 - protein, 21 aa, Mycobacterium tuberculosis
DGTAFPRLYGVQTRFFDDFFN

SEQ ID NO: 1503261 - protein, 21 aa, Mycobacterium tuberculosis
DGTLPHFPLPLGDLSVPHTGK

SEQ ID NO: 1503262 - protein, 19 aa, Mycobacterium tuberculosis
DGVGNYTFGLAEQAVFHEV

SEQ ID NO: 1503263 - protein, 22 aa, Mycobacterium tuberculosis
DGVGYPVHKPVTAGWNGYGDFQ

SEQ ID NO: 1503264 - protein, 25 aa, Mycobacterium tuberculosis
DHFANRGFAFYALDLRKCGRSRAPG

SEQ ID NO: 1503265 - protein, 29 aa, Mycobacterium tuberculosis
DHRDTYDAMFDLWFPAALGARAVITTEDE

SEQ ID NO: 1503266 - protein, 21 aa, Mycobacterium tuberculosis
DHRTSPLLVLTENGRRVLQAI

SEQ ID NO: 1503267 - protein, 25 aa, Mycobacterium tuberculosis
DHVPEQAFFLIGGLDDLAKKAESLG

SEQ ID NO: 1503268 - protein, 24 aa, Mycobacterium tuberculosis
DHVVLVLHDWGSALGFDWANQHRD

SEQ ID NO: 1503269 - protein, 29 aa, Mycobacterium tuberculosis
DIDEIQAQAILDMQLRRLAALERQRIIDD

SEQ ID NO: 1503270 - protein, 25 aa, Mycobacterium tuberculosis
DINLVGTFNVLRLGAERIAKTEPIG

SEQ ID NO: 1503271 - protein, 29 aa, Mycobacterium tuberculosis
DITVNVDGFWMLQALLDIRHVAPELRCRP

SEQ ID NO: 1503272 - protein, 26 aa, Mycobacterium tuberculosis
DIVSNVGYTALLVAGWRALHTTGPKP

SEQ ID NO: 1503273 - protein, 24 aa, Mycobacterium tuberculosis
DKEGRLILSKKRAQYERAWGTIEA

SEQ ID NO: 1503274 - protein, 32 aa, Mycobacterium tuberculosis; identical to SEQ ID NO: 216996

SEQ ID NO: 1503275 - protein, 30 aa, Mycobacterium tuberculosis; identical to SEQ ID NO: 216999

SEQ ID NO: 1503276 - protein, 33 aa, Mycobacterium tuberculosis; identical to SEQ ID NO: 217013

SEQ ID NO: 1503277 - protein, 23 aa, Mycobacterium tuberculosis
DLDGELFTFTPMSPANAFSVTAE

SEQ ID NO: 1503278 - protein, 27 aa, Mycobacterium tuberculosis
DLDHPPVLLIMGLGAQMLLWRTDFCAR

SEQ ID NO: 1503279 - protein, 25 aa, Mycobacterium tuberculosis
DLDKPKLVFFFDEAHLLFTDASKAF

SEQ ID NO: 1503280 - protein, 25 aa, Mycobacterium tuberculosis
DLDLFKHLHRAGLRRVFIGVETGSY

SEQ ID NO: 1503281 - protein, 17 aa, Mycobacterium tuberculosis
DLDRFWTRALTGYAQLI

SEQ ID NO: 1503282 - protein, 23 aa, Mycobacterium tuberculosis
DLDTIAALSRRASALLDGLDGAN

SEQ ID NO: 1503283 - protein, 19 aa, Mycobacterium tuberculosis
DLEMRRPTYVFAAVDHTGA

SEQ ID NO: 1503284 - protein, 18 aa, Mycobacterium tuberculosis
DLERRVADFLGFATVFNS

SEQ ID NO: 1503285 - protein, 24 aa, Mycobacterium tuberculosis
DLLDLEAIASGYLLHRHERLEQIR

SEQ ID NO: 1503286 - protein, 17 aa, Mycobacterium tuberculosis
DLLHLACCQRRGVTRIK

SEQ ID NO: 1503287 - protein, 24 aa, Mycobacterium tuberculosis
DLTGLAVLDLYAGSGALGLEALSR

SEQ ID NO: 1503288 - protein, 25 aa, Mycobacterium tuberculosis
DLVDRHLPAFLRFAGREFIGVQGTQ

SEQ ID NO: 1503289 - protein, 18 aa, Mycobacterium tuberculosis
DLVRDGVFVGYQLDRAFA

SEQ ID NO: 1503290 - protein, 24 aa, Mycobacterium tuberculosis
DLVVLARYMQILSPGFLEAIGCPL

SEQ ID NO: 1503291 - protein, 35 aa, Mycobacterium tuberculosis; identical to SEQ ID NO: 217083

SEQ ID NO: 1503292 - protein, 21 aa, Mycobacterium tuberculosis
DNRLPPVHMFGGINLSFGLMG

SEQ ID NO: 1503293 - protein, 26 aa, Mycobacterium tuberculosis
DPAEWKVFLNLLRTRFETDKDKWTKI

SEQ ID NO: 1503294 - protein, 23 aa, Mycobacterium tuberculosis
DPALPRNRGAFAELLRACGDIDG

SEQ ID NO: 1503295 - protein, 19 aa, Mycobacterium tuberculosis
DPEFRARRMAQMSQYVVGE

SEQ ID NO: 1503296 - protein, 26 aa, Mycobacterium tuberculosis
DPLDALVLLPQPVFPGVLVAARPVGM

SEQ ID NO: 1503297 - protein, 20 aa, Mycobacterium tuberculosis
DPQHLIDWKGNDWYFRETET

SEQ ID NO: 1503298 - protein, 19 aa, Mycobacterium tuberculosis
DPQIAYLSGDRLPPALRGF

SEQ ID NO: 1503299 - protein, 22 aa, Mycobacterium tuberculosis
DPRIWPNIVASQLDWDLELIGR

SEQ ID NO: 1503300 - protein, 19 aa, Mycobacterium tuberculosis
DPRNEWLFNDAWGVDVAVS

SEQ ID NO: 1503301 - protein, 23 aa, Mycobacterium tuberculosis
DPSGAAFGLWQPLQHHGFEVIGE

SEQ ID NO: 1503302 - protein, 32 aa, Mycobacterium tuberculosis; identical to SEQ ID NO: 217137

SEQ ID NO: 1503303 - protein, 25 aa, Mycobacterium tuberculosis
DPYLPDLLMCRAEVAPILLGAIADA

SEQ ID NO: 1503304 - protein, 27 aa, Mycobacterium tuberculosis
DPYYHAELEWWTSPFVLAHGVPPDTLA

SEQ ID NO: 1503305 - protein, 24 aa, Mycobacterium tuberculosis
DQQVDWTWQLVRDAVLDRVWSNPT

SEQ ID NO: 1503306 - protein, 22 aa, Mycobacterium tuberculosis
DRAIDLFKPLASKATRPEVRGG

SEQ ID NO: 1503307 - protein, 25 aa, Mycobacterium tuberculosis
DRATLRISSQLLANWLRHGVITSAD

SEQ ID NO: 1503308 - protein, 18 aa, Mycobacterium tuberculosis
DRETLARQFAIPGTPGLE

SEQ ID NO: 1503309 - protein, 23 aa, Mycobacterium tuberculosis
DRGRPVALLSPLPQGGPYEQLLA

SEQ ID NO: 1503310 - protein, 24 aa, Mycobacterium tuberculosis
DRGRWGCVLGGRPDRRITAMRARE

SEQ ID NO: 1503311 - protein, 17 aa, Mycobacterium tuberculosis
DRLLAADDPFTVPNLVW

SEQ ID NO: 1503312 - protein, 30 aa, Mycobacterium tuberculosis; identical to SEQ ID NO: 217190

SEQ ID NO: 1503313 - protein, 17 aa, Mycobacterium tuberculosis
DRPRAMAKVHHAGVDGV

SEQ ID NO: 1503314 - protein, 22 aa, Mycobacterium tuberculosis
DRRHWHTPCWANRATRGPTRKW

SEQ ID NO: 1503315 - protein, 23 aa, Mycobacterium tuberculosis
DRRRSFYRIFFDSGFTPHPGEPG

SEQ ID NO: 1503316 - protein, 24 aa, Mycobacterium tuberculosis
DRTDVVFASHHWPTWGREKIVEFL

SEQ ID NO: 1503317 - protein, 17 aa, Mycobacterium tuberculosis
DRTLITENRLGLVQAAA

SEQ ID NO: 1503318 - protein, 25 aa, Mycobacterium tuberculosis
DRVVTKCFLLWAGVVGAISLEVFGQ

SEQ ID NO: 1503319 - protein, 25 aa, Mycobacterium tuberculosis
DRYDLQVLAPPIPRTVRFAEASASG

SEQ ID NO: 1503320 - protein, 20 aa, Mycobacterium tuberculosis
DSALTLVRALTEIWPVEAAD

SEQ ID NO: 1503321 - protein, 27 aa, Mycobacterium tuberculosis
DSDLAAWPATLDRVLAIGGPDASYVPG

SEQ ID NO: 1503322 - protein, 17 aa, Mycobacterium tuberculosis
DSLTWDAWRNEDSRWTV

SEQ ID NO: 1503323 - protein, 19 aa, Mycobacterium tuberculosis
DSNQGFRRFTPRARNAVVA

SEQ ID NO: 1503324 - protein, 22 aa, Mycobacterium tuberculosis
DSPRHWVAHLNVLRDIQDRTGG

SEQ ID NO: 1503325 - protein, 17 aa, Mycobacterium tuberculosis
DSRIQLRDALRAALLAF

SEQ ID NO: 1503326 - protein, 30 aa, Mycobacterium tuberculosis; identical to SEQ ID NO: 217238

SEQ ID NO: 1503327 - protein, 24 aa, Mycobacterium tuberculosis
DTDSELFRRYWPADLHMIGKDIIR

SEQ ID NO: 1503328 - protein, 25 aa, Mycobacterium tuberculosis
DTDTVRLYLQETLTFLCYTAEASVA

SEQ ID NO: 1503329 - protein, 34 aa, Mycobacterium tuberculosis; identical to SEQ ID NO: 217249

SEQ ID NO: 1503330 - protein, 26 aa, Mycobacterium tuberculosis
DTLEETALWLDLTYAGSRPVVLTGAM

SEQ ID NO: 1503331 - protein, 25 aa, Mycobacterium tuberculosis
DTNVYYRRALMLAACFGRGSEYPQR

SEQ ID NO: 1503332 - protein, 38 aa, Mycobacterium tuberculosis; identical to SEQ ID NO: 217270

SEQ ID NO: 1503333 - protein, 23 aa, Mycobacterium tuberculosis
DVAERILLNSKTRRPSVCNAAET

SEQ ID NO: 1503334 - protein, 20 aa, Mycobacterium tuberculosis
DVALALLTPIVGQEFLDKYR

SEQ ID NO: 1503335 - protein, 28 aa, Mycobacterium tuberculosis
DVAVGDWIAMFSMWPIKSTPGLRCQLDC

SEQ ID NO: 1503336 - protein, 31 aa, Mycobacterium tuberculosis; identical to SEQ ID NO: 215214

SEQ ID NO: 1503337 - protein, 37 aa, Mycobacterium tuberculosis; identical to SEQ ID NO: 217288

SEQ ID NO: 1503338 - protein, 24 aa, Mycobacterium tuberculosis
DVFCSVVRRVALPDSFFAVDGQIE

SEQ ID NO: 1503339 - protein, 25 aa, Mycobacterium tuberculosis
DVFKEKLIRRDISLKAFEAGEPQAS

SEQ ID NO: 1503340 - protein, 31 aa, Mycobacterium tuberculosis; identical to SEQ ID NO: 217300

SEQ ID NO: 1503341 - protein, 26 aa, Mycobacterium tuberculosis
DVLAALRPHFRLRPDPAPRGSAPAEL

SEQ ID NO: 1503342 - protein, 28 aa, Mycobacterium tuberculosis
DVLDRYLPVLADLRMRYLDDGDWDGDIV

SEQ ID NO: 1503343 - protein, 22 aa, Mycobacterium tuberculosis
DVMFGPPGRLYTYRSHGIHVCA

SEQ ID NO: 1503344 - protein, 25 aa, Mycobacterium tuberculosis
DVMTVVQRLELVRRIGLVIDYDVVE

SEQ ID NO: 1503345 - protein, 23 aa, Mycobacterium tuberculosis
DVNVPMPIRVTSSLRHLALVVAD

SEQ ID NO: 1503346 - protein, 18 aa, Mycobacterium tuberculosis
DYHGDRLVLTGRGRLLAD

SEQ ID NO: 1503347 - protein, 24 aa, Mycobacterium tuberculosis
EAARAWWGNFLAQKANEAGIGLDE

SEQ ID NO: 1503348 - protein, 35 aa, Mycobacterium tuberculosis; identical to SEQ ID NO: 217365

SEQ ID NO: 1503349 - protein, 22 aa, Mycobacterium tuberculosis
EADDYWIDPLKLSKQVAFLDRH

SEQ ID NO: 1503350 - protein, 22 aa, Mycobacterium tuberculosis
EAFRLLGHVDVVFSNAGIVVGG

SEQ ID NO: 1503351 - protein, 24 aa, Mycobacterium tuberculosis
EAGKQPVLYVVGRKAQNYYSFRNW

SEQ ID NO: 1503352 - protein, 26 aa, Mycobacterium tuberculosis
EAIGLLKMDFLGLRNLTIIGDAIDNV

SEQ ID NO: 1503353 - protein, 27 aa, Mycobacterium tuberculosis
EALAYGDMGLALPILAPGGVASALTHW

SEQ ID NO: 1503354 - protein, 17 aa, Mycobacterium tuberculosis
EARLNLLRVHASFLFEE

SEQ ID NO: 1503355 - protein, 30 aa, Mycobacterium tuberculosis; identical to SEQ ID NO: 217405

SEQ ID NO: 1503356 - protein, 19 aa, Mycobacterium tuberculosis
ECWAMQAYGAAYTLQELLT

SEQ ID NO: 1503357 - protein, 24 aa, Mycobacterium tuberculosis
EDALADMFLAALFGDHPVGRPVIG

SEQ ID NO: 1503358 - protein, 24 aa, Mycobacterium tuberculosis
EDEEVPLPDFFYVSARLQRKHRQY

SEQ ID NO: 1503359 - protein, 24 aa, Mycobacterium tuberculosis
EDFNAIARGLKLLELDYLGGSGTR

SEQ ID NO: 1503360 - protein, 25 aa, Mycobacterium tuberculosis
EDIKGQFYCSISVPLDLYSCAVYAG

SEQ ID NO: 1503361 - protein, 31 aa, Mycobacterium tuberculosis; identical to SEQ ID NO: 217436

SEQ ID NO: 1503362 - protein, 20 aa, Mycobacterium tuberculosis
EDLVFLRKVLNRADIPYLLI

SEQ ID NO: 1503363 - protein, 26 aa, Mycobacterium tuberculosis
EDVANLAMFLLSDAASWITGQVINVD

SEQ ID NO: 1503364 - protein, 24 aa, Mycobacterium tuberculosis
EDVPNLFWCVGYTNASWTLRADMT

SEQ ID NO: 1503365 - protein, 26 aa, Mycobacterium tuberculosis
EEAGPDALIVVLLPDGGRGYMSKIFN

SEQ ID NO: 1503366 - protein, 26 aa, Mycobacterium tuberculosis
EEKFGFLLEAFMFGAPPHGGIAFGWD

SEQ ID NO: 1503367 - protein, 23 aa, Mycobacterium tuberculosis
EEKPYARRPYPPFMTSTLQQEAS

SEQ ID NO: 1503368 - protein, 30 aa, Mycobacterium tuberculosis; identical to SEQ ID NO: 217473

SEQ ID NO: 1503369 - protein, 24 aa, Mycobacterium tuberculosis
EERWRPGLPPPPEQFYRVLAEQSK

SEQ ID NO: 1503370 - protein, 28 aa, Mycobacterium tuberculosis
EETMKLPRTILMYPMTLASQAAHVVMRF

SEQ ID NO: 1503371 - protein, 18 aa, Mycobacterium tuberculosis
EFAYGSFVRTVSLPVGAD

SEQ ID NO: 1503372 - protein, 20 aa, Mycobacterium tuberculosis
EFCYTTAWFDDQQLLGVMDG

SEQ ID NO: 1503373 - protein, 25 aa, Mycobacterium tuberculosis
EFDEWQRLYLFTRADTIYGGSNEIQ

SEQ ID NO: 1503374 - protein, 25 aa, Mycobacterium tuberculosis
EFRRRVGMLFQRPNPFPMSIMDNVL

SEQ ID NO: 1503375 - protein, 19 aa, Mycobacterium tuberculosis
EFYDPQPGVPGRTVCKWGG

SEQ ID NO: 1503376 - protein, 17 aa, Mycobacterium tuberculosis
EGARRFGGRWNPPLLFP

SEQ ID NO: 1503377 - protein, 21 aa, Mycobacterium tuberculosis
EGDILFLEWTANSAVSRVDDG

SEQ ID NO: 1503378 - protein, 24 aa, Mycobacterium tuberculosis
EGFTDAYRDLAFPGGIRESGFTRL

SEQ ID NO: 1503379 - protein, 27 aa, Mycobacterium tuberculosis
EGGQMPIHMRLPKLKGFRNRFRTEYEI

SEQ ID NO: 1503380 - protein, 24 aa, Mycobacterium tuberculosis
EGNFALVPLSLYFAEGKVKVELAL

SEQ ID NO: 1503381 - protein, 25 aa, Mycobacterium tuberculosis
EHDAHLHLRRALVTVGLFGGDAPVR

SEQ ID NO: 1503382 - protein, 27 aa, Mycobacterium tuberculosis
EHEGKPFFGSLLEFITSGPVVAAIVEG

SEQ ID NO: 1503383 - protein, 24 aa, Mycobacterium tuberculosis
EHRPEILLSFGFVPKVETRIGLIN

SEQ ID NO: 1503384 - protein, 19 aa, Mycobacterium tuberculosis
EIAGRLAARIGSGLLVDVV

SEQ ID NO: 1503385 - protein, 23 aa, Mycobacterium tuberculosis
EIGFSQLLYDDHIGKVSLIGAGM

SEQ ID NO: 1503386 - protein, 23 aa, Mycobacterium tuberculosis
EIPPGFSHCLLLSEARVVAAGLL

SEQ ID NO: 1503387 - protein, 22 aa, Mycobacterium tuberculosis
EIRPELRRLDLGKLLELKREWG

SEQ ID NO: 1503388 - protein, 27 aa, Mycobacterium tuberculosis
EKLERLGLWGLMPRTVYDTLIWCIYSG

SEQ ID NO: 1503389 - protein, 18 aa, Mycobacterium tuberculosis
EKTRLALAGLVASTANVL

SEQ ID NO: 1503390 - protein, 25 aa, Mycobacterium tuberculosis
EKWGKPYPAITRLWDSAWEEFIPFL

SEQ ID NO: 1503391 - protein, 27 aa, Mycobacterium tuberculosis
ELADAGPALLLPLRARGTVAGVVVVLS

SEQ ID NO: 1503392 - protein, 25 aa, Mycobacterium tuberculosis
ELARDALREWLRRGGKPARLIEIAT

SEQ ID NO: 1503393 - protein, 25 aa, Mycobacterium tuberculosis
ELCEEAPFYTLGPLATDIAPAYDHI

SEQ ID NO: 1503394 - protein, 17 aa, Mycobacterium tuberculosis
ELDEHLVALPNGRYGWR

SEQ ID NO: 1503395 - protein, 35 aa, Mycobacterium tuberculosis; identical to SEQ ID NO: 217607

SEQ ID NO: 1503396 - protein, 25 aa, Mycobacterium tuberculosis
ELDLHAPVARYWPEFGQAGKQAITL

SEQ ID NO: 1503397 - protein, 25 aa, Mycobacterium tuberculosis
ELGEQLPVYRPPLDMARLFNQPELG

SEQ ID NO: 1503398 - protein, 22 aa, Mycobacterium tuberculosis
ELGLSYLLPRAIGSSRAFEIML

SEQ ID NO: 1503399 - protein, 25 aa, Mycobacterium tuberculosis
ELGYRVRRFAARVVWKLAPDAPLPP

SEQ ID NO: 1503400 - protein, 28 aa, Mycobacterium tuberculosis
ELLSVAAGMPFPLFVKAVAGGGGRGMRR

SEQ ID NO: 1503401 - protein, 21 aa, Mycobacterium tuberculosis
ELPADTRWHPVSSLPPMAFDH

SEQ ID NO: 1503402 - protein, 31 aa, Mycobacterium tuberculosis; identical to SEQ ID NO: 217644

SEQ ID NO: 1503403 - protein, 22 aa, Mycobacterium tuberculosis
ELSVHYPFPIADLVALDDALTY

SEQ ID NO: 1503404 - protein, 26 aa, Mycobacterium tuberculosis
EMTHDDWRWVIDVDLWGSIHTVEAFL

SEQ ID NO: 1503405 - protein, 20 aa, Mycobacterium tuberculosis
EMYPLPRPHQPLLCNALIAL

SEQ ID NO: 1503406 - protein, 25 aa, Mycobacterium tuberculosis
ENGRSWSRWSFIGAGAPTALTVREG

SEQ ID NO: 1503407 - protein, 24 aa, Mycobacterium tuberculosis
ENKLLALLHRFGIAAPASADRSRA

SEQ ID NO: 1503408 - protein, 24 aa, Mycobacterium tuberculosis
ENKYRLIFEKLRLEPGDRLLDVGC

SEQ ID NO: 1503409 - protein, 24 aa, Mycobacterium tuberculosis
ENLEAFLRVMVYDKNLITPELVDQ

SEQ ID NO: 1503410 - protein, 19 aa, Mycobacterium tuberculosis
ENPDSYLAYGFAVHNCTAP

SEQ ID NO: 1503411 - protein, 25 aa, Mycobacterium tuberculosis
ENSAGYLLPYLVPGLSVLDVGCGPG

SEQ ID NO: 1503412 - protein, 20 aa, Mycobacterium tuberculosis
ENYHRLTTPSTWLEALVKTY

SEQ ID NO: 1503413 - protein, 25 aa, Mycobacterium tuberculosis
EPDCLLDSLLLEDPGLLADDLQVPG

SEQ ID NO: 1503414 - protein, 17 aa, Mycobacterium tuberculosis
EPDWLVWTHGCPAGESV

SEQ ID NO: 1503415 - protein, 27 aa, Mycobacterium tuberculosis
EPEFGNLMLYSRLRLATAASWSIRYVV

SEQ ID NO: 1503416 - protein, 24 aa, Mycobacterium tuberculosis
EPGDFVILNWRAVCGQCRACKRGR

SEQ ID NO: 1503417 - protein, 30 aa, Mycobacterium tuberculosis; identical to SEQ ID NO: 217710

SEQ ID NO: 1503418 - protein, 23 aa, Mycobacterium tuberculosis
EPLRRRVLARLRDLGQPIVLTVP

SEQ ID NO: 1503419 - protein, 35 aa, Mycobacterium tuberculosis; identical to SEQ ID NO: 217714

SEQ ID NO: 1503420 - protein, 17 aa, Mycobacterium tuberculosis
EPPLVLFCPTKVSRSWQ

SEQ ID NO: 1503421 - protein, 17 aa, Mycobacterium tuberculosis
EPRFPSFKGIMAAKKKE

SEQ ID NO: 1503422 - protein, 18 aa, Mycobacterium tuberculosis
EPSEAVVAAARWARSELD

SEQ ID NO: 1503423 - protein, 17 aa, Mycobacterium tuberculosis
EPSLLAVEPPDHTRYRK

SEQ ID NO: 1503424 - protein, 24 aa, Mycobacterium tuberculosis
EPSMDGVLLHYFLHAEPTGVAAWQ

SEQ ID NO: 1503425 - protein, 25 aa, Mycobacterium tuberculosis
EQAFYAALEFWSALHGFVLLEMTGV

SEQ ID NO: 1503426 - protein, 23 aa, Mycobacterium tuberculosis
EQAQQLLLRLLPDSGNAHRVGIT

SEQ ID NO: 1503427 - protein, 24 aa, Mycobacterium tuberculosis
EQKQKWLPDLTSGRALAGFGLTEP

SEQ ID NO: 1503428 - protein, 28 aa, Mycobacterium tuberculosis
EQPRQEDLLNRWTWIPFGAGRHRCVGAA

SEQ ID NO: 1503429 - protein, 22 aa, Mycobacterium tuberculosis
EQRPSFRRTVKWRTGSEGRIST

SEQ ID NO: 1503430 - protein, 24 aa, Mycobacterium tuberculosis
EQVGPMLADWAKWGQARHNYFLRP

SEQ ID NO: 1503431 - protein, 18 aa, Mycobacterium tuberculosis
EQVMTARGLALVRDDSLT

SEQ ID NO: 1503432 - protein, 25 aa, Mycobacterium tuberculosis
ERARAGLFLAMQYPVEVPGVSMSNF

SEQ ID NO: 1503433 - protein, 30 aa, Mycobacterium tuberculosis; identical to SEQ ID NO: 217758

SEQ ID NO: 1503434 - protein, 25 aa, Mycobacterium tuberculosis
EREYRTRLKTYLESQLEELGQRGSA

SEQ ID NO: 1503435 - protein, 25 aa, Mycobacterium tuberculosis
ERGIPLTMEMAKFIRFIVTDIFPGG

SEQ ID NO: 1503436 - protein, 18 aa, Mycobacterium tuberculosis
ERILAELAEHARATFAEI

SEQ ID NO: 1503437 - protein, 24 aa, Mycobacterium tuberculosis
ERLEPALRTVPLELARTWVGLAGT

SEQ ID NO: 1503438 - protein, 26 aa, Mycobacterium tuberculosis
ERLRQTIPELPWLSRRRIQQEWGVSD

SEQ ID NO: 1503439 - protein, 25 aa, Mycobacterium tuberculosis
ERNQPWPYAHRLPPSGASNGLVRRV

SEQ ID NO: 1503440 - protein, 21 aa, Mycobacterium tuberculosis
ERPVTSLIRASAAAALVCVGA

SEQ ID NO: 1503441 - protein, 24 aa, Mycobacterium tuberculosis
ERSSHTWFVLTHLLGKADVRNYDG

SEQ ID NO: 1503442 - protein, 17 aa, Mycobacterium tuberculosis
ESAIDSWRRVVSTAAQL

SEQ ID NO: 1503443 - protein, 21 aa, Mycobacterium tuberculosis
ESFGFKYGLPMDADMVMDVRF

SEQ ID NO: 1503444 - protein, 27 aa, Mycobacterium tuberculosis
ESNAPVLLGLIGLWYSNFFGAQSRTVL

SEQ ID NO: 1503445 - protein, 24 aa, Mycobacterium tuberculosis
ESPKPLGMPLQYMVSGMAVKATHK

SEQ ID NO: 1503446 - protein, 26 aa, Mycobacterium tuberculosis
ESSLSEGLLYERRLFHSAFATEDQSE

SEQ ID NO: 1503447 - protein, 23 aa, Mycobacterium tuberculosis
ESYAPLMAYLVRSMQSGGELAKM

SEQ ID NO: 1503448 - protein, 18 aa, Mycobacterium tuberculosis
ETGLLPAELFAEAISQVA

SEQ ID NO: 1503449 - protein, 21 aa, Mycobacterium tuberculosis
ETHTWAYWRAPLQAMLPDLQR

SEQ ID NO: 1503450 - protein, 25 aa, Mycobacterium tuberculosis
ETQAVLALLESPLGQLLHAAATGKL

SEQ ID NO: 1503451 - protein, 20 aa, Mycobacterium tuberculosis
ETRIGLINWLIQDPGNAAVA

SEQ ID NO: 1503452 - protein, 29 aa, Mycobacterium tuberculosis
ETRRILDRLYGYEVSPVLWKKVAPKLSAG

SEQ ID NO: 1503453 - protein, 28 aa, Mycobacterium tuberculosis
ETSKRYMHHYNFPPFSTGETGRVGSPKR

SEQ ID NO: 1503454 - protein, 25 aa, Mycobacterium tuberculosis
ETVDLAGDYLDFLRICVIATEFELV

SEQ ID NO: 1503455 - protein, 24 aa, Mycobacterium tuberculosis
EVGPTLHRLIRGADGRVIVACFAS

SEQ ID NO: 1503456 - protein, 36 aa, Mycobacterium tuberculosis; identical to SEQ ID NO: 217857

SEQ ID NO: 1503457 - protein, 18 aa, Mycobacterium tuberculosis
EVIRILQRYKDLQDIIAI

SEQ ID NO: 1503458 - protein, 18 aa, Mycobacterium tuberculosis
EVLVKYTAAGLCHSDLHL

SEQ ID NO: 1503459 - protein, 18 aa, Mycobacterium tuberculosis
EVMQANLAELPLPDASVD

SEQ ID NO: 1503460 - protein, 17 aa, Mycobacterium tuberculosis
EVNSVRMYAGPGSAPMV

SEQ ID NO: 1503461 - protein, 17 aa, Mycobacterium tuberculosis
EWARFVAACDLVRGAHA

SEQ ID NO: 1503462 - protein, 26 aa, Mycobacterium tuberculosis
EWEWPANPRFLMCTPLSHAGAAFFTP

SEQ ID NO: 1503463 - protein, 19 aa, Mycobacterium tuberculosis
EYGRTVVVLTIDPAKRLAQ

SEQ ID NO: 1503464 - protein, 18 aa, Mycobacterium tuberculosis
EYHWGPDWVCWDADQTFQ

SEQ ID NO: 1503465 - protein, 31 aa, Mycobacterium tuberculosis; identical to SEQ ID NO: 217912

SEQ ID NO: 1503466 - protein, 18 aa, Mycobacterium tuberculosis
FADYDAGLHWFRAALDAR

SEQ ID NO: 1503467 - protein, 24 aa, Mycobacterium tuberculosis
FAERFGRFNFAAAALRPAYGMAEA

SEQ ID NO: 1503468 - protein, 18 aa, Mycobacterium tuberculosis
FAHRVFQELAGLATLPGL

SEQ ID NO: 1503469 - protein, 25 aa, Mycobacterium tuberculosis
FAQAVIDAGLIWIGPSPQSIRDLGD

SEQ ID NO: 1503470 - protein, 20 aa, Mycobacterium tuberculosis
FDDLAWIKSQWPGKLVVKGI

SEQ ID NO: 1503471 - protein, 27 aa, Mycobacterium tuberculosis
FDSLPLLIKVVKHPSAWRGWLTTMRSR

SEQ ID NO: 1503472 - protein, 29 aa, Mycobacterium tuberculosis
FEITVDPQVPLPGFVLKRAIKGTIDTATE

SEQ ID NO: 1503473 - protein, 35 aa, Mycobacterium tuberculosis; identical to SEQ ID NO: 217956

SEQ ID NO: 1503474 - protein, 17 aa, Mycobacterium tuberculosis
FESMRTLAPPTARGWEV

SEQ ID NO: 1503475 - protein, 21 aa, Mycobacterium tuberculosis
FEVAWRILQATPVTATGLVSA

SEQ ID NO: 1503476 - protein, 18 aa, Mycobacterium tuberculosis
FFDLLLSERGSGLDWGKT

SEQ ID NO: 1503477 - protein, 25 aa, Mycobacterium tuberculosis
FGGGSMFLLVGILAALWERQSSGKG

SEQ ID NO: 1503478 - protein, 24 aa, Mycobacterium tuberculosis
FGHFLNRLRALTHDDFRNAWFVDA

SEQ ID NO: 1503479 - protein, 17 aa, Mycobacterium tuberculosis
FGHPWEFGPRKTKELLL

SEQ ID NO: 1503480 - protein, 24 aa, Mycobacterium tuberculosis
FGPSFMINWLHNRYGNYKSESILI

SEQ ID NO: 1503481 - protein, 29 aa, Mycobacterium tuberculosis
FGTAFEGTPPGLPPLVFCTDATSFPTMRT

SEQ ID NO: 1503482 - protein, 20 aa, Mycobacterium tuberculosis
FGTALHPRFGPDSSARHRRS

SEQ ID NO: 1503483 - protein, 24 aa, Mycobacterium tuberculosis
FHGFEPLPHRGGAVSNALIDRLRD

SEQ ID NO: 1503484 - protein, 22 aa, Mycobacterium tuberculosis
FHLADYQPGLGPLLDRYRGRDV

SEQ ID NO: 1503485 - protein, 23 aa, Mycobacterium tuberculosis
FHVYARIAPCWSFPQVRLAAQTV

SEQ ID NO: 1503486 - protein, 27 aa, Mycobacterium tuberculosis
FILASDSAFFMLANTKVALMPDGGASA

SEQ ID NO: 1503487 - protein, 24 aa, Mycobacterium tuberculosis
FKKERYLTFFERSYDILPDDGRML

SEQ ID NO: 1503488 - protein, 26 aa, Mycobacterium tuberculosis
FLAMDLEFLGRKDLGDYFLAGYAVRS

SEQ ID NO: 1503489 - protein, 19 aa, Mycobacterium tuberculosis
FLETNVMGTYRVLEAVRRY

SEQ ID NO: 1503490 - protein, 21 aa, Mycobacterium tuberculosis
FLGQRIKPPYVAAYVLLDGAD

SEQ ID NO: 1503491 - protein, 30 aa, Mycobacterium tuberculosis; identical to SEQ ID NO: 218051

SEQ ID NO: 1503492 - protein, 19 aa, Mycobacterium tuberculosis
FLNNLQKGTIRKGVVSSIV

SEQ ID NO: 1503493 - protein, 19 aa, Mycobacterium tuberculosis
FLPASLVEMRRVRDLQPYI

SEQ ID NO: 1503494 - protein, 22 aa, Mycobacterium tuberculosis
FMTFNLMHIAQMLRVAGGIPAY

SEQ ID NO: 1503495 - protein, 26 aa, Mycobacterium tuberculosis
FNEHRRKFLSLLRDPSVHRIVVEHRD

SEQ ID NO: 1503496 - protein, 19 aa, Mycobacterium tuberculosis
FNTVYLDDVFVPDELVLGE

SEQ ID NO: 1503497 - protein, 18 aa, Mycobacterium tuberculosis
FPACLDPLRQSLPGKAIE

SEQ ID NO: 1503498 - protein, 25 aa, Mycobacterium tuberculosis
FPKGVMWRHEDIYRVLFGGTDFATG

SEQ ID NO: 1503499 - protein, 26 aa, Mycobacterium tuberculosis
FPVTDFNVSLPWTKMVVLNPGVQTES

SEQ ID NO: 1503500 - protein, 17 aa, Mycobacterium tuberculosis
FQVLLNHPRLARTFNDL

SEQ ID NO: 1503501 - protein, 17 aa, Mycobacterium tuberculosis
FRLIAIDRPGYGRSTFQ

SEQ ID NO: 1503502 - protein, 17 aa, Mycobacterium tuberculosis
FRPGTMEKLGLGPDDLR

SEQ ID NO: 1503503 - protein, 42 aa, Mycobacterium tuberculosis; identical to SEQ ID NO: 218104

SEQ ID NO: 1503504 - protein, 17 aa, Mycobacterium tuberculosis
FTASFAGLVPNAGLGAY

SEQ ID NO: 1503505 - protein, 17 aa, Mycobacterium tuberculosis
FTAVRRSVTVDGVATDI

SEQ ID NO: 1503506 - protein, 29 aa, Mycobacterium tuberculosis
FTENYVILNDFPLFWDPRLLERDVHLPRF

SEQ ID NO: 1503507 - protein, 18 aa, Mycobacterium tuberculosis
FTNICYTGCRFCAFAQRK

SEQ ID NO: 1503508 - protein, 19 aa, Mycobacterium tuberculosis
FTPRYNPWDQRLCLIPDAD

SEQ ID NO: 1503509 - protein, 28 aa, Mycobacterium tuberculosis
FTVPEPLSLRPHYIKTLRIWGDTLQSNK

SEQ ID NO: 1503510 - protein, 25 aa, Mycobacterium tuberculosis
FTVPNLVWASFLRLTTNRRIFEIPS

SEQ ID NO: 1503511 - protein, 25 aa, Mycobacterium tuberculosis
FVENYNLNMAIPWIAAERGFIDAVI

SEQ ID NO: 1503512 - protein, 17 aa, Mycobacterium tuberculosis
FYELVSRVGLERARRVV

SEQ ID NO: 1503513 - protein, 34 aa, Mycobacterium tuberculosis; identical to SEQ ID NO: 218158

SEQ ID NO: 1503514 - protein, 26 aa, Mycobacterium tuberculosis
GADLNNALLALLPLVGVWRGEGEGRG

SEQ ID NO: 1503515 - protein, 18 aa, Mycobacterium tuberculosis
GAGLTLALAADWRVSGDN

SEQ ID NO: 1503516 - protein, 31 aa, Mycobacterium tuberculosis; identical to SEQ ID NO: 218199

SEQ ID NO: 1503517 - protein, 28 aa, Mycobacterium tuberculosis
GAKDQLRFTAPPRLDLSLLASALPEGYQ

SEQ ID NO: 1503518 - protein, 18 aa, Mycobacterium tuberculosis
GAPDIKLLQPVPAGDPSK

SEQ ID NO: 1503519 - protein, 19 aa, Mycobacterium tuberculosis
GAQAIRGGLADCVLALGFE

SEQ ID NO: 1503520 - protein, 18 aa, Mycobacterium tuberculosis
GAQPILLGAGWEGGWRCG

SEQ ID NO: 1503521 - protein, 23 aa, Mycobacterium tuberculosis
GARGTFFARCEQALRAAGRSFVV

SEQ ID NO: 1503522 - protein, 23 aa, Mycobacterium tuberculosis
GARVDLAGWDLWVSGKAEAMSDE

SEQ ID NO: 1503523 - protein, 22 aa, Mycobacterium tuberculosis
GATRVFALRPRGRGPSLRLPLA

SEQ ID NO: 1503524 - protein, 24 aa, Mycobacterium tuberculosis
GAVLHTLNIRLFPEQIAYVTNEAE

SEQ ID NO: 1503525 - protein, 19 aa, Mycobacterium tuberculosis
GCATPARVFKGTRMAGRMG

SEQ ID NO: 1503526 - protein, 31 aa, Mycobacterium tuberculosis; identical to SEQ ID NO: 218248

SEQ ID NO: 1503527 - protein, 20 aa, Mycobacterium tuberculosis
GCYGIQRIHPLRNVMILAGA

SEQ ID NO: 1503528 - protein, 27 aa, Mycobacterium tuberculosis
GDDDNEAKWFWFEGNFGAYEENKVERL

SEQ ID NO: 1503529 - protein, 29 aa, Mycobacterium tuberculosis
GDGSSWINRLYWNLADYAGSPVRIIGYAN

SEQ ID NO: 1503530 - protein, 21 aa, Mycobacterium tuberculosis
GDLVAYRYLDHARSAAGCALE

SEQ ID NO: 1503531 - protein, 20 aa, Mycobacterium tuberculosis
GDMPNDVPMLLRAGLGVAMG

SEQ ID NO: 1503532 - protein, 24 aa, Mycobacterium tuberculosis
GDRVDLLIDVLAAALPAGPAYYPD

SEQ ID NO: 1503533 - protein, 17 aa, Mycobacterium tuberculosis
GDTWAAIGVALGITRQA

SEQ ID NO: 1503534 - protein, 20 aa, Mycobacterium tuberculosis
GDVWALLVDGNFGSGLPPAE

SEQ ID NO: 1503535 - protein, 19 aa, Mycobacterium tuberculosis
GDVYTSVAVWFPETAKPAP

SEQ ID NO: 1503536 - protein, 27 aa, Mycobacterium tuberculosis
GDYQEPGLREAGFWRFVADPYDPSESQ

SEQ ID NO: 1503537 - protein, 24 aa, Mycobacterium tuberculosis
GEAWSLAVALRLAAYQLLRVDGGE

SEQ ID NO: 1503538 - protein, 25 aa, Mycobacterium tuberculosis
GEDGVIAWLLAGPEHTYRVPLPAPG

SEQ ID NO: 1503539 - protein, 19 aa, Mycobacterium tuberculosis
GELFNIPLTAHFLGGAVIG

SEQ ID NO: 1503540 - protein, 18 aa, Mycobacterium tuberculosis
GELLDYLAGLGRSVHMVV

SEQ ID NO: 1503541 - protein, 24 aa, Mycobacterium tuberculosis
GEQLDWGTYVFDFGRPEVRNFLVA

SEQ ID NO: 1503542 - protein, 21 aa, Mycobacterium tuberculosis
GETLYRRFMSARVPSPALMHY

SEQ ID NO: 1503543 - protein, 23 aa, Mycobacterium tuberculosis
GEVDVRIWIHPDHRKKGYGTAAL

SEQ ID NO: 1503544 - protein, 31 aa, Mycobacterium tuberculosis; identical to SEQ ID NO: 218340

SEQ ID NO: 1503545 - protein, 20 aa, Mycobacterium tuberculosis
GFAIPAAMGAKIALPGTEVW

SEQ ID NO: 1503546 - protein, 24 aa, Mycobacterium tuberculosis
GFQLGRLAAILRDKRIPLELCPSS

SEQ ID NO: 1503547 - protein, 22 aa, Mycobacterium tuberculosis
GFRAREIVLTLFEKITGLRMNS

SEQ ID NO: 1503548 - protein, 27 aa, Mycobacterium tuberculosis
GFTEFVPLPFVHQNSPLYLAGAARPGP

SEQ ID NO: 1503549 - protein, 23 aa, Mycobacterium tuberculosis
GGADTVLVHPFDVAIPGGFPGTA

SEQ ID NO: 1503550 - protein, 25 aa, Mycobacterium tuberculosis
GGCAGLRYNLFFDDRTLDGDQTAEF

SEQ ID NO: 1503551 - protein, 26 aa, Mycobacterium tuberculosis
GGEEALYLRPFIFATEPGLGVRPATQ

SEQ ID NO: 1503552 - protein, 20 aa, Mycobacterium tuberculosis
GGEMIVLAKFDPAEVLRIIE

SEQ ID NO: 1503553 - protein, 25 aa, Mycobacterium tuberculosis
GGKPYGVDVLLPPKYIGAEQGGIDA

SEQ ID NO: 1503554 - protein, 26 aa, Mycobacterium tuberculosis
GGLVTRSFSPRWRGLKADVVHVDPDP

SEQ ID NO: 1503555 - protein, 24 aa, Mycobacterium tuberculosis
GGMELGAMTPMFVGFRAREIVLTL

SEQ ID NO: 1503556 - protein, 25 aa, Mycobacterium tuberculosis
GGMGGDYFALSLVLEELGKVDQSVA

SEQ ID NO: 1503557 - protein, 23 aa, Mycobacterium tuberculosis
GGRELDLWLHRAAVDLVAVHADQ

SEQ ID NO: 1503558 - protein, 17 aa, Mycobacterium tuberculosis
GGRVKDLPGVRYKIIRG

SEQ ID NO: 1503559 - protein, 26 aa, Mycobacterium tuberculosis
GGVKGFFEKTFAPLGLKKIQAEVLSN

SEQ ID NO: 1503560 - protein, 25 aa, Mycobacterium tuberculosis
GGVSPDRWLLALRAELELAAAKLDA

SEQ ID NO: 1503561 - protein, 29 aa, Mycobacterium tuberculosis
GGVVNEEVAPWLDLVRKLGVLAGVLSDEL

SEQ ID NO: 1503562 - protein, 28 aa, Mycobacterium tuberculosis
GGYRDTEIMRWLFTPDPSLTITRDGSRD

SEQ ID NO: 1503563 - protein, 26 aa, Mycobacterium tuberculosis
GHLPKGLGVIGLLIEDPKPLRLDDVS

SEQ ID NO: 1503564 - protein, 25 aa, Mycobacterium tuberculosis
GIANVRILDGGLPAWRSAGGSIETG

SEQ ID NO: 1503565 - protein, 18 aa, Mycobacterium tuberculosis
GIDMYWPGRLDGCAEPHV

SEQ ID NO: 1503566 - protein, 24 aa, Mycobacterium tuberculosis
GIEKNLEYRYWTQGVTFVTRMDYL

SEQ ID NO: 1503567 - protein, 25 aa, Mycobacterium tuberculosis
GIGFVFQHYAAFKHLTVRDNVAFGL

SEQ ID NO: 1503568 - protein, 27 aa, Mycobacterium tuberculosis
GIPTPGFSSALSYYDALRTARLPAALT

SEQ ID NO: 1503569 - protein, 31 aa, Mycobacterium tuberculosis; identical to SEQ ID NO: 218524

SEQ ID NO: 1503570 - protein, 38 aa, Mycobacterium tuberculosis; identical to SEQ ID NO: 218525

SEQ ID NO: 1503571 - protein, 24 aa, Mycobacterium tuberculosis
GKGSLIHTTWSPEGWVRVAGRVVS

SEQ ID NO: 1503572 - protein, 25 aa, Mycobacterium tuberculosis
GKNVVTPLGWFYPSEKEAAPLEVAA

SEQ ID NO: 1503573 - protein, 23 aa, Mycobacterium tuberculosis
GKVRRVRLLPTDPPATRQAVDAI

SEQ ID NO: 1503574 - protein, 24 aa, Mycobacterium tuberculosis
GKYQSLDFRFPYPDASFDVVFLTS

SEQ ID NO: 1503575 - protein, 17 aa, Mycobacterium tuberculosis
GLAEIQLPDLQPGSSIM

SEQ ID NO: 1503576 - protein, 19 aa, Mycobacterium tuberculosis
GLARDLAFIAFSSADGDLV

SEQ ID NO: 1503577 - protein, 24 aa, Mycobacterium tuberculosis
GLATVIPFHRAVVSDPAFIGDANG

SEQ ID NO: 1503578 - protein, 18 aa, Mycobacterium tuberculosis
GLDEDLLQVLPGKGTVVG

SEQ ID NO: 1503579 - protein, 30 aa, Mycobacterium tuberculosis; identical to SEQ ID NO: 218559

SEQ ID NO: 1503580 - protein, 25 aa, Mycobacterium tuberculosis
GLGGFAGLFTLRGDYREPVLAASSD

SEQ ID NO: 1503581 - protein, 38 aa, Mycobacterium tuberculosis; identical to SEQ ID NO: 218579

SEQ ID NO: 1503582 - protein, 19 aa, Mycobacterium tuberculosis
GLLETYHDVLRLPVDLVVT

SEQ ID NO: 1503583 - protein, 22 aa, Mycobacterium tuberculosis
GLPEMGLVGRQLWAQSGLTPAD

SEQ ID NO: 1503584 - protein, 24 aa, Mycobacterium tuberculosis
GLQHAIRVLRYPTLEDDYANAWQE

SEQ ID NO: 1503585 - protein, 24 aa, Mycobacterium tuberculosis
GLRAAYLPCRLAPHVGALTTSLDL

SEQ ID NO: 1503586 - protein, 23 aa, Mycobacterium tuberculosis
GLSKIARLVDLYAKRPQVQERLT

SEQ ID NO: 1503587 - protein, 27 aa, Mycobacterium tuberculosis
GLVDRALIAAYAGGLTPILCLTKTDLA

SEQ ID NO: 1503588 - protein, 32 aa, Mycobacterium tuberculosis; identical to SEQ ID NO: 218613

SEQ ID NO: 1503589 - protein, 19 aa, Mycobacterium tuberculosis
GMFSRITIDYYGAATPITQ

SEQ ID NO: 1503590 - protein, 19 aa, Mycobacterium tuberculosis
GMNIFFVLGSGGSARLVTP

SEQ ID NO: 1503591 - protein, 25 aa, Mycobacterium tuberculosis
GMPPMAPLAPLLPAAADIGLHIIVT

SEQ ID NO: 1503592 - protein, 23 aa, Mycobacterium tuberculosis
GMRGLLRVIGAEHPHLKASYVDV

SEQ ID NO: 1503593 - protein, 25 aa, Mycobacterium tuberculosis
GMTETSPLATMAWPPPGTPDDQHWA

SEQ ID NO: 1503594 - protein, 23 aa, Mycobacterium tuberculosis
GMVRQWQSLFYAERYSQTDLATH

SEQ ID NO: 1503595 - protein, 25 aa, Mycobacterium tuberculosis
GNATRARIVLFRKPIERRAKDTEEL

SEQ ID NO: 1503596 - protein, 17 aa, Mycobacterium tuberculosis
GNDLRGLNLTGCRLRET

SEQ ID NO: 1503597 - protein, 24 aa, Mycobacterium tuberculosis
GNVTQVLPGIHPVIGLDAGAATVH

SEQ ID NO: 1503598 - protein, 23 aa, Mycobacterium tuberculosis
GPAFQGTIKSAVAFGALLSRGIG

SEQ ID NO: 1503599 - protein, 23 aa, Mycobacterium tuberculosis
GPALLGPIGMIVAAALRADIRES

SEQ ID NO: 1503600 - protein, 25 aa, Mycobacterium tuberculosis
GPDDPRPWLVDGERLRLLLREVFTA

SEQ ID NO: 1503601 - protein, 28 aa, Mycobacterium tuberculosis
GPDGQPHLTAMWYAVIDGEIWLETKAKS

SEQ ID NO: 1503602 - protein, 22 aa, Mycobacterium tuberculosis
GPFYDGAVFHRVIQGFMIQGGD

SEQ ID NO: 1503603 - protein, 26 aa, Mycobacterium tuberculosis
GPNIDDFRLYELIWQRTVASQMADAR

SEQ ID NO: 1503604 - protein, 22 aa, Mycobacterium tuberculosis
GPQDMFFLYSESSTTMMHVGAL

SEQ ID NO: 1503605 - protein, 17 aa, Mycobacterium tuberculosis
GPQRFTPGGLVLTEWQG

SEQ ID NO: 1503606 - protein, 24 aa, Mycobacterium tuberculosis
GPTMTQYYIIRTENLPLLEPLRSV

SEQ ID NO: 1503607 - protein, 28 aa, Mycobacterium tuberculosis
GQRAKNMFALGLLSWMYGRELEHSEAFI

SEQ ID NO: 1503608 - protein, 21 aa, Mycobacterium tuberculosis
GQRFVIDVTVWIDLAEAANSD

SEQ ID NO: 1503609 - protein, 25 aa, Mycobacterium tuberculosis
GQTKWAVRWKPALNALAITFADRMP

SEQ ID NO: 1503610 - protein, 23 aa, Mycobacterium tuberculosis
GQVDVYNMGWQRYVDARATDEQR

SEQ ID NO: 1503611 - protein, 24 aa, Mycobacterium tuberculosis
GRAALQKAVPLWRGVQAEVTASVG

SEQ ID NO: 1503612 - protein, 25 aa, Mycobacterium tuberculosis
GRGIGRRLLRELLDFARGGVVYLEV

SEQ ID NO: 1503613 - protein, 26 aa, Mycobacterium tuberculosis
GRIDPRTRWLLRELVYALLVKKDHAA

SEQ ID NO: 1503614 - protein, 19 aa, Mycobacterium tuberculosis
GRIGRLPKPEPLRTFVARL

SEQ ID NO: 1503615 - protein, 33 aa, Mycobacterium tuberculosis; identical to SEQ ID NO: 218776

SEQ ID NO: 1503616 - protein, 21 aa, Mycobacterium tuberculosis
GRPPRFCRRVGVRPPAPAALP

SEQ ID NO: 1503617 - protein, 19 aa, Mycobacterium tuberculosis
GRQVPKVMEVLLAESVRAD

SEQ ID NO: 1503618 - protein, 21 aa, Mycobacterium tuberculosis
GRRFHGLAVDVGNPHLACVDS

SEQ ID NO: 1503619 - protein, 18 aa, Mycobacterium tuberculosis
GRRVLAVLGLVERAARGR

SEQ ID NO: 1503620 - protein, 21 aa, Mycobacterium tuberculosis
GRTWHPHQVPAFLAAGYRCIT

SEQ ID NO: 1503621 - protein, 26 aa, Mycobacterium tuberculosis
GSAHAPFAPVPWLADVLRAGVPDGPV

SEQ ID NO: 1503622 - protein, 32 aa, Mycobacterium tuberculosis; identical to SEQ ID NO: 218813

SEQ ID NO: 1503623 - protein, 22 aa, Mycobacterium tuberculosis
GSALVPSWVAFAVTGLLEQHFG

SEQ ID NO: 1503624 - protein, 26 aa, Mycobacterium tuberculosis
GSATPVHLPFADLSFPAGVTVDRDDS

SEQ ID NO: 1503625 - protein, 26 aa, Mycobacterium tuberculosis
GSGLASIYRLRLALPQLDPGTLTLGR

SEQ ID NO: 1503626 - protein, 17 aa, Mycobacterium tuberculosis
GSGRWPGRLLGSVSSGL

SEQ ID NO: 1503627 - protein, 25 aa, Mycobacterium tuberculosis
GSTGSLLMALLGDAGVPFRVIPIAA

SEQ ID NO: 1503628 - protein, 24 aa, Mycobacterium tuberculosis
GSTRPLTVVAGAASRWAWVTDADG

SEQ ID NO: 1503629 - protein, 22 aa, Mycobacterium tuberculosis
GTALRLLERKIAQLPPKKHGNV

SEQ ID NO: 1503630 - protein, 24 aa, Mycobacterium tuberculosis
GTEAPAEMHFYFPRFRALCMAENA

SEQ ID NO: 1503631 - protein, 27 aa, Mycobacterium tuberculosis
GTIGVISWTCEGFFGRMLATIRPYRPS

SEQ ID NO: 1503632 - protein, 25 aa, Mycobacterium tuberculosis
GTKGLSLYFVPKFLFDVETGEPGER

SEQ ID NO: 1503633 - protein, 25 aa, Mycobacterium tuberculosis
GTKRRLVEYYFAVAGGPMLTALRDR

SEQ ID NO: 1503634 - protein, 25 aa, Mycobacterium tuberculosis
GTLQSELIRLARYPLLVVDEVGYIP

SEQ ID NO: 1503635 - protein, 24 aa, Mycobacterium tuberculosis
GTSDAILHVLAHDMRHLEAALERI

SEQ ID NO: 1503636 - protein, 19 aa, Mycobacterium tuberculosis
GTTYEIPPATLPPGEYRQI

SEQ ID NO: 1503637 - protein, 27 aa, Mycobacterium tuberculosis
GTVEAYLHRRSADLPPAVGVLVEYRGD

SEQ ID NO: 1503638 - protein, 27 aa, Mycobacterium tuberculosis
GVCQDFVHLSLMVLRSMGIPCRYVSGY

SEQ ID NO: 1503639 - protein, 27 aa, Mycobacterium tuberculosis
GVDTFASYIAALLWFGEFSGCGIKASM

SEQ ID NO: 1503640 - protein, 22 aa, Mycobacterium tuberculosis
GVEHTWLGFVDSGLPKGDLPPP

SEQ ID NO: 1503641 - protein, 22 aa, Mycobacterium tuberculosis
GVKDAFVLIRRADIQTAVHLSD

SEQ ID NO: 1503642 - protein, 20 aa, Mycobacterium tuberculosis
GVPFYDHMLTALGSHASFDL

SEQ ID NO: 1503643 - protein, 25 aa, Mycobacterium tuberculosis
GVPLWTTRAKRWLRRRTGAEHPAVA

SEQ ID NO: 1503644 - protein, 20 aa, Mycobacterium tuberculosis
GVSFLADEIGRFIRAALAGR

SEQ ID NO: 1503645 - protein, 18 aa, Mycobacterium tuberculosis
GVSRPTVVRLIKSGELAA

SEQ ID NO: 1503646 - protein, 24 aa, Mycobacterium tuberculosis
GVSRPTVYRRWPDTRSIMASMLTS

SEQ ID NO: 1503647 - protein, 25 aa, Mycobacterium tuberculosis
GVVLGNTWFWPADTLAMKAFSRVMS

SEQ ID NO: 1503648 - protein, 41 aa, Mycobacterium tuberculosis; identical to SEQ ID NO: 218981

SEQ ID NO: 1503649 - protein, 37 aa, Mycobacterium tuberculosis; identical to SEQ ID NO: 218983

SEQ ID NO: 1503650 - protein, 20 aa, Mycobacterium tuberculosis
GWDYPACEAIGLLKMDFLGL

SEQ ID NO: 1503651 - protein, 17 aa, Mycobacterium tuberculosis
GWFNTSPVGLLAGSGYQ

SEQ ID NO: 1503652 - protein, 21 aa, Mycobacterium tuberculosis
GWGHRTVGLGLRQKLDRVAQG

SEQ ID NO: 1503653 - protein, 24 aa, Mycobacterium tuberculosis
GWHNARVIPYGPIELDPSAIVLHY

SEQ ID NO: 1503654 - protein, 21 aa, Mycobacterium tuberculosis
GYIGVTRWWNVKHPNTYAEIL

SEQ ID NO: 1503655 - protein, 21 aa, Mycobacterium tuberculosis
GYMAVTPPQPRWIISESILNR

SEQ ID NO: 1503656 - protein, 19 aa, Mycobacterium tuberculosis
HAASHWRGLSKAGKAPKDI

SEQ ID NO: 1503657 - protein, 25 aa, Mycobacterium tuberculosis
HAVWALMDYGFRVVISSRFGDIFRG

SEQ ID NO: 1503658 - protein, 19 aa, Mycobacterium tuberculosis
HAYEILSSIRLPGGHFRSD

SEQ ID NO: 1503659 - protein, 26 aa, Mycobacterium tuberculosis
HDHCSAFHPLGVGSPFWAAIDLQRYG

SEQ ID NO: 1503660 - protein, 31 aa, Mycobacterium tuberculosis; identical to SEQ ID NO: 219048

SEQ ID NO: 1503661 - protein, 20 aa, Mycobacterium tuberculosis
HDLGVRTVAIPRKGRPSQAR

SEQ ID NO: 1503662 - protein, 26 aa, Mycobacterium tuberculosis
HDLSDPLWSARLLVDAPHAITAVHTA

SEQ ID NO: 1503663 - protein, 29 aa, Mycobacterium tuberculosis
HDRRVGLLLQDPLLFPHLSVAKNVAFGPQ

SEQ ID NO: 1503664 - protein, 24 aa, Mycobacterium tuberculosis
HDTTHPLFFNIPTPGRSPADTQDS

SEQ ID NO: 1503665 - protein, 25 aa, Mycobacterium tuberculosis
HEIGHYYFYRLIASSSDYLSRFNEL

SEQ ID NO: 1503666 - protein, 28 aa, Mycobacterium tuberculosis
HEPELRAIFINSVWAPRLRIVESILQAG

SEQ ID NO: 1503667 - protein, 25 aa, Mycobacterium tuberculosis
HESALFRLMRSPLMPITPRDHVDVH

SEQ ID NO: 1503668 - protein, 30 aa, Mycobacterium tuberculosis; identical to SEQ ID NO: 219073

SEQ ID NO: 1503669 - protein, 19 aa, Mycobacterium tuberculosis
HEVLLDCDSPHVGAALRAI

SEQ ID NO: 1503670 - protein, 25 aa, Mycobacterium tuberculosis
HFDAQAMHLALEAIWLMLGDANKYF

SEQ ID NO: 1503671 - protein, 17 aa, Mycobacterium tuberculosis
HFFRSVLRWLQVGYPEG

SEQ ID NO: 1503672 - protein, 26 aa, Mycobacterium tuberculosis
HFKSVAYELLWFLRGDSNIGWLHEHG

SEQ ID NO: 1503673 - protein, 28 aa, Mycobacterium tuberculosis
HGADDVFITYPLWIGTRQADRLRQLADR

SEQ ID NO: 1503674 - protein, 32 aa, Mycobacterium tuberculosis; identical to SEQ ID NO: 219088

SEQ ID NO: 1503675 - protein, 31 aa, Mycobacterium tuberculosis; identical to SEQ ID NO: 219092

SEQ ID NO: 1503676 - protein, 25 aa, Mycobacterium tuberculosis
HGLCGYRRFFSITSLAGLRQEDRAV

SEQ ID NO: 1503677 - protein, 24 aa, Mycobacterium tuberculosis
HGLLRGLPLGSRITRRSGAFAHRY

SEQ ID NO: 1503678 - protein, 19 aa, Mycobacterium tuberculosis
HGPRYLWTRTVAGRGTKGR

SEQ ID NO: 1503679 - protein, 30 aa, Mycobacterium tuberculosis; identical to SEQ ID NO: 219103

SEQ ID NO: 1503680 - protein, 27 aa, Mycobacterium tuberculosis
HGYRVSPGTLYPTLHRLEADGLLVSEQ

SEQ ID NO: 1503681 - protein, 27 aa, Mycobacterium tuberculosis
HIAGVDTFFVATAPRYSFVSSSLAKEV

SEQ ID NO: 1503682 - protein, 30 aa, Mycobacterium tuberculosis; identical to SEQ ID NO: 219117

SEQ ID NO: 1503683 - protein, 30 aa, Mycobacterium tuberculosis; identical to SEQ ID NO: 219118

SEQ ID NO: 1503684 - protein, 27 aa, Mycobacterium tuberculosis
HILEVQRLIRFMPKVVICLVNGWAAGG

SEQ ID NO: 1503685 - protein, 17 aa, Mycobacterium tuberculosis
HKLPPRILAAVVEFAFG

SEQ ID NO: 1503686 - protein, 19 aa, Mycobacterium tuberculosis
HLAQCNWLVPSDQLGGLCS

SEQ ID NO: 1503687 - protein, 17 aa, Mycobacterium tuberculosis
HLATRLSAMFRTRRFRV

SEQ ID NO: 1503688 - protein, 25 aa, Mycobacterium tuberculosis
HLLSAPAIKLLIRKAGAASADMAAE

SEQ ID NO: 1503689 - protein, 25 aa, Mycobacterium tuberculosis
HNFHRKIVELNVLAPLLVSQHANVL

SEQ ID NO: 1503690 - protein, 19 aa, Mycobacterium tuberculosis
HPFLQHLLAHRDVTRLKVT

SEQ ID NO: 1503691 - protein, 26 aa, Mycobacterium tuberculosis
HPGIVAPPAMIQVWTMMGLGGVRPKD

SEQ ID NO: 1503692 - protein, 22 aa, Mycobacterium tuberculosis
HPVLLESYLDGPEVSLFCVVDR

SEQ ID NO: 1503693 - protein, 33 aa, Mycobacterium tuberculosis; identical to SEQ ID NO: 219178

SEQ ID NO: 1503694 - protein, 23 aa, Mycobacterium tuberculosis
HRGLTYFMFDLKAKGVTVRPIAQ

SEQ ID NO: 1503695 - protein, 20 aa, Mycobacterium tuberculosis
HRLAERLLVDVIGLPWEEVH

SEQ ID NO: 1503696 - protein, 20 aa, Mycobacterium tuberculosis
HRNRPFYELVSRVGLERARR

SEQ ID NO: 1503697 - protein, 25 aa, Mycobacterium tuberculosis
HRRHRPTVWALWGDAMALLAGDAML

SEQ ID NO: 1503698 - protein, 19 aa, Mycobacterium tuberculosis
HRVCRYLEDLAGDYHRFYD

SEQ ID NO: 1503699 - protein, 17 aa, Mycobacterium tuberculosis
HRYYSTIKDLTRLLGGP

SEQ ID NO: 1503700 - protein, 23 aa, Mycobacterium tuberculosis
HSRGPFPGALWLQVRDLEATQTE

SEQ ID NO: 1503701 - protein, 20 aa, Mycobacterium tuberculosis
HTFRRLNGTLLAGLPALVVA

SEQ ID NO: 1503702 - protein, 17 aa, Mycobacterium tuberculosis
HTKAWKAMFDAYLAERA

SEQ ID NO: 1503703 - protein, 23 aa, Mycobacterium tuberculosis
HTQARWQLLSVVSDRALTVPQAA

SEQ ID NO: 1503704 - protein, 23 aa, Mycobacterium tuberculosis
HTVEMWCPVIGDGAFQRVLDVEV

SEQ ID NO: 1503705 - protein, 19 aa, Mycobacterium tuberculosis
HVYTRLDRPLTASLGLMIL

SEQ ID NO: 1503706 - protein, 19 aa, Mycobacterium tuberculosis
HYDLSDAFFALFQDPTRTY

SEQ ID NO: 1503707 - protein, 17 aa, Mycobacterium tuberculosis
HYVDVPLPGPRLPHDMA

SEQ ID NO: 1503708 - protein, 35 aa, Mycobacterium tuberculosis; identical to SEQ ID NO: 219261

SEQ ID NO: 1503709 - protein, 25 aa, Mycobacterium tuberculosis
IAHASGDLLWFLHSADRFSGPDVVA

SEQ ID NO: 1503710 - protein, 26 aa, Mycobacterium tuberculosis
IAIELDGLRLITWRGASRAEQGLPFA

SEQ ID NO: 1503711 - protein, 32 aa, Mycobacterium tuberculosis; identical to SEQ ID NO: 219266

SEQ ID NO: 1503712 - protein, 22 aa, Mycobacterium tuberculosis
IANRLCAQILLLAAEDASKDIS

SEQ ID NO: 1503713 - protein, 28 aa, Mycobacterium tuberculosis
ICSATVEGLILGSYRFSAFRSDKTAPKD

SEQ ID NO: 1503714 - protein, 30 aa, Mycobacterium tuberculosis; identical to SEQ ID NO: 219295

SEQ ID NO: 1503715 - protein, 19 aa, Mycobacterium tuberculosis
IDLFNSARFSRQGEHRARD

SEQ ID NO: 1503716 - protein, 22 aa, Mycobacterium tuberculosis
IDMMRRHHLPVPPAFCITTEVG

SEQ ID NO: 1503717 - protein, 26 aa, Mycobacterium tuberculosis
IDPNAEFFAAPLAWQERLWPTEEFEL

SEQ ID NO: 1503718 - protein, 19 aa, Mycobacterium tuberculosis
IEEMGGMNIFFVLGSGGSA

SEQ ID NO: 1503719 - protein, 26 aa, Mycobacterium tuberculosis
IEEVVLRLRALLRRTGVTTVDSGAQL

SEQ ID NO: 1503720 - protein, 26 aa, Mycobacterium tuberculosis
IEIVGRFLALLELYRTRAVAFEQSEP

SEQ ID NO: 1503721 - protein, 17 aa, Mycobacterium tuberculosis
IELRRMGYLQRMSTVLS

SEQ ID NO: 1503722 - protein, 27 aa, Mycobacterium tuberculosis
IEVVKGGLILDIGLRGFLPASLVEMRR

SEQ ID NO: 1503723 - protein, 18 aa, Mycobacterium tuberculosis
IEYKFGFMGNPWGELEGV

SEQ ID NO: 1503724 - protein, 18 aa, Mycobacterium tuberculosis
IFDQGLGDMFVVRTAGHV

SEQ ID NO: 1503725 - protein, 17 aa, Mycobacterium tuberculosis
IFEGDILFLEWTANSAV

SEQ ID NO: 1503726 - protein, 25 aa, Mycobacterium tuberculosis
IFEQMLIDDGILLRKYWFSVSDAEQ

SEQ ID NO: 1503727 - protein, 23 aa, Mycobacterium tuberculosis
IFMGPLFTLLGRPKVEGLEYIPS

SEQ ID NO: 1503728 - protein, 17 aa, Mycobacterium tuberculosis
IFSFPYDVDAVTKIASL

SEQ ID NO: 1503729 - protein, 24 aa, Mycobacterium tuberculosis
IGEVTNVLLLRGMIGKPGAGVCPV

SEQ ID NO: 1503730 - protein, 26 aa, Mycobacterium tuberculosis
IGGLLIACLQFDLPIRLFEIGSSAGL

SEQ ID NO: 1503731 - protein, 28 aa, Mycobacterium tuberculosis
IGLANYFAGAFLLPYREFHRAAEQLRYD

SEQ ID NO: 1503732 - protein, 19 aa, Mycobacterium tuberculosis
IGLFRYQLIREAADAAHST

SEQ ID NO: 1503733 - protein, 17 aa, Mycobacterium tuberculosis
IGLHIIVTCQMSQAYKA

SEQ ID NO: 1503734 - protein, 24 aa, Mycobacterium tuberculosis
IGMTIPYAALEIMKLRLTRSAYQQ

SEQ ID NO: 1503735 - protein, 17 aa, Mycobacterium tuberculosis
IGNMTLLADAMGTVGGA

SEQ ID NO: 1503736 - protein, 27 aa, Mycobacterium tuberculosis
IGRELDRYLPFLATTKVLMAAVRAGMG

SEQ ID NO: 1503737 - protein, 17 aa, Mycobacterium tuberculosis
IHHDPRWWPDPDRFDPG

SEQ ID NO: 1503738 - protein, 23 aa, Mycobacterium tuberculosis
IHLVGANRLATAVLPAMVARRRG

SEQ ID NO: 1503739 - protein, 26 aa, Mycobacterium tuberculosis
IHVDSRGLFFEWLTDHGFRAFAGHSL

SEQ ID NO: 1503740 - protein, 21 aa, Mycobacterium tuberculosis
IISDVLTASDFWGGAGSAACQ

SEQ ID NO: 1503741 - protein, 25 aa, Mycobacterium tuberculosis
IKPGNNLPLRNIPAGTLIHAVELRP

SEQ ID NO: 1503742 - protein, 25 aa, Mycobacterium tuberculosis
IKSATFAVHAPFAYGTLSVEQGTHR

SEQ ID NO: 1503743 - protein, 21 aa, Mycobacterium tuberculosis
IKVFDAFPLTHYVECVALLTR

SEQ ID NO: 1503744 - protein, 18 aa, Mycobacterium tuberculosis
ILVRGVAIDPDALRRRLR

SEQ ID NO: 1503745 - protein, 19 aa, Mycobacterium tuberculosis
INFGLAGRVVLVTGGVRGV

SEQ ID NO: 1503746 - protein, 18 aa, Mycobacterium tuberculosis
INMPVLDGVSVVTALRAM

SEQ ID NO: 1503747 - protein, 17 aa, Mycobacterium tuberculosis
IPAVLYGHGAEPQHLEL

SEQ ID NO: 1503748 - protein, 25 aa, Mycobacterium tuberculosis
IPDVGGVYLLSRAPGALGLHAALTG

SEQ ID NO: 1503749 - protein, 28 aa, Mycobacterium tuberculosis
IPKLRAGSFFPSLLERRRRIDKALHAVI

SEQ ID NO: 1503750 - protein, 19 aa, Mycobacterium tuberculosis
IPMAGFPVLGGHEGAGIVT

SEQ ID NO: 1503751 - protein, 19 aa, Mycobacterium tuberculosis
IPSVTVPPITIPAGTALGA

SEQ ID NO: 1503752 - protein, 18 aa, Mycobacterium tuberculosis
IPTPRRVQLPLVHCGGAA

SEQ ID NO: 1503753 - protein, 25 aa, Mycobacterium tuberculosis
IPTVSGWRMLSGDETGWLLGDYILS

SEQ ID NO: 1503754 - protein, 22 aa, Mycobacterium tuberculosis
IQAQDFFFRKIVRDKGVALAHV

SEQ ID NO: 1503755 - protein, 27 aa, Mycobacterium tuberculosis
IRDEAVHGYYIGYKFQRGLALVDDVTR

SEQ ID NO: 1503756 - protein, 20 aa, Mycobacterium tuberculosis
IRLIFQRAREKASEGTPVIV

SEQ ID NO: 1503757 - protein, 24 aa, Mycobacterium tuberculosis
ISFTHLLGYALVQAVKKFPNMNRH

SEQ ID NO: 1503758 - protein, 27 aa, Mycobacterium tuberculosis
ISGAKAWLGTALALKPLLSVDDGKLVL

SEQ ID NO: 1503759 - protein, 24 aa, Mycobacterium tuberculosis
ISGLVIALLCRGHVLLEGVPGVAK

SEQ ID NO: 1503760 - protein, 18 aa, Mycobacterium tuberculosis
ISTLKRNYGWNRSCIDGT

SEQ ID NO: 1503761 - protein, 24 aa, Mycobacterium tuberculosis
ISVPAFSLPAITLPSLTIPAVTTP

SEQ ID NO: 1503762 - protein, 28 aa, Mycobacterium tuberculosis
ITDNSTLAHLLKFDSILGRLPCDVGLEG

SEQ ID NO: 1503763 - protein, 17 aa, Mycobacterium tuberculosis
ITGPDTAAQARCVVECM

SEQ ID NO: 1503764 - protein, 19 aa, Mycobacterium tuberculosis
ITKSRRPIGALLMDQTVIA

SEQ ID NO: 1503765 - protein, 27 aa, Mycobacterium tuberculosis
ITMPENTIRWNWAPGDVAIWDNRATQH

SEQ ID NO: 1503766 - protein, 27 aa, Mycobacterium tuberculosis
ITPAQTGPFFLLDIDSFWTPSGGSIPE

SEQ ID NO: 1503767 - protein, 26 aa, Mycobacterium tuberculosis
ITVGELLARPFFADPLRRHDIAPITD

SEQ ID NO: 1503768 - protein, 18 aa, Mycobacterium tuberculosis
IVGGGPYLETLRKLAHDC

SEQ ID NO: 1503769 - protein, 20 aa, Mycobacterium tuberculosis
IVICSPRRRTLDTAKLAGLT

SEQ ID NO: 1503770 - protein, 19 aa, Mycobacterium tuberculosis
IVMGRRTWDSLPAKVRPLP

SEQ ID NO: 1503771 - protein, 19 aa, Mycobacterium tuberculosis
IVMPVLPMHGPRGQGLPKG

SEQ ID NO: 1503772 - protein, 26 aa, Mycobacterium tuberculosis
IVPMFHANGWGLPYAALMAGADLVLP

SEQ ID NO: 1503773 - protein, 18 aa, Mycobacterium tuberculosis
IVTMNRPAARNALSTEMM

SEQ ID NO: 1503774 - protein, 30 aa, Mycobacterium tuberculosis; identical to SEQ ID NO: 219587

SEQ ID NO: 1503775 - protein, 17 aa, Mycobacterium tuberculosis
KAELNLGKLLTKRARVI

SEQ ID NO: 1503776 - protein, 20 aa, Mycobacterium tuberculosis
KALLDVAGVTVTRFVRFEVG

SEQ ID NO: 1503777 - protein, 19 aa, Mycobacterium tuberculosis
KARHNYSIIEVFEAGVALQ

SEQ ID NO: 1503778 - protein, 21 aa, Mycobacterium tuberculosis
KATVKLLFRDAYALGGRFEEH

SEQ ID NO: 1503779 - protein, 26 aa, Mycobacterium tuberculosis
KDAEVWDRLTGNFWLPEKVPVSNDIP

SEQ ID NO: 1503780 - protein, 32 aa, Mycobacterium tuberculosis; identical to SEQ ID NO: 219620

SEQ ID NO: 1503781 - protein, 22 aa, Mycobacterium tuberculosis
KDHPPILRVTPGATPWVTWGEF

SEQ ID NO: 1503782 - protein, 27 aa, Mycobacterium tuberculosis
KDNRPVARIVPLKRRRQWLPAAEVIGE

SEQ ID NO: 1503783 - protein, 25 aa, Mycobacterium tuberculosis
KDRDAVLRRAPWVDVVFGTHNIGSL

SEQ ID NO: 1503784 - protein, 18 aa, Mycobacterium tuberculosis
KFDLVRYYLAVAEGAMRG

SEQ ID NO: 1503785 - protein, 25 aa, Mycobacterium tuberculosis
KGKRYALPHARILMHQPLGGVTGSA

SEQ ID NO: 1503786 - protein, 41 aa, Mycobacterium tuberculosis; identical to SEQ ID NO: 215326

SEQ ID NO: 1503787 - protein, 26 aa, Mycobacterium tuberculosis
KGRLTLPAKFRDALAGGLMVTKSQDH

SEQ ID NO: 1503788 - protein, 17 aa, Mycobacterium tuberculosis
KGVKWDPAELGPVVSDL

SEQ ID NO: 1503789 - protein, 22 aa, Mycobacterium tuberculosis
KHPWRVLMHYEKDAKILLEDPI

SEQ ID NO: 1503790 - protein, 19 aa, Mycobacterium tuberculosis
KHRVTRETLALLIDLARTA

SEQ ID NO: 1503791 - protein, 17 aa, Mycobacterium tuberculosis
KILGSDRPAWATGFGRL

SEQ ID NO: 1503792 - protein, 20 aa, Mycobacterium tuberculosis
KIRGRYLLEVSSPGVERPLT

SEQ ID NO: 1503793 - protein, 24 aa, Mycobacterium tuberculosis
KIVEGRLNGFFKDAVLLEQASVSD

SEQ ID NO: 1503794 - protein, 20 aa, Mycobacterium tuberculosis
KLADLVAVFAPGGALAQYDE

SEQ ID NO: 1503795 - protein, 20 aa, Mycobacterium tuberculosis
KLDVLDFWSIIKPELAGVHG

SEQ ID NO: 1503796 - protein, 27 aa, Mycobacterium tuberculosis
KLHELQRLWLIEATRYNVLPLDDDTAS

SEQ ID NO: 1503797 - protein, 25 aa, Mycobacterium tuberculosis
KLLRSDFPVLWPVGTRWADNDMFGH

SEQ ID NO: 1503798 - protein, 20 aa, Mycobacterium tuberculosis
KLPPRPLVSGNYRRPPRELS

SEQ ID NO: 1503799 - protein, 18 aa, Mycobacterium tuberculosis
KPATVLVLGVGVAGLQAL

SEQ ID NO: 1503800 - protein, 20 aa, Mycobacterium tuberculosis
KPAYIAGDLAYYLDKRQRGF

SEQ ID NO: 1503801 - protein, 23 aa, Mycobacterium tuberculosis
KPEEFVQFARFAEGLGFAGVLAG

SEQ ID NO: 1503802 - protein, 19 aa, Mycobacterium tuberculosis
KPEWTERWPDLVASFTAAT

SEQ ID NO: 1503803 - protein, 33 aa, Mycobacterium tuberculosis; identical to SEQ ID NO: 219719

SEQ ID NO: 1503804 - protein, 17 aa, Mycobacterium tuberculosis
KPLVRLRVPFTLSRNEI

SEQ ID NO: 1503805 - protein, 18 aa, Mycobacterium tuberculosis
KPPYVAAYVLLDGADIPF

SEQ ID NO: 1503806 - protein, 25 aa, Mycobacterium tuberculosis
KPVRPRLHSISFIFKGRPGEVYLTV

SEQ ID NO: 1503807 - protein, 25 aa, Mycobacterium tuberculosis
KQDGQWRIAYRRLRNDRLVSDPSVA

SEQ ID NO: 1503808 - protein, 21 aa, Mycobacterium tuberculosis
KQYIRLFEMDGVELEFTDDAL

SEQ ID NO: 1503809 - protein, 26 aa, Mycobacterium tuberculosis
KRGGKVWINIFPDRPLTKKPAETRMG

SEQ ID NO: 1503810 - protein, 23 aa, Mycobacterium tuberculosis
KRHQNKPVLFLGDTRLTGGQLAD

SEQ ID NO: 1503811 - protein, 25 aa, Mycobacterium tuberculosis
KRLKPSLRQRVIAAWLWSGRKGVIA

SEQ ID NO: 1503812 - protein, 22 aa, Mycobacterium tuberculosis
KSETFPGLAGLGDLIVTCTSQR

SEQ ID NO: 1503813 - protein, 28 aa, Mycobacterium tuberculosis
KSRGVRPRVWFGERWITSVLDLFQENIR

SEQ ID NO: 1503814 - protein, 20 aa, Mycobacterium tuberculosis
KSTLLRLLSGIYEPTRGWAK

SEQ ID NO: 1503815 - protein, 18 aa, Mycobacterium tuberculosis
KSVIWRLAEDLDAGDDLG

SEQ ID NO: 1503816 - protein, 24 aa, Mycobacterium tuberculosis
KTATEWVQLLQANGLMACLAHTWK

SEQ ID NO: 1503817 - protein, 25 aa, Mycobacterium tuberculosis
KTTTTERILYYTGINYKIGEVHDGA

SEQ ID NO: 1503818 - protein, 18 aa, Mycobacterium tuberculosis
KVADGVRMLIVPGSMRVR

SEQ ID NO: 1503819 - protein, 25 aa, Mycobacterium tuberculosis
KVDVLAHALAQLRPLPERLVMVGDR

SEQ ID NO: 1503820 - protein, 31 aa, Mycobacterium tuberculosis; identical to SEQ ID NO: 219781

SEQ ID NO: 1503821 - protein, 24 aa, Mycobacterium tuberculosis
KVLRVAHWLMPGQRAFQIATQLAL

SEQ ID NO: 1503822 - protein, 22 aa, Mycobacterium tuberculosis
KVNRGFGPLLLPRIVASVFANE

SEQ ID NO: 1503823 - protein, 23 aa, Mycobacterium tuberculosis
KVNRLLLNNIDVVGVGWGAWSLT

SEQ ID NO: 1503824 - protein, 19 aa, Mycobacterium tuberculosis
KVSALLEALPKVGKVKAQE

SEQ ID NO: 1503825 - protein, 24 aa, Mycobacterium tuberculosis
KVSENQLFYLMSRGLTEDEAMAMV

SEQ ID NO: 1503826 - protein, 18 aa, Mycobacterium tuberculosis
KVSLSAPAVKRRVDRMLE

SEQ ID NO: 1503827 - protein, 17 aa, Mycobacterium tuberculosis
KVTALQLVWADRRGRWP

SEQ ID NO: 1503828 - protein, 20 aa, Mycobacterium tuberculosis
KVVDLLTPYVRGGKIALFGG

SEQ ID NO: 1503829 - protein, 24 aa, Mycobacterium tuberculosis
KVVSWYDNEWGYSNRLVDLVTLVG

SEQ ID NO: 1503830 - protein, 18 aa, Mycobacterium tuberculosis
KVWGLYMAASRVAFERNN

SEQ ID NO: 1503831 - protein, 17 aa, Mycobacterium tuberculosis
KVYAPFESGLPGPTGRV

SEQ ID NO: 1503832 - protein, 21 aa, Mycobacterium tuberculosis
KWGQLSNVVLLLPHGHEGQGP

SEQ ID NO: 1503833 - protein, 31 aa, Mycobacterium tuberculosis; identical to SEQ ID NO: 219809

SEQ ID NO: 1503834 - protein, 29 aa, Mycobacterium tuberculosis
KYGGRDAPLLHWIVFEEEYFRAGAPGRAS

SEQ ID NO: 1503835 - protein, 22 aa, Mycobacterium tuberculosis
KYYDRVDVAVIPPFTDLRSVQT

SEQ ID NO: 1503836 - protein, 20 aa, Mycobacterium tuberculosis
LAAGLDAPFSCREGHCGACA

SEQ ID NO: 1503837 - protein, 32 aa, Mycobacterium tuberculosis; identical to SEQ ID NO: 219821

SEQ ID NO: 1503838 - protein, 18 aa, Mycobacterium tuberculosis
LAARLRLPIDVIATVPMA

SEQ ID NO: 1503839 - protein, 20 aa, Mycobacterium tuberculosis
LADDIFLVDGEPALLDCLEF

SEQ ID NO: 1503840 - protein, 19 aa, Mycobacterium tuberculosis
LADFGELRWRDGVAVTVVL

SEQ ID NO: 1503841 - protein, 24 aa, Mycobacterium tuberculosis
LADYLESLHRLRGLGRRTVLPGHG

SEQ ID NO: 1503842 - protein, 21 aa, Mycobacterium tuberculosis
LAFAGLLGTPIGHPAAIALAD

SEQ ID NO: 1503843 - protein, 17 aa, Mycobacterium tuberculosis
LAFYAASPERLSGRQIP

SEQ ID NO: 1503844 - protein, 24 aa, Mycobacterium tuberculosis
LAHWTRLYPEVRVDRAIAGGSACR

SEQ ID NO: 1503845 - protein, 29 aa, Mycobacterium tuberculosis
LAIPAGPADWALLGAALLGVGGSGAAVVN

SEQ ID NO: 1503846 - protein, 21 aa, Mycobacterium tuberculosis
LAIVLLPRHHRRHSRRGRALP

SEQ ID NO: 1503847 - protein, 21 aa, Mycobacterium tuberculosis
LAKCGPWHRGGWDPIPEGLTT

SEQ ID NO: 1503848 - protein, 31 aa, Mycobacterium tuberculosis; identical to SEQ ID NO: 219885

SEQ ID NO: 1503849 - protein, 24 aa, Mycobacterium tuberculosis
LAMAALALTILQWNRTHDVPAADS

SEQ ID NO: 1503850 - protein, 17 aa, Mycobacterium tuberculosis
LANWLRHGVITSADVRA

SEQ ID NO: 1503851 - protein, 24 aa, Mycobacterium tuberculosis
LARNAAELALIPDTNHLELLNHDK

SEQ ID NO: 1503852 - protein, 19 aa, Mycobacterium tuberculosis
LASLGVFEEAFRRAQEAIE

SEQ ID NO: 1503853 - protein, 30 aa, Mycobacterium tuberculosis; identical to SEQ ID NO: 219926

SEQ ID NO: 1503854 - protein, 22 aa, Mycobacterium tuberculosis
LAVDFRQRFKKDVVIDMLCYRR

SEQ ID NO: 1503855 - protein, 18 aa, Mycobacterium tuberculosis
LAVTFRNGWQWATVEGRA

SEQ ID NO: 1503856 - protein, 19 aa, Mycobacterium tuberculosis
LAWPTAQIAVMGASGAVGF

SEQ ID NO: 1503857 - protein, 17 aa, Mycobacterium tuberculosis
LCAPCDLFTPTYEASSR

SEQ ID NO: 1503858 - protein, 17 aa, Mycobacterium tuberculosis
LCDVGVNAAILDAALDD

SEQ ID NO: 1503859 - protein, 28 aa, Mycobacterium tuberculosis
LDADSLGWLRDFLRLHTGGLVVISHNVD

SEQ ID NO: 1503860 - protein, 19 aa, Mycobacterium tuberculosis
LDALMRATPFSRDDVLLLA

SEQ ID NO: 1503861 - protein, 21 aa, Mycobacterium tuberculosis
LDHSLPYIFAVALQDGCWHHE

SEQ ID NO: 1503862 - protein, 17 aa, Mycobacterium tuberculosis
LDITLYRDDLMIKPPRP

SEQ ID NO: 1503863 - protein, 17 aa, Mycobacterium tuberculosis
LDNLRRSGRISGAKAWL

SEQ ID NO: 1503864 - protein, 23 aa, Mycobacterium tuberculosis
LDNQIWQCPVVLLADVRSVGVQG

SEQ ID NO: 1503865 - protein, 20 aa, Mycobacterium tuberculosis
LDQAYPPRLAQSWDSVGLVC

SEQ ID NO: 1503866 - protein, 26 aa, Mycobacterium tuberculosis
LDQSVSLLHLQLILREGGAELTLYLH

SEQ ID NO: 1503867 - protein, 20 aa, Mycobacterium tuberculosis
LDREILGIAEAIRASGLSAG

SEQ ID NO: 1503868 - protein, 23 aa, Mycobacterium tuberculosis
LDRIRELVLKPVEGSGGYGIVFG

SEQ ID NO: 1503869 - protein, 25 aa, Mycobacterium tuberculosis
LDRSRPLWQVDLIEGLPGGRCAVYV

SEQ ID NO: 1503870 - protein, 17 aa, Mycobacterium tuberculosis
LDRYLYTPMAYPTDYGF

SEQ ID NO: 1503871 - protein, 29 aa, Mycobacterium tuberculosis
LDTRRLIDRAGRWLLNYRPQPLAVGAEIN

SEQ ID NO: 1503872 - protein, 22 aa, Mycobacterium tuberculosis
LDVDARFYFVHSYAAQRWEGSP

SEQ ID NO: 1503873 - protein, 18 aa, Mycobacterium tuberculosis
LDVFTLADRVLVLESGTI

SEQ ID NO: 1503874 - protein, 28 aa, Mycobacterium tuberculosis
LEAVRQFLNLDVPLFVESAFHGLGGVAD

SEQ ID NO: 1503875 - protein, 26 aa, Mycobacterium tuberculosis
LEHGTALVPTLINLENFPGIADAAGR

SEQ ID NO: 1503876 - protein, 23 aa, Mycobacterium tuberculosis
LETNLFGPLALASAFADRIAERS

SEQ ID NO: 1503877 - protein, 22 aa, Mycobacterium tuberculosis
LEYHAIAHMRRGPGGGLVVTTP

SEQ ID NO: 1503878 - protein, 19 aa, Mycobacterium tuberculosis
LFEKITGLRMNSAYIRPGG

SEQ ID NO: 1503879 - protein, 22 aa, Mycobacterium tuberculosis
LFNDLTVYFALAVRGRLQAGET

SEQ ID NO: 1503880 - protein, 20 aa, Mycobacterium tuberculosis
LFNLRFQMATGQLNNNRRLR

SEQ ID NO: 1503881 - protein, 20 aa, Mycobacterium tuberculosis
LGAMPIYRFGTEEQKQKWLP

SEQ ID NO: 1503882 - protein, 18 aa, Mycobacterium tuberculosis
LGCFGLKIPSEYGGLNMS

SEQ ID NO: 1503883 - protein, 20 aa, Mycobacterium tuberculosis
LGCRSLALVAFGTGVGGFPL

SEQ ID NO: 1503884 - protein, 24 aa, Mycobacterium tuberculosis
LGELPNKSLIVVLPVNVRPKDDEG

SEQ ID NO: 1503885 - protein, 25 aa, Mycobacterium tuberculosis
LGEPTLTWLDSLAPNGPLVIIHNSG

SEQ ID NO: 1503886 - protein, 19 aa, Mycobacterium tuberculosis
LGFETKVCWFPDSGNPGLV

SEQ ID NO: 1503887 - protein, 22 aa, Mycobacterium tuberculosis
LGFLMARFNIWGRPDLRRWLPL

SEQ ID NO: 1503888 - protein, 23 aa, Mycobacterium tuberculosis
LGGFSTIWLARGAGPQGRVVTLE

SEQ ID NO: 1503889 - protein, 19 aa, Mycobacterium tuberculosis
LGGFTLPQLSIPAITTPAF

SEQ ID NO: 1503890 - protein, 24 aa, Mycobacterium tuberculosis
LGHRELGLLTMRLGRDRRQDLVDA

SEQ ID NO: 1503891 - protein, 35 aa, Mycobacterium tuberculosis; identical to SEQ ID NO: 220112

SEQ ID NO: 1503892 - protein, 17 aa, Mycobacterium tuberculosis
LGPQRVVLLPDGTEDYW

SEQ ID NO: 1503893 - protein, 24 aa, Mycobacterium tuberculosis
LGPSWVRVNSIRPGLIRTDLVVPV

SEQ ID NO: 1503894 - protein, 21 aa, Mycobacterium tuberculosis
LGRHVWRIALPRPGNEDQLFE

SEQ ID NO: 1503895 - protein, 21 aa, Mycobacterium tuberculosis
LGRPPRMLVLLHLDESVQRPS

SEQ ID NO: 1503896 - protein, 20 aa, Mycobacterium tuberculosis
LHGMLTDRDIVIKGLAAGLD

SEQ ID NO: 1503897 - protein, 25 aa, Mycobacterium tuberculosis
LHNMRTMRFLPPEKQARKARETLEV

SEQ ID NO: 1503898 - protein, 29 aa, Mycobacterium tuberculosis
LHPEYRTMPMVWYIPPLSPVVDAVSRDGH

SEQ ID NO: 1503899 - protein, 26 aa, Mycobacterium tuberculosis
LIGGATMLRMLLYPDDMLDDAWVDQT

SEQ ID NO: 1503900 - protein, 25 aa, Mycobacterium tuberculosis
LIKSIGLRLGVPWYAYDTVTFSGEV

SEQ ID NO: 1503901 - protein, 27 aa, Mycobacterium tuberculosis
LKEIRSRLGFLLDVGLEYLSLSRAAAT

SEQ ID NO: 1503902 - protein, 20 aa, Mycobacterium tuberculosis
LKNVFAIAVGMGYSLGIGEN

SEQ ID NO: 1503903 - protein, 18 aa, Mycobacterium tuberculosis
LKVTHPAAIVWAAQMGTI

SEQ ID NO: 1503904 - protein, 20 aa, Mycobacterium tuberculosis
LLCAGIIGYRSLLRTELPPG

SEQ ID NO: 1503905 - protein, 20 aa, Mycobacterium tuberculosis
LLDALLSTVPWRAERRQMYD

SEQ ID NO: 1503906 - protein, 25 aa, Mycobacterium tuberculosis
LLMLTDIDGLYTRWPDRDSLVSEID

SEQ ID NO: 1503907 - protein, 19 aa, Mycobacterium tuberculosis
LLPLIRPHEHMPDSVRRLL

SEQ ID NO: 1503908 - protein, 19 aa, Mycobacterium tuberculosis
LLRQRRALRQTGGDPREAV

SEQ ID NO: 1503909 - protein, 20 aa, Mycobacterium tuberculosis
LLVDVIGLPWEEVHAEACRW

SEQ ID NO: 1503910 - protein, 21 aa, Mycobacterium tuberculosis
LLVESGMAPLFPLVVVVHADV

SEQ ID NO: 1503911 - protein, 19 aa, Mycobacterium tuberculosis
LMEFQSMYTALIMGEPPIG

SEQ ID NO: 1503912 - protein, 17 aa, Mycobacterium tuberculosis
LNLLVHKVDAENGVLLI

SEQ ID NO: 1503913 - protein, 18 aa, Mycobacterium tuberculosis
LNVLLSADGGIWPRQRVR

SEQ ID NO: 1503914 - protein, 29 aa, Mycobacterium tuberculosis
LPAMRRAFPSWMAWSPFAPAMRQAVVSVD

SEQ ID NO: 1503915 - protein, 26 aa, Mycobacterium tuberculosis
LPDDLKFTLVEPLRLLFKDEVRAVGR

SEQ ID NO: 1503916 - protein, 18 aa, Mycobacterium tuberculosis
LPDRPRTYVYRRAGEPCR

SEQ ID NO: 1503917 - protein, 24 aa, Mycobacterium tuberculosis
LPEAQLDRFLLKLNVTLPARDSEI

SEQ ID NO: 1503918 - protein, 24 aa, Mycobacterium tuberculosis
LPGVAMMVVLISRGGWCTVTVRYD

SEQ ID NO: 1503919 - protein, 18 aa, Mycobacterium tuberculosis
LPHVRATVLDALRRARVT

SEQ ID NO: 1503920 - protein, 18 aa, Mycobacterium tuberculosis
LPNGLQLRQQRVPLGVVG

SEQ ID NO: 1503921 - protein, 26 aa, Mycobacterium tuberculosis
LPVKLCYAGPFFRYERPQAGRYRQLQ

SEQ ID NO: 1503922 - protein, 28 aa, Mycobacterium tuberculosis
LQAKANLVWTPQPALPPQLRAVTNWVGP

SEQ ID NO: 1503923 - protein, 18 aa, Mycobacterium tuberculosis
LQFRPEVSDGLFLRLAIT

SEQ ID NO: 1503924 - protein, 21 aa, Mycobacterium tuberculosis
LQLMFVKFRYRLGYESLCREV

SEQ ID NO: 1503925 - protein, 18 aa, Mycobacterium tuberculosis
LQNRLLILAKEKTEQLYL

SEQ ID NO: 1503926 - protein, 23 aa, Mycobacterium tuberculosis
LQPYASFFYNTEGLPYFSIGMGN

SEQ ID NO: 1503927 - protein, 19 aa, Mycobacterium tuberculosis
LQRKAEIVLQYYRGDEPLK

SEQ ID NO: 1503928 - protein, 18 aa, Mycobacterium tuberculosis
LRELVIMRIGWLTDCDYE

SEQ ID NO: 1503929 - protein, 36 aa, Mycobacterium tuberculosis; identical to SEQ ID NO: 220364

SEQ ID NO: 1503930 - protein, 33 aa, Mycobacterium tuberculosis; identical to SEQ ID NO: 121199

SEQ ID NO: 1503931 - protein, 22 aa, Mycobacterium tuberculosis
LRPCTRFGQRLRLRPFDLGAPK

SEQ ID NO: 1503932 - protein, 24 aa, Mycobacterium tuberculosis
LRPSDLARAIAFVAETPRGCVVVN

SEQ ID NO: 1503933 - protein, 19 aa, Mycobacterium tuberculosis
LRRRTLITAAQYLALGIDP

SEQ ID NO: 1503934 - protein, 21 aa, Mycobacterium tuberculosis
LRRWVPPHLDGYKPLFEAVQE

SEQ ID NO: 1503935 - protein, 32 aa, Mycobacterium tuberculosis; identical to SEQ ID NO: 220404

SEQ ID NO: 1503936 - protein, 29 aa, Mycobacterium tuberculosis
LRYTMPLGEIIFDFFDALKSRTRGYASLD

SEQ ID NO: 1503937 - protein, 26 aa, Mycobacterium tuberculosis
LSAAVFNGFLPAVARMRALDPVTSEL

SEQ ID NO: 1503938 - protein, 24 aa, Mycobacterium tuberculosis
LSDSPLQVTIWTKRLRAVDFTLGY

SEQ ID NO: 1503939 - protein, 22 aa, Mycobacterium tuberculosis
LSETVADLMRRGLAANRPTALS

SEQ ID NO: 1503940 - protein, 18 aa, Mycobacterium tuberculosis
LSLNPQRVDGIAAGLRQV

SEQ ID NO: 1503941 - protein, 37 aa, Mycobacterium tuberculosis; identical to SEQ ID NO: 215192

SEQ ID NO: 1503942 - protein, 32 aa, Mycobacterium tuberculosis; identical to SEQ ID NO: 220433

SEQ ID NO: 1503943 - protein, 26 aa, Mycobacterium tuberculosis
LSPERKSRRFAYPPNLYVVDGGAPQV

SEQ ID NO: 1503944 - protein, 26 aa, Mycobacterium tuberculosis
LSRDGVFPLAAFRKIVDINLVGTFNV

SEQ ID NO: 1503945 - protein, 26 aa, Mycobacterium tuberculosis
LSRGTWLARRLGLKRLLRSDILPISF

SEQ ID NO: 1503946 - protein, 23 aa, Mycobacterium tuberculosis
LSSRAEWLPAWEEGLRRASAAID

SEQ ID NO: 1503947 - protein, 17 aa, Mycobacterium tuberculosis
LSVITWPAKYGGRDAPL

SEQ ID NO: 1503948 - protein, 18 aa, Mycobacterium tuberculosis
LSVLRLADRLIPHRAWIF

SEQ ID NO: 1503949 - protein, 18 aa, Mycobacterium tuberculosis
LTAPVDGAVWMRVHERGV

SEQ ID NO: 1503950 - protein, 19 aa, Mycobacterium tuberculosis
LTDERLRPYQPGHIPFIEP

SEQ ID NO: 1503951 - protein, 18 aa, Mycobacterium tuberculosis
LTFIDKAYEFVKETVAHG

SEQ ID NO: 1503952 - protein, 20 aa, Mycobacterium tuberculosis
LTLAVLPGMIERKAGGILIS

SEQ ID NO: 1503953 - protein, 18 aa, Mycobacterium tuberculosis
LTLFETTPGLEACDAVLA

SEQ ID NO: 1503954 - protein, 26 aa, Mycobacterium tuberculosis
LTMPRPNFPVVNFLDAGAAPLSVLLT

SEQ ID NO: 1503955 - protein, 19 aa, Mycobacterium tuberculosis
LTREELLEALLKDAERAYA

SEQ ID NO: 1503956 - protein, 18 aa, Mycobacterium tuberculosis
LTVLWQREARYLNEDDRT

SEQ ID NO: 1503957 - protein, 17 aa, Mycobacterium tuberculosis
LVAAEGPFASVYFDDSH

SEQ ID NO: 1503958 - protein, 19 aa, Mycobacterium tuberculosis
LVAANRALVAWLAGSNVFG

SEQ ID NO: 1503959 - protein, 20 aa, Mycobacterium tuberculosis
LVATAMRIVNAIPAVVAAEP

SEQ ID NO: 1503960 - protein, 19 aa, Mycobacterium tuberculosis
LVDGDIIWAPAIDGAFVLT

SEQ ID NO: 1503961 - protein, 20 aa, Mycobacterium tuberculosis
LVEYARKYRQTIAAAAVVLE

SEQ ID NO: 1503962 - protein, 26 aa, Mycobacterium tuberculosis
LVGRADLVLPMWQRLEPVWGPARDVR

SEQ ID NO: 1503963 - protein, 24 aa, Mycobacterium tuberculosis
LVGSVSMTAQWWLDAREPKKEVVA

SEQ ID NO: 1503964 - protein, 17 aa, Mycobacterium tuberculosis
LVQFEITVDPQVPLPGF

SEQ ID NO: 1503965 - protein, 21 aa, Mycobacterium tuberculosis
LVRRGSSFCGLLYVGLAITAR

SEQ ID NO: 1503966 - protein, 18 aa, Mycobacterium tuberculosis
LVSGRYPFASLPRRCVRL

SEQ ID NO: 1503967 - protein, 17 aa, Mycobacterium tuberculosis
LVSKFAREVPGVAHALL

SEQ ID NO: 1503968 - protein, 20 aa, Mycobacterium tuberculosis
LVTGDIPMAGFPVLGGHEGA

SEQ ID NO: 1503969 - protein, 26 aa, Mycobacterium tuberculosis
LVVPGRPAVMVLPGPPRELQPIWSKA

SEQ ID NO: 1503970 - protein, 22 aa, Mycobacterium tuberculosis
LYDAPEVVIPMLVPDGAHSYPD

SEQ ID NO: 1503971 - protein, 19 aa, Mycobacterium tuberculosis
LYLDTLADWPVDGLPAVDL

SEQ ID NO: 1503972 - protein, 38 aa, Mycobacterium tuberculosis; identical to SEQ ID NO: 220603

SEQ ID NO: 1503973 - protein, 26 aa, Mycobacterium tuberculosis
MAAKRTSDLIPLCHQLALTGVDVDFT

SEQ ID NO: 1503974 - protein, 26 aa, Mycobacterium tuberculosis
MAEEVMAPLGPILVAAAGIGPGVRVL

SEQ ID NO: 1503975 - protein, 18 aa, Mycobacterium tuberculosis
MAFGVPLTGSISAAGDHA

SEQ ID NO: 1503976 - protein, 25 aa, Mycobacterium tuberculosis
MAIYDTMVLAPCDIATYAMGMAASM

SEQ ID NO: 1503977 - protein, 26 aa, Mycobacterium tuberculosis
MALGKNLLVAIMPWEGHNYEDAIILS

SEQ ID NO: 1503978 - protein, 18 aa, Mycobacterium tuberculosis
MCGPKFCSMRITQDVREY

SEQ ID NO: 1503979 - protein, 25 aa, Mycobacterium tuberculosis
MDAHARVLVWELIDALRRDGVTVVL

SEQ ID NO: 1503980 - protein, 27 aa, Mycobacterium tuberculosis
MDSAVTVFIPAFLRYDLRPVTGEWQIA

SEQ ID NO: 1503981 - protein, 31 aa, Mycobacterium tuberculosis; identical to SEQ ID NO: 215342

SEQ ID NO: 1503982 - protein, 22 aa, Mycobacterium tuberculosis
MDVRFLPNPHWVDELRPLTGQH

SEQ ID NO: 1503983 - protein, 17 aa, Mycobacterium tuberculosis
MEWCAMVGCPIVGINDS

SEQ ID NO: 1503984 - protein, 35 aa, Mycobacterium tuberculosis; identical to SEQ ID NO: 220651

SEQ ID NO: 1503985 - protein, 20 aa, Mycobacterium tuberculosis
MGPVVNLTRWMEAAGCLVFE

SEQ ID NO: 1503986 - protein, 24 aa, Mycobacterium tuberculosis
MGRLAARGFAAYGTAKAALAHYTR

SEQ ID NO: 1503987 - protein, 25 aa, Mycobacterium tuberculosis
MIALRRLRELIDRYPLRGIKGPMGT

SEQ ID NO: 1503988 - protein, 34 aa, Mycobacterium tuberculosis; identical to SEQ ID NO: 220675

SEQ ID NO: 1503989 - protein, 24 aa, Mycobacterium tuberculosis
MMHVGALMPFTPPSGAPPDLLRQL

SEQ ID NO: 1503990 - protein, 17 aa, Mycobacterium tuberculosis
MNLNHYEAIALVQKIAF

SEQ ID NO: 1503991 - protein, 32 aa, Mycobacterium tuberculosis; identical to SEQ ID NO: 220698

SEQ ID NO: 1503992 - protein, 19 aa, Mycobacterium tuberculosis
MNVLYSLQHLGYTIPPQAD

SEQ ID NO: 1503993 - protein, 25 aa, Mycobacterium tuberculosis
MQNGYLLLMQVGDGSALAALAATGC

SEQ ID NO: 1503994 - protein, 24 aa, Mycobacterium tuberculosis
MRGEFLWCQLFSEPGAGSDLASLR

SEQ ID NO: 1503995 - protein, 19 aa, Mycobacterium tuberculosis
MRRVGDIAALPEAIEAASR

SEQ ID NO: 1503996 - protein, 25 aa, Mycobacterium tuberculosis
MSAGVIEVAPLAYMRGRTLNDAFIV

SEQ ID NO: 1503997 - protein, 35 aa, Mycobacterium tuberculosis; identical to SEQ ID NO: 220728

SEQ ID NO: 1503998 - protein, 23 aa, Mycobacterium tuberculosis
MSENPACIARLPDQGRPLEVGEP

SEQ ID NO: 1503999 - protein, 25 aa, Mycobacterium tuberculosis
MSGTRITLHAALQLARRGSGVGVAA

SEQ ID NO: 1504000 - protein, 25 aa, Mycobacterium tuberculosis
MSHATEFIMLIAENHWRVAEEPVEV

SEQ ID NO: 1504001 - protein, 25 aa, Mycobacterium tuberculosis
MSLERRMLLRAYGAELILTPGADGM

SEQ ID NO: 1504002 - protein, 22 aa, Mycobacterium tuberculosis
MTELPLLVIDVQRGGPSTGLPT

SEQ ID NO: 1504003 - protein, 20 aa, Mycobacterium tuberculosis
MTFPQWRTQLRLQHALVLLA

SEQ ID NO: 1504004 - protein, 20 aa, Mycobacterium tuberculosis
MTLGSYRWLRPSGRRTAKEI

SEQ ID NO: 1504005 - protein, 29 aa, Mycobacterium tuberculosis
MTMLSLQHRWAQTPWRRFKRRLSTELSSL

SEQ ID NO: 1504006 - protein, 19 aa, Mycobacterium tuberculosis
MTRPRFGSWLRNSTRGALA

SEQ ID NO: 1504007 - protein, 17 aa, Mycobacterium tuberculosis
MVGFFAYDMVRRLERLP

SEQ ID NO: 1504008 - protein, 17 aa, Mycobacterium tuberculosis
MVTNWTVAPAGPGSSVT

SEQ ID NO: 1504009 - protein, 30 aa, Mycobacterium tuberculosis; identical to SEQ ID NO: 220771

SEQ ID NO: 1504010 - protein, 30 aa, Mycobacterium tuberculosis; identical to SEQ ID NO: 220775

SEQ ID NO: 1504011 - protein, 24 aa, Mycobacterium tuberculosis
NAEVERPLAVSLPTRQCTFDKVSA

SEQ ID NO: 1504012 - protein, 24 aa, Mycobacterium tuberculosis
NAGKLIVVVLPDFGERYLSTPLFA

SEQ ID NO: 1504013 - protein, 24 aa, Mycobacterium tuberculosis
NAGVYAFDIAALRSALSRLSSNNA

SEQ ID NO: 1504014 - protein, 25 aa, Mycobacterium tuberculosis
NAKTPFFLHRHDGALLFTAGLWSVW

SEQ ID NO: 1504015 - protein, 29 aa, Mycobacterium tuberculosis
NALPEWPQMLLRALMFRLAVYALHPRSTA

SEQ ID NO: 1504016 - protein, 20 aa, Mycobacterium tuberculosis
NANPFALLVGMLLDQQVPME

SEQ ID NO: 1504017 - protein, 17 aa, Mycobacterium tuberculosis
NDELRAPMEQATPLRRL

SEQ ID NO: 1504018 - protein, 19 aa, Mycobacterium tuberculosis
NDITYNRLIQGLKAAGVEV

SEQ ID NO: 1504019 - protein, 20 aa, Mycobacterium tuberculosis
NDLQLWRQIEFPGTNGQVSA

SEQ ID NO: 1504020 - protein, 28 aa, Mycobacterium tuberculosis
NDQRPITVPVLLLLTERFDLSAQYFSSD

SEQ ID NO: 1504021 - protein, 25 aa, Mycobacterium tuberculosis
NERRTNWLNNFYFGGDHGVPDSVAR

SEQ ID NO: 1504022 - protein, 25 aa, Mycobacterium tuberculosis
NETEALLRRIGLAAAKYWVCKRSTA

SEQ ID NO: 1504023 - protein, 32 aa, Mycobacterium tuberculosis; identical to SEQ ID NO: 220833

SEQ ID NO: 1504024 - protein, 17 aa, Mycobacterium tuberculosis
NFLPAPGPVTKFHPPSG

SEQ ID NO: 1504025 - protein, 24 aa, Mycobacterium tuberculosis
NGCKTWISNARRSGLFAVLCKTDP

SEQ ID NO: 1504026 - protein, 21 aa, Mycobacterium tuberculosis
NGFWPVYRRVADPVKPRGNLV

SEQ ID NO: 1504027 - protein, 26 aa, Mycobacterium tuberculosis
NGHRRKFLALLRDPSVKRIVVEHRDR

SEQ ID NO: 1504028 - protein, 27 aa, Mycobacterium tuberculosis
NGQKMWTSLIQYADYVWLAVRTNPESS

SEQ ID NO: 1504029 - protein, 34 aa, Mycobacterium tuberculosis; identical to SEQ ID NO: 220868

SEQ ID NO: 1504030 - protein, 25 aa, Mycobacterium tuberculosis
NHGLFDTVFCCGLFYHLENPKQYLE

SEQ ID NO: 1504031 - protein, 19 aa, Mycobacterium tuberculosis
NIAARRALVGDLLTPGMQT

SEQ ID NO: 1504032 - protein, 20 aa, Mycobacterium tuberculosis
NIKRQWWRSVVTGRDDVVGI

SEQ ID NO: 1504033 - protein, 24 aa, Mycobacterium tuberculosis
NKVPNAAALPFRYTVNGYRGCSHA

SEQ ID NO: 1504034 - protein, 19 aa, Mycobacterium tuberculosis
NLGKLLTKRARVIGTTLRA

SEQ ID NO: 1504035 - protein, 22 aa, Mycobacterium tuberculosis
NLRGAWLCTKHAAPRMIERGGG

SEQ ID NO: 1504036 - protein, 22 aa, Mycobacterium tuberculosis
NLRQMERVIPGSEFAFSLVYEV

SEQ ID NO: 1504037 - protein, 22 aa, Mycobacterium tuberculosis
NMVDTFVLLTLARTGDQLQGIK

SEQ ID NO: 1504038 - protein, 27 aa, Mycobacterium tuberculosis
NNANYAWIQHILYKLAPGGRAGVVMAN

SEQ ID NO: 1504039 - protein, 17 aa, Mycobacterium tuberculosis
NNGLVEIVPLGISKATG

SEQ ID NO: 1504040 - protein, 24 aa, Mycobacterium tuberculosis
NPVLRGILALDQAGGRPGPTNRRK

SEQ ID NO: 1504041 - protein, 23 aa, Mycobacterium tuberculosis
NQQRAVLEGRLEQLRTFEREYRT

SEQ ID NO: 1504042 - protein, 17 aa, Mycobacterium tuberculosis
NRAGSARAWWVLTAAGI

SEQ ID NO: 1504043 - protein, 28 aa, Mycobacterium tuberculosis
NRYAPPPPYPAPDPFEPFAVAAVELADE

SEQ ID NO: 1504044 - protein, 30 aa, Mycobacterium tuberculosis; identical to SEQ ID NO: 220979

SEQ ID NO: 1504045 - protein, 25 aa, Mycobacterium tuberculosis
NTSRATLYVAMTPARESNTAYLCER

SEQ ID NO: 1504046 - protein, 24 aa, Mycobacterium tuberculosis
NTTAAALAGLKPAFRGDGTITAGS

SEQ ID NO: 1504047 - protein, 18 aa, Mycobacterium tuberculosis
NVARIVHVLGGCSTALFP

SEQ ID NO: 1504048 - protein, 25 aa, Mycobacterium tuberculosis
NVETVPRIFKRIRPAFTYRRSLGVL

SEQ ID NO: 1504049 - protein, 27 aa, Mycobacterium tuberculosis
NVLKETLRLHPPLIILMRVAKGEFEVQ

SEQ ID NO: 1504050 - protein, 24 aa, Mycobacterium tuberculosis
NVPASLVEYVIMGQVLTAGAGQMP

SEQ ID NO: 1504051 - protein, 25 aa, Mycobacterium tuberculosis
NVPEARLVVIKPYEANQLRAIETAI

SEQ ID NO: 1504052 - protein, 30 aa, Mycobacterium tuberculosis; identical to SEQ ID NO: 221008

SEQ ID NO: 1504053 - protein, 23 aa, Mycobacterium tuberculosis
PAAWTHLVGIKPQRGRISTWPLP

SEQ ID NO: 1504054 - protein, 32 aa, Mycobacterium tuberculosis; identical to SEQ ID NO: 221027

SEQ ID NO: 1504055 - protein, 22 aa, Mycobacterium tuberculosis
PADNIPPLVAVAQQLGVCGAEL

SEQ ID NO: 1504056 - protein, 24 aa, Mycobacterium tuberculosis
PAELRPALERAFASGLPAVVNVLT

SEQ ID NO: 1504057 - protein, 24 aa, Mycobacterium tuberculosis
PAERRKIVQLLIDGAPISREHAEA

SEQ ID NO: 1504058 - protein, 25 aa, Mycobacterium tuberculosis
PAERYQPWLDRLLAMSWDDSEHRKI

SEQ ID NO: 1504059 - protein, 28 aa, Mycobacterium tuberculosis
PAHQPGSWSRLFTGATFPGASKAVADLR

SEQ ID NO: 1504060 - protein, 30 aa, Mycobacterium tuberculosis; identical to SEQ ID NO: 221045

SEQ ID NO: 1504061 - protein, 29 aa, Mycobacterium tuberculosis
PAIIAEYLGLPQLTHLRKVSIEGGKITGE

SEQ ID NO: 1504062 - protein, 17 aa, Mycobacterium tuberculosis
PALACGNAFVLKPSERD

SEQ ID NO: 1504063 - protein, 20 aa, Mycobacterium tuberculosis
PALTINKMCLSGIDAIALAD

SEQ ID NO: 1504064 - protein, 23 aa, Mycobacterium tuberculosis
PAPRALLALLTGPPPDSPRDVIV

SEQ ID NO: 1504065 - protein, 32 aa, Mycobacterium tuberculosis; identical to SEQ ID NO: 221067

SEQ ID NO: 1504066 - protein, 30 aa, Mycobacterium tuberculosis; identical to SEQ ID NO: 221070

SEQ ID NO: 1504067 - protein, 19 aa, Mycobacterium tuberculosis
PARPRAGLIGCAFADLAEV

SEQ ID NO: 1504068 - protein, 28 aa, Mycobacterium tuberculosis
PAVIKNAIDWLSRPFGDGALKDKPLAVI

SEQ ID NO: 1504069 - protein, 20 aa, Mycobacterium tuberculosis
PAWVTLLRSAGAHDTYLRTY

SEQ ID NO: 1504070 - protein, 25 aa, Mycobacterium tuberculosis
PDAPTLSGFWHWAVANLPANVTELP

SEQ ID NO: 1504071 - protein, 24 aa, Mycobacterium tuberculosis
PDEFAIVHKLRRVLSGLDSHQAID

SEQ ID NO: 1504072 - protein, 21 aa, Mycobacterium tuberculosis
PDIDIRWRTVTFALVTHAVGG

SEQ ID NO: 1504073 - protein, 23 aa, Mycobacterium tuberculosis
PDLEVVALLSRGKLLYGVIDDEN

SEQ ID NO: 1504074 - protein, 24 aa, Mycobacterium tuberculosis
PDSFLRAAELLGVTPDAAAVFEDA

SEQ ID NO: 1504075 - protein, 24 aa, Mycobacterium tuberculosis
PDVDRLARSMLLLHGDHHDHNDSP

SEQ ID NO: 1504076 - protein, 19 aa, Mycobacterium tuberculosis
PDVVQRLSALGLLVSITVT

SEQ ID NO: 1504077 - protein, 24 aa, Mycobacterium tuberculosis
PDYRFNFGVAYDRSLLFGYALDEV

SEQ ID NO: 1504078 - protein, 23 aa, Mycobacterium tuberculosis
PEEDGPIAVMPPAPGMVVAANSV

SEQ ID NO: 1504079 - protein, 24 aa, Mycobacterium tuberculosis
PEETFPVIVALMTNVFDGAAIVRG

SEQ ID NO: 1504080 - protein, 20 aa, Mycobacterium tuberculosis
PEGIEGRVPFRGPLSSVIHQ

SEQ ID NO: 1504081 - protein, 30 aa, Mycobacterium tuberculosis; identical to SEQ ID NO: 221153

SEQ ID NO: 1504082 - protein, 19 aa, Mycobacterium tuberculosis
PEILLLDEGIGAVDADFLR

SEQ ID NO: 1504083 - protein, 26 aa, Mycobacterium tuberculosis
PEISEQLLRVLARRLRRTNNNLADLI

SEQ ID NO: 1504084 - protein, 17 aa, Mycobacterium tuberculosis
PEPVVYPLDQAAAAIAS

SEQ ID NO: 1504085 - protein, 30 aa, Mycobacterium tuberculosis; identical to SEQ ID NO: 221177

SEQ ID NO: 1504086 - protein, 19 aa, Mycobacterium tuberculosis
PEVRSQLAMTWGTETFIVP

SEQ ID NO: 1504087 - protein, 26 aa, Mycobacterium tuberculosis
PFAGHPTVGASWWLRERGTPINTLQV

SEQ ID NO: 1504088 - protein, 30 aa, Mycobacterium tuberculosis; identical to SEQ ID NO: 221182

SEQ ID NO: 1504089 - protein, 24 aa, Mycobacterium tuberculosis
PGASYFVLVFDRAAIPEGPINAVT

SEQ ID NO: 1504090 - protein, 18 aa, Mycobacterium tuberculosis
PGGFRYGPAFGVELQFWV

SEQ ID NO: 1504091 - protein, 22 aa, Mycobacterium tuberculosis
PGKWGEYLLASRATTIYGGTSE

SEQ ID NO: 1504092 - protein, 31 aa, Mycobacterium tuberculosis; identical to SEQ ID NO: 221239

SEQ ID NO: 1504093 - protein, 18 aa, Mycobacterium tuberculosis
PGSGMRGVIAKKGNIPVG

SEQ ID NO: 1504094 - protein, 21 aa, Mycobacterium tuberculosis
PGSLAAKWLVTRVPVAGLAEK

SEQ ID NO: 1504095 - protein, 24 aa, Mycobacterium tuberculosis
PGSPAHHVLSLVQLPVVGADTEDI

SEQ ID NO: 1504096 - protein, 18 aa, Mycobacterium tuberculosis
PGSRFDTRRILWGDPSQK

SEQ ID NO: 1504097 - protein, 32 aa, Mycobacterium tuberculosis; identical to SEQ ID NO: 221254

SEQ ID NO: 1504098 - protein, 19 aa, Mycobacterium tuberculosis
PGVWHSSGMNRIRLSTTVD

SEQ ID NO: 1504099 - protein, 22 aa, Mycobacterium tuberculosis
PHIEKRFSMPWGHPARRMREFV

SEQ ID NO: 1504100 - protein, 23 aa, Mycobacterium tuberculosis
PHQPLLCNALIALCDFTADNGAT

SEQ ID NO: 1504101 - protein, 32 aa, Mycobacterium tuberculosis; identical to SEQ ID NO: 225413

SEQ ID NO: 1504102 - protein, 25 aa, Mycobacterium tuberculosis
PIGAPSFVEALRWGAEVYHALKSVL

SEQ ID NO: 1504103 - protein, 36 aa, Mycobacterium tuberculosis; identical to SEQ ID NO: 221299

SEQ ID NO: 1504104 - protein, 18 aa, Mycobacterium tuberculosis
PKHNGITYFLLDMKSEGV

SEQ ID NO: 1504105 - protein, 22 aa, Mycobacterium tuberculosis
PLLHRRPDQRRLLLDDPEGIPD

SEQ ID NO: 1504106 - protein, 34 aa, Mycobacterium tuberculosis; identical to SEQ ID NO: 221325

SEQ ID NO: 1504107 - protein, 24 aa, Mycobacterium tuberculosis
PLNTVGFHEPPIAPSLPTPVPHNE

SEQ ID NO: 1504108 - protein, 17 aa, Mycobacterium tuberculosis
PMHRYYSTIKDLTRLLG

SEQ ID NO: 1504109 - protein, 23 aa, Mycobacterium tuberculosis
PMSARFRSLPAGDSVLYCGNDKY

SEQ ID NO: 1504110 - protein, 20 aa, Mycobacterium tuberculosis
PMTPFERKIVHDAVAAVPGV

SEQ ID NO: 1504111 - protein, 29 aa, Mycobacterium tuberculosis
PNLGMTEFKVFWQPPPAPEIPKSSLGAGL

SEQ ID NO: 1504112 - protein, 20 aa, Mycobacterium tuberculosis
PNPFPMSIMDNVLAGVRAHK

SEQ ID NO: 1504113 - protein, 35 aa, Mycobacterium tuberculosis; identical to SEQ ID NO: 221356

SEQ ID NO: 1504114 - protein, 19 aa, Mycobacterium tuberculosis
PPLSGGMVGFFAYDMVRRL

SEQ ID NO: 1504115 - protein, 17 aa, Mycobacterium tuberculosis
PPRPLTHDLIRDLIAAL

SEQ ID NO: 1504116 - protein, 20 aa, Mycobacterium tuberculosis
PPVPLDAAILFAPVGDLVLP

SEQ ID NO: 1504117 - protein, 27 aa, Mycobacterium tuberculosis
PQAIDPVLLDLLRLGTYQLLRTRVDAH

SEQ ID NO: 1504118 - protein, 22 aa, Mycobacterium tuberculosis
PQITAMLRRLGIEGDFKGGFRV

SEQ ID NO: 1504119 - protein, 17 aa, Mycobacterium tuberculosis
PQLSIPSVTVPPITIPA

SEQ ID NO: 1504120 - protein, 21 aa, Mycobacterium tuberculosis
PQQRVGLRVAWRTLENSGINP

SEQ ID NO: 1504121 - protein, 36 aa, Mycobacterium tuberculosis; identical to SEQ ID NO: 221400

SEQ ID NO: 1504122 - protein, 19 aa, Mycobacterium tuberculosis
PQVDKGVKWDPAELGPVVS

SEQ ID NO: 1504123 - protein, 18 aa, Mycobacterium tuberculosis
PRARARFLAITGGGGFLL

SEQ ID NO: 1504124 - protein, 24 aa, Mycobacterium tuberculosis
PRGDGLALALSYAKAIGGTRAGVI

SEQ ID NO: 1504125 - protein, 24 aa, Mycobacterium tuberculosis
PRIAGMGFDVVYLPPIHPIGKVHR

SEQ ID NO: 1504126 - protein, 24 aa, Mycobacterium tuberculosis
PRVVRLYRRRIAPGGFRYGPAFGV

SEQ ID NO: 1504127 - protein, 18 aa, Mycobacterium tuberculosis
PRWQVTVSVVFDDWAAAV

SEQ ID NO: 1504128 - protein, 23 aa, Mycobacterium tuberculosis
PSAWSVEGLLPYLTGDAQYALFA

SEQ ID NO: 1504129 - protein, 24 aa, Mycobacterium tuberculosis
PTGDAELLLIGWGSSYGPIGEACR

SEQ ID NO: 1504130 - protein, 29 aa, Mycobacterium tuberculosis
PTRRVRLMRWGLIPSWIKAGPGGAPDAKG

SEQ ID NO: 1504131 - protein, 19 aa, Mycobacterium tuberculosis
PTRVPFTRGLHEVADRVWA

SEQ ID NO: 1504132 - protein, 18 aa, Mycobacterium tuberculosis
PTSSYLWRNIMPHLEGLG

SEQ ID NO: 1504133 - protein, 27 aa, Mycobacterium tuberculosis
PVAAEIARLALFLTTPAARHITGQTLH

SEQ ID NO: 1504134 - protein, 20 aa, Mycobacterium tuberculosis
PVAWIHGTALRTEPLAFAGR

SEQ ID NO: 1504135 - protein, 19 aa, Mycobacterium tuberculosis
PVDQLRYPVFSWQRITLQE

SEQ ID NO: 1504136 - protein, 25 aa, Mycobacterium tuberculosis
PVGGFPVTFGWIHASRRGHARLHRG

SEQ ID NO: 1504137 - protein, 19 aa, Mycobacterium tuberculosis
PVHFVQMWVIPDATGITAS

SEQ ID NO: 1504138 - protein, 25 aa, Mycobacterium tuberculosis
PVLDRYDYVLIDCQPSLGLLTVNGL

SEQ ID NO: 1504139 - protein, 17 aa, Mycobacterium tuberculosis
PYLLIRNHKNRPVLAIN

SEQ ID NO: 1504140 - protein, 20 aa, Mycobacterium tuberculosis
PYSLLMGSIRVADEVSVAFT

SEQ ID NO: 1504141 - protein, 18 aa, Mycobacterium tuberculosis
PYVLPRLVPVAGDSAGGV

SEQ ID NO: 1504142 - protein, 25 aa, Mycobacterium tuberculosis
QAASAFAMWFPIEGGSKYGGYGRAK

SEQ ID NO: 1504143 - protein, 24 aa, Mycobacterium tuberculosis
QARALARHFGARRKAYNWAVATLK

SEQ ID NO: 1504144 - protein, 21 aa, Mycobacterium tuberculosis
QASLMRIPAPASNTTGLTETS

SEQ ID NO: 1504145 - protein, 26 aa, Mycobacterium tuberculosis
QATGARIAFLIRFGTGVLPEPKTVLQ

SEQ ID NO: 1504146 - protein, 26 aa, Mycobacterium tuberculosis
QAVLAAFPEAAVVRTAWVYTGGTGKD

SEQ ID NO: 1504147 - protein, 24 aa, Mycobacterium tuberculosis
QAVTPAARALPLTSLTSAAQTAPG

SEQ ID NO: 1504148 - protein, 22 aa, Mycobacterium tuberculosis
QDQVFDLLMPTAVEGSLSLDEL

SEQ ID NO: 1504149 - protein, 19 aa, Mycobacterium tuberculosis
QDRRKLLETLANATSLTVP

SEQ ID NO: 1504150 - protein, 24 aa, Mycobacterium tuberculosis
QDVLVDYGAFLRSLVDTSGLRPLR

SEQ ID NO: 1504151 - protein, 22 aa, Mycobacterium tuberculosis
QEGLDKVFQVLRAPHTEEPTNW

SEQ ID NO: 1504152 - protein, 21 aa, Mycobacterium tuberculosis
QEISRLIGRSLRACIDLAALG

SEQ ID NO: 1504153 - protein, 20 aa, Mycobacterium tuberculosis
QFARIFYARPETRKFRVEFL

SEQ ID NO: 1504154 - protein, 18 aa, Mycobacterium tuberculosis
QFRQELIPLLNDAYPPRA

SEQ ID NO: 1504155 - protein, 24 aa, Mycobacterium tuberculosis
QFRRFAACPICHLHLRSFANRHQE

SEQ ID NO: 1504156 - protein, 31 aa, Mycobacterium tuberculosis; identical to SEQ ID NO: 221637

SEQ ID NO: 1504157 - protein, 25 aa, Mycobacterium tuberculosis
QFWSQIHGFVMLELAGFYGDRGAAV

SEQ ID NO: 1504158 - protein, 20 aa, Mycobacterium tuberculosis
QFYAAMLAGLGLDAAELPPQ

SEQ ID NO: 1504159 - protein, 19 aa, Mycobacterium tuberculosis
QGFCYTAFVTDVCTRKIVV

SEQ ID NO: 1504160 - protein, 18 aa, Mycobacterium tuberculosis
QGLQDQVFDLLMPTAVEG

SEQ ID NO: 1504161 - protein, 17 aa, Mycobacterium tuberculosis
QGWQWAVVVASYSGADH

SEQ ID NO: 1504162 - protein, 24 aa, Mycobacterium tuberculosis
QGWVPVIGPFFHRGLMLLDFEEHM

SEQ ID NO: 1504163 - protein, 26 aa, Mycobacterium tuberculosis
QGYHMTTFGFILGEVFRRVTGRTVGQ

SEQ ID NO: 1504164 - protein, 22 aa, Mycobacterium tuberculosis
QIKRFRILPTLWEPGGDEITLT

SEQ ID NO: 1504165 - protein, 25 aa, Mycobacterium tuberculosis
QIRLGGDMALFAGLGRLLLEAEERV

SEQ ID NO: 1504166 - protein, 29 aa, Mycobacterium tuberculosis
QITSVLPGRPPLATYFLPNNRGKKSVTVD

SEQ ID NO: 1504167 - protein, 19 aa, Mycobacterium tuberculosis
QIYQMYRLLAVAKYEERYV

SEQ ID NO: 1504168 - protein, 18 aa, Mycobacterium tuberculosis
QKRLTEELAWVRSGAKAR

SEQ ID NO: 1504169 - protein, 25 aa, Mycobacterium tuberculosis
QLADEIFVIADLARQKARASQYTFM

SEQ ID NO: 1504170 - protein, 18 aa, Mycobacterium tuberculosis
QLAFDERRLRQVLSALDC

SEQ ID NO: 1504171 - protein, 36 aa, Mycobacterium tuberculosis; identical to SEQ ID NO: 225466

SEQ ID NO: 1504172 - protein, 18 aa, Mycobacterium tuberculosis
QLLCLARTLAVNPEVLLL

SEQ ID NO: 1504173 - protein, 19 aa, Mycobacterium tuberculosis
QLLHEVWGYDFFGGTRTVD

SEQ ID NO: 1504174 - protein, 18 aa, Mycobacterium tuberculosis
QLMGQLINAIFGPTGATT

SEQ ID NO: 1504175 - protein, 26 aa, Mycobacterium tuberculosis
QLPTMFADVRRELAIRAAVEAATVTD

SEQ ID NO: 1504176 - protein, 17 aa, Mycobacterium tuberculosis
QLPVGMLDGLVAADWPP

SEQ ID NO: 1504177 - protein, 19 aa, Mycobacterium tuberculosis
QLRTSVAMLSYADDLYFGI

SEQ ID NO: 1504178 - protein, 32 aa, Mycobacterium tuberculosis; identical to SEQ ID NO: 221733

SEQ ID NO: 1504179 - protein, 32 aa, Mycobacterium tuberculosis; identical to SEQ ID NO: 221735

SEQ ID NO: 1504180 - protein, 19 aa, Mycobacterium tuberculosis
QMDAYFARFGGVRDYLRAV

SEQ ID NO: 1504181 - protein, 24 aa, Mycobacterium tuberculosis
QMGRDGWLALGWPKEYGGQGRSAM

SEQ ID NO: 1504182 - protein, 20 aa, Mycobacterium tuberculosis
QMRYDLSAGFPLLTTKKVHF

SEQ ID NO: 1504183 - protein, 18 aa, Mycobacterium tuberculosis
QMVSVATAMIPFLEHDDA

SEQ ID NO: 1504184 - protein, 24 aa, Mycobacterium tuberculosis
QNATKPWMLYYATGATHAPHHVFK

SEQ ID NO: 1504185 - protein, 19 aa, Mycobacterium tuberculosis
QNIAFPLTLAKMRKADIAQ

SEQ ID NO: 1504186 - protein, 26 aa, Mycobacterium tuberculosis
QPWDRDHIHRLFDDLEFRVLRDRLFD

SEQ ID NO: 1504187 - protein, 21 aa, Mycobacterium tuberculosis
QQRLALACALVGRPQLVFLDE

SEQ ID NO: 1504188 - protein, 21 aa, Mycobacterium tuberculosis
QQRRFEWLLSVLRLADRLIPH

SEQ ID NO: 1504189 - protein, 30 aa, Mycobacterium tuberculosis; identical to SEQ ID NO: 116893

SEQ ID NO: 1504190 - protein, 18 aa, Mycobacterium tuberculosis
QRAFSVVPLMLHGDAAFA

SEQ ID NO: 1504191 - protein, 22 aa, Mycobacterium tuberculosis
QRAHWPLGTLQLTAIAACCAPR

SEQ ID NO: 1504192 - protein, 25 aa, Mycobacterium tuberculosis
QREALLLTQLLGLSYADAAAVCGCP

SEQ ID NO: 1504193 - protein, 20 aa, Mycobacterium tuberculosis
QRGMPVLGICRGTQVLNVAL

SEQ ID NO: 1504194 - protein, 24 aa, Mycobacterium tuberculosis
QRIRPSLDWLIKNVGPHALASQDL

SEQ ID NO: 1504195 - protein, 29 aa, Mycobacterium tuberculosis
QRLYSFKDILVLKIVKRLLDTGISLHNIR

SEQ ID NO: 1504196 - protein, 25 aa, Mycobacterium tuberculosis
QRNGERYQFLRWGQGAFDDFKVVPP

SEQ ID NO: 1504197 - protein, 26 aa, Mycobacterium tuberculosis
QRPGAQIKYLVRMRSWPGGHARVLGE

SEQ ID NO: 1504198 - protein, 24 aa, Mycobacterium tuberculosis
QRPRQRGIPFIFVRTDKAGNISKR

SEQ ID NO: 1504199 - protein, 25 aa, Mycobacterium tuberculosis
QRRAPTPPLHITLDATINAARTVRA

SEQ ID NO: 1504200 - protein, 21 aa, Mycobacterium tuberculosis
QRRARLYDQLAATGDFRRGSI

SEQ ID NO: 1504201 - protein, 24 aa, Mycobacterium tuberculosis
QRSLLGQMLTSRPCPTCRGVGVVI

SEQ ID NO: 1504202 - protein, 32 aa, Mycobacterium tuberculosis; identical to SEQ ID NO: 221806

SEQ ID NO: 1504203 - protein, 27 aa, Mycobacterium tuberculosis
QRWAELVYDGLWYSPLKAALEAFVAKT

SEQ ID NO: 1504204 - protein, 29 aa, Mycobacterium tuberculosis
QRWEGSPDALLTWATYRAPFLAAVEDGAL

SEQ ID NO: 1504205 - protein, 24 aa, Mycobacterium tuberculosis
QSGKYRRVLALAWEKQSESNAMWA

SEQ ID NO: 1504206 - protein, 21 aa, Mycobacterium tuberculosis
QSNYGVKPYSLLMGSIRVADE

SEQ ID NO: 1504207 - protein, 22 aa, Mycobacterium tuberculosis
QSQVPAHTQLAWVLGCFTGFGQ

SEQ ID NO: 1504208 - protein, 24 aa, Mycobacterium tuberculosis
QTEGAGFDWVSWVTALGSAPDAMT

SEQ ID NO: 1504209 - protein, 24 aa, Mycobacterium tuberculosis
QTGRPFFEALYADPRRLEAFMAAM

SEQ ID NO: 1504210 - protein, 33 aa, Mycobacterium tuberculosis; identical to SEQ ID NO: 221843

SEQ ID NO: 1504211 - protein, 27 aa, Mycobacterium tuberculosis
QTRRWNPKMKRFIFTDRNGIYIIDLQQ

SEQ ID NO: 1504212 - protein, 23 aa, Mycobacterium tuberculosis
QTTYGGRWVVNPSGGLISKGHPL

SEQ ID NO: 1504213 - protein, 31 aa, Mycobacterium tuberculosis; identical to SEQ ID NO: 221856

SEQ ID NO: 1504214 - protein, 23 aa, Mycobacterium tuberculosis
QVCPVCLGLPGSLPVLNRAAVES

SEQ ID NO: 1504215 - protein, 25 aa, Mycobacterium tuberculosis
QVGQKFAREIFFLGRTYTAEQMHQM

SEQ ID NO: 1504216 - protein, 17 aa, Mycobacterium tuberculosis
QVHRLAVPSLPVGSVLT

SEQ ID NO: 1504217 - protein, 17 aa, Mycobacterium tuberculosis
QVLPDRNLLVPLNFHLG

SEQ ID NO: 1504218 - protein, 25 aa, Mycobacterium tuberculosis
QVLVNEHLIGPPPATVIRLSDYPYV

SEQ ID NO: 1504219 - protein, 21 aa, Mycobacterium tuberculosis
RAALTRAIHKLPIKARIITRE

SEQ ID NO: 1504220 - protein, 34 aa, Mycobacterium tuberculosis; identical to SEQ ID NO: 221903

SEQ ID NO: 1504221 - protein, 18 aa, Mycobacterium tuberculosis
RAAWVNIPEVVSAATVTG

SEQ ID NO: 1504222 - protein, 21 aa, Mycobacterium tuberculosis
RADDIAHRRLAITGVNEYPNL

SEQ ID NO: 1504223 - protein, 18 aa, Mycobacterium tuberculosis
RAEHLMLVDLGRNDLGRV

SEQ ID NO: 1504224 - protein, 25 aa, Mycobacterium tuberculosis
RAELRKRYRLGERPTVVCLSRLVPR

SEQ ID NO: 1504225 - protein, 24 aa, Mycobacterium tuberculosis
RAFAADMAFLRNCGIHPVVVHGGG

SEQ ID NO: 1504226 - protein, 24 aa, Mycobacterium tuberculosis
RAHREPQLLLNYLGSLHVGVGDLA

SEQ ID NO: 1504227 - protein, 20 aa, Mycobacterium tuberculosis
RALILVSPEDRPALKKAGFL

SEQ ID NO: 1504228 - protein, 18 aa, Mycobacterium tuberculosis
RALKYSKQMIDDISQLVY

SEQ ID NO: 1504229 - protein, 27 aa, Mycobacterium tuberculosis
RALYDEHAAVLWRYALRLTGDAAQAED

SEQ ID NO: 1504230 - protein, 27 aa, Mycobacterium tuberculosis
RANVVAVYQEALRKARLLLGSGHSVIL

SEQ ID NO: 1504231 - protein, 27 aa, Mycobacterium tuberculosis
RASCKYMKMITPAALLRCLVEGADEVH

SEQ ID NO: 1504232 - protein, 21 aa, Mycobacterium tuberculosis
RATLDVVDLPEPLDLDAGVEL

SEQ ID NO: 1504233 - protein, 25 aa, Mycobacterium tuberculosis
RAVPMWAHPEPLPPVSGLTIAVERW

SEQ ID NO: 1504234 - protein, 26 aa, Mycobacterium tuberculosis
RDAIDGRPRGHLRKFGLSRVRVRQLA

SEQ ID NO: 1504235 - protein, 23 aa, Mycobacterium tuberculosis
RDALRRIEIALGQAGATLADVVR

SEQ ID NO: 1504236 - protein, 29 aa, Mycobacterium tuberculosis
RDDDHMQGHWLLARLGKRVLRPGGVELTR

SEQ ID NO: 1504237 - protein, 23 aa, Mycobacterium tuberculosis
RDDGYRFMLLGRAIERVDMTVRL

SEQ ID NO: 1504238 - protein, 25 aa, Mycobacterium tuberculosis
RDDLQAVIAMLKKADLDVALQFVNY

SEQ ID NO: 1504239 - protein, 25 aa, Mycobacterium tuberculosis
RDDWAVHIALWRRSSNGQPEITDAA

SEQ ID NO: 1504240 - protein, 29 aa, Mycobacterium tuberculosis
RDEQGQDVLLFIDNIFRFTQAGSEVSTLL

SEQ ID NO: 1504241 - protein, 32 aa, Mycobacterium tuberculosis; identical to SEQ ID NO: 222024

SEQ ID NO: 1504242 - protein, 22 aa, Mycobacterium tuberculosis
RDGWRISWMPGVVVVVLGGDTV

SEQ ID NO: 1504243 - protein, 20 aa, Mycobacterium tuberculosis
RDGYAAVVPVLPLSDTIKAV

SEQ ID NO: 1504244 - protein, 20 aa, Mycobacterium tuberculosis
RDTTYLYRDGSDFVFMDSQD

SEQ ID NO: 1504245 - protein, 20 aa, Mycobacterium tuberculosis
RDVLAVLRWVADNIAVFGGD

SEQ ID NO: 1504246 - protein, 21 aa, Mycobacterium tuberculosis
RDYVMALGYLQAPVVVAGNDH

SEQ ID NO: 1504247 - protein, 30 aa, Mycobacterium tuberculosis; identical to SEQ ID NO: 222062

SEQ ID NO: 1504248 - protein, 21 aa, Mycobacterium tuberculosis
REASFFVDRLSQESMPLAGLV

SEQ ID NO: 1504249 - protein, 26 aa, Mycobacterium tuberculosis
REEERSLWLHRALLSPLLTEPDTVVS

SEQ ID NO: 1504250 - protein, 22 aa, Mycobacterium tuberculosis
REEMRDAVLAHRLAEIRKALGH

SEQ ID NO: 1504251 - protein, 23 aa, Mycobacterium tuberculosis
REIVGPDNYFLELMDHGLTIERR

SEQ ID NO: 1504252 - protein, 33 aa, Mycobacterium tuberculosis; identical to SEQ ID NO: 222075

SEQ ID NO: 1504253 - protein, 25 aa, Mycobacterium tuberculosis
REQLAEIVGAYFPRGWQIACHVHGD

SEQ ID NO: 1504254 - protein, 24 aa, Mycobacterium tuberculosis
RERGQWYYQRYIAHLPAKGEIVLF

SEQ ID NO: 1504255 - protein, 24 aa, Mycobacterium tuberculosis
RETFGVPRVVARIYDAKRAEVYER

SEQ ID NO: 1504256 - protein, 22 aa, Mycobacterium tuberculosis
REYALLLRHPEPRPWLVCVHGT

SEQ ID NO: 1504257 - protein, 17 aa, Mycobacterium tuberculosis
RFCAFAQRKGDADAYSL

SEQ ID NO: 1504258 - protein, 18 aa, Mycobacterium tuberculosis
RFGSWLRNSTRGALAMDP

SEQ ID NO: 1504259 - protein, 25 aa, Mycobacterium tuberculosis
RFIRDTTWVSVRWYRPGGPLTAQQV

SEQ ID NO: 1504260 - protein, 22 aa, Mycobacterium tuberculosis
RFTTVHMALVRTPMISPTTIYD

SEQ ID NO: 1504261 - protein, 24 aa, Mycobacterium tuberculosis
RGEPQALIRVGIAPPLAAVPAPTP

SEQ ID NO: 1504262 - protein, 19 aa, Mycobacterium tuberculosis
RGFARFRRLRWRHPLDGQT

SEQ ID NO: 1504263 - protein, 18 aa, Mycobacterium tuberculosis
RGHDYTDLALVTDGLRAE

SEQ ID NO: 1504264 - protein, 17 aa, Mycobacterium tuberculosis
RGIDVSFPLGVLTSVTG

SEQ ID NO: 1504265 - protein, 25 aa, Mycobacterium tuberculosis
RGIPVRRPGRFFATVDFSPMGCGIA

SEQ ID NO: 1504266 - protein, 17 aa, Mycobacterium tuberculosis
RGLTLFETTPGLEACDA

SEQ ID NO: 1504267 - protein, 30 aa, Mycobacterium tuberculosis; identical to SEQ ID NO: 222160

SEQ ID NO: 1504268 - protein, 26 aa, Mycobacterium tuberculosis
RGNLSLDALILMNFIQTNSAVYRRLE

SEQ ID NO: 1504269 - protein, 20 aa, Mycobacterium tuberculosis
RGPRALTRAAAFIHHLPVDQ

SEQ ID NO: 1504270 - protein, 25 aa, Mycobacterium tuberculosis
RGQNVYPMTLLGTFSPYMVVHRSSV

SEQ ID NO: 1504271 - protein, 20 aa, Mycobacterium tuberculosis
RGRHPLPSGASLQATVRRCG

SEQ ID NO: 1504272 - protein, 31 aa, Mycobacterium tuberculosis; identical to SEQ ID NO: 222169

SEQ ID NO: 1504273 - protein, 25 aa, Mycobacterium tuberculosis
RGSGDVLMVAWMNDEALARTLQTRE

SEQ ID NO: 1504274 - protein, 17 aa, Mycobacterium tuberculosis
RGTAPAGRGFWFPPTVL

SEQ ID NO: 1504275 - protein, 30 aa, Mycobacterium tuberculosis; identical to SEQ ID NO: 222183

SEQ ID NO: 1504276 - protein, 29 aa, Mycobacterium tuberculosis
RGYHRREDKPFWWAHFDRLNYPVDEWSDS

SEQ ID NO: 1504277 - protein, 25 aa, Mycobacterium tuberculosis
RHDRPPEWLVRQLAALLPELARYPS

SEQ ID NO: 1504278 - protein, 24 aa, Mycobacterium tuberculosis
RHDTYRSWFQYNGNGQIIRRTIQD

SEQ ID NO: 1504279 - protein, 20 aa, Mycobacterium tuberculosis
RHGFVKIFCRRSTGVVIGGV

SEQ ID NO: 1504280 - protein, 23 aa, Mycobacterium tuberculosis
RHGRPLLRHRVELGAGSLADDVI

SEQ ID NO: 1504281 - protein, 19 aa, Mycobacterium tuberculosis
RHLLEHKPSTRTRRLDGRT

SEQ ID NO: 1504282 - protein, 36 aa, Mycobacterium tuberculosis; identical to SEQ ID NO: 222207

SEQ ID NO: 1504283 - protein, 20 aa, Mycobacterium tuberculosis
RHPRWRGKKALLLQGRLWQG

SEQ ID NO: 1504284 - protein, 29 aa, Mycobacterium tuberculosis
RIAQAQLVGWLEGLFHGIQTALFAQQMAA

SEQ ID NO: 1504285 - protein, 19 aa, Mycobacterium tuberculosis
RIELAPRGVQVVGVYVGLV

SEQ ID NO: 1504286 - protein, 17 aa, Mycobacterium tuberculosis
RIELSEAAFRRFVAALD

SEQ ID NO: 1504287 - protein, 34 aa, Mycobacterium tuberculosis; identical to SEQ ID NO: 215366

SEQ ID NO: 1504288 - protein, 21 aa, Mycobacterium tuberculosis
RIQLRDALRAALLAFNTFDES

SEQ ID NO: 1504289 - protein, 25 aa, Mycobacterium tuberculosis
RISGKKGERIVYIRTLVTGKSSSAS

SEQ ID NO: 1504290 - protein, 17 aa, Mycobacterium tuberculosis
RITACLLANGGIFADGH

SEQ ID NO: 1504291 - protein, 19 aa, Mycobacterium tuberculosis
RKGMAVLLDALPKVVQRFP

SEQ ID NO: 1504292 - protein, 22 aa, Mycobacterium tuberculosis
RKHRQYPAHRKPAPSWRHTACP

SEQ ID NO: 1504293 - protein, 22 aa, Mycobacterium tuberculosis
RKIIGRQFIRAFEGAVRDVLDG

SEQ ID NO: 1504294 - protein, 27 aa, Mycobacterium tuberculosis
RKKWFGKRDVLPGVGLYLDGGFGVGKT

SEQ ID NO: 1504295 - protein, 17 aa, Mycobacterium tuberculosis
RKLYQACRRWPKLMRRL

SEQ ID NO: 1504296 - protein, 23 aa, Mycobacterium tuberculosis
RKTLPGLRALQKYAVRTGGGVNH

SEQ ID NO: 1504297 - protein, 36 aa, Mycobacterium tuberculosis; identical to SEQ ID NO: 17410

SEQ ID NO: 1504298 - protein, 20 aa, Mycobacterium tuberculosis
RLARRFAHLTYRGEIELDTR

SEQ ID NO: 1504299 - protein, 25 aa, Mycobacterium tuberculosis
RLCSDTLELLLRSTGYNDDVTLLAM

SEQ ID NO: 1504300 - protein, 20 aa, Mycobacterium tuberculosis
RLDIVVANAGVLGWGRLWEL

SEQ ID NO: 1504301 - protein, 17 aa, Mycobacterium tuberculosis
RLDRLLMLAEELGPPQK

SEQ ID NO: 1504302 - protein, 23 aa, Mycobacterium tuberculosis
RLDRLTAGVLLFTTRREVRGSYQ

SEQ ID NO: 1504303 - protein, 30 aa, Mycobacterium tuberculosis; identical to SEQ ID NO: 222306

SEQ ID NO: 1504304 - protein, 19 aa, Mycobacterium tuberculosis
RLHCDDEMYPLPRPHQPLL

SEQ ID NO: 1504305 - protein, 21 aa, Mycobacterium tuberculosis
RLLASFRVQPATEVIARRAGD

SEQ ID NO: 1504306 - protein, 18 aa, Mycobacterium tuberculosis
RLNIIRRLHPAFQQLRTI

SEQ ID NO: 1504307 - protein, 18 aa, Mycobacterium tuberculosis
RLPIDVIATVPMAENMPS

SEQ ID NO: 1504308 - protein, 35 aa, Mycobacterium tuberculosis; identical to SEQ ID NO: 222354

SEQ ID NO: 1504309 - protein, 18 aa, Mycobacterium tuberculosis
RMLIVPGSMRVRAQAEAE

SEQ ID NO: 1504310 - protein, 20 aa, Mycobacterium tuberculosis
RMNIGQILETHLGWCAHSGW

SEQ ID NO: 1504311 - protein, 32 aa, Mycobacterium tuberculosis; identical to SEQ ID NO: 222393

SEQ ID NO: 1504312 - protein, 22 aa, Mycobacterium tuberculosis
RNELLFRHRIDPQRPGRGIGEP

SEQ ID NO: 1504313 - protein, 23 aa, Mycobacterium tuberculosis
RNGNRWRVIAVDTEHHRIAARRL

SEQ ID NO: 1504314 - protein, 20 aa, Mycobacterium tuberculosis
RNGPWIADRLLELGVELAHI

SEQ ID NO: 1504315 - protein, 23 aa, Mycobacterium tuberculosis
RNIELLAKRFPFERYRRLCDVGC

SEQ ID NO: 1504316 - protein, 17 aa, Mycobacterium tuberculosis
RNLRKITIAQVHGAVLS

SEQ ID NO: 1504317 - protein, 23 aa, Mycobacterium tuberculosis
RNQITLRRRTGGADAGWHLKLPA

SEQ ID NO: 1504318 - protein, 23 aa, Mycobacterium tuberculosis
RNRLNLALTLKQGGNLILLDEPT

SEQ ID NO: 1504319 - protein, 17 aa, Mycobacterium tuberculosis
RNRVLVEGVNRIKKHTA

SEQ ID NO: 1504320 - protein, 34 aa, Mycobacterium tuberculosis; identical to SEQ ID NO: 222420

SEQ ID NO: 1504321 - protein, 22 aa, Mycobacterium tuberculosis
RPDLRRWLPLDVYRPLKSTLVT

SEQ ID NO: 1504322 - protein, 29 aa, Mycobacterium tuberculosis
RPERYDRLAQLRDLVLLLSDSLTPRGVGQ

SEQ ID NO: 1504323 - protein, 27 aa, Mycobacterium tuberculosis
RPERYQFSVTLPRTLPGSGAGIIEKRD

SEQ ID NO: 1504324 - protein, 25 aa, Mycobacterium tuberculosis
RPEVSDGLFLRLAITSVDSLACAYA

SEQ ID NO: 1504325 - protein, 30 aa, Mycobacterium tuberculosis; identical to SEQ ID NO: 215236

SEQ ID NO: 1504326 - protein, 18 aa, Mycobacterium tuberculosis
RPGLARLVAVKRGREAAA

SEQ ID NO: 1504327 - protein, 24 aa, Mycobacterium tuberculosis
RPGQRSFTLDDLSLRYLRRELRAE

SEQ ID NO: 1504328 - protein, 26 aa, Mycobacterium tuberculosis
RPGRDAWEFALLRGALQRGMPVLGIC

SEQ ID NO: 1504329 - protein, 27 aa, Mycobacterium tuberculosis
RPQYRELLQEFLFGLDLDEDTRRRAGI

SEQ ID NO: 1504330 - protein, 23 aa, Mycobacterium tuberculosis
RPRDLRLRVLSWGAAPAPDALLR

SEQ ID NO: 1504331 - protein, 26 aa, Mycobacterium tuberculosis
RPTRPHPLFVAFVGAAIDYKAGELLP

SEQ ID NO: 1504332 - protein, 19 aa, Mycobacterium tuberculosis
RPVFICGPGPFMQAARDAL

SEQ ID NO: 1504333 - protein, 23 aa, Mycobacterium tuberculosis
RQGKTVLFLGRYDEPRKGMAVLL

SEQ ID NO: 1504334 - protein, 17 aa, Mycobacterium tuberculosis
RQLLSGRDFAVGDMFAT

SEQ ID NO: 1504335 - protein, 18 aa, Mycobacterium tuberculosis
RQLPGQVLVLGGGESRDL

SEQ ID NO: 1504336 - protein, 34 aa, Mycobacterium tuberculosis; identical to SEQ ID NO: 222493

SEQ ID NO: 1504337 - protein, 19 aa, Mycobacterium tuberculosis
RQRPEPPSWALRRVEAGPD

SEQ ID NO: 1504338 - protein, 19 aa, Mycobacterium tuberculosis
RQWHDIADARWPSAGNWRY

SEQ ID NO: 1504339 - protein, 24 aa, Mycobacterium tuberculosis
RRGDGWVKLVGDWIDRQIGDLAPL

SEQ ID NO: 1504340 - protein, 23 aa, Mycobacterium tuberculosis
RRLDLNERGTFGHFLNRLRALTH

SEQ ID NO: 1504341 - protein, 25 aa, Mycobacterium tuberculosis
RRLHTWNRIVFPTGAPPAKQRYLVQ

SEQ ID NO: 1504342 - protein, 33 aa, Mycobacterium tuberculosis; identical to SEQ ID NO: 222536

SEQ ID NO: 1504343 - protein, 18 aa, Mycobacterium tuberculosis
RRQQLWLVTITDDTDRVV

SEQ ID NO: 1504344 - protein, 20 aa, Mycobacterium tuberculosis
RRRRREELAALADEVARRVA

SEQ ID NO: 1504345 - protein, 25 aa, Mycobacterium tuberculosis
RRSRGTPRIANRLLRRVRDFAEVRA

SEQ ID NO: 1504346 - protein, 25 aa, Mycobacterium tuberculosis
RRTMARVFPNLFATHRVRAVDDYAS

SEQ ID NO: 1504347 - protein, 18 aa, Mycobacterium tuberculosis
RRYQKLVEEAPAPFLTDF

SEQ ID NO: 1504348 - protein, 23 aa, Mycobacterium tuberculosis
RSADLFLGVPFNIASYALLTHMM

SEQ ID NO: 1504349 - protein, 24 aa, Mycobacterium tuberculosis
RSAVDLALRRLVGEPLGRDEALAL

SEQ ID NO: 1504350 - protein, 31 aa, Mycobacterium tuberculosis; identical to SEQ ID NO: 222573

SEQ ID NO: 1504351 - protein, 19 aa, Mycobacterium tuberculosis
RSENPGLPVLLLTAKDAVE

SEQ ID NO: 1504352 - protein, 26 aa, Mycobacterium tuberculosis
RSGPRLFGALFAPLGWCAKYTPGLFS

SEQ ID NO: 1504353 - protein, 18 aa, Mycobacterium tuberculosis
RSKHDLLFADYDAGLHWF

SEQ ID NO: 1504354 - protein, 17 aa, Mycobacterium tuberculosis
RSLAISQRLLGTREIIL

SEQ ID NO: 1504355 - protein, 28 aa, Mycobacterium tuberculosis
RSMELLDDVILMLRRLHQPVIAAVNGPA

SEQ ID NO: 1504356 - protein, 24 aa, Mycobacterium tuberculosis
RSPHSERLFCIPATIDLAGAEIEL

SEQ ID NO: 1504357 - protein, 20 aa, Mycobacterium tuberculosis
RSRILVQRSVYDRFMELLEP

SEQ ID NO: 1504358 - protein, 21 aa, Mycobacterium tuberculosis
RSTAAAYPNPALRSLDAIHLA

SEQ ID NO: 1504359 - protein, 20 aa, Mycobacterium tuberculosis
RSVGAQWLDLGISASGEGGY

SEQ ID NO: 1504360 - protein, 20 aa, Mycobacterium tuberculosis
RSWDHRKLGLPHMSVGGSTA

SEQ ID NO: 1504361 - protein, 23 aa, Mycobacterium tuberculosis
RSYRYIDYWGTAVTAFDLHAPHT

SEQ ID NO: 1504362 - protein, 19 aa, Mycobacterium tuberculosis
RSYVTALRDLLRALDVSDV
